United States Patent 11,421,016 (CANCER NEOEPITOPES) - sequence listing, part 29

SEQ ID NO: 1289931 - protein, 9 aa, Homo Sapiens
AQGIAQEDK

SEQ ID NO: 1289932 - protein, 9 aa, Homo Sapiens
EDNNLPTNG

SEQ ID NO: 1289933 - protein, 9 aa, Homo Sapiens
GESYSGKAS

SEQ ID NO: 1289934 - protein, 9 aa, Homo Sapiens
LMALKFILA

SEQ ID NO: 1289935 - protein, 9 aa, Homo Sapiens
MVEENTYRQ

SEQ ID NO: 1289936 - protein, 9 aa, Homo Sapiens
IVDYISGCG

SEQ ID NO: 1289937 - protein, 9 aa, Homo Sapiens
MPTICVQNT

SEQ ID NO: 1289938 - protein, 9 aa, Homo Sapiens
KTWGFHNNL

SEQ ID NO: 1289939 - protein, 9 aa, Homo Sapiens
LATMDSQPH

SEQ ID NO: 1289940 - protein, 9 aa, Homo Sapiens
SNNMPTICV

SEQ ID NO: 1289941 - protein, 9 aa, Homo Sapiens
AAPLIKVHS

SEQ ID NO: 1289942 - protein, 9 aa, Homo Sapiens
SVPVPLKEA

SEQ ID NO: 1289943 - protein, 9 aa, Homo Sapiens
NPHGFAFVE

SEQ ID NO: 1289944 - protein, 9 aa, Homo Sapiens
QDSKDSSLF

SEQ ID NO: 1289945 - protein, 9 aa, Homo Sapiens
NCDCCELPT

SEQ ID NO: 1289946 - protein, 9 aa, Homo Sapiens
KEKVDLKMM

SEQ ID NO: 1289947 - protein, 9 aa, Homo Sapiens
GRSFCDKDF

SEQ ID NO: 1289948 - protein, 9 aa, Homo Sapiens
GKTLHTGDR

SEQ ID NO: 1289949 - protein, 9 aa, Homo Sapiens
PHGWVSWAW

SEQ ID NO: 1289950 - protein, 9 aa, Homo Sapiens
QISQTDLFC

SEQ ID NO: 1289951 - protein, 9 aa, Homo Sapiens
TSPQSQLMQ

SEQ ID NO: 1289952 - protein, 9 aa, Homo Sapiens
DTLNATYIV

SEQ ID NO: 1289953 - protein, 9 aa, Homo Sapiens
REKKLLQVV

SEQ ID NO: 1289954 - protein, 9 aa, Homo Sapiens
KEQATFVKR

SEQ ID NO: 1289955 - protein, 9 aa, Homo Sapiens
TINELQQTL

SEQ ID NO: 1289956 - protein, 9 aa, Homo Sapiens
NIILNNRGQ

SEQ ID NO: 1289957 - protein, 9 aa, Homo Sapiens
LLGRKVPLD

SEQ ID NO: 1289958 - protein, 9 aa, Homo Sapiens
QPHQKQPQR

SEQ ID NO: 1289959 - protein, 9 aa, Homo Sapiens
LSATNMKWI

SEQ ID NO: 1289960 - protein, 9 aa, Homo Sapiens
KLEQDENPG

SEQ ID NO: 1289961 - protein, 9 aa, Homo Sapiens
EDQDPPCHR

SEQ ID NO: 1289962 - protein, 9 aa, Homo Sapiens
YPGIQVIFC

SEQ ID NO: 1289963 - protein, 9 aa, Homo Sapiens
HVNGNCTEE

SEQ ID NO: 1289964 - protein, 9 aa, Homo Sapiens
PCHRLSREL

SEQ ID NO: 1289965 - protein, 9 aa, Homo Sapiens
EENTYRQLP

SEQ ID NO: 1289966 - protein, 9 aa, Homo Sapiens
SVCAQNTVI

SEQ ID NO: 1289967 - protein, 9 aa, Homo Sapiens
EYLNKCCHF

SEQ ID NO: 1289968 - protein, 9 aa, Homo Sapiens
GYYRTYGVP

SEQ ID NO: 1289969 - protein, 9 aa, Homo Sapiens
NPKFDEVFY

SEQ ID NO: 1289970 - protein, 9 aa, Homo Sapiens
SHCLSMLGR

SEQ ID NO: 1289971 - protein, 9 aa, Homo Sapiens
EDSKTSTRC

SEQ ID NO: 1289972 - protein, 9 aa, Homo Sapiens
QTENMLASA

SEQ ID NO: 1289973 - protein, 9 aa, Homo Sapiens
CNLLMKDQK

SEQ ID NO: 1289974 - protein, 9 aa, Homo Sapiens
QVVESYTLT

SEQ ID NO: 1289975 - protein, 9 aa, Homo Sapiens
LGSLNLLWQ

SEQ ID NO: 1289976 - protein, 9 aa, Homo Sapiens
EDTDPSVIH

SEQ ID NO: 1289977 - protein, 9 aa, Homo Sapiens
GKELPQTKG

SEQ ID NO: 1289978 - protein, 9 aa, Homo Sapiens
CVMFPGNSP

SEQ ID NO: 1289979 - protein, 9 aa, Homo Sapiens
LYYLWEFYL

SEQ ID NO: 1289980 - protein, 9 aa, Homo Sapiens
NAQGNKTIL

SEQ ID NO: 1289981 - protein, 9 aa, Homo Sapiens
NQQFPNTDI

SEQ ID NO: 1289982 - protein, 9 aa, Homo Sapiens
ALISIIKKG

SEQ ID NO: 1289983 - protein, 9 aa, Homo Sapiens
QILQGLSFI

SEQ ID NO: 1289984 - protein, 9 aa, Homo Sapiens
LSCCVCCFI

SEQ ID NO: 1289985 - protein, 9 aa, Homo Sapiens
DIDENQLKD

SEQ ID NO: 1289986 - protein, 9 aa, Homo Sapiens
SNLTAITIF

SEQ ID NO: 1289987 - protein, 9 aa, Homo Sapiens
FFYSCIVSD

SEQ ID NO: 1289988 - protein, 9 aa, Homo Sapiens
CEVLATPTE

SEQ ID NO: 1289989 - protein, 9 aa, Homo Sapiens
AVNRTVNRE

SEQ ID NO: 1289990 - protein, 9 aa, Homo Sapiens
ELQHSDKHV

SEQ ID NO: 1289991 - protein, 9 aa, Homo Sapiens
PKTPEIFMA

SEQ ID NO: 1289992 - protein, 9 aa, Homo Sapiens
SSSSWLLNK

SEQ ID NO: 1289993 - protein, 9 aa, Homo Sapiens
DSEQEDERC

SEQ ID NO: 1289994 - protein, 9 aa, Homo Sapiens
QETLQQYGV

SEQ ID NO: 1289995 - protein, 9 aa, Homo Sapiens
KFGGPLDQG

SEQ ID NO: 1289996 - protein, 9 aa, Homo Sapiens
DMIDEDDLQ

SEQ ID NO: 1289997 - protein, 9 aa, Homo Sapiens
LKWNFTTPL

SEQ ID NO: 1289998 - protein, 9 aa, Homo Sapiens
ESIVETHDP

SEQ ID NO: 1289999 - protein, 9 aa, Homo Sapiens
YALYLICQR

SEQ ID NO: 1290000 - protein, 9 aa, Homo Sapiens
MLLYPDGKR

SEQ ID NO: 1290001 - protein, 9 aa, Homo Sapiens
DCRKFKLES

SEQ ID NO: 1290002 - protein, 9 aa, Homo Sapiens
DYITKDLKS

SEQ ID NO: 1290003 - protein, 9 aa, Homo Sapiens
ALILCVSPT

SEQ ID NO: 1290004 - protein, 9 aa, Homo Sapiens
HKQKLTEIS

SEQ ID NO: 1290005 - protein, 9 aa, Homo Sapiens
CVCCFITPL

SEQ ID NO: 1290006 - protein, 9 aa, Homo Sapiens
IDAILLSLT

SEQ ID NO: 1290007 - protein, 9 aa, Homo Sapiens
NSETLVLCS

SEQ ID NO: 1290008 - protein, 9 aa, Homo Sapiens
TAAPLIKVH

SEQ ID NO: 1290009 - protein, 9 aa, Homo Sapiens
YNLCHLLSA

SEQ ID NO: 1290010 - protein, 9 aa, Homo Sapiens
DTQNKDINQ

SEQ ID NO: 1290011 - protein, 9 aa, Homo Sapiens
VHSDLEAKV

SEQ ID NO: 1290012 - protein, 9 aa, Homo Sapiens
YKSQMYNLC

SEQ ID NO: 1290013 - protein, 9 aa, Homo Sapiens
SDPEDSKTS

SEQ ID NO: 1290014 - protein, 9 aa, Homo Sapiens
VNFNCSAGT

SEQ ID NO: 1290015 - protein, 9 aa, Homo Sapiens
EPAADKYWS

SEQ ID NO: 1290016 - protein, 9 aa, Homo Sapiens
KILSELFEE

SEQ ID NO: 1290017 - protein, 9 aa, Homo Sapiens
EDIDENQLK

SEQ ID NO: 1290018 - protein, 9 aa, Homo Sapiens
WSHIFCVNR

SEQ ID NO: 1290019 - protein, 9 aa, Homo Sapiens
FFSSTFSDQ

SEQ ID NO: 1290020 - protein, 9 aa, Homo Sapiens
YGCNRVQIQ

SEQ ID NO: 1290021 - protein, 9 aa, Homo Sapiens
LALQTLLTI

SEQ ID NO: 1290022 - protein, 9 aa, Homo Sapiens
DHGLQKSFL

SEQ ID NO: 1290023 - protein, 9 aa, Homo Sapiens
HILDTKQIF

SEQ ID NO: 1290024 - protein, 9 aa, Homo Sapiens
KYWSTFLSS

SEQ ID NO: 1290025 - protein, 9 aa, Homo Sapiens
VNRTIYLID

SEQ ID NO: 1290026 - protein, 9 aa, Homo Sapiens
CQIGSLENH

SEQ ID NO: 1290027 - protein, 9 aa, Homo Sapiens
HNDPYTFLS

SEQ ID NO: 1290028 - protein, 9 aa, Homo Sapiens
ENMQIIQLH

SEQ ID NO: 1290029 - protein, 9 aa, Homo Sapiens
LDVQLCLEY

SEQ ID NO: 1290030 - protein, 9 aa, Homo Sapiens
GFLDVSLDK

SEQ ID NO: 1290031 - protein, 9 aa, Homo Sapiens
MSIALKNIR

SEQ ID NO: 1290032 - protein, 9 aa, Homo Sapiens
RKNKMSIAL

SEQ ID NO: 1290033 - protein, 9 aa, Homo Sapiens
SCFILTDQL

SEQ ID NO: 1290034 - protein, 9 aa, Homo Sapiens
NKRTLTKIK

SEQ ID NO: 1290035 - protein, 9 aa, Homo Sapiens
KKAADIGNP

SEQ ID NO: 1290036 - protein, 9 aa, Homo Sapiens
LEHSEPKRG

SEQ ID NO: 1290037 - protein, 9 aa, Homo Sapiens
NVLDNKKMT

SEQ ID NO: 1290038 - protein, 9 aa, Homo Sapiens
AVDWLGLGV

SEQ ID NO: 1290039 - protein, 9 aa, Homo Sapiens
ERNGGKDNC

SEQ ID NO: 1290040 - protein, 9 aa, Homo Sapiens
YKCEYCLQY

SEQ ID NO: 1290041 - protein, 9 aa, Homo Sapiens
EKAGSCFIL

SEQ ID NO: 1290042 - protein, 9 aa, Homo Sapiens
HRDYGHRTD

SEQ ID NO: 1290043 - protein, 9 aa, Homo Sapiens
PNNSVFPEE

SEQ ID NO: 1290044 - protein, 9 aa, Homo Sapiens
YYYSLDMWS

SEQ ID NO: 1290045 - protein, 9 aa, Homo Sapiens
ALINMKLAL

SEQ ID NO: 1290046 - protein, 9 aa, Homo Sapiens
TMLITLARL

SEQ ID NO: 1290047 - protein, 9 aa, Homo Sapiens
DCIKRIQDD

SEQ ID NO: 1290048 - protein, 9 aa, Homo Sapiens
DKHLVTLIK

SEQ ID NO: 1290049 - protein, 9 aa, Homo Sapiens
MFDIHKNSI

SEQ ID NO: 1290050 - protein, 9 aa, Homo Sapiens
PDDKHLVTL

SEQ ID NO: 1290051 - protein, 9 aa, Homo Sapiens
GLIDNPNIV

SEQ ID NO: 1290052 - protein, 9 aa, Homo Sapiens
QHSDKHVGT

SEQ ID NO: 1290053 - protein, 9 aa, Homo Sapiens
TVCMNVLRE

SEQ ID NO: 1290054 - protein, 9 aa, Homo Sapiens
CSQKRFPSN

SEQ ID NO: 1290055 - protein, 9 aa, Homo Sapiens
MLHTVTLCC

SEQ ID NO: 1290056 - protein, 9 aa, Homo Sapiens
DQELQLPLH

SEQ ID NO: 1290057 - protein, 9 aa, Homo Sapiens
MHLLSQEVV

SEQ ID NO: 1290058 - protein, 9 aa, Homo Sapiens
QIIQLHVLN

SEQ ID NO: 1290059 - protein, 9 aa, Homo Sapiens
LPKTPLCAP

SEQ ID NO: 1290060 - protein, 9 aa, Homo Sapiens
DSSGMSAVG

SEQ ID NO: 1290061 - protein, 9 aa, Homo Sapiens
NQTENMLAS

SEQ ID NO: 1290062 - protein, 9 aa, Homo Sapiens
WIHDIRHFS

SEQ ID NO: 1290063 - protein, 9 aa, Homo Sapiens
VPKSLNYSC

SEQ ID NO: 1290064 - protein, 9 aa, Homo Sapiens
NHHSTQHKR

SEQ ID NO: 1290065 - protein, 9 aa, Homo Sapiens
LDEDIYDEN

SEQ ID NO: 1290066 - protein, 9 aa, Homo Sapiens
PYKGGNTMK

SEQ ID NO: 1290067 - protein, 9 aa, Homo Sapiens
FVQSSSPGN

SEQ ID NO: 1290068 - protein, 9 aa, Homo Sapiens
MSVSGSPSQ

SEQ ID NO: 1290069 - protein, 9 aa, Homo Sapiens
QEQVVESYT

SEQ ID NO: 1290070 - protein, 9 aa, Homo Sapiens
DVWMFCVCM

SEQ ID NO: 1290071 - protein, 9 aa, Homo Sapiens
YRSLLETDH

SEQ ID NO: 1290072 - protein, 9 aa, Homo Sapiens
PCAVGEPGA

SEQ ID NO: 1290073 - protein, 9 aa, Homo Sapiens
TGEQFVCLM

SEQ ID NO: 1290074 - protein, 9 aa, Homo Sapiens
SGSTYILVT

SEQ ID NO: 1290075 - protein, 9 aa, Homo Sapiens
IPQLRVSYV

SEQ ID NO: 1290076 - protein, 9 aa, Homo Sapiens
YSSKSPAPV

SEQ ID NO: 1290077 - protein, 9 aa, Homo Sapiens
EDERCAQDM

SEQ ID NO: 1290078 - protein, 9 aa, Homo Sapiens
DIYDENFPN

SEQ ID NO: 1290079 - protein, 9 aa, Homo Sapiens
PQHNKQLLL

SEQ ID NO: 1290080 - protein, 9 aa, Homo Sapiens
GQLVCAKKP

SEQ ID NO: 1290081 - protein, 9 aa, Homo Sapiens
NPEGEDPEM

SEQ ID NO: 1290082 - protein, 9 aa, Homo Sapiens
NVLREVKVL

SEQ ID NO: 1290083 - protein, 9 aa, Homo Sapiens
TPQHVFVKC

SEQ ID NO: 1290084 - protein, 9 aa, Homo Sapiens
FGGHRDYGH

SEQ ID NO: 1290085 - protein, 9 aa, Homo Sapiens
LVSYQLLEA

SEQ ID NO: 1290086 - protein, 9 aa, Homo Sapiens
YYTAGSSSV

SEQ ID NO: 1290087 - protein, 9 aa, Homo Sapiens
QDCERRWRN

SEQ ID NO: 1290088 - protein, 9 aa, Homo Sapiens
FKLGFLNML

SEQ ID NO: 1290089 - protein, 9 aa, Homo Sapiens
TMKKEKQQK

SEQ ID NO: 1290090 - protein, 9 aa, Homo Sapiens
PPEIYMTLM

SEQ ID NO: 1290091 - protein, 9 aa, Homo Sapiens
TMLGQDWLV

SEQ ID NO: 1290092 - protein, 9 aa, Homo Sapiens
TQFAPHAKQ

SEQ ID NO: 1290093 - protein, 9 aa, Homo Sapiens
NEISYELKC

SEQ ID NO: 1290094 - protein, 9 aa, Homo Sapiens
PPCHRLSRE

SEQ ID NO: 1290095 - protein, 9 aa, Homo Sapiens
EEISCYTEN

SEQ ID NO: 1290096 - protein, 9 aa, Homo Sapiens
ISSASSQVP

SEQ ID NO: 1290097 - protein, 9 aa, Homo Sapiens
KTLYFFSLA

SEQ ID NO: 1290098 - protein, 9 aa, Homo Sapiens
HKQLIPLVE

SEQ ID NO: 1290099 - protein, 9 aa, Homo Sapiens
DTDPSVIHP

SEQ ID NO: 1290100 - protein, 9 aa, Homo Sapiens
FVVLARSAM

SEQ ID NO: 1290101 - protein, 9 aa, Homo Sapiens
KEKQQKMAI

SEQ ID NO: 1290102 - protein, 9 aa, Homo Sapiens
CNTQLGKRK

SEQ ID NO: 1290103 - protein, 9 aa, Homo Sapiens
GYGIPHSFE

SEQ ID NO: 1290104 - protein, 9 aa, Homo Sapiens
PRKLKTCGN

SEQ ID NO: 1290105 - protein, 9 aa, Homo Sapiens
AALQDTQNK

SEQ ID NO: 1290106 - protein, 9 aa, Homo Sapiens
RSAALHSTQ

SEQ ID NO: 1290107 - protein, 9 aa, Homo Sapiens
QQSENDKLQ

SEQ ID NO: 1290108 - protein, 9 aa, Homo Sapiens
ELDQNEENI

SEQ ID NO: 1290109 - protein, 9 aa, Homo Sapiens
FCILLIIAS

SEQ ID NO: 1290110 - protein, 9 aa, Homo Sapiens
GNDELEHSE

SEQ ID NO: 1290111 - protein, 9 aa, Homo Sapiens
PVICSNFAE

SEQ ID NO: 1290112 - protein, 9 aa, Homo Sapiens
NRMNCVMFP

SEQ ID NO: 1290113 - protein, 9 aa, Homo Sapiens
VLLEHTFSA

SEQ ID NO: 1290114 - protein, 9 aa, Homo Sapiens
ATQQSENDK

SEQ ID NO: 1290115 - protein, 9 aa, Homo Sapiens
PLKNVCCLI

SEQ ID NO: 1290116 - protein, 9 aa, Homo Sapiens
SNIPDDAQG

SEQ ID NO: 1290117 - protein, 9 aa, Homo Sapiens
GLIHAFGGM

SEQ ID NO: 1290118 - protein, 9 aa, Homo Sapiens
LKTLCQETL

SEQ ID NO: 1290119 - protein, 9 aa, Homo Sapiens
GVDINTLQD

SEQ ID NO: 1290120 - protein, 9 aa, Homo Sapiens
IQHGIHDVL

SEQ ID NO: 1290121 - protein, 9 aa, Homo Sapiens
KIVVSIAED

SEQ ID NO: 1290122 - protein, 9 aa, Homo Sapiens
WVTKTRIML

SEQ ID NO: 1290123 - protein, 9 aa, Homo Sapiens
GSITCNVTS

SEQ ID NO: 1290124 - protein, 9 aa, Homo Sapiens
VKAFEKFHT

SEQ ID NO: 1290125 - protein, 9 aa, Homo Sapiens
TIIFTDSSG

SEQ ID NO: 1290126 - protein, 9 aa, Homo Sapiens
CSGFVPSFQ

SEQ ID NO: 1290127 - protein, 9 aa, Homo Sapiens
FSHMNNIMS

SEQ ID NO: 1290128 - protein, 9 aa, Homo Sapiens
INEDNNTRV

SEQ ID NO: 1290129 - protein, 9 aa, Homo Sapiens
TESLLWSTS

SEQ ID NO: 1290130 - protein, 9 aa, Homo Sapiens
HTIEIARQL

SEQ ID NO: 1290131 - protein, 9 aa, Homo Sapiens
QQQETHTCE

SEQ ID NO: 1290132 - protein, 9 aa, Homo Sapiens
FNKFGGPLD

SEQ ID NO: 1290133 - protein, 9 aa, Homo Sapiens
GVINDCRKF

SEQ ID NO: 1290134 - protein, 9 aa, Homo Sapiens
VARNPHGFA

SEQ ID NO: 1290135 - protein, 9 aa, Homo Sapiens
HLVQMPEDY

SEQ ID NO: 1290136 - protein, 9 aa, Homo Sapiens
CHKWPNPDS

SEQ ID NO: 1290137 - protein, 9 aa, Homo Sapiens
DFPLRQNND

SEQ ID NO: 1290138 - protein, 9 aa, Homo Sapiens
GQSNLKSNI

SEQ ID NO: 1290139 - protein, 9 aa, Homo Sapiens
KEGLTLNRK

SEQ ID NO: 1290140 - protein, 9 aa, Homo Sapiens
PGIPGQPGY

SEQ ID NO: 1290141 - protein, 9 aa, Homo Sapiens
HRVCWMIIA

SEQ ID NO: 1290142 - protein, 9 aa, Homo Sapiens
TKANSTSIL

SEQ ID NO: 1290143 - protein, 9 aa, Homo Sapiens
GGWTSTLKV

SEQ ID NO: 1290144 - protein, 9 aa, Homo Sapiens
IKINFKFTN

SEQ ID NO: 1290145 - protein, 9 aa, Homo Sapiens
VMNWDVQCY

SEQ ID NO: 1290146 - protein, 9 aa, Homo Sapiens
VSRCNLEKE

SEQ ID NO: 1290147 - protein, 9 aa, Homo Sapiens
HARKHIFPV

SEQ ID NO: 1290148 - protein, 9 aa, Homo Sapiens
FFLEEIQLC

SEQ ID NO: 1290149 - protein, 9 aa, Homo Sapiens
IQDHTLPLT

SEQ ID NO: 1290150 - protein, 9 aa, Homo Sapiens
YSKMLLFPY

SEQ ID NO: 1290151 - protein, 9 aa, Homo Sapiens
KMTALIKAV

SEQ ID NO: 1290152 - protein, 9 aa, Homo Sapiens
LLWQEVCKQ

SEQ ID NO: 1290153 - protein, 9 aa, Homo Sapiens
QHSISMHAM

SEQ ID NO: 1290154 - protein, 9 aa, Homo Sapiens
QEASYKAFG

SEQ ID NO: 1290155 - protein, 9 aa, Homo Sapiens
DFDGKDVAT

SEQ ID NO: 1290156 - protein, 9 aa, Homo Sapiens
LQNAHKQKL

SEQ ID NO: 1290157 - protein, 9 aa, Homo Sapiens
HTAGRLTLT

SEQ ID NO: 1290158 - protein, 9 aa, Homo Sapiens
GWGATVIVD

SEQ ID NO: 1290159 - protein, 9 aa, Homo Sapiens
RSEIPIKME

SEQ ID NO: 1290160 - protein, 9 aa, Homo Sapiens
LETSLFKTR

SEQ ID NO: 1290161 - protein, 9 aa, Homo Sapiens
TQAIPFDNP

SEQ ID NO: 1290162 - protein, 9 aa, Homo Sapiens
SCQFCDVRL

SEQ ID NO: 1290163 - protein, 9 aa, Homo Sapiens
LYKFFCGFS

SEQ ID NO: 1290164 - protein, 9 aa, Homo Sapiens
QRNLDKTCC

SEQ ID NO: 1290165 - protein, 9 aa, Homo Sapiens
LAATNRPDM

SEQ ID NO: 1290166 - protein, 9 aa, Homo Sapiens
GTFVGRIVQ

SEQ ID NO: 1290167 - protein, 9 aa, Homo Sapiens
QDDLPGLAH

SEQ ID NO: 1290168 - protein, 9 aa, Homo Sapiens
MKLFYYYEV

SEQ ID NO: 1290169 - protein, 9 aa, Homo Sapiens
MSSKEIYYD

SEQ ID NO: 1290170 - protein, 9 aa, Homo Sapiens
KNGVLDFFF

SEQ ID NO: 1290171 - protein, 9 aa, Homo Sapiens
ITELQLHIR

SEQ ID NO: 1290172 - protein, 9 aa, Homo Sapiens
PFCDRCGKL

SEQ ID NO: 1290173 - protein, 9 aa, Homo Sapiens
YQQKLEQDE

SEQ ID NO: 1290174 - protein, 9 aa, Homo Sapiens
CYNYFYLFK

SEQ ID NO: 1290175 - protein, 9 aa, Homo Sapiens
LRRVEHING

SEQ ID NO: 1290176 - protein, 9 aa, Homo Sapiens
LCMFDLNFS

SEQ ID NO: 1290177 - protein, 9 aa, Homo Sapiens
MFRSEEEHL

SEQ ID NO: 1290178 - protein, 9 aa, Homo Sapiens
PESAIQDAI

SEQ ID NO: 1290179 - protein, 9 aa, Homo Sapiens
VQLIVNDGI

SEQ ID NO: 1290180 - protein, 9 aa, Homo Sapiens
KQTTLWFLI

SEQ ID NO: 1290181 - protein, 9 aa, Homo Sapiens
HVSRQTSGF

SEQ ID NO: 1290182 - protein, 9 aa, Homo Sapiens
EILHHLVQM

SEQ ID NO: 1290183 - protein, 9 aa, Homo Sapiens
NHSHSHEEP

SEQ ID NO: 1290184 - protein, 9 aa, Homo Sapiens
MFNFYPKWT

SEQ ID NO: 1290185 - protein, 9 aa, Homo Sapiens
YSGIRVIPD

SEQ ID NO: 1290186 - protein, 9 aa, Homo Sapiens
GIIGPSNNG

SEQ ID NO: 1290187 - protein, 9 aa, Homo Sapiens
GSTTQKVKK

SEQ ID NO: 1290188 - protein, 9 aa, Homo Sapiens
QLRYIILTH

SEQ ID NO: 1290189 - protein, 9 aa, Homo Sapiens
FLDFKLVPH

SEQ ID NO: 1290190 - protein, 9 aa, Homo Sapiens
QLGLLSFFL

SEQ ID NO: 1290191 - protein, 9 aa, Homo Sapiens
PTGTDTRIL

SEQ ID NO: 1290192 - protein, 9 aa, Homo Sapiens
WGATVIVDA

SEQ ID NO: 1290193 - protein, 9 aa, Homo Sapiens
KYDLRYRKR

SEQ ID NO: 1290194 - protein, 9 aa, Homo Sapiens
KRDLEDLGL

SEQ ID NO: 1290195 - protein, 9 aa, Homo Sapiens
AFGGMANAN

SEQ ID NO: 1290196 - protein, 9 aa, Homo Sapiens
LIKTENNVL

SEQ ID NO: 1290197 - protein, 9 aa, Homo Sapiens
TNSSWTQDL

SEQ ID NO: 1290198 - protein, 9 aa, Homo Sapiens
MIDKALMRP

SEQ ID NO: 1290199 - protein, 9 aa, Homo Sapiens
LMLCVTSAL

SEQ ID NO: 1290200 - protein, 9 aa, Homo Sapiens
INNSDAKNN

SEQ ID NO: 1290201 - protein, 9 aa, Homo Sapiens
KSNYVCATF

SEQ ID NO: 1290202 - protein, 9 aa, Homo Sapiens
KSKCKSINE

SEQ ID NO: 1290203 - protein, 9 aa, Homo Sapiens
RRQDIVLSW

SEQ ID NO: 1290204 - protein, 9 aa, Homo Sapiens
ISETSIFDV

SEQ ID NO: 1290205 - protein, 9 aa, Homo Sapiens
CDVVMVNYN

SEQ ID NO: 1290206 - protein, 9 aa, Homo Sapiens
IENLKKQHY

SEQ ID NO: 1290207 - protein, 9 aa, Homo Sapiens
ELPWPPVVK

SEQ ID NO: 1290208 - protein, 9 aa, Homo Sapiens
SPENILDND

SEQ ID NO: 1290209 - protein, 9 aa, Homo Sapiens
CHEELKEIG

SEQ ID NO: 1290210 - protein, 9 aa, Homo Sapiens
KLVVFVFEV

SEQ ID NO: 1290211 - protein, 9 aa, Homo Sapiens
DREPHEELV

SEQ ID NO: 1290212 - protein, 9 aa, Homo Sapiens
ISFLQVQLN

SEQ ID NO: 1290213 - protein, 9 aa, Homo Sapiens
ALQMSNLKK

SEQ ID NO: 1290214 - protein, 9 aa, Homo Sapiens
MKESSTSGS

SEQ ID NO: 1290215 - protein, 9 aa, Homo Sapiens
NHCPDPSCK

SEQ ID NO: 1290216 - protein, 9 aa, Homo Sapiens
VNKCLQEDW

SEQ ID NO: 1290217 - protein, 9 aa, Homo Sapiens
LDIQTGTTP

SEQ ID NO: 1290218 - protein, 9 aa, Homo Sapiens
HLKMEPQSP

SEQ ID NO: 1290219 - protein, 9 aa, Homo Sapiens
QGLFVRYLS

SEQ ID NO: 1290220 - protein, 9 aa, Homo Sapiens
DSFRFEKRN

SEQ ID NO: 1290221 - protein, 9 aa, Homo Sapiens
CAQCSTDFT

SEQ ID NO: 1290222 - protein, 9 aa, Homo Sapiens
TLHTIEIAR

SEQ ID NO: 1290223 - protein, 9 aa, Homo Sapiens
LCQFTTLCG

SEQ ID NO: 1290224 - protein, 9 aa, Homo Sapiens
PKNVNIKKD

SEQ ID NO: 1290225 - protein, 9 aa, Homo Sapiens
AHVCVLLQH

SEQ ID NO: 1290226 - protein, 9 aa, Homo Sapiens
PIGDYTSRA

SEQ ID NO: 1290227 - protein, 9 aa, Homo Sapiens
NTAVKNSYY

SEQ ID NO: 1290228 - protein, 9 aa, Homo Sapiens
STDRNYIIK

SEQ ID NO: 1290229 - protein, 9 aa, Homo Sapiens
NKLLILCVC

SEQ ID NO: 1290230 - protein, 9 aa, Homo Sapiens
ICPDYCHNM

SEQ ID NO: 1290231 - protein, 9 aa, Homo Sapiens
YMGSVQRDL

SEQ ID NO: 1290232 - protein, 9 aa, Homo Sapiens
NLQILQPEK

SEQ ID NO: 1290233 - protein, 9 aa, Homo Sapiens
STFDYITKD

SEQ ID NO: 1290234 - protein, 9 aa, Homo Sapiens
CSNIILNNR

SEQ ID NO: 1290235 - protein, 9 aa, Homo Sapiens
TKLITDDKE

SEQ ID NO: 1290236 - protein, 9 aa, Homo Sapiens
IRLLLYNFK

SEQ ID NO: 1290237 - protein, 9 aa, Homo Sapiens
LPLSILTKK

SEQ ID NO: 1290238 - protein, 9 aa, Homo Sapiens
YDENFPNSK

SEQ ID NO: 1290239 - protein, 9 aa, Homo Sapiens
SSQTTLLAT

SEQ ID NO: 1290240 - protein, 9 aa, Homo Sapiens
FECEACTQY

SEQ ID NO: 1290241 - protein, 9 aa, Homo Sapiens
PVEHSAPKL

SEQ ID NO: 1290242 - protein, 9 aa, Homo Sapiens
KKALEFQDI

SEQ ID NO: 1290243 - protein, 9 aa, Homo Sapiens
KEISAILGG

SEQ ID NO: 1290244 - protein, 9 aa, Homo Sapiens
NKDFGTFER

SEQ ID NO: 1290245 - protein, 9 aa, Homo Sapiens
NEKSYASII

SEQ ID NO: 1290246 - protein, 9 aa, Homo Sapiens
NSSCLNMTD

SEQ ID NO: 1290247 - protein, 9 aa, Homo Sapiens
DLEMLKVSS

SEQ ID NO: 1290248 - protein, 9 aa, Homo Sapiens
CTAQGLKGY

SEQ ID NO: 1290249 - protein, 9 aa, Homo Sapiens
SGTPSPTLC

SEQ ID NO: 1290250 - protein, 9 aa, Homo Sapiens
ATSPQSQLM

SEQ ID NO: 1290251 - protein, 9 aa, Homo Sapiens
SLFHSDLIE

SEQ ID NO: 1290252 - protein, 9 aa, Homo Sapiens
YYDSFIRPV

SEQ ID NO: 1290253 - protein, 9 aa, Homo Sapiens
HERTVWKYF

SEQ ID NO: 1290254 - protein, 9 aa, Homo Sapiens
IMLQYDAVV

SEQ ID NO: 1290255 - protein, 9 aa, Homo Sapiens
IDYEGRYDG

SEQ ID NO: 1290256 - protein, 9 aa, Homo Sapiens
QGENLLSWM

SEQ ID NO: 1290257 - protein, 9 aa, Homo Sapiens
SQLEISTKM

SEQ ID NO: 1290258 - protein, 9 aa, Homo Sapiens
LRNSASWVL

SEQ ID NO: 1290259 - protein, 9 aa, Homo Sapiens
GSESAEQSE

SEQ ID NO: 1290260 - protein, 9 aa, Homo Sapiens
NKNGVLDFF

SEQ ID NO: 1290261 - protein, 9 aa, Homo Sapiens
LTLYLTCNT

SEQ ID NO: 1290262 - protein, 9 aa, Homo Sapiens
CASAVFFCI

SEQ ID NO: 1290263 - protein, 9 aa, Homo Sapiens
SVFPEELGT

SEQ ID NO: 1290264 - protein, 9 aa, Homo Sapiens
LARQIANHC

SEQ ID NO: 1290265 - protein, 9 aa, Homo Sapiens
SSGHKRFNK

SEQ ID NO: 1290266 - protein, 9 aa, Homo Sapiens
GSHGKLKVL

SEQ ID NO: 1290267 - protein, 9 aa, Homo Sapiens
PNNFIIGTD

SEQ ID NO: 1290268 - protein, 9 aa, Homo Sapiens
NFIDCLVIE

SEQ ID NO: 1290269 - protein, 9 aa, Homo Sapiens
RGPEVQTDP

SEQ ID NO: 1290270 - protein, 9 aa, Homo Sapiens
LESTESLLW

SEQ ID NO: 1290271 - protein, 9 aa, Homo Sapiens
HVIEDSDRK

SEQ ID NO: 1290272 - protein, 9 aa, Homo Sapiens
GHSKAVSYA

SEQ ID NO: 1290273 - protein, 9 aa, Homo Sapiens
QGPWQRTWK

SEQ ID NO: 1290274 - protein, 9 aa, Homo Sapiens
NKKLFNYLF

SEQ ID NO: 1290275 - protein, 9 aa, Homo Sapiens
FEVHTTGVY

SEQ ID NO: 1290276 - protein, 9 aa, Homo Sapiens
YLGLCMFDL

SEQ ID NO: 1290277 - protein, 9 aa, Homo Sapiens
LPPINGQVD

SEQ ID NO: 1290278 - protein, 9 aa, Homo Sapiens
PIQLYSSYW

SEQ ID NO: 1290279 - protein, 9 aa, Homo Sapiens
HQSHHTPLE

SEQ ID NO: 1290280 - protein, 9 aa, Homo Sapiens
RLQCVLEGT

SEQ ID NO: 1290281 - protein, 9 aa, Homo Sapiens
HLFKEVRCM

SEQ ID NO: 1290282 - protein, 9 aa, Homo Sapiens
ATQCTLLCT

SEQ ID NO: 1290283 - protein, 9 aa, Homo Sapiens
KEKETFKAE

SEQ ID NO: 1290284 - protein, 9 aa, Homo Sapiens
HILYTEESN

SEQ ID NO: 1290285 - protein, 9 aa, Homo Sapiens
PNNNLHEGT

SEQ ID NO: 1290286 - protein, 9 aa, Homo Sapiens
FENLVQRME

SEQ ID NO: 1290287 - protein, 9 aa, Homo Sapiens
LKVHHLKKY

SEQ ID NO: 1290288 - protein, 9 aa, Homo Sapiens
GLPHCAVRN

SEQ ID NO: 1290289 - protein, 9 aa, Homo Sapiens
LGDLIEHLV

SEQ ID NO: 1290290 - protein, 9 aa, Homo Sapiens
VTELKLNPN

SEQ ID NO: 1290291 - protein, 9 aa, Homo Sapiens
RDYGHRTDA

SEQ ID NO: 1290292 - protein, 9 aa, Homo Sapiens
KASPPQQKD

SEQ ID NO: 1290293 - protein, 9 aa, Homo Sapiens
GFDQDDNEA

SEQ ID NO: 1290294 - protein, 9 aa, Homo Sapiens
VIAGRGINS

SEQ ID NO: 1290295 - protein, 9 aa, Homo Sapiens
LDNLLNYNN

SEQ ID NO: 1290296 - protein, 9 aa, Homo Sapiens
PPSKNQKIL

SEQ ID NO: 1290297 - protein, 9 aa, Homo Sapiens
GTPQGENLL

SEQ ID NO: 1290298 - protein, 9 aa, Homo Sapiens
MHAMRNSPT

SEQ ID NO: 1290299 - protein, 9 aa, Homo Sapiens
TSLHFVDFL

SEQ ID NO: 1290300 - protein, 9 aa, Homo Sapiens
LLRDERKNQ

SEQ ID NO: 1290301 - protein, 9 aa, Homo Sapiens
CSIENVFLC

SEQ ID NO: 1290302 - protein, 9 aa, Homo Sapiens
TYVCAVFNG

SEQ ID NO: 1290303 - protein, 9 aa, Homo Sapiens
CTFEEASYP

SEQ ID NO: 1290304 - protein, 9 aa, Homo Sapiens
KKEMHLLSQ

SEQ ID NO: 1290305 - protein, 9 aa, Homo Sapiens
PTSCDEYSR

SEQ ID NO: 1290306 - protein, 9 aa, Homo Sapiens
MSHRVCWMI

SEQ ID NO: 1290307 - protein, 9 aa, Homo Sapiens
FENPALLEL

SEQ ID NO: 1290308 - protein, 9 aa, Homo Sapiens
GQDLIHVAV

SEQ ID NO: 1290309 - protein, 9 aa, Homo Sapiens
TPLDEYIEQ

SEQ ID NO: 1290310 - protein, 9 aa, Homo Sapiens
WTSTLKVTP

SEQ ID NO: 1290311 - protein, 9 aa, Homo Sapiens
NAHLHTLVM

SEQ ID NO: 1290312 - protein, 9 aa, Homo Sapiens
PKEVCAECN

SEQ ID NO: 1290313 - protein, 9 aa, Homo Sapiens
RDVSNICAH

SEQ ID NO: 1290314 - protein, 9 aa, Homo Sapiens
ENLQKLIIS

SEQ ID NO: 1290315 - protein, 9 aa, Homo Sapiens
YDSFIRPVT

SEQ ID NO: 1290316 - protein, 9 aa, Homo Sapiens
CNVLQRIKG

SEQ ID NO: 1290317 - protein, 9 aa, Homo Sapiens
SDNLMQIQK

SEQ ID NO: 1290318 - protein, 9 aa, Homo Sapiens
MRKNQTTKR

SEQ ID NO: 1290319 - protein, 9 aa, Homo Sapiens
MENKALQEA

SEQ ID NO: 1290320 - protein, 9 aa, Homo Sapiens
GRREPWLLQ

SEQ ID NO: 1290321 - protein, 9 aa, Homo Sapiens
DYLSHINED

SEQ ID NO: 1290322 - protein, 9 aa, Homo Sapiens
RVQEKTALQ

SEQ ID NO: 1290323 - protein, 9 aa, Homo Sapiens
IECKNKSYS

SEQ ID NO: 1290324 - protein, 9 aa, Homo Sapiens
CGRTAFFSW

SEQ ID NO: 1290325 - protein, 9 aa, Homo Sapiens
CTPDSLHKA

SEQ ID NO: 1290326 - protein, 9 aa, Homo Sapiens
EQVTGRSFC

SEQ ID NO: 1290327 - protein, 9 aa, Homo Sapiens
QRSKTADVT

SEQ ID NO: 1290328 - protein, 9 aa, Homo Sapiens
KALQEAKQM

SEQ ID NO: 1290329 - protein, 9 aa, Homo Sapiens
FFVNLKSMS

SEQ ID NO: 1290330 - protein, 9 aa, Homo Sapiens
EDHTAALTN

SEQ ID NO: 1290331 - protein, 9 aa, Homo Sapiens
KPPAQPSWL

SEQ ID NO: 1290332 - protein, 9 aa, Homo Sapiens
GVTIPNQRR

SEQ ID NO: 1290333 - protein, 9 aa, Homo Sapiens
KKLLQVVFR

SEQ ID NO: 1290334 - protein, 9 aa, Homo Sapiens
SNLTQQQKI

SEQ ID NO: 1290335 - protein, 9 aa, Homo Sapiens
HWDRKQMLA

SEQ ID NO: 1290336 - protein, 9 aa, Homo Sapiens
SQVSKHHRT

SEQ ID NO: 1290337 - protein, 9 aa, Homo Sapiens
TAHRITAKE

SEQ ID NO: 1290338 - protein, 9 aa, Homo Sapiens
LNEQSHTRC

SEQ ID NO: 1290339 - protein, 9 aa, Homo Sapiens
STFSDQSTT

SEQ ID NO: 1290340 - protein, 9 aa, Homo Sapiens
LEISQTLFG

SEQ ID NO: 1290341 - protein, 9 aa, Homo Sapiens
MKLDNVLLD

SEQ ID NO: 1290342 - protein, 9 aa, Homo Sapiens
DPNNNLHEG

SEQ ID NO: 1290343 - protein, 9 aa, Homo Sapiens
QGNLEDPAI

SEQ ID NO: 1290344 - protein, 9 aa, Homo Sapiens
IAMLVVLYK

SEQ ID NO: 1290345 - protein, 9 aa, Homo Sapiens
GGNTMKGDA

SEQ ID NO: 1290346 - protein, 9 aa, Homo Sapiens
ICTSIPGYG

SEQ ID NO: 1290347 - protein, 9 aa, Homo Sapiens
LSVQILGKA

SEQ ID NO: 1290348 - protein, 9 aa, Homo Sapiens
KAITLDMDG

SEQ ID NO: 1290349 - protein, 9 aa, Homo Sapiens
CDSSTDGSC

SEQ ID NO: 1290350 - protein, 9 aa, Homo Sapiens
IIDLLSCTG

SEQ ID NO: 1290351 - protein, 9 aa, Homo Sapiens
MLMEACLCG

SEQ ID NO: 1290352 - protein, 9 aa, Homo Sapiens
RREPWLLQS

SEQ ID NO: 1290353 - protein, 9 aa, Homo Sapiens
RPISLFHSD

SEQ ID NO: 1290354 - protein, 9 aa, Homo Sapiens
IEICYNYFY

SEQ ID NO: 1290355 - protein, 9 aa, Homo Sapiens
GAWIAIFCC

SEQ ID NO: 1290356 - protein, 9 aa, Homo Sapiens
IKVTVLGYG

SEQ ID NO: 1290357 - protein, 9 aa, Homo Sapiens
RRNEPPQPR

SEQ ID NO: 1290358 - protein, 9 aa, Homo Sapiens
FLIKEISAI

SEQ ID NO: 1290359 - protein, 9 aa, Homo Sapiens
GMAYFVLSL

SEQ ID NO: 1290360 - protein, 9 aa, Homo Sapiens
HEQDGLAVL

SEQ ID NO: 1290361 - protein, 9 aa, Homo Sapiens
QSSGYGQHV

SEQ ID NO: 1290362 - protein, 9 aa, Homo Sapiens
PPVICSNFA

SEQ ID NO: 1290363 - protein, 9 aa, Homo Sapiens
QAIPFDNPR

SEQ ID NO: 1290364 - protein, 9 aa, Homo Sapiens
QECAGIQGV

SEQ ID NO: 1290365 - protein, 9 aa, Homo Sapiens
ILCVSPTAN

SEQ ID NO: 1290366 - protein, 9 aa, Homo Sapiens
LQVQLNDLD

SEQ ID NO: 1290367 - protein, 9 aa, Homo Sapiens
KYKDDFSTT

SEQ ID NO: 1290368 - protein, 9 aa, Homo Sapiens
TVSTDTRDL

SEQ ID NO: 1290369 - protein, 9 aa, Homo Sapiens
TILLKENFT

SEQ ID NO: 1290370 - protein, 9 aa, Homo Sapiens
VNRVNKCLQ

SEQ ID NO: 1290371 - protein, 9 aa, Homo Sapiens
YGVFTTTIS

SEQ ID NO: 1290372 - protein, 9 aa, Homo Sapiens
SEEWTEAIQ

SEQ ID NO: 1290373 - protein, 9 aa, Homo Sapiens
CATFQGKMC

SEQ ID NO: 1290374 - protein, 9 aa, Homo Sapiens
RFDLPEVIN

SEQ ID NO: 1290375 - protein, 9 aa, Homo Sapiens
PLAYTVTIN

SEQ ID NO: 1290376 - protein, 9 aa, Homo Sapiens
PDMIDKALM

SEQ ID NO: 1290377 - protein, 9 aa, Homo Sapiens
ISGDSSSEH

SEQ ID NO: 1290378 - protein, 9 aa, Homo Sapiens
DSRRNEPPQ

SEQ ID NO: 1290379 - protein, 9 aa, Homo Sapiens
SLCDDYPGS

SEQ ID NO: 1290380 - protein, 9 aa, Homo Sapiens
EMHLLSQEV

SEQ ID NO: 1290381 - protein, 9 aa, Homo Sapiens
GNTCTQTNG

SEQ ID NO: 1290382 - protein, 9 aa, Homo Sapiens
LYAVCTIGG

SEQ ID NO: 1290383 - protein, 9 aa, Homo Sapiens
VVFVFEVTE

SEQ ID NO: 1290384 - protein, 9 aa, Homo Sapiens
WMAHEVMEQ

SEQ ID NO: 1290385 - protein, 9 aa, Homo Sapiens
LPMNVLKFS

SEQ ID NO: 1290386 - protein, 9 aa, Homo Sapiens
SHMNNIMSK

SEQ ID NO: 1290387 - protein, 9 aa, Homo Sapiens
NEDNQECAG

SEQ ID NO: 1290388 - protein, 9 aa, Homo Sapiens
SNSSCLNMT

SEQ ID NO: 1290389 - protein, 9 aa, Homo Sapiens
FNIALLHVW

SEQ ID NO: 1290390 - protein, 9 aa, Homo Sapiens
TLLVNTTSF

SEQ ID NO: 1290391 - protein, 9 aa, Homo Sapiens
DERMTVDFM

SEQ ID NO: 1290392 - protein, 9 aa, Homo Sapiens
ISLLISDTK

SEQ ID NO: 1290393 - protein, 9 aa, Homo Sapiens
LSLYPVFTS

SEQ ID NO: 1290394 - protein, 9 aa, Homo Sapiens
ITCNVTSSS

SEQ ID NO: 1290395 - protein, 9 aa, Homo Sapiens
HSFENNQQP

SEQ ID NO: 1290396 - protein, 9 aa, Homo Sapiens
IGLTQFELT

SEQ ID NO: 1290397 - protein, 9 aa, Homo Sapiens
LYYKIVIQL

SEQ ID NO: 1290398 - protein, 9 aa, Homo Sapiens
SNNTLAEMS

SEQ ID NO: 1290399 - protein, 9 aa, Homo Sapiens
KVTLSTDKK

SEQ ID NO: 1290400 - protein, 9 aa, Homo Sapiens
IDVNMCCPK

SEQ ID NO: 1290401 - protein, 9 aa, Homo Sapiens
QSAVKIPGF

SEQ ID NO: 1290402 - protein, 9 aa, Homo Sapiens
CIVSDVHVT

SEQ ID NO: 1290403 - protein, 9 aa, Homo Sapiens
TYECRKKLL

SEQ ID NO: 1290404 - protein, 9 aa, Homo Sapiens
SEHTLLLSD

SEQ ID NO: 1290405 - protein, 9 aa, Homo Sapiens
DQALDAHHR

SEQ ID NO: 1290406 - protein, 9 aa, Homo Sapiens
GQSLSLYNH

SEQ ID NO: 1290407 - protein, 9 aa, Homo Sapiens
PKWTISKDN

SEQ ID NO: 1290408 - protein, 9 aa, Homo Sapiens
HNEISWECD

SEQ ID NO: 1290409 - protein, 9 aa, Homo Sapiens
STNFSGSQH

SEQ ID NO: 1290410 - protein, 9 aa, Homo Sapiens
ILSATNMKW

SEQ ID NO: 1290411 - protein, 9 aa, Homo Sapiens
NKLCYKKEG

SEQ ID NO: 1290412 - protein, 9 aa, Homo Sapiens
ASAVFFCIL

SEQ ID NO: 1290413 - protein, 9 aa, Homo Sapiens
YQDFKRIVN

SEQ ID NO: 1290414 - protein, 9 aa, Homo Sapiens
WLVAWLSMQ

SEQ ID NO: 1290415 - protein, 9 aa, Homo Sapiens
EELPWPPVV

SEQ ID NO: 1290416 - protein, 9 aa, Homo Sapiens
EHANYSLAP

SEQ ID NO: 1290417 - protein, 9 aa, Homo Sapiens
QFPSLEHLN

SEQ ID NO: 1290418 - protein, 9 aa, Homo Sapiens
IHTGERHYE

SEQ ID NO: 1290419 - protein, 9 aa, Homo Sapiens
HFFDHKKKK

SEQ ID NO: 1290420 - protein, 9 aa, Homo Sapiens
CGPYPFGID

SEQ ID NO: 1290421 - protein, 9 aa, Homo Sapiens
ASHNHSHSH

SEQ ID NO: 1290422 - protein, 9 aa, Homo Sapiens
LMYPYVYSV

SEQ ID NO: 1290423 - protein, 9 aa, Homo Sapiens
SNLTKIKLS

SEQ ID NO: 1290424 - protein, 9 aa, Homo Sapiens
HTEKVHDGT

SEQ ID NO: 1290425 - protein, 9 aa, Homo Sapiens
SLHKPQGNK

SEQ ID NO: 1290426 - protein, 9 aa, Homo Sapiens
YYEVTPPDY

SEQ ID NO: 1290427 - protein, 9 aa, Homo Sapiens
KIVENLKKQ

SEQ ID NO: 1290428 - protein, 9 aa, Homo Sapiens
FKEYAGSMC

SEQ ID NO: 1290429 - protein, 9 aa, Homo Sapiens
VKVFAIQDH

SEQ ID NO: 1290430 - protein, 9 aa, Homo Sapiens
AKVELQRIS

SEQ ID NO: 1290431 - protein, 9 aa, Homo Sapiens
EARLYHILG

SEQ ID NO: 1290432 - protein, 9 aa, Homo Sapiens
NIHLQGNLE

SEQ ID NO: 1290433 - protein, 9 aa, Homo Sapiens
TQLMYSLVH

SEQ ID NO: 1290434 - protein, 9 aa, Homo Sapiens
LYTEESNSK

SEQ ID NO: 1290435 - protein, 9 aa, Homo Sapiens
RLCITHLVC

SEQ ID NO: 1290436 - protein, 9 aa, Homo Sapiens
LVVFVFEVT

SEQ ID NO: 1290437 - protein, 9 aa, Homo Sapiens
AVLYNYRSV

SEQ ID NO: 1290438 - protein, 9 aa, Homo Sapiens
LFNLDSFRF

SEQ ID NO: 1290439 - protein, 9 aa, Homo Sapiens
SHINEDNNT

SEQ ID NO: 1290440 - protein, 9 aa, Homo Sapiens
CETERIRVS

SEQ ID NO: 1290441 - protein, 9 aa, Homo Sapiens
QAITSHRAT

SEQ ID NO: 1290442 - protein, 9 aa, Homo Sapiens
ASDVWMFCV

SEQ ID NO: 1290443 - protein, 9 aa, Homo Sapiens
YCIYNEALY

SEQ ID NO: 1290444 - protein, 9 aa, Homo Sapiens
SNLIITRLL

SEQ ID NO: 1290445 - protein, 9 aa, Homo Sapiens
PAQSLPSKP

SEQ ID NO: 1290446 - protein, 9 aa, Homo Sapiens
EYQDFKRIV

SEQ ID NO: 1290447 - protein, 9 aa, Homo Sapiens
RGPSYILTF

SEQ ID NO: 1290448 - protein, 9 aa, Homo Sapiens
TSISSFNDK

SEQ ID NO: 1290449 - protein, 9 aa, Homo Sapiens
CVTSALTHK

SEQ ID NO: 1290450 - protein, 9 aa, Homo Sapiens
QIELVIKEK

SEQ ID NO: 1290451 - protein, 9 aa, Homo Sapiens
QECSNYDQL

SEQ ID NO: 1290452 - protein, 9 aa, Homo Sapiens
ILPDCLAPR

SEQ ID NO: 1290453 - protein, 9 aa, Homo Sapiens
CTFHGRDER

SEQ ID NO: 1290454 - protein, 9 aa, Homo Sapiens
PFFESSQTT

SEQ ID NO: 1290455 - protein, 9 aa, Homo Sapiens
TASSCFCDS

SEQ ID NO: 1290456 - protein, 9 aa, Homo Sapiens
CGTCLNLPG

SEQ ID NO: 1290457 - protein, 9 aa, Homo Sapiens
SLDLPLSIL

SEQ ID NO: 1290458 - protein, 9 aa, Homo Sapiens
ALPKTLSFR

SEQ ID NO: 1290459 - protein, 9 aa, Homo Sapiens
NMHAIPLRS

SEQ ID NO: 1290460 - protein, 9 aa, Homo Sapiens
DASVKASPP

SEQ ID NO: 1290461 - protein, 9 aa, Homo Sapiens
TLRVDCTQL

SEQ ID NO: 1290462 - protein, 9 aa, Homo Sapiens
VTLRTETCV

SEQ ID NO: 1290463 - protein, 9 aa, Homo Sapiens
LCGVYHLDI

SEQ ID NO: 1290464 - protein, 9 aa, Homo Sapiens
SHSLGNSSI

SEQ ID NO: 1290465 - protein, 9 aa, Homo Sapiens
EYISVIIAK

SEQ ID NO: 1290466 - protein, 9 aa, Homo Sapiens
RCAQDMDNN

SEQ ID NO: 1290467 - protein, 9 aa, Homo Sapiens
TYCVHYYAV

SEQ ID NO: 1290468 - protein, 9 aa, Homo Sapiens
KDEDWQMSV

SEQ ID NO: 1290469 - protein, 9 aa, Homo Sapiens
TTLCGVYHL

SEQ ID NO: 1290470 - protein, 9 aa, Homo Sapiens
VFEVICTSI

SEQ ID NO: 1290471 - protein, 9 aa, Homo Sapiens
RYEGILANC

SEQ ID NO: 1290472 - protein, 9 aa, Homo Sapiens
LINMKLALI

SEQ ID NO: 1290473 - protein, 9 aa, Homo Sapiens
EFLTWNCDK

SEQ ID NO: 1290474 - protein, 9 aa, Homo Sapiens
PGQPGYPGS

SEQ ID NO: 1290475 - protein, 9 aa, Homo Sapiens
LSTINELQQ

SEQ ID NO: 1290476 - protein, 9 aa, Homo Sapiens
LCVCAFNIL

SEQ ID NO: 1290477 - protein, 9 aa, Homo Sapiens
NSAVLGISD

SEQ ID NO: 1290478 - protein, 9 aa, Homo Sapiens
GKGLGGNVW

SEQ ID NO: 1290479 - protein, 9 aa, Homo Sapiens
KGMGRFIPL

SEQ ID NO: 1290480 - protein, 9 aa, Homo Sapiens
RHYECKQCG

SEQ ID NO: 1290481 - protein, 9 aa, Homo Sapiens
LLQEKHGQY

SEQ ID NO: 1290482 - protein, 9 aa, Homo Sapiens
RCWVPDVGE

SEQ ID NO: 1290483 - protein, 9 aa, Homo Sapiens
RGEGPGAEG

SEQ ID NO: 1290484 - protein, 9 aa, Homo Sapiens
VEQMCNLLM

SEQ ID NO: 1290485 - protein, 8 aa, Homo Sapiens
SKQVSLPE

SEQ ID NO: 1290486 - protein, 9 aa, Homo Sapiens
EHTLLLSDP

SEQ ID NO: 1290487 - protein, 9 aa, Homo Sapiens
NFKFTNFPE

SEQ ID NO: 1290488 - protein, 9 aa, Homo Sapiens
HHQKFVFFA

SEQ ID NO: 1290489 - protein, 9 aa, Homo Sapiens
LNRKRKWEL

SEQ ID NO: 1290490 - protein, 9 aa, Homo Sapiens
NYLISHQDI

SEQ ID NO: 1290491 - protein, 9 aa, Homo Sapiens
NEISWECDP

SEQ ID NO: 1290492 - protein, 9 aa, Homo Sapiens
KETFKAELQ

SEQ ID NO: 1290493 - protein, 9 aa, Homo Sapiens
VCAVFNGIT

SEQ ID NO: 1290494 - protein, 9 aa, Homo Sapiens
SKMFQVHHV

SEQ ID NO: 1290495 - protein, 9 aa, Homo Sapiens
VGFRIFIDA

SEQ ID NO: 1290496 - protein, 9 aa, Homo Sapiens
CVSPGMFSS

SEQ ID NO: 1290497 - protein, 9 aa, Homo Sapiens
LKKEGLTLN

SEQ ID NO: 1290498 - protein, 9 aa, Homo Sapiens
LNTQGGSGV

SEQ ID NO: 1290499 - protein, 9 aa, Homo Sapiens
YSLDLSLVE

SEQ ID NO: 1290500 - protein, 9 aa, Homo Sapiens
PYILYILPD

SEQ ID NO: 1290501 - protein, 9 aa, Homo Sapiens
LCLEYLGYL

SEQ ID NO: 1290502 - protein, 9 aa, Homo Sapiens
QAEMSIIGM

SEQ ID NO: 1290503 - protein, 9 aa, Homo Sapiens
VFSKFSNPL

SEQ ID NO: 1290504 - protein, 9 aa, Homo Sapiens
IGKGFLDVS

SEQ ID NO: 1290505 - protein, 9 aa, Homo Sapiens
CKLQEVSQL

SEQ ID NO: 1290506 - protein, 9 aa, Homo Sapiens
TLYFFSLAA

SEQ ID NO: 1290507 - protein, 9 aa, Homo Sapiens
GQEQVVESY

SEQ ID NO: 1290508 - protein, 9 aa, Homo Sapiens
PRNTLFAIN

SEQ ID NO: 1290509 - protein, 9 aa, Homo Sapiens
LDELYLSMP

SEQ ID NO: 1290510 - protein, 9 aa, Homo Sapiens
LIRLCCEVL

SEQ ID NO: 1290511 - protein, 9 aa, Homo Sapiens
LHKPQGNKE

SEQ ID NO: 1290512 - protein, 9 aa, Homo Sapiens
YICHALFTQ

SEQ ID NO: 1290513 - protein, 9 aa, Homo Sapiens
ICFNIALLH

SEQ ID NO: 1290514 - protein, 9 aa, Homo Sapiens
AWLSMQIFA

SEQ ID NO: 1290515 - protein, 9 aa, Homo Sapiens
DLKSKCKSI

SEQ ID NO: 1290516 - protein, 9 aa, Homo Sapiens
TMRKNQTTK

SEQ ID NO: 1290517 - protein, 9 aa, Homo Sapiens
VSFKRKQHT

SEQ ID NO: 1290518 - protein, 9 aa, Homo Sapiens
EPSLNPSEI

SEQ ID NO: 1290519 - protein, 9 aa, Homo Sapiens
FTTLCGVYH

SEQ ID NO: 1290520 - protein, 9 aa, Homo Sapiens
NSVDIKLSK

SEQ ID NO: 1290521 - protein, 9 aa, Homo Sapiens
FLFCHNCNN

SEQ ID NO: 1290522 - protein, 9 aa, Homo Sapiens
LLYLGHLLL

SEQ ID NO: 1290523 - protein, 9 aa, Homo Sapiens
IIQLHVLNK

SEQ ID NO: 1290524 - protein, 9 aa, Homo Sapiens
QQETHTCEK

SEQ ID NO: 1290525 - protein, 9 aa, Homo Sapiens
IIQRAYTIQ

SEQ ID NO: 1290526 - protein, 9 aa, Homo Sapiens
IYGTYLIGT

SEQ ID NO: 1290527 - protein, 9 aa, Homo Sapiens
NKALQEAKQ

SEQ ID NO: 1290528 - protein, 9 aa, Homo Sapiens
KFKQKELAR

SEQ ID NO: 1290529 - protein, 9 aa, Homo Sapiens
MVKHCYLGL

SEQ ID NO: 1290530 - protein, 9 aa, Homo Sapiens
HGWVSWAWS

SEQ ID NO: 1290531 - protein, 9 aa, Homo Sapiens
LCQIGSLEN

SEQ ID NO: 1290532 - protein, 9 aa, Homo Sapiens
ICVQGQCIA

SEQ ID NO: 1290533 - protein, 9 aa, Homo Sapiens
SLLNTQDTP

SEQ ID NO: 1290534 - protein, 9 aa, Homo Sapiens
YFKKAADIG

SEQ ID NO: 1290535 - protein, 9 aa, Homo Sapiens
GHHYPFSGI

SEQ ID NO: 1290536 - protein, 9 aa, Homo Sapiens
ISIIKKGLQ

SEQ ID NO: 1290537 - protein, 9 aa, Homo Sapiens
HKSHILYTE

SEQ ID NO: 1290538 - protein, 9 aa, Homo Sapiens
YDISSGNIP

SEQ ID NO: 1290539 - protein, 9 aa, Homo Sapiens
GHKRFNKLI

SEQ ID NO: 1290540 - protein, 9 aa, Homo Sapiens
YYKIVIQLP

SEQ ID NO: 1290541 - protein, 9 aa, Homo Sapiens
YFYINEDQI

SEQ ID NO: 1290542 - protein, 9 aa, Homo Sapiens
AVQPPGSDM

SEQ ID NO: 1290543 - protein, 9 aa, Homo Sapiens
LFVKEQATF

SEQ ID NO: 1290544 - protein, 9 aa, Homo Sapiens
RLCMAETSC

SEQ ID NO: 1290545 - protein, 9 aa, Homo Sapiens
PLKAFPEHL

SEQ ID NO: 1290546 - protein, 9 aa, Homo Sapiens
SFKRKQHTN

SEQ ID NO: 1290547 - protein, 9 aa, Homo Sapiens
CKKNFLIKE

SEQ ID NO: 1290548 - protein, 9 aa, Homo Sapiens
IHDIRHFSQ

SEQ ID NO: 1290549 - protein, 9 aa, Homo Sapiens
SVELCCVKI

SEQ ID NO: 1290550 - protein, 9 aa, Homo Sapiens
KAKSSMFRS

SEQ ID NO: 1290551 - protein, 9 aa, Homo Sapiens
EKETFKAEL

SEQ ID NO: 1290552 - protein, 9 aa, Homo Sapiens
EAKFAQTFG

SEQ ID NO: 1290553 - protein, 9 aa, Homo Sapiens
QHTVKPEST

SEQ ID NO: 1290554 - protein, 9 aa, Homo Sapiens
PWLLQSQHN

SEQ ID NO: 1290555 - protein, 9 aa, Homo Sapiens
RKLKTCGNF

SEQ ID NO: 1290556 - protein, 9 aa, Homo Sapiens
LSELFEEEL

SEQ ID NO: 1290557 - protein, 9 aa, Homo Sapiens
NPSTRLWHV

SEQ ID NO: 1290558 - protein, 9 aa, Homo Sapiens
IYYDSFIRP

SEQ ID NO: 1290559 - protein, 9 aa, Homo Sapiens
HNLLAAWAA

SEQ ID NO: 1290560 - protein, 9 aa, Homo Sapiens
TLTDLGTSS

SEQ ID NO: 1290561 - protein, 9 aa, Homo Sapiens
IIKLYKVIS

SEQ ID NO: 1290562 - protein, 9 aa, Homo Sapiens
SIHSLLDEP

SEQ ID NO: 1290563 - protein, 9 aa, Homo Sapiens
AKGDYLHET

SEQ ID NO: 1290564 - protein, 9 aa, Homo Sapiens
SCSVIHETS

SEQ ID NO: 1290565 - protein, 9 aa, Homo Sapiens
GRSYDGRSL

SEQ ID NO: 1290566 - protein, 9 aa, Homo Sapiens
KWNFTTPLD

SEQ ID NO: 1290567 - protein, 9 aa, Homo Sapiens
LLKQEKRDE

SEQ ID NO: 1290568 - protein, 9 aa, Homo Sapiens
WTEKVQFVV

SEQ ID NO: 1290569 - protein, 9 aa, Homo Sapiens
YLPYNINEG

SEQ ID NO: 1290570 - protein, 9 aa, Homo Sapiens
LSGSECGNM

SEQ ID NO: 1290571 - protein, 9 aa, Homo Sapiens
EKASENVLD

SEQ ID NO: 1290572 - protein, 9 aa, Homo Sapiens
LVDHNHNKG

SEQ ID NO: 1290573 - protein, 9 aa, Homo Sapiens
SQYSVEHLT

SEQ ID NO: 1290574 - protein, 9 aa, Homo Sapiens
HSISMHAMR

SEQ ID NO: 1290575 - protein, 9 aa, Homo Sapiens
MSAVVCIWL

SEQ ID NO: 1290576 - protein, 9 aa, Homo Sapiens
YLDELYLSM

SEQ ID NO: 1290577 - protein, 9 aa, Homo Sapiens
IGRSYDGRS

SEQ ID NO: 1290578 - protein, 9 aa, Homo Sapiens
LLHAASLGK

SEQ ID NO: 1290579 - protein, 9 aa, Homo Sapiens
NDFGNYNKQ

SEQ ID NO: 1290580 - protein, 9 aa, Homo Sapiens
MFSLCYLHT

SEQ ID NO: 1290581 - protein, 9 aa, Homo Sapiens
LLYPVGLFL

SEQ ID NO: 1290582 - protein, 9 aa, Homo Sapiens
RGINSKVKS

SEQ ID NO: 1290583 - protein, 9 aa, Homo Sapiens
LNPELIKCP

SEQ ID NO: 1290584 - protein, 9 aa, Homo Sapiens
MNCVMFPGN

SEQ ID NO: 1290585 - protein, 9 aa, Homo Sapiens
GEILDNKNC

SEQ ID NO: 1290586 - protein, 9 aa, Homo Sapiens
KLQECSNYD

SEQ ID NO: 1290587 - protein, 9 aa, Homo Sapiens
VTQKPRLTS

SEQ ID NO: 1290588 - protein, 9 aa, Homo Sapiens
SQTKVKCED

SEQ ID NO: 1290589 - protein, 9 aa, Homo Sapiens
EPPQPRNEL

SEQ ID NO: 1290590 - protein, 9 aa, Homo Sapiens
IIPPSLNTT

SEQ ID NO: 1290591 - protein, 9 aa, Homo Sapiens
VNKYIGLTQ

SEQ ID NO: 1290592 - protein, 9 aa, Homo Sapiens
SHPKPSNSE

SEQ ID NO: 1290593 - protein, 9 aa, Homo Sapiens
TFLKASLIC

SEQ ID NO: 1290594 - protein, 9 aa, Homo Sapiens
AACANHTLL

SEQ ID NO: 1290595 - protein, 9 aa, Homo Sapiens
ALQLRNADV

SEQ ID NO: 1290596 - protein, 9 aa, Homo Sapiens
QNGYTPYDM

SEQ ID NO: 1290597 - protein, 9 aa, Homo Sapiens
YEGKHNSME

SEQ ID NO: 1290598 - protein, 9 aa, Homo Sapiens
QLKDSCKSL

SEQ ID NO: 1290599 - protein, 9 aa, Homo Sapiens
KLTNAWSKL

SEQ ID NO: 1290600 - protein, 9 aa, Homo Sapiens
RTETCVTTQ

SEQ ID NO: 1290601 - protein, 9 aa, Homo Sapiens
AAYLQDMAE

SEQ ID NO: 1290602 - protein, 9 aa, Homo Sapiens
KSLWNGDTC

SEQ ID NO: 1290603 - protein, 9 aa, Homo Sapiens
KAGKIFSHM

SEQ ID NO: 1290604 - protein, 9 aa, Homo Sapiens
KCPWTKEED

SEQ ID NO: 1290605 - protein, 9 aa, Homo Sapiens
VYNSAVLGI

SEQ ID NO: 1290606 - protein, 9 aa, Homo Sapiens
ENVLDPASS

SEQ ID NO: 1290607 - protein, 9 aa, Homo Sapiens
LITNYKIGA

SEQ ID NO: 1290608 - protein, 9 aa, Homo Sapiens
LLRKSKELQ

SEQ ID NO: 1290609 - protein, 9 aa, Homo Sapiens
HDGTLCQPG

SEQ ID NO: 1290610 - protein, 9 aa, Homo Sapiens
QVQLNDLDA

SEQ ID NO: 1290611 - protein, 9 aa, Homo Sapiens
VQKLIRLCC

SEQ ID NO: 1290612 - protein, 9 aa, Homo Sapiens
DDITVFLRH

SEQ ID NO: 1290613 - protein, 9 aa, Homo Sapiens
AKLIESCGK

SEQ ID NO: 1290614 - protein, 9 aa, Homo Sapiens
SHHTPLEGR

SEQ ID NO: 1290615 - protein, 9 aa, Homo Sapiens
IKQFKEARE

SEQ ID NO: 1290616 - protein, 9 aa, Homo Sapiens
QFQALVKHM

SEQ ID NO: 1290617 - protein, 9 aa, Homo Sapiens
LTNEGGVFT

SEQ ID NO: 1290618 - protein, 9 aa, Homo Sapiens
YIIKFWAKL

SEQ ID NO: 1290619 - protein, 9 aa, Homo Sapiens
VLSWAHIKE

SEQ ID NO: 1290620 - protein, 9 aa, Homo Sapiens
DVECLTYGW

SEQ ID NO: 1290621 - protein, 9 aa, Homo Sapiens
CCVDTKEAD

SEQ ID NO: 1290622 - protein, 9 aa, Homo Sapiens
SDVWMFCVC

SEQ ID NO: 1290623 - protein, 9 aa, Homo Sapiens
IIVDMLDSD

SEQ ID NO: 1290624 - protein, 9 aa, Homo Sapiens
RVVCDGGSI

SEQ ID NO: 1290625 - protein, 9 aa, Homo Sapiens
LPPSYLDEL

SEQ ID NO: 1290626 - protein, 9 aa, Homo Sapiens
SGSQHDYPS

SEQ ID NO: 1290627 - protein, 9 aa, Homo Sapiens
IVQAELCDY

SEQ ID NO: 1290628 - protein, 9 aa, Homo Sapiens
HKWPNPDSP

SEQ ID NO: 1290629 - protein, 9 aa, Homo Sapiens
KQKRLIHER

SEQ ID NO: 1290630 - protein, 9 aa, Homo Sapiens
LSILTKKGK

SEQ ID NO: 1290631 - protein, 9 aa, Homo Sapiens
HLTLKEHFS

SEQ ID NO: 1290632 - protein, 9 aa, Homo Sapiens
LDDPESAIQ

SEQ ID NO: 1290633 - protein, 9 aa, Homo Sapiens
WGFHNNLLD

SEQ ID NO: 1290634 - protein, 9 aa, Homo Sapiens
PTVNVSSES

SEQ ID NO: 1290635 - protein, 9 aa, Homo Sapiens
CIKRIQDDC

SEQ ID NO: 1290636 - protein, 9 aa, Homo Sapiens
MDSQPHQKQ

SEQ ID NO: 1290637 - protein, 9 aa, Homo Sapiens
QDIVLSWAH

SEQ ID NO: 1290638 - protein, 9 aa, Homo Sapiens
TSLYSSYGF

SEQ ID NO: 1290639 - protein, 9 aa, Homo Sapiens
FTTPLDEYI

SEQ ID NO: 1290640 - protein, 9 aa, Homo Sapiens
LVFSKLEWP

SEQ ID NO: 1290641 - protein, 9 aa, Homo Sapiens
CYICHALFT

SEQ ID NO: 1290642 - protein, 9 aa, Homo Sapiens
VSSLCDDYP

SEQ ID NO: 1290643 - protein, 9 aa, Homo Sapiens
QVFHNKSKF

SEQ ID NO: 1290644 - protein, 9 aa, Homo Sapiens
SYDGRSLFI

SEQ ID NO: 1290645 - protein, 9 aa, Homo Sapiens
GGQPLEGVG

SEQ ID NO: 1290646 - protein, 9 aa, Homo Sapiens
EKTALQLRN

SEQ ID NO: 1290647 - protein, 9 aa, Homo Sapiens
CCVKIVVVD

SEQ ID NO: 1290648 - protein, 9 aa, Homo Sapiens
QTLLTIIVV

SEQ ID NO: 1290649 - protein, 9 aa, Homo Sapiens
FTTMTPTHE

SEQ ID NO: 1290650 - protein, 9 aa, Homo Sapiens
KQHYLLKRM

SEQ ID NO: 1290651 - protein, 9 aa, Homo Sapiens
DKNVLLVLP

SEQ ID NO: 1290652 - protein, 9 aa, Homo Sapiens
EGLIDSETM

SEQ ID NO: 1290653 - protein, 9 aa, Homo Sapiens
GCYSAFVVL

SEQ ID NO: 1290654 - protein, 9 aa, Homo Sapiens
VFAIQDHTL

SEQ ID NO: 1290655 - protein, 9 aa, Homo Sapiens
HYALYLICQ

SEQ ID NO: 1290656 - protein, 9 aa, Homo Sapiens
SNYDQLQGK

SEQ ID NO: 1290657 - protein, 9 aa, Homo Sapiens
SPLYSPQQT

SEQ ID NO: 1290658 - protein, 9 aa, Homo Sapiens
IAYPTYEVG

SEQ ID NO: 1290659 - protein, 9 aa, Homo Sapiens
MMADLPYQN

SEQ ID NO: 1290660 - protein, 9 aa, Homo Sapiens
YNSDEQNDT

SEQ ID NO: 1290661 - protein, 9 aa, Homo Sapiens
FQLLTTMCN

SEQ ID NO: 1290662 - protein, 9 aa, Homo Sapiens
IQLMVNLLI

SEQ ID NO: 1290663 - protein, 9 aa, Homo Sapiens
RMSQDILCD

SEQ ID NO: 1290664 - protein, 9 aa, Homo Sapiens
STIKVTVLG

SEQ ID NO: 1290665 - protein, 9 aa, Homo Sapiens
EEDTDPSVI

SEQ ID NO: 1290666 - protein, 9 aa, Homo Sapiens
NFEATPIVI

SEQ ID NO: 1290667 - protein, 9 aa, Homo Sapiens
AVTVCIGVP

SEQ ID NO: 1290668 - protein, 9 aa, Homo Sapiens
TNANLGEFW

SEQ ID NO: 1290669 - protein, 9 aa, Homo Sapiens
GFNKFGGPL

SEQ ID NO: 1290670 - protein, 9 aa, Homo Sapiens
NKSKFVPPF

SEQ ID NO: 1290671 - protein, 9 aa, Homo Sapiens
IKAKYKDDF

SEQ ID NO: 1290672 - protein, 9 aa, Homo Sapiens
NIFALSDEA

SEQ ID NO: 1290673 - protein, 9 aa, Homo Sapiens
NKTKVANQS

SEQ ID NO: 1290674 - protein, 9 aa, Homo Sapiens
GVFCGPYPF

SEQ ID NO: 1290675 - protein, 9 aa, Homo Sapiens
PDSHQLFVC

SEQ ID NO: 1290676 - protein, 9 aa, Homo Sapiens
VCCFITPLP

SEQ ID NO: 1290677 - protein, 9 aa, Homo Sapiens
EKAQVKKIN

SEQ ID NO: 1290678 - protein, 9 aa, Homo Sapiens
GQHVSRQTS

SEQ ID NO: 1290679 - protein, 9 aa, Homo Sapiens
LKEEHGLVK

SEQ ID NO: 1290680 - protein, 9 aa, Homo Sapiens
CKSINEKME

SEQ ID NO: 1290681 - protein, 9 aa, Homo Sapiens
GLTPLLLCV

SEQ ID NO: 1290682 - protein, 9 aa, Homo Sapiens
SQLIDCQEF

SEQ ID NO: 1290683 - protein, 9 aa, Homo Sapiens
AWSDHRHIC

SEQ ID NO: 1290684 - protein, 9 aa, Homo Sapiens
PELNNMTQK

SEQ ID NO: 1290685 - protein, 9 aa, Homo Sapiens
CDHILVGTQ

SEQ ID NO: 1290686 - protein, 9 aa, Homo Sapiens
PEVHTLPTP

SEQ ID NO: 1290687 - protein, 9 aa, Homo Sapiens
YMTLMKNGE

SEQ ID NO: 1290688 - protein, 9 aa, Homo Sapiens
VNGQLVCAK

SEQ ID NO: 1290689 - protein, 9 aa, Homo Sapiens
TYIDYEGRY

SEQ ID NO: 1290690 - protein, 9 aa, Homo Sapiens
QLTGTIKVA

SEQ ID NO: 1290691 - protein, 9 aa, Homo Sapiens
LVLCSRLLV

SEQ ID NO: 1290692 - protein, 9 aa, Homo Sapiens
ALPLDMIDE

SEQ ID NO: 1290693 - protein, 9 aa, Homo Sapiens
CNINSQCVI

SEQ ID NO: 1290694 - protein, 9 aa, Homo Sapiens
HKRFNKLIW

SEQ ID NO: 1290695 - protein, 9 aa, Homo Sapiens
LATGHLFKE

SEQ ID NO: 1290696 - protein, 9 aa, Homo Sapiens
KKLIHTEDQ

SEQ ID NO: 1290697 - protein, 9 aa, Homo Sapiens
LANPKAWTN

SEQ ID NO: 1290698 - protein, 9 aa, Homo Sapiens
ILDNDPSFF

SEQ ID NO: 1290699 - protein, 9 aa, Homo Sapiens
AAKENWSRW

SEQ ID NO: 1290700 - protein, 9 aa, Homo Sapiens
SAESRPTLF

SEQ ID NO: 1290701 - protein, 9 aa, Homo Sapiens
GKIFSHMNN

SEQ ID NO: 1290702 - protein, 9 aa, Homo Sapiens
PQKPIQLYS

SEQ ID NO: 1290703 - protein, 9 aa, Homo Sapiens
LVKQHTVKP

SEQ ID NO: 1290704 - protein, 9 aa, Homo Sapiens
ASYPAVPCE

SEQ ID NO: 1290705 - protein, 9 aa, Homo Sapiens
LSQCPEVHT

SEQ ID NO: 1290706 - protein, 9 aa, Homo Sapiens
QGITRHLTK

SEQ ID NO: 1290707 - protein, 9 aa, Homo Sapiens
YQSEIKLLF

SEQ ID NO: 1290708 - protein, 9 aa, Homo Sapiens
YDMFCPFYK

SEQ ID NO: 1290709 - protein, 9 aa, Homo Sapiens
ELIKCPWTK

SEQ ID NO: 1290710 - protein, 9 aa, Homo Sapiens
EVINFILQK

SEQ ID NO: 1290711 - protein, 9 aa, Homo Sapiens
IKLCTFHGR

SEQ ID NO: 1290712 - protein, 9 aa, Homo Sapiens
AKKHGKEYT

SEQ ID NO: 1290713 - protein, 9 aa, Homo Sapiens
LLWKSYPIV

SEQ ID NO: 1290714 - protein, 9 aa, Homo Sapiens
PSLCPPTAP

SEQ ID NO: 1290715 - protein, 9 aa, Homo Sapiens
PKAPPLVIK

SEQ ID NO: 1290716 - protein, 9 aa, Homo Sapiens
TTDIVSGTT

SEQ ID NO: 1290717 - protein, 9 aa, Homo Sapiens
PVRHRTLPA

SEQ ID NO: 1290718 - protein, 9 aa, Homo Sapiens
SARTTAPPC

SEQ ID NO: 1290719 - protein, 9 aa, Homo Sapiens
SPDSSIRTS

SEQ ID NO: 1290720 - protein, 9 aa, Homo Sapiens
AQDPDSNNA

SEQ ID NO: 1290721 - protein, 9 aa, Homo Sapiens
LVGAAGKGA

SEQ ID NO: 1290722 - protein, 9 aa, Homo Sapiens
VGENHVVKM

SEQ ID NO: 1290723 - protein, 9 aa, Homo Sapiens
QRIHTTART

SEQ ID NO: 1290724 - protein, 9 aa, Homo Sapiens
DAELDWVAE

SEQ ID NO: 1290725 - protein, 9 aa, Homo Sapiens
VLQVLEVGA

SEQ ID NO: 1290726 - protein, 9 aa, Homo Sapiens
KNIRQRVYD

SEQ ID NO: 1290727 - protein, 9 aa, Homo Sapiens
RSQRKDCKW

SEQ ID NO: 1290728 - protein, 9 aa, Homo Sapiens
GATSYRCGV

SEQ ID NO: 1290729 - protein, 9 aa, Homo Sapiens
STNAQVTYS

SEQ ID NO: 1290730 - protein, 9 aa, Homo Sapiens
RHPHRSPPT

SEQ ID NO: 1290731 - protein, 9 aa, Homo Sapiens
DMLDWDCLH

SEQ ID NO: 1290732 - protein, 9 aa, Homo Sapiens
GEAALSPDK

SEQ ID NO: 1290733 - protein, 9 aa, Homo Sapiens
MVFVHRPWP

SEQ ID NO: 1290734 - protein, 9 aa, Homo Sapiens
FGVSAVTGT

SEQ ID NO: 1290735 - protein, 9 aa, Homo Sapiens
KCAFQAPPS

SEQ ID NO: 1290736 - protein, 9 aa, Homo Sapiens
DVMEMRMVK

SEQ ID NO: 1290737 - protein, 9 aa, Homo Sapiens
LASNDLPLL

SEQ ID NO: 1290738 - protein, 9 aa, Homo Sapiens
EPSRLGGGR

SEQ ID NO: 1290739 - protein, 9 aa, Homo Sapiens
KQEDLVGDV

SEQ ID NO: 1290740 - protein, 9 aa, Homo Sapiens
FKLEEYYEL

SEQ ID NO: 1290741 - protein, 9 aa, Homo Sapiens
EGFDLSTLS

SEQ ID NO: 1290742 - protein, 9 aa, Homo Sapiens
RQRVYDALN

SEQ ID NO: 1290743 - protein, 9 aa, Homo Sapiens
LMLCLHHQR

SEQ ID NO: 1290744 - protein, 9 aa, Homo Sapiens
ISKKVSWYS

SEQ ID NO: 1290745 - protein, 9 aa, Homo Sapiens
CFSPLWLMT

SEQ ID NO: 1290746 - protein, 9 aa, Homo Sapiens
LAETVTLIE

SEQ ID NO: 1290747 - protein, 9 aa, Homo Sapiens
SLCLEGIRY

SEQ ID NO: 1290748 - protein, 9 aa, Homo Sapiens
SMEKEKMKD

SEQ ID NO: 1290749 - protein, 9 aa, Homo Sapiens
RGRARAGVC

SEQ ID NO: 1290750 - protein, 9 aa, Homo Sapiens
IRQRVYDAL

SEQ ID NO: 1290751 - protein, 9 aa, Homo Sapiens
QNGLRPVLR

SEQ ID NO: 1290752 - protein, 9 aa, Homo Sapiens
VRTGALGHR

SEQ ID NO: 1290753 - protein, 9 aa, Homo Sapiens
AKVSIWATV

SEQ ID NO: 1290754 - protein, 9 aa, Homo Sapiens
GHPQDPGLA

SEQ ID NO: 1290755 - protein, 9 aa, Homo Sapiens
DALTEPPAI

SEQ ID NO: 1290756 - protein, 9 aa, Homo Sapiens
RKLDEDAPP

SEQ ID NO: 1290757 - protein, 9 aa, Homo Sapiens
RAGGFGGGQ

SEQ ID NO: 1290758 - protein, 9 aa, Homo Sapiens
VSCGTGAAG

SEQ ID NO: 1290759 - protein, 9 aa, Homo Sapiens
WLSASHFTT

SEQ ID NO: 1290760 - protein, 9 aa, Homo Sapiens
QPWDSQMPG

SEQ ID NO: 1290761 - protein, 9 aa, Homo Sapiens
LMMSNGCWG

SEQ ID NO: 1290762 - protein, 9 aa, Homo Sapiens
KQKCIEQRE

SEQ ID NO: 1290763 - protein, 9 aa, Homo Sapiens
WVPLQIDTK

SEQ ID NO: 1290764 - protein, 9 aa, Homo Sapiens
PPTLMMSNG

SEQ ID NO: 1290765 - protein, 9 aa, Homo Sapiens
IMCIIRAAV

SEQ ID NO: 1290766 - protein, 9 aa, Homo Sapiens
QDTPPVHQV

SEQ ID NO: 1290767 - protein, 9 aa, Homo Sapiens
QPPSPEPRN

SEQ ID NO: 1290768 - protein, 9 aa, Homo Sapiens
HEKCLGSME

SEQ ID NO: 1290769 - protein, 9 aa, Homo Sapiens
MQNLASNDL

SEQ ID NO: 1290770 - protein, 9 aa, Homo Sapiens
GITHLAEVC

SEQ ID NO: 1290771 - protein, 9 aa, Homo Sapiens
QDLQKLITT

SEQ ID NO: 1290772 - protein, 9 aa, Homo Sapiens
CGKGFCEST

SEQ ID NO: 1290773 - protein, 9 aa, Homo Sapiens
TIANDIMIS

SEQ ID NO: 1290774 - protein, 9 aa, Homo Sapiens
YGKSFSNTS

SEQ ID NO: 1290775 - protein, 9 aa, Homo Sapiens
DLTENPVGL

SEQ ID NO: 1290776 - protein, 9 aa, Homo Sapiens
LGDLHQAVS

SEQ ID NO: 1290777 - protein, 9 aa, Homo Sapiens
RKRVITTYQ

SEQ ID NO: 1290778 - protein, 9 aa, Homo Sapiens
LPNVTVRGA

SEQ ID NO: 1290779 - protein, 9 aa, Homo Sapiens
HQRVKLFWM

SEQ ID NO: 1290780 - protein, 9 aa, Homo Sapiens
FLKQLRPEI

SEQ ID NO: 1290781 - protein, 9 aa, Homo Sapiens
VRILVSDSL

SEQ ID NO: 1290782 - protein, 9 aa, Homo Sapiens
LCHIIEKKH

SEQ ID NO: 1290783 - protein, 9 aa, Homo Sapiens
KSSVSGSTG

SEQ ID NO: 1290784 - protein, 9 aa, Homo Sapiens
SYPLVLKEF

SEQ ID NO: 1290785 - protein, 9 aa, Homo Sapiens
GTLVVLSGI

SEQ ID NO: 1290786 - protein, 9 aa, Homo Sapiens
LNCIWKVLH

SEQ ID NO: 1290787 - protein, 9 aa, Homo Sapiens
LLVTQQKAA

SEQ ID NO: 1290788 - protein, 9 aa, Homo Sapiens
MTERWPGRD

SEQ ID NO: 1290789 - protein, 9 aa, Homo Sapiens
VVLLLQGIT

SEQ ID NO: 1290790 - protein, 9 aa, Homo Sapiens
LEEYYELRS

SEQ ID NO: 1290791 - protein, 9 aa, Homo Sapiens
YNLIAIIHD

SEQ ID NO: 1290792 - protein, 9 aa, Homo Sapiens
HMPMYVFLL

SEQ ID NO: 1290793 - protein, 9 aa, Homo Sapiens
HTMRSLDRA

SEQ ID NO: 1290794 - protein, 9 aa, Homo Sapiens
MKCLTAVDC

SEQ ID NO: 1290795 - protein, 9 aa, Homo Sapiens
KEKINIRML

SEQ ID NO: 1290796 - protein, 9 aa, Homo Sapiens
AAEGEGMLE

SEQ ID NO: 1290797 - protein, 9 aa, Homo Sapiens
LLQRNLLRL

SEQ ID NO: 1290798 - protein, 9 aa, Homo Sapiens
GCDGRDGTP

SEQ ID NO: 1290799 - protein, 9 aa, Homo Sapiens
RPVVNLVLC

SEQ ID NO: 1290800 - protein, 9 aa, Homo Sapiens
RGAGGYQPP

SEQ ID NO: 1290801 - protein, 9 aa, Homo Sapiens
LALQPAALG

SEQ ID NO: 1290802 - protein, 9 aa, Homo Sapiens
NKSLNRVHL

SEQ ID NO: 1290803 - protein, 9 aa, Homo Sapiens
TWSHLESIL

SEQ ID NO: 1290804 - protein, 9 aa, Homo Sapiens
PDARSALRP

SEQ ID NO: 1290805 - protein, 9 aa, Homo Sapiens
RAMTERWPG

SEQ ID NO: 1290806 - protein, 9 aa, Homo Sapiens
SLKSRDPEN

SEQ ID NO: 1290807 - protein, 9 aa, Homo Sapiens
VHLAPHVQL

SEQ ID NO: 1290808 - protein, 9 aa, Homo Sapiens
KENFENKEK

SEQ ID NO: 1290809 - protein, 9 aa, Homo Sapiens
RGSCGSRGN

SEQ ID NO: 1290810 - protein, 9 aa, Homo Sapiens
SKKVSWYSH

SEQ ID NO: 1290811 - protein, 9 aa, Homo Sapiens
PQLDNGHPQ

SEQ ID NO: 1290812 - protein, 9 aa, Homo Sapiens
SDDNVKLIV

SEQ ID NO: 1290813 - protein, 9 aa, Homo Sapiens
VPEAPLPSR

SEQ ID NO: 1290814 - protein, 9 aa, Homo Sapiens
PDRGCLLQL

SEQ ID NO: 1290815 - protein, 9 aa, Homo Sapiens
GRHRPAGHA

SEQ ID NO: 1290816 - protein, 9 aa, Homo Sapiens
ELEVIARGV

SEQ ID NO: 1290817 - protein, 9 aa, Homo Sapiens
VAKRQQLVT

SEQ ID NO: 1290818 - protein, 9 aa, Homo Sapiens
QPFSSTTQI

SEQ ID NO: 1290819 - protein, 9 aa, Homo Sapiens
NTESYLKKC

SEQ ID NO: 1290820 - protein, 9 aa, Homo Sapiens
LNEQWVVSA

SEQ ID NO: 1290821 - protein, 9 aa, Homo Sapiens
LSPARTKCP

SEQ ID NO: 1290822 - protein, 9 aa, Homo Sapiens
GMCPVGRGC

SEQ ID NO: 1290823 - protein, 9 aa, Homo Sapiens
HCQYKLTYT

SEQ ID NO: 1290824 - protein, 9 aa, Homo Sapiens
LLNCQRKRR

SEQ ID NO: 1290825 - protein, 9 aa, Homo Sapiens
DWDCLHHHL

SEQ ID NO: 1290826 - protein, 9 aa, Homo Sapiens
KSCDPPGMT

SEQ ID NO: 1290827 - protein, 9 aa, Homo Sapiens
VTQRKSQTI

SEQ ID NO: 1290828 - protein, 9 aa, Homo Sapiens
PPPPTKKRG

SEQ ID NO: 1290829 - protein, 9 aa, Homo Sapiens
HSVPSTPPR

SEQ ID NO: 1290830 - protein, 9 aa, Homo Sapiens
YQIFFLFFL

SEQ ID NO: 1290831 - protein, 9 aa, Homo Sapiens
TRVMYPVKS

SEQ ID NO: 1290832 - protein, 9 aa, Homo Sapiens
SAGDCVWAG

SEQ ID NO: 1290833 - protein, 9 aa, Homo Sapiens
VLADMRGWD

SEQ ID NO: 1290834 - protein, 9 aa, Homo Sapiens
ISVPVARTG

SEQ ID NO: 1290835 - protein, 9 aa, Homo Sapiens
LKDIFFTAK

SEQ ID NO: 1290836 - protein, 9 aa, Homo Sapiens
KRMSEQIFT

SEQ ID NO: 1290837 - protein, 9 aa, Homo Sapiens
ARPCPPGRC

SEQ ID NO: 1290838 - protein, 9 aa, Homo Sapiens
RTMYNQDRH

SEQ ID NO: 1290839 - protein, 9 aa, Homo Sapiens
LQGEAAGAG

SEQ ID NO: 1290840 - protein, 9 aa, Homo Sapiens
RRAPGRTAA

SEQ ID NO: 1290841 - protein, 9 aa, Homo Sapiens
TLGTLVSIP

SEQ ID NO: 1290842 - protein, 9 aa, Homo Sapiens
YSRAVLVER

SEQ ID NO: 1290843 - protein, 9 aa, Homo Sapiens
HVKRHAVNL

SEQ ID NO: 1290844 - protein, 9 aa, Homo Sapiens
YDNRQRSAQ

SEQ ID NO: 1290845 - protein, 9 aa, Homo Sapiens
DNVYCVGQR

SEQ ID NO: 1290846 - protein, 9 aa, Homo Sapiens
YVDKSWGDK

SEQ ID NO: 1290847 - protein, 9 aa, Homo Sapiens
LWAVDGRKK

SEQ ID NO: 1290848 - protein, 9 aa, Homo Sapiens
VTAFPNTSS

SEQ ID NO: 1290849 - protein, 9 aa, Homo Sapiens
QLSDPGLQF

SEQ ID NO: 1290850 - protein, 9 aa, Homo Sapiens
LRLCYMANW

SEQ ID NO: 1290851 - protein, 9 aa, Homo Sapiens
MWSFCFSPL

SEQ ID NO: 1290852 - protein, 9 aa, Homo Sapiens
MGTELTRVL

SEQ ID NO: 1290853 - protein, 9 aa, Homo Sapiens
ILPVLFTLV

SEQ ID NO: 1290854 - protein, 9 aa, Homo Sapiens
ILPSSRGMG

SEQ ID NO: 1290855 - protein, 9 aa, Homo Sapiens
PWKKINSAP

SEQ ID NO: 1290856 - protein, 9 aa, Homo Sapiens
DEIAEVVNE

SEQ ID NO: 1290857 - protein, 9 aa, Homo Sapiens
AWSSVACPA

SEQ ID NO: 1290858 - protein, 9 aa, Homo Sapiens
KNKKIVYSH

SEQ ID NO: 1290859 - protein, 9 aa, Homo Sapiens
VAMLQGMAY

SEQ ID NO: 1290860 - protein, 9 aa, Homo Sapiens
RGQSAKSGS

SEQ ID NO: 1290861 - protein, 9 aa, Homo Sapiens
LAVEVSITY

SEQ ID NO: 1290862 - protein, 9 aa, Homo Sapiens
VLLSIPWTQ

SEQ ID NO: 1290863 - protein, 9 aa, Homo Sapiens
SIRNLSQSN

SEQ ID NO: 1290864 - protein, 9 aa, Homo Sapiens
RPGTPPPLI

SEQ ID NO: 1290865 - protein, 9 aa, Homo Sapiens
AACPMTACS

SEQ ID NO: 1290866 - protein, 9 aa, Homo Sapiens
HCGVLGLWK

SEQ ID NO: 1290867 - protein, 9 aa, Homo Sapiens
GGGGVLGML

SEQ ID NO: 1290868 - protein, 9 aa, Homo Sapiens
WPGRRGRCE

SEQ ID NO: 1290869 - protein, 9 aa, Homo Sapiens
ETPPSVETP

SEQ ID NO: 1290870 - protein, 9 aa, Homo Sapiens
LGLTFLRCS

SEQ ID NO: 1290871 - protein, 9 aa, Homo Sapiens
TAATATAAT

SEQ ID NO: 1290872 - protein, 9 aa, Homo Sapiens
IVYSHPKLK

SEQ ID NO: 1290873 - protein, 9 aa, Homo Sapiens
CDEHGLTCG

SEQ ID NO: 1290874 - protein, 9 aa, Homo Sapiens
RYAIRIACI

SEQ ID NO: 1290875 - protein, 9 aa, Homo Sapiens
KNSLGIIWP

SEQ ID NO: 1290876 - protein, 9 aa, Homo Sapiens
APPTPRGRL

SEQ ID NO: 1290877 - protein, 9 aa, Homo Sapiens
RSNQNREWC

SEQ ID NO: 1290878 - protein, 9 aa, Homo Sapiens
CSARGGEGR

SEQ ID NO: 1290879 - protein, 9 aa, Homo Sapiens
FMSPSPYTV

SEQ ID NO: 1290880 - protein, 9 aa, Homo Sapiens
GPCRGRSSM

SEQ ID NO: 1290881 - protein, 9 aa, Homo Sapiens
EFPAVGLEL

SEQ ID NO: 1290882 - protein, 9 aa, Homo Sapiens
TTDHNTQIH

SEQ ID NO: 1290883 - protein, 9 aa, Homo Sapiens
RCLHWSLMS

SEQ ID NO: 1290884 - protein, 9 aa, Homo Sapiens
SHRSLLEST

SEQ ID NO: 1290885 - protein, 9 aa, Homo Sapiens
TVTAFPNTS

SEQ ID NO: 1290886 - protein, 9 aa, Homo Sapiens
GPPADLEGP

SEQ ID NO: 1290887 - protein, 9 aa, Homo Sapiens
LDEFLMGGM

SEQ ID NO: 1290888 - protein, 9 aa, Homo Sapiens
VGAYEEVKH

SEQ ID NO: 1290889 - protein, 9 aa, Homo Sapiens
ITNNFGSVA

SEQ ID NO: 1290890 - protein, 9 aa, Homo Sapiens
VLGLWKWQF

SEQ ID NO: 1290891 - protein, 9 aa, Homo Sapiens
MDTEWHLHV

SEQ ID NO: 1290892 - protein, 9 aa, Homo Sapiens
DWAPRCPRR

SEQ ID NO: 1290893 - protein, 9 aa, Homo Sapiens
DTVQLSIFE

SEQ ID NO: 1290894 - protein, 9 aa, Homo Sapiens
HSGNLPHPS

SEQ ID NO: 1290895 - protein, 9 aa, Homo Sapiens
CQLQPACLQ

SEQ ID NO: 1290896 - protein, 9 aa, Homo Sapiens
GCGFELDSG

SEQ ID NO: 1290897 - protein, 9 aa, Homo Sapiens
CPRAPEVPR

SEQ ID NO: 1290898 - protein, 9 aa, Homo Sapiens
MTLGASWVE

SEQ ID NO: 1290899 - protein, 9 aa, Homo Sapiens
CGFFMATVH

SEQ ID NO: 1290900 - protein, 9 aa, Homo Sapiens
TTYQNIAVY

SEQ ID NO: 1290901 - protein, 9 aa, Homo Sapiens
YAIRIACIF

SEQ ID NO: 1290902 - protein, 9 aa, Homo Sapiens
IGTTDIVSG

SEQ ID NO: 1290903 - protein, 9 aa, Homo Sapiens
PSGTPPSPV

SEQ ID NO: 1290904 - protein, 9 aa, Homo Sapiens
GKWSAVPPH

SEQ ID NO: 1290905 - protein, 9 aa, Homo Sapiens
LGVRSQRKD

SEQ ID NO: 1290906 - protein, 9 aa, Homo Sapiens
KLFWMVWSS

SEQ ID NO: 1290907 - protein, 9 aa, Homo Sapiens
CWSEITRNV

SEQ ID NO: 1290908 - protein, 9 aa, Homo Sapiens
YFTVTLYLE

SEQ ID NO: 1290909 - protein, 9 aa, Homo Sapiens
DVEVQAVAS

SEQ ID NO: 1290910 - protein, 9 aa, Homo Sapiens
PQGFGFLLQ

SEQ ID NO: 1290911 - protein, 9 aa, Homo Sapiens
LVTITNNFG

SEQ ID NO: 1290912 - protein, 9 aa, Homo Sapiens
HGGSYSAVS

SEQ ID NO: 1290913 - protein, 9 aa, Homo Sapiens
EKTVRNTEM

SEQ ID NO: 1290914 - protein, 9 aa, Homo Sapiens
QGNRLMVLQ

SEQ ID NO: 1290915 - protein, 9 aa, Homo Sapiens
SRKVYILML

SEQ ID NO: 1290916 - protein, 9 aa, Homo Sapiens
RKNTLGEAA

SEQ ID NO: 1290917 - protein, 9 aa, Homo Sapiens
PIFVFQKDK

SEQ ID NO: 1290918 - protein, 9 aa, Homo Sapiens
RTTATCSLS

SEQ ID NO: 1290919 - protein, 9 aa, Homo Sapiens
LSSPTRPLP

SEQ ID NO: 1290920 - protein, 9 aa, Homo Sapiens
PKTGWEKRK

SEQ ID NO: 1290921 - protein, 9 aa, Homo Sapiens
PRDLLESNS

SEQ ID NO: 1290922 - protein, 9 aa, Homo Sapiens
NGCWGWQQS

SEQ ID NO: 1290923 - protein, 9 aa, Homo Sapiens
PVEDAEPDE

SEQ ID NO: 1290924 - protein, 9 aa, Homo Sapiens
LCVKATVCP

SEQ ID NO: 1290925 - protein, 9 aa, Homo Sapiens
LVHHDDYLD

SEQ ID NO: 1290926 - protein, 9 aa, Homo Sapiens
LRPAAAAAA

SEQ ID NO: 1290927 - protein, 9 aa, Homo Sapiens
HCQQDHKVL

SEQ ID NO: 1290928 - protein, 9 aa, Homo Sapiens
RGRRRPGRG

SEQ ID NO: 1290929 - protein, 9 aa, Homo Sapiens
ECGKGFCES

SEQ ID NO: 1290930 - protein, 9 aa, Homo Sapiens
FYDSLESIL

SEQ ID NO: 1290931 - protein, 9 aa, Homo Sapiens
RRTSDNGQF

SEQ ID NO: 1290932 - protein, 9 aa, Homo Sapiens
DEDAPPNEE

SEQ ID NO: 1290933 - protein, 9 aa, Homo Sapiens
EKSLGKNLS

SEQ ID NO: 1290934 - protein, 9 aa, Homo Sapiens
GAPDGIGSG

SEQ ID NO: 1290935 - protein, 9 aa, Homo Sapiens
SCLTWASPL

SEQ ID NO: 1290936 - protein, 9 aa, Homo Sapiens
FLIVDPYMR

SEQ ID NO: 1290937 - protein, 9 aa, Homo Sapiens
PEEQEKENL

SEQ ID NO: 1290938 - protein, 9 aa, Homo Sapiens
APTPRSPTR

SEQ ID NO: 1290939 - protein, 9 aa, Homo Sapiens
GPPAAQARP

SEQ ID NO: 1290940 - protein, 9 aa, Homo Sapiens
AKILFFSIK

SEQ ID NO: 1290941 - protein, 9 aa, Homo Sapiens
DGTLSPART

SEQ ID NO: 1290942 - protein, 9 aa, Homo Sapiens
ETNSGNERT

SEQ ID NO: 1290943 - protein, 9 aa, Homo Sapiens
KSLGKNLSK

SEQ ID NO: 1290944 - protein, 9 aa, Homo Sapiens
PCLCTVSLA

SEQ ID NO: 1290945 - protein, 9 aa, Homo Sapiens
LLLSLKFKL

SEQ ID NO: 1290946 - protein, 9 aa, Homo Sapiens
KECKKKDEE

SEQ ID NO: 1290947 - protein, 9 aa, Homo Sapiens
AGGGDARAA

SEQ ID NO: 1290948 - protein, 9 aa, Homo Sapiens
RILLQRNLL

SEQ ID NO: 1290949 - protein, 9 aa, Homo Sapiens
PSRLGGGRR

SEQ ID NO: 1290950 - protein, 9 aa, Homo Sapiens
RRQGPAAWS

SEQ ID NO: 1290951 - protein, 9 aa, Homo Sapiens
KTTVSYTKI

SEQ ID NO: 1290952 - protein, 9 aa, Homo Sapiens
GGGGPLPLD

SEQ ID NO: 1290953 - protein, 9 aa, Homo Sapiens
KCIEQRESR

SEQ ID NO: 1290954 - protein, 9 aa, Homo Sapiens
WCLLSFSWS

SEQ ID NO: 1290955 - protein, 9 aa, Homo Sapiens
ACSRPVCCP

SEQ ID NO: 1290956 - protein, 9 aa, Homo Sapiens
IAEDSSGPV

SEQ ID NO: 1290957 - protein, 9 aa, Homo Sapiens
QLHNKKEGN

SEQ ID NO: 1290958 - protein, 9 aa, Homo Sapiens
EKLVELRRR

SEQ ID NO: 1290959 - protein, 9 aa, Homo Sapiens
LGNPRVLSA

SEQ ID NO: 1290960 - protein, 9 aa, Homo Sapiens
VQRLGRREQ

SEQ ID NO: 1290961 - protein, 9 aa, Homo Sapiens
LEDGEEGGG

SEQ ID NO: 1290962 - protein, 9 aa, Homo Sapiens
GPYCTEKSF

SEQ ID NO: 1290963 - protein, 9 aa, Homo Sapiens
TVLGKASVY

SEQ ID NO: 1290964 - protein, 9 aa, Homo Sapiens
SHTQRSDKN

SEQ ID NO: 1290965 - protein, 9 aa, Homo Sapiens
ILLMERIAW

SEQ ID NO: 1290966 - protein, 9 aa, Homo Sapiens
GVCCEPATC

SEQ ID NO: 1290967 - protein, 9 aa, Homo Sapiens
IARGVALRG

SEQ ID NO: 1290968 - protein, 9 aa, Homo Sapiens
APGRTAASQ

SEQ ID NO: 1290969 - protein, 9 aa, Homo Sapiens
VFLYMWSFC

SEQ ID NO: 1290970 - protein, 9 aa, Homo Sapiens
CLQGTRSLT

SEQ ID NO: 1290971 - protein, 9 aa, Homo Sapiens
LHGDTEALV

SEQ ID NO: 1290972 - protein, 9 aa, Homo Sapiens
GHSGNLPHP

SEQ ID NO: 1290973 - protein, 9 aa, Homo Sapiens
HQEPVNFIT

SEQ ID NO: 1290974 - protein, 9 aa, Homo Sapiens
TYECGQCGK

SEQ ID NO: 1290975 - protein, 9 aa, Homo Sapiens
KSLNRVHLL

SEQ ID NO: 1290976 - protein, 9 aa, Homo Sapiens
VDPNSGYNA

SEQ ID NO: 1290977 - protein, 9 aa, Homo Sapiens
PMMSSMACG

SEQ ID NO: 1290978 - protein, 9 aa, Homo Sapiens
AAGAGPPAA

SEQ ID NO: 1290979 - protein, 9 aa, Homo Sapiens
PNMLKFIGV

SEQ ID NO: 1290980 - protein, 9 aa, Homo Sapiens
RATVPRHSS

SEQ ID NO: 1290981 - protein, 9 aa, Homo Sapiens
KSKVLIYRS

SEQ ID NO: 1290982 - protein, 9 aa, Homo Sapiens
PHADPAAQG

SEQ ID NO: 1290983 - protein, 9 aa, Homo Sapiens
TLNLLYTLV

SEQ ID NO: 1290984 - protein, 9 aa, Homo Sapiens
TRVRDANPE

SEQ ID NO: 1290985 - protein, 9 aa, Homo Sapiens
YCITEFGVE

SEQ ID NO: 1290986 - protein, 9 aa, Homo Sapiens
EGEKQRSWT

SEQ ID NO: 1290987 - protein, 9 aa, Homo Sapiens
EPRRLSFWS

SEQ ID NO: 1290988 - protein, 9 aa, Homo Sapiens
PRTRTCPSP

SEQ ID NO: 1290989 - protein, 9 aa, Homo Sapiens
PPSPTMPPP

SEQ ID NO: 1290990 - protein, 9 aa, Homo Sapiens
APQTETRAP

SEQ ID NO: 1290991 - protein, 9 aa, Homo Sapiens
DTKYFRFVV

SEQ ID NO: 1290992 - protein, 9 aa, Homo Sapiens
STPASQSFG

SEQ ID NO: 1290993 - protein, 9 aa, Homo Sapiens
AVSQASELA

SEQ ID NO: 1290994 - protein, 9 aa, Homo Sapiens
ALVGAAGKG

SEQ ID NO: 1290995 - protein, 9 aa, Homo Sapiens
GALLLFGLR

SEQ ID NO: 1290996 - protein, 9 aa, Homo Sapiens
EGGGVPLAP

SEQ ID NO: 1290997 - protein, 9 aa, Homo Sapiens
CDKKRGASS

SEQ ID NO: 1290998 - protein, 9 aa, Homo Sapiens
NKRRSTLTT

SEQ ID NO: 1290999 - protein, 9 aa, Homo Sapiens
LMAVLCKRM

SEQ ID NO: 1291000 - protein, 9 aa, Homo Sapiens
STAWSGSRG

SEQ ID NO: 1291001 - protein, 9 aa, Homo Sapiens
EVKHGALPS

SEQ ID NO: 1291002 - protein, 9 aa, Homo Sapiens
VHNNHGSSI

SEQ ID NO: 1291003 - protein, 9 aa, Homo Sapiens
YRYGPASTM

SEQ ID NO: 1291004 - protein, 9 aa, Homo Sapiens
RPMFDFQGL

SEQ ID NO: 1291005 - protein, 9 aa, Homo Sapiens
GLMSRPSQV

SEQ ID NO: 1291006 - protein, 9 aa, Homo Sapiens
KSMEKEKMK

SEQ ID NO: 1291007 - protein, 9 aa, Homo Sapiens
CLRALGGPR

SEQ ID NO: 1291008 - protein, 9 aa, Homo Sapiens
TFFIISKGM

SEQ ID NO: 1291009 - protein, 9 aa, Homo Sapiens
WALAPARPC

SEQ ID NO: 1291010 - protein, 9 aa, Homo Sapiens
KIWLDDVFC

SEQ ID NO: 1291011 - protein, 9 aa, Homo Sapiens
HIVGSKPLH

SEQ ID NO: 1291012 - protein, 9 aa, Homo Sapiens
ILQTPGGKP

SEQ ID NO: 1291013 - protein, 9 aa, Homo Sapiens
PPSEGSHHI

SEQ ID NO: 1291014 - protein, 9 aa, Homo Sapiens
RTERGCAFV

SEQ ID NO: 1291015 - protein, 9 aa, Homo Sapiens
TQVKEVKEN

SEQ ID NO: 1291016 - protein, 9 aa, Homo Sapiens
GRRRPGRGA

SEQ ID NO: 1291017 - protein, 9 aa, Homo Sapiens
RHQYLQSEW

SEQ ID NO: 1291018 - protein, 9 aa, Homo Sapiens
TFPQESCLM

SEQ ID NO: 1291019 - protein, 9 aa, Homo Sapiens
PVGLRGAVE

SEQ ID NO: 1291020 - protein, 9 aa, Homo Sapiens
SGRKPRCTQ

SEQ ID NO: 1291021 - protein, 9 aa, Homo Sapiens
TCLEQGKNP

SEQ ID NO: 1291022 - protein, 9 aa, Homo Sapiens
RFFAHLLVY

SEQ ID NO: 1291023 - protein, 9 aa, Homo Sapiens
AVEASELCL

SEQ ID NO: 1291024 - protein, 9 aa, Homo Sapiens
LSTLSDPLY

SEQ ID NO: 1291025 - protein, 9 aa, Homo Sapiens
MTVIAGAHH

SEQ ID NO: 1291026 - protein, 9 aa, Homo Sapiens
NFITFLEWK

SEQ ID NO: 1291027 - protein, 9 aa, Homo Sapiens
RGPKRQRWR

SEQ ID NO: 1291028 - protein, 9 aa, Homo Sapiens
TYVGLQLVV

SEQ ID NO: 1291029 - protein, 9 aa, Homo Sapiens
TSKADLESI

SEQ ID NO: 1291030 - protein, 9 aa, Homo Sapiens
RSGADRSPV

SEQ ID NO: 1291031 - protein, 9 aa, Homo Sapiens
KLWQIPEGE

SEQ ID NO: 1291032 - protein, 9 aa, Homo Sapiens
KCRLEAHAP

SEQ ID NO: 1291033 - protein, 9 aa, Homo Sapiens
GNIVVYHVI

SEQ ID NO: 1291034 - protein, 9 aa, Homo Sapiens
DHLCHIIEK

SEQ ID NO: 1291035 - protein, 9 aa, Homo Sapiens
HWSLMSEKN

SEQ ID NO: 1291036 - protein, 9 aa, Homo Sapiens
HGDLWGGNI

SEQ ID NO: 1291037 - protein, 9 aa, Homo Sapiens
GDVLGSQVI

SEQ ID NO: 1291038 - protein, 9 aa, Homo Sapiens
VPPEGRHRP

SEQ ID NO: 1291039 - protein, 9 aa, Homo Sapiens
EMLYLSALW

SEQ ID NO: 1291040 - protein, 9 aa, Homo Sapiens
WKALLIPLP

SEQ ID NO: 1291041 - protein, 9 aa, Homo Sapiens
WNTMQWNNK

SEQ ID NO: 1291042 - protein, 9 aa, Homo Sapiens
VTHSVHSRV

SEQ ID NO: 1291043 - protein, 9 aa, Homo Sapiens
LLAARVVEL

SEQ ID NO: 1291044 - protein, 9 aa, Homo Sapiens
IHPVKERLF

SEQ ID NO: 1291045 - protein, 9 aa, Homo Sapiens
CPRRLPMSF

SEQ ID NO: 1291046 - protein, 9 aa, Homo Sapiens
TEPPAIVEG

SEQ ID NO: 1291047 - protein, 9 aa, Homo Sapiens
PCRGRSSME

SEQ ID NO: 1291048 - protein, 9 aa, Homo Sapiens
VMEFLNGGT

SEQ ID NO: 1291049 - protein, 9 aa, Homo Sapiens
LEEVRKKDT

SEQ ID NO: 1291050 - protein, 9 aa, Homo Sapiens
KGPMGVLLP

SEQ ID NO: 1291051 - protein, 9 aa, Homo Sapiens
PANGAPPPS

SEQ ID NO: 1291052 - protein, 9 aa, Homo Sapiens
KVSWYSHQK

SEQ ID NO: 1291053 - protein, 9 aa, Homo Sapiens
SAKSGSTAS

SEQ ID NO: 1291054 - protein, 9 aa, Homo Sapiens
SFLLTKPLS

SEQ ID NO: 1291055 - protein, 9 aa, Homo Sapiens
VRFLDSLQD

SEQ ID NO: 1291056 - protein, 9 aa, Homo Sapiens
TAQLRASWS

SEQ ID NO: 1291057 - protein, 9 aa, Homo Sapiens
PWRPRATAV

SEQ ID NO: 1291058 - protein, 9 aa, Homo Sapiens
LGRREQRAR

SEQ ID NO: 1291059 - protein, 9 aa, Homo Sapiens
SWGRPSPWK

SEQ ID NO: 1291060 - protein, 9 aa, Homo Sapiens
DPPGMTGLN

SEQ ID NO: 1291061 - protein, 9 aa, Homo Sapiens
IACLLSVHK

SEQ ID NO: 1291062 - protein, 9 aa, Homo Sapiens
CSILARLVA

SEQ ID NO: 1291063 - protein, 9 aa, Homo Sapiens
GVGEHALGR

SEQ ID NO: 1291064 - protein, 9 aa, Homo Sapiens
HIFVIIVSI

SEQ ID NO: 1291065 - protein, 9 aa, Homo Sapiens
GENHVVKMA

SEQ ID NO: 1291066 - protein, 9 aa, Homo Sapiens
QIDTKPEVP

SEQ ID NO: 1291067 - protein, 9 aa, Homo Sapiens
SRLPWEIPG

SEQ ID NO: 1291068 - protein, 9 aa, Homo Sapiens
FFIISKGMV

SEQ ID NO: 1291069 - protein, 9 aa, Homo Sapiens
ATQASMTLP

SEQ ID NO: 1291070 - protein, 9 aa, Homo Sapiens
ALRAQRAGA

SEQ ID NO: 1291071 - protein, 9 aa, Homo Sapiens
RGLVKLGTV

SEQ ID NO: 1291072 - protein, 9 aa, Homo Sapiens
RLRLDRLLP

SEQ ID NO: 1291073 - protein, 9 aa, Homo Sapiens
NSSHIYYEN

SEQ ID NO: 1291074 - protein, 9 aa, Homo Sapiens
GNGWWGQKT

SEQ ID NO: 1291075 - protein, 9 aa, Homo Sapiens
PSSRGMGRR

SEQ ID NO: 1291076 - protein, 9 aa, Homo Sapiens
RHIRKLWQI

SEQ ID NO: 1291077 - protein, 9 aa, Homo Sapiens
RPRACSLHT

SEQ ID NO: 1291078 - protein, 9 aa, Homo Sapiens
PNGNTTGKN

SEQ ID NO: 1291079 - protein, 9 aa, Homo Sapiens
PPEDERHPG

SEQ ID NO: 1291080 - protein, 9 aa, Homo Sapiens
AVDPNSGYN

SEQ ID NO: 1291081 - protein, 9 aa, Homo Sapiens
THLAEVCQL

SEQ ID NO: 1291082 - protein, 9 aa, Homo Sapiens
SPLWLMTAM

SEQ ID NO: 1291083 - protein, 9 aa, Homo Sapiens
DFPPIGAFP

SEQ ID NO: 1291084 - protein, 9 aa, Homo Sapiens
ARKRVITTY

SEQ ID NO: 1291085 - protein, 9 aa, Homo Sapiens
FISDLSISY

SEQ ID NO: 1291086 - protein, 9 aa, Homo Sapiens
LGRIVHAEV

SEQ ID NO: 1291087 - protein, 9 aa, Homo Sapiens
RMNQVPTVG

SEQ ID NO: 1291088 - protein, 9 aa, Homo Sapiens
HSQREPAHP

SEQ ID NO: 1291089 - protein, 9 aa, Homo Sapiens
QRPPWRTSR

SEQ ID NO: 1291090 - protein, 9 aa, Homo Sapiens
VTVRGATSY

SEQ ID NO: 1291091 - protein, 9 aa, Homo Sapiens
YVENIFHNF

SEQ ID NO: 1291092 - protein, 9 aa, Homo Sapiens
AGVGKSALT

SEQ ID NO: 1291093 - protein, 9 aa, Homo Sapiens
INIRMLDPF

SEQ ID NO: 1291094 - protein, 9 aa, Homo Sapiens
ALMVLNMAL

SEQ ID NO: 1291095 - protein, 9 aa, Homo Sapiens
ALTRTAMYT

SEQ ID NO: 1291096 - protein, 9 aa, Homo Sapiens
LVRILVSDS

SEQ ID NO: 1291097 - protein, 9 aa, Homo Sapiens
FEAWLLLLL

SEQ ID NO: 1291098 - protein, 9 aa, Homo Sapiens
KSCSCMCLQ

SEQ ID NO: 1291099 - protein, 9 aa, Homo Sapiens
VSPYHGKRD

SEQ ID NO: 1291100 - protein, 9 aa, Homo Sapiens
GPGDFRRYR

SEQ ID NO: 1291101 - protein, 9 aa, Homo Sapiens
FLPPKAPPL

SEQ ID NO: 1291102 - protein, 9 aa, Homo Sapiens
EAIEHGLGD

SEQ ID NO: 1291103 - protein, 9 aa, Homo Sapiens
SPFMLYPLQ

SEQ ID NO: 1291104 - protein, 9 aa, Homo Sapiens
KKILNCIWK

SEQ ID NO: 1291105 - protein, 9 aa, Homo Sapiens
AVPQITSPP

SEQ ID NO: 1291106 - protein, 9 aa, Homo Sapiens
CTEKSFSEK

SEQ ID NO: 1291107 - protein, 9 aa, Homo Sapiens
KKKNKWNAM

SEQ ID NO: 1291108 - protein, 9 aa, Homo Sapiens
PENLKTHQT

SEQ ID NO: 1291109 - protein, 9 aa, Homo Sapiens
ACSKNCLCT

SEQ ID NO: 1291110 - protein, 9 aa, Homo Sapiens
MSPSPYTVP

SEQ ID NO: 1291111 - protein, 9 aa, Homo Sapiens
SRRSPAQPT

SEQ ID NO: 1291112 - protein, 9 aa, Homo Sapiens
TYRCMDCVF

SEQ ID NO: 1291113 - protein, 9 aa, Homo Sapiens
RVCAEKWNL

SEQ ID NO: 1291114 - protein, 9 aa, Homo Sapiens
AENSTGRND

SEQ ID NO: 1291115 - protein, 9 aa, Homo Sapiens
PCPPGRCWA

SEQ ID NO: 1291116 - protein, 9 aa, Homo Sapiens
VMLTYKQKR

SEQ ID NO: 1291117 - protein, 9 aa, Homo Sapiens
QQQQGQAHQ

SEQ ID NO: 1291118 - protein, 9 aa, Homo Sapiens
LDHPDHVLL

SEQ ID NO: 1291119 - protein, 9 aa, Homo Sapiens
DEKPASMPW

SEQ ID NO: 1291120 - protein, 9 aa, Homo Sapiens
PLFLTGAYI

SEQ ID NO: 1291121 - protein, 9 aa, Homo Sapiens
VPPDGVGAA

SEQ ID NO: 1291122 - protein, 9 aa, Homo Sapiens
VIARGVALR

SEQ ID NO: 1291123 - protein, 9 aa, Homo Sapiens
MNVNIRDID

SEQ ID NO: 1291124 - protein, 9 aa, Homo Sapiens
RRPRPRRAW

SEQ ID NO: 1291125 - protein, 9 aa, Homo Sapiens
LLRPRGGAW

SEQ ID NO: 1291126 - protein, 9 aa, Homo Sapiens
KMLENRKSV

SEQ ID NO: 1291127 - protein, 9 aa, Homo Sapiens
FLLQEEKGL

SEQ ID NO: 1291128 - protein, 9 aa, Homo Sapiens
TIHECDEGF

SEQ ID NO: 1291129 - protein, 9 aa, Homo Sapiens
RGSPLCMAP

SEQ ID NO: 1291130 - protein, 9 aa, Homo Sapiens
PVCCPRAPE

SEQ ID NO: 1291131 - protein, 9 aa, Homo Sapiens
LWQVPAAGV

SEQ ID NO: 1291132 - protein, 9 aa, Homo Sapiens
ATAATATAA

SEQ ID NO: 1291133 - protein, 9 aa, Homo Sapiens
LLSEFSPDS

SEQ ID NO: 1291134 - protein, 9 aa, Homo Sapiens
LVNPSFLSV

SEQ ID NO: 1291135 - protein, 9 aa, Homo Sapiens
GLVHNGWGD

SEQ ID NO: 1291136 - protein, 9 aa, Homo Sapiens
IRALMSKVE

SEQ ID NO: 1291137 - protein, 9 aa, Homo Sapiens
VGAAVADGD

SEQ ID NO: 1291138 - protein, 9 aa, Homo Sapiens
SISMPTMRN

SEQ ID NO: 1291139 - protein, 9 aa, Homo Sapiens
IILINCCTL

SEQ ID NO: 1291140 - protein, 9 aa, Homo Sapiens
SRALVPGSS

SEQ ID NO: 1291141 - protein, 9 aa, Homo Sapiens
VTITNNFGS

SEQ ID NO: 1291142 - protein, 9 aa, Homo Sapiens
PPCGRWKPV

SEQ ID NO: 1291143 - protein, 9 aa, Homo Sapiens
EKPASMPWG

SEQ ID NO: 1291144 - protein, 9 aa, Homo Sapiens
TVPHSLLFR

SEQ ID NO: 1291145 - protein, 9 aa, Homo Sapiens
KQVSQERKF

SEQ ID NO: 1291146 - protein, 9 aa, Homo Sapiens
ANQQRKWCS

SEQ ID NO: 1291147 - protein, 9 aa, Homo Sapiens
KMMIGSQHL

SEQ ID NO: 1291148 - protein, 9 aa, Homo Sapiens
NKALILSSV

SEQ ID NO: 1291149 - protein, 9 aa, Homo Sapiens
LAPGESHRG

SEQ ID NO: 1291150 - protein, 9 aa, Homo Sapiens
STLARTGFL

SEQ ID NO: 1291151 - protein, 9 aa, Homo Sapiens
EQGQGQGEP

SEQ ID NO: 1291152 - protein, 9 aa, Homo Sapiens
SQREPAHPH

SEQ ID NO: 1291153 - protein, 9 aa, Homo Sapiens
RREKTVRNT

SEQ ID NO: 1291154 - protein, 9 aa, Homo Sapiens
LATGLHLHR

SEQ ID NO: 1291155 - protein, 9 aa, Homo Sapiens
TEKSFSEKG

SEQ ID NO: 1291156 - protein, 9 aa, Homo Sapiens
EAVLPQAVS

SEQ ID NO: 1291157 - protein, 9 aa, Homo Sapiens
GFGGGQSSC

SEQ ID NO: 1291158 - protein, 9 aa, Homo Sapiens
NSLAKPLLS

SEQ ID NO: 1291159 - protein, 9 aa, Homo Sapiens
LQVLEVGAD

SEQ ID NO: 1291160 - protein, 9 aa, Homo Sapiens
FVDNKALIL

SEQ ID NO: 1291161 - protein, 9 aa, Homo Sapiens
HILPVLFTL

SEQ ID NO: 1291162 - protein, 9 aa, Homo Sapiens
AAPMMSSMA

SEQ ID NO: 1291163 - protein, 9 aa, Homo Sapiens
CRRHCPRCP

SEQ ID NO: 1291164 - protein, 9 aa, Homo Sapiens
QSSGAQHQS

SEQ ID NO: 1291165 - protein, 9 aa, Homo Sapiens
SGPQVLMMG

SEQ ID NO: 1291166 - protein, 9 aa, Homo Sapiens
SSGCPAGCW

SEQ ID NO: 1291167 - protein, 9 aa, Homo Sapiens
QTLKKEKSK

SEQ ID NO: 1291168 - protein, 9 aa, Homo Sapiens
QRPAVFYTF

SEQ ID NO: 1291169 - protein, 9 aa, Homo Sapiens
WLGSHFPDS

SEQ ID NO: 1291170 - protein, 9 aa, Homo Sapiens
AEKKAEPSP

SEQ ID NO: 1291171 - protein, 9 aa, Homo Sapiens
NGWWGQKTK

SEQ ID NO: 1291172 - protein, 9 aa, Homo Sapiens
DKLVHLVIR

SEQ ID NO: 1291173 - protein, 9 aa, Homo Sapiens
CLEHPNMLK

SEQ ID NO: 1291174 - protein, 9 aa, Homo Sapiens
NGNTTGKNS

SEQ ID NO: 1291175 - protein, 9 aa, Homo Sapiens
APEQRVGHR

SEQ ID NO: 1291176 - protein, 9 aa, Homo Sapiens
VPVARTGIL

SEQ ID NO: 1291177 - protein, 9 aa, Homo Sapiens
SPEPDSLLG

SEQ ID NO: 1291178 - protein, 9 aa, Homo Sapiens
HLKNTYVGL

SEQ ID NO: 1291179 - protein, 9 aa, Homo Sapiens
RALMSKVER

SEQ ID NO: 1291180 - protein, 9 aa, Homo Sapiens
CCSTMGWCP

SEQ ID NO: 1291181 - protein, 9 aa, Homo Sapiens
NWKKMMIGS

SEQ ID NO: 1291182 - protein, 9 aa, Homo Sapiens
LECQASGPQ

SEQ ID NO: 1291183 - protein, 9 aa, Homo Sapiens
GPAPWWHPG

SEQ ID NO: 1291184 - protein, 9 aa, Homo Sapiens
LDWVAETKR

SEQ ID NO: 1291185 - protein, 9 aa, Homo Sapiens
SKRMSYELS

SEQ ID NO: 1291186 - protein, 9 aa, Homo Sapiens
CVWAGQPGP

SEQ ID NO: 1291187 - protein, 9 aa, Homo Sapiens
RMHELEQQN

SEQ ID NO: 1291188 - protein, 9 aa, Homo Sapiens
VLGMLGEGG

SEQ ID NO: 1291189 - protein, 9 aa, Homo Sapiens
RKPRCTQEL

SEQ ID NO: 1291190 - protein, 9 aa, Homo Sapiens
EAKTYRCMD

SEQ ID NO: 1291191 - protein, 9 aa, Homo Sapiens
FTAKRRKPC

SEQ ID NO: 1291192 - protein, 9 aa, Homo Sapiens
GLTGTGKTL

SEQ ID NO: 1291193 - protein, 9 aa, Homo Sapiens
EEAPTGWDK

SEQ ID NO: 1291194 - protein, 9 aa, Homo Sapiens
RPRGGAWKS

SEQ ID NO: 1291195 - protein, 9 aa, Homo Sapiens
KDIDGKNDI

SEQ ID NO: 1291196 - protein, 9 aa, Homo Sapiens
QVENPNSLL

SEQ ID NO: 1291197 - protein, 9 aa, Homo Sapiens
APGQSSGAQ

SEQ ID NO: 1291198 - protein, 9 aa, Homo Sapiens
ENMNIFFSS

SEQ ID NO: 1291199 - protein, 9 aa, Homo Sapiens
KLEEYYELR

SEQ ID NO: 1291200 - protein, 9 aa, Homo Sapiens
ARHKFENKI

SEQ ID NO: 1291201 - protein, 9 aa, Homo Sapiens
HDINGIQAK

SEQ ID NO: 1291202 - protein, 9 aa, Homo Sapiens
PQRDGSYGS

SEQ ID NO: 1291203 - protein, 9 aa, Homo Sapiens
NSRGPKRQR

SEQ ID NO: 1291204 - protein, 9 aa, Homo Sapiens
SRLTDYYEP

SEQ ID NO: 1291205 - protein, 9 aa, Homo Sapiens
TCSLSSRWT

SEQ ID NO: 1291206 - protein, 9 aa, Homo Sapiens
VNSHTQRSD

SEQ ID NO: 1291207 - protein, 9 aa, Homo Sapiens
KRRGRPPGE

SEQ ID NO: 1291208 - protein, 9 aa, Homo Sapiens
NIRQRVYDA

SEQ ID NO: 1291209 - protein, 9 aa, Homo Sapiens
FNDAPLGLP

SEQ ID NO: 1291210 - protein, 9 aa, Homo Sapiens
GLVAMLQGM

SEQ ID NO: 1291211 - protein, 9 aa, Homo Sapiens
CSLHTAPAS

SEQ ID NO: 1291212 - protein, 9 aa, Homo Sapiens
RSWNTMQWN

SEQ ID NO: 1291213 - protein, 9 aa, Homo Sapiens
GGVTTTQWS

SEQ ID NO: 1291214 - protein, 9 aa, Homo Sapiens
PPRGDHRSN

SEQ ID NO: 1291215 - protein, 9 aa, Homo Sapiens
KSATPATDG

SEQ ID NO: 1291216 - protein, 9 aa, Homo Sapiens
QDFNDPSQD

SEQ ID NO: 1291217 - protein, 9 aa, Homo Sapiens
FSRSPPTLM

SEQ ID NO: 1291218 - protein, 9 aa, Homo Sapiens
NKDFGSIFL

SEQ ID NO: 1291219 - protein, 9 aa, Homo Sapiens
PYQCGEYGK

SEQ ID NO: 1291220 - protein, 9 aa, Homo Sapiens
HVEAAQFQE

SEQ ID NO: 1291221 - protein, 9 aa, Homo Sapiens
LKTHQTFPS

SEQ ID NO: 1291222 - protein, 9 aa, Homo Sapiens
TAVTWTQTQ

SEQ ID NO: 1291223 - protein, 9 aa, Homo Sapiens
AVFTFMWLV

SEQ ID NO: 1291224 - protein, 9 aa, Homo Sapiens
VYNAGTNIL

SEQ ID NO: 1291225 - protein, 9 aa, Homo Sapiens
EPSPSKPTV

SEQ ID NO: 1291226 - protein, 9 aa, Homo Sapiens
SSRWTTRPC

SEQ ID NO: 1291227 - protein, 9 aa, Homo Sapiens
CPMTACSIL

SEQ ID NO: 1291228 - protein, 9 aa, Homo Sapiens
RGASSSTSR

SEQ ID NO: 1291229 - protein, 9 aa, Homo Sapiens
NQQGVEIHI

SEQ ID NO: 1291230 - protein, 9 aa, Homo Sapiens
MDLSEFMSP

SEQ ID NO: 1291231 - protein, 9 aa, Homo Sapiens
KLKECLHQL

SEQ ID NO: 1291232 - protein, 9 aa, Homo Sapiens
MRYLCSQCL

SEQ ID NO: 1291233 - protein, 9 aa, Homo Sapiens
TAMWLSASH

SEQ ID NO: 1291234 - protein, 9 aa, Homo Sapiens
RSLREIDHD

SEQ ID NO: 1291235 - protein, 9 aa, Homo Sapiens
KNKWNAMVV

SEQ ID NO: 1291236 - protein, 9 aa, Homo Sapiens
TPDEPQKSS

SEQ ID NO: 1291237 - protein, 9 aa, Homo Sapiens
NPLQFYVNY

SEQ ID NO: 1291238 - protein, 9 aa, Homo Sapiens
GSNGAGRQA

SEQ ID NO: 1291239 - protein, 9 aa, Homo Sapiens
TQITVSLSS

SEQ ID NO: 1291240 - protein, 9 aa, Homo Sapiens
CPRLRLPLP

SEQ ID NO: 1291241 - protein, 9 aa, Homo Sapiens
SQHILPVLF

SEQ ID NO: 1291242 - protein, 9 aa, Homo Sapiens
GTGIVILGY

SEQ ID NO: 1291243 - protein, 9 aa, Homo Sapiens
PGSSPRGSR

SEQ ID NO: 1291244 - protein, 9 aa, Homo Sapiens
HELQVPQVI

SEQ ID NO: 1291245 - protein, 9 aa, Homo Sapiens
DLLESNSDS

SEQ ID NO: 1291246 - protein, 9 aa, Homo Sapiens
LSSGLGSEV

SEQ ID NO: 1291247 - protein, 9 aa, Homo Sapiens
EIGTTDIVS

SEQ ID NO: 1291248 - protein, 9 aa, Homo Sapiens
QDQACVPPE

SEQ ID NO: 1291249 - protein, 9 aa, Homo Sapiens
RTLPAFTLG

SEQ ID NO: 1291250 - protein, 9 aa, Homo Sapiens
ENFENKEKK

SEQ ID NO: 1291251 - protein, 9 aa, Homo Sapiens
GCQGRPRGA

SEQ ID NO: 1291252 - protein, 9 aa, Homo Sapiens
HPHGKRCNP

SEQ ID NO: 1291253 - protein, 9 aa, Homo Sapiens
EHHVEAAQF

SEQ ID NO: 1291254 - protein, 9 aa, Homo Sapiens
SITKQKNPT

SEQ ID NO: 1291255 - protein, 9 aa, Homo Sapiens
LPPKAPPLV

SEQ ID NO: 1291256 - protein, 9 aa, Homo Sapiens
LLKSCSCMC

SEQ ID NO: 1291257 - protein, 9 aa, Homo Sapiens
GADKQVSQE

SEQ ID NO: 1291258 - protein, 9 aa, Homo Sapiens
RLVATPALP

SEQ ID NO: 1291259 - protein, 9 aa, Homo Sapiens
SAVTGTLAD

SEQ ID NO: 1291260 - protein, 9 aa, Homo Sapiens
QGMKARNLI

SEQ ID NO: 1291261 - protein, 9 aa, Homo Sapiens
KSPGGGRVW

SEQ ID NO: 1291262 - protein, 9 aa, Homo Sapiens
LNWKEPLDS

SEQ ID NO: 1291263 - protein, 9 aa, Homo Sapiens
VDGRKKKNK

SEQ ID NO: 1291264 - protein, 9 aa, Homo Sapiens
QPARVCERC

SEQ ID NO: 1291265 - protein, 9 aa, Homo Sapiens
LTTVLNISE

SEQ ID NO: 1291266 - protein, 9 aa, Homo Sapiens
ERKFTVRHV

SEQ ID NO: 1291267 - protein, 9 aa, Homo Sapiens
DPPSGTPPS

SEQ ID NO: 1291268 - protein, 9 aa, Homo Sapiens
PGSPRLCAT

SEQ ID NO: 1291269 - protein, 9 aa, Homo Sapiens
PCRRSSSAW

SEQ ID NO: 1291270 - protein, 9 aa, Homo Sapiens
WWATVSIST

SEQ ID NO: 1291271 - protein, 9 aa, Homo Sapiens
MSCVTIAND

SEQ ID NO: 1291272 - protein, 9 aa, Homo Sapiens
GKKEDMLDW

SEQ ID NO: 1291273 - protein, 9 aa, Homo Sapiens
MAPETTLWL

SEQ ID NO: 1291274 - protein, 9 aa, Homo Sapiens
EVEWEVKKE

SEQ ID NO: 1291275 - protein, 9 aa, Homo Sapiens
GLRKARMEG

SEQ ID NO: 1291276 - protein, 9 aa, Homo Sapiens
RHLKNTYVG

SEQ ID NO: 1291277 - protein, 9 aa, Homo Sapiens
QYLQSEWTQ

SEQ ID NO: 1291278 - protein, 9 aa, Homo Sapiens
NIVRFYDSL

SEQ ID NO: 1291279 - protein, 9 aa, Homo Sapiens
PGVGPGPHA

SEQ ID NO: 1291280 - protein, 9 aa, Homo Sapiens
KTHQTFPSG

SEQ ID NO: 1291281 - protein, 9 aa, Homo Sapiens
SKRPGTSQA

SEQ ID NO: 1291282 - protein, 9 aa, Homo Sapiens
DEPQKSSLS

SEQ ID NO: 1291283 - protein, 9 aa, Homo Sapiens
DAKYLNMYS

SEQ ID NO: 1291284 - protein, 9 aa, Homo Sapiens
RVETRPNYC

SEQ ID NO: 1291285 - protein, 9 aa, Homo Sapiens
SSFPETNSG

SEQ ID NO: 1291286 - protein, 9 aa, Homo Sapiens
GQAQDTSGH

SEQ ID NO: 1291287 - protein, 9 aa, Homo Sapiens
RPLVERFTF

SEQ ID NO: 1291288 - protein, 9 aa, Homo Sapiens
ATDDDEDDD

SEQ ID NO: 1291289 - protein, 9 aa, Homo Sapiens
PLPPPEDER

SEQ ID NO: 1291290 - protein, 9 aa, Homo Sapiens
ASLAEIAGC

SEQ ID NO: 1291291 - protein, 9 aa, Homo Sapiens
TSSRSLKSR

SEQ ID NO: 1291292 - protein, 9 aa, Homo Sapiens
RGQPRLLHV

SEQ ID NO: 1291293 - protein, 9 aa, Homo Sapiens
VPRHSSVLA

SEQ ID NO: 1291294 - protein, 9 aa, Homo Sapiens
RGATSYRCG

SEQ ID NO: 1291295 - protein, 9 aa, Homo Sapiens
VPPVRHRTL

SEQ ID NO: 1291296 - protein, 9 aa, Homo Sapiens
QCGTMWSWG

SEQ ID NO: 1291297 - protein, 9 aa, Homo Sapiens
DGVILGVEE

SEQ ID NO: 1291298 - protein, 9 aa, Homo Sapiens
VHHDDYLDR

SEQ ID NO: 1291299 - protein, 9 aa, Homo Sapiens
KSFAEGQIS

SEQ ID NO: 1291300 - protein, 9 aa, Homo Sapiens
VTQQKAANR

SEQ ID NO: 1291301 - protein, 9 aa, Homo Sapiens
VQARWSVRT

SEQ ID NO: 1291302 - protein, 9 aa, Homo Sapiens
QRAGALIAH

SEQ ID NO: 1291303 - protein, 9 aa, Homo Sapiens
PQTETRAPT

SEQ ID NO: 1291304 - protein, 9 aa, Homo Sapiens
EVLGLALQP

SEQ ID NO: 1291305 - protein, 9 aa, Homo Sapiens
VEVTDGSHT

SEQ ID NO: 1291306 - protein, 9 aa, Homo Sapiens
YYHSPADSS

SEQ ID NO: 1291307 - protein, 9 aa, Homo Sapiens
GARRGQGAV

SEQ ID NO: 1291308 - protein, 9 aa, Homo Sapiens
QTETRAPTP

SEQ ID NO: 1291309 - protein, 9 aa, Homo Sapiens
RCMDCVFEA

SEQ ID NO: 1291310 - protein, 9 aa, Homo Sapiens
EPGSNGAGR

SEQ ID NO: 1291311 - protein, 9 aa, Homo Sapiens
LMVLNMALA

SEQ ID NO: 1291312 - protein, 9 aa, Homo Sapiens
KVWKMNWKK

SEQ ID NO: 1291313 - protein, 9 aa, Homo Sapiens
QIHSQETTY

SEQ ID NO: 1291314 - protein, 9 aa, Homo Sapiens
RDALTEPPA

SEQ ID NO: 1291315 - protein, 9 aa, Homo Sapiens
VKTLGTLVS

SEQ ID NO: 1291316 - protein, 9 aa, Homo Sapiens
VRKKDTVQL

SEQ ID NO: 1291317 - protein, 9 aa, Homo Sapiens
SPGRAPPTP

SEQ ID NO: 1291318 - protein, 9 aa, Homo Sapiens
VYHVIVPCS

SEQ ID NO: 1291319 - protein, 9 aa, Homo Sapiens
DQVLCGGRV

SEQ ID NO: 1291320 - protein, 9 aa, Homo Sapiens
YNLKNSSHI

SEQ ID NO: 1291321 - protein, 9 aa, Homo Sapiens
APGSPRLCA

SEQ ID NO: 1291322 - protein, 9 aa, Homo Sapiens
RVRDANPEK

SEQ ID NO: 1291323 - protein, 9 aa, Homo Sapiens
SLVDYSQNV

SEQ ID NO: 1291324 - protein, 9 aa, Homo Sapiens
GSSPRGSRP

SEQ ID NO: 1291325 - protein, 9 aa, Homo Sapiens
TAPPCTSAA

SEQ ID NO: 1291326 - protein, 9 aa, Homo Sapiens
AFAVPGQLL

SEQ ID NO: 1291327 - protein, 9 aa, Homo Sapiens
GPVEDAEPD

SEQ ID NO: 1291328 - protein, 9 aa, Homo Sapiens
PDVWLEAQA

SEQ ID NO: 1291329 - protein, 9 aa, Homo Sapiens
PRVPDGVIL

SEQ ID NO: 1291330 - protein, 9 aa, Homo Sapiens
NTTGKNSRG

SEQ ID NO: 1291331 - protein, 9 aa, Homo Sapiens
GGQLSWGGR

SEQ ID NO: 1291332 - protein, 9 aa, Homo Sapiens
LRATVPRHS

SEQ ID NO: 1291333 - protein, 9 aa, Homo Sapiens
AAPGHVHLA

SEQ ID NO: 1291334 - protein, 9 aa, Homo Sapiens
YIGSLNKHT

SEQ ID NO: 1291335 - protein, 9 aa, Homo Sapiens
PSAVHEGHA

SEQ ID NO: 1291336 - protein, 9 aa, Homo Sapiens
CLSLGFSRT

SEQ ID NO: 1291337 - protein, 9 aa, Homo Sapiens
SWNESPLCG

SEQ ID NO: 1291338 - protein, 9 aa, Homo Sapiens
WNQQGVEIH

SEQ ID NO: 1291339 - protein, 9 aa, Homo Sapiens
TLITYISAL

SEQ ID NO: 1291340 - protein, 9 aa, Homo Sapiens
EEEAVPVQK

SEQ ID NO: 1291341 - protein, 9 aa, Homo Sapiens
AATAATATA

SEQ ID NO: 1291342 - protein, 9 aa, Homo Sapiens
RREQRARRA

SEQ ID NO: 1291343 - protein, 9 aa, Homo Sapiens
VDPFAMHFI

SEQ ID NO: 1291344 - protein, 9 aa, Homo Sapiens
VTALMVLNM

SEQ ID NO: 1291345 - protein, 9 aa, Homo Sapiens
VKLGTVERR

SEQ ID NO: 1291346 - protein, 9 aa, Homo Sapiens
RAAPGHVHL

SEQ ID NO: 1291347 - protein, 9 aa, Homo Sapiens
NMNIFFSSS

SEQ ID NO: 1291348 - protein, 9 aa, Homo Sapiens
WQIPEGEGA

SEQ ID NO: 1291349 - protein, 9 aa, Homo Sapiens
LVPGSSPRG

SEQ ID NO: 1291350 - protein, 9 aa, Homo Sapiens
GWHWGAAPM

SEQ ID NO: 1291351 - protein, 9 aa, Homo Sapiens
PNYCFLFLG

SEQ ID NO: 1291352 - protein, 9 aa, Homo Sapiens
GHWTSKSSV

SEQ ID NO: 1291353 - protein, 9 aa, Homo Sapiens
QVPQVIQDV

SEQ ID NO: 1291354 - protein, 9 aa, Homo Sapiens
QLEINGQNN

SEQ ID NO: 1291355 - protein, 9 aa, Homo Sapiens
TLIECECSE

SEQ ID NO: 1291356 - protein, 9 aa, Homo Sapiens
AALRAQRAG

SEQ ID NO: 1291357 - protein, 9 aa, Homo Sapiens
RVITTYQNI

SEQ ID NO: 1291358 - protein, 9 aa, Homo Sapiens
MVWSSRLPW

SEQ ID NO: 1291359 - protein, 9 aa, Homo Sapiens
AEPSPSKPT

SEQ ID NO: 1291360 - protein, 9 aa, Homo Sapiens
AVFSGSGRA

SEQ ID NO: 1291361 - protein, 9 aa, Homo Sapiens
CKSEECSQK

SEQ ID NO: 1291362 - protein, 9 aa, Homo Sapiens
HGLGDPLKR

SEQ ID NO: 1291363 - protein, 9 aa, Homo Sapiens
RKKKNKWNA

SEQ ID NO: 1291364 - protein, 9 aa, Homo Sapiens
WKEPLDSNG

SEQ ID NO: 1291365 - protein, 9 aa, Homo Sapiens
CCSSWTWCL

SEQ ID NO: 1291366 - protein, 9 aa, Homo Sapiens
KTVRNTEMD

SEQ ID NO: 1291367 - protein, 9 aa, Homo Sapiens
AQPPGPAPW

SEQ ID NO: 1291368 - protein, 9 aa, Homo Sapiens
DCFGLFSKI

SEQ ID NO: 1291369 - protein, 9 aa, Homo Sapiens
SCSERCAWQ

SEQ ID NO: 1291370 - protein, 9 aa, Homo Sapiens
LCPKTGWEK

SEQ ID NO: 1291371 - protein, 9 aa, Homo Sapiens
DLESILQTP

SEQ ID NO: 1291372 - protein, 9 aa, Homo Sapiens
TPNLLTGET

SEQ ID NO: 1291373 - protein, 9 aa, Homo Sapiens
SPAQPTMPG

SEQ ID NO: 1291374 - protein, 9 aa, Homo Sapiens
SPRRSPALR

SEQ ID NO: 1291375 - protein, 9 aa, Homo Sapiens
SPLLRPRGG

SEQ ID NO: 1291376 - protein, 9 aa, Homo Sapiens
HLLRPRRGR

SEQ ID NO: 1291377 - protein, 9 aa, Homo Sapiens
GSWVSCGTG

SEQ ID NO: 1291378 - protein, 9 aa, Homo Sapiens
VEVSITYQS

SEQ ID NO: 1291379 - protein, 9 aa, Homo Sapiens
WDCLHHHLY

SEQ ID NO: 1291380 - protein, 9 aa, Homo Sapiens
VHEGHAAEV

SEQ ID NO: 1291381 - protein, 9 aa, Homo Sapiens
MAPVGPPPS

SEQ ID NO: 1291382 - protein, 9 aa, Homo Sapiens
SLLNEQWVV

SEQ ID NO: 1291383 - protein, 9 aa, Homo Sapiens
LCGDVWWET

SEQ ID NO: 1291384 - protein, 9 aa, Homo Sapiens
LVSPYHGKR

SEQ ID NO: 1291385 - protein, 9 aa, Homo Sapiens
HHCQYKLTY

SEQ ID NO: 1291386 - protein, 9 aa, Homo Sapiens
APAVTHSEQ

SEQ ID NO: 1291387 - protein, 9 aa, Homo Sapiens
GSLCMLGCI

SEQ ID NO: 1291388 - protein, 9 aa, Homo Sapiens
KLVELRRRT

SEQ ID NO: 1291389 - protein, 9 aa, Homo Sapiens
MLCLHHQRV

SEQ ID NO: 1291390 - protein, 9 aa, Homo Sapiens
PGHPGVGPG

SEQ ID NO: 1291391 - protein, 9 aa, Homo Sapiens
TLGASWVEL

SEQ ID NO: 1291392 - protein, 9 aa, Homo Sapiens
EGLNDLRRQ

SEQ ID NO: 1291393 - protein, 9 aa, Homo Sapiens
HFQKDFLRP

SEQ ID NO: 1291394 - protein, 9 aa, Homo Sapiens
MLENRKSVV

SEQ ID NO: 1291395 - protein, 9 aa, Homo Sapiens
GEAVKTLKT

SEQ ID NO: 1291396 - protein, 9 aa, Homo Sapiens
LHHHLYPVI

SEQ ID NO: 1291397 - protein, 9 aa, Homo Sapiens
ATGSEDMCV

SEQ ID NO: 1291398 - protein, 9 aa, Homo Sapiens
NMFLILLQS

SEQ ID NO: 1291399 - protein, 9 aa, Homo Sapiens
SRSFFTSAH

SEQ ID NO: 1291400 - protein, 9 aa, Homo Sapiens
GWEKRKSPE

SEQ ID NO: 1291401 - protein, 9 aa, Homo Sapiens
FIERMHELE

SEQ ID NO: 1291402 - protein, 9 aa, Homo Sapiens
YHGKRDSVP

SEQ ID NO: 1291403 - protein, 9 aa, Homo Sapiens
LKKEKSKVL

SEQ ID NO: 1291404 - protein, 9 aa, Homo Sapiens
TLVTITNNF

SEQ ID NO: 1291405 - protein, 9 aa, Homo Sapiens
PAPWWHPGR

SEQ ID NO: 1291406 - protein, 9 aa, Homo Sapiens
IESDDAVVL

SEQ ID NO: 1291407 - protein, 9 aa, Homo Sapiens
DGRKKKNKW

SEQ ID NO: 1291408 - protein, 9 aa, Homo Sapiens
CAFQAPPSC

SEQ ID NO: 1291409 - protein, 9 aa, Homo Sapiens
RDRQQQQGQ

SEQ ID NO: 1291410 - protein, 9 aa, Homo Sapiens
YVDPFAMHF

SEQ ID NO: 1291411 - protein, 9 aa, Homo Sapiens
RCTQELQPP

SEQ ID NO: 1291412 - protein, 9 aa, Homo Sapiens
LMSRPSQVL

SEQ ID NO: 1291413 - protein, 9 aa, Homo Sapiens
QAPNIQIHS

SEQ ID NO: 1291414 - protein, 9 aa, Homo Sapiens
NMLKFIGVL

SEQ ID NO: 1291415 - protein, 9 aa, Homo Sapiens
VEVQAVASV

SEQ ID NO: 1291416 - protein, 9 aa, Homo Sapiens
PVGQKTARH

SEQ ID NO: 1291417 - protein, 9 aa, Homo Sapiens
LMGGMSRTP

SEQ ID NO: 1291418 - protein, 9 aa, Homo Sapiens
VNTGLMASK

SEQ ID NO: 1291419 - protein, 9 aa, Homo Sapiens
DDDDMVLDP

SEQ ID NO: 1291420 - protein, 9 aa, Homo Sapiens
VSASTLART

SEQ ID NO: 1291421 - protein, 9 aa, Homo Sapiens
KVERVETRP

SEQ ID NO: 1291422 - protein, 9 aa, Homo Sapiens
TITNNFGSV

SEQ ID NO: 1291423 - protein, 9 aa, Homo Sapiens
NLEDAIKNF

SEQ ID NO: 1291424 - protein, 9 aa, Homo Sapiens
FYDPRSLNI

SEQ ID NO: 1291425 - protein, 9 aa, Homo Sapiens
EATFGCQMS

SEQ ID NO: 1291426 - protein, 9 aa, Homo Sapiens
MVFGPANLE

SEQ ID NO: 1291427 - protein, 9 aa, Homo Sapiens
CIISCIDCF

SEQ ID NO: 1291428 - protein, 9 aa, Homo Sapiens
VLNIASVDL

SEQ ID NO: 1291429 - protein, 9 aa, Homo Sapiens
RKPMVRLTR

SEQ ID NO: 1291430 - protein, 9 aa, Homo Sapiens
VYCIISCID

SEQ ID NO: 1291431 - protein, 9 aa, Homo Sapiens
PSPSKPTVA

SEQ ID NO: 1291432 - protein, 9 aa, Homo Sapiens
IMDDFQHAV

SEQ ID NO: 1291433 - protein, 9 aa, Homo Sapiens
TDTDRERKS

SEQ ID NO: 1291434 - protein, 9 aa, Homo Sapiens
LSRKVYILM

SEQ ID NO: 1291435 - protein, 9 aa, Homo Sapiens
QVSQERKFT

SEQ ID NO: 1291436 - protein, 9 aa, Homo Sapiens
HIPENPLQF

SEQ ID NO: 1291437 - protein, 9 aa, Homo Sapiens
WGAAPMMSS

SEQ ID NO: 1291438 - protein, 9 aa, Homo Sapiens
WCPRLRLPL

SEQ ID NO: 1291439 - protein, 9 aa, Homo Sapiens
TAASQLQRG

SEQ ID NO: 1291440 - protein, 9 aa, Homo Sapiens
PSDVMEMRM

SEQ ID NO: 1291441 - protein, 9 aa, Homo Sapiens
TYVDPFAMH

SEQ ID NO: 1291442 - protein, 9 aa, Homo Sapiens
QALKLHDRN

SEQ ID NO: 1291443 - protein, 9 aa, Homo Sapiens
LLSLKFKLQ

SEQ ID NO: 1291444 - protein, 9 aa, Homo Sapiens
SDPGLQFLD

SEQ ID NO: 1291445 - protein, 9 aa, Homo Sapiens
DVWWETRAK

SEQ ID NO: 1291446 - protein, 9 aa, Homo Sapiens
LIPLPAPCQ

SEQ ID NO: 1291447 - protein, 9 aa, Homo Sapiens
SYLDSGIHP

SEQ ID NO: 1291448 - protein, 9 aa, Homo Sapiens
KNTLGEAAL

SEQ ID NO: 1291449 - protein, 9 aa, Homo Sapiens
SSPRRSPAL

SEQ ID NO: 1291450 - protein, 9 aa, Homo Sapiens
SQHLLFEAW

SEQ ID NO: 1291451 - protein, 9 aa, Homo Sapiens
NCGFFMATV

SEQ ID NO: 1291452 - protein, 9 aa, Homo Sapiens
GVRSQRKDC

SEQ ID NO: 1291453 - protein, 9 aa, Homo Sapiens
GGGQLSWGG

SEQ ID NO: 1291454 - protein, 9 aa, Homo Sapiens
ARLGQLVEG

SEQ ID NO: 1291455 - protein, 9 aa, Homo Sapiens
LGQAGPCRG

SEQ ID NO: 1291456 - protein, 9 aa, Homo Sapiens
VHCSHGGGC

SEQ ID NO: 1291457 - protein, 9 aa, Homo Sapiens
EHALGRIVH

SEQ ID NO: 1291458 - protein, 9 aa, Homo Sapiens
GQPMRCLHL

SEQ ID NO: 1291459 - protein, 9 aa, Homo Sapiens
GMFQDFNDP

SEQ ID NO: 1291460 - protein, 9 aa, Homo Sapiens
HLKKKILNC

SEQ ID NO: 1291461 - protein, 9 aa, Homo Sapiens
HPSAVHEGH

SEQ ID NO: 1291462 - protein, 9 aa, Homo Sapiens
RSKGPMGVL

SEQ ID NO: 1291463 - protein, 9 aa, Homo Sapiens
YYRKMSEPK

SEQ ID NO: 1291464 - protein, 9 aa, Homo Sapiens
ATAAERNMS

SEQ ID NO: 1291465 - protein, 9 aa, Homo Sapiens
VGYVLQVLE

SEQ ID NO: 1291466 - protein, 9 aa, Homo Sapiens
KKEAKEVFP

SEQ ID NO: 1291467 - protein, 9 aa, Homo Sapiens
LALDTCDIY

SEQ ID NO: 1291468 - protein, 9 aa, Homo Sapiens
VFGPANLED

SEQ ID NO: 1291469 - protein, 9 aa, Homo Sapiens
WYSHQKKLT

SEQ ID NO: 1291470 - protein, 9 aa, Homo Sapiens
EEQALCCQA

SEQ ID NO: 1291471 - protein, 9 aa, Homo Sapiens
IESEAKKNH

SEQ ID NO: 1291472 - protein, 9 aa, Homo Sapiens
LRSEGGPPR

SEQ ID NO: 1291473 - protein, 9 aa, Homo Sapiens
SMTLPAPTA

SEQ ID NO: 1291474 - protein, 9 aa, Homo Sapiens
FHRGASCHF

SEQ ID NO: 1291475 - protein, 9 aa, Homo Sapiens
TMPPPPPLA

SEQ ID NO: 1291476 - protein, 9 aa, Homo Sapiens
IEARSDTYD

SEQ ID NO: 1291477 - protein, 9 aa, Homo Sapiens
HIYYENILL

SEQ ID NO: 1291478 - protein, 9 aa, Homo Sapiens
GSVLNIASV

SEQ ID NO: 1291479 - protein, 9 aa, Homo Sapiens
KMAMTVIAG

SEQ ID NO: 1291480 - protein, 9 aa, Homo Sapiens
PHGRRAVVL

SEQ ID NO: 1291481 - protein, 9 aa, Homo Sapiens
TKYFRFVVS

SEQ ID NO: 1291482 - protein, 9 aa, Homo Sapiens
EGMCPVGRG

SEQ ID NO: 1291483 - protein, 9 aa, Homo Sapiens
TMLYVSSGS

SEQ ID NO: 1291484 - protein, 9 aa, Homo Sapiens
DDNVKLIVL

SEQ ID NO: 1291485 - protein, 9 aa, Homo Sapiens
AVDEMNGHI

SEQ ID NO: 1291486 - protein, 9 aa, Homo Sapiens
QMKCLTAVD

SEQ ID NO: 1291487 - protein, 9 aa, Homo Sapiens
ELQIVKPQE

SEQ ID NO: 1291488 - protein, 9 aa, Homo Sapiens
EEDTRARAC

SEQ ID NO: 1291489 - protein, 9 aa, Homo Sapiens
SGELHLLGP

SEQ ID NO: 1291490 - protein, 9 aa, Homo Sapiens
RVPDGVILG

SEQ ID NO: 1291491 - protein, 9 aa, Homo Sapiens
RSLKSRDPE

SEQ ID NO: 1291492 - protein, 9 aa, Homo Sapiens
NMYSTYAKL

SEQ ID NO: 1291493 - protein, 9 aa, Homo Sapiens
EWAGSDVFD

SEQ ID NO: 1291494 - protein, 9 aa, Homo Sapiens
TLPAFTLGC

SEQ ID NO: 1291495 - protein, 9 aa, Homo Sapiens
NLLIHTGEK

SEQ ID NO: 1291496 - protein, 9 aa, Homo Sapiens
RLAGLGPVE

SEQ ID NO: 1291497 - protein, 9 aa, Homo Sapiens
VETRPNYCF

SEQ ID NO: 1291498 - protein, 9 aa, Homo Sapiens
ACVPPEGRH

SEQ ID NO: 1291499 - protein, 9 aa, Homo Sapiens
QRSPSGCQG

SEQ ID NO: 1291500 - protein, 9 aa, Homo Sapiens
SHGGGCFLA

SEQ ID NO: 1291501 - protein, 9 aa, Homo Sapiens
APWRPRATA

SEQ ID NO: 1291502 - protein, 9 aa, Homo Sapiens
LEFRESFKH

SEQ ID NO: 1291503 - protein, 9 aa, Homo Sapiens
QRRLSANGD

SEQ ID NO: 1291504 - protein, 9 aa, Homo Sapiens
PCSHQGLAV

SEQ ID NO: 1291505 - protein, 9 aa, Homo Sapiens
EPAHPHRRQ

SEQ ID NO: 1291506 - protein, 9 aa, Homo Sapiens
YMGSHIPEN

SEQ ID NO: 1291507 - protein, 9 aa, Homo Sapiens
LVVFLYMWS

SEQ ID NO: 1291508 - protein, 9 aa, Homo Sapiens
DVNLCWSEI

SEQ ID NO: 1291509 - protein, 9 aa, Homo Sapiens
KRVLCGFCH

SEQ ID NO: 1291510 - protein, 9 aa, Homo Sapiens
AKRQQLVTQ

SEQ ID NO: 1291511 - protein, 9 aa, Homo Sapiens
TRAPTPRSP

SEQ ID NO: 1291512 - protein, 9 aa, Homo Sapiens
LSLKFKLQL

SEQ ID NO: 1291513 - protein, 9 aa, Homo Sapiens
EINGQNNLI

SEQ ID NO: 1291514 - protein, 9 aa, Homo Sapiens
SCWALAPAR

SEQ ID NO: 1291515 - protein, 9 aa, Homo Sapiens
ENLRTMYNQ

SEQ ID NO: 1291516 - protein, 9 aa, Homo Sapiens
IGAFPVNTL

SEQ ID NO: 1291517 - protein, 9 aa, Homo Sapiens
GSTNHQEPV

SEQ ID NO: 1291518 - protein, 9 aa, Homo Sapiens
KVNTGLMAS

SEQ ID NO: 1291519 - protein, 9 aa, Homo Sapiens
LARTGFLYT

SEQ ID NO: 1291520 - protein, 9 aa, Homo Sapiens
RSWTRSRTV

SEQ ID NO: 1291521 - protein, 9 aa, Homo Sapiens
TDDDEDDDD

SEQ ID NO: 1291522 - protein, 9 aa, Homo Sapiens
QPAALGEVV

SEQ ID NO: 1291523 - protein, 9 aa, Homo Sapiens
LNKSLNRVH

SEQ ID NO: 1291524 - protein, 9 aa, Homo Sapiens
LGEAALSPD

SEQ ID NO: 1291525 - protein, 9 aa, Homo Sapiens
GAYEEVKHG

SEQ ID NO: 1291526 - protein, 9 aa, Homo Sapiens
LPPSPTMPP

SEQ ID NO: 1291527 - protein, 9 aa, Homo Sapiens
GAQRGQPRL

SEQ ID NO: 1291528 - protein, 9 aa, Homo Sapiens
LCDGDEVVS

SEQ ID NO: 1291529 - protein, 9 aa, Homo Sapiens
GALGHRGSQ

SEQ ID NO: 1291530 - protein, 9 aa, Homo Sapiens
DAPLRLRLD

SEQ ID NO: 1291531 - protein, 9 aa, Homo Sapiens
TTIPQPWEL

SEQ ID NO: 1291532 - protein, 9 aa, Homo Sapiens
QPPAKKNKE

SEQ ID NO: 1291533 - protein, 9 aa, Homo Sapiens
ALAPARPCP

SEQ ID NO: 1291534 - protein, 9 aa, Homo Sapiens
LGFSRTSRH

SEQ ID NO: 1291535 - protein, 9 aa, Homo Sapiens
NIVCKPVPF

SEQ ID NO: 1291536 - protein, 9 aa, Homo Sapiens
CTQELQPPS

SEQ ID NO: 1291537 - protein, 9 aa, Homo Sapiens
SRTDKLKSM

SEQ ID NO: 1291538 - protein, 9 aa, Homo Sapiens
LSGLSADIQ

SEQ ID NO: 1291539 - protein, 9 aa, Homo Sapiens
YRMEMKPLP

SEQ ID NO: 1291540 - protein, 9 aa, Homo Sapiens
RPGQLRGRA

SEQ ID NO: 1291541 - protein, 9 aa, Homo Sapiens
MLYPLQNGS

SEQ ID NO: 1291542 - protein, 9 aa, Homo Sapiens
PAGPAGQQV

SEQ ID NO: 1291543 - protein, 9 aa, Homo Sapiens
SGCLSLGFS

SEQ ID NO: 1291544 - protein, 9 aa, Homo Sapiens
RDSRSFFTS

SEQ ID NO: 1291545 - protein, 9 aa, Homo Sapiens
KVLIYRSRV

SEQ ID NO: 1291546 - protein, 9 aa, Homo Sapiens
PTCPPWHCP

SEQ ID NO: 1291547 - protein, 9 aa, Homo Sapiens
IERMHELEQ

SEQ ID NO: 1291548 - protein, 9 aa, Homo Sapiens
DLRGISGMR

SEQ ID NO: 1291549 - protein, 9 aa, Homo Sapiens
TWCLPSASS

SEQ ID NO: 1291550 - protein, 9 aa, Homo Sapiens
RHPNCNSKC

SEQ ID NO: 1291551 - protein, 9 aa, Homo Sapiens
SALRISNLF

SEQ ID NO: 1291552 - protein, 9 aa, Homo Sapiens
RGALLLFGL

SEQ ID NO: 1291553 - protein, 9 aa, Homo Sapiens
CLTAVDCLQ

SEQ ID NO: 1291554 - protein, 9 aa, Homo Sapiens
RLRGEREER

SEQ ID NO: 1291555 - protein, 9 aa, Homo Sapiens
LSGILLLCK

SEQ ID NO: 1291556 - protein, 9 aa, Homo Sapiens
EQRARRAPG

SEQ ID NO: 1291557 - protein, 9 aa, Homo Sapiens
ALMSKVERV

SEQ ID NO: 1291558 - protein, 9 aa, Homo Sapiens
RELQIVKPQ

SEQ ID NO: 1291559 - protein, 9 aa, Homo Sapiens
IVHIFVIIV

SEQ ID NO: 1291560 - protein, 9 aa, Homo Sapiens
HHLTTDHNT

SEQ ID NO: 1291561 - protein, 9 aa, Homo Sapiens
GLVKLGTVE

SEQ ID NO: 1291562 - protein, 9 aa, Homo Sapiens
QLRPEILQD

SEQ ID NO: 1291563 - protein, 9 aa, Homo Sapiens
HNGWGDLEF

SEQ ID NO: 1291564 - protein, 9 aa, Homo Sapiens
CILEMWDLH

SEQ ID NO: 1291565 - protein, 9 aa, Homo Sapiens
HLPGHSQRE

SEQ ID NO: 1291566 - protein, 9 aa, Homo Sapiens
TMDLSEFMS

SEQ ID NO: 1291567 - protein, 9 aa, Homo Sapiens
IWSSSSALG

SEQ ID NO: 1291568 - protein, 9 aa, Homo Sapiens
LLLLLSPLD

SEQ ID NO: 1291569 - protein, 9 aa, Homo Sapiens
QAALRAQRA

SEQ ID NO: 1291570 - protein, 9 aa, Homo Sapiens
ASGPQVLMM

SEQ ID NO: 1291571 - protein, 9 aa, Homo Sapiens
DLDALLSRM

SEQ ID NO: 1291572 - protein, 9 aa, Homo Sapiens
IWLDDVFCD

SEQ ID NO: 1291573 - protein, 9 aa, Homo Sapiens
LVQAPDAVG

SEQ ID NO: 1291574 - protein, 9 aa, Homo Sapiens
QERKFTVRH

SEQ ID NO: 1291575 - protein, 9 aa, Homo Sapiens
LMSEKNLAC

SEQ ID NO: 1291576 - protein, 9 aa, Homo Sapiens
GLMANLLIH

SEQ ID NO: 1291577 - protein, 9 aa, Homo Sapiens
EAVKTLKTT

SEQ ID NO: 1291578 - protein, 9 aa, Homo Sapiens
SGCPAGCWL

SEQ ID NO: 1291579 - protein, 9 aa, Homo Sapiens
SDVMEMRMV

SEQ ID NO: 1291580 - protein, 9 aa, Homo Sapiens
PCCRLTWMS

SEQ ID NO: 1291581 - protein, 9 aa, Homo Sapiens
QHLLFEAWL

SEQ ID NO: 1291582 - protein, 9 aa, Homo Sapiens
ENHVVKMAD

SEQ ID NO: 1291583 - protein, 9 aa, Homo Sapiens
RAPGRTAAS

SEQ ID NO: 1291584 - protein, 9 aa, Homo Sapiens
LAVPWLECQ

SEQ ID NO: 1291585 - protein, 9 aa, Homo Sapiens
SYNKLQALV

SEQ ID NO: 1291586 - protein, 9 aa, Homo Sapiens
ELRHLLVTQ

SEQ ID NO: 1291587 - protein, 9 aa, Homo Sapiens
LLVRILVSD

SEQ ID NO: 1291588 - protein, 9 aa, Homo Sapiens
WDKKRKQQQ

SEQ ID NO: 1291589 - protein, 9 aa, Homo Sapiens
RTEGYFISI

SEQ ID NO: 1291590 - protein, 9 aa, Homo Sapiens
ELQVPQVIQ

SEQ ID NO: 1291591 - protein, 9 aa, Homo Sapiens
NSHPPTTTT

SEQ ID NO: 1291592 - protein, 9 aa, Homo Sapiens
VLDNDGCTP

SEQ ID NO: 1291593 - protein, 9 aa, Homo Sapiens
RHGPYPAAS

SEQ ID NO: 1291594 - protein, 9 aa, Homo Sapiens
SWWWATVSI

SEQ ID NO: 1291595 - protein, 9 aa, Homo Sapiens
QDTSGHRGS

SEQ ID NO: 1291596 - protein, 9 aa, Homo Sapiens
RGASCHFSS

SEQ ID NO: 1291597 - protein, 9 aa, Homo Sapiens
RPCRMRLYQ

SEQ ID NO: 1291598 - protein, 9 aa, Homo Sapiens
ATVCPAVER

SEQ ID NO: 1291599 - protein, 9 aa, Homo Sapiens
PPATALNPR

SEQ ID NO: 1291600 - protein, 9 aa, Homo Sapiens
NIITPPPHQ

SEQ ID NO: 1291601 - protein, 9 aa, Homo Sapiens
EVLALQGNR

SEQ ID NO: 1291602 - protein, 9 aa, Homo Sapiens
LPHPSAVHE

SEQ ID NO: 1291603 - protein, 9 aa, Homo Sapiens
PGMTGLNKN

SEQ ID NO: 1291604 - protein, 9 aa, Homo Sapiens
QQPRALAPG

SEQ ID NO: 1291605 - protein, 9 aa, Homo Sapiens
PTPSLCPPT

SEQ ID NO: 1291606 - protein, 9 aa, Homo Sapiens
KTLKTTQPT

SEQ ID NO: 1291607 - protein, 9 aa, Homo Sapiens
VHPAGPAGQ

SEQ ID NO: 1291608 - protein, 9 aa, Homo Sapiens
EEGIVVAMG

SEQ ID NO: 1291609 - protein, 9 aa, Homo Sapiens
ASCHFSSSS

SEQ ID NO: 1291610 - protein, 9 aa, Homo Sapiens
PVPPDGSDP

SEQ ID NO: 1291611 - protein, 9 aa, Homo Sapiens
DIRDEKVKV

SEQ ID NO: 1291612 - protein, 9 aa, Homo Sapiens
SSSALGLSL

SEQ ID NO: 1291613 - protein, 9 aa, Homo Sapiens
KDFGSIFLL

SEQ ID NO: 1291614 - protein, 9 aa, Homo Sapiens
KILFFSIKH

SEQ ID NO: 1291615 - protein, 9 aa, Homo Sapiens
PPVRHRTLP

SEQ ID NO: 1291616 - protein, 9 aa, Homo Sapiens
FRKIVDSKH

SEQ ID NO: 1291617 - protein, 9 aa, Homo Sapiens
LEGIRYAIR

SEQ ID NO: 1291618 - protein, 9 aa, Homo Sapiens
WVPHPLTVL

SEQ ID NO: 1291619 - protein, 9 aa, Homo Sapiens
WGAMALTRG

SEQ ID NO: 1291620 - protein, 9 aa, Homo Sapiens
LGASWVELR

SEQ ID NO: 1291621 - protein, 9 aa, Homo Sapiens
LSARAMTER

SEQ ID NO: 1291622 - protein, 9 aa, Homo Sapiens
LKRDRQQQQ

SEQ ID NO: 1291623 - protein, 9 aa, Homo Sapiens
RWRRRPVVN

SEQ ID NO: 1291624 - protein, 9 aa, Homo Sapiens
CIPFRVGLY

SEQ ID NO: 1291625 - protein, 9 aa, Homo Sapiens
STATWTHPS

SEQ ID NO: 1291626 - protein, 9 aa, Homo Sapiens
SWRPRACSL

SEQ ID NO: 1291627 - protein, 9 aa, Homo Sapiens
TGLRKARME

SEQ ID NO: 1291628 - protein, 9 aa, Homo Sapiens
GDCVWAGQP

SEQ ID NO: 1291629 - protein, 9 aa, Homo Sapiens
GRRPRPRRA

SEQ ID NO: 1291630 - protein, 9 aa, Homo Sapiens
ALLVHPAPR

SEQ ID NO: 1291631 - protein, 9 aa, Homo Sapiens
SLSSLKNIF

SEQ ID NO: 1291632 - protein, 9 aa, Homo Sapiens
LAPHVQLHD

SEQ ID NO: 1291633 - protein, 9 aa, Homo Sapiens
TQSSKRPGT

SEQ ID NO: 1291634 - protein, 9 aa, Homo Sapiens
PSLEVCYLT

SEQ ID NO: 1291635 - protein, 9 aa, Homo Sapiens
VDDDALHGD

SEQ ID NO: 1291636 - protein, 9 aa, Homo Sapiens
PLFFPSATR

SEQ ID NO: 1291637 - protein, 9 aa, Homo Sapiens
AEPGGRPWC

SEQ ID NO: 1291638 - protein, 9 aa, Homo Sapiens
PWSRSSCRS

SEQ ID NO: 1291639 - protein, 9 aa, Homo Sapiens
PFRGLVKLG

SEQ ID NO: 1291640 - protein, 9 aa, Homo Sapiens
CDEGFEPLG

SEQ ID NO: 1291641 - protein, 9 aa, Homo Sapiens
SGPMSRSLW

SEQ ID NO: 1291642 - protein, 9 aa, Homo Sapiens
RCAMAPETT

SEQ ID NO: 1291643 - protein, 9 aa, Homo Sapiens
TAAPLPHPG

SEQ ID NO: 1291644 - protein, 9 aa, Homo Sapiens
SLFDAADGQ

SEQ ID NO: 1291645 - protein, 9 aa, Homo Sapiens
ILVSDSLFV

SEQ ID NO: 1291646 - protein, 9 aa, Homo Sapiens
NCLEFRESF

SEQ ID NO: 1291647 - protein, 9 aa, Homo Sapiens
LERGVRMKS

SEQ ID NO: 1291648 - protein, 9 aa, Homo Sapiens
IRKKMLENR

SEQ ID NO: 1291649 - protein, 9 aa, Homo Sapiens
GIHPGATTT

SEQ ID NO: 1291650 - protein, 9 aa, Homo Sapiens
PGRRGRCEK

SEQ ID NO: 1291651 - protein, 9 aa, Homo Sapiens
KCREKDDDV

SEQ ID NO: 1291652 - protein, 9 aa, Homo Sapiens
RAPPTPRGR

SEQ ID NO: 1291653 - protein, 9 aa, Homo Sapiens
SGLGSEVGG

SEQ ID NO: 1291654 - protein, 9 aa, Homo Sapiens
ELELVNSWN

SEQ ID NO: 1291655 - protein, 9 aa, Homo Sapiens
TYMNVNIRD

SEQ ID NO: 1291656 - protein, 9 aa, Homo Sapiens
ADGERTALV

SEQ ID NO: 1291657 - protein, 9 aa, Homo Sapiens
CNSKCYLET

SEQ ID NO: 1291658 - protein, 9 aa, Homo Sapiens
TRLTVLVLL

SEQ ID NO: 1291659 - protein, 9 aa, Homo Sapiens
SLWPQSRPQ

SEQ ID NO: 1291660 - protein, 9 aa, Homo Sapiens
TDVFVVRTE

SEQ ID NO: 1291661 - protein, 9 aa, Homo Sapiens
SPLCMAPEM

SEQ ID NO: 1291662 - protein, 9 aa, Homo Sapiens
SWTRSRTVP

SEQ ID NO: 1291663 - protein, 9 aa, Homo Sapiens
PTCILGQRA

SEQ ID NO: 1291664 - protein, 9 aa, Homo Sapiens
SELIIRIVM

SEQ ID NO: 1291665 - protein, 9 aa, Homo Sapiens
CLTWASPLA

SEQ ID NO: 1291666 - protein, 9 aa, Homo Sapiens
PAEPHPAGG

SEQ ID NO: 1291667 - protein, 9 aa, Homo Sapiens
KQLRPEILQ

SEQ ID NO: 1291668 - protein, 9 aa, Homo Sapiens
PPPLGNPRV

SEQ ID NO: 1291669 - protein, 9 aa, Homo Sapiens
RWSAPTCPP

SEQ ID NO: 1291670 - protein, 9 aa, Homo Sapiens
GQRCRCVCL

SEQ ID NO: 1291671 - protein, 9 aa, Homo Sapiens
SWVELRVSC

SEQ ID NO: 1291672 - protein, 9 aa, Homo Sapiens
IKHSIWSSS

SEQ ID NO: 1291673 - protein, 9 aa, Homo Sapiens
LREHAPEQR

SEQ ID NO: 1291674 - protein, 9 aa, Homo Sapiens
PEGMQNLAS

SEQ ID NO: 1291675 - protein, 9 aa, Homo Sapiens
CPPWHCPAS

SEQ ID NO: 1291676 - protein, 9 aa, Homo Sapiens
SLAEIAGCL

SEQ ID NO: 1291677 - protein, 9 aa, Homo Sapiens
LSISYEGFN

SEQ ID NO: 1291678 - protein, 9 aa, Homo Sapiens
PQRPAVFYT

SEQ ID NO: 1291679 - protein, 9 aa, Homo Sapiens
SISRDNNNI

SEQ ID NO: 1291680 - protein, 9 aa, Homo Sapiens
QRRKKRRWA

SEQ ID NO: 1291681 - protein, 9 aa, Homo Sapiens
LPCRRHCPR

SEQ ID NO: 1291682 - protein, 9 aa, Homo Sapiens
CLLSFSWSG

SEQ ID NO: 1291683 - protein, 9 aa, Homo Sapiens
SVYSPGPRA

SEQ ID NO: 1291684 - protein, 9 aa, Homo Sapiens
SSALGLSLY

SEQ ID NO: 1291685 - protein, 9 aa, Homo Sapiens
HQGKNGVKF

SEQ ID NO: 1291686 - protein, 9 aa, Homo Sapiens
QKRRQGPAA

SEQ ID NO: 1291687 - protein, 9 aa, Homo Sapiens
SIFLLFCLV

SEQ ID NO: 1291688 - protein, 9 aa, Homo Sapiens
SPPRLCVKA

SEQ ID NO: 1291689 - protein, 9 aa, Homo Sapiens
YPLVLKEFR

SEQ ID NO: 1291690 - protein, 9 aa, Homo Sapiens
PGRAPPTPR

SEQ ID NO: 1291691 - protein, 9 aa, Homo Sapiens
HVLDKLVHL

SEQ ID NO: 1291692 - protein, 9 aa, Homo Sapiens
RRRARPGQL

SEQ ID NO: 1291693 - protein, 9 aa, Homo Sapiens
YRSRVAYVD

SEQ ID NO: 1291694 - protein, 9 aa, Homo Sapiens
DNRTTIPQP

SEQ ID NO: 1291695 - protein, 9 aa, Homo Sapiens
PVWNQQGVE

SEQ ID NO: 1291696 - protein, 9 aa, Homo Sapiens
MSEPKDAAS

SEQ ID NO: 1291697 - protein, 9 aa, Homo Sapiens
PANLEDAIK

SEQ ID NO: 1291698 - protein, 9 aa, Homo Sapiens
DFTLKRKCR

SEQ ID NO: 1291699 - protein, 9 aa, Homo Sapiens
SSPTRPLPP

SEQ ID NO: 1291700 - protein, 9 aa, Homo Sapiens
VVLIVDVVG

SEQ ID NO: 1291701 - protein, 9 aa, Homo Sapiens
TTTSSPRRS

SEQ ID NO: 1291702 - protein, 9 aa, Homo Sapiens
AGPPAAQAR

SEQ ID NO: 1291703 - protein, 9 aa, Homo Sapiens
QRKSQTIVV

SEQ ID NO: 1291704 - protein, 9 aa, Homo Sapiens
AGPDLVLAL

SEQ ID NO: 1291705 - protein, 9 aa, Homo Sapiens
TWTQTQCGT

SEQ ID NO: 1291706 - protein, 9 aa, Homo Sapiens
QSLLSLYSV

SEQ ID NO: 1291707 - protein, 9 aa, Homo Sapiens
PAVEPHGRR

SEQ ID NO: 1291708 - protein, 9 aa, Homo Sapiens
RGMGRRPRP

SEQ ID NO: 1291709 - protein, 9 aa, Homo Sapiens
NRTQSLNYD

SEQ ID NO: 1291710 - protein, 9 aa, Homo Sapiens
NQQRKWCSS

SEQ ID NO: 1291711 - protein, 9 aa, Homo Sapiens
VYSYDDDDM

SEQ ID NO: 1291712 - protein, 9 aa, Homo Sapiens
MKTSEEDTR

SEQ ID NO: 1291713 - protein, 9 aa, Homo Sapiens
QCDKKRGAS

SEQ ID NO: 1291714 - protein, 9 aa, Homo Sapiens
RAGVDVDQV

SEQ ID NO: 1291715 - protein, 9 aa, Homo Sapiens
RTAAEGEGM

SEQ ID NO: 1291716 - protein, 9 aa, Homo Sapiens
AWQDVEVQA

SEQ ID NO: 1291717 - protein, 9 aa, Homo Sapiens
VLDAEPPRC

SEQ ID NO: 1291718 - protein, 9 aa, Homo Sapiens
PTRHLSGYC

SEQ ID NO: 1291719 - protein, 9 aa, Homo Sapiens
LVSKCDGNS

SEQ ID NO: 1291720 - protein, 9 aa, Homo Sapiens
QSEWTQRSP

SEQ ID NO: 1291721 - protein, 9 aa, Homo Sapiens
RHCPRCPAP

SEQ ID NO: 1291722 - protein, 9 aa, Homo Sapiens
GPQRDGSYG

SEQ ID NO: 1291723 - protein, 9 aa, Homo Sapiens
NFENKEKKL

SEQ ID NO: 1291724 - protein, 9 aa, Homo Sapiens
VPFSGLYQG

SEQ ID NO: 1291725 - protein, 9 aa, Homo Sapiens
PLPLDQNPG

SEQ ID NO: 1291726 - protein, 9 aa, Homo Sapiens
SILCPKTGW

SEQ ID NO: 1291727 - protein, 9 aa, Homo Sapiens
GVPAFVQGV

SEQ ID NO: 1291728 - protein, 9 aa, Homo Sapiens
GWDWAPRCP

SEQ ID NO: 1291729 - protein, 9 aa, Homo Sapiens
LLARGHVPH

SEQ ID NO: 1291730 - protein, 9 aa, Homo Sapiens
IKKAHRRKA

SEQ ID NO: 1291731 - protein, 9 aa, Homo Sapiens
HAVSDSEAY

SEQ ID NO: 1291732 - protein, 9 aa, Homo Sapiens
AHPHRRQVP

SEQ ID NO: 1291733 - protein, 9 aa, Homo Sapiens
SSTNAQVTY

SEQ ID NO: 1291734 - protein, 9 aa, Homo Sapiens
RRRPVVNLV

SEQ ID NO: 1291735 - protein, 9 aa, Homo Sapiens
VGAAGVGKS

SEQ ID NO: 1291736 - protein, 9 aa, Homo Sapiens
QSPSRSPSR

SEQ ID NO: 1291737 - protein, 9 aa, Homo Sapiens
KPAIAPPIF

SEQ ID NO: 1291738 - protein, 9 aa, Homo Sapiens
GGGSPSLFD

SEQ ID NO: 1291739 - protein, 9 aa, Homo Sapiens
KGELANFHF

SEQ ID NO: 1291740 - protein, 9 aa, Homo Sapiens
QLVDNVYCV

SEQ ID NO: 1291741 - protein, 9 aa, Homo Sapiens
VLLLLSLKF

SEQ ID NO: 1291742 - protein, 9 aa, Homo Sapiens
YNKLQALVP

SEQ ID NO: 1291743 - protein, 9 aa, Homo Sapiens
GNIAEDSSG

SEQ ID NO: 1291744 - protein, 9 aa, Homo Sapiens
EGEGMLESE

SEQ ID NO: 1291745 - protein, 9 aa, Homo Sapiens
GPVQPIAQG

SEQ ID NO: 1291746 - protein, 9 aa, Homo Sapiens
LCATYMNVN

SEQ ID NO: 1291747 - protein, 9 aa, Homo Sapiens
STSLYVRPV

SEQ ID NO: 1291748 - protein, 9 aa, Homo Sapiens
YDSLESILK

SEQ ID NO: 1291749 - protein, 9 aa, Homo Sapiens
CFPAEIHVV

SEQ ID NO: 1291750 - protein, 9 aa, Homo Sapiens
PSTPASQSF

SEQ ID NO: 1291751 - protein, 9 aa, Homo Sapiens
FIISKGMVN

SEQ ID NO: 1291752 - protein, 9 aa, Homo Sapiens
GVLGLWKWQ

SEQ ID NO: 1291753 - protein, 9 aa, Homo Sapiens
GGFFGVSAV

SEQ ID NO: 1291754 - protein, 9 aa, Homo Sapiens
HSQQIAGSK

SEQ ID NO: 1291755 - protein, 9 aa, Homo Sapiens
PACARPKQK

SEQ ID NO: 1291756 - protein, 9 aa, Homo Sapiens
QRGRGSCGS

SEQ ID NO: 1291757 - protein, 9 aa, Homo Sapiens
TCPCSAPLS

SEQ ID NO: 1291758 - protein, 9 aa, Homo Sapiens
AAATAATAT

SEQ ID NO: 1291759 - protein, 9 aa, Homo Sapiens
KWSAVPPHV

SEQ ID NO: 1291760 - protein, 9 aa, Homo Sapiens
LVPDLFHGL

SEQ ID NO: 1291761 - protein, 9 aa, Homo Sapiens
LQQLEFSMP

SEQ ID NO: 1291762 - protein, 9 aa, Homo Sapiens
YEEVKHGAL

SEQ ID NO: 1291763 - protein, 9 aa, Homo Sapiens
KKEDMLDWD

SEQ ID NO: 1291764 - protein, 9 aa, Homo Sapiens
VHPAPRGRR

SEQ ID NO: 1291765 - protein, 9 aa, Homo Sapiens
WGGRGQVHP

SEQ ID NO: 1291766 - protein, 9 aa, Homo Sapiens
STKRRLSSP

SEQ ID NO: 1291767 - protein, 9 aa, Homo Sapiens
RAVDPNSGY

SEQ ID NO: 1291768 - protein, 9 aa, Homo Sapiens
QVLADMRGW

SEQ ID NO: 1291769 - protein, 9 aa, Homo Sapiens
HLGDQLGDD

SEQ ID NO: 1291770 - protein, 9 aa, Homo Sapiens
AQAALRAQR

SEQ ID NO: 1291771 - protein, 9 aa, Homo Sapiens
ALGRIVHAE

SEQ ID NO: 1291772 - protein, 9 aa, Homo Sapiens
SIPFSVFWS

SEQ ID NO: 1291773 - protein, 9 aa, Homo Sapiens
ERSARLQRE

SEQ ID NO: 1291774 - protein, 9 aa, Homo Sapiens
QKNCLVKNL

SEQ ID NO: 1291775 - protein, 9 aa, Homo Sapiens
NNKKMAMTV

SEQ ID NO: 1291776 - protein, 9 aa, Homo Sapiens
SQVIRSLTT

SEQ ID NO: 1291777 - protein, 9 aa, Homo Sapiens
GGVLLPALY

SEQ ID NO: 1291778 - protein, 9 aa, Homo Sapiens
SPVNSHTQR

SEQ ID NO: 1291779 - protein, 9 aa, Homo Sapiens
ENCLEFRES

SEQ ID NO: 1291780 - protein, 9 aa, Homo Sapiens
QRVGHRHHR

SEQ ID NO: 1291781 - protein, 9 aa, Homo Sapiens
TVEVTDGSH

SEQ ID NO: 1291782 - protein, 9 aa, Homo Sapiens
GPYPAASAP

SEQ ID NO: 1291783 - protein, 9 aa, Homo Sapiens
YRCCDQPRH

SEQ ID NO: 1291784 - protein, 9 aa, Homo Sapiens
CSRPVCCPR

SEQ ID NO: 1291785 - protein, 9 aa, Homo Sapiens
AHEKAAVLD

SEQ ID NO: 1291786 - protein, 9 aa, Homo Sapiens
FSMPPGVKV

SEQ ID NO: 1291787 - protein, 9 aa, Homo Sapiens
SMPPGVKVD

SEQ ID NO: 1291788 - protein, 9 aa, Homo Sapiens
IDTKPEVPR

SEQ ID NO: 1291789 - protein, 9 aa, Homo Sapiens
VVELQTKHA

SEQ ID NO: 1291790 - protein, 9 aa, Homo Sapiens
AAHELWQLE

SEQ ID NO: 1291791 - protein, 9 aa, Homo Sapiens
FLDLLLPAL

SEQ ID NO: 1291792 - protein, 9 aa, Homo Sapiens
DVSVLHTLL

SEQ ID NO: 1291793 - protein, 9 aa, Homo Sapiens
VSWYSHQKK

SEQ ID NO: 1291794 - protein, 9 aa, Homo Sapiens
RSRTVPGPG

SEQ ID NO: 1291795 - protein, 9 aa, Homo Sapiens
VVYNAGTNI

SEQ ID NO: 1291796 - protein, 9 aa, Homo Sapiens
RVWAAKGEK

SEQ ID NO: 1291797 - protein, 9 aa, Homo Sapiens
QGPPCGRWK

SEQ ID NO: 1291798 - protein, 9 aa, Homo Sapiens
AAGVPPDRG

SEQ ID NO: 1291799 - protein, 9 aa, Homo Sapiens
PTSCPPLLE

SEQ ID NO: 1291800 - protein, 9 aa, Homo Sapiens
SFSWSGCLS

SEQ ID NO: 1291801 - protein, 9 aa, Homo Sapiens
ASPAAPAVT

SEQ ID NO: 1291802 - protein, 9 aa, Homo Sapiens
EWHLHVHFV

SEQ ID NO: 1291803 - protein, 9 aa, Homo Sapiens
WEIVMETLQ

SEQ ID NO: 1291804 - protein, 9 aa, Homo Sapiens
GSEIGTTDI

SEQ ID NO: 1291805 - protein, 9 aa, Homo Sapiens
RGDHRSNQN

SEQ ID NO: 1291806 - protein, 9 aa, Homo Sapiens
RGGQRCRCV

SEQ ID NO: 1291807 - protein, 9 aa, Homo Sapiens
AWGDSPWNK

SEQ ID NO: 1291808 - protein, 9 aa, Homo Sapiens
AEPPRCLLA

SEQ ID NO: 1291809 - protein, 9 aa, Homo Sapiens
RAEKKAEPS

SEQ ID NO: 1291810 - protein, 9 aa, Homo Sapiens
INQKSMEKE

SEQ ID NO: 1291811 - protein, 9 aa, Homo Sapiens
QVHLFKDHV

SEQ ID NO: 1291812 - protein, 9 aa, Homo Sapiens
EKPAIAPPI

SEQ ID NO: 1291813 - protein, 9 aa, Homo Sapiens
QTGITAAPL

SEQ ID NO: 1291814 - protein, 9 aa, Homo Sapiens
VVRFLDSLQ

SEQ ID NO: 1291815 - protein, 9 aa, Homo Sapiens
RDGWGAMAL

SEQ ID NO: 1291816 - protein, 9 aa, Homo Sapiens
HTAFSCPKK

SEQ ID NO: 1291817 - protein, 9 aa, Homo Sapiens
PLRIHSTAT

SEQ ID NO: 1291818 - protein, 9 aa, Homo Sapiens
PSPPWSPST

SEQ ID NO: 1291819 - protein, 9 aa, Homo Sapiens
RVIDVSVLH

SEQ ID NO: 1291820 - protein, 9 aa, Homo Sapiens
QRARRAPGR

SEQ ID NO: 1291821 - protein, 9 aa, Homo Sapiens
HLLFEAWLL

SEQ ID NO: 1291822 - protein, 9 aa, Homo Sapiens
WSSRLPWEI

SEQ ID NO: 1291823 - protein, 9 aa, Homo Sapiens
IQQAMRYLC

SEQ ID NO: 1291824 - protein, 9 aa, Homo Sapiens
GMLYSLLQY

SEQ ID NO: 1291825 - protein, 9 aa, Homo Sapiens
RVLHKNKGR

SEQ ID NO: 1291826 - protein, 9 aa, Homo Sapiens
KLDEDAPPN

SEQ ID NO: 1291827 - protein, 9 aa, Homo Sapiens
NGWGDLEFL

SEQ ID NO: 1291828 - protein, 9 aa, Homo Sapiens
LTFLRCSQT

SEQ ID NO: 1291829 - protein, 9 aa, Homo Sapiens
ENSTGRNDA

SEQ ID NO: 1291830 - protein, 9 aa, Homo Sapiens
LLSIPWTQI

SEQ ID NO: 1291831 - protein, 9 aa, Homo Sapiens
GGVCPPGAR

SEQ ID NO: 1291832 - protein, 9 aa, Homo Sapiens
LVSRSGADR

SEQ ID NO: 1291833 - protein, 9 aa, Homo Sapiens
IAIIHDQIK

SEQ ID NO: 1291834 - protein, 9 aa, Homo Sapiens
LGQVRDHCR

SEQ ID NO: 1291835 - protein, 9 aa, Homo Sapiens
KKRRWAPRH

SEQ ID NO: 1291836 - protein, 9 aa, Homo Sapiens
GAPRHPHRS

SEQ ID NO: 1291837 - protein, 9 aa, Homo Sapiens
NPVGLRGAV

SEQ ID NO: 1291838 - protein, 9 aa, Homo Sapiens
TRPNYCFLF

SEQ ID NO: 1291839 - protein, 9 aa, Homo Sapiens
NLRTMYNQD

SEQ ID NO: 1291840 - protein, 9 aa, Homo Sapiens
TILEGLEAV

SEQ ID NO: 1291841 - protein, 9 aa, Homo Sapiens
VFCCNYDHC

SEQ ID NO: 1291842 - protein, 9 aa, Homo Sapiens
EFSMPPGVK

SEQ ID NO: 1291843 - protein, 9 aa, Homo Sapiens
RGRCEKQEL

SEQ ID NO: 1291844 - protein, 9 aa, Homo Sapiens
ELQNHRPTR

SEQ ID NO: 1291845 - protein, 9 aa, Homo Sapiens
RSALRPAAA

SEQ ID NO: 1291846 - protein, 9 aa, Homo Sapiens
SQSNSQLST

SEQ ID NO: 1291847 - protein, 9 aa, Homo Sapiens
APRHLGQAG

SEQ ID NO: 1291848 - protein, 9 aa, Homo Sapiens
LLPPSRRKT

SEQ ID NO: 1291849 - protein, 9 aa, Homo Sapiens
RPVCCPRAP

SEQ ID NO: 1291850 - protein, 9 aa, Homo Sapiens
NTLHMPMYV

SEQ ID NO: 1291851 - protein, 9 aa, Homo Sapiens
REYNKLKEC

SEQ ID NO: 1291852 - protein, 9 aa, Homo Sapiens
SGRGTCPCS

SEQ ID NO: 1291853 - protein, 9 aa, Homo Sapiens
AVWKVVFGI

SEQ ID NO: 1291854 - protein, 9 aa, Homo Sapiens
RQAGMWEEC

SEQ ID NO: 1291855 - protein, 9 aa, Homo Sapiens
GWRGWWGNG

SEQ ID NO: 1291856 - protein, 9 aa, Homo Sapiens
VTPPAWLVW

SEQ ID NO: 1291857 - protein, 9 aa, Homo Sapiens
ARGPGMLEQ

SEQ ID NO: 1291858 - protein, 9 aa, Homo Sapiens
HPNCNSKCY

SEQ ID NO: 1291859 - protein, 9 aa, Homo Sapiens
PGCDGRDGT

SEQ ID NO: 1291860 - protein, 9 aa, Homo Sapiens
PPEGRHRPA

SEQ ID NO: 1291861 - protein, 9 aa, Homo Sapiens
AARHHVEAR

SEQ ID NO: 1291862 - protein, 9 aa, Homo Sapiens
VACPARKQQ

SEQ ID NO: 1291863 - protein, 9 aa, Homo Sapiens
TEMDTEWHL

SEQ ID NO: 1291864 - protein, 9 aa, Homo Sapiens
RVCERCFQE

SEQ ID NO: 1291865 - protein, 9 aa, Homo Sapiens
DVFCDGDES

SEQ ID NO: 1291866 - protein, 9 aa, Homo Sapiens
CGAPGQSSG

SEQ ID NO: 1291867 - protein, 9 aa, Homo Sapiens
GSHIPENPL

SEQ ID NO: 1291868 - protein, 9 aa, Homo Sapiens
HSPELGVRL

SEQ ID NO: 1291869 - protein, 9 aa, Homo Sapiens
NMIDNIPKE

SEQ ID NO: 1291870 - protein, 9 aa, Homo Sapiens
TPSWALPTG

SEQ ID NO: 1291871 - protein, 9 aa, Homo Sapiens
PDSNNARIT

SEQ ID NO: 1291872 - protein, 9 aa, Homo Sapiens
CWALAPARP

SEQ ID NO: 1291873 - protein, 9 aa, Homo Sapiens
WHCPASRSS

SEQ ID NO: 1291874 - protein, 9 aa, Homo Sapiens
PLPRASLRA

SEQ ID NO: 1291875 - protein, 9 aa, Homo Sapiens
AAGGAAAAL

SEQ ID NO: 1291876 - protein, 9 aa, Homo Sapiens
SPSKPTVAK

SEQ ID NO: 1291877 - protein, 9 aa, Homo Sapiens
MRGWDWAPR

SEQ ID NO: 1291878 - protein, 9 aa, Homo Sapiens
SIKHSIWSS

SEQ ID NO: 1291879 - protein, 9 aa, Homo Sapiens
CLCTVSLAS

SEQ ID NO: 1291880 - protein, 9 aa, Homo Sapiens
VVNLVLCLH

SEQ ID NO: 1291881 - protein, 9 aa, Homo Sapiens
KVSKKRLPK

SEQ ID NO: 1291882 - protein, 9 aa, Homo Sapiens
MEGEKQRSW

SEQ ID NO: 1291883 - protein, 9 aa, Homo Sapiens
EPDVWLEAQ

SEQ ID NO: 1291884 - protein, 9 aa, Homo Sapiens
LQKLITTAD

SEQ ID NO: 1291885 - protein, 9 aa, Homo Sapiens
QEPVNFITF

SEQ ID NO: 1291886 - protein, 9 aa, Homo Sapiens
HPPTTTTSS

SEQ ID NO: 1291887 - protein, 9 aa, Homo Sapiens
SKDDMQELL

SEQ ID NO: 1291888 - protein, 9 aa, Homo Sapiens
SSEEARKPM

SEQ ID NO: 1291889 - protein, 9 aa, Homo Sapiens
CLHHHLYPV

SEQ ID NO: 1291890 - protein, 9 aa, Homo Sapiens
NSPFMLYPL

SEQ ID NO: 1291891 - protein, 9 aa, Homo Sapiens
ESDDAVVLI

SEQ ID NO: 1291892 - protein, 9 aa, Homo Sapiens
FSPLWLMTA

SEQ ID NO: 1291893 - protein, 9 aa, Homo Sapiens
VGEHALGRI

SEQ ID NO: 1291894 - protein, 9 aa, Homo Sapiens
ARKDNLESH

SEQ ID NO: 1291895 - protein, 9 aa, Homo Sapiens
RRKTPNSLA

SEQ ID NO: 1291896 - protein, 9 aa, Homo Sapiens
LQALVPDLF

SEQ ID NO: 1291897 - protein, 9 aa, Homo Sapiens
RDANPEKPY

SEQ ID NO: 1291898 - protein, 9 aa, Homo Sapiens
DALHGDTEA

SEQ ID NO: 1291899 - protein, 9 aa, Homo Sapiens
QQASTQSSK

SEQ ID NO: 1291900 - protein, 9 aa, Homo Sapiens
GFEPLGFWD

SEQ ID NO: 1291901 - protein, 9 aa, Homo Sapiens
TRPLPPSPT

SEQ ID NO: 1291902 - protein, 9 aa, Homo Sapiens
FVNFEHLKK

SEQ ID NO: 1291903 - protein, 9 aa, Homo Sapiens
DPAAQGHLD

SEQ ID NO: 1291904 - protein, 9 aa, Homo Sapiens
PALPTQQLA

SEQ ID NO: 1291905 - protein, 9 aa, Homo Sapiens
ALHGDTEAL

SEQ ID NO: 1291906 - protein, 9 aa, Homo Sapiens
CKPRPLLQK

SEQ ID NO: 1291907 - protein, 9 aa, Homo Sapiens
DCLQAFWDM

SEQ ID NO: 1291908 - protein, 9 aa, Homo Sapiens
GDPLKRDRQ

SEQ ID NO: 1291909 - protein, 9 aa, Homo Sapiens
WAVDGRKKK

SEQ ID NO: 1291910 - protein, 9 aa, Homo Sapiens
EDMLDWDCL

SEQ ID NO: 1291911 - protein, 9 aa, Homo Sapiens
PNSLAKPLL

SEQ ID NO: 1291912 - protein, 9 aa, Homo Sapiens
PDPAVHLPF

SEQ ID NO: 1291913 - protein, 9 aa, Homo Sapiens
VHIFVIIVS

SEQ ID NO: 1291914 - protein, 9 aa, Homo Sapiens
YHFCGGSLL

SEQ ID NO: 1291915 - protein, 9 aa, Homo Sapiens
TTSEIVLPE

SEQ ID NO: 1291916 - protein, 9 aa, Homo Sapiens
SPPTLMMSN

SEQ ID NO: 1291917 - protein, 9 aa, Homo Sapiens
HCSHGGGCF

SEQ ID NO: 1291918 - protein, 9 aa, Homo Sapiens
TPRSPTRCC

SEQ ID NO: 1291919 - protein, 9 aa, Homo Sapiens
MCNTLFFRC

SEQ ID NO: 1291920 - protein, 9 aa, Homo Sapiens
DDALHGDTE

SEQ ID NO: 1291921 - protein, 9 aa, Homo Sapiens
FHFQKDFLR

SEQ ID NO: 1291922 - protein, 9 aa, Homo Sapiens
LSKKGSLVA

SEQ ID NO: 1291923 - protein, 9 aa, Homo Sapiens
LRPRGGAWK

SEQ ID NO: 1291924 - protein, 9 aa, Homo Sapiens
PPDRRGSGE

SEQ ID NO: 1291925 - protein, 9 aa, Homo Sapiens
KALILSSVL

SEQ ID NO: 1291926 - protein, 9 aa, Homo Sapiens
GSQVIRSLT

SEQ ID NO: 1291927 - protein, 9 aa, Homo Sapiens
CGTMWSWGR

SEQ ID NO: 1291928 - protein, 9 aa, Homo Sapiens
KRLAGLGPV

SEQ ID NO: 1291929 - protein, 9 aa, Homo Sapiens
AGCWLSFNL

SEQ ID NO: 1291930 - protein, 9 aa, Homo Sapiens
RTGALGHRG

SEQ ID NO: 1291931 - protein, 9 aa, Homo Sapiens
WSGSRGLPP

SEQ ID NO: 1291932 - protein, 9 aa, Homo Sapiens
LGGKRILKM

SEQ ID NO: 1291933 - protein, 9 aa, Homo Sapiens
APLGLPAQD

SEQ ID NO: 1291934 - protein, 9 aa, Homo Sapiens
YQLAPAVEP

SEQ ID NO: 1291935 - protein, 9 aa, Homo Sapiens
ALTEPPAIV

SEQ ID NO: 1291936 - protein, 9 aa, Homo Sapiens
GYVLQVLEV

SEQ ID NO: 1291937 - protein, 9 aa, Homo Sapiens
DLAVADLAE

SEQ ID NO: 1291938 - protein, 9 aa, Homo Sapiens
LCQCDKKRG

SEQ ID NO: 1291939 - protein, 9 aa, Homo Sapiens
HRAGPPGGG

SEQ ID NO: 1291940 - protein, 9 aa, Homo Sapiens
PETNSGNER

SEQ ID NO: 1291941 - protein, 9 aa, Homo Sapiens
LIYRSRVAY

SEQ ID NO: 1291942 - protein, 9 aa, Homo Sapiens
AGCLGPFGF

SEQ ID NO: 1291943 - protein, 9 aa, Homo Sapiens
LPGQHLWLS

SEQ ID NO: 1291944 - protein, 9 aa, Homo Sapiens
QLMAVLCKR

SEQ ID NO: 1291945 - protein, 9 aa, Homo Sapiens
QKRQKCRWC

SEQ ID NO: 1291946 - protein, 9 aa, Homo Sapiens
AGQVYGEPP

SEQ ID NO: 1291947 - protein, 9 aa, Homo Sapiens
LGTALHGDV

SEQ ID NO: 1291948 - protein, 9 aa, Homo Sapiens
MEMKPLPRM

SEQ ID NO: 1291949 - protein, 9 aa, Homo Sapiens
RAPAAVQRL

SEQ ID NO: 1291950 - protein, 9 aa, Homo Sapiens
LTRTAMYTL

SEQ ID NO: 1291951 - protein, 9 aa, Homo Sapiens
LDIPAHPSI

SEQ ID NO: 1291952 - protein, 9 aa, Homo Sapiens
DVPEAPLPS

SEQ ID NO: 1291953 - protein, 9 aa, Homo Sapiens
PLKRDRQQQ

SEQ ID NO: 1291954 - protein, 9 aa, Homo Sapiens
FLLFCLVLM

SEQ ID NO: 1291955 - protein, 9 aa, Homo Sapiens
QVLLPPEGM

SEQ ID NO: 1291956 - protein, 9 aa, Homo Sapiens
AEPHPAGGV

SEQ ID NO: 1291957 - protein, 9 aa, Homo Sapiens
GPASVAPAT

SEQ ID NO: 1291958 - protein, 9 aa, Homo Sapiens
VPIHPVKER

SEQ ID NO: 1291959 - protein, 9 aa, Homo Sapiens
VVYHVIVPC

SEQ ID NO: 1291960 - protein, 9 aa, Homo Sapiens
VAESSAEML

SEQ ID NO: 1291961 - protein, 9 aa, Homo Sapiens
IVTVGNTIY

SEQ ID NO: 1291962 - protein, 9 aa, Homo Sapiens
GAAGKGAGA

SEQ ID NO: 1291963 - protein, 9 aa, Homo Sapiens
PAPGSPRLC

SEQ ID NO: 1291964 - protein, 9 aa, Homo Sapiens
TNNFGSVAR

SEQ ID NO: 1291965 - protein, 9 aa, Homo Sapiens
DHRADFWCD

SEQ ID NO: 1291966 - protein, 9 aa, Homo Sapiens
DSKHFGRGI

SEQ ID NO: 1291967 - protein, 9 aa, Homo Sapiens
SLVARTQPS

SEQ ID NO: 1291968 - protein, 9 aa, Homo Sapiens
VDVNLCWSE

SEQ ID NO: 1291969 - protein, 9 aa, Homo Sapiens
RAPTPRSPT

SEQ ID NO: 1291970 - protein, 9 aa, Homo Sapiens
SMCNTLFFR

SEQ ID NO: 1291971 - protein, 9 aa, Homo Sapiens
SSTSRDSRS

SEQ ID NO: 1291972 - protein, 9 aa, Homo Sapiens
GRTAASQLQ

SEQ ID NO: 1291973 - protein, 9 aa, Homo Sapiens
HSPADSSSM

SEQ ID NO: 1291974 - protein, 9 aa, Homo Sapiens
IITPPPHQM

SEQ ID NO: 1291975 - protein, 9 aa, Homo Sapiens
RLQKRRQGP

SEQ ID NO: 1291976 - protein, 9 aa, Homo Sapiens
RQISLPLRG

SEQ ID NO: 1291977 - protein, 9 aa, Homo Sapiens
FCGGSLLNE

SEQ ID NO: 1291978 - protein, 9 aa, Homo Sapiens
PPLILPQAL

SEQ ID NO: 1291979 - protein, 9 aa, Homo Sapiens
GCLSLGFSR

SEQ ID NO: 1291980 - protein, 9 aa, Homo Sapiens
WSAPTCPPW

SEQ ID NO: 1291981 - protein, 9 aa, Homo Sapiens
LFLVMLAAI

SEQ ID NO: 1291982 - protein, 9 aa, Homo Sapiens
SPKPPTPCS

SEQ ID NO: 1291983 - protein, 9 aa, Homo Sapiens
GVSAVTGTL

SEQ ID NO: 1291984 - protein, 9 aa, Homo Sapiens
DRSPVIQTL

SEQ ID NO: 1291985 - protein, 9 aa, Homo Sapiens
VLGLALQPA

SEQ ID NO: 1291986 - protein, 9 aa, Homo Sapiens
IFFTAKRRK

SEQ ID NO: 1291987 - protein, 9 aa, Homo Sapiens
FSSSSSGSR

SEQ ID NO: 1291988 - protein, 9 aa, Homo Sapiens
LWLSHRLRL

SEQ ID NO: 1291989 - protein, 9 aa, Homo Sapiens
VLHDLKDRY

SEQ ID NO: 1291990 - protein, 9 aa, Homo Sapiens
VCCPRAPEV

SEQ ID NO: 1291991 - protein, 9 aa, Homo Sapiens
SFPETNSGN

SEQ ID NO: 1291992 - protein, 9 aa, Homo Sapiens
PAQDTPPVH

SEQ ID NO: 1291993 - protein, 9 aa, Homo Sapiens
AWNNYRIFI

SEQ ID NO: 1291994 - protein, 9 aa, Homo Sapiens
KKEKINIRM

SEQ ID NO: 1291995 - protein, 9 aa, Homo Sapiens
NCNSKCYLE

SEQ ID NO: 1291996 - protein, 9 aa, Homo Sapiens
RTVPGPGMA

SEQ ID NO: 1291997 - protein, 9 aa, Homo Sapiens
DQACVPPEG

SEQ ID NO: 1291998 - protein, 9 aa, Homo Sapiens
PAPRGRRPR

SEQ ID NO: 1291999 - protein, 9 aa, Homo Sapiens
SNWVETRLE

SEQ ID NO: 1292000 - protein, 9 aa, Homo Sapiens
RPLPPSPTM

SEQ ID NO: 1292001 - protein, 9 aa, Homo Sapiens
TYISALSYG

SEQ ID NO: 1292002 - protein, 9 aa, Homo Sapiens
VPSRAWQDV

SEQ ID NO: 1292003 - protein, 9 aa, Homo Sapiens
GSLHDTLQE

SEQ ID NO: 1292004 - protein, 9 aa, Homo Sapiens
HAAEQYTPK

SEQ ID NO: 1292005 - protein, 9 aa, Homo Sapiens
DIPAHPSIR

SEQ ID NO: 1292006 - protein, 9 aa, Homo Sapiens
NQSVELKPH

SEQ ID NO: 1292007 - protein, 9 aa, Homo Sapiens
GESHRGARR

SEQ ID NO: 1292008 - protein, 9 aa, Homo Sapiens
STQSSKRPG

SEQ ID NO: 1292009 - protein, 9 aa, Homo Sapiens
SGMRTFRVL

SEQ ID NO: 1292010 - protein, 9 aa, Homo Sapiens
NLGLTFLRC

SEQ ID NO: 1292011 - protein, 9 aa, Homo Sapiens
FPPIGAFPV

SEQ ID NO: 1292012 - protein, 9 aa, Homo Sapiens
SGGSLFTTG

SEQ ID NO: 1292013 - protein, 9 aa, Homo Sapiens
NRTTIPQPW

SEQ ID NO: 1292014 - protein, 9 aa, Homo Sapiens
HGQGGQKPS

SEQ ID NO: 1292015 - protein, 9 aa, Homo Sapiens
EKGELANFH

SEQ ID NO: 1292016 - protein, 9 aa, Homo Sapiens
GRILLQRNL

SEQ ID NO: 1292017 - protein, 9 aa, Homo Sapiens
ASGRGTCPC

SEQ ID NO: 1292018 - protein, 9 aa, Homo Sapiens
TQRALLVHP

SEQ ID NO: 1292019 - protein, 9 aa, Homo Sapiens
QVLEVGADK

SEQ ID NO: 1292020 - protein, 9 aa, Homo Sapiens
GRRGAPGHP

SEQ ID NO: 1292021 - protein, 9 aa, Homo Sapiens
EYLKGGHRH

SEQ ID NO: 1292022 - protein, 9 aa, Homo Sapiens
SAHPSRPCR

SEQ ID NO: 1292023 - protein, 9 aa, Homo Sapiens
TTRNSSIRA

SEQ ID NO: 1292024 - protein, 9 aa, Homo Sapiens
TETSVHDFK

SEQ ID NO: 1292025 - protein, 9 aa, Homo Sapiens
QQMEQKKIT

SEQ ID NO: 1292026 - protein, 9 aa, Homo Sapiens
VEAAQFQED

SEQ ID NO: 1292027 - protein, 9 aa, Homo Sapiens
SRGPKRQRW

SEQ ID NO: 1292028 - protein, 9 aa, Homo Sapiens
SFHRGASCH

SEQ ID NO: 1292029 - protein, 9 aa, Homo Sapiens
TVIAGAHHC

SEQ ID NO: 1292030 - protein, 9 aa, Homo Sapiens
ISPSHSQQI

SEQ ID NO: 1292031 - protein, 9 aa, Homo Sapiens
HPNMLKFIG

SEQ ID NO: 1292032 - protein, 9 aa, Homo Sapiens
DWVAETKRK

SEQ ID NO: 1292033 - protein, 9 aa, Homo Sapiens
AFIESDDAV

SEQ ID NO: 1292034 - protein, 9 aa, Homo Sapiens
PPSGTPPSP

SEQ ID NO: 1292035 - protein, 9 aa, Homo Sapiens
SLNKHTAFS

SEQ ID NO: 1292036 - protein, 9 aa, Homo Sapiens
SPSRSPSRH

SEQ ID NO: 1292037 - protein, 9 aa, Homo Sapiens
RTRTCPSPP

SEQ ID NO: 1292038 - protein, 9 aa, Homo Sapiens
AEKRCRIST

SEQ ID NO: 1292039 - protein, 9 aa, Homo Sapiens
DTLQQPWDS

SEQ ID NO: 1292040 - protein, 9 aa, Homo Sapiens
DNGHPQDPG

SEQ ID NO: 1292041 - protein, 9 aa, Homo Sapiens
EVDEKPASM

SEQ ID NO: 1292042 - protein, 9 aa, Homo Sapiens
DDLKDIFFT

SEQ ID NO: 1292043 - protein, 9 aa, Homo Sapiens
LHLVNPSFL

SEQ ID NO: 1292044 - protein, 9 aa, Homo Sapiens
AQGHQRRKK

SEQ ID NO: 1292045 - protein, 9 aa, Homo Sapiens
HQYLQSEWT

SEQ ID NO: 1292046 - protein, 9 aa, Homo Sapiens
FSGAAISQH

SEQ ID NO: 1292047 - protein, 9 aa, Homo Sapiens
LEALFLIVD

SEQ ID NO: 1292048 - protein, 9 aa, Homo Sapiens
QLRGRARAG

SEQ ID NO: 1292049 - protein, 9 aa, Homo Sapiens
AASTSLYVR

SEQ ID NO: 1292050 - protein, 9 aa, Homo Sapiens
MILCRNDHI

SEQ ID NO: 1292051 - protein, 9 aa, Homo Sapiens
DQKNIRQRV

SEQ ID NO: 1292052 - protein, 9 aa, Homo Sapiens
VARTGILQE

SEQ ID NO: 1292053 - protein, 9 aa, Homo Sapiens
RWPGRDSGR

SEQ ID NO: 1292054 - protein, 9 aa, Homo Sapiens
CLGPFGFFG

SEQ ID NO: 1292055 - protein, 9 aa, Homo Sapiens
RKKMLENRK

SEQ ID NO: 1292056 - protein, 9 aa, Homo Sapiens
KNSRGPKRQ

SEQ ID NO: 1292057 - protein, 9 aa, Homo Sapiens
PHGKRCNPC

SEQ ID NO: 1292058 - protein, 9 aa, Homo Sapiens
KNMCKPRPL

SEQ ID NO: 1292059 - protein, 9 aa, Homo Sapiens
EYYELRSIL

SEQ ID NO: 1292060 - protein, 9 aa, Homo Sapiens
GGNRSICLT

SEQ ID NO: 1292061 - protein, 9 aa, Homo Sapiens
ATRHGPYPA

SEQ ID NO: 1292062 - protein, 9 aa, Homo Sapiens
LKSMLKKYA

SEQ ID NO: 1292063 - protein, 9 aa, Homo Sapiens
LARGHVPHC

SEQ ID NO: 1292064 - protein, 9 aa, Homo Sapiens
RRARPGQLR

SEQ ID NO: 1292065 - protein, 9 aa, Homo Sapiens
KGMVNVTRE

SEQ ID NO: 1292066 - protein, 9 aa, Homo Sapiens
ANDNSPFML

SEQ ID NO: 1292067 - protein, 9 aa, Homo Sapiens
LSQSNSQLS

SEQ ID NO: 1292068 - protein, 9 aa, Homo Sapiens
LSYPLVLKE

SEQ ID NO: 1292069 - protein, 9 aa, Homo Sapiens
SMSCWALAP

SEQ ID NO: 1292070 - protein, 9 aa, Homo Sapiens
FLTGAYILL

SEQ ID NO: 1292071 - protein, 9 aa, Homo Sapiens
EGQISINKT

SEQ ID NO: 1292072 - protein, 9 aa, Homo Sapiens
HGSSITKQK

SEQ ID NO: 1292073 - protein, 9 aa, Homo Sapiens
ALVPDLFHG

SEQ ID NO: 1292074 - protein, 9 aa, Homo Sapiens
EGGSARHAV

SEQ ID NO: 1292075 - protein, 9 aa, Homo Sapiens
GAPPPSAAA

SEQ ID NO: 1292076 - protein, 9 aa, Homo Sapiens
MPTGLRKAR

SEQ ID NO: 1292077 - protein, 9 aa, Homo Sapiens
LLHPHGKRC

SEQ ID NO: 1292078 - protein, 9 aa, Homo Sapiens
GEAIYQIGV

SEQ ID NO: 1292079 - protein, 9 aa, Homo Sapiens
AMVVLNKSL

SEQ ID NO: 1292080 - protein, 9 aa, Homo Sapiens
GPMSRSLWP

SEQ ID NO: 1292081 - protein, 9 aa, Homo Sapiens
RQKCRWCQC

SEQ ID NO: 1292082 - protein, 9 aa, Homo Sapiens
ASPVPTSSP

SEQ ID NO: 1292083 - protein, 9 aa, Homo Sapiens
FQHAVSDSE

SEQ ID NO: 1292084 - protein, 9 aa, Homo Sapiens
LLSPAVPQI

SEQ ID NO: 1292085 - protein, 9 aa, Homo Sapiens
RATRHGPYP

SEQ ID NO: 1292086 - protein, 9 aa, Homo Sapiens
PGCFLKKVI

SEQ ID NO: 1292087 - protein, 9 aa, Homo Sapiens
SSMACGSAE

SEQ ID NO: 1292088 - protein, 9 aa, Homo Sapiens
ADMRGWDWA

SEQ ID NO: 1292089 - protein, 9 aa, Homo Sapiens
GRGEAIYQI

SEQ ID NO: 1292090 - protein, 9 aa, Homo Sapiens
CCNYDHCPS

SEQ ID NO: 1292091 - protein, 9 aa, Homo Sapiens
DCDEHGLTC

SEQ ID NO: 1292092 - protein, 9 aa, Homo Sapiens
SHSQQIAGS

SEQ ID NO: 1292093 - protein, 9 aa, Homo Sapiens
LDFPPIGAF

SEQ ID NO: 1292094 - protein, 9 aa, Homo Sapiens
TRPCRRSSS

SEQ ID NO: 1292095 - protein, 9 aa, Homo Sapiens
ENSHPPTTT

SEQ ID NO: 1292096 - protein, 9 aa, Homo Sapiens
TFLLVIMLI

SEQ ID NO: 1292097 - protein, 9 aa, Homo Sapiens
DLSISYEGF

SEQ ID NO: 1292098 - protein, 9 aa, Homo Sapiens
WQLEVLGLA

SEQ ID NO: 1292099 - protein, 9 aa, Homo Sapiens
ATWTHPSTK

SEQ ID NO: 1292100 - protein, 9 aa, Homo Sapiens
ADLEGPGGG

SEQ ID NO: 1292101 - protein, 9 aa, Homo Sapiens
YNAGTNILE

SEQ ID NO: 1292102 - protein, 9 aa, Homo Sapiens
GVPKHLLGQ

SEQ ID NO: 1292103 - protein, 9 aa, Homo Sapiens
LCRNDHIRL

SEQ ID NO: 1292104 - protein, 9 aa, Homo Sapiens
DPRSLNIVC

SEQ ID NO: 1292105 - protein, 9 aa, Homo Sapiens
NQPARVCER

SEQ ID NO: 1292106 - protein, 9 aa, Homo Sapiens
SRPCRMRLY

SEQ ID NO: 1292107 - protein, 9 aa, Homo Sapiens
LEVAAFMLA

SEQ ID NO: 1292108 - protein, 9 aa, Homo Sapiens
GLGPVEDAE

SEQ ID NO: 1292109 - protein, 9 aa, Homo Sapiens
DTTHPTCIL

SEQ ID NO: 1292110 - protein, 9 aa, Homo Sapiens
IASVDLPNT

SEQ ID NO: 1292111 - protein, 9 aa, Homo Sapiens
ISKDDMQEL

SEQ ID NO: 1292112 - protein, 9 aa, Homo Sapiens
RNPDARSAL

SEQ ID NO: 1292113 - protein, 9 aa, Homo Sapiens
SVPLDYRLE

SEQ ID NO: 1292114 - protein, 9 aa, Homo Sapiens
PGQHLWLSH

SEQ ID NO: 1292115 - protein, 9 aa, Homo Sapiens
QQQRGRGSC

SEQ ID NO: 1292116 - protein, 9 aa, Homo Sapiens
RQRSAQWLD

SEQ ID NO: 1292117 - protein, 9 aa, Homo Sapiens
RAGEMLYLS

SEQ ID NO: 1292118 - protein, 9 aa, Homo Sapiens
LQSLLSLYS

SEQ ID NO: 1292119 - protein, 9 aa, Homo Sapiens
RERKSDGEN

SEQ ID NO: 1292120 - protein, 9 aa, Homo Sapiens
LMMGHFPSQ

SEQ ID NO: 1292121 - protein, 9 aa, Homo Sapiens
EEEQALCCQ

SEQ ID NO: 1292122 - protein, 9 aa, Homo Sapiens
MACGSAESS

SEQ ID NO: 1292123 - protein, 9 aa, Homo Sapiens
KLSALRISN

SEQ ID NO: 1292124 - protein, 9 aa, Homo Sapiens
AAMIPTQTW

SEQ ID NO: 1292125 - protein, 9 aa, Homo Sapiens
SGRSTPRLP

SEQ ID NO: 1292126 - protein, 9 aa, Homo Sapiens
YKLTYTKVW

SEQ ID NO: 1292127 - protein, 9 aa, Homo Sapiens
HVLLTFDGF

SEQ ID NO: 1292128 - protein, 9 aa, Homo Sapiens
VRDANPEKP

SEQ ID NO: 1292129 - protein, 9 aa, Homo Sapiens
PQITSPPCC

SEQ ID NO: 1292130 - protein, 9 aa, Homo Sapiens
GGSPFLFWE

SEQ ID NO: 1292131 - protein, 9 aa, Homo Sapiens
ANKRRSTLT

SEQ ID NO: 1292132 - protein, 9 aa, Homo Sapiens
HIHQGKNGV

SEQ ID NO: 1292133 - protein, 9 aa, Homo Sapiens
QAGVHAYPG

SEQ ID NO: 1292134 - protein, 9 aa, Homo Sapiens
DPFAMHFIF

SEQ ID NO: 1292135 - protein, 9 aa, Homo Sapiens
AGTNILEGD

SEQ ID NO: 1292136 - protein, 9 aa, Homo Sapiens
RRGLGPPAT

SEQ ID NO: 1292137 - protein, 9 aa, Homo Sapiens
AVQQPAGAR

SEQ ID NO: 1292138 - protein, 9 aa, Homo Sapiens
IHSTATWTH

SEQ ID NO: 1292139 - protein, 9 aa, Homo Sapiens
QGLAVPWLE

SEQ ID NO: 1292140 - protein, 9 aa, Homo Sapiens
HQQKHLLRP

SEQ ID NO: 1292141 - protein, 9 aa, Homo Sapiens
EKCLGSMEK

SEQ ID NO: 1292142 - protein, 9 aa, Homo Sapiens
DLKDIFFTA

SEQ ID NO: 1292143 - protein, 9 aa, Homo Sapiens
KPRPLLQKW

SEQ ID NO: 1292144 - protein, 9 aa, Homo Sapiens
LFLGRNSFW

SEQ ID NO: 1292145 - protein, 9 aa, Homo Sapiens
DEGFEPLGF

SEQ ID NO: 1292146 - protein, 9 aa, Homo Sapiens
AVPVQKEAA

SEQ ID NO: 1292147 - protein, 9 aa, Homo Sapiens
PPPPPTKKR

SEQ ID NO: 1292148 - protein, 9 aa, Homo Sapiens
HYIKPCFKG

SEQ ID NO: 1292149 - protein, 9 aa, Homo Sapiens
NMALADLAV

SEQ ID NO: 1292150 - protein, 9 aa, Homo Sapiens
TTATCSLSS

SEQ ID NO: 1292151 - protein, 9 aa, Homo Sapiens
AEVCQLQPA

SEQ ID NO: 1292152 - protein, 9 aa, Homo Sapiens
SPFLARSWN

SEQ ID NO: 1292153 - protein, 9 aa, Homo Sapiens
RKKRRWAPR

SEQ ID NO: 1292154 - protein, 9 aa, Homo Sapiens
GEVVGQHEL

SEQ ID NO: 1292155 - protein, 9 aa, Homo Sapiens
PPVHQVLLV

SEQ ID NO: 1292156 - protein, 9 aa, Homo Sapiens
NCQRKRRQR

SEQ ID NO: 1292157 - protein, 9 aa, Homo Sapiens
TPASQSFGI

SEQ ID NO: 1292158 - protein, 9 aa, Homo Sapiens
PDRRGSGEP

SEQ ID NO: 1292159 - protein, 9 aa, Homo Sapiens
HDRDCKSEE

SEQ ID NO: 1292160 - protein, 9 aa, Homo Sapiens
GQSAKSGST

SEQ ID NO: 1292161 - protein, 9 aa, Homo Sapiens
YVADGERTA

SEQ ID NO: 1292162 - protein, 9 aa, Homo Sapiens
GRAPPTPRG

SEQ ID NO: 1292163 - protein, 9 aa, Homo Sapiens
DVLDNDGCT

SEQ ID NO: 1292164 - protein, 9 aa, Homo Sapiens
IDRFHVATN

SEQ ID NO: 1292165 - protein, 9 aa, Homo Sapiens
TARTYECGQ

SEQ ID NO: 1292166 - protein, 9 aa, Homo Sapiens
PSEWAGSDV

SEQ ID NO: 1292167 - protein, 9 aa, Homo Sapiens
ENIPGKLTK

SEQ ID NO: 1292168 - protein, 9 aa, Homo Sapiens
GHQQKHLLR

SEQ ID NO: 1292169 - protein, 9 aa, Homo Sapiens
LFFVLVNLE

SEQ ID NO: 1292170 - protein, 9 aa, Homo Sapiens
LEVLGLALQ

SEQ ID NO: 1292171 - protein, 9 aa, Homo Sapiens
DVDILQRPG

SEQ ID NO: 1292172 - protein, 9 aa, Homo Sapiens
PQPFSSTTQ

SEQ ID NO: 1292173 - protein, 9 aa, Homo Sapiens
FLPPMHCPT

SEQ ID NO: 1292174 - protein, 9 aa, Homo Sapiens
SVFWSQLCC

SEQ ID NO: 1292175 - protein, 9 aa, Homo Sapiens
LCLHETVNT

SEQ ID NO: 1292176 - protein, 9 aa, Homo Sapiens
ASELCLEQN

SEQ ID NO: 1292177 - protein, 9 aa, Homo Sapiens
EVKKEAKEV

SEQ ID NO: 1292178 - protein, 9 aa, Homo Sapiens
INATDDDED

SEQ ID NO: 1292179 - protein, 9 aa, Homo Sapiens
GHRHQYLQS

SEQ ID NO: 1292180 - protein, 9 aa, Homo Sapiens
DSSSMGSPV

SEQ ID NO: 1292181 - protein, 9 aa, Homo Sapiens
HLESILSVQ

SEQ ID NO: 1292182 - protein, 9 aa, Homo Sapiens
WCQCLQFAM

SEQ ID NO: 1292183 - protein, 9 aa, Homo Sapiens
SQLQRGRRR

SEQ ID NO: 1292184 - protein, 9 aa, Homo Sapiens
LIIKESDDN

SEQ ID NO: 1292185 - protein, 9 aa, Homo Sapiens
VKTSTTQSK

SEQ ID NO: 1292186 - protein, 9 aa, Homo Sapiens
LPLRGFLLH

SEQ ID NO: 1292187 - protein, 9 aa, Homo Sapiens
CIGLTGTGK

SEQ ID NO: 1292188 - protein, 9 aa, Homo Sapiens
ESELERGVR

SEQ ID NO: 1292189 - protein, 9 aa, Homo Sapiens
IHQGKNGVK

SEQ ID NO: 1292190 - protein, 9 aa, Homo Sapiens
TFKTRKAST

SEQ ID NO: 1292191 - protein, 9 aa, Homo Sapiens
QHILPVLFT

SEQ ID NO: 1292192 - protein, 9 aa, Homo Sapiens
AYDQKNIRQ

SEQ ID NO: 1292193 - protein, 9 aa, Homo Sapiens
PVARTGILQ

SEQ ID NO: 1292194 - protein, 9 aa, Homo Sapiens
IVVYHVIVP

SEQ ID NO: 1292195 - protein, 9 aa, Homo Sapiens
RGCLLQLGQ

SEQ ID NO: 1292196 - protein, 9 aa, Homo Sapiens
CGGRVEAAV

SEQ ID NO: 1292197 - protein, 9 aa, Homo Sapiens
ESILSVQKI

SEQ ID NO: 1292198 - protein, 9 aa, Homo Sapiens
KTQLEINGQ

SEQ ID NO: 1292199 - protein, 9 aa, Homo Sapiens
ASSGNCCST

SEQ ID NO: 1292200 - protein, 9 aa, Homo Sapiens
STPPRGDHR

SEQ ID NO: 1292201 - protein, 9 aa, Homo Sapiens
GSLLNEQWV

SEQ ID NO: 1292202 - protein, 9 aa, Homo Sapiens
GNLPHPSAV

SEQ ID NO: 1292203 - protein, 9 aa, Homo Sapiens
KCYLETLPN

SEQ ID NO: 1292204 - protein, 9 aa, Homo Sapiens
LINCCTLEV

SEQ ID NO: 1292205 - protein, 9 aa, Homo Sapiens
AIEHGLGDP

SEQ ID NO: 1292206 - protein, 9 aa, Homo Sapiens
IQVKTLGTL

SEQ ID NO: 1292207 - protein, 9 aa, Homo Sapiens
LEDLLEIIL

SEQ ID NO: 1292208 - protein, 9 aa, Homo Sapiens
DHRRCSQGG

SEQ ID NO: 1292209 - protein, 9 aa, Homo Sapiens
SKHFGRGIM

SEQ ID NO: 1292210 - protein, 9 aa, Homo Sapiens
RDSGRKPRC

SEQ ID NO: 1292211 - protein, 9 aa, Homo Sapiens
RTALVERLR

SEQ ID NO: 1292212 - protein, 9 aa, Homo Sapiens
AMWLSASHF

SEQ ID NO: 1292213 - protein, 9 aa, Homo Sapiens
LVYILWAVD

SEQ ID NO: 1292214 - protein, 9 aa, Homo Sapiens
APPNEEKGD

SEQ ID NO: 1292215 - protein, 9 aa, Homo Sapiens
FSVFWSQLC

SEQ ID NO: 1292216 - protein, 9 aa, Homo Sapiens
SLVSRSGAD

SEQ ID NO: 1292217 - protein, 9 aa, Homo Sapiens
HPQDPGLAL

SEQ ID NO: 1292218 - protein, 9 aa, Homo Sapiens
MTSAVLLTV

SEQ ID NO: 1292219 - protein, 9 aa, Homo Sapiens
KSRDPENSE

SEQ ID NO: 1292220 - protein, 9 aa, Homo Sapiens
RSTLTTVLN

SEQ ID NO: 1292221 - protein, 9 aa, Homo Sapiens
LQRGRRRPG

SEQ ID NO: 1292222 - protein, 9 aa, Homo Sapiens
GPGMLEQKQ

SEQ ID NO: 1292223 - protein, 9 aa, Homo Sapiens
EPPAIVEGY

SEQ ID NO: 1292224 - protein, 9 aa, Homo Sapiens
AQKLLNCQR

SEQ ID NO: 1292225 - protein, 9 aa, Homo Sapiens
RVSTLTMES

SEQ ID NO: 1292226 - protein, 9 aa, Homo Sapiens
LTDTDRERK

SEQ ID NO: 1292227 - protein, 9 aa, Homo Sapiens
SHHAWPGCF

SEQ ID NO: 1292228 - protein, 9 aa, Homo Sapiens
TSKSSVSGS

SEQ ID NO: 1292229 - protein, 9 aa, Homo Sapiens
EDLLEIILI

SEQ ID NO: 1292230 - protein, 9 aa, Homo Sapiens
LKCMECGSL

SEQ ID NO: 1292231 - protein, 9 aa, Homo Sapiens
LDKLVHLVI

SEQ ID NO: 1292232 - protein, 9 aa, Homo Sapiens
QVPAAGVPP

SEQ ID NO: 1292233 - protein, 9 aa, Homo Sapiens
VNFEHLKKK

SEQ ID NO: 1292234 - protein, 9 aa, Homo Sapiens
LSPAVPQIT

SEQ ID NO: 1292235 - protein, 9 aa, Homo Sapiens
TLTAKRMAQ

SEQ ID NO: 1292236 - protein, 9 aa, Homo Sapiens
ATCSLSSRW

SEQ ID NO: 1292237 - protein, 9 aa, Homo Sapiens
LTEPPAIVE

SEQ ID NO: 1292238 - protein, 9 aa, Homo Sapiens
MSYELSRKV

SEQ ID NO: 1292239 - protein, 9 aa, Homo Sapiens
PSQNGLRPV

SEQ ID NO: 1292240 - protein, 9 aa, Homo Sapiens
DYLDRTLYP

SEQ ID NO: 1292241 - protein, 9 aa, Homo Sapiens
SLGGWRGWW

SEQ ID NO: 1292242 - protein, 9 aa, Homo Sapiens
SWALPTGSS

SEQ ID NO: 1292243 - protein, 9 aa, Homo Sapiens
QWDGAGRAP

SEQ ID NO: 1292244 - protein, 9 aa, Homo Sapiens
NGAPPPSAA

SEQ ID NO: 1292245 - protein, 9 aa, Homo Sapiens
AAPPPPPLG

SEQ ID NO: 1292246 - protein, 9 aa, Homo Sapiens
KPRCTQELQ

SEQ ID NO: 1292247 - protein, 9 aa, Homo Sapiens
VLLTVLIPC

SEQ ID NO: 1292248 - protein, 9 aa, Homo Sapiens
LHFNDAPLG

SEQ ID NO: 1292249 - protein, 9 aa, Homo Sapiens
GRPSPWKPC

SEQ ID NO: 1292250 - protein, 9 aa, Homo Sapiens
ELRRRTDPA

SEQ ID NO: 1292251 - protein, 9 aa, Homo Sapiens
HFVNFEHLK

SEQ ID NO: 1292252 - protein, 9 aa, Homo Sapiens
KRQKCRWCQ

SEQ ID NO: 1292253 - protein, 9 aa, Homo Sapiens
KHGGSYSAV

SEQ ID NO: 1292254 - protein, 9 aa, Homo Sapiens
FVQGVPKHL

SEQ ID NO: 1292255 - protein, 9 aa, Homo Sapiens
VVLSGILLL

SEQ ID NO: 1292256 - protein, 9 aa, Homo Sapiens
QVLCGGRVE

SEQ ID NO: 1292257 - protein, 9 aa, Homo Sapiens
PATCPAVVQ

SEQ ID NO: 1292258 - protein, 9 aa, Homo Sapiens
ILCRNDHIR

SEQ ID NO: 1292259 - protein, 9 aa, Homo Sapiens
YNKLKECLH

SEQ ID NO: 1292260 - protein, 9 aa, Homo Sapiens
EMWDLHPST

SEQ ID NO: 1292261 - protein, 9 aa, Homo Sapiens
PPCTSAASA

SEQ ID NO: 1292262 - protein, 9 aa, Homo Sapiens
VRMKSVGIL

SEQ ID NO: 1292263 - protein, 9 aa, Homo Sapiens
SFWSTIYGS

SEQ ID NO: 1292264 - protein, 9 aa, Homo Sapiens
VRQLLDPPL

SEQ ID NO: 1292265 - protein, 9 aa, Homo Sapiens
VICILEMWD

SEQ ID NO: 1292266 - protein, 9 aa, Homo Sapiens
GRVDTATPS

SEQ ID NO: 1292267 - protein, 9 aa, Homo Sapiens
HGGGCFLAG

SEQ ID NO: 1292268 - protein, 9 aa, Homo Sapiens
QSSCAFAGG

SEQ ID NO: 1292269 - protein, 9 aa, Homo Sapiens
QDRVQCMTS

SEQ ID NO: 1292270 - protein, 9 aa, Homo Sapiens
PEVPRCAMA

SEQ ID NO: 1292271 - protein, 9 aa, Homo Sapiens
FTFMWLVSS

SEQ ID NO: 1292272 - protein, 9 aa, Homo Sapiens
ALNPRLHPP

SEQ ID NO: 1292273 - protein, 9 aa, Homo Sapiens
HYHSLVDYS

SEQ ID NO: 1292274 - protein, 9 aa, Homo Sapiens
SNARGQLSC

SEQ ID NO: 1292275 - protein, 9 aa, Homo Sapiens
DTDRERKSD

SEQ ID NO: 1292276 - protein, 9 aa, Homo Sapiens
FAISKDDMQ

SEQ ID NO: 1292277 - protein, 9 aa, Homo Sapiens
VPDLFHGLR

SEQ ID NO: 1292278 - protein, 9 aa, Homo Sapiens
NARGQLSCS

SEQ ID NO: 1292279 - protein, 9 aa, Homo Sapiens
SPLDSSPLQ

SEQ ID NO: 1292280 - protein, 9 aa, Homo Sapiens
PEGMCPVGR

SEQ ID NO: 1292281 - protein, 9 aa, Homo Sapiens
TKKRGKSQG

SEQ ID NO: 1292282 - protein, 9 aa, Homo Sapiens
LKSRDPENS

SEQ ID NO: 1292283 - protein, 9 aa, Homo Sapiens
WLAETVTLI

SEQ ID NO: 1292284 - protein, 9 aa, Homo Sapiens
DLIIKESDD

SEQ ID NO: 1292285 - protein, 9 aa, Homo Sapiens
HPLNWILVD

SEQ ID NO: 1292286 - protein, 9 aa, Homo Sapiens
VWSSRLPWE

SEQ ID NO: 1292287 - protein, 9 aa, Homo Sapiens
RWTTRPCRR

SEQ ID NO: 1292288 - protein, 9 aa, Homo Sapiens
GLLQEVELE

SEQ ID NO: 1292289 - protein, 9 aa, Homo Sapiens
CLEQGKNPS

SEQ ID NO: 1292290 - protein, 9 aa, Homo Sapiens
VSKKRLPKL

SEQ ID NO: 1292291 - protein, 9 aa, Homo Sapiens
RYYRKMSEP

SEQ ID NO: 1292292 - protein, 9 aa, Homo Sapiens
KEEEVEAQV

SEQ ID NO: 1292293 - protein, 9 aa, Homo Sapiens
RVMYPVKSV

SEQ ID NO: 1292294 - protein, 9 aa, Homo Sapiens
PTRPLPPSP

SEQ ID NO: 1292295 - protein, 9 aa, Homo Sapiens
HRADFWCDV

SEQ ID NO: 1292296 - protein, 9 aa, Homo Sapiens
EEQIGPYCT

SEQ ID NO: 1292297 - protein, 9 aa, Homo Sapiens
LIAEKRCRI

SEQ ID NO: 1292298 - protein, 9 aa, Homo Sapiens
GMQNLASND

SEQ ID NO: 1292299 - protein, 9 aa, Homo Sapiens
PATDKSATP

SEQ ID NO: 1292300 - protein, 9 aa, Homo Sapiens
TPRKDCDEH

SEQ ID NO: 1292301 - protein, 9 aa, Homo Sapiens
VTKCAFQAP

SEQ ID NO: 1292302 - protein, 9 aa, Homo Sapiens
GKRVLCGFC

SEQ ID NO: 1292303 - protein, 9 aa, Homo Sapiens
SHRLRLRLP

SEQ ID NO: 1292304 - protein, 9 aa, Homo Sapiens
IMRMNQVPT

SEQ ID NO: 1292305 - protein, 9 aa, Homo Sapiens
SSRALVPGS

SEQ ID NO: 1292306 - protein, 9 aa, Homo Sapiens
RARRAPGRT

SEQ ID NO: 1292307 - protein, 9 aa, Homo Sapiens
NLPHPSAVH

SEQ ID NO: 1292308 - protein, 9 aa, Homo Sapiens
RRTDPATLY

SEQ ID NO: 1292309 - protein, 9 aa, Homo Sapiens
QKCIEQRES

SEQ ID NO: 1292310 - protein, 9 aa, Homo Sapiens
WSENTRLAL

SEQ ID NO: 1292311 - protein, 9 aa, Homo Sapiens
RTSRGQAQD

SEQ ID NO: 1292312 - protein, 9 aa, Homo Sapiens
PTMTLGASW

SEQ ID NO: 1292313 - protein, 9 aa, Homo Sapiens
QNISVREHF

SEQ ID NO: 1292314 - protein, 9 aa, Homo Sapiens
ACGGDIEAR

SEQ ID NO: 1292315 - protein, 9 aa, Homo Sapiens
DPNSGYNAW

SEQ ID NO: 1292316 - protein, 9 aa, Homo Sapiens
CLLAVEVSI

SEQ ID NO: 1292317 - protein, 9 aa, Homo Sapiens
LAMDVLHRQ

SEQ ID NO: 1292318 - protein, 9 aa, Homo Sapiens
PMTACSILA

SEQ ID NO: 1292319 - protein, 9 aa, Homo Sapiens
PHQMKCLTA

SEQ ID NO: 1292320 - protein, 9 aa, Homo Sapiens
QKCRWCQCL

SEQ ID NO: 1292321 - protein, 9 aa, Homo Sapiens
RNTEMDTEW

SEQ ID NO: 1292322 - protein, 9 aa, Homo Sapiens
PRRGRELWQ

SEQ ID NO: 1292323 - protein, 9 aa, Homo Sapiens
YDHCPSTPA

SEQ ID NO: 1292324 - protein, 9 aa, Homo Sapiens
KEDMLDWDC

SEQ ID NO: 1292325 - protein, 9 aa, Homo Sapiens
IDNIPKETF

SEQ ID NO: 1292326 - protein, 9 aa, Homo Sapiens
RPTRHLSGY

SEQ ID NO: 1292327 - protein, 9 aa, Homo Sapiens
GITAAPLPH

SEQ ID NO: 1292328 - protein, 9 aa, Homo Sapiens
VATNTLPKV

SEQ ID NO: 1292329 - protein, 9 aa, Homo Sapiens
TVQLSIFEL

SEQ ID NO: 1292330 - protein, 9 aa, Homo Sapiens
LQFLDLLLP

SEQ ID NO: 1292331 - protein, 9 aa, Homo Sapiens
RLQSLLSLY

SEQ ID NO: 1292332 - protein, 9 aa, Homo Sapiens
TLPCRRHCP

SEQ ID NO: 1292333 - protein, 9 aa, Homo Sapiens
GHAGGGDAR

SEQ ID NO: 1292334 - protein, 9 aa, Homo Sapiens
VFTFMWLVS

SEQ ID NO: 1292335 - protein, 9 aa, Homo Sapiens
PDGVGAAVA

SEQ ID NO: 1292336 - protein, 9 aa, Homo Sapiens
PVPTSSPAQ

SEQ ID NO: 1292337 - protein, 9 aa, Homo Sapiens
RDNNNISST

SEQ ID NO: 1292338 - protein, 9 aa, Homo Sapiens
PAQPPGPAP

SEQ ID NO: 1292339 - protein, 9 aa, Homo Sapiens
LPRASLRAT

SEQ ID NO: 1292340 - protein, 9 aa, Homo Sapiens
QLPIAEVML

SEQ ID NO: 1292341 - protein, 9 aa, Homo Sapiens
CLCTLNLLY

SEQ ID NO: 1292342 - protein, 9 aa, Homo Sapiens
SANGDARHS

SEQ ID NO: 1292343 - protein, 9 aa, Homo Sapiens
RQLLDPPLI

SEQ ID NO: 1292344 - protein, 9 aa, Homo Sapiens
PAVHLPFFY

SEQ ID NO: 1292345 - protein, 9 aa, Homo Sapiens
KSSLSPPHP

SEQ ID NO: 1292346 - protein, 9 aa, Homo Sapiens
IPFSVFWSQ

SEQ ID NO: 1292347 - protein, 9 aa, Homo Sapiens
RGWWGNGWW

SEQ ID NO: 1292348 - protein, 9 aa, Homo Sapiens
KDIFFTAKR

SEQ ID NO: 1292349 - protein, 9 aa, Homo Sapiens
LTRVLPTNP

SEQ ID NO: 1292350 - protein, 9 aa, Homo Sapiens
WATVSISTV

SEQ ID NO: 1292351 - protein, 9 aa, Homo Sapiens
STSTCLSPE

SEQ ID NO: 1292352 - protein, 9 aa, Homo Sapiens
DSFHRGASC

SEQ ID NO: 1292353 - protein, 9 aa, Homo Sapiens
SGTPPSPVS

SEQ ID NO: 1292354 - protein, 9 aa, Homo Sapiens
RRRPGRGAL

SEQ ID NO: 1292355 - protein, 9 aa, Homo Sapiens
LQVPQVIQD

SEQ ID NO: 1292356 - protein, 9 aa, Homo Sapiens
NSHTQRSDK

SEQ ID NO: 1292357 - protein, 9 aa, Homo Sapiens
SPPTSCPPL

SEQ ID NO: 1292358 - protein, 9 aa, Homo Sapiens
KEQTALYRG

SEQ ID NO: 1292359 - protein, 9 aa, Homo Sapiens
LLWLAETVT

SEQ ID NO: 1292360 - protein, 9 aa, Homo Sapiens
WSWGRPSPW

SEQ ID NO: 1292361 - protein, 9 aa, Homo Sapiens
RVFCCNYDH

SEQ ID NO: 1292362 - protein, 9 aa, Homo Sapiens
EENLRTMYN

SEQ ID NO: 1292363 - protein, 9 aa, Homo Sapiens
PHRSPPTSC

SEQ ID NO: 1292364 - protein, 9 aa, Homo Sapiens
CLSPEPDSL

SEQ ID NO: 1292365 - protein, 9 aa, Homo Sapiens
LLLPALQRQ

SEQ ID NO: 1292366 - protein, 9 aa, Homo Sapiens
GADRSPVIQ

SEQ ID NO: 1292367 - protein, 9 aa, Homo Sapiens
PDGVILGVE

SEQ ID NO: 1292368 - protein, 9 aa, Homo Sapiens
KKNKWNAMV

SEQ ID NO: 1292369 - protein, 9 aa, Homo Sapiens
HLGLCAAAL

SEQ ID NO: 1292370 - protein, 9 aa, Homo Sapiens
KSVAWRGVL

SEQ ID NO: 1292371 - protein, 9 aa, Homo Sapiens
EVVGQHELQ

SEQ ID NO: 1292372 - protein, 9 aa, Homo Sapiens
RRSPAQPTM

SEQ ID NO: 1292373 - protein, 9 aa, Homo Sapiens
RMLDPFTIK

SEQ ID NO: 1292374 - protein, 9 aa, Homo Sapiens
EVAAFMLAM

SEQ ID NO: 1292375 - protein, 9 aa, Homo Sapiens
PSISHRSLL

SEQ ID NO: 1292376 - protein, 9 aa, Homo Sapiens
EGMLESEPA

SEQ ID NO: 1292377 - protein, 9 aa, Homo Sapiens
SLCGKKEDM

SEQ ID NO: 1292378 - protein, 9 aa, Homo Sapiens
GPASISRDN

SEQ ID NO: 1292379 - protein, 9 aa, Homo Sapiens
DSGIHPGAT

SEQ ID NO: 1292380 - protein, 9 aa, Homo Sapiens
GCLLQLGQI

SEQ ID NO: 1292381 - protein, 9 aa, Homo Sapiens
LDLKLFDRL

SEQ ID NO: 1292382 - protein, 9 aa, Homo Sapiens
GVPLAPGES

SEQ ID NO: 1292383 - protein, 9 aa, Homo Sapiens
GGKRILKMR

SEQ ID NO: 1292384 - protein, 9 aa, Homo Sapiens
IPHSWWWAT

SEQ ID NO: 1292385 - protein, 9 aa, Homo Sapiens
SRGQAQDTS

SEQ ID NO: 1292386 - protein, 9 aa, Homo Sapiens
CWGWQQSWE

SEQ ID NO: 1292387 - protein, 9 aa, Homo Sapiens
PMYLFLVML

SEQ ID NO: 1292388 - protein, 9 aa, Homo Sapiens
VICQLKSAL

SEQ ID NO: 1292389 - protein, 9 aa, Homo Sapiens
RTTAPPCTS

SEQ ID NO: 1292390 - protein, 9 aa, Homo Sapiens
THQTFPSGK

SEQ ID NO: 1292391 - protein, 9 aa, Homo Sapiens
VNEIENLGS

SEQ ID NO: 1292392 - protein, 9 aa, Homo Sapiens
RMEMKPLPR

SEQ ID NO: 1292393 - protein, 9 aa, Homo Sapiens
HVLRGSPLC

SEQ ID NO: 1292394 - protein, 9 aa, Homo Sapiens
RKIRKKMLE

SEQ ID NO: 1292395 - protein, 9 aa, Homo Sapiens
NCEAAWSRI

SEQ ID NO: 1292396 - protein, 9 aa, Homo Sapiens
HARLFFCIF

SEQ ID NO: 1292397 - protein, 9 aa, Homo Sapiens
WVELRVSCH

SEQ ID NO: 1292398 - protein, 9 aa, Homo Sapiens
WPQSRPQII

SEQ ID NO: 1292399 - protein, 9 aa, Homo Sapiens
GDIEARSDT

SEQ ID NO: 1292400 - protein, 9 aa, Homo Sapiens
ISCIDCFGL

SEQ ID NO: 1292401 - protein, 9 aa, Homo Sapiens
WKKMMIGSQ

SEQ ID NO: 1292402 - protein, 9 aa, Homo Sapiens
HVHLAPHVQ

SEQ ID NO: 1292403 - protein, 9 aa, Homo Sapiens
STNHQEPVN

SEQ ID NO: 1292404 - protein, 9 aa, Homo Sapiens
KHSIWSSSS

SEQ ID NO: 1292405 - protein, 9 aa, Homo Sapiens
IAGAHHCQY

SEQ ID NO: 1292406 - protein, 9 aa, Homo Sapiens
LNMYSTYAK

SEQ ID NO: 1292407 - protein, 9 aa, Homo Sapiens
LLFGLRVAK

SEQ ID NO: 1292408 - protein, 9 aa, Homo Sapiens
ARTGFLYTG

SEQ ID NO: 1292409 - protein, 9 aa, Homo Sapiens
HPPSISHRS

SEQ ID NO: 1292410 - protein, 9 aa, Homo Sapiens
LRGGRRGAT

SEQ ID NO: 1292411 - protein, 9 aa, Homo Sapiens
IHECDEGFE

SEQ ID NO: 1292412 - protein, 9 aa, Homo Sapiens
LQGITHLAE

SEQ ID NO: 1292413 - protein, 9 aa, Homo Sapiens
SEAKKNHFL

SEQ ID NO: 1292414 - protein, 9 aa, Homo Sapiens
WMVWSSRLP

SEQ ID NO: 1292415 - protein, 9 aa, Homo Sapiens
GSGLCDGDE

SEQ ID NO: 1292416 - protein, 9 aa, Homo Sapiens
LTRVRDANP

SEQ ID NO: 1292417 - protein, 9 aa, Homo Sapiens
YTKIMSKNI

SEQ ID NO: 1292418 - protein, 9 aa, Homo Sapiens
QGGGEPGWQ

SEQ ID NO: 1292419 - protein, 9 aa, Homo Sapiens
SHLESILSV

SEQ ID NO: 1292420 - protein, 9 aa, Homo Sapiens
PYPAASAPC

SEQ ID NO: 1292421 - protein, 9 aa, Homo Sapiens
SLLFRHKSR

SEQ ID NO: 1292422 - protein, 9 aa, Homo Sapiens
KNCGFFMAT

SEQ ID NO: 1292423 - protein, 9 aa, Homo Sapiens
QIQVKTLGT

SEQ ID NO: 1292424 - protein, 9 aa, Homo Sapiens
ILGVEEPEG

SEQ ID NO: 1292425 - protein, 9 aa, Homo Sapiens
AVERVSTLT

SEQ ID NO: 1292426 - protein, 9 aa, Homo Sapiens
LSNPFRGLV

SEQ ID NO: 1292427 - protein, 9 aa, Homo Sapiens
GLCDGDEVV

SEQ ID NO: 1292428 - protein, 9 aa, Homo Sapiens
RPRATAVTW

SEQ ID NO: 1292429 - protein, 9 aa, Homo Sapiens
RDLKEQQPR

SEQ ID NO: 1292430 - protein, 9 aa, Homo Sapiens
CLMSTTRSI

SEQ ID NO: 1292431 - protein, 9 aa, Homo Sapiens
AARVVELQT

SEQ ID NO: 1292432 - protein, 9 aa, Homo Sapiens
DVFVVRTER

SEQ ID NO: 1292433 - protein, 9 aa, Homo Sapiens
QRWRRRPVV

SEQ ID NO: 1292434 - protein, 9 aa, Homo Sapiens
NDVDPPGSV

SEQ ID NO: 1292435 - protein, 9 aa, Homo Sapiens
TALHGDVCT

SEQ ID NO: 1292436 - protein, 9 aa, Homo Sapiens
RKCREKDDD

SEQ ID NO: 1292437 - protein, 9 aa, Homo Sapiens
LVRQLLDPP

SEQ ID NO: 1292438 - protein, 9 aa, Homo Sapiens
VDVVGYVLQ

SEQ ID NO: 1292439 - protein, 9 aa, Homo Sapiens
PASTNSDDI

SEQ ID NO: 1292440 - protein, 9 aa, Homo Sapiens
NLCWSEITR

SEQ ID NO: 1292441 - protein, 9 aa, Homo Sapiens
LSHRLRLRL

SEQ ID NO: 1292442 - protein, 9 aa, Homo Sapiens
VRHVLHFND

SEQ ID NO: 1292443 - protein, 9 aa, Homo Sapiens
RNLYRCCDQ

SEQ ID NO: 1292444 - protein, 9 aa, Homo Sapiens
LYVDKSWGD

SEQ ID NO: 1292445 - protein, 9 aa, Homo Sapiens
LLAVEVSIT

SEQ ID NO: 1292446 - protein, 9 aa, Homo Sapiens
HLREFDKKL

SEQ ID NO: 1292447 - protein, 9 aa, Homo Sapiens
KVSIWATVR

SEQ ID NO: 1292448 - protein, 9 aa, Homo Sapiens
LTRLEGLND

SEQ ID NO: 1292449 - protein, 9 aa, Homo Sapiens
LEIILINCC

SEQ ID NO: 1292450 - protein, 9 aa, Homo Sapiens
QHTMRSLDR

SEQ ID NO: 1292451 - protein, 9 aa, Homo Sapiens
GLSSGLGSE

SEQ ID NO: 1292452 - protein, 9 aa, Homo Sapiens
SECGKGFCE

SEQ ID NO: 1292453 - protein, 9 aa, Homo Sapiens
EGGPPRPTV

SEQ ID NO: 1292454 - protein, 9 aa, Homo Sapiens
SFRRAHVYT

SEQ ID NO: 1292455 - protein, 9 aa, Homo Sapiens
FLVVFLYMW

SEQ ID NO: 1292456 - protein, 9 aa, Homo Sapiens
LLPALQRQL

SEQ ID NO: 1292457 - protein, 9 aa, Homo Sapiens
GQVYGEPPP

SEQ ID NO: 1292458 - protein, 9 aa, Homo Sapiens
VLLPASPVP

SEQ ID NO: 1292459 - protein, 9 aa, Homo Sapiens
DANPEKPYA

SEQ ID NO: 1292460 - protein, 9 aa, Homo Sapiens
IVKPQEAPK

SEQ ID NO: 1292461 - protein, 9 aa, Homo Sapiens
TGALGHRGS

SEQ ID NO: 1292462 - protein, 9 aa, Homo Sapiens
NIVRPSIGK

SEQ ID NO: 1292463 - protein, 9 aa, Homo Sapiens
MVDVGGRGQ

SEQ ID NO: 1292464 - protein, 9 aa, Homo Sapiens
APLSTWSAS

SEQ ID NO: 1292465 - protein, 9 aa, Homo Sapiens
LEMWDLHPS

SEQ ID NO: 1292466 - protein, 9 aa, Homo Sapiens
EEVKHGALP

SEQ ID NO: 1292467 - protein, 9 aa, Homo Sapiens
ERSRLTDYY

SEQ ID NO: 1292468 - protein, 9 aa, Homo Sapiens
IVVDVNLCW

SEQ ID NO: 1292469 - protein, 9 aa, Homo Sapiens
VLIVDVVGY

SEQ ID NO: 1292470 - protein, 9 aa, Homo Sapiens
RPPWRTSRG

SEQ ID NO: 1292471 - protein, 9 aa, Homo Sapiens
PTVQWDGAG

SEQ ID NO: 1292472 - protein, 9 aa, Homo Sapiens
GSSITKQKN

SEQ ID NO: 1292473 - protein, 9 aa, Homo Sapiens
MWDLHPSTL

SEQ ID NO: 1292474 - protein, 9 aa, Homo Sapiens
LRENSICGA

SEQ ID NO: 1292475 - protein, 9 aa, Homo Sapiens
KARMEGQPM

SEQ ID NO: 1292476 - protein, 9 aa, Homo Sapiens
EWKQEDLVG

SEQ ID NO: 1292477 - protein, 9 aa, Homo Sapiens
SSFRRAHVY

SEQ ID NO: 1292478 - protein, 9 aa, Homo Sapiens
KRGASSSTS

SEQ ID NO: 1292479 - protein, 9 aa, Homo Sapiens
APARPCPPG

SEQ ID NO: 1292480 - protein, 9 aa, Homo Sapiens
AVLLTVLIP

SEQ ID NO: 1292481 - protein, 9 aa, Homo Sapiens
CRPRTRTCP

SEQ ID NO: 1292482 - protein, 9 aa, Homo Sapiens
QYKLTYTKV

SEQ ID NO: 1292483 - protein, 9 aa, Homo Sapiens
LNIITPPPH

SEQ ID NO: 1292484 - protein, 9 aa, Homo Sapiens
SSIRASWRI

SEQ ID NO: 1292485 - protein, 9 aa, Homo Sapiens
PMSRSLWPQ

SEQ ID NO: 1292486 - protein, 9 aa, Homo Sapiens
SDDAVVLIV

SEQ ID NO: 1292487 - protein, 9 aa, Homo Sapiens
DTILNPKEK

SEQ ID NO: 1292488 - protein, 9 aa, Homo Sapiens
TFGCQMSPD

SEQ ID NO: 1292489 - protein, 9 aa, Homo Sapiens
ASMPWGSKM

SEQ ID NO: 1292490 - protein, 9 aa, Homo Sapiens
YCTEKSFSE

SEQ ID NO: 1292491 - protein, 9 aa, Homo Sapiens
LMASKKDSA

SEQ ID NO: 1292492 - protein, 9 aa, Homo Sapiens
KEDKECKKK

SEQ ID NO: 1292493 - protein, 9 aa, Homo Sapiens
LFFPSATRC

SEQ ID NO: 1292494 - protein, 9 aa, Homo Sapiens
PGQLRGRAR

SEQ ID NO: 1292495 - protein, 9 aa, Homo Sapiens
MSSDSELTV

SEQ ID NO: 1292496 - protein, 9 aa, Homo Sapiens
GGRDFLQRP

SEQ ID NO: 1292497 - protein, 9 aa, Homo Sapiens
VVRTAEPDV

SEQ ID NO: 1292498 - protein, 9 aa, Homo Sapiens
EQKKITTRN

SEQ ID NO: 1292499 - protein, 9 aa, Homo Sapiens
LDNDGCTPL

SEQ ID NO: 1292500 - protein, 9 aa, Homo Sapiens
ASKVPGGSR

SEQ ID NO: 1292501 - protein, 9 aa, Homo Sapiens
MGWCPRLRL

SEQ ID NO: 1292502 - protein, 9 aa, Homo Sapiens
ELVNSWNES

SEQ ID NO: 1292503 - protein, 9 aa, Homo Sapiens
PRYLRSVVG

SEQ ID NO: 1292504 - protein, 9 aa, Homo Sapiens
FTLKRKCRE

SEQ ID NO: 1292505 - protein, 9 aa, Homo Sapiens
RAVEASELC

SEQ ID NO: 1292506 - protein, 9 aa, Homo Sapiens
SVKTSTTQS

SEQ ID NO: 1292507 - protein, 9 aa, Homo Sapiens
SIWKRLKLC

SEQ ID NO: 1292508 - protein, 9 aa, Homo Sapiens
GQPGPEYRE

SEQ ID NO: 1292509 - protein, 9 aa, Homo Sapiens
LLQGITHLA

SEQ ID NO: 1292510 - protein, 9 aa, Homo Sapiens
WSLMSEKNL

SEQ ID NO: 1292511 - protein, 9 aa, Homo Sapiens
LEDAIKNFR

SEQ ID NO: 1292512 - protein, 9 aa, Homo Sapiens
EKNSLGIIW

SEQ ID NO: 1292513 - protein, 9 aa, Homo Sapiens
HLAPHVQLH

SEQ ID NO: 1292514 - protein, 9 aa, Homo Sapiens
VWWETRAKL

SEQ ID NO: 1292515 - protein, 9 aa, Homo Sapiens
LPVLFTLVR

SEQ ID NO: 1292516 - protein, 9 aa, Homo Sapiens
PEEAKILFF

SEQ ID NO: 1292517 - protein, 9 aa, Homo Sapiens
SKKGSLVAR

SEQ ID NO: 1292518 - protein, 9 aa, Homo Sapiens
LDSSPLQLL

SEQ ID NO: 1292519 - protein, 9 aa, Homo Sapiens
MSRPSQVLD

SEQ ID NO: 1292520 - protein, 9 aa, Homo Sapiens
GERKTTVSY

SEQ ID NO: 1292521 - protein, 9 aa, Homo Sapiens
LQLMAVLCK

SEQ ID NO: 1292522 - protein, 9 aa, Homo Sapiens
PVLFTLVRQ

SEQ ID NO: 1292523 - protein, 9 aa, Homo Sapiens
QAGGGGPLP

SEQ ID NO: 1292524 - protein, 9 aa, Homo Sapiens
SLNYDCIVE

SEQ ID NO: 1292525 - protein, 9 aa, Homo Sapiens
LAMQFSIPP

SEQ ID NO: 1292526 - protein, 9 aa, Homo Sapiens
QELQPPSPE

SEQ ID NO: 1292527 - protein, 9 aa, Homo Sapiens
MTGLNKNRR

SEQ ID NO: 1292528 - protein, 9 aa, Homo Sapiens
PGHNGAPGC

SEQ ID NO: 1292529 - protein, 9 aa, Homo Sapiens
PGRCWAWRS

SEQ ID NO: 1292530 - protein, 9 aa, Homo Sapiens
KKEKKNNMA

SEQ ID NO: 1292531 - protein, 9 aa, Homo Sapiens
LHLGLCAAA

SEQ ID NO: 1292532 - protein, 9 aa, Homo Sapiens
ATAVFTFMW

SEQ ID NO: 1292533 - protein, 9 aa, Homo Sapiens
FNTQKRERR

SEQ ID NO: 1292534 - protein, 9 aa, Homo Sapiens
QQRKWCSSE

SEQ ID NO: 1292535 - protein, 9 aa, Homo Sapiens
DAVGLGDLH

SEQ ID NO: 1292536 - protein, 9 aa, Homo Sapiens
NLIAIIHDQ

SEQ ID NO: 1292537 - protein, 9 aa, Homo Sapiens
TDRERKSDG

SEQ ID NO: 1292538 - protein, 9 aa, Homo Sapiens
GSARHAVFS

SEQ ID NO: 1292539 - protein, 9 aa, Homo Sapiens
KDEIAEVVN

SEQ ID NO: 1292540 - protein, 9 aa, Homo Sapiens
TQRSDKNNE

SEQ ID NO: 1292541 - protein, 9 aa, Homo Sapiens
WALLLVRIL

SEQ ID NO: 1292542 - protein, 9 aa, Homo Sapiens
VVEVHDRDC

SEQ ID NO: 1292543 - protein, 9 aa, Homo Sapiens
ICILEMWDL

SEQ ID NO: 1292544 - protein, 9 aa, Homo Sapiens
LADMRGWDW

SEQ ID NO: 1292545 - protein, 9 aa, Homo Sapiens
LITYISALS

SEQ ID NO: 1292546 - protein, 9 aa, Homo Sapiens
HCQVHLFKD

SEQ ID NO: 1292547 - protein, 9 aa, Homo Sapiens
ESEAKKNHF

SEQ ID NO: 1292548 - protein, 9 aa, Homo Sapiens
GGPRLTHPA

SEQ ID NO: 1292549 - protein, 9 aa, Homo Sapiens
PRRAWKHSP

SEQ ID NO: 1292550 - protein, 9 aa, Homo Sapiens
APPLVIKIP

SEQ ID NO: 1292551 - protein, 9 aa, Homo Sapiens
VLALVGAAG

SEQ ID NO: 1292552 - protein, 9 aa, Homo Sapiens
NQPQRPAVF

SEQ ID NO: 1292553 - protein, 9 aa, Homo Sapiens
AKRHRLSSL

SEQ ID NO: 1292554 - protein, 9 aa, Homo Sapiens
FCDGDESDL

SEQ ID NO: 1292555 - protein, 9 aa, Homo Sapiens
GEGMLESEP

SEQ ID NO: 1292556 - protein, 9 aa, Homo Sapiens
ATCPAVVQR

SEQ ID NO: 1292557 - protein, 9 aa, Homo Sapiens
QLRASWSSW

SEQ ID NO: 1292558 - protein, 9 aa, Homo Sapiens
APPCTSAAS

SEQ ID NO: 1292559 - protein, 9 aa, Homo Sapiens
LPTQQLAWP

SEQ ID NO: 1292560 - protein, 9 aa, Homo Sapiens
TPNSLAKPL

SEQ ID NO: 1292561 - protein, 9 aa, Homo Sapiens
TSDNGQFFR

SEQ ID NO: 1292562 - protein, 9 aa, Homo Sapiens
ACSLHTAPA

SEQ ID NO: 1292563 - protein, 9 aa, Homo Sapiens
LRPRRGREL

SEQ ID NO: 1292564 - protein, 9 aa, Homo Sapiens
KRKKEDKEC

SEQ ID NO: 1292565 - protein, 9 aa, Homo Sapiens
PPANGAPPP

SEQ ID NO: 1292566 - protein, 9 aa, Homo Sapiens
IRMLDPFTI

SEQ ID NO: 1292567 - protein, 9 aa, Homo Sapiens
SEFSPDSSI

SEQ ID NO: 1292568 - protein, 9 aa, Homo Sapiens
QGEAAGAGP

SEQ ID NO: 1292569 - protein, 9 aa, Homo Sapiens
SPPWSPSTR

SEQ ID NO: 1292570 - protein, 9 aa, Homo Sapiens
RESFKHIDS

SEQ ID NO: 1292571 - protein, 9 aa, Homo Sapiens
DGEEGGGVP

SEQ ID NO: 1292572 - protein, 9 aa, Homo Sapiens
LSHHAWPGC

SEQ ID NO: 1292573 - protein, 9 aa, Homo Sapiens
VKEVKENFE

SEQ ID NO: 1292574 - protein, 9 aa, Homo Sapiens
RLSQDLDAL

SEQ ID NO: 1292575 - protein, 9 aa, Homo Sapiens
YRKDLGAPD

SEQ ID NO: 1292576 - protein, 9 aa, Homo Sapiens
SSSSALGLS

SEQ ID NO: 1292577 - protein, 9 aa, Homo Sapiens
RWLRGGRRG

SEQ ID NO: 1292578 - protein, 9 aa, Homo Sapiens
RLSSPTRPL

SEQ ID NO: 1292579 - protein, 9 aa, Homo Sapiens
FRGLVKLGT

SEQ ID NO: 1292580 - protein, 9 aa, Homo Sapiens
SSHKIQKIR

SEQ ID NO: 1292581 - protein, 9 aa, Homo Sapiens
VDPPGSVWI

SEQ ID NO: 1292582 - protein, 9 aa, Homo Sapiens
LPSSSFRRA

SEQ ID NO: 1292583 - protein, 9 aa, Homo Sapiens
KCDGNSSLI

SEQ ID NO: 1292584 - protein, 9 aa, Homo Sapiens
DLSTLSDPL

SEQ ID NO: 1292585 - protein, 9 aa, Homo Sapiens
PGLSWTKAG

SEQ ID NO: 1292586 - protein, 9 aa, Homo Sapiens
RRSPALRAR

SEQ ID NO: 1292587 - protein, 9 aa, Homo Sapiens
DSQMPGQPP

SEQ ID NO: 1292588 - protein, 9 aa, Homo Sapiens
GSDDDDDDF

SEQ ID NO: 1292589 - protein, 9 aa, Homo Sapiens
EKPYQCGEY

SEQ ID NO: 1292590 - protein, 9 aa, Homo Sapiens
VHNGWGDLE

SEQ ID NO: 1292591 - protein, 9 aa, Homo Sapiens
PLPAKPSPG

SEQ ID NO: 1292592 - protein, 9 aa, Homo Sapiens
VKHGALPSG

SEQ ID NO: 1292593 - protein, 9 aa, Homo Sapiens
ARAGGHQQK

SEQ ID NO: 1292594 - protein, 9 aa, Homo Sapiens
GPMGVLLPA

SEQ ID NO: 1292595 - protein, 9 aa, Homo Sapiens
CPCSAPLST

SEQ ID NO: 1292596 - protein, 9 aa, Homo Sapiens
HPIYILKGG

SEQ ID NO: 1292597 - protein, 9 aa, Homo Sapiens
PTRCCRPRT

SEQ ID NO: 1292598 - protein, 9 aa, Homo Sapiens
QRKWCSSEP

SEQ ID NO: 1292599 - protein, 9 aa, Homo Sapiens
EAWLLLLLS

SEQ ID NO: 1292600 - protein, 9 aa, Homo Sapiens
DSELTVFGE

SEQ ID NO: 1292601 - protein, 9 aa, Homo Sapiens
LSLQRAWGS

SEQ ID NO: 1292602 - protein, 9 aa, Homo Sapiens
AQKNCLVKN

SEQ ID NO: 1292603 - protein, 9 aa, Homo Sapiens
APDGIGSGS

SEQ ID NO: 1292604 - protein, 9 aa, Homo Sapiens
FVTKCAFQA

SEQ ID NO: 1292605 - protein, 9 aa, Homo Sapiens
HLVNPSFLS

SEQ ID NO: 1292606 - protein, 9 aa, Homo Sapiens
LLQYMIALL

SEQ ID NO: 1292607 - protein, 9 aa, Homo Sapiens
GNRKKHGGS

SEQ ID NO: 1292608 - protein, 9 aa, Homo Sapiens
AAAALQGEA

SEQ ID NO: 1292609 - protein, 9 aa, Homo Sapiens
CGSLHDTLQ

SEQ ID NO: 1292610 - protein, 9 aa, Homo Sapiens
QPRLLHVHN

SEQ ID NO: 1292611 - protein, 9 aa, Homo Sapiens
ACLLSVHKS

SEQ ID NO: 1292612 - protein, 9 aa, Homo Sapiens
VCCEPATCP

SEQ ID NO: 1292613 - protein, 9 aa, Homo Sapiens
WILVDLAVA

SEQ ID NO: 1292614 - protein, 9 aa, Homo Sapiens
LPLPTPSLC

SEQ ID NO: 1292615 - protein, 9 aa, Homo Sapiens
AKPIRLNGT

SEQ ID NO: 1292616 - protein, 9 aa, Homo Sapiens
ITSPVVTQR

SEQ ID NO: 1292617 - protein, 9 aa, Homo Sapiens
LGYVENIFH

SEQ ID NO: 1292618 - protein, 9 aa, Homo Sapiens
PTLMMSNGC

SEQ ID NO: 1292619 - protein, 9 aa, Homo Sapiens
EDINRIQVE

SEQ ID NO: 1292620 - protein, 9 aa, Homo Sapiens
QAGMWEECV

SEQ ID NO: 1292621 - protein, 9 aa, Homo Sapiens
AGAHHCQYK

SEQ ID NO: 1292622 - protein, 9 aa, Homo Sapiens
IGKIVNELF

SEQ ID NO: 1292623 - protein, 9 aa, Homo Sapiens
NAAVWKVVF

SEQ ID NO: 1292624 - protein, 9 aa, Homo Sapiens
MSNGCWGWQ

SEQ ID NO: 1292625 - protein, 9 aa, Homo Sapiens
ELWQVPAAG

SEQ ID NO: 1292626 - protein, 9 aa, Homo Sapiens
NSDSDEKVP

SEQ ID NO: 1292627 - protein, 9 aa, Homo Sapiens
PTATAACPM

SEQ ID NO: 1292628 - protein, 9 aa, Homo Sapiens
GNRLMVLQV

SEQ ID NO: 1292629 - protein, 9 aa, Homo Sapiens
KWILYDNRQ

SEQ ID NO: 1292630 - protein, 9 aa, Homo Sapiens
TQKRERRRE

SEQ ID NO: 1292631 - protein, 9 aa, Homo Sapiens
VVRTERGCA

SEQ ID NO: 1292632 - protein, 9 aa, Homo Sapiens
RCAWQQAVV

SEQ ID NO: 1292633 - protein, 9 aa, Homo Sapiens
ATNTLPKVR

SEQ ID NO: 1292634 - protein, 9 aa, Homo Sapiens
PRALYCWTA

SEQ ID NO: 1292635 - protein, 9 aa, Homo Sapiens
NDIMISIVG

SEQ ID NO: 1292636 - protein, 9 aa, Homo Sapiens
MEKEKMKDK

SEQ ID NO: 1292637 - protein, 9 aa, Homo Sapiens
VADGDVARA

SEQ ID NO: 1292638 - protein, 9 aa, Homo Sapiens
PGWQPAEPH

SEQ ID NO: 1292639 - protein, 9 aa, Homo Sapiens
AWPGCFLKK

SEQ ID NO: 1292640 - protein, 9 aa, Homo Sapiens
CQASGPQVL

SEQ ID NO: 1292641 - protein, 9 aa, Homo Sapiens
DNKALILSS

SEQ ID NO: 1292642 - protein, 9 aa, Homo Sapiens
TACSPPRLC

SEQ ID NO: 1292643 - protein, 9 aa, Homo Sapiens
EVGADKQVS

SEQ ID NO: 1292644 - protein, 9 aa, Homo Sapiens
EDDLKDIFF

SEQ ID NO: 1292645 - protein, 9 aa, Homo Sapiens
FTSAHPSRP

SEQ ID NO: 1292646 - protein, 9 aa, Homo Sapiens
GEMLYLSAL

SEQ ID NO: 1292647 - protein, 9 aa, Homo Sapiens
AQLRASWSS

SEQ ID NO: 1292648 - protein, 9 aa, Homo Sapiens
PPLGNPRVL

SEQ ID NO: 1292649 - protein, 9 aa, Homo Sapiens
GGWRGWWGN

SEQ ID NO: 1292650 - protein, 9 aa, Homo Sapiens
WQDVEVQAV

SEQ ID NO: 1292651 - protein, 9 aa, Homo Sapiens
VQWDGAGRA

SEQ ID NO: 1292652 - protein, 9 aa, Homo Sapiens
LNPRLHPPS

SEQ ID NO: 1292653 - protein, 9 aa, Homo Sapiens
QKEQTALYR

SEQ ID NO: 1292654 - protein, 9 aa, Homo Sapiens
AMTVIAGAH

SEQ ID NO: 1292655 - protein, 9 aa, Homo Sapiens
GKGAGARGA

SEQ ID NO: 1292656 - protein, 9 aa, Homo Sapiens
DNLVFTVLE

SEQ ID NO: 1292657 - protein, 9 aa, Homo Sapiens
WTWCLPSAS

SEQ ID NO: 1292658 - protein, 9 aa, Homo Sapiens
PLHLVNPSF

SEQ ID NO: 1292659 - protein, 9 aa, Homo Sapiens
LEATFGCQM

SEQ ID NO: 1292660 - protein, 9 aa, Homo Sapiens
TPPSVETPA

SEQ ID NO: 1292661 - protein, 9 aa, Homo Sapiens
KLGVWCLLS

SEQ ID NO: 1292662 - protein, 9 aa, Homo Sapiens
HWTSKSSVS

SEQ ID NO: 1292663 - protein, 9 aa, Homo Sapiens
AGLLGRPEA

SEQ ID NO: 1292664 - protein, 9 aa, Homo Sapiens
SKVPGGSRP

SEQ ID NO: 1292665 - protein, 9 aa, Homo Sapiens
AIYQIGVED

SEQ ID NO: 1292666 - protein, 9 aa, Homo Sapiens
PLRLRLDRL

SEQ ID NO: 1292667 - protein, 9 aa, Homo Sapiens
QIGPYCTEK

SEQ ID NO: 1292668 - protein, 9 aa, Homo Sapiens
VGRGCCSSW

SEQ ID NO: 1292669 - protein, 9 aa, Homo Sapiens
SLSSFLIFF

SEQ ID NO: 1292670 - protein, 9 aa, Homo Sapiens
YLRSVVGSE

SEQ ID NO: 1292671 - protein, 9 aa, Homo Sapiens
DDIRDEKVK

SEQ ID NO: 1292672 - protein, 9 aa, Homo Sapiens
GGVLGMLGE

SEQ ID NO: 1292673 - protein, 9 aa, Homo Sapiens
ADKQVSQER

SEQ ID NO: 1292674 - protein, 9 aa, Homo Sapiens
RVEAAVDLY

SEQ ID NO: 1292675 - protein, 9 aa, Homo Sapiens
IVDVVGYVL

SEQ ID NO: 1292676 - protein, 9 aa, Homo Sapiens
DFQHAVSDS

SEQ ID NO: 1292677 - protein, 9 aa, Homo Sapiens
SGSRRSPAQ

SEQ ID NO: 1292678 - protein, 9 aa, Homo Sapiens
KPVTPPAWL

SEQ ID NO: 1292679 - protein, 9 aa, Homo Sapiens
RLRLPLPTP

SEQ ID NO: 1292680 - protein, 9 aa, Homo Sapiens
PMGVLLPAS

SEQ ID NO: 1292681 - protein, 9 aa, Homo Sapiens
GGEPGWQPA

SEQ ID NO: 1292682 - protein, 9 aa, Homo Sapiens
KAPPLVIKI

SEQ ID NO: 1292683 - protein, 9 aa, Homo Sapiens
VSLASTSGK

SEQ ID NO: 1292684 - protein, 9 aa, Homo Sapiens
KECLHQLVM

SEQ ID NO: 1292685 - protein, 9 aa, Homo Sapiens
GGVPLAPGE

SEQ ID NO: 1292686 - protein, 9 aa, Homo Sapiens
SRICCVRPL

SEQ ID NO: 1292687 - protein, 9 aa, Homo Sapiens
LSVHKSLGE

SEQ ID NO: 1292688 - protein, 9 aa, Homo Sapiens
KRGKSQGGR

SEQ ID NO: 1292689 - protein, 9 aa, Homo Sapiens
PRPLLQKWV

SEQ ID NO: 1292690 - protein, 9 aa, Homo Sapiens
SSTTTVASL

SEQ ID NO: 1292691 - protein, 9 aa, Homo Sapiens
YSVFPYQNE

SEQ ID NO: 1292692 - protein, 9 aa, Homo Sapiens
RYGPASTML

SEQ ID NO: 1292693 - protein, 9 aa, Homo Sapiens
GRPEAAHEL

SEQ ID NO: 1292694 - protein, 9 aa, Homo Sapiens
KWCSSEPGK

SEQ ID NO: 1292695 - protein, 9 aa, Homo Sapiens
GALLAARVV

SEQ ID NO: 1292696 - protein, 9 aa, Homo Sapiens
FLLHQPLPG

SEQ ID NO: 1292697 - protein, 9 aa, Homo Sapiens
DLSEFMSPS

SEQ ID NO: 1292698 - protein, 9 aa, Homo Sapiens
CIWKVLHIR

SEQ ID NO: 1292699 - protein, 9 aa, Homo Sapiens
AKSGSTASR

SEQ ID NO: 1292700 - protein, 9 aa, Homo Sapiens
EKINIRMLD

SEQ ID NO: 1292701 - protein, 9 aa, Homo Sapiens
IGSQHLLFE

SEQ ID NO: 1292702 - protein, 9 aa, Homo Sapiens
VDLYQLAPA

SEQ ID NO: 1292703 - protein, 9 aa, Homo Sapiens
PCRRHCPRC

SEQ ID NO: 1292704 - protein, 9 aa, Homo Sapiens
SAGHWTSKS

SEQ ID NO: 1292705 - protein, 9 aa, Homo Sapiens
HLLVTQQKA

SEQ ID NO: 1292706 - protein, 9 aa, Homo Sapiens
KKLTVPHSL

SEQ ID NO: 1292707 - protein, 9 aa, Homo Sapiens
GDQLGDDLE

SEQ ID NO: 1292708 - protein, 9 aa, Homo Sapiens
GVPPDRGCL

SEQ ID NO: 1292709 - protein, 9 aa, Homo Sapiens
CDFLKQLRP

SEQ ID NO: 1292710 - protein, 9 aa, Homo Sapiens
IGEKPYECR

SEQ ID NO: 1292711 - protein, 9 aa, Homo Sapiens
KEAAFAVPG

SEQ ID NO: 1292712 - protein, 9 aa, Homo Sapiens
SDVNDNAPP

SEQ ID NO: 1292713 - protein, 9 aa, Homo Sapiens
ASGSGLCDG

SEQ ID NO: 1292714 - protein, 9 aa, Homo Sapiens
RRGRCEKQE

SEQ ID NO: 1292715 - protein, 9 aa, Homo Sapiens
DDAVVLIVD

SEQ ID NO: 1292716 - protein, 9 aa, Homo Sapiens
RLGGGRRGA

SEQ ID NO: 1292717 - protein, 9 aa, Homo Sapiens
WEVKKEAKE

SEQ ID NO: 1292718 - protein, 9 aa, Homo Sapiens
RTAMYTLNL

SEQ ID NO: 1292719 - protein, 9 aa, Homo Sapiens
APENLKTHQ

SEQ ID NO: 1292720 - protein, 9 aa, Homo Sapiens
AAAQRGPAP

SEQ ID NO: 1292721 - protein, 9 aa, Homo Sapiens
STNSDDIRD

SEQ ID NO: 1292722 - protein, 9 aa, Homo Sapiens
GVEIHIPIT

SEQ ID NO: 1292723 - protein, 9 aa, Homo Sapiens
IDHDRYSGN

SEQ ID NO: 1292724 - protein, 9 aa, Homo Sapiens
SSVWSSAAT

SEQ ID NO: 1292725 - protein, 9 aa, Homo Sapiens
AACWPRALY

SEQ ID NO: 1292726 - protein, 9 aa, Homo Sapiens
GILLLCKRC

SEQ ID NO: 1292727 - protein, 9 aa, Homo Sapiens
SQHSGRQWG

SEQ ID NO: 1292728 - protein, 9 aa, Homo Sapiens
PDSSIRTSS

SEQ ID NO: 1292729 - protein, 9 aa, Homo Sapiens
ARHHVEARL

SEQ ID NO: 1292730 - protein, 9 aa, Homo Sapiens
MWEECVLSE

SEQ ID NO: 1292731 - protein, 9 aa, Homo Sapiens
CSSWTWCLP

SEQ ID NO: 1292732 - protein, 9 aa, Homo Sapiens
TAVFTFMWL

SEQ ID NO: 1292733 - protein, 9 aa, Homo Sapiens
VCYLTSALQ

SEQ ID NO: 1292734 - protein, 9 aa, Homo Sapiens
TKDGNGSTN

SEQ ID NO: 1292735 - protein, 9 aa, Homo Sapiens
GVTTTQWSL

SEQ ID NO: 1292736 - protein, 9 aa, Homo Sapiens
VNFITFLEW

SEQ ID NO: 1292737 - protein, 9 aa, Homo Sapiens
PLVIKIPEC

SEQ ID NO: 1292738 - protein, 9 aa, Homo Sapiens
RNMPPYSRK

SEQ ID NO: 1292739 - protein, 9 aa, Homo Sapiens
CSQTQSHPD

SEQ ID NO: 1292740 - protein, 9 aa, Homo Sapiens
RKTTVSYTK

SEQ ID NO: 1292741 - protein, 9 aa, Homo Sapiens
GEYGKSFSN

SEQ ID NO: 1292742 - protein, 9 aa, Homo Sapiens
ELIGNRKKH

SEQ ID NO: 1292743 - protein, 9 aa, Homo Sapiens
VAGPDLVLA

SEQ ID NO: 1292744 - protein, 9 aa, Homo Sapiens
GYVENIFHN

SEQ ID NO: 1292745 - protein, 9 aa, Homo Sapiens
SGNVTITNP

SEQ ID NO: 1292746 - protein, 9 aa, Homo Sapiens
AMIPTQTWI

SEQ ID NO: 1292747 - protein, 9 aa, Homo Sapiens
PAALGEVVG

SEQ ID NO: 1292748 - protein, 9 aa, Homo Sapiens
ATAVTWTQT

SEQ ID NO: 1292749 - protein, 9 aa, Homo Sapiens
VKSVAWRGV

SEQ ID NO: 1292750 - protein, 9 aa, Homo Sapiens
FLRCSQTQS

SEQ ID NO: 1292751 - protein, 9 aa, Homo Sapiens
AIAPPIFVF

SEQ ID NO: 1292752 - protein, 9 aa, Homo Sapiens
KPVLCIGLT

SEQ ID NO: 1292753 - protein, 9 aa, Homo Sapiens
ADDIKKAHR

SEQ ID NO: 1292754 - protein, 9 aa, Homo Sapiens
LVHPAPRGR

SEQ ID NO: 1292755 - protein, 9 aa, Homo Sapiens
FLARSWNTM

SEQ ID NO: 1292756 - protein, 9 aa, Homo Sapiens
EGIRYAIRI

SEQ ID NO: 1292757 - protein, 9 aa, Homo Sapiens
ETSVHDFKT

SEQ ID NO: 1292758 - protein, 9 aa, Homo Sapiens
SVQKIFESS

SEQ ID NO: 1292759 - protein, 9 aa, Homo Sapiens
HRTHIGEKP

SEQ ID NO: 1292760 - protein, 9 aa, Homo Sapiens
SDDIRDEKV

SEQ ID NO: 1292761 - protein, 9 aa, Homo Sapiens
KLQALVPDL

SEQ ID NO: 1292762 - protein, 9 aa, Homo Sapiens
HQAVSQASE

SEQ ID NO: 1292763 - protein, 9 aa, Homo Sapiens
PTGSSSTTT

SEQ ID NO: 1292764 - protein, 9 aa, Homo Sapiens
SHSESSIWK

SEQ ID NO: 1292765 - protein, 9 aa, Homo Sapiens
SPAVPQITS

SEQ ID NO: 1292766 - protein, 9 aa, Homo Sapiens
GTVLGKASV

SEQ ID NO: 1292767 - protein, 9 aa, Homo Sapiens
LESILSVQK

SEQ ID NO: 1292768 - protein, 9 aa, Homo Sapiens
DARAAGGAA

SEQ ID NO: 1292769 - protein, 9 aa, Homo Sapiens
VATPALPTQ

SEQ ID NO: 1292770 - protein, 9 aa, Homo Sapiens
HSQETTYWC

SEQ ID NO: 1292771 - protein, 9 aa, Homo Sapiens
PRPRRAWKH

SEQ ID NO: 1292772 - protein, 9 aa, Homo Sapiens
SSIRTSSFY

SEQ ID NO: 1292773 - protein, 9 aa, Homo Sapiens
WLECQASGP

SEQ ID NO: 1292774 - protein, 9 aa, Homo Sapiens
AQRGPAPAA

SEQ ID NO: 1292775 - protein, 9 aa, Homo Sapiens
SLRATVPRH

SEQ ID NO: 1292776 - protein, 9 aa, Homo Sapiens
GHIVGSKPL

SEQ ID NO: 1292777 - protein, 9 aa, Homo Sapiens
MYNQDRHVD

SEQ ID NO: 1292778 - protein, 9 aa, Homo Sapiens
LPFVEEIKG

SEQ ID NO: 1292779 - protein, 9 aa, Homo Sapiens
EAAFAVPGQ

SEQ ID NO: 1292780 - protein, 9 aa, Homo Sapiens
VHAEVGRPV

SEQ ID NO: 1292781 - protein, 9 aa, Homo Sapiens
NDAPLGLPA

SEQ ID NO: 1292782 - protein, 9 aa, Homo Sapiens
MTAMWLSAS

SEQ ID NO: 1292783 - protein, 9 aa, Homo Sapiens
PRLSQDLDA

SEQ ID NO: 1292784 - protein, 9 aa, Homo Sapiens
ILLQRNLLR

SEQ ID NO: 1292785 - protein, 9 aa, Homo Sapiens
SGAQHQSAG

SEQ ID NO: 1292786 - protein, 9 aa, Homo Sapiens
KWVPLQIDT

SEQ ID NO: 1292787 - protein, 9 aa, Homo Sapiens
GVSTGLVAM

SEQ ID NO: 1292788 - protein, 9 aa, Homo Sapiens
ALLAARVVE

SEQ ID NO: 1292789 - protein, 9 aa, Homo Sapiens
TREEEQALC

SEQ ID NO: 1292790 - protein, 9 aa, Homo Sapiens
LLLVRILVS

SEQ ID NO: 1292791 - protein, 9 aa, Homo Sapiens
ECDEGFEPL

SEQ ID NO: 1292792 - protein, 9 aa, Homo Sapiens
IQNRSPTPS

SEQ ID NO: 1292793 - protein, 9 aa, Homo Sapiens
EHPNMLKFI

SEQ ID NO: 1292794 - protein, 9 aa, Homo Sapiens
LEGGSARHA

SEQ ID NO: 1292795 - protein, 9 aa, Homo Sapiens
GIQAWGDSP

SEQ ID NO: 1292796 - protein, 9 aa, Homo Sapiens
RKWCSSEPG

SEQ ID NO: 1292797 - protein, 9 aa, Homo Sapiens
RHRPAGHAG

SEQ ID NO: 1292798 - protein, 9 aa, Homo Sapiens
RHHRAAPGH

SEQ ID NO: 1292799 - protein, 9 aa, Homo Sapiens
LVEGLLQEV

SEQ ID NO: 1292800 - protein, 9 aa, Homo Sapiens
RRGQGAVQQ

SEQ ID NO: 1292801 - protein, 9 aa, Homo Sapiens
HLVGHLGDQ

SEQ ID NO: 1292802 - protein, 9 aa, Homo Sapiens
NSLGIIWPK

SEQ ID NO: 1292803 - protein, 9 aa, Homo Sapiens
SRHWRAAAQ

SEQ ID NO: 1292804 - protein, 9 aa, Homo Sapiens
KKPVLCIGL

SEQ ID NO: 1292805 - protein, 9 aa, Homo Sapiens
CMEGLTLES

SEQ ID NO: 1292806 - protein, 9 aa, Homo Sapiens
RTSSFYCPI

SEQ ID NO: 1292807 - protein, 9 aa, Homo Sapiens
NDPSTPASQ

SEQ ID NO: 1292808 - protein, 9 aa, Homo Sapiens
CEKQELRRP

SEQ ID NO: 1292809 - protein, 9 aa, Homo Sapiens
GCWARAGGH

SEQ ID NO: 1292810 - protein, 9 aa, Homo Sapiens
DDYLDRTLY

SEQ ID NO: 1292811 - protein, 9 aa, Homo Sapiens
NTRLALCEH

SEQ ID NO: 1292812 - protein, 9 aa, Homo Sapiens
APATLPCRR

SEQ ID NO: 1292813 - protein, 9 aa, Homo Sapiens
GAAVADGDV

SEQ ID NO: 1292814 - protein, 9 aa, Homo Sapiens
YNDYVHYIK

SEQ ID NO: 1292815 - protein, 9 aa, Homo Sapiens
YQCGEYGKS

SEQ ID NO: 1292816 - protein, 9 aa, Homo Sapiens
QNREWCLEE

SEQ ID NO: 1292817 - protein, 9 aa, Homo Sapiens
FEHLKKKIL

SEQ ID NO: 1292818 - protein, 9 aa, Homo Sapiens
ASQPSSSVW

SEQ ID NO: 1292819 - protein, 9 aa, Homo Sapiens
PPPKKLEPA

SEQ ID NO: 1292820 - protein, 9 aa, Homo Sapiens
WLGPASVAP

SEQ ID NO: 1292821 - protein, 9 aa, Homo Sapiens
MSGNVTITN

SEQ ID NO: 1292822 - protein, 9 aa, Homo Sapiens
PLPHPGAPH

SEQ ID NO: 1292823 - protein, 9 aa, Homo Sapiens
ELLVNMGGN

SEQ ID NO: 1292824 - protein, 9 aa, Homo Sapiens
QAVGMFQDF

SEQ ID NO: 1292825 - protein, 9 aa, Homo Sapiens
RKRGATAAE

SEQ ID NO: 1292826 - protein, 9 aa, Homo Sapiens
TCLSLERSR

SEQ ID NO: 1292827 - protein, 9 aa, Homo Sapiens
TEALVQAPD

SEQ ID NO: 1292828 - protein, 9 aa, Homo Sapiens
WCRESLGGW

SEQ ID NO: 1292829 - protein, 9 aa, Homo Sapiens
RALLVHPAP

SEQ ID NO: 1292830 - protein, 9 aa, Homo Sapiens
KGGHRHQYL

SEQ ID NO: 1292831 - protein, 9 aa, Homo Sapiens
VLNKSLNRV

SEQ ID NO: 1292832 - protein, 9 aa, Homo Sapiens
NASGRGTCP

SEQ ID NO: 1292833 - protein, 9 aa, Homo Sapiens
LGLSLYLQT

SEQ ID NO: 1292834 - protein, 9 aa, Homo Sapiens
AVPRVQARW

SEQ ID NO: 1292835 - protein, 9 aa, Homo Sapiens
IFVFQKDKG

SEQ ID NO: 1292836 - protein, 9 aa, Homo Sapiens
PCGRVDTAT

SEQ ID NO: 1292837 - protein, 9 aa, Homo Sapiens
AWAPQTAAP

SEQ ID NO: 1292838 - protein, 9 aa, Homo Sapiens
CREKDDDVV

SEQ ID NO: 1292839 - protein, 9 aa, Homo Sapiens
CRRSSSAWA

SEQ ID NO: 1292840 - protein, 9 aa, Homo Sapiens
VAQKLLNCQ

SEQ ID NO: 1292841 - protein, 9 aa, Homo Sapiens
DDIKKAHRR

SEQ ID NO: 1292842 - protein, 9 aa, Homo Sapiens
RHHVEARLG

SEQ ID NO: 1292843 - protein, 9 aa, Homo Sapiens
HSWWWATVS

SEQ ID NO: 1292844 - protein, 9 aa, Homo Sapiens
NYDCIVENP

SEQ ID NO: 1292845 - protein, 9 aa, Homo Sapiens
RWNNAKPIR

SEQ ID NO: 1292846 - protein, 9 aa, Homo Sapiens
PRCPRRLPM

SEQ ID NO: 1292847 - protein, 9 aa, Homo Sapiens
LCLQGTRSL

SEQ ID NO: 1292848 - protein, 9 aa, Homo Sapiens
PTAPWRPRA

SEQ ID NO: 1292849 - protein, 9 aa, Homo Sapiens
ACSILARLV

SEQ ID NO: 1292850 - protein, 9 aa, Homo Sapiens
EFLMGGMSR

SEQ ID NO: 1292851 - protein, 9 aa, Homo Sapiens
IQQMEQKKI

SEQ ID NO: 1292852 - protein, 9 aa, Homo Sapiens
LEVCYLTSA

SEQ ID NO: 1292853 - protein, 9 aa, Homo Sapiens
KAEPSPSKP

SEQ ID NO: 1292854 - protein, 9 aa, Homo Sapiens
STTTVASLR

SEQ ID NO: 1292855 - protein, 9 aa, Homo Sapiens
ETRLEVSLT

SEQ ID NO: 1292856 - protein, 9 aa, Homo Sapiens
PPSPEPRNP

SEQ ID NO: 1292857 - protein, 9 aa, Homo Sapiens
ALGLSLYLQ

SEQ ID NO: 1292858 - protein, 9 aa, Homo Sapiens
QTYVDPFAM

SEQ ID NO: 1292859 - protein, 9 aa, Homo Sapiens
MGRILQCTA

SEQ ID NO: 1292860 - protein, 9 aa, Homo Sapiens
QQGVEIHIP

SEQ ID NO: 1292861 - protein, 9 aa, Homo Sapiens
ILLLCKRCW

SEQ ID NO: 1292862 - protein, 9 aa, Homo Sapiens
SRTPPRRVC

SEQ ID NO: 1292863 - protein, 9 aa, Homo Sapiens
WLMTAMWLS

SEQ ID NO: 1292864 - protein, 9 aa, Homo Sapiens
LLVIMLICS

SEQ ID NO: 1292865 - protein, 9 aa, Homo Sapiens
PPPPPLGNP

SEQ ID NO: 1292866 - protein, 9 aa, Homo Sapiens
AEVCGRHLP

SEQ ID NO: 1292867 - protein, 9 aa, Homo Sapiens
DSRDGWGAM

SEQ ID NO: 1292868 - protein, 9 aa, Homo Sapiens
YQGMLYSLL

SEQ ID NO: 1292869 - protein, 9 aa, Homo Sapiens
DAPPNEEKG

SEQ ID NO: 1292870 - protein, 9 aa, Homo Sapiens
TAFSCPKKP

SEQ ID NO: 1292871 - protein, 9 aa, Homo Sapiens
WPGCFLKKV

SEQ ID NO: 1292872 - protein, 9 aa, Homo Sapiens
KAHRRKALQ

SEQ ID NO: 1292873 - protein, 9 aa, Homo Sapiens
IWKRLKLCA

SEQ ID NO: 1292874 - protein, 9 aa, Homo Sapiens
RHAVFSGSG

SEQ ID NO: 1292875 - protein, 9 aa, Homo Sapiens
SSLSPPHPV

SEQ ID NO: 1292876 - protein, 9 aa, Homo Sapiens
RPGWKRTQQ

SEQ ID NO: 1292877 - protein, 9 aa, Homo Sapiens
FIMRMNQVP

SEQ ID NO: 1292878 - protein, 9 aa, Homo Sapiens
SSARTTAPP

SEQ ID NO: 1292879 - protein, 9 aa, Homo Sapiens
LKGGHRHQY

SEQ ID NO: 1292880 - protein, 9 aa, Homo Sapiens
GGNIAEDSS

SEQ ID NO: 1292881 - protein, 9 aa, Homo Sapiens
QPLPGQHLW

SEQ ID NO: 1292882 - protein, 9 aa, Homo Sapiens
VTIANDIMI

SEQ ID NO: 1292883 - protein, 9 aa, Homo Sapiens
QNEMSDVVV

SEQ ID NO: 1292884 - protein, 9 aa, Homo Sapiens
GSLVARTQP

SEQ ID NO: 1292885 - protein, 9 aa, Homo Sapiens
AKKNHFLPE

SEQ ID NO: 1292886 - protein, 9 aa, Homo Sapiens
SKCYLETLP

SEQ ID NO: 1292887 - protein, 9 aa, Homo Sapiens
LWGGNIAED

SEQ ID NO: 1292888 - protein, 9 aa, Homo Sapiens
VPSTPPRGD

SEQ ID NO: 1292889 - protein, 9 aa, Homo Sapiens
QRNLLRLQS

SEQ ID NO: 1292890 - protein, 9 aa, Homo Sapiens
HQMKCLTAV

SEQ ID NO: 1292891 - protein, 9 aa, Homo Sapiens
HNNHGSSIT

SEQ ID NO: 1292892 - protein, 9 aa, Homo Sapiens
VRAQRQCMF

SEQ ID NO: 1292893 - protein, 9 aa, Homo Sapiens
RTAEPDVWL

SEQ ID NO: 1292894 - protein, 9 aa, Homo Sapiens
SSSERRQRS

SEQ ID NO: 1292895 - protein, 9 aa, Homo Sapiens
KLFDVPEAP

SEQ ID NO: 1292896 - protein, 9 aa, Homo Sapiens
SRRLRLCYM

SEQ ID NO: 1292897 - protein, 9 aa, Homo Sapiens
TLTTVLNIS

SEQ ID NO: 1292898 - protein, 9 aa, Homo Sapiens
ILFFSIKHS

SEQ ID NO: 1292899 - protein, 9 aa, Homo Sapiens
VCSARGGEG

SEQ ID NO: 1292900 - protein, 9 aa, Homo Sapiens
NDYVHYIKP

SEQ ID NO: 1292901 - protein, 9 aa, Homo Sapiens
GKNSRGPKR

SEQ ID NO: 1292902 - protein, 9 aa, Homo Sapiens
VHQVLLVSP

SEQ ID NO: 1292903 - protein, 9 aa, Homo Sapiens
DVGEERWLR

SEQ ID NO: 1292904 - protein, 9 aa, Homo Sapiens
LLSFSWSGC

SEQ ID NO: 1292905 - protein, 9 aa, Homo Sapiens
LLEKVSKKR

SEQ ID NO: 1292906 - protein, 9 aa, Homo Sapiens
NEPDSQGPT

SEQ ID NO: 1292907 - protein, 9 aa, Homo Sapiens
FLLVIMLIC

SEQ ID NO: 1292908 - protein, 9 aa, Homo Sapiens
TPPAWLVWV

SEQ ID NO: 1292909 - protein, 9 aa, Homo Sapiens
ECGSLHDTL

SEQ ID NO: 1292910 - protein, 9 aa, Homo Sapiens
DFGSIFLLF

SEQ ID NO: 1292911 - protein, 9 aa, Homo Sapiens
PEYREARGG

SEQ ID NO: 1292912 - protein, 9 aa, Homo Sapiens
LESILQTPG

SEQ ID NO: 1292913 - protein, 9 aa, Homo Sapiens
GANPTVQWD

SEQ ID NO: 1292914 - protein, 9 aa, Homo Sapiens
TACSILARL

SEQ ID NO: 1292915 - protein, 9 aa, Homo Sapiens
FIESDDAVV

SEQ ID NO: 1292916 - protein, 9 aa, Homo Sapiens
IVMGPPADL

SEQ ID NO: 1292917 - protein, 9 aa, Homo Sapiens
TITNPSSSG

SEQ ID NO: 1292918 - protein, 9 aa, Homo Sapiens
SLLESTKRR

SEQ ID NO: 1292919 - protein, 9 aa, Homo Sapiens
LAPAVEPHG

SEQ ID NO: 1292920 - protein, 9 aa, Homo Sapiens
HRALGQVRD

SEQ ID NO: 1292921 - protein, 9 aa, Homo Sapiens
LVGDVLGSQ

SEQ ID NO: 1292922 - protein, 9 aa, Homo Sapiens
PRKDCDEHG

SEQ ID NO: 1292923 - protein, 9 aa, Homo Sapiens
PPKAPPLVI

SEQ ID NO: 1292924 - protein, 9 aa, Homo Sapiens
CSPPRLCVK

SEQ ID NO: 1292925 - protein, 9 aa, Homo Sapiens
LWLAETVTL

SEQ ID NO: 1292926 - protein, 9 aa, Homo Sapiens
VEGHCFPAE

SEQ ID NO: 1292927 - protein, 9 aa, Homo Sapiens
TKVWKMNWK

SEQ ID NO: 1292928 - protein, 9 aa, Homo Sapiens
IVRAQRQCM

SEQ ID NO: 1292929 - protein, 9 aa, Homo Sapiens
LGSSGRVCA

SEQ ID NO: 1292930 - protein, 9 aa, Homo Sapiens
GRAPAQPPG

SEQ ID NO: 1292931 - protein, 9 aa, Homo Sapiens
DKNKKIVYS

SEQ ID NO: 1292932 - protein, 9 aa, Homo Sapiens
NQWLGSHFP

SEQ ID NO: 1292933 - protein, 9 aa, Homo Sapiens
LVIMLICSL

SEQ ID NO: 1292934 - protein, 9 aa, Homo Sapiens
RMLDLQGPP

SEQ ID NO: 1292935 - protein, 9 aa, Homo Sapiens
RSDTYDTFK

SEQ ID NO: 1292936 - protein, 9 aa, Homo Sapiens
ASEGWHWGA

SEQ ID NO: 1292937 - protein, 9 aa, Homo Sapiens
VLMLCLHHQ

SEQ ID NO: 1292938 - protein, 9 aa, Homo Sapiens
QITSPPCCL

SEQ ID NO: 1292939 - protein, 9 aa, Homo Sapiens
PGLQFLDLL

SEQ ID NO: 1292940 - protein, 9 aa, Homo Sapiens
IAQGEEKGG

SEQ ID NO: 1292941 - protein, 9 aa, Homo Sapiens
PPWHCPASR

SEQ ID NO: 1292942 - protein, 9 aa, Homo Sapiens
FDTCGLSNL

SEQ ID NO: 1292943 - protein, 9 aa, Homo Sapiens
HHHLYPVIQ

SEQ ID NO: 1292944 - protein, 9 aa, Homo Sapiens
PARPCPPGR

SEQ ID NO: 1292945 - protein, 9 aa, Homo Sapiens
TPRLPVPAA

SEQ ID NO: 1292946 - protein, 9 aa, Homo Sapiens
NAMVVLNKS

SEQ ID NO: 1292947 - protein, 9 aa, Homo Sapiens
QKLITTADT

SEQ ID NO: 1292948 - protein, 9 aa, Homo Sapiens
FSGGSLFTT

SEQ ID NO: 1292949 - protein, 9 aa, Homo Sapiens
AIFVPIHPV

SEQ ID NO: 1292950 - protein, 9 aa, Homo Sapiens
QPSPHPQVP

SEQ ID NO: 1292951 - protein, 9 aa, Homo Sapiens
EPSQNGLRP

SEQ ID NO: 1292952 - protein, 9 aa, Homo Sapiens
GLLARGHVP

SEQ ID NO: 1292953 - protein, 9 aa, Homo Sapiens
SRSPPTLMM

SEQ ID NO: 1292954 - protein, 9 aa, Homo Sapiens
GFFGVSAVT

SEQ ID NO: 1292955 - protein, 9 aa, Homo Sapiens
HGRRAVVLL

SEQ ID NO: 1292956 - protein, 9 aa, Homo Sapiens
RASWSSWSR

SEQ ID NO: 1292957 - protein, 9 aa, Homo Sapiens
VNDNAPPSP

SEQ ID NO: 1292958 - protein, 9 aa, Homo Sapiens
SEIGTTDIV

SEQ ID NO: 1292959 - protein, 9 aa, Homo Sapiens
CDQPRHFAI

SEQ ID NO: 1292960 - protein, 9 aa, Homo Sapiens
QAPPSCLRF

SEQ ID NO: 1292961 - protein, 9 aa, Homo Sapiens
DSPWNKTQA

SEQ ID NO: 1292962 - protein, 9 aa, Homo Sapiens
REKTVRNTE

SEQ ID NO: 1292963 - protein, 9 aa, Homo Sapiens
KGPVQPIAQ

SEQ ID NO: 1292964 - protein, 9 aa, Homo Sapiens
LFFRCHSGI

SEQ ID NO: 1292965 - protein, 9 aa, Homo Sapiens
KKDTVQLSI

SEQ ID NO: 1292966 - protein, 9 aa, Homo Sapiens
LVATPALPT

SEQ ID NO: 1292967 - protein, 9 aa, Homo Sapiens
FAEGQISIN

SEQ ID NO: 1292968 - protein, 9 aa, Homo Sapiens
PPGPAPWWH

SEQ ID NO: 1292969 - protein, 9 aa, Homo Sapiens
TETRAPTPR

SEQ ID NO: 1292970 - protein, 9 aa, Homo Sapiens
IDHLCHIIE

SEQ ID NO: 1292971 - protein, 9 aa, Homo Sapiens
VFPYQNEMS

SEQ ID NO: 1292972 - protein, 9 aa, Homo Sapiens
ITSPPCCLC

SEQ ID NO: 1292973 - protein, 9 aa, Homo Sapiens
STPRYLRSV

SEQ ID NO: 1292974 - protein, 9 aa, Homo Sapiens
VCPAVERVS

SEQ ID NO: 1292975 - protein, 9 aa, Homo Sapiens
VKPPMPTGL

SEQ ID NO: 1292976 - protein, 9 aa, Homo Sapiens
LNIASVDLP

SEQ ID NO: 1292977 - protein, 9 aa, Homo Sapiens
SAHTSRSVL

SEQ ID NO: 1292978 - protein, 9 aa, Homo Sapiens
DHPDHVLLT

SEQ ID NO: 1292979 - protein, 9 aa, Homo Sapiens
CSAPLSTWS

SEQ ID NO: 1292980 - protein, 9 aa, Homo Sapiens
RLVHHDDYL

SEQ ID NO: 1292981 - protein, 9 aa, Homo Sapiens
DGVKPPMPT

SEQ ID NO: 1292982 - protein, 9 aa, Homo Sapiens
RFVLYKEGG

SEQ ID NO: 1292983 - protein, 9 aa, Homo Sapiens
PKHLLGQRR

SEQ ID NO: 1292984 - protein, 9 aa, Homo Sapiens
LLVYILWAV

SEQ ID NO: 1292985 - protein, 9 aa, Homo Sapiens
YPAASAPCW

SEQ ID NO: 1292986 - protein, 9 aa, Homo Sapiens
PEAAHELWQ

SEQ ID NO: 1292987 - protein, 9 aa, Homo Sapiens
REVPPRFHC

SEQ ID NO: 1292988 - protein, 9 aa, Homo Sapiens
LIGNRKKHG

SEQ ID NO: 1292989 - protein, 9 aa, Homo Sapiens
FLRHIRKLW

SEQ ID NO: 1292990 - protein, 9 aa, Homo Sapiens
RKSQTIVVD

SEQ ID NO: 1292991 - protein, 9 aa, Homo Sapiens
PPPPLGNPR

SEQ ID NO: 1292992 - protein, 9 aa, Homo Sapiens
CKKKDEEKV

SEQ ID NO: 1292993 - protein, 9 aa, Homo Sapiens
SLCPPTAPW

SEQ ID NO: 1292994 - protein, 9 aa, Homo Sapiens
VAEEEAVPV

SEQ ID NO: 1292995 - protein, 9 aa, Homo Sapiens
MEKSLGKNL

SEQ ID NO: 1292996 - protein, 9 aa, Homo Sapiens
LKDEIAEVV

SEQ ID NO: 1292997 - protein, 9 aa, Homo Sapiens
SLSSRWTTR

SEQ ID NO: 1292998 - protein, 9 aa, Homo Sapiens
HSGRQWGAG

SEQ ID NO: 1292999 - protein, 9 aa, Homo Sapiens
GRVEAAVDL

SEQ ID NO: 1293000 - protein, 9 aa, Homo Sapiens
ATVPRHSSV

SEQ ID NO: 1293001 - protein, 9 aa, Homo Sapiens
VLIYRSRVA

SEQ ID NO: 1293002 - protein, 9 aa, Homo Sapiens
WSHLESILS

SEQ ID NO: 1293003 - protein, 9 aa, Homo Sapiens
LQDSFHRGA

SEQ ID NO: 1293004 - protein, 9 aa, Homo Sapiens
FVLYKEGGR

SEQ ID NO: 1293005 - protein, 9 aa, Homo Sapiens
SLGKNLSKL

SEQ ID NO: 1293006 - protein, 9 aa, Homo Sapiens
QPQHTMRSL

SEQ ID NO: 1293007 - protein, 9 aa, Homo Sapiens
NEASVLHDL

SEQ ID NO: 1293008 - protein, 9 aa, Homo Sapiens
ERMHELEQQ

SEQ ID NO: 1293009 - protein, 9 aa, Homo Sapiens
LFPIVHIFV

SEQ ID NO: 1293010 - protein, 9 aa, Homo Sapiens
EVVRTAEPD

SEQ ID NO: 1293011 - protein, 9 aa, Homo Sapiens
RGAPRHPHR

SEQ ID NO: 1293012 - protein, 9 aa, Homo Sapiens
GRGQSAKSG

SEQ ID NO: 1293013 - protein, 9 aa, Homo Sapiens
PPLARVRAL

SEQ ID NO: 1293014 - protein, 9 aa, Homo Sapiens
WTAQLRASW

SEQ ID NO: 1293015 - protein, 9 aa, Homo Sapiens
LQELKLCFS

SEQ ID NO: 1293016 - protein, 9 aa, Homo Sapiens
ILWAVDGRK

SEQ ID NO: 1293017 - protein, 9 aa, Homo Sapiens
HVEARLGQL

SEQ ID NO: 1293018 - protein, 9 aa, Homo Sapiens
KENQKEQTA

SEQ ID NO: 1293019 - protein, 9 aa, Homo Sapiens
SSVACPARK

SEQ ID NO: 1293020 - protein, 9 aa, Homo Sapiens
LILWPQAAP

SEQ ID NO: 1293021 - protein, 9 aa, Homo Sapiens
HDVGEERWL

SEQ ID NO: 1293022 - protein, 9 aa, Homo Sapiens
CPSPPWSPS

SEQ ID NO: 1293023 - protein, 9 aa, Homo Sapiens
FSGGCGFEL

SEQ ID NO: 1293024 - protein, 9 aa, Homo Sapiens
QGGQKPSQE

SEQ ID NO: 1293025 - protein, 9 aa, Homo Sapiens
MHCPTATAA

SEQ ID NO: 1293026 - protein, 9 aa, Homo Sapiens
FTVLEFRSF

SEQ ID NO: 1293027 - protein, 9 aa, Homo Sapiens
GVDVDQVLC

SEQ ID NO: 1293028 - protein, 9 aa, Homo Sapiens
VDLPNTGRP

SEQ ID NO: 1293029 - protein, 9 aa, Homo Sapiens
PQFKLEEYY

SEQ ID NO: 1293030 - protein, 9 aa, Homo Sapiens
LPAKPSPGA

SEQ ID NO: 1293031 - protein, 9 aa, Homo Sapiens
VDEKPASMP

SEQ ID NO: 1293032 - protein, 9 aa, Homo Sapiens
CLHQLVMNK

SEQ ID NO: 1293033 - protein, 9 aa, Homo Sapiens
KLQLSDPGL

SEQ ID NO: 1293034 - protein, 9 aa, Homo Sapiens
LPSASSGNC

SEQ ID NO: 1293035 - protein, 9 aa, Homo Sapiens
LSPEPDSLL

SEQ ID NO: 1293036 - protein, 9 aa, Homo Sapiens
YRKMSEPKD

SEQ ID NO: 1293037 - protein, 9 aa, Homo Sapiens
KGAGARGAA

SEQ ID NO: 1293038 - protein, 9 aa, Homo Sapiens
SCDPPGMTG

SEQ ID NO: 1293039 - protein, 9 aa, Homo Sapiens
NMPPYSRKN

SEQ ID NO: 1293040 - protein, 9 aa, Homo Sapiens
LSLYSVAVW

SEQ ID NO: 1293041 - protein, 9 aa, Homo Sapiens
LHRQISLPL

SEQ ID NO: 1293042 - protein, 9 aa, Homo Sapiens
CSLSSRWTT

SEQ ID NO: 1293043 - protein, 9 aa, Homo Sapiens
EVIARGVAL

SEQ ID NO: 1293044 - protein, 9 aa, Homo Sapiens
VNLCWSEIT

SEQ ID NO: 1293045 - protein, 9 aa, Homo Sapiens
SENTRLALC

SEQ ID NO: 1293046 - protein, 9 aa, Homo Sapiens
LDSNGIITQ

SEQ ID NO: 1293047 - protein, 9 aa, Homo Sapiens
FSKKKKKEK

SEQ ID NO: 1293048 - protein, 9 aa, Homo Sapiens
AAPAVTHSE

SEQ ID NO: 1293049 - protein, 9 aa, Homo Sapiens
LDVLDNDGC

SEQ ID NO: 1293050 - protein, 9 aa, Homo Sapiens
SSPAQGHQR

SEQ ID NO: 1293051 - protein, 9 aa, Homo Sapiens
DFTLLVQAL

SEQ ID NO: 1293052 - protein, 9 aa, Homo Sapiens
TLHMPMYVF

SEQ ID NO: 1293053 - protein, 9 aa, Homo Sapiens
LVDLAVADL

SEQ ID NO: 1293054 - protein, 9 aa, Homo Sapiens
YGEDHRADF

SEQ ID NO: 1293055 - protein, 9 aa, Homo Sapiens
GGQSSCAFA

SEQ ID NO: 1293056 - protein, 9 aa, Homo Sapiens
TDKSATPAT

SEQ ID NO: 1293057 - protein, 9 aa, Homo Sapiens
KIVDSKHFG

SEQ ID NO: 1293058 - protein, 9 aa, Homo Sapiens
SQNISVREH

SEQ ID NO: 1293059 - protein, 9 aa, Homo Sapiens
EGIVVAMGQ

SEQ ID NO: 1293060 - protein, 9 aa, Homo Sapiens
SPRLCATTT

SEQ ID NO: 1293061 - protein, 9 aa, Homo Sapiens
ENASGRGTC

SEQ ID NO: 1293062 - protein, 9 aa, Homo Sapiens
RLTPPHADP

SEQ ID NO: 1293063 - protein, 9 aa, Homo Sapiens
EHAPEQRVG

SEQ ID NO: 1293064 - protein, 9 aa, Homo Sapiens
THYHSLVDY

SEQ ID NO: 1293065 - protein, 9 aa, Homo Sapiens
CPPTAPWRP

SEQ ID NO: 1293066 - protein, 9 aa, Homo Sapiens
DTRARACAV

SEQ ID NO: 1293067 - protein, 9 aa, Homo Sapiens
EGRRLCRAE

SEQ ID NO: 1293068 - protein, 9 aa, Homo Sapiens
QALNRLCVL

SEQ ID NO: 1293069 - protein, 9 aa, Homo Sapiens
RPSIGKIVN

SEQ ID NO: 1293070 - protein, 9 aa, Homo Sapiens
AEVVNEIEN

SEQ ID NO: 1293071 - protein, 9 aa, Homo Sapiens
EGQPMRCLH

SEQ ID NO: 1293072 - protein, 9 aa, Homo Sapiens
GLWKWQFDV

SEQ ID NO: 1293073 - protein, 9 aa, Homo Sapiens
PPYSRKNTL

SEQ ID NO: 1293074 - protein, 9 aa, Homo Sapiens
LWQIPEGEG

SEQ ID NO: 1293075 - protein, 9 aa, Homo Sapiens
TQLEINGQN

SEQ ID NO: 1293076 - protein, 9 aa, Homo Sapiens
AKYLNMYST

SEQ ID NO: 1293077 - protein, 9 aa, Homo Sapiens
PMPTGLRKA

SEQ ID NO: 1293078 - protein, 9 aa, Homo Sapiens
VGPGPHAVS

SEQ ID NO: 1293079 - protein, 9 aa, Homo Sapiens
GEKTSELTV

SEQ ID NO: 1293080 - protein, 9 aa, Homo Sapiens
LHDTLQELT

SEQ ID NO: 1293081 - protein, 9 aa, Homo Sapiens
IVHHRTHIG

SEQ ID NO: 1293082 - protein, 9 aa, Homo Sapiens
ELLSEFSPD

SEQ ID NO: 1293083 - protein, 9 aa, Homo Sapiens
ITVSLSSLK

SEQ ID NO: 1293084 - protein, 9 aa, Homo Sapiens
DGDVARAPA

SEQ ID NO: 1293085 - protein, 9 aa, Homo Sapiens
TGSSSTTTV

SEQ ID NO: 1293086 - protein, 9 aa, Homo Sapiens
HARGPQRDG

SEQ ID NO: 1293087 - protein, 9 aa, Homo Sapiens
SRASQPSSS

SEQ ID NO: 1293088 - protein, 9 aa, Homo Sapiens
WTQIPQGCL

SEQ ID NO: 1293089 - protein, 9 aa, Homo Sapiens
LYRCCDQPR

SEQ ID NO: 1293090 - protein, 9 aa, Homo Sapiens
GWGDLEFLS

SEQ ID NO: 1293091 - protein, 9 aa, Homo Sapiens
PLPTPSLCP

SEQ ID NO: 1293092 - protein, 9 aa, Homo Sapiens
PKAQPGVSE

SEQ ID NO: 1293093 - protein, 9 aa, Homo Sapiens
GLVDIMDIR

SEQ ID NO: 1293094 - protein, 9 aa, Homo Sapiens
SHGQGGQKP

SEQ ID NO: 1293095 - protein, 9 aa, Homo Sapiens
VLCKRMSEQ

SEQ ID NO: 1293096 - protein, 9 aa, Homo Sapiens
LTGETPPSV

SEQ ID NO: 1293097 - protein, 9 aa, Homo Sapiens
MPWGSKMPF

SEQ ID NO: 1293098 - protein, 9 aa, Homo Sapiens
LVIKIPECP

SEQ ID NO: 1293099 - protein, 9 aa, Homo Sapiens
PGRTAASQL

SEQ ID NO: 1293100 - protein, 9 aa, Homo Sapiens
NDNAPPSPK

SEQ ID NO: 1293101 - protein, 9 aa, Homo Sapiens
WSRILSIQK

SEQ ID NO: 1293102 - protein, 9 aa, Homo Sapiens
MLDWDCLHH

SEQ ID NO: 1293103 - protein, 9 aa, Homo Sapiens
LQLSDPGLQ

SEQ ID NO: 1293104 - protein, 9 aa, Homo Sapiens
GVHAYPGGS

SEQ ID NO: 1293105 - protein, 9 aa, Homo Sapiens
CSLCGKKED

SEQ ID NO: 1293106 - protein, 9 aa, Homo Sapiens
RAVVLLLQG

SEQ ID NO: 1293107 - protein, 9 aa, Homo Sapiens
GGGEPGWQP

SEQ ID NO: 1293108 - protein, 9 aa, Homo Sapiens
VPTVGFEQD

SEQ ID NO: 1293109 - protein, 9 aa, Homo Sapiens
HRSLLESTK

SEQ ID NO: 1293110 - protein, 9 aa, Homo Sapiens
RTTIPQPWE

SEQ ID NO: 1293111 - protein, 9 aa, Homo Sapiens
PGDFRRYRE

SEQ ID NO: 1293112 - protein, 9 aa, Homo Sapiens
FHCQQDHKV

SEQ ID NO: 1293113 - protein, 9 aa, Homo Sapiens
ASVAPATLP

SEQ ID NO: 1293114 - protein, 9 aa, Homo Sapiens
DCKSEECSQ

SEQ ID NO: 1293115 - protein, 9 aa, Homo Sapiens
TKCAFQAPP

SEQ ID NO: 1293116 - protein, 9 aa, Homo Sapiens
TERWPGRDS

SEQ ID NO: 1293117 - protein, 9 aa, Homo Sapiens
HLGQAGPCR

SEQ ID NO: 1293118 - protein, 9 aa, Homo Sapiens
LVTQQKAAN

SEQ ID NO: 1293119 - protein, 9 aa, Homo Sapiens
LRVAKRQQL

SEQ ID NO: 1293120 - protein, 9 aa, Homo Sapiens
PSRRKTPNS

SEQ ID NO: 1293121 - protein, 9 aa, Homo Sapiens
GWWGQKTKV

SEQ ID NO: 1293122 - protein, 9 aa, Homo Sapiens
SLPLRGFLL

SEQ ID NO: 1293123 - protein, 9 aa, Homo Sapiens
PRVQARWSV

SEQ ID NO: 1293124 - protein, 9 aa, Homo Sapiens
LFDVPEAPL

SEQ ID NO: 1293125 - protein, 9 aa, Homo Sapiens
PHPSAVHEG

SEQ ID NO: 1293126 - protein, 9 aa, Homo Sapiens
ALRPAAAAA

SEQ ID NO: 1293127 - protein, 9 aa, Homo Sapiens
PSWALPTGS

SEQ ID NO: 1293128 - protein, 9 aa, Homo Sapiens
RLSGELHLL

SEQ ID NO: 1293129 - protein, 9 aa, Homo Sapiens
QSSPFLARS

SEQ ID NO: 1293130 - protein, 9 aa, Homo Sapiens
SEGWHWGAA

SEQ ID NO: 1293131 - protein, 9 aa, Homo Sapiens
PYCITEFGV

SEQ ID NO: 1293132 - protein, 9 aa, Homo Sapiens
KDDMQELLS

SEQ ID NO: 1293133 - protein, 9 aa, Homo Sapiens
HQTFPSGKR

SEQ ID NO: 1293134 - protein, 9 aa, Homo Sapiens
ENPVGLRGA

SEQ ID NO: 1293135 - protein, 9 aa, Homo Sapiens
EDVDILQRP

SEQ ID NO: 1293136 - protein, 9 aa, Homo Sapiens
SILSVQKIF

SEQ ID NO: 1293137 - protein, 9 aa, Homo Sapiens
RGLGPPATA

SEQ ID NO: 1293138 - protein, 9 aa, Homo Sapiens
VLALQGNRL

SEQ ID NO: 1293139 - protein, 9 aa, Homo Sapiens
EEAIEHGLG

SEQ ID NO: 1293140 - protein, 9 aa, Homo Sapiens
LPIAEVMLT

SEQ ID NO: 1293141 - protein, 9 aa, Homo Sapiens
SRSSCRSKG

SEQ ID NO: 1293142 - protein, 9 aa, Homo Sapiens
WTTRPCRRS

SEQ ID NO: 1293143 - protein, 9 aa, Homo Sapiens
VKLFDVPEA

SEQ ID NO: 1293144 - protein, 9 aa, Homo Sapiens
DPAVHLPFF

SEQ ID NO: 1293145 - protein, 9 aa, Homo Sapiens
AGTPCSHQG

SEQ ID NO: 1293146 - protein, 9 aa, Homo Sapiens
LLLFGLRVA

SEQ ID NO: 1293147 - protein, 9 aa, Homo Sapiens
AQGHLDPQD

SEQ ID NO: 1293148 - protein, 9 aa, Homo Sapiens
GELHLLGPL

SEQ ID NO: 1293149 - protein, 9 aa, Homo Sapiens
ITTLITYIS

SEQ ID NO: 1293150 - protein, 9 aa, Homo Sapiens
CCDQPRHFA

SEQ ID NO: 1293151 - protein, 9 aa, Homo Sapiens
HPQVPPQLP

SEQ ID NO: 1293152 - protein, 9 aa, Homo Sapiens
KRKCREKDD

SEQ ID NO: 1293153 - protein, 9 aa, Homo Sapiens
WAGSDVFDG

SEQ ID NO: 1293154 - protein, 9 aa, Homo Sapiens
VFVVRTERG

SEQ ID NO: 1293155 - protein, 9 aa, Homo Sapiens
HALHFCYYV

SEQ ID NO: 1293156 - protein, 9 aa, Homo Sapiens
RAGPPGGGC

SEQ ID NO: 1293157 - protein, 9 aa, Homo Sapiens
QPAGARASK

SEQ ID NO: 1293158 - protein, 9 aa, Homo Sapiens
LSQNISVRE

SEQ ID NO: 1293159 - protein, 9 aa, Homo Sapiens
MPHTFLLVI

SEQ ID NO: 1293160 - protein, 9 aa, Homo Sapiens
ITCLEQGKN

SEQ ID NO: 1293161 - protein, 9 aa, Homo Sapiens
RTAASQLQR

SEQ ID NO: 1293162 - protein, 9 aa, Homo Sapiens
KKTKDGNGS

SEQ ID NO: 1293163 - protein, 9 aa, Homo Sapiens
DLYQLAPAV

SEQ ID NO: 1293164 - protein, 9 aa, Homo Sapiens
VPRCAMAPE

SEQ ID NO: 1293165 - protein, 9 aa, Homo Sapiens
HFSSSSSGS

SEQ ID NO: 1293166 - protein, 9 aa, Homo Sapiens
LHWSLMSEK

SEQ ID NO: 1293167 - protein, 9 aa, Homo Sapiens
VVTFVPVSK

SEQ ID NO: 1293168 - protein, 9 aa, Homo Sapiens
RRGRPPGEK

SEQ ID NO: 1293169 - protein, 9 aa, Homo Sapiens
GARHHARLF

SEQ ID NO: 1293170 - protein, 9 aa, Homo Sapiens
GDFRRYRER

SEQ ID NO: 1293171 - protein, 9 aa, Homo Sapiens
LRHIRKLWQ

SEQ ID NO: 1293172 - protein, 9 aa, Homo Sapiens
TDHNTQIHA

SEQ ID NO: 1293173 - protein, 9 aa, Homo Sapiens
ILHHLTTDH

SEQ ID NO: 1293174 - protein, 9 aa, Homo Sapiens
KCPRKRGAT

SEQ ID NO: 1293175 - protein, 9 aa, Homo Sapiens
CGKKEDMLD

SEQ ID NO: 1293176 - protein, 9 aa, Homo Sapiens
AAAAQRGPA

SEQ ID NO: 1293177 - protein, 9 aa, Homo Sapiens
TGFLYTGEG

SEQ ID NO: 1293178 - protein, 9 aa, Homo Sapiens
SHPPTTTTS

SEQ ID NO: 1293179 - protein, 9 aa, Homo Sapiens
GKGFCESTA

SEQ ID NO: 1293180 - protein, 9 aa, Homo Sapiens
FTVRHVLHF

SEQ ID NO: 1293181 - protein, 9 aa, Homo Sapiens
PPSISHRSL

SEQ ID NO: 1293182 - protein, 9 aa, Homo Sapiens
EAKEVFPKM

SEQ ID NO: 1293183 - protein, 9 aa, Homo Sapiens
QQGRWNNAK

SEQ ID NO: 1293184 - protein, 9 aa, Homo Sapiens
LRISNLFNI

SEQ ID NO: 1293185 - protein, 9 aa, Homo Sapiens
AMAPETTLW

SEQ ID NO: 1293186 - protein, 9 aa, Homo Sapiens
HRSNQNREW

SEQ ID NO: 1293187 - protein, 9 aa, Homo Sapiens
DGSHTIATQ

SEQ ID NO: 1293188 - protein, 9 aa, Homo Sapiens
SKADLESIL

SEQ ID NO: 1293189 - protein, 9 aa, Homo Sapiens
WHLHVHFVN

SEQ ID NO: 1293190 - protein, 9 aa, Homo Sapiens
LRRRTDPAT

SEQ ID NO: 1293191 - protein, 9 aa, Homo Sapiens
QHARKRVIT

SEQ ID NO: 1293192 - protein, 9 aa, Homo Sapiens
KKNHFLPEN

SEQ ID NO: 1293193 - protein, 9 aa, Homo Sapiens
TMGWCPRLR

SEQ ID NO: 1293194 - protein, 9 aa, Homo Sapiens
FFMATVHFQ

SEQ ID NO: 1293195 - protein, 9 aa, Homo Sapiens
FRRAHVYTA

SEQ ID NO: 1293196 - protein, 9 aa, Homo Sapiens
RGGRRGATA

SEQ ID NO: 1293197 - protein, 9 aa, Homo Sapiens
ELWQLEVLG

SEQ ID NO: 1293198 - protein, 9 aa, Homo Sapiens
HHARLFFCI

SEQ ID NO: 1293199 - protein, 9 aa, Homo Sapiens
DVGGRGQSA

SEQ ID NO: 1293200 - protein, 9 aa, Homo Sapiens
HALGRIVHA

SEQ ID NO: 1293201 - protein, 9 aa, Homo Sapiens
RQLALQKEE

SEQ ID NO: 1293202 - protein, 9 aa, Homo Sapiens
LQPPSPEPR

SEQ ID NO: 1293203 - protein, 9 aa, Homo Sapiens
HRQISLPLR

SEQ ID NO: 1293204 - protein, 9 aa, Homo Sapiens
HPTCILGQR

SEQ ID NO: 1293205 - protein, 9 aa, Homo Sapiens
YLDSGIHPG

SEQ ID NO: 1293206 - protein, 9 aa, Homo Sapiens
LIMEQVKVK

SEQ ID NO: 1293207 - protein, 9 aa, Homo Sapiens
STHTVMQGN

SEQ ID NO: 1293208 - protein, 9 aa, Homo Sapiens
SARAMTERW

SEQ ID NO: 1293209 - protein, 9 aa, Homo Sapiens
APAAVQRLG

SEQ ID NO: 1293210 - protein, 9 aa, Homo Sapiens
APMMSSMAC

SEQ ID NO: 1293211 - protein, 9 aa, Homo Sapiens
FPAVGLELL

SEQ ID NO: 1293212 - protein, 9 aa, Homo Sapiens
VYGEPPPKK

SEQ ID NO: 1293213 - protein, 9 aa, Homo Sapiens
DVNDNAPPS

SEQ ID NO: 1293214 - protein, 9 aa, Homo Sapiens
IMSLSVPLD

SEQ ID NO: 1293215 - protein, 9 aa, Homo Sapiens
PAGCWLSFN

SEQ ID NO: 1293216 - protein, 9 aa, Homo Sapiens
WLLLLLSPL

SEQ ID NO: 1293217 - protein, 9 aa, Homo Sapiens
WCLPSASSG

SEQ ID NO: 1293218 - protein, 9 aa, Homo Sapiens
HPSDVMEMR

SEQ ID NO: 1293219 - protein, 9 aa, Homo Sapiens
KAVDEMNGH

SEQ ID NO: 1293220 - protein, 9 aa, Homo Sapiens
TATPSWALP

SEQ ID NO: 1293221 - protein, 9 aa, Homo Sapiens
QKNIRQRVY

SEQ ID NO: 1293222 - protein, 9 aa, Homo Sapiens
ELQKQVENM

SEQ ID NO: 1293223 - protein, 9 aa, Homo Sapiens
SWTWCLPSA

SEQ ID NO: 1293224 - protein, 9 aa, Homo Sapiens
PQDQACVPP

SEQ ID NO: 1293225 - protein, 9 aa, Homo Sapiens
GCLGPFGFF

SEQ ID NO: 1293226 - protein, 9 aa, Homo Sapiens
FRESFKHID

SEQ ID NO: 1293227 - protein, 9 aa, Homo Sapiens
AMRYLCSQC

SEQ ID NO: 1293228 - protein, 9 aa, Homo Sapiens
DTATPSWAL

SEQ ID NO: 1293229 - protein, 9 aa, Homo Sapiens
IAEVVNEIE

SEQ ID NO: 1293230 - protein, 9 aa, Homo Sapiens
LGLWKWQFD

SEQ ID NO: 1293231 - protein, 9 aa, Homo Sapiens
AAVDLYQLA

SEQ ID NO: 1293232 - protein, 9 aa, Homo Sapiens
GRSTPRLPV

SEQ ID NO: 1293233 - protein, 9 aa, Homo Sapiens
WQPAEPHPA

SEQ ID NO: 1293234 - protein, 9 aa, Homo Sapiens
TIVVDVNLC

SEQ ID NO: 1293235 - protein, 9 aa, Homo Sapiens
PIAEVMLTY

SEQ ID NO: 1293236 - protein, 9 aa, Homo Sapiens
CSTMGWCPR

SEQ ID NO: 1293237 - protein, 9 aa, Homo Sapiens
AVVTFVPVS

SEQ ID NO: 1293238 - protein, 9 aa, Homo Sapiens
PLWLMTAMW

SEQ ID NO: 1293239 - protein, 9 aa, Homo Sapiens
SRTVPGPGM

SEQ ID NO: 1293240 - protein, 9 aa, Homo Sapiens
YRERISQGL

SEQ ID NO: 1293241 - protein, 9 aa, Homo Sapiens
FPSATRCMG

SEQ ID NO: 1293242 - protein, 9 aa, Homo Sapiens
AGRQARPDG

SEQ ID NO: 1293243 - protein, 9 aa, Homo Sapiens
HLAEVCQLQ

SEQ ID NO: 1293244 - protein, 9 aa, Homo Sapiens
ISGVCSARG

SEQ ID NO: 1293245 - protein, 9 aa, Homo Sapiens
GYQPPDRRG

SEQ ID NO: 1293246 - protein, 9 aa, Homo Sapiens
AQDTSGHRG

SEQ ID NO: 1293247 - protein, 9 aa, Homo Sapiens
RTSDNGQFF

SEQ ID NO: 1293248 - protein, 9 aa, Homo Sapiens
KRVITTYQN

SEQ ID NO: 1293249 - protein, 9 aa, Homo Sapiens
KDNLESHMK

SEQ ID NO: 1293250 - protein, 9 aa, Homo Sapiens
CGSLCMLGC

SEQ ID NO: 1293251 - protein, 9 aa, Homo Sapiens
QPMRCLHLP

SEQ ID NO: 1293252 - protein, 9 aa, Homo Sapiens
LVKLGTVER

SEQ ID NO: 1293253 - protein, 9 aa, Homo Sapiens
PELGVRLRV

SEQ ID NO: 1293254 - protein, 9 aa, Homo Sapiens
PKPPTPCSS

SEQ ID NO: 1293255 - protein, 9 aa, Homo Sapiens
AASAPCWAP

SEQ ID NO: 1293256 - protein, 9 aa, Homo Sapiens
ATVRVMDVN

SEQ ID NO: 1293257 - protein, 9 aa, Homo Sapiens
ADPAAQGHL

SEQ ID NO: 1293258 - protein, 9 aa, Homo Sapiens
SGEEAPTGW

SEQ ID NO: 1293259 - protein, 9 aa, Homo Sapiens
GISGMRTFR

SEQ ID NO: 1293260 - protein, 9 aa, Homo Sapiens
NLLPPSRRK

SEQ ID NO: 1293261 - protein, 9 aa, Homo Sapiens
LTVLIPCFP

SEQ ID NO: 1293262 - protein, 9 aa, Homo Sapiens
RQGACVATG

SEQ ID NO: 1293263 - protein, 9 aa, Homo Sapiens
FTLLVQALK

SEQ ID NO: 1293264 - protein, 9 aa, Homo Sapiens
FVEEIKGEC

SEQ ID NO: 1293265 - protein, 9 aa, Homo Sapiens
PTQQLAWPD

SEQ ID NO: 1293266 - protein, 9 aa, Homo Sapiens
AGGYQPPDR

SEQ ID NO: 1293267 - protein, 9 aa, Homo Sapiens
QWLGSHFPD

SEQ ID NO: 1293268 - protein, 9 aa, Homo Sapiens
SPSRHWRAA

SEQ ID NO: 1293269 - protein, 9 aa, Homo Sapiens
ALRKTEHPA

SEQ ID NO: 1293270 - protein, 9 aa, Homo Sapiens
SLAKPLLSY

SEQ ID NO: 1293271 - protein, 9 aa, Homo Sapiens
KLHAAEQYT

SEQ ID NO: 1293272 - protein, 9 aa, Homo Sapiens
LGTWVPECL

SEQ ID NO: 1293273 - protein, 9 aa, Homo Sapiens
GLNDLRRQL

SEQ ID NO: 1293274 - protein, 9 aa, Homo Sapiens
LDLLLPALQ

SEQ ID NO: 1293275 - protein, 9 aa, Homo Sapiens
GHRHHRAAP

SEQ ID NO: 1293276 - protein, 9 aa, Homo Sapiens
IHRSCSERC

SEQ ID NO: 1293277 - protein, 9 aa, Homo Sapiens
FYYKLHAAE

SEQ ID NO: 1293278 - protein, 9 aa, Homo Sapiens
KTTQPTVIN

SEQ ID NO: 1293279 - protein, 9 aa, Homo Sapiens
PMVRLTRHT

SEQ ID NO: 1293280 - protein, 9 aa, Homo Sapiens
PGEKLSPNP

SEQ ID NO: 1293281 - protein, 9 aa, Homo Sapiens
PGWKRTQQR

SEQ ID NO: 1293282 - protein, 9 aa, Homo Sapiens
SSSVWSSAA

SEQ ID NO: 1293283 - protein, 9 aa, Homo Sapiens
TSPRAVEAS

SEQ ID NO: 1293284 - protein, 9 aa, Homo Sapiens
DMSCVTIAN

SEQ ID NO: 1293285 - protein, 9 aa, Homo Sapiens
RGGAWKSIF

SEQ ID NO: 1293286 - protein, 9 aa, Homo Sapiens
YSIRRTSDN

SEQ ID NO: 1293287 - protein, 9 aa, Homo Sapiens
SEFMSPSPY

SEQ ID NO: 1293288 - protein, 9 aa, Homo Sapiens
PGPHAVSGC

SEQ ID NO: 1293289 - protein, 9 aa, Homo Sapiens
VRNMFLILL

SEQ ID NO: 1293290 - protein, 9 aa, Homo Sapiens
CMDCVFEAV

SEQ ID NO: 1293291 - protein, 9 aa, Homo Sapiens
DKSATPATD

SEQ ID NO: 1293292 - protein, 9 aa, Homo Sapiens
SNAGIVTVG

SEQ ID NO: 1293293 - protein, 9 aa, Homo Sapiens
TCPGPSWHP

SEQ ID NO: 1293294 - protein, 9 aa, Homo Sapiens
KPCLCTVSL

SEQ ID NO: 1293295 - protein, 9 aa, Homo Sapiens
PPVPPDGSD

SEQ ID NO: 1293296 - protein, 9 aa, Homo Sapiens
RKARMEGQP

SEQ ID NO: 1293297 - protein, 9 aa, Homo Sapiens
DAPLGLPAQ

SEQ ID NO: 1293298 - protein, 9 aa, Homo Sapiens
HSISMPTMR

SEQ ID NO: 1293299 - protein, 9 aa, Homo Sapiens
YQNEMSDVV

SEQ ID NO: 1293300 - protein, 9 aa, Homo Sapiens
CTLNLLYTL

SEQ ID NO: 1293301 - protein, 9 aa, Homo Sapiens
WPVNRRPMF

SEQ ID NO: 1293302 - protein, 9 aa, Homo Sapiens
CRAEDEDAA

SEQ ID NO: 1293303 - protein, 9 aa, Homo Sapiens
RLPLPTPSL

SEQ ID NO: 1293304 - protein, 9 aa, Homo Sapiens
LTVLGVRSQ

SEQ ID NO: 1293305 - protein, 9 aa, Homo Sapiens
RIHSTATWT

SEQ ID NO: 1293306 - protein, 9 aa, Homo Sapiens
PPGRCWAWR

SEQ ID NO: 1293307 - protein, 9 aa, Homo Sapiens
EAFPLPRAS

SEQ ID NO: 1293308 - protein, 9 aa, Homo Sapiens
MPPGVKVDL

SEQ ID NO: 1293309 - protein, 9 aa, Homo Sapiens
HAAEVCGRH

SEQ ID NO: 1293310 - protein, 9 aa, Homo Sapiens
EVELEVIAR

SEQ ID NO: 1293311 - protein, 9 aa, Homo Sapiens
SAPLSTWSA

SEQ ID NO: 1293312 - protein, 9 aa, Homo Sapiens
WKVLHIRKH

SEQ ID NO: 1293313 - protein, 9 aa, Homo Sapiens
RLPWEIPGK

SEQ ID NO: 1293314 - protein, 9 aa, Homo Sapiens
EKLSALRIS

SEQ ID NO: 1293315 - protein, 9 aa, Homo Sapiens
AETVTLIEC

SEQ ID NO: 1293316 - protein, 9 aa, Homo Sapiens
PGGRPWCRE

SEQ ID NO: 1293317 - protein, 9 aa, Homo Sapiens
HGDTEALVQ

SEQ ID NO: 1293318 - protein, 9 aa, Homo Sapiens
TELQKQVEN

SEQ ID NO: 1293319 - protein, 9 aa, Homo Sapiens
RLRLCYMAN

SEQ ID NO: 1293320 - protein, 9 aa, Homo Sapiens
CQMSPDIKQ

SEQ ID NO: 1293321 - protein, 9 aa, Homo Sapiens
RPEILQDSR

SEQ ID NO: 1293322 - protein, 9 aa, Homo Sapiens
NFSRSPPTL

SEQ ID NO: 1293323 - protein, 9 aa, Homo Sapiens
RCEKQELRR

SEQ ID NO: 1293324 - protein, 9 aa, Homo Sapiens
LVDNVYCVG

SEQ ID NO: 1293325 - protein, 9 aa, Homo Sapiens
ALGEVVGQH

SEQ ID NO: 1293326 - protein, 9 aa, Homo Sapiens
PGSEIGTTD

SEQ ID NO: 1293327 - protein, 9 aa, Homo Sapiens
GQRATRHGP

SEQ ID NO: 1293328 - protein, 9 aa, Homo Sapiens
RLMVLQVDL

SEQ ID NO: 1293329 - protein, 9 aa, Homo Sapiens
RTDKLKSML

SEQ ID NO: 1293330 - protein, 9 aa, Homo Sapiens
VHDRDCKSE

SEQ ID NO: 1293331 - protein, 9 aa, Homo Sapiens
SCIDCFGLF

SEQ ID NO: 1293332 - protein, 9 aa, Homo Sapiens
PPHADPAAQ

SEQ ID NO: 1293333 - protein, 9 aa, Homo Sapiens
MEGLTLESN

SEQ ID NO: 1293334 - protein, 9 aa, Homo Sapiens
RASLRATVP

SEQ ID NO: 1293335 - protein, 9 aa, Homo Sapiens
GGGQSSCAF

SEQ ID NO: 1293336 - protein, 9 aa, Homo Sapiens
PGLMANLLI

SEQ ID NO: 1293337 - protein, 9 aa, Homo Sapiens
HRPGTPPPL

SEQ ID NO: 1293338 - protein, 9 aa, Homo Sapiens
AVGMFQDFN

SEQ ID NO: 1293339 - protein, 9 aa, Homo Sapiens
DGDEVVSIN

SEQ ID NO: 1293340 - protein, 9 aa, Homo Sapiens
RSLWPQSRP

SEQ ID NO: 1293341 - protein, 9 aa, Homo Sapiens
AQLRFISDL

SEQ ID NO: 1293342 - protein, 9 aa, Homo Sapiens
ETFSHLHKM

SEQ ID NO: 1293343 - protein, 9 aa, Homo Sapiens
IVVAMGQDC

SEQ ID NO: 1293344 - protein, 9 aa, Homo Sapiens
TRTTATCSL

SEQ ID NO: 1293345 - protein, 9 aa, Homo Sapiens
PPTPRGRLL

SEQ ID NO: 1293346 - protein, 9 aa, Homo Sapiens
QRLGRREQR

SEQ ID NO: 1293347 - protein, 9 aa, Homo Sapiens
NMGGNRSIC

SEQ ID NO: 1293348 - protein, 9 aa, Homo Sapiens
QTALYRGGQ

SEQ ID NO: 1293349 - protein, 9 aa, Homo Sapiens
KRILKMREG

SEQ ID NO: 1293350 - protein, 9 aa, Homo Sapiens
LPRMETHPQ

SEQ ID NO: 1293351 - protein, 9 aa, Homo Sapiens
TPQPFSSTT

SEQ ID NO: 1293352 - protein, 9 aa, Homo Sapiens
CLLSVHKSL

SEQ ID NO: 1293353 - protein, 9 aa, Homo Sapiens
ARVVELQTK

SEQ ID NO: 1293354 - protein, 9 aa, Homo Sapiens
TENPVGLRG

SEQ ID NO: 1293355 - protein, 9 aa, Homo Sapiens
GAAISQHSG

SEQ ID NO: 1293356 - protein, 9 aa, Homo Sapiens
AYEEVKHGA

SEQ ID NO: 1293357 - protein, 9 aa, Homo Sapiens
CRNDHIRLF

SEQ ID NO: 1293358 - protein, 9 aa, Homo Sapiens
LLESTKRRL

SEQ ID NO: 1293359 - protein, 9 aa, Homo Sapiens
PGHSQREPA

SEQ ID NO: 1293360 - protein, 9 aa, Homo Sapiens
STCLSPEPD

SEQ ID NO: 1293361 - protein, 9 aa, Homo Sapiens
ANDIMISIV

SEQ ID NO: 1293362 - protein, 9 aa, Homo Sapiens
RTQSLNYDC

SEQ ID NO: 1293363 - protein, 9 aa, Homo Sapiens
SSRSLKSRD

SEQ ID NO: 1293364 - protein, 9 aa, Homo Sapiens
VRAVDPNSG

SEQ ID NO: 1293365 - protein, 9 aa, Homo Sapiens
ALAGGVCPP

SEQ ID NO: 1293366 - protein, 9 aa, Homo Sapiens
RLRLRLPRT

SEQ ID NO: 1293367 - protein, 9 aa, Homo Sapiens
LVLKEFRRS

SEQ ID NO: 1293368 - protein, 9 aa, Homo Sapiens
GKRILKMRE

SEQ ID NO: 1293369 - protein, 9 aa, Homo Sapiens
RSSAACWPR

SEQ ID NO: 1293370 - protein, 9 aa, Homo Sapiens
NLSQSNSQL

SEQ ID NO: 1293371 - protein, 9 aa, Homo Sapiens
DLWGGNIAE

SEQ ID NO: 1293372 - protein, 9 aa, Homo Sapiens
IAGCLGPFG

SEQ ID NO: 1293373 - protein, 9 aa, Homo Sapiens
HLCHIIEKK

SEQ ID NO: 1293374 - protein, 9 aa, Homo Sapiens
YDQKNIRQR

SEQ ID NO: 1293375 - protein, 9 aa, Homo Sapiens
EPLDSNGII

SEQ ID NO: 1293376 - protein, 9 aa, Homo Sapiens
DKQVSQERK

SEQ ID NO: 1293377 - protein, 9 aa, Homo Sapiens
CCRPRTRTC

SEQ ID NO: 1293378 - protein, 9 aa, Homo Sapiens
EELRENSIC

SEQ ID NO: 1293379 - protein, 9 aa, Homo Sapiens
ELHIHQGKN

SEQ ID NO: 1293380 - protein, 9 aa, Homo Sapiens
IISKGMVNV

SEQ ID NO: 1293381 - protein, 9 aa, Homo Sapiens
RHRLSSLRA

SEQ ID NO: 1293382 - protein, 9 aa, Homo Sapiens
LFDAADGQG

SEQ ID NO: 1293383 - protein, 9 aa, Homo Sapiens
TAACPMTAC

SEQ ID NO: 1293384 - protein, 9 aa, Homo Sapiens
GRCEKQELR

SEQ ID NO: 1293385 - protein, 9 aa, Homo Sapiens
YNQDRHVDV

SEQ ID NO: 1293386 - protein, 9 aa, Homo Sapiens
TTTCPGPSW

SEQ ID NO: 1293387 - protein, 9 aa, Homo Sapiens
LPTPSLCPP

SEQ ID NO: 1293388 - protein, 9 aa, Homo Sapiens
SHQKKLTVP

SEQ ID NO: 1293389 - protein, 9 aa, Homo Sapiens
GPGMAVPRV

SEQ ID NO: 1293390 - protein, 9 aa, Homo Sapiens
SMSYSSPKA

SEQ ID NO: 1293391 - protein, 9 aa, Homo Sapiens
TVPGPGMAV

SEQ ID NO: 1293392 - protein, 9 aa, Homo Sapiens
SLHTAPASV

SEQ ID NO: 1293393 - protein, 9 aa, Homo Sapiens
GATAAERNM

SEQ ID NO: 1293394 - protein, 9 aa, Homo Sapiens
PPAWLVWVP

SEQ ID NO: 1293395 - protein, 9 aa, Homo Sapiens
PPGSVWILP

SEQ ID NO: 1293396 - protein, 9 aa, Homo Sapiens
VDVGGRGQS

SEQ ID NO: 1293397 - protein, 9 aa, Homo Sapiens
FKLQLSDPG

SEQ ID NO: 1293398 - protein, 9 aa, Homo Sapiens
EPHGRRAVV

SEQ ID NO: 1293399 - protein, 9 aa, Homo Sapiens
MWLSASHFT

SEQ ID NO: 1293400 - protein, 9 aa, Homo Sapiens
ETRTEGYFI

SEQ ID NO: 1293401 - protein, 9 aa, Homo Sapiens
VFSKKKKKE

SEQ ID NO: 1293402 - protein, 9 aa, Homo Sapiens
WGNGWWGQK

SEQ ID NO: 1293403 - protein, 9 aa, Homo Sapiens
CPKTGWEKR

SEQ ID NO: 1293404 - protein, 9 aa, Homo Sapiens
MSEKNLACP

SEQ ID NO: 1293405 - protein, 9 aa, Homo Sapiens
STWSASYTG

SEQ ID NO: 1293406 - protein, 9 aa, Homo Sapiens
PGPAPWWHP

SEQ ID NO: 1293407 - protein, 9 aa, Homo Sapiens
GFLAHEKAA

SEQ ID NO: 1293408 - protein, 9 aa, Homo Sapiens
CKGVTTTQW

SEQ ID NO: 1293409 - protein, 9 aa, Homo Sapiens
NQDRHVDVL

SEQ ID NO: 1293410 - protein, 9 aa, Homo Sapiens
SRMTSAVLL

SEQ ID NO: 1293411 - protein, 9 aa, Homo Sapiens
TQQRPPWRT

SEQ ID NO: 1293412 - protein, 9 aa, Homo Sapiens
SGLVDIMDI

SEQ ID NO: 1293413 - protein, 9 aa, Homo Sapiens
PPWRTSRGQ

SEQ ID NO: 1293414 - protein, 9 aa, Homo Sapiens
AEIAGCLGP

SEQ ID NO: 1293415 - protein, 9 aa, Homo Sapiens
AQRQCMFDE

SEQ ID NO: 1293416 - protein, 9 aa, Homo Sapiens
VSATDRDSS

SEQ ID NO: 1293417 - protein, 9 aa, Homo Sapiens
DGCTPLMIA

SEQ ID NO: 1293418 - protein, 9 aa, Homo Sapiens
YSHQKKLTV

SEQ ID NO: 1293419 - protein, 9 aa, Homo Sapiens
LVLCLHETV

SEQ ID NO: 1293420 - protein, 9 aa, Homo Sapiens
TGAAGAAAA

SEQ ID NO: 1293421 - protein, 9 aa, Homo Sapiens
LRGRARAGV

SEQ ID NO: 1293422 - protein, 9 aa, Homo Sapiens
SRSPSRHWR

SEQ ID NO: 1293423 - protein, 9 aa, Homo Sapiens
HARKRVITT

SEQ ID NO: 1293424 - protein, 9 aa, Homo Sapiens
KRCNPCCRL

SEQ ID NO: 1293425 - protein, 9 aa, Homo Sapiens
WSIPFSVFW

SEQ ID NO: 1293426 - protein, 9 aa, Homo Sapiens
DFAISKDDM

SEQ ID NO: 1293427 - protein, 9 aa, Homo Sapiens
RNMSWRPRA

SEQ ID NO: 1293428 - protein, 9 aa, Homo Sapiens
GGGVPLAPG

SEQ ID NO: 1293429 - protein, 9 aa, Homo Sapiens
TTGKNSRGP

SEQ ID NO: 1293430 - protein, 9 aa, Homo Sapiens
WSFCFSPLW

SEQ ID NO: 1293431 - protein, 9 aa, Homo Sapiens
DLQKLITTA

SEQ ID NO: 1293432 - protein, 9 aa, Homo Sapiens
VLGSQVIRS

SEQ ID NO: 1293433 - protein, 9 aa, Homo Sapiens
GPHAVSGCG

SEQ ID NO: 1293434 - protein, 9 aa, Homo Sapiens
TRHLSGYCG

SEQ ID NO: 1293435 - protein, 9 aa, Homo Sapiens
KASCSTAWS

SEQ ID NO: 1293436 - protein, 9 aa, Homo Sapiens
KHSPLLRPR

SEQ ID NO: 1293437 - protein, 9 aa, Homo Sapiens
KTRKASTQA

SEQ ID NO: 1293438 - protein, 9 aa, Homo Sapiens
RPKPNLDRL

SEQ ID NO: 1293439 - protein, 9 aa, Homo Sapiens
IRTSSFYCP

SEQ ID NO: 1293440 - protein, 9 aa, Homo Sapiens
SRSGADRSP

SEQ ID NO: 1293441 - protein, 9 aa, Homo Sapiens
KESDDNVKL

SEQ ID NO: 1293442 - protein, 9 aa, Homo Sapiens
GRGALLLFG

SEQ ID NO: 1293443 - protein, 9 aa, Homo Sapiens
NIPGKLTKN

SEQ ID NO: 1293444 - protein, 9 aa, Homo Sapiens
NGIQAKFFP

SEQ ID NO: 1293445 - protein, 9 aa, Homo Sapiens
RKIVDSKHF

SEQ ID NO: 1293446 - protein, 9 aa, Homo Sapiens
QGPTQRRSA

SEQ ID NO: 1293447 - protein, 9 aa, Homo Sapiens
EIAGCLGPF

SEQ ID NO: 1293448 - protein, 9 aa, Homo Sapiens
LQCTAISTN

SEQ ID NO: 1293449 - protein, 9 aa, Homo Sapiens
ARNMPPYSR

SEQ ID NO: 1293450 - protein, 9 aa, Homo Sapiens
TTADTTAEQ

SEQ ID NO: 1293451 - protein, 9 aa, Homo Sapiens
KGCGVGPHP

SEQ ID NO: 1293452 - protein, 9 aa, Homo Sapiens
SASTLARTG

SEQ ID NO: 1293453 - protein, 9 aa, Homo Sapiens
VPAFVQGVP

SEQ ID NO: 1293454 - protein, 9 aa, Homo Sapiens
PPNEEKGDV

SEQ ID NO: 1293455 - protein, 9 aa, Homo Sapiens
WWFDTCGLS

SEQ ID NO: 1293456 - protein, 9 aa, Homo Sapiens
STPRLPVPA

SEQ ID NO: 1293457 - protein, 9 aa, Homo Sapiens
QVYGEPPPK

SEQ ID NO: 1293458 - protein, 9 aa, Homo Sapiens
SNDPSTPAS

SEQ ID NO: 1293459 - protein, 9 aa, Homo Sapiens
RKKHGGSYS

SEQ ID NO: 1293460 - protein, 9 aa, Homo Sapiens
GLALQPAAL

SEQ ID NO: 1293461 - protein, 9 aa, Homo Sapiens
QKLLNCQRK

SEQ ID NO: 1293462 - protein, 9 aa, Homo Sapiens
SIMSLSVPL

SEQ ID NO: 1293463 - protein, 9 aa, Homo Sapiens
IIRIVMGPP

SEQ ID NO: 1293464 - protein, 9 aa, Homo Sapiens
KDLGAPDGI

SEQ ID NO: 1293465 - protein, 9 aa, Homo Sapiens
PRRLSFWST

SEQ ID NO: 1293466 - protein, 9 aa, Homo Sapiens
ARSWNTMQW

SEQ ID NO: 1293467 - protein, 9 aa, Homo Sapiens
MLYLSALWF

SEQ ID NO: 1293468 - protein, 9 aa, Homo Sapiens
VNLVLCLHE

SEQ ID NO: 1293469 - protein, 9 aa, Homo Sapiens
WKHSPLLRP

SEQ ID NO: 1293470 - protein, 9 aa, Homo Sapiens
GVCSARGGE

SEQ ID NO: 1293471 - protein, 9 aa, Homo Sapiens
HCPASRSSA

SEQ ID NO: 1293472 - protein, 9 aa, Homo Sapiens
QWSLARPQG

SEQ ID NO: 1293473 - protein, 9 aa, Homo Sapiens
LNKHTAFSC

SEQ ID NO: 1293474 - protein, 9 aa, Homo Sapiens
SMPWGSKMP

SEQ ID NO: 1293475 - protein, 9 aa, Homo Sapiens
HPAGGVHRA

SEQ ID NO: 1293476 - protein, 9 aa, Homo Sapiens
LQPACLQAT

SEQ ID NO: 1293477 - protein, 9 aa, Homo Sapiens
YMPHTFLLV

SEQ ID NO: 1293478 - protein, 9 aa, Homo Sapiens
LHGDVCTHS

SEQ ID NO: 1293479 - protein, 9 aa, Homo Sapiens
EELGGKRIL

SEQ ID NO: 1293480 - protein, 9 aa, Homo Sapiens
PSSSFRRAH

SEQ ID NO: 1293481 - protein, 9 aa, Homo Sapiens
GRPPGEKLS

SEQ ID NO: 1293482 - protein, 9 aa, Homo Sapiens
GEKQRSWTR

SEQ ID NO: 1293483 - protein, 9 aa, Homo Sapiens
AFNQSVELK

SEQ ID NO: 1293484 - protein, 9 aa, Homo Sapiens
PCSAPLSTW

SEQ ID NO: 1293485 - protein, 9 aa, Homo Sapiens
KKAEPSPSK

SEQ ID NO: 1293486 - protein, 9 aa, Homo Sapiens
GEPPPKKLE

SEQ ID NO: 1293487 - protein, 9 aa, Homo Sapiens
HPLTVLGVR

SEQ ID NO: 1293488 - protein, 9 aa, Homo Sapiens
ARTTAPPCT

SEQ ID NO: 1293489 - protein, 9 aa, Homo Sapiens
RPRTRTCPS

SEQ ID NO: 1293490 - protein, 9 aa, Homo Sapiens
GKASVYSPG

SEQ ID NO: 1293491 - protein, 9 aa, Homo Sapiens
RRLSANGDA

SEQ ID NO: 1293492 - protein, 9 aa, Homo Sapiens
EKVSKKRLP

SEQ ID NO: 1293493 - protein, 9 aa, Homo Sapiens
LVTQRALLV

SEQ ID NO: 1293494 - protein, 9 aa, Homo Sapiens
AATATAATS

SEQ ID NO: 1293495 - protein, 9 aa, Homo Sapiens
LKKCRLEAH

SEQ ID NO: 1293496 - protein, 9 aa, Homo Sapiens
NTLFFRCHS

SEQ ID NO: 1293497 - protein, 9 aa, Homo Sapiens
CLLQLGQIP

SEQ ID NO: 1293498 - protein, 9 aa, Homo Sapiens
KSQTIVVDV

SEQ ID NO: 1293499 - protein, 9 aa, Homo Sapiens
KGVTTTQWS

SEQ ID NO: 1293500 - protein, 9 aa, Homo Sapiens
SPSLFDAAD

SEQ ID NO: 1293501 - protein, 9 aa, Homo Sapiens
EPSPVNSHT

SEQ ID NO: 1293502 - protein, 9 aa, Homo Sapiens
GNTTGKNSR

SEQ ID NO: 1293503 - protein, 9 aa, Homo Sapiens
LFLIVDPYM

SEQ ID NO: 1293504 - protein, 9 aa, Homo Sapiens
DIYLISGSR

SEQ ID NO: 1293505 - protein, 9 aa, Homo Sapiens
QMEQKKITT

SEQ ID NO: 1293506 - protein, 9 aa, Homo Sapiens
ILQCTAIST

SEQ ID NO: 1293507 - protein, 9 aa, Homo Sapiens
LDPQDQACV

SEQ ID NO: 1293508 - protein, 9 aa, Homo Sapiens
ATYMNVNIR

SEQ ID NO: 1293509 - protein, 9 aa, Homo Sapiens
RSPSGCQGR

SEQ ID NO: 1293510 - protein, 9 aa, Homo Sapiens
DNVKLIVLD

SEQ ID NO: 1293511 - protein, 9 aa, Homo Sapiens
LWLMTAMWL

SEQ ID NO: 1293512 - protein, 9 aa, Homo Sapiens
STGLVAMLQ

SEQ ID NO: 1293513 - protein, 9 aa, Homo Sapiens
GDLHQAVSQ

SEQ ID NO: 1293514 - protein, 9 aa, Homo Sapiens
KPCFKGILV

SEQ ID NO: 1293515 - protein, 9 aa, Homo Sapiens
NAGIVTVGN

SEQ ID NO: 1293516 - protein, 9 aa, Homo Sapiens
AFMLAMQFS

SEQ ID NO: 1293517 - protein, 9 aa, Homo Sapiens
LTAKRMAQK

SEQ ID NO: 1293518 - protein, 9 aa, Homo Sapiens
CTSAASAPQ

SEQ ID NO: 1293519 - protein, 9 aa, Homo Sapiens
CPPLLEAFP

SEQ ID NO: 1293520 - protein, 9 aa, Homo Sapiens
KEVKENFEN

SEQ ID NO: 1293521 - protein, 9 aa, Homo Sapiens
SISHRSLLE

SEQ ID NO: 1293522 - protein, 9 aa, Homo Sapiens
FNQSVELKP

SEQ ID NO: 1293523 - protein, 9 aa, Homo Sapiens
SLQPQHTMR

SEQ ID NO: 1293524 - protein, 9 aa, Homo Sapiens
WSVRTGALG

SEQ ID NO: 1293525 - protein, 9 aa, Homo Sapiens
SSSEEARKP

SEQ ID NO: 1293526 - protein, 9 aa, Homo Sapiens
GRVWAAKGE

SEQ ID NO: 1293527 - protein, 9 aa, Homo Sapiens
KHGALPSGE

SEQ ID NO: 1293528 - protein, 9 aa, Homo Sapiens
GQISINKTF

SEQ ID NO: 1293529 - protein, 9 aa, Homo Sapiens
EGLLQEVEL

SEQ ID NO: 1293530 - protein, 9 aa, Homo Sapiens
GCPAGCWLS

SEQ ID NO: 1293531 - protein, 9 aa, Homo Sapiens
FFVLVNLEV

SEQ ID NO: 1293532 - protein, 9 aa, Homo Sapiens
GSLFTTGSS

SEQ ID NO: 1293533 - protein, 9 aa, Homo Sapiens
MLKKYAEVI

SEQ ID NO: 1293534 - protein, 9 aa, Homo Sapiens
EEEGIVVAM

SEQ ID NO: 1293535 - protein, 9 aa, Homo Sapiens
LIQNRSPTP

SEQ ID NO: 1293536 - protein, 9 aa, Homo Sapiens
GGCGFELDS

SEQ ID NO: 1293537 - protein, 9 aa, Homo Sapiens
APSEWAGSD

SEQ ID NO: 1293538 - protein, 9 aa, Homo Sapiens
GQLSWGGRG

SEQ ID NO: 1293539 - protein, 9 aa, Homo Sapiens
LTKNGLPVQ

SEQ ID NO: 1293540 - protein, 9 aa, Homo Sapiens
GEDHRADFW

SEQ ID NO: 1293541 - protein, 9 aa, Homo Sapiens
FHVATNTLP

SEQ ID NO: 1293542 - protein, 9 aa, Homo Sapiens
KVAQKLLNC

SEQ ID NO: 1293543 - protein, 9 aa, Homo Sapiens
LSQVLLPPE

SEQ ID NO: 1293544 - protein, 9 aa, Homo Sapiens
RCCDQPRHF

SEQ ID NO: 1293545 - protein, 9 aa, Homo Sapiens
QEKENLLPP

SEQ ID NO: 1293546 - protein, 9 aa, Homo Sapiens
VDKSWGDKL

SEQ ID NO: 1293547 - protein, 9 aa, Homo Sapiens
NNYRIFIKQ

SEQ ID NO: 1293548 - protein, 9 aa, Homo Sapiens
EARKPMVRL

SEQ ID NO: 1293549 - protein, 9 aa, Homo Sapiens
LLIPLPAPC

SEQ ID NO: 1293550 - protein, 9 aa, Homo Sapiens
ECQASGPQV

SEQ ID NO: 1293551 - protein, 9 aa, Homo Sapiens
DINRIQVEN

SEQ ID NO: 1293552 - protein, 9 aa, Homo Sapiens
SQMPGQPPP

SEQ ID NO: 1293553 - protein, 9 aa, Homo Sapiens
SIRRTSDNG

SEQ ID NO: 1293554 - protein, 9 aa, Homo Sapiens
KIIDLVSKC

SEQ ID NO: 1293555 - protein, 9 aa, Homo Sapiens
EAKILFFSI

SEQ ID NO: 1293556 - protein, 9 aa, Homo Sapiens
SNGAGRQAR

SEQ ID NO: 1293557 - protein, 9 aa, Homo Sapiens
QVRDHCRPR

SEQ ID NO: 1293558 - protein, 9 aa, Homo Sapiens
PATALNPRL

SEQ ID NO: 1293559 - protein, 9 aa, Homo Sapiens
SSSGSRRSP

SEQ ID NO: 1293560 - protein, 9 aa, Homo Sapiens
PGSVWILPC

SEQ ID NO: 1293561 - protein, 9 aa, Homo Sapiens
EIVAANPLF

SEQ ID NO: 1293562 - protein, 9 aa, Homo Sapiens
RVLPTNPEE

SEQ ID NO: 1293563 - protein, 9 aa, Homo Sapiens
VCQLQPACL

SEQ ID NO: 1293564 - protein, 9 aa, Homo Sapiens
PGSMSCWAL

SEQ ID NO: 1293565 - protein, 9 aa, Homo Sapiens
AQRGQPRLL

SEQ ID NO: 1293566 - protein, 9 aa, Homo Sapiens
SELCLEQNN

SEQ ID NO: 1293567 - protein, 9 aa, Homo Sapiens
PSATRCMGS

SEQ ID NO: 1293568 - protein, 9 aa, Homo Sapiens
RVLKNQELK

SEQ ID NO: 1293569 - protein, 9 aa, Homo Sapiens
LKECLHQLV

SEQ ID NO: 1293570 - protein, 9 aa, Homo Sapiens
LHQAVSQAS

SEQ ID NO: 1293571 - protein, 9 aa, Homo Sapiens
AGQPGPEYR

SEQ ID NO: 1293572 - protein, 9 aa, Homo Sapiens
CVGQRRFHT

SEQ ID NO: 1293573 - protein, 9 aa, Homo Sapiens
KKGSLVART

SEQ ID NO: 1293574 - protein, 9 aa, Homo Sapiens
PRRSPALRA

SEQ ID NO: 1293575 - protein, 9 aa, Homo Sapiens
KKIVYSHPK

SEQ ID NO: 1293576 - protein, 9 aa, Homo Sapiens
SLSVPLDYR

SEQ ID NO: 1293577 - protein, 9 aa, Homo Sapiens
AWSGSRGLP

SEQ ID NO: 1293578 - protein, 9 aa, Homo Sapiens
KEQQPRALA

SEQ ID NO: 1293579 - protein, 9 aa, Homo Sapiens
RSPTRCCRP

SEQ ID NO: 1293580 - protein, 9 aa, Homo Sapiens
RGFLLHQPL

SEQ ID NO: 1293581 - protein, 9 aa, Homo Sapiens
TPPHADPAA

SEQ ID NO: 1293582 - protein, 9 aa, Homo Sapiens
QCMFDENGE

SEQ ID NO: 1293583 - protein, 9 aa, Homo Sapiens
GRREQRARR

SEQ ID NO: 1293584 - protein, 9 aa, Homo Sapiens
SAVLLTVLI

SEQ ID NO: 1293585 - protein, 9 aa, Homo Sapiens
IQDVAEEEA

SEQ ID NO: 1293586 - protein, 9 aa, Homo Sapiens
AEVMLTYKQ

SEQ ID NO: 1293587 - protein, 9 aa, Homo Sapiens
VFVHRPWPA

SEQ ID NO: 1293588 - protein, 9 aa, Homo Sapiens
AGIVTVGNT

SEQ ID NO: 1293589 - protein, 9 aa, Homo Sapiens
LVICQLKSA

SEQ ID NO: 1293590 - protein, 9 aa, Homo Sapiens
AGVPPDRGC

SEQ ID NO: 1293591 - protein, 9 aa, Homo Sapiens
RFHCQQDHK

SEQ ID NO: 1293592 - protein, 9 aa, Homo Sapiens
LISSSFPET

SEQ ID NO: 1293593 - protein, 9 aa, Homo Sapiens
VRPSLEVCY

SEQ ID NO: 1293594 - protein, 9 aa, Homo Sapiens
EKQRSWTRS

SEQ ID NO: 1293595 - protein, 9 aa, Homo Sapiens
VAFIESDDA

SEQ ID NO: 1293596 - protein, 9 aa, Homo Sapiens
DIDGKNDIK

SEQ ID NO: 1293597 - protein, 9 aa, Homo Sapiens
LGQLVEGLL

SEQ ID NO: 1293598 - protein, 9 aa, Homo Sapiens
MYSTYAKLA

SEQ ID NO: 1293599 - protein, 9 aa, Homo Sapiens
AESSAEMLK

SEQ ID NO: 1293600 - protein, 9 aa, Homo Sapiens
LLLREHAPE

SEQ ID NO: 1293601 - protein, 9 aa, Homo Sapiens
VEYLKGGHR

SEQ ID NO: 1293602 - protein, 9 aa, Homo Sapiens
DVVGYVLQV

SEQ ID NO: 1293603 - protein, 9 aa, Homo Sapiens
RRLRLCYMA

SEQ ID NO: 1293604 - protein, 9 aa, Homo Sapiens
KCRQAGMWE

SEQ ID NO: 1293605 - protein, 9 aa, Homo Sapiens
LSVPAGILP

SEQ ID NO: 1293606 - protein, 9 aa, Homo Sapiens
NWILVDLAV

SEQ ID NO: 1293607 - protein, 9 aa, Homo Sapiens
VETRLEVSL

SEQ ID NO: 1293608 - protein, 9 aa, Homo Sapiens
VLEFRSFGD

SEQ ID NO: 1293609 - protein, 9 aa, Homo Sapiens
SQASELALC

SEQ ID NO: 1293610 - protein, 9 aa, Homo Sapiens
LEAFPLPRA

SEQ ID NO: 1293611 - protein, 9 aa, Homo Sapiens
SSERRQRSP

SEQ ID NO: 1293612 - protein, 9 aa, Homo Sapiens
VSVLHTLLH

SEQ ID NO: 1293613 - protein, 9 aa, Homo Sapiens
IARKIRKKM

SEQ ID NO: 1293614 - protein, 9 aa, Homo Sapiens
RCFQELQKL

SEQ ID NO: 1293615 - protein, 9 aa, Homo Sapiens
DLVSKCDGN

SEQ ID NO: 1293616 - protein, 9 aa, Homo Sapiens
SGPRLTPPH

SEQ ID NO: 1293617 - protein, 9 aa, Homo Sapiens
PPADLEGPG

SEQ ID NO: 1293618 - protein, 9 aa, Homo Sapiens
HRPAGHAGG

SEQ ID NO: 1293619 - protein, 9 aa, Homo Sapiens
LSLTDTDRE

SEQ ID NO: 1293620 - protein, 9 aa, Homo Sapiens
SHIPENPLQ

SEQ ID NO: 1293621 - protein, 9 aa, Homo Sapiens
GSNISKKVS

SEQ ID NO: 1293622 - protein, 9 aa, Homo Sapiens
CDAIDHLCH

SEQ ID NO: 1293623 - protein, 9 aa, Homo Sapiens
LQLLLHPHG

SEQ ID NO: 1293624 - protein, 9 aa, Homo Sapiens
CIDCFGLFS

SEQ ID NO: 1293625 - protein, 9 aa, Homo Sapiens
SHFPDSQEK

SEQ ID NO: 1293626 - protein, 9 aa, Homo Sapiens
NHAFNQSVE

SEQ ID NO: 1293627 - protein, 9 aa, Homo Sapiens
ERWPGRDSG

SEQ ID NO: 1293628 - protein, 9 aa, Homo Sapiens
STLTTVLNI

SEQ ID NO: 1293629 - protein, 9 aa, Homo Sapiens
NLASNDLPL

SEQ ID NO: 1293630 - protein, 9 aa, Homo Sapiens
VEEPLFFPS

SEQ ID NO: 1293631 - protein, 9 aa, Homo Sapiens
KELPGFLAH

SEQ ID NO: 1293632 - protein, 9 aa, Homo Sapiens
VPHSLLFRH

SEQ ID NO: 1293633 - protein, 9 aa, Homo Sapiens
SDGTLSPAR

SEQ ID NO: 1293634 - protein, 9 aa, Homo Sapiens
ELTRVRDAN

SEQ ID NO: 1293635 - protein, 9 aa, Homo Sapiens
DGWGAMALT

SEQ ID NO: 1293636 - protein, 9 aa, Homo Sapiens
PEPRNPDAR

SEQ ID NO: 1293637 - protein, 9 aa, Homo Sapiens
ISHRSLLES

SEQ ID NO: 1293638 - protein, 9 aa, Homo Sapiens
FTLESHGQG

SEQ ID NO: 1293639 - protein, 9 aa, Homo Sapiens
EKSRMTSAV

SEQ ID NO: 1293640 - protein, 9 aa, Homo Sapiens
NSDDIRDEK

SEQ ID NO: 1293641 - protein, 9 aa, Homo Sapiens
PGMLEQKQS

SEQ ID NO: 1293642 - protein, 9 aa, Homo Sapiens
VLIAEKRCR

SEQ ID NO: 1293643 - protein, 9 aa, Homo Sapiens
SKNCLCTLN

SEQ ID NO: 1293644 - protein, 9 aa, Homo Sapiens
QENASGRGT

SEQ ID NO: 1293645 - protein, 9 aa, Homo Sapiens
RFSGGSLFT

SEQ ID NO: 1293646 - protein, 9 aa, Homo Sapiens
PRHPHRSPP

SEQ ID NO: 1293647 - protein, 9 aa, Homo Sapiens
KPPTPCSSA

SEQ ID NO: 1293648 - protein, 9 aa, Homo Sapiens
VTHSEQAQP

SEQ ID NO: 1293649 - protein, 9 aa, Homo Sapiens
PVVINATDD

SEQ ID NO: 1293650 - protein, 9 aa, Homo Sapiens
LFWMVWSSR

SEQ ID NO: 1293651 - protein, 9 aa, Homo Sapiens
FSGLYQGMK

SEQ ID NO: 1293652 - protein, 9 aa, Homo Sapiens
QGMLYSLLQ

SEQ ID NO: 1293653 - protein, 9 aa, Homo Sapiens
GTCPCSAPL

SEQ ID NO: 1293654 - protein, 9 aa, Homo Sapiens
PATAPARRR

SEQ ID NO: 1293655 - protein, 9 aa, Homo Sapiens
TVEGRELQI

SEQ ID NO: 1293656 - protein, 9 aa, Homo Sapiens
ARAPAAVQR

SEQ ID NO: 1293657 - protein, 9 aa, Homo Sapiens
APAPGSPRL

SEQ ID NO: 1293658 - protein, 9 aa, Homo Sapiens
KCRWCQCLQ

SEQ ID NO: 1293659 - protein, 9 aa, Homo Sapiens
SQQIAGSKL

SEQ ID NO: 1293660 - protein, 9 aa, Homo Sapiens
VLGKASVYS

SEQ ID NO: 1293661 - protein, 9 aa, Homo Sapiens
FRHLKNTYV

SEQ ID NO: 1293662 - protein, 9 aa, Homo Sapiens
WPKSGLILT

SEQ ID NO: 1293663 - protein, 9 aa, Homo Sapiens
HHPEPPVPP

SEQ ID NO: 1293664 - protein, 9 aa, Homo Sapiens
DRFHVATNT

SEQ ID NO: 1293665 - protein, 9 aa, Homo Sapiens
QNRSPTPSE

SEQ ID NO: 1293666 - protein, 9 aa, Homo Sapiens
REIDHDRYS

SEQ ID NO: 1293667 - protein, 9 aa, Homo Sapiens
VFCDGDESD

SEQ ID NO: 1293668 - protein, 9 aa, Homo Sapiens
MYLFLVMLA

SEQ ID NO: 1293669 - protein, 9 aa, Homo Sapiens
IIRAAVSFL

SEQ ID NO: 1293670 - protein, 9 aa, Homo Sapiens
PLSTWSASY

SEQ ID NO: 1293671 - protein, 9 aa, Homo Sapiens
GGPLPLDQN

SEQ ID NO: 1293672 - protein, 9 aa, Homo Sapiens
SFRQGACVA

SEQ ID NO: 1293673 - protein, 9 aa, Homo Sapiens
RQGPAAWSS

SEQ ID NO: 1293674 - protein, 9 aa, Homo Sapiens
WAPQTAAPR

SEQ ID NO: 1293675 - protein, 9 aa, Homo Sapiens
GVRMKSVGI

SEQ ID NO: 1293676 - protein, 9 aa, Homo Sapiens
DNSPFMLYP

SEQ ID NO: 1293677 - protein, 9 aa, Homo Sapiens
SAEMLKVNQ

SEQ ID NO: 1293678 - protein, 9 aa, Homo Sapiens
HDLKDRYYS

SEQ ID NO: 1293679 - protein, 9 aa, Homo Sapiens
LLFEAWLLL

SEQ ID NO: 1293680 - protein, 9 aa, Homo Sapiens
LQRPGLSWT

SEQ ID NO: 1293681 - protein, 9 aa, Homo Sapiens
AGGVHRAGP

SEQ ID NO: 1293682 - protein, 9 aa, Homo Sapiens
PTPCSSART

SEQ ID NO: 1293683 - protein, 9 aa, Homo Sapiens
VWCLLSFSW

SEQ ID NO: 1293684 - protein, 9 aa, Homo Sapiens
VITTYQNIA

SEQ ID NO: 1293685 - protein, 9 aa, Homo Sapiens
LGKASVYSP

SEQ ID NO: 1293686 - protein, 9 aa, Homo Sapiens
NSGYNAWLS

SEQ ID NO: 1293687 - protein, 9 aa, Homo Sapiens
SEITRNVIQ

SEQ ID NO: 1293688 - protein, 9 aa, Homo Sapiens
AYPGGSPFL

SEQ ID NO: 1293689 - protein, 9 aa, Homo Sapiens
GGMSRTPPR

SEQ ID NO: 1293690 - protein, 9 aa, Homo Sapiens
RCLEHPNML

SEQ ID NO: 1293691 - protein, 9 aa, Homo Sapiens
DLLVICQLK

SEQ ID NO: 1293692 - protein, 9 aa, Homo Sapiens
IDGVKPPMP

SEQ ID NO: 1293693 - protein, 9 aa, Homo Sapiens
ILSVQKIFE

SEQ ID NO: 1293694 - protein, 9 aa, Homo Sapiens
PNCNSKCYL

SEQ ID NO: 1293695 - protein, 9 aa, Homo Sapiens
TQTQCGTMW

SEQ ID NO: 1293696 - protein, 9 aa, Homo Sapiens
LQEGRGEAI

SEQ ID NO: 1293697 - protein, 9 aa, Homo Sapiens
GRGSCGSRG

SEQ ID NO: 1293698 - protein, 9 aa, Homo Sapiens
ASSSTSRDS

SEQ ID NO: 1293699 - protein, 9 aa, Homo Sapiens
TSPVVTQRK

SEQ ID NO: 1293700 - protein, 9 aa, Homo Sapiens
VWVPHPLTV

SEQ ID NO: 1293701 - protein, 9 aa, Homo Sapiens
RVGHRHHRA

SEQ ID NO: 1293702 - protein, 9 aa, Homo Sapiens
LRASWSSWS

SEQ ID NO: 1293703 - protein, 9 aa, Homo Sapiens
VWKVVFGIN

SEQ ID NO: 1293704 - protein, 9 aa, Homo Sapiens
CLDIPAHPS

SEQ ID NO: 1293705 - protein, 9 aa, Homo Sapiens
LRLRLDRLL

SEQ ID NO: 1293706 - protein, 9 aa, Homo Sapiens
IYRSRVAYV

SEQ ID NO: 1293707 - protein, 9 aa, Homo Sapiens
PVTPPAWLV

SEQ ID NO: 1293708 - protein, 9 aa, Homo Sapiens
QPGPEYREA

SEQ ID NO: 1293709 - protein, 9 aa, Homo Sapiens
EAAHELWQL

SEQ ID NO: 1293710 - protein, 9 aa, Homo Sapiens
KKMLENRKS

SEQ ID NO: 1293711 - protein, 9 aa, Homo Sapiens
ITHLAEVCQ

SEQ ID NO: 1293712 - protein, 9 aa, Homo Sapiens
ESAKPVTPP

SEQ ID NO: 1293713 - protein, 9 aa, Homo Sapiens
WKRTQQRPP

SEQ ID NO: 1293714 - protein, 9 aa, Homo Sapiens
NPFRGLVKL

SEQ ID NO: 1293715 - protein, 9 aa, Homo Sapiens
GPPPSEGSH

SEQ ID NO: 1293716 - protein, 9 aa, Homo Sapiens
LTMESAKPV

SEQ ID NO: 1293717 - protein, 9 aa, Homo Sapiens
PQTFSGGCG

SEQ ID NO: 1293718 - protein, 9 aa, Homo Sapiens
AVQRLGRRE

SEQ ID NO: 1293719 - protein, 9 aa, Homo Sapiens
GFLLHQPLP

SEQ ID NO: 1293720 - protein, 9 aa, Homo Sapiens
AAVADGDVA

SEQ ID NO: 1293721 - protein, 9 aa, Homo Sapiens
PGANPTVQW

SEQ ID NO: 1293722 - protein, 9 aa, Homo Sapiens
LGGGRRGAP

SEQ ID NO: 1293723 - protein, 9 aa, Homo Sapiens
WLSCGSLCM

SEQ ID NO: 1293724 - protein, 9 aa, Homo Sapiens
QAVSQASEL

SEQ ID NO: 1293725 - protein, 9 aa, Homo Sapiens
ENTRLALCE

SEQ ID NO: 1293726 - protein, 9 aa, Homo Sapiens
RCLLAVEVS

SEQ ID NO: 1293727 - protein, 9 aa, Homo Sapiens
TAWSGSRGL

SEQ ID NO: 1293728 - protein, 9 aa, Homo Sapiens
TSVHDFKTE

SEQ ID NO: 1293729 - protein, 9 aa, Homo Sapiens
LHHQRVKLF

SEQ ID NO: 1293730 - protein, 9 aa, Homo Sapiens
TRCMGSRQW

SEQ ID NO: 1293731 - protein, 9 aa, Homo Sapiens
DIFFTAKRR

SEQ ID NO: 1293732 - protein, 9 aa, Homo Sapiens
GAQHQSAGD

SEQ ID NO: 1293733 - protein, 9 aa, Homo Sapiens
AVGLGDLHQ

SEQ ID NO: 1293734 - protein, 9 aa, Homo Sapiens
VGQKTARHK

SEQ ID NO: 1293735 - protein, 9 aa, Homo Sapiens
KVKIAVANA

SEQ ID NO: 1293736 - protein, 9 aa, Homo Sapiens
QRISVPVAR

SEQ ID NO: 1293737 - protein, 9 aa, Homo Sapiens
NIASVDLPN

SEQ ID NO: 1293738 - protein, 9 aa, Homo Sapiens
NQKEQTALY

SEQ ID NO: 1293739 - protein, 9 aa, Homo Sapiens
AAAAATAAT

SEQ ID NO: 1293740 - protein, 9 aa, Homo Sapiens
SRSLKSRDP

SEQ ID NO: 1293741 - protein, 9 aa, Homo Sapiens
RSSSAWAPQ

SEQ ID NO: 1293742 - protein, 9 aa, Homo Sapiens
PTKKRGKSQ

SEQ ID NO: 1293743 - protein, 9 aa, Homo Sapiens
LDALLSRMQ

SEQ ID NO: 1293744 - protein, 9 aa, Homo Sapiens
KKKILNCIW

SEQ ID NO: 1293745 - protein, 9 aa, Homo Sapiens
SQNGLRPVL

SEQ ID NO: 1293746 - protein, 9 aa, Homo Sapiens
LVNMGGNRS

SEQ ID NO: 1293747 - protein, 9 aa, Homo Sapiens
VVEYLKGGH

SEQ ID NO: 1293748 - protein, 9 aa, Homo Sapiens
RWKALLIPL

SEQ ID NO: 1293749 - protein, 9 aa, Homo Sapiens
RREREHHVE

SEQ ID NO: 1293750 - protein, 9 aa, Homo Sapiens
IHPGATTTA

SEQ ID NO: 1293751 - protein, 9 aa, Homo Sapiens
SPSVEPSQN

SEQ ID NO: 1293752 - protein, 9 aa, Homo Sapiens
LSADIQDYG

SEQ ID NO: 1293753 - protein, 9 aa, Homo Sapiens
FCLVLMLCL

SEQ ID NO: 1293754 - protein, 9 aa, Homo Sapiens
IPKETFSHL

SEQ ID NO: 1293755 - protein, 9 aa, Homo Sapiens
HPACARPKQ

SEQ ID NO: 1293756 - protein, 9 aa, Homo Sapiens
VLAMDVLHR

SEQ ID NO: 1293757 - protein, 9 aa, Homo Sapiens
PRPTVAFLP

SEQ ID NO: 1293758 - protein, 9 aa, Homo Sapiens
SSWTWCLPS

SEQ ID NO: 1293759 - protein, 9 aa, Homo Sapiens
THSVHSRVL

SEQ ID NO: 1293760 - protein, 9 aa, Homo Sapiens
GAFPVNTLQ

SEQ ID NO: 1293761 - protein, 9 aa, Homo Sapiens
WAPRHLGQA

SEQ ID NO: 1293762 - protein, 9 aa, Homo Sapiens
TLFFRCHSG

SEQ ID NO: 1293763 - protein, 9 aa, Homo Sapiens
DKKRGASSS

SEQ ID NO: 1293764 - protein, 9 aa, Homo Sapiens
KASVYSPGP

SEQ ID NO: 1293765 - protein, 9 aa, Homo Sapiens
KQVENMNIF

SEQ ID NO: 1293766 - protein, 9 aa, Homo Sapiens
VLGTALHGD

SEQ ID NO: 1293767 - protein, 9 aa, Homo Sapiens
IFRLYSRAV

SEQ ID NO: 1293768 - protein, 9 aa, Homo Sapiens
RMANEGFDL

SEQ ID NO: 1293769 - protein, 9 aa, Homo Sapiens
LVELRRRTD

SEQ ID NO: 1293770 - protein, 9 aa, Homo Sapiens
GLNIVRPSI

SEQ ID NO: 1293771 - protein, 9 aa, Homo Sapiens
TSTCLSPEP

SEQ ID NO: 1293772 - protein, 9 aa, Homo Sapiens
GQRRLSANG

SEQ ID NO: 1293773 - protein, 9 aa, Homo Sapiens
YCWTAQLRA

SEQ ID NO: 1293774 - protein, 9 aa, Homo Sapiens
QVAFIESDD

SEQ ID NO: 1293775 - protein, 9 aa, Homo Sapiens
LIAHAVVRA

SEQ ID NO: 1293776 - protein, 9 aa, Homo Sapiens
GRSMSYSSP

SEQ ID NO: 1293777 - protein, 9 aa, Homo Sapiens
DEFLMGGMS

SEQ ID NO: 1293778 - protein, 9 aa, Homo Sapiens
CGDVWWETR

SEQ ID NO: 1293779 - protein, 9 aa, Homo Sapiens
QQPWDSQMP

SEQ ID NO: 1293780 - protein, 9 aa, Homo Sapiens
SVTPATDKS

SEQ ID NO: 1293781 - protein, 9 aa, Homo Sapiens
SGNLPHPSA

SEQ ID NO: 1293782 - protein, 9 aa, Homo Sapiens
SMSGNVTIT

SEQ ID NO: 1293783 - protein, 9 aa, Homo Sapiens
TKCPRKRGA

SEQ ID NO: 1293784 - protein, 9 aa, Homo Sapiens
KVRAVDPNS

SEQ ID NO: 1293785 - protein, 9 aa, Homo Sapiens
GLSADIQDY

SEQ ID NO: 1293786 - protein, 9 aa, Homo Sapiens
AFLPPMHCP

SEQ ID NO: 1293787 - protein, 9 aa, Homo Sapiens
FLILLQSFF

SEQ ID NO: 1293788 - protein, 9 aa, Homo Sapiens
NMCKPRPLL

SEQ ID NO: 1293789 - protein, 9 aa, Homo Sapiens
RSSSERRQR

SEQ ID NO: 1293790 - protein, 9 aa, Homo Sapiens
SPYCITEFG

SEQ ID NO: 1293791 - protein, 9 aa, Homo Sapiens
LFFSIKHSI

SEQ ID NO: 1293792 - protein, 9 aa, Homo Sapiens
IHTTARTYE

SEQ ID NO: 1293793 - protein, 9 aa, Homo Sapiens
LTYTKVWKM

SEQ ID NO: 1293794 - protein, 9 aa, Homo Sapiens
PPPLARVRA

SEQ ID NO: 1293795 - protein, 9 aa, Homo Sapiens
WLDDVFCDG

SEQ ID NO: 1293796 - protein, 9 aa, Homo Sapiens
NLLRLQSLL

SEQ ID NO: 1293797 - protein, 9 aa, Homo Sapiens
SASSGNCCS

SEQ ID NO: 1293798 - protein, 9 aa, Homo Sapiens
NIAEDSSGP

SEQ ID NO: 1293799 - protein, 9 aa, Homo Sapiens
VEEEAIEHG

SEQ ID NO: 1293800 - protein, 9 aa, Homo Sapiens
GHVPHCPGA

SEQ ID NO: 1293801 - protein, 9 aa, Homo Sapiens
NIVVYHVIV

SEQ ID NO: 1293802 - protein, 9 aa, Homo Sapiens
INGIQAKFF

SEQ ID NO: 1293803 - protein, 9 aa, Homo Sapiens
VSRSGADRS

SEQ ID NO: 1293804 - protein, 9 aa, Homo Sapiens
PREVPPRFH

SEQ ID NO: 1293805 - protein, 9 aa, Homo Sapiens
WWWATVSIS

SEQ ID NO: 1293806 - protein, 9 aa, Homo Sapiens
VLSGILLLC

SEQ ID NO: 1293807 - protein, 9 aa, Homo Sapiens
MANEGFDLS

SEQ ID NO: 1293808 - protein, 9 aa, Homo Sapiens
GEREERSAR

SEQ ID NO: 1293809 - protein, 9 aa, Homo Sapiens
RSARLQREL

SEQ ID NO: 1293810 - protein, 9 aa, Homo Sapiens
NKKIVYSHP

SEQ ID NO: 1293811 - protein, 9 aa, Homo Sapiens
ANFHFQKDF

SEQ ID NO: 1293812 - protein, 9 aa, Homo Sapiens
ATDKSATPA

SEQ ID NO: 1293813 - protein, 9 aa, Homo Sapiens
PVNSHTQRS

SEQ ID NO: 1293814 - protein, 9 aa, Homo Sapiens
PRSNAGIVT

SEQ ID NO: 1293815 - protein, 9 aa, Homo Sapiens
EYNKLKECL

SEQ ID NO: 1293816 - protein, 9 aa, Homo Sapiens
PSHSQQIAG

SEQ ID NO: 1293817 - protein, 9 aa, Homo Sapiens
WWGNGWWGQ

SEQ ID NO: 1293818 - protein, 9 aa, Homo Sapiens
WSLLKSCSC

SEQ ID NO: 1293819 - protein, 9 aa, Homo Sapiens
IPSTPRYLR

SEQ ID NO: 1293820 - protein, 9 aa, Homo Sapiens
GSMEKSLGK

SEQ ID NO: 1293821 - protein, 9 aa, Homo Sapiens
LEHPNMLKF

SEQ ID NO: 1293822 - protein, 9 aa, Homo Sapiens
ARLVATPAL

SEQ ID NO: 1293823 - protein, 9 aa, Homo Sapiens
GEAAGAGPP

SEQ ID NO: 1293824 - protein, 9 aa, Homo Sapiens
SALRPAAAA

SEQ ID NO: 1293825 - protein, 9 aa, Homo Sapiens
NPSFLSVTI

SEQ ID NO: 1293826 - protein, 9 aa, Homo Sapiens
VPGSSPRGS

SEQ ID NO: 1293827 - protein, 9 aa, Homo Sapiens
VHHRTHIGE

SEQ ID NO: 1293828 - protein, 9 aa, Homo Sapiens
GLAVPWLEC

SEQ ID NO: 1293829 - protein, 9 aa, Homo Sapiens
QLEVLGLAL

SEQ ID NO: 1293830 - protein, 9 aa, Homo Sapiens
TVAVPTVTA

SEQ ID NO: 1293831 - protein, 9 aa, Homo Sapiens
SITYQSPSK

SEQ ID NO: 1293832 - protein, 9 aa, Homo Sapiens
ILQSQHILP

SEQ ID NO: 1293833 - protein, 9 aa, Homo Sapiens
AGVDVDQVL

SEQ ID NO: 1293834 - protein, 9 aa, Homo Sapiens
AGPAGQQVA

SEQ ID NO: 1293835 - protein, 9 aa, Homo Sapiens
LQIDTKPEV

SEQ ID NO: 1293836 - protein, 9 aa, Homo Sapiens
PSRAWQDVE

SEQ ID NO: 1293837 - protein, 9 aa, Homo Sapiens
KLITTADTT

SEQ ID NO: 1293838 - protein, 9 aa, Homo Sapiens
YRGGQRCRC

SEQ ID NO: 1293839 - protein, 9 aa, Homo Sapiens
KGQGHSGNL

SEQ ID NO: 1293840 - protein, 9 aa, Homo Sapiens
LYSLLQYMI

SEQ ID NO: 1293841 - protein, 9 aa, Homo Sapiens
ALGQVRDHC

SEQ ID NO: 1293842 - protein, 9 aa, Homo Sapiens
RGVRMKSVG

SEQ ID NO: 1293843 - protein, 9 aa, Homo Sapiens
QKQVENMNI

SEQ ID NO: 1293844 - protein, 9 aa, Homo Sapiens
HLLGQRRLS

SEQ ID NO: 1293845 - protein, 9 aa, Homo Sapiens
LNKGCGVGP

SEQ ID NO: 1293846 - protein, 9 aa, Homo Sapiens
IIWPKSGLI

SEQ ID NO: 1293847 - protein, 9 aa, Homo Sapiens
HRTLPAFTL

SEQ ID NO: 1293848 - protein, 9 aa, Homo Sapiens
TCLALDTCD

SEQ ID NO: 1293849 - protein, 9 aa, Homo Sapiens
GSCGSRGNR

SEQ ID NO: 1293850 - protein, 9 aa, Homo Sapiens
LNEASVLHD

SEQ ID NO: 1293851 - protein, 9 aa, Homo Sapiens
QEPSRLGGG

SEQ ID NO: 1293852 - protein, 9 aa, Homo Sapiens
LVVLSGILL

SEQ ID NO: 1293853 - protein, 9 aa, Homo Sapiens
PLDYRLEDN

SEQ ID NO: 1293854 - protein, 9 aa, Homo Sapiens
PKPNLDRLM

SEQ ID NO: 1293855 - protein, 9 aa, Homo Sapiens
GVLGMLGEG

SEQ ID NO: 1293856 - protein, 9 aa, Homo Sapiens
LEPVGQKTA

SEQ ID NO: 1293857 - protein, 9 aa, Homo Sapiens
DVDQVLCGG

SEQ ID NO: 1293858 - protein, 9 aa, Homo Sapiens
LLLDHPDHV

SEQ ID NO: 1293859 - protein, 9 aa, Homo Sapiens
HKRPGLMAN

SEQ ID NO: 1293860 - protein, 9 aa, Homo Sapiens
LRARGGTTI

SEQ ID NO: 1293861 - protein, 9 aa, Homo Sapiens
LSGGVTTTQ

SEQ ID NO: 1293862 - protein, 9 aa, Homo Sapiens
EPEEQEKEN

SEQ ID NO: 1293863 - protein, 9 aa, Homo Sapiens
CHIIEKKHV

SEQ ID NO: 1293864 - protein, 9 aa, Homo Sapiens
LHAAEQYTP

SEQ ID NO: 1293865 - protein, 9 aa, Homo Sapiens
LSFKNMCKP

SEQ ID NO: 1293866 - protein, 9 aa, Homo Sapiens
LQIVKPQEA

SEQ ID NO: 1293867 - protein, 9 aa, Homo Sapiens
DSQGPTQRR

SEQ ID NO: 1293868 - protein, 9 aa, Homo Sapiens
GGSGRSTPR

SEQ ID NO: 1293869 - protein, 9 aa, Homo Sapiens
CLVLMLCLH

SEQ ID NO: 1293870 - protein, 9 aa, Homo Sapiens
TDRDSSTNA

SEQ ID NO: 1293871 - protein, 9 aa, Homo Sapiens
QRCLHWSLM

SEQ ID NO: 1293872 - protein, 9 aa, Homo Sapiens
PQVLMMGHF

SEQ ID NO: 1293873 - protein, 9 aa, Homo Sapiens
YPGGSPFLF

SEQ ID NO: 1293874 - protein, 9 aa, Homo Sapiens
TWSENTRLA

SEQ ID NO: 1293875 - protein, 9 aa, Homo Sapiens
PQKLAYEKS

SEQ ID NO: 1293876 - protein, 9 aa, Homo Sapiens
KIRKKMLEN

SEQ ID NO: 1293877 - protein, 9 aa, Homo Sapiens
TLARTGFLY

SEQ ID NO: 1293878 - protein, 9 aa, Homo Sapiens
GGWWFDTCG

SEQ ID NO: 1293879 - protein, 9 aa, Homo Sapiens
SLTLGDSWL

SEQ ID NO: 1293880 - protein, 9 aa, Homo Sapiens
DTRVMYPVK

SEQ ID NO: 1293881 - protein, 9 aa, Homo Sapiens
KQRRRREKT

SEQ ID NO: 1293882 - protein, 9 aa, Homo Sapiens
LLRLLLREH

SEQ ID NO: 1293883 - protein, 9 aa, Homo Sapiens
QHELQVPQV

SEQ ID NO: 1293884 - protein, 9 aa, Homo Sapiens
ESHRGARRG

SEQ ID NO: 1293885 - protein, 9 aa, Homo Sapiens
QPSSSVWSS

SEQ ID NO: 1293886 - protein, 9 aa, Homo Sapiens
VCGRHLPGH

SEQ ID NO: 1293887 - protein, 9 aa, Homo Sapiens
RRPVVNLVL

SEQ ID NO: 1293888 - protein, 9 aa, Homo Sapiens
HIRLFGNSG

SEQ ID NO: 1293889 - protein, 9 aa, Homo Sapiens
SELERGVRM

SEQ ID NO: 1293890 - protein, 9 aa, Homo Sapiens
SPPHPVLLS

SEQ ID NO: 1293891 - protein, 9 aa, Homo Sapiens
LVERFTFVD

SEQ ID NO: 1293892 - protein, 9 aa, Homo Sapiens
RVQARWSVR

SEQ ID NO: 1293893 - protein, 9 aa, Homo Sapiens
TQCGTMWSW

SEQ ID NO: 1293894 - protein, 9 aa, Homo Sapiens
KEGNLIQNR

SEQ ID NO: 1293895 - protein, 9 aa, Homo Sapiens
ISALSYGGC

SEQ ID NO: 1293896 - protein, 9 aa, Homo Sapiens
NTELTRVRD

SEQ ID NO: 1293897 - protein, 9 aa, Homo Sapiens
SFFTSAHPS

SEQ ID NO: 1293898 - protein, 9 aa, Homo Sapiens
CPVGRGCCS

SEQ ID NO: 1293899 - protein, 9 aa, Homo Sapiens
EEAKILFFS

SEQ ID NO: 1293900 - protein, 9 aa, Homo Sapiens
FVPIHPVKE

SEQ ID NO: 1293901 - protein, 9 aa, Homo Sapiens
IWKVLHIRK

SEQ ID NO: 1293902 - protein, 9 aa, Homo Sapiens
CSNWVETRL

SEQ ID NO: 1293903 - protein, 9 aa, Homo Sapiens
SVHKSLGEL

SEQ ID NO: 1293904 - protein, 9 aa, Homo Sapiens
PLPPPQSSP

SEQ ID NO: 1293905 - protein, 9 aa, Homo Sapiens
FMLYPLQNG

SEQ ID NO: 1293906 - protein, 9 aa, Homo Sapiens
QRVYDALNV

SEQ ID NO: 1293907 - protein, 9 aa, Homo Sapiens
GGGVLGMLG

SEQ ID NO: 1293908 - protein, 9 aa, Homo Sapiens
PDSQGPTQR

SEQ ID NO: 1293909 - protein, 9 aa, Homo Sapiens
CHFSSSSSG

SEQ ID NO: 1293910 - protein, 9 aa, Homo Sapiens
LNIVRPSIG

SEQ ID NO: 1293911 - protein, 9 aa, Homo Sapiens
ANCEAAWSR

SEQ ID NO: 1293912 - protein, 9 aa, Homo Sapiens
SADDIKKAH

SEQ ID NO: 1293913 - protein, 9 aa, Homo Sapiens
KSVKTSTTQ

SEQ ID NO: 1293914 - protein, 9 aa, Homo Sapiens
LAARVVELQ

SEQ ID NO: 1293915 - protein, 9 aa, Homo Sapiens
IYNNTLHMP

SEQ ID NO: 1293916 - protein, 9 aa, Homo Sapiens
VFTVLEFRS

SEQ ID NO: 1293917 - protein, 9 aa, Homo Sapiens
TLVRQLLDP

SEQ ID NO: 1293918 - protein, 9 aa, Homo Sapiens
ASTMLYVSS

SEQ ID NO: 1293919 - protein, 9 aa, Homo Sapiens
WGDKLKINI

SEQ ID NO: 1293920 - protein, 9 aa, Homo Sapiens
ELGGKRILK

SEQ ID NO: 1293921 - protein, 9 aa, Homo Sapiens
DNGQFFRVT

SEQ ID NO: 1293922 - protein, 9 aa, Homo Sapiens
TEWHLHVHF

SEQ ID NO: 1293923 - protein, 9 aa, Homo Sapiens
LREIDHDRY

SEQ ID NO: 1293924 - protein, 9 aa, Homo Sapiens
VHRAGPPGG

SEQ ID NO: 1293925 - protein, 9 aa, Homo Sapiens
KTSELTVVN

SEQ ID NO: 1293926 - protein, 9 aa, Homo Sapiens
RIQVENPNS

SEQ ID NO: 1293927 - protein, 9 aa, Homo Sapiens
DPQDQACVP

SEQ ID NO: 1293928 - protein, 9 aa, Homo Sapiens
AISKDDMQE

SEQ ID NO: 1293929 - protein, 9 aa, Homo Sapiens
RLHPPSISH

SEQ ID NO: 1293930 - protein, 9 aa, Homo Sapiens
SCRSKGPMG

SEQ ID NO: 1293931 - protein, 9 aa, Homo Sapiens
PLDSSPLQL

SEQ ID NO: 1293932 - protein, 9 aa, Homo Sapiens
VTITNPSSS

SEQ ID NO: 1293933 - protein, 9 aa, Homo Sapiens
AAGKGAGAR

SEQ ID NO: 1293934 - protein, 9 aa, Homo Sapiens
HRGARRGQG

SEQ ID NO: 1293935 - protein, 9 aa, Homo Sapiens
ARSALRPAA

SEQ ID NO: 1293936 - protein, 9 aa, Homo Sapiens
PLDSNGIIT

SEQ ID NO: 1293937 - protein, 9 aa, Homo Sapiens
LSLERSRLT

SEQ ID NO: 1293938 - protein, 9 aa, Homo Sapiens
EPATCPAVV

SEQ ID NO: 1293939 - protein, 9 aa, Homo Sapiens
TLSPARTKC

SEQ ID NO: 1293940 - protein, 9 aa, Homo Sapiens
GKWPVNRRP

SEQ ID NO: 1293941 - protein, 9 aa, Homo Sapiens
TKPLSCKHL

SEQ ID NO: 1293942 - protein, 9 aa, Homo Sapiens
QGFGFLLQE

SEQ ID NO: 1293943 - protein, 9 aa, Homo Sapiens
CDGDEVVSI

SEQ ID NO: 1293944 - protein, 9 aa, Homo Sapiens
RGRGGPRLT

SEQ ID NO: 1293945 - protein, 9 aa, Homo Sapiens
CNQPQRPAV

SEQ ID NO: 1293946 - protein, 9 aa, Homo Sapiens
KGECQVKKV

SEQ ID NO: 1293947 - protein, 9 aa, Homo Sapiens
TGLMASKKD

SEQ ID NO: 1293948 - protein, 9 aa, Homo Sapiens
LSANGDARH

SEQ ID NO: 1293949 - protein, 9 aa, Homo Sapiens
FCCNYDHCP

SEQ ID NO: 1293950 - protein, 9 aa, Homo Sapiens
EPLFFPSAT

SEQ ID NO: 1293951 - protein, 9 aa, Homo Sapiens
PMSFSRRGG

SEQ ID NO: 1293952 - protein, 9 aa, Homo Sapiens
DVDPPGSVW

SEQ ID NO: 1293953 - protein, 9 aa, Homo Sapiens
GDSPWNKTQ

SEQ ID NO: 1293954 - protein, 9 aa, Homo Sapiens
QRWARGPGM

SEQ ID NO: 1293955 - protein, 9 aa, Homo Sapiens
ICQLKSALS

SEQ ID NO: 1293956 - protein, 9 aa, Homo Sapiens
GADVYSYDD

SEQ ID NO: 1293957 - protein, 9 aa, Homo Sapiens
DCIVENPQT

SEQ ID NO: 1293958 - protein, 9 aa, Homo Sapiens
KEPLDSNGI

SEQ ID NO: 1293959 - protein, 9 aa, Homo Sapiens
RWCQCLQFA

SEQ ID NO: 1293960 - protein, 9 aa, Homo Sapiens
EALVQAPDA

SEQ ID NO: 1293961 - protein, 9 aa, Homo Sapiens
PPLPPPEDE

SEQ ID NO: 1293962 - protein, 9 aa, Homo Sapiens
LLVHPAPRG

SEQ ID NO: 1293963 - protein, 9 aa, Homo Sapiens
ITFLEWKQE

SEQ ID NO: 1293964 - protein, 9 aa, Homo Sapiens
VVINATDDD

SEQ ID NO: 1293965 - protein, 9 aa, Homo Sapiens
NWKEPLDSN

SEQ ID NO: 1293966 - protein, 9 aa, Homo Sapiens
YVLQVLEVG

SEQ ID NO: 1293967 - protein, 9 aa, Homo Sapiens
RHKSRRLRL

SEQ ID NO: 1293968 - protein, 9 aa, Homo Sapiens
SELTVFGEA

SEQ ID NO: 1293969 - protein, 9 aa, Homo Sapiens
GTNILEGDR

SEQ ID NO: 1293970 - protein, 9 aa, Homo Sapiens
GVALRGTVG

SEQ ID NO: 1293971 - protein, 9 aa, Homo Sapiens
LRTMYNQDR

SEQ ID NO: 1293972 - protein, 9 aa, Homo Sapiens
CRSKGPMGV

SEQ ID NO: 1293973 - protein, 9 aa, Homo Sapiens
RWAPRHLGQ

SEQ ID NO: 1293974 - protein, 9 aa, Homo Sapiens
WKWQFDVWS

SEQ ID NO: 1293975 - protein, 9 aa, Homo Sapiens
VCPPGARNL

SEQ ID NO: 1293976 - protein, 9 aa, Homo Sapiens
TVEGHCFPA

SEQ ID NO: 1293977 - protein, 9 aa, Homo Sapiens
PHSLLFRHK

SEQ ID NO: 1293978 - protein, 9 aa, Homo Sapiens
ADLESILQT

SEQ ID NO: 1293979 - protein, 9 aa, Homo Sapiens
IIHDQIKHL

SEQ ID NO: 1293980 - protein, 9 aa, Homo Sapiens
GLEAVLPQA

SEQ ID NO: 1293981 - protein, 9 aa, Homo Sapiens
QAWYAKLGV

SEQ ID NO: 1293982 - protein, 9 aa, Homo Sapiens
QGQAHQDAG

SEQ ID NO: 1293983 - protein, 9 aa, Homo Sapiens
YMNVNIRDI

SEQ ID NO: 1293984 - protein, 9 aa, Homo Sapiens
GPASTMLYV

SEQ ID NO: 1293985 - protein, 9 aa, Homo Sapiens
EGLEAVLPQ

SEQ ID NO: 1293986 - protein, 9 aa, Homo Sapiens
GQLVEGLLQ

SEQ ID NO: 1293987 - protein, 9 aa, Homo Sapiens
MNGHIVGSK

SEQ ID NO: 1293988 - protein, 9 aa, Homo Sapiens
PSVEPSQNG

SEQ ID NO: 1293989 - protein, 9 aa, Homo Sapiens
PIHPVKERL

SEQ ID NO: 1293990 - protein, 9 aa, Homo Sapiens
ERKTTVSYT

SEQ ID NO: 1293991 - protein, 9 aa, Homo Sapiens
LASPAAPAV

SEQ ID NO: 1293992 - protein, 9 aa, Homo Sapiens
HEGHAAEVC

SEQ ID NO: 1293993 - protein, 9 aa, Homo Sapiens
ASRSSAACW

SEQ ID NO: 1293994 - protein, 9 aa, Homo Sapiens
RRRLQKRRQ

SEQ ID NO: 1293995 - protein, 9 aa, Homo Sapiens
WAPRCPRRL

SEQ ID NO: 1293996 - protein, 9 aa, Homo Sapiens
KASTQASLA

SEQ ID NO: 1293997 - protein, 9 aa, Homo Sapiens
CLEFRESFK

SEQ ID NO: 1293998 - protein, 9 aa, Homo Sapiens
FLATAVFTF

SEQ ID NO: 1293999 - protein, 9 aa, Homo Sapiens
PPPQSSPFL

SEQ ID NO: 1294000 - protein, 9 aa, Homo Sapiens
IYQIGVEDN

SEQ ID NO: 1294001 - protein, 9 aa, Homo Sapiens
SNPFRGLVK

SEQ ID NO: 1294002 - protein, 9 aa, Homo Sapiens
KEAKEVFPK

SEQ ID NO: 1294003 - protein, 9 aa, Homo Sapiens
TVMQGNMDT

SEQ ID NO: 1294004 - protein, 9 aa, Homo Sapiens
WKKINSAPL

SEQ ID NO: 1294005 - protein, 9 aa, Homo Sapiens
LILSSVLSE

SEQ ID NO: 1294006 - protein, 9 aa, Homo Sapiens
WKSIFRLYS

SEQ ID NO: 1294007 - protein, 9 aa, Homo Sapiens
LTKPLSCKH

SEQ ID NO: 1294008 - protein, 9 aa, Homo Sapiens
LTVPHSLLF

SEQ ID NO: 1294009 - protein, 9 aa, Homo Sapiens
QEPLHLVNP

SEQ ID NO: 1294010 - protein, 9 aa, Homo Sapiens
DYVHYIKPC

SEQ ID NO: 1294011 - protein, 9 aa, Homo Sapiens
HSLLFRHKS

SEQ ID NO: 1294012 - protein, 9 aa, Homo Sapiens
NDHIRLFGN

SEQ ID NO: 1294013 - protein, 9 aa, Homo Sapiens
ARGAARHHV

SEQ ID NO: 1294014 - protein, 9 aa, Homo Sapiens
STMGWCPRL

SEQ ID NO: 1294015 - protein, 9 aa, Homo Sapiens
LLSYPLVLK

SEQ ID NO: 1294016 - protein, 9 aa, Homo Sapiens
GQKTARHKF

SEQ ID NO: 1294017 - protein, 9 aa, Homo Sapiens
SKGQGHSGN

SEQ ID NO: 1294018 - protein, 9 aa, Homo Sapiens
HPPVVINAT

SEQ ID NO: 1294019 - protein, 9 aa, Homo Sapiens
TPALPTQQL

SEQ ID NO: 1294020 - protein, 9 aa, Homo Sapiens
ATALNPRLH

SEQ ID NO: 1294021 - protein, 9 aa, Homo Sapiens
SAVPPHVKR

SEQ ID NO: 1294022 - protein, 9 aa, Homo Sapiens
AKLGVWCLL

SEQ ID NO: 1294023 - protein, 9 aa, Homo Sapiens
VEGLLQEVE

SEQ ID NO: 1294024 - protein, 9 aa, Homo Sapiens
VKINQKSME

SEQ ID NO: 1294025 - protein, 9 aa, Homo Sapiens
SVELKPHVF

SEQ ID NO: 1294026 - protein, 9 aa, Homo Sapiens
LHVHNRVID

SEQ ID NO: 1294027 - protein, 9 aa, Homo Sapiens
FTVTLYLET

SEQ ID NO: 1294028 - protein, 9 aa, Homo Sapiens
DRQQQQGQA

SEQ ID NO: 1294029 - protein, 9 aa, Homo Sapiens
RGGPRLTHP

SEQ ID NO: 1294030 - protein, 9 aa, Homo Sapiens
PGPEYREAR

SEQ ID NO: 1294031 - protein, 9 aa, Homo Sapiens
ILGQRATRH

SEQ ID NO: 1294032 - protein, 9 aa, Homo Sapiens
LSPPHPVLL

SEQ ID NO: 1294033 - protein, 9 aa, Homo Sapiens
HEPMYLFLV

SEQ ID NO: 1294034 - protein, 9 aa, Homo Sapiens
DLVGDVLGS

SEQ ID NO: 1294035 - protein, 9 aa, Homo Sapiens
GGCFLAGVS

SEQ ID NO: 1294036 - protein, 9 aa, Homo Sapiens
GGFGGGQSS

SEQ ID NO: 1294037 - protein, 9 aa, Homo Sapiens
TADTTAEQR

SEQ ID NO: 1294038 - protein, 9 aa, Homo Sapiens
RGAARHHVE

SEQ ID NO: 1294039 - protein, 9 aa, Homo Sapiens
TNSGNERTI

SEQ ID NO: 1294040 - protein, 9 aa, Homo Sapiens
GVGPHPPWS

SEQ ID NO: 1294041 - protein, 9 aa, Homo Sapiens
GGHCQVHLF

SEQ ID NO: 1294042 - protein, 9 aa, Homo Sapiens
RRALTRTAM

SEQ ID NO: 1294043 - protein, 9 aa, Homo Sapiens
GMAVPRVQA

SEQ ID NO: 1294044 - protein, 9 aa, Homo Sapiens
QTIVVDVNL

SEQ ID NO: 1294045 - protein, 9 aa, Homo Sapiens
LNCQRKRRQ

SEQ ID NO: 1294046 - protein, 9 aa, Homo Sapiens
IPWTQIPQG

SEQ ID NO: 1294047 - protein, 9 aa, Homo Sapiens
WHPGRRRAR

SEQ ID NO: 1294048 - protein, 9 aa, Homo Sapiens
ALILSSVLS

SEQ ID NO: 1294049 - protein, 9 aa, Homo Sapiens
GWQQSWEIV

SEQ ID NO: 1294050 - protein, 9 aa, Homo Sapiens
SLEVCYLTS

SEQ ID NO: 1294051 - protein, 9 aa, Homo Sapiens
DFLKQLRPE

SEQ ID NO: 1294052 - protein, 9 aa, Homo Sapiens
DRLLPAAEP

SEQ ID NO: 1294053 - protein, 9 aa, Homo Sapiens
MLDLQGPPC

SEQ ID NO: 1294054 - protein, 9 aa, Homo Sapiens
EAAGAGPPA

SEQ ID NO: 1294055 - protein, 9 aa, Homo Sapiens
LGMLGEGGI

SEQ ID NO: 1294056 - protein, 9 aa, Homo Sapiens
RKDCDEHGL

SEQ ID NO: 1294057 - protein, 9 aa, Homo Sapiens
HLWLSHRLR

SEQ ID NO: 1294058 - protein, 9 aa, Homo Sapiens
PTVTAFPNT

SEQ ID NO: 1294059 - protein, 9 aa, Homo Sapiens
SSPLQLLLH

SEQ ID NO: 1294060 - protein, 9 aa, Homo Sapiens
MSRTPPRRV

SEQ ID NO: 1294061 - protein, 9 aa, Homo Sapiens
TSIRNLSQS

SEQ ID NO: 1294062 - protein, 9 aa, Homo Sapiens
ISDLSISYE

SEQ ID NO: 1294063 - protein, 9 aa, Homo Sapiens
KIAVANAQE

SEQ ID NO: 1294064 - protein, 9 aa, Homo Sapiens
VDLAVADLA

SEQ ID NO: 1294065 - protein, 9 aa, Homo Sapiens
GAAGVGKSA

SEQ ID NO: 1294066 - protein, 9 aa, Homo Sapiens
VIDTNDNRT

SEQ ID NO: 1294067 - protein, 9 aa, Homo Sapiens
PWDSQMPGQ

SEQ ID NO: 1294068 - protein, 9 aa, Homo Sapiens
LAKPLLSYP

SEQ ID NO: 1294069 - protein, 9 aa, Homo Sapiens
NHQEPVNFI

SEQ ID NO: 1294070 - protein, 9 aa, Homo Sapiens
QEVELEVIA

SEQ ID NO: 1294071 - protein, 9 aa, Homo Sapiens
AALGEVVGQ

SEQ ID NO: 1294072 - protein, 9 aa, Homo Sapiens
PAGGVHRAG

SEQ ID NO: 1294073 - protein, 9 aa, Homo Sapiens
TLEGEKTSE

SEQ ID NO: 1294074 - protein, 9 aa, Homo Sapiens
WPRALYCWT

SEQ ID NO: 1294075 - protein, 9 aa, Homo Sapiens
HGALPSGEL

SEQ ID NO: 1294076 - protein, 9 aa, Homo Sapiens
ITWSENTRL

SEQ ID NO: 1294077 - protein, 9 aa, Homo Sapiens
HVHNRVIDV

SEQ ID NO: 1294078 - protein, 9 aa, Homo Sapiens
KRRQGPAAW

SEQ ID NO: 1294079 - protein, 9 aa, Homo Sapiens
MSCWALAPA

SEQ ID NO: 1294080 - protein, 9 aa, Homo Sapiens
SRPVCCPRA

SEQ ID NO: 1294081 - protein, 9 aa, Homo Sapiens
LNQTLKKEK

SEQ ID NO: 1294082 - protein, 9 aa, Homo Sapiens
CNPCCRLTW

SEQ ID NO: 1294083 - protein, 9 aa, Homo Sapiens
LYLQTRVLH

SEQ ID NO: 1294084 - protein, 9 aa, Homo Sapiens
ATLPCRRHC

SEQ ID NO: 1294085 - protein, 9 aa, Homo Sapiens
APGHPGVGP

SEQ ID NO: 1294086 - protein, 9 aa, Homo Sapiens
VAVPTVTAF

SEQ ID NO: 1294087 - protein, 9 aa, Homo Sapiens
QALCCQARA

SEQ ID NO: 1294088 - protein, 9 aa, Homo Sapiens
PPPPPLARV

SEQ ID NO: 1294089 - protein, 9 aa, Homo Sapiens
NGAPGCDGR

SEQ ID NO: 1294090 - protein, 9 aa, Homo Sapiens
ISRDNNNIS

SEQ ID NO: 1294091 - protein, 9 aa, Homo Sapiens
SSPFLARSW

SEQ ID NO: 1294092 - protein, 9 aa, Homo Sapiens
RAQRQCMFD

SEQ ID NO: 1294093 - protein, 9 aa, Homo Sapiens
HAYPGGSPF

SEQ ID NO: 1294094 - protein, 9 aa, Homo Sapiens
ERMILLMER

SEQ ID NO: 1294095 - protein, 9 aa, Homo Sapiens
ASKGQGHSG

SEQ ID NO: 1294096 - protein, 9 aa, Homo Sapiens
KNGVKFNVG

SEQ ID NO: 1294097 - protein, 9 aa, Homo Sapiens
GGGCFLAGV

SEQ ID NO: 1294098 - protein, 9 aa, Homo Sapiens
VPQVIQDVA

SEQ ID NO: 1294099 - protein, 9 aa, Homo Sapiens
RAPAQPPGP

SEQ ID NO: 1294100 - protein, 9 aa, Homo Sapiens
TRSLTLGDS

SEQ ID NO: 1294101 - protein, 9 aa, Homo Sapiens
RSPAQPTMP

SEQ ID NO: 1294102 - protein, 9 aa, Homo Sapiens
EDLVGDVLG

SEQ ID NO: 1294103 - protein, 9 aa, Homo Sapiens
PSTRTTATC

SEQ ID NO: 1294104 - protein, 9 aa, Homo Sapiens
GETPPSVET

SEQ ID NO: 1294105 - protein, 9 aa, Homo Sapiens
QQPAGARAS

SEQ ID NO: 1294106 - protein, 9 aa, Homo Sapiens
LSSFLIFFI

SEQ ID NO: 1294107 - protein, 9 aa, Homo Sapiens
GGGRRGAPG

SEQ ID NO: 1294108 - protein, 9 aa, Homo Sapiens
QTRVLHKNK

SEQ ID NO: 1294109 - protein, 9 aa, Homo Sapiens
ERWLRGGRR

SEQ ID NO: 1294110 - protein, 9 aa, Homo Sapiens
TRLALCEHP

SEQ ID NO: 1294111 - protein, 9 aa, Homo Sapiens
VDCLQAFWD

SEQ ID NO: 1294112 - protein, 9 aa, Homo Sapiens
PAKPSPGAR

SEQ ID NO: 1294113 - protein, 9 aa, Homo Sapiens
KMADFGLSR

SEQ ID NO: 1294114 - protein, 9 aa, Homo Sapiens
GPQVLMMGH

SEQ ID NO: 1294115 - protein, 9 aa, Homo Sapiens
YSSPKAQPG

SEQ ID NO: 1294116 - protein, 9 aa, Homo Sapiens
DCKWSSCLT

SEQ ID NO: 1294117 - protein, 9 aa, Homo Sapiens
QKLDTILNP

SEQ ID NO: 1294118 - protein, 9 aa, Homo Sapiens
LGAPDGIGS

SEQ ID NO: 1294119 - protein, 9 aa, Homo Sapiens
LCGKKEDML

SEQ ID NO: 1294120 - protein, 9 aa, Homo Sapiens
MSLSVPLDY

SEQ ID NO: 1294121 - protein, 9 aa, Homo Sapiens
KLTYTKVWK

SEQ ID NO: 1294122 - protein, 9 aa, Homo Sapiens
KILCATYMN

SEQ ID NO: 1294123 - protein, 9 aa, Homo Sapiens
PGHVHLAPH

SEQ ID NO: 1294124 - protein, 9 aa, Homo Sapiens
RQARPDGTP

SEQ ID NO: 1294125 - protein, 9 aa, Homo Sapiens
TTVSYTKIM

SEQ ID NO: 1294126 - protein, 9 aa, Homo Sapiens
LPPPQSSPF

SEQ ID NO: 1294127 - protein, 9 aa, Homo Sapiens
WAPAPGSPR

SEQ ID NO: 1294128 - protein, 9 aa, Homo Sapiens
SAPCWAPAP

SEQ ID NO: 1294129 - protein, 9 aa, Homo Sapiens
IAKRHRLSS

SEQ ID NO: 1294130 - protein, 9 aa, Homo Sapiens
REHHVEAAQ

SEQ ID NO: 1294131 - protein, 9 aa, Homo Sapiens
GRSSMEGEK

SEQ ID NO: 1294132 - protein, 9 aa, Homo Sapiens
PRGRRPRAG

SEQ ID NO: 1294133 - protein, 9 aa, Homo Sapiens
MFQDFNDPS

SEQ ID NO: 1294134 - protein, 9 aa, Homo Sapiens
AGAQRGQPR

SEQ ID NO: 1294135 - protein, 9 aa, Homo Sapiens
VRPLVERFT

SEQ ID NO: 1294136 - protein, 9 aa, Homo Sapiens
LTWASPLAS

SEQ ID NO: 1294137 - protein, 9 aa, Homo Sapiens
RPRRAWKHS

SEQ ID NO: 1294138 - protein, 9 aa, Homo Sapiens
CESTALIQH

SEQ ID NO: 1294139 - protein, 9 aa, Homo Sapiens
TKRRLSSPT

SEQ ID NO: 1294140 - protein, 9 aa, Homo Sapiens
MPPYSRKNT

SEQ ID NO: 1294141 - protein, 9 aa, Homo Sapiens
TQIPQGCLP

SEQ ID NO: 1294142 - protein, 9 aa, Homo Sapiens
PARTKCPRK

SEQ ID NO: 1294143 - protein, 9 aa, Homo Sapiens
EVCYLTSAL

SEQ ID NO: 1294144 - protein, 9 aa, Homo Sapiens
VKVKIAVAN

SEQ ID NO: 1294145 - protein, 9 aa, Homo Sapiens
LQGNRLMVL

SEQ ID NO: 1294146 - protein, 9 aa, Homo Sapiens
ENQKEQTAL

SEQ ID NO: 1294147 - protein, 9 aa, Homo Sapiens
CGRVDTATP

SEQ ID NO: 1294148 - protein, 9 aa, Homo Sapiens
RGTVGVPAF

SEQ ID NO: 1294149 - protein, 9 aa, Homo Sapiens
VAVVTFVPV

SEQ ID NO: 1294150 - protein, 9 aa, Homo Sapiens
PAASAPCWA

SEQ ID NO: 1294151 - protein, 9 aa, Homo Sapiens
LKKTKDGNG

SEQ ID NO: 1294152 - protein, 9 aa, Homo Sapiens
FPIVHIFVI

SEQ ID NO: 1294153 - protein, 9 aa, Homo Sapiens
WWHPGRRRA

SEQ ID NO: 1294154 - protein, 9 aa, Homo Sapiens
VPLAPGESH

SEQ ID NO: 1294155 - protein, 9 aa, Homo Sapiens
PFVEEIKGE

SEQ ID NO: 1294156 - protein, 9 aa, Homo Sapiens
PELYVDKSW

SEQ ID NO: 1294157 - protein, 9 aa, Homo Sapiens
RLLLREHAP

SEQ ID NO: 1294158 - protein, 9 aa, Homo Sapiens
ETDVFVVRT

SEQ ID NO: 1294159 - protein, 9 aa, Homo Sapiens
APPSPKPPT

SEQ ID NO: 1294160 - protein, 9 aa, Homo Sapiens
HGPYPAASA

SEQ ID NO: 1294161 - protein, 9 aa, Homo Sapiens
EPDSQGPTQ

SEQ ID NO: 1294162 - protein, 9 aa, Homo Sapiens
LFRHKSRRL

SEQ ID NO: 1294163 - protein, 9 aa, Homo Sapiens
RGRELWQVP

SEQ ID NO: 1294164 - protein, 9 aa, Homo Sapiens
AHPSRPCRM

SEQ ID NO: 1294165 - protein, 9 aa, Homo Sapiens
QRCRCVCLR

SEQ ID NO: 1294166 - protein, 9 aa, Homo Sapiens
GPEYREARG

SEQ ID NO: 1294167 - protein, 9 aa, Homo Sapiens
RRHCPRCPA

SEQ ID NO: 1294168 - protein, 9 aa, Homo Sapiens
WLCGDVWWE

SEQ ID NO: 1294169 - protein, 9 aa, Homo Sapiens
RKASTQASL

SEQ ID NO: 1294170 - protein, 9 aa, Homo Sapiens
AKRRKPCLC

SEQ ID NO: 1294171 - protein, 9 aa, Homo Sapiens
VATTSEIVL

SEQ ID NO: 1294172 - protein, 9 aa, Homo Sapiens
ITYISALSY

SEQ ID NO: 1294173 - protein, 9 aa, Homo Sapiens
HHHPEPPVP

SEQ ID NO: 1294174 - protein, 9 aa, Homo Sapiens
ESTKRRLSS

SEQ ID NO: 1294175 - protein, 9 aa, Homo Sapiens
QKTARHKFE

SEQ ID NO: 1294176 - protein, 9 aa, Homo Sapiens
PHPAGGVHR

SEQ ID NO: 1294177 - protein, 9 aa, Homo Sapiens
VVGAAGVGK

SEQ ID NO: 1294178 - protein, 9 aa, Homo Sapiens
LRGISGMRT

SEQ ID NO: 1294179 - protein, 9 aa, Homo Sapiens
LVLALVGAA

SEQ ID NO: 1294180 - protein, 9 aa, Homo Sapiens
RGPQRDGSY

SEQ ID NO: 1294181 - protein, 9 aa, Homo Sapiens
RVLDAEPPR

SEQ ID NO: 1294182 - protein, 9 aa, Homo Sapiens
KKEDKECKK

SEQ ID NO: 1294183 - protein, 9 aa, Homo Sapiens
AGKRVLCGF

SEQ ID NO: 1294184 - protein, 9 aa, Homo Sapiens
VLCIGLTGT

SEQ ID NO: 1294185 - protein, 9 aa, Homo Sapiens
DMDFTLLVQ

SEQ ID NO: 1294186 - protein, 9 aa, Homo Sapiens
QLALQKEEE

SEQ ID NO: 1294187 - protein, 9 aa, Homo Sapiens
LVWVPHPLT

SEQ ID NO: 1294188 - protein, 9 aa, Homo Sapiens
LIVDPYMRV

SEQ ID NO: 1294189 - protein, 9 aa, Homo Sapiens
LCMLGCIAG

SEQ ID NO: 1294190 - protein, 9 aa, Homo Sapiens
EERSARLQR

SEQ ID NO: 1294191 - protein, 9 aa, Homo Sapiens
SGCGRAPAQ

SEQ ID NO: 1294192 - protein, 9 aa, Homo Sapiens
LYKEGGRDF

SEQ ID NO: 1294193 - protein, 9 aa, Homo Sapiens
NKYRSLREI

SEQ ID NO: 1294194 - protein, 9 aa, Homo Sapiens
SVEPSQNGL

SEQ ID NO: 1294195 - protein, 9 aa, Homo Sapiens
PNLDRLMGA

SEQ ID NO: 1294196 - protein, 9 aa, Homo Sapiens
IPAHPSIRI

SEQ ID NO: 1294197 - protein, 9 aa, Homo Sapiens
EPGWQPAEP

SEQ ID NO: 1294198 - protein, 9 aa, Homo Sapiens
FWSTIYGSR

SEQ ID NO: 1294199 - protein, 9 aa, Homo Sapiens
EFMSPSPYT

SEQ ID NO: 1294200 - protein, 9 aa, Homo Sapiens
GAAAAAAQR

SEQ ID NO: 1294201 - protein, 9 aa, Homo Sapiens
PRLHPPSIS

SEQ ID NO: 1294202 - protein, 9 aa, Homo Sapiens
ELTVFGEAA

SEQ ID NO: 1294203 - protein, 9 aa, Homo Sapiens
HAGQVYGEP

SEQ ID NO: 1294204 - protein, 9 aa, Homo Sapiens
SLWSLLKSC

SEQ ID NO: 1294205 - protein, 9 aa, Homo Sapiens
TPATDKSAT

SEQ ID NO: 1294206 - protein, 9 aa, Homo Sapiens
LTGTGKTLT

SEQ ID NO: 1294207 - protein, 9 aa, Homo Sapiens
NDGCTPLMI

SEQ ID NO: 1294208 - protein, 9 aa, Homo Sapiens
LPHPGAPHP

SEQ ID NO: 1294209 - protein, 9 aa, Homo Sapiens
GACVATGSE

SEQ ID NO: 1294210 - protein, 9 aa, Homo Sapiens
NDADTFEDK

SEQ ID NO: 1294211 - protein, 9 aa, Homo Sapiens
TGITAAPLP

SEQ ID NO: 1294212 - protein, 9 aa, Homo Sapiens
NNHGSSITK

SEQ ID NO: 1294213 - protein, 9 aa, Homo Sapiens
PDSQEKMDP

SEQ ID NO: 1294214 - protein, 9 aa, Homo Sapiens
RRPMFDFQG

SEQ ID NO: 1294215 - protein, 9 aa, Homo Sapiens
VTLIECECS

SEQ ID NO: 1294216 - protein, 9 aa, Homo Sapiens
RDCKSEECS

SEQ ID NO: 1294217 - protein, 9 aa, Homo Sapiens
GTPCSHQGL

SEQ ID NO: 1294218 - protein, 9 aa, Homo Sapiens
ASNARGQLS

SEQ ID NO: 1294219 - protein, 9 aa, Homo Sapiens
QLLRLLLRE

SEQ ID NO: 1294220 - protein, 9 aa, Homo Sapiens
VTWTQTQCG

SEQ ID NO: 1294221 - protein, 9 aa, Homo Sapiens
PGQSSGAQH

SEQ ID NO: 1294222 - protein, 9 aa, Homo Sapiens
EHGLTCGST

SEQ ID NO: 1294223 - protein, 9 aa, Homo Sapiens
KRCRISTEE

SEQ ID NO: 1294224 - protein, 9 aa, Homo Sapiens
LHVHFVNFE

SEQ ID NO: 1294225 - protein, 9 aa, Homo Sapiens
SEEARKPMV

SEQ ID NO: 1294226 - protein, 9 aa, Homo Sapiens
PWWHPGRRR

SEQ ID NO: 1294227 - protein, 9 aa, Homo Sapiens
EASVLHDLK

SEQ ID NO: 1294228 - protein, 9 aa, Homo Sapiens
ATGLHLHRQ

SEQ ID NO: 1294229 - protein, 9 aa, Homo Sapiens
SADIQDYGL

SEQ ID NO: 1294230 - protein, 9 aa, Homo Sapiens
AKVRAVDPN

SEQ ID NO: 1294231 - protein, 9 aa, Homo Sapiens
GALIAHAVV

SEQ ID NO: 1294232 - protein, 9 aa, Homo Sapiens
KKRGASSST

SEQ ID NO: 1294233 - protein, 9 aa, Homo Sapiens
ELDWVAETK

SEQ ID NO: 1294234 - protein, 9 aa, Homo Sapiens
LGLPAQDTP

SEQ ID NO: 1294235 - protein, 9 aa, Homo Sapiens
RNDADTFED

SEQ ID NO: 1294236 - protein, 9 aa, Homo Sapiens
EDTRARACA

SEQ ID NO: 1294237 - protein, 9 aa, Homo Sapiens
APGHVHLAP

SEQ ID NO: 1294238 - protein, 9 aa, Homo Sapiens
TAFPNTSST

SEQ ID NO: 1294239 - protein, 9 aa, Homo Sapiens
EGGRDFLQR

SEQ ID NO: 1294240 - protein, 9 aa, Homo Sapiens
GPPGGGCWA

SEQ ID NO: 1294241 - protein, 9 aa, Homo Sapiens
LHPHGKRCN

SEQ ID NO: 1294242 - protein, 9 aa, Homo Sapiens
LLEALFLIV

SEQ ID NO: 1294243 - protein, 9 aa, Homo Sapiens
PFLARSWNT

SEQ ID NO: 1294244 - protein, 9 aa, Homo Sapiens
RISNLFNIL

SEQ ID NO: 1294245 - protein, 9 aa, Homo Sapiens
SQTYVDPFA

SEQ ID NO: 1294246 - protein, 9 aa, Homo Sapiens
QISINKTFK

SEQ ID NO: 1294247 - protein, 9 aa, Homo Sapiens
CSKNCLCTL

SEQ ID NO: 1294248 - protein, 9 aa, Homo Sapiens
ALLLFGLRV

SEQ ID NO: 1294249 - protein, 9 aa, Homo Sapiens
LALVGAAGK

SEQ ID NO: 1294250 - protein, 9 aa, Homo Sapiens
SLREIDHDR

SEQ ID NO: 1294251 - protein, 9 aa, Homo Sapiens
ISQHSGRQW

SEQ ID NO: 1294252 - protein, 9 aa, Homo Sapiens
NPRLHPPSI

SEQ ID NO: 1294253 - protein, 9 aa, Homo Sapiens
LHNKKEGNL

SEQ ID NO: 1294254 - protein, 9 aa, Homo Sapiens
MEGGVLLPA

SEQ ID NO: 1294255 - protein, 9 aa, Homo Sapiens
ARKIRKKML

SEQ ID NO: 1294256 - protein, 9 aa, Homo Sapiens
VGLQLVVVI

SEQ ID NO: 1294257 - protein, 9 aa, Homo Sapiens
RFYDSLESI

SEQ ID NO: 1294258 - protein, 9 aa, Homo Sapiens
HPDHVLLTF

SEQ ID NO: 1294259 - protein, 9 aa, Homo Sapiens
PAGHAGGGD

SEQ ID NO: 1294260 - protein, 9 aa, Homo Sapiens
PKSGLILTA

SEQ ID NO: 1294261 - protein, 9 aa, Homo Sapiens
SKGPMGVLL

SEQ ID NO: 1294262 - protein, 9 aa, Homo Sapiens
KLTVPHSLL

SEQ ID NO: 1294263 - protein, 9 aa, Homo Sapiens
VRGATSYRC

SEQ ID NO: 1294264 - protein, 9 aa, Homo Sapiens
MEQKKITTR

SEQ ID NO: 1294265 - protein, 9 aa, Homo Sapiens
LGQRATRHG

SEQ ID NO: 1294266 - protein, 9 aa, Homo Sapiens
IRVFCCNYD

SEQ ID NO: 1294267 - protein, 9 aa, Homo Sapiens
VEEQVAVVT

SEQ ID NO: 1294268 - protein, 9 aa, Homo Sapiens
GQGAVQQPA

SEQ ID NO: 1294269 - protein, 9 aa, Homo Sapiens
KRRLSSPTR

SEQ ID NO: 1294270 - protein, 9 aa, Homo Sapiens
VAFLPPMHC

SEQ ID NO: 1294271 - protein, 9 aa, Homo Sapiens
GRGAPRHPH

SEQ ID NO: 1294272 - protein, 9 aa, Homo Sapiens
GEEAPTGWD

SEQ ID NO: 1294273 - protein, 9 aa, Homo Sapiens
EAIYQIGVE

SEQ ID NO: 1294274 - protein, 9 aa, Homo Sapiens
EIAEVVNEI

SEQ ID NO: 1294275 - protein, 9 aa, Homo Sapiens
TTAPPCTSA

SEQ ID NO: 1294276 - protein, 9 aa, Homo Sapiens
CISGVCSAR

SEQ ID NO: 1294277 - protein, 9 aa, Homo Sapiens
TAEPDVWLE

SEQ ID NO: 1294278 - protein, 9 aa, Homo Sapiens
PPRFHCQQD

SEQ ID NO: 1294279 - protein, 9 aa, Homo Sapiens
ETRAPTPRS

SEQ ID NO: 1294280 - protein, 9 aa, Homo Sapiens
YGNEKRFFA

SEQ ID NO: 1294281 - protein, 9 aa, Homo Sapiens
NPLFLTGAY

SEQ ID NO: 1294282 - protein, 9 aa, Homo Sapiens
RKDNLESHM

SEQ ID NO: 1294283 - protein, 9 aa, Homo Sapiens
AGILPSSRG

SEQ ID NO: 1294284 - protein, 9 aa, Homo Sapiens
DIACLLSVH

SEQ ID NO: 1294285 - protein, 9 aa, Homo Sapiens
KILNCIWKV

SEQ ID NO: 1294286 - protein, 9 aa, Homo Sapiens
SLESILKGK

SEQ ID NO: 1294287 - protein, 9 aa, Homo Sapiens
PSPEPRNPD

SEQ ID NO: 1294288 - protein, 9 aa, Homo Sapiens
PVVNLVLCL

SEQ ID NO: 1294289 - protein, 9 aa, Homo Sapiens
PPAIVEGYN

SEQ ID NO: 1294290 - protein, 9 aa, Homo Sapiens
AVTHSEQAQ

SEQ ID NO: 1294291 - protein, 9 aa, Homo Sapiens
VLRGSPLCM

SEQ ID NO: 1294292 - protein, 9 aa, Homo Sapiens
QDLDALLSR

SEQ ID NO: 1294293 - protein, 9 aa, Homo Sapiens
KRMSYELSR

SEQ ID NO: 1294294 - protein, 9 aa, Homo Sapiens
LEFSMPPGV

SEQ ID NO: 1294295 - protein, 9 aa, Homo Sapiens
VLHFNDAPL

SEQ ID NO: 1294296 - protein, 9 aa, Homo Sapiens
GQLRGRARA

SEQ ID NO: 1294297 - protein, 9 aa, Homo Sapiens
EHLKKKILN

SEQ ID NO: 1294298 - protein, 9 aa, Homo Sapiens
FLGRNSFWQ

SEQ ID NO: 1294299 - protein, 9 aa, Homo Sapiens
LGVGEHALG

SEQ ID NO: 1294300 - protein, 9 aa, Homo Sapiens
MMSNGCWGW

SEQ ID NO: 1294301 - protein, 9 aa, Homo Sapiens
LSVPLDYRL

SEQ ID NO: 1294302 - protein, 9 aa, Homo Sapiens
DPPGSVWIL

SEQ ID NO: 1294303 - protein, 9 aa, Homo Sapiens
VALRGTVGV

SEQ ID NO: 1294304 - protein, 9 aa, Homo Sapiens
LWQLEVLGL

SEQ ID NO: 1294305 - protein, 9 aa, Homo Sapiens
EGRHRPAGH

SEQ ID NO: 1294306 - protein, 9 aa, Homo Sapiens
GGYQPPDRR

SEQ ID NO: 1294307 - protein, 9 aa, Homo Sapiens
LMGTELTRV

SEQ ID NO: 1294308 - protein, 9 aa, Homo Sapiens
STMLYVSSG

SEQ ID NO: 1294309 - protein, 9 aa, Homo Sapiens
VCAEKWNLL

SEQ ID NO: 1294310 - protein, 9 aa, Homo Sapiens
FLMGGMSRT

SEQ ID NO: 1294311 - protein, 9 aa, Homo Sapiens
RAGGHQQKH

SEQ ID NO: 1294312 - protein, 9 aa, Homo Sapiens
LRSVVGSER

SEQ ID NO: 1294313 - protein, 9 aa, Homo Sapiens
KSWGDKLKI

SEQ ID NO: 1294314 - protein, 9 aa, Homo Sapiens
GHSQREPAH

SEQ ID NO: 1294315 - protein, 9 aa, Homo Sapiens
AVPTVTAFP

SEQ ID NO: 1294316 - protein, 9 aa, Homo Sapiens
YLQSEWTQR

SEQ ID NO: 1294317 - protein, 9 aa, Homo Sapiens
RWARGPGML

SEQ ID NO: 1294318 - protein, 9 aa, Homo Sapiens
DGVGAAVAD

SEQ ID NO: 1294319 - protein, 9 aa, Homo Sapiens
GGCWARAGG

SEQ ID NO: 1294320 - protein, 9 aa, Homo Sapiens
ELTRVLPTN

SEQ ID NO: 1294321 - protein, 9 aa, Homo Sapiens
GCCSSWTWC

SEQ ID NO: 1294322 - protein, 9 aa, Homo Sapiens
YLCSQCLDQ

SEQ ID NO: 1294323 - protein, 9 aa, Homo Sapiens
NNAKPIRLN

SEQ ID NO: 1294324 - protein, 9 aa, Homo Sapiens
SPLQLLLHP

SEQ ID NO: 1294325 - protein, 9 aa, Homo Sapiens
SNISKKVSW

SEQ ID NO: 1294326 - protein, 9 aa, Homo Sapiens
NGQNNLIQQ

SEQ ID NO: 1294327 - protein, 9 aa, Homo Sapiens
RTCPSPPWS

SEQ ID NO: 1294328 - protein, 9 aa, Homo Sapiens
LMSTTRSIE

SEQ ID NO: 1294329 - protein, 9 aa, Homo Sapiens
GRGQVHPAG

SEQ ID NO: 1294330 - protein, 9 aa, Homo Sapiens
SLCMLGCIA

SEQ ID NO: 1294331 - protein, 9 aa, Homo Sapiens
PGFLAHEKA

SEQ ID NO: 1294332 - protein, 9 aa, Homo Sapiens
FLFLGRNSF

SEQ ID NO: 1294333 - protein, 9 aa, Homo Sapiens
VPPRFHCQQ

SEQ ID NO: 1294334 - protein, 9 aa, Homo Sapiens
EREHHVEAA

SEQ ID NO: 1294335 - protein, 9 aa, Homo Sapiens
VRNTEMDTE

SEQ ID NO: 1294336 - protein, 9 aa, Homo Sapiens
APPIFVFQK

SEQ ID NO: 1294337 - protein, 9 aa, Homo Sapiens
LLSPLDSSP

SEQ ID NO: 1294338 - protein, 9 aa, Homo Sapiens
EARLGQLVE

SEQ ID NO: 1294339 - protein, 9 aa, Homo Sapiens
GGSAHTSRS

SEQ ID NO: 1294340 - protein, 9 aa, Homo Sapiens
LERSRLTDY

SEQ ID NO: 1294341 - protein, 9 aa, Homo Sapiens
ASRASQPSS

SEQ ID NO: 1294342 - protein, 9 aa, Homo Sapiens
NESPLCGDV

SEQ ID NO: 1294343 - protein, 9 aa, Homo Sapiens
TSRDSRSFF

SEQ ID NO: 1294344 - protein, 9 aa, Homo Sapiens
MSFSRRGGS

SEQ ID NO: 1294345 - protein, 9 aa, Homo Sapiens
APHVQLHDV

SEQ ID NO: 1294346 - protein, 9 aa, Homo Sapiens
TAKRRKPCL

SEQ ID NO: 1294347 - protein, 9 aa, Homo Sapiens
LRHLLVTQQ

SEQ ID NO: 1294348 - protein, 9 aa, Homo Sapiens
DPLKRDRQQ

SEQ ID NO: 1294349 - protein, 9 aa, Homo Sapiens
LPSSRGMGR

SEQ ID NO: 1294350 - protein, 9 aa, Homo Sapiens
ILYDNRQRS

SEQ ID NO: 1294351 - protein, 9 aa, Homo Sapiens
ELSRKVYIL

SEQ ID NO: 1294352 - protein, 9 aa, Homo Sapiens
TSAHPSRPC

SEQ ID NO: 1294353 - protein, 9 aa, Homo Sapiens
RKLWQIPEG

SEQ ID NO: 1294354 - protein, 9 aa, Homo Sapiens
YILWAVDGR

SEQ ID NO: 1294355 - protein, 9 aa, Homo Sapiens
RSSMEGEKQ

SEQ ID NO: 1294356 - protein, 9 aa, Homo Sapiens
GGGDARAAG

SEQ ID NO: 1294357 - protein, 9 aa, Homo Sapiens
VESELERGV

SEQ ID NO: 1294358 - protein, 9 aa, Homo Sapiens
ASTSLYVRP

SEQ ID NO: 1294359 - protein, 9 aa, Homo Sapiens
AVTWTQTQC

SEQ ID NO: 1294360 - protein, 9 aa, Homo Sapiens
HWGAAPMMS

SEQ ID NO: 1294361 - protein, 9 aa, Homo Sapiens
ATVSISTVG

SEQ ID NO: 1294362 - protein, 9 aa, Homo Sapiens
LQKEEEVEA

SEQ ID NO: 1294363 - protein, 9 aa, Homo Sapiens
SIRASWRIE

SEQ ID NO: 1294364 - protein, 9 aa, Homo Sapiens
PAKKNKENQ

SEQ ID NO: 1294365 - protein, 9 aa, Homo Sapiens
DKSFAEGQI

SEQ ID NO: 1294366 - protein, 9 aa, Homo Sapiens
RRWAPRHLG

SEQ ID NO: 1294367 - protein, 9 aa, Homo Sapiens
QQSWEIVME

SEQ ID NO: 1294368 - protein, 9 aa, Homo Sapiens
WKMNWKKMM

SEQ ID NO: 1294369 - protein, 9 aa, Homo Sapiens
SVPAGILPS

SEQ ID NO: 1294370 - protein, 9 aa, Homo Sapiens
PPTSCPPLL

SEQ ID NO: 1294371 - protein, 9 aa, Homo Sapiens
RLLHVHNRV

SEQ ID NO: 1294372 - protein, 9 aa, Homo Sapiens
LESHGQGGQ

SEQ ID NO: 1294373 - protein, 9 aa, Homo Sapiens
QNDFAISKD

SEQ ID NO: 1294374 - protein, 9 aa, Homo Sapiens
ERRQRSPSQ

SEQ ID NO: 1294375 - protein, 9 aa, Homo Sapiens
LQTRVLHKN

SEQ ID NO: 1294376 - protein, 9 aa, Homo Sapiens
PASVAPATL

SEQ ID NO: 1294377 - protein, 9 aa, Homo Sapiens
WCSSEPGKL

SEQ ID NO: 1294378 - protein, 9 aa, Homo Sapiens
LSALWFHHV

SEQ ID NO: 1294379 - protein, 9 aa, Homo Sapiens
DNIPKETFS

SEQ ID NO: 1294380 - protein, 9 aa, Homo Sapiens
CSERCAWQQ

SEQ ID NO: 1294381 - protein, 9 aa, Homo Sapiens
AVHLPFFYG

SEQ ID NO: 1294382 - protein, 9 aa, Homo Sapiens
PTTTTSSPR

SEQ ID NO: 1294383 - protein, 9 aa, Homo Sapiens
KINSAPLAL

SEQ ID NO: 1294384 - protein, 9 aa, Homo Sapiens
SQGGGEPGW

SEQ ID NO: 1294385 - protein, 9 aa, Homo Sapiens
NYCFLFLGR

SEQ ID NO: 1294386 - protein, 9 aa, Homo Sapiens
ASTNSDDIR

SEQ ID NO: 1294387 - protein, 9 aa, Homo Sapiens
PSRSPSRHW

SEQ ID NO: 1294388 - protein, 9 aa, Homo Sapiens
KCMECGSLH

SEQ ID NO: 1294389 - protein, 9 aa, Homo Sapiens
GAGGYQPPD

SEQ ID NO: 1294390 - protein, 9 aa, Homo Sapiens
GVRLRVPPD

SEQ ID NO: 1294391 - protein, 9 aa, Homo Sapiens
GIVILGYVE

SEQ ID NO: 1294392 - protein, 9 aa, Homo Sapiens
REQRISVPV

SEQ ID NO: 1294393 - protein, 9 aa, Homo Sapiens
KTPNSLAKP

SEQ ID NO: 1294394 - protein, 9 aa, Homo Sapiens
MLAMQFSIP

SEQ ID NO: 1294395 - protein, 9 aa, Homo Sapiens
QGRPRGAGA

SEQ ID NO: 1294396 - protein, 9 aa, Homo Sapiens
AKPSPGARA

SEQ ID NO: 1294397 - protein, 9 aa, Homo Sapiens
RSPLAPSEW

SEQ ID NO: 1294398 - protein, 9 aa, Homo Sapiens
NKKMAMTVI

SEQ ID NO: 1294399 - protein, 9 aa, Homo Sapiens
LCWSEITRN

SEQ ID NO: 1294400 - protein, 9 aa, Homo Sapiens
WSTVKETRT

SEQ ID NO: 1294401 - protein, 9 aa, Homo Sapiens
QKSMEKEKM

SEQ ID NO: 1294402 - protein, 9 aa, Homo Sapiens
ELYVDKSWG

SEQ ID NO: 1294403 - protein, 9 aa, Homo Sapiens
GGLLARGHV

SEQ ID NO: 1294404 - protein, 9 aa, Homo Sapiens
FTTGSSRRK

SEQ ID NO: 1294405 - protein, 9 aa, Homo Sapiens
HVHFVNFEH

SEQ ID NO: 1294406 - protein, 9 aa, Homo Sapiens
QSQHILPVL

SEQ ID NO: 1294407 - protein, 9 aa, Homo Sapiens
TYSVFPYQN

SEQ ID NO: 1294408 - protein, 9 aa, Homo Sapiens
TCPSPPWSP

SEQ ID NO: 1294409 - protein, 9 aa, Homo Sapiens
ANPTVQWDG

SEQ ID NO: 1294410 - protein, 9 aa, Homo Sapiens
VPQITSPPC

SEQ ID NO: 1294411 - protein, 9 aa, Homo Sapiens
VRLRVPPDG

SEQ ID NO: 1294412 - protein, 9 aa, Homo Sapiens
MPDPAVHLP

SEQ ID NO: 1294413 - protein, 9 aa, Homo Sapiens
TLTMESAKP

SEQ ID NO: 1294414 - protein, 9 aa, Homo Sapiens
EPRLSQDLD

SEQ ID NO: 1294415 - protein, 9 aa, Homo Sapiens
LGATREEEQ

SEQ ID NO: 1294416 - protein, 9 aa, Homo Sapiens
RYLRSVVGS

SEQ ID NO: 1294417 - protein, 9 aa, Homo Sapiens
PLGLPAQDT

SEQ ID NO: 1294418 - protein, 9 aa, Homo Sapiens
SKSCDPPGM

SEQ ID NO: 1294419 - protein, 9 aa, Homo Sapiens
GGHRHQYLQ

SEQ ID NO: 1294420 - protein, 9 aa, Homo Sapiens
EQRESRSLS

SEQ ID NO: 1294421 - protein, 9 aa, Homo Sapiens
HLVIRPPII

SEQ ID NO: 1294422 - protein, 9 aa, Homo Sapiens
ILARLVATP

SEQ ID NO: 1294423 - protein, 9 aa, Homo Sapiens
PPGANPTVQ

SEQ ID NO: 1294424 - protein, 9 aa, Homo Sapiens
PDLTENPVG

SEQ ID NO: 1294425 - protein, 9 aa, Homo Sapiens
RSRVAYVDN

SEQ ID NO: 1294426 - protein, 9 aa, Homo Sapiens
TVRNTEMDT

SEQ ID NO: 1294427 - protein, 9 aa, Homo Sapiens
QRALLVHPA

SEQ ID NO: 1294428 - protein, 9 aa, Homo Sapiens
SPTMPPPPP

SEQ ID NO: 1294429 - protein, 9 aa, Homo Sapiens
FPQESCLMS

SEQ ID NO: 1294430 - protein, 9 aa, Homo Sapiens
SFSRRGGSA

SEQ ID NO: 1294431 - protein, 9 aa, Homo Sapiens
SQGPTQRRS

SEQ ID NO: 1294432 - protein, 9 aa, Homo Sapiens
KLVVVGAAG

SEQ ID NO: 1294433 - protein, 9 aa, Homo Sapiens
ACPMTACSI

SEQ ID NO: 1294434 - protein, 9 aa, Homo Sapiens
VRFYDSLES

SEQ ID NO: 1294435 - protein, 9 aa, Homo Sapiens
KKINSAPLA

SEQ ID NO: 1294436 - protein, 9 aa, Homo Sapiens
RPRDLLESN

SEQ ID NO: 1294437 - protein, 9 aa, Homo Sapiens
ELEKKAEKN

SEQ ID NO: 1294438 - protein, 9 aa, Homo Sapiens
PPWSRSSCR

SEQ ID NO: 1294439 - protein, 9 aa, Homo Sapiens
QRATRHGPY

SEQ ID NO: 1294440 - protein, 9 aa, Homo Sapiens
VMQGNMDTA

SEQ ID NO: 1294441 - protein, 9 aa, Homo Sapiens
EFSPDSSIR

SEQ ID NO: 1294442 - protein, 9 aa, Homo Sapiens
TVSLASTSG

SEQ ID NO: 1294443 - protein, 9 aa, Homo Sapiens
RSPALRARG

SEQ ID NO: 1294444 - protein, 9 aa, Homo Sapiens
KLAYEKSRM

SEQ ID NO: 1294445 - protein, 9 aa, Homo Sapiens
FLVMLAAID

SEQ ID NO: 1294446 - protein, 9 aa, Homo Sapiens
EASELCLEQ

SEQ ID NO: 1294447 - protein, 9 aa, Homo Sapiens
PDTTHPTCI

SEQ ID NO: 1294448 - protein, 9 aa, Homo Sapiens
DHRSNQNRE

SEQ ID NO: 1294449 - protein, 9 aa, Homo Sapiens
QRSPSQRSH

SEQ ID NO: 1294450 - protein, 9 aa, Homo Sapiens
VPGPGMAVP

SEQ ID NO: 1294451 - protein, 9 aa, Homo Sapiens
AEAKTYRCM

SEQ ID NO: 1294452 - protein, 9 aa, Homo Sapiens
LNRLCVLLL

SEQ ID NO: 1294453 - protein, 9 aa, Homo Sapiens
KEKKNNMAA

SEQ ID NO: 1294454 - protein, 9 aa, Homo Sapiens
RCSQTQSHP

SEQ ID NO: 1294455 - protein, 9 aa, Homo Sapiens
PLILPQALN

SEQ ID NO: 1294456 - protein, 9 aa, Homo Sapiens
EMRMVKENF

SEQ ID NO: 1294457 - protein, 9 aa, Homo Sapiens
PQVPPQLPQ

SEQ ID NO: 1294458 - protein, 9 aa, Homo Sapiens
AMLQGMAYA

SEQ ID NO: 1294459 - protein, 9 aa, Homo Sapiens
EGWHWGAAP

SEQ ID NO: 1294460 - protein, 9 aa, Homo Sapiens
SAKPVTPPA

SEQ ID NO: 1294461 - protein, 9 aa, Homo Sapiens
NHGSSITKQ

SEQ ID NO: 1294462 - protein, 9 aa, Homo Sapiens
DLHPSTLTL

SEQ ID NO: 1294463 - protein, 9 aa, Homo Sapiens
KCLGSMEKS

SEQ ID NO: 1294464 - protein, 9 aa, Homo Sapiens
LSIPWTQIP

SEQ ID NO: 1294465 - protein, 9 aa, Homo Sapiens
LNYDCIVEN

SEQ ID NO: 1294466 - protein, 9 aa, Homo Sapiens
VDSKHFGRG

SEQ ID NO: 1294467 - protein, 9 aa, Homo Sapiens
LRLDRLLPA

SEQ ID NO: 1294468 - protein, 9 aa, Homo Sapiens
CWLSFNLPP

SEQ ID NO: 1294469 - protein, 9 aa, Homo Sapiens
LQSQHILPV

SEQ ID NO: 1294470 - protein, 9 aa, Homo Sapiens
RSSCRSKGP

SEQ ID NO: 1294471 - protein, 9 aa, Homo Sapiens
WNAMVVLNK

SEQ ID NO: 1294472 - protein, 9 aa, Homo Sapiens
GLGSEVGGK

SEQ ID NO: 1294473 - protein, 9 aa, Homo Sapiens
WHWGAAPMM

SEQ ID NO: 1294474 - protein, 9 aa, Homo Sapiens
IMEQVKVKI

SEQ ID NO: 1294475 - protein, 9 aa, Homo Sapiens
ATREEEQAL

SEQ ID NO: 1294476 - protein, 9 aa, Homo Sapiens
FKTRKASTQ

SEQ ID NO: 1294477 - protein, 9 aa, Homo Sapiens
EKSKVLIYR

SEQ ID NO: 1294478 - protein, 9 aa, Homo Sapiens
AEGQISINK

SEQ ID NO: 1294479 - protein, 9 aa, Homo Sapiens
GDLEFLSDI

SEQ ID NO: 1294480 - protein, 9 aa, Homo Sapiens
VPVQKEAAF

SEQ ID NO: 1294481 - protein, 9 aa, Homo Sapiens
LLRLQSLLS

SEQ ID NO: 1294482 - protein, 9 aa, Homo Sapiens
VTPVKNWHK

SEQ ID NO: 1294483 - protein, 9 aa, Homo Sapiens
MPPPPPLAR

SEQ ID NO: 1294484 - protein, 9 aa, Homo Sapiens
VTVTQITVS

SEQ ID NO: 1294485 - protein, 9 aa, Homo Sapiens
LARNMPPYS

SEQ ID NO: 1294486 - protein, 9 aa, Homo Sapiens
IPGKLTKNG

SEQ ID NO: 1294487 - protein, 9 aa, Homo Sapiens
RGQVHPAGP

SEQ ID NO: 1294488 - protein, 9 aa, Homo Sapiens
GEERWLRGG

SEQ ID NO: 1294489 - protein, 9 aa, Homo Sapiens
EENCLEFRE

SEQ ID NO: 1294490 - protein, 9 aa, Homo Sapiens
APRPKPNLD

SEQ ID NO: 1294491 - protein, 9 aa, Homo Sapiens
ESCLMSTTR

SEQ ID NO: 1294492 - protein, 9 aa, Homo Sapiens
LYNLKNSSH

SEQ ID NO: 1294493 - protein, 9 aa, Homo Sapiens
HGKRCNPCC

SEQ ID NO: 1294494 - protein, 9 aa, Homo Sapiens
MMSSMACGS

SEQ ID NO: 1294495 - protein, 9 aa, Homo Sapiens
QLRFISDLS

SEQ ID NO: 1294496 - protein, 9 aa, Homo Sapiens
GGDIEARSD

SEQ ID NO: 1294497 - protein, 9 aa, Homo Sapiens
SSAEMLKVN

SEQ ID NO: 1294498 - protein, 9 aa, Homo Sapiens
SSMEGEKQR

SEQ ID NO: 1294499 - protein, 9 aa, Homo Sapiens
EPPPKKLEP

SEQ ID NO: 1294500 - protein, 9 aa, Homo Sapiens
NATDDDEDD

SEQ ID NO: 1294501 - protein, 9 aa, Homo Sapiens
GSPRLCATT

SEQ ID NO: 1294502 - protein, 9 aa, Homo Sapiens
PAVPQITSP

SEQ ID NO: 1294503 - protein, 9 aa, Homo Sapiens
FLLTKPLSC

SEQ ID NO: 1294504 - protein, 9 aa, Homo Sapiens
QPPGPAPWW

SEQ ID NO: 1294505 - protein, 9 aa, Homo Sapiens
VHYIKPCFK

SEQ ID NO: 1294506 - protein, 9 aa, Homo Sapiens
ALQGEAAGA

SEQ ID NO: 1294507 - protein, 9 aa, Homo Sapiens
QEPRRLSFW

SEQ ID NO: 1294508 - protein, 9 aa, Homo Sapiens
IFLLFCLVL

SEQ ID NO: 1294509 - protein, 9 aa, Homo Sapiens
LEELGGKRI

SEQ ID NO: 1294510 - protein, 9 aa, Homo Sapiens
DAVVLIVDV

SEQ ID NO: 1294511 - protein, 9 aa, Homo Sapiens
QVLLVSPYH

SEQ ID NO: 1294512 - protein, 9 aa, Homo Sapiens
VKKEAKEVF

SEQ ID NO: 1294513 - protein, 9 aa, Homo Sapiens
TATWTHPST

SEQ ID NO: 1294514 - protein, 9 aa, Homo Sapiens
MVNVTREDS

SEQ ID NO: 1294515 - protein, 9 aa, Homo Sapiens
RSNAGIVTV

SEQ ID NO: 1294516 - protein, 9 aa, Homo Sapiens
MNQVPTVGF

SEQ ID NO: 1294517 - protein, 9 aa, Homo Sapiens
GCGRAPAQP

SEQ ID NO: 1294518 - protein, 9 aa, Homo Sapiens
APPSCLRFV

SEQ ID NO: 1294519 - protein, 9 aa, Homo Sapiens
DCLHHHLYP

SEQ ID NO: 1294520 - protein, 9 aa, Homo Sapiens
HLLVYILWA

SEQ ID NO: 1294521 - protein, 9 aa, Homo Sapiens
ASVDLPNTG

SEQ ID NO: 1294522 - protein, 9 aa, Homo Sapiens
AGRWSAPTC

SEQ ID NO: 1294523 - protein, 9 aa, Homo Sapiens
MMIGSQHLL

SEQ ID NO: 1294524 - protein, 9 aa, Homo Sapiens
IVILGYVEN

SEQ ID NO: 1294525 - protein, 9 aa, Homo Sapiens
ILCATYMNV

SEQ ID NO: 1294526 - protein, 9 aa, Homo Sapiens
VGQHELQVP

SEQ ID NO: 1294527 - protein, 9 aa, Homo Sapiens
HHPIYILKG

SEQ ID NO: 1294528 - protein, 9 aa, Homo Sapiens
QAMRYLCSQ

SEQ ID NO: 1294529 - protein, 9 aa, Homo Sapiens
DTPDEPQKS

SEQ ID NO: 1294530 - protein, 9 aa, Homo Sapiens
VILGVEEPE

SEQ ID NO: 1294531 - protein, 9 aa, Homo Sapiens
RILQCTAIS

SEQ ID NO: 1294532 - protein, 9 aa, Homo Sapiens
HNRVIDVSV

SEQ ID NO: 1294533 - protein, 9 aa, Homo Sapiens
GACIPFRVG

SEQ ID NO: 1294534 - protein, 9 aa, Homo Sapiens
MQWNNKKMA

SEQ ID NO: 1294535 - protein, 9 aa, Homo Sapiens
MGPGDFRRY

SEQ ID NO: 1294536 - protein, 9 aa, Homo Sapiens
VVDVNLCWS

SEQ ID NO: 1294537 - protein, 9 aa, Homo Sapiens
LAEVCQLQP

SEQ ID NO: 1294538 - protein, 9 aa, Homo Sapiens
RKKEDKECK

SEQ ID NO: 1294539 - protein, 9 aa, Homo Sapiens
FRLYSRAVL

SEQ ID NO: 1294540 - protein, 9 aa, Homo Sapiens
LPWEIPGKK

SEQ ID NO: 1294541 - protein, 9 aa, Homo Sapiens
HLHRQISLP

SEQ ID NO: 1294542 - protein, 9 aa, Homo Sapiens
SRRGGSAHT

SEQ ID NO: 1294543 - protein, 9 aa, Homo Sapiens
EKKNNMAAK

SEQ ID NO: 1294544 - protein, 9 aa, Homo Sapiens
ESHGQGGQK

SEQ ID NO: 1294545 - protein, 9 aa, Homo Sapiens
GQQVAFIES

SEQ ID NO: 1294546 - protein, 9 aa, Homo Sapiens
EHTVEGHCF

SEQ ID NO: 1294547 - protein, 9 aa, Homo Sapiens
QQAGGGGPL

SEQ ID NO: 1294548 - protein, 9 aa, Homo Sapiens
WRPRATAVT

SEQ ID NO: 1294549 - protein, 9 aa, Homo Sapiens
LQEEKGLDG

SEQ ID NO: 1294550 - protein, 9 aa, Homo Sapiens
NGDARHSPE

SEQ ID NO: 1294551 - protein, 9 aa, Homo Sapiens
HAPEQRVGH

SEQ ID NO: 1294552 - protein, 9 aa, Homo Sapiens
FLSTFNIRI

SEQ ID NO: 1294553 - protein, 9 aa, Homo Sapiens
QAHQDAGAQ

SEQ ID NO: 1294554 - protein, 9 aa, Homo Sapiens
SNGCWGWQQ

SEQ ID NO: 1294555 - protein, 9 aa, Homo Sapiens
RVLSARAMT

SEQ ID NO: 1294556 - protein, 9 aa, Homo Sapiens
QIVKPQEAP

SEQ ID NO: 1294557 - protein, 9 aa, Homo Sapiens
CLHHQRVKL

SEQ ID NO: 1294558 - protein, 9 aa, Homo Sapiens
WVSCGTGAA

SEQ ID NO: 1294559 - protein, 9 aa, Homo Sapiens
YQPPAKKNK

SEQ ID NO: 1294560 - protein, 9 aa, Homo Sapiens
GLGDLHQAV

SEQ ID NO: 1294561 - protein, 9 aa, Homo Sapiens
DWVPDAAST

SEQ ID NO: 1294562 - protein, 9 aa, Homo Sapiens
VLLLQGITH

SEQ ID NO: 1294563 - protein, 9 aa, Homo Sapiens
FSCNQPQRP

SEQ ID NO: 1294564 - protein, 9 aa, Homo Sapiens
AVVRAGVDV

SEQ ID NO: 1294565 - protein, 9 aa, Homo Sapiens
QGVEIHIPI

SEQ ID NO: 1294566 - protein, 9 aa, Homo Sapiens
KHQKLDTIL

SEQ ID NO: 1294567 - protein, 9 aa, Homo Sapiens
EGAPQPSPH

SEQ ID NO: 1294568 - protein, 9 aa, Homo Sapiens
PRHLGQAGP

SEQ ID NO: 1294569 - protein, 9 aa, Homo Sapiens
ASAPQTETR

SEQ ID NO: 1294570 - protein, 9 aa, Homo Sapiens
PPMHCPTAT

SEQ ID NO: 1294571 - protein, 9 aa, Homo Sapiens
HTSRSVLSV

SEQ ID NO: 1294572 - protein, 9 aa, Homo Sapiens
SCGSLCMLG

SEQ ID NO: 1294573 - protein, 9 aa, Homo Sapiens
HTIATQVHI

SEQ ID NO: 1294574 - protein, 9 aa, Homo Sapiens
RTKCPRKRG

SEQ ID NO: 1294575 - protein, 9 aa, Homo Sapiens
AWSRILSIQ

SEQ ID NO: 1294576 - protein, 9 aa, Homo Sapiens
VIMLICSLT

SEQ ID NO: 1294577 - protein, 9 aa, Homo Sapiens
YDCIVENPQ

SEQ ID NO: 1294578 - protein, 9 aa, Homo Sapiens
KMVDVGGRG

SEQ ID NO: 1294579 - protein, 9 aa, Homo Sapiens
QVKVKIAVA

SEQ ID NO: 1294580 - protein, 9 aa, Homo Sapiens
AVDCLQAFW

SEQ ID NO: 1294581 - protein, 9 aa, Homo Sapiens
MEMRMVKEN

SEQ ID NO: 1294582 - protein, 9 aa, Homo Sapiens
VFNTQKRER

SEQ ID NO: 1294583 - protein, 9 aa, Homo Sapiens
HTVEGHCFP

SEQ ID NO: 1294584 - protein, 9 aa, Homo Sapiens
FGSVARMCA

SEQ ID NO: 1294585 - protein, 9 aa, Homo Sapiens
LYLSALWFH

SEQ ID NO: 1294586 - protein, 9 aa, Homo Sapiens
ARTKCPRKR

SEQ ID NO: 1294587 - protein, 9 aa, Homo Sapiens
CDIYLISGS

SEQ ID NO: 1294588 - protein, 9 aa, Homo Sapiens
VDVDQVLCG

SEQ ID NO: 1294589 - protein, 9 aa, Homo Sapiens
LLQQLEFSM

SEQ ID NO: 1294590 - protein, 9 aa, Homo Sapiens
NKDERMILL

SEQ ID NO: 1294591 - protein, 9 aa, Homo Sapiens
FLGQSEGLM

SEQ ID NO: 1294592 - protein, 9 aa, Homo Sapiens
GGSPSLFDA

SEQ ID NO: 1294593 - protein, 9 aa, Homo Sapiens
RPRPRRAWK

SEQ ID NO: 1294594 - protein, 9 aa, Homo Sapiens
SSFLIFFIP

SEQ ID NO: 1294595 - protein, 9 aa, Homo Sapiens
CSQGGGEPG

SEQ ID NO: 1294596 - protein, 9 aa, Homo Sapiens
RKPCLCTVS

SEQ ID NO: 1294597 - protein, 9 aa, Homo Sapiens
MGGMSRTPP

SEQ ID NO: 1294598 - protein, 9 aa, Homo Sapiens
LEVIARGVA

SEQ ID NO: 1294599 - protein, 9 aa, Homo Sapiens
TFLRCSQTQ

SEQ ID NO: 1294600 - protein, 9 aa, Homo Sapiens
WGDSPWNKT

SEQ ID NO: 1294601 - protein, 9 aa, Homo Sapiens
LWSLLKSCS

SEQ ID NO: 1294602 - protein, 9 aa, Homo Sapiens
PRLLHVHNR

SEQ ID NO: 1294603 - protein, 9 aa, Homo Sapiens
RHSISMPTM

SEQ ID NO: 1294604 - protein, 9 aa, Homo Sapiens
NGAGRQARP

SEQ ID NO: 1294605 - protein, 9 aa, Homo Sapiens
PVQKEAAFA

SEQ ID NO: 1294606 - protein, 9 aa, Homo Sapiens
LSQDLDALL

SEQ ID NO: 1294607 - protein, 9 aa, Homo Sapiens
HKIQKIRQK

SEQ ID NO: 1294608 - protein, 9 aa, Homo Sapiens
VCERCFQEL

SEQ ID NO: 1294609 - protein, 9 aa, Homo Sapiens
QMGRILQCT

SEQ ID NO: 1294610 - protein, 9 aa, Homo Sapiens
WNNYRIFIK

SEQ ID NO: 1294611 - protein, 9 aa, Homo Sapiens
MADFGLSRL

SEQ ID NO: 1294612 - protein, 9 aa, Homo Sapiens
PRAPEVPRC

SEQ ID NO: 1294613 - protein, 9 aa, Homo Sapiens
KWNAMVVLN

SEQ ID NO: 1294614 - protein, 9 aa, Homo Sapiens
PPDLTENPV

SEQ ID NO: 1294615 - protein, 9 aa, Homo Sapiens
IFIKQKCIE

SEQ ID NO: 1294616 - protein, 9 aa, Homo Sapiens
RCPRRLPMS

SEQ ID NO: 1294617 - protein, 9 aa, Homo Sapiens
PCKGVTTTQ

SEQ ID NO: 1294618 - protein, 9 aa, Homo Sapiens
AFVQGVPKH

SEQ ID NO: 1294619 - protein, 9 aa, Homo Sapiens
DTEWHLHVH

SEQ ID NO: 1294620 - protein, 9 aa, Homo Sapiens
HDDYLDRTL

SEQ ID NO: 1294621 - protein, 9 aa, Homo Sapiens
SATRCMGSR

SEQ ID NO: 1294622 - protein, 9 aa, Homo Sapiens
KKKKKEKKN

SEQ ID NO: 1294623 - protein, 9 aa, Homo Sapiens
WNNAKPIRL

SEQ ID NO: 1294624 - protein, 9 aa, Homo Sapiens
IQDYGLIID

SEQ ID NO: 1294625 - protein, 9 aa, Homo Sapiens
AAFMLAMQF

SEQ ID NO: 1294626 - protein, 9 aa, Homo Sapiens
GSSSTTTVA

SEQ ID NO: 1294627 - protein, 9 aa, Homo Sapiens
ASMTLPAPT

SEQ ID NO: 1294628 - protein, 9 aa, Homo Sapiens
SLMSEKNLA

SEQ ID NO: 1294629 - protein, 9 aa, Homo Sapiens
LSTWSASYT

SEQ ID NO: 1294630 - protein, 9 aa, Homo Sapiens
LLLHPHGKR

SEQ ID NO: 1294631 - protein, 9 aa, Homo Sapiens
RGISGMRTF

SEQ ID NO: 1294632 - protein, 9 aa, Homo Sapiens
PLPAPCQVP

SEQ ID NO: 1294633 - protein, 9 aa, Homo Sapiens
VERVETRPN

SEQ ID NO: 1294634 - protein, 9 aa, Homo Sapiens
CATTTCPGP

SEQ ID NO: 1294635 - protein, 9 aa, Homo Sapiens
RGCCSSWTW

SEQ ID NO: 1294636 - protein, 9 aa, Homo Sapiens
LLDHPDHVL

SEQ ID NO: 1294637 - protein, 9 aa, Homo Sapiens
GMTGLNKNR

SEQ ID NO: 1294638 - protein, 9 aa, Homo Sapiens
TGLVAMLQG

SEQ ID NO: 1294639 - protein, 9 aa, Homo Sapiens
SGNCCSTMG

SEQ ID NO: 1294640 - protein, 9 aa, Homo Sapiens
DERMILLME

SEQ ID NO: 1294641 - protein, 9 aa, Homo Sapiens
ATAACPMTA

SEQ ID NO: 1294642 - protein, 9 aa, Homo Sapiens
SPSPYTVPQ

SEQ ID NO: 1294643 - protein, 9 aa, Homo Sapiens
PEPEEQEKE

SEQ ID NO: 1294644 - protein, 9 aa, Homo Sapiens
TSELTVVNN

SEQ ID NO: 1294645 - protein, 9 aa, Homo Sapiens
RSTPRLPVP

SEQ ID NO: 1294646 - protein, 9 aa, Homo Sapiens
MPTMRNSAT

SEQ ID NO: 1294647 - protein, 9 aa, Homo Sapiens
TTQWSLARP

SEQ ID NO: 1294648 - protein, 9 aa, Homo Sapiens
ITEGGGHCQ

SEQ ID NO: 1294649 - protein, 9 aa, Homo Sapiens
LYQLAPAVE

SEQ ID NO: 1294650 - protein, 9 aa, Homo Sapiens
MSGGWWFDT

SEQ ID NO: 1294651 - protein, 9 aa, Homo Sapiens
LKCGNIVVY

SEQ ID NO: 1294652 - protein, 9 aa, Homo Sapiens
INGQNNLIQ

SEQ ID NO: 1294653 - protein, 9 aa, Homo Sapiens
GPDLVLALV

SEQ ID NO: 1294654 - protein, 9 aa, Homo Sapiens
VFVDNKALI

SEQ ID NO: 1294655 - protein, 9 aa, Homo Sapiens
LLEELGGKR

SEQ ID NO: 1294656 - protein, 9 aa, Homo Sapiens
FESGHDING

SEQ ID NO: 1294657 - protein, 9 aa, Homo Sapiens
FWMVWSSRL

SEQ ID NO: 1294658 - protein, 9 aa, Homo Sapiens
LRAQRAGAL

SEQ ID NO: 1294659 - protein, 9 aa, Homo Sapiens
PAHPSIRIL

SEQ ID NO: 1294660 - protein, 9 aa, Homo Sapiens
WKPCGRVDT

SEQ ID NO: 1294661 - protein, 9 aa, Homo Sapiens
PLAPSEWAG

SEQ ID NO: 1294662 - protein, 9 aa, Homo Sapiens
KWPVNRRPM

SEQ ID NO: 1294663 - protein, 9 aa, Homo Sapiens
CERCFQELQ

SEQ ID NO: 1294664 - protein, 9 aa, Homo Sapiens
KTKDGNGST

SEQ ID NO: 1294665 - protein, 9 aa, Homo Sapiens
NFGSVARMC

SEQ ID NO: 1294666 - protein, 9 aa, Homo Sapiens
DIVSGTTVA

SEQ ID NO: 1294667 - protein, 9 aa, Homo Sapiens
TVLIPCFPN

SEQ ID NO: 1294668 - protein, 9 aa, Homo Sapiens
LPAFTLGCR

SEQ ID NO: 1294669 - protein, 9 aa, Homo Sapiens
PLTVLGVRS

SEQ ID NO: 1294670 - protein, 9 aa, Homo Sapiens
SGGWWFDTC

SEQ ID NO: 1294671 - protein, 9 aa, Homo Sapiens
PVVTQRKSQ

SEQ ID NO: 1294672 - protein, 9 aa, Homo Sapiens
PAQPTMPGS

SEQ ID NO: 1294673 - protein, 9 aa, Homo Sapiens
SVLNIASVD

SEQ ID NO: 1294674 - protein, 9 aa, Homo Sapiens
SFKNMCKPR

SEQ ID NO: 1294675 - protein, 9 aa, Homo Sapiens
TFGPASISR

SEQ ID NO: 1294676 - protein, 9 aa, Homo Sapiens
AHRRKALQW

SEQ ID NO: 1294677 - protein, 9 aa, Homo Sapiens
KKMAMTVIA

SEQ ID NO: 1294678 - protein, 9 aa, Homo Sapiens
STLTMESAK

SEQ ID NO: 1294679 - protein, 9 aa, Homo Sapiens
PLVERFTFV

SEQ ID NO: 1294680 - protein, 9 aa, Homo Sapiens
PMFDFQGLI

SEQ ID NO: 1294681 - protein, 9 aa, Homo Sapiens
PDLVLALVG

SEQ ID NO: 1294682 - protein, 9 aa, Homo Sapiens
PVKERLFPR

SEQ ID NO: 1294683 - protein, 9 aa, Homo Sapiens
ALNRLCVLL

SEQ ID NO: 1294684 - protein, 9 aa, Homo Sapiens
KITTRNSSI

SEQ ID NO: 1294685 - protein, 9 aa, Homo Sapiens
GKNDIKAAM

SEQ ID NO: 1294686 - protein, 9 aa, Homo Sapiens
GTGGACIPF

SEQ ID NO: 1294687 - protein, 9 aa, Homo Sapiens
GSAGHWTSK

SEQ ID NO: 1294688 - protein, 9 aa, Homo Sapiens
SSAACWPRA

SEQ ID NO: 1294689 - protein, 9 aa, Homo Sapiens
MLHLGLCAA

SEQ ID NO: 1294690 - protein, 9 aa, Homo Sapiens
LNIVCKPVP

SEQ ID NO: 1294691 - protein, 9 aa, Homo Sapiens
ALVPGSSPR

SEQ ID NO: 1294692 - protein, 9 aa, Homo Sapiens
GCFLAGVSC

SEQ ID NO: 1294693 - protein, 9 aa, Homo Sapiens
TRSRTVPGP

SEQ ID NO: 1294694 - protein, 9 aa, Homo Sapiens
SIRTSSFYC

SEQ ID NO: 1294695 - protein, 9 aa, Homo Sapiens
GRRGATAAP

SEQ ID NO: 1294696 - protein, 9 aa, Homo Sapiens
DHVLLTFDG

SEQ ID NO: 1294697 - protein, 9 aa, Homo Sapiens
DPGLALRKT

SEQ ID NO: 1294698 - protein, 9 aa, Homo Sapiens
HFPDSQEKM

SEQ ID NO: 1294699 - protein, 9 aa, Homo Sapiens
CSHQGLAVP

SEQ ID NO: 1294700 - protein, 9 aa, Homo Sapiens
KEKSKVLIY

SEQ ID NO: 1294701 - protein, 9 aa, Homo Sapiens
GAAGKRVLC

SEQ ID NO: 1294702 - protein, 9 aa, Homo Sapiens
LAYEKSRMT

SEQ ID NO: 1294703 - protein, 9 aa, Homo Sapiens
LALRKTEHP

SEQ ID NO: 1294704 - protein, 9 aa, Homo Sapiens
DLHQAVSQA

SEQ ID NO: 1294705 - protein, 9 aa, Homo Sapiens
VKLFWMVWS

SEQ ID NO: 1294706 - protein, 9 aa, Homo Sapiens
EIDHDRYSG

SEQ ID NO: 1294707 - protein, 9 aa, Homo Sapiens
LYRGGQRCR

SEQ ID NO: 1294708 - protein, 9 aa, Homo Sapiens
YGEPPPKKL

SEQ ID NO: 1294709 - protein, 9 aa, Homo Sapiens
KKKEKKNNM

SEQ ID NO: 1294710 - protein, 9 aa, Homo Sapiens
AVHEGHAAE

SEQ ID NO: 1294711 - protein, 9 aa, Homo Sapiens
MIDNIPKET

SEQ ID NO: 1294712 - protein, 9 aa, Homo Sapiens
RKKDTVQLS

SEQ ID NO: 1294713 - protein, 9 aa, Homo Sapiens
SSITKQKNP

SEQ ID NO: 1294714 - protein, 9 aa, Homo Sapiens
PQRRRLQKR

SEQ ID NO: 1294715 - protein, 9 aa, Homo Sapiens
RQRWRRRPV

SEQ ID NO: 1294716 - protein, 9 aa, Homo Sapiens
LPQALNRLC

SEQ ID NO: 1294717 - protein, 9 aa, Homo Sapiens
AALQGEAAG

SEQ ID NO: 1294718 - protein, 9 aa, Homo Sapiens
LQGPPCGRW

SEQ ID NO: 1294719 - protein, 9 aa, Homo Sapiens
NFHFQKDFL

SEQ ID NO: 1294720 - protein, 9 aa, Homo Sapiens
RKCRQAGMW

SEQ ID NO: 1294721 - protein, 9 aa, Homo Sapiens
LPGFLAHEK

SEQ ID NO: 1294722 - protein, 9 aa, Homo Sapiens
QPPDRRGSG

SEQ ID NO: 1294723 - protein, 9 aa, Homo Sapiens
EVPPRFHCQ

SEQ ID NO: 1294724 - protein, 9 aa, Homo Sapiens
RALGQVRDH

SEQ ID NO: 1294725 - protein, 9 aa, Homo Sapiens
RRKPCLCTV

SEQ ID NO: 1294726 - protein, 9 aa, Homo Sapiens
PGSWVSCGT

SEQ ID NO: 1294727 - protein, 9 aa, Homo Sapiens
QDPGLALRK

SEQ ID NO: 1294728 - protein, 9 aa, Homo Sapiens
AGAAGKRVL

SEQ ID NO: 1294729 - protein, 9 aa, Homo Sapiens
GLMASKKDS

SEQ ID NO: 1294730 - protein, 9 aa, Homo Sapiens
PRGGAWKSI

SEQ ID NO: 1294731 - protein, 9 aa, Homo Sapiens
TEFGVEAFS

SEQ ID NO: 1294732 - protein, 9 aa, Homo Sapiens
SPHPQVPPQ

SEQ ID NO: 1294733 - protein, 9 aa, Homo Sapiens
NEMSDVVVQ

SEQ ID NO: 1294734 - protein, 9 aa, Homo Sapiens
FASFIERMH

SEQ ID NO: 1294735 - protein, 9 aa, Homo Sapiens
NKGRRKSGI

SEQ ID NO: 1294736 - protein, 9 aa, Homo Sapiens
RNLSQSNSQ

SEQ ID NO: 1294737 - protein, 9 aa, Homo Sapiens
RPRAGLLGR

SEQ ID NO: 1294738 - protein, 9 aa, Homo Sapiens
QKKLTVPHS

SEQ ID NO: 1294739 - protein, 9 aa, Homo Sapiens
VSAVTGTLA

SEQ ID NO: 1294740 - protein, 9 aa, Homo Sapiens
YLQAVGMFQ

SEQ ID NO: 1294741 - protein, 9 aa, Homo Sapiens
VLCGGRVEA

SEQ ID NO: 1294742 - protein, 9 aa, Homo Sapiens
QPGTGGACI

SEQ ID NO: 1294743 - protein, 9 aa, Homo Sapiens
AIIHDQIKH

SEQ ID NO: 1294744 - protein, 9 aa, Homo Sapiens
LYDNRQRSA

SEQ ID NO: 1294745 - protein, 9 aa, Homo Sapiens
EQEKENLLP

SEQ ID NO: 1294746 - protein, 9 aa, Homo Sapiens
LTTDHNTQI

SEQ ID NO: 1294747 - protein, 9 aa, Homo Sapiens
SPVPTSSPA

SEQ ID NO: 1294748 - protein, 9 aa, Homo Sapiens
PPSPKPPTP

SEQ ID NO: 1294749 - protein, 9 aa, Homo Sapiens
GNPRVLSAR

SEQ ID NO: 1294750 - protein, 9 aa, Homo Sapiens
KYLNMYSTY

SEQ ID NO: 1294751 - protein, 9 aa, Homo Sapiens
LAPARPCPP

SEQ ID NO: 1294752 - protein, 9 aa, Homo Sapiens
CTPLMIASL

SEQ ID NO: 1294753 - protein, 9 aa, Homo Sapiens
RFASFIERM

SEQ ID NO: 1294754 - protein, 9 aa, Homo Sapiens
NCISGVCSA

SEQ ID NO: 1294755 - protein, 9 aa, Homo Sapiens
SPKAQPGVS

SEQ ID NO: 1294756 - protein, 9 aa, Homo Sapiens
PFAMHFIFT

SEQ ID NO: 1294757 - protein, 9 aa, Homo Sapiens
RRRREKTVR

SEQ ID NO: 1294758 - protein, 9 aa, Homo Sapiens
EMDTEWHLH

SEQ ID NO: 1294759 - protein, 9 aa, Homo Sapiens
QEQIAKRHR

SEQ ID NO: 1294760 - protein, 9 aa, Homo Sapiens
HSVHSRVLK

SEQ ID NO: 1294761 - protein, 9 aa, Homo Sapiens
KPPMPTGLR

SEQ ID NO: 1294762 - protein, 9 aa, Homo Sapiens
SKKKKKEKK

SEQ ID NO: 1294763 - protein, 9 aa, Homo Sapiens
RALTRTAMY

SEQ ID NO: 1294764 - protein, 9 aa, Homo Sapiens
VPTSSPAQG

SEQ ID NO: 1294765 - protein, 9 aa, Homo Sapiens
RALVPGSSP

SEQ ID NO: 1294766 - protein, 9 aa, Homo Sapiens
LSASHFTTL

SEQ ID NO: 1294767 - protein, 9 aa, Homo Sapiens
WSPSTRTTA

SEQ ID NO: 1294768 - protein, 9 aa, Homo Sapiens
HTTSTHTVM

SEQ ID NO: 1294769 - protein, 9 aa, Homo Sapiens
KSMLKKYAE

SEQ ID NO: 1294770 - protein, 9 aa, Homo Sapiens
SKSSVSGST

SEQ ID NO: 1294771 - protein, 9 aa, Homo Sapiens
AHPSIRILI

SEQ ID NO: 1294772 - protein, 9 aa, Homo Sapiens
PSAPRPKPN

SEQ ID NO: 1294773 - protein, 9 aa, Homo Sapiens
LGSEVGGKP

SEQ ID NO: 1294774 - protein, 9 aa, Homo Sapiens
HTRLTETSV

SEQ ID NO: 1294775 - protein, 9 aa, Homo Sapiens
VGHRHHRAA

SEQ ID NO: 1294776 - protein, 9 aa, Homo Sapiens
PDFLSTFNI

SEQ ID NO: 1294777 - protein, 9 aa, Homo Sapiens
TARHKFENK

SEQ ID NO: 1294778 - protein, 9 aa, Homo Sapiens
HPHRRQVPV

SEQ ID NO: 1294779 - protein, 9 aa, Homo Sapiens
QLLDPPLIL

SEQ ID NO: 1294780 - protein, 9 aa, Homo Sapiens
IRLVHHDDY

SEQ ID NO: 1294781 - protein, 9 aa, Homo Sapiens
PGRDSGRKP

SEQ ID NO: 1294782 - protein, 9 aa, Homo Sapiens
REARGGGGH

SEQ ID NO: 1294783 - protein, 9 aa, Homo Sapiens
AIDHLCHII

SEQ ID NO: 1294784 - protein, 9 aa, Homo Sapiens
WSRSSCRSK

SEQ ID NO: 1294785 - protein, 9 aa, Homo Sapiens
TVKETRTEG

SEQ ID NO: 1294786 - protein, 9 aa, Homo Sapiens
FIKQKCIEQ

SEQ ID NO: 1294787 - protein, 9 aa, Homo Sapiens
CTVSLASTS

SEQ ID NO: 1294788 - protein, 9 aa, Homo Sapiens
PTSSPAQGH

SEQ ID NO: 1294789 - protein, 9 aa, Homo Sapiens
TPSLCPPTA

SEQ ID NO: 1294790 - protein, 9 aa, Homo Sapiens
RGGTTIGEV

SEQ ID NO: 1294791 - protein, 9 aa, Homo Sapiens
SDLSISYEG

SEQ ID NO: 1294792 - protein, 9 aa, Homo Sapiens
HSLVDYSQN

SEQ ID NO: 1294793 - protein, 9 aa, Homo Sapiens
MPGSMSCWA

SEQ ID NO: 1294794 - protein, 9 aa, Homo Sapiens
RGPAPAAQV

SEQ ID NO: 1294795 - protein, 9 aa, Homo Sapiens
VPAAGVPPD

SEQ ID NO: 1294796 - protein, 9 aa, Homo Sapiens
ACPARKQQV

SEQ ID NO: 1294797 - protein, 9 aa, Homo Sapiens
ILSSVLSEK

SEQ ID NO: 1294798 - protein, 9 aa, Homo Sapiens
HTFLLVIML

SEQ ID NO: 1294799 - protein, 9 aa, Homo Sapiens
FDRLQELKL

SEQ ID NO: 1294800 - protein, 9 aa, Homo Sapiens
GLHLHRQIS

SEQ ID NO: 1294801 - protein, 9 aa, Homo Sapiens
KPMVRLTRH

SEQ ID NO: 1294802 - protein, 9 aa, Homo Sapiens
LPLDQNPGA

SEQ ID NO: 1294803 - protein, 9 aa, Homo Sapiens
LQKQVENMN

SEQ ID NO: 1294804 - protein, 9 aa, Homo Sapiens
WTSKSSVSG

SEQ ID NO: 1294805 - protein, 9 aa, Homo Sapiens
RLCATTTCP

SEQ ID NO: 1294806 - protein, 9 aa, Homo Sapiens
RSPYCITEF

SEQ ID NO: 1294807 - protein, 9 aa, Homo Sapiens
WEECVLSEE

SEQ ID NO: 1294808 - protein, 9 aa, Homo Sapiens
TVRHVLHFN

SEQ ID NO: 1294809 - protein, 9 aa, Homo Sapiens
GSMSCWALA

SEQ ID NO: 1294810 - protein, 9 aa, Homo Sapiens
QGPAAWSSV

SEQ ID NO: 1294811 - protein, 9 aa, Homo Sapiens
GRRPRAGLL

SEQ ID NO: 1294812 - protein, 9 aa, Homo Sapiens
MTACSILAR

SEQ ID NO: 1294813 - protein, 9 aa, Homo Sapiens
NDFAISKDD

SEQ ID NO: 1294814 - protein, 9 aa, Homo Sapiens
VHLPFFYGS

SEQ ID NO: 1294815 - protein, 9 aa, Homo Sapiens
DVAEEEAVP

SEQ ID NO: 1294816 - protein, 9 aa, Homo Sapiens
SRAWQDVEV

SEQ ID NO: 1294817 - protein, 9 aa, Homo Sapiens
LLFCLVLML

SEQ ID NO: 1294818 - protein, 9 aa, Homo Sapiens
VENMNIFFS

SEQ ID NO: 1294819 - protein, 9 aa, Homo Sapiens
MFLILLQSF

SEQ ID NO: 1294820 - protein, 9 aa, Homo Sapiens
AAGKRVLCG

SEQ ID NO: 1294821 - protein, 9 aa, Homo Sapiens
GSQHLLFEA

SEQ ID NO: 1294822 - protein, 9 aa, Homo Sapiens
ARGQLSCSW

SEQ ID NO: 1294823 - protein, 9 aa, Homo Sapiens
LHLHRQISL

SEQ ID NO: 1294824 - protein, 9 aa, Homo Sapiens
EEQEKENLL

SEQ ID NO: 1294825 - protein, 9 aa, Homo Sapiens
RLEVSLTTD

SEQ ID NO: 1294826 - protein, 9 aa, Homo Sapiens
CRISTEEKL

SEQ ID NO: 1294827 - protein, 9 aa, Homo Sapiens
NIQIHSQET

SEQ ID NO: 1294828 - protein, 9 aa, Homo Sapiens
NLYRCCDQP

SEQ ID NO: 1294829 - protein, 9 aa, Homo Sapiens
YCFLFLGRN

SEQ ID NO: 1294830 - protein, 9 aa, Homo Sapiens
SRDGWGAMA

SEQ ID NO: 1294831 - protein, 9 aa, Homo Sapiens
TRLEGLNDL

SEQ ID NO: 1294832 - protein, 9 aa, Homo Sapiens
GSEVGGKPE

SEQ ID NO: 1294833 - protein, 9 aa, Homo Sapiens
MAQKNCLVK

SEQ ID NO: 1294834 - protein, 9 aa, Homo Sapiens
RPRRGRELW

SEQ ID NO: 1294835 - protein, 9 aa, Homo Sapiens
RVKLFWMVW

SEQ ID NO: 1294836 - protein, 9 aa, Homo Sapiens
SLLKSCSCM

SEQ ID NO: 1294837 - protein, 9 aa, Homo Sapiens
VELKPHVFE

SEQ ID NO: 1294838 - protein, 9 aa, Homo Sapiens
ERVETRPNY

SEQ ID NO: 1294839 - protein, 9 aa, Homo Sapiens
GSLQPQHTM

SEQ ID NO: 1294840 - protein, 9 aa, Homo Sapiens
ARLFFCIFS

SEQ ID NO: 1294841 - protein, 9 aa, Homo Sapiens
EYREARGGG

SEQ ID NO: 1294842 - protein, 9 aa, Homo Sapiens
TTRPCRRSS

SEQ ID NO: 1294843 - protein, 9 aa, Homo Sapiens
PSGCQGRPR

SEQ ID NO: 1294844 - protein, 9 aa, Homo Sapiens
ATRCMGSRQ

SEQ ID NO: 1294845 - protein, 9 aa, Homo Sapiens
KPLSCKHLI

SEQ ID NO: 1294846 - protein, 9 aa, Homo Sapiens
DVARAPAAV

SEQ ID NO: 1294847 - protein, 9 aa, Homo Sapiens
LLCQCDKKR

SEQ ID NO: 1294848 - protein, 9 aa, Homo Sapiens
QSVELKPHV

SEQ ID NO: 1294849 - protein, 9 aa, Homo Sapiens
EGLTLESNC

SEQ ID NO: 1294850 - protein, 9 aa, Homo Sapiens
TELTRVRDA

SEQ ID NO: 1294851 - protein, 9 aa, Homo Sapiens
GGACIPFRV

SEQ ID NO: 1294852 - protein, 9 aa, Homo Sapiens
PRPKPNLDR

SEQ ID NO: 1294853 - protein, 9 aa, Homo Sapiens
ISMPTMRNS

SEQ ID NO: 1294854 - protein, 9 aa, Homo Sapiens
VAALAGGVC

SEQ ID NO: 1294855 - protein, 9 aa, Homo Sapiens
GPPRPTVAF

SEQ ID NO: 1294856 - protein, 9 aa, Homo Sapiens
PPTPCSSAR

SEQ ID NO: 1294857 - protein, 9 aa, Homo Sapiens
FVLVNLEVT

SEQ ID NO: 1294858 - protein, 9 aa, Homo Sapiens
TGWDKKRKQ

SEQ ID NO: 1294859 - protein, 9 aa, Homo Sapiens
CSHGGGCFL

SEQ ID NO: 1294860 - protein, 9 aa, Homo Sapiens
AELDWVAET

SEQ ID NO: 1294861 - protein, 9 aa, Homo Sapiens
SNHAFNQSV

SEQ ID NO: 1294862 - protein, 9 aa, Homo Sapiens
DDMQELLSC

SEQ ID NO: 1294863 - protein, 9 aa, Homo Sapiens
VFGINNLDH

SEQ ID NO: 1294864 - protein, 9 aa, Homo Sapiens
CSSEPGKLD

SEQ ID NO: 1294865 - protein, 9 aa, Homo Sapiens
GSPLCMAPE

SEQ ID NO: 1294866 - protein, 9 aa, Homo Sapiens
WKRLKLCAD

SEQ ID NO: 1294867 - protein, 9 aa, Homo Sapiens
HRRCSQGGG

SEQ ID NO: 1294868 - protein, 9 aa, Homo Sapiens
FLAHEKAAV

SEQ ID NO: 1294869 - protein, 9 aa, Homo Sapiens
LLREHAPEQ

SEQ ID NO: 1294870 - protein, 9 aa, Homo Sapiens
DNAPPSPKP

SEQ ID NO: 1294871 - protein, 9 aa, Homo Sapiens
RRLQKRRQG

SEQ ID NO: 1294872 - protein, 9 aa, Homo Sapiens
MVVLNKSLN

SEQ ID NO: 1294873 - protein, 9 aa, Homo Sapiens
GQSEGLMSR

SEQ ID NO: 1294874 - protein, 9 aa, Homo Sapiens
GAHHCQYKL

SEQ ID NO: 1294875 - protein, 9 aa, Homo Sapiens
DLGAPDGIG

SEQ ID NO: 1294876 - protein, 9 aa, Homo Sapiens
PPHPVLLSI

SEQ ID NO: 1294877 - protein, 9 aa, Homo Sapiens
RTQQRPPWR

SEQ ID NO: 1294878 - protein, 9 aa, Homo Sapiens
ALQGNRLMV

SEQ ID NO: 1294879 - protein, 9 aa, Homo Sapiens
GRPVDDDAL

SEQ ID NO: 1294880 - protein, 9 aa, Homo Sapiens
AMDVLHRQV

SEQ ID NO: 1294881 - protein, 9 aa, Homo Sapiens
TVTLYLETP

SEQ ID NO: 1294882 - protein, 9 aa, Homo Sapiens
RQRSPSQRS

SEQ ID NO: 1294883 - protein, 9 aa, Homo Sapiens
PPHQMKCLT

SEQ ID NO: 1294884 - protein, 9 aa, Homo Sapiens
PTVAFLPPM

SEQ ID NO: 1294885 - protein, 9 aa, Homo Sapiens
YLFPIVHIF

SEQ ID NO: 1294886 - protein, 9 aa, Homo Sapiens
RARAGVCCE

SEQ ID NO: 1294887 - protein, 9 aa, Homo Sapiens
GPHPPWSRS

SEQ ID NO: 1294888 - protein, 9 aa, Homo Sapiens
KIRQKKPLY

SEQ ID NO: 1294889 - protein, 9 aa, Homo Sapiens
VAPATLPCR

SEQ ID NO: 1294890 - protein, 9 aa, Homo Sapiens
PGPGMAVPR

SEQ ID NO: 1294891 - protein, 9 aa, Homo Sapiens
YLNPWKKIN

SEQ ID NO: 1294892 - protein, 9 aa, Homo Sapiens
VGRPVDDDA

SEQ ID NO: 1294893 - protein, 9 aa, Homo Sapiens
QTQCGTMWS

SEQ ID NO: 1294894 - protein, 9 aa, Homo Sapiens
PGGGRVWAA

SEQ ID NO: 1294895 - protein, 9 aa, Homo Sapiens
IDGKNDIKA

SEQ ID NO: 1294896 - protein, 9 aa, Homo Sapiens
LCPPTAPWR

SEQ ID NO: 1294897 - protein, 9 aa, Homo Sapiens
GRVCAEKWN

SEQ ID NO: 1294898 - protein, 9 aa, Homo Sapiens
KVAVTPVKN

SEQ ID NO: 1294899 - protein, 9 aa, Homo Sapiens
STHYHSLVD

SEQ ID NO: 1294900 - protein, 9 aa, Homo Sapiens
WILYDNRQR

SEQ ID NO: 1294901 - protein, 9 aa, Homo Sapiens
GAAAAAGAA

SEQ ID NO: 1294902 - protein, 9 aa, Homo Sapiens
VQKEAAFAV

SEQ ID NO: 1294903 - protein, 9 aa, Homo Sapiens
PPLVIKIPE

SEQ ID NO: 1294904 - protein, 9 aa, Homo Sapiens
QCGEYGKSF

SEQ ID NO: 1294905 - protein, 9 aa, Homo Sapiens
GKRCNPCCR

SEQ ID NO: 1294906 - protein, 9 aa, Homo Sapiens
HVQLHDVGE

SEQ ID NO: 1294907 - protein, 9 aa, Homo Sapiens
SIWATVRVM

SEQ ID NO: 1294908 - protein, 9 aa, Homo Sapiens
DITTLITYI

SEQ ID NO: 1294909 - protein, 9 aa, Homo Sapiens
DADTFEDKL

SEQ ID NO: 1294910 - protein, 9 aa, Homo Sapiens
SARGGEGRS

SEQ ID NO: 1294911 - protein, 9 aa, Homo Sapiens
AVEPHGRRA

SEQ ID NO: 1294912 - protein, 9 aa, Homo Sapiens
HQDAGAQRG

SEQ ID NO: 1294913 - protein, 9 aa, Homo Sapiens
SAPRPKPNL

SEQ ID NO: 1294914 - protein, 9 aa, Homo Sapiens
VLPQAVSSG

SEQ ID NO: 1294915 - protein, 9 aa, Homo Sapiens
ELANFHFQK

SEQ ID NO: 1294916 - protein, 9 aa, Homo Sapiens
KLKSMLKKY

SEQ ID NO: 1294917 - protein, 9 aa, Homo Sapiens
TALVERLRQ

SEQ ID NO: 1294918 - protein, 9 aa, Homo Sapiens
SFCFSPLWL

SEQ ID NO: 1294919 - protein, 9 aa, Homo Sapiens
CCDFLKQLR

SEQ ID NO: 1294920 - protein, 9 aa, Homo Sapiens
ALRARGGTT

SEQ ID NO: 1294921 - protein, 9 aa, Homo Sapiens
PAAQGHLDP

SEQ ID NO: 1294922 - protein, 9 aa, Homo Sapiens
KHLLRPRRG

SEQ ID NO: 1294923 - protein, 9 aa, Homo Sapiens
LEKVSKKRL

SEQ ID NO: 1294924 - protein, 9 aa, Homo Sapiens
SLLQYMIAL

SEQ ID NO: 1294925 - protein, 9 aa, Homo Sapiens
KCLTAVDCL

SEQ ID NO: 1294926 - protein, 9 aa, Homo Sapiens
PCSNWVETR

SEQ ID NO: 1294927 - protein, 9 aa, Homo Sapiens
QQAMRYLCS

SEQ ID NO: 1294928 - protein, 9 aa, Homo Sapiens
GLALRKTEH

SEQ ID NO: 1294929 - protein, 9 aa, Homo Sapiens
QLVTQRALL

SEQ ID NO: 1294930 - protein, 9 aa, Homo Sapiens
GSMCNTLFF

SEQ ID NO: 1294931 - protein, 9 aa, Homo Sapiens
HAWPGCFLK

SEQ ID NO: 1294932 - protein, 9 aa, Homo Sapiens
ATAPARRRI

SEQ ID NO: 1294933 - protein, 9 aa, Homo Sapiens
HSVLGTALH

SEQ ID NO: 1294934 - protein, 9 aa, Homo Sapiens
ITEFGVEAF

SEQ ID NO: 1294935 - protein, 9 aa, Homo Sapiens
CGYGEDHRA

SEQ ID NO: 1294936 - protein, 9 aa, Homo Sapiens
LTVFGEAAP

SEQ ID NO: 1294937 - protein, 9 aa, Homo Sapiens
SSSMGSPVN

SEQ ID NO: 1294938 - protein, 9 aa, Homo Sapiens
TALMVLNMA

SEQ ID NO: 1294939 - protein, 9 aa, Homo Sapiens
TTTTSSPRR

SEQ ID NO: 1294940 - protein, 9 aa, Homo Sapiens
KHFGRGIMI

SEQ ID NO: 1294941 - protein, 9 aa, Homo Sapiens
VPHPLTVLG

SEQ ID NO: 1294942 - protein, 9 aa, Homo Sapiens
ARMEGQPMR

SEQ ID NO: 1294943 - protein, 9 aa, Homo Sapiens
LGRNSFWQY

SEQ ID NO: 1294944 - protein, 9 aa, Homo Sapiens
QPQRPAVFY

SEQ ID NO: 1294945 - protein, 9 aa, Homo Sapiens
TYTKVWKMN

SEQ ID NO: 1294946 - protein, 9 aa, Homo Sapiens
QLQRGRRRP

SEQ ID NO: 1294947 - protein, 9 aa, Homo Sapiens
STASRASQP

SEQ ID NO: 1294948 - protein, 9 aa, Homo Sapiens
PQSSPFLAR

SEQ ID NO: 1294949 - protein, 9 aa, Homo Sapiens
YQPPDRRGS

SEQ ID NO: 1294950 - protein, 9 aa, Homo Sapiens
IISCIDCFG

SEQ ID NO: 1294951 - protein, 9 aa, Homo Sapiens
HRPWPALTT

SEQ ID NO: 1294952 - protein, 9 aa, Homo Sapiens
APRGRRPRA

SEQ ID NO: 1294953 - protein, 9 aa, Homo Sapiens
NLKNSSHIY

SEQ ID NO: 1294954 - protein, 9 aa, Homo Sapiens
VERVSTLTM

SEQ ID NO: 1294955 - protein, 9 aa, Homo Sapiens
QVIQDVAEE

SEQ ID NO: 1294956 - protein, 9 aa, Homo Sapiens
GHCFPAEIH

SEQ ID NO: 1294957 - protein, 9 aa, Homo Sapiens
SGLCDGDEV

SEQ ID NO: 1294958 - protein, 9 aa, Homo Sapiens
SAVHEGHAA

SEQ ID NO: 1294959 - protein, 9 aa, Homo Sapiens
PCTSAASAP

SEQ ID NO: 1294960 - protein, 9 aa, Homo Sapiens
TASNARGQL

SEQ ID NO: 1294961 - protein, 9 aa, Homo Sapiens
MLDPFTIKP

SEQ ID NO: 1294962 - protein, 9 aa, Homo Sapiens
PPPHQMKCL

SEQ ID NO: 1294963 - protein, 9 aa, Homo Sapiens
PGTPPPLIL

SEQ ID NO: 1294964 - protein, 9 aa, Homo Sapiens
GQGHSGNLP

SEQ ID NO: 1294965 - protein, 9 aa, Homo Sapiens
KTARHKFEN

SEQ ID NO: 1294966 - protein, 9 aa, Homo Sapiens
TMYNQDRHV

SEQ ID NO: 1294967 - protein, 9 aa, Homo Sapiens
APEVPRCAM

SEQ ID NO: 1294968 - protein, 9 aa, Homo Sapiens
SEVGGKPEE

SEQ ID NO: 1294969 - protein, 9 aa, Homo Sapiens
DDRNLYRCC

SEQ ID NO: 1294970 - protein, 9 aa, Homo Sapiens
SSPKAQPGV

SEQ ID NO: 1294971 - protein, 9 aa, Homo Sapiens
EGNLIQNRS

SEQ ID NO: 1294972 - protein, 9 aa, Homo Sapiens
ALIAHAVVR

SEQ ID NO: 1294973 - protein, 9 aa, Homo Sapiens
CWTAQLRAS

SEQ ID NO: 1294974 - protein, 9 aa, Homo Sapiens
RNSSIRASW

SEQ ID NO: 1294975 - protein, 9 aa, Homo Sapiens
AGEMLYLSA

SEQ ID NO: 1294976 - protein, 9 aa, Homo Sapiens
VATGSEDMC

SEQ ID NO: 1294977 - protein, 9 aa, Homo Sapiens
CGVGPHPPW

SEQ ID NO: 1294978 - protein, 9 aa, Homo Sapiens
LEVGADKQV

SEQ ID NO: 1294979 - protein, 9 aa, Homo Sapiens
SQPSSSVWS

SEQ ID NO: 1294980 - protein, 9 aa, Homo Sapiens
VPVWNQQGV

SEQ ID NO: 1294981 - protein, 9 aa, Homo Sapiens
PRLTPPHAD

SEQ ID NO: 1294982 - protein, 9 aa, Homo Sapiens
QLGDDLEPT

SEQ ID NO: 1294983 - protein, 9 aa, Homo Sapiens
TNHQEPVNF

SEQ ID NO: 1294984 - protein, 9 aa, Homo Sapiens
RCARKDNLE

SEQ ID NO: 1294985 - protein, 9 aa, Homo Sapiens
GERTALVER

SEQ ID NO: 1294986 - protein, 9 aa, Homo Sapiens
RSRLTDYYE

SEQ ID NO: 1294987 - protein, 9 aa, Homo Sapiens
IQKIRQKKP

SEQ ID NO: 1294988 - protein, 9 aa, Homo Sapiens
QEGRGEAIY

SEQ ID NO: 1294989 - protein, 9 aa, Homo Sapiens
LPMSFSRRG

SEQ ID NO: 1294990 - protein, 9 aa, Homo Sapiens
DHYLFPIVH

SEQ ID NO: 1294991 - protein, 9 aa, Homo Sapiens
GEPGWQPAE

SEQ ID NO: 1294992 - protein, 9 aa, Homo Sapiens
LIAIIHDQI

SEQ ID NO: 1294993 - protein, 9 aa, Homo Sapiens
SFIERMHEL

SEQ ID NO: 1294994 - protein, 9 aa, Homo Sapiens
VRTERGCAF

SEQ ID NO: 1294995 - protein, 9 aa, Homo Sapiens
PCWAPAPGS

SEQ ID NO: 1294996 - protein, 9 aa, Homo Sapiens
RQQLVTQRA

SEQ ID NO: 1294997 - protein, 9 aa, Homo Sapiens
DTPPVHQVL

SEQ ID NO: 1294998 - protein, 9 aa, Homo Sapiens
PEPPVPPDG

SEQ ID NO: 1294999 - protein, 9 aa, Homo Sapiens
TVSISTVGY

SEQ ID NO: 1295000 - protein, 9 aa, Homo Sapiens
WVPDAASTS

SEQ ID NO: 1295001 - protein, 9 aa, Homo Sapiens
GGGCWARAG

SEQ ID NO: 1295002 - protein, 9 aa, Homo Sapiens
LGLALQPAA

SEQ ID NO: 1295003 - protein, 9 aa, Homo Sapiens
MDFTLLVQA

SEQ ID NO: 1295004 - protein, 9 aa, Homo Sapiens
SLGIIWPKS

SEQ ID NO: 1295005 - protein, 9 aa, Homo Sapiens
RNLLRLQSL

SEQ ID NO: 1295006 - protein, 9 aa, Homo Sapiens
ELEATFGCQ

SEQ ID NO: 1295007 - protein, 9 aa, Homo Sapiens
QKIRQKKPL

SEQ ID NO: 1295008 - protein, 9 aa, Homo Sapiens
HHRAAPGHV

SEQ ID NO: 1295009 - protein, 9 aa, Homo Sapiens
VPGGSRPGW

SEQ ID NO: 1295010 - protein, 9 aa, Homo Sapiens
IVDSKHFGR

SEQ ID NO: 1295011 - protein, 9 aa, Homo Sapiens
IKGECQVKK

SEQ ID NO: 1295012 - protein, 9 aa, Homo Sapiens
LVHNGWGDL

SEQ ID NO: 1295013 - protein, 9 aa, Homo Sapiens
LSEFSPDSS

SEQ ID NO: 1295014 - protein, 9 aa, Homo Sapiens
LRGEREERS

SEQ ID NO: 1295015 - protein, 9 aa, Homo Sapiens
LEGEKTSEL

SEQ ID NO: 1295016 - protein, 9 aa, Homo Sapiens
HVVKMADFG

SEQ ID NO: 1295017 - protein, 9 aa, Homo Sapiens
RPAVFYTFN

SEQ ID NO: 1295018 - protein, 9 aa, Homo Sapiens
ASNDPSTPA

SEQ ID NO: 1295019 - protein, 9 aa, Homo Sapiens
SPSTRTTAT

SEQ ID NO: 1295020 - protein, 9 aa, Homo Sapiens
VLLEALFLI

SEQ ID NO: 1295021 - protein, 9 aa, Homo Sapiens
KRFFAHLLV

SEQ ID NO: 1295022 - protein, 9 aa, Homo Sapiens
SSHIYYENI

SEQ ID NO: 1295023 - protein, 9 aa, Homo Sapiens
LLVNMGGNR

SEQ ID NO: 1295024 - protein, 9 aa, Homo Sapiens
DAGAQRGQP

SEQ ID NO: 1295025 - protein, 9 aa, Homo Sapiens
SGSDDDDDD

SEQ ID NO: 1295026 - protein, 9 aa, Homo Sapiens
LGQRRLSAN

SEQ ID NO: 1295027 - protein, 9 aa, Homo Sapiens
IRAAVSFLT

SEQ ID NO: 1295028 - protein, 9 aa, Homo Sapiens
TFMWLVSSS

SEQ ID NO: 1295029 - protein, 9 aa, Homo Sapiens
VTVGNTIYA

SEQ ID NO: 1295030 - protein, 9 aa, Homo Sapiens
KEGGRDFLQ

SEQ ID NO: 1295031 - protein, 9 aa, Homo Sapiens
AALAGGVCP

SEQ ID NO: 1295032 - protein, 9 aa, Homo Sapiens
SMPTMRNSA

SEQ ID NO: 1295033 - protein, 9 aa, Homo Sapiens
CAMAPETTL

SEQ ID NO: 1295034 - protein, 9 aa, Homo Sapiens
MVLNMALAD

SEQ ID NO: 1295035 - protein, 9 aa, Homo Sapiens
HRHHRAAPG

SEQ ID NO: 1295036 - protein, 9 aa, Homo Sapiens
GRARAGVCC

SEQ ID NO: 1295037 - protein, 9 aa, Homo Sapiens
ILNCIWKVL

SEQ ID NO: 1295038 - protein, 9 aa, Homo Sapiens
QEAKVSIWA

SEQ ID NO: 1295039 - protein, 9 aa, Homo Sapiens
SGAAISQHS

SEQ ID NO: 1295040 - protein, 9 aa, Homo Sapiens
NLDRLMGAF

SEQ ID NO: 1295041 - protein, 9 aa, Homo Sapiens
RLGRREQRA

SEQ ID NO: 1295042 - protein, 9 aa, Homo Sapiens
SGGCGFELD

SEQ ID NO: 1295043 - protein, 9 aa, Homo Sapiens
CATYMNVNI

SEQ ID NO: 1295044 - protein, 9 aa, Homo Sapiens
PQPSPHPQV

SEQ ID NO: 1295045 - protein, 9 aa, Homo Sapiens
SCSTAWSGS

SEQ ID NO: 1295046 - protein, 9 aa, Homo Sapiens
PGGGQLSWG

SEQ ID NO: 1295047 - protein, 9 aa, Homo Sapiens
DLKLFDRLQ

SEQ ID NO: 1295048 - protein, 9 aa, Homo Sapiens
PDHVLLTFD

SEQ ID NO: 1295049 - protein, 9 aa, Homo Sapiens
DSQEKMDPS

SEQ ID NO: 1295050 - protein, 9 aa, Homo Sapiens
PRLTHPACA

SEQ ID NO: 1295051 - protein, 9 aa, Homo Sapiens
QGGRILLQR

SEQ ID NO: 1295052 - protein, 9 aa, Homo Sapiens
ARGGTTIGE

SEQ ID NO: 1295053 - protein, 9 aa, Homo Sapiens
KEKLSALRI

SEQ ID NO: 1295054 - protein, 9 aa, Homo Sapiens
TVTLIECEC

SEQ ID NO: 1295055 - protein, 9 aa, Homo Sapiens
LLEAFPLPR

SEQ ID NO: 1295056 - protein, 9 aa, Homo Sapiens
SEGGPPRPT

SEQ ID NO: 1295057 - protein, 9 aa, Homo Sapiens
PWALLLVRI

SEQ ID NO: 1295058 - protein, 9 aa, Homo Sapiens
RFHVATNTL

SEQ ID NO: 1295059 - protein, 9 aa, Homo Sapiens
PHPPWSRSS

SEQ ID NO: 1295060 - protein, 9 aa, Homo Sapiens
LQPGTGGAC

SEQ ID NO: 1295061 - protein, 9 aa, Homo Sapiens
KRDRQQQQG

SEQ ID NO: 1295062 - protein, 9 aa, Homo Sapiens
QQLEFSMPP

SEQ ID NO: 1295063 - protein, 9 aa, Homo Sapiens
KMSEPKDAA

SEQ ID NO: 1295064 - protein, 9 aa, Homo Sapiens
EFGVEAFSD

SEQ ID NO: 1295065 - protein, 9 aa, Homo Sapiens
GIVVAMGQD

SEQ ID NO: 1295066 - protein, 9 aa, Homo Sapiens
APAVEPHGR

SEQ ID NO: 1295067 - protein, 9 aa, Homo Sapiens
LVEEQVAVV

SEQ ID NO: 1295068 - protein, 9 aa, Homo Sapiens
GTALHGDVC

SEQ ID NO: 1295069 - protein, 9 aa, Homo Sapiens
DLKDRYYSG

SEQ ID NO: 1295070 - protein, 9 aa, Homo Sapiens
VLHRQVLPF

SEQ ID NO: 1295071 - protein, 9 aa, Homo Sapiens
PAAGVPPDR

SEQ ID NO: 1295072 - protein, 9 aa, Homo Sapiens
EPRNPDARS

SEQ ID NO: 1295073 - protein, 9 aa, Homo Sapiens
LDEDAPPNE

SEQ ID NO: 1295074 - protein, 9 aa, Homo Sapiens
FFSIKHSIW

SEQ ID NO: 1295075 - protein, 9 aa, Homo Sapiens
TDKLKSMLK

SEQ ID NO: 1295076 - protein, 9 aa, Homo Sapiens
GFGFLLQEE

SEQ ID NO: 1295077 - protein, 9 aa, Homo Sapiens
YREARGGGG

SEQ ID NO: 1295078 - protein, 9 aa, Homo Sapiens
DNQWLGSHF

SEQ ID NO: 1295079 - protein, 9 aa, Homo Sapiens
SGLYQGMKA

SEQ ID NO: 1295080 - protein, 9 aa, Homo Sapiens
ELHLLGPLD

SEQ ID NO: 1295081 - protein, 9 aa, Homo Sapiens
CGTGAAGAA

SEQ ID NO: 1295082 - protein, 9 aa, Homo Sapiens
QDIACLLSV

SEQ ID NO: 1295083 - protein, 9 aa, Homo Sapiens
GRRAVVLLL

SEQ ID NO: 1295084 - protein, 9 aa, Homo Sapiens
TQEPLHLVN

SEQ ID NO: 1295085 - protein, 9 aa, Homo Sapiens
CQRKRRQRQ

SEQ ID NO: 1295086 - protein, 9 aa, Homo Sapiens
WRPRACSLH

SEQ ID NO: 1295087 - protein, 9 aa, Homo Sapiens
CVRPLVERF

SEQ ID NO: 1295088 - protein, 9 aa, Homo Sapiens
HPSRPCRMR

SEQ ID NO: 1295089 - protein, 9 aa, Homo Sapiens
SLHDTLQEL

SEQ ID NO: 1295090 - protein, 9 aa, Homo Sapiens
TLVVLSGIL

SEQ ID NO: 1295091 - protein, 9 aa, Homo Sapiens
VTTTQWSLA

SEQ ID NO: 1295092 - protein, 9 aa, Homo Sapiens
RAQRAGALI

SEQ ID NO: 1295093 - protein, 9 aa, Homo Sapiens
DALLSRMQA

SEQ ID NO: 1295094 - protein, 9 aa, Homo Sapiens
AQQASTQSS

SEQ ID NO: 1295095 - protein, 9 aa, Homo Sapiens
YDPRSLNIV

SEQ ID NO: 1295096 - protein, 9 aa, Homo Sapiens
SLASTSGKL

SEQ ID NO: 1295097 - protein, 9 aa, Homo Sapiens
GGRGQVHPA

SEQ ID NO: 1295098 - protein, 9 aa, Homo Sapiens
ERTALVERL

SEQ ID NO: 1295099 - protein, 9 aa, Homo Sapiens
SVDLPNTGR

SEQ ID NO: 1295100 - protein, 9 aa, Homo Sapiens
RWSVRTGAL

SEQ ID NO: 1295101 - protein, 9 aa, Homo Sapiens
FSIKHSIWS

SEQ ID NO: 1295102 - protein, 9 aa, Homo Sapiens
GGRVWAAKG

SEQ ID NO: 1295103 - protein, 9 aa, Homo Sapiens
AGHWTSKSS

SEQ ID NO: 1295104 - protein, 9 aa, Homo Sapiens
KVPGGSRPG

SEQ ID NO: 1295105 - protein, 9 aa, Homo Sapiens
VVKMADFGL

SEQ ID NO: 1295106 - protein, 9 aa, Homo Sapiens
PLQIDTKPE

SEQ ID NO: 1295107 - protein, 9 aa, Homo Sapiens
ARSFYYKLH

SEQ ID NO: 1295108 - protein, 9 aa, Homo Sapiens
PCSSARTTA

SEQ ID NO: 1295109 - protein, 9 aa, Homo Sapiens
LAGGVCPPG

SEQ ID NO: 1295110 - protein, 9 aa, Homo Sapiens
HNTQIHACR

SEQ ID NO: 1295111 - protein, 9 aa, Homo Sapiens
VGLGDLHQA

SEQ ID NO: 1295112 - protein, 9 aa, Homo Sapiens
SAPQTETRA

SEQ ID NO: 1295113 - protein, 9 aa, Homo Sapiens
GDARHSPEL

SEQ ID NO: 1295114 - protein, 9 aa, Homo Sapiens
VRGRGGPRL

SEQ ID NO: 1295115 - protein, 9 aa, Homo Sapiens
GDVARAPAA

SEQ ID NO: 1295116 - protein, 9 aa, Homo Sapiens
NKLQALVPD

SEQ ID NO: 1295117 - protein, 9 aa, Homo Sapiens
FGCQMSPDI

SEQ ID NO: 1295118 - protein, 9 aa, Homo Sapiens
ENLLPPSRR

SEQ ID NO: 1295119 - protein, 9 aa, Homo Sapiens
GQHELQVPQ

SEQ ID NO: 1295120 - protein, 9 aa, Homo Sapiens
QHSGRQWGA

SEQ ID NO: 1295121 - protein, 9 aa, Homo Sapiens
LVFTVLEFR

SEQ ID NO: 1295122 - protein, 9 aa, Homo Sapiens
IITWSENTR

SEQ ID NO: 1295123 - protein, 9 aa, Homo Sapiens
CCVRPLVER

SEQ ID NO: 1295124 - protein, 9 aa, Homo Sapiens
YYELRSILR

SEQ ID NO: 1295125 - protein, 9 aa, Homo Sapiens
TQASLASKD

SEQ ID NO: 1295126 - protein, 9 aa, Homo Sapiens
KSIFRLYSR

SEQ ID NO: 1295127 - protein, 9 aa, Homo Sapiens
VGVPAFVQG

SEQ ID NO: 1295128 - protein, 9 aa, Homo Sapiens
SHPSDVMEM

SEQ ID NO: 1295129 - protein, 9 aa, Homo Sapiens
NSWNESPLC

SEQ ID NO: 1295130 - protein, 9 aa, Homo Sapiens
VEHARGPQR

SEQ ID NO: 1295131 - protein, 9 aa, Homo Sapiens
AFQAPPSCL

SEQ ID NO: 1295132 - protein, 9 aa, Homo Sapiens
VHSRVLKNQ

SEQ ID NO: 1295133 - protein, 9 aa, Homo Sapiens
EIESEAKKN

SEQ ID NO: 1295134 - protein, 9 aa, Homo Sapiens
RSFYYKLHA

SEQ ID NO: 1295135 - protein, 9 aa, Homo Sapiens
NPRVLSARA

SEQ ID NO: 1295136 - protein, 9 aa, Homo Sapiens
IYNLIAIIH

SEQ ID NO: 1295137 - protein, 9 aa, Homo Sapiens
WARAGGHQQ

SEQ ID NO: 1295138 - protein, 9 aa, Homo Sapiens
NFIMRMNQV

SEQ ID NO: 1295139 - protein, 9 aa, Homo Sapiens
CPTATAACP

SEQ ID NO: 1295140 - protein, 9 aa, Homo Sapiens
ITKQKNPTQ

SEQ ID NO: 1295141 - protein, 9 aa, Homo Sapiens
APRHPHRSP

SEQ ID NO: 1295142 - protein, 9 aa, Homo Sapiens
SEWAGSDVF

SEQ ID NO: 1295143 - protein, 9 aa, Homo Sapiens
TLPAPTACS

SEQ ID NO: 1295144 - protein, 9 aa, Homo Sapiens
AVTPVKNWH

SEQ ID NO: 1295145 - protein, 9 aa, Homo Sapiens
AHQDAGAQR

SEQ ID NO: 1295146 - protein, 9 aa, Homo Sapiens
WLRGGRRGA

SEQ ID NO: 1295147 - protein, 9 aa, Homo Sapiens
LKRKCREKD

SEQ ID NO: 1295148 - protein, 9 aa, Homo Sapiens
LSALRISNL

SEQ ID NO: 1295149 - protein, 9 aa, Homo Sapiens
PTMPGSMSC

SEQ ID NO: 1295150 - protein, 9 aa, Homo Sapiens
RHRTLPAFT

SEQ ID NO: 1295151 - protein, 9 aa, Homo Sapiens
IGSLNKHTA

SEQ ID NO: 1295152 - protein, 9 aa, Homo Sapiens
NLLTGETPP

SEQ ID NO: 1295153 - protein, 9 aa, Homo Sapiens
NPTVQWDGA

SEQ ID NO: 1295154 - protein, 9 aa, Homo Sapiens
LESTKRRLS

SEQ ID NO: 1295155 - protein, 9 aa, Homo Sapiens
GGSLFTTGS

SEQ ID NO: 1295156 - protein, 9 aa, Homo Sapiens
CPAVERVST

SEQ ID NO: 1295157 - protein, 9 aa, Homo Sapiens
SLYLQTRVL

SEQ ID NO: 1295158 - protein, 9 aa, Homo Sapiens
PPAGRGAPR

SEQ ID NO: 1295159 - protein, 9 aa, Homo Sapiens
DRDSSTNAQ

SEQ ID NO: 1295160 - protein, 9 aa, Homo Sapiens
RPPGEKLSP

SEQ ID NO: 1295161 - protein, 9 aa, Homo Sapiens
REQRARRAP

SEQ ID NO: 1295162 - protein, 9 aa, Homo Sapiens
VDNVYCVGQ

SEQ ID NO: 1295163 - protein, 9 aa, Homo Sapiens
QKHLLRPRR

SEQ ID NO: 1295164 - protein, 9 aa, Homo Sapiens
GQAHQDAGA

SEQ ID NO: 1295165 - protein, 9 aa, Homo Sapiens
GDTEALVQA

SEQ ID NO: 1295166 - protein, 9 aa, Homo Sapiens
MSSMACGSA

SEQ ID NO: 1295167 - protein, 9 aa, Homo Sapiens
QRGRRRPGR

SEQ ID NO: 1295168 - protein, 9 aa, Homo Sapiens
MALADLAVL

SEQ ID NO: 1295169 - protein, 9 aa, Homo Sapiens
CLHWSLMSE

SEQ ID NO: 1295170 - protein, 9 aa, Homo Sapiens
PPAKKNKEN

SEQ ID NO: 1295171 - protein, 9 aa, Homo Sapiens
DCSLCGKKE

SEQ ID NO: 1295172 - protein, 9 aa, Homo Sapiens
GLRVAKRQQ

SEQ ID NO: 1295173 - protein, 9 aa, Homo Sapiens
TRLEVSLTT

SEQ ID NO: 1295174 - protein, 9 aa, Homo Sapiens
ITPPPHQMK

SEQ ID NO: 1295175 - protein, 9 aa, Homo Sapiens
KNKGRRKSG

SEQ ID NO: 1295176 - protein, 9 aa, Homo Sapiens
FFAHLLVYI

SEQ ID NO: 1295177 - protein, 9 aa, Homo Sapiens
ATPSWALPT

SEQ ID NO: 1295178 - protein, 9 aa, Homo Sapiens
GRGTCPCSA

SEQ ID NO: 1295179 - protein, 9 aa, Homo Sapiens
GASSSTSRD

SEQ ID NO: 1295180 - protein, 9 aa, Homo Sapiens
YSLLQYMIA

SEQ ID NO: 1295181 - protein, 9 aa, Homo Sapiens
VFLVVFLYM

SEQ ID NO: 1295182 - protein, 9 aa, Homo Sapiens
LNDLRRQLE

SEQ ID NO: 1295183 - protein, 9 aa, Homo Sapiens
QISLPLRGF

SEQ ID NO: 1295184 - protein, 9 aa, Homo Sapiens
GATREEEQA

SEQ ID NO: 1295185 - protein, 9 aa, Homo Sapiens
SPAGTPCSH

SEQ ID NO: 1295186 - protein, 9 aa, Homo Sapiens
PNSGYNAWL

SEQ ID NO: 1295187 - protein, 9 aa, Homo Sapiens
PHSWWWATV

SEQ ID NO: 1295188 - protein, 9 aa, Homo Sapiens
FCESTALIQ

SEQ ID NO: 1295189 - protein, 9 aa, Homo Sapiens
GTRSLTLGD

SEQ ID NO: 1295190 - protein, 9 aa, Homo Sapiens
KIVRAQRQC

SEQ ID NO: 1295191 - protein, 9 aa, Homo Sapiens
GAGPPAAQA

SEQ ID NO: 1295192 - protein, 9 aa, Homo Sapiens
TCILGQRAT

SEQ ID NO: 1295193 - protein, 9 aa, Homo Sapiens
KTLGTLVSI

SEQ ID NO: 1295194 - protein, 9 aa, Homo Sapiens
VPAGILPSS

SEQ ID NO: 1295195 - protein, 9 aa, Homo Sapiens
PHPVLLSIP

SEQ ID NO: 1295196 - protein, 9 aa, Homo Sapiens
SWYSHQKKL

SEQ ID NO: 1295197 - protein, 9 aa, Homo Sapiens
SLKFKLQLS

SEQ ID NO: 1295198 - protein, 9 aa, Homo Sapiens
QLDNGHPQD

SEQ ID NO: 1295199 - protein, 9 aa, Homo Sapiens
LCTVSLAST

SEQ ID NO: 1295200 - protein, 9 aa, Homo Sapiens
SEWTQRSPS

SEQ ID NO: 1295201 - protein, 9 aa, Homo Sapiens
FGINNLDHP

SEQ ID NO: 1295202 - protein, 9 aa, Homo Sapiens
HAVFSGSGR

SEQ ID NO: 1295203 - protein, 9 aa, Homo Sapiens
GLYQGMKAR

SEQ ID NO: 1295204 - protein, 9 aa, Homo Sapiens
RRGAPGHPG

SEQ ID NO: 1295205 - protein, 9 aa, Homo Sapiens
RANCEAAWS

SEQ ID NO: 1295206 - protein, 9 aa, Homo Sapiens
LALQKEEEV

SEQ ID NO: 1295207 - protein, 9 aa, Homo Sapiens
NMSWRPRAC

SEQ ID NO: 1295208 - protein, 9 aa, Homo Sapiens
PAAVQRLGR

SEQ ID NO: 1295209 - protein, 9 aa, Homo Sapiens
TGKNSRGPK

SEQ ID NO: 1295210 - protein, 9 aa, Homo Sapiens
HLVEEQVAV

SEQ ID NO: 1295211 - protein, 9 aa, Homo Sapiens
PVGPPPSEG

SEQ ID NO: 1295212 - protein, 9 aa, Homo Sapiens
DIQDYGLII

SEQ ID NO: 1295213 - protein, 9 aa, Homo Sapiens
NTLGEAALS

SEQ ID NO: 1295214 - protein, 9 aa, Homo Sapiens
RYLCSQCLD

SEQ ID NO: 1295215 - protein, 9 aa, Homo Sapiens
GGGPLPLDQ

SEQ ID NO: 1295216 - protein, 9 aa, Homo Sapiens
PSRHWRAAA

SEQ ID NO: 1295217 - protein, 9 aa, Homo Sapiens
EEEAIEHGL

SEQ ID NO: 1295218 - protein, 9 aa, Homo Sapiens
LCMAPEMVC

SEQ ID NO: 1295219 - protein, 9 aa, Homo Sapiens
SPALRARGG

SEQ ID NO: 1295220 - protein, 9 aa, Homo Sapiens
RGRGSCGSR

SEQ ID NO: 1295221 - protein, 9 aa, Homo Sapiens
HLTTDHNTQ

SEQ ID NO: 1295222 - protein, 9 aa, Homo Sapiens
KKEGNLIQN

SEQ ID NO: 1295223 - protein, 9 aa, Homo Sapiens
TGETPPSVE

SEQ ID NO: 1295224 - protein, 9 aa, Homo Sapiens
TVRGATSYR

SEQ ID NO: 1295225 - protein, 9 aa, Homo Sapiens
QCTAISTNI

SEQ ID NO: 1295226 - protein, 9 aa, Homo Sapiens
SLSPPHPVL

SEQ ID NO: 1295227 - protein, 9 aa, Homo Sapiens
IGLTGTGKT

SEQ ID NO: 1295228 - protein, 9 aa, Homo Sapiens
MSWRPRACS

SEQ ID NO: 1295229 - protein, 9 aa, Homo Sapiens
AGHAGGGDA

SEQ ID NO: 1295230 - protein, 9 aa, Homo Sapiens
YISALSYGG

SEQ ID NO: 1295231 - protein, 9 aa, Homo Sapiens
THPTCILGQ

SEQ ID NO: 1295232 - protein, 9 aa, Homo Sapiens
HRHQYLQSE

SEQ ID NO: 1295233 - protein, 9 aa, Homo Sapiens
KGSLVARTQ

SEQ ID NO: 1295234 - protein, 9 aa, Homo Sapiens
LPPEGMCPV

SEQ ID NO: 1295235 - protein, 9 aa, Homo Sapiens
QLLLHPHGK

SEQ ID NO: 1295236 - protein, 9 aa, Homo Sapiens
LGGWRGWWG

SEQ ID NO: 1295237 - protein, 9 aa, Homo Sapiens
KETRTEGYF

SEQ ID NO: 1295238 - protein, 9 aa, Homo Sapiens
PMRCLHLPP

SEQ ID NO: 1295239 - protein, 9 aa, Homo Sapiens
QHQSAGDCV

SEQ ID NO: 1295240 - protein, 9 aa, Homo Sapiens
VLLVSPYHG

SEQ ID NO: 1295241 - protein, 9 aa, Homo Sapiens
CRESLGGWR

SEQ ID NO: 1295242 - protein, 9 aa, Homo Sapiens
PPPEDERHP

SEQ ID NO: 1295243 - protein, 9 aa, Homo Sapiens
VADGERTAL

SEQ ID NO: 1295244 - protein, 9 aa, Homo Sapiens
MLYSLLQYM

SEQ ID NO: 1295245 - protein, 9 aa, Homo Sapiens
TVCPAVERV

SEQ ID NO: 1295246 - protein, 9 aa, Homo Sapiens
AAALQGEAA

SEQ ID NO: 1295247 - protein, 9 aa, Homo Sapiens
HECDEGFEP

SEQ ID NO: 1295248 - protein, 9 aa, Homo Sapiens
NKENQKEQT

SEQ ID NO: 1295249 - protein, 9 aa, Homo Sapiens
SICGAPGQS

SEQ ID NO: 1295250 - protein, 9 aa, Homo Sapiens
PMHCPTATA

SEQ ID NO: 1295251 - protein, 9 aa, Homo Sapiens
QDSFHRGAS

SEQ ID NO: 1295252 - protein, 9 aa, Homo Sapiens
GTTIGEVTS

SEQ ID NO: 1295253 - protein, 9 aa, Homo Sapiens
FLEWKQEDL

SEQ ID NO: 1295254 - protein, 9 aa, Homo Sapiens
HRRKALQWH

SEQ ID NO: 1295255 - protein, 9 aa, Homo Sapiens
NGVKFNVGT

SEQ ID NO: 1295256 - protein, 9 aa, Homo Sapiens
VSTGLVAML

SEQ ID NO: 1295257 - protein, 9 aa, Homo Sapiens
VGIMCIIRA

SEQ ID NO: 1295258 - protein, 9 aa, Homo Sapiens
RTYECGQCG

SEQ ID NO: 1295259 - protein, 9 aa, Homo Sapiens
YMWSFCFSP

SEQ ID NO: 1295260 - protein, 9 aa, Homo Sapiens
LQYMIALLK

SEQ ID NO: 1295261 - protein, 9 aa, Homo Sapiens
PTMPPPPPL

SEQ ID NO: 1295262 - protein, 9 aa, Homo Sapiens
VNMGGNRSI

SEQ ID NO: 1295263 - protein, 9 aa, Homo Sapiens
QNHRPTRHL

SEQ ID NO: 1295264 - protein, 9 aa, Homo Sapiens
ACIPFRVGL

SEQ ID NO: 1295265 - protein, 9 aa, Homo Sapiens
DVYSYDDDD

SEQ ID NO: 1295266 - protein, 9 aa, Homo Sapiens
HHVEAAQFQ

SEQ ID NO: 1295267 - protein, 9 aa, Homo Sapiens
AKTYRCMDC

SEQ ID NO: 1295268 - protein, 9 aa, Homo Sapiens
RKMSEPKDA

SEQ ID NO: 1295269 - protein, 9 aa, Homo Sapiens
TPPVHQVLL

SEQ ID NO: 1295270 - protein, 9 aa, Homo Sapiens
KPSPGARAP

SEQ ID NO: 1295271 - protein, 9 aa, Homo Sapiens
LLTKPLSCK

SEQ ID NO: 1295272 - protein, 9 aa, Homo Sapiens
IKNCGFFMA

SEQ ID NO: 1295273 - protein, 9 aa, Homo Sapiens
GTPPPLILW

SEQ ID NO: 1295274 - protein, 9 aa, Homo Sapiens
PTGWDKKRK

SEQ ID NO: 1295275 - protein, 9 aa, Homo Sapiens
NGHPQDPGL

SEQ ID NO: 1295276 - protein, 9 aa, Homo Sapiens
VRSQRKDCK

SEQ ID NO: 1295277 - protein, 9 aa, Homo Sapiens
SPYHGKRDS

SEQ ID NO: 1295278 - protein, 9 aa, Homo Sapiens
KIQKIRQKK

SEQ ID NO: 1295279 - protein, 9 aa, Homo Sapiens
HLHVHFVNF

SEQ ID NO: 1295280 - protein, 9 aa, Homo Sapiens
AAQGHLDPQ

SEQ ID NO: 1295281 - protein, 9 aa, Homo Sapiens
AHVYTASTR

SEQ ID NO: 1295282 - protein, 9 aa, Homo Sapiens
VWNQQGVEI

SEQ ID NO: 1295283 - protein, 9 aa, Homo Sapiens
NTEMDTEWH

SEQ ID NO: 1295284 - protein, 9 aa, Homo Sapiens
LRPEILQDS

SEQ ID NO: 1295285 - protein, 9 aa, Homo Sapiens
CLALDTCDI

SEQ ID NO: 1295286 - protein, 9 aa, Homo Sapiens
RLSANGDAR

SEQ ID NO: 1295287 - protein, 9 aa, Homo Sapiens
LGIIWPKSG

SEQ ID NO: 1295288 - protein, 9 aa, Homo Sapiens
QACVPPEGR

SEQ ID NO: 1295289 - protein, 9 aa, Homo Sapiens
KSRRLRLCY

SEQ ID NO: 1295290 - protein, 9 aa, Homo Sapiens
VGQRRFHTM

SEQ ID NO: 1295291 - protein, 9 aa, Homo Sapiens
RGVALRGTV

SEQ ID NO: 1295292 - protein, 9 aa, Homo Sapiens
ARHHARLFF

SEQ ID NO: 1295293 - protein, 9 aa, Homo Sapiens
GGQRCRCVC

SEQ ID NO: 1295294 - protein, 9 aa, Homo Sapiens
ISENIPGKL

SEQ ID NO: 1295295 - protein, 9 aa, Homo Sapiens
APLRLRLDR

SEQ ID NO: 1295296 - protein, 9 aa, Homo Sapiens
WAGQPGPEY

SEQ ID NO: 1295297 - protein, 9 aa, Homo Sapiens
SEHTVEGHC

SEQ ID NO: 1295298 - protein, 9 aa, Homo Sapiens
PAGTPCSHQ

SEQ ID NO: 1295299 - protein, 9 aa, Homo Sapiens
CCPRAPEVP

SEQ ID NO: 1295300 - protein, 9 aa, Homo Sapiens
PAGILPSSR

SEQ ID NO: 1295301 - protein, 9 aa, Homo Sapiens
SVRTGALGH

SEQ ID NO: 1295302 - protein, 9 aa, Homo Sapiens
EQVKVKIAV

SEQ ID NO: 1295303 - protein, 9 aa, Homo Sapiens
EVRKKDTVQ

SEQ ID NO: 1295304 - protein, 9 aa, Homo Sapiens
ISGMRTFRV

SEQ ID NO: 1295305 - protein, 9 aa, Homo Sapiens
SYSSPKAQP

SEQ ID NO: 1295306 - protein, 9 aa, Homo Sapiens
SLTDTDRER

SEQ ID NO: 1295307 - protein, 9 aa, Homo Sapiens
GGAWKSIFR

SEQ ID NO: 1295308 - protein, 9 aa, Homo Sapiens
APTCPPWHC

SEQ ID NO: 1295309 - protein, 9 aa, Homo Sapiens
VMLAAIDLV

SEQ ID NO: 1295310 - protein, 9 aa, Homo Sapiens
LDSGIHPGA

SEQ ID NO: 1295311 - protein, 9 aa, Homo Sapiens
NTGLMASKK

SEQ ID NO: 1295312 - protein, 9 aa, Homo Sapiens
AMYTLNLAL

SEQ ID NO: 1295313 - protein, 9 aa, Homo Sapiens
SGADRSPVI

SEQ ID NO: 1295314 - protein, 9 aa, Homo Sapiens
LYQGMKARN

SEQ ID NO: 1295315 - protein, 9 aa, Homo Sapiens
GGRPWCRES

SEQ ID NO: 1295316 - protein, 9 aa, Homo Sapiens
GEHALGRIV

SEQ ID NO: 1295317 - protein, 9 aa, Homo Sapiens
YCVGQRRFH

SEQ ID NO: 1295318 - protein, 9 aa, Homo Sapiens
GEKLSPNPP

SEQ ID NO: 1295319 - protein, 9 aa, Homo Sapiens
HSIWSSSSA

SEQ ID NO: 1295320 - protein, 9 aa, Homo Sapiens
TASRASQPS

SEQ ID NO: 1295321 - protein, 9 aa, Homo Sapiens
VYCVGQRRF

SEQ ID NO: 1295322 - protein, 9 aa, Homo Sapiens
GCTPLMIAS

SEQ ID NO: 1295323 - protein, 9 aa, Homo Sapiens
PVDDDALHG

SEQ ID NO: 1295324 - protein, 9 aa, Homo Sapiens
QKSSLSPPH

SEQ ID NO: 1295325 - protein, 9 aa, Homo Sapiens
SGSGLCDGD

SEQ ID NO: 1295326 - protein, 9 aa, Homo Sapiens
ILEGLEAVL

SEQ ID NO: 1295327 - protein, 9 aa, Homo Sapiens
LSPLDSSPL

SEQ ID NO: 1295328 - protein, 9 aa, Homo Sapiens
VPKHLLGQR

SEQ ID NO: 1295329 - protein, 9 aa, Homo Sapiens
YQGMKARNL

SEQ ID NO: 1295330 - protein, 9 aa, Homo Sapiens
PVQPIAQGE

SEQ ID NO: 1295331 - protein, 9 aa, Homo Sapiens
KTSTTQSKH

SEQ ID NO: 1295332 - protein, 9 aa, Homo Sapiens
PLLSYPLVL

SEQ ID NO: 1295333 - protein, 9 aa, Homo Sapiens
DNDGCTPLM

SEQ ID NO: 1295334 - protein, 9 aa, Homo Sapiens
VQGVPKHLL

SEQ ID NO: 1295335 - protein, 9 aa, Homo Sapiens
SCPPLLEAF

SEQ ID NO: 1295336 - protein, 9 aa, Homo Sapiens
GGRVEAAVD

SEQ ID NO: 1295337 - protein, 9 aa, Homo Sapiens
EVMLTYKQK

SEQ ID NO: 1295338 - protein, 9 aa, Homo Sapiens
LYSRAVLVE

SEQ ID NO: 1295339 - protein, 9 aa, Homo Sapiens
NRQRSAQWL

SEQ ID NO: 1295340 - protein, 9 aa, Homo Sapiens
LKNSSHIYY

SEQ ID NO: 1295341 - protein, 9 aa, Homo Sapiens
RGWDWAPRC

SEQ ID NO: 1295342 - protein, 9 aa, Homo Sapiens
AAVQRLGRR

SEQ ID NO: 1295343 - protein, 9 aa, Homo Sapiens
CQYKLTYTK

SEQ ID NO: 1295344 - protein, 9 aa, Homo Sapiens
VPPDGSDPR

SEQ ID NO: 1295345 - protein, 9 aa, Homo Sapiens
AYEKSRMTS

SEQ ID NO: 1295346 - protein, 9 aa, Homo Sapiens
CPAGCWLSF

SEQ ID NO: 1295347 - protein, 9 aa, Homo Sapiens
TQRKSQTIV

SEQ ID NO: 1295348 - protein, 9 aa, Homo Sapiens
TAKRMAQKN

SEQ ID NO: 1295349 - protein, 9 aa, Homo Sapiens
YEKSRMTSA

SEQ ID NO: 1295350 - protein, 9 aa, Homo Sapiens
SALWFHHVQ

SEQ ID NO: 1295351 - protein, 9 aa, Homo Sapiens
MRCLHLPPS

SEQ ID NO: 1295352 - protein, 9 aa, Homo Sapiens
SLFTTGSSR

SEQ ID NO: 1295353 - protein, 9 aa, Homo Sapiens
SPRAVEASE

SEQ ID NO: 1295354 - protein, 9 aa, Homo Sapiens
DHCPSTPAT

SEQ ID NO: 1295355 - protein, 9 aa, Homo Sapiens
CGSRGNRGG

SEQ ID NO: 1295356 - protein, 9 aa, Homo Sapiens
IYILKGGYE

SEQ ID NO: 1295357 - protein, 9 aa, Homo Sapiens
ATPALPTQQ

SEQ ID NO: 1295358 - protein, 9 aa, Homo Sapiens
CGRAPAQPP

SEQ ID NO: 1295359 - protein, 9 aa, Homo Sapiens
SSVLATGLH

SEQ ID NO: 1295360 - protein, 9 aa, Homo Sapiens
RRLCRAEDE

SEQ ID NO: 1295361 - protein, 9 aa, Homo Sapiens
RENSICGAP

SEQ ID NO: 1295362 - protein, 9 aa, Homo Sapiens
ATFGCQMSP

SEQ ID NO: 1295363 - protein, 9 aa, Homo Sapiens
MYTLNLALA

SEQ ID NO: 1295364 - protein, 9 aa, Homo Sapiens
EAKVSIWAT

SEQ ID NO: 1295365 - protein, 9 aa, Homo Sapiens
TRVLHKNKG

SEQ ID NO: 1295366 - protein, 9 aa, Homo Sapiens
LLVICQLKS

SEQ ID NO: 1295367 - protein, 9 aa, Homo Sapiens
ISINKTFKK

SEQ ID NO: 1295368 - protein, 9 aa, Homo Sapiens
TSRSVLSVP

SEQ ID NO: 1295369 - protein, 9 aa, Homo Sapiens
VAQAALRAQ

SEQ ID NO: 1295370 - protein, 9 aa, Homo Sapiens
MTRLTVLVL

SEQ ID NO: 1295371 - protein, 9 aa, Homo Sapiens
HPAGPAGQQ

SEQ ID NO: 1295372 - protein, 9 aa, Homo Sapiens
PTPRGRLLQ

SEQ ID NO: 1295373 - protein, 9 aa, Homo Sapiens
RLFFCIFSR

SEQ ID NO: 1295374 - protein, 9 aa, Homo Sapiens
NTQKRERRR

SEQ ID NO: 1295375 - protein, 9 aa, Homo Sapiens
LQPQHTMRS

SEQ ID NO: 1295376 - protein, 9 aa, Homo Sapiens
LFEAWLLLL

SEQ ID NO: 1295377 - protein, 9 aa, Homo Sapiens
LPTGSSSTT

SEQ ID NO: 1295378 - protein, 9 aa, Homo Sapiens
VYILWAVDG

SEQ ID NO: 1295379 - protein, 9 aa, Homo Sapiens
SSSSGSRRS

SEQ ID NO: 1295380 - protein, 9 aa, Homo Sapiens
VLGVRSQRK

SEQ ID NO: 1295381 - protein, 9 aa, Homo Sapiens
HKNKGRRKS

SEQ ID NO: 1295382 - protein, 9 aa, Homo Sapiens
PGTGGACIP

SEQ ID NO: 1295383 - protein, 9 aa, Homo Sapiens
EVLIAEKRC

SEQ ID NO: 1295384 - protein, 9 aa, Homo Sapiens
VREHFVFTD

SEQ ID NO: 1295385 - protein, 9 aa, Homo Sapiens
PPRLCVKAT

SEQ ID NO: 1295386 - protein, 9 aa, Homo Sapiens
RHVLHFNDA

SEQ ID NO: 1295387 - protein, 9 aa, Homo Sapiens
RKFTVRHVL

SEQ ID NO: 1295388 - protein, 9 aa, Homo Sapiens
RHHARLFFC

SEQ ID NO: 1295389 - protein, 9 aa, Homo Sapiens
VPLPPPQSS

SEQ ID NO: 1295390 - protein, 9 aa, Homo Sapiens
QGHQRRKKR

SEQ ID NO: 1295391 - protein, 9 aa, Homo Sapiens
RAWKHSPLL

SEQ ID NO: 1295392 - protein, 9 aa, Homo Sapiens
GMLEQKQSS

SEQ ID NO: 1295393 - protein, 9 aa, Homo Sapiens
PRAGLLGRP

SEQ ID NO: 1295394 - protein, 9 aa, Homo Sapiens
ISSSFPETN

SEQ ID NO: 1295395 - protein, 9 aa, Homo Sapiens
IRASWRIEV

SEQ ID NO: 1295396 - protein, 9 aa, Homo Sapiens
KAEKNSLGI

SEQ ID NO: 1295397 - protein, 9 aa, Homo Sapiens
LKEQQPRAL

SEQ ID NO: 1295398 - protein, 9 aa, Homo Sapiens
RDPENSETE

SEQ ID NO: 1295399 - protein, 9 aa, Homo Sapiens
GPPLPPPED

SEQ ID NO: 1295400 - protein, 9 aa, Homo Sapiens
RQCMFDENG

SEQ ID NO: 1295401 - protein, 9 aa, Homo Sapiens
EVCGRHLPG

SEQ ID NO: 1295402 - protein, 9 aa, Homo Sapiens
CIIRAAVSF

SEQ ID NO: 1295403 - protein, 9 aa, Homo Sapiens
QLLLDHPDH

SEQ ID NO: 1295404 - protein, 9 aa, Homo Sapiens
EEEVEAQVI

SEQ ID NO: 1295405 - protein, 9 aa, Homo Sapiens
IRKLDEDAP

SEQ ID NO: 1295406 - protein, 9 aa, Homo Sapiens
ENSICGAPG

SEQ ID NO: 1295407 - protein, 9 aa, Homo Sapiens
LQEVELEVI

SEQ ID NO: 1295408 - protein, 9 aa, Homo Sapiens
GNEKRFFAH

SEQ ID NO: 1295409 - protein, 9 aa, Homo Sapiens
SMEGEKQRS

SEQ ID NO: 1295410 - protein, 9 aa, Homo Sapiens
ANGDARHSP

SEQ ID NO: 1295411 - protein, 9 aa, Homo Sapiens
LCGGRVEAA

SEQ ID NO: 1295412 - protein, 9 aa, Homo Sapiens
ILEMWDLHP

SEQ ID NO: 1295413 - protein, 9 aa, Homo Sapiens
RRLVAQAAL

SEQ ID NO: 1295414 - protein, 9 aa, Homo Sapiens
HAGGGDARA

SEQ ID NO: 1295415 - protein, 9 aa, Homo Sapiens
RLTETSVHD

SEQ ID NO: 1295416 - protein, 9 aa, Homo Sapiens
THTVMQGNM

SEQ ID NO: 1295417 - protein, 9 aa, Homo Sapiens
VPLDYRLED

SEQ ID NO: 1295418 - protein, 9 aa, Homo Sapiens
AFPLPRASL

SEQ ID NO: 1295419 - protein, 9 aa, Homo Sapiens
NLKTHQTFP

SEQ ID NO: 1295420 - protein, 9 aa, Homo Sapiens
WFDTCGLSN

SEQ ID NO: 1295421 - protein, 9 aa, Homo Sapiens
VEEIKGECQ

SEQ ID NO: 1295422 - protein, 9 aa, Homo Sapiens
LQQPWDSQM

SEQ ID NO: 1295423 - protein, 9 aa, Homo Sapiens
QGHSGNLPH

SEQ ID NO: 1295424 - protein, 9 aa, Homo Sapiens
SAWAPQTAA

SEQ ID NO: 1295425 - protein, 9 aa, Homo Sapiens
HPPWSRSSC

SEQ ID NO: 1295426 - protein, 9 aa, Homo Sapiens
AKPVTPPAW

SEQ ID NO: 1295427 - protein, 9 aa, Homo Sapiens
TSTTQSKHN

SEQ ID NO: 1295428 - protein, 9 aa, Homo Sapiens
SRSLWPQSR

SEQ ID NO: 1295429 - protein, 9 aa, Homo Sapiens
CRGRSSMEG

SEQ ID NO: 1295430 - protein, 9 aa, Homo Sapiens
TQQLAWPDT

SEQ ID NO: 1295431 - protein, 9 aa, Homo Sapiens
ESFLLTKPL

SEQ ID NO: 1295432 - protein, 9 aa, Homo Sapiens
LSLYLQTRV

SEQ ID NO: 1295433 - protein, 9 aa, Homo Sapiens
TELTRVLPT

SEQ ID NO: 1295434 - protein, 9 aa, Homo Sapiens
VEPSQNGLR

SEQ ID NO: 1295435 - protein, 9 aa, Homo Sapiens
APCWAPAPG

SEQ ID NO: 1295436 - protein, 9 aa, Homo Sapiens
VPTVTAFPN

SEQ ID NO: 1295437 - protein, 9 aa, Homo Sapiens
TLLEELGGK

SEQ ID NO: 1295438 - protein, 9 aa, Homo Sapiens
VPPHVKRHA

SEQ ID NO: 1295439 - protein, 9 aa, Homo Sapiens
AQRAGALIA

SEQ ID NO: 1295440 - protein, 9 aa, Homo Sapiens
GVHRAGPPG

SEQ ID NO: 1295441 - protein, 9 aa, Homo Sapiens
LLQEVELEV

SEQ ID NO: 1295442 - protein, 9 aa, Homo Sapiens
EEGGGVPLA

SEQ ID NO: 1295443 - protein, 9 aa, Homo Sapiens
VLNMALADL

SEQ ID NO: 1295444 - protein, 9 aa, Homo Sapiens
MDDFQHAVS

SEQ ID NO: 1295445 - protein, 9 aa, Homo Sapiens
NSKCYLETL

SEQ ID NO: 1295446 - protein, 9 aa, Homo Sapiens
QDAGAQRGQ

SEQ ID NO: 1295447 - protein, 9 aa, Homo Sapiens
ALDTCDIYL

SEQ ID NO: 1295448 - protein, 9 aa, Homo Sapiens
ESYLKKCRL

SEQ ID NO: 1295449 - protein, 9 aa, Homo Sapiens
ISRYYRKMS

SEQ ID NO: 1295450 - protein, 9 aa, Homo Sapiens
CYLETLPNT

SEQ ID NO: 1295451 - protein, 9 aa, Homo Sapiens
ENPLQFYVN

SEQ ID NO: 1295452 - protein, 9 aa, Homo Sapiens
TEENCLEFR

SEQ ID NO: 1295453 - protein, 9 aa, Homo Sapiens
VINATDDDE

SEQ ID NO: 1295454 - protein, 9 aa, Homo Sapiens
DSGRKPRCT

SEQ ID NO: 1295455 - protein, 9 aa, Homo Sapiens
QSWEIVMET

SEQ ID NO: 1295456 - protein, 9 aa, Homo Sapiens
ACWPRALYC

SEQ ID NO: 1295457 - protein, 9 aa, Homo Sapiens
TATCSLSSR

SEQ ID NO: 1295458 - protein, 9 aa, Homo Sapiens
MLKFIGVLY

SEQ ID NO: 1295459 - protein, 9 aa, Homo Sapiens
KRTQQRPPW

SEQ ID NO: 1295460 - protein, 9 aa, Homo Sapiens
AAWSRILSI

SEQ ID NO: 1295461 - protein, 9 aa, Homo Sapiens
EAAVDLYQL

SEQ ID NO: 1295462 - protein, 9 aa, Homo Sapiens
PQKSSLSPP

SEQ ID NO: 1295463 - protein, 9 aa, Homo Sapiens
EVHDRDCKS

SEQ ID NO: 1295464 - protein, 9 aa, Homo Sapiens
CMECGSLHD

SEQ ID NO: 1295465 - protein, 9 aa, Homo Sapiens
PQHTMRSLD

SEQ ID NO: 1295466 - protein, 9 aa, Homo Sapiens
GMILCRNDH

SEQ ID NO: 1295467 - protein, 9 aa, Homo Sapiens
QEFPAVGLE

SEQ ID NO: 1295468 - protein, 9 aa, Homo Sapiens
VQLHDVGEE

SEQ ID NO: 1295469 - protein, 9 aa, Homo Sapiens
DVWLEAQAP

SEQ ID NO: 1295470 - protein, 9 aa, Homo Sapiens
RPGLMANLL

SEQ ID NO: 1295471 - protein, 9 aa, Homo Sapiens
DPGLQFLDL

SEQ ID NO: 1295472 - protein, 9 aa, Homo Sapiens
LDRLLPAAE

SEQ ID NO: 1295473 - protein, 9 aa, Homo Sapiens
EGRELQIVK

SEQ ID NO: 1295474 - protein, 9 aa, Homo Sapiens
RPAAAAAAT

SEQ ID NO: 1295475 - protein, 9 aa, Homo Sapiens
AVLCKRMSE

SEQ ID NO: 1295476 - protein, 9 aa, Homo Sapiens
LYCWTAQLR

SEQ ID NO: 1295477 - protein, 9 aa, Homo Sapiens
PWHCPASRS

SEQ ID NO: 1295478 - protein, 9 aa, Homo Sapiens
RVPPDGVGA

SEQ ID NO: 1295479 - protein, 9 aa, Homo Sapiens
FEPLGFWDA

SEQ ID NO: 1295480 - protein, 9 aa, Homo Sapiens
GVCPPGARN

SEQ ID NO: 1295481 - protein, 9 aa, Homo Sapiens
VEDINRIQV

SEQ ID NO: 1295482 - protein, 9 aa, Homo Sapiens
HRAAPGHVH

SEQ ID NO: 1295483 - protein, 9 aa, Homo Sapiens
LESILKGKK

SEQ ID NO: 1295484 - protein, 9 aa, Homo Sapiens
GPGPHAVSG

SEQ ID NO: 1295485 - protein, 9 aa, Homo Sapiens
HQVLLVSPY

SEQ ID NO: 1295486 - protein, 9 aa, Homo Sapiens
IWATVRVMD

SEQ ID NO: 1295487 - protein, 9 aa, Homo Sapiens
PLPRMETHP

SEQ ID NO: 1295488 - protein, 9 aa, Homo Sapiens
RRYRERISQ

SEQ ID NO: 1295489 - protein, 9 aa, Homo Sapiens
QQRPPWRTS

SEQ ID NO: 1295490 - protein, 9 aa, Homo Sapiens
VGEERWLRG

SEQ ID NO: 1295491 - protein, 9 aa, Homo Sapiens
GDARAAGGA

SEQ ID NO: 1295492 - protein, 9 aa, Homo Sapiens
EARGGGGHG

SEQ ID NO: 1295493 - protein, 9 aa, Homo Sapiens
LNPWKKINS

SEQ ID NO: 1295494 - protein, 9 aa, Homo Sapiens
GHCQVHLFK

SEQ ID NO: 1295495 - protein, 9 aa, Homo Sapiens
NFEHLKKKI

SEQ ID NO: 1295496 - protein, 9 aa, Homo Sapiens
SSGLGSEVG

SEQ ID NO: 1295497 - protein, 9 aa, Homo Sapiens
VLSARAMTE

SEQ ID NO: 1295498 - protein, 9 aa, Homo Sapiens
DTNDNRTTI

SEQ ID NO: 1295499 - protein, 9 aa, Homo Sapiens
FQAPPSCLR

SEQ ID NO: 1295500 - protein, 9 aa, Homo Sapiens
ITTRNSSIR

SEQ ID NO: 1295501 - protein, 9 aa, Homo Sapiens
PLNWILVDL

SEQ ID NO: 1295502 - protein, 9 aa, Homo Sapiens
EAKKNHFLP

SEQ ID NO: 1295503 - protein, 9 aa, Homo Sapiens
SPAAPAVTH

SEQ ID NO: 1295504 - protein, 9 aa, Homo Sapiens
VKTLKTTQP

SEQ ID NO: 1295505 - protein, 9 aa, Homo Sapiens
PWKPCGRVD

SEQ ID NO: 1295506 - protein, 9 aa, Homo Sapiens
PASISRDNN

SEQ ID NO: 1295507 - protein, 9 aa, Homo Sapiens
SSRLPWEIP

SEQ ID NO: 1295508 - protein, 9 aa, Homo Sapiens
VDEMNGHIV

SEQ ID NO: 1295509 - protein, 9 aa, Homo Sapiens
AVKTLKTTQ

SEQ ID NO: 1295510 - protein, 9 aa, Homo Sapiens
VGHLGDQLG

SEQ ID NO: 1295511 - protein, 9 aa, Homo Sapiens
WSSCLTWAS

SEQ ID NO: 1295512 - protein, 9 aa, Homo Sapiens
LPPMHCPTA

SEQ ID NO: 1295513 - protein, 9 aa, Homo Sapiens
PRCLLAVEV

SEQ ID NO: 1295514 - protein, 9 aa, Homo Sapiens
GPKRQRWRR

SEQ ID NO: 1295515 - protein, 9 aa, Homo Sapiens
NISVREHFV

SEQ ID NO: 1295516 - protein, 9 aa, Homo Sapiens
RLRVPPDGV

SEQ ID NO: 1295517 - protein, 9 aa, Homo Sapiens
LEINGQNNL

SEQ ID NO: 1295518 - protein, 9 aa, Homo Sapiens
MEQVKVKIA

SEQ ID NO: 1295519 - protein, 9 aa, Homo Sapiens
SSGAQHQSA

SEQ ID NO: 1295520 - protein, 9 aa, Homo Sapiens
LQKRRQGPA

SEQ ID NO: 1295521 - protein, 9 aa, Homo Sapiens
SKGPVQPIA

SEQ ID NO: 1295522 - protein, 9 aa, Homo Sapiens
SENIPGKLT

SEQ ID NO: 1295523 - protein, 9 aa, Homo Sapiens
GHLDPQDQA

SEQ ID NO: 1295524 - protein, 9 aa, Homo Sapiens
GRELQIVKP

SEQ ID NO: 1295525 - protein, 9 aa, Homo Sapiens
GPTQRRSAR

SEQ ID NO: 1295526 - protein, 9 aa, Homo Sapiens
IDVSVLHTL

SEQ ID NO: 1295527 - protein, 9 aa, Homo Sapiens
TSTHTVMQG

SEQ ID NO: 1295528 - protein, 9 aa, Homo Sapiens
VIAGAHHCQ

SEQ ID NO: 1295529 - protein, 9 aa, Homo Sapiens
TLWLGPASV

SEQ ID NO: 1295530 - protein, 9 aa, Homo Sapiens
GSPSLFDAA

SEQ ID NO: 1295531 - protein, 9 aa, Homo Sapiens
QVPVWNQQG

SEQ ID NO: 1295532 - protein, 9 aa, Homo Sapiens
SFAEGQISI

SEQ ID NO: 1295533 - protein, 9 aa, Homo Sapiens
YYKLHAAEQ

SEQ ID NO: 1295534 - protein, 9 aa, Homo Sapiens
LSCGSLCML

SEQ ID NO: 1295535 - protein, 9 aa, Homo Sapiens
GWQPAEPHP

SEQ ID NO: 1295536 - protein, 9 aa, Homo Sapiens
NKKEGNLIQ

SEQ ID NO: 1295537 - protein, 9 aa, Homo Sapiens
GRRRARPGQ

SEQ ID NO: 1295538 - protein, 9 aa, Homo Sapiens
QVAVVTFVP

SEQ ID NO: 1295539 - protein, 9 aa, Homo Sapiens
TGIVILGYV

SEQ ID NO: 1295540 - protein, 9 aa, Homo Sapiens
REHAPEQRV

SEQ ID NO: 1295541 - protein, 9 aa, Homo Sapiens
LTHHPIYIL

SEQ ID NO: 1295542 - protein, 9 aa, Homo Sapiens
ILQRPGLSW

SEQ ID NO: 1295543 - protein, 9 aa, Homo Sapiens
ANLEDAIKN

SEQ ID NO: 1295544 - protein, 9 aa, Homo Sapiens
PPMPTGLRK

SEQ ID NO: 1295545 - protein, 9 aa, Homo Sapiens
TTTQWSLAR

SEQ ID NO: 1295546 - protein, 9 aa, Homo Sapiens
WNESPLCGD

SEQ ID NO: 1295547 - protein, 9 aa, Homo Sapiens
RLVAQAALR

SEQ ID NO: 1295548 - protein, 9 aa, Homo Sapiens
GDVWWETRA

SEQ ID NO: 1295549 - protein, 9 aa, Homo Sapiens
NQTLKKEKS

SEQ ID NO: 1295550 - protein, 9 aa, Homo Sapiens
EYGKSFSNT

SEQ ID NO: 1295551 - protein, 9 aa, Homo Sapiens
SKVERVETR

SEQ ID NO: 1295552 - protein, 9 aa, Homo Sapiens
DQLGDDLEP

SEQ ID NO: 1295553 - protein, 9 aa, Homo Sapiens
SPRSNAGIV

SEQ ID NO: 1295554 - protein, 9 aa, Homo Sapiens
RGARRGQGA

SEQ ID NO: 1295555 - protein, 9 aa, Homo Sapiens
NRRPMFDFQ

SEQ ID NO: 1295556 - protein, 9 aa, Homo Sapiens
GHTTSTHTV

SEQ ID NO: 1295557 - protein, 9 aa, Homo Sapiens
PSIGKIVNE

SEQ ID NO: 1295558 - protein, 9 aa, Homo Sapiens
KQRSWTRSR

SEQ ID NO: 1295559 - protein, 9 aa, Homo Sapiens
HPAPRGRRP

SEQ ID NO: 1295560 - protein, 9 aa, Homo Sapiens
SARHAVFSG

SEQ ID NO: 1295561 - protein, 9 aa, Homo Sapiens
RAGVCCEPA

SEQ ID NO: 1295562 - protein, 9 aa, Homo Sapiens
LLGQRRLSA

SEQ ID NO: 1295563 - protein, 9 aa, Homo Sapiens
MKPLPRMET

SEQ ID NO: 1295564 - protein, 9 aa, Homo Sapiens
ICGAPGQSS

SEQ ID NO: 1295565 - protein, 9 aa, Homo Sapiens
ARHAVFSGS

SEQ ID NO: 1295566 - protein, 9 aa, Homo Sapiens
GIQAKFFPN

SEQ ID NO: 1295567 - protein, 9 aa, Homo Sapiens
GTLSPARTK

SEQ ID NO: 1295568 - protein, 9 aa, Homo Sapiens
DGIGSGSKA

SEQ ID NO: 1295569 - protein, 9 aa, Homo Sapiens
AVVLLLQGI

SEQ ID NO: 1295570 - protein, 9 aa, Homo Sapiens
HCFPAEIHV

SEQ ID NO: 1295571 - protein, 9 aa, Homo Sapiens
TLLVQALKL

SEQ ID NO: 1295572 - protein, 9 aa, Homo Sapiens
SPAQGHQRR

SEQ ID NO: 1295573 - protein, 9 aa, Homo Sapiens
GGAAAALQG

SEQ ID NO: 1295574 - protein, 9 aa, Homo Sapiens
LDTCDIYLI

SEQ ID NO: 1295575 - protein, 9 aa, Homo Sapiens
QFKLEEYYE

SEQ ID NO: 1295576 - protein, 9 aa, Homo Sapiens
HHAWPGCFL

SEQ ID NO: 1295577 - protein, 9 aa, Homo Sapiens
PPEGMCPVG

SEQ ID NO: 1295578 - protein, 9 aa, Homo Sapiens
WLSHRLRLR

SEQ ID NO: 1295579 - protein, 9 aa, Homo Sapiens
AMLDLLVIC

SEQ ID NO: 1295580 - protein, 9 aa, Homo Sapiens
LFCLVLMLC

SEQ ID NO: 1295581 - protein, 9 aa, Homo Sapiens
ASTQSSKRP

SEQ ID NO: 1295582 - protein, 9 aa, Homo Sapiens
INSAPLALL

SEQ ID NO: 1295583 - protein, 9 aa, Homo Sapiens
SVACPARKQ

SEQ ID NO: 1295584 - protein, 9 aa, Homo Sapiens
RSFFTSAHP

SEQ ID NO: 1295585 - protein, 9 aa, Homo Sapiens
VVFGINNLD

SEQ ID NO: 1295586 - protein, 9 aa, Homo Sapiens
PENPLQFYV

SEQ ID NO: 1295587 - protein, 9 aa, Homo Sapiens
VEASELCLE

SEQ ID NO: 1295588 - protein, 9 aa, Homo Sapiens
GPRLTHPAC

SEQ ID NO: 1295589 - protein, 9 aa, Homo Sapiens
GPLPLDQNP

SEQ ID NO: 1295590 - protein, 9 aa, Homo Sapiens
ETVTLIECE

SEQ ID NO: 1295591 - protein, 9 aa, Homo Sapiens
PPSRRKTPN

SEQ ID NO: 1295592 - protein, 9 aa, Homo Sapiens
SKHQKLDTI

SEQ ID NO: 1295593 - protein, 9 aa, Homo Sapiens
VMEMRMVKE

SEQ ID NO: 1295594 - protein, 9 aa, Homo Sapiens
RGRSSMEGE

SEQ ID NO: 1295595 - protein, 9 aa, Homo Sapiens
GLTFLRCSQ

SEQ ID NO: 1295596 - protein, 9 aa, Homo Sapiens
KDTVQLSIF

SEQ ID NO: 1295597 - protein, 9 aa, Homo Sapiens
ARTYECGQC

SEQ ID NO: 1295598 - protein, 9 aa, Homo Sapiens
LALQGNRLM

SEQ ID NO: 1295599 - protein, 9 aa, Homo Sapiens
HRSSSERRQ

SEQ ID NO: 1295600 - protein, 9 aa, Homo Sapiens
VKIAVANAQ

SEQ ID NO: 1295601 - protein, 9 aa, Homo Sapiens
TSCPPLLEA

SEQ ID NO: 1295602 - protein, 9 aa, Homo Sapiens
ITVATTSEI

SEQ ID NO: 1295603 - protein, 9 aa, Homo Sapiens
KNTYVGLQL

SEQ ID NO: 1295604 - protein, 9 aa, Homo Sapiens
QPAEPHPAG

SEQ ID NO: 1295605 - protein, 9 aa, Homo Sapiens
VEPHGRRAV

SEQ ID NO: 1295606 - protein, 9 aa, Homo Sapiens
PPPPLARVR

SEQ ID NO: 1295607 - protein, 9 aa, Homo Sapiens
LTETSVHDF

SEQ ID NO: 1295608 - protein, 9 aa, Homo Sapiens
SPGGGRVWA

SEQ ID NO: 1295609 - protein, 9 aa, Homo Sapiens
LQLHNKKEG

SEQ ID NO: 1295610 - protein, 9 aa, Homo Sapiens
ANLLIHTGE

SEQ ID NO: 1295611 - protein, 9 aa, Homo Sapiens
RAWQDVEVQ

SEQ ID NO: 1295612 - protein, 9 aa, Homo Sapiens
GRDSGRKPR

SEQ ID NO: 1295613 - protein, 9 aa, Homo Sapiens
CWPRALYCW

SEQ ID NO: 1295614 - protein, 9 aa, Homo Sapiens
ILCPKTGWE

SEQ ID NO: 1295615 - protein, 9 aa, Homo Sapiens
ALHGDVCTH

SEQ ID NO: 1295616 - protein, 9 aa, Homo Sapiens
PPPSEGSHH

SEQ ID NO: 1295617 - protein, 9 aa, Homo Sapiens
WPGRDSGRK

SEQ ID NO: 1295618 - protein, 9 aa, Homo Sapiens
GRPRGAGAG

SEQ ID NO: 1295619 - protein, 9 aa, Homo Sapiens
DVPFSGLYQ

SEQ ID NO: 1295620 - protein, 9 aa, Homo Sapiens
TMPGSMSCW

SEQ ID NO: 1295621 - protein, 9 aa, Homo Sapiens
GWCPRLRLP

SEQ ID NO: 1295622 - protein, 9 aa, Homo Sapiens
ALYCWTAQL

SEQ ID NO: 1295623 - protein, 9 aa, Homo Sapiens
LITTADTTA

SEQ ID NO: 1295624 - protein, 9 aa, Homo Sapiens
ATDRDSSTN

SEQ ID NO: 1295625 - protein, 9 aa, Homo Sapiens
VVNEIENLG

SEQ ID NO: 1295626 - protein, 9 aa, Homo Sapiens
TCDIYLISG

SEQ ID NO: 1295627 - protein, 9 aa, Homo Sapiens
GARGAARHH

SEQ ID NO: 1295628 - protein, 9 aa, Homo Sapiens
MESAKPVTP

SEQ ID NO: 1295629 - protein, 9 aa, Homo Sapiens
MSKVERVET

SEQ ID NO: 1295630 - protein, 9 aa, Homo Sapiens
SQGGRILLQ

SEQ ID NO: 1295631 - protein, 9 aa, Homo Sapiens
QRGQPRLLH

SEQ ID NO: 1295632 - protein, 9 aa, Homo Sapiens
GGSLLNEQW

SEQ ID NO: 1295633 - protein, 9 aa, Homo Sapiens
RAGALIAHA

SEQ ID NO: 1295634 - protein, 9 aa, Homo Sapiens
ALRISNLFN

SEQ ID NO: 1295635 - protein, 9 aa, Homo Sapiens
EDERHPGLS

SEQ ID NO: 1295636 - protein, 9 aa, Homo Sapiens
CDGNSSLIA

SEQ ID NO: 1295637 - protein, 9 aa, Homo Sapiens
AVDGRKKKN

SEQ ID NO: 1295638 - protein, 9 aa, Homo Sapiens
SPVVTQRKS

SEQ ID NO: 1295639 - protein, 9 aa, Homo Sapiens
TAMYTLNLA

SEQ ID NO: 1295640 - protein, 9 aa, Homo Sapiens
CSQCLDQVG

SEQ ID NO: 1295641 - protein, 9 aa, Homo Sapiens
LRLLLREHA

SEQ ID NO: 1295642 - protein, 9 aa, Homo Sapiens
IAHAVVRAG

SEQ ID NO: 1295643 - protein, 9 aa, Homo Sapiens
LSSRWTTRP

SEQ ID NO: 1295644 - protein, 9 aa, Homo Sapiens
VYSPGPRAH

SEQ ID NO: 1295645 - protein, 9 aa, Homo Sapiens
IQAWGDSPW

SEQ ID NO: 1295646 - protein, 9 aa, Homo Sapiens
LAGLGPVED

SEQ ID NO: 1295647 - protein, 9 aa, Homo Sapiens
GHDINGIQA

SEQ ID NO: 1295648 - protein, 9 aa, Homo Sapiens
WEEGRRLCR

SEQ ID NO: 1295649 - protein, 9 aa, Homo Sapiens
GVKPPMPTG

SEQ ID NO: 1295650 - protein, 9 aa, Homo Sapiens
AAAAAQRGP

SEQ ID NO: 1295651 - protein, 9 aa, Homo Sapiens
DEVAESSAE

SEQ ID NO: 1295652 - protein, 9 aa, Homo Sapiens
CEAAWSRIL

SEQ ID NO: 1295653 - protein, 9 aa, Homo Sapiens
TEGYFISIL

SEQ ID NO: 1295654 - protein, 9 aa, Homo Sapiens
KFTVRHVLH

SEQ ID NO: 1295655 - protein, 9 aa, Homo Sapiens
RHWRAAAQR

SEQ ID NO: 1295656 - protein, 9 aa, Homo Sapiens
PHVKRHAVN

SEQ ID NO: 1295657 - protein, 9 aa, Homo Sapiens
TAAERNMSW

SEQ ID NO: 1295658 - protein, 9 aa, Homo Sapiens
GTVGVPAFV

SEQ ID NO: 1295659 - protein, 9 aa, Homo Sapiens
HQGLAVPWL

SEQ ID NO: 1295660 - protein, 9 aa, Homo Sapiens
PASPVPTSS

SEQ ID NO: 1295661 - protein, 9 aa, Homo Sapiens
GRIVHAEVG

SEQ ID NO: 1295662 - protein, 9 aa, Homo Sapiens
NDNRTTIPQ

SEQ ID NO: 1295663 - protein, 9 aa, Homo Sapiens
RAHVYTAST

SEQ ID NO: 1295664 - protein, 9 aa, Homo Sapiens
AAEVCGRHL

SEQ ID NO: 1295665 - protein, 9 aa, Homo Sapiens
GELANFHFQ

SEQ ID NO: 1295666 - protein, 9 aa, Homo Sapiens
HIRKLWQIP

SEQ ID NO: 1295667 - protein, 9 aa, Homo Sapiens
SATDRDSST

SEQ ID NO: 1295668 - protein, 9 aa, Homo Sapiens
KVVFGINNL

SEQ ID NO: 1295669 - protein, 9 aa, Homo Sapiens
LFFCIFSRD

SEQ ID NO: 1295670 - protein, 9 aa, Homo Sapiens
VSIWATVRV

SEQ ID NO: 1295671 - protein, 9 aa, Homo Sapiens
DMRGWDWAP

SEQ ID NO: 1295672 - protein, 9 aa, Homo Sapiens
VLLAGLLAS

SEQ ID NO: 1295673 - protein, 9 aa, Homo Sapiens
YETDVFVVR

SEQ ID NO: 1295674 - protein, 9 aa, Homo Sapiens
LLGRPEAAH

SEQ ID NO: 1295675 - protein, 9 aa, Homo Sapiens
RRKKRRWAP

SEQ ID NO: 1295676 - protein, 9 aa, Homo Sapiens
FGGGQSSCA

SEQ ID NO: 1295677 - protein, 9 aa, Homo Sapiens
SKVNTGLMA

SEQ ID NO: 1295678 - protein, 9 aa, Homo Sapiens
RSLTLGDSW

SEQ ID NO: 1295679 - protein, 9 aa, Homo Sapiens
MGSHIPENP

SEQ ID NO: 1295680 - protein, 9 aa, Homo Sapiens
NGQFFRVTK

SEQ ID NO: 1295681 - protein, 9 aa, Homo Sapiens
PALRARGGT

SEQ ID NO: 1295682 - protein, 9 aa, Homo Sapiens
ARRAPGRTA

SEQ ID NO: 1295683 - protein, 9 aa, Homo Sapiens
AEEEAVPVQ

SEQ ID NO: 1295684 - protein, 9 aa, Homo Sapiens
YVHYIKPCF

SEQ ID NO: 1295685 - protein, 9 aa, Homo Sapiens
HPVKERLFP

SEQ ID NO: 1295686 - protein, 9 aa, Homo Sapiens
CLSLERSRL

SEQ ID NO: 1295687 - protein, 9 aa, Homo Sapiens
NHRPTRHLS

SEQ ID NO: 1295688 - protein, 9 aa, Homo Sapiens
ASFIERMHE

SEQ ID NO: 1295689 - protein, 9 aa, Homo Sapiens
AAGRWSAPT

SEQ ID NO: 1295690 - protein, 9 aa, Homo Sapiens
RGGSAHTSR

SEQ ID NO: 1295691 - protein, 9 aa, Homo Sapiens
ADRSPVIQT

SEQ ID NO: 1295692 - protein, 9 aa, Homo Sapiens
PRHSSVLAT

SEQ ID NO: 1295693 - protein, 9 aa, Homo Sapiens
VGADKQVSQ

SEQ ID NO: 1295694 - protein, 9 aa, Homo Sapiens
ASWVELRVS

SEQ ID NO: 1295695 - protein, 9 aa, Homo Sapiens
QKEEEVEAQ

SEQ ID NO: 1295696 - protein, 9 aa, Homo Sapiens
REERSARLQ

SEQ ID NO: 1295697 - protein, 9 aa, Homo Sapiens
CNYDHCPST

SEQ ID NO: 1295698 - protein, 9 aa, Homo Sapiens
WGWQQSWEI

SEQ ID NO: 1295699 - protein, 9 aa, Homo Sapiens
PASRSSAAC

SEQ ID NO: 1295700 - protein, 9 aa, Homo Sapiens
QEDLVGDVL

SEQ ID NO: 1295701 - protein, 9 aa, Homo Sapiens
WAAKGEKGK

SEQ ID NO: 1295702 - protein, 9 aa, Homo Sapiens
PGRGALLLF

SEQ ID NO: 1295703 - protein, 9 aa, Homo Sapiens
PLCMAPEMV

SEQ ID NO: 1295704 - protein, 9 aa, Homo Sapiens
LFTLVRQLL

SEQ ID NO: 1295705 - protein, 9 aa, Homo Sapiens
ARRGQGAVQ

SEQ ID NO: 1295706 - protein, 9 aa, Homo Sapiens
DTCGLSNLN

SEQ ID NO: 1295707 - protein, 9 aa, Homo Sapiens
HVPHCPGAC

SEQ ID NO: 1295708 - protein, 9 aa, Homo Sapiens
DSMSGNVTI

SEQ ID NO: 1295709 - protein, 9 aa, Homo Sapiens
RCRCVCLRF

SEQ ID NO: 1295710 - protein, 9 aa, Homo Sapiens
MDVLHRQVL

SEQ ID NO: 1295711 - protein, 9 aa, Homo Sapiens
PLLRPRGGA

SEQ ID NO: 1295712 - protein, 9 aa, Homo Sapiens
GPAAWSSVA

SEQ ID NO: 1295713 - protein, 9 aa, Homo Sapiens
APQTAAPRR

SEQ ID NO: 1295714 - protein, 9 aa, Homo Sapiens
CFLAGVSCM

SEQ ID NO: 1295715 - protein, 9 aa, Homo Sapiens
CVKATVCPA

SEQ ID NO: 1295716 - protein, 9 aa, Homo Sapiens
SIWSSSSAL

SEQ ID NO: 1295717 - protein, 9 aa, Homo Sapiens
RKDLGAPDG

SEQ ID NO: 1295718 - protein, 9 aa, Homo Sapiens
LWLGPASVA

SEQ ID NO: 1295719 - protein, 9 aa, Homo Sapiens
LMANLLIHT

SEQ ID NO: 1295720 - protein, 9 aa, Homo Sapiens
GAIFVPIHP

SEQ ID NO: 1295721 - protein, 9 aa, Homo Sapiens
HQKLDTILN

SEQ ID NO: 1295722 - protein, 9 aa, Homo Sapiens
ASKKDSASE

SEQ ID NO: 1295723 - protein, 9 aa, Homo Sapiens
TMRSLDRAL

SEQ ID NO: 1295724 - protein, 9 aa, Homo Sapiens
SWGGRGQVH

SEQ ID NO: 1295725 - protein, 9 aa, Homo Sapiens
PASTMLYVS

SEQ ID NO: 1295726 - protein, 9 aa, Homo Sapiens
KETFSHLHK

SEQ ID NO: 1295727 - protein, 9 aa, Homo Sapiens
LEWKQEDLV

SEQ ID NO: 1295728 - protein, 9 aa, Homo Sapiens
PPIFVFQKD

SEQ ID NO: 1295729 - protein, 9 aa, Homo Sapiens
TSAVLLTVL

SEQ ID NO: 1295730 - protein, 9 aa, Homo Sapiens
MLGCIAGCC

SEQ ID NO: 1295731 - protein, 9 aa, Homo Sapiens
LSFWSTIYG

SEQ ID NO: 1295732 - protein, 9 aa, Homo Sapiens
EKKAEPSPS

SEQ ID NO: 1295733 - protein, 9 aa, Homo Sapiens
VSLSSLKNI

SEQ ID NO: 1295734 - protein, 9 aa, Homo Sapiens
ICCVRPLVE

SEQ ID NO: 1295735 - protein, 9 aa, Homo Sapiens
LDDVFCDGD

SEQ ID NO: 1295736 - protein, 9 aa, Homo Sapiens
RASKGQGHS

SEQ ID NO: 1295737 - protein, 9 aa, Homo Sapiens
RGQGAVQQP

SEQ ID NO: 1295738 - protein, 9 aa, Homo Sapiens
DRLSGELHL

SEQ ID NO: 1295739 - protein, 9 aa, Homo Sapiens
NCCSTMGWC

SEQ ID NO: 1295740 - protein, 9 aa, Homo Sapiens
HPGVGPGPH

SEQ ID NO: 1295741 - protein, 9 aa, Homo Sapiens
PFSVFWSQL

SEQ ID NO: 1295742 - protein, 9 aa, Homo Sapiens
ASISRDNNN

SEQ ID NO: 1295743 - protein, 9 aa, Homo Sapiens
GHPGVGPGP

SEQ ID NO: 1295744 - protein, 9 aa, Homo Sapiens
SHTIATQVH

SEQ ID NO: 1295745 - protein, 9 aa, Homo Sapiens
LCVLLLLSL

SEQ ID NO: 1295746 - protein, 9 aa, Homo Sapiens
MCKPRPLLQ

SEQ ID NO: 1295747 - protein, 9 aa, Homo Sapiens
VNRRPMFDF

SEQ ID NO: 1295748 - protein, 9 aa, Homo Sapiens
RAAVSFLTR

SEQ ID NO: 1295749 - protein, 9 aa, Homo Sapiens
LYMWSFCFS

SEQ ID NO: 1295750 - protein, 9 aa, Homo Sapiens
QHLWLSHRL

SEQ ID NO: 1295751 - protein, 9 aa, Homo Sapiens
EEPLFFPSA

SEQ ID NO: 1295752 - protein, 9 aa, Homo Sapiens
SRLGGGRRG

SEQ ID NO: 1295753 - protein, 9 aa, Homo Sapiens
VLFTLVRQL

SEQ ID NO: 1295754 - protein, 9 aa, Homo Sapiens
LGGGGVLGM

SEQ ID NO: 1295755 - protein, 9 aa, Homo Sapiens
SNNARITYA

SEQ ID NO: 1295756 - protein, 9 aa, Homo Sapiens
AAAAAAQRG

SEQ ID NO: 1295757 - protein, 9 aa, Homo Sapiens
REPAHPHRR

SEQ ID NO: 1295758 - protein, 9 aa, Homo Sapiens
GILPSSRGM

SEQ ID NO: 1295759 - protein, 9 aa, Homo Sapiens
RLEGLNDLR

SEQ ID NO: 1295760 - protein, 9 aa, Homo Sapiens
NGSTNHQEP

SEQ ID NO: 1295761 - protein, 9 aa, Homo Sapiens
FSWSGCLSL

SEQ ID NO: 1295762 - protein, 9 aa, Homo Sapiens
HCPTATAAC

SEQ ID NO: 1295763 - protein, 9 aa, Homo Sapiens
SSDSELTVF

SEQ ID NO: 1295764 - protein, 9 aa, Homo Sapiens
KIPSTPRYL

SEQ ID NO: 1295765 - protein, 9 aa, Homo Sapiens
MMGHFPSQP

SEQ ID NO: 1295766 - protein, 9 aa, Homo Sapiens
SQKDIDGKN

SEQ ID NO: 1295767 - protein, 9 aa, Homo Sapiens
EGLVHNGWG

SEQ ID NO: 1295768 - protein, 9 aa, Homo Sapiens
PIVKLFDVP

SEQ ID NO: 1295769 - protein, 9 aa, Homo Sapiens
GRILQCTAI

SEQ ID NO: 1295770 - protein, 9 aa, Homo Sapiens
HQLPIAEVM

SEQ ID NO: 1295771 - protein, 9 aa, Homo Sapiens
MRMNQVPTV

SEQ ID NO: 1295772 - protein, 9 aa, Homo Sapiens
YLSVPLPAK

SEQ ID NO: 1295773 - protein, 9 aa, Homo Sapiens
GSIFLLFCL

SEQ ID NO: 1295774 - protein, 9 aa, Homo Sapiens
VDQVLCGGR

SEQ ID NO: 1295775 - protein, 9 aa, Homo Sapiens
IPQFKLEEY

SEQ ID NO: 1295776 - protein, 9 aa, Homo Sapiens
QASELALCA

SEQ ID NO: 1295777 - protein, 9 aa, Homo Sapiens
APTGWDKKR

SEQ ID NO: 1295778 - protein, 9 aa, Homo Sapiens
AGAGAAGKR

SEQ ID NO: 1295779 - protein, 9 aa, Homo Sapiens
FFGVSAVTG

SEQ ID NO: 1295780 - protein, 9 aa, Homo Sapiens
SRPGWKRTQ

SEQ ID NO: 1295781 - protein, 9 aa, Homo Sapiens
PRSPTRCCR

SEQ ID NO: 1295782 - protein, 9 aa, Homo Sapiens
NSFWQYWLI

SEQ ID NO: 1295783 - protein, 9 aa, Homo Sapiens
EAVPVQKEA

SEQ ID NO: 1295784 - protein, 9 aa, Homo Sapiens
PWRTSRGQA

SEQ ID NO: 1295785 - protein, 9 aa, Homo Sapiens
WTQRSPSGC

SEQ ID NO: 1295786 - protein, 9 aa, Homo Sapiens
DSLQDIQSL

SEQ ID NO: 1295787 - protein, 9 aa, Homo Sapiens
RSVLSVPAG

SEQ ID NO: 1295788 - protein, 9 aa, Homo Sapiens
RPWCRESLG

SEQ ID NO: 1295789 - protein, 9 aa, Homo Sapiens
MYPVKSVAW

SEQ ID NO: 1295790 - protein, 9 aa, Homo Sapiens
DYGDITVAT

SEQ ID NO: 1295791 - protein, 9 aa, Homo Sapiens
LGKNLSKLS

SEQ ID NO: 1295792 - protein, 9 aa, Homo Sapiens
TVQWDGAGR

SEQ ID NO: 1295793 - protein, 9 aa, Homo Sapiens
LGVWCLLSF

SEQ ID NO: 1295794 - protein, 9 aa, Homo Sapiens
WSSSSALGL

SEQ ID NO: 1295795 - protein, 9 aa, Homo Sapiens
PLAPGESHR

SEQ ID NO: 1295796 - protein, 9 aa, Homo Sapiens
YRSLREIDH

SEQ ID NO: 1295797 - protein, 9 aa, Homo Sapiens
KPASMPWGS

SEQ ID NO: 1295798 - protein, 9 aa, Homo Sapiens
GGSARHAVF

SEQ ID NO: 1295799 - protein, 9 aa, Homo Sapiens
NILEGDRLG

SEQ ID NO: 1295800 - protein, 9 aa, Homo Sapiens
PQESCLMST

SEQ ID NO: 1295801 - protein, 9 aa, Homo Sapiens
CFLFLGRNS

SEQ ID NO: 1295802 - protein, 9 aa, Homo Sapiens
HRLSSLRAS

SEQ ID NO: 1295803 - protein, 9 aa, Homo Sapiens
GRKPRCTQE

SEQ ID NO: 1295804 - protein, 9 aa, Homo Sapiens
SRRKTPNSL

SEQ ID NO: 1295805 - protein, 9 aa, Homo Sapiens
RNMFLILLQ

SEQ ID NO: 1295806 - protein, 9 aa, Homo Sapiens
VEDAEPDED

SEQ ID NO: 1295807 - protein, 9 aa, Homo Sapiens
LKTTQPTVI

SEQ ID NO: 1295808 - protein, 9 aa, Homo Sapiens
CVPPEGRHR

SEQ ID NO: 1295809 - protein, 9 aa, Homo Sapiens
AAVWKVVFG

SEQ ID NO: 1295810 - protein, 9 aa, Homo Sapiens
ASTLARTGF

SEQ ID NO: 1295811 - protein, 9 aa, Homo Sapiens
QAMEGGVLL

SEQ ID NO: 1295812 - protein, 9 aa, Homo Sapiens
NRLMVLQVD

SEQ ID NO: 1295813 - protein, 9 aa, Homo Sapiens
CMAPEMVCQ

SEQ ID NO: 1295814 - protein, 9 aa, Homo Sapiens
IVDPYMRVA

SEQ ID NO: 1295815 - protein, 9 aa, Homo Sapiens
LCKRMSEQI

SEQ ID NO: 1295816 - protein, 9 aa, Homo Sapiens
SDDDDDDFN

SEQ ID NO: 1295817 - protein, 9 aa, Homo Sapiens
AGAGPPAAQ

SEQ ID NO: 1295818 - protein, 9 aa, Homo Sapiens
DSNGIITQY

SEQ ID NO: 1295819 - protein, 9 aa, Homo Sapiens
PDGIGSGSK

SEQ ID NO: 1295820 - protein, 9 aa, Homo Sapiens
LNWILVDLA

SEQ ID NO: 1295821 - protein, 9 aa, Homo Sapiens
APGESHRGA

SEQ ID NO: 1295822 - protein, 9 aa, Homo Sapiens
MRTFRVLRA

SEQ ID NO: 1295823 - protein, 9 aa, Homo Sapiens
DINGIQAKF

SEQ ID NO: 1295824 - protein, 9 aa, Homo Sapiens
EQQPRALAP

SEQ ID NO: 1295825 - protein, 9 aa, Homo Sapiens
EGPGGGQLS

SEQ ID NO: 1295826 - protein, 9 aa, Homo Sapiens
MGVLLPASP

SEQ ID NO: 1295827 - protein, 9 aa, Homo Sapiens
SNSDSDEKV

SEQ ID NO: 1295828 - protein, 9 aa, Homo Sapiens
MPMYVFLLT

SEQ ID NO: 1295829 - protein, 9 aa, Homo Sapiens
RRPRAGLLG

SEQ ID NO: 1295830 - protein, 9 aa, Homo Sapiens
AWYAKLGVW

SEQ ID NO: 1295831 - protein, 9 aa, Homo Sapiens
ESLGGWRGW

SEQ ID NO: 1295832 - protein, 9 aa, Homo Sapiens
QREPAHPHR

SEQ ID NO: 1295833 - protein, 9 aa, Homo Sapiens
LPAQDTPPV

SEQ ID NO: 1295834 - protein, 9 aa, Homo Sapiens
PGGGCWARA

SEQ ID NO: 1295835 - protein, 9 aa, Homo Sapiens
YPVKSVAWR

SEQ ID NO: 1295836 - protein, 9 aa, Homo Sapiens
MRMVKENFK

SEQ ID NO: 1295837 - protein, 9 aa, Homo Sapiens
CTACSPPRL

SEQ ID NO: 1295838 - protein, 9 aa, Homo Sapiens
QAPDAVGLG

SEQ ID NO: 1295839 - protein, 9 aa, Homo Sapiens
VELRRRTDP

SEQ ID NO: 1295840 - protein, 9 aa, Homo Sapiens
IDLRGISGM

SEQ ID NO: 1295841 - protein, 9 aa, Homo Sapiens
GIDGVKPPM

SEQ ID NO: 1295842 - protein, 9 aa, Homo Sapiens
NNFGSVARM

SEQ ID NO: 1295843 - protein, 9 aa, Homo Sapiens
RDLLESNSD

SEQ ID NO: 1295844 - protein, 9 aa, Homo Sapiens
VGMFQDFND

SEQ ID NO: 1295845 - protein, 9 aa, Homo Sapiens
HSTATWTHP

SEQ ID NO: 1295846 - protein, 9 aa, Homo Sapiens
LRMLDLQGP

SEQ ID NO: 1295847 - protein, 9 aa, Homo Sapiens
ARPGQLRGR

SEQ ID NO: 1295848 - protein, 9 aa, Homo Sapiens
LDLQGPPCG

SEQ ID NO: 1295849 - protein, 9 aa, Homo Sapiens
ESSIWKRLK

SEQ ID NO: 1295850 - protein, 9 aa, Homo Sapiens
GISPSHSQQ

SEQ ID NO: 1295851 - protein, 9 aa, Homo Sapiens
LRFISDLSI

SEQ ID NO: 1295852 - protein, 9 aa, Homo Sapiens
PPTTTTSSP

SEQ ID NO: 1295853 - protein, 9 aa, Homo Sapiens
LFGLRVAKR

SEQ ID NO: 1295854 - protein, 9 aa, Homo Sapiens
MLYVSSGSS

SEQ ID NO: 1295855 - protein, 9 aa, Homo Sapiens
IGPYCTEKS

SEQ ID NO: 1295856 - protein, 9 aa, Homo Sapiens
SCGSRGNRG

SEQ ID NO: 1295857 - protein, 9 aa, Homo Sapiens
VPLQIDTKP

SEQ ID NO: 1295858 - protein, 9 aa, Homo Sapiens
GLGPPATAP

SEQ ID NO: 1295859 - protein, 9 aa, Homo Sapiens
EVSITYQSP

SEQ ID NO: 1295860 - protein, 9 aa, Homo Sapiens
RRAHVYTAS

SEQ ID NO: 1295861 - protein, 9 aa, Homo Sapiens
HELWQLEVL

SEQ ID NO: 1295862 - protein, 9 aa, Homo Sapiens
QKKITTRNS

SEQ ID NO: 1295863 - protein, 9 aa, Homo Sapiens
RTGFLYTGE

SEQ ID NO: 1295864 - protein, 9 aa, Homo Sapiens
ELPGFLAHE

SEQ ID NO: 1295865 - protein, 9 aa, Homo Sapiens
VELQTKHAA

SEQ ID NO: 1295866 - protein, 9 aa, Homo Sapiens
RGTCPCSAP

SEQ ID NO: 1295867 - protein, 9 aa, Homo Sapiens
RRPGRGALL

SEQ ID NO: 1295868 - protein, 9 aa, Homo Sapiens
LAPSEWAGS

SEQ ID NO: 1295869 - protein, 9 aa, Homo Sapiens
GRRLCRAED

SEQ ID NO: 1295870 - protein, 9 aa, Homo Sapiens
LIIRIVMGP

SEQ ID NO: 1295871 - protein, 9 aa, Homo Sapiens
GMSRTPPRR

SEQ ID NO: 1295872 - protein, 9 aa, Homo Sapiens
GYGEDHRAD

SEQ ID NO: 1295873 - protein, 9 aa, Homo Sapiens
PRNPDARSA

SEQ ID NO: 1295874 - protein, 9 aa, Homo Sapiens
WSTIYGSRL

SEQ ID NO: 1295875 - protein, 9 aa, Homo Sapiens
LVDIMDIRN

SEQ ID NO: 1295876 - protein, 9 aa, Homo Sapiens
QSNSQLSTT

SEQ ID NO: 1295877 - protein, 9 aa, Homo Sapiens
CGFELDSGS

SEQ ID NO: 1295878 - protein, 9 aa, Homo Sapiens
PAIVEGYNS

SEQ ID NO: 1295879 - protein, 9 aa, Homo Sapiens
LGSMEKSLG

SEQ ID NO: 1295880 - protein, 9 aa, Homo Sapiens
GGDARAAGG

SEQ ID NO: 1295881 - protein, 9 aa, Homo Sapiens
HQRRKKRRW

SEQ ID NO: 1295882 - protein, 9 aa, Homo Sapiens
RGHVPHCPG

SEQ ID NO: 1295883 - protein, 9 aa, Homo Sapiens
GAAAALQGE

SEQ ID NO: 1295884 - protein, 9 aa, Homo Sapiens
SSSTTTVAS

SEQ ID NO: 1295885 - protein, 9 aa, Homo Sapiens
ESNSDSDEK

SEQ ID NO: 1295886 - protein, 9 aa, Homo Sapiens
LKLFDRLQE

SEQ ID NO: 1295887 - protein, 9 aa, Homo Sapiens
CVATGSEDM

SEQ ID NO: 1295888 - protein, 9 aa, Homo Sapiens
ASVLHDLKD

SEQ ID NO: 1295889 - protein, 9 aa, Homo Sapiens
PSPKPPTPC

SEQ ID NO: 1295890 - protein, 9 aa, Homo Sapiens
RRSSSAWAP

SEQ ID NO: 1295891 - protein, 9 aa, Homo Sapiens
EDAPPNEEK

SEQ ID NO: 1295892 - protein, 9 aa, Homo Sapiens
APNIQIHSQ

SEQ ID NO: 1295893 - protein, 9 aa, Homo Sapiens
EHARGPQRD

SEQ ID NO: 1295894 - protein, 9 aa, Homo Sapiens
GWGAMALTR

SEQ ID NO: 1295895 - protein, 9 aa, Homo Sapiens
RRREKTVRN

SEQ ID NO: 1295896 - protein, 9 aa, Homo Sapiens
RLTHPACAR

SEQ ID NO: 1295897 - protein, 9 aa, Homo Sapiens
MWSWGRPSP

SEQ ID NO: 1295898 - protein, 9 aa, Homo Sapiens
TMTLGASWV

SEQ ID NO: 1295899 - protein, 9 aa, Homo Sapiens
SGCQGRPRG

SEQ ID NO: 1295900 - protein, 9 aa, Homo Sapiens
AGKGAGARG

SEQ ID NO: 1295901 - protein, 9 aa, Homo Sapiens
VWLCGDVWW

SEQ ID NO: 1295902 - protein, 9 aa, Homo Sapiens
GVLLPALYE

SEQ ID NO: 1295903 - protein, 9 aa, Homo Sapiens
PSTPRYLRS

SEQ ID NO: 1295904 - protein, 9 aa, Homo Sapiens
RICCVRPLV

SEQ ID NO: 1295905 - protein, 9 aa, Homo Sapiens
PGGSRPGWK

SEQ ID NO: 1295906 - protein, 9 aa, Homo Sapiens
PGQLLRLLL

SEQ ID NO: 1295907 - protein, 9 aa, Homo Sapiens
QGTRSLTLG

SEQ ID NO: 1295908 - protein, 9 aa, Homo Sapiens
ARVCERCFQ

SEQ ID NO: 1295909 - protein, 9 aa, Homo Sapiens
NGLRPVLRV

SEQ ID NO: 1295910 - protein, 9 aa, Homo Sapiens
QGACVATGS

SEQ ID NO: 1295911 - protein, 9 aa, Homo Sapiens
MILLMERIA

SEQ ID NO: 1295912 - protein, 9 aa, Homo Sapiens
PSHSESSIW

SEQ ID NO: 1295913 - protein, 9 aa, Homo Sapiens
LHHLTTDHN

SEQ ID NO: 1295914 - protein, 9 aa, Homo Sapiens
LPRVPDGVI

SEQ ID NO: 1295915 - protein, 9 aa, Homo Sapiens
GMVNVTRED

SEQ ID NO: 1295916 - protein, 9 aa, Homo Sapiens
QGVPKHLLG

SEQ ID NO: 1295917 - protein, 9 aa, Homo Sapiens
EPHPAGGVH

SEQ ID NO: 1295918 - protein, 9 aa, Homo Sapiens
IVAANPLFL

SEQ ID NO: 1295919 - protein, 9 aa, Homo Sapiens
DVLGSQVIR

SEQ ID NO: 1295920 - protein, 9 aa, Homo Sapiens
GSDGTLSPA

SEQ ID NO: 1295921 - protein, 9 aa, Homo Sapiens
PSLFDAADG

SEQ ID NO: 1295922 - protein, 9 aa, Homo Sapiens
RMEGQPMRC

SEQ ID NO: 1295923 - protein, 9 aa, Homo Sapiens
KYRSLREID

SEQ ID NO: 1295924 - protein, 9 aa, Homo Sapiens
GIVTVGNTI

SEQ ID NO: 1295925 - protein, 9 aa, Homo Sapiens
QGHLDPQDQ

SEQ ID NO: 1295926 - protein, 9 aa, Homo Sapiens
TLKKEKSKV

SEQ ID NO: 1295927 - protein, 9 aa, Homo Sapiens
PPLILWPQA

SEQ ID NO: 1295928 - protein, 9 aa, Homo Sapiens
FFCIFSRDV

SEQ ID NO: 1295929 - protein, 9 aa, Homo Sapiens
LHQPLPGQH

SEQ ID NO: 1295930 - protein, 9 aa, Homo Sapiens
EVPRCAMAP

SEQ ID NO: 1295931 - protein, 9 aa, Homo Sapiens
LLTVLIPCF

SEQ ID NO: 1295932 - protein, 9 aa, Homo Sapiens
RKDCKWSSC

SEQ ID NO: 1295933 - protein, 9 aa, Homo Sapiens
EDKECKKKD

SEQ ID NO: 1295934 - protein, 9 aa, Homo Sapiens
PTPRSPTRC

SEQ ID NO: 1295935 - protein, 9 aa, Homo Sapiens
SVLSVPAGI

SEQ ID NO: 1295936 - protein, 9 aa, Homo Sapiens
FSGLVDIMD

SEQ ID NO: 1295937 - protein, 9 aa, Homo Sapiens
MHELEQQNK

SEQ ID NO: 1295938 - protein, 9 aa, Homo Sapiens
LEAVLPQAV

SEQ ID NO: 1295939 - protein, 9 aa, Homo Sapiens
QASMTLPAP

SEQ ID NO: 1295940 - protein, 9 aa, Homo Sapiens
SRREREHHV

SEQ ID NO: 1295941 - protein, 9 aa, Homo Sapiens
PPQSSPFLA

SEQ ID NO: 1295942 - protein, 9 aa, Homo Sapiens
TSRGQAQDT

SEQ ID NO: 1295943 - protein, 9 aa, Homo Sapiens
NYDHCPSTP

SEQ ID NO: 1295944 - protein, 9 aa, Homo Sapiens
RPEAAHELW

SEQ ID NO: 1295945 - protein, 9 aa, Homo Sapiens
TRKASTQAS

SEQ ID NO: 1295946 - protein, 9 aa, Homo Sapiens
KNCLCTLNL

SEQ ID NO: 1295947 - protein, 9 aa, Homo Sapiens
ACSPPRLCV

SEQ ID NO: 1295948 - protein, 9 aa, Homo Sapiens
LRGTVGVPA

SEQ ID NO: 1295949 - protein, 9 aa, Homo Sapiens
QRSAQWLDQ

SEQ ID NO: 1295950 - protein, 8 aa, Homo Sapiens
SDQEAKPS

SEQ ID NO: 1295951 - protein, 9 aa, Homo Sapiens
SPARTKCPR

SEQ ID NO: 1295952 - protein, 9 aa, Homo Sapiens
SRGMGRRPR

SEQ ID NO: 1295953 - protein, 9 aa, Homo Sapiens
TVFGEAAPF

SEQ ID NO: 1295954 - protein, 9 aa, Homo Sapiens
TCLSPEPDS

SEQ ID NO: 1295955 - protein, 9 aa, Homo Sapiens
TRTCPSPPW

SEQ ID NO: 1295956 - protein, 9 aa, Homo Sapiens
SERRQRSPS

SEQ ID NO: 1295957 - protein, 9 aa, Homo Sapiens
MSYSSPKAQ

SEQ ID NO: 1295958 - protein, 9 aa, Homo Sapiens
WDFTLKRKC

SEQ ID NO: 1295959 - protein, 9 aa, Homo Sapiens
ADIQDYGLI

SEQ ID NO: 1295960 - protein, 9 aa, Homo Sapiens
ADAELDWVA

SEQ ID NO: 1295961 - protein, 9 aa, Homo Sapiens
WDSQMPGQP

SEQ ID NO: 1295962 - protein, 9 aa, Homo Sapiens
SMEKSLGKN

SEQ ID NO: 1295963 - protein, 9 aa, Homo Sapiens
DDDMVLDPS

SEQ ID NO: 1295964 - protein, 9 aa, Homo Sapiens
IKQKCIEQR

SEQ ID NO: 1295965 - protein, 9 aa, Homo Sapiens
TAAEGEGML

SEQ ID NO: 1295966 - protein, 9 aa, Homo Sapiens
TPCSSARTT

SEQ ID NO: 1295967 - protein, 9 aa, Homo Sapiens
PETTLWLGP

SEQ ID NO: 1295968 - protein, 9 aa, Homo Sapiens
NCLVRGRGG

SEQ ID NO: 1295969 - protein, 9 aa, Homo Sapiens
FCFSPLWLM

SEQ ID NO: 1295970 - protein, 9 aa, Homo Sapiens
ILINCCTLE

SEQ ID NO: 1295971 - protein, 9 aa, Homo Sapiens
DARHSPELG

SEQ ID NO: 1295972 - protein, 9 aa, Homo Sapiens
LPGHSQREP

SEQ ID NO: 1295973 - protein, 9 aa, Homo Sapiens
GCWLSFNLP

SEQ ID NO: 1295974 - protein, 9 aa, Homo Sapiens
RELWQVPAA

SEQ ID NO: 1295975 - protein, 9 aa, Homo Sapiens
KNSSHIYYE

SEQ ID NO: 1295976 - protein, 9 aa, Homo Sapiens
EDHRADFWC

SEQ ID NO: 1295977 - protein, 9 aa, Homo Sapiens
AHAVVRAGV

SEQ ID NO: 1295978 - protein, 9 aa, Homo Sapiens
VEWEVKKEA

SEQ ID NO: 1295979 - protein, 9 aa, Homo Sapiens
PRLRLPLPT

SEQ ID NO: 1295980 - protein, 9 aa, Homo Sapiens
GVILGVEEP

SEQ ID NO: 1295981 - protein, 9 aa, Homo Sapiens
GAGAGAAGK

SEQ ID NO: 1295982 - protein, 9 aa, Homo Sapiens
NTLPKVRPI

SEQ ID NO: 1295983 - protein, 9 aa, Homo Sapiens
EWEVKKEAK

SEQ ID NO: 1295984 - protein, 9 aa, Homo Sapiens
FPDSQEKMD

SEQ ID NO: 1295985 - protein, 9 aa, Homo Sapiens
GAAPMMSSM

SEQ ID NO: 1295986 - protein, 9 aa, Homo Sapiens
GLSLYLQTR

SEQ ID NO: 1295987 - protein, 9 aa, Homo Sapiens
NGHIVGSKP

SEQ ID NO: 1295988 - protein, 9 aa, Homo Sapiens
WQQSWEIVM

SEQ ID NO: 1295989 - protein, 9 aa, Homo Sapiens
ADSSSMGSP

SEQ ID NO: 1295990 - protein, 9 aa, Homo Sapiens
ITNPSSSGK

SEQ ID NO: 1295991 - protein, 9 aa, Homo Sapiens
LKEKLSALR

SEQ ID NO: 1295992 - protein, 9 aa, Homo Sapiens
ELERGVRMK

SEQ ID NO: 1295993 - protein, 9 aa, Homo Sapiens
LFLTGAYIL

SEQ ID NO: 1295994 - protein, 9 aa, Homo Sapiens
GGTTIGEVT

SEQ ID NO: 1295995 - protein, 9 aa, Homo Sapiens
APDAVGLGD

SEQ ID NO: 1295996 - protein, 9 aa, Homo Sapiens
ARAMTERWP

SEQ ID NO: 1295997 - protein, 9 aa, Homo Sapiens
SKCDGNSSL

SEQ ID NO: 1295998 - protein, 9 aa, Homo Sapiens
PSEGSHHIT

SEQ ID NO: 1295999 - protein, 9 aa, Homo Sapiens
EEVRKKDTV

SEQ ID NO: 1296000 - protein, 9 aa, Homo Sapiens
AAWSSVACP

SEQ ID NO: 1296001 - protein, 9 aa, Homo Sapiens
DSSTNAQVT

SEQ ID NO: 1296002 - protein, 9 aa, Homo Sapiens
SRKNTLGEA

SEQ ID NO: 1296003 - protein, 9 aa, Homo Sapiens
PLPNVTVRG

SEQ ID NO: 1296004 - protein, 9 aa, Homo Sapiens
PPTAPWRPR

SEQ ID NO: 1296005 - protein, 9 aa, Homo Sapiens
LLPASPVPT

SEQ ID NO: 1296006 - protein, 9 aa, Homo Sapiens
GGGHCQVHL

SEQ ID NO: 1296007 - protein, 9 aa, Homo Sapiens
PWEIPGKKT

SEQ ID NO: 1296008 - protein, 9 aa, Homo Sapiens
SRSVLSVPA

SEQ ID NO: 1296009 - protein, 9 aa, Homo Sapiens
SAACWPRAL

SEQ ID NO: 1296010 - protein, 9 aa, Homo Sapiens
YSYDDDDMV

SEQ ID NO: 1296011 - protein, 9 aa, Homo Sapiens
ASTQASLAS

SEQ ID NO: 1296012 - protein, 9 aa, Homo Sapiens
QEEKGLDGR

SEQ ID NO: 1296013 - protein, 9 aa, Homo Sapiens
VQAPDAVGL

SEQ ID NO: 1296014 - protein, 9 aa, Homo Sapiens
VHAYPGGSP

SEQ ID NO: 1296015 - protein, 9 aa, Homo Sapiens
GRQARPDGT

SEQ ID NO: 1296016 - protein, 9 aa, Homo Sapiens
VDRLSGELH

SEQ ID NO: 1296017 - protein, 9 aa, Homo Sapiens
SSGRVCAEK

SEQ ID NO: 1296018 - protein, 9 aa, Homo Sapiens
QITVSLSSL

SEQ ID NO: 1296019 - protein, 9 aa, Homo Sapiens
DDFQHAVSD

SEQ ID NO: 1296020 - protein, 9 aa, Homo Sapiens
LESNSDSDE

SEQ ID NO: 1296021 - protein, 9 aa, Homo Sapiens
QRQCMFDEN

SEQ ID NO: 1296022 - protein, 9 aa, Homo Sapiens
VLSVPAGIL

SEQ ID NO: 1296023 - protein, 9 aa, Homo Sapiens
FTLVRQLLD

SEQ ID NO: 1296024 - protein, 9 aa, Homo Sapiens
EVRPSLEVC

SEQ ID NO: 1296025 - protein, 9 aa, Homo Sapiens
VPDGVILGV

SEQ ID NO: 1296026 - protein, 9 aa, Homo Sapiens
SGLSADIQD

SEQ ID NO: 1296027 - protein, 9 aa, Homo Sapiens
AAPLPHPGA

SEQ ID NO: 1296028 - protein, 9 aa, Homo Sapiens
WSGCLSLGF

SEQ ID NO: 1296029 - protein, 9 aa, Homo Sapiens
DSTSTCLSP

SEQ ID NO: 1296030 - protein, 9 aa, Homo Sapiens
NQQGRWNNA

SEQ ID NO: 1296031 - protein, 9 aa, Homo Sapiens
GVLLPASPV

SEQ ID NO: 1296032 - protein, 9 aa, Homo Sapiens
LEGLNDLRR

SEQ ID NO: 1296033 - protein, 9 aa, Homo Sapiens
PVNRRPMFD

SEQ ID NO: 1296034 - protein, 9 aa, Homo Sapiens
RRCSQGGGE

SEQ ID NO: 1296035 - protein, 9 aa, Homo Sapiens
GDITVATTS

SEQ ID NO: 1296036 - protein, 9 aa, Homo Sapiens
SATQASMTL

SEQ ID NO: 1296037 - protein, 9 aa, Homo Sapiens
WRGWWGNGW

SEQ ID NO: 1296038 - protein, 9 aa, Homo Sapiens
PWEEGRRLC

SEQ ID NO: 1296039 - protein, 9 aa, Homo Sapiens
GRNDADTFE

SEQ ID NO: 1296040 - protein, 9 aa, Homo Sapiens
RSPPTLMMS

SEQ ID NO: 1296041 - protein, 9 aa, Homo Sapiens
NEGFDLSTL

SEQ ID NO: 1296042 - protein, 9 aa, Homo Sapiens
TSSPRRSPA

SEQ ID NO: 1296043 - protein, 9 aa, Homo Sapiens
CWARAGGHQ

SEQ ID NO: 1296044 - protein, 9 aa, Homo Sapiens
QAGPCRGRS

SEQ ID NO: 1296045 - protein, 9 aa, Homo Sapiens
GPPCGRWKP

SEQ ID NO: 1296046 - protein, 9 aa, Homo Sapiens
SIGKIVNEL

SEQ ID NO: 1296047 - protein, 9 aa, Homo Sapiens
VWAGQPGPE

SEQ ID NO: 1296048 - protein, 9 aa, Homo Sapiens
PSPTMPPPP

SEQ ID NO: 1296049 - protein, 9 aa, Homo Sapiens
KLVHLVIRP

SEQ ID NO: 1296050 - protein, 9 aa, Homo Sapiens
EPVGQKTAR

SEQ ID NO: 1296051 - protein, 9 aa, Homo Sapiens
MQAMEGGVL

SEQ ID NO: 1296052 - protein, 9 aa, Homo Sapiens
PPVVINATD

SEQ ID NO: 1296053 - protein, 9 aa, Homo Sapiens
QGDKNKKIV

SEQ ID NO: 1296054 - protein, 9 aa, Homo Sapiens
GRNSFWQYW

SEQ ID NO: 1296055 - protein, 9 aa, Homo Sapiens
AGLGPVEDA

SEQ ID NO: 1296056 - protein, 9 aa, Homo Sapiens
LHKNKGRRK

SEQ ID NO: 1296057 - protein, 9 aa, Homo Sapiens
HEKAAVLDT

SEQ ID NO: 1296058 - protein, 9 aa, Homo Sapiens
QSAKSGSTA

SEQ ID NO: 1296059 - protein, 9 aa, Homo Sapiens
PAVERVSTL

SEQ ID NO: 1296060 - protein, 9 aa, Homo Sapiens
TSKHQKLDT

SEQ ID NO: 1296061 - protein, 9 aa, Homo Sapiens
HAVSGCGRA

SEQ ID NO: 1296062 - protein, 9 aa, Homo Sapiens
TTAHEKCLG

SEQ ID NO: 1296063 - protein, 9 aa, Homo Sapiens
SVEDINRIQ

SEQ ID NO: 1296064 - protein, 9 aa, Homo Sapiens
AGGVCPPGA

SEQ ID NO: 1296065 - protein, 9 aa, Homo Sapiens
LTRLTHHPI

SEQ ID NO: 1296066 - protein, 9 aa, Homo Sapiens
DRNLYRCCD

SEQ ID NO: 1296067 - protein, 9 aa, Homo Sapiens
LDSLQDIQS

SEQ ID NO: 1296068 - protein, 9 aa, Homo Sapiens
SPTRPLPPS

SEQ ID NO: 1296069 - protein, 9 aa, Homo Sapiens
SNGIITQYE

SEQ ID NO: 1296070 - protein, 9 aa, Homo Sapiens
IRHSISMPT

SEQ ID NO: 1296071 - protein, 9 aa, Homo Sapiens
MTLPAPTAC

SEQ ID NO: 1296072 - protein, 9 aa, Homo Sapiens
NLESHMKVH

SEQ ID NO: 1296073 - protein, 9 aa, Homo Sapiens
VARAPAAVQ

SEQ ID NO: 1296074 - protein, 9 aa, Homo Sapiens
TCGLSNLNG

SEQ ID NO: 1296075 - protein, 9 aa, Homo Sapiens
LDNGHPQDP

SEQ ID NO: 1296076 - protein, 9 aa, Homo Sapiens
PASQSFGIT

SEQ ID NO: 1296077 - protein, 9 aa, Homo Sapiens
GSGRSTPRL

SEQ ID NO: 1296078 - protein, 9 aa, Homo Sapiens
VDIMDIRNA

SEQ ID NO: 1296079 - protein, 9 aa, Homo Sapiens
IEHGLGDPL

SEQ ID NO: 1296080 - protein, 9 aa, Homo Sapiens
LTCLSLERS

SEQ ID NO: 1296081 - protein, 9 aa, Homo Sapiens
DEMNGHIVG

SEQ ID NO: 1296082 - protein, 9 aa, Homo Sapiens
VTLYLETPK

SEQ ID NO: 1296083 - protein, 9 aa, Homo Sapiens
EVTDGSHTI

SEQ ID NO: 1296084 - protein, 9 aa, Homo Sapiens
SGIHPGATT

SEQ ID NO: 1296085 - protein, 9 aa, Homo Sapiens
VMYPVKSVA

SEQ ID NO: 1296086 - protein, 9 aa, Homo Sapiens
LVVVGAAGV

SEQ ID NO: 1296087 - protein, 9 aa, Homo Sapiens
ALQRQLLGL

SEQ ID NO: 1296088 - protein, 9 aa, Homo Sapiens
EARSDTYDT

SEQ ID NO: 1296089 - protein, 9 aa, Homo Sapiens
YGPASTMLY

SEQ ID NO: 1296090 - protein, 9 aa, Homo Sapiens
SSSAWAPQT

SEQ ID NO: 1296091 - protein, 9 aa, Homo Sapiens
CLVRGRGGP

SEQ ID NO: 1296092 - protein, 9 aa, Homo Sapiens
GAWKSIFRL

SEQ ID NO: 1296093 - protein, 9 aa, Homo Sapiens
AKEVFPKML

SEQ ID NO: 1296094 - protein, 9 aa, Homo Sapiens
TVLGVRSQR

SEQ ID NO: 1296095 - protein, 9 aa, Homo Sapiens
MCLDIPAHP

SEQ ID NO: 1296096 - protein, 9 aa, Homo Sapiens
WQVPAAGVP

SEQ ID NO: 1296097 - protein, 9 aa, Homo Sapiens
SWNTMQWNN

SEQ ID NO: 1296098 - protein, 9 aa, Homo Sapiens
LVAQAALRA

SEQ ID NO: 1296099 - protein, 9 aa, Homo Sapiens
PNVTVRGAT

SEQ ID NO: 1296100 - protein, 9 aa, Homo Sapiens
DRGCLLQLG

SEQ ID NO: 1296101 - protein, 9 aa, Homo Sapiens
HNGAPGCDG

SEQ ID NO: 1296102 - protein, 9 aa, Homo Sapiens
QARWSVRTG

SEQ ID NO: 1296103 - protein, 9 aa, Homo Sapiens
TVGVPAFVQ

SEQ ID NO: 1296104 - protein, 9 aa, Homo Sapiens
HRGASCHFS

SEQ ID NO: 1296105 - protein, 9 aa, Homo Sapiens
VRHRTLPAF

SEQ ID NO: 1296106 - protein, 9 aa, Homo Sapiens
DVLHRQVLP

SEQ ID NO: 1296107 - protein, 9 aa, Homo Sapiens
REEEQALCC

SEQ ID NO: 1296108 - protein, 9 aa, Homo Sapiens
PLPGQHLWL

SEQ ID NO: 1296109 - protein, 9 aa, Homo Sapiens
AFSGLVDIM

SEQ ID NO: 1296110 - protein, 9 aa, Homo Sapiens
SVFPYQNEM

SEQ ID NO: 1296111 - protein, 9 aa, Homo Sapiens
AHHCQYKLT

SEQ ID NO: 1296112 - protein, 9 aa, Homo Sapiens
DTCDIYLIS

SEQ ID NO: 1296113 - protein, 9 aa, Homo Sapiens
LQPAALGEV

SEQ ID NO: 1296114 - protein, 9 aa, Homo Sapiens
AGPCRGRSS

SEQ ID NO: 1296115 - protein, 9 aa, Homo Sapiens
TISRYYRKM

SEQ ID NO: 1296116 - protein, 9 aa, Homo Sapiens
RISVPVART

SEQ ID NO: 1296117 - protein, 9 aa, Homo Sapiens
RGQLSCSWT

SEQ ID NO: 1296118 - protein, 9 aa, Homo Sapiens
RLCVLLLLS

SEQ ID NO: 1296119 - protein, 9 aa, Homo Sapiens
PTGLRKARM

SEQ ID NO: 1296120 - protein, 9 aa, Homo Sapiens
RPTVAFLPP

SEQ ID NO: 1296121 - protein, 9 aa, Homo Sapiens
AHLLVYILW

SEQ ID NO: 1296122 - protein, 9 aa, Homo Sapiens
KSQGGRILL

SEQ ID NO: 1296123 - protein, 9 aa, Homo Sapiens
NHVVKMADF

SEQ ID NO: 1296124 - protein, 9 aa, Homo Sapiens
VPPQLPQAG

SEQ ID NO: 1296125 - protein, 9 aa, Homo Sapiens
QMSPDIKQE

SEQ ID NO: 1296126 - protein, 9 aa, Homo Sapiens
QWNNKKMAM

SEQ ID NO: 1296127 - protein, 9 aa, Homo Sapiens
MNWKKMMIG

SEQ ID NO: 1296128 - protein, 9 aa, Homo Sapiens
SSCLTWASP

SEQ ID NO: 1296129 - protein, 9 aa, Homo Sapiens
CLKCGNIVV

SEQ ID NO: 1296130 - protein, 9 aa, Homo Sapiens
ARSPYCITE

SEQ ID NO: 1296131 - protein, 9 aa, Homo Sapiens
VEAAVDLYQ

SEQ ID NO: 1296132 - protein, 9 aa, Homo Sapiens
SEEDTRARA

SEQ ID NO: 1296133 - protein, 9 aa, Homo Sapiens
HGDVCTHSV

SEQ ID NO: 1296134 - protein, 9 aa, Homo Sapiens
VQKIFESSL

SEQ ID NO: 1296135 - protein, 9 aa, Homo Sapiens
RILVSDSLF

SEQ ID NO: 1296136 - protein, 9 aa, Homo Sapiens
GRRGRCEKQ

SEQ ID NO: 1296137 - protein, 9 aa, Homo Sapiens
EGFEPLGFW

SEQ ID NO: 1296138 - protein, 9 aa, Homo Sapiens
NAKPIRLNG

SEQ ID NO: 1296139 - protein, 9 aa, Homo Sapiens
VAAFMLAMQ

SEQ ID NO: 1296140 - protein, 9 aa, Homo Sapiens
SVWSSAATT

SEQ ID NO: 1296141 - protein, 9 aa, Homo Sapiens
LLMERIAWE

SEQ ID NO: 1296142 - protein, 9 aa, Homo Sapiens
LGTLVSIPV

SEQ ID NO: 1296143 - protein, 9 aa, Homo Sapiens
LGDPLKRDR

SEQ ID NO: 1296144 - protein, 9 aa, Homo Sapiens
HHRTHIGEK

SEQ ID NO: 1296145 - protein, 9 aa, Homo Sapiens
NQKSMEKEK

SEQ ID NO: 1296146 - protein, 9 aa, Homo Sapiens
TTARTYECG

SEQ ID NO: 1296147 - protein, 9 aa, Homo Sapiens
YNKDERMIL

SEQ ID NO: 1296148 - protein, 9 aa, Homo Sapiens
IVRPSIGKI

SEQ ID NO: 1296149 - protein, 9 aa, Homo Sapiens
RLCRAEDED

SEQ ID NO: 1296150 - protein, 9 aa, Homo Sapiens
LGRPEAAHE

SEQ ID NO: 1296151 - protein, 9 aa, Homo Sapiens
VTVAVPTVT

SEQ ID NO: 1296152 - protein, 9 aa, Homo Sapiens
SESPAGTPC

SEQ ID NO: 1296153 - protein, 9 aa, Homo Sapiens
AWLVWVPHP

SEQ ID NO: 1296154 - protein, 9 aa, Homo Sapiens
DLQGPPCGR

SEQ ID NO: 1296155 - protein, 9 aa, Homo Sapiens
VPGQLLRLL

SEQ ID NO: 1296156 - protein, 9 aa, Homo Sapiens
FVHRPWPAL

SEQ ID NO: 1296157 - protein, 9 aa, Homo Sapiens
KPLPRMETH

SEQ ID NO: 1296158 - protein, 9 aa, Homo Sapiens
VLCLHETVN

SEQ ID NO: 1296159 - protein, 9 aa, Homo Sapiens
VHNRVIDVS

SEQ ID NO: 1296160 - protein, 9 aa, Homo Sapiens
PGRRRARPG

SEQ ID NO: 1296161 - protein, 9 aa, Homo Sapiens
DRQLALQKE

SEQ ID NO: 1296162 - protein, 9 aa, Homo Sapiens
QPTMPGSMS

SEQ ID NO: 1296163 - protein, 9 aa, Homo Sapiens
KKEKSKVLI

SEQ ID NO: 1296164 - protein, 9 aa, Homo Sapiens
KRMAQKNCL

SEQ ID NO: 1296165 - protein, 9 aa, Homo Sapiens
YIKPCFKGI

SEQ ID NO: 1296166 - protein, 9 aa, Homo Sapiens
FGPASISRD

SEQ ID NO: 1296167 - protein, 9 aa, Homo Sapiens
PPHVKRHAV

SEQ ID NO: 1296168 - protein, 9 aa, Homo Sapiens
LHDLKDRYY

SEQ ID NO: 1296169 - protein, 9 aa, Homo Sapiens
AGVCCEPAT

SEQ ID NO: 1296170 - protein, 9 aa, Homo Sapiens
GASWVELRV

SEQ ID NO: 1296171 - protein, 9 aa, Homo Sapiens
TLMMSNGCW

SEQ ID NO: 1296172 - protein, 9 aa, Homo Sapiens
PPTKKRGKS

SEQ ID NO: 1296173 - protein, 9 aa, Homo Sapiens
STVKETRTE

SEQ ID NO: 1296174 - protein, 9 aa, Homo Sapiens
DTKPEVPRE

SEQ ID NO: 1296175 - protein, 9 aa, Homo Sapiens
ERVSTLTME

SEQ ID NO: 1296176 - protein, 9 aa, Homo Sapiens
LILLQSFFF

SEQ ID NO: 1296177 - protein, 9 aa, Homo Sapiens
AGMWEECVL

SEQ ID NO: 1296178 - protein, 9 aa, Homo Sapiens
KLTKNGLPV

SEQ ID NO: 1296179 - protein, 9 aa, Homo Sapiens
RPCRRSSSA

SEQ ID NO: 1296180 - protein, 9 aa, Homo Sapiens
VVAMGQDCY

SEQ ID NO: 1296181 - protein, 9 aa, Homo Sapiens
EVGGKPEEE

SEQ ID NO: 1296182 - protein, 9 aa, Homo Sapiens
QQQGQAHQD

SEQ ID NO: 1296183 - protein, 9 aa, Homo Sapiens
CRQAGMWEE

SEQ ID NO: 1296184 - protein, 9 aa, Homo Sapiens
RACSLHTAP

SEQ ID NO: 1296185 - protein, 9 aa, Homo Sapiens
CPPGARNLT

SEQ ID NO: 1296186 - protein, 9 aa, Homo Sapiens
LTLGDSWLQ

SEQ ID NO: 1296187 - protein, 9 aa, Homo Sapiens
ALFLIVDPY

SEQ ID NO: 1296188 - protein, 9 aa, Homo Sapiens
LANFHFQKD

SEQ ID NO: 1296189 - protein, 9 aa, Homo Sapiens
NYRIFIKQK

SEQ ID NO: 1296190 - protein, 9 aa, Homo Sapiens
NVPLPPPQS

SEQ ID NO: 1296191 - protein, 9 aa, Homo Sapiens
AGGFGGGQS

SEQ ID NO: 1296192 - protein, 9 aa, Homo Sapiens
ILGYVENIF

SEQ ID NO: 1296193 - protein, 9 aa, Homo Sapiens
IHSQETTYW

SEQ ID NO: 1296194 - protein, 9 aa, Homo Sapiens
LPALQRQLL

SEQ ID NO: 1296195 - protein, 9 aa, Homo Sapiens
AWKSIFRLY

SEQ ID NO: 1296196 - protein, 9 aa, Homo Sapiens
NWVETRLEV

SEQ ID NO: 1296197 - protein, 9 aa, Homo Sapiens
NLIQNRSPT

SEQ ID NO: 1296198 - protein, 9 aa, Homo Sapiens
SQTIVVDVN

SEQ ID NO: 1296199 - protein, 9 aa, Homo Sapiens
QNLASNDLP

SEQ ID NO: 1296200 - protein, 9 aa, Homo Sapiens
HSPLLRPRG

SEQ ID NO: 1296201 - protein, 9 aa, Homo Sapiens
LPASPVPTS

SEQ ID NO: 1296202 - protein, 9 aa, Homo Sapiens
PVLLSIPWT

SEQ ID NO: 1296203 - protein, 9 aa, Homo Sapiens
KCGNIVVYH

SEQ ID NO: 1296204 - protein, 9 aa, Homo Sapiens
SSSHKIQKI

SEQ ID NO: 1296205 - protein, 9 aa, Homo Sapiens
EAGVLAMDV

SEQ ID NO: 1296206 - protein, 9 aa, Homo Sapiens
GQSSGAQHQ

SEQ ID NO: 1296207 - protein, 9 aa, Homo Sapiens
PAGRGAPRH

SEQ ID NO: 1296208 - protein, 9 aa, Homo Sapiens
VQQPAGARA

SEQ ID NO: 1296209 - protein, 9 aa, Homo Sapiens
VLATGLHLH

SEQ ID NO: 1296210 - protein, 9 aa, Homo Sapiens
QSPGRAPPT

SEQ ID NO: 1296211 - protein, 9 aa, Homo Sapiens
VKETRTEGY

SEQ ID NO: 1296212 - protein, 9 aa, Homo Sapiens
PKRQRWRRR

SEQ ID NO: 1296213 - protein, 9 aa, Homo Sapiens
HPHRSPPTS

SEQ ID NO: 1296214 - protein, 9 aa, Homo Sapiens
SSRGMGRRP

SEQ ID NO: 1296215 - protein, 9 aa, Homo Sapiens
DPSTPASQS

SEQ ID NO: 1296216 - protein, 9 aa, Homo Sapiens
GASCHFSSS

SEQ ID NO: 1296217 - protein, 9 aa, Homo Sapiens
GRHLPGHSQ

SEQ ID NO: 1296218 - protein, 9 aa, Homo Sapiens
NLVLCLHET

SEQ ID NO: 1296219 - protein, 9 aa, Homo Sapiens
SEGLMSRPS

SEQ ID NO: 1296220 - protein, 9 aa, Homo Sapiens
AQVFLVVFL

SEQ ID NO: 1296221 - protein, 9 aa, Homo Sapiens
LGEVVGQHE

SEQ ID NO: 1296222 - protein, 9 aa, Homo Sapiens
VVVGAAGVG

SEQ ID NO: 1296223 - protein, 9 aa, Homo Sapiens
EQMGRILQC

SEQ ID NO: 1296224 - protein, 9 aa, Homo Sapiens
CQCLQFAMK

SEQ ID NO: 1296225 - protein, 9 aa, Homo Sapiens
IRRTSDNGQ

SEQ ID NO: 1296226 - protein, 9 aa, Homo Sapiens
RESLGGWRG

SEQ ID NO: 1296227 - protein, 9 aa, Homo Sapiens
SPADSSSMG

SEQ ID NO: 1296228 - protein, 9 aa, Homo Sapiens
LGQSEGLMS

SEQ ID NO: 1296229 - protein, 9 aa, Homo Sapiens
APPPSAAAA

SEQ ID NO: 1296230 - protein, 9 aa, Homo Sapiens
RSMSYSSPK

SEQ ID NO: 1296231 - protein, 9 aa, Homo Sapiens
IPLPAPCQV

SEQ ID NO: 1296232 - protein, 9 aa, Homo Sapiens
RLSFWSTIY

SEQ ID NO: 1296233 - protein, 9 aa, Homo Sapiens
NKLKECLHQ

SEQ ID NO: 1296234 - protein, 9 aa, Homo Sapiens
ANPLFLTGA

SEQ ID NO: 1296235 - protein, 9 aa, Homo Sapiens
MRSLDRALE

SEQ ID NO: 1296236 - protein, 9 aa, Homo Sapiens
VLHKNKGRR

SEQ ID NO: 1296237 - protein, 9 aa, Homo Sapiens
RLQELKLCF

SEQ ID NO: 1296238 - protein, 9 aa, Homo Sapiens
PWSPSTRTT

SEQ ID NO: 1296239 - protein, 9 aa, Homo Sapiens
PNLLTGETP

SEQ ID NO: 1296240 - protein, 9 aa, Homo Sapiens
VELRHLLVT

SEQ ID NO: 1296241 - protein, 9 aa, Homo Sapiens
ARWSVRTGA

SEQ ID NO: 1296242 - protein, 9 aa, Homo Sapiens
GDLWGGNIA

SEQ ID NO: 1296243 - protein, 9 aa, Homo Sapiens
CSIMSLSVP

SEQ ID NO: 1296244 - protein, 9 aa, Homo Sapiens
QGKNGVKFN

SEQ ID NO: 1296245 - protein, 9 aa, Homo Sapiens
HAVVRAGVD

SEQ ID NO: 1296246 - protein, 9 aa, Homo Sapiens
TSAASAPQT

SEQ ID NO: 1296247 - protein, 9 aa, Homo Sapiens
SHQGLAVPW

SEQ ID NO: 1296248 - protein, 9 aa, Homo Sapiens
EGEKTSELT

SEQ ID NO: 1296249 - protein, 9 aa, Homo Sapiens
CKRMSEQIF

SEQ ID NO: 1296250 - protein, 9 aa, Homo Sapiens
FVVRTERGC

SEQ ID NO: 1296251 - protein, 9 aa, Homo Sapiens
GEEGGGVPL

SEQ ID NO: 1296252 - protein, 9 aa, Homo Sapiens
ECKKKDEEK

SEQ ID NO: 1296253 - protein, 9 aa, Homo Sapiens
YNNTLHMPM

SEQ ID NO: 1296254 - protein, 9 aa, Homo Sapiens
EGHAAEVCG

SEQ ID NO: 1296255 - protein, 9 aa, Homo Sapiens
PLVLKEFRR

SEQ ID NO: 1296256 - protein, 9 aa, Homo Sapiens
IDCFGLFSK

SEQ ID NO: 1296257 - protein, 9 aa, Homo Sapiens
NSAPLALLH

SEQ ID NO: 1296258 - protein, 9 aa, Homo Sapiens
HCTACSPPR

SEQ ID NO: 1296259 - protein, 9 aa, Homo Sapiens
GFDLSTLSD

SEQ ID NO: 1296260 - protein, 9 aa, Homo Sapiens
IHDQIKHLQ

SEQ ID NO: 1296261 - protein, 9 aa, Homo Sapiens
VPHCPGACQ

SEQ ID NO: 1296262 - protein, 9 aa, Homo Sapiens
CGRHLPGHS

SEQ ID NO: 1296263 - protein, 9 aa, Homo Sapiens
EQTALYRGG

SEQ ID NO: 1296264 - protein, 9 aa, Homo Sapiens
ERNMSWRPR

SEQ ID NO: 1296265 - protein, 9 aa, Homo Sapiens
VTDGSHTIA

SEQ ID NO: 1296266 - protein, 9 aa, Homo Sapiens
IGNRKKHGG

SEQ ID NO: 1296267 - protein, 9 aa, Homo Sapiens
RSLLESTKR

SEQ ID NO: 1296268 - protein, 9 aa, Homo Sapiens
LSEFMSPSP

SEQ ID NO: 1296269 - protein, 9 aa, Homo Sapiens
TPRYLRSVV

SEQ ID NO: 1296270 - protein, 9 aa, Homo Sapiens
PVLCIGLTG

SEQ ID NO: 1296271 - protein, 9 aa, Homo Sapiens
RRGGSAHTS

SEQ ID NO: 1296272 - protein, 9 aa, Homo Sapiens
FSRRGGSAH

SEQ ID NO: 1296273 - protein, 9 aa, Homo Sapiens
TEGGGHCQV

SEQ ID NO: 1296274 - protein, 9 aa, Homo Sapiens
GKNGVKFNV

SEQ ID NO: 1296275 - protein, 9 aa, Homo Sapiens
AGGAAAALQ

SEQ ID NO: 1296276 - protein, 9 aa, Homo Sapiens
NEKRFFAHL

SEQ ID NO: 1296277 - protein, 9 aa, Homo Sapiens
TAPWRPRAT

SEQ ID NO: 1296278 - protein, 9 aa, Homo Sapiens
AHELWQLEV

SEQ ID NO: 1296279 - protein, 9 aa, Homo Sapiens
ETRPNYCFL

SEQ ID NO: 1296280 - protein, 9 aa, Homo Sapiens
ARGPQRDGS

SEQ ID NO: 1296281 - protein, 9 aa, Homo Sapiens
SLGFSRTSR

SEQ ID NO: 1296282 - protein, 9 aa, Homo Sapiens
GIMCIIRAA

SEQ ID NO: 1296283 - protein, 9 aa, Homo Sapiens
VPDAASTSL

SEQ ID NO: 1296284 - protein, 9 aa, Homo Sapiens
NIPKETFSH

SEQ ID NO: 1296285 - protein, 9 aa, Homo Sapiens
GLQFLDLLL

SEQ ID NO: 1296286 - protein, 9 aa, Homo Sapiens
QQKHLLRPR

SEQ ID NO: 1296287 - protein, 9 aa, Homo Sapiens
AAFAVPGQL

SEQ ID NO: 1296288 - protein, 9 aa, Homo Sapiens
MPQTFSGGC

SEQ ID NO: 1296289 - protein, 9 aa, Homo Sapiens
ASVYSPGPR

SEQ ID NO: 1296290 - protein, 9 aa, Homo Sapiens
AASAPQTET

SEQ ID NO: 1296291 - protein, 9 aa, Homo Sapiens
YTKVWKMNW

SEQ ID NO: 1296292 - protein, 9 aa, Homo Sapiens
WLEVAAFML

SEQ ID NO: 1296293 - protein, 9 aa, Homo Sapiens
ELSQNISVR

SEQ ID NO: 1296294 - protein, 9 aa, Homo Sapiens
LDLLVICQL

SEQ ID NO: 1296295 - protein, 9 aa, Homo Sapiens
GNLIQNRSP

SEQ ID NO: 1296296 - protein, 9 aa, Homo Sapiens
PPLLEAFPL

SEQ ID NO: 1296297 - protein, 9 aa, Homo Sapiens
TESYLKKCR

SEQ ID NO: 1296298 - protein, 9 aa, Homo Sapiens
EFRESFKHI

SEQ ID NO: 1296299 - protein, 9 aa, Homo Sapiens
VRPSIGKIV

SEQ ID NO: 1296300 - protein, 9 aa, Homo Sapiens
RYVADGERT

SEQ ID NO: 1296301 - protein, 9 aa, Homo Sapiens
AVPGQLLRL

SEQ ID NO: 1296302 - protein, 9 aa, Homo Sapiens
AVDLYQLAP

SEQ ID NO: 1296303 - protein, 9 aa, Homo Sapiens
PRSLNIVCK

SEQ ID NO: 1296304 - protein, 9 aa, Homo Sapiens
QAQDTSGHR

SEQ ID NO: 1296305 - protein, 9 aa, Homo Sapiens
HYLFPIVHI

SEQ ID NO: 1296306 - protein, 9 aa, Homo Sapiens
PYSRKNTLG

SEQ ID NO: 1296307 - protein, 9 aa, Homo Sapiens
TAPARRRIP

SEQ ID NO: 1296308 - protein, 9 aa, Homo Sapiens
LRVPPDGVG

SEQ ID NO: 1296309 - protein, 9 aa, Homo Sapiens
RPSPWKPCG

SEQ ID NO: 1296310 - protein, 9 aa, Homo Sapiens
KPCGRVDTA

SEQ ID NO: 1296311 - protein, 9 aa, Homo Sapiens
SWVSCGTGA

SEQ ID NO: 1296312 - protein, 9 aa, Homo Sapiens
YLQTRVLHK

SEQ ID NO: 1296313 - protein, 9 aa, Homo Sapiens
HFGRGIMIA

SEQ ID NO: 1296314 - protein, 9 aa, Homo Sapiens
IFVPIHPVK

SEQ ID NO: 1296315 - protein, 9 aa, Homo Sapiens
RLGQLVEGL

SEQ ID NO: 1296316 - protein, 9 aa, Homo Sapiens
ILPQALNRL

SEQ ID NO: 1296317 - protein, 9 aa, Homo Sapiens
QQVAFIESD

SEQ ID NO: 1296318 - protein, 9 aa, Homo Sapiens
SGILLLCKR

SEQ ID NO: 1296319 - protein, 9 aa, Homo Sapiens
ARAGVCCEP

SEQ ID NO: 1296320 - protein, 9 aa, Homo Sapiens
LRLQSLLSL

SEQ ID NO: 1296321 - protein, 9 aa, Homo Sapiens
TNDNRTTIP

SEQ ID NO: 1296322 - protein, 9 aa, Homo Sapiens
ARGVALRGT

SEQ ID NO: 1296323 - protein, 9 aa, Homo Sapiens
APDFLSTFN

SEQ ID NO: 1296324 - protein, 9 aa, Homo Sapiens
RSLNIVCKP

SEQ ID NO: 1296325 - protein, 9 aa, Homo Sapiens
TSSPAQGHQ

SEQ ID NO: 1296326 - protein, 9 aa, Homo Sapiens
ARSDTYDTF

SEQ ID NO: 1296327 - protein, 9 aa, Homo Sapiens
SIFRLYSRA

SEQ ID NO: 1296328 - protein, 9 aa, Homo Sapiens
GQAGPCRGR

SEQ ID NO: 1296329 - protein, 9 aa, Homo Sapiens
LSVPLPAKP

SEQ ID NO: 1296330 - protein, 9 aa, Homo Sapiens
KHTAFSCPK

SEQ ID NO: 1296331 - protein, 9 aa, Homo Sapiens
DLKEQQPRA

SEQ ID NO: 1296332 - protein, 9 aa, Homo Sapiens
EQIAKRHRL

SEQ ID NO: 1296333 - protein, 9 aa, Homo Sapiens
QRDGSYGSG

SEQ ID NO: 1296334 - protein, 9 aa, Homo Sapiens
FRQGACVAT

SEQ ID NO: 1296335 - protein, 9 aa, Homo Sapiens
SGHDINGIQ

SEQ ID NO: 1296336 - protein, 9 aa, Homo Sapiens
ESDDNVKLI

SEQ ID NO: 1296337 - protein, 9 aa, Homo Sapiens
KKCRLEAHA

SEQ ID NO: 1296338 - protein, 9 aa, Homo Sapiens
FDVPEAPLP

SEQ ID NO: 1296339 - protein, 9 aa, Homo Sapiens
TSQTYVDPF

SEQ ID NO: 1296340 - protein, 9 aa, Homo Sapiens
PRACSLHTA

SEQ ID NO: 1296341 - protein, 9 aa, Homo Sapiens
VSYTKIMSK

SEQ ID NO: 1296342 - protein, 9 aa, Homo Sapiens
DLVLALVGA

SEQ ID NO: 1296343 - protein, 9 aa, Homo Sapiens
CMLGCIAGC

SEQ ID NO: 1296344 - protein, 9 aa, Homo Sapiens
SVPSTPPRG

SEQ ID NO: 1296345 - protein, 9 aa, Homo Sapiens
VAANPLFLT

SEQ ID NO: 1296346 - protein, 9 aa, Homo Sapiens
SWGDKLKIN

SEQ ID NO: 1296347 - protein, 9 aa, Homo Sapiens
PPRCLLAVE

SEQ ID NO: 1296348 - protein, 9 aa, Homo Sapiens
VGPPPSEGS

SEQ ID NO: 1296349 - protein, 9 aa, Homo Sapiens
EKRCRISTE

SEQ ID NO: 1296350 - protein, 9 aa, Homo Sapiens
CILGQRATR

SEQ ID NO: 1296351 - protein, 9 aa, Homo Sapiens
LVLMLCLHH

SEQ ID NO: 1296352 - protein, 9 aa, Homo Sapiens
PPPSAAAAG

SEQ ID NO: 1296353 - protein, 9 aa, Homo Sapiens
PPWSPSTRT

SEQ ID NO: 1296354 - protein, 9 aa, Homo Sapiens
SSGNCCSTM

SEQ ID NO: 1296355 - protein, 9 aa, Homo Sapiens
TCPPWHCPA

SEQ ID NO: 1296356 - protein, 9 aa, Homo Sapiens
KASKVPGGS

SEQ ID NO: 1296357 - protein, 9 aa, Homo Sapiens
SCTASNARG

SEQ ID NO: 1296358 - protein, 9 aa, Homo Sapiens
MAVLCKRMS

SEQ ID NO: 1296359 - protein, 9 aa, Homo Sapiens
PSTPPRGDH

SEQ ID NO: 1296360 - protein, 9 aa, Homo Sapiens
IRNLSQSNS

SEQ ID NO: 1296361 - protein, 9 aa, Homo Sapiens
SELSQNISV

SEQ ID NO: 1296362 - protein, 9 aa, Homo Sapiens
GTGAAGAAA

SEQ ID NO: 1296363 - protein, 9 aa, Homo Sapiens
GNGSTNHQE

SEQ ID NO: 1296364 - protein, 9 aa, Homo Sapiens
PWTQIPQGC

SEQ ID NO: 1296365 - protein, 9 aa, Homo Sapiens
PVKSVAWRG

SEQ ID NO: 1296366 - protein, 9 aa, Homo Sapiens
KKVSWYSHQ

SEQ ID NO: 1296367 - protein, 9 aa, Homo Sapiens
DDNLVFTVL

SEQ ID NO: 1296368 - protein, 9 aa, Homo Sapiens
LSGELHLLG

SEQ ID NO: 1296369 - protein, 9 aa, Homo Sapiens
LLLLSLKFK

SEQ ID NO: 1296370 - protein, 9 aa, Homo Sapiens
DAIDHLCHI

SEQ ID NO: 1296371 - protein, 9 aa, Homo Sapiens
LRGFLLHQP

SEQ ID NO: 1296372 - protein, 9 aa, Homo Sapiens
SPEPRNPDA

SEQ ID NO: 1296373 - protein, 9 aa, Homo Sapiens
DNRQRSAQW

SEQ ID NO: 1296374 - protein, 9 aa, Homo Sapiens
TGRNDADTF

SEQ ID NO: 1296375 - protein, 9 aa, Homo Sapiens
NVTVRGATS

SEQ ID NO: 1296376 - protein, 9 aa, Homo Sapiens
AHTSRSVLS

SEQ ID NO: 1296377 - protein, 9 aa, Homo Sapiens
ITYQSPSKV

SEQ ID NO: 1296378 - protein, 9 aa, Homo Sapiens
WKQEDLVGD

SEQ ID NO: 1296379 - protein, 9 aa, Homo Sapiens
PIGAFPVNT

SEQ ID NO: 1296380 - protein, 9 aa, Homo Sapiens
DTEALVQAP

SEQ ID NO: 1296381 - protein, 9 aa, Homo Sapiens
LLVSPYHGK

SEQ ID NO: 1296382 - protein, 9 aa, Homo Sapiens
LIVDVVGYV

SEQ ID NO: 1296383 - protein, 9 aa, Homo Sapiens
QSAGDCVWA

SEQ ID NO: 1296384 - protein, 9 aa, Homo Sapiens
SRWTTRPCR

SEQ ID NO: 1296385 - protein, 9 aa, Homo Sapiens
ENLKTHQTF

SEQ ID NO: 1296386 - protein, 9 aa, Homo Sapiens
KALLIPLPA

SEQ ID NO: 1296387 - protein, 9 aa, Homo Sapiens
GLLGRPEAA

SEQ ID NO: 1296388 - protein, 9 aa, Homo Sapiens
PHPQVPPQL

SEQ ID NO: 1296389 - protein, 9 aa, Homo Sapiens
LQAVGMFQD

SEQ ID NO: 1296390 - protein, 9 aa, Homo Sapiens
NDNSPFMLY

SEQ ID NO: 1296391 - protein, 9 aa, Homo Sapiens
VQDRVQCMT

SEQ ID NO: 1296392 - protein, 9 aa, Homo Sapiens
TFLEWKQED

SEQ ID NO: 1296393 - protein, 9 aa, Homo Sapiens
GGQKPSQES

SEQ ID NO: 1296394 - protein, 9 aa, Homo Sapiens
VSQERKFTV

SEQ ID NO: 1296395 - protein, 9 aa, Homo Sapiens
VGPHPPWSR

SEQ ID NO: 1296396 - protein, 9 aa, Homo Sapiens
QDVAEEEAV

SEQ ID NO: 1296397 - protein, 9 aa, Homo Sapiens
KRRWAPRHL

SEQ ID NO: 1296398 - protein, 9 aa, Homo Sapiens
CPRKRGATA

SEQ ID NO: 1296399 - protein, 9 aa, Homo Sapiens
PAAPAVTHS

SEQ ID NO: 1296400 - protein, 9 aa, Homo Sapiens
ARGGEGRSR

SEQ ID NO: 1296401 - protein, 9 aa, Homo Sapiens
SHRGARRGQ

SEQ ID NO: 1296402 - protein, 9 aa, Homo Sapiens
CGGSLLNEQ

SEQ ID NO: 1296403 - protein, 9 aa, Homo Sapiens
RGRRPRAGL

SEQ ID NO: 1296404 - protein, 9 aa, Homo Sapiens
REREHHVEA

SEQ ID NO: 1296405 - protein, 9 aa, Homo Sapiens
AGPPGGGCW

SEQ ID NO: 1296406 - protein, 9 aa, Homo Sapiens
RNDHIRLFG

SEQ ID NO: 1296407 - protein, 9 aa, Homo Sapiens
LGSQVIRSL

SEQ ID NO: 1296408 - protein, 9 aa, Homo Sapiens
SSSFRRAHV

SEQ ID NO: 1296409 - protein, 9 aa, Homo Sapiens
RLPMSFSRR

SEQ ID NO: 1296410 - protein, 9 aa, Homo Sapiens
CGNIVVYHV

SEQ ID NO: 1296411 - protein, 9 aa, Homo Sapiens
HRSCSERCA

SEQ ID NO: 1296412 - protein, 9 aa, Homo Sapiens
KRHRLSSLR

SEQ ID NO: 1296413 - protein, 9 aa, Homo Sapiens
TSEEDTRAR

SEQ ID NO: 1296414 - protein, 9 aa, Homo Sapiens
KDERMILLM

SEQ ID NO: 1296415 - protein, 9 aa, Homo Sapiens
SVHSRVLKN

SEQ ID NO: 1296416 - protein, 9 aa, Homo Sapiens
STSRDSRSF

SEQ ID NO: 1296417 - protein, 9 aa, Homo Sapiens
VHCGVLGLW

SEQ ID NO: 1296418 - protein, 9 aa, Homo Sapiens
AYMPHTFLL

SEQ ID NO: 1296419 - protein, 9 aa, Homo Sapiens
MLQGMAYAL

SEQ ID NO: 1296420 - protein, 9 aa, Homo Sapiens
RALYCWTAQ

SEQ ID NO: 1296421 - protein, 9 aa, Homo Sapiens
EERWLRGGR

SEQ ID NO: 1296422 - protein, 9 aa, Homo Sapiens
RGPGMLEQK

SEQ ID NO: 1296423 - protein, 9 aa, Homo Sapiens
AGARGAARH

SEQ ID NO: 1296424 - protein, 9 aa, Homo Sapiens
GCWGWQQSW

SEQ ID NO: 1296425 - protein, 9 aa, Homo Sapiens
WRRRPVVNL

SEQ ID NO: 1296426 - protein, 9 aa, Homo Sapiens
TWASPLASV

SEQ ID NO: 1296427 - protein, 9 aa, Homo Sapiens
FFPSATRCM

SEQ ID NO: 1296428 - protein, 9 aa, Homo Sapiens
FAMHFIFTI

SEQ ID NO: 1296429 - protein, 9 aa, Homo Sapiens
RSPPTSCPP

SEQ ID NO: 1296430 - protein, 9 aa, Homo Sapiens
APGCDGRDG

SEQ ID NO: 1296431 - protein, 9 aa, Homo Sapiens
WEKRKSPEN

SEQ ID NO: 1296432 - protein, 9 aa, Homo Sapiens
AGQQVAFIE

SEQ ID NO: 1296433 - protein, 9 aa, Homo Sapiens
QQIAGSKLS

SEQ ID NO: 1296434 - protein, 9 aa, Homo Sapiens
IDLVSKCDG

SEQ ID NO: 1296435 - protein, 9 aa, Homo Sapiens
EEGRRLCRA

SEQ ID NO: 1296436 - protein, 9 aa, Homo Sapiens
CQLKSALSQ

SEQ ID NO: 1296437 - protein, 9 aa, Homo Sapiens
PDAVGLGDL

SEQ ID NO: 1296438 - protein, 9 aa, Homo Sapiens
IQIHSQETT

SEQ ID NO: 1296439 - protein, 9 aa, Homo Sapiens
ASNDLPLLA

SEQ ID NO: 1296440 - protein, 9 aa, Homo Sapiens
DLLEIILIN

SEQ ID NO: 1296441 - protein, 9 aa, Homo Sapiens
GHLGDQLGD

SEQ ID NO: 1296442 - protein, 9 aa, Homo Sapiens
GDKNKKIVY

SEQ ID NO: 1296443 - protein, 9 aa, Homo Sapiens
SLQDIQSLC

SEQ ID NO: 1296444 - protein, 9 aa, Homo Sapiens
MGQDCYTRI

SEQ ID NO: 1296445 - protein, 9 aa, Homo Sapiens
ALYRGGQRC

SEQ ID NO: 1296446 - protein, 9 aa, Homo Sapiens
APRCPRRLP

SEQ ID NO: 1296447 - protein, 9 aa, Homo Sapiens
GWWFDTCGL

SEQ ID NO: 1296448 - protein, 9 aa, Homo Sapiens
RVVELQTKH

SEQ ID NO: 1296449 - protein, 9 aa, Homo Sapiens
CTAISTNIK

SEQ ID NO: 1296450 - protein, 9 aa, Homo Sapiens
ALLLVRILV

SEQ ID NO: 1296451 - protein, 9 aa, Homo Sapiens
IIKESDDNV

SEQ ID NO: 1296452 - protein, 9 aa, Homo Sapiens
DIKKAHRRK

SEQ ID NO: 1296453 - protein, 9 aa, Homo Sapiens
RHLPGHSQR

SEQ ID NO: 1296454 - protein, 9 aa, Homo Sapiens
VLYKEGGRD

SEQ ID NO: 1296455 - protein, 9 aa, Homo Sapiens
TMKTSEEDT

SEQ ID NO: 1296456 - protein, 9 aa, Homo Sapiens
RRGATAAPP

SEQ ID NO: 1296457 - protein, 9 aa, Homo Sapiens
WDLHPSTLT

SEQ ID NO: 1296458 - protein, 9 aa, Homo Sapiens
RQEQIAKRH

SEQ ID NO: 1296459 - protein, 9 aa, Homo Sapiens
MANLLIHTG

SEQ ID NO: 1296460 - protein, 9 aa, Homo Sapiens
RLTVLVLLA

SEQ ID NO: 1296461 - protein, 9 aa, Homo Sapiens
RKASCSTAW

SEQ ID NO: 1296462 - protein, 9 aa, Homo Sapiens
LHMPMYVFL

SEQ ID NO: 1296463 - protein, 9 aa, Homo Sapiens
MSRSLWPQS

SEQ ID NO: 1296464 - protein, 9 aa, Homo Sapiens
AAGVGKSAL

SEQ ID NO: 1296465 - protein, 9 aa, Homo Sapiens
EKENLLPPS

SEQ ID NO: 1296466 - protein, 9 aa, Homo Sapiens
PFSGLYQGM

SEQ ID NO: 1296467 - protein, 9 aa, Homo Sapiens
RPSLEVCYL

SEQ ID NO: 1296468 - protein, 9 aa, Homo Sapiens
KKAEKNSLG

SEQ ID NO: 1296469 - protein, 9 aa, Homo Sapiens
RHLLVTQQK

SEQ ID NO: 1296470 - protein, 9 aa, Homo Sapiens
TRLTETSVH

SEQ ID NO: 1296471 - protein, 9 aa, Homo Sapiens
LLQEEKGLD

SEQ ID NO: 1296472 - protein, 9 aa, Homo Sapiens
RAAGGAAAA

SEQ ID NO: 1296473 - protein, 9 aa, Homo Sapiens
HLDPQDQAC

SEQ ID NO: 1296474 - protein, 9 aa, Homo Sapiens
QVFLVVFLY

SEQ ID NO: 1296475 - protein, 9 aa, Homo Sapiens
LARSWNTMQ

SEQ ID NO: 1296476 - protein, 9 aa, Homo Sapiens
WGRPSPWKP

SEQ ID NO: 1296477 - protein, 9 aa, Homo Sapiens
ACVATGSED

SEQ ID NO: 1296478 - protein, 9 aa, Homo Sapiens
QRSWTRSRT

SEQ ID NO: 1296479 - protein, 9 aa, Homo Sapiens
RGRPPGEKL

SEQ ID NO: 1296480 - protein, 9 aa, Homo Sapiens
PAHPHRRQV

SEQ ID NO: 1296481 - protein, 9 aa, Homo Sapiens
GSSGRVCAE

SEQ ID NO: 1296482 - protein, 9 aa, Homo Sapiens
EKTSELTVV

SEQ ID NO: 1296483 - protein, 9 aa, Homo Sapiens
QRRRREKTV

SEQ ID NO: 1296484 - protein, 9 aa, Homo Sapiens
RAGLLGRPE

SEQ ID NO: 1296485 - protein, 9 aa, Homo Sapiens
VPWLECQAS

SEQ ID NO: 1296486 - protein, 9 aa, Homo Sapiens
GAPQPSPHP

SEQ ID NO: 1296487 - protein, 9 aa, Homo Sapiens
CITEFGVEA

SEQ ID NO: 1296488 - protein, 9 aa, Homo Sapiens
EPLHLVNPS

SEQ ID NO: 1296489 - protein, 9 aa, Homo Sapiens
DSSPLQLLL

SEQ ID NO: 1296490 - protein, 9 aa, Homo Sapiens
VGAAGKGAG

SEQ ID NO: 1296491 - protein, 9 aa, Homo Sapiens
EHGLGDPLK

SEQ ID NO: 1296492 - protein, 9 aa, Homo Sapiens
SRDSRSFFT

SEQ ID NO: 1296493 - protein, 9 aa, Homo Sapiens
MGGNRSICL

SEQ ID NO: 1296494 - protein, 9 aa, Homo Sapiens
GFCESTALI

SEQ ID NO: 1296495 - protein, 9 aa, Homo Sapiens
ALVQAPDAV

SEQ ID NO: 1296496 - protein, 9 aa, Homo Sapiens
HPGATTTAP

SEQ ID NO: 1296497 - protein, 9 aa, Homo Sapiens
MDIRNALVG

SEQ ID NO: 1296498 - protein, 9 aa, Homo Sapiens
LFDRLQELK

SEQ ID NO: 1296499 - protein, 9 aa, Homo Sapiens
QALVPDLFH

SEQ ID NO: 1296500 - protein, 9 aa, Homo Sapiens
VNPSFLSVT

SEQ ID NO: 1296501 - protein, 9 aa, Homo Sapiens
FGPANLEDA

SEQ ID NO: 1296502 - protein, 9 aa, Homo Sapiens
EEIKGECQV

SEQ ID NO: 1296503 - protein, 9 aa, Homo Sapiens
TGLHLHRQI

SEQ ID NO: 1296504 - protein, 9 aa, Homo Sapiens
YLNMYSTYA

SEQ ID NO: 1296505 - protein, 9 aa, Homo Sapiens
LCLHHQRVK

SEQ ID NO: 1296506 - protein, 9 aa, Homo Sapiens
GAGARGAAR

SEQ ID NO: 1296507 - protein, 9 aa, Homo Sapiens
STQASLASK

SEQ ID NO: 1296508 - protein, 9 aa, Homo Sapiens
GRGCCSSWT

SEQ ID NO: 1296509 - protein, 9 aa, Homo Sapiens
APLPHPGAP

SEQ ID NO: 1296510 - protein, 9 aa, Homo Sapiens
KKNKENQKE

SEQ ID NO: 1296511 - protein, 9 aa, Homo Sapiens
LGPASVAPA

SEQ ID NO: 1296512 - protein, 9 aa, Homo Sapiens
FCQIQVKTL

SEQ ID NO: 1296513 - protein, 9 aa, Homo Sapiens
TQASMTLPA

SEQ ID NO: 1296514 - protein, 9 aa, Homo Sapiens
LVHLVIRPP

SEQ ID NO: 1296515 - protein, 9 aa, Homo Sapiens
PAVTHSEQA

SEQ ID NO: 1296516 - protein, 9 aa, Homo Sapiens
KMNWKKMMI

SEQ ID NO: 1296517 - protein, 9 aa, Homo Sapiens
RGKSQGGRI

SEQ ID NO: 1296518 - protein, 9 aa, Homo Sapiens
DERHPGLSN

SEQ ID NO: 1296519 - protein, 9 aa, Homo Sapiens
ANEGFDLST

SEQ ID NO: 1296520 - protein, 9 aa, Homo Sapiens
RYRERISQG

SEQ ID NO: 1296521 - protein, 9 aa, Homo Sapiens
TVSYTKIMS

SEQ ID NO: 1296522 - protein, 9 aa, Homo Sapiens
GHNGAPGCD

SEQ ID NO: 1296523 - protein, 9 aa, Homo Sapiens
IATTAHEKC

SEQ ID NO: 1296524 - protein, 9 aa, Homo Sapiens
PSPVNSHTQ

SEQ ID NO: 1296525 - protein, 9 aa, Homo Sapiens
PADSSSMGS

SEQ ID NO: 1296526 - protein, 9 aa, Homo Sapiens
VLEVGADKQ

SEQ ID NO: 1296527 - protein, 9 aa, Homo Sapiens
LFTTGSSRR

SEQ ID NO: 1296528 - protein, 9 aa, Homo Sapiens
SQERKFTVR

SEQ ID NO: 1296529 - protein, 9 aa, Homo Sapiens
LRGSPLCMA

SEQ ID NO: 1296530 - protein, 9 aa, Homo Sapiens
LELVNSWNE

SEQ ID NO: 1296531 - protein, 9 aa, Homo Sapiens
PNIQIHSQE

SEQ ID NO: 1296532 - protein, 9 aa, Homo Sapiens
ILDFPPIGA

SEQ ID NO: 1296533 - protein, 9 aa, Homo Sapiens
CVLLLLSLK

SEQ ID NO: 1296534 - protein, 9 aa, Homo Sapiens
ALRGTVGVP

SEQ ID NO: 1296535 - protein, 9 aa, Homo Sapiens
HFCGGSLLN

SEQ ID NO: 1296536 - protein, 9 aa, Homo Sapiens
RFLDSLQDI

SEQ ID NO: 1296537 - protein, 9 aa, Homo Sapiens
NPWKKINSA

SEQ ID NO: 1296538 - protein, 9 aa, Homo Sapiens
RRLPMSFSR

SEQ ID NO: 1296539 - protein, 9 aa, Homo Sapiens
PIVHIFVII

SEQ ID NO: 1296540 - protein, 9 aa, Homo Sapiens
GWDKKRKQQ

SEQ ID NO: 1296541 - protein, 9 aa, Homo Sapiens
VLVLLAGLL

SEQ ID NO: 1296542 - protein, 9 aa, Homo Sapiens
SSAWAPQTA

SEQ ID NO: 1296543 - protein, 9 aa, Homo Sapiens
ALLIPLPAP

SEQ ID NO: 1296544 - protein, 9 aa, Homo Sapiens
QHAVSDSEA

SEQ ID NO: 1296545 - protein, 9 aa, Homo Sapiens
PAGARASKG

SEQ ID NO: 1296546 - protein, 9 aa, Homo Sapiens
GRPWCRESL

SEQ ID NO: 1296547 - protein, 9 aa, Homo Sapiens
ELGVRLRVP

SEQ ID NO: 1296548 - protein, 9 aa, Homo Sapiens
PYCTEKSFS

SEQ ID NO: 1296549 - protein, 9 aa, Homo Sapiens
GIIWPKSGL

SEQ ID NO: 1296550 - protein, 9 aa, Homo Sapiens
GFFMATVHF

SEQ ID NO: 1296551 - protein, 9 aa, Homo Sapiens
YDDDDMVLD

SEQ ID NO: 1296552 - protein, 9 aa, Homo Sapiens
SAPTCPPWH

SEQ ID NO: 1296553 - protein, 9 aa, Homo Sapiens
DHIRLFGNS

SEQ ID NO: 1296554 - protein, 9 aa, Homo Sapiens
EVCQLQPAC

SEQ ID NO: 1296555 - protein, 9 aa, Homo Sapiens
GVGPGPHAV

SEQ ID NO: 1296556 - protein, 9 aa, Homo Sapiens
NDIKAAMLA

SEQ ID NO: 1296557 - protein, 9 aa, Homo Sapiens
QVLMMGHFP

SEQ ID NO: 1296558 - protein, 9 aa, Homo Sapiens
LRIHSTATW

SEQ ID NO: 1296559 - protein, 9 aa, Homo Sapiens
QQRGRGSCG

SEQ ID NO: 1296560 - protein, 9 aa, Homo Sapiens
EGMQNLASN

SEQ ID NO: 1296561 - protein, 9 aa, Homo Sapiens
VGDVLGSQV

SEQ ID NO: 1296562 - protein, 9 aa, Homo Sapiens
FLDSLQDIQ

SEQ ID NO: 1296563 - protein, 9 aa, Homo Sapiens
QDAKYLNMY

SEQ ID NO: 1296564 - protein, 9 aa, Homo Sapiens
RARGGTTIG

SEQ ID NO: 1296565 - protein, 9 aa, Homo Sapiens
TATAACPMT

SEQ ID NO: 1296566 - protein, 9 aa, Homo Sapiens
LPPSRRKTP

SEQ ID NO: 1296567 - protein, 9 aa, Homo Sapiens
YLFLVMLAA

SEQ ID NO: 1296568 - protein, 9 aa, Homo Sapiens
RHLSGYCGS

SEQ ID NO: 1296569 - protein, 9 aa, Homo Sapiens
TGWEKRKSP

SEQ ID NO: 1296570 - protein, 9 aa, Homo Sapiens
KSRMTSAVL

SEQ ID NO: 1296571 - protein, 9 aa, Homo Sapiens
QGRWNNAKP

SEQ ID NO: 1296572 - protein, 9 aa, Homo Sapiens
PVNFITFLE

SEQ ID NO: 1296573 - protein, 9 aa, Homo Sapiens
SCHFSSSSS

SEQ ID NO: 1296574 - protein, 9 aa, Homo Sapiens
SMLKKYAEV

SEQ ID NO: 1296575 - protein, 9 aa, Homo Sapiens
LNMALADLA

SEQ ID NO: 1296576 - protein, 9 aa, Homo Sapiens
WLSFNLPPS

SEQ ID NO: 1296577 - protein, 9 aa, Homo Sapiens
LVAMLQGMA

SEQ ID NO: 1296578 - protein, 9 aa, Homo Sapiens
PGMAVPRVQ

SEQ ID NO: 1296579 - protein, 9 aa, Homo Sapiens
GQVHPAGPA

SEQ ID NO: 1296580 - protein, 9 aa, Homo Sapiens
SVPLPAKPS

SEQ ID NO: 1296581 - protein, 9 aa, Homo Sapiens
DHNTQIHAC

SEQ ID NO: 1296582 - protein, 9 aa, Homo Sapiens
DANDNSPFM

SEQ ID NO: 1296583 - protein, 9 aa, Homo Sapiens
GGRGQSAKS

SEQ ID NO: 1296584 - protein, 9 aa, Homo Sapiens
LEFRSFGDL

SEQ ID NO: 1296585 - protein, 9 aa, Homo Sapiens
WATVRVMDV

SEQ ID NO: 1296586 - protein, 9 aa, Homo Sapiens
QDPDSNNAR

SEQ ID NO: 1296587 - protein, 9 aa, Homo Sapiens
KKKKEKKNN

SEQ ID NO: 1296588 - protein, 9 aa, Homo Sapiens
PRCTQELQP

SEQ ID NO: 1296589 - protein, 9 aa, Homo Sapiens
IRDEKVKVL

SEQ ID NO: 1296590 - protein, 9 aa, Homo Sapiens
NSICGAPGQ

SEQ ID NO: 1296591 - protein, 9 aa, Homo Sapiens
QKEAAFAVP

SEQ ID NO: 1296592 - protein, 9 aa, Homo Sapiens
LQNHRPTRH

SEQ ID NO: 1296593 - protein, 9 aa, Homo Sapiens
VVTQRKSQT

SEQ ID NO: 1296594 - protein, 9 aa, Homo Sapiens
SCLMSTTRS

SEQ ID NO: 1296595 - protein, 9 aa, Homo Sapiens
AHEKCLGSM

SEQ ID NO: 1296596 - protein, 9 aa, Homo Sapiens
PGESHRGAR

SEQ ID NO: 1296597 - protein, 9 aa, Homo Sapiens
DRLQELKLC

SEQ ID NO: 1296598 - protein, 9 aa, Homo Sapiens
TVATTSEIV

SEQ ID NO: 1296599 - protein, 9 aa, Homo Sapiens
HSSVLATGL

SEQ ID NO: 1296600 - protein, 9 aa, Homo Sapiens
SRYYRKMSE

SEQ ID NO: 1296601 - protein, 9 aa, Homo Sapiens
DSLESILKG

SEQ ID NO: 1296602 - protein, 9 aa, Homo Sapiens
SSHTRLTET

SEQ ID NO: 1296603 - protein, 9 aa, Homo Sapiens
DFLATAVFT

SEQ ID NO: 1296604 - protein, 9 aa, Homo Sapiens
CQGRPRGAG

SEQ ID NO: 1296605 - protein, 9 aa, Homo Sapiens
TDIVSGTTV

SEQ ID NO: 1296606 - protein, 9 aa, Homo Sapiens
GNVTITNPS

SEQ ID NO: 1296607 - protein, 9 aa, Homo Sapiens
KRRSTLTTV

SEQ ID NO: 1296608 - protein, 9 aa, Homo Sapiens
QEQGQGQGE

SEQ ID NO: 1296609 - protein, 9 aa, Homo Sapiens
AVSGCGRAP

SEQ ID NO: 1296610 - protein, 9 aa, Homo Sapiens
PQDPGLALR

SEQ ID NO: 1296611 - protein, 9 aa, Homo Sapiens
GMLGEGGIL

SEQ ID NO: 1296612 - protein, 9 aa, Homo Sapiens
QILDFPPIG

SEQ ID NO: 1296613 - protein, 9 aa, Homo Sapiens
QIKNCGFFM

SEQ ID NO: 1296614 - protein, 9 aa, Homo Sapiens
MAMTVIAGA

SEQ ID NO: 1296615 - protein, 9 aa, Homo Sapiens
TQRRSARPP

SEQ ID NO: 1296616 - protein, 9 aa, Homo Sapiens
KNDIKAAML

SEQ ID NO: 1296617 - protein, 9 aa, Homo Sapiens
GQNNLIQQK

SEQ ID NO: 1296618 - protein, 9 aa, Homo Sapiens
PGSNGAGRQ

SEQ ID NO: 1296619 - protein, 9 aa, Homo Sapiens
HPGRRRARP

SEQ ID NO: 1296620 - protein, 9 aa, Homo Sapiens
MDCVFEAVS

SEQ ID NO: 1296621 - protein, 9 aa, Homo Sapiens
LDPPLILPQ

SEQ ID NO: 1296622 - protein, 9 aa, Homo Sapiens
TTLITYISA

SEQ ID NO: 1296623 - protein, 9 aa, Homo Sapiens
LTVLVLLAG

SEQ ID NO: 1296624 - protein, 9 aa, Homo Sapiens
EWTQRSPSG

SEQ ID NO: 1296625 - protein, 9 aa, Homo Sapiens
LHPPSISHR

SEQ ID NO: 1296626 - protein, 9 aa, Homo Sapiens
SYTKIMSKN

SEQ ID NO: 1296627 - protein, 9 aa, Homo Sapiens
AMGQDCYTR

SEQ ID NO: 1296628 - protein, 9 aa, Homo Sapiens
HKSRRLRLC

SEQ ID NO: 1296629 - protein, 9 aa, Homo Sapiens
PPATAPARR

SEQ ID NO: 1296630 - protein, 9 aa, Homo Sapiens
QRPGLSWTK

SEQ ID NO: 1296631 - protein, 9 aa, Homo Sapiens
PHTFLLVIM

SEQ ID NO: 1296632 - protein, 9 aa, Homo Sapiens
TLKRKCREK

SEQ ID NO: 1296633 - protein, 9 aa, Homo Sapiens
DSRSFFTSA

SEQ ID NO: 1296634 - protein, 9 aa, Homo Sapiens
LGSHFPDSQ

SEQ ID NO: 1296635 - protein, 9 aa, Homo Sapiens
FGSIFLLFC

SEQ ID NO: 1296636 - protein, 9 aa, Homo Sapiens
SCSCMCLQA

SEQ ID NO: 1296637 - protein, 9 aa, Homo Sapiens
DYQPPAKKN

SEQ ID NO: 1296638 - protein, 9 aa, Homo Sapiens
CGEYGKSFS

SEQ ID NO: 1296639 - protein, 9 aa, Homo Sapiens
LESHMKVHQ

SEQ ID NO: 1296640 - protein, 9 aa, Homo Sapiens
LVQALKLHD

SEQ ID NO: 1296641 - protein, 9 aa, Homo Sapiens
VEVHDRDCK

SEQ ID NO: 1296642 - protein, 9 aa, Homo Sapiens
KKHGGSYSA

SEQ ID NO: 1296643 - protein, 9 aa, Homo Sapiens
DRERKSDGE

SEQ ID NO: 1296644 - protein, 9 aa, Homo Sapiens
VHFVNFEHL

SEQ ID NO: 1296645 - protein, 9 aa, Homo Sapiens
PPIVKLFDV

SEQ ID NO: 1296646 - protein, 9 aa, Homo Sapiens
DKSWGDKLK

SEQ ID NO: 1296647 - protein, 9 aa, Homo Sapiens
IRIVMGPPA

SEQ ID NO: 1296648 - protein, 9 aa, Homo Sapiens
PQVIQDVAE

SEQ ID NO: 1296649 - protein, 9 aa, Homo Sapiens
EPMYLFLVM

SEQ ID NO: 1296650 - protein, 9 aa, Homo Sapiens
QVPPQLPQA

SEQ ID NO: 1296651 - protein, 9 aa, Homo Sapiens
QLSWGGRGQ

SEQ ID NO: 1296652 - protein, 9 aa, Homo Sapiens
WVETRLEVS

SEQ ID NO: 1296653 - protein, 9 aa, Homo Sapiens
PAWLVWVPH

SEQ ID NO: 1296654 - protein, 9 aa, Homo Sapiens
GATAAPPPP

SEQ ID NO: 1296655 - protein, 9 aa, Homo Sapiens
SIPWTQIPQ

SEQ ID NO: 1296656 - protein, 9 aa, Homo Sapiens
LLRPRRGRE

SEQ ID NO: 1296657 - protein, 9 aa, Homo Sapiens
EQRVGHRHH

SEQ ID NO: 1296658 - protein, 9 aa, Homo Sapiens
CPPGRCWAW

SEQ ID NO: 1296659 - protein, 9 aa, Homo Sapiens
EPPVPPDGS

SEQ ID NO: 1296660 - protein, 9 aa, Homo Sapiens
AVPWLECQA

SEQ ID NO: 1296661 - protein, 9 aa, Homo Sapiens
CDGRDGTPG

SEQ ID NO: 1296662 - protein, 9 aa, Homo Sapiens
QIAKRHRLS

SEQ ID NO: 1296663 - protein, 9 aa, Homo Sapiens
RRAWKHSPL

SEQ ID NO: 1296664 - protein, 9 aa, Homo Sapiens
NSSIRASWR

SEQ ID NO: 1296665 - protein, 9 aa, Homo Sapiens
TRLTHHPIY

SEQ ID NO: 1296666 - protein, 9 aa, Homo Sapiens
TTHPTCILG

SEQ ID NO: 1296667 - protein, 9 aa, Homo Sapiens
EALFLIVDP

SEQ ID NO: 1296668 - protein, 9 aa, Homo Sapiens
SSIWKRLKL

SEQ ID NO: 1296669 - protein, 9 aa, Homo Sapiens
GRGGPRLTH

SEQ ID NO: 1296670 - protein, 9 aa, Homo Sapiens
NDLRRQLEL

SEQ ID NO: 1296671 - protein, 9 aa, Homo Sapiens
AHQLPIAEV

SEQ ID NO: 1296672 - protein, 9 aa, Homo Sapiens
ERDNQWLGS

SEQ ID NO: 1296673 - protein, 9 aa, Homo Sapiens
KLDTILNPK

SEQ ID NO: 1296674 - protein, 9 aa, Homo Sapiens
SSGSRRSPA

SEQ ID NO: 1296675 - protein, 9 aa, Homo Sapiens
IIDLVSKCD

SEQ ID NO: 1296676 - protein, 9 aa, Homo Sapiens
QLQPACLQA

SEQ ID NO: 1296677 - protein, 9 aa, Homo Sapiens
LRLPLPTPS

SEQ ID NO: 1296678 - protein, 9 aa, Homo Sapiens
RTDPATLYC

SEQ ID NO: 1296679 - protein, 9 aa, Homo Sapiens
ECLHQLVMN

SEQ ID NO: 1296680 - protein, 9 aa, Homo Sapiens
LPPPEDERH

SEQ ID NO: 1296681 - protein, 9 aa, Homo Sapiens
QVKEVKENF

SEQ ID NO: 1296682 - protein, 9 aa, Homo Sapiens
SRVLKNQEL

SEQ ID NO: 1296683 - protein, 9 aa, Homo Sapiens
PSRPCRMRL

SEQ ID NO: 1296684 - protein, 9 aa, Homo Sapiens
TVTQITVSL

SEQ ID NO: 1296685 - protein, 9 aa, Homo Sapiens
MIGSQHLLF

SEQ ID NO: 1296686 - protein, 9 aa, Homo Sapiens
LKNTYVGLQ

SEQ ID NO: 1296687 - protein, 9 aa, Homo Sapiens
ARKPMVRLT

SEQ ID NO: 1296688 - protein, 9 aa, Homo Sapiens
WKVVFGINN

SEQ ID NO: 1296689 - protein, 9 aa, Homo Sapiens
PRKRGATAA

SEQ ID NO: 1296690 - protein, 9 aa, Homo Sapiens
PAQGHQRRK

SEQ ID NO: 1296691 - protein, 9 aa, Homo Sapiens
YLSALWFHH

SEQ ID NO: 1296692 - protein, 9 aa, Homo Sapiens
GMWEECVLS

SEQ ID NO: 1296693 - protein, 9 aa, Homo Sapiens
TNTLPKVRP

SEQ ID NO: 1296694 - protein, 9 aa, Homo Sapiens
AVPPHVKRH

SEQ ID NO: 1296695 - protein, 9 aa, Homo Sapiens
CDPPGMTGL

SEQ ID NO: 1296696 - protein, 9 aa, Homo Sapiens
GTMWSWGRP

SEQ ID NO: 1296697 - protein, 9 aa, Homo Sapiens
SMACGSAES

SEQ ID NO: 1296698 - protein, 9 aa, Homo Sapiens
QLEFSMPPG

SEQ ID NO: 1296699 - protein, 9 aa, Homo Sapiens
YSTYAKLAA

SEQ ID NO: 1296700 - protein, 9 aa, Homo Sapiens
IRKLWQIPE

SEQ ID NO: 1296701 - protein, 9 aa, Homo Sapiens
RPGLSWTKA

SEQ ID NO: 1296702 - protein, 9 aa, Homo Sapiens
RLCVKATVC

SEQ ID NO: 1296703 - protein, 9 aa, Homo Sapiens
TKPEVPREK

SEQ ID NO: 1296704 - protein, 9 aa, Homo Sapiens
FPETNSGNE

SEQ ID NO: 1296705 - protein, 9 aa, Homo Sapiens
HRSPPTSCP

SEQ ID NO: 1296706 - protein, 9 aa, Homo Sapiens
ASCSTAWSG

SEQ ID NO: 1296707 - protein, 9 aa, Homo Sapiens
GKLTKNGLP

SEQ ID NO: 1296708 - protein, 9 aa, Homo Sapiens
VVGQHELQV

SEQ ID NO: 1296709 - protein, 9 aa, Homo Sapiens
PLARNMPPY

SEQ ID NO: 1296710 - protein, 9 aa, Homo Sapiens
GMGRRPRPR

SEQ ID NO: 1296711 - protein, 9 aa, Homo Sapiens
VRDHCRPRA

SEQ ID NO: 1296712 - protein, 9 aa, Homo Sapiens
FGFLLQEEK

SEQ ID NO: 1296713 - protein, 9 aa, Homo Sapiens
QLHDVGEER

SEQ ID NO: 1296714 - protein, 9 aa, Homo Sapiens
AGGHQQKHL

SEQ ID NO: 1296715 - protein, 9 aa, Homo Sapiens
NNFSRSPPT

SEQ ID NO: 1296716 - protein, 9 aa, Homo Sapiens
AWLLLLLSP

SEQ ID NO: 1296717 - protein, 9 aa, Homo Sapiens
VDYSQNVAV

SEQ ID NO: 1296718 - protein, 9 aa, Homo Sapiens
TALYRGGQR

SEQ ID NO: 1296719 - protein, 9 aa, Homo Sapiens
TAHEKCLGS

SEQ ID NO: 1296720 - protein, 9 aa, Homo Sapiens
DLLLPALQR

SEQ ID NO: 1296721 - protein, 9 aa, Homo Sapiens
TIITWSENT

SEQ ID NO: 1296722 - protein, 9 aa, Homo Sapiens
SKGMVNVTR

SEQ ID NO: 1296723 - protein, 9 aa, Homo Sapiens
ELRENSICG

SEQ ID NO: 1296724 - protein, 9 aa, Homo Sapiens
GGSRPGWKR

SEQ ID NO: 1296725 - protein, 9 aa, Homo Sapiens
SPWKPCGRV

SEQ ID NO: 1296726 - protein, 9 aa, Homo Sapiens
DILQRPGLS

SEQ ID NO: 1296727 - protein, 9 aa, Homo Sapiens
FAVPGQLLR

SEQ ID NO: 1296728 - protein, 9 aa, Homo Sapiens
SGGVTTTQW

SEQ ID NO: 1296729 - protein, 9 aa, Homo Sapiens
KCMEGLTLE

SEQ ID NO: 1296730 - protein, 9 aa, Homo Sapiens
TTSSPRRSP

SEQ ID NO: 1296731 - protein, 9 aa, Homo Sapiens
SYLKKCRLE

SEQ ID NO: 1296732 - protein, 9 aa, Homo Sapiens
RAVLVERGP

SEQ ID NO: 1296733 - protein, 9 aa, Homo Sapiens
TLQQPWDSQ

SEQ ID NO: 1296734 - protein, 9 aa, Homo Sapiens
YKEGGRDFL

SEQ ID NO: 1296735 - protein, 9 aa, Homo Sapiens
APQPSPHPQ

SEQ ID NO: 1296736 - protein, 9 aa, Homo Sapiens
GLPAQDTPP

SEQ ID NO: 1296737 - protein, 9 aa, Homo Sapiens
DFRRYRERI

SEQ ID NO: 1296738 - protein, 9 aa, Homo Sapiens
KDGNGSTNH

SEQ ID NO: 1296739 - protein, 9 aa, Homo Sapiens
QVKTLGTLV

SEQ ID NO: 1296740 - protein, 9 aa, Homo Sapiens
VTQITVSLS

SEQ ID NO: 1296741 - protein, 9 aa, Homo Sapiens
SRAVLVERG

SEQ ID NO: 1296742 - protein, 9 aa, Homo Sapiens
ASLRATVPR

SEQ ID NO: 1296743 - protein, 9 aa, Homo Sapiens
KTGWEKRKS

SEQ ID NO: 1296744 - protein, 9 aa, Homo Sapiens
LQRQLLGLI

SEQ ID NO: 1296745 - protein, 9 aa, Homo Sapiens
LRALGGPRV

SEQ ID NO: 1296746 - protein, 9 aa, Homo Sapiens
AKKNKENQK

SEQ ID NO: 1296747 - protein, 9 aa, Homo Sapiens
TDGSHTIAT

SEQ ID NO: 1296748 - protein, 9 aa, Homo Sapiens
SGSNISKKV

SEQ ID NO: 1296749 - protein, 9 aa, Homo Sapiens
ALSLTDTDR

SEQ ID NO: 1296750 - protein, 9 aa, Homo Sapiens
SDSELTVFG

SEQ ID NO: 1296751 - protein, 9 aa, Homo Sapiens
TLGEAALSP

SEQ ID NO: 1296752 - protein, 9 aa, Homo Sapiens
IVELRHLLV

SEQ ID NO: 1296753 - protein, 9 aa, Homo Sapiens
DDVFCDGDE

SEQ ID NO: 1296754 - protein, 9 aa, Homo Sapiens
ATTAHEKCL

SEQ ID NO: 1296755 - protein, 9 aa, Homo Sapiens
TQRSPSGCQ

SEQ ID NO: 1296756 - protein, 9 aa, Homo Sapiens
QRKDCKWSS

SEQ ID NO: 1296757 - protein, 9 aa, Homo Sapiens
QLAPAVEPH

SEQ ID NO: 1296758 - protein, 9 aa, Homo Sapiens
HRPTRHLSG

SEQ ID NO: 1296759 - protein, 9 aa, Homo Sapiens
VPPDRGCLL

SEQ ID NO: 1296760 - protein, 9 aa, Homo Sapiens
GVKINQKSM

SEQ ID NO: 1296761 - protein, 9 aa, Homo Sapiens
PAAWSSVAC

SEQ ID NO: 1296762 - protein, 9 aa, Homo Sapiens
VKMADFGLS

SEQ ID NO: 1296763 - protein, 9 aa, Homo Sapiens
VDNKALILS

SEQ ID NO: 1296764 - protein, 9 aa, Homo Sapiens
ELHRALGQV

SEQ ID NO: 1296765 - protein, 9 aa, Homo Sapiens
IAPPIFVFQ

SEQ ID NO: 1296766 - protein, 9 aa, Homo Sapiens
PRATAVTWT

SEQ ID NO: 1296767 - protein, 9 aa, Homo Sapiens
SWSGCLSLG

SEQ ID NO: 1296768 - protein, 9 aa, Homo Sapiens
PLRGFLLHQ

SEQ ID NO: 1296769 - protein, 9 aa, Homo Sapiens
VRTAEPDVW

SEQ ID NO: 1296770 - protein, 9 aa, Homo Sapiens
LLSVHKSLG

SEQ ID NO: 1296771 - protein, 9 aa, Homo Sapiens
RNSFWQYWL

SEQ ID NO: 1296772 - protein, 9 aa, Homo Sapiens
RRLSSPTRP

SEQ ID NO: 1296773 - protein, 9 aa, Homo Sapiens
PIAQGEEKG

SEQ ID NO: 1296774 - protein, 9 aa, Homo Sapiens
WWGQKTKVF

SEQ ID NO: 1296775 - protein, 9 aa, Homo Sapiens
LAYMPHTFL

SEQ ID NO: 1296776 - protein, 9 aa, Homo Sapiens
RDNQWLGSH

SEQ ID NO: 1296777 - protein, 9 aa, Homo Sapiens
AQPTMPGSM

SEQ ID NO: 1296778 - protein, 9 aa, Homo Sapiens
SALGLSLYL

SEQ ID NO: 1296779 - protein, 9 aa, Homo Sapiens
WNNKKMAMT

SEQ ID NO: 1296780 - protein, 9 aa, Homo Sapiens
DLEGPGGGQ

SEQ ID NO: 1296781 - protein, 9 aa, Homo Sapiens
AGARASKGQ

SEQ ID NO: 1296782 - protein, 9 aa, Homo Sapiens
AADAELDWV

SEQ ID NO: 1296783 - protein, 9 aa, Homo Sapiens
LLESNSDSD

SEQ ID NO: 1296784 - protein, 9 aa, Homo Sapiens
HPVLLSIPW

SEQ ID NO: 1296785 - protein, 9 aa, Homo Sapiens
IKILCATYM

SEQ ID NO: 1296786 - protein, 9 aa, Homo Sapiens
MEGQPMRCL

SEQ ID NO: 1296787 - protein, 9 aa, Homo Sapiens
PRALAPGRG

SEQ ID NO: 1296788 - protein, 9 aa, Homo Sapiens
YELSRKVYI

SEQ ID NO: 1296789 - protein, 9 aa, Homo Sapiens
HQSAGDCVW

SEQ ID NO: 1296790 - protein, 9 aa, Homo Sapiens
SYDDDDMVL

SEQ ID NO: 1296791 - protein, 9 aa, Homo Sapiens
EEYYELRSI

SEQ ID NO: 1296792 - protein, 9 aa, Homo Sapiens
TQSLNYDCI

SEQ ID NO: 1296793 - protein, 9 aa, Homo Sapiens
FGLRVAKRQ

SEQ ID NO: 1296794 - protein, 9 aa, Homo Sapiens
PVGRGCCSS

SEQ ID NO: 1296795 - protein, 9 aa, Homo Sapiens
GFSRTSRHS

SEQ ID NO: 1296796 - protein, 9 aa, Homo Sapiens
LREFDKKLI

SEQ ID NO: 1296797 - protein, 9 aa, Homo Sapiens
EGLMSRPSQ

SEQ ID NO: 1296798 - protein, 9 aa, Homo Sapiens
GGRILLQRN

SEQ ID NO: 1296799 - protein, 9 aa, Homo Sapiens
NPDARSALR

SEQ ID NO: 1296800 - protein, 9 aa, Homo Sapiens
LEGLEAVLP

SEQ ID NO: 1296801 - protein, 9 aa, Homo Sapiens
AVSDSEAYH

SEQ ID NO: 1296802 - protein, 9 aa, Homo Sapiens
LKQLRPEIL

SEQ ID NO: 1296803 - protein, 9 aa, Homo Sapiens
CTASNARGQ

SEQ ID NO: 1296804 - protein, 9 aa, Homo Sapiens
QKLAYEKSR

SEQ ID NO: 1296805 - protein, 9 aa, Homo Sapiens
QQGDKNKKI

SEQ ID NO: 1296806 - protein, 9 aa, Homo Sapiens
LGPPATAPA

SEQ ID NO: 1296807 - protein, 9 aa, Homo Sapiens
ESPAGTPCS

SEQ ID NO: 1296808 - protein, 9 aa, Homo Sapiens
DGNGSTNHQ

SEQ ID NO: 1296809 - protein, 9 aa, Homo Sapiens
PYQNEMSDV

SEQ ID NO: 1296810 - protein, 9 aa, Homo Sapiens
EEAVPVQKE

SEQ ID NO: 1296811 - protein, 9 aa, Homo Sapiens
EREERSARL

SEQ ID NO: 1296812 - protein, 9 aa, Homo Sapiens
DPPLILPQA

SEQ ID NO: 1296813 - protein, 9 aa, Homo Sapiens
TTSTHTVMQ

SEQ ID NO: 1296814 - protein, 9 aa, Homo Sapiens
NNTLHMPMY

SEQ ID NO: 1296815 - protein, 9 aa, Homo Sapiens
VTQRALLVH

SEQ ID NO: 1296816 - protein, 9 aa, Homo Sapiens
DIMDIRNAL

SEQ ID NO: 1296817 - protein, 9 aa, Homo Sapiens
EQVAVVTFV

SEQ ID NO: 1296818 - protein, 9 aa, Homo Sapiens
PAGQQVAFI

SEQ ID NO: 1296819 - protein, 9 aa, Homo Sapiens
TMESAKPVT

SEQ ID NO: 1296820 - protein, 9 aa, Homo Sapiens
IEQRESRSL

SEQ ID NO: 1296821 - protein, 9 aa, Homo Sapiens
EVVNEIENL

SEQ ID NO: 1296822 - protein, 9 aa, Homo Sapiens
FKMVDVGGR

SEQ ID NO: 1296823 - protein, 9 aa, Homo Sapiens
ISKGMVNVT

SEQ ID NO: 1296824 - protein, 9 aa, Homo Sapiens
VKATVCPAV

SEQ ID NO: 1296825 - protein, 9 aa, Homo Sapiens
KHLLGQRRL

SEQ ID NO: 1296826 - protein, 9 aa, Homo Sapiens
ESHMKVHQH

SEQ ID NO: 1296827 - protein, 9 aa, Homo Sapiens
HVLHFNDAP

SEQ ID NO: 1296828 - protein, 9 aa, Homo Sapiens
ISVREHFVF

SEQ ID NO: 1296829 - protein, 9 aa, Homo Sapiens
LLSLYSVAV

SEQ ID NO: 1296830 - protein, 9 aa, Homo Sapiens
EGGGHCQVH

SEQ ID NO: 1296831 - protein, 9 aa, Homo Sapiens
NVTITNPSS

SEQ ID NO: 1296832 - protein, 9 aa, Homo Sapiens
MLDLLVICQ

SEQ ID NO: 1296833 - protein, 9 aa, Homo Sapiens
AVEVSITYQ

SEQ ID NO: 1296834 - protein, 9 aa, Homo Sapiens
PLSCKHLIK

SEQ ID NO: 1296835 - protein, 9 aa, Homo Sapiens
TTCPGPSWH

SEQ ID NO: 1296836 - protein, 9 aa, Homo Sapiens
WETRAKLRG

SEQ ID NO: 1296837 - protein, 9 aa, Homo Sapiens
SVLHDLKDR

SEQ ID NO: 1296838 - protein, 9 aa, Homo Sapiens
TVAFLPPMH

SEQ ID NO: 1296839 - protein, 9 aa, Homo Sapiens
LNDEVAESS

SEQ ID NO: 1296840 - protein, 9 aa, Homo Sapiens
LASNDPSTP

SEQ ID NO: 1296841 - protein, 9 aa, Homo Sapiens
LLLQGITHL

SEQ ID NO: 1296842 - protein, 9 aa, Homo Sapiens
SRDPENSET

SEQ ID NO: 1296843 - protein, 9 aa, Homo Sapiens
AGAAAAAAQ

SEQ ID NO: 1296844 - protein, 9 aa, Homo Sapiens
SILARLVAT

SEQ ID NO: 1296845 - protein, 9 aa, Homo Sapiens
PYHGKRDSV

SEQ ID NO: 1296846 - protein, 9 aa, Homo Sapiens
WSSVACPAR

SEQ ID NO: 1296847 - protein, 9 aa, Homo Sapiens
GTPDSRPPS

SEQ ID NO: 1296848 - protein, 9 aa, Homo Sapiens
SRDNNNISS

SEQ ID NO: 1296849 - protein, 9 aa, Homo Sapiens
GFLLQEEKG

SEQ ID NO: 1296850 - protein, 9 aa, Homo Sapiens
SPLAPSEWA

SEQ ID NO: 1296851 - protein, 9 aa, Homo Sapiens
EKRFFAHLL

SEQ ID NO: 1296852 - protein, 9 aa, Homo Sapiens
HAFNQSVEL

SEQ ID NO: 1296853 - protein, 9 aa, Homo Sapiens
WRTSRGQAQ

SEQ ID NO: 1296854 - protein, 9 aa, Homo Sapiens
RGAPGHPGV

SEQ ID NO: 1296855 - protein, 9 aa, Homo Sapiens
MAVPRVQAR

SEQ ID NO: 1296856 - protein, 9 aa, Homo Sapiens
SSCRSKGPM

SEQ ID NO: 1296857 - protein, 9 aa, Homo Sapiens
TRCCRPRTR

SEQ ID NO: 1296858 - protein, 9 aa, Homo Sapiens
PLLEAFPLP

SEQ ID NO: 1296859 - protein, 9 aa, Homo Sapiens
VVRAGVDVD

SEQ ID NO: 1296860 - protein, 9 aa, Homo Sapiens
TQWSLARPQ

SEQ ID NO: 1296861 - protein, 9 aa, Homo Sapiens
ANTESYLKK

SEQ ID NO: 1296862 - protein, 9 aa, Homo Sapiens
AAAMIPTQT

SEQ ID NO: 1296863 - protein, 9 aa, Homo Sapiens
EEQVAVVTF

SEQ ID NO: 1296864 - protein, 9 aa, Homo Sapiens
KKAHRRKAL

SEQ ID NO: 1296865 - protein, 9 aa, Homo Sapiens
NRIQVENPN

SEQ ID NO: 1296866 - protein, 9 aa, Homo Sapiens
SLYSVAVWP

SEQ ID NO: 1296867 - protein, 9 aa, Homo Sapiens
LVGHLGDQL

SEQ ID NO: 1296868 - protein, 9 aa, Homo Sapiens
PGATTTAPS

SEQ ID NO: 1296869 - protein, 9 aa, Homo Sapiens
PRFHCQQDH

SEQ ID NO: 1296870 - protein, 9 aa, Homo Sapiens
DPDSNNARI

SEQ ID NO: 1296871 - protein, 9 aa, Homo Sapiens
PPGEKLSPN

SEQ ID NO: 1296872 - protein, 9 aa, Homo Sapiens
QLVEGLLQE

SEQ ID NO: 1296873 - protein, 9 aa, Homo Sapiens
AASQLQRGR

SEQ ID NO: 1296874 - protein, 9 aa, Homo Sapiens
VVFLYMWSF

SEQ ID NO: 1296875 - protein, 9 aa, Homo Sapiens
LLDPPLILP

SEQ ID NO: 1296876 - protein, 9 aa, Homo Sapiens
LMTAMWLSA

SEQ ID NO: 1296877 - protein, 9 aa, Homo Sapiens
KPLLSYPLV

SEQ ID NO: 1296878 - protein, 9 aa, Homo Sapiens
KATVCPAVE

SEQ ID NO: 1296879 - protein, 9 aa, Homo Sapiens
VHLVIRPPI

SEQ ID NO: 1296880 - protein, 9 aa, Homo Sapiens
FPYQNEMSD

SEQ ID NO: 1296881 - protein, 9 aa, Homo Sapiens
GAARHHVEA

SEQ ID NO: 1296882 - protein, 9 aa, Homo Sapiens
KLLNCQRKR

SEQ ID NO: 1296883 - protein, 9 aa, Homo Sapiens
CLPSASSGN

SEQ ID NO: 1296884 - protein, 9 aa, Homo Sapiens
LWKWQFDVW

SEQ ID NO: 1296885 - protein, 9 aa, Homo Sapiens
LQSEWTQRS

SEQ ID NO: 1296886 - protein, 9 aa, Homo Sapiens
NLVFTVLEF

SEQ ID NO: 1296887 - protein, 9 aa, Homo Sapiens
LKFKLQLSD

SEQ ID NO: 1296888 - protein, 9 aa, Homo Sapiens
FQDFNDPSQ

SEQ ID NO: 1296889 - protein, 9 aa, Homo Sapiens
EPVNFITFL

SEQ ID NO: 1296890 - protein, 9 aa, Homo Sapiens
PKETFSHLH

SEQ ID NO: 1296891 - protein, 9 aa, Homo Sapiens
KENLLPPSR

SEQ ID NO: 1296892 - protein, 9 aa, Homo Sapiens
VAMGQDCYT

SEQ ID NO: 1296893 - protein, 9 aa, Homo Sapiens
MLGEGGILS

SEQ ID NO: 1296894 - protein, 9 aa, Homo Sapiens
AVTGTLADD

SEQ ID NO: 1296895 - protein, 9 aa, Homo Sapiens
LCATTTCPG

SEQ ID NO: 1296896 - protein, 9 aa, Homo Sapiens
MASKKDSAS

SEQ ID NO: 1296897 - protein, 9 aa, Homo Sapiens
KRQRWRRRP

SEQ ID NO: 1296898 - protein, 9 aa, Homo Sapiens
EAAWSRILS

SEQ ID NO: 1296899 - protein, 9 aa, Homo Sapiens
CSSARTTAP

SEQ ID NO: 1296900 - protein, 9 aa, Homo Sapiens
SPWNKTQAK

SEQ ID NO: 1296901 - protein, 9 aa, Homo Sapiens
QRRRLQKRR

SEQ ID NO: 1296902 - protein, 9 aa, Homo Sapiens
QTFSGGCGF

SEQ ID NO: 1296903 - protein, 9 aa, Homo Sapiens
RCSQGGGEP

SEQ ID NO: 1296904 - protein, 9 aa, Homo Sapiens
GRWSAPTCP

SEQ ID NO: 1296905 - protein, 9 aa, Homo Sapiens
PRAVEASEL

SEQ ID NO: 1296906 - protein, 9 aa, Homo Sapiens
YCIISCIDC

SEQ ID NO: 1296907 - protein, 9 aa, Homo Sapiens
MLESEPAVQ

SEQ ID NO: 1296908 - protein, 9 aa, Homo Sapiens
ESILQTPGG

SEQ ID NO: 1296909 - protein, 9 aa, Homo Sapiens
DDDALHGDT

SEQ ID NO: 1296910 - protein, 9 aa, Homo Sapiens
RYCGYGEDH

SEQ ID NO: 1296911 - protein, 9 aa, Homo Sapiens
KTSEEDTRA

SEQ ID NO: 1296912 - protein, 9 aa, Homo Sapiens
VQALKLHDR

SEQ ID NO: 1296913 - protein, 9 aa, Homo Sapiens
CPASRSSAA

SEQ ID NO: 1296914 - protein, 9 aa, Homo Sapiens
SGSTASRAS

SEQ ID NO: 1296915 - protein, 9 aa, Homo Sapiens
RIFIKQKCI

SEQ ID NO: 1296916 - protein, 9 aa, Homo Sapiens
RLTHHPIYI

SEQ ID NO: 1296917 - protein, 9 aa, Homo Sapiens
GKSQGGRIL

SEQ ID NO: 1296918 - protein, 9 aa, Homo Sapiens
LAPENLKTH

SEQ ID NO: 1296919 - protein, 9 aa, Homo Sapiens
FDLSTLSDP

SEQ ID NO: 1296920 - protein, 9 aa, Homo Sapiens
WYAKLGVWC

SEQ ID NO: 1296921 - protein, 9 aa, Homo Sapiens
PTQRRSARP

SEQ ID NO: 1296922 - protein, 9 aa, Homo Sapiens
GSLNKHTAF

SEQ ID NO: 1296923 - protein, 9 aa, Homo Sapiens
RLNQTLKKE

SEQ ID NO: 1296924 - protein, 9 aa, Homo Sapiens
VVVYNAGTN

SEQ ID NO: 1296925 - protein, 9 aa, Homo Sapiens
HQKKLTVPH

SEQ ID NO: 1296926 - protein, 9 aa, Homo Sapiens
ERCAWQQAV

SEQ ID NO: 1296927 - protein, 9 aa, Homo Sapiens
VSTLTMESA

SEQ ID NO: 1296928 - protein, 9 aa, Homo Sapiens
PIYILKGGY

SEQ ID NO: 1296929 - protein, 9 aa, Homo Sapiens
RSEGGPPRP

SEQ ID NO: 1296930 - protein, 9 aa, Homo Sapiens
VELEVIARG

SEQ ID NO: 1296931 - protein, 9 aa, Homo Sapiens
NTYVGLQLV

SEQ ID NO: 1296932 - protein, 9 aa, Homo Sapiens
GSAHTSRSV

SEQ ID NO: 1296933 - protein, 9 aa, Homo Sapiens
PLGNPRVLS

SEQ ID NO: 1296934 - protein, 9 aa, Homo Sapiens
CKWSSCLTW

SEQ ID NO: 1296935 - protein, 9 aa, Homo Sapiens
VSITYQSPS

SEQ ID NO: 1296936 - protein, 9 aa, Homo Sapiens
NISKKVSWY

SEQ ID NO: 1296937 - protein, 9 aa, Homo Sapiens
ERGVRMKSV

SEQ ID NO: 1296938 - protein, 9 aa, Homo Sapiens
RPVDDDALH

SEQ ID NO: 1296939 - protein, 9 aa, Homo Sapiens
LLLSPLDSS

SEQ ID NO: 1296940 - protein, 9 aa, Homo Sapiens
ALPTQQLAW

SEQ ID NO: 1296941 - protein, 9 aa, Homo Sapiens
FAHLLVYIL

SEQ ID NO: 1296942 - protein, 9 aa, Homo Sapiens
SNDLPLLAM

SEQ ID NO: 1296943 - protein, 9 aa, Homo Sapiens
RASQPSSSV

SEQ ID NO: 1296944 - protein, 9 aa, Homo Sapiens
PDEPQKSSL

SEQ ID NO: 1296945 - protein, 9 aa, Homo Sapiens
QVENMNIFF

SEQ ID NO: 1296946 - protein, 9 aa, Homo Sapiens
HTVMQGNMD

SEQ ID NO: 1296947 - protein, 9 aa, Homo Sapiens
SGRVCAEKW

SEQ ID NO: 1296948 - protein, 9 aa, Homo Sapiens
VIDVSVLHT

SEQ ID NO: 1296949 - protein, 9 aa, Homo Sapiens
YLDRTLYPL

SEQ ID NO: 1296950 - protein, 9 aa, Homo Sapiens
GGRRGAPGH

SEQ ID NO: 1296951 - protein, 9 aa, Homo Sapiens
VSKCDGNSS

SEQ ID NO: 1296952 - protein, 9 aa, Homo Sapiens
TPPPHQMKC

SEQ ID NO: 1296953 - protein, 9 aa, Homo Sapiens
AVLPQAVSS

SEQ ID NO: 1296954 - protein, 9 aa, Homo Sapiens
LLVQALKLH

SEQ ID NO: 1296955 - protein, 9 aa, Homo Sapiens
VLLPPEGMC

SEQ ID NO: 1296956 - protein, 9 aa, Homo Sapiens
LIVHHRTHI

SEQ ID NO: 1296957 - protein, 9 aa, Homo Sapiens
GQVRDHCRP

SEQ ID NO: 1296958 - protein, 9 aa, Homo Sapiens
AAISQHSGR

SEQ ID NO: 1296959 - protein, 9 aa, Homo Sapiens
KRANCEAAW

SEQ ID NO: 1296960 - protein, 9 aa, Homo Sapiens
PPGGGCWAR

SEQ ID NO: 1296961 - protein, 9 aa, Homo Sapiens
QESCLMSTT

SEQ ID NO: 1296962 - protein, 9 aa, Homo Sapiens
AGRGAPRHP

SEQ ID NO: 1296963 - protein, 9 aa, Homo Sapiens
AEGEGMLES

SEQ ID NO: 1296964 - protein, 9 aa, Homo Sapiens
SCVTIANDI

SEQ ID NO: 1296965 - protein, 9 aa, Homo Sapiens
KINIRMLDP

SEQ ID NO: 1296966 - protein, 9 aa, Homo Sapiens
MRCLEHPNM

SEQ ID NO: 1296967 - protein, 9 aa, Homo Sapiens
NRLCVLLLL

SEQ ID NO: 1296968 - protein, 9 aa, Homo Sapiens
GGVHRAGPP

SEQ ID NO: 1296969 - protein, 9 aa, Homo Sapiens
LVDYSQNVA

SEQ ID NO: 1296970 - protein, 9 aa, Homo Sapiens
IRYAIRIAC

SEQ ID NO: 1296971 - protein, 9 aa, Homo Sapiens
PLILWPQAA

SEQ ID NO: 1296972 - protein, 9 aa, Homo Sapiens
RCRISTEEK

SEQ ID NO: 1296973 - protein, 9 aa, Homo Sapiens
WWETRAKLR

SEQ ID NO: 1296974 - protein, 9 aa, Homo Sapiens
MSTTRSIER

SEQ ID NO: 1296975 - protein, 9 aa, Homo Sapiens
KINQKSMEK

SEQ ID NO: 1296976 - protein, 9 aa, Homo Sapiens
GNCCSTMGW

SEQ ID NO: 1296977 - protein, 9 aa, Homo Sapiens
WSAVPPHVK

SEQ ID NO: 1296978 - protein, 9 aa, Homo Sapiens
NAGTNILEG

SEQ ID NO: 1296979 - protein, 9 aa, Homo Sapiens
ITTADTTAE

SEQ ID NO: 1296980 - protein, 9 aa, Homo Sapiens
GRWNNAKPI

SEQ ID NO: 1296981 - protein, 9 aa, Homo Sapiens
MCIIRAAVS

SEQ ID NO: 1296982 - protein, 9 aa, Homo Sapiens
IAEKRCRIS

SEQ ID NO: 1296983 - protein, 9 aa, Homo Sapiens
HTQRSDKNN

SEQ ID NO: 1296984 - protein, 9 aa, Homo Sapiens
HIIEKKHVS

SEQ ID NO: 1296985 - protein, 9 aa, Homo Sapiens
TRTEGYFIS

SEQ ID NO: 1296986 - protein, 9 aa, Homo Sapiens
ARHSPELGV

SEQ ID NO: 1296987 - protein, 9 aa, Homo Sapiens
VWAAKGEKG

SEQ ID NO: 1296988 - protein, 9 aa, Homo Sapiens
YGDITVATT

SEQ ID NO: 1296989 - protein, 9 aa, Homo Sapiens
SVPVARTGI

SEQ ID NO: 1296990 - protein, 9 aa, Homo Sapiens
PGLALRKTE

SEQ ID NO: 1296991 - protein, 9 aa, Homo Sapiens
VSGCGRAPA

SEQ ID NO: 1296992 - protein, 9 aa, Homo Sapiens
RMTSAVLLT

SEQ ID NO: 1296993 - protein, 9 aa, Homo Sapiens
LVMLAAIDL

SEQ ID NO: 1296994 - protein, 9 aa, Homo Sapiens
GAPGHPGVG

SEQ ID NO: 1296995 - protein, 9 aa, Homo Sapiens
PEQRVGHRH

SEQ ID NO: 1296996 - protein, 9 aa, Homo Sapiens
RCCRPRTRT

SEQ ID NO: 1296997 - protein, 9 aa, Homo Sapiens
RVAKRQQLV

SEQ ID NO: 1296998 - protein, 9 aa, Homo Sapiens
AANPLFLTG

SEQ ID NO: 1296999 - protein, 9 aa, Homo Sapiens
TRDALTEPP

SEQ ID NO: 1297000 - protein, 9 aa, Homo Sapiens
YVGLQLVVV

SEQ ID NO: 1297001 - protein, 9 aa, Homo Sapiens
LLHQPLPGQ

SEQ ID NO: 1297002 - protein, 9 aa, Homo Sapiens
TQELQPPSP

SEQ ID NO: 1297003 - protein, 9 aa, Homo Sapiens
GHVHLAPHV

SEQ ID NO: 1297004 - protein, 9 aa, Homo Sapiens
PRGDHRSNQ

SEQ ID NO: 1297005 - protein, 9 aa, Homo Sapiens
SVLGTALHG

SEQ ID NO: 1297006 - protein, 9 aa, Homo Sapiens
ATTSEIVLP

SEQ ID NO: 1297007 - protein, 9 aa, Homo Sapiens
PSPWKPCGR

SEQ ID NO: 1297008 - protein, 9 aa, Homo Sapiens
QSSKRPGTS

SEQ ID NO: 1297009 - protein, 9 aa, Homo Sapiens
QPRALAPGR

SEQ ID NO: 1297010 - protein, 9 aa, Homo Sapiens
SPTRCCRPR

SEQ ID NO: 1297011 - protein, 9 aa, Homo Sapiens
AMTERWPGR

SEQ ID NO: 1297012 - protein, 9 aa, Homo Sapiens
LSLGFSRTS

SEQ ID NO: 1297013 - protein, 9 aa, Homo Sapiens
TTVLNISEI

SEQ ID NO: 1297014 - protein, 9 aa, Homo Sapiens
GCGVGPHPP

SEQ ID NO: 1297015 - protein, 9 aa, Homo Sapiens
GQRWARGPG

SEQ ID NO: 1297016 - protein, 9 aa, Homo Sapiens
RGEAIYQIG

SEQ ID NO: 1297017 - protein, 9 aa, Homo Sapiens
GKSVKTSTT

SEQ ID NO: 1297018 - protein, 9 aa, Homo Sapiens
QFLDLLLPA

SEQ ID NO: 1297019 - protein, 9 aa, Homo Sapiens
GSTASRASQ

SEQ ID NO: 1297020 - protein, 9 aa, Homo Sapiens
KPYQCGEYG

SEQ ID NO: 1297021 - protein, 9 aa, Homo Sapiens
HHDDYLDRT

SEQ ID NO: 1297022 - protein, 9 aa, Homo Sapiens
NVGIMCIIR

SEQ ID NO: 1297023 - protein, 9 aa, Homo Sapiens
GGGRVWAAK

SEQ ID NO: 1297024 - protein, 9 aa, Homo Sapiens
CNTLFFRCH

SEQ ID NO: 1297025 - protein, 9 aa, Homo Sapiens
NTMQWNNKK

SEQ ID NO: 1297026 - protein, 9 aa, Homo Sapiens
KIYNNTLHM

SEQ ID NO: 1297027 - protein, 9 aa, Homo Sapiens
EIKGECQVK

SEQ ID NO: 1297028 - protein, 9 aa, Homo Sapiens
EPPRCLLAV

SEQ ID NO: 1297029 - protein, 9 aa, Homo Sapiens
TRVLPTNPE

SEQ ID NO: 1297030 - protein, 9 aa, Homo Sapiens
KLFDRLQEL

SEQ ID NO: 1297031 - protein, 9 aa, Homo Sapiens
IMDIRNALV

SEQ ID NO: 1297032 - protein, 9 aa, Homo Sapiens
RRQRSPSQR

SEQ ID NO: 1297033 - protein, 9 aa, Homo Sapiens
GLGDPLKRD

SEQ ID NO: 1297034 - protein, 9 aa, Homo Sapiens
QVHPAGPAG

SEQ ID NO: 1297035 - protein, 9 aa, Homo Sapiens
LCLEGIRYA

SEQ ID NO: 1297036 - protein, 9 aa, Homo Sapiens
MGPPADLEG

SEQ ID NO: 1297037 - protein, 9 aa, Homo Sapiens
GQHLWLSHR

SEQ ID NO: 1297038 - protein, 9 aa, Homo Sapiens
PLPPSPTMP

SEQ ID NO: 1297039 - protein, 9 aa, Homo Sapiens
NCIWKVLHI

SEQ ID NO: 1297040 - protein, 9 aa, Homo Sapiens
NQVPTVGFE

SEQ ID NO: 1297041 - protein, 9 aa, Homo Sapiens
PGGSPFLFW

SEQ ID NO: 1297042 - protein, 9 aa, Homo Sapiens
VKENFENKE

SEQ ID NO: 1297043 - protein, 9 aa, Homo Sapiens
KKMMIGSQH

SEQ ID NO: 1297044 - protein, 9 aa, Homo Sapiens
RHSSVLATG

SEQ ID NO: 1297045 - protein, 9 aa, Homo Sapiens
PEDERHPGL

SEQ ID NO: 1297046 - protein, 9 aa, Homo Sapiens
PPIGAFPVN

SEQ ID NO: 1297047 - protein, 9 aa, Homo Sapiens
LILPQALNR

SEQ ID NO: 1297048 - protein, 9 aa, Homo Sapiens
SSKRPGTSQ

SEQ ID NO: 1297049 - protein, 9 aa, Homo Sapiens
ASQLQRGRR

SEQ ID NO: 1297050 - protein, 9 aa, Homo Sapiens
FRHKSRRLR

SEQ ID NO: 1297051 - protein, 9 aa, Homo Sapiens
KRPGLMANL

SEQ ID NO: 1297052 - protein, 9 aa, Homo Sapiens
VSQASELAL

SEQ ID NO: 1297053 - protein, 9 aa, Homo Sapiens
PPDRGCLLQ

SEQ ID NO: 1297054 - protein, 9 aa, Homo Sapiens
LSFSWSGCL

SEQ ID NO: 1297055 - protein, 9 aa, Homo Sapiens
ATTTCPGPS

SEQ ID NO: 1297056 - protein, 9 aa, Homo Sapiens
QAADAELDW

SEQ ID NO: 1297057 - protein, 9 aa, Homo Sapiens
RFSCNQPQR

SEQ ID NO: 1297058 - protein, 9 aa, Homo Sapiens
PQALNRLCV

SEQ ID NO: 1297059 - protein, 9 aa, Homo Sapiens
TTLWLGPAS

SEQ ID NO: 1297060 - protein, 9 aa, Homo Sapiens
PRNDVDPPG

SEQ ID NO: 1297061 - protein, 9 aa, Homo Sapiens
TWTHPSTKD

SEQ ID NO: 1297062 - protein, 9 aa, Homo Sapiens
PEGRHRPAG

SEQ ID NO: 1297063 - protein, 9 aa, Homo Sapiens
ANGAPPPSA

SEQ ID NO: 1297064 - protein, 9 aa, Homo Sapiens
AAERNMSWR

SEQ ID NO: 1297065 - protein, 9 aa, Homo Sapiens
PPRPTVAFL

SEQ ID NO: 1297066 - protein, 9 aa, Homo Sapiens
DKKLISVET

SEQ ID NO: 1297067 - protein, 9 aa, Homo Sapiens
YRIFIKQKC

SEQ ID NO: 1297068 - protein, 9 aa, Homo Sapiens
CVTIANDIM

SEQ ID NO: 1297069 - protein, 9 aa, Homo Sapiens
DITVATTSE

SEQ ID NO: 1297070 - protein, 9 aa, Homo Sapiens
RVDTATPSW

SEQ ID NO: 1297071 - protein, 9 aa, Homo Sapiens
CQVHLFKDH

SEQ ID NO: 1297072 - protein, 9 aa, Homo Sapiens
AGAAAAAGA

SEQ ID NO: 1297073 - protein, 9 aa, Homo Sapiens
PRMETHPQK

SEQ ID NO: 1297074 - protein, 9 aa, Homo Sapiens
DCVWAGQPG

SEQ ID NO: 1297075 - protein, 9 aa, Homo Sapiens
RIHTTARTY

SEQ ID NO: 1297076 - protein, 9 aa, Homo Sapiens
NRVIDVSVL

SEQ ID NO: 1297077 - protein, 9 aa, Homo Sapiens
PATLPCRRH

SEQ ID NO: 1297078 - protein, 9 aa, Homo Sapiens
SLNIVCKPV

SEQ ID NO: 1297079 - protein, 9 aa, Homo Sapiens
FMLAMQFSI

SEQ ID NO: 1297080 - protein, 9 aa, Homo Sapiens
SSATQASMT

SEQ ID NO: 1297081 - protein, 9 aa, Homo Sapiens
PAIAPPIFV

SEQ ID NO: 1297082 - protein, 9 aa, Homo Sapiens
RSPSRHWRA

SEQ ID NO: 1297083 - protein, 9 aa, Homo Sapiens
PPGMTGLNK

SEQ ID NO: 1297084 - protein, 9 aa, Homo Sapiens
PTMRNSATF

SEQ ID NO: 1297085 - protein, 9 aa, Homo Sapiens
VVGYVLQVL

SEQ ID NO: 1297086 - protein, 9 aa, Homo Sapiens
VWKMNWKKM

SEQ ID NO: 1297087 - protein, 9 aa, Homo Sapiens
RGEREERSA

SEQ ID NO: 1297088 - protein, 9 aa, Homo Sapiens
AQDTPPVHQ

SEQ ID NO: 1297089 - protein, 9 aa, Homo Sapiens
SSPRGSRPR

SEQ ID NO: 1297090 - protein, 9 aa, Homo Sapiens
LLPPEGMCP

SEQ ID NO: 1297091 - protein, 9 aa, Homo Sapiens
THPACARPK

SEQ ID NO: 1297092 - protein, 9 aa, Homo Sapiens
LQRNLLRLQ

SEQ ID NO: 1297093 - protein, 9 aa, Homo Sapiens
ALQKEEEVE

SEQ ID NO: 1297094 - protein, 9 aa, Homo Sapiens
PSSSVWSSA

SEQ ID NO: 1297095 - protein, 9 aa, Homo Sapiens
RCNPCCRLT

SEQ ID NO: 1297096 - protein, 9 aa, Homo Sapiens
SQRKDCKWS

SEQ ID NO: 1297097 - protein, 9 aa, Homo Sapiens
DFLSTFNIR

SEQ ID NO: 1297098 - protein, 9 aa, Homo Sapiens
MECGSLHDT

SEQ ID NO: 1297099 - protein, 9 aa, Homo Sapiens
EVAESSAEM

SEQ ID NO: 1297100 - protein, 9 aa, Homo Sapiens
HPEPPVPPD

SEQ ID NO: 1297101 - protein, 9 aa, Homo Sapiens
LSVQKIFES

SEQ ID NO: 1297102 - protein, 9 aa, Homo Sapiens
HDQIKHLQA

SEQ ID NO: 1297103 - protein, 9 aa, Homo Sapiens
PLQLLLHPH

SEQ ID NO: 1297104 - protein, 9 aa, Homo Sapiens
KFKLQLSDP

SEQ ID NO: 1297105 - protein, 9 aa, Homo Sapiens
AVADGDVAR

SEQ ID NO: 1297106 - protein, 9 aa, Homo Sapiens
HHVLDKLVH

SEQ ID NO: 1297107 - protein, 9 aa, Homo Sapiens
SILQTPGGK

SEQ ID NO: 1297108 - protein, 9 aa, Homo Sapiens
AKPLLSYPL

SEQ ID NO: 1297109 - protein, 9 aa, Homo Sapiens
DAEPPRCLL

SEQ ID NO: 1297110 - protein, 9 aa, Homo Sapiens
KKRGKSQGG

SEQ ID NO: 1297111 - protein, 9 aa, Homo Sapiens
AEKNSLGII

SEQ ID NO: 1297112 - protein, 9 aa, Homo Sapiens
SQVLLPPEG

SEQ ID NO: 1297113 - protein, 9 aa, Homo Sapiens
TPPRGDHRS

SEQ ID NO: 1297114 - protein, 9 aa, Homo Sapiens
EQALCCQAR

SEQ ID NO: 1297115 - protein, 9 aa, Homo Sapiens
RPNYCFLFL

SEQ ID NO: 1297116 - protein, 9 aa, Homo Sapiens
GQPRLLHVH

SEQ ID NO: 1297117 - protein, 9 aa, Homo Sapiens
GGHQQKHLL

SEQ ID NO: 1297118 - protein, 9 aa, Homo Sapiens
APPPPPLGN

SEQ ID NO: 1297119 - protein, 9 aa, Homo Sapiens
LATAVFTFM

SEQ ID NO: 1297120 - protein, 9 aa, Homo Sapiens
LRKARMEGQ

SEQ ID NO: 1297121 - protein, 9 aa, Homo Sapiens
AAQRGPAPA

SEQ ID NO: 1297122 - protein, 9 aa, Homo Sapiens
IVRFYDSLE

SEQ ID NO: 1297123 - protein, 9 aa, Homo Sapiens
HADPAAQGH

SEQ ID NO: 1297124 - protein, 9 aa, Homo Sapiens
NDEVAESSA

SEQ ID NO: 1297125 - protein, 9 aa, Homo Sapiens
EMKPLPRME

SEQ ID NO: 1297126 - protein, 9 aa, Homo Sapiens
HTTARTYEC

SEQ ID NO: 1297127 - protein, 9 aa, Homo Sapiens
ALQPAALGE

SEQ ID NO: 1297128 - protein, 9 aa, Homo Sapiens
TNSDDIRDE

SEQ ID NO: 1297129 - protein, 9 aa, Homo Sapiens
GGRRGATAA

SEQ ID NO: 1297130 - protein, 9 aa, Homo Sapiens
TALNPRLHP

SEQ ID NO: 1297131 - protein, 9 aa, Homo Sapiens
RGQAQDTSG

SEQ ID NO: 1297132 - protein, 9 aa, Homo Sapiens
GTTDIVSGT

SEQ ID NO: 1297133 - protein, 9 aa, Homo Sapiens
LSCKHLIKS

SEQ ID NO: 1297134 - protein, 9 aa, Homo Sapiens
VHRPWPALT

SEQ ID NO: 1297135 - protein, 9 aa, Homo Sapiens
FSPDSSIRT

SEQ ID NO: 1297136 - protein, 9 aa, Homo Sapiens
TRTAMYTLN

SEQ ID NO: 1297137 - protein, 9 aa, Homo Sapiens
NSKGPVQPI

SEQ ID NO: 1297138 - protein, 9 aa, Homo Sapiens
LAHEKAAVL

SEQ ID NO: 1297139 - protein, 9 aa, Homo Sapiens
CIEQRESRS

SEQ ID NO: 1297140 - protein, 9 aa, Homo Sapiens
HAEVGRPVD

SEQ ID NO: 1297141 - protein, 9 aa, Homo Sapiens
RRRTDPATL

SEQ ID NO: 1297142 - protein, 9 aa, Homo Sapiens
TGGACIPFR

SEQ ID NO: 1297143 - protein, 9 aa, Homo Sapiens
KIVYSHPKL

SEQ ID NO: 1297144 - protein, 9 aa, Homo Sapiens
APEPEEQEK

SEQ ID NO: 1297145 - protein, 9 aa, Homo Sapiens
SGVCSARGG

SEQ ID NO: 1297146 - protein, 9 aa, Homo Sapiens
GVGAAVADG

SEQ ID NO: 1297147 - protein, 9 aa, Homo Sapiens
FITFLEWKQ

SEQ ID NO: 1297148 - protein, 9 aa, Homo Sapiens
PADLEGPGG

SEQ ID NO: 1297149 - protein, 9 aa, Homo Sapiens
STTQSKHNT

SEQ ID NO: 1297150 - protein, 9 aa, Homo Sapiens
SKVLIYRSR

SEQ ID NO: 1297151 - protein, 9 aa, Homo Sapiens
RATAVTWTQ

SEQ ID NO: 1297152 - protein, 9 aa, Homo Sapiens
LEGPGGGQL

SEQ ID NO: 1297153 - protein, 9 aa, Homo Sapiens
RNDVDPPGS

SEQ ID NO: 1297154 - protein, 9 aa, Homo Sapiens
LCIGLTGTG

SEQ ID NO: 1297155 - protein, 9 aa, Homo Sapiens
PRASLRATV

SEQ ID NO: 1297156 - protein, 9 aa, Homo Sapiens
TPPPLILWP

SEQ ID NO: 1297157 - protein, 9 aa, Homo Sapiens
PHAVSGCGR

SEQ ID NO: 1297158 - protein, 9 aa, Homo Sapiens
RPRGAGAGA

SEQ ID NO: 1297159 - protein, 9 aa, Homo Sapiens
NCLCTLNLL

SEQ ID NO: 1297160 - protein, 9 aa, Homo Sapiens
WSEITRNVI

SEQ ID NO: 1297161 - protein, 9 aa, Homo Sapiens
IWPKSGLIL

SEQ ID NO: 1297162 - protein, 9 aa, Homo Sapiens
EQRISVPVA

SEQ ID NO: 1297163 - protein, 9 aa, Homo Sapiens
ALPTGSSST

SEQ ID NO: 1297164 - protein, 9 aa, Homo Sapiens
EKKAEKNSL

SEQ ID NO: 1297165 - protein, 9 aa, Homo Sapiens
RMSYELSRK

SEQ ID NO: 1297166 - protein, 9 aa, Homo Sapiens
LDTILNPKE

SEQ ID NO: 1297167 - protein, 9 aa, Homo Sapiens
SYELSRKVY

SEQ ID NO: 1297168 - protein, 9 aa, Homo Sapiens
GSVTPATDK

SEQ ID NO: 1297169 - protein, 9 aa, Homo Sapiens
CYLTSALQD

SEQ ID NO: 1297170 - protein, 9 aa, Homo Sapiens
PWLECQASG

SEQ ID NO: 1297171 - protein, 9 aa, Homo Sapiens
PRVLSARAM

SEQ ID NO: 1297172 - protein, 9 aa, Homo Sapiens
GAVQQPAGA

SEQ ID NO: 1297173 - protein, 9 aa, Homo Sapiens
KASGSGLCD

SEQ ID NO: 1297174 - protein, 9 aa, Homo Sapiens
TLKTTQPTV

SEQ ID NO: 1297175 - protein, 9 aa, Homo Sapiens
GSRRSPAQP

SEQ ID NO: 1297176 - protein, 9 aa, Homo Sapiens
QIAGSKLSP

SEQ ID NO: 1297177 - protein, 9 aa, Homo Sapiens
IANDIMISI

SEQ ID NO: 1297178 - protein, 9 aa, Homo Sapiens
WARGPGMLE

SEQ ID NO: 1297179 - protein, 9 aa, Homo Sapiens
WGDLEFLSD

SEQ ID NO: 1297180 - protein, 9 aa, Homo Sapiens
TVSLSSLKN

SEQ ID NO: 1297181 - protein, 9 aa, Homo Sapiens
RDSRDGWGA

SEQ ID NO: 1297182 - protein, 9 aa, Homo Sapiens
TVTHSVHSR

SEQ ID NO: 1297183 - protein, 9 aa, Homo Sapiens
FKNMCKPRP

SEQ ID NO: 1297184 - protein, 9 aa, Homo Sapiens
VEARLGQLV

SEQ ID NO: 1297185 - protein, 9 aa, Homo Sapiens
PARVCERCF

SEQ ID NO: 1297186 - protein, 9 aa, Homo Sapiens
NKWNAMVVL

SEQ ID NO: 1297187 - protein, 9 aa, Homo Sapiens
GSRPGWKRT

SEQ ID NO: 1297188 - protein, 9 aa, Homo Sapiens
YLKKCRLEA

SEQ ID NO: 1297189 - protein, 9 aa, Homo Sapiens
GAGAAGKRV

SEQ ID NO: 1297190 - protein, 9 aa, Homo Sapiens
AVVLIVDVV

SEQ ID NO: 1297191 - protein, 9 aa, Homo Sapiens
PDSTSTCLS

SEQ ID NO: 1297192 - protein, 9 aa, Homo Sapiens
PASMPWGSK

SEQ ID NO: 1297193 - protein, 9 aa, Homo Sapiens
AERNMSWRP

SEQ ID NO: 1297194 - protein, 9 aa, Homo Sapiens
LLNEQWVVS

SEQ ID NO: 1297195 - protein, 9 aa, Homo Sapiens
SWEIVMETL

SEQ ID NO: 1297196 - protein, 9 aa, Homo Sapiens
DSNNARITY

SEQ ID NO: 1297197 - protein, 9 aa, Homo Sapiens
DSSIRTSSF

SEQ ID NO: 1297198 - protein, 9 aa, Homo Sapiens
GTELTRVLP

SEQ ID NO: 1297199 - protein, 9 aa, Homo Sapiens
WALPTGSSS

SEQ ID NO: 1297200 - protein, 9 aa, Homo Sapiens
GQLLRLLLR

SEQ ID NO: 1297201 - protein, 9 aa, Homo Sapiens
VGLRGAVEE

SEQ ID NO: 1297202 - protein, 9 aa, Homo Sapiens
VVLNKSLNR

SEQ ID NO: 1297203 - protein, 9 aa, Homo Sapiens
CLEGIRYAI

SEQ ID NO: 1297204 - protein, 9 aa, Homo Sapiens
HPSIRILIS

SEQ ID NO: 1297205 - protein, 9 aa, Homo Sapiens
SNQNREWCL

SEQ ID NO: 1297206 - protein, 9 aa, Homo Sapiens
ASAPCWAPA

SEQ ID NO: 1297207 - protein, 9 aa, Homo Sapiens
KNKENQKEQ

SEQ ID NO: 1297208 - protein, 9 aa, Homo Sapiens
PPPLILWPQ

SEQ ID NO: 1297209 - protein, 9 aa, Homo Sapiens
APETTLWLG

SEQ ID NO: 1297210 - protein, 9 aa, Homo Sapiens
PSPHPQVPP

SEQ ID NO: 1297211 - protein, 9 aa, Homo Sapiens
CGGDIEARS

SEQ ID NO: 1297212 - protein, 9 aa, Homo Sapiens
SRFSGGSLF

SEQ ID NO: 1297213 - protein, 9 aa, Homo Sapiens
CGVLGLWKW

SEQ ID NO: 1297214 - protein, 9 aa, Homo Sapiens
YLKGGHRHQ

SEQ ID NO: 1297215 - protein, 9 aa, Homo Sapiens
QASTQSSKR

SEQ ID NO: 1297216 - protein, 9 aa, Homo Sapiens
GQGGQKPSQ

SEQ ID NO: 1297217 - protein, 9 aa, Homo Sapiens
IKESDDNVK

SEQ ID NO: 1297218 - protein, 9 aa, Homo Sapiens
CQIQVKTLG

SEQ ID NO: 1297219 - protein, 9 aa, Homo Sapiens
RMAQKNCLV

SEQ ID NO: 1297220 - protein, 9 aa, Homo Sapiens
VLMMGHFPS

SEQ ID NO: 1297221 - protein, 9 aa, Homo Sapiens
SRSSAACWP

SEQ ID NO: 1297222 - protein, 9 aa, Homo Sapiens
CMFDENGEQ

SEQ ID NO: 1297223 - protein, 9 aa, Homo Sapiens
RRSTLTTVL

SEQ ID NO: 1297224 - protein, 9 aa, Homo Sapiens
LAEIAGCLG

SEQ ID NO: 1297225 - protein, 9 aa, Homo Sapiens
ARGHVPHCP

SEQ ID NO: 1297226 - protein, 9 aa, Homo Sapiens
TVLEFRSFG

SEQ ID NO: 1297227 - protein, 9 aa, Homo Sapiens
ARAAGGAAA

SEQ ID NO: 1297228 - protein, 9 aa, Homo Sapiens
AEKWNLLNS

SEQ ID NO: 1297229 - protein, 9 aa, Homo Sapiens
VNSWNESPL

SEQ ID NO: 1297230 - protein, 9 aa, Homo Sapiens
PRLCVKATV

SEQ ID NO: 1297231 - protein, 9 aa, Homo Sapiens
DNLESHMKV

SEQ ID NO: 1297232 - protein, 9 aa, Homo Sapiens
LLTGETPPS

SEQ ID NO: 1297233 - protein, 9 aa, Homo Sapiens
WLVWVPHPL

SEQ ID NO: 1297234 - protein, 9 aa, Homo Sapiens
GARASKGQG

SEQ ID NO: 1297235 - protein, 9 aa, Homo Sapiens
KDWVPDAAS

SEQ ID NO: 1297236 - protein, 9 aa, Homo Sapiens
NTSIRNLSQ

SEQ ID NO: 1297237 - protein, 9 aa, Homo Sapiens
INRIQVENP

SEQ ID NO: 1297238 - protein, 9 aa, Homo Sapiens
QDVEVQAVA

SEQ ID NO: 1297239 - protein, 9 aa, Homo Sapiens
HLYPVIQQG

SEQ ID NO: 1297240 - protein, 9 aa, Homo Sapiens
SCNQPQRPA

SEQ ID NO: 1297241 - protein, 9 aa, Homo Sapiens
PVHQVLLVS

SEQ ID NO: 1297242 - protein, 9 aa, Homo Sapiens
TFSGGCGFE

SEQ ID NO: 1297243 - protein, 9 aa, Homo Sapiens
RRAVVLLLQ

SEQ ID NO: 1297244 - protein, 9 aa, Homo Sapiens
KDCDEHGLT

SEQ ID NO: 1297245 - protein, 9 aa, Homo Sapiens
QPIAQGEEK

SEQ ID NO: 1297246 - protein, 9 aa, Homo Sapiens
GSHFPDSQE

SEQ ID NO: 1297247 - protein, 9 aa, Homo Sapiens
LEKKAEKNS

SEQ ID NO: 1297248 - protein, 9 aa, Homo Sapiens
RLDRLLPAA

SEQ ID NO: 1297249 - protein, 9 aa, Homo Sapiens
AMEGGVLLP

SEQ ID NO: 1297250 - protein, 9 aa, Homo Sapiens
LVRGRGGPR

SEQ ID NO: 1297251 - protein, 9 aa, Homo Sapiens
LGVRLRVPP

SEQ ID NO: 1297252 - protein, 9 aa, Homo Sapiens
LTENPVGLR

SEQ ID NO: 1297253 - protein, 9 aa, Homo Sapiens
NQNREWCLE

SEQ ID NO: 1297254 - protein, 9 aa, Homo Sapiens
LLFRHKSRR

SEQ ID NO: 1297255 - protein, 9 aa, Homo Sapiens
GWKRTQQRP

SEQ ID NO: 1297256 - protein, 9 aa, Homo Sapiens
GPAGQQVAF

SEQ ID NO: 1297257 - protein, 9 aa, Homo Sapiens
AISQHSGRQ

SEQ ID NO: 1297258 - protein, 9 aa, Homo Sapiens
SCGTGAAGA

SEQ ID NO: 1297259 - protein, 9 aa, Homo Sapiens
AGVLAMDVL

SEQ ID NO: 1297260 - protein, 9 aa, Homo Sapiens
LSDPGLQFL

SEQ ID NO: 1297261 - protein, 9 aa, Homo Sapiens
STGRNDADT

SEQ ID NO: 1297262 - protein, 9 aa, Homo Sapiens
PFMLYPLQN

SEQ ID NO: 1297263 - protein, 9 aa, Homo Sapiens
LLLLSPLDS

SEQ ID NO: 1297264 - protein, 9 aa, Homo Sapiens
VIQDVAEEE

SEQ ID NO: 1297265 - protein, 9 aa, Homo Sapiens
SQDLDALLS

SEQ ID NO: 1297266 - protein, 9 aa, Homo Sapiens
QVPTVGFEQ

SEQ ID NO: 1297267 - protein, 9 aa, Homo Sapiens
LHIHQGKNG

SEQ ID NO: 1297268 - protein, 9 aa, Homo Sapiens
RPAGHAGGG

SEQ ID NO: 1297269 - protein, 9 aa, Homo Sapiens
SHIYYENIL

SEQ ID NO: 1297270 - protein, 9 aa, Homo Sapiens
ILVDLAVAD

SEQ ID NO: 1297271 - protein, 9 aa, Homo Sapiens
VDTATPSWA

SEQ ID NO: 1297272 - protein, 9 aa, Homo Sapiens
PSIRILISD

SEQ ID NO: 1297273 - protein, 9 aa, Homo Sapiens
TLESHGQGG

SEQ ID NO: 1297274 - protein, 9 aa, Homo Sapiens
MCPVGRGCC

SEQ ID NO: 1297275 - protein, 9 aa, Homo Sapiens
RGATAAERN

SEQ ID NO: 1297276 - protein, 9 aa, Homo Sapiens
LLEIILINC

SEQ ID NO: 1297277 - protein, 9 aa, Homo Sapiens
KRQQLVTQR

SEQ ID NO: 1297278 - protein, 9 aa, Homo Sapiens
KKITTRNSS

SEQ ID NO: 1297279 - protein, 9 aa, Homo Sapiens
LSWGGRGQV

SEQ ID NO: 1297280 - protein, 9 aa, Homo Sapiens
IRQKKPLYL

SEQ ID NO: 1297281 - protein, 9 aa, Homo Sapiens
IKPCFKGIL

SEQ ID NO: 1297282 - protein, 9 aa, Homo Sapiens
ESGHDINGI

SEQ ID NO: 1297283 - protein, 9 aa, Homo Sapiens
GCQMSPDIK

SEQ ID NO: 1297284 - protein, 9 aa, Homo Sapiens
AGDCVWAGQ

SEQ ID NO: 1297285 - protein, 9 aa, Homo Sapiens
NKHTAFSCP

SEQ ID NO: 1297286 - protein, 9 aa, Homo Sapiens
RMILLMERI

SEQ ID NO: 1297287 - protein, 9 aa, Homo Sapiens
AKRMAQKNC

SEQ ID NO: 1297288 - protein, 9 aa, Homo Sapiens
CAWQQAVVG

SEQ ID NO: 1297289 - protein, 9 aa, Homo Sapiens
KPNLDRLMG

SEQ ID NO: 1297290 - protein, 9 aa, Homo Sapiens
QRGPAPAAQ

SEQ ID NO: 1297291 - protein, 9 aa, Homo Sapiens
VQPIAQGEE

SEQ ID NO: 1297292 - protein, 9 aa, Homo Sapiens
AVDRLSGEL

SEQ ID NO: 1297293 - protein, 9 aa, Homo Sapiens
VAVTPVKNW

SEQ ID NO: 1297294 - protein, 9 aa, Homo Sapiens
EQIGPYCTE

SEQ ID NO: 1297295 - protein, 9 aa, Homo Sapiens
EEARKPMVR

SEQ ID NO: 1297296 - protein, 9 aa, Homo Sapiens
GWWGNGWWG

SEQ ID NO: 1297297 - protein, 9 aa, Homo Sapiens
AQHQSAGDC

SEQ ID NO: 1297298 - protein, 9 aa, Homo Sapiens
GRELWQVPA

SEQ ID NO: 1297299 - protein, 9 aa, Homo Sapiens
FFTSAHPSR

SEQ ID NO: 1297300 - protein, 9 aa, Homo Sapiens
LHRALGQVR

SEQ ID NO: 1297301 - protein, 9 aa, Homo Sapiens
THHPIYILK

SEQ ID NO: 1297302 - protein, 9 aa, Homo Sapiens
DGERTALVE

SEQ ID NO: 1297303 - protein, 9 aa, Homo Sapiens
ITTYQNIAV

SEQ ID NO: 1297304 - protein, 9 aa, Homo Sapiens
GAPGQSSGA

SEQ ID NO: 1297305 - protein, 9 aa, Homo Sapiens
APWWHPGRR

SEQ ID NO: 1297306 - protein, 9 aa, Homo Sapiens
IVKLFDVPE

SEQ ID NO: 1297307 - protein, 9 aa, Homo Sapiens
QQLVTQRAL

SEQ ID NO: 1297308 - protein, 9 aa, Homo Sapiens
AGGGGPLPL

SEQ ID NO: 1297309 - protein, 9 aa, Homo Sapiens
ITAAPLPHP

SEQ ID NO: 1297310 - protein, 9 aa, Homo Sapiens
YRCMDCVFE

SEQ ID NO: 1297311 - protein, 9 aa, Homo Sapiens
ISLPLRGFL

SEQ ID NO: 1297312 - protein, 9 aa, Homo Sapiens
GKIWLDDVF

SEQ ID NO: 1297313 - protein, 9 aa, Homo Sapiens
KGFCESTAL

SEQ ID NO: 1297314 - protein, 9 aa, Homo Sapiens
DVVRFLDSL

SEQ ID NO: 1297315 - protein, 9 aa, Homo Sapiens
LDAEPPRCL

SEQ ID NO: 1297316 - protein, 9 aa, Homo Sapiens
GPANLEDAI

SEQ ID NO: 1297317 - protein, 9 aa, Homo Sapiens
QGITHLAEV

SEQ ID NO: 1297318 - protein, 9 aa, Homo Sapiens
LDWDCLHHH

SEQ ID NO: 1297319 - protein, 9 aa, Homo Sapiens
KDCKWSSCL

SEQ ID NO: 1297320 - protein, 9 aa, Homo Sapiens
TRNSSIRAS

SEQ ID NO: 1297321 - protein, 9 aa, Homo Sapiens
GDHRSNQNR

SEQ ID NO: 1297322 - protein, 9 aa, Homo Sapiens
KTYRCMDCV

SEQ ID NO: 1297323 - protein, 9 aa, Homo Sapiens
ILMGTELTR

SEQ ID NO: 1297324 - protein, 9 aa, Homo Sapiens
RHLGQAGPC

SEQ ID NO: 1297325 - protein, 9 aa, Homo Sapiens
SDNGQFFRV

SEQ ID NO: 1297326 - protein, 9 aa, Homo Sapiens
EGHCFPAEI

SEQ ID NO: 1297327 - protein, 9 aa, Homo Sapiens
TRARACAVE

SEQ ID NO: 1297328 - protein, 9 aa, Homo Sapiens
PRRLPMSFS

SEQ ID NO: 1297329 - protein, 9 aa, Homo Sapiens
PSASSGNCC

SEQ ID NO: 1297330 - protein, 9 aa, Homo Sapiens
EPGGRPWCR

SEQ ID NO: 1297331 - protein, 9 aa, Homo Sapiens
APAQPPGPA

SEQ ID NO: 1297332 - protein, 9 aa, Homo Sapiens
QGAVQQPAG

SEQ ID NO: 1297333 - protein, 9 aa, Homo Sapiens
EMNGHIVGS

SEQ ID NO: 1297334 - protein, 9 aa, Homo Sapiens
TTQPTVINN

SEQ ID NO: 1297335 - protein, 9 aa, Homo Sapiens
CARKDNLES

SEQ ID NO: 1297336 - protein, 9 aa, Homo Sapiens
DRDCKSEEC

SEQ ID NO: 1297337 - protein, 9 aa, Homo Sapiens
GIRYAIRIA

SEQ ID NO: 1297338 - protein, 9 aa, Homo Sapiens
YSCTASNAR

SEQ ID NO: 1297339 - protein, 9 aa, Homo Sapiens
GMLESEPAV

SEQ ID NO: 1297340 - protein, 9 aa, Homo Sapiens
EDGEEGGGV

SEQ ID NO: 1297341 - protein, 9 aa, Homo Sapiens
RKTPNSLAK

SEQ ID NO: 1297342 - protein, 9 aa, Homo Sapiens
RQQQQGQAH

SEQ ID NO: 1297343 - protein, 9 aa, Homo Sapiens
LHLLGPLDY

SEQ ID NO: 1297344 - protein, 9 aa, Homo Sapiens
LKSCSCMCL

SEQ ID NO: 1297345 - protein, 9 aa, Homo Sapiens
CAEKWNLLN

SEQ ID NO: 1297346 - protein, 9 aa, Homo Sapiens
GYFTVTLYL

SEQ ID NO: 1297347 - protein, 9 aa, Homo Sapiens
RALAPGRGP

SEQ ID NO: 1297348 - protein, 9 aa, Homo Sapiens
TMRNSATFK

SEQ ID NO: 1297349 - protein, 9 aa, Homo Sapiens
DKLKSMLKK

SEQ ID NO: 1297350 - protein, 9 aa, Homo Sapiens
RIVHAEVGR

SEQ ID NO: 1297351 - protein, 9 aa, Homo Sapiens
LLHVHNRVI

SEQ ID NO: 1297352 - protein, 9 aa, Homo Sapiens
WWPGRRGRC

SEQ ID NO: 1297353 - protein, 9 aa, Homo Sapiens
LRCSQTQSH

SEQ ID NO: 1297354 - protein, 9 aa, Homo Sapiens
SPSHSQQIA

SEQ ID NO: 1297355 - protein, 9 aa, Homo Sapiens
SSSFPETNS

SEQ ID NO: 1297356 - protein, 9 aa, Homo Sapiens
RRGRELWQV

SEQ ID NO: 1297357 - protein, 9 aa, Homo Sapiens
HFNDAPLGL

SEQ ID NO: 1297358 - protein, 9 aa, Homo Sapiens
PHVQLHDVG

SEQ ID NO: 1297359 - protein, 9 aa, Homo Sapiens
LGPVEDAEP

SEQ ID NO: 1297360 - protein, 9 aa, Homo Sapiens
TRHGPYPAA

SEQ ID NO: 1297361 - protein, 9 aa, Homo Sapiens
RFISDLSIS

SEQ ID NO: 1297362 - protein, 9 aa, Homo Sapiens
FLYMWSFCF

SEQ ID NO: 1297363 - protein, 9 aa, Homo Sapiens
LTPRKDCDE

SEQ ID NO: 1297364 - protein, 9 aa, Homo Sapiens
KRGATAAER

SEQ ID NO: 1297365 - protein, 9 aa, Homo Sapiens
CEPATCPAV

SEQ ID NO: 1297366 - protein, 9 aa, Homo Sapiens
LTAVDCLQA

SEQ ID NO: 1297367 - protein, 9 aa, Homo Sapiens
NKGCGVGPH

SEQ ID NO: 1297368 - protein, 9 aa, Homo Sapiens
AWKHSPLLR

SEQ ID NO: 1297369 - protein, 9 aa, Homo Sapiens
PRLCATTTC

SEQ ID NO: 1297370 - protein, 9 aa, Homo Sapiens
PHPLTVLGV

SEQ ID NO: 1297371 - protein, 9 aa, Homo Sapiens
NIRMLDPFT

SEQ ID NO: 1297372 - protein, 9 aa, Homo Sapiens
LWPQSRPQI

SEQ ID NO: 1297373 - protein, 9 aa, Homo Sapiens
EFDKKLISV

SEQ ID NO: 1297374 - protein, 9 aa, Homo Sapiens
NVYCVGQRR

SEQ ID NO: 1297375 - protein, 9 aa, Homo Sapiens
NLKKTKDGN

SEQ ID NO: 1297376 - protein, 9 aa, Homo Sapiens
HHQRVKLFW

SEQ ID NO: 1297377 - protein, 9 aa, Homo Sapiens
QNNLIQQKT

SEQ ID NO: 1297378 - protein, 9 aa, Homo Sapiens
FRRYRERIS

SEQ ID NO: 1297379 - protein, 9 aa, Homo Sapiens
SPSGCQGRP

SEQ ID NO: 1297380 - protein, 9 aa, Homo Sapiens
PGKLTKNGL

SEQ ID NO: 1297381 - protein, 9 aa, Homo Sapiens
CQCDKKRGA

SEQ ID NO: 1297382 - protein, 9 aa, Homo Sapiens
SAASAPQTE

SEQ ID NO: 1297383 - protein, 9 aa, Homo Sapiens
FDKKLISVE

SEQ ID NO: 1297384 - protein, 9 aa, Homo Sapiens
SESSIWKRL

SEQ ID NO: 1297385 - protein, 9 aa, Homo Sapiens
FPLPRASLR

SEQ ID NO: 1297386 - protein, 9 aa, Homo Sapiens
KRRKPCLCT

SEQ ID NO: 1297387 - protein, 9 aa, Homo Sapiens
KWSSCLTWA

SEQ ID NO: 1297388 - protein, 9 aa, Homo Sapiens
EGRGEAIYQ

SEQ ID NO: 1297389 - protein, 9 aa, Homo Sapiens
VEGRELQIV

SEQ ID NO: 1297390 - protein, 9 aa, Homo Sapiens
CLGSMEKSL

SEQ ID NO: 1297391 - protein, 9 aa, Homo Sapiens
CRWCQCLQF

SEQ ID NO: 1297392 - protein, 9 aa, Homo Sapiens
GHQRRKKRR

SEQ ID NO: 1297393 - protein, 9 aa, Homo Sapiens
PDAASTSLY

SEQ ID NO: 1297394 - protein, 9 aa, Homo Sapiens
AGALIAHAV

SEQ ID NO: 1297395 - protein, 9 aa, Homo Sapiens
IQVENPNSL

SEQ ID NO: 1297396 - protein, 9 aa, Homo Sapiens
HHVEARLGQ

SEQ ID NO: 1297397 - protein, 9 aa, Homo Sapiens
NPCCRLTWM

SEQ ID NO: 1297398 - protein, 9 aa, Homo Sapiens
TNILEGDRL

SEQ ID NO: 1297399 - protein, 9 aa, Homo Sapiens
GPGGGQLSW

SEQ ID NO: 1297400 - protein, 9 aa, Homo Sapiens
ARASKGQGH

SEQ ID NO: 1297401 - protein, 9 aa, Homo Sapiens
CSTAWSGSR

SEQ ID NO: 1297402 - protein, 9 aa, Homo Sapiens
LKKKILNCI

SEQ ID NO: 1297403 - protein, 9 aa, Homo Sapiens
LEQGKNPSL

SEQ ID NO: 1297404 - protein, 9 aa, Homo Sapiens
RIVMGPPAD

SEQ ID NO: 1297405 - protein, 9 aa, Homo Sapiens
ADVYSYDDD

SEQ ID NO: 1297406 - protein, 9 aa, Homo Sapiens
DGKNDIKAA

SEQ ID NO: 1297407 - protein, 9 aa, Homo Sapiens
TVLVLLAGL

SEQ ID NO: 1297408 - protein, 9 aa, Homo Sapiens
GAGRQARPD

SEQ ID NO: 1297409 - protein, 9 aa, Homo Sapiens
EVGRPVDDD

SEQ ID NO: 1297410 - protein, 9 aa, Homo Sapiens
RRLSFWSTI

SEQ ID NO: 1297411 - protein, 9 aa, Homo Sapiens
PWNKTQAKQ

SEQ ID NO: 1297412 - protein, 9 aa, Homo Sapiens
MGRRPRPRR

SEQ ID NO: 1297413 - protein, 9 aa, Homo Sapiens
DARSALRPA

SEQ ID NO: 1297414 - protein, 9 aa, Homo Sapiens
REFDKKLIS

SEQ ID NO: 1297415 - protein, 9 aa, Homo Sapiens
EGGVLLPAL

SEQ ID NO: 1297416 - protein, 9 aa, Homo Sapiens
APVGPPPSE

SEQ ID NO: 1297417 - protein, 9 aa, Homo Sapiens
VQAPNIQIH

SEQ ID NO: 1297418 - protein, 9 aa, Homo Sapiens
STRTTATCS

SEQ ID NO: 1297419 - protein, 9 aa, Homo Sapiens
AEPDVWLEA

SEQ ID NO: 1297420 - protein, 9 aa, Homo Sapiens
ELQPPSPEP

SEQ ID NO: 1297421 - protein, 9 aa, Homo Sapiens
ESSAEMLKV

SEQ ID NO: 1297422 - protein, 9 aa, Homo Sapiens
SLERSRLTD

SEQ ID NO: 1297423 - protein, 9 aa, Homo Sapiens
YHSPADSSS

SEQ ID NO: 1297424 - protein, 9 aa, Homo Sapiens
HSESSIWKR

SEQ ID NO: 1297425 - protein, 9 aa, Homo Sapiens
ERCFQELQK

SEQ ID NO: 1297426 - protein, 9 aa, Homo Sapiens
QQGQAHQDA

SEQ ID NO: 1297427 - protein, 9 aa, Homo Sapiens
IQDIACLLS

SEQ ID NO: 1297428 - protein, 9 aa, Homo Sapiens
QSEGLMSRP

SEQ ID NO: 1297429 - protein, 9 aa, Homo Sapiens
LHDVGEERW

SEQ ID NO: 1297430 - protein, 9 aa, Homo Sapiens
GGPPRPTVA

SEQ ID NO: 1297431 - protein, 9 aa, Homo Sapiens
HHLYPVIQQ

SEQ ID NO: 1297432 - protein, 9 aa, Homo Sapiens
EPQKSSLSP

SEQ ID NO: 1297433 - protein, 9 aa, Homo Sapiens
GSHTIATQV

SEQ ID NO: 1297434 - protein, 9 aa, Homo Sapiens
DEHGLTCGS

SEQ ID NO: 1297435 - protein, 9 aa, Homo Sapiens
PAFVQGVPK

SEQ ID NO: 1297436 - protein, 9 aa, Homo Sapiens
TVPRHSSVL

SEQ ID NO: 1297437 - protein, 9 aa, Homo Sapiens
VPRVQARWS

SEQ ID NO: 1297438 - protein, 9 aa, Homo Sapiens
IAEVMLTYK

SEQ ID NO: 1297439 - protein, 9 aa, Homo Sapiens
RSCSERCAW

SEQ ID NO: 1297440 - protein, 9 aa, Homo Sapiens
RPGRGALLL

SEQ ID NO: 1297441 - protein, 9 aa, Homo Sapiens
GRKKKNKWN

SEQ ID NO: 1297442 - protein, 9 aa, Homo Sapiens
MENSHPPTT

SEQ ID NO: 1297443 - protein, 9 aa, Homo Sapiens
WDWAPRCPR

SEQ ID NO: 1297444 - protein, 9 aa, Homo Sapiens
ADGDVARAP

SEQ ID NO: 1297445 - protein, 9 aa, Homo Sapiens
IPENPLQFY

SEQ ID NO: 1297446 - protein, 9 aa, Homo Sapiens
IDTNDNRTT

SEQ ID NO: 1297447 - protein, 9 aa, Homo Sapiens
SVAPATLPC

SEQ ID NO: 1297448 - protein, 9 aa, Homo Sapiens
NLSGLSADI

SEQ ID NO: 1297449 - protein, 9 aa, Homo Sapiens
DIEARSDTY

SEQ ID NO: 1297450 - protein, 9 aa, Homo Sapiens
VMAPVGPPP

SEQ ID NO: 1297451 - protein, 9 aa, Homo Sapiens
WTRSRTVPG

SEQ ID NO: 1297452 - protein, 9 aa, Homo Sapiens
VDILQRPGL

SEQ ID NO: 1297453 - protein, 9 aa, Homo Sapiens
HQPLPGQHL

SEQ ID NO: 1297454 - protein, 9 aa, Homo Sapiens
VMGPPADLE

SEQ ID NO: 1297455 - protein, 9 aa, Homo Sapiens
ANVPLPPPQ

SEQ ID NO: 1297456 - protein, 9 aa, Homo Sapiens
LCTLNLLYT

SEQ ID NO: 1297457 - protein, 9 aa, Homo Sapiens
CSGPRLTPP

SEQ ID NO: 1297458 - protein, 9 aa, Homo Sapiens
LCRAEDEDA

SEQ ID NO: 1297459 - protein, 9 aa, Homo Sapiens
NPGSWVSCG

SEQ ID NO: 1297460 - protein, 9 aa, Homo Sapiens
TMWSWGRPS

SEQ ID NO: 1297461 - protein, 9 aa, Homo Sapiens
YSRKNTLGE

SEQ ID NO: 1297462 - protein, 9 aa, Homo Sapiens
PWCRESLGG

SEQ ID NO: 1297463 - protein, 9 aa, Homo Sapiens
WTQTQCGTM

SEQ ID NO: 1297464 - protein, 9 aa, Homo Sapiens
DKECKKKDE

SEQ ID NO: 1297465 - protein, 9 aa, Homo Sapiens
VTPATDKSA

SEQ ID NO: 1297466 - protein, 9 aa, Homo Sapiens
VILGYVENI

SEQ ID NO: 1297467 - protein, 9 aa, Homo Sapiens
VLDKLVHLV

SEQ ID NO: 1297468 - protein, 9 aa, Homo Sapiens
GVWCLLSFS

SEQ ID NO: 1297469 - protein, 9 aa, Homo Sapiens
TAVDCLQAF

SEQ ID NO: 1297470 - protein, 9 aa, Homo Sapiens
HRLRLRLPR

SEQ ID NO: 1297471 - protein, 9 aa, Homo Sapiens
YHSLVDYSQ

SEQ ID NO: 1297472 - protein, 9 aa, Homo Sapiens
PPDGVGAAV

SEQ ID NO: 1297473 - protein, 9 aa, Homo Sapiens
QSLNYDCIV

SEQ ID NO: 1297474 - protein, 9 aa, Homo Sapiens
SSEPGKLDR

SEQ ID NO: 1297475 - protein, 9 aa, Homo Sapiens
RARPGQLRG

SEQ ID NO: 1297476 - protein, 9 aa, Homo Sapiens
SERCAWQQA

SEQ ID NO: 1297477 - protein, 9 aa, Homo Sapiens
SHKIQKIRQ

SEQ ID NO: 1297478 - protein, 9 aa, Homo Sapiens
EQAADAELD

SEQ ID NO: 1297479 - protein, 9 aa, Homo Sapiens
IGKSVKTST

SEQ ID NO: 1297480 - protein, 9 aa, Homo Sapiens
KADLESILQ

SEQ ID NO: 1297481 - protein, 9 aa, Homo Sapiens
TAAPPPPPL

SEQ ID NO: 1297482 - protein, 9 aa, Homo Sapiens
LMSKVERVE

SEQ ID NO: 1297483 - protein, 9 aa, Homo Sapiens
RLYSRAVLV

SEQ ID NO: 1297484 - protein, 9 aa, Homo Sapiens
PLTRLEGLN

SEQ ID NO: 1297485 - protein, 9 aa, Homo Sapiens
QASGPQVLM

SEQ ID NO: 1297486 - protein, 9 aa, Homo Sapiens
RHSPELGVR

SEQ ID NO: 1297487 - protein, 9 aa, Homo Sapiens
RDSSTNAQV

SEQ ID NO: 1297488 - protein, 9 aa, Homo Sapiens
NRKKHGGSY

SEQ ID NO: 1297489 - protein, 9 aa, Homo Sapiens
AGVHAYPGG

SEQ ID NO: 1297490 - protein, 9 aa, Homo Sapiens
RGATAAPPP

SEQ ID NO: 1297491 - protein, 9 aa, Homo Sapiens
SLSKKGSLV

SEQ ID NO: 1297492 - protein, 9 aa, Homo Sapiens
GVLAMDVLH

SEQ ID NO: 1297493 - protein, 9 aa, Homo Sapiens
ELIIRIVMG

SEQ ID NO: 1297494 - protein, 9 aa, Homo Sapiens
FFTAKRRKP

SEQ ID NO: 1297495 - protein, 9 aa, Homo Sapiens
SHTRLTETS

SEQ ID NO: 1297496 - protein, 9 aa, Homo Sapiens
KSGSTASRA

SEQ ID NO: 1297497 - protein, 9 aa, Homo Sapiens
TILNPKEKH

SEQ ID NO: 1297498 - protein, 9 aa, Homo Sapiens
EVKENFENK

SEQ ID NO: 1297499 - protein, 9 aa, Homo Sapiens
SHHHPEPPV

SEQ ID NO: 1297500 - protein, 9 aa, Homo Sapiens
LVNSWNESP

SEQ ID NO: 1297501 - protein, 9 aa, Homo Sapiens
CFLKKVIEI

SEQ ID NO: 1297502 - protein, 9 aa, Homo Sapiens
VTGTLADDH

SEQ ID NO: 1297503 - protein, 9 aa, Homo Sapiens
AFYDPRSLN

SEQ ID NO: 1297504 - protein, 9 aa, Homo Sapiens
PALQRQLLG

SEQ ID NO: 1297505 - protein, 9 aa, Homo Sapiens
GAPGCDGRD

SEQ ID NO: 1297506 - protein, 9 aa, Homo Sapiens
HNKKEGNLI

SEQ ID NO: 1297507 - protein, 9 aa, Homo Sapiens
VRAGVDVDQ

SEQ ID NO: 1297508 - protein, 9 aa, Homo Sapiens
PPPTKKRGK

SEQ ID NO: 1297509 - protein, 9 aa, Homo Sapiens
GQSSCAFAG

SEQ ID NO: 1297510 - protein, 9 aa, Homo Sapiens
LVLLAGLLA

SEQ ID NO: 1297511 - protein, 9 aa, Homo Sapiens
VGGRGQSAK

SEQ ID NO: 1297512 - protein, 9 aa, Homo Sapiens
LTHPACARP

SEQ ID NO: 1297513 - protein, 9 aa, Homo Sapiens
YKLVVVGAA

SEQ ID NO: 1297514 - protein, 9 aa, Homo Sapiens
TPCSHQGLA

SEQ ID NO: 1297515 - protein, 9 aa, Homo Sapiens
LQGTRSLTL

SEQ ID NO: 1297516 - protein, 9 aa, Homo Sapiens
VPLPAKPSP

SEQ ID NO: 1297517 - protein, 9 aa, Homo Sapiens
EAPTGWDKK

SEQ ID NO: 1297518 - protein, 9 aa, Homo Sapiens
LCSQCLDQV

SEQ ID NO: 1297519 - protein, 9 aa, Homo Sapiens
NSTGRNDAD

SEQ ID NO: 1297520 - protein, 9 aa, Homo Sapiens
GHAAEVCGR

SEQ ID NO: 1297521 - protein, 9 aa, Homo Sapiens
SVREHFVFT

SEQ ID NO: 1297522 - protein, 9 aa, Homo Sapiens
YKLHAAEQY

SEQ ID NO: 1297523 - protein, 9 aa, Homo Sapiens
YCGYGEDHR

SEQ ID NO: 1297524 - protein, 9 aa, Homo Sapiens
SLLSLYSVA

SEQ ID NO: 1297525 - protein, 9 aa, Homo Sapiens
GPRLTPPHA

SEQ ID NO: 1297526 - protein, 9 aa, Homo Sapiens
HSRVLKNQE

SEQ ID NO: 1297527 - protein, 9 aa, Homo Sapiens
LVEEPLFFP

SEQ ID NO: 1297528 - protein, 9 aa, Homo Sapiens
LGDQLGDDL

SEQ ID NO: 1297529 - protein, 9 aa, Homo Sapiens
AEVGRPVDD

SEQ ID NO: 1297530 - protein, 9 aa, Homo Sapiens
IVEHARGPQ

SEQ ID NO: 1297531 - protein, 9 aa, Homo Sapiens
EIILINCCT

SEQ ID NO: 1297532 - protein, 9 aa, Homo Sapiens
SPELGVRLR

SEQ ID NO: 1297533 - protein, 9 aa, Homo Sapiens
RAPEVPRCA

SEQ ID NO: 1297534 - protein, 9 aa, Homo Sapiens
PRCAMAPET

SEQ ID NO: 1297535 - protein, 9 aa, Homo Sapiens
CSCMCLQAR

SEQ ID NO: 1297536 - protein, 9 aa, Homo Sapiens
SVLATGLHL

SEQ ID NO: 1297537 - protein, 9 aa, Homo Sapiens
YLQLHNKKE

SEQ ID NO: 1297538 - protein, 9 aa, Homo Sapiens
RPCPPGRCW

SEQ ID NO: 1297539 - protein, 9 aa, Homo Sapiens
HVATNTLPK

SEQ ID NO: 1297540 - protein, 9 aa, Homo Sapiens
TMQWNNKKM

SEQ ID NO: 1297541 - protein, 9 aa, Homo Sapiens
QRVKLFWMV

SEQ ID NO: 1297542 - protein, 9 aa, Homo Sapiens
QAWGDSPWN

SEQ ID NO: 1297543 - protein, 9 aa, Homo Sapiens
WGGNIAEDS

SEQ ID NO: 1297544 - protein, 9 aa, Homo Sapiens
LTPPHADPA

SEQ ID NO: 1297545 - protein, 9 aa, Homo Sapiens
NAPPSPKPP

SEQ ID NO: 1297546 - protein, 9 aa, Homo Sapiens
SFYYKLHAA

SEQ ID NO: 1297547 - protein, 9 aa, Homo Sapiens
ETTLWLGPA

SEQ ID NO: 1297548 - protein, 9 aa, Homo Sapiens
IVHAEVGRP

SEQ ID NO: 1297549 - protein, 9 aa, Homo Sapiens
GCFLKKVIE

SEQ ID NO: 1297550 - protein, 9 aa, Homo Sapiens
SSSTSRDSR

SEQ ID NO: 1297551 - protein, 9 aa, Homo Sapiens
CCEPATCPA

SEQ ID NO: 1297552 - protein, 9 aa, Homo Sapiens
DAASTSLYV

SEQ ID NO: 1297553 - protein, 9 aa, Homo Sapiens
GMRTFRVLR

SEQ ID NO: 1297554 - protein, 9 aa, Homo Sapiens
QKDIDGKND

SEQ ID NO: 1297555 - protein, 9 aa, Homo Sapiens
YAKLGVWCL

SEQ ID NO: 1297556 - protein, 9 aa, Homo Sapiens
LLQLGQIPH

SEQ ID NO: 1297557 - protein, 9 aa, Homo Sapiens
IEAMAKLEK

SEQ ID NO: 1297558 - protein, 9 aa, Homo Sapiens
IPGKISWSI

SEQ ID NO: 1297559 - protein, 9 aa, Homo Sapiens
LREQEVSVS

SEQ ID NO: 1297560 - protein, 9 aa, Homo Sapiens
AARQTQKMR

SEQ ID NO: 1297561 - protein, 9 aa, Homo Sapiens
KQTNLTEAQ

SEQ ID NO: 1297562 - protein, 9 aa, Homo Sapiens
VRRSYFKRA

SEQ ID NO: 1297563 - protein, 9 aa, Homo Sapiens
ITPIILVAH

SEQ ID NO: 1297564 - protein, 9 aa, Homo Sapiens
SVLAVLGLG

SEQ ID NO: 1297565 - protein, 9 aa, Homo Sapiens
DILPWWAII

SEQ ID NO: 1297566 - protein, 9 aa, Homo Sapiens
PQLNDFFSH

SEQ ID NO: 1297567 - protein, 9 aa, Homo Sapiens
YGTEVQKQT

SEQ ID NO: 1297568 - protein, 9 aa, Homo Sapiens
IARCIDIQK

SEQ ID NO: 1297569 - protein, 9 aa, Homo Sapiens
SVKESTAES

SEQ ID NO: 1297570 - protein, 9 aa, Homo Sapiens
SPASIAPNL

SEQ ID NO: 1297571 - protein, 9 aa, Homo Sapiens
ELWVGSFLV

SEQ ID NO: 1297572 - protein, 9 aa, Homo Sapiens
EPDKDLFNP

SEQ ID NO: 1297573 - protein, 9 aa, Homo Sapiens
EYLSQRLHI

SEQ ID NO: 1297574 - protein, 9 aa, Homo Sapiens
ISWSIISAS

SEQ ID NO: 1297575 - protein, 9 aa, Homo Sapiens
LPTLTKSPH

SEQ ID NO: 1297576 - protein, 9 aa, Homo Sapiens
DSKVQVNKP

SEQ ID NO: 1297577 - protein, 9 aa, Homo Sapiens
REAWTATCA

SEQ ID NO: 1297578 - protein, 9 aa, Homo Sapiens
APSVSQGSQ

SEQ ID NO: 1297579 - protein, 9 aa, Homo Sapiens
HFWAQREME

SEQ ID NO: 1297580 - protein, 9 aa, Homo Sapiens
IAAARQTQK

SEQ ID NO: 1297581 - protein, 9 aa, Homo Sapiens
PGKISWSII

SEQ ID NO: 1297582 - protein, 9 aa, Homo Sapiens
TELWVGSFL

SEQ ID NO: 1297583 - protein, 9 aa, Homo Sapiens
ALNSAAGGS

SEQ ID NO: 1297584 - protein, 9 aa, Homo Sapiens
SKPHSLGFQ

SEQ ID NO: 1297585 - protein, 9 aa, Homo Sapiens
ILPWWAIIG

SEQ ID NO: 1297586 - protein, 9 aa, Homo Sapiens
SSGRTELWV

SEQ ID NO: 1297587 - protein, 9 aa, Homo Sapiens
MDVDMRRTR

SEQ ID NO: 1297588 - protein, 9 aa, Homo Sapiens
KLEYPCSES

SEQ ID NO: 1297589 - protein, 9 aa, Homo Sapiens
HDITPIILV

SEQ ID NO: 1297590 - protein, 9 aa, Homo Sapiens
WLHKRGKYI

SEQ ID NO: 1297591 - protein, 9 aa, Homo Sapiens
KVGWLGPRS

SEQ ID NO: 1297592 - protein, 9 aa, Homo Sapiens
QKQTAPSVK

SEQ ID NO: 1297593 - protein, 9 aa, Homo Sapiens
NPVRRSYFK

SEQ ID NO: 1297594 - protein, 9 aa, Homo Sapiens
GLTALNSAA

SEQ ID NO: 1297595 - protein, 9 aa, Homo Sapiens
GLLLTWENG

SEQ ID NO: 1297596 - protein, 9 aa, Homo Sapiens
IALKSKAKA

SEQ ID NO: 1297597 - protein, 9 aa, Homo Sapiens
PSKTAKQKE

SEQ ID NO: 1297598 - protein, 9 aa, Homo Sapiens
KGSKKKIWT

SEQ ID NO: 1297599 - protein, 9 aa, Homo Sapiens
VGSVKLEYP

SEQ ID NO: 1297600 - protein, 9 aa, Homo Sapiens
LSTRREAWT

SEQ ID NO: 1297601 - protein, 9 aa, Homo Sapiens
LGYLGDIAI

SEQ ID NO: 1297602 - protein, 9 aa, Homo Sapiens
KSNEVERTQ

SEQ ID NO: 1297603 - protein, 9 aa, Homo Sapiens
WTATCAYTW

SEQ ID NO: 1297604 - protein, 9 aa, Homo Sapiens
GSHHSSAAC

SEQ ID NO: 1297605 - protein, 9 aa, Homo Sapiens
IQKSNEVER

SEQ ID NO: 1297606 - protein, 9 aa, Homo Sapiens
GTRMDSKVQ

SEQ ID NO: 1297607 - protein, 9 aa, Homo Sapiens
TLPTLTKSP

SEQ ID NO: 1297608 - protein, 9 aa, Homo Sapiens
HSGSNSSHS

SEQ ID NO: 1297609 - protein, 9 aa, Homo Sapiens
QTNLTEAQE

SEQ ID NO: 1297610 - protein, 9 aa, Homo Sapiens
MGALRSVLA

SEQ ID NO: 1297611 - protein, 9 aa, Homo Sapiens
LLTWENGQV

SEQ ID NO: 1297612 - protein, 9 aa, Homo Sapiens
SVAKVSPSR

SEQ ID NO: 1297613 - protein, 9 aa, Homo Sapiens
MDSKVQVNK

SEQ ID NO: 1297614 - protein, 9 aa, Homo Sapiens
GPRSDQPLG

SEQ ID NO: 1297615 - protein, 9 aa, Homo Sapiens
VIAAARQTQ

SEQ ID NO: 1297616 - protein, 9 aa, Homo Sapiens
CVARSIPGK

SEQ ID NO: 1297617 - protein, 9 aa, Homo Sapiens
SKDMNTTIM

SEQ ID NO: 1297618 - protein, 9 aa, Homo Sapiens
GSVKLEYPC

SEQ ID NO: 1297619 - protein, 9 aa, Homo Sapiens
VSPASIAPN

SEQ ID NO: 1297620 - protein, 9 aa, Homo Sapiens
SQGSQEPRS

SEQ ID NO: 1297621 - protein, 9 aa, Homo Sapiens
GTEVQKQTA

SEQ ID NO: 1297622 - protein, 9 aa, Homo Sapiens
KSKAKAETL

SEQ ID NO: 1297623 - protein, 9 aa, Homo Sapiens
WSIISASTQ

SEQ ID NO: 1297624 - protein, 9 aa, Homo Sapiens
TTLPTLTKS

SEQ ID NO: 1297625 - protein, 9 aa, Homo Sapiens
PIILVAHCQ

SEQ ID NO: 1297626 - protein, 9 aa, Homo Sapiens
KKKIWTSST

SEQ ID NO: 1297627 - protein, 9 aa, Homo Sapiens
AFYNSSERI

SEQ ID NO: 1297628 - protein, 9 aa, Homo Sapiens
VGWLGPRSD

SEQ ID NO: 1297629 - protein, 9 aa, Homo Sapiens
VSKDMNTTI

SEQ ID NO: 1297630 - protein, 9 aa, Homo Sapiens
WKYGTEVQK

SEQ ID NO: 1297631 - protein, 9 aa, Homo Sapiens
KKIWTSSTR

SEQ ID NO: 1297632 - protein, 9 aa, Homo Sapiens
SGSHSGSNS

SEQ ID NO: 1297633 - protein, 9 aa, Homo Sapiens
KQTAPSVKE

SEQ ID NO: 1297634 - protein, 9 aa, Homo Sapiens
QEFLSSLEC

SEQ ID NO: 1297635 - protein, 9 aa, Homo Sapiens
GKISWSIIS

SEQ ID NO: 1297636 - protein, 9 aa, Homo Sapiens
DEEMLPVLR

SEQ ID NO: 1297637 - protein, 9 aa, Homo Sapiens
QSYLDFGIH

SEQ ID NO: 1297638 - protein, 9 aa, Homo Sapiens
KELEHQHQQ

SEQ ID NO: 1297639 - protein, 9 aa, Homo Sapiens
IPLVMVSKP

SEQ ID NO: 1297640 - protein, 9 aa, Homo Sapiens
SPKQTNLTE

SEQ ID NO: 1297641 - protein, 9 aa, Homo Sapiens
REQEVSVSP

SEQ ID NO: 1297642 - protein, 9 aa, Homo Sapiens
RRSYFKRAD

SEQ ID NO: 1297643 - protein, 9 aa, Homo Sapiens
QRLHIKEED

SEQ ID NO: 1297644 - protein, 9 aa, Homo Sapiens
RMDSKVQVN

SEQ ID NO: 1297645 - protein, 9 aa, Homo Sapiens
CFVNVLSGA

SEQ ID NO: 1297646 - protein, 9 aa, Homo Sapiens
TDTSTTLPT

SEQ ID NO: 1297647 - protein, 9 aa, Homo Sapiens
AMAKLEKMY

SEQ ID NO: 1297648 - protein, 9 aa, Homo Sapiens
TSPFTVMSV

SEQ ID NO: 1297649 - protein, 9 aa, Homo Sapiens
SGSNSSHSS

SEQ ID NO: 1297650 - protein, 9 aa, Homo Sapiens
DITPIILVA

SEQ ID NO: 1297651 - protein, 9 aa, Homo Sapiens
SQRLHIKEE

SEQ ID NO: 1297652 - protein, 9 aa, Homo Sapiens
AYTWGSHHS

SEQ ID NO: 1297653 - protein, 9 aa, Homo Sapiens
STRGGGRRR

SEQ ID NO: 1297654 - protein, 9 aa, Homo Sapiens
KWKYGTEVQ

SEQ ID NO: 1297655 - protein, 9 aa, Homo Sapiens
FYNSSERIA

SEQ ID NO: 1297656 - protein, 9 aa, Homo Sapiens
AKVSPSRPS

SEQ ID NO: 1297657 - protein, 9 aa, Homo Sapiens
CRGPEGDRS

SEQ ID NO: 1297658 - protein, 9 aa, Homo Sapiens
HEYLSQRLH

SEQ ID NO: 1297659 - protein, 9 aa, Homo Sapiens
LTEAQEVHS

SEQ ID NO: 1297660 - protein, 9 aa, Homo Sapiens
TSSGRTELW

SEQ ID NO: 1297661 - protein, 9 aa, Homo Sapiens
SASTQATSP

SEQ ID NO: 1297662 - protein, 9 aa, Homo Sapiens
TSSTRGGGR

SEQ ID NO: 1297663 - protein, 9 aa, Homo Sapiens
PRSDQPLGA

SEQ ID NO: 1297664 - protein, 9 aa, Homo Sapiens
YLREQEVSV

SEQ ID NO: 1297665 - protein, 9 aa, Homo Sapiens
KAAHIEAMA

SEQ ID NO: 1297666 - protein, 9 aa, Homo Sapiens
RGKYIKTWR

SEQ ID NO: 1297667 - protein, 9 aa, Homo Sapiens
IQTVSKDMN

SEQ ID NO: 1297668 - protein, 9 aa, Homo Sapiens
WSQPAFYNS

SEQ ID NO: 1297669 - protein, 9 aa, Homo Sapiens
KKGSKKKIW

SEQ ID NO: 1297670 - protein, 9 aa, Homo Sapiens
LLLTWENGQ

SEQ ID NO: 1297671 - protein, 9 aa, Homo Sapiens
PDKDLFNPD

SEQ ID NO: 1297672 - protein, 9 aa, Homo Sapiens
IIQTVSKDM

SEQ ID NO: 1297673 - protein, 9 aa, Homo Sapiens
PAFYNSSER

SEQ ID NO: 1297674 - protein, 9 aa, Homo Sapiens
WENGQVLGD

SEQ ID NO: 1297675 - protein, 9 aa, Homo Sapiens
HEMGALRSV

SEQ ID NO: 1297676 - protein, 9 aa, Homo Sapiens
ATSPFTVMS

SEQ ID NO: 1297677 - protein, 9 aa, Homo Sapiens
PSVKESTAE

SEQ ID NO: 1297678 - protein, 9 aa, Homo Sapiens
LTALNSAAG

SEQ ID NO: 1297679 - protein, 9 aa, Homo Sapiens
VSQGSQEPR

SEQ ID NO: 1297680 - protein, 9 aa, Homo Sapiens
TQKMRKFYF

SEQ ID NO: 1297681 - protein, 9 aa, Homo Sapiens
LVAHCQEYE

SEQ ID NO: 1297682 - protein, 9 aa, Homo Sapiens
VLAVLGLGG

SEQ ID NO: 1297683 - protein, 9 aa, Homo Sapiens
SLECFVNVL

SEQ ID NO: 1297684 - protein, 9 aa, Homo Sapiens
SAACVARSI

SEQ ID NO: 1297685 - protein, 9 aa, Homo Sapiens
QEVSVSPAS

SEQ ID NO: 1297686 - protein, 9 aa, Homo Sapiens
SKTAKQKEL

SEQ ID NO: 1297687 - protein, 9 aa, Homo Sapiens
LSQRLHIKE

SEQ ID NO: 1297688 - protein, 9 aa, Homo Sapiens
SWSIISAST

SEQ ID NO: 1297689 - protein, 9 aa, Homo Sapiens
RKTKWKYGT

SEQ ID NO: 1297690 - protein, 9 aa, Homo Sapiens
PVRRSYFKR

SEQ ID NO: 1297691 - protein, 9 aa, Homo Sapiens
FTEPDKDLF

SEQ ID NO: 1297692 - protein, 9 aa, Homo Sapiens
FFSHFWAQR

SEQ ID NO: 1297693 - protein, 9 aa, Homo Sapiens
ALRSVLAVL

SEQ ID NO: 1297694 - protein, 9 aa, Homo Sapiens
KTKWKYGTE

SEQ ID NO: 1297695 - protein, 9 aa, Homo Sapiens
NSSERIASR

SEQ ID NO: 1297696 - protein, 9 aa, Homo Sapiens
GLGYLGDIA

SEQ ID NO: 1297697 - protein, 9 aa, Homo Sapiens
KDMNTTIME

SEQ ID NO: 1297698 - protein, 9 aa, Homo Sapiens
KDLFNPDYV

SEQ ID NO: 1297699 - protein, 9 aa, Homo Sapiens
AAARQTQKM

SEQ ID NO: 1297700 - protein, 9 aa, Homo Sapiens
CKELEHQHQ

SEQ ID NO: 1297701 - protein, 9 aa, Homo Sapiens
GVRGLGYLG

SEQ ID NO: 1297702 - protein, 9 aa, Homo Sapiens
IIFEGVRGL

SEQ ID NO: 1297703 - protein, 9 aa, Homo Sapiens
SMDVDMRRT

SEQ ID NO: 1297704 - protein, 9 aa, Homo Sapiens
DRSRDDPGP

SEQ ID NO: 1297705 - protein, 9 aa, Homo Sapiens
SNSSHSSSS

SEQ ID NO: 1297706 - protein, 9 aa, Homo Sapiens
TRMDSKVQV

SEQ ID NO: 1297707 - protein, 9 aa, Homo Sapiens
ELKAAHIEA

SEQ ID NO: 1297708 - protein, 9 aa, Homo Sapiens
RSRDDPGPR

SEQ ID NO: 1297709 - protein, 9 aa, Homo Sapiens
SLRLSCKEL

SEQ ID NO: 1297710 - protein, 9 aa, Homo Sapiens
GALRSVLAV

SEQ ID NO: 1297711 - protein, 9 aa, Homo Sapiens
IWTSSTRGG

SEQ ID NO: 1297712 - protein, 9 aa, Homo Sapiens
KAPSVSQGS

SEQ ID NO: 1297713 - protein, 9 aa, Homo Sapiens
EGVRGLGYL

SEQ ID NO: 1297714 - protein, 9 aa, Homo Sapiens
CVGSVKLEY

SEQ ID NO: 1297715 - protein, 9 aa, Homo Sapiens
LEYPCSESH

SEQ ID NO: 1297716 - protein, 9 aa, Homo Sapiens
RSDQPLGAQ

SEQ ID NO: 1297717 - protein, 9 aa, Homo Sapiens
AEGLTALNS

SEQ ID NO: 1297718 - protein, 9 aa, Homo Sapiens
SQPAFYNSS

SEQ ID NO: 1297719 - protein, 9 aa, Homo Sapiens
KIWTSSTRG

SEQ ID NO: 1297720 - protein, 9 aa, Homo Sapiens
GGRRRKTKW

SEQ ID NO: 1297721 - protein, 9 aa, Homo Sapiens
PLVMVSKPH

SEQ ID NO: 1297722 - protein, 9 aa, Homo Sapiens
RLSCKELEH

SEQ ID NO: 1297723 - protein, 9 aa, Homo Sapiens
WTSSTRGGG

SEQ ID NO: 1297724 - protein, 9 aa, Homo Sapiens
ECEEDNPVR

SEQ ID NO: 1297725 - protein, 9 aa, Homo Sapiens
TKWKYGTEV

SEQ ID NO: 1297726 - protein, 9 aa, Homo Sapiens
ESTAESRIS

SEQ ID NO: 1297727 - protein, 9 aa, Homo Sapiens
EMLPVLRPH

SEQ ID NO: 1297728 - protein, 9 aa, Homo Sapiens
KHIFTEPDK

SEQ ID NO: 1297729 - protein, 9 aa, Homo Sapiens
SGTDTSTTL

SEQ ID NO: 1297730 - protein, 9 aa, Homo Sapiens
VARSIPGKI

SEQ ID NO: 1297731 - protein, 9 aa, Homo Sapiens
IDIQKSNEV

SEQ ID NO: 1297732 - protein, 9 aa, Homo Sapiens
AWTATCAYT

SEQ ID NO: 1297733 - protein, 9 aa, Homo Sapiens
RREAWTATC

SEQ ID NO: 1297734 - protein, 9 aa, Homo Sapiens
LRSVLAVLG

SEQ ID NO: 1297735 - protein, 9 aa, Homo Sapiens
WLGPRSDQP

SEQ ID NO: 1297736 - protein, 9 aa, Homo Sapiens
WWAIIGWLL

SEQ ID NO: 1297737 - protein, 9 aa, Homo Sapiens
LNDFFSHFW

SEQ ID NO: 1297738 - protein, 9 aa, Homo Sapiens
GPEGDRSRD

SEQ ID NO: 1297739 - protein, 9 aa, Homo Sapiens
TWGSHHSSA

SEQ ID NO: 1297740 - protein, 9 aa, Homo Sapiens
QLGRGGPDW

SEQ ID NO: 1297741 - protein, 9 aa, Homo Sapiens
SHSGSNSSH

SEQ ID NO: 1297742 - protein, 9 aa, Homo Sapiens
KSKAPSVSQ

SEQ ID NO: 1297743 - protein, 9 aa, Homo Sapiens
LDRLLHWAV

SEQ ID NO: 1297744 - protein, 9 aa, Homo Sapiens
QTAPSVKES

SEQ ID NO: 1297745 - protein, 9 aa, Homo Sapiens
SCKELEHQH

SEQ ID NO: 1297746 - protein, 9 aa, Homo Sapiens
QGSQEPRSG

SEQ ID NO: 1297747 - protein, 9 aa, Homo Sapiens
NSAAGGSHP

SEQ ID NO: 1297748 - protein, 9 aa, Homo Sapiens
DEDEEMLPV

SEQ ID NO: 1297749 - protein, 9 aa, Homo Sapiens
DFGIHSGAT

SEQ ID NO: 1297750 - protein, 9 aa, Homo Sapiens
ILVAHCQEY

SEQ ID NO: 1297751 - protein, 9 aa, Homo Sapiens
RGPEGDRSR

SEQ ID NO: 1297752 - protein, 9 aa, Homo Sapiens
ISASTQATS

SEQ ID NO: 1297753 - protein, 9 aa, Homo Sapiens
FLSSLECFV

SEQ ID NO: 1297754 - protein, 9 aa, Homo Sapiens
WGSHHSSAA

SEQ ID NO: 1297755 - protein, 9 aa, Homo Sapiens
LKAAHIEAM

SEQ ID NO: 1297756 - protein, 9 aa, Homo Sapiens
EQEVSVSPA

SEQ ID NO: 1297757 - protein, 9 aa, Homo Sapiens
HIEAMAKLE

SEQ ID NO: 1297758 - protein, 9 aa, Homo Sapiens
CEEDNPVRR

SEQ ID NO: 1297759 - protein, 9 aa, Homo Sapiens
SICLPVLDR

SEQ ID NO: 1297760 - protein, 9 aa, Homo Sapiens
GGGRRRKTK

SEQ ID NO: 1297761 - protein, 9 aa, Homo Sapiens
LKSKAKAET

SEQ ID NO: 1297762 - protein, 9 aa, Homo Sapiens
HSSAACVAR

SEQ ID NO: 1297763 - protein, 9 aa, Homo Sapiens
EDEEMLPVL

SEQ ID NO: 1297764 - protein, 9 aa, Homo Sapiens
EDEDEEMLP

SEQ ID NO: 1297765 - protein, 9 aa, Homo Sapiens
IILVAHCQE

SEQ ID NO: 1297766 - protein, 9 aa, Homo Sapiens
AACVARSIP

SEQ ID NO: 1297767 - protein, 9 aa, Homo Sapiens
LRLSCKELE

SEQ ID NO: 1297768 - protein, 9 aa, Homo Sapiens
DFFSHFWAQ

SEQ ID NO: 1297769 - protein, 9 aa, Homo Sapiens
KESTAESRI

SEQ ID NO: 1297770 - protein, 9 aa, Homo Sapiens
ISLRLSCKE

SEQ ID NO: 1297771 - protein, 9 aa, Homo Sapiens
ACVARSIPG

SEQ ID NO: 1297772 - protein, 9 aa, Homo Sapiens
WVGSFLVTQ

SEQ ID NO: 1297773 - protein, 9 aa, Homo Sapiens
AKAETLYQT

SEQ ID NO: 1297774 - protein, 9 aa, Homo Sapiens
SQLGRGGPD

SEQ ID NO: 1297775 - protein, 9 aa, Homo Sapiens
SHHSSAACV

SEQ ID NO: 1297776 - protein, 9 aa, Homo Sapiens
APSVKESTA

SEQ ID NO: 1297777 - protein, 9 aa, Homo Sapiens
SSLECFVNV

SEQ ID NO: 1297778 - protein, 9 aa, Homo Sapiens
YLDFGIHSG

SEQ ID NO: 1297779 - protein, 9 aa, Homo Sapiens
TNLTEAQEV

SEQ ID NO: 1297780 - protein, 9 aa, Homo Sapiens
SVKLEYPCS

SEQ ID NO: 1297781 - protein, 9 aa, Homo Sapiens
PWWAIIGWL

SEQ ID NO: 1297782 - protein, 9 aa, Homo Sapiens
ASIAPNLST

SEQ ID NO: 1297783 - protein, 9 aa, Homo Sapiens
ICLPVLDRL

SEQ ID NO: 1297784 - protein, 9 aa, Homo Sapiens
RRKTKWKYG

SEQ ID NO: 1297785 - protein, 9 aa, Homo Sapiens
KAKAETLYQ

SEQ ID NO: 1297786 - protein, 9 aa, Homo Sapiens
PNLSTRREA

SEQ ID NO: 1297787 - protein, 9 aa, Homo Sapiens
EDNPVRRSY

SEQ ID NO: 1297788 - protein, 9 aa, Homo Sapiens
GDRSRDDPG

SEQ ID NO: 1297789 - protein, 9 aa, Homo Sapiens
DWKKTGQRG

SEQ ID NO: 1297790 - protein, 9 aa, Homo Sapiens
STQATSPFT

SEQ ID NO: 1297791 - protein, 9 aa, Homo Sapiens
EGLTALNSA

SEQ ID NO: 1297792 - protein, 9 aa, Homo Sapiens
LSAGPIPGK

SEQ ID NO: 1297793 - protein, 9 aa, Homo Sapiens
PVLDRLLHW

SEQ ID NO: 1297794 - protein, 9 aa, Homo Sapiens
TRREAWTAT

SEQ ID NO: 1297795 - protein, 9 aa, Homo Sapiens
LCRGPEGDR

SEQ ID NO: 1297796 - protein, 9 aa, Homo Sapiens
SVSPASIAP

SEQ ID NO: 1297797 - protein, 9 aa, Homo Sapiens
ALKSKAKAE

SEQ ID NO: 1297798 - protein, 9 aa, Homo Sapiens
RGLGYLGDI

SEQ ID NO: 1297799 - protein, 9 aa, Homo Sapiens
TRGGGRRRK

SEQ ID NO: 1297800 - protein, 9 aa, Homo Sapiens
WQQQSYLDF

SEQ ID NO: 1297801 - protein, 9 aa, Homo Sapiens
EAQEVHSTG

SEQ ID NO: 1297802 - protein, 9 aa, Homo Sapiens
LHKRGKYIK

SEQ ID NO: 1297803 - protein, 9 aa, Homo Sapiens
TWENGQVLG

SEQ ID NO: 1297804 - protein, 9 aa, Homo Sapiens
ECFVNVLSG

SEQ ID NO: 1297805 - protein, 9 aa, Homo Sapiens
IAPNLSTRR

SEQ ID NO: 1297806 - protein, 9 aa, Homo Sapiens
GGPDWKKTG

SEQ ID NO: 1297807 - protein, 9 aa, Homo Sapiens
HHSSAACVA

SEQ ID NO: 1297808 - protein, 9 aa, Homo Sapiens
RTELWVGSF

SEQ ID NO: 1297809 - protein, 9 aa, Homo Sapiens
VLDRLLHWA

SEQ ID NO: 1297810 - protein, 9 aa, Homo Sapiens
VSKPHSLGF

SEQ ID NO: 1297811 - protein, 9 aa, Homo Sapiens
DRLLHWAVC

SEQ ID NO: 1297812 - protein, 9 aa, Homo Sapiens
NGQVLGDQT

SEQ ID NO: 1297813 - protein, 9 aa, Homo Sapiens
QPAFYNSSE

SEQ ID NO: 1297814 - protein, 9 aa, Homo Sapiens
PDWKKTGQR

SEQ ID NO: 1297815 - protein, 9 aa, Homo Sapiens
QQSYLDFGI

SEQ ID NO: 1297816 - protein, 9 aa, Homo Sapiens
NLSTRREAW

SEQ ID NO: 1297817 - protein, 9 aa, Homo Sapiens
STRREAWTA

SEQ ID NO: 1297818 - protein, 9 aa, Homo Sapiens
YPCSESHSL

SEQ ID NO: 1297819 - protein, 9 aa, Homo Sapiens
DMRRTRCGT

SEQ ID NO: 1297820 - protein, 9 aa, Homo Sapiens
ENGQVLGDQ

SEQ ID NO: 1297821 - protein, 9 aa, Homo Sapiens
LGPRSDQPL

SEQ ID NO: 1297822 - protein, 9 aa, Homo Sapiens
PASIAPNLS

SEQ ID NO: 1297823 - protein, 9 aa, Homo Sapiens
EFLSSLECF

SEQ ID NO: 1297824 - protein, 9 aa, Homo Sapiens
MVSKPHSLG

SEQ ID NO: 1297825 - protein, 9 aa, Homo Sapiens
EYPCSESHS

SEQ ID NO: 1297826 - protein, 9 aa, Homo Sapiens
QQQSYLDFG

SEQ ID NO: 1297827 - protein, 9 aa, Homo Sapiens
TCAYTWGSH

SEQ ID NO: 1297828 - protein, 9 aa, Homo Sapiens
RSIPGKISW

SEQ ID NO: 1297829 - protein, 9 aa, Homo Sapiens
PFTVMSVAK

SEQ ID NO: 1297830 - protein, 9 aa, Homo Sapiens
VQKQTAPSV

SEQ ID NO: 1297831 - protein, 9 aa, Homo Sapiens
YYEDEDEEM

SEQ ID NO: 1297832 - protein, 9 aa, Homo Sapiens
GSGTRMDSK

SEQ ID NO: 1297833 - protein, 9 aa, Homo Sapiens
SKAPSVSQG

SEQ ID NO: 1297834 - protein, 9 aa, Homo Sapiens
DVDMRRTRC

SEQ ID NO: 1297835 - protein, 9 aa, Homo Sapiens
SDILPWWAI

SEQ ID NO: 1297836 - protein, 9 aa, Homo Sapiens
YTWGSHHSS

SEQ ID NO: 1297837 - protein, 9 aa, Homo Sapiens
GWLGPRSDQ

SEQ ID NO: 1297838 - protein, 9 aa, Homo Sapiens
GKYIKTWRP

SEQ ID NO: 1297839 - protein, 9 aa, Homo Sapiens
PKQTNLTEA

SEQ ID NO: 1297840 - protein, 9 aa, Homo Sapiens
GWLHKRGKY

SEQ ID NO: 1297841 - protein, 9 aa, Homo Sapiens
GRGGPDWKK

SEQ ID NO: 1297842 - protein, 9 aa, Homo Sapiens
SKKKIWTSS

SEQ ID NO: 1297843 - protein, 9 aa, Homo Sapiens
PEGDRSRDD

SEQ ID NO: 1297844 - protein, 9 aa, Homo Sapiens
EVSVSPASI

SEQ ID NO: 1297845 - protein, 9 aa, Homo Sapiens
MLPVLRPHS

SEQ ID NO: 1297846 - protein, 9 aa, Homo Sapiens
VAHCQEYEI

SEQ ID NO: 1297847 - protein, 9 aa, Homo Sapiens
GRRRKTKWK

SEQ ID NO: 1297848 - protein, 9 aa, Homo Sapiens
IFTEPDKDL

SEQ ID NO: 1297849 - protein, 9 aa, Homo Sapiens
VDMRRTRCG

SEQ ID NO: 1297850 - protein, 9 aa, Homo Sapiens
LNSAAGGSH

SEQ ID NO: 1297851 - protein, 9 aa, Homo Sapiens
SGTRMDSKV

SEQ ID NO: 1297852 - protein, 9 aa, Homo Sapiens
IISASTQAT

SEQ ID NO: 1297853 - protein, 9 aa, Homo Sapiens
RGGPDWKKT

SEQ ID NO: 1297854 - protein, 9 aa, Homo Sapiens
HKRGKYIKT

SEQ ID NO: 1297855 - protein, 9 aa, Homo Sapiens
NSSHSSSSS

SEQ ID NO: 1297856 - protein, 9 aa, Homo Sapiens
NDFFSHFWA

SEQ ID NO: 1297857 - protein, 9 aa, Homo Sapiens
GSNSSHSSS

SEQ ID NO: 1297858 - protein, 9 aa, Homo Sapiens
DNPVRRSYF

SEQ ID NO: 1297859 - protein, 9 aa, Homo Sapiens
FGIHSGATT

SEQ ID NO: 1297860 - protein, 9 aa, Homo Sapiens
ARSIPGKIS

SEQ ID NO: 1297861 - protein, 9 aa, Homo Sapiens
STTLPTLTK

SEQ ID NO: 1297862 - protein, 9 aa, Homo Sapiens
VKLEYPCSE

SEQ ID NO: 1297863 - protein, 9 aa, Homo Sapiens
TQATSPFTV

SEQ ID NO: 1297864 - protein, 9 aa, Homo Sapiens
LPVLDRLLH

SEQ ID NO: 1297865 - protein, 9 aa, Homo Sapiens
SGRTELWVG

SEQ ID NO: 1297866 - protein, 9 aa, Homo Sapiens
LPWWAIIGW

SEQ ID NO: 1297867 - protein, 9 aa, Homo Sapiens
VKESTAESR

SEQ ID NO: 1297868 - protein, 9 aa, Homo Sapiens
LSCKELEHQ

SEQ ID NO: 1297869 - protein, 9 aa, Homo Sapiens
KRGKYIKTW

SEQ ID NO: 1297870 - protein, 9 aa, Homo Sapiens
ASTQATSPF

SEQ ID NO: 1297871 - protein, 9 aa, Homo Sapiens
ARQTQKMRK

SEQ ID NO: 1297872 - protein, 9 aa, Homo Sapiens
QLNDFFSHF

SEQ ID NO: 1297873 - protein, 9 aa, Homo Sapiens
MSVAKVSPS

SEQ ID NO: 1297874 - protein, 9 aa, Homo Sapiens
LECFVNVLS

SEQ ID NO: 1297875 - protein, 9 aa, Homo Sapiens
RCIDIQKSN

SEQ ID NO: 1297876 - protein, 9 aa, Homo Sapiens
TEVQKQTAP

SEQ ID NO: 1297877 - protein, 9 aa, Homo Sapiens
DKDLFNPDY

SEQ ID NO: 1297878 - protein, 9 aa, Homo Sapiens
KYIKTWRPR

SEQ ID NO: 1297879 - protein, 9 aa, Homo Sapiens
ARCIDIQKS

SEQ ID NO: 1297880 - protein, 9 aa, Homo Sapiens
LGRGGPDWK

SEQ ID NO: 1297881 - protein, 9 aa, Homo Sapiens
TALNSAAGG

SEQ ID NO: 1297882 - protein, 9 aa, Homo Sapiens
VRGLGYLGD

SEQ ID NO: 1297883 - protein, 9 aa, Homo Sapiens
NSGSHSGSN

SEQ ID NO: 1297884 - protein, 9 aa, Homo Sapiens
DTSTTLPTL

SEQ ID NO: 1297885 - protein, 9 aa, Homo Sapiens
EEDNPVRRS

SEQ ID NO: 1297886 - protein, 9 aa, Homo Sapiens
FEGVRGLGY

SEQ ID NO: 1297887 - protein, 9 aa, Homo Sapiens
GSKKKIWTS

SEQ ID NO: 1297888 - protein, 9 aa, Homo Sapiens
TAPSVKEST

SEQ ID NO: 1297889 - protein, 9 aa, Homo Sapiens
EMGALRSVL

SEQ ID NO: 1297890 - protein, 9 aa, Homo Sapiens
SVSQGSQEP

SEQ ID NO: 1297891 - protein, 9 aa, Homo Sapiens
WVIAAARQT

SEQ ID NO: 1297892 - protein, 9 aa, Homo Sapiens
EVQKQTAPS

SEQ ID NO: 1297893 - protein, 9 aa, Homo Sapiens
PSVSQGSQE

SEQ ID NO: 1297894 - protein, 9 aa, Homo Sapiens
SKVQVNKPG

SEQ ID NO: 1297895 - protein, 9 aa, Homo Sapiens
AASMDVDMR

SEQ ID NO: 1297896 - protein, 9 aa, Homo Sapiens
GPDWKKTGQ

SEQ ID NO: 1297897 - protein, 9 aa, Homo Sapiens
CIDIQKSNE

SEQ ID NO: 1297898 - protein, 9 aa, Homo Sapiens
QKSNEVERT

SEQ ID NO: 1297899 - protein, 9 aa, Homo Sapiens
LIPLVMVSK

SEQ ID NO: 1297900 - protein, 9 aa, Homo Sapiens
RRRKTKWKY

SEQ ID NO: 1297901 - protein, 9 aa, Homo Sapiens
AAHIEAMAK

SEQ ID NO: 1297902 - protein, 9 aa, Homo Sapiens
IFEGVRGLG

SEQ ID NO: 1297903 - protein, 9 aa, Homo Sapiens
GSHSGSNSS

SEQ ID NO: 1297904 - protein, 9 aa, Homo Sapiens
FTVMSVAKV

SEQ ID NO: 1297905 - protein, 9 aa, Homo Sapiens
EGWLHKRGK

SEQ ID NO: 1297906 - protein, 9 aa, Homo Sapiens
LWVGSFLVT

SEQ ID NO: 1297907 - protein, 9 aa, Homo Sapiens
VLSSDILPW

SEQ ID NO: 1297908 - protein, 9 aa, Homo Sapiens
SIAPNLSTR

SEQ ID NO: 1297909 - protein, 9 aa, Homo Sapiens
VGLLLTWEN

SEQ ID NO: 1297910 - protein, 9 aa, Homo Sapiens
TATCAYTWG

SEQ ID NO: 1297911 - protein, 9 aa, Homo Sapiens
PAASMDVDM

SEQ ID NO: 1297912 - protein, 9 aa, Homo Sapiens
EGDRSRDDP

SEQ ID NO: 1297913 - protein, 9 aa, Homo Sapiens
YISLRLSCK

SEQ ID NO: 1297914 - protein, 9 aa, Homo Sapiens
SIPGKISWS

SEQ ID NO: 1297915 - protein, 9 aa, Homo Sapiens
VMSVAKVSP

SEQ ID NO: 1297916 - protein, 9 aa, Homo Sapiens
QTVSKDMNT

SEQ ID NO: 1297917 - protein, 9 aa, Homo Sapiens
QATSPFTVM

SEQ ID NO: 1297918 - protein, 9 aa, Homo Sapiens
KVQVNKPGE

SEQ ID NO: 1297919 - protein, 9 aa, Homo Sapiens
SYLDFGIHS

SEQ ID NO: 1297920 - protein, 9 aa, Homo Sapiens
LDFGIHSGA

SEQ ID NO: 1297921 - protein, 9 aa, Homo Sapiens
QTQKMRKFY

SEQ ID NO: 1297922 - protein, 9 aa, Homo Sapiens
FSHFWAQRE

SEQ ID NO: 1297923 - protein, 9 aa, Homo Sapiens
YLSQRLHIK

SEQ ID NO: 1297924 - protein, 9 aa, Homo Sapiens
NLTEAQEVH

SEQ ID NO: 1297925 - protein, 9 aa, Homo Sapiens
SHFWAQREM

SEQ ID NO: 1297926 - protein, 9 aa, Homo Sapiens
KAETLYQTK

SEQ ID NO: 1297927 - protein, 9 aa, Homo Sapiens
LVMVSKPHS

SEQ ID NO: 1297928 - protein, 9 aa, Homo Sapiens
CLPVLDRLL

SEQ ID NO: 1297929 - protein, 9 aa, Homo Sapiens
SSAACVARS

SEQ ID NO: 1297930 - protein, 9 aa, Homo Sapiens
SKAKAETLY

SEQ ID NO: 1297931 - protein, 9 aa, Homo Sapiens
SKKGSKKKI

SEQ ID NO: 1297932 - protein, 9 aa, Homo Sapiens
SSDILPWWA

SEQ ID NO: 1297933 - protein, 9 aa, Homo Sapiens
ATCAYTWGS

SEQ ID NO: 1297934 - protein, 9 aa, Homo Sapiens
KYGTEVQKQ

SEQ ID NO: 1297935 - protein, 9 aa, Homo Sapiens
EIALKSKAK

SEQ ID NO: 1297936 - protein, 9 aa, Homo Sapiens
VAKVSPSRP

SEQ ID NO: 1297937 - protein, 9 aa, Homo Sapiens
LSSLECFVN

SEQ ID NO: 1297938 - protein, 9 aa, Homo Sapiens
SPFTVMSVA

SEQ ID NO: 1297939 - protein, 9 aa, Homo Sapiens
RSVLAVLGL

SEQ ID NO: 1297940 - protein, 9 aa, Homo Sapiens
TEPDKDLFN

SEQ ID NO: 1297941 - protein, 9 aa, Homo Sapiens
VMVSKPHSL

SEQ ID NO: 1297942 - protein, 9 aa, Homo Sapiens
HIFTEPDKD

SEQ ID NO: 1297943 - protein, 9 aa, Homo Sapiens
LTWENGQVL

SEQ ID NO: 1297944 - protein, 9 aa, Homo Sapiens
EEMLPVLRP

SEQ ID NO: 1297945 - protein, 9 aa, Homo Sapiens
EAMAKLEKM

SEQ ID NO: 1297946 - protein, 9 aa, Homo Sapiens
TEAQEVHST

SEQ ID NO: 1297947 - protein, 9 aa, Homo Sapiens
FPAASMDVD

SEQ ID NO: 1297948 - protein, 9 aa, Homo Sapiens
YNSSERIAS

SEQ ID NO: 1297949 - protein, 9 aa, Homo Sapiens
TPIILVAHC

SEQ ID NO: 1297950 - protein, 9 aa, Homo Sapiens
VSVSPASIA

SEQ ID NO: 1297951 - protein, 9 aa, Homo Sapiens
TVMSVAKVS

SEQ ID NO: 1297952 - protein, 9 aa, Homo Sapiens
CAYTWGSHH

SEQ ID NO: 1297953 - protein, 9 aa, Homo Sapiens
RLHIKEEDM

SEQ ID NO: 1297954 - protein, 9 aa, Homo Sapiens
RLLHWAVCP

SEQ ID NO: 1297955 - protein, 9 aa, Homo Sapiens
MNTTIMELL

SEQ ID NO: 1297956 - protein, 9 aa, Homo Sapiens
GKVGWLGPR

SEQ ID NO: 1297957 - protein, 9 aa, Homo Sapiens
KPHSLGFQA

SEQ ID NO: 1297958 - protein, 9 aa, Homo Sapiens
NAEGLTALN

SEQ ID NO: 1297959 - protein, 9 aa, Homo Sapiens
AHIEAMAKL

SEQ ID NO: 1297960 - protein, 9 aa, Homo Sapiens
DMNTTIMEL

SEQ ID NO: 1297961 - protein, 9 aa, Homo Sapiens
LSSDILPWW

SEQ ID NO: 1297962 - protein, 9 aa, Homo Sapiens
APNLSTRRE

SEQ ID NO: 1297963 - protein, 9 aa, Homo Sapiens
ASMDVDMRR

SEQ ID NO: 1297964 - protein, 9 aa, Homo Sapiens
RQTQKMRKF

SEQ ID NO: 1297965 - protein, 9 aa, Homo Sapiens
PWSQPAFYN

SEQ ID NO: 1297966 - protein, 9 aa, Homo Sapiens
YEDEDEEML

SEQ ID NO: 1297967 - protein, 9 aa, Homo Sapiens
SIISASTQA

SEQ ID NO: 1297968 - protein, 9 aa, Homo Sapiens
HIKEEDMRL

SEQ ID NO: 1297969 - protein, 9 aa, Homo Sapiens
SSTRGGGRR

SEQ ID NO: 1297970 - protein, 9 aa, Homo Sapiens
GRTELWVGS

SEQ ID NO: 1297971 - protein, 9 aa, Homo Sapiens
EAWTATCAY

SEQ ID NO: 1297972 - protein, 9 aa, Homo Sapiens
TVSKDMNTT

SEQ ID NO: 1297973 - protein, 9 aa, Homo Sapiens
GTDTSTTLP

SEQ ID NO: 1297974 - protein, 9 aa, Homo Sapiens
LHIKEEDMR

SEQ ID NO: 1297975 - protein, 9 aa, Homo Sapiens
KISWSIISA

SEQ ID NO: 1297976 - protein, 9 aa, Homo Sapiens
RGGGRRRKT

SEQ ID NO: 1297977 - protein, 9 aa, Homo Sapiens
DIQKSNEVE

SEQ ID NO: 1297978 - protein, 9 aa, Homo Sapiens
LVSVGLDYF

SEQ ID NO: 1297979 - protein, 9 aa, Homo Sapiens
QAKHMKKYP

SEQ ID NO: 1297980 - protein, 9 aa, Homo Sapiens
GHESYLWSS

SEQ ID NO: 1297981 - protein, 9 aa, Homo Sapiens
CKEAINVLS

SEQ ID NO: 1297982 - protein, 9 aa, Homo Sapiens
RTTLPEQPL

SEQ ID NO: 1297983 - protein, 9 aa, Homo Sapiens
ASRRAIQRL

SEQ ID NO: 1297984 - protein, 9 aa, Homo Sapiens
ESPNTTSPE

SEQ ID NO: 1297985 - protein, 9 aa, Homo Sapiens
ESPSGALTI

SEQ ID NO: 1297986 - protein, 9 aa, Homo Sapiens
SLAVVGSVA

SEQ ID NO: 1297987 - protein, 9 aa, Homo Sapiens
DVVDSKRCS

SEQ ID NO: 1297988 - protein, 9 aa, Homo Sapiens
RQLAKTCPV

SEQ ID NO: 1297989 - protein, 9 aa, Homo Sapiens
RRYGKCEYQ

SEQ ID NO: 1297990 - protein, 9 aa, Homo Sapiens
QRLVGSATL

SEQ ID NO: 1297991 - protein, 9 aa, Homo Sapiens
GQTRCRPSR

SEQ ID NO: 1297992 - protein, 9 aa, Homo Sapiens
LEIPCGIAA

SEQ ID NO: 1297993 - protein, 9 aa, Homo Sapiens
RIEKQAKHM

SEQ ID NO: 1297994 - protein, 9 aa, Homo Sapiens
SKPGNPRHL

SEQ ID NO: 1297995 - protein, 9 aa, Homo Sapiens
VQLYRQRSK

SEQ ID NO: 1297996 - protein, 9 aa, Homo Sapiens
AVEAQLRDK

SEQ ID NO: 1297997 - protein, 9 aa, Homo Sapiens
YGKCEYQNL

SEQ ID NO: 1297998 - protein, 9 aa, Homo Sapiens
EKYNVPLYR

SEQ ID NO: 1297999 - protein, 9 aa, Homo Sapiens
GSYTINFQG

SEQ ID NO: 1298000 - protein, 9 aa, Homo Sapiens
IVVVGIFSA

SEQ ID NO: 1298001 - protein, 9 aa, Homo Sapiens
KTRDQYFDV

SEQ ID NO: 1298002 - protein, 9 aa, Homo Sapiens
TKHITGLTI

SEQ ID NO: 1298003 - protein, 9 aa, Homo Sapiens
AKHMKKYPK

SEQ ID NO: 1298004 - protein, 9 aa, Homo Sapiens
FDVVDSKRC

SEQ ID NO: 1298005 - protein, 9 aa, Homo Sapiens
SVGLDYFHS

SEQ ID NO: 1298006 - protein, 9 aa, Homo Sapiens
TSQALNEVN

SEQ ID NO: 1298007 - protein, 9 aa, Homo Sapiens
KYNVPLYRL

SEQ ID NO: 1298008 - protein, 9 aa, Homo Sapiens
EITTQKSRL

SEQ ID NO: 1298009 - protein, 9 aa, Homo Sapiens
PAEHETRLW

SEQ ID NO: 1298010 - protein, 9 aa, Homo Sapiens
QNEMNDSQV

SEQ ID NO: 1298011 - protein, 9 aa, Homo Sapiens
TLHNTTPNF

SEQ ID NO: 1298012 - protein, 9 aa, Homo Sapiens
EDLEFAVSQ

SEQ ID NO: 1298013 - protein, 9 aa, Homo Sapiens
KQAKHMKKY

SEQ ID NO: 1298014 - protein, 9 aa, Homo Sapiens
LYRQRSKLY

SEQ ID NO: 1298015 - protein, 9 aa, Homo Sapiens
RSKLYGSIF

SEQ ID NO: 1298016 - protein, 9 aa, Homo Sapiens
HESYLWSSP

SEQ ID NO: 1298017 - protein, 9 aa, Homo Sapiens
DQYFDVVDS

SEQ ID NO: 1298018 - protein, 9 aa, Homo Sapiens
RLLEIPCGI

SEQ ID NO: 1298019 - protein, 9 aa, Homo Sapiens
KMLVSSAQL

SEQ ID NO: 1298020 - protein, 9 aa, Homo Sapiens
SDTMAEILV

SEQ ID NO: 1298021 - protein, 9 aa, Homo Sapiens
WKANWADLL

SEQ ID NO: 1298022 - protein, 9 aa, Homo Sapiens
PQLYKDPCA

SEQ ID NO: 1298023 - protein, 9 aa, Homo Sapiens
METSQALNE

SEQ ID NO: 1298024 - protein, 9 aa, Homo Sapiens
SRTTLPEQP

SEQ ID NO: 1298025 - protein, 9 aa, Homo Sapiens
YYAAPQLYK

SEQ ID NO: 1298026 - protein, 9 aa, Homo Sapiens
PALNKMFRQ

SEQ ID NO: 1298027 - protein, 9 aa, Homo Sapiens
RRAIQRLVG

SEQ ID NO: 1298028 - protein, 9 aa, Homo Sapiens
QFQKDNLIT

SEQ ID NO: 1298029 - protein, 9 aa, Homo Sapiens
LFMLFSYWA

SEQ ID NO: 1298030 - protein, 9 aa, Homo Sapiens
ALTIECRIC

SEQ ID NO: 1298031 - protein, 9 aa, Homo Sapiens
YNVPLYRLK

SEQ ID NO: 1298032 - protein, 9 aa, Homo Sapiens
RKIMEQSPH

SEQ ID NO: 1298033 - protein, 9 aa, Homo Sapiens
GGDCADFWR

SEQ ID NO: 1298034 - protein, 9 aa, Homo Sapiens
SFISCRFTG

SEQ ID NO: 1298035 - protein, 9 aa, Homo Sapiens
MTKSTFQRT

SEQ ID NO: 1298036 - protein, 9 aa, Homo Sapiens
LIMTKSTFQ

SEQ ID NO: 1298037 - protein, 9 aa, Homo Sapiens
TLPEQPLTE

SEQ ID NO: 1298038 - protein, 9 aa, Homo Sapiens
PFSMEEMFS

SEQ ID NO: 1298039 - protein, 9 aa, Homo Sapiens
MAEILVTVI

SEQ ID NO: 1298040 - protein, 9 aa, Homo Sapiens
MFSFISCRF

SEQ ID NO: 1298041 - protein, 9 aa, Homo Sapiens
CADFWRFRG

SEQ ID NO: 1298042 - protein, 9 aa, Homo Sapiens
SVAVDSGTC

SEQ ID NO: 1298043 - protein, 9 aa, Homo Sapiens
LEFAVSQSY

SEQ ID NO: 1298044 - protein, 9 aa, Homo Sapiens
EQSPHMHNA

SEQ ID NO: 1298045 - protein, 9 aa, Homo Sapiens
FNIPAEHET

SEQ ID NO: 1298046 - protein, 9 aa, Homo Sapiens
KEITTQKSR

SEQ ID NO: 1298047 - protein, 9 aa, Homo Sapiens
NLCGGLHCW

SEQ ID NO: 1298048 - protein, 9 aa, Homo Sapiens
SPESPNTTS

SEQ ID NO: 1298049 - protein, 9 aa, Homo Sapiens
PTTVAIMKM

SEQ ID NO: 1298050 - protein, 9 aa, Homo Sapiens
FIHIFKFVL

SEQ ID NO: 1298051 - protein, 9 aa, Homo Sapiens
VGIFSAILE

SEQ ID NO: 1298052 - protein, 9 aa, Homo Sapiens
QKIETMQFQ

SEQ ID NO: 1298053 - protein, 9 aa, Homo Sapiens
LQFKCGLLH

SEQ ID NO: 1298054 - protein, 9 aa, Homo Sapiens
CNFIHIFKF

SEQ ID NO: 1298055 - protein, 9 aa, Homo Sapiens
VHIERKPYI

SEQ ID NO: 1298056 - protein, 9 aa, Homo Sapiens
PGQTRCRPS

SEQ ID NO: 1298057 - protein, 9 aa, Homo Sapiens
QEDLEFAVS

SEQ ID NO: 1298058 - protein, 9 aa, Homo Sapiens
DSGSYTINF

SEQ ID NO: 1298059 - protein, 9 aa, Homo Sapiens
LDVVERWPH

SEQ ID NO: 1298060 - protein, 9 aa, Homo Sapiens
PGNPRHLHV

SEQ ID NO: 1298061 - protein, 9 aa, Homo Sapiens
KTAGGDCAD

SEQ ID NO: 1298062 - protein, 9 aa, Homo Sapiens
ERWPHRPIL

SEQ ID NO: 1298063 - protein, 9 aa, Homo Sapiens
EAVEAQLRD

SEQ ID NO: 1298064 - protein, 9 aa, Homo Sapiens
FSMEEMFSF

SEQ ID NO: 1298065 - protein, 9 aa, Homo Sapiens
LYRLKMMFE

SEQ ID NO: 1298066 - protein, 9 aa, Homo Sapiens
IFSAILEQA

SEQ ID NO: 1298067 - protein, 9 aa, Homo Sapiens
STVQLYRQR

SEQ ID NO: 1298068 - protein, 9 aa, Homo Sapiens
KPPDTPGEA

SEQ ID NO: 1298069 - protein, 9 aa, Homo Sapiens
SMEEMFSFI

SEQ ID NO: 1298070 - protein, 9 aa, Homo Sapiens
TMAEILVTV

SEQ ID NO: 1298071 - protein, 9 aa, Homo Sapiens
MVGEVFYGS

SEQ ID NO: 1298072 - protein, 9 aa, Homo Sapiens
GSVAVDSGT

SEQ ID NO: 1298073 - protein, 9 aa, Homo Sapiens
QIFCKMDYF

SEQ ID NO: 1298074 - protein, 9 aa, Homo Sapiens
RDQYFDVVD

SEQ ID NO: 1298075 - protein, 9 aa, Homo Sapiens
FIIVVVGIF

SEQ ID NO: 1298076 - protein, 9 aa, Homo Sapiens
KCGLLHEFR

SEQ ID NO: 1298077 - protein, 9 aa, Homo Sapiens
TINFQGRVT

SEQ ID NO: 1298078 - protein, 9 aa, Homo Sapiens
AIMKMLVSS

SEQ ID NO: 1298079 - protein, 9 aa, Homo Sapiens
EEQYYAAPQ

SEQ ID NO: 1298080 - protein, 9 aa, Homo Sapiens
GEQRQSAFS

SEQ ID NO: 1298081 - protein, 9 aa, Homo Sapiens
LVEQWSKVI

SEQ ID NO: 1298082 - protein, 9 aa, Homo Sapiens
FRQLAKTCP

SEQ ID NO: 1298083 - protein, 9 aa, Homo Sapiens
AGSPTTVAI

SEQ ID NO: 1298084 - protein, 9 aa, Homo Sapiens
NDDSGSYTI

SEQ ID NO: 1298085 - protein, 9 aa, Homo Sapiens
TIECRICGD

SEQ ID NO: 1298086 - protein, 9 aa, Homo Sapiens
IHWKAGKGR

SEQ ID NO: 1298087 - protein, 9 aa, Homo Sapiens
HFPQVVKEC

SEQ ID NO: 1298088 - protein, 9 aa, Homo Sapiens
NCNFIHIFK

SEQ ID NO: 1298089 - protein, 9 aa, Homo Sapiens
DLNKHKKVH

SEQ ID NO: 1298090 - protein, 9 aa, Homo Sapiens
TAGGDCADF

SEQ ID NO: 1298091 - protein, 9 aa, Homo Sapiens
SGALTIECR

SEQ ID NO: 1298092 - protein, 9 aa, Homo Sapiens
IHIFKFVLD

SEQ ID NO: 1298093 - protein, 9 aa, Homo Sapiens
LHNTTPNFV

SEQ ID NO: 1298094 - protein, 9 aa, Homo Sapiens
QSAFSELPR

SEQ ID NO: 1298095 - protein, 9 aa, Homo Sapiens
ETSQALNEV

SEQ ID NO: 1298096 - protein, 9 aa, Homo Sapiens
GKCEYQNLQ

SEQ ID NO: 1298097 - protein, 9 aa, Homo Sapiens
PHIHGEDQK

SEQ ID NO: 1298098 - protein, 9 aa, Homo Sapiens
ETMQFQKDN

SEQ ID NO: 1298099 - protein, 9 aa, Homo Sapiens
TSPESPNTT

SEQ ID NO: 1298100 - protein, 9 aa, Homo Sapiens
SYTINFQGR

SEQ ID NO: 1298101 - protein, 9 aa, Homo Sapiens
LNKHKKVHI

SEQ ID NO: 1298102 - protein, 9 aa, Homo Sapiens
YFDVVDSKR

SEQ ID NO: 1298103 - protein, 9 aa, Homo Sapiens
AQLRDKLQR

SEQ ID NO: 1298104 - protein, 9 aa, Homo Sapiens
CRPSRYLHR

SEQ ID NO: 1298105 - protein, 9 aa, Homo Sapiens
YLWSSPTMA

SEQ ID NO: 1298106 - protein, 9 aa, Homo Sapiens
ESYLWSSPT

SEQ ID NO: 1298107 - protein, 9 aa, Homo Sapiens
KMFRQLAKT

SEQ ID NO: 1298108 - protein, 9 aa, Homo Sapiens
EVNVATRLP

SEQ ID NO: 1298109 - protein, 9 aa, Homo Sapiens
DESPSGALT

SEQ ID NO: 1298110 - protein, 9 aa, Homo Sapiens
NKQIFCKMD

SEQ ID NO: 1298111 - protein, 9 aa, Homo Sapiens
IHGEDQKPP

SEQ ID NO: 1298112 - protein, 9 aa, Homo Sapiens
ANWRHHPAL

SEQ ID NO: 1298113 - protein, 9 aa, Homo Sapiens
TRIEKQAKH

SEQ ID NO: 1298114 - protein, 9 aa, Homo Sapiens
ARISSSSFS

SEQ ID NO: 1298115 - protein, 9 aa, Homo Sapiens
QALNEVNVA

SEQ ID NO: 1298116 - protein, 9 aa, Homo Sapiens
WSSPTMAGS

SEQ ID NO: 1298117 - protein, 9 aa, Homo Sapiens
ALNKMFRQL

SEQ ID NO: 1298118 - protein, 9 aa, Homo Sapiens
LRKTRDQYF

SEQ ID NO: 1298119 - protein, 9 aa, Homo Sapiens
TVQLYRQRS

SEQ ID NO: 1298120 - protein, 9 aa, Homo Sapiens
STTSLELDL

SEQ ID NO: 1298121 - protein, 9 aa, Homo Sapiens
TMQFQKDNL

SEQ ID NO: 1298122 - protein, 9 aa, Homo Sapiens
EVFYGSWYQ

SEQ ID NO: 1298123 - protein, 9 aa, Homo Sapiens
AINVLSHLP

SEQ ID NO: 1298124 - protein, 9 aa, Homo Sapiens
PAVHFPQVV

SEQ ID NO: 1298125 - protein, 9 aa, Homo Sapiens
CGGLHCWAP

SEQ ID NO: 1298126 - protein, 9 aa, Homo Sapiens
EAQLRDKLQ

SEQ ID NO: 1298127 - protein, 9 aa, Homo Sapiens
DDSGSYTIN

SEQ ID NO: 1298128 - protein, 9 aa, Homo Sapiens
VGLDYFHSI

SEQ ID NO: 1298129 - protein, 9 aa, Homo Sapiens
RRPGQTRCR

SEQ ID NO: 1298130 - protein, 9 aa, Homo Sapiens
EFAVSQSYS

SEQ ID NO: 1298131 - protein, 9 aa, Homo Sapiens
HIHGEDQKP

SEQ ID NO: 1298132 - protein, 9 aa, Homo Sapiens
KANWADLLI

SEQ ID NO: 1298133 - protein, 9 aa, Homo Sapiens
VVVGIFSAI

SEQ ID NO: 1298134 - protein, 9 aa, Homo Sapiens
EKLSKEITT

SEQ ID NO: 1298135 - protein, 9 aa, Homo Sapiens
KLSKEITTQ

SEQ ID NO: 1298136 - protein, 9 aa, Homo Sapiens
TKSTFQRTV

SEQ ID NO: 1298137 - protein, 9 aa, Homo Sapiens
PESPNTTSP

SEQ ID NO: 1298138 - protein, 9 aa, Homo Sapiens
HHPALVEQW

SEQ ID NO: 1298139 - protein, 9 aa, Homo Sapiens
YFHSIVFWD

SEQ ID NO: 1298140 - protein, 9 aa, Homo Sapiens
RCSAKEVER

SEQ ID NO: 1298141 - protein, 9 aa, Homo Sapiens
MAGSPTTVA

SEQ ID NO: 1298142 - protein, 9 aa, Homo Sapiens
YRQRSKLYG

SEQ ID NO: 1298143 - protein, 9 aa, Homo Sapiens
YTINFQGRV

SEQ ID NO: 1298144 - protein, 9 aa, Homo Sapiens
NEVNVATRL

SEQ ID NO: 1298145 - protein, 9 aa, Homo Sapiens
TVAIMKMLV

SEQ ID NO: 1298146 - protein, 9 aa, Homo Sapiens
PTEPSSKPG

SEQ ID NO: 1298147 - protein, 9 aa, Homo Sapiens
TTQKSRLSE

SEQ ID NO: 1298148 - protein, 9 aa, Homo Sapiens
RHHPALVEQ

SEQ ID NO: 1298149 - protein, 9 aa, Homo Sapiens
LAVVGSVAV

SEQ ID NO: 1298150 - protein, 9 aa, Homo Sapiens
HKKVHIERK

SEQ ID NO: 1298151 - protein, 9 aa, Homo Sapiens
IEKQAKHMK

SEQ ID NO: 1298152 - protein, 9 aa, Homo Sapiens
TRDQYFDVV

SEQ ID NO: 1298153 - protein, 9 aa, Homo Sapiens
VERWPHRPI

SEQ ID NO: 1298154 - protein, 9 aa, Homo Sapiens
VSVGLDYFH

SEQ ID NO: 1298155 - protein, 9 aa, Homo Sapiens
LNPAVHFPQ

SEQ ID NO: 1298156 - protein, 9 aa, Homo Sapiens
LDYFHSIVF

SEQ ID NO: 1298157 - protein, 9 aa, Homo Sapiens
MTTLHNTTP

SEQ ID NO: 1298158 - protein, 9 aa, Homo Sapiens
FYGSWYQHV

SEQ ID NO: 1298159 - protein, 9 aa, Homo Sapiens
TTLHNTTPN

SEQ ID NO: 1298160 - protein, 9 aa, Homo Sapiens
AVHFPQVVK

SEQ ID NO: 1298161 - protein, 9 aa, Homo Sapiens
QRSKLYGSI

SEQ ID NO: 1298162 - protein, 9 aa, Homo Sapiens
FNTWPACMF

SEQ ID NO: 1298163 - protein, 9 aa, Homo Sapiens
KSRTTLPEQ

SEQ ID NO: 1298164 - protein, 9 aa, Homo Sapiens
RWTKHITGL

SEQ ID NO: 1298165 - protein, 9 aa, Homo Sapiens
GARISSSSF

SEQ ID NO: 1298166 - protein, 9 aa, Homo Sapiens
LNKMFRQLA

SEQ ID NO: 1298167 - protein, 9 aa, Homo Sapiens
YTSGPGARI

SEQ ID NO: 1298168 - protein, 9 aa, Homo Sapiens
DLEFAVSQS

SEQ ID NO: 1298169 - protein, 9 aa, Homo Sapiens
SRRAIQRLV

SEQ ID NO: 1298170 - protein, 9 aa, Homo Sapiens
SLELDLRRH

SEQ ID NO: 1298171 - protein, 9 aa, Homo Sapiens
VVDSKRCSA

SEQ ID NO: 1298172 - protein, 9 aa, Homo Sapiens
ALNEVNVAT

SEQ ID NO: 1298173 - protein, 9 aa, Homo Sapiens
KKVHIERKP

SEQ ID NO: 1298174 - protein, 9 aa, Homo Sapiens
LRALQFKCG

SEQ ID NO: 1298175 - protein, 9 aa, Homo Sapiens
WAPWLSSGI

SEQ ID NO: 1298176 - protein, 9 aa, Homo Sapiens
SSKPGNPRH

SEQ ID NO: 1298177 - protein, 9 aa, Homo Sapiens
GGEAVEAQL

SEQ ID NO: 1298178 - protein, 9 aa, Homo Sapiens
AAPQLYKDP

SEQ ID NO: 1298179 - protein, 9 aa, Homo Sapiens
GEEQYYAAP

SEQ ID NO: 1298180 - protein, 9 aa, Homo Sapiens
GIAACMEIL

SEQ ID NO: 1298181 - protein, 9 aa, Homo Sapiens
VTTSVQPQA

SEQ ID NO: 1298182 - protein, 9 aa, Homo Sapiens
NWADLLIWL

SEQ ID NO: 1298183 - protein, 9 aa, Homo Sapiens
INVLSHLPS

SEQ ID NO: 1298184 - protein, 9 aa, Homo Sapiens
RKTRDQYFD

SEQ ID NO: 1298185 - protein, 9 aa, Homo Sapiens
LFNIPAEHE

SEQ ID NO: 1298186 - protein, 9 aa, Homo Sapiens
VHFPQVVKE

SEQ ID NO: 1298187 - protein, 9 aa, Homo Sapiens
SAQLPSPGR

SEQ ID NO: 1298188 - protein, 9 aa, Homo Sapiens
PALVEQWSK

SEQ ID NO: 1298189 - protein, 9 aa, Homo Sapiens
FSYWAGPFS

SEQ ID NO: 1298190 - protein, 9 aa, Homo Sapiens
LWKANWADL

SEQ ID NO: 1298191 - protein, 9 aa, Homo Sapiens
KNKQIFCKM

SEQ ID NO: 1298192 - protein, 9 aa, Homo Sapiens
RALQFKCGL

SEQ ID NO: 1298193 - protein, 9 aa, Homo Sapiens
PSGALTIEC

SEQ ID NO: 1298194 - protein, 9 aa, Homo Sapiens
NVPLYRLKM

SEQ ID NO: 1298195 - protein, 9 aa, Homo Sapiens
ETIYFNTWP

SEQ ID NO: 1298196 - protein, 9 aa, Homo Sapiens
TSGPGARIS

SEQ ID NO: 1298197 - protein, 9 aa, Homo Sapiens
LNEVNVATR

SEQ ID NO: 1298198 - protein, 9 aa, Homo Sapiens
GPGARISSS

SEQ ID NO: 1298199 - protein, 9 aa, Homo Sapiens
LTKQNEMND

SEQ ID NO: 1298200 - protein, 9 aa, Homo Sapiens
DCADFWRFR

SEQ ID NO: 1298201 - protein, 9 aa, Homo Sapiens
ALQFKCGLL

SEQ ID NO: 1298202 - protein, 9 aa, Homo Sapiens
IIVVVGIFS

SEQ ID NO: 1298203 - protein, 9 aa, Homo Sapiens
QPLTEVKAE

SEQ ID NO: 1298204 - protein, 9 aa, Homo Sapiens
GGLHCWAPW

SEQ ID NO: 1298205 - protein, 9 aa, Homo Sapiens
NCKEAINVL

SEQ ID NO: 1298206 - protein, 9 aa, Homo Sapiens
KLMTTLHNT

SEQ ID NO: 1298207 - protein, 9 aa, Homo Sapiens
FMVGEVFYG

SEQ ID NO: 1298208 - protein, 9 aa, Homo Sapiens
LLEIPCGIA

SEQ ID NO: 1298209 - protein, 9 aa, Homo Sapiens
KIETMQFQK

SEQ ID NO: 1298210 - protein, 9 aa, Homo Sapiens
EMFSFISCR

SEQ ID NO: 1298211 - protein, 9 aa, Homo Sapiens
EQRQSAFSE

SEQ ID NO: 1298212 - protein, 9 aa, Homo Sapiens
DTTSPESPN

SEQ ID NO: 1298213 - protein, 9 aa, Homo Sapiens
SPNTTSPES

SEQ ID NO: 1298214 - protein, 9 aa, Homo Sapiens
KRCSAKEVE

SEQ ID NO: 1298215 - protein, 9 aa, Homo Sapiens
VGSVAVDSG

SEQ ID NO: 1298216 - protein, 9 aa, Homo Sapiens
CEYQNLQLR

SEQ ID NO: 1298217 - protein, 9 aa, Homo Sapiens
PSLAVVGSV

SEQ ID NO: 1298218 - protein, 9 aa, Homo Sapiens
NVLSHLPSH

SEQ ID NO: 1298219 - protein, 9 aa, Homo Sapiens
QETIYFNTW

SEQ ID NO: 1298220 - protein, 9 aa, Homo Sapiens
EPSSKPGNP

SEQ ID NO: 1298221 - protein, 9 aa, Homo Sapiens
APAMSNDTM

SEQ ID NO: 1298222 - protein, 9 aa, Homo Sapiens
IMTKSTFQR

SEQ ID NO: 1298223 - protein, 9 aa, Homo Sapiens
AAIHWKAGK

SEQ ID NO: 1298224 - protein, 9 aa, Homo Sapiens
CWAPWLSSG

SEQ ID NO: 1298225 - protein, 9 aa, Homo Sapiens
LCGGLHCWA

SEQ ID NO: 1298226 - protein, 9 aa, Homo Sapiens
MQFQKDNLI

SEQ ID NO: 1298227 - protein, 9 aa, Homo Sapiens
VLSHLPSHH

SEQ ID NO: 1298228 - protein, 9 aa, Homo Sapiens
EIPCGIAAC

SEQ ID NO: 1298229 - protein, 9 aa, Homo Sapiens
QTRCRPSRY

SEQ ID NO: 1298230 - protein, 9 aa, Homo Sapiens
MLVSSAQLP

SEQ ID NO: 1298231 - protein, 9 aa, Homo Sapiens
DGGEAVEAQ

SEQ ID NO: 1298232 - protein, 9 aa, Homo Sapiens
ALVEQWSKV

SEQ ID NO: 1298233 - protein, 9 aa, Homo Sapiens
AQQEQQIQV

SEQ ID NO: 1298234 - protein, 9 aa, Homo Sapiens
SSAQLPSPG

SEQ ID NO: 1298235 - protein, 9 aa, Homo Sapiens
TTSVQPQAQ

SEQ ID NO: 1298236 - protein, 9 aa, Homo Sapiens
PNTTSPESP

SEQ ID NO: 1298237 - protein, 9 aa, Homo Sapiens
EAINVLSHL

SEQ ID NO: 1298238 - protein, 9 aa, Homo Sapiens
WTKHITGLT

SEQ ID NO: 1298239 - protein, 9 aa, Homo Sapiens
KIMEQSPHM

SEQ ID NO: 1298240 - protein, 9 aa, Homo Sapiens
GRRPGQTRC

SEQ ID NO: 1298241 - protein, 9 aa, Homo Sapiens
SELPRMKDR

SEQ ID NO: 1298242 - protein, 9 aa, Homo Sapiens
LMTTLHNTT

SEQ ID NO: 1298243 - protein, 9 aa, Homo Sapiens
GLDYFHSIV

SEQ ID NO: 1298244 - protein, 9 aa, Homo Sapiens
MEEMFSFIS

SEQ ID NO: 1298245 - protein, 9 aa, Homo Sapiens
PGARISSSS

SEQ ID NO: 1298246 - protein, 9 aa, Homo Sapiens
VEAQLRDKL

SEQ ID NO: 1298247 - protein, 9 aa, Homo Sapiens
NWKLTKQNE

SEQ ID NO: 1298248 - protein, 9 aa, Homo Sapiens
WADLLIWLV

SEQ ID NO: 1298249 - protein, 9 aa, Homo Sapiens
GEDQKPPDT

SEQ ID NO: 1298250 - protein, 9 aa, Homo Sapiens
SDLNKHKKV

SEQ ID NO: 1298251 - protein, 9 aa, Homo Sapiens
LLNPAVHFP

SEQ ID NO: 1298252 - protein, 9 aa, Homo Sapiens
CHNMNCNFI

SEQ ID NO: 1298253 - protein, 9 aa, Homo Sapiens
RYGKCEYQN

SEQ ID NO: 1298254 - protein, 9 aa, Homo Sapiens
DVVERWPHR

SEQ ID NO: 1298255 - protein, 9 aa, Homo Sapiens
NWRHHPALV

SEQ ID NO: 1298256 - protein, 9 aa, Homo Sapiens
SVQPQAQQE

SEQ ID NO: 1298257 - protein, 9 aa, Homo Sapiens
FTRIEKQAK

SEQ ID NO: 1298258 - protein, 9 aa, Homo Sapiens
PLYRLKMMF

SEQ ID NO: 1298259 - protein, 9 aa, Homo Sapiens
NIPAEHETR

SEQ ID NO: 1298260 - protein, 9 aa, Homo Sapiens
AEHETRLWN

SEQ ID NO: 1298261 - protein, 9 aa, Homo Sapiens
TKQNEMNDS

SEQ ID NO: 1298262 - protein, 9 aa, Homo Sapiens
IQRLVGSAT

SEQ ID NO: 1298263 - protein, 9 aa, Homo Sapiens
TEPSSKPGN

SEQ ID NO: 1298264 - protein, 9 aa, Homo Sapiens
QLYRQRSKL

SEQ ID NO: 1298265 - protein, 9 aa, Homo Sapiens
QNLQLRKGC

SEQ ID NO: 1298266 - protein, 9 aa, Homo Sapiens
DSRWTKHIT

SEQ ID NO: 1298267 - protein, 9 aa, Homo Sapiens
YNCKEAINV

SEQ ID NO: 1298268 - protein, 9 aa, Homo Sapiens
EDQKPPDTP

SEQ ID NO: 1298269 - protein, 9 aa, Homo Sapiens
VFYGSWYQH

SEQ ID NO: 1298270 - protein, 9 aa, Homo Sapiens
TMAGSPTTV

SEQ ID NO: 1298271 - protein, 9 aa, Homo Sapiens
DQKPPDTPG

SEQ ID NO: 1298272 - protein, 9 aa, Homo Sapiens
QSPHMHNAE

SEQ ID NO: 1298273 - protein, 9 aa, Homo Sapiens
TSVQPQAQQ

SEQ ID NO: 1298274 - protein, 9 aa, Homo Sapiens
IKNKQIFCK

SEQ ID NO: 1298275 - protein, 9 aa, Homo Sapiens
EKQAKHMKK

SEQ ID NO: 1298276 - protein, 9 aa, Homo Sapiens
APQLYKDPC

SEQ ID NO: 1298277 - protein, 9 aa, Homo Sapiens
VAIMKMLVS

SEQ ID NO: 1298278 - protein, 9 aa, Homo Sapiens
RQSAFSELP

SEQ ID NO: 1298279 - protein, 9 aa, Homo Sapiens
YRLKMMFEK

SEQ ID NO: 1298280 - protein, 9 aa, Homo Sapiens
SPHMHNAEI

SEQ ID NO: 1298281 - protein, 9 aa, Homo Sapiens
DDFLQALIM

SEQ ID NO: 1298282 - protein, 9 aa, Homo Sapiens
SQALNEVNV

SEQ ID NO: 1298283 - protein, 9 aa, Homo Sapiens
GEVFYGSWY

SEQ ID NO: 1298284 - protein, 9 aa, Homo Sapiens
SPTMAGSPT

SEQ ID NO: 1298285 - protein, 9 aa, Homo Sapiens
KPGNPRHLH

SEQ ID NO: 1298286 - protein, 9 aa, Homo Sapiens
PAMSNDTMP

SEQ ID NO: 1298287 - protein, 9 aa, Homo Sapiens
KHKKVHIER

SEQ ID NO: 1298288 - protein, 9 aa, Homo Sapiens
HMHNAEISK

SEQ ID NO: 1298289 - protein, 9 aa, Homo Sapiens
MKMLVSSAQ

SEQ ID NO: 1298290 - protein, 9 aa, Homo Sapiens
LPKTAGGDC

SEQ ID NO: 1298291 - protein, 9 aa, Homo Sapiens
SPTEPSSKP

SEQ ID NO: 1298292 - protein, 9 aa, Homo Sapiens
GALTIECRI

SEQ ID NO: 1298293 - protein, 9 aa, Homo Sapiens
DYFHSIVFW

SEQ ID NO: 1298294 - protein, 9 aa, Homo Sapiens
ANWADLLIW

SEQ ID NO: 1298295 - protein, 9 aa, Homo Sapiens
PQAQQEQQI

SEQ ID NO: 1298296 - protein, 9 aa, Homo Sapiens
HNMNCNFIH

SEQ ID NO: 1298297 - protein, 9 aa, Homo Sapiens
QFKCGLLHE

SEQ ID NO: 1298298 - protein, 9 aa, Homo Sapiens
NSCYIKNKQ

SEQ ID NO: 1298299 - protein, 9 aa, Homo Sapiens
CYIKNKQIF

SEQ ID NO: 1298300 - protein, 9 aa, Homo Sapiens
VGEVFYGSW

SEQ ID NO: 1298301 - protein, 9 aa, Homo Sapiens
KLFNIPAEH

SEQ ID NO: 1298302 - protein, 9 aa, Homo Sapiens
RSYTSGPGA

SEQ ID NO: 1298303 - protein, 9 aa, Homo Sapiens
PLRALQFKC

SEQ ID NO: 1298304 - protein, 9 aa, Homo Sapiens
MNCNFIHIF

SEQ ID NO: 1298305 - protein, 9 aa, Homo Sapiens
YQNLQLRKG

SEQ ID NO: 1298306 - protein, 9 aa, Homo Sapiens
YSDTMAEIL

SEQ ID NO: 1298307 - protein, 9 aa, Homo Sapiens
MLFSYWAGP

SEQ ID NO: 1298308 - protein, 9 aa, Homo Sapiens
HITGLTISD

SEQ ID NO: 1298309 - protein, 9 aa, Homo Sapiens
ADSRWTKHI

SEQ ID NO: 1298310 - protein, 9 aa, Homo Sapiens
TIYFNTWPA

SEQ ID NO: 1298311 - protein, 9 aa, Homo Sapiens
GLHCWAPWL

SEQ ID NO: 1298312 - protein, 9 aa, Homo Sapiens
GEAVEAQLR

SEQ ID NO: 1298313 - protein, 9 aa, Homo Sapiens
WKLTKQNEM

SEQ ID NO: 1298314 - protein, 9 aa, Homo Sapiens
FMLFSYWAG

SEQ ID NO: 1298315 - protein, 9 aa, Homo Sapiens
DFLQALIMT

SEQ ID NO: 1298316 - protein, 9 aa, Homo Sapiens
QITRYSDTM

SEQ ID NO: 1298317 - protein, 9 aa, Homo Sapiens
ARLLEIPCG

SEQ ID NO: 1298318 - protein, 9 aa, Homo Sapiens
EEMFSFISC

SEQ ID NO: 1298319 - protein, 9 aa, Homo Sapiens
PKTAGGDCA

SEQ ID NO: 1298320 - protein, 9 aa, Homo Sapiens
KQEDLEFAV

SEQ ID NO: 1298321 - protein, 9 aa, Homo Sapiens
CSAKEVERV

SEQ ID NO: 1298322 - protein, 9 aa, Homo Sapiens
IETMQFQKD

SEQ ID NO: 1298323 - protein, 9 aa, Homo Sapiens
PCGIAACME

SEQ ID NO: 1298324 - protein, 9 aa, Homo Sapiens
EHETRLWNK

SEQ ID NO: 1298325 - protein, 9 aa, Homo Sapiens
FAVSQSYSE

SEQ ID NO: 1298326 - protein, 9 aa, Homo Sapiens
HWKAGKGRT

SEQ ID NO: 1298327 - protein, 9 aa, Homo Sapiens
HNTTPNFVR

SEQ ID NO: 1298328 - protein, 9 aa, Homo Sapiens
SRWTKHITG

SEQ ID NO: 1298329 - protein, 9 aa, Homo Sapiens
QRQSAFSEL

SEQ ID NO: 1298330 - protein, 9 aa, Homo Sapiens
MFRQLAKTC

SEQ ID NO: 1298331 - protein, 9 aa, Homo Sapiens
LFSYWAGPF

SEQ ID NO: 1298332 - protein, 9 aa, Homo Sapiens
DFIIVVVGI

SEQ ID NO: 1298333 - protein, 9 aa, Homo Sapiens
KEVERVVGQ

SEQ ID NO: 1298334 - protein, 9 aa, Homo Sapiens
FSELPRMKD

SEQ ID NO: 1298335 - protein, 9 aa, Homo Sapiens
KEAINVLSH

SEQ ID NO: 1298336 - protein, 9 aa, Homo Sapiens
IPAEHETRL

SEQ ID NO: 1298337 - protein, 9 aa, Homo Sapiens
EQPLTEVKA

SEQ ID NO: 1298338 - protein, 9 aa, Homo Sapiens
AGGDCADFW

SEQ ID NO: 1298339 - protein, 9 aa, Homo Sapiens
LVGSATLQV

SEQ ID NO: 1298340 - protein, 9 aa, Homo Sapiens
MRSLWKANW

SEQ ID NO: 1298341 - protein, 9 aa, Homo Sapiens
LGKLMTTLH

SEQ ID NO: 1298342 - protein, 9 aa, Homo Sapiens
AIHWKAGKG

SEQ ID NO: 1298343 - protein, 9 aa, Homo Sapiens
PGRRPGQTR

SEQ ID NO: 1298344 - protein, 9 aa, Homo Sapiens
WAPAMSNDT

SEQ ID NO: 1298345 - protein, 9 aa, Homo Sapiens
QYYAAPQLY

SEQ ID NO: 1298346 - protein, 9 aa, Homo Sapiens
KLTKQNEMN

SEQ ID NO: 1298347 - protein, 9 aa, Homo Sapiens
GKLMTTLHN

SEQ ID NO: 1298348 - protein, 9 aa, Homo Sapiens
INFQGRVTQ

SEQ ID NO: 1298349 - protein, 9 aa, Homo Sapiens
KVHIERKPY

SEQ ID NO: 1298350 - protein, 9 aa, Homo Sapiens
TSLELDLRR

SEQ ID NO: 1298351 - protein, 9 aa, Homo Sapiens
EQYYAAPQL

SEQ ID NO: 1298352 - protein, 9 aa, Homo Sapiens
VAAIHWKAG

SEQ ID NO: 1298353 - protein, 9 aa, Homo Sapiens
QLRDKLQRL

SEQ ID NO: 1298354 - protein, 9 aa, Homo Sapiens
MTNWKLTKQ

SEQ ID NO: 1298355 - protein, 9 aa, Homo Sapiens
QALIMTKST

SEQ ID NO: 1298356 - protein, 9 aa, Homo Sapiens
FKCGLLHEF

SEQ ID NO: 1298357 - protein, 9 aa, Homo Sapiens
KFMVGEVFY

SEQ ID NO: 1298358 - protein, 9 aa, Homo Sapiens
GIFSAILEQ

SEQ ID NO: 1298359 - protein, 9 aa, Homo Sapiens
TTSPESPNT

SEQ ID NO: 1298360 - protein, 9 aa, Homo Sapiens
FPQVVKECR

SEQ ID NO: 1298361 - protein, 9 aa, Homo Sapiens
YHLDVVERW

SEQ ID NO: 1298362 - protein, 9 aa, Homo Sapiens
QFTRIEKQA

SEQ ID NO: 1298363 - protein, 9 aa, Homo Sapiens
AVSQSYSEF

SEQ ID NO: 1298364 - protein, 9 aa, Homo Sapiens
DSKRCSAKE

SEQ ID NO: 1298365 - protein, 9 aa, Homo Sapiens
PQVVKECRA

SEQ ID NO: 1298366 - protein, 9 aa, Homo Sapiens
DTMAEILVT

SEQ ID NO: 1298367 - protein, 9 aa, Homo Sapiens
ITTQKSRLS

SEQ ID NO: 1298368 - protein, 9 aa, Homo Sapiens
KQNEMNDSQ

SEQ ID NO: 1298369 - protein, 9 aa, Homo Sapiens
AIQRLVGSA

SEQ ID NO: 1298370 - protein, 9 aa, Homo Sapiens
YFNTWPACM

SEQ ID NO: 1298371 - protein, 9 aa, Homo Sapiens
RQRSKLYGS

SEQ ID NO: 1298372 - protein, 9 aa, Homo Sapiens
NFIHIFKFV

SEQ ID NO: 1298373 - protein, 9 aa, Homo Sapiens
RSLWKANWA

SEQ ID NO: 1298374 - protein, 9 aa, Homo Sapiens
PHMHNAEIS

SEQ ID NO: 1298375 - protein, 9 aa, Homo Sapiens
SAKEVERVV

SEQ ID NO: 1298376 - protein, 9 aa, Homo Sapiens
HCWAPWLSS

SEQ ID NO: 1298377 - protein, 9 aa, Homo Sapiens
RAIQRLVGS

SEQ ID NO: 1298378 - protein, 9 aa, Homo Sapiens
SGPGARISS

SEQ ID NO: 1298379 - protein, 9 aa, Homo Sapiens
RYSDTMAEI

SEQ ID NO: 1298380 - protein, 9 aa, Homo Sapiens
CGLLHEFRK

SEQ ID NO: 1298381 - protein, 9 aa, Homo Sapiens
AFSELPRMK

SEQ ID NO: 1298382 - protein, 9 aa, Homo Sapiens
ITRYSDTMA

SEQ ID NO: 1298383 - protein, 9 aa, Homo Sapiens
SKEITTQKS

SEQ ID NO: 1298384 - protein, 9 aa, Homo Sapiens
MEQSPHMHN

SEQ ID NO: 1298385 - protein, 9 aa, Homo Sapiens
SPGRRPGQT

SEQ ID NO: 1298386 - protein, 9 aa, Homo Sapiens
FQKDNLITK

SEQ ID NO: 1298387 - protein, 9 aa, Homo Sapiens
VDSKRCSAK

SEQ ID NO: 1298388 - protein, 9 aa, Homo Sapiens
LSKEITTQK

SEQ ID NO: 1298389 - protein, 9 aa, Homo Sapiens
LTIECRICG

SEQ ID NO: 1298390 - protein, 9 aa, Homo Sapiens
VSQSYSEFF

SEQ ID NO: 1298391 - protein, 9 aa, Homo Sapiens
TRYSDTMAE

SEQ ID NO: 1298392 - protein, 9 aa, Homo Sapiens
HLDVVERWP

SEQ ID NO: 1298393 - protein, 9 aa, Homo Sapiens
VQPQAQQEQ

SEQ ID NO: 1298394 - protein, 9 aa, Homo Sapiens
GDCADFWRF

SEQ ID NO: 1298395 - protein, 9 aa, Homo Sapiens
SLFMLFSYW

SEQ ID NO: 1298396 - protein, 9 aa, Homo Sapiens
NKHKKVHIE

SEQ ID NO: 1298397 - protein, 9 aa, Homo Sapiens
QYFDVVDSK

SEQ ID NO: 1298398 - protein, 9 aa, Homo Sapiens
VVGIFSAIL

SEQ ID NO: 1298399 - protein, 9 aa, Homo Sapiens
VSSAQLPSP

SEQ ID NO: 1298400 - protein, 9 aa, Homo Sapiens
IYFNTWPAC

SEQ ID NO: 1298401 - protein, 9 aa, Homo Sapiens
TTLPEQPLT

SEQ ID NO: 1298402 - protein, 9 aa, Homo Sapiens
DNHVAAIHW

SEQ ID NO: 1298403 - protein, 9 aa, Homo Sapiens
CGIAACMEI

SEQ ID NO: 1298404 - protein, 9 aa, Homo Sapiens
YAAPQLYKD

SEQ ID NO: 1298405 - protein, 9 aa, Homo Sapiens
IPCGIAACM

SEQ ID NO: 1298406 - protein, 9 aa, Homo Sapiens
SGSYTINFQ

SEQ ID NO: 1298407 - protein, 9 aa, Homo Sapiens
ELQETIYFN

SEQ ID NO: 1298408 - protein, 9 aa, Homo Sapiens
HGEDQKPPD

SEQ ID NO: 1298409 - protein, 9 aa, Homo Sapiens
SWAPAMSND

SEQ ID NO: 1298410 - protein, 9 aa, Homo Sapiens
SYLWSSPTM

SEQ ID NO: 1298411 - protein, 9 aa, Homo Sapiens
SPSGALTIE

SEQ ID NO: 1298412 - protein, 9 aa, Homo Sapiens
FLQALIMTK

SEQ ID NO: 1298413 - protein, 9 aa, Homo Sapiens
NPAVHFPQV

SEQ ID NO: 1298414 - protein, 9 aa, Homo Sapiens
AVVGSVAVD

SEQ ID NO: 1298415 - protein, 9 aa, Homo Sapiens
WKAGKGRTG

SEQ ID NO: 1298416 - protein, 9 aa, Homo Sapiens
HPALVEQWS

SEQ ID NO: 1298417 - protein, 9 aa, Homo Sapiens
PSPGRRPGQ

SEQ ID NO: 1298418 - protein, 9 aa, Homo Sapiens
VPLYRLKMM

SEQ ID NO: 1298419 - protein, 9 aa, Homo Sapiens
VVGSVAVDS

SEQ ID NO: 1298420 - protein, 9 aa, Homo Sapiens
VVERWPHRP

SEQ ID NO: 1298421 - protein, 9 aa, Homo Sapiens
SYWAGPFSI

SEQ ID NO: 1298422 - protein, 9 aa, Homo Sapiens
AQLPSPGRR

SEQ ID NO: 1298423 - protein, 9 aa, Homo Sapiens
GSPTTVAIM

SEQ ID NO: 1298424 - protein, 9 aa, Homo Sapiens
QAQQEQQIQ

SEQ ID NO: 1298425 - protein, 9 aa, Homo Sapiens
KCEYQNLQL

SEQ ID NO: 1298426 - protein, 9 aa, Homo Sapiens
WRHHPALVE

SEQ ID NO: 1298427 - protein, 9 aa, Homo Sapiens
PADSRWTKH

SEQ ID NO: 1298428 - protein, 9 aa, Homo Sapiens
IMKMLVSSA

SEQ ID NO: 1298429 - protein, 9 aa, Homo Sapiens
HSLFMLFSY

SEQ ID NO: 1298430 - protein, 9 aa, Homo Sapiens
QPQAQQEQQ

SEQ ID NO: 1298431 - protein, 9 aa, Homo Sapiens
SPTTVAIMK

SEQ ID NO: 1298432 - protein, 9 aa, Homo Sapiens
QKDNLITKQ

SEQ ID NO: 1298433 - protein, 9 aa, Homo Sapiens
HVAAIHWKA

SEQ ID NO: 1298434 - protein, 9 aa, Homo Sapiens
PEQPLTEVK

SEQ ID NO: 1298435 - protein, 9 aa, Homo Sapiens
RLVGSATLQ

SEQ ID NO: 1298436 - protein, 9 aa, Homo Sapiens
ALIMTKSTF

SEQ ID NO: 1298437 - protein, 9 aa, Homo Sapiens
LHCWAPWLS

SEQ ID NO: 1298438 - protein, 9 aa, Homo Sapiens
VAVDSGTCS

SEQ ID NO: 1298439 - protein, 9 aa, Homo Sapiens
NMNCNFIHI

SEQ ID NO: 1298440 - protein, 9 aa, Homo Sapiens
LQETIYFNT

SEQ ID NO: 1298441 - protein, 9 aa, Homo Sapiens
RPGQTRCRP

SEQ ID NO: 1298442 - protein, 9 aa, Homo Sapiens
SPALNKMFR

SEQ ID NO: 1298443 - protein, 9 aa, Homo Sapiens
QKPPDTPGE

SEQ ID NO: 1298444 - protein, 9 aa, Homo Sapiens
TTSLELDLR

SEQ ID NO: 1298445 - protein, 9 aa, Homo Sapiens
IMEQSPHMH

SEQ ID NO: 1298446 - protein, 9 aa, Homo Sapiens
YIKNKQIFC

SEQ ID NO: 1298447 - protein, 9 aa, Homo Sapiens
TTVAIMKML

SEQ ID NO: 1298448 - protein, 9 aa, Homo Sapiens
LPEQPLTEV

SEQ ID NO: 1298449 - protein, 9 aa, Homo Sapiens
FSFISCRFT

SEQ ID NO: 1298450 - protein, 9 aa, Homo Sapiens
EYQNLQLRK

SEQ ID NO: 1298451 - protein, 9 aa, Homo Sapiens
QLPSPGRRP

SEQ ID NO: 1298452 - protein, 9 aa, Homo Sapiens
SAFSELPRM

SEQ ID NO: 1298453 - protein, 9 aa, Homo Sapiens
KQIFCKMDY

SEQ ID NO: 1298454 - protein, 9 aa, Homo Sapiens
AEYFCAVIL

SEQ ID NO: 1298455 - protein, 9 aa, Homo Sapiens
NTTSPESPD

SEQ ID NO: 1298456 - protein, 9 aa, Homo Sapiens
LVSSAQLPS

SEQ ID NO: 1298457 - protein, 9 aa, Homo Sapiens
TNWKLTKQN

SEQ ID NO: 1298458 - protein, 9 aa, Homo Sapiens
RPSRYLHRQ

SEQ ID NO: 1298459 - protein, 9 aa, Homo Sapiens
LQALIMTKS

SEQ ID NO: 1298460 - protein, 9 aa, Homo Sapiens
RWPHRPILQ

SEQ ID NO: 1298461 - protein, 9 aa, Homo Sapiens
CLVSVGLDY

SEQ ID NO: 1298462 - protein, 9 aa, Homo Sapiens
AKEVERVVG

SEQ ID NO: 1298463 - protein, 9 aa, Homo Sapiens
HETRLWNKY

SEQ ID NO: 1298464 - protein, 9 aa, Homo Sapiens
LWSSPTMAG

SEQ ID NO: 1298465 - protein, 9 aa, Homo Sapiens
KHITGLTIS

SEQ ID NO: 1298466 - protein, 9 aa, Homo Sapiens
YWAGPFSIM

SEQ ID NO: 1298467 - protein, 9 aa, Homo Sapiens
RCRPSRYLH

SEQ ID NO: 1298468 - protein, 9 aa, Homo Sapiens
SLWKANWAD

SEQ ID NO: 1298469 - protein, 9 aa, Homo Sapiens
LPSPGRRPG

SEQ ID NO: 1298470 - protein, 9 aa, Homo Sapiens
PSSKPGNPR

SEQ ID NO: 1298471 - protein, 9 aa, Homo Sapiens
IEKYNVPLY

SEQ ID NO: 1298472 - protein, 9 aa, Homo Sapiens
SSPTMAGSP

SEQ ID NO: 1298473 - protein, 9 aa, Homo Sapiens
LEKLSKEIT

SEQ ID NO: 1298474 - protein, 9 aa, Homo Sapiens
EKFMVGEVF

SEQ ID NO: 1298475 - protein, 9 aa, Homo Sapiens
NHVAAIHWK

SEQ ID NO: 1298476 - protein, 9 aa, Homo Sapiens
SKRCSAKEV

SEQ ID NO: 1298477 - protein, 9 aa, Homo Sapiens
SCYIKNKQI

SEQ ID NO: 1298478 - protein, 9 aa, Homo Sapiens
PTMAGSPTT

SEQ ID NO: 1298479 - protein, 9 aa, Homo Sapiens
SYTSGPGAR

SEQ ID NO: 1298480 - protein, 9 aa, Homo Sapiens
NKMFRQLAK

SEQ ID NO: 1298481 - protein, 9 aa, Homo Sapiens
WPHRPILQA

SEQ ID NO: 1298482 - protein, 9 aa, Homo Sapiens
TRCRPSRYL

SEQ ID NO: 1298483 - protein, 9 aa, Homo Sapiens
LPLAKHTIS

SEQ ID NO: 1298484 - protein, 8 aa, Homo Sapiens
RKPRRAGW

SEQ ID NO: 1298485 - protein, 9 aa, Homo Sapiens
EQINPRNTI

SEQ ID NO: 1298486 - protein, 9 aa, Homo Sapiens
NSFKNTGEL

SEQ ID NO: 1298487 - protein, 9 aa, Homo Sapiens
CEDGGRASE

SEQ ID NO: 1298488 - protein, 9 aa, Homo Sapiens
AGIIITIVW

SEQ ID NO: 1298489 - protein, 9 aa, Homo Sapiens
CGHTGVCNN

SEQ ID NO: 1298490 - protein, 9 aa, Homo Sapiens
DRRVFIAWL

SEQ ID NO: 1298491 - protein, 9 aa, Homo Sapiens
GKTGILWKN

SEQ ID NO: 1298492 - protein, 9 aa, Homo Sapiens
EDQKPLTSL

SEQ ID NO: 1298493 - protein, 9 aa, Homo Sapiens
DRPRFERVR

SEQ ID NO: 1298494 - protein, 9 aa, Homo Sapiens
LTDGAQFPE

SEQ ID NO: 1298495 - protein, 9 aa, Homo Sapiens
HVCACPGRD

SEQ ID NO: 1298496 - protein, 9 aa, Homo Sapiens
TSYRERALS

SEQ ID NO: 1298497 - protein, 9 aa, Homo Sapiens
FPFDQHNCT

SEQ ID NO: 1298498 - protein, 9 aa, Homo Sapiens
TETPRWQRF

SEQ ID NO: 1298499 - protein, 9 aa, Homo Sapiens
GENKQLKIS

SEQ ID NO: 1298500 - protein, 9 aa, Homo Sapiens
NTQKEWLII

SEQ ID NO: 1298501 - protein, 9 aa, Homo Sapiens
EDGGRASEA

SEQ ID NO: 1298502 - protein, 9 aa, Homo Sapiens
GIIITIVWI

SEQ ID NO: 1298503 - protein, 9 aa, Homo Sapiens
ALGLDPLGA

SEQ ID NO: 1298504 - protein, 9 aa, Homo Sapiens
LKILVNQVS

SEQ ID NO: 1298505 - protein, 9 aa, Homo Sapiens
QLAKGNLNT

SEQ ID NO: 1298506 - protein, 9 aa, Homo Sapiens
FTLTCIADN

SEQ ID NO: 1298507 - protein, 9 aa, Homo Sapiens
NYSDTETEA

SEQ ID NO: 1298508 - protein, 9 aa, Homo Sapiens
ASTGITDLE

SEQ ID NO: 1298509 - protein, 9 aa, Homo Sapiens
NSKGTVFLQ

SEQ ID NO: 1298510 - protein, 9 aa, Homo Sapiens
KGTVFLQLM

SEQ ID NO: 1298511 - protein, 9 aa, Homo Sapiens
IITIVWIIS

SEQ ID NO: 1298512 - protein, 9 aa, Homo Sapiens
YLPLAKHTI

SEQ ID NO: 1298513 - protein, 9 aa, Homo Sapiens
LERAARNKA

SEQ ID NO: 1298514 - protein, 9 aa, Homo Sapiens
LRGKENERE

SEQ ID NO: 1298515 - protein, 9 aa, Homo Sapiens
GKAQQRIRQ

SEQ ID NO: 1298516 - protein, 9 aa, Homo Sapiens
GQITVGQKI

SEQ ID NO: 1298517 - protein, 9 aa, Homo Sapiens
INFLGHILH

SEQ ID NO: 1298518 - protein, 9 aa, Homo Sapiens
HTKENIYQC

SEQ ID NO: 1298519 - protein, 9 aa, Homo Sapiens
QVYTGSSSS

SEQ ID NO: 1298520 - protein, 9 aa, Homo Sapiens
DGAQFPESF

SEQ ID NO: 1298521 - protein, 9 aa, Homo Sapiens
LLGYFSLFL

SEQ ID NO: 1298522 - protein, 9 aa, Homo Sapiens
PNIELHKDS

SEQ ID NO: 1298523 - protein, 9 aa, Homo Sapiens
VVSGTIFDY

SEQ ID NO: 1298524 - protein, 9 aa, Homo Sapiens
VHNQKERPR

SEQ ID NO: 1298525 - protein, 9 aa, Homo Sapiens
TFATGLGWL

SEQ ID NO: 1298526 - protein, 9 aa, Homo Sapiens
KDHTCEGRK

SEQ ID NO: 1298527 - protein, 9 aa, Homo Sapiens
PPFGVPVSV

SEQ ID NO: 1298528 - protein, 9 aa, Homo Sapiens
EIRLENEEG

SEQ ID NO: 1298529 - protein, 9 aa, Homo Sapiens
TLTCIADNV

SEQ ID NO: 1298530 - protein, 9 aa, Homo Sapiens
SPLRMNSNN

SEQ ID NO: 1298531 - protein, 9 aa, Homo Sapiens
LHGCVKWCG

SEQ ID NO: 1298532 - protein, 9 aa, Homo Sapiens
ENIYQCSKC

SEQ ID NO: 1298533 - protein, 9 aa, Homo Sapiens
VCNGDWSTC

SEQ ID NO: 1298534 - protein, 9 aa, Homo Sapiens
LHTDVKPSN

SEQ ID NO: 1298535 - protein, 9 aa, Homo Sapiens
EKTAPRATC

SEQ ID NO: 1298536 - protein, 9 aa, Homo Sapiens
KQHHLDPGS

SEQ ID NO: 1298537 - protein, 9 aa, Homo Sapiens
NSFEVHVCA

SEQ ID NO: 1298538 - protein, 9 aa, Homo Sapiens
NCGVCNGDW

SEQ ID NO: 1298539 - protein, 9 aa, Homo Sapiens
ELVRKYPHS

SEQ ID NO: 1298540 - protein, 9 aa, Homo Sapiens
TGLGWLLLQ

SEQ ID NO: 1298541 - protein, 9 aa, Homo Sapiens
YTSTASTGI

SEQ ID NO: 1298542 - protein, 9 aa, Homo Sapiens
GRMTQKCIQ

SEQ ID NO: 1298543 - protein, 9 aa, Homo Sapiens
HCEDGGRAS

SEQ ID NO: 1298544 - protein, 9 aa, Homo Sapiens
SNRRANVAL

SEQ ID NO: 1298545 - protein, 9 aa, Homo Sapiens
LGYFSLFLI

SEQ ID NO: 1298546 - protein, 9 aa, Homo Sapiens
HVEFSADWL

SEQ ID NO: 1298547 - protein, 9 aa, Homo Sapiens
TMYNSKGTV

SEQ ID NO: 1298548 - protein, 9 aa, Homo Sapiens
PTCFGSLAP

SEQ ID NO: 1298549 - protein, 9 aa, Homo Sapiens
VKPLTVNLD

SEQ ID NO: 1298550 - protein, 9 aa, Homo Sapiens
DYSTYLRHK

SEQ ID NO: 1298551 - protein, 9 aa, Homo Sapiens
STLPTSTSC

SEQ ID NO: 1298552 - protein, 9 aa, Homo Sapiens
LIQLAKGNL

SEQ ID NO: 1298553 - protein, 9 aa, Homo Sapiens
QQLKVWHCW

SEQ ID NO: 1298554 - protein, 9 aa, Homo Sapiens
LVAQRLQQL

SEQ ID NO: 1298555 - protein, 9 aa, Homo Sapiens
VDRRVFIAW

SEQ ID NO: 1298556 - protein, 9 aa, Homo Sapiens
LNTVSLMNV

SEQ ID NO: 1298557 - protein, 9 aa, Homo Sapiens
NRRANVALP

SEQ ID NO: 1298558 - protein, 9 aa, Homo Sapiens
DKFFAYLPL

SEQ ID NO: 1298559 - protein, 9 aa, Homo Sapiens
VITEQVKPL

SEQ ID NO: 1298560 - protein, 9 aa, Homo Sapiens
QQLVQEQLK

SEQ ID NO: 1298561 - protein, 9 aa, Homo Sapiens
YTGSSSSSD

SEQ ID NO: 1298562 - protein, 9 aa, Homo Sapiens
TVGQKIGSG

SEQ ID NO: 1298563 - protein, 9 aa, Homo Sapiens
CQQPPPFGV

SEQ ID NO: 1298564 - protein, 9 aa, Homo Sapiens
KAQDAAAME

SEQ ID NO: 1298565 - protein, 9 aa, Homo Sapiens
AQDAAAMEM

SEQ ID NO: 1298566 - protein, 9 aa, Homo Sapiens
NVALPQEPS

SEQ ID NO: 1298567 - protein, 9 aa, Homo Sapiens
AWLGLYGSS

SEQ ID NO: 1298568 - protein, 9 aa, Homo Sapiens
LDLERAARN

SEQ ID NO: 1298569 - protein, 9 aa, Homo Sapiens
IREIKNELL

SEQ ID NO: 1298570 - protein, 9 aa, Homo Sapiens
MRIYVTNTQ

SEQ ID NO: 1298571 - protein, 9 aa, Homo Sapiens
DPSVSEQIN

SEQ ID NO: 1298572 - protein, 9 aa, Homo Sapiens
KNKKGKKVK

SEQ ID NO: 1298573 - protein, 9 aa, Homo Sapiens
EKNFLTSAI

SEQ ID NO: 1298574 - protein, 9 aa, Homo Sapiens
FAHRRMTPS

SEQ ID NO: 1298575 - protein, 9 aa, Homo Sapiens
FIPRSYFEV

SEQ ID NO: 1298576 - protein, 9 aa, Homo Sapiens
DWSTCRLVR

SEQ ID NO: 1298577 - protein, 9 aa, Homo Sapiens
QKIGSGSFG

SEQ ID NO: 1298578 - protein, 9 aa, Homo Sapiens
ETETPRWQR

SEQ ID NO: 1298579 - protein, 9 aa, Homo Sapiens
WSLKILHTD

SEQ ID NO: 1298580 - protein, 9 aa, Homo Sapiens
CFGSLAPAP

SEQ ID NO: 1298581 - protein, 9 aa, Homo Sapiens
ELLGYFSLF

SEQ ID NO: 1298582 - protein, 9 aa, Homo Sapiens
VLKILVNQV

SEQ ID NO: 1298583 - protein, 9 aa, Homo Sapiens
CGSVRKMET

SEQ ID NO: 1298584 - protein, 9 aa, Homo Sapiens
TCEGRKQVL

SEQ ID NO: 1298585 - protein, 9 aa, Homo Sapiens
AQQRIRQTL

SEQ ID NO: 1298586 - protein, 9 aa, Homo Sapiens
GGGGSYNDL

SEQ ID NO: 1298587 - protein, 9 aa, Homo Sapiens
PQKCGHTGV

SEQ ID NO: 1298588 - protein, 9 aa, Homo Sapiens
VRKMETETP

SEQ ID NO: 1298589 - protein, 9 aa, Homo Sapiens
WECTELIYD

SEQ ID NO: 1298590 - protein, 9 aa, Homo Sapiens
SADWLILQA

SEQ ID NO: 1298591 - protein, 9 aa, Homo Sapiens
PLAKHTISS

SEQ ID NO: 1298592 - protein, 9 aa, Homo Sapiens
SALGLDPLG

SEQ ID NO: 1298593 - protein, 9 aa, Homo Sapiens
ETPRWQRFL

SEQ ID NO: 1298594 - protein, 9 aa, Homo Sapiens
RQQCLRVPK

SEQ ID NO: 1298595 - protein, 9 aa, Homo Sapiens
HEGDEVLQI

SEQ ID NO: 1298596 - protein, 9 aa, Homo Sapiens
SWYKYTSTA

SEQ ID NO: 1298597 - protein, 9 aa, Homo Sapiens
RRVFIAWLG

SEQ ID NO: 1298598 - protein, 9 aa, Homo Sapiens
KNNPDALGD

SEQ ID NO: 1298599 - protein, 9 aa, Homo Sapiens
PLGARLVTG

SEQ ID NO: 1298600 - protein, 9 aa, Homo Sapiens
CWRVIAHWN

SEQ ID NO: 1298601 - protein, 9 aa, Homo Sapiens
QDAAAMEMQ

SEQ ID NO: 1298602 - protein, 9 aa, Homo Sapiens
RERALSARK

SEQ ID NO: 1298603 - protein, 9 aa, Homo Sapiens
QKYVSSKRK

SEQ ID NO: 1298604 - protein, 9 aa, Homo Sapiens
SDTETEAEI

SEQ ID NO: 1298605 - protein, 9 aa, Homo Sapiens
GQKIGSGSF

SEQ ID NO: 1298606 - protein, 9 aa, Homo Sapiens
GMDVHNQKE

SEQ ID NO: 1298607 - protein, 9 aa, Homo Sapiens
QKCGHTGVC

SEQ ID NO: 1298608 - protein, 9 aa, Homo Sapiens
ATEFIPRSY

SEQ ID NO: 1298609 - protein, 9 aa, Homo Sapiens
QLEKMVIQT

SEQ ID NO: 1298610 - protein, 9 aa, Homo Sapiens
IADNVVGMS

SEQ ID NO: 1298611 - protein, 9 aa, Homo Sapiens
AKAQDAAAM

SEQ ID NO: 1298612 - protein, 9 aa, Homo Sapiens
EVHVCACPG

SEQ ID NO: 1298613 - protein, 9 aa, Homo Sapiens
QVKPLTVNL

SEQ ID NO: 1298614 - protein, 9 aa, Homo Sapiens
FERVRGPCS

SEQ ID NO: 1298615 - protein, 9 aa, Homo Sapiens
LINFLGHIL

SEQ ID NO: 1298616 - protein, 9 aa, Homo Sapiens
AVHVEFSAD

SEQ ID NO: 1298617 - protein, 9 aa, Homo Sapiens
GGGSYNDLG

SEQ ID NO: 1298618 - protein, 9 aa, Homo Sapiens
HNCTLKFRS

SEQ ID NO: 1298619 - protein, 9 aa, Homo Sapiens
PYSCEGCGQ

SEQ ID NO: 1298620 - protein, 9 aa, Homo Sapiens
SMLEHISKN

SEQ ID NO: 1298621 - protein, 9 aa, Homo Sapiens
HLDPGSAVR

SEQ ID NO: 1298622 - protein, 9 aa, Homo Sapiens
GFTLTCIAD

SEQ ID NO: 1298623 - protein, 9 aa, Homo Sapiens
LQQLVQEQL

SEQ ID NO: 1298624 - protein, 9 aa, Homo Sapiens
TQPKQLEKM

SEQ ID NO: 1298625 - protein, 9 aa, Homo Sapiens
QNLKGENKQ

SEQ ID NO: 1298626 - protein, 9 aa, Homo Sapiens
ILVNQVSVD

SEQ ID NO: 1298627 - protein, 9 aa, Homo Sapiens
ALRGKENER

SEQ ID NO: 1298628 - protein, 9 aa, Homo Sapiens
QSHCEDGGR

SEQ ID NO: 1298629 - protein, 9 aa, Homo Sapiens
YPHSPRARY

SEQ ID NO: 1298630 - protein, 9 aa, Homo Sapiens
GGSYNDLGN

SEQ ID NO: 1298631 - protein, 9 aa, Homo Sapiens
YNSKGTVFL

SEQ ID NO: 1298632 - protein, 9 aa, Homo Sapiens
WYKYTSTAS

SEQ ID NO: 1298633 - protein, 9 aa, Homo Sapiens
LPTSTSCLS

SEQ ID NO: 1298634 - protein, 9 aa, Homo Sapiens
IYDIPLPEH

SEQ ID NO: 1298635 - protein, 9 aa, Homo Sapiens
LDTCDQVFV

SEQ ID NO: 1298636 - protein, 9 aa, Homo Sapiens
CGHACNPAE

SEQ ID NO: 1298637 - protein, 9 aa, Homo Sapiens
LAKGNLNTL

SEQ ID NO: 1298638 - protein, 9 aa, Homo Sapiens
LRVPKNNPD

SEQ ID NO: 1298639 - protein, 9 aa, Homo Sapiens
VSEQINPRN

SEQ ID NO: 1298640 - protein, 9 aa, Homo Sapiens
KIGSGSFGT

SEQ ID NO: 1298641 - protein, 9 aa, Homo Sapiens
FGRVYTLSI

SEQ ID NO: 1298642 - protein, 9 aa, Homo Sapiens
HILHGCVKW

SEQ ID NO: 1298643 - protein, 9 aa, Homo Sapiens
LGRNSFEVH

SEQ ID NO: 1298644 - protein, 9 aa, Homo Sapiens
IEKVLKRIR

SEQ ID NO: 1298645 - protein, 9 aa, Homo Sapiens
ELHKDSDCC

SEQ ID NO: 1298646 - protein, 9 aa, Homo Sapiens
LTSLNPVLE

SEQ ID NO: 1298647 - protein, 9 aa, Homo Sapiens
ALVAQRLQQ

SEQ ID NO: 1298648 - protein, 9 aa, Homo Sapiens
FLTSAIRPH

SEQ ID NO: 1298649 - protein, 9 aa, Homo Sapiens
NAPSTATAA

SEQ ID NO: 1298650 - protein, 9 aa, Homo Sapiens
NDLGNYNNQ

SEQ ID NO: 1298651 - protein, 9 aa, Homo Sapiens
KQLKISADL

SEQ ID NO: 1298652 - protein, 9 aa, Homo Sapiens
NVAKPKKAA

SEQ ID NO: 1298653 - protein, 9 aa, Homo Sapiens
VYTLSIAGQ

SEQ ID NO: 1298654 - protein, 9 aa, Homo Sapiens
IPCQQPPPF

SEQ ID NO: 1298655 - protein, 9 aa, Homo Sapiens
RANVALPQE

SEQ ID NO: 1298656 - protein, 9 aa, Homo Sapiens
GVCNGDWST

SEQ ID NO: 1298657 - protein, 9 aa, Homo Sapiens
PTSTSCLST

SEQ ID NO: 1298658 - protein, 9 aa, Homo Sapiens
DPEKNFLTS

SEQ ID NO: 1298659 - protein, 9 aa, Homo Sapiens
GSVRKMETE

SEQ ID NO: 1298660 - protein, 9 aa, Homo Sapiens
KGENKQLKI

SEQ ID NO: 1298661 - protein, 9 aa, Homo Sapiens
ECTELIYDI

SEQ ID NO: 1298662 - protein, 9 aa, Homo Sapiens
KYPHSPRAR

SEQ ID NO: 1298663 - protein, 9 aa, Homo Sapiens
KFFAYLPLA

SEQ ID NO: 1298664 - protein, 9 aa, Homo Sapiens
SGPIAFAHR

SEQ ID NO: 1298665 - protein, 9 aa, Homo Sapiens
EGRKQVLPH

SEQ ID NO: 1298666 - protein, 9 aa, Homo Sapiens
SCLSTSEKT

SEQ ID NO: 1298667 - protein, 9 aa, Homo Sapiens
PRSYFEVFW

SEQ ID NO: 1298668 - protein, 9 aa, Homo Sapiens
DHTCEGRKQ

SEQ ID NO: 1298669 - protein, 9 aa, Homo Sapiens
KENEREMAP

SEQ ID NO: 1298670 - protein, 9 aa, Homo Sapiens
EGCGQAFSQ

SEQ ID NO: 1298671 - protein, 9 aa, Homo Sapiens
DQKPLTSLN

SEQ ID NO: 1298672 - protein, 9 aa, Homo Sapiens
FYIFCACGC

SEQ ID NO: 1298673 - protein, 9 aa, Homo Sapiens
CVKWCGHAC

SEQ ID NO: 1298674 - protein, 9 aa, Homo Sapiens
EFIPRSYFE

SEQ ID NO: 1298675 - protein, 9 aa, Homo Sapiens
KQLEKMVIQ

SEQ ID NO: 1298676 - protein, 9 aa, Homo Sapiens
WVITEQVKP

SEQ ID NO: 1298677 - protein, 9 aa, Homo Sapiens
HGCVKWCGH

SEQ ID NO: 1298678 - protein, 9 aa, Homo Sapiens
CGVCNGDWS

SEQ ID NO: 1298679 - protein, 9 aa, Homo Sapiens
KCGHTGVCN

SEQ ID NO: 1298680 - protein, 9 aa, Homo Sapiens
ALQNGQKNK

SEQ ID NO: 1298681 - protein, 9 aa, Homo Sapiens
QKPLTSLNP

SEQ ID NO: 1298682 - protein, 9 aa, Homo Sapiens
MTQKCIQSG

SEQ ID NO: 1298683 - protein, 9 aa, Homo Sapiens
LHEGDEVLQ

SEQ ID NO: 1298684 - protein, 9 aa, Homo Sapiens
DEVLQINGI

SEQ ID NO: 1298685 - protein, 9 aa, Homo Sapiens
RMTQKCIQS

SEQ ID NO: 1298686 - protein, 9 aa, Homo Sapiens
LMNVLIPKL

SEQ ID NO: 1298687 - protein, 9 aa, Homo Sapiens
FKNTGELQE

SEQ ID NO: 1298688 - protein, 9 aa, Homo Sapiens
YIFCACGCA

SEQ ID NO: 1298689 - protein, 9 aa, Homo Sapiens
KKTSYRERA

SEQ ID NO: 1298690 - protein, 9 aa, Homo Sapiens
PGPNIELHK

SEQ ID NO: 1298691 - protein, 9 aa, Homo Sapiens
KCIQSGHIA

SEQ ID NO: 1298692 - protein, 9 aa, Homo Sapiens
NTVSLMNVL

SEQ ID NO: 1298693 - protein, 9 aa, Homo Sapiens
MDVHNQKER

SEQ ID NO: 1298694 - protein, 9 aa, Homo Sapiens
RNKAKAQDA

SEQ ID NO: 1298695 - protein, 9 aa, Homo Sapiens
EHISKNLVK

SEQ ID NO: 1298696 - protein, 9 aa, Homo Sapiens
CEGCGQAFS

SEQ ID NO: 1298697 - protein, 9 aa, Homo Sapiens
TPRWQRFLS

SEQ ID NO: 1298698 - protein, 9 aa, Homo Sapiens
IPRSYFEVF

SEQ ID NO: 1298699 - protein, 9 aa, Homo Sapiens
KCPMDFLAR

SEQ ID NO: 1298700 - protein, 9 aa, Homo Sapiens
FDQSHCEDG

SEQ ID NO: 1298701 - protein, 9 aa, Homo Sapiens
LDPGSAVRK

SEQ ID NO: 1298702 - protein, 9 aa, Homo Sapiens
QSKSQQLKV

SEQ ID NO: 1298703 - protein, 9 aa, Homo Sapiens
LDPLGARLV

SEQ ID NO: 1298704 - protein, 9 aa, Homo Sapiens
HSPRARYGK

SEQ ID NO: 1298705 - protein, 9 aa, Homo Sapiens
DQPLQVYTG

SEQ ID NO: 1298706 - protein, 9 aa, Homo Sapiens
VLNTVSLMN

SEQ ID NO: 1298707 - protein, 9 aa, Homo Sapiens
EVLQINGIE

SEQ ID NO: 1298708 - protein, 9 aa, Homo Sapiens
GLGWLLLQE

SEQ ID NO: 1298709 - protein, 9 aa, Homo Sapiens
KTSYRERAL

SEQ ID NO: 1298710 - protein, 9 aa, Homo Sapiens
CLRVPKNNP

SEQ ID NO: 1298711 - protein, 9 aa, Homo Sapiens
QKNKKGKKV

SEQ ID NO: 1298712 - protein, 9 aa, Homo Sapiens
TLPTCFGSL

SEQ ID NO: 1298713 - protein, 9 aa, Homo Sapiens
SPMVSVYKH

SEQ ID NO: 1298714 - protein, 9 aa, Homo Sapiens
LKVWHCWRV

SEQ ID NO: 1298715 - protein, 9 aa, Homo Sapiens
GSSPTLPTC

SEQ ID NO: 1298716 - protein, 9 aa, Homo Sapiens
WLGLYGSSS

SEQ ID NO: 1298717 - protein, 9 aa, Homo Sapiens
NVLIPKLPQ

SEQ ID NO: 1298718 - protein, 9 aa, Homo Sapiens
LWSLKILHT

SEQ ID NO: 1298719 - protein, 9 aa, Homo Sapiens
KMETETPRW

SEQ ID NO: 1298720 - protein, 9 aa, Homo Sapiens
VLKRIREIK

SEQ ID NO: 1298721 - protein, 9 aa, Homo Sapiens
QITVGQKIG

SEQ ID NO: 1298722 - protein, 9 aa, Homo Sapiens
TELIYDIPL

SEQ ID NO: 1298723 - protein, 9 aa, Homo Sapiens
KWECTELIY

SEQ ID NO: 1298724 - protein, 9 aa, Homo Sapiens
AFAHRRMTP

SEQ ID NO: 1298725 - protein, 9 aa, Homo Sapiens
SCEGCGQAF

SEQ ID NO: 1298726 - protein, 9 aa, Homo Sapiens
NVVSGTIFD

SEQ ID NO: 1298727 - protein, 9 aa, Homo Sapiens
ALTDGAQFP

SEQ ID NO: 1298728 - protein, 9 aa, Homo Sapiens
PRWQRFLST

SEQ ID NO: 1298729 - protein, 9 aa, Homo Sapiens
VRGPCSDIL

SEQ ID NO: 1298730 - protein, 9 aa, Homo Sapiens
PKKANVAKP

SEQ ID NO: 1298731 - protein, 9 aa, Homo Sapiens
GSYNDLGNY

SEQ ID NO: 1298732 - protein, 9 aa, Homo Sapiens
SQQLKVWHC

SEQ ID NO: 1298733 - protein, 9 aa, Homo Sapiens
AKGKAQQRI

SEQ ID NO: 1298734 - protein, 9 aa, Homo Sapiens
LDAAASSNA

SEQ ID NO: 1298735 - protein, 9 aa, Homo Sapiens
DQSHCEDGG

SEQ ID NO: 1298736 - protein, 9 aa, Homo Sapiens
AGKTGILWK

SEQ ID NO: 1298737 - protein, 9 aa, Homo Sapiens
GPNIELHKD

SEQ ID NO: 1298738 - protein, 9 aa, Homo Sapiens
KWCGHACNP

SEQ ID NO: 1298739 - protein, 9 aa, Homo Sapiens
NEEGAPCTA

SEQ ID NO: 1298740 - protein, 9 aa, Homo Sapiens
HAGIIITIV

SEQ ID NO: 1298741 - protein, 9 aa, Homo Sapiens
QLKVWHCWR

SEQ ID NO: 1298742 - protein, 9 aa, Homo Sapiens
MWFTQKYVS

SEQ ID NO: 1298743 - protein, 9 aa, Homo Sapiens
YVSSKRKRN

SEQ ID NO: 1298744 - protein, 9 aa, Homo Sapiens
RKQHHLDPG

SEQ ID NO: 1298745 - protein, 9 aa, Homo Sapiens
SGTIFDYNY

SEQ ID NO: 1298746 - protein, 9 aa, Homo Sapiens
SSKDHTCEG

SEQ ID NO: 1298747 - protein, 9 aa, Homo Sapiens
VWHCWRVIA

SEQ ID NO: 1298748 - protein, 9 aa, Homo Sapiens
VALRGKENE

SEQ ID NO: 1298749 - protein, 9 aa, Homo Sapiens
GCGQAFSQN

SEQ ID NO: 1298750 - protein, 9 aa, Homo Sapiens
RELLGYFSL

SEQ ID NO: 1298751 - protein, 9 aa, Homo Sapiens
AASSNAPST

SEQ ID NO: 1298752 - protein, 9 aa, Homo Sapiens
WCGHACNPA

SEQ ID NO: 1298753 - protein, 9 aa, Homo Sapiens
TCDQVFVWV

SEQ ID NO: 1298754 - protein, 9 aa, Homo Sapiens
TYLRHKRTH

SEQ ID NO: 1298755 - protein, 9 aa, Homo Sapiens
EFSADWLIL

SEQ ID NO: 1298756 - protein, 9 aa, Homo Sapiens
NKQLKISAD

SEQ ID NO: 1298757 - protein, 9 aa, Homo Sapiens
SKDHTCEGR

SEQ ID NO: 1298758 - protein, 9 aa, Homo Sapiens
NQKERPRKT

SEQ ID NO: 1298759 - protein, 9 aa, Homo Sapiens
VSVDDVNVL

SEQ ID NO: 1298760 - protein, 9 aa, Homo Sapiens
MLTDPSVSE

SEQ ID NO: 1298761 - protein, 9 aa, Homo Sapiens
MVSVYKHQS

SEQ ID NO: 1298762 - protein, 9 aa, Homo Sapiens
HTCEGRKQV

SEQ ID NO: 1298763 - protein, 9 aa, Homo Sapiens
SATEFIPRS

SEQ ID NO: 1298764 - protein, 9 aa, Homo Sapiens
QQNLKGENK

SEQ ID NO: 1298765 - protein, 9 aa, Homo Sapiens
KGMDVHNQK

SEQ ID NO: 1298766 - protein, 9 aa, Homo Sapiens
FEVHVCACP

SEQ ID NO: 1298767 - protein, 9 aa, Homo Sapiens
QPPPFGVPV

SEQ ID NO: 1298768 - protein, 9 aa, Homo Sapiens
TGVCNNRRN

SEQ ID NO: 1298769 - protein, 9 aa, Homo Sapiens
KIEKVLKRI

SEQ ID NO: 1298770 - protein, 9 aa, Homo Sapiens
GCVKWCGHA

SEQ ID NO: 1298771 - protein, 9 aa, Homo Sapiens
ERALSARKN

SEQ ID NO: 1298772 - protein, 9 aa, Homo Sapiens
HACNPAETR

SEQ ID NO: 1298773 - protein, 9 aa, Homo Sapiens
CIADNVVGM

SEQ ID NO: 1298774 - protein, 9 aa, Homo Sapiens
LQEDLDLER

SEQ ID NO: 1298775 - protein, 9 aa, Homo Sapiens
KKANVAKPK

SEQ ID NO: 1298776 - protein, 9 aa, Homo Sapiens
HCMRIYVTN

SEQ ID NO: 1298777 - protein, 9 aa, Homo Sapiens
SCGSVRKME

SEQ ID NO: 1298778 - protein, 9 aa, Homo Sapiens
QKERPRKTL

SEQ ID NO: 1298779 - protein, 9 aa, Homo Sapiens
LGNYNNQSS

SEQ ID NO: 1298780 - protein, 9 aa, Homo Sapiens
FIAWLGLYG

SEQ ID NO: 1298781 - protein, 9 aa, Homo Sapiens
LKEIRLENE

SEQ ID NO: 1298782 - protein, 9 aa, Homo Sapiens
PFDQSHCED

SEQ ID NO: 1298783 - protein, 9 aa, Homo Sapiens
LQVYTGSSS

SEQ ID NO: 1298784 - protein, 9 aa, Homo Sapiens
GRNSFEVHV

SEQ ID NO: 1298785 - protein, 9 aa, Homo Sapiens
SVRKMETET

SEQ ID NO: 1298786 - protein, 9 aa, Homo Sapiens
CSLKIRGID

SEQ ID NO: 1298787 - protein, 9 aa, Homo Sapiens
EKPPASPLR

SEQ ID NO: 1298788 - protein, 9 aa, Homo Sapiens
GHACNPAET

SEQ ID NO: 1298789 - protein, 9 aa, Homo Sapiens
NIELHKDSD

SEQ ID NO: 1298790 - protein, 9 aa, Homo Sapiens
MLEHISKNL

SEQ ID NO: 1298791 - protein, 9 aa, Homo Sapiens
PSVSEQINP

SEQ ID NO: 1298792 - protein, 9 aa, Homo Sapiens
SLKIRGIDA

SEQ ID NO: 1298793 - protein, 9 aa, Homo Sapiens
VSVYKHQSP

SEQ ID NO: 1298794 - protein, 9 aa, Homo Sapiens
ENEEGAPCT

SEQ ID NO: 1298795 - protein, 9 aa, Homo Sapiens
PKQLEKMVI

SEQ ID NO: 1298796 - protein, 9 aa, Homo Sapiens
QCLRVPKNN

SEQ ID NO: 1298797 - protein, 9 aa, Homo Sapiens
DVMLLDTCD

SEQ ID NO: 1298798 - protein, 9 aa, Homo Sapiens
ATGLGWLLL

SEQ ID NO: 1298799 - protein, 9 aa, Homo Sapiens
CTELIYDIP

SEQ ID NO: 1298800 - protein, 9 aa, Homo Sapiens
YSTYLRHKR

SEQ ID NO: 1298801 - protein, 9 aa, Homo Sapiens
LSNSFKNTG

SEQ ID NO: 1298802 - protein, 9 aa, Homo Sapiens
IYVTNTQKE

SEQ ID NO: 1298803 - protein, 9 aa, Homo Sapiens
GEKPYSCEG

SEQ ID NO: 1298804 - protein, 9 aa, Homo Sapiens
GTIFDYNYD

SEQ ID NO: 1298805 - protein, 9 aa, Homo Sapiens
FFAYLPLAK

SEQ ID NO: 1298806 - protein, 9 aa, Homo Sapiens
RKMETETPR

SEQ ID NO: 1298807 - protein, 9 aa, Homo Sapiens
QEDLDLERA

SEQ ID NO: 1298808 - protein, 9 aa, Homo Sapiens
MNVLIPKLP

SEQ ID NO: 1298809 - protein, 9 aa, Homo Sapiens
SLMNVLIPK

SEQ ID NO: 1298810 - protein, 9 aa, Homo Sapiens
QRIRQTLKQ

SEQ ID NO: 1298811 - protein, 9 aa, Homo Sapiens
CDQVFVWVG

SEQ ID NO: 1298812 - protein, 9 aa, Homo Sapiens
KTAPRATCW

SEQ ID NO: 1298813 - protein, 9 aa, Homo Sapiens
LPFDQSHCE

SEQ ID NO: 1298814 - protein, 9 aa, Homo Sapiens
GLDPLGARL

SEQ ID NO: 1298815 - protein, 9 aa, Homo Sapiens
GTVFLQLMP

SEQ ID NO: 1298816 - protein, 9 aa, Homo Sapiens
NKAKAQDAA

SEQ ID NO: 1298817 - protein, 9 aa, Homo Sapiens
DDVMLLDTC

SEQ ID NO: 1298818 - protein, 9 aa, Homo Sapiens
DPGSAVRKT

SEQ ID NO: 1298819 - protein, 9 aa, Homo Sapiens
RGPCSDILK

SEQ ID NO: 1298820 - protein, 9 aa, Homo Sapiens
ETEAEIFNS

SEQ ID NO: 1298821 - protein, 9 aa, Homo Sapiens
IRGIDAKEE

SEQ ID NO: 1298822 - protein, 9 aa, Homo Sapiens
PKHAGIIIT

SEQ ID NO: 1298823 - protein, 9 aa, Homo Sapiens
LIYDIPLPE

SEQ ID NO: 1298824 - protein, 9 aa, Homo Sapiens
VFIAWLGLY

SEQ ID NO: 1298825 - protein, 9 aa, Homo Sapiens
YDQPLQVYT

SEQ ID NO: 1298826 - protein, 9 aa, Homo Sapiens
QHHLDPGSA

SEQ ID NO: 1298827 - protein, 9 aa, Homo Sapiens
LHKDSDCCS

SEQ ID NO: 1298828 - protein, 9 aa, Homo Sapiens
DTWVITEQV

SEQ ID NO: 1298829 - protein, 9 aa, Homo Sapiens
PLQVYTGSS

SEQ ID NO: 1298830 - protein, 9 aa, Homo Sapiens
YSDTETEAE

SEQ ID NO: 1298831 - protein, 9 aa, Homo Sapiens
FSADWLILQ

SEQ ID NO: 1298832 - protein, 9 aa, Homo Sapiens
ETFATGLGW

SEQ ID NO: 1298833 - protein, 9 aa, Homo Sapiens
NGVNVVSGT

SEQ ID NO: 1298834 - protein, 9 aa, Homo Sapiens
PSMLEHISK

SEQ ID NO: 1298835 - protein, 9 aa, Homo Sapiens
KHAGIIITI

SEQ ID NO: 1298836 - protein, 9 aa, Homo Sapiens
TSATEFIPR

SEQ ID NO: 1298837 - protein, 9 aa, Homo Sapiens
FLARDAPDT

SEQ ID NO: 1298838 - protein, 9 aa, Homo Sapiens
QHNCTLKFR

SEQ ID NO: 1298839 - protein, 9 aa, Homo Sapiens
CPMDFLARD

SEQ ID NO: 1298840 - protein, 9 aa, Homo Sapiens
QRFLSTLPT

SEQ ID NO: 1298841 - protein, 9 aa, Homo Sapiens
DLGNYNNQS

SEQ ID NO: 1298842 - protein, 9 aa, Homo Sapiens
RALSARKNE

SEQ ID NO: 1298843 - protein, 9 aa, Homo Sapiens
KNFLTSAIR

SEQ ID NO: 1298844 - protein, 9 aa, Homo Sapiens
RVRGPCSDI

SEQ ID NO: 1298845 - protein, 9 aa, Homo Sapiens
VRKYPHSPR

SEQ ID NO: 1298846 - protein, 9 aa, Homo Sapiens
DLDLERAAR

SEQ ID NO: 1298847 - protein, 9 aa, Homo Sapiens
GYFSLFLIR

SEQ ID NO: 1298848 - protein, 9 aa, Homo Sapiens
ADWLILQAL

SEQ ID NO: 1298849 - protein, 9 aa, Homo Sapiens
KELVRKYPH

SEQ ID NO: 1298850 - protein, 9 aa, Homo Sapiens
THTKENIYQ

SEQ ID NO: 1298851 - protein, 9 aa, Homo Sapiens
TSTASTGIT

SEQ ID NO: 1298852 - protein, 9 aa, Homo Sapiens
ENKQLKISA

SEQ ID NO: 1298853 - protein, 9 aa, Homo Sapiens
EDLDLERAA

SEQ ID NO: 1298854 - protein, 9 aa, Homo Sapiens
IAHWNLINF

SEQ ID NO: 1298855 - protein, 9 aa, Homo Sapiens
DGQITVGQK

SEQ ID NO: 1298856 - protein, 9 aa, Homo Sapiens
YTLSIAGQY

SEQ ID NO: 1298857 - protein, 9 aa, Homo Sapiens
LGETFATGL

SEQ ID NO: 1298858 - protein, 9 aa, Homo Sapiens
VKWCGHACN

SEQ ID NO: 1298859 - protein, 9 aa, Homo Sapiens
YRERALSAR

SEQ ID NO: 1298860 - protein, 9 aa, Homo Sapiens
SNSFKNTGE

SEQ ID NO: 1298861 - protein, 9 aa, Homo Sapiens
DTETEAEIF

SEQ ID NO: 1298862 - protein, 9 aa, Homo Sapiens
IAWLGLYGS

SEQ ID NO: 1298863 - protein, 9 aa, Homo Sapiens
ILHTDVKPS

SEQ ID NO: 1298864 - protein, 9 aa, Homo Sapiens
NIYQCSKCG

SEQ ID NO: 1298865 - protein, 9 aa, Homo Sapiens
EQVKPLTVN

SEQ ID NO: 1298866 - protein, 9 aa, Homo Sapiens
IQLAKGNLN

SEQ ID NO: 1298867 - protein, 9 aa, Homo Sapiens
RVIAHWNLI

SEQ ID NO: 1298868 - protein, 9 aa, Homo Sapiens
SSNAPSTAT

SEQ ID NO: 1298869 - protein, 9 aa, Homo Sapiens
IKSPMVSVY

SEQ ID NO: 1298870 - protein, 9 aa, Homo Sapiens
FDQHNCTLK

SEQ ID NO: 1298871 - protein, 9 aa, Homo Sapiens
NEEKPPASP

SEQ ID NO: 1298872 - protein, 9 aa, Homo Sapiens
LYDQPLQVY

SEQ ID NO: 1298873 - protein, 9 aa, Homo Sapiens
GETFATGLG

SEQ ID NO: 1298874 - protein, 9 aa, Homo Sapiens
VGQKIGSGS

SEQ ID NO: 1298875 - protein, 9 aa, Homo Sapiens
VEFSADWLI

SEQ ID NO: 1298876 - protein, 9 aa, Homo Sapiens
GLSLSNSFK

SEQ ID NO: 1298877 - protein, 9 aa, Homo Sapiens
QQRIRQTLK

SEQ ID NO: 1298878 - protein, 9 aa, Homo Sapiens
TGRMTQKCI

SEQ ID NO: 1298879 - protein, 9 aa, Homo Sapiens
VPKNNPDAL

SEQ ID NO: 1298880 - protein, 9 aa, Homo Sapiens
ERVRGPCSD

SEQ ID NO: 1298881 - protein, 9 aa, Homo Sapiens
GSAVRKTKR

SEQ ID NO: 1298882 - protein, 9 aa, Homo Sapiens
VSSKRKRNM

SEQ ID NO: 1298883 - protein, 9 aa, Homo Sapiens
QPKQLEKMV

SEQ ID NO: 1298884 - protein, 9 aa, Homo Sapiens
YQCSKCGKS

SEQ ID NO: 1298885 - protein, 9 aa, Homo Sapiens
KPLTSLNPV

SEQ ID NO: 1298886 - protein, 9 aa, Homo Sapiens
PEKNFLTSA

SEQ ID NO: 1298887 - protein, 9 aa, Homo Sapiens
SFEVHVCAC

SEQ ID NO: 1298888 - protein, 9 aa, Homo Sapiens
PLTSLNPVL

SEQ ID NO: 1298889 - protein, 9 aa, Homo Sapiens
RLQQLVQEQ

SEQ ID NO: 1298890 - protein, 9 aa, Homo Sapiens
ANVAKPKKA

SEQ ID NO: 1298891 - protein, 9 aa, Homo Sapiens
TQKYVSSKR

SEQ ID NO: 1298892 - protein, 9 aa, Homo Sapiens
RIREIKNEL

SEQ ID NO: 1298893 - protein, 9 aa, Homo Sapiens
MDFLARDAP

SEQ ID NO: 1298894 - protein, 9 aa, Homo Sapiens
TNTQKEWLI

SEQ ID NO: 1298895 - protein, 9 aa, Homo Sapiens
GHILHGCVK

SEQ ID NO: 1298896 - protein, 9 aa, Homo Sapiens
SYRERALSA

SEQ ID NO: 1298897 - protein, 9 aa, Homo Sapiens
HISKNLVKE

SEQ ID NO: 1298898 - protein, 9 aa, Homo Sapiens
NLINFLGHI

SEQ ID NO: 1298899 - protein, 9 aa, Homo Sapiens
WNLINFLGH

SEQ ID NO: 1298900 - protein, 9 aa, Homo Sapiens
CLSTSEKTA

SEQ ID NO: 1298901 - protein, 9 aa, Homo Sapiens
RWQRFLSTL

SEQ ID NO: 1298902 - protein, 9 aa, Homo Sapiens
VNQVSVDDV

SEQ ID NO: 1298903 - protein, 9 aa, Homo Sapiens
GDWSTCRLV

SEQ ID NO: 1298904 - protein, 9 aa, Homo Sapiens
VSLMNVLIP

SEQ ID NO: 1298905 - protein, 9 aa, Homo Sapiens
WQRFLSTLP

SEQ ID NO: 1298906 - protein, 9 aa, Homo Sapiens
AHRRMTPSS

SEQ ID NO: 1298907 - protein, 9 aa, Homo Sapiens
TCFGSLAPA

SEQ ID NO: 1298908 - protein, 9 aa, Homo Sapiens
PKNNPDALG

SEQ ID NO: 1298909 - protein, 9 aa, Homo Sapiens
HNQKERPRK

SEQ ID NO: 1298910 - protein, 9 aa, Homo Sapiens
YVTNTQKEW

SEQ ID NO: 1298911 - protein, 9 aa, Homo Sapiens
ALKEIRLEN

SEQ ID NO: 1298912 - protein, 9 aa, Homo Sapiens
IAFAHRRMT

SEQ ID NO: 1298913 - protein, 9 aa, Homo Sapiens
ICAGKTGIL

SEQ ID NO: 1298914 - protein, 9 aa, Homo Sapiens
KSPKKANVA

SEQ ID NO: 1298915 - protein, 9 aa, Homo Sapiens
KYVSSKRKR

SEQ ID NO: 1298916 - protein, 9 aa, Homo Sapiens
PCQQPPPFG

SEQ ID NO: 1298917 - protein, 9 aa, Homo Sapiens
PRFERVRGP

SEQ ID NO: 1298918 - protein, 9 aa, Homo Sapiens
SLNPVLELE

SEQ ID NO: 1298919 - protein, 9 aa, Homo Sapiens
LPTCFGSLA

SEQ ID NO: 1298920 - protein, 9 aa, Homo Sapiens
HPQKCGHTG

SEQ ID NO: 1298921 - protein, 9 aa, Homo Sapiens
METETPRWQ

SEQ ID NO: 1298922 - protein, 9 aa, Homo Sapiens
QPLQVYTGS

SEQ ID NO: 1298923 - protein, 9 aa, Homo Sapiens
KMWFTQKYV

SEQ ID NO: 1298924 - protein, 9 aa, Homo Sapiens
KEIRLENEE

SEQ ID NO: 1298925 - protein, 9 aa, Homo Sapiens
HTGVCNNRR

SEQ ID NO: 1298926 - protein, 9 aa, Homo Sapiens
VFYIFCACG

SEQ ID NO: 1298927 - protein, 9 aa, Homo Sapiens
HWNLINFLG

SEQ ID NO: 1298928 - protein, 9 aa, Homo Sapiens
PFDQHNCTL

SEQ ID NO: 1298929 - protein, 9 aa, Homo Sapiens
WHCWRVIAH

SEQ ID NO: 1298930 - protein, 9 aa, Homo Sapiens
IAGQYWEMC

SEQ ID NO: 1298931 - protein, 9 aa, Homo Sapiens
SLKILHTDV

SEQ ID NO: 1298932 - protein, 9 aa, Homo Sapiens
TWVITEQVK

SEQ ID NO: 1298933 - protein, 9 aa, Homo Sapiens
TEAEIFNSL

SEQ ID NO: 1298934 - protein, 9 aa, Homo Sapiens
TETEAEIFN

SEQ ID NO: 1298935 - protein, 9 aa, Homo Sapiens
DLERAARNK

SEQ ID NO: 1298936 - protein, 9 aa, Homo Sapiens
SSPTLPTCF

SEQ ID NO: 1298937 - protein, 9 aa, Homo Sapiens
TCIADNVVG

SEQ ID NO: 1298938 - protein, 9 aa, Homo Sapiens
TVFLQLMPA

SEQ ID NO: 1298939 - protein, 9 aa, Homo Sapiens
FLGHILHGC

SEQ ID NO: 1298940 - protein, 9 aa, Homo Sapiens
STYLRHKRT

SEQ ID NO: 1298941 - protein, 9 aa, Homo Sapiens
AKGNLNTLV

SEQ ID NO: 1298942 - protein, 9 aa, Homo Sapiens
RKYPHSPRA

SEQ ID NO: 1298943 - protein, 9 aa, Homo Sapiens
LRHKRTHTG

SEQ ID NO: 1298944 - protein, 9 aa, Homo Sapiens
IDAKEEKSL

SEQ ID NO: 1298945 - protein, 9 aa, Homo Sapiens
LEHISKNLV

SEQ ID NO: 1298946 - protein, 9 aa, Homo Sapiens
NTGRMTQKC

SEQ ID NO: 1298947 - protein, 9 aa, Homo Sapiens
KSQQLKVWH

SEQ ID NO: 1298948 - protein, 9 aa, Homo Sapiens
KGNLNTLVT

SEQ ID NO: 1298949 - protein, 9 aa, Homo Sapiens
CACGCAVCL

SEQ ID NO: 1298950 - protein, 9 aa, Homo Sapiens
GILWKNCEF

SEQ ID NO: 1298951 - protein, 9 aa, Homo Sapiens
TASTGITDL

SEQ ID NO: 1298952 - protein, 9 aa, Homo Sapiens
TDVKPSNML

SEQ ID NO: 1298953 - protein, 9 aa, Homo Sapiens
IIITIVWII

SEQ ID NO: 1298954 - protein, 9 aa, Homo Sapiens
HHLDPGSAV

SEQ ID NO: 1298955 - protein, 9 aa, Homo Sapiens
HTDVKPSNM

SEQ ID NO: 1298956 - protein, 9 aa, Homo Sapiens
GLDAAASSN

SEQ ID NO: 1298957 - protein, 9 aa, Homo Sapiens
ELIYDIPLP

SEQ ID NO: 1298958 - protein, 9 aa, Homo Sapiens
CEGRKQVLP

SEQ ID NO: 1298959 - protein, 9 aa, Homo Sapiens
YKYTSTAST

SEQ ID NO: 1298960 - protein, 9 aa, Homo Sapiens
LQNGQKNKK

SEQ ID NO: 1298961 - protein, 9 aa, Homo Sapiens
CLGETFATG

SEQ ID NO: 1298962 - protein, 9 aa, Homo Sapiens
EAICAGKTG

SEQ ID NO: 1298963 - protein, 9 aa, Homo Sapiens
IYQCSKCGK

SEQ ID NO: 1298964 - protein, 9 aa, Homo Sapiens
DKKTSYRER

SEQ ID NO: 1298965 - protein, 9 aa, Homo Sapiens
QMKETQPKQ

SEQ ID NO: 1298966 - protein, 9 aa, Homo Sapiens
LNPVLELEL

SEQ ID NO: 1298967 - protein, 9 aa, Homo Sapiens
RIRQTLKQQ

SEQ ID NO: 1298968 - protein, 9 aa, Homo Sapiens
STSEKTAPR

SEQ ID NO: 1298969 - protein, 9 aa, Homo Sapiens
KANVAKPKK

SEQ ID NO: 1298970 - protein, 9 aa, Homo Sapiens
PGSAVRKTK

SEQ ID NO: 1298971 - protein, 9 aa, Homo Sapiens
ESNRRANVA

SEQ ID NO: 1298972 - protein, 9 aa, Homo Sapiens
IRLENEEGA

SEQ ID NO: 1298973 - protein, 9 aa, Homo Sapiens
TSAIRPHGI

SEQ ID NO: 1298974 - protein, 9 aa, Homo Sapiens
HRRMTPSSM

SEQ ID NO: 1298975 - protein, 9 aa, Homo Sapiens
TPGPNIELH

SEQ ID NO: 1298976 - protein, 9 aa, Homo Sapiens
AYLPLAKHT

SEQ ID NO: 1298977 - protein, 9 aa, Homo Sapiens
EGDEVLQIN

SEQ ID NO: 1298978 - protein, 9 aa, Homo Sapiens
EKPYSCEGC

SEQ ID NO: 1298979 - protein, 9 aa, Homo Sapiens
CRELLGYFS

SEQ ID NO: 1298980 - protein, 9 aa, Homo Sapiens
LTDPSVSEQ

SEQ ID NO: 1298981 - protein, 9 aa, Homo Sapiens
VHVEFSADW

SEQ ID NO: 1298982 - protein, 9 aa, Homo Sapiens
AICAGKTGI

SEQ ID NO: 1298983 - protein, 9 aa, Homo Sapiens
NFLTSAIRP

SEQ ID NO: 1298984 - protein, 9 aa, Homo Sapiens
DFLARDAPD

SEQ ID NO: 1298985 - protein, 9 aa, Homo Sapiens
YLRHKRTHT

SEQ ID NO: 1298986 - protein, 9 aa, Homo Sapiens
RFLSTLPTS

SEQ ID NO: 1298987 - protein, 9 aa, Homo Sapiens
ITVGQKIGS

SEQ ID NO: 1298988 - protein, 9 aa, Homo Sapiens
GHTGVCNNR

SEQ ID NO: 1298989 - protein, 9 aa, Homo Sapiens
WSTCRLVRG

SEQ ID NO: 1298990 - protein, 9 aa, Homo Sapiens
NLKGENKQL

SEQ ID NO: 1298991 - protein, 9 aa, Homo Sapiens
GQKNKKGKK

SEQ ID NO: 1298992 - protein, 9 aa, Homo Sapiens
KILVNQVSV

SEQ ID NO: 1298993 - protein, 9 aa, Homo Sapiens
KAQQRIRQT

SEQ ID NO: 1298994 - protein, 9 aa, Homo Sapiens
AQRLQQLVQ

SEQ ID NO: 1298995 - protein, 9 aa, Homo Sapiens
TEFIPRSYF

SEQ ID NO: 1298996 - protein, 9 aa, Homo Sapiens
HKDSDCCSC

SEQ ID NO: 1298997 - protein, 9 aa, Homo Sapiens
PTLPTCFGS

SEQ ID NO: 1298998 - protein, 9 aa, Homo Sapiens
LLKCPMDFL

SEQ ID NO: 1298999 - protein, 9 aa, Homo Sapiens
SPKKANVAK

SEQ ID NO: 1299000 - protein, 9 aa, Homo Sapiens
GAKGKAQQR

SEQ ID NO: 1299001 - protein, 9 aa, Homo Sapiens
ANVALPQEP

SEQ ID NO: 1299002 - protein, 9 aa, Homo Sapiens
LTCIADNVV

SEQ ID NO: 1299003 - protein, 9 aa, Homo Sapiens
LSLSNSFKN

SEQ ID NO: 1299004 - protein, 9 aa, Homo Sapiens
FCACGCAVC

SEQ ID NO: 1299005 - protein, 9 aa, Homo Sapiens
YFSLFLIRF

SEQ ID NO: 1299006 - protein, 9 aa, Homo Sapiens
LKILHTDVK

SEQ ID NO: 1299007 - protein, 9 aa, Homo Sapiens
KRIREIKNE

SEQ ID NO: 1299008 - protein, 9 aa, Homo Sapiens
DQHNCTLKF

SEQ ID NO: 1299009 - protein, 9 aa, Homo Sapiens
LGHILHGCV

SEQ ID NO: 1299010 - protein, 9 aa, Homo Sapiens
CHPQKCGHT

SEQ ID NO: 1299011 - protein, 9 aa, Homo Sapiens
TGILWKNCE

SEQ ID NO: 1299012 - protein, 9 aa, Homo Sapiens
HCWRVIAHW

SEQ ID NO: 1299013 - protein, 9 aa, Homo Sapiens
DPLGARLVT

SEQ ID NO: 1299014 - protein, 9 aa, Homo Sapiens
VTSATEFIP

SEQ ID NO: 1299015 - protein, 9 aa, Homo Sapiens
DTCDQVFVW

SEQ ID NO: 1299016 - protein, 9 aa, Homo Sapiens
GKENEREMA

SEQ ID NO: 1299017 - protein, 9 aa, Homo Sapiens
SVYKHQSPS

SEQ ID NO: 1299018 - protein, 9 aa, Homo Sapiens
GPIAFAHRR

SEQ ID NO: 1299019 - protein, 9 aa, Homo Sapiens
SYNDLGNYN

SEQ ID NO: 1299020 - protein, 9 aa, Homo Sapiens
TEQVKPLTV

SEQ ID NO: 1299021 - protein, 9 aa, Homo Sapiens
LTSAIRPHG

SEQ ID NO: 1299022 - protein, 9 aa, Homo Sapiens
VLQINGIEI

SEQ ID NO: 1299023 - protein, 9 aa, Homo Sapiens
SAIRPHGIF

SEQ ID NO: 1299024 - protein, 9 aa, Homo Sapiens
STSCLSTSE

SEQ ID NO: 1299025 - protein, 9 aa, Homo Sapiens
CGLSLSNSF

SEQ ID NO: 1299026 - protein, 9 aa, Homo Sapiens
DAKEEKSLH

SEQ ID NO: 1299027 - protein, 9 aa, Homo Sapiens
PMDFLARDA

SEQ ID NO: 1299028 - protein, 9 aa, Homo Sapiens
CNGDWSTCR

SEQ ID NO: 1299029 - protein, 9 aa, Homo Sapiens
GIDAKEEKS

SEQ ID NO: 1299030 - protein, 9 aa, Homo Sapiens
KENIYQCSK

SEQ ID NO: 1299031 - protein, 9 aa, Homo Sapiens
NQVSVDDVN

SEQ ID NO: 1299032 - protein, 9 aa, Homo Sapiens
TLPTSTSCL

SEQ ID NO: 1299033 - protein, 9 aa, Homo Sapiens
FAYLPLAKH

SEQ ID NO: 1299034 - protein, 9 aa, Homo Sapiens
RLENEEGAP

SEQ ID NO: 1299035 - protein, 9 aa, Homo Sapiens
KPYSCEGCG

SEQ ID NO: 1299036 - protein, 9 aa, Homo Sapiens
RTPKHAGII

SEQ ID NO: 1299037 - protein, 9 aa, Homo Sapiens
WPMVFYIFC

SEQ ID NO: 1299038 - protein, 9 aa, Homo Sapiens
SLFLIRFGK

SEQ ID NO: 1299039 - protein, 9 aa, Homo Sapiens
IFCACGCAV

SEQ ID NO: 1299040 - protein, 9 aa, Homo Sapiens
QNGQKNKKG

SEQ ID NO: 1299041 - protein, 9 aa, Homo Sapiens
LGARLVTGG

SEQ ID NO: 1299042 - protein, 9 aa, Homo Sapiens
ETQPKQLEK

SEQ ID NO: 1299043 - protein, 9 aa, Homo Sapiens
VALPQEPSS

SEQ ID NO: 1299044 - protein, 9 aa, Homo Sapiens
KSPMVSVYK

SEQ ID NO: 1299045 - protein, 9 aa, Homo Sapiens
VFLQLMPAA

SEQ ID NO: 1299046 - protein, 9 aa, Homo Sapiens
NGDWSTCRL

SEQ ID NO: 1299047 - protein, 9 aa, Homo Sapiens
PPPFGVPVS

SEQ ID NO: 1299048 - protein, 9 aa, Homo Sapiens
AAEALTDGA

SEQ ID NO: 1299049 - protein, 9 aa, Homo Sapiens
MVFYIFCAC

SEQ ID NO: 1299050 - protein, 9 aa, Homo Sapiens
EAEIFNSLV

SEQ ID NO: 1299051 - protein, 9 aa, Homo Sapiens
DNEEKPPAS

SEQ ID NO: 1299052 - protein, 9 aa, Homo Sapiens
SFKNTGELQ

SEQ ID NO: 1299053 - protein, 9 aa, Homo Sapiens
AKSPKKANV

SEQ ID NO: 1299054 - protein, 9 aa, Homo Sapiens
TDGAQFPES

SEQ ID NO: 1299055 - protein, 9 aa, Homo Sapiens
ASPLRMNSN

SEQ ID NO: 1299056 - protein, 9 aa, Homo Sapiens
QQCLRVPKN

SEQ ID NO: 1299057 - protein, 9 aa, Homo Sapiens
DLQEDLDLE

SEQ ID NO: 1299058 - protein, 9 aa, Homo Sapiens
SVALRGKEN

SEQ ID NO: 1299059 - protein, 9 aa, Homo Sapiens
RGIDAKEEK

SEQ ID NO: 1299060 - protein, 9 aa, Homo Sapiens
YDIPLPEHR

SEQ ID NO: 1299061 - protein, 9 aa, Homo Sapiens
KPPASPLRM

SEQ ID NO: 1299062 - protein, 9 aa, Homo Sapiens
MLLDTCDQV

SEQ ID NO: 1299063 - protein, 9 aa, Homo Sapiens
SVSEQINPR

SEQ ID NO: 1299064 - protein, 9 aa, Homo Sapiens
QQPPPFGVP

SEQ ID NO: 1299065 - protein, 9 aa, Homo Sapiens
KAAEALTDG

SEQ ID NO: 1299066 - protein, 9 aa, Homo Sapiens
ERLIQLAKG

SEQ ID NO: 1299067 - protein, 9 aa, Homo Sapiens
IKAAEALTD

SEQ ID NO: 1299068 - protein, 9 aa, Homo Sapiens
SKSQQLKVW

SEQ ID NO: 1299069 - protein, 9 aa, Homo Sapiens
KYFPFDQHN

SEQ ID NO: 1299070 - protein, 9 aa, Homo Sapiens
VIAHWNLIN

SEQ ID NO: 1299071 - protein, 9 aa, Homo Sapiens
NGQKNKKGK

SEQ ID NO: 1299072 - protein, 9 aa, Homo Sapiens
TDPSVSEQI

SEQ ID NO: 1299073 - protein, 9 aa, Homo Sapiens
PIAFAHRRM

SEQ ID NO: 1299074 - protein, 9 aa, Homo Sapiens
RALQNGQKN

SEQ ID NO: 1299075 - protein, 9 aa, Homo Sapiens
FSLFLIRFG

SEQ ID NO: 1299076 - protein, 9 aa, Homo Sapiens
NKKGKKVKK

SEQ ID NO: 1299077 - protein, 9 aa, Homo Sapiens
CIQSGHIAT

SEQ ID NO: 1299078 - protein, 9 aa, Homo Sapiens
RPRFERVRG

SEQ ID NO: 1299079 - protein, 9 aa, Homo Sapiens
DAAAMEMQP

SEQ ID NO: 1299080 - protein, 9 aa, Homo Sapiens
RNSFEVHVC

SEQ ID NO: 1299081 - protein, 9 aa, Homo Sapiens
TSEKTAPRA

SEQ ID NO: 1299082 - protein, 9 aa, Homo Sapiens
EALTDGAQF

SEQ ID NO: 1299083 - protein, 9 aa, Homo Sapiens
PMVSVYKHQ

SEQ ID NO: 1299084 - protein, 9 aa, Homo Sapiens
RRMTPSSML

SEQ ID NO: 1299085 - protein, 9 aa, Homo Sapiens
YSCEGCGQA

SEQ ID NO: 1299086 - protein, 9 aa, Homo Sapiens
PASPLRMNS

SEQ ID NO: 1299087 - protein, 9 aa, Homo Sapiens
KTGILWKNC

SEQ ID NO: 1299088 - protein, 9 aa, Homo Sapiens
PMVFYIFCA

SEQ ID NO: 1299089 - protein, 9 aa, Homo Sapiens
KVWHCWRVI

SEQ ID NO: 1299090 - protein, 9 aa, Homo Sapiens
PERLIQLAK

SEQ ID NO: 1299091 - protein, 9 aa, Homo Sapiens
MPSMLEHIS

SEQ ID NO: 1299092 - protein, 9 aa, Homo Sapiens
VTNTQKEWL

SEQ ID NO: 1299093 - protein, 9 aa, Homo Sapiens
LVRKYPHSP

SEQ ID NO: 1299094 - protein, 9 aa, Homo Sapiens
TIFDYNYDG

SEQ ID NO: 1299095 - protein, 9 aa, Homo Sapiens
TQKCIQSGH

SEQ ID NO: 1299096 - protein, 9 aa, Homo Sapiens
CMRIYVTNT

SEQ ID NO: 1299097 - protein, 9 aa, Homo Sapiens
RLIQLAKGN

SEQ ID NO: 1299098 - protein, 9 aa, Homo Sapiens
PHSPRARYG

SEQ ID NO: 1299099 - protein, 9 aa, Homo Sapiens
KVLKRIREI

SEQ ID NO: 1299100 - protein, 9 aa, Homo Sapiens
MYNSKGTVF

SEQ ID NO: 1299101 - protein, 9 aa, Homo Sapiens
TSLNPVLEL

SEQ ID NO: 1299102 - protein, 9 aa, Homo Sapiens
ITEQVKPLT

SEQ ID NO: 1299103 - protein, 9 aa, Homo Sapiens
WRVIAHWNL

SEQ ID NO: 1299104 - protein, 9 aa, Homo Sapiens
LVNQVSVDD

SEQ ID NO: 1299105 - protein, 9 aa, Homo Sapiens
TLSIAGQYW

SEQ ID NO: 1299106 - protein, 9 aa, Homo Sapiens
SEKTAPRAT

SEQ ID NO: 1299107 - protein, 9 aa, Homo Sapiens
DAAASSNAP

SEQ ID NO: 1299108 - protein, 9 aa, Homo Sapiens
GVNVVSGTI

SEQ ID NO: 1299109 - protein, 9 aa, Homo Sapiens
VHVCACPGR

SEQ ID NO: 1299110 - protein, 9 aa, Homo Sapiens
QKCIQSGHI

SEQ ID NO: 1299111 - protein, 9 aa, Homo Sapiens
KERPRKTLV

SEQ ID NO: 1299112 - protein, 9 aa, Homo Sapiens
SEQINPRNT

SEQ ID NO: 1299113 - protein, 9 aa, Homo Sapiens
DVHNQKERP

SEQ ID NO: 1299114 - protein, 9 aa, Homo Sapiens
CAGKTGILW

SEQ ID NO: 1299115 - protein, 9 aa, Homo Sapiens
QVSVDDVNV

SEQ ID NO: 1299116 - protein, 9 aa, Homo Sapiens
VNVVSGTIF

SEQ ID NO: 1299117 - protein, 9 aa, Homo Sapiens
GRKQVLPHS

SEQ ID NO: 1299118 - protein, 9 aa, Homo Sapiens
EEKPPASPL

SEQ ID NO: 1299119 - protein, 9 aa, Homo Sapiens
KLLKCPMDF

SEQ ID NO: 1299120 - protein, 9 aa, Homo Sapiens
FTQKYVSSK

SEQ ID NO: 1299121 - protein, 9 aa, Homo Sapiens
VYTGSSSSS

SEQ ID NO: 1299122 - protein, 9 aa, Homo Sapiens
KAKAQDAAA

SEQ ID NO: 1299123 - protein, 9 aa, Homo Sapiens
SPTLPTCFG

SEQ ID NO: 1299124 - protein, 9 aa, Homo Sapiens
WFTQKYVSS

SEQ ID NO: 1299125 - protein, 9 aa, Homo Sapiens
ILHGCVKWC

SEQ ID NO: 1299126 - protein, 9 aa, Homo Sapiens
QINGIEIRG

SEQ ID NO: 1299127 - protein, 9 aa, Homo Sapiens
ASSNAPSTA

SEQ ID NO: 1299128 - protein, 9 aa, Homo Sapiens
PSVALRGKE

SEQ ID NO: 1299129 - protein, 9 aa, Homo Sapiens
KILHTDVKP

SEQ ID NO: 1299130 - protein, 9 aa, Homo Sapiens
SHCEDGGRA

SEQ ID NO: 1299131 - protein, 9 aa, Homo Sapiens
AEALTDGAQ

SEQ ID NO: 1299132 - protein, 9 aa, Homo Sapiens
KDKFFAYLP

SEQ ID NO: 1299133 - protein, 9 aa, Homo Sapiens
VKYFPFDQH

SEQ ID NO: 1299134 - protein, 9 aa, Homo Sapiens
MKETQPKQL

SEQ ID NO: 1299135 - protein, 9 aa, Homo Sapiens
LKRIREIKN

SEQ ID NO: 1299136 - protein, 9 aa, Homo Sapiens
RGKENEREM

SEQ ID NO: 1299137 - protein, 9 aa, Homo Sapiens
VYKHQSPSL

SEQ ID NO: 1299138 - protein, 9 aa, Homo Sapiens
VSGTIFDYN

SEQ ID NO: 1299139 - protein, 9 aa, Homo Sapiens
TVSLMNVLI

SEQ ID NO: 1299140 - protein, 9 aa, Homo Sapiens
ADNVVGMSN

SEQ ID NO: 1299141 - protein, 9 aa, Homo Sapiens
SIAGQYWEM

SEQ ID NO: 1299142 - protein, 9 aa, Homo Sapiens
AEIFNSLVQ

SEQ ID NO: 1299143 - protein, 9 aa, Homo Sapiens
TSCLSTSEK

SEQ ID NO: 1299144 - protein, 9 aa, Homo Sapiens
VAQRLQQLV

SEQ ID NO: 1299145 - protein, 9 aa, Homo Sapiens
LKIRGIDAK

SEQ ID NO: 1299146 - protein, 9 aa, Homo Sapiens
VAKSPKKAN

SEQ ID NO: 1299147 - protein, 9 aa, Homo Sapiens
LKGENKQLK

SEQ ID NO: 1299148 - protein, 9 aa, Homo Sapiens
KETQPKQLE

SEQ ID NO: 1299149 - protein, 9 aa, Homo Sapiens
LGLDPLGAR

SEQ ID NO: 1299150 - protein, 9 aa, Homo Sapiens
NFLGHILHG

SEQ ID NO: 1299151 - protein, 9 aa, Homo Sapiens
RIYVTNTQK

SEQ ID NO: 1299152 - protein, 9 aa, Homo Sapiens
FATGLGWLL

SEQ ID NO: 1299153 - protein, 9 aa, Homo Sapiens
PPASPLRMN

SEQ ID NO: 1299154 - protein, 9 aa, Homo Sapiens
LQINGIEIR

SEQ ID NO: 1299155 - protein, 9 aa, Homo Sapiens
KYTSTASTG

SEQ ID NO: 1299156 - protein, 9 aa, Homo Sapiens
ACNPAETRI

SEQ ID NO: 1299157 - protein, 9 aa, Homo Sapiens
SPSVALRGK

SEQ ID NO: 1299158 - protein, 9 aa, Homo Sapiens
VSALGLDPL

SEQ ID NO: 1299159 - protein, 9 aa, Homo Sapiens
TESNRRANV

SEQ ID NO: 1299160 - protein, 9 aa, Homo Sapiens
LSIAGQYWE

SEQ ID NO: 1299161 - protein, 9 aa, Homo Sapiens
FLSTLPTST

SEQ ID NO: 1299162 - protein, 9 aa, Homo Sapiens
LSTSEKTAP

SEQ ID NO: 1299163 - protein, 9 aa, Homo Sapiens
YKHQSPSLK

SEQ ID NO: 1299164 - protein, 9 aa, Homo Sapiens
YALVAQRLQ

SEQ ID NO: 1299165 - protein, 9 aa, Homo Sapiens
AHWNLINFL

SEQ ID NO: 1299166 - protein, 9 aa, Homo Sapiens
GDEVLQING

SEQ ID NO: 1299167 - protein, 9 aa, Homo Sapiens
QCSKCGKSF

SEQ ID NO: 1299168 - protein, 9 aa, Homo Sapiens
STASTGITD

SEQ ID NO: 1299169 - protein, 9 aa, Homo Sapiens
QRLQQLVQE

SEQ ID NO: 1299170 - protein, 9 aa, Homo Sapiens
IELHKDSDC

SEQ ID NO: 1299171 - protein, 9 aa, Homo Sapiens
SKGTVFLQL

SEQ ID NO: 1299172 - protein, 9 aa, Homo Sapiens
TPKHAGIII

SEQ ID NO: 1299173 - protein, 9 aa, Homo Sapiens
VMLLDTCDQ

SEQ ID NO: 1299174 - protein, 9 aa, Homo Sapiens
RVPKNNPDA

SEQ ID NO: 1299175 - protein, 9 aa, Homo Sapiens
EKVLKRIRE

SEQ ID NO: 1299176 - protein, 9 aa, Homo Sapiens
RVYTLSIAG

SEQ ID NO: 1299177 - protein, 9 aa, Homo Sapiens
YNDLGNYNN

SEQ ID NO: 1299178 - protein, 9 aa, Homo Sapiens
LSTLPTSTS

SEQ ID NO: 1299179 - protein, 9 aa, Homo Sapiens
KGKAQQRIR

SEQ ID NO: 1299180 - protein, 9 aa, Homo Sapiens
TSTSCLSTS

SEQ ID NO: 1299181 - protein, 9 aa, Homo Sapiens
SIPCQQPPP

SEQ ID NO: 1299182 - protein, 9 aa, Homo Sapiens
DAVHVEFSA

SEQ ID NO: 1299183 - protein, 9 aa, Homo Sapiens
SNAPSTATA

SEQ ID NO: 1299184 - protein, 9 aa, Homo Sapiens
SLSNSFKNT

SEQ ID NO: 1299185 - protein, 9 aa, Homo Sapiens
RVFIAWLGL

SEQ ID NO: 1299186 - protein, 9 aa, Homo Sapiens
LKCPMDFLA

SEQ ID NO: 1299187 - protein, 9 aa, Homo Sapiens
RRANVALPQ

SEQ ID NO: 1299188 - protein, 9 aa, Homo Sapiens
AAASSNAPS

SEQ ID NO: 1299189 - protein, 9 aa, Homo Sapiens
DNVVGMSNA

SEQ ID NO: 1299190 - protein, 9 aa, Homo Sapiens
SDLQEDLDL

SEQ ID NO: 1299191 - protein, 9 aa, Homo Sapiens
ASIPCQQPP

SEQ ID NO: 1299192 - protein, 9 aa, Homo Sapiens
LLDTCDQVF

SEQ ID NO: 1299193 - protein, 9 aa, Homo Sapiens
TKENIYQCS

SEQ ID NO: 1299194 - protein, 9 aa, Homo Sapiens
KIRGIDAKE

SEQ ID NO: 1299195 - protein, 9 aa, Homo Sapiens
GRVYTLSIA

SEQ ID NO: 1299196 - protein, 9 aa, Homo Sapiens
LENEEGAPC

SEQ ID NO: 1299197 - protein, 9 aa, Homo Sapiens
YFPFDQHNC

SEQ ID NO: 1299198 - protein, 9 aa, Homo Sapiens
RFERVRGPC

SEQ ID NO: 1299199 - protein, 9 aa, Homo Sapiens
SASPSIRSA

SEQ ID NO: 1299200 - protein, 9 aa, Homo Sapiens
GEEQARLWR

SEQ ID NO: 1299201 - protein, 9 aa, Homo Sapiens
LCSCCIPDP

SEQ ID NO: 1299202 - protein, 9 aa, Homo Sapiens
AGAVGLSLA

SEQ ID NO: 1299203 - protein, 9 aa, Homo Sapiens
LDFDLSSNS

SEQ ID NO: 1299204 - protein, 9 aa, Homo Sapiens
GLDVEGERH

SEQ ID NO: 1299205 - protein, 9 aa, Homo Sapiens
PSKRTQPDK

SEQ ID NO: 1299206 - protein, 9 aa, Homo Sapiens
WGTMATIQC

SEQ ID NO: 1299207 - protein, 9 aa, Homo Sapiens
PLLAMLSNT

SEQ ID NO: 1299208 - protein, 9 aa, Homo Sapiens
CWGWQQSWE

SEQ ID NO: 1299209 - protein, 9 aa, Homo Sapiens
QPGQPPFRR

SEQ ID NO: 1299210 - protein, 9 aa, Homo Sapiens
KPYECECGK

SEQ ID NO: 1299211 - protein, 9 aa, Homo Sapiens
PDSPVALGM

SEQ ID NO: 1299212 - protein, 9 aa, Homo Sapiens
ETTALSPEA

SEQ ID NO: 1299213 - protein, 9 aa, Homo Sapiens
LGVAHLQRA

SEQ ID NO: 1299214 - protein, 9 aa, Homo Sapiens
RSTVKPHLQ

SEQ ID NO: 1299215 - protein, 9 aa, Homo Sapiens
LGSCPGPGA

SEQ ID NO: 1299216 - protein, 9 aa, Homo Sapiens
ELPMLTYHV

SEQ ID NO: 1299217 - protein, 9 aa, Homo Sapiens
LKMRIWYIP

SEQ ID NO: 1299218 - protein, 9 aa, Homo Sapiens
VKVAEAQKN

SEQ ID NO: 1299219 - protein, 9 aa, Homo Sapiens
KKVFRIASP

SEQ ID NO: 1299220 - protein, 9 aa, Homo Sapiens
IVHPSQEDR

SEQ ID NO: 1299221 - protein, 9 aa, Homo Sapiens
TLYIMTLIP

SEQ ID NO: 1299222 - protein, 9 aa, Homo Sapiens
ESEGLVGLM

SEQ ID NO: 1299223 - protein, 9 aa, Homo Sapiens
ASQTTKRPS

SEQ ID NO: 1299224 - protein, 9 aa, Homo Sapiens
SCCVVALHF

SEQ ID NO: 1299225 - protein, 9 aa, Homo Sapiens
PPGTVGPLG

SEQ ID NO: 1299226 - protein, 9 aa, Homo Sapiens
PVGRVAAHM

SEQ ID NO: 1299227 - protein, 9 aa, Homo Sapiens
LTFVSLQCQ

SEQ ID NO: 1299228 - protein, 9 aa, Homo Sapiens
PIGPSCVPT

SEQ ID NO: 1299229 - protein, 9 aa, Homo Sapiens
FELLSFISS

SEQ ID NO: 1299230 - protein, 9 aa, Homo Sapiens
CGKTGEYHQ

SEQ ID NO: 1299231 - protein, 9 aa, Homo Sapiens
DPVCKIVNW

SEQ ID NO: 1299232 - protein, 9 aa, Homo Sapiens
PSDPRNPPR

SEQ ID NO: 1299233 - protein, 9 aa, Homo Sapiens
AQPWRRRGL

SEQ ID NO: 1299234 - protein, 9 aa, Homo Sapiens
ENEDSPVKR

SEQ ID NO: 1299235 - protein, 9 aa, Homo Sapiens
GRRRAQAGR

SEQ ID NO: 1299236 - protein, 9 aa, Homo Sapiens
FYPICTSWH

SEQ ID NO: 1299237 - protein, 9 aa, Homo Sapiens
KARAAEEPL

SEQ ID NO: 1299238 - protein, 9 aa, Homo Sapiens
GAAGLRCGK

SEQ ID NO: 1299239 - protein, 9 aa, Homo Sapiens
FVSSEAISP

SEQ ID NO: 1299240 - protein, 9 aa, Homo Sapiens
EAPPPSTAA

SEQ ID NO: 1299241 - protein, 9 aa, Homo Sapiens
ILKEMLVCM

SEQ ID NO: 1299242 - protein, 9 aa, Homo Sapiens
HVHRHPQGD

SEQ ID NO: 1299243 - protein, 9 aa, Homo Sapiens
GPRVVCSCC

SEQ ID NO: 1299244 - protein, 9 aa, Homo Sapiens
KLTRVEKEL

SEQ ID NO: 1299245 - protein, 9 aa, Homo Sapiens
HSLTTYKII

SEQ ID NO: 1299246 - protein, 9 aa, Homo Sapiens
RDPLSKITE

SEQ ID NO: 1299247 - protein, 9 aa, Homo Sapiens
LIWGRRRAQ

SEQ ID NO: 1299248 - protein, 9 aa, Homo Sapiens
PPNEVHPLH

SEQ ID NO: 1299249 - protein, 9 aa, Homo Sapiens
SFPINVSSL

SEQ ID NO: 1299250 - protein, 9 aa, Homo Sapiens
AVYEQPLGL

SEQ ID NO: 1299251 - protein, 9 aa, Homo Sapiens
DRALGEVPV

SEQ ID NO: 1299252 - protein, 9 aa, Homo Sapiens
NMFNHLSVV

SEQ ID NO: 1299253 - protein, 9 aa, Homo Sapiens
ERTGCTAPT

SEQ ID NO: 1299254 - protein, 9 aa, Homo Sapiens
VFRIASPPS

SEQ ID NO: 1299255 - protein, 9 aa, Homo Sapiens
QCMDLAECT

SEQ ID NO: 1299256 - protein, 9 aa, Homo Sapiens
NLKGIPVDV

SEQ ID NO: 1299257 - protein, 9 aa, Homo Sapiens
ALSTPKTMR

SEQ ID NO: 1299258 - protein, 9 aa, Homo Sapiens
VVAARVGRD

SEQ ID NO: 1299259 - protein, 9 aa, Homo Sapiens
HRALRDQCP

SEQ ID NO: 1299260 - protein, 9 aa, Homo Sapiens
IVGLYRTGR

SEQ ID NO: 1299261 - protein, 9 aa, Homo Sapiens
SKRTQPDKL

SEQ ID NO: 1299262 - protein, 9 aa, Homo Sapiens
QCPAVCDGV

SEQ ID NO: 1299263 - protein, 9 aa, Homo Sapiens
SPWSPRSPP

SEQ ID NO: 1299264 - protein, 9 aa, Homo Sapiens
LCRLECSNT

SEQ ID NO: 1299265 - protein, 9 aa, Homo Sapiens
PAVCDGVLG

SEQ ID NO: 1299266 - protein, 9 aa, Homo Sapiens
GVAHLQRAI

SEQ ID NO: 1299267 - protein, 9 aa, Homo Sapiens
GVYSPVHCV

SEQ ID NO: 1299268 - protein, 9 aa, Homo Sapiens
RSHYIYVVW

SEQ ID NO: 1299269 - protein, 9 aa, Homo Sapiens
VLVKVAEAQ

SEQ ID NO: 1299270 - protein, 9 aa, Homo Sapiens
SILPSWLPT

SEQ ID NO: 1299271 - protein, 9 aa, Homo Sapiens
KVVVVDADS

SEQ ID NO: 1299272 - protein, 9 aa, Homo Sapiens
GRAPLEGML

SEQ ID NO: 1299273 - protein, 9 aa, Homo Sapiens
SSNSESSSE

SEQ ID NO: 1299274 - protein, 9 aa, Homo Sapiens
KFYKCEECD

SEQ ID NO: 1299275 - protein, 9 aa, Homo Sapiens
ICSNHSKQS

SEQ ID NO: 1299276 - protein, 9 aa, Homo Sapiens
SPRSSLPLL

SEQ ID NO: 1299277 - protein, 9 aa, Homo Sapiens
SVKKRCSLM

SEQ ID NO: 1299278 - protein, 9 aa, Homo Sapiens
ARATSGTAP

SEQ ID NO: 1299279 - protein, 9 aa, Homo Sapiens
QTAAVRRRR

SEQ ID NO: 1299280 - protein, 9 aa, Homo Sapiens
KEEFVVTTE

SEQ ID NO: 1299281 - protein, 9 aa, Homo Sapiens
SNMFNHLSV

SEQ ID NO: 1299282 - protein, 9 aa, Homo Sapiens
FGNDMSRFL

SEQ ID NO: 1299283 - protein, 9 aa, Homo Sapiens
QRRVHHLQV

SEQ ID NO: 1299284 - protein, 9 aa, Homo Sapiens
WTWASTAAW

SEQ ID NO: 1299285 - protein, 9 aa, Homo Sapiens
QHQLQDASP

SEQ ID NO: 1299286 - protein, 9 aa, Homo Sapiens
LMMSNGCWG

SEQ ID NO: 1299287 - protein, 9 aa, Homo Sapiens
QSRSPSLQE

SEQ ID NO: 1299288 - protein, 9 aa, Homo Sapiens
SRNQSKLSK

SEQ ID NO: 1299289 - protein, 9 aa, Homo Sapiens
SPLAPCPPL

SEQ ID NO: 1299290 - protein, 9 aa, Homo Sapiens
TVKPHLQSS

SEQ ID NO: 1299291 - protein, 9 aa, Homo Sapiens
NKQPVYRKA

SEQ ID NO: 1299292 - protein, 9 aa, Homo Sapiens
YLVTKVVVV

SEQ ID NO: 1299293 - protein, 9 aa, Homo Sapiens
SSQISFGLL

SEQ ID NO: 1299294 - protein, 9 aa, Homo Sapiens
INDTFQDVS

SEQ ID NO: 1299295 - protein, 9 aa, Homo Sapiens
TEPPPVGAG

SEQ ID NO: 1299296 - protein, 9 aa, Homo Sapiens
FQPDFRYFC

SEQ ID NO: 1299297 - protein, 9 aa, Homo Sapiens
GASTRASGP

SEQ ID NO: 1299298 - protein, 9 aa, Homo Sapiens
AQHQHQSQQ

SEQ ID NO: 1299299 - protein, 9 aa, Homo Sapiens
SLKKNPVMP

SEQ ID NO: 1299300 - protein, 9 aa, Homo Sapiens
SCSFPHNFV

SEQ ID NO: 1299301 - protein, 9 aa, Homo Sapiens
SSPTARATS

SEQ ID NO: 1299302 - protein, 9 aa, Homo Sapiens
KKGAQVSFL

SEQ ID NO: 1299303 - protein, 9 aa, Homo Sapiens
EVELWLITT

SEQ ID NO: 1299304 - protein, 9 aa, Homo Sapiens
RAVTASKHS

SEQ ID NO: 1299305 - protein, 9 aa, Homo Sapiens
FSKESGKNR

SEQ ID NO: 1299306 - protein, 9 aa, Homo Sapiens
LTRANSGDQ

SEQ ID NO: 1299307 - protein, 9 aa, Homo Sapiens
PLAPCPPLE

SEQ ID NO: 1299308 - protein, 9 aa, Homo Sapiens
QFGKALRMS

SEQ ID NO: 1299309 - protein, 9 aa, Homo Sapiens
GGHGVVAAR

SEQ ID NO: 1299310 - protein, 9 aa, Homo Sapiens
ACVPVAEAS

SEQ ID NO: 1299311 - protein, 9 aa, Homo Sapiens
LHNPSSGQI

SEQ ID NO: 1299312 - protein, 9 aa, Homo Sapiens
CQDPPISPT

SEQ ID NO: 1299313 - protein, 9 aa, Homo Sapiens
QFLVKVLIH

SEQ ID NO: 1299314 - protein, 9 aa, Homo Sapiens
RPMKRSRSS

SEQ ID NO: 1299315 - protein, 9 aa, Homo Sapiens
RVHHLQVDE

SEQ ID NO: 1299316 - protein, 9 aa, Homo Sapiens
ADRALGEVP

SEQ ID NO: 1299317 - protein, 9 aa, Homo Sapiens
GTALINVVV

SEQ ID NO: 1299318 - protein, 9 aa, Homo Sapiens
AQMCTFCGR

SEQ ID NO: 1299319 - protein, 9 aa, Homo Sapiens
WFQFGKALR

SEQ ID NO: 1299320 - protein, 9 aa, Homo Sapiens
EKSTMESGE

SEQ ID NO: 1299321 - protein, 9 aa, Homo Sapiens
GRKGSCPRP

SEQ ID NO: 1299322 - protein, 9 aa, Homo Sapiens
EKQQHQAEE

SEQ ID NO: 1299323 - protein, 9 aa, Homo Sapiens
ITDCTYRWH

SEQ ID NO: 1299324 - protein, 9 aa, Homo Sapiens
GESSLASSQ

SEQ ID NO: 1299325 - protein, 9 aa, Homo Sapiens
FSSLEDPAL

SEQ ID NO: 1299326 - protein, 9 aa, Homo Sapiens
MRDCDEVIA

SEQ ID NO: 1299327 - protein, 9 aa, Homo Sapiens
GQNTRSTVK

SEQ ID NO: 1299328 - protein, 9 aa, Homo Sapiens
KNLKMRIWY

SEQ ID NO: 1299329 - protein, 9 aa, Homo Sapiens
TAEVTSPQS

SEQ ID NO: 1299330 - protein, 9 aa, Homo Sapiens
LQERTGCTA

SEQ ID NO: 1299331 - protein, 9 aa, Homo Sapiens
DDEGLDVEG

SEQ ID NO: 1299332 - protein, 9 aa, Homo Sapiens
WTRASAQPW

SEQ ID NO: 1299333 - protein, 9 aa, Homo Sapiens
TTPPIGPSC

SEQ ID NO: 1299334 - protein, 9 aa, Homo Sapiens
LLSNRQPRR

SEQ ID NO: 1299335 - protein, 9 aa, Homo Sapiens
TAWFYRDCF

SEQ ID NO: 1299336 - protein, 9 aa, Homo Sapiens
ALKMPRNPT

SEQ ID NO: 1299337 - protein, 9 aa, Homo Sapiens
KKAKKAARA

SEQ ID NO: 1299338 - protein, 9 aa, Homo Sapiens
ARLWRRSYN

SEQ ID NO: 1299339 - protein, 9 aa, Homo Sapiens
EMPIADYHT

SEQ ID NO: 1299340 - protein, 9 aa, Homo Sapiens
VPSSGYRAV

SEQ ID NO: 1299341 - protein, 9 aa, Homo Sapiens
PTWCRTGAS

SEQ ID NO: 1299342 - protein, 9 aa, Homo Sapiens
AGSSPAGAK

SEQ ID NO: 1299343 - protein, 9 aa, Homo Sapiens
TPSPWSASS

SEQ ID NO: 1299344 - protein, 9 aa, Homo Sapiens
DTWIVIDGA

SEQ ID NO: 1299345 - protein, 9 aa, Homo Sapiens
HKMTLWFKR

SEQ ID NO: 1299346 - protein, 9 aa, Homo Sapiens
SPSVIFDNG

SEQ ID NO: 1299347 - protein, 9 aa, Homo Sapiens
MEQIPHLKS

SEQ ID NO: 1299348 - protein, 9 aa, Homo Sapiens
LLSRMPARR

SEQ ID NO: 1299349 - protein, 9 aa, Homo Sapiens
EAHGGGDDE

SEQ ID NO: 1299350 - protein, 9 aa, Homo Sapiens
CCATPAHAL

SEQ ID NO: 1299351 - protein, 9 aa, Homo Sapiens
VVDDPGRNH

SEQ ID NO: 1299352 - protein, 9 aa, Homo Sapiens
ARTHPKEKP

SEQ ID NO: 1299353 - protein, 9 aa, Homo Sapiens
QTHEDKQNC

SEQ ID NO: 1299354 - protein, 9 aa, Homo Sapiens
PISPTRRPL

SEQ ID NO: 1299355 - protein, 9 aa, Homo Sapiens
HQEARLKRQ

SEQ ID NO: 1299356 - protein, 9 aa, Homo Sapiens
PPPPGGARG

SEQ ID NO: 1299357 - protein, 9 aa, Homo Sapiens
NSSLTSPGI

SEQ ID NO: 1299358 - protein, 9 aa, Homo Sapiens
PVVIMMVLY

SEQ ID NO: 1299359 - protein, 9 aa, Homo Sapiens
GLQLLPGGE

SEQ ID NO: 1299360 - protein, 9 aa, Homo Sapiens
TAAGASGWS

SEQ ID NO: 1299361 - protein, 9 aa, Homo Sapiens
KEHQEARLK

SEQ ID NO: 1299362 - protein, 9 aa, Homo Sapiens
LAPAPEKQQ

SEQ ID NO: 1299363 - protein, 9 aa, Homo Sapiens
TKCEICVKR

SEQ ID NO: 1299364 - protein, 9 aa, Homo Sapiens
VSLKGEEGI

SEQ ID NO: 1299365 - protein, 9 aa, Homo Sapiens
EARLKRQEQ

SEQ ID NO: 1299366 - protein, 9 aa, Homo Sapiens
IIQGTSRSS

SEQ ID NO: 1299367 - protein, 9 aa, Homo Sapiens
HQLQDASPV

SEQ ID NO: 1299368 - protein, 9 aa, Homo Sapiens
AIWRRIGAT

SEQ ID NO: 1299369 - protein, 9 aa, Homo Sapiens
NCQRRDRQT

SEQ ID NO: 1299370 - protein, 9 aa, Homo Sapiens
TPASGPSPA

SEQ ID NO: 1299371 - protein, 9 aa, Homo Sapiens
ISDHFSDPK

SEQ ID NO: 1299372 - protein, 9 aa, Homo Sapiens
YSLRFGGPE

SEQ ID NO: 1299373 - protein, 9 aa, Homo Sapiens
TAPSAVPSV

SEQ ID NO: 1299374 - protein, 9 aa, Homo Sapiens
PYLQSVKKR

SEQ ID NO: 1299375 - protein, 9 aa, Homo Sapiens
VKSRGDGAK

SEQ ID NO: 1299376 - protein, 9 aa, Homo Sapiens
ASPSIRSAS

SEQ ID NO: 1299377 - protein, 9 aa, Homo Sapiens
QTTKRPSLQ

SEQ ID NO: 1299378 - protein, 9 aa, Homo Sapiens
AGRVGGADA

SEQ ID NO: 1299379 - protein, 9 aa, Homo Sapiens
GAHGESSLA

SEQ ID NO: 1299380 - protein, 9 aa, Homo Sapiens
ALINVVVLD

SEQ ID NO: 1299381 - protein, 9 aa, Homo Sapiens
ARTARSALP

SEQ ID NO: 1299382 - protein, 9 aa, Homo Sapiens
AVRNMASCV

SEQ ID NO: 1299383 - protein, 9 aa, Homo Sapiens
RTGASTRAS

SEQ ID NO: 1299384 - protein, 9 aa, Homo Sapiens
ASPRAAIWR

SEQ ID NO: 1299385 - protein, 9 aa, Homo Sapiens
GNIAVIPII

SEQ ID NO: 1299386 - protein, 9 aa, Homo Sapiens
RSPSPRSSL

SEQ ID NO: 1299387 - protein, 9 aa, Homo Sapiens
LANLDTFIK

SEQ ID NO: 1299388 - protein, 9 aa, Homo Sapiens
GAQVSFLIL

SEQ ID NO: 1299389 - protein, 9 aa, Homo Sapiens
SLEDPALLV

SEQ ID NO: 1299390 - protein, 9 aa, Homo Sapiens
QYKKGAQVS

SEQ ID NO: 1299391 - protein, 9 aa, Homo Sapiens
GLPLSQWSL

SEQ ID NO: 1299392 - protein, 9 aa, Homo Sapiens
AAIWRRIGA

SEQ ID NO: 1299393 - protein, 9 aa, Homo Sapiens
SGQSLNVYS

SEQ ID NO: 1299394 - protein, 9 aa, Homo Sapiens
QGKPHGAAG

SEQ ID NO: 1299395 - protein, 9 aa, Homo Sapiens
ELASKFLQQ

SEQ ID NO: 1299396 - protein, 9 aa, Homo Sapiens
ALGEVPVVD

SEQ ID NO: 1299397 - protein, 9 aa, Homo Sapiens
NLYSPVFDM

SEQ ID NO: 1299398 - protein, 9 aa, Homo Sapiens
RREGRAAAQ

SEQ ID NO: 1299399 - protein, 9 aa, Homo Sapiens
GIQCTAQTY

SEQ ID NO: 1299400 - protein, 9 aa, Homo Sapiens
QSSNSSAVN

SEQ ID NO: 1299401 - protein, 9 aa, Homo Sapiens
ENDGVCFTK

SEQ ID NO: 1299402 - protein, 9 aa, Homo Sapiens
SQLISLKHQ

SEQ ID NO: 1299403 - protein, 9 aa, Homo Sapiens
QLLPAPPNE

SEQ ID NO: 1299404 - protein, 9 aa, Homo Sapiens
MPRNPTDED

SEQ ID NO: 1299405 - protein, 9 aa, Homo Sapiens
GHTAAPVLR

SEQ ID NO: 1299406 - protein, 9 aa, Homo Sapiens
WFKRMAVRN

SEQ ID NO: 1299407 - protein, 9 aa, Homo Sapiens
RRKRSSQSR

SEQ ID NO: 1299408 - protein, 9 aa, Homo Sapiens
RASAQPWRR

SEQ ID NO: 1299409 - protein, 9 aa, Homo Sapiens
DHSGRLHDR

SEQ ID NO: 1299410 - protein, 9 aa, Homo Sapiens
TLAGWDGLL

SEQ ID NO: 1299411 - protein, 9 aa, Homo Sapiens
QDIQRRPLP

SEQ ID NO: 1299412 - protein, 9 aa, Homo Sapiens
QWPTVPCTS

SEQ ID NO: 1299413 - protein, 9 aa, Homo Sapiens
PLPWTRASA

SEQ ID NO: 1299414 - protein, 9 aa, Homo Sapiens
YIFPPGVQG

SEQ ID NO: 1299415 - protein, 9 aa, Homo Sapiens
SQPAVPWQK

SEQ ID NO: 1299416 - protein, 9 aa, Homo Sapiens
PAVPWQKEE

SEQ ID NO: 1299417 - protein, 9 aa, Homo Sapiens
APSAVPSVA

SEQ ID NO: 1299418 - protein, 9 aa, Homo Sapiens
KKKKKKELA

SEQ ID NO: 1299419 - protein, 9 aa, Homo Sapiens
LFIIQACHG

SEQ ID NO: 1299420 - protein, 9 aa, Homo Sapiens
KALKMKLGP

SEQ ID NO: 1299421 - protein, 9 aa, Homo Sapiens
MSWRRHEPE

SEQ ID NO: 1299422 - protein, 9 aa, Homo Sapiens
HSGAGAVGL

SEQ ID NO: 1299423 - protein, 9 aa, Homo Sapiens
ALGERAPPG

SEQ ID NO: 1299424 - protein, 9 aa, Homo Sapiens
GMTSSSRQW

SEQ ID NO: 1299425 - protein, 9 aa, Homo Sapiens
SPTWCRTGA

SEQ ID NO: 1299426 - protein, 9 aa, Homo Sapiens
RNRLPGEEE

SEQ ID NO: 1299427 - protein, 9 aa, Homo Sapiens
ARPSTTRRD

SEQ ID NO: 1299428 - protein, 9 aa, Homo Sapiens
AKRNENFWQ

SEQ ID NO: 1299429 - protein, 9 aa, Homo Sapiens
HRAQELVRA

SEQ ID NO: 1299430 - protein, 9 aa, Homo Sapiens
CDEVIAFLG

SEQ ID NO: 1299431 - protein, 9 aa, Homo Sapiens
LWLITTFHD

SEQ ID NO: 1299432 - protein, 9 aa, Homo Sapiens
QATYNKQPV

SEQ ID NO: 1299433 - protein, 9 aa, Homo Sapiens
GSVVRRCGG

SEQ ID NO: 1299434 - protein, 9 aa, Homo Sapiens
GDESEGLVG

SEQ ID NO: 1299435 - protein, 9 aa, Homo Sapiens
RGQKKRCIA

SEQ ID NO: 1299436 - protein, 9 aa, Homo Sapiens
QKNRPAGAI

SEQ ID NO: 1299437 - protein, 9 aa, Homo Sapiens
AVVLYLGVA

SEQ ID NO: 1299438 - protein, 9 aa, Homo Sapiens
FFAGVLFSA

SEQ ID NO: 1299439 - protein, 9 aa, Homo Sapiens
LVSASASPS

SEQ ID NO: 1299440 - protein, 9 aa, Homo Sapiens
RSLSLTRAN

SEQ ID NO: 1299441 - protein, 9 aa, Homo Sapiens
MKLEAMDLM

SEQ ID NO: 1299442 - protein, 9 aa, Homo Sapiens
PRRHGAGQQ

SEQ ID NO: 1299443 - protein, 9 aa, Homo Sapiens
LTNMPDEGI

SEQ ID NO: 1299444 - protein, 9 aa, Homo Sapiens
PLSKITEQE

SEQ ID NO: 1299445 - protein, 9 aa, Homo Sapiens
IRAAGGAVY

SEQ ID NO: 1299446 - protein, 9 aa, Homo Sapiens
RCGGPRLQR

SEQ ID NO: 1299447 - protein, 9 aa, Homo Sapiens
EAQKNRPAG

SEQ ID NO: 1299448 - protein, 9 aa, Homo Sapiens
KAIFAVAFC

SEQ ID NO: 1299449 - protein, 9 aa, Homo Sapiens
TSSSRQWPT

SEQ ID NO: 1299450 - protein, 9 aa, Homo Sapiens
QDGKWFETW

SEQ ID NO: 1299451 - protein, 9 aa, Homo Sapiens
ASGPTPVPT

SEQ ID NO: 1299452 - protein, 9 aa, Homo Sapiens
SQAVRGKEK

SEQ ID NO: 1299453 - protein, 9 aa, Homo Sapiens
KGSCPRPGA

SEQ ID NO: 1299454 - protein, 9 aa, Homo Sapiens
VPLTFVSLQ

SEQ ID NO: 1299455 - protein, 9 aa, Homo Sapiens
QITTLAGWD

SEQ ID NO: 1299456 - protein, 9 aa, Homo Sapiens
SPLIPQTTA

SEQ ID NO: 1299457 - protein, 9 aa, Homo Sapiens
CATPAHALQ

SEQ ID NO: 1299458 - protein, 9 aa, Homo Sapiens
AGRQAPTVV

SEQ ID NO: 1299459 - protein, 9 aa, Homo Sapiens
VRARTARSA

SEQ ID NO: 1299460 - protein, 9 aa, Homo Sapiens
QLPENGIAP

SEQ ID NO: 1299461 - protein, 9 aa, Homo Sapiens
DQLPENGIA

SEQ ID NO: 1299462 - protein, 9 aa, Homo Sapiens
TKDPASVKH

SEQ ID NO: 1299463 - protein, 9 aa, Homo Sapiens
SGPSPAPSA

SEQ ID NO: 1299464 - protein, 9 aa, Homo Sapiens
SSEAISPDL

SEQ ID NO: 1299465 - protein, 9 aa, Homo Sapiens
SLGVSDLLV

SEQ ID NO: 1299466 - protein, 9 aa, Homo Sapiens
GKALRMSWR

SEQ ID NO: 1299467 - protein, 9 aa, Homo Sapiens
CCVVALHFL

SEQ ID NO: 1299468 - protein, 9 aa, Homo Sapiens
VGDESEGLV

SEQ ID NO: 1299469 - protein, 9 aa, Homo Sapiens
TGNIAVIPI

SEQ ID NO: 1299470 - protein, 9 aa, Homo Sapiens
HGESSLASS

SEQ ID NO: 1299471 - protein, 9 aa, Homo Sapiens
VHPLHMLVQ

SEQ ID NO: 1299472 - protein, 9 aa, Homo Sapiens
IVIQYIFPP

SEQ ID NO: 1299473 - protein, 9 aa, Homo Sapiens
DLRVPSISF

SEQ ID NO: 1299474 - protein, 9 aa, Homo Sapiens
AQKRSHYIY

SEQ ID NO: 1299475 - protein, 9 aa, Homo Sapiens
RRCSGARVE

SEQ ID NO: 1299476 - protein, 9 aa, Homo Sapiens
PCTSPMCRR

SEQ ID NO: 1299477 - protein, 9 aa, Homo Sapiens
RELHKARAA

SEQ ID NO: 1299478 - protein, 9 aa, Homo Sapiens
ESDIIYKKL

SEQ ID NO: 1299479 - protein, 9 aa, Homo Sapiens
FNHLSVVSE

SEQ ID NO: 1299480 - protein, 9 aa, Homo Sapiens
TARATSGTA

SEQ ID NO: 1299481 - protein, 9 aa, Homo Sapiens
GQMFVSINY

SEQ ID NO: 1299482 - protein, 9 aa, Homo Sapiens
VCSCCSTHG

SEQ ID NO: 1299483 - protein, 9 aa, Homo Sapiens
PGIRGVSLK

SEQ ID NO: 1299484 - protein, 9 aa, Homo Sapiens
RMGLYTGEI

SEQ ID NO: 1299485 - protein, 9 aa, Homo Sapiens
RSHARTHPK

SEQ ID NO: 1299486 - protein, 9 aa, Homo Sapiens
LLHPSQRLL

SEQ ID NO: 1299487 - protein, 9 aa, Homo Sapiens
RPNLKGIPV

SEQ ID NO: 1299488 - protein, 9 aa, Homo Sapiens
SVQYKKGAQ

SEQ ID NO: 1299489 - protein, 9 aa, Homo Sapiens
VAEAQKNRP

SEQ ID NO: 1299490 - protein, 9 aa, Homo Sapiens
KKRCSLMEQ

SEQ ID NO: 1299491 - protein, 9 aa, Homo Sapiens
TNNRATKAN

SEQ ID NO: 1299492 - protein, 9 aa, Homo Sapiens
ASTGAWTAE

SEQ ID NO: 1299493 - protein, 9 aa, Homo Sapiens
KTFVSSEAI

SEQ ID NO: 1299494 - protein, 9 aa, Homo Sapiens
SPRSPPELQ

SEQ ID NO: 1299495 - protein, 9 aa, Homo Sapiens
LIHLHTVRS

SEQ ID NO: 1299496 - protein, 9 aa, Homo Sapiens
ENGIAPITL

SEQ ID NO: 1299497 - protein, 9 aa, Homo Sapiens
AEASTGAWT

SEQ ID NO: 1299498 - protein, 9 aa, Homo Sapiens
IHFDPENPQ

SEQ ID NO: 1299499 - protein, 9 aa, Homo Sapiens
APAPEKQQH

SEQ ID NO: 1299500 - protein, 9 aa, Homo Sapiens
THGGLIWGR

SEQ ID NO: 1299501 - protein, 9 aa, Homo Sapiens
TNSHQVLKA

SEQ ID NO: 1299502 - protein, 9 aa, Homo Sapiens
PKEKPFDCS

SEQ ID NO: 1299503 - protein, 9 aa, Homo Sapiens
SGTALINVV

SEQ ID NO: 1299504 - protein, 9 aa, Homo Sapiens
RTDGLLPLE

SEQ ID NO: 1299505 - protein, 9 aa, Homo Sapiens
KNDNSLWIS

SEQ ID NO: 1299506 - protein, 9 aa, Homo Sapiens
ALNGIHFDP

SEQ ID NO: 1299507 - protein, 9 aa, Homo Sapiens
STRPRLLFS

SEQ ID NO: 1299508 - protein, 9 aa, Homo Sapiens
VFSFDSHRQ

SEQ ID NO: 1299509 - protein, 9 aa, Homo Sapiens
CEMKTFVSS

SEQ ID NO: 1299510 - protein, 9 aa, Homo Sapiens
TQPDKLQTL

SEQ ID NO: 1299511 - protein, 9 aa, Homo Sapiens
VHPSQEDRH

SEQ ID NO: 1299512 - protein, 9 aa, Homo Sapiens
IISDHFSDP

SEQ ID NO: 1299513 - protein, 9 aa, Homo Sapiens
PLCSCCIPD

SEQ ID NO: 1299514 - protein, 9 aa, Homo Sapiens
NFQPDFRYF

SEQ ID NO: 1299515 - protein, 9 aa, Homo Sapiens
WQQSWEIVM

SEQ ID NO: 1299516 - protein, 9 aa, Homo Sapiens
RGGQGTPGP

SEQ ID NO: 1299517 - protein, 9 aa, Homo Sapiens
IGATTPPIG

SEQ ID NO: 1299518 - protein, 9 aa, Homo Sapiens
KQNCQRRDR

SEQ ID NO: 1299519 - protein, 9 aa, Homo Sapiens
PRRATLWIP

SEQ ID NO: 1299520 - protein, 9 aa, Homo Sapiens
RVPQGKPHG

SEQ ID NO: 1299521 - protein, 9 aa, Homo Sapiens
KNPVMPQNM

SEQ ID NO: 1299522 - protein, 9 aa, Homo Sapiens
DYHTRWSGI

SEQ ID NO: 1299523 - protein, 9 aa, Homo Sapiens
PPQLLFSSL

SEQ ID NO: 1299524 - protein, 9 aa, Homo Sapiens
WIHPVTWDQ

SEQ ID NO: 1299525 - protein, 9 aa, Homo Sapiens
ARRGPFWLL

SEQ ID NO: 1299526 - protein, 9 aa, Homo Sapiens
PFRRESSAL

SEQ ID NO: 1299527 - protein, 9 aa, Homo Sapiens
IRWMSCESI

SEQ ID NO: 1299528 - protein, 9 aa, Homo Sapiens
ILNLQALIF

SEQ ID NO: 1299529 - protein, 9 aa, Homo Sapiens
LILGYRGDC

SEQ ID NO: 1299530 - protein, 9 aa, Homo Sapiens
GPDLRQKLQ

SEQ ID NO: 1299531 - protein, 9 aa, Homo Sapiens
VHRHPQGDR

SEQ ID NO: 1299532 - protein, 9 aa, Homo Sapiens
LQGMTSSSR

SEQ ID NO: 1299533 - protein, 9 aa, Homo Sapiens
SWLPTAMGP

SEQ ID NO: 1299534 - protein, 9 aa, Homo Sapiens
DGMDQLPEN

SEQ ID NO: 1299535 - protein, 9 aa, Homo Sapiens
APIFTSEQR

SEQ ID NO: 1299536 - protein, 9 aa, Homo Sapiens
STRGRKGSC

SEQ ID NO: 1299537 - protein, 9 aa, Homo Sapiens
KMTLWFKRM

SEQ ID NO: 1299538 - protein, 9 aa, Homo Sapiens
DSPQDPVSL

SEQ ID NO: 1299539 - protein, 9 aa, Homo Sapiens
IRDRAHFTR

SEQ ID NO: 1299540 - protein, 9 aa, Homo Sapiens
ARVGTEVTG

SEQ ID NO: 1299541 - protein, 9 aa, Homo Sapiens
CGEAFNQKI

SEQ ID NO: 1299542 - protein, 9 aa, Homo Sapiens
ERMMLPVRA

SEQ ID NO: 1299543 - protein, 9 aa, Homo Sapiens
ECDDRHCED

SEQ ID NO: 1299544 - protein, 9 aa, Homo Sapiens
THRAQELVR

SEQ ID NO: 1299545 - protein, 9 aa, Homo Sapiens
HGAISRTDT

SEQ ID NO: 1299546 - protein, 9 aa, Homo Sapiens
SVVRRCGGP

SEQ ID NO: 1299547 - protein, 9 aa, Homo Sapiens
AARAKKAVK

SEQ ID NO: 1299548 - protein, 9 aa, Homo Sapiens
PPTLMMSNG

SEQ ID NO: 1299549 - protein, 9 aa, Homo Sapiens
PHALDSPSV

SEQ ID NO: 1299550 - protein, 9 aa, Homo Sapiens
TYTCQVENP

SEQ ID NO: 1299551 - protein, 9 aa, Homo Sapiens
FWRGQKKRC

SEQ ID NO: 1299552 - protein, 9 aa, Homo Sapiens
NPFFFYPIC

SEQ ID NO: 1299553 - protein, 9 aa, Homo Sapiens
PIVLKLLCQ

SEQ ID NO: 1299554 - protein, 9 aa, Homo Sapiens
GLAVHRGDT

SEQ ID NO: 1299555 - protein, 9 aa, Homo Sapiens
SSVSMPLNA

SEQ ID NO: 1299556 - protein, 9 aa, Homo Sapiens
APPGPSGLA

SEQ ID NO: 1299557 - protein, 9 aa, Homo Sapiens
DNSLWISVT

SEQ ID NO: 1299558 - protein, 9 aa, Homo Sapiens
EDSPVKRPR

SEQ ID NO: 1299559 - protein, 9 aa, Homo Sapiens
VLKADPESA

SEQ ID NO: 1299560 - protein, 9 aa, Homo Sapiens
PQGAHGESS

SEQ ID NO: 1299561 - protein, 9 aa, Homo Sapiens
ARLHTRGRP

SEQ ID NO: 1299562 - protein, 9 aa, Homo Sapiens
ATGNIAVIP

SEQ ID NO: 1299563 - protein, 9 aa, Homo Sapiens
SLPLLRDQD

SEQ ID NO: 1299564 - protein, 9 aa, Homo Sapiens
TLPQTSLQL

SEQ ID NO: 1299565 - protein, 9 aa, Homo Sapiens
PCLITDCTY

SEQ ID NO: 1299566 - protein, 9 aa, Homo Sapiens
RMPARRESR

SEQ ID NO: 1299567 - protein, 9 aa, Homo Sapiens
ASASPSIRS

SEQ ID NO: 1299568 - protein, 9 aa, Homo Sapiens
RTSARRRTW

SEQ ID NO: 1299569 - protein, 9 aa, Homo Sapiens
VRLGVQPAA

SEQ ID NO: 1299570 - protein, 9 aa, Homo Sapiens
LISLKHQVQ

SEQ ID NO: 1299571 - protein, 9 aa, Homo Sapiens
ISFGLLPLS

SEQ ID NO: 1299572 - protein, 9 aa, Homo Sapiens
PYECECGKA

SEQ ID NO: 1299573 - protein, 9 aa, Homo Sapiens
PQGRAPLEG

SEQ ID NO: 1299574 - protein, 9 aa, Homo Sapiens
YHVDADKGF

SEQ ID NO: 1299575 - protein, 9 aa, Homo Sapiens
LTHSSEIVR

SEQ ID NO: 1299576 - protein, 9 aa, Homo Sapiens
SFLILGYRG

SEQ ID NO: 1299577 - protein, 9 aa, Homo Sapiens
RLPGEEENH

SEQ ID NO: 1299578 - protein, 9 aa, Homo Sapiens
QGMTSSSRQ

SEQ ID NO: 1299579 - protein, 9 aa, Homo Sapiens
PSPRPPPLV

SEQ ID NO: 1299580 - protein, 9 aa, Homo Sapiens
SGYRAVTAS

SEQ ID NO: 1299581 - protein, 9 aa, Homo Sapiens
PEATPAQAQ

SEQ ID NO: 1299582 - protein, 9 aa, Homo Sapiens
HRELQRPQL

SEQ ID NO: 1299583 - protein, 9 aa, Homo Sapiens
GRDAQVRAV

SEQ ID NO: 1299584 - protein, 9 aa, Homo Sapiens
DEGIMVTKF

SEQ ID NO: 1299585 - protein, 9 aa, Homo Sapiens
EEEEEEETQ

SEQ ID NO: 1299586 - protein, 9 aa, Homo Sapiens
LQVDEGLGP

SEQ ID NO: 1299587 - protein, 9 aa, Homo Sapiens
TTTTTNNRA

SEQ ID NO: 1299588 - protein, 9 aa, Homo Sapiens
ALNHGEEQA

SEQ ID NO: 1299589 - protein, 9 aa, Homo Sapiens
AHMQVGGHG

SEQ ID NO: 1299590 - protein, 9 aa, Homo Sapiens
RTDTENLLR

SEQ ID NO: 1299591 - protein, 9 aa, Homo Sapiens
CSNHSKQSS

SEQ ID NO: 1299592 - protein, 9 aa, Homo Sapiens
LRMSWRRHE

SEQ ID NO: 1299593 - protein, 9 aa, Homo Sapiens
VGLMGPVGR

SEQ ID NO: 1299594 - protein, 9 aa, Homo Sapiens
SSLPLLRDQ

SEQ ID NO: 1299595 - protein, 9 aa, Homo Sapiens
GELDSMVPV

SEQ ID NO: 1299596 - protein, 9 aa, Homo Sapiens
YECECGKAF

SEQ ID NO: 1299597 - protein, 9 aa, Homo Sapiens
PGAHGPIGP

SEQ ID NO: 1299598 - protein, 9 aa, Homo Sapiens
YVGSSLDVW

SEQ ID NO: 1299599 - protein, 9 aa, Homo Sapiens
AYFVYCHIH

SEQ ID NO: 1299600 - protein, 9 aa, Homo Sapiens
CRPPPVPAP

SEQ ID NO: 1299601 - protein, 9 aa, Homo Sapiens
FNTLLKCHL

SEQ ID NO: 1299602 - protein, 9 aa, Homo Sapiens
CCLDLRVPS

SEQ ID NO: 1299603 - protein, 9 aa, Homo Sapiens
TTEPPPVGA

SEQ ID NO: 1299604 - protein, 9 aa, Homo Sapiens
ALYDTINPD

SEQ ID NO: 1299605 - protein, 9 aa, Homo Sapiens
WSLRSPRTA

SEQ ID NO: 1299606 - protein, 9 aa, Homo Sapiens
TESTRCEDE

SEQ ID NO: 1299607 - protein, 9 aa, Homo Sapiens
QDPPISPTR

SEQ ID NO: 1299608 - protein, 9 aa, Homo Sapiens
TRILSTNHT

SEQ ID NO: 1299609 - protein, 9 aa, Homo Sapiens
GGPRLQRRR

SEQ ID NO: 1299610 - protein, 9 aa, Homo Sapiens
KTMRNLKQF

SEQ ID NO: 1299611 - protein, 9 aa, Homo Sapiens
HIKIIHGYA

SEQ ID NO: 1299612 - protein, 9 aa, Homo Sapiens
NITKKKETG

SEQ ID NO: 1299613 - protein, 9 aa, Homo Sapiens
HIKQGSDVY

SEQ ID NO: 1299614 - protein, 9 aa, Homo Sapiens
RSPSPKPHG

SEQ ID NO: 1299615 - protein, 9 aa, Homo Sapiens
EEVRRYQGE

SEQ ID NO: 1299616 - protein, 9 aa, Homo Sapiens
LASDHSGRL

SEQ ID NO: 1299617 - protein, 9 aa, Homo Sapiens
HTRWSGITR

SEQ ID NO: 1299618 - protein, 9 aa, Homo Sapiens
SSSTTTTTN

SEQ ID NO: 1299619 - protein, 9 aa, Homo Sapiens
IEILSDAWV

SEQ ID NO: 1299620 - protein, 9 aa, Homo Sapiens
VYEQPLGLE

SEQ ID NO: 1299621 - protein, 9 aa, Homo Sapiens
HTAAPVLRV

SEQ ID NO: 1299622 - protein, 9 aa, Homo Sapiens
VIPQELQLL

SEQ ID NO: 1299623 - protein, 9 aa, Homo Sapiens
RPSATNPTW

SEQ ID NO: 1299624 - protein, 9 aa, Homo Sapiens
NGCWGWQQS

SEQ ID NO: 1299625 - protein, 9 aa, Homo Sapiens
MLTYHVDAD

SEQ ID NO: 1299626 - protein, 9 aa, Homo Sapiens
CQNFQPDFR

SEQ ID NO: 1299627 - protein, 9 aa, Homo Sapiens
SCGPTSGST

SEQ ID NO: 1299628 - protein, 9 aa, Homo Sapiens
IEAHRQERE

SEQ ID NO: 1299629 - protein, 9 aa, Homo Sapiens
DQDLCRGPR

SEQ ID NO: 1299630 - protein, 9 aa, Homo Sapiens
FPTHLTPQK

SEQ ID NO: 1299631 - protein, 9 aa, Homo Sapiens
PTKCEICVK

SEQ ID NO: 1299632 - protein, 9 aa, Homo Sapiens
QNFQPDFRY

SEQ ID NO: 1299633 - protein, 9 aa, Homo Sapiens
HFQASSSSK

SEQ ID NO: 1299634 - protein, 9 aa, Homo Sapiens
VAEWRLPSP

SEQ ID NO: 1299635 - protein, 9 aa, Homo Sapiens
PRPRIRGGD

SEQ ID NO: 1299636 - protein, 9 aa, Homo Sapiens
ARVPTVPPQ

SEQ ID NO: 1299637 - protein, 9 aa, Homo Sapiens
VDRAKWKIP

SEQ ID NO: 1299638 - protein, 9 aa, Homo Sapiens
WRRIGATTP

SEQ ID NO: 1299639 - protein, 9 aa, Homo Sapiens
RSPPTLMMS

SEQ ID NO: 1299640 - protein, 9 aa, Homo Sapiens
LKMKLGPLQ

SEQ ID NO: 1299641 - protein, 9 aa, Homo Sapiens
SRFWLALQA

SEQ ID NO: 1299642 - protein, 9 aa, Homo Sapiens
ALQAGPPGT

SEQ ID NO: 1299643 - protein, 9 aa, Homo Sapiens
LMKKPTKRP

SEQ ID NO: 1299644 - protein, 9 aa, Homo Sapiens
ELSSTRGRK

SEQ ID NO: 1299645 - protein, 9 aa, Homo Sapiens
VAARVGRDA

SEQ ID NO: 1299646 - protein, 9 aa, Homo Sapiens
TDPQLEKEA

SEQ ID NO: 1299647 - protein, 9 aa, Homo Sapiens
PPPGGARGG

SEQ ID NO: 1299648 - protein, 9 aa, Homo Sapiens
GRHLPLLTW

SEQ ID NO: 1299649 - protein, 9 aa, Homo Sapiens
PSQLPASSP

SEQ ID NO: 1299650 - protein, 9 aa, Homo Sapiens
GPSAFVRTE

SEQ ID NO: 1299651 - protein, 9 aa, Homo Sapiens
VIQYIFPPG

SEQ ID NO: 1299652 - protein, 9 aa, Homo Sapiens
PTPVPTATA

SEQ ID NO: 1299653 - protein, 9 aa, Homo Sapiens
PGHTAAPVL

SEQ ID NO: 1299654 - protein, 9 aa, Homo Sapiens
QHQSQQEPT

SEQ ID NO: 1299655 - protein, 9 aa, Homo Sapiens
CHLLQEAFF

SEQ ID NO: 1299656 - protein, 9 aa, Homo Sapiens
GVVAARVGR

SEQ ID NO: 1299657 - protein, 9 aa, Homo Sapiens
QHLLDGLHH

SEQ ID NO: 1299658 - protein, 9 aa, Homo Sapiens
NVLMDTSAK

SEQ ID NO: 1299659 - protein, 9 aa, Homo Sapiens
LKLLCQESV

SEQ ID NO: 1299660 - protein, 9 aa, Homo Sapiens
TWASTAAWP

SEQ ID NO: 1299661 - protein, 9 aa, Homo Sapiens
EGLVGLMGP

SEQ ID NO: 1299662 - protein, 9 aa, Homo Sapiens
EHIKIIHGY

SEQ ID NO: 1299663 - protein, 9 aa, Homo Sapiens
WRTDGLLPL

SEQ ID NO: 1299664 - protein, 9 aa, Homo Sapiens
CEVDSPQDP

SEQ ID NO: 1299665 - protein, 9 aa, Homo Sapiens
TQAQHQHQS

SEQ ID NO: 1299666 - protein, 9 aa, Homo Sapiens
VRNMASCVQ

SEQ ID NO: 1299667 - protein, 9 aa, Homo Sapiens
GDDEGLDVE

SEQ ID NO: 1299668 - protein, 9 aa, Homo Sapiens
ARLVGDESE

SEQ ID NO: 1299669 - protein, 9 aa, Homo Sapiens
GQQGSVVRR

SEQ ID NO: 1299670 - protein, 9 aa, Homo Sapiens
PPISPTRRP

SEQ ID NO: 1299671 - protein, 9 aa, Homo Sapiens
AARVGRDAQ

SEQ ID NO: 1299672 - protein, 9 aa, Homo Sapiens
GTAPSAVPS

SEQ ID NO: 1299673 - protein, 9 aa, Homo Sapiens
DGELWGYAV

SEQ ID NO: 1299674 - protein, 9 aa, Homo Sapiens
RPLGVSPLA

SEQ ID NO: 1299675 - protein, 9 aa, Homo Sapiens
NSLEKDIAM

SEQ ID NO: 1299676 - protein, 9 aa, Homo Sapiens
VVSESIPAL

SEQ ID NO: 1299677 - protein, 9 aa, Homo Sapiens
PGLALGERA

SEQ ID NO: 1299678 - protein, 9 aa, Homo Sapiens
QQSWEIVME

SEQ ID NO: 1299679 - protein, 9 aa, Homo Sapiens
LNHGEEQAR

SEQ ID NO: 1299680 - protein, 9 aa, Homo Sapiens
NGIHFDPEN

SEQ ID NO: 1299681 - protein, 9 aa, Homo Sapiens
KKPTKRPTR

SEQ ID NO: 1299682 - protein, 9 aa, Homo Sapiens
KDEPDSPVA

SEQ ID NO: 1299683 - protein, 9 aa, Homo Sapiens
PTLMMSNGC

SEQ ID NO: 1299684 - protein, 9 aa, Homo Sapiens
LPIRWMSCE

SEQ ID NO: 1299685 - protein, 9 aa, Homo Sapiens
TRVEKELRR

SEQ ID NO: 1299686 - protein, 9 aa, Homo Sapiens
ETHRAQELV

SEQ ID NO: 1299687 - protein, 9 aa, Homo Sapiens
RMAVRNMAS

SEQ ID NO: 1299688 - protein, 9 aa, Homo Sapiens
TWQLWHREL

SEQ ID NO: 1299689 - protein, 9 aa, Homo Sapiens
SCESILLGK

SEQ ID NO: 1299690 - protein, 9 aa, Homo Sapiens
LPAPPNEVH

SEQ ID NO: 1299691 - protein, 9 aa, Homo Sapiens
RPRIRGGDP

SEQ ID NO: 1299692 - protein, 9 aa, Homo Sapiens
EATPAQAQA

SEQ ID NO: 1299693 - protein, 9 aa, Homo Sapiens
AQVRAVVLY

SEQ ID NO: 1299694 - protein, 9 aa, Homo Sapiens
RRVHHLQVD

SEQ ID NO: 1299695 - protein, 9 aa, Homo Sapiens
PRKAPGGLQ

SEQ ID NO: 1299696 - protein, 9 aa, Homo Sapiens
HLTPQKKQM

SEQ ID NO: 1299697 - protein, 9 aa, Homo Sapiens
MSNGCWGWQ

SEQ ID NO: 1299698 - protein, 9 aa, Homo Sapiens
HHLCPSKRH

SEQ ID NO: 1299699 - protein, 9 aa, Homo Sapiens
PCSSFGGWT

SEQ ID NO: 1299700 - protein, 9 aa, Homo Sapiens
AWFFTSPAS

SEQ ID NO: 1299701 - protein, 9 aa, Homo Sapiens
GQKGSPGGQ

SEQ ID NO: 1299702 - protein, 9 aa, Homo Sapiens
ECSQCVKGF

SEQ ID NO: 1299703 - protein, 9 aa, Homo Sapiens
VRRYQGEHK

SEQ ID NO: 1299704 - protein, 9 aa, Homo Sapiens
VKPHLQSST

SEQ ID NO: 1299705 - protein, 9 aa, Homo Sapiens
LLCRLECSN

SEQ ID NO: 1299706 - protein, 9 aa, Homo Sapiens
SLRSPRTAL

SEQ ID NO: 1299707 - protein, 9 aa, Homo Sapiens
RVGRDAQVR

SEQ ID NO: 1299708 - protein, 9 aa, Homo Sapiens
ASRAPCRPP

SEQ ID NO: 1299709 - protein, 9 aa, Homo Sapiens
SFDSHRQEK

SEQ ID NO: 1299710 - protein, 9 aa, Homo Sapiens
RLQALYDTI

SEQ ID NO: 1299711 - protein, 9 aa, Homo Sapiens
ARSAAAASP

SEQ ID NO: 1299712 - protein, 9 aa, Homo Sapiens
FQFGKALRM

SEQ ID NO: 1299713 - protein, 9 aa, Homo Sapiens
TIVIQYIFP

SEQ ID NO: 1299714 - protein, 9 aa, Homo Sapiens
VSPLAPCPP

SEQ ID NO: 1299715 - protein, 9 aa, Homo Sapiens
ETTEPPPVG

SEQ ID NO: 1299716 - protein, 9 aa, Homo Sapiens
DRSHGEHSS

SEQ ID NO: 1299717 - protein, 9 aa, Homo Sapiens
VPTAARPSA

SEQ ID NO: 1299718 - protein, 9 aa, Homo Sapiens
SCSRPSSSA

SEQ ID NO: 1299719 - protein, 9 aa, Homo Sapiens
MDLAECTLI

SEQ ID NO: 1299720 - protein, 9 aa, Homo Sapiens
KAMQWVHST

SEQ ID NO: 1299721 - protein, 9 aa, Homo Sapiens
GRSPSPKPH

SEQ ID NO: 1299722 - protein, 9 aa, Homo Sapiens
DEPDSPVAL

SEQ ID NO: 1299723 - protein, 9 aa, Homo Sapiens
CADETSLCS

SEQ ID NO: 1299724 - protein, 9 aa, Homo Sapiens
PPRAGNEEK

SEQ ID NO: 1299725 - protein, 9 aa, Homo Sapiens
SSFGGWTSP

SEQ ID NO: 1299726 - protein, 9 aa, Homo Sapiens
IDGAAIWTQ

SEQ ID NO: 1299727 - protein, 9 aa, Homo Sapiens
TGCTAPTVI

SEQ ID NO: 1299728 - protein, 9 aa, Homo Sapiens
VYRKAIYEV

SEQ ID NO: 1299729 - protein, 9 aa, Homo Sapiens
PTAMGPLLA

SEQ ID NO: 1299730 - protein, 9 aa, Homo Sapiens
LKRQEQRKF

SEQ ID NO: 1299731 - protein, 9 aa, Homo Sapiens
TPAQAQADS

SEQ ID NO: 1299732 - protein, 9 aa, Homo Sapiens
SSGYRAVTA

SEQ ID NO: 1299733 - protein, 9 aa, Homo Sapiens
LQVLLKAFS

SEQ ID NO: 1299734 - protein, 9 aa, Homo Sapiens
LWLCCATPA

SEQ ID NO: 1299735 - protein, 9 aa, Homo Sapiens
LLEVAAPEV

SEQ ID NO: 1299736 - protein, 9 aa, Homo Sapiens
GEALKCWYE

SEQ ID NO: 1299737 - protein, 9 aa, Homo Sapiens
EDLIASQLD

SEQ ID NO: 1299738 - protein, 9 aa, Homo Sapiens
SPMCRRWTW

SEQ ID NO: 1299739 - protein, 9 aa, Homo Sapiens
RSPTSAPTA

SEQ ID NO: 1299740 - protein, 9 aa, Homo Sapiens
ETTESTRCE

SEQ ID NO: 1299741 - protein, 9 aa, Homo Sapiens
LPSPRRATL

SEQ ID NO: 1299742 - protein, 9 aa, Homo Sapiens
LQPGEKKSQ

SEQ ID NO: 1299743 - protein, 9 aa, Homo Sapiens
FQITTLAGW

SEQ ID NO: 1299744 - protein, 9 aa, Homo Sapiens
KLEAMDLME

SEQ ID NO: 1299745 - protein, 9 aa, Homo Sapiens
TSTGSRQSR

SEQ ID NO: 1299746 - protein, 9 aa, Homo Sapiens
LRELHKARA

SEQ ID NO: 1299747 - protein, 9 aa, Homo Sapiens
YAQKRSHYI

SEQ ID NO: 1299748 - protein, 9 aa, Homo Sapiens
SLRFGGPET

SEQ ID NO: 1299749 - protein, 9 aa, Homo Sapiens
WPTVPCTSP

SEQ ID NO: 1299750 - protein, 9 aa, Homo Sapiens
STLYIMTLI

SEQ ID NO: 1299751 - protein, 9 aa, Homo Sapiens
QIFQIMRIL

SEQ ID NO: 1299752 - protein, 9 aa, Homo Sapiens
GEEVRRYQG

SEQ ID NO: 1299753 - protein, 9 aa, Homo Sapiens
AQKNRPAGA

SEQ ID NO: 1299754 - protein, 9 aa, Homo Sapiens
YSSSLSSYV

SEQ ID NO: 1299755 - protein, 9 aa, Homo Sapiens
GAVYEQPLG

SEQ ID NO: 1299756 - protein, 9 aa, Homo Sapiens
SPPELQPGQ

SEQ ID NO: 1299757 - protein, 9 aa, Homo Sapiens
GPAWASLGS

SEQ ID NO: 1299758 - protein, 9 aa, Homo Sapiens
DIMKHIGMT

SEQ ID NO: 1299759 - protein, 9 aa, Homo Sapiens
KWEEYQRQL

SEQ ID NO: 1299760 - protein, 9 aa, Homo Sapiens
GQKKRCIAN

SEQ ID NO: 1299761 - protein, 9 aa, Homo Sapiens
FFDIQFPTH

SEQ ID NO: 1299762 - protein, 9 aa, Homo Sapiens
RQHLHCCTG

SEQ ID NO: 1299763 - protein, 9 aa, Homo Sapiens
VRSLLGEIF

SEQ ID NO: 1299764 - protein, 9 aa, Homo Sapiens
ILKRRKSLE

SEQ ID NO: 1299765 - protein, 9 aa, Homo Sapiens
STVKPHLQS

SEQ ID NO: 1299766 - protein, 9 aa, Homo Sapiens
VKRRRRRKR

SEQ ID NO: 1299767 - protein, 9 aa, Homo Sapiens
QGSVVRRCG

SEQ ID NO: 1299768 - protein, 9 aa, Homo Sapiens
SIETKSRQM

SEQ ID NO: 1299769 - protein, 9 aa, Homo Sapiens
SSRQWPTVP

SEQ ID NO: 1299770 - protein, 9 aa, Homo Sapiens
RTWWRTRAC

SEQ ID NO: 1299771 - protein, 9 aa, Homo Sapiens
GRSWDQDGK

SEQ ID NO: 1299772 - protein, 9 aa, Homo Sapiens
VLNSSYTWM

SEQ ID NO: 1299773 - protein, 9 aa, Homo Sapiens
NARSPPQLL

SEQ ID NO: 1299774 - protein, 9 aa, Homo Sapiens
GDLPSLQSN

SEQ ID NO: 1299775 - protein, 9 aa, Homo Sapiens
HPSQEDRHS

SEQ ID NO: 1299776 - protein, 9 aa, Homo Sapiens
ASCGPTSGS

SEQ ID NO: 1299777 - protein, 9 aa, Homo Sapiens
SPKPHGLQR

SEQ ID NO: 1299778 - protein, 9 aa, Homo Sapiens
WVHSTPVRP

SEQ ID NO: 1299779 - protein, 9 aa, Homo Sapiens
TRCEDEELE

SEQ ID NO: 1299780 - protein, 9 aa, Homo Sapiens
SSTRGRKGS

SEQ ID NO: 1299781 - protein, 9 aa, Homo Sapiens
AQGAEAERR

SEQ ID NO: 1299782 - protein, 9 aa, Homo Sapiens
PEKQQHQAE

SEQ ID NO: 1299783 - protein, 9 aa, Homo Sapiens
ENARSPPQL

SEQ ID NO: 1299784 - protein, 9 aa, Homo Sapiens
TLHQVLHLV

SEQ ID NO: 1299785 - protein, 9 aa, Homo Sapiens
MKRSRSSRT

SEQ ID NO: 1299786 - protein, 9 aa, Homo Sapiens
IVIDGAAIW

SEQ ID NO: 1299787 - protein, 9 aa, Homo Sapiens
FIIQACHGT

SEQ ID NO: 1299788 - protein, 9 aa, Homo Sapiens
CSESPDCHW

SEQ ID NO: 1299789 - protein, 9 aa, Homo Sapiens
ASDHSGRLH

SEQ ID NO: 1299790 - protein, 9 aa, Homo Sapiens
RSAAAASPR

SEQ ID NO: 1299791 - protein, 9 aa, Homo Sapiens
DVLKADPES

SEQ ID NO: 1299792 - protein, 9 aa, Homo Sapiens
RPFAYVEGQ

SEQ ID NO: 1299793 - protein, 9 aa, Homo Sapiens
QPPFRRESS

SEQ ID NO: 1299794 - protein, 9 aa, Homo Sapiens
LIFLNISRN

SEQ ID NO: 1299795 - protein, 9 aa, Homo Sapiens
QAIIERIPL

SEQ ID NO: 1299796 - protein, 9 aa, Homo Sapiens
IHLHTVRSL

SEQ ID NO: 1299797 - protein, 9 aa, Homo Sapiens
LRSPRTALP

SEQ ID NO: 1299798 - protein, 9 aa, Homo Sapiens
ESSALESPE

SEQ ID NO: 1299799 - protein, 9 aa, Homo Sapiens
TRMRGESEL

SEQ ID NO: 1299800 - protein, 9 aa, Homo Sapiens
RGLPLSQWS

SEQ ID NO: 1299801 - protein, 9 aa, Homo Sapiens
AGTRCRASR

SEQ ID NO: 1299802 - protein, 9 aa, Homo Sapiens
SWPTRRSTM

SEQ ID NO: 1299803 - protein, 9 aa, Homo Sapiens
VLHLVLRGH

SEQ ID NO: 1299804 - protein, 9 aa, Homo Sapiens
LQRAIREDC

SEQ ID NO: 1299805 - protein, 9 aa, Homo Sapiens
LEVAAPEVL

SEQ ID NO: 1299806 - protein, 9 aa, Homo Sapiens
CSYEGQEAL

SEQ ID NO: 1299807 - protein, 9 aa, Homo Sapiens
TRSTVKPHL

SEQ ID NO: 1299808 - protein, 9 aa, Homo Sapiens
AAVRRRRGV

SEQ ID NO: 1299809 - protein, 9 aa, Homo Sapiens
KLVSACVRL

SEQ ID NO: 1299810 - protein, 9 aa, Homo Sapiens
SIWPACSIL

SEQ ID NO: 1299811 - protein, 9 aa, Homo Sapiens
AQCQDPPIS

SEQ ID NO: 1299812 - protein, 9 aa, Homo Sapiens
GERAPPGPS

SEQ ID NO: 1299813 - protein, 9 aa, Homo Sapiens
RVEKELRRF

SEQ ID NO: 1299814 - protein, 9 aa, Homo Sapiens
GNDMSRFLE

SEQ ID NO: 1299815 - protein, 9 aa, Homo Sapiens
QSVFELLSF

SEQ ID NO: 1299816 - protein, 9 aa, Homo Sapiens
LASAGHGTC

SEQ ID NO: 1299817 - protein, 9 aa, Homo Sapiens
RCRASRAPC

SEQ ID NO: 1299818 - protein, 9 aa, Homo Sapiens
GLYRTGRSY

SEQ ID NO: 1299819 - protein, 9 aa, Homo Sapiens
RTQSYSFVW

SEQ ID NO: 1299820 - protein, 9 aa, Homo Sapiens
GLALGERAP

SEQ ID NO: 1299821 - protein, 9 aa, Homo Sapiens
RAVSVTLFL

SEQ ID NO: 1299822 - protein, 9 aa, Homo Sapiens
LLPGGELLH

SEQ ID NO: 1299823 - protein, 9 aa, Homo Sapiens
FWLLSLASS

SEQ ID NO: 1299824 - protein, 9 aa, Homo Sapiens
VEGQAHRNA

SEQ ID NO: 1299825 - protein, 9 aa, Homo Sapiens
RACTPASGP

SEQ ID NO: 1299826 - protein, 9 aa, Homo Sapiens
CDPVCKIVN

SEQ ID NO: 1299827 - protein, 9 aa, Homo Sapiens
PVSLDFPLN

SEQ ID NO: 1299828 - protein, 9 aa, Homo Sapiens
LNLQALIFL

SEQ ID NO: 1299829 - protein, 9 aa, Homo Sapiens
KDCSYLSRN

SEQ ID NO: 1299830 - protein, 9 aa, Homo Sapiens
LVPHACCGL

SEQ ID NO: 1299831 - protein, 9 aa, Homo Sapiens
CGKVFNRRT

SEQ ID NO: 1299832 - protein, 9 aa, Homo Sapiens
HACCGLCHG

SEQ ID NO: 1299833 - protein, 9 aa, Homo Sapiens
LPMLTYHVD

SEQ ID NO: 1299834 - protein, 9 aa, Homo Sapiens
SEEDLIASQ

SEQ ID NO: 1299835 - protein, 9 aa, Homo Sapiens
KEDLKGKKR

SEQ ID NO: 1299836 - protein, 9 aa, Homo Sapiens
LLTWQLWHR

SEQ ID NO: 1299837 - protein, 9 aa, Homo Sapiens
GITLLCRLE

SEQ ID NO: 1299838 - protein, 9 aa, Homo Sapiens
ESPDCHWCC

SEQ ID NO: 1299839 - protein, 9 aa, Homo Sapiens
TGASTRASG

SEQ ID NO: 1299840 - protein, 9 aa, Homo Sapiens
SQISFGLLP

SEQ ID NO: 1299841 - protein, 9 aa, Homo Sapiens
WMVPLTFVS

SEQ ID NO: 1299842 - protein, 9 aa, Homo Sapiens
VGETTESTR

SEQ ID NO: 1299843 - protein, 9 aa, Homo Sapiens
AVIPIIKTI

SEQ ID NO: 1299844 - protein, 9 aa, Homo Sapiens
SSSCSRPSS

SEQ ID NO: 1299845 - protein, 9 aa, Homo Sapiens
MASCVQWKR

SEQ ID NO: 1299846 - protein, 9 aa, Homo Sapiens
RYYQNVRTQ

SEQ ID NO: 1299847 - protein, 9 aa, Homo Sapiens
PEASDQSLL

SEQ ID NO: 1299848 - protein, 9 aa, Homo Sapiens
KKKKKELAS

SEQ ID NO: 1299849 - protein, 9 aa, Homo Sapiens
PKPHGLQRS

SEQ ID NO: 1299850 - protein, 9 aa, Homo Sapiens
HQSQQEPTE

SEQ ID NO: 1299851 - protein, 9 aa, Homo Sapiens
TMESGESTS

SEQ ID NO: 1299852 - protein, 9 aa, Homo Sapiens
SAGRTSARR

SEQ ID NO: 1299853 - protein, 9 aa, Homo Sapiens
KRQTPQSVF

SEQ ID NO: 1299854 - protein, 9 aa, Homo Sapiens
LCSVMAPLV

SEQ ID NO: 1299855 - protein, 9 aa, Homo Sapiens
VPHPLNKLQ

SEQ ID NO: 1299856 - protein, 9 aa, Homo Sapiens
RRGLTLFFV

SEQ ID NO: 1299857 - protein, 9 aa, Homo Sapiens
TTAWFYRDC

SEQ ID NO: 1299858 - protein, 9 aa, Homo Sapiens
QLAEIEAHR

SEQ ID NO: 1299859 - protein, 9 aa, Homo Sapiens
RSHGEHSST

SEQ ID NO: 1299860 - protein, 9 aa, Homo Sapiens
LCGTPEYLT

SEQ ID NO: 1299861 - protein, 9 aa, Homo Sapiens
FRMGLYTGE

SEQ ID NO: 1299862 - protein, 9 aa, Homo Sapiens
RTGCTAPTV

SEQ ID NO: 1299863 - protein, 9 aa, Homo Sapiens
KRSSQSRSP

SEQ ID NO: 1299864 - protein, 9 aa, Homo Sapiens
HPLHMLVQR

SEQ ID NO: 1299865 - protein, 9 aa, Homo Sapiens
RTGASTPAR

SEQ ID NO: 1299866 - protein, 9 aa, Homo Sapiens
HIGMTDQTL

SEQ ID NO: 1299867 - protein, 9 aa, Homo Sapiens
TAATTAAGA

SEQ ID NO: 1299868 - protein, 9 aa, Homo Sapiens
TLDTRHESL

SEQ ID NO: 1299869 - protein, 9 aa, Homo Sapiens
RRESSALES

SEQ ID NO: 1299870 - protein, 9 aa, Homo Sapiens
VSLQCQKED

SEQ ID NO: 1299871 - protein, 9 aa, Homo Sapiens
CMSKDSSYL

SEQ ID NO: 1299872 - protein, 9 aa, Homo Sapiens
RSSDEPTTT

SEQ ID NO: 1299873 - protein, 9 aa, Homo Sapiens
ALKMKLGPL

SEQ ID NO: 1299874 - protein, 9 aa, Homo Sapiens
SKLSKRMCQ

SEQ ID NO: 1299875 - protein, 9 aa, Homo Sapiens
QRRPLPWTR

SEQ ID NO: 1299876 - protein, 9 aa, Homo Sapiens
YEGQEALSF

SEQ ID NO: 1299877 - protein, 9 aa, Homo Sapiens
SPPLRHHPR

SEQ ID NO: 1299878 - protein, 9 aa, Homo Sapiens
QWLQGMTSS

SEQ ID NO: 1299879 - protein, 9 aa, Homo Sapiens
GVGLQRREG

SEQ ID NO: 1299880 - protein, 9 aa, Homo Sapiens
RRRAQAGRQ

SEQ ID NO: 1299881 - protein, 9 aa, Homo Sapiens
ECDKDFNQS

SEQ ID NO: 1299882 - protein, 9 aa, Homo Sapiens
RPIVLKLLC

SEQ ID NO: 1299883 - protein, 9 aa, Homo Sapiens
DRAHFTRQL

SEQ ID NO: 1299884 - protein, 9 aa, Homo Sapiens
TTTTNNRAT

SEQ ID NO: 1299885 - protein, 9 aa, Homo Sapiens
VTLKDVEDW

SEQ ID NO: 1299886 - protein, 9 aa, Homo Sapiens
RWFQFGKAL

SEQ ID NO: 1299887 - protein, 9 aa, Homo Sapiens
ACTPASGPS

SEQ ID NO: 1299888 - protein, 9 aa, Homo Sapiens
MTLWFKRMA

SEQ ID NO: 1299889 - protein, 9 aa, Homo Sapiens
SLGSCPGPG

SEQ ID NO: 1299890 - protein, 9 aa, Homo Sapiens
RVPTVPPQA

SEQ ID NO: 1299891 - protein, 9 aa, Homo Sapiens
EYLTPEIIL

SEQ ID NO: 1299892 - protein, 9 aa, Homo Sapiens
PLPSGLITP

SEQ ID NO: 1299893 - protein, 9 aa, Homo Sapiens
LCQESVTKQ

SEQ ID NO: 1299894 - protein, 9 aa, Homo Sapiens
KPSARSPTW

SEQ ID NO: 1299895 - protein, 9 aa, Homo Sapiens
SQWSLRSPR

SEQ ID NO: 1299896 - protein, 9 aa, Homo Sapiens
EEQARLWRR

SEQ ID NO: 1299897 - protein, 9 aa, Homo Sapiens
HSTPVRPAA

SEQ ID NO: 1299898 - protein, 9 aa, Homo Sapiens
GRAAAQRAQ

SEQ ID NO: 1299899 - protein, 9 aa, Homo Sapiens
HPSQRLLVP

SEQ ID NO: 1299900 - protein, 9 aa, Homo Sapiens
RRRGVGQAQ

SEQ ID NO: 1299901 - protein, 9 aa, Homo Sapiens
RTEKGIPAS

SEQ ID NO: 1299902 - protein, 9 aa, Homo Sapiens
CVKGFSYNS

SEQ ID NO: 1299903 - protein, 9 aa, Homo Sapiens
CPAVCDGVL

SEQ ID NO: 1299904 - protein, 9 aa, Homo Sapiens
QVLHLVLRG

SEQ ID NO: 1299905 - protein, 9 aa, Homo Sapiens
TRDPLSKIT

SEQ ID NO: 1299906 - protein, 9 aa, Homo Sapiens
MLGMPSPPV

SEQ ID NO: 1299907 - protein, 9 aa, Homo Sapiens
TVVVQHLLD

SEQ ID NO: 1299908 - protein, 9 aa, Homo Sapiens
VRGKEKEKD

SEQ ID NO: 1299909 - protein, 9 aa, Homo Sapiens
DPLSKITEQ

SEQ ID NO: 1299910 - protein, 9 aa, Homo Sapiens
YLTTVSQVT

SEQ ID NO: 1299911 - protein, 9 aa, Homo Sapiens
PGGAGPMEL

SEQ ID NO: 1299912 - protein, 9 aa, Homo Sapiens
SQRPVPHPL

SEQ ID NO: 1299913 - protein, 9 aa, Homo Sapiens
VPLRGLPLS

SEQ ID NO: 1299914 - protein, 9 aa, Homo Sapiens
SPSRRPLGV

SEQ ID NO: 1299915 - protein, 9 aa, Homo Sapiens
LHKARAAEE

SEQ ID NO: 1299916 - protein, 9 aa, Homo Sapiens
TAASARSPT

SEQ ID NO: 1299917 - protein, 9 aa, Homo Sapiens
GTPEYLTPE

SEQ ID NO: 1299918 - protein, 9 aa, Homo Sapiens
ESRFWLALQ

SEQ ID NO: 1299919 - protein, 9 aa, Homo Sapiens
LARRVCHPR

SEQ ID NO: 1299920 - protein, 9 aa, Homo Sapiens
PNLKGIPVD

SEQ ID NO: 1299921 - protein, 9 aa, Homo Sapiens
QDPIEAPPP

SEQ ID NO: 1299922 - protein, 9 aa, Homo Sapiens
EDKQNCQRR

SEQ ID NO: 1299923 - protein, 9 aa, Homo Sapiens
RQWPTVPCT

SEQ ID NO: 1299924 - protein, 9 aa, Homo Sapiens
QDVSSMQFA

SEQ ID NO: 1299925 - protein, 9 aa, Homo Sapiens
ASETTALSP

SEQ ID NO: 1299926 - protein, 9 aa, Homo Sapiens
TLMMSNGCW

SEQ ID NO: 1299927 - protein, 9 aa, Homo Sapiens
EIFVSCCVV

SEQ ID NO: 1299928 - protein, 9 aa, Homo Sapiens
RNMASCVQW

SEQ ID NO: 1299929 - protein, 9 aa, Homo Sapiens
PSTAATTAA

SEQ ID NO: 1299930 - protein, 9 aa, Homo Sapiens
PLHRFLLSN

SEQ ID NO: 1299931 - protein, 9 aa, Homo Sapiens
PARSAAAAS

SEQ ID NO: 1299932 - protein, 9 aa, Homo Sapiens
SSFPINVSS

SEQ ID NO: 1299933 - protein, 9 aa, Homo Sapiens
DMEKIPLHR

SEQ ID NO: 1299934 - protein, 9 aa, Homo Sapiens
PRNPTDEDV

SEQ ID NO: 1299935 - protein, 9 aa, Homo Sapiens
RDRAHFTRQ

SEQ ID NO: 1299936 - protein, 9 aa, Homo Sapiens
NTLLANSSP

SEQ ID NO: 1299937 - protein, 9 aa, Homo Sapiens
LGVSPLAPC

SEQ ID NO: 1299938 - protein, 9 aa, Homo Sapiens
TCSESPDCH

SEQ ID NO: 1299939 - protein, 9 aa, Homo Sapiens
HRQEKPSEY

SEQ ID NO: 1299940 - protein, 9 aa, Homo Sapiens
MVPSLWKGL

SEQ ID NO: 1299941 - protein, 9 aa, Homo Sapiens
VAWEHACQD

SEQ ID NO: 1299942 - protein, 9 aa, Homo Sapiens
RKSLYTLWN

SEQ ID NO: 1299943 - protein, 9 aa, Homo Sapiens
RARTARSAL

SEQ ID NO: 1299944 - protein, 9 aa, Homo Sapiens
SPLPSGLIT

SEQ ID NO: 1299945 - protein, 9 aa, Homo Sapiens
EIVHPSQED

SEQ ID NO: 1299946 - protein, 9 aa, Homo Sapiens
PESAEWKVL

SEQ ID NO: 1299947 - protein, 9 aa, Homo Sapiens
PLASAGHGT

SEQ ID NO: 1299948 - protein, 9 aa, Homo Sapiens
STTTTTNNR

SEQ ID NO: 1299949 - protein, 9 aa, Homo Sapiens
ARIPFRMGL

SEQ ID NO: 1299950 - protein, 9 aa, Homo Sapiens
LRDQCPAVC

SEQ ID NO: 1299951 - protein, 9 aa, Homo Sapiens
RRPLPWTRA

SEQ ID NO: 1299952 - protein, 9 aa, Homo Sapiens
AQRPRRHGA

SEQ ID NO: 1299953 - protein, 9 aa, Homo Sapiens
LLGLFGCLV

SEQ ID NO: 1299954 - protein, 9 aa, Homo Sapiens
AERRAQRVG

SEQ ID NO: 1299955 - protein, 9 aa, Homo Sapiens
RLHDRPPRR

SEQ ID NO: 1299956 - protein, 9 aa, Homo Sapiens
QYIFPPGVQ

SEQ ID NO: 1299957 - protein, 9 aa, Homo Sapiens
RSHSLKKNP

SEQ ID NO: 1299958 - protein, 9 aa, Homo Sapiens
ACCGLCHGG

SEQ ID NO: 1299959 - protein, 9 aa, Homo Sapiens
PTAAKPSAR

SEQ ID NO: 1299960 - protein, 9 aa, Homo Sapiens
YLQSVKKRC

SEQ ID NO: 1299961 - protein, 9 aa, Homo Sapiens
TLLCRLECS

SEQ ID NO: 1299962 - protein, 9 aa, Homo Sapiens
TWIHPVTWD

SEQ ID NO: 1299963 - protein, 9 aa, Homo Sapiens
GPVGRVAAH

SEQ ID NO: 1299964 - protein, 9 aa, Homo Sapiens
DLRQKLQGL

SEQ ID NO: 1299965 - protein, 9 aa, Homo Sapiens
RRRRKRSSQ

SEQ ID NO: 1299966 - protein, 9 aa, Homo Sapiens
FRIASPPSD

SEQ ID NO: 1299967 - protein, 9 aa, Homo Sapiens
VGARVGTEV

SEQ ID NO: 1299968 - protein, 9 aa, Homo Sapiens
PLGVSPLAP

SEQ ID NO: 1299969 - protein, 9 aa, Homo Sapiens
QPGEKKSQA

SEQ ID NO: 1299970 - protein, 9 aa, Homo Sapiens
MFVSINYIC

SEQ ID NO: 1299971 - protein, 9 aa, Homo Sapiens
TKANGSNKR

SEQ ID NO: 1299972 - protein, 9 aa, Homo Sapiens
DFDLSSNSE

SEQ ID NO: 1299973 - protein, 9 aa, Homo Sapiens
PEMPIADYH

SEQ ID NO: 1299974 - protein, 9 aa, Homo Sapiens
FLVKVLIHL

SEQ ID NO: 1299975 - protein, 9 aa, Homo Sapiens
PTSGSTPGS

SEQ ID NO: 1299976 - protein, 9 aa, Homo Sapiens
YHTRWSGIT

SEQ ID NO: 1299977 - protein, 9 aa, Homo Sapiens
RCEDEELEH

SEQ ID NO: 1299978 - protein, 9 aa, Homo Sapiens
HFDPENPQT

SEQ ID NO: 1299979 - protein, 9 aa, Homo Sapiens
SAKRNENFW

SEQ ID NO: 1299980 - protein, 9 aa, Homo Sapiens
LQLLPAPPN

SEQ ID NO: 1299981 - protein, 9 aa, Homo Sapiens
LAGAGNSTT

SEQ ID NO: 1299982 - protein, 9 aa, Homo Sapiens
FSLGVSDLL

SEQ ID NO: 1299983 - protein, 9 aa, Homo Sapiens
PPPSTAATT

SEQ ID NO: 1299984 - protein, 9 aa, Homo Sapiens
LREALNERH

SEQ ID NO: 1299985 - protein, 9 aa, Homo Sapiens
TLKDVEDWA

SEQ ID NO: 1299986 - protein, 9 aa, Homo Sapiens
RFQKNLKMR

SEQ ID NO: 1299987 - protein, 9 aa, Homo Sapiens
IVLKLLCQE

SEQ ID NO: 1299988 - protein, 9 aa, Homo Sapiens
GKTGEYHQT

SEQ ID NO: 1299989 - protein, 9 aa, Homo Sapiens
GPPWNMAQM

SEQ ID NO: 1299990 - protein, 9 aa, Homo Sapiens
WATGNIAVI

SEQ ID NO: 1299991 - protein, 9 aa, Homo Sapiens
SLKHQVQSM

SEQ ID NO: 1299992 - protein, 9 aa, Homo Sapiens
SLMEQIPHL

SEQ ID NO: 1299993 - protein, 9 aa, Homo Sapiens
IFPPGVQGA

SEQ ID NO: 1299994 - protein, 9 aa, Homo Sapiens
LRCGKTGEY

SEQ ID NO: 1299995 - protein, 9 aa, Homo Sapiens
QTTAWFYRD

SEQ ID NO: 1299996 - protein, 9 aa, Homo Sapiens
PQSVFELLS

SEQ ID NO: 1299997 - protein, 9 aa, Homo Sapiens
EGERHSGAG

SEQ ID NO: 1299998 - protein, 9 aa, Homo Sapiens
IHPVTWDQF

SEQ ID NO: 1299999 - protein, 9 aa, Homo Sapiens
ARAAEEPLP

SEQ ID NO: 1300000 - protein, 9 aa, Homo Sapiens
PSGLITPPQ

SEQ ID NO: 1300001 - protein, 9 aa, Homo Sapiens
SSRWFQFGK

SEQ ID NO: 1300002 - protein, 9 aa, Homo Sapiens
SVLNSSYTW

SEQ ID NO: 1300003 - protein, 9 aa, Homo Sapiens
LPLSQWSLR

SEQ ID NO: 1300004 - protein, 9 aa, Homo Sapiens
PSKRHPIFG

SEQ ID NO: 1300005 - protein, 9 aa, Homo Sapiens
QHTMNVPSL

SEQ ID NO: 1300006 - protein, 9 aa, Homo Sapiens
SDIIYKKLL

SEQ ID NO: 1300007 - protein, 9 aa, Homo Sapiens
GKPHGAAGL

SEQ ID NO: 1300008 - protein, 9 aa, Homo Sapiens
PRIRPNLKG

SEQ ID NO: 1300009 - protein, 9 aa, Homo Sapiens
ACVRLSGHI

SEQ ID NO: 1300010 - protein, 9 aa, Homo Sapiens
ATTAAGASG

SEQ ID NO: 1300011 - protein, 9 aa, Homo Sapiens
GSRPFAYVE

SEQ ID NO: 1300012 - protein, 9 aa, Homo Sapiens
WVMPKKVFR

SEQ ID NO: 1300013 - protein, 9 aa, Homo Sapiens
ICVKRRRRR

SEQ ID NO: 1300014 - protein, 9 aa, Homo Sapiens
CFTKQEWEN

SEQ ID NO: 1300015 - protein, 9 aa, Homo Sapiens
PETRTDPQL

SEQ ID NO: 1300016 - protein, 9 aa, Homo Sapiens
SAAAASPRA

SEQ ID NO: 1300017 - protein, 9 aa, Homo Sapiens
WMSCESILL

SEQ ID NO: 1300018 - protein, 9 aa, Homo Sapiens
KHSLTTYKI

SEQ ID NO: 1300019 - protein, 9 aa, Homo Sapiens
LRRFQALKK

SEQ ID NO: 1300020 - protein, 9 aa, Homo Sapiens
SYSLRFGGP

SEQ ID NO: 1300021 - protein, 9 aa, Homo Sapiens
WWAWFFTSP

SEQ ID NO: 1300022 - protein, 9 aa, Homo Sapiens
DMVWRTDGL

SEQ ID NO: 1300023 - protein, 9 aa, Homo Sapiens
AAKPSARSP

SEQ ID NO: 1300024 - protein, 9 aa, Homo Sapiens
STLRPMKRS

SEQ ID NO: 1300025 - protein, 9 aa, Homo Sapiens
WPRVPQGKP

SEQ ID NO: 1300026 - protein, 9 aa, Homo Sapiens
STPARSPTS

SEQ ID NO: 1300027 - protein, 9 aa, Homo Sapiens
IMVTKFYFQ

SEQ ID NO: 1300028 - protein, 9 aa, Homo Sapiens
TRRDSWPTR

SEQ ID NO: 1300029 - protein, 9 aa, Homo Sapiens
SLSSYVGSS

SEQ ID NO: 1300030 - protein, 9 aa, Homo Sapiens
PWRRRGLTL

SEQ ID NO: 1300031 - protein, 9 aa, Homo Sapiens
EVTGVGLQR

SEQ ID NO: 1300032 - protein, 9 aa, Homo Sapiens
LQLLPGGEL

SEQ ID NO: 1300033 - protein, 9 aa, Homo Sapiens
RQEKPSEYI

SEQ ID NO: 1300034 - protein, 9 aa, Homo Sapiens
QLLFSSLED

SEQ ID NO: 1300035 - protein, 9 aa, Homo Sapiens
WYIPLMKKP

SEQ ID NO: 1300036 - protein, 9 aa, Homo Sapiens
ELDSMVPVR

SEQ ID NO: 1300037 - protein, 9 aa, Homo Sapiens
VTWDQFLVV

SEQ ID NO: 1300038 - protein, 9 aa, Homo Sapiens
LQCHGELDS

SEQ ID NO: 1300039 - protein, 9 aa, Homo Sapiens
VTGVGLQRR

SEQ ID NO: 1300040 - protein, 9 aa, Homo Sapiens
RAPPGPSGL

SEQ ID NO: 1300041 - protein, 9 aa, Homo Sapiens
LQPGQPPFR

SEQ ID NO: 1300042 - protein, 9 aa, Homo Sapiens
QSVQYKKGA

SEQ ID NO: 1300043 - protein, 9 aa, Homo Sapiens
SHGEHSSTL

SEQ ID NO: 1300044 - protein, 9 aa, Homo Sapiens
KSRQMSHSS

SEQ ID NO: 1300045 - protein, 9 aa, Homo Sapiens
AQVSFLILG

SEQ ID NO: 1300046 - protein, 9 aa, Homo Sapiens
SQLPASSPT

SEQ ID NO: 1300047 - protein, 9 aa, Homo Sapiens
VKWGRSQAV

SEQ ID NO: 1300048 - protein, 9 aa, Homo Sapiens
TRGRKGSCP

SEQ ID NO: 1300049 - protein, 9 aa, Homo Sapiens
EVRRYQGEH

SEQ ID NO: 1300050 - protein, 9 aa, Homo Sapiens
GAVPDWELS

SEQ ID NO: 1300051 - protein, 9 aa, Homo Sapiens
LNARLNGEK

SEQ ID NO: 1300052 - protein, 9 aa, Homo Sapiens
YRTGRSYLM

SEQ ID NO: 1300053 - protein, 9 aa, Homo Sapiens
TVPPQARQQ

SEQ ID NO: 1300054 - protein, 9 aa, Homo Sapiens
INYICFTSK

SEQ ID NO: 1300055 - protein, 9 aa, Homo Sapiens
RCIANTHLN

SEQ ID NO: 1300056 - protein, 9 aa, Homo Sapiens
LDVVLCVAL

SEQ ID NO: 1300057 - protein, 9 aa, Homo Sapiens
ESGESTSTG

SEQ ID NO: 1300058 - protein, 9 aa, Homo Sapiens
MVWRTDGLL

SEQ ID NO: 1300059 - protein, 9 aa, Homo Sapiens
SNGCWGWQQ

SEQ ID NO: 1300060 - protein, 9 aa, Homo Sapiens
RGVGQAQGA

SEQ ID NO: 1300061 - protein, 9 aa, Homo Sapiens
QTSLQLLIP

SEQ ID NO: 1300062 - protein, 9 aa, Homo Sapiens
DEPTTTFVV

SEQ ID NO: 1300063 - protein, 9 aa, Homo Sapiens
KHIGMTDQT

SEQ ID NO: 1300064 - protein, 9 aa, Homo Sapiens
LFGCLVFLV

SEQ ID NO: 1300065 - protein, 9 aa, Homo Sapiens
VASLGPPWN

SEQ ID NO: 1300066 - protein, 9 aa, Homo Sapiens
PIAVRFANT

SEQ ID NO: 1300067 - protein, 9 aa, Homo Sapiens
QKGSPGGQN

SEQ ID NO: 1300068 - protein, 9 aa, Homo Sapiens
PHGLQRSRS

SEQ ID NO: 1300069 - protein, 9 aa, Homo Sapiens
PPIGPSCVP

SEQ ID NO: 1300070 - protein, 9 aa, Homo Sapiens
QMSHSSIQF

SEQ ID NO: 1300071 - protein, 9 aa, Homo Sapiens
AGVLFSAVS

SEQ ID NO: 1300072 - protein, 9 aa, Homo Sapiens
SASCGPTSG

SEQ ID NO: 1300073 - protein, 9 aa, Homo Sapiens
VAPDTWIVI

SEQ ID NO: 1300074 - protein, 9 aa, Homo Sapiens
IRPNLKGIP

SEQ ID NO: 1300075 - protein, 9 aa, Homo Sapiens
RKNSGSDNR

SEQ ID NO: 1300076 - protein, 9 aa, Homo Sapiens
WLPTAMGPL

SEQ ID NO: 1300077 - protein, 9 aa, Homo Sapiens
SFGGWTSPN

SEQ ID NO: 1300078 - protein, 9 aa, Homo Sapiens
NLDTFIKKS

SEQ ID NO: 1300079 - protein, 9 aa, Homo Sapiens
PKKRERMML

SEQ ID NO: 1300080 - protein, 9 aa, Homo Sapiens
AQCMDLAEC

SEQ ID NO: 1300081 - protein, 9 aa, Homo Sapiens
KTLPQTSLQ

SEQ ID NO: 1300082 - protein, 9 aa, Homo Sapiens
FYKCEECDK

SEQ ID NO: 1300083 - protein, 9 aa, Homo Sapiens
PRVPQGKPH

SEQ ID NO: 1300084 - protein, 9 aa, Homo Sapiens
SDVYDAQTY

SEQ ID NO: 1300085 - protein, 9 aa, Homo Sapiens
SPDCHWCCC

SEQ ID NO: 1300086 - protein, 9 aa, Homo Sapiens
PPGGARGGL

SEQ ID NO: 1300087 - protein, 9 aa, Homo Sapiens
GAHGPIGPP

SEQ ID NO: 1300088 - protein, 9 aa, Homo Sapiens
WCRTGASTR

SEQ ID NO: 1300089 - protein, 9 aa, Homo Sapiens
GKWFETWDE

SEQ ID NO: 1300090 - protein, 9 aa, Homo Sapiens
CQVENPPDV

SEQ ID NO: 1300091 - protein, 9 aa, Homo Sapiens
SSISSVSMP

SEQ ID NO: 1300092 - protein, 9 aa, Homo Sapiens
SLGPPWNMA

SEQ ID NO: 1300093 - protein, 9 aa, Homo Sapiens
FDGELWGYA

SEQ ID NO: 1300094 - protein, 9 aa, Homo Sapiens
RKSLEQKKK

SEQ ID NO: 1300095 - protein, 9 aa, Homo Sapiens
LDSMVPVRF

SEQ ID NO: 1300096 - protein, 9 aa, Homo Sapiens
SACVRLGVQ

SEQ ID NO: 1300097 - protein, 9 aa, Homo Sapiens
HSLANLDTF

SEQ ID NO: 1300098 - protein, 9 aa, Homo Sapiens
LQKDCSYLS

SEQ ID NO: 1300099 - protein, 9 aa, Homo Sapiens
SPWWWAWFF

SEQ ID NO: 1300100 - protein, 9 aa, Homo Sapiens
RQSRSPSLQ

SEQ ID NO: 1300101 - protein, 9 aa, Homo Sapiens
LPSLLSRMP

SEQ ID NO: 1300102 - protein, 9 aa, Homo Sapiens
WHRELQRPQ

SEQ ID NO: 1300103 - protein, 9 aa, Homo Sapiens
AVRFANTLL

SEQ ID NO: 1300104 - protein, 9 aa, Homo Sapiens
VPKKRERMM

SEQ ID NO: 1300105 - protein, 9 aa, Homo Sapiens
GRTSARRRT

SEQ ID NO: 1300106 - protein, 9 aa, Homo Sapiens
DLSSNSESS

SEQ ID NO: 1300107 - protein, 9 aa, Homo Sapiens
ELVRASRAG

SEQ ID NO: 1300108 - protein, 9 aa, Homo Sapiens
LQRREGRAA

SEQ ID NO: 1300109 - protein, 9 aa, Homo Sapiens
RWTWASTAA

SEQ ID NO: 1300110 - protein, 9 aa, Homo Sapiens
PGAVPDQEL

SEQ ID NO: 1300111 - protein, 9 aa, Homo Sapiens
EQARLWRRS

SEQ ID NO: 1300112 - protein, 9 aa, Homo Sapiens
RVGGADACV

SEQ ID NO: 1300113 - protein, 9 aa, Homo Sapiens
GKSYRLKHS

SEQ ID NO: 1300114 - protein, 9 aa, Homo Sapiens
CTAQTYPGP

SEQ ID NO: 1300115 - protein, 9 aa, Homo Sapiens
TSSPTARAT

SEQ ID NO: 1300116 - protein, 9 aa, Homo Sapiens
DRHCEDLDG

SEQ ID NO: 1300117 - protein, 9 aa, Homo Sapiens
NTQSLNPWG

SEQ ID NO: 1300118 - protein, 9 aa, Homo Sapiens
AGASGWSAS

SEQ ID NO: 1300119 - protein, 9 aa, Homo Sapiens
HYIYVVWVL

SEQ ID NO: 1300120 - protein, 9 aa, Homo Sapiens
HESLFSART

SEQ ID NO: 1300121 - protein, 9 aa, Homo Sapiens
TPLQNPVPL

SEQ ID NO: 1300122 - protein, 9 aa, Homo Sapiens
CHGELDSMV

SEQ ID NO: 1300123 - protein, 9 aa, Homo Sapiens
CPSKRHPIF

SEQ ID NO: 1300124 - protein, 9 aa, Homo Sapiens
EIVQDFKTD

SEQ ID NO: 1300125 - protein, 9 aa, Homo Sapiens
PTATAASAR

SEQ ID NO: 1300126 - protein, 9 aa, Homo Sapiens
GRSYLMNKL

SEQ ID NO: 1300127 - protein, 9 aa, Homo Sapiens
EVNGLILDI

SEQ ID NO: 1300128 - protein, 9 aa, Homo Sapiens
NPHALDSPS

SEQ ID NO: 1300129 - protein, 9 aa, Homo Sapiens
DESKWVELM

SEQ ID NO: 1300130 - protein, 9 aa, Homo Sapiens
PPQARQQSQ

SEQ ID NO: 1300131 - protein, 9 aa, Homo Sapiens
HPLTCDDPH

SEQ ID NO: 1300132 - protein, 9 aa, Homo Sapiens
RALPSLLSR

SEQ ID NO: 1300133 - protein, 9 aa, Homo Sapiens
ALWLCCATP

SEQ ID NO: 1300134 - protein, 9 aa, Homo Sapiens
PHACCGLCH

SEQ ID NO: 1300135 - protein, 9 aa, Homo Sapiens
PEMGCEIFI

SEQ ID NO: 1300136 - protein, 9 aa, Homo Sapiens
DPASVKHSL

SEQ ID NO: 1300137 - protein, 9 aa, Homo Sapiens
RPGAVPDWE

SEQ ID NO: 1300138 - protein, 9 aa, Homo Sapiens
ARSALPQGR

SEQ ID NO: 1300139 - protein, 9 aa, Homo Sapiens
SEQREKLYL

SEQ ID NO: 1300140 - protein, 9 aa, Homo Sapiens
FFFYPICTS

SEQ ID NO: 1300141 - protein, 9 aa, Homo Sapiens
WLLSLASSS

SEQ ID NO: 1300142 - protein, 9 aa, Homo Sapiens
SSLSSYVGS

SEQ ID NO: 1300143 - protein, 9 aa, Homo Sapiens
QLREALNER

SEQ ID NO: 1300144 - protein, 9 aa, Homo Sapiens
IPLHRFLLS

SEQ ID NO: 1300145 - protein, 9 aa, Homo Sapiens
LDTFIKKSE

SEQ ID NO: 1300146 - protein, 9 aa, Homo Sapiens
KTCECDDRH

SEQ ID NO: 1300147 - protein, 9 aa, Homo Sapiens
TRACTPASG

SEQ ID NO: 1300148 - protein, 9 aa, Homo Sapiens
SSSLSSYVG

SEQ ID NO: 1300149 - protein, 9 aa, Homo Sapiens
HQVLHLVLR

SEQ ID NO: 1300150 - protein, 9 aa, Homo Sapiens
LAKDGDLPS

SEQ ID NO: 1300151 - protein, 9 aa, Homo Sapiens
IRSASSTAT

SEQ ID NO: 1300152 - protein, 9 aa, Homo Sapiens
SNKRQTPQS

SEQ ID NO: 1300153 - protein, 9 aa, Homo Sapiens
AWPRVPQGK

SEQ ID NO: 1300154 - protein, 9 aa, Homo Sapiens
SPSPKPHGL

SEQ ID NO: 1300155 - protein, 9 aa, Homo Sapiens
PGGELLHPS

SEQ ID NO: 1300156 - protein, 9 aa, Homo Sapiens
PGEEENHKG

SEQ ID NO: 1300157 - protein, 9 aa, Homo Sapiens
AILNLQALI

SEQ ID NO: 1300158 - protein, 9 aa, Homo Sapiens
VPCLITDCT

SEQ ID NO: 1300159 - protein, 9 aa, Homo Sapiens
PQGKPHGAA

SEQ ID NO: 1300160 - protein, 9 aa, Homo Sapiens
GGDPAPGGA

SEQ ID NO: 1300161 - protein, 9 aa, Homo Sapiens
GCLVFLVIY

SEQ ID NO: 1300162 - protein, 9 aa, Homo Sapiens
FSRSPPTLM

SEQ ID NO: 1300163 - protein, 9 aa, Homo Sapiens
VLYLGVAHL

SEQ ID NO: 1300164 - protein, 9 aa, Homo Sapiens
SPQDPVSLD

SEQ ID NO: 1300165 - protein, 9 aa, Homo Sapiens
WTAEGAAGT

SEQ ID NO: 1300166 - protein, 9 aa, Homo Sapiens
GGARGGLGL

SEQ ID NO: 1300167 - protein, 9 aa, Homo Sapiens
PSAVPSVAR

SEQ ID NO: 1300168 - protein, 9 aa, Homo Sapiens
HLQVDEGLG

SEQ ID NO: 1300169 - protein, 9 aa, Homo Sapiens
PDEGIMVTK

SEQ ID NO: 1300170 - protein, 9 aa, Homo Sapiens
RSASSTATT

SEQ ID NO: 1300171 - protein, 9 aa, Homo Sapiens
SHYIYVVWV

SEQ ID NO: 1300172 - protein, 9 aa, Homo Sapiens
AIEVNGLIL

SEQ ID NO: 1300173 - protein, 9 aa, Homo Sapiens
RQMSHSSIQ

SEQ ID NO: 1300174 - protein, 9 aa, Homo Sapiens
GQIFQHLSP

SEQ ID NO: 1300175 - protein, 9 aa, Homo Sapiens
ELWLITTFH

SEQ ID NO: 1300176 - protein, 9 aa, Homo Sapiens
ASARSPTSS

SEQ ID NO: 1300177 - protein, 9 aa, Homo Sapiens
KMMLMHLVV

SEQ ID NO: 1300178 - protein, 9 aa, Homo Sapiens
FAYVEGQAH

SEQ ID NO: 1300179 - protein, 9 aa, Homo Sapiens
SLQLLIPRS

SEQ ID NO: 1300180 - protein, 9 aa, Homo Sapiens
GLRCGKTGE

SEQ ID NO: 1300181 - protein, 9 aa, Homo Sapiens
TAMGPLLAM

SEQ ID NO: 1300182 - protein, 9 aa, Homo Sapiens
DAAGPRVVC

SEQ ID NO: 1300183 - protein, 9 aa, Homo Sapiens
PITLTHSSE

SEQ ID NO: 1300184 - protein, 9 aa, Homo Sapiens
LDGLHHVAA

SEQ ID NO: 1300185 - protein, 9 aa, Homo Sapiens
VVSCCLDLR

SEQ ID NO: 1300186 - protein, 9 aa, Homo Sapiens
CSYLSRNQS

SEQ ID NO: 1300187 - protein, 9 aa, Homo Sapiens
VLLKAFSFH

SEQ ID NO: 1300188 - protein, 9 aa, Homo Sapiens
RDSWPTRRS

SEQ ID NO: 1300189 - protein, 9 aa, Homo Sapiens
SCSGIIQGT

SEQ ID NO: 1300190 - protein, 9 aa, Homo Sapiens
YECSQCVKG

SEQ ID NO: 1300191 - protein, 9 aa, Homo Sapiens
SWRRHEPEF

SEQ ID NO: 1300192 - protein, 9 aa, Homo Sapiens
YDIRDRAHF

SEQ ID NO: 1300193 - protein, 9 aa, Homo Sapiens
ELAGRVGGA

SEQ ID NO: 1300194 - protein, 9 aa, Homo Sapiens
TGSPEDRSH

SEQ ID NO: 1300195 - protein, 9 aa, Homo Sapiens
PACSILPSW

SEQ ID NO: 1300196 - protein, 9 aa, Homo Sapiens
PTSSPTARA

SEQ ID NO: 1300197 - protein, 9 aa, Homo Sapiens
IIHGYAEKK

SEQ ID NO: 1300198 - protein, 9 aa, Homo Sapiens
LKCHLLQEA

SEQ ID NO: 1300199 - protein, 9 aa, Homo Sapiens
IDVLKADPE

SEQ ID NO: 1300200 - protein, 9 aa, Homo Sapiens
NRATKANGS

SEQ ID NO: 1300201 - protein, 9 aa, Homo Sapiens
ARPSATNPT

SEQ ID NO: 1300202 - protein, 9 aa, Homo Sapiens
ETKSRQMSH

SEQ ID NO: 1300203 - protein, 9 aa, Homo Sapiens
TRKNSGSDN

SEQ ID NO: 1300204 - protein, 9 aa, Homo Sapiens
SLVNPFFFY

SEQ ID NO: 1300205 - protein, 9 aa, Homo Sapiens
VVCSCCSTH

SEQ ID NO: 1300206 - protein, 9 aa, Homo Sapiens
VQIFQIMRI

SEQ ID NO: 1300207 - protein, 9 aa, Homo Sapiens
EDSQRPVPH

SEQ ID NO: 1300208 - protein, 9 aa, Homo Sapiens
DPAPGGAGP

SEQ ID NO: 1300209 - protein, 9 aa, Homo Sapiens
TENLLRLCK

SEQ ID NO: 1300210 - protein, 9 aa, Homo Sapiens
DLPSLQSNA

SEQ ID NO: 1300211 - protein, 9 aa, Homo Sapiens
DTENLLRLC

SEQ ID NO: 1300212 - protein, 9 aa, Homo Sapiens
PNSSLTSPG

SEQ ID NO: 1300213 - protein, 9 aa, Homo Sapiens
AAQCQDPPI

SEQ ID NO: 1300214 - protein, 9 aa, Homo Sapiens
AAGPAWASL

SEQ ID NO: 1300215 - protein, 9 aa, Homo Sapiens
VKKRCSLME

SEQ ID NO: 1300216 - protein, 9 aa, Homo Sapiens
GTSLVAARG

SEQ ID NO: 1300217 - protein, 9 aa, Homo Sapiens
REKLYLVKH

SEQ ID NO: 1300218 - protein, 9 aa, Homo Sapiens
RAIREDCEP

SEQ ID NO: 1300219 - protein, 9 aa, Homo Sapiens
VGRDAQVRA

SEQ ID NO: 1300220 - protein, 9 aa, Homo Sapiens
TRASGPTPV

SEQ ID NO: 1300221 - protein, 9 aa, Homo Sapiens
DWAFLLRQV

SEQ ID NO: 1300222 - protein, 9 aa, Homo Sapiens
IAVIPIIKT

SEQ ID NO: 1300223 - protein, 9 aa, Homo Sapiens
FTLHQVLHL

SEQ ID NO: 1300224 - protein, 9 aa, Homo Sapiens
ASPLPSGLI

SEQ ID NO: 1300225 - protein, 9 aa, Homo Sapiens
PQDPVSLDF

SEQ ID NO: 1300226 - protein, 9 aa, Homo Sapiens
AVRRRRGVG

SEQ ID NO: 1300227 - protein, 9 aa, Homo Sapiens
WRRRGLTLF

SEQ ID NO: 1300228 - protein, 9 aa, Homo Sapiens
YQNVRTQSY

SEQ ID NO: 1300229 - protein, 9 aa, Homo Sapiens
LKRRKSLEQ

SEQ ID NO: 1300230 - protein, 9 aa, Homo Sapiens
SLARLVGDE

SEQ ID NO: 1300231 - protein, 9 aa, Homo Sapiens
SARSPTWCR

SEQ ID NO: 1300232 - protein, 9 aa, Homo Sapiens
DDPHFQASS

SEQ ID NO: 1300233 - protein, 9 aa, Homo Sapiens
EYQRQLLLG

SEQ ID NO: 1300234 - protein, 9 aa, Homo Sapiens
VAAHMQVGG

SEQ ID NO: 1300235 - protein, 9 aa, Homo Sapiens
HGLQRSRSR

SEQ ID NO: 1300236 - protein, 9 aa, Homo Sapiens
CQESVTKQQ

SEQ ID NO: 1300237 - protein, 9 aa, Homo Sapiens
CECGKAFSG

SEQ ID NO: 1300238 - protein, 9 aa, Homo Sapiens
RDAQVRAVV

SEQ ID NO: 1300239 - protein, 9 aa, Homo Sapiens
DETSLCSVM

SEQ ID NO: 1300240 - protein, 9 aa, Homo Sapiens
PWSPRSPPE

SEQ ID NO: 1300241 - protein, 9 aa, Homo Sapiens
VRKIGEEVR

SEQ ID NO: 1300242 - protein, 9 aa, Homo Sapiens
CVALAPAPE

SEQ ID NO: 1300243 - protein, 9 aa, Homo Sapiens
EITSPSKRT

SEQ ID NO: 1300244 - protein, 9 aa, Homo Sapiens
RDCFTLHQV

SEQ ID NO: 1300245 - protein, 9 aa, Homo Sapiens
HPRGPPPPS

SEQ ID NO: 1300246 - protein, 9 aa, Homo Sapiens
AMQWVHSTP

SEQ ID NO: 1300247 - protein, 9 aa, Homo Sapiens
LGPPWNMAQ

SEQ ID NO: 1300248 - protein, 9 aa, Homo Sapiens
KSSISSVSM

SEQ ID NO: 1300249 - protein, 9 aa, Homo Sapiens
CQKEDLKGK

SEQ ID NO: 1300250 - protein, 9 aa, Homo Sapiens
KMRIWYIPL

SEQ ID NO: 1300251 - protein, 9 aa, Homo Sapiens
KRQHLHCCT

SEQ ID NO: 1300252 - protein, 9 aa, Homo Sapiens
KPHGAAGLR

SEQ ID NO: 1300253 - protein, 9 aa, Homo Sapiens
SRGDGAKFP

SEQ ID NO: 1300254 - protein, 9 aa, Homo Sapiens
LKDVEDWAF

SEQ ID NO: 1300255 - protein, 9 aa, Homo Sapiens
VRRCGGPRL

SEQ ID NO: 1300256 - protein, 9 aa, Homo Sapiens
REFRNRLPG

SEQ ID NO: 1300257 - protein, 9 aa, Homo Sapiens
QDLCRGPRL

SEQ ID NO: 1300258 - protein, 9 aa, Homo Sapiens
CRLECSNTI

SEQ ID NO: 1300259 - protein, 9 aa, Homo Sapiens
REGRAAAQR

SEQ ID NO: 1300260 - protein, 9 aa, Homo Sapiens
PLIPQTTAW

SEQ ID NO: 1300261 - protein, 9 aa, Homo Sapiens
EECDKDFNQ

SEQ ID NO: 1300262 - protein, 9 aa, Homo Sapiens
ATTPPIGPS

SEQ ID NO: 1300263 - protein, 9 aa, Homo Sapiens
IAVRGGQGT

SEQ ID NO: 1300264 - protein, 9 aa, Homo Sapiens
SSAASSLKS

SEQ ID NO: 1300265 - protein, 9 aa, Homo Sapiens
AKKKMMLMH

SEQ ID NO: 1300266 - protein, 9 aa, Homo Sapiens
CRGPRLPSQ

SEQ ID NO: 1300267 - protein, 9 aa, Homo Sapiens
AVRGKEKEK

SEQ ID NO: 1300268 - protein, 9 aa, Homo Sapiens
EVHPLHMLV

SEQ ID NO: 1300269 - protein, 9 aa, Homo Sapiens
LASSQISFG

SEQ ID NO: 1300270 - protein, 9 aa, Homo Sapiens
HLCPSKRHP

SEQ ID NO: 1300271 - protein, 9 aa, Homo Sapiens
TATAASARS

SEQ ID NO: 1300272 - protein, 9 aa, Homo Sapiens
CSRPSSSAT

SEQ ID NO: 1300273 - protein, 9 aa, Homo Sapiens
SPGIPGAHG

SEQ ID NO: 1300274 - protein, 9 aa, Homo Sapiens
CVKRRRRRK

SEQ ID NO: 1300275 - protein, 9 aa, Homo Sapiens
VQYKKGAQV

SEQ ID NO: 1300276 - protein, 9 aa, Homo Sapiens
TKSRQMSHS

SEQ ID NO: 1300277 - protein, 9 aa, Homo Sapiens
MDQLPENGI

SEQ ID NO: 1300278 - protein, 9 aa, Homo Sapiens
RNVLMDTSA

SEQ ID NO: 1300279 - protein, 9 aa, Homo Sapiens
LALGERAPP

SEQ ID NO: 1300280 - protein, 9 aa, Homo Sapiens
VDPAVMGAS

SEQ ID NO: 1300281 - protein, 9 aa, Homo Sapiens
RSTLRPMKR

SEQ ID NO: 1300282 - protein, 9 aa, Homo Sapiens
ASAGHGTCS

SEQ ID NO: 1300283 - protein, 9 aa, Homo Sapiens
SPTSAPTAA

SEQ ID NO: 1300284 - protein, 9 aa, Homo Sapiens
WSPRSPPEL

SEQ ID NO: 1300285 - protein, 9 aa, Homo Sapiens
LASSSYYRA

SEQ ID NO: 1300286 - protein, 9 aa, Homo Sapiens
YRDCFTLHQ

SEQ ID NO: 1300287 - protein, 9 aa, Homo Sapiens
SRQMSHSSI

SEQ ID NO: 1300288 - protein, 9 aa, Homo Sapiens
AMDLMEPRL

SEQ ID NO: 1300289 - protein, 9 aa, Homo Sapiens
SRSPPTLMM

SEQ ID NO: 1300290 - protein, 9 aa, Homo Sapiens
NIMFDPHKM

SEQ ID NO: 1300291 - protein, 9 aa, Homo Sapiens
PPVGAGTGG

SEQ ID NO: 1300292 - protein, 9 aa, Homo Sapiens
ETRTDPQLE

SEQ ID NO: 1300293 - protein, 9 aa, Homo Sapiens
QVKELKKIL

SEQ ID NO: 1300294 - protein, 9 aa, Homo Sapiens
LGPPPPGGA

SEQ ID NO: 1300295 - protein, 9 aa, Homo Sapiens
RLNGEKTLP

SEQ ID NO: 1300296 - protein, 9 aa, Homo Sapiens
KSGVLNLTV

SEQ ID NO: 1300297 - protein, 9 aa, Homo Sapiens
EDWAFLLRQ

SEQ ID NO: 1300298 - protein, 9 aa, Homo Sapiens
VYCHIHRIP

SEQ ID NO: 1300299 - protein, 9 aa, Homo Sapiens
AATTAAGAS

SEQ ID NO: 1300300 - protein, 9 aa, Homo Sapiens
PCPPLEVHL

SEQ ID NO: 1300301 - protein, 9 aa, Homo Sapiens
WLCCATPAH

SEQ ID NO: 1300302 - protein, 9 aa, Homo Sapiens
RRKSLEQKK

SEQ ID NO: 1300303 - protein, 9 aa, Homo Sapiens
IQACHGTEL

SEQ ID NO: 1300304 - protein, 9 aa, Homo Sapiens
IIQACHGTE

SEQ ID NO: 1300305 - protein, 9 aa, Homo Sapiens
GATTPPIGP

SEQ ID NO: 1300306 - protein, 9 aa, Homo Sapiens
NGIAPITLT

SEQ ID NO: 1300307 - protein, 9 aa, Homo Sapiens
PACVPVAEA

SEQ ID NO: 1300308 - protein, 9 aa, Homo Sapiens
FQKNLKMRI

SEQ ID NO: 1300309 - protein, 9 aa, Homo Sapiens
DALAKWEEY

SEQ ID NO: 1300310 - protein, 9 aa, Homo Sapiens
RGDGAKFPE

SEQ ID NO: 1300311 - protein, 9 aa, Homo Sapiens
CYTRLFSPL

SEQ ID NO: 1300312 - protein, 9 aa, Homo Sapiens
TINPDRETL

SEQ ID NO: 1300313 - protein, 9 aa, Homo Sapiens
QVRAVVLYL

SEQ ID NO: 1300314 - protein, 9 aa, Homo Sapiens
CKIVNWALS

SEQ ID NO: 1300315 - protein, 9 aa, Homo Sapiens
GWSASCGPT

SEQ ID NO: 1300316 - protein, 9 aa, Homo Sapiens
IVDRAKWKI

SEQ ID NO: 1300317 - protein, 9 aa, Homo Sapiens
VGGHGVVAA

SEQ ID NO: 1300318 - protein, 9 aa, Homo Sapiens
WISVTVLFD

SEQ ID NO: 1300319 - protein, 9 aa, Homo Sapiens
KIGEEVRRY

SEQ ID NO: 1300320 - protein, 9 aa, Homo Sapiens
QCQDPPISP

SEQ ID NO: 1300321 - protein, 9 aa, Homo Sapiens
AKDGDLPSL

SEQ ID NO: 1300322 - protein, 9 aa, Homo Sapiens
SFSSTKSFA

SEQ ID NO: 1300323 - protein, 9 aa, Homo Sapiens
SPEDRSHGE

SEQ ID NO: 1300324 - protein, 9 aa, Homo Sapiens
YTRLFSPLI

SEQ ID NO: 1300325 - protein, 9 aa, Homo Sapiens
VKTTVENEL

SEQ ID NO: 1300326 - protein, 9 aa, Homo Sapiens
HACQDIQRR

SEQ ID NO: 1300327 - protein, 9 aa, Homo Sapiens
GASTPARSP

SEQ ID NO: 1300328 - protein, 9 aa, Homo Sapiens
QKNLKMRIW

SEQ ID NO: 1300329 - protein, 9 aa, Homo Sapiens
ASLGSCPGP

SEQ ID NO: 1300330 - protein, 9 aa, Homo Sapiens
IPLLKCIAK

SEQ ID NO: 1300331 - protein, 9 aa, Homo Sapiens
ERAPPGPSG

SEQ ID NO: 1300332 - protein, 9 aa, Homo Sapiens
LNGEKTLPQ

SEQ ID NO: 1300333 - protein, 9 aa, Homo Sapiens
LALWLCCAT

SEQ ID NO: 1300334 - protein, 9 aa, Homo Sapiens
SGQIFQHLS

SEQ ID NO: 1300335 - protein, 9 aa, Homo Sapiens
RVAAHMQVG

SEQ ID NO: 1300336 - protein, 9 aa, Homo Sapiens
TLSGAEGTS

SEQ ID NO: 1300337 - protein, 9 aa, Homo Sapiens
PRPGAVPDW

SEQ ID NO: 1300338 - protein, 9 aa, Homo Sapiens
AAPMAGSML

SEQ ID NO: 1300339 - protein, 9 aa, Homo Sapiens
DAKKKKKKE

SEQ ID NO: 1300340 - protein, 9 aa, Homo Sapiens
VPPQARQQS

SEQ ID NO: 1300341 - protein, 9 aa, Homo Sapiens
FAGVLFSAV

SEQ ID NO: 1300342 - protein, 9 aa, Homo Sapiens
VRLSGHILD

SEQ ID NO: 1300343 - protein, 9 aa, Homo Sapiens
QKKRCIANT

SEQ ID NO: 1300344 - protein, 9 aa, Homo Sapiens
PIRWMSCES

SEQ ID NO: 1300345 - protein, 9 aa, Homo Sapiens
GRSQAVRGK

SEQ ID NO: 1300346 - protein, 9 aa, Homo Sapiens
AYVEGQAHR

SEQ ID NO: 1300347 - protein, 9 aa, Homo Sapiens
SAFVRTEKG

SEQ ID NO: 1300348 - protein, 9 aa, Homo Sapiens
TPEYLTPEI

SEQ ID NO: 1300349 - protein, 9 aa, Homo Sapiens
SYTWMVPLT

SEQ ID NO: 1300350 - protein, 9 aa, Homo Sapiens
GGPETRCSY

SEQ ID NO: 1300351 - protein, 9 aa, Homo Sapiens
KKMMLMHLV

SEQ ID NO: 1300352 - protein, 9 aa, Homo Sapiens
TGSRQSRSP

SEQ ID NO: 1300353 - protein, 9 aa, Homo Sapiens
PGEKKSQAS

SEQ ID NO: 1300354 - protein, 9 aa, Homo Sapiens
VALHFLQPR

SEQ ID NO: 1300355 - protein, 9 aa, Homo Sapiens
EAMDLMEPR

SEQ ID NO: 1300356 - protein, 9 aa, Homo Sapiens
ECECGKAFS

SEQ ID NO: 1300357 - protein, 9 aa, Homo Sapiens
QKEDLKGKK

SEQ ID NO: 1300358 - protein, 9 aa, Homo Sapiens
KIPLHRFLL

SEQ ID NO: 1300359 - protein, 9 aa, Homo Sapiens
VSSLVNPFF

SEQ ID NO: 1300360 - protein, 9 aa, Homo Sapiens
AASSLKSSI

SEQ ID NO: 1300361 - protein, 9 aa, Homo Sapiens
GTYTCQVEN

SEQ ID NO: 1300362 - protein, 9 aa, Homo Sapiens
PHFQASSSS

SEQ ID NO: 1300363 - protein, 9 aa, Homo Sapiens
TDGLLPLEE

SEQ ID NO: 1300364 - protein, 9 aa, Homo Sapiens
ELHKARAAE

SEQ ID NO: 1300365 - protein, 9 aa, Homo Sapiens
PYAQKRSHY

SEQ ID NO: 1300366 - protein, 9 aa, Homo Sapiens
VAKKKMMLM

SEQ ID NO: 1300367 - protein, 9 aa, Homo Sapiens
HCVKTTVEN

SEQ ID NO: 1300368 - protein, 9 aa, Homo Sapiens
GCWGWQQSW

SEQ ID NO: 1300369 - protein, 9 aa, Homo Sapiens
LTYHVDADK

SEQ ID NO: 1300370 - protein, 9 aa, Homo Sapiens
GGLQIQEKS

SEQ ID NO: 1300371 - protein, 9 aa, Homo Sapiens
WEHACQDIQ

SEQ ID NO: 1300372 - protein, 9 aa, Homo Sapiens
NVSSLVNPF

SEQ ID NO: 1300373 - protein, 9 aa, Homo Sapiens
VLAKDGDLP

SEQ ID NO: 1300374 - protein, 9 aa, Homo Sapiens
FPHNFVLLV

SEQ ID NO: 1300375 - protein, 9 aa, Homo Sapiens
TKRPTRKNS

SEQ ID NO: 1300376 - protein, 9 aa, Homo Sapiens
STRDPLSKI

SEQ ID NO: 1300377 - protein, 9 aa, Homo Sapiens
PSSGYRAVT

SEQ ID NO: 1300378 - protein, 9 aa, Homo Sapiens
QMFVSINYI

SEQ ID NO: 1300379 - protein, 9 aa, Homo Sapiens
RDEAHGGGD

SEQ ID NO: 1300380 - protein, 9 aa, Homo Sapiens
DSPVKRPRL

SEQ ID NO: 1300381 - protein, 9 aa, Homo Sapiens
RPVPHPLNK

SEQ ID NO: 1300382 - protein, 9 aa, Homo Sapiens
FSSTKSFAR

SEQ ID NO: 1300383 - protein, 9 aa, Homo Sapiens
RKVPWKRKQ

SEQ ID NO: 1300384 - protein, 9 aa, Homo Sapiens
ARAKKAVKK

SEQ ID NO: 1300385 - protein, 9 aa, Homo Sapiens
LFSSLEDPA

SEQ ID NO: 1300386 - protein, 9 aa, Homo Sapiens
LWSIWPACS

SEQ ID NO: 1300387 - protein, 9 aa, Homo Sapiens
LLGPPPPHQ

SEQ ID NO: 1300388 - protein, 9 aa, Homo Sapiens
DQCPAVCDG

SEQ ID NO: 1300389 - protein, 9 aa, Homo Sapiens
LPRALPSLL

SEQ ID NO: 1300390 - protein, 9 aa, Homo Sapiens
EPGIRGVSL

SEQ ID NO: 1300391 - protein, 9 aa, Homo Sapiens
PHPLNKLQG

SEQ ID NO: 1300392 - protein, 9 aa, Homo Sapiens
DTINPDRET

SEQ ID NO: 1300393 - protein, 9 aa, Homo Sapiens
AGLRCGKTG

SEQ ID NO: 1300394 - protein, 9 aa, Homo Sapiens
PMKRSRSSR

SEQ ID NO: 1300395 - protein, 9 aa, Homo Sapiens
SKGIAVRGG

SEQ ID NO: 1300396 - protein, 9 aa, Homo Sapiens
LCVALAPAP

SEQ ID NO: 1300397 - protein, 9 aa, Homo Sapiens
KRCSLMEQI

SEQ ID NO: 1300398 - protein, 9 aa, Homo Sapiens
STTRRDSWP

SEQ ID NO: 1300399 - protein, 9 aa, Homo Sapiens
IMKHIGMTD

SEQ ID NO: 1300400 - protein, 9 aa, Homo Sapiens
DLAECTLIH

SEQ ID NO: 1300401 - protein, 9 aa, Homo Sapiens
HTRGRPRWC

SEQ ID NO: 1300402 - protein, 9 aa, Homo Sapiens
TSEQREKLY

SEQ ID NO: 1300403 - protein, 9 aa, Homo Sapiens
GQPPFRRES

SEQ ID NO: 1300404 - protein, 9 aa, Homo Sapiens
RPPPLVRCH

SEQ ID NO: 1300405 - protein, 9 aa, Homo Sapiens
TVPCTSPMC

SEQ ID NO: 1300406 - protein, 9 aa, Homo Sapiens
PKTMRNLKQ

SEQ ID NO: 1300407 - protein, 9 aa, Homo Sapiens
MKKPTKRPT

SEQ ID NO: 1300408 - protein, 9 aa, Homo Sapiens
DETTEPPPV

SEQ ID NO: 1300409 - protein, 9 aa, Homo Sapiens
PAPGGAGPM

SEQ ID NO: 1300410 - protein, 9 aa, Homo Sapiens
NEDSPVKRP

SEQ ID NO: 1300411 - protein, 9 aa, Homo Sapiens
LRGFFFAGV

SEQ ID NO: 1300412 - protein, 9 aa, Homo Sapiens
EHQEARLKR

SEQ ID NO: 1300413 - protein, 9 aa, Homo Sapiens
GTIVIQYIF

SEQ ID NO: 1300414 - protein, 9 aa, Homo Sapiens
SFNTLLKCH

SEQ ID NO: 1300415 - protein, 9 aa, Homo Sapiens
VMPKKVFRI

SEQ ID NO: 1300416 - protein, 9 aa, Homo Sapiens
RGDTSTPPC

SEQ ID NO: 1300417 - protein, 9 aa, Homo Sapiens
RPRRHGAGQ

SEQ ID NO: 1300418 - protein, 9 aa, Homo Sapiens
AHFTRQLIV

SEQ ID NO: 1300419 - protein, 9 aa, Homo Sapiens
GPRLQRRRQ

SEQ ID NO: 1300420 - protein, 9 aa, Homo Sapiens
LLSFISSFP

SEQ ID NO: 1300421 - protein, 9 aa, Homo Sapiens
VSINYICFT

SEQ ID NO: 1300422 - protein, 9 aa, Homo Sapiens
NPVPLRGLP

SEQ ID NO: 1300423 - protein, 9 aa, Homo Sapiens
PICTSWHCN

SEQ ID NO: 1300424 - protein, 9 aa, Homo Sapiens
RGAAGPAWA

SEQ ID NO: 1300425 - protein, 9 aa, Homo Sapiens
SLTTYKIIP

SEQ ID NO: 1300426 - protein, 9 aa, Homo Sapiens
FVRTEKGIP

SEQ ID NO: 1300427 - protein, 9 aa, Homo Sapiens
CGTPEYLTP

SEQ ID NO: 1300428 - protein, 9 aa, Homo Sapiens
CMDLAECTL

SEQ ID NO: 1300429 - protein, 9 aa, Homo Sapiens
RALRDQCPA

SEQ ID NO: 1300430 - protein, 9 aa, Homo Sapiens
NMASCVQWK

SEQ ID NO: 1300431 - protein, 9 aa, Homo Sapiens
AARPSATNP

SEQ ID NO: 1300432 - protein, 9 aa, Homo Sapiens
SRWFQFGKA

SEQ ID NO: 1300433 - protein, 9 aa, Homo Sapiens
HSGRLHDRP

SEQ ID NO: 1300434 - protein, 9 aa, Homo Sapiens
ALSPEATTF

SEQ ID NO: 1300435 - protein, 9 aa, Homo Sapiens
PMAGSMLGM

SEQ ID NO: 1300436 - protein, 9 aa, Homo Sapiens
RGGDPAPGG

SEQ ID NO: 1300437 - protein, 9 aa, Homo Sapiens
HCEDLDGVV

SEQ ID NO: 1300438 - protein, 9 aa, Homo Sapiens
GGTRMRGES

SEQ ID NO: 1300439 - protein, 9 aa, Homo Sapiens
PDCHWCCCS

SEQ ID NO: 1300440 - protein, 9 aa, Homo Sapiens
EIHVHRHPQ

SEQ ID NO: 1300441 - protein, 9 aa, Homo Sapiens
SRTDTENLL

SEQ ID NO: 1300442 - protein, 9 aa, Homo Sapiens
PLQNPVPLR

SEQ ID NO: 1300443 - protein, 9 aa, Homo Sapiens
GAAGPAWAS

SEQ ID NO: 1300444 - protein, 9 aa, Homo Sapiens
HEDKQNCQR

SEQ ID NO: 1300445 - protein, 9 aa, Homo Sapiens
ENDLFDRLN

SEQ ID NO: 1300446 - protein, 9 aa, Homo Sapiens
QREKLYLVK

SEQ ID NO: 1300447 - protein, 9 aa, Homo Sapiens
QCQKEDLKG

SEQ ID NO: 1300448 - protein, 9 aa, Homo Sapiens
RSPVPKKRE

SEQ ID NO: 1300449 - protein, 9 aa, Homo Sapiens
RPSTTRRDS

SEQ ID NO: 1300450 - protein, 9 aa, Homo Sapiens
SCVPTAARP

SEQ ID NO: 1300451 - protein, 9 aa, Homo Sapiens
RTHPKEKPF

SEQ ID NO: 1300452 - protein, 9 aa, Homo Sapiens
SPVAWEHAC

SEQ ID NO: 1300453 - protein, 9 aa, Homo Sapiens
AKFPELVIQ

SEQ ID NO: 1300454 - protein, 9 aa, Homo Sapiens
FYLPVVIMM

SEQ ID NO: 1300455 - protein, 9 aa, Homo Sapiens
LRHHPRGPP

SEQ ID NO: 1300456 - protein, 9 aa, Homo Sapiens
RRWTWASTA

SEQ ID NO: 1300457 - protein, 9 aa, Homo Sapiens
LKEMLVCMS

SEQ ID NO: 1300458 - protein, 9 aa, Homo Sapiens
AVHRGDTST

SEQ ID NO: 1300459 - protein, 9 aa, Homo Sapiens
LARLVGDES

SEQ ID NO: 1300460 - protein, 9 aa, Homo Sapiens
PVTWDQFLV

SEQ ID NO: 1300461 - protein, 9 aa, Homo Sapiens
GARVEAVAS

SEQ ID NO: 1300462 - protein, 9 aa, Homo Sapiens
RRIGATTPP

SEQ ID NO: 1300463 - protein, 9 aa, Homo Sapiens
DCDEVIAFL

SEQ ID NO: 1300464 - protein, 9 aa, Homo Sapiens
MGPVGRVAA

SEQ ID NO: 1300465 - protein, 9 aa, Homo Sapiens
SPSKRTQPD

SEQ ID NO: 1300466 - protein, 9 aa, Homo Sapiens
VRPAAQCQD

SEQ ID NO: 1300467 - protein, 9 aa, Homo Sapiens
RQTPQSVFE

SEQ ID NO: 1300468 - protein, 9 aa, Homo Sapiens
WWWAWFFTS

SEQ ID NO: 1300469 - protein, 9 aa, Homo Sapiens
QIMRILRIL

SEQ ID NO: 1300470 - protein, 9 aa, Homo Sapiens
GPGAVPDQE

SEQ ID NO: 1300471 - protein, 9 aa, Homo Sapiens
STGSRQSRS

SEQ ID NO: 1300472 - protein, 9 aa, Homo Sapiens
IIERIPLLK

SEQ ID NO: 1300473 - protein, 9 aa, Homo Sapiens
RKRSSQSRS

SEQ ID NO: 1300474 - protein, 9 aa, Homo Sapiens
MRIWYIPLM

SEQ ID NO: 1300475 - protein, 9 aa, Homo Sapiens
GHILDLDVV

SEQ ID NO: 1300476 - protein, 9 aa, Homo Sapiens
LQDASPVAW

SEQ ID NO: 1300477 - protein, 9 aa, Homo Sapiens
LEDPALLVP

SEQ ID NO: 1300478 - protein, 9 aa, Homo Sapiens
DDAQERDEA

SEQ ID NO: 1300479 - protein, 9 aa, Homo Sapiens
HGVVAARVG

SEQ ID NO: 1300480 - protein, 9 aa, Homo Sapiens
TCQVENPPD

SEQ ID NO: 1300481 - protein, 9 aa, Homo Sapiens
QRREGRAAA

SEQ ID NO: 1300482 - protein, 9 aa, Homo Sapiens
GASGWSASC

SEQ ID NO: 1300483 - protein, 9 aa, Homo Sapiens
RRTHLLCYR

SEQ ID NO: 1300484 - protein, 9 aa, Homo Sapiens
ERIPLLKCI

SEQ ID NO: 1300485 - protein, 9 aa, Homo Sapiens
EHACQDIQR

SEQ ID NO: 1300486 - protein, 9 aa, Homo Sapiens
TSPASTTRS

SEQ ID NO: 1300487 - protein, 9 aa, Homo Sapiens
VLCVALAPA

SEQ ID NO: 1300488 - protein, 9 aa, Homo Sapiens
VPSLWKGLV

SEQ ID NO: 1300489 - protein, 9 aa, Homo Sapiens
WRRTGASTP

SEQ ID NO: 1300490 - protein, 9 aa, Homo Sapiens
SATSARRGP

SEQ ID NO: 1300491 - protein, 9 aa, Homo Sapiens
LPLLTWQLW

SEQ ID NO: 1300492 - protein, 9 aa, Homo Sapiens
SLWISVTVL

SEQ ID NO: 1300493 - protein, 9 aa, Homo Sapiens
SCCIPDPMG

SEQ ID NO: 1300494 - protein, 9 aa, Homo Sapiens
GQWLQGMTS

SEQ ID NO: 1300495 - protein, 9 aa, Homo Sapiens
SQCVKGFSY

SEQ ID NO: 1300496 - protein, 9 aa, Homo Sapiens
AGPAWASLG

SEQ ID NO: 1300497 - protein, 9 aa, Homo Sapiens
FSVLNSSYT

SEQ ID NO: 1300498 - protein, 9 aa, Homo Sapiens
PSSGQIFQH

SEQ ID NO: 1300499 - protein, 9 aa, Homo Sapiens
TSATSARRG

SEQ ID NO: 1300500 - protein, 9 aa, Homo Sapiens
THLTPQKKQ

SEQ ID NO: 1300501 - protein, 9 aa, Homo Sapiens
SMPLNARLN

SEQ ID NO: 1300502 - protein, 9 aa, Homo Sapiens
SSLEDPALL

SEQ ID NO: 1300503 - protein, 9 aa, Homo Sapiens
KIVNWALSV

SEQ ID NO: 1300504 - protein, 9 aa, Homo Sapiens
GDSPPLRHH

SEQ ID NO: 1300505 - protein, 9 aa, Homo Sapiens
GYRGDCYTR

SEQ ID NO: 1300506 - protein, 9 aa, Homo Sapiens
LMHLVVRPG

SEQ ID NO: 1300507 - protein, 9 aa, Homo Sapiens
PRSPPELQP

SEQ ID NO: 1300508 - protein, 9 aa, Homo Sapiens
ARLNGEKTL

SEQ ID NO: 1300509 - protein, 9 aa, Homo Sapiens
NSTTRILST

SEQ ID NO: 1300510 - protein, 9 aa, Homo Sapiens
NQSKLSKRM

SEQ ID NO: 1300511 - protein, 9 aa, Homo Sapiens
SIRSASSTA

SEQ ID NO: 1300512 - protein, 9 aa, Homo Sapiens
MFGNDMSRF

SEQ ID NO: 1300513 - protein, 9 aa, Homo Sapiens
VMGASQTTK

SEQ ID NO: 1300514 - protein, 9 aa, Homo Sapiens
LKGKKRQHL

SEQ ID NO: 1300515 - protein, 9 aa, Homo Sapiens
PMELMFAEW

SEQ ID NO: 1300516 - protein, 9 aa, Homo Sapiens
KKRERMMLP

SEQ ID NO: 1300517 - protein, 9 aa, Homo Sapiens
SSMQFAKDL

SEQ ID NO: 1300518 - protein, 9 aa, Homo Sapiens
TWRRTGAST

SEQ ID NO: 1300519 - protein, 9 aa, Homo Sapiens
ELLEVAAPE

SEQ ID NO: 1300520 - protein, 9 aa, Homo Sapiens
MTSSSRQWP

SEQ ID NO: 1300521 - protein, 9 aa, Homo Sapiens
SYEGQEALS

SEQ ID NO: 1300522 - protein, 9 aa, Homo Sapiens
KKKKELASK

SEQ ID NO: 1300523 - protein, 9 aa, Homo Sapiens
PHLQSSTLY

SEQ ID NO: 1300524 - protein, 9 aa, Homo Sapiens
NSSYTWMVP

SEQ ID NO: 1300525 - protein, 9 aa, Homo Sapiens
GAEGTSLVA

SEQ ID NO: 1300526 - protein, 9 aa, Homo Sapiens
WPQGAHGES

SEQ ID NO: 1300527 - protein, 9 aa, Homo Sapiens
YLSRNQSKL

SEQ ID NO: 1300528 - protein, 9 aa, Homo Sapiens
PTIPPPKAM

SEQ ID NO: 1300529 - protein, 9 aa, Homo Sapiens
GGPLCSCCI

SEQ ID NO: 1300530 - protein, 9 aa, Homo Sapiens
GSRQSRSPS

SEQ ID NO: 1300531 - protein, 9 aa, Homo Sapiens
VVALHFLQP

SEQ ID NO: 1300532 - protein, 9 aa, Homo Sapiens
AWASLGSCP

SEQ ID NO: 1300533 - protein, 9 aa, Homo Sapiens
HTTIAFSVL

SEQ ID NO: 1300534 - protein, 9 aa, Homo Sapiens
LSKITEQEK

SEQ ID NO: 1300535 - protein, 9 aa, Homo Sapiens
SGSTPGSGP

SEQ ID NO: 1300536 - protein, 9 aa, Homo Sapiens
EASVPCLIT

SEQ ID NO: 1300537 - protein, 9 aa, Homo Sapiens
LAKNDNSLW

SEQ ID NO: 1300538 - protein, 9 aa, Homo Sapiens
LSLTRANSG

SEQ ID NO: 1300539 - protein, 9 aa, Homo Sapiens
FLLGLFGCL

SEQ ID NO: 1300540 - protein, 9 aa, Homo Sapiens
HSKQSSNSS

SEQ ID NO: 1300541 - protein, 9 aa, Homo Sapiens
SPWSASSSC

SEQ ID NO: 1300542 - protein, 9 aa, Homo Sapiens
QGPSAFVRT

SEQ ID NO: 1300543 - protein, 9 aa, Homo Sapiens
RKGSCPRPG

SEQ ID NO: 1300544 - protein, 9 aa, Homo Sapiens
HLQSSTLYI

SEQ ID NO: 1300545 - protein, 9 aa, Homo Sapiens
HLLQEAFFP

SEQ ID NO: 1300546 - protein, 9 aa, Homo Sapiens
VKVLIHLHT

SEQ ID NO: 1300547 - protein, 9 aa, Homo Sapiens
NRLPGEEEN

SEQ ID NO: 1300548 - protein, 9 aa, Homo Sapiens
QVGGHGVVA

SEQ ID NO: 1300549 - protein, 9 aa, Homo Sapiens
AKKAARAKK

SEQ ID NO: 1300550 - protein, 9 aa, Homo Sapiens
QVDEGLGPD

SEQ ID NO: 1300551 - protein, 9 aa, Homo Sapiens
LHDRPPRRS

SEQ ID NO: 1300552 - protein, 9 aa, Homo Sapiens
QVENPPDVD

SEQ ID NO: 1300553 - protein, 9 aa, Homo Sapiens
QRAIREDCE

SEQ ID NO: 1300554 - protein, 9 aa, Homo Sapiens
LLDGLHHVA

SEQ ID NO: 1300555 - protein, 9 aa, Homo Sapiens
PWGTMATIQ

SEQ ID NO: 1300556 - protein, 9 aa, Homo Sapiens
MLMHLVVRP

SEQ ID NO: 1300557 - protein, 9 aa, Homo Sapiens
GGQGTPGPP

SEQ ID NO: 1300558 - protein, 9 aa, Homo Sapiens
SARRGPFWL

SEQ ID NO: 1300559 - protein, 9 aa, Homo Sapiens
RGRSWDQDG

SEQ ID NO: 1300560 - protein, 9 aa, Homo Sapiens
DSQLISLKH

SEQ ID NO: 1300561 - protein, 9 aa, Homo Sapiens
RAHFTRQLI

SEQ ID NO: 1300562 - protein, 9 aa, Homo Sapiens
PQTSLQLLI

SEQ ID NO: 1300563 - protein, 9 aa, Homo Sapiens
IFQHLSPNR

SEQ ID NO: 1300564 - protein, 9 aa, Homo Sapiens
TPAHALQCR

SEQ ID NO: 1300565 - protein, 9 aa, Homo Sapiens
LPIAVRFAN

SEQ ID NO: 1300566 - protein, 9 aa, Homo Sapiens
DTSTPPCSS

SEQ ID NO: 1300567 - protein, 9 aa, Homo Sapiens
QKLQGLPAD

SEQ ID NO: 1300568 - protein, 9 aa, Homo Sapiens
QRLVREIVQ

SEQ ID NO: 1300569 - protein, 9 aa, Homo Sapiens
QEDRHSNAS

SEQ ID NO: 1300570 - protein, 9 aa, Homo Sapiens
QNTRSTVKP

SEQ ID NO: 1300571 - protein, 9 aa, Homo Sapiens
PTVPPQARQ

SEQ ID NO: 1300572 - protein, 9 aa, Homo Sapiens
LVCMSKDSS

SEQ ID NO: 1300573 - protein, 9 aa, Homo Sapiens
GQGTPGPPG

SEQ ID NO: 1300574 - protein, 9 aa, Homo Sapiens
KELASKFLQ

SEQ ID NO: 1300575 - protein, 9 aa, Homo Sapiens
ANGSNKRQT

SEQ ID NO: 1300576 - protein, 9 aa, Homo Sapiens
RKIGEEVRR

SEQ ID NO: 1300577 - protein, 9 aa, Homo Sapiens
KCHLLQEAF

SEQ ID NO: 1300578 - protein, 9 aa, Homo Sapiens
DDRHCEDLD

SEQ ID NO: 1300579 - protein, 9 aa, Homo Sapiens
DCHWCCCSW

SEQ ID NO: 1300580 - protein, 9 aa, Homo Sapiens
MDTSAKFKE

SEQ ID NO: 1300581 - protein, 9 aa, Homo Sapiens
ARSPTSAPT

SEQ ID NO: 1300582 - protein, 9 aa, Homo Sapiens
WQYLTTVSQ

SEQ ID NO: 1300583 - protein, 9 aa, Homo Sapiens
GSPLASAGH

SEQ ID NO: 1300584 - protein, 9 aa, Homo Sapiens
ILSDAWVKA

SEQ ID NO: 1300585 - protein, 9 aa, Homo Sapiens
QACHGTELD

SEQ ID NO: 1300586 - protein, 9 aa, Homo Sapiens
LVTKDPASV

SEQ ID NO: 1300587 - protein, 9 aa, Homo Sapiens
IWPACSILP

SEQ ID NO: 1300588 - protein, 9 aa, Homo Sapiens
VCQNFQPDF

SEQ ID NO: 1300589 - protein, 9 aa, Homo Sapiens
CCIPDPMGL

SEQ ID NO: 1300590 - protein, 9 aa, Homo Sapiens
CVFSFDSHR

SEQ ID NO: 1300591 - protein, 9 aa, Homo Sapiens
HQTPLQNPV

SEQ ID NO: 1300592 - protein, 9 aa, Homo Sapiens
RFWLALQAG

SEQ ID NO: 1300593 - protein, 9 aa, Homo Sapiens
APMAGSMLG

SEQ ID NO: 1300594 - protein, 9 aa, Homo Sapiens
TRTDPQLEK

SEQ ID NO: 1300595 - protein, 9 aa, Homo Sapiens
RMRGESELG

SEQ ID NO: 1300596 - protein, 9 aa, Homo Sapiens
VSCCVVALH

SEQ ID NO: 1300597 - protein, 9 aa, Homo Sapiens
EKPYECECG

SEQ ID NO: 1300598 - protein, 9 aa, Homo Sapiens
GPTSGSTPG

SEQ ID NO: 1300599 - protein, 9 aa, Homo Sapiens
RLFSPLIPQ

SEQ ID NO: 1300600 - protein, 9 aa, Homo Sapiens
PTHLTPQKK

SEQ ID NO: 1300601 - protein, 9 aa, Homo Sapiens
CHGGRHLPL

SEQ ID NO: 1300602 - protein, 9 aa, Homo Sapiens
RDQCPAVCD

SEQ ID NO: 1300603 - protein, 9 aa, Homo Sapiens
MAVRNMASC

SEQ ID NO: 1300604 - protein, 9 aa, Homo Sapiens
SCCLDLRVP

SEQ ID NO: 1300605 - protein, 9 aa, Homo Sapiens
PAAQCQDPP

SEQ ID NO: 1300606 - protein, 9 aa, Homo Sapiens
WGYAVQRLP

SEQ ID NO: 1300607 - protein, 9 aa, Homo Sapiens
CLITDCTYR

SEQ ID NO: 1300608 - protein, 9 aa, Homo Sapiens
SFPHNFVLL

SEQ ID NO: 1300609 - protein, 9 aa, Homo Sapiens
SSLKSSISS

SEQ ID NO: 1300610 - protein, 9 aa, Homo Sapiens
SPSIRSASS

SEQ ID NO: 1300611 - protein, 9 aa, Homo Sapiens
GLMGPVGRV

SEQ ID NO: 1300612 - protein, 9 aa, Homo Sapiens
PPKAMQWVH

SEQ ID NO: 1300613 - protein, 9 aa, Homo Sapiens
VTWIHPVTW

SEQ ID NO: 1300614 - protein, 9 aa, Homo Sapiens
LWHRELQRP

SEQ ID NO: 1300615 - protein, 9 aa, Homo Sapiens
LILDISALV

SEQ ID NO: 1300616 - protein, 9 aa, Homo Sapiens
NKQPENDLF

SEQ ID NO: 1300617 - protein, 9 aa, Homo Sapiens
CQDIQRRPL

SEQ ID NO: 1300618 - protein, 9 aa, Homo Sapiens
PAPPNEVHP

SEQ ID NO: 1300619 - protein, 9 aa, Homo Sapiens
YRLKHSLTT

SEQ ID NO: 1300620 - protein, 9 aa, Homo Sapiens
MPKKVFRIA

SEQ ID NO: 1300621 - protein, 9 aa, Homo Sapiens
SSEEDLIAS

SEQ ID NO: 1300622 - protein, 9 aa, Homo Sapiens
LQCQKEDLK

SEQ ID NO: 1300623 - protein, 9 aa, Homo Sapiens
LVGLMGPVG

SEQ ID NO: 1300624 - protein, 9 aa, Homo Sapiens
ADETSLCSV

SEQ ID NO: 1300625 - protein, 9 aa, Homo Sapiens
NDTFQDVSS

SEQ ID NO: 1300626 - protein, 9 aa, Homo Sapiens
PGIPGAHGP

SEQ ID NO: 1300627 - protein, 9 aa, Homo Sapiens
TRSSDEPTT

SEQ ID NO: 1300628 - protein, 9 aa, Homo Sapiens
SATSATSAR

SEQ ID NO: 1300629 - protein, 9 aa, Homo Sapiens
FVLVNLEVT

SEQ ID NO: 1300630 - protein, 9 aa, Homo Sapiens
SGVLNLTVL

SEQ ID NO: 1300631 - protein, 9 aa, Homo Sapiens
GADACVRLS

SEQ ID NO: 1300632 - protein, 9 aa, Homo Sapiens
AVASLGPPW

SEQ ID NO: 1300633 - protein, 9 aa, Homo Sapiens
DQDGKWFET

SEQ ID NO: 1300634 - protein, 9 aa, Homo Sapiens
EKDIAMKMR

SEQ ID NO: 1300635 - protein, 9 aa, Homo Sapiens
LVSACVRLG

SEQ ID NO: 1300636 - protein, 9 aa, Homo Sapiens
KKLQHTMNV

SEQ ID NO: 1300637 - protein, 9 aa, Homo Sapiens
VSMPLNARL

SEQ ID NO: 1300638 - protein, 9 aa, Homo Sapiens
SRAPCRPPP

SEQ ID NO: 1300639 - protein, 9 aa, Homo Sapiens
DPQLEKEAE

SEQ ID NO: 1300640 - protein, 9 aa, Homo Sapiens
PVFDMEKIP

SEQ ID NO: 1300641 - protein, 9 aa, Homo Sapiens
NEPTATRKV

SEQ ID NO: 1300642 - protein, 9 aa, Homo Sapiens
RDTLDTRHE

SEQ ID NO: 1300643 - protein, 9 aa, Homo Sapiens
ELWGYAVQR

SEQ ID NO: 1300644 - protein, 9 aa, Homo Sapiens
GAGNSTTRI

SEQ ID NO: 1300645 - protein, 9 aa, Homo Sapiens
PRSSLPLLR

SEQ ID NO: 1300646 - protein, 9 aa, Homo Sapiens
KVRSLLGEI

SEQ ID NO: 1300647 - protein, 9 aa, Homo Sapiens
HPVAGSSPA

SEQ ID NO: 1300648 - protein, 9 aa, Homo Sapiens
WGRRRAQAG

SEQ ID NO: 1300649 - protein, 9 aa, Homo Sapiens
PGTVGPLGL

SEQ ID NO: 1300650 - protein, 9 aa, Homo Sapiens
RIPLLKCIA

SEQ ID NO: 1300651 - protein, 9 aa, Homo Sapiens
RNPPRKAPG

SEQ ID NO: 1300652 - protein, 9 aa, Homo Sapiens
HLSVVSESI

SEQ ID NO: 1300653 - protein, 9 aa, Homo Sapiens
GPTPVPTAT

SEQ ID NO: 1300654 - protein, 9 aa, Homo Sapiens
GAGPMELMF

SEQ ID NO: 1300655 - protein, 9 aa, Homo Sapiens
CVRLSGHIL

SEQ ID NO: 1300656 - protein, 9 aa, Homo Sapiens
QPWRRRGLT

SEQ ID NO: 1300657 - protein, 9 aa, Homo Sapiens
TLTHSSEIV

SEQ ID NO: 1300658 - protein, 9 aa, Homo Sapiens
ESKWVELMK

SEQ ID NO: 1300659 - protein, 9 aa, Homo Sapiens
ICTSWHCNR

SEQ ID NO: 1300660 - protein, 9 aa, Homo Sapiens
STPVRPAAQ

SEQ ID NO: 1300661 - protein, 9 aa, Homo Sapiens
LVKVLIHLH

SEQ ID NO: 1300662 - protein, 9 aa, Homo Sapiens
CLFQITTLA

SEQ ID NO: 1300663 - protein, 9 aa, Homo Sapiens
RVPSISFRI

SEQ ID NO: 1300664 - protein, 9 aa, Homo Sapiens
RPPPVPAPS

SEQ ID NO: 1300665 - protein, 9 aa, Homo Sapiens
DGAKFPELV

SEQ ID NO: 1300666 - protein, 9 aa, Homo Sapiens
DVKSRGDGA

SEQ ID NO: 1300667 - protein, 9 aa, Homo Sapiens
LPSCHPLPQ

SEQ ID NO: 1300668 - protein, 9 aa, Homo Sapiens
PSPARSAAA

SEQ ID NO: 1300669 - protein, 9 aa, Homo Sapiens
NRRTHLLCY

SEQ ID NO: 1300670 - protein, 9 aa, Homo Sapiens
RSGTALINV

SEQ ID NO: 1300671 - protein, 9 aa, Homo Sapiens
DDIVDRAKW

SEQ ID NO: 1300672 - protein, 9 aa, Homo Sapiens
AGPMELMFA

SEQ ID NO: 1300673 - protein, 9 aa, Homo Sapiens
CVPTAARPS

SEQ ID NO: 1300674 - protein, 9 aa, Homo Sapiens
STPKTMRNL

SEQ ID NO: 1300675 - protein, 9 aa, Homo Sapiens
RPPHLPSCH

SEQ ID NO: 1300676 - protein, 9 aa, Homo Sapiens
LGPDLRQKL

SEQ ID NO: 1300677 - protein, 9 aa, Homo Sapiens
KWGRSQAVR

SEQ ID NO: 1300678 - protein, 9 aa, Homo Sapiens
ECGEAFNQK

SEQ ID NO: 1300679 - protein, 9 aa, Homo Sapiens
LPLASSQIS

SEQ ID NO: 1300680 - protein, 9 aa, Homo Sapiens
LQSSTLYIM

SEQ ID NO: 1300681 - protein, 9 aa, Homo Sapiens
RPLPWTRAS

SEQ ID NO: 1300682 - protein, 9 aa, Homo Sapiens
MKHIGMTDQ

SEQ ID NO: 1300683 - protein, 9 aa, Homo Sapiens
VVIMMVLYI

SEQ ID NO: 1300684 - protein, 9 aa, Homo Sapiens
RIRPNLKGI

SEQ ID NO: 1300685 - protein, 9 aa, Homo Sapiens
RPRLLFSLP

SEQ ID NO: 1300686 - protein, 9 aa, Homo Sapiens
HALDSPSVI

SEQ ID NO: 1300687 - protein, 9 aa, Homo Sapiens
SDEPTTTFV

SEQ ID NO: 1300688 - protein, 9 aa, Homo Sapiens
GGGGGGGVD

SEQ ID NO: 1300689 - protein, 9 aa, Homo Sapiens
FQIMRILRI

SEQ ID NO: 1300690 - protein, 9 aa, Homo Sapiens
DDIMKHIGM

SEQ ID NO: 1300691 - protein, 9 aa, Homo Sapiens
YVEGQAHRN

SEQ ID NO: 1300692 - protein, 9 aa, Homo Sapiens
DCSYLSRNQ

SEQ ID NO: 1300693 - protein, 9 aa, Homo Sapiens
QQSVQYKKG

SEQ ID NO: 1300694 - protein, 9 aa, Homo Sapiens
EGLGPDLRQ

SEQ ID NO: 1300695 - protein, 9 aa, Homo Sapiens
LLKCHLLQE

SEQ ID NO: 1300696 - protein, 9 aa, Homo Sapiens
PPRSGTALI

SEQ ID NO: 1300697 - protein, 9 aa, Homo Sapiens
QVIPQELQL

SEQ ID NO: 1300698 - protein, 9 aa, Homo Sapiens
CCGLCHGGR

SEQ ID NO: 1300699 - protein, 9 aa, Homo Sapiens
ISSFPINVS

SEQ ID NO: 1300700 - protein, 9 aa, Homo Sapiens
PVHCVKTTV

SEQ ID NO: 1300701 - protein, 9 aa, Homo Sapiens
HGGGDDEGL

SEQ ID NO: 1300702 - protein, 9 aa, Homo Sapiens
SGWSASCGP

SEQ ID NO: 1300703 - protein, 9 aa, Homo Sapiens
GAEAERRAQ

SEQ ID NO: 1300704 - protein, 9 aa, Homo Sapiens
GLTLFFVSL

SEQ ID NO: 1300705 - protein, 9 aa, Homo Sapiens
DPEAEHPRR

SEQ ID NO: 1300706 - protein, 9 aa, Homo Sapiens
LFFVLVNLE

SEQ ID NO: 1300707 - protein, 9 aa, Homo Sapiens
ATPAHALQC

SEQ ID NO: 1300708 - protein, 9 aa, Homo Sapiens
PSCSFPHNF

SEQ ID NO: 1300709 - protein, 9 aa, Homo Sapiens
SKWVELMKM

SEQ ID NO: 1300710 - protein, 9 aa, Homo Sapiens
AEVTSPQSG

SEQ ID NO: 1300711 - protein, 9 aa, Homo Sapiens
LFQITTLAG

SEQ ID NO: 1300712 - protein, 9 aa, Homo Sapiens
LPGEEENHK

SEQ ID NO: 1300713 - protein, 9 aa, Homo Sapiens
QKGIQCTAQ

SEQ ID NO: 1300714 - protein, 9 aa, Homo Sapiens
QVSFLILGY

SEQ ID NO: 1300715 - protein, 9 aa, Homo Sapiens
GAGQQGSVV

SEQ ID NO: 1300716 - protein, 9 aa, Homo Sapiens
PIEKSGVLN

SEQ ID NO: 1300717 - protein, 9 aa, Homo Sapiens
QSLNVYSQP

SEQ ID NO: 1300718 - protein, 9 aa, Homo Sapiens
HNPSSGQIF

SEQ ID NO: 1300719 - protein, 9 aa, Homo Sapiens
IQEKSTMES

SEQ ID NO: 1300720 - protein, 9 aa, Homo Sapiens
IETKSRQMS

SEQ ID NO: 1300721 - protein, 9 aa, Homo Sapiens
GEKPYECEC

SEQ ID NO: 1300722 - protein, 9 aa, Homo Sapiens
AWVKAEVLI

SEQ ID NO: 1300723 - protein, 9 aa, Homo Sapiens
GGQNTRSTV

SEQ ID NO: 1300724 - protein, 9 aa, Homo Sapiens
GTCRSTLRP

SEQ ID NO: 1300725 - protein, 9 aa, Homo Sapiens
QIRGITLLC

SEQ ID NO: 1300726 - protein, 9 aa, Homo Sapiens
MVLYIHISL

SEQ ID NO: 1300727 - protein, 9 aa, Homo Sapiens
LSRNQSKLS

SEQ ID NO: 1300728 - protein, 9 aa, Homo Sapiens
TWMVPLTFV

SEQ ID NO: 1300729 - protein, 9 aa, Homo Sapiens
SAASSLKSS

SEQ ID NO: 1300730 - protein, 9 aa, Homo Sapiens
PGGQNTRST

SEQ ID NO: 1300731 - protein, 9 aa, Homo Sapiens
RKAPGGLQI

SEQ ID NO: 1300732 - protein, 9 aa, Homo Sapiens
DESEGLVGL

SEQ ID NO: 1300733 - protein, 9 aa, Homo Sapiens
SPTRRPLWS

SEQ ID NO: 1300734 - protein, 9 aa, Homo Sapiens
KLSKRMCQN

SEQ ID NO: 1300735 - protein, 9 aa, Homo Sapiens
LPLLRDQDL

SEQ ID NO: 1300736 - protein, 9 aa, Homo Sapiens
GTRMRGESE

SEQ ID NO: 1300737 - protein, 9 aa, Homo Sapiens
VALAPAPEK

SEQ ID NO: 1300738 - protein, 9 aa, Homo Sapiens
KRRKSLEQK

SEQ ID NO: 1300739 - protein, 9 aa, Homo Sapiens
ETRCSYEGQ

SEQ ID NO: 1300740 - protein, 9 aa, Homo Sapiens
LHHVAAAAL

SEQ ID NO: 1300741 - protein, 9 aa, Homo Sapiens
VRTQSYSFV

SEQ ID NO: 1300742 - protein, 9 aa, Homo Sapiens
LKSSISSVS

SEQ ID NO: 1300743 - protein, 9 aa, Homo Sapiens
GVCFTKQEW

SEQ ID NO: 1300744 - protein, 9 aa, Homo Sapiens
FPAVGLELL

SEQ ID NO: 1300745 - protein, 9 aa, Homo Sapiens
AEHLPEASD

SEQ ID NO: 1300746 - protein, 9 aa, Homo Sapiens
SPNSSLTSP

SEQ ID NO: 1300747 - protein, 9 aa, Homo Sapiens
SPVALGMVD

SEQ ID NO: 1300748 - protein, 9 aa, Homo Sapiens
PLRHHPRGP

SEQ ID NO: 1300749 - protein, 9 aa, Homo Sapiens
PRALPSLLS

SEQ ID NO: 1300750 - protein, 9 aa, Homo Sapiens
TGEYHQTPL

SEQ ID NO: 1300751 - protein, 9 aa, Homo Sapiens
SARSPTSSP

SEQ ID NO: 1300752 - protein, 9 aa, Homo Sapiens
VWRTDGLLP

SEQ ID NO: 1300753 - protein, 9 aa, Homo Sapiens
TCRSTLRPM

SEQ ID NO: 1300754 - protein, 9 aa, Homo Sapiens
AIFAVAFCL

SEQ ID NO: 1300755 - protein, 9 aa, Homo Sapiens
LLPAPPNEV

SEQ ID NO: 1300756 - protein, 9 aa, Homo Sapiens
LQQSVQYKK

SEQ ID NO: 1300757 - protein, 9 aa, Homo Sapiens
RLPSPRRAT

SEQ ID NO: 1300758 - protein, 9 aa, Homo Sapiens
GKLCRIVDS

SEQ ID NO: 1300759 - protein, 9 aa, Homo Sapiens
EILSDAWVK

SEQ ID NO: 1300760 - protein, 9 aa, Homo Sapiens
EHLPEASDQ

SEQ ID NO: 1300761 - protein, 9 aa, Homo Sapiens
HLQRAIRED

SEQ ID NO: 1300762 - protein, 9 aa, Homo Sapiens
SKQSSNSSA

SEQ ID NO: 1300763 - protein, 9 aa, Homo Sapiens
KRPSLQTGT

SEQ ID NO: 1300764 - protein, 9 aa, Homo Sapiens
LQSVKKRCS

SEQ ID NO: 1300765 - protein, 9 aa, Homo Sapiens
GAVPDQELS

SEQ ID NO: 1300766 - protein, 9 aa, Homo Sapiens
PQLLFSSLE

SEQ ID NO: 1300767 - protein, 9 aa, Homo Sapiens
YHQTPLQNP

SEQ ID NO: 1300768 - protein, 9 aa, Homo Sapiens
RMMLPVRAR

SEQ ID NO: 1300769 - protein, 9 aa, Homo Sapiens
GKVFNRRTH

SEQ ID NO: 1300770 - protein, 9 aa, Homo Sapiens
QARLHTRGR

SEQ ID NO: 1300771 - protein, 9 aa, Homo Sapiens
AHRQEREKN

SEQ ID NO: 1300772 - protein, 9 aa, Homo Sapiens
PSIRSASST

SEQ ID NO: 1300773 - protein, 9 aa, Homo Sapiens
AGAGNSTTR

SEQ ID NO: 1300774 - protein, 9 aa, Homo Sapiens
AVRGGQGTP

SEQ ID NO: 1300775 - protein, 9 aa, Homo Sapiens
SNTQSLNPW

SEQ ID NO: 1300776 - protein, 9 aa, Homo Sapiens
SSEIVRFQK

SEQ ID NO: 1300777 - protein, 9 aa, Homo Sapiens
NGEKTLPQT

SEQ ID NO: 1300778 - protein, 9 aa, Homo Sapiens
PTVPCTSPM

SEQ ID NO: 1300779 - protein, 9 aa, Homo Sapiens
SYLSRNQSK

SEQ ID NO: 1300780 - protein, 9 aa, Homo Sapiens
QTPLQNPVP

SEQ ID NO: 1300781 - protein, 9 aa, Homo Sapiens
QSVKKRCSL

SEQ ID NO: 1300782 - protein, 9 aa, Homo Sapiens
QLHPVAGSS

SEQ ID NO: 1300783 - protein, 9 aa, Homo Sapiens
KLCRIVDSK

SEQ ID NO: 1300784 - protein, 9 aa, Homo Sapiens
TMRNLKQFS

SEQ ID NO: 1300785 - protein, 9 aa, Homo Sapiens
PARSPTSAP

SEQ ID NO: 1300786 - protein, 9 aa, Homo Sapiens
SNSESSSES

SEQ ID NO: 1300787 - protein, 9 aa, Homo Sapiens
RAQRPRRHG

SEQ ID NO: 1300788 - protein, 9 aa, Homo Sapiens
FGSRPFAYV

SEQ ID NO: 1300789 - protein, 9 aa, Homo Sapiens
YNKQPVYRK

SEQ ID NO: 1300790 - protein, 9 aa, Homo Sapiens
ACQDIQRRP

SEQ ID NO: 1300791 - protein, 9 aa, Homo Sapiens
STATTSWCS

SEQ ID NO: 1300792 - protein, 9 aa, Homo Sapiens
LPSWLPTAM

SEQ ID NO: 1300793 - protein, 9 aa, Homo Sapiens
QVRKIGEEV

SEQ ID NO: 1300794 - protein, 9 aa, Homo Sapiens
LPSQPAVPW

SEQ ID NO: 1300795 - protein, 9 aa, Homo Sapiens
DLRELHKAR

SEQ ID NO: 1300796 - protein, 9 aa, Homo Sapiens
WDAAPPEMG

SEQ ID NO: 1300797 - protein, 9 aa, Homo Sapiens
VPTIPPPKA

SEQ ID NO: 1300798 - protein, 9 aa, Homo Sapiens
RQAPTVVVQ

SEQ ID NO: 1300799 - protein, 9 aa, Homo Sapiens
VGLQRREGR

SEQ ID NO: 1300800 - protein, 9 aa, Homo Sapiens
HMQVGGHGV

SEQ ID NO: 1300801 - protein, 9 aa, Homo Sapiens
SSATSATSA

SEQ ID NO: 1300802 - protein, 9 aa, Homo Sapiens
GGAVYEQPL

SEQ ID NO: 1300803 - protein, 9 aa, Homo Sapiens
HGPIGPPGS

SEQ ID NO: 1300804 - protein, 9 aa, Homo Sapiens
FVSCCVVAL

SEQ ID NO: 1300805 - protein, 9 aa, Homo Sapiens
RYRYYQNVR

SEQ ID NO: 1300806 - protein, 9 aa, Homo Sapiens
WSASSSCSR

SEQ ID NO: 1300807 - protein, 9 aa, Homo Sapiens
LTWQLWHRE

SEQ ID NO: 1300808 - protein, 9 aa, Homo Sapiens
TLWFKRMAV

SEQ ID NO: 1300809 - protein, 9 aa, Homo Sapiens
NGTYTCQVE

SEQ ID NO: 1300810 - protein, 9 aa, Homo Sapiens
WNMAQMCTF

SEQ ID NO: 1300811 - protein, 9 aa, Homo Sapiens
SDHSGRLHD

SEQ ID NO: 1300812 - protein, 9 aa, Homo Sapiens
GSTPGSGPS

SEQ ID NO: 1300813 - protein, 9 aa, Homo Sapiens
PTATRKVPW

SEQ ID NO: 1300814 - protein, 9 aa, Homo Sapiens
CFTLHQVLH

SEQ ID NO: 1300815 - protein, 9 aa, Homo Sapiens
SRQWPTVPC

SEQ ID NO: 1300816 - protein, 9 aa, Homo Sapiens
TIEILSDAW

SEQ ID NO: 1300817 - protein, 9 aa, Homo Sapiens
HRQEREKNG

SEQ ID NO: 1300818 - protein, 9 aa, Homo Sapiens
MLVCMSKDS

SEQ ID NO: 1300819 - protein, 9 aa, Homo Sapiens
SILQVLLKA

SEQ ID NO: 1300820 - protein, 9 aa, Homo Sapiens
SENEDSPVK

SEQ ID NO: 1300821 - protein, 9 aa, Homo Sapiens
NENFWQDSV

SEQ ID NO: 1300822 - protein, 9 aa, Homo Sapiens
EEDLIASQL

SEQ ID NO: 1300823 - protein, 9 aa, Homo Sapiens
RLPSQPAVP

SEQ ID NO: 1300824 - protein, 9 aa, Homo Sapiens
FKRMAVRNM

SEQ ID NO: 1300825 - protein, 9 aa, Homo Sapiens
ASDQSLLTV

SEQ ID NO: 1300826 - protein, 9 aa, Homo Sapiens
PQLEKEAEG

SEQ ID NO: 1300827 - protein, 9 aa, Homo Sapiens
RMSWRRHEP

SEQ ID NO: 1300828 - protein, 9 aa, Homo Sapiens
VVVVDADSG

SEQ ID NO: 1300829 - protein, 9 aa, Homo Sapiens
GSPEDRSHG

SEQ ID NO: 1300830 - protein, 9 aa, Homo Sapiens
PFAYVEGQA

SEQ ID NO: 1300831 - protein, 9 aa, Homo Sapiens
NSLWISVTV

SEQ ID NO: 1300832 - protein, 9 aa, Homo Sapiens
GIHFDPENP

SEQ ID NO: 1300833 - protein, 9 aa, Homo Sapiens
RKLVSACVR

SEQ ID NO: 1300834 - protein, 9 aa, Homo Sapiens
ADPESAEWK

SEQ ID NO: 1300835 - protein, 9 aa, Homo Sapiens
NEEKCPEED

SEQ ID NO: 1300836 - protein, 9 aa, Homo Sapiens
VPDWELSQA

SEQ ID NO: 1300837 - protein, 9 aa, Homo Sapiens
YLFSLGVSD

SEQ ID NO: 1300838 - protein, 9 aa, Homo Sapiens
NNFSRSPPT

SEQ ID NO: 1300839 - protein, 9 aa, Homo Sapiens
RGRPRWCCR

SEQ ID NO: 1300840 - protein, 9 aa, Homo Sapiens
GSARIPFRM

SEQ ID NO: 1300841 - protein, 9 aa, Homo Sapiens
CECDDRHCE

SEQ ID NO: 1300842 - protein, 9 aa, Homo Sapiens
TTTNNRATK

SEQ ID NO: 1300843 - protein, 9 aa, Homo Sapiens
SEAISPDLV

SEQ ID NO: 1300844 - protein, 9 aa, Homo Sapiens
AIIERIPLL

SEQ ID NO: 1300845 - protein, 9 aa, Homo Sapiens
WVKAEVLIH

SEQ ID NO: 1300846 - protein, 9 aa, Homo Sapiens
RAVVLYLGV

SEQ ID NO: 1300847 - protein, 9 aa, Homo Sapiens
HLHTVRSLS

SEQ ID NO: 1300848 - protein, 9 aa, Homo Sapiens
VCFTKQEWE

SEQ ID NO: 1300849 - protein, 9 aa, Homo Sapiens
FSSEEDLIA

SEQ ID NO: 1300850 - protein, 9 aa, Homo Sapiens
SATNPTWRR

SEQ ID NO: 1300851 - protein, 9 aa, Homo Sapiens
SLANLDTFI

SEQ ID NO: 1300852 - protein, 9 aa, Homo Sapiens
AQAGRQAPT

SEQ ID NO: 1300853 - protein, 9 aa, Homo Sapiens
RRRTWWRTR

SEQ ID NO: 1300854 - protein, 9 aa, Homo Sapiens
SGPTPVPTA

SEQ ID NO: 1300855 - protein, 9 aa, Homo Sapiens
GLFGCLVFL

SEQ ID NO: 1300856 - protein, 9 aa, Homo Sapiens
QGRAPLEGM

SEQ ID NO: 1300857 - protein, 9 aa, Homo Sapiens
IFTSEQREK

SEQ ID NO: 1300858 - protein, 9 aa, Homo Sapiens
RKQRAVSVT

SEQ ID NO: 1300859 - protein, 9 aa, Homo Sapiens
PKAMQWVHS

SEQ ID NO: 1300860 - protein, 9 aa, Homo Sapiens
AALQHQLQD

SEQ ID NO: 1300861 - protein, 9 aa, Homo Sapiens
AAGTRCRAS

SEQ ID NO: 1300862 - protein, 9 aa, Homo Sapiens
IAPITLTHS

SEQ ID NO: 1300863 - protein, 9 aa, Homo Sapiens
LHQVLHLVL

SEQ ID NO: 1300864 - protein, 9 aa, Homo Sapiens
LYLGVAHLQ

SEQ ID NO: 1300865 - protein, 9 aa, Homo Sapiens
GWDAAPPEM

SEQ ID NO: 1300866 - protein, 9 aa, Homo Sapiens
DGEALKCWY

SEQ ID NO: 1300867 - protein, 9 aa, Homo Sapiens
PWTRASAQP

SEQ ID NO: 1300868 - protein, 9 aa, Homo Sapiens
DPESAEWKV

SEQ ID NO: 1300869 - protein, 9 aa, Homo Sapiens
FTKQEWENL

SEQ ID NO: 1300870 - protein, 9 aa, Homo Sapiens
TTAAGASGW

SEQ ID NO: 1300871 - protein, 9 aa, Homo Sapiens
AIREDCEPP

SEQ ID NO: 1300872 - protein, 9 aa, Homo Sapiens
PPVPAPSQL

SEQ ID NO: 1300873 - protein, 9 aa, Homo Sapiens
YRAVTASKH

SEQ ID NO: 1300874 - protein, 9 aa, Homo Sapiens
CGGPRLQRR

SEQ ID NO: 1300875 - protein, 9 aa, Homo Sapiens
AKPSARSPT

SEQ ID NO: 1300876 - protein, 9 aa, Homo Sapiens
RDCDEVIAF

SEQ ID NO: 1300877 - protein, 9 aa, Homo Sapiens
IRGITLLCR

SEQ ID NO: 1300878 - protein, 9 aa, Homo Sapiens
IPQELQLLP

SEQ ID NO: 1300879 - protein, 9 aa, Homo Sapiens
RSYLMNKLA

SEQ ID NO: 1300880 - protein, 9 aa, Homo Sapiens
SLSLTRANS

SEQ ID NO: 1300881 - protein, 9 aa, Homo Sapiens
SLQENEPTA

SEQ ID NO: 1300882 - protein, 9 aa, Homo Sapiens
EMGCEIFIG

SEQ ID NO: 1300883 - protein, 9 aa, Homo Sapiens
GMDQLPENG

SEQ ID NO: 1300884 - protein, 9 aa, Homo Sapiens
SHSLKKNPV

SEQ ID NO: 1300885 - protein, 9 aa, Homo Sapiens
LGQMFVSIN

SEQ ID NO: 1300886 - protein, 9 aa, Homo Sapiens
LQLLIPRSP

SEQ ID NO: 1300887 - protein, 9 aa, Homo Sapiens
PRRCSGARV

SEQ ID NO: 1300888 - protein, 9 aa, Homo Sapiens
RCSYEGQEA

SEQ ID NO: 1300889 - protein, 9 aa, Homo Sapiens
RSWDQDGKW

SEQ ID NO: 1300890 - protein, 9 aa, Homo Sapiens
STSTGSRQS

SEQ ID NO: 1300891 - protein, 9 aa, Homo Sapiens
SFISSFPIN

SEQ ID NO: 1300892 - protein, 9 aa, Homo Sapiens
TDSQSENED

SEQ ID NO: 1300893 - protein, 9 aa, Homo Sapiens
TALINVVVL

SEQ ID NO: 1300894 - protein, 9 aa, Homo Sapiens
PEDRSHGEH

SEQ ID NO: 1300895 - protein, 9 aa, Homo Sapiens
WEEYQRQLL

SEQ ID NO: 1300896 - protein, 9 aa, Homo Sapiens
KAPGGLQIQ

SEQ ID NO: 1300897 - protein, 9 aa, Homo Sapiens
EEKCPEEDM

SEQ ID NO: 1300898 - protein, 9 aa, Homo Sapiens
PFRMGLYTG

SEQ ID NO: 1300899 - protein, 9 aa, Homo Sapiens
LQALIFLNI

SEQ ID NO: 1300900 - protein, 9 aa, Homo Sapiens
LIASQLDEE

SEQ ID NO: 1300901 - protein, 9 aa, Homo Sapiens
PASSPTKCE

SEQ ID NO: 1300902 - protein, 9 aa, Homo Sapiens
PSAGRTSAR

SEQ ID NO: 1300903 - protein, 9 aa, Homo Sapiens
KSFARSSRW

SEQ ID NO: 1300904 - protein, 9 aa, Homo Sapiens
QGSDVYDAQ

SEQ ID NO: 1300905 - protein, 9 aa, Homo Sapiens
VLRVCSSCH

SEQ ID NO: 1300906 - protein, 9 aa, Homo Sapiens
CSGIIQGTS

SEQ ID NO: 1300907 - protein, 9 aa, Homo Sapiens
HILDLDVVL

SEQ ID NO: 1300908 - protein, 9 aa, Homo Sapiens
PSQEDRHSN

SEQ ID NO: 1300909 - protein, 9 aa, Homo Sapiens
RNQSKLSKR

SEQ ID NO: 1300910 - protein, 9 aa, Homo Sapiens
GSPGIPGAH

SEQ ID NO: 1300911 - protein, 9 aa, Homo Sapiens
TYHVDADKG

SEQ ID NO: 1300912 - protein, 9 aa, Homo Sapiens
AHLQRAIRE

SEQ ID NO: 1300913 - protein, 9 aa, Homo Sapiens
GESELGGRG

SEQ ID NO: 1300914 - protein, 9 aa, Homo Sapiens
QLISLKHQV

SEQ ID NO: 1300915 - protein, 9 aa, Homo Sapiens
RASRAPCRP

SEQ ID NO: 1300916 - protein, 9 aa, Homo Sapiens
ITTFHDKGS

SEQ ID NO: 1300917 - protein, 9 aa, Homo Sapiens
TSAKRNENF

SEQ ID NO: 1300918 - protein, 9 aa, Homo Sapiens
DACVRLSGH

SEQ ID NO: 1300919 - protein, 9 aa, Homo Sapiens
LDTRHESLF

SEQ ID NO: 1300920 - protein, 9 aa, Homo Sapiens
ALDSPSVIF

SEQ ID NO: 1300921 - protein, 9 aa, Homo Sapiens
DPIEAPPPS

SEQ ID NO: 1300922 - protein, 9 aa, Homo Sapiens
TPPCSSFGG

SEQ ID NO: 1300923 - protein, 9 aa, Homo Sapiens
RAAGGAVYE

SEQ ID NO: 1300924 - protein, 9 aa, Homo Sapiens
CSTHGGLIW

SEQ ID NO: 1300925 - protein, 9 aa, Homo Sapiens
LWGYAVQRL

SEQ ID NO: 1300926 - protein, 9 aa, Homo Sapiens
GGELLHPSQ

SEQ ID NO: 1300927 - protein, 9 aa, Homo Sapiens
NFSRSPPTL

SEQ ID NO: 1300928 - protein, 9 aa, Homo Sapiens
LNPWGTMAT

SEQ ID NO: 1300929 - protein, 9 aa, Homo Sapiens
SYRLKHSLT

SEQ ID NO: 1300930 - protein, 9 aa, Homo Sapiens
KGIQCTAQT

SEQ ID NO: 1300931 - protein, 9 aa, Homo Sapiens
ASKFLQQSV

SEQ ID NO: 1300932 - protein, 9 aa, Homo Sapiens
QRAVSVTLF

SEQ ID NO: 1300933 - protein, 9 aa, Homo Sapiens
SMVPVRFGT

SEQ ID NO: 1300934 - protein, 9 aa, Homo Sapiens
LNSSYTWMV

SEQ ID NO: 1300935 - protein, 9 aa, Homo Sapiens
FDIQFPTHL

SEQ ID NO: 1300936 - protein, 9 aa, Homo Sapiens
GFFFAGVLF

SEQ ID NO: 1300937 - protein, 9 aa, Homo Sapiens
GPLCSCCIP

SEQ ID NO: 1300938 - protein, 9 aa, Homo Sapiens
DASPVAWEH

SEQ ID NO: 1300939 - protein, 9 aa, Homo Sapiens
ESTSTGSRQ

SEQ ID NO: 1300940 - protein, 9 aa, Homo Sapiens
RGPRLPSQP

SEQ ID NO: 1300941 - protein, 9 aa, Homo Sapiens
CTLIHLSAG

SEQ ID NO: 1300942 - protein, 9 aa, Homo Sapiens
LTCDDPHFQ

SEQ ID NO: 1300943 - protein, 9 aa, Homo Sapiens
ERRAQRVGA

SEQ ID NO: 1300944 - protein, 9 aa, Homo Sapiens
YGTIVIQYI

SEQ ID NO: 1300945 - protein, 9 aa, Homo Sapiens
KPHLQSSTL

SEQ ID NO: 1300946 - protein, 9 aa, Homo Sapiens
CHGTELDCG

SEQ ID NO: 1300947 - protein, 9 aa, Homo Sapiens
ALEIKALKM

SEQ ID NO: 1300948 - protein, 9 aa, Homo Sapiens
KKELASKFL

SEQ ID NO: 1300949 - protein, 9 aa, Homo Sapiens
WQRSLSLTR

SEQ ID NO: 1300950 - protein, 9 aa, Homo Sapiens
QHQHQSQQE

SEQ ID NO: 1300951 - protein, 9 aa, Homo Sapiens
SRSHSLKKN

SEQ ID NO: 1300952 - protein, 9 aa, Homo Sapiens
KPHGLQRSR

SEQ ID NO: 1300953 - protein, 9 aa, Homo Sapiens
MLVQRRVHH

SEQ ID NO: 1300954 - protein, 9 aa, Homo Sapiens
VLKLLCQES

SEQ ID NO: 1300955 - protein, 9 aa, Homo Sapiens
RFGGPETRC

SEQ ID NO: 1300956 - protein, 9 aa, Homo Sapiens
RSPTSSPTA

SEQ ID NO: 1300957 - protein, 9 aa, Homo Sapiens
AAPVLRVCS

SEQ ID NO: 1300958 - protein, 9 aa, Homo Sapiens
TALSPEATT

SEQ ID NO: 1300959 - protein, 9 aa, Homo Sapiens
LGGRGAAGP

SEQ ID NO: 1300960 - protein, 9 aa, Homo Sapiens
ATYNKQPVY

SEQ ID NO: 1300961 - protein, 9 aa, Homo Sapiens
PALLVPHAC

SEQ ID NO: 1300962 - protein, 9 aa, Homo Sapiens
PPSTAATTA

SEQ ID NO: 1300963 - protein, 9 aa, Homo Sapiens
VCKIVNWAL

SEQ ID NO: 1300964 - protein, 9 aa, Homo Sapiens
WSIWPACSI

SEQ ID NO: 1300965 - protein, 9 aa, Homo Sapiens
GHGTCSPDS

SEQ ID NO: 1300966 - protein, 9 aa, Homo Sapiens
HLPSCHPLP

SEQ ID NO: 1300967 - protein, 9 aa, Homo Sapiens
RASGPTPVP

SEQ ID NO: 1300968 - protein, 9 aa, Homo Sapiens
FKVLAKDGD

SEQ ID NO: 1300969 - protein, 9 aa, Homo Sapiens
VGQAQGAEA

SEQ ID NO: 1300970 - protein, 9 aa, Homo Sapiens
FLLSNRQPR

SEQ ID NO: 1300971 - protein, 9 aa, Homo Sapiens
SPAPSAGRT

SEQ ID NO: 1300972 - protein, 9 aa, Homo Sapiens
VHRGDTSTP

SEQ ID NO: 1300973 - protein, 9 aa, Homo Sapiens
GPSCVPTAA

SEQ ID NO: 1300974 - protein, 9 aa, Homo Sapiens
PETHRAQEL

SEQ ID NO: 1300975 - protein, 9 aa, Homo Sapiens
AASARSPTS

SEQ ID NO: 1300976 - protein, 9 aa, Homo Sapiens
ASTAAWPRV

SEQ ID NO: 1300977 - protein, 9 aa, Homo Sapiens
NGSNKRQTP

SEQ ID NO: 1300978 - protein, 9 aa, Homo Sapiens
ATRKVPWKR

SEQ ID NO: 1300979 - protein, 9 aa, Homo Sapiens
STRCEDEEL

SEQ ID NO: 1300980 - protein, 9 aa, Homo Sapiens
LPWTRASAQ

SEQ ID NO: 1300981 - protein, 9 aa, Homo Sapiens
PRLLFSLPK

SEQ ID NO: 1300982 - protein, 9 aa, Homo Sapiens
LKADPESAE

SEQ ID NO: 1300983 - protein, 9 aa, Homo Sapiens
VRRRRGVGQ

SEQ ID NO: 1300984 - protein, 9 aa, Homo Sapiens
IQCTAQTYP

SEQ ID NO: 1300985 - protein, 9 aa, Homo Sapiens
LFSLGVSDL

SEQ ID NO: 1300986 - protein, 9 aa, Homo Sapiens
NMAQMCTFC

SEQ ID NO: 1300987 - protein, 9 aa, Homo Sapiens
GSNKRQTPQ

SEQ ID NO: 1300988 - protein, 9 aa, Homo Sapiens
KCEICVKRR

SEQ ID NO: 1300989 - protein, 9 aa, Homo Sapiens
VTSPQSGRV

SEQ ID NO: 1300990 - protein, 9 aa, Homo Sapiens
AARVGQLRE

SEQ ID NO: 1300991 - protein, 9 aa, Homo Sapiens
QSKLSKRMC

SEQ ID NO: 1300992 - protein, 9 aa, Homo Sapiens
ACHGTELDC

SEQ ID NO: 1300993 - protein, 9 aa, Homo Sapiens
CVRLGVQPA

SEQ ID NO: 1300994 - protein, 9 aa, Homo Sapiens
WAWFFTSPA

SEQ ID NO: 1300995 - protein, 9 aa, Homo Sapiens
STKSFARSS

SEQ ID NO: 1300996 - protein, 9 aa, Homo Sapiens
LITTFHDKG

SEQ ID NO: 1300997 - protein, 9 aa, Homo Sapiens
KQSSNSSAV

SEQ ID NO: 1300998 - protein, 9 aa, Homo Sapiens
GEAFNQKIT

SEQ ID NO: 1300999 - protein, 9 aa, Homo Sapiens
HGAAGLRCG

SEQ ID NO: 1301000 - protein, 9 aa, Homo Sapiens
LSCSGIIQG

SEQ ID NO: 1301001 - protein, 9 aa, Homo Sapiens
GASQTTKRP

SEQ ID NO: 1301002 - protein, 9 aa, Homo Sapiens
WLQGMTSSS

SEQ ID NO: 1301003 - protein, 9 aa, Homo Sapiens
TECFFLQKD

SEQ ID NO: 1301004 - protein, 9 aa, Homo Sapiens
FLQQSVQYK

SEQ ID NO: 1301005 - protein, 9 aa, Homo Sapiens
LHPSQRLLV

SEQ ID NO: 1301006 - protein, 9 aa, Homo Sapiens
EIEAHRQER

SEQ ID NO: 1301007 - protein, 9 aa, Homo Sapiens
TSAKFKELG

SEQ ID NO: 1301008 - protein, 9 aa, Homo Sapiens
AFVRTEKGI

SEQ ID NO: 1301009 - protein, 9 aa, Homo Sapiens
YDTINPDRE

SEQ ID NO: 1301010 - protein, 9 aa, Homo Sapiens
RNENFWQDS

SEQ ID NO: 1301011 - protein, 9 aa, Homo Sapiens
LEAMDLMEP

SEQ ID NO: 1301012 - protein, 9 aa, Homo Sapiens
PGAVPDWEL

SEQ ID NO: 1301013 - protein, 9 aa, Homo Sapiens
ASTRASGPT

SEQ ID NO: 1301014 - protein, 9 aa, Homo Sapiens
VGQLREALN

SEQ ID NO: 1301015 - protein, 9 aa, Homo Sapiens
SPVHCVKTT

SEQ ID NO: 1301016 - protein, 9 aa, Homo Sapiens
YLPVVIMMV

SEQ ID NO: 1301017 - protein, 9 aa, Homo Sapiens
VRRVVQIFQ

SEQ ID NO: 1301018 - protein, 9 aa, Homo Sapiens
RLLFSLPKL

SEQ ID NO: 1301019 - protein, 9 aa, Homo Sapiens
LTPEIILSK

SEQ ID NO: 1301020 - protein, 9 aa, Homo Sapiens
AKNDNSLWI

SEQ ID NO: 1301021 - protein, 9 aa, Homo Sapiens
NNRATKANG

SEQ ID NO: 1301022 - protein, 9 aa, Homo Sapiens
CGLCHGGRH

SEQ ID NO: 1301023 - protein, 9 aa, Homo Sapiens
FPRAFKKLQ

SEQ ID NO: 1301024 - protein, 9 aa, Homo Sapiens
MKMRLRALS

SEQ ID NO: 1301025 - protein, 9 aa, Homo Sapiens
RSQAVRGKE

SEQ ID NO: 1301026 - protein, 9 aa, Homo Sapiens
QETLSGAEG

SEQ ID NO: 1301027 - protein, 9 aa, Homo Sapiens
AAASPRAAI

SEQ ID NO: 1301028 - protein, 9 aa, Homo Sapiens
RRAQAGRQA

SEQ ID NO: 1301029 - protein, 9 aa, Homo Sapiens
KEMLVCMSK

SEQ ID NO: 1301030 - protein, 9 aa, Homo Sapiens
MENKQPEND

SEQ ID NO: 1301031 - protein, 9 aa, Homo Sapiens
TWCRTGAST

SEQ ID NO: 1301032 - protein, 9 aa, Homo Sapiens
QKEHQEARL

SEQ ID NO: 1301033 - protein, 9 aa, Homo Sapiens
LSDAWVKAE

SEQ ID NO: 1301034 - protein, 9 aa, Homo Sapiens
IHVHRHPQG

SEQ ID NO: 1301035 - protein, 9 aa, Homo Sapiens
YSPVHCVKT

SEQ ID NO: 1301036 - protein, 9 aa, Homo Sapiens
NWALSVWRQ

SEQ ID NO: 1301037 - protein, 9 aa, Homo Sapiens
LGLFGCLVF

SEQ ID NO: 1301038 - protein, 9 aa, Homo Sapiens
CRIVDSKYF

SEQ ID NO: 1301039 - protein, 9 aa, Homo Sapiens
MTEAEQIIS

SEQ ID NO: 1301040 - protein, 9 aa, Homo Sapiens
KVLIHLHTV

SEQ ID NO: 1301041 - protein, 9 aa, Homo Sapiens
RRPLWSIWP

SEQ ID NO: 1301042 - protein, 9 aa, Homo Sapiens
TFVSLQCQK

SEQ ID NO: 1301043 - protein, 9 aa, Homo Sapiens
PSWLPTAMG

SEQ ID NO: 1301044 - protein, 9 aa, Homo Sapiens
DAAPPEMGC

SEQ ID NO: 1301045 - protein, 9 aa, Homo Sapiens
MQVGGHGVV

SEQ ID NO: 1301046 - protein, 9 aa, Homo Sapiens
RRGPFWLLS

SEQ ID NO: 1301047 - protein, 9 aa, Homo Sapiens
TSLQLLIPR

SEQ ID NO: 1301048 - protein, 9 aa, Homo Sapiens
PAPEKQQHQ

SEQ ID NO: 1301049 - protein, 9 aa, Homo Sapiens
RAQRVGARV

SEQ ID NO: 1301050 - protein, 9 aa, Homo Sapiens
MMLPVRART

SEQ ID NO: 1301051 - protein, 9 aa, Homo Sapiens
KLQGLPADR

SEQ ID NO: 1301052 - protein, 9 aa, Homo Sapiens
GIAVRGGQG

SEQ ID NO: 1301053 - protein, 9 aa, Homo Sapiens
TCECDDRHC

SEQ ID NO: 1301054 - protein, 9 aa, Homo Sapiens
QGLPADRAL

SEQ ID NO: 1301055 - protein, 9 aa, Homo Sapiens
SSSRQWPTV

SEQ ID NO: 1301056 - protein, 9 aa, Homo Sapiens
SLQTGTCRS

SEQ ID NO: 1301057 - protein, 9 aa, Homo Sapiens
RQKLQGLPA

SEQ ID NO: 1301058 - protein, 9 aa, Homo Sapiens
WTSPNSSLT

SEQ ID NO: 1301059 - protein, 9 aa, Homo Sapiens
MCRRWTWAS

SEQ ID NO: 1301060 - protein, 9 aa, Homo Sapiens
PRLARRVCH

SEQ ID NO: 1301061 - protein, 9 aa, Homo Sapiens
EAFNQKITL

SEQ ID NO: 1301062 - protein, 9 aa, Homo Sapiens
ARSPTWCRT

SEQ ID NO: 1301063 - protein, 9 aa, Homo Sapiens
DVEGERHSG

SEQ ID NO: 1301064 - protein, 9 aa, Homo Sapiens
IPIIKTIGL

SEQ ID NO: 1301065 - protein, 9 aa, Homo Sapiens
DIQFPTHLT

SEQ ID NO: 1301066 - protein, 9 aa, Homo Sapiens
VLKAIFAVA

SEQ ID NO: 1301067 - protein, 9 aa, Homo Sapiens
ALPSLLSRM

SEQ ID NO: 1301068 - protein, 9 aa, Homo Sapiens
QPAVPWQKE

SEQ ID NO: 1301069 - protein, 9 aa, Homo Sapiens
AWTAEGAAG

SEQ ID NO: 1301070 - protein, 9 aa, Homo Sapiens
CDKDFNQSS

SEQ ID NO: 1301071 - protein, 9 aa, Homo Sapiens
YRYYQNVRT

SEQ ID NO: 1301072 - protein, 9 aa, Homo Sapiens
RVEAVASLG

SEQ ID NO: 1301073 - protein, 9 aa, Homo Sapiens
VLMDTSAKF

SEQ ID NO: 1301074 - protein, 9 aa, Homo Sapiens
TFIKKSESG

SEQ ID NO: 1301075 - protein, 9 aa, Homo Sapiens
QLPASSPTK

SEQ ID NO: 1301076 - protein, 9 aa, Homo Sapiens
GAWTAEGAA

SEQ ID NO: 1301077 - protein, 9 aa, Homo Sapiens
PLGLRPPHL

SEQ ID NO: 1301078 - protein, 9 aa, Homo Sapiens
QERDEAHGG

SEQ ID NO: 1301079 - protein, 9 aa, Homo Sapiens
CSFPHNFVL

SEQ ID NO: 1301080 - protein, 9 aa, Homo Sapiens
TPPIGPSCV

SEQ ID NO: 1301081 - protein, 9 aa, Homo Sapiens
DTLDTRHES

SEQ ID NO: 1301082 - protein, 9 aa, Homo Sapiens
PTSAPTAAK

SEQ ID NO: 1301083 - protein, 9 aa, Homo Sapiens
GPLLAMLSN

SEQ ID NO: 1301084 - protein, 9 aa, Homo Sapiens
GERHSGAGA

SEQ ID NO: 1301085 - protein, 9 aa, Homo Sapiens
YKDGEALKC

SEQ ID NO: 1301086 - protein, 9 aa, Homo Sapiens
VRAVVLYLG

SEQ ID NO: 1301087 - protein, 9 aa, Homo Sapiens
ALHFLQPRS

SEQ ID NO: 1301088 - protein, 9 aa, Homo Sapiens
AGQQGSVVR

SEQ ID NO: 1301089 - protein, 9 aa, Homo Sapiens
ASPWWWAWF

SEQ ID NO: 1301090 - protein, 9 aa, Homo Sapiens
TTVSQVTED

SEQ ID NO: 1301091 - protein, 9 aa, Homo Sapiens
WGRSQAVRG

SEQ ID NO: 1301092 - protein, 9 aa, Homo Sapiens
KMPRNPTDE

SEQ ID NO: 1301093 - protein, 9 aa, Homo Sapiens
SLTRANSGD

SEQ ID NO: 1301094 - protein, 9 aa, Homo Sapiens
GLHHVAAAA

SEQ ID NO: 1301095 - protein, 9 aa, Homo Sapiens
AGPPGTVGP

SEQ ID NO: 1301096 - protein, 9 aa, Homo Sapiens
HALEIKALK

SEQ ID NO: 1301097 - protein, 9 aa, Homo Sapiens
VPSVARPST

SEQ ID NO: 1301098 - protein, 9 aa, Homo Sapiens
PRAFKKLQH

SEQ ID NO: 1301099 - protein, 9 aa, Homo Sapiens
QGAEAERRA

SEQ ID NO: 1301100 - protein, 9 aa, Homo Sapiens
GPSCSFPHN

SEQ ID NO: 1301101 - protein, 9 aa, Homo Sapiens
QPENDLFDR

SEQ ID NO: 1301102 - protein, 9 aa, Homo Sapiens
LYECSQCVK

SEQ ID NO: 1301103 - protein, 9 aa, Homo Sapiens
AAPPEMGCE

SEQ ID NO: 1301104 - protein, 9 aa, Homo Sapiens
HGTELDCGI

SEQ ID NO: 1301105 - protein, 9 aa, Homo Sapiens
AIAVSTRPR

SEQ ID NO: 1301106 - protein, 9 aa, Homo Sapiens
FLILGYRGD

SEQ ID NO: 1301107 - protein, 9 aa, Homo Sapiens
GLSLARLVG

SEQ ID NO: 1301108 - protein, 9 aa, Homo Sapiens
GLGPDLRQK

SEQ ID NO: 1301109 - protein, 9 aa, Homo Sapiens
IEVNGLILD

SEQ ID NO: 1301110 - protein, 9 aa, Homo Sapiens
RHSGAGAVG

SEQ ID NO: 1301111 - protein, 9 aa, Homo Sapiens
CPRPGAVPD

SEQ ID NO: 1301112 - protein, 9 aa, Homo Sapiens
VAHLQRAIR

SEQ ID NO: 1301113 - protein, 9 aa, Homo Sapiens
VAGSSPAGA

SEQ ID NO: 1301114 - protein, 9 aa, Homo Sapiens
IAFSVLNSS

SEQ ID NO: 1301115 - protein, 9 aa, Homo Sapiens
KSYRLKHSL

SEQ ID NO: 1301116 - protein, 9 aa, Homo Sapiens
ARRESRFWL

SEQ ID NO: 1301117 - protein, 9 aa, Homo Sapiens
QVLLKAFSF

SEQ ID NO: 1301118 - protein, 9 aa, Homo Sapiens
WRRHEPEFR

SEQ ID NO: 1301119 - protein, 9 aa, Homo Sapiens
SQSENEDSP

SEQ ID NO: 1301120 - protein, 9 aa, Homo Sapiens
RRAQRVGAR

SEQ ID NO: 1301121 - protein, 9 aa, Homo Sapiens
ASPVAWEHA

SEQ ID NO: 1301122 - protein, 9 aa, Homo Sapiens
TFSGKLCRI

SEQ ID NO: 1301123 - protein, 9 aa, Homo Sapiens
GLRGFFFAG

SEQ ID NO: 1301124 - protein, 9 aa, Homo Sapiens
SLNVYSQPG

SEQ ID NO: 1301125 - protein, 9 aa, Homo Sapiens
KNNITKKKE

SEQ ID NO: 1301126 - protein, 9 aa, Homo Sapiens
RPLWSIWPA

SEQ ID NO: 1301127 - protein, 9 aa, Homo Sapiens
GKKRQHLHC

SEQ ID NO: 1301128 - protein, 9 aa, Homo Sapiens
SSQSRSPVP

SEQ ID NO: 1301129 - protein, 9 aa, Homo Sapiens
SGAEGTSLV

SEQ ID NO: 1301130 - protein, 9 aa, Homo Sapiens
EEDDAQERD

SEQ ID NO: 1301131 - protein, 9 aa, Homo Sapiens
IVQDFKTDL

SEQ ID NO: 1301132 - protein, 9 aa, Homo Sapiens
PTRKNSGSD

SEQ ID NO: 1301133 - protein, 9 aa, Homo Sapiens
LDLDVVLCV

SEQ ID NO: 1301134 - protein, 9 aa, Homo Sapiens
HQHQSQQEP

SEQ ID NO: 1301135 - protein, 9 aa, Homo Sapiens
MPDEGIMVT

SEQ ID NO: 1301136 - protein, 9 aa, Homo Sapiens
KRSHYIYVV

SEQ ID NO: 1301137 - protein, 9 aa, Homo Sapiens
DVSSMQFAK

SEQ ID NO: 1301138 - protein, 9 aa, Homo Sapiens
SARRRTWWR

SEQ ID NO: 1301139 - protein, 9 aa, Homo Sapiens
YRASPWWWA

SEQ ID NO: 1301140 - protein, 9 aa, Homo Sapiens
RASPWWWAW

SEQ ID NO: 1301141 - protein, 9 aa, Homo Sapiens
SSLASSQAK

SEQ ID NO: 1301142 - protein, 9 aa, Homo Sapiens
QTRSSDEPT

SEQ ID NO: 1301143 - protein, 9 aa, Homo Sapiens
PSSSATSAT

SEQ ID NO: 1301144 - protein, 9 aa, Homo Sapiens
SEIVRFQKN

SEQ ID NO: 1301145 - protein, 9 aa, Homo Sapiens
TSSGQSLNV

SEQ ID NO: 1301146 - protein, 9 aa, Homo Sapiens
MMLMHLVVR

SEQ ID NO: 1301147 - protein, 9 aa, Homo Sapiens
IADYHTRWS

SEQ ID NO: 1301148 - protein, 9 aa, Homo Sapiens
WLALQAGPP

SEQ ID NO: 1301149 - protein, 9 aa, Homo Sapiens
TWWRTRACT

SEQ ID NO: 1301150 - protein, 9 aa, Homo Sapiens
INVSSLVNP

SEQ ID NO: 1301151 - protein, 9 aa, Homo Sapiens
QARLWRRSY

SEQ ID NO: 1301152 - protein, 9 aa, Homo Sapiens
DLIASQLDE

SEQ ID NO: 1301153 - protein, 9 aa, Homo Sapiens
TTLAGWDGL

SEQ ID NO: 1301154 - protein, 9 aa, Homo Sapiens
WPTRRSTMS

SEQ ID NO: 1301155 - protein, 9 aa, Homo Sapiens
KEALKMPRN

SEQ ID NO: 1301156 - protein, 9 aa, Homo Sapiens
APDTWIVID

SEQ ID NO: 1301157 - protein, 9 aa, Homo Sapiens
SGKLCRIVD

SEQ ID NO: 1301158 - protein, 9 aa, Homo Sapiens
VVTTESTTE

SEQ ID NO: 1301159 - protein, 9 aa, Homo Sapiens
YLPLPEATP

SEQ ID NO: 1301160 - protein, 9 aa, Homo Sapiens
VSASASPSI

SEQ ID NO: 1301161 - protein, 9 aa, Homo Sapiens
ECTLIHLSA

SEQ ID NO: 1301162 - protein, 9 aa, Homo Sapiens
PLPEATPAQ

SEQ ID NO: 1301163 - protein, 9 aa, Homo Sapiens
LYDTINPDR

SEQ ID NO: 1301164 - protein, 9 aa, Homo Sapiens
GLITPPQSG

SEQ ID NO: 1301165 - protein, 9 aa, Homo Sapiens
FISSFPINV

SEQ ID NO: 1301166 - protein, 9 aa, Homo Sapiens
KGIAVRGGQ

SEQ ID NO: 1301167 - protein, 9 aa, Homo Sapiens
PLLTWQLWH

SEQ ID NO: 1301168 - protein, 9 aa, Homo Sapiens
SQQEPTEHP

SEQ ID NO: 1301169 - protein, 9 aa, Homo Sapiens
QILKEMLVC

SEQ ID NO: 1301170 - protein, 9 aa, Homo Sapiens
ARVEAVASL

SEQ ID NO: 1301171 - protein, 9 aa, Homo Sapiens
RLSGHILDL

SEQ ID NO: 1301172 - protein, 9 aa, Homo Sapiens
KQPVYRKAI

SEQ ID NO: 1301173 - protein, 9 aa, Homo Sapiens
TAQTYPGPF

SEQ ID NO: 1301174 - protein, 9 aa, Homo Sapiens
FDMEKIPLH

SEQ ID NO: 1301175 - protein, 9 aa, Homo Sapiens
ISRTDTENL

SEQ ID NO: 1301176 - protein, 9 aa, Homo Sapiens
QAPTVVVQH

SEQ ID NO: 1301177 - protein, 9 aa, Homo Sapiens
SQLQERTGC

SEQ ID NO: 1301178 - protein, 9 aa, Homo Sapiens
CVPVAEAST

SEQ ID NO: 1301179 - protein, 9 aa, Homo Sapiens
TLRPMKRSR

SEQ ID NO: 1301180 - protein, 9 aa, Homo Sapiens
IGPSCVPTA

SEQ ID NO: 1301181 - protein, 9 aa, Homo Sapiens
YIPLMKKPT

SEQ ID NO: 1301182 - protein, 9 aa, Homo Sapiens
TAAPVLRVC

SEQ ID NO: 1301183 - protein, 9 aa, Homo Sapiens
WSVPSSGYR

SEQ ID NO: 1301184 - protein, 9 aa, Homo Sapiens
LGERAPPGP

SEQ ID NO: 1301185 - protein, 9 aa, Homo Sapiens
WASTAAWPR

SEQ ID NO: 1301186 - protein, 9 aa, Homo Sapiens
TNPTWRRTG

SEQ ID NO: 1301187 - protein, 9 aa, Homo Sapiens
LSSTRGRKG

SEQ ID NO: 1301188 - protein, 9 aa, Homo Sapiens
VTKVVVVDA

SEQ ID NO: 1301189 - protein, 9 aa, Homo Sapiens
RHPQGDRAP

SEQ ID NO: 1301190 - protein, 9 aa, Homo Sapiens
LLIPRSPSP

SEQ ID NO: 1301191 - protein, 9 aa, Homo Sapiens
LNLTVLWMC

SEQ ID NO: 1301192 - protein, 9 aa, Homo Sapiens
IVRFQKNLK

SEQ ID NO: 1301193 - protein, 9 aa, Homo Sapiens
LMDTSAKFK

SEQ ID NO: 1301194 - protein, 9 aa, Homo Sapiens
VRFQKNLKM

SEQ ID NO: 1301195 - protein, 9 aa, Homo Sapiens
PLEGMLLPR

SEQ ID NO: 1301196 - protein, 9 aa, Homo Sapiens
NIRNVLMDT

SEQ ID NO: 1301197 - protein, 9 aa, Homo Sapiens
CSCCIPDPM

SEQ ID NO: 1301198 - protein, 9 aa, Homo Sapiens
QSQQEPTEH

SEQ ID NO: 1301199 - protein, 9 aa, Homo Sapiens
SLLSRMPAR

SEQ ID NO: 1301200 - protein, 9 aa, Homo Sapiens
AASPRAAIW

SEQ ID NO: 1301201 - protein, 9 aa, Homo Sapiens
TSARRRTWW

SEQ ID NO: 1301202 - protein, 9 aa, Homo Sapiens
FVSINYICF

SEQ ID NO: 1301203 - protein, 9 aa, Homo Sapiens
PSVIFDNGS

SEQ ID NO: 1301204 - protein, 9 aa, Homo Sapiens
TTESTRCED

SEQ ID NO: 1301205 - protein, 9 aa, Homo Sapiens
SKESGKNRE

SEQ ID NO: 1301206 - protein, 9 aa, Homo Sapiens
HVELAGRVG

SEQ ID NO: 1301207 - protein, 9 aa, Homo Sapiens
LSNTQSLNP

SEQ ID NO: 1301208 - protein, 9 aa, Homo Sapiens
QISFGLLPL

SEQ ID NO: 1301209 - protein, 9 aa, Homo Sapiens
GKEEFVVTT

SEQ ID NO: 1301210 - protein, 9 aa, Homo Sapiens
ERDEAHGGG

SEQ ID NO: 1301211 - protein, 9 aa, Homo Sapiens
KQRAVSVTL

SEQ ID NO: 1301212 - protein, 9 aa, Homo Sapiens
CKECGEAFN

SEQ ID NO: 1301213 - protein, 9 aa, Homo Sapiens
PAPSAGRTS

SEQ ID NO: 1301214 - protein, 9 aa, Homo Sapiens
GGVDAAGPR

SEQ ID NO: 1301215 - protein, 9 aa, Homo Sapiens
LEGMLLPRA

SEQ ID NO: 1301216 - protein, 9 aa, Homo Sapiens
ATKANGSNK

SEQ ID NO: 1301217 - protein, 9 aa, Homo Sapiens
VCMSKDSSY

SEQ ID NO: 1301218 - protein, 9 aa, Homo Sapiens
KLFIIQACH

SEQ ID NO: 1301219 - protein, 9 aa, Homo Sapiens
TTRILSTNH

SEQ ID NO: 1301220 - protein, 9 aa, Homo Sapiens
GCADETSLC

SEQ ID NO: 1301221 - protein, 9 aa, Homo Sapiens
QFPTHLTPQ

SEQ ID NO: 1301222 - protein, 9 aa, Homo Sapiens
PSCHPLPQL

SEQ ID NO: 1301223 - protein, 9 aa, Homo Sapiens
RCSLMEQIP

SEQ ID NO: 1301224 - protein, 9 aa, Homo Sapiens
GYFSSEEDL

SEQ ID NO: 1301225 - protein, 9 aa, Homo Sapiens
DIVDRAKWK

SEQ ID NO: 1301226 - protein, 9 aa, Homo Sapiens
SMLGMPSPP

SEQ ID NO: 1301227 - protein, 9 aa, Homo Sapiens
ITSSGQSLN

SEQ ID NO: 1301228 - protein, 9 aa, Homo Sapiens
PVPAPSQLP

SEQ ID NO: 1301229 - protein, 9 aa, Homo Sapiens
ASSPTKCEI

SEQ ID NO: 1301230 - protein, 9 aa, Homo Sapiens
TTIAFSVLN

SEQ ID NO: 1301231 - protein, 9 aa, Homo Sapiens
KKKMMLMHL

SEQ ID NO: 1301232 - protein, 9 aa, Homo Sapiens
AMKMRLRAL

SEQ ID NO: 1301233 - protein, 9 aa, Homo Sapiens
VDEGLGPDL

SEQ ID NO: 1301234 - protein, 9 aa, Homo Sapiens
VQHLLDGLH

SEQ ID NO: 1301235 - protein, 9 aa, Homo Sapiens
EVDSPQDPV

SEQ ID NO: 1301236 - protein, 9 aa, Homo Sapiens
LGEIFVSCC

SEQ ID NO: 1301237 - protein, 9 aa, Homo Sapiens
TATPSPWSA

SEQ ID NO: 1301238 - protein, 9 aa, Homo Sapiens
EFPAVGLEL

SEQ ID NO: 1301239 - protein, 9 aa, Homo Sapiens
PLASSQISF

SEQ ID NO: 1301240 - protein, 9 aa, Homo Sapiens
AVPDWELSQ

SEQ ID NO: 1301241 - protein, 9 aa, Homo Sapiens
RGDCYTRLF

SEQ ID NO: 1301242 - protein, 9 aa, Homo Sapiens
GARVGTEVT

SEQ ID NO: 1301243 - protein, 9 aa, Homo Sapiens
AEIEAHRQE

SEQ ID NO: 1301244 - protein, 9 aa, Homo Sapiens
GGPACVPVA

SEQ ID NO: 1301245 - protein, 9 aa, Homo Sapiens
RRVVQIFQI

SEQ ID NO: 1301246 - protein, 9 aa, Homo Sapiens
APEKQQHQA

SEQ ID NO: 1301247 - protein, 9 aa, Homo Sapiens
GPFWLLSLA

SEQ ID NO: 1301248 - protein, 9 aa, Homo Sapiens
PVPLRGLPL

SEQ ID NO: 1301249 - protein, 9 aa, Homo Sapiens
ANTLLANSS

SEQ ID NO: 1301250 - protein, 9 aa, Homo Sapiens
RGRKGSCPR

SEQ ID NO: 1301251 - protein, 9 aa, Homo Sapiens
PKKVFRIAS

SEQ ID NO: 1301252 - protein, 9 aa, Homo Sapiens
KFLQQSVQY

SEQ ID NO: 1301253 - protein, 9 aa, Homo Sapiens
LCHGGRHLP

SEQ ID NO: 1301254 - protein, 9 aa, Homo Sapiens
FECKECGEA

SEQ ID NO: 1301255 - protein, 9 aa, Homo Sapiens
EVPVVDDPG

SEQ ID NO: 1301256 - protein, 9 aa, Homo Sapiens
QRPVPHPLN

SEQ ID NO: 1301257 - protein, 9 aa, Homo Sapiens
SINYICFTS

SEQ ID NO: 1301258 - protein, 9 aa, Homo Sapiens
CPGPGAVPD

SEQ ID NO: 1301259 - protein, 9 aa, Homo Sapiens
LWFKRMAVR

SEQ ID NO: 1301260 - protein, 9 aa, Homo Sapiens
PGGARGGLG

SEQ ID NO: 1301261 - protein, 9 aa, Homo Sapiens
RTHLLCYRQ

SEQ ID NO: 1301262 - protein, 9 aa, Homo Sapiens
SSLVNPFFF

SEQ ID NO: 1301263 - protein, 9 aa, Homo Sapiens
AEAQKNRPA

SEQ ID NO: 1301264 - protein, 9 aa, Homo Sapiens
NPVMPQNMI

SEQ ID NO: 1301265 - protein, 9 aa, Homo Sapiens
IKIIHGYAE

SEQ ID NO: 1301266 - protein, 9 aa, Homo Sapiens
LDSPSVIFD

SEQ ID NO: 1301267 - protein, 9 aa, Homo Sapiens
DPRIRPNLK

SEQ ID NO: 1301268 - protein, 9 aa, Homo Sapiens
KKRQHLHCC

SEQ ID NO: 1301269 - protein, 9 aa, Homo Sapiens
LQGLPADRA

SEQ ID NO: 1301270 - protein, 9 aa, Homo Sapiens
AECTLIHLS

SEQ ID NO: 1301271 - protein, 9 aa, Homo Sapiens
GIAPITLTH

SEQ ID NO: 1301272 - protein, 9 aa, Homo Sapiens
WIVIDGAAI

SEQ ID NO: 1301273 - protein, 9 aa, Homo Sapiens
GIRGVSLKG

SEQ ID NO: 1301274 - protein, 9 aa, Homo Sapiens
FFTSPASTT

SEQ ID NO: 1301275 - protein, 9 aa, Homo Sapiens
GPETRCSYE

SEQ ID NO: 1301276 - protein, 9 aa, Homo Sapiens
MMSNGCWGW

SEQ ID NO: 1301277 - protein, 9 aa, Homo Sapiens
SPPQLLFSS

SEQ ID NO: 1301278 - protein, 9 aa, Homo Sapiens
SLLGEIFVS

SEQ ID NO: 1301279 - protein, 9 aa, Homo Sapiens
ALKCWYENH

SEQ ID NO: 1301280 - protein, 9 aa, Homo Sapiens
LPLPEATPA

SEQ ID NO: 1301281 - protein, 9 aa, Homo Sapiens
EMLVCMSKD

SEQ ID NO: 1301282 - protein, 9 aa, Homo Sapiens
RTQPDKLQT

SEQ ID NO: 1301283 - protein, 9 aa, Homo Sapiens
LKAIFAVAF

SEQ ID NO: 1301284 - protein, 9 aa, Homo Sapiens
SSLTSPGIS

SEQ ID NO: 1301285 - protein, 9 aa, Homo Sapiens
PSPWSASSS

SEQ ID NO: 1301286 - protein, 9 aa, Homo Sapiens
EHIKQGSDV

SEQ ID NO: 1301287 - protein, 9 aa, Homo Sapiens
LPVRARTAR

SEQ ID NO: 1301288 - protein, 9 aa, Homo Sapiens
HRHPQGDRA

SEQ ID NO: 1301289 - protein, 9 aa, Homo Sapiens
PWWWAWFFT

SEQ ID NO: 1301290 - protein, 9 aa, Homo Sapiens
AVSTRPRLL

SEQ ID NO: 1301291 - protein, 9 aa, Homo Sapiens
HHPRGPPPP

SEQ ID NO: 1301292 - protein, 9 aa, Homo Sapiens
FTSPASTTR

SEQ ID NO: 1301293 - protein, 9 aa, Homo Sapiens
VFNRRTHLL

SEQ ID NO: 1301294 - protein, 9 aa, Homo Sapiens
GSTSILQVL

SEQ ID NO: 1301295 - protein, 9 aa, Homo Sapiens
GSDVYDAQT

SEQ ID NO: 1301296 - protein, 9 aa, Homo Sapiens
RRRKRSSQS

SEQ ID NO: 1301297 - protein, 9 aa, Homo Sapiens
NDMSRFLEG

SEQ ID NO: 1301298 - protein, 9 aa, Homo Sapiens
RSALPQGRA

SEQ ID NO: 1301299 - protein, 9 aa, Homo Sapiens
KKNPVMPQN

SEQ ID NO: 1301300 - protein, 9 aa, Homo Sapiens
NPTWRRTGA

SEQ ID NO: 1301301 - protein, 9 aa, Homo Sapiens
SGAGAVGLS

SEQ ID NO: 1301302 - protein, 9 aa, Homo Sapiens
GEEENHKGN

SEQ ID NO: 1301303 - protein, 9 aa, Homo Sapiens
AAPEVLQDS

SEQ ID NO: 1301304 - protein, 9 aa, Homo Sapiens
PPPVGAGTG

SEQ ID NO: 1301305 - protein, 9 aa, Homo Sapiens
PSAFVRTEK

SEQ ID NO: 1301306 - protein, 9 aa, Homo Sapiens
RRESRFWLA

SEQ ID NO: 1301307 - protein, 9 aa, Homo Sapiens
SETTALSPE

SEQ ID NO: 1301308 - protein, 9 aa, Homo Sapiens
KDPASVKHS

SEQ ID NO: 1301309 - protein, 9 aa, Homo Sapiens
MPLNARLNG

SEQ ID NO: 1301310 - protein, 9 aa, Homo Sapiens
AGTGGGPAC

SEQ ID NO: 1301311 - protein, 9 aa, Homo Sapiens
LICSNHSKQ

SEQ ID NO: 1301312 - protein, 9 aa, Homo Sapiens
MSHSSIQFS

SEQ ID NO: 1301313 - protein, 9 aa, Homo Sapiens
CESILLGKF

SEQ ID NO: 1301314 - protein, 9 aa, Homo Sapiens
SALPQGRAP

SEQ ID NO: 1301315 - protein, 9 aa, Homo Sapiens
ILGQMFVSI

SEQ ID NO: 1301316 - protein, 9 aa, Homo Sapiens
PSARSPTWC

SEQ ID NO: 1301317 - protein, 9 aa, Homo Sapiens
RPPGGGGGG

SEQ ID NO: 1301318 - protein, 9 aa, Homo Sapiens
RAQELVRAS

SEQ ID NO: 1301319 - protein, 9 aa, Homo Sapiens
RVGARVGTE

SEQ ID NO: 1301320 - protein, 9 aa, Homo Sapiens
CEECDKDFN

SEQ ID NO: 1301321 - protein, 9 aa, Homo Sapiens
DAQVRAVVL

SEQ ID NO: 1301322 - protein, 9 aa, Homo Sapiens
EDCEPPIAL

SEQ ID NO: 1301323 - protein, 9 aa, Homo Sapiens
EKELRRFQA

SEQ ID NO: 1301324 - protein, 9 aa, Homo Sapiens
VELMKMHTA

SEQ ID NO: 1301325 - protein, 9 aa, Homo Sapiens
ENPPDVDGV

SEQ ID NO: 1301326 - protein, 9 aa, Homo Sapiens
LKMPRNPTD

SEQ ID NO: 1301327 - protein, 9 aa, Homo Sapiens
LQKGIQCTA

SEQ ID NO: 1301328 - protein, 9 aa, Homo Sapiens
LMGPVGRVA

SEQ ID NO: 1301329 - protein, 9 aa, Homo Sapiens
PSPAPSAGR

SEQ ID NO: 1301330 - protein, 9 aa, Homo Sapiens
HVDADKGFN

SEQ ID NO: 1301331 - protein, 9 aa, Homo Sapiens
DPAVMGASQ

SEQ ID NO: 1301332 - protein, 9 aa, Homo Sapiens
VGLSLARLV

SEQ ID NO: 1301333 - protein, 9 aa, Homo Sapiens
SGESTSTGS

SEQ ID NO: 1301334 - protein, 9 aa, Homo Sapiens
PSRRPLGVS

SEQ ID NO: 1301335 - protein, 9 aa, Homo Sapiens
PLLRDQDLC

SEQ ID NO: 1301336 - protein, 9 aa, Homo Sapiens
LSGAEGTSL

SEQ ID NO: 1301337 - protein, 9 aa, Homo Sapiens
HGGLIWGRR

SEQ ID NO: 1301338 - protein, 9 aa, Homo Sapiens
TRASAQPWR

SEQ ID NO: 1301339 - protein, 9 aa, Homo Sapiens
PRVVCSCCS

SEQ ID NO: 1301340 - protein, 9 aa, Homo Sapiens
NYYLFSLGV

SEQ ID NO: 1301341 - protein, 9 aa, Homo Sapiens
PHKMTLWFK

SEQ ID NO: 1301342 - protein, 9 aa, Homo Sapiens
SGIIQGTSR

SEQ ID NO: 1301343 - protein, 9 aa, Homo Sapiens
TPVRPAAQC

SEQ ID NO: 1301344 - protein, 9 aa, Homo Sapiens
HGELDSMVP

SEQ ID NO: 1301345 - protein, 9 aa, Homo Sapiens
SPRPPPLVR

SEQ ID NO: 1301346 - protein, 9 aa, Homo Sapiens
VVRRCGGPR

SEQ ID NO: 1301347 - protein, 9 aa, Homo Sapiens
SSYTWMVPL

SEQ ID NO: 1301348 - protein, 9 aa, Homo Sapiens
LQAGPPGTV

SEQ ID NO: 1301349 - protein, 9 aa, Homo Sapiens
YFSSEEDLI

SEQ ID NO: 1301350 - protein, 9 aa, Homo Sapiens
GEPGIRGVS

SEQ ID NO: 1301351 - protein, 9 aa, Homo Sapiens
GGDDEGLDV

SEQ ID NO: 1301352 - protein, 9 aa, Homo Sapiens
PRNPPRKAP

SEQ ID NO: 1301353 - protein, 9 aa, Homo Sapiens
SFGLLPLSM

SEQ ID NO: 1301354 - protein, 9 aa, Homo Sapiens
KGSPGGQNT

SEQ ID NO: 1301355 - protein, 9 aa, Homo Sapiens
TWIVIDGAA

SEQ ID NO: 1301356 - protein, 9 aa, Homo Sapiens
SGPSPARSA

SEQ ID NO: 1301357 - protein, 9 aa, Homo Sapiens
RELQRPQLG

SEQ ID NO: 1301358 - protein, 9 aa, Homo Sapiens
FTSEQREKL

SEQ ID NO: 1301359 - protein, 9 aa, Homo Sapiens
IERIPLLKC

SEQ ID NO: 1301360 - protein, 9 aa, Homo Sapiens
SALESPETH

SEQ ID NO: 1301361 - protein, 9 aa, Homo Sapiens
AFSVLNSSY

SEQ ID NO: 1301362 - protein, 9 aa, Homo Sapiens
TMQLHPVAG

SEQ ID NO: 1301363 - protein, 9 aa, Homo Sapiens
VAAAALQHQ

SEQ ID NO: 1301364 - protein, 9 aa, Homo Sapiens
PTVVVQHLL

SEQ ID NO: 1301365 - protein, 9 aa, Homo Sapiens
TFVSSEAIS

SEQ ID NO: 1301366 - protein, 9 aa, Homo Sapiens
QRPRRHGAG

SEQ ID NO: 1301367 - protein, 9 aa, Homo Sapiens
FFVLVNLEV

SEQ ID NO: 1301368 - protein, 9 aa, Homo Sapiens
VENPPDVDG

SEQ ID NO: 1301369 - protein, 9 aa, Homo Sapiens
RAQAGRQAP

SEQ ID NO: 1301370 - protein, 9 aa, Homo Sapiens
TSWHCNRCL

SEQ ID NO: 1301371 - protein, 9 aa, Homo Sapiens
RPAAQCQDP

SEQ ID NO: 1301372 - protein, 9 aa, Homo Sapiens
DAQERDEAH

SEQ ID NO: 1301373 - protein, 9 aa, Homo Sapiens
TVSQVTEDY

SEQ ID NO: 1301374 - protein, 9 aa, Homo Sapiens
PPHLPSCHP

SEQ ID NO: 1301375 - protein, 9 aa, Homo Sapiens
RAGNEEKCP

SEQ ID NO: 1301376 - protein, 9 aa, Homo Sapiens
DCYTRLFSP

SEQ ID NO: 1301377 - protein, 9 aa, Homo Sapiens
SRELLEVAA

SEQ ID NO: 1301378 - protein, 9 aa, Homo Sapiens
RESSALESP

SEQ ID NO: 1301379 - protein, 9 aa, Homo Sapiens
DSMVPVRFG

SEQ ID NO: 1301380 - protein, 9 aa, Homo Sapiens
QNVRTQSYS

SEQ ID NO: 1301381 - protein, 9 aa, Homo Sapiens
VGTEVTGVG

SEQ ID NO: 1301382 - protein, 9 aa, Homo Sapiens
VTTESTTET

SEQ ID NO: 1301383 - protein, 9 aa, Homo Sapiens
ESTRCEDEE

SEQ ID NO: 1301384 - protein, 9 aa, Homo Sapiens
KPTKRPTRK

SEQ ID NO: 1301385 - protein, 9 aa, Homo Sapiens
NPWGTMATI

SEQ ID NO: 1301386 - protein, 9 aa, Homo Sapiens
SGRLHDRPP

SEQ ID NO: 1301387 - protein, 9 aa, Homo Sapiens
VPHACCGLC

SEQ ID NO: 1301388 - protein, 9 aa, Homo Sapiens
PASETTALS

SEQ ID NO: 1301389 - protein, 9 aa, Homo Sapiens
PPWNMAQMC

SEQ ID NO: 1301390 - protein, 9 aa, Homo Sapiens
SLEKDIAMK

SEQ ID NO: 1301391 - protein, 9 aa, Homo Sapiens
WEIVMETLQ

SEQ ID NO: 1301392 - protein, 9 aa, Homo Sapiens
CTPASGPSP

SEQ ID NO: 1301393 - protein, 9 aa, Homo Sapiens
REDCEPPIA

SEQ ID NO: 1301394 - protein, 9 aa, Homo Sapiens
ILDLDVVLC

SEQ ID NO: 1301395 - protein, 9 aa, Homo Sapiens
WWQRSLSLT

SEQ ID NO: 1301396 - protein, 9 aa, Homo Sapiens
RSPPELQPG

SEQ ID NO: 1301397 - protein, 9 aa, Homo Sapiens
WRLPSPRRA

SEQ ID NO: 1301398 - protein, 9 aa, Homo Sapiens
LAGRVGGAD

SEQ ID NO: 1301399 - protein, 9 aa, Homo Sapiens
GIMVTKFYF

SEQ ID NO: 1301400 - protein, 9 aa, Homo Sapiens
RRRRRKRSS

SEQ ID NO: 1301401 - protein, 9 aa, Homo Sapiens
ALAPAPEKQ

SEQ ID NO: 1301402 - protein, 9 aa, Homo Sapiens
SASSSCSRP

SEQ ID NO: 1301403 - protein, 9 aa, Homo Sapiens
CGPTSGSTP

SEQ ID NO: 1301404 - protein, 9 aa, Homo Sapiens
TYNKQPVYR

SEQ ID NO: 1301405 - protein, 9 aa, Homo Sapiens
VNGLILDIS

SEQ ID NO: 1301406 - protein, 9 aa, Homo Sapiens
QLEKEAEGS

SEQ ID NO: 1301407 - protein, 9 aa, Homo Sapiens
VGGADACVR

SEQ ID NO: 1301408 - protein, 9 aa, Homo Sapiens
VQRRVHHLQ

SEQ ID NO: 1301409 - protein, 9 aa, Homo Sapiens
MFNHLSVVS

SEQ ID NO: 1301410 - protein, 9 aa, Homo Sapiens
MLPVRARTA

SEQ ID NO: 1301411 - protein, 9 aa, Homo Sapiens
AEGAAGTRC

SEQ ID NO: 1301412 - protein, 9 aa, Homo Sapiens
AISRTDTEN

SEQ ID NO: 1301413 - protein, 9 aa, Homo Sapiens
PHNFVLLVQ

SEQ ID NO: 1301414 - protein, 9 aa, Homo Sapiens
LQNPVPLRG

SEQ ID NO: 1301415 - protein, 9 aa, Homo Sapiens
CSILPSWLP

SEQ ID NO: 1301416 - protein, 9 aa, Homo Sapiens
PRDTLDTRH

SEQ ID NO: 1301417 - protein, 9 aa, Homo Sapiens
GPSPARSAA

SEQ ID NO: 1301418 - protein, 9 aa, Homo Sapiens
QGFDGELWG

SEQ ID NO: 1301419 - protein, 9 aa, Homo Sapiens
IISQFTEKN

SEQ ID NO: 1301420 - protein, 9 aa, Homo Sapiens
VVLCVALAP

SEQ ID NO: 1301421 - protein, 9 aa, Homo Sapiens
VPDQELSST

SEQ ID NO: 1301422 - protein, 9 aa, Homo Sapiens
AVSVTLFLW

SEQ ID NO: 1301423 - protein, 9 aa, Homo Sapiens
LCCATPAHA

SEQ ID NO: 1301424 - protein, 9 aa, Homo Sapiens
EYHQTPLQN

SEQ ID NO: 1301425 - protein, 9 aa, Homo Sapiens
TPEIILSKG

SEQ ID NO: 1301426 - protein, 9 aa, Homo Sapiens
SKITEQEKD

SEQ ID NO: 1301427 - protein, 9 aa, Homo Sapiens
APCRPPPVP

SEQ ID NO: 1301428 - protein, 9 aa, Homo Sapiens
EASTGAWTA

SEQ ID NO: 1301429 - protein, 9 aa, Homo Sapiens
SDQSLLTVA

SEQ ID NO: 1301430 - protein, 9 aa, Homo Sapiens
GTRCRASRA

SEQ ID NO: 1301431 - protein, 9 aa, Homo Sapiens
LSRELLEVA

SEQ ID NO: 1301432 - protein, 9 aa, Homo Sapiens
IFQIMRILR

SEQ ID NO: 1301433 - protein, 9 aa, Homo Sapiens
PVRARTARS

SEQ ID NO: 1301434 - protein, 9 aa, Homo Sapiens
IPPPKAMQW

SEQ ID NO: 1301435 - protein, 9 aa, Homo Sapiens
VGLYRTGRS

SEQ ID NO: 1301436 - protein, 9 aa, Homo Sapiens
PLPQLLGPP

SEQ ID NO: 1301437 - protein, 9 aa, Homo Sapiens
YLGVAHLQR

SEQ ID NO: 1301438 - protein, 9 aa, Homo Sapiens
ARSPPQLLF

SEQ ID NO: 1301439 - protein, 9 aa, Homo Sapiens
RIGATTPPI

SEQ ID NO: 1301440 - protein, 9 aa, Homo Sapiens
PLMKKPTKR

SEQ ID NO: 1301441 - protein, 9 aa, Homo Sapiens
PVAWEHACQ

SEQ ID NO: 1301442 - protein, 9 aa, Homo Sapiens
RSSRWFQFG

SEQ ID NO: 1301443 - protein, 9 aa, Homo Sapiens
SAARVGQLR

SEQ ID NO: 1301444 - protein, 9 aa, Homo Sapiens
SYYRASPWW

SEQ ID NO: 1301445 - protein, 9 aa, Homo Sapiens
QLQDASPVA

SEQ ID NO: 1301446 - protein, 9 aa, Homo Sapiens
HPYAQKRSH

SEQ ID NO: 1301447 - protein, 9 aa, Homo Sapiens
APGGLQIQE

SEQ ID NO: 1301448 - protein, 9 aa, Homo Sapiens
SITSSGQSL

SEQ ID NO: 1301449 - protein, 9 aa, Homo Sapiens
IQRRPLPWT

SEQ ID NO: 1301450 - protein, 9 aa, Homo Sapiens
PMLTYHVDA

SEQ ID NO: 1301451 - protein, 9 aa, Homo Sapiens
DSPVALGMV

SEQ ID NO: 1301452 - protein, 9 aa, Homo Sapiens
FSPLIPQTT

SEQ ID NO: 1301453 - protein, 9 aa, Homo Sapiens
KKAARAKKA

SEQ ID NO: 1301454 - protein, 9 aa, Homo Sapiens
WASLGSCPG

SEQ ID NO: 1301455 - protein, 9 aa, Homo Sapiens
AGNSTTRIL

SEQ ID NO: 1301456 - protein, 9 aa, Homo Sapiens
EKSGVLNLT

SEQ ID NO: 1301457 - protein, 9 aa, Homo Sapiens
KKKELASKF

SEQ ID NO: 1301458 - protein, 9 aa, Homo Sapiens
VTFSGKLCR

SEQ ID NO: 1301459 - protein, 9 aa, Homo Sapiens
LSFISSFPI

SEQ ID NO: 1301460 - protein, 9 aa, Homo Sapiens
HGGRHLPLL

SEQ ID NO: 1301461 - protein, 9 aa, Homo Sapiens
LGYRGDCYT

SEQ ID NO: 1301462 - protein, 9 aa, Homo Sapiens
PRAGNEEKC

SEQ ID NO: 1301463 - protein, 9 aa, Homo Sapiens
QDASPVAWE

SEQ ID NO: 1301464 - protein, 9 aa, Homo Sapiens
VSCCLDLRV

SEQ ID NO: 1301465 - protein, 9 aa, Homo Sapiens
REALNERHS

SEQ ID NO: 1301466 - protein, 9 aa, Homo Sapiens
TSPNSSLTS

SEQ ID NO: 1301467 - protein, 9 aa, Homo Sapiens
FSFDSHRQE

SEQ ID NO: 1301468 - protein, 9 aa, Homo Sapiens
PEYLTPEII

SEQ ID NO: 1301469 - protein, 9 aa, Homo Sapiens
PRAAIWRRI

SEQ ID NO: 1301470 - protein, 9 aa, Homo Sapiens
LHRFLLSNR

SEQ ID NO: 1301471 - protein, 9 aa, Homo Sapiens
AEQIISDHF

SEQ ID NO: 1301472 - protein, 9 aa, Homo Sapiens
LPVVIMMVL

SEQ ID NO: 1301473 - protein, 9 aa, Homo Sapiens
DIAMKMRLR

SEQ ID NO: 1301474 - protein, 9 aa, Homo Sapiens
TARSALPQG

SEQ ID NO: 1301475 - protein, 9 aa, Homo Sapiens
CVKTTVENE

SEQ ID NO: 1301476 - protein, 9 aa, Homo Sapiens
RELLEVAAP

SEQ ID NO: 1301477 - protein, 9 aa, Homo Sapiens
PEAEHPRRC

SEQ ID NO: 1301478 - protein, 9 aa, Homo Sapiens
AAQKCHKKT

SEQ ID NO: 1301479 - protein, 9 aa, Homo Sapiens
RAKKAVKKT

SEQ ID NO: 1301480 - protein, 9 aa, Homo Sapiens
STAATTAAG

SEQ ID NO: 1301481 - protein, 9 aa, Homo Sapiens
YKCEECDKD

SEQ ID NO: 1301482 - protein, 9 aa, Homo Sapiens
EDMVWRTDG

SEQ ID NO: 1301483 - protein, 9 aa, Homo Sapiens
VARPSTTRR

SEQ ID NO: 1301484 - protein, 9 aa, Homo Sapiens
RLARRVCHP

SEQ ID NO: 1301485 - protein, 9 aa, Homo Sapiens
PVAGSSPAG

SEQ ID NO: 1301486 - protein, 9 aa, Homo Sapiens
GSPGGQNTR

SEQ ID NO: 1301487 - protein, 9 aa, Homo Sapiens
HGEHSSTLP

SEQ ID NO: 1301488 - protein, 9 aa, Homo Sapiens
EELRAEHQR

SEQ ID NO: 1301489 - protein, 9 aa, Homo Sapiens
VSQVTEDYV

SEQ ID NO: 1301490 - protein, 9 aa, Homo Sapiens
AKNALNGIH

SEQ ID NO: 1301491 - protein, 9 aa, Homo Sapiens
MGLYTGEIS

SEQ ID NO: 1301492 - protein, 9 aa, Homo Sapiens
TKRPSLQTG

SEQ ID NO: 1301493 - protein, 9 aa, Homo Sapiens
GAGAVGLSL

SEQ ID NO: 1301494 - protein, 9 aa, Homo Sapiens
LWNLYSPVF

SEQ ID NO: 1301495 - protein, 9 aa, Homo Sapiens
GPPPPGGAR

SEQ ID NO: 1301496 - protein, 9 aa, Homo Sapiens
AASLSCSGI

SEQ ID NO: 1301497 - protein, 9 aa, Homo Sapiens
GVDAAGPRV

SEQ ID NO: 1301498 - protein, 9 aa, Homo Sapiens
QIQEKSTME

SEQ ID NO: 1301499 - protein, 9 aa, Homo Sapiens
NMPDEGIMV

SEQ ID NO: 1301500 - protein, 9 aa, Homo Sapiens
AQELVRASR

SEQ ID NO: 1301501 - protein, 9 aa, Homo Sapiens
LAKWEEYQR

SEQ ID NO: 1301502 - protein, 9 aa, Homo Sapiens
WDQDGKWFE

SEQ ID NO: 1301503 - protein, 9 aa, Homo Sapiens
RTRACTPAS

SEQ ID NO: 1301504 - protein, 9 aa, Homo Sapiens
KNSGSDNRK

SEQ ID NO: 1301505 - protein, 9 aa, Homo Sapiens
LYTLWNLYS

SEQ ID NO: 1301506 - protein, 9 aa, Homo Sapiens
LHPVAGSSP

SEQ ID NO: 1301507 - protein, 9 aa, Homo Sapiens
KQGSDVYDA

SEQ ID NO: 1301508 - protein, 9 aa, Homo Sapiens
LSLARLVGD

SEQ ID NO: 1301509 - protein, 9 aa, Homo Sapiens
QIFQHLSPN

SEQ ID NO: 1301510 - protein, 9 aa, Homo Sapiens
SPLASAGHG

SEQ ID NO: 1301511 - protein, 9 aa, Homo Sapiens
RALGEVPVV

SEQ ID NO: 1301512 - protein, 9 aa, Homo Sapiens
VIMMVLYIH

SEQ ID NO: 1301513 - protein, 9 aa, Homo Sapiens
IMMVLYIHI

SEQ ID NO: 1301514 - protein, 9 aa, Homo Sapiens
GPASETTAL

SEQ ID NO: 1301515 - protein, 9 aa, Homo Sapiens
RIWYIPLMK

SEQ ID NO: 1301516 - protein, 9 aa, Homo Sapiens
TEVTGVGLQ

SEQ ID NO: 1301517 - protein, 9 aa, Homo Sapiens
RRCGGPRLQ

SEQ ID NO: 1301518 - protein, 9 aa, Homo Sapiens
ASSTATTSW

SEQ ID NO: 1301519 - protein, 9 aa, Homo Sapiens
FFLQKDCSY

SEQ ID NO: 1301520 - protein, 9 aa, Homo Sapiens
YSPVFDMEK

SEQ ID NO: 1301521 - protein, 9 aa, Homo Sapiens
QSENEDSPV

SEQ ID NO: 1301522 - protein, 9 aa, Homo Sapiens
SSTTTTTNN

SEQ ID NO: 1301523 - protein, 9 aa, Homo Sapiens
LSSYVGSSL

SEQ ID NO: 1301524 - protein, 9 aa, Homo Sapiens
APVLRVCSS

SEQ ID NO: 1301525 - protein, 9 aa, Homo Sapiens
SVARPSTTR

SEQ ID NO: 1301526 - protein, 9 aa, Homo Sapiens
GPSPAPSAG

SEQ ID NO: 1301527 - protein, 9 aa, Homo Sapiens
VGSSLDVWR

SEQ ID NO: 1301528 - protein, 9 aa, Homo Sapiens
WRTRACTPA

SEQ ID NO: 1301529 - protein, 9 aa, Homo Sapiens
HGTCSPDSF

SEQ ID NO: 1301530 - protein, 9 aa, Homo Sapiens
SSSYYRASP

SEQ ID NO: 1301531 - protein, 9 aa, Homo Sapiens
PVPKKRERM

SEQ ID NO: 1301532 - protein, 9 aa, Homo Sapiens
VPAPSQLPA

SEQ ID NO: 1301533 - protein, 9 aa, Homo Sapiens
AAWPRVPQG

SEQ ID NO: 1301534 - protein, 9 aa, Homo Sapiens
PLSQWSLRS

SEQ ID NO: 1301535 - protein, 9 aa, Homo Sapiens
KRRRRRKRS

SEQ ID NO: 1301536 - protein, 9 aa, Homo Sapiens
GLCHGGRHL

SEQ ID NO: 1301537 - protein, 9 aa, Homo Sapiens
ESPETHRAQ

SEQ ID NO: 1301538 - protein, 9 aa, Homo Sapiens
NALNGIHFD

SEQ ID NO: 1301539 - protein, 9 aa, Homo Sapiens
SCPRPGAVP

SEQ ID NO: 1301540 - protein, 9 aa, Homo Sapiens
EEFVVTTES

SEQ ID NO: 1301541 - protein, 9 aa, Homo Sapiens
QGSTSILQV

SEQ ID NO: 1301542 - protein, 9 aa, Homo Sapiens
RSSQSRSPV

SEQ ID NO: 1301543 - protein, 9 aa, Homo Sapiens
GEIFVSCCV

SEQ ID NO: 1301544 - protein, 9 aa, Homo Sapiens
AAGGAVYEQ

SEQ ID NO: 1301545 - protein, 9 aa, Homo Sapiens
SPARSAAAA

SEQ ID NO: 1301546 - protein, 9 aa, Homo Sapiens
KWVELMKMH

SEQ ID NO: 1301547 - protein, 9 aa, Homo Sapiens
SRRPLGVSP

SEQ ID NO: 1301548 - protein, 9 aa, Homo Sapiens
DTFQDVSSM

SEQ ID NO: 1301549 - protein, 9 aa, Homo Sapiens
LKKNPVMPQ

SEQ ID NO: 1301550 - protein, 9 aa, Homo Sapiens
ASGPSPARS

SEQ ID NO: 1301551 - protein, 9 aa, Homo Sapiens
IVNWALSVW

SEQ ID NO: 1301552 - protein, 9 aa, Homo Sapiens
MAGSMLGMP

SEQ ID NO: 1301553 - protein, 9 aa, Homo Sapiens
EPDSPVALG

SEQ ID NO: 1301554 - protein, 9 aa, Homo Sapiens
TTNNRATKA

SEQ ID NO: 1301555 - protein, 9 aa, Homo Sapiens
VHCVKTTVE

SEQ ID NO: 1301556 - protein, 9 aa, Homo Sapiens
GCTAPTVIT

SEQ ID NO: 1301557 - protein, 9 aa, Homo Sapiens
ELGGRGAAG

SEQ ID NO: 1301558 - protein, 9 aa, Homo Sapiens
KNALNGIHF

SEQ ID NO: 1301559 - protein, 9 aa, Homo Sapiens
EEYQRQLLL

SEQ ID NO: 1301560 - protein, 9 aa, Homo Sapiens
IEKSGVLNL

SEQ ID NO: 1301561 - protein, 9 aa, Homo Sapiens
SGGTRMRGE

SEQ ID NO: 1301562 - protein, 9 aa, Homo Sapiens
RAPCRPPPV

SEQ ID NO: 1301563 - protein, 9 aa, Homo Sapiens
VPQGKPHGA

SEQ ID NO: 1301564 - protein, 9 aa, Homo Sapiens
PQTTAWFYR

SEQ ID NO: 1301565 - protein, 9 aa, Homo Sapiens
QKRSHYIYV

SEQ ID NO: 1301566 - protein, 9 aa, Homo Sapiens
AEHPRRCSG

SEQ ID NO: 1301567 - protein, 9 aa, Homo Sapiens
QLWHRELQR

SEQ ID NO: 1301568 - protein, 9 aa, Homo Sapiens
KRMAVRNMA

SEQ ID NO: 1301569 - protein, 9 aa, Homo Sapiens
GIPGAHGPI

SEQ ID NO: 1301570 - protein, 9 aa, Homo Sapiens
QSLNPWGTM

SEQ ID NO: 1301571 - protein, 9 aa, Homo Sapiens
NHLSVVSES

SEQ ID NO: 1301572 - protein, 9 aa, Homo Sapiens
KADPESAEW

SEQ ID NO: 1301573 - protein, 9 aa, Homo Sapiens
LPGGELLHP

SEQ ID NO: 1301574 - protein, 9 aa, Homo Sapiens
RAAEEPLPK

SEQ ID NO: 1301575 - protein, 9 aa, Homo Sapiens
NHSKQSSNS

SEQ ID NO: 1301576 - protein, 9 aa, Homo Sapiens
PSLQTGTCR

SEQ ID NO: 1301577 - protein, 9 aa, Homo Sapiens
RATSGTAPS

SEQ ID NO: 1301578 - protein, 9 aa, Homo Sapiens
EGLDVEGER

SEQ ID NO: 1301579 - protein, 9 aa, Homo Sapiens
LCPSKRHPI

SEQ ID NO: 1301580 - protein, 9 aa, Homo Sapiens
LEELRAEHQ

SEQ ID NO: 1301581 - protein, 9 aa, Homo Sapiens
RHESLFSAR

SEQ ID NO: 1301582 - protein, 9 aa, Homo Sapiens
EAEHPRRCS

SEQ ID NO: 1301583 - protein, 9 aa, Homo Sapiens
QALYDTINP

SEQ ID NO: 1301584 - protein, 9 aa, Homo Sapiens
GVGQAQGAE

SEQ ID NO: 1301585 - protein, 9 aa, Homo Sapiens
GRLHDRPPR

SEQ ID NO: 1301586 - protein, 9 aa, Homo Sapiens
PRLQRRRQP

SEQ ID NO: 1301587 - protein, 9 aa, Homo Sapiens
PPPKAMQWV

SEQ ID NO: 1301588 - protein, 9 aa, Homo Sapiens
PLWSIWPAC

SEQ ID NO: 1301589 - protein, 9 aa, Homo Sapiens
QAQHQHQSQ

SEQ ID NO: 1301590 - protein, 9 aa, Homo Sapiens
IPRSPSPRS

SEQ ID NO: 1301591 - protein, 9 aa, Homo Sapiens
NEVHPLHML

SEQ ID NO: 1301592 - protein, 9 aa, Homo Sapiens
CSGARVEAV

SEQ ID NO: 1301593 - protein, 9 aa, Homo Sapiens
LPEATPAQA

SEQ ID NO: 1301594 - protein, 9 aa, Homo Sapiens
VLPIRWMSC

SEQ ID NO: 1301595 - protein, 9 aa, Homo Sapiens
QMCTFCGRW

SEQ ID NO: 1301596 - protein, 9 aa, Homo Sapiens
HLLDGLHHV

SEQ ID NO: 1301597 - protein, 9 aa, Homo Sapiens
GVSPLAPCP

SEQ ID NO: 1301598 - protein, 9 aa, Homo Sapiens
QPDFRYFCM

SEQ ID NO: 1301599 - protein, 9 aa, Homo Sapiens
DIRDRAHFT

SEQ ID NO: 1301600 - protein, 9 aa, Homo Sapiens
DLKKLQVKE

SEQ ID NO: 1301601 - protein, 9 aa, Homo Sapiens
SAGHGTCSP

SEQ ID NO: 1301602 - protein, 9 aa, Homo Sapiens
PQLLGPPPP

SEQ ID NO: 1301603 - protein, 9 aa, Homo Sapiens
PRLPSQPAV

SEQ ID NO: 1301604 - protein, 9 aa, Homo Sapiens
STTRILSTN

SEQ ID NO: 1301605 - protein, 9 aa, Homo Sapiens
PSPRSSLPL

SEQ ID NO: 1301606 - protein, 9 aa, Homo Sapiens
ATNPTWRRT

SEQ ID NO: 1301607 - protein, 9 aa, Homo Sapiens
SPTKCEICV

SEQ ID NO: 1301608 - protein, 9 aa, Homo Sapiens
FSGKLCRIV

SEQ ID NO: 1301609 - protein, 9 aa, Homo Sapiens
LLFSSLEDP

SEQ ID NO: 1301610 - protein, 9 aa, Homo Sapiens
LPSPRPPPL

SEQ ID NO: 1301611 - protein, 9 aa, Homo Sapiens
CTSWHCNRC

SEQ ID NO: 1301612 - protein, 9 aa, Homo Sapiens
KRHPIFGDF

SEQ ID NO: 1301613 - protein, 9 aa, Homo Sapiens
TGAWTAEGA

SEQ ID NO: 1301614 - protein, 9 aa, Homo Sapiens
GPACVPVAE

SEQ ID NO: 1301615 - protein, 9 aa, Homo Sapiens
LQHQLQDAS

SEQ ID NO: 1301616 - protein, 9 aa, Homo Sapiens
ASTPARSPT

SEQ ID NO: 1301617 - protein, 9 aa, Homo Sapiens
KIDVLKADP

SEQ ID NO: 1301618 - protein, 9 aa, Homo Sapiens
AVPWQKEET

SEQ ID NO: 1301619 - protein, 9 aa, Homo Sapiens
LWISVTVLF

SEQ ID NO: 1301620 - protein, 9 aa, Homo Sapiens
LQHTMNVPS

SEQ ID NO: 1301621 - protein, 9 aa, Homo Sapiens
SDHFSDPKF

SEQ ID NO: 1301622 - protein, 9 aa, Homo Sapiens
CLDLRVPSI

SEQ ID NO: 1301623 - protein, 9 aa, Homo Sapiens
RLQRRRQPR

SEQ ID NO: 1301624 - protein, 9 aa, Homo Sapiens
DLCRGPRLP

SEQ ID NO: 1301625 - protein, 9 aa, Homo Sapiens
VGPLGLRPP

SEQ ID NO: 1301626 - protein, 9 aa, Homo Sapiens
QGPSCSFPH

SEQ ID NO: 1301627 - protein, 9 aa, Homo Sapiens
IRGGDPAPG

SEQ ID NO: 1301628 - protein, 9 aa, Homo Sapiens
TAAKPSARS

SEQ ID NO: 1301629 - protein, 9 aa, Homo Sapiens
LYIMTLIPM

SEQ ID NO: 1301630 - protein, 9 aa, Homo Sapiens
ECFFLQKDC

SEQ ID NO: 1301631 - protein, 9 aa, Homo Sapiens
SCCSTHGGL

SEQ ID NO: 1301632 - protein, 9 aa, Homo Sapiens
AAALQHQLQ

SEQ ID NO: 1301633 - protein, 9 aa, Homo Sapiens
FDPHKMTLW

SEQ ID NO: 1301634 - protein, 9 aa, Homo Sapiens
SPPTLMMSN

SEQ ID NO: 1301635 - protein, 9 aa, Homo Sapiens
CSSFGGWTS

SEQ ID NO: 1301636 - protein, 9 aa, Homo Sapiens
QRRRQPRPP

SEQ ID NO: 1301637 - protein, 9 aa, Homo Sapiens
FPINVSSLV

SEQ ID NO: 1301638 - protein, 9 aa, Homo Sapiens
ILGYRGDCY

SEQ ID NO: 1301639 - protein, 9 aa, Homo Sapiens
PRPPGGGGG

SEQ ID NO: 1301640 - protein, 9 aa, Homo Sapiens
PPELQPGQP

SEQ ID NO: 1301641 - protein, 9 aa, Homo Sapiens
PVAEASTGA

SEQ ID NO: 1301642 - protein, 9 aa, Homo Sapiens
TFLLGLFGC

SEQ ID NO: 1301643 - protein, 9 aa, Homo Sapiens
ALLVPHACC

SEQ ID NO: 1301644 - protein, 9 aa, Homo Sapiens
KKRCIANTH

SEQ ID NO: 1301645 - protein, 9 aa, Homo Sapiens
NSHQVLKAI

SEQ ID NO: 1301646 - protein, 9 aa, Homo Sapiens
HPLNKLQGF

SEQ ID NO: 1301647 - protein, 9 aa, Homo Sapiens
NPPRKAPGG

SEQ ID NO: 1301648 - protein, 9 aa, Homo Sapiens
ALRMSWRRH

SEQ ID NO: 1301649 - protein, 9 aa, Homo Sapiens
VDLKKLQVK

SEQ ID NO: 1301650 - protein, 9 aa, Homo Sapiens
LLGEIFVSC

SEQ ID NO: 1301651 - protein, 9 aa, Homo Sapiens
KHQVQSMKQ

SEQ ID NO: 1301652 - protein, 9 aa, Homo Sapiens
KRTQPDKLQ

SEQ ID NO: 1301653 - protein, 9 aa, Homo Sapiens
QCTAQTYPG

SEQ ID NO: 1301654 - protein, 9 aa, Homo Sapiens
NARLNGEKT

SEQ ID NO: 1301655 - protein, 9 aa, Homo Sapiens
VKGFSYNSD

SEQ ID NO: 1301656 - protein, 9 aa, Homo Sapiens
DVCQNFQPD

SEQ ID NO: 1301657 - protein, 9 aa, Homo Sapiens
PLLKCIAKI

SEQ ID NO: 1301658 - protein, 9 aa, Homo Sapiens
SLLNHRIFS

SEQ ID NO: 1301659 - protein, 9 aa, Homo Sapiens
PVGAGTGGG

SEQ ID NO: 1301660 - protein, 9 aa, Homo Sapiens
TSPQSGRVQ

SEQ ID NO: 1301661 - protein, 9 aa, Homo Sapiens
VVDADSGYN

SEQ ID NO: 1301662 - protein, 9 aa, Homo Sapiens
SPRLARRVC

SEQ ID NO: 1301663 - protein, 9 aa, Homo Sapiens
PWKRKQRAV

SEQ ID NO: 1301664 - protein, 9 aa, Homo Sapiens
GNSTTRILS

SEQ ID NO: 1301665 - protein, 9 aa, Homo Sapiens
ATSARRGPF

SEQ ID NO: 1301666 - protein, 9 aa, Homo Sapiens
ILDISALVE

SEQ ID NO: 1301667 - protein, 9 aa, Homo Sapiens
VNPFFFYPI

SEQ ID NO: 1301668 - protein, 9 aa, Homo Sapiens
IWYIPLMKK

SEQ ID NO: 1301669 - protein, 9 aa, Homo Sapiens
RSPTWCRTG

SEQ ID NO: 1301670 - protein, 9 aa, Homo Sapiens
VPVAEASTG

SEQ ID NO: 1301671 - protein, 9 aa, Homo Sapiens
LPENGIAPI

SEQ ID NO: 1301672 - protein, 9 aa, Homo Sapiens
RRGVGQAQG

SEQ ID NO: 1301673 - protein, 9 aa, Homo Sapiens
LAPCPPLEV

SEQ ID NO: 1301674 - protein, 9 aa, Homo Sapiens
FVVTTESTT

SEQ ID NO: 1301675 - protein, 9 aa, Homo Sapiens
FGGPETRCS

SEQ ID NO: 1301676 - protein, 9 aa, Homo Sapiens
SHARTHPKE

SEQ ID NO: 1301677 - protein, 9 aa, Homo Sapiens
LKGIPVDVV

SEQ ID NO: 1301678 - protein, 9 aa, Homo Sapiens
GHGVVAARV

SEQ ID NO: 1301679 - protein, 9 aa, Homo Sapiens
TDCTYRWHV

SEQ ID NO: 1301680 - protein, 9 aa, Homo Sapiens
KMKLGPLQF

SEQ ID NO: 1301681 - protein, 9 aa, Homo Sapiens
LAVHRGDTS

SEQ ID NO: 1301682 - protein, 9 aa, Homo Sapiens
PNEVHPLHM

SEQ ID NO: 1301683 - protein, 9 aa, Homo Sapiens
SQEDRHSNA

SEQ ID NO: 1301684 - protein, 9 aa, Homo Sapiens
ALIFLNISR

SEQ ID NO: 1301685 - protein, 9 aa, Homo Sapiens
SSSATSATS

SEQ ID NO: 1301686 - protein, 9 aa, Homo Sapiens
LSTPKTMRN

SEQ ID NO: 1301687 - protein, 9 aa, Homo Sapiens
TSPSKRTQP

SEQ ID NO: 1301688 - protein, 9 aa, Homo Sapiens
RHCEDLDGV

SEQ ID NO: 1301689 - protein, 9 aa, Homo Sapiens
ITLLCRLEC

SEQ ID NO: 1301690 - protein, 9 aa, Homo Sapiens
GMLLPRALP

SEQ ID NO: 1301691 - protein, 9 aa, Homo Sapiens
TAARPSATN

SEQ ID NO: 1301692 - protein, 9 aa, Homo Sapiens
PGGLQIQEK

SEQ ID NO: 1301693 - protein, 9 aa, Homo Sapiens
EGIMVTKFY

SEQ ID NO: 1301694 - protein, 9 aa, Homo Sapiens
LLRDQDLCR

SEQ ID NO: 1301695 - protein, 9 aa, Homo Sapiens
ELRRFQALK

SEQ ID NO: 1301696 - protein, 9 aa, Homo Sapiens
MESGESTST

SEQ ID NO: 1301697 - protein, 9 aa, Homo Sapiens
FDSHRQEKP

SEQ ID NO: 1301698 - protein, 9 aa, Homo Sapiens
DPPISPTRR

SEQ ID NO: 1301699 - protein, 9 aa, Homo Sapiens
TTKRPSLQT

SEQ ID NO: 1301700 - protein, 9 aa, Homo Sapiens
KELPMLTYH

SEQ ID NO: 1301701 - protein, 9 aa, Homo Sapiens
KLYECSQCV

SEQ ID NO: 1301702 - protein, 9 aa, Homo Sapiens
TSILQVLLK

SEQ ID NO: 1301703 - protein, 9 aa, Homo Sapiens
GGKEEFVVT

SEQ ID NO: 1301704 - protein, 9 aa, Homo Sapiens
DKQNCQRRD

SEQ ID NO: 1301705 - protein, 9 aa, Homo Sapiens
GGGDDEGLD

SEQ ID NO: 1301706 - protein, 9 aa, Homo Sapiens
MFDPHKMTL

SEQ ID NO: 1301707 - protein, 9 aa, Homo Sapiens
CDDRHCEDL

SEQ ID NO: 1301708 - protein, 9 aa, Homo Sapiens
AGNEEKCPE

SEQ ID NO: 1301709 - protein, 9 aa, Homo Sapiens
NNITKKKET

SEQ ID NO: 1301710 - protein, 9 aa, Homo Sapiens
RLKRQEQRK

SEQ ID NO: 1301711 - protein, 9 aa, Homo Sapiens
KQPENDLFD

SEQ ID NO: 1301712 - protein, 9 aa, Homo Sapiens
LSWQYLTTV

SEQ ID NO: 1301713 - protein, 9 aa, Homo Sapiens
DVYDAQTYD

SEQ ID NO: 1301714 - protein, 9 aa, Homo Sapiens
GLQRREGRA

SEQ ID NO: 1301715 - protein, 9 aa, Homo Sapiens
TSARRGPFW

SEQ ID NO: 1301716 - protein, 9 aa, Homo Sapiens
ASGWSASCG

SEQ ID NO: 1301717 - protein, 9 aa, Homo Sapiens
PPRKAPGGL

SEQ ID NO: 1301718 - protein, 9 aa, Homo Sapiens
TKVVVVDAD

SEQ ID NO: 1301719 - protein, 9 aa, Homo Sapiens
HPIFGDFLK

SEQ ID NO: 1301720 - protein, 9 aa, Homo Sapiens
GTGGGPACV

SEQ ID NO: 1301721 - protein, 9 aa, Homo Sapiens
QWVHSTPVR

SEQ ID NO: 1301722 - protein, 9 aa, Homo Sapiens
TAAWPRVPQ

SEQ ID NO: 1301723 - protein, 9 aa, Homo Sapiens
AMLSNTQSL

SEQ ID NO: 1301724 - protein, 9 aa, Homo Sapiens
PLTCDDPHF

SEQ ID NO: 1301725 - protein, 9 aa, Homo Sapiens
HQAEEDDAQ

SEQ ID NO: 1301726 - protein, 9 aa, Homo Sapiens
ASVPCLITD

SEQ ID NO: 1301727 - protein, 9 aa, Homo Sapiens
SSALESPET

SEQ ID NO: 1301728 - protein, 9 aa, Homo Sapiens
SGHILDLDV

SEQ ID NO: 1301729 - protein, 9 aa, Homo Sapiens
KALRMSWRR

SEQ ID NO: 1301730 - protein, 9 aa, Homo Sapiens
DKDFNQSSH

SEQ ID NO: 1301731 - protein, 9 aa, Homo Sapiens
EDDAQERDE

SEQ ID NO: 1301732 - protein, 9 aa, Homo Sapiens
VPVVDDPGR

SEQ ID NO: 1301733 - protein, 9 aa, Homo Sapiens
THLLCYRQI

SEQ ID NO: 1301734 - protein, 9 aa, Homo Sapiens
HPQGDRAPA

SEQ ID NO: 1301735 - protein, 9 aa, Homo Sapiens
SWQYLTTVS

SEQ ID NO: 1301736 - protein, 9 aa, Homo Sapiens
SCHPLPQLL

SEQ ID NO: 1301737 - protein, 9 aa, Homo Sapiens
VREIVQDFK

SEQ ID NO: 1301738 - protein, 9 aa, Homo Sapiens
PPLRHHPRG

SEQ ID NO: 1301739 - protein, 9 aa, Homo Sapiens
TRCRASRAP

SEQ ID NO: 1301740 - protein, 9 aa, Homo Sapiens
YIMTLIPMT

SEQ ID NO: 1301741 - protein, 9 aa, Homo Sapiens
PVYRKAIYE

SEQ ID NO: 1301742 - protein, 9 aa, Homo Sapiens
ATPSPWSAS

SEQ ID NO: 1301743 - protein, 9 aa, Homo Sapiens
ARLQALYDT

SEQ ID NO: 1301744 - protein, 9 aa, Homo Sapiens
RRPLGVSPL

SEQ ID NO: 1301745 - protein, 9 aa, Homo Sapiens
CSVMAPLVQ

SEQ ID NO: 1301746 - protein, 9 aa, Homo Sapiens
PDFRYFCME

SEQ ID NO: 1301747 - protein, 9 aa, Homo Sapiens
ELQLLPAPP

SEQ ID NO: 1301748 - protein, 9 aa, Homo Sapiens
LRSHARTHP

SEQ ID NO: 1301749 - protein, 9 aa, Homo Sapiens
SLKSSISSV

SEQ ID NO: 1301750 - protein, 9 aa, Homo Sapiens
PTTTFVVCN

SEQ ID NO: 1301751 - protein, 9 aa, Homo Sapiens
PKKAKKAAR

SEQ ID NO: 1301752 - protein, 9 aa, Homo Sapiens
DGQWLQGMT

SEQ ID NO: 1301753 - protein, 9 aa, Homo Sapiens
GDGAKFPEL

SEQ ID NO: 1301754 - protein, 9 aa, Homo Sapiens
VYSPVHCVK

SEQ ID NO: 1301755 - protein, 9 aa, Homo Sapiens
HQVLKAIFA

SEQ ID NO: 1301756 - protein, 9 aa, Homo Sapiens
LKKLQVKEL

SEQ ID NO: 1301757 - protein, 9 aa, Homo Sapiens
VRTATPSPW

SEQ ID NO: 1301758 - protein, 9 aa, Homo Sapiens
TRHESLFSA

SEQ ID NO: 1301759 - protein, 9 aa, Homo Sapiens
LGEVPVVDD

SEQ ID NO: 1301760 - protein, 9 aa, Homo Sapiens
PLHMLVQRR

SEQ ID NO: 1301761 - protein, 9 aa, Homo Sapiens
LMEQIPHLK

SEQ ID NO: 1301762 - protein, 9 aa, Homo Sapiens
APITLTHSS

SEQ ID NO: 1301763 - protein, 9 aa, Homo Sapiens
RLHTRGRPR

SEQ ID NO: 1301764 - protein, 9 aa, Homo Sapiens
MKTFVSSEA

SEQ ID NO: 1301765 - protein, 9 aa, Homo Sapiens
APPPSTAAT

SEQ ID NO: 1301766 - protein, 9 aa, Homo Sapiens
GRVGGADAC

SEQ ID NO: 1301767 - protein, 9 aa, Homo Sapiens
KVLAKDGDL

SEQ ID NO: 1301768 - protein, 9 aa, Homo Sapiens
TQSLNPWGT

SEQ ID NO: 1301769 - protein, 9 aa, Homo Sapiens
VVVDADSGY

SEQ ID NO: 1301770 - protein, 9 aa, Homo Sapiens
DMSRFLEGK

SEQ ID NO: 1301771 - protein, 9 aa, Homo Sapiens
RTGRSYLMN

SEQ ID NO: 1301772 - protein, 9 aa, Homo Sapiens
MQWVHSTPV

SEQ ID NO: 1301773 - protein, 9 aa, Homo Sapiens
HHLQVDEGL

SEQ ID NO: 1301774 - protein, 9 aa, Homo Sapiens
LPQLLGPPP

SEQ ID NO: 1301775 - protein, 9 aa, Homo Sapiens
LHMLVQRRV

SEQ ID NO: 1301776 - protein, 9 aa, Homo Sapiens
SVIFDNGSG

SEQ ID NO: 1301777 - protein, 9 aa, Homo Sapiens
TPVPTATAA

SEQ ID NO: 1301778 - protein, 9 aa, Homo Sapiens
EQREKLYLV

SEQ ID NO: 1301779 - protein, 9 aa, Homo Sapiens
RTDPQLEKE

SEQ ID NO: 1301780 - protein, 9 aa, Homo Sapiens
WNLYSPVFD

SEQ ID NO: 1301781 - protein, 9 aa, Homo Sapiens
EPTTTFVVC

SEQ ID NO: 1301782 - protein, 9 aa, Homo Sapiens
STPGSGPSP

SEQ ID NO: 1301783 - protein, 9 aa, Homo Sapiens
MSRFLEGKR

SEQ ID NO: 1301784 - protein, 9 aa, Homo Sapiens
VIPIIKTIG

SEQ ID NO: 1301785 - protein, 9 aa, Homo Sapiens
VPTVPPQAR

SEQ ID NO: 1301786 - protein, 9 aa, Homo Sapiens
RATKANGSN

SEQ ID NO: 1301787 - protein, 9 aa, Homo Sapiens
SMMFGNDMS

SEQ ID NO: 1301788 - protein, 9 aa, Homo Sapiens
LPSGLITPP

SEQ ID NO: 1301789 - protein, 9 aa, Homo Sapiens
PSLLSRMPA

SEQ ID NO: 1301790 - protein, 9 aa, Homo Sapiens
ITSPSKRTQ

SEQ ID NO: 1301791 - protein, 9 aa, Homo Sapiens
LRQKLQGLP

SEQ ID NO: 1301792 - protein, 9 aa, Homo Sapiens
FKKLQHTMN

SEQ ID NO: 1301793 - protein, 9 aa, Homo Sapiens
QEKSTMESG

SEQ ID NO: 1301794 - protein, 9 aa, Homo Sapiens
LLKCIAKIL

SEQ ID NO: 1301795 - protein, 9 aa, Homo Sapiens
APPEMGCEI

SEQ ID NO: 1301796 - protein, 9 aa, Homo Sapiens
IEAPPPSTA

SEQ ID NO: 1301797 - protein, 9 aa, Homo Sapiens
IQFPTHLTP

SEQ ID NO: 1301798 - protein, 9 aa, Homo Sapiens
LVREIVQDF

SEQ ID NO: 1301799 - protein, 9 aa, Homo Sapiens
VSVTLFLWF

SEQ ID NO: 1301800 - protein, 9 aa, Homo Sapiens
QQGSVVRRC

SEQ ID NO: 1301801 - protein, 9 aa, Homo Sapiens
LQENEPTAT

SEQ ID NO: 1301802 - protein, 9 aa, Homo Sapiens
YYRASPWWW

SEQ ID NO: 1301803 - protein, 9 aa, Homo Sapiens
DEAHGGGDD

SEQ ID NO: 1301804 - protein, 9 aa, Homo Sapiens
SPQSGRVQC

SEQ ID NO: 1301805 - protein, 9 aa, Homo Sapiens
GVLNLTVLW

SEQ ID NO: 1301806 - protein, 9 aa, Homo Sapiens
TPQSVFELL

SEQ ID NO: 1301807 - protein, 9 aa, Homo Sapiens
PVPTATAAS

SEQ ID NO: 1301808 - protein, 9 aa, Homo Sapiens
FYRDCFTLH

SEQ ID NO: 1301809 - protein, 9 aa, Homo Sapiens
SSPTKCEIC

SEQ ID NO: 1301810 - protein, 9 aa, Homo Sapiens
NLQALIFLN

SEQ ID NO: 1301811 - protein, 9 aa, Homo Sapiens
VVVQHLLDG

SEQ ID NO: 1301812 - protein, 9 aa, Homo Sapiens
EFRNRLPGE

SEQ ID NO: 1301813 - protein, 9 aa, Homo Sapiens
HPLPQLLGP

SEQ ID NO: 1301814 - protein, 9 aa, Homo Sapiens
IKALKMKLG

SEQ ID NO: 1301815 - protein, 9 aa, Homo Sapiens
SWEIVMETL

SEQ ID NO: 1301816 - protein, 9 aa, Homo Sapiens
RFANTLLAN

SEQ ID NO: 1301817 - protein, 9 aa, Homo Sapiens
SVPCLITDC

SEQ ID NO: 1301818 - protein, 9 aa, Homo Sapiens
LTTVSQVTE

SEQ ID NO: 1301819 - protein, 9 aa, Homo Sapiens
SEGLVGLMG

SEQ ID NO: 1301820 - protein, 9 aa, Homo Sapiens
VSSMQFAKD

SEQ ID NO: 1301821 - protein, 9 aa, Homo Sapiens
PMCRRWTWA

SEQ ID NO: 1301822 - protein, 9 aa, Homo Sapiens
AHGESSLAS

SEQ ID NO: 1301823 - protein, 9 aa, Homo Sapiens
APSAGRTSA

SEQ ID NO: 1301824 - protein, 9 aa, Homo Sapiens
HSLKKNPVM

SEQ ID NO: 1301825 - protein, 9 aa, Homo Sapiens
ITPPQSGKK

SEQ ID NO: 1301826 - protein, 9 aa, Homo Sapiens
QQLAEIEAH

SEQ ID NO: 1301827 - protein, 9 aa, Homo Sapiens
RAEHQRLKS

SEQ ID NO: 1301828 - protein, 9 aa, Homo Sapiens
SENARSPPQ

SEQ ID NO: 1301829 - protein, 9 aa, Homo Sapiens
PENDLFDRL

SEQ ID NO: 1301830 - protein, 9 aa, Homo Sapiens
PALSTPKTM

SEQ ID NO: 1301831 - protein, 9 aa, Homo Sapiens
AVGLSLARL

SEQ ID NO: 1301832 - protein, 9 aa, Homo Sapiens
TWDQFLVVG

SEQ ID NO: 1301833 - protein, 9 aa, Homo Sapiens
AWEHACQDI

SEQ ID NO: 1301834 - protein, 9 aa, Homo Sapiens
PTWRRTGAS

SEQ ID NO: 1301835 - protein, 9 aa, Homo Sapiens
GQSLNVYSQ

SEQ ID NO: 1301836 - protein, 9 aa, Homo Sapiens
NKRQTPQSV

SEQ ID NO: 1301837 - protein, 9 aa, Homo Sapiens
SAPTAAKPS

SEQ ID NO: 1301838 - protein, 9 aa, Homo Sapiens
SHQVLKAIF

SEQ ID NO: 1301839 - protein, 9 aa, Homo Sapiens
IREDCEPPI

SEQ ID NO: 1301840 - protein, 9 aa, Homo Sapiens
HQRLKSQDL

SEQ ID NO: 1301841 - protein, 9 aa, Homo Sapiens
GLILDISAL

SEQ ID NO: 1301842 - protein, 9 aa, Homo Sapiens
TRGRPRWCC

SEQ ID NO: 1301843 - protein, 9 aa, Homo Sapiens
DGKWFETWD

SEQ ID NO: 1301844 - protein, 9 aa, Homo Sapiens
SRPFAYVEG

SEQ ID NO: 1301845 - protein, 9 aa, Homo Sapiens
IKQGSDVYD

SEQ ID NO: 1301846 - protein, 9 aa, Homo Sapiens
KRPTRKNSG

SEQ ID NO: 1301847 - protein, 9 aa, Homo Sapiens
QSWEIVMET

SEQ ID NO: 1301848 - protein, 9 aa, Homo Sapiens
ELRAEHQRL

SEQ ID NO: 1301849 - protein, 9 aa, Homo Sapiens
SFSKESGKN

SEQ ID NO: 1301850 - protein, 9 aa, Homo Sapiens
EMKTFVSSE

SEQ ID NO: 1301851 - protein, 9 aa, Homo Sapiens
CSCCSTHGG

SEQ ID NO: 1301852 - protein, 9 aa, Homo Sapiens
QCHGELDSM

SEQ ID NO: 1301853 - protein, 9 aa, Homo Sapiens
STSILQVLL

SEQ ID NO: 1301854 - protein, 9 aa, Homo Sapiens
QVLKAIFAV

SEQ ID NO: 1301855 - protein, 9 aa, Homo Sapiens
QRAQRPRRH

SEQ ID NO: 1301856 - protein, 9 aa, Homo Sapiens
YDPRIRPNL

SEQ ID NO: 1301857 - protein, 9 aa, Homo Sapiens
RRQPRPPGG

SEQ ID NO: 1301858 - protein, 9 aa, Homo Sapiens
QLQERTGCT

SEQ ID NO: 1301859 - protein, 9 aa, Homo Sapiens
RDQDLCRGP

SEQ ID NO: 1301860 - protein, 9 aa, Homo Sapiens
WAFLLRQVG

SEQ ID NO: 1301861 - protein, 9 aa, Homo Sapiens
SGTAPSAVP

SEQ ID NO: 1301862 - protein, 9 aa, Homo Sapiens
PFWLLSLAS

SEQ ID NO: 1301863 - protein, 9 aa, Homo Sapiens
GLPADRALG

SEQ ID NO: 1301864 - protein, 9 aa, Homo Sapiens
SSDEPTTTF

SEQ ID NO: 1301865 - protein, 9 aa, Homo Sapiens
PDLRQKLQG

SEQ ID NO: 1301866 - protein, 9 aa, Homo Sapiens
RSPSLQENE

SEQ ID NO: 1301867 - protein, 9 aa, Homo Sapiens
TLWNLYSPV

SEQ ID NO: 1301868 - protein, 9 aa, Homo Sapiens
CIPDPMGLS

SEQ ID NO: 1301869 - protein, 9 aa, Homo Sapiens
ARSPTSSPT

SEQ ID NO: 1301870 - protein, 9 aa, Homo Sapiens
DGVCFTKQE

SEQ ID NO: 1301871 - protein, 9 aa, Homo Sapiens
KRKQRAVSV

SEQ ID NO: 1301872 - protein, 9 aa, Homo Sapiens
PQELQLLPA

SEQ ID NO: 1301873 - protein, 9 aa, Homo Sapiens
RRHEPEFRQ

SEQ ID NO: 1301874 - protein, 9 aa, Homo Sapiens
RGFFFAGVL

SEQ ID NO: 1301875 - protein, 9 aa, Homo Sapiens
LLPRALPSL

SEQ ID NO: 1301876 - protein, 9 aa, Homo Sapiens
QEFPAVGLE

SEQ ID NO: 1301877 - protein, 9 aa, Homo Sapiens
QYLTTVSQV

SEQ ID NO: 1301878 - protein, 9 aa, Homo Sapiens
WFYRDCFTL

SEQ ID NO: 1301879 - protein, 9 aa, Homo Sapiens
ADACVRLSG

SEQ ID NO: 1301880 - protein, 9 aa, Homo Sapiens
NHGEEQARL

SEQ ID NO: 1301881 - protein, 9 aa, Homo Sapiens
ITTLAGWDG

SEQ ID NO: 1301882 - protein, 9 aa, Homo Sapiens
TRPRLLFSL

SEQ ID NO: 1301883 - protein, 9 aa, Homo Sapiens
PFFFYPICT

SEQ ID NO: 1301884 - protein, 9 aa, Homo Sapiens
STVDLKKLQ

SEQ ID NO: 1301885 - protein, 9 aa, Homo Sapiens
DQSLLTVAH

SEQ ID NO: 1301886 - protein, 9 aa, Homo Sapiens
LQRRRQPRP

SEQ ID NO: 1301887 - protein, 9 aa, Homo Sapiens
GFDGELWGY

SEQ ID NO: 1301888 - protein, 9 aa, Homo Sapiens
LSNRQPRRT

SEQ ID NO: 1301889 - protein, 9 aa, Homo Sapiens
ESSLASSQA

SEQ ID NO: 1301890 - protein, 9 aa, Homo Sapiens
AGSMLGMPS

SEQ ID NO: 1301891 - protein, 9 aa, Homo Sapiens
YRGDCYTRL

SEQ ID NO: 1301892 - protein, 9 aa, Homo Sapiens
GWTSPNSSL

SEQ ID NO: 1301893 - protein, 9 aa, Homo Sapiens
LQGFDGELW

SEQ ID NO: 1301894 - protein, 9 aa, Homo Sapiens
CLVFLVIYK

SEQ ID NO: 1301895 - protein, 9 aa, Homo Sapiens
CWYENHNIS

SEQ ID NO: 1301896 - protein, 9 aa, Homo Sapiens
TGVGLQRRE

SEQ ID NO: 1301897 - protein, 9 aa, Homo Sapiens
DPALLVPHA

SEQ ID NO: 1301898 - protein, 9 aa, Homo Sapiens
ARRRTWWRT

SEQ ID NO: 1301899 - protein, 9 aa, Homo Sapiens
QNCQRRDRQ

SEQ ID NO: 1301900 - protein, 9 aa, Homo Sapiens
CTSPMCRRW

SEQ ID NO: 1301901 - protein, 9 aa, Homo Sapiens
ELQPGQPPF

SEQ ID NO: 1301902 - protein, 9 aa, Homo Sapiens
CHIHRIPFR

SEQ ID NO: 1301903 - protein, 9 aa, Homo Sapiens
KLQHTMNVP

SEQ ID NO: 1301904 - protein, 9 aa, Homo Sapiens
SAQPWRRRG

SEQ ID NO: 1301905 - protein, 9 aa, Homo Sapiens
HEHIKIIHG

SEQ ID NO: 1301906 - protein, 9 aa, Homo Sapiens
LAGWDGLLS

SEQ ID NO: 1301907 - protein, 9 aa, Homo Sapiens
RRDSWPTRR

SEQ ID NO: 1301908 - protein, 9 aa, Homo Sapiens
YTCQVENPP

SEQ ID NO: 1301909 - protein, 9 aa, Homo Sapiens
TSGTAPSAV

SEQ ID NO: 1301910 - protein, 9 aa, Homo Sapiens
GWQQSWEIV

SEQ ID NO: 1301911 - protein, 9 aa, Homo Sapiens
DLDFDLSSN

SEQ ID NO: 1301912 - protein, 9 aa, Homo Sapiens
RVGQLREAL

SEQ ID NO: 1301913 - protein, 9 aa, Homo Sapiens
GSCPGPGAV

SEQ ID NO: 1301914 - protein, 9 aa, Homo Sapiens
DFRYFCMEK

SEQ ID NO: 1301915 - protein, 9 aa, Homo Sapiens
KSLYTLWNL

SEQ ID NO: 1301916 - protein, 9 aa, Homo Sapiens
LEKDIAMKM

SEQ ID NO: 1301917 - protein, 9 aa, Homo Sapiens
EAERRAQRV

SEQ ID NO: 1301918 - protein, 9 aa, Homo Sapiens
QLLPGGELL

SEQ ID NO: 1301919 - protein, 9 aa, Homo Sapiens
QERTGCTAP

SEQ ID NO: 1301920 - protein, 9 aa, Homo Sapiens
LQIQEKSTM

SEQ ID NO: 1301921 - protein, 9 aa, Homo Sapiens
DCEPPIALG

SEQ ID NO: 1301922 - protein, 9 aa, Homo Sapiens
MGPLLAMLS

SEQ ID NO: 1301923 - protein, 9 aa, Homo Sapiens
ACSILPSWL

SEQ ID NO: 1301924 - protein, 9 aa, Homo Sapiens
AAQRAQRPR

SEQ ID NO: 1301925 - protein, 9 aa, Homo Sapiens
FQDVSSMQF

SEQ ID NO: 1301926 - protein, 9 aa, Homo Sapiens
MGCEIFIGK

SEQ ID NO: 1301927 - protein, 9 aa, Homo Sapiens
LIPQTTAWF

SEQ ID NO: 1301928 - protein, 9 aa, Homo Sapiens
NVRTQSYSF

SEQ ID NO: 1301929 - protein, 9 aa, Homo Sapiens
PSQPAVPWQ

SEQ ID NO: 1301930 - protein, 9 aa, Homo Sapiens
AWFYRDCFT

SEQ ID NO: 1301931 - protein, 9 aa, Homo Sapiens
PDQELSSTR

SEQ ID NO: 1301932 - protein, 9 aa, Homo Sapiens
GPPGTVGPL

SEQ ID NO: 1301933 - protein, 9 aa, Homo Sapiens
SLYTLWNLY

SEQ ID NO: 1301934 - protein, 9 aa, Homo Sapiens
NTLLKCHLL

SEQ ID NO: 1301935 - protein, 9 aa, Homo Sapiens
QLLGPPPPH

SEQ ID NO: 1301936 - protein, 9 aa, Homo Sapiens
SPETHRAQE

SEQ ID NO: 1301937 - protein, 9 aa, Homo Sapiens
DGLHHVAAA

SEQ ID NO: 1301938 - protein, 9 aa, Homo Sapiens
LGGKEEFVV

SEQ ID NO: 1301939 - protein, 9 aa, Homo Sapiens
FGKALRMSW

SEQ ID NO: 1301940 - protein, 9 aa, Homo Sapiens
SSYYRASPW

SEQ ID NO: 1301941 - protein, 9 aa, Homo Sapiens
YFVYCHIHR

SEQ ID NO: 1301942 - protein, 9 aa, Homo Sapiens
EASDQSLLT

SEQ ID NO: 1301943 - protein, 9 aa, Homo Sapiens
RLKHSLTTY

SEQ ID NO: 1301944 - protein, 9 aa, Homo Sapiens
KCEECDKDF

SEQ ID NO: 1301945 - protein, 9 aa, Homo Sapiens
AAAALQHQL

SEQ ID NO: 1301946 - protein, 9 aa, Homo Sapiens
SGARVEAVA

SEQ ID NO: 1301947 - protein, 9 aa, Homo Sapiens
QQHQAEEDD

SEQ ID NO: 1301948 - protein, 9 aa, Homo Sapiens
SAVPSVARP

SEQ ID NO: 1301949 - protein, 9 aa, Homo Sapiens
AVPDQELSS

SEQ ID NO: 1301950 - protein, 9 aa, Homo Sapiens
VKHSLLSAR

SEQ ID NO: 1301951 - protein, 9 aa, Homo Sapiens
ATPAQAQAD

SEQ ID NO: 1301952 - protein, 9 aa, Homo Sapiens
APGGAGPME

SEQ ID NO: 1301953 - protein, 9 aa, Homo Sapiens
SDAWVKAEV

SEQ ID NO: 1301954 - protein, 9 aa, Homo Sapiens
PRSPSPRSS

SEQ ID NO: 1301955 - protein, 9 aa, Homo Sapiens
ILPSWLPTA

SEQ ID NO: 1301956 - protein, 9 aa, Homo Sapiens
SSCSRPSSS

SEQ ID NO: 1301957 - protein, 9 aa, Homo Sapiens
RRTWWRTRA

SEQ ID NO: 1301958 - protein, 9 aa, Homo Sapiens
GELLHPSQR

SEQ ID NO: 1301959 - protein, 9 aa, Homo Sapiens
MDLMEPRLI

SEQ ID NO: 1301960 - protein, 9 aa, Homo Sapiens
QAQGAEAER

SEQ ID NO: 1301961 - protein, 9 aa, Homo Sapiens
PGPGAVPDQ

SEQ ID NO: 1301962 - protein, 9 aa, Homo Sapiens
RRTGASTPA

SEQ ID NO: 1301963 - protein, 9 aa, Homo Sapiens
PAYFVYCHI

SEQ ID NO: 1301964 - protein, 9 aa, Homo Sapiens
PWSASSSCS

SEQ ID NO: 1301965 - protein, 9 aa, Homo Sapiens
LITPPQSGK

SEQ ID NO: 1301966 - protein, 9 aa, Homo Sapiens
FEIHVHRHP

SEQ ID NO: 1301967 - protein, 9 aa, Homo Sapiens
IPDPMGLSF

SEQ ID NO: 1301968 - protein, 9 aa, Homo Sapiens
LSQWSLRSP

SEQ ID NO: 1301969 - protein, 9 aa, Homo Sapiens
TSPMCRRWT

SEQ ID NO: 1301970 - protein, 9 aa, Homo Sapiens
LSVVSESIP

SEQ ID NO: 1301971 - protein, 9 aa, Homo Sapiens
GSGGTRMRG

SEQ ID NO: 1301972 - protein, 9 aa, Homo Sapiens
RRRQPRPPG

SEQ ID NO: 1301973 - protein, 9 aa, Homo Sapiens
LVKVAEAQK

SEQ ID NO: 1301974 - protein, 9 aa, Homo Sapiens
PVRPAAQCQ

SEQ ID NO: 1301975 - protein, 9 aa, Homo Sapiens
PDTWIVIDG

SEQ ID NO: 1301976 - protein, 9 aa, Homo Sapiens
IAVSTRPRL

SEQ ID NO: 1301977 - protein, 9 aa, Homo Sapiens
ERHSGAGAV

SEQ ID NO: 1301978 - protein, 9 aa, Homo Sapiens
PASVKHSLL

SEQ ID NO: 1301979 - protein, 9 aa, Homo Sapiens
LAECTLIHL

SEQ ID NO: 1301980 - protein, 9 aa, Homo Sapiens
LITDCTYRW

SEQ ID NO: 1301981 - protein, 9 aa, Homo Sapiens
GGADACVRL

SEQ ID NO: 1301982 - protein, 9 aa, Homo Sapiens
PRIRGGDPA

SEQ ID NO: 1301983 - protein, 9 aa, Homo Sapiens
SELGGRGAA

SEQ ID NO: 1301984 - protein, 9 aa, Homo Sapiens
STMESGEST

SEQ ID NO: 1301985 - protein, 9 aa, Homo Sapiens
RAAIWRRIG

SEQ ID NO: 1301986 - protein, 9 aa, Homo Sapiens
PASGPSPAR

SEQ ID NO: 1301987 - protein, 9 aa, Homo Sapiens
RWMSCESIL

SEQ ID NO: 1301988 - protein, 9 aa, Homo Sapiens
RCSGARVEA

SEQ ID NO: 1301989 - protein, 9 aa, Homo Sapiens
TGGGPACVP

SEQ ID NO: 1301990 - protein, 9 aa, Homo Sapiens
EDPALLVPH

SEQ ID NO: 1301991 - protein, 9 aa, Homo Sapiens
SSFSSTKSF

SEQ ID NO: 1301992 - protein, 9 aa, Homo Sapiens
GIIQGTSRS

SEQ ID NO: 1301993 - protein, 9 aa, Homo Sapiens
GNEEKCPEE

SEQ ID NO: 1301994 - protein, 9 aa, Homo Sapiens
SGLITPPQS

SEQ ID NO: 1301995 - protein, 9 aa, Homo Sapiens
QSMMFGNDM

SEQ ID NO: 1301996 - protein, 9 aa, Homo Sapiens
AVMGASQTT

SEQ ID NO: 1301997 - protein, 9 aa, Homo Sapiens
AEAERRAQR

SEQ ID NO: 1301998 - protein, 9 aa, Homo Sapiens
WPACSILPS

SEQ ID NO: 1301999 - protein, 9 aa, Homo Sapiens
IPLMKKPTK

SEQ ID NO: 1302000 - protein, 9 aa, Homo Sapiens
NYDIRDRAH

SEQ ID NO: 1302001 - protein, 9 aa, Homo Sapiens
VVQIFQIMR

SEQ ID NO: 1302002 - protein, 9 aa, Homo Sapiens
LLAMLSNTQ

SEQ ID NO: 1302003 - protein, 9 aa, Homo Sapiens
APETRTDPQ

SEQ ID NO: 1302004 - protein, 9 aa, Homo Sapiens
RIPFRMGLY

SEQ ID NO: 1302005 - protein, 9 aa, Homo Sapiens
ASAQPWRRR

SEQ ID NO: 1302006 - protein, 9 aa, Homo Sapiens
QRSLSLTRA

SEQ ID NO: 1302007 - protein, 9 aa, Homo Sapiens
FWLALQAGP

SEQ ID NO: 1302008 - protein, 9 aa, Homo Sapiens
SSGQSLNVY

SEQ ID NO: 1302009 - protein, 9 aa, Homo Sapiens
PSVARPSTT

SEQ ID NO: 1302010 - protein, 9 aa, Homo Sapiens
FLQKDCSYL

SEQ ID NO: 1302011 - protein, 9 aa, Homo Sapiens
NDNSLWISV

SEQ ID NO: 1302012 - protein, 9 aa, Homo Sapiens
DPVSLDFPL

SEQ ID NO: 1302013 - protein, 9 aa, Homo Sapiens
HFLQPRSDS

SEQ ID NO: 1302014 - protein, 9 aa, Homo Sapiens
LASKFLQQS

SEQ ID NO: 1302015 - protein, 9 aa, Homo Sapiens
KDVEDWAFL

SEQ ID NO: 1302016 - protein, 9 aa, Homo Sapiens
PSPKPHGLQ

SEQ ID NO: 1302017 - protein, 9 aa, Homo Sapiens
RLVREIVQD

SEQ ID NO: 1302018 - protein, 9 aa, Homo Sapiens
EIKALKMKL

SEQ ID NO: 1302019 - protein, 9 aa, Homo Sapiens
LDLRVPSIS

SEQ ID NO: 1302020 - protein, 9 aa, Homo Sapiens
CSLMEQIPH

SEQ ID NO: 1302021 - protein, 9 aa, Homo Sapiens
GGGGGGVDA

SEQ ID NO: 1302022 - protein, 9 aa, Homo Sapiens
CIANTHLNR

SEQ ID NO: 1302023 - protein, 9 aa, Homo Sapiens
ATSATSARR

SEQ ID NO: 1302024 - protein, 9 aa, Homo Sapiens
KELRRFQAL

SEQ ID NO: 1302025 - protein, 9 aa, Homo Sapiens
MSCESILLG

SEQ ID NO: 1302026 - protein, 9 aa, Homo Sapiens
IAMKMRLRA

SEQ ID NO: 1302027 - protein, 9 aa, Homo Sapiens
RGITLLCRL

SEQ ID NO: 1302028 - protein, 9 aa, Homo Sapiens
SKRHPIFGD

SEQ ID NO: 1302029 - protein, 9 aa, Homo Sapiens
FARSSRWFQ

SEQ ID NO: 1302030 - protein, 9 aa, Homo Sapiens
KRCIANTHL

SEQ ID NO: 1302031 - protein, 9 aa, Homo Sapiens
WVELMKMHT

SEQ ID NO: 1302032 - protein, 9 aa, Homo Sapiens
RAAAQRAQR

SEQ ID NO: 1302033 - protein, 9 aa, Homo Sapiens
EAVASLGPP

SEQ ID NO: 1302034 - protein, 9 aa, Homo Sapiens
FVSLQCQKE

SEQ ID NO: 1302035 - protein, 9 aa, Homo Sapiens
KLLCQESVT

SEQ ID NO: 1302036 - protein, 9 aa, Homo Sapiens
ENKQPENDL

SEQ ID NO: 1302037 - protein, 9 aa, Homo Sapiens
PTAARPSAT

SEQ ID NO: 1302038 - protein, 9 aa, Homo Sapiens
EAEQIISDH

SEQ ID NO: 1302039 - protein, 9 aa, Homo Sapiens
GAVGLSLAR

SEQ ID NO: 1302040 - protein, 9 aa, Homo Sapiens
SDPRNPPRK

SEQ ID NO: 1302041 - protein, 9 aa, Homo Sapiens
KSRGDGAKF

SEQ ID NO: 1302042 - protein, 9 aa, Homo Sapiens
LHVELAGRV

SEQ ID NO: 1302043 - protein, 9 aa, Homo Sapiens
ELEELRAEH

SEQ ID NO: 1302044 - protein, 9 aa, Homo Sapiens
GYLVTKVVV

SEQ ID NO: 1302045 - protein, 9 aa, Homo Sapiens
LRPPHLPSC

SEQ ID NO: 1302046 - protein, 9 aa, Homo Sapiens
RHLPLLTWQ

SEQ ID NO: 1302047 - protein, 9 aa, Homo Sapiens
SNHSKQSSN

SEQ ID NO: 1302048 - protein, 9 aa, Homo Sapiens
ASSSYYRAS

SEQ ID NO: 1302049 - protein, 9 aa, Homo Sapiens
SVVSESIPA

SEQ ID NO: 1302050 - protein, 9 aa, Homo Sapiens
GRGAAGPAW

SEQ ID NO: 1302051 - protein, 9 aa, Homo Sapiens
KDPEAEHPR

SEQ ID NO: 1302052 - protein, 9 aa, Homo Sapiens
GAKFPELVI

SEQ ID NO: 1302053 - protein, 9 aa, Homo Sapiens
GTVGPLGLR

SEQ ID NO: 1302054 - protein, 9 aa, Homo Sapiens
ADYHTRWSG

SEQ ID NO: 1302055 - protein, 9 aa, Homo Sapiens
CTCSESPDC

SEQ ID NO: 1302056 - protein, 9 aa, Homo Sapiens
TPKTMRNLK

SEQ ID NO: 1302057 - protein, 9 aa, Homo Sapiens
TRLFSPLIP

SEQ ID NO: 1302058 - protein, 9 aa, Homo Sapiens
HLHVELAGR

SEQ ID NO: 1302059 - protein, 9 aa, Homo Sapiens
TPGSGPSPA

SEQ ID NO: 1302060 - protein, 9 aa, Homo Sapiens
PPFRRESSA

SEQ ID NO: 1302061 - protein, 9 aa, Homo Sapiens
FQRLVREIV

SEQ ID NO: 1302062 - protein, 9 aa, Homo Sapiens
PIADYHTRW

SEQ ID NO: 1302063 - protein, 9 aa, Homo Sapiens
WFFTSPAST

SEQ ID NO: 1302064 - protein, 9 aa, Homo Sapiens
QIISDHFSD

SEQ ID NO: 1302065 - protein, 9 aa, Homo Sapiens
FDLSSNSES

SEQ ID NO: 1302066 - protein, 9 aa, Homo Sapiens
LRDQDLCRG

SEQ ID NO: 1302067 - protein, 9 aa, Homo Sapiens
SPSLQENEP

SEQ ID NO: 1302068 - protein, 9 aa, Homo Sapiens
LGLRPPHLP

SEQ ID NO: 1302069 - protein, 9 aa, Homo Sapiens
KRERMMLPV

SEQ ID NO: 1302070 - protein, 9 aa, Homo Sapiens
LPEASDQSL

SEQ ID NO: 1302071 - protein, 9 aa, Homo Sapiens
GGGGGVDAA

SEQ ID NO: 1302072 - protein, 9 aa, Homo Sapiens
EPTATRKVP

SEQ ID NO: 1302073 - protein, 9 aa, Homo Sapiens
HRGDTSTPP

SEQ ID NO: 1302074 - protein, 9 aa, Homo Sapiens
PLRGLPLSQ

SEQ ID NO: 1302075 - protein, 9 aa, Homo Sapiens
DPHKMTLWF

SEQ ID NO: 1302076 - protein, 9 aa, Homo Sapiens
GAISRTDTE

SEQ ID NO: 1302077 - protein, 9 aa, Homo Sapiens
THSLANLDT

SEQ ID NO: 1302078 - protein, 9 aa, Homo Sapiens
QELQLLPAP

SEQ ID NO: 1302079 - protein, 9 aa, Homo Sapiens
LEIKALKMK

SEQ ID NO: 1302080 - protein, 9 aa, Homo Sapiens
QHQAEEDDA

SEQ ID NO: 1302081 - protein, 9 aa, Homo Sapiens
LPTAMGPLL

SEQ ID NO: 1302082 - protein, 9 aa, Homo Sapiens
TATTSWCSA

SEQ ID NO: 1302083 - protein, 9 aa, Homo Sapiens
MQLHPVAGS

SEQ ID NO: 1302084 - protein, 9 aa, Homo Sapiens
VHHLQVDEG

SEQ ID NO: 1302085 - protein, 9 aa, Homo Sapiens
PSLQENEPT

SEQ ID NO: 1302086 - protein, 9 aa, Homo Sapiens
IPFRMGLYT

SEQ ID NO: 1302087 - protein, 9 aa, Homo Sapiens
RLVGDESEG

SEQ ID NO: 1302088 - protein, 9 aa, Homo Sapiens
SRQSRSPSL

SEQ ID NO: 1302089 - protein, 9 aa, Homo Sapiens
LLSLASSSY

SEQ ID NO: 1302090 - protein, 9 aa, Homo Sapiens
TTTFVVCNE

SEQ ID NO: 1302091 - protein, 9 aa, Homo Sapiens
VRGGQGTPG

SEQ ID NO: 1302092 - protein, 9 aa, Homo Sapiens
ISLKHQVQS

SEQ ID NO: 1302093 - protein, 9 aa, Homo Sapiens
DTRHESLFS

SEQ ID NO: 1302094 - protein, 9 aa, Homo Sapiens
SLCSVMAPL

SEQ ID NO: 1302095 - protein, 9 aa, Homo Sapiens
GDCYTRLFS

SEQ ID NO: 1302096 - protein, 9 aa, Homo Sapiens
VEAVASLGP

SEQ ID NO: 1302097 - protein, 9 aa, Homo Sapiens
TPARSPTSA

SEQ ID NO: 1302098 - protein, 9 aa, Homo Sapiens
IMFDPHKMT

SEQ ID NO: 1302099 - protein, 9 aa, Homo Sapiens
MEKIPLHRF

SEQ ID NO: 1302100 - protein, 9 aa, Homo Sapiens
AAAQRAQRP

SEQ ID NO: 1302101 - protein, 9 aa, Homo Sapiens
LSPRLARRV

SEQ ID NO: 1302102 - protein, 9 aa, Homo Sapiens
IPQTTAWFY

SEQ ID NO: 1302103 - protein, 9 aa, Homo Sapiens
NGLILDISA

SEQ ID NO: 1302104 - protein, 9 aa, Homo Sapiens
ISPTRRPLW

SEQ ID NO: 1302105 - protein, 9 aa, Homo Sapiens
VYDAQTYDV

SEQ ID NO: 1302106 - protein, 9 aa, Homo Sapiens
LGVSDLLVL

SEQ ID NO: 1302107 - protein, 9 aa, Homo Sapiens
AAGASGWSA

SEQ ID NO: 1302108 - protein, 9 aa, Homo Sapiens
QENEPTATR

SEQ ID NO: 1302109 - protein, 9 aa, Homo Sapiens
EGEPGIRGV

SEQ ID NO: 1302110 - protein, 9 aa, Homo Sapiens
ARVGRDAQV

SEQ ID NO: 1302111 - protein, 9 aa, Homo Sapiens
KKLQVKELK

SEQ ID NO: 1302112 - protein, 9 aa, Homo Sapiens
DAWVKAEVL

SEQ ID NO: 1302113 - protein, 9 aa, Homo Sapiens
EGMLLPRAL

SEQ ID NO: 1302114 - protein, 9 aa, Homo Sapiens
TTRRDSWPT

SEQ ID NO: 1302115 - protein, 9 aa, Homo Sapiens
PTRRPLWSI

SEQ ID NO: 1302116 - protein, 9 aa, Homo Sapiens
SPRAAIWRR

SEQ ID NO: 1302117 - protein, 9 aa, Homo Sapiens
RSSLPLLRD

SEQ ID NO: 1302118 - protein, 9 aa, Homo Sapiens
RIASPPSDF

SEQ ID NO: 1302119 - protein, 9 aa, Homo Sapiens
VSFLILGYR

SEQ ID NO: 1302120 - protein, 9 aa, Homo Sapiens
GLVGLMGPV

SEQ ID NO: 1302121 - protein, 9 aa, Homo Sapiens
PINVSSLVN

SEQ ID NO: 1302122 - protein, 9 aa, Homo Sapiens
ILQVLLKAF

SEQ ID NO: 1302123 - protein, 9 aa, Homo Sapiens
GLIWGRRRA

SEQ ID NO: 1302124 - protein, 9 aa, Homo Sapiens
PRPPPLVRC

SEQ ID NO: 1302125 - protein, 9 aa, Homo Sapiens
PVLRVCSSC

SEQ ID NO: 1302126 - protein, 9 aa, Homo Sapiens
TIPPPKAMQ

SEQ ID NO: 1302127 - protein, 9 aa, Homo Sapiens
CSQCVKGFS

SEQ ID NO: 1302128 - protein, 9 aa, Homo Sapiens
RKVRSLLGE

SEQ ID NO: 1302129 - protein, 9 aa, Homo Sapiens
SRSPSLQEN

SEQ ID NO: 1302130 - protein, 9 aa, Homo Sapiens
AAHMQVGGH

SEQ ID NO: 1302131 - protein, 9 aa, Homo Sapiens
AQRVGARVG

SEQ ID NO: 1302132 - protein, 9 aa, Homo Sapiens
VPTATAASA

SEQ ID NO: 1302133 - protein, 9 aa, Homo Sapiens
EGRAAAQRA

SEQ ID NO: 1302134 - protein, 9 aa, Homo Sapiens
AHGPIGPPG

SEQ ID NO: 1302135 - protein, 9 aa, Homo Sapiens
LPSDPRNPP

SEQ ID NO: 1302136 - protein, 9 aa, Homo Sapiens
EKIPLHRFL

SEQ ID NO: 1302137 - protein, 9 aa, Homo Sapiens
TTFHDKGSL

SEQ ID NO: 1302138 - protein, 9 aa, Homo Sapiens
SVPSSGYRA

SEQ ID NO: 1302139 - protein, 9 aa, Homo Sapiens
CRASRAPCR

SEQ ID NO: 1302140 - protein, 9 aa, Homo Sapiens
CEICVKRRR

SEQ ID NO: 1302141 - protein, 9 aa, Homo Sapiens
WQLWHRELQ

SEQ ID NO: 1302142 - protein, 9 aa, Homo Sapiens
AGRTSARRR

SEQ ID NO: 1302143 - protein, 9 aa, Homo Sapiens
LVTKVVVVD

SEQ ID NO: 1302144 - protein, 9 aa, Homo Sapiens
KLQVKELKK

SEQ ID NO: 1302145 - protein, 9 aa, Homo Sapiens
GGRGAAGPA

SEQ ID NO: 1302146 - protein, 9 aa, Homo Sapiens
PGQPPFRRE

SEQ ID NO: 1302147 - protein, 9 aa, Homo Sapiens
ASLSCSGII

SEQ ID NO: 1302148 - protein, 9 aa, Homo Sapiens
PAPSQLPAS

SEQ ID NO: 1302149 - protein, 9 aa, Homo Sapiens
HMLVQRRVH

SEQ ID NO: 1302150 - protein, 9 aa, Homo Sapiens
DEGLGPDLR

SEQ ID NO: 1302151 - protein, 9 aa, Homo Sapiens
FFYPICTSW

SEQ ID NO: 1302152 - protein, 9 aa, Homo Sapiens
GAAGTRCRA

SEQ ID NO: 1302153 - protein, 9 aa, Homo Sapiens
SRMPARRES

SEQ ID NO: 1302154 - protein, 9 aa, Homo Sapiens
WDQFLVVGA

SEQ ID NO: 1302155 - protein, 9 aa, Homo Sapiens
LPQTSLQLL

SEQ ID NO: 1302156 - protein, 9 aa, Homo Sapiens
RQPRPPGGG

SEQ ID NO: 1302157 - protein, 9 aa, Homo Sapiens
SVFELLSFI

SEQ ID NO: 1302158 - protein, 9 aa, Homo Sapiens
SRSPVPKKR

SEQ ID NO: 1302159 - protein, 9 aa, Homo Sapiens
FGCLVFLVI

SEQ ID NO: 1302160 - protein, 9 aa, Homo Sapiens
TLLKCHLLQ

SEQ ID NO: 1302161 - protein, 9 aa, Homo Sapiens
RHPIFGDFL

SEQ ID NO: 1302162 - protein, 9 aa, Homo Sapiens
RRRGLTLFF

SEQ ID NO: 1302163 - protein, 9 aa, Homo Sapiens
GEVPVVDDP

SEQ ID NO: 1302164 - protein, 9 aa, Homo Sapiens
ASSSCSRPS

SEQ ID NO: 1302165 - protein, 9 aa, Homo Sapiens
KCPEEDMEG

SEQ ID NO: 1302166 - protein, 9 aa, Homo Sapiens
LSGHILDLD

SEQ ID NO: 1302167 - protein, 9 aa, Homo Sapiens
IGEEVRRYQ

SEQ ID NO: 1302168 - protein, 9 aa, Homo Sapiens
EVAAPEVLQ

SEQ ID NO: 1302169 - protein, 9 aa, Homo Sapiens
SWDQDGKWF

SEQ ID NO: 1302170 - protein, 9 aa, Homo Sapiens
NLKMRIWYI

SEQ ID NO: 1302171 - protein, 9 aa, Homo Sapiens
AEEDDAQER

SEQ ID NO: 1302172 - protein, 9 aa, Homo Sapiens
PHGAAGLRC

SEQ ID NO: 1302173 - protein, 9 aa, Homo Sapiens
ALPQGRAPL

SEQ ID NO: 1302174 - protein, 9 aa, Homo Sapiens
EGAAGTRCR

SEQ ID NO: 1302175 - protein, 9 aa, Homo Sapiens
EWRLPSPRR

SEQ ID NO: 1302176 - protein, 9 aa, Homo Sapiens
THSSEIVRF

SEQ ID NO: 1302177 - protein, 9 aa, Homo Sapiens
SQTTKRPSL

SEQ ID NO: 1302178 - protein, 9 aa, Homo Sapiens
TSTPPCSSF

SEQ ID NO: 1302179 - protein, 9 aa, Homo Sapiens
RLGVQPAAV

SEQ ID NO: 1302180 - protein, 9 aa, Homo Sapiens
YYLFSLGVS

SEQ ID NO: 1302181 - protein, 9 aa, Homo Sapiens
LKHQVQSMK

SEQ ID NO: 1302182 - protein, 9 aa, Homo Sapiens
PPEMGCEIF

SEQ ID NO: 1302183 - protein, 9 aa, Homo Sapiens
DCFTLHQVL

SEQ ID NO: 1302184 - protein, 9 aa, Homo Sapiens
SPTSSPTAR

SEQ ID NO: 1302185 - protein, 9 aa, Homo Sapiens
VAEASTGAW

SEQ ID NO: 1302186 - protein, 9 aa, Homo Sapiens
HKARAAEEP

SEQ ID NO: 1302187 - protein, 9 aa, Homo Sapiens
KVFNRRTHL

SEQ ID NO: 1302188 - protein, 9 aa, Homo Sapiens
TRCSYEGQE

SEQ ID NO: 1302189 - protein, 9 aa, Homo Sapiens
AFEIHVHRH

SEQ ID NO: 1302190 - protein, 9 aa, Homo Sapiens
APTAAKPSA

SEQ ID NO: 1302191 - protein, 9 aa, Homo Sapiens
QTGTCRSTL

SEQ ID NO: 1302192 - protein, 9 aa, Homo Sapiens
SSTATTSWC

SEQ ID NO: 1302193 - protein, 9 aa, Homo Sapiens
GGGPACVPV

SEQ ID NO: 1302194 - protein, 9 aa, Homo Sapiens
QNPVPLRGL

SEQ ID NO: 1302195 - protein, 9 aa, Homo Sapiens
KSLEQKKKR

SEQ ID NO: 1302196 - protein, 9 aa, Homo Sapiens
CRTGASTRA

SEQ ID NO: 1302197 - protein, 9 aa, Homo Sapiens
IFLNISRNQ

SEQ ID NO: 1302198 - protein, 9 aa, Homo Sapiens
AGGAVYEQP

SEQ ID NO: 1302199 - protein, 9 aa, Homo Sapiens
ALRDQCPAV

SEQ ID NO: 1302200 - protein, 9 aa, Homo Sapiens
RVVCSCCST

SEQ ID NO: 1302201 - protein, 9 aa, Homo Sapiens
RPSSSATSA

SEQ ID NO: 1302202 - protein, 9 aa, Homo Sapiens
LAMLSNTQS

SEQ ID NO: 1302203 - protein, 9 aa, Homo Sapiens
AEGTSLVAA

SEQ ID NO: 1302204 - protein, 9 aa, Homo Sapiens
RVVQIFQIM

SEQ ID NO: 1302205 - protein, 9 aa, Homo Sapiens
VGAGTGGGP

SEQ ID NO: 1302206 - protein, 9 aa, Homo Sapiens
ARSSRWFQF

SEQ ID NO: 1302207 - protein, 9 aa, Homo Sapiens
GDTSTPPCS

SEQ ID NO: 1302208 - protein, 9 aa, Homo Sapiens
KKEALKMPR

SEQ ID NO: 1302209 - protein, 9 aa, Homo Sapiens
SESPDCHWC

SEQ ID NO: 1302210 - protein, 9 aa, Homo Sapiens
FNRRTHLLC

SEQ ID NO: 1302211 - protein, 9 aa, Homo Sapiens
PADRALGEV

SEQ ID NO: 1302212 - protein, 9 aa, Homo Sapiens
ALQPGEKKS

SEQ ID NO: 1302213 - protein, 9 aa, Homo Sapiens
VPCTSPMCR

SEQ ID NO: 1302214 - protein, 9 aa, Homo Sapiens
RHHPRGPPP

SEQ ID NO: 1302215 - protein, 9 aa, Homo Sapiens
WLITTFHDK

SEQ ID NO: 1302216 - protein, 9 aa, Homo Sapiens
IPGAHGPIG

SEQ ID NO: 1302217 - protein, 9 aa, Homo Sapiens
QSRSPVPKK

SEQ ID NO: 1302218 - protein, 9 aa, Homo Sapiens
ALQHQLQDA

SEQ ID NO: 1302219 - protein, 9 aa, Homo Sapiens
NDLFDRLNT

SEQ ID NO: 1302220 - protein, 9 aa, Homo Sapiens
PHLPSCHPL

SEQ ID NO: 1302221 - protein, 9 aa, Homo Sapiens
GPRLPSQPA

SEQ ID NO: 1302222 - protein, 9 aa, Homo Sapiens
GGLIWGRRR

SEQ ID NO: 1302223 - protein, 9 aa, Homo Sapiens
SPVPKKRER

SEQ ID NO: 1302224 - protein, 9 aa, Homo Sapiens
KVAEAQKNR

SEQ ID NO: 1302225 - protein, 9 aa, Homo Sapiens
AHGGGDDEG

SEQ ID NO: 1302226 - protein, 9 aa, Homo Sapiens
RGESELGGR

SEQ ID NO: 1302227 - protein, 9 aa, Homo Sapiens
CDDPHFQAS

SEQ ID NO: 1302228 - protein, 9 aa, Homo Sapiens
VEKELRRFQ

SEQ ID NO: 1302229 - protein, 9 aa, Homo Sapiens
PSITSSGQS

SEQ ID NO: 1302230 - protein, 9 aa, Homo Sapiens
HIHRIPFRP

SEQ ID NO: 1302231 - protein, 9 aa, Homo Sapiens
SPGGQNTRS

SEQ ID NO: 1302232 - protein, 9 aa, Homo Sapiens
RSLLGEIFV

SEQ ID NO: 1302233 - protein, 9 aa, Homo Sapiens
LQTGTCRST

SEQ ID NO: 1302234 - protein, 9 aa, Homo Sapiens
GVSLKGEEG

SEQ ID NO: 1302235 - protein, 9 aa, Homo Sapiens
VNWALSVWR

SEQ ID NO: 1302236 - protein, 9 aa, Homo Sapiens
IRNVLMDTS

SEQ ID NO: 1302237 - protein, 9 aa, Homo Sapiens
QAGPPGTVG

SEQ ID NO: 1302238 - protein, 9 aa, Homo Sapiens
HRFLLSNRQ

SEQ ID NO: 1302239 - protein, 9 aa, Homo Sapiens
VELAGRVGG

SEQ ID NO: 1302240 - protein, 9 aa, Homo Sapiens
TRKVPWKRK

SEQ ID NO: 1302241 - protein, 9 aa, Homo Sapiens
PETRCSYEG

SEQ ID NO: 1302242 - protein, 9 aa, Homo Sapiens
LGMPSPPVL

SEQ ID NO: 1302243 - protein, 9 aa, Homo Sapiens
ISTRDPLSK

SEQ ID NO: 1302244 - protein, 9 aa, Homo Sapiens
LDVEGERHS

SEQ ID NO: 1302245 - protein, 9 aa, Homo Sapiens
LKHSLTTYK

SEQ ID NO: 1302246 - protein, 9 aa, Homo Sapiens
GGWTSPNSS

SEQ ID NO: 1302247 - protein, 9 aa, Homo Sapiens
KLPSDPRNP

SEQ ID NO: 1302248 - protein, 9 aa, Homo Sapiens
RSPPQLLFS

SEQ ID NO: 1302249 - protein, 9 aa, Homo Sapiens
GSCPRPGAV

SEQ ID NO: 1302250 - protein, 9 aa, Homo Sapiens
WKRKQRAVS

SEQ ID NO: 1302251 - protein, 9 aa, Homo Sapiens
SLQCQKEDL

SEQ ID NO: 1302252 - protein, 9 aa, Homo Sapiens
KECGEAFNQ

SEQ ID NO: 1302253 - protein, 9 aa, Homo Sapiens
HHVAAAALQ

SEQ ID NO: 1302254 - protein, 9 aa, Homo Sapiens
EDESKWVEL

SEQ ID NO: 1302255 - protein, 9 aa, Homo Sapiens
ERKSLYTLW

SEQ ID NO: 1302256 - protein, 9 aa, Homo Sapiens
EKCPEEDME

SEQ ID NO: 1302257 - protein, 9 aa, Homo Sapiens
VFELLSFIS

SEQ ID NO: 1302258 - protein, 9 aa, Homo Sapiens
ASVKHSLLS

SEQ ID NO: 1302259 - protein, 9 aa, Homo Sapiens
RTARSALPQ

SEQ ID NO: 1302260 - protein, 9 aa, Homo Sapiens
AAGLRCGKT

SEQ ID NO: 1302261 - protein, 9 aa, Homo Sapiens
YTLWNLYSP

SEQ ID NO: 1302262 - protein, 9 aa, Homo Sapiens
LGPPPPHQA

SEQ ID NO: 1302263 - protein, 9 aa, Homo Sapiens
SHRQEKPSE

SEQ ID NO: 1302264 - protein, 9 aa, Homo Sapiens
WRGQKKRCI

SEQ ID NO: 1302265 - protein, 9 aa, Homo Sapiens
TRRPLWSIW

SEQ ID NO: 1302266 - protein, 9 aa, Homo Sapiens
YPICTSWHC

SEQ ID NO: 1302267 - protein, 9 aa, Homo Sapiens
YYQNVRTQS

SEQ ID NO: 1302268 - protein, 9 aa, Homo Sapiens
EAHRQEREK

SEQ ID NO: 1302269 - protein, 9 aa, Homo Sapiens
PENGIAPIT

SEQ ID NO: 1302270 - protein, 9 aa, Homo Sapiens
IQYIFPPGV

SEQ ID NO: 1302271 - protein, 9 aa, Homo Sapiens
TKQEWENLE

SEQ ID NO: 1302272 - protein, 9 aa, Homo Sapiens
STGAWTAEG

SEQ ID NO: 1302273 - protein, 9 aa, Homo Sapiens
AMGPLLAML

SEQ ID NO: 1302274 - protein, 9 aa, Homo Sapiens
GRVAAHMQV

SEQ ID NO: 1302275 - protein, 9 aa, Homo Sapiens
QELVRASRA

SEQ ID NO: 1302276 - protein, 9 aa, Homo Sapiens
SQSRSPVPK

SEQ ID NO: 1302277 - protein, 9 aa, Homo Sapiens
LRPMKRSRS

SEQ ID NO: 1302278 - protein, 9 aa, Homo Sapiens
KDGQWLQGM

SEQ ID NO: 1302279 - protein, 9 aa, Homo Sapiens
AQERDEAHG

SEQ ID NO: 1302280 - protein, 9 aa, Homo Sapiens
ASSLKSSIS

SEQ ID NO: 1302281 - protein, 9 aa, Homo Sapiens
IMTLIPMTA

SEQ ID NO: 1302282 - protein, 9 aa, Homo Sapiens
EICVKRRRR

SEQ ID NO: 1302283 - protein, 9 aa, Homo Sapiens
SSTLYIMTL

SEQ ID NO: 1302284 - protein, 9 aa, Homo Sapiens
EGTSLVAAR

SEQ ID NO: 1302285 - protein, 9 aa, Homo Sapiens
QKDCSYLSR

SEQ ID NO: 1302286 - protein, 9 aa, Homo Sapiens
GGGGVDAAG

SEQ ID NO: 1302287 - protein, 9 aa, Homo Sapiens
AGLAVHRGD

SEQ ID NO: 1302288 - protein, 9 aa, Homo Sapiens
IWRRIGATT

SEQ ID NO: 1302289 - protein, 9 aa, Homo Sapiens
APPNEVHPL

SEQ ID NO: 1302290 - protein, 9 aa, Homo Sapiens
YQRQLLLGL

SEQ ID NO: 1302291 - protein, 9 aa, Homo Sapiens
GLQIQEKST

SEQ ID NO: 1302292 - protein, 9 aa, Homo Sapiens
KQQHQAEED

SEQ ID NO: 1302293 - protein, 9 aa, Homo Sapiens
DGLLPLEET

SEQ ID NO: 1302294 - protein, 9 aa, Homo Sapiens
SFARSSRWF

SEQ ID NO: 1302295 - protein, 9 aa, Homo Sapiens
GGRHLPLLT

SEQ ID NO: 1302296 - protein, 9 aa, Homo Sapiens
GPLGLRPPH

SEQ ID NO: 1302297 - protein, 9 aa, Homo Sapiens
TNMPDEGIM

SEQ ID NO: 1302298 - protein, 9 aa, Homo Sapiens
APLEGMLLP

SEQ ID NO: 1302299 - protein, 9 aa, Homo Sapiens
ELLSFISSF

SEQ ID NO: 1302300 - protein, 9 aa, Homo Sapiens
ISSVSMPLN

SEQ ID NO: 1302301 - protein, 9 aa, Homo Sapiens
SSYVGSSLD

SEQ ID NO: 1302302 - protein, 9 aa, Homo Sapiens
PAVMGASQT

SEQ ID NO: 1302303 - protein, 9 aa, Homo Sapiens
AQRAQRPRR

SEQ ID NO: 1302304 - protein, 9 aa, Homo Sapiens
LHTRGRPRW

SEQ ID NO: 1302305 - protein, 9 aa, Homo Sapiens
GARGGLGLV

SEQ ID NO: 1302306 - protein, 9 aa, Homo Sapiens
ATSGTAPSA

SEQ ID NO: 1302307 - protein, 9 aa, Homo Sapiens
CQRRDRQTH

SEQ ID NO: 1302308 - protein, 9 aa, Homo Sapiens
KCWYENHNI

SEQ ID NO: 1302309 - protein, 9 aa, Homo Sapiens
RHGAGQQGS

SEQ ID NO: 1302310 - protein, 9 aa, Homo Sapiens
HCTCSESPD

SEQ ID NO: 1302311 - protein, 9 aa, Homo Sapiens
MHLVVRPGL

SEQ ID NO: 1302312 - protein, 9 aa, Homo Sapiens
ITLTHSSEI

SEQ ID NO: 1302313 - protein, 9 aa, Homo Sapiens
DEGLDVEGE

SEQ ID NO: 1302314 - protein, 9 aa, Homo Sapiens
FMENKQPEN

SEQ ID NO: 1302315 - protein, 9 aa, Homo Sapiens
NIAVIPIIK

SEQ ID NO: 1302316 - protein, 9 aa, Homo Sapiens
EALKMPRNP

SEQ ID NO: 1302317 - protein, 9 aa, Homo Sapiens
HPKEKPFDC

SEQ ID NO: 1302318 - protein, 9 aa, Homo Sapiens
DSPSVIFDN

SEQ ID NO: 1302319 - protein, 9 aa, Homo Sapiens
LSSNSESSS

SEQ ID NO: 1302320 - protein, 9 aa, Homo Sapiens
CVVALHFLQ

SEQ ID NO: 1302321 - protein, 9 aa, Homo Sapiens
RGLTLFFVS

SEQ ID NO: 1302322 - protein, 9 aa, Homo Sapiens
EFVVTTEST

SEQ ID NO: 1302323 - protein, 9 aa, Homo Sapiens
SSTKSFARS

SEQ ID NO: 1302324 - protein, 9 aa, Homo Sapiens
AAGPRVVCS

SEQ ID NO: 1302325 - protein, 9 aa, Homo Sapiens
QLLIPRSPS

SEQ ID NO: 1302326 - protein, 9 aa, Homo Sapiens
VEDWAFLLR

SEQ ID NO: 1302327 - protein, 9 aa, Homo Sapiens
EVTSPQSGR

SEQ ID NO: 1302328 - protein, 9 aa, Homo Sapiens
QRVGARVGT

SEQ ID NO: 1302329 - protein, 9 aa, Homo Sapiens
SRPSSSATS

SEQ ID NO: 1302330 - protein, 9 aa, Homo Sapiens
RGPFWLLSL

SEQ ID NO: 1302331 - protein, 9 aa, Homo Sapiens
EKTLPQTSL

SEQ ID NO: 1302332 - protein, 9 aa, Homo Sapiens
LCRGPRLPS

SEQ ID NO: 1302333 - protein, 9 aa, Homo Sapiens
QAVRGKEKE

SEQ ID NO: 1302334 - protein, 9 aa, Homo Sapiens
KVGMKLEAM

SEQ ID NO: 1302335 - protein, 9 aa, Homo Sapiens
FVYCHIHRI

SEQ ID NO: 1302336 - protein, 9 aa, Homo Sapiens
VLIHLHTVR

SEQ ID NO: 1302337 - protein, 9 aa, Homo Sapiens
RVGTEVTGV

SEQ ID NO: 1302338 - protein, 9 aa, Homo Sapiens
TNYYLFSLG

SEQ ID NO: 1302339 - protein, 9 aa, Homo Sapiens
VDAAGPRVV

SEQ ID NO: 1302340 - protein, 9 aa, Homo Sapiens
VSSEAISPD

SEQ ID NO: 1302341 - protein, 9 aa, Homo Sapiens
WVTFSGKLC

SEQ ID NO: 1302342 - protein, 9 aa, Homo Sapiens
PAWASLGSC

SEQ ID NO: 1302343 - protein, 9 aa, Homo Sapiens
LNGIHFDPE

SEQ ID NO: 1302344 - protein, 9 aa, Homo Sapiens
LAEIEAHRQ

SEQ ID NO: 1302345 - protein, 9 aa, Homo Sapiens
KDGEALKCW

SEQ ID NO: 1302346 - protein, 9 aa, Homo Sapiens
KGLRGFFFA

SEQ ID NO: 1302347 - protein, 9 aa, Homo Sapiens
SPTARATSG

SEQ ID NO: 1302348 - protein, 9 aa, Homo Sapiens
TVDLKKLQV

SEQ ID NO: 1302349 - protein, 9 aa, Homo Sapiens
ALESPETHR

SEQ ID NO: 1302350 - protein, 9 aa, Homo Sapiens
LSLASSSYY

SEQ ID NO: 1302351 - protein, 9 aa, Homo Sapiens
EALKCWYEN

SEQ ID NO: 1302352 - protein, 9 aa, Homo Sapiens
FANTLLANS

SEQ ID NO: 1302353 - protein, 9 aa, Homo Sapiens
VQDFKTDLR

SEQ ID NO: 1302354 - protein, 9 aa, Homo Sapiens
STRASGPTP

SEQ ID NO: 1302355 - protein, 9 aa, Homo Sapiens
YEQPLGLEC

SEQ ID NO: 1302356 - protein, 9 aa, Homo Sapiens
DVEDWAFLL

SEQ ID NO: 1302357 - protein, 9 aa, Homo Sapiens
VEGERHSGA

SEQ ID NO: 1302358 - protein, 9 aa, Homo Sapiens
VTKDPASVK

SEQ ID NO: 1302359 - protein, 9 aa, Homo Sapiens
QEARLKRQE

SEQ ID NO: 1302360 - protein, 9 aa, Homo Sapiens
YLTPEIILS

SEQ ID NO: 1302361 - protein, 9 aa, Homo Sapiens
KDIAMKMRL

SEQ ID NO: 1302362 - protein, 9 aa, Homo Sapiens
ESELGGRGA

SEQ ID NO: 1302363 - protein, 9 aa, Homo Sapiens
QAEEDDAQE

SEQ ID NO: 1302364 - protein, 9 aa, Homo Sapiens
RRRRGVGQA

SEQ ID NO: 1302365 - protein, 9 aa, Homo Sapiens
GQLREALNE

SEQ ID NO: 1302366 - protein, 9 aa, Homo Sapiens
VRFANTLLA

SEQ ID NO: 1302367 - protein, 9 aa, Homo Sapiens
LRFGGPETR

SEQ ID NO: 1302368 - protein, 9 aa, Homo Sapiens
WGWQQSWEI

SEQ ID NO: 1302369 - protein, 9 aa, Homo Sapiens
LHFLQPRSD

SEQ ID NO: 1302370 - protein, 9 aa, Homo Sapiens
TGASTPARS

SEQ ID NO: 1302371 - protein, 9 aa, Homo Sapiens
FRNRLPGEE

SEQ ID NO: 1302372 - protein, 9 aa, Homo Sapiens
ELLHPSQRL

SEQ ID NO: 1302373 - protein, 9 aa, Homo Sapiens
GSSPAGAKW

SEQ ID NO: 1302374 - protein, 9 aa, Homo Sapiens
LTRVEKELR

SEQ ID NO: 1302375 - protein, 9 aa, Homo Sapiens
WSASCGPTS

SEQ ID NO: 1302376 - protein, 9 aa, Homo Sapiens
TIAFSVLNS

SEQ ID NO: 1302377 - protein, 9 aa, Homo Sapiens
LVNPFFFYP

SEQ ID NO: 1302378 - protein, 9 aa, Homo Sapiens
DSWPTRRST

SEQ ID NO: 1302379 - protein, 9 aa, Homo Sapiens
MMFGNDMSR

SEQ ID NO: 1302380 - protein, 9 aa, Homo Sapiens
TSLCSVMAP

SEQ ID NO: 1302381 - protein, 9 aa, Homo Sapiens
LHEHIKIIH

SEQ ID NO: 1302382 - protein, 9 aa, Homo Sapiens
QPVYRKAIY

SEQ ID NO: 1302383 - protein, 9 aa, Homo Sapiens
HPVTWDQFL

SEQ ID NO: 1302384 - protein, 9 aa, Homo Sapiens
LYRTGRSYL

SEQ ID NO: 1302385 - protein, 9 aa, Homo Sapiens
KAKKAARAK

SEQ ID NO: 1302386 - protein, 9 aa, Homo Sapiens
HSSEIVRFQ

SEQ ID NO: 1302387 - protein, 9 aa, Homo Sapiens
LCRIVDSKY

SEQ ID NO: 1302388 - protein, 9 aa, Homo Sapiens
SPVFDMEKI

SEQ ID NO: 1302389 - protein, 9 aa, Homo Sapiens
KVPWKRKQR

SEQ ID NO: 1302390 - protein, 9 aa, Homo Sapiens
APTVVVQHL

SEQ ID NO: 1302391 - protein, 9 aa, Homo Sapiens
MMVLYIHIS

SEQ ID NO: 1302392 - protein, 9 aa, Homo Sapiens
VVQHLLDGL

SEQ ID NO: 1302393 - protein, 9 aa, Homo Sapiens
IFVSCCVVA

SEQ ID NO: 1302394 - protein, 9 aa, Homo Sapiens
LPQGRAPLE

SEQ ID NO: 1302395 - protein, 9 aa, Homo Sapiens
CCSTHGGLI

SEQ ID NO: 1302396 - protein, 9 aa, Homo Sapiens
EDRSHGEHS

SEQ ID NO: 1302397 - protein, 9 aa, Homo Sapiens
RRHGAGQQG

SEQ ID NO: 1302398 - protein, 9 aa, Homo Sapiens
ENFWQDSVS

SEQ ID NO: 1302399 - protein, 9 aa, Homo Sapiens
TTALSPEAT

SEQ ID NO: 1302400 - protein, 9 aa, Homo Sapiens
VPWKRKQRA

SEQ ID NO: 1302401 - protein, 9 aa, Homo Sapiens
CRSTLRPMK

SEQ ID NO: 1302402 - protein, 9 aa, Homo Sapiens
WWRTRACTP

SEQ ID NO: 1302403 - protein, 9 aa, Homo Sapiens
TEKGIPASP

SEQ ID NO: 1302404 - protein, 9 aa, Homo Sapiens
VLNLTVLWM

SEQ ID NO: 1302405 - protein, 9 aa, Homo Sapiens
DGDLPSLQS

SEQ ID NO: 1302406 - protein, 9 aa, Homo Sapiens
DSQRPVPHP

SEQ ID NO: 1302407 - protein, 9 aa, Homo Sapiens
FGGWTSPNS

SEQ ID NO: 1302408 - protein, 9 aa, Homo Sapiens
VAAPEVLQD

SEQ ID NO: 1302409 - protein, 9 aa, Homo Sapiens
PVPHPLNKL

SEQ ID NO: 1302410 - protein, 9 aa, Homo Sapiens
LALQAGPPG

SEQ ID NO: 1302411 - protein, 9 aa, Homo Sapiens
YTWMVPLTF

SEQ ID NO: 1302412 - protein, 9 aa, Homo Sapiens
LESPETHRA

SEQ ID NO: 1302413 - protein, 9 aa, Homo Sapiens
PKKEALKMP

SEQ ID NO: 1302414 - protein, 9 aa, Homo Sapiens
GQAQGAEAE

SEQ ID NO: 1302415 - protein, 9 aa, Homo Sapiens
ETSLCSVMA

SEQ ID NO: 1302416 - protein, 9 aa, Homo Sapiens
HLPLLTWQL

SEQ ID NO: 1302417 - protein, 9 aa, Homo Sapiens
ARLKRQEQR

SEQ ID NO: 1302418 - protein, 9 aa, Homo Sapiens
IAVRFANTL

SEQ ID NO: 1302419 - protein, 9 aa, Homo Sapiens
KSTMESGES

SEQ ID NO: 1302420 - protein, 9 aa, Homo Sapiens
PCRPPPVPA

SEQ ID NO: 1302421 - protein, 9 aa, Homo Sapiens
DPHFQASSS

SEQ ID NO: 1302422 - protein, 9 aa, Homo Sapiens
KVFRIASPP

SEQ ID NO: 1302423 - protein, 9 aa, Homo Sapiens
SASSTATTS

SEQ ID NO: 1302424 - protein, 9 aa, Homo Sapiens
SLNPWGTMA

SEQ ID NO: 1302425 - protein, 9 aa, Homo Sapiens
SKFLQQSVQ

SEQ ID NO: 1302426 - protein, 9 aa, Homo Sapiens
GTEVTGVGL

SEQ ID NO: 1302427 - protein, 9 aa, Homo Sapiens
HGAGQQGSV

SEQ ID NO: 1302428 - protein, 9 aa, Homo Sapiens
APSQLPASS

SEQ ID NO: 1302429 - protein, 9 aa, Homo Sapiens
AVPSVARPS

SEQ ID NO: 1302430 - protein, 9 aa, Homo Sapiens
PIEAPPPST

SEQ ID NO: 1302431 - protein, 9 aa, Homo Sapiens
IHGYAEKKF

SEQ ID NO: 1302432 - protein, 9 aa, Homo Sapiens
VDSPQDPVS

SEQ ID NO: 1302433 - protein, 9 aa, Homo Sapiens
SPSPRSSLP

SEQ ID NO: 1302434 - protein, 9 aa, Homo Sapiens
MRGESELGG

SEQ ID NO: 1302435 - protein, 9 aa, Homo Sapiens
VSACVRLGV

SEQ ID NO: 1302436 - protein, 9 aa, Homo Sapiens
APCPPLEVH

SEQ ID NO: 1302437 - protein, 9 aa, Homo Sapiens
EIVRFQKNL

SEQ ID NO: 1302438 - protein, 9 aa, Homo Sapiens
PVCKIVNWA

SEQ ID NO: 1302439 - protein, 9 aa, Homo Sapiens
DGPASETTA

SEQ ID NO: 1302440 - protein, 9 aa, Homo Sapiens
HARTHPKEK

SEQ ID NO: 1302441 - protein, 9 aa, Homo Sapiens
LLVPHACCG

SEQ ID NO: 1302442 - protein, 9 aa, Homo Sapiens
TDTENLLRL

SEQ ID NO: 1302443 - protein, 9 aa, Homo Sapiens
QSSTLYIMT

SEQ ID NO: 1302444 - protein, 9 aa, Homo Sapiens
HQGPSCSFP

SEQ ID NO: 1302445 - protein, 9 aa, Homo Sapiens
RESRFWLAL

SEQ ID NO: 1302446 - protein, 9 aa, Homo Sapiens
LRVPSISFR

SEQ ID NO: 1302447 - protein, 9 aa, Homo Sapiens
GRQAPTVVV

SEQ ID NO: 1302448 - protein, 9 aa, Homo Sapiens
AGPRVVCSC

SEQ ID NO: 1302449 - protein, 9 aa, Homo Sapiens
PTARATSGT

SEQ ID NO: 1302450 - protein, 9 aa, Homo Sapiens
GYRAVTASK

SEQ ID NO: 1302451 - protein, 9 aa, Homo Sapiens
GAGTGGGPA

SEQ ID NO: 1302452 - protein, 9 aa, Homo Sapiens
TKSFARSSR

SEQ ID NO: 1302453 - protein, 9 aa, Homo Sapiens
GPPPPHQAP

SEQ ID NO: 1302454 - protein, 9 aa, Homo Sapiens
MAQMCTFCG

SEQ ID NO: 1302455 - protein, 9 aa, Homo Sapiens
NDGVCFTKQ

SEQ ID NO: 1302456 - protein, 9 aa, Homo Sapiens
YKKGAQVSF

SEQ ID NO: 1302457 - protein, 9 aa, Homo Sapiens
ETLSGAEGT

SEQ ID NO: 1302458 - protein, 9 aa, Homo Sapiens
TSAPTAAKP

SEQ ID NO: 1302459 - protein, 9 aa, Homo Sapiens
DLDVVLCVA

SEQ ID NO: 1302460 - protein, 9 aa, Homo Sapiens
ARVGQLREA

SEQ ID NO: 1302461 - protein, 9 aa, Homo Sapiens
DSPPLRHHP

SEQ ID NO: 1302462 - protein, 9 aa, Homo Sapiens
EDLKGKKRQ

SEQ ID NO: 1302463 - protein, 9 aa, Homo Sapiens
MPIADYHTR

SEQ ID NO: 1302464 - protein, 9 aa, Homo Sapiens
TAEGAAGTR

SEQ ID NO: 1302465 - protein, 9 aa, Homo Sapiens
TGTCRSTLR

SEQ ID NO: 1302466 - protein, 9 aa, Homo Sapiens
DTFIKKSES

SEQ ID NO: 1302467 - protein, 9 aa, Homo Sapiens
MGASQTTKR

SEQ ID NO: 1302468 - protein, 9 aa, Homo Sapiens
SSGQIFQHL

SEQ ID NO: 1302469 - protein, 9 aa, Homo Sapiens
IPAYFVYCH

SEQ ID NO: 1302470 - protein, 9 aa, Homo Sapiens
KANGSNKRQ

SEQ ID NO: 1302471 - protein, 9 aa, Homo Sapiens
KTVRTATPS

SEQ ID NO: 1302472 - protein, 9 aa, Homo Sapiens
MVPLTFVSL

SEQ ID NO: 1302473 - protein, 9 aa, Homo Sapiens
PVVDDPGRN

SEQ ID NO: 1302474 - protein, 9 aa, Homo Sapiens
IAIEVNGLI

SEQ ID NO: 1302475 - protein, 9 aa, Homo Sapiens
GESTSTGSR

SEQ ID NO: 1302476 - protein, 9 aa, Homo Sapiens
LRAEHQRLK

SEQ ID NO: 1302477 - protein, 9 aa, Homo Sapiens
RKLPSDPRN

SEQ ID NO: 1302478 - protein, 9 aa, Homo Sapiens
TCDDPHFQA

SEQ ID NO: 1302479 - protein, 9 aa, Homo Sapiens
SISSVSMPL

SEQ ID NO: 1302480 - protein, 9 aa, Homo Sapiens
QTPQSVFEL

SEQ ID NO: 1302481 - protein, 9 aa, Homo Sapiens
CRRWTWAST

SEQ ID NO: 1302482 - protein, 9 aa, Homo Sapiens
GPMELMFAE

SEQ ID NO: 1302483 - protein, 9 aa, Homo Sapiens
AEHQRLKSQ

SEQ ID NO: 1302484 - protein, 9 aa, Homo Sapiens
SASASPSIR

SEQ ID NO: 1302485 - protein, 9 aa, Homo Sapiens
VVLYLGVAH

SEQ ID NO: 1302486 - protein, 9 aa, Homo Sapiens
GDPAPGGAG

SEQ ID NO: 1302487 - protein, 9 aa, Homo Sapiens
RAFKKLQHT

SEQ ID NO: 1302488 - protein, 9 aa, Homo Sapiens
PPCSSFGGW

SEQ ID NO: 1302489 - protein, 9 aa, Homo Sapiens
CPPLEVHLH

SEQ ID NO: 1302490 - protein, 9 aa, Homo Sapiens
KGKKRQHLH

SEQ ID NO: 1302491 - protein, 9 aa, Homo Sapiens
STAAWPRVP

SEQ ID NO: 1302492 - protein, 9 aa, Homo Sapiens
PSTTRRDSW

SEQ ID NO: 1302493 - protein, 9 aa, Homo Sapiens
LKCWYENHN

SEQ ID NO: 1302494 - protein, 9 aa, Homo Sapiens
VHSTPVRPA

SEQ ID NO: 1302495 - protein, 9 aa, Homo Sapiens
MRNLKQFSD

SEQ ID NO: 1302496 - protein, 9 aa, Homo Sapiens
HVAAAALQH

SEQ ID NO: 1302497 - protein, 9 aa, Homo Sapiens
RTATPSPWS

SEQ ID NO: 1302498 - protein, 9 aa, Homo Sapiens
VGMKLEAMD

SEQ ID NO: 1302499 - protein, 9 aa, Homo Sapiens
GEKTLPQTS

SEQ ID NO: 1302500 - protein, 9 aa, Homo Sapiens
CHPLPQLLG

SEQ ID NO: 1302501 - protein, 9 aa, Homo Sapiens
FRRESSALE

SEQ ID NO: 1302502 - protein, 9 aa, Homo Sapiens
TAAVRRRRG

SEQ ID NO: 1302503 - protein, 9 aa, Homo Sapiens
EQIISDHFS

SEQ ID NO: 1302504 - protein, 9 aa, Homo Sapiens
GSGPSPAPS

SEQ ID NO: 1302505 - protein, 9 aa, Homo Sapiens
HFTRQLIVP

SEQ ID NO: 1302506 - protein, 9 aa, Homo Sapiens
RGVSLKGEE

SEQ ID NO: 1302507 - protein, 9 aa, Homo Sapiens
CRKLPSDPR

SEQ ID NO: 1302508 - protein, 9 aa, Homo Sapiens
THPKEKPFD

SEQ ID NO: 1302509 - protein, 9 aa, Homo Sapiens
QGAHGESSL

SEQ ID NO: 1302510 - protein, 9 aa, Homo Sapiens
LRGLPLSQW

SEQ ID NO: 1302511 - protein, 9 aa, Homo Sapiens
LFSPLIPQT

SEQ ID NO: 1302512 - protein, 9 aa, Homo Sapiens
AKKKKKKEL

SEQ ID NO: 1302513 - protein, 9 aa, Homo Sapiens
PARRESRFW

SEQ ID NO: 1302514 - protein, 9 aa, Homo Sapiens
SYVGSSLDV

SEQ ID NO: 1302515 - protein, 9 aa, Homo Sapiens
SLHEHIKII

SEQ ID NO: 1302516 - protein, 9 aa, Homo Sapiens
LLCQESVTK

SEQ ID NO: 1302517 - protein, 9 aa, Homo Sapiens
RAPLEGMLL

SEQ ID NO: 1302518 - protein, 9 aa, Homo Sapiens
GPGHTAAPV

SEQ ID NO: 1302519 - protein, 9 aa, Homo Sapiens
PIFTSEQRE

SEQ ID NO: 1302520 - protein, 9 aa, Homo Sapiens
AAAASPRAA

SEQ ID NO: 1302521 - protein, 9 aa, Homo Sapiens
HQVQSMKQT

SEQ ID NO: 1302522 - protein, 9 aa, Homo Sapiens
DTSAKFKEL

SEQ ID NO: 1302523 - protein, 9 aa, Homo Sapiens
GEYHQTPLQ

SEQ ID NO: 1302524 - protein, 9 aa, Homo Sapiens
VELWLITTF

SEQ ID NO: 1302525 - protein, 9 aa, Homo Sapiens
ALAKWEEYQ

SEQ ID NO: 1302526 - protein, 9 aa, Homo Sapiens
ACVRLGVQP

SEQ ID NO: 1302527 - protein, 9 aa, Homo Sapiens
EHPRRCSGA

SEQ ID NO: 1302528 - protein, 9 aa, Homo Sapiens
KDGDLPSLQ

SEQ ID NO: 1302529 - protein, 9 aa, Homo Sapiens
ENEPTATRK

SEQ ID NO: 1302530 - protein, 9 aa, Homo Sapiens
PGSGPSPAP

SEQ ID NO: 1302531 - protein, 9 aa, Homo Sapiens
QPRPPGGGG

SEQ ID NO: 1302532 - protein, 9 aa, Homo Sapiens
TFHDKGSLT

SEQ ID NO: 1302533 - protein, 9 aa, Homo Sapiens
AEWRLPSPR

SEQ ID NO: 1302534 - protein, 9 aa, Homo Sapiens
NTRSTVKPH

SEQ ID NO: 1302535 - protein, 9 aa, Homo Sapiens
EPPPVGAGT

SEQ ID NO: 1302536 - protein, 9 aa, Homo Sapiens
DPRNPPRKA

SEQ ID NO: 1302537 - protein, 9 aa, Homo Sapiens
EHQRLKSQD

SEQ ID NO: 1302538 - protein, 9 aa, Homo Sapiens
HPRRCSGAR

SEQ ID NO: 1302539 - protein, 9 aa, Homo Sapiens
RPSLQTGTC

SEQ ID NO: 1302540 - protein, 9 aa, Homo Sapiens
ASSQISFGL

SEQ ID NO: 1302541 - protein, 9 aa, Homo Sapiens
PLTFVSLQC

SEQ ID NO: 1302542 - protein, 9 aa, Homo Sapiens
TVRTATPSP

SEQ ID NO: 1302543 - protein, 9 aa, Homo Sapiens
AKWEEYQRQ

SEQ ID NO: 1302544 - protein, 9 aa, Homo Sapiens
SPRRATLWI

SEQ ID NO: 1302545 - protein, 9 aa, Homo Sapiens
DLKGKKRQH

SEQ ID NO: 1302546 - protein, 9 aa, Homo Sapiens
QCVKGFSYN

SEQ ID NO: 1302547 - protein, 9 aa, Homo Sapiens
VGRVAAHMQ

SEQ ID NO: 1302548 - protein, 9 aa, Homo Sapiens
KITEQEKDF

SEQ ID NO: 1302549 - protein, 9 aa, Homo Sapiens
SVKHSLLSA

SEQ ID NO: 1302550 - protein, 9 aa, Homo Sapiens
PLNARLNGE

SEQ ID NO: 1302551 - protein, 9 aa, Homo Sapiens
KQEWENLED

SEQ ID NO: 1302552 - protein, 9 aa, Homo Sapiens
NPSSGQIFQ

SEQ ID NO: 1302553 - protein, 9 aa, Homo Sapiens
CFFLQKDCS

SEQ ID NO: 1302554 - protein, 9 aa, Homo Sapiens
TSGSTPGSG

SEQ ID NO: 1302555 - protein, 9 aa, Homo Sapiens
LSRMPARRE

SEQ ID NO: 1302556 - protein, 9 aa, Homo Sapiens
SARIPFRMG

SEQ ID NO: 1302557 - protein, 9 aa, Homo Sapiens
GLQKGIQCT

SEQ ID NO: 1302558 - protein, 9 aa, Homo Sapiens
KAARAKKAV

SEQ ID NO: 1302559 - protein, 9 aa, Homo Sapiens
LYSPVFDME

SEQ ID NO: 1302560 - protein, 9 aa, Homo Sapiens
PSPRRATLW

SEQ ID NO: 1302561 - protein, 9 aa, Homo Sapiens
GGGVDAAGP

SEQ ID NO: 1302562 - protein, 9 aa, Homo Sapiens
TRANSGDQD

SEQ ID NO: 1302563 - protein, 9 aa, Homo Sapiens
VSTRPRLLF

SEQ ID NO: 1302564 - protein, 9 aa, Homo Sapiens
FFFAGVLFS

SEQ ID NO: 1302565 - protein, 9 aa, Homo Sapiens
IRGVSLKGE

SEQ ID NO: 1302566 - protein, 9 aa, Homo Sapiens
ARGGLGLVS

SEQ ID NO: 1302567 - protein, 9 aa, Homo Sapiens
TATRKVPWK

SEQ ID NO: 1302568 - protein, 9 aa, Homo Sapiens
TVGPLGLRP

SEQ ID NO: 1302569 - protein, 9 aa, Homo Sapiens
IWGRRRAQA

SEQ ID NO: 1302570 - protein, 9 aa, Homo Sapiens
PPPVPAPSQ

SEQ ID NO: 1302571 - protein, 9 aa, Homo Sapiens
STPPCSSFG

SEQ ID NO: 1302572 - protein, 9 aa, Homo Sapiens
RCGKTGEYH

SEQ ID NO: 1302573 - protein, 9 aa, Homo Sapiens
PWNMAQMCT

SEQ ID NO: 1302574 - protein, 9 aa, Homo Sapiens
AFKKLQHTM

SEQ ID NO: 1302575 - protein, 9 aa, Homo Sapiens
LQVKELKKI

SEQ ID NO: 1302576 - protein, 9 aa, Homo Sapiens
QELSSTRGR

SEQ ID NO: 1302577 - protein, 9 aa, Homo Sapiens
QAGRQAPTV

SEQ ID NO: 1302578 - protein, 9 aa, Homo Sapiens
GLRPPHLPS

SEQ ID NO: 1302579 - protein, 9 aa, Homo Sapiens
RERMMLPVR

SEQ ID NO: 1302580 - protein, 9 aa, Homo Sapiens
KGAQVSFLI

SEQ ID NO: 1302581 - protein, 9 aa, Homo Sapiens
GELWGYAVQ

SEQ ID NO: 1302582 - protein, 9 aa, Homo Sapiens
VFDMEKIPL

SEQ ID NO: 1302583 - protein, 9 aa, Homo Sapiens
LVQRRVHHL

SEQ ID NO: 1302584 - protein, 9 aa, Homo Sapiens
LPADRALGE

SEQ ID NO: 1302585 - protein, 9 aa, Homo Sapiens
YCHIHRIPF

SEQ ID NO: 1302586 - protein, 9 aa, Homo Sapiens
ITAEVTSPQ

SEQ ID NO: 1302587 - protein, 9 aa, Homo Sapiens
PYLPLPEAT

SEQ ID NO: 1302588 - protein, 9 aa, Homo Sapiens
RPTRKNSGS

SEQ ID NO: 1302589 - protein, 9 aa, Homo Sapiens
MLSNTQSLN

SEQ ID NO: 1302590 - protein, 9 aa, Homo Sapiens
QALIFLNIS

SEQ ID NO: 1302591 - protein, 9 aa, Homo Sapiens
HGEEQARLW

SEQ ID NO: 1302592 - protein, 9 aa, Homo Sapiens
GGAGPMELM

SEQ ID NO: 1302593 - protein, 9 aa, Homo Sapiens
SLSCSGIIQ

SEQ ID NO: 1302594 - protein, 9 aa, Homo Sapiens
HLPEASDQS

SEQ ID NO: 1302595 - protein, 9 aa, Homo Sapiens
LPASSPTKC

SEQ ID NO: 1302596 - protein, 9 aa, Homo Sapiens
IVDPAVMGA

SEQ ID NO: 1302597 - protein, 9 aa, Homo Sapiens
ASLGPPWNM

SEQ ID NO: 1302598 - protein, 9 aa, Homo Sapiens
TEAEQIISD

SEQ ID NO: 1302599 - protein, 9 aa, Homo Sapiens
DSHRQEKPS

SEQ ID NO: 1302600 - protein, 9 aa, Homo Sapiens
LIPRSPSPR

SEQ ID NO: 1302601 - protein, 9 aa, Homo Sapiens
MLLPRALPS

SEQ ID NO: 1302602 - protein, 9 aa, Homo Sapiens
ANLDTFIKK

SEQ ID NO: 1302603 - protein, 9 aa, Homo Sapiens
DVVLCVALA

SEQ ID NO: 1302604 - protein, 9 aa, Homo Sapiens
EEDMVWRTD

SEQ ID NO: 1302605 - protein, 9 aa, Homo Sapiens
LQALYDTIN

SEQ ID NO: 1302606 - protein, 9 aa, Homo Sapiens
SCPGPGAVP

SEQ ID NO: 1302607 - protein, 9 aa, Homo Sapiens
DSQSENEDS

SEQ ID NO: 1302608 - protein, 9 aa, Homo Sapiens
STHGGLIWG

SEQ ID NO: 1302609 - protein, 9 aa, Homo Sapiens
RFLLSNRQP

SEQ ID NO: 1302610 - protein, 9 aa, Homo Sapiens
KIIHGYAEK

SEQ ID NO: 1302611 - protein, 9 aa, Homo Sapiens
SLASSSYYR

SEQ ID NO: 1302612 - protein, 9 aa, Homo Sapiens
GETTESTRC

SEQ ID NO: 1302613 - protein, 9 aa, Homo Sapiens
GSMLGMPSP

SEQ ID NO: 1302614 - protein, 9 aa, Homo Sapiens
KRNENFWQD

SEQ ID NO: 1302615 - protein, 9 aa, Homo Sapiens
VKDEPDSPV

SEQ ID NO: 1302616 - protein, 9 aa, Homo Sapiens
AGHGTCSPD

SEQ ID NO: 1302617 - protein, 9 aa, Homo Sapiens
VIDGAAIWT

SEQ ID NO: 1302618 - protein, 9 aa, Homo Sapiens
REIVQDFKT

SEQ ID NO: 1302619 - protein, 9 aa, Homo Sapiens
TGRSYLMNK

SEQ ID NO: 1302620 - protein, 9 aa, Homo Sapiens
PTKRPTRKN

SEQ ID NO: 1302621 - protein, 9 aa, Homo Sapiens
SVSMPLNAR

SEQ ID NO: 1302622 - protein, 9 aa, Homo Sapiens
QWSLRSPRT

SEQ ID NO: 1302623 - protein, 9 aa, Homo Sapiens
ATAASARSP

SEQ ID NO: 1302624 - protein, 9 aa, Homo Sapiens
TFQDVSSMQ

SEQ ID NO: 1302625 - protein, 9 aa, Homo Sapiens
QDPVSLDFP

SEQ ID NO: 1302626 - protein, 9 aa, Homo Sapiens
VRTEKGIPA

SEQ ID NO: 1302627 - protein, 9 aa, Homo Sapiens
GMKLEAMDL

SEQ ID NO: 1302628 - protein, 9 aa, Homo Sapiens
KTGEYHQTP

SEQ ID NO: 1302629 - protein, 9 aa, Homo Sapiens
PSATNPTWR

SEQ ID NO: 1302630 - protein, 9 aa, Homo Sapiens
PELQPGQPP

SEQ ID NO: 1302631 - protein, 9 aa, Homo Sapiens
DQELSSTRG

SEQ ID NO: 1302632 - protein, 9 aa, Homo Sapiens
LCLFQITTL

SEQ ID NO: 1302633 - protein, 9 aa, Homo Sapiens
GVSDLLVLL

SEQ ID NO: 1302634 - protein, 9 aa, Homo Sapiens
ATTSWCSAA

SEQ ID NO: 1302635 - protein, 9 aa, Homo Sapiens
PSCVPTAAR

SEQ ID NO: 1302636 - protein, 9 aa, Homo Sapiens
MPARRESRF

SEQ ID NO: 1302637 - protein, 9 aa, Homo Sapiens
PRSGTALIN

SEQ ID NO: 1302638 - protein, 9 aa, Homo Sapiens
DIQRRPLPW

SEQ ID NO: 1302639 - protein, 9 aa, Homo Sapiens
THEDKQNCQ

SEQ ID NO: 1302640 - protein, 9 aa, Homo Sapiens
RIRGGDPAP

SEQ ID NO: 1302641 - protein, 9 aa, Homo Sapiens
SKKQKSLEP

SEQ ID NO: 1302642 - protein, 9 aa, Homo Sapiens
MESGPGCTW

SEQ ID NO: 1302643 - protein, 9 aa, Homo Sapiens
PPAPTAPRP

SEQ ID NO: 1302644 - protein, 9 aa, Homo Sapiens
PDDLVILMR

SEQ ID NO: 1302645 - protein, 9 aa, Homo Sapiens
IWLLILSYV

SEQ ID NO: 1302646 - protein, 9 aa, Homo Sapiens
PMLRTALSN

SEQ ID NO: 1302647 - protein, 9 aa, Homo Sapiens
QSSDSVSVG

SEQ ID NO: 1302648 - protein, 9 aa, Homo Sapiens
ILHPMVQGD

SEQ ID NO: 1302649 - protein, 9 aa, Homo Sapiens
LYHVETKVD

SEQ ID NO: 1302650 - protein, 9 aa, Homo Sapiens
TTRENSSSP

SEQ ID NO: 1302651 - protein, 9 aa, Homo Sapiens
LARVIVNVG

SEQ ID NO: 1302652 - protein, 9 aa, Homo Sapiens
VSVGLCKGS

SEQ ID NO: 1302653 - protein, 9 aa, Homo Sapiens
MNSRKWRYK

SEQ ID NO: 1302654 - protein, 9 aa, Homo Sapiens
AQVLQHPWI

SEQ ID NO: 1302655 - protein, 9 aa, Homo Sapiens
TVSPLIMPN

SEQ ID NO: 1302656 - protein, 9 aa, Homo Sapiens
FMATANTTA

SEQ ID NO: 1302657 - protein, 9 aa, Homo Sapiens
GNWYRLLNS

SEQ ID NO: 1302658 - protein, 9 aa, Homo Sapiens
IMVVKAVEH

SEQ ID NO: 1302659 - protein, 9 aa, Homo Sapiens
PMKRSCPDV

SEQ ID NO: 1302660 - protein, 9 aa, Homo Sapiens
HIHLDHWLL

SEQ ID NO: 1302661 - protein, 9 aa, Homo Sapiens
RECMESGPG

SEQ ID NO: 1302662 - protein, 9 aa, Homo Sapiens
IWQFKRREC

SEQ ID NO: 1302663 - protein, 9 aa, Homo Sapiens
CHADPAHQL

SEQ ID NO: 1302664 - protein, 9 aa, Homo Sapiens
EPYTCDVCG

SEQ ID NO: 1302665 - protein, 9 aa, Homo Sapiens
DAIVELDGD

SEQ ID NO: 1302666 - protein, 9 aa, Homo Sapiens
EGEDNSTTV

SEQ ID NO: 1302667 - protein, 9 aa, Homo Sapiens
IPKLILPCI

SEQ ID NO: 1302668 - protein, 9 aa, Homo Sapiens
QLTKRVKNT

SEQ ID NO: 1302669 - protein, 9 aa, Homo Sapiens
KIFICFPRT

SEQ ID NO: 1302670 - protein, 9 aa, Homo Sapiens
VTGNRQQPP

SEQ ID NO: 1302671 - protein, 9 aa, Homo Sapiens
DDLVILMRQ

SEQ ID NO: 1302672 - protein, 9 aa, Homo Sapiens
PPAQPLAQC

SEQ ID NO: 1302673 - protein, 9 aa, Homo Sapiens
KDVQSPGLL

SEQ ID NO: 1302674 - protein, 9 aa, Homo Sapiens
YSNTPFTTS

SEQ ID NO: 1302675 - protein, 9 aa, Homo Sapiens
LLEQDLFHH

SEQ ID NO: 1302676 - protein, 9 aa, Homo Sapiens
KRSVWINAD

SEQ ID NO: 1302677 - protein, 9 aa, Homo Sapiens
TDTEHDNKS

SEQ ID NO: 1302678 - protein, 9 aa, Homo Sapiens
NRQQPPQQN

SEQ ID NO: 1302679 - protein, 9 aa, Homo Sapiens
TRPQSCLWK

SEQ ID NO: 1302680 - protein, 9 aa, Homo Sapiens
DPIHLDLHF

SEQ ID NO: 1302681 - protein, 9 aa, Homo Sapiens
ENSNSAWML

SEQ ID NO: 1302682 - protein, 9 aa, Homo Sapiens
RECKSILLD

SEQ ID NO: 1302683 - protein, 9 aa, Homo Sapiens
QDPIHLDLH

SEQ ID NO: 1302684 - protein, 9 aa, Homo Sapiens
KVSSCRECM

SEQ ID NO: 1302685 - protein, 9 aa, Homo Sapiens
TQELPCMIW

SEQ ID NO: 1302686 - protein, 9 aa, Homo Sapiens
KRVKNTAAN

SEQ ID NO: 1302687 - protein, 9 aa, Homo Sapiens
NVGDANDHS

SEQ ID NO: 1302688 - protein, 9 aa, Homo Sapiens
SHQVTGNRQ

SEQ ID NO: 1302689 - protein, 9 aa, Homo Sapiens
DLTDASAAK

SEQ ID NO: 1302690 - protein, 9 aa, Homo Sapiens
KHPDDLVIL

SEQ ID NO: 1302691 - protein, 9 aa, Homo Sapiens
PPMKRSCPD

SEQ ID NO: 1302692 - protein, 9 aa, Homo Sapiens
ARALTAVMS

SEQ ID NO: 1302693 - protein, 9 aa, Homo Sapiens
QSCLWKLTE

SEQ ID NO: 1302694 - protein, 9 aa, Homo Sapiens
PKAFMLLGV

SEQ ID NO: 1302695 - protein, 9 aa, Homo Sapiens
PKIQQQKFQ

SEQ ID NO: 1302696 - protein, 9 aa, Homo Sapiens
GGNPDFSAE

SEQ ID NO: 1302697 - protein, 9 aa, Homo Sapiens
VKRHLKRSV

SEQ ID NO: 1302698 - protein, 9 aa, Homo Sapiens
PAPTAPRPG

SEQ ID NO: 1302699 - protein, 9 aa, Homo Sapiens
LWALAAVSH

SEQ ID NO: 1302700 - protein, 9 aa, Homo Sapiens
EDPRAAKHA

SEQ ID NO: 1302701 - protein, 9 aa, Homo Sapiens
PHGKNYTCC

SEQ ID NO: 1302702 - protein, 9 aa, Homo Sapiens
FSTLAKHKR

SEQ ID NO: 1302703 - protein, 9 aa, Homo Sapiens
ARVIVNVGD

SEQ ID NO: 1302704 - protein, 9 aa, Homo Sapiens
TRMHTGKRP

SEQ ID NO: 1302705 - protein, 9 aa, Homo Sapiens
VGTSQNLNE

SEQ ID NO: 1302706 - protein, 9 aa, Homo Sapiens
GGNWYRLLN

SEQ ID NO: 1302707 - protein, 9 aa, Homo Sapiens
GLSIEKVSK

SEQ ID NO: 1302708 - protein, 9 aa, Homo Sapiens
RQQQCHSPQ

SEQ ID NO: 1302709 - protein, 9 aa, Homo Sapiens
DNKSDSENE

SEQ ID NO: 1302710 - protein, 9 aa, Homo Sapiens
HNDQEVEKK

SEQ ID NO: 1302711 - protein, 9 aa, Homo Sapiens
DCKEVSPIF

SEQ ID NO: 1302712 - protein, 9 aa, Homo Sapiens
AAVSHLVRV

SEQ ID NO: 1302713 - protein, 9 aa, Homo Sapiens
VLYGVTTSL

SEQ ID NO: 1302714 - protein, 9 aa, Homo Sapiens
WRTEEENLR

SEQ ID NO: 1302715 - protein, 9 aa, Homo Sapiens
WEQYIGIRH

SEQ ID NO: 1302716 - protein, 9 aa, Homo Sapiens
GPESSTQEL

SEQ ID NO: 1302717 - protein, 9 aa, Homo Sapiens
TLSTTPVYS

SEQ ID NO: 1302718 - protein, 9 aa, Homo Sapiens
FDAIVELDG

SEQ ID NO: 1302719 - protein, 9 aa, Homo Sapiens
HHIIHAGKE

SEQ ID NO: 1302720 - protein, 9 aa, Homo Sapiens
RDWRTEEEN

SEQ ID NO: 1302721 - protein, 9 aa, Homo Sapiens
QESNYQLLR

SEQ ID NO: 1302722 - protein, 9 aa, Homo Sapiens
CAPPPPAPT

SEQ ID NO: 1302723 - protein, 9 aa, Homo Sapiens
EIDSMPAAS

SEQ ID NO: 1302724 - protein, 9 aa, Homo Sapiens
VCSIPALAE

SEQ ID NO: 1302725 - protein, 9 aa, Homo Sapiens
VPRLVAAAV

SEQ ID NO: 1302726 - protein, 9 aa, Homo Sapiens
VWVWLQFCC

SEQ ID NO: 1302727 - protein, 9 aa, Homo Sapiens
DDFNYERQA

SEQ ID NO: 1302728 - protein, 9 aa, Homo Sapiens
GLLNEPLSS

SEQ ID NO: 1302729 - protein, 9 aa, Homo Sapiens
LEMELLTFR

SEQ ID NO: 1302730 - protein, 9 aa, Homo Sapiens
LTLTDTEHD

SEQ ID NO: 1302731 - protein, 9 aa, Homo Sapiens
DTGKENCEA

SEQ ID NO: 1302732 - protein, 9 aa, Homo Sapiens
RNRILHNDQ

SEQ ID NO: 1302733 - protein, 9 aa, Homo Sapiens
FMLLGVSDR

SEQ ID NO: 1302734 - protein, 9 aa, Homo Sapiens
PPCPAIGSS

SEQ ID NO: 1302735 - protein, 9 aa, Homo Sapiens
TLTDTEHDN

SEQ ID NO: 1302736 - protein, 9 aa, Homo Sapiens
LDHWLLLLH

SEQ ID NO: 1302737 - protein, 9 aa, Homo Sapiens
YRQQKAEIE

SEQ ID NO: 1302738 - protein, 9 aa, Homo Sapiens
QVLQHPWIQ

SEQ ID NO: 1302739 - protein, 9 aa, Homo Sapiens
STTPVYSNT

SEQ ID NO: 1302740 - protein, 9 aa, Homo Sapiens
CKAGKGLTG

SEQ ID NO: 1302741 - protein, 9 aa, Homo Sapiens
EQYIGIRHW

SEQ ID NO: 1302742 - protein, 9 aa, Homo Sapiens
GRGGSRGLG

SEQ ID NO: 1302743 - protein, 9 aa, Homo Sapiens
GQPGLPGPV

SEQ ID NO: 1302744 - protein, 9 aa, Homo Sapiens
MKRSCPDVQ

SEQ ID NO: 1302745 - protein, 9 aa, Homo Sapiens
QGESHHPLL

SEQ ID NO: 1302746 - protein, 9 aa, Homo Sapiens
HDGSSPGDT

SEQ ID NO: 1302747 - protein, 9 aa, Homo Sapiens
QGDFHHPFL

SEQ ID NO: 1302748 - protein, 9 aa, Homo Sapiens
MTWDSLSGT

SEQ ID NO: 1302749 - protein, 9 aa, Homo Sapiens
LCQSTGLME

SEQ ID NO: 1302750 - protein, 9 aa, Homo Sapiens
TRQILHLQW

SEQ ID NO: 1302751 - protein, 9 aa, Homo Sapiens
GNRQQPPQQ

SEQ ID NO: 1302752 - protein, 9 aa, Homo Sapiens
KEPYTCDVC

SEQ ID NO: 1302753 - protein, 9 aa, Homo Sapiens
NSRKWRYKA

SEQ ID NO: 1302754 - protein, 9 aa, Homo Sapiens
SPGDTGKEN

SEQ ID NO: 1302755 - protein, 9 aa, Homo Sapiens
PALAELNVS

SEQ ID NO: 1302756 - protein, 9 aa, Homo Sapiens
QYSSYLSSF

SEQ ID NO: 1302757 - protein, 9 aa, Homo Sapiens
RMHTGKRPY

SEQ ID NO: 1302758 - protein, 9 aa, Homo Sapiens
DPVHGYWFW

SEQ ID NO: 1302759 - protein, 9 aa, Homo Sapiens
ETEFYNIGP

SEQ ID NO: 1302760 - protein, 9 aa, Homo Sapiens
WVWLQFCCD

SEQ ID NO: 1302761 - protein, 9 aa, Homo Sapiens
IEREGLMYY

SEQ ID NO: 1302762 - protein, 9 aa, Homo Sapiens
KIVVQKKLE

SEQ ID NO: 1302763 - protein, 9 aa, Homo Sapiens
RWKNLLNLH

SEQ ID NO: 1302764 - protein, 9 aa, Homo Sapiens
LTDASAAKN

SEQ ID NO: 1302765 - protein, 9 aa, Homo Sapiens
RRCSAVSWV

SEQ ID NO: 1302766 - protein, 9 aa, Homo Sapiens
TSQSPPMKR

SEQ ID NO: 1302767 - protein, 9 aa, Homo Sapiens
EQDLFHHPI

SEQ ID NO: 1302768 - protein, 9 aa, Homo Sapiens
NKALLLGAR

SEQ ID NO: 1302769 - protein, 9 aa, Homo Sapiens
PESSTQELP

SEQ ID NO: 1302770 - protein, 9 aa, Homo Sapiens
RHLKRSVWI

SEQ ID NO: 1302771 - protein, 9 aa, Homo Sapiens
GIRHWLLLF

SEQ ID NO: 1302772 - protein, 9 aa, Homo Sapiens
GDTGKENCE

SEQ ID NO: 1302773 - protein, 9 aa, Homo Sapiens
HPMVQGDFH

SEQ ID NO: 1302774 - protein, 9 aa, Homo Sapiens
PVHGYWFWA

SEQ ID NO: 1302775 - protein, 9 aa, Homo Sapiens
PYLPSAPVS

SEQ ID NO: 1302776 - protein, 9 aa, Homo Sapiens
AGRGGSRGL

SEQ ID NO: 1302777 - protein, 9 aa, Homo Sapiens
SNYQLLRRN

SEQ ID NO: 1302778 - protein, 9 aa, Homo Sapiens
PLFRSTVPF

SEQ ID NO: 1302779 - protein, 9 aa, Homo Sapiens
GDFHHPFLH

SEQ ID NO: 1302780 - protein, 9 aa, Homo Sapiens
RMNSRKWRY

SEQ ID NO: 1302781 - protein, 9 aa, Homo Sapiens
WAGDRPYQD

SEQ ID NO: 1302782 - protein, 9 aa, Homo Sapiens
DGGNPDFSA

SEQ ID NO: 1302783 - protein, 9 aa, Homo Sapiens
VLFMATANT

SEQ ID NO: 1302784 - protein, 9 aa, Homo Sapiens
RDLAPEDEN

SEQ ID NO: 1302785 - protein, 9 aa, Homo Sapiens
VQCSFPNCE

SEQ ID NO: 1302786 - protein, 9 aa, Homo Sapiens
HIIHAGKEP

SEQ ID NO: 1302787 - protein, 9 aa, Homo Sapiens
QYIGIRHWL

SEQ ID NO: 1302788 - protein, 9 aa, Homo Sapiens
LSFRLDSML

SEQ ID NO: 1302789 - protein, 9 aa, Homo Sapiens
DFHHPFLHP

SEQ ID NO: 1302790 - protein, 9 aa, Homo Sapiens
PQSCLWKLT

SEQ ID NO: 1302791 - protein, 9 aa, Homo Sapiens
SCHADPAHQ

SEQ ID NO: 1302792 - protein, 9 aa, Homo Sapiens
YGVTTSLEH

SEQ ID NO: 1302793 - protein, 9 aa, Homo Sapiens
TVGHYAVVC

SEQ ID NO: 1302794 - protein, 9 aa, Homo Sapiens
ESNYQLLRR

SEQ ID NO: 1302795 - protein, 9 aa, Homo Sapiens
PAQESNYQL

SEQ ID NO: 1302796 - protein, 9 aa, Homo Sapiens
FPSSYLLVG

SEQ ID NO: 1302797 - protein, 9 aa, Homo Sapiens
NSTRQILHL

SEQ ID NO: 1302798 - protein, 9 aa, Homo Sapiens
PPPAPTAPR

SEQ ID NO: 1302799 - protein, 9 aa, Homo Sapiens
TFSGSSSIC

SEQ ID NO: 1302800 - protein, 9 aa, Homo Sapiens
LEQDLFHHP

SEQ ID NO: 1302801 - protein, 9 aa, Homo Sapiens
CSFPNCEKW

SEQ ID NO: 1302802 - protein, 9 aa, Homo Sapiens
TKRVKNTAA

SEQ ID NO: 1302803 - protein, 9 aa, Homo Sapiens
RGGSRGLGR

SEQ ID NO: 1302804 - protein, 9 aa, Homo Sapiens
EHRRCSAVS

SEQ ID NO: 1302805 - protein, 9 aa, Homo Sapiens
PRGSLPFPA

SEQ ID NO: 1302806 - protein, 9 aa, Homo Sapiens
IQGCAPENT

SEQ ID NO: 1302807 - protein, 9 aa, Homo Sapiens
GSSPGDTGK

SEQ ID NO: 1302808 - protein, 9 aa, Homo Sapiens
SDSVSVGLC

SEQ ID NO: 1302809 - protein, 9 aa, Homo Sapiens
DENSNSAWM

SEQ ID NO: 1302810 - protein, 9 aa, Homo Sapiens
LSHHRPHLF

SEQ ID NO: 1302811 - protein, 9 aa, Homo Sapiens
IKDVQSPGL

SEQ ID NO: 1302812 - protein, 9 aa, Homo Sapiens
NLILLLATV

SEQ ID NO: 1302813 - protein, 9 aa, Homo Sapiens
IGIRHWLLL

SEQ ID NO: 1302814 - protein, 9 aa, Homo Sapiens
HDDFNYERQ

SEQ ID NO: 1302815 - protein, 9 aa, Homo Sapiens
ALRGLCSLT

SEQ ID NO: 1302816 - protein, 9 aa, Homo Sapiens
NDQEVEKKQ

SEQ ID NO: 1302817 - protein, 9 aa, Homo Sapiens
PQRLREKKF

SEQ ID NO: 1302818 - protein, 9 aa, Homo Sapiens
VVEIDSMPA

SEQ ID NO: 1302819 - protein, 9 aa, Homo Sapiens
ALAAVSHLV

SEQ ID NO: 1302820 - protein, 9 aa, Homo Sapiens
QELPCMIWP

SEQ ID NO: 1302821 - protein, 9 aa, Homo Sapiens
HGKNYTCCC

SEQ ID NO: 1302822 - protein, 9 aa, Homo Sapiens
HSHLPNQDP

SEQ ID NO: 1302823 - protein, 9 aa, Homo Sapiens
CSAVSWVKE

SEQ ID NO: 1302824 - protein, 9 aa, Homo Sapiens
QVESHVGLH

SEQ ID NO: 1302825 - protein, 9 aa, Homo Sapiens
KGSRSQASE

SEQ ID NO: 1302826 - protein, 9 aa, Homo Sapiens
QNMKNLILL

SEQ ID NO: 1302827 - protein, 9 aa, Homo Sapiens
HAMSKKRGS

SEQ ID NO: 1302828 - protein, 9 aa, Homo Sapiens
HHPLLHPMV

SEQ ID NO: 1302829 - protein, 9 aa, Homo Sapiens
GPGGGGGCG

SEQ ID NO: 1302830 - protein, 9 aa, Homo Sapiens
LDSMLRAHR

SEQ ID NO: 1302831 - protein, 9 aa, Homo Sapiens
AEIMVVKAV

SEQ ID NO: 1302832 - protein, 9 aa, Homo Sapiens
HDNKSDSEN

SEQ ID NO: 1302833 - protein, 9 aa, Homo Sapiens
HTLFLLLMA

SEQ ID NO: 1302834 - protein, 9 aa, Homo Sapiens
THLIEVWPT

SEQ ID NO: 1302835 - protein, 9 aa, Homo Sapiens
AFMLLGVSD

SEQ ID NO: 1302836 - protein, 9 aa, Homo Sapiens
VDLTDASAA

SEQ ID NO: 1302837 - protein, 9 aa, Homo Sapiens
LCIWLLILS

SEQ ID NO: 1302838 - protein, 9 aa, Homo Sapiens
VQSPGLLNE

SEQ ID NO: 1302839 - protein, 9 aa, Homo Sapiens
VGDANDHSP

SEQ ID NO: 1302840 - protein, 9 aa, Homo Sapiens
CSIYLEKQL

SEQ ID NO: 1302841 - protein, 9 aa, Homo Sapiens
PLSSSGLIY

SEQ ID NO: 1302842 - protein, 9 aa, Homo Sapiens
HLAEIMVVK

SEQ ID NO: 1302843 - protein, 9 aa, Homo Sapiens
KWLNPENST

SEQ ID NO: 1302844 - protein, 9 aa, Homo Sapiens
SICATSGVL

SEQ ID NO: 1302845 - protein, 9 aa, Homo Sapiens
HFVLYGVTT

SEQ ID NO: 1302846 - protein, 9 aa, Homo Sapiens
DMPTSLHYL

SEQ ID NO: 1302847 - protein, 9 aa, Homo Sapiens
TSQNLNEEF

SEQ ID NO: 1302848 - protein, 9 aa, Homo Sapiens
DGSSPGDTG

SEQ ID NO: 1302849 - protein, 9 aa, Homo Sapiens
KASNVLEET

SEQ ID NO: 1302850 - protein, 9 aa, Homo Sapiens
VTFKNVAVI

SEQ ID NO: 1302851 - protein, 9 aa, Homo Sapiens
LLLMAQVIH

SEQ ID NO: 1302852 - protein, 9 aa, Homo Sapiens
EGVLEETEF

SEQ ID NO: 1302853 - protein, 9 aa, Homo Sapiens
EEQKMMTSQ

SEQ ID NO: 1302854 - protein, 9 aa, Homo Sapiens
NVLEETAKD

SEQ ID NO: 1302855 - protein, 9 aa, Homo Sapiens
VTPQRLREK

SEQ ID NO: 1302856 - protein, 9 aa, Homo Sapiens
LSSFCKGMV

SEQ ID NO: 1302857 - protein, 9 aa, Homo Sapiens
AEFDAIVEL

SEQ ID NO: 1302858 - protein, 9 aa, Homo Sapiens
LCEIRRYQK

SEQ ID NO: 1302859 - protein, 9 aa, Homo Sapiens
EAGQPGLPG

SEQ ID NO: 1302860 - protein, 9 aa, Homo Sapiens
IGSSNCALG

SEQ ID NO: 1302861 - protein, 9 aa, Homo Sapiens
KGNKMKMTF

SEQ ID NO: 1302862 - protein, 9 aa, Homo Sapiens
YTQYVMEQE

SEQ ID NO: 1302863 - protein, 9 aa, Homo Sapiens
ELSKYRQVE

SEQ ID NO: 1302864 - protein, 9 aa, Homo Sapiens
TPVQSMHAG

SEQ ID NO: 1302865 - protein, 9 aa, Homo Sapiens
KNYTCCCPQ

SEQ ID NO: 1302866 - protein, 9 aa, Homo Sapiens
SSSICATSG

SEQ ID NO: 1302867 - protein, 9 aa, Homo Sapiens
RCGHLDGDC

SEQ ID NO: 1302868 - protein, 9 aa, Homo Sapiens
PLLLVTPQR

SEQ ID NO: 1302869 - protein, 9 aa, Homo Sapiens
IIQQSVQDI

SEQ ID NO: 1302870 - protein, 9 aa, Homo Sapiens
KKRGSLYQL

SEQ ID NO: 1302871 - protein, 9 aa, Homo Sapiens
MTNGLCIWL

SEQ ID NO: 1302872 - protein, 9 aa, Homo Sapiens
PSTHLIEVW

SEQ ID NO: 1302873 - protein, 9 aa, Homo Sapiens
PNNNGSSMD

SEQ ID NO: 1302874 - protein, 9 aa, Homo Sapiens
FPLPLLIKW

SEQ ID NO: 1302875 - protein, 9 aa, Homo Sapiens
KPAQESNYQ

SEQ ID NO: 1302876 - protein, 9 aa, Homo Sapiens
HGYWFWAGD

SEQ ID NO: 1302877 - protein, 9 aa, Homo Sapiens
APTAPRPGP

SEQ ID NO: 1302878 - protein, 9 aa, Homo Sapiens
RRECKSILL

SEQ ID NO: 1302879 - protein, 9 aa, Homo Sapiens
LIVIQNPTK

SEQ ID NO: 1302880 - protein, 9 aa, Homo Sapiens
FICFPRTLF

SEQ ID NO: 1302881 - protein, 9 aa, Homo Sapiens
VQDIYKPGT

SEQ ID NO: 1302882 - protein, 9 aa, Homo Sapiens
LLCPMLRTA

SEQ ID NO: 1302883 - protein, 9 aa, Homo Sapiens
NCEKWRRLC

SEQ ID NO: 1302884 - protein, 9 aa, Homo Sapiens
PVAVMHFAA

SEQ ID NO: 1302885 - protein, 9 aa, Homo Sapiens
QKSYAKDMP

SEQ ID NO: 1302886 - protein, 9 aa, Homo Sapiens
DEGEDNSTT

SEQ ID NO: 1302887 - protein, 9 aa, Homo Sapiens
PHLFHRRRH

SEQ ID NO: 1302888 - protein, 9 aa, Homo Sapiens
AEEAVTFKN

SEQ ID NO: 1302889 - protein, 9 aa, Homo Sapiens
EAGDWRPEK

SEQ ID NO: 1302890 - protein, 9 aa, Homo Sapiens
PLAVCSIPA

SEQ ID NO: 1302891 - protein, 9 aa, Homo Sapiens
PVSLASPAQ

SEQ ID NO: 1302892 - protein, 9 aa, Homo Sapiens
KRHLKRSVW

SEQ ID NO: 1302893 - protein, 9 aa, Homo Sapiens
VETKVDGRR

SEQ ID NO: 1302894 - protein, 9 aa, Homo Sapiens
CGLSFRLDS

SEQ ID NO: 1302895 - protein, 9 aa, Homo Sapiens
LLVTPQRLR

SEQ ID NO: 1302896 - protein, 9 aa, Homo Sapiens
APPLFRSTV

SEQ ID NO: 1302897 - protein, 9 aa, Homo Sapiens
GKRPYTCTV

SEQ ID NO: 1302898 - protein, 9 aa, Homo Sapiens
SGTPVQSMH

SEQ ID NO: 1302899 - protein, 9 aa, Homo Sapiens
GESHHPLLH

SEQ ID NO: 1302900 - protein, 9 aa, Homo Sapiens
YLPSAPVSL

SEQ ID NO: 1302901 - protein, 9 aa, Homo Sapiens
DSKKQKSLE

SEQ ID NO: 1302902 - protein, 9 aa, Homo Sapiens
AVSHLVRVK

SEQ ID NO: 1302903 - protein, 9 aa, Homo Sapiens
QCLCSMVCF

SEQ ID NO: 1302904 - protein, 9 aa, Homo Sapiens
ASTRPQSCL

SEQ ID NO: 1302905 - protein, 9 aa, Homo Sapiens
DLSQVLFMA

SEQ ID NO: 1302906 - protein, 9 aa, Homo Sapiens
PTAPRPGPA

SEQ ID NO: 1302907 - protein, 9 aa, Homo Sapiens
DQEVEKKQG

SEQ ID NO: 1302908 - protein, 9 aa, Homo Sapiens
VQGDFHHPF

SEQ ID NO: 1302909 - protein, 9 aa, Homo Sapiens
CEIRRYQKS

SEQ ID NO: 1302910 - protein, 9 aa, Homo Sapiens
QLIIQQSVQ

SEQ ID NO: 1302911 - protein, 9 aa, Homo Sapiens
NSWHHDDFN

SEQ ID NO: 1302912 - protein, 9 aa, Homo Sapiens
SIPALAELN

SEQ ID NO: 1302913 - protein, 9 aa, Homo Sapiens
TVALCEIRR

SEQ ID NO: 1302914 - protein, 9 aa, Homo Sapiens
TNSTRQILH

SEQ ID NO: 1302915 - protein, 9 aa, Homo Sapiens
AGQPGLPGP

SEQ ID NO: 1302916 - protein, 9 aa, Homo Sapiens
NLHVIKKKN

SEQ ID NO: 1302917 - protein, 9 aa, Homo Sapiens
NEHRRCSAV

SEQ ID NO: 1302918 - protein, 9 aa, Homo Sapiens
SKGNKMKMT

SEQ ID NO: 1302919 - protein, 9 aa, Homo Sapiens
NPDFSAEVI

SEQ ID NO: 1302920 - protein, 9 aa, Homo Sapiens
HLDHWLLLL

SEQ ID NO: 1302921 - protein, 9 aa, Homo Sapiens
PGTVALCEI

SEQ ID NO: 1302922 - protein, 9 aa, Homo Sapiens
QPGLPGPVG

SEQ ID NO: 1302923 - protein, 9 aa, Homo Sapiens
EKVSKSLRF

SEQ ID NO: 1302924 - protein, 9 aa, Homo Sapiens
QLLRRNNSY

SEQ ID NO: 1302925 - protein, 9 aa, Homo Sapiens
KICILWDHP

SEQ ID NO: 1302926 - protein, 9 aa, Homo Sapiens
SEENSRNSI

SEQ ID NO: 1302927 - protein, 9 aa, Homo Sapiens
MIAVSNLND

SEQ ID NO: 1302928 - protein, 9 aa, Homo Sapiens
ELLCPMLRT

SEQ ID NO: 1302929 - protein, 9 aa, Homo Sapiens
PGDTGKENC

SEQ ID NO: 1302930 - protein, 9 aa, Homo Sapiens
GDCKEVSPI

SEQ ID NO: 1302931 - protein, 9 aa, Homo Sapiens
PRSLEMELL

SEQ ID NO: 1302932 - protein, 9 aa, Homo Sapiens
VTTSLEHPA

SEQ ID NO: 1302933 - protein, 9 aa, Homo Sapiens
EAKNEHRRC

SEQ ID NO: 1302934 - protein, 9 aa, Homo Sapiens
EAPGDHIHL

SEQ ID NO: 1302935 - protein, 9 aa, Homo Sapiens
ESHHPLLHP

SEQ ID NO: 1302936 - protein, 9 aa, Homo Sapiens
LKHPDDLVI

SEQ ID NO: 1302937 - protein, 9 aa, Homo Sapiens
CEKWRRLCG

SEQ ID NO: 1302938 - protein, 9 aa, Homo Sapiens
GLMYYNRAL

SEQ ID NO: 1302939 - protein, 9 aa, Homo Sapiens
HCKAGKGLT

SEQ ID NO: 1302940 - protein, 9 aa, Homo Sapiens
RPEKSPCSN

SEQ ID NO: 1302941 - protein, 9 aa, Homo Sapiens
KNLLNLHVI

SEQ ID NO: 1302942 - protein, 9 aa, Homo Sapiens
GPPCPAIGS

SEQ ID NO: 1302943 - protein, 9 aa, Homo Sapiens
MMTSQGLVS

SEQ ID NO: 1302944 - protein, 9 aa, Homo Sapiens
ASNVLEETA

SEQ ID NO: 1302945 - protein, 9 aa, Homo Sapiens
KRPYTCTVC

SEQ ID NO: 1302946 - protein, 9 aa, Homo Sapiens
RAPGAGRGG

SEQ ID NO: 1302947 - protein, 9 aa, Homo Sapiens
NTAANVLRE

SEQ ID NO: 1302948 - protein, 9 aa, Homo Sapiens
LRPVAAPPL

SEQ ID NO: 1302949 - protein, 9 aa, Homo Sapiens
QILHLQWTV

SEQ ID NO: 1302950 - protein, 9 aa, Homo Sapiens
LFPSSYLLV

SEQ ID NO: 1302951 - protein, 9 aa, Homo Sapiens
YRPGTVALC

SEQ ID NO: 1302952 - protein, 9 aa, Homo Sapiens
DSTSQSPPM

SEQ ID NO: 1302953 - protein, 9 aa, Homo Sapiens
SHFSTLAKH

SEQ ID NO: 1302954 - protein, 9 aa, Homo Sapiens
STHLIEVWP

SEQ ID NO: 1302955 - protein, 9 aa, Homo Sapiens
VSHLVRVKE

SEQ ID NO: 1302956 - protein, 9 aa, Homo Sapiens
VTTRENSSS

SEQ ID NO: 1302957 - protein, 9 aa, Homo Sapiens
PRLVAAAVL

SEQ ID NO: 1302958 - protein, 9 aa, Homo Sapiens
QSHQVTGNR

SEQ ID NO: 1302959 - protein, 9 aa, Homo Sapiens
GTPVQSMHA

SEQ ID NO: 1302960 - protein, 9 aa, Homo Sapiens
GGCGRKLLL

SEQ ID NO: 1302961 - protein, 9 aa, Homo Sapiens
ECMESGPGC

SEQ ID NO: 1302962 - protein, 9 aa, Homo Sapiens
IRHWLLLFI

SEQ ID NO: 1302963 - protein, 9 aa, Homo Sapiens
LNEEFLRRS

SEQ ID NO: 1302964 - protein, 9 aa, Homo Sapiens
NYQLLRRNN

SEQ ID NO: 1302965 - protein, 9 aa, Homo Sapiens
AARSWRQPG

SEQ ID NO: 1302966 - protein, 9 aa, Homo Sapiens
SKNALRGLC

SEQ ID NO: 1302967 - protein, 9 aa, Homo Sapiens
KAEIEKQKQ

SEQ ID NO: 1302968 - protein, 9 aa, Homo Sapiens
TSRAARSWR

SEQ ID NO: 1302969 - protein, 9 aa, Homo Sapiens
GKDSKKQKS

SEQ ID NO: 1302970 - protein, 9 aa, Homo Sapiens
AEEGVLEET

SEQ ID NO: 1302971 - protein, 9 aa, Homo Sapiens
LSGTPVQSM

SEQ ID NO: 1302972 - protein, 9 aa, Homo Sapiens
ESPKIQQQK

SEQ ID NO: 1302973 - protein, 9 aa, Homo Sapiens
GAGRGGSRG

SEQ ID NO: 1302974 - protein, 9 aa, Homo Sapiens
RQILHLQWT

SEQ ID NO: 1302975 - protein, 9 aa, Homo Sapiens
PLIMPNNNG

SEQ ID NO: 1302976 - protein, 9 aa, Homo Sapiens
GGASTRPQS

SEQ ID NO: 1302977 - protein, 9 aa, Homo Sapiens
NWYRLLNSH

SEQ ID NO: 1302978 - protein, 9 aa, Homo Sapiens
FLLEQDLFH

SEQ ID NO: 1302979 - protein, 9 aa, Homo Sapiens
LLGARALTA

SEQ ID NO: 1302980 - protein, 9 aa, Homo Sapiens
VYPLSSSGL

SEQ ID NO: 1302981 - protein, 9 aa, Homo Sapiens
IVELDGDDV

SEQ ID NO: 1302982 - protein, 9 aa, Homo Sapiens
SVWINADIL

SEQ ID NO: 1302983 - protein, 9 aa, Homo Sapiens
SRAARSWRQ

SEQ ID NO: 1302984 - protein, 9 aa, Homo Sapiens
SQSPPMKRS

SEQ ID NO: 1302985 - protein, 9 aa, Homo Sapiens
LKRSVWINA

SEQ ID NO: 1302986 - protein, 9 aa, Homo Sapiens
EDNSTTVSI

SEQ ID NO: 1302987 - protein, 9 aa, Homo Sapiens
DGDMIAVSN

SEQ ID NO: 1302988 - protein, 9 aa, Homo Sapiens
EENSRNSIL

SEQ ID NO: 1302989 - protein, 9 aa, Homo Sapiens
TEFYNIGPL

SEQ ID NO: 1302990 - protein, 9 aa, Homo Sapiens
LLHPMVQGE

SEQ ID NO: 1302991 - protein, 9 aa, Homo Sapiens
AVVCSIYLE

SEQ ID NO: 1302992 - protein, 9 aa, Homo Sapiens
FNHTLFLLL

SEQ ID NO: 1302993 - protein, 9 aa, Homo Sapiens
ETAKDKVLK

SEQ ID NO: 1302994 - protein, 9 aa, Homo Sapiens
PEKSPCSNV

SEQ ID NO: 1302995 - protein, 9 aa, Homo Sapiens
VSTNSTRQI

SEQ ID NO: 1302996 - protein, 9 aa, Homo Sapiens
EETEFYNIG

SEQ ID NO: 1302997 - protein, 9 aa, Homo Sapiens
MHFAAVVLQ

SEQ ID NO: 1302998 - protein, 9 aa, Homo Sapiens
WLLLLHHVF

SEQ ID NO: 1302999 - protein, 9 aa, Homo Sapiens
VCQDIKPCI

SEQ ID NO: 1303000 - protein, 9 aa, Homo Sapiens
RAARSWRQP

SEQ ID NO: 1303001 - protein, 9 aa, Homo Sapiens
FYRPVAVMH

SEQ ID NO: 1303002 - protein, 9 aa, Homo Sapiens
RPGTVALCE

SEQ ID NO: 1303003 - protein, 9 aa, Homo Sapiens
SLVGTSQNL

SEQ ID NO: 1303004 - protein, 9 aa, Homo Sapiens
SFRLDSMLR

SEQ ID NO: 1303005 - protein, 9 aa, Homo Sapiens
ALCEIRRYQ

SEQ ID NO: 1303006 - protein, 9 aa, Homo Sapiens
GDANDHSPY

SEQ ID NO: 1303007 - protein, 9 aa, Homo Sapiens
HPFLHPMVQ

SEQ ID NO: 1303008 - protein, 9 aa, Homo Sapiens
QESPKIQQQ

SEQ ID NO: 1303009 - protein, 9 aa, Homo Sapiens
LSSSGLIYF

SEQ ID NO: 1303010 - protein, 9 aa, Homo Sapiens
SHLPNQDPI

SEQ ID NO: 1303011 - protein, 9 aa, Homo Sapiens
HVFLLEQDL

SEQ ID NO: 1303012 - protein, 9 aa, Homo Sapiens
YRPVAVMHF

SEQ ID NO: 1303013 - protein, 9 aa, Homo Sapiens
CLSHHRPHL

SEQ ID NO: 1303014 - protein, 9 aa, Homo Sapiens
RSWRQPGPG

SEQ ID NO: 1303015 - protein, 9 aa, Homo Sapiens
HLIEVWPTQ

SEQ ID NO: 1303016 - protein, 9 aa, Homo Sapiens
LFLLLMAQV

SEQ ID NO: 1303017 - protein, 9 aa, Homo Sapiens
GYWFWAGDR

SEQ ID NO: 1303018 - protein, 9 aa, Homo Sapiens
LEETAKDKV

SEQ ID NO: 1303019 - protein, 9 aa, Homo Sapiens
LAVCSIPAL

SEQ ID NO: 1303020 - protein, 9 aa, Homo Sapiens
LIEVWPTQD

SEQ ID NO: 1303021 - protein, 9 aa, Homo Sapiens
RGSLPFPAL

SEQ ID NO: 1303022 - protein, 9 aa, Homo Sapiens
GPAEFDAIV

SEQ ID NO: 1303023 - protein, 9 aa, Homo Sapiens
NVAVIFTEE

SEQ ID NO: 1303024 - protein, 9 aa, Homo Sapiens
GCGRKLLLP

SEQ ID NO: 1303025 - protein, 9 aa, Homo Sapiens
YAVVCSIYL

SEQ ID NO: 1303026 - protein, 9 aa, Homo Sapiens
LLLGARALT

SEQ ID NO: 1303027 - protein, 9 aa, Homo Sapiens
GVTTSLEHP

SEQ ID NO: 1303028 - protein, 9 aa, Homo Sapiens
AFSCHADPA

SEQ ID NO: 1303029 - protein, 9 aa, Homo Sapiens
LHHVFLLEQ

SEQ ID NO: 1303030 - protein, 9 aa, Homo Sapiens
PRAAKHARG

SEQ ID NO: 1303031 - protein, 9 aa, Homo Sapiens
TVYPLSSSG

SEQ ID NO: 1303032 - protein, 9 aa, Homo Sapiens
IVVQKKLEE

SEQ ID NO: 1303033 - protein, 9 aa, Homo Sapiens
TLFPSSYLL

SEQ ID NO: 1303034 - protein, 9 aa, Homo Sapiens
CGSEVTTRE

SEQ ID NO: 1303035 - protein, 9 aa, Homo Sapiens
FSGSSSICA

SEQ ID NO: 1303036 - protein, 9 aa, Homo Sapiens
FLHPMVQGE

SEQ ID NO: 1303037 - protein, 9 aa, Homo Sapiens
LWELLCPML

SEQ ID NO: 1303038 - protein, 9 aa, Homo Sapiens
LAAVSHLVR

SEQ ID NO: 1303039 - protein, 9 aa, Homo Sapiens
PGAPGEAGQ

SEQ ID NO: 1303040 - protein, 9 aa, Homo Sapiens
GEDNSTTVS

SEQ ID NO: 1303041 - protein, 9 aa, Homo Sapiens
FSHFSTLAK

SEQ ID NO: 1303042 - protein, 9 aa, Homo Sapiens
ILHLQWTVH

SEQ ID NO: 1303043 - protein, 9 aa, Homo Sapiens
LHVIKKKNK

SEQ ID NO: 1303044 - protein, 9 aa, Homo Sapiens
LFWEQYIGI

SEQ ID NO: 1303045 - protein, 9 aa, Homo Sapiens
DPRAAKHAR

SEQ ID NO: 1303046 - protein, 9 aa, Homo Sapiens
LSKYRQVES

SEQ ID NO: 1303047 - protein, 9 aa, Homo Sapiens
KYRQVESHV

SEQ ID NO: 1303048 - protein, 9 aa, Homo Sapiens
RSQASEENS

SEQ ID NO: 1303049 - protein, 9 aa, Homo Sapiens
GDHIHLDHW

SEQ ID NO: 1303050 - protein, 9 aa, Homo Sapiens
DLAPEDENS

SEQ ID NO: 1303051 - protein, 9 aa, Homo Sapiens
MKELLVDLT

SEQ ID NO: 1303052 - protein, 9 aa, Homo Sapiens
TVPRLVAAA

SEQ ID NO: 1303053 - protein, 9 aa, Homo Sapiens
CLCSMVCFS

SEQ ID NO: 1303054 - protein, 9 aa, Homo Sapiens
PGDHIHLDH

SEQ ID NO: 1303055 - protein, 9 aa, Homo Sapiens
EVTVQPGCY

SEQ ID NO: 1303056 - protein, 9 aa, Homo Sapiens
HLFHRRRHQ

SEQ ID NO: 1303057 - protein, 9 aa, Homo Sapiens
AQESPKIQQ

SEQ ID NO: 1303058 - protein, 9 aa, Homo Sapiens
QSPPMKRSC

SEQ ID NO: 1303059 - protein, 9 aa, Homo Sapiens
AGPPCPAIG

SEQ ID NO: 1303060 - protein, 9 aa, Homo Sapiens
TRENSSSPG

SEQ ID NO: 1303061 - protein, 9 aa, Homo Sapiens
MVVKAVEHI

SEQ ID NO: 1303062 - protein, 9 aa, Homo Sapiens
VHTRMHTGK

SEQ ID NO: 1303063 - protein, 9 aa, Homo Sapiens
DLSGLSIEK

SEQ ID NO: 1303064 - protein, 9 aa, Homo Sapiens
LIKWLAFCH

SEQ ID NO: 1303065 - protein, 9 aa, Homo Sapiens
PMVQGESHH

SEQ ID NO: 1303066 - protein, 9 aa, Homo Sapiens
MAQESPKIQ

SEQ ID NO: 1303067 - protein, 9 aa, Homo Sapiens
LMAQVIHSH

SEQ ID NO: 1303068 - protein, 9 aa, Homo Sapiens
CACPGRDWR

SEQ ID NO: 1303069 - protein, 9 aa, Homo Sapiens
HWLLLLHHV

SEQ ID NO: 1303070 - protein, 9 aa, Homo Sapiens
ADFLPKWLN

SEQ ID NO: 1303071 - protein, 9 aa, Homo Sapiens
EEKYRQQKA

SEQ ID NO: 1303072 - protein, 9 aa, Homo Sapiens
APEDENSNS

SEQ ID NO: 1303073 - protein, 9 aa, Homo Sapiens
SPKAFMLLG

SEQ ID NO: 1303074 - protein, 9 aa, Homo Sapiens
HHRPHLFHR

SEQ ID NO: 1303075 - protein, 9 aa, Homo Sapiens
TTSLEHPAS

SEQ ID NO: 1303076 - protein, 9 aa, Homo Sapiens
KTLFPSSYL

SEQ ID NO: 1303077 - protein, 9 aa, Homo Sapiens
PLPLLIKWL

SEQ ID NO: 1303078 - protein, 9 aa, Homo Sapiens
EQKMMTSQG

SEQ ID NO: 1303079 - protein, 9 aa, Homo Sapiens
GARALTAVM

SEQ ID NO: 1303080 - protein, 9 aa, Homo Sapiens
IGQKICILW

SEQ ID NO: 1303081 - protein, 9 aa, Homo Sapiens
SIEKVSKSL

SEQ ID NO: 1303082 - protein, 9 aa, Homo Sapiens
CFPRTLFAT

SEQ ID NO: 1303083 - protein, 9 aa, Homo Sapiens
KVSKSLRFI

SEQ ID NO: 1303084 - protein, 9 aa, Homo Sapiens
LAQCLCSMV

SEQ ID NO: 1303085 - protein, 9 aa, Homo Sapiens
MYYNRALDR

SEQ ID NO: 1303086 - protein, 9 aa, Homo Sapiens
MAQVIHSHL

SEQ ID NO: 1303087 - protein, 9 aa, Homo Sapiens
PLIGQKICI

SEQ ID NO: 1303088 - protein, 9 aa, Homo Sapiens
SQNLNEEFL

SEQ ID NO: 1303089 - protein, 9 aa, Homo Sapiens
EFNHTLFLL

SEQ ID NO: 1303090 - protein, 9 aa, Homo Sapiens
KYRQQKAEI

SEQ ID NO: 1303091 - protein, 9 aa, Homo Sapiens
GTSQNLNEE

SEQ ID NO: 1303092 - protein, 9 aa, Homo Sapiens
NSTTVSIVG

SEQ ID NO: 1303093 - protein, 9 aa, Homo Sapiens
KNTAANVLR

SEQ ID NO: 1303094 - protein, 9 aa, Homo Sapiens
SDAPLLPTR

SEQ ID NO: 1303095 - protein, 9 aa, Homo Sapiens
ESPAFSCHA

SEQ ID NO: 1303096 - protein, 9 aa, Homo Sapiens
VKNTAANVL

SEQ ID NO: 1303097 - protein, 9 aa, Homo Sapiens
TPQRLREKK

SEQ ID NO: 1303098 - protein, 9 aa, Homo Sapiens
LYGVTTSLE

SEQ ID NO: 1303099 - protein, 9 aa, Homo Sapiens
YRLLNSHAT

SEQ ID NO: 1303100 - protein, 9 aa, Homo Sapiens
LLNSHATLL

SEQ ID NO: 1303101 - protein, 9 aa, Homo Sapiens
VQGEFNHTL

SEQ ID NO: 1303102 - protein, 9 aa, Homo Sapiens
HPWIQGCAP

SEQ ID NO: 1303103 - protein, 9 aa, Homo Sapiens
APGAGRGGS

SEQ ID NO: 1303104 - protein, 9 aa, Homo Sapiens
VLQHPWIQG

SEQ ID NO: 1303105 - protein, 9 aa, Homo Sapiens
WQFKRRECK

SEQ ID NO: 1303106 - protein, 9 aa, Homo Sapiens
LLLHHVFLL

SEQ ID NO: 1303107 - protein, 9 aa, Homo Sapiens
FWEQYIGIR

SEQ ID NO: 1303108 - protein, 9 aa, Homo Sapiens
MTVPRLVAA

SEQ ID NO: 1303109 - protein, 9 aa, Homo Sapiens
TRVYSTENH

SEQ ID NO: 1303110 - protein, 9 aa, Homo Sapiens
NALRGLCSL

SEQ ID NO: 1303111 - protein, 9 aa, Homo Sapiens
VVQKKLEEL

SEQ ID NO: 1303112 - protein, 9 aa, Homo Sapiens
GKEPYTCDV

SEQ ID NO: 1303113 - protein, 9 aa, Homo Sapiens
IMPNNNGSS

SEQ ID NO: 1303114 - protein, 9 aa, Homo Sapiens
LRMNSRKWR

SEQ ID NO: 1303115 - protein, 9 aa, Homo Sapiens
MVQGDFHHP

SEQ ID NO: 1303116 - protein, 9 aa, Homo Sapiens
PWIQGCAPE

SEQ ID NO: 1303117 - protein, 9 aa, Homo Sapiens
IDSMPAASS

SEQ ID NO: 1303118 - protein, 9 aa, Homo Sapiens
ACPGRDWRT

SEQ ID NO: 1303119 - protein, 9 aa, Homo Sapiens
KCGSEVTTR

SEQ ID NO: 1303120 - protein, 9 aa, Homo Sapiens
EHDNKSDSE

SEQ ID NO: 1303121 - protein, 9 aa, Homo Sapiens
GHLDGDCKE

SEQ ID NO: 1303122 - protein, 9 aa, Homo Sapiens
GGGCGRKLL

SEQ ID NO: 1303123 - protein, 9 aa, Homo Sapiens
RRPEDPRAA

SEQ ID NO: 1303124 - protein, 9 aa, Homo Sapiens
NLLNLHVIK

SEQ ID NO: 1303125 - protein, 9 aa, Homo Sapiens
HLVRVKEAP

SEQ ID NO: 1303126 - protein, 9 aa, Homo Sapiens
IVNVGDAND

SEQ ID NO: 1303127 - protein, 9 aa, Homo Sapiens
LPTRVYSTE

SEQ ID NO: 1303128 - protein, 9 aa, Homo Sapiens
YHVETKVDG

SEQ ID NO: 1303129 - protein, 9 aa, Homo Sapiens
DLFHHPILH

SEQ ID NO: 1303130 - protein, 9 aa, Homo Sapiens
QQSVQDIYK

SEQ ID NO: 1303131 - protein, 9 aa, Homo Sapiens
RPLLLVTPQ

SEQ ID NO: 1303132 - protein, 9 aa, Homo Sapiens
FRRPEDPRA

SEQ ID NO: 1303133 - protein, 9 aa, Homo Sapiens
RKWRYKAFS

SEQ ID NO: 1303134 - protein, 9 aa, Homo Sapiens
QQQCHSPQN

SEQ ID NO: 1303135 - protein, 9 aa, Homo Sapiens
VKAVEHIFE

SEQ ID NO: 1303136 - protein, 9 aa, Homo Sapiens
DSPKAFMLL

SEQ ID NO: 1303137 - protein, 9 aa, Homo Sapiens
SSYLSSFCK

SEQ ID NO: 1303138 - protein, 9 aa, Homo Sapiens
APLLPTRVY

SEQ ID NO: 1303139 - protein, 9 aa, Homo Sapiens
PGEAGQPGL

SEQ ID NO: 1303140 - protein, 9 aa, Homo Sapiens
VESKGNKMK

SEQ ID NO: 1303141 - protein, 9 aa, Homo Sapiens
STNSTRQIL

SEQ ID NO: 1303142 - protein, 9 aa, Homo Sapiens
LLLLHHVFL

SEQ ID NO: 1303143 - protein, 9 aa, Homo Sapiens
GGGGCGRKL

SEQ ID NO: 1303144 - protein, 9 aa, Homo Sapiens
SSDSVSVGL

SEQ ID NO: 1303145 - protein, 9 aa, Homo Sapiens
MKNLILLLA

SEQ ID NO: 1303146 - protein, 9 aa, Homo Sapiens
EQEKIVVQK

SEQ ID NO: 1303147 - protein, 9 aa, Homo Sapiens
STRQILHLQ

SEQ ID NO: 1303148 - protein, 9 aa, Homo Sapiens
TGNRQQPPQ

SEQ ID NO: 1303149 - protein, 9 aa, Homo Sapiens
ALAELNVSC

SEQ ID NO: 1303150 - protein, 9 aa, Homo Sapiens
WHHDDFNYE

SEQ ID NO: 1303151 - protein, 9 aa, Homo Sapiens
FKNVAVIFT

SEQ ID NO: 1303152 - protein, 9 aa, Homo Sapiens
MHTGKRPYT

SEQ ID NO: 1303153 - protein, 9 aa, Homo Sapiens
PVAAPPLFR

SEQ ID NO: 1303154 - protein, 9 aa, Homo Sapiens
CTLKLCQST

SEQ ID NO: 1303155 - protein, 9 aa, Homo Sapiens
MKMTFKDLG

SEQ ID NO: 1303156 - protein, 9 aa, Homo Sapiens
TQYVMEQEL

SEQ ID NO: 1303157 - protein, 9 aa, Homo Sapiens
GSEVTTREN

SEQ ID NO: 1303158 - protein, 9 aa, Homo Sapiens
QDLFHHPIL

SEQ ID NO: 1303159 - protein, 9 aa, Homo Sapiens
KALLLGARA

SEQ ID NO: 1303160 - protein, 9 aa, Homo Sapiens
PGAGRGGSR

SEQ ID NO: 1303161 - protein, 9 aa, Homo Sapiens
PLAQCLCSM

SEQ ID NO: 1303162 - protein, 9 aa, Homo Sapiens
SSTQELPCM

SEQ ID NO: 1303163 - protein, 9 aa, Homo Sapiens
VALCEIRRY

SEQ ID NO: 1303164 - protein, 9 aa, Homo Sapiens
IHLDLHFSL

SEQ ID NO: 1303165 - protein, 9 aa, Homo Sapiens
WLLILSYVG

SEQ ID NO: 1303166 - protein, 9 aa, Homo Sapiens
QQKAEIEKQ

SEQ ID NO: 1303167 - protein, 9 aa, Homo Sapiens
LCPMLRTAL

SEQ ID NO: 1303168 - protein, 9 aa, Homo Sapiens
VEIDSMPAA

SEQ ID NO: 1303169 - protein, 9 aa, Homo Sapiens
KYNSWHHDD

SEQ ID NO: 1303170 - protein, 9 aa, Homo Sapiens
WFWAGDRPY

SEQ ID NO: 1303171 - protein, 9 aa, Homo Sapiens
SFPNCEKWR

SEQ ID NO: 1303172 - protein, 9 aa, Homo Sapiens
QEVEKKQGW

SEQ ID NO: 1303173 - protein, 9 aa, Homo Sapiens
HRRCSAVSW

SEQ ID NO: 1303174 - protein, 9 aa, Homo Sapiens
SGSSSICAT

SEQ ID NO: 1303175 - protein, 9 aa, Homo Sapiens
EMELLTFRD

SEQ ID NO: 1303176 - protein, 9 aa, Homo Sapiens
VGPAEFDAI

SEQ ID NO: 1303177 - protein, 9 aa, Homo Sapiens
EVDADGDMI

SEQ ID NO: 1303178 - protein, 9 aa, Homo Sapiens
GASTRPQSC

SEQ ID NO: 1303179 - protein, 9 aa, Homo Sapiens
WPTQDPAKP

SEQ ID NO: 1303180 - protein, 9 aa, Homo Sapiens
QNLNEEFLR

SEQ ID NO: 1303181 - protein, 9 aa, Homo Sapiens
EKYRQQKAE

SEQ ID NO: 1303182 - protein, 9 aa, Homo Sapiens
WRYKAFSTC

SEQ ID NO: 1303183 - protein, 9 aa, Homo Sapiens
GDMIAVSNL

SEQ ID NO: 1303184 - protein, 9 aa, Homo Sapiens
PDFSAEVIV

SEQ ID NO: 1303185 - protein, 9 aa, Homo Sapiens
CCLSHHRPH

SEQ ID NO: 1303186 - protein, 9 aa, Homo Sapiens
AGDWRPEKS

SEQ ID NO: 1303187 - protein, 9 aa, Homo Sapiens
IHSHLPNQD

SEQ ID NO: 1303188 - protein, 9 aa, Homo Sapiens
EEAVTFKNV

SEQ ID NO: 1303189 - protein, 9 aa, Homo Sapiens
TSLEHPASL

SEQ ID NO: 1303190 - protein, 9 aa, Homo Sapiens
NLRQNMKNL

SEQ ID NO: 1303191 - protein, 9 aa, Homo Sapiens
DVLYHVETK

SEQ ID NO: 1303192 - protein, 9 aa, Homo Sapiens
SCGGNWYRL

SEQ ID NO: 1303193 - protein, 9 aa, Homo Sapiens
LCSLTHLSL

SEQ ID NO: 1303194 - protein, 9 aa, Homo Sapiens
RLTTPRGSL

SEQ ID NO: 1303195 - protein, 9 aa, Homo Sapiens
VIEREGLMY

SEQ ID NO: 1303196 - protein, 9 aa, Homo Sapiens
SLQSSDSVS

SEQ ID NO: 1303197 - protein, 9 aa, Homo Sapiens
CPAIGSSNC

SEQ ID NO: 1303198 - protein, 9 aa, Homo Sapiens
LAEIMVVKA

SEQ ID NO: 1303199 - protein, 9 aa, Homo Sapiens
VNFRRPEDP

SEQ ID NO: 1303200 - protein, 9 aa, Homo Sapiens
KMKMTFKDL

SEQ ID NO: 1303201 - protein, 9 aa, Homo Sapiens
DSVSVGLCK

SEQ ID NO: 1303202 - protein, 9 aa, Homo Sapiens
SSYLLVGVC

SEQ ID NO: 1303203 - protein, 9 aa, Homo Sapiens
IEVWPTQDP

SEQ ID NO: 1303204 - protein, 9 aa, Homo Sapiens
RVIVNVGDA

SEQ ID NO: 1303205 - protein, 9 aa, Homo Sapiens
WKNLLNLHV

SEQ ID NO: 1303206 - protein, 9 aa, Homo Sapiens
NVKRHLKRS

SEQ ID NO: 1303207 - protein, 9 aa, Homo Sapiens
RQNMKNLIL

SEQ ID NO: 1303208 - protein, 9 aa, Homo Sapiens
KVDGRRSPP

SEQ ID NO: 1303209 - protein, 9 aa, Homo Sapiens
RVKEAPGDH

SEQ ID NO: 1303210 - protein, 9 aa, Homo Sapiens
VAAPPLFRS

SEQ ID NO: 1303211 - protein, 9 aa, Homo Sapiens
TLFLLLMAQ

SEQ ID NO: 1303212 - protein, 9 aa, Homo Sapiens
ASEENSRNS

SEQ ID NO: 1303213 - protein, 9 aa, Homo Sapiens
PLLHPMVQG

SEQ ID NO: 1303214 - protein, 9 aa, Homo Sapiens
NHTLFLLLM

SEQ ID NO: 1303215 - protein, 9 aa, Homo Sapiens
HLDGDCKEV

SEQ ID NO: 1303216 - protein, 9 aa, Homo Sapiens
SPKIQQQKF

SEQ ID NO: 1303217 - protein, 9 aa, Homo Sapiens
EGKDSKKQK

SEQ ID NO: 1303218 - protein, 9 aa, Homo Sapiens
YQLLRRNNS

SEQ ID NO: 1303219 - protein, 9 aa, Homo Sapiens
PLLPTRVYS

SEQ ID NO: 1303220 - protein, 9 aa, Homo Sapiens
VDADGDMIA

SEQ ID NO: 1303221 - protein, 9 aa, Homo Sapiens
VTVQPGCYL

SEQ ID NO: 1303222 - protein, 9 aa, Homo Sapiens
VWLQFCCDQ

SEQ ID NO: 1303223 - protein, 9 aa, Homo Sapiens
WYRLLNSHA

SEQ ID NO: 1303224 - protein, 9 aa, Homo Sapiens
KLCQSTGLM

SEQ ID NO: 1303225 - protein, 9 aa, Homo Sapiens
SQVLFMATA

SEQ ID NO: 1303226 - protein, 9 aa, Homo Sapiens
SFCKGMVTA

SEQ ID NO: 1303227 - protein, 9 aa, Homo Sapiens
GVLEETEFY

SEQ ID NO: 1303228 - protein, 9 aa, Homo Sapiens
LKEGKDSKK

SEQ ID NO: 1303229 - protein, 9 aa, Homo Sapiens
LGKTKIFIC

SEQ ID NO: 1303230 - protein, 9 aa, Homo Sapiens
LHNDQEVEK

SEQ ID NO: 1303231 - protein, 9 aa, Homo Sapiens
GGPGGGGGC

SEQ ID NO: 1303232 - protein, 9 aa, Homo Sapiens
WRQPGPGAD

SEQ ID NO: 1303233 - protein, 9 aa, Homo Sapiens
EAVTFKNVA

SEQ ID NO: 1303234 - protein, 9 aa, Homo Sapiens
HVETKVDGR

SEQ ID NO: 1303235 - protein, 9 aa, Homo Sapiens
AVCSIPALA

SEQ ID NO: 1303236 - protein, 9 aa, Homo Sapiens
LLMAQVIHS

SEQ ID NO: 1303237 - protein, 9 aa, Homo Sapiens
LVGTSQNLN

SEQ ID NO: 1303238 - protein, 9 aa, Homo Sapiens
GLKEGKDSK

SEQ ID NO: 1303239 - protein, 9 aa, Homo Sapiens
YTCCCPQGY

SEQ ID NO: 1303240 - protein, 9 aa, Homo Sapiens
MPNNNGSSM

SEQ ID NO: 1303241 - protein, 9 aa, Homo Sapiens
ECKSILLDM

SEQ ID NO: 1303242 - protein, 9 aa, Homo Sapiens
STRPQSCLW

SEQ ID NO: 1303243 - protein, 9 aa, Homo Sapiens
QSPGLLNEP

SEQ ID NO: 1303244 - protein, 9 aa, Homo Sapiens
MTSQGLVSF

SEQ ID NO: 1303245 - protein, 9 aa, Homo Sapiens
AGKEPYTCD

SEQ ID NO: 1303246 - protein, 9 aa, Homo Sapiens
CQDIKPCIM

SEQ ID NO: 1303247 - protein, 9 aa, Homo Sapiens
LRQNMKNLI

SEQ ID NO: 1303248 - protein, 9 aa, Homo Sapiens
TVQPGCYLP

SEQ ID NO: 1303249 - protein, 9 aa, Homo Sapiens
LIGQKICIL

SEQ ID NO: 1303250 - protein, 9 aa, Homo Sapiens
PPRSLEMEL

SEQ ID NO: 1303251 - protein, 9 aa, Homo Sapiens
VLYHVETKV

SEQ ID NO: 1303252 - protein, 9 aa, Homo Sapiens
HVIKKKNKP

SEQ ID NO: 1303253 - protein, 9 aa, Homo Sapiens
DHWLLLLHH

SEQ ID NO: 1303254 - protein, 9 aa, Homo Sapiens
FHHPILHPM

SEQ ID NO: 1303255 - protein, 9 aa, Homo Sapiens
GLCIWLLIL

SEQ ID NO: 1303256 - protein, 9 aa, Homo Sapiens
SPLIMPNNN

SEQ ID NO: 1303257 - protein, 9 aa, Homo Sapiens
HPMVQGEFN

SEQ ID NO: 1303258 - protein, 9 aa, Homo Sapiens
TTPVYSNTP

SEQ ID NO: 1303259 - protein, 9 aa, Homo Sapiens
RQVESHVGL

SEQ ID NO: 1303260 - protein, 9 aa, Homo Sapiens
HLPNQDPIH

SEQ ID NO: 1303261 - protein, 9 aa, Homo Sapiens
APPPPAPTA

SEQ ID NO: 1303262 - protein, 9 aa, Homo Sapiens
TWDSLSGTP

SEQ ID NO: 1303263 - protein, 9 aa, Homo Sapiens
VSPLIMPNN

SEQ ID NO: 1303264 - protein, 9 aa, Homo Sapiens
QPLAQCLCS

SEQ ID NO: 1303265 - protein, 9 aa, Homo Sapiens
KNVAVIFTE

SEQ ID NO: 1303266 - protein, 9 aa, Homo Sapiens
YPLSSSGLI

SEQ ID NO: 1303267 - protein, 9 aa, Homo Sapiens
PVYSNTPFT

SEQ ID NO: 1303268 - protein, 9 aa, Homo Sapiens
AKNEHRRCS

SEQ ID NO: 1303269 - protein, 9 aa, Homo Sapiens
REQEKIVVQ

SEQ ID NO: 1303270 - protein, 9 aa, Homo Sapiens
RQQPPQQNT

SEQ ID NO: 1303271 - protein, 9 aa, Homo Sapiens
RENSSSPGM

SEQ ID NO: 1303272 - protein, 9 aa, Homo Sapiens
KDMPTSLHY

SEQ ID NO: 1303273 - protein, 9 aa, Homo Sapiens
EKSPCSNVV

SEQ ID NO: 1303274 - protein, 9 aa, Homo Sapiens
KLILPCIMG

SEQ ID NO: 1303275 - protein, 9 aa, Homo Sapiens
IQQSVQDIY

SEQ ID NO: 1303276 - protein, 9 aa, Homo Sapiens
GLCSLTHLS

SEQ ID NO: 1303277 - protein, 9 aa, Homo Sapiens
RILHNDQEV

SEQ ID NO: 1303278 - protein, 9 aa, Homo Sapiens
MATANTTAT

SEQ ID NO: 1303279 - protein, 9 aa, Homo Sapiens
SKKRGSLYQ

SEQ ID NO: 1303280 - protein, 9 aa, Homo Sapiens
TNGLCIWLL

SEQ ID NO: 1303281 - protein, 9 aa, Homo Sapiens
CKEVSPIFT

SEQ ID NO: 1303282 - protein, 9 aa, Homo Sapiens
SRKWRYKAF

SEQ ID NO: 1303283 - protein, 9 aa, Homo Sapiens
NSNSAWMLG

SEQ ID NO: 1303284 - protein, 9 aa, Homo Sapiens
PNCEKWRRL

SEQ ID NO: 1303285 - protein, 9 aa, Homo Sapiens
LTGVMICAY

SEQ ID NO: 1303286 - protein, 9 aa, Homo Sapiens
DGDCKEVSP

SEQ ID NO: 1303287 - protein, 9 aa, Homo Sapiens
AQESNYQLL

SEQ ID NO: 1303288 - protein, 9 aa, Homo Sapiens
HHPILHPMV

SEQ ID NO: 1303289 - protein, 9 aa, Homo Sapiens
NNNGSSMDD

SEQ ID NO: 1303290 - protein, 9 aa, Homo Sapiens
FPNCEKWRR

SEQ ID NO: 1303291 - protein, 9 aa, Homo Sapiens
YIGIRHWLL

SEQ ID NO: 1303292 - protein, 9 aa, Homo Sapiens
MVQGESHHP

SEQ ID NO: 1303293 - protein, 9 aa, Homo Sapiens
MEQELADLP

SEQ ID NO: 1303294 - protein, 9 aa, Homo Sapiens
GLSFRLDSM

SEQ ID NO: 1303295 - protein, 9 aa, Homo Sapiens
SLEMELLTF

SEQ ID NO: 1303296 - protein, 9 aa, Homo Sapiens
SPPMKRSCP

SEQ ID NO: 1303297 - protein, 9 aa, Homo Sapiens
DSMLRAHRL

SEQ ID NO: 1303298 - protein, 9 aa, Homo Sapiens
LLNLHVIKK

SEQ ID NO: 1303299 - protein, 9 aa, Homo Sapiens
RPQSCLWKL

SEQ ID NO: 1303300 - protein, 9 aa, Homo Sapiens
LHPMVQGES

SEQ ID NO: 1303301 - protein, 9 aa, Homo Sapiens
SSPGDTGKE

SEQ ID NO: 1303302 - protein, 9 aa, Homo Sapiens
PGRDWRTEE

SEQ ID NO: 1303303 - protein, 9 aa, Homo Sapiens
SLSGTPVQS

SEQ ID NO: 1303304 - protein, 9 aa, Homo Sapiens
NYTCCCPQG

SEQ ID NO: 1303305 - protein, 9 aa, Homo Sapiens
LFHHPILHP

SEQ ID NO: 1303306 - protein, 9 aa, Homo Sapiens
QCSFPNCEK

SEQ ID NO: 1303307 - protein, 9 aa, Homo Sapiens
QKICILWDH

SEQ ID NO: 1303308 - protein, 9 aa, Homo Sapiens
ESKGNKMKM

SEQ ID NO: 1303309 - protein, 9 aa, Homo Sapiens
TGKRPYTCT

SEQ ID NO: 1303310 - protein, 9 aa, Homo Sapiens
HPMVQGESH

SEQ ID NO: 1303311 - protein, 9 aa, Homo Sapiens
SEVTTRENS

SEQ ID NO: 1303312 - protein, 9 aa, Homo Sapiens
NRILHNDQE

SEQ ID NO: 1303313 - protein, 9 aa, Homo Sapiens
KNEHRRCSA

SEQ ID NO: 1303314 - protein, 9 aa, Homo Sapiens
QVLFMATAN

SEQ ID NO: 1303315 - protein, 9 aa, Homo Sapiens
EKIVVQKKL

SEQ ID NO: 1303316 - protein, 9 aa, Homo Sapiens
AQPLAQCLC

SEQ ID NO: 1303317 - protein, 9 aa, Homo Sapiens
HCTLKLCQS

SEQ ID NO: 1303318 - protein, 9 aa, Homo Sapiens
WELLCPMLR

SEQ ID NO: 1303319 - protein, 9 aa, Homo Sapiens
PCIMGYFAG

SEQ ID NO: 1303320 - protein, 9 aa, Homo Sapiens
QRLREKKFD

SEQ ID NO: 1303321 - protein, 9 aa, Homo Sapiens
SSICATSGV

SEQ ID NO: 1303322 - protein, 9 aa, Homo Sapiens
LSGLSIEKV

SEQ ID NO: 1303323 - protein, 9 aa, Homo Sapiens
APGDHIHLD

SEQ ID NO: 1303324 - protein, 9 aa, Homo Sapiens
STSQSPPMK

SEQ ID NO: 1303325 - protein, 9 aa, Homo Sapiens
QKMMTSQGL

SEQ ID NO: 1303326 - protein, 9 aa, Homo Sapiens
HHDDFNYER

SEQ ID NO: 1303327 - protein, 9 aa, Homo Sapiens
TSQGLVSFK

SEQ ID NO: 1303328 - protein, 9 aa, Homo Sapiens
SWRQPGPGA

SEQ ID NO: 1303329 - protein, 9 aa, Homo Sapiens
PAQPLAQCL

SEQ ID NO: 1303330 - protein, 9 aa, Homo Sapiens
ELPCMIWPK

SEQ ID NO: 1303331 - protein, 9 aa, Homo Sapiens
THLAEIMVV

SEQ ID NO: 1303332 - protein, 9 aa, Homo Sapiens
AQCLCSMVC

SEQ ID NO: 1303333 - protein, 9 aa, Homo Sapiens
HTGKRPYTC

SEQ ID NO: 1303334 - protein, 9 aa, Homo Sapiens
ILRMNSRKW

SEQ ID NO: 1303335 - protein, 9 aa, Homo Sapiens
VNVGDANDH

SEQ ID NO: 1303336 - protein, 9 aa, Homo Sapiens
NFRRPEDPR

SEQ ID NO: 1303337 - protein, 9 aa, Homo Sapiens
LPSAPVSLA

SEQ ID NO: 1303338 - protein, 9 aa, Homo Sapiens
FVLYGVTTS

SEQ ID NO: 1303339 - protein, 9 aa, Homo Sapiens
VIVNVGDAN

SEQ ID NO: 1303340 - protein, 9 aa, Homo Sapiens
CCCPQGYQL

SEQ ID NO: 1303341 - protein, 9 aa, Homo Sapiens
GKTKIFICF

SEQ ID NO: 1303342 - protein, 9 aa, Homo Sapiens
YRQVESHVG

SEQ ID NO: 1303343 - protein, 9 aa, Homo Sapiens
ETKVDGRRS

SEQ ID NO: 1303344 - protein, 9 aa, Homo Sapiens
DSLSGTPVQ

SEQ ID NO: 1303345 - protein, 9 aa, Homo Sapiens
TLKLCQSTG

SEQ ID NO: 1303346 - protein, 9 aa, Homo Sapiens
SHHPLLHPM

SEQ ID NO: 1303347 - protein, 9 aa, Homo Sapiens
DFLPKWLNP

SEQ ID NO: 1303348 - protein, 9 aa, Homo Sapiens
FLPKWLNPE

SEQ ID NO: 1303349 - protein, 9 aa, Homo Sapiens
HLKRSVWIN

SEQ ID NO: 1303350 - protein, 9 aa, Homo Sapiens
VWPTQDPAK

SEQ ID NO: 1303351 - protein, 9 aa, Homo Sapiens
TFKNVAVIF

SEQ ID NO: 1303352 - protein, 9 aa, Homo Sapiens
GEAGQPGLP

SEQ ID NO: 1303353 - protein, 9 aa, Homo Sapiens
KQCTVYPLS

SEQ ID NO: 1303354 - protein, 9 aa, Homo Sapiens
LQHPWIQGC

SEQ ID NO: 1303355 - protein, 9 aa, Homo Sapiens
GKGLTGVMI

SEQ ID NO: 1303356 - protein, 9 aa, Homo Sapiens
KDGGNPDFS

SEQ ID NO: 1303357 - protein, 9 aa, Homo Sapiens
WLAFCHSNV

SEQ ID NO: 1303358 - protein, 9 aa, Homo Sapiens
GKNYTCCCP

SEQ ID NO: 1303359 - protein, 9 aa, Homo Sapiens
CSIPALAEL

SEQ ID NO: 1303360 - protein, 9 aa, Homo Sapiens
KAFSHFSTL

SEQ ID NO: 1303361 - protein, 9 aa, Homo Sapiens
LGLWALAAV

SEQ ID NO: 1303362 - protein, 9 aa, Homo Sapiens
QCTVYPLSS

SEQ ID NO: 1303363 - protein, 9 aa, Homo Sapiens
LAPEDENSN

SEQ ID NO: 1303364 - protein, 9 aa, Homo Sapiens
AKDMPTSLH

SEQ ID NO: 1303365 - protein, 9 aa, Homo Sapiens
IHAGKEPYT

SEQ ID NO: 1303366 - protein, 9 aa, Homo Sapiens
NGLCIWLLI

SEQ ID NO: 1303367 - protein, 9 aa, Homo Sapiens
DDYTQYVME

SEQ ID NO: 1303368 - protein, 9 aa, Homo Sapiens
LFMATANTT

SEQ ID NO: 1303369 - protein, 9 aa, Homo Sapiens
EREGLMYYN

SEQ ID NO: 1303370 - protein, 9 aa, Homo Sapiens
AVTFKNVAV

SEQ ID NO: 1303371 - protein, 9 aa, Homo Sapiens
FSCHADPAH

SEQ ID NO: 1303372 - protein, 9 aa, Homo Sapiens
QGGASTRPQ

SEQ ID NO: 1303373 - protein, 9 aa, Homo Sapiens
PSAPVSLAS

SEQ ID NO: 1303374 - protein, 9 aa, Homo Sapiens
PEDPRAAKH

SEQ ID NO: 1303375 - protein, 9 aa, Homo Sapiens
GGSRGLGRG

SEQ ID NO: 1303376 - protein, 9 aa, Homo Sapiens
SHLVRVKEA

SEQ ID NO: 1303377 - protein, 9 aa, Homo Sapiens
NHCTLKLCQ

SEQ ID NO: 1303378 - protein, 9 aa, Homo Sapiens
STQELPCMI

SEQ ID NO: 1303379 - protein, 9 aa, Homo Sapiens
GEFNHTLFL

SEQ ID NO: 1303380 - protein, 9 aa, Homo Sapiens
RGLCSLTHL

SEQ ID NO: 1303381 - protein, 9 aa, Homo Sapiens
PIHLDLHFS

SEQ ID NO: 1303382 - protein, 9 aa, Homo Sapiens
EETAKDKVL

SEQ ID NO: 1303383 - protein, 9 aa, Homo Sapiens
KWLAFCHSN

SEQ ID NO: 1303384 - protein, 9 aa, Homo Sapiens
RCSAVSWVK

SEQ ID NO: 1303385 - protein, 9 aa, Homo Sapiens
SPMNLKHPD

SEQ ID NO: 1303386 - protein, 9 aa, Homo Sapiens
LLEEQKMMT

SEQ ID NO: 1303387 - protein, 9 aa, Homo Sapiens
VFLLEQDLF

SEQ ID NO: 1303388 - protein, 9 aa, Homo Sapiens
KLWELLCPM

SEQ ID NO: 1303389 - protein, 9 aa, Homo Sapiens
RLLNSHATL

SEQ ID NO: 1303390 - protein, 9 aa, Homo Sapiens
TAKDKVLKD

SEQ ID NO: 1303391 - protein, 9 aa, Homo Sapiens
SNVLEETAK

SEQ ID NO: 1303392 - protein, 9 aa, Homo Sapiens
APVSLASPA

SEQ ID NO: 1303393 - protein, 9 aa, Homo Sapiens
LGARALTAV

SEQ ID NO: 1303394 - protein, 9 aa, Homo Sapiens
LKLCQSTGL

SEQ ID NO: 1303395 - protein, 9 aa, Homo Sapiens
APGEAGQPG

SEQ ID NO: 1303396 - protein, 9 aa, Homo Sapiens
QHPWIQGCA

SEQ ID NO: 1303397 - protein, 9 aa, Homo Sapiens
LEETEFYNI

SEQ ID NO: 1303398 - protein, 9 aa, Homo Sapiens
VAKDGGNPD

SEQ ID NO: 1303399 - protein, 9 aa, Homo Sapiens
RLDSMLRAH

SEQ ID NO: 1303400 - protein, 9 aa, Homo Sapiens
TEHDNKSDS

SEQ ID NO: 1303401 - protein, 9 aa, Homo Sapiens
VIHSHLPNQ

SEQ ID NO: 1303402 - protein, 9 aa, Homo Sapiens
LSQVLFMAT

SEQ ID NO: 1303403 - protein, 9 aa, Homo Sapiens
CGRKLLLPT

SEQ ID NO: 1303404 - protein, 9 aa, Homo Sapiens
GGGGGCGRK

SEQ ID NO: 1303405 - protein, 9 aa, Homo Sapiens
SAPVSLASP

SEQ ID NO: 1303406 - protein, 9 aa, Homo Sapiens
RPVAAPPLF

SEQ ID NO: 1303407 - protein, 9 aa, Homo Sapiens
TAPRPGPAQ

SEQ ID NO: 1303408 - protein, 9 aa, Homo Sapiens
PAEFDAIVE

SEQ ID NO: 1303409 - protein, 9 aa, Homo Sapiens
WDSLSGTPV

SEQ ID NO: 1303410 - protein, 9 aa, Homo Sapiens
WTKRHVWVW

SEQ ID NO: 1303411 - protein, 9 aa, Homo Sapiens
YWFWAGDRP

SEQ ID NO: 1303412 - protein, 9 aa, Homo Sapiens
MSKKRGSLY

SEQ ID NO: 1303413 - protein, 9 aa, Homo Sapiens
RSVWINADI

SEQ ID NO: 1303414 - protein, 9 aa, Homo Sapiens
NDEGEDNST

SEQ ID NO: 1303415 - protein, 9 aa, Homo Sapiens
PCPAIGSSN

SEQ ID NO: 1303416 - protein, 9 aa, Homo Sapiens
GNPDFSAEV

SEQ ID NO: 1303417 - protein, 9 aa, Homo Sapiens
SSRLTTPRG

SEQ ID NO: 1303418 - protein, 9 aa, Homo Sapiens
LVRVKEAPG

SEQ ID NO: 1303419 - protein, 9 aa, Homo Sapiens
LLIKWLAFC

SEQ ID NO: 1303420 - protein, 9 aa, Homo Sapiens
DVQSPGLLN

SEQ ID NO: 1303421 - protein, 9 aa, Homo Sapiens
AFSHFSTLA

SEQ ID NO: 1303422 - protein, 9 aa, Homo Sapiens
EKYNSWHHD

SEQ ID NO: 1303423 - protein, 9 aa, Homo Sapiens
MQAKTLFPS

SEQ ID NO: 1303424 - protein, 9 aa, Homo Sapiens
ARSWRQPGP

SEQ ID NO: 1303425 - protein, 9 aa, Homo Sapiens
LDGDCKEVS

SEQ ID NO: 1303426 - protein, 9 aa, Homo Sapiens
KMMTSQGLV

SEQ ID NO: 1303427 - protein, 9 aa, Homo Sapiens
CIWLLILSY

SEQ ID NO: 1303428 - protein, 9 aa, Homo Sapiens
DYTQYVMEQ

SEQ ID NO: 1303429 - protein, 9 aa, Homo Sapiens
SVSVGLCKG

SEQ ID NO: 1303430 - protein, 9 aa, Homo Sapiens
KTKIFICFP

SEQ ID NO: 1303431 - protein, 9 aa, Homo Sapiens
ICFPRTLFA

SEQ ID NO: 1303432 - protein, 9 aa, Homo Sapiens
WIQGCAPEN

SEQ ID NO: 1303433 - protein, 9 aa, Homo Sapiens
SVGLCKGSL

SEQ ID NO: 1303434 - protein, 9 aa, Homo Sapiens
CQSTGLMEY

SEQ ID NO: 1303435 - protein, 9 aa, Homo Sapiens
AGKGLTGVM

SEQ ID NO: 1303436 - protein, 9 aa, Homo Sapiens
IIHAGKEPY

SEQ ID NO: 1303437 - protein, 9 aa, Homo Sapiens
AAPPLFRST

SEQ ID NO: 1303438 - protein, 9 aa, Homo Sapiens
TQLIIQQSV

SEQ ID NO: 1303439 - protein, 9 aa, Homo Sapiens
EGLKEGKDS

SEQ ID NO: 1303440 - protein, 9 aa, Homo Sapiens
PMVQGDFHH

SEQ ID NO: 1303441 - protein, 9 aa, Homo Sapiens
SSCRECMES

SEQ ID NO: 1303442 - protein, 9 aa, Homo Sapiens
FVIEREGLM

SEQ ID NO: 1303443 - protein, 9 aa, Homo Sapiens
HVWVWLQFC

SEQ ID NO: 1303444 - protein, 9 aa, Homo Sapiens
PKLILPCIM

SEQ ID NO: 1303445 - protein, 9 aa, Homo Sapiens
PESPAFSCH

SEQ ID NO: 1303446 - protein, 9 aa, Homo Sapiens
EIMVVKAVE

SEQ ID NO: 1303447 - protein, 9 aa, Homo Sapiens
GTVALCEIR

SEQ ID NO: 1303448 - protein, 9 aa, Homo Sapiens
ESSTQELPC

SEQ ID NO: 1303449 - protein, 9 aa, Homo Sapiens
SIPKLILPC

SEQ ID NO: 1303450 - protein, 9 aa, Homo Sapiens
DHIHLDHWL

SEQ ID NO: 1303451 - protein, 9 aa, Homo Sapiens
GDWRPEKSP

SEQ ID NO: 1303452 - protein, 9 aa, Homo Sapiens
EEGVLEETE

SEQ ID NO: 1303453 - protein, 9 aa, Homo Sapiens
LPCIMGYFA

SEQ ID NO: 1303454 - protein, 9 aa, Homo Sapiens
VHGYWFWAG

SEQ ID NO: 1303455 - protein, 9 aa, Homo Sapiens
FKRRECKSI

SEQ ID NO: 1303456 - protein, 9 aa, Homo Sapiens
PEDENSNSA

SEQ ID NO: 1303457 - protein, 9 aa, Homo Sapiens
VVKAVEHIF

SEQ ID NO: 1303458 - protein, 9 aa, Homo Sapiens
FREQEKIVV

SEQ ID NO: 1303459 - protein, 9 aa, Homo Sapiens
SKYRQVESH

SEQ ID NO: 1303460 - protein, 9 aa, Homo Sapiens
VLEETEFYN

SEQ ID NO: 1303461 - protein, 9 aa, Homo Sapiens
ALLLGARAL

SEQ ID NO: 1303462 - protein, 9 aa, Homo Sapiens
LGDSPKAFM

SEQ ID NO: 1303463 - protein, 9 aa, Homo Sapiens
PSSYLLVGV

SEQ ID NO: 1303464 - protein, 9 aa, Homo Sapiens
HPDDLVILM

SEQ ID NO: 1303465 - protein, 9 aa, Homo Sapiens
MNLKHPDDL

SEQ ID NO: 1303466 - protein, 9 aa, Homo Sapiens
PAFSCHADP

SEQ ID NO: 1303467 - protein, 9 aa, Homo Sapiens
YNSWHHDDF

SEQ ID NO: 1303468 - protein, 9 aa, Homo Sapiens
QQCHSPQNG

SEQ ID NO: 1303469 - protein, 9 aa, Homo Sapiens
NLKHPDDLV

SEQ ID NO: 1303470 - protein, 9 aa, Homo Sapiens
RGSLYQLID

SEQ ID NO: 1303471 - protein, 9 aa, Homo Sapiens
ESDAPLLPT

SEQ ID NO: 1303472 - protein, 9 aa, Homo Sapiens
REGLMYYNR

SEQ ID NO: 1303473 - protein, 9 aa, Homo Sapiens
TCCCPQGYQ

SEQ ID NO: 1303474 - protein, 9 aa, Homo Sapiens
GLTGVMICA

SEQ ID NO: 1303475 - protein, 9 aa, Homo Sapiens
CILWDHPMS

SEQ ID NO: 1303476 - protein, 9 aa, Homo Sapiens
GKAFSHFST

SEQ ID NO: 1303477 - protein, 9 aa, Homo Sapiens
STLSTTPVY

SEQ ID NO: 1303478 - protein, 9 aa, Homo Sapiens
EVTTRENSS

SEQ ID NO: 1303479 - protein, 9 aa, Homo Sapiens
CGGNWYRLL

SEQ ID NO: 1303480 - protein, 9 aa, Homo Sapiens
QASEENSRN

SEQ ID NO: 1303481 - protein, 9 aa, Homo Sapiens
LVTPQRLRE

SEQ ID NO: 1303482 - protein, 9 aa, Homo Sapiens
TKVDGRRSP

SEQ ID NO: 1303483 - protein, 9 aa, Homo Sapiens
GSIPKLILP

SEQ ID NO: 1303484 - protein, 9 aa, Homo Sapiens
GHYAVVCSI

SEQ ID NO: 1303485 - protein, 9 aa, Homo Sapiens
VSSCRECME

SEQ ID NO: 1303486 - protein, 9 aa, Homo Sapiens
EVESKGNKM

SEQ ID NO: 1303487 - protein, 9 aa, Homo Sapiens
GQKICILWD

SEQ ID NO: 1303488 - protein, 9 aa, Homo Sapiens
TRQQQCHSP

SEQ ID NO: 1303489 - protein, 9 aa, Homo Sapiens
REVDADGDM

SEQ ID NO: 1303490 - protein, 9 aa, Homo Sapiens
DWRPEKSPC

SEQ ID NO: 1303491 - protein, 9 aa, Homo Sapiens
KSYAKDMPT

SEQ ID NO: 1303492 - protein, 9 aa, Homo Sapiens
HFAAVVLQV

SEQ ID NO: 1303493 - protein, 9 aa, Homo Sapiens
SWHHDDFNY

SEQ ID NO: 1303494 - protein, 9 aa, Homo Sapiens
PMNLKHPDD

SEQ ID NO: 1303495 - protein, 9 aa, Homo Sapiens
STTVSIVGR

SEQ ID NO: 1303496 - protein, 9 aa, Homo Sapiens
PGLLNEPLS

SEQ ID NO: 1303497 - protein, 9 aa, Homo Sapiens
QEKIVVQKK

SEQ ID NO: 1303498 - protein, 9 aa, Homo Sapiens
CSLTHLSLA

SEQ ID NO: 1303499 - protein, 9 aa, Homo Sapiens
PGGGGGCGR

SEQ ID NO: 1303500 - protein, 9 aa, Homo Sapiens
AVMHFAAVV

SEQ ID NO: 1303501 - protein, 9 aa, Homo Sapiens
LNPENSTNR

SEQ ID NO: 1303502 - protein, 9 aa, Homo Sapiens
GSLPFPALS

SEQ ID NO: 1303503 - protein, 9 aa, Homo Sapiens
QVTGNRQQP

SEQ ID NO: 1303504 - protein, 9 aa, Homo Sapiens
CPGRDWRTE

SEQ ID NO: 1303505 - protein, 9 aa, Homo Sapiens
VPESPAFSC

SEQ ID NO: 1303506 - protein, 9 aa, Homo Sapiens
MLLGVSDRP

SEQ ID NO: 1303507 - protein, 9 aa, Homo Sapiens
KDSKKQKSL

SEQ ID NO: 1303508 - protein, 9 aa, Homo Sapiens
VQGESHHPL

SEQ ID NO: 1303509 - protein, 9 aa, Homo Sapiens
NLNEEFLRR

SEQ ID NO: 1303510 - protein, 9 aa, Homo Sapiens
PTSLHYLDN

SEQ ID NO: 1303511 - protein, 9 aa, Homo Sapiens
SLYQLIDRI

SEQ ID NO: 1303512 - protein, 9 aa, Homo Sapiens
LLVDLTDAS

SEQ ID NO: 1303513 - protein, 9 aa, Homo Sapiens
ILHNDQEVE

SEQ ID NO: 1303514 - protein, 9 aa, Homo Sapiens
RSLEMELLT

SEQ ID NO: 1303515 - protein, 9 aa, Homo Sapiens
FHHPFLHPM

SEQ ID NO: 1303516 - protein, 9 aa, Homo Sapiens
CMESGPGCT

SEQ ID NO: 1303517 - protein, 9 aa, Homo Sapiens
SQASEENSR

SEQ ID NO: 1303518 - protein, 9 aa, Homo Sapiens
ESHVGLHSA

SEQ ID NO: 1303519 - protein, 9 aa, Homo Sapiens
ADGDMIAVS

SEQ ID NO: 1303520 - protein, 9 aa, Homo Sapiens
AMSKKRGSL

SEQ ID NO: 1303521 - protein, 9 aa, Homo Sapiens
EVWPTQDPA

SEQ ID NO: 1303522 - protein, 9 aa, Homo Sapiens
HTRMHTGKR

SEQ ID NO: 1303523 - protein, 9 aa, Homo Sapiens
SCRECMESG

SEQ ID NO: 1303524 - protein, 9 aa, Homo Sapiens
NPENSTNRV

SEQ ID NO: 1303525 - protein, 9 aa, Homo Sapiens
ICATSGVLA

SEQ ID NO: 1303526 - protein, 9 aa, Homo Sapiens
TKIFICFPR

SEQ ID NO: 1303527 - protein, 9 aa, Homo Sapiens
CCPQGYQLD

SEQ ID NO: 1303528 - protein, 9 aa, Homo Sapiens
IEKVSKSLR

SEQ ID NO: 1303529 - protein, 9 aa, Homo Sapiens
IPALAELNV

SEQ ID NO: 1303530 - protein, 9 aa, Homo Sapiens
IHCKAGKGL

SEQ ID NO: 1303531 - protein, 9 aa, Homo Sapiens
QVIHSHLPN

SEQ ID NO: 1303532 - protein, 9 aa, Homo Sapiens
LNLHVIKKK

SEQ ID NO: 1303533 - protein, 9 aa, Homo Sapiens
CRECMESGP

SEQ ID NO: 1303534 - protein, 9 aa, Homo Sapiens
EFDAIVELD

SEQ ID NO: 1303535 - protein, 9 aa, Homo Sapiens
KWRYKAFST

SEQ ID NO: 1303536 - protein, 9 aa, Homo Sapiens
VESHVGLHS

SEQ ID NO: 1303537 - protein, 9 aa, Homo Sapiens
LPNQDPIHL

SEQ ID NO: 1303538 - protein, 9 aa, Homo Sapiens
VMHFAAVVL

SEQ ID NO: 1303539 - protein, 9 aa, Homo Sapiens
SGLSIEKVS

SEQ ID NO: 1303540 - protein, 9 aa, Homo Sapiens
QKAEIEKQK

SEQ ID NO: 1303541 - protein, 9 aa, Homo Sapiens
KNLILLLAT

SEQ ID NO: 1303542 - protein, 9 aa, Homo Sapiens
HHVFLLEQD

SEQ ID NO: 1303543 - protein, 9 aa, Homo Sapiens
LIMPNNNGS

SEQ ID NO: 1303544 - protein, 9 aa, Homo Sapiens
AKTLFPSSY

SEQ ID NO: 1303545 - protein, 9 aa, Homo Sapiens
PFLHPMVQG

SEQ ID NO: 1303546 - protein, 9 aa, Homo Sapiens
PNQDPIHLD

SEQ ID NO: 1303547 - protein, 9 aa, Homo Sapiens
LLPTRVYST

SEQ ID NO: 1303548 - protein, 9 aa, Homo Sapiens
CPMLRTALS

SEQ ID NO: 1303549 - protein, 9 aa, Homo Sapiens
LLNEPLSSK

SEQ ID NO: 1303550 - protein, 9 aa, Homo Sapiens
YWTKRHVWV

SEQ ID NO: 1303551 - protein, 9 aa, Homo Sapiens
RPVAVMHFA

SEQ ID NO: 1303552 - protein, 9 aa, Homo Sapiens
LPKWLNPEN

SEQ ID NO: 1303553 - protein, 9 aa, Homo Sapiens
LSIEKVSKS

SEQ ID NO: 1303554 - protein, 9 aa, Homo Sapiens
VAVMHFAAV

SEQ ID NO: 1303555 - protein, 9 aa, Homo Sapiens
SRLTTPRGS

SEQ ID NO: 1303556 - protein, 9 aa, Homo Sapiens
CKSILLDMA

SEQ ID NO: 1303557 - protein, 9 aa, Homo Sapiens
LLHHVFLLE

SEQ ID NO: 1303558 - protein, 9 aa, Homo Sapiens
IKWLAFCHS

SEQ ID NO: 1303559 - protein, 9 aa, Homo Sapiens
KELLVDLTD

SEQ ID NO: 1303560 - protein, 9 aa, Homo Sapiens
YVMEQELAD

SEQ ID NO: 1303561 - protein, 9 aa, Homo Sapiens
VGHYAVVCS

SEQ ID NO: 1303562 - protein, 9 aa, Homo Sapiens
SLASPAQQH

SEQ ID NO: 1303563 - protein, 9 aa, Homo Sapiens
IHLDHWLLL

SEQ ID NO: 1303564 - protein, 9 aa, Homo Sapiens
RHVWVWLQF

SEQ ID NO: 1303565 - protein, 9 aa, Homo Sapiens
INHCTLKLC

SEQ ID NO: 1303566 - protein, 9 aa, Homo Sapiens
QAKTLFPSS

SEQ ID NO: 1303567 - protein, 9 aa, Homo Sapiens
DFSAEVIVP

SEQ ID NO: 1303568 - protein, 9 aa, Homo Sapiens
PILHPMVQG

SEQ ID NO: 1303569 - protein, 9 aa, Homo Sapiens
SSFCKGMVT

SEQ ID NO: 1303570 - protein, 9 aa, Homo Sapiens
KAFMLLGVS

SEQ ID NO: 1303571 - protein, 9 aa, Homo Sapiens
VYSNTPFTT

SEQ ID NO: 1303572 - protein, 9 aa, Homo Sapiens
WRPEKSPCS

SEQ ID NO: 1303573 - protein, 9 aa, Homo Sapiens
TKRHVWVWL

SEQ ID NO: 1303574 - protein, 9 aa, Homo Sapiens
QFKRRECKS

SEQ ID NO: 1303575 - protein, 9 aa, Homo Sapiens
QSVQDIYKP

SEQ ID NO: 1303576 - protein, 9 aa, Homo Sapiens
SHHRPHLFH

SEQ ID NO: 1303577 - protein, 9 aa, Homo Sapiens
MPTSLHYLD

SEQ ID NO: 1303578 - protein, 9 aa, Homo Sapiens
GSRSQASEE

SEQ ID NO: 1303579 - protein, 9 aa, Homo Sapiens
KAGKGLTGV

SEQ ID NO: 1303580 - protein, 9 aa, Homo Sapiens
NQDPIHLDL

SEQ ID NO: 1303581 - protein, 9 aa, Homo Sapiens
GTMTRQQQC

SEQ ID NO: 1303582 - protein, 9 aa, Homo Sapiens
IFICFPRTL

SEQ ID NO: 1303583 - protein, 9 aa, Homo Sapiens
WLNPENSTN

SEQ ID NO: 1303584 - protein, 9 aa, Homo Sapiens
AKDGGNPDF

SEQ ID NO: 1303585 - protein, 9 aa, Homo Sapiens
SRSQASEEN

SEQ ID NO: 1303586 - protein, 9 aa, Homo Sapiens
HRPHLFHRR

SEQ ID NO: 1303587 - protein, 9 aa, Homo Sapiens
LRGLCSLTH

SEQ ID NO: 1303588 - protein, 9 aa, Homo Sapiens
EKWRRLCGN

SEQ ID NO: 1303589 - protein, 9 aa, Homo Sapiens
PLLIKWLAF

SEQ ID NO: 1303590 - protein, 9 aa, Homo Sapiens
EQELADLPK

SEQ ID NO: 1303591 - protein, 9 aa, Homo Sapiens
KRHVWVWLQ

SEQ ID NO: 1303592 - protein, 9 aa, Homo Sapiens
HPILHPMVQ

SEQ ID NO: 1303593 - protein, 9 aa, Homo Sapiens
TTPRGSLPF

SEQ ID NO: 1303594 - protein, 9 aa, Homo Sapiens
SYLSSFCKG

SEQ ID NO: 1303595 - protein, 9 aa, Homo Sapiens
LEEQKMMTS

SEQ ID NO: 1303596 - protein, 9 aa, Homo Sapiens
SYAKDMPTS

SEQ ID NO: 1303597 - protein, 9 aa, Homo Sapiens
DADGDMIAV

SEQ ID NO: 1303598 - protein, 9 aa, Homo Sapiens
DTEHDNKSD

SEQ ID NO: 1303599 - protein, 9 aa, Homo Sapiens
VMEQELADL

SEQ ID NO: 1303600 - protein, 9 aa, Homo Sapiens
DKQCTVYPL

SEQ ID NO: 1303601 - protein, 9 aa, Homo Sapiens
MTRQQQCHS

SEQ ID NO: 1303602 - protein, 9 aa, Homo Sapiens
QGEFNHTLF

SEQ ID NO: 1303603 - protein, 9 aa, Homo Sapiens
GSRGLGRGG

SEQ ID NO: 1303604 - protein, 9 aa, Homo Sapiens
DNSTTVSIV

SEQ ID NO: 1303605 - protein, 9 aa, Homo Sapiens
RQQKAEIEK

SEQ ID NO: 1303606 - protein, 9 aa, Homo Sapiens
FRLDSMLRA

SEQ ID NO: 1303607 - protein, 9 aa, Homo Sapiens
HAGKEPYTC

SEQ ID NO: 1303608 - protein, 9 aa, Homo Sapiens
FLLLMAQVI

SEQ ID NO: 1303609 - protein, 9 aa, Homo Sapiens
TPRGSLPFP

SEQ ID NO: 1303610 - protein, 9 aa, Homo Sapiens
LIIQQSVQD

SEQ ID NO: 1303611 - protein, 9 aa, Homo Sapiens
KSPCSNVVV

SEQ ID NO: 1303612 - protein, 9 aa, Homo Sapiens
KRRECKSIL

SEQ ID NO: 1303613 - protein, 9 aa, Homo Sapiens
RALTAVMSP

SEQ ID NO: 1303614 - protein, 9 aa, Homo Sapiens
ATSRAARSW

SEQ ID NO: 1303615 - protein, 9 aa, Homo Sapiens
MVVEIDSMP

SEQ ID NO: 1303616 - protein, 9 aa, Homo Sapiens
AAGPPCPAI

SEQ ID NO: 1303617 - protein, 9 aa, Homo Sapiens
GSSSICATS

SEQ ID NO: 1303618 - protein, 9 aa, Homo Sapiens
TPVYSNTPF

SEQ ID NO: 1303619 - protein, 9 aa, Homo Sapiens
PMVQGEFNH

SEQ ID NO: 1303620 - protein, 9 aa, Homo Sapiens
LTDTEHDNK

SEQ ID NO: 1303621 - protein, 9 aa, Homo Sapiens
AGPESSTQE

SEQ ID NO: 1303622 - protein, 9 aa, Homo Sapiens
GLWALAAVS

SEQ ID NO: 1303623 - protein, 9 aa, Homo Sapiens
VKEAPGDHI

SEQ ID NO: 1303624 - protein, 9 aa, Homo Sapiens
LSTTPVYSN

SEQ ID NO: 1303625 - protein, 9 aa, Homo Sapiens
AQVIHSHLP

SEQ ID NO: 1303626 - protein, 9 aa, Homo Sapiens
CGHLDGDCK

SEQ ID NO: 1303627 - protein, 9 aa, Homo Sapiens
ELLVDLTDA

SEQ ID NO: 1303628 - protein, 9 aa, Homo Sapiens
FDLSQVLFM

SEQ ID NO: 1303629 - protein, 9 aa, Homo Sapiens
MLRTALSNI

SEQ ID NO: 1303630 - protein, 9 aa, Homo Sapiens
AEIEKQKQE

SEQ ID NO: 1303631 - protein, 9 aa, Homo Sapiens
VCSIYLEKQ

SEQ ID NO: 1303632 - protein, 9 aa, Homo Sapiens
LFRSTVPFP

SEQ ID NO: 1303633 - protein, 9 aa, Homo Sapiens
KEGKDSKKQ

SEQ ID NO: 1303634 - protein, 9 aa, Homo Sapiens
RVKNTAANV

SEQ ID NO: 1303635 - protein, 9 aa, Homo Sapiens
LMYYNRALD

SEQ ID NO: 1303636 - protein, 9 aa, Homo Sapiens
FCKGMVTAM

SEQ ID NO: 1303637 - protein, 9 aa, Homo Sapiens
KRGSLYQLI

SEQ ID NO: 1303638 - protein, 9 aa, Homo Sapiens
DMIAVSNLN

SEQ ID NO: 1303639 - protein, 9 aa, Homo Sapiens
ECGLSFRLD

SEQ ID NO: 1303640 - protein, 9 aa, Homo Sapiens
KNALRGLCS

SEQ ID NO: 1303641 - protein, 9 aa, Homo Sapiens
RPEDPRAAK

SEQ ID NO: 1303642 - protein, 9 aa, Homo Sapiens
ICILWDHPM

SEQ ID NO: 1303643 - protein, 9 aa, Homo Sapiens
HPLLHPMVQ

SEQ ID NO: 1303644 - protein, 9 aa, Homo Sapiens
AIGSSNCAL

SEQ ID NO: 1303645 - protein, 9 aa, Homo Sapiens
NMKNLILLL

SEQ ID NO: 1303646 - protein, 9 aa, Homo Sapiens
FWAGDRPYQ

SEQ ID NO: 1303647 - protein, 9 aa, Homo Sapiens
LVDLTDASA

SEQ ID NO: 1303648 - protein, 9 aa, Homo Sapiens
ILWDHPMSS

SEQ ID NO: 1303649 - protein, 9 aa, Homo Sapiens
LQSSDSVSV

SEQ ID NO: 1303650 - protein, 9 aa, Homo Sapiens
VTFSGSSSI

SEQ ID NO: 1303651 - protein, 9 aa, Homo Sapiens
PAIGSSNCA

SEQ ID NO: 1303652 - protein, 9 aa, Homo Sapiens
PTRVYSTEN

SEQ ID NO: 1303653 - protein, 9 aa, Homo Sapiens
GAPGEAGQP

SEQ ID NO: 1303654 - protein, 9 aa, Homo Sapiens
SVQDIYKPG

SEQ ID NO: 1303655 - protein, 9 aa, Homo Sapiens
VSLASPAQQ

SEQ ID NO: 1303656 - protein, 9 aa, Homo Sapiens
LPLLIKWLA

SEQ ID NO: 1303657 - protein, 9 aa, Homo Sapiens
KEAPGDHIH

SEQ ID NO: 1303658 - protein, 9 aa, Homo Sapiens
LHPMVQGEF

SEQ ID NO: 1303659 - protein, 9 aa, Homo Sapiens
VCACPGRDW

SEQ ID NO: 1303660 - protein, 9 aa, Homo Sapiens
PKWLNPENS

SEQ ID NO: 1303661 - protein, 9 aa, Homo Sapiens
VRVKEAPGD

SEQ ID NO: 1303662 - protein, 9 aa, Homo Sapiens
AIVELDGDD

SEQ ID NO: 1303663 - protein, 9 aa, Homo Sapiens
YAKDMPTSL

SEQ ID NO: 1303664 - protein, 9 aa, Homo Sapiens
CTVYPLSSS

SEQ ID NO: 1303665 - protein, 9 aa, Homo Sapiens
RPHLFHRRR

SEQ ID NO: 1303666 - protein, 9 aa, Homo Sapiens
TTVSIVGRP

SEQ ID NO: 1303667 - protein, 9 aa, Homo Sapiens
EDENSNSAW

SEQ ID NO: 1303668 - protein, 9 aa, Homo Sapiens
EGLMYYNRA

SEQ ID NO: 1303669 - protein, 9 aa, Homo Sapiens
HHPFLHPMV

SEQ ID NO: 1303670 - protein, 9 aa, Homo Sapiens
DWRTEEENL

SEQ ID NO: 1303671 - protein, 9 aa, Homo Sapiens
QYVMEQELA

SEQ ID NO: 1303672 - protein, 9 aa, Homo Sapiens
MVQGEFNHT

SEQ ID NO: 1303673 - protein, 9 aa, Homo Sapiens
GDSPKAFML

SEQ ID NO: 1303674 - protein, 9 aa, Homo Sapiens
HQVTGNRQQ

SEQ ID NO: 1303675 - protein, 9 aa, Homo Sapiens
VLEETAKDK

SEQ ID NO: 1303676 - protein, 9 aa, Homo Sapiens
HYAVVCSIY

SEQ ID NO: 1303677 - protein, 9 aa, Homo Sapiens
SPAFSCHAD

SEQ ID NO: 1303678 - protein, 9 aa, Homo Sapiens
PPLFRSTVP

SEQ ID NO: 1303679 - protein, 9 aa, Homo Sapiens
LILPCIMGY

SEQ ID NO: 1303680 - protein, 9 aa, Homo Sapiens
RFREQEKIV

SEQ ID NO: 1303681 - protein, 9 aa, Homo Sapiens
SNLRQNMKN

SEQ ID NO: 1303682 - protein, 9 aa, Homo Sapiens
TAANVLRET

SEQ ID NO: 1303683 - protein, 9 aa, Homo Sapiens
LTKRVKNTA

SEQ ID NO: 1303684 - protein, 9 aa, Homo Sapiens
GPPRSLEME

SEQ ID NO: 1303685 - protein, 9 aa, Homo Sapiens
YLSSFCKGM

SEQ ID NO: 1303686 - protein, 9 aa, Homo Sapiens
GNKMKMTFK

SEQ ID NO: 1303687 - protein, 9 aa, Homo Sapiens
CRGTMTRQQ

SEQ ID NO: 1303688 - protein, 9 aa, Homo Sapiens
YSSYLSSFC

SEQ ID NO: 1303689 - protein, 9 aa, Homo Sapiens
LTTPRGSLP

SEQ ID NO: 1303690 - protein, 9 aa, Homo Sapiens
RGTMTRQQQ

SEQ ID NO: 1303691 - protein, 9 aa, Homo Sapiens
WALAAVSHL

SEQ ID NO: 1303692 - protein, 9 aa, Homo Sapiens
EHDGSSPGD

SEQ ID NO: 1303693 - protein, 9 aa, Homo Sapiens
VVCSIYLEK

SEQ ID NO: 1303694 - protein, 9 aa, Homo Sapiens
ILPCIMGYF

SEQ ID NO: 1303695 - protein, 9 aa, Homo Sapiens
LLLVTPQRL

SEQ ID NO: 1303696 - protein, 9 aa, Homo Sapiens
SPGLLNEPL

SEQ ID NO: 1303697 - protein, 9 aa, Homo Sapiens
HFSTLAKHK

SEQ ID NO: 1303698 - protein, 9 aa, Homo Sapiens
NKMKMTFKD

SEQ ID NO: 1303699 - protein, 9 aa, Homo Sapiens
TMTRQQQCH

SEQ ID NO: 1303700 - protein, 9 aa, Homo Sapiens
KGLTGVMIC

SEQ ID NO: 1303701 - protein, 9 aa, Homo Sapiens
GRDWRTEEE

SEQ ID NO: 1303702 - protein, 9 aa, Homo Sapiens
LHPMVQGDF

SEQ ID NO: 1303703 - protein, 9 aa, Homo Sapiens
IMTNGLCIW

SEQ ID NO: 1303704 - protein, 9 aa, Homo Sapiens
GSLYQLIDR

SEQ ID NO: 1303705 - protein, 9 aa, Homo Sapiens
DAPLLPTRV

SEQ ID NO: 1303706 - protein, 9 aa, Homo Sapiens
TDASAAKNP

SEQ ID NO: 1303707 - protein, 9 aa, Homo Sapiens
ENISVVGRR

SEQ ID NO: 1303708 - protein, 9 aa, Homo Sapiens
ITQFWLYFA

SEQ ID NO: 1303709 - protein, 9 aa, Homo Sapiens
IQHEIINNK

SEQ ID NO: 1303710 - protein, 9 aa, Homo Sapiens
VTQYHYMQW

SEQ ID NO: 1303711 - protein, 9 aa, Homo Sapiens
NHPCRFNTN

SEQ ID NO: 1303712 - protein, 9 aa, Homo Sapiens
KKNQKTKQN

SEQ ID NO: 1303713 - protein, 9 aa, Homo Sapiens
GEQQDVGDF

SEQ ID NO: 1303714 - protein, 9 aa, Homo Sapiens
LGQLRRIQR

SEQ ID NO: 1303715 - protein, 9 aa, Homo Sapiens
VTVPESITV

SEQ ID NO: 1303716 - protein, 9 aa, Homo Sapiens
IQINEIVTE

SEQ ID NO: 1303717 - protein, 9 aa, Homo Sapiens
ASGYSCGPG

SEQ ID NO: 1303718 - protein, 9 aa, Homo Sapiens
DKHKEEDTN

SEQ ID NO: 1303719 - protein, 9 aa, Homo Sapiens
VCTLHGGKG

SEQ ID NO: 1303720 - protein, 9 aa, Homo Sapiens
ANMVMYFFY

SEQ ID NO: 1303721 - protein, 9 aa, Homo Sapiens
TIRLRIVEL

SEQ ID NO: 1303722 - protein, 9 aa, Homo Sapiens
MHGNKALGR

SEQ ID NO: 1303723 - protein, 9 aa, Homo Sapiens
MTKSQIIAV

SEQ ID NO: 1303724 - protein, 9 aa, Homo Sapiens
VLMPEWKIM

SEQ ID NO: 1303725 - protein, 9 aa, Homo Sapiens
TVIRIILFL

SEQ ID NO: 1303726 - protein, 9 aa, Homo Sapiens
RSERNKWIH

SEQ ID NO: 1303727 - protein, 9 aa, Homo Sapiens
SRRADHLLA

SEQ ID NO: 1303728 - protein, 9 aa, Homo Sapiens
ENTMQEYLP

SEQ ID NO: 1303729 - protein, 9 aa, Homo Sapiens
PNRFSQARS

SEQ ID NO: 1303730 - protein, 9 aa, Homo Sapiens
DIVTILQAT

SEQ ID NO: 1303731 - protein, 9 aa, Homo Sapiens
NGRQRLIKY

SEQ ID NO: 1303732 - protein, 9 aa, Homo Sapiens
CKTYWKVCL

SEQ ID NO: 1303733 - protein, 9 aa, Homo Sapiens
GIIHPNRQV

SEQ ID NO: 1303734 - protein, 9 aa, Homo Sapiens
TNLCKRQCE

SEQ ID NO: 1303735 - protein, 9 aa, Homo Sapiens
LGMCLEFEG

SEQ ID NO: 1303736 - protein, 9 aa, Homo Sapiens
PPLTISTHT

SEQ ID NO: 1303737 - protein, 9 aa, Homo Sapiens
CCSELVTKI

SEQ ID NO: 1303738 - protein, 9 aa, Homo Sapiens
QKTKQNPRS

SEQ ID NO: 1303739 - protein, 9 aa, Homo Sapiens
IELQDKLHQ

SEQ ID NO: 1303740 - protein, 9 aa, Homo Sapiens
NSSDYLAPR

SEQ ID NO: 1303741 - protein, 9 aa, Homo Sapiens
RLANMVMYF

SEQ ID NO: 1303742 - protein, 9 aa, Homo Sapiens
AQIVVMQES

SEQ ID NO: 1303743 - protein, 9 aa, Homo Sapiens
CFDDSLPNP

SEQ ID NO: 1303744 - protein, 9 aa, Homo Sapiens
FIYNQTEDI

SEQ ID NO: 1303745 - protein, 9 aa, Homo Sapiens
IDNKDECPT

SEQ ID NO: 1303746 - protein, 9 aa, Homo Sapiens
LGNLKIKWD

SEQ ID NO: 1303747 - protein, 9 aa, Homo Sapiens
DWMGNVESY

SEQ ID NO: 1303748 - protein, 9 aa, Homo Sapiens
KERRLRIWS

SEQ ID NO: 1303749 - protein, 9 aa, Homo Sapiens
ALERCQIIE

SEQ ID NO: 1303750 - protein, 9 aa, Homo Sapiens
NDHNEFEEQ

SEQ ID NO: 1303751 - protein, 9 aa, Homo Sapiens
NDRKVFVGQ

SEQ ID NO: 1303752 - protein, 9 aa, Homo Sapiens
ILHPPSEKG

SEQ ID NO: 1303753 - protein, 9 aa, Homo Sapiens
IIHPNRQVL

SEQ ID NO: 1303754 - protein, 9 aa, Homo Sapiens
PLDPVHLCV

SEQ ID NO: 1303755 - protein, 9 aa, Homo Sapiens
DSLYNPKRQ

SEQ ID NO: 1303756 - protein, 9 aa, Homo Sapiens
NFWMIGDDL

SEQ ID NO: 1303757 - protein, 9 aa, Homo Sapiens
EKLTTRVTK

SEQ ID NO: 1303758 - protein, 9 aa, Homo Sapiens
GVETCGIIC

SEQ ID NO: 1303759 - protein, 9 aa, Homo Sapiens
LFLFIWFIL

SEQ ID NO: 1303760 - protein, 9 aa, Homo Sapiens
QRPKDPNNV

SEQ ID NO: 1303761 - protein, 9 aa, Homo Sapiens
YARTEYAEN

SEQ ID NO: 1303762 - protein, 9 aa, Homo Sapiens
ADLISQTAV

SEQ ID NO: 1303763 - protein, 9 aa, Homo Sapiens
GWLCWNNVA

SEQ ID NO: 1303764 - protein, 9 aa, Homo Sapiens
IEINDELKK

SEQ ID NO: 1303765 - protein, 9 aa, Homo Sapiens
SVLLEKHDD

SEQ ID NO: 1303766 - protein, 9 aa, Homo Sapiens
SNGVSCTNL

SEQ ID NO: 1303767 - protein, 9 aa, Homo Sapiens
LKYNDTENK

SEQ ID NO: 1303768 - protein, 9 aa, Homo Sapiens
EHDKIKSTL

SEQ ID NO: 1303769 - protein, 9 aa, Homo Sapiens
SLEATVSSK

SEQ ID NO: 1303770 - protein, 9 aa, Homo Sapiens
LLCLSKDDL

SEQ ID NO: 1303771 - protein, 9 aa, Homo Sapiens
ADEIIVLNQ

SEQ ID NO: 1303772 - protein, 9 aa, Homo Sapiens
HNNSSLNTI

SEQ ID NO: 1303773 - protein, 9 aa, Homo Sapiens
AVKYIWLAA

SEQ ID NO: 1303774 - protein, 9 aa, Homo Sapiens
QLYILHRKP

SEQ ID NO: 1303775 - protein, 9 aa, Homo Sapiens
PRSIPTTHI

SEQ ID NO: 1303776 - protein, 9 aa, Homo Sapiens
YLPSGIVNF

SEQ ID NO: 1303777 - protein, 9 aa, Homo Sapiens
NTLLQPDKN

SEQ ID NO: 1303778 - protein, 9 aa, Homo Sapiens
ENNKEQSPP

SEQ ID NO: 1303779 - protein, 9 aa, Homo Sapiens
VHYISAEEE

SEQ ID NO: 1303780 - protein, 9 aa, Homo Sapiens
VSVTPQGNY

SEQ ID NO: 1303781 - protein, 9 aa, Homo Sapiens
RIYLYSLIS

SEQ ID NO: 1303782 - protein, 9 aa, Homo Sapiens
QDETEQNQA

SEQ ID NO: 1303783 - protein, 9 aa, Homo Sapiens
HGNRVFFGK

SEQ ID NO: 1303784 - protein, 9 aa, Homo Sapiens
SASAPNPNV

SEQ ID NO: 1303785 - protein, 9 aa, Homo Sapiens
SFLLFWTLP

SEQ ID NO: 1303786 - protein, 9 aa, Homo Sapiens
GNTSSLWST

SEQ ID NO: 1303787 - protein, 9 aa, Homo Sapiens
KQKSSTSGS

SEQ ID NO: 1303788 - protein, 9 aa, Homo Sapiens
FGLARDMYK

SEQ ID NO: 1303789 - protein, 9 aa, Homo Sapiens
PSSYNSTMG

SEQ ID NO: 1303790 - protein, 9 aa, Homo Sapiens
GKSFSCVSL

SEQ ID NO: 1303791 - protein, 9 aa, Homo Sapiens
ASFLALMWF

SEQ ID NO: 1303792 - protein, 9 aa, Homo Sapiens
KTVKNVTCK

SEQ ID NO: 1303793 - protein, 9 aa, Homo Sapiens
RIRSELSQD

SEQ ID NO: 1303794 - protein, 9 aa, Homo Sapiens
RWPNYAATS

SEQ ID NO: 1303795 - protein, 9 aa, Homo Sapiens
ERINIIRQN

SEQ ID NO: 1303796 - protein, 9 aa, Homo Sapiens
TSLAVGDTI

SEQ ID NO: 1303797 - protein, 9 aa, Homo Sapiens
LVEYLKESY

SEQ ID NO: 1303798 - protein, 9 aa, Homo Sapiens
LQIQNILTE

SEQ ID NO: 1303799 - protein, 9 aa, Homo Sapiens
VFKHSLEEE

SEQ ID NO: 1303800 - protein, 9 aa, Homo Sapiens
AFDSYYEES

SEQ ID NO: 1303801 - protein, 9 aa, Homo Sapiens
IVAALKCLK

SEQ ID NO: 1303802 - protein, 9 aa, Homo Sapiens
PVIFSQYNP

SEQ ID NO: 1303803 - protein, 9 aa, Homo Sapiens
YNVRLAQRA

SEQ ID NO: 1303804 - protein, 9 aa, Homo Sapiens
CEHMDIAHL

SEQ ID NO: 1303805 - protein, 9 aa, Homo Sapiens
PNSSDYLAP

SEQ ID NO: 1303806 - protein, 9 aa, Homo Sapiens
TEAVQGPKG

SEQ ID NO: 1303807 - protein, 9 aa, Homo Sapiens
VVCNPNVYS

SEQ ID NO: 1303808 - protein, 9 aa, Homo Sapiens
HYGELIEFL

SEQ ID NO: 1303809 - protein, 9 aa, Homo Sapiens
QELLKDRNP

SEQ ID NO: 1303810 - protein, 9 aa, Homo Sapiens
AAVDHTTEL

SEQ ID NO: 1303811 - protein, 9 aa, Homo Sapiens
ISFSFKGIQ

SEQ ID NO: 1303812 - protein, 9 aa, Homo Sapiens
FKIHGQGKN

SEQ ID NO: 1303813 - protein, 9 aa, Homo Sapiens
PGIGLLDIS

SEQ ID NO: 1303814 - protein, 9 aa, Homo Sapiens
YEHTIQKDG

SEQ ID NO: 1303815 - protein, 9 aa, Homo Sapiens
VVVLSQNSR

SEQ ID NO: 1303816 - protein, 9 aa, Homo Sapiens
QAADLISQT

SEQ ID NO: 1303817 - protein, 9 aa, Homo Sapiens
LSVKCWLRY

SEQ ID NO: 1303818 - protein, 9 aa, Homo Sapiens
IHFSNIYFY

SEQ ID NO: 1303819 - protein, 9 aa, Homo Sapiens
INPLCNLLS

SEQ ID NO: 1303820 - protein, 9 aa, Homo Sapiens
FLGPQKSFP

SEQ ID NO: 1303821 - protein, 9 aa, Homo Sapiens
HALGEMLAV

SEQ ID NO: 1303822 - protein, 9 aa, Homo Sapiens
CFNKERAEG

SEQ ID NO: 1303823 - protein, 9 aa, Homo Sapiens
IITSLQRAA

SEQ ID NO: 1303824 - protein, 9 aa, Homo Sapiens
PMHLEYFPM

SEQ ID NO: 1303825 - protein, 9 aa, Homo Sapiens
NQKTKQNPR

SEQ ID NO: 1303826 - protein, 9 aa, Homo Sapiens
QVQRYTNAI

SEQ ID NO: 1303827 - protein, 9 aa, Homo Sapiens
IHVCLYLIA

SEQ ID NO: 1303828 - protein, 9 aa, Homo Sapiens
HPLEIVKSL

SEQ ID NO: 1303829 - protein, 9 aa, Homo Sapiens
THKGHFQLW

SEQ ID NO: 1303830 - protein, 9 aa, Homo Sapiens
GSALALART

SEQ ID NO: 1303831 - protein, 9 aa, Homo Sapiens
DQKSCFKSI

SEQ ID NO: 1303832 - protein, 9 aa, Homo Sapiens
EGDKDDWAS

SEQ ID NO: 1303833 - protein, 9 aa, Homo Sapiens
LSFKKGEIF

SEQ ID NO: 1303834 - protein, 9 aa, Homo Sapiens
YDMMIVRHG

SEQ ID NO: 1303835 - protein, 9 aa, Homo Sapiens
SQIIAVIRE

SEQ ID NO: 1303836 - protein, 9 aa, Homo Sapiens
KKAYTYPEN

SEQ ID NO: 1303837 - protein, 9 aa, Homo Sapiens
QSRRYAGKY

SEQ ID NO: 1303838 - protein, 9 aa, Homo Sapiens
KTSCCAMLE

SEQ ID NO: 1303839 - protein, 9 aa, Homo Sapiens
ANVALRKEL

SEQ ID NO: 1303840 - protein, 9 aa, Homo Sapiens
IGDGKFAVV

SEQ ID NO: 1303841 - protein, 9 aa, Homo Sapiens
NNRLCPSLI

SEQ ID NO: 1303842 - protein, 9 aa, Homo Sapiens
ITNKFCCED

SEQ ID NO: 1303843 - protein, 9 aa, Homo Sapiens
DKGSKTFTR

SEQ ID NO: 1303844 - protein, 9 aa, Homo Sapiens
QINPLCNLL

SEQ ID NO: 1303845 - protein, 9 aa, Homo Sapiens
DQDGAYLFQ

SEQ ID NO: 1303846 - protein, 9 aa, Homo Sapiens
IDRSMKNNN

SEQ ID NO: 1303847 - protein, 9 aa, Homo Sapiens
KKNHKLEYK

SEQ ID NO: 1303848 - protein, 9 aa, Homo Sapiens
VIILHGGVS

SEQ ID NO: 1303849 - protein, 9 aa, Homo Sapiens
LLVFATDYG

SEQ ID NO: 1303850 - protein, 9 aa, Homo Sapiens
ANTSVKPSQ

SEQ ID NO: 1303851 - protein, 9 aa, Homo Sapiens
HLQAAVDHT

SEQ ID NO: 1303852 - protein, 9 aa, Homo Sapiens
RTHSQLLQM

SEQ ID NO: 1303853 - protein, 9 aa, Homo Sapiens
EKPYKFKEC

SEQ ID NO: 1303854 - protein, 9 aa, Homo Sapiens
KKKEERAAL

SEQ ID NO: 1303855 - protein, 9 aa, Homo Sapiens
NMVMYFFYK

SEQ ID NO: 1303856 - protein, 9 aa, Homo Sapiens
FSKLPRNLK

SEQ ID NO: 1303857 - protein, 9 aa, Homo Sapiens
VVLSQNSRD

SEQ ID NO: 1303858 - protein, 9 aa, Homo Sapiens
GDRKLFQVW

SEQ ID NO: 1303859 - protein, 9 aa, Homo Sapiens
HSSCGFCCE

SEQ ID NO: 1303860 - protein, 9 aa, Homo Sapiens
ILSSELLQF

SEQ ID NO: 1303861 - protein, 9 aa, Homo Sapiens
RESYMSTLL

SEQ ID NO: 1303862 - protein, 9 aa, Homo Sapiens
PFRYNELIT

SEQ ID NO: 1303863 - protein, 9 aa, Homo Sapiens
SEYVYKVVV

SEQ ID NO: 1303864 - protein, 9 aa, Homo Sapiens
SPVTTVYLI

SEQ ID NO: 1303865 - protein, 9 aa, Homo Sapiens
SIAPVIVHT

SEQ ID NO: 1303866 - protein, 9 aa, Homo Sapiens
RGQTICIDN

SEQ ID NO: 1303867 - protein, 9 aa, Homo Sapiens
ITERDNVFG

SEQ ID NO: 1303868 - protein, 9 aa, Homo Sapiens
PLPPAKGSI

SEQ ID NO: 1303869 - protein, 9 aa, Homo Sapiens
LAETSETMV

SEQ ID NO: 1303870 - protein, 9 aa, Homo Sapiens
SGRSIEIND

SEQ ID NO: 1303871 - protein, 9 aa, Homo Sapiens
LADLLGFTG

SEQ ID NO: 1303872 - protein, 9 aa, Homo Sapiens
TGPLQINPL

SEQ ID NO: 1303873 - protein, 9 aa, Homo Sapiens
QSEEIKDTI

SEQ ID NO: 1303874 - protein, 9 aa, Homo Sapiens
ENVHFFYTN

SEQ ID NO: 1303875 - protein, 9 aa, Homo Sapiens
EAVQGPKGS

SEQ ID NO: 1303876 - protein, 9 aa, Homo Sapiens
CKICIRKMD

SEQ ID NO: 1303877 - protein, 9 aa, Homo Sapiens
EPGPENTPI

SEQ ID NO: 1303878 - protein, 9 aa, Homo Sapiens
KKGQNKGEK

SEQ ID NO: 1303879 - protein, 9 aa, Homo Sapiens
TSFDKSLHT

SEQ ID NO: 1303880 - protein, 9 aa, Homo Sapiens
PESITVGYS

SEQ ID NO: 1303881 - protein, 9 aa, Homo Sapiens
QNISASAPN

SEQ ID NO: 1303882 - protein, 9 aa, Homo Sapiens
NNIFSYHIF

SEQ ID NO: 1303883 - protein, 9 aa, Homo Sapiens
LLLPIPLLV

SEQ ID NO: 1303884 - protein, 9 aa, Homo Sapiens
VDDPEAIIL

SEQ ID NO: 1303885 - protein, 9 aa, Homo Sapiens
WDKIKSSFH

SEQ ID NO: 1303886 - protein, 9 aa, Homo Sapiens
DIFSERSYL

SEQ ID NO: 1303887 - protein, 9 aa, Homo Sapiens
DIKNIYSNC

SEQ ID NO: 1303888 - protein, 9 aa, Homo Sapiens
HTEGRGTNK

SEQ ID NO: 1303889 - protein, 9 aa, Homo Sapiens
STVINSRAC

SEQ ID NO: 1303890 - protein, 9 aa, Homo Sapiens
YNSTMGGSI

SEQ ID NO: 1303891 - protein, 9 aa, Homo Sapiens
MSSDANEFI

SEQ ID NO: 1303892 - protein, 9 aa, Homo Sapiens
SIAAGIITT

SEQ ID NO: 1303893 - protein, 9 aa, Homo Sapiens
ENEKLSSCL

SEQ ID NO: 1303894 - protein, 9 aa, Homo Sapiens
EAFLRLAQS

SEQ ID NO: 1303895 - protein, 9 aa, Homo Sapiens
VKSLSEDTA

SEQ ID NO: 1303896 - protein, 9 aa, Homo Sapiens
SAETAPGIH

SEQ ID NO: 1303897 - protein, 9 aa, Homo Sapiens
SCQPTPDLE

SEQ ID NO: 1303898 - protein, 9 aa, Homo Sapiens
MKILTQDTP

SEQ ID NO: 1303899 - protein, 9 aa, Homo Sapiens
KILCSKTEN

SEQ ID NO: 1303900 - protein, 9 aa, Homo Sapiens
EYKGWSVGN

SEQ ID NO: 1303901 - protein, 9 aa, Homo Sapiens
DRDKAFIHK

SEQ ID NO: 1303902 - protein, 9 aa, Homo Sapiens
VLENERQVL

SEQ ID NO: 1303903 - protein, 9 aa, Homo Sapiens
DVNGEKEQT

SEQ ID NO: 1303904 - protein, 9 aa, Homo Sapiens
TIMDPHNPE

SEQ ID NO: 1303905 - protein, 9 aa, Homo Sapiens
PSNPSNPSM

SEQ ID NO: 1303906 - protein, 9 aa, Homo Sapiens
NEEHKKEED

SEQ ID NO: 1303907 - protein, 9 aa, Homo Sapiens
KSQIIAVIR

SEQ ID NO: 1303908 - protein, 9 aa, Homo Sapiens
KGAMKTLFR

SEQ ID NO: 1303909 - protein, 9 aa, Homo Sapiens
NIISRPWDF

SEQ ID NO: 1303910 - protein, 9 aa, Homo Sapiens
RADHLLAAG

SEQ ID NO: 1303911 - protein, 9 aa, Homo Sapiens
DQRASIIQR

SEQ ID NO: 1303912 - protein, 9 aa, Homo Sapiens
ENPSSYNST

SEQ ID NO: 1303913 - protein, 9 aa, Homo Sapiens
QIISQVVDP

SEQ ID NO: 1303914 - protein, 9 aa, Homo Sapiens
LNWAYQQLQ

SEQ ID NO: 1303915 - protein, 9 aa, Homo Sapiens
IVRQEALQS

SEQ ID NO: 1303916 - protein, 9 aa, Homo Sapiens
KFCRFVLAY

SEQ ID NO: 1303917 - protein, 9 aa, Homo Sapiens
ESKFDSFRQ

SEQ ID NO: 1303918 - protein, 9 aa, Homo Sapiens
PYKFKECGK

SEQ ID NO: 1303919 - protein, 9 aa, Homo Sapiens
LAVLNNGRL

SEQ ID NO: 1303920 - protein, 9 aa, Homo Sapiens
IGKLTIINL

SEQ ID NO: 1303921 - protein, 9 aa, Homo Sapiens
MMAGIRALV

SEQ ID NO: 1303922 - protein, 9 aa, Homo Sapiens
PSKNYFISY

SEQ ID NO: 1303923 - protein, 9 aa, Homo Sapiens
LASASSLQC

SEQ ID NO: 1303924 - protein, 9 aa, Homo Sapiens
LEFEGLKPA

SEQ ID NO: 1303925 - protein, 9 aa, Homo Sapiens
PVIVHTVSG

SEQ ID NO: 1303926 - protein, 9 aa, Homo Sapiens
EKVEVEHVM

SEQ ID NO: 1303927 - protein, 9 aa, Homo Sapiens
IYFDFWFQI

SEQ ID NO: 1303928 - protein, 9 aa, Homo Sapiens
LGDSDGQHN

SEQ ID NO: 1303929 - protein, 9 aa, Homo Sapiens
SDAKDNFYR

SEQ ID NO: 1303930 - protein, 9 aa, Homo Sapiens
VHKIIHSGK

SEQ ID NO: 1303931 - protein, 9 aa, Homo Sapiens
FTRIVTLIK

SEQ ID NO: 1303932 - protein, 9 aa, Homo Sapiens
LSEAVLDGI

SEQ ID NO: 1303933 - protein, 9 aa, Homo Sapiens
LELMVLYVA

SEQ ID NO: 1303934 - protein, 9 aa, Homo Sapiens
YTYPENLPA

SEQ ID NO: 1303935 - protein, 9 aa, Homo Sapiens
KENICSCNE

SEQ ID NO: 1303936 - protein, 9 aa, Homo Sapiens
MGHFDLINY

SEQ ID NO: 1303937 - protein, 9 aa, Homo Sapiens
EYLKESYFD

SEQ ID NO: 1303938 - protein, 9 aa, Homo Sapiens
VCLRTSEKA

SEQ ID NO: 1303939 - protein, 9 aa, Homo Sapiens
SCGFCCERG

SEQ ID NO: 1303940 - protein, 9 aa, Homo Sapiens
ACVSKMYLN

SEQ ID NO: 1303941 - protein, 9 aa, Homo Sapiens
SCSGHLVVQ

SEQ ID NO: 1303942 - protein, 9 aa, Homo Sapiens
FFYNVRLAQ

SEQ ID NO: 1303943 - protein, 9 aa, Homo Sapiens
IVVPLLNHF

SEQ ID NO: 1303944 - protein, 9 aa, Homo Sapiens
IRNQLPLIV

SEQ ID NO: 1303945 - protein, 9 aa, Homo Sapiens
SWTTADTVA

SEQ ID NO: 1303946 - protein, 9 aa, Homo Sapiens
PDKETAWKV

SEQ ID NO: 1303947 - protein, 9 aa, Homo Sapiens
TYFSAVKLC

SEQ ID NO: 1303948 - protein, 9 aa, Homo Sapiens
ELMVLYVAA

SEQ ID NO: 1303949 - protein, 9 aa, Homo Sapiens
LSKPLMRLE

SEQ ID NO: 1303950 - protein, 9 aa, Homo Sapiens
GNKALGREL

SEQ ID NO: 1303951 - protein, 9 aa, Homo Sapiens
PDNNSLQSP

SEQ ID NO: 1303952 - protein, 9 aa, Homo Sapiens
MDPHNPESL

SEQ ID NO: 1303953 - protein, 9 aa, Homo Sapiens
PNDLFRLIK

SEQ ID NO: 1303954 - protein, 9 aa, Homo Sapiens
LADRVHTSK

SEQ ID NO: 1303955 - protein, 9 aa, Homo Sapiens
TSYMTIAPK

SEQ ID NO: 1303956 - protein, 9 aa, Homo Sapiens
VNNLGVCGS

SEQ ID NO: 1303957 - protein, 9 aa, Homo Sapiens
EKVIILHGG

SEQ ID NO: 1303958 - protein, 9 aa, Homo Sapiens
KTKQNPRSK

SEQ ID NO: 1303959 - protein, 9 aa, Homo Sapiens
APSSQRYSQ

SEQ ID NO: 1303960 - protein, 9 aa, Homo Sapiens
KTSFYVGAS

SEQ ID NO: 1303961 - protein, 9 aa, Homo Sapiens
RHFFCGMPQ

SEQ ID NO: 1303962 - protein, 9 aa, Homo Sapiens
GFSRTNIIQ

SEQ ID NO: 1303963 - protein, 9 aa, Homo Sapiens
SKPIQAPSA

SEQ ID NO: 1303964 - protein, 9 aa, Homo Sapiens
YEVNQSNYK

SEQ ID NO: 1303965 - protein, 9 aa, Homo Sapiens
DIHATRQID

SEQ ID NO: 1303966 - protein, 9 aa, Homo Sapiens
KHIHQFGIV

SEQ ID NO: 1303967 - protein, 9 aa, Homo Sapiens
DENVHFFYT

SEQ ID NO: 1303968 - protein, 9 aa, Homo Sapiens
DVEALCQTF

SEQ ID NO: 1303969 - protein, 9 aa, Homo Sapiens
GTLQSCSTV

SEQ ID NO: 1303970 - protein, 9 aa, Homo Sapiens
QYVISMTAN

SEQ ID NO: 1303971 - protein, 9 aa, Homo Sapiens
IPSDMVCLR

SEQ ID NO: 1303972 - protein, 9 aa, Homo Sapiens
PEPLQRPKM

SEQ ID NO: 1303973 - protein, 9 aa, Homo Sapiens
DLVKSHFMY

SEQ ID NO: 1303974 - protein, 9 aa, Homo Sapiens
SILLFPVRG

SEQ ID NO: 1303975 - protein, 9 aa, Homo Sapiens
STAFTKVLH

SEQ ID NO: 1303976 - protein, 9 aa, Homo Sapiens
LTGWSKGLI

SEQ ID NO: 1303977 - protein, 9 aa, Homo Sapiens
PMTETGKEN

SEQ ID NO: 1303978 - protein, 9 aa, Homo Sapiens
LILHPPSEK

SEQ ID NO: 1303979 - protein, 9 aa, Homo Sapiens
VFNCCLVDL

SEQ ID NO: 1303980 - protein, 9 aa, Homo Sapiens
RKELNALRG

SEQ ID NO: 1303981 - protein, 9 aa, Homo Sapiens
VRCWIIRDK

SEQ ID NO: 1303982 - protein, 9 aa, Homo Sapiens
IKFVSKLSE

SEQ ID NO: 1303983 - protein, 9 aa, Homo Sapiens
NNQSHRDCV

SEQ ID NO: 1303984 - protein, 9 aa, Homo Sapiens
VSEAQNISR

SEQ ID NO: 1303985 - protein, 9 aa, Homo Sapiens
QEIKTYSLS

SEQ ID NO: 1303986 - protein, 9 aa, Homo Sapiens
DDIDNIAQE

SEQ ID NO: 1303987 - protein, 9 aa, Homo Sapiens
DKIIENLRE

SEQ ID NO: 1303988 - protein, 9 aa, Homo Sapiens
LEELKKRNF

SEQ ID NO: 1303989 - protein, 9 aa, Homo Sapiens
RVHTSKSDV

SEQ ID NO: 1303990 - protein, 9 aa, Homo Sapiens
GRPLPNTIR

SEQ ID NO: 1303991 - protein, 9 aa, Homo Sapiens
NDLFRLIKI

SEQ ID NO: 1303992 - protein, 9 aa, Homo Sapiens
GNSMVYEWR

SEQ ID NO: 1303993 - protein, 9 aa, Homo Sapiens
RMHTDERPY

SEQ ID NO: 1303994 - protein, 9 aa, Homo Sapiens
EAEYLILRE

SEQ ID NO: 1303995 - protein, 9 aa, Homo Sapiens
YKGVTKEVD

SEQ ID NO: 1303996 - protein, 9 aa, Homo Sapiens
PWYRSVSQE

SEQ ID NO: 1303997 - protein, 9 aa, Homo Sapiens
NKNLAGPVE

SEQ ID NO: 1303998 - protein, 9 aa, Homo Sapiens
FGAITLNLV

SEQ ID NO: 1303999 - protein, 9 aa, Homo Sapiens
SSGLIQHQI

SEQ ID NO: 1304000 - protein, 9 aa, Homo Sapiens
QDVCTYIDF

SEQ ID NO: 1304001 - protein, 9 aa, Homo Sapiens
HHQKIHQNQ

SEQ ID NO: 1304002 - protein, 9 aa, Homo Sapiens
EGKFDKDRD

SEQ ID NO: 1304003 - protein, 9 aa, Homo Sapiens
VSSCAVVAN

SEQ ID NO: 1304004 - protein, 9 aa, Homo Sapiens
YLLDKDEND

SEQ ID NO: 1304005 - protein, 9 aa, Homo Sapiens
KCCFCDLLK

SEQ ID NO: 1304006 - protein, 9 aa, Homo Sapiens
VIRIILFLI

SEQ ID NO: 1304007 - protein, 9 aa, Homo Sapiens
YLPRRYKLM

SEQ ID NO: 1304008 - protein, 9 aa, Homo Sapiens
NWASSIDDA

SEQ ID NO: 1304009 - protein, 9 aa, Homo Sapiens
KNISEWKCM

SEQ ID NO: 1304010 - protein, 9 aa, Homo Sapiens
FNCCLVDLD

SEQ ID NO: 1304011 - protein, 9 aa, Homo Sapiens
VAKPNNIKS

SEQ ID NO: 1304012 - protein, 9 aa, Homo Sapiens
LMVLYVAAA

SEQ ID NO: 1304013 - protein, 9 aa, Homo Sapiens
MIMHTGERP

SEQ ID NO: 1304014 - protein, 9 aa, Homo Sapiens
DSDYNLLQA

SEQ ID NO: 1304015 - protein, 9 aa, Homo Sapiens
TQELIEDLW

SEQ ID NO: 1304016 - protein, 9 aa, Homo Sapiens
LGSNLSELN

SEQ ID NO: 1304017 - protein, 9 aa, Homo Sapiens
VYRLLLPQI

SEQ ID NO: 1304018 - protein, 9 aa, Homo Sapiens
NPSKPIQAP

SEQ ID NO: 1304019 - protein, 9 aa, Homo Sapiens
FSFCENNVD

SEQ ID NO: 1304020 - protein, 9 aa, Homo Sapiens
ATILAVSKL

SEQ ID NO: 1304021 - protein, 9 aa, Homo Sapiens
PCTDLFSFA

SEQ ID NO: 1304022 - protein, 9 aa, Homo Sapiens
KKKKKDDNK

SEQ ID NO: 1304023 - protein, 9 aa, Homo Sapiens
SLSSLIAGQ

SEQ ID NO: 1304024 - protein, 9 aa, Homo Sapiens
FIHVFFSSP

SEQ ID NO: 1304025 - protein, 9 aa, Homo Sapiens
VHTGEKPFW

SEQ ID NO: 1304026 - protein, 9 aa, Homo Sapiens
QDKKLSENT

SEQ ID NO: 1304027 - protein, 9 aa, Homo Sapiens
ADAFDSYYE

SEQ ID NO: 1304028 - protein, 9 aa, Homo Sapiens
WDSYAELRQ

SEQ ID NO: 1304029 - protein, 9 aa, Homo Sapiens
LNENYFLSN

SEQ ID NO: 1304030 - protein, 9 aa, Homo Sapiens
ITVGYSVLT

SEQ ID NO: 1304031 - protein, 9 aa, Homo Sapiens
ETCGIICGK

SEQ ID NO: 1304032 - protein, 9 aa, Homo Sapiens
AVHLNSLIT

SEQ ID NO: 1304033 - protein, 9 aa, Homo Sapiens
CPQPKTLDK

SEQ ID NO: 1304034 - protein, 9 aa, Homo Sapiens
GLGVEVLEH

SEQ ID NO: 1304035 - protein, 9 aa, Homo Sapiens
HLLSIIYLA

SEQ ID NO: 1304036 - protein, 9 aa, Homo Sapiens
RKHYLVQEA

SEQ ID NO: 1304037 - protein, 9 aa, Homo Sapiens
EHRPKDKRV

SEQ ID NO: 1304038 - protein, 9 aa, Homo Sapiens
DKKPRKQTY

SEQ ID NO: 1304039 - protein, 9 aa, Homo Sapiens
SSVSDKLKK

SEQ ID NO: 1304040 - protein, 9 aa, Homo Sapiens
RGLCSDLEL

SEQ ID NO: 1304041 - protein, 9 aa, Homo Sapiens
LNENCTCTC

SEQ ID NO: 1304042 - protein, 9 aa, Homo Sapiens
PSNPSMEEK

SEQ ID NO: 1304043 - protein, 9 aa, Homo Sapiens
LKDLNENYF

SEQ ID NO: 1304044 - protein, 9 aa, Homo Sapiens
TEQNQALLQ

SEQ ID NO: 1304045 - protein, 9 aa, Homo Sapiens
KKTSNNIKD

SEQ ID NO: 1304046 - protein, 9 aa, Homo Sapiens
VFFVNSLCK

SEQ ID NO: 1304047 - protein, 9 aa, Homo Sapiens
IRPRRTLQK

SEQ ID NO: 1304048 - protein, 9 aa, Homo Sapiens
QLHQGGKIN

SEQ ID NO: 1304049 - protein, 9 aa, Homo Sapiens
DKMYRNVYK

SEQ ID NO: 1304050 - protein, 9 aa, Homo Sapiens
PGPMINCED

SEQ ID NO: 1304051 - protein, 9 aa, Homo Sapiens
HLTKHKIIH

SEQ ID NO: 1304052 - protein, 9 aa, Homo Sapiens
GEIRTIFYL

SEQ ID NO: 1304053 - protein, 9 aa, Homo Sapiens
QRRYCSTSY

SEQ ID NO: 1304054 - protein, 9 aa, Homo Sapiens
PAKQEYEWD

SEQ ID NO: 1304055 - protein, 9 aa, Homo Sapiens
SQAALQSMQ

SEQ ID NO: 1304056 - protein, 9 aa, Homo Sapiens
PDGSEEAAE

SEQ ID NO: 1304057 - protein, 9 aa, Homo Sapiens
ISCFMGHTF

SEQ ID NO: 1304058 - protein, 9 aa, Homo Sapiens
ESLHRINIT

SEQ ID NO: 1304059 - protein, 9 aa, Homo Sapiens
PENISVVGR

SEQ ID NO: 1304060 - protein, 9 aa, Homo Sapiens
ETPEYKMNT

SEQ ID NO: 1304061 - protein, 9 aa, Homo Sapiens
KIISFNWCM

SEQ ID NO: 1304062 - protein, 9 aa, Homo Sapiens
PISRLGAAS

SEQ ID NO: 1304063 - protein, 9 aa, Homo Sapiens
RRCTLNENC

SEQ ID NO: 1304064 - protein, 9 aa, Homo Sapiens
RKEEEEANK

SEQ ID NO: 1304065 - protein, 9 aa, Homo Sapiens
EDSITPSAQ

SEQ ID NO: 1304066 - protein, 9 aa, Homo Sapiens
EKVNKYLDL

SEQ ID NO: 1304067 - protein, 9 aa, Homo Sapiens
GKYFRKKAR

SEQ ID NO: 1304068 - protein, 9 aa, Homo Sapiens
ESISEQLYD

SEQ ID NO: 1304069 - protein, 9 aa, Homo Sapiens
APAKQEYEW

SEQ ID NO: 1304070 - protein, 9 aa, Homo Sapiens
AGCTFQYII

SEQ ID NO: 1304071 - protein, 9 aa, Homo Sapiens
CGMPQLLIL

SEQ ID NO: 1304072 - protein, 9 aa, Homo Sapiens
SFDYYYFIL

SEQ ID NO: 1304073 - protein, 9 aa, Homo Sapiens
AQMDPNKIS

SEQ ID NO: 1304074 - protein, 9 aa, Homo Sapiens
TNKFCCEDG

SEQ ID NO: 1304075 - protein, 9 aa, Homo Sapiens
YMWIKAAKT

SEQ ID NO: 1304076 - protein, 9 aa, Homo Sapiens
NQSNYKLPH

SEQ ID NO: 1304077 - protein, 9 aa, Homo Sapiens
VKNYLEELI

SEQ ID NO: 1304078 - protein, 9 aa, Homo Sapiens
RWTTSEGEL

SEQ ID NO: 1304079 - protein, 9 aa, Homo Sapiens
YFVNDKFMP

SEQ ID NO: 1304080 - protein, 9 aa, Homo Sapiens
PTVFAIYWG

SEQ ID NO: 1304081 - protein, 9 aa, Homo Sapiens
LKTDYNNPI

SEQ ID NO: 1304082 - protein, 9 aa, Homo Sapiens
QSKNCEGFS

SEQ ID NO: 1304083 - protein, 9 aa, Homo Sapiens
SIIIHQLQM

SEQ ID NO: 1304084 - protein, 9 aa, Homo Sapiens
HNTCEGAFG

SEQ ID NO: 1304085 - protein, 9 aa, Homo Sapiens
GFVMLKGRP

SEQ ID NO: 1304086 - protein, 9 aa, Homo Sapiens
ERHGDYLKK

SEQ ID NO: 1304087 - protein, 9 aa, Homo Sapiens
GSKDEEVPS

SEQ ID NO: 1304088 - protein, 9 aa, Homo Sapiens
APQAGIRIN

SEQ ID NO: 1304089 - protein, 9 aa, Homo Sapiens
SSPMVKSKS

SEQ ID NO: 1304090 - protein, 9 aa, Homo Sapiens
MKDIQKNTV

SEQ ID NO: 1304091 - protein, 9 aa, Homo Sapiens
CTDLFSFAC

SEQ ID NO: 1304092 - protein, 9 aa, Homo Sapiens
EWSMSKDFS

SEQ ID NO: 1304093 - protein, 9 aa, Homo Sapiens
QTYEQIKVD

SEQ ID NO: 1304094 - protein, 9 aa, Homo Sapiens
GHKYKGVTK

SEQ ID NO: 1304095 - protein, 9 aa, Homo Sapiens
KRHFKLEKH

SEQ ID NO: 1304096 - protein, 9 aa, Homo Sapiens
KDEAEKKLR

SEQ ID NO: 1304097 - protein, 9 aa, Homo Sapiens
NNIYGIVVA

SEQ ID NO: 1304098 - protein, 9 aa, Homo Sapiens
YLKKEFESV

SEQ ID NO: 1304099 - protein, 9 aa, Homo Sapiens
ISKLVQARN

SEQ ID NO: 1304100 - protein, 9 aa, Homo Sapiens
TEAMLYKKF

SEQ ID NO: 1304101 - protein, 9 aa, Homo Sapiens
SVLGNTSSL

SEQ ID NO: 1304102 - protein, 9 aa, Homo Sapiens
SSADVDWNV

SEQ ID NO: 1304103 - protein, 9 aa, Homo Sapiens
GNYLTGHNN

SEQ ID NO: 1304104 - protein, 9 aa, Homo Sapiens
NAHKVVLAS

SEQ ID NO: 1304105 - protein, 9 aa, Homo Sapiens
KSKQETVIF

SEQ ID NO: 1304106 - protein, 9 aa, Homo Sapiens
EVGQLGPEG

SEQ ID NO: 1304107 - protein, 9 aa, Homo Sapiens
MYSQPFGEN

SEQ ID NO: 1304108 - protein, 9 aa, Homo Sapiens
TVEIMESPI

SEQ ID NO: 1304109 - protein, 9 aa, Homo Sapiens
HIKCRHKRA

SEQ ID NO: 1304110 - protein, 9 aa, Homo Sapiens
PGPVGFPGY

SEQ ID NO: 1304111 - protein, 9 aa, Homo Sapiens
PHLKGRPRK

SEQ ID NO: 1304112 - protein, 9 aa, Homo Sapiens
RSLRIRSEL

SEQ ID NO: 1304113 - protein, 9 aa, Homo Sapiens
VLRITERLQ

SEQ ID NO: 1304114 - protein, 9 aa, Homo Sapiens
PTQIKEMFQ

SEQ ID NO: 1304115 - protein, 9 aa, Homo Sapiens
QTKKASKAR

SEQ ID NO: 1304116 - protein, 9 aa, Homo Sapiens
NKEVSKTVV

SEQ ID NO: 1304117 - protein, 9 aa, Homo Sapiens
EIFMINGES

SEQ ID NO: 1304118 - protein, 9 aa, Homo Sapiens
LSSDESGYL

SEQ ID NO: 1304119 - protein, 9 aa, Homo Sapiens
NILQSQGSP

SEQ ID NO: 1304120 - protein, 9 aa, Homo Sapiens
KIESLGLHS

SEQ ID NO: 1304121 - protein, 9 aa, Homo Sapiens
QNANKTAEL

SEQ ID NO: 1304122 - protein, 9 aa, Homo Sapiens
ITPSAQTQE

SEQ ID NO: 1304123 - protein, 9 aa, Homo Sapiens
LKKTFNIPV

SEQ ID NO: 1304124 - protein, 9 aa, Homo Sapiens
VGDVKINAH

SEQ ID NO: 1304125 - protein, 9 aa, Homo Sapiens
AETAPGIHK

SEQ ID NO: 1304126 - protein, 9 aa, Homo Sapiens
DEAEKKLRK

SEQ ID NO: 1304127 - protein, 9 aa, Homo Sapiens
ATVKTLVNL

SEQ ID NO: 1304128 - protein, 9 aa, Homo Sapiens
NYFRRRTHL

SEQ ID NO: 1304129 - protein, 9 aa, Homo Sapiens
RLRNHEIRE

SEQ ID NO: 1304130 - protein, 9 aa, Homo Sapiens
KYQTVTATL

SEQ ID NO: 1304131 - protein, 9 aa, Homo Sapiens
APLLRIARR

SEQ ID NO: 1304132 - protein, 9 aa, Homo Sapiens
EEDFNKNMN

SEQ ID NO: 1304133 - protein, 9 aa, Homo Sapiens
VTPQGNYFE

SEQ ID NO: 1304134 - protein, 9 aa, Homo Sapiens
MEEENNNKN

SEQ ID NO: 1304135 - protein, 9 aa, Homo Sapiens
QYINGLKFC

SEQ ID NO: 1304136 - protein, 9 aa, Homo Sapiens
GYETIEAYK

SEQ ID NO: 1304137 - protein, 9 aa, Homo Sapiens
PQPKTLDKF

SEQ ID NO: 1304138 - protein, 9 aa, Homo Sapiens
LQNAIKSSM

SEQ ID NO: 1304139 - protein, 9 aa, Homo Sapiens
YLETLRFSI

SEQ ID NO: 1304140 - protein, 9 aa, Homo Sapiens
VETCGIICG

SEQ ID NO: 1304141 - protein, 9 aa, Homo Sapiens
GKSFSLRLS

SEQ ID NO: 1304142 - protein, 9 aa, Homo Sapiens
IMKILTQDT

SEQ ID NO: 1304143 - protein, 9 aa, Homo Sapiens
GVEVLEHLS

SEQ ID NO: 1304144 - protein, 9 aa, Homo Sapiens
SLNTITQKA

SEQ ID NO: 1304145 - protein, 9 aa, Homo Sapiens
RPREELPDN

SEQ ID NO: 1304146 - protein, 9 aa, Homo Sapiens
SQQTILDRY

SEQ ID NO: 1304147 - protein, 9 aa, Homo Sapiens
LCLSKDDLM

SEQ ID NO: 1304148 - protein, 9 aa, Homo Sapiens
VNAQEQKFG

SEQ ID NO: 1304149 - protein, 9 aa, Homo Sapiens
VSMGLGVEV

SEQ ID NO: 1304150 - protein, 9 aa, Homo Sapiens
GNFWMIGDD

SEQ ID NO: 1304151 - protein, 9 aa, Homo Sapiens
TFSFCPPFV

SEQ ID NO: 1304152 - protein, 9 aa, Homo Sapiens
LSSELLQFQ

SEQ ID NO: 1304153 - protein, 9 aa, Homo Sapiens
QPLHTKLNR

SEQ ID NO: 1304154 - protein, 9 aa, Homo Sapiens
LYNPKRQTL

SEQ ID NO: 1304155 - protein, 9 aa, Homo Sapiens
NIPALELMV

SEQ ID NO: 1304156 - protein, 9 aa, Homo Sapiens
LIALTQKNQ

SEQ ID NO: 1304157 - protein, 9 aa, Homo Sapiens
DMVNGTDSE

SEQ ID NO: 1304158 - protein, 9 aa, Homo Sapiens
PNFLPPQPD

SEQ ID NO: 1304159 - protein, 9 aa, Homo Sapiens
RPSPNHSKL

SEQ ID NO: 1304160 - protein, 9 aa, Homo Sapiens
LLILKAFAN

SEQ ID NO: 1304161 - protein, 9 aa, Homo Sapiens
SWQITIRWE

SEQ ID NO: 1304162 - protein, 9 aa, Homo Sapiens
LGTALNILF

SEQ ID NO: 1304163 - protein, 9 aa, Homo Sapiens
KDILMAAGC

SEQ ID NO: 1304164 - protein, 9 aa, Homo Sapiens
APMLSTFVM

SEQ ID NO: 1304165 - protein, 9 aa, Homo Sapiens
VVVGAVGVG

SEQ ID NO: 1304166 - protein, 9 aa, Homo Sapiens
NSGLIQHQI

SEQ ID NO: 1304167 - protein, 9 aa, Homo Sapiens
ALNMLMAMN

SEQ ID NO: 1304168 - protein, 9 aa, Homo Sapiens
CLAILSLHI

SEQ ID NO: 1304169 - protein, 9 aa, Homo Sapiens
NLVFGVLSG

SEQ ID NO: 1304170 - protein, 9 aa, Homo Sapiens
LRIIMLSVL

SEQ ID NO: 1304171 - protein, 9 aa, Homo Sapiens
SPDSLQINQ

SEQ ID NO: 1304172 - protein, 9 aa, Homo Sapiens
IGLTGRPPS

SEQ ID NO: 1304173 - protein, 9 aa, Homo Sapiens
DYGFHFAGD

SEQ ID NO: 1304174 - protein, 9 aa, Homo Sapiens
ISPSVYMGI

SEQ ID NO: 1304175 - protein, 9 aa, Homo Sapiens
VNVFDPNRF

SEQ ID NO: 1304176 - protein, 9 aa, Homo Sapiens
KWISDTELI

SEQ ID NO: 1304177 - protein, 9 aa, Homo Sapiens
KFKECGKAF

SEQ ID NO: 1304178 - protein, 9 aa, Homo Sapiens
GKSYYKVNN

SEQ ID NO: 1304179 - protein, 9 aa, Homo Sapiens
YGIGGLRPA

SEQ ID NO: 1304180 - protein, 9 aa, Homo Sapiens
HYRTESRGV

SEQ ID NO: 1304181 - protein, 9 aa, Homo Sapiens
ELLKDRNPK

SEQ ID NO: 1304182 - protein, 9 aa, Homo Sapiens
PATQEPDNI

SEQ ID NO: 1304183 - protein, 9 aa, Homo Sapiens
ENLDAIQVL

SEQ ID NO: 1304184 - protein, 9 aa, Homo Sapiens
GEKPFWCTF

SEQ ID NO: 1304185 - protein, 9 aa, Homo Sapiens
IYQFHYNNW

SEQ ID NO: 1304186 - protein, 9 aa, Homo Sapiens
ELDPEDKCR

SEQ ID NO: 1304187 - protein, 9 aa, Homo Sapiens
HHATILAVS

SEQ ID NO: 1304188 - protein, 9 aa, Homo Sapiens
ILITMASYI

SEQ ID NO: 1304189 - protein, 9 aa, Homo Sapiens
MINKIMLTK

SEQ ID NO: 1304190 - protein, 9 aa, Homo Sapiens
SKEICNELE

SEQ ID NO: 1304191 - protein, 9 aa, Homo Sapiens
KNPNFKVFR

SEQ ID NO: 1304192 - protein, 9 aa, Homo Sapiens
ILSSNIISY

SEQ ID NO: 1304193 - protein, 9 aa, Homo Sapiens
LTVHQIIHT

SEQ ID NO: 1304194 - protein, 9 aa, Homo Sapiens
LYELCDELG

SEQ ID NO: 1304195 - protein, 9 aa, Homo Sapiens
LIQVQRRGS

SEQ ID NO: 1304196 - protein, 9 aa, Homo Sapiens
QSPVQENSS

SEQ ID NO: 1304197 - protein, 9 aa, Homo Sapiens
NDNTKFYAA

SEQ ID NO: 1304198 - protein, 9 aa, Homo Sapiens
SREDYISEN

SEQ ID NO: 1304199 - protein, 9 aa, Homo Sapiens
VKYIWLAAN

SEQ ID NO: 1304200 - protein, 9 aa, Homo Sapiens
AARSDNYSL

SEQ ID NO: 1304201 - protein, 9 aa, Homo Sapiens
SDLLCLSKD

SEQ ID NO: 1304202 - protein, 9 aa, Homo Sapiens
YFDAVFLDP

SEQ ID NO: 1304203 - protein, 9 aa, Homo Sapiens
FAINHQLNV

SEQ ID NO: 1304204 - protein, 9 aa, Homo Sapiens
HHTLILCVW

SEQ ID NO: 1304205 - protein, 9 aa, Homo Sapiens
LKNIISRPW

SEQ ID NO: 1304206 - protein, 9 aa, Homo Sapiens
EGRGTNKEE

SEQ ID NO: 1304207 - protein, 9 aa, Homo Sapiens
HSAQHLDNV

SEQ ID NO: 1304208 - protein, 9 aa, Homo Sapiens
EFAKDIDVS

SEQ ID NO: 1304209 - protein, 9 aa, Homo Sapiens
KIINSMWKQ

SEQ ID NO: 1304210 - protein, 9 aa, Homo Sapiens
HHGSADAKG

SEQ ID NO: 1304211 - protein, 9 aa, Homo Sapiens
LSTFVMGKD

SEQ ID NO: 1304212 - protein, 9 aa, Homo Sapiens
GPSAKQRYK

SEQ ID NO: 1304213 - protein, 9 aa, Homo Sapiens
PPLSGAPQA

SEQ ID NO: 1304214 - protein, 9 aa, Homo Sapiens
LCQTFWQAS

SEQ ID NO: 1304215 - protein, 9 aa, Homo Sapiens
LELMCETKL

SEQ ID NO: 1304216 - protein, 9 aa, Homo Sapiens
HTLILCVWF

SEQ ID NO: 1304217 - protein, 9 aa, Homo Sapiens
EVNEWMAQY

SEQ ID NO: 1304218 - protein, 9 aa, Homo Sapiens
GEECVEDLR

SEQ ID NO: 1304219 - protein, 9 aa, Homo Sapiens
ADGYSDKIE

SEQ ID NO: 1304220 - protein, 9 aa, Homo Sapiens
KKLRFHPWQ

SEQ ID NO: 1304221 - protein, 9 aa, Homo Sapiens
KMSRITLLP

SEQ ID NO: 1304222 - protein, 9 aa, Homo Sapiens
ISFKTYLSG

SEQ ID NO: 1304223 - protein, 9 aa, Homo Sapiens
SLEDQIEDF

SEQ ID NO: 1304224 - protein, 9 aa, Homo Sapiens
NTQMFQPMK

SEQ ID NO: 1304225 - protein, 9 aa, Homo Sapiens
GNPRVPDAK

SEQ ID NO: 1304226 - protein, 9 aa, Homo Sapiens
KLFENKVVQ

SEQ ID NO: 1304227 - protein, 9 aa, Homo Sapiens
NHSKLSNVA

SEQ ID NO: 1304228 - protein, 9 aa, Homo Sapiens
TIYQFHYNN

SEQ ID NO: 1304229 - protein, 9 aa, Homo Sapiens
NYFEYTAKI

SEQ ID NO: 1304230 - protein, 9 aa, Homo Sapiens
LWKENVIIL

SEQ ID NO: 1304231 - protein, 9 aa, Homo Sapiens
KAIGNTLFD

SEQ ID NO: 1304232 - protein, 9 aa, Homo Sapiens
VHWKPSDKL

SEQ ID NO: 1304233 - protein, 9 aa, Homo Sapiens
IDSQLVVCN

SEQ ID NO: 1304234 - protein, 9 aa, Homo Sapiens
LYESIIPKK

SEQ ID NO: 1304235 - protein, 9 aa, Homo Sapiens
RYQFLWGSR

SEQ ID NO: 1304236 - protein, 9 aa, Homo Sapiens
SQLVVCNPN

SEQ ID NO: 1304237 - protein, 9 aa, Homo Sapiens
RLWVLVVLD

SEQ ID NO: 1304238 - protein, 9 aa, Homo Sapiens
CILSKMLGI

SEQ ID NO: 1304239 - protein, 9 aa, Homo Sapiens
GLEAMALTS

SEQ ID NO: 1304240 - protein, 9 aa, Homo Sapiens
FNKISDKLN

SEQ ID NO: 1304241 - protein, 9 aa, Homo Sapiens
LLNISLESE

SEQ ID NO: 1304242 - protein, 9 aa, Homo Sapiens
YMGHIMEKE

SEQ ID NO: 1304243 - protein, 9 aa, Homo Sapiens
PENTPIAQP

SEQ ID NO: 1304244 - protein, 9 aa, Homo Sapiens
IWFILGNYW

SEQ ID NO: 1304245 - protein, 9 aa, Homo Sapiens
EHVLIILWM

SEQ ID NO: 1304246 - protein, 9 aa, Homo Sapiens
CESWDKIKS

SEQ ID NO: 1304247 - protein, 9 aa, Homo Sapiens
NPPASEVLQ

SEQ ID NO: 1304248 - protein, 9 aa, Homo Sapiens
FRPRPHQQP

SEQ ID NO: 1304249 - protein, 9 aa, Homo Sapiens
TNSERITVK

SEQ ID NO: 1304250 - protein, 9 aa, Homo Sapiens
EIYKGKITP

SEQ ID NO: 1304251 - protein, 9 aa, Homo Sapiens
IEFACHQLY

SEQ ID NO: 1304252 - protein, 9 aa, Homo Sapiens
LSYYKSTSS

SEQ ID NO: 1304253 - protein, 9 aa, Homo Sapiens
LHSHMINKI

SEQ ID NO: 1304254 - protein, 9 aa, Homo Sapiens
TALNILFSE

SEQ ID NO: 1304255 - protein, 9 aa, Homo Sapiens
AKPNNIKSM

SEQ ID NO: 1304256 - protein, 9 aa, Homo Sapiens
MEFGLEHTT

SEQ ID NO: 1304257 - protein, 9 aa, Homo Sapiens
NKSPKISRA

SEQ ID NO: 1304258 - protein, 9 aa, Homo Sapiens
YLGQMPIII

SEQ ID NO: 1304259 - protein, 9 aa, Homo Sapiens
GVDKRVTRL

SEQ ID NO: 1304260 - protein, 9 aa, Homo Sapiens
EKIKNHYFP

SEQ ID NO: 1304261 - protein, 9 aa, Homo Sapiens
ITYGLFCGE

SEQ ID NO: 1304262 - protein, 9 aa, Homo Sapiens
QLQVFLCLE

SEQ ID NO: 1304263 - protein, 9 aa, Homo Sapiens
QAVPRPLPK

SEQ ID NO: 1304264 - protein, 9 aa, Homo Sapiens
RDCVIGLMM

SEQ ID NO: 1304265 - protein, 9 aa, Homo Sapiens
PNYAATSIY

SEQ ID NO: 1304266 - protein, 9 aa, Homo Sapiens
NLLNENNAS

SEQ ID NO: 1304267 - protein, 9 aa, Homo Sapiens
LGIHQIIHT

SEQ ID NO: 1304268 - protein, 9 aa, Homo Sapiens
MTSKRHFKL

SEQ ID NO: 1304269 - protein, 9 aa, Homo Sapiens
LAVGVFSFS

SEQ ID NO: 1304270 - protein, 9 aa, Homo Sapiens
RLSLSFWLK

SEQ ID NO: 1304271 - protein, 9 aa, Homo Sapiens
GIITTKGLV

SEQ ID NO: 1304272 - protein, 9 aa, Homo Sapiens
NFIFFLGTQ

SEQ ID NO: 1304273 - protein, 9 aa, Homo Sapiens
LMTSAVPVA

SEQ ID NO: 1304274 - protein, 9 aa, Homo Sapiens
QTILDRYYT

SEQ ID NO: 1304275 - protein, 9 aa, Homo Sapiens
TNTNNLKVP

SEQ ID NO: 1304276 - protein, 9 aa, Homo Sapiens
YPENLPALV

SEQ ID NO: 1304277 - protein, 9 aa, Homo Sapiens
ASSSEDSIT

SEQ ID NO: 1304278 - protein, 9 aa, Homo Sapiens
AVQKAAPSS

SEQ ID NO: 1304279 - protein, 9 aa, Homo Sapiens
LTRMIPLDP

SEQ ID NO: 1304280 - protein, 9 aa, Homo Sapiens
EVIQEKLLL

SEQ ID NO: 1304281 - protein, 9 aa, Homo Sapiens
ERRSLRIRS

SEQ ID NO: 1304282 - protein, 9 aa, Homo Sapiens
YTQRSYSWF

SEQ ID NO: 1304283 - protein, 9 aa, Homo Sapiens
MPSFQLCVY

SEQ ID NO: 1304284 - protein, 9 aa, Homo Sapiens
ILPLLKLSC

SEQ ID NO: 1304285 - protein, 9 aa, Homo Sapiens
NINTQMFQP

SEQ ID NO: 1304286 - protein, 9 aa, Homo Sapiens
HEIYKGKIT

SEQ ID NO: 1304287 - protein, 9 aa, Homo Sapiens
TEWAGFFKQ

SEQ ID NO: 1304288 - protein, 9 aa, Homo Sapiens
VNWASSIDD

SEQ ID NO: 1304289 - protein, 9 aa, Homo Sapiens
GELTVDQRA

SEQ ID NO: 1304290 - protein, 9 aa, Homo Sapiens
QENGPILLD

SEQ ID NO: 1304291 - protein, 9 aa, Homo Sapiens
CNKFFRREH

SEQ ID NO: 1304292 - protein, 9 aa, Homo Sapiens
VGIHHGSAD

SEQ ID NO: 1304293 - protein, 9 aa, Homo Sapiens
VLLEKHDDK

SEQ ID NO: 1304294 - protein, 9 aa, Homo Sapiens
LCWNNVAAG

SEQ ID NO: 1304295 - protein, 9 aa, Homo Sapiens
CHSGEIFGI

SEQ ID NO: 1304296 - protein, 9 aa, Homo Sapiens
YEGQITEDE

SEQ ID NO: 1304297 - protein, 9 aa, Homo Sapiens
CGAKTQNGV

SEQ ID NO: 1304298 - protein, 9 aa, Homo Sapiens
VIVHTVSGF

SEQ ID NO: 1304299 - protein, 9 aa, Homo Sapiens
LNLFKALKH

SEQ ID NO: 1304300 - protein, 9 aa, Homo Sapiens
HGNKALGRE

SEQ ID NO: 1304301 - protein, 9 aa, Homo Sapiens
IIGVTQKTI

SEQ ID NO: 1304302 - protein, 9 aa, Homo Sapiens
KLGSTQIMK

SEQ ID NO: 1304303 - protein, 9 aa, Homo Sapiens
HNPESLSVD

SEQ ID NO: 1304304 - protein, 9 aa, Homo Sapiens
ICLRTRSSH

SEQ ID NO: 1304305 - protein, 9 aa, Homo Sapiens
FCPPFVSCI

SEQ ID NO: 1304306 - protein, 9 aa, Homo Sapiens
ALGGRESYM

SEQ ID NO: 1304307 - protein, 9 aa, Homo Sapiens
LLLLLVQCH

SEQ ID NO: 1304308 - protein, 9 aa, Homo Sapiens
LNRLLLELN

SEQ ID NO: 1304309 - protein, 9 aa, Homo Sapiens
KEAKDLPVK

SEQ ID NO: 1304310 - protein, 9 aa, Homo Sapiens
ETIEAYKDD

SEQ ID NO: 1304311 - protein, 9 aa, Homo Sapiens
KLNWKIILI

SEQ ID NO: 1304312 - protein, 9 aa, Homo Sapiens
RDFLQYLQS

SEQ ID NO: 1304313 - protein, 9 aa, Homo Sapiens
ALKSEDLNI

SEQ ID NO: 1304314 - protein, 9 aa, Homo Sapiens
AFGKDGSNL

SEQ ID NO: 1304315 - protein, 9 aa, Homo Sapiens
HSGEIFGID

SEQ ID NO: 1304316 - protein, 9 aa, Homo Sapiens
DKIEHVGDF

SEQ ID NO: 1304317 - protein, 9 aa, Homo Sapiens
KGPEEKQSV

SEQ ID NO: 1304318 - protein, 9 aa, Homo Sapiens
SRLGAASMP

SEQ ID NO: 1304319 - protein, 9 aa, Homo Sapiens
GYLTFSLKN

SEQ ID NO: 1304320 - protein, 9 aa, Homo Sapiens
TLLKPSRRS

SEQ ID NO: 1304321 - protein, 9 aa, Homo Sapiens
YRTESRGVN

SEQ ID NO: 1304322 - protein, 9 aa, Homo Sapiens
IPRPREELP

SEQ ID NO: 1304323 - protein, 9 aa, Homo Sapiens
QGVTVRCWI

SEQ ID NO: 1304324 - protein, 9 aa, Homo Sapiens
CVLLPDPAV

SEQ ID NO: 1304325 - protein, 9 aa, Homo Sapiens
IVTLIKHQR

SEQ ID NO: 1304326 - protein, 9 aa, Homo Sapiens
FYPVIFSQY

SEQ ID NO: 1304327 - protein, 9 aa, Homo Sapiens
DAFSFLAKR

SEQ ID NO: 1304328 - protein, 9 aa, Homo Sapiens
NIIIISSRR

SEQ ID NO: 1304329 - protein, 9 aa, Homo Sapiens
KRNFDLEND

SEQ ID NO: 1304330 - protein, 9 aa, Homo Sapiens
SEQLYDRSL

SEQ ID NO: 1304331 - protein, 9 aa, Homo Sapiens
VLTAVHCVE

SEQ ID NO: 1304332 - protein, 9 aa, Homo Sapiens
VEKKKKNQK

SEQ ID NO: 1304333 - protein, 9 aa, Homo Sapiens
KSPPANGPP

SEQ ID NO: 1304334 - protein, 9 aa, Homo Sapiens
IGEKRYECE

SEQ ID NO: 1304335 - protein, 9 aa, Homo Sapiens
KHLQAAVDH

SEQ ID NO: 1304336 - protein, 9 aa, Homo Sapiens
FLWGSRAHA

SEQ ID NO: 1304337 - protein, 9 aa, Homo Sapiens
CLRTSEKAG

SEQ ID NO: 1304338 - protein, 9 aa, Homo Sapiens
SSELLQFQV

SEQ ID NO: 1304339 - protein, 9 aa, Homo Sapiens
PPLPPAKGS

SEQ ID NO: 1304340 - protein, 9 aa, Homo Sapiens
AHTFCEHMD

SEQ ID NO: 1304341 - protein, 9 aa, Homo Sapiens
KTYWKVCLH

SEQ ID NO: 1304342 - protein, 9 aa, Homo Sapiens
GSVLRYPSF

SEQ ID NO: 1304343 - protein, 9 aa, Homo Sapiens
PGMHKLKLE

SEQ ID NO: 1304344 - protein, 9 aa, Homo Sapiens
IIKSECSLH

SEQ ID NO: 1304345 - protein, 9 aa, Homo Sapiens
SLAAFKINK

SEQ ID NO: 1304346 - protein, 9 aa, Homo Sapiens
IIHNNLNPV

SEQ ID NO: 1304347 - protein, 9 aa, Homo Sapiens
YPKFKWPII

SEQ ID NO: 1304348 - protein, 9 aa, Homo Sapiens
SQLRENKYL

SEQ ID NO: 1304349 - protein, 9 aa, Homo Sapiens
CWNNVAAGT

SEQ ID NO: 1304350 - protein, 9 aa, Homo Sapiens
GTDFWYEYQ

SEQ ID NO: 1304351 - protein, 9 aa, Homo Sapiens
TQNFIFFLG

SEQ ID NO: 1304352 - protein, 9 aa, Homo Sapiens
KFDSFRQSL

SEQ ID NO: 1304353 - protein, 9 aa, Homo Sapiens
FSVSSSLQI

SEQ ID NO: 1304354 - protein, 9 aa, Homo Sapiens
SSKAHLYRE

SEQ ID NO: 1304355 - protein, 9 aa, Homo Sapiens
LSSNIISYF

SEQ ID NO: 1304356 - protein, 9 aa, Homo Sapiens
AKSQFSICL

SEQ ID NO: 1304357 - protein, 9 aa, Homo Sapiens
AFSVSSSLQ

SEQ ID NO: 1304358 - protein, 9 aa, Homo Sapiens
VEKGTIHYL

SEQ ID NO: 1304359 - protein, 9 aa, Homo Sapiens
TSVTVMSTF

SEQ ID NO: 1304360 - protein, 9 aa, Homo Sapiens
KYVNKAKRQ

SEQ ID NO: 1304361 - protein, 9 aa, Homo Sapiens
RDCGAKTQN

SEQ ID NO: 1304362 - protein, 9 aa, Homo Sapiens
GIKVQLRPL

SEQ ID NO: 1304363 - protein, 9 aa, Homo Sapiens
IIGLGDRHV

SEQ ID NO: 1304364 - protein, 9 aa, Homo Sapiens
VAFAINHQL

SEQ ID NO: 1304365 - protein, 9 aa, Homo Sapiens
SQDETEQNQ

SEQ ID NO: 1304366 - protein, 9 aa, Homo Sapiens
MMSDYRGFG

SEQ ID NO: 1304367 - protein, 9 aa, Homo Sapiens
LFTTIYLTA

SEQ ID NO: 1304368 - protein, 9 aa, Homo Sapiens
PTRMGGLFN

SEQ ID NO: 1304369 - protein, 9 aa, Homo Sapiens
NSQNKIKQV

SEQ ID NO: 1304370 - protein, 9 aa, Homo Sapiens
ILNISADCL

SEQ ID NO: 1304371 - protein, 9 aa, Homo Sapiens
WNVEFSATC

SEQ ID NO: 1304372 - protein, 9 aa, Homo Sapiens
RIVTLIKHQ

SEQ ID NO: 1304373 - protein, 9 aa, Homo Sapiens
ENGKYQLAT

SEQ ID NO: 1304374 - protein, 9 aa, Homo Sapiens
EDKVIKLHK

SEQ ID NO: 1304375 - protein, 9 aa, Homo Sapiens
EPGPMINCE

SEQ ID NO: 1304376 - protein, 9 aa, Homo Sapiens
FDLENDILY

SEQ ID NO: 1304377 - protein, 9 aa, Homo Sapiens
RDQLLASNG

SEQ ID NO: 1304378 - protein, 9 aa, Homo Sapiens
LSGELTVDQ

SEQ ID NO: 1304379 - protein, 9 aa, Homo Sapiens
FEMCKGVRD

SEQ ID NO: 1304380 - protein, 9 aa, Homo Sapiens
QLLILKAFA

SEQ ID NO: 1304381 - protein, 9 aa, Homo Sapiens
PSAKQRYKN

SEQ ID NO: 1304382 - protein, 9 aa, Homo Sapiens
DPKTISFWS

SEQ ID NO: 1304383 - protein, 9 aa, Homo Sapiens
TLRPRCIIG

SEQ ID NO: 1304384 - protein, 9 aa, Homo Sapiens
IRLRRNMCL

SEQ ID NO: 1304385 - protein, 9 aa, Homo Sapiens
KYLMWFDKT

SEQ ID NO: 1304386 - protein, 9 aa, Homo Sapiens
PSDKLLEEE

SEQ ID NO: 1304387 - protein, 9 aa, Homo Sapiens
VHWDQVFSG

SEQ ID NO: 1304388 - protein, 9 aa, Homo Sapiens
MSPSKNYFI

SEQ ID NO: 1304389 - protein, 9 aa, Homo Sapiens
AIQAPHSPR

SEQ ID NO: 1304390 - protein, 9 aa, Homo Sapiens
TLKIIPSYM

SEQ ID NO: 1304391 - protein, 9 aa, Homo Sapiens
EIICRFETR

SEQ ID NO: 1304392 - protein, 9 aa, Homo Sapiens
SLEDNLLHQ

SEQ ID NO: 1304393 - protein, 9 aa, Homo Sapiens
FEPGPMINC

SEQ ID NO: 1304394 - protein, 9 aa, Homo Sapiens
CVQCGKSFS

SEQ ID NO: 1304395 - protein, 9 aa, Homo Sapiens
ILLVSYLKI

SEQ ID NO: 1304396 - protein, 9 aa, Homo Sapiens
NTVMGRVIE

SEQ ID NO: 1304397 - protein, 9 aa, Homo Sapiens
SVKYKSSNK

SEQ ID NO: 1304398 - protein, 9 aa, Homo Sapiens
RIILYESII

SEQ ID NO: 1304399 - protein, 9 aa, Homo Sapiens
KHHLKEHLQ

SEQ ID NO: 1304400 - protein, 9 aa, Homo Sapiens
LLKRDCGAK

SEQ ID NO: 1304401 - protein, 9 aa, Homo Sapiens
PDNILPRSQ

SEQ ID NO: 1304402 - protein, 9 aa, Homo Sapiens
DGHYARTEY

SEQ ID NO: 1304403 - protein, 9 aa, Homo Sapiens
NQHKHKFQA

SEQ ID NO: 1304404 - protein, 9 aa, Homo Sapiens
KDVITINQD

SEQ ID NO: 1304405 - protein, 9 aa, Homo Sapiens
VNTRLTLLQ

SEQ ID NO: 1304406 - protein, 9 aa, Homo Sapiens
VALTKLTKF

SEQ ID NO: 1304407 - protein, 9 aa, Homo Sapiens
KIKKDKKAK

SEQ ID NO: 1304408 - protein, 9 aa, Homo Sapiens
SESPDKPLE

SEQ ID NO: 1304409 - protein, 9 aa, Homo Sapiens
LFRPRCLRT

SEQ ID NO: 1304410 - protein, 9 aa, Homo Sapiens
AHRTVFMRL

SEQ ID NO: 1304411 - protein, 9 aa, Homo Sapiens
DPEDKCRMA

SEQ ID NO: 1304412 - protein, 9 aa, Homo Sapiens
NYLGQMPII

SEQ ID NO: 1304413 - protein, 9 aa, Homo Sapiens
IVFCKIQME

SEQ ID NO: 1304414 - protein, 9 aa, Homo Sapiens
KVIGTLKNY

SEQ ID NO: 1304415 - protein, 9 aa, Homo Sapiens
VTPTILNFI

SEQ ID NO: 1304416 - protein, 9 aa, Homo Sapiens
HEIIHMREK

SEQ ID NO: 1304417 - protein, 9 aa, Homo Sapiens
KRDCGAKTQ

SEQ ID NO: 1304418 - protein, 9 aa, Homo Sapiens
GLLALGASL

SEQ ID NO: 1304419 - protein, 9 aa, Homo Sapiens
VPNYFSPQT

SEQ ID NO: 1304420 - protein, 9 aa, Homo Sapiens
RHKLIETDF

SEQ ID NO: 1304421 - protein, 9 aa, Homo Sapiens
IMAMAMTHN

SEQ ID NO: 1304422 - protein, 9 aa, Homo Sapiens
FSILLFPVR

SEQ ID NO: 1304423 - protein, 9 aa, Homo Sapiens
SHLTSHKII

SEQ ID NO: 1304424 - protein, 9 aa, Homo Sapiens
QFEEVIQEK

SEQ ID NO: 1304425 - protein, 9 aa, Homo Sapiens
QVVCWRSMR

SEQ ID NO: 1304426 - protein, 9 aa, Homo Sapiens
IALNTCILS

SEQ ID NO: 1304427 - protein, 9 aa, Homo Sapiens
LHKELNAAV

SEQ ID NO: 1304428 - protein, 9 aa, Homo Sapiens
HLKGRPRKK

SEQ ID NO: 1304429 - protein, 9 aa, Homo Sapiens
KMNTYMNYT

SEQ ID NO: 1304430 - protein, 9 aa, Homo Sapiens
LKKPYQPII

SEQ ID NO: 1304431 - protein, 9 aa, Homo Sapiens
KTSNNIKDD

SEQ ID NO: 1304432 - protein, 9 aa, Homo Sapiens
VQELLKDRN

SEQ ID NO: 1304433 - protein, 9 aa, Homo Sapiens
KDDLYRDES

SEQ ID NO: 1304434 - protein, 9 aa, Homo Sapiens
ASVQALQHK

SEQ ID NO: 1304435 - protein, 9 aa, Homo Sapiens
IFMINGESK

SEQ ID NO: 1304436 - protein, 9 aa, Homo Sapiens
MHVFNPIDF

SEQ ID NO: 1304437 - protein, 9 aa, Homo Sapiens
IEWIIEEVE

SEQ ID NO: 1304438 - protein, 9 aa, Homo Sapiens
SRFNKIINS

SEQ ID NO: 1304439 - protein, 9 aa, Homo Sapiens
LHSSQHYCG

SEQ ID NO: 1304440 - protein, 9 aa, Homo Sapiens
IQTKKASKA

SEQ ID NO: 1304441 - protein, 9 aa, Homo Sapiens
EVTGTCLGE

SEQ ID NO: 1304442 - protein, 9 aa, Homo Sapiens
GSVIAQNLE

SEQ ID NO: 1304443 - protein, 9 aa, Homo Sapiens
QKITVAVTI

SEQ ID NO: 1304444 - protein, 9 aa, Homo Sapiens
HQQPTTEGG

SEQ ID NO: 1304445 - protein, 9 aa, Homo Sapiens
GDHVGSLSD

SEQ ID NO: 1304446 - protein, 9 aa, Homo Sapiens
RNCQYSVWV

SEQ ID NO: 1304447 - protein, 9 aa, Homo Sapiens
MKVLEKKRA

SEQ ID NO: 1304448 - protein, 9 aa, Homo Sapiens
NQKCQKCRW

SEQ ID NO: 1304449 - protein, 9 aa, Homo Sapiens
CSDRDKAFI

SEQ ID NO: 1304450 - protein, 9 aa, Homo Sapiens
KEIVKNYLE

SEQ ID NO: 1304451 - protein, 9 aa, Homo Sapiens
EPQIGWYNR

SEQ ID NO: 1304452 - protein, 9 aa, Homo Sapiens
SDYNLLQAE

SEQ ID NO: 1304453 - protein, 9 aa, Homo Sapiens
QNINAVHSH

SEQ ID NO: 1304454 - protein, 9 aa, Homo Sapiens
ISDPEEDDK

SEQ ID NO: 1304455 - protein, 9 aa, Homo Sapiens
LLKNIPEKT

SEQ ID NO: 1304456 - protein, 9 aa, Homo Sapiens
GQDQNGGVG

SEQ ID NO: 1304457 - protein, 9 aa, Homo Sapiens
SQQYEVNQS

SEQ ID NO: 1304458 - protein, 9 aa, Homo Sapiens
HHAYVFLQS

SEQ ID NO: 1304459 - protein, 9 aa, Homo Sapiens
EERLIRLRR

SEQ ID NO: 1304460 - protein, 9 aa, Homo Sapiens
SYMTIAPKG

SEQ ID NO: 1304461 - protein, 9 aa, Homo Sapiens
QNKGEKPEA

SEQ ID NO: 1304462 - protein, 9 aa, Homo Sapiens
LQSQDETEQ

SEQ ID NO: 1304463 - protein, 9 aa, Homo Sapiens
LVTKIKLPN

SEQ ID NO: 1304464 - protein, 9 aa, Homo Sapiens
AVPRPLPKR

SEQ ID NO: 1304465 - protein, 9 aa, Homo Sapiens
LPERNKLSE

SEQ ID NO: 1304466 - protein, 9 aa, Homo Sapiens
IIHTGKKPH

SEQ ID NO: 1304467 - protein, 9 aa, Homo Sapiens
NVTSPLESN

SEQ ID NO: 1304468 - protein, 9 aa, Homo Sapiens
EFSCTGGYE

SEQ ID NO: 1304469 - protein, 9 aa, Homo Sapiens
IQYNDDDHK

SEQ ID NO: 1304470 - protein, 9 aa, Homo Sapiens
KGTAEELQE

SEQ ID NO: 1304471 - protein, 9 aa, Homo Sapiens
QSMQTSRLM

SEQ ID NO: 1304472 - protein, 9 aa, Homo Sapiens
EQDKYLSYG

SEQ ID NO: 1304473 - protein, 9 aa, Homo Sapiens
RIASESWAI

SEQ ID NO: 1304474 - protein, 9 aa, Homo Sapiens
LEEIFMING

SEQ ID NO: 1304475 - protein, 9 aa, Homo Sapiens
RAVKYIWLA

SEQ ID NO: 1304476 - protein, 9 aa, Homo Sapiens
RATPHSYSA

SEQ ID NO: 1304477 - protein, 9 aa, Homo Sapiens
PNLSRNCQY

SEQ ID NO: 1304478 - protein, 9 aa, Homo Sapiens
NKRAEDDAK

SEQ ID NO: 1304479 - protein, 9 aa, Homo Sapiens
HYNNWPDHD

SEQ ID NO: 1304480 - protein, 9 aa, Homo Sapiens
TRIKLWEMD

SEQ ID NO: 1304481 - protein, 9 aa, Homo Sapiens
RRNMCLLLT

SEQ ID NO: 1304482 - protein, 9 aa, Homo Sapiens
GTTWFEAHV

SEQ ID NO: 1304483 - protein, 9 aa, Homo Sapiens
WQLYLSVKQ

SEQ ID NO: 1304484 - protein, 9 aa, Homo Sapiens
FSKISGILT

SEQ ID NO: 1304485 - protein, 9 aa, Homo Sapiens
DAIATLHEK

SEQ ID NO: 1304486 - protein, 9 aa, Homo Sapiens
DKLAAVVNN

SEQ ID NO: 1304487 - protein, 9 aa, Homo Sapiens
IFMFVIFLA

SEQ ID NO: 1304488 - protein, 9 aa, Homo Sapiens
SMVSKRFCF

SEQ ID NO: 1304489 - protein, 9 aa, Homo Sapiens
LQYLQSLLA

SEQ ID NO: 1304490 - protein, 9 aa, Homo Sapiens
NIIPLHIIS

SEQ ID NO: 1304491 - protein, 9 aa, Homo Sapiens
EIIVLNQGK

SEQ ID NO: 1304492 - protein, 9 aa, Homo Sapiens
INCEDINEC

SEQ ID NO: 1304493 - protein, 9 aa, Homo Sapiens
EQKFGRTAL

SEQ ID NO: 1304494 - protein, 9 aa, Homo Sapiens
SYDQNNGFY

SEQ ID NO: 1304495 - protein, 9 aa, Homo Sapiens
SKIIHNNLN

SEQ ID NO: 1304496 - protein, 9 aa, Homo Sapiens
ALNILFSEK

SEQ ID NO: 1304497 - protein, 9 aa, Homo Sapiens
WKRVEKYVN

SEQ ID NO: 1304498 - protein, 9 aa, Homo Sapiens
WSRVLPSNA

SEQ ID NO: 1304499 - protein, 9 aa, Homo Sapiens
GITYRNKYL

SEQ ID NO: 1304500 - protein, 9 aa, Homo Sapiens
SPQIEHALG

SEQ ID NO: 1304501 - protein, 9 aa, Homo Sapiens
VSEMYRMEE

SEQ ID NO: 1304502 - protein, 9 aa, Homo Sapiens
KEHEEEEEI

SEQ ID NO: 1304503 - protein, 9 aa, Homo Sapiens
ERQVLDEAN

SEQ ID NO: 1304504 - protein, 9 aa, Homo Sapiens
FSFCPPFVS

SEQ ID NO: 1304505 - protein, 9 aa, Homo Sapiens
ISYSEHDYL

SEQ ID NO: 1304506 - protein, 9 aa, Homo Sapiens
LPKTVKNVT

SEQ ID NO: 1304507 - protein, 9 aa, Homo Sapiens
KYMTKAGTF

SEQ ID NO: 1304508 - protein, 9 aa, Homo Sapiens
KSWQITIRW

SEQ ID NO: 1304509 - protein, 9 aa, Homo Sapiens
PDQTKDNLV

SEQ ID NO: 1304510 - protein, 9 aa, Homo Sapiens
NILSFYFDP

SEQ ID NO: 1304511 - protein, 9 aa, Homo Sapiens
NKLIQSEEI

SEQ ID NO: 1304512 - protein, 9 aa, Homo Sapiens
TICEKIHLL

SEQ ID NO: 1304513 - protein, 9 aa, Homo Sapiens
LVIAADMLG

SEQ ID NO: 1304514 - protein, 9 aa, Homo Sapiens
NDAIVAFAI

SEQ ID NO: 1304515 - protein, 9 aa, Homo Sapiens
LKMPAYQLG

SEQ ID NO: 1304516 - protein, 9 aa, Homo Sapiens
LTTRVTKEE

SEQ ID NO: 1304517 - protein, 9 aa, Homo Sapiens
CSDLELMCE

SEQ ID NO: 1304518 - protein, 9 aa, Homo Sapiens
TGGYELQGS

SEQ ID NO: 1304519 - protein, 9 aa, Homo Sapiens
DQNGGVGRE

SEQ ID NO: 1304520 - protein, 9 aa, Homo Sapiens
FLKILEKLL

SEQ ID NO: 1304521 - protein, 9 aa, Homo Sapiens
AALKATGNN

SEQ ID NO: 1304522 - protein, 9 aa, Homo Sapiens
TVFKHSLEE

SEQ ID NO: 1304523 - protein, 9 aa, Homo Sapiens
FSSDNTISS

SEQ ID NO: 1304524 - protein, 9 aa, Homo Sapiens
IIPVLRSLA

SEQ ID NO: 1304525 - protein, 9 aa, Homo Sapiens
TFYATPVTA

SEQ ID NO: 1304526 - protein, 9 aa, Homo Sapiens
KALGQKDKI

SEQ ID NO: 1304527 - protein, 9 aa, Homo Sapiens
TINGKLEES

SEQ ID NO: 1304528 - protein, 9 aa, Homo Sapiens
EATTINLSI

SEQ ID NO: 1304529 - protein, 9 aa, Homo Sapiens
SICLRTRSS

SEQ ID NO: 1304530 - protein, 9 aa, Homo Sapiens
HEVSDTLKT

SEQ ID NO: 1304531 - protein, 9 aa, Homo Sapiens
LFTVSPENG

SEQ ID NO: 1304532 - protein, 9 aa, Homo Sapiens
TSSIVGYII

SEQ ID NO: 1304533 - protein, 9 aa, Homo Sapiens
QKDAENEVN

SEQ ID NO: 1304534 - protein, 9 aa, Homo Sapiens
KGRSTNYVF

SEQ ID NO: 1304535 - protein, 9 aa, Homo Sapiens
QLQLSEVTG

SEQ ID NO: 1304536 - protein, 9 aa, Homo Sapiens
RLIQFSEML

SEQ ID NO: 1304537 - protein, 9 aa, Homo Sapiens
IYHNWDTGR

SEQ ID NO: 1304538 - protein, 9 aa, Homo Sapiens
HLYGIGGLR

SEQ ID NO: 1304539 - protein, 9 aa, Homo Sapiens
FVIFLAGFT

SEQ ID NO: 1304540 - protein, 9 aa, Homo Sapiens
KTDYNNPID

SEQ ID NO: 1304541 - protein, 9 aa, Homo Sapiens
QLCVYVHDQ

SEQ ID NO: 1304542 - protein, 9 aa, Homo Sapiens
AINHQLNVV

SEQ ID NO: 1304543 - protein, 9 aa, Homo Sapiens
NPSNPSMEE

SEQ ID NO: 1304544 - protein, 9 aa, Homo Sapiens
PSTIFQASA

SEQ ID NO: 1304545 - protein, 9 aa, Homo Sapiens
LINYFAIAE

SEQ ID NO: 1304546 - protein, 9 aa, Homo Sapiens
LGNTSSLWS

SEQ ID NO: 1304547 - protein, 9 aa, Homo Sapiens
PNKISEDGT

SEQ ID NO: 1304548 - protein, 9 aa, Homo Sapiens
KSFCRKSAL

SEQ ID NO: 1304549 - protein, 9 aa, Homo Sapiens
SVIMRGSSR

SEQ ID NO: 1304550 - protein, 9 aa, Homo Sapiens
CVEKGTIHY

SEQ ID NO: 1304551 - protein, 9 aa, Homo Sapiens
PIIKISKTS

SEQ ID NO: 1304552 - protein, 9 aa, Homo Sapiens
QSGSGGIVP

SEQ ID NO: 1304553 - protein, 9 aa, Homo Sapiens
LQHEGIFQV

SEQ ID NO: 1304554 - protein, 9 aa, Homo Sapiens
GNEAGDGPG

SEQ ID NO: 1304555 - protein, 9 aa, Homo Sapiens
KIKDKYIDQ

SEQ ID NO: 1304556 - protein, 9 aa, Homo Sapiens
RGCHQVQIN

SEQ ID NO: 1304557 - protein, 9 aa, Homo Sapiens
LNHHAYVFL

SEQ ID NO: 1304558 - protein, 9 aa, Homo Sapiens
WAANKSPKI

SEQ ID NO: 1304559 - protein, 9 aa, Homo Sapiens
YLITPHVSR

SEQ ID NO: 1304560 - protein, 9 aa, Homo Sapiens
DLLETTTKQ

SEQ ID NO: 1304561 - protein, 9 aa, Homo Sapiens
RDAERALTN

SEQ ID NO: 1304562 - protein, 9 aa, Homo Sapiens
KNYLFFSAQ

SEQ ID NO: 1304563 - protein, 9 aa, Homo Sapiens
QEQLQRTHS

SEQ ID NO: 1304564 - protein, 9 aa, Homo Sapiens
TVKNVTCKN

SEQ ID NO: 1304565 - protein, 9 aa, Homo Sapiens
LWNEDFQYG

SEQ ID NO: 1304566 - protein, 9 aa, Homo Sapiens
LNDSLYNPK

SEQ ID NO: 1304567 - protein, 9 aa, Homo Sapiens
APNFLPPQP

SEQ ID NO: 1304568 - protein, 9 aa, Homo Sapiens
LQCWLFLVS

SEQ ID NO: 1304569 - protein, 9 aa, Homo Sapiens
ASSLQCWLF

SEQ ID NO: 1304570 - protein, 9 aa, Homo Sapiens
KDKAIGNTL

SEQ ID NO: 1304571 - protein, 9 aa, Homo Sapiens
NKKKLLKMI

SEQ ID NO: 1304572 - protein, 9 aa, Homo Sapiens
LQINQKELQ

SEQ ID NO: 1304573 - protein, 9 aa, Homo Sapiens
LVNYGDASK

SEQ ID NO: 1304574 - protein, 9 aa, Homo Sapiens
SIYFNAQTT

SEQ ID NO: 1304575 - protein, 9 aa, Homo Sapiens
FTSEDAKSA

SEQ ID NO: 1304576 - protein, 9 aa, Homo Sapiens
IEYGKKKTT

SEQ ID NO: 1304577 - protein, 9 aa, Homo Sapiens
IWEVLHKLG

SEQ ID NO: 1304578 - protein, 9 aa, Homo Sapiens
MNNIFSYHI

SEQ ID NO: 1304579 - protein, 9 aa, Homo Sapiens
DDPQDKAMH

SEQ ID NO: 1304580 - protein, 9 aa, Homo Sapiens
ACHQLYILH

SEQ ID NO: 1304581 - protein, 9 aa, Homo Sapiens
PEPGTLKII

SEQ ID NO: 1304582 - protein, 9 aa, Homo Sapiens
HRGHSESPD

SEQ ID NO: 1304583 - protein, 9 aa, Homo Sapiens
YLSSFQTSC

SEQ ID NO: 1304584 - protein, 9 aa, Homo Sapiens
GPPPRVLQQ

SEQ ID NO: 1304585 - protein, 9 aa, Homo Sapiens
VLIHFSNIY

SEQ ID NO: 1304586 - protein, 9 aa, Homo Sapiens
AITICEKIH

SEQ ID NO: 1304587 - protein, 9 aa, Homo Sapiens
LISHKIIHM

SEQ ID NO: 1304588 - protein, 9 aa, Homo Sapiens
CLRTRSSHG

SEQ ID NO: 1304589 - protein, 9 aa, Homo Sapiens
NCGKSFSCV

SEQ ID NO: 1304590 - protein, 9 aa, Homo Sapiens
NFKLLQEYY

SEQ ID NO: 1304591 - protein, 9 aa, Homo Sapiens
GDGKFAVVK

SEQ ID NO: 1304592 - protein, 9 aa, Homo Sapiens
QDKIKTNIT

SEQ ID NO: 1304593 - protein, 9 aa, Homo Sapiens
HLIIHKIIH

SEQ ID NO: 1304594 - protein, 9 aa, Homo Sapiens
LGCKLVLYL

SEQ ID NO: 1304595 - protein, 9 aa, Homo Sapiens
DVCTYIDFI

SEQ ID NO: 1304596 - protein, 9 aa, Homo Sapiens
FKREEQNVV

SEQ ID NO: 1304597 - protein, 9 aa, Homo Sapiens
NLSKPLMRL

SEQ ID NO: 1304598 - protein, 9 aa, Homo Sapiens
NWFHLNDGG

SEQ ID NO: 1304599 - protein, 9 aa, Homo Sapiens
ARSALSYYK

SEQ ID NO: 1304600 - protein, 9 aa, Homo Sapiens
PRVVEEAQK

SEQ ID NO: 1304601 - protein, 9 aa, Homo Sapiens
VSSKMITPE

SEQ ID NO: 1304602 - protein, 9 aa, Homo Sapiens
LTVDQRASI

SEQ ID NO: 1304603 - protein, 9 aa, Homo Sapiens
KKKIKKDKK

SEQ ID NO: 1304604 - protein, 9 aa, Homo Sapiens
GEYNDLSEP

SEQ ID NO: 1304605 - protein, 9 aa, Homo Sapiens
DQLLASNGV

SEQ ID NO: 1304606 - protein, 9 aa, Homo Sapiens
VTKFTKLWE

SEQ ID NO: 1304607 - protein, 9 aa, Homo Sapiens
ALEEENGKY

SEQ ID NO: 1304608 - protein, 9 aa, Homo Sapiens
MNTYMNYTT

SEQ ID NO: 1304609 - protein, 9 aa, Homo Sapiens
FYVGASIVT

SEQ ID NO: 1304610 - protein, 9 aa, Homo Sapiens
VTIMPRDIQ

SEQ ID NO: 1304611 - protein, 9 aa, Homo Sapiens
RPFRPRPHQ

SEQ ID NO: 1304612 - protein, 9 aa, Homo Sapiens
AEYSSFIIA

SEQ ID NO: 1304613 - protein, 9 aa, Homo Sapiens
DRYQFTSRK

SEQ ID NO: 1304614 - protein, 9 aa, Homo Sapiens
NIISYFLNN

SEQ ID NO: 1304615 - protein, 9 aa, Homo Sapiens
PNHPCRFNT

SEQ ID NO: 1304616 - protein, 9 aa, Homo Sapiens
TPTRIILYE

SEQ ID NO: 1304617 - protein, 8 aa, Homo Sapiens
TSKLAVAL

SEQ ID NO: 1304618 - protein, 9 aa, Homo Sapiens
GKAFIHGSH

SEQ ID NO: 1304619 - protein, 9 aa, Homo Sapiens
DQATTAQIR

SEQ ID NO: 1304620 - protein, 9 aa, Homo Sapiens
NNAYEESLE

SEQ ID NO: 1304621 - protein, 9 aa, Homo Sapiens
SADVDWNVE

SEQ ID NO: 1304622 - protein, 9 aa, Homo Sapiens
HIPQSPYKF

SEQ ID NO: 1304623 - protein, 9 aa, Homo Sapiens
AQNISRSPT

SEQ ID NO: 1304624 - protein, 9 aa, Homo Sapiens
PPQPDFVPF

SEQ ID NO: 1304625 - protein, 9 aa, Homo Sapiens
LLLLIFDEN

SEQ ID NO: 1304626 - protein, 9 aa, Homo Sapiens
LCFISPGPS

SEQ ID NO: 1304627 - protein, 9 aa, Homo Sapiens
WEVEVVSHI

SEQ ID NO: 1304628 - protein, 9 aa, Homo Sapiens
TNRIFLVSP

SEQ ID NO: 1304629 - protein, 9 aa, Homo Sapiens
YFSPQTDKL

SEQ ID NO: 1304630 - protein, 9 aa, Homo Sapiens
PQIKNKSKL

SEQ ID NO: 1304631 - protein, 9 aa, Homo Sapiens
DSITPSAQT

SEQ ID NO: 1304632 - protein, 9 aa, Homo Sapiens
YLDSIHLFR

SEQ ID NO: 1304633 - protein, 9 aa, Homo Sapiens
PLPVTRYSD

SEQ ID NO: 1304634 - protein, 9 aa, Homo Sapiens
KFEGGLVIA

SEQ ID NO: 1304635 - protein, 9 aa, Homo Sapiens
QTFLEREKC

SEQ ID NO: 1304636 - protein, 9 aa, Homo Sapiens
QIKPEEAKT

SEQ ID NO: 1304637 - protein, 9 aa, Homo Sapiens
TGAFGKDGS

SEQ ID NO: 1304638 - protein, 9 aa, Homo Sapiens
ELTVDQRAS

SEQ ID NO: 1304639 - protein, 9 aa, Homo Sapiens
FSEMLQFLN

SEQ ID NO: 1304640 - protein, 9 aa, Homo Sapiens
FDELKTDYN

SEQ ID NO: 1304641 - protein, 9 aa, Homo Sapiens
EKHDDKSPI

SEQ ID NO: 1304642 - protein, 9 aa, Homo Sapiens
KELRAKEDK

SEQ ID NO: 1304643 - protein, 9 aa, Homo Sapiens
LMYYFVNDK

SEQ ID NO: 1304644 - protein, 9 aa, Homo Sapiens
QAIGQLKIH

SEQ ID NO: 1304645 - protein, 9 aa, Homo Sapiens
KMGYNVCTL

SEQ ID NO: 1304646 - protein, 9 aa, Homo Sapiens
SFSLRLSLT

SEQ ID NO: 1304647 - protein, 9 aa, Homo Sapiens
VQCHPNTHD

SEQ ID NO: 1304648 - protein, 9 aa, Homo Sapiens
IPPCKSELK

SEQ ID NO: 1304649 - protein, 9 aa, Homo Sapiens
GTNKEEMRK

SEQ ID NO: 1304650 - protein, 9 aa, Homo Sapiens
PGAPGISLS

SEQ ID NO: 1304651 - protein, 9 aa, Homo Sapiens
NKYNLSFDY

SEQ ID NO: 1304652 - protein, 9 aa, Homo Sapiens
PDKKSNKSL

SEQ ID NO: 1304653 - protein, 9 aa, Homo Sapiens
IEILNQSKN

SEQ ID NO: 1304654 - protein, 9 aa, Homo Sapiens
AVVANIVLT

SEQ ID NO: 1304655 - protein, 9 aa, Homo Sapiens
LAPRAVLTG

SEQ ID NO: 1304656 - protein, 9 aa, Homo Sapiens
DQEAHRTVF

SEQ ID NO: 1304657 - protein, 9 aa, Homo Sapiens
NSRLNEGKL

SEQ ID NO: 1304658 - protein, 9 aa, Homo Sapiens
ELECMRALD

SEQ ID NO: 1304659 - protein, 9 aa, Homo Sapiens
EKTEDKLKY

SEQ ID NO: 1304660 - protein, 9 aa, Homo Sapiens
SCRNLLNSS

SEQ ID NO: 1304661 - protein, 9 aa, Homo Sapiens
EINDELKKK

SEQ ID NO: 1304662 - protein, 9 aa, Homo Sapiens
DYSQRPLFH

SEQ ID NO: 1304663 - protein, 9 aa, Homo Sapiens
AKTGSICWA

SEQ ID NO: 1304664 - protein, 9 aa, Homo Sapiens
FWMGSEGHQ

SEQ ID NO: 1304665 - protein, 9 aa, Homo Sapiens
DHPNVVNLE

SEQ ID NO: 1304666 - protein, 9 aa, Homo Sapiens
MCKGVRDMF

SEQ ID NO: 1304667 - protein, 9 aa, Homo Sapiens
KYNLSFDYY

SEQ ID NO: 1304668 - protein, 9 aa, Homo Sapiens
IDPNKPTYC

SEQ ID NO: 1304669 - protein, 9 aa, Homo Sapiens
NMTLQSDIM

SEQ ID NO: 1304670 - protein, 9 aa, Homo Sapiens
QENFKLLQE

SEQ ID NO: 1304671 - protein, 9 aa, Homo Sapiens
YWGQVKLIQ

SEQ ID NO: 1304672 - protein, 9 aa, Homo Sapiens
LDKIFQEDH

SEQ ID NO: 1304673 - protein, 9 aa, Homo Sapiens
PTILNFILC

SEQ ID NO: 1304674 - protein, 9 aa, Homo Sapiens
ELLAKVNGT

SEQ ID NO: 1304675 - protein, 9 aa, Homo Sapiens
CGKSFSLRL

SEQ ID NO: 1304676 - protein, 9 aa, Homo Sapiens
MKGIKPNKV

SEQ ID NO: 1304677 - protein, 9 aa, Homo Sapiens
PEGEQQDVG

SEQ ID NO: 1304678 - protein, 9 aa, Homo Sapiens
RRKRLLEQD

SEQ ID NO: 1304679 - protein, 9 aa, Homo Sapiens
HKEVPPRIT

SEQ ID NO: 1304680 - protein, 9 aa, Homo Sapiens
QDVGDFPEA

SEQ ID NO: 1304681 - protein, 9 aa, Homo Sapiens
CRAEAEDGL

SEQ ID NO: 1304682 - protein, 9 aa, Homo Sapiens
AASIQTKKA

SEQ ID NO: 1304683 - protein, 9 aa, Homo Sapiens
RRHVSTLLI

SEQ ID NO: 1304684 - protein, 9 aa, Homo Sapiens
PEHSIKDYF

SEQ ID NO: 1304685 - protein, 9 aa, Homo Sapiens
WDQVFSGLE

SEQ ID NO: 1304686 - protein, 9 aa, Homo Sapiens
QFHYNNWPD

SEQ ID NO: 1304687 - protein, 9 aa, Homo Sapiens
GSGDIEKYN

SEQ ID NO: 1304688 - protein, 9 aa, Homo Sapiens
STNYVFKEI

SEQ ID NO: 1304689 - protein, 9 aa, Homo Sapiens
IIDQYLSGD

SEQ ID NO: 1304690 - protein, 9 aa, Homo Sapiens
QERHGDYLK

SEQ ID NO: 1304691 - protein, 9 aa, Homo Sapiens
KLNDHNEFE

SEQ ID NO: 1304692 - protein, 9 aa, Homo Sapiens
GVDKITQFW

SEQ ID NO: 1304693 - protein, 9 aa, Homo Sapiens
QMHRAKVDY

SEQ ID NO: 1304694 - protein, 9 aa, Homo Sapiens
PFWCTFEGC

SEQ ID NO: 1304695 - protein, 9 aa, Homo Sapiens
APPAERRNF

SEQ ID NO: 1304696 - protein, 9 aa, Homo Sapiens
TSEGELSWY

SEQ ID NO: 1304697 - protein, 9 aa, Homo Sapiens
YSRFFYNVR

SEQ ID NO: 1304698 - protein, 9 aa, Homo Sapiens
TDAPGHRDF

SEQ ID NO: 1304699 - protein, 9 aa, Homo Sapiens
RDRGWDAVK

SEQ ID NO: 1304700 - protein, 9 aa, Homo Sapiens
GVFRSISLS

SEQ ID NO: 1304701 - protein, 9 aa, Homo Sapiens
KWKALKRKK

SEQ ID NO: 1304702 - protein, 9 aa, Homo Sapiens
SDKLLEEEV

SEQ ID NO: 1304703 - protein, 9 aa, Homo Sapiens
YTVPAVQGV

SEQ ID NO: 1304704 - protein, 9 aa, Homo Sapiens
SGGIVPPPP

SEQ ID NO: 1304705 - protein, 9 aa, Homo Sapiens
KDDNKKKEA

SEQ ID NO: 1304706 - protein, 9 aa, Homo Sapiens
AQEQKFGRT

SEQ ID NO: 1304707 - protein, 9 aa, Homo Sapiens
KDSPRRANH

SEQ ID NO: 1304708 - protein, 9 aa, Homo Sapiens
SGNLSNHKI

SEQ ID NO: 1304709 - protein, 9 aa, Homo Sapiens
MKKLGIIHP

SEQ ID NO: 1304710 - protein, 9 aa, Homo Sapiens
FRRHVSTLL

SEQ ID NO: 1304711 - protein, 9 aa, Homo Sapiens
LDKFTIIQN

SEQ ID NO: 1304712 - protein, 9 aa, Homo Sapiens
DERKLLSNK

SEQ ID NO: 1304713 - protein, 9 aa, Homo Sapiens
ENEMNWFHL

SEQ ID NO: 1304714 - protein, 9 aa, Homo Sapiens
QTYDMMIVR

SEQ ID NO: 1304715 - protein, 9 aa, Homo Sapiens
MCRYDRLST

SEQ ID NO: 1304716 - protein, 9 aa, Homo Sapiens
SMKHPQEIK

SEQ ID NO: 1304717 - protein, 9 aa, Homo Sapiens
GVLESHFLK

SEQ ID NO: 1304718 - protein, 9 aa, Homo Sapiens
YLLKVLPAL

SEQ ID NO: 1304719 - protein, 9 aa, Homo Sapiens
KKPYQPIIK

SEQ ID NO: 1304720 - protein, 9 aa, Homo Sapiens
NLCEHEKTH

SEQ ID NO: 1304721 - protein, 9 aa, Homo Sapiens
YDRFIEYGK

SEQ ID NO: 1304722 - protein, 9 aa, Homo Sapiens
LSMAFYFNQ

SEQ ID NO: 1304723 - protein, 9 aa, Homo Sapiens
KSLQKTATI

SEQ ID NO: 1304724 - protein, 9 aa, Homo Sapiens
ILVNYGDAS

SEQ ID NO: 1304725 - protein, 9 aa, Homo Sapiens
EDKLKYNDT

SEQ ID NO: 1304726 - protein, 9 aa, Homo Sapiens
QKHFDCPVL

SEQ ID NO: 1304727 - protein, 9 aa, Homo Sapiens
FKCCFCDLL

SEQ ID NO: 1304728 - protein, 9 aa, Homo Sapiens
EIREIQREI

SEQ ID NO: 1304729 - protein, 9 aa, Homo Sapiens
SNKSLIGGN

SEQ ID NO: 1304730 - protein, 9 aa, Homo Sapiens
AMAMTHNAK

SEQ ID NO: 1304731 - protein, 9 aa, Homo Sapiens
WLCWNNVAA

SEQ ID NO: 1304732 - protein, 9 aa, Homo Sapiens
QPIIKISKT

SEQ ID NO: 1304733 - protein, 9 aa, Homo Sapiens
EERLLMYYF

SEQ ID NO: 1304734 - protein, 9 aa, Homo Sapiens
FKALKHIHQ

SEQ ID NO: 1304735 - protein, 9 aa, Homo Sapiens
GTIHYLCKF

SEQ ID NO: 1304736 - protein, 9 aa, Homo Sapiens
LTCFLRHEI

SEQ ID NO: 1304737 - protein, 9 aa, Homo Sapiens
TIHKKTNLC

SEQ ID NO: 1304738 - protein, 9 aa, Homo Sapiens
RLLLYLQSI

SEQ ID NO: 1304739 - protein, 9 aa, Homo Sapiens
KDCKPPVCL

SEQ ID NO: 1304740 - protein, 9 aa, Homo Sapiens
VIYVWTNGS

SEQ ID NO: 1304741 - protein, 9 aa, Homo Sapiens
RSMKNNNQH

SEQ ID NO: 1304742 - protein, 9 aa, Homo Sapiens
TQEPDNILP

SEQ ID NO: 1304743 - protein, 9 aa, Homo Sapiens
KAFANYSVL

SEQ ID NO: 1304744 - protein, 9 aa, Homo Sapiens
KMLKEETRS

SEQ ID NO: 1304745 - protein, 9 aa, Homo Sapiens
CQYVISMTA

SEQ ID NO: 1304746 - protein, 9 aa, Homo Sapiens
LRTRIKLWE

SEQ ID NO: 1304747 - protein, 9 aa, Homo Sapiens
SMWKQQCGY

SEQ ID NO: 1304748 - protein, 9 aa, Homo Sapiens
KANLNALDI

SEQ ID NO: 1304749 - protein, 9 aa, Homo Sapiens
EKKHSSCGF

SEQ ID NO: 1304750 - protein, 9 aa, Homo Sapiens
TSGRSIEIN

SEQ ID NO: 1304751 - protein, 9 aa, Homo Sapiens
RTLTVHQII

SEQ ID NO: 1304752 - protein, 9 aa, Homo Sapiens
NNNNSLESS

SEQ ID NO: 1304753 - protein, 9 aa, Homo Sapiens
IIAKQIFTR

SEQ ID NO: 1304754 - protein, 9 aa, Homo Sapiens
GLAEEVDNK

SEQ ID NO: 1304755 - protein, 9 aa, Homo Sapiens
LFIFRGTMY

SEQ ID NO: 1304756 - protein, 9 aa, Homo Sapiens
GSQDQEAHR

SEQ ID NO: 1304757 - protein, 9 aa, Homo Sapiens
LEKMGYNVC

SEQ ID NO: 1304758 - protein, 9 aa, Homo Sapiens
GPYEGQITE

SEQ ID NO: 1304759 - protein, 9 aa, Homo Sapiens
KNIGKAFLP

SEQ ID NO: 1304760 - protein, 9 aa, Homo Sapiens
SKLLYIYGA

SEQ ID NO: 1304761 - protein, 9 aa, Homo Sapiens
AMLYKKFSP

SEQ ID NO: 1304762 - protein, 9 aa, Homo Sapiens
SKNISEWKC

SEQ ID NO: 1304763 - protein, 9 aa, Homo Sapiens
LADGYSDKI

SEQ ID NO: 1304764 - protein, 9 aa, Homo Sapiens
KSTEAVQGP

SEQ ID NO: 1304765 - protein, 9 aa, Homo Sapiens
AMTHNAKYL

SEQ ID NO: 1304766 - protein, 9 aa, Homo Sapiens
LGQKDKIPE

SEQ ID NO: 1304767 - protein, 9 aa, Homo Sapiens
LMKQLDTLG

SEQ ID NO: 1304768 - protein, 9 aa, Homo Sapiens
ISSLSNHEC

SEQ ID NO: 1304769 - protein, 9 aa, Homo Sapiens
RSKIIHNNL

SEQ ID NO: 1304770 - protein, 9 aa, Homo Sapiens
IYLYSLISL

SEQ ID NO: 1304771 - protein, 9 aa, Homo Sapiens
CCFCDLLKV

SEQ ID NO: 1304772 - protein, 9 aa, Homo Sapiens
YNVSEAQNI

SEQ ID NO: 1304773 - protein, 9 aa, Homo Sapiens
NLFIALYLA

SEQ ID NO: 1304774 - protein, 9 aa, Homo Sapiens
DVPLEQKMA

SEQ ID NO: 1304775 - protein, 9 aa, Homo Sapiens
SQGCLSVGS

SEQ ID NO: 1304776 - protein, 9 aa, Homo Sapiens
MLLEHVLII

SEQ ID NO: 1304777 - protein, 9 aa, Homo Sapiens
AIYWGQVKL

SEQ ID NO: 1304778 - protein, 9 aa, Homo Sapiens
PRKQTYEQI

SEQ ID NO: 1304779 - protein, 9 aa, Homo Sapiens
EVRPPYRNN

SEQ ID NO: 1304780 - protein, 9 aa, Homo Sapiens
MLKCRQFVD

SEQ ID NO: 1304781 - protein, 9 aa, Homo Sapiens
SNLVHPSCH

SEQ ID NO: 1304782 - protein, 9 aa, Homo Sapiens
DRVHTSKSD

SEQ ID NO: 1304783 - protein, 9 aa, Homo Sapiens
RQLEEKETL

SEQ ID NO: 1304784 - protein, 9 aa, Homo Sapiens
SVWDSYAEL

SEQ ID NO: 1304785 - protein, 9 aa, Homo Sapiens
NDSLYNPKR

SEQ ID NO: 1304786 - protein, 9 aa, Homo Sapiens
LDRETQELY

SEQ ID NO: 1304787 - protein, 9 aa, Homo Sapiens
MTFIYLSNK

SEQ ID NO: 1304788 - protein, 9 aa, Homo Sapiens
DAENEVNET

SEQ ID NO: 1304789 - protein, 9 aa, Homo Sapiens
DIDNISDGI

SEQ ID NO: 1304790 - protein, 9 aa, Homo Sapiens
KLHGPHAAP

SEQ ID NO: 1304791 - protein, 9 aa, Homo Sapiens
KGGTGVMIC

SEQ ID NO: 1304792 - protein, 9 aa, Homo Sapiens
LPNDLFRLI

SEQ ID NO: 1304793 - protein, 9 aa, Homo Sapiens
QDKAMHSET

SEQ ID NO: 1304794 - protein, 9 aa, Homo Sapiens
RHYGELIEF

SEQ ID NO: 1304795 - protein, 9 aa, Homo Sapiens
ESGSSLQAE

SEQ ID NO: 1304796 - protein, 9 aa, Homo Sapiens
RLASASSLQ

SEQ ID NO: 1304797 - protein, 9 aa, Homo Sapiens
RNIFNLSAP

SEQ ID NO: 1304798 - protein, 9 aa, Homo Sapiens
ILNFILCFS

SEQ ID NO: 1304799 - protein, 9 aa, Homo Sapiens
FAPHLKGRP

SEQ ID NO: 1304800 - protein, 9 aa, Homo Sapiens
QVLMPEWKI

SEQ ID NO: 1304801 - protein, 9 aa, Homo Sapiens
KYPRTVRKL

SEQ ID NO: 1304802 - protein, 9 aa, Homo Sapiens
TKRGPYCVW

SEQ ID NO: 1304803 - protein, 9 aa, Homo Sapiens
SSTAKITII

SEQ ID NO: 1304804 - protein, 9 aa, Homo Sapiens
KRNIYLIME

SEQ ID NO: 1304805 - protein, 9 aa, Homo Sapiens
FIVLREPHS

SEQ ID NO: 1304806 - protein, 9 aa, Homo Sapiens
PANGPPPRV

SEQ ID NO: 1304807 - protein, 9 aa, Homo Sapiens
GCVIVHCLA

SEQ ID NO: 1304808 - protein, 9 aa, Homo Sapiens
LRDTFLELA

SEQ ID NO: 1304809 - protein, 9 aa, Homo Sapiens
VNLEGVVTR

SEQ ID NO: 1304810 - protein, 9 aa, Homo Sapiens
EYLEKWMVC

SEQ ID NO: 1304811 - protein, 9 aa, Homo Sapiens
LSLDSTPSR

SEQ ID NO: 1304812 - protein, 9 aa, Homo Sapiens
FNNIYGIVV

SEQ ID NO: 1304813 - protein, 9 aa, Homo Sapiens
GIVVAMFIV

SEQ ID NO: 1304814 - protein, 9 aa, Homo Sapiens
SGSNNAVEI

SEQ ID NO: 1304815 - protein, 9 aa, Homo Sapiens
TGRFRGTKP

SEQ ID NO: 1304816 - protein, 9 aa, Homo Sapiens
KTHPKDSPR

SEQ ID NO: 1304817 - protein, 9 aa, Homo Sapiens
DSEDHNTCE

SEQ ID NO: 1304818 - protein, 9 aa, Homo Sapiens
EINGPDTNH

SEQ ID NO: 1304819 - protein, 9 aa, Homo Sapiens
LFCGESSEE

SEQ ID NO: 1304820 - protein, 9 aa, Homo Sapiens
KPNARIVVL

SEQ ID NO: 1304821 - protein, 9 aa, Homo Sapiens
RFNRQKEQD

SEQ ID NO: 1304822 - protein, 9 aa, Homo Sapiens
WKPSDKLLE

SEQ ID NO: 1304823 - protein, 9 aa, Homo Sapiens
PSSPAPQDT

SEQ ID NO: 1304824 - protein, 9 aa, Homo Sapiens
KDKHKEEDT

SEQ ID NO: 1304825 - protein, 9 aa, Homo Sapiens
IILIRHRED

SEQ ID NO: 1304826 - protein, 9 aa, Homo Sapiens
CSGHLVVQS

SEQ ID NO: 1304827 - protein, 9 aa, Homo Sapiens
IRKGGETSD

SEQ ID NO: 1304828 - protein, 9 aa, Homo Sapiens
IINNKEKEP

SEQ ID NO: 1304829 - protein, 9 aa, Homo Sapiens
NKFCRFVLA

SEQ ID NO: 1304830 - protein, 9 aa, Homo Sapiens
ARIGSGKLS

SEQ ID NO: 1304831 - protein, 9 aa, Homo Sapiens
SLFIFRGTM

SEQ ID NO: 1304832 - protein, 9 aa, Homo Sapiens
KITLTGFNS

SEQ ID NO: 1304833 - protein, 9 aa, Homo Sapiens
SIHRHRKSK

SEQ ID NO: 1304834 - protein, 9 aa, Homo Sapiens
PGLSSESCE

SEQ ID NO: 1304835 - protein, 9 aa, Homo Sapiens
FDYYYFILI

SEQ ID NO: 1304836 - protein, 9 aa, Homo Sapiens
VCKENICSC

SEQ ID NO: 1304837 - protein, 9 aa, Homo Sapiens
YGKQCCNSC

SEQ ID NO: 1304838 - protein, 9 aa, Homo Sapiens
SPMVKSKSA

SEQ ID NO: 1304839 - protein, 9 aa, Homo Sapiens
VFQEVVSFS

SEQ ID NO: 1304840 - protein, 9 aa, Homo Sapiens
YISENVTTL

SEQ ID NO: 1304841 - protein, 9 aa, Homo Sapiens
FKLNNAYEE

SEQ ID NO: 1304842 - protein, 9 aa, Homo Sapiens
NQIDASVLS

SEQ ID NO: 1304843 - protein, 9 aa, Homo Sapiens
GDTEQLIQV

SEQ ID NO: 1304844 - protein, 9 aa, Homo Sapiens
ALRKNGFVM

SEQ ID NO: 1304845 - protein, 9 aa, Homo Sapiens
EEERNVFKL

SEQ ID NO: 1304846 - protein, 9 aa, Homo Sapiens
EPGLSSESC

SEQ ID NO: 1304847 - protein, 9 aa, Homo Sapiens
GVRDMFHSC

SEQ ID NO: 1304848 - protein, 9 aa, Homo Sapiens
KPSDKLLEE

SEQ ID NO: 1304849 - protein, 9 aa, Homo Sapiens
ESGEQNKKS

SEQ ID NO: 1304850 - protein, 9 aa, Homo Sapiens
ATCEFSCTG

SEQ ID NO: 1304851 - protein, 9 aa, Homo Sapiens
QVGIHHGSA

SEQ ID NO: 1304852 - protein, 9 aa, Homo Sapiens
DSENNKEQS

SEQ ID NO: 1304853 - protein, 9 aa, Homo Sapiens
PSAASCDLS

SEQ ID NO: 1304854 - protein, 9 aa, Homo Sapiens
SSKLLYIYG

SEQ ID NO: 1304855 - protein, 9 aa, Homo Sapiens
RGHSESPDK

SEQ ID NO: 1304856 - protein, 9 aa, Homo Sapiens
QWPMTETGK

SEQ ID NO: 1304857 - protein, 9 aa, Homo Sapiens
ALNTCILSK

SEQ ID NO: 1304858 - protein, 9 aa, Homo Sapiens
THLVQHQII

SEQ ID NO: 1304859 - protein, 9 aa, Homo Sapiens
GQLRRIQRQ

SEQ ID NO: 1304860 - protein, 9 aa, Homo Sapiens
YAESIINPD

SEQ ID NO: 1304861 - protein, 9 aa, Homo Sapiens
KSYECKQCG

SEQ ID NO: 1304862 - protein, 9 aa, Homo Sapiens
INNKEKEPE

SEQ ID NO: 1304863 - protein, 9 aa, Homo Sapiens
KQAKNQQRQ

SEQ ID NO: 1304864 - protein, 9 aa, Homo Sapiens
SAIQAPHSP

SEQ ID NO: 1304865 - protein, 9 aa, Homo Sapiens
GISIKQVVL

SEQ ID NO: 1304866 - protein, 9 aa, Homo Sapiens
DAERALTNL

SEQ ID NO: 1304867 - protein, 9 aa, Homo Sapiens
LEDQIEDFS

SEQ ID NO: 1304868 - protein, 9 aa, Homo Sapiens
SEDSITPSA

SEQ ID NO: 1304869 - protein, 9 aa, Homo Sapiens
VACLVIYRE

SEQ ID NO: 1304870 - protein, 9 aa, Homo Sapiens
LGKNKAKLS

SEQ ID NO: 1304871 - protein, 9 aa, Homo Sapiens
IKWDNLSNH

SEQ ID NO: 1304872 - protein, 9 aa, Homo Sapiens
VSNIYLEII

SEQ ID NO: 1304873 - protein, 9 aa, Homo Sapiens
YSDLLCLSK

SEQ ID NO: 1304874 - protein, 9 aa, Homo Sapiens
ISGILTFMT

SEQ ID NO: 1304875 - protein, 9 aa, Homo Sapiens
SPPANGPPP

SEQ ID NO: 1304876 - protein, 9 aa, Homo Sapiens
IMHTGERPH

SEQ ID NO: 1304877 - protein, 9 aa, Homo Sapiens
TTELQDKLS

SEQ ID NO: 1304878 - protein, 9 aa, Homo Sapiens
ADLLGFTGP

SEQ ID NO: 1304879 - protein, 9 aa, Homo Sapiens
DYGKSFNKI

SEQ ID NO: 1304880 - protein, 9 aa, Homo Sapiens
NNLKEQDKI

SEQ ID NO: 1304881 - protein, 9 aa, Homo Sapiens
ANLNALDIY

SEQ ID NO: 1304882 - protein, 9 aa, Homo Sapiens
IRDFVLPWY

SEQ ID NO: 1304883 - protein, 9 aa, Homo Sapiens
IYKESSTWK

SEQ ID NO: 1304884 - protein, 9 aa, Homo Sapiens
TVFFKTLQN

SEQ ID NO: 1304885 - protein, 9 aa, Homo Sapiens
MSQFIEKET

SEQ ID NO: 1304886 - protein, 9 aa, Homo Sapiens
TLTVAAEEE

SEQ ID NO: 1304887 - protein, 9 aa, Homo Sapiens
FCFDDSLPN

SEQ ID NO: 1304888 - protein, 9 aa, Homo Sapiens
SGLKSQGCL

SEQ ID NO: 1304889 - protein, 9 aa, Homo Sapiens
RLGAASMPS

SEQ ID NO: 1304890 - protein, 9 aa, Homo Sapiens
DDAIVAALK

SEQ ID NO: 1304891 - protein, 9 aa, Homo Sapiens
LCWMLDNVR

SEQ ID NO: 1304892 - protein, 9 aa, Homo Sapiens
KHSSCGFCC

SEQ ID NO: 1304893 - protein, 9 aa, Homo Sapiens
FSFLAKRSN

SEQ ID NO: 1304894 - protein, 9 aa, Homo Sapiens
LLMYYFVND

SEQ ID NO: 1304895 - protein, 9 aa, Homo Sapiens
TTWFEAHVD

SEQ ID NO: 1304896 - protein, 9 aa, Homo Sapiens
EWFSEYVYK

SEQ ID NO: 1304897 - protein, 9 aa, Homo Sapiens
HVSIEEGER

SEQ ID NO: 1304898 - protein, 9 aa, Homo Sapiens
NATTPHYVC

SEQ ID NO: 1304899 - protein, 9 aa, Homo Sapiens
DFVLPWYRS

SEQ ID NO: 1304900 - protein, 9 aa, Homo Sapiens
ETIQYNDDD

SEQ ID NO: 1304901 - protein, 9 aa, Homo Sapiens
EASPKAKVR

SEQ ID NO: 1304902 - protein, 9 aa, Homo Sapiens
IHVFFSSPL

SEQ ID NO: 1304903 - protein, 9 aa, Homo Sapiens
HNQLSDVGG

SEQ ID NO: 1304904 - protein, 9 aa, Homo Sapiens
GIQIEFINE

SEQ ID NO: 1304905 - protein, 9 aa, Homo Sapiens
PGNGAKYLL

SEQ ID NO: 1304906 - protein, 9 aa, Homo Sapiens
IFQCEDSES

SEQ ID NO: 1304907 - protein, 9 aa, Homo Sapiens
QRAVKYIWL

SEQ ID NO: 1304908 - protein, 9 aa, Homo Sapiens
KIHGQGKNN

SEQ ID NO: 1304909 - protein, 9 aa, Homo Sapiens
DIEKYNDAT

SEQ ID NO: 1304910 - protein, 9 aa, Homo Sapiens
EAFSLKSNL

SEQ ID NO: 1304911 - protein, 9 aa, Homo Sapiens
ADPVLAEVV

SEQ ID NO: 1304912 - protein, 9 aa, Homo Sapiens
EDRKILVNY

SEQ ID NO: 1304913 - protein, 9 aa, Homo Sapiens
QIIHTGEKL

SEQ ID NO: 1304914 - protein, 9 aa, Homo Sapiens
KIKWDNLSN

SEQ ID NO: 1304915 - protein, 9 aa, Homo Sapiens
LIVDAICTR

SEQ ID NO: 1304916 - protein, 9 aa, Homo Sapiens
SEVTGTCLG

SEQ ID NO: 1304917 - protein, 9 aa, Homo Sapiens
IHGSHLTEH

SEQ ID NO: 1304918 - protein, 9 aa, Homo Sapiens
TIEAYKDDL

SEQ ID NO: 1304919 - protein, 9 aa, Homo Sapiens
DYFDKLSLY

SEQ ID NO: 1304920 - protein, 9 aa, Homo Sapiens
CSLHEPLYI

SEQ ID NO: 1304921 - protein, 9 aa, Homo Sapiens
GIFQVSGSQ

SEQ ID NO: 1304922 - protein, 9 aa, Homo Sapiens
EIIKKQVNT

SEQ ID NO: 1304923 - protein, 9 aa, Homo Sapiens
YFRMDFSAT

SEQ ID NO: 1304924 - protein, 9 aa, Homo Sapiens
ALIPYSVHM

SEQ ID NO: 1304925 - protein, 9 aa, Homo Sapiens
LCVQLVVIA

SEQ ID NO: 1304926 - protein, 9 aa, Homo Sapiens
FNWCMAQAY

SEQ ID NO: 1304927 - protein, 9 aa, Homo Sapiens
VLLPDPAVE

SEQ ID NO: 1304928 - protein, 9 aa, Homo Sapiens
IHSAQHLDN

SEQ ID NO: 1304929 - protein, 9 aa, Homo Sapiens
TTTSEIIIA

SEQ ID NO: 1304930 - protein, 9 aa, Homo Sapiens
MLKGRPCKI

SEQ ID NO: 1304931 - protein, 9 aa, Homo Sapiens
RDSDYNLLQ

SEQ ID NO: 1304932 - protein, 9 aa, Homo Sapiens
MANTGIILC

SEQ ID NO: 1304933 - protein, 9 aa, Homo Sapiens
WPEHSIKDY

SEQ ID NO: 1304934 - protein, 9 aa, Homo Sapiens
DLELMCETK

SEQ ID NO: 1304935 - protein, 9 aa, Homo Sapiens
EHSIKDYFQ

SEQ ID NO: 1304936 - protein, 9 aa, Homo Sapiens
DQIEDFSKD

SEQ ID NO: 1304937 - protein, 9 aa, Homo Sapiens
EVVENNLTL

SEQ ID NO: 1304938 - protein, 9 aa, Homo Sapiens
MAARSDQAE

SEQ ID NO: 1304939 - protein, 9 aa, Homo Sapiens
DRGWDAVKR

SEQ ID NO: 1304940 - protein, 9 aa, Homo Sapiens
GFDMYSQPF

SEQ ID NO: 1304941 - protein, 9 aa, Homo Sapiens
EKEAKDLPV

SEQ ID NO: 1304942 - protein, 9 aa, Homo Sapiens
MDLVKSHFM

SEQ ID NO: 1304943 - protein, 9 aa, Homo Sapiens
LREGQHFIF

SEQ ID NO: 1304944 - protein, 9 aa, Homo Sapiens
NQLSVKCWL

SEQ ID NO: 1304945 - protein, 9 aa, Homo Sapiens
VMYLWLQLD

SEQ ID NO: 1304946 - protein, 9 aa, Homo Sapiens
EFHVPLVDV

SEQ ID NO: 1304947 - protein, 9 aa, Homo Sapiens
NICRKCSEN

SEQ ID NO: 1304948 - protein, 9 aa, Homo Sapiens
QLQGFPFYD

SEQ ID NO: 1304949 - protein, 9 aa, Homo Sapiens
VLYVAAAMH

SEQ ID NO: 1304950 - protein, 9 aa, Homo Sapiens
TERDNVFGK

SEQ ID NO: 1304951 - protein, 9 aa, Homo Sapiens
SPNHSKLSN

SEQ ID NO: 1304952 - protein, 9 aa, Homo Sapiens
DNERFHMVK

SEQ ID NO: 1304953 - protein, 9 aa, Homo Sapiens
FKTYLSGNY

SEQ ID NO: 1304954 - protein, 9 aa, Homo Sapiens
TAGVAAEEA

SEQ ID NO: 1304955 - protein, 9 aa, Homo Sapiens
WKRWNTSEV

SEQ ID NO: 1304956 - protein, 9 aa, Homo Sapiens
LLGFTGPLC

SEQ ID NO: 1304957 - protein, 9 aa, Homo Sapiens
CQDNQTIPS

SEQ ID NO: 1304958 - protein, 9 aa, Homo Sapiens
FVNWASSID

SEQ ID NO: 1304959 - protein, 9 aa, Homo Sapiens
MSEPQDKKL

SEQ ID NO: 1304960 - protein, 9 aa, Homo Sapiens
TEITSAISE

SEQ ID NO: 1304961 - protein, 9 aa, Homo Sapiens
LAVKSFQMQ

SEQ ID NO: 1304962 - protein, 9 aa, Homo Sapiens
KLIQSEEIK

SEQ ID NO: 1304963 - protein, 9 aa, Homo Sapiens
RKQSFKAVV

SEQ ID NO: 1304964 - protein, 9 aa, Homo Sapiens
EHYENTIEY

SEQ ID NO: 1304965 - protein, 9 aa, Homo Sapiens
SGAPQAGIR

SEQ ID NO: 1304966 - protein, 9 aa, Homo Sapiens
KCSQLCEQH

SEQ ID NO: 1304967 - protein, 9 aa, Homo Sapiens
VKSWQITIR

SEQ ID NO: 1304968 - protein, 9 aa, Homo Sapiens
GMSGKQNKD

SEQ ID NO: 1304969 - protein, 9 aa, Homo Sapiens
QQAADLISQ

SEQ ID NO: 1304970 - protein, 9 aa, Homo Sapiens
TLISHKIIH

SEQ ID NO: 1304971 - protein, 9 aa, Homo Sapiens
KSDPPDGSE

SEQ ID NO: 1304972 - protein, 9 aa, Homo Sapiens
CHPVGDFHC

SEQ ID NO: 1304973 - protein, 9 aa, Homo Sapiens
LYETRAIYF

SEQ ID NO: 1304974 - protein, 9 aa, Homo Sapiens
KFVSAPHIS

SEQ ID NO: 1304975 - protein, 9 aa, Homo Sapiens
WVHYISAEE

SEQ ID NO: 1304976 - protein, 9 aa, Homo Sapiens
LYEEGSNKI

SEQ ID NO: 1304977 - protein, 9 aa, Homo Sapiens
KNEDCFGMW

SEQ ID NO: 1304978 - protein, 9 aa, Homo Sapiens
STLTSHKII

SEQ ID NO: 1304979 - protein, 9 aa, Homo Sapiens
WNGPYETSR

SEQ ID NO: 1304980 - protein, 9 aa, Homo Sapiens
RSALSYYKS

SEQ ID NO: 1304981 - protein, 9 aa, Homo Sapiens
RIYGTIKEE

SEQ ID NO: 1304982 - protein, 9 aa, Homo Sapiens
SGELTVDQR

SEQ ID NO: 1304983 - protein, 9 aa, Homo Sapiens
IGQLKIHGK

SEQ ID NO: 1304984 - protein, 9 aa, Homo Sapiens
RAKTINNTA

SEQ ID NO: 1304985 - protein, 9 aa, Homo Sapiens
VLNNGRLTV

SEQ ID NO: 1304986 - protein, 9 aa, Homo Sapiens
VVCWRSMRR

SEQ ID NO: 1304987 - protein, 9 aa, Homo Sapiens
VEVKSWQIT

SEQ ID NO: 1304988 - protein, 9 aa, Homo Sapiens
NEKLSSCLS

SEQ ID NO: 1304989 - protein, 9 aa, Homo Sapiens
KSVGTLFGM

SEQ ID NO: 1304990 - protein, 9 aa, Homo Sapiens
PIIKGLGYN

SEQ ID NO: 1304991 - protein, 9 aa, Homo Sapiens
DPVHLCVHD

SEQ ID NO: 1304992 - protein, 9 aa, Homo Sapiens
ARTEYAENA

SEQ ID NO: 1304993 - protein, 9 aa, Homo Sapiens
HVMEFGLEH

SEQ ID NO: 1304994 - protein, 9 aa, Homo Sapiens
SLPIFQRVN

SEQ ID NO: 1304995 - protein, 9 aa, Homo Sapiens
SSKMITPEY

SEQ ID NO: 1304996 - protein, 9 aa, Homo Sapiens
FVNLFCFNK

SEQ ID NO: 1304997 - protein, 9 aa, Homo Sapiens
IHTNVSMDY

SEQ ID NO: 1304998 - protein, 9 aa, Homo Sapiens
GLVIAADML

SEQ ID NO: 1304999 - protein, 9 aa, Homo Sapiens
YSSLLKRDC

SEQ ID NO: 1305000 - protein, 9 aa, Homo Sapiens
KTKKIKDKY

SEQ ID NO: 1305001 - protein, 9 aa, Homo Sapiens
EELDKIFQE

SEQ ID NO: 1305002 - protein, 9 aa, Homo Sapiens
STELFKLNN

SEQ ID NO: 1305003 - protein, 9 aa, Homo Sapiens
DADEIIVLN

SEQ ID NO: 1305004 - protein, 9 aa, Homo Sapiens
DKPYRGSVE

SEQ ID NO: 1305005 - protein, 9 aa, Homo Sapiens
PILTRMSQF

SEQ ID NO: 1305006 - protein, 9 aa, Homo Sapiens
NGPILLDTK

SEQ ID NO: 1305007 - protein, 9 aa, Homo Sapiens
TNKEEMRKR

SEQ ID NO: 1305008 - protein, 9 aa, Homo Sapiens
CEFSCTGGY

SEQ ID NO: 1305009 - protein, 9 aa, Homo Sapiens
ERNETVFKH

SEQ ID NO: 1305010 - protein, 9 aa, Homo Sapiens
GHTNTNNLK

SEQ ID NO: 1305011 - protein, 9 aa, Homo Sapiens
EAKRYKIYH

SEQ ID NO: 1305012 - protein, 9 aa, Homo Sapiens
ASPKYEVCK

SEQ ID NO: 1305013 - protein, 9 aa, Homo Sapiens
KEQDKIIEN

SEQ ID NO: 1305014 - protein, 9 aa, Homo Sapiens
SYFDAVFLD

SEQ ID NO: 1305015 - protein, 9 aa, Homo Sapiens
LITVFWMGS

SEQ ID NO: 1305016 - protein, 9 aa, Homo Sapiens
NKGSMGFPG

SEQ ID NO: 1305017 - protein, 9 aa, Homo Sapiens
QVNTRLTLL

SEQ ID NO: 1305018 - protein, 9 aa, Homo Sapiens
GISLSSLIA

SEQ ID NO: 1305019 - protein, 9 aa, Homo Sapiens
DNTISSLKG

SEQ ID NO: 1305020 - protein, 9 aa, Homo Sapiens
TLNVHKIIH

SEQ ID NO: 1305021 - protein, 9 aa, Homo Sapiens
KAFRNNSGP

SEQ ID NO: 1305022 - protein, 9 aa, Homo Sapiens
CVSEMYRME

SEQ ID NO: 1305023 - protein, 9 aa, Homo Sapiens
ITQDYLQLE

SEQ ID NO: 1305024 - protein, 9 aa, Homo Sapiens
VKIMKDIQK

SEQ ID NO: 1305025 - protein, 9 aa, Homo Sapiens
KVIKLHKSH

SEQ ID NO: 1305026 - protein, 9 aa, Homo Sapiens
PSFQLCVYV

SEQ ID NO: 1305027 - protein, 9 aa, Homo Sapiens
GCFDEFNQI

SEQ ID NO: 1305028 - protein, 9 aa, Homo Sapiens
RAAQVAGIC

SEQ ID NO: 1305029 - protein, 9 aa, Homo Sapiens
KNQGAHYPD

SEQ ID NO: 1305030 - protein, 9 aa, Homo Sapiens
AMTKSQIIA

SEQ ID NO: 1305031 - protein, 9 aa, Homo Sapiens
SNIYLEIIK

SEQ ID NO: 1305032 - protein, 9 aa, Homo Sapiens
RYPSFFSNP

SEQ ID NO: 1305033 - protein, 9 aa, Homo Sapiens
PSAKFSGLI

SEQ ID NO: 1305034 - protein, 9 aa, Homo Sapiens
YMTIAPKGR

SEQ ID NO: 1305035 - protein, 9 aa, Homo Sapiens
NSNVTSPLE

SEQ ID NO: 1305036 - protein, 9 aa, Homo Sapiens
HDDKSPICD

SEQ ID NO: 1305037 - protein, 9 aa, Homo Sapiens
EDIVTILQA

SEQ ID NO: 1305038 - protein, 9 aa, Homo Sapiens
YHNWDTGRE

SEQ ID NO: 1305039 - protein, 9 aa, Homo Sapiens
SSHLIRHHQ

SEQ ID NO: 1305040 - protein, 9 aa, Homo Sapiens
KLWEFQLLE

SEQ ID NO: 1305041 - protein, 9 aa, Homo Sapiens
NQTIPSEPE

SEQ ID NO: 1305042 - protein, 9 aa, Homo Sapiens
DCQTGAWRH

SEQ ID NO: 1305043 - protein, 9 aa, Homo Sapiens
TLQSCSTVH

SEQ ID NO: 1305044 - protein, 9 aa, Homo Sapiens
SFTFIPRPR

SEQ ID NO: 1305045 - protein, 9 aa, Homo Sapiens
NYLTGHNNN

SEQ ID NO: 1305046 - protein, 9 aa, Homo Sapiens
GFQKKAYTY

SEQ ID NO: 1305047 - protein, 9 aa, Homo Sapiens
EYAENANKL

SEQ ID NO: 1305048 - protein, 9 aa, Homo Sapiens
QIIHSREKP

SEQ ID NO: 1305049 - protein, 9 aa, Homo Sapiens
SKLVQARNK

SEQ ID NO: 1305050 - protein, 9 aa, Homo Sapiens
NISASAPNP

SEQ ID NO: 1305051 - protein, 9 aa, Homo Sapiens
SQEQLQRTH

SEQ ID NO: 1305052 - protein, 9 aa, Homo Sapiens
IKHHATILA

SEQ ID NO: 1305053 - protein, 9 aa, Homo Sapiens
MGYNVCTLH

SEQ ID NO: 1305054 - protein, 9 aa, Homo Sapiens
TQKSNINIH

SEQ ID NO: 1305055 - protein, 9 aa, Homo Sapiens
LEDFFMMSD

SEQ ID NO: 1305056 - protein, 9 aa, Homo Sapiens
LDKDENDLR

SEQ ID NO: 1305057 - protein, 9 aa, Homo Sapiens
IESLGLHSK

SEQ ID NO: 1305058 - protein, 9 aa, Homo Sapiens
EIFPKQSHK

SEQ ID NO: 1305059 - protein, 9 aa, Homo Sapiens
CHLSYKMSD

SEQ ID NO: 1305060 - protein, 9 aa, Homo Sapiens
KLTKFVSAP

SEQ ID NO: 1305061 - protein, 9 aa, Homo Sapiens
EKPFWCTFE

SEQ ID NO: 1305062 - protein, 9 aa, Homo Sapiens
LFKCCFCDL

SEQ ID NO: 1305063 - protein, 9 aa, Homo Sapiens
MNTKAGVAA

SEQ ID NO: 1305064 - protein, 9 aa, Homo Sapiens
SDVSDLIIF

SEQ ID NO: 1305065 - protein, 9 aa, Homo Sapiens
EEIMRNQLS

SEQ ID NO: 1305066 - protein, 9 aa, Homo Sapiens
GATCEFSCT

SEQ ID NO: 1305067 - protein, 9 aa, Homo Sapiens
ICNELEKQM

SEQ ID NO: 1305068 - protein, 9 aa, Homo Sapiens
AFLRLAQSR

SEQ ID NO: 1305069 - protein, 9 aa, Homo Sapiens
SAEEEDWDY

SEQ ID NO: 1305070 - protein, 9 aa, Homo Sapiens
YDILWDDML

SEQ ID NO: 1305071 - protein, 9 aa, Homo Sapiens
LLRIARRAL

SEQ ID NO: 1305072 - protein, 9 aa, Homo Sapiens
VQINHIVNK

SEQ ID NO: 1305073 - protein, 9 aa, Homo Sapiens
KGNENSKAN

SEQ ID NO: 1305074 - protein, 9 aa, Homo Sapiens
NWAYQQLQQ

SEQ ID NO: 1305075 - protein, 9 aa, Homo Sapiens
NHLSSVSVG

SEQ ID NO: 1305076 - protein, 9 aa, Homo Sapiens
KTPHNITIR

SEQ ID NO: 1305077 - protein, 9 aa, Homo Sapiens
ESFRQPVDL

SEQ ID NO: 1305078 - protein, 9 aa, Homo Sapiens
VGMDRIVRQ

SEQ ID NO: 1305079 - protein, 9 aa, Homo Sapiens
FICTVYIEV

SEQ ID NO: 1305080 - protein, 9 aa, Homo Sapiens
EENNIRRDI

SEQ ID NO: 1305081 - protein, 9 aa, Homo Sapiens
VDNKVLHAA

SEQ ID NO: 1305082 - protein, 9 aa, Homo Sapiens
KCRMATEQP

SEQ ID NO: 1305083 - protein, 9 aa, Homo Sapiens
DGSCRNLLN

SEQ ID NO: 1305084 - protein, 9 aa, Homo Sapiens
DKPYTCEER

SEQ ID NO: 1305085 - protein, 9 aa, Homo Sapiens
YVALTVIRI

SEQ ID NO: 1305086 - protein, 9 aa, Homo Sapiens
AIQVGFITY

SEQ ID NO: 1305087 - protein, 9 aa, Homo Sapiens
RTPAACLNF

SEQ ID NO: 1305088 - protein, 9 aa, Homo Sapiens
TSAIQVGFI

SEQ ID NO: 1305089 - protein, 9 aa, Homo Sapiens
FLWLSVLQN

SEQ ID NO: 1305090 - protein, 9 aa, Homo Sapiens
LTTNLSKPL

SEQ ID NO: 1305091 - protein, 9 aa, Homo Sapiens
CPMHLEYFP

SEQ ID NO: 1305092 - protein, 9 aa, Homo Sapiens
SLPELSPHK

SEQ ID NO: 1305093 - protein, 9 aa, Homo Sapiens
QKKAYTYPE

SEQ ID NO: 1305094 - protein, 9 aa, Homo Sapiens
KKMPGSVSC

SEQ ID NO: 1305095 - protein, 9 aa, Homo Sapiens
SELKVLVVK

SEQ ID NO: 1305096 - protein, 9 aa, Homo Sapiens
FCEHMDIAH

SEQ ID NO: 1305097 - protein, 9 aa, Homo Sapiens
THTTIATQT

SEQ ID NO: 1305098 - protein, 9 aa, Homo Sapiens
RATGVDYIT

SEQ ID NO: 1305099 - protein, 9 aa, Homo Sapiens
IKSECSLHE

SEQ ID NO: 1305100 - protein, 9 aa, Homo Sapiens
LQAENQSTT

SEQ ID NO: 1305101 - protein, 9 aa, Homo Sapiens
REQLQLSEV

SEQ ID NO: 1305102 - protein, 9 aa, Homo Sapiens
EKIILNISA

SEQ ID NO: 1305103 - protein, 9 aa, Homo Sapiens
TVFQEVVSF

SEQ ID NO: 1305104 - protein, 9 aa, Homo Sapiens
ALGCKLVLY

SEQ ID NO: 1305105 - protein, 9 aa, Homo Sapiens
SSTLNVHKI

SEQ ID NO: 1305106 - protein, 9 aa, Homo Sapiens
GTLKNYLFF

SEQ ID NO: 1305107 - protein, 9 aa, Homo Sapiens
NLKEQDKII

SEQ ID NO: 1305108 - protein, 9 aa, Homo Sapiens
PRDIQLARR

SEQ ID NO: 1305109 - protein, 9 aa, Homo Sapiens
AMDLVKSHF

SEQ ID NO: 1305110 - protein, 9 aa, Homo Sapiens
KTYLIGSHT

SEQ ID NO: 1305111 - protein, 9 aa, Homo Sapiens
PIWKKEIYK

SEQ ID NO: 1305112 - protein, 9 aa, Homo Sapiens
SIINPDAFI

SEQ ID NO: 1305113 - protein, 9 aa, Homo Sapiens
VKGRLDQLD

SEQ ID NO: 1305114 - protein, 9 aa, Homo Sapiens
YDQNNGFYF

SEQ ID NO: 1305115 - protein, 9 aa, Homo Sapiens
KYTLSVDWW

SEQ ID NO: 1305116 - protein, 9 aa, Homo Sapiens
PLYYLRIDQ

SEQ ID NO: 1305117 - protein, 9 aa, Homo Sapiens
LACKYNGKY

SEQ ID NO: 1305118 - protein, 9 aa, Homo Sapiens
KMTFIYLSN

SEQ ID NO: 1305119 - protein, 9 aa, Homo Sapiens
EMSPSKNYF

SEQ ID NO: 1305120 - protein, 9 aa, Homo Sapiens
EKNGQGASG

SEQ ID NO: 1305121 - protein, 9 aa, Homo Sapiens
YAEQLKIFL

SEQ ID NO: 1305122 - protein, 9 aa, Homo Sapiens
GIGGLVWAL

SEQ ID NO: 1305123 - protein, 9 aa, Homo Sapiens
LNSTFSSDN

SEQ ID NO: 1305124 - protein, 9 aa, Homo Sapiens
FTRSVSEMK

SEQ ID NO: 1305125 - protein, 9 aa, Homo Sapiens
YLKIWGKKR

SEQ ID NO: 1305126 - protein, 9 aa, Homo Sapiens
EVVVLSQNS

SEQ ID NO: 1305127 - protein, 9 aa, Homo Sapiens
SYLKIWGKK

SEQ ID NO: 1305128 - protein, 9 aa, Homo Sapiens
QSYLNSVQH

SEQ ID NO: 1305129 - protein, 9 aa, Homo Sapiens
AQNLEKMHP

SEQ ID NO: 1305130 - protein, 9 aa, Homo Sapiens
LSLHLYGIG

SEQ ID NO: 1305131 - protein, 9 aa, Homo Sapiens
NILSSELLQ

SEQ ID NO: 1305132 - protein, 9 aa, Homo Sapiens
LPEGQAPCL

SEQ ID NO: 1305133 - protein, 9 aa, Homo Sapiens
HYCGVCLGL

SEQ ID NO: 1305134 - protein, 9 aa, Homo Sapiens
YVAGMHGNK

SEQ ID NO: 1305135 - protein, 9 aa, Homo Sapiens
ATLSFLLFW

SEQ ID NO: 1305136 - protein, 9 aa, Homo Sapiens
GPQKSFPEE

SEQ ID NO: 1305137 - protein, 9 aa, Homo Sapiens
KSQLTEHKI

SEQ ID NO: 1305138 - protein, 9 aa, Homo Sapiens
DAIVAFAIN

SEQ ID NO: 1305139 - protein, 9 aa, Homo Sapiens
VRNPYTGHN

SEQ ID NO: 1305140 - protein, 9 aa, Homo Sapiens
RIPNLSRNC

SEQ ID NO: 1305141 - protein, 9 aa, Homo Sapiens
ITLNLVPSS

SEQ ID NO: 1305142 - protein, 9 aa, Homo Sapiens
FPGYPGPPG

SEQ ID NO: 1305143 - protein, 9 aa, Homo Sapiens
GSSVSDKLK

SEQ ID NO: 1305144 - protein, 9 aa, Homo Sapiens
DDDAIVAAL

SEQ ID NO: 1305145 - protein, 9 aa, Homo Sapiens
NTYMNYTTS

SEQ ID NO: 1305146 - protein, 9 aa, Homo Sapiens
QNQISHLPA

SEQ ID NO: 1305147 - protein, 9 aa, Homo Sapiens
EDERKLLSN

SEQ ID NO: 1305148 - protein, 9 aa, Homo Sapiens
CRKSALILH

SEQ ID NO: 1305149 - protein, 9 aa, Homo Sapiens
ICDEFAPHL

SEQ ID NO: 1305150 - protein, 9 aa, Homo Sapiens
ISFLQDCLH

SEQ ID NO: 1305151 - protein, 9 aa, Homo Sapiens
GFGLLSGYL

SEQ ID NO: 1305152 - protein, 9 aa, Homo Sapiens
HIFSNMYQN

SEQ ID NO: 1305153 - protein, 9 aa, Homo Sapiens
GSEVEREMD

SEQ ID NO: 1305154 - protein, 9 aa, Homo Sapiens
SRPWDFREF

SEQ ID NO: 1305155 - protein, 9 aa, Homo Sapiens
LVFGVLSGE

SEQ ID NO: 1305156 - protein, 9 aa, Homo Sapiens
NYGNRYHLR

SEQ ID NO: 1305157 - protein, 9 aa, Homo Sapiens
CDYFDKLSL

SEQ ID NO: 1305158 - protein, 9 aa, Homo Sapiens
PNTIRLRIV

SEQ ID NO: 1305159 - protein, 9 aa, Homo Sapiens
SRHSPAPVS

SEQ ID NO: 1305160 - protein, 9 aa, Homo Sapiens
ESINQENFK

SEQ ID NO: 1305161 - protein, 9 aa, Homo Sapiens
ITERITNSQ

SEQ ID NO: 1305162 - protein, 9 aa, Homo Sapiens
FRMDFSATQ

SEQ ID NO: 1305163 - protein, 9 aa, Homo Sapiens
QDRIVVTCK

SEQ ID NO: 1305164 - protein, 9 aa, Homo Sapiens
LEEKETLLA

SEQ ID NO: 1305165 - protein, 9 aa, Homo Sapiens
GAALKATGN

SEQ ID NO: 1305166 - protein, 9 aa, Homo Sapiens
AIVAFAINH

SEQ ID NO: 1305167 - protein, 9 aa, Homo Sapiens
RNHEIREIQ

SEQ ID NO: 1305168 - protein, 9 aa, Homo Sapiens
RDSYAPYKL

SEQ ID NO: 1305169 - protein, 9 aa, Homo Sapiens
IPLLVWVKR

SEQ ID NO: 1305170 - protein, 9 aa, Homo Sapiens
KLSHLSPME

SEQ ID NO: 1305171 - protein, 9 aa, Homo Sapiens
LMSKNNMNS

SEQ ID NO: 1305172 - protein, 9 aa, Homo Sapiens
SLSDKLAAV

SEQ ID NO: 1305173 - protein, 9 aa, Homo Sapiens
SLPPLPPAK

SEQ ID NO: 1305174 - protein, 9 aa, Homo Sapiens
SKTFTRSVS

SEQ ID NO: 1305175 - protein, 9 aa, Homo Sapiens
GNVESYLKE

SEQ ID NO: 1305176 - protein, 9 aa, Homo Sapiens
IELLNAELE

SEQ ID NO: 1305177 - protein, 9 aa, Homo Sapiens
ELKVLVVKL

SEQ ID NO: 1305178 - protein, 9 aa, Homo Sapiens
SKNPNFKVF

SEQ ID NO: 1305179 - protein, 9 aa, Homo Sapiens
YSTKLYRCF

SEQ ID NO: 1305180 - protein, 9 aa, Homo Sapiens
EVDNKVLHA

SEQ ID NO: 1305181 - protein, 9 aa, Homo Sapiens
MRKGPSAKQ

SEQ ID NO: 1305182 - protein, 9 aa, Homo Sapiens
IMVPNYFSP

SEQ ID NO: 1305183 - protein, 9 aa, Homo Sapiens
KITQFWLYF

SEQ ID NO: 1305184 - protein, 9 aa, Homo Sapiens
FIEYGKKKT

SEQ ID NO: 1305185 - protein, 9 aa, Homo Sapiens
LQKTATIMV

SEQ ID NO: 1305186 - protein, 9 aa, Homo Sapiens
GTSFDKSLH

SEQ ID NO: 1305187 - protein, 9 aa, Homo Sapiens
DRPSRQISI

SEQ ID NO: 1305188 - protein, 9 aa, Homo Sapiens
KTHTGVKPY

SEQ ID NO: 1305189 - protein, 9 aa, Homo Sapiens
LSQNSRDAI

SEQ ID NO: 1305190 - protein, 9 aa, Homo Sapiens
TNGFSSLED

SEQ ID NO: 1305191 - protein, 9 aa, Homo Sapiens
DQVFSGLEE

SEQ ID NO: 1305192 - protein, 9 aa, Homo Sapiens
GKMSRITLL

SEQ ID NO: 1305193 - protein, 9 aa, Homo Sapiens
PASEVLQIQ

SEQ ID NO: 1305194 - protein, 9 aa, Homo Sapiens
KLYRCFKYI

SEQ ID NO: 1305195 - protein, 9 aa, Homo Sapiens
RELSTQVPA

SEQ ID NO: 1305196 - protein, 9 aa, Homo Sapiens
QGQSMHLSN

SEQ ID NO: 1305197 - protein, 9 aa, Homo Sapiens
AALIVHQII

SEQ ID NO: 1305198 - protein, 9 aa, Homo Sapiens
FWSRVLPSN

SEQ ID NO: 1305199 - protein, 9 aa, Homo Sapiens
KAHLYRELT

SEQ ID NO: 1305200 - protein, 9 aa, Homo Sapiens
EIDEEAICV

SEQ ID NO: 1305201 - protein, 9 aa, Homo Sapiens
DGCLEYNHK

SEQ ID NO: 1305202 - protein, 9 aa, Homo Sapiens
VGGSAGNYL

SEQ ID NO: 1305203 - protein, 9 aa, Homo Sapiens
RENKYLEDI

SEQ ID NO: 1305204 - protein, 9 aa, Homo Sapiens
PAALARSAL

SEQ ID NO: 1305205 - protein, 9 aa, Homo Sapiens
TLNLVPSSM

SEQ ID NO: 1305206 - protein, 9 aa, Homo Sapiens
VSCFFIWQC

SEQ ID NO: 1305207 - protein, 9 aa, Homo Sapiens
SGDIEKYND

SEQ ID NO: 1305208 - protein, 9 aa, Homo Sapiens
PNCPFLENY

SEQ ID NO: 1305209 - protein, 9 aa, Homo Sapiens
YDALNMLMA

SEQ ID NO: 1305210 - protein, 9 aa, Homo Sapiens
GGLVIAADM

SEQ ID NO: 1305211 - protein, 9 aa, Homo Sapiens
KRMLKVIHD

SEQ ID NO: 1305212 - protein, 9 aa, Homo Sapiens
ISSPVTTVY

SEQ ID NO: 1305213 - protein, 9 aa, Homo Sapiens
LKIIPSYMS

SEQ ID NO: 1305214 - protein, 9 aa, Homo Sapiens
KISGILTFM

SEQ ID NO: 1305215 - protein, 9 aa, Homo Sapiens
CEIDEEAIC

SEQ ID NO: 1305216 - protein, 9 aa, Homo Sapiens
CELLALEEN

SEQ ID NO: 1305217 - protein, 9 aa, Homo Sapiens
HQNEHIGDK

SEQ ID NO: 1305218 - protein, 9 aa, Homo Sapiens
FEGGLVIAA

SEQ ID NO: 1305219 - protein, 9 aa, Homo Sapiens
ALSCFIIPV

SEQ ID NO: 1305220 - protein, 9 aa, Homo Sapiens
NGQRGFIPG

SEQ ID NO: 1305221 - protein, 9 aa, Homo Sapiens
LEVKILESA

SEQ ID NO: 1305222 - protein, 9 aa, Homo Sapiens
LNLVFGVLS

SEQ ID NO: 1305223 - protein, 9 aa, Homo Sapiens
NNGFYFEYY

SEQ ID NO: 1305224 - protein, 9 aa, Homo Sapiens
LFNAELLEV

SEQ ID NO: 1305225 - protein, 9 aa, Homo Sapiens
KDIDVSFVK

SEQ ID NO: 1305226 - protein, 9 aa, Homo Sapiens
LNHDGEYRF

SEQ ID NO: 1305227 - protein, 9 aa, Homo Sapiens
HTIQKDGLD

SEQ ID NO: 1305228 - protein, 9 aa, Homo Sapiens
RNPYTGHNY

SEQ ID NO: 1305229 - protein, 9 aa, Homo Sapiens
IQSFYQMHR

SEQ ID NO: 1305230 - protein, 9 aa, Homo Sapiens
ERNKWIHCF

SEQ ID NO: 1305231 - protein, 9 aa, Homo Sapiens
RLLMYYFVN

SEQ ID NO: 1305232 - protein, 9 aa, Homo Sapiens
LQSMQTSRL

SEQ ID NO: 1305233 - protein, 9 aa, Homo Sapiens
ILAVGVFSF

SEQ ID NO: 1305234 - protein, 9 aa, Homo Sapiens
VLVVLDTSW

SEQ ID NO: 1305235 - protein, 9 aa, Homo Sapiens
NGQGASGTV

SEQ ID NO: 1305236 - protein, 9 aa, Homo Sapiens
NLKTPTERI

SEQ ID NO: 1305237 - protein, 9 aa, Homo Sapiens
EFIRVRKEV

SEQ ID NO: 1305238 - protein, 9 aa, Homo Sapiens
KVLVVKLLS

SEQ ID NO: 1305239 - protein, 9 aa, Homo Sapiens
FTKEKLALL

SEQ ID NO: 1305240 - protein, 9 aa, Homo Sapiens
QRQQKIQGK

SEQ ID NO: 1305241 - protein, 9 aa, Homo Sapiens
SSCSLNALD

SEQ ID NO: 1305242 - protein, 9 aa, Homo Sapiens
GDYWKKMPG

SEQ ID NO: 1305243 - protein, 9 aa, Homo Sapiens
ISCIFNYGN

SEQ ID NO: 1305244 - protein, 9 aa, Homo Sapiens
AVKGRSTNY

SEQ ID NO: 1305245 - protein, 9 aa, Homo Sapiens
QEFHVPLVD

SEQ ID NO: 1305246 - protein, 9 aa, Homo Sapiens
QKFGRTALH

SEQ ID NO: 1305247 - protein, 9 aa, Homo Sapiens
ERATGVDYI

SEQ ID NO: 1305248 - protein, 9 aa, Homo Sapiens
HYISAEEED

SEQ ID NO: 1305249 - protein, 9 aa, Homo Sapiens
SSSCSLNAL

SEQ ID NO: 1305250 - protein, 9 aa, Homo Sapiens
EHWEKLLNK

SEQ ID NO: 1305251 - protein, 9 aa, Homo Sapiens
VAVVFTKEK

SEQ ID NO: 1305252 - protein, 9 aa, Homo Sapiens
HLSSVSVGL

SEQ ID NO: 1305253 - protein, 9 aa, Homo Sapiens
RSGISIKQV

SEQ ID NO: 1305254 - protein, 9 aa, Homo Sapiens
INKIMLTKD

SEQ ID NO: 1305255 - protein, 9 aa, Homo Sapiens
RLSRRRASG

SEQ ID NO: 1305256 - protein, 9 aa, Homo Sapiens
RISCSGHLV

SEQ ID NO: 1305257 - protein, 9 aa, Homo Sapiens
MNTAQIVVM

SEQ ID NO: 1305258 - protein, 9 aa, Homo Sapiens
GQSMHLSNY

SEQ ID NO: 1305259 - protein, 9 aa, Homo Sapiens
VCDDKFIFS

SEQ ID NO: 1305260 - protein, 9 aa, Homo Sapiens
LKDEAEKKL

SEQ ID NO: 1305261 - protein, 9 aa, Homo Sapiens
ERDNVFGKT

SEQ ID NO: 1305262 - protein, 9 aa, Homo Sapiens
IKGAMKTLF

SEQ ID NO: 1305263 - protein, 9 aa, Homo Sapiens
DKPKQESQS

SEQ ID NO: 1305264 - protein, 9 aa, Homo Sapiens
DKVIKLHKS

SEQ ID NO: 1305265 - protein, 9 aa, Homo Sapiens
FWTLPGQVL

SEQ ID NO: 1305266 - protein, 9 aa, Homo Sapiens
ALTSSKLLY

SEQ ID NO: 1305267 - protein, 9 aa, Homo Sapiens
LIMPVIPMN

SEQ ID NO: 1305268 - protein, 9 aa, Homo Sapiens
FVLNLVFGV

SEQ ID NO: 1305269 - protein, 9 aa, Homo Sapiens
RSYSWFQDE

SEQ ID NO: 1305270 - protein, 9 aa, Homo Sapiens
KGWSVGNIY

SEQ ID NO: 1305271 - protein, 9 aa, Homo Sapiens
FNGCHSGEI

SEQ ID NO: 1305272 - protein, 9 aa, Homo Sapiens
QLKIHGKNN

SEQ ID NO: 1305273 - protein, 9 aa, Homo Sapiens
AIEFACHQL

SEQ ID NO: 1305274 - protein, 9 aa, Homo Sapiens
IKMTFIYLS

SEQ ID NO: 1305275 - protein, 9 aa, Homo Sapiens
NVRLAQRAI

SEQ ID NO: 1305276 - protein, 9 aa, Homo Sapiens
PRRYKLMSR

SEQ ID NO: 1305277 - protein, 9 aa, Homo Sapiens
SAIQVGFIT

SEQ ID NO: 1305278 - protein, 9 aa, Homo Sapiens
DPETNNNIT

SEQ ID NO: 1305279 - protein, 9 aa, Homo Sapiens
KLRKQVEEM

SEQ ID NO: 1305280 - protein, 9 aa, Homo Sapiens
MGSHYIVDG

SEQ ID NO: 1305281 - protein, 9 aa, Homo Sapiens
GQQENGPIL

SEQ ID NO: 1305282 - protein, 9 aa, Homo Sapiens
ESWKHMNYS

SEQ ID NO: 1305283 - protein, 9 aa, Homo Sapiens
KYVILADLL

SEQ ID NO: 1305284 - protein, 9 aa, Homo Sapiens
ELNETINIG

SEQ ID NO: 1305285 - protein, 9 aa, Homo Sapiens
VPLLNHFIY

SEQ ID NO: 1305286 - protein, 9 aa, Homo Sapiens
SSAGGILAV

SEQ ID NO: 1305287 - protein, 9 aa, Homo Sapiens
LSSRVQFQN

SEQ ID NO: 1305288 - protein, 9 aa, Homo Sapiens
MVPNYFSPQ

SEQ ID NO: 1305289 - protein, 9 aa, Homo Sapiens
IPLDPVHLC

SEQ ID NO: 1305290 - protein, 9 aa, Homo Sapiens
EDCQTGAWR

SEQ ID NO: 1305291 - protein, 9 aa, Homo Sapiens
RMGGLFNSG

SEQ ID NO: 1305292 - protein, 9 aa, Homo Sapiens
IQIEFINEK

SEQ ID NO: 1305293 - protein, 9 aa, Homo Sapiens
YIRPVTTLS

SEQ ID NO: 1305294 - protein, 9 aa, Homo Sapiens
NASTANKCV

SEQ ID NO: 1305295 - protein, 9 aa, Homo Sapiens
DSYYEESDE

SEQ ID NO: 1305296 - protein, 9 aa, Homo Sapiens
HKHKFQAPV

SEQ ID NO: 1305297 - protein, 9 aa, Homo Sapiens
LEYRGLASR

SEQ ID NO: 1305298 - protein, 9 aa, Homo Sapiens
KNICSAGGG

SEQ ID NO: 1305299 - protein, 9 aa, Homo Sapiens
PPVCLLLEL

SEQ ID NO: 1305300 - protein, 9 aa, Homo Sapiens
YLEELISGS

SEQ ID NO: 1305301 - protein, 9 aa, Homo Sapiens
PSEHTDTEI

SEQ ID NO: 1305302 - protein, 9 aa, Homo Sapiens
KKLFTVSPE

SEQ ID NO: 1305303 - protein, 9 aa, Homo Sapiens
EIWNGPYET

SEQ ID NO: 1305304 - protein, 9 aa, Homo Sapiens
NKSLIGGNH

SEQ ID NO: 1305305 - protein, 9 aa, Homo Sapiens
LSPIPHIPQ

SEQ ID NO: 1305306 - protein, 9 aa, Homo Sapiens
SGIDQIISQ

SEQ ID NO: 1305307 - protein, 9 aa, Homo Sapiens
LNAAVREAG

SEQ ID NO: 1305308 - protein, 9 aa, Homo Sapiens
LEAMALTST

SEQ ID NO: 1305309 - protein, 9 aa, Homo Sapiens
LEKLRVDTS

SEQ ID NO: 1305310 - protein, 9 aa, Homo Sapiens
CSLLDSEDH

SEQ ID NO: 1305311 - protein, 9 aa, Homo Sapiens
GSSLQAENQ

SEQ ID NO: 1305312 - protein, 9 aa, Homo Sapiens
TLTVHQIIH

SEQ ID NO: 1305313 - protein, 9 aa, Homo Sapiens
RIKYSRYFL

SEQ ID NO: 1305314 - protein, 9 aa, Homo Sapiens
DNFFLLRGN

SEQ ID NO: 1305315 - protein, 9 aa, Homo Sapiens
GQHNGHIES

SEQ ID NO: 1305316 - protein, 9 aa, Homo Sapiens
EAIILVNQP

SEQ ID NO: 1305317 - protein, 9 aa, Homo Sapiens
SRRYAGKYS

SEQ ID NO: 1305318 - protein, 9 aa, Homo Sapiens
QITEDEEAA

SEQ ID NO: 1305319 - protein, 9 aa, Homo Sapiens
FSPPIKHPW

SEQ ID NO: 1305320 - protein, 9 aa, Homo Sapiens
EVVEVKSWQ

SEQ ID NO: 1305321 - protein, 9 aa, Homo Sapiens
YNGKYEVCL

SEQ ID NO: 1305322 - protein, 9 aa, Homo Sapiens
ATLSYDQNN

SEQ ID NO: 1305323 - protein, 9 aa, Homo Sapiens
STFVQDFSN

SEQ ID NO: 1305324 - protein, 9 aa, Homo Sapiens
CSQLCEQHK

SEQ ID NO: 1305325 - protein, 9 aa, Homo Sapiens
KKQKQNCPI

SEQ ID NO: 1305326 - protein, 9 aa, Homo Sapiens
KCVEEILEI

SEQ ID NO: 1305327 - protein, 9 aa, Homo Sapiens
QDYLQLEQF

SEQ ID NO: 1305328 - protein, 9 aa, Homo Sapiens
SASRVQAII

SEQ ID NO: 1305329 - protein, 9 aa, Homo Sapiens
FNPIDFLEP

SEQ ID NO: 1305330 - protein, 9 aa, Homo Sapiens
TSRNIIPLH

SEQ ID NO: 1305331 - protein, 9 aa, Homo Sapiens
MSPAPVTLL

SEQ ID NO: 1305332 - protein, 9 aa, Homo Sapiens
FTQHQIIHT

SEQ ID NO: 1305333 - protein, 9 aa, Homo Sapiens
QRTHSQLLQ

SEQ ID NO: 1305334 - protein, 9 aa, Homo Sapiens
MPVRSSVDE

SEQ ID NO: 1305335 - protein, 9 aa, Homo Sapiens
GKYEVCLTL

SEQ ID NO: 1305336 - protein, 9 aa, Homo Sapiens
IKKQVNTRL

SEQ ID NO: 1305337 - protein, 9 aa, Homo Sapiens
MLESGIDQI

SEQ ID NO: 1305338 - protein, 9 aa, Homo Sapiens
NARRKPKGN

SEQ ID NO: 1305339 - protein, 9 aa, Homo Sapiens
SSFVNLFCF

SEQ ID NO: 1305340 - protein, 9 aa, Homo Sapiens
FGGSNQKCQ

SEQ ID NO: 1305341 - protein, 9 aa, Homo Sapiens
YKGWSVGNI

SEQ ID NO: 1305342 - protein, 9 aa, Homo Sapiens
SDNIPNEVY

SEQ ID NO: 1305343 - protein, 9 aa, Homo Sapiens
KKTNLCKRQ

SEQ ID NO: 1305344 - protein, 9 aa, Homo Sapiens
TKVLHFKDW

SEQ ID NO: 1305345 - protein, 9 aa, Homo Sapiens
NPESLSVDE

SEQ ID NO: 1305346 - protein, 9 aa, Homo Sapiens
ATISKTPST

SEQ ID NO: 1305347 - protein, 9 aa, Homo Sapiens
CLRGDKDPK

SEQ ID NO: 1305348 - protein, 9 aa, Homo Sapiens
RNKLSETED

SEQ ID NO: 1305349 - protein, 9 aa, Homo Sapiens
VKINAHKVV

SEQ ID NO: 1305350 - protein, 9 aa, Homo Sapiens
ITDAPGHRD

SEQ ID NO: 1305351 - protein, 9 aa, Homo Sapiens
TEYLLMISK

SEQ ID NO: 1305352 - protein, 9 aa, Homo Sapiens
DETEQNQAL

SEQ ID NO: 1305353 - protein, 9 aa, Homo Sapiens
LHEKILNGV

SEQ ID NO: 1305354 - protein, 9 aa, Homo Sapiens
FPVRGGLGP

SEQ ID NO: 1305355 - protein, 9 aa, Homo Sapiens
MWIKAAKTG

SEQ ID NO: 1305356 - protein, 9 aa, Homo Sapiens
DHTTELSRQ

SEQ ID NO: 1305357 - protein, 9 aa, Homo Sapiens
SIYEIQEFH

SEQ ID NO: 1305358 - protein, 9 aa, Homo Sapiens
VSTDKGNEN

SEQ ID NO: 1305359 - protein, 9 aa, Homo Sapiens
ELRQLTLPR

SEQ ID NO: 1305360 - protein, 9 aa, Homo Sapiens
MIKELRRTN

SEQ ID NO: 1305361 - protein, 9 aa, Homo Sapiens
FSATQFHIE

SEQ ID NO: 1305362 - protein, 9 aa, Homo Sapiens
KVDPETNNN

SEQ ID NO: 1305363 - protein, 9 aa, Homo Sapiens
MIFGDLIRF

SEQ ID NO: 1305364 - protein, 9 aa, Homo Sapiens
YDSNSTNHN

SEQ ID NO: 1305365 - protein, 9 aa, Homo Sapiens
TLECRAEAE

SEQ ID NO: 1305366 - protein, 9 aa, Homo Sapiens
DDGCKTYWK

SEQ ID NO: 1305367 - protein, 9 aa, Homo Sapiens
RKHIKDMKV

SEQ ID NO: 1305368 - protein, 9 aa, Homo Sapiens
IIKISKTSV

SEQ ID NO: 1305369 - protein, 9 aa, Homo Sapiens
LTGFNSPFN

SEQ ID NO: 1305370 - protein, 9 aa, Homo Sapiens
SRIHVCLYL

SEQ ID NO: 1305371 - protein, 9 aa, Homo Sapiens
RCRINLVAL

SEQ ID NO: 1305372 - protein, 9 aa, Homo Sapiens
NRKLTYIRG

SEQ ID NO: 1305373 - protein, 9 aa, Homo Sapiens
RNFDLENDI

SEQ ID NO: 1305374 - protein, 9 aa, Homo Sapiens
IRVAKGYQE

SEQ ID NO: 1305375 - protein, 9 aa, Homo Sapiens
GSKTFTRSV

SEQ ID NO: 1305376 - protein, 9 aa, Homo Sapiens
LDICDDDEF

SEQ ID NO: 1305377 - protein, 9 aa, Homo Sapiens
PCLPQARGP

SEQ ID NO: 1305378 - protein, 9 aa, Homo Sapiens
TQRSYSWFQ

SEQ ID NO: 1305379 - protein, 9 aa, Homo Sapiens
VFCKIQMEP

SEQ ID NO: 1305380 - protein, 9 aa, Homo Sapiens
QFDHPNVVN

SEQ ID NO: 1305381 - protein, 9 aa, Homo Sapiens
KETAWKVKD

SEQ ID NO: 1305382 - protein, 9 aa, Homo Sapiens
MLANQTAAN

SEQ ID NO: 1305383 - protein, 9 aa, Homo Sapiens
GKTQVEAVA

SEQ ID NO: 1305384 - protein, 9 aa, Homo Sapiens
DYNNPIDQC

SEQ ID NO: 1305385 - protein, 9 aa, Homo Sapiens
PVGDFHCKN

SEQ ID NO: 1305386 - protein, 9 aa, Homo Sapiens
EKILNGVRL

SEQ ID NO: 1305387 - protein, 9 aa, Homo Sapiens
IKKLPKDAN

SEQ ID NO: 1305388 - protein, 9 aa, Homo Sapiens
RRNIFNLSA

SEQ ID NO: 1305389 - protein, 9 aa, Homo Sapiens
RAESMRSFS

SEQ ID NO: 1305390 - protein, 9 aa, Homo Sapiens
VLSYFWYMR

SEQ ID NO: 1305391 - protein, 9 aa, Homo Sapiens
IIHKIIHTG

SEQ ID NO: 1305392 - protein, 9 aa, Homo Sapiens
TVMGRVIEE

SEQ ID NO: 1305393 - protein, 9 aa, Homo Sapiens
VNKYLDLSL

SEQ ID NO: 1305394 - protein, 9 aa, Homo Sapiens
IIHQLQMNS

SEQ ID NO: 1305395 - protein, 9 aa, Homo Sapiens
CLCWMPHHT

SEQ ID NO: 1305396 - protein, 9 aa, Homo Sapiens
HKIIHMELR

SEQ ID NO: 1305397 - protein, 9 aa, Homo Sapiens
CWMPHHTLI

SEQ ID NO: 1305398 - protein, 9 aa, Homo Sapiens
CKTFEEIWK

SEQ ID NO: 1305399 - protein, 9 aa, Homo Sapiens
YQTVTATLE

SEQ ID NO: 1305400 - protein, 9 aa, Homo Sapiens
TRNAFRIRY

SEQ ID NO: 1305401 - protein, 9 aa, Homo Sapiens
SILGFNILS

SEQ ID NO: 1305402 - protein, 9 aa, Homo Sapiens
ITINQDPLG

SEQ ID NO: 1305403 - protein, 9 aa, Homo Sapiens
ALKLFCEID

SEQ ID NO: 1305404 - protein, 9 aa, Homo Sapiens
PKLYLSPQI

SEQ ID NO: 1305405 - protein, 9 aa, Homo Sapiens
INMTLQSDI

SEQ ID NO: 1305406 - protein, 9 aa, Homo Sapiens
QQFKAESED

SEQ ID NO: 1305407 - protein, 9 aa, Homo Sapiens
RNGQRGFIP

SEQ ID NO: 1305408 - protein, 9 aa, Homo Sapiens
INPEKKGEK

SEQ ID NO: 1305409 - protein, 9 aa, Homo Sapiens
TCGIICGKL

SEQ ID NO: 1305410 - protein, 9 aa, Homo Sapiens
MVGTINMTL

SEQ ID NO: 1305411 - protein, 9 aa, Homo Sapiens
VTSVYWYRE

SEQ ID NO: 1305412 - protein, 9 aa, Homo Sapiens
VQPSRPAPL

SEQ ID NO: 1305413 - protein, 9 aa, Homo Sapiens
SRAHAETSK

SEQ ID NO: 1305414 - protein, 9 aa, Homo Sapiens
IMISYCLIA

SEQ ID NO: 1305415 - protein, 9 aa, Homo Sapiens
LLEKLCFSA

SEQ ID NO: 1305416 - protein, 9 aa, Homo Sapiens
MPVNYYIYS

SEQ ID NO: 1305417 - protein, 9 aa, Homo Sapiens
VPAEYSSFI

SEQ ID NO: 1305418 - protein, 9 aa, Homo Sapiens
YGKDYSQRP

SEQ ID NO: 1305419 - protein, 9 aa, Homo Sapiens
KATGNNLSE

SEQ ID NO: 1305420 - protein, 9 aa, Homo Sapiens
ELKHHQKIH

SEQ ID NO: 1305421 - protein, 9 aa, Homo Sapiens
TYLIGSHTV

SEQ ID NO: 1305422 - protein, 9 aa, Homo Sapiens
IAAEINKFL

SEQ ID NO: 1305423 - protein, 9 aa, Homo Sapiens
KDIQKNTVK

SEQ ID NO: 1305424 - protein, 9 aa, Homo Sapiens
FGPYEGQIT

SEQ ID NO: 1305425 - protein, 9 aa, Homo Sapiens
GYSDKIEHV

SEQ ID NO: 1305426 - protein, 9 aa, Homo Sapiens
IRTIFYLFL

SEQ ID NO: 1305427 - protein, 9 aa, Homo Sapiens
PLLNHFIYS

SEQ ID NO: 1305428 - protein, 9 aa, Homo Sapiens
NYFSPQTDK

SEQ ID NO: 1305429 - protein, 9 aa, Homo Sapiens
SPEPLQRPK

SEQ ID NO: 1305430 - protein, 9 aa, Homo Sapiens
WQCGLLMCI

SEQ ID NO: 1305431 - protein, 9 aa, Homo Sapiens
AKSKKNKPL

SEQ ID NO: 1305432 - protein, 9 aa, Homo Sapiens
VTKEEFCEA

SEQ ID NO: 1305433 - protein, 9 aa, Homo Sapiens
RPLPNTIRL

SEQ ID NO: 1305434 - protein, 9 aa, Homo Sapiens
GLLLLLVQC

SEQ ID NO: 1305435 - protein, 9 aa, Homo Sapiens
KIKYPDNFF

SEQ ID NO: 1305436 - protein, 9 aa, Homo Sapiens
PKQSHKLER

SEQ ID NO: 1305437 - protein, 9 aa, Homo Sapiens
NLTEEPTKL

SEQ ID NO: 1305438 - protein, 9 aa, Homo Sapiens
REFALLLLI

SEQ ID NO: 1305439 - protein, 9 aa, Homo Sapiens
TPEYKMNTK

SEQ ID NO: 1305440 - protein, 9 aa, Homo Sapiens
RAQMDPNKI

SEQ ID NO: 1305441 - protein, 9 aa, Homo Sapiens
TKAGTFQVR

SEQ ID NO: 1305442 - protein, 9 aa, Homo Sapiens
FTMLLGVLP

SEQ ID NO: 1305443 - protein, 9 aa, Homo Sapiens
NSPFNGEVI

SEQ ID NO: 1305444 - protein, 9 aa, Homo Sapiens
NNKEKEPEC

SEQ ID NO: 1305445 - protein, 9 aa, Homo Sapiens
RYNELITKY

SEQ ID NO: 1305446 - protein, 9 aa, Homo Sapiens
QKGNAVHLN

SEQ ID NO: 1305447 - protein, 9 aa, Homo Sapiens
TICIDNKDE

SEQ ID NO: 1305448 - protein, 9 aa, Homo Sapiens
EDKYLHEVS

SEQ ID NO: 1305449 - protein, 9 aa, Homo Sapiens
AQGYFRMDF

SEQ ID NO: 1305450 - protein, 9 aa, Homo Sapiens
SFIELQDKL

SEQ ID NO: 1305451 - protein, 9 aa, Homo Sapiens
SVIAQNLEK

SEQ ID NO: 1305452 - protein, 9 aa, Homo Sapiens
DDPEAIILV

SEQ ID NO: 1305453 - protein, 9 aa, Homo Sapiens
MHEIYKGKI

SEQ ID NO: 1305454 - protein, 9 aa, Homo Sapiens
KEIDTINGK

SEQ ID NO: 1305455 - protein, 9 aa, Homo Sapiens
LPDQTKDNL

SEQ ID NO: 1305456 - protein, 9 aa, Homo Sapiens
DDKLKTLVE

SEQ ID NO: 1305457 - protein, 9 aa, Homo Sapiens
APNPNVICN

SEQ ID NO: 1305458 - protein, 9 aa, Homo Sapiens
TSSKLLYIY

SEQ ID NO: 1305459 - protein, 9 aa, Homo Sapiens
LARTPAACL

SEQ ID NO: 1305460 - protein, 9 aa, Homo Sapiens
FTKTPHNIT

SEQ ID NO: 1305461 - protein, 9 aa, Homo Sapiens
RFHKEDKLM

SEQ ID NO: 1305462 - protein, 9 aa, Homo Sapiens
PSATISKTP

SEQ ID NO: 1305463 - protein, 9 aa, Homo Sapiens
EKLLNKMQS

SEQ ID NO: 1305464 - protein, 9 aa, Homo Sapiens
HGSPRSIPT

SEQ ID NO: 1305465 - protein, 9 aa, Homo Sapiens
EEDTNSERI

SEQ ID NO: 1305466 - protein, 9 aa, Homo Sapiens
SAIKSVGTL

SEQ ID NO: 1305467 - protein, 9 aa, Homo Sapiens
VPKNNEMKK

SEQ ID NO: 1305468 - protein, 9 aa, Homo Sapiens
ILAPAKQEY

SEQ ID NO: 1305469 - protein, 9 aa, Homo Sapiens
ETSDMYLIQ

SEQ ID NO: 1305470 - protein, 9 aa, Homo Sapiens
LDSEDHNTC

SEQ ID NO: 1305471 - protein, 9 aa, Homo Sapiens
WGCFDEFNQ

SEQ ID NO: 1305472 - protein, 9 aa, Homo Sapiens
MSKNNMNST

SEQ ID NO: 1305473 - protein, 9 aa, Homo Sapiens
IHQLQMNSR

SEQ ID NO: 1305474 - protein, 9 aa, Homo Sapiens
REERLDGHL

SEQ ID NO: 1305475 - protein, 9 aa, Homo Sapiens
GLQHEGIFQ

SEQ ID NO: 1305476 - protein, 9 aa, Homo Sapiens
QTIPSEPER

SEQ ID NO: 1305477 - protein, 9 aa, Homo Sapiens
SIQTKKASK

SEQ ID NO: 1305478 - protein, 9 aa, Homo Sapiens
QVGFITYNK

SEQ ID NO: 1305479 - protein, 9 aa, Homo Sapiens
KFDKDRDSI

SEQ ID NO: 1305480 - protein, 9 aa, Homo Sapiens
WMPHHTLIL

SEQ ID NO: 1305481 - protein, 9 aa, Homo Sapiens
QLVVIAILT

SEQ ID NO: 1305482 - protein, 9 aa, Homo Sapiens
PPAERRNFI

SEQ ID NO: 1305483 - protein, 9 aa, Homo Sapiens
LYERFLRII

SEQ ID NO: 1305484 - protein, 9 aa, Homo Sapiens
QVQRRGSRW

SEQ ID NO: 1305485 - protein, 9 aa, Homo Sapiens
VVLDTSWVG

SEQ ID NO: 1305486 - protein, 9 aa, Homo Sapiens
IHQIIHTGE

SEQ ID NO: 1305487 - protein, 9 aa, Homo Sapiens
ISPTQLCFI

SEQ ID NO: 1305488 - protein, 9 aa, Homo Sapiens
DIYGRTALI

SEQ ID NO: 1305489 - protein, 9 aa, Homo Sapiens
KKTKKIKDK

SEQ ID NO: 1305490 - protein, 9 aa, Homo Sapiens
KINKDILMA

SEQ ID NO: 1305491 - protein, 9 aa, Homo Sapiens
FEIFPKQSH

SEQ ID NO: 1305492 - protein, 9 aa, Homo Sapiens
QIDASVLSV

SEQ ID NO: 1305493 - protein, 9 aa, Homo Sapiens
LELLAKVNG

SEQ ID NO: 1305494 - protein, 9 aa, Homo Sapiens
SSFIIAKQI

SEQ ID NO: 1305495 - protein, 8 aa, Homo Sapiens
NWFGSNFF

SEQ ID NO: 1305496 - protein, 9 aa, Homo Sapiens
CKGVRDMFH

SEQ ID NO: 1305497 - protein, 9 aa, Homo Sapiens
SFNWCMAQA

SEQ ID NO: 1305498 - protein, 9 aa, Homo Sapiens
PKDKRVTLL

SEQ ID NO: 1305499 - protein, 9 aa, Homo Sapiens
NANKTDPCT

SEQ ID NO: 1305500 - protein, 9 aa, Homo Sapiens
TGCCSELVT

SEQ ID NO: 1305501 - protein, 9 aa, Homo Sapiens
PVSKSSTFY

SEQ ID NO: 1305502 - protein, 9 aa, Homo Sapiens
ALLGKYFRK

SEQ ID NO: 1305503 - protein, 9 aa, Homo Sapiens
ESVRGDVRS

SEQ ID NO: 1305504 - protein, 9 aa, Homo Sapiens
VANIVLTVV

SEQ ID NO: 1305505 - protein, 9 aa, Homo Sapiens
DPNDNTKFY

SEQ ID NO: 1305506 - protein, 9 aa, Homo Sapiens
FLGGVDKIT

SEQ ID NO: 1305507 - protein, 9 aa, Homo Sapiens
HIGDKPYRG

SEQ ID NO: 1305508 - protein, 9 aa, Homo Sapiens
LGITYRNKY

SEQ ID NO: 1305509 - protein, 9 aa, Homo Sapiens
IHERMHTDE

SEQ ID NO: 1305510 - protein, 9 aa, Homo Sapiens
LIMMPVNYY

SEQ ID NO: 1305511 - protein, 9 aa, Homo Sapiens
EDFNKNMNE

SEQ ID NO: 1305512 - protein, 9 aa, Homo Sapiens
SVPESSSEA

SEQ ID NO: 1305513 - protein, 9 aa, Homo Sapiens
IKKKEERAA

SEQ ID NO: 1305514 - protein, 9 aa, Homo Sapiens
CVVEHYENT

SEQ ID NO: 1305515 - protein, 9 aa, Homo Sapiens
SSREGVSCT

SEQ ID NO: 1305516 - protein, 9 aa, Homo Sapiens
RKLFQVWKV

SEQ ID NO: 1305517 - protein, 9 aa, Homo Sapiens
QVAGICYIT

SEQ ID NO: 1305518 - protein, 9 aa, Homo Sapiens
IKDKYIDQE

SEQ ID NO: 1305519 - protein, 9 aa, Homo Sapiens
LALARTPAA

SEQ ID NO: 1305520 - protein, 9 aa, Homo Sapiens
GAPQAGIRI

SEQ ID NO: 1305521 - protein, 9 aa, Homo Sapiens
IKERQQRIK

SEQ ID NO: 1305522 - protein, 9 aa, Homo Sapiens
PSIYFNAQT

SEQ ID NO: 1305523 - protein, 9 aa, Homo Sapiens
IIHSREKPH

SEQ ID NO: 1305524 - protein, 9 aa, Homo Sapiens
QLRRIQRQT

SEQ ID NO: 1305525 - protein, 9 aa, Homo Sapiens
LALKENDIK

SEQ ID NO: 1305526 - protein, 9 aa, Homo Sapiens
ESYLKEQGQ

SEQ ID NO: 1305527 - protein, 9 aa, Homo Sapiens
YLSGNYFRH

SEQ ID NO: 1305528 - protein, 9 aa, Homo Sapiens
FKILNYQNK

SEQ ID NO: 1305529 - protein, 9 aa, Homo Sapiens
ENVTSKEIC

SEQ ID NO: 1305530 - protein, 9 aa, Homo Sapiens
LSRSLPPLP

SEQ ID NO: 1305531 - protein, 9 aa, Homo Sapiens
CENNVDYET

SEQ ID NO: 1305532 - protein, 9 aa, Homo Sapiens
LFTTHKGHF

SEQ ID NO: 1305533 - protein, 9 aa, Homo Sapiens
INLVALKAD

SEQ ID NO: 1305534 - protein, 9 aa, Homo Sapiens
ANQNINAVH

SEQ ID NO: 1305535 - protein, 9 aa, Homo Sapiens
ERVKGRLDQ

SEQ ID NO: 1305536 - protein, 9 aa, Homo Sapiens
KISEDGTHC

SEQ ID NO: 1305537 - protein, 9 aa, Homo Sapiens
WKIMARTLT

SEQ ID NO: 1305538 - protein, 9 aa, Homo Sapiens
SVQHLINQW

SEQ ID NO: 1305539 - protein, 9 aa, Homo Sapiens
SCIFNYGNR

SEQ ID NO: 1305540 - protein, 9 aa, Homo Sapiens
DFHCKNHHC

SEQ ID NO: 1305541 - protein, 9 aa, Homo Sapiens
EIKARPPQE

SEQ ID NO: 1305542 - protein, 9 aa, Homo Sapiens
FKTLQNHWK

SEQ ID NO: 1305543 - protein, 9 aa, Homo Sapiens
LQAETTFWV

SEQ ID NO: 1305544 - protein, 9 aa, Homo Sapiens
QRFMEEENN

SEQ ID NO: 1305545 - protein, 9 aa, Homo Sapiens
TTRVTKEEF

SEQ ID NO: 1305546 - protein, 9 aa, Homo Sapiens
RNKFSGLEI

SEQ ID NO: 1305547 - protein, 9 aa, Homo Sapiens
RDASFKSLQ

SEQ ID NO: 1305548 - protein, 9 aa, Homo Sapiens
IRPVTTLSE

SEQ ID NO: 1305549 - protein, 9 aa, Homo Sapiens
LVRRNIFNL

SEQ ID NO: 1305550 - protein, 9 aa, Homo Sapiens
SVSVGLPVD

SEQ ID NO: 1305551 - protein, 9 aa, Homo Sapiens
VFRSKIIHN

SEQ ID NO: 1305552 - protein, 9 aa, Homo Sapiens
PIPLLVWVK

SEQ ID NO: 1305553 - protein, 9 aa, Homo Sapiens
VFTKEKLAL

SEQ ID NO: 1305554 - protein, 9 aa, Homo Sapiens
SLGNHCTEI

SEQ ID NO: 1305555 - protein, 9 aa, Homo Sapiens
LDVPLEQKM

SEQ ID NO: 1305556 - protein, 9 aa, Homo Sapiens
LLYLQSIPR

SEQ ID NO: 1305557 - protein, 9 aa, Homo Sapiens
SDNTISSLK

SEQ ID NO: 1305558 - protein, 9 aa, Homo Sapiens
VIFLAGFTY

SEQ ID NO: 1305559 - protein, 9 aa, Homo Sapiens
FCENNVDYE

SEQ ID NO: 1305560 - protein, 9 aa, Homo Sapiens
SIAPSSQTK

SEQ ID NO: 1305561 - protein, 9 aa, Homo Sapiens
LQLSEVTGT

SEQ ID NO: 1305562 - protein, 9 aa, Homo Sapiens
TEQLIQVQR

SEQ ID NO: 1305563 - protein, 9 aa, Homo Sapiens
EVLEHLSPG

SEQ ID NO: 1305564 - protein, 9 aa, Homo Sapiens
IFNLSAPEK

SEQ ID NO: 1305565 - protein, 9 aa, Homo Sapiens
ISKTPSTPE

SEQ ID NO: 1305566 - protein, 9 aa, Homo Sapiens
KPYKFKECG

SEQ ID NO: 1305567 - protein, 9 aa, Homo Sapiens
VSVKGVLES

SEQ ID NO: 1305568 - protein, 9 aa, Homo Sapiens
QNCPIPQWI

SEQ ID NO: 1305569 - protein, 9 aa, Homo Sapiens
DVVSCFRDK

SEQ ID NO: 1305570 - protein, 9 aa, Homo Sapiens
PQSLEGKRK

SEQ ID NO: 1305571 - protein, 9 aa, Homo Sapiens
RVTIMPRDI

SEQ ID NO: 1305572 - protein, 9 aa, Homo Sapiens
TKLTKFVSA

SEQ ID NO: 1305573 - protein, 9 aa, Homo Sapiens
KKKTKKIKD

SEQ ID NO: 1305574 - protein, 9 aa, Homo Sapiens
IVLEEIFMI

SEQ ID NO: 1305575 - protein, 9 aa, Homo Sapiens
DVACLVIYR

SEQ ID NO: 1305576 - protein, 9 aa, Homo Sapiens
CSELVTKIK

SEQ ID NO: 1305577 - protein, 9 aa, Homo Sapiens
EDNIIIISS

SEQ ID NO: 1305578 - protein, 9 aa, Homo Sapiens
ITIILLDIN

SEQ ID NO: 1305579 - protein, 9 aa, Homo Sapiens
ILTTHKIIS

SEQ ID NO: 1305580 - protein, 9 aa, Homo Sapiens
QAALQSMQT

SEQ ID NO: 1305581 - protein, 9 aa, Homo Sapiens
KDAENEVNE

SEQ ID NO: 1305582 - protein, 9 aa, Homo Sapiens
ASSVKYKSS

SEQ ID NO: 1305583 - protein, 9 aa, Homo Sapiens
EKKLFTVSP

SEQ ID NO: 1305584 - protein, 9 aa, Homo Sapiens
GITSRNIIP

SEQ ID NO: 1305585 - protein, 9 aa, Homo Sapiens
DRKVFVGQF

SEQ ID NO: 1305586 - protein, 9 aa, Homo Sapiens
IMLSVLKNT

SEQ ID NO: 1305587 - protein, 9 aa, Homo Sapiens
QGLKYTLSV

SEQ ID NO: 1305588 - protein, 9 aa, Homo Sapiens
TIMPRDIQL

SEQ ID NO: 1305589 - protein, 9 aa, Homo Sapiens
RPHQQPTTE

SEQ ID NO: 1305590 - protein, 9 aa, Homo Sapiens
SADCQYVIS

SEQ ID NO: 1305591 - protein, 9 aa, Homo Sapiens
TTLSEDKVF

SEQ ID NO: 1305592 - protein, 9 aa, Homo Sapiens
VVIQNEINN

SEQ ID NO: 1305593 - protein, 9 aa, Homo Sapiens
QIEHALGGS

SEQ ID NO: 1305594 - protein, 9 aa, Homo Sapiens
YSNKLSHLS

SEQ ID NO: 1305595 - protein, 9 aa, Homo Sapiens
RHFKLEKHS

SEQ ID NO: 1305596 - protein, 9 aa, Homo Sapiens
GSMGFPGHQ

SEQ ID NO: 1305597 - protein, 9 aa, Homo Sapiens
HGSHLTEHL

SEQ ID NO: 1305598 - protein, 9 aa, Homo Sapiens
PYYYNKKNT

SEQ ID NO: 1305599 - protein, 9 aa, Homo Sapiens
IFSERSYLS

SEQ ID NO: 1305600 - protein, 9 aa, Homo Sapiens
VELDPEDKC

SEQ ID NO: 1305601 - protein, 9 aa, Homo Sapiens
QHVMEFGLE

SEQ ID NO: 1305602 - protein, 9 aa, Homo Sapiens
IVVTCKTFE

SEQ ID NO: 1305603 - protein, 9 aa, Homo Sapiens
GDKKPRKQT

SEQ ID NO: 1305604 - protein, 9 aa, Homo Sapiens
FLLVKLNDH

SEQ ID NO: 1305605 - protein, 9 aa, Homo Sapiens
SKLEGISPS

SEQ ID NO: 1305606 - protein, 9 aa, Homo Sapiens
NPNSSDYLA

SEQ ID NO: 1305607 - protein, 9 aa, Homo Sapiens
DMFHSCTGQ

SEQ ID NO: 1305608 - protein, 9 aa, Homo Sapiens
KEERAALIA

SEQ ID NO: 1305609 - protein, 9 aa, Homo Sapiens
RYKIYHLAL

SEQ ID NO: 1305610 - protein, 9 aa, Homo Sapiens
NTKAGVAAS

SEQ ID NO: 1305611 - protein, 9 aa, Homo Sapiens
SMGLGVEVL

SEQ ID NO: 1305612 - protein, 9 aa, Homo Sapiens
DNTPELLPK

SEQ ID NO: 1305613 - protein, 9 aa, Homo Sapiens
MNWFHLNDG

SEQ ID NO: 1305614 - protein, 9 aa, Homo Sapiens
VLIILWMQL

SEQ ID NO: 1305615 - protein, 9 aa, Homo Sapiens
GWMKFRLPL

SEQ ID NO: 1305616 - protein, 9 aa, Homo Sapiens
CCIKPNDFK

SEQ ID NO: 1305617 - protein, 9 aa, Homo Sapiens
PSLHLPLWD

SEQ ID NO: 1305618 - protein, 9 aa, Homo Sapiens
INLFIALYL

SEQ ID NO: 1305619 - protein, 9 aa, Homo Sapiens
TQKTYLIGS

SEQ ID NO: 1305620 - protein, 9 aa, Homo Sapiens
EAAKKNIGK

SEQ ID NO: 1305621 - protein, 9 aa, Homo Sapiens
VNSLCKGYY

SEQ ID NO: 1305622 - protein, 9 aa, Homo Sapiens
FSMEIQQFK

SEQ ID NO: 1305623 - protein, 9 aa, Homo Sapiens
PMINCEDIN

SEQ ID NO: 1305624 - protein, 9 aa, Homo Sapiens
SVGLPVDLQ

SEQ ID NO: 1305625 - protein, 9 aa, Homo Sapiens
PIPHIPQSP

SEQ ID NO: 1305626 - protein, 9 aa, Homo Sapiens
EIFQIINNT

SEQ ID NO: 1305627 - protein, 9 aa, Homo Sapiens
NNITVPFKA

SEQ ID NO: 1305628 - protein, 9 aa, Homo Sapiens
KRKQSFKAV

SEQ ID NO: 1305629 - protein, 9 aa, Homo Sapiens
YQPICDTNF

SEQ ID NO: 1305630 - protein, 9 aa, Homo Sapiens
HSKLSNVAR

SEQ ID NO: 1305631 - protein, 9 aa, Homo Sapiens
INQISTLHA

SEQ ID NO: 1305632 - protein, 9 aa, Homo Sapiens
DVPIFIHCS

SEQ ID NO: 1305633 - protein, 9 aa, Homo Sapiens
EEHWEKLLN

SEQ ID NO: 1305634 - protein, 9 aa, Homo Sapiens
RNVYKKACS

SEQ ID NO: 1305635 - protein, 9 aa, Homo Sapiens
KQSFKAVVT

SEQ ID NO: 1305636 - protein, 9 aa, Homo Sapiens
QIPENESAD

SEQ ID NO: 1305637 - protein, 9 aa, Homo Sapiens
KQRYKNQKF

SEQ ID NO: 1305638 - protein, 9 aa, Homo Sapiens
GTELALKEN

SEQ ID NO: 1305639 - protein, 9 aa, Homo Sapiens
PPIKHPWRK

SEQ ID NO: 1305640 - protein, 9 aa, Homo Sapiens
FFDDIDHNM

SEQ ID NO: 1305641 - protein, 9 aa, Homo Sapiens
ISAEEEDWD

SEQ ID NO: 1305642 - protein, 9 aa, Homo Sapiens
SSKTQKTYL

SEQ ID NO: 1305643 - protein, 9 aa, Homo Sapiens
YESIIPKKY

SEQ ID NO: 1305644 - protein, 9 aa, Homo Sapiens
SYAELRQLT

SEQ ID NO: 1305645 - protein, 9 aa, Homo Sapiens
QHQNEHIGD

SEQ ID NO: 1305646 - protein, 9 aa, Homo Sapiens
EILEIFDML

SEQ ID NO: 1305647 - protein, 9 aa, Homo Sapiens
TYLSVLMKQ

SEQ ID NO: 1305648 - protein, 9 aa, Homo Sapiens
LLLLPIPLL

SEQ ID NO: 1305649 - protein, 9 aa, Homo Sapiens
SSLEDNLLH

SEQ ID NO: 1305650 - protein, 9 aa, Homo Sapiens
AMRILDLPQ

SEQ ID NO: 1305651 - protein, 9 aa, Homo Sapiens
DLWKRWNTS

SEQ ID NO: 1305652 - protein, 9 aa, Homo Sapiens
IVHTVSGFL

SEQ ID NO: 1305653 - protein, 9 aa, Homo Sapiens
FWKKNHKLE

SEQ ID NO: 1305654 - protein, 9 aa, Homo Sapiens
CFPPTKRGP

SEQ ID NO: 1305655 - protein, 9 aa, Homo Sapiens
APEVSHIKN

SEQ ID NO: 1305656 - protein, 9 aa, Homo Sapiens
TELFKLNNA

SEQ ID NO: 1305657 - protein, 9 aa, Homo Sapiens
GPTNLQIEY

SEQ ID NO: 1305658 - protein, 9 aa, Homo Sapiens
VGNHEEKIL

SEQ ID NO: 1305659 - protein, 9 aa, Homo Sapiens
CRHKRARKQ

SEQ ID NO: 1305660 - protein, 9 aa, Homo Sapiens
ISLAIYFRC

SEQ ID NO: 1305661 - protein, 9 aa, Homo Sapiens
CRSFALFFD

SEQ ID NO: 1305662 - protein, 9 aa, Homo Sapiens
ITERLQAHL

SEQ ID NO: 1305663 - protein, 9 aa, Homo Sapiens
HYIVDGNHR

SEQ ID NO: 1305664 - protein, 9 aa, Homo Sapiens
IIFLGPLMQ

SEQ ID NO: 1305665 - protein, 9 aa, Homo Sapiens
ILNYQNNYF

SEQ ID NO: 1305666 - protein, 9 aa, Homo Sapiens
RLAGCTFQY

SEQ ID NO: 1305667 - protein, 9 aa, Homo Sapiens
PQEIKTYSL

SEQ ID NO: 1305668 - protein, 9 aa, Homo Sapiens
NGFSSLEDN

SEQ ID NO: 1305669 - protein, 9 aa, Homo Sapiens
IQNKYATGK

SEQ ID NO: 1305670 - protein, 9 aa, Homo Sapiens
SNIYFYCNP

SEQ ID NO: 1305671 - protein, 9 aa, Homo Sapiens
KKSPPANGP

SEQ ID NO: 1305672 - protein, 9 aa, Homo Sapiens
YVYKVVVDR

SEQ ID NO: 1305673 - protein, 9 aa, Homo Sapiens
FDHPNVVNL

SEQ ID NO: 1305674 - protein, 9 aa, Homo Sapiens
TRMTDDIDN

SEQ ID NO: 1305675 - protein, 9 aa, Homo Sapiens
GSLDGSCRN

SEQ ID NO: 1305676 - protein, 9 aa, Homo Sapiens
EDVPIFIHC

SEQ ID NO: 1305677 - protein, 9 aa, Homo Sapiens
LARSALSYY

SEQ ID NO: 1305678 - protein, 9 aa, Homo Sapiens
QTQRNVINV

SEQ ID NO: 1305679 - protein, 9 aa, Homo Sapiens
RNNSGPKVH

SEQ ID NO: 1305680 - protein, 9 aa, Homo Sapiens
SPAPVTLLA

SEQ ID NO: 1305681 - protein, 9 aa, Homo Sapiens
KNNLHGDGL

SEQ ID NO: 1305682 - protein, 9 aa, Homo Sapiens
RFFYNVRLA

SEQ ID NO: 1305683 - protein, 9 aa, Homo Sapiens
SSQVQRYTN

SEQ ID NO: 1305684 - protein, 9 aa, Homo Sapiens
ALQSMQTSR

SEQ ID NO: 1305685 - protein, 9 aa, Homo Sapiens
SVKGVLESH

SEQ ID NO: 1305686 - protein, 9 aa, Homo Sapiens
SEGIKERQQ

SEQ ID NO: 1305687 - protein, 9 aa, Homo Sapiens
IEEARFAVA

SEQ ID NO: 1305688 - protein, 9 aa, Homo Sapiens
INDELKKKK

SEQ ID NO: 1305689 - protein, 9 aa, Homo Sapiens
TYAEQLKIF

SEQ ID NO: 1305690 - protein, 9 aa, Homo Sapiens
RHLSFRWTT

SEQ ID NO: 1305691 - protein, 9 aa, Homo Sapiens
NTCILSKML

SEQ ID NO: 1305692 - protein, 9 aa, Homo Sapiens
INYFAIAEN

SEQ ID NO: 1305693 - protein, 9 aa, Homo Sapiens
GDSDGQHNG

SEQ ID NO: 1305694 - protein, 9 aa, Homo Sapiens
HRKGSNSNE

SEQ ID NO: 1305695 - protein, 9 aa, Homo Sapiens
YLRIDQKIY

SEQ ID NO: 1305696 - protein, 9 aa, Homo Sapiens
YSEHDYLWV

SEQ ID NO: 1305697 - protein, 9 aa, Homo Sapiens
IVVMQESLL

SEQ ID NO: 1305698 - protein, 9 aa, Homo Sapiens
LRVGDVKIN

SEQ ID NO: 1305699 - protein, 9 aa, Homo Sapiens
MRLLEKLCF

SEQ ID NO: 1305700 - protein, 9 aa, Homo Sapiens
RDIFSERSY

SEQ ID NO: 1305701 - protein, 9 aa, Homo Sapiens
AVGVGKSAL

SEQ ID NO: 1305702 - protein, 9 aa, Homo Sapiens
FPKVAITIC

SEQ ID NO: 1305703 - protein, 9 aa, Homo Sapiens
EVCSTFVQD

SEQ ID NO: 1305704 - protein, 9 aa, Homo Sapiens
SITPSAQTQ

SEQ ID NO: 1305705 - protein, 9 aa, Homo Sapiens
RYSRFFYNV

SEQ ID NO: 1305706 - protein, 9 aa, Homo Sapiens
RMHEIIHTG

SEQ ID NO: 1305707 - protein, 9 aa, Homo Sapiens
AHRKGSNSN

SEQ ID NO: 1305708 - protein, 9 aa, Homo Sapiens
QTKDNLVEA

SEQ ID NO: 1305709 - protein, 9 aa, Homo Sapiens
ETNWRDYLL

SEQ ID NO: 1305710 - protein, 9 aa, Homo Sapiens
VKGRSTNYV

SEQ ID NO: 1305711 - protein, 9 aa, Homo Sapiens
MSDNIPNEV

SEQ ID NO: 1305712 - protein, 9 aa, Homo Sapiens
QEQKFGRTA

SEQ ID NO: 1305713 - protein, 9 aa, Homo Sapiens
RDFVLPWYR

SEQ ID NO: 1305714 - protein, 9 aa, Homo Sapiens
HSHMINKIM

SEQ ID NO: 1305715 - protein, 9 aa, Homo Sapiens
TVDQRASII

SEQ ID NO: 1305716 - protein, 9 aa, Homo Sapiens
LCKRQCEPF

SEQ ID NO: 1305717 - protein, 9 aa, Homo Sapiens
LVTKFTKLW

SEQ ID NO: 1305718 - protein, 9 aa, Homo Sapiens
DPPDGSEEA

SEQ ID NO: 1305719 - protein, 9 aa, Homo Sapiens
QVSGEIRTI

SEQ ID NO: 1305720 - protein, 9 aa, Homo Sapiens
NGKYQLATE

SEQ ID NO: 1305721 - protein, 9 aa, Homo Sapiens
SLGYSDLLC

SEQ ID NO: 1305722 - protein, 9 aa, Homo Sapiens
INLLTEHLL

SEQ ID NO: 1305723 - protein, 9 aa, Homo Sapiens
ILIKKLDTF

SEQ ID NO: 1305724 - protein, 9 aa, Homo Sapiens
LWKELEHLQ

SEQ ID NO: 1305725 - protein, 9 aa, Homo Sapiens
ARRKPKGNP

SEQ ID NO: 1305726 - protein, 9 aa, Homo Sapiens
LEIIKKQVN

SEQ ID NO: 1305727 - protein, 9 aa, Homo Sapiens
SYFWYMRIY

SEQ ID NO: 1305728 - protein, 9 aa, Homo Sapiens
EVEREMDEE

SEQ ID NO: 1305729 - protein, 9 aa, Homo Sapiens
NPKEIEWDD

SEQ ID NO: 1305730 - protein, 9 aa, Homo Sapiens
NTVVLAMQH

SEQ ID NO: 1305731 - protein, 9 aa, Homo Sapiens
MTHNAKYLA

SEQ ID NO: 1305732 - protein, 9 aa, Homo Sapiens
VFAIYWGQV

SEQ ID NO: 1305733 - protein, 9 aa, Homo Sapiens
PSTTQATSR

SEQ ID NO: 1305734 - protein, 9 aa, Homo Sapiens
IKHPWRKVF

SEQ ID NO: 1305735 - protein, 9 aa, Homo Sapiens
NKISEDGTH

SEQ ID NO: 1305736 - protein, 9 aa, Homo Sapiens
LHSLKPQSL

SEQ ID NO: 1305737 - protein, 9 aa, Homo Sapiens
KQKQNCPIP

SEQ ID NO: 1305738 - protein, 9 aa, Homo Sapiens
FWYMRIYRR

SEQ ID NO: 1305739 - protein, 9 aa, Homo Sapiens
DFSATQFHI

SEQ ID NO: 1305740 - protein, 9 aa, Homo Sapiens
EEVDNKVLH

SEQ ID NO: 1305741 - protein, 9 aa, Homo Sapiens
AKNQQRQQK

SEQ ID NO: 1305742 - protein, 9 aa, Homo Sapiens
WMTYIKCAC

SEQ ID NO: 1305743 - protein, 9 aa, Homo Sapiens
YKIVLYPNA

SEQ ID NO: 1305744 - protein, 9 aa, Homo Sapiens
PNDNTKFYA

SEQ ID NO: 1305745 - protein, 9 aa, Homo Sapiens
TINLSILAE

SEQ ID NO: 1305746 - protein, 9 aa, Homo Sapiens
FDKSLHTWV

SEQ ID NO: 1305747 - protein, 9 aa, Homo Sapiens
ICDTVKYKE

SEQ ID NO: 1305748 - protein, 9 aa, Homo Sapiens
SSDNTISSL

SEQ ID NO: 1305749 - protein, 9 aa, Homo Sapiens
KTREEVLQL

SEQ ID NO: 1305750 - protein, 9 aa, Homo Sapiens
LRLSRRRAS

SEQ ID NO: 1305751 - protein, 9 aa, Homo Sapiens
EQEETSAIQ

SEQ ID NO: 1305752 - protein, 9 aa, Homo Sapiens
HIQFEEVIQ

SEQ ID NO: 1305753 - protein, 9 aa, Homo Sapiens
STHTTIATQ

SEQ ID NO: 1305754 - protein, 9 aa, Homo Sapiens
FSCVSLLIQ

SEQ ID NO: 1305755 - protein, 9 aa, Homo Sapiens
QRIKEFQEK

SEQ ID NO: 1305756 - protein, 9 aa, Homo Sapiens
VREFAKDID

SEQ ID NO: 1305757 - protein, 9 aa, Homo Sapiens
MIIRDFVLP

SEQ ID NO: 1305758 - protein, 9 aa, Homo Sapiens
IDFLEPEGS

SEQ ID NO: 1305759 - protein, 9 aa, Homo Sapiens
WHLYRVISK

SEQ ID NO: 1305760 - protein, 9 aa, Homo Sapiens
TFINHQIIH

SEQ ID NO: 1305761 - protein, 9 aa, Homo Sapiens
VEQNTEEFI

SEQ ID NO: 1305762 - protein, 9 aa, Homo Sapiens
LYILHRKPF

SEQ ID NO: 1305763 - protein, 9 aa, Homo Sapiens
RRTNLETQK

SEQ ID NO: 1305764 - protein, 9 aa, Homo Sapiens
KFLISNENK

SEQ ID NO: 1305765 - protein, 9 aa, Homo Sapiens
LEDKRMLKV

SEQ ID NO: 1305766 - protein, 9 aa, Homo Sapiens
GQGKNNLHG

SEQ ID NO: 1305767 - protein, 9 aa, Homo Sapiens
KPIQAPSAL

SEQ ID NO: 1305768 - protein, 9 aa, Homo Sapiens
IEIWNGPYE

SEQ ID NO: 1305769 - protein, 9 aa, Homo Sapiens
KMAKEDPVC

SEQ ID NO: 1305770 - protein, 9 aa, Homo Sapiens
KGSMGFPGH

SEQ ID NO: 1305771 - protein, 9 aa, Homo Sapiens
KERQQRIKE

SEQ ID NO: 1305772 - protein, 9 aa, Homo Sapiens
ILDRYYTAL

SEQ ID NO: 1305773 - protein, 9 aa, Homo Sapiens
NKPTYCLCN

SEQ ID NO: 1305774 - protein, 9 aa, Homo Sapiens
HMIYFDFWF

SEQ ID NO: 1305775 - protein, 9 aa, Homo Sapiens
HPPGSPTSV

SEQ ID NO: 1305776 - protein, 9 aa, Homo Sapiens
KPKGNPRVP

SEQ ID NO: 1305777 - protein, 9 aa, Homo Sapiens
EQNTEEFIR

SEQ ID NO: 1305778 - protein, 9 aa, Homo Sapiens
SELKHHQKI

SEQ ID NO: 1305779 - protein, 9 aa, Homo Sapiens
LQAAVDHTT

SEQ ID NO: 1305780 - protein, 9 aa, Homo Sapiens
NNVLNDWSQ

SEQ ID NO: 1305781 - protein, 9 aa, Homo Sapiens
EVLHKLGLR

SEQ ID NO: 1305782 - protein, 9 aa, Homo Sapiens
ISISERRAA

SEQ ID NO: 1305783 - protein, 9 aa, Homo Sapiens
KFRLPLSYF

SEQ ID NO: 1305784 - protein, 9 aa, Homo Sapiens
NLMQSSSAK

SEQ ID NO: 1305785 - protein, 9 aa, Homo Sapiens
KQNCPIPQW

SEQ ID NO: 1305786 - protein, 9 aa, Homo Sapiens
VQPHFTSED

SEQ ID NO: 1305787 - protein, 9 aa, Homo Sapiens
FITQDYLQL

SEQ ID NO: 1305788 - protein, 9 aa, Homo Sapiens
DRIVRQEAL

SEQ ID NO: 1305789 - protein, 9 aa, Homo Sapiens
TISFWSRVL

SEQ ID NO: 1305790 - protein, 9 aa, Homo Sapiens
ERRLRIWSD

SEQ ID NO: 1305791 - protein, 9 aa, Homo Sapiens
VDHTTELSR

SEQ ID NO: 1305792 - protein, 9 aa, Homo Sapiens
WYKDDEDKE

SEQ ID NO: 1305793 - protein, 9 aa, Homo Sapiens
PVYEKKPNK

SEQ ID NO: 1305794 - protein, 9 aa, Homo Sapiens
LQPDKNICS

SEQ ID NO: 1305795 - protein, 9 aa, Homo Sapiens
KVNQHKHKF

SEQ ID NO: 1305796 - protein, 9 aa, Homo Sapiens
QAENQSTTL

SEQ ID NO: 1305797 - protein, 9 aa, Homo Sapiens
VAFITQDYL

SEQ ID NO: 1305798 - protein, 9 aa, Homo Sapiens
ASFKSLQAG

SEQ ID NO: 1305799 - protein, 9 aa, Homo Sapiens
DNLVEALQE

SEQ ID NO: 1305800 - protein, 9 aa, Homo Sapiens
STYAEQLKI

SEQ ID NO: 1305801 - protein, 9 aa, Homo Sapiens
TKLWEFQLL

SEQ ID NO: 1305802 - protein, 9 aa, Homo Sapiens
KLVVVGAVG

SEQ ID NO: 1305803 - protein, 9 aa, Homo Sapiens
RTIFYLFLY

SEQ ID NO: 1305804 - protein, 9 aa, Homo Sapiens
LPQIKNKSK

SEQ ID NO: 1305805 - protein, 9 aa, Homo Sapiens
CALEEENGK

SEQ ID NO: 1305806 - protein, 9 aa, Homo Sapiens
RNKWIHCFE

SEQ ID NO: 1305807 - protein, 9 aa, Homo Sapiens
TNLQIEYQD

SEQ ID NO: 1305808 - protein, 9 aa, Homo Sapiens
GAYLFQTFL

SEQ ID NO: 1305809 - protein, 9 aa, Homo Sapiens
SNENKIFSE

SEQ ID NO: 1305810 - protein, 9 aa, Homo Sapiens
PVCLLLELE

SEQ ID NO: 1305811 - protein, 9 aa, Homo Sapiens
VLPIIKGLG

SEQ ID NO: 1305812 - protein, 9 aa, Homo Sapiens
PDNFFLLRG

SEQ ID NO: 1305813 - protein, 9 aa, Homo Sapiens
LATDNNTAA

SEQ ID NO: 1305814 - protein, 9 aa, Homo Sapiens
GTMVSLYYP

SEQ ID NO: 1305815 - protein, 9 aa, Homo Sapiens
IFQRVNFGP

SEQ ID NO: 1305816 - protein, 9 aa, Homo Sapiens
LNVHKIIHS

SEQ ID NO: 1305817 - protein, 9 aa, Homo Sapiens
SPKAKVRDA

SEQ ID NO: 1305818 - protein, 9 aa, Homo Sapiens
EQKEILIKK

SEQ ID NO: 1305819 - protein, 9 aa, Homo Sapiens
GIQFSKGKY

SEQ ID NO: 1305820 - protein, 9 aa, Homo Sapiens
QNNYFRRRT

SEQ ID NO: 1305821 - protein, 9 aa, Homo Sapiens
LEHVLIILW

SEQ ID NO: 1305822 - protein, 9 aa, Homo Sapiens
HMDIAHLSC

SEQ ID NO: 1305823 - protein, 9 aa, Homo Sapiens
ERKLLSNKN

SEQ ID NO: 1305824 - protein, 9 aa, Homo Sapiens
RRVYDALNM

SEQ ID NO: 1305825 - protein, 9 aa, Homo Sapiens
CFSAAGSSA

SEQ ID NO: 1305826 - protein, 9 aa, Homo Sapiens
SDLELMCET

SEQ ID NO: 1305827 - protein, 9 aa, Homo Sapiens
HCSICKICI

SEQ ID NO: 1305828 - protein, 9 aa, Homo Sapiens
ESIKMTFIY

SEQ ID NO: 1305829 - protein, 9 aa, Homo Sapiens
NALGGRESY

SEQ ID NO: 1305830 - protein, 9 aa, Homo Sapiens
TFSSDNTIS

SEQ ID NO: 1305831 - protein, 9 aa, Homo Sapiens
AKASNGCVI

SEQ ID NO: 1305832 - protein, 9 aa, Homo Sapiens
KSFPEENAS

SEQ ID NO: 1305833 - protein, 9 aa, Homo Sapiens
GIVPPPPDD

SEQ ID NO: 1305834 - protein, 9 aa, Homo Sapiens
NHHAYVFLQ

SEQ ID NO: 1305835 - protein, 9 aa, Homo Sapiens
ESETQAVPR

SEQ ID NO: 1305836 - protein, 9 aa, Homo Sapiens
PDSLKAYED

SEQ ID NO: 1305837 - protein, 9 aa, Homo Sapiens
LPSSNLVHP

SEQ ID NO: 1305838 - protein, 9 aa, Homo Sapiens
VIAILTLTF

SEQ ID NO: 1305839 - protein, 9 aa, Homo Sapiens
FKINKRKLE

SEQ ID NO: 1305840 - protein, 9 aa, Homo Sapiens
NIVSTRIYK

SEQ ID NO: 1305841 - protein, 9 aa, Homo Sapiens
NNPIDQCNT

SEQ ID NO: 1305842 - protein, 9 aa, Homo Sapiens
GGQRSERNK

SEQ ID NO: 1305843 - protein, 9 aa, Homo Sapiens
KSKNPNFKV

SEQ ID NO: 1305844 - protein, 9 aa, Homo Sapiens
YLMWFDKTP

SEQ ID NO: 1305845 - protein, 9 aa, Homo Sapiens
DKNICSAGG

SEQ ID NO: 1305846 - protein, 9 aa, Homo Sapiens
KNVTCKNKD

SEQ ID NO: 1305847 - protein, 9 aa, Homo Sapiens
KLSSGNEEH

SEQ ID NO: 1305848 - protein, 9 aa, Homo Sapiens
RVIEEARFA

SEQ ID NO: 1305849 - protein, 9 aa, Homo Sapiens
KELRRTNLE

SEQ ID NO: 1305850 - protein, 9 aa, Homo Sapiens
NPKVIEENN

SEQ ID NO: 1305851 - protein, 9 aa, Homo Sapiens
KLDLSHNQL

SEQ ID NO: 1305852 - protein, 9 aa, Homo Sapiens
KELNAAVRE

SEQ ID NO: 1305853 - protein, 9 aa, Homo Sapiens
EVVSHIRPA

SEQ ID NO: 1305854 - protein, 9 aa, Homo Sapiens
IKNILKPEI

SEQ ID NO: 1305855 - protein, 9 aa, Homo Sapiens
IFLHLPSES

SEQ ID NO: 1305856 - protein, 9 aa, Homo Sapiens
LECRAEAED

SEQ ID NO: 1305857 - protein, 9 aa, Homo Sapiens
DKMAGEGFF

SEQ ID NO: 1305858 - protein, 9 aa, Homo Sapiens
LNMLMAMNI

SEQ ID NO: 1305859 - protein, 9 aa, Homo Sapiens
KVRDAPKKS

SEQ ID NO: 1305860 - protein, 9 aa, Homo Sapiens
KYETINLTE

SEQ ID NO: 1305861 - protein, 9 aa, Homo Sapiens
INQLTELFS

SEQ ID NO: 1305862 - protein, 9 aa, Homo Sapiens
LLVSTDKGN

SEQ ID NO: 1305863 - protein, 9 aa, Homo Sapiens
RVIQNKYAT

SEQ ID NO: 1305864 - protein, 9 aa, Homo Sapiens
SLQAENQST

SEQ ID NO: 1305865 - protein, 9 aa, Homo Sapiens
IFYSLCAHK

SEQ ID NO: 1305866 - protein, 9 aa, Homo Sapiens
CSSKTQKTY

SEQ ID NO: 1305867 - protein, 9 aa, Homo Sapiens
FGQRAKTIN

SEQ ID NO: 1305868 - protein, 9 aa, Homo Sapiens
EHGNRVFFG

SEQ ID NO: 1305869 - protein, 9 aa, Homo Sapiens
DMALGNKKN

SEQ ID NO: 1305870 - protein, 9 aa, Homo Sapiens
VFGGQKPEN

SEQ ID NO: 1305871 - protein, 9 aa, Homo Sapiens
CTCTCQGID

SEQ ID NO: 1305872 - protein, 9 aa, Homo Sapiens
SFKSLQAGL

SEQ ID NO: 1305873 - protein, 9 aa, Homo Sapiens
SGSGGIVPP

SEQ ID NO: 1305874 - protein, 9 aa, Homo Sapiens
EGGLVIAAD

SEQ ID NO: 1305875 - protein, 9 aa, Homo Sapiens
YTTQKLKDT

SEQ ID NO: 1305876 - protein, 9 aa, Homo Sapiens
EGIFQVSGS

SEQ ID NO: 1305877 - protein, 9 aa, Homo Sapiens
VKFEGGLVI

SEQ ID NO: 1305878 - protein, 9 aa, Homo Sapiens
RPTISCIFN

SEQ ID NO: 1305879 - protein, 9 aa, Homo Sapiens
LMCETKLLS

SEQ ID NO: 1305880 - protein, 9 aa, Homo Sapiens
SKLFENKVV

SEQ ID NO: 1305881 - protein, 9 aa, Homo Sapiens
PRVIQNKYA

SEQ ID NO: 1305882 - protein, 9 aa, Homo Sapiens
ATDYGFHFA

SEQ ID NO: 1305883 - protein, 9 aa, Homo Sapiens
LPKDANKSS

SEQ ID NO: 1305884 - protein, 9 aa, Homo Sapiens
ASAYPEAGF

SEQ ID NO: 1305885 - protein, 9 aa, Homo Sapiens
SSQTKVLSS

SEQ ID NO: 1305886 - protein, 9 aa, Homo Sapiens
ERNGQRGFI

SEQ ID NO: 1305887 - protein, 9 aa, Homo Sapiens
KKNKPLKKK

SEQ ID NO: 1305888 - protein, 9 aa, Homo Sapiens
TLSVDWWSF

SEQ ID NO: 1305889 - protein, 9 aa, Homo Sapiens
FEERRSLRI

SEQ ID NO: 1305890 - protein, 9 aa, Homo Sapiens
QNKYATGKP

SEQ ID NO: 1305891 - protein, 9 aa, Homo Sapiens
ALKCLKMVY

SEQ ID NO: 1305892 - protein, 9 aa, Homo Sapiens
FKQECIILG

SEQ ID NO: 1305893 - protein, 9 aa, Homo Sapiens
LKSEDLNIN

SEQ ID NO: 1305894 - protein, 9 aa, Homo Sapiens
GGLAEEVDN

SEQ ID NO: 1305895 - protein, 9 aa, Homo Sapiens
MNGEECVED

SEQ ID NO: 1305896 - protein, 9 aa, Homo Sapiens
IDTINGKLE

SEQ ID NO: 1305897 - protein, 9 aa, Homo Sapiens
MVSKRFCFD

SEQ ID NO: 1305898 - protein, 9 aa, Homo Sapiens
NDTLEHKKK

SEQ ID NO: 1305899 - protein, 9 aa, Homo Sapiens
GIKERQQRI

SEQ ID NO: 1305900 - protein, 9 aa, Homo Sapiens
SFCENNVDY

SEQ ID NO: 1305901 - protein, 9 aa, Homo Sapiens
LHLPLWDAL

SEQ ID NO: 1305902 - protein, 9 aa, Homo Sapiens
PTQLCFISP

SEQ ID NO: 1305903 - protein, 9 aa, Homo Sapiens
EEKVEVEHV

SEQ ID NO: 1305904 - protein, 9 aa, Homo Sapiens
QGSKFRRHV

SEQ ID NO: 1305905 - protein, 9 aa, Homo Sapiens
IANTSVKPS

SEQ ID NO: 1305906 - protein, 9 aa, Homo Sapiens
AIYFLVGSN

SEQ ID NO: 1305907 - protein, 9 aa, Homo Sapiens
ERMHTDERP

SEQ ID NO: 1305908 - protein, 9 aa, Homo Sapiens
KEHLQIHSG

SEQ ID NO: 1305909 - protein, 9 aa, Homo Sapiens
KIFLLVVNA

SEQ ID NO: 1305910 - protein, 9 aa, Homo Sapiens
LIDINDNTP

SEQ ID NO: 1305911 - protein, 9 aa, Homo Sapiens
KEDMSEPQD

SEQ ID NO: 1305912 - protein, 9 aa, Homo Sapiens
HYLVQEACH

SEQ ID NO: 1305913 - protein, 9 aa, Homo Sapiens
DGIGGLVWA

SEQ ID NO: 1305914 - protein, 9 aa, Homo Sapiens
GLGDSDGQH

SEQ ID NO: 1305915 - protein, 9 aa, Homo Sapiens
KFTKLWEFQ

SEQ ID NO: 1305916 - protein, 9 aa, Homo Sapiens
LLAETSETM

SEQ ID NO: 1305917 - protein, 9 aa, Homo Sapiens
PNKPTYCLC

SEQ ID NO: 1305918 - protein, 9 aa, Homo Sapiens
IHMIYFDFW

SEQ ID NO: 1305919 - protein, 9 aa, Homo Sapiens
ANSPLHKEL

SEQ ID NO: 1305920 - protein, 9 aa, Homo Sapiens
TRMIPLDPV

SEQ ID NO: 1305921 - protein, 9 aa, Homo Sapiens
VGWKYQTVT

SEQ ID NO: 1305922 - protein, 9 aa, Homo Sapiens
DGQHNGHIE

SEQ ID NO: 1305923 - protein, 9 aa, Homo Sapiens
NRIFLVSPI

SEQ ID NO: 1305924 - protein, 9 aa, Homo Sapiens
RWPLRLSRR

SEQ ID NO: 1305925 - protein, 9 aa, Homo Sapiens
GLSSESCEQ

SEQ ID NO: 1305926 - protein, 9 aa, Homo Sapiens
DTEINGPDT

SEQ ID NO: 1305927 - protein, 9 aa, Homo Sapiens
VFLQSTFDK

SEQ ID NO: 1305928 - protein, 9 aa, Homo Sapiens
AYVFLQSTF

SEQ ID NO: 1305929 - protein, 9 aa, Homo Sapiens
LLLFSILLF

SEQ ID NO: 1305930 - protein, 9 aa, Homo Sapiens
TEDKYLHEV

SEQ ID NO: 1305931 - protein, 9 aa, Homo Sapiens
TGSQDQEAH

SEQ ID NO: 1305932 - protein, 9 aa, Homo Sapiens
FEKNGQGAS

SEQ ID NO: 1305933 - protein, 9 aa, Homo Sapiens
KHQRIHTGQ

SEQ ID NO: 1305934 - protein, 9 aa, Homo Sapiens
ALDNSRLNE

SEQ ID NO: 1305935 - protein, 9 aa, Homo Sapiens
HKELNAAVR

SEQ ID NO: 1305936 - protein, 9 aa, Homo Sapiens
SEASFTLTV

SEQ ID NO: 1305937 - protein, 9 aa, Homo Sapiens
PVRPSLHLP

SEQ ID NO: 1305938 - protein, 9 aa, Homo Sapiens
LPRRYKLMS

SEQ ID NO: 1305939 - protein, 9 aa, Homo Sapiens
FSERSYLSS

SEQ ID NO: 1305940 - protein, 9 aa, Homo Sapiens
QNVVIQNEI

SEQ ID NO: 1305941 - protein, 9 aa, Homo Sapiens
LENERQVLD

SEQ ID NO: 1305942 - protein, 9 aa, Homo Sapiens
RKLNWKIIL

SEQ ID NO: 1305943 - protein, 9 aa, Homo Sapiens
VLSQNSRDA

SEQ ID NO: 1305944 - protein, 9 aa, Homo Sapiens
KRFCFDDSL

SEQ ID NO: 1305945 - protein, 9 aa, Homo Sapiens
FISYSEHDY

SEQ ID NO: 1305946 - protein, 9 aa, Homo Sapiens
YETRAIYFL

SEQ ID NO: 1305947 - protein, 9 aa, Homo Sapiens
LLMISKLVQ

SEQ ID NO: 1305948 - protein, 9 aa, Homo Sapiens
LSYDQNNGF

SEQ ID NO: 1305949 - protein, 9 aa, Homo Sapiens
EAYKDDLYR

SEQ ID NO: 1305950 - protein, 9 aa, Homo Sapiens
QLPLIVDAI

SEQ ID NO: 1305951 - protein, 9 aa, Homo Sapiens
TDKGNENSK

SEQ ID NO: 1305952 - protein, 9 aa, Homo Sapiens
NTDNERFHM

SEQ ID NO: 1305953 - protein, 9 aa, Homo Sapiens
EVCDDKFIF

SEQ ID NO: 1305954 - protein, 9 aa, Homo Sapiens
KAYTYPENL

SEQ ID NO: 1305955 - protein, 9 aa, Homo Sapiens
LRITERLQA

SEQ ID NO: 1305956 - protein, 9 aa, Homo Sapiens
YESGSSLQA

SEQ ID NO: 1305957 - protein, 9 aa, Homo Sapiens
HIMEKEQAY

SEQ ID NO: 1305958 - protein, 9 aa, Homo Sapiens
FNSPFNGEV

SEQ ID NO: 1305959 - protein, 9 aa, Homo Sapiens
IKEMFQSAG

SEQ ID NO: 1305960 - protein, 9 aa, Homo Sapiens
STKLYRCFK

SEQ ID NO: 1305961 - protein, 9 aa, Homo Sapiens
QFNKKYGVQ

SEQ ID NO: 1305962 - protein, 9 aa, Homo Sapiens
NPSTIFQAS

SEQ ID NO: 1305963 - protein, 9 aa, Homo Sapiens
GGILAVGVF

SEQ ID NO: 1305964 - protein, 9 aa, Homo Sapiens
LHPPSEKGR

SEQ ID NO: 1305965 - protein, 9 aa, Homo Sapiens
YLWVKNELI

SEQ ID NO: 1305966 - protein, 9 aa, Homo Sapiens
GHLNLAGSG

SEQ ID NO: 1305967 - protein, 9 aa, Homo Sapiens
QIGWYNRFA

SEQ ID NO: 1305968 - protein, 9 aa, Homo Sapiens
VLMKQLDTL

SEQ ID NO: 1305969 - protein, 9 aa, Homo Sapiens
IFLLVVNAL

SEQ ID NO: 1305970 - protein, 9 aa, Homo Sapiens
LFHMLRITH

SEQ ID NO: 1305971 - protein, 9 aa, Homo Sapiens
NLSAPEKDK

SEQ ID NO: 1305972 - protein, 9 aa, Homo Sapiens
ENVIILDTA

SEQ ID NO: 1305973 - protein, 9 aa, Homo Sapiens
EIHESKNRA

SEQ ID NO: 1305974 - protein, 9 aa, Homo Sapiens
NSPLHKELN

SEQ ID NO: 1305975 - protein, 9 aa, Homo Sapiens
NHYFCDILP

SEQ ID NO: 1305976 - protein, 9 aa, Homo Sapiens
KVAITICEK

SEQ ID NO: 1305977 - protein, 9 aa, Homo Sapiens
LRVTEPKYQ

SEQ ID NO: 1305978 - protein, 9 aa, Homo Sapiens
HIKNKEVSK

SEQ ID NO: 1305979 - protein, 9 aa, Homo Sapiens
KLNNAYEES

SEQ ID NO: 1305980 - protein, 9 aa, Homo Sapiens
ICIDNKDEC

SEQ ID NO: 1305981 - protein, 9 aa, Homo Sapiens
RKGGETSDM

SEQ ID NO: 1305982 - protein, 9 aa, Homo Sapiens
HKEEDTNSE

SEQ ID NO: 1305983 - protein, 9 aa, Homo Sapiens
ECPMHLEYF

SEQ ID NO: 1305984 - protein, 9 aa, Homo Sapiens
QGYFRMDFS

SEQ ID NO: 1305985 - protein, 9 aa, Homo Sapiens
TLTGFNSPF

SEQ ID NO: 1305986 - protein, 9 aa, Homo Sapiens
AGKYSDAFG

SEQ ID NO: 1305987 - protein, 9 aa, Homo Sapiens
NLRVTEPKY

SEQ ID NO: 1305988 - protein, 9 aa, Homo Sapiens
LLKPSRRSL

SEQ ID NO: 1305989 - protein, 9 aa, Homo Sapiens
MKYKLESCV

SEQ ID NO: 1305990 - protein, 9 aa, Homo Sapiens
LEKIIQTYD

SEQ ID NO: 1305991 - protein, 9 aa, Homo Sapiens
LDLSLFKHR

SEQ ID NO: 1305992 - protein, 9 aa, Homo Sapiens
AHTLILHPP

SEQ ID NO: 1305993 - protein, 9 aa, Homo Sapiens
GTNRIFLVS

SEQ ID NO: 1305994 - protein, 9 aa, Homo Sapiens
LKGIHPDPK

SEQ ID NO: 1305995 - protein, 9 aa, Homo Sapiens
VSHIKNKEV

SEQ ID NO: 1305996 - protein, 9 aa, Homo Sapiens
EDTNSERIT

SEQ ID NO: 1305997 - protein, 9 aa, Homo Sapiens
SLFYDTVLW

SEQ ID NO: 1305998 - protein, 9 aa, Homo Sapiens
FQKKAYTYP

SEQ ID NO: 1305999 - protein, 9 aa, Homo Sapiens
SWYKDDEDK

SEQ ID NO: 1306000 - protein, 9 aa, Homo Sapiens
PDFSDAKDN

SEQ ID NO: 1306001 - protein, 9 aa, Homo Sapiens
LSVDWWSFG

SEQ ID NO: 1306002 - protein, 9 aa, Homo Sapiens
LIVHQIIHT

SEQ ID NO: 1306003 - protein, 9 aa, Homo Sapiens
ALCQTFWQA

SEQ ID NO: 1306004 - protein, 9 aa, Homo Sapiens
AALARSALS

SEQ ID NO: 1306005 - protein, 9 aa, Homo Sapiens
PAPVSKSST

SEQ ID NO: 1306006 - protein, 9 aa, Homo Sapiens
HYEMLANQT

SEQ ID NO: 1306007 - protein, 9 aa, Homo Sapiens
TETSLGIPG

SEQ ID NO: 1306008 - protein, 9 aa, Homo Sapiens
SEAMKYKLE

SEQ ID NO: 1306009 - protein, 9 aa, Homo Sapiens
FKLEKHSAP

SEQ ID NO: 1306010 - protein, 9 aa, Homo Sapiens
MLIALGNTY

SEQ ID NO: 1306011 - protein, 9 aa, Homo Sapiens
SRHNLEKLR

SEQ ID NO: 1306012 - protein, 9 aa, Homo Sapiens
LFCEIDEEA

SEQ ID NO: 1306013 - protein, 9 aa, Homo Sapiens
HYLCKFLGV

SEQ ID NO: 1306014 - protein, 9 aa, Homo Sapiens
INHQLNVVI

SEQ ID NO: 1306015 - protein, 9 aa, Homo Sapiens
KPNKEVKKK

SEQ ID NO: 1306016 - protein, 9 aa, Homo Sapiens
PLPNTIRLR

SEQ ID NO: 1306017 - protein, 9 aa, Homo Sapiens
RETIYYNAS

SEQ ID NO: 1306018 - protein, 9 aa, Homo Sapiens
SLDSTPSRP

SEQ ID NO: 1306019 - protein, 9 aa, Homo Sapiens
TVRNILQSQ

SEQ ID NO: 1306020 - protein, 9 aa, Homo Sapiens
KCACNEQEQ

SEQ ID NO: 1306021 - protein, 9 aa, Homo Sapiens
PTISCIFNY

SEQ ID NO: 1306022 - protein, 9 aa, Homo Sapiens
ADSSNTALI

SEQ ID NO: 1306023 - protein, 9 aa, Homo Sapiens
VALNVVFEQ

SEQ ID NO: 1306024 - protein, 9 aa, Homo Sapiens
SIYHTLGSR

SEQ ID NO: 1306025 - protein, 9 aa, Homo Sapiens
NGFYFEYYE

SEQ ID NO: 1306026 - protein, 9 aa, Homo Sapiens
TPDLETLNL

SEQ ID NO: 1306027 - protein, 9 aa, Homo Sapiens
RQISISERR

SEQ ID NO: 1306028 - protein, 9 aa, Homo Sapiens
VVALIPYSV

SEQ ID NO: 1306029 - protein, 9 aa, Homo Sapiens
DQNNGFYFE

SEQ ID NO: 1306030 - protein, 9 aa, Homo Sapiens
VAAEEEKVL

SEQ ID NO: 1306031 - protein, 9 aa, Homo Sapiens
LNEGKLEAL

SEQ ID NO: 1306032 - protein, 9 aa, Homo Sapiens
NHEEKILNR

SEQ ID NO: 1306033 - protein, 9 aa, Homo Sapiens
DEGSEVERE

SEQ ID NO: 1306034 - protein, 9 aa, Homo Sapiens
RNNITVPFK

SEQ ID NO: 1306035 - protein, 9 aa, Homo Sapiens
GLHSKVLRK

SEQ ID NO: 1306036 - protein, 9 aa, Homo Sapiens
KVLISFLQD

SEQ ID NO: 1306037 - protein, 9 aa, Homo Sapiens
ASLLCNAIT

SEQ ID NO: 1306038 - protein, 9 aa, Homo Sapiens
PDKNICSAG

SEQ ID NO: 1306039 - protein, 9 aa, Homo Sapiens
TDYNNPIDQ

SEQ ID NO: 1306040 - protein, 9 aa, Homo Sapiens
QFSICLRTR

SEQ ID NO: 1306041 - protein, 9 aa, Homo Sapiens
SRANQNINA

SEQ ID NO: 1306042 - protein, 9 aa, Homo Sapiens
SPLHKELNA

SEQ ID NO: 1306043 - protein, 9 aa, Homo Sapiens
ILNYQNKAL

SEQ ID NO: 1306044 - protein, 9 aa, Homo Sapiens
ENYLETLRF

SEQ ID NO: 1306045 - protein, 9 aa, Homo Sapiens
AVPLSIIMI

SEQ ID NO: 1306046 - protein, 9 aa, Homo Sapiens
IYFNAQTTL

SEQ ID NO: 1306047 - protein, 9 aa, Homo Sapiens
DISLGADIC

SEQ ID NO: 1306048 - protein, 9 aa, Homo Sapiens
TGDKPYTCE

SEQ ID NO: 1306049 - protein, 9 aa, Homo Sapiens
SLQINQKEL

SEQ ID NO: 1306050 - protein, 9 aa, Homo Sapiens
NLTLLNSFW

SEQ ID NO: 1306051 - protein, 9 aa, Homo Sapiens
IWLAANNGD

SEQ ID NO: 1306052 - protein, 9 aa, Homo Sapiens
GTINMTLQS

SEQ ID NO: 1306053 - protein, 9 aa, Homo Sapiens
RYDRLSTLE

SEQ ID NO: 1306054 - protein, 9 aa, Homo Sapiens
EMNWFHLND

SEQ ID NO: 1306055 - protein, 9 aa, Homo Sapiens
AECPMHLEY

SEQ ID NO: 1306056 - protein, 9 aa, Homo Sapiens
HTNVSMDYV

SEQ ID NO: 1306057 - protein, 9 aa, Homo Sapiens
LVSYLKIWG

SEQ ID NO: 1306058 - protein, 9 aa, Homo Sapiens
TKSQIIAVI

SEQ ID NO: 1306059 - protein, 9 aa, Homo Sapiens
SAVKLCWML

SEQ ID NO: 1306060 - protein, 9 aa, Homo Sapiens
TLILCVWFG

SEQ ID NO: 1306061 - protein, 9 aa, Homo Sapiens
SPPIKHPWR

SEQ ID NO: 1306062 - protein, 9 aa, Homo Sapiens
QYLQSLLAE

SEQ ID NO: 1306063 - protein, 9 aa, Homo Sapiens
ENKLIQSEE

SEQ ID NO: 1306064 - protein, 9 aa, Homo Sapiens
AGIITTKGL

SEQ ID NO: 1306065 - protein, 9 aa, Homo Sapiens
PVSRGGIGL

SEQ ID NO: 1306066 - protein, 9 aa, Homo Sapiens
PSQTPDKET

SEQ ID NO: 1306067 - protein, 9 aa, Homo Sapiens
FPSEICRHK

SEQ ID NO: 1306068 - protein, 9 aa, Homo Sapiens
LFYDTVLWR

SEQ ID NO: 1306069 - protein, 9 aa, Homo Sapiens
KMSDNIPNE

SEQ ID NO: 1306070 - protein, 9 aa, Homo Sapiens
DMKVLEKKR

SEQ ID NO: 1306071 - protein, 9 aa, Homo Sapiens
VQRRGSRWW

SEQ ID NO: 1306072 - protein, 9 aa, Homo Sapiens
CPPFVSCIQ

SEQ ID NO: 1306073 - protein, 9 aa, Homo Sapiens
YEKKPNKEV

SEQ ID NO: 1306074 - protein, 9 aa, Homo Sapiens
RSDNYSLTD

SEQ ID NO: 1306075 - protein, 9 aa, Homo Sapiens
ELRRTNLET

SEQ ID NO: 1306076 - protein, 9 aa, Homo Sapiens
WLCVQLVVI

SEQ ID NO: 1306077 - protein, 9 aa, Homo Sapiens
NTCLVTAAH

SEQ ID NO: 1306078 - protein, 9 aa, Homo Sapiens
CLEFEGLKP

SEQ ID NO: 1306079 - protein, 9 aa, Homo Sapiens
GIGLLDISL

SEQ ID NO: 1306080 - protein, 9 aa, Homo Sapiens
YGKSFNKIS

SEQ ID NO: 1306081 - protein, 9 aa, Homo Sapiens
WFMGDQSKP

SEQ ID NO: 1306082 - protein, 9 aa, Homo Sapiens
NKRTIGWMK

SEQ ID NO: 1306083 - protein, 9 aa, Homo Sapiens
RAKGTTWFE

SEQ ID NO: 1306084 - protein, 9 aa, Homo Sapiens
QFTSRKPIT

SEQ ID NO: 1306085 - protein, 9 aa, Homo Sapiens
HECWRKEIH

SEQ ID NO: 1306086 - protein, 9 aa, Homo Sapiens
ALVMYLWLQ

SEQ ID NO: 1306087 - protein, 9 aa, Homo Sapiens
RQTQEQQTQ

SEQ ID NO: 1306088 - protein, 9 aa, Homo Sapiens
LEDKVIKLH

SEQ ID NO: 1306089 - protein, 9 aa, Homo Sapiens
MLYNRQQHY

SEQ ID NO: 1306090 - protein, 9 aa, Homo Sapiens
TVAAEEEKV

SEQ ID NO: 1306091 - protein, 9 aa, Homo Sapiens
RPPQEEHLE

SEQ ID NO: 1306092 - protein, 9 aa, Homo Sapiens
HLSYTKIFD

SEQ ID NO: 1306093 - protein, 9 aa, Homo Sapiens
LAGCTFQYI

SEQ ID NO: 1306094 - protein, 9 aa, Homo Sapiens
STIFQASAP

SEQ ID NO: 1306095 - protein, 9 aa, Homo Sapiens
LITERDNVF

SEQ ID NO: 1306096 - protein, 9 aa, Homo Sapiens
IITTKGLVR

SEQ ID NO: 1306097 - protein, 9 aa, Homo Sapiens
AKGTTWFEA

SEQ ID NO: 1306098 - protein, 9 aa, Homo Sapiens
FIELQDKLH

SEQ ID NO: 1306099 - protein, 9 aa, Homo Sapiens
EACNLMQSS

SEQ ID NO: 1306100 - protein, 9 aa, Homo Sapiens
WKYQTVTAT

SEQ ID NO: 1306101 - protein, 9 aa, Homo Sapiens
NQDDAALEH

SEQ ID NO: 1306102 - protein, 9 aa, Homo Sapiens
SCLSKAAGQ

SEQ ID NO: 1306103 - protein, 9 aa, Homo Sapiens
RQGSKFRRH

SEQ ID NO: 1306104 - protein, 9 aa, Homo Sapiens
EFTMLLGVL

SEQ ID NO: 1306105 - protein, 9 aa, Homo Sapiens
IEERLLMYY

SEQ ID NO: 1306106 - protein, 9 aa, Homo Sapiens
AIYIPFPEY

SEQ ID NO: 1306107 - protein, 9 aa, Homo Sapiens
EAIAFPSAK

SEQ ID NO: 1306108 - protein, 9 aa, Homo Sapiens
YFRRRTHLN

SEQ ID NO: 1306109 - protein, 9 aa, Homo Sapiens
KNASTANKC

SEQ ID NO: 1306110 - protein, 9 aa, Homo Sapiens
HTTIATQTG

SEQ ID NO: 1306111 - protein, 9 aa, Homo Sapiens
PQPDFVPFP

SEQ ID NO: 1306112 - protein, 9 aa, Homo Sapiens
VEFSATCLN

SEQ ID NO: 1306113 - protein, 9 aa, Homo Sapiens
PTPDLETLN

SEQ ID NO: 1306114 - protein, 9 aa, Homo Sapiens
RFNTNTRVL

SEQ ID NO: 1306115 - protein, 9 aa, Homo Sapiens
RMSSDANEF

SEQ ID NO: 1306116 - protein, 9 aa, Homo Sapiens
QRRNVKQII

SEQ ID NO: 1306117 - protein, 9 aa, Homo Sapiens
MGNVESYLK

SEQ ID NO: 1306118 - protein, 9 aa, Homo Sapiens
SQDQEAHRT

SEQ ID NO: 1306119 - protein, 9 aa, Homo Sapiens
FNKFCRFVL

SEQ ID NO: 1306120 - protein, 9 aa, Homo Sapiens
MDRPSRQIS

SEQ ID NO: 1306121 - protein, 9 aa, Homo Sapiens
NSTFSSDNT

SEQ ID NO: 1306122 - protein, 9 aa, Homo Sapiens
LYLHRVGRG

SEQ ID NO: 1306123 - protein, 9 aa, Homo Sapiens
ELEEMEIHI

SEQ ID NO: 1306124 - protein, 9 aa, Homo Sapiens
LLIHERMHT

SEQ ID NO: 1306125 - protein, 9 aa, Homo Sapiens
PNINTQMFQ

SEQ ID NO: 1306126 - protein, 9 aa, Homo Sapiens
GQITEDEEA

SEQ ID NO: 1306127 - protein, 9 aa, Homo Sapiens
EEKDKALGQ

SEQ ID NO: 1306128 - protein, 9 aa, Homo Sapiens
RDYLLKVLP

SEQ ID NO: 1306129 - protein, 9 aa, Homo Sapiens
DTKKNICRK

SEQ ID NO: 1306130 - protein, 9 aa, Homo Sapiens
LLEVVVLSQ

SEQ ID NO: 1306131 - protein, 9 aa, Homo Sapiens
VAPCTDLFS

SEQ ID NO: 1306132 - protein, 9 aa, Homo Sapiens
SSLGIHQII

SEQ ID NO: 1306133 - protein, 9 aa, Homo Sapiens
DKCRMATEQ

SEQ ID NO: 1306134 - protein, 9 aa, Homo Sapiens
NKDILMAAG

SEQ ID NO: 1306135 - protein, 9 aa, Homo Sapiens
KKDDGCKTY

SEQ ID NO: 1306136 - protein, 9 aa, Homo Sapiens
NGEECVEDL

SEQ ID NO: 1306137 - protein, 9 aa, Homo Sapiens
HPISQVVCW

SEQ ID NO: 1306138 - protein, 9 aa, Homo Sapiens
TNYDNNRLC

SEQ ID NO: 1306139 - protein, 9 aa, Homo Sapiens
MSKDFSPLA

SEQ ID NO: 1306140 - protein, 9 aa, Homo Sapiens
LNFILCFSF

SEQ ID NO: 1306141 - protein, 9 aa, Homo Sapiens
SQNKIKQVK

SEQ ID NO: 1306142 - protein, 9 aa, Homo Sapiens
KKIKDKYID

SEQ ID NO: 1306143 - protein, 9 aa, Homo Sapiens
PSDMVCLRT

SEQ ID NO: 1306144 - protein, 9 aa, Homo Sapiens
IEDFNKFCR

SEQ ID NO: 1306145 - protein, 9 aa, Homo Sapiens
LLTSSKAHL

SEQ ID NO: 1306146 - protein, 9 aa, Homo Sapiens
NHEIREIQR

SEQ ID NO: 1306147 - protein, 9 aa, Homo Sapiens
DLLKVKMHT

SEQ ID NO: 1306148 - protein, 9 aa, Homo Sapiens
FHVPLVDVN

SEQ ID NO: 1306149 - protein, 9 aa, Homo Sapiens
WKKNHKLEY

SEQ ID NO: 1306150 - protein, 9 aa, Homo Sapiens
YLAPRAVLT

SEQ ID NO: 1306151 - protein, 9 aa, Homo Sapiens
PQIEHALGG

SEQ ID NO: 1306152 - protein, 9 aa, Homo Sapiens
LTKNNRPHA

SEQ ID NO: 1306153 - protein, 9 aa, Homo Sapiens
DIDNIAQEV

SEQ ID NO: 1306154 - protein, 9 aa, Homo Sapiens
TLDKFTIIQ

SEQ ID NO: 1306155 - protein, 9 aa, Homo Sapiens
LLLTSSKAH

SEQ ID NO: 1306156 - protein, 9 aa, Homo Sapiens
RTEYAENAN

SEQ ID NO: 1306157 - protein, 9 aa, Homo Sapiens
GDGPGLGEW

SEQ ID NO: 1306158 - protein, 9 aa, Homo Sapiens
QKSCFKSII

SEQ ID NO: 1306159 - protein, 9 aa, Homo Sapiens
MYKNKGIQE

SEQ ID NO: 1306160 - protein, 9 aa, Homo Sapiens
NPLDPSLFI

SEQ ID NO: 1306161 - protein, 9 aa, Homo Sapiens
VTEAMLYKK

SEQ ID NO: 1306162 - protein, 9 aa, Homo Sapiens
YERDFLQYL

SEQ ID NO: 1306163 - protein, 9 aa, Homo Sapiens
PPLLAVLNN

SEQ ID NO: 1306164 - protein, 9 aa, Homo Sapiens
KAGTFQVRT

SEQ ID NO: 1306165 - protein, 9 aa, Homo Sapiens
ITTSYMTIA

SEQ ID NO: 1306166 - protein, 9 aa, Homo Sapiens
HKHEGFERD

SEQ ID NO: 1306167 - protein, 9 aa, Homo Sapiens
KALSKVQGW

SEQ ID NO: 1306168 - protein, 9 aa, Homo Sapiens
NIYSNCLPK

SEQ ID NO: 1306169 - protein, 9 aa, Homo Sapiens
FIADDPQDK

SEQ ID NO: 1306170 - protein, 9 aa, Homo Sapiens
KAFTQKSNI

SEQ ID NO: 1306171 - protein, 9 aa, Homo Sapiens
FEEKVEVEH

SEQ ID NO: 1306172 - protein, 9 aa, Homo Sapiens
IDNISDGIG

SEQ ID NO: 1306173 - protein, 9 aa, Homo Sapiens
EDSYGTMVS

SEQ ID NO: 1306174 - protein, 9 aa, Homo Sapiens
LDGHLNLAG

SEQ ID NO: 1306175 - protein, 9 aa, Homo Sapiens
EILGFDMYS

SEQ ID NO: 1306176 - protein, 9 aa, Homo Sapiens
EVNETLRPG

SEQ ID NO: 1306177 - protein, 9 aa, Homo Sapiens
PHNPESLSV

SEQ ID NO: 1306178 - protein, 9 aa, Homo Sapiens
ETCDYFDKL

SEQ ID NO: 1306179 - protein, 9 aa, Homo Sapiens
LSFLLFWTL

SEQ ID NO: 1306180 - protein, 9 aa, Homo Sapiens
EEIRKKYEE

SEQ ID NO: 1306181 - protein, 9 aa, Homo Sapiens
MKHPQEIKT

SEQ ID NO: 1306182 - protein, 9 aa, Homo Sapiens
SAKFSGLIS

SEQ ID NO: 1306183 - protein, 9 aa, Homo Sapiens
YPRLSLSFW

SEQ ID NO: 1306184 - protein, 9 aa, Homo Sapiens
RSDQAEVVR

SEQ ID NO: 1306185 - protein, 9 aa, Homo Sapiens
KVNFEDDYR

SEQ ID NO: 1306186 - protein, 9 aa, Homo Sapiens
LTSHKIIHT

SEQ ID NO: 1306187 - protein, 9 aa, Homo Sapiens
MLGSVLRYP

SEQ ID NO: 1306188 - protein, 9 aa, Homo Sapiens
EENGKYQLA

SEQ ID NO: 1306189 - protein, 9 aa, Homo Sapiens
IINSMWKQQ

SEQ ID NO: 1306190 - protein, 9 aa, Homo Sapiens
ATGNNLSEA

SEQ ID NO: 1306191 - protein, 9 aa, Homo Sapiens
ENICSCNEI

SEQ ID NO: 1306192 - protein, 9 aa, Homo Sapiens
HFQLWLYQN

SEQ ID NO: 1306193 - protein, 9 aa, Homo Sapiens
SVEIMVPNY

SEQ ID NO: 1306194 - protein, 9 aa, Homo Sapiens
INAVHSHYT

SEQ ID NO: 1306195 - protein, 9 aa, Homo Sapiens
NNEAFSGIQ

SEQ ID NO: 1306196 - protein, 9 aa, Homo Sapiens
LNTCILSKM

SEQ ID NO: 1306197 - protein, 9 aa, Homo Sapiens
IYYNASLLI

SEQ ID NO: 1306198 - protein, 9 aa, Homo Sapiens
RSVSEMKSS

SEQ ID NO: 1306199 - protein, 9 aa, Homo Sapiens
YAGKYSDAF

SEQ ID NO: 1306200 - protein, 9 aa, Homo Sapiens
GAKSQFSIC

SEQ ID NO: 1306201 - protein, 9 aa, Homo Sapiens
LVLSYFWYM

SEQ ID NO: 1306202 - protein, 9 aa, Homo Sapiens
AHNRHKLIE

SEQ ID NO: 1306203 - protein, 9 aa, Homo Sapiens
YTTSKKDTG

SEQ ID NO: 1306204 - protein, 9 aa, Homo Sapiens
IQEKLLLKT

SEQ ID NO: 1306205 - protein, 9 aa, Homo Sapiens
TVTATLEEK

SEQ ID NO: 1306206 - protein, 9 aa, Homo Sapiens
QIEFINEKG

SEQ ID NO: 1306207 - protein, 9 aa, Homo Sapiens
LHIILWIGE

SEQ ID NO: 1306208 - protein, 9 aa, Homo Sapiens
NNMNSTLNF

SEQ ID NO: 1306209 - protein, 9 aa, Homo Sapiens
LLLLVQCHP

SEQ ID NO: 1306210 - protein, 9 aa, Homo Sapiens
RVVEEAQKH

SEQ ID NO: 1306211 - protein, 9 aa, Homo Sapiens
VIFSQYNPG

SEQ ID NO: 1306212 - protein, 9 aa, Homo Sapiens
PSNQKIVFQ

SEQ ID NO: 1306213 - protein, 9 aa, Homo Sapiens
ETTQNFIFF

SEQ ID NO: 1306214 - protein, 9 aa, Homo Sapiens
CTSLNESIT

SEQ ID NO: 1306215 - protein, 9 aa, Homo Sapiens
RKKLRFHPW

SEQ ID NO: 1306216 - protein, 9 aa, Homo Sapiens
IQVGFITYN

SEQ ID NO: 1306217 - protein, 9 aa, Homo Sapiens
PGTLKIIPS

SEQ ID NO: 1306218 - protein, 9 aa, Homo Sapiens
ETVIFLHLP

SEQ ID NO: 1306219 - protein, 9 aa, Homo Sapiens
IIAVIRELK

SEQ ID NO: 1306220 - protein, 9 aa, Homo Sapiens
IYSNCLPKS

SEQ ID NO: 1306221 - protein, 9 aa, Homo Sapiens
IEDLWKRWN

SEQ ID NO: 1306222 - protein, 9 aa, Homo Sapiens
VCSTFVQDF

SEQ ID NO: 1306223 - protein, 9 aa, Homo Sapiens
HDYIEIWNG

SEQ ID NO: 1306224 - protein, 9 aa, Homo Sapiens
LIKYTPQHM

SEQ ID NO: 1306225 - protein, 9 aa, Homo Sapiens
SYVDYLSSS

SEQ ID NO: 1306226 - protein, 9 aa, Homo Sapiens
GLKSQGCLS

SEQ ID NO: 1306227 - protein, 9 aa, Homo Sapiens
AFSFPSEIC

SEQ ID NO: 1306228 - protein, 9 aa, Homo Sapiens
TATIMVHSP

SEQ ID NO: 1306229 - protein, 9 aa, Homo Sapiens
FPANIDICD

SEQ ID NO: 1306230 - protein, 9 aa, Homo Sapiens
LDRYYTALY

SEQ ID NO: 1306231 - protein, 9 aa, Homo Sapiens
KYFRKKARQ

SEQ ID NO: 1306232 - protein, 9 aa, Homo Sapiens
VMGRVIEEA

SEQ ID NO: 1306233 - protein, 9 aa, Homo Sapiens
AKEDKVEEG

SEQ ID NO: 1306234 - protein, 9 aa, Homo Sapiens
RVNGKTQVE

SEQ ID NO: 1306235 - protein, 9 aa, Homo Sapiens
YKALSKVQG

SEQ ID NO: 1306236 - protein, 9 aa, Homo Sapiens
CQIIELLNA

SEQ ID NO: 1306237 - protein, 9 aa, Homo Sapiens
GLIQHQIIH

SEQ ID NO: 1306238 - protein, 9 aa, Homo Sapiens
KPTNYDNNR

SEQ ID NO: 1306239 - protein, 9 aa, Homo Sapiens
LIEDLWKEL

SEQ ID NO: 1306240 - protein, 9 aa, Homo Sapiens
SLEKMGYNV

SEQ ID NO: 1306241 - protein, 9 aa, Homo Sapiens
AELRQLTLP

SEQ ID NO: 1306242 - protein, 9 aa, Homo Sapiens
FEIIDQYLS

SEQ ID NO: 1306243 - protein, 9 aa, Homo Sapiens
SHLSYTKIF

SEQ ID NO: 1306244 - protein, 9 aa, Homo Sapiens
DLFSRSGIS

SEQ ID NO: 1306245 - protein, 9 aa, Homo Sapiens
LIKINYSWD

SEQ ID NO: 1306246 - protein, 9 aa, Homo Sapiens
DENDLRSTP

SEQ ID NO: 1306247 - protein, 9 aa, Homo Sapiens
TIVVPLLNH

SEQ ID NO: 1306248 - protein, 9 aa, Homo Sapiens
NKLCELLAL

SEQ ID NO: 1306249 - protein, 9 aa, Homo Sapiens
CPIQHEIIN

SEQ ID NO: 1306250 - protein, 9 aa, Homo Sapiens
AEACNLMQS

SEQ ID NO: 1306251 - protein, 9 aa, Homo Sapiens
LLLCFPPTK

SEQ ID NO: 1306252 - protein, 9 aa, Homo Sapiens
FVNSLCKGY

SEQ ID NO: 1306253 - protein, 9 aa, Homo Sapiens
ALELMVLYV

SEQ ID NO: 1306254 - protein, 9 aa, Homo Sapiens
YKDGTELAL

SEQ ID NO: 1306255 - protein, 9 aa, Homo Sapiens
MRGSSREGV

SEQ ID NO: 1306256 - protein, 9 aa, Homo Sapiens
TKETLLKPS

SEQ ID NO: 1306257 - protein, 9 aa, Homo Sapiens
LILSSNIIS

SEQ ID NO: 1306258 - protein, 9 aa, Homo Sapiens
VGFPDSLKA

SEQ ID NO: 1306259 - protein, 9 aa, Homo Sapiens
SLCKGYYEY

SEQ ID NO: 1306260 - protein, 9 aa, Homo Sapiens
SFLYGKDYS

SEQ ID NO: 1306261 - protein, 9 aa, Homo Sapiens
RITNSQNKI

SEQ ID NO: 1306262 - protein, 9 aa, Homo Sapiens
GQRGFIPGS

SEQ ID NO: 1306263 - protein, 9 aa, Homo Sapiens
NDELKKKKN

SEQ ID NO: 1306264 - protein, 9 aa, Homo Sapiens
YDYGKSFNK

SEQ ID NO: 1306265 - protein, 9 aa, Homo Sapiens
VWSGTIVRS

SEQ ID NO: 1306266 - protein, 9 aa, Homo Sapiens
TVHQIIHTG

SEQ ID NO: 1306267 - protein, 9 aa, Homo Sapiens
ELIEDLWKE

SEQ ID NO: 1306268 - protein, 9 aa, Homo Sapiens
QLEEKETLL

SEQ ID NO: 1306269 - protein, 9 aa, Homo Sapiens
FDLINYFAI

SEQ ID NO: 1306270 - protein, 9 aa, Homo Sapiens
QQHPISQVV

SEQ ID NO: 1306271 - protein, 9 aa, Homo Sapiens
FSAAGSSAP

SEQ ID NO: 1306272 - protein, 9 aa, Homo Sapiens
LTSLAVGDT

SEQ ID NO: 1306273 - protein, 9 aa, Homo Sapiens
IYWGQVKLI

SEQ ID NO: 1306274 - protein, 9 aa, Homo Sapiens
REEQNVVIQ

SEQ ID NO: 1306275 - protein, 9 aa, Homo Sapiens
CLLLELEDK

SEQ ID NO: 1306276 - protein, 9 aa, Homo Sapiens
LANQTAANG

SEQ ID NO: 1306277 - protein, 9 aa, Homo Sapiens
DSFIELQDK

SEQ ID NO: 1306278 - protein, 9 aa, Homo Sapiens
ELIYREQKG

SEQ ID NO: 1306279 - protein, 9 aa, Homo Sapiens
ILVNQPGSD

SEQ ID NO: 1306280 - protein, 9 aa, Homo Sapiens
MQWPDMGVP

SEQ ID NO: 1306281 - protein, 9 aa, Homo Sapiens
VIEKTETSL

SEQ ID NO: 1306282 - protein, 9 aa, Homo Sapiens
SSRSPPDKP

SEQ ID NO: 1306283 - protein, 9 aa, Homo Sapiens
INIGLTKLN

SEQ ID NO: 1306284 - protein, 9 aa, Homo Sapiens
DESISEQLY

SEQ ID NO: 1306285 - protein, 9 aa, Homo Sapiens
ADLPIDPNK

SEQ ID NO: 1306286 - protein, 9 aa, Homo Sapiens
SENNNNSLE

SEQ ID NO: 1306287 - protein, 9 aa, Homo Sapiens
YFNAQTTLK

SEQ ID NO: 1306288 - protein, 9 aa, Homo Sapiens
VPLSIIMIS

SEQ ID NO: 1306289 - protein, 9 aa, Homo Sapiens
LVEKKHSSC

SEQ ID NO: 1306290 - protein, 9 aa, Homo Sapiens
DKRVTLLTP

SEQ ID NO: 1306291 - protein, 9 aa, Homo Sapiens
TTQNFIFFL

SEQ ID NO: 1306292 - protein, 9 aa, Homo Sapiens
GIGGLRPAP

SEQ ID NO: 1306293 - protein, 9 aa, Homo Sapiens
VTEPKYQCL

SEQ ID NO: 1306294 - protein, 9 aa, Homo Sapiens
LLNTVVLAM

SEQ ID NO: 1306295 - protein, 9 aa, Homo Sapiens
LQHKHEGFE

SEQ ID NO: 1306296 - protein, 9 aa, Homo Sapiens
CGESSEELS

SEQ ID NO: 1306297 - protein, 9 aa, Homo Sapiens
HNWDTGRER

SEQ ID NO: 1306298 - protein, 9 aa, Homo Sapiens
FVLPWYRSV

SEQ ID NO: 1306299 - protein, 9 aa, Homo Sapiens
LPIPLLVWV

SEQ ID NO: 1306300 - protein, 9 aa, Homo Sapiens
SKEVCSTFV

SEQ ID NO: 1306301 - protein, 9 aa, Homo Sapiens
NIKDDTILK

SEQ ID NO: 1306302 - protein, 9 aa, Homo Sapiens
QKHIGSINP

SEQ ID NO: 1306303 - protein, 9 aa, Homo Sapiens
SLGLHSKVL

SEQ ID NO: 1306304 - protein, 9 aa, Homo Sapiens
ERSYLSSFQ

SEQ ID NO: 1306305 - protein, 9 aa, Homo Sapiens
NALGCKLVL

SEQ ID NO: 1306306 - protein, 9 aa, Homo Sapiens
KHQSQLREN

SEQ ID NO: 1306307 - protein, 9 aa, Homo Sapiens
VYDALNMLM

SEQ ID NO: 1306308 - protein, 9 aa, Homo Sapiens
SSDESGYLT

SEQ ID NO: 1306309 - protein, 9 aa, Homo Sapiens
EYTQRSYSW

SEQ ID NO: 1306310 - protein, 9 aa, Homo Sapiens
TPFKKGHTI

SEQ ID NO: 1306311 - protein, 9 aa, Homo Sapiens
VPGNNSNVT

SEQ ID NO: 1306312 - protein, 9 aa, Homo Sapiens
NNAVEIINS

SEQ ID NO: 1306313 - protein, 9 aa, Homo Sapiens
KIIHSGKNP

SEQ ID NO: 1306314 - protein, 9 aa, Homo Sapiens
FSYHIFSNM

SEQ ID NO: 1306315 - protein, 9 aa, Homo Sapiens
TITDAPGHR

SEQ ID NO: 1306316 - protein, 9 aa, Homo Sapiens
RSDQLEELD

SEQ ID NO: 1306317 - protein, 9 aa, Homo Sapiens
LKKRNFDLE

SEQ ID NO: 1306318 - protein, 9 aa, Homo Sapiens
HQLYILHRK

SEQ ID NO: 1306319 - protein, 9 aa, Homo Sapiens
RNQLSVKCW

SEQ ID NO: 1306320 - protein, 9 aa, Homo Sapiens
RYDRFIEYG

SEQ ID NO: 1306321 - protein, 9 aa, Homo Sapiens
EWAGFFKQN

SEQ ID NO: 1306322 - protein, 9 aa, Homo Sapiens
LLVQCHPNT

SEQ ID NO: 1306323 - protein, 9 aa, Homo Sapiens
PYECSDRDK

SEQ ID NO: 1306324 - protein, 9 aa, Homo Sapiens
KLWNEDFQY

SEQ ID NO: 1306325 - protein, 9 aa, Homo Sapiens
PPGKHLVTK

SEQ ID NO: 1306326 - protein, 9 aa, Homo Sapiens
KLICDASSL

SEQ ID NO: 1306327 - protein, 9 aa, Homo Sapiens
FTKMGITQL

SEQ ID NO: 1306328 - protein, 9 aa, Homo Sapiens
TKMGITQLR

SEQ ID NO: 1306329 - protein, 9 aa, Homo Sapiens
GRIYGTIKE

SEQ ID NO: 1306330 - protein, 9 aa, Homo Sapiens
FRWTTSEGE

SEQ ID NO: 1306331 - protein, 9 aa, Homo Sapiens
WLLLCFPPT

SEQ ID NO: 1306332 - protein, 9 aa, Homo Sapiens
EFFTKMGIT

SEQ ID NO: 1306333 - protein, 9 aa, Homo Sapiens
RPWDFREFE

SEQ ID NO: 1306334 - protein, 9 aa, Homo Sapiens
RIPSDMVCL

SEQ ID NO: 1306335 - protein, 9 aa, Homo Sapiens
LECMRALDE

SEQ ID NO: 1306336 - protein, 9 aa, Homo Sapiens
AALQSMQTS

SEQ ID NO: 1306337 - protein, 9 aa, Homo Sapiens
IFITYGLFC

SEQ ID NO: 1306338 - protein, 9 aa, Homo Sapiens
QETNWRDYL

SEQ ID NO: 1306339 - protein, 9 aa, Homo Sapiens
ATTPHYVCC

SEQ ID NO: 1306340 - protein, 9 aa, Homo Sapiens
TPRVVEEAQ

SEQ ID NO: 1306341 - protein, 9 aa, Homo Sapiens
EHTDTEING

SEQ ID NO: 1306342 - protein, 9 aa, Homo Sapiens
AVAFITQDY

SEQ ID NO: 1306343 - protein, 9 aa, Homo Sapiens
ILEKLLNIS

SEQ ID NO: 1306344 - protein, 9 aa, Homo Sapiens
FEEVIQEKL

SEQ ID NO: 1306345 - protein, 9 aa, Homo Sapiens
FIRVRKEVL

SEQ ID NO: 1306346 - protein, 9 aa, Homo Sapiens
QGVFRSISL

SEQ ID NO: 1306347 - protein, 9 aa, Homo Sapiens
TTSEIIIAY

SEQ ID NO: 1306348 - protein, 9 aa, Homo Sapiens
YRETFNQTV

SEQ ID NO: 1306349 - protein, 9 aa, Homo Sapiens
MAQYLENIV

SEQ ID NO: 1306350 - protein, 9 aa, Homo Sapiens
QNNGFYFEY

SEQ ID NO: 1306351 - protein, 9 aa, Homo Sapiens
VGNEAGDGP

SEQ ID NO: 1306352 - protein, 9 aa, Homo Sapiens
KDDKGKRKQ

SEQ ID NO: 1306353 - protein, 9 aa, Homo Sapiens
MDPNKISED

SEQ ID NO: 1306354 - protein, 9 aa, Homo Sapiens
IKKDKKAKA

SEQ ID NO: 1306355 - protein, 9 aa, Homo Sapiens
QNRKRDPIS

SEQ ID NO: 1306356 - protein, 9 aa, Homo Sapiens
QPKTLDKFT

SEQ ID NO: 1306357 - protein, 9 aa, Homo Sapiens
KILNYQNKA

SEQ ID NO: 1306358 - protein, 9 aa, Homo Sapiens
SDESISEQL

SEQ ID NO: 1306359 - protein, 9 aa, Homo Sapiens
ELNAAVREA

SEQ ID NO: 1306360 - protein, 9 aa, Homo Sapiens
NQLTELFSY

SEQ ID NO: 1306361 - protein, 9 aa, Homo Sapiens
NYVFKEINT

SEQ ID NO: 1306362 - protein, 9 aa, Homo Sapiens
DQSELKHHQ

SEQ ID NO: 1306363 - protein, 9 aa, Homo Sapiens
FYTTQKLKD

SEQ ID NO: 1306364 - protein, 9 aa, Homo Sapiens
VGTINMTLQ

SEQ ID NO: 1306365 - protein, 9 aa, Homo Sapiens
AITLNLVPS

SEQ ID NO: 1306366 - protein, 9 aa, Homo Sapiens
VVSIHQYPK

SEQ ID NO: 1306367 - protein, 9 aa, Homo Sapiens
TINKSTSSA

SEQ ID NO: 1306368 - protein, 9 aa, Homo Sapiens
PYGVASVSF

SEQ ID NO: 1306369 - protein, 9 aa, Homo Sapiens
AFITQDYLQ

SEQ ID NO: 1306370 - protein, 9 aa, Homo Sapiens
RNLKTPTER

SEQ ID NO: 1306371 - protein, 9 aa, Homo Sapiens
GPGSGAPLL

SEQ ID NO: 1306372 - protein, 9 aa, Homo Sapiens
PGNNSNVTS

SEQ ID NO: 1306373 - protein, 9 aa, Homo Sapiens
EKLLNISLE

SEQ ID NO: 1306374 - protein, 9 aa, Homo Sapiens
KIVLYPNAG

SEQ ID NO: 1306375 - protein, 9 aa, Homo Sapiens
KKKLLKMIT

SEQ ID NO: 1306376 - protein, 9 aa, Homo Sapiens
YFSAVKLCW

SEQ ID NO: 1306377 - protein, 9 aa, Homo Sapiens
GKQCCNSCT

SEQ ID NO: 1306378 - protein, 9 aa, Homo Sapiens
YRTPLYYLR

SEQ ID NO: 1306379 - protein, 9 aa, Homo Sapiens
LVWVKRKEV

SEQ ID NO: 1306380 - protein, 9 aa, Homo Sapiens
RGFIPGSYL

SEQ ID NO: 1306381 - protein, 9 aa, Homo Sapiens
CQPTPDLET

SEQ ID NO: 1306382 - protein, 9 aa, Homo Sapiens
AYSNKLSHL

SEQ ID NO: 1306383 - protein, 9 aa, Homo Sapiens
SKLKDEAEK

SEQ ID NO: 1306384 - protein, 9 aa, Homo Sapiens
YLSPQIEHA

SEQ ID NO: 1306385 - protein, 9 aa, Homo Sapiens
EECDEAFSL

SEQ ID NO: 1306386 - protein, 9 aa, Homo Sapiens
LVKIMKDIQ

SEQ ID NO: 1306387 - protein, 9 aa, Homo Sapiens
AQKHFDCPV

SEQ ID NO: 1306388 - protein, 9 aa, Homo Sapiens
SAKQRYKNQ

SEQ ID NO: 1306389 - protein, 9 aa, Homo Sapiens
DEDDKLKTL

SEQ ID NO: 1306390 - protein, 9 aa, Homo Sapiens
FVGGSAGNY

SEQ ID NO: 1306391 - protein, 9 aa, Homo Sapiens
LPPAKGSIP

SEQ ID NO: 1306392 - protein, 9 aa, Homo Sapiens
LLDTKDLLY

SEQ ID NO: 1306393 - protein, 9 aa, Homo Sapiens
RNAFRIRYF

SEQ ID NO: 1306394 - protein, 9 aa, Homo Sapiens
ERAALIAYL

SEQ ID NO: 1306395 - protein, 9 aa, Homo Sapiens
VPIFIHCSA

SEQ ID NO: 1306396 - protein, 9 aa, Homo Sapiens
IPALELMVL

SEQ ID NO: 1306397 - protein, 9 aa, Homo Sapiens
HTSKSDVWS

SEQ ID NO: 1306398 - protein, 9 aa, Homo Sapiens
AVGDTISLL

SEQ ID NO: 1306399 - protein, 9 aa, Homo Sapiens
VRKMQLNMQ

SEQ ID NO: 1306400 - protein, 9 aa, Homo Sapiens
QDQEAHRTV

SEQ ID NO: 1306401 - protein, 9 aa, Homo Sapiens
NYAATSIYM

SEQ ID NO: 1306402 - protein, 9 aa, Homo Sapiens
LIDEKVIIL

SEQ ID NO: 1306403 - protein, 9 aa, Homo Sapiens
NNKNMGQEV

SEQ ID NO: 1306404 - protein, 9 aa, Homo Sapiens
VYKKACSSA

SEQ ID NO: 1306405 - protein, 9 aa, Homo Sapiens
EILNQSKNC

SEQ ID NO: 1306406 - protein, 9 aa, Homo Sapiens
NKFCCEDGT

SEQ ID NO: 1306407 - protein, 9 aa, Homo Sapiens
IQEFHVPLV

SEQ ID NO: 1306408 - protein, 9 aa, Homo Sapiens
NMLMAMNII

SEQ ID NO: 1306409 - protein, 9 aa, Homo Sapiens
VVFEQIPEN

SEQ ID NO: 1306410 - protein, 9 aa, Homo Sapiens
FATQLVRKG

SEQ ID NO: 1306411 - protein, 9 aa, Homo Sapiens
YLNSVQHLI

SEQ ID NO: 1306412 - protein, 9 aa, Homo Sapiens
LFCGFSSST

SEQ ID NO: 1306413 - protein, 9 aa, Homo Sapiens
RKGSNSNEP

SEQ ID NO: 1306414 - protein, 9 aa, Homo Sapiens
PEWKIMART

SEQ ID NO: 1306415 - protein, 9 aa, Homo Sapiens
FKHSLEEED

SEQ ID NO: 1306416 - protein, 9 aa, Homo Sapiens
IFLGGVDKI

SEQ ID NO: 1306417 - protein, 9 aa, Homo Sapiens
GTIKEENFV

SEQ ID NO: 1306418 - protein, 9 aa, Homo Sapiens
DSQLVVCNP

SEQ ID NO: 1306419 - protein, 9 aa, Homo Sapiens
IIHAGEKPI

SEQ ID NO: 1306420 - protein, 9 aa, Homo Sapiens
EGVLRITER

SEQ ID NO: 1306421 - protein, 9 aa, Homo Sapiens
DWLHIILWI

SEQ ID NO: 1306422 - protein, 9 aa, Homo Sapiens
QVERCRINL

SEQ ID NO: 1306423 - protein, 9 aa, Homo Sapiens
TEINGPDTN

SEQ ID NO: 1306424 - protein, 9 aa, Homo Sapiens
PLTVVALIP

SEQ ID NO: 1306425 - protein, 9 aa, Homo Sapiens
NLELNETIN

SEQ ID NO: 1306426 - protein, 9 aa, Homo Sapiens
CKGYYEYLG

SEQ ID NO: 1306427 - protein, 9 aa, Homo Sapiens
TGHNYLCGA

SEQ ID NO: 1306428 - protein, 9 aa, Homo Sapiens
TMVPFVSDT

SEQ ID NO: 1306429 - protein, 9 aa, Homo Sapiens
SSLQAENQS

SEQ ID NO: 1306430 - protein, 9 aa, Homo Sapiens
KLVLYLHRV

SEQ ID NO: 1306431 - protein, 9 aa, Homo Sapiens
NLNALDIYG

SEQ ID NO: 1306432 - protein, 9 aa, Homo Sapiens
NKVLHAAFI

SEQ ID NO: 1306433 - protein, 9 aa, Homo Sapiens
QIEDFSKDT

SEQ ID NO: 1306434 - protein, 9 aa, Homo Sapiens
VEEAQKHFD

SEQ ID NO: 1306435 - protein, 9 aa, Homo Sapiens
ILQATPSSV

SEQ ID NO: 1306436 - protein, 9 aa, Homo Sapiens
MSENNNNSL

SEQ ID NO: 1306437 - protein, 9 aa, Homo Sapiens
PRLSLSFWL

SEQ ID NO: 1306438 - protein, 9 aa, Homo Sapiens
KYLHEVSDT

SEQ ID NO: 1306439 - protein, 9 aa, Homo Sapiens
DKFTIIQNL

SEQ ID NO: 1306440 - protein, 9 aa, Homo Sapiens
FYESGSSLQ

SEQ ID NO: 1306441 - protein, 9 aa, Homo Sapiens
FFYTNFLVS

SEQ ID NO: 1306442 - protein, 9 aa, Homo Sapiens
KTLKNIISR

SEQ ID NO: 1306443 - protein, 9 aa, Homo Sapiens
LLLIFDENK

SEQ ID NO: 1306444 - protein, 9 aa, Homo Sapiens
AKLSLVGIA

SEQ ID NO: 1306445 - protein, 9 aa, Homo Sapiens
GALFGPIRL

SEQ ID NO: 1306446 - protein, 9 aa, Homo Sapiens
VVEHYENTI

SEQ ID NO: 1306447 - protein, 9 aa, Homo Sapiens
INNTASVNL

SEQ ID NO: 1306448 - protein, 9 aa, Homo Sapiens
SLKPQSLEG

SEQ ID NO: 1306449 - protein, 9 aa, Homo Sapiens
FSGLEEQAR

SEQ ID NO: 1306450 - protein, 9 aa, Homo Sapiens
SNNIKDDTI

SEQ ID NO: 1306451 - protein, 9 aa, Homo Sapiens
YHYMQWPDM

SEQ ID NO: 1306452 - protein, 9 aa, Homo Sapiens
FCEIDEEAI

SEQ ID NO: 1306453 - protein, 9 aa, Homo Sapiens
QYKEIVKNY

SEQ ID NO: 1306454 - protein, 9 aa, Homo Sapiens
LLNHFIYSL

SEQ ID NO: 1306455 - protein, 9 aa, Homo Sapiens
QAFQITLEC

SEQ ID NO: 1306456 - protein, 9 aa, Homo Sapiens
LEVLLNYYI

SEQ ID NO: 1306457 - protein, 9 aa, Homo Sapiens
QEHEDVPIF

SEQ ID NO: 1306458 - protein, 9 aa, Homo Sapiens
NHECWRKEI

SEQ ID NO: 1306459 - protein, 9 aa, Homo Sapiens
INWEFKNEL

SEQ ID NO: 1306460 - protein, 9 aa, Homo Sapiens
TAEELQEKY

SEQ ID NO: 1306461 - protein, 9 aa, Homo Sapiens
LKTLVEQHG

SEQ ID NO: 1306462 - protein, 9 aa, Homo Sapiens
KKEIYKESS

SEQ ID NO: 1306463 - protein, 9 aa, Homo Sapiens
LEYLRPRSQ

SEQ ID NO: 1306464 - protein, 9 aa, Homo Sapiens
AADLISQTA

SEQ ID NO: 1306465 - protein, 9 aa, Homo Sapiens
ASTGAFGKD

SEQ ID NO: 1306466 - protein, 9 aa, Homo Sapiens
IHLFRPRCL

SEQ ID NO: 1306467 - protein, 9 aa, Homo Sapiens
SYHIFSNMY

SEQ ID NO: 1306468 - protein, 9 aa, Homo Sapiens
TFDKEDNII

SEQ ID NO: 1306469 - protein, 9 aa, Homo Sapiens
SEHTDTEIN

SEQ ID NO: 1306470 - protein, 9 aa, Homo Sapiens
EKDKALGQK

SEQ ID NO: 1306471 - protein, 9 aa, Homo Sapiens
LTDVVISQN

SEQ ID NO: 1306472 - protein, 9 aa, Homo Sapiens
VIQNKYATG

SEQ ID NO: 1306473 - protein, 9 aa, Homo Sapiens
GTAEELQEK

SEQ ID NO: 1306474 - protein, 9 aa, Homo Sapiens
VGCWHGSKD

SEQ ID NO: 1306475 - protein, 9 aa, Homo Sapiens
SICKICIRK

SEQ ID NO: 1306476 - protein, 9 aa, Homo Sapiens
FLPPQPDFV

SEQ ID NO: 1306477 - protein, 9 aa, Homo Sapiens
VEHVMKRKF

SEQ ID NO: 1306478 - protein, 9 aa, Homo Sapiens
LLQAETTFW

SEQ ID NO: 1306479 - protein, 9 aa, Homo Sapiens
NKVVQDDTE

SEQ ID NO: 1306480 - protein, 9 aa, Homo Sapiens
IKINKDILM

SEQ ID NO: 1306481 - protein, 9 aa, Homo Sapiens
NDAIATLHE

SEQ ID NO: 1306482 - protein, 9 aa, Homo Sapiens
YNLLQAETT

SEQ ID NO: 1306483 - protein, 9 aa, Homo Sapiens
KLPNLEYLR

SEQ ID NO: 1306484 - protein, 9 aa, Homo Sapiens
DAFDSYYEE

SEQ ID NO: 1306485 - protein, 9 aa, Homo Sapiens
ISCSGHLVV

SEQ ID NO: 1306486 - protein, 9 aa, Homo Sapiens
HTVSGFLLS

SEQ ID NO: 1306487 - protein, 9 aa, Homo Sapiens
EEEIRKKYE

SEQ ID NO: 1306488 - protein, 9 aa, Homo Sapiens
AAGIITTKG

SEQ ID NO: 1306489 - protein, 9 aa, Homo Sapiens
LLHKVFNCC

SEQ ID NO: 1306490 - protein, 9 aa, Homo Sapiens
YSTVINSRA

SEQ ID NO: 1306491 - protein, 9 aa, Homo Sapiens
FNPMCRYDR

SEQ ID NO: 1306492 - protein, 9 aa, Homo Sapiens
APIHSAQHL

SEQ ID NO: 1306493 - protein, 9 aa, Homo Sapiens
DLFRLIKIK

SEQ ID NO: 1306494 - protein, 9 aa, Homo Sapiens
LENMGSHYI

SEQ ID NO: 1306495 - protein, 9 aa, Homo Sapiens
RLLLPQIKN

SEQ ID NO: 1306496 - protein, 9 aa, Homo Sapiens
FIWQCGLLM

SEQ ID NO: 1306497 - protein, 9 aa, Homo Sapiens
ERCQIIELL

SEQ ID NO: 1306498 - protein, 9 aa, Homo Sapiens
YQLFCGFSS

SEQ ID NO: 1306499 - protein, 9 aa, Homo Sapiens
PNYFSPQTD

SEQ ID NO: 1306500 - protein, 9 aa, Homo Sapiens
DFAEGVLRI

SEQ ID NO: 1306501 - protein, 9 aa, Homo Sapiens
RCQIIELLN

SEQ ID NO: 1306502 - protein, 9 aa, Homo Sapiens
YETINLTEE

SEQ ID NO: 1306503 - protein, 9 aa, Homo Sapiens
RQNFTGAVR

SEQ ID NO: 1306504 - protein, 9 aa, Homo Sapiens
KHDDKSPIC

SEQ ID NO: 1306505 - protein, 9 aa, Homo Sapiens
AVRIASESW

SEQ ID NO: 1306506 - protein, 9 aa, Homo Sapiens
ESAAPSSRF

SEQ ID NO: 1306507 - protein, 9 aa, Homo Sapiens
NKYLEDIES

SEQ ID NO: 1306508 - protein, 9 aa, Homo Sapiens
INYSWDDQC

SEQ ID NO: 1306509 - protein, 9 aa, Homo Sapiens
CKIQMEPGD

SEQ ID NO: 1306510 - protein, 9 aa, Homo Sapiens
VSFDYYYFI

SEQ ID NO: 1306511 - protein, 9 aa, Homo Sapiens
AEEPDNNSL

SEQ ID NO: 1306512 - protein, 9 aa, Homo Sapiens
GSPRSIPTT

SEQ ID NO: 1306513 - protein, 9 aa, Homo Sapiens
LYLSPQIEH

SEQ ID NO: 1306514 - protein, 9 aa, Homo Sapiens
PVAQQLLNQ

SEQ ID NO: 1306515 - protein, 9 aa, Homo Sapiens
ASRVQAIIL

SEQ ID NO: 1306516 - protein, 9 aa, Homo Sapiens
VSSLSLDST

SEQ ID NO: 1306517 - protein, 9 aa, Homo Sapiens
RKNGFVMLK

SEQ ID NO: 1306518 - protein, 9 aa, Homo Sapiens
QATTAQIRD

SEQ ID NO: 1306519 - protein, 9 aa, Homo Sapiens
DFSKDTMQM

SEQ ID NO: 1306520 - protein, 9 aa, Homo Sapiens
TSSSCSLNA

SEQ ID NO: 1306521 - protein, 9 aa, Homo Sapiens
HQIKNILKP

SEQ ID NO: 1306522 - protein, 9 aa, Homo Sapiens
TEVCDDKFI

SEQ ID NO: 1306523 - protein, 9 aa, Homo Sapiens
YTGHNYLCG

SEQ ID NO: 1306524 - protein, 9 aa, Homo Sapiens
EGIKERQQR

SEQ ID NO: 1306525 - protein, 9 aa, Homo Sapiens
RMIPLDPVH

SEQ ID NO: 1306526 - protein, 9 aa, Homo Sapiens
ECVQCGKSF

SEQ ID NO: 1306527 - protein, 9 aa, Homo Sapiens
LRAKEDKVE

SEQ ID NO: 1306528 - protein, 9 aa, Homo Sapiens
TFWQASQVK

SEQ ID NO: 1306529 - protein, 9 aa, Homo Sapiens
VVISQNLLE

SEQ ID NO: 1306530 - protein, 9 aa, Homo Sapiens
LKLWAIDRQ

SEQ ID NO: 1306531 - protein, 9 aa, Homo Sapiens
IIPSYMSIY

SEQ ID NO: 1306532 - protein, 9 aa, Homo Sapiens
TILQATPSS

SEQ ID NO: 1306533 - protein, 9 aa, Homo Sapiens
KANPFFQKP

SEQ ID NO: 1306534 - protein, 9 aa, Homo Sapiens
LGSTQIMKI

SEQ ID NO: 1306535 - protein, 9 aa, Homo Sapiens
RLIKYTPQH

SEQ ID NO: 1306536 - protein, 9 aa, Homo Sapiens
PGPENTPIA

SEQ ID NO: 1306537 - protein, 9 aa, Homo Sapiens
VQDPNDNTK

SEQ ID NO: 1306538 - protein, 9 aa, Homo Sapiens
TKKSREDYI

SEQ ID NO: 1306539 - protein, 9 aa, Homo Sapiens
RNILQSQGS

SEQ ID NO: 1306540 - protein, 9 aa, Homo Sapiens
HLNDGGNVL

SEQ ID NO: 1306541 - protein, 9 aa, Homo Sapiens
PLQYSTVIN

SEQ ID NO: 1306542 - protein, 9 aa, Homo Sapiens
RPPYRNNIT

SEQ ID NO: 1306543 - protein, 9 aa, Homo Sapiens
NFEDDYRGK

SEQ ID NO: 1306544 - protein, 9 aa, Homo Sapiens
SVTSVYWYR

SEQ ID NO: 1306545 - protein, 9 aa, Homo Sapiens
GKITDAFSF

SEQ ID NO: 1306546 - protein, 9 aa, Homo Sapiens
SNHKIIHTG

SEQ ID NO: 1306547 - protein, 9 aa, Homo Sapiens
NCPIPQWIR

SEQ ID NO: 1306548 - protein, 9 aa, Homo Sapiens
QKSNINIHQ

SEQ ID NO: 1306549 - protein, 9 aa, Homo Sapiens
GMHGNKALG

SEQ ID NO: 1306550 - protein, 9 aa, Homo Sapiens
NLPSFIRYH

SEQ ID NO: 1306551 - protein, 9 aa, Homo Sapiens
TSHGSPRSI

SEQ ID NO: 1306552 - protein, 9 aa, Homo Sapiens
RGTNKEEMR

SEQ ID NO: 1306553 - protein, 9 aa, Homo Sapiens
QDKSLAGWA

SEQ ID NO: 1306554 - protein, 9 aa, Homo Sapiens
VDPETNNNI

SEQ ID NO: 1306555 - protein, 9 aa, Homo Sapiens
GGSNQKCQK

SEQ ID NO: 1306556 - protein, 9 aa, Homo Sapiens
YYNKKNTFI

SEQ ID NO: 1306557 - protein, 9 aa, Homo Sapiens
QTVFSFLKH

SEQ ID NO: 1306558 - protein, 9 aa, Homo Sapiens
MLNEKINWE

SEQ ID NO: 1306559 - protein, 9 aa, Homo Sapiens
VDKSKNPNF

SEQ ID NO: 1306560 - protein, 9 aa, Homo Sapiens
IKNKEVSKT

SEQ ID NO: 1306561 - protein, 9 aa, Homo Sapiens
NVTCKNKDN

SEQ ID NO: 1306562 - protein, 9 aa, Homo Sapiens
RNVKQIIAR

SEQ ID NO: 1306563 - protein, 9 aa, Homo Sapiens
SLFHMLRIT

SEQ ID NO: 1306564 - protein, 9 aa, Homo Sapiens
KEIIRPRRT

SEQ ID NO: 1306565 - protein, 9 aa, Homo Sapiens
YTSQEEIIC

SEQ ID NO: 1306566 - protein, 9 aa, Homo Sapiens
TYWKVCLHY

SEQ ID NO: 1306567 - protein, 9 aa, Homo Sapiens
QTLPERNKL

SEQ ID NO: 1306568 - protein, 9 aa, Homo Sapiens
VGFDGGTNR

SEQ ID NO: 1306569 - protein, 9 aa, Homo Sapiens
GTLFGMFAM

SEQ ID NO: 1306570 - protein, 9 aa, Homo Sapiens
LPIFQRVNF

SEQ ID NO: 1306571 - protein, 9 aa, Homo Sapiens
LFPVRGGLG

SEQ ID NO: 1306572 - protein, 9 aa, Homo Sapiens
IIKGLGYNC

SEQ ID NO: 1306573 - protein, 9 aa, Homo Sapiens
RYLLDKDEN

SEQ ID NO: 1306574 - protein, 9 aa, Homo Sapiens
KGLFATQLV

SEQ ID NO: 1306575 - protein, 9 aa, Homo Sapiens
WRAKGTTWF

SEQ ID NO: 1306576 - protein, 9 aa, Homo Sapiens
LASTGAFGK

SEQ ID NO: 1306577 - protein, 9 aa, Homo Sapiens
KLLNKMQSL

SEQ ID NO: 1306578 - protein, 9 aa, Homo Sapiens
YKESSTWKG

SEQ ID NO: 1306579 - protein, 9 aa, Homo Sapiens
DERPWASRQ

SEQ ID NO: 1306580 - protein, 9 aa, Homo Sapiens
IIFYRGSGL

SEQ ID NO: 1306581 - protein, 9 aa, Homo Sapiens
QNISRSPTL

SEQ ID NO: 1306582 - protein, 9 aa, Homo Sapiens
TLIQSFYQM

SEQ ID NO: 1306583 - protein, 9 aa, Homo Sapiens
SDDRKANPF

SEQ ID NO: 1306584 - protein, 9 aa, Homo Sapiens
HIILWIGEF

SEQ ID NO: 1306585 - protein, 9 aa, Homo Sapiens
KVQKGNAVH

SEQ ID NO: 1306586 - protein, 9 aa, Homo Sapiens
SSSEASAYP

SEQ ID NO: 1306587 - protein, 9 aa, Homo Sapiens
KSALLSGGL

SEQ ID NO: 1306588 - protein, 9 aa, Homo Sapiens
VVEVKSWQI

SEQ ID NO: 1306589 - protein, 9 aa, Homo Sapiens
LASNGVSCT

SEQ ID NO: 1306590 - protein, 9 aa, Homo Sapiens
QHNGHIESE

SEQ ID NO: 1306591 - protein, 9 aa, Homo Sapiens
LPLLLTMII

SEQ ID NO: 1306592 - protein, 9 aa, Homo Sapiens
QGRIYGTIK

SEQ ID NO: 1306593 - protein, 9 aa, Homo Sapiens
PLSGAPQAG

SEQ ID NO: 1306594 - protein, 9 aa, Homo Sapiens
LILLNTVVL

SEQ ID NO: 1306595 - protein, 9 aa, Homo Sapiens
HFGPYEGQI

SEQ ID NO: 1306596 - protein, 9 aa, Homo Sapiens
GPENTPIAQ

SEQ ID NO: 1306597 - protein, 9 aa, Homo Sapiens
HLPLWDALS

SEQ ID NO: 1306598 - protein, 9 aa, Homo Sapiens
TDVVISQNL

SEQ ID NO: 1306599 - protein, 9 aa, Homo Sapiens
FRDQSELKH

SEQ ID NO: 1306600 - protein, 9 aa, Homo Sapiens
LSSSLYQAL

SEQ ID NO: 1306601 - protein, 9 aa, Homo Sapiens
PAVQGVFRS

SEQ ID NO: 1306602 - protein, 9 aa, Homo Sapiens
KSQLMIHQI

SEQ ID NO: 1306603 - protein, 9 aa, Homo Sapiens
NLEKLRVDT

SEQ ID NO: 1306604 - protein, 9 aa, Homo Sapiens
QCGKAFIHG

SEQ ID NO: 1306605 - protein, 9 aa, Homo Sapiens
GSNSNEPSS

SEQ ID NO: 1306606 - protein, 9 aa, Homo Sapiens
FFCGMPQLL

SEQ ID NO: 1306607 - protein, 9 aa, Homo Sapiens
PESSSEASA

SEQ ID NO: 1306608 - protein, 9 aa, Homo Sapiens
SMEIQQFKA

SEQ ID NO: 1306609 - protein, 9 aa, Homo Sapiens
ISHKIIHME

SEQ ID NO: 1306610 - protein, 9 aa, Homo Sapiens
CTGGYELQG

SEQ ID NO: 1306611 - protein, 9 aa, Homo Sapiens
KQEYEWDKP

SEQ ID NO: 1306612 - protein, 9 aa, Homo Sapiens
EGSEVEREM

SEQ ID NO: 1306613 - protein, 9 aa, Homo Sapiens
EDLRSWTTA

SEQ ID NO: 1306614 - protein, 9 aa, Homo Sapiens
NPRVPDAKK

SEQ ID NO: 1306615 - protein, 9 aa, Homo Sapiens
LSLFLFIWF

SEQ ID NO: 1306616 - protein, 9 aa, Homo Sapiens
SKLPNLEYL

SEQ ID NO: 1306617 - protein, 9 aa, Homo Sapiens
EFALLLLIF

SEQ ID NO: 1306618 - protein, 9 aa, Homo Sapiens
EALGNMFMY

SEQ ID NO: 1306619 - protein, 9 aa, Homo Sapiens
LLSGELTVD

SEQ ID NO: 1306620 - protein, 9 aa, Homo Sapiens
YYYNKKNTF

SEQ ID NO: 1306621 - protein, 9 aa, Homo Sapiens
SCSLNALDN

SEQ ID NO: 1306622 - protein, 9 aa, Homo Sapiens
DVVISQNLL

SEQ ID NO: 1306623 - protein, 9 aa, Homo Sapiens
TATPTQIKE

SEQ ID NO: 1306624 - protein, 9 aa, Homo Sapiens
QIEYQDGKF

SEQ ID NO: 1306625 - protein, 9 aa, Homo Sapiens
DSYAPYKLH

SEQ ID NO: 1306626 - protein, 9 aa, Homo Sapiens
IEPVGNHEE

SEQ ID NO: 1306627 - protein, 9 aa, Homo Sapiens
PPANGPPPR

SEQ ID NO: 1306628 - protein, 9 aa, Homo Sapiens
LSDPCVLLP

SEQ ID NO: 1306629 - protein, 9 aa, Homo Sapiens
VTSPLESNH

SEQ ID NO: 1306630 - protein, 9 aa, Homo Sapiens
GCHQVQINH

SEQ ID NO: 1306631 - protein, 9 aa, Homo Sapiens
DKALGQKDK

SEQ ID NO: 1306632 - protein, 9 aa, Homo Sapiens
VKQIIARSK

SEQ ID NO: 1306633 - protein, 9 aa, Homo Sapiens
LFDRHPYGV

SEQ ID NO: 1306634 - protein, 9 aa, Homo Sapiens
IPRPPGALC

SEQ ID NO: 1306635 - protein, 9 aa, Homo Sapiens
RVQAIILPQ

SEQ ID NO: 1306636 - protein, 9 aa, Homo Sapiens
RCTSLNESI

SEQ ID NO: 1306637 - protein, 9 aa, Homo Sapiens
NKLSETEDS

SEQ ID NO: 1306638 - protein, 9 aa, Homo Sapiens
EKKPNKEVK

SEQ ID NO: 1306639 - protein, 9 aa, Homo Sapiens
YLKESYFDA

SEQ ID NO: 1306640 - protein, 9 aa, Homo Sapiens
HTDTEINGP

SEQ ID NO: 1306641 - protein, 9 aa, Homo Sapiens
TCFLRHEII

SEQ ID NO: 1306642 - protein, 9 aa, Homo Sapiens
EMEFSLFYD

SEQ ID NO: 1306643 - protein, 9 aa, Homo Sapiens
TQELYILKV

SEQ ID NO: 1306644 - protein, 9 aa, Homo Sapiens
PSNNSSRRN

SEQ ID NO: 1306645 - protein, 9 aa, Homo Sapiens
KTLITERDN

SEQ ID NO: 1306646 - protein, 9 aa, Homo Sapiens
ALQYITTSY

SEQ ID NO: 1306647 - protein, 9 aa, Homo Sapiens
KILEKLLNI

SEQ ID NO: 1306648 - protein, 9 aa, Homo Sapiens
DKIKYPRTV

SEQ ID NO: 1306649 - protein, 9 aa, Homo Sapiens
EIIIAYLRD

SEQ ID NO: 1306650 - protein, 9 aa, Homo Sapiens
ATQEPDNIL

SEQ ID NO: 1306651 - protein, 9 aa, Homo Sapiens
QLRMYKNKG

SEQ ID NO: 1306652 - protein, 9 aa, Homo Sapiens
MLYKKFSPA

SEQ ID NO: 1306653 - protein, 9 aa, Homo Sapiens
VFRSISLSR

SEQ ID NO: 1306654 - protein, 9 aa, Homo Sapiens
VPNIDRINP

SEQ ID NO: 1306655 - protein, 9 aa, Homo Sapiens
EAIDSQLVV

SEQ ID NO: 1306656 - protein, 9 aa, Homo Sapiens
QHIIQRRYC

SEQ ID NO: 1306657 - protein, 9 aa, Homo Sapiens
SPRCEPGLS

SEQ ID NO: 1306658 - protein, 9 aa, Homo Sapiens
YTKIFDVGT

SEQ ID NO: 1306659 - protein, 9 aa, Homo Sapiens
HLKEHLQIH

SEQ ID NO: 1306660 - protein, 9 aa, Homo Sapiens
LRLSLTGHK

SEQ ID NO: 1306661 - protein, 9 aa, Homo Sapiens
ITVAVTIIP

SEQ ID NO: 1306662 - protein, 9 aa, Homo Sapiens
SGFILFTTI

SEQ ID NO: 1306663 - protein, 9 aa, Homo Sapiens
SEEGDKDDW

SEQ ID NO: 1306664 - protein, 9 aa, Homo Sapiens
TVFWMGSEG

SEQ ID NO: 1306665 - protein, 9 aa, Homo Sapiens
NRWPNYAAT

SEQ ID NO: 1306666 - protein, 9 aa, Homo Sapiens
NTAQIVVMQ

SEQ ID NO: 1306667 - protein, 9 aa, Homo Sapiens
ISNENKIFS

SEQ ID NO: 1306668 - protein, 9 aa, Homo Sapiens
DKDVITINQ

SEQ ID NO: 1306669 - protein, 9 aa, Homo Sapiens
IIKKQVNTR

SEQ ID NO: 1306670 - protein, 9 aa, Homo Sapiens
FATDYGFHF

SEQ ID NO: 1306671 - protein, 9 aa, Homo Sapiens
AKRYKIYHL

SEQ ID NO: 1306672 - protein, 9 aa, Homo Sapiens
LRKLNWKII

SEQ ID NO: 1306673 - protein, 9 aa, Homo Sapiens
PFKKGHTIN

SEQ ID NO: 1306674 - protein, 9 aa, Homo Sapiens
RPRCIIGVT

SEQ ID NO: 1306675 - protein, 9 aa, Homo Sapiens
CFEDCQTGA

SEQ ID NO: 1306676 - protein, 9 aa, Homo Sapiens
HFIYSLRNR

SEQ ID NO: 1306677 - protein, 9 aa, Homo Sapiens
SPRSIPTTH

SEQ ID NO: 1306678 - protein, 9 aa, Homo Sapiens
NNLSEAQLR

SEQ ID NO: 1306679 - protein, 9 aa, Homo Sapiens
YELHSSQHY

SEQ ID NO: 1306680 - protein, 9 aa, Homo Sapiens
SLYNPKRQT

SEQ ID NO: 1306681 - protein, 9 aa, Homo Sapiens
GDFHCKNHH

SEQ ID NO: 1306682 - protein, 9 aa, Homo Sapiens
KDLPVKLFV

SEQ ID NO: 1306683 - protein, 9 aa, Homo Sapiens
DVNVFDPNR

SEQ ID NO: 1306684 - protein, 9 aa, Homo Sapiens
DQNRKLTYI

SEQ ID NO: 1306685 - protein, 9 aa, Homo Sapiens
LLKKPYQPI

SEQ ID NO: 1306686 - protein, 9 aa, Homo Sapiens
LMISKLVQA

SEQ ID NO: 1306687 - protein, 9 aa, Homo Sapiens
EESLHRINI

SEQ ID NO: 1306688 - protein, 9 aa, Homo Sapiens
SCVSLLIQH

SEQ ID NO: 1306689 - protein, 9 aa, Homo Sapiens
PMVKSKSAL

SEQ ID NO: 1306690 - protein, 9 aa, Homo Sapiens
PDKPLEGNT

SEQ ID NO: 1306691 - protein, 9 aa, Homo Sapiens
ECDEAFSLK

SEQ ID NO: 1306692 - protein, 9 aa, Homo Sapiens
KYKDGTELA

SEQ ID NO: 1306693 - protein, 9 aa, Homo Sapiens
NNGRLTVGQ

SEQ ID NO: 1306694 - protein, 9 aa, Homo Sapiens
PVGNHEEKI

SEQ ID NO: 1306695 - protein, 9 aa, Homo Sapiens
IHITLEKVF

SEQ ID NO: 1306696 - protein, 9 aa, Homo Sapiens
IFSLTSPSI

SEQ ID NO: 1306697 - protein, 9 aa, Homo Sapiens
YDLQREFHM

SEQ ID NO: 1306698 - protein, 9 aa, Homo Sapiens
SRQISISER

SEQ ID NO: 1306699 - protein, 9 aa, Homo Sapiens
VCCIKPNDF

SEQ ID NO: 1306700 - protein, 9 aa, Homo Sapiens
STLKYKVTV

SEQ ID NO: 1306701 - protein, 9 aa, Homo Sapiens
ALIMPVIPM

SEQ ID NO: 1306702 - protein, 9 aa, Homo Sapiens
WTTSEGELS

SEQ ID NO: 1306703 - protein, 9 aa, Homo Sapiens
RKPKGNPRV

SEQ ID NO: 1306704 - protein, 9 aa, Homo Sapiens
SRKHYLVQE

SEQ ID NO: 1306705 - protein, 9 aa, Homo Sapiens
PYTGHNYLC

SEQ ID NO: 1306706 - protein, 9 aa, Homo Sapiens
MTKAGTFQV

SEQ ID NO: 1306707 - protein, 9 aa, Homo Sapiens
LSSLIAGQP

SEQ ID NO: 1306708 - protein, 9 aa, Homo Sapiens
NVVIQNEIN

SEQ ID NO: 1306709 - protein, 9 aa, Homo Sapiens
LEELDKIFQ

SEQ ID NO: 1306710 - protein, 9 aa, Homo Sapiens
REMDEELDD

SEQ ID NO: 1306711 - protein, 9 aa, Homo Sapiens
DLQREFHMQ

SEQ ID NO: 1306712 - protein, 9 aa, Homo Sapiens
RIDRPFPVC

SEQ ID NO: 1306713 - protein, 9 aa, Homo Sapiens
LTQKNQLIS

SEQ ID NO: 1306714 - protein, 9 aa, Homo Sapiens
RDSENNKEQ

SEQ ID NO: 1306715 - protein, 9 aa, Homo Sapiens
STLNVHKII

SEQ ID NO: 1306716 - protein, 9 aa, Homo Sapiens
ILVLSYFWY

SEQ ID NO: 1306717 - protein, 9 aa, Homo Sapiens
ASEEGDKDD

SEQ ID NO: 1306718 - protein, 9 aa, Homo Sapiens
KLMSKNNMN

SEQ ID NO: 1306719 - protein, 9 aa, Homo Sapiens
LRPRCIIGV

SEQ ID NO: 1306720 - protein, 9 aa, Homo Sapiens
GAVRIASES

SEQ ID NO: 1306721 - protein, 9 aa, Homo Sapiens
NLMTSAVPV

SEQ ID NO: 1306722 - protein, 9 aa, Homo Sapiens
NKKNTFIVL

SEQ ID NO: 1306723 - protein, 9 aa, Homo Sapiens
IMESPIDSA

SEQ ID NO: 1306724 - protein, 9 aa, Homo Sapiens
TYDMMIVRH

SEQ ID NO: 1306725 - protein, 9 aa, Homo Sapiens
WKENVIILD

SEQ ID NO: 1306726 - protein, 9 aa, Homo Sapiens
HSLKPQSLE

SEQ ID NO: 1306727 - protein, 9 aa, Homo Sapiens
LLEKHDDKS

SEQ ID NO: 1306728 - protein, 9 aa, Homo Sapiens
GSITNKFCC

SEQ ID NO: 1306729 - protein, 9 aa, Homo Sapiens
GDLIRFCWL

SEQ ID NO: 1306730 - protein, 9 aa, Homo Sapiens
PFPVCPIPL

SEQ ID NO: 1306731 - protein, 9 aa, Homo Sapiens
AIYFRCLGL

SEQ ID NO: 1306732 - protein, 9 aa, Homo Sapiens
MYYFVNDKF

SEQ ID NO: 1306733 - protein, 9 aa, Homo Sapiens
VQAIILPQP

SEQ ID NO: 1306734 - protein, 9 aa, Homo Sapiens
ACNLMQSSS

SEQ ID NO: 1306735 - protein, 9 aa, Homo Sapiens
SGTSFDKSL

SEQ ID NO: 1306736 - protein, 9 aa, Homo Sapiens
KINYSWDDQ

SEQ ID NO: 1306737 - protein, 9 aa, Homo Sapiens
EDSLKANLH

SEQ ID NO: 1306738 - protein, 9 aa, Homo Sapiens
GGSAGNYLT

SEQ ID NO: 1306739 - protein, 9 aa, Homo Sapiens
SLWTGSITN

SEQ ID NO: 1306740 - protein, 9 aa, Homo Sapiens
VEEILEIFD

SEQ ID NO: 1306741 - protein, 9 aa, Homo Sapiens
IHPDPKALK

SEQ ID NO: 1306742 - protein, 9 aa, Homo Sapiens
ENKVVQDDT

SEQ ID NO: 1306743 - protein, 9 aa, Homo Sapiens
QSHKLERKI

SEQ ID NO: 1306744 - protein, 9 aa, Homo Sapiens
FMNNIFSYH

SEQ ID NO: 1306745 - protein, 9 aa, Homo Sapiens
LQQNKEDAW

SEQ ID NO: 1306746 - protein, 9 aa, Homo Sapiens
IYHTLGSRC

SEQ ID NO: 1306747 - protein, 9 aa, Homo Sapiens
ENKYLEDIE

SEQ ID NO: 1306748 - protein, 9 aa, Homo Sapiens
PNFKVFRYS

SEQ ID NO: 1306749 - protein, 9 aa, Homo Sapiens
LVVVGAVGV

SEQ ID NO: 1306750 - protein, 9 aa, Homo Sapiens
EEIAAEINK

SEQ ID NO: 1306751 - protein, 9 aa, Homo Sapiens
ETYLSVLMK

SEQ ID NO: 1306752 - protein, 9 aa, Homo Sapiens
RGIVFCKIQ

SEQ ID NO: 1306753 - protein, 9 aa, Homo Sapiens
PVCPIPLSS

SEQ ID NO: 1306754 - protein, 9 aa, Homo Sapiens
LRKQVEEMF

SEQ ID NO: 1306755 - protein, 9 aa, Homo Sapiens
LLILLNTVV

SEQ ID NO: 1306756 - protein, 9 aa, Homo Sapiens
ALQTFYATP

SEQ ID NO: 1306757 - protein, 9 aa, Homo Sapiens
YQMHRAKVD

SEQ ID NO: 1306758 - protein, 9 aa, Homo Sapiens
LNEKINWEF

SEQ ID NO: 1306759 - protein, 9 aa, Homo Sapiens
PSHQKHIGS

SEQ ID NO: 1306760 - protein, 9 aa, Homo Sapiens
FSLAAFKIN

SEQ ID NO: 1306761 - protein, 9 aa, Homo Sapiens
SSHLTKHKI

SEQ ID NO: 1306762 - protein, 9 aa, Homo Sapiens
LVVCNPNVY

SEQ ID NO: 1306763 - protein, 9 aa, Homo Sapiens
CEMNGEECV

SEQ ID NO: 1306764 - protein, 9 aa, Homo Sapiens
FRSKIIHNN

SEQ ID NO: 1306765 - protein, 9 aa, Homo Sapiens
GCKTYWKVC

SEQ ID NO: 1306766 - protein, 9 aa, Homo Sapiens
LSPHKYFST

SEQ ID NO: 1306767 - protein, 9 aa, Homo Sapiens
DPVLAEVVT

SEQ ID NO: 1306768 - protein, 9 aa, Homo Sapiens
VVILPNDLF

SEQ ID NO: 1306769 - protein, 9 aa, Homo Sapiens
SQLCEQHKH

SEQ ID NO: 1306770 - protein, 9 aa, Homo Sapiens
DGPGLGEWA

SEQ ID NO: 1306771 - protein, 9 aa, Homo Sapiens
RKILVNYGD

SEQ ID NO: 1306772 - protein, 9 aa, Homo Sapiens
QSPYKFPSS

SEQ ID NO: 1306773 - protein, 9 aa, Homo Sapiens
MQLNMQEEE

SEQ ID NO: 1306774 - protein, 9 aa, Homo Sapiens
KDGTELALK

SEQ ID NO: 1306775 - protein, 9 aa, Homo Sapiens
QEYLPSGIV

SEQ ID NO: 1306776 - protein, 9 aa, Homo Sapiens
AQQLLNQIQ

SEQ ID NO: 1306777 - protein, 9 aa, Homo Sapiens
TNPGIKYEH

SEQ ID NO: 1306778 - protein, 9 aa, Homo Sapiens
GIHPDPKAL

SEQ ID NO: 1306779 - protein, 9 aa, Homo Sapiens
IAAGIITTK

SEQ ID NO: 1306780 - protein, 9 aa, Homo Sapiens
KQPDKKSNK

SEQ ID NO: 1306781 - protein, 9 aa, Homo Sapiens
GTIMDPHNP

SEQ ID NO: 1306782 - protein, 9 aa, Homo Sapiens
GLGTALNIL

SEQ ID NO: 1306783 - protein, 9 aa, Homo Sapiens
SLASTGAFG

SEQ ID NO: 1306784 - protein, 9 aa, Homo Sapiens
AHLYRELTC

SEQ ID NO: 1306785 - protein, 9 aa, Homo Sapiens
EDNLLHQVE

SEQ ID NO: 1306786 - protein, 9 aa, Homo Sapiens
PSMEEKLEH

SEQ ID NO: 1306787 - protein, 9 aa, Homo Sapiens
NLKLWAIDR

SEQ ID NO: 1306788 - protein, 9 aa, Homo Sapiens
QIVVMQESL

SEQ ID NO: 1306789 - protein, 9 aa, Homo Sapiens
VSSSLQIHE

SEQ ID NO: 1306790 - protein, 9 aa, Homo Sapiens
CIFLKKTFN

SEQ ID NO: 1306791 - protein, 9 aa, Homo Sapiens
PAERRNFIC

SEQ ID NO: 1306792 - protein, 9 aa, Homo Sapiens
ADNILSFYF

SEQ ID NO: 1306793 - protein, 9 aa, Homo Sapiens
LGFDMYSQP

SEQ ID NO: 1306794 - protein, 9 aa, Homo Sapiens
DYLKKEFES

SEQ ID NO: 1306795 - protein, 9 aa, Homo Sapiens
NINAVHSHY

SEQ ID NO: 1306796 - protein, 9 aa, Homo Sapiens
HRINITHFG

SEQ ID NO: 1306797 - protein, 9 aa, Homo Sapiens
QDTTAAPIT

SEQ ID NO: 1306798 - protein, 9 aa, Homo Sapiens
NVHKIIHSG

SEQ ID NO: 1306799 - protein, 9 aa, Homo Sapiens
ISFWSRVLP

SEQ ID NO: 1306800 - protein, 9 aa, Homo Sapiens
TAIEGNYLG

SEQ ID NO: 1306801 - protein, 9 aa, Homo Sapiens
EYGKKKTTF

SEQ ID NO: 1306802 - protein, 9 aa, Homo Sapiens
KVNKYLDLS

SEQ ID NO: 1306803 - protein, 9 aa, Homo Sapiens
DNFYRVANW

SEQ ID NO: 1306804 - protein, 9 aa, Homo Sapiens
TNLSKPLMR

SEQ ID NO: 1306805 - protein, 9 aa, Homo Sapiens
THPKDSPRR

SEQ ID NO: 1306806 - protein, 9 aa, Homo Sapiens
LLEHVLIIL

SEQ ID NO: 1306807 - protein, 9 aa, Homo Sapiens
APVIVHTVS

SEQ ID NO: 1306808 - protein, 9 aa, Homo Sapiens
LPIIKGLGY

SEQ ID NO: 1306809 - protein, 9 aa, Homo Sapiens
VIILDTAKK

SEQ ID NO: 1306810 - protein, 9 aa, Homo Sapiens
LFFDDIDHN

SEQ ID NO: 1306811 - protein, 9 aa, Homo Sapiens
SFLAKRSNF

SEQ ID NO: 1306812 - protein, 9 aa, Homo Sapiens
QDKLSHLRS

SEQ ID NO: 1306813 - protein, 9 aa, Homo Sapiens
SITQSYYRN

SEQ ID NO: 1306814 - protein, 9 aa, Homo Sapiens
PWQLYLSVK

SEQ ID NO: 1306815 - protein, 9 aa, Homo Sapiens
SGLGFGLLS

SEQ ID NO: 1306816 - protein, 9 aa, Homo Sapiens
GEQNKKSVT

SEQ ID NO: 1306817 - protein, 9 aa, Homo Sapiens
WDNLSNHVT

SEQ ID NO: 1306818 - protein, 9 aa, Homo Sapiens
LSEVTGTCL

SEQ ID NO: 1306819 - protein, 9 aa, Homo Sapiens
AAPSSQRYS

SEQ ID NO: 1306820 - protein, 9 aa, Homo Sapiens
ESGYLTFSL

SEQ ID NO: 1306821 - protein, 9 aa, Homo Sapiens
LIKKEKKKI

SEQ ID NO: 1306822 - protein, 9 aa, Homo Sapiens
EEHKKEEDN

SEQ ID NO: 1306823 - protein, 9 aa, Homo Sapiens
KETCDYFDK

SEQ ID NO: 1306824 - protein, 9 aa, Homo Sapiens
SSGNEEHKK

SEQ ID NO: 1306825 - protein, 9 aa, Homo Sapiens
APGEYNDLS

SEQ ID NO: 1306826 - protein, 9 aa, Homo Sapiens
GKFAVVKEC

SEQ ID NO: 1306827 - protein, 9 aa, Homo Sapiens
GGTNRIFLV

SEQ ID NO: 1306828 - protein, 9 aa, Homo Sapiens
PLELVEKKH

SEQ ID NO: 1306829 - protein, 9 aa, Homo Sapiens
EQDELYELC

SEQ ID NO: 1306830 - protein, 9 aa, Homo Sapiens
VEAAKKNIG

SEQ ID NO: 1306831 - protein, 9 aa, Homo Sapiens
TINMTLQSD

SEQ ID NO: 1306832 - protein, 9 aa, Homo Sapiens
HDYLWVKNE

SEQ ID NO: 1306833 - protein, 9 aa, Homo Sapiens
PHQQPTTEG

SEQ ID NO: 1306834 - protein, 9 aa, Homo Sapiens
LTKLTKFVS

SEQ ID NO: 1306835 - protein, 9 aa, Homo Sapiens
NVAAGTESM

SEQ ID NO: 1306836 - protein, 9 aa, Homo Sapiens
SFYVGASIV

SEQ ID NO: 1306837 - protein, 9 aa, Homo Sapiens
AGQDQNGGV

SEQ ID NO: 1306838 - protein, 9 aa, Homo Sapiens
FDGGTNRIF

SEQ ID NO: 1306839 - protein, 9 aa, Homo Sapiens
DDRKANPFF

SEQ ID NO: 1306840 - protein, 9 aa, Homo Sapiens
SEVGFPDSL

SEQ ID NO: 1306841 - protein, 9 aa, Homo Sapiens
QTICIDNKD

SEQ ID NO: 1306842 - protein, 9 aa, Homo Sapiens
SFSCVSLLI

SEQ ID NO: 1306843 - protein, 9 aa, Homo Sapiens
GKRKQKSST

SEQ ID NO: 1306844 - protein, 9 aa, Homo Sapiens
CFLRHEIIH

SEQ ID NO: 1306845 - protein, 9 aa, Homo Sapiens
DRKILVNYG

SEQ ID NO: 1306846 - protein, 9 aa, Homo Sapiens
SGPKVHKRI

SEQ ID NO: 1306847 - protein, 9 aa, Homo Sapiens
RQKEQDKYL

SEQ ID NO: 1306848 - protein, 9 aa, Homo Sapiens
TRQIDREEK

SEQ ID NO: 1306849 - protein, 9 aa, Homo Sapiens
QTQEQQTQR

SEQ ID NO: 1306850 - protein, 9 aa, Homo Sapiens
NTALIMPVI

SEQ ID NO: 1306851 - protein, 9 aa, Homo Sapiens
EIINNKEKE

SEQ ID NO: 1306852 - protein, 9 aa, Homo Sapiens
PSGSSVSDK

SEQ ID NO: 1306853 - protein, 9 aa, Homo Sapiens
PSWKTSFYV

SEQ ID NO: 1306854 - protein, 9 aa, Homo Sapiens
MENSERINI

SEQ ID NO: 1306855 - protein, 9 aa, Homo Sapiens
PNVVNLEGV

SEQ ID NO: 1306856 - protein, 9 aa, Homo Sapiens
GAKYLLSDN

SEQ ID NO: 1306857 - protein, 9 aa, Homo Sapiens
GLFATQLVR

SEQ ID NO: 1306858 - protein, 9 aa, Homo Sapiens
LDEAFLRLA

SEQ ID NO: 1306859 - protein, 9 aa, Homo Sapiens
LIIHKIIHT

SEQ ID NO: 1306860 - protein, 9 aa, Homo Sapiens
DGHLNLAGS

SEQ ID NO: 1306861 - protein, 9 aa, Homo Sapiens
SEKTHPKDS

SEQ ID NO: 1306862 - protein, 9 aa, Homo Sapiens
IHIGEKRYE

SEQ ID NO: 1306863 - protein, 9 aa, Homo Sapiens
ISTGEKFYK

SEQ ID NO: 1306864 - protein, 9 aa, Homo Sapiens
IEAYKDDLY

SEQ ID NO: 1306865 - protein, 9 aa, Homo Sapiens
MHEIIHTGE

SEQ ID NO: 1306866 - protein, 9 aa, Homo Sapiens
DHVGSLSDK

SEQ ID NO: 1306867 - protein, 9 aa, Homo Sapiens
VAQQLLNQI

SEQ ID NO: 1306868 - protein, 9 aa, Homo Sapiens
SKRHFKLEK

SEQ ID NO: 1306869 - protein, 9 aa, Homo Sapiens
VLHKLGLRP

SEQ ID NO: 1306870 - protein, 9 aa, Homo Sapiens
INKFLEYFI

SEQ ID NO: 1306871 - protein, 9 aa, Homo Sapiens
KNILKPEIM

SEQ ID NO: 1306872 - protein, 9 aa, Homo Sapiens
MTYIKCACN

SEQ ID NO: 1306873 - protein, 9 aa, Homo Sapiens
GLVWALPKT

SEQ ID NO: 1306874 - protein, 9 aa, Homo Sapiens
ECWRKEIHG

SEQ ID NO: 1306875 - protein, 9 aa, Homo Sapiens
YDRLSTLEY

SEQ ID NO: 1306876 - protein, 9 aa, Homo Sapiens
LKEEDFNKN

SEQ ID NO: 1306877 - protein, 9 aa, Homo Sapiens
GKFDKDRDS

SEQ ID NO: 1306878 - protein, 9 aa, Homo Sapiens
DMTSKRHFK

SEQ ID NO: 1306879 - protein, 9 aa, Homo Sapiens
HSSLRYSPS

SEQ ID NO: 1306880 - protein, 9 aa, Homo Sapiens
VVTGLHPNQ

SEQ ID NO: 1306881 - protein, 9 aa, Homo Sapiens
SCAVVANIV

SEQ ID NO: 1306882 - protein, 9 aa, Homo Sapiens
SGYLTFSLK

SEQ ID NO: 1306883 - protein, 9 aa, Homo Sapiens
KITVAVTII

SEQ ID NO: 1306884 - protein, 9 aa, Homo Sapiens
SNIISYFLN

SEQ ID NO: 1306885 - protein, 9 aa, Homo Sapiens
ALGNKKNVE

SEQ ID NO: 1306886 - protein, 9 aa, Homo Sapiens
IKPNKVPGE

SEQ ID NO: 1306887 - protein, 9 aa, Homo Sapiens
HEKILNGVR

SEQ ID NO: 1306888 - protein, 9 aa, Homo Sapiens
MYRMEEVTG

SEQ ID NO: 1306889 - protein, 9 aa, Homo Sapiens
IVSTRIYKK

SEQ ID NO: 1306890 - protein, 9 aa, Homo Sapiens
NYYIYSRIL

SEQ ID NO: 1306891 - protein, 9 aa, Homo Sapiens
TTIATQTGP

SEQ ID NO: 1306892 - protein, 9 aa, Homo Sapiens
FYNVRLAQR

SEQ ID NO: 1306893 - protein, 9 aa, Homo Sapiens
DKLHQNICR

SEQ ID NO: 1306894 - protein, 9 aa, Homo Sapiens
IEDFSKDTM

SEQ ID NO: 1306895 - protein, 9 aa, Homo Sapiens
GDIEKYNDA

SEQ ID NO: 1306896 - protein, 9 aa, Homo Sapiens
DEVAGGAHK

SEQ ID NO: 1306897 - protein, 9 aa, Homo Sapiens
EQIPENESA

SEQ ID NO: 1306898 - protein, 9 aa, Homo Sapiens
WNEDFQYGY

SEQ ID NO: 1306899 - protein, 9 aa, Homo Sapiens
YLEDFFMMS

SEQ ID NO: 1306900 - protein, 9 aa, Homo Sapiens
CKVLISFLQ

SEQ ID NO: 1306901 - protein, 9 aa, Homo Sapiens
NIRYLIKFV

SEQ ID NO: 1306902 - protein, 9 aa, Homo Sapiens
ALKENDIKP

SEQ ID NO: 1306903 - protein, 9 aa, Homo Sapiens
FIFRGTMYR

SEQ ID NO: 1306904 - protein, 9 aa, Homo Sapiens
LFNSGCSQC

SEQ ID NO: 1306905 - protein, 9 aa, Homo Sapiens
PKNPSKPIQ

SEQ ID NO: 1306906 - protein, 9 aa, Homo Sapiens
VPLEQKMAK

SEQ ID NO: 1306907 - protein, 9 aa, Homo Sapiens
SRITLLPIP

SEQ ID NO: 1306908 - protein, 9 aa, Homo Sapiens
TAKITIILL

SEQ ID NO: 1306909 - protein, 9 aa, Homo Sapiens
FALFFDDID

SEQ ID NO: 1306910 - protein, 9 aa, Homo Sapiens
GIYEQDELY

SEQ ID NO: 1306911 - protein, 9 aa, Homo Sapiens
KYLNETAGV

SEQ ID NO: 1306912 - protein, 9 aa, Homo Sapiens
RITERLQAH

SEQ ID NO: 1306913 - protein, 9 aa, Homo Sapiens
SQEEIICRF

SEQ ID NO: 1306914 - protein, 9 aa, Homo Sapiens
MTTIHYDII

SEQ ID NO: 1306915 - protein, 9 aa, Homo Sapiens
ILCIIMLLA

SEQ ID NO: 1306916 - protein, 9 aa, Homo Sapiens
SECSLHEPL

SEQ ID NO: 1306917 - protein, 9 aa, Homo Sapiens
EETVRNILQ

SEQ ID NO: 1306918 - protein, 9 aa, Homo Sapiens
SYSWFQDEE

SEQ ID NO: 1306919 - protein, 9 aa, Homo Sapiens
EDLWKELEH

SEQ ID NO: 1306920 - protein, 9 aa, Homo Sapiens
STFINHQII

SEQ ID NO: 1306921 - protein, 9 aa, Homo Sapiens
RFHMVKQKI

SEQ ID NO: 1306922 - protein, 9 aa, Homo Sapiens
IRVRKEVLQ

SEQ ID NO: 1306923 - protein, 9 aa, Homo Sapiens
DPSLFIFRG

SEQ ID NO: 1306924 - protein, 9 aa, Homo Sapiens
SFRQPVDLL

SEQ ID NO: 1306925 - protein, 9 aa, Homo Sapiens
SDLIIFYRG

SEQ ID NO: 1306926 - protein, 9 aa, Homo Sapiens
NDNTPELLP

SEQ ID NO: 1306927 - protein, 9 aa, Homo Sapiens
WMKFRLPLS

SEQ ID NO: 1306928 - protein, 9 aa, Homo Sapiens
LGNHCTEIT

SEQ ID NO: 1306929 - protein, 9 aa, Homo Sapiens
PLDPSLFIF

SEQ ID NO: 1306930 - protein, 9 aa, Homo Sapiens
SIEINDELK

SEQ ID NO: 1306931 - protein, 9 aa, Homo Sapiens
TYIDFIYRT

SEQ ID NO: 1306932 - protein, 9 aa, Homo Sapiens
LSLSGGYWN

SEQ ID NO: 1306933 - protein, 9 aa, Homo Sapiens
HEIREIQRE

SEQ ID NO: 1306934 - protein, 9 aa, Homo Sapiens
GNYFEYTAK

SEQ ID NO: 1306935 - protein, 9 aa, Homo Sapiens
KSFSLRLSL

SEQ ID NO: 1306936 - protein, 9 aa, Homo Sapiens
VTKEVDGLS

SEQ ID NO: 1306937 - protein, 9 aa, Homo Sapiens
SNHLKCSQL

SEQ ID NO: 1306938 - protein, 9 aa, Homo Sapiens
NEIVTETLL

SEQ ID NO: 1306939 - protein, 9 aa, Homo Sapiens
HVGSLSDKL

SEQ ID NO: 1306940 - protein, 9 aa, Homo Sapiens
IMKGIKPNK

SEQ ID NO: 1306941 - protein, 9 aa, Homo Sapiens
GPKVHKRIH

SEQ ID NO: 1306942 - protein, 9 aa, Homo Sapiens
KNIYSNCLP

SEQ ID NO: 1306943 - protein, 9 aa, Homo Sapiens
LIPYSVHML

SEQ ID NO: 1306944 - protein, 9 aa, Homo Sapiens
FLQDCLHGI

SEQ ID NO: 1306945 - protein, 9 aa, Homo Sapiens
KLSLVGIAG

SEQ ID NO: 1306946 - protein, 9 aa, Homo Sapiens
IQFSEMLQF

SEQ ID NO: 1306947 - protein, 9 aa, Homo Sapiens
AVEIINSTN

SEQ ID NO: 1306948 - protein, 9 aa, Homo Sapiens
RWNTSEVHN

SEQ ID NO: 1306949 - protein, 9 aa, Homo Sapiens
LQIHSGEKP

SEQ ID NO: 1306950 - protein, 9 aa, Homo Sapiens
IEGNYLGQM

SEQ ID NO: 1306951 - protein, 9 aa, Homo Sapiens
IIHTREKAY

SEQ ID NO: 1306952 - protein, 9 aa, Homo Sapiens
ADDPQDKAM

SEQ ID NO: 1306953 - protein, 9 aa, Homo Sapiens
QMQNTLYLS

SEQ ID NO: 1306954 - protein, 9 aa, Homo Sapiens
EIQEFHVPL

SEQ ID NO: 1306955 - protein, 9 aa, Homo Sapiens
INITHFGPT

SEQ ID NO: 1306956 - protein, 9 aa, Homo Sapiens
KHHQKIHQN

SEQ ID NO: 1306957 - protein, 9 aa, Homo Sapiens
HKKEEDNDE

SEQ ID NO: 1306958 - protein, 9 aa, Homo Sapiens
SMENSERIN

SEQ ID NO: 1306959 - protein, 9 aa, Homo Sapiens
KLEKHSAPS

SEQ ID NO: 1306960 - protein, 9 aa, Homo Sapiens
FCVEKGTIH

SEQ ID NO: 1306961 - protein, 9 aa, Homo Sapiens
LVKSHFMYA

SEQ ID NO: 1306962 - protein, 9 aa, Homo Sapiens
DREFALLLL

SEQ ID NO: 1306963 - protein, 9 aa, Homo Sapiens
ADCQYVISM

SEQ ID NO: 1306964 - protein, 9 aa, Homo Sapiens
ALILHQGIH

SEQ ID NO: 1306965 - protein, 9 aa, Homo Sapiens
IDQYLSGDD

SEQ ID NO: 1306966 - protein, 9 aa, Homo Sapiens
WPNYAATSI

SEQ ID NO: 1306967 - protein, 9 aa, Homo Sapiens
PNIDRINPE

SEQ ID NO: 1306968 - protein, 9 aa, Homo Sapiens
KQVEEMFNL

SEQ ID NO: 1306969 - protein, 9 aa, Homo Sapiens
TPNPSTIFQ

SEQ ID NO: 1306970 - protein, 9 aa, Homo Sapiens
CLYLIAPTG

SEQ ID NO: 1306971 - protein, 9 aa, Homo Sapiens
EHVMKRKFS

SEQ ID NO: 1306972 - protein, 9 aa, Homo Sapiens
EPGTLKIIP

SEQ ID NO: 1306973 - protein, 9 aa, Homo Sapiens
FVTPTILNF

SEQ ID NO: 1306974 - protein, 9 aa, Homo Sapiens
VNGRPLPNT

SEQ ID NO: 1306975 - protein, 9 aa, Homo Sapiens
FNKIINSMW

SEQ ID NO: 1306976 - protein, 9 aa, Homo Sapiens
KIYHLALSP

SEQ ID NO: 1306977 - protein, 9 aa, Homo Sapiens
STANKCVSC

SEQ ID NO: 1306978 - protein, 9 aa, Homo Sapiens
AALIAYLKK

SEQ ID NO: 1306979 - protein, 9 aa, Homo Sapiens
LRFHPWQLY

SEQ ID NO: 1306980 - protein, 9 aa, Homo Sapiens
HMAARSDQA

SEQ ID NO: 1306981 - protein, 9 aa, Homo Sapiens
SHMINKIML

SEQ ID NO: 1306982 - protein, 9 aa, Homo Sapiens
EMFNLKFAQ

SEQ ID NO: 1306983 - protein, 9 aa, Homo Sapiens
SNTCLVTAA

SEQ ID NO: 1306984 - protein, 9 aa, Homo Sapiens
SSAIQAPHS

SEQ ID NO: 1306985 - protein, 9 aa, Homo Sapiens
KTETSLGIP

SEQ ID NO: 1306986 - protein, 9 aa, Homo Sapiens
VHTEGRGTN

SEQ ID NO: 1306987 - protein, 9 aa, Homo Sapiens
PSFIRYHEM

SEQ ID NO: 1306988 - protein, 9 aa, Homo Sapiens
NFSMEIQQF

SEQ ID NO: 1306989 - protein, 9 aa, Homo Sapiens
QVPALQSNQ

SEQ ID NO: 1306990 - protein, 9 aa, Homo Sapiens
VYEKKPNKE

SEQ ID NO: 1306991 - protein, 9 aa, Homo Sapiens
TAWKVKDEK

SEQ ID NO: 1306992 - protein, 9 aa, Homo Sapiens
QFYAESIIN

SEQ ID NO: 1306993 - protein, 9 aa, Homo Sapiens
LEDNLLHQV

SEQ ID NO: 1306994 - protein, 9 aa, Homo Sapiens
ANYSVLCLE

SEQ ID NO: 1306995 - protein, 9 aa, Homo Sapiens
VIQEKLLLK

SEQ ID NO: 1306996 - protein, 9 aa, Homo Sapiens
SKETCDYFD

SEQ ID NO: 1306997 - protein, 9 aa, Homo Sapiens
MDYVPYTEW

SEQ ID NO: 1306998 - protein, 9 aa, Homo Sapiens
NPKLCVSEM

SEQ ID NO: 1306999 - protein, 9 aa, Homo Sapiens
TPHNITIRT

SEQ ID NO: 1307000 - protein, 9 aa, Homo Sapiens
GKDKYKVYE

SEQ ID NO: 1307001 - protein, 9 aa, Homo Sapiens
SRSLPPLPP

SEQ ID NO: 1307002 - protein, 9 aa, Homo Sapiens
PPLPVTRYS

SEQ ID NO: 1307003 - protein, 9 aa, Homo Sapiens
RINLVALKA

SEQ ID NO: 1307004 - protein, 9 aa, Homo Sapiens
FLIKHHATI

SEQ ID NO: 1307005 - protein, 9 aa, Homo Sapiens
IESLADRVH

SEQ ID NO: 1307006 - protein, 9 aa, Homo Sapiens
EELKKRNFD

SEQ ID NO: 1307007 - protein, 9 aa, Homo Sapiens
PTRIILYES

SEQ ID NO: 1307008 - protein, 9 aa, Homo Sapiens
LKESYFDAV

SEQ ID NO: 1307009 - protein, 9 aa, Homo Sapiens
HLYRVISKN

SEQ ID NO: 1307010 - protein, 9 aa, Homo Sapiens
NFICTVYIE

SEQ ID NO: 1307011 - protein, 9 aa, Homo Sapiens
RDDLEALGN

SEQ ID NO: 1307012 - protein, 9 aa, Homo Sapiens
DNIPNEVYA

SEQ ID NO: 1307013 - protein, 9 aa, Homo Sapiens
SVTVMSTFT

SEQ ID NO: 1307014 - protein, 9 aa, Homo Sapiens
NALDNISHL

SEQ ID NO: 1307015 - protein, 9 aa, Homo Sapiens
WMGSEGHQD

SEQ ID NO: 1307016 - protein, 9 aa, Homo Sapiens
PNHSKLSNV

SEQ ID NO: 1307017 - protein, 9 aa, Homo Sapiens
LKNASTANK

SEQ ID NO: 1307018 - protein, 9 aa, Homo Sapiens
NKISDKLNF

SEQ ID NO: 1307019 - protein, 9 aa, Homo Sapiens
VFIFYSLCA

SEQ ID NO: 1307020 - protein, 9 aa, Homo Sapiens
VQKAAPSSQ

SEQ ID NO: 1307021 - protein, 9 aa, Homo Sapiens
PSRQISISE

SEQ ID NO: 1307022 - protein, 9 aa, Homo Sapiens
SFTLTVAAE

SEQ ID NO: 1307023 - protein, 9 aa, Homo Sapiens
ALLTGPLQI

SEQ ID NO: 1307024 - protein, 9 aa, Homo Sapiens
GQHFIFRHQ

SEQ ID NO: 1307025 - protein, 9 aa, Homo Sapiens
EYQSPVQEN

SEQ ID NO: 1307026 - protein, 9 aa, Homo Sapiens
NRLLLELNA

SEQ ID NO: 1307027 - protein, 9 aa, Homo Sapiens
EIMRNQLSV

SEQ ID NO: 1307028 - protein, 9 aa, Homo Sapiens
SDKIEHVGD

SEQ ID NO: 1307029 - protein, 9 aa, Homo Sapiens
CNEQEQNLE

SEQ ID NO: 1307030 - protein, 9 aa, Homo Sapiens
SEAQNISRS

SEQ ID NO: 1307031 - protein, 9 aa, Homo Sapiens
KINWEFKNE

SEQ ID NO: 1307032 - protein, 9 aa, Homo Sapiens
YVDYLSSSL

SEQ ID NO: 1307033 - protein, 9 aa, Homo Sapiens
YADAFDSYY

SEQ ID NO: 1307034 - protein, 9 aa, Homo Sapiens
DKITQFWLY

SEQ ID NO: 1307035 - protein, 9 aa, Homo Sapiens
QNEHIGDKP

SEQ ID NO: 1307036 - protein, 9 aa, Homo Sapiens
QNCQVMNIT

SEQ ID NO: 1307037 - protein, 9 aa, Homo Sapiens
AFNPMCRYD

SEQ ID NO: 1307038 - protein, 9 aa, Homo Sapiens
DGTPVIYHN

SEQ ID NO: 1307039 - protein, 9 aa, Homo Sapiens
DRNPKEIEW

SEQ ID NO: 1307040 - protein, 9 aa, Homo Sapiens
LGLSPSNNS

SEQ ID NO: 1307041 - protein, 9 aa, Homo Sapiens
STARAAQVA

SEQ ID NO: 1307042 - protein, 9 aa, Homo Sapiens
APGSYVDYL

SEQ ID NO: 1307043 - protein, 9 aa, Homo Sapiens
RGVETCGII

SEQ ID NO: 1307044 - protein, 9 aa, Homo Sapiens
KYNGKYEVC

SEQ ID NO: 1307045 - protein, 9 aa, Homo Sapiens
IAVIRELKC

SEQ ID NO: 1307046 - protein, 9 aa, Homo Sapiens
IGTNKKKLL

SEQ ID NO: 1307047 - protein, 9 aa, Homo Sapiens
NPDFSDAKD

SEQ ID NO: 1307048 - protein, 9 aa, Homo Sapiens
GIEWIIEEV

SEQ ID NO: 1307049 - protein, 9 aa, Homo Sapiens
GNYLGQMPI

SEQ ID NO: 1307050 - protein, 9 aa, Homo Sapiens
KYKLESCVA

SEQ ID NO: 1307051 - protein, 9 aa, Homo Sapiens
RPVSRGGIG

SEQ ID NO: 1307052 - protein, 9 aa, Homo Sapiens
SNSNEPSSD

SEQ ID NO: 1307053 - protein, 9 aa, Homo Sapiens
SPGEVGQLG

SEQ ID NO: 1307054 - protein, 9 aa, Homo Sapiens
KRIHTGDKP

SEQ ID NO: 1307055 - protein, 9 aa, Homo Sapiens
RVTRLVLPV

SEQ ID NO: 1307056 - protein, 9 aa, Homo Sapiens
SPSVYMGIR

SEQ ID NO: 1307057 - protein, 9 aa, Homo Sapiens
LMQSSSAKQ

SEQ ID NO: 1307058 - protein, 9 aa, Homo Sapiens
KHMNYSEQA

SEQ ID NO: 1307059 - protein, 9 aa, Homo Sapiens
FRYDRFIEY

SEQ ID NO: 1307060 - protein, 9 aa, Homo Sapiens
ETMVPFVSD

SEQ ID NO: 1307061 - protein, 9 aa, Homo Sapiens
VQHLINQWR

SEQ ID NO: 1307062 - protein, 9 aa, Homo Sapiens
KIIPSYMSI

SEQ ID NO: 1307063 - protein, 9 aa, Homo Sapiens
GIHHGSADA

SEQ ID NO: 1307064 - protein, 9 aa, Homo Sapiens
KQDKIKTNI

SEQ ID NO: 1307065 - protein, 9 aa, Homo Sapiens
EDKSDPPDG

SEQ ID NO: 1307066 - protein, 9 aa, Homo Sapiens
MKFRLPLSY

SEQ ID NO: 1307067 - protein, 9 aa, Homo Sapiens
SISEQLYDR

SEQ ID NO: 1307068 - protein, 9 aa, Homo Sapiens
YEWDKPRII

SEQ ID NO: 1307069 - protein, 9 aa, Homo Sapiens
NHDGEYRFI

SEQ ID NO: 1307070 - protein, 9 aa, Homo Sapiens
PCRFNTNTR

SEQ ID NO: 1307071 - protein, 9 aa, Homo Sapiens
EYNHKEWIE

SEQ ID NO: 1307072 - protein, 9 aa, Homo Sapiens
SSQHYCGVC

SEQ ID NO: 1307073 - protein, 9 aa, Homo Sapiens
KLKLEQCMV

SEQ ID NO: 1307074 - protein, 9 aa, Homo Sapiens
SSLSLDSTP

SEQ ID NO: 1307075 - protein, 9 aa, Homo Sapiens
MTEKEHGNR

SEQ ID NO: 1307076 - protein, 9 aa, Homo Sapiens
YNNWPDHDV

SEQ ID NO: 1307077 - protein, 9 aa, Homo Sapiens
LCELLALEE

SEQ ID NO: 1307078 - protein, 9 aa, Homo Sapiens
FLGLLALGA

SEQ ID NO: 1307079 - protein, 9 aa, Homo Sapiens
TSTIDLTCN

SEQ ID NO: 1307080 - protein, 9 aa, Homo Sapiens
VALTVIRII

SEQ ID NO: 1307081 - protein, 9 aa, Homo Sapiens
VVPLLNHFI

SEQ ID NO: 1307082 - protein, 9 aa, Homo Sapiens
QWVLTAVHC

SEQ ID NO: 1307083 - protein, 9 aa, Homo Sapiens
TGPLCIFGI

SEQ ID NO: 1307084 - protein, 9 aa, Homo Sapiens
LDLPQNQIS

SEQ ID NO: 1307085 - protein, 9 aa, Homo Sapiens
ELHSSQHYC

SEQ ID NO: 1307086 - protein, 9 aa, Homo Sapiens
SGKSYYKVN

SEQ ID NO: 1307087 - protein, 9 aa, Homo Sapiens
SSNTALIMP

SEQ ID NO: 1307088 - protein, 9 aa, Homo Sapiens
PLTLQFIYS

SEQ ID NO: 1307089 - protein, 9 aa, Homo Sapiens
TSVAPCTDL

SEQ ID NO: 1307090 - protein, 9 aa, Homo Sapiens
PKYQCLILL

SEQ ID NO: 1307091 - protein, 9 aa, Homo Sapiens
ELVEKKHSS

SEQ ID NO: 1307092 - protein, 9 aa, Homo Sapiens
HKLERKIVE

SEQ ID NO: 1307093 - protein, 9 aa, Homo Sapiens
DVLAVKSFQ

SEQ ID NO: 1307094 - protein, 9 aa, Homo Sapiens
CTYIDFIYR

SEQ ID NO: 1307095 - protein, 9 aa, Homo Sapiens
DQYLSGDDI

SEQ ID NO: 1307096 - protein, 9 aa, Homo Sapiens
VDIKKINYS

SEQ ID NO: 1307097 - protein, 9 aa, Homo Sapiens
GQRSERNKW

SEQ ID NO: 1307098 - protein, 9 aa, Homo Sapiens
SLSFWLKRN

SEQ ID NO: 1307099 - protein, 9 aa, Homo Sapiens
QEVVSFSPD

SEQ ID NO: 1307100 - protein, 9 aa, Homo Sapiens
SGPDKLLAL

SEQ ID NO: 1307101 - protein, 9 aa, Homo Sapiens
SNNAVEIIN

SEQ ID NO: 1307102 - protein, 9 aa, Homo Sapiens
AGGILAVGV

SEQ ID NO: 1307103 - protein, 9 aa, Homo Sapiens
NYSEQAHTA

SEQ ID NO: 1307104 - protein, 9 aa, Homo Sapiens
SSLQCWLFL

SEQ ID NO: 1307105 - protein, 9 aa, Homo Sapiens
EDCFGMWIE

SEQ ID NO: 1307106 - protein, 9 aa, Homo Sapiens
EKGPEEKQS

SEQ ID NO: 1307107 - protein, 9 aa, Homo Sapiens
KKYTRFEKN

SEQ ID NO: 1307108 - protein, 9 aa, Homo Sapiens
NCQVMNITN

SEQ ID NO: 1307109 - protein, 9 aa, Homo Sapiens
VKKKHTNKN

SEQ ID NO: 1307110 - protein, 9 aa, Homo Sapiens
NISVVGRRH

SEQ ID NO: 1307111 - protein, 9 aa, Homo Sapiens
WFSEYVYKV

SEQ ID NO: 1307112 - protein, 9 aa, Homo Sapiens
TIYYNASLL

SEQ ID NO: 1307113 - protein, 9 aa, Homo Sapiens
NEKINWEFK

SEQ ID NO: 1307114 - protein, 9 aa, Homo Sapiens
KTFTRSVSE

SEQ ID NO: 1307115 - protein, 9 aa, Homo Sapiens
QITLECRAE

SEQ ID NO: 1307116 - protein, 9 aa, Homo Sapiens
QEKDYLITP

SEQ ID NO: 1307117 - protein, 9 aa, Homo Sapiens
IILVNQPGS

SEQ ID NO: 1307118 - protein, 9 aa, Homo Sapiens
EYMGHIMEK

SEQ ID NO: 1307119 - protein, 9 aa, Homo Sapiens
NLEYLRPRS

SEQ ID NO: 1307120 - protein, 9 aa, Homo Sapiens
DKKSNKSLI

SEQ ID NO: 1307121 - protein, 9 aa, Homo Sapiens
DNVKKKHTN

SEQ ID NO: 1307122 - protein, 9 aa, Homo Sapiens
RINIIRQNL

SEQ ID NO: 1307123 - protein, 9 aa, Homo Sapiens
SEASAYPEA

SEQ ID NO: 1307124 - protein, 9 aa, Homo Sapiens
ELDKIFQED

SEQ ID NO: 1307125 - protein, 9 aa, Homo Sapiens
MKVLELLAK

SEQ ID NO: 1307126 - protein, 9 aa, Homo Sapiens
TTARPYECV

SEQ ID NO: 1307127 - protein, 9 aa, Homo Sapiens
VGAVGVGKS

SEQ ID NO: 1307128 - protein, 9 aa, Homo Sapiens
LISNENKIF

SEQ ID NO: 1307129 - protein, 9 aa, Homo Sapiens
TEKEHGNRV

SEQ ID NO: 1307130 - protein, 9 aa, Homo Sapiens
DPEAIILVN

SEQ ID NO: 1307131 - protein, 9 aa, Homo Sapiens
KQYINGLKF

SEQ ID NO: 1307132 - protein, 9 aa, Homo Sapiens
GFEPGPMIN

SEQ ID NO: 1307133 - protein, 9 aa, Homo Sapiens
GEVGQLGPE

SEQ ID NO: 1307134 - protein, 9 aa, Homo Sapiens
ALTSTIDLT

SEQ ID NO: 1307135 - protein, 9 aa, Homo Sapiens
DLIRFCWLM

SEQ ID NO: 1307136 - protein, 9 aa, Homo Sapiens
GNKYLNETA

SEQ ID NO: 1307137 - protein, 9 aa, Homo Sapiens
AAVGKKKKY

SEQ ID NO: 1307138 - protein, 9 aa, Homo Sapiens
RNQLPLIVD

SEQ ID NO: 1307139 - protein, 9 aa, Homo Sapiens
KQVSGEIRT

SEQ ID NO: 1307140 - protein, 9 aa, Homo Sapiens
ASADCQYVI

SEQ ID NO: 1307141 - protein, 9 aa, Homo Sapiens
GGAHKATKS

SEQ ID NO: 1307142 - protein, 9 aa, Homo Sapiens
IFHITENSY

SEQ ID NO: 1307143 - protein, 9 aa, Homo Sapiens
AHIKCRHKR

SEQ ID NO: 1307144 - protein, 9 aa, Homo Sapiens
RPKDKRVTL

SEQ ID NO: 1307145 - protein, 9 aa, Homo Sapiens
FQYIILEAR

SEQ ID NO: 1307146 - protein, 9 aa, Homo Sapiens
LTAVHCVEP

SEQ ID NO: 1307147 - protein, 9 aa, Homo Sapiens
KCQKHAPIH

SEQ ID NO: 1307148 - protein, 9 aa, Homo Sapiens
LHIYYKKCP

SEQ ID NO: 1307149 - protein, 9 aa, Homo Sapiens
PKTLDKFTI

SEQ ID NO: 1307150 - protein, 9 aa, Homo Sapiens
WKHMNYSEQ

SEQ ID NO: 1307151 - protein, 9 aa, Homo Sapiens
KNQQRQQKI

SEQ ID NO: 1307152 - protein, 9 aa, Homo Sapiens
QTEQNCQVM

SEQ ID NO: 1307153 - protein, 9 aa, Homo Sapiens
NAASEEGDK

SEQ ID NO: 1307154 - protein, 9 aa, Homo Sapiens
IISCFMGHT

SEQ ID NO: 1307155 - protein, 9 aa, Homo Sapiens
LAILSLHIY

SEQ ID NO: 1307156 - protein, 9 aa, Homo Sapiens
GPVGFPGYP

SEQ ID NO: 1307157 - protein, 9 aa, Homo Sapiens
LSSGNEEHK

SEQ ID NO: 1307158 - protein, 9 aa, Homo Sapiens
LLTGPLQIN

SEQ ID NO: 1307159 - protein, 9 aa, Homo Sapiens
DEFNQIDAS

SEQ ID NO: 1307160 - protein, 9 aa, Homo Sapiens
NPNFKVFRY

SEQ ID NO: 1307161 - protein, 9 aa, Homo Sapiens
SGILTFMTS

SEQ ID NO: 1307162 - protein, 9 aa, Homo Sapiens
QEASADCQY

SEQ ID NO: 1307163 - protein, 9 aa, Homo Sapiens
EVEHVMKRK

SEQ ID NO: 1307164 - protein, 9 aa, Homo Sapiens
KAFIHGSHL

SEQ ID NO: 1307165 - protein, 9 aa, Homo Sapiens
AQEKDYLIT

SEQ ID NO: 1307166 - protein, 9 aa, Homo Sapiens
KQGQSMHLS

SEQ ID NO: 1307167 - protein, 9 aa, Homo Sapiens
EIVKSLSED

SEQ ID NO: 1307168 - protein, 9 aa, Homo Sapiens
DGAYLFQTF

SEQ ID NO: 1307169 - protein, 9 aa, Homo Sapiens
KNHLSSVSV

SEQ ID NO: 1307170 - protein, 9 aa, Homo Sapiens
KFLWLSVLQ

SEQ ID NO: 1307171 - protein, 9 aa, Homo Sapiens
SSSEDSITP

SEQ ID NO: 1307172 - protein, 9 aa, Homo Sapiens
VNYGDASKA

SEQ ID NO: 1307173 - protein, 9 aa, Homo Sapiens
CIILGMMAF

SEQ ID NO: 1307174 - protein, 9 aa, Homo Sapiens
ALSKVQGWK

SEQ ID NO: 1307175 - protein, 9 aa, Homo Sapiens
VPPRITSRT

SEQ ID NO: 1307176 - protein, 9 aa, Homo Sapiens
HNAKYLATI

SEQ ID NO: 1307177 - protein, 9 aa, Homo Sapiens
GSHYIVDGN

SEQ ID NO: 1307178 - protein, 9 aa, Homo Sapiens
HYDIITSLQ

SEQ ID NO: 1307179 - protein, 9 aa, Homo Sapiens
EKQPDKKSN

SEQ ID NO: 1307180 - protein, 9 aa, Homo Sapiens
DVSSCQYII

SEQ ID NO: 1307181 - protein, 9 aa, Homo Sapiens
FGKDGSNLV

SEQ ID NO: 1307182 - protein, 9 aa, Homo Sapiens
LLQKPNARI

SEQ ID NO: 1307183 - protein, 9 aa, Homo Sapiens
GTKPEPRDG

SEQ ID NO: 1307184 - protein, 9 aa, Homo Sapiens
VMGKDFTRT

SEQ ID NO: 1307185 - protein, 9 aa, Homo Sapiens
PGIHKRYFR

SEQ ID NO: 1307186 - protein, 9 aa, Homo Sapiens
NTLFDAGAA

SEQ ID NO: 1307187 - protein, 9 aa, Homo Sapiens
LLFWYQLFC

SEQ ID NO: 1307188 - protein, 9 aa, Homo Sapiens
IRALVMYLW

SEQ ID NO: 1307189 - protein, 9 aa, Homo Sapiens
AFSPPIKHP

SEQ ID NO: 1307190 - protein, 9 aa, Homo Sapiens
DKLKYNDTE

SEQ ID NO: 1307191 - protein, 9 aa, Homo Sapiens
MLNDSLYNP

SEQ ID NO: 1307192 - protein, 9 aa, Homo Sapiens
QPKLGNIAN

SEQ ID NO: 1307193 - protein, 9 aa, Homo Sapiens
QQEESVRGD

SEQ ID NO: 1307194 - protein, 9 aa, Homo Sapiens
KGSNSNEPS

SEQ ID NO: 1307195 - protein, 9 aa, Homo Sapiens
TLTSHKIIH

SEQ ID NO: 1307196 - protein, 9 aa, Homo Sapiens
LVMYLWLQL

SEQ ID NO: 1307197 - protein, 9 aa, Homo Sapiens
LKELRAKED

SEQ ID NO: 1307198 - protein, 9 aa, Homo Sapiens
VLQNAIKSS

SEQ ID NO: 1307199 - protein, 9 aa, Homo Sapiens
SVQALQHKH

SEQ ID NO: 1307200 - protein, 9 aa, Homo Sapiens
AFVTPTILN

SEQ ID NO: 1307201 - protein, 9 aa, Homo Sapiens
SHKLERKIV

SEQ ID NO: 1307202 - protein, 9 aa, Homo Sapiens
PGEVGQLGP

SEQ ID NO: 1307203 - protein, 9 aa, Homo Sapiens
IPNLSRNCQ

SEQ ID NO: 1307204 - protein, 9 aa, Homo Sapiens
LDIYGRTAL

SEQ ID NO: 1307205 - protein, 9 aa, Homo Sapiens
EIDTINGKL

SEQ ID NO: 1307206 - protein, 9 aa, Homo Sapiens
SNNSSRRNQ

SEQ ID NO: 1307207 - protein, 9 aa, Homo Sapiens
GKQNKDDEK

SEQ ID NO: 1307208 - protein, 9 aa, Homo Sapiens
TELIYREQK

SEQ ID NO: 1307209 - protein, 9 aa, Homo Sapiens
QEGKWKALK

SEQ ID NO: 1307210 - protein, 9 aa, Homo Sapiens
LVLPVGATI

SEQ ID NO: 1307211 - protein, 9 aa, Homo Sapiens
AFQITLECR

SEQ ID NO: 1307212 - protein, 9 aa, Homo Sapiens
IIRDFVLPW

SEQ ID NO: 1307213 - protein, 9 aa, Homo Sapiens
DAIQVLPKM

SEQ ID NO: 1307214 - protein, 9 aa, Homo Sapiens
KQNPRSKNK

SEQ ID NO: 1307215 - protein, 9 aa, Homo Sapiens
PRPHQQPTT

SEQ ID NO: 1307216 - protein, 9 aa, Homo Sapiens
GVLRITERL

SEQ ID NO: 1307217 - protein, 9 aa, Homo Sapiens
IFSQYNPGI

SEQ ID NO: 1307218 - protein, 9 aa, Homo Sapiens
TFNIPVISE

SEQ ID NO: 1307219 - protein, 9 aa, Homo Sapiens
KLLYIYGAL

SEQ ID NO: 1307220 - protein, 9 aa, Homo Sapiens
QNKDDEKYL

SEQ ID NO: 1307221 - protein, 9 aa, Homo Sapiens
TMLLGVLPK

SEQ ID NO: 1307222 - protein, 9 aa, Homo Sapiens
ELITVFWMG

SEQ ID NO: 1307223 - protein, 9 aa, Homo Sapiens
INSRACYAM

SEQ ID NO: 1307224 - protein, 9 aa, Homo Sapiens
WRDYLLKVL

SEQ ID NO: 1307225 - protein, 9 aa, Homo Sapiens
IVAFAINHQ

SEQ ID NO: 1307226 - protein, 9 aa, Homo Sapiens
HNNLNPVWE

SEQ ID NO: 1307227 - protein, 9 aa, Homo Sapiens
SAAPSSRFP

SEQ ID NO: 1307228 - protein, 9 aa, Homo Sapiens
LTTHKIIST

SEQ ID NO: 1307229 - protein, 9 aa, Homo Sapiens
PNKYNLSFD

SEQ ID NO: 1307230 - protein, 9 aa, Homo Sapiens
KEHRPKDKR

SEQ ID NO: 1307231 - protein, 9 aa, Homo Sapiens
VVRGHYRTE

SEQ ID NO: 1307232 - protein, 9 aa, Homo Sapiens
NVVFEQIPE

SEQ ID NO: 1307233 - protein, 9 aa, Homo Sapiens
AIVAALKCL

SEQ ID NO: 1307234 - protein, 9 aa, Homo Sapiens
ICIRKMDHH

SEQ ID NO: 1307235 - protein, 9 aa, Homo Sapiens
NENNASGYS

SEQ ID NO: 1307236 - protein, 9 aa, Homo Sapiens
LNDTLEHKK

SEQ ID NO: 1307237 - protein, 9 aa, Homo Sapiens
SSIHRHRKS

SEQ ID NO: 1307238 - protein, 9 aa, Homo Sapiens
IADDPQDKA

SEQ ID NO: 1307239 - protein, 9 aa, Homo Sapiens
ANKCVSCQN

SEQ ID NO: 1307240 - protein, 9 aa, Homo Sapiens
DKDDWASNK

SEQ ID NO: 1307241 - protein, 9 aa, Homo Sapiens
EKDYLITPH

SEQ ID NO: 1307242 - protein, 9 aa, Homo Sapiens
SCDLSVLGS

SEQ ID NO: 1307243 - protein, 9 aa, Homo Sapiens
FITYGLFCG

SEQ ID NO: 1307244 - protein, 9 aa, Homo Sapiens
RRPSPNHSK

SEQ ID NO: 1307245 - protein, 9 aa, Homo Sapiens
LRGDKDPKG

SEQ ID NO: 1307246 - protein, 9 aa, Homo Sapiens
QKTYLIGSH

SEQ ID NO: 1307247 - protein, 9 aa, Homo Sapiens
KGPSAKQRY

SEQ ID NO: 1307248 - protein, 9 aa, Homo Sapiens
IICGLTLIH

SEQ ID NO: 1307249 - protein, 9 aa, Homo Sapiens
GLIGMHREM

SEQ ID NO: 1307250 - protein, 9 aa, Homo Sapiens
KTLQNHWKK

SEQ ID NO: 1307251 - protein, 9 aa, Homo Sapiens
AGGAHKATK

SEQ ID NO: 1307252 - protein, 9 aa, Homo Sapiens
VTCKTFEEI

SEQ ID NO: 1307253 - protein, 9 aa, Homo Sapiens
GGRQTQEQQ

SEQ ID NO: 1307254 - protein, 9 aa, Homo Sapiens
QDSKLFENK

SEQ ID NO: 1307255 - protein, 9 aa, Homo Sapiens
KSFSCVSLL

SEQ ID NO: 1307256 - protein, 9 aa, Homo Sapiens
EFAPHLKGR

SEQ ID NO: 1307257 - protein, 9 aa, Homo Sapiens
SMDYVPYTE

SEQ ID NO: 1307258 - protein, 9 aa, Homo Sapiens
STTSHGSPR

SEQ ID NO: 1307259 - protein, 9 aa, Homo Sapiens
EEVIQEKLL

SEQ ID NO: 1307260 - protein, 9 aa, Homo Sapiens
VILHSLKPQ

SEQ ID NO: 1307261 - protein, 9 aa, Homo Sapiens
FRGKMSRIT

SEQ ID NO: 1307262 - protein, 9 aa, Homo Sapiens
KEILIKKLD

SEQ ID NO: 1307263 - protein, 9 aa, Homo Sapiens
KTEDKLKYN

SEQ ID NO: 1307264 - protein, 9 aa, Homo Sapiens
LFKLNNAYE

SEQ ID NO: 1307265 - protein, 9 aa, Homo Sapiens
DLNENYFLS

SEQ ID NO: 1307266 - protein, 9 aa, Homo Sapiens
ITQSYYRNS

SEQ ID NO: 1307267 - protein, 9 aa, Homo Sapiens
LAVGDTISL

SEQ ID NO: 1307268 - protein, 9 aa, Homo Sapiens
DWTIQWPMT

SEQ ID NO: 1307269 - protein, 9 aa, Homo Sapiens
LLQPDKNIC

SEQ ID NO: 1307270 - protein, 9 aa, Homo Sapiens
TNNNITRGQ

SEQ ID NO: 1307271 - protein, 9 aa, Homo Sapiens
SNVIEKTET

SEQ ID NO: 1307272 - protein, 9 aa, Homo Sapiens
DSDDRKANP

SEQ ID NO: 1307273 - protein, 9 aa, Homo Sapiens
RDKMAGEGF

SEQ ID NO: 1307274 - protein, 9 aa, Homo Sapiens
RRHEIHESK

SEQ ID NO: 1307275 - protein, 9 aa, Homo Sapiens
IITAGFEPV

SEQ ID NO: 1307276 - protein, 9 aa, Homo Sapiens
TYRNKYLMW

SEQ ID NO: 1307277 - protein, 9 aa, Homo Sapiens
EDMSEPQDK

SEQ ID NO: 1307278 - protein, 9 aa, Homo Sapiens
GSNNAVEII

SEQ ID NO: 1307279 - protein, 9 aa, Homo Sapiens
KAKVRDAPK

SEQ ID NO: 1307280 - protein, 9 aa, Homo Sapiens
DVCKENICS

SEQ ID NO: 1307281 - protein, 9 aa, Homo Sapiens
NRFSQARSE

SEQ ID NO: 1307282 - protein, 9 aa, Homo Sapiens
PGNKGSMGF

SEQ ID NO: 1307283 - protein, 9 aa, Homo Sapiens
QLSEVTGTC

SEQ ID NO: 1307284 - protein, 9 aa, Homo Sapiens
IYGTIKEEN

SEQ ID NO: 1307285 - protein, 9 aa, Homo Sapiens
DYLWVKNEL

SEQ ID NO: 1307286 - protein, 9 aa, Homo Sapiens
NDVACLVIY

SEQ ID NO: 1307287 - protein, 9 aa, Homo Sapiens
KKKYVILAD

SEQ ID NO: 1307288 - protein, 9 aa, Homo Sapiens
HLALSPIYE

SEQ ID NO: 1307289 - protein, 9 aa, Homo Sapiens
DANEFISII

SEQ ID NO: 1307290 - protein, 9 aa, Homo Sapiens
YNDTENKDV

SEQ ID NO: 1307291 - protein, 9 aa, Homo Sapiens
LEMLNDSLY

SEQ ID NO: 1307292 - protein, 9 aa, Homo Sapiens
VTITDAPGH

SEQ ID NO: 1307293 - protein, 9 aa, Homo Sapiens
GIGLTGRPP

SEQ ID NO: 1307294 - protein, 9 aa, Homo Sapiens
PLLLTMIIF

SEQ ID NO: 1307295 - protein, 9 aa, Homo Sapiens
EQLQLSEVT

SEQ ID NO: 1307296 - protein, 9 aa, Homo Sapiens
QCHPNTHDR

SEQ ID NO: 1307297 - protein, 9 aa, Homo Sapiens
VLPKTFQDG

SEQ ID NO: 1307298 - protein, 9 aa, Homo Sapiens
PQDKKLSEN

SEQ ID NO: 1307299 - protein, 9 aa, Homo Sapiens
QLNHDGEYR

SEQ ID NO: 1307300 - protein, 9 aa, Homo Sapiens
CVDKSKNPN

SEQ ID NO: 1307301 - protein, 9 aa, Homo Sapiens
NIQLEYRGL

SEQ ID NO: 1307302 - protein, 9 aa, Homo Sapiens
IYSTKLYRC

SEQ ID NO: 1307303 - protein, 9 aa, Homo Sapiens
DDKGKRKQK

SEQ ID NO: 1307304 - protein, 9 aa, Homo Sapiens
KEHGNRVFF

SEQ ID NO: 1307305 - protein, 9 aa, Homo Sapiens
QSWSGPDKL

SEQ ID NO: 1307306 - protein, 9 aa, Homo Sapiens
TLLQPDKNI

SEQ ID NO: 1307307 - protein, 9 aa, Homo Sapiens
ESMRSFSSS

SEQ ID NO: 1307308 - protein, 9 aa, Homo Sapiens
TYIRGIYSK

SEQ ID NO: 1307309 - protein, 9 aa, Homo Sapiens
DFQYGYSYY

SEQ ID NO: 1307310 - protein, 9 aa, Homo Sapiens
LIYREQKGT

SEQ ID NO: 1307311 - protein, 9 aa, Homo Sapiens
PIQHEIINN

SEQ ID NO: 1307312 - protein, 9 aa, Homo Sapiens
WNTSEVHNW

SEQ ID NO: 1307313 - protein, 9 aa, Homo Sapiens
LCKGYYEYL

SEQ ID NO: 1307314 - protein, 9 aa, Homo Sapiens
SGLEAMALT

SEQ ID NO: 1307315 - protein, 9 aa, Homo Sapiens
RGHYRTESR

SEQ ID NO: 1307316 - protein, 9 aa, Homo Sapiens
FPVCPIPLS

SEQ ID NO: 1307317 - protein, 9 aa, Homo Sapiens
YQSPVQENS

SEQ ID NO: 1307318 - protein, 9 aa, Homo Sapiens
GITISVTSV

SEQ ID NO: 1307319 - protein, 9 aa, Homo Sapiens
SVSSSLQIH

SEQ ID NO: 1307320 - protein, 9 aa, Homo Sapiens
IYNQTEDIR

SEQ ID NO: 1307321 - protein, 9 aa, Homo Sapiens
GPLQINPLC

SEQ ID NO: 1307322 - protein, 9 aa, Homo Sapiens
ARTPAACLN

SEQ ID NO: 1307323 - protein, 9 aa, Homo Sapiens
IKYSRYFLL

SEQ ID NO: 1307324 - protein, 9 aa, Homo Sapiens
MSTARAAQV

SEQ ID NO: 1307325 - protein, 9 aa, Homo Sapiens
QDGAYLFQT

SEQ ID NO: 1307326 - protein, 9 aa, Homo Sapiens
VRRNIFNLS

SEQ ID NO: 1307327 - protein, 9 aa, Homo Sapiens
KHKEEDTNS

SEQ ID NO: 1307328 - protein, 9 aa, Homo Sapiens
GNHEEKILN

SEQ ID NO: 1307329 - protein, 9 aa, Homo Sapiens
MLLGVLPKT

SEQ ID NO: 1307330 - protein, 9 aa, Homo Sapiens
QLSVKCWLR

SEQ ID NO: 1307331 - protein, 9 aa, Homo Sapiens
DEDIVTILQ

SEQ ID NO: 1307332 - protein, 9 aa, Homo Sapiens
PIPFDKMLY

SEQ ID NO: 1307333 - protein, 9 aa, Homo Sapiens
HLKCSQLCE

SEQ ID NO: 1307334 - protein, 9 aa, Homo Sapiens
ILSLHIYYK

SEQ ID NO: 1307335 - protein, 9 aa, Homo Sapiens
DRHPYGVAS

SEQ ID NO: 1307336 - protein, 9 aa, Homo Sapiens
SPAPVSKSS

SEQ ID NO: 1307337 - protein, 9 aa, Homo Sapiens
DKYLHEVSD

SEQ ID NO: 1307338 - protein, 9 aa, Homo Sapiens
KSCFKSIIT

SEQ ID NO: 1307339 - protein, 9 aa, Homo Sapiens
SRIYLYSLI

SEQ ID NO: 1307340 - protein, 9 aa, Homo Sapiens
EITSAISEI

SEQ ID NO: 1307341 - protein, 9 aa, Homo Sapiens
GLGFGLLSG

SEQ ID NO: 1307342 - protein, 9 aa, Homo Sapiens
LKRFIHVFF

SEQ ID NO: 1307343 - protein, 9 aa, Homo Sapiens
TCKTFEEIW

SEQ ID NO: 1307344 - protein, 9 aa, Homo Sapiens
FTLTVAAEE

SEQ ID NO: 1307345 - protein, 9 aa, Homo Sapiens
VPPLPVTRY

SEQ ID NO: 1307346 - protein, 9 aa, Homo Sapiens
RNIIPLHII

SEQ ID NO: 1307347 - protein, 9 aa, Homo Sapiens
AKKNIGKAF

SEQ ID NO: 1307348 - protein, 9 aa, Homo Sapiens
TKEEFCEAF

SEQ ID NO: 1307349 - protein, 9 aa, Homo Sapiens
HPYGVASVS

SEQ ID NO: 1307350 - protein, 9 aa, Homo Sapiens
IRHELNRLR

SEQ ID NO: 1307351 - protein, 9 aa, Homo Sapiens
DEAFLRLAQ

SEQ ID NO: 1307352 - protein, 9 aa, Homo Sapiens
EDFNKFCRF

SEQ ID NO: 1307353 - protein, 9 aa, Homo Sapiens
PEYKMNTKA

SEQ ID NO: 1307354 - protein, 9 aa, Homo Sapiens
KGNFWMIGD

SEQ ID NO: 1307355 - protein, 9 aa, Homo Sapiens
CKLVLYLHR

SEQ ID NO: 1307356 - protein, 9 aa, Homo Sapiens
QHLLSIIYL

SEQ ID NO: 1307357 - protein, 9 aa, Homo Sapiens
IGKAFLPSN

SEQ ID NO: 1307358 - protein, 9 aa, Homo Sapiens
QKLMSKNNM

SEQ ID NO: 1307359 - protein, 9 aa, Homo Sapiens
EAVLDGIKV

SEQ ID NO: 1307360 - protein, 9 aa, Homo Sapiens
AIILVNQPG

SEQ ID NO: 1307361 - protein, 9 aa, Homo Sapiens
ENERQVLDE

SEQ ID NO: 1307362 - protein, 9 aa, Homo Sapiens
GHLVVQSLP

SEQ ID NO: 1307363 - protein, 9 aa, Homo Sapiens
PYKLHGPHA

SEQ ID NO: 1307364 - protein, 9 aa, Homo Sapiens
SMPSFQLCV

SEQ ID NO: 1307365 - protein, 9 aa, Homo Sapiens
GDYLKKEFE

SEQ ID NO: 1307366 - protein, 9 aa, Homo Sapiens
KARPPQEEH

SEQ ID NO: 1307367 - protein, 9 aa, Homo Sapiens
YRNNITVPF

SEQ ID NO: 1307368 - protein, 9 aa, Homo Sapiens
FYGKQCCNS

SEQ ID NO: 1307369 - protein, 9 aa, Homo Sapiens
LQDKLSHLR

SEQ ID NO: 1307370 - protein, 9 aa, Homo Sapiens
NPVYEKKPN

SEQ ID NO: 1307371 - protein, 9 aa, Homo Sapiens
LAKKQKQNC

SEQ ID NO: 1307372 - protein, 9 aa, Homo Sapiens
SIIYSIPFF

SEQ ID NO: 1307373 - protein, 9 aa, Homo Sapiens
YFNQDDAAL

SEQ ID NO: 1307374 - protein, 9 aa, Homo Sapiens
EIQQFKAES

SEQ ID NO: 1307375 - protein, 9 aa, Homo Sapiens
YENPSSYNS

SEQ ID NO: 1307376 - protein, 9 aa, Homo Sapiens
KSFNKISDK

SEQ ID NO: 1307377 - protein, 9 aa, Homo Sapiens
YESMPSFQL

SEQ ID NO: 1307378 - protein, 9 aa, Homo Sapiens
ILGFDMYSQ

SEQ ID NO: 1307379 - protein, 9 aa, Homo Sapiens
GSGAPLLRI

SEQ ID NO: 1307380 - protein, 9 aa, Homo Sapiens
IKINYSWDD

SEQ ID NO: 1307381 - protein, 9 aa, Homo Sapiens
GEDSYGTMV

SEQ ID NO: 1307382 - protein, 9 aa, Homo Sapiens
YRGKYLELL

SEQ ID NO: 1307383 - protein, 9 aa, Homo Sapiens
KQNRKRDPI

SEQ ID NO: 1307384 - protein, 9 aa, Homo Sapiens
DEAFSLKSN

SEQ ID NO: 1307385 - protein, 9 aa, Homo Sapiens
HMVKQKIPF

SEQ ID NO: 1307386 - protein, 9 aa, Homo Sapiens
IYSIPFFFL

SEQ ID NO: 1307387 - protein, 9 aa, Homo Sapiens
AKDLPVKLF

SEQ ID NO: 1307388 - protein, 9 aa, Homo Sapiens
PHRWPLRLS

SEQ ID NO: 1307389 - protein, 9 aa, Homo Sapiens
QTPDKETAW

SEQ ID NO: 1307390 - protein, 9 aa, Homo Sapiens
NKTAELSVK

SEQ ID NO: 1307391 - protein, 9 aa, Homo Sapiens
EKKKKKDDN

SEQ ID NO: 1307392 - protein, 9 aa, Homo Sapiens
WEVLHKLGL

SEQ ID NO: 1307393 - protein, 9 aa, Homo Sapiens
DKLSLYSVC

SEQ ID NO: 1307394 - protein, 9 aa, Homo Sapiens
PLHKELNAA

SEQ ID NO: 1307395 - protein, 9 aa, Homo Sapiens
PISQVVCWR

SEQ ID NO: 1307396 - protein, 9 aa, Homo Sapiens
PVHLCVHDL

SEQ ID NO: 1307397 - protein, 9 aa, Homo Sapiens
LIHIGEKRY

SEQ ID NO: 1307398 - protein, 9 aa, Homo Sapiens
PIFIHCSAG

SEQ ID NO: 1307399 - protein, 9 aa, Homo Sapiens
PLVGMSGKQ

SEQ ID NO: 1307400 - protein, 9 aa, Homo Sapiens
DMMIVRHGF

SEQ ID NO: 1307401 - protein, 9 aa, Homo Sapiens
AFSFLAKRS

SEQ ID NO: 1307402 - protein, 9 aa, Homo Sapiens
STAFSGLGF

SEQ ID NO: 1307403 - protein, 9 aa, Homo Sapiens
IYLANTLMS

SEQ ID NO: 1307404 - protein, 9 aa, Homo Sapiens
HFIFRHQHD

SEQ ID NO: 1307405 - protein, 9 aa, Homo Sapiens
ANKRAEDDA

SEQ ID NO: 1307406 - protein, 9 aa, Homo Sapiens
KIFHITENS

SEQ ID NO: 1307407 - protein, 9 aa, Homo Sapiens
ASPKAKVRD

SEQ ID NO: 1307408 - protein, 9 aa, Homo Sapiens
MALTSTIDL

SEQ ID NO: 1307409 - protein, 9 aa, Homo Sapiens
RNKNLAGPV

SEQ ID NO: 1307410 - protein, 9 aa, Homo Sapiens
RYFLLKLSS

SEQ ID NO: 1307411 - protein, 9 aa, Homo Sapiens
AKVRDAPKK

SEQ ID NO: 1307412 - protein, 9 aa, Homo Sapiens
HTTELSRQR

SEQ ID NO: 1307413 - protein, 9 aa, Homo Sapiens
INHIVNKYQ

SEQ ID NO: 1307414 - protein, 9 aa, Homo Sapiens
LFRLIKIKI

SEQ ID NO: 1307415 - protein, 9 aa, Homo Sapiens
NSQQYEVNQ

SEQ ID NO: 1307416 - protein, 9 aa, Homo Sapiens
ECRIQLGDK

SEQ ID NO: 1307417 - protein, 9 aa, Homo Sapiens
TSETMVPFV

SEQ ID NO: 1307418 - protein, 9 aa, Homo Sapiens
DFSDAKDNF

SEQ ID NO: 1307419 - protein, 9 aa, Homo Sapiens
TGAYGKLFL

SEQ ID NO: 1307420 - protein, 9 aa, Homo Sapiens
LLPQIKNKS

SEQ ID NO: 1307421 - protein, 9 aa, Homo Sapiens
ETGIMTDKR

SEQ ID NO: 1307422 - protein, 9 aa, Homo Sapiens
AKTAQEKDY

SEQ ID NO: 1307423 - protein, 9 aa, Homo Sapiens
IFIADDPQD

SEQ ID NO: 1307424 - protein, 9 aa, Homo Sapiens
DVSDLIIFY

SEQ ID NO: 1307425 - protein, 9 aa, Homo Sapiens
GKVIGDGKF

SEQ ID NO: 1307426 - protein, 9 aa, Homo Sapiens
LQGFPFYDK

SEQ ID NO: 1307427 - protein, 9 aa, Homo Sapiens
FEDDYRGKY

SEQ ID NO: 1307428 - protein, 9 aa, Homo Sapiens
SCSTVHEKF

SEQ ID NO: 1307429 - protein, 9 aa, Homo Sapiens
IVTILQATP

SEQ ID NO: 1307430 - protein, 9 aa, Homo Sapiens
EENEKLSSC

SEQ ID NO: 1307431 - protein, 9 aa, Homo Sapiens
LNMLSDPCV

SEQ ID NO: 1307432 - protein, 9 aa, Homo Sapiens
SLRIRSELS

SEQ ID NO: 1307433 - protein, 9 aa, Homo Sapiens
EYVYKVVVD

SEQ ID NO: 1307434 - protein, 9 aa, Homo Sapiens
LIALGNTYR

SEQ ID NO: 1307435 - protein, 9 aa, Homo Sapiens
IHKKTNLCK

SEQ ID NO: 1307436 - protein, 9 aa, Homo Sapiens
NETVFKHSL

SEQ ID NO: 1307437 - protein, 9 aa, Homo Sapiens
PLVVQPSRP

SEQ ID NO: 1307438 - protein, 9 aa, Homo Sapiens
SDPPDGSEE

SEQ ID NO: 1307439 - protein, 9 aa, Homo Sapiens
QNTEEFIRV

SEQ ID NO: 1307440 - protein, 9 aa, Homo Sapiens
IRFCWLMAV

SEQ ID NO: 1307441 - protein, 9 aa, Homo Sapiens
TVFAIYWGQ

SEQ ID NO: 1307442 - protein, 9 aa, Homo Sapiens
EIIDQYLSG

SEQ ID NO: 1307443 - protein, 9 aa, Homo Sapiens
FFKQECIIL

SEQ ID NO: 1307444 - protein, 9 aa, Homo Sapiens
TFLELAVFD

SEQ ID NO: 1307445 - protein, 9 aa, Homo Sapiens
IIVLNQGKV

SEQ ID NO: 1307446 - protein, 9 aa, Homo Sapiens
VKNVTCKNK

SEQ ID NO: 1307447 - protein, 9 aa, Homo Sapiens
LYLQSIPRP

SEQ ID NO: 1307448 - protein, 9 aa, Homo Sapiens
SVSSLSLDS

SEQ ID NO: 1307449 - protein, 9 aa, Homo Sapiens
PEAIILVNQ

SEQ ID NO: 1307450 - protein, 9 aa, Homo Sapiens
TLFGMFAMC

SEQ ID NO: 1307451 - protein, 9 aa, Homo Sapiens
NGRPLPNTI

SEQ ID NO: 1307452 - protein, 9 aa, Homo Sapiens
TINQDPLGK

SEQ ID NO: 1307453 - protein, 9 aa, Homo Sapiens
QNGGVGREV

SEQ ID NO: 1307454 - protein, 9 aa, Homo Sapiens
LLVKLNDHN

SEQ ID NO: 1307455 - protein, 9 aa, Homo Sapiens
DVDWNVEFS

SEQ ID NO: 1307456 - protein, 9 aa, Homo Sapiens
TWFEAHVDK

SEQ ID NO: 1307457 - protein, 9 aa, Homo Sapiens
GIKYEHTIQ

SEQ ID NO: 1307458 - protein, 9 aa, Homo Sapiens
AVDHTTELS

SEQ ID NO: 1307459 - protein, 9 aa, Homo Sapiens
MILEDKRML

SEQ ID NO: 1307460 - protein, 9 aa, Homo Sapiens
GRESYMSTL

SEQ ID NO: 1307461 - protein, 9 aa, Homo Sapiens
QISTLHAII

SEQ ID NO: 1307462 - protein, 9 aa, Homo Sapiens
VVQSLPIRS

SEQ ID NO: 1307463 - protein, 9 aa, Homo Sapiens
SDRDKAFIH

SEQ ID NO: 1307464 - protein, 9 aa, Homo Sapiens
LQRPKMLKE

SEQ ID NO: 1307465 - protein, 9 aa, Homo Sapiens
IRLPELTKN

SEQ ID NO: 1307466 - protein, 9 aa, Homo Sapiens
IVSSCAVVA

SEQ ID NO: 1307467 - protein, 9 aa, Homo Sapiens
QLPAYPSCR

SEQ ID NO: 1307468 - protein, 9 aa, Homo Sapiens
EGNYLGQMP

SEQ ID NO: 1307469 - protein, 9 aa, Homo Sapiens
FGCRSFALF

SEQ ID NO: 1307470 - protein, 9 aa, Homo Sapiens
EVSDTLKTL

SEQ ID NO: 1307471 - protein, 9 aa, Homo Sapiens
KINYSRVAK

SEQ ID NO: 1307472 - protein, 9 aa, Homo Sapiens
NVKKLAVAK

SEQ ID NO: 1307473 - protein, 9 aa, Homo Sapiens
MEASPKAKV

SEQ ID NO: 1307474 - protein, 9 aa, Homo Sapiens
RPYECSDRD

SEQ ID NO: 1307475 - protein, 9 aa, Homo Sapiens
SNKILFNVD

SEQ ID NO: 1307476 - protein, 9 aa, Homo Sapiens
RAALIAYLK

SEQ ID NO: 1307477 - protein, 9 aa, Homo Sapiens
LWPLYQFNK

SEQ ID NO: 1307478 - protein, 9 aa, Homo Sapiens
LLAVLNNGR

SEQ ID NO: 1307479 - protein, 9 aa, Homo Sapiens
ENDLRSTPN

SEQ ID NO: 1307480 - protein, 9 aa, Homo Sapiens
VTGDVCKEN

SEQ ID NO: 1307481 - protein, 9 aa, Homo Sapiens
SQTAVVMKT

SEQ ID NO: 1307482 - protein, 9 aa, Homo Sapiens
KLMSRIDKQ

SEQ ID NO: 1307483 - protein, 9 aa, Homo Sapiens
TPSTPEPNK

SEQ ID NO: 1307484 - protein, 9 aa, Homo Sapiens
LPTRNKNLA

SEQ ID NO: 1307485 - protein, 9 aa, Homo Sapiens
KRKQKSSTS

SEQ ID NO: 1307486 - protein, 9 aa, Homo Sapiens
LSYTKIFDV

SEQ ID NO: 1307487 - protein, 9 aa, Homo Sapiens
QLEELDKIF

SEQ ID NO: 1307488 - protein, 9 aa, Homo Sapiens
EDQIEDFSK

SEQ ID NO: 1307489 - protein, 9 aa, Homo Sapiens
HYVCCIKPN

SEQ ID NO: 1307490 - protein, 9 aa, Homo Sapiens
ISFNWCMAQ

SEQ ID NO: 1307491 - protein, 9 aa, Homo Sapiens
MQTSRLMAQ

SEQ ID NO: 1307492 - protein, 9 aa, Homo Sapiens
ATQLVRKGE

SEQ ID NO: 1307493 - protein, 9 aa, Homo Sapiens
QELLDIRHE

SEQ ID NO: 1307494 - protein, 9 aa, Homo Sapiens
MFNLKFAQA

SEQ ID NO: 1307495 - protein, 9 aa, Homo Sapiens
QDGTLQSCS

SEQ ID NO: 1307496 - protein, 9 aa, Homo Sapiens
SRLRDTFLE

SEQ ID NO: 1307497 - protein, 9 aa, Homo Sapiens
DMYKDPDYV

SEQ ID NO: 1307498 - protein, 9 aa, Homo Sapiens
FLRLAQSRT

SEQ ID NO: 1307499 - protein, 9 aa, Homo Sapiens
KLTIINLLT

SEQ ID NO: 1307500 - protein, 9 aa, Homo Sapiens
SRVQFQNQG

SEQ ID NO: 1307501 - protein, 9 aa, Homo Sapiens
DEEEETVFQ

SEQ ID NO: 1307502 - protein, 9 aa, Homo Sapiens
LARIGSGKL

SEQ ID NO: 1307503 - protein, 9 aa, Homo Sapiens
PKMLKEETR

SEQ ID NO: 1307504 - protein, 9 aa, Homo Sapiens
FNLSAPEKD

SEQ ID NO: 1307505 - protein, 9 aa, Homo Sapiens
LSIIMISYC

SEQ ID NO: 1307506 - protein, 9 aa, Homo Sapiens
QTFYATPVT

SEQ ID NO: 1307507 - protein, 9 aa, Homo Sapiens
EMEIHITLE

SEQ ID NO: 1307508 - protein, 9 aa, Homo Sapiens
KGHTINKST

SEQ ID NO: 1307509 - protein, 9 aa, Homo Sapiens
LQLRMYKNK

SEQ ID NO: 1307510 - protein, 9 aa, Homo Sapiens
EGSNKILFN

SEQ ID NO: 1307511 - protein, 9 aa, Homo Sapiens
VDSQPKEDT

SEQ ID NO: 1307512 - protein, 9 aa, Homo Sapiens
GKSFCRKSA

SEQ ID NO: 1307513 - protein, 9 aa, Homo Sapiens
PNARIVVLF

SEQ ID NO: 1307514 - protein, 9 aa, Homo Sapiens
LKRDCGAKT

SEQ ID NO: 1307515 - protein, 9 aa, Homo Sapiens
LPLIVDAIC

SEQ ID NO: 1307516 - protein, 9 aa, Homo Sapiens
QNKKSVTEM

SEQ ID NO: 1307517 - protein, 9 aa, Homo Sapiens
MPSATISKT

SEQ ID NO: 1307518 - protein, 9 aa, Homo Sapiens
MIPLDPVHL

SEQ ID NO: 1307519 - protein, 9 aa, Homo Sapiens
EDGEGPSTF

SEQ ID NO: 1307520 - protein, 9 aa, Homo Sapiens
DDLPTRNKN

SEQ ID NO: 1307521 - protein, 9 aa, Homo Sapiens
RMSQFIEKE

SEQ ID NO: 1307522 - protein, 9 aa, Homo Sapiens
LPETTQNFI

SEQ ID NO: 1307523 - protein, 9 aa, Homo Sapiens
NQNINAVHS

SEQ ID NO: 1307524 - protein, 9 aa, Homo Sapiens
SFPTVFAIY

SEQ ID NO: 1307525 - protein, 9 aa, Homo Sapiens
RTIYQFHYN

SEQ ID NO: 1307526 - protein, 9 aa, Homo Sapiens
KMHEIYKGK

SEQ ID NO: 1307527 - protein, 9 aa, Homo Sapiens
SNTALIMPV

SEQ ID NO: 1307528 - protein, 9 aa, Homo Sapiens
FDPNRFSQA

SEQ ID NO: 1307529 - protein, 9 aa, Homo Sapiens
RDTFLELAV

SEQ ID NO: 1307530 - protein, 9 aa, Homo Sapiens
HYPDYENIT

SEQ ID NO: 1307531 - protein, 9 aa, Homo Sapiens
CTLNENCTC

SEQ ID NO: 1307532 - protein, 9 aa, Homo Sapiens
CLVIYRETF

SEQ ID NO: 1307533 - protein, 9 aa, Homo Sapiens
FSFPSEICR

SEQ ID NO: 1307534 - protein, 9 aa, Homo Sapiens
APHLKGRPR

SEQ ID NO: 1307535 - protein, 9 aa, Homo Sapiens
LGASLLCNA

SEQ ID NO: 1307536 - protein, 9 aa, Homo Sapiens
DLDVPLEQK

SEQ ID NO: 1307537 - protein, 9 aa, Homo Sapiens
YSLISLFIY

SEQ ID NO: 1307538 - protein, 9 aa, Homo Sapiens
VKILESAAP

SEQ ID NO: 1307539 - protein, 9 aa, Homo Sapiens
GPPPISRLG

SEQ ID NO: 1307540 - protein, 9 aa, Homo Sapiens
AFTKVLHFK

SEQ ID NO: 1307541 - protein, 9 aa, Homo Sapiens
LEKLCFSAA

SEQ ID NO: 1307542 - protein, 9 aa, Homo Sapiens
SNKLSHLSP

SEQ ID NO: 1307543 - protein, 9 aa, Homo Sapiens
QRIPSDMVC

SEQ ID NO: 1307544 - protein, 9 aa, Homo Sapiens
MQESLLERL

SEQ ID NO: 1307545 - protein, 9 aa, Homo Sapiens
LALDNSRLN

SEQ ID NO: 1307546 - protein, 9 aa, Homo Sapiens
HEIINNKEK

SEQ ID NO: 1307547 - protein, 9 aa, Homo Sapiens
SDQAEVVRY

SEQ ID NO: 1307548 - protein, 9 aa, Homo Sapiens
QKRKQSFKA

SEQ ID NO: 1307549 - protein, 9 aa, Homo Sapiens
EKSYECKQC

SEQ ID NO: 1307550 - protein, 9 aa, Homo Sapiens
MLRITHTEE

SEQ ID NO: 1307551 - protein, 9 aa, Homo Sapiens
QPLPSSNLV

SEQ ID NO: 1307552 - protein, 9 aa, Homo Sapiens
NENYFLSNN

SEQ ID NO: 1307553 - protein, 9 aa, Homo Sapiens
TEDRDRGWD

SEQ ID NO: 1307554 - protein, 9 aa, Homo Sapiens
IQLEYRGLA

SEQ ID NO: 1307555 - protein, 9 aa, Homo Sapiens
PQGVTVRCW

SEQ ID NO: 1307556 - protein, 9 aa, Homo Sapiens
RRDAERALT

SEQ ID NO: 1307557 - protein, 9 aa, Homo Sapiens
ILTFMTSFY

SEQ ID NO: 1307558 - protein, 9 aa, Homo Sapiens
SYDYGKSFN

SEQ ID NO: 1307559 - protein, 9 aa, Homo Sapiens
LALMWFMGD

SEQ ID NO: 1307560 - protein, 9 aa, Homo Sapiens
FSGLGFGLL

SEQ ID NO: 1307561 - protein, 9 aa, Homo Sapiens
VTVMSTFTH

SEQ ID NO: 1307562 - protein, 9 aa, Homo Sapiens
MSETIQYND

SEQ ID NO: 1307563 - protein, 9 aa, Homo Sapiens
VPPPPDDDI

SEQ ID NO: 1307564 - protein, 9 aa, Homo Sapiens
EDCACVSKM

SEQ ID NO: 1307565 - protein, 9 aa, Homo Sapiens
MGKDFTRTK

SEQ ID NO: 1307566 - protein, 9 aa, Homo Sapiens
GLSRSLPPL

SEQ ID NO: 1307567 - protein, 9 aa, Homo Sapiens
DSLQINQKE

SEQ ID NO: 1307568 - protein, 9 aa, Homo Sapiens
YMNYTTSKK

SEQ ID NO: 1307569 - protein, 9 aa, Homo Sapiens
LNALDIYGR

SEQ ID NO: 1307570 - protein, 9 aa, Homo Sapiens
PRYQFLWGS

SEQ ID NO: 1307571 - protein, 9 aa, Homo Sapiens
HQHVMEFGL

SEQ ID NO: 1307572 - protein, 9 aa, Homo Sapiens
LLNWAYQQL

SEQ ID NO: 1307573 - protein, 9 aa, Homo Sapiens
ESKNRALVH

SEQ ID NO: 1307574 - protein, 9 aa, Homo Sapiens
AFEIIDQYL

SEQ ID NO: 1307575 - protein, 9 aa, Homo Sapiens
EEMEIHITL

SEQ ID NO: 1307576 - protein, 9 aa, Homo Sapiens
QMIKELRRT

SEQ ID NO: 1307577 - protein, 9 aa, Homo Sapiens
YKNKGIQES

SEQ ID NO: 1307578 - protein, 9 aa, Homo Sapiens
LLKMPAYQL

SEQ ID NO: 1307579 - protein, 9 aa, Homo Sapiens
RMYKNKGIQ

SEQ ID NO: 1307580 - protein, 9 aa, Homo Sapiens
YQNKALKSE

SEQ ID NO: 1307581 - protein, 9 aa, Homo Sapiens
MEEKLEHLE

SEQ ID NO: 1307582 - protein, 9 aa, Homo Sapiens
HKEWIEIRV

SEQ ID NO: 1307583 - protein, 9 aa, Homo Sapiens
DPSIAPSSQ

SEQ ID NO: 1307584 - protein, 9 aa, Homo Sapiens
IFQIINNTE

SEQ ID NO: 1307585 - protein, 9 aa, Homo Sapiens
SYLDSIHLF

SEQ ID NO: 1307586 - protein, 9 aa, Homo Sapiens
YQFYAESII

SEQ ID NO: 1307587 - protein, 9 aa, Homo Sapiens
YFISYSRGT

SEQ ID NO: 1307588 - protein, 9 aa, Homo Sapiens
LIGMHREMQ

SEQ ID NO: 1307589 - protein, 9 aa, Homo Sapiens
NLQIEYQDG

SEQ ID NO: 1307590 - protein, 9 aa, Homo Sapiens
EVLQIQNIL

SEQ ID NO: 1307591 - protein, 9 aa, Homo Sapiens
TNNLKVPEC

SEQ ID NO: 1307592 - protein, 9 aa, Homo Sapiens
KQECIILGM

SEQ ID NO: 1307593 - protein, 9 aa, Homo Sapiens
KFTPNPSTI

SEQ ID NO: 1307594 - protein, 9 aa, Homo Sapiens
TIQYNDDDH

SEQ ID NO: 1307595 - protein, 9 aa, Homo Sapiens
IFLAGFTYR

SEQ ID NO: 1307596 - protein, 9 aa, Homo Sapiens
VIYRETFNQ

SEQ ID NO: 1307597 - protein, 9 aa, Homo Sapiens
TMVSLYYPA

SEQ ID NO: 1307598 - protein, 9 aa, Homo Sapiens
QAPHSPRLG

SEQ ID NO: 1307599 - protein, 9 aa, Homo Sapiens
IMDPHNPES

SEQ ID NO: 1307600 - protein, 9 aa, Homo Sapiens
YNNPIDQCN

SEQ ID NO: 1307601 - protein, 9 aa, Homo Sapiens
FPSAKFSGL

SEQ ID NO: 1307602 - protein, 9 aa, Homo Sapiens
VREAAYKIV

SEQ ID NO: 1307603 - protein, 9 aa, Homo Sapiens
LNENNASGY

SEQ ID NO: 1307604 - protein, 9 aa, Homo Sapiens
RVIAEKKLF

SEQ ID NO: 1307605 - protein, 9 aa, Homo Sapiens
SCFFIWQCG

SEQ ID NO: 1307606 - protein, 9 aa, Homo Sapiens
YLIAPTGHS

SEQ ID NO: 1307607 - protein, 9 aa, Homo Sapiens
EEGDKDDWA

SEQ ID NO: 1307608 - protein, 9 aa, Homo Sapiens
QSQDETEQN

SEQ ID NO: 1307609 - protein, 9 aa, Homo Sapiens
DKPYRCCEC

SEQ ID NO: 1307610 - protein, 9 aa, Homo Sapiens
IRYLIKFVS

SEQ ID NO: 1307611 - protein, 9 aa, Homo Sapiens
KPFEIQINE

SEQ ID NO: 1307612 - protein, 9 aa, Homo Sapiens
ANKSSTPLS

SEQ ID NO: 1307613 - protein, 9 aa, Homo Sapiens
DLEALGNMF

SEQ ID NO: 1307614 - protein, 9 aa, Homo Sapiens
FIEKETEEY

SEQ ID NO: 1307615 - protein, 9 aa, Homo Sapiens
WDSIYHTLG

SEQ ID NO: 1307616 - protein, 9 aa, Homo Sapiens
CQVMNITNS

SEQ ID NO: 1307617 - protein, 9 aa, Homo Sapiens
PQKSFPEEN

SEQ ID NO: 1307618 - protein, 9 aa, Homo Sapiens
LKLEQCMVC

SEQ ID NO: 1307619 - protein, 9 aa, Homo Sapiens
KCRQFVDMV

SEQ ID NO: 1307620 - protein, 9 aa, Homo Sapiens
EYLPSGIVN

SEQ ID NO: 1307621 - protein, 9 aa, Homo Sapiens
LIRLRRNMC

SEQ ID NO: 1307622 - protein, 9 aa, Homo Sapiens
LNNAYEESL

SEQ ID NO: 1307623 - protein, 9 aa, Homo Sapiens
KITPQLNKN

SEQ ID NO: 1307624 - protein, 9 aa, Homo Sapiens
KITIILLDI

SEQ ID NO: 1307625 - protein, 9 aa, Homo Sapiens
TQEGKWKAL

SEQ ID NO: 1307626 - protein, 9 aa, Homo Sapiens
EKTHTGVKP

SEQ ID NO: 1307627 - protein, 9 aa, Homo Sapiens
DIQKNTVKF

SEQ ID NO: 1307628 - protein, 9 aa, Homo Sapiens
HWDQVFSGL

SEQ ID NO: 1307629 - protein, 9 aa, Homo Sapiens
HKVFNCCLV

SEQ ID NO: 1307630 - protein, 9 aa, Homo Sapiens
EQLIQVQRR

SEQ ID NO: 1307631 - protein, 9 aa, Homo Sapiens
GISPSVYMG

SEQ ID NO: 1307632 - protein, 9 aa, Homo Sapiens
LTIINLLTE

SEQ ID NO: 1307633 - protein, 9 aa, Homo Sapiens
CVQLVVIAI

SEQ ID NO: 1307634 - protein, 9 aa, Homo Sapiens
SATISKTPS

SEQ ID NO: 1307635 - protein, 9 aa, Homo Sapiens
ESKLIEKII

SEQ ID NO: 1307636 - protein, 9 aa, Homo Sapiens
TRMGGLFNS

SEQ ID NO: 1307637 - protein, 9 aa, Homo Sapiens
ELPDQTKDN

SEQ ID NO: 1307638 - protein, 9 aa, Homo Sapiens
SHRDCVIGL

SEQ ID NO: 1307639 - protein, 9 aa, Homo Sapiens
FETYLSVLM

SEQ ID NO: 1307640 - protein, 9 aa, Homo Sapiens
DPQDKAMHS

SEQ ID NO: 1307641 - protein, 9 aa, Homo Sapiens
NERQVLDEA

SEQ ID NO: 1307642 - protein, 9 aa, Homo Sapiens
KTAQEKDYL

SEQ ID NO: 1307643 - protein, 9 aa, Homo Sapiens
FTTLTKHKI

SEQ ID NO: 1307644 - protein, 9 aa, Homo Sapiens
TLLATEQED

SEQ ID NO: 1307645 - protein, 9 aa, Homo Sapiens
KKLAVAKPN

SEQ ID NO: 1307646 - protein, 9 aa, Homo Sapiens
ITKETLLKP

SEQ ID NO: 1307647 - protein, 9 aa, Homo Sapiens
RAYLRTRIK

SEQ ID NO: 1307648 - protein, 9 aa, Homo Sapiens
HPCRFNTNT

SEQ ID NO: 1307649 - protein, 9 aa, Homo Sapiens
ATLHEKILN

SEQ ID NO: 1307650 - protein, 9 aa, Homo Sapiens
IHRHRKSKV

SEQ ID NO: 1307651 - protein, 9 aa, Homo Sapiens
QELIEDLWK

SEQ ID NO: 1307652 - protein, 9 aa, Homo Sapiens
SHIRPAADT

SEQ ID NO: 1307653 - protein, 9 aa, Homo Sapiens
TVIFLHLPS

SEQ ID NO: 1307654 - protein, 9 aa, Homo Sapiens
EDGHYARTE

SEQ ID NO: 1307655 - protein, 9 aa, Homo Sapiens
IDICDTVKY

SEQ ID NO: 1307656 - protein, 9 aa, Homo Sapiens
NSLCKGYYE

SEQ ID NO: 1307657 - protein, 9 aa, Homo Sapiens
RNPKEIEWD

SEQ ID NO: 1307658 - protein, 9 aa, Homo Sapiens
TIEYDCKEE

SEQ ID NO: 1307659 - protein, 9 aa, Homo Sapiens
RKSALILHQ

SEQ ID NO: 1307660 - protein, 9 aa, Homo Sapiens
EEMFNLKFA

SEQ ID NO: 1307661 - protein, 9 aa, Homo Sapiens
QAGIRINVT

SEQ ID NO: 1307662 - protein, 9 aa, Homo Sapiens
ATPTQIKEM

SEQ ID NO: 1307663 - protein, 9 aa, Homo Sapiens
YKFKECGKA

SEQ ID NO: 1307664 - protein, 9 aa, Homo Sapiens
ATTATPTQI

SEQ ID NO: 1307665 - protein, 9 aa, Homo Sapiens
EQDKIIENL

SEQ ID NO: 1307666 - protein, 9 aa, Homo Sapiens
KPLMRLEKY

SEQ ID NO: 1307667 - protein, 9 aa, Homo Sapiens
ADEVAGGAH

SEQ ID NO: 1307668 - protein, 9 aa, Homo Sapiens
KAHTLILHP

SEQ ID NO: 1307669 - protein, 9 aa, Homo Sapiens
IPFPEYDSN

SEQ ID NO: 1307670 - protein, 9 aa, Homo Sapiens
YGELIEFLS

SEQ ID NO: 1307671 - protein, 9 aa, Homo Sapiens
KPEPRDGIE

SEQ ID NO: 1307672 - protein, 9 aa, Homo Sapiens
FWYQLFCGF

SEQ ID NO: 1307673 - protein, 9 aa, Homo Sapiens
SSCGFCCER

SEQ ID NO: 1307674 - protein, 9 aa, Homo Sapiens
VEIMVPNYF

SEQ ID NO: 1307675 - protein, 9 aa, Homo Sapiens
QKMIFGDLI

SEQ ID NO: 1307676 - protein, 9 aa, Homo Sapiens
CMPDRYQFT

SEQ ID NO: 1307677 - protein, 9 aa, Homo Sapiens
GKKVFYPVI

SEQ ID NO: 1307678 - protein, 9 aa, Homo Sapiens
AMVGTINMT

SEQ ID NO: 1307679 - protein, 9 aa, Homo Sapiens
NNIRRDIKP

SEQ ID NO: 1307680 - protein, 9 aa, Homo Sapiens
IYIRPVTTL

SEQ ID NO: 1307681 - protein, 9 aa, Homo Sapiens
IHYDIITSL

SEQ ID NO: 1307682 - protein, 9 aa, Homo Sapiens
VKPTNYDNN

SEQ ID NO: 1307683 - protein, 9 aa, Homo Sapiens
VLDTSWVGW

SEQ ID NO: 1307684 - protein, 9 aa, Homo Sapiens
YSEQAHTAT

SEQ ID NO: 1307685 - protein, 9 aa, Homo Sapiens
DRDRGWDAV

SEQ ID NO: 1307686 - protein, 9 aa, Homo Sapiens
CRQFVDMVN

SEQ ID NO: 1307687 - protein, 9 aa, Homo Sapiens
GNAVHLNSL

SEQ ID NO: 1307688 - protein, 9 aa, Homo Sapiens
SSMVSKRFC

SEQ ID NO: 1307689 - protein, 9 aa, Homo Sapiens
SRFFYNVRL

SEQ ID NO: 1307690 - protein, 9 aa, Homo Sapiens
ENSERINII

SEQ ID NO: 1307691 - protein, 9 aa, Homo Sapiens
DFNKNMNED

SEQ ID NO: 1307692 - protein, 9 aa, Homo Sapiens
QLRENKYLE

SEQ ID NO: 1307693 - protein, 9 aa, Homo Sapiens
NYQNNYFRR

SEQ ID NO: 1307694 - protein, 9 aa, Homo Sapiens
QRPKMLKEE

SEQ ID NO: 1307695 - protein, 9 aa, Homo Sapiens
AAFLTVEIM

SEQ ID NO: 1307696 - protein, 9 aa, Homo Sapiens
LGTGAYGKL

SEQ ID NO: 1307697 - protein, 9 aa, Homo Sapiens
LLIFDENKS

SEQ ID NO: 1307698 - protein, 9 aa, Homo Sapiens
SFLALMWFM

SEQ ID NO: 1307699 - protein, 9 aa, Homo Sapiens
LFSIIYSIP

SEQ ID NO: 1307700 - protein, 9 aa, Homo Sapiens
ANKTAELSV

SEQ ID NO: 1307701 - protein, 9 aa, Homo Sapiens
SPDKPLEGN

SEQ ID NO: 1307702 - protein, 9 aa, Homo Sapiens
GLARDMYKD

SEQ ID NO: 1307703 - protein, 9 aa, Homo Sapiens
AFIYNQTED

SEQ ID NO: 1307704 - protein, 9 aa, Homo Sapiens
FFVNSLCKG

SEQ ID NO: 1307705 - protein, 9 aa, Homo Sapiens
TTSEGELSW

SEQ ID NO: 1307706 - protein, 9 aa, Homo Sapiens
HPPSEKGRQ

SEQ ID NO: 1307707 - protein, 9 aa, Homo Sapiens
ISTHTTIAT

SEQ ID NO: 1307708 - protein, 9 aa, Homo Sapiens
HELNRLRQQ

SEQ ID NO: 1307709 - protein, 9 aa, Homo Sapiens
PELTKNNRP

SEQ ID NO: 1307710 - protein, 9 aa, Homo Sapiens
RCTLNENCT

SEQ ID NO: 1307711 - protein, 9 aa, Homo Sapiens
EVGVHGIQI

SEQ ID NO: 1307712 - protein, 9 aa, Homo Sapiens
IAPVIVHTV

SEQ ID NO: 1307713 - protein, 9 aa, Homo Sapiens
ILKAFANYS

SEQ ID NO: 1307714 - protein, 9 aa, Homo Sapiens
HLIRHHQIH

SEQ ID NO: 1307715 - protein, 9 aa, Homo Sapiens
HTTAASIQT

SEQ ID NO: 1307716 - protein, 9 aa, Homo Sapiens
LCLEMCLQC

SEQ ID NO: 1307717 - protein, 9 aa, Homo Sapiens
LQDKLHQNI

SEQ ID NO: 1307718 - protein, 9 aa, Homo Sapiens
RILDLPQNQ

SEQ ID NO: 1307719 - protein, 9 aa, Homo Sapiens
YEYQSPVQE

SEQ ID NO: 1307720 - protein, 9 aa, Homo Sapiens
TERATGVDY

SEQ ID NO: 1307721 - protein, 9 aa, Homo Sapiens
NGKDKYKVY

SEQ ID NO: 1307722 - protein, 9 aa, Homo Sapiens
FRGTKPEPR

SEQ ID NO: 1307723 - protein, 9 aa, Homo Sapiens
MVRKMQLNM

SEQ ID NO: 1307724 - protein, 9 aa, Homo Sapiens
RSLLVSTDK

SEQ ID NO: 1307725 - protein, 9 aa, Homo Sapiens
NILFSEKEI

SEQ ID NO: 1307726 - protein, 9 aa, Homo Sapiens
DLPQNQISH

SEQ ID NO: 1307727 - protein, 9 aa, Homo Sapiens
GEAEYLILR

SEQ ID NO: 1307728 - protein, 9 aa, Homo Sapiens
QCEDSESFR

SEQ ID NO: 1307729 - protein, 9 aa, Homo Sapiens
TQVEAVAEA

SEQ ID NO: 1307730 - protein, 9 aa, Homo Sapiens
ELQDKLSHL

SEQ ID NO: 1307731 - protein, 9 aa, Homo Sapiens
FCGESSEEL

SEQ ID NO: 1307732 - protein, 9 aa, Homo Sapiens
KLYLSPQIE

SEQ ID NO: 1307733 - protein, 9 aa, Homo Sapiens
LSIAAGIIT

SEQ ID NO: 1307734 - protein, 9 aa, Homo Sapiens
KMAGEGFFP

SEQ ID NO: 1307735 - protein, 9 aa, Homo Sapiens
DANKSSTPL

SEQ ID NO: 1307736 - protein, 9 aa, Homo Sapiens
ENTIEYDCK

SEQ ID NO: 1307737 - protein, 9 aa, Homo Sapiens
YYNKTLATD

SEQ ID NO: 1307738 - protein, 9 aa, Homo Sapiens
WEKLLNKMQ

SEQ ID NO: 1307739 - protein, 9 aa, Homo Sapiens
NQTAANGHC

SEQ ID NO: 1307740 - protein, 9 aa, Homo Sapiens
RIGSGKLSL

SEQ ID NO: 1307741 - protein, 9 aa, Homo Sapiens
LKHHQKIHQ

SEQ ID NO: 1307742 - protein, 9 aa, Homo Sapiens
GFNLPSFIR

SEQ ID NO: 1307743 - protein, 9 aa, Homo Sapiens
EECRIQLGD

SEQ ID NO: 1307744 - protein, 9 aa, Homo Sapiens
KIKYPRTVR

SEQ ID NO: 1307745 - protein, 9 aa, Homo Sapiens
LGFNILSMS

SEQ ID NO: 1307746 - protein, 9 aa, Homo Sapiens
SLQKTATIM

SEQ ID NO: 1307747 - protein, 9 aa, Homo Sapiens
RVTKEEFCE

SEQ ID NO: 1307748 - protein, 9 aa, Homo Sapiens
EQAIGQLKI

SEQ ID NO: 1307749 - protein, 9 aa, Homo Sapiens
PEKTSCCAM

SEQ ID NO: 1307750 - protein, 9 aa, Homo Sapiens
SYLNSVQHL

SEQ ID NO: 1307751 - protein, 9 aa, Homo Sapiens
DNNRLCPSL

SEQ ID NO: 1307752 - protein, 9 aa, Homo Sapiens
DTEQLIQVQ

SEQ ID NO: 1307753 - protein, 9 aa, Homo Sapiens
KKDDNKKKE

SEQ ID NO: 1307754 - protein, 9 aa, Homo Sapiens
LLLVQCHPN

SEQ ID NO: 1307755 - protein, 9 aa, Homo Sapiens
PILLDTKDL

SEQ ID NO: 1307756 - protein, 9 aa, Homo Sapiens
LRDASFKSL

SEQ ID NO: 1307757 - protein, 9 aa, Homo Sapiens
ALIMMPVNY

SEQ ID NO: 1307758 - protein, 9 aa, Homo Sapiens
NEMNWFHLN

SEQ ID NO: 1307759 - protein, 9 aa, Homo Sapiens
DVKINAHKV

SEQ ID NO: 1307760 - protein, 9 aa, Homo Sapiens
LEPSMFIVL

SEQ ID NO: 1307761 - protein, 9 aa, Homo Sapiens
SLRYSPSGF

SEQ ID NO: 1307762 - protein, 9 aa, Homo Sapiens
ISNVIEKTE

SEQ ID NO: 1307763 - protein, 9 aa, Homo Sapiens
TPVIYHNWD

SEQ ID NO: 1307764 - protein, 9 aa, Homo Sapiens
PHYVCCIKP

SEQ ID NO: 1307765 - protein, 9 aa, Homo Sapiens
CRINLVALK

SEQ ID NO: 1307766 - protein, 9 aa, Homo Sapiens
VPRPLPKRV

SEQ ID NO: 1307767 - protein, 9 aa, Homo Sapiens
LSKMLGIFW

SEQ ID NO: 1307768 - protein, 9 aa, Homo Sapiens
VIGDGKFAV

SEQ ID NO: 1307769 - protein, 9 aa, Homo Sapiens
KLDTFKSVK

SEQ ID NO: 1307770 - protein, 9 aa, Homo Sapiens
AAFKINKRK

SEQ ID NO: 1307771 - protein, 9 aa, Homo Sapiens
LAPAKQEYE

SEQ ID NO: 1307772 - protein, 9 aa, Homo Sapiens
FSRSGISIK

SEQ ID NO: 1307773 - protein, 9 aa, Homo Sapiens
SEDERKLLS

SEQ ID NO: 1307774 - protein, 9 aa, Homo Sapiens
EALCQTFWQ

SEQ ID NO: 1307775 - protein, 9 aa, Homo Sapiens
RHVSIEEGE

SEQ ID NO: 1307776 - protein, 9 aa, Homo Sapiens
RTRIKLWEM

SEQ ID NO: 1307777 - protein, 9 aa, Homo Sapiens
INIHQKIHT

SEQ ID NO: 1307778 - protein, 9 aa, Homo Sapiens
TRLVLPVGA

SEQ ID NO: 1307779 - protein, 9 aa, Homo Sapiens
LDISLGADI

SEQ ID NO: 1307780 - protein, 9 aa, Homo Sapiens
IPSAASCDL

SEQ ID NO: 1307781 - protein, 9 aa, Homo Sapiens
SAASCDLSV

SEQ ID NO: 1307782 - protein, 9 aa, Homo Sapiens
QMILEDKRM

SEQ ID NO: 1307783 - protein, 9 aa, Homo Sapiens
YIILEARYG

SEQ ID NO: 1307784 - protein, 9 aa, Homo Sapiens
VLQIQNILT

SEQ ID NO: 1307785 - protein, 9 aa, Homo Sapiens
HCKNHHCIP

SEQ ID NO: 1307786 - protein, 9 aa, Homo Sapiens
GESKFDSFR

SEQ ID NO: 1307787 - protein, 9 aa, Homo Sapiens
AIGNTLFDA

SEQ ID NO: 1307788 - protein, 9 aa, Homo Sapiens
HLTQHKIFH

SEQ ID NO: 1307789 - protein, 9 aa, Homo Sapiens
FPEYDSNST

SEQ ID NO: 1307790 - protein, 9 aa, Homo Sapiens
FNYGNRYHL

SEQ ID NO: 1307791 - protein, 9 aa, Homo Sapiens
DKAFIHKSE

SEQ ID NO: 1307792 - protein, 9 aa, Homo Sapiens
LFSILLFPV

SEQ ID NO: 1307793 - protein, 9 aa, Homo Sapiens
NKWIHCFEG

SEQ ID NO: 1307794 - protein, 9 aa, Homo Sapiens
GHNYLCGAL

SEQ ID NO: 1307795 - protein, 9 aa, Homo Sapiens
SLGIHQIIH

SEQ ID NO: 1307796 - protein, 9 aa, Homo Sapiens
YSFQDKRNI

SEQ ID NO: 1307797 - protein, 9 aa, Homo Sapiens
DKRNIYLIM

SEQ ID NO: 1307798 - protein, 9 aa, Homo Sapiens
QTHMIMHTG

SEQ ID NO: 1307799 - protein, 9 aa, Homo Sapiens
LFDAGAAEF

SEQ ID NO: 1307800 - protein, 9 aa, Homo Sapiens
YWKKMPGSV

SEQ ID NO: 1307801 - protein, 9 aa, Homo Sapiens
DIKKINYSR

SEQ ID NO: 1307802 - protein, 9 aa, Homo Sapiens
DNLLHQVES

SEQ ID NO: 1307803 - protein, 9 aa, Homo Sapiens
NNSLQSPEM

SEQ ID NO: 1307804 - protein, 9 aa, Homo Sapiens
KKGHTINKS

SEQ ID NO: 1307805 - protein, 9 aa, Homo Sapiens
VTGTCLGER

SEQ ID NO: 1307806 - protein, 9 aa, Homo Sapiens
YIRGIYSKK

SEQ ID NO: 1307807 - protein, 9 aa, Homo Sapiens
SPTQLCFIS

SEQ ID NO: 1307808 - protein, 9 aa, Homo Sapiens
KHKFQAPVC

SEQ ID NO: 1307809 - protein, 9 aa, Homo Sapiens
ILLDTKDLL

SEQ ID NO: 1307810 - protein, 9 aa, Homo Sapiens
HTRINLFIA

SEQ ID NO: 1307811 - protein, 9 aa, Homo Sapiens
PKTVKNVTC

SEQ ID NO: 1307812 - protein, 9 aa, Homo Sapiens
FIYSKGAIS

SEQ ID NO: 1307813 - protein, 9 aa, Homo Sapiens
RIQRQTPRL

SEQ ID NO: 1307814 - protein, 9 aa, Homo Sapiens
TIILLDIND

SEQ ID NO: 1307815 - protein, 9 aa, Homo Sapiens
PKVAITICE

SEQ ID NO: 1307816 - protein, 9 aa, Homo Sapiens
DYNLLQAET

SEQ ID NO: 1307817 - protein, 9 aa, Homo Sapiens
GAVGVGKSA

SEQ ID NO: 1307818 - protein, 9 aa, Homo Sapiens
WTTADTVAQ

SEQ ID NO: 1307819 - protein, 9 aa, Homo Sapiens
CLEYNHKEW

SEQ ID NO: 1307820 - protein, 9 aa, Homo Sapiens
VDYLSSSLY

SEQ ID NO: 1307821 - protein, 9 aa, Homo Sapiens
QVFLCLEMC

SEQ ID NO: 1307822 - protein, 9 aa, Homo Sapiens
EALERCQII

SEQ ID NO: 1307823 - protein, 9 aa, Homo Sapiens
LVLYETRAI

SEQ ID NO: 1307824 - protein, 9 aa, Homo Sapiens
SKAHLYREL

SEQ ID NO: 1307825 - protein, 9 aa, Homo Sapiens
STLHSLKKD

SEQ ID NO: 1307826 - protein, 9 aa, Homo Sapiens
VDKITQFWL

SEQ ID NO: 1307827 - protein, 9 aa, Homo Sapiens
VGMSGKQNK

SEQ ID NO: 1307828 - protein, 9 aa, Homo Sapiens
LSWYKDDED

SEQ ID NO: 1307829 - protein, 9 aa, Homo Sapiens
CTFQYIILE

SEQ ID NO: 1307830 - protein, 9 aa, Homo Sapiens
TRSVSEMKS

SEQ ID NO: 1307831 - protein, 9 aa, Homo Sapiens
LDMALGNKK

SEQ ID NO: 1307832 - protein, 9 aa, Homo Sapiens
RFMEEENNN

SEQ ID NO: 1307833 - protein, 9 aa, Homo Sapiens
QSNYKLPHS

SEQ ID NO: 1307834 - protein, 9 aa, Homo Sapiens
SILNYQNNY

SEQ ID NO: 1307835 - protein, 9 aa, Homo Sapiens
KEVPPRITS

SEQ ID NO: 1307836 - protein, 9 aa, Homo Sapiens
SSIVGYIIG

SEQ ID NO: 1307837 - protein, 9 aa, Homo Sapiens
AASEEGDKD

SEQ ID NO: 1307838 - protein, 9 aa, Homo Sapiens
FHCKNHHCI

SEQ ID NO: 1307839 - protein, 9 aa, Homo Sapiens
NLEKMHPKH

SEQ ID NO: 1307840 - protein, 9 aa, Homo Sapiens
ITYRNKYLM

SEQ ID NO: 1307841 - protein, 9 aa, Homo Sapiens
TYLSGNYFR

SEQ ID NO: 1307842 - protein, 9 aa, Homo Sapiens
VSDKLKKLD

SEQ ID NO: 1307843 - protein, 9 aa, Homo Sapiens
RLPKTVKNV

SEQ ID NO: 1307844 - protein, 9 aa, Homo Sapiens
EAVPLTLQF

SEQ ID NO: 1307845 - protein, 9 aa, Homo Sapiens
WYMRIYRRY

SEQ ID NO: 1307846 - protein, 9 aa, Homo Sapiens
SALILHQGI

SEQ ID NO: 1307847 - protein, 9 aa, Homo Sapiens
KRVTRLVLP

SEQ ID NO: 1307848 - protein, 9 aa, Homo Sapiens
YLEIDRSMK

SEQ ID NO: 1307849 - protein, 9 aa, Homo Sapiens
SKRFCFDDS

SEQ ID NO: 1307850 - protein, 9 aa, Homo Sapiens
DSDEKGPEE

SEQ ID NO: 1307851 - protein, 9 aa, Homo Sapiens
MKIFLLVVN

SEQ ID NO: 1307852 - protein, 9 aa, Homo Sapiens
LFLVRKISG

SEQ ID NO: 1307853 - protein, 9 aa, Homo Sapiens
ASNGVSCTN

SEQ ID NO: 1307854 - protein, 9 aa, Homo Sapiens
FFMMSDYRG

SEQ ID NO: 1307855 - protein, 9 aa, Homo Sapiens
HNGHIESEG

SEQ ID NO: 1307856 - protein, 9 aa, Homo Sapiens
SIPLTVVAL

SEQ ID NO: 1307857 - protein, 9 aa, Homo Sapiens
HERMHTDER

SEQ ID NO: 1307858 - protein, 9 aa, Homo Sapiens
FKECGKAFN

SEQ ID NO: 1307859 - protein, 9 aa, Homo Sapiens
SRSGISIKQ

SEQ ID NO: 1307860 - protein, 9 aa, Homo Sapiens
NIFSYHIFS

SEQ ID NO: 1307861 - protein, 9 aa, Homo Sapiens
HVSTLLIEL

SEQ ID NO: 1307862 - protein, 9 aa, Homo Sapiens
SIITAGFEP

SEQ ID NO: 1307863 - protein, 9 aa, Homo Sapiens
KELITVFWM

SEQ ID NO: 1307864 - protein, 9 aa, Homo Sapiens
LGFGLLSGY

SEQ ID NO: 1307865 - protein, 9 aa, Homo Sapiens
SGSSVSDKL

SEQ ID NO: 1307866 - protein, 9 aa, Homo Sapiens
VRGHYRTES

SEQ ID NO: 1307867 - protein, 9 aa, Homo Sapiens
EFSLFYDTV

SEQ ID NO: 1307868 - protein, 9 aa, Homo Sapiens
GQRAKTINN

SEQ ID NO: 1307869 - protein, 9 aa, Homo Sapiens
EITKETLLK

SEQ ID NO: 1307870 - protein, 9 aa, Homo Sapiens
NHLKCSQLC

SEQ ID NO: 1307871 - protein, 9 aa, Homo Sapiens
LSNHECWRK

SEQ ID NO: 1307872 - protein, 9 aa, Homo Sapiens
LIQFSEMLQ

SEQ ID NO: 1307873 - protein, 9 aa, Homo Sapiens
LSSVSVGLP

SEQ ID NO: 1307874 - protein, 9 aa, Homo Sapiens
DKGKRKQKS

SEQ ID NO: 1307875 - protein, 9 aa, Homo Sapiens
VEHYENTIE

SEQ ID NO: 1307876 - protein, 9 aa, Homo Sapiens
TGAVRIASE

SEQ ID NO: 1307877 - protein, 9 aa, Homo Sapiens
QDTKKNICR

SEQ ID NO: 1307878 - protein, 9 aa, Homo Sapiens
GQLPAYPSC

SEQ ID NO: 1307879 - protein, 9 aa, Homo Sapiens
SQDGTLQSC

SEQ ID NO: 1307880 - protein, 9 aa, Homo Sapiens
VIIRVAKGY

SEQ ID NO: 1307881 - protein, 9 aa, Homo Sapiens
IEKIILNIS

SEQ ID NO: 1307882 - protein, 9 aa, Homo Sapiens
YQFNKKYGV

SEQ ID NO: 1307883 - protein, 9 aa, Homo Sapiens
SEDAKSAED

SEQ ID NO: 1307884 - protein, 9 aa, Homo Sapiens
VIGTLKNYL

SEQ ID NO: 1307885 - protein, 9 aa, Homo Sapiens
YPDNFFLLR

SEQ ID NO: 1307886 - protein, 9 aa, Homo Sapiens
KKKNEDCFG

SEQ ID NO: 1307887 - protein, 9 aa, Homo Sapiens
DNYSLTDFW

SEQ ID NO: 1307888 - protein, 9 aa, Homo Sapiens
TLHAIIDPN

SEQ ID NO: 1307889 - protein, 9 aa, Homo Sapiens
SQVVCWRSM

SEQ ID NO: 1307890 - protein, 9 aa, Homo Sapiens
VFKLICDAS

SEQ ID NO: 1307891 - protein, 9 aa, Homo Sapiens
VNLFCFNKE

SEQ ID NO: 1307892 - protein, 9 aa, Homo Sapiens
ALDERPWAS

SEQ ID NO: 1307893 - protein, 9 aa, Homo Sapiens
SSLLKRDCG

SEQ ID NO: 1307894 - protein, 9 aa, Homo Sapiens
DRINPEKKG

SEQ ID NO: 1307895 - protein, 9 aa, Homo Sapiens
MIEILNQSK

SEQ ID NO: 1307896 - protein, 9 aa, Homo Sapiens
INSMWKQQC

SEQ ID NO: 1307897 - protein, 9 aa, Homo Sapiens
SELTLHQKI

SEQ ID NO: 1307898 - protein, 9 aa, Homo Sapiens
RCWIIRDKR

SEQ ID NO: 1307899 - protein, 9 aa, Homo Sapiens
DEKVIILHG

SEQ ID NO: 1307900 - protein, 9 aa, Homo Sapiens
LEYFPMDVH

SEQ ID NO: 1307901 - protein, 9 aa, Homo Sapiens
FCGMPQLLI

SEQ ID NO: 1307902 - protein, 9 aa, Homo Sapiens
GSEVVENNL

SEQ ID NO: 1307903 - protein, 9 aa, Homo Sapiens
RLPELTKNN

SEQ ID NO: 1307904 - protein, 9 aa, Homo Sapiens
KYTRFEKNG

SEQ ID NO: 1307905 - protein, 9 aa, Homo Sapiens
CFGMWIEYL

SEQ ID NO: 1307906 - protein, 9 aa, Homo Sapiens
RKGPSAKQR

SEQ ID NO: 1307907 - protein, 9 aa, Homo Sapiens
RRRATPHSY

SEQ ID NO: 1307908 - protein, 9 aa, Homo Sapiens
GSGKLSLSG

SEQ ID NO: 1307909 - protein, 9 aa, Homo Sapiens
SKYLEIDRS

SEQ ID NO: 1307910 - protein, 9 aa, Homo Sapiens
CSKTENARL

SEQ ID NO: 1307911 - protein, 9 aa, Homo Sapiens
HFTSEDAKS

SEQ ID NO: 1307912 - protein, 9 aa, Homo Sapiens
ETVFKHSLE

SEQ ID NO: 1307913 - protein, 9 aa, Homo Sapiens
ATHQKEIDT

SEQ ID NO: 1307914 - protein, 9 aa, Homo Sapiens
FRNNSGPKV

SEQ ID NO: 1307915 - protein, 9 aa, Homo Sapiens
LRQLTLPRT

SEQ ID NO: 1307916 - protein, 9 aa, Homo Sapiens
YFILITMAS

SEQ ID NO: 1307917 - protein, 9 aa, Homo Sapiens
ADINQLTEL

SEQ ID NO: 1307918 - protein, 9 aa, Homo Sapiens
MEIQQFKAE

SEQ ID NO: 1307919 - protein, 9 aa, Homo Sapiens
LKCRQFVDM

SEQ ID NO: 1307920 - protein, 9 aa, Homo Sapiens
ILSKMLGIF

SEQ ID NO: 1307921 - protein, 9 aa, Homo Sapiens
ISRLGAASM

SEQ ID NO: 1307922 - protein, 9 aa, Homo Sapiens
QEAHRTVFM

SEQ ID NO: 1307923 - protein, 9 aa, Homo Sapiens
LGLLALGAS

SEQ ID NO: 1307924 - protein, 9 aa, Homo Sapiens
PPCKSELKV

SEQ ID NO: 1307925 - protein, 9 aa, Homo Sapiens
LLNENNASG

SEQ ID NO: 1307926 - protein, 9 aa, Homo Sapiens
LKLWNEDFQ

SEQ ID NO: 1307927 - protein, 9 aa, Homo Sapiens
QLIQVQRRG

SEQ ID NO: 1307928 - protein, 9 aa, Homo Sapiens
YFLLKLSSV

SEQ ID NO: 1307929 - protein, 9 aa, Homo Sapiens
ECSDRDKAF

SEQ ID NO: 1307930 - protein, 9 aa, Homo Sapiens
VLYETRAIY

SEQ ID NO: 1307931 - protein, 9 aa, Homo Sapiens
INGLKFCKQ

SEQ ID NO: 1307932 - protein, 9 aa, Homo Sapiens
PIQAPSALP

SEQ ID NO: 1307933 - protein, 9 aa, Homo Sapiens
TQIMKILTQ

SEQ ID NO: 1307934 - protein, 9 aa, Homo Sapiens
PPISRLGAA

SEQ ID NO: 1307935 - protein, 9 aa, Homo Sapiens
FYFNQDDAA

SEQ ID NO: 1307936 - protein, 9 aa, Homo Sapiens
FFTSTLHSL

SEQ ID NO: 1307937 - protein, 9 aa, Homo Sapiens
TPLYYLRID

SEQ ID NO: 1307938 - protein, 9 aa, Homo Sapiens
DCQYVISMT

SEQ ID NO: 1307939 - protein, 9 aa, Homo Sapiens
HTINKSTSS

SEQ ID NO: 1307940 - protein, 9 aa, Homo Sapiens
YYEESDEEE

SEQ ID NO: 1307941 - protein, 9 aa, Homo Sapiens
DRFIEYGKK

SEQ ID NO: 1307942 - protein, 9 aa, Homo Sapiens
TGDIHATRQ

SEQ ID NO: 1307943 - protein, 9 aa, Homo Sapiens
SDANEFISI

SEQ ID NO: 1307944 - protein, 9 aa, Homo Sapiens
LEEMEIHIT

SEQ ID NO: 1307945 - protein, 9 aa, Homo Sapiens
RCKVLISFL

SEQ ID NO: 1307946 - protein, 9 aa, Homo Sapiens
GDVCKENIC

SEQ ID NO: 1307947 - protein, 9 aa, Homo Sapiens
KKIISFNWC

SEQ ID NO: 1307948 - protein, 9 aa, Homo Sapiens
FTPNPSTIF

SEQ ID NO: 1307949 - protein, 9 aa, Homo Sapiens
SGHLVVQSL

SEQ ID NO: 1307950 - protein, 9 aa, Homo Sapiens
MGGLFNSGC

SEQ ID NO: 1307951 - protein, 9 aa, Homo Sapiens
RLRRNMCLL

SEQ ID NO: 1307952 - protein, 9 aa, Homo Sapiens
FQQKLMSKN

SEQ ID NO: 1307953 - protein, 9 aa, Homo Sapiens
KGHFQLWLY

SEQ ID NO: 1307954 - protein, 9 aa, Homo Sapiens
LVLLKTREE

SEQ ID NO: 1307955 - protein, 9 aa, Homo Sapiens
MRNQLSVKC

SEQ ID NO: 1307956 - protein, 9 aa, Homo Sapiens
LPNTIRLRI

SEQ ID NO: 1307957 - protein, 9 aa, Homo Sapiens
CHQLYILHR

SEQ ID NO: 1307958 - protein, 9 aa, Homo Sapiens
NELITKYGK

SEQ ID NO: 1307959 - protein, 9 aa, Homo Sapiens
VHTVSGFLL

SEQ ID NO: 1307960 - protein, 9 aa, Homo Sapiens
SCQYIIHLY

SEQ ID NO: 1307961 - protein, 9 aa, Homo Sapiens
RRNVKQIIA

SEQ ID NO: 1307962 - protein, 9 aa, Homo Sapiens
DEFAPHLKG

SEQ ID NO: 1307963 - protein, 9 aa, Homo Sapiens
TTSYMTIAP

SEQ ID NO: 1307964 - protein, 9 aa, Homo Sapiens
MSKKGQNKG

SEQ ID NO: 1307965 - protein, 9 aa, Homo Sapiens
RTTELQDKL

SEQ ID NO: 1307966 - protein, 9 aa, Homo Sapiens
EFGLEHTTS

SEQ ID NO: 1307967 - protein, 9 aa, Homo Sapiens
NIPEKTSCC

SEQ ID NO: 1307968 - protein, 9 aa, Homo Sapiens
IAFPSAKFS

SEQ ID NO: 1307969 - protein, 9 aa, Homo Sapiens
NGKTQVEAV

SEQ ID NO: 1307970 - protein, 9 aa, Homo Sapiens
KQCCNSCTR

SEQ ID NO: 1307971 - protein, 9 aa, Homo Sapiens
QFSKGKYKC

SEQ ID NO: 1307972 - protein, 9 aa, Homo Sapiens
SMAFYFNQD

SEQ ID NO: 1307973 - protein, 9 aa, Homo Sapiens
DNKKKEAAQ

SEQ ID NO: 1307974 - protein, 9 aa, Homo Sapiens
AVDDPEAII

SEQ ID NO: 1307975 - protein, 9 aa, Homo Sapiens
LSKYLEIDR

SEQ ID NO: 1307976 - protein, 9 aa, Homo Sapiens
LPHQIKNIL

SEQ ID NO: 1307977 - protein, 9 aa, Homo Sapiens
KENVIILDT

SEQ ID NO: 1307978 - protein, 9 aa, Homo Sapiens
ISLIALTQK

SEQ ID NO: 1307979 - protein, 9 aa, Homo Sapiens
VGREVGWIG

SEQ ID NO: 1307980 - protein, 9 aa, Homo Sapiens
SIHQYPKFK

SEQ ID NO: 1307981 - protein, 9 aa, Homo Sapiens
EHTRINLFI

SEQ ID NO: 1307982 - protein, 9 aa, Homo Sapiens
GNTDNERFH

SEQ ID NO: 1307983 - protein, 9 aa, Homo Sapiens
SHPLEIVKS

SEQ ID NO: 1307984 - protein, 9 aa, Homo Sapiens
IYRETFNQT

SEQ ID NO: 1307985 - protein, 9 aa, Homo Sapiens
NEEIAAEIN

SEQ ID NO: 1307986 - protein, 9 aa, Homo Sapiens
DKAMHSETC

SEQ ID NO: 1307987 - protein, 9 aa, Homo Sapiens
DDNKKKEAA

SEQ ID NO: 1307988 - protein, 9 aa, Homo Sapiens
DNQTIPSEP

SEQ ID NO: 1307989 - protein, 9 aa, Homo Sapiens
LILREPGHV

SEQ ID NO: 1307990 - protein, 9 aa, Homo Sapiens
IKYMTKAGT

SEQ ID NO: 1307991 - protein, 9 aa, Homo Sapiens
LLDSEDHNT

SEQ ID NO: 1307992 - protein, 9 aa, Homo Sapiens
TLIDEKVII

SEQ ID NO: 1307993 - protein, 9 aa, Homo Sapiens
GMLESGIDQ

SEQ ID NO: 1307994 - protein, 9 aa, Homo Sapiens
VFYPVIFSQ

SEQ ID NO: 1307995 - protein, 9 aa, Homo Sapiens
IVLREPHSC

SEQ ID NO: 1307996 - protein, 9 aa, Homo Sapiens
LCSDLELMC

SEQ ID NO: 1307997 - protein, 9 aa, Homo Sapiens
DKLMKICKI

SEQ ID NO: 1307998 - protein, 9 aa, Homo Sapiens
ESNTSRHNL

SEQ ID NO: 1307999 - protein, 9 aa, Homo Sapiens
VVTFDKEDN

SEQ ID NO: 1308000 - protein, 9 aa, Homo Sapiens
MNLMTSAVP

SEQ ID NO: 1308001 - protein, 9 aa, Homo Sapiens
PMCILGALF

SEQ ID NO: 1308002 - protein, 9 aa, Homo Sapiens
SRGCHQVQI

SEQ ID NO: 1308003 - protein, 9 aa, Homo Sapiens
SKFRRHVST

SEQ ID NO: 1308004 - protein, 9 aa, Homo Sapiens
FNKKYGVQP

SEQ ID NO: 1308005 - protein, 9 aa, Homo Sapiens
CFMGHTFSL

SEQ ID NO: 1308006 - protein, 9 aa, Homo Sapiens
VHTSKSDVW

SEQ ID NO: 1308007 - protein, 9 aa, Homo Sapiens
LGLHSKVLR

SEQ ID NO: 1308008 - protein, 9 aa, Homo Sapiens
ARAAQVAGI

SEQ ID NO: 1308009 - protein, 9 aa, Homo Sapiens
TKQNPRSKN

SEQ ID NO: 1308010 - protein, 9 aa, Homo Sapiens
DQTKDNLVE

SEQ ID NO: 1308011 - protein, 9 aa, Homo Sapiens
YECSDRDKA

SEQ ID NO: 1308012 - protein, 9 aa, Homo Sapiens
FFKQNRKRD

SEQ ID NO: 1308013 - protein, 9 aa, Homo Sapiens
LMIHQINHI

SEQ ID NO: 1308014 - protein, 9 aa, Homo Sapiens
YKMSDNIPN

SEQ ID NO: 1308015 - protein, 9 aa, Homo Sapiens
GPSIYFNAQ

SEQ ID NO: 1308016 - protein, 9 aa, Homo Sapiens
SIDDAPVLI

SEQ ID NO: 1308017 - protein, 9 aa, Homo Sapiens
FSLKSNLQR

SEQ ID NO: 1308018 - protein, 9 aa, Homo Sapiens
KGFFSSIHR

SEQ ID NO: 1308019 - protein, 9 aa, Homo Sapiens
VLRELSTQV

SEQ ID NO: 1308020 - protein, 9 aa, Homo Sapiens
CQLQVFLCL

SEQ ID NO: 1308021 - protein, 9 aa, Homo Sapiens
LHLTQHKIF

SEQ ID NO: 1308022 - protein, 9 aa, Homo Sapiens
AEEVDNKVL

SEQ ID NO: 1308023 - protein, 9 aa, Homo Sapiens
PCKEIIRPR

SEQ ID NO: 1308024 - protein, 9 aa, Homo Sapiens
QNKIKQVKE

SEQ ID NO: 1308025 - protein, 9 aa, Homo Sapiens
VIEENNIRR

SEQ ID NO: 1308026 - protein, 9 aa, Homo Sapiens
FLISNENKI

SEQ ID NO: 1308027 - protein, 9 aa, Homo Sapiens
LNSCQPTPD

SEQ ID NO: 1308028 - protein, 9 aa, Homo Sapiens
KFTIIQNLQ

SEQ ID NO: 1308029 - protein, 9 aa, Homo Sapiens
EMLANQTAA

SEQ ID NO: 1308030 - protein, 9 aa, Homo Sapiens
AVPLTLQFI

SEQ ID NO: 1308031 - protein, 9 aa, Homo Sapiens
YMTKAGTFQ

SEQ ID NO: 1308032 - protein, 9 aa, Homo Sapiens
TMPVRSSVD

SEQ ID NO: 1308033 - protein, 9 aa, Homo Sapiens
YNVCTLHGG

SEQ ID NO: 1308034 - protein, 9 aa, Homo Sapiens
TAVPLSIIM

SEQ ID NO: 1308035 - protein, 9 aa, Homo Sapiens
LSVLMKQLD

SEQ ID NO: 1308036 - protein, 9 aa, Homo Sapiens
TLILHPPSE

SEQ ID NO: 1308037 - protein, 9 aa, Homo Sapiens
WIIRDKRGM

SEQ ID NO: 1308038 - protein, 9 aa, Homo Sapiens
GLFNSGCSQ

SEQ ID NO: 1308039 - protein, 9 aa, Homo Sapiens
ALGQKDKIP

SEQ ID NO: 1308040 - protein, 9 aa, Homo Sapiens
VNYYIYSRI

SEQ ID NO: 1308041 - protein, 9 aa, Homo Sapiens
EISSRSPPD

SEQ ID NO: 1308042 - protein, 9 aa, Homo Sapiens
NKSSTPLSE

SEQ ID NO: 1308043 - protein, 9 aa, Homo Sapiens
MAKYDILWD

SEQ ID NO: 1308044 - protein, 9 aa, Homo Sapiens
RVYDALNML

SEQ ID NO: 1308045 - protein, 9 aa, Homo Sapiens
WSLPDKIKY

SEQ ID NO: 1308046 - protein, 9 aa, Homo Sapiens
SGRETIYYN

SEQ ID NO: 1308047 - protein, 9 aa, Homo Sapiens
QEVEGKSPE

SEQ ID NO: 1308048 - protein, 9 aa, Homo Sapiens
EWKIMARTL

SEQ ID NO: 1308049 - protein, 9 aa, Homo Sapiens
TLFDAGAAE

SEQ ID NO: 1308050 - protein, 9 aa, Homo Sapiens
LAIYFRCLG

SEQ ID NO: 1308051 - protein, 9 aa, Homo Sapiens
EECVEDLRM

SEQ ID NO: 1308052 - protein, 9 aa, Homo Sapiens
NKLSHLSPM

SEQ ID NO: 1308053 - protein, 9 aa, Homo Sapiens
ELFKLNNAY

SEQ ID NO: 1308054 - protein, 9 aa, Homo Sapiens
TSKMKVLEL

SEQ ID NO: 1308055 - protein, 9 aa, Homo Sapiens
VLNDWSQKL

SEQ ID NO: 1308056 - protein, 9 aa, Homo Sapiens
QNSVLQNAN

SEQ ID NO: 1308057 - protein, 9 aa, Homo Sapiens
VKLNDHNEF

SEQ ID NO: 1308058 - protein, 9 aa, Homo Sapiens
LAAFLTVEI

SEQ ID NO: 1308059 - protein, 9 aa, Homo Sapiens
CKSELKVLV

SEQ ID NO: 1308060 - protein, 9 aa, Homo Sapiens
AKRVTIMPR

SEQ ID NO: 1308061 - protein, 9 aa, Homo Sapiens
SDQLEELDK

SEQ ID NO: 1308062 - protein, 9 aa, Homo Sapiens
YQFLWGSRA

SEQ ID NO: 1308063 - protein, 9 aa, Homo Sapiens
LCVSEMYRM

SEQ ID NO: 1308064 - protein, 9 aa, Homo Sapiens
HTNTNNLKV

SEQ ID NO: 1308065 - protein, 9 aa, Homo Sapiens
ESIIIHQLQ

SEQ ID NO: 1308066 - protein, 9 aa, Homo Sapiens
AIGQLKIHG

SEQ ID NO: 1308067 - protein, 9 aa, Homo Sapiens
EIRLKRFIH

SEQ ID NO: 1308068 - protein, 9 aa, Homo Sapiens
SSLIQHQQI

SEQ ID NO: 1308069 - protein, 9 aa, Homo Sapiens
GSKFRRHVS

SEQ ID NO: 1308070 - protein, 9 aa, Homo Sapiens
WMIGDDLVN

SEQ ID NO: 1308071 - protein, 9 aa, Homo Sapiens
NLEGVVTRG

SEQ ID NO: 1308072 - protein, 9 aa, Homo Sapiens
NNSGPKVHK

SEQ ID NO: 1308073 - protein, 9 aa, Homo Sapiens
TINLTEEPT

SEQ ID NO: 1308074 - protein, 9 aa, Homo Sapiens
QHEGIFQVS

SEQ ID NO: 1308075 - protein, 9 aa, Homo Sapiens
GMCLEFEGL

SEQ ID NO: 1308076 - protein, 9 aa, Homo Sapiens
GNRVFFGKN

SEQ ID NO: 1308077 - protein, 9 aa, Homo Sapiens
PEERLIRLR

SEQ ID NO: 1308078 - protein, 9 aa, Homo Sapiens
KNHYFPAFE

SEQ ID NO: 1308079 - protein, 9 aa, Homo Sapiens
GHFQLWLYQ

SEQ ID NO: 1308080 - protein, 9 aa, Homo Sapiens
INHYFCDIL

SEQ ID NO: 1308081 - protein, 9 aa, Homo Sapiens
LDGIKVQLR

SEQ ID NO: 1308082 - protein, 9 aa, Homo Sapiens
FDMYSQPFG

SEQ ID NO: 1308083 - protein, 9 aa, Homo Sapiens
VHFFYTNFL

SEQ ID NO: 1308084 - protein, 9 aa, Homo Sapiens
PVIYHNWDT

SEQ ID NO: 1308085 - protein, 9 aa, Homo Sapiens
HNITIRTTT

SEQ ID NO: 1308086 - protein, 9 aa, Homo Sapiens
HQIIHSREK

SEQ ID NO: 1308087 - protein, 9 aa, Homo Sapiens
AVLDGIKVQ

SEQ ID NO: 1308088 - protein, 9 aa, Homo Sapiens
CLVDLDLAL

SEQ ID NO: 1308089 - protein, 9 aa, Homo Sapiens
LMPEWKIMA

SEQ ID NO: 1308090 - protein, 9 aa, Homo Sapiens
GAPLLRIAR

SEQ ID NO: 1308091 - protein, 9 aa, Homo Sapiens
YVFLQSTFD

SEQ ID NO: 1308092 - protein, 9 aa, Homo Sapiens
EVKSWQITI

SEQ ID NO: 1308093 - protein, 9 aa, Homo Sapiens
IALTSSKLL

SEQ ID NO: 1308094 - protein, 9 aa, Homo Sapiens
LEATVSSKM

SEQ ID NO: 1308095 - protein, 9 aa, Homo Sapiens
TDFWYEYQS

SEQ ID NO: 1308096 - protein, 9 aa, Homo Sapiens
SWKHMNYSE

SEQ ID NO: 1308097 - protein, 9 aa, Homo Sapiens
QHKIFHITE

SEQ ID NO: 1308098 - protein, 9 aa, Homo Sapiens
LYYLRIDQK

SEQ ID NO: 1308099 - protein, 9 aa, Homo Sapiens
WDRRRRATP

SEQ ID NO: 1308100 - protein, 9 aa, Homo Sapiens
NLKIKWDNL

SEQ ID NO: 1308101 - protein, 9 aa, Homo Sapiens
LKIESLGLH

SEQ ID NO: 1308102 - protein, 9 aa, Homo Sapiens
SRGGIGLTG

SEQ ID NO: 1308103 - protein, 9 aa, Homo Sapiens
YLILREPGH

SEQ ID NO: 1308104 - protein, 9 aa, Homo Sapiens
EERNETVFK

SEQ ID NO: 1308105 - protein, 9 aa, Homo Sapiens
KEKKKIKKD

SEQ ID NO: 1308106 - protein, 9 aa, Homo Sapiens
STLHAIIDP

SEQ ID NO: 1308107 - protein, 9 aa, Homo Sapiens
LSRNCQYSV

SEQ ID NO: 1308108 - protein, 9 aa, Homo Sapiens
IYLSNKMPS

SEQ ID NO: 1308109 - protein, 9 aa, Homo Sapiens
DSKEVCSTF

SEQ ID NO: 1308110 - protein, 9 aa, Homo Sapiens
KNYLEELIS

SEQ ID NO: 1308111 - protein, 9 aa, Homo Sapiens
NKKNVEPFT

SEQ ID NO: 1308112 - protein, 9 aa, Homo Sapiens
DNTKFYAAG

SEQ ID NO: 1308113 - protein, 9 aa, Homo Sapiens
FYFDPFDPS

SEQ ID NO: 1308114 - protein, 9 aa, Homo Sapiens
LNWKIILIR

SEQ ID NO: 1308115 - protein, 9 aa, Homo Sapiens
QLTELFSYE

SEQ ID NO: 1308116 - protein, 9 aa, Homo Sapiens
IYVWTNGST

SEQ ID NO: 1308117 - protein, 9 aa, Homo Sapiens
RHEIIHMRE

SEQ ID NO: 1308118 - protein, 9 aa, Homo Sapiens
LPPLPPAKG

SEQ ID NO: 1308119 - protein, 9 aa, Homo Sapiens
WSGPDKLLA

SEQ ID NO: 1308120 - protein, 9 aa, Homo Sapiens
KELNDTLEH

SEQ ID NO: 1308121 - protein, 9 aa, Homo Sapiens
KAALIVHQI

SEQ ID NO: 1308122 - protein, 9 aa, Homo Sapiens
SKNNMNSTL

SEQ ID NO: 1308123 - protein, 9 aa, Homo Sapiens
KGEIFQIIN

SEQ ID NO: 1308124 - protein, 9 aa, Homo Sapiens
PVNYYIYSR

SEQ ID NO: 1308125 - protein, 9 aa, Homo Sapiens
RNFICTVYI

SEQ ID NO: 1308126 - protein, 9 aa, Homo Sapiens
RQIDREEKA

SEQ ID NO: 1308127 - protein, 9 aa, Homo Sapiens
CKAYEYMGH

SEQ ID NO: 1308128 - protein, 9 aa, Homo Sapiens
VVENNLTLL

SEQ ID NO: 1308129 - protein, 9 aa, Homo Sapiens
SLHIYYKKC

SEQ ID NO: 1308130 - protein, 9 aa, Homo Sapiens
VVRAESMRS

SEQ ID NO: 1308131 - protein, 9 aa, Homo Sapiens
AEQIKPEEA

SEQ ID NO: 1308132 - protein, 9 aa, Homo Sapiens
AHHCSICKI

SEQ ID NO: 1308133 - protein, 9 aa, Homo Sapiens
KAKLSLVGI

SEQ ID NO: 1308134 - protein, 9 aa, Homo Sapiens
HESKNRALV

SEQ ID NO: 1308135 - protein, 9 aa, Homo Sapiens
QFSEMLQFL

SEQ ID NO: 1308136 - protein, 9 aa, Homo Sapiens
GDKDPKGGF

SEQ ID NO: 1308137 - protein, 9 aa, Homo Sapiens
SGEQNKKSV

SEQ ID NO: 1308138 - protein, 9 aa, Homo Sapiens
INQKELQGL

SEQ ID NO: 1308139 - protein, 9 aa, Homo Sapiens
RDGTPVIYH

SEQ ID NO: 1308140 - protein, 9 aa, Homo Sapiens
AHKATKSKL

SEQ ID NO: 1308141 - protein, 9 aa, Homo Sapiens
SEMLQFLNI

SEQ ID NO: 1308142 - protein, 9 aa, Homo Sapiens
IMMPVNYYI

SEQ ID NO: 1308143 - protein, 9 aa, Homo Sapiens
NNVAAGTES

SEQ ID NO: 1308144 - protein, 9 aa, Homo Sapiens
SLATQEGKW

SEQ ID NO: 1308145 - protein, 9 aa, Homo Sapiens
LRNHEIREI

SEQ ID NO: 1308146 - protein, 9 aa, Homo Sapiens
ILTRMSQFI

SEQ ID NO: 1308147 - protein, 9 aa, Homo Sapiens
VTRLVLPVG

SEQ ID NO: 1308148 - protein, 9 aa, Homo Sapiens
YFRKKARQS

SEQ ID NO: 1308149 - protein, 9 aa, Homo Sapiens
WKIILIRHR

SEQ ID NO: 1308150 - protein, 9 aa, Homo Sapiens
VIKLHKSHR

SEQ ID NO: 1308151 - protein, 9 aa, Homo Sapiens
TCNVLPIIK

SEQ ID NO: 1308152 - protein, 9 aa, Homo Sapiens
GLKYTLSVD

SEQ ID NO: 1308153 - protein, 9 aa, Homo Sapiens
LPWYRSVSQ

SEQ ID NO: 1308154 - protein, 9 aa, Homo Sapiens
NCCLVDLDL

SEQ ID NO: 1308155 - protein, 9 aa, Homo Sapiens
LNNQSHRDC

SEQ ID NO: 1308156 - protein, 9 aa, Homo Sapiens
IDDAPVLIS

SEQ ID NO: 1308157 - protein, 9 aa, Homo Sapiens
SWSGPDKLL

SEQ ID NO: 1308158 - protein, 9 aa, Homo Sapiens
FHMVKQKIP

SEQ ID NO: 1308159 - protein, 9 aa, Homo Sapiens
RIILFLITV

SEQ ID NO: 1308160 - protein, 9 aa, Homo Sapiens
EQQDVGDFP

SEQ ID NO: 1308161 - protein, 9 aa, Homo Sapiens
LIKKLDTFK

SEQ ID NO: 1308162 - protein, 9 aa, Homo Sapiens
YYIYSRILG

SEQ ID NO: 1308163 - protein, 9 aa, Homo Sapiens
EIIRPRRTL

SEQ ID NO: 1308164 - protein, 9 aa, Homo Sapiens
LGFTGPLCI

SEQ ID NO: 1308165 - protein, 9 aa, Homo Sapiens
MPRDIQLAR

SEQ ID NO: 1308166 - protein, 9 aa, Homo Sapiens
FIRYHEMTH

SEQ ID NO: 1308167 - protein, 9 aa, Homo Sapiens
KVLELLAKV

SEQ ID NO: 1308168 - protein, 9 aa, Homo Sapiens
ILREPGHVA

SEQ ID NO: 1308169 - protein, 9 aa, Homo Sapiens
NEDCFGMWI

SEQ ID NO: 1308170 - protein, 9 aa, Homo Sapiens
APYKLHGPH

SEQ ID NO: 1308171 - protein, 9 aa, Homo Sapiens
PHQIKNILK

SEQ ID NO: 1308172 - protein, 9 aa, Homo Sapiens
NTSVKPSQP

SEQ ID NO: 1308173 - protein, 9 aa, Homo Sapiens
EMLQFLNIL

SEQ ID NO: 1308174 - protein, 9 aa, Homo Sapiens
VLYPNAGQL

SEQ ID NO: 1308175 - protein, 9 aa, Homo Sapiens
TIFQASAPR

SEQ ID NO: 1308176 - protein, 9 aa, Homo Sapiens
DTKKSREDY

SEQ ID NO: 1308177 - protein, 9 aa, Homo Sapiens
NICSCNEIE

SEQ ID NO: 1308178 - protein, 9 aa, Homo Sapiens
QMFQPMKNL

SEQ ID NO: 1308179 - protein, 9 aa, Homo Sapiens
GWSKGLIGM

SEQ ID NO: 1308180 - protein, 9 aa, Homo Sapiens
KVVVDRKHV

SEQ ID NO: 1308181 - protein, 9 aa, Homo Sapiens
VPESSSEAS

SEQ ID NO: 1308182 - protein, 9 aa, Homo Sapiens
GVLPKTFQD

SEQ ID NO: 1308183 - protein, 9 aa, Homo Sapiens
LLALGASLL

SEQ ID NO: 1308184 - protein, 9 aa, Homo Sapiens
NWCMAQAYA

SEQ ID NO: 1308185 - protein, 9 aa, Homo Sapiens
VNLLFWYQL

SEQ ID NO: 1308186 - protein, 9 aa, Homo Sapiens
SYYEESDEE

SEQ ID NO: 1308187 - protein, 9 aa, Homo Sapiens
KTPKASPKY

SEQ ID NO: 1308188 - protein, 9 aa, Homo Sapiens
GSNKILFNV

SEQ ID NO: 1308189 - protein, 9 aa, Homo Sapiens
FLENYLETL

SEQ ID NO: 1308190 - protein, 9 aa, Homo Sapiens
PEVSHIKNK

SEQ ID NO: 1308191 - protein, 9 aa, Homo Sapiens
MWRAKGTTW

SEQ ID NO: 1308192 - protein, 9 aa, Homo Sapiens
MLQFLNILK

SEQ ID NO: 1308193 - protein, 9 aa, Homo Sapiens
LKCLKMVYY

SEQ ID NO: 1308194 - protein, 9 aa, Homo Sapiens
SRNIIPLHI

SEQ ID NO: 1308195 - protein, 9 aa, Homo Sapiens
FTSTLHSLK

SEQ ID NO: 1308196 - protein, 9 aa, Homo Sapiens
SGHTNTNNL

SEQ ID NO: 1308197 - protein, 9 aa, Homo Sapiens
SSDANEFIS

SEQ ID NO: 1308198 - protein, 9 aa, Homo Sapiens
QYITTSYMT

SEQ ID NO: 1308199 - protein, 9 aa, Homo Sapiens
IMRNQLSVK

SEQ ID NO: 1308200 - protein, 9 aa, Homo Sapiens
MSRITLLPI

SEQ ID NO: 1308201 - protein, 9 aa, Homo Sapiens
EICRHKRSH

SEQ ID NO: 1308202 - protein, 9 aa, Homo Sapiens
EEANKRAED

SEQ ID NO: 1308203 - protein, 9 aa, Homo Sapiens
RINITHFGP

SEQ ID NO: 1308204 - protein, 9 aa, Homo Sapiens
KYKGVTKEV

SEQ ID NO: 1308205 - protein, 9 aa, Homo Sapiens
AMKTLFRGK

SEQ ID NO: 1308206 - protein, 9 aa, Homo Sapiens
NLFKALKHI

SEQ ID NO: 1308207 - protein, 9 aa, Homo Sapiens
GAPGISLSS

SEQ ID NO: 1308208 - protein, 9 aa, Homo Sapiens
VIWEVLHKL

SEQ ID NO: 1308209 - protein, 9 aa, Homo Sapiens
LPIDPNKPT

SEQ ID NO: 1308210 - protein, 9 aa, Homo Sapiens
TTLTKHKII

SEQ ID NO: 1308211 - protein, 9 aa, Homo Sapiens
LVRKGETIF

SEQ ID NO: 1308212 - protein, 9 aa, Homo Sapiens
NTNNLKVPE

SEQ ID NO: 1308213 - protein, 9 aa, Homo Sapiens
HFLGPQKSF

SEQ ID NO: 1308214 - protein, 9 aa, Homo Sapiens
EAEQIKPEE

SEQ ID NO: 1308215 - protein, 9 aa, Homo Sapiens
FVMLKGRPC

SEQ ID NO: 1308216 - protein, 9 aa, Homo Sapiens
TVPESITVG

SEQ ID NO: 1308217 - protein, 9 aa, Homo Sapiens
LCIFMFVIF

SEQ ID NO: 1308218 - protein, 9 aa, Homo Sapiens
VPATQEPDN

SEQ ID NO: 1308219 - protein, 9 aa, Homo Sapiens
GTNQTEQNC

SEQ ID NO: 1308220 - protein, 9 aa, Homo Sapiens
VEHDKIKST

SEQ ID NO: 1308221 - protein, 9 aa, Homo Sapiens
IILLVSYLK

SEQ ID NO: 1308222 - protein, 9 aa, Homo Sapiens
LQYSTVINS

SEQ ID NO: 1308223 - protein, 9 aa, Homo Sapiens
PLSGFILFT

SEQ ID NO: 1308224 - protein, 9 aa, Homo Sapiens
ETVFQEVVS

SEQ ID NO: 1308225 - protein, 9 aa, Homo Sapiens
KMCALEEEN

SEQ ID NO: 1308226 - protein, 9 aa, Homo Sapiens
TSRKPITPE

SEQ ID NO: 1308227 - protein, 9 aa, Homo Sapiens
DDKSPICDS

SEQ ID NO: 1308228 - protein, 9 aa, Homo Sapiens
GDKPYTCEE

SEQ ID NO: 1308229 - protein, 9 aa, Homo Sapiens
ALFGPIRLG

SEQ ID NO: 1308230 - protein, 9 aa, Homo Sapiens
TTHKIISTG

SEQ ID NO: 1308231 - protein, 9 aa, Homo Sapiens
NGGVGREVG

SEQ ID NO: 1308232 - protein, 9 aa, Homo Sapiens
RDVNIPRPP

SEQ ID NO: 1308233 - protein, 9 aa, Homo Sapiens
SDKLKKLDS

SEQ ID NO: 1308234 - protein, 9 aa, Homo Sapiens
KPPVCLLLE

SEQ ID NO: 1308235 - protein, 9 aa, Homo Sapiens
LCWMPHHTL

SEQ ID NO: 1308236 - protein, 9 aa, Homo Sapiens
SDMVCLRTS

SEQ ID NO: 1308237 - protein, 9 aa, Homo Sapiens
ETAPGIHKR

SEQ ID NO: 1308238 - protein, 9 aa, Homo Sapiens
GIDQIISQV

SEQ ID NO: 1308239 - protein, 9 aa, Homo Sapiens
AIATLHEKI

SEQ ID NO: 1308240 - protein, 9 aa, Homo Sapiens
MLSDPCVLL

SEQ ID NO: 1308241 - protein, 9 aa, Homo Sapiens
AYLRTRIKL

SEQ ID NO: 1308242 - protein, 9 aa, Homo Sapiens
SLHLPLWDA

SEQ ID NO: 1308243 - protein, 9 aa, Homo Sapiens
TEESLHRIN

SEQ ID NO: 1308244 - protein, 9 aa, Homo Sapiens
VAALKCLKM

SEQ ID NO: 1308245 - protein, 9 aa, Homo Sapiens
IIIAYLRDF

SEQ ID NO: 1308246 - protein, 9 aa, Homo Sapiens
CQKCRWRQC

SEQ ID NO: 1308247 - protein, 9 aa, Homo Sapiens
KVIGDGKFA

SEQ ID NO: 1308248 - protein, 9 aa, Homo Sapiens
GLEHTTSSR

SEQ ID NO: 1308249 - protein, 9 aa, Homo Sapiens
DKRYISVVP

SEQ ID NO: 1308250 - protein, 9 aa, Homo Sapiens
AKDDLPTRN

SEQ ID NO: 1308251 - protein, 9 aa, Homo Sapiens
TNYVFKEIN

SEQ ID NO: 1308252 - protein, 9 aa, Homo Sapiens
SKDCKPPVC

SEQ ID NO: 1308253 - protein, 9 aa, Homo Sapiens
SWFQDEEDD

SEQ ID NO: 1308254 - protein, 9 aa, Homo Sapiens
LGEAEYLIL

SEQ ID NO: 1308255 - protein, 9 aa, Homo Sapiens
TQAVPRPLP

SEQ ID NO: 1308256 - protein, 9 aa, Homo Sapiens
KGKITPQLN

SEQ ID NO: 1308257 - protein, 9 aa, Homo Sapiens
SGKLSLSGG

SEQ ID NO: 1308258 - protein, 9 aa, Homo Sapiens
QKILCSKTE

SEQ ID NO: 1308259 - protein, 9 aa, Homo Sapiens
FEDCQTGAW

SEQ ID NO: 1308260 - protein, 9 aa, Homo Sapiens
LHFGPYEGQ

SEQ ID NO: 1308261 - protein, 9 aa, Homo Sapiens
LSEDKVFAL

SEQ ID NO: 1308262 - protein, 9 aa, Homo Sapiens
LDERPWASR

SEQ ID NO: 1308263 - protein, 9 aa, Homo Sapiens
MISYCLIAQ

SEQ ID NO: 1308264 - protein, 9 aa, Homo Sapiens
PRCEPGLSS

SEQ ID NO: 1308265 - protein, 9 aa, Homo Sapiens
KLLKMITVH

SEQ ID NO: 1308266 - protein, 9 aa, Homo Sapiens
VTVRCWIIR

SEQ ID NO: 1308267 - protein, 9 aa, Homo Sapiens
IGLGDRHVQ

SEQ ID NO: 1308268 - protein, 9 aa, Homo Sapiens
VLELLAKVN

SEQ ID NO: 1308269 - protein, 9 aa, Homo Sapiens
FVPGNNSNV

SEQ ID NO: 1308270 - protein, 9 aa, Homo Sapiens
IFSYHIFSN

SEQ ID NO: 1308271 - protein, 9 aa, Homo Sapiens
FLYALLGKY

SEQ ID NO: 1308272 - protein, 9 aa, Homo Sapiens
LPQNQISHL

SEQ ID NO: 1308273 - protein, 9 aa, Homo Sapiens
PMLGSVLRY

SEQ ID NO: 1308274 - protein, 9 aa, Homo Sapiens
HPVGDFHCK

SEQ ID NO: 1308275 - protein, 9 aa, Homo Sapiens
ILPNDLFRL

SEQ ID NO: 1308276 - protein, 9 aa, Homo Sapiens
IYFLVGSNN

SEQ ID NO: 1308277 - protein, 9 aa, Homo Sapiens
GLGGQLPAY

SEQ ID NO: 1308278 - protein, 9 aa, Homo Sapiens
SKTENARLI

SEQ ID NO: 1308279 - protein, 9 aa, Homo Sapiens
GKITPQLNK

SEQ ID NO: 1308280 - protein, 9 aa, Homo Sapiens
CEDSESFRQ

SEQ ID NO: 1308281 - protein, 9 aa, Homo Sapiens
LKAFANYSV

SEQ ID NO: 1308282 - protein, 9 aa, Homo Sapiens
KGNPRVPDA

SEQ ID NO: 1308283 - protein, 9 aa, Homo Sapiens
GFSSLEDNL

SEQ ID NO: 1308284 - protein, 9 aa, Homo Sapiens
EIINSTNRQ

SEQ ID NO: 1308285 - protein, 9 aa, Homo Sapiens
PVTTLSEDK

SEQ ID NO: 1308286 - protein, 9 aa, Homo Sapiens
EAKDLPVKL

SEQ ID NO: 1308287 - protein, 9 aa, Homo Sapiens
GTALNILFS

SEQ ID NO: 1308288 - protein, 9 aa, Homo Sapiens
QINHIVNKY

SEQ ID NO: 1308289 - protein, 9 aa, Homo Sapiens
YLSSSLYQA

SEQ ID NO: 1308290 - protein, 9 aa, Homo Sapiens
QGGKINLKV

SEQ ID NO: 1308291 - protein, 9 aa, Homo Sapiens
ITICEKIHL

SEQ ID NO: 1308292 - protein, 9 aa, Homo Sapiens
ILYESIIPK

SEQ ID NO: 1308293 - protein, 9 aa, Homo Sapiens
RDMFHSCTG

SEQ ID NO: 1308294 - protein, 9 aa, Homo Sapiens
YGTMVSLYY

SEQ ID NO: 1308295 - protein, 9 aa, Homo Sapiens
FTGPLCIFG

SEQ ID NO: 1308296 - protein, 9 aa, Homo Sapiens
NFLPPQPDF

SEQ ID NO: 1308297 - protein, 9 aa, Homo Sapiens
ITTKGLVRG

SEQ ID NO: 1308298 - protein, 9 aa, Homo Sapiens
EILIKKLDT

SEQ ID NO: 1308299 - protein, 9 aa, Homo Sapiens
LISFLQDCL

SEQ ID NO: 1308300 - protein, 9 aa, Homo Sapiens
ITISVTSVY

SEQ ID NO: 1308301 - protein, 9 aa, Homo Sapiens
DLADKRHVS

SEQ ID NO: 1308302 - protein, 9 aa, Homo Sapiens
EEVPFRYNE

SEQ ID NO: 1308303 - protein, 9 aa, Homo Sapiens
RSYLSSFQT

SEQ ID NO: 1308304 - protein, 9 aa, Homo Sapiens
KKHSSCGFC

SEQ ID NO: 1308305 - protein, 9 aa, Homo Sapiens
GIVFCKIQM

SEQ ID NO: 1308306 - protein, 9 aa, Homo Sapiens
KDKRVTLLT

SEQ ID NO: 1308307 - protein, 9 aa, Homo Sapiens
ELFSYEHFY

SEQ ID NO: 1308308 - protein, 9 aa, Homo Sapiens
HKIIHSGKN

SEQ ID NO: 1308309 - protein, 9 aa, Homo Sapiens
WFQDEEDDD

SEQ ID NO: 1308310 - protein, 9 aa, Homo Sapiens
EIRLPELTK

SEQ ID NO: 1308311 - protein, 9 aa, Homo Sapiens
PRHYGELIE

SEQ ID NO: 1308312 - protein, 9 aa, Homo Sapiens
QYIIHLYHL

SEQ ID NO: 1308313 - protein, 9 aa, Homo Sapiens
LRRNMCLLL

SEQ ID NO: 1308314 - protein, 9 aa, Homo Sapiens
TSVLGNTSS

SEQ ID NO: 1308315 - protein, 9 aa, Homo Sapiens
DQQHPISQV

SEQ ID NO: 1308316 - protein, 9 aa, Homo Sapiens
RANQNINAV

SEQ ID NO: 1308317 - protein, 9 aa, Homo Sapiens
DVSCFFIWQ

SEQ ID NO: 1308318 - protein, 9 aa, Homo Sapiens
MEEFKILNY

SEQ ID NO: 1308319 - protein, 9 aa, Homo Sapiens
GLDEAFLRL

SEQ ID NO: 1308320 - protein, 9 aa, Homo Sapiens
MPHHTLILC

SEQ ID NO: 1308321 - protein, 9 aa, Homo Sapiens
APCTDLFSF

SEQ ID NO: 1308322 - protein, 9 aa, Homo Sapiens
LTSSKAHLY

SEQ ID NO: 1308323 - protein, 9 aa, Homo Sapiens
LPDKIKYPR

SEQ ID NO: 1308324 - protein, 9 aa, Homo Sapiens
EKMGYNVCT

SEQ ID NO: 1308325 - protein, 9 aa, Homo Sapiens
YLANTLMSM

SEQ ID NO: 1308326 - protein, 9 aa, Homo Sapiens
FQMQNTLYL

SEQ ID NO: 1308327 - protein, 9 aa, Homo Sapiens
PEGQAPCLP

SEQ ID NO: 1308328 - protein, 9 aa, Homo Sapiens
RPSRQISIS

SEQ ID NO: 1308329 - protein, 9 aa, Homo Sapiens
ILFTTIYLT

SEQ ID NO: 1308330 - protein, 9 aa, Homo Sapiens
LLAKVNGTT

SEQ ID NO: 1308331 - protein, 9 aa, Homo Sapiens
WVLVVLDTS

SEQ ID NO: 1308332 - protein, 9 aa, Homo Sapiens
QEPDNILPR

SEQ ID NO: 1308333 - protein, 9 aa, Homo Sapiens
YEEGSNKIL

SEQ ID NO: 1308334 - protein, 9 aa, Homo Sapiens
LLLTMIIFL

SEQ ID NO: 1308335 - protein, 9 aa, Homo Sapiens
LWLSVLQNA

SEQ ID NO: 1308336 - protein, 9 aa, Homo Sapiens
FMMSDYRGF

SEQ ID NO: 1308337 - protein, 9 aa, Homo Sapiens
MDFSATQFH

SEQ ID NO: 1308338 - protein, 9 aa, Homo Sapiens
LNSLLDTMP

SEQ ID NO: 1308339 - protein, 9 aa, Homo Sapiens
KSREDYISE

SEQ ID NO: 1308340 - protein, 9 aa, Homo Sapiens
YHLALSPIY

SEQ ID NO: 1308341 - protein, 9 aa, Homo Sapiens
MHKLKLEQC

SEQ ID NO: 1308342 - protein, 9 aa, Homo Sapiens
HYFPAFEKV

SEQ ID NO: 1308343 - protein, 9 aa, Homo Sapiens
LYKKFSPAG

SEQ ID NO: 1308344 - protein, 9 aa, Homo Sapiens
FKKGHTINK

SEQ ID NO: 1308345 - protein, 9 aa, Homo Sapiens
KPKEATTIN

SEQ ID NO: 1308346 - protein, 9 aa, Homo Sapiens
SQTPDKETA

SEQ ID NO: 1308347 - protein, 9 aa, Homo Sapiens
EKTHPKDSP

SEQ ID NO: 1308348 - protein, 9 aa, Homo Sapiens
SAPNPNVIC

SEQ ID NO: 1308349 - protein, 9 aa, Homo Sapiens
VEKYVNKAK

SEQ ID NO: 1308350 - protein, 9 aa, Homo Sapiens
NNASGYSCG

SEQ ID NO: 1308351 - protein, 9 aa, Homo Sapiens
KQCGKAFIH

SEQ ID NO: 1308352 - protein, 9 aa, Homo Sapiens
KKKDDNKKK

SEQ ID NO: 1308353 - protein, 9 aa, Homo Sapiens
DINDNTPEL

SEQ ID NO: 1308354 - protein, 9 aa, Homo Sapiens
PQGNYFEYT

SEQ ID NO: 1308355 - protein, 9 aa, Homo Sapiens
KKVQKGNAV

SEQ ID NO: 1308356 - protein, 9 aa, Homo Sapiens
IWSDYVAPT

SEQ ID NO: 1308357 - protein, 9 aa, Homo Sapiens
TFSRENHSE

SEQ ID NO: 1308358 - protein, 9 aa, Homo Sapiens
PQLAVSVII

SEQ ID NO: 1308359 - protein, 9 aa, Homo Sapiens
KKELITVFW

SEQ ID NO: 1308360 - protein, 9 aa, Homo Sapiens
GKNKAKLSL

SEQ ID NO: 1308361 - protein, 9 aa, Homo Sapiens
ILGFNILSM

SEQ ID NO: 1308362 - protein, 9 aa, Homo Sapiens
KVEVEHVMK

SEQ ID NO: 1308363 - protein, 9 aa, Homo Sapiens
LIKFVSKLS

SEQ ID NO: 1308364 - protein, 9 aa, Homo Sapiens
AETSETMVP

SEQ ID NO: 1308365 - protein, 9 aa, Homo Sapiens
RRLRIWSDY

SEQ ID NO: 1308366 - protein, 9 aa, Homo Sapiens
QEEHLELLG

SEQ ID NO: 1308367 - protein, 9 aa, Homo Sapiens
ETGVVFIFY

SEQ ID NO: 1308368 - protein, 9 aa, Homo Sapiens
KLCFSAAGS

SEQ ID NO: 1308369 - protein, 9 aa, Homo Sapiens
GSNLSELNR

SEQ ID NO: 1308370 - protein, 9 aa, Homo Sapiens
HFFCGMPQL

SEQ ID NO: 1308371 - protein, 9 aa, Homo Sapiens
TVYLIDFST

SEQ ID NO: 1308372 - protein, 9 aa, Homo Sapiens
VIAQNLEKM

SEQ ID NO: 1308373 - protein, 9 aa, Homo Sapiens
EEEIMRNQL

SEQ ID NO: 1308374 - protein, 9 aa, Homo Sapiens
TGERPFKCI

SEQ ID NO: 1308375 - protein, 9 aa, Homo Sapiens
SGIQIEKHF

SEQ ID NO: 1308376 - protein, 9 aa, Homo Sapiens
RGSPFVWSG

SEQ ID NO: 1308377 - protein, 9 aa, Homo Sapiens
TSKEICNEL

SEQ ID NO: 1308378 - protein, 9 aa, Homo Sapiens
TSGLKSQGC

SEQ ID NO: 1308379 - protein, 9 aa, Homo Sapiens
SYGTMVSLY

SEQ ID NO: 1308380 - protein, 9 aa, Homo Sapiens
GEKPYKFKE

SEQ ID NO: 1308381 - protein, 9 aa, Homo Sapiens
VAGICYITS

SEQ ID NO: 1308382 - protein, 9 aa, Homo Sapiens
SETQAVPRP

SEQ ID NO: 1308383 - protein, 9 aa, Homo Sapiens
GTLKIIPSY

SEQ ID NO: 1308384 - protein, 9 aa, Homo Sapiens
WQITIRWEP

SEQ ID NO: 1308385 - protein, 9 aa, Homo Sapiens
STHLVQHQI

SEQ ID NO: 1308386 - protein, 9 aa, Homo Sapiens
LKCSQLCEQ

SEQ ID NO: 1308387 - protein, 9 aa, Homo Sapiens
LTTDFWARC

SEQ ID NO: 1308388 - protein, 9 aa, Homo Sapiens
GETSDMYLI

SEQ ID NO: 1308389 - protein, 9 aa, Homo Sapiens
EIDRSMKNN

SEQ ID NO: 1308390 - protein, 9 aa, Homo Sapiens
CFKSIITAG

SEQ ID NO: 1308391 - protein, 9 aa, Homo Sapiens
FTTHKGHFQ

SEQ ID NO: 1308392 - protein, 9 aa, Homo Sapiens
TQEQQTQRN

SEQ ID NO: 1308393 - protein, 9 aa, Homo Sapiens
KQIIARSKA

SEQ ID NO: 1308394 - protein, 9 aa, Homo Sapiens
MNYTTSKKD

SEQ ID NO: 1308395 - protein, 9 aa, Homo Sapiens
VQKRKQSFK

SEQ ID NO: 1308396 - protein, 9 aa, Homo Sapiens
EAVREFAKD

SEQ ID NO: 1308397 - protein, 9 aa, Homo Sapiens
FCQDNQTIP

SEQ ID NO: 1308398 - protein, 9 aa, Homo Sapiens
YITTSYMTI

SEQ ID NO: 1308399 - protein, 9 aa, Homo Sapiens
KICIRKMDH

SEQ ID NO: 1308400 - protein, 9 aa, Homo Sapiens
LTEESLHRI

SEQ ID NO: 1308401 - protein, 9 aa, Homo Sapiens
SAKNQGAHY

SEQ ID NO: 1308402 - protein, 9 aa, Homo Sapiens
QCQRDSENN

SEQ ID NO: 1308403 - protein, 9 aa, Homo Sapiens
YIWLAANNG

SEQ ID NO: 1308404 - protein, 9 aa, Homo Sapiens
DEDGEGPST

SEQ ID NO: 1308405 - protein, 9 aa, Homo Sapiens
DLLCLSKDD

SEQ ID NO: 1308406 - protein, 9 aa, Homo Sapiens
LSLFKHRGF

SEQ ID NO: 1308407 - protein, 9 aa, Homo Sapiens
LRKELNALR

SEQ ID NO: 1308408 - protein, 9 aa, Homo Sapiens
GWDAVKREA

SEQ ID NO: 1308409 - protein, 9 aa, Homo Sapiens
VSSCQYIIH

SEQ ID NO: 1308410 - protein, 9 aa, Homo Sapiens
NARIVVLFM

SEQ ID NO: 1308411 - protein, 9 aa, Homo Sapiens
SHIKNKEVS

SEQ ID NO: 1308412 - protein, 9 aa, Homo Sapiens
ITSRNIIPL

SEQ ID NO: 1308413 - protein, 9 aa, Homo Sapiens
KRWNTSEVH

SEQ ID NO: 1308414 - protein, 9 aa, Homo Sapiens
NAVHLNSLI

SEQ ID NO: 1308415 - protein, 9 aa, Homo Sapiens
VTTLSEDKV

SEQ ID NO: 1308416 - protein, 9 aa, Homo Sapiens
LVSFQTHMI

SEQ ID NO: 1308417 - protein, 9 aa, Homo Sapiens
EFRKHIKDM

SEQ ID NO: 1308418 - protein, 9 aa, Homo Sapiens
IVGYIIGLG

SEQ ID NO: 1308419 - protein, 9 aa, Homo Sapiens
VLQNANKTA

SEQ ID NO: 1308420 - protein, 9 aa, Homo Sapiens
KIILNISAD

SEQ ID NO: 1308421 - protein, 9 aa, Homo Sapiens
EAMKYKLES

SEQ ID NO: 1308422 - protein, 9 aa, Homo Sapiens
LSCFIIPVL

SEQ ID NO: 1308423 - protein, 9 aa, Homo Sapiens
NIGKAFLPS

SEQ ID NO: 1308424 - protein, 9 aa, Homo Sapiens
QLIKINYSW

SEQ ID NO: 1308425 - protein, 9 aa, Homo Sapiens
KLCELLALE

SEQ ID NO: 1308426 - protein, 9 aa, Homo Sapiens
STFVMGKDF

SEQ ID NO: 1308427 - protein, 9 aa, Homo Sapiens
GKKKKYVIL

SEQ ID NO: 1308428 - protein, 9 aa, Homo Sapiens
LPSWKTSFY

SEQ ID NO: 1308429 - protein, 9 aa, Homo Sapiens
VPGSRKHYL

SEQ ID NO: 1308430 - protein, 9 aa, Homo Sapiens
VASFLALMW

SEQ ID NO: 1308431 - protein, 9 aa, Homo Sapiens
KLREGQHFI

SEQ ID NO: 1308432 - protein, 9 aa, Homo Sapiens
KRVTIMPRD

SEQ ID NO: 1308433 - protein, 9 aa, Homo Sapiens
LKYKVTVGE

SEQ ID NO: 1308434 - protein, 9 aa, Homo Sapiens
IEKYNDATQ

SEQ ID NO: 1308435 - protein, 9 aa, Homo Sapiens
INKRKLELA

SEQ ID NO: 1308436 - protein, 9 aa, Homo Sapiens
CGFCCERGH

SEQ ID NO: 1308437 - protein, 9 aa, Homo Sapiens
ALAATHALG

SEQ ID NO: 1308438 - protein, 9 aa, Homo Sapiens
VLPWYRSVS

SEQ ID NO: 1308439 - protein, 9 aa, Homo Sapiens
IKLWEMDNM

SEQ ID NO: 1308440 - protein, 9 aa, Homo Sapiens
TLPERNKLS

SEQ ID NO: 1308441 - protein, 9 aa, Homo Sapiens
TAQEKDYLI

SEQ ID NO: 1308442 - protein, 9 aa, Homo Sapiens
PSSQTKVLS

SEQ ID NO: 1308443 - protein, 9 aa, Homo Sapiens
FELLDGINA

SEQ ID NO: 1308444 - protein, 9 aa, Homo Sapiens
FWMIGDDLV

SEQ ID NO: 1308445 - protein, 9 aa, Homo Sapiens
SEVLQIQNI

SEQ ID NO: 1308446 - protein, 9 aa, Homo Sapiens
QTAVVMKTC

SEQ ID NO: 1308447 - protein, 9 aa, Homo Sapiens
NITVPFKAW

SEQ ID NO: 1308448 - protein, 9 aa, Homo Sapiens
AAEINKFLE

SEQ ID NO: 1308449 - protein, 9 aa, Homo Sapiens
DDAPVLISQ

SEQ ID NO: 1308450 - protein, 9 aa, Homo Sapiens
WVLTAVHCV

SEQ ID NO: 1308451 - protein, 9 aa, Homo Sapiens
KSEITKETL

SEQ ID NO: 1308452 - protein, 9 aa, Homo Sapiens
AGPTNLQIE

SEQ ID NO: 1308453 - protein, 9 aa, Homo Sapiens
KLFCEIDEE

SEQ ID NO: 1308454 - protein, 9 aa, Homo Sapiens
NQLPLIVDA

SEQ ID NO: 1308455 - protein, 9 aa, Homo Sapiens
SSLIAGQPG

SEQ ID NO: 1308456 - protein, 9 aa, Homo Sapiens
QGAHYPDYE

SEQ ID NO: 1308457 - protein, 9 aa, Homo Sapiens
NDPCLRGDK

SEQ ID NO: 1308458 - protein, 9 aa, Homo Sapiens
DSYAELRQL

SEQ ID NO: 1308459 - protein, 9 aa, Homo Sapiens
PRNLKTPTE

SEQ ID NO: 1308460 - protein, 9 aa, Homo Sapiens
DYLITPHVS

SEQ ID NO: 1308461 - protein, 9 aa, Homo Sapiens
IYRTPLYYL

SEQ ID NO: 1308462 - protein, 9 aa, Homo Sapiens
LLGKYFRKK

SEQ ID NO: 1308463 - protein, 9 aa, Homo Sapiens
VFDPNRFSQ

SEQ ID NO: 1308464 - protein, 9 aa, Homo Sapiens
HKEDKLMKI

SEQ ID NO: 1308465 - protein, 9 aa, Homo Sapiens
KLAVAKPNN

SEQ ID NO: 1308466 - protein, 9 aa, Homo Sapiens
IRGIYSKKQ

SEQ ID NO: 1308467 - protein, 9 aa, Homo Sapiens
KVFNCCLVD

SEQ ID NO: 1308468 - protein, 9 aa, Homo Sapiens
KLCVSEMYR

SEQ ID NO: 1308469 - protein, 9 aa, Homo Sapiens
DFELLDGIN

SEQ ID NO: 1308470 - protein, 9 aa, Homo Sapiens
SEICRHKRS

SEQ ID NO: 1308471 - protein, 9 aa, Homo Sapiens
FESEAMKYK

SEQ ID NO: 1308472 - protein, 9 aa, Homo Sapiens
THMIMHTGE

SEQ ID NO: 1308473 - protein, 9 aa, Homo Sapiens
EALSCFIIP

SEQ ID NO: 1308474 - protein, 9 aa, Homo Sapiens
FNLPSFIRY

SEQ ID NO: 1308475 - protein, 9 aa, Homo Sapiens
QLLNQIQRH

SEQ ID NO: 1308476 - protein, 9 aa, Homo Sapiens
LREFFTKMG

SEQ ID NO: 1308477 - protein, 9 aa, Homo Sapiens
RQKDAENEV

SEQ ID NO: 1308478 - protein, 9 aa, Homo Sapiens
VYLIDFSTD

SEQ ID NO: 1308479 - protein, 9 aa, Homo Sapiens
TKFVSAPHI

SEQ ID NO: 1308480 - protein, 9 aa, Homo Sapiens
FSFYDLQRE

SEQ ID NO: 1308481 - protein, 9 aa, Homo Sapiens
LQYITTSYM

SEQ ID NO: 1308482 - protein, 9 aa, Homo Sapiens
IRLKRFIHV

SEQ ID NO: 1308483 - protein, 9 aa, Homo Sapiens
TLDMALGNK

SEQ ID NO: 1308484 - protein, 9 aa, Homo Sapiens
EEEEANKRA

SEQ ID NO: 1308485 - protein, 9 aa, Homo Sapiens
AYKIKYPDN

SEQ ID NO: 1308486 - protein, 9 aa, Homo Sapiens
VRIASESWA

SEQ ID NO: 1308487 - protein, 9 aa, Homo Sapiens
DTSWVGWGS

SEQ ID NO: 1308488 - protein, 9 aa, Homo Sapiens
EERRSLRIR

SEQ ID NO: 1308489 - protein, 9 aa, Homo Sapiens
INLTEEPTK

SEQ ID NO: 1308490 - protein, 9 aa, Homo Sapiens
DYRGKYLEL

SEQ ID NO: 1308491 - protein, 9 aa, Homo Sapiens
TITQKARHC

SEQ ID NO: 1308492 - protein, 9 aa, Homo Sapiens
CQTGAWRHG

SEQ ID NO: 1308493 - protein, 9 aa, Homo Sapiens
VQGVFRSIS

SEQ ID NO: 1308494 - protein, 9 aa, Homo Sapiens
NSFFKQECI

SEQ ID NO: 1308495 - protein, 9 aa, Homo Sapiens
SLVKIMKDI

SEQ ID NO: 1308496 - protein, 9 aa, Homo Sapiens
TIQWPMTET

SEQ ID NO: 1308497 - protein, 9 aa, Homo Sapiens
KVLHFKDWI

SEQ ID NO: 1308498 - protein, 9 aa, Homo Sapiens
IGVTQKTIW

SEQ ID NO: 1308499 - protein, 9 aa, Homo Sapiens
MINCEDINE

SEQ ID NO: 1308500 - protein, 9 aa, Homo Sapiens
ENEEIAAEI

SEQ ID NO: 1308501 - protein, 9 aa, Homo Sapiens
TEMEFSLFY

SEQ ID NO: 1308502 - protein, 9 aa, Homo Sapiens
LLFNGCHSG

SEQ ID NO: 1308503 - protein, 9 aa, Homo Sapiens
ISTLHAIID

SEQ ID NO: 1308504 - protein, 9 aa, Homo Sapiens
FILFTTIYL

SEQ ID NO: 1308505 - protein, 9 aa, Homo Sapiens
FNILSMSIT

SEQ ID NO: 1308506 - protein, 9 aa, Homo Sapiens
RTPLYYLRI

SEQ ID NO: 1308507 - protein, 9 aa, Homo Sapiens
ANTGIILCI

SEQ ID NO: 1308508 - protein, 9 aa, Homo Sapiens
PGISLSSLI

SEQ ID NO: 1308509 - protein, 9 aa, Homo Sapiens
DAKDNFYRV

SEQ ID NO: 1308510 - protein, 9 aa, Homo Sapiens
VVMQESLLE

SEQ ID NO: 1308511 - protein, 9 aa, Homo Sapiens
KYNDTENKD

SEQ ID NO: 1308512 - protein, 9 aa, Homo Sapiens
FVDMVNGTD

SEQ ID NO: 1308513 - protein, 9 aa, Homo Sapiens
YTRFEKNGQ

SEQ ID NO: 1308514 - protein, 9 aa, Homo Sapiens
SLRLSLTGH

SEQ ID NO: 1308515 - protein, 9 aa, Homo Sapiens
DRCKVLISF

SEQ ID NO: 1308516 - protein, 9 aa, Homo Sapiens
QEQQTQRNV

SEQ ID NO: 1308517 - protein, 9 aa, Homo Sapiens
QKLKDTLGH

SEQ ID NO: 1308518 - protein, 9 aa, Homo Sapiens
KVFYPVIFS

SEQ ID NO: 1308519 - protein, 9 aa, Homo Sapiens
VPLTLQFIY

SEQ ID NO: 1308520 - protein, 9 aa, Homo Sapiens
AYPSCRDPP

SEQ ID NO: 1308521 - protein, 9 aa, Homo Sapiens
APEHEEPQI

SEQ ID NO: 1308522 - protein, 9 aa, Homo Sapiens
PAYPSCRDP

SEQ ID NO: 1308523 - protein, 9 aa, Homo Sapiens
ALTKLTKFV

SEQ ID NO: 1308524 - protein, 9 aa, Homo Sapiens
TPTILNFIL

SEQ ID NO: 1308525 - protein, 9 aa, Homo Sapiens
NLDAIQVLP

SEQ ID NO: 1308526 - protein, 9 aa, Homo Sapiens
VKEKIKNHY

SEQ ID NO: 1308527 - protein, 9 aa, Homo Sapiens
AVSVIIRVA

SEQ ID NO: 1308528 - protein, 9 aa, Homo Sapiens
DHLLAAGKY

SEQ ID NO: 1308529 - protein, 9 aa, Homo Sapiens
TNIIQRLFA

SEQ ID NO: 1308530 - protein, 9 aa, Homo Sapiens
LWLCVQLVV

SEQ ID NO: 1308531 - protein, 9 aa, Homo Sapiens
VVIAILTLT

SEQ ID NO: 1308532 - protein, 9 aa, Homo Sapiens
EHMDIAHLS

SEQ ID NO: 1308533 - protein, 9 aa, Homo Sapiens
EDQLIKINY

SEQ ID NO: 1308534 - protein, 9 aa, Homo Sapiens
DFWARCTSL

SEQ ID NO: 1308535 - protein, 9 aa, Homo Sapiens
IPNINTQMF

SEQ ID NO: 1308536 - protein, 9 aa, Homo Sapiens
CVEEILEIF

SEQ ID NO: 1308537 - protein, 9 aa, Homo Sapiens
ADVDWNVEF

SEQ ID NO: 1308538 - protein, 9 aa, Homo Sapiens
CDEAFSLKS

SEQ ID NO: 1308539 - protein, 9 aa, Homo Sapiens
KSEDLNINL

SEQ ID NO: 1308540 - protein, 9 aa, Homo Sapiens
TRFEKNGQG

SEQ ID NO: 1308541 - protein, 9 aa, Homo Sapiens
FSLRLSLTG

SEQ ID NO: 1308542 - protein, 9 aa, Homo Sapiens
RGGIGLTGR

SEQ ID NO: 1308543 - protein, 9 aa, Homo Sapiens
FVMGKDFTR

SEQ ID NO: 1308544 - protein, 9 aa, Homo Sapiens
AGFFKQNRK

SEQ ID NO: 1308545 - protein, 9 aa, Homo Sapiens
SVLMKQLDT

SEQ ID NO: 1308546 - protein, 9 aa, Homo Sapiens
GFNILSMSI

SEQ ID NO: 1308547 - protein, 9 aa, Homo Sapiens
NNSSLNTIT

SEQ ID NO: 1308548 - protein, 9 aa, Homo Sapiens
SDKLAAVVN

SEQ ID NO: 1308549 - protein, 9 aa, Homo Sapiens
DFWYEYQSP

SEQ ID NO: 1308550 - protein, 9 aa, Homo Sapiens
AYKDDLYRD

SEQ ID NO: 1308551 - protein, 9 aa, Homo Sapiens
FIPGSYLEK

SEQ ID NO: 1308552 - protein, 9 aa, Homo Sapiens
KVQGWKQRM

SEQ ID NO: 1308553 - protein, 9 aa, Homo Sapiens
YGDASKARL

SEQ ID NO: 1308554 - protein, 9 aa, Homo Sapiens
PTSVTVMST

SEQ ID NO: 1308555 - protein, 9 aa, Homo Sapiens
TFIYLSNKM

SEQ ID NO: 1308556 - protein, 9 aa, Homo Sapiens
LHLYGIGGL

SEQ ID NO: 1308557 - protein, 9 aa, Homo Sapiens
KTLVNLKLW

SEQ ID NO: 1308558 - protein, 9 aa, Homo Sapiens
MPDRYQFTS

SEQ ID NO: 1308559 - protein, 9 aa, Homo Sapiens
PLEQKMAKE

SEQ ID NO: 1308560 - protein, 9 aa, Homo Sapiens
ILLDINDNP

SEQ ID NO: 1308561 - protein, 9 aa, Homo Sapiens
SFPSEICRH

SEQ ID NO: 1308562 - protein, 9 aa, Homo Sapiens
TPHSYSAQR

SEQ ID NO: 1308563 - protein, 9 aa, Homo Sapiens
PETTQNFIF

SEQ ID NO: 1308564 - protein, 9 aa, Homo Sapiens
SHESGEQNK

SEQ ID NO: 1308565 - protein, 9 aa, Homo Sapiens
PIHSAQHLD

SEQ ID NO: 1308566 - protein, 9 aa, Homo Sapiens
HTGEKPFWC

SEQ ID NO: 1308567 - protein, 9 aa, Homo Sapiens
FIFFLGTQA

SEQ ID NO: 1308568 - protein, 9 aa, Homo Sapiens
ERNKLSETE

SEQ ID NO: 1308569 - protein, 9 aa, Homo Sapiens
NIANTSVKP

SEQ ID NO: 1308570 - protein, 9 aa, Homo Sapiens
LRYSRFFYN

SEQ ID NO: 1308571 - protein, 9 aa, Homo Sapiens
VEIKARPPQ

SEQ ID NO: 1308572 - protein, 9 aa, Homo Sapiens
LTLDMALGN

SEQ ID NO: 1308573 - protein, 9 aa, Homo Sapiens
HQQSRRADH

SEQ ID NO: 1308574 - protein, 9 aa, Homo Sapiens
NYGDASKAR

SEQ ID NO: 1308575 - protein, 9 aa, Homo Sapiens
YAELRQLTL

SEQ ID NO: 1308576 - protein, 9 aa, Homo Sapiens
VLGEAEYLI

SEQ ID NO: 1308577 - protein, 9 aa, Homo Sapiens
LPVTRYSDA

SEQ ID NO: 1308578 - protein, 9 aa, Homo Sapiens
LKSQGCLSV

SEQ ID NO: 1308579 - protein, 9 aa, Homo Sapiens
SKYETINLT

SEQ ID NO: 1308580 - protein, 9 aa, Homo Sapiens
TTADTVAQI

SEQ ID NO: 1308581 - protein, 9 aa, Homo Sapiens
SKSALLSGG

SEQ ID NO: 1308582 - protein, 9 aa, Homo Sapiens
SGALQTFYA

SEQ ID NO: 1308583 - protein, 9 aa, Homo Sapiens
SLLKRDCGA

SEQ ID NO: 1308584 - protein, 9 aa, Homo Sapiens
KLIEKIILN

SEQ ID NO: 1308585 - protein, 9 aa, Homo Sapiens
TTSHGSPRS

SEQ ID NO: 1308586 - protein, 9 aa, Homo Sapiens
PRPLPKRVE

SEQ ID NO: 1308587 - protein, 9 aa, Homo Sapiens
PESPDSLQI

SEQ ID NO: 1308588 - protein, 9 aa, Homo Sapiens
EGQHFIFRH

SEQ ID NO: 1308589 - protein, 9 aa, Homo Sapiens
CQTFWQASQ

SEQ ID NO: 1308590 - protein, 9 aa, Homo Sapiens
DIKIYPQKI

SEQ ID NO: 1308591 - protein, 9 aa, Homo Sapiens
ATIMVHSPT

SEQ ID NO: 1308592 - protein, 9 aa, Homo Sapiens
RNVFKLICD

SEQ ID NO: 1308593 - protein, 9 aa, Homo Sapiens
TGTIMDPHN

SEQ ID NO: 1308594 - protein, 9 aa, Homo Sapiens
NKVPGEKPG

SEQ ID NO: 1308595 - protein, 9 aa, Homo Sapiens
DKDENDLRS

SEQ ID NO: 1308596 - protein, 9 aa, Homo Sapiens
FHLNDGGNV

SEQ ID NO: 1308597 - protein, 9 aa, Homo Sapiens
EDFSKDTMQ

SEQ ID NO: 1308598 - protein, 9 aa, Homo Sapiens
AASCDLSVL

SEQ ID NO: 1308599 - protein, 9 aa, Homo Sapiens
LQNANKTAE

SEQ ID NO: 1308600 - protein, 9 aa, Homo Sapiens
ARGSPFVWS

SEQ ID NO: 1308601 - protein, 9 aa, Homo Sapiens
DPYYYNKKN

SEQ ID NO: 1308602 - protein, 9 aa, Homo Sapiens
LGPQKSFPE

SEQ ID NO: 1308603 - protein, 9 aa, Homo Sapiens
LQEKYKELT

SEQ ID NO: 1308604 - protein, 9 aa, Homo Sapiens
YNASLLIQN

SEQ ID NO: 1308605 - protein, 9 aa, Homo Sapiens
IAEKKLFTV

SEQ ID NO: 1308606 - protein, 9 aa, Homo Sapiens
NIYFYCNPD

SEQ ID NO: 1308607 - protein, 9 aa, Homo Sapiens
CDDKFIFSL

SEQ ID NO: 1308608 - protein, 9 aa, Homo Sapiens
RFIHVFFSS

SEQ ID NO: 1308609 - protein, 9 aa, Homo Sapiens
EASFTLTVA

SEQ ID NO: 1308610 - protein, 9 aa, Homo Sapiens
KSKKNKPLK

SEQ ID NO: 1308611 - protein, 9 aa, Homo Sapiens
KTIQAARSD

SEQ ID NO: 1308612 - protein, 9 aa, Homo Sapiens
YLSVLMKQL

SEQ ID NO: 1308613 - protein, 9 aa, Homo Sapiens
LLCFPPTKR

SEQ ID NO: 1308614 - protein, 9 aa, Homo Sapiens
HLNLAGSGI

SEQ ID NO: 1308615 - protein, 9 aa, Homo Sapiens
TPGSVIAQN

SEQ ID NO: 1308616 - protein, 9 aa, Homo Sapiens
AMALTSTID

SEQ ID NO: 1308617 - protein, 9 aa, Homo Sapiens
FIWFILGNY

SEQ ID NO: 1308618 - protein, 9 aa, Homo Sapiens
IQSEEIKDT

SEQ ID NO: 1308619 - protein, 9 aa, Homo Sapiens
ELKKRNFDL

SEQ ID NO: 1308620 - protein, 9 aa, Homo Sapiens
NKKSVTEMQ

SEQ ID NO: 1308621 - protein, 9 aa, Homo Sapiens
LYLEDFFMM

SEQ ID NO: 1308622 - protein, 9 aa, Homo Sapiens
PGEYNDLSE

SEQ ID NO: 1308623 - protein, 9 aa, Homo Sapiens
KVHWDQVFS

SEQ ID NO: 1308624 - protein, 9 aa, Homo Sapiens
EHKKKSFLT

SEQ ID NO: 1308625 - protein, 9 aa, Homo Sapiens
SQFSICLRT

SEQ ID NO: 1308626 - protein, 9 aa, Homo Sapiens
EAGDGPGLG

SEQ ID NO: 1308627 - protein, 9 aa, Homo Sapiens
PSLFIFRGT

SEQ ID NO: 1308628 - protein, 9 aa, Homo Sapiens
GQKPENISV

SEQ ID NO: 1308629 - protein, 9 aa, Homo Sapiens
TCDYFDKLS

SEQ ID NO: 1308630 - protein, 9 aa, Homo Sapiens
NGCVIVHCL

SEQ ID NO: 1308631 - protein, 9 aa, Homo Sapiens
SSTLTSHKI

SEQ ID NO: 1308632 - protein, 9 aa, Homo Sapiens
HLSFRWTTS

SEQ ID NO: 1308633 - protein, 9 aa, Homo Sapiens
SLPDKIKYP

SEQ ID NO: 1308634 - protein, 9 aa, Homo Sapiens
HRPKDKRVT

SEQ ID NO: 1308635 - protein, 9 aa, Homo Sapiens
HQGGKINLK

SEQ ID NO: 1308636 - protein, 9 aa, Homo Sapiens
TEQNCQVMN

SEQ ID NO: 1308637 - protein, 9 aa, Homo Sapiens
TSTLHSLKK

SEQ ID NO: 1308638 - protein, 9 aa, Homo Sapiens
EDRDRGWDA

SEQ ID NO: 1308639 - protein, 9 aa, Homo Sapiens
GKLSLSGGY

SEQ ID NO: 1308640 - protein, 9 aa, Homo Sapiens
SSCLSKAAG

SEQ ID NO: 1308641 - protein, 9 aa, Homo Sapiens
GILTFMTSF

SEQ ID NO: 1308642 - protein, 9 aa, Homo Sapiens
KAAPSSQRY

SEQ ID NO: 1308643 - protein, 9 aa, Homo Sapiens
GIILCIIML

SEQ ID NO: 1308644 - protein, 9 aa, Homo Sapiens
GKGSPSHQK

SEQ ID NO: 1308645 - protein, 9 aa, Homo Sapiens
TTFSFCPPF

SEQ ID NO: 1308646 - protein, 9 aa, Homo Sapiens
ALDRETQEL

SEQ ID NO: 1308647 - protein, 9 aa, Homo Sapiens
PIFQRVNFG

SEQ ID NO: 1308648 - protein, 9 aa, Homo Sapiens
DGEILGFDM

SEQ ID NO: 1308649 - protein, 9 aa, Homo Sapiens
AGPPPISRL

SEQ ID NO: 1308650 - protein, 9 aa, Homo Sapiens
LKNYLFFSA

SEQ ID NO: 1308651 - protein, 9 aa, Homo Sapiens
YHIFSNMYQ

SEQ ID NO: 1308652 - protein, 9 aa, Homo Sapiens
KGLIGMHRE

SEQ ID NO: 1308653 - protein, 9 aa, Homo Sapiens
GHYRTESRG

SEQ ID NO: 1308654 - protein, 9 aa, Homo Sapiens
TQHLLSIIY

SEQ ID NO: 1308655 - protein, 9 aa, Homo Sapiens
CHPNTHDRL

SEQ ID NO: 1308656 - protein, 9 aa, Homo Sapiens
IPVKRGESK

SEQ ID NO: 1308657 - protein, 9 aa, Homo Sapiens
TSSQVQRYT

SEQ ID NO: 1308658 - protein, 9 aa, Homo Sapiens
IHYLCKFLG

SEQ ID NO: 1308659 - protein, 9 aa, Homo Sapiens
ISEHTRINL

SEQ ID NO: 1308660 - protein, 9 aa, Homo Sapiens
NKKYGVQPW

SEQ ID NO: 1308661 - protein, 9 aa, Homo Sapiens
VGVHGIQIE

SEQ ID NO: 1308662 - protein, 9 aa, Homo Sapiens
AYTYPENLP

SEQ ID NO: 1308663 - protein, 9 aa, Homo Sapiens
QSSAIQAPH

SEQ ID NO: 1308664 - protein, 9 aa, Homo Sapiens
ESWDKIKSS

SEQ ID NO: 1308665 - protein, 9 aa, Homo Sapiens
LKGFFSSIH

SEQ ID NO: 1308666 - protein, 9 aa, Homo Sapiens
PPTKRGPYC

SEQ ID NO: 1308667 - protein, 9 aa, Homo Sapiens
NRHKLIETD

SEQ ID NO: 1308668 - protein, 9 aa, Homo Sapiens
HKFQAPVCG

SEQ ID NO: 1308669 - protein, 9 aa, Homo Sapiens
PRNYKALSK

SEQ ID NO: 1308670 - protein, 9 aa, Homo Sapiens
IKKINYSRV

SEQ ID NO: 1308671 - protein, 9 aa, Homo Sapiens
SSCQYIIHL

SEQ ID NO: 1308672 - protein, 9 aa, Homo Sapiens
HYNVSEAQN

SEQ ID NO: 1308673 - protein, 9 aa, Homo Sapiens
HMNYSEQAH

SEQ ID NO: 1308674 - protein, 9 aa, Homo Sapiens
LIEFLSKAR

SEQ ID NO: 1308675 - protein, 9 aa, Homo Sapiens
EKEHGNRVF

SEQ ID NO: 1308676 - protein, 9 aa, Homo Sapiens
RIWSDYVAP

SEQ ID NO: 1308677 - protein, 9 aa, Homo Sapiens
NSSLNTITQ

SEQ ID NO: 1308678 - protein, 9 aa, Homo Sapiens
TAQIRDTLR

SEQ ID NO: 1308679 - protein, 9 aa, Homo Sapiens
GNKGSMGFP

SEQ ID NO: 1308680 - protein, 9 aa, Homo Sapiens
NKTLATDNN

SEQ ID NO: 1308681 - protein, 9 aa, Homo Sapiens
VEALCQTFW

SEQ ID NO: 1308682 - protein, 9 aa, Homo Sapiens
FNTNTRVLA

SEQ ID NO: 1308683 - protein, 9 aa, Homo Sapiens
DGWLCWNNV

SEQ ID NO: 1308684 - protein, 9 aa, Homo Sapiens
RKENAHNRH

SEQ ID NO: 1308685 - protein, 9 aa, Homo Sapiens
QALQHKHEG

SEQ ID NO: 1308686 - protein, 9 aa, Homo Sapiens
QDKDVITIN

SEQ ID NO: 1308687 - protein, 9 aa, Homo Sapiens
TCILSKMLG

SEQ ID NO: 1308688 - protein, 9 aa, Homo Sapiens
NLEIIKKQV

SEQ ID NO: 1308689 - protein, 9 aa, Homo Sapiens
VQKGNAVHL

SEQ ID NO: 1308690 - protein, 9 aa, Homo Sapiens
NNIKDDTIL

SEQ ID NO: 1308691 - protein, 9 aa, Homo Sapiens
RNIYLIMEF

SEQ ID NO: 1308692 - protein, 9 aa, Homo Sapiens
KYDILWDDM

SEQ ID NO: 1308693 - protein, 9 aa, Homo Sapiens
TRIILYESI

SEQ ID NO: 1308694 - protein, 9 aa, Homo Sapiens
DSQPKEDTQ

SEQ ID NO: 1308695 - protein, 9 aa, Homo Sapiens
SSHLTSHKI

SEQ ID NO: 1308696 - protein, 9 aa, Homo Sapiens
EEQNVVIQN

SEQ ID NO: 1308697 - protein, 9 aa, Homo Sapiens
ESITVGYSV

SEQ ID NO: 1308698 - protein, 9 aa, Homo Sapiens
KIKNHYFPA

SEQ ID NO: 1308699 - protein, 9 aa, Homo Sapiens
FLCLEMCLQ

SEQ ID NO: 1308700 - protein, 9 aa, Homo Sapiens
VMQESLLER

SEQ ID NO: 1308701 - protein, 9 aa, Homo Sapiens
KLKYNDTEN

SEQ ID NO: 1308702 - protein, 9 aa, Homo Sapiens
WWGGVFLII

SEQ ID NO: 1308703 - protein, 9 aa, Homo Sapiens
NMQEEEEQR

SEQ ID NO: 1308704 - protein, 9 aa, Homo Sapiens
KVRRPSPNH

SEQ ID NO: 1308705 - protein, 9 aa, Homo Sapiens
FIYLSNKMP

SEQ ID NO: 1308706 - protein, 9 aa, Homo Sapiens
TEEFIRVRK

SEQ ID NO: 1308707 - protein, 9 aa, Homo Sapiens
RLVLPVGAT

SEQ ID NO: 1308708 - protein, 9 aa, Homo Sapiens
DLLTTTSEI

SEQ ID NO: 1308709 - protein, 9 aa, Homo Sapiens
KSLQAGLSS

SEQ ID NO: 1308710 - protein, 9 aa, Homo Sapiens
EEIFMINGE

SEQ ID NO: 1308711 - protein, 9 aa, Homo Sapiens
SNLCEHEKT

SEQ ID NO: 1308712 - protein, 9 aa, Homo Sapiens
VMEFGLEHT

SEQ ID NO: 1308713 - protein, 9 aa, Homo Sapiens
PSEICRHKR

SEQ ID NO: 1308714 - protein, 9 aa, Homo Sapiens
LALGASLLC

SEQ ID NO: 1308715 - protein, 9 aa, Homo Sapiens
KKKHTNKNE

SEQ ID NO: 1308716 - protein, 9 aa, Homo Sapiens
THQKEIDTI

SEQ ID NO: 1308717 - protein, 9 aa, Homo Sapiens
HHTEMEFSL

SEQ ID NO: 1308718 - protein, 9 aa, Homo Sapiens
NAKYLATIS

SEQ ID NO: 1308719 - protein, 9 aa, Homo Sapiens
FNRQKEQDK

SEQ ID NO: 1308720 - protein, 9 aa, Homo Sapiens
VKTLVNLKL

SEQ ID NO: 1308721 - protein, 9 aa, Homo Sapiens
IVLNQGKVA

SEQ ID NO: 1308722 - protein, 9 aa, Homo Sapiens
NPGIKYEHT

SEQ ID NO: 1308723 - protein, 9 aa, Homo Sapiens
HVMKRKFSL

SEQ ID NO: 1308724 - protein, 9 aa, Homo Sapiens
RPFKCIECG

SEQ ID NO: 1308725 - protein, 9 aa, Homo Sapiens
RVTEPKYQC

SEQ ID NO: 1308726 - protein, 9 aa, Homo Sapiens
IFFLGTQAF

SEQ ID NO: 1308727 - protein, 9 aa, Homo Sapiens
HGIQIEFIN

SEQ ID NO: 1308728 - protein, 9 aa, Homo Sapiens
EEENNNKNM

SEQ ID NO: 1308729 - protein, 9 aa, Homo Sapiens
FSRTNIIQR

SEQ ID NO: 1308730 - protein, 9 aa, Homo Sapiens
HMIMHTGER

SEQ ID NO: 1308731 - protein, 9 aa, Homo Sapiens
VPALQSNQG

SEQ ID NO: 1308732 - protein, 9 aa, Homo Sapiens
INIIRQNLQ

SEQ ID NO: 1308733 - protein, 9 aa, Homo Sapiens
QEETSAIQV

SEQ ID NO: 1308734 - protein, 9 aa, Homo Sapiens
LEALGNMFM

SEQ ID NO: 1308735 - protein, 9 aa, Homo Sapiens
NMSDVSDLI

SEQ ID NO: 1308736 - protein, 9 aa, Homo Sapiens
TNKKKLLKM

SEQ ID NO: 1308737 - protein, 9 aa, Homo Sapiens
RRNKLCELL

SEQ ID NO: 1308738 - protein, 9 aa, Homo Sapiens
KKSREDYIS

SEQ ID NO: 1308739 - protein, 9 aa, Homo Sapiens
MALGNKKNV

SEQ ID NO: 1308740 - protein, 9 aa, Homo Sapiens
LWKRWNTSE

SEQ ID NO: 1308741 - protein, 9 aa, Homo Sapiens
LQKPNARIV

SEQ ID NO: 1308742 - protein, 9 aa, Homo Sapiens
FTSRKPITP

SEQ ID NO: 1308743 - protein, 9 aa, Homo Sapiens
IHTTAASIQ

SEQ ID NO: 1308744 - protein, 9 aa, Homo Sapiens
QNLWKENVI

SEQ ID NO: 1308745 - protein, 9 aa, Homo Sapiens
ARSDNYSLT

SEQ ID NO: 1308746 - protein, 9 aa, Homo Sapiens
IKDDTILKT

SEQ ID NO: 1308747 - protein, 9 aa, Homo Sapiens
IIEEVESKR

SEQ ID NO: 1308748 - protein, 9 aa, Homo Sapiens
ELALDNSRL

SEQ ID NO: 1308749 - protein, 9 aa, Homo Sapiens
SLKSNLQRH

SEQ ID NO: 1308750 - protein, 9 aa, Homo Sapiens
NCPFLENYL

SEQ ID NO: 1308751 - protein, 9 aa, Homo Sapiens
DYVPYTEWE

SEQ ID NO: 1308752 - protein, 9 aa, Homo Sapiens
GSTQIMKIL

SEQ ID NO: 1308753 - protein, 9 aa, Homo Sapiens
EAFSGIQIE

SEQ ID NO: 1308754 - protein, 9 aa, Homo Sapiens
KELNALRGE

SEQ ID NO: 1308755 - protein, 9 aa, Homo Sapiens
QHFIFRHQH

SEQ ID NO: 1308756 - protein, 9 aa, Homo Sapiens
SSLWSTTPF

SEQ ID NO: 1308757 - protein, 9 aa, Homo Sapiens
PERNKLSET

SEQ ID NO: 1308758 - protein, 9 aa, Homo Sapiens
IYGRTALIL

SEQ ID NO: 1308759 - protein, 9 aa, Homo Sapiens
REGQHFIFR

SEQ ID NO: 1308760 - protein, 9 aa, Homo Sapiens
SSFRMHEII

SEQ ID NO: 1308761 - protein, 9 aa, Homo Sapiens
NTITQKARH

SEQ ID NO: 1308762 - protein, 9 aa, Homo Sapiens
VVQPSRPAP

SEQ ID NO: 1308763 - protein, 9 aa, Homo Sapiens
IKDYFQKVI

SEQ ID NO: 1308764 - protein, 9 aa, Homo Sapiens
CPFLENYLE

SEQ ID NO: 1308765 - protein, 9 aa, Homo Sapiens
EVVILPNDL

SEQ ID NO: 1308766 - protein, 9 aa, Homo Sapiens
QEESVRGDV

SEQ ID NO: 1308767 - protein, 9 aa, Homo Sapiens
REEVLQLSS

SEQ ID NO: 1308768 - protein, 9 aa, Homo Sapiens
TIFYLFLYM

SEQ ID NO: 1308769 - protein, 9 aa, Homo Sapiens
RRYAGKYSD

SEQ ID NO: 1308770 - protein, 9 aa, Homo Sapiens
QNFIFFLGT

SEQ ID NO: 1308771 - protein, 9 aa, Homo Sapiens
VYKVVVDRK

SEQ ID NO: 1308772 - protein, 9 aa, Homo Sapiens
SSQRYSQTG

SEQ ID NO: 1308773 - protein, 9 aa, Homo Sapiens
TTDFWARCT

SEQ ID NO: 1308774 - protein, 9 aa, Homo Sapiens
HKYFSTLQP

SEQ ID NO: 1308775 - protein, 9 aa, Homo Sapiens
KYEHTIQKD

SEQ ID NO: 1308776 - protein, 9 aa, Homo Sapiens
QGCLSVGSN

SEQ ID NO: 1308777 - protein, 9 aa, Homo Sapiens
ETINIGLTK

SEQ ID NO: 1308778 - protein, 9 aa, Homo Sapiens
EERLDGHLN

SEQ ID NO: 1308779 - protein, 9 aa, Homo Sapiens
LLLPQIKNK

SEQ ID NO: 1308780 - protein, 9 aa, Homo Sapiens
YQFHYNNWP

SEQ ID NO: 1308781 - protein, 9 aa, Homo Sapiens
DSSNTALIM

SEQ ID NO: 1308782 - protein, 9 aa, Homo Sapiens
EEPQIGWYN

SEQ ID NO: 1308783 - protein, 9 aa, Homo Sapiens
VNEWMAQYL

SEQ ID NO: 1308784 - protein, 9 aa, Homo Sapiens
HIIQRRYCS

SEQ ID NO: 1308785 - protein, 9 aa, Homo Sapiens
YVISMTANR

SEQ ID NO: 1308786 - protein, 9 aa, Homo Sapiens
GKSFNKISD

SEQ ID NO: 1308787 - protein, 9 aa, Homo Sapiens
RVKGRLDQL

SEQ ID NO: 1308788 - protein, 9 aa, Homo Sapiens
MKSLQKTAT

SEQ ID NO: 1308789 - protein, 9 aa, Homo Sapiens
KLFQVWKVC

SEQ ID NO: 1308790 - protein, 9 aa, Homo Sapiens
GFPGHQGPP

SEQ ID NO: 1308791 - protein, 9 aa, Homo Sapiens
KLFTVSPEN

SEQ ID NO: 1308792 - protein, 9 aa, Homo Sapiens
HYARTEYAE

SEQ ID NO: 1308793 - protein, 9 aa, Homo Sapiens
KEKIKNHYF

SEQ ID NO: 1308794 - protein, 9 aa, Homo Sapiens
DDGLDEAFL

SEQ ID NO: 1308795 - protein, 9 aa, Homo Sapiens
DGLDEAFLR

SEQ ID NO: 1308796 - protein, 9 aa, Homo Sapiens
ATLIDEKVI

SEQ ID NO: 1308797 - protein, 9 aa, Homo Sapiens
SNHECWRKE

SEQ ID NO: 1308798 - protein, 9 aa, Homo Sapiens
PSTFSRENH

SEQ ID NO: 1308799 - protein, 9 aa, Homo Sapiens
NETAGVAAE

SEQ ID NO: 1308800 - protein, 9 aa, Homo Sapiens
PREELPDNF

SEQ ID NO: 1308801 - protein, 9 aa, Homo Sapiens
HLVQHQIIH

SEQ ID NO: 1308802 - protein, 9 aa, Homo Sapiens
NGAKYLLSD

SEQ ID NO: 1308803 - protein, 9 aa, Homo Sapiens
DCACVSKMY

SEQ ID NO: 1308804 - protein, 9 aa, Homo Sapiens
NEVNETLRP

SEQ ID NO: 1308805 - protein, 9 aa, Homo Sapiens
HLENMGSHY

SEQ ID NO: 1308806 - protein, 9 aa, Homo Sapiens
GWKYQTVTA

SEQ ID NO: 1308807 - protein, 9 aa, Homo Sapiens
NTMQEYLPS

SEQ ID NO: 1308808 - protein, 9 aa, Homo Sapiens
PSFTKTPHN

SEQ ID NO: 1308809 - protein, 9 aa, Homo Sapiens
ISGHTNTNN

SEQ ID NO: 1308810 - protein, 9 aa, Homo Sapiens
KGNAVHLNS

SEQ ID NO: 1308811 - protein, 9 aa, Homo Sapiens
QSQLRENKY

SEQ ID NO: 1308812 - protein, 9 aa, Homo Sapiens
FFTKMGITQ

SEQ ID NO: 1308813 - protein, 9 aa, Homo Sapiens
HWEKLLNKM

SEQ ID NO: 1308814 - protein, 9 aa, Homo Sapiens
QIIHTGENP

SEQ ID NO: 1308815 - protein, 9 aa, Homo Sapiens
SKDFSPLAG

SEQ ID NO: 1308816 - protein, 9 aa, Homo Sapiens
QKEQDKYLS

SEQ ID NO: 1308817 - protein, 9 aa, Homo Sapiens
PTKRGPYCV

SEQ ID NO: 1308818 - protein, 9 aa, Homo Sapiens
AFKINKRKL

SEQ ID NO: 1308819 - protein, 9 aa, Homo Sapiens
SFKKGEIFQ

SEQ ID NO: 1308820 - protein, 9 aa, Homo Sapiens
EDLWKRWNT

SEQ ID NO: 1308821 - protein, 9 aa, Homo Sapiens
EGQAPCLPQ

SEQ ID NO: 1308822 - protein, 9 aa, Homo Sapiens
GNEEHKKEE

SEQ ID NO: 1308823 - protein, 9 aa, Homo Sapiens
AGDYWKKMP

SEQ ID NO: 1308824 - protein, 9 aa, Homo Sapiens
ALRKELNAL

SEQ ID NO: 1308825 - protein, 9 aa, Homo Sapiens
TISTHTTIA

SEQ ID NO: 1308826 - protein, 9 aa, Homo Sapiens
DMQLNHDGE

SEQ ID NO: 1308827 - protein, 9 aa, Homo Sapiens
LEKLLNISL

SEQ ID NO: 1308828 - protein, 9 aa, Homo Sapiens
ASIQTKKAS

SEQ ID NO: 1308829 - protein, 9 aa, Homo Sapiens
ASFTLTVAA

SEQ ID NO: 1308830 - protein, 9 aa, Homo Sapiens
EEDSLKANL

SEQ ID NO: 1308831 - protein, 9 aa, Homo Sapiens
QEKYKELTE

SEQ ID NO: 1308832 - protein, 9 aa, Homo Sapiens
QEALQSEED

SEQ ID NO: 1308833 - protein, 9 aa, Homo Sapiens
SYYKVNNLG

SEQ ID NO: 1308834 - protein, 9 aa, Homo Sapiens
KIIHMELRP

SEQ ID NO: 1308835 - protein, 9 aa, Homo Sapiens
RNKYLMWFD

SEQ ID NO: 1308836 - protein, 9 aa, Homo Sapiens
FFSFYDLQR

SEQ ID NO: 1308837 - protein, 9 aa, Homo Sapiens
AEELQEKYK

SEQ ID NO: 1308838 - protein, 9 aa, Homo Sapiens
DNIIIISSR

SEQ ID NO: 1308839 - protein, 9 aa, Homo Sapiens
RIVVLFMRS

SEQ ID NO: 1308840 - protein, 9 aa, Homo Sapiens
INANKTDPC

SEQ ID NO: 1308841 - protein, 9 aa, Homo Sapiens
PTNYDNNRL

SEQ ID NO: 1308842 - protein, 9 aa, Homo Sapiens
NSLLDTMPV

SEQ ID NO: 1308843 - protein, 9 aa, Homo Sapiens
SNFTQHQII

SEQ ID NO: 1308844 - protein, 9 aa, Homo Sapiens
NENKIFSEN

SEQ ID NO: 1308845 - protein, 9 aa, Homo Sapiens
SHYIVDGNH

SEQ ID NO: 1308846 - protein, 9 aa, Homo Sapiens
EDSESFRQP

SEQ ID NO: 1308847 - protein, 9 aa, Homo Sapiens
IGKVIGDGK

SEQ ID NO: 1308848 - protein, 9 aa, Homo Sapiens
LRYSPSGFK

SEQ ID NO: 1308849 - protein, 9 aa, Homo Sapiens
DKMLYNRQQ

SEQ ID NO: 1308850 - protein, 9 aa, Homo Sapiens
NKIINSMWK

SEQ ID NO: 1308851 - protein, 9 aa, Homo Sapiens
SLGLAFIYN

SEQ ID NO: 1308852 - protein, 9 aa, Homo Sapiens
VSDFKINFP

SEQ ID NO: 1308853 - protein, 9 aa, Homo Sapiens
QIEKHFNVN

SEQ ID NO: 1308854 - protein, 9 aa, Homo Sapiens
KPTYCLCNQ

SEQ ID NO: 1308855 - protein, 9 aa, Homo Sapiens
SPKSTEAVQ

SEQ ID NO: 1308856 - protein, 9 aa, Homo Sapiens
FFCCFEDCQ

SEQ ID NO: 1308857 - protein, 9 aa, Homo Sapiens
AESIINPDA

SEQ ID NO: 1308858 - protein, 9 aa, Homo Sapiens
VSTRIYKKV

SEQ ID NO: 1308859 - protein, 9 aa, Homo Sapiens
GALQTFYAT

SEQ ID NO: 1308860 - protein, 9 aa, Homo Sapiens
REFAKDIDV

SEQ ID NO: 1308861 - protein, 9 aa, Homo Sapiens
VEKKHSSCG

SEQ ID NO: 1308862 - protein, 9 aa, Homo Sapiens
MFFSFCENN

SEQ ID NO: 1308863 - protein, 9 aa, Homo Sapiens
KGIKPNKVP

SEQ ID NO: 1308864 - protein, 9 aa, Homo Sapiens
SGLEEQARQ

SEQ ID NO: 1308865 - protein, 9 aa, Homo Sapiens
LFSRSGISI

SEQ ID NO: 1308866 - protein, 9 aa, Homo Sapiens
KTFNIPVIS

SEQ ID NO: 1308867 - protein, 9 aa, Homo Sapiens
IGTLKNYLF

SEQ ID NO: 1308868 - protein, 9 aa, Homo Sapiens
LPNHPCRFN

SEQ ID NO: 1308869 - protein, 9 aa, Homo Sapiens
DLVLLKTRE

SEQ ID NO: 1308870 - protein, 9 aa, Homo Sapiens
KENTMQEYL

SEQ ID NO: 1308871 - protein, 9 aa, Homo Sapiens
VGGQRSERN

SEQ ID NO: 1308872 - protein, 9 aa, Homo Sapiens
YLTFSLKNL

SEQ ID NO: 1308873 - protein, 9 aa, Homo Sapiens
FYDLQREFH

SEQ ID NO: 1308874 - protein, 9 aa, Homo Sapiens
GSPGEVGQL

SEQ ID NO: 1308875 - protein, 9 aa, Homo Sapiens
HTFSLPVYK

SEQ ID NO: 1308876 - protein, 9 aa, Homo Sapiens
LFQVWKVCA

SEQ ID NO: 1308877 - protein, 9 aa, Homo Sapiens
IDEEAICVV

SEQ ID NO: 1308878 - protein, 9 aa, Homo Sapiens
QTVTATLEE

SEQ ID NO: 1308879 - protein, 9 aa, Homo Sapiens
LEIDRSMKN

SEQ ID NO: 1308880 - protein, 9 aa, Homo Sapiens
SKISLAIYF

SEQ ID NO: 1308881 - protein, 9 aa, Homo Sapiens
KHYLVQEAC

SEQ ID NO: 1308882 - protein, 9 aa, Homo Sapiens
LLPIPLLVW

SEQ ID NO: 1308883 - protein, 9 aa, Homo Sapiens
ASVSSLSLD

SEQ ID NO: 1308884 - protein, 9 aa, Homo Sapiens
VDKRVTRLV

SEQ ID NO: 1308885 - protein, 9 aa, Homo Sapiens
EKAHTLILH

SEQ ID NO: 1308886 - protein, 9 aa, Homo Sapiens
DWNVEFSAT

SEQ ID NO: 1308887 - protein, 9 aa, Homo Sapiens
KFVSKLSEY

SEQ ID NO: 1308888 - protein, 9 aa, Homo Sapiens
DQAEVVRYL

SEQ ID NO: 1308889 - protein, 9 aa, Homo Sapiens
SYTKIFDVG

SEQ ID NO: 1308890 - protein, 9 aa, Homo Sapiens
YDSFIELQD

SEQ ID NO: 1308891 - protein, 9 aa, Homo Sapiens
ETIYYNASL

SEQ ID NO: 1308892 - protein, 9 aa, Homo Sapiens
YFEYTAKIR

SEQ ID NO: 1308893 - protein, 9 aa, Homo Sapiens
IIENLREKV

SEQ ID NO: 1308894 - protein, 9 aa, Homo Sapiens
WKKMPGSVS

SEQ ID NO: 1308895 - protein, 9 aa, Homo Sapiens
YYNASLLIQ

SEQ ID NO: 1308896 - protein, 9 aa, Homo Sapiens
EDKRMLKVI

SEQ ID NO: 1308897 - protein, 9 aa, Homo Sapiens
KMPAYQLGL

SEQ ID NO: 1308898 - protein, 9 aa, Homo Sapiens
SDNYSLTDF

SEQ ID NO: 1308899 - protein, 9 aa, Homo Sapiens
SMRSFSSSR

SEQ ID NO: 1308900 - protein, 9 aa, Homo Sapiens
NMLSDPCVL

SEQ ID NO: 1308901 - protein, 9 aa, Homo Sapiens
SSTLISHKI

SEQ ID NO: 1308902 - protein, 9 aa, Homo Sapiens
LQLGLSPSN

SEQ ID NO: 1308903 - protein, 9 aa, Homo Sapiens
EEEANKRAE

SEQ ID NO: 1308904 - protein, 9 aa, Homo Sapiens
YEMLANQTA

SEQ ID NO: 1308905 - protein, 9 aa, Homo Sapiens
FHKEDKLMK

SEQ ID NO: 1308906 - protein, 9 aa, Homo Sapiens
NNLHGDGLA

SEQ ID NO: 1308907 - protein, 9 aa, Homo Sapiens
QRLIKYTPQ

SEQ ID NO: 1308908 - protein, 9 aa, Homo Sapiens
TLQFIYSKG

SEQ ID NO: 1308909 - protein, 9 aa, Homo Sapiens
VDQRASIIQ

SEQ ID NO: 1308910 - protein, 9 aa, Homo Sapiens
YGLFCGESS

SEQ ID NO: 1308911 - protein, 9 aa, Homo Sapiens
MVCLTFKQS

SEQ ID NO: 1308912 - protein, 9 aa, Homo Sapiens
KYPDNFFLL

SEQ ID NO: 1308913 - protein, 9 aa, Homo Sapiens
NIFNLSAPE

SEQ ID NO: 1308914 - protein, 9 aa, Homo Sapiens
PDKIKYPRT

SEQ ID NO: 1308915 - protein, 9 aa, Homo Sapiens
PLMRLEKYV

SEQ ID NO: 1308916 - protein, 9 aa, Homo Sapiens
ELLEVLLNY

SEQ ID NO: 1308917 - protein, 9 aa, Homo Sapiens
HKLGLRPGI

SEQ ID NO: 1308918 - protein, 9 aa, Homo Sapiens
KVIEENNIR

SEQ ID NO: 1308919 - protein, 9 aa, Homo Sapiens
CEPGLSSES

SEQ ID NO: 1308920 - protein, 9 aa, Homo Sapiens
LFGAITLNL

SEQ ID NO: 1308921 - protein, 9 aa, Homo Sapiens
GSAGNYLTG

SEQ ID NO: 1308922 - protein, 9 aa, Homo Sapiens
VAEDQLIKI

SEQ ID NO: 1308923 - protein, 9 aa, Homo Sapiens
EICNELEKQ

SEQ ID NO: 1308924 - protein, 9 aa, Homo Sapiens
IKPEEAKTA

SEQ ID NO: 1308925 - protein, 9 aa, Homo Sapiens
SSNLVHPSC

SEQ ID NO: 1308926 - protein, 9 aa, Homo Sapiens
IFPKQSHKL

SEQ ID NO: 1308927 - protein, 9 aa, Homo Sapiens
DIRHELNRL

SEQ ID NO: 1308928 - protein, 9 aa, Homo Sapiens
IYHLALSPI

SEQ ID NO: 1308929 - protein, 9 aa, Homo Sapiens
FILITMASY

SEQ ID NO: 1308930 - protein, 9 aa, Homo Sapiens
ALGASLLCN

SEQ ID NO: 1308931 - protein, 9 aa, Homo Sapiens
EASADCQYV

SEQ ID NO: 1308932 - protein, 9 aa, Homo Sapiens
ELEVKILES

SEQ ID NO: 1308933 - protein, 9 aa, Homo Sapiens
TWVHYISAE

SEQ ID NO: 1308934 - protein, 9 aa, Homo Sapiens
KREEQNVVI

SEQ ID NO: 1308935 - protein, 9 aa, Homo Sapiens
NKVNSEGKF

SEQ ID NO: 1308936 - protein, 9 aa, Homo Sapiens
KRTIGWMKF

SEQ ID NO: 1308937 - protein, 9 aa, Homo Sapiens
SHFMYAVRE

SEQ ID NO: 1308938 - protein, 9 aa, Homo Sapiens
KKNEDCFGM

SEQ ID NO: 1308939 - protein, 9 aa, Homo Sapiens
GRVIEEARF

SEQ ID NO: 1308940 - protein, 9 aa, Homo Sapiens
SLTDVVISQ

SEQ ID NO: 1308941 - protein, 9 aa, Homo Sapiens
LPAYPSCRD

SEQ ID NO: 1308942 - protein, 9 aa, Homo Sapiens
EEETVFQEV

SEQ ID NO: 1308943 - protein, 9 aa, Homo Sapiens
GSGGIVPPP

SEQ ID NO: 1308944 - protein, 9 aa, Homo Sapiens
CQYSVWVVA

SEQ ID NO: 1308945 - protein, 9 aa, Homo Sapiens
TKKIKDKYI

SEQ ID NO: 1308946 - protein, 9 aa, Homo Sapiens
GKINLKVAK

SEQ ID NO: 1308947 - protein, 9 aa, Homo Sapiens
RITHTEEKP

SEQ ID NO: 1308948 - protein, 9 aa, Homo Sapiens
FPGHQGPPG

SEQ ID NO: 1308949 - protein, 9 aa, Homo Sapiens
KPYQPIIKI

SEQ ID NO: 1308950 - protein, 9 aa, Homo Sapiens
TPDKETAWK

SEQ ID NO: 1308951 - protein, 9 aa, Homo Sapiens
SRSPPDKPK

SEQ ID NO: 1308952 - protein, 9 aa, Homo Sapiens
SDTELIYRE

SEQ ID NO: 1308953 - protein, 9 aa, Homo Sapiens
AAHRKGSNS

SEQ ID NO: 1308954 - protein, 9 aa, Homo Sapiens
FSLFYDTVL

SEQ ID NO: 1308955 - protein, 9 aa, Homo Sapiens
FLKKTFNIP

SEQ ID NO: 1308956 - protein, 9 aa, Homo Sapiens
FCCERGHKR

SEQ ID NO: 1308957 - protein, 9 aa, Homo Sapiens
LLFWTLPGQ

SEQ ID NO: 1308958 - protein, 9 aa, Homo Sapiens
CRFNTNTRV

SEQ ID NO: 1308959 - protein, 9 aa, Homo Sapiens
HKKKSFLTA

SEQ ID NO: 1308960 - protein, 9 aa, Homo Sapiens
KHHATILAV

SEQ ID NO: 1308961 - protein, 9 aa, Homo Sapiens
SSPVTTVYL

SEQ ID NO: 1308962 - protein, 9 aa, Homo Sapiens
RCEPGLSSE

SEQ ID NO: 1308963 - protein, 9 aa, Homo Sapiens
SWKTSFYVG

SEQ ID NO: 1308964 - protein, 9 aa, Homo Sapiens
APPLVVQPS

SEQ ID NO: 1308965 - protein, 9 aa, Homo Sapiens
SITVGYSVL

SEQ ID NO: 1308966 - protein, 9 aa, Homo Sapiens
NSLATQEGK

SEQ ID NO: 1308967 - protein, 9 aa, Homo Sapiens
EPVGNHEEK

SEQ ID NO: 1308968 - protein, 9 aa, Homo Sapiens
NIDICDTVK

SEQ ID NO: 1308969 - protein, 9 aa, Homo Sapiens
PNDPCLRGD

SEQ ID NO: 1308970 - protein, 9 aa, Homo Sapiens
EVLLNYYIL

SEQ ID NO: 1308971 - protein, 9 aa, Homo Sapiens
VSCFRDKMA

SEQ ID NO: 1308972 - protein, 9 aa, Homo Sapiens
KPNKVPGEK

SEQ ID NO: 1308973 - protein, 9 aa, Homo Sapiens
RYQFTSRKP

SEQ ID NO: 1308974 - protein, 9 aa, Homo Sapiens
DYYYFILIT

SEQ ID NO: 1308975 - protein, 9 aa, Homo Sapiens
FPISFKTYL

SEQ ID NO: 1308976 - protein, 9 aa, Homo Sapiens
TEHKLIHIG

SEQ ID NO: 1308977 - protein, 9 aa, Homo Sapiens
DLSVLGSSI

SEQ ID NO: 1308978 - protein, 9 aa, Homo Sapiens
ERDFLQYLQ

SEQ ID NO: 1308979 - protein, 9 aa, Homo Sapiens
KGTTWFEAH

SEQ ID NO: 1308980 - protein, 9 aa, Homo Sapiens
PMLSTFVMG

SEQ ID NO: 1308981 - protein, 9 aa, Homo Sapiens
VQLVVIAIL

SEQ ID NO: 1308982 - protein, 9 aa, Homo Sapiens
IFNYGNRYH

SEQ ID NO: 1308983 - protein, 9 aa, Homo Sapiens
LFGMFAMCQ

SEQ ID NO: 1308984 - protein, 9 aa, Homo Sapiens
FIHGSHLTE

SEQ ID NO: 1308985 - protein, 9 aa, Homo Sapiens
PPRITSRTN

SEQ ID NO: 1308986 - protein, 9 aa, Homo Sapiens
IQTYDMMIV

SEQ ID NO: 1308987 - protein, 9 aa, Homo Sapiens
HKLKLEQCM

SEQ ID NO: 1308988 - protein, 9 aa, Homo Sapiens
LELPDQTKD

SEQ ID NO: 1308989 - protein, 9 aa, Homo Sapiens
LFWTLPGQV

SEQ ID NO: 1308990 - protein, 9 aa, Homo Sapiens
KGPGIGLLD

SEQ ID NO: 1308991 - protein, 9 aa, Homo Sapiens
KYLDLSLFK

SEQ ID NO: 1308992 - protein, 9 aa, Homo Sapiens
DKGNENSKA

SEQ ID NO: 1308993 - protein, 9 aa, Homo Sapiens
GSELTLHQK

SEQ ID NO: 1308994 - protein, 9 aa, Homo Sapiens
PYEGQITED

SEQ ID NO: 1308995 - protein, 9 aa, Homo Sapiens
VEVEHVMKR

SEQ ID NO: 1308996 - protein, 9 aa, Homo Sapiens
CHHSSLRYS

SEQ ID NO: 1308997 - protein, 9 aa, Homo Sapiens
LPNLEYLRP

SEQ ID NO: 1308998 - protein, 9 aa, Homo Sapiens
TVGYSVLTL

SEQ ID NO: 1308999 - protein, 9 aa, Homo Sapiens
SIVGYIIGL

SEQ ID NO: 1309000 - protein, 9 aa, Homo Sapiens
ELKTDYNNP

SEQ ID NO: 1309001 - protein, 9 aa, Homo Sapiens
REFFTKMGI

SEQ ID NO: 1309002 - protein, 9 aa, Homo Sapiens
YLTGHNNNF

SEQ ID NO: 1309003 - protein, 9 aa, Homo Sapiens
GHTFSLPVY

SEQ ID NO: 1309004 - protein, 9 aa, Homo Sapiens
SSNLCEHEK

SEQ ID NO: 1309005 - protein, 9 aa, Homo Sapiens
CKKGVEHDK

SEQ ID NO: 1309006 - protein, 9 aa, Homo Sapiens
GTPVIYHNW

SEQ ID NO: 1309007 - protein, 9 aa, Homo Sapiens
YYFVNDKFM

SEQ ID NO: 1309008 - protein, 9 aa, Homo Sapiens
QVCNKFFRR

SEQ ID NO: 1309009 - protein, 9 aa, Homo Sapiens
ATGRFRGTK

SEQ ID NO: 1309010 - protein, 9 aa, Homo Sapiens
LAFIYNQTE

SEQ ID NO: 1309011 - protein, 9 aa, Homo Sapiens
ISMKHPQEI

SEQ ID NO: 1309012 - protein, 9 aa, Homo Sapiens
FYQMHRAKV

SEQ ID NO: 1309013 - protein, 9 aa, Homo Sapiens
NLSELNRLL

SEQ ID NO: 1309014 - protein, 9 aa, Homo Sapiens
WSGTIVRSQ

SEQ ID NO: 1309015 - protein, 9 aa, Homo Sapiens
SLAVGDTIS

SEQ ID NO: 1309016 - protein, 9 aa, Homo Sapiens
QFQVTDLDE

SEQ ID NO: 1309017 - protein, 9 aa, Homo Sapiens
LGNKKNVEP

SEQ ID NO: 1309018 - protein, 9 aa, Homo Sapiens
DGTELALKE

SEQ ID NO: 1309019 - protein, 9 aa, Homo Sapiens
DTLEHKKKS

SEQ ID NO: 1309020 - protein, 9 aa, Homo Sapiens
DIAHLSCSD

SEQ ID NO: 1309021 - protein, 9 aa, Homo Sapiens
FKLLQEYYK

SEQ ID NO: 1309022 - protein, 9 aa, Homo Sapiens
KTPSTPEPN

SEQ ID NO: 1309023 - protein, 9 aa, Homo Sapiens
VKRGESKFD

SEQ ID NO: 1309024 - protein, 9 aa, Homo Sapiens
YSGRETIYY

SEQ ID NO: 1309025 - protein, 9 aa, Homo Sapiens
SLDGSCRNL

SEQ ID NO: 1309026 - protein, 9 aa, Homo Sapiens
LTMIIFLGP

SEQ ID NO: 1309027 - protein, 9 aa, Homo Sapiens
NLLTEHLLG

SEQ ID NO: 1309028 - protein, 9 aa, Homo Sapiens
LNDHNEFEE

SEQ ID NO: 1309029 - protein, 9 aa, Homo Sapiens
EKLSSCLSK

SEQ ID NO: 1309030 - protein, 9 aa, Homo Sapiens
KDHFLGPQK

SEQ ID NO: 1309031 - protein, 9 aa, Homo Sapiens
DIDVSFVKI

SEQ ID NO: 1309032 - protein, 9 aa, Homo Sapiens
SPRVIQNKY

SEQ ID NO: 1309033 - protein, 9 aa, Homo Sapiens
TFQYIILEA

SEQ ID NO: 1309034 - protein, 9 aa, Homo Sapiens
NRVFFGKNL

SEQ ID NO: 1309035 - protein, 9 aa, Homo Sapiens
LIHERMHTD

SEQ ID NO: 1309036 - protein, 9 aa, Homo Sapiens
KNMIHMIYF

SEQ ID NO: 1309037 - protein, 9 aa, Homo Sapiens
HFTCNVLPI

SEQ ID NO: 1309038 - protein, 9 aa, Homo Sapiens
LLADGYSDK

SEQ ID NO: 1309039 - protein, 9 aa, Homo Sapiens
NVESYLKEQ

SEQ ID NO: 1309040 - protein, 9 aa, Homo Sapiens
ISIKQVVLC

SEQ ID NO: 1309041 - protein, 9 aa, Homo Sapiens
LTSTIDLTC

SEQ ID NO: 1309042 - protein, 9 aa, Homo Sapiens
VFLGMCLEF

SEQ ID NO: 1309043 - protein, 9 aa, Homo Sapiens
GYNVCTLHG

SEQ ID NO: 1309044 - protein, 9 aa, Homo Sapiens
YLRPRSQLM

SEQ ID NO: 1309045 - protein, 9 aa, Homo Sapiens
QKRGNSMVY

SEQ ID NO: 1309046 - protein, 9 aa, Homo Sapiens
VIMRGSSRE

SEQ ID NO: 1309047 - protein, 9 aa, Homo Sapiens
VIEEARFAV

SEQ ID NO: 1309048 - protein, 9 aa, Homo Sapiens
FLELAVFDQ

SEQ ID NO: 1309049 - protein, 9 aa, Homo Sapiens
DNNTAATRN

SEQ ID NO: 1309050 - protein, 9 aa, Homo Sapiens
KKYVILADL

SEQ ID NO: 1309051 - protein, 9 aa, Homo Sapiens
DPNNVLNDW

SEQ ID NO: 1309052 - protein, 9 aa, Homo Sapiens
APGIHKRYF

SEQ ID NO: 1309053 - protein, 9 aa, Homo Sapiens
MHLEYFPMD

SEQ ID NO: 1309054 - protein, 9 aa, Homo Sapiens
LRSWTTADT

SEQ ID NO: 1309055 - protein, 9 aa, Homo Sapiens
YYVTITDAP

SEQ ID NO: 1309056 - protein, 9 aa, Homo Sapiens
VEREMDEEL

SEQ ID NO: 1309057 - protein, 9 aa, Homo Sapiens
KYEVCLTLY

SEQ ID NO: 1309058 - protein, 9 aa, Homo Sapiens
EEENGKYQL

SEQ ID NO: 1309059 - protein, 9 aa, Homo Sapiens
EMKEDSDEK

SEQ ID NO: 1309060 - protein, 9 aa, Homo Sapiens
ARHDWLHII

SEQ ID NO: 1309061 - protein, 9 aa, Homo Sapiens
LVLYLHRVG

SEQ ID NO: 1309062 - protein, 9 aa, Homo Sapiens
AGDGPGLGE

SEQ ID NO: 1309063 - protein, 9 aa, Homo Sapiens
YKVEWSMSK

SEQ ID NO: 1309064 - protein, 9 aa, Homo Sapiens
RLLKMPAYQ

SEQ ID NO: 1309065 - protein, 9 aa, Homo Sapiens
RKMQLNMQE

SEQ ID NO: 1309066 - protein, 9 aa, Homo Sapiens
GSPFVWSGT

SEQ ID NO: 1309067 - protein, 9 aa, Homo Sapiens
NNYFRRRTH

SEQ ID NO: 1309068 - protein, 9 aa, Homo Sapiens
KELEDKVIK

SEQ ID NO: 1309069 - protein, 9 aa, Homo Sapiens
KEQDKYLSY

SEQ ID NO: 1309070 - protein, 9 aa, Homo Sapiens
VVSGITISV

SEQ ID NO: 1309071 - protein, 9 aa, Homo Sapiens
DLFSFACGR

SEQ ID NO: 1309072 - protein, 9 aa, Homo Sapiens
GCRSFALFF

SEQ ID NO: 1309073 - protein, 9 aa, Homo Sapiens
WARCTSLNE

SEQ ID NO: 1309074 - protein, 9 aa, Homo Sapiens
HPNVVNLEG

SEQ ID NO: 1309075 - protein, 9 aa, Homo Sapiens
GHSESPDKP

SEQ ID NO: 1309076 - protein, 9 aa, Homo Sapiens
QDNQTIPSE

SEQ ID NO: 1309077 - protein, 9 aa, Homo Sapiens
LEYNHKEWI

SEQ ID NO: 1309078 - protein, 9 aa, Homo Sapiens
LLYLEDFFM

SEQ ID NO: 1309079 - protein, 9 aa, Homo Sapiens
LSNHKIIHT

SEQ ID NO: 1309080 - protein, 9 aa, Homo Sapiens
LVVIAILTL

SEQ ID NO: 1309081 - protein, 9 aa, Homo Sapiens
LRYPSFFSN

SEQ ID NO: 1309082 - protein, 9 aa, Homo Sapiens
QLVRKGETI

SEQ ID NO: 1309083 - protein, 9 aa, Homo Sapiens
TGIILCIIM

SEQ ID NO: 1309084 - protein, 9 aa, Homo Sapiens
EIHITLEKV

SEQ ID NO: 1309085 - protein, 9 aa, Homo Sapiens
YLIDINDNT

SEQ ID NO: 1309086 - protein, 9 aa, Homo Sapiens
EDKEKKYML

SEQ ID NO: 1309087 - protein, 9 aa, Homo Sapiens
SMFFSFCEN

SEQ ID NO: 1309088 - protein, 9 aa, Homo Sapiens
KIIENLREK

SEQ ID NO: 1309089 - protein, 9 aa, Homo Sapiens
ASNGCVIVH

SEQ ID NO: 1309090 - protein, 9 aa, Homo Sapiens
SKVNQHKHK

SEQ ID NO: 1309091 - protein, 9 aa, Homo Sapiens
IISRPWDFR

SEQ ID NO: 1309092 - protein, 9 aa, Homo Sapiens
LSGNYFRHI

SEQ ID NO: 1309093 - protein, 9 aa, Homo Sapiens
NSNEPSSDS

SEQ ID NO: 1309094 - protein, 9 aa, Homo Sapiens
NGEKEQTVF

SEQ ID NO: 1309095 - protein, 9 aa, Homo Sapiens
AAKTGSICW

SEQ ID NO: 1309096 - protein, 9 aa, Homo Sapiens
NNITRGQSL

SEQ ID NO: 1309097 - protein, 9 aa, Homo Sapiens
RDLVLLKTR

SEQ ID NO: 1309098 - protein, 9 aa, Homo Sapiens
ALKATGNNL

SEQ ID NO: 1309099 - protein, 9 aa, Homo Sapiens
YSDAQGSGD

SEQ ID NO: 1309100 - protein, 9 aa, Homo Sapiens
KFGRTALHL

SEQ ID NO: 1309101 - protein, 9 aa, Homo Sapiens
TEGRGTNKE

SEQ ID NO: 1309102 - protein, 9 aa, Homo Sapiens
FVWSGTIVR

SEQ ID NO: 1309103 - protein, 9 aa, Homo Sapiens
RFLRIIMLS

SEQ ID NO: 1309104 - protein, 9 aa, Homo Sapiens
VVPKNNEMK

SEQ ID NO: 1309105 - protein, 9 aa, Homo Sapiens
LICDASSLH

SEQ ID NO: 1309106 - protein, 9 aa, Homo Sapiens
LTYIRGIYS

SEQ ID NO: 1309107 - protein, 9 aa, Homo Sapiens
NNEMKKSVH

SEQ ID NO: 1309108 - protein, 9 aa, Homo Sapiens
LPPQPDFVP

SEQ ID NO: 1309109 - protein, 9 aa, Homo Sapiens
LGAEACNLM

SEQ ID NO: 1309110 - protein, 9 aa, Homo Sapiens
GCTFQYIIL

SEQ ID NO: 1309111 - protein, 9 aa, Homo Sapiens
AVKLCWMLD

SEQ ID NO: 1309112 - protein, 9 aa, Homo Sapiens
YIDFIYRTV

SEQ ID NO: 1309113 - protein, 9 aa, Homo Sapiens
ERALTNLNG

SEQ ID NO: 1309114 - protein, 9 aa, Homo Sapiens
NKYLNETAG

SEQ ID NO: 1309115 - protein, 9 aa, Homo Sapiens
KQNKDDEKY

SEQ ID NO: 1309116 - protein, 9 aa, Homo Sapiens
RSTNYVFKE

SEQ ID NO: 1309117 - protein, 9 aa, Homo Sapiens
LSRHSPAPV

SEQ ID NO: 1309118 - protein, 9 aa, Homo Sapiens
VSGLFSIIY

SEQ ID NO: 1309119 - protein, 9 aa, Homo Sapiens
SSILGFNIL

SEQ ID NO: 1309120 - protein, 9 aa, Homo Sapiens
SLQAHIKCR

SEQ ID NO: 1309121 - protein, 9 aa, Homo Sapiens
LKTPTERIY

SEQ ID NO: 1309122 - protein, 9 aa, Homo Sapiens
LLLSLFLFI

SEQ ID NO: 1309123 - protein, 9 aa, Homo Sapiens
AMKYKLESC

SEQ ID NO: 1309124 - protein, 9 aa, Homo Sapiens
CFDEFNQID

SEQ ID NO: 1309125 - protein, 9 aa, Homo Sapiens
HFKLEKHSA

SEQ ID NO: 1309126 - protein, 9 aa, Homo Sapiens
AIDSQLVVC

SEQ ID NO: 1309127 - protein, 9 aa, Homo Sapiens
LPSFIRYHE

SEQ ID NO: 1309128 - protein, 9 aa, Homo Sapiens
EQLIENLDA

SEQ ID NO: 1309129 - protein, 9 aa, Homo Sapiens
STFSRENHS

SEQ ID NO: 1309130 - protein, 9 aa, Homo Sapiens
NINIHQKIH

SEQ ID NO: 1309131 - protein, 9 aa, Homo Sapiens
LFSYEHFYV

SEQ ID NO: 1309132 - protein, 9 aa, Homo Sapiens
REDYISENV

SEQ ID NO: 1309133 - protein, 9 aa, Homo Sapiens
RMANVALRK

SEQ ID NO: 1309134 - protein, 9 aa, Homo Sapiens
YMGHFDLIN

SEQ ID NO: 1309135 - protein, 9 aa, Homo Sapiens
SMSKDFSPL

SEQ ID NO: 1309136 - protein, 9 aa, Homo Sapiens
SLSLDSTPS

SEQ ID NO: 1309137 - protein, 9 aa, Homo Sapiens
EPLQRPKML

SEQ ID NO: 1309138 - protein, 9 aa, Homo Sapiens
KLCWMLDNV

SEQ ID NO: 1309139 - protein, 9 aa, Homo Sapiens
SETMVPFVS

SEQ ID NO: 1309140 - protein, 9 aa, Homo Sapiens
AYQQLQQNK

SEQ ID NO: 1309141 - protein, 9 aa, Homo Sapiens
FLYGKDYSQ

SEQ ID NO: 1309142 - protein, 9 aa, Homo Sapiens
DNSRLNEGK

SEQ ID NO: 1309143 - protein, 9 aa, Homo Sapiens
YSIPFFFLP

SEQ ID NO: 1309144 - protein, 9 aa, Homo Sapiens
IISTGEKFY

SEQ ID NO: 1309145 - protein, 9 aa, Homo Sapiens
TKEVDGLSQ

SEQ ID NO: 1309146 - protein, 9 aa, Homo Sapiens
QGNYFEYTA

SEQ ID NO: 1309147 - protein, 9 aa, Homo Sapiens
ERQQRIKEF

SEQ ID NO: 1309148 - protein, 9 aa, Homo Sapiens
DICDTVKYK

SEQ ID NO: 1309149 - protein, 9 aa, Homo Sapiens
KINKRKLEL

SEQ ID NO: 1309150 - protein, 9 aa, Homo Sapiens
ESMPSFQLC

SEQ ID NO: 1309151 - protein, 9 aa, Homo Sapiens
CKAGKGGTG

SEQ ID NO: 1309152 - protein, 9 aa, Homo Sapiens
IEGLSSTYA

SEQ ID NO: 1309153 - protein, 9 aa, Homo Sapiens
QAAVDHTTE

SEQ ID NO: 1309154 - protein, 9 aa, Homo Sapiens
HLSYKMSDN

SEQ ID NO: 1309155 - protein, 9 aa, Homo Sapiens
VCTYIDFIY

SEQ ID NO: 1309156 - protein, 9 aa, Homo Sapiens
DRIVVTCKT

SEQ ID NO: 1309157 - protein, 9 aa, Homo Sapiens
VEENEKLSS

SEQ ID NO: 1309158 - protein, 9 aa, Homo Sapiens
KNKGIQESE

SEQ ID NO: 1309159 - protein, 9 aa, Homo Sapiens
GLYQPICDT

SEQ ID NO: 1309160 - protein, 9 aa, Homo Sapiens
KEKLALLDK

SEQ ID NO: 1309161 - protein, 9 aa, Homo Sapiens
ELVTKIKLP

SEQ ID NO: 1309162 - protein, 9 aa, Homo Sapiens
HLLAAGKYE

SEQ ID NO: 1309163 - protein, 9 aa, Homo Sapiens
QLGDKPYRC

SEQ ID NO: 1309164 - protein, 9 aa, Homo Sapiens
PEQLIENLD

SEQ ID NO: 1309165 - protein, 9 aa, Homo Sapiens
FPTVFAIYW

SEQ ID NO: 1309166 - protein, 9 aa, Homo Sapiens
ERLLMYYFV

SEQ ID NO: 1309167 - protein, 9 aa, Homo Sapiens
LNGKDKYKV

SEQ ID NO: 1309168 - protein, 9 aa, Homo Sapiens
ALALARTPA

SEQ ID NO: 1309169 - protein, 9 aa, Homo Sapiens
KKSNKSLIG

SEQ ID NO: 1309170 - protein, 9 aa, Homo Sapiens
QFQNQGSEP

SEQ ID NO: 1309171 - protein, 9 aa, Homo Sapiens
SSTLKYKVT

SEQ ID NO: 1309172 - protein, 9 aa, Homo Sapiens
SSTYAEQLK

SEQ ID NO: 1309173 - protein, 9 aa, Homo Sapiens
KLPRNLKTP

SEQ ID NO: 1309174 - protein, 9 aa, Homo Sapiens
LTVIRIILF

SEQ ID NO: 1309175 - protein, 9 aa, Homo Sapiens
DCGAKTQNG

SEQ ID NO: 1309176 - protein, 9 aa, Homo Sapiens
LFATQLVRK

SEQ ID NO: 1309177 - protein, 9 aa, Homo Sapiens
LDAIQVLPK

SEQ ID NO: 1309178 - protein, 9 aa, Homo Sapiens
EKWMVCLTF

SEQ ID NO: 1309179 - protein, 9 aa, Homo Sapiens
EEKEHRPKD

SEQ ID NO: 1309180 - protein, 9 aa, Homo Sapiens
CQRDSENNK

SEQ ID NO: 1309181 - protein, 9 aa, Homo Sapiens
LGNMFMYFL

SEQ ID NO: 1309182 - protein, 9 aa, Homo Sapiens
LSTELFKLN

SEQ ID NO: 1309183 - protein, 9 aa, Homo Sapiens
KDKALGQKD

SEQ ID NO: 1309184 - protein, 9 aa, Homo Sapiens
VSIHQYPKF

SEQ ID NO: 1309185 - protein, 9 aa, Homo Sapiens
LKEHLQIHS

SEQ ID NO: 1309186 - protein, 9 aa, Homo Sapiens
AEVVTGLHP

SEQ ID NO: 1309187 - protein, 9 aa, Homo Sapiens
DKETAWKVK

SEQ ID NO: 1309188 - protein, 9 aa, Homo Sapiens
FQNQGSEPK

SEQ ID NO: 1309189 - protein, 9 aa, Homo Sapiens
YGFHFAGDG

SEQ ID NO: 1309190 - protein, 9 aa, Homo Sapiens
KGKGSPSHQ

SEQ ID NO: 1309191 - protein, 9 aa, Homo Sapiens
TGDVCKENI

SEQ ID NO: 1309192 - protein, 9 aa, Homo Sapiens
EYDSNSTNH

SEQ ID NO: 1309193 - protein, 9 aa, Homo Sapiens
TINIGLTKL

SEQ ID NO: 1309194 - protein, 9 aa, Homo Sapiens
AVIWEVLHK

SEQ ID NO: 1309195 - protein, 9 aa, Homo Sapiens
WIIEEVESK

SEQ ID NO: 1309196 - protein, 9 aa, Homo Sapiens
DTISLLCAS

SEQ ID NO: 1309197 - protein, 9 aa, Homo Sapiens
LSLTGHKRI

SEQ ID NO: 1309198 - protein, 9 aa, Homo Sapiens
NVLNDWSQK

SEQ ID NO: 1309199 - protein, 9 aa, Homo Sapiens
VLNQGKVAE

SEQ ID NO: 1309200 - protein, 9 aa, Homo Sapiens
SGSSLQAEN

SEQ ID NO: 1309201 - protein, 9 aa, Homo Sapiens
VFWMGSEGH

SEQ ID NO: 1309202 - protein, 9 aa, Homo Sapiens
KVVSIHQYP

SEQ ID NO: 1309203 - protein, 9 aa, Homo Sapiens
NKYLDLSLF

SEQ ID NO: 1309204 - protein, 9 aa, Homo Sapiens
EPDNNSLQS

SEQ ID NO: 1309205 - protein, 9 aa, Homo Sapiens
MFFSFYDLQ

SEQ ID NO: 1309206 - protein, 9 aa, Homo Sapiens
RGTKPEPRD

SEQ ID NO: 1309207 - protein, 9 aa, Homo Sapiens
NKITLTGFN

SEQ ID NO: 1309208 - protein, 9 aa, Homo Sapiens
NYFLSNNIH

SEQ ID NO: 1309209 - protein, 9 aa, Homo Sapiens
ILGALFGPI

SEQ ID NO: 1309210 - protein, 9 aa, Homo Sapiens
VRAALDRET

SEQ ID NO: 1309211 - protein, 9 aa, Homo Sapiens
IMTDKRYIS

SEQ ID NO: 1309212 - protein, 9 aa, Homo Sapiens
SPPDKPKQE

SEQ ID NO: 1309213 - protein, 9 aa, Homo Sapiens
NISRSPTLT

SEQ ID NO: 1309214 - protein, 9 aa, Homo Sapiens
HATRQIDRE

SEQ ID NO: 1309215 - protein, 9 aa, Homo Sapiens
KYSRYFLLK

SEQ ID NO: 1309216 - protein, 9 aa, Homo Sapiens
DGEGPSTFS

SEQ ID NO: 1309217 - protein, 9 aa, Homo Sapiens
KDNFYRVAN

SEQ ID NO: 1309218 - protein, 9 aa, Homo Sapiens
VEAVAEAEL

SEQ ID NO: 1309219 - protein, 9 aa, Homo Sapiens
LEVVEVKSW

SEQ ID NO: 1309220 - protein, 9 aa, Homo Sapiens
KDYFQKVIL

SEQ ID NO: 1309221 - protein, 9 aa, Homo Sapiens
GSKYETINL

SEQ ID NO: 1309222 - protein, 9 aa, Homo Sapiens
SLSNHECWR

SEQ ID NO: 1309223 - protein, 9 aa, Homo Sapiens
SFIRYHEMT

SEQ ID NO: 1309224 - protein, 9 aa, Homo Sapiens
YMSTLLAEG

SEQ ID NO: 1309225 - protein, 9 aa, Homo Sapiens
FFVLNLVFG

SEQ ID NO: 1309226 - protein, 9 aa, Homo Sapiens
LLKDRNPKE

SEQ ID NO: 1309227 - protein, 9 aa, Homo Sapiens
PQNQISHLP

SEQ ID NO: 1309228 - protein, 9 aa, Homo Sapiens
KDANKSSTP

SEQ ID NO: 1309229 - protein, 9 aa, Homo Sapiens
ENKIFSENS

SEQ ID NO: 1309230 - protein, 9 aa, Homo Sapiens
KDENDLRST

SEQ ID NO: 1309231 - protein, 9 aa, Homo Sapiens
DSIHLFRPR

SEQ ID NO: 1309232 - protein, 9 aa, Homo Sapiens
LSLSFWLKR

SEQ ID NO: 1309233 - protein, 9 aa, Homo Sapiens
TKDNLVEAL

SEQ ID NO: 1309234 - protein, 9 aa, Homo Sapiens
QCCNSCTRK

SEQ ID NO: 1309235 - protein, 9 aa, Homo Sapiens
FENKLIQSE

SEQ ID NO: 1309236 - protein, 9 aa, Homo Sapiens
SMFIVLREP

SEQ ID NO: 1309237 - protein, 9 aa, Homo Sapiens
VGTLFGMFA

SEQ ID NO: 1309238 - protein, 9 aa, Homo Sapiens
ARSDQAEVV

SEQ ID NO: 1309239 - protein, 9 aa, Homo Sapiens
KCRHKRARK

SEQ ID NO: 1309240 - protein, 9 aa, Homo Sapiens
RGNSMVYEW

SEQ ID NO: 1309241 - protein, 9 aa, Homo Sapiens
DPCLRGDKD

SEQ ID NO: 1309242 - protein, 9 aa, Homo Sapiens
DGGTNRIFL

SEQ ID NO: 1309243 - protein, 9 aa, Homo Sapiens
FQTFLEREK

SEQ ID NO: 1309244 - protein, 9 aa, Homo Sapiens
KNKEVSKTV

SEQ ID NO: 1309245 - protein, 9 aa, Homo Sapiens
RRLRNHEIR

SEQ ID NO: 1309246 - protein, 9 aa, Homo Sapiens
HIGEKRYEC

SEQ ID NO: 1309247 - protein, 9 aa, Homo Sapiens
EIMESPIDS

SEQ ID NO: 1309248 - protein, 9 aa, Homo Sapiens
LNTTFSFCP

SEQ ID NO: 1309249 - protein, 9 aa, Homo Sapiens
ALKHIHQFG

SEQ ID NO: 1309250 - protein, 9 aa, Homo Sapiens
WPMTETGKE

SEQ ID NO: 1309251 - protein, 9 aa, Homo Sapiens
LRELSTQVP

SEQ ID NO: 1309252 - protein, 9 aa, Homo Sapiens
LCEHEKTHT

SEQ ID NO: 1309253 - protein, 9 aa, Homo Sapiens
DGIKVQLRP

SEQ ID NO: 1309254 - protein, 9 aa, Homo Sapiens
CDEFAPHLK

SEQ ID NO: 1309255 - protein, 9 aa, Homo Sapiens
CDFGLARDM

SEQ ID NO: 1309256 - protein, 9 aa, Homo Sapiens
IDWKRVEKY

SEQ ID NO: 1309257 - protein, 9 aa, Homo Sapiens
NQENFKLLQ

SEQ ID NO: 1309258 - protein, 9 aa, Homo Sapiens
AGCESWDKI

SEQ ID NO: 1309259 - protein, 9 aa, Homo Sapiens
LIQSFYQMH

SEQ ID NO: 1309260 - protein, 9 aa, Homo Sapiens
KNNEMKKSV

SEQ ID NO: 1309261 - protein, 9 aa, Homo Sapiens
GGVDKITQF

SEQ ID NO: 1309262 - protein, 9 aa, Homo Sapiens
RIQLGDKPY

SEQ ID NO: 1309263 - protein, 9 aa, Homo Sapiens
VASVSSLSL

SEQ ID NO: 1309264 - protein, 9 aa, Homo Sapiens
KTGSQDQEA

SEQ ID NO: 1309265 - protein, 9 aa, Homo Sapiens
GLSPSNNSS

SEQ ID NO: 1309266 - protein, 9 aa, Homo Sapiens
KKKKNQKTK

SEQ ID NO: 1309267 - protein, 9 aa, Homo Sapiens
LFKALKHIH

SEQ ID NO: 1309268 - protein, 9 aa, Homo Sapiens
NHYFPAFEK

SEQ ID NO: 1309269 - protein, 9 aa, Homo Sapiens
PEYDSNSTN

SEQ ID NO: 1309270 - protein, 9 aa, Homo Sapiens
QEEIICRFE

SEQ ID NO: 1309271 - protein, 9 aa, Homo Sapiens
YYLRIDQKI

SEQ ID NO: 1309272 - protein, 9 aa, Homo Sapiens
ILQGLKYTL

SEQ ID NO: 1309273 - protein, 9 aa, Homo Sapiens
VQNLWKENV

SEQ ID NO: 1309274 - protein, 9 aa, Homo Sapiens
PHNITIRTT

SEQ ID NO: 1309275 - protein, 9 aa, Homo Sapiens
LLSIIYLAN

SEQ ID NO: 1309276 - protein, 9 aa, Homo Sapiens
VRPSLHLPL

SEQ ID NO: 1309277 - protein, 9 aa, Homo Sapiens
RRPFRPRPH

SEQ ID NO: 1309278 - protein, 9 aa, Homo Sapiens
YLHEVSDTL

SEQ ID NO: 1309279 - protein, 9 aa, Homo Sapiens
VFLIICGLT

SEQ ID NO: 1309280 - protein, 9 aa, Homo Sapiens
GHYARTEYA

SEQ ID NO: 1309281 - protein, 9 aa, Homo Sapiens
AARSDQAEV

SEQ ID NO: 1309282 - protein, 9 aa, Homo Sapiens
TQLVRKGET

SEQ ID NO: 1309283 - protein, 9 aa, Homo Sapiens
RSIEINDEL

SEQ ID NO: 1309284 - protein, 9 aa, Homo Sapiens
LLSLFLFIW

SEQ ID NO: 1309285 - protein, 9 aa, Homo Sapiens
SQSGSGGIV

SEQ ID NO: 1309286 - protein, 9 aa, Homo Sapiens
MAFYFNQDD

SEQ ID NO: 1309287 - protein, 9 aa, Homo Sapiens
FIIPVLRSL

SEQ ID NO: 1309288 - protein, 9 aa, Homo Sapiens
CCNSCTRKI

SEQ ID NO: 1309289 - protein, 9 aa, Homo Sapiens
FFSFCENNV

SEQ ID NO: 1309290 - protein, 9 aa, Homo Sapiens
ATDNNTAAT

SEQ ID NO: 1309291 - protein, 9 aa, Homo Sapiens
NWKIILIRH

SEQ ID NO: 1309292 - protein, 9 aa, Homo Sapiens
RLLEQDKSL

SEQ ID NO: 1309293 - protein, 9 aa, Homo Sapiens
KDDEDKEKK

SEQ ID NO: 1309294 - protein, 9 aa, Homo Sapiens
PSLFHMLRI

SEQ ID NO: 1309295 - protein, 9 aa, Homo Sapiens
KLKTLVEQH

SEQ ID NO: 1309296 - protein, 9 aa, Homo Sapiens
VINSRACYA

SEQ ID NO: 1309297 - protein, 9 aa, Homo Sapiens
HNYLCGALQ

SEQ ID NO: 1309298 - protein, 9 aa, Homo Sapiens
CLPQARGPD

SEQ ID NO: 1309299 - protein, 9 aa, Homo Sapiens
SSIDDAPVL

SEQ ID NO: 1309300 - protein, 9 aa, Homo Sapiens
TGIMTDKRY

SEQ ID NO: 1309301 - protein, 9 aa, Homo Sapiens
VRDMFHSCT

SEQ ID NO: 1309302 - protein, 9 aa, Homo Sapiens
NFTQHQIIH

SEQ ID NO: 1309303 - protein, 9 aa, Homo Sapiens
PKDPNNVLN

SEQ ID NO: 1309304 - protein, 9 aa, Homo Sapiens
TTINLSILA

SEQ ID NO: 1309305 - protein, 9 aa, Homo Sapiens
ELNRLLLEL

SEQ ID NO: 1309306 - protein, 9 aa, Homo Sapiens
FQTHMIMHT

SEQ ID NO: 1309307 - protein, 9 aa, Homo Sapiens
KYYVTITDA

SEQ ID NO: 1309308 - protein, 9 aa, Homo Sapiens
VAGMHGNKA

SEQ ID NO: 1309309 - protein, 9 aa, Homo Sapiens
LSSESCEQL

SEQ ID NO: 1309310 - protein, 9 aa, Homo Sapiens
SPHKYFSTL

SEQ ID NO: 1309311 - protein, 9 aa, Homo Sapiens
VRQEALQSE

SEQ ID NO: 1309312 - protein, 9 aa, Homo Sapiens
YIQERHGDY

SEQ ID NO: 1309313 - protein, 9 aa, Homo Sapiens
NNTASVNLE

SEQ ID NO: 1309314 - protein, 9 aa, Homo Sapiens
NIAQEVEGK

SEQ ID NO: 1309315 - protein, 9 aa, Homo Sapiens
DKYIDQEEL

SEQ ID NO: 1309316 - protein, 9 aa, Homo Sapiens
KERVKGRLD

SEQ ID NO: 1309317 - protein, 9 aa, Homo Sapiens
RMTDDIDNI

SEQ ID NO: 1309318 - protein, 9 aa, Homo Sapiens
QLAVSVIIR

SEQ ID NO: 1309319 - protein, 9 aa, Homo Sapiens
KNTVMGRVI

SEQ ID NO: 1309320 - protein, 9 aa, Homo Sapiens
RVISKNISE

SEQ ID NO: 1309321 - protein, 9 aa, Homo Sapiens
GFFKQNRKR

SEQ ID NO: 1309322 - protein, 9 aa, Homo Sapiens
PKASPKYEV

SEQ ID NO: 1309323 - protein, 9 aa, Homo Sapiens
NFKREEQNV

SEQ ID NO: 1309324 - protein, 9 aa, Homo Sapiens
DNKVLHAAF

SEQ ID NO: 1309325 - protein, 9 aa, Homo Sapiens
EEPDNNSLQ

SEQ ID NO: 1309326 - protein, 9 aa, Homo Sapiens
EFEGLKPAS

SEQ ID NO: 1309327 - protein, 9 aa, Homo Sapiens
REAMVGTIN

SEQ ID NO: 1309328 - protein, 9 aa, Homo Sapiens
LHFKDWIER

SEQ ID NO: 1309329 - protein, 9 aa, Homo Sapiens
GCHSGEIFG

SEQ ID NO: 1309330 - protein, 9 aa, Homo Sapiens
NYTTSKKDT

SEQ ID NO: 1309331 - protein, 9 aa, Homo Sapiens
VNQHKHKFQ

SEQ ID NO: 1309332 - protein, 9 aa, Homo Sapiens
LYQPICDTN

SEQ ID NO: 1309333 - protein, 9 aa, Homo Sapiens
FWLKRNIGY

SEQ ID NO: 1309334 - protein, 9 aa, Homo Sapiens
IYLIMEFLP

SEQ ID NO: 1309335 - protein, 9 aa, Homo Sapiens
AVGKKKKYV

SEQ ID NO: 1309336 - protein, 9 aa, Homo Sapiens
WPLYQFNKK

SEQ ID NO: 1309337 - protein, 9 aa, Homo Sapiens
YFPMDVHAC

SEQ ID NO: 1309338 - protein, 9 aa, Homo Sapiens
EDKCRMATE

SEQ ID NO: 1309339 - protein, 9 aa, Homo Sapiens
CLSVGSNRD

SEQ ID NO: 1309340 - protein, 9 aa, Homo Sapiens
HEEPQIGWY

SEQ ID NO: 1309341 - protein, 9 aa, Homo Sapiens
RHELNRLRQ

SEQ ID NO: 1309342 - protein, 9 aa, Homo Sapiens
KLGNIANTS

SEQ ID NO: 1309343 - protein, 9 aa, Homo Sapiens
VVANIVLTV

SEQ ID NO: 1309344 - protein, 9 aa, Homo Sapiens
DKEDNIIII

SEQ ID NO: 1309345 - protein, 9 aa, Homo Sapiens
ACLVIYRET

SEQ ID NO: 1309346 - protein, 9 aa, Homo Sapiens
FINHQIIHS

SEQ ID NO: 1309347 - protein, 9 aa, Homo Sapiens
LENYLETLR

SEQ ID NO: 1309348 - protein, 9 aa, Homo Sapiens
PGYPGPPGE

SEQ ID NO: 1309349 - protein, 9 aa, Homo Sapiens
DDEDKEKKY

SEQ ID NO: 1309350 - protein, 9 aa, Homo Sapiens
VTLIKHQRI

SEQ ID NO: 1309351 - protein, 9 aa, Homo Sapiens
MVMYFFYKN

SEQ ID NO: 1309352 - protein, 9 aa, Homo Sapiens
EHDYLWVKN

SEQ ID NO: 1309353 - protein, 9 aa, Homo Sapiens
LVSTDKGNE

SEQ ID NO: 1309354 - protein, 9 aa, Homo Sapiens
KHPQEIKTY

SEQ ID NO: 1309355 - protein, 9 aa, Homo Sapiens
ILMAAGCIK

SEQ ID NO: 1309356 - protein, 9 aa, Homo Sapiens
LRVIAEKKL

SEQ ID NO: 1309357 - protein, 9 aa, Homo Sapiens
TGEKPFWCT

SEQ ID NO: 1309358 - protein, 9 aa, Homo Sapiens
PPVRPSLHL

SEQ ID NO: 1309359 - protein, 9 aa, Homo Sapiens
GRFKCQVCN

SEQ ID NO: 1309360 - protein, 9 aa, Homo Sapiens
QYPKFKWPI

SEQ ID NO: 1309361 - protein, 9 aa, Homo Sapiens
TGEKPYKFK

SEQ ID NO: 1309362 - protein, 9 aa, Homo Sapiens
ISKNISEWK

SEQ ID NO: 1309363 - protein, 9 aa, Homo Sapiens
RHVSTLLIE

SEQ ID NO: 1309364 - protein, 9 aa, Homo Sapiens
IARSKALQW

SEQ ID NO: 1309365 - protein, 9 aa, Homo Sapiens
KTQKTYLIG

SEQ ID NO: 1309366 - protein, 9 aa, Homo Sapiens
GPGIGLLDI

SEQ ID NO: 1309367 - protein, 9 aa, Homo Sapiens
NYFISYSRG

SEQ ID NO: 1309368 - protein, 9 aa, Homo Sapiens
PLYQFNKKY

SEQ ID NO: 1309369 - protein, 9 aa, Homo Sapiens
QWDSIYHTL

SEQ ID NO: 1309370 - protein, 9 aa, Homo Sapiens
EGQPLHTKL

SEQ ID NO: 1309371 - protein, 9 aa, Homo Sapiens
QIIARSKAL

SEQ ID NO: 1309372 - protein, 9 aa, Homo Sapiens
DKLLALDEL

SEQ ID NO: 1309373 - protein, 9 aa, Homo Sapiens
SLNALDNIS

SEQ ID NO: 1309374 - protein, 9 aa, Homo Sapiens
MCLEFEGLK

SEQ ID NO: 1309375 - protein, 9 aa, Homo Sapiens
DRLSTLEYD

SEQ ID NO: 1309376 - protein, 9 aa, Homo Sapiens
ESLADRVHT

SEQ ID NO: 1309377 - protein, 9 aa, Homo Sapiens
LCEQHKHTV

SEQ ID NO: 1309378 - protein, 9 aa, Homo Sapiens
FHIQFEEVI

SEQ ID NO: 1309379 - protein, 9 aa, Homo Sapiens
RKKDDGCKT

SEQ ID NO: 1309380 - protein, 9 aa, Homo Sapiens
GNIANTSVK

SEQ ID NO: 1309381 - protein, 9 aa, Homo Sapiens
KRQLEEKET

SEQ ID NO: 1309382 - protein, 9 aa, Homo Sapiens
LLVRRNIFN

SEQ ID NO: 1309383 - protein, 9 aa, Homo Sapiens
LHEVSDTLK

SEQ ID NO: 1309384 - protein, 9 aa, Homo Sapiens
SLKNASTAN

SEQ ID NO: 1309385 - protein, 9 aa, Homo Sapiens
ASKVNQHKH

SEQ ID NO: 1309386 - protein, 9 aa, Homo Sapiens
IENLDAIQV

SEQ ID NO: 1309387 - protein, 9 aa, Homo Sapiens
VSKSSTFYR

SEQ ID NO: 1309388 - protein, 9 aa, Homo Sapiens
VGYERDFLQ

SEQ ID NO: 1309389 - protein, 9 aa, Homo Sapiens
FHMLRITHT

SEQ ID NO: 1309390 - protein, 9 aa, Homo Sapiens
EQNQALLQT

SEQ ID NO: 1309391 - protein, 9 aa, Homo Sapiens
GLFCGESSE

SEQ ID NO: 1309392 - protein, 9 aa, Homo Sapiens
KIIHNNLNP

SEQ ID NO: 1309393 - protein, 9 aa, Homo Sapiens
GPLELVEKK

SEQ ID NO: 1309394 - protein, 9 aa, Homo Sapiens
KPRKQTYEQ

SEQ ID NO: 1309395 - protein, 9 aa, Homo Sapiens
QIIELLNAE

SEQ ID NO: 1309396 - protein, 9 aa, Homo Sapiens
DKSLAGWAL

SEQ ID NO: 1309397 - protein, 9 aa, Homo Sapiens
PCKSELKVL

SEQ ID NO: 1309398 - protein, 9 aa, Homo Sapiens
GISNVIEKT

SEQ ID NO: 1309399 - protein, 9 aa, Homo Sapiens
IEIPNINTQ

SEQ ID NO: 1309400 - protein, 9 aa, Homo Sapiens
VFFSKISGI

SEQ ID NO: 1309401 - protein, 9 aa, Homo Sapiens
EQNKKSVTE

SEQ ID NO: 1309402 - protein, 9 aa, Homo Sapiens
NKILFNVDR

SEQ ID NO: 1309403 - protein, 9 aa, Homo Sapiens
VYTKGNFWM

SEQ ID NO: 1309404 - protein, 9 aa, Homo Sapiens
NNSNVTSPL

SEQ ID NO: 1309405 - protein, 9 aa, Homo Sapiens
ETLLATEQE

SEQ ID NO: 1309406 - protein, 9 aa, Homo Sapiens
CFRDKMAGE

SEQ ID NO: 1309407 - protein, 9 aa, Homo Sapiens
VVLAMQHYE

SEQ ID NO: 1309408 - protein, 9 aa, Homo Sapiens
LDSHLSYTK

SEQ ID NO: 1309409 - protein, 9 aa, Homo Sapiens
VKSKSALLS

SEQ ID NO: 1309410 - protein, 9 aa, Homo Sapiens
FSNIYFYCN

SEQ ID NO: 1309411 - protein, 9 aa, Homo Sapiens
QQENGPILL

SEQ ID NO: 1309412 - protein, 9 aa, Homo Sapiens
CNELEKQMN

SEQ ID NO: 1309413 - protein, 9 aa, Homo Sapiens
QPKEDTQKL

SEQ ID NO: 1309414 - protein, 9 aa, Homo Sapiens
LDSIHLFRP

SEQ ID NO: 1309415 - protein, 9 aa, Homo Sapiens
LSPKSTEAV

SEQ ID NO: 1309416 - protein, 9 aa, Homo Sapiens
FLNTTFSFC

SEQ ID NO: 1309417 - protein, 9 aa, Homo Sapiens
SEIIIAYLR

SEQ ID NO: 1309418 - protein, 9 aa, Homo Sapiens
GSPSHQKHI

SEQ ID NO: 1309419 - protein, 9 aa, Homo Sapiens
NTKFYAAGL

SEQ ID NO: 1309420 - protein, 9 aa, Homo Sapiens
YPPVRPSLH

SEQ ID NO: 1309421 - protein, 9 aa, Homo Sapiens
SAGNYLTGH

SEQ ID NO: 1309422 - protein, 9 aa, Homo Sapiens
FISPGPSPQ

SEQ ID NO: 1309423 - protein, 9 aa, Homo Sapiens
ETAWKVKDE

SEQ ID NO: 1309424 - protein, 9 aa, Homo Sapiens
GQNKGEKPE

SEQ ID NO: 1309425 - protein, 9 aa, Homo Sapiens
QLCFISPGP

SEQ ID NO: 1309426 - protein, 9 aa, Homo Sapiens
TFCEHMDIA

SEQ ID NO: 1309427 - protein, 9 aa, Homo Sapiens
MMPVNYYIY

SEQ ID NO: 1309428 - protein, 9 aa, Homo Sapiens
KEDKVEEGP

SEQ ID NO: 1309429 - protein, 9 aa, Homo Sapiens
RVEKYVNKA

SEQ ID NO: 1309430 - protein, 9 aa, Homo Sapiens
SKMYLNTLA

SEQ ID NO: 1309431 - protein, 9 aa, Homo Sapiens
NNLKVPECR

SEQ ID NO: 1309432 - protein, 9 aa, Homo Sapiens
KISLAIYFR

SEQ ID NO: 1309433 - protein, 9 aa, Homo Sapiens
SFIIAKQIF

SEQ ID NO: 1309434 - protein, 9 aa, Homo Sapiens
ALNVVFEQI

SEQ ID NO: 1309435 - protein, 9 aa, Homo Sapiens
HLVVQSLPI

SEQ ID NO: 1309436 - protein, 9 aa, Homo Sapiens
VEIMESPID

SEQ ID NO: 1309437 - protein, 9 aa, Homo Sapiens
VETGVVFIF

SEQ ID NO: 1309438 - protein, 9 aa, Homo Sapiens
IGNTLFDAG

SEQ ID NO: 1309439 - protein, 9 aa, Homo Sapiens
NQGAHYPDY

SEQ ID NO: 1309440 - protein, 9 aa, Homo Sapiens
TEYAENANK

SEQ ID NO: 1309441 - protein, 9 aa, Homo Sapiens
LQDKDVITI

SEQ ID NO: 1309442 - protein, 9 aa, Homo Sapiens
VNQSNYKLP

SEQ ID NO: 1309443 - protein, 9 aa, Homo Sapiens
STQIMKILT

SEQ ID NO: 1309444 - protein, 9 aa, Homo Sapiens
KIIHTREKA

SEQ ID NO: 1309445 - protein, 9 aa, Homo Sapiens
CILGALFGP

SEQ ID NO: 1309446 - protein, 9 aa, Homo Sapiens
LTSLTDVVI

SEQ ID NO: 1309447 - protein, 9 aa, Homo Sapiens
ESIINPDAF

SEQ ID NO: 1309448 - protein, 9 aa, Homo Sapiens
IKCRHKRAR

SEQ ID NO: 1309449 - protein, 9 aa, Homo Sapiens
NTIRLRIVE

SEQ ID NO: 1309450 - protein, 9 aa, Homo Sapiens
LDPKTISFW

SEQ ID NO: 1309451 - protein, 9 aa, Homo Sapiens
EVTVQPGCY

SEQ ID NO: 1309452 - protein, 9 aa, Homo Sapiens
HSPRLGRAR

SEQ ID NO: 1309453 - protein, 9 aa, Homo Sapiens
ANGPPPRVL

SEQ ID NO: 1309454 - protein, 9 aa, Homo Sapiens
HKSKQETVI

SEQ ID NO: 1309455 - protein, 9 aa, Homo Sapiens
KRGESKFDS

SEQ ID NO: 1309456 - protein, 9 aa, Homo Sapiens
FSAVKLCWM

SEQ ID NO: 1309457 - protein, 9 aa, Homo Sapiens
IILCIIMLL

SEQ ID NO: 1309458 - protein, 9 aa, Homo Sapiens
PGSVIAQNL

SEQ ID NO: 1309459 - protein, 9 aa, Homo Sapiens
CGIICGKLM

SEQ ID NO: 1309460 - protein, 9 aa, Homo Sapiens
RRIQRQTPR

SEQ ID NO: 1309461 - protein, 9 aa, Homo Sapiens
TNLETQKEI

SEQ ID NO: 1309462 - protein, 9 aa, Homo Sapiens
MHLSNYRIT

SEQ ID NO: 1309463 - protein, 9 aa, Homo Sapiens
VSGITISVT

SEQ ID NO: 1309464 - protein, 9 aa, Homo Sapiens
AMLNEKINW

SEQ ID NO: 1309465 - protein, 9 aa, Homo Sapiens
QNQALLQTR

SEQ ID NO: 1309466 - protein, 9 aa, Homo Sapiens
GSYVDYLSS

SEQ ID NO: 1309467 - protein, 9 aa, Homo Sapiens
SVTPQGNYF

SEQ ID NO: 1309468 - protein, 9 aa, Homo Sapiens
TAKSKKNKP

SEQ ID NO: 1309469 - protein, 9 aa, Homo Sapiens
ELNVQKRKQ

SEQ ID NO: 1309470 - protein, 9 aa, Homo Sapiens
FSCTGGYEL

SEQ ID NO: 1309471 - protein, 9 aa, Homo Sapiens
VWKVCAANF

SEQ ID NO: 1309472 - protein, 9 aa, Homo Sapiens
ESEAMKYKL

SEQ ID NO: 1309473 - protein, 9 aa, Homo Sapiens
EHKKEEDND

SEQ ID NO: 1309474 - protein, 9 aa, Homo Sapiens
LSDKLAAVV

SEQ ID NO: 1309475 - protein, 9 aa, Homo Sapiens
SCTGGYELQ

SEQ ID NO: 1309476 - protein, 9 aa, Homo Sapiens
SRVQAIILP

SEQ ID NO: 1309477 - protein, 9 aa, Homo Sapiens
NPEKKGEKE

SEQ ID NO: 1309478 - protein, 9 aa, Homo Sapiens
GVILHSLKP

SEQ ID NO: 1309479 - protein, 9 aa, Homo Sapiens
VRDAPKKSE

SEQ ID NO: 1309480 - protein, 9 aa, Homo Sapiens
GLAFIYNQT

SEQ ID NO: 1309481 - protein, 9 aa, Homo Sapiens
KTVQQEESV

SEQ ID NO: 1309482 - protein, 9 aa, Homo Sapiens
HKLIETDFK

SEQ ID NO: 1309483 - protein, 9 aa, Homo Sapiens
LILKAFANY

SEQ ID NO: 1309484 - protein, 9 aa, Homo Sapiens
KDDTILKTN

SEQ ID NO: 1309485 - protein, 9 aa, Homo Sapiens
GCCSELVTK

SEQ ID NO: 1309486 - protein, 9 aa, Homo Sapiens
AAAHRKGSN

SEQ ID NO: 1309487 - protein, 9 aa, Homo Sapiens
VLESHFLKC

SEQ ID NO: 1309488 - protein, 9 aa, Homo Sapiens
YLENIVAIH

SEQ ID NO: 1309489 - protein, 9 aa, Homo Sapiens
RDQSELKHH

SEQ ID NO: 1309490 - protein, 9 aa, Homo Sapiens
FCDILPLLK

SEQ ID NO: 1309491 - protein, 9 aa, Homo Sapiens
LDENVHFFY

SEQ ID NO: 1309492 - protein, 9 aa, Homo Sapiens
YIPFPEYDS

SEQ ID NO: 1309493 - protein, 9 aa, Homo Sapiens
FLTVEIMES

SEQ ID NO: 1309494 - protein, 9 aa, Homo Sapiens
KGIHPDPKA

SEQ ID NO: 1309495 - protein, 9 aa, Homo Sapiens
EEEEIRKKY

SEQ ID NO: 1309496 - protein, 9 aa, Homo Sapiens
TINNTASVN

SEQ ID NO: 1309497 - protein, 9 aa, Homo Sapiens
AWEVVRAES

SEQ ID NO: 1309498 - protein, 9 aa, Homo Sapiens
QYGYSYYNS

SEQ ID NO: 1309499 - protein, 9 aa, Homo Sapiens
KYKSSNKQP

SEQ ID NO: 1309500 - protein, 9 aa, Homo Sapiens
TSRHNLEKL

SEQ ID NO: 1309501 - protein, 9 aa, Homo Sapiens
ICGKLMRNE

SEQ ID NO: 1309502 - protein, 9 aa, Homo Sapiens
VLHFKDWIE

SEQ ID NO: 1309503 - protein, 9 aa, Homo Sapiens
YCSTSYSAR

SEQ ID NO: 1309504 - protein, 9 aa, Homo Sapiens
EIMVPNYFS

SEQ ID NO: 1309505 - protein, 9 aa, Homo Sapiens
IALTQKNQL

SEQ ID NO: 1309506 - protein, 9 aa, Homo Sapiens
EHTIQKDGL

SEQ ID NO: 1309507 - protein, 9 aa, Homo Sapiens
DELKTDYNN

SEQ ID NO: 1309508 - protein, 9 aa, Homo Sapiens
PAPNFLPPQ

SEQ ID NO: 1309509 - protein, 9 aa, Homo Sapiens
MDRIVRQEA

SEQ ID NO: 1309510 - protein, 9 aa, Homo Sapiens
DKDPKGGFD

SEQ ID NO: 1309511 - protein, 9 aa, Homo Sapiens
KEDNIIIIS

SEQ ID NO: 1309512 - protein, 9 aa, Homo Sapiens
TNVSMDYVP

SEQ ID NO: 1309513 - protein, 9 aa, Homo Sapiens
RINPEKKGE

SEQ ID NO: 1309514 - protein, 9 aa, Homo Sapiens
NHKEWIEIR

SEQ ID NO: 1309515 - protein, 9 aa, Homo Sapiens
PLLAVLNNG

SEQ ID NO: 1309516 - protein, 9 aa, Homo Sapiens
TSQEEIICR

SEQ ID NO: 1309517 - protein, 9 aa, Homo Sapiens
ALSPKSTEA

SEQ ID NO: 1309518 - protein, 9 aa, Homo Sapiens
DCFGMWIEY

SEQ ID NO: 1309519 - protein, 9 aa, Homo Sapiens
PHFTSEDAK

SEQ ID NO: 1309520 - protein, 9 aa, Homo Sapiens
DILMAAGCI

SEQ ID NO: 1309521 - protein, 9 aa, Homo Sapiens
PAARDVNIP

SEQ ID NO: 1309522 - protein, 9 aa, Homo Sapiens
IFLKKTFNI

SEQ ID NO: 1309523 - protein, 9 aa, Homo Sapiens
QGLGTALNI

SEQ ID NO: 1309524 - protein, 9 aa, Homo Sapiens
EYEWDKPRI

SEQ ID NO: 1309525 - protein, 9 aa, Homo Sapiens
SKTPSTPEP

SEQ ID NO: 1309526 - protein, 9 aa, Homo Sapiens
VKSHFMYAV

SEQ ID NO: 1309527 - protein, 9 aa, Homo Sapiens
STFSSDNTI

SEQ ID NO: 1309528 - protein, 9 aa, Homo Sapiens
YHTLGSRCY

SEQ ID NO: 1309529 - protein, 9 aa, Homo Sapiens
TYPENLPAL

SEQ ID NO: 1309530 - protein, 9 aa, Homo Sapiens
PPQEEHLEL

SEQ ID NO: 1309531 - protein, 9 aa, Homo Sapiens
FQCEDSESF

SEQ ID NO: 1309532 - protein, 9 aa, Homo Sapiens
AFSLKSNLQ

SEQ ID NO: 1309533 - protein, 9 aa, Homo Sapiens
QRSYSWFQD

SEQ ID NO: 1309534 - protein, 9 aa, Homo Sapiens
RPLPKRVEI

SEQ ID NO: 1309535 - protein, 9 aa, Homo Sapiens
EGPSTFSRE

SEQ ID NO: 1309536 - protein, 9 aa, Homo Sapiens
EGLSSTYAE

SEQ ID NO: 1309537 - protein, 9 aa, Homo Sapiens
DLNINLISS

SEQ ID NO: 1309538 - protein, 9 aa, Homo Sapiens
QPTPDLETL

SEQ ID NO: 1309539 - protein, 9 aa, Homo Sapiens
SLHRINITH

SEQ ID NO: 1309540 - protein, 9 aa, Homo Sapiens
SFFKQECII

SEQ ID NO: 1309541 - protein, 9 aa, Homo Sapiens
YAYPNSEVI

SEQ ID NO: 1309542 - protein, 9 aa, Homo Sapiens
SSVGCWHGS

SEQ ID NO: 1309543 - protein, 9 aa, Homo Sapiens
AQGRIYGTI

SEQ ID NO: 1309544 - protein, 9 aa, Homo Sapiens
EKKIISFNW

SEQ ID NO: 1309545 - protein, 9 aa, Homo Sapiens
VALIPYSVH

SEQ ID NO: 1309546 - protein, 9 aa, Homo Sapiens
NHDYIEIWN

SEQ ID NO: 1309547 - protein, 9 aa, Homo Sapiens
KEATTINLS

SEQ ID NO: 1309548 - protein, 9 aa, Homo Sapiens
LGYSDLLCL

SEQ ID NO: 1309549 - protein, 9 aa, Homo Sapiens
LKPQSLEGK

SEQ ID NO: 1309550 - protein, 9 aa, Homo Sapiens
RDDIDNIAQ

SEQ ID NO: 1309551 - protein, 9 aa, Homo Sapiens
IPSEPERTN

SEQ ID NO: 1309552 - protein, 9 aa, Homo Sapiens
KLALLDKAQ

SEQ ID NO: 1309553 - protein, 9 aa, Homo Sapiens
RLRKLNWKI

SEQ ID NO: 1309554 - protein, 9 aa, Homo Sapiens
LNMQEEEEQ

SEQ ID NO: 1309555 - protein, 9 aa, Homo Sapiens
KMYLNTLAT

SEQ ID NO: 1309556 - protein, 9 aa, Homo Sapiens
QTKVLSSKL

SEQ ID NO: 1309557 - protein, 9 aa, Homo Sapiens
ENYFLSNNI

SEQ ID NO: 1309558 - protein, 9 aa, Homo Sapiens
ETAGVAAEE

SEQ ID NO: 1309559 - protein, 9 aa, Homo Sapiens
SVGTLFGMF

SEQ ID NO: 1309560 - protein, 9 aa, Homo Sapiens
FQSWSGPDK

SEQ ID NO: 1309561 - protein, 9 aa, Homo Sapiens
LNILFSEKE

SEQ ID NO: 1309562 - protein, 9 aa, Homo Sapiens
ICRHKRSHT

SEQ ID NO: 1309563 - protein, 9 aa, Homo Sapiens
SLPNKYNLS

SEQ ID NO: 1309564 - protein, 9 aa, Homo Sapiens
LSSDPSNQK

SEQ ID NO: 1309565 - protein, 9 aa, Homo Sapiens
GEIFQIINN

SEQ ID NO: 1309566 - protein, 9 aa, Homo Sapiens
DEKGPEEKQ

SEQ ID NO: 1309567 - protein, 9 aa, Homo Sapiens
SLPHQIKNI

SEQ ID NO: 1309568 - protein, 9 aa, Homo Sapiens
DRETQELYI

SEQ ID NO: 1309569 - protein, 9 aa, Homo Sapiens
FKSLQAGLS

SEQ ID NO: 1309570 - protein, 9 aa, Homo Sapiens
PATLSFLLF

SEQ ID NO: 1309571 - protein, 9 aa, Homo Sapiens
HKIISTGEK

SEQ ID NO: 1309572 - protein, 9 aa, Homo Sapiens
VCPIPLSSS

SEQ ID NO: 1309573 - protein, 9 aa, Homo Sapiens
ISKISLAIY

SEQ ID NO: 1309574 - protein, 9 aa, Homo Sapiens
NWEFKNELY

SEQ ID NO: 1309575 - protein, 9 aa, Homo Sapiens
QYEVNQSNY

SEQ ID NO: 1309576 - protein, 9 aa, Homo Sapiens
SIIYLANTL

SEQ ID NO: 1309577 - protein, 9 aa, Homo Sapiens
RPRPHQQPT

SEQ ID NO: 1309578 - protein, 9 aa, Homo Sapiens
LRLAQSRTN

SEQ ID NO: 1309579 - protein, 9 aa, Homo Sapiens
DNIAQEVEG

SEQ ID NO: 1309580 - protein, 9 aa, Homo Sapiens
IRLLLYLQS

SEQ ID NO: 1309581 - protein, 9 aa, Homo Sapiens
LSIIKSECS

SEQ ID NO: 1309582 - protein, 9 aa, Homo Sapiens
IMRGSSREG

SEQ ID NO: 1309583 - protein, 9 aa, Homo Sapiens
MATSVVPKN

SEQ ID NO: 1309584 - protein, 9 aa, Homo Sapiens
YVCCIKPND

SEQ ID NO: 1309585 - protein, 9 aa, Homo Sapiens
PKAFSPPIK

SEQ ID NO: 1309586 - protein, 9 aa, Homo Sapiens
YKVNNLGVC

SEQ ID NO: 1309587 - protein, 9 aa, Homo Sapiens
ELMCETKLL

SEQ ID NO: 1309588 - protein, 9 aa, Homo Sapiens
IKSSFHNVD

SEQ ID NO: 1309589 - protein, 9 aa, Homo Sapiens
SLGAEACNL

SEQ ID NO: 1309590 - protein, 9 aa, Homo Sapiens
PDRYQFTSR

SEQ ID NO: 1309591 - protein, 9 aa, Homo Sapiens
IFSFLYGKD

SEQ ID NO: 1309592 - protein, 9 aa, Homo Sapiens
AALKCLKMV

SEQ ID NO: 1309593 - protein, 9 aa, Homo Sapiens
NNWPDHDVP

SEQ ID NO: 1309594 - protein, 9 aa, Homo Sapiens
VERCRINLV

SEQ ID NO: 1309595 - protein, 9 aa, Homo Sapiens
AAYKIVLYP

SEQ ID NO: 1309596 - protein, 9 aa, Homo Sapiens
CNLMQSSSA

SEQ ID NO: 1309597 - protein, 9 aa, Homo Sapiens
KAYEYMGHI

SEQ ID NO: 1309598 - protein, 9 aa, Homo Sapiens
IINLLTEHL

SEQ ID NO: 1309599 - protein, 9 aa, Homo Sapiens
QQTQRNVIN

SEQ ID NO: 1309600 - protein, 9 aa, Homo Sapiens
YISAEEEDW

SEQ ID NO: 1309601 - protein, 9 aa, Homo Sapiens
TQDYLQLEQ

SEQ ID NO: 1309602 - protein, 9 aa, Homo Sapiens
GGQLPAYPS

SEQ ID NO: 1309603 - protein, 9 aa, Homo Sapiens
ALILFGAIT

SEQ ID NO: 1309604 - protein, 9 aa, Homo Sapiens
KIKSSFHNV

SEQ ID NO: 1309605 - protein, 9 aa, Homo Sapiens
EAHRTVFMR

SEQ ID NO: 1309606 - protein, 9 aa, Homo Sapiens
ERFLRIIML

SEQ ID NO: 1309607 - protein, 9 aa, Homo Sapiens
KSYYKVNNL

SEQ ID NO: 1309608 - protein, 9 aa, Homo Sapiens
QNRKLTYIR

SEQ ID NO: 1309609 - protein, 9 aa, Homo Sapiens
KIMARTLTG

SEQ ID NO: 1309610 - protein, 9 aa, Homo Sapiens
NEQDGPSIY

SEQ ID NO: 1309611 - protein, 9 aa, Homo Sapiens
EHEEPQIGW

SEQ ID NO: 1309612 - protein, 9 aa, Homo Sapiens
IYKSKLKDE

SEQ ID NO: 1309613 - protein, 9 aa, Homo Sapiens
YQCLILLTW

SEQ ID NO: 1309614 - protein, 9 aa, Homo Sapiens
NTIEYDCKE

SEQ ID NO: 1309615 - protein, 9 aa, Homo Sapiens
WLSVLQNAI

SEQ ID NO: 1309616 - protein, 9 aa, Homo Sapiens
YNELITKYG

SEQ ID NO: 1309617 - protein, 9 aa, Homo Sapiens
GGRESYMST

SEQ ID NO: 1309618 - protein, 9 aa, Homo Sapiens
QEYEWDKPR

SEQ ID NO: 1309619 - protein, 9 aa, Homo Sapiens
WCHHSSLRY

SEQ ID NO: 1309620 - protein, 9 aa, Homo Sapiens
TESRGVNLN

SEQ ID NO: 1309621 - protein, 9 aa, Homo Sapiens
LEKWMVCLT

SEQ ID NO: 1309622 - protein, 9 aa, Homo Sapiens
TLSEDKVFA

SEQ ID NO: 1309623 - protein, 9 aa, Homo Sapiens
CVSLLIQHL

SEQ ID NO: 1309624 - protein, 9 aa, Homo Sapiens
GILAVGVFS

SEQ ID NO: 1309625 - protein, 9 aa, Homo Sapiens
TISVTSVYW

SEQ ID NO: 1309626 - protein, 9 aa, Homo Sapiens
LSDDWAANK

SEQ ID NO: 1309627 - protein, 9 aa, Homo Sapiens
QIINQISTL

SEQ ID NO: 1309628 - protein, 9 aa, Homo Sapiens
DNPNSSDYL

SEQ ID NO: 1309629 - protein, 9 aa, Homo Sapiens
NNNITRGQS

SEQ ID NO: 1309630 - protein, 9 aa, Homo Sapiens
EGISPSVYM

SEQ ID NO: 1309631 - protein, 9 aa, Homo Sapiens
KGGETSDMY

SEQ ID NO: 1309632 - protein, 9 aa, Homo Sapiens
NERFHMVKQ

SEQ ID NO: 1309633 - protein, 9 aa, Homo Sapiens
TTAQIRDTL

SEQ ID NO: 1309634 - protein, 9 aa, Homo Sapiens
EIQINEIVT

SEQ ID NO: 1309635 - protein, 9 aa, Homo Sapiens
KESSTWKGN

SEQ ID NO: 1309636 - protein, 9 aa, Homo Sapiens
IWQCGLLMC

SEQ ID NO: 1309637 - protein, 9 aa, Homo Sapiens
ELQDKLHQN

SEQ ID NO: 1309638 - protein, 9 aa, Homo Sapiens
RIHVCLYLI

SEQ ID NO: 1309639 - protein, 9 aa, Homo Sapiens
RYSDAQGSG

SEQ ID NO: 1309640 - protein, 9 aa, Homo Sapiens
QYIILEARY

SEQ ID NO: 1309641 - protein, 9 aa, Homo Sapiens
FLKNRWPNY

SEQ ID NO: 1309642 - protein, 9 aa, Homo Sapiens
SLIALTQKN

SEQ ID NO: 1309643 - protein, 9 aa, Homo Sapiens
DCVIGLMMT

SEQ ID NO: 1309644 - protein, 9 aa, Homo Sapiens
CMRALDERP

SEQ ID NO: 1309645 - protein, 9 aa, Homo Sapiens
DKIKTNITF

SEQ ID NO: 1309646 - protein, 9 aa, Homo Sapiens
KDKYIDQEE

SEQ ID NO: 1309647 - protein, 9 aa, Homo Sapiens
IDRINPEKK

SEQ ID NO: 1309648 - protein, 9 aa, Homo Sapiens
GVHGIQIEF

SEQ ID NO: 1309649 - protein, 9 aa, Homo Sapiens
YYLPRRYKL

SEQ ID NO: 1309650 - protein, 9 aa, Homo Sapiens
LYALLGKYF

SEQ ID NO: 1309651 - protein, 9 aa, Homo Sapiens
GSRAHAETS

SEQ ID NO: 1309652 - protein, 9 aa, Homo Sapiens
SEVIYVWTN

SEQ ID NO: 1309653 - protein, 9 aa, Homo Sapiens
ELLQFQVTD

SEQ ID NO: 1309654 - protein, 9 aa, Homo Sapiens
IIQRLFARG

SEQ ID NO: 1309655 - protein, 9 aa, Homo Sapiens
LSDVGGEHL

SEQ ID NO: 1309656 - protein, 9 aa, Homo Sapiens
AFLTVEIME

SEQ ID NO: 1309657 - protein, 9 aa, Homo Sapiens
ICQKTPKAS

SEQ ID NO: 1309658 - protein, 9 aa, Homo Sapiens
RAALDRETQ

SEQ ID NO: 1309659 - protein, 9 aa, Homo Sapiens
SPSKNYFIS

SEQ ID NO: 1309660 - protein, 9 aa, Homo Sapiens
ATRQIDREE

SEQ ID NO: 1309661 - protein, 9 aa, Homo Sapiens
KKLDTFKSV

SEQ ID NO: 1309662 - protein, 9 aa, Homo Sapiens
QQKLMSKNN

SEQ ID NO: 1309663 - protein, 9 aa, Homo Sapiens
NTNTRVLAS

SEQ ID NO: 1309664 - protein, 9 aa, Homo Sapiens
ARPYECVQC

SEQ ID NO: 1309665 - protein, 9 aa, Homo Sapiens
IDNIAQEVE

SEQ ID NO: 1309666 - protein, 9 aa, Homo Sapiens
LKEQDKIIE

SEQ ID NO: 1309667 - protein, 9 aa, Homo Sapiens
QKNQLISFQ

SEQ ID NO: 1309668 - protein, 9 aa, Homo Sapiens
TSDMYLIQP

SEQ ID NO: 1309669 - protein, 9 aa, Homo Sapiens
KKIKKDKKA

SEQ ID NO: 1309670 - protein, 9 aa, Homo Sapiens
DKLSHLRSQ

SEQ ID NO: 1309671 - protein, 9 aa, Homo Sapiens
NYLEELISG

SEQ ID NO: 1309672 - protein, 9 aa, Homo Sapiens
GPILLDTKD

SEQ ID NO: 1309673 - protein, 9 aa, Homo Sapiens
KLPKDANKS

SEQ ID NO: 1309674 - protein, 9 aa, Homo Sapiens
LTEHKLIHI

SEQ ID NO: 1309675 - protein, 9 aa, Homo Sapiens
PVGFPGYPG

SEQ ID NO: 1309676 - protein, 9 aa, Homo Sapiens
YSDAFGGYG

SEQ ID NO: 1309677 - protein, 9 aa, Homo Sapiens
DRPFPVCPI

SEQ ID NO: 1309678 - protein, 9 aa, Homo Sapiens
SVLRYPSFF

SEQ ID NO: 1309679 - protein, 9 aa, Homo Sapiens
LSSCLSKAA

SEQ ID NO: 1309680 - protein, 9 aa, Homo Sapiens
LQFIYSKGA

SEQ ID NO: 1309681 - protein, 9 aa, Homo Sapiens
TVSNIYLEI

SEQ ID NO: 1309682 - protein, 9 aa, Homo Sapiens
GPEGEQQDV

SEQ ID NO: 1309683 - protein, 9 aa, Homo Sapiens
TTQKLKDTL

SEQ ID NO: 1309684 - protein, 9 aa, Homo Sapiens
RKLTYIRGI

SEQ ID NO: 1309685 - protein, 9 aa, Homo Sapiens
PRCIIGVTQ

SEQ ID NO: 1309686 - protein, 9 aa, Homo Sapiens
RDMYKDPDY

SEQ ID NO: 1309687 - protein, 9 aa, Homo Sapiens
LKDRNPKEI

SEQ ID NO: 1309688 - protein, 9 aa, Homo Sapiens
SPTSVTVMS

SEQ ID NO: 1309689 - protein, 9 aa, Homo Sapiens
LCVYVHDQG

SEQ ID NO: 1309690 - protein, 9 aa, Homo Sapiens
LESGIDQII

SEQ ID NO: 1309691 - protein, 9 aa, Homo Sapiens
EERRNKLCE

SEQ ID NO: 1309692 - protein, 9 aa, Homo Sapiens
YQQLQQNKE

SEQ ID NO: 1309693 - protein, 9 aa, Homo Sapiens
GPDKLLALD

SEQ ID NO: 1309694 - protein, 9 aa, Homo Sapiens
NSMVYEWRT

SEQ ID NO: 1309695 - protein, 9 aa, Homo Sapiens
QLGLSPSNN

SEQ ID NO: 1309696 - protein, 9 aa, Homo Sapiens
ATTINLSIL

SEQ ID NO: 1309697 - protein, 9 aa, Homo Sapiens
DSLEDQIED

SEQ ID NO: 1309698 - protein, 9 aa, Homo Sapiens
GEILGFDMY

SEQ ID NO: 1309699 - protein, 9 aa, Homo Sapiens
HKIFHITEN

SEQ ID NO: 1309700 - protein, 9 aa, Homo Sapiens
RRSLRIRSE

SEQ ID NO: 1309701 - protein, 9 aa, Homo Sapiens
KLRFHPWQL

SEQ ID NO: 1309702 - protein, 9 aa, Homo Sapiens
MVCLRTSEK

SEQ ID NO: 1309703 - protein, 9 aa, Homo Sapiens
EQLQRTHSQ

SEQ ID NO: 1309704 - protein, 9 aa, Homo Sapiens
EGQITEDEE

SEQ ID NO: 1309705 - protein, 9 aa, Homo Sapiens
PSIAPSSQT

SEQ ID NO: 1309706 - protein, 9 aa, Homo Sapiens
VRNILQSQG

SEQ ID NO: 1309707 - protein, 9 aa, Homo Sapiens
WSKGLIGMH

SEQ ID NO: 1309708 - protein, 9 aa, Homo Sapiens
AIKSVGTLF

SEQ ID NO: 1309709 - protein, 9 aa, Homo Sapiens
HEIHESKNR

SEQ ID NO: 1309710 - protein, 9 aa, Homo Sapiens
QLGMAKYDI

SEQ ID NO: 1309711 - protein, 9 aa, Homo Sapiens
HEDVPIFIH

SEQ ID NO: 1309712 - protein, 9 aa, Homo Sapiens
HQIHTGEKP

SEQ ID NO: 1309713 - protein, 9 aa, Homo Sapiens
CFFIWQCGL

SEQ ID NO: 1309714 - protein, 9 aa, Homo Sapiens
NVSMDYVPY

SEQ ID NO: 1309715 - protein, 9 aa, Homo Sapiens
LSRRRASGL

SEQ ID NO: 1309716 - protein, 9 aa, Homo Sapiens
EVPPRITSR

SEQ ID NO: 1309717 - protein, 9 aa, Homo Sapiens
YVNKAKRQI

SEQ ID NO: 1309718 - protein, 9 aa, Homo Sapiens
YTNAIQWMS

SEQ ID NO: 1309719 - protein, 9 aa, Homo Sapiens
KPAARDVNI

SEQ ID NO: 1309720 - protein, 9 aa, Homo Sapiens
TSCCAMLEC

SEQ ID NO: 1309721 - protein, 9 aa, Homo Sapiens
GYSDLLCLS

SEQ ID NO: 1309722 - protein, 9 aa, Homo Sapiens
FIGSPGEVG

SEQ ID NO: 1309723 - protein, 9 aa, Homo Sapiens
YRVISKNIS

SEQ ID NO: 1309724 - protein, 9 aa, Homo Sapiens
HHCSICKIC

SEQ ID NO: 1309725 - protein, 9 aa, Homo Sapiens
WVEKKKKNQ

SEQ ID NO: 1309726 - protein, 9 aa, Homo Sapiens
FVSAPHISS

SEQ ID NO: 1309727 - protein, 9 aa, Homo Sapiens
LLLYLQSIP

SEQ ID NO: 1309728 - protein, 9 aa, Homo Sapiens
EEEETVFQE

SEQ ID NO: 1309729 - protein, 9 aa, Homo Sapiens
GNNLSEAQL

SEQ ID NO: 1309730 - protein, 9 aa, Homo Sapiens
FQDKRNIYL

SEQ ID NO: 1309731 - protein, 9 aa, Homo Sapiens
LIHFSNIYF

SEQ ID NO: 1309732 - protein, 9 aa, Homo Sapiens
FQLCVYVHD

SEQ ID NO: 1309733 - protein, 9 aa, Homo Sapiens
WKTSFYVGA

SEQ ID NO: 1309734 - protein, 9 aa, Homo Sapiens
MTDDIDNIS

SEQ ID NO: 1309735 - protein, 9 aa, Homo Sapiens
KRFIHVFFS

SEQ ID NO: 1309736 - protein, 9 aa, Homo Sapiens
DAIVAALKC

SEQ ID NO: 1309737 - protein, 9 aa, Homo Sapiens
YFLSNNIHT

SEQ ID NO: 1309738 - protein, 9 aa, Homo Sapiens
GKCVEEILE

SEQ ID NO: 1309739 - protein, 9 aa, Homo Sapiens
TQIKEMFQS

SEQ ID NO: 1309740 - protein, 9 aa, Homo Sapiens
LDPEDKCRM

SEQ ID NO: 1309741 - protein, 9 aa, Homo Sapiens
RFEKNGQGA

SEQ ID NO: 1309742 - protein, 9 aa, Homo Sapiens
LCFPPTKRG

SEQ ID NO: 1309743 - protein, 9 aa, Homo Sapiens
LSLHIYYKK

SEQ ID NO: 1309744 - protein, 9 aa, Homo Sapiens
EQTVFSFLK

SEQ ID NO: 1309745 - protein, 9 aa, Homo Sapiens
HKQYINGLK

SEQ ID NO: 1309746 - protein, 9 aa, Homo Sapiens
VIAEKKLFT

SEQ ID NO: 1309747 - protein, 9 aa, Homo Sapiens
SIKDYFQKV

SEQ ID NO: 1309748 - protein, 9 aa, Homo Sapiens
KESYFDAVF

SEQ ID NO: 1309749 - protein, 9 aa, Homo Sapiens
HTEMEFSLF

SEQ ID NO: 1309750 - protein, 9 aa, Homo Sapiens
HDGEYRFIL

SEQ ID NO: 1309751 - protein, 9 aa, Homo Sapiens
PFRPRPHQQ

SEQ ID NO: 1309752 - protein, 9 aa, Homo Sapiens
NLVHPSCHG

SEQ ID NO: 1309753 - protein, 9 aa, Homo Sapiens
CVEDLRMLD

SEQ ID NO: 1309754 - protein, 9 aa, Homo Sapiens
ELYELCDEL

SEQ ID NO: 1309755 - protein, 9 aa, Homo Sapiens
NCTCTCQGI

SEQ ID NO: 1309756 - protein, 9 aa, Homo Sapiens
KYIWLAANN

SEQ ID NO: 1309757 - protein, 9 aa, Homo Sapiens
LDTSWVGWG

SEQ ID NO: 1309758 - protein, 9 aa, Homo Sapiens
SFWSRVLPS

SEQ ID NO: 1309759 - protein, 9 aa, Homo Sapiens
SRYFLLKLS

SEQ ID NO: 1309760 - protein, 9 aa, Homo Sapiens
HHSSLRYSP

SEQ ID NO: 1309761 - protein, 9 aa, Homo Sapiens
NVKQIIARS

SEQ ID NO: 1309762 - protein, 9 aa, Homo Sapiens
YENTIEYDC

SEQ ID NO: 1309763 - protein, 9 aa, Homo Sapiens
LQSCSTVHE

SEQ ID NO: 1309764 - protein, 9 aa, Homo Sapiens
AGIRINVTT

SEQ ID NO: 1309765 - protein, 9 aa, Homo Sapiens
ACLAILSLH

SEQ ID NO: 1309766 - protein, 9 aa, Homo Sapiens
RPYECVQCG

SEQ ID NO: 1309767 - protein, 9 aa, Homo Sapiens
EEFIRVRKE

SEQ ID NO: 1309768 - protein, 9 aa, Homo Sapiens
RYTNAIQWM

SEQ ID NO: 1309769 - protein, 9 aa, Homo Sapiens
EVEVVSHIR

SEQ ID NO: 1309770 - protein, 9 aa, Homo Sapiens
TFVQDFSNC

SEQ ID NO: 1309771 - protein, 9 aa, Homo Sapiens
GSPTSVTVM

SEQ ID NO: 1309772 - protein, 9 aa, Homo Sapiens
MDIAHLSCS

SEQ ID NO: 1309773 - protein, 9 aa, Homo Sapiens
PSMFIVLRE

SEQ ID NO: 1309774 - protein, 9 aa, Homo Sapiens
ENMGSHYIV

SEQ ID NO: 1309775 - protein, 9 aa, Homo Sapiens
DCIFLKKTF

SEQ ID NO: 1309776 - protein, 9 aa, Homo Sapiens
ALTQKNQLI

SEQ ID NO: 1309777 - protein, 9 aa, Homo Sapiens
LNQGKVAER

SEQ ID NO: 1309778 - protein, 9 aa, Homo Sapiens
YEHKQYING

SEQ ID NO: 1309779 - protein, 9 aa, Homo Sapiens
KEQTVFSFL

SEQ ID NO: 1309780 - protein, 9 aa, Homo Sapiens
IKVQLRPLA

SEQ ID NO: 1309781 - protein, 9 aa, Homo Sapiens
MYFFYKNTM

SEQ ID NO: 1309782 - protein, 9 aa, Homo Sapiens
APVSKSSTF

SEQ ID NO: 1309783 - protein, 9 aa, Homo Sapiens
RNKLCELLA

SEQ ID NO: 1309784 - protein, 9 aa, Homo Sapiens
YPRTVRKLS

SEQ ID NO: 1309785 - protein, 9 aa, Homo Sapiens
ATLISNTCL

SEQ ID NO: 1309786 - protein, 9 aa, Homo Sapiens
IHESKNRAL

SEQ ID NO: 1309787 - protein, 9 aa, Homo Sapiens
GDKPYRCCE

SEQ ID NO: 1309788 - protein, 9 aa, Homo Sapiens
EKEHRPKDK

SEQ ID NO: 1309789 - protein, 9 aa, Homo Sapiens
DQLEELDKI

SEQ ID NO: 1309790 - protein, 9 aa, Homo Sapiens
YFDPFDPSH

SEQ ID NO: 1309791 - protein, 9 aa, Homo Sapiens
KSIITAGFE

SEQ ID NO: 1309792 - protein, 9 aa, Homo Sapiens
LTTTSEIII

SEQ ID NO: 1309793 - protein, 9 aa, Homo Sapiens
ALTNLNGKM

SEQ ID NO: 1309794 - protein, 9 aa, Homo Sapiens
LLNSLLDTM

SEQ ID NO: 1309795 - protein, 9 aa, Homo Sapiens
KHYEMLANQ

SEQ ID NO: 1309796 - protein, 9 aa, Homo Sapiens
RYAGKYSDA

SEQ ID NO: 1309797 - protein, 9 aa, Homo Sapiens
RNVKKLAVA

SEQ ID NO: 1309798 - protein, 9 aa, Homo Sapiens
SITNKFCCE

SEQ ID NO: 1309799 - protein, 9 aa, Homo Sapiens
VAITICEKI

SEQ ID NO: 1309800 - protein, 9 aa, Homo Sapiens
EVVTGLHPN

SEQ ID NO: 1309801 - protein, 9 aa, Homo Sapiens
NSEGKFDKD

SEQ ID NO: 1309802 - protein, 9 aa, Homo Sapiens
QKSSTSGSD

SEQ ID NO: 1309803 - protein, 9 aa, Homo Sapiens
IGGLVWALP

SEQ ID NO: 1309804 - protein, 9 aa, Homo Sapiens
TVKTLVNLK

SEQ ID NO: 1309805 - protein, 9 aa, Homo Sapiens
FRDKMAGEG

SEQ ID NO: 1309806 - protein, 9 aa, Homo Sapiens
IQLGDKPYR

SEQ ID NO: 1309807 - protein, 9 aa, Homo Sapiens
FKKGEIFQI

SEQ ID NO: 1309808 - protein, 9 aa, Homo Sapiens
RRSRANQNI

SEQ ID NO: 1309809 - protein, 9 aa, Homo Sapiens
VQFQNQGSE

SEQ ID NO: 1309810 - protein, 9 aa, Homo Sapiens
YTKGNFWMI

SEQ ID NO: 1309811 - protein, 9 aa, Homo Sapiens
RALVMYLWL

SEQ ID NO: 1309812 - protein, 9 aa, Homo Sapiens
RIILNGKDK

SEQ ID NO: 1309813 - protein, 9 aa, Homo Sapiens
ELIEFLSKA

SEQ ID NO: 1309814 - protein, 9 aa, Homo Sapiens
MKEDSDEKG

SEQ ID NO: 1309815 - protein, 9 aa, Homo Sapiens
LLSIIKSEC

SEQ ID NO: 1309816 - protein, 9 aa, Homo Sapiens
TDYGFHFAG

SEQ ID NO: 1309817 - protein, 9 aa, Homo Sapiens
EVPFRYNEL

SEQ ID NO: 1309818 - protein, 9 aa, Homo Sapiens
EPGNGAKYL

SEQ ID NO: 1309819 - protein, 9 aa, Homo Sapiens
SSVSVGLPV

SEQ ID NO: 1309820 - protein, 9 aa, Homo Sapiens
AIEGNYLGQ

SEQ ID NO: 1309821 - protein, 9 aa, Homo Sapiens
FSSLEDNLL

SEQ ID NO: 1309822 - protein, 9 aa, Homo Sapiens
ERFHMVKQK

SEQ ID NO: 1309823 - protein, 9 aa, Homo Sapiens
YSDKIEHVG

SEQ ID NO: 1309824 - protein, 9 aa, Homo Sapiens
EQQTQRNVI

SEQ ID NO: 1309825 - protein, 9 aa, Homo Sapiens
LYGKDYSQR

SEQ ID NO: 1309826 - protein, 9 aa, Homo Sapiens
KKTAKSKKN

SEQ ID NO: 1309827 - protein, 9 aa, Homo Sapiens
CLRDASFKS

SEQ ID NO: 1309828 - protein, 9 aa, Homo Sapiens
ICDTNFITY

SEQ ID NO: 1309829 - protein, 9 aa, Homo Sapiens
NKYLMWFDK

SEQ ID NO: 1309830 - protein, 9 aa, Homo Sapiens
NIGLTKLNC

SEQ ID NO: 1309831 - protein, 9 aa, Homo Sapiens
LGGRESYMS

SEQ ID NO: 1309832 - protein, 9 aa, Homo Sapiens
LANMVMYFF

SEQ ID NO: 1309833 - protein, 9 aa, Homo Sapiens
IGSGKLSLS

SEQ ID NO: 1309834 - protein, 9 aa, Homo Sapiens
IHCKAGKGG

SEQ ID NO: 1309835 - protein, 9 aa, Homo Sapiens
YFDKLSLYS

SEQ ID NO: 1309836 - protein, 9 aa, Homo Sapiens
LFVSGKTLF

SEQ ID NO: 1309837 - protein, 9 aa, Homo Sapiens
SMSETIQYN

SEQ ID NO: 1309838 - protein, 9 aa, Homo Sapiens
QIGTNKKKL

SEQ ID NO: 1309839 - protein, 9 aa, Homo Sapiens
FVYTKGNFW

SEQ ID NO: 1309840 - protein, 9 aa, Homo Sapiens
PKSTEAVQG

SEQ ID NO: 1309841 - protein, 9 aa, Homo Sapiens
TVQPGCYLP

SEQ ID NO: 1309842 - protein, 9 aa, Homo Sapiens
EKYNDATQV

SEQ ID NO: 1309843 - protein, 9 aa, Homo Sapiens
SPRRANHWS

SEQ ID NO: 1309844 - protein, 9 aa, Homo Sapiens
DRKANPFFQ

SEQ ID NO: 1309845 - protein, 9 aa, Homo Sapiens
HEVGWKYQT

SEQ ID NO: 1309846 - protein, 9 aa, Homo Sapiens
ITSAISEIQ

SEQ ID NO: 1309847 - protein, 9 aa, Homo Sapiens
ELLDIRHEL

SEQ ID NO: 1309848 - protein, 9 aa, Homo Sapiens
LGVEVLEHL

SEQ ID NO: 1309849 - protein, 9 aa, Homo Sapiens
NLSILAETA

SEQ ID NO: 1309850 - protein, 9 aa, Homo Sapiens
YRGLASRGD

SEQ ID NO: 1309851 - protein, 9 aa, Homo Sapiens
GRSTNYVFK

SEQ ID NO: 1309852 - protein, 9 aa, Homo Sapiens
MIHQINHII

SEQ ID NO: 1309853 - protein, 9 aa, Homo Sapiens
LEPGPENTP

SEQ ID NO: 1309854 - protein, 9 aa, Homo Sapiens
INDNTPELL

SEQ ID NO: 1309855 - protein, 9 aa, Homo Sapiens
DKSLHTWVA

SEQ ID NO: 1309856 - protein, 9 aa, Homo Sapiens
ANEFISIIN

SEQ ID NO: 1309857 - protein, 9 aa, Homo Sapiens
MFQSWSGPD

SEQ ID NO: 1309858 - protein, 9 aa, Homo Sapiens
EWMAQYLEN

SEQ ID NO: 1309859 - protein, 9 aa, Homo Sapiens
KNRWPNYAA

SEQ ID NO: 1309860 - protein, 9 aa, Homo Sapiens
PVDIKKINY

SEQ ID NO: 1309861 - protein, 9 aa, Homo Sapiens
VSRGGIGLT

SEQ ID NO: 1309862 - protein, 9 aa, Homo Sapiens
SLLDSEDHN

SEQ ID NO: 1309863 - protein, 9 aa, Homo Sapiens
YYKVNNLGV

SEQ ID NO: 1309864 - protein, 9 aa, Homo Sapiens
GINANKTDP

SEQ ID NO: 1309865 - protein, 9 aa, Homo Sapiens
FSEYVYKVV

SEQ ID NO: 1309866 - protein, 9 aa, Homo Sapiens
TGVDYITVD

SEQ ID NO: 1309867 - protein, 9 aa, Homo Sapiens
SSDPSNQKI

SEQ ID NO: 1309868 - protein, 9 aa, Homo Sapiens
KTAKSKKNK

SEQ ID NO: 1309869 - protein, 9 aa, Homo Sapiens
DKPLEGNTC

SEQ ID NO: 1309870 - protein, 9 aa, Homo Sapiens
LSKVQGWKQ

SEQ ID NO: 1309871 - protein, 9 aa, Homo Sapiens
ENNIRRDIK

SEQ ID NO: 1309872 - protein, 9 aa, Homo Sapiens
GQLKIHGKN

SEQ ID NO: 1309873 - protein, 9 aa, Homo Sapiens
LIIFYRGSG

SEQ ID NO: 1309874 - protein, 9 aa, Homo Sapiens
KKGVEHDKI

SEQ ID NO: 1309875 - protein, 9 aa, Homo Sapiens
KGFNLPSFI

SEQ ID NO: 1309876 - protein, 9 aa, Homo Sapiens
ALIAYLKKA

SEQ ID NO: 1309877 - protein, 9 aa, Homo Sapiens
VVTCKTFEE

SEQ ID NO: 1309878 - protein, 9 aa, Homo Sapiens
PFPANIDIC

SEQ ID NO: 1309879 - protein, 9 aa, Homo Sapiens
SSSLQIHER

SEQ ID NO: 1309880 - protein, 9 aa, Homo Sapiens
ERIDRPFPV

SEQ ID NO: 1309881 - protein, 9 aa, Homo Sapiens
LTSSKLLYI

SEQ ID NO: 1309882 - protein, 9 aa, Homo Sapiens
VSKLSEYQD

SEQ ID NO: 1309883 - protein, 9 aa, Homo Sapiens
DPSNQKIVF

SEQ ID NO: 1309884 - protein, 9 aa, Homo Sapiens
ARPPQEEHL

SEQ ID NO: 1309885 - protein, 9 aa, Homo Sapiens
PPPISRLGA

SEQ ID NO: 1309886 - protein, 9 aa, Homo Sapiens
ESYFDAVFL

SEQ ID NO: 1309887 - protein, 9 aa, Homo Sapiens
HEEKILNRE

SEQ ID NO: 1309888 - protein, 9 aa, Homo Sapiens
IDVSSCQYI

SEQ ID NO: 1309889 - protein, 9 aa, Homo Sapiens
PQALAATHA

SEQ ID NO: 1309890 - protein, 9 aa, Homo Sapiens
TPQGNYFEY

SEQ ID NO: 1309891 - protein, 9 aa, Homo Sapiens
ESYMSTLLA

SEQ ID NO: 1309892 - protein, 9 aa, Homo Sapiens
EELQEKYKE

SEQ ID NO: 1309893 - protein, 9 aa, Homo Sapiens
TQHKIFHIT

SEQ ID NO: 1309894 - protein, 9 aa, Homo Sapiens
SSSFRMHEI

SEQ ID NO: 1309895 - protein, 9 aa, Homo Sapiens
SFQTHMIMH

SEQ ID NO: 1309896 - protein, 9 aa, Homo Sapiens
VCLTFKQSS

SEQ ID NO: 1309897 - protein, 9 aa, Homo Sapiens
CVIGLMMTA

SEQ ID NO: 1309898 - protein, 9 aa, Homo Sapiens
MRILDLPQN

SEQ ID NO: 1309899 - protein, 9 aa, Homo Sapiens
SERSYLSSF

SEQ ID NO: 1309900 - protein, 9 aa, Homo Sapiens
HNGRQRLIK

SEQ ID NO: 1309901 - protein, 9 aa, Homo Sapiens
MVSDFKINF

SEQ ID NO: 1309902 - protein, 9 aa, Homo Sapiens
SGEIRTIFY

SEQ ID NO: 1309903 - protein, 9 aa, Homo Sapiens
PGIKYEHTI

SEQ ID NO: 1309904 - protein, 9 aa, Homo Sapiens
LNYQNKALK

SEQ ID NO: 1309905 - protein, 9 aa, Homo Sapiens
RRNFICTVY

SEQ ID NO: 1309906 - protein, 9 aa, Homo Sapiens
CNVLPIIKG

SEQ ID NO: 1309907 - protein, 9 aa, Homo Sapiens
LQNHWKKTT

SEQ ID NO: 1309908 - protein, 9 aa, Homo Sapiens
SLLVSTDKG

SEQ ID NO: 1309909 - protein, 9 aa, Homo Sapiens
HYMQWPDMG

SEQ ID NO: 1309910 - protein, 9 aa, Homo Sapiens
FLGMCLEFE

SEQ ID NO: 1309911 - protein, 9 aa, Homo Sapiens
PMCRYDRLS

SEQ ID NO: 1309912 - protein, 9 aa, Homo Sapiens
EQKMAKEDP

SEQ ID NO: 1309913 - protein, 9 aa, Homo Sapiens
PQAGIRINV

SEQ ID NO: 1309914 - protein, 9 aa, Homo Sapiens
EPQALAATH

SEQ ID NO: 1309915 - protein, 9 aa, Homo Sapiens
TISKTPSTP

SEQ ID NO: 1309916 - protein, 9 aa, Homo Sapiens
DDLEALGNM

SEQ ID NO: 1309917 - protein, 9 aa, Homo Sapiens
HHQIHTGEK

SEQ ID NO: 1309918 - protein, 9 aa, Homo Sapiens
YSSFVNLFC

SEQ ID NO: 1309919 - protein, 9 aa, Homo Sapiens
LQINPLCNL

SEQ ID NO: 1309920 - protein, 9 aa, Homo Sapiens
DVFFVNSLC

SEQ ID NO: 1309921 - protein, 9 aa, Homo Sapiens
TELQDKLSH

SEQ ID NO: 1309922 - protein, 9 aa, Homo Sapiens
LGVLPKTFQ

SEQ ID NO: 1309923 - protein, 9 aa, Homo Sapiens
YLFQTFLER

SEQ ID NO: 1309924 - protein, 9 aa, Homo Sapiens
LYSLISLFI

SEQ ID NO: 1309925 - protein, 9 aa, Homo Sapiens
EMTTIHYDI

SEQ ID NO: 1309926 - protein, 9 aa, Homo Sapiens
NHQIIHSRE

SEQ ID NO: 1309927 - protein, 9 aa, Homo Sapiens
IVPPPPDDD

SEQ ID NO: 1309928 - protein, 9 aa, Homo Sapiens
EANKRAEDD

SEQ ID NO: 1309929 - protein, 9 aa, Homo Sapiens
TILVLSYFW

SEQ ID NO: 1309930 - protein, 9 aa, Homo Sapiens
VNLKLWAID

SEQ ID NO: 1309931 - protein, 9 aa, Homo Sapiens
NTPELLPKE

SEQ ID NO: 1309932 - protein, 9 aa, Homo Sapiens
RLRIWSDYV

SEQ ID NO: 1309933 - protein, 9 aa, Homo Sapiens
PKVHKRIHT

SEQ ID NO: 1309934 - protein, 9 aa, Homo Sapiens
SNTSRHNLE

SEQ ID NO: 1309935 - protein, 9 aa, Homo Sapiens
ELSPHKYFS

SEQ ID NO: 1309936 - protein, 9 aa, Homo Sapiens
PKGNPRVPD

SEQ ID NO: 1309937 - protein, 9 aa, Homo Sapiens
SSLRYSPSG

SEQ ID NO: 1309938 - protein, 9 aa, Homo Sapiens
INTQMFQPM

SEQ ID NO: 1309939 - protein, 9 aa, Homo Sapiens
SFDKSLHTW

SEQ ID NO: 1309940 - protein, 9 aa, Homo Sapiens
MGLGVEVLE

SEQ ID NO: 1309941 - protein, 9 aa, Homo Sapiens
FWCTFEGCG

SEQ ID NO: 1309942 - protein, 9 aa, Homo Sapiens
IKTYSLSFD

SEQ ID NO: 1309943 - protein, 9 aa, Homo Sapiens
SSNIISYFL

SEQ ID NO: 1309944 - protein, 9 aa, Homo Sapiens
QTGAWRHGR

SEQ ID NO: 1309945 - protein, 9 aa, Homo Sapiens
TLHSLKKDY

SEQ ID NO: 1309946 - protein, 9 aa, Homo Sapiens
EMNGEECVE

SEQ ID NO: 1309947 - protein, 9 aa, Homo Sapiens
FKLICDASS

SEQ ID NO: 1309948 - protein, 9 aa, Homo Sapiens
SVVPKNNEM

SEQ ID NO: 1309949 - protein, 9 aa, Homo Sapiens
PLIVDAICT

SEQ ID NO: 1309950 - protein, 9 aa, Homo Sapiens
NLWKENVII

SEQ ID NO: 1309951 - protein, 9 aa, Homo Sapiens
LRENKYLED

SEQ ID NO: 1309952 - protein, 9 aa, Homo Sapiens
YKGKITPQL

SEQ ID NO: 1309953 - protein, 9 aa, Homo Sapiens
ECRAEAEDG

SEQ ID NO: 1309954 - protein, 9 aa, Homo Sapiens
ICGLTLIHR

SEQ ID NO: 1309955 - protein, 9 aa, Homo Sapiens
KMQLNMQEE

SEQ ID NO: 1309956 - protein, 9 aa, Homo Sapiens
NQTEDIRDV

SEQ ID NO: 1309957 - protein, 9 aa, Homo Sapiens
SKGLIGMHR

SEQ ID NO: 1309958 - protein, 9 aa, Homo Sapiens
LIRLLLYLQ

SEQ ID NO: 1309959 - protein, 9 aa, Homo Sapiens
QKPNARIVV

SEQ ID NO: 1309960 - protein, 9 aa, Homo Sapiens
RGDKDPKGG

SEQ ID NO: 1309961 - protein, 9 aa, Homo Sapiens
SFQLCVYVH

SEQ ID NO: 1309962 - protein, 9 aa, Homo Sapiens
DQIISQVVD

SEQ ID NO: 1309963 - protein, 9 aa, Homo Sapiens
CSICKICIR

SEQ ID NO: 1309964 - protein, 9 aa, Homo Sapiens
NDEPCKEII

SEQ ID NO: 1309965 - protein, 9 aa, Homo Sapiens
SIIKSECSL

SEQ ID NO: 1309966 - protein, 9 aa, Homo Sapiens
SEDHNTCEG

SEQ ID NO: 1309967 - protein, 9 aa, Homo Sapiens
EHLQIHSGE

SEQ ID NO: 1309968 - protein, 9 aa, Homo Sapiens
YGIVVAMFI

SEQ ID NO: 1309969 - protein, 9 aa, Homo Sapiens
KDEGSEVER

SEQ ID NO: 1309970 - protein, 9 aa, Homo Sapiens
ATTAQIRDT

SEQ ID NO: 1309971 - protein, 9 aa, Homo Sapiens
IINPDAFIA

SEQ ID NO: 1309972 - protein, 9 aa, Homo Sapiens
ITLLPIPTV

SEQ ID NO: 1309973 - protein, 9 aa, Homo Sapiens
GERPFKCIE

SEQ ID NO: 1309974 - protein, 9 aa, Homo Sapiens
VFSGLEEQA

SEQ ID NO: 1309975 - protein, 9 aa, Homo Sapiens
QQYEVNQSN

SEQ ID NO: 1309976 - protein, 9 aa, Homo Sapiens
VSGEIRTIF

SEQ ID NO: 1309977 - protein, 9 aa, Homo Sapiens
LEQKMAKED

SEQ ID NO: 1309978 - protein, 9 aa, Homo Sapiens
QQKILCSKT

SEQ ID NO: 1309979 - protein, 9 aa, Homo Sapiens
SMVYEWRTG

SEQ ID NO: 1309980 - protein, 9 aa, Homo Sapiens
WFEAHVDKC

SEQ ID NO: 1309981 - protein, 9 aa, Homo Sapiens
QQIINQIST

SEQ ID NO: 1309982 - protein, 9 aa, Homo Sapiens
GQPLHTKLN

SEQ ID NO: 1309983 - protein, 9 aa, Homo Sapiens
YVILADLLP

SEQ ID NO: 1309984 - protein, 9 aa, Homo Sapiens
TLSFLLFWT

SEQ ID NO: 1309985 - protein, 9 aa, Homo Sapiens
RSLPPLPPA

SEQ ID NO: 1309986 - protein, 9 aa, Homo Sapiens
NKCVSCQNL

SEQ ID NO: 1309987 - protein, 9 aa, Homo Sapiens
NSQQTILDR

SEQ ID NO: 1309988 - protein, 9 aa, Homo Sapiens
EETSAIQVG

SEQ ID NO: 1309989 - protein, 9 aa, Homo Sapiens
FYATPVTAP

SEQ ID NO: 1309990 - protein, 9 aa, Homo Sapiens
SQVQRYTNA

SEQ ID NO: 1309991 - protein, 9 aa, Homo Sapiens
YSWFQDEED

SEQ ID NO: 1309992 - protein, 9 aa, Homo Sapiens
KRGNSMVYE

SEQ ID NO: 1309993 - protein, 9 aa, Homo Sapiens
GVGREVGWI

SEQ ID NO: 1309994 - protein, 9 aa, Homo Sapiens
IMKDIQKNT

SEQ ID NO: 1309995 - protein, 9 aa, Homo Sapiens
WTGSITNKF

SEQ ID NO: 1309996 - protein, 9 aa, Homo Sapiens
KMNTKAGVA

SEQ ID NO: 1309997 - protein, 9 aa, Homo Sapiens
YPNSEVIYV

SEQ ID NO: 1309998 - protein, 9 aa, Homo Sapiens
VQTAIEGNY

SEQ ID NO: 1309999 - protein, 9 aa, Homo Sapiens
GIVHWKPSD

SEQ ID NO: 1310000 - protein, 9 aa, Homo Sapiens
ANIDICDTV

SEQ ID NO: 1310001 - protein, 9 aa, Homo Sapiens
QRYTNAIQW

SEQ ID NO: 1310002 - protein, 9 aa, Homo Sapiens
QQLLNQIQR

SEQ ID NO: 1310003 - protein, 9 aa, Homo Sapiens
AENEVNETL

SEQ ID NO: 1310004 - protein, 9 aa, Homo Sapiens
KAQGRIYGT

SEQ ID NO: 1310005 - protein, 9 aa, Homo Sapiens
SKMLGIFWF

SEQ ID NO: 1310006 - protein, 9 aa, Homo Sapiens
ASDQATTAQ

SEQ ID NO: 1310007 - protein, 9 aa, Homo Sapiens
YSRLANMVM

SEQ ID NO: 1310008 - protein, 9 aa, Homo Sapiens
YATPVTAPS

SEQ ID NO: 1310009 - protein, 9 aa, Homo Sapiens
PDKPKQESQ

SEQ ID NO: 1310010 - protein, 9 aa, Homo Sapiens
GDVKINAHK

SEQ ID NO: 1310011 - protein, 9 aa, Homo Sapiens
LNQIQRHHT

SEQ ID NO: 1310012 - protein, 9 aa, Homo Sapiens
DRRRRATPH

SEQ ID NO: 1310013 - protein, 9 aa, Homo Sapiens
PISFKTYLS

SEQ ID NO: 1310014 - protein, 9 aa, Homo Sapiens
NYLETLRFS

SEQ ID NO: 1310015 - protein, 9 aa, Homo Sapiens
VEIINSTNR

SEQ ID NO: 1310016 - protein, 9 aa, Homo Sapiens
KELEEMEIH

SEQ ID NO: 1310017 - protein, 9 aa, Homo Sapiens
PKNNEMKKS

SEQ ID NO: 1310018 - protein, 9 aa, Homo Sapiens
LGLAFIYNQ

SEQ ID NO: 1310019 - protein, 9 aa, Homo Sapiens
SNPSMEEKL

SEQ ID NO: 1310020 - protein, 9 aa, Homo Sapiens
EGKCVEEIL

SEQ ID NO: 1310021 - protein, 9 aa, Homo Sapiens
DKYKVYEEQ

SEQ ID NO: 1310022 - protein, 9 aa, Homo Sapiens
EEILEIFDM

SEQ ID NO: 1310023 - protein, 9 aa, Homo Sapiens
PELSPHKYF

SEQ ID NO: 1310024 - protein, 9 aa, Homo Sapiens
LSGFILFTT

SEQ ID NO: 1310025 - protein, 9 aa, Homo Sapiens
KEEDTNSER

SEQ ID NO: 1310026 - protein, 9 aa, Homo Sapiens
IKARPPQEE

SEQ ID NO: 1310027 - protein, 9 aa, Homo Sapiens
GKERVKGRL

SEQ ID NO: 1310028 - protein, 9 aa, Homo Sapiens
LSPSNNSSR

SEQ ID NO: 1310029 - protein, 9 aa, Homo Sapiens
FKQNRKRDP

SEQ ID NO: 1310030 - protein, 9 aa, Homo Sapiens
EQLYDRSLG

SEQ ID NO: 1310031 - protein, 9 aa, Homo Sapiens
GNLKIKWDN

SEQ ID NO: 1310032 - protein, 9 aa, Homo Sapiens
QQTILDRYY

SEQ ID NO: 1310033 - protein, 9 aa, Homo Sapiens
KTWVHYISA

SEQ ID NO: 1310034 - protein, 9 aa, Homo Sapiens
GASLLCNAI

SEQ ID NO: 1310035 - protein, 9 aa, Homo Sapiens
IIIHQLQMN

SEQ ID NO: 1310036 - protein, 9 aa, Homo Sapiens
GMDRIVRQE

SEQ ID NO: 1310037 - protein, 9 aa, Homo Sapiens
PHKYFSTLQ

SEQ ID NO: 1310038 - protein, 9 aa, Homo Sapiens
ITIHKKTNL

SEQ ID NO: 1310039 - protein, 9 aa, Homo Sapiens
LLTMIIFLG

SEQ ID NO: 1310040 - protein, 9 aa, Homo Sapiens
KLEGISPSV

SEQ ID NO: 1310041 - protein, 9 aa, Homo Sapiens
RDKAFIHKS

SEQ ID NO: 1310042 - protein, 9 aa, Homo Sapiens
LKHIHQFGI

SEQ ID NO: 1310043 - protein, 9 aa, Homo Sapiens
FLLFWTLPG

SEQ ID NO: 1310044 - protein, 9 aa, Homo Sapiens
FIFYSLCAH

SEQ ID NO: 1310045 - protein, 9 aa, Homo Sapiens
HDKIKSTLR

SEQ ID NO: 1310046 - protein, 9 aa, Homo Sapiens
TGSITNKFC

SEQ ID NO: 1310047 - protein, 9 aa, Homo Sapiens
CPIPQWIRM

SEQ ID NO: 1310048 - protein, 9 aa, Homo Sapiens
GDKDDWASN

SEQ ID NO: 1310049 - protein, 9 aa, Homo Sapiens
RFCFDDSLP

SEQ ID NO: 1310050 - protein, 9 aa, Homo Sapiens
DRKLFQVWK

SEQ ID NO: 1310051 - protein, 9 aa, Homo Sapiens
MTDKRYISV

SEQ ID NO: 1310052 - protein, 9 aa, Homo Sapiens
KKTFNIPVI

SEQ ID NO: 1310053 - protein, 9 aa, Homo Sapiens
IPEKTSCCA

SEQ ID NO: 1310054 - protein, 9 aa, Homo Sapiens
FLNGIEWII

SEQ ID NO: 1310055 - protein, 9 aa, Homo Sapiens
RYLIKFVSK

SEQ ID NO: 1310056 - protein, 9 aa, Homo Sapiens
SYLKEQGQV

SEQ ID NO: 1310057 - protein, 9 aa, Homo Sapiens
LQPLPSSNL

SEQ ID NO: 1310058 - protein, 9 aa, Homo Sapiens
KLSLSGGYW

SEQ ID NO: 1310059 - protein, 9 aa, Homo Sapiens
TVRCWIIRD

SEQ ID NO: 1310060 - protein, 9 aa, Homo Sapiens
AAQVAGICY

SEQ ID NO: 1310061 - protein, 9 aa, Homo Sapiens
FQVSGSQVE

SEQ ID NO: 1310062 - protein, 9 aa, Homo Sapiens
IILNISADC

SEQ ID NO: 1310063 - protein, 9 aa, Homo Sapiens
LGAASMPSS

SEQ ID NO: 1310064 - protein, 9 aa, Homo Sapiens
QQLQQNKED

SEQ ID NO: 1310065 - protein, 9 aa, Homo Sapiens
ELRAKEDKV

SEQ ID NO: 1310066 - protein, 9 aa, Homo Sapiens
KLFLVRKIS

SEQ ID NO: 1310067 - protein, 9 aa, Homo Sapiens
RFSLAAFKI

SEQ ID NO: 1310068 - protein, 9 aa, Homo Sapiens
IDMQLNHDG

SEQ ID NO: 1310069 - protein, 9 aa, Homo Sapiens
FEIQINEIV

SEQ ID NO: 1310070 - protein, 9 aa, Homo Sapiens
KKYGVQPWQ

SEQ ID NO: 1310071 - protein, 9 aa, Homo Sapiens
TCLVTAAHC

SEQ ID NO: 1310072 - protein, 9 aa, Homo Sapiens
HLQIHSGEK

SEQ ID NO: 1310073 - protein, 9 aa, Homo Sapiens
DTINGKLEE

SEQ ID NO: 1310074 - protein, 9 aa, Homo Sapiens
QMTEKEHGN

SEQ ID NO: 1310075 - protein, 9 aa, Homo Sapiens
KTLDKFTII

SEQ ID NO: 1310076 - protein, 9 aa, Homo Sapiens
KTNLCKRQC

SEQ ID NO: 1310077 - protein, 9 aa, Homo Sapiens
QREFHMQHP

SEQ ID NO: 1310078 - protein, 9 aa, Homo Sapiens
NNSSRRNQN

SEQ ID NO: 1310079 - protein, 9 aa, Homo Sapiens
HATILAVSK

SEQ ID NO: 1310080 - protein, 9 aa, Homo Sapiens
KYNDATQVR

SEQ ID NO: 1310081 - protein, 9 aa, Homo Sapiens
YPQKITVAV

SEQ ID NO: 1310082 - protein, 9 aa, Homo Sapiens
VMLKGRPCK

SEQ ID NO: 1310083 - protein, 9 aa, Homo Sapiens
YFRCLGLHL

SEQ ID NO: 1310084 - protein, 9 aa, Homo Sapiens
HSESPDKPL

SEQ ID NO: 1310085 - protein, 9 aa, Homo Sapiens
MVEAAKKNI

SEQ ID NO: 1310086 - protein, 9 aa, Homo Sapiens
YQFTSRKPI

SEQ ID NO: 1310087 - protein, 9 aa, Homo Sapiens
FQYGYSYYN

SEQ ID NO: 1310088 - protein, 9 aa, Homo Sapiens
DLINYFAIA

SEQ ID NO: 1310089 - protein, 9 aa, Homo Sapiens
ACKYNGKYE

SEQ ID NO: 1310090 - protein, 9 aa, Homo Sapiens
GHTINKSTS

SEQ ID NO: 1310091 - protein, 9 aa, Homo Sapiens
CLPKSSPNK

SEQ ID NO: 1310092 - protein, 9 aa, Homo Sapiens
MGITQLRFK

SEQ ID NO: 1310093 - protein, 9 aa, Homo Sapiens
HSTFINHQI

SEQ ID NO: 1310094 - protein, 9 aa, Homo Sapiens
RMLKVIHDC

SEQ ID NO: 1310095 - protein, 9 aa, Homo Sapiens
AEDQLIKIN

SEQ ID NO: 1310096 - protein, 9 aa, Homo Sapiens
NGCHSGEIF

SEQ ID NO: 1310097 - protein, 9 aa, Homo Sapiens
QVQPHFTSE

SEQ ID NO: 1310098 - protein, 9 aa, Homo Sapiens
DKSKNPNFK

SEQ ID NO: 1310099 - protein, 9 aa, Homo Sapiens
SSSLIQHQQ

SEQ ID NO: 1310100 - protein, 9 aa, Homo Sapiens
VEYLKESYF

SEQ ID NO: 1310101 - protein, 9 aa, Homo Sapiens
YYYFILITM

SEQ ID NO: 1310102 - protein, 9 aa, Homo Sapiens
KPRMSSDAN

SEQ ID NO: 1310103 - protein, 9 aa, Homo Sapiens
QKCQKCRWR

SEQ ID NO: 1310104 - protein, 9 aa, Homo Sapiens
SLISLFIYM

SEQ ID NO: 1310105 - protein, 9 aa, Homo Sapiens
GQKDKIPEE

SEQ ID NO: 1310106 - protein, 9 aa, Homo Sapiens
NIIQRLFAR

SEQ ID NO: 1310107 - protein, 9 aa, Homo Sapiens
SFCPPFVSC

SEQ ID NO: 1310108 - protein, 9 aa, Homo Sapiens
TRYSDAQGS

SEQ ID NO: 1310109 - protein, 9 aa, Homo Sapiens
NIYGIVVAM

SEQ ID NO: 1310110 - protein, 9 aa, Homo Sapiens
SHNQLSDVG

SEQ ID NO: 1310111 - protein, 9 aa, Homo Sapiens
FNAELLEVL

SEQ ID NO: 1310112 - protein, 9 aa, Homo Sapiens
LQSIPRPEV

SEQ ID NO: 1310113 - protein, 9 aa, Homo Sapiens
IYEIQEFHV

SEQ ID NO: 1310114 - protein, 9 aa, Homo Sapiens
KEVDGLSQT

SEQ ID NO: 1310115 - protein, 9 aa, Homo Sapiens
PGSGAPLLR

SEQ ID NO: 1310116 - protein, 9 aa, Homo Sapiens
KSNINIHQK

SEQ ID NO: 1310117 - protein, 9 aa, Homo Sapiens
SSVKYKSSN

SEQ ID NO: 1310118 - protein, 9 aa, Homo Sapiens
NQGKVAERG

SEQ ID NO: 1310119 - protein, 9 aa, Homo Sapiens
HMINKIMLT

SEQ ID NO: 1310120 - protein, 9 aa, Homo Sapiens
VEWSMSKDF

SEQ ID NO: 1310121 - protein, 9 aa, Homo Sapiens
NVIILDTAK

SEQ ID NO: 1310122 - protein, 9 aa, Homo Sapiens
IDINDNTPE

SEQ ID NO: 1310123 - protein, 9 aa, Homo Sapiens
EYRGLASRG

SEQ ID NO: 1310124 - protein, 9 aa, Homo Sapiens
QNLEKMHPK

SEQ ID NO: 1310125 - protein, 9 aa, Homo Sapiens
IQRQTPRLG

SEQ ID NO: 1310126 - protein, 9 aa, Homo Sapiens
PQEEHLELL

SEQ ID NO: 1310127 - protein, 9 aa, Homo Sapiens
ELALKENDI

SEQ ID NO: 1310128 - protein, 9 aa, Homo Sapiens
ARNKFSGLE

SEQ ID NO: 1310129 - protein, 9 aa, Homo Sapiens
KEDSDEKGP

SEQ ID NO: 1310130 - protein, 9 aa, Homo Sapiens
LEVVVLSQN

SEQ ID NO: 1310131 - protein, 9 aa, Homo Sapiens
QHPISQVVC

SEQ ID NO: 1310132 - protein, 9 aa, Homo Sapiens
SMEEKLEHL

SEQ ID NO: 1310133 - protein, 9 aa, Homo Sapiens
IIMISYCLI

SEQ ID NO: 1310134 - protein, 9 aa, Homo Sapiens
NRIALTSSK

SEQ ID NO: 1310135 - protein, 9 aa, Homo Sapiens
QLFCGFSSS

SEQ ID NO: 1310136 - protein, 9 aa, Homo Sapiens
LCSKTENAR

SEQ ID NO: 1310137 - protein, 9 aa, Homo Sapiens
IILNGKDKY

SEQ ID NO: 1310138 - protein, 9 aa, Homo Sapiens
HPQEIKTYS

SEQ ID NO: 1310139 - protein, 9 aa, Homo Sapiens
SDQATTAQI

SEQ ID NO: 1310140 - protein, 9 aa, Homo Sapiens
MYKDPDYVR

SEQ ID NO: 1310141 - protein, 9 aa, Homo Sapiens
FQEVVSFSP

SEQ ID NO: 1310142 - protein, 9 aa, Homo Sapiens
TQMFQPMKN

SEQ ID NO: 1310143 - protein, 9 aa, Homo Sapiens
MNCGKSFSC

SEQ ID NO: 1310144 - protein, 9 aa, Homo Sapiens
NGPPPRVLQ

SEQ ID NO: 1310145 - protein, 9 aa, Homo Sapiens
FVSKLSEYQ

SEQ ID NO: 1310146 - protein, 9 aa, Homo Sapiens
HPKDSPRRA

SEQ ID NO: 1310147 - protein, 9 aa, Homo Sapiens
KQSHKLERK

SEQ ID NO: 1310148 - protein, 9 aa, Homo Sapiens
SDYLAPRAV

SEQ ID NO: 1310149 - protein, 9 aa, Homo Sapiens
FGVLSGEFS

SEQ ID NO: 1310150 - protein, 9 aa, Homo Sapiens
PALELMVLY

SEQ ID NO: 1310151 - protein, 9 aa, Homo Sapiens
DTELIYREQ

SEQ ID NO: 1310152 - protein, 9 aa, Homo Sapiens
KNGFVMLKG

SEQ ID NO: 1310153 - protein, 9 aa, Homo Sapiens
RGSSREGVS

SEQ ID NO: 1310154 - protein, 9 aa, Homo Sapiens
SMDKMYRNV

SEQ ID NO: 1310155 - protein, 9 aa, Homo Sapiens
HVKPTNYDN

SEQ ID NO: 1310156 - protein, 9 aa, Homo Sapiens
DKIKSTLRR

SEQ ID NO: 1310157 - protein, 9 aa, Homo Sapiens
IFGDLIRFC

SEQ ID NO: 1310158 - protein, 9 aa, Homo Sapiens
KMKVLELLA

SEQ ID NO: 1310159 - protein, 9 aa, Homo Sapiens
ATVSSKMIT

SEQ ID NO: 1310160 - protein, 9 aa, Homo Sapiens
CLQPLPSSN

SEQ ID NO: 1310161 - protein, 9 aa, Homo Sapiens
NSMWKQQCG

SEQ ID NO: 1310162 - protein, 9 aa, Homo Sapiens
SFYQMHRAK

SEQ ID NO: 1310163 - protein, 9 aa, Homo Sapiens
LIRFCWLMA

SEQ ID NO: 1310164 - protein, 9 aa, Homo Sapiens
SRLNEGKLE

SEQ ID NO: 1310165 - protein, 9 aa, Homo Sapiens
ELGKNKAKL

SEQ ID NO: 1310166 - protein, 9 aa, Homo Sapiens
DVGFDGGTN

SEQ ID NO: 1310167 - protein, 9 aa, Homo Sapiens
SSDYLAPRA

SEQ ID NO: 1310168 - protein, 9 aa, Homo Sapiens
YGDKKPRKQ

SEQ ID NO: 1310169 - protein, 9 aa, Homo Sapiens
QETVIFLHL

SEQ ID NO: 1310170 - protein, 9 aa, Homo Sapiens
EAVIWEVLH

SEQ ID NO: 1310171 - protein, 9 aa, Homo Sapiens
FDEFNQIDA

SEQ ID NO: 1310172 - protein, 9 aa, Homo Sapiens
AVQGVFRSI

SEQ ID NO: 1310173 - protein, 9 aa, Homo Sapiens
FHYNNWPDH

SEQ ID NO: 1310174 - protein, 9 aa, Homo Sapiens
RMDRPSRQI

SEQ ID NO: 1310175 - protein, 9 aa, Homo Sapiens
HQTLPERNK

SEQ ID NO: 1310176 - protein, 9 aa, Homo Sapiens
LLSSTLKYK

SEQ ID NO: 1310177 - protein, 9 aa, Homo Sapiens
VTSKEICNE

SEQ ID NO: 1310178 - protein, 9 aa, Homo Sapiens
IGSPGEVGQ

SEQ ID NO: 1310179 - protein, 9 aa, Homo Sapiens
YRNVYKKAC

SEQ ID NO: 1310180 - protein, 9 aa, Homo Sapiens
IQAPSALPP

SEQ ID NO: 1310181 - protein, 9 aa, Homo Sapiens
CIIGVTQKT

SEQ ID NO: 1310182 - protein, 9 aa, Homo Sapiens
LGKERVKGR

SEQ ID NO: 1310183 - protein, 9 aa, Homo Sapiens
ITSRTNQIK

SEQ ID NO: 1310184 - protein, 9 aa, Homo Sapiens
FDRHPYGVA

SEQ ID NO: 1310185 - protein, 9 aa, Homo Sapiens
TARAAQVAG

SEQ ID NO: 1310186 - protein, 9 aa, Homo Sapiens
HNRHKLIET

SEQ ID NO: 1310187 - protein, 9 aa, Homo Sapiens
EHKIIHTGK

SEQ ID NO: 1310188 - protein, 9 aa, Homo Sapiens
FCRKSALIL

SEQ ID NO: 1310189 - protein, 9 aa, Homo Sapiens
RLSLHLYGI

SEQ ID NO: 1310190 - protein, 9 aa, Homo Sapiens
KINAHKVVL

SEQ ID NO: 1310191 - protein, 9 aa, Homo Sapiens
QTAANGHCI

SEQ ID NO: 1310192 - protein, 9 aa, Homo Sapiens
QLVVCNPNV

SEQ ID NO: 1310193 - protein, 9 aa, Homo Sapiens
EVVRAESMR

SEQ ID NO: 1310194 - protein, 9 aa, Homo Sapiens
DKLGSTQIM

SEQ ID NO: 1310195 - protein, 9 aa, Homo Sapiens
FIEGLSSTY

SEQ ID NO: 1310196 - protein, 9 aa, Homo Sapiens
EKYVNKAKR

SEQ ID NO: 1310197 - protein, 9 aa, Homo Sapiens
FQVWKVCAA

SEQ ID NO: 1310198 - protein, 9 aa, Homo Sapiens
KGSKTFTRS

SEQ ID NO: 1310199 - protein, 9 aa, Homo Sapiens
WISDTELIY

SEQ ID NO: 1310200 - protein, 9 aa, Homo Sapiens
CGITSRNII

SEQ ID NO: 1310201 - protein, 9 aa, Homo Sapiens
NPMCRYDRL

SEQ ID NO: 1310202 - protein, 9 aa, Homo Sapiens
KNPSKPIQA

SEQ ID NO: 1310203 - protein, 9 aa, Homo Sapiens
ITQKARHCG

SEQ ID NO: 1310204 - protein, 9 aa, Homo Sapiens
THQHVMEFG

SEQ ID NO: 1310205 - protein, 9 aa, Homo Sapiens
FTKVDSQPK

SEQ ID NO: 1310206 - protein, 9 aa, Homo Sapiens
YKLMSRIDK

SEQ ID NO: 1310207 - protein, 9 aa, Homo Sapiens
TPLEPGPEN

SEQ ID NO: 1310208 - protein, 9 aa, Homo Sapiens
IPGSYLEKL

SEQ ID NO: 1310209 - protein, 9 aa, Homo Sapiens
NDLRSTPNL

SEQ ID NO: 1310210 - protein, 9 aa, Homo Sapiens
PNKVPGEKP

SEQ ID NO: 1310211 - protein, 9 aa, Homo Sapiens
QKEIDTING

SEQ ID NO: 1310212 - protein, 9 aa, Homo Sapiens
PGSYVDYLS

SEQ ID NO: 1310213 - protein, 9 aa, Homo Sapiens
NQSKNCEGF

SEQ ID NO: 1310214 - protein, 9 aa, Homo Sapiens
LDPVHLCVH

SEQ ID NO: 1310215 - protein, 9 aa, Homo Sapiens
CIDNKDECP

SEQ ID NO: 1310216 - protein, 9 aa, Homo Sapiens
LDPSLFIFR

SEQ ID NO: 1310217 - protein, 9 aa, Homo Sapiens
RPKDPNNVL

SEQ ID NO: 1310218 - protein, 9 aa, Homo Sapiens
QEAEQIKPE

SEQ ID NO: 1310219 - protein, 9 aa, Homo Sapiens
EEAQKHFDC

SEQ ID NO: 1310220 - protein, 9 aa, Homo Sapiens
YQPIIKISK

SEQ ID NO: 1310221 - protein, 9 aa, Homo Sapiens
TGSGDIEKY

SEQ ID NO: 1310222 - protein, 9 aa, Homo Sapiens
NLSFDYYAF

SEQ ID NO: 1310223 - protein, 9 aa, Homo Sapiens
GFPGYPGPP

SEQ ID NO: 1310224 - protein, 9 aa, Homo Sapiens
EERNVFKLI

SEQ ID NO: 1310225 - protein, 9 aa, Homo Sapiens
LFCFNKERA

SEQ ID NO: 1310226 - protein, 9 aa, Homo Sapiens
LYGIGGLRP

SEQ ID NO: 1310227 - protein, 9 aa, Homo Sapiens
SHKIIHMEL

SEQ ID NO: 1310228 - protein, 9 aa, Homo Sapiens
VEVLEHLSP

SEQ ID NO: 1310229 - protein, 9 aa, Homo Sapiens
LRIRSELSQ

SEQ ID NO: 1310230 - protein, 9 aa, Homo Sapiens
DCKPPVCLL

SEQ ID NO: 1310231 - protein, 9 aa, Homo Sapiens
YFWKKNHKL

SEQ ID NO: 1310232 - protein, 9 aa, Homo Sapiens
VSDLIIFYR

SEQ ID NO: 1310233 - protein, 9 aa, Homo Sapiens
AVGVFSFSR

SEQ ID NO: 1310234 - protein, 9 aa, Homo Sapiens
ERLIRLRRN

SEQ ID NO: 1310235 - protein, 9 aa, Homo Sapiens
VVSCFRDKM

SEQ ID NO: 1310236 - protein, 9 aa, Homo Sapiens
SENNKEQSP

SEQ ID NO: 1310237 - protein, 9 aa, Homo Sapiens
LTLQFIYSK

SEQ ID NO: 1310238 - protein, 9 aa, Homo Sapiens
FEIRLPELT

SEQ ID NO: 1310239 - protein, 9 aa, Homo Sapiens
IYEQDELYE

SEQ ID NO: 1310240 - protein, 9 aa, Homo Sapiens
REIRLKRFI

SEQ ID NO: 1310241 - protein, 9 aa, Homo Sapiens
KFAVVKECI

SEQ ID NO: 1310242 - protein, 9 aa, Homo Sapiens
NTSEVHNWT

SEQ ID NO: 1310243 - protein, 9 aa, Homo Sapiens
TELFSYEHF

SEQ ID NO: 1310244 - protein, 9 aa, Homo Sapiens
IYGIVVAMF

SEQ ID NO: 1310245 - protein, 9 aa, Homo Sapiens
ALDNISHLL

SEQ ID NO: 1310246 - protein, 9 aa, Homo Sapiens
SPRHYGELI

SEQ ID NO: 1310247 - protein, 9 aa, Homo Sapiens
RHGDYLKKE

SEQ ID NO: 1310248 - protein, 9 aa, Homo Sapiens
NAELLEVLL

SEQ ID NO: 1310249 - protein, 9 aa, Homo Sapiens
SYMGHFDLI

SEQ ID NO: 1310250 - protein, 9 aa, Homo Sapiens
MINGESKNK

SEQ ID NO: 1310251 - protein, 9 aa, Homo Sapiens
FDSYYEESD

SEQ ID NO: 1310252 - protein, 9 aa, Homo Sapiens
TIHYDIITS

SEQ ID NO: 1310253 - protein, 9 aa, Homo Sapiens
PGLYQPICD

SEQ ID NO: 1310254 - protein, 9 aa, Homo Sapiens
SGITISVTS

SEQ ID NO: 1310255 - protein, 9 aa, Homo Sapiens
IKCACNEQE

SEQ ID NO: 1310256 - protein, 9 aa, Homo Sapiens
SQFIEKETE

SEQ ID NO: 1310257 - protein, 9 aa, Homo Sapiens
RWQVGIHHG

SEQ ID NO: 1310258 - protein, 9 aa, Homo Sapiens
LQTFYATPV

SEQ ID NO: 1310259 - protein, 9 aa, Homo Sapiens
YKLHGPHAA

SEQ ID NO: 1310260 - protein, 9 aa, Homo Sapiens
HFDLINYFA

SEQ ID NO: 1310261 - protein, 9 aa, Homo Sapiens
LLNQIQRHH

SEQ ID NO: 1310262 - protein, 9 aa, Homo Sapiens
LGGVDKITQ

SEQ ID NO: 1310263 - protein, 9 aa, Homo Sapiens
QLYDRSLGI

SEQ ID NO: 1310264 - protein, 9 aa, Homo Sapiens
LAVAKPNNI

SEQ ID NO: 1310265 - protein, 9 aa, Homo Sapiens
KTLRPRCII

SEQ ID NO: 1310266 - protein, 9 aa, Homo Sapiens
TDLFSFACG

SEQ ID NO: 1310267 - protein, 9 aa, Homo Sapiens
HFKDWIERN

SEQ ID NO: 1310268 - protein, 9 aa, Homo Sapiens
REAAYKIVL

SEQ ID NO: 1310269 - protein, 9 aa, Homo Sapiens
KGVEHDKIK

SEQ ID NO: 1310270 - protein, 9 aa, Homo Sapiens
CRFVLAYAG

SEQ ID NO: 1310271 - protein, 9 aa, Homo Sapiens
FHPWQLYLS

SEQ ID NO: 1310272 - protein, 9 aa, Homo Sapiens
PPYRNNITV

SEQ ID NO: 1310273 - protein, 9 aa, Homo Sapiens
DYFQKVILR

SEQ ID NO: 1310274 - protein, 9 aa, Homo Sapiens
RTNIIQRLF

SEQ ID NO: 1310275 - protein, 9 aa, Homo Sapiens
ADKRHVSIE

SEQ ID NO: 1310276 - protein, 9 aa, Homo Sapiens
QIKNKSKLQ

SEQ ID NO: 1310277 - protein, 9 aa, Homo Sapiens
AAKKNIGKA

SEQ ID NO: 1310278 - protein, 9 aa, Homo Sapiens
TRAIYFLVG

SEQ ID NO: 1310279 - protein, 9 aa, Homo Sapiens
PKTWVHYIS

SEQ ID NO: 1310280 - protein, 9 aa, Homo Sapiens
RNETVFKHS

SEQ ID NO: 1310281 - protein, 9 aa, Homo Sapiens
PFEIRLPEL

SEQ ID NO: 1310282 - protein, 9 aa, Homo Sapiens
PIDPNKPTY

SEQ ID NO: 1310283 - protein, 9 aa, Homo Sapiens
KNIISRPWD

SEQ ID NO: 1310284 - protein, 9 aa, Homo Sapiens
RAIYFLVGS

SEQ ID NO: 1310285 - protein, 9 aa, Homo Sapiens
GFTGPLCIF

SEQ ID NO: 1310286 - protein, 9 aa, Homo Sapiens
VSYLKIWGK

SEQ ID NO: 1310287 - protein, 9 aa, Homo Sapiens
CDTVKYKEV

SEQ ID NO: 1310288 - protein, 9 aa, Homo Sapiens
TPELLPKEA

SEQ ID NO: 1310289 - protein, 9 aa, Homo Sapiens
MLMAMNIIS

SEQ ID NO: 1310290 - protein, 9 aa, Homo Sapiens
LILFGAITL

SEQ ID NO: 1310291 - protein, 9 aa, Homo Sapiens
NKMQSLWEK

SEQ ID NO: 1310292 - protein, 9 aa, Homo Sapiens
SQLTEHKII

SEQ ID NO: 1310293 - protein, 9 aa, Homo Sapiens
RGESKFDSF

SEQ ID NO: 1310294 - protein, 9 aa, Homo Sapiens
ISNTCLVTA

SEQ ID NO: 1310295 - protein, 9 aa, Homo Sapiens
SVGCWHGSK

SEQ ID NO: 1310296 - protein, 9 aa, Homo Sapiens
ESSPRVIQN

SEQ ID NO: 1310297 - protein, 9 aa, Homo Sapiens
VFLCLEMCL

SEQ ID NO: 1310298 - protein, 9 aa, Homo Sapiens
ITLTGFNSP

SEQ ID NO: 1310299 - protein, 9 aa, Homo Sapiens
TLEHKKKSF

SEQ ID NO: 1310300 - protein, 9 aa, Homo Sapiens
TGFNSPFNG

SEQ ID NO: 1310301 - protein, 9 aa, Homo Sapiens
HHLKEHLQI

SEQ ID NO: 1310302 - protein, 9 aa, Homo Sapiens
LVNLKLWAI

SEQ ID NO: 1310303 - protein, 9 aa, Homo Sapiens
LQIEYQDGK

SEQ ID NO: 1310304 - protein, 9 aa, Homo Sapiens
HGPGSGAPL

SEQ ID NO: 1310305 - protein, 9 aa, Homo Sapiens
DLIDMQLNH

SEQ ID NO: 1310306 - protein, 9 aa, Homo Sapiens
QVWKVCAAN

SEQ ID NO: 1310307 - protein, 9 aa, Homo Sapiens
YEYMGHIME

SEQ ID NO: 1310308 - protein, 9 aa, Homo Sapiens
YPSCRDPPG

SEQ ID NO: 1310309 - protein, 9 aa, Homo Sapiens
RFKCQVCNK

SEQ ID NO: 1310310 - protein, 9 aa, Homo Sapiens
VILPNDLFR

SEQ ID NO: 1310311 - protein, 9 aa, Homo Sapiens
CSTVHEKFN

SEQ ID NO: 1310312 - protein, 9 aa, Homo Sapiens
TLGSRCYII

SEQ ID NO: 1310313 - protein, 9 aa, Homo Sapiens
PTRNKNLAG

SEQ ID NO: 1310314 - protein, 9 aa, Homo Sapiens
ERNVFKLIC

SEQ ID NO: 1310315 - protein, 9 aa, Homo Sapiens
SLLSSTLKY

SEQ ID NO: 1310316 - protein, 9 aa, Homo Sapiens
VRKLREGQH

SEQ ID NO: 1310317 - protein, 9 aa, Homo Sapiens
LPELSPHKY

SEQ ID NO: 1310318 - protein, 9 aa, Homo Sapiens
KPFWCTFEG

SEQ ID NO: 1310319 - protein, 9 aa, Homo Sapiens
TQYHYMQWP

SEQ ID NO: 1310320 - protein, 9 aa, Homo Sapiens
PSSQRYSQT

SEQ ID NO: 1310321 - protein, 9 aa, Homo Sapiens
PVSRLRDTF

SEQ ID NO: 1310322 - protein, 9 aa, Homo Sapiens
ISQTAVVMK

SEQ ID NO: 1310323 - protein, 9 aa, Homo Sapiens
LVIYRETFN

SEQ ID NO: 1310324 - protein, 9 aa, Homo Sapiens
IMPVIPMNT

SEQ ID NO: 1310325 - protein, 9 aa, Homo Sapiens
LERNIQLEY

SEQ ID NO: 1310326 - protein, 9 aa, Homo Sapiens
LVKLNDHNE

SEQ ID NO: 1310327 - protein, 9 aa, Homo Sapiens
QDKLHQNIC

SEQ ID NO: 1310328 - protein, 9 aa, Homo Sapiens
LELVEKKHS

SEQ ID NO: 1310329 - protein, 9 aa, Homo Sapiens
YPDYENITL

SEQ ID NO: 1310330 - protein, 9 aa, Homo Sapiens
LCFSAAGSS

SEQ ID NO: 1310331 - protein, 9 aa, Homo Sapiens
LQREFHMQH

SEQ ID NO: 1310332 - protein, 9 aa, Homo Sapiens
LLLFDRHPY

SEQ ID NO: 1310333 - protein, 9 aa, Homo Sapiens
QQRIKEFQE

SEQ ID NO: 1310334 - protein, 9 aa, Homo Sapiens
PAPPLVVQP

SEQ ID NO: 1310335 - protein, 9 aa, Homo Sapiens
EDVDPYYYN

SEQ ID NO: 1310336 - protein, 9 aa, Homo Sapiens
DPPLLAVLN

SEQ ID NO: 1310337 - protein, 9 aa, Homo Sapiens
QKQNCPIPQ

SEQ ID NO: 1310338 - protein, 9 aa, Homo Sapiens
QLTEHKIIH

SEQ ID NO: 1310339 - protein, 9 aa, Homo Sapiens
EKEQTVFSF

SEQ ID NO: 1310340 - protein, 9 aa, Homo Sapiens
ASCDLSVLG

SEQ ID NO: 1310341 - protein, 9 aa, Homo Sapiens
GGIVPPPPD

SEQ ID NO: 1310342 - protein, 9 aa, Homo Sapiens
HRDCVIGLM

SEQ ID NO: 1310343 - protein, 9 aa, Homo Sapiens
RLLEKLCFS

SEQ ID NO: 1310344 - protein, 9 aa, Homo Sapiens
LFWYQLFCG

SEQ ID NO: 1310345 - protein, 9 aa, Homo Sapiens
KKKNQKTKQ

SEQ ID NO: 1310346 - protein, 9 aa, Homo Sapiens
TLQNHWKKT

SEQ ID NO: 1310347 - protein, 9 aa, Homo Sapiens
INGESKNKE

SEQ ID NO: 1310348 - protein, 9 aa, Homo Sapiens
ILESAAPSS

SEQ ID NO: 1310349 - protein, 9 aa, Homo Sapiens
VIRHFFCGM

SEQ ID NO: 1310350 - protein, 9 aa, Homo Sapiens
GAHYPDYEN

SEQ ID NO: 1310351 - protein, 9 aa, Homo Sapiens
GGVGREVGW

SEQ ID NO: 1310352 - protein, 9 aa, Homo Sapiens
IREIQREIL

SEQ ID NO: 1310353 - protein, 9 aa, Homo Sapiens
INTLLQPDK

SEQ ID NO: 1310354 - protein, 9 aa, Homo Sapiens
FEQIPENES

SEQ ID NO: 1310355 - protein, 9 aa, Homo Sapiens
SFSFKGIQF

SEQ ID NO: 1310356 - protein, 9 aa, Homo Sapiens
NHKLEYKYS

SEQ ID NO: 1310357 - protein, 9 aa, Homo Sapiens
FTKVLHFKD

SEQ ID NO: 1310358 - protein, 9 aa, Homo Sapiens
WYQLFCGFS

SEQ ID NO: 1310359 - protein, 9 aa, Homo Sapiens
IQAPHSPRL

SEQ ID NO: 1310360 - protein, 9 aa, Homo Sapiens
IATLHEKIL

SEQ ID NO: 1310361 - protein, 9 aa, Homo Sapiens
FCDLLKVKM

SEQ ID NO: 1310362 - protein, 9 aa, Homo Sapiens
NSCQPTPDL

SEQ ID NO: 1310363 - protein, 9 aa, Homo Sapiens
LTVEIMESP

SEQ ID NO: 1310364 - protein, 9 aa, Homo Sapiens
IVKSLSEDT

SEQ ID NO: 1310365 - protein, 9 aa, Homo Sapiens
IVHQIIHTG

SEQ ID NO: 1310366 - protein, 9 aa, Homo Sapiens
LTGPLQINP

SEQ ID NO: 1310367 - protein, 9 aa, Homo Sapiens
TKKNICRKC

SEQ ID NO: 1310368 - protein, 9 aa, Homo Sapiens
LQATPSSVS

SEQ ID NO: 1310369 - protein, 9 aa, Homo Sapiens
FRYNELITK

SEQ ID NO: 1310370 - protein, 9 aa, Homo Sapiens
HSIKDYFQK

SEQ ID NO: 1310371 - protein, 9 aa, Homo Sapiens
LIEKIILNI

SEQ ID NO: 1310372 - protein, 9 aa, Homo Sapiens
RQQRIKEFQ

SEQ ID NO: 1310373 - protein, 9 aa, Homo Sapiens
PEHEEPQIG

SEQ ID NO: 1310374 - protein, 9 aa, Homo Sapiens
STWEVEVVS

SEQ ID NO: 1310375 - protein, 9 aa, Homo Sapiens
NTEEFIRVR

SEQ ID NO: 1310376 - protein, 9 aa, Homo Sapiens
HDWLHIILW

SEQ ID NO: 1310377 - protein, 9 aa, Homo Sapiens
KINLKVAKN

SEQ ID NO: 1310378 - protein, 9 aa, Homo Sapiens
NTSRHNLEK

SEQ ID NO: 1310379 - protein, 9 aa, Homo Sapiens
QTSRLMAQN

SEQ ID NO: 1310380 - protein, 9 aa, Homo Sapiens
GNGAKYLLS

SEQ ID NO: 1310381 - protein, 9 aa, Homo Sapiens
PPSSPAPQD

SEQ ID NO: 1310382 - protein, 9 aa, Homo Sapiens
SLAIYFRCL

SEQ ID NO: 1310383 - protein, 9 aa, Homo Sapiens
ANQTAANGH

SEQ ID NO: 1310384 - protein, 9 aa, Homo Sapiens
YYFILITMA

SEQ ID NO: 1310385 - protein, 9 aa, Homo Sapiens
IILYESIIP

SEQ ID NO: 1310386 - protein, 9 aa, Homo Sapiens
LLVWVKRKE

SEQ ID NO: 1310387 - protein, 9 aa, Homo Sapiens
KKVFYPVIF

SEQ ID NO: 1310388 - protein, 9 aa, Homo Sapiens
SPFVWSGTI

SEQ ID NO: 1310389 - protein, 9 aa, Homo Sapiens
NLSRNCQYS

SEQ ID NO: 1310390 - protein, 9 aa, Homo Sapiens
LNVVFEQIP

SEQ ID NO: 1310391 - protein, 9 aa, Homo Sapiens
TSEDAKSAE

SEQ ID NO: 1310392 - protein, 9 aa, Homo Sapiens
VDWNVEFSA

SEQ ID NO: 1310393 - protein, 9 aa, Homo Sapiens
NKALGRELL

SEQ ID NO: 1310394 - protein, 9 aa, Homo Sapiens
PSEPERTNI

SEQ ID NO: 1310395 - protein, 9 aa, Homo Sapiens
TKAGVAASK

SEQ ID NO: 1310396 - protein, 9 aa, Homo Sapiens
TAVHCVEPD

SEQ ID NO: 1310397 - protein, 9 aa, Homo Sapiens
LARDMYKDP

SEQ ID NO: 1310398 - protein, 9 aa, Homo Sapiens
LLSNKNISA

SEQ ID NO: 1310399 - protein, 9 aa, Homo Sapiens
TAFSGLGFG

SEQ ID NO: 1310400 - protein, 9 aa, Homo Sapiens
KLTYIRGIY

SEQ ID NO: 1310401 - protein, 9 aa, Homo Sapiens
NKPLKKKPT

SEQ ID NO: 1310402 - protein, 9 aa, Homo Sapiens
ILCSKTENA

SEQ ID NO: 1310403 - protein, 9 aa, Homo Sapiens
LWGSRAHAE

SEQ ID NO: 1310404 - protein, 9 aa, Homo Sapiens
DIITSLQRA

SEQ ID NO: 1310405 - protein, 9 aa, Homo Sapiens
ILFGAITLN

SEQ ID NO: 1310406 - protein, 9 aa, Homo Sapiens
VLYLHRVGR

SEQ ID NO: 1310407 - protein, 9 aa, Homo Sapiens
AVREFAKDI

SEQ ID NO: 1310408 - protein, 9 aa, Homo Sapiens
HWKPSDKLL

SEQ ID NO: 1310409 - protein, 9 aa, Homo Sapiens
AFTQKSNIN

SEQ ID NO: 1310410 - protein, 9 aa, Homo Sapiens
CFIIPVLRS

SEQ ID NO: 1310411 - protein, 9 aa, Homo Sapiens
NENCTCTCQ

SEQ ID NO: 1310412 - protein, 9 aa, Homo Sapiens
RVVTQYHYM

SEQ ID NO: 1310413 - protein, 9 aa, Homo Sapiens
DPNKPTYCL

SEQ ID NO: 1310414 - protein, 9 aa, Homo Sapiens
GFIPGSYLE

SEQ ID NO: 1310415 - protein, 9 aa, Homo Sapiens
FIPRPREEL

SEQ ID NO: 1310416 - protein, 9 aa, Homo Sapiens
AVHCVEPDI

SEQ ID NO: 1310417 - protein, 9 aa, Homo Sapiens
YPGPPGEPG

SEQ ID NO: 1310418 - protein, 9 aa, Homo Sapiens
WALPKTYTI

SEQ ID NO: 1310419 - protein, 9 aa, Homo Sapiens
SLWSTTPFS

SEQ ID NO: 1310420 - protein, 9 aa, Homo Sapiens
QSCSTVHEK

SEQ ID NO: 1310421 - protein, 9 aa, Homo Sapiens
ILDLPQNQI

SEQ ID NO: 1310422 - protein, 9 aa, Homo Sapiens
KALKHIHQF

SEQ ID NO: 1310423 - protein, 9 aa, Homo Sapiens
IVDAICTRG

SEQ ID NO: 1310424 - protein, 9 aa, Homo Sapiens
TIMVHSPTK

SEQ ID NO: 1310425 - protein, 9 aa, Homo Sapiens
KLLNISLES

SEQ ID NO: 1310426 - protein, 9 aa, Homo Sapiens
EQWDSIYHT

SEQ ID NO: 1310427 - protein, 9 aa, Homo Sapiens
AKITIILLD

SEQ ID NO: 1310428 - protein, 9 aa, Homo Sapiens
DMVCLRTSE

SEQ ID NO: 1310429 - protein, 9 aa, Homo Sapiens
PVKRGESKF

SEQ ID NO: 1310430 - protein, 9 aa, Homo Sapiens
SQTKVLSSK

SEQ ID NO: 1310431 - protein, 9 aa, Homo Sapiens
KILFNVDRH

SEQ ID NO: 1310432 - protein, 9 aa, Homo Sapiens
GGETSDMYL

SEQ ID NO: 1310433 - protein, 9 aa, Homo Sapiens
SSLNTITQK

SEQ ID NO: 1310434 - protein, 9 aa, Homo Sapiens
LAEEVDNKV

SEQ ID NO: 1310435 - protein, 9 aa, Homo Sapiens
GMVSDFKIN

SEQ ID NO: 1310436 - protein, 9 aa, Homo Sapiens
SYLSSFQTS

SEQ ID NO: 1310437 - protein, 9 aa, Homo Sapiens
PLQVERCRI

SEQ ID NO: 1310438 - protein, 9 aa, Homo Sapiens
SKKGQNKGE

SEQ ID NO: 1310439 - protein, 9 aa, Homo Sapiens
RCIIGVTQK

SEQ ID NO: 1310440 - protein, 9 aa, Homo Sapiens
DNVFGKTLN

SEQ ID NO: 1310441 - protein, 9 aa, Homo Sapiens
HVLIILWMQ

SEQ ID NO: 1310442 - protein, 9 aa, Homo Sapiens
NFILCFSFY

SEQ ID NO: 1310443 - protein, 9 aa, Homo Sapiens
GGMVSDFKI

SEQ ID NO: 1310444 - protein, 9 aa, Homo Sapiens
EYLLMISKL

SEQ ID NO: 1310445 - protein, 9 aa, Homo Sapiens
DYLLKVLPA

SEQ ID NO: 1310446 - protein, 9 aa, Homo Sapiens
QGKNNLHGD

SEQ ID NO: 1310447 - protein, 9 aa, Homo Sapiens
DASFKSLQA

SEQ ID NO: 1310448 - protein, 9 aa, Homo Sapiens
SAGGILAVG

SEQ ID NO: 1310449 - protein, 9 aa, Homo Sapiens
YQLGLPWPP

SEQ ID NO: 1310450 - protein, 9 aa, Homo Sapiens
ALTVIRIIL

SEQ ID NO: 1310451 - protein, 9 aa, Homo Sapiens
RTIGWMKFR

SEQ ID NO: 1310452 - protein, 9 aa, Homo Sapiens
SVLQNAIKS

SEQ ID NO: 1310453 - protein, 9 aa, Homo Sapiens
MCALEEENG

SEQ ID NO: 1310454 - protein, 9 aa, Homo Sapiens
SDYVAPTAN

SEQ ID NO: 1310455 - protein, 9 aa, Homo Sapiens
PNSEVIYVW

SEQ ID NO: 1310456 - protein, 9 aa, Homo Sapiens
FSEVGFPDS

SEQ ID NO: 1310457 - protein, 9 aa, Homo Sapiens
QINEIVTET

SEQ ID NO: 1310458 - protein, 9 aa, Homo Sapiens
SEHDYLWVK

SEQ ID NO: 1310459 - protein, 9 aa, Homo Sapiens
LGALFGPIR

SEQ ID NO: 1310460 - protein, 9 aa, Homo Sapiens
EMYRMEEVT

SEQ ID NO: 1310461 - protein, 9 aa, Homo Sapiens
RFIEYGKKK

SEQ ID NO: 1310462 - protein, 9 aa, Homo Sapiens
RIALTSSKL

SEQ ID NO: 1310463 - protein, 9 aa, Homo Sapiens
LKELEEMEI

SEQ ID NO: 1310464 - protein, 9 aa, Homo Sapiens
KLFVSGKTL

SEQ ID NO: 1310465 - protein, 9 aa, Homo Sapiens
DHNEFEEQA

SEQ ID NO: 1310466 - protein, 9 aa, Homo Sapiens
WASSIDDAP

SEQ ID NO: 1310467 - protein, 9 aa, Homo Sapiens
GMPQLLILS

SEQ ID NO: 1310468 - protein, 9 aa, Homo Sapiens
LINHYFCDI

SEQ ID NO: 1310469 - protein, 9 aa, Homo Sapiens
GGQKPENIS

SEQ ID NO: 1310470 - protein, 9 aa, Homo Sapiens
YIIHLYHLL

SEQ ID NO: 1310471 - protein, 9 aa, Homo Sapiens
FRFHKEDKL

SEQ ID NO: 1310472 - protein, 9 aa, Homo Sapiens
LQGLKYTLS

SEQ ID NO: 1310473 - protein, 9 aa, Homo Sapiens
IHQYPKFKW

SEQ ID NO: 1310474 - protein, 9 aa, Homo Sapiens
LLDISLGAD

SEQ ID NO: 1310475 - protein, 9 aa, Homo Sapiens
LQAHIKCRH

SEQ ID NO: 1310476 - protein, 9 aa, Homo Sapiens
LQRTHSQLL

SEQ ID NO: 1310477 - protein, 9 aa, Homo Sapiens
ELILSSNII

SEQ ID NO: 1310478 - protein, 9 aa, Homo Sapiens
KENAHNRHK

SEQ ID NO: 1310479 - protein, 9 aa, Homo Sapiens
LLVSYLKIW

SEQ ID NO: 1310480 - protein, 9 aa, Homo Sapiens
EGEQQDVGD

SEQ ID NO: 1310481 - protein, 9 aa, Homo Sapiens
QINQKELQG

SEQ ID NO: 1310482 - protein, 9 aa, Homo Sapiens
ETEQNQALL

SEQ ID NO: 1310483 - protein, 9 aa, Homo Sapiens
KYLEIDRSM

SEQ ID NO: 1310484 - protein, 9 aa, Homo Sapiens
CLVTAAHCF

SEQ ID NO: 1310485 - protein, 9 aa, Homo Sapiens
SRLANMVMY

SEQ ID NO: 1310486 - protein, 9 aa, Homo Sapiens
VLNLVFGVL

SEQ ID NO: 1310487 - protein, 9 aa, Homo Sapiens
MFENKLIQS

SEQ ID NO: 1310488 - protein, 9 aa, Homo Sapiens
DLETLNLTT

SEQ ID NO: 1310489 - protein, 9 aa, Homo Sapiens
RRYCSTSYS

SEQ ID NO: 1310490 - protein, 9 aa, Homo Sapiens
GFCCERGHK

SEQ ID NO: 1310491 - protein, 9 aa, Homo Sapiens
PKTISFWSR

SEQ ID NO: 1310492 - protein, 9 aa, Homo Sapiens
LYDRSLGIM

SEQ ID NO: 1310493 - protein, 9 aa, Homo Sapiens
NKFFRREHY

SEQ ID NO: 1310494 - protein, 9 aa, Homo Sapiens
MFIVLREPH

SEQ ID NO: 1310495 - protein, 9 aa, Homo Sapiens
IHAYSNKLS

SEQ ID NO: 1310496 - protein, 9 aa, Homo Sapiens
SLQCWLFLV

SEQ ID NO: 1310497 - protein, 9 aa, Homo Sapiens
SIIMISYCL

SEQ ID NO: 1310498 - protein, 9 aa, Homo Sapiens
TIPSEPERT

SEQ ID NO: 1310499 - protein, 9 aa, Homo Sapiens
DNNSLQSPE

SEQ ID NO: 1310500 - protein, 9 aa, Homo Sapiens
RDEGKCVEE

SEQ ID NO: 1310501 - protein, 9 aa, Homo Sapiens
NEHIGDKPY

SEQ ID NO: 1310502 - protein, 9 aa, Homo Sapiens
GVGNEAGDG

SEQ ID NO: 1310503 - protein, 9 aa, Homo Sapiens
ASTANKCVS

SEQ ID NO: 1310504 - protein, 9 aa, Homo Sapiens
NFTGAVRIA

SEQ ID NO: 1310505 - protein, 9 aa, Homo Sapiens
LPLQYSTVI

SEQ ID NO: 1310506 - protein, 9 aa, Homo Sapiens
ESRGVNLNR

SEQ ID NO: 1310507 - protein, 9 aa, Homo Sapiens
ITDAFSFLA

SEQ ID NO: 1310508 - protein, 9 aa, Homo Sapiens
FYAESIINP

SEQ ID NO: 1310509 - protein, 9 aa, Homo Sapiens
PKDANKSST

SEQ ID NO: 1310510 - protein, 9 aa, Homo Sapiens
GYLTFFTST

SEQ ID NO: 1310511 - protein, 9 aa, Homo Sapiens
ALMWFMGDQ

SEQ ID NO: 1310512 - protein, 9 aa, Homo Sapiens
IYKGKITPQ

SEQ ID NO: 1310513 - protein, 9 aa, Homo Sapiens
RLQLRMYKN

SEQ ID NO: 1310514 - protein, 9 aa, Homo Sapiens
ECVEDLRML

SEQ ID NO: 1310515 - protein, 9 aa, Homo Sapiens
QAKNQQRQQ

SEQ ID NO: 1310516 - protein, 9 aa, Homo Sapiens
TTAASIQTK

SEQ ID NO: 1310517 - protein, 9 aa, Homo Sapiens
GFDGGTNRI

SEQ ID NO: 1310518 - protein, 9 aa, Homo Sapiens
EVAGGAHKA

SEQ ID NO: 1310519 - protein, 9 aa, Homo Sapiens
IKNIYSNCL

SEQ ID NO: 1310520 - protein, 9 aa, Homo Sapiens
EFKILNYQN

SEQ ID NO: 1310521 - protein, 9 aa, Homo Sapiens
TSNFTQHQI

SEQ ID NO: 1310522 - protein, 9 aa, Homo Sapiens
VWDSYAELR

SEQ ID NO: 1310523 - protein, 9 aa, Homo Sapiens
KRYKIYHLA

SEQ ID NO: 1310524 - protein, 9 aa, Homo Sapiens
QVTVPESIT

SEQ ID NO: 1310525 - protein, 9 aa, Homo Sapiens
NSVLQNANK

SEQ ID NO: 1310526 - protein, 9 aa, Homo Sapiens
MDKMYRNVY

SEQ ID NO: 1310527 - protein, 9 aa, Homo Sapiens
WQVGIHHGS

SEQ ID NO: 1310528 - protein, 9 aa, Homo Sapiens
NMNEDNEGT

SEQ ID NO: 1310529 - protein, 9 aa, Homo Sapiens
EDFFMMSDY

SEQ ID NO: 1310530 - protein, 9 aa, Homo Sapiens
GKKVQKGNA

SEQ ID NO: 1310531 - protein, 9 aa, Homo Sapiens
SERINIIRQ

SEQ ID NO: 1310532 - protein, 9 aa, Homo Sapiens
WLHIILWIG

SEQ ID NO: 1310533 - protein, 9 aa, Homo Sapiens
AILSLHIYY

SEQ ID NO: 1310534 - protein, 9 aa, Homo Sapiens
FKFTKVDSQ

SEQ ID NO: 1310535 - protein, 9 aa, Homo Sapiens
INKDILMAA

SEQ ID NO: 1310536 - protein, 9 aa, Homo Sapiens
ELDSHLSYT

SEQ ID NO: 1310537 - protein, 9 aa, Homo Sapiens
TKIKLPNTN

SEQ ID NO: 1310538 - protein, 9 aa, Homo Sapiens
KPENISVVG

SEQ ID NO: 1310539 - protein, 9 aa, Homo Sapiens
FAIYWGQVK

SEQ ID NO: 1310540 - protein, 9 aa, Homo Sapiens
ENNVDYETF

SEQ ID NO: 1310541 - protein, 9 aa, Homo Sapiens
KKKKDDNKK

SEQ ID NO: 1310542 - protein, 9 aa, Homo Sapiens
CEHEKTHTG

SEQ ID NO: 1310543 - protein, 9 aa, Homo Sapiens
KKINYSRVA

SEQ ID NO: 1310544 - protein, 9 aa, Homo Sapiens
LLFPVRGGL

SEQ ID NO: 1310545 - protein, 9 aa, Homo Sapiens
IHGQGKNNL

SEQ ID NO: 1310546 - protein, 9 aa, Homo Sapiens
LTLLNSFWF

SEQ ID NO: 1310547 - protein, 9 aa, Homo Sapiens
HKGHFQLWL

SEQ ID NO: 1310548 - protein, 9 aa, Homo Sapiens
TMIIFLGPL

SEQ ID NO: 1310549 - protein, 9 aa, Homo Sapiens
NLFCFNKER

SEQ ID NO: 1310550 - protein, 9 aa, Homo Sapiens
YLTFFTSTL

SEQ ID NO: 1310551 - protein, 9 aa, Homo Sapiens
PFPEYDSNS

SEQ ID NO: 1310552 - protein, 9 aa, Homo Sapiens
ISYLDSIHL

SEQ ID NO: 1310553 - protein, 9 aa, Homo Sapiens
WIKAAKTGS

SEQ ID NO: 1310554 - protein, 9 aa, Homo Sapiens
TILNFILCF

SEQ ID NO: 1310555 - protein, 9 aa, Homo Sapiens
ERLDGHLNL

SEQ ID NO: 1310556 - protein, 9 aa, Homo Sapiens
IKVDPETNN

SEQ ID NO: 1310557 - protein, 9 aa, Homo Sapiens
IIELLNAEL

SEQ ID NO: 1310558 - protein, 9 aa, Homo Sapiens
HGSKDEEVP

SEQ ID NO: 1310559 - protein, 9 aa, Homo Sapiens
VTTVYLIDF

SEQ ID NO: 1310560 - protein, 9 aa, Homo Sapiens
KDMKVLEKK

SEQ ID NO: 1310561 - protein, 9 aa, Homo Sapiens
FSFKGIQFS

SEQ ID NO: 1310562 - protein, 9 aa, Homo Sapiens
KKRNFDLEN

SEQ ID NO: 1310563 - protein, 9 aa, Homo Sapiens
PVKLFVREP

SEQ ID NO: 1310564 - protein, 9 aa, Homo Sapiens
YERFLRIIM

SEQ ID NO: 1310565 - protein, 9 aa, Homo Sapiens
VMVRKMQLN

SEQ ID NO: 1310566 - protein, 9 aa, Homo Sapiens
FSGIQIEKH

SEQ ID NO: 1310567 - protein, 9 aa, Homo Sapiens
TPIPFDKML

SEQ ID NO: 1310568 - protein, 9 aa, Homo Sapiens
DKGTAEELQ

SEQ ID NO: 1310569 - protein, 9 aa, Homo Sapiens
TFFTSTLHS

SEQ ID NO: 1310570 - protein, 9 aa, Homo Sapiens
HVFNPIDFL

SEQ ID NO: 1310571 - protein, 9 aa, Homo Sapiens
LEKEAKDLP

SEQ ID NO: 1310572 - protein, 9 aa, Homo Sapiens
KGVLESHFL

SEQ ID NO: 1310573 - protein, 9 aa, Homo Sapiens
LLEQDKSLA

SEQ ID NO: 1310574 - protein, 9 aa, Homo Sapiens
ATLIQSFYQ

SEQ ID NO: 1310575 - protein, 9 aa, Homo Sapiens
TVPAVQGVF

SEQ ID NO: 1310576 - protein, 9 aa, Homo Sapiens
LWTGSITNK

SEQ ID NO: 1310577 - protein, 9 aa, Homo Sapiens
FTASSVKYK

SEQ ID NO: 1310578 - protein, 9 aa, Homo Sapiens
IFLGPLMQL

SEQ ID NO: 1310579 - protein, 9 aa, Homo Sapiens
KTQVEAVAE

SEQ ID NO: 1310580 - protein, 9 aa, Homo Sapiens
NNLGVCGSR

SEQ ID NO: 1310581 - protein, 9 aa, Homo Sapiens
KEICNELEK

SEQ ID NO: 1310582 - protein, 9 aa, Homo Sapiens
AVKSFQMQN

SEQ ID NO: 1310583 - protein, 9 aa, Homo Sapiens
QDKIIENLR

SEQ ID NO: 1310584 - protein, 9 aa, Homo Sapiens
SFRWTTSEG

SEQ ID NO: 1310585 - protein, 9 aa, Homo Sapiens
SDDWAANKS

SEQ ID NO: 1310586 - protein, 9 aa, Homo Sapiens
KSKLKDEAE

SEQ ID NO: 1310587 - protein, 9 aa, Homo Sapiens
DWKRVEKYV

SEQ ID NO: 1310588 - protein, 9 aa, Homo Sapiens
FACHQLYIL

SEQ ID NO: 1310589 - protein, 9 aa, Homo Sapiens
ARVNGKTQV

SEQ ID NO: 1310590 - protein, 9 aa, Homo Sapiens
DYIEIWNGP

SEQ ID NO: 1310591 - protein, 9 aa, Homo Sapiens
TTATPTQIK

SEQ ID NO: 1310592 - protein, 9 aa, Homo Sapiens
EQNVVIQNE

SEQ ID NO: 1310593 - protein, 9 aa, Homo Sapiens
VLDEANLEF

SEQ ID NO: 1310594 - protein, 9 aa, Homo Sapiens
VGNKYLNET

SEQ ID NO: 1310595 - protein, 9 aa, Homo Sapiens
KLLADGYSD

SEQ ID NO: 1310596 - protein, 9 aa, Homo Sapiens
FSQLSSDPS

SEQ ID NO: 1310597 - protein, 9 aa, Homo Sapiens
GNHCTEITS

SEQ ID NO: 1310598 - protein, 9 aa, Homo Sapiens
QYLENIVAI

SEQ ID NO: 1310599 - protein, 9 aa, Homo Sapiens
NMIHMIYFD

SEQ ID NO: 1310600 - protein, 9 aa, Homo Sapiens
QPDKNICSA

SEQ ID NO: 1310601 - protein, 9 aa, Homo Sapiens
DLRSWTTAD

SEQ ID NO: 1310602 - protein, 9 aa, Homo Sapiens
AGMHGNKAL

SEQ ID NO: 1310603 - protein, 9 aa, Homo Sapiens
IMARTLTGL

SEQ ID NO: 1310604 - protein, 9 aa, Homo Sapiens
RERDQLLAS

SEQ ID NO: 1310605 - protein, 9 aa, Homo Sapiens
LTISTHTTI

SEQ ID NO: 1310606 - protein, 9 aa, Homo Sapiens
QPDKKSNKS

SEQ ID NO: 1310607 - protein, 9 aa, Homo Sapiens
EDKLMKICK

SEQ ID NO: 1310608 - protein, 9 aa, Homo Sapiens
FSIIYSIPF

SEQ ID NO: 1310609 - protein, 9 aa, Homo Sapiens
KIMLTKDLK

SEQ ID NO: 1310610 - protein, 9 aa, Homo Sapiens
QNFTGAVRI

SEQ ID NO: 1310611 - protein, 9 aa, Homo Sapiens
QDELYELCD

SEQ ID NO: 1310612 - protein, 9 aa, Homo Sapiens
SHLTKHKII

SEQ ID NO: 1310613 - protein, 9 aa, Homo Sapiens
DKIFQEDHY

SEQ ID NO: 1310614 - protein, 9 aa, Homo Sapiens
LDSTPSRPG

SEQ ID NO: 1310615 - protein, 9 aa, Homo Sapiens
SALSYYKST

SEQ ID NO: 1310616 - protein, 9 aa, Homo Sapiens
VVFIFYSLC

SEQ ID NO: 1310617 - protein, 9 aa, Homo Sapiens
KMIFGDLIR

SEQ ID NO: 1310618 - protein, 9 aa, Homo Sapiens
VVSHIRPAA

SEQ ID NO: 1310619 - protein, 9 aa, Homo Sapiens
IICRFETRI

SEQ ID NO: 1310620 - protein, 9 aa, Homo Sapiens
IIVSSCAVV

SEQ ID NO: 1310621 - protein, 9 aa, Homo Sapiens
MAGIRALVM

SEQ ID NO: 1310622 - protein, 9 aa, Homo Sapiens
SVRGDVRSC

SEQ ID NO: 1310623 - protein, 9 aa, Homo Sapiens
DTNSERITV

SEQ ID NO: 1310624 - protein, 9 aa, Homo Sapiens
QKPENISVV

SEQ ID NO: 1310625 - protein, 9 aa, Homo Sapiens
LVWALPKTY

SEQ ID NO: 1310626 - protein, 9 aa, Homo Sapiens
IQMEPGDQG

SEQ ID NO: 1310627 - protein, 9 aa, Homo Sapiens
GLSSRVQFQ

SEQ ID NO: 1310628 - protein, 9 aa, Homo Sapiens
VNETLRPGY

SEQ ID NO: 1310629 - protein, 9 aa, Homo Sapiens
KERIKYSRY

SEQ ID NO: 1310630 - protein, 9 aa, Homo Sapiens
FPKQSHKLE

SEQ ID NO: 1310631 - protein, 9 aa, Homo Sapiens
CWIIRDKRG

SEQ ID NO: 1310632 - protein, 9 aa, Homo Sapiens
KKKTSNNIK

SEQ ID NO: 1310633 - protein, 9 aa, Homo Sapiens
IMPRDIQLA

SEQ ID NO: 1310634 - protein, 9 aa, Homo Sapiens
TILAVSKLE

SEQ ID NO: 1310635 - protein, 9 aa, Homo Sapiens
SLSIAAGII

SEQ ID NO: 1310636 - protein, 9 aa, Homo Sapiens
PSPNHSKLS

SEQ ID NO: 1310637 - protein, 9 aa, Homo Sapiens
MKQLDTLGN

SEQ ID NO: 1310638 - protein, 9 aa, Homo Sapiens
MCPPGMHKL

SEQ ID NO: 1310639 - protein, 9 aa, Homo Sapiens
HRHRKSKVT

SEQ ID NO: 1310640 - protein, 9 aa, Homo Sapiens
HQSQLRENK

SEQ ID NO: 1310641 - protein, 9 aa, Homo Sapiens
IPSYMSIYF

SEQ ID NO: 1310642 - protein, 9 aa, Homo Sapiens
YSNCLPKSS

SEQ ID NO: 1310643 - protein, 9 aa, Homo Sapiens
PPGMHKLKL

SEQ ID NO: 1310644 - protein, 9 aa, Homo Sapiens
CKEIIRPRR

SEQ ID NO: 1310645 - protein, 9 aa, Homo Sapiens
LEHKKKSFL

SEQ ID NO: 1310646 - protein, 9 aa, Homo Sapiens
PIPSAASCD

SEQ ID NO: 1310647 - protein, 9 aa, Homo Sapiens
DLIIFYRGS

SEQ ID NO: 1310648 - protein, 9 aa, Homo Sapiens
LTELFSYEH

SEQ ID NO: 1310649 - protein, 9 aa, Homo Sapiens
SVIHAYSNK

SEQ ID NO: 1310650 - protein, 9 aa, Homo Sapiens
KYQCLILLT

SEQ ID NO: 1310651 - protein, 9 aa, Homo Sapiens
QIQRHHTFL

SEQ ID NO: 1310652 - protein, 9 aa, Homo Sapiens
DELYELCDE

SEQ ID NO: 1310653 - protein, 9 aa, Homo Sapiens
TADTVAQIT

SEQ ID NO: 1310654 - protein, 9 aa, Homo Sapiens
HLINQWRNR

SEQ ID NO: 1310655 - protein, 9 aa, Homo Sapiens
LNETAGVAA

SEQ ID NO: 1310656 - protein, 9 aa, Homo Sapiens
KNIPEKTSC

SEQ ID NO: 1310657 - protein, 9 aa, Homo Sapiens
VLRYPSFFS

SEQ ID NO: 1310658 - protein, 9 aa, Homo Sapiens
GGIYEQDEL

SEQ ID NO: 1310659 - protein, 9 aa, Homo Sapiens
VTVQPGCYL

SEQ ID NO: 1310660 - protein, 9 aa, Homo Sapiens
KDVNVFDPN

SEQ ID NO: 1310661 - protein, 9 aa, Homo Sapiens
SAVQKAAPS

SEQ ID NO: 1310662 - protein, 9 aa, Homo Sapiens
VPTRMGGLF

SEQ ID NO: 1310663 - protein, 9 aa, Homo Sapiens
TARPYECVQ

SEQ ID NO: 1310664 - protein, 9 aa, Homo Sapiens
AVVFTKEKL

SEQ ID NO: 1310665 - protein, 9 aa, Homo Sapiens
TKFTKLWEF

SEQ ID NO: 1310666 - protein, 9 aa, Homo Sapiens
THNAKYLAT

SEQ ID NO: 1310667 - protein, 9 aa, Homo Sapiens
CDLLKVKMH

SEQ ID NO: 1310668 - protein, 9 aa, Homo Sapiens
QNSRDAIAA

SEQ ID NO: 1310669 - protein, 9 aa, Homo Sapiens
NNLTLLNSF

SEQ ID NO: 1310670 - protein, 9 aa, Homo Sapiens
TGWSKGLIG

SEQ ID NO: 1310671 - protein, 9 aa, Homo Sapiens
TDTEINGPD

SEQ ID NO: 1310672 - protein, 9 aa, Homo Sapiens
YITVDSNSS

SEQ ID NO: 1310673 - protein, 9 aa, Homo Sapiens
ARCTSLNES

SEQ ID NO: 1310674 - protein, 9 aa, Homo Sapiens
EIIHMREKS

SEQ ID NO: 1310675 - protein, 9 aa, Homo Sapiens
PIKHPWRKV

SEQ ID NO: 1310676 - protein, 9 aa, Homo Sapiens
KSELKVLVV

SEQ ID NO: 1310677 - protein, 9 aa, Homo Sapiens
EALKLFCEI

SEQ ID NO: 1310678 - protein, 9 aa, Homo Sapiens
CIIMLLAVA

SEQ ID NO: 1310679 - protein, 9 aa, Homo Sapiens
ALARTPAAC

SEQ ID NO: 1310680 - protein, 9 aa, Homo Sapiens
VEDLRMLDA

SEQ ID NO: 1310681 - protein, 9 aa, Homo Sapiens
SHTGEKSYE

SEQ ID NO: 1310682 - protein, 9 aa, Homo Sapiens
EDKVEEGPS

SEQ ID NO: 1310683 - protein, 9 aa, Homo Sapiens
QAARSDNYS

SEQ ID NO: 1310684 - protein, 9 aa, Homo Sapiens
RQELLDIRH

SEQ ID NO: 1310685 - protein, 9 aa, Homo Sapiens
FKSIITAGF

SEQ ID NO: 1310686 - protein, 9 aa, Homo Sapiens
YLQLEQFSH

SEQ ID NO: 1310687 - protein, 9 aa, Homo Sapiens
VVEEAQKHF

SEQ ID NO: 1310688 - protein, 9 aa, Homo Sapiens
ISEQLYDRS

SEQ ID NO: 1310689 - protein, 9 aa, Homo Sapiens
ELEDKVIKL

SEQ ID NO: 1310690 - protein, 9 aa, Homo Sapiens
CFCDLLKVK

SEQ ID NO: 1310691 - protein, 9 aa, Homo Sapiens
SETIQYNDD

SEQ ID NO: 1310692 - protein, 9 aa, Homo Sapiens
SGKQNKDDE

SEQ ID NO: 1310693 - protein, 9 aa, Homo Sapiens
IEEVESKRA

SEQ ID NO: 1310694 - protein, 9 aa, Homo Sapiens
DMYSQPFGE

SEQ ID NO: 1310695 - protein, 9 aa, Homo Sapiens
EDDYRGKYL

SEQ ID NO: 1310696 - protein, 9 aa, Homo Sapiens
NNKEQSPPG

SEQ ID NO: 1310697 - protein, 9 aa, Homo Sapiens
QDQNGGVGR

SEQ ID NO: 1310698 - protein, 9 aa, Homo Sapiens
SLKAYEDDV

SEQ ID NO: 1310699 - protein, 9 aa, Homo Sapiens
VKGVLESHF

SEQ ID NO: 1310700 - protein, 9 aa, Homo Sapiens
IIRVAKGYQ

SEQ ID NO: 1310701 - protein, 9 aa, Homo Sapiens
RRKPKGNPR

SEQ ID NO: 1310702 - protein, 9 aa, Homo Sapiens
SFQMQNTLY

SEQ ID NO: 1310703 - protein, 9 aa, Homo Sapiens
PNPSTIFQA

SEQ ID NO: 1310704 - protein, 9 aa, Homo Sapiens
YIVDGNHRL

SEQ ID NO: 1310705 - protein, 9 aa, Homo Sapiens
QLQQNKEDA

SEQ ID NO: 1310706 - protein, 9 aa, Homo Sapiens
IVKNYLEEL

SEQ ID NO: 1310707 - protein, 9 aa, Homo Sapiens
NQQRQQKIQ

SEQ ID NO: 1310708 - protein, 9 aa, Homo Sapiens
EENNNKNMG

SEQ ID NO: 1310709 - protein, 9 aa, Homo Sapiens
NKNMNEDNE

SEQ ID NO: 1310710 - protein, 9 aa, Homo Sapiens
VDMVNGTDS

SEQ ID NO: 1310711 - protein, 9 aa, Homo Sapiens
SLHTWVALS

SEQ ID NO: 1310712 - protein, 9 aa, Homo Sapiens
NTSSLWSTT

SEQ ID NO: 1310713 - protein, 9 aa, Homo Sapiens
QSHRDCVIG

SEQ ID NO: 1310714 - protein, 9 aa, Homo Sapiens
LKNIPEKTS

SEQ ID NO: 1310715 - protein, 9 aa, Homo Sapiens
CRYDRLSTL

SEQ ID NO: 1310716 - protein, 9 aa, Homo Sapiens
QYSTVINSR

SEQ ID NO: 1310717 - protein, 9 aa, Homo Sapiens
ALGNMFMYF

SEQ ID NO: 1310718 - protein, 9 aa, Homo Sapiens
FFIWQCGLL

SEQ ID NO: 1310719 - protein, 9 aa, Homo Sapiens
LLNKMQSLW

SEQ ID NO: 1310720 - protein, 9 aa, Homo Sapiens
NYLFFSAQP

SEQ ID NO: 1310721 - protein, 9 aa, Homo Sapiens
LHTWVALSH

SEQ ID NO: 1310722 - protein, 9 aa, Homo Sapiens
FLALMWFMG

SEQ ID NO: 1310723 - protein, 9 aa, Homo Sapiens
KEWIEIRVA

SEQ ID NO: 1310724 - protein, 9 aa, Homo Sapiens
FNIPVISEK

SEQ ID NO: 1310725 - protein, 9 aa, Homo Sapiens
GATLISNTC

SEQ ID NO: 1310726 - protein, 9 aa, Homo Sapiens
TAPGIHKRY

SEQ ID NO: 1310727 - protein, 9 aa, Homo Sapiens
KHAPIHSAQ

SEQ ID NO: 1310728 - protein, 9 aa, Homo Sapiens
LNQSKNCEG

SEQ ID NO: 1310729 - protein, 9 aa, Homo Sapiens
FNQDDAALE

SEQ ID NO: 1310730 - protein, 9 aa, Homo Sapiens
PPLVVQPSR

SEQ ID NO: 1310731 - protein, 9 aa, Homo Sapiens
CYFWKKNHK

SEQ ID NO: 1310732 - protein, 9 aa, Homo Sapiens
TLNENCTCT

SEQ ID NO: 1310733 - protein, 9 aa, Homo Sapiens
NEAGDGPGL

SEQ ID NO: 1310734 - protein, 9 aa, Homo Sapiens
IKYPRTVRK

SEQ ID NO: 1310735 - protein, 9 aa, Homo Sapiens
NPSMEEKLE

SEQ ID NO: 1310736 - protein, 9 aa, Homo Sapiens
AIYTSQEEI

SEQ ID NO: 1310737 - protein, 9 aa, Homo Sapiens
QYLSGDDID

SEQ ID NO: 1310738 - protein, 9 aa, Homo Sapiens
DTFLELAVF

SEQ ID NO: 1310739 - protein, 9 aa, Homo Sapiens
SEVEREMDE

SEQ ID NO: 1310740 - protein, 9 aa, Homo Sapiens
GSNQKCQKC

SEQ ID NO: 1310741 - protein, 9 aa, Homo Sapiens
LAVSVIIRV

SEQ ID NO: 1310742 - protein, 9 aa, Homo Sapiens
VEDKSDPPD

SEQ ID NO: 1310743 - protein, 9 aa, Homo Sapiens
KIISTGEKF

SEQ ID NO: 1310744 - protein, 9 aa, Homo Sapiens
IGWMKFRLP

SEQ ID NO: 1310745 - protein, 9 aa, Homo Sapiens
MSLPIFQRV

SEQ ID NO: 1310746 - protein, 9 aa, Homo Sapiens
ASHPLEIVK

SEQ ID NO: 1310747 - protein, 9 aa, Homo Sapiens
DGSEEAAEP

SEQ ID NO: 1310748 - protein, 9 aa, Homo Sapiens
IFQVSGSQV

SEQ ID NO: 1310749 - protein, 9 aa, Homo Sapiens
VKTVQQEES

SEQ ID NO: 1310750 - protein, 9 aa, Homo Sapiens
LPVKLFVRE

SEQ ID NO: 1310751 - protein, 9 aa, Homo Sapiens
SEDLNINLI

SEQ ID NO: 1310752 - protein, 9 aa, Homo Sapiens
RHDWLHIIL

SEQ ID NO: 1310753 - protein, 9 aa, Homo Sapiens
RKRLLEQDK

SEQ ID NO: 1310754 - protein, 9 aa, Homo Sapiens
RHSPAPVSK

SEQ ID NO: 1310755 - protein, 9 aa, Homo Sapiens
DYLQLEQFS

SEQ ID NO: 1310756 - protein, 9 aa, Homo Sapiens
PNHDYIEIW

SEQ ID NO: 1310757 - protein, 9 aa, Homo Sapiens
RHEIHESKN

SEQ ID NO: 1310758 - protein, 9 aa, Homo Sapiens
SDPSNQKIV

SEQ ID NO: 1310759 - protein, 9 aa, Homo Sapiens
LGSVLRYPS

SEQ ID NO: 1310760 - protein, 9 aa, Homo Sapiens
DLPVKLFVR

SEQ ID NO: 1310761 - protein, 9 aa, Homo Sapiens
ETQELYILK

SEQ ID NO: 1310762 - protein, 9 aa, Homo Sapiens
WKELEHLQM

SEQ ID NO: 1310763 - protein, 9 aa, Homo Sapiens
RALKSEDLN

SEQ ID NO: 1310764 - protein, 9 aa, Homo Sapiens
LQVFLCLEM

SEQ ID NO: 1310765 - protein, 9 aa, Homo Sapiens
LNHFIYSLR

SEQ ID NO: 1310766 - protein, 9 aa, Homo Sapiens
ALARSALSY

SEQ ID NO: 1310767 - protein, 9 aa, Homo Sapiens
DTEALSCFI

SEQ ID NO: 1310768 - protein, 9 aa, Homo Sapiens
KGQNKGEKP

SEQ ID NO: 1310769 - protein, 9 aa, Homo Sapiens
VALRKELNA

SEQ ID NO: 1310770 - protein, 9 aa, Homo Sapiens
PFLENYLET

SEQ ID NO: 1310771 - protein, 9 aa, Homo Sapiens
QMFENKLIQ

SEQ ID NO: 1310772 - protein, 9 aa, Homo Sapiens
AGNYLTGHN

SEQ ID NO: 1310773 - protein, 9 aa, Homo Sapiens
DYLSSSLYQ

SEQ ID NO: 1310774 - protein, 9 aa, Homo Sapiens
FEGLKPASH

SEQ ID NO: 1310775 - protein, 9 aa, Homo Sapiens
WAGFFKQNR

SEQ ID NO: 1310776 - protein, 9 aa, Homo Sapiens
FDKMLYNRQ

SEQ ID NO: 1310777 - protein, 9 aa, Homo Sapiens
EDFQYGYSY

SEQ ID NO: 1310778 - protein, 9 aa, Homo Sapiens
NIDRINPEK

SEQ ID NO: 1310779 - protein, 9 aa, Homo Sapiens
LSHNQLSDV

SEQ ID NO: 1310780 - protein, 9 aa, Homo Sapiens
ALIVHQIIH

SEQ ID NO: 1310781 - protein, 9 aa, Homo Sapiens
IKKEKKKIK

SEQ ID NO: 1310782 - protein, 9 aa, Homo Sapiens
TSSLWSTTP

SEQ ID NO: 1310783 - protein, 9 aa, Homo Sapiens
TYMNYTTSK

SEQ ID NO: 1310784 - protein, 9 aa, Homo Sapiens
ENNLTLLNS

SEQ ID NO: 1310785 - protein, 9 aa, Homo Sapiens
YLFFSAQPF

SEQ ID NO: 1310786 - protein, 9 aa, Homo Sapiens
LNETINIGL

SEQ ID NO: 1310787 - protein, 9 aa, Homo Sapiens
RSKLEGISP

SEQ ID NO: 1310788 - protein, 9 aa, Homo Sapiens
FLAKRSNFR

SEQ ID NO: 1310789 - protein, 9 aa, Homo Sapiens
IKKLDTFKS

SEQ ID NO: 1310790 - protein, 9 aa, Homo Sapiens
LVVQPSRPA

SEQ ID NO: 1310791 - protein, 9 aa, Homo Sapiens
ASASSLQCW

SEQ ID NO: 1310792 - protein, 9 aa, Homo Sapiens
DVETGVVFI

SEQ ID NO: 1310793 - protein, 9 aa, Homo Sapiens
KTLVEQHGT

SEQ ID NO: 1310794 - protein, 9 aa, Homo Sapiens
KQVNTRLTL

SEQ ID NO: 1310795 - protein, 9 aa, Homo Sapiens
SFALFFDDI

SEQ ID NO: 1310796 - protein, 9 aa, Homo Sapiens
IRIILFLIT

SEQ ID NO: 1310797 - protein, 9 aa, Homo Sapiens
EESVRGDVR

SEQ ID NO: 1310798 - protein, 9 aa, Homo Sapiens
VQALQHKHE

SEQ ID NO: 1310799 - protein, 9 aa, Homo Sapiens
KNGQGASGT

SEQ ID NO: 1310800 - protein, 9 aa, Homo Sapiens
AGIRALVMY

SEQ ID NO: 1310801 - protein, 9 aa, Homo Sapiens
AEGVLRITE

SEQ ID NO: 1310802 - protein, 9 aa, Homo Sapiens
FYTNFLVSQ

SEQ ID NO: 1310803 - protein, 9 aa, Homo Sapiens
FDKLSLYSV

SEQ ID NO: 1310804 - protein, 9 aa, Homo Sapiens
EEIICRFET

SEQ ID NO: 1310805 - protein, 9 aa, Homo Sapiens
EEFKILNYQ

SEQ ID NO: 1310806 - protein, 9 aa, Homo Sapiens
CSTFVQDFS

SEQ ID NO: 1310807 - protein, 9 aa, Homo Sapiens
WFHLNDGGN

SEQ ID NO: 1310808 - protein, 9 aa, Homo Sapiens
LHKLGLRPG

SEQ ID NO: 1310809 - protein, 9 aa, Homo Sapiens
FMYAVREEV

SEQ ID NO: 1310810 - protein, 9 aa, Homo Sapiens
FCCFEDCQT

SEQ ID NO: 1310811 - protein, 9 aa, Homo Sapiens
GKGFNLPSF

SEQ ID NO: 1310812 - protein, 9 aa, Homo Sapiens
KNMNEDNEG

SEQ ID NO: 1310813 - protein, 9 aa, Homo Sapiens
LSGAPQAGI

SEQ ID NO: 1310814 - protein, 9 aa, Homo Sapiens
KDDLPTRNK

SEQ ID NO: 1310815 - protein, 9 aa, Homo Sapiens
SEPGNGAKY

SEQ ID NO: 1310816 - protein, 9 aa, Homo Sapiens
TKEKLALLD

SEQ ID NO: 1310817 - protein, 9 aa, Homo Sapiens
KSLQAHIKC

SEQ ID NO: 1310818 - protein, 9 aa, Homo Sapiens
TDDIDNISD

SEQ ID NO: 1310819 - protein, 9 aa, Homo Sapiens
PQDKAMHSE

SEQ ID NO: 1310820 - protein, 9 aa, Homo Sapiens
DHNTCEGAF

SEQ ID NO: 1310821 - protein, 9 aa, Homo Sapiens
LQVERCRIN

SEQ ID NO: 1310822 - protein, 9 aa, Homo Sapiens
FPDSDDRKA

SEQ ID NO: 1310823 - protein, 9 aa, Homo Sapiens
DTTAAPITT

SEQ ID NO: 1310824 - protein, 9 aa, Homo Sapiens
AYEYMGHIM

SEQ ID NO: 1310825 - protein, 9 aa, Homo Sapiens
NSVQHLINQ

SEQ ID NO: 1310826 - protein, 9 aa, Homo Sapiens
YRNKYLMWF

SEQ ID NO: 1310827 - protein, 9 aa, Homo Sapiens
KDDGCKTYW

SEQ ID NO: 1310828 - protein, 9 aa, Homo Sapiens
VTKIKLPNT

SEQ ID NO: 1310829 - protein, 9 aa, Homo Sapiens
HTFCEHMDI

SEQ ID NO: 1310830 - protein, 9 aa, Homo Sapiens
YNLLIHERM

SEQ ID NO: 1310831 - protein, 9 aa, Homo Sapiens
RNIQLEYRG

SEQ ID NO: 1310832 - protein, 9 aa, Homo Sapiens
AHYPDYENI

SEQ ID NO: 1310833 - protein, 9 aa, Homo Sapiens
APHSPRLGR

SEQ ID NO: 1310834 - protein, 9 aa, Homo Sapiens
RSIPTTHIS

SEQ ID NO: 1310835 - protein, 9 aa, Homo Sapiens
TQLCFISPG

SEQ ID NO: 1310836 - protein, 9 aa, Homo Sapiens
EYLRPRSQL

SEQ ID NO: 1310837 - protein, 9 aa, Homo Sapiens
PSVYMGIRD

SEQ ID NO: 1310838 - protein, 9 aa, Homo Sapiens
KEEDFNKNM

SEQ ID NO: 1310839 - protein, 9 aa, Homo Sapiens
SGLTSLTDV

SEQ ID NO: 1310840 - protein, 9 aa, Homo Sapiens
RLIRLRRNM

SEQ ID NO: 1310841 - protein, 9 aa, Homo Sapiens
NIIRQNLQM

SEQ ID NO: 1310842 - protein, 9 aa, Homo Sapiens
FCRFVLAYA

SEQ ID NO: 1310843 - protein, 9 aa, Homo Sapiens
FCKIQMEPG

SEQ ID NO: 1310844 - protein, 9 aa, Homo Sapiens
TLSYDQNNG

SEQ ID NO: 1310845 - protein, 9 aa, Homo Sapiens
NNNKNMGQE

SEQ ID NO: 1310846 - protein, 9 aa, Homo Sapiens
VQKRGNSMV

SEQ ID NO: 1310847 - protein, 9 aa, Homo Sapiens
PLEIVKSLS

SEQ ID NO: 1310848 - protein, 9 aa, Homo Sapiens
AFYFNQDDA

SEQ ID NO: 1310849 - protein, 9 aa, Homo Sapiens
SLQAGLSSN

SEQ ID NO: 1310850 - protein, 9 aa, Homo Sapiens
IHHGSADAK

SEQ ID NO: 1310851 - protein, 9 aa, Homo Sapiens
PANIDICDT

SEQ ID NO: 1310852 - protein, 9 aa, Homo Sapiens
DPCVLLPDP

SEQ ID NO: 1310853 - protein, 9 aa, Homo Sapiens
NINLISSEF

SEQ ID NO: 1310854 - protein, 9 aa, Homo Sapiens
NIYLIMEFL

SEQ ID NO: 1310855 - protein, 9 aa, Homo Sapiens
ETRAIYFLV

SEQ ID NO: 1310856 - protein, 9 aa, Homo Sapiens
HEEEEEIRK

SEQ ID NO: 1310857 - protein, 9 aa, Homo Sapiens
ECIILGMMA

SEQ ID NO: 1310858 - protein, 9 aa, Homo Sapiens
GHFDLINYF

SEQ ID NO: 1310859 - protein, 9 aa, Homo Sapiens
LVQLGMAKY

SEQ ID NO: 1310860 - protein, 9 aa, Homo Sapiens
IKYTPQHMH

SEQ ID NO: 1310861 - protein, 9 aa, Homo Sapiens
VDPYYYNKK

SEQ ID NO: 1310862 - protein, 9 aa, Homo Sapiens
KLGIIHPNR

SEQ ID NO: 1310863 - protein, 9 aa, Homo Sapiens
SESFRQPVD

SEQ ID NO: 1310864 - protein, 9 aa, Homo Sapiens
SYAPYKLHG

SEQ ID NO: 1310865 - protein, 9 aa, Homo Sapiens
IKNHYFPAF

SEQ ID NO: 1310866 - protein, 9 aa, Homo Sapiens
ILFNVDRHV

SEQ ID NO: 1310867 - protein, 9 aa, Homo Sapiens
HKATKSKLF

SEQ ID NO: 1310868 - protein, 9 aa, Homo Sapiens
RSPPDKPKQ

SEQ ID NO: 1310869 - protein, 9 aa, Homo Sapiens
LESAAPSSR

SEQ ID NO: 1310870 - protein, 9 aa, Homo Sapiens
AGEDSYGTM

SEQ ID NO: 1310871 - protein, 9 aa, Homo Sapiens
DVNIPRPPG

SEQ ID NO: 1310872 - protein, 9 aa, Homo Sapiens
HPWQLYLSV

SEQ ID NO: 1310873 - protein, 9 aa, Homo Sapiens
EYSSFIIAK

SEQ ID NO: 1310874 - protein, 9 aa, Homo Sapiens
KLHKSHRGM

SEQ ID NO: 1310875 - protein, 9 aa, Homo Sapiens
EKGTIHYLC

SEQ ID NO: 1310876 - protein, 9 aa, Homo Sapiens
RGKMSRITL

SEQ ID NO: 1310877 - protein, 9 aa, Homo Sapiens
DVDPYYYNK

SEQ ID NO: 1310878 - protein, 9 aa, Homo Sapiens
SHQKHIGSI

SEQ ID NO: 1310879 - protein, 9 aa, Homo Sapiens
SMQTSRLMA

SEQ ID NO: 1310880 - protein, 9 aa, Homo Sapiens
KKFSPAGPI

SEQ ID NO: 1310881 - protein, 9 aa, Homo Sapiens
FMGHTFSLP

SEQ ID NO: 1310882 - protein, 9 aa, Homo Sapiens
TFIPRPREE

SEQ ID NO: 1310883 - protein, 9 aa, Homo Sapiens
LYELHSSQH

SEQ ID NO: 1310884 - protein, 9 aa, Homo Sapiens
EKINWEFKN

SEQ ID NO: 1310885 - protein, 9 aa, Homo Sapiens
KIILIRHRE

SEQ ID NO: 1310886 - protein, 9 aa, Homo Sapiens
IPLTVVALI

SEQ ID NO: 1310887 - protein, 9 aa, Homo Sapiens
FIIAKQIFT

SEQ ID NO: 1310888 - protein, 9 aa, Homo Sapiens
IICGKLMRN

SEQ ID NO: 1310889 - protein, 9 aa, Homo Sapiens
DILPLLKLS

SEQ ID NO: 1310890 - protein, 9 aa, Homo Sapiens
LPELTKNNR

SEQ ID NO: 1310891 - protein, 9 aa, Homo Sapiens
FWYEYQSPV

SEQ ID NO: 1310892 - protein, 9 aa, Homo Sapiens
CFKYIENRD

SEQ ID NO: 1310893 - protein, 9 aa, Homo Sapiens
ERDQLLASN

SEQ ID NO: 1310894 - protein, 9 aa, Homo Sapiens
LSFYFDPFD

SEQ ID NO: 1310895 - protein, 9 aa, Homo Sapiens
DHFLGPQKS

SEQ ID NO: 1310896 - protein, 9 aa, Homo Sapiens
GVTVRCWII

SEQ ID NO: 1310897 - protein, 9 aa, Homo Sapiens
PLQRPKMLK

SEQ ID NO: 1310898 - protein, 9 aa, Homo Sapiens
VLLNYYILN

SEQ ID NO: 1310899 - protein, 9 aa, Homo Sapiens
KASNGCVIV

SEQ ID NO: 1310900 - protein, 9 aa, Homo Sapiens
NNVDYETFK

SEQ ID NO: 1310901 - protein, 9 aa, Homo Sapiens
KRVEKYVNK

SEQ ID NO: 1310902 - protein, 9 aa, Homo Sapiens
HSSQHYCGV

SEQ ID NO: 1310903 - protein, 9 aa, Homo Sapiens
PNLEYLRPR

SEQ ID NO: 1310904 - protein, 9 aa, Homo Sapiens
KKKKYVILA

SEQ ID NO: 1310905 - protein, 9 aa, Homo Sapiens
NAHNRHKLI

SEQ ID NO: 1310906 - protein, 9 aa, Homo Sapiens
AATHALGEM

SEQ ID NO: 1310907 - protein, 9 aa, Homo Sapiens
QSFYQMHRA

SEQ ID NO: 1310908 - protein, 9 aa, Homo Sapiens
LASVQALQH

SEQ ID NO: 1310909 - protein, 9 aa, Homo Sapiens
PRITSRTNQ

SEQ ID NO: 1310910 - protein, 9 aa, Homo Sapiens
FTEYLLMIS

SEQ ID NO: 1310911 - protein, 9 aa, Homo Sapiens
VFGVLSGEF

SEQ ID NO: 1310912 - protein, 9 aa, Homo Sapiens
PHSPRLGRA

SEQ ID NO: 1310913 - protein, 9 aa, Homo Sapiens
GAYGKLFLV

SEQ ID NO: 1310914 - protein, 9 aa, Homo Sapiens
ECMRALDER

SEQ ID NO: 1310915 - protein, 9 aa, Homo Sapiens
ELTKNNRPH

SEQ ID NO: 1310916 - protein, 9 aa, Homo Sapiens
KEEEEANKR

SEQ ID NO: 1310917 - protein, 9 aa, Homo Sapiens
SQPKEDTQK

SEQ ID NO: 1310918 - protein, 9 aa, Homo Sapiens
GRGTNKEEM

SEQ ID NO: 1310919 - protein, 9 aa, Homo Sapiens
MSGKQNKDD

SEQ ID NO: 1310920 - protein, 9 aa, Homo Sapiens
EQIKPEEAK

SEQ ID NO: 1310921 - protein, 9 aa, Homo Sapiens
DYITVDSNS

SEQ ID NO: 1310922 - protein, 9 aa, Homo Sapiens
QDGPSIYFN

SEQ ID NO: 1310923 - protein, 9 aa, Homo Sapiens
SALLSGGLR

SEQ ID NO: 1310924 - protein, 9 aa, Homo Sapiens
YSSFIIAKQ

SEQ ID NO: 1310925 - protein, 9 aa, Homo Sapiens
EQRAVKYIW

SEQ ID NO: 1310926 - protein, 9 aa, Homo Sapiens
FTCNVLPII

SEQ ID NO: 1310927 - protein, 9 aa, Homo Sapiens
TAQIVVMQE

SEQ ID NO: 1310928 - protein, 9 aa, Homo Sapiens
EKLCFSAAG

SEQ ID NO: 1310929 - protein, 9 aa, Homo Sapiens
RLNEGKLEA

SEQ ID NO: 1310930 - protein, 9 aa, Homo Sapiens
YWDRRRRAT

SEQ ID NO: 1310931 - protein, 9 aa, Homo Sapiens
NKIFSENSL

SEQ ID NO: 1310932 - protein, 9 aa, Homo Sapiens
ESLGLHSKV

SEQ ID NO: 1310933 - protein, 9 aa, Homo Sapiens
YVPYTEWEL

SEQ ID NO: 1310934 - protein, 9 aa, Homo Sapiens
ALDIYGRTA

SEQ ID NO: 1310935 - protein, 9 aa, Homo Sapiens
GNLSNHKII

SEQ ID NO: 1310936 - protein, 9 aa, Homo Sapiens
CGKAFIHGS

SEQ ID NO: 1310937 - protein, 9 aa, Homo Sapiens
TQSYYRNSV

SEQ ID NO: 1310938 - protein, 9 aa, Homo Sapiens
QTFWQASQV

SEQ ID NO: 1310939 - protein, 9 aa, Homo Sapiens
DFLEPEGSI

SEQ ID NO: 1310940 - protein, 9 aa, Homo Sapiens
ENAHNRHKL

SEQ ID NO: 1310941 - protein, 9 aa, Homo Sapiens
FAEGVLRIT

SEQ ID NO: 1310942 - protein, 9 aa, Homo Sapiens
FLEPEGSIT

SEQ ID NO: 1310943 - protein, 9 aa, Homo Sapiens
DKRVTRLVL

SEQ ID NO: 1310944 - protein, 9 aa, Homo Sapiens
PPASEVLQI

SEQ ID NO: 1310945 - protein, 9 aa, Homo Sapiens
YEAIDSQLV

SEQ ID NO: 1310946 - protein, 9 aa, Homo Sapiens
RKLLSNKNI

SEQ ID NO: 1310947 - protein, 9 aa, Homo Sapiens
TSAGPTNLQ

SEQ ID NO: 1310948 - protein, 9 aa, Homo Sapiens
IVVAMFIVV

SEQ ID NO: 1310949 - protein, 9 aa, Homo Sapiens
QRLFARGED

SEQ ID NO: 1310950 - protein, 9 aa, Homo Sapiens
LDGSCRNLL

SEQ ID NO: 1310951 - protein, 9 aa, Homo Sapiens
AIAFPSAKF

SEQ ID NO: 1310952 - protein, 9 aa, Homo Sapiens
DSLKANLHV

SEQ ID NO: 1310953 - protein, 9 aa, Homo Sapiens
NLLFWYQLF

SEQ ID NO: 1310954 - protein, 9 aa, Homo Sapiens
VLCIFMFVI

SEQ ID NO: 1310955 - protein, 9 aa, Homo Sapiens
SQHYCGVCL

SEQ ID NO: 1310956 - protein, 9 aa, Homo Sapiens
LSTQVPALQ

SEQ ID NO: 1310957 - protein, 9 aa, Homo Sapiens
PETNNNITR

SEQ ID NO: 1310958 - protein, 9 aa, Homo Sapiens
TNAIQWMSP

SEQ ID NO: 1310959 - protein, 9 aa, Homo Sapiens
PAGDYWKKM

SEQ ID NO: 1310960 - protein, 9 aa, Homo Sapiens
ADHLLAAGK

SEQ ID NO: 1310961 - protein, 9 aa, Homo Sapiens
MEFSLFYDT

SEQ ID NO: 1310962 - protein, 9 aa, Homo Sapiens
HAYSNKLSH

SEQ ID NO: 1310963 - protein, 9 aa, Homo Sapiens
KDDWASNKV

SEQ ID NO: 1310964 - protein, 9 aa, Homo Sapiens
LQCQRDSEN

SEQ ID NO: 1310965 - protein, 9 aa, Homo Sapiens
EFNQIDASV

SEQ ID NO: 1310966 - protein, 9 aa, Homo Sapiens
TREEVLQLS

SEQ ID NO: 1310967 - protein, 9 aa, Homo Sapiens
EEAEEPDNN

SEQ ID NO: 1310968 - protein, 9 aa, Homo Sapiens
TFSLPVYKG

SEQ ID NO: 1310969 - protein, 9 aa, Homo Sapiens
SKNHLSSVS

SEQ ID NO: 1310970 - protein, 9 aa, Homo Sapiens
GIMTDKRYI

SEQ ID NO: 1310971 - protein, 9 aa, Homo Sapiens
RCFKYIENR

SEQ ID NO: 1310972 - protein, 9 aa, Homo Sapiens
LGNIANTSV

SEQ ID NO: 1310973 - protein, 9 aa, Homo Sapiens
EAQNISRSP

SEQ ID NO: 1310974 - protein, 9 aa, Homo Sapiens
RPFPVCPIP

SEQ ID NO: 1310975 - protein, 9 aa, Homo Sapiens
DLLGFTGPL

SEQ ID NO: 1310976 - protein, 9 aa, Homo Sapiens
IISFNWCMA

SEQ ID NO: 1310977 - protein, 9 aa, Homo Sapiens
RHQTLPERN

SEQ ID NO: 1310978 - protein, 9 aa, Homo Sapiens
TPHYVCCIK

SEQ ID NO: 1310979 - protein, 9 aa, Homo Sapiens
LLTTTSEII

SEQ ID NO: 1310980 - protein, 9 aa, Homo Sapiens
FGRTALHLA

SEQ ID NO: 1310981 - protein, 9 aa, Homo Sapiens
PCLRGDKDP

SEQ ID NO: 1310982 - protein, 9 aa, Homo Sapiens
TTNLSKPLM

SEQ ID NO: 1310983 - protein, 9 aa, Homo Sapiens
ISLPNKYNL

SEQ ID NO: 1310984 - protein, 9 aa, Homo Sapiens
CWHGSKDEE

SEQ ID NO: 1310985 - protein, 9 aa, Homo Sapiens
QQSRRADHL

SEQ ID NO: 1310986 - protein, 9 aa, Homo Sapiens
DESGYLTFS

SEQ ID NO: 1310987 - protein, 9 aa, Homo Sapiens
EDLNINLIS

SEQ ID NO: 1310988 - protein, 9 aa, Homo Sapiens
NNNSLESSL

SEQ ID NO: 1310989 - protein, 9 aa, Homo Sapiens
HSPAPVSKS

SEQ ID NO: 1310990 - protein, 9 aa, Homo Sapiens
PKEATTINL

SEQ ID NO: 1310991 - protein, 9 aa, Homo Sapiens
VHFTASSVK

SEQ ID NO: 1310992 - protein, 9 aa, Homo Sapiens
YEVCLTLYG

SEQ ID NO: 1310993 - protein, 9 aa, Homo Sapiens
FANYSVLCL

SEQ ID NO: 1310994 - protein, 9 aa, Homo Sapiens
RDNVFGKTL

SEQ ID NO: 1310995 - protein, 9 aa, Homo Sapiens
LKIHGKNNW

SEQ ID NO: 1310996 - protein, 9 aa, Homo Sapiens
NILKPEIME

SEQ ID NO: 1310997 - protein, 9 aa, Homo Sapiens
SERNKWIHC

SEQ ID NO: 1310998 - protein, 9 aa, Homo Sapiens
VKSFQMQNT

SEQ ID NO: 1310999 - protein, 9 aa, Homo Sapiens
TSFYVGASI

SEQ ID NO: 1311000 - protein, 9 aa, Homo Sapiens
WTIQWPMTE

SEQ ID NO: 1311001 - protein, 9 aa, Homo Sapiens
YKKFSPAGP

SEQ ID NO: 1311002 - protein, 9 aa, Homo Sapiens
RFNKIINSM

SEQ ID NO: 1311003 - protein, 9 aa, Homo Sapiens
MHTDERPYT

SEQ ID NO: 1311004 - protein, 9 aa, Homo Sapiens
TLKNYLFFS

SEQ ID NO: 1311005 - protein, 9 aa, Homo Sapiens
GGLFNSGCS

SEQ ID NO: 1311006 - protein, 9 aa, Homo Sapiens
ELSDDWAAN

SEQ ID NO: 1311007 - protein, 9 aa, Homo Sapiens
NSGPKVHKR

SEQ ID NO: 1311008 - protein, 9 aa, Homo Sapiens
QRSERNKWI

SEQ ID NO: 1311009 - protein, 9 aa, Homo Sapiens
EHIGDKPYR

SEQ ID NO: 1311010 - protein, 9 aa, Homo Sapiens
HSQLLQMVL

SEQ ID NO: 1311011 - protein, 9 aa, Homo Sapiens
MVLYVAAAM

SEQ ID NO: 1311012 - protein, 9 aa, Homo Sapiens
YALLGKYFR

SEQ ID NO: 1311013 - protein, 9 aa, Homo Sapiens
WSMSKDFSP

SEQ ID NO: 1311014 - protein, 9 aa, Homo Sapiens
PQIGWYNRF

SEQ ID NO: 1311015 - protein, 9 aa, Homo Sapiens
NLLIHERMH

SEQ ID NO: 1311016 - protein, 9 aa, Homo Sapiens
LSGDDIDED

SEQ ID NO: 1311017 - protein, 9 aa, Homo Sapiens
SCFKSIITA

SEQ ID NO: 1311018 - protein, 9 aa, Homo Sapiens
PTNLQIEYQ

SEQ ID NO: 1311019 - protein, 9 aa, Homo Sapiens
VMYFFYKNT

SEQ ID NO: 1311020 - protein, 9 aa, Homo Sapiens
YETIEAYKD

SEQ ID NO: 1311021 - protein, 9 aa, Homo Sapiens
GLLDISLGA

SEQ ID NO: 1311022 - protein, 9 aa, Homo Sapiens
CKPPVCLLL

SEQ ID NO: 1311023 - protein, 9 aa, Homo Sapiens
IETGIMTDK

SEQ ID NO: 1311024 - protein, 9 aa, Homo Sapiens
LNVQKRKQS

SEQ ID NO: 1311025 - protein, 9 aa, Homo Sapiens
DKVEEGPSE

SEQ ID NO: 1311026 - protein, 9 aa, Homo Sapiens
YLVQEACHF

SEQ ID NO: 1311027 - protein, 9 aa, Homo Sapiens
KFGGSNQKC

SEQ ID NO: 1311028 - protein, 9 aa, Homo Sapiens
IQERHGDYL

SEQ ID NO: 1311029 - protein, 9 aa, Homo Sapiens
KTYLSGNYF

SEQ ID NO: 1311030 - protein, 9 aa, Homo Sapiens
LHRINITHF

SEQ ID NO: 1311031 - protein, 9 aa, Homo Sapiens
LFNGCHSGE

SEQ ID NO: 1311032 - protein, 9 aa, Homo Sapiens
LREERLDGH

SEQ ID NO: 1311033 - protein, 9 aa, Homo Sapiens
LFIALYLAN

SEQ ID NO: 1311034 - protein, 9 aa, Homo Sapiens
VSHIRPAAD

SEQ ID NO: 1311035 - protein, 9 aa, Homo Sapiens
TTIHYDIIT

SEQ ID NO: 1311036 - protein, 9 aa, Homo Sapiens
KNNMNSTLN

SEQ ID NO: 1311037 - protein, 9 aa, Homo Sapiens
LIENLDAIQ

SEQ ID NO: 1311038 - protein, 9 aa, Homo Sapiens
IYTSQEEII

SEQ ID NO: 1311039 - protein, 9 aa, Homo Sapiens
RYKLMSRID

SEQ ID NO: 1311040 - protein, 9 aa, Homo Sapiens
KLSHLRSQI

SEQ ID NO: 1311041 - protein, 9 aa, Homo Sapiens
SSLSNHECW

SEQ ID NO: 1311042 - protein, 9 aa, Homo Sapiens
HKKTNLCKR

SEQ ID NO: 1311043 - protein, 9 aa, Homo Sapiens
DEDKEKKYM

SEQ ID NO: 1311044 - protein, 9 aa, Homo Sapiens
FIILLVSYL

SEQ ID NO: 1311045 - protein, 9 aa, Homo Sapiens
ETLLKPSRR

SEQ ID NO: 1311046 - protein, 9 aa, Homo Sapiens
ADRVHTSKS

SEQ ID NO: 1311047 - protein, 9 aa, Homo Sapiens
IQFEEVIQE

SEQ ID NO: 1311048 - protein, 9 aa, Homo Sapiens
VLAVKSFQM

SEQ ID NO: 1311049 - protein, 9 aa, Homo Sapiens
LRRIQRQTP

SEQ ID NO: 1311050 - protein, 9 aa, Homo Sapiens
AVPGSRKHY

SEQ ID NO: 1311051 - protein, 9 aa, Homo Sapiens
VSKMYLNTL

SEQ ID NO: 1311052 - protein, 9 aa, Homo Sapiens
QIHSGEKPY

SEQ ID NO: 1311053 - protein, 9 aa, Homo Sapiens
LEEKDKALG

SEQ ID NO: 1311054 - protein, 9 aa, Homo Sapiens
NKKKEAAQK

SEQ ID NO: 1311055 - protein, 9 aa, Homo Sapiens
QTAIEGNYL

SEQ ID NO: 1311056 - protein, 9 aa, Homo Sapiens
NLKVPECRL

SEQ ID NO: 1311057 - protein, 9 aa, Homo Sapiens
EPSMFIVLR

SEQ ID NO: 1311058 - protein, 9 aa, Homo Sapiens
EDDKLKTLV

SEQ ID NO: 1311059 - protein, 9 aa, Homo Sapiens
ATQEGKWKA

SEQ ID NO: 1311060 - protein, 9 aa, Homo Sapiens
TIHYLCKFL

SEQ ID NO: 1311061 - protein, 9 aa, Homo Sapiens
YRLLLPQIK

SEQ ID NO: 1311062 - protein, 9 aa, Homo Sapiens
GYERDFLQY

SEQ ID NO: 1311063 - protein, 9 aa, Homo Sapiens
PLPEGQAPC

SEQ ID NO: 1311064 - protein, 9 aa, Homo Sapiens
YKLESCVAL

SEQ ID NO: 1311065 - protein, 9 aa, Homo Sapiens
VGVGKSALT

SEQ ID NO: 1311066 - protein, 9 aa, Homo Sapiens
CSLNALDNI

SEQ ID NO: 1311067 - protein, 9 aa, Homo Sapiens
ELTLHQKIH

SEQ ID NO: 1311068 - protein, 9 aa, Homo Sapiens
ILLNTVVLA

SEQ ID NO: 1311069 - protein, 9 aa, Homo Sapiens
QLSDVGGEH

SEQ ID NO: 1311070 - protein, 9 aa, Homo Sapiens
IQQFKAESE

SEQ ID NO: 1311071 - protein, 9 aa, Homo Sapiens
YVFKEINTQ

SEQ ID NO: 1311072 - protein, 9 aa, Homo Sapiens
WLKRNIGYF

SEQ ID NO: 1311073 - protein, 9 aa, Homo Sapiens
EAMALTSTI

SEQ ID NO: 1311074 - protein, 9 aa, Homo Sapiens
QQDVGDFPE

SEQ ID NO: 1311075 - protein, 9 aa, Homo Sapiens
VPESITVGY

SEQ ID NO: 1311076 - protein, 9 aa, Homo Sapiens
RDIQLARRI

SEQ ID NO: 1311077 - protein, 9 aa, Homo Sapiens
RKQVEEMFN

SEQ ID NO: 1311078 - protein, 9 aa, Homo Sapiens
SFRFHKEDK

SEQ ID NO: 1311079 - protein, 9 aa, Homo Sapiens
VQRYTNAIQ

SEQ ID NO: 1311080 - protein, 9 aa, Homo Sapiens
LGDKPYRCC

SEQ ID NO: 1311081 - protein, 9 aa, Homo Sapiens
CFISPGPSP

SEQ ID NO: 1311082 - protein, 9 aa, Homo Sapiens
DKKLSENTD

SEQ ID NO: 1311083 - protein, 9 aa, Homo Sapiens
ERSHTGEKS

SEQ ID NO: 1311084 - protein, 9 aa, Homo Sapiens
TDAFSFLAK

SEQ ID NO: 1311085 - protein, 9 aa, Homo Sapiens
TKIFDVGTR

SEQ ID NO: 1311086 - protein, 9 aa, Homo Sapiens
EAMLYKKFS

SEQ ID NO: 1311087 - protein, 9 aa, Homo Sapiens
FGGQKPENI

SEQ ID NO: 1311088 - protein, 9 aa, Homo Sapiens
ISPRHYGEL

SEQ ID NO: 1311089 - protein, 9 aa, Homo Sapiens
PVTRYSDAQ

SEQ ID NO: 1311090 - protein, 9 aa, Homo Sapiens
RIKLWEMDN

SEQ ID NO: 1311091 - protein, 9 aa, Homo Sapiens
LLDTMPVRS

SEQ ID NO: 1311092 - protein, 9 aa, Homo Sapiens
TAFTKVLHF

SEQ ID NO: 1311093 - protein, 9 aa, Homo Sapiens
DKFIFSLTS

SEQ ID NO: 1311094 - protein, 9 aa, Homo Sapiens
EPQDKKLSE

SEQ ID NO: 1311095 - protein, 9 aa, Homo Sapiens
AKDNFYRVA

SEQ ID NO: 1311096 - protein, 9 aa, Homo Sapiens
TQKNQLISF

SEQ ID NO: 1311097 - protein, 9 aa, Homo Sapiens
SGISIKQVV

SEQ ID NO: 1311098 - protein, 9 aa, Homo Sapiens
MVYEWRTGT

SEQ ID NO: 1311099 - protein, 9 aa, Homo Sapiens
GKLFLVRKI

SEQ ID NO: 1311100 - protein, 9 aa, Homo Sapiens
KFYGKQCCN

SEQ ID NO: 1311101 - protein, 9 aa, Homo Sapiens
LGIIHPNRQ

SEQ ID NO: 1311102 - protein, 9 aa, Homo Sapiens
TELALKEND

SEQ ID NO: 1311103 - protein, 9 aa, Homo Sapiens
CKENICSCN

SEQ ID NO: 1311104 - protein, 9 aa, Homo Sapiens
LDIRHELNR

SEQ ID NO: 1311105 - protein, 9 aa, Homo Sapiens
PKAKVRDAP

SEQ ID NO: 1311106 - protein, 9 aa, Homo Sapiens
HLEYFPMDV

SEQ ID NO: 1311107 - protein, 9 aa, Homo Sapiens
RHHQIHTGE

SEQ ID NO: 1311108 - protein, 9 aa, Homo Sapiens
QIQNILTEE

SEQ ID NO: 1311109 - protein, 9 aa, Homo Sapiens
SEPQDKKLS

SEQ ID NO: 1311110 - protein, 9 aa, Homo Sapiens
SNVTSPLES

SEQ ID NO: 1311111 - protein, 9 aa, Homo Sapiens
RHPYGVASV

SEQ ID NO: 1311112 - protein, 9 aa, Homo Sapiens
PCVLLPDPA

SEQ ID NO: 1311113 - protein, 9 aa, Homo Sapiens
SFNNIYGIV

SEQ ID NO: 1311114 - protein, 9 aa, Homo Sapiens
MGFPGHQGP

SEQ ID NO: 1311115 - protein, 9 aa, Homo Sapiens
NHCTEITSA

SEQ ID NO: 1311116 - protein, 9 aa, Homo Sapiens
DKAIGNTLF

SEQ ID NO: 1311117 - protein, 9 aa, Homo Sapiens
YNHKEWIEI

SEQ ID NO: 1311118 - protein, 9 aa, Homo Sapiens
SFYDLQREF

SEQ ID NO: 1311119 - protein, 9 aa, Homo Sapiens
EDHNTCEGA

SEQ ID NO: 1311120 - protein, 9 aa, Homo Sapiens
YAPYKLHGP

SEQ ID NO: 1311121 - protein, 9 aa, Homo Sapiens
DPNKISEDG

SEQ ID NO: 1311122 - protein, 9 aa, Homo Sapiens
GFPDSLKAY

SEQ ID NO: 1311123 - protein, 9 aa, Homo Sapiens
ISASAPNPN

SEQ ID NO: 1311124 - protein, 9 aa, Homo Sapiens
QDPNDNTKF

SEQ ID NO: 1311125 - protein, 9 aa, Homo Sapiens
HYENTIEYD

SEQ ID NO: 1311126 - protein, 9 aa, Homo Sapiens
GIICGKLMR

SEQ ID NO: 1311127 - protein, 9 aa, Homo Sapiens
FPPTKRGPY

SEQ ID NO: 1311128 - protein, 9 aa, Homo Sapiens
TSNNIKDDT

SEQ ID NO: 1311129 - protein, 9 aa, Homo Sapiens
RARGSPFVW

SEQ ID NO: 1311130 - protein, 9 aa, Homo Sapiens
QVEAVAEAE

SEQ ID NO: 1311131 - protein, 9 aa, Homo Sapiens
LVQCHPNTH

SEQ ID NO: 1311132 - protein, 9 aa, Homo Sapiens
WEVGVHGIQ

SEQ ID NO: 1311133 - protein, 9 aa, Homo Sapiens
KVDSQPKED

SEQ ID NO: 1311134 - protein, 9 aa, Homo Sapiens
NISDGIGDK

SEQ ID NO: 1311135 - protein, 9 aa, Homo Sapiens
RSWTTADTV

SEQ ID NO: 1311136 - protein, 9 aa, Homo Sapiens
NYQNKALKS

SEQ ID NO: 1311137 - protein, 9 aa, Homo Sapiens
MYLNTLATV

SEQ ID NO: 1311138 - protein, 9 aa, Homo Sapiens
NYENPSSYN

SEQ ID NO: 1311139 - protein, 9 aa, Homo Sapiens
TPTQIKEMF

SEQ ID NO: 1311140 - protein, 9 aa, Homo Sapiens
ATRWQVGIH

SEQ ID NO: 1311141 - protein, 9 aa, Homo Sapiens
YEQDELYEL

SEQ ID NO: 1311142 - protein, 9 aa, Homo Sapiens
VRAESMRSF

SEQ ID NO: 1311143 - protein, 9 aa, Homo Sapiens
SSIAPVIVH

SEQ ID NO: 1311144 - protein, 9 aa, Homo Sapiens
TPAACLNFN

SEQ ID NO: 1311145 - protein, 9 aa, Homo Sapiens
KILVNYGDA

SEQ ID NO: 1311146 - protein, 9 aa, Homo Sapiens
EAMVGTINM

SEQ ID NO: 1311147 - protein, 9 aa, Homo Sapiens
YLKEQGQVP

SEQ ID NO: 1311148 - protein, 9 aa, Homo Sapiens
EGKWKALKR

SEQ ID NO: 1311149 - protein, 9 aa, Homo Sapiens
LIRHHQIHT

SEQ ID NO: 1311150 - protein, 9 aa, Homo Sapiens
QIDREEKAF

SEQ ID NO: 1311151 - protein, 9 aa, Homo Sapiens
NRQKEQDKY

SEQ ID NO: 1311152 - protein, 9 aa, Homo Sapiens
SRTTELQDK

SEQ ID NO: 1311153 - protein, 9 aa, Homo Sapiens
SFQDKRNIY

SEQ ID NO: 1311154 - protein, 9 aa, Homo Sapiens
SLFLFIWFI

SEQ ID NO: 1311155 - protein, 9 aa, Homo Sapiens
LSKLPNLEY

SEQ ID NO: 1311156 - protein, 9 aa, Homo Sapiens
QRYKNQKFG

SEQ ID NO: 1311157 - protein, 9 aa, Homo Sapiens
SSLQIHERT

SEQ ID NO: 1311158 - protein, 9 aa, Homo Sapiens
KTDLADKRH

SEQ ID NO: 1311159 - protein, 9 aa, Homo Sapiens
SPSTTQATS

SEQ ID NO: 1311160 - protein, 9 aa, Homo Sapiens
RALTNLNGK

SEQ ID NO: 1311161 - protein, 9 aa, Homo Sapiens
RIVRQEALQ

SEQ ID NO: 1311162 - protein, 9 aa, Homo Sapiens
DMSEPQDKK

SEQ ID NO: 1311163 - protein, 9 aa, Homo Sapiens
SKVQGWKQR

SEQ ID NO: 1311164 - protein, 9 aa, Homo Sapiens
DSKLFENKV

SEQ ID NO: 1311165 - protein, 9 aa, Homo Sapiens
EYLILREPG

SEQ ID NO: 1311166 - protein, 9 aa, Homo Sapiens
QRAKTINNT

SEQ ID NO: 1311167 - protein, 9 aa, Homo Sapiens
SMHLSNYRI

SEQ ID NO: 1311168 - protein, 9 aa, Homo Sapiens
VQLGMAKYD

SEQ ID NO: 1311169 - protein, 9 aa, Homo Sapiens
GPSTFSREN

SEQ ID NO: 1311170 - protein, 9 aa, Homo Sapiens
VVFTKEKLA

SEQ ID NO: 1311171 - protein, 9 aa, Homo Sapiens
PQWVLTAVH

SEQ ID NO: 1311172 - protein, 9 aa, Homo Sapiens
INLKVAKNG

SEQ ID NO: 1311173 - protein, 9 aa, Homo Sapiens
SYKMSDNIP

SEQ ID NO: 1311174 - protein, 9 aa, Homo Sapiens
AEYLILREP

SEQ ID NO: 1311175 - protein, 9 aa, Homo Sapiens
IWKKEIYKE

SEQ ID NO: 1311176 - protein, 9 aa, Homo Sapiens
EAAYKIVLY

SEQ ID NO: 1311177 - protein, 9 aa, Homo Sapiens
YPSFFSNPQ

SEQ ID NO: 1311178 - protein, 9 aa, Homo Sapiens
VKYKSSNKQ

SEQ ID NO: 1311179 - protein, 9 aa, Homo Sapiens
TNSQNKIKQ

SEQ ID NO: 1311180 - protein, 9 aa, Homo Sapiens
APCLPQARG

SEQ ID NO: 1311181 - protein, 9 aa, Homo Sapiens
EVKILESAA

SEQ ID NO: 1311182 - protein, 9 aa, Homo Sapiens
QQNISASAP

SEQ ID NO: 1311183 - protein, 9 aa, Homo Sapiens
LNKMQSLWE

SEQ ID NO: 1311184 - protein, 9 aa, Homo Sapiens
DRSMKNNNQ

SEQ ID NO: 1311185 - protein, 9 aa, Homo Sapiens
GRLDQLDEV

SEQ ID NO: 1311186 - protein, 9 aa, Homo Sapiens
EVGWKYQTV

SEQ ID NO: 1311187 - protein, 9 aa, Homo Sapiens
KMYRNVYKK

SEQ ID NO: 1311188 - protein, 9 aa, Homo Sapiens
YLLSDNVHF

SEQ ID NO: 1311189 - protein, 9 aa, Homo Sapiens
TVFSFLKHS

SEQ ID NO: 1311190 - protein, 9 aa, Homo Sapiens
GEGPSTFSR

SEQ ID NO: 1311191 - protein, 9 aa, Homo Sapiens
RCYEHKQYI

SEQ ID NO: 1311192 - protein, 9 aa, Homo Sapiens
ESGIDQIIS

SEQ ID NO: 1311193 - protein, 9 aa, Homo Sapiens
EHEEEEEIR

SEQ ID NO: 1311194 - protein, 9 aa, Homo Sapiens
WEVVRAESM

SEQ ID NO: 1311195 - protein, 9 aa, Homo Sapiens
RINLFIALY

SEQ ID NO: 1311196 - protein, 9 aa, Homo Sapiens
LNGIEWIIE

SEQ ID NO: 1311197 - protein, 9 aa, Homo Sapiens
LNNGRLTVG

SEQ ID NO: 1311198 - protein, 9 aa, Homo Sapiens
YSRYFLLKL

SEQ ID NO: 1311199 - protein, 9 aa, Homo Sapiens
KDYLITPHV

SEQ ID NO: 1311200 - protein, 9 aa, Homo Sapiens
NVLPIIKGL

SEQ ID NO: 1311201 - protein, 9 aa, Homo Sapiens
RRATPHSYS

SEQ ID NO: 1311202 - protein, 9 aa, Homo Sapiens
FNKNMNEDN

SEQ ID NO: 1311203 - protein, 9 aa, Homo Sapiens
NRTLTVHQI

SEQ ID NO: 1311204 - protein, 9 aa, Homo Sapiens
ASLPHQIKN

SEQ ID NO: 1311205 - protein, 9 aa, Homo Sapiens
IDFIYRTVE

SEQ ID NO: 1311206 - protein, 9 aa, Homo Sapiens
GFIGSPGEV

SEQ ID NO: 1311207 - protein, 9 aa, Homo Sapiens
ISPGPSPQS

SEQ ID NO: 1311208 - protein, 9 aa, Homo Sapiens
DEIIVLNQG

SEQ ID NO: 1311209 - protein, 9 aa, Homo Sapiens
HESGEQNKK

SEQ ID NO: 1311210 - protein, 9 aa, Homo Sapiens
EKVVSIHQY

SEQ ID NO: 1311211 - protein, 9 aa, Homo Sapiens
YGKLFLVRK

SEQ ID NO: 1311212 - protein, 9 aa, Homo Sapiens
NEAFSGIQI

SEQ ID NO: 1311213 - protein, 9 aa, Homo Sapiens
PASHPLEIV

SEQ ID NO: 1311214 - protein, 9 aa, Homo Sapiens
KVEWSMSKD

SEQ ID NO: 1311215 - protein, 9 aa, Homo Sapiens
ISLSSLIAG

SEQ ID NO: 1311216 - protein, 9 aa, Homo Sapiens
KTENARLIV

SEQ ID NO: 1311217 - protein, 9 aa, Homo Sapiens
SFKTYLSGN

SEQ ID NO: 1311218 - protein, 9 aa, Homo Sapiens
NVCTLHGGK

SEQ ID NO: 1311219 - protein, 9 aa, Homo Sapiens
ECSLHEPLY

SEQ ID NO: 1311220 - protein, 9 aa, Homo Sapiens
GIHQIIHTG

SEQ ID NO: 1311221 - protein, 9 aa, Homo Sapiens
PDSLQINQK

SEQ ID NO: 1311222 - protein, 9 aa, Homo Sapiens
DDIDNISDG

SEQ ID NO: 1311223 - protein, 9 aa, Homo Sapiens
ENGPILLDT

SEQ ID NO: 1311224 - protein, 9 aa, Homo Sapiens
AIILPQPPE

SEQ ID NO: 1311225 - protein, 9 aa, Homo Sapiens
MRKEEEEAN

SEQ ID NO: 1311226 - protein, 9 aa, Homo Sapiens
NLSNHKIIH

SEQ ID NO: 1311227 - protein, 9 aa, Homo Sapiens
IFIHCSAGC

SEQ ID NO: 1311228 - protein, 9 aa, Homo Sapiens
TENARLIVQ

SEQ ID NO: 1311229 - protein, 9 aa, Homo Sapiens
KSQGCLSVG

SEQ ID NO: 1311230 - protein, 9 aa, Homo Sapiens
SLLDTMPVR

SEQ ID NO: 1311231 - protein, 9 aa, Homo Sapiens
ICRKCSENC

SEQ ID NO: 1311232 - protein, 9 aa, Homo Sapiens
GVEHDKIKS

SEQ ID NO: 1311233 - protein, 9 aa, Homo Sapiens
IVHWKPSDK

SEQ ID NO: 1311234 - protein, 9 aa, Homo Sapiens
DDKFIFSLT

SEQ ID NO: 1311235 - protein, 9 aa, Homo Sapiens
SFTKTPHNI

SEQ ID NO: 1311236 - protein, 9 aa, Homo Sapiens
MPGSVSCFT

SEQ ID NO: 1311237 - protein, 9 aa, Homo Sapiens
TNQTEQNCQ

SEQ ID NO: 1311238 - protein, 9 aa, Homo Sapiens
CWMLDNVRN

SEQ ID NO: 1311239 - protein, 9 aa, Homo Sapiens
LWVLVVLDT

SEQ ID NO: 1311240 - protein, 9 aa, Homo Sapiens
NIETGIMTD

SEQ ID NO: 1311241 - protein, 9 aa, Homo Sapiens
MRALDERPW

SEQ ID NO: 1311242 - protein, 9 aa, Homo Sapiens
WSDYVAPTA

SEQ ID NO: 1311243 - protein, 9 aa, Homo Sapiens
GDTISLLCA

SEQ ID NO: 1311244 - protein, 9 aa, Homo Sapiens
LFSFACGRA

SEQ ID NO: 1311245 - protein, 9 aa, Homo Sapiens
FVQDFSNCS

SEQ ID NO: 1311246 - protein, 9 aa, Homo Sapiens
GLSSTYAEQ

SEQ ID NO: 1311247 - protein, 9 aa, Homo Sapiens
QALAATHAL

SEQ ID NO: 1311248 - protein, 9 aa, Homo Sapiens
QSYYRNSVG

SEQ ID NO: 1311249 - protein, 9 aa, Homo Sapiens
RLGQLRRIQ

SEQ ID NO: 1311250 - protein, 9 aa, Homo Sapiens
NVIEKTETS

SEQ ID NO: 1311251 - protein, 9 aa, Homo Sapiens
VSFQTHMIM

SEQ ID NO: 1311252 - protein, 9 aa, Homo Sapiens
LEGISPSVY

SEQ ID NO: 1311253 - protein, 9 aa, Homo Sapiens
PNNVLNDWS

SEQ ID NO: 1311254 - protein, 9 aa, Homo Sapiens
KDYSQRPLF

SEQ ID NO: 1311255 - protein, 9 aa, Homo Sapiens
NCLPKSSPN

SEQ ID NO: 1311256 - protein, 9 aa, Homo Sapiens
SKQETVIFL

SEQ ID NO: 1311257 - protein, 9 aa, Homo Sapiens
IKYPDNFFL

SEQ ID NO: 1311258 - protein, 9 aa, Homo Sapiens
SIHLFRPRC

SEQ ID NO: 1311259 - protein, 9 aa, Homo Sapiens
KIKINKDIL

SEQ ID NO: 1311260 - protein, 9 aa, Homo Sapiens
YQNNYFRRR

SEQ ID NO: 1311261 - protein, 9 aa, Homo Sapiens
MVKSKSALL

SEQ ID NO: 1311262 - protein, 9 aa, Homo Sapiens
VFSKLPRNL

SEQ ID NO: 1311263 - protein, 9 aa, Homo Sapiens
QIKEMFQSA

SEQ ID NO: 1311264 - protein, 9 aa, Homo Sapiens
ASSIDDAPV

SEQ ID NO: 1311265 - protein, 9 aa, Homo Sapiens
IWNGPYETS

SEQ ID NO: 1311266 - protein, 9 aa, Homo Sapiens
QHKHEGFER

SEQ ID NO: 1311267 - protein, 9 aa, Homo Sapiens
EYKMNTKAG

SEQ ID NO: 1311268 - protein, 9 aa, Homo Sapiens
YLRTRIKLW

SEQ ID NO: 1311269 - protein, 9 aa, Homo Sapiens
STQVPALQS

SEQ ID NO: 1311270 - protein, 9 aa, Homo Sapiens
INLSILAET

SEQ ID NO: 1311271 - protein, 9 aa, Homo Sapiens
SKISGILTF

SEQ ID NO: 1311272 - protein, 9 aa, Homo Sapiens
KAGKGGTGV

SEQ ID NO: 1311273 - protein, 9 aa, Homo Sapiens
PDKLLALDE

SEQ ID NO: 1311274 - protein, 9 aa, Homo Sapiens
HRWPLRLSR

SEQ ID NO: 1311275 - protein, 9 aa, Homo Sapiens
EFIILLVSY

SEQ ID NO: 1311276 - protein, 9 aa, Homo Sapiens
WDAVKREAA

SEQ ID NO: 1311277 - protein, 9 aa, Homo Sapiens
IINSTNRQE

SEQ ID NO: 1311278 - protein, 9 aa, Homo Sapiens
FMFVIFLAG

SEQ ID NO: 1311279 - protein, 9 aa, Homo Sapiens
HDVEALCQT

SEQ ID NO: 1311280 - protein, 9 aa, Homo Sapiens
DKLKTLVEQ

SEQ ID NO: 1311281 - protein, 9 aa, Homo Sapiens
LPMCILGAL

SEQ ID NO: 1311282 - protein, 9 aa, Homo Sapiens
KEIYKESST

SEQ ID NO: 1311283 - protein, 9 aa, Homo Sapiens
NAVEIINST

SEQ ID NO: 1311284 - protein, 9 aa, Homo Sapiens
ETNNNITRG

SEQ ID NO: 1311285 - protein, 9 aa, Homo Sapiens
GRETIYYNA

SEQ ID NO: 1311286 - protein, 9 aa, Homo Sapiens
KWMVCLTFK

SEQ ID NO: 1311287 - protein, 9 aa, Homo Sapiens
FVSGKTLFL

SEQ ID NO: 1311288 - protein, 9 aa, Homo Sapiens
GKWKALKRK

SEQ ID NO: 1311289 - protein, 9 aa, Homo Sapiens
EKTSCCAML

SEQ ID NO: 1311290 - protein, 9 aa, Homo Sapiens
IQAARSDNY

SEQ ID NO: 1311291 - protein, 9 aa, Homo Sapiens
HFMYAVREE

SEQ ID NO: 1311292 - protein, 9 aa, Homo Sapiens
QSRRADHLL

SEQ ID NO: 1311293 - protein, 9 aa, Homo Sapiens
LLGVLPKTF

SEQ ID NO: 1311294 - protein, 9 aa, Homo Sapiens
SQNSRDAIA

SEQ ID NO: 1311295 - protein, 9 aa, Homo Sapiens
VESYLKEQG

SEQ ID NO: 1311296 - protein, 9 aa, Homo Sapiens
LLFSILLFP

SEQ ID NO: 1311297 - protein, 9 aa, Homo Sapiens
FFKTLQNHW

SEQ ID NO: 1311298 - protein, 9 aa, Homo Sapiens
ETSAIQVGF

SEQ ID NO: 1311299 - protein, 9 aa, Homo Sapiens
NYDNNRLCP

SEQ ID NO: 1311300 - protein, 9 aa, Homo Sapiens
RQRLIKYTP

SEQ ID NO: 1311301 - protein, 9 aa, Homo Sapiens
GRAYLRTRI

SEQ ID NO: 1311302 - protein, 9 aa, Homo Sapiens
YEIQEFHVP

SEQ ID NO: 1311303 - protein, 9 aa, Homo Sapiens
VQCGKSFSL

SEQ ID NO: 1311304 - protein, 9 aa, Homo Sapiens
KSHFMYAVR

SEQ ID NO: 1311305 - protein, 9 aa, Homo Sapiens
LSLVGIAGQ

SEQ ID NO: 1311306 - protein, 9 aa, Homo Sapiens
NLCKRQCEP

SEQ ID NO: 1311307 - protein, 9 aa, Homo Sapiens
QSELKHHQK

SEQ ID NO: 1311308 - protein, 9 aa, Homo Sapiens
AKKQAKNQQ

SEQ ID NO: 1311309 - protein, 9 aa, Homo Sapiens
TSSKAHLYR

SEQ ID NO: 1311310 - protein, 9 aa, Homo Sapiens
FAVQDPNDN

SEQ ID NO: 1311311 - protein, 9 aa, Homo Sapiens
WPLRLSRRR

SEQ ID NO: 1311312 - protein, 9 aa, Homo Sapiens
CHQVQINHI

SEQ ID NO: 1311313 - protein, 9 aa, Homo Sapiens
LGVKFEGGL

SEQ ID NO: 1311314 - protein, 9 aa, Homo Sapiens
HQVQINHIV

SEQ ID NO: 1311315 - protein, 9 aa, Homo Sapiens
KVIILHGGV

SEQ ID NO: 1311316 - protein, 9 aa, Homo Sapiens
DVITINQDP

SEQ ID NO: 1311317 - protein, 9 aa, Homo Sapiens
FISMSETIQ

SEQ ID NO: 1311318 - protein, 9 aa, Homo Sapiens
QIRDTLRRV

SEQ ID NO: 1311319 - protein, 9 aa, Homo Sapiens
VAGGAHKAT

SEQ ID NO: 1311320 - protein, 9 aa, Homo Sapiens
EAQKHFDCP

SEQ ID NO: 1311321 - protein, 9 aa, Homo Sapiens
KCQKCRWRQ

SEQ ID NO: 1311322 - protein, 9 aa, Homo Sapiens
KDFSPLAGE

SEQ ID NO: 1311323 - protein, 9 aa, Homo Sapiens
ALFFDDIDH

SEQ ID NO: 1311324 - protein, 9 aa, Homo Sapiens
HSFRFHKED

SEQ ID NO: 1311325 - protein, 9 aa, Homo Sapiens
TKGNFWMIG

SEQ ID NO: 1311326 - protein, 9 aa, Homo Sapiens
YVPNIDRIN

SEQ ID NO: 1311327 - protein, 9 aa, Homo Sapiens
TRWQVGIHH

SEQ ID NO: 1311328 - protein, 9 aa, Homo Sapiens
HLSNYRITW

SEQ ID NO: 1311329 - protein, 9 aa, Homo Sapiens
AVLNNGRLT

SEQ ID NO: 1311330 - protein, 9 aa, Homo Sapiens
QQRQQKIQG

SEQ ID NO: 1311331 - protein, 9 aa, Homo Sapiens
ILNGKDKYK

SEQ ID NO: 1311332 - protein, 9 aa, Homo Sapiens
LERCQIIEL

SEQ ID NO: 1311333 - protein, 9 aa, Homo Sapiens
ERNIQLEYR

SEQ ID NO: 1311334 - protein, 9 aa, Homo Sapiens
LLHLTQHKI

SEQ ID NO: 1311335 - protein, 9 aa, Homo Sapiens
SCFMGHTFS

SEQ ID NO: 1311336 - protein, 9 aa, Homo Sapiens
VNVSGTRKK

SEQ ID NO: 1311337 - protein, 9 aa, Homo Sapiens
YLIDFSTDI

SEQ ID NO: 1311338 - protein, 9 aa, Homo Sapiens
QSMHLSNYR

SEQ ID NO: 1311339 - protein, 9 aa, Homo Sapiens
VIYHNWDTG

SEQ ID NO: 1311340 - protein, 9 aa, Homo Sapiens
VRRPSPNHS

SEQ ID NO: 1311341 - protein, 9 aa, Homo Sapiens
GKGGTGVMI

SEQ ID NO: 1311342 - protein, 9 aa, Homo Sapiens
DQLIKINYS

SEQ ID NO: 1311343 - protein, 9 aa, Homo Sapiens
LLVVLYRRC

SEQ ID NO: 1311344 - protein, 9 aa, Homo Sapiens
AKTINNTAS

SEQ ID NO: 1311345 - protein, 9 aa, Homo Sapiens
DYISENVTT

SEQ ID NO: 1311346 - protein, 9 aa, Homo Sapiens
GAFGKDGSN

SEQ ID NO: 1311347 - protein, 9 aa, Homo Sapiens
MKTLFRGKQ

SEQ ID NO: 1311348 - protein, 9 aa, Homo Sapiens
KKPNKEVKK

SEQ ID NO: 1311349 - protein, 9 aa, Homo Sapiens
VHCVEPDIK

SEQ ID NO: 1311350 - protein, 9 aa, Homo Sapiens
RDEDDKLKT

SEQ ID NO: 1311351 - protein, 9 aa, Homo Sapiens
PLHTKLNRA

SEQ ID NO: 1311352 - protein, 9 aa, Homo Sapiens
QEEVPFRYN

SEQ ID NO: 1311353 - protein, 9 aa, Homo Sapiens
KRHVSIEEG

SEQ ID NO: 1311354 - protein, 9 aa, Homo Sapiens
AKQRYKNQK

SEQ ID NO: 1311355 - protein, 9 aa, Homo Sapiens
ENEVNETLR

SEQ ID NO: 1311356 - protein, 9 aa, Homo Sapiens
STEAVQGPK

SEQ ID NO: 1311357 - protein, 9 aa, Homo Sapiens
ETINLTEEP

SEQ ID NO: 1311358 - protein, 9 aa, Homo Sapiens
CQKHAPIHS

SEQ ID NO: 1311359 - protein, 9 aa, Homo Sapiens
DNILSFYFD

SEQ ID NO: 1311360 - protein, 9 aa, Homo Sapiens
NVVNLEGVV

SEQ ID NO: 1311361 - protein, 9 aa, Homo Sapiens
HGQGKNNLH

SEQ ID NO: 1311362 - protein, 9 aa, Homo Sapiens
EIYKSKLKD

SEQ ID NO: 1311363 - protein, 9 aa, Homo Sapiens
EPKYQCLIL

SEQ ID NO: 1311364 - protein, 9 aa, Homo Sapiens
LKATGNNLS

SEQ ID NO: 1311365 - protein, 9 aa, Homo Sapiens
NADPVLAEV

SEQ ID NO: 1311366 - protein, 9 aa, Homo Sapiens
MGRVIEEAR

SEQ ID NO: 1311367 - protein, 9 aa, Homo Sapiens
KSFQMQNTL

SEQ ID NO: 1311368 - protein, 9 aa, Homo Sapiens
VIEPVGNHE

SEQ ID NO: 1311369 - protein, 9 aa, Homo Sapiens
SCFIIPVLR

SEQ ID NO: 1311370 - protein, 9 aa, Homo Sapiens
PSSNLVHPS

SEQ ID NO: 1311371 - protein, 9 aa, Homo Sapiens
GYFRMDFSA

SEQ ID NO: 1311372 - protein, 9 aa, Homo Sapiens
HTLGSRCYI

SEQ ID NO: 1311373 - protein, 9 aa, Homo Sapiens
WHGSKDEEV

SEQ ID NO: 1311374 - protein, 9 aa, Homo Sapiens
GVKFEGGLV

SEQ ID NO: 1311375 - protein, 9 aa, Homo Sapiens
YPVIFSQYN

SEQ ID NO: 1311376 - protein, 9 aa, Homo Sapiens
FSDAKDNFY

SEQ ID NO: 1311377 - protein, 9 aa, Homo Sapiens
GELIEFLSK

SEQ ID NO: 1311378 - protein, 9 aa, Homo Sapiens
FGDLIRFCW

SEQ ID NO: 1311379 - protein, 9 aa, Homo Sapiens
LMSRIDKQI

SEQ ID NO: 1311380 - protein, 9 aa, Homo Sapiens
ITVFWMGSE

SEQ ID NO: 1311381 - protein, 9 aa, Homo Sapiens
ELNDTLEHK

SEQ ID NO: 1311382 - protein, 9 aa, Homo Sapiens
TEALSCFII

SEQ ID NO: 1311383 - protein, 9 aa, Homo Sapiens
NKDECPTSA

SEQ ID NO: 1311384 - protein, 9 aa, Homo Sapiens
DKLLEEEVT

SEQ ID NO: 1311385 - protein, 9 aa, Homo Sapiens
CIFNYGNRY

SEQ ID NO: 1311386 - protein, 9 aa, Homo Sapiens
STAKITIIL

SEQ ID NO: 1311387 - protein, 9 aa, Homo Sapiens
QHKHKFQAP

SEQ ID NO: 1311388 - protein, 9 aa, Homo Sapiens
RLRDTFLEL

SEQ ID NO: 1311389 - protein, 9 aa, Homo Sapiens
ATSVVPKNN

SEQ ID NO: 1311390 - protein, 9 aa, Homo Sapiens
NHFIYSLRN

SEQ ID NO: 1311391 - protein, 9 aa, Homo Sapiens
QPICDTNFI

SEQ ID NO: 1311392 - protein, 9 aa, Homo Sapiens
MTVFFKTLQ

SEQ ID NO: 1311393 - protein, 9 aa, Homo Sapiens
HAYVFLQST

SEQ ID NO: 1311394 - protein, 9 aa, Homo Sapiens
ECQLQVFLC

SEQ ID NO: 1311395 - protein, 9 aa, Homo Sapiens
ICKICIRKM

SEQ ID NO: 1311396 - protein, 9 aa, Homo Sapiens
LCPLSGFIL

SEQ ID NO: 1311397 - protein, 9 aa, Homo Sapiens
AKDIDVSFV

SEQ ID NO: 1311398 - protein, 9 aa, Homo Sapiens
YFWYMRIYR

SEQ ID NO: 1311399 - protein, 9 aa, Homo Sapiens
ISMSETIQY

SEQ ID NO: 1311400 - protein, 9 aa, Homo Sapiens
LSSTLKYKV

SEQ ID NO: 1311401 - protein, 9 aa, Homo Sapiens
QKTATIMVH

SEQ ID NO: 1311402 - protein, 9 aa, Homo Sapiens
MYRNVYKKA

SEQ ID NO: 1311403 - protein, 9 aa, Homo Sapiens
SREGVSCTI

SEQ ID NO: 1311404 - protein, 9 aa, Homo Sapiens
ISRPWDFRE

SEQ ID NO: 1311405 - protein, 9 aa, Homo Sapiens
IIRPRRTLQ

SEQ ID NO: 1311406 - protein, 9 aa, Homo Sapiens
DVTEAMLYK

SEQ ID NO: 1311407 - protein, 9 aa, Homo Sapiens
QDWTIQWPM

SEQ ID NO: 1311408 - protein, 9 aa, Homo Sapiens
LVVLDTSWV

SEQ ID NO: 1311409 - protein, 9 aa, Homo Sapiens
LTEDRDRGW

SEQ ID NO: 1311410 - protein, 9 aa, Homo Sapiens
GFFSSIHRH

SEQ ID NO: 1311411 - protein, 9 aa, Homo Sapiens
TRMSQFIEK

SEQ ID NO: 1311412 - protein, 9 aa, Homo Sapiens
FSFLYGKDY

SEQ ID NO: 1311413 - protein, 9 aa, Homo Sapiens
VFATDYGFH

SEQ ID NO: 1311414 - protein, 9 aa, Homo Sapiens
LMWFMGDQS

SEQ ID NO: 1311415 - protein, 9 aa, Homo Sapiens
IFRGTMYRR

SEQ ID NO: 1311416 - protein, 9 aa, Homo Sapiens
IGLLDISLG

SEQ ID NO: 1311417 - protein, 9 aa, Homo Sapiens
IRSELSQDA

SEQ ID NO: 1311418 - protein, 9 aa, Homo Sapiens
MGHIMEKEQ

SEQ ID NO: 1311419 - protein, 9 aa, Homo Sapiens
WKKEIYKES

SEQ ID NO: 1311420 - protein, 9 aa, Homo Sapiens
QYNDDDHKT

SEQ ID NO: 1311421 - protein, 9 aa, Homo Sapiens
GGVFLIICG

SEQ ID NO: 1311422 - protein, 9 aa, Homo Sapiens
RRYKLMSRI

SEQ ID NO: 1311423 - protein, 9 aa, Homo Sapiens
TGNNLSEAQ

SEQ ID NO: 1311424 - protein, 9 aa, Homo Sapiens
RSLASTGAF

SEQ ID NO: 1311425 - protein, 9 aa, Homo Sapiens
ENTPIAQPE

SEQ ID NO: 1311426 - protein, 9 aa, Homo Sapiens
DPHNPESLS

SEQ ID NO: 1311427 - protein, 9 aa, Homo Sapiens
LFIWFILGN

SEQ ID NO: 1311428 - protein, 9 aa, Homo Sapiens
RVQFQNQGS

SEQ ID NO: 1311429 - protein, 9 aa, Homo Sapiens
PSPSTTQAT

SEQ ID NO: 1311430 - protein, 9 aa, Homo Sapiens
CRHKRSHTG

SEQ ID NO: 1311431 - protein, 9 aa, Homo Sapiens
NQTEQNCQV

SEQ ID NO: 1311432 - protein, 9 aa, Homo Sapiens
VLEEIFMIN

SEQ ID NO: 1311433 - protein, 9 aa, Homo Sapiens
SNGCVIVHC

SEQ ID NO: 1311434 - protein, 9 aa, Homo Sapiens
MFVIFLAGF

SEQ ID NO: 1311435 - protein, 9 aa, Homo Sapiens
NFDLENDIL

SEQ ID NO: 1311436 - protein, 9 aa, Homo Sapiens
VIFLHLPSE

SEQ ID NO: 1311437 - protein, 9 aa, Homo Sapiens
NTPIAQPES

SEQ ID NO: 1311438 - protein, 9 aa, Homo Sapiens
PPDKPKQES

SEQ ID NO: 1311439 - protein, 9 aa, Homo Sapiens
GCLSVGSNR

SEQ ID NO: 1311440 - protein, 9 aa, Homo Sapiens
VLDGIKVQL

SEQ ID NO: 1311441 - protein, 9 aa, Homo Sapiens
EEGSNKILF

SEQ ID NO: 1311442 - protein, 9 aa, Homo Sapiens
PDLETLNLT

SEQ ID NO: 1311443 - protein, 9 aa, Homo Sapiens
YLSNKMPSL

SEQ ID NO: 1311444 - protein, 9 aa, Homo Sapiens
ARDMYKDPD

SEQ ID NO: 1311445 - protein, 9 aa, Homo Sapiens
MAMAMTHNA

SEQ ID NO: 1311446 - protein, 9 aa, Homo Sapiens
LVRRHEIHE

SEQ ID NO: 1311447 - protein, 9 aa, Homo Sapiens
PWVEKKKKN

SEQ ID NO: 1311448 - protein, 9 aa, Homo Sapiens
LSIIYLANT

SEQ ID NO: 1311449 - protein, 9 aa, Homo Sapiens
IQIEKHFNV

SEQ ID NO: 1311450 - protein, 9 aa, Homo Sapiens
PPDGSEEAA

SEQ ID NO: 1311451 - protein, 9 aa, Homo Sapiens
IEEDSLKAN

SEQ ID NO: 1311452 - protein, 9 aa, Homo Sapiens
IIARSKALQ

SEQ ID NO: 1311453 - protein, 9 aa, Homo Sapiens
YLEKWMVCL

SEQ ID NO: 1311454 - protein, 9 aa, Homo Sapiens
CCFEDCQTG

SEQ ID NO: 1311455 - protein, 9 aa, Homo Sapiens
LGKYFRKKA

SEQ ID NO: 1311456 - protein, 9 aa, Homo Sapiens
TDLADKRHV

SEQ ID NO: 1311457 - protein, 9 aa, Homo Sapiens
LRRTNLETQ

SEQ ID NO: 1311458 - protein, 9 aa, Homo Sapiens
QYHYMQWPD

SEQ ID NO: 1311459 - protein, 9 aa, Homo Sapiens
GLFSIIYSI

SEQ ID NO: 1311460 - protein, 9 aa, Homo Sapiens
NVYKKACSS

SEQ ID NO: 1311461 - protein, 9 aa, Homo Sapiens
WMGNVESYL

SEQ ID NO: 1311462 - protein, 9 aa, Homo Sapiens
LADKRHVSI

SEQ ID NO: 1311463 - protein, 9 aa, Homo Sapiens
ILAVSKLET

SEQ ID NO: 1311464 - protein, 9 aa, Homo Sapiens
TWEVEVVSH

SEQ ID NO: 1311465 - protein, 9 aa, Homo Sapiens
ASAPNPNVI

SEQ ID NO: 1311466 - protein, 9 aa, Homo Sapiens
KILESAAPS

SEQ ID NO: 1311467 - protein, 9 aa, Homo Sapiens
FDKEDNIII

SEQ ID NO: 1311468 - protein, 9 aa, Homo Sapiens
TERITNSQN

SEQ ID NO: 1311469 - protein, 9 aa, Homo Sapiens
TSLTDVVIS

SEQ ID NO: 1311470 - protein, 9 aa, Homo Sapiens
ILEDKRMLK

SEQ ID NO: 1311471 - protein, 9 aa, Homo Sapiens
YIDVSSCQY

SEQ ID NO: 1311472 - protein, 9 aa, Homo Sapiens
LVVLYRRCL

SEQ ID NO: 1311473 - protein, 9 aa, Homo Sapiens
VLEHLSPGE

SEQ ID NO: 1311474 - protein, 9 aa, Homo Sapiens
GPMINCEDI

SEQ ID NO: 1311475 - protein, 9 aa, Homo Sapiens
PLSIIMISY

SEQ ID NO: 1311476 - protein, 9 aa, Homo Sapiens
DNLSNHVTD

SEQ ID NO: 1311477 - protein, 9 aa, Homo Sapiens
EMLNDSLYN

SEQ ID NO: 1311478 - protein, 9 aa, Homo Sapiens
KYSDAFGGY

SEQ ID NO: 1311479 - protein, 9 aa, Homo Sapiens
MANVALRKE

SEQ ID NO: 1311480 - protein, 9 aa, Homo Sapiens
FENKVVQDD

SEQ ID NO: 1311481 - protein, 9 aa, Homo Sapiens
IVYRLLLPQ

SEQ ID NO: 1311482 - protein, 9 aa, Homo Sapiens
KETLLATEQ

SEQ ID NO: 1311483 - protein, 9 aa, Homo Sapiens
EIRKKYEEK

SEQ ID NO: 1311484 - protein, 9 aa, Homo Sapiens
KTGSGDIEK

SEQ ID NO: 1311485 - protein, 9 aa, Homo Sapiens
RIIMLSVLK

SEQ ID NO: 1311486 - protein, 9 aa, Homo Sapiens
AKNQGAHYP

SEQ ID NO: 1311487 - protein, 9 aa, Homo Sapiens
EKFLISNEN

SEQ ID NO: 1311488 - protein, 9 aa, Homo Sapiens
LSFDYYAFL

SEQ ID NO: 1311489 - protein, 9 aa, Homo Sapiens
SGNEEHKKE

SEQ ID NO: 1311490 - protein, 9 aa, Homo Sapiens
IAPSSQTKV

SEQ ID NO: 1311491 - protein, 9 aa, Homo Sapiens
THSQLLQMV

SEQ ID NO: 1311492 - protein, 9 aa, Homo Sapiens
SEITKETLL

SEQ ID NO: 1311493 - protein, 9 aa, Homo Sapiens
SNPSNPSME

SEQ ID NO: 1311494 - protein, 9 aa, Homo Sapiens
VVGAVGVGK

SEQ ID NO: 1311495 - protein, 9 aa, Homo Sapiens
EKKKIKKDK

SEQ ID NO: 1311496 - protein, 9 aa, Homo Sapiens
QAETTFWVL

SEQ ID NO: 1311497 - protein, 9 aa, Homo Sapiens
LNALDNISH

SEQ ID NO: 1311498 - protein, 9 aa, Homo Sapiens
GSCRNLLNS

SEQ ID NO: 1311499 - protein, 9 aa, Homo Sapiens
SDGQHNGHI

SEQ ID NO: 1311500 - protein, 9 aa, Homo Sapiens
AQYLENIVA

SEQ ID NO: 1311501 - protein, 9 aa, Homo Sapiens
LGGQLPAYP

SEQ ID NO: 1311502 - protein, 9 aa, Homo Sapiens
AQIRDTLRR

SEQ ID NO: 1311503 - protein, 9 aa, Homo Sapiens
KVNNLGVCG

SEQ ID NO: 1311504 - protein, 9 aa, Homo Sapiens
VNGEKEQTV

SEQ ID NO: 1311505 - protein, 9 aa, Homo Sapiens
EYFPMDVHA

SEQ ID NO: 1311506 - protein, 9 aa, Homo Sapiens
MQLNHDGEY

SEQ ID NO: 1311507 - protein, 9 aa, Homo Sapiens
AKKQKQNCP

SEQ ID NO: 1311508 - protein, 9 aa, Homo Sapiens
TSTAFSGLG

SEQ ID NO: 1311509 - protein, 9 aa, Homo Sapiens
KDKYKVYEE

SEQ ID NO: 1311510 - protein, 9 aa, Homo Sapiens
RGWDAVKRE

SEQ ID NO: 1311511 - protein, 9 aa, Homo Sapiens
SVLQNANKT

SEQ ID NO: 1311512 - protein, 9 aa, Homo Sapiens
PYQPIIKIS

SEQ ID NO: 1311513 - protein, 9 aa, Homo Sapiens
VPFRYNELI

SEQ ID NO: 1311514 - protein, 9 aa, Homo Sapiens
NKEEMRKRD

SEQ ID NO: 1311515 - protein, 9 aa, Homo Sapiens
LLASNGVSC

SEQ ID NO: 1311516 - protein, 9 aa, Homo Sapiens
TNWRDYLLK

SEQ ID NO: 1311517 - protein, 9 aa, Homo Sapiens
IEENNIRRD

SEQ ID NO: 1311518 - protein, 9 aa, Homo Sapiens
SASSLQCWL

SEQ ID NO: 1311519 - protein, 9 aa, Homo Sapiens
WCTFEGCGK

SEQ ID NO: 1311520 - protein, 9 aa, Homo Sapiens
RQFVDMVNG

SEQ ID NO: 1311521 - protein, 9 aa, Homo Sapiens
IQFSKGKYK

SEQ ID NO: 1311522 - protein, 9 aa, Homo Sapiens
SVSDKLKKL

SEQ ID NO: 1311523 - protein, 9 aa, Homo Sapiens
SHKIIHTGE

SEQ ID NO: 1311524 - protein, 9 aa, Homo Sapiens
LVVQSLPIR

SEQ ID NO: 1311525 - protein, 9 aa, Homo Sapiens
QIIAVIREL

SEQ ID NO: 1311526 - protein, 9 aa, Homo Sapiens
MWFMGDQSK

SEQ ID NO: 1311527 - protein, 9 aa, Homo Sapiens
PRPREELPD

SEQ ID NO: 1311528 - protein, 9 aa, Homo Sapiens
TTHKGHFQL

SEQ ID NO: 1311529 - protein, 9 aa, Homo Sapiens
LAEVVTGLH

SEQ ID NO: 1311530 - protein, 9 aa, Homo Sapiens
KKLPKDANK

SEQ ID NO: 1311531 - protein, 9 aa, Homo Sapiens
YLSGDDIDE

SEQ ID NO: 1311532 - protein, 9 aa, Homo Sapiens
KSALILHQG

SEQ ID NO: 1311533 - protein, 9 aa, Homo Sapiens
QKMAKEDPV

SEQ ID NO: 1311534 - protein, 9 aa, Homo Sapiens
ERRNFICTV

SEQ ID NO: 1311535 - protein, 9 aa, Homo Sapiens
KLNRAMDNC

SEQ ID NO: 1311536 - protein, 9 aa, Homo Sapiens
LFENKVVQD

SEQ ID NO: 1311537 - protein, 9 aa, Homo Sapiens
VLGNTSSLW

SEQ ID NO: 1311538 - protein, 9 aa, Homo Sapiens
CTEITSAIS

SEQ ID NO: 1311539 - protein, 9 aa, Homo Sapiens
YTNFLVSQL

SEQ ID NO: 1311540 - protein, 9 aa, Homo Sapiens
HSSLGIHQI

SEQ ID NO: 1311541 - protein, 9 aa, Homo Sapiens
IAQNLEKMH

SEQ ID NO: 1311542 - protein, 9 aa, Homo Sapiens
PAYQLGLPW

SEQ ID NO: 1311543 - protein, 9 aa, Homo Sapiens
QPHFTSEDA

SEQ ID NO: 1311544 - protein, 9 aa, Homo Sapiens
HFFYTNFLV

SEQ ID NO: 1311545 - protein, 9 aa, Homo Sapiens
TVQQEESVR

SEQ ID NO: 1311546 - protein, 9 aa, Homo Sapiens
GVVFIFYSL

SEQ ID NO: 1311547 - protein, 9 aa, Homo Sapiens
RIKNMIHMI

SEQ ID NO: 1311548 - protein, 9 aa, Homo Sapiens
GAITLNLVP

SEQ ID NO: 1311549 - protein, 9 aa, Homo Sapiens
FLRIIMLSV

SEQ ID NO: 1311550 - protein, 9 aa, Homo Sapiens
NQLSDVGGE

SEQ ID NO: 1311551 - protein, 9 aa, Homo Sapiens
NETINIGLT

SEQ ID NO: 1311552 - protein, 9 aa, Homo Sapiens
PQKITVAVT

SEQ ID NO: 1311553 - protein, 9 aa, Homo Sapiens
DTNFITYDN

SEQ ID NO: 1311554 - protein, 9 aa, Homo Sapiens
IKAAKTGSI

SEQ ID NO: 1311555 - protein, 9 aa, Homo Sapiens
ILHSLKPQS

SEQ ID NO: 1311556 - protein, 9 aa, Homo Sapiens
TDNNTAATR

SEQ ID NO: 1311557 - protein, 9 aa, Homo Sapiens
AELLEVLLN

SEQ ID NO: 1311558 - protein, 9 aa, Homo Sapiens
PKLCVSEMY

SEQ ID NO: 1311559 - protein, 9 aa, Homo Sapiens
DKLKKLDSS

SEQ ID NO: 1311560 - protein, 9 aa, Homo Sapiens
QMDPNKISE

SEQ ID NO: 1311561 - protein, 9 aa, Homo Sapiens
KNQKTKQNP

SEQ ID NO: 1311562 - protein, 9 aa, Homo Sapiens
VQQEESVRG

SEQ ID NO: 1311563 - protein, 9 aa, Homo Sapiens
EERAALIAY

SEQ ID NO: 1311564 - protein, 9 aa, Homo Sapiens
LEIVKSLSE

SEQ ID NO: 1311565 - protein, 9 aa, Homo Sapiens
SKNYFISYS

SEQ ID NO: 1311566 - protein, 9 aa, Homo Sapiens
GEKSYECKQ

SEQ ID NO: 1311567 - protein, 9 aa, Homo Sapiens
RFHPWQLYL

SEQ ID NO: 1311568 - protein, 9 aa, Homo Sapiens
TCEFSCTGG

SEQ ID NO: 1311569 - protein, 9 aa, Homo Sapiens
SGLFSIIYS

SEQ ID NO: 1311570 - protein, 9 aa, Homo Sapiens
ATPHSYSAQ

SEQ ID NO: 1311571 - protein, 9 aa, Homo Sapiens
TYIKCACNE

SEQ ID NO: 1311572 - protein, 9 aa, Homo Sapiens
EIKTYSLSF

SEQ ID NO: 1311573 - protein, 9 aa, Homo Sapiens
EASAYPEAG

SEQ ID NO: 1311574 - protein, 9 aa, Homo Sapiens
YQDTKKNIC

SEQ ID NO: 1311575 - protein, 9 aa, Homo Sapiens
LTNLNGKMI

SEQ ID NO: 1311576 - protein, 9 aa, Homo Sapiens
LSVLQNAIK

SEQ ID NO: 1311577 - protein, 9 aa, Homo Sapiens
MNYSEQAHT

SEQ ID NO: 1311578 - protein, 9 aa, Homo Sapiens
FNQIDASVL

SEQ ID NO: 1311579 - protein, 9 aa, Homo Sapiens
VGSLSDKLA

SEQ ID NO: 1311580 - protein, 9 aa, Homo Sapiens
KSKSALLSG

SEQ ID NO: 1311581 - protein, 9 aa, Homo Sapiens
PGSPTSVTV

SEQ ID NO: 1311582 - protein, 9 aa, Homo Sapiens
TLTGWSKGL

SEQ ID NO: 1311583 - protein, 9 aa, Homo Sapiens
VFNPIDFLE

SEQ ID NO: 1311584 - protein, 9 aa, Homo Sapiens
QKEILIKKL

SEQ ID NO: 1311585 - protein, 9 aa, Homo Sapiens
PFVWSGTIV

SEQ ID NO: 1311586 - protein, 9 aa, Homo Sapiens
VNGKTQVEA

SEQ ID NO: 1311587 - protein, 9 aa, Homo Sapiens
ASEVLQIQN

SEQ ID NO: 1311588 - protein, 9 aa, Homo Sapiens
FRMHEIIHT

SEQ ID NO: 1311589 - protein, 9 aa, Homo Sapiens
KKLGIIHPN

SEQ ID NO: 1311590 - protein, 9 aa, Homo Sapiens
GNTLFDAGA

SEQ ID NO: 1311591 - protein, 9 aa, Homo Sapiens
KPEEAKTAI

SEQ ID NO: 1311592 - protein, 9 aa, Homo Sapiens
STGAFGKDG

SEQ ID NO: 1311593 - protein, 9 aa, Homo Sapiens
NLLQAETTF

SEQ ID NO: 1311594 - protein, 9 aa, Homo Sapiens
CLEMCLQCP

SEQ ID NO: 1311595 - protein, 9 aa, Homo Sapiens
HKYKGVTKE

SEQ ID NO: 1311596 - protein, 9 aa, Homo Sapiens
NPYTGHNYL

SEQ ID NO: 1311597 - protein, 9 aa, Homo Sapiens
IPHIPQSPY

SEQ ID NO: 1311598 - protein, 9 aa, Homo Sapiens
RALDERPWA

SEQ ID NO: 1311599 - protein, 9 aa, Homo Sapiens
SFKGIQFSK

SEQ ID NO: 1311600 - protein, 9 aa, Homo Sapiens
QIKNILKPE

SEQ ID NO: 1311601 - protein, 9 aa, Homo Sapiens
GVFLIICGL

SEQ ID NO: 1311602 - protein, 9 aa, Homo Sapiens
QVLDEANLE

SEQ ID NO: 1311603 - protein, 9 aa, Homo Sapiens
GTNKKKLLK

SEQ ID NO: 1311604 - protein, 9 aa, Homo Sapiens
FAKDIDVSF

SEQ ID NO: 1311605 - protein, 9 aa, Homo Sapiens
SGAPLLRIA

SEQ ID NO: 1311606 - protein, 9 aa, Homo Sapiens
GRSIEINDE

SEQ ID NO: 1311607 - protein, 9 aa, Homo Sapiens
QSVLLEKHD

SEQ ID NO: 1311608 - protein, 9 aa, Homo Sapiens
LRIWSDYVA

SEQ ID NO: 1311609 - protein, 9 aa, Homo Sapiens
KMLYNRQQH

SEQ ID NO: 1311610 - protein, 9 aa, Homo Sapiens
THKIISTGE

SEQ ID NO: 1311611 - protein, 9 aa, Homo Sapiens
AVQDPNDNT

SEQ ID NO: 1311612 - protein, 9 aa, Homo Sapiens
ERIKYSRYF

SEQ ID NO: 1311613 - protein, 9 aa, Homo Sapiens
YIEIWNGPY

SEQ ID NO: 1311614 - protein, 9 aa, Homo Sapiens
KIIQTYDMM

SEQ ID NO: 1311615 - protein, 9 aa, Homo Sapiens
LTVVALIPY

SEQ ID NO: 1311616 - protein, 9 aa, Homo Sapiens
SKFDSFRQS

SEQ ID NO: 1311617 - protein, 9 aa, Homo Sapiens
MIHMIYFDF

SEQ ID NO: 1311618 - protein, 9 aa, Homo Sapiens
ISDTELIYR

SEQ ID NO: 1311619 - protein, 9 aa, Homo Sapiens
LSEDERKLL

SEQ ID NO: 1311620 - protein, 9 aa, Homo Sapiens
QFIYSKGAI

SEQ ID NO: 1311621 - protein, 9 aa, Homo Sapiens
ALQHKHEGF

SEQ ID NO: 1311622 - protein, 9 aa, Homo Sapiens
YDIITSLQR

SEQ ID NO: 1311623 - protein, 9 aa, Homo Sapiens
AEKKLFTVS

SEQ ID NO: 1311624 - protein, 9 aa, Homo Sapiens
FIFSLTSPS

SEQ ID NO: 1311625 - protein, 9 aa, Homo Sapiens
AESMRSFSS

SEQ ID NO: 1311626 - protein, 9 aa, Homo Sapiens
RNLLNSSIT

SEQ ID NO: 1311627 - protein, 9 aa, Homo Sapiens
EVSHIKNKE

SEQ ID NO: 1311628 - protein, 9 aa, Homo Sapiens
LATQEGKWK

SEQ ID NO: 1311629 - protein, 9 aa, Homo Sapiens
YRRLRNHEI

SEQ ID NO: 1311630 - protein, 9 aa, Homo Sapiens
LESWKHMNY

SEQ ID NO: 1311631 - protein, 9 aa, Homo Sapiens
LLEMLNDSL

SEQ ID NO: 1311632 - protein, 9 aa, Homo Sapiens
EETVFQEVV

SEQ ID NO: 1311633 - protein, 9 aa, Homo Sapiens
WNNVAAGTE

SEQ ID NO: 1311634 - protein, 9 aa, Homo Sapiens
IIYLANTLM

SEQ ID NO: 1311635 - protein, 9 aa, Homo Sapiens
TRVTKEEFC

SEQ ID NO: 1311636 - protein, 9 aa, Homo Sapiens
RVGDVKINA

SEQ ID NO: 1311637 - protein, 9 aa, Homo Sapiens
LSQDVCTYI

SEQ ID NO: 1311638 - protein, 9 aa, Homo Sapiens
IQKNTVKFY

SEQ ID NO: 1311639 - protein, 9 aa, Homo Sapiens
NALDIYGRT

SEQ ID NO: 1311640 - protein, 9 aa, Homo Sapiens
PGSRKHYLV

SEQ ID NO: 1311641 - protein, 9 aa, Homo Sapiens
LKSNLQRHR

SEQ ID NO: 1311642 - protein, 9 aa, Homo Sapiens
NMFMYFLRG

SEQ ID NO: 1311643 - protein, 9 aa, Homo Sapiens
CDILPLLKL

SEQ ID NO: 1311644 - protein, 9 aa, Homo Sapiens
NYKALSKVQ

SEQ ID NO: 1311645 - protein, 9 aa, Homo Sapiens
DTMPVRSSV

SEQ ID NO: 1311646 - protein, 9 aa, Homo Sapiens
SELVTKIKL

SEQ ID NO: 1311647 - protein, 9 aa, Homo Sapiens
GGKINLKVA

SEQ ID NO: 1311648 - protein, 9 aa, Homo Sapiens
TLVNLKLWA

SEQ ID NO: 1311649 - protein, 9 aa, Homo Sapiens
DKEKKYMLS

SEQ ID NO: 1311650 - protein, 9 aa, Homo Sapiens
SQQNISASA

SEQ ID NO: 1311651 - protein, 9 aa, Homo Sapiens
DALNMLMAM

SEQ ID NO: 1311652 - protein, 9 aa, Homo Sapiens
QNHWKKTTA

SEQ ID NO: 1311653 - protein, 9 aa, Homo Sapiens
LTARHDWLH

SEQ ID NO: 1311654 - protein, 9 aa, Homo Sapiens
RKLREGQHF

SEQ ID NO: 1311655 - protein, 9 aa, Homo Sapiens
QAPCLPQAR

SEQ ID NO: 1311656 - protein, 9 aa, Homo Sapiens
ILADLLGFT

SEQ ID NO: 1311657 - protein, 9 aa, Homo Sapiens
FLFIWFILG

SEQ ID NO: 1311658 - protein, 9 aa, Homo Sapiens
YLIGSHTVK

SEQ ID NO: 1311659 - protein, 9 aa, Homo Sapiens
QLKDLNENY

SEQ ID NO: 1311660 - protein, 9 aa, Homo Sapiens
LKIKWDNLS

SEQ ID NO: 1311661 - protein, 9 aa, Homo Sapiens
HIYYKKCPA

SEQ ID NO: 1311662 - protein, 9 aa, Homo Sapiens
GGLVWALPK

SEQ ID NO: 1311663 - protein, 9 aa, Homo Sapiens
KNYFISYSR

SEQ ID NO: 1311664 - protein, 9 aa, Homo Sapiens
QAHIKCRHK

SEQ ID NO: 1311665 - protein, 9 aa, Homo Sapiens
NSEVIYVWT

SEQ ID NO: 1311666 - protein, 9 aa, Homo Sapiens
EIAAEINKF

SEQ ID NO: 1311667 - protein, 9 aa, Homo Sapiens
YKDDEDKEK

SEQ ID NO: 1311668 - protein, 9 aa, Homo Sapiens
PHHTLILCV

SEQ ID NO: 1311669 - protein, 9 aa, Homo Sapiens
TSHKIIHTG

SEQ ID NO: 1311670 - protein, 9 aa, Homo Sapiens
LKYTLSVDW

SEQ ID NO: 1311671 - protein, 9 aa, Homo Sapiens
LMRLEKYVT

SEQ ID NO: 1311672 - protein, 9 aa, Homo Sapiens
SNLSELNRL

SEQ ID NO: 1311673 - protein, 9 aa, Homo Sapiens
KGKRKQKSS

SEQ ID NO: 1311674 - protein, 9 aa, Homo Sapiens
IVVLFMRSD

SEQ ID NO: 1311675 - protein, 9 aa, Homo Sapiens
KIMKDIQKN

SEQ ID NO: 1311676 - protein, 9 aa, Homo Sapiens
IDRPFPVCP

SEQ ID NO: 1311677 - protein, 9 aa, Homo Sapiens
AYKIVLYPN

SEQ ID NO: 1311678 - protein, 9 aa, Homo Sapiens
QECIILGMM

SEQ ID NO: 1311679 - protein, 9 aa, Homo Sapiens
TSKRHFKLE

SEQ ID NO: 1311680 - protein, 9 aa, Homo Sapiens
MAPEHEEPQ

SEQ ID NO: 1311681 - protein, 9 aa, Homo Sapiens
LISLFIYMI

SEQ ID NO: 1311682 - protein, 9 aa, Homo Sapiens
AYLFQTFLE

SEQ ID NO: 1311683 - protein, 9 aa, Homo Sapiens
SEGKFDKDR

SEQ ID NO: 1311684 - protein, 9 aa, Homo Sapiens
GDEDIVTIL

SEQ ID NO: 1311685 - protein, 9 aa, Homo Sapiens
GDKPYRGSV

SEQ ID NO: 1311686 - protein, 9 aa, Homo Sapiens
EQDKSLAGW

SEQ ID NO: 1311687 - protein, 9 aa, Homo Sapiens
KALGRELLL

SEQ ID NO: 1311688 - protein, 9 aa, Homo Sapiens
DLSHNQLSD

SEQ ID NO: 1311689 - protein, 9 aa, Homo Sapiens
TISLLCASF

SEQ ID NO: 1311690 - protein, 9 aa, Homo Sapiens
TGVVFIFYS

SEQ ID NO: 1311691 - protein, 9 aa, Homo Sapiens
QNQGSEPKY

SEQ ID NO: 1311692 - protein, 9 aa, Homo Sapiens
SELLQFQVT

SEQ ID NO: 1311693 - protein, 9 aa, Homo Sapiens
ENNASGYSC

SEQ ID NO: 1311694 - protein, 9 aa, Homo Sapiens
VENNLTLLN

SEQ ID NO: 1311695 - protein, 9 aa, Homo Sapiens
KIYPQKITV

SEQ ID NO: 1311696 - protein, 9 aa, Homo Sapiens
LQDSKLFEN

SEQ ID NO: 1311697 - protein, 9 aa, Homo Sapiens
SVAPCTDLF

SEQ ID NO: 1311698 - protein, 9 aa, Homo Sapiens
DGCKTYWKV

SEQ ID NO: 1311699 - protein, 9 aa, Homo Sapiens
VVLYRRCLH

SEQ ID NO: 1311700 - protein, 9 aa, Homo Sapiens
EKIIQTYDM

SEQ ID NO: 1311701 - protein, 9 aa, Homo Sapiens
LPRNLKTPT

SEQ ID NO: 1311702 - protein, 9 aa, Homo Sapiens
KMGITQLRF

SEQ ID NO: 1311703 - protein, 9 aa, Homo Sapiens
TCHPVGDFH

SEQ ID NO: 1311704 - protein, 9 aa, Homo Sapiens
EEKETLLAT

SEQ ID NO: 1311705 - protein, 9 aa, Homo Sapiens
GCESWDKIK

SEQ ID NO: 1311706 - protein, 9 aa, Homo Sapiens
SHLIIHKII

SEQ ID NO: 1311707 - protein, 9 aa, Homo Sapiens
YTLSVDWWS

SEQ ID NO: 1311708 - protein, 9 aa, Homo Sapiens
PKLGNIANT

SEQ ID NO: 1311709 - protein, 9 aa, Homo Sapiens
KLKDEAEKK

SEQ ID NO: 1311710 - protein, 9 aa, Homo Sapiens
CWRKEIHGR

SEQ ID NO: 1311711 - protein, 9 aa, Homo Sapiens
IDQIISQVV

SEQ ID NO: 1311712 - protein, 9 aa, Homo Sapiens
RLDQLDEVA

SEQ ID NO: 1311713 - protein, 9 aa, Homo Sapiens
LTKFVSAPH

SEQ ID NO: 1311714 - protein, 9 aa, Homo Sapiens
EVIYVWTNG

SEQ ID NO: 1311715 - protein, 9 aa, Homo Sapiens
HKLIHIGEK

SEQ ID NO: 1311716 - protein, 9 aa, Homo Sapiens
IQVQRRGSR

SEQ ID NO: 1311717 - protein, 9 aa, Homo Sapiens
MLKVIHDCR

SEQ ID NO: 1311718 - protein, 9 aa, Homo Sapiens
LRITHTEEK

SEQ ID NO: 1311719 - protein, 9 aa, Homo Sapiens
IHNNLNPVW

SEQ ID NO: 1311720 - protein, 9 aa, Homo Sapiens
GRQRLIKYT

SEQ ID NO: 1311721 - protein, 9 aa, Homo Sapiens
KKNIGKAFL

SEQ ID NO: 1311722 - protein, 9 aa, Homo Sapiens
SDESGYLTF

SEQ ID NO: 1311723 - protein, 9 aa, Homo Sapiens
YNKKNTFIV

SEQ ID NO: 1311724 - protein, 9 aa, Homo Sapiens
FRAQMDPNK

SEQ ID NO: 1311725 - protein, 9 aa, Homo Sapiens
KDLNENYFL

SEQ ID NO: 1311726 - protein, 9 aa, Homo Sapiens
QHEIINNKE

SEQ ID NO: 1311727 - protein, 9 aa, Homo Sapiens
LQFQVTDLD

SEQ ID NO: 1311728 - protein, 9 aa, Homo Sapiens
SYSEHDYLW

SEQ ID NO: 1311729 - protein, 9 aa, Homo Sapiens
ACNEQEQNL

SEQ ID NO: 1311730 - protein, 9 aa, Homo Sapiens
NWRDYLLKV

SEQ ID NO: 1311731 - protein, 9 aa, Homo Sapiens
PLPSSNLVH

SEQ ID NO: 1311732 - protein, 9 aa, Homo Sapiens
KLLSNKNIS

SEQ ID NO: 1311733 - protein, 9 aa, Homo Sapiens
NVALRKELN

SEQ ID NO: 1311734 - protein, 9 aa, Homo Sapiens
RPVTTLSED

SEQ ID NO: 1311735 - protein, 9 aa, Homo Sapiens
CYEHKQYIN

SEQ ID NO: 1311736 - protein, 9 aa, Homo Sapiens
QFKAESEDY

SEQ ID NO: 1311737 - protein, 9 aa, Homo Sapiens
MEIHITLEK

SEQ ID NO: 1311738 - protein, 9 aa, Homo Sapiens
ETQAVPRPL

SEQ ID NO: 1311739 - protein, 9 aa, Homo Sapiens
TLHEKILNG

SEQ ID NO: 1311740 - protein, 9 aa, Homo Sapiens
GAMKTLFRG

SEQ ID NO: 1311741 - protein, 9 aa, Homo Sapiens
NQSHRDCVI

SEQ ID NO: 1311742 - protein, 9 aa, Homo Sapiens
KKPRKQTYE

SEQ ID NO: 1311743 - protein, 9 aa, Homo Sapiens
FTKLWEFQL

SEQ ID NO: 1311744 - protein, 9 aa, Homo Sapiens
EKKKKNQKT

SEQ ID NO: 1311745 - protein, 9 aa, Homo Sapiens
HIKGAMKTL

SEQ ID NO: 1311746 - protein, 9 aa, Homo Sapiens
SYMSTLLAE

SEQ ID NO: 1311747 - protein, 9 aa, Homo Sapiens
GRQTQEQQT

SEQ ID NO: 1311748 - protein, 9 aa, Homo Sapiens
KQETVIFLH

SEQ ID NO: 1311749 - protein, 9 aa, Homo Sapiens
IYFYCNPDT

SEQ ID NO: 1311750 - protein, 9 aa, Homo Sapiens
LNTVVLAMQ

SEQ ID NO: 1311751 - protein, 9 aa, Homo Sapiens
SEVVENNLT

SEQ ID NO: 1311752 - protein, 9 aa, Homo Sapiens
KPQSLEGKR

SEQ ID NO: 1311753 - protein, 9 aa, Homo Sapiens
LRLIQFSEM

SEQ ID NO: 1311754 - protein, 9 aa, Homo Sapiens
TLKYKVTVG

SEQ ID NO: 1311755 - protein, 9 aa, Homo Sapiens
PVTTVYLID

SEQ ID NO: 1311756 - protein, 9 aa, Homo Sapiens
NILSMSITN

SEQ ID NO: 1311757 - protein, 9 aa, Homo Sapiens
SFNKISDKL

SEQ ID NO: 1311758 - protein, 9 aa, Homo Sapiens
YRCFKYIEN

SEQ ID NO: 1311759 - protein, 9 aa, Homo Sapiens
HPQWVLTAV

SEQ ID NO: 1311760 - protein, 9 aa, Homo Sapiens
SSEASAYPE

SEQ ID NO: 1311761 - protein, 9 aa, Homo Sapiens
GKMNTYMNY

SEQ ID NO: 1311762 - protein, 9 aa, Homo Sapiens
GNMFMYFLR

SEQ ID NO: 1311763 - protein, 9 aa, Homo Sapiens
FTGAVRIAS

SEQ ID NO: 1311764 - protein, 9 aa, Homo Sapiens
MPEWKIMAR

SEQ ID NO: 1311765 - protein, 9 aa, Homo Sapiens
LLDGINANK

SEQ ID NO: 1311766 - protein, 9 aa, Homo Sapiens
VLREPHSCV

SEQ ID NO: 1311767 - protein, 9 aa, Homo Sapiens
DLWKELEHL

SEQ ID NO: 1311768 - protein, 9 aa, Homo Sapiens
TRIVTLIKH

SEQ ID NO: 1311769 - protein, 9 aa, Homo Sapiens
SEAVLDGIK

SEQ ID NO: 1311770 - protein, 9 aa, Homo Sapiens
KIHGKNNWT

SEQ ID NO: 1311771 - protein, 9 aa, Homo Sapiens
VNSEGKFDK

SEQ ID NO: 1311772 - protein, 9 aa, Homo Sapiens
AFSGIQIEK

SEQ ID NO: 1311773 - protein, 9 aa, Homo Sapiens
DLPIDPNKP

SEQ ID NO: 1311774 - protein, 9 aa, Homo Sapiens
TDVSCFFIW

SEQ ID NO: 1311775 - protein, 9 aa, Homo Sapiens
NEDLRSWTT

SEQ ID NO: 1311776 - protein, 9 aa, Homo Sapiens
IKELRRTNL

SEQ ID NO: 1311777 - protein, 9 aa, Homo Sapiens
TVVALIPYS

SEQ ID NO: 1311778 - protein, 9 aa, Homo Sapiens
SRRRASGLL

SEQ ID NO: 1311779 - protein, 9 aa, Homo Sapiens
NITIRTTTM

SEQ ID NO: 1311780 - protein, 9 aa, Homo Sapiens
SPSNNSSRR

SEQ ID NO: 1311781 - protein, 9 aa, Homo Sapiens
IDEKVIILH

SEQ ID NO: 1311782 - protein, 9 aa, Homo Sapiens
KETLLKPSR

SEQ ID NO: 1311783 - protein, 9 aa, Homo Sapiens
EPDNILPRS

SEQ ID NO: 1311784 - protein, 9 aa, Homo Sapiens
TLKKKNEDC

SEQ ID NO: 1311785 - protein, 9 aa, Homo Sapiens
FKGIQFSKG

SEQ ID NO: 1311786 - protein, 9 aa, Homo Sapiens
SEHTRINLF

SEQ ID NO: 1311787 - protein, 9 aa, Homo Sapiens
SNQKCQKCR

SEQ ID NO: 1311788 - protein, 9 aa, Homo Sapiens
RTPTRIILY

SEQ ID NO: 1311789 - protein, 9 aa, Homo Sapiens
IILHGGVSD

SEQ ID NO: 1311790 - protein, 9 aa, Homo Sapiens
SSRVQFQNQ

SEQ ID NO: 1311791 - protein, 9 aa, Homo Sapiens
EIRTIFYLF

SEQ ID NO: 1311792 - protein, 9 aa, Homo Sapiens
LTQHKIFHI

SEQ ID NO: 1311793 - protein, 9 aa, Homo Sapiens
IFRGKMSRI

SEQ ID NO: 1311794 - protein, 9 aa, Homo Sapiens
IKIYPQKIT

SEQ ID NO: 1311795 - protein, 9 aa, Homo Sapiens
TMQEYLPSG

SEQ ID NO: 1311796 - protein, 9 aa, Homo Sapiens
QAPSALPPR

SEQ ID NO: 1311797 - protein, 9 aa, Homo Sapiens
ANPFFQKPV

SEQ ID NO: 1311798 - protein, 9 aa, Homo Sapiens
DSPRRANHW

SEQ ID NO: 1311799 - protein, 9 aa, Homo Sapiens
ARPVSRGGI

SEQ ID NO: 1311800 - protein, 9 aa, Homo Sapiens
SKKNKPLKK

SEQ ID NO: 1311801 - protein, 9 aa, Homo Sapiens
FVQKRGNSM

SEQ ID NO: 1311802 - protein, 9 aa, Homo Sapiens
RMEETVRNI

SEQ ID NO: 1311803 - protein, 9 aa, Homo Sapiens
AKYDILWDD

SEQ ID NO: 1311804 - protein, 9 aa, Homo Sapiens
QPSRPAPLP

SEQ ID NO: 1311805 - protein, 9 aa, Homo Sapiens
LELNETINI

SEQ ID NO: 1311806 - protein, 9 aa, Homo Sapiens
KDRNPKEIE

SEQ ID NO: 1311807 - protein, 9 aa, Homo Sapiens
LYRCFKYIE

SEQ ID NO: 1311808 - protein, 9 aa, Homo Sapiens
AQVAGICYI

SEQ ID NO: 1311809 - protein, 9 aa, Homo Sapiens
KGVTKEVDG

SEQ ID NO: 1311810 - protein, 9 aa, Homo Sapiens
IRKKYEEKD

SEQ ID NO: 1311811 - protein, 9 aa, Homo Sapiens
EKLALLDKA

SEQ ID NO: 1311812 - protein, 9 aa, Homo Sapiens
ENFKLLQEY

SEQ ID NO: 1311813 - protein, 9 aa, Homo Sapiens
CQKTPKASP

SEQ ID NO: 1311814 - protein, 9 aa, Homo Sapiens
GSRKHYLVQ

SEQ ID NO: 1311815 - protein, 9 aa, Homo Sapiens
EIVKNYLEE

SEQ ID NO: 1311816 - protein, 9 aa, Homo Sapiens
LIICGLTLI

SEQ ID NO: 1311817 - protein, 9 aa, Homo Sapiens
RTESRGVNL

SEQ ID NO: 1311818 - protein, 9 aa, Homo Sapiens
IYFRCLGLH

SEQ ID NO: 1311819 - protein, 9 aa, Homo Sapiens
GKDYSQRPL

SEQ ID NO: 1311820 - protein, 9 aa, Homo Sapiens
DNISDGIGD

SEQ ID NO: 1311821 - protein, 9 aa, Homo Sapiens
AYQLGLPWP

SEQ ID NO: 1311822 - protein, 9 aa, Homo Sapiens
TICQKTPKA

SEQ ID NO: 1311823 - protein, 9 aa, Homo Sapiens
AANKSPKIS

SEQ ID NO: 1311824 - protein, 9 aa, Homo Sapiens
EPCKEIIRP

SEQ ID NO: 1311825 - protein, 9 aa, Homo Sapiens
VDYITVDSN

SEQ ID NO: 1311826 - protein, 9 aa, Homo Sapiens
LKTREEVLQ

SEQ ID NO: 1311827 - protein, 9 aa, Homo Sapiens
PLLFNGCHS

SEQ ID NO: 1311828 - protein, 9 aa, Homo Sapiens
GEKEQTVFS

SEQ ID NO: 1311829 - protein, 9 aa, Homo Sapiens
QSIPRPEVQ

SEQ ID NO: 1311830 - protein, 9 aa, Homo Sapiens
IHKRYFRKI

SEQ ID NO: 1311831 - protein, 9 aa, Homo Sapiens
LKILEKLLN

SEQ ID NO: 1311832 - protein, 9 aa, Homo Sapiens
DLPTRNKNL

SEQ ID NO: 1311833 - protein, 9 aa, Homo Sapiens
SDEKGPEEK

SEQ ID NO: 1311834 - protein, 9 aa, Homo Sapiens
QLLASNGVS

SEQ ID NO: 1311835 - protein, 9 aa, Homo Sapiens
GGIGLTGRP

SEQ ID NO: 1311836 - protein, 9 aa, Homo Sapiens
EYVALTVIR

SEQ ID NO: 1311837 - protein, 9 aa, Homo Sapiens
NMGSHYIVD

SEQ ID NO: 1311838 - protein, 9 aa, Homo Sapiens
LISQTAVVM

SEQ ID NO: 1311839 - protein, 9 aa, Homo Sapiens
QKSFPEENA

SEQ ID NO: 1311840 - protein, 9 aa, Homo Sapiens
LREPHSCVA

SEQ ID NO: 1311841 - protein, 9 aa, Homo Sapiens
DNKDECPTS

SEQ ID NO: 1311842 - protein, 9 aa, Homo Sapiens
EDYISENVT

SEQ ID NO: 1311843 - protein, 9 aa, Homo Sapiens
EEEAEEPDN

SEQ ID NO: 1311844 - protein, 9 aa, Homo Sapiens
INQENFKLL

SEQ ID NO: 1311845 - protein, 9 aa, Homo Sapiens
KLSSCLSKA

SEQ ID NO: 1311846 - protein, 9 aa, Homo Sapiens
TQVPALQSN

SEQ ID NO: 1311847 - protein, 9 aa, Homo Sapiens
IQRLFARGE

SEQ ID NO: 1311848 - protein, 9 aa, Homo Sapiens
DLISQTAVV

SEQ ID NO: 1311849 - protein, 9 aa, Homo Sapiens
GNSFFKQEC

SEQ ID NO: 1311850 - protein, 9 aa, Homo Sapiens
KITDAFSFL

SEQ ID NO: 1311851 - protein, 9 aa, Homo Sapiens
QMEPGDQGL

SEQ ID NO: 1311852 - protein, 9 aa, Homo Sapiens
HIKDMKVLE

SEQ ID NO: 1311853 - protein, 9 aa, Homo Sapiens
NILPRSQAT

SEQ ID NO: 1311854 - protein, 9 aa, Homo Sapiens
KGIQFSKGK

SEQ ID NO: 1311855 - protein, 9 aa, Homo Sapiens
DKRHVSIEE

SEQ ID NO: 1311856 - protein, 9 aa, Homo Sapiens
KFRRHVSTL

SEQ ID NO: 1311857 - protein, 9 aa, Homo Sapiens
EREMDEELD

SEQ ID NO: 1311858 - protein, 9 aa, Homo Sapiens
TTPHYVCCI

SEQ ID NO: 1311859 - protein, 9 aa, Homo Sapiens
TKVDSQPKE

SEQ ID NO: 1311860 - protein, 9 aa, Homo Sapiens
IEDLWKELE

SEQ ID NO: 1311861 - protein, 9 aa, Homo Sapiens
HVPLVDVND

SEQ ID NO: 1311862 - protein, 9 aa, Homo Sapiens
KLTTRVTKE

SEQ ID NO: 1311863 - protein, 9 aa, Homo Sapiens
ESFTFIPRP

SEQ ID NO: 1311864 - protein, 9 aa, Homo Sapiens
SSEDSITPS

SEQ ID NO: 1311865 - protein, 9 aa, Homo Sapiens
WGVGNEAGD

SEQ ID NO: 1311866 - protein, 9 aa, Homo Sapiens
ELSTQVPAL

SEQ ID NO: 1311867 - protein, 9 aa, Homo Sapiens
LGMAKYDIL

SEQ ID NO: 1311868 - protein, 9 aa, Homo Sapiens
AFAINHQLN

SEQ ID NO: 1311869 - protein, 9 aa, Homo Sapiens
QLSSDPSNQ

SEQ ID NO: 1311870 - protein, 9 aa, Homo Sapiens
ARLASASSL

SEQ ID NO: 1311871 - protein, 9 aa, Homo Sapiens
THALGEMLA

SEQ ID NO: 1311872 - protein, 9 aa, Homo Sapiens
VGFPGYPGP

SEQ ID NO: 1311873 - protein, 9 aa, Homo Sapiens
ILQSQGSPE

SEQ ID NO: 1311874 - protein, 9 aa, Homo Sapiens
MDREFALLL

SEQ ID NO: 1311875 - protein, 9 aa, Homo Sapiens
ILLFPVRGG

SEQ ID NO: 1311876 - protein, 9 aa, Homo Sapiens
LLDIRHELN

SEQ ID NO: 1311877 - protein, 9 aa, Homo Sapiens
TSVVPKNNE

SEQ ID NO: 1311878 - protein, 9 aa, Homo Sapiens
KKQVNTRLT

SEQ ID NO: 1311879 - protein, 9 aa, Homo Sapiens
VGDFHCKNH

SEQ ID NO: 1311880 - protein, 9 aa, Homo Sapiens
YKSKLKDEA

SEQ ID NO: 1311881 - protein, 9 aa, Homo Sapiens
IIHMREKSY

SEQ ID NO: 1311882 - protein, 9 aa, Homo Sapiens
VNFEDDYRG

SEQ ID NO: 1311883 - protein, 9 aa, Homo Sapiens
YRIILNGKD

SEQ ID NO: 1311884 - protein, 9 aa, Homo Sapiens
PLQINPLCN

SEQ ID NO: 1311885 - protein, 9 aa, Homo Sapiens
DFLQYLQSL

SEQ ID NO: 1311886 - protein, 9 aa, Homo Sapiens
APGISLSSL

SEQ ID NO: 1311887 - protein, 9 aa, Homo Sapiens
LKVLVVKLL

SEQ ID NO: 1311888 - protein, 9 aa, Homo Sapiens
SKENTMQEY

SEQ ID NO: 1311889 - protein, 9 aa, Homo Sapiens
SKYYVTITD

SEQ ID NO: 1311890 - protein, 9 aa, Homo Sapiens
GCLEYNHKE

SEQ ID NO: 1311891 - protein, 9 aa, Homo Sapiens
GAHKATKSK

SEQ ID NO: 1311892 - protein, 9 aa, Homo Sapiens
CVSKMYLNT

SEQ ID NO: 1311893 - protein, 9 aa, Homo Sapiens
NYLCGALQT

SEQ ID NO: 1311894 - protein, 9 aa, Homo Sapiens
PCGITSRNI

SEQ ID NO: 1311895 - protein, 9 aa, Homo Sapiens
DWAANKSPK

SEQ ID NO: 1311896 - protein, 9 aa, Homo Sapiens
GKLTIINLL

SEQ ID NO: 1311897 - protein, 9 aa, Homo Sapiens
KMPGSVSCF

SEQ ID NO: 1311898 - protein, 9 aa, Homo Sapiens
KNKAKLSLV

SEQ ID NO: 1311899 - protein, 9 aa, Homo Sapiens
EAEEPDNNS

SEQ ID NO: 1311900 - protein, 9 aa, Homo Sapiens
INHQIIHSR

SEQ ID NO: 1311901 - protein, 9 aa, Homo Sapiens
AFPSAKFSG

SEQ ID NO: 1311902 - protein, 9 aa, Homo Sapiens
KKEERAALI

SEQ ID NO: 1311903 - protein, 9 aa, Homo Sapiens
QLMIHQINH

SEQ ID NO: 1311904 - protein, 9 aa, Homo Sapiens
GTGAYGKLF

SEQ ID NO: 1311905 - protein, 9 aa, Homo Sapiens
DINQLTELF

SEQ ID NO: 1311906 - protein, 9 aa, Homo Sapiens
AKWISDTEL

SEQ ID NO: 1311907 - protein, 9 aa, Homo Sapiens
NKFSGLEIS

SEQ ID NO: 1311908 - protein, 9 aa, Homo Sapiens
MKQEAEQIK

SEQ ID NO: 1311909 - protein, 9 aa, Homo Sapiens
ISVTSVYWY

SEQ ID NO: 1311910 - protein, 9 aa, Homo Sapiens
YLQSIPRPE

SEQ ID NO: 1311911 - protein, 9 aa, Homo Sapiens
LKQGQSMHL

SEQ ID NO: 1311912 - protein, 9 aa, Homo Sapiens
EWIIEEVES

SEQ ID NO: 1311913 - protein, 9 aa, Homo Sapiens
RLDGHLNLA

SEQ ID NO: 1311914 - protein, 9 aa, Homo Sapiens
YPKLYLSPQ

SEQ ID NO: 1311915 - protein, 9 aa, Homo Sapiens
STGEKFYKC

SEQ ID NO: 1311916 - protein, 9 aa, Homo Sapiens
FSICLRTRS

SEQ ID NO: 1311917 - protein, 9 aa, Homo Sapiens
GVTKEVDGL

SEQ ID NO: 1311918 - protein, 9 aa, Homo Sapiens
ILNQSKNCE

SEQ ID NO: 1311919 - protein, 9 aa, Homo Sapiens
YKMNTKAGV

SEQ ID NO: 1311920 - protein, 9 aa, Homo Sapiens
FLIICGLTL

SEQ ID NO: 1311921 - protein, 9 aa, Homo Sapiens
LEEENGKYQ

SEQ ID NO: 1311922 - protein, 9 aa, Homo Sapiens
IQWPMTETG

SEQ ID NO: 1311923 - protein, 9 aa, Homo Sapiens
YNLSFDYYA

SEQ ID NO: 1311924 - protein, 9 aa, Homo Sapiens
NVEFSATCL

SEQ ID NO: 1311925 - protein, 9 aa, Homo Sapiens
YKVVVDRKH

SEQ ID NO: 1311926 - protein, 9 aa, Homo Sapiens
DKSDPPDGS

SEQ ID NO: 1311927 - protein, 9 aa, Homo Sapiens
KTLATDNNT

SEQ ID NO: 1311928 - protein, 9 aa, Homo Sapiens
RPKMLKEET

SEQ ID NO: 1311929 - protein, 9 aa, Homo Sapiens
QVEEMFNLK

SEQ ID NO: 1311930 - protein, 9 aa, Homo Sapiens
IIQRRYCST

SEQ ID NO: 1311931 - protein, 9 aa, Homo Sapiens
KYLLSDNVH

SEQ ID NO: 1311932 - protein, 9 aa, Homo Sapiens
EGFEPGPMI

SEQ ID NO: 1311933 - protein, 9 aa, Homo Sapiens
GCKLVLYLH

SEQ ID NO: 1311934 - protein, 9 aa, Homo Sapiens
KEVCSTFVQ

SEQ ID NO: 1311935 - protein, 9 aa, Homo Sapiens
IVLYPNAGQ

SEQ ID NO: 1311936 - protein, 9 aa, Homo Sapiens
RMDFSATQF

SEQ ID NO: 1311937 - protein, 9 aa, Homo Sapiens
YLDLSLFKH

SEQ ID NO: 1311938 - protein, 9 aa, Homo Sapiens
FLQYLQSLL

SEQ ID NO: 1311939 - protein, 9 aa, Homo Sapiens
NVFKLICDA

SEQ ID NO: 1311940 - protein, 9 aa, Homo Sapiens
NFKVFRYST

SEQ ID NO: 1311941 - protein, 9 aa, Homo Sapiens
EFACHQLYI

SEQ ID NO: 1311942 - protein, 9 aa, Homo Sapiens
KKLLKMITV

SEQ ID NO: 1311943 - protein, 9 aa, Homo Sapiens
NTGIILCII

SEQ ID NO: 1311944 - protein, 9 aa, Homo Sapiens
SYNSTMGGS

SEQ ID NO: 1311945 - protein, 9 aa, Homo Sapiens
TPKASPKYE

SEQ ID NO: 1311946 - protein, 9 aa, Homo Sapiens
SGLIQHQII

SEQ ID NO: 1311947 - protein, 9 aa, Homo Sapiens
KEEFCEAFC

SEQ ID NO: 1311948 - protein, 9 aa, Homo Sapiens
KKFTPNPST

SEQ ID NO: 1311949 - protein, 9 aa, Homo Sapiens
SFWLKRNIG

SEQ ID NO: 1311950 - protein, 9 aa, Homo Sapiens
AARDVNIPR

SEQ ID NO: 1311951 - protein, 9 aa, Homo Sapiens
TVINSRACY

SEQ ID NO: 1311952 - protein, 9 aa, Homo Sapiens
TEDKLKYND

SEQ ID NO: 1311953 - protein, 9 aa, Homo Sapiens
TLISNTCLV

SEQ ID NO: 1311954 - protein, 9 aa, Homo Sapiens
PRDSYAPYK

SEQ ID NO: 1311955 - protein, 9 aa, Homo Sapiens
MLSTFVMGK

SEQ ID NO: 1311956 - protein, 9 aa, Homo Sapiens
VIHAYSNKL

SEQ ID NO: 1311957 - protein, 9 aa, Homo Sapiens
SKTQKTYLI

SEQ ID NO: 1311958 - protein, 9 aa, Homo Sapiens
RFVLAYAGY

SEQ ID NO: 1311959 - protein, 9 aa, Homo Sapiens
GNKKNVEPF

SEQ ID NO: 1311960 - protein, 9 aa, Homo Sapiens
QHLINQWRN

SEQ ID NO: 1311961 - protein, 9 aa, Homo Sapiens
ESSSEASAY

SEQ ID NO: 1311962 - protein, 9 aa, Homo Sapiens
WAYQQLQQN

SEQ ID NO: 1311963 - protein, 9 aa, Homo Sapiens
KEDKLMKIC

SEQ ID NO: 1311964 - protein, 9 aa, Homo Sapiens
LAATHALGE

SEQ ID NO: 1311965 - protein, 9 aa, Homo Sapiens
TLATDNNTA

SEQ ID NO: 1311966 - protein, 9 aa, Homo Sapiens
SMGFPGHQG

SEQ ID NO: 1311967 - protein, 9 aa, Homo Sapiens
FRKHIKDMK

SEQ ID NO: 1311968 - protein, 9 aa, Homo Sapiens
KCQVCNKFF

SEQ ID NO: 1311969 - protein, 9 aa, Homo Sapiens
TILDRYYTA

SEQ ID NO: 1311970 - protein, 9 aa, Homo Sapiens
CCLVDLDLA

SEQ ID NO: 1311971 - protein, 9 aa, Homo Sapiens
KDNLVEALQ

SEQ ID NO: 1311972 - protein, 9 aa, Homo Sapiens
RCFPKVAIT

SEQ ID NO: 1311973 - protein, 9 aa, Homo Sapiens
ENNNNSLES

SEQ ID NO: 1311974 - protein, 9 aa, Homo Sapiens
VPAVQGVFR

SEQ ID NO: 1311975 - protein, 9 aa, Homo Sapiens
TAASIQTKK

SEQ ID NO: 1311976 - protein, 9 aa, Homo Sapiens
GIHKRYFRK

SEQ ID NO: 1311977 - protein, 9 aa, Homo Sapiens
LLPSWKTSF

SEQ ID NO: 1311978 - protein, 9 aa, Homo Sapiens
IPFDKMLYN

SEQ ID NO: 1311979 - protein, 9 aa, Homo Sapiens
RKANPFFQK

SEQ ID NO: 1311980 - protein, 9 aa, Homo Sapiens
WYEYQSPVQ

SEQ ID NO: 1311981 - protein, 9 aa, Homo Sapiens
RITLLPIPT

SEQ ID NO: 1311982 - protein, 9 aa, Homo Sapiens
HTKLNRAMD

SEQ ID NO: 1311983 - protein, 9 aa, Homo Sapiens
VVAMFIVVL

SEQ ID NO: 1311984 - protein, 9 aa, Homo Sapiens
KVNSEGKFD

SEQ ID NO: 1311985 - protein, 9 aa, Homo Sapiens
KFIFSLTSP

SEQ ID NO: 1311986 - protein, 9 aa, Homo Sapiens
TRNKNLAGP

SEQ ID NO: 1311987 - protein, 9 aa, Homo Sapiens
RKQTYEQIK

SEQ ID NO: 1311988 - protein, 9 aa, Homo Sapiens
LSELNRLLL

SEQ ID NO: 1311989 - protein, 9 aa, Homo Sapiens
HQKHIGSIN

SEQ ID NO: 1311990 - protein, 9 aa, Homo Sapiens
LRKNGFVML

SEQ ID NO: 1311991 - protein, 9 aa, Homo Sapiens
ELLDGINAN

SEQ ID NO: 1311992 - protein, 9 aa, Homo Sapiens
MNSQQTILD

SEQ ID NO: 1311993 - protein, 9 aa, Homo Sapiens
ARIVVLFMR

SEQ ID NO: 1311994 - protein, 9 aa, Homo Sapiens
EQNCQVMNI

SEQ ID NO: 1311995 - protein, 9 aa, Homo Sapiens
SVIIRVAKG

SEQ ID NO: 1311996 - protein, 9 aa, Homo Sapiens
QFESEAMKY

SEQ ID NO: 1311997 - protein, 9 aa, Homo Sapiens
KFTKVDSQP

SEQ ID NO: 1311998 - protein, 9 aa, Homo Sapiens
ETVRNILQS

SEQ ID NO: 1311999 - protein, 9 aa, Homo Sapiens
CKYNGKYEV

SEQ ID NO: 1312000 - protein, 9 aa, Homo Sapiens
ERITNSQNK

SEQ ID NO: 1312001 - protein, 9 aa, Homo Sapiens
ANKSPKISR

SEQ ID NO: 1312002 - protein, 9 aa, Homo Sapiens
LYLIAPTGH

SEQ ID NO: 1312003 - protein, 9 aa, Homo Sapiens
GKYSDAFGG

SEQ ID NO: 1312004 - protein, 9 aa, Homo Sapiens
VFEQIPENE

SEQ ID NO: 1312005 - protein, 9 aa, Homo Sapiens
NEFISIINP

SEQ ID NO: 1312006 - protein, 9 aa, Homo Sapiens
QKTPKASPK

SEQ ID NO: 1312007 - protein, 9 aa, Homo Sapiens
LQHIIQRRY

SEQ ID NO: 1312008 - protein, 9 aa, Homo Sapiens
LSYKMSDNI

SEQ ID NO: 1312009 - protein, 9 aa, Homo Sapiens
PKDSPRRAN

SEQ ID NO: 1312010 - protein, 9 aa, Homo Sapiens
NLLNSSITS

SEQ ID NO: 1312011 - protein, 9 aa, Homo Sapiens
RQVLDEANL

SEQ ID NO: 1312012 - protein, 9 aa, Homo Sapiens
QFLWGSRAH

SEQ ID NO: 1312013 - protein, 9 aa, Homo Sapiens
RTNLETQKE

SEQ ID NO: 1312014 - protein, 9 aa, Homo Sapiens
SINQENFKL

SEQ ID NO: 1312015 - protein, 9 aa, Homo Sapiens
TFTRSVSEM

SEQ ID NO: 1312016 - protein, 9 aa, Homo Sapiens
DSLKAYEDD

SEQ ID NO: 1312017 - protein, 9 aa, Homo Sapiens
NKIMLTKDL

SEQ ID NO: 1312018 - protein, 9 aa, Homo Sapiens
FMINGESKN

SEQ ID NO: 1312019 - protein, 9 aa, Homo Sapiens
KSECSLHEP

SEQ ID NO: 1312020 - protein, 9 aa, Homo Sapiens
LTRMSQFIE

SEQ ID NO: 1312021 - protein, 9 aa, Homo Sapiens
MEETVRNIL

SEQ ID NO: 1312022 - protein, 9 aa, Homo Sapiens
YNQTEDIRD

SEQ ID NO: 1312023 - protein, 9 aa, Homo Sapiens
HAPIHSAQH

SEQ ID NO: 1312024 - protein, 9 aa, Homo Sapiens
LEQDKSLAG

SEQ ID NO: 1312025 - protein, 9 aa, Homo Sapiens
KKEKKKIKK

SEQ ID NO: 1312026 - protein, 9 aa, Homo Sapiens
DSDGQHNGH

SEQ ID NO: 1312027 - protein, 9 aa, Homo Sapiens
RYCSTSYSA

SEQ ID NO: 1312028 - protein, 9 aa, Homo Sapiens
VRKGETIFV

SEQ ID NO: 1312029 - protein, 9 aa, Homo Sapiens
LHTKLNRAM

SEQ ID NO: 1312030 - protein, 9 aa, Homo Sapiens
WMAQYLENI

SEQ ID NO: 1312031 - protein, 9 aa, Homo Sapiens
YMQWPDMGV

SEQ ID NO: 1312032 - protein, 9 aa, Homo Sapiens
EATVSSKMI

SEQ ID NO: 1312033 - protein, 9 aa, Homo Sapiens
AERRNFICT

SEQ ID NO: 1312034 - protein, 9 aa, Homo Sapiens
WCMAQAYAE

SEQ ID NO: 1312035 - protein, 9 aa, Homo Sapiens
KSQFSICLR

SEQ ID NO: 1312036 - protein, 9 aa, Homo Sapiens
HQIIHTGEN

SEQ ID NO: 1312037 - protein, 9 aa, Homo Sapiens
SPSHQKHIG

SEQ ID NO: 1312038 - protein, 9 aa, Homo Sapiens
WGGVFLIIC

SEQ ID NO: 1312039 - protein, 9 aa, Homo Sapiens
HFTASSVKY

SEQ ID NO: 1312040 - protein, 9 aa, Homo Sapiens
DVNAQEQKF

SEQ ID NO: 1312041 - protein, 9 aa, Homo Sapiens
KKGEIFQII

SEQ ID NO: 1312042 - protein, 9 aa, Homo Sapiens
PDSDDRKAN

SEQ ID NO: 1312043 - protein, 9 aa, Homo Sapiens
EHKLIHIGE

SEQ ID NO: 1312044 - protein, 9 aa, Homo Sapiens
VEEMFNLKF

SEQ ID NO: 1312045 - protein, 9 aa, Homo Sapiens
LNINLISSE

SEQ ID NO: 1312046 - protein, 9 aa, Homo Sapiens
INKVNSEGK

SEQ ID NO: 1312047 - protein, 9 aa, Homo Sapiens
LWEFQLLET

SEQ ID NO: 1312048 - protein, 9 aa, Homo Sapiens
HQYPKFKWP

SEQ ID NO: 1312049 - protein, 9 aa, Homo Sapiens
QLCEQHKHT

SEQ ID NO: 1312050 - protein, 9 aa, Homo Sapiens
LKVNFEDDY

SEQ ID NO: 1312051 - protein, 9 aa, Homo Sapiens
TDNERFHMV

SEQ ID NO: 1312052 - protein, 9 aa, Homo Sapiens
LDGINANKT

SEQ ID NO: 1312053 - protein, 9 aa, Homo Sapiens
LDEANLEFL

SEQ ID NO: 1312054 - protein, 9 aa, Homo Sapiens
SALALARTP

SEQ ID NO: 1312055 - protein, 9 aa, Homo Sapiens
VGDFPEAGG

SEQ ID NO: 1312056 - protein, 9 aa, Homo Sapiens
SQLMIHQIN

SEQ ID NO: 1312057 - protein, 9 aa, Homo Sapiens
LSFRWTTSE

SEQ ID NO: 1312058 - protein, 9 aa, Homo Sapiens
DHNGRQRLI

SEQ ID NO: 1312059 - protein, 9 aa, Homo Sapiens
EYNDLSEPL

SEQ ID NO: 1312060 - protein, 9 aa, Homo Sapiens
VSVIIRVAK

SEQ ID NO: 1312061 - protein, 9 aa, Homo Sapiens
DYLAPRAVL

SEQ ID NO: 1312062 - protein, 9 aa, Homo Sapiens
SRNCQYSVW

SEQ ID NO: 1312063 - protein, 9 aa, Homo Sapiens
KHIKDMKVL

SEQ ID NO: 1312064 - protein, 9 aa, Homo Sapiens
EIYKESSTW

SEQ ID NO: 1312065 - protein, 9 aa, Homo Sapiens
RIVVTCKTF

SEQ ID NO: 1312066 - protein, 9 aa, Homo Sapiens
CACNEQEQN

SEQ ID NO: 1312067 - protein, 9 aa, Homo Sapiens
TSRTNQIKI

SEQ ID NO: 1312068 - protein, 9 aa, Homo Sapiens
RSRANQNIN

SEQ ID NO: 1312069 - protein, 9 aa, Homo Sapiens
CDTNFITYD

SEQ ID NO: 1312070 - protein, 9 aa, Homo Sapiens
PFEIQINEI

SEQ ID NO: 1312071 - protein, 9 aa, Homo Sapiens
IGDKPYRGS

SEQ ID NO: 1312072 - protein, 9 aa, Homo Sapiens
YGKKKTTFF

SEQ ID NO: 1312073 - protein, 9 aa, Homo Sapiens
KRLLEQDKS

SEQ ID NO: 1312074 - protein, 9 aa, Homo Sapiens
TKTPHNITI

SEQ ID NO: 1312075 - protein, 9 aa, Homo Sapiens
NKTLITERD

SEQ ID NO: 1312076 - protein, 9 aa, Homo Sapiens
IILLDINDN

SEQ ID NO: 1312077 - protein, 9 aa, Homo Sapiens
YYMWIKAAK

SEQ ID NO: 1312078 - protein, 9 aa, Homo Sapiens
KGRLDQLDE

SEQ ID NO: 1312079 - protein, 9 aa, Homo Sapiens
LKKKNEDCF

SEQ ID NO: 1312080 - protein, 9 aa, Homo Sapiens
SSPAPQDTT

SEQ ID NO: 1312081 - protein, 9 aa, Homo Sapiens
HCKAGKGGT

SEQ ID NO: 1312082 - protein, 9 aa, Homo Sapiens
QLIENLDAI

SEQ ID NO: 1312083 - protein, 9 aa, Homo Sapiens
LHSKVLRKI

SEQ ID NO: 1312084 - protein, 9 aa, Homo Sapiens
KGVRDMFHS

SEQ ID NO: 1312085 - protein, 9 aa, Homo Sapiens
ITNSQNKIK

SEQ ID NO: 1312086 - protein, 9 aa, Homo Sapiens
SDMYLIQPD

SEQ ID NO: 1312087 - protein, 9 aa, Homo Sapiens
LHKVFNCCL

SEQ ID NO: 1312088 - protein, 9 aa, Homo Sapiens
IQRRYCSTS

SEQ ID NO: 1312089 - protein, 9 aa, Homo Sapiens
QNFSMEIQQ

SEQ ID NO: 1312090 - protein, 9 aa, Homo Sapiens
YLIKFVSKL

SEQ ID NO: 1312091 - protein, 9 aa, Homo Sapiens
YAMLNEKIN

SEQ ID NO: 1312092 - protein, 9 aa, Homo Sapiens
VVTQYHYMQ

SEQ ID NO: 1312093 - protein, 9 aa, Homo Sapiens
NSLPELSPH

SEQ ID NO: 1312094 - protein, 9 aa, Homo Sapiens
HCTEITSAI

SEQ ID NO: 1312095 - protein, 9 aa, Homo Sapiens
FMEEENNNK

SEQ ID NO: 1312096 - protein, 9 aa, Homo Sapiens
TKLNRAMDN

SEQ ID NO: 1312097 - protein, 9 aa, Homo Sapiens
PFLKILEKL

SEQ ID NO: 1312098 - protein, 9 aa, Homo Sapiens
SFRMHEIIH

SEQ ID NO: 1312099 - protein, 9 aa, Homo Sapiens
AFRNNSGPK

SEQ ID NO: 1312100 - protein, 9 aa, Homo Sapiens
GKNNLHGDG

SEQ ID NO: 1312101 - protein, 9 aa, Homo Sapiens
PSKPIQAPS

SEQ ID NO: 1312102 - protein, 9 aa, Homo Sapiens
IAQEVEGKS

SEQ ID NO: 1312103 - protein, 9 aa, Homo Sapiens
TFLKNRWPN

SEQ ID NO: 1312104 - protein, 9 aa, Homo Sapiens
PQSPYKFPS

SEQ ID NO: 1312105 - protein, 9 aa, Homo Sapiens
SIKMTFIYL

SEQ ID NO: 1312106 - protein, 9 aa, Homo Sapiens
YVTITDAPG

SEQ ID NO: 1312107 - protein, 9 aa, Homo Sapiens
NNSLESSLR

SEQ ID NO: 1312108 - protein, 9 aa, Homo Sapiens
DGTLQSCST

SEQ ID NO: 1312109 - protein, 9 aa, Homo Sapiens
IRHFFCGMP

SEQ ID NO: 1312110 - protein, 9 aa, Homo Sapiens
PVPTRMGGL

SEQ ID NO: 1312111 - protein, 9 aa, Homo Sapiens
GYPGPPGEP

SEQ ID NO: 1312112 - protein, 9 aa, Homo Sapiens
ERRNKLCEL

SEQ ID NO: 1312113 - protein, 9 aa, Homo Sapiens
LNDGGNVLY

SEQ ID NO: 1312114 - protein, 9 aa, Homo Sapiens
IRHHQIHTG

SEQ ID NO: 1312115 - protein, 9 aa, Homo Sapiens
KPSGSSVSD

SEQ ID NO: 1312116 - protein, 9 aa, Homo Sapiens
IPQSPYKFP

SEQ ID NO: 1312117 - protein, 9 aa, Homo Sapiens
SKPLMRLEK

SEQ ID NO: 1312118 - protein, 9 aa, Homo Sapiens
VSRLRDTFL

SEQ ID NO: 1312119 - protein, 9 aa, Homo Sapiens
AKQEYEWDK

SEQ ID NO: 1312120 - protein, 9 aa, Homo Sapiens
KSLHTWVAL

SEQ ID NO: 1312121 - protein, 9 aa, Homo Sapiens
PHIPQSPYK

SEQ ID NO: 1312122 - protein, 9 aa, Homo Sapiens
GTPIPFDKM

SEQ ID NO: 1312123 - protein, 9 aa, Homo Sapiens
DFFMMSDYR

SEQ ID NO: 1312124 - protein, 9 aa, Homo Sapiens
VHGIQIEFI

SEQ ID NO: 1312125 - protein, 9 aa, Homo Sapiens
MKPFEIQIN

SEQ ID NO: 1312126 - protein, 9 aa, Homo Sapiens
VVNLEGVVT

SEQ ID NO: 1312127 - protein, 9 aa, Homo Sapiens
AKYLLSDNV

SEQ ID NO: 1312128 - protein, 9 aa, Homo Sapiens
ISGALQTFY

SEQ ID NO: 1312129 - protein, 9 aa, Homo Sapiens
FCFNKERAE

SEQ ID NO: 1312130 - protein, 9 aa, Homo Sapiens
LLKMITVHM

SEQ ID NO: 1312131 - protein, 9 aa, Homo Sapiens
DYWKKMPGS

SEQ ID NO: 1312132 - protein, 9 aa, Homo Sapiens
SSYNSTMGG

SEQ ID NO: 1312133 - protein, 9 aa, Homo Sapiens
IIHSGKNPY

SEQ ID NO: 1312134 - protein, 9 aa, Homo Sapiens
HTLILHPPS

SEQ ID NO: 1312135 - protein, 9 aa, Homo Sapiens
QFIEKETEE

SEQ ID NO: 1312136 - protein, 9 aa, Homo Sapiens
EHKQYINGL

SEQ ID NO: 1312137 - protein, 9 aa, Homo Sapiens
QVQINHIVN

SEQ ID NO: 1312138 - protein, 9 aa, Homo Sapiens
LVKEKIKNH

SEQ ID NO: 1312139 - protein, 9 aa, Homo Sapiens
DSHLSYTKI

SEQ ID NO: 1312140 - protein, 9 aa, Homo Sapiens
LAMTKSQII

SEQ ID NO: 1312141 - protein, 9 aa, Homo Sapiens
AIRNQLPLI

SEQ ID NO: 1312142 - protein, 9 aa, Homo Sapiens
SNINIHQKI

SEQ ID NO: 1312143 - protein, 9 aa, Homo Sapiens
SKLIEKIIL

SEQ ID NO: 1312144 - protein, 9 aa, Homo Sapiens
NCQYSVWVV

SEQ ID NO: 1312145 - protein, 9 aa, Homo Sapiens
ALSYYKSTS

SEQ ID NO: 1312146 - protein, 9 aa, Homo Sapiens
GMAKYDILW

SEQ ID NO: 1312147 - protein, 9 aa, Homo Sapiens
ISQVVCWRS

SEQ ID NO: 1312148 - protein, 9 aa, Homo Sapiens
LDNSRLNEG

SEQ ID NO: 1312149 - protein, 9 aa, Homo Sapiens
LNYQNNYFR

SEQ ID NO: 1312150 - protein, 9 aa, Homo Sapiens
RISLIALTQ

SEQ ID NO: 1312151 - protein, 9 aa, Homo Sapiens
NIRRDIKPD

SEQ ID NO: 1312152 - protein, 9 aa, Homo Sapiens
SNCLPKSSP

SEQ ID NO: 1312153 - protein, 9 aa, Homo Sapiens
ERPFKCIEC

SEQ ID NO: 1312154 - protein, 9 aa, Homo Sapiens
VEVVSHIRP

SEQ ID NO: 1312155 - protein, 9 aa, Homo Sapiens
VSMDYVPYT

SEQ ID NO: 1312156 - protein, 9 aa, Homo Sapiens
VLLKTREEV

SEQ ID NO: 1312157 - protein, 9 aa, Homo Sapiens
FGLEHTTSS

SEQ ID NO: 1312158 - protein, 9 aa, Homo Sapiens
CQVCNKFFR

SEQ ID NO: 1312159 - protein, 9 aa, Homo Sapiens
RRADHLLAA

SEQ ID NO: 1312160 - protein, 9 aa, Homo Sapiens
QDKYLSYGA

SEQ ID NO: 1312161 - protein, 9 aa, Homo Sapiens
RHNLEKLRV

SEQ ID NO: 1312162 - protein, 9 aa, Homo Sapiens
PAEYSSFII

SEQ ID NO: 1312163 - protein, 9 aa, Homo Sapiens
PYRNNITVP

SEQ ID NO: 1312164 - protein, 9 aa, Homo Sapiens
ESPDKPLEG

SEQ ID NO: 1312165 - protein, 9 aa, Homo Sapiens
KVIEPVGNH

SEQ ID NO: 1312166 - protein, 9 aa, Homo Sapiens
VSVGLPVDL

SEQ ID NO: 1312167 - protein, 9 aa, Homo Sapiens
QRGFIPGSY

SEQ ID NO: 1312168 - protein, 9 aa, Homo Sapiens
KQEAEQIKP

SEQ ID NO: 1312169 - protein, 9 aa, Homo Sapiens
LYQFNKKYG

SEQ ID NO: 1312170 - protein, 9 aa, Homo Sapiens
PLTISTHTT

SEQ ID NO: 1312171 - protein, 9 aa, Homo Sapiens
LSYFWYMRI

SEQ ID NO: 1312172 - protein, 9 aa, Homo Sapiens
GLCSDLELM

SEQ ID NO: 1312173 - protein, 9 aa, Homo Sapiens
KKQAKNQQR

SEQ ID NO: 1312174 - protein, 9 aa, Homo Sapiens
TLNSTFSSD

SEQ ID NO: 1312175 - protein, 9 aa, Homo Sapiens
RLLVFATDY

SEQ ID NO: 1312176 - protein, 9 aa, Homo Sapiens
LIKHHATIL

SEQ ID NO: 1312177 - protein, 9 aa, Homo Sapiens
CPLSGFILF

SEQ ID NO: 1312178 - protein, 9 aa, Homo Sapiens
IKLHKSHRG

SEQ ID NO: 1312179 - protein, 9 aa, Homo Sapiens
KAFSPPIKH

SEQ ID NO: 1312180 - protein, 9 aa, Homo Sapiens
DVGDFPEAG

SEQ ID NO: 1312181 - protein, 9 aa, Homo Sapiens
VLAEVVTGL

SEQ ID NO: 1312182 - protein, 9 aa, Homo Sapiens
MTETGKENN

SEQ ID NO: 1312183 - protein, 9 aa, Homo Sapiens
LDTMPVRSS

SEQ ID NO: 1312184 - protein, 9 aa, Homo Sapiens
QLSSDESGY

SEQ ID NO: 1312185 - protein, 9 aa, Homo Sapiens
QFVDMVNGT

SEQ ID NO: 1312186 - protein, 9 aa, Homo Sapiens
EEEEEIRKK

SEQ ID NO: 1312187 - protein, 9 aa, Homo Sapiens
ILSMSITNP

SEQ ID NO: 1312188 - protein, 9 aa, Homo Sapiens
LVFATDYGF

SEQ ID NO: 1312189 - protein, 9 aa, Homo Sapiens
EMCKGVRDM

SEQ ID NO: 1312190 - protein, 9 aa, Homo Sapiens
KTATIMVHS

SEQ ID NO: 1312191 - protein, 9 aa, Homo Sapiens
KKNICRKCS

SEQ ID NO: 1312192 - protein, 9 aa, Homo Sapiens
SHLIRHHQI

SEQ ID NO: 1312193 - protein, 9 aa, Homo Sapiens
SGYSCGPGT

SEQ ID NO: 1312194 - protein, 9 aa, Homo Sapiens
FQITLECRA

SEQ ID NO: 1312195 - protein, 9 aa, Homo Sapiens
QHYCGVCLG

SEQ ID NO: 1312196 - protein, 9 aa, Homo Sapiens
LVGMSGKQN

SEQ ID NO: 1312197 - protein, 9 aa, Homo Sapiens
VITINQDPL

SEQ ID NO: 1312198 - protein, 9 aa, Homo Sapiens
RAKEDKVEE

SEQ ID NO: 1312199 - protein, 9 aa, Homo Sapiens
KNHKLEYKY

SEQ ID NO: 1312200 - protein, 9 aa, Homo Sapiens
RQEALQSEE

SEQ ID NO: 1312201 - protein, 9 aa, Homo Sapiens
LASSSEDSI

SEQ ID NO: 1312202 - protein, 9 aa, Homo Sapiens
LNSVQHLIN

SEQ ID NO: 1312203 - protein, 9 aa, Homo Sapiens
PNKEVKKKR

SEQ ID NO: 1312204 - protein, 9 aa, Homo Sapiens
VTFDKEDNI

SEQ ID NO: 1312205 - protein, 9 aa, Homo Sapiens
TELNHHAYV

SEQ ID NO: 1312206 - protein, 9 aa, Homo Sapiens
ENCTCTCQG

SEQ ID NO: 1312207 - protein, 9 aa, Homo Sapiens
QKAAPSSQR

SEQ ID NO: 1312208 - protein, 9 aa, Homo Sapiens
LCIIMLLAV

SEQ ID NO: 1312209 - protein, 9 aa, Homo Sapiens
IISYFLNNT

SEQ ID NO: 1312210 - protein, 9 aa, Homo Sapiens
SWDKIKSSF

SEQ ID NO: 1312211 - protein, 9 aa, Homo Sapiens
DEQRAVKYI

SEQ ID NO: 1312212 - protein, 9 aa, Homo Sapiens
FIHCSAGCG

SEQ ID NO: 1312213 - protein, 9 aa, Homo Sapiens
KSNKSLIGG

SEQ ID NO: 1312214 - protein, 9 aa, Homo Sapiens
QISISERRA

SEQ ID NO: 1312215 - protein, 9 aa, Homo Sapiens
NVIRHFFCG

SEQ ID NO: 1312216 - protein, 9 aa, Homo Sapiens
FFSSIHRHR

SEQ ID NO: 1312217 - protein, 9 aa, Homo Sapiens
TLVEQHGTD

SEQ ID NO: 1312218 - protein, 9 aa, Homo Sapiens
WSAETAPGI

SEQ ID NO: 1312219 - protein, 9 aa, Homo Sapiens
LRMYKNKGI

SEQ ID NO: 1312220 - protein, 9 aa, Homo Sapiens
SLADRVHTS

SEQ ID NO: 1312221 - protein, 9 aa, Homo Sapiens
VTILQATPS

SEQ ID NO: 1312222 - protein, 9 aa, Homo Sapiens
NANKTAELS

SEQ ID NO: 1312223 - protein, 9 aa, Homo Sapiens
DLSFKKGEI

SEQ ID NO: 1312224 - protein, 9 aa, Homo Sapiens
HQKEIDTIN

SEQ ID NO: 1312225 - protein, 9 aa, Homo Sapiens
HNEFEEQAK

SEQ ID NO: 1312226 - protein, 9 aa, Homo Sapiens
KQTYEQIKV

SEQ ID NO: 1312227 - protein, 9 aa, Homo Sapiens
LLDKDENDL

SEQ ID NO: 1312228 - protein, 9 aa, Homo Sapiens
FWARCTSLN

SEQ ID NO: 1312229 - protein, 9 aa, Homo Sapiens
VGQLGPEGE

SEQ ID NO: 1312230 - protein, 9 aa, Homo Sapiens
DGPSIYFNA

SEQ ID NO: 1312231 - protein, 9 aa, Homo Sapiens
LFGPIRLGA

SEQ ID NO: 1312232 - protein, 9 aa, Homo Sapiens
PRMSSDANE

SEQ ID NO: 1312233 - protein, 9 aa, Homo Sapiens
YADNILSFY

SEQ ID NO: 1312234 - protein, 9 aa, Homo Sapiens
FTFIPRPRE

SEQ ID NO: 1312235 - protein, 9 aa, Homo Sapiens
GQAPCLPQA

SEQ ID NO: 1312236 - protein, 9 aa, Homo Sapiens
INPDAFIAY

SEQ ID NO: 1312237 - protein, 9 aa, Homo Sapiens
TQGLGTALN

SEQ ID NO: 1312238 - protein, 9 aa, Homo Sapiens
EVGFPDSLK

SEQ ID NO: 1312239 - protein, 9 aa, Homo Sapiens
DLSLFKHRG

SEQ ID NO: 1312240 - protein, 9 aa, Homo Sapiens
PICDTNFIT

SEQ ID NO: 1312241 - protein, 9 aa, Homo Sapiens
HKLEYKYSK

SEQ ID NO: 1312242 - protein, 9 aa, Homo Sapiens
DNILPRSQA

SEQ ID NO: 1312243 - protein, 9 aa, Homo Sapiens
PLLRIARRA

SEQ ID NO: 1312244 - protein, 9 aa, Homo Sapiens
IIHMELRPY

SEQ ID NO: 1312245 - protein, 9 aa, Homo Sapiens
LSPQIEHAL

SEQ ID NO: 1312246 - protein, 9 aa, Homo Sapiens
QAIILPQPP

SEQ ID NO: 1312247 - protein, 9 aa, Homo Sapiens
LLQDKDVIT

SEQ ID NO: 1312248 - protein, 9 aa, Homo Sapiens
ARDVNIPRP

SEQ ID NO: 1312249 - protein, 9 aa, Homo Sapiens
ELQEKYKEL

SEQ ID NO: 1312250 - protein, 9 aa, Homo Sapiens
PLLAETSET

SEQ ID NO: 1312251 - protein, 9 aa, Homo Sapiens
IEKTETSLG

SEQ ID NO: 1312252 - protein, 9 aa, Homo Sapiens
SKLPRNLKT

SEQ ID NO: 1312253 - protein, 9 aa, Homo Sapiens
KWDNLSNHV

SEQ ID NO: 1312254 - protein, 9 aa, Homo Sapiens
TANKCVSCQ

SEQ ID NO: 1312255 - protein, 9 aa, Homo Sapiens
WMVCLTFKQ

SEQ ID NO: 1312256 - protein, 9 aa, Homo Sapiens
MAMTHNAKY

SEQ ID NO: 1312257 - protein, 9 aa, Homo Sapiens
TQKLKDTLG

SEQ ID NO: 1312258 - protein, 9 aa, Homo Sapiens
IIPLHIISI

SEQ ID NO: 1312259 - protein, 9 aa, Homo Sapiens
INAHKVVLA

SEQ ID NO: 1312260 - protein, 9 aa, Homo Sapiens
AYGKLFLVR

SEQ ID NO: 1312261 - protein, 9 aa, Homo Sapiens
ILSFYFDPF

SEQ ID NO: 1312262 - protein, 9 aa, Homo Sapiens
FSRIYLYSL

SEQ ID NO: 1312263 - protein, 9 aa, Homo Sapiens
VRRHEIHES

SEQ ID NO: 1312264 - protein, 9 aa, Homo Sapiens
PIDFLEPEG

SEQ ID NO: 1312265 - protein, 9 aa, Homo Sapiens
VCLLLELED

SEQ ID NO: 1312266 - protein, 9 aa, Homo Sapiens
KIQMEPGDQ

SEQ ID NO: 1312267 - protein, 9 aa, Homo Sapiens
RSFALFFDD

SEQ ID NO: 1312268 - protein, 9 aa, Homo Sapiens
NVQKRKQSF

SEQ ID NO: 1312269 - protein, 9 aa, Homo Sapiens
ENNNKNMGQ

SEQ ID NO: 1312270 - protein, 9 aa, Homo Sapiens
QNAIKSSME

SEQ ID NO: 1312271 - protein, 9 aa, Homo Sapiens
IIMLSVLKN

SEQ ID NO: 1312272 - protein, 9 aa, Homo Sapiens
DIYRTPLYY

SEQ ID NO: 1312273 - protein, 9 aa, Homo Sapiens
SLHLYGIGG

SEQ ID NO: 1312274 - protein, 9 aa, Homo Sapiens
NVFDPNRFS

SEQ ID NO: 1312275 - protein, 9 aa, Homo Sapiens
SSPRVIQNK

SEQ ID NO: 1312276 - protein, 9 aa, Homo Sapiens
TRINLFIAL

SEQ ID NO: 1312277 - protein, 9 aa, Homo Sapiens
TTVYLIDFS

SEQ ID NO: 1312278 - protein, 9 aa, Homo Sapiens
LNTITQKAR

SEQ ID NO: 1312279 - protein, 9 aa, Homo Sapiens
GDIHATRQI

SEQ ID NO: 1312280 - protein, 9 aa, Homo Sapiens
MIIFLGPLM

SEQ ID NO: 1312281 - protein, 9 aa, Homo Sapiens
VMNSQQTIL

SEQ ID NO: 1312282 - protein, 9 aa, Homo Sapiens
VSDTLKTLL

SEQ ID NO: 1312283 - protein, 9 aa, Homo Sapiens
IKYEHTIQK

SEQ ID NO: 1312284 - protein, 9 aa, Homo Sapiens
GFNSPFNGE

SEQ ID NO: 1312285 - protein, 9 aa, Homo Sapiens
REGVSCTIR

SEQ ID NO: 1312286 - protein, 9 aa, Homo Sapiens
FLRHEIIHM

SEQ ID NO: 1312287 - protein, 9 aa, Homo Sapiens
EINKFLEYF

SEQ ID NO: 1312288 - protein, 9 aa, Homo Sapiens
RITSRTNQI

SEQ ID NO: 1312289 - protein, 9 aa, Homo Sapiens
AALDRETQE

SEQ ID NO: 1312290 - protein, 9 aa, Homo Sapiens
HNLEKLRVD

SEQ ID NO: 1312291 - protein, 9 aa, Homo Sapiens
QPDFVPFPP

SEQ ID NO: 1312292 - protein, 9 aa, Homo Sapiens
KLIHIGEKR

SEQ ID NO: 1312293 - protein, 9 aa, Homo Sapiens
QLEYRGLAS

SEQ ID NO: 1312294 - protein, 9 aa, Homo Sapiens
TLITERDNV

SEQ ID NO: 1312295 - protein, 9 aa, Homo Sapiens
KNKPLKKKP

SEQ ID NO: 1312296 - protein, 9 aa, Homo Sapiens
ERCRINLVA

SEQ ID NO: 1312297 - protein, 9 aa, Homo Sapiens
MPAYQLGLP

SEQ ID NO: 1312298 - protein, 9 aa, Homo Sapiens
STDKGNENS

SEQ ID NO: 1312299 - protein, 9 aa, Homo Sapiens
GIQIEKHFN

SEQ ID NO: 1312300 - protein, 9 aa, Homo Sapiens
DKIKSSFHN

SEQ ID NO: 1312301 - protein, 9 aa, Homo Sapiens
VLAMQHYEQ

SEQ ID NO: 1312302 - protein, 9 aa, Homo Sapiens
MSDVSDLII

SEQ ID NO: 1312303 - protein, 9 aa, Homo Sapiens
MQEYLPSGI

SEQ ID NO: 1312304 - protein, 9 aa, Homo Sapiens
NKGIQESEP

SEQ ID NO: 1312305 - protein, 9 aa, Homo Sapiens
LEKHDDKSP

SEQ ID NO: 1312306 - protein, 9 aa, Homo Sapiens
AGKGGTGVM

SEQ ID NO: 1312307 - protein, 9 aa, Homo Sapiens
YGTIKEENF

SEQ ID NO: 1312308 - protein, 9 aa, Homo Sapiens
SFVNLFCFN

SEQ ID NO: 1312309 - protein, 9 aa, Homo Sapiens
LLFDRHPYG

SEQ ID NO: 1312310 - protein, 9 aa, Homo Sapiens
QVFSGLEEQ

SEQ ID NO: 1312311 - protein, 9 aa, Homo Sapiens
FALLLLIFD

SEQ ID NO: 1312312 - protein, 9 aa, Homo Sapiens
NTTFSFCPP

SEQ ID NO: 1312313 - protein, 9 aa, Homo Sapiens
ATHALGEML

SEQ ID NO: 1312314 - protein, 9 aa, Homo Sapiens
PPGSPTSVT

SEQ ID NO: 1312315 - protein, 9 aa, Homo Sapiens
SSCAVVANI

SEQ ID NO: 1312316 - protein, 9 aa, Homo Sapiens
KNICRKCSE

SEQ ID NO: 1312317 - protein, 9 aa, Homo Sapiens
TDKRYISVV

SEQ ID NO: 1312318 - protein, 9 aa, Homo Sapiens
SCFRDKMAG

SEQ ID NO: 1312319 - protein, 9 aa, Homo Sapiens
GCWHGSKDE

SEQ ID NO: 1312320 - protein, 9 aa, Homo Sapiens
FQLHQGGKI

SEQ ID NO: 1312321 - protein, 9 aa, Homo Sapiens
RRRRATPHS

SEQ ID NO: 1312322 - protein, 9 aa, Homo Sapiens
TKPEPRDGI

SEQ ID NO: 1312323 - protein, 9 aa, Homo Sapiens
AFSGLGFGL

SEQ ID NO: 1312324 - protein, 9 aa, Homo Sapiens
AFANYSVLC

SEQ ID NO: 1312325 - protein, 9 aa, Homo Sapiens
RPSLHLPLW

SEQ ID NO: 1312326 - protein, 9 aa, Homo Sapiens
EHEDVPIFI

SEQ ID NO: 1312327 - protein, 9 aa, Homo Sapiens
YDGIGGLVW

SEQ ID NO: 1312328 - protein, 9 aa, Homo Sapiens
NEDFQYGYS

SEQ ID NO: 1312329 - protein, 9 aa, Homo Sapiens
AEINKFLEY

SEQ ID NO: 1312330 - protein, 9 aa, Homo Sapiens
SDPCVLLPD

SEQ ID NO: 1312331 - protein, 9 aa, Homo Sapiens
CPPGMHKLK

SEQ ID NO: 1312332 - protein, 9 aa, Homo Sapiens
IEERRNKLC

SEQ ID NO: 1312333 - protein, 9 aa, Homo Sapiens
NQISTLHAI

SEQ ID NO: 1312334 - protein, 9 aa, Homo Sapiens
VEGQPLHTK

SEQ ID NO: 1312335 - protein, 9 aa, Homo Sapiens
FSSIHRHRK

SEQ ID NO: 1312336 - protein, 9 aa, Homo Sapiens
LLEVLLNYY

SEQ ID NO: 1312337 - protein, 9 aa, Homo Sapiens
TLSEDERKL

SEQ ID NO: 1312338 - protein, 9 aa, Homo Sapiens
LIDMQLNHD

SEQ ID NO: 1312339 - protein, 9 aa, Homo Sapiens
MARNKFSGL

SEQ ID NO: 1312340 - protein, 9 aa, Homo Sapiens
LRHEIIHMR

SEQ ID NO: 1312341 - protein, 9 aa, Homo Sapiens
TIKEENFVS

SEQ ID NO: 1312342 - protein, 9 aa, Homo Sapiens
QVSGSQVEV

SEQ ID NO: 1312343 - protein, 9 aa, Homo Sapiens
NVHFFYTNF

SEQ ID NO: 1312344 - protein, 9 aa, Homo Sapiens
LSLLSSTLK

SEQ ID NO: 1312345 - protein, 9 aa, Homo Sapiens
IHATRQIDR

SEQ ID NO: 1312346 - protein, 9 aa, Homo Sapiens
EKETLLATE

SEQ ID NO: 1312347 - protein, 9 aa, Homo Sapiens
NKEVKKKRW

SEQ ID NO: 1312348 - protein, 9 aa, Homo Sapiens
GSSREGVSC

SEQ ID NO: 1312349 - protein, 9 aa, Homo Sapiens
VTRYSDAQG

SEQ ID NO: 1312350 - protein, 9 aa, Homo Sapiens
PVLAEVVTG

SEQ ID NO: 1312351 - protein, 9 aa, Homo Sapiens
IKSVGTLFG

SEQ ID NO: 1312352 - protein, 9 aa, Homo Sapiens
GMHKLKLEQ

SEQ ID NO: 1312353 - protein, 9 aa, Homo Sapiens
AYPNSEVIY

SEQ ID NO: 1312354 - protein, 9 aa, Homo Sapiens
PKVIEENNI

SEQ ID NO: 1312355 - protein, 9 aa, Homo Sapiens
SPIPHIPQS

SEQ ID NO: 1312356 - protein, 9 aa, Homo Sapiens
NGFVMLKGR

SEQ ID NO: 1312357 - protein, 9 aa, Homo Sapiens
DSIYHTLGS

SEQ ID NO: 1312358 - protein, 9 aa, Homo Sapiens
KTISFWSRV

SEQ ID NO: 1312359 - protein, 9 aa, Homo Sapiens
TALIMPVIP

SEQ ID NO: 1312360 - protein, 9 aa, Homo Sapiens
DGYSDKIEH

SEQ ID NO: 1312361 - protein, 9 aa, Homo Sapiens
SKMITPEYL

SEQ ID NO: 1312362 - protein, 9 aa, Homo Sapiens
TIINLLTEH

SEQ ID NO: 1312363 - protein, 9 aa, Homo Sapiens
RKIKINKDI

SEQ ID NO: 1312364 - protein, 9 aa, Homo Sapiens
TKLYRCFKY

SEQ ID NO: 1312365 - protein, 9 aa, Homo Sapiens
TIGWMKFRL

SEQ ID NO: 1312366 - protein, 9 aa, Homo Sapiens
CRNLLNSSI

SEQ ID NO: 1312367 - protein, 9 aa, Homo Sapiens
NSTMGGSIC

SEQ ID NO: 1312368 - protein, 9 aa, Homo Sapiens
KFSGLISYS

SEQ ID NO: 1312369 - protein, 9 aa, Homo Sapiens
YEESDEEEE

SEQ ID NO: 1312370 - protein, 9 aa, Homo Sapiens
CAVVANIVL

SEQ ID NO: 1312371 - protein, 9 aa, Homo Sapiens
VSKRFCFDD

SEQ ID NO: 1312372 - protein, 9 aa, Homo Sapiens
TEPKYQCLI

SEQ ID NO: 1312373 - protein, 9 aa, Homo Sapiens
NVKKKHTNK

SEQ ID NO: 1312374 - protein, 9 aa, Homo Sapiens
IGGLRPAPG

SEQ ID NO: 1312375 - protein, 9 aa, Homo Sapiens
GQTICIDNK

SEQ ID NO: 1312376 - protein, 9 aa, Homo Sapiens
QDKRNIYLI

SEQ ID NO: 1312377 - protein, 9 aa, Homo Sapiens
TASSVKYKS

SEQ ID NO: 1312378 - protein, 9 aa, Homo Sapiens
LLQFQVTDL

SEQ ID NO: 1312379 - protein, 9 aa, Homo Sapiens
VFFKTLQNH

SEQ ID NO: 1312380 - protein, 9 aa, Homo Sapiens
LTFFTSTLH

SEQ ID NO: 1312381 - protein, 9 aa, Homo Sapiens
SFLQDCLHG

SEQ ID NO: 1312382 - protein, 9 aa, Homo Sapiens
LSMSITNPL

SEQ ID NO: 1312383 - protein, 9 aa, Homo Sapiens
GIRALVMYL

SEQ ID NO: 1312384 - protein, 9 aa, Homo Sapiens
KTINNTASV

SEQ ID NO: 1312385 - protein, 9 aa, Homo Sapiens
LYRVISKNI

SEQ ID NO: 1312386 - protein, 9 aa, Homo Sapiens
VGDTISLLC

SEQ ID NO: 1312387 - protein, 9 aa, Homo Sapiens
YKEIVKNYL

SEQ ID NO: 1312388 - protein, 9 aa, Homo Sapiens
WGSRAHAET

SEQ ID NO: 1312389 - protein, 9 aa, Homo Sapiens
AKFSGLISY

SEQ ID NO: 1312390 - protein, 9 aa, Homo Sapiens
PLLVWVKRK

SEQ ID NO: 1312391 - protein, 9 aa, Homo Sapiens
PGKHLVTKV

SEQ ID NO: 1312392 - protein, 9 aa, Homo Sapiens
LIQSEEIKD

SEQ ID NO: 1312393 - protein, 9 aa, Homo Sapiens
DEGKCVEEI

SEQ ID NO: 1312394 - protein, 9 aa, Homo Sapiens
GLFTTHKGH

SEQ ID NO: 1312395 - protein, 9 aa, Homo Sapiens
HVCLYLIAP

SEQ ID NO: 1312396 - protein, 9 aa, Homo Sapiens
LISNTCLVT

SEQ ID NO: 1312397 - protein, 9 aa, Homo Sapiens
DKRMLKVIH

SEQ ID NO: 1312398 - protein, 9 aa, Homo Sapiens
GLTSLTDVV

SEQ ID NO: 1312399 - protein, 9 aa, Homo Sapiens
NNLNPVWEE

SEQ ID NO: 1312400 - protein, 9 aa, Homo Sapiens
PQDTTAAPI

SEQ ID NO: 1312401 - protein, 9 aa, Homo Sapiens
AVQGPKGSS

SEQ ID NO: 1312402 - protein, 9 aa, Homo Sapiens
TSEIIIAYL

SEQ ID NO: 1312403 - protein, 9 aa, Homo Sapiens
LTVAAEEEK

SEQ ID NO: 1312404 - protein, 9 aa, Homo Sapiens
LSSTYAEQL

SEQ ID NO: 1312405 - protein, 9 aa, Homo Sapiens
KSHLIIHKI

SEQ ID NO: 1312406 - protein, 9 aa, Homo Sapiens
EKTETSLGI

SEQ ID NO: 1312407 - protein, 9 aa, Homo Sapiens
CIMKGIKPN

SEQ ID NO: 1312408 - protein, 9 aa, Homo Sapiens
NASGYSCGP

SEQ ID NO: 1312409 - protein, 9 aa, Homo Sapiens
SEMYRMEEV

SEQ ID NO: 1312410 - protein, 9 aa, Homo Sapiens
NKYATGKPD

SEQ ID NO: 1312411 - protein, 9 aa, Homo Sapiens
DMYLIQPDS

SEQ ID NO: 1312412 - protein, 9 aa, Homo Sapiens
RSLGYSDLL

SEQ ID NO: 1312413 - protein, 9 aa, Homo Sapiens
HLTSHKIIH

SEQ ID NO: 1312414 - protein, 9 aa, Homo Sapiens
ALLLLIFDE

SEQ ID NO: 1312415 - protein, 9 aa, Homo Sapiens
HMLRITHTE

SEQ ID NO: 1312416 - protein, 9 aa, Homo Sapiens
WDGWLCWNN

SEQ ID NO: 1312417 - protein, 9 aa, Homo Sapiens
EIPNINTQM

SEQ ID NO: 1312418 - protein, 9 aa, Homo Sapiens
EVNQSNYKL

SEQ ID NO: 1312419 - protein, 9 aa, Homo Sapiens
GRFRGTKPE

SEQ ID NO: 1312420 - protein, 9 aa, Homo Sapiens
LKLFCEIDE

SEQ ID NO: 1312421 - protein, 9 aa, Homo Sapiens
PEDKCRMAT

SEQ ID NO: 1312422 - protein, 9 aa, Homo Sapiens
HGDYLKKEF

SEQ ID NO: 1312423 - protein, 9 aa, Homo Sapiens
MIYFDFWFQ

SEQ ID NO: 1312424 - protein, 9 aa, Homo Sapiens
TLKNIISRP

SEQ ID NO: 1312425 - protein, 9 aa, Homo Sapiens
HFSNIYFYC

SEQ ID NO: 1312426 - protein, 9 aa, Homo Sapiens
DGSKYETIN

SEQ ID NO: 1312427 - protein, 9 aa, Homo Sapiens
IKNMIHMIY

SEQ ID NO: 1312428 - protein, 9 aa, Homo Sapiens
DSLEATVSS

SEQ ID NO: 1312429 - protein, 9 aa, Homo Sapiens
ATGVDYITV

SEQ ID NO: 1312430 - protein, 9 aa, Homo Sapiens
NGKYEVCLT

SEQ ID NO: 1312431 - protein, 9 aa, Homo Sapiens
VRPPYRNNI

SEQ ID NO: 1312432 - protein, 9 aa, Homo Sapiens
LHQGGKINL

SEQ ID NO: 1312433 - protein, 9 aa, Homo Sapiens
KLLQEYYKI

SEQ ID NO: 1312434 - protein, 9 aa, Homo Sapiens
YDNNRLCPS

SEQ ID NO: 1312435 - protein, 9 aa, Homo Sapiens
LAYKIKYPD

SEQ ID NO: 1312436 - protein, 9 aa, Homo Sapiens
TDFWARCTS

SEQ ID NO: 1312437 - protein, 9 aa, Homo Sapiens
HSKVLRKIE

SEQ ID NO: 1312438 - protein, 9 aa, Homo Sapiens
TYGLFCGES

SEQ ID NO: 1312439 - protein, 9 aa, Homo Sapiens
IKDMKVLEK

SEQ ID NO: 1312440 - protein, 9 aa, Homo Sapiens
IYIPFPEYD

SEQ ID NO: 1312441 - protein, 9 aa, Homo Sapiens
TIQAARSDN

SEQ ID NO: 1312442 - protein, 9 aa, Homo Sapiens
CGKSFSCVS

SEQ ID NO: 1312443 - protein, 9 aa, Homo Sapiens
VGVFSFSRL

SEQ ID NO: 1312444 - protein, 9 aa, Homo Sapiens
YKIYHLALS

SEQ ID NO: 1312445 - protein, 9 aa, Homo Sapiens
TVSSKMITP

SEQ ID NO: 1312446 - protein, 9 aa, Homo Sapiens
VCLYLIAPT

SEQ ID NO: 1312447 - protein, 9 aa, Homo Sapiens
RETQELYIL

SEQ ID NO: 1312448 - protein, 9 aa, Homo Sapiens
NAQEQKFGR

SEQ ID NO: 1312449 - protein, 9 aa, Homo Sapiens
SPKAFSPPI

SEQ ID NO: 1312450 - protein, 9 aa, Homo Sapiens
YLDICDDDE

SEQ ID NO: 1312451 - protein, 9 aa, Homo Sapiens
GNNSNVTSP

SEQ ID NO: 1312452 - protein, 9 aa, Homo Sapiens
GAEACNLMQ

SEQ ID NO: 1312453 - protein, 9 aa, Homo Sapiens
SKDEEVPSK

SEQ ID NO: 1312454 - protein, 9 aa, Homo Sapiens
VKLCWMLDN

SEQ ID NO: 1312455 - protein, 9 aa, Homo Sapiens
SKMKVLELL

SEQ ID NO: 1312456 - protein, 9 aa, Homo Sapiens
LIAPTGHSL

SEQ ID NO: 1312457 - protein, 9 aa, Homo Sapiens
DDYRGKYLE

SEQ ID NO: 1312458 - protein, 9 aa, Homo Sapiens
YLYSLISLF

SEQ ID NO: 1312459 - protein, 9 aa, Homo Sapiens
NSERINIIR

SEQ ID NO: 1312460 - protein, 9 aa, Homo Sapiens
NVSEAQNIS

SEQ ID NO: 1312461 - protein, 9 aa, Homo Sapiens
YNKTLATDN

SEQ ID NO: 1312462 - protein, 9 aa, Homo Sapiens
NEWMAQYLE

SEQ ID NO: 1312463 - protein, 9 aa, Homo Sapiens
LQETNWRDY

SEQ ID NO: 1312464 - protein, 9 aa, Homo Sapiens
CDLSVLGSS

SEQ ID NO: 1312465 - protein, 9 aa, Homo Sapiens
VNIPRPPGA

SEQ ID NO: 1312466 - protein, 9 aa, Homo Sapiens
GIKPNKVPG

SEQ ID NO: 1312467 - protein, 9 aa, Homo Sapiens
NVTSKEICN

SEQ ID NO: 1312468 - protein, 9 aa, Homo Sapiens
YSHESGEQN

SEQ ID NO: 1312469 - protein, 9 aa, Homo Sapiens
SNQKIVFQE

SEQ ID NO: 1312470 - protein, 9 aa, Homo Sapiens
GGTGVMICA

SEQ ID NO: 1312471 - protein, 9 aa, Homo Sapiens
RKQKSSTSG

SEQ ID NO: 1312472 - protein, 9 aa, Homo Sapiens
RNYKALSKV

SEQ ID NO: 1312473 - protein, 9 aa, Homo Sapiens
NKAKLSLVG

SEQ ID NO: 1312474 - protein, 9 aa, Homo Sapiens
FKCQVCNKF

SEQ ID NO: 1312475 - protein, 9 aa, Homo Sapiens
GSLSDKLAA

SEQ ID NO: 1312476 - protein, 9 aa, Homo Sapiens
EQDGPSIYF

SEQ ID NO: 1312477 - protein, 9 aa, Homo Sapiens
SAGPTNLQI

SEQ ID NO: 1312478 - protein, 9 aa, Homo Sapiens
PEERNETVF

SEQ ID NO: 1312479 - protein, 9 aa, Homo Sapiens
TYYMWIKAA

SEQ ID NO: 1312480 - protein, 9 aa, Homo Sapiens
TCYFWKKNH

SEQ ID NO: 1312481 - protein, 9 aa, Homo Sapiens
WEFQLLETG

SEQ ID NO: 1312482 - protein, 9 aa, Homo Sapiens
EDSDEKGPE

SEQ ID NO: 1312483 - protein, 9 aa, Homo Sapiens
WKVCAANFG

SEQ ID NO: 1312484 - protein, 9 aa, Homo Sapiens
VLISFLQDC

SEQ ID NO: 1312485 - protein, 9 aa, Homo Sapiens
CACVSKMYL

SEQ ID NO: 1312486 - protein, 9 aa, Homo Sapiens
QLNMQEEEE

SEQ ID NO: 1312487 - protein, 9 aa, Homo Sapiens
IIYSIPFFF

SEQ ID NO: 1312488 - protein, 9 aa, Homo Sapiens
STLISHKII

SEQ ID NO: 1312489 - protein, 9 aa, Homo Sapiens
PFDKMLYNR

SEQ ID NO: 1312490 - protein, 9 aa, Homo Sapiens
SFFVLNLVF

SEQ ID NO: 1312491 - protein, 9 aa, Homo Sapiens
PLRLSRRRA

SEQ ID NO: 1312492 - protein, 9 aa, Homo Sapiens
FPDSLKAYE

SEQ ID NO: 1312493 - protein, 9 aa, Homo Sapiens
KAAKTGSIC

SEQ ID NO: 1312494 - protein, 9 aa, Homo Sapiens
RLSLLSSTL

SEQ ID NO: 1312495 - protein, 9 aa, Homo Sapiens
NPIDFLEPE

SEQ ID NO: 1312496 - protein, 9 aa, Homo Sapiens
MGHTFSLPV

SEQ ID NO: 1312497 - protein, 9 aa, Homo Sapiens
KASPKYEVC

SEQ ID NO: 1312498 - protein, 9 aa, Homo Sapiens
ELNHHAYVF

SEQ ID NO: 1312499 - protein, 9 aa, Homo Sapiens
YGVASVSFR

SEQ ID NO: 1312500 - protein, 9 aa, Homo Sapiens
LFQTFLERE

SEQ ID NO: 1312501 - protein, 9 aa, Homo Sapiens
APSSQTKVL

SEQ ID NO: 1312502 - protein, 9 aa, Homo Sapiens
DGKFAVVKE

SEQ ID NO: 1312503 - protein, 9 aa, Homo Sapiens
ESPDSLQIN

SEQ ID NO: 1312504 - protein, 9 aa, Homo Sapiens
MISKLVQAR

SEQ ID NO: 1312505 - protein, 9 aa, Homo Sapiens
AFIHGSHLT

SEQ ID NO: 1312506 - protein, 9 aa, Homo Sapiens
TISCIFNYG

SEQ ID NO: 1312507 - protein, 9 aa, Homo Sapiens
LHMAARSDQ

SEQ ID NO: 1312508 - protein, 9 aa, Homo Sapiens
KRLLKMPAY

SEQ ID NO: 1312509 - protein, 9 aa, Homo Sapiens
QKHAPIHSA

SEQ ID NO: 1312510 - protein, 9 aa, Homo Sapiens
HIHQFGIVH

SEQ ID NO: 1312511 - protein, 9 aa, Homo Sapiens
KDPNNVLND

SEQ ID NO: 1312512 - protein, 9 aa, Homo Sapiens
RLKRFIHVF

SEQ ID NO: 1312513 - protein, 9 aa, Homo Sapiens
KGSPSHQKH

SEQ ID NO: 1312514 - protein, 9 aa, Homo Sapiens
PPPRVLQQL

SEQ ID NO: 1312515 - protein, 9 aa, Homo Sapiens
ETSETMVPF

SEQ ID NO: 1312516 - protein, 9 aa, Homo Sapiens
SICDEFAPH

SEQ ID NO: 1312517 - protein, 9 aa, Homo Sapiens
VLREFFTKM

SEQ ID NO: 1312518 - protein, 9 aa, Homo Sapiens
CRIQLGDKP

SEQ ID NO: 1312519 - protein, 9 aa, Homo Sapiens
DSESFRQPV

SEQ ID NO: 1312520 - protein, 9 aa, Homo Sapiens
CFPKVAITI

SEQ ID NO: 1312521 - protein, 9 aa, Homo Sapiens
MVSLYYPAG

SEQ ID NO: 1312522 - protein, 9 aa, Homo Sapiens
LLKVKMHTM

SEQ ID NO: 1312523 - protein, 9 aa, Homo Sapiens
HKRIHTGDK

SEQ ID NO: 1312524 - protein, 9 aa, Homo Sapiens
CVIVHCLAG

SEQ ID NO: 1312525 - protein, 9 aa, Homo Sapiens
DFNKFCRFV

SEQ ID NO: 1312526 - protein, 9 aa, Homo Sapiens
SFCRKSALI

SEQ ID NO: 1312527 - protein, 9 aa, Homo Sapiens
VGKKKKYVI

SEQ ID NO: 1312528 - protein, 9 aa, Homo Sapiens
SIKQVVLCK

SEQ ID NO: 1312529 - protein, 9 aa, Homo Sapiens
IIQTYDMMI

SEQ ID NO: 1312530 - protein, 9 aa, Homo Sapiens
AQEVEGKSP

SEQ ID NO: 1312531 - protein, 9 aa, Homo Sapiens
YLNETAGVA

SEQ ID NO: 1312532 - protein, 9 aa, Homo Sapiens
SYQDTKKNI

SEQ ID NO: 1312533 - protein, 9 aa, Homo Sapiens
PVELDPEDK

SEQ ID NO: 1312534 - protein, 9 aa, Homo Sapiens
IHGKNNWTL

SEQ ID NO: 1312535 - protein, 9 aa, Homo Sapiens
IINQISTLH

SEQ ID NO: 1312536 - protein, 9 aa, Homo Sapiens
SFYFDPFDP

SEQ ID NO: 1312537 - protein, 9 aa, Homo Sapiens
IMLTKDLKN

SEQ ID NO: 1312538 - protein, 9 aa, Homo Sapiens
YKIKYPDNF

SEQ ID NO: 1312539 - protein, 9 aa, Homo Sapiens
INGPDTNHQ

SEQ ID NO: 1312540 - protein, 9 aa, Homo Sapiens
YKDDLYRDE

SEQ ID NO: 1312541 - protein, 9 aa, Homo Sapiens
CQYIIHLYH

SEQ ID NO: 1312542 - protein, 9 aa, Homo Sapiens
RFRGTKPEP

SEQ ID NO: 1312543 - protein, 9 aa, Homo Sapiens
VIGKLTIIN

SEQ ID NO: 1312544 - protein, 9 aa, Homo Sapiens
PEFTMLLGV

SEQ ID NO: 1312545 - protein, 9 aa, Homo Sapiens
HLFRPRCLR

SEQ ID NO: 1312546 - protein, 9 aa, Homo Sapiens
PLEPGPENT

SEQ ID NO: 1312547 - protein, 9 aa, Homo Sapiens
DGINANKTD

SEQ ID NO: 1312548 - protein, 9 aa, Homo Sapiens
DDWAANKSP

SEQ ID NO: 1312549 - protein, 9 aa, Homo Sapiens
NGIEWIIEE

SEQ ID NO: 1312550 - protein, 9 aa, Homo Sapiens
LAAFKINKR

SEQ ID NO: 1312551 - protein, 9 aa, Homo Sapiens
SQLSSDPSN

SEQ ID NO: 1312552 - protein, 9 aa, Homo Sapiens
INEIVTETL

SEQ ID NO: 1312553 - protein, 9 aa, Homo Sapiens
LKNRWPNYA

SEQ ID NO: 1312554 - protein, 9 aa, Homo Sapiens
MCILGALFG

SEQ ID NO: 1312555 - protein, 9 aa, Homo Sapiens
VWALPKTYT

SEQ ID NO: 1312556 - protein, 9 aa, Homo Sapiens
QSFKAVVTA

SEQ ID NO: 1312557 - protein, 9 aa, Homo Sapiens
INKSTSSAM

SEQ ID NO: 1312558 - protein, 9 aa, Homo Sapiens
NPSSYNSTM

SEQ ID NO: 1312559 - protein, 9 aa, Homo Sapiens
LLKTREEVL

SEQ ID NO: 1312560 - protein, 9 aa, Homo Sapiens
TEMSPSKNY

SEQ ID NO: 1312561 - protein, 9 aa, Homo Sapiens
ITLECRAEA

SEQ ID NO: 1312562 - protein, 9 aa, Homo Sapiens
TFVMGKDFT

SEQ ID NO: 1312563 - protein, 9 aa, Homo Sapiens
IYPQKITVA

SEQ ID NO: 1312564 - protein, 9 aa, Homo Sapiens
VISKNISEW

SEQ ID NO: 1312565 - protein, 9 aa, Homo Sapiens
GTGVMICAY

SEQ ID NO: 1312566 - protein, 9 aa, Homo Sapiens
CIFMFVIFL

SEQ ID NO: 1312567 - protein, 9 aa, Homo Sapiens
GHIMEKEQA

SEQ ID NO: 1312568 - protein, 9 aa, Homo Sapiens
FTQKSNINI

SEQ ID NO: 1312569 - protein, 9 aa, Homo Sapiens
HEGIFQVSG

SEQ ID NO: 1312570 - protein, 9 aa, Homo Sapiens
GFILFTTIY

SEQ ID NO: 1312571 - protein, 9 aa, Homo Sapiens
YIKCACNEQ

SEQ ID NO: 1312572 - protein, 9 aa, Homo Sapiens
KPAPPLVVQ

SEQ ID NO: 1312573 - protein, 9 aa, Homo Sapiens
TARHDWLHI

SEQ ID NO: 1312574 - protein, 9 aa, Homo Sapiens
SSPRCEPGL

SEQ ID NO: 1312575 - protein, 9 aa, Homo Sapiens
LSFWLKRNI

SEQ ID NO: 1312576 - protein, 9 aa, Homo Sapiens
VCNKFFRRE

SEQ ID NO: 1312577 - protein, 9 aa, Homo Sapiens
NCKKGVEHD

SEQ ID NO: 1312578 - protein, 9 aa, Homo Sapiens
ALHMAARSD

SEQ ID NO: 1312579 - protein, 9 aa, Homo Sapiens
VAPGEYNDL

SEQ ID NO: 1312580 - protein, 9 aa, Homo Sapiens
TVVLAMQHY

SEQ ID NO: 1312581 - protein, 9 aa, Homo Sapiens
QIMKILTQD

SEQ ID NO: 1312582 - protein, 9 aa, Homo Sapiens
EHEKTHTGV

SEQ ID NO: 1312583 - protein, 9 aa, Homo Sapiens
DEPCKEIIR

SEQ ID NO: 1312584 - protein, 9 aa, Homo Sapiens
DPNRFSQAR

SEQ ID NO: 1312585 - protein, 9 aa, Homo Sapiens
QRDSENNKE

SEQ ID NO: 1312586 - protein, 9 aa, Homo Sapiens
NIPRPPGAL

SEQ ID NO: 1312587 - protein, 9 aa, Homo Sapiens
TNLNGKMIM

SEQ ID NO: 1312588 - protein, 9 aa, Homo Sapiens
RVLIHFSNI

SEQ ID NO: 1312589 - protein, 9 aa, Homo Sapiens
RLSLTGHKR

SEQ ID NO: 1312590 - protein, 9 aa, Homo Sapiens
SHGSPRSIP

SEQ ID NO: 1312591 - protein, 9 aa, Homo Sapiens
TSKYYVTIT

SEQ ID NO: 1312592 - protein, 9 aa, Homo Sapiens
YLLMISKLV

SEQ ID NO: 1312593 - protein, 9 aa, Homo Sapiens
SRTNIIQRL

SEQ ID NO: 1312594 - protein, 9 aa, Homo Sapiens
TPLLFNGCH

SEQ ID NO: 1312595 - protein, 9 aa, Homo Sapiens
KGTIHYLCK

SEQ ID NO: 1312596 - protein, 9 aa, Homo Sapiens
DQDRIVVTC

SEQ ID NO: 1312597 - protein, 9 aa, Homo Sapiens
KLLLTSSKA

SEQ ID NO: 1312598 - protein, 9 aa, Homo Sapiens
SELNRLLLE

SEQ ID NO: 1312599 - protein, 9 aa, Homo Sapiens
SRLGQLRRI

SEQ ID NO: 1312600 - protein, 9 aa, Homo Sapiens
LEYLEKWMV

SEQ ID NO: 1312601 - protein, 9 aa, Homo Sapiens
AVAKPNNIK

SEQ ID NO: 1312602 - protein, 9 aa, Homo Sapiens
VKKLAVAKP

SEQ ID NO: 1312603 - protein, 9 aa, Homo Sapiens
YINGLKFCK

SEQ ID NO: 1312604 - protein, 9 aa, Homo Sapiens
FFSKISGIL

SEQ ID NO: 1312605 - protein, 9 aa, Homo Sapiens
DSYGTMVSL

SEQ ID NO: 1312606 - protein, 9 aa, Homo Sapiens
SQDVCTYID

SEQ ID NO: 1312607 - protein, 9 aa, Homo Sapiens
GVDYITVDS

SEQ ID NO: 1312608 - protein, 9 aa, Homo Sapiens
ISSRSPPDK

SEQ ID NO: 1312609 - protein, 9 aa, Homo Sapiens
NQIQRHHTF

SEQ ID NO: 1312610 - protein, 9 aa, Homo Sapiens
QLQRTHSQL

SEQ ID NO: 1312611 - protein, 9 aa, Homo Sapiens
AERALTNLN

SEQ ID NO: 1312612 - protein, 9 aa, Homo Sapiens
DMVKKLLNI

SEQ ID NO: 1312613 - protein, 9 aa, Homo Sapiens
YKLVVVGAV

SEQ ID NO: 1312614 - protein, 9 aa, Homo Sapiens
LPNKYNLSF

SEQ ID NO: 1312615 - protein, 9 aa, Homo Sapiens
LSNYRITWI

SEQ ID NO: 1312616 - protein, 9 aa, Homo Sapiens
EREKFFDET

SEQ ID NO: 1312617 - protein, 9 aa, Homo Sapiens
WFASLCSWT

SEQ ID NO: 1312618 - protein, 9 aa, Homo Sapiens
PPQSACTRG

SEQ ID NO: 1312619 - protein, 9 aa, Homo Sapiens
SAIFHRSGS

SEQ ID NO: 1312620 - protein, 9 aa, Homo Sapiens
SRVRVLRID

SEQ ID NO: 1312621 - protein, 9 aa, Homo Sapiens
AETEKSDCD

SEQ ID NO: 1312622 - protein, 9 aa, Homo Sapiens
LMEKLLDFL

SEQ ID NO: 1312623 - protein, 9 aa, Homo Sapiens
HRSGSACST

SEQ ID NO: 1312624 - protein, 9 aa, Homo Sapiens
NEQEEIDIW

SEQ ID NO: 1312625 - protein, 9 aa, Homo Sapiens
ARGCRTLSV

SEQ ID NO: 1312626 - protein, 9 aa, Homo Sapiens
LLSDLARLE

SEQ ID NO: 1312627 - protein, 9 aa, Homo Sapiens
SSPHRPQML

SEQ ID NO: 1312628 - protein, 9 aa, Homo Sapiens
CDTPNYLLS

SEQ ID NO: 1312629 - protein, 9 aa, Homo Sapiens
MARGCRTLS

SEQ ID NO: 1312630 - protein, 9 aa, Homo Sapiens
KKHEVILNK

SEQ ID NO: 1312631 - protein, 9 aa, Homo Sapiens
CRTLSVQAR

SEQ ID NO: 1312632 - protein, 9 aa, Homo Sapiens
KFQRSCSTF

SEQ ID NO: 1312633 - protein, 9 aa, Homo Sapiens
LHRATESHR

SEQ ID NO: 1312634 - protein, 9 aa, Homo Sapiens
FFPQKVSEL

SEQ ID NO: 1312635 - protein, 9 aa, Homo Sapiens
VSELHRATE

SEQ ID NO: 1312636 - protein, 9 aa, Homo Sapiens
GSRTAAGPR

SEQ ID NO: 1312637 - protein, 9 aa, Homo Sapiens
SWTMARGCR

SEQ ID NO: 1312638 - protein, 9 aa, Homo Sapiens
KHEVILNKS

SEQ ID NO: 1312639 - protein, 9 aa, Homo Sapiens
ERWSTVLGL

SEQ ID NO: 1312640 - protein, 9 aa, Homo Sapiens
KFFDETRRL

SEQ ID NO: 1312641 - protein, 9 aa, Homo Sapiens
ECTGLLLSD

SEQ ID NO: 1312642 - protein, 9 aa, Homo Sapiens
HVCACPGRD

SEQ ID NO: 1312643 - protein, 9 aa, Homo Sapiens
HEVILNKST

SEQ ID NO: 1312644 - protein, 9 aa, Homo Sapiens
IKKKHEVIL

SEQ ID NO: 1312645 - protein, 9 aa, Homo Sapiens
MKCLMEKLL

SEQ ID NO: 1312646 - protein, 9 aa, Homo Sapiens
HSSLLNEQE

SEQ ID NO: 1312647 - protein, 9 aa, Homo Sapiens
RWSTVLGLP

SEQ ID NO: 1312648 - protein, 9 aa, Homo Sapiens
ERLTRENHS

SEQ ID NO: 1312649 - protein, 9 aa, Homo Sapiens
LFFFFPQKV

SEQ ID NO: 1312650 - protein, 9 aa, Homo Sapiens
EYHYKSRVR

SEQ ID NO: 1312651 - protein, 9 aa, Homo Sapiens
LRIPPPGTL

SEQ ID NO: 1312652 - protein, 9 aa, Homo Sapiens
KKKHEVILN

SEQ ID NO: 1312653 - protein, 9 aa, Homo Sapiens
RERWSTVLG

SEQ ID NO: 1312654 - protein, 9 aa, Homo Sapiens
LRTWFASLC

SEQ ID NO: 1312655 - protein, 9 aa, Homo Sapiens
PPPGTLRGS

SEQ ID NO: 1312656 - protein, 9 aa, Homo Sapiens
QSACTRGMR

SEQ ID NO: 1312657 - protein, 9 aa, Homo Sapiens
ADKERLTRE

SEQ ID NO: 1312658 - protein, 9 aa, Homo Sapiens
RGSRTAAGP

SEQ ID NO: 1312659 - protein, 9 aa, Homo Sapiens
QKVSELHRA

SEQ ID NO: 1312660 - protein, 9 aa, Homo Sapiens
TLRGSRTAA

SEQ ID NO: 1312661 - protein, 9 aa, Homo Sapiens
KIKKKHEVI

SEQ ID NO: 1312662 - protein, 9 aa, Homo Sapiens
ELHRATESH

SEQ ID NO: 1312663 - protein, 9 aa, Homo Sapiens
VRGLRTWFA

SEQ ID NO: 1312664 - protein, 9 aa, Homo Sapiens
PRWAVPVHV

SEQ ID NO: 1312665 - protein, 9 aa, Homo Sapiens
SRTAAGPRW

SEQ ID NO: 1312666 - protein, 9 aa, Homo Sapiens
PQSACTRGM

SEQ ID NO: 1312667 - protein, 9 aa, Homo Sapiens
FSWQSVLLS

SEQ ID NO: 1312668 - protein, 9 aa, Homo Sapiens
RIPPPGTLR

SEQ ID NO: 1312669 - protein, 9 aa, Homo Sapiens
KAETEKSDC

SEQ ID NO: 1312670 - protein, 9 aa, Homo Sapiens
MEKLLDFLG

SEQ ID NO: 1312671 - protein, 9 aa, Homo Sapiens
IFFGRQPQP

SEQ ID NO: 1312672 - protein, 9 aa, Homo Sapiens
ESLKQIEEQ

SEQ ID NO: 1312673 - protein, 9 aa, Homo Sapiens
IPPPGTLRG

SEQ ID NO: 1312674 - protein, 9 aa, Homo Sapiens
EELMESLKQ

SEQ ID NO: 1312675 - protein, 9 aa, Homo Sapiens
SSRFVHLSW

SEQ ID NO: 1312676 - protein, 9 aa, Homo Sapiens
KERLTRENH

SEQ ID NO: 1312677 - protein, 9 aa, Homo Sapiens
LCSWTMARG

SEQ ID NO: 1312678 - protein, 9 aa, Homo Sapiens
SLLNEQEEI

SEQ ID NO: 1312679 - protein, 9 aa, Homo Sapiens
PTMPSWRWC

SEQ ID NO: 1312680 - protein, 9 aa, Homo Sapiens
SCSTFLSSG

SEQ ID NO: 1312681 - protein, 9 aa, Homo Sapiens
SGSACSTPA

SEQ ID NO: 1312682 - protein, 9 aa, Homo Sapiens
DLKFQRSCS

SEQ ID NO: 1312683 - protein, 9 aa, Homo Sapiens
SACSTPAGP

SEQ ID NO: 1312684 - protein, 9 aa, Homo Sapiens
PRWREASEL

SEQ ID NO: 1312685 - protein, 9 aa, Homo Sapiens
PPRNLTISN

SEQ ID NO: 1312686 - protein, 9 aa, Homo Sapiens
KGEPKVPGV

SEQ ID NO: 1312687 - protein, 9 aa, Homo Sapiens
LLNEQEEID

SEQ ID NO: 1312688 - protein, 9 aa, Homo Sapiens
CSTFLSSGD

SEQ ID NO: 1312689 - protein, 9 aa, Homo Sapiens
MASGMDKAC

SEQ ID NO: 1312690 - protein, 9 aa, Homo Sapiens
SWRWCPLPG

SEQ ID NO: 1312691 - protein, 9 aa, Homo Sapiens
RRERWSTVL

SEQ ID NO: 1312692 - protein, 9 aa, Homo Sapiens
EPAHHPGCQ

SEQ ID NO: 1312693 - protein, 9 aa, Homo Sapiens
RWCPLPGAV

SEQ ID NO: 1312694 - protein, 9 aa, Homo Sapiens
LPTCPTMPS

SEQ ID NO: 1312695 - protein, 9 aa, Homo Sapiens
REKEELMES

SEQ ID NO: 1312696 - protein, 9 aa, Homo Sapiens
RRRERWSTV

SEQ ID NO: 1312697 - protein, 9 aa, Homo Sapiens
SLKQIEEQT

SEQ ID NO: 1312698 - protein, 9 aa, Homo Sapiens
EQEEIDIWG

SEQ ID NO: 1312699 - protein, 9 aa, Homo Sapiens
RCLRIPPPG

SEQ ID NO: 1312700 - protein, 9 aa, Homo Sapiens
GRRRRERWS

SEQ ID NO: 1312701 - protein, 9 aa, Homo Sapiens
SELPQKNQR

SEQ ID NO: 1312702 - protein, 9 aa, Homo Sapiens
SLCSWTMAR

SEQ ID NO: 1312703 - protein, 9 aa, Homo Sapiens
IFHRSGSAC

SEQ ID NO: 1312704 - protein, 9 aa, Homo Sapiens
RVRVLRIDA

SEQ ID NO: 1312705 - protein, 9 aa, Homo Sapiens
PHRPQMLSP

SEQ ID NO: 1312706 - protein, 9 aa, Homo Sapiens
SFEVHVCAC

SEQ ID NO: 1312707 - protein, 9 aa, Homo Sapiens
GSACSTPAG

SEQ ID NO: 1312708 - protein, 9 aa, Homo Sapiens
DLPTCPTMP

SEQ ID NO: 1312709 - protein, 9 aa, Homo Sapiens
SPPRNLTIS

SEQ ID NO: 1312710 - protein, 9 aa, Homo Sapiens
RSGSACSTP

SEQ ID NO: 1312711 - protein, 9 aa, Homo Sapiens
FASLCSWTM

SEQ ID NO: 1312712 - protein, 9 aa, Homo Sapiens
LMESLKQIE

SEQ ID NO: 1312713 - protein, 9 aa, Homo Sapiens
SRFVHLSWR

SEQ ID NO: 1312714 - protein, 9 aa, Homo Sapiens
NFGNTIMTS

SEQ ID NO: 1312715 - protein, 9 aa, Homo Sapiens
SGMDKACTG

SEQ ID NO: 1312716 - protein, 9 aa, Homo Sapiens
TESHRCLRI

SEQ ID NO: 1312717 - protein, 9 aa, Homo Sapiens
KEELMESLK

SEQ ID NO: 1312718 - protein, 9 aa, Homo Sapiens
NSFEVHVCA

SEQ ID NO: 1312719 - protein, 9 aa, Homo Sapiens
WTMARGCRT

SEQ ID NO: 1312720 - protein, 9 aa, Homo Sapiens
GTLRGSRTA

SEQ ID NO: 1312721 - protein, 9 aa, Homo Sapiens
QACCAPVCC

SEQ ID NO: 1312722 - protein, 9 aa, Homo Sapiens
SHRCLRIPP

SEQ ID NO: 1312723 - protein, 9 aa, Homo Sapiens
RTLSVQARP

SEQ ID NO: 1312724 - protein, 9 aa, Homo Sapiens
AKIKKKHEV

SEQ ID NO: 1312725 - protein, 9 aa, Homo Sapiens
FEVHVCACP

SEQ ID NO: 1312726 - protein, 9 aa, Homo Sapiens
GCRTLSVQA

SEQ ID NO: 1312727 - protein, 9 aa, Homo Sapiens
RNSFEVHVC

SEQ ID NO: 1312728 - protein, 9 aa, Homo Sapiens
HLSWRPPAE

SEQ ID NO: 1312729 - protein, 9 aa, Homo Sapiens
FQRSCSTFL

SEQ ID NO: 1312730 - protein, 9 aa, Homo Sapiens
LSDLARLEQ

SEQ ID NO: 1312731 - protein, 9 aa, Homo Sapiens
QRSCSTFLS

SEQ ID NO: 1312732 - protein, 9 aa, Homo Sapiens
ASGMDKACT

SEQ ID NO: 1312733 - protein, 9 aa, Homo Sapiens
GSFSAIFHR

SEQ ID NO: 1312734 - protein, 9 aa, Homo Sapiens
AAKIKKKHE

SEQ ID NO: 1312735 - protein, 9 aa, Homo Sapiens
WAVPVHVPG

SEQ ID NO: 1312736 - protein, 9 aa, Homo Sapiens
PAGPPQSAC

SEQ ID NO: 1312737 - protein, 9 aa, Homo Sapiens
MPSWRWCPL

SEQ ID NO: 1312738 - protein, 9 aa, Homo Sapiens
PSWRWCPLP

SEQ ID NO: 1312739 - protein, 9 aa, Homo Sapiens
FHRSGSACS

SEQ ID NO: 1312740 - protein, 9 aa, Homo Sapiens
THSSLLNEQ

SEQ ID NO: 1312741 - protein, 9 aa, Homo Sapiens
HYKSRVRVL

SEQ ID NO: 1312742 - protein, 9 aa, Homo Sapiens
CSWTMARGC

SEQ ID NO: 1312743 - protein, 9 aa, Homo Sapiens
QARPSGSFS

SEQ ID NO: 1312744 - protein, 9 aa, Homo Sapiens
LIEHHQTHT

SEQ ID NO: 1312745 - protein, 9 aa, Homo Sapiens
HKSTNFGNT

SEQ ID NO: 1312746 - protein, 9 aa, Homo Sapiens
ACTGSSPPI

SEQ ID NO: 1312747 - protein, 9 aa, Homo Sapiens
ASLCSWTMA

SEQ ID NO: 1312748 - protein, 9 aa, Homo Sapiens
STNFGNTIM

SEQ ID NO: 1312749 - protein, 9 aa, Homo Sapiens
TGLLLSDLA

SEQ ID NO: 1312750 - protein, 9 aa, Homo Sapiens
SAETAAFGT

SEQ ID NO: 1312751 - protein, 9 aa, Homo Sapiens
AAGPRWAVP

SEQ ID NO: 1312752 - protein, 9 aa, Homo Sapiens
TFLSSGDLP

SEQ ID NO: 1312753 - protein, 9 aa, Homo Sapiens
LNEQEEIDI

SEQ ID NO: 1312754 - protein, 9 aa, Homo Sapiens
ESHRCLRIP

SEQ ID NO: 1312755 - protein, 9 aa, Homo Sapiens
VLLSHQRTH

SEQ ID NO: 1312756 - protein, 9 aa, Homo Sapiens
SDCDTPNYL

SEQ ID NO: 1312757 - protein, 9 aa, Homo Sapiens
RGCRTLSVQ

SEQ ID NO: 1312758 - protein, 9 aa, Homo Sapiens
ELMESLKQI

SEQ ID NO: 1312759 - protein, 9 aa, Homo Sapiens
IEHHQTHTG

SEQ ID NO: 1312760 - protein, 9 aa, Homo Sapiens
PCQQACCAP

SEQ ID NO: 1312761 - protein, 9 aa, Homo Sapiens
LKGEPKVPG

SEQ ID NO: 1312762 - protein, 9 aa, Homo Sapiens
AVRGLRTWF

SEQ ID NO: 1312763 - protein, 9 aa, Homo Sapiens
CLRIPPPGT

SEQ ID NO: 1312764 - protein, 9 aa, Homo Sapiens
HHQTHTGER

SEQ ID NO: 1312765 - protein, 9 aa, Homo Sapiens
LTISNVGSN

SEQ ID NO: 1312766 - protein, 9 aa, Homo Sapiens
HRPQMLSPV

SEQ ID NO: 1312767 - protein, 9 aa, Homo Sapiens
VQARPSGSF

SEQ ID NO: 1312768 - protein, 9 aa, Homo Sapiens
PILFFFFPQ

SEQ ID NO: 1312769 - protein, 9 aa, Homo Sapiens
EASELPQKN

SEQ ID NO: 1312770 - protein, 9 aa, Homo Sapiens
CCAPVCCKP

SEQ ID NO: 1312771 - protein, 9 aa, Homo Sapiens
AEREKFFDE

SEQ ID NO: 1312772 - protein, 9 aa, Homo Sapiens
CAPVCCKPV

SEQ ID NO: 1312773 - protein, 9 aa, Homo Sapiens
PQKVSELHR

SEQ ID NO: 1312774 - protein, 9 aa, Homo Sapiens
GMDKACTGS

SEQ ID NO: 1312775 - protein, 9 aa, Homo Sapiens
KEYHYKSRV

SEQ ID NO: 1312776 - protein, 9 aa, Homo Sapiens
WSTVLGLPQ

SEQ ID NO: 1312777 - protein, 9 aa, Homo Sapiens
DKERLTREN

SEQ ID NO: 1312778 - protein, 9 aa, Homo Sapiens
RATESHRCL

SEQ ID NO: 1312779 - protein, 9 aa, Homo Sapiens
RPQMLSPVS

SEQ ID NO: 1312780 - protein, 9 aa, Homo Sapiens
EKFFDETRR

SEQ ID NO: 1312781 - protein, 9 aa, Homo Sapiens
ATESHRCLR

SEQ ID NO: 1312782 - protein, 9 aa, Homo Sapiens
SSALIEHHQ

SEQ ID NO: 1312783 - protein, 9 aa, Homo Sapiens
GPSAETAAF

SEQ ID NO: 1312784 - protein, 9 aa, Homo Sapiens
LPRWREASE

SEQ ID NO: 1312785 - protein, 9 aa, Homo Sapiens
PTCPTMPSW

SEQ ID NO: 1312786 - protein, 9 aa, Homo Sapiens
REASELPQK

SEQ ID NO: 1312787 - protein, 9 aa, Homo Sapiens
PPGTLRGSR

SEQ ID NO: 1312788 - protein, 9 aa, Homo Sapiens
GDLPTCPTM

SEQ ID NO: 1312789 - protein, 9 aa, Homo Sapiens
AREALAIIF

SEQ ID NO: 1312790 - protein, 9 aa, Homo Sapiens
SALIEHHQT

SEQ ID NO: 1312791 - protein, 9 aa, Homo Sapiens
ETEKSDCDT

SEQ ID NO: 1312792 - protein, 9 aa, Homo Sapiens
PAREALAII

SEQ ID NO: 1312793 - protein, 9 aa, Homo Sapiens
CLMEKLLDF

SEQ ID NO: 1312794 - protein, 9 aa, Homo Sapiens
QQACCAPVC

SEQ ID NO: 1312795 - protein, 9 aa, Homo Sapiens
NLTISNVGS

SEQ ID NO: 1312796 - protein, 9 aa, Homo Sapiens
ILFFFFPQK

SEQ ID NO: 1312797 - protein, 9 aa, Homo Sapiens
LSSGDLPTC

SEQ ID NO: 1312798 - protein, 9 aa, Homo Sapiens
PGAVRGLRT

SEQ ID NO: 1312799 - protein, 9 aa, Homo Sapiens
LTRENHSEI

SEQ ID NO: 1312800 - protein, 9 aa, Homo Sapiens
GLRTWFASL

SEQ ID NO: 1312801 - protein, 9 aa, Homo Sapiens
IIFFGRQPQ

SEQ ID NO: 1312802 - protein, 9 aa, Homo Sapiens
RGLRTWFAS

SEQ ID NO: 1312803 - protein, 9 aa, Homo Sapiens
GLLLSDLAR

SEQ ID NO: 1312804 - protein, 9 aa, Homo Sapiens
KSRVRVLRI

SEQ ID NO: 1312805 - protein, 9 aa, Homo Sapiens
GTFHKSTNF

SEQ ID NO: 1312806 - protein, 9 aa, Homo Sapiens
TWFASLCSW

SEQ ID NO: 1312807 - protein, 9 aa, Homo Sapiens
REKFFDETR

SEQ ID NO: 1312808 - protein, 9 aa, Homo Sapiens
TMPSWRWCP

SEQ ID NO: 1312809 - protein, 9 aa, Homo Sapiens
KVPGVVQIL

SEQ ID NO: 1312810 - protein, 9 aa, Homo Sapiens
WQSVLLSHQ

SEQ ID NO: 1312811 - protein, 9 aa, Homo Sapiens
QMLSPVSKD

SEQ ID NO: 1312812 - protein, 9 aa, Homo Sapiens
SADKERLTR

SEQ ID NO: 1312813 - protein, 9 aa, Homo Sapiens
LPGAVRGLR

SEQ ID NO: 1312814 - protein, 9 aa, Homo Sapiens
TAAGPRWAV

SEQ ID NO: 1312815 - protein, 9 aa, Homo Sapiens
SPCQQACCA

SEQ ID NO: 1312816 - protein, 9 aa, Homo Sapiens
YDLKFQRSC

SEQ ID NO: 1312817 - protein, 9 aa, Homo Sapiens
RWREASELP

SEQ ID NO: 1312818 - protein, 9 aa, Homo Sapiens
VPGVVQILT

SEQ ID NO: 1312819 - protein, 9 aa, Homo Sapiens
PSAETAAFG

SEQ ID NO: 1312820 - protein, 9 aa, Homo Sapiens
AETAAFGTV

SEQ ID NO: 1312821 - protein, 9 aa, Homo Sapiens
EAAKIKKKH

SEQ ID NO: 1312822 - protein, 9 aa, Homo Sapiens
AIIFFGRQP

SEQ ID NO: 1312823 - protein, 9 aa, Homo Sapiens
FPILFFFFP

SEQ ID NO: 1312824 - protein, 9 aa, Homo Sapiens
MESLKQIEE

SEQ ID NO: 1312825 - protein, 9 aa, Homo Sapiens
SGDLPTCPT

SEQ ID NO: 1312826 - protein, 9 aa, Homo Sapiens
CPLPGAVRG

SEQ ID NO: 1312827 - protein, 9 aa, Homo Sapiens
HRATESHRC

SEQ ID NO: 1312828 - protein, 9 aa, Homo Sapiens
CPTMPSWRW

SEQ ID NO: 1312829 - protein, 9 aa, Homo Sapiens
LRGSRTAAG

SEQ ID NO: 1312830 - protein, 9 aa, Homo Sapiens
AIFHRSGSA

SEQ ID NO: 1312831 - protein, 9 aa, Homo Sapiens
QSVLLSHQR

SEQ ID NO: 1312832 - protein, 9 aa, Homo Sapiens
KVSELHRAT

SEQ ID NO: 1312833 - protein, 9 aa, Homo Sapiens
WRWCPLPGA

SEQ ID NO: 1312834 - protein, 9 aa, Homo Sapiens
LAIIFFGRQ

SEQ ID NO: 1312835 - protein, 9 aa, Homo Sapiens
STFLSSGDL

SEQ ID NO: 1312836 - protein, 9 aa, Homo Sapiens
SPHRPQMLS

SEQ ID NO: 1312837 - protein, 9 aa, Homo Sapiens
PRNLTISNV

SEQ ID NO: 1312838 - protein, 9 aa, Homo Sapiens
TISNVGSNS

SEQ ID NO: 1312839 - protein, 9 aa, Homo Sapiens
PQMLSPVSK

SEQ ID NO: 1312840 - protein, 9 aa, Homo Sapiens
TMARGCRTL

SEQ ID NO: 1312841 - protein, 9 aa, Homo Sapiens
VAPGPSAET

SEQ ID NO: 1312842 - protein, 9 aa, Homo Sapiens
GEPKVPGVV

SEQ ID NO: 1312843 - protein, 9 aa, Homo Sapiens
PLPGAVRGL

SEQ ID NO: 1312844 - protein, 9 aa, Homo Sapiens
GPPQSACTR

SEQ ID NO: 1312845 - protein, 9 aa, Homo Sapiens
PGVVQILTA

SEQ ID NO: 1312846 - protein, 9 aa, Homo Sapiens
RSCSTFLSS

SEQ ID NO: 1312847 - protein, 9 aa, Homo Sapiens
RFVHLSWRP

SEQ ID NO: 1312848 - protein, 9 aa, Homo Sapiens
SVLLSHQRT

SEQ ID NO: 1312849 - protein, 9 aa, Homo Sapiens
TAAFGTVTS

SEQ ID NO: 1312850 - protein, 9 aa, Homo Sapiens
ACCAPVCCK

SEQ ID NO: 1312851 - protein, 9 aa, Homo Sapiens
DCDTPNYLL

SEQ ID NO: 1312852 - protein, 9 aa, Homo Sapiens
RRRRERWST

SEQ ID NO: 1312853 - protein, 9 aa, Homo Sapiens
FFFPQKVSE

SEQ ID NO: 1312854 - protein, 9 aa, Homo Sapiens
TRENHSEIE

SEQ ID NO: 1312855 - protein, 9 aa, Homo Sapiens
SWQSVLLSH

SEQ ID NO: 1312856 - protein, 9 aa, Homo Sapiens
AGPPQSACT

SEQ ID NO: 1312857 - protein, 9 aa, Homo Sapiens
FTHSSLLNE

SEQ ID NO: 1312858 - protein, 9 aa, Homo Sapiens
AGPRWAVPV

SEQ ID NO: 1312859 - protein, 9 aa, Homo Sapiens
GRNSFEVHV

SEQ ID NO: 1312860 - protein, 9 aa, Homo Sapiens
TQEAEREKF

SEQ ID NO: 1312861 - protein, 9 aa, Homo Sapiens
GEPAHHPGC

SEQ ID NO: 1312862 - protein, 9 aa, Homo Sapiens
HRCLRIPPP

SEQ ID NO: 1312863 - protein, 9 aa, Homo Sapiens
AGTFHKSTN

SEQ ID NO: 1312864 - protein, 9 aa, Homo Sapiens
EVHVCACPG

SEQ ID NO: 1312865 - protein, 9 aa, Homo Sapiens
CSTPAGPPQ

SEQ ID NO: 1312866 - protein, 9 aa, Homo Sapiens
SVQARPSGS

SEQ ID NO: 1312867 - protein, 9 aa, Homo Sapiens
TPAGPPQSA

SEQ ID NO: 1312868 - protein, 9 aa, Homo Sapiens
LSPPRNLTI

SEQ ID NO: 1312869 - protein, 9 aa, Homo Sapiens
SDLARLEQM

SEQ ID NO: 1312870 - protein, 9 aa, Homo Sapiens
LLPRWREAS

SEQ ID NO: 1312871 - protein, 9 aa, Homo Sapiens
EKEELMESL

SEQ ID NO: 1312872 - protein, 9 aa, Homo Sapiens
DECTGLLLS

SEQ ID NO: 1312873 - protein, 9 aa, Homo Sapiens
ALSPPRNLT

SEQ ID NO: 1312874 - protein, 9 aa, Homo Sapiens
YHYKSRVRV

SEQ ID NO: 1312875 - protein, 9 aa, Homo Sapiens
ACSTPAGPP

SEQ ID NO: 1312876 - protein, 9 aa, Homo Sapiens
EHHQTHTGE

SEQ ID NO: 1312877 - protein, 9 aa, Homo Sapiens
CTGLLLSDL

SEQ ID NO: 1312878 - protein, 9 aa, Homo Sapiens
EKLLDFLGS

SEQ ID NO: 1312879 - protein, 9 aa, Homo Sapiens
GPRWAVPVH

SEQ ID NO: 1312880 - protein, 9 aa, Homo Sapiens
FVHLSWRPP

SEQ ID NO: 1312881 - protein, 9 aa, Homo Sapiens
KACTGSSPP

SEQ ID NO: 1312882 - protein, 9 aa, Homo Sapiens
LSPVSKDAT

SEQ ID NO: 1312883 - protein, 9 aa, Homo Sapiens
SSGDLPTCP

SEQ ID NO: 1312884 - protein, 9 aa, Homo Sapiens
FSAIFHRSG

SEQ ID NO: 1312885 - protein, 9 aa, Homo Sapiens
GAVRGLRTW

SEQ ID NO: 1312886 - protein, 9 aa, Homo Sapiens
LSVQARPSG

SEQ ID NO: 1312887 - protein, 9 aa, Homo Sapiens
LDFLGSLLT

SEQ ID NO: 1312888 - protein, 9 aa, Homo Sapiens
QEAEREKFF

SEQ ID NO: 1312889 - protein, 9 aa, Homo Sapiens
RPSGSFSAI

SEQ ID NO: 1312890 - protein, 9 aa, Homo Sapiens
LGRNSFEVH

SEQ ID NO: 1312891 - protein, 9 aa, Homo Sapiens
REALAIIFF

SEQ ID NO: 1312892 - protein, 9 aa, Homo Sapiens
WREASELPQ

SEQ ID NO: 1312893 - protein, 9 aa, Homo Sapiens
RLTRENHSE

SEQ ID NO: 1312894 - protein, 9 aa, Homo Sapiens
LVSSRFVHL

SEQ ID NO: 1312895 - protein, 9 aa, Homo Sapiens
RTWFASLCS

SEQ ID NO: 1312896 - protein, 9 aa, Homo Sapiens
DKACTGSSP

SEQ ID NO: 1312897 - protein, 9 aa, Homo Sapiens
SSADKERLT

SEQ ID NO: 1312898 - protein, 9 aa, Homo Sapiens
VLVSSRFVH

SEQ ID NO: 1312899 - protein, 9 aa, Homo Sapiens
KCLMEKLLD

SEQ ID NO: 1312900 - protein, 9 aa, Homo Sapiens
VTQEAEREK

SEQ ID NO: 1312901 - protein, 9 aa, Homo Sapiens
TEKSDCDTP

SEQ ID NO: 1312902 - protein, 9 aa, Homo Sapiens
PAHHPGCQL

SEQ ID NO: 1312903 - protein, 9 aa, Homo Sapiens
ARPSGSFSA

SEQ ID NO: 1312904 - protein, 9 aa, Homo Sapiens
LKEYHYKSR

SEQ ID NO: 1312905 - protein, 9 aa, Homo Sapiens
TFHKSTNFG

SEQ ID NO: 1312906 - protein, 9 aa, Homo Sapiens
SELHRATES

SEQ ID NO: 1312907 - protein, 9 aa, Homo Sapiens
LLDFLGSLL

SEQ ID NO: 1312908 - protein, 9 aa, Homo Sapiens
CTGSSPPIV

SEQ ID NO: 1312909 - protein, 9 aa, Homo Sapiens
APGPSAETA

SEQ ID NO: 1312910 - protein, 9 aa, Homo Sapiens
VSSRFVHLS

SEQ ID NO: 1312911 - protein, 9 aa, Homo Sapiens
RWAVPVHVP

SEQ ID NO: 1312912 - protein, 9 aa, Homo Sapiens
SGRRRRERW

SEQ ID NO: 1312913 - protein, 9 aa, Homo Sapiens
YKSRVRVLR

SEQ ID NO: 1312914 - protein, 9 aa, Homo Sapiens
SGSFSAIFH

SEQ ID NO: 1312915 - protein, 9 aa, Homo Sapiens
FPQKVSELH

SEQ ID NO: 1312916 - protein, 9 aa, Homo Sapiens
FFFFPQKVS

SEQ ID NO: 1312917 - protein, 9 aa, Homo Sapiens
EAEREKFFD

SEQ ID NO: 1312918 - protein, 9 aa, Homo Sapiens
FHKSTNFGN

SEQ ID NO: 1312919 - protein, 9 aa, Homo Sapiens
EALAIIFFG

SEQ ID NO: 1312920 - protein, 9 aa, Homo Sapiens
FLKGEPKVP

SEQ ID NO: 1312921 - protein, 9 aa, Homo Sapiens
STPAGPPQS

SEQ ID NO: 1312922 - protein, 9 aa, Homo Sapiens
HQTHTGERP

SEQ ID NO: 1312923 - protein, 9 aa, Homo Sapiens
MDKACTGSS

SEQ ID NO: 1312924 - protein, 9 aa, Homo Sapiens
PSGSFSAIF

SEQ ID NO: 1312925 - protein, 9 aa, Homo Sapiens
SFSAIFHRS

SEQ ID NO: 1312926 - protein, 9 aa, Homo Sapiens
ALIEHHQTH

SEQ ID NO: 1312927 - protein, 9 aa, Homo Sapiens
APVCCKPVC

SEQ ID NO: 1312928 - protein, 9 aa, Homo Sapiens
KLLDFLGSL

SEQ ID NO: 1312929 - protein, 9 aa, Homo Sapiens
VHVCACPGR

SEQ ID NO: 1312930 - protein, 9 aa, Homo Sapiens
KSTNFGNTI

SEQ ID NO: 1312931 - protein, 9 aa, Homo Sapiens
TNFGNTIMT

SEQ ID NO: 1312932 - protein, 9 aa, Homo Sapiens
PGTLRGSRT

SEQ ID NO: 1312933 - protein, 9 aa, Homo Sapiens
RTAAGPRWA

SEQ ID NO: 1312934 - protein, 9 aa, Homo Sapiens
KSDCDTPNY

SEQ ID NO: 1312935 - protein, 9 aa, Homo Sapiens
RNLTISNVG

SEQ ID NO: 1312936 - protein, 9 aa, Homo Sapiens
ASELPQKNQ

SEQ ID NO: 1312937 - protein, 9 aa, Homo Sapiens
WCPLPGAVR

SEQ ID NO: 1312938 - protein, 9 aa, Homo Sapiens
FLSSGDLPT

SEQ ID NO: 1312939 - protein, 9 aa, Homo Sapiens
PKVPGVVQI

SEQ ID NO: 1312940 - protein, 9 aa, Homo Sapiens
TLSVQARPS

SEQ ID NO: 1312941 - protein, 9 aa, Homo Sapiens
SSLLNEQEE

SEQ ID NO: 1312942 - protein, 9 aa, Homo Sapiens
LKFQRSCST

SEQ ID NO: 1312943 - protein, 9 aa, Homo Sapiens
TCPTMPSWR

SEQ ID NO: 1312944 - protein, 9 aa, Homo Sapiens
PGPSAETAA

SEQ ID NO: 1312945 - protein, 9 aa, Homo Sapiens
VHLSWRPPA

SEQ ID NO: 1312946 - protein, 9 aa, Homo Sapiens
EKSDCDTPN

SEQ ID NO: 1312947 - protein, 9 aa, Homo Sapiens
ALAIIFFGR

SEQ ID NO: 1312948 - protein, 9 aa, Homo Sapiens
EPKVPGVVQ

SEQ ID NO: 1312949 - protein, 9 aa, Homo Sapiens
MLSPVSKDA

SEQ ID NO: 1312950 - protein, 9 aa, Homo Sapiens
ETAAFGTVT

SEQ ID NO: 1312951 - protein, 9 aa, Homo Sapiens
CQQACCAPV

SEQ ID NO: 1312952 - protein, 9 aa, Homo Sapiens
LLLSDLARL

SEQ ID NO: 1312953 - protein, 9 aa, Homo Sapiens
LQPLRQQAF

SEQ ID NO: 1312954 - protein, 9 aa, Homo Sapiens
GVWHVSELD

SEQ ID NO: 1312955 - protein, 9 aa, Homo Sapiens
TITGADMSS

SEQ ID NO: 1312956 - protein, 9 aa, Homo Sapiens
SGFTGVYFE

SEQ ID NO: 1312957 - protein, 9 aa, Homo Sapiens
LVLMEDTGW

SEQ ID NO: 1312958 - protein, 9 aa, Homo Sapiens
GALPAYVIS

SEQ ID NO: 1312959 - protein, 9 aa, Homo Sapiens
SDYIEAIYS

SEQ ID NO: 1312960 - protein, 9 aa, Homo Sapiens
QQVSASTDG

SEQ ID NO: 1312961 - protein, 9 aa, Homo Sapiens
PHFNSLPQA

SEQ ID NO: 1312962 - protein, 9 aa, Homo Sapiens
NTQLYIHQM

SEQ ID NO: 1312963 - protein, 9 aa, Homo Sapiens
RRRVSSNSI

SEQ ID NO: 1312964 - protein, 9 aa, Homo Sapiens
GYQLCKPDV

SEQ ID NO: 1312965 - protein, 9 aa, Homo Sapiens
KCTHCGCRG

SEQ ID NO: 1312966 - protein, 9 aa, Homo Sapiens
MNLPEDKLT

SEQ ID NO: 1312967 - protein, 9 aa, Homo Sapiens
KLLEKYCVE

SEQ ID NO: 1312968 - protein, 9 aa, Homo Sapiens
KKIEGKYEK

SEQ ID NO: 1312969 - protein, 9 aa, Homo Sapiens
SDQGFNLMN

SEQ ID NO: 1312970 - protein, 9 aa, Homo Sapiens
IQDRTPFSV

SEQ ID NO: 1312971 - protein, 9 aa, Homo Sapiens
TKLEVAQNV

SEQ ID NO: 1312972 - protein, 9 aa, Homo Sapiens
EIQDAFDIY

SEQ ID NO: 1312973 - protein, 9 aa, Homo Sapiens
YPIQVLTYE

SEQ ID NO: 1312974 - protein, 9 aa, Homo Sapiens
GHEPRSCPE

SEQ ID NO: 1312975 - protein, 9 aa, Homo Sapiens
EESPYTPPS

SEQ ID NO: 1312976 - protein, 9 aa, Homo Sapiens
LYTVLHHLG

SEQ ID NO: 1312977 - protein, 9 aa, Homo Sapiens
KFYAKNEWL

SEQ ID NO: 1312978 - protein, 9 aa, Homo Sapiens
ADGLKSSCI

SEQ ID NO: 1312979 - protein, 9 aa, Homo Sapiens
ARSPRLRSI

SEQ ID NO: 1312980 - protein, 9 aa, Homo Sapiens
TVRAMVFTL

SEQ ID NO: 1312981 - protein, 9 aa, Homo Sapiens
AILFHILQT

SEQ ID NO: 1312982 - protein, 9 aa, Homo Sapiens
KGWWQKFWL

SEQ ID NO: 1312983 - protein, 9 aa, Homo Sapiens
AGLIFYLIV

SEQ ID NO: 1312984 - protein, 9 aa, Homo Sapiens
DDSLNTTVN

SEQ ID NO: 1312985 - protein, 9 aa, Homo Sapiens
EDFKQQVSY

SEQ ID NO: 1312986 - protein, 9 aa, Homo Sapiens
HRNVVYVIA

SEQ ID NO: 1312987 - protein, 9 aa, Homo Sapiens
INLNLRAGP

SEQ ID NO: 1312988 - protein, 9 aa, Homo Sapiens
CAGYEAFRT

SEQ ID NO: 1312989 - protein, 9 aa, Homo Sapiens
TNKENAKQL

SEQ ID NO: 1312990 - protein, 9 aa, Homo Sapiens
RCMPRGGAG

SEQ ID NO: 1312991 - protein, 9 aa, Homo Sapiens
PVALTESEM

SEQ ID NO: 1312992 - protein, 9 aa, Homo Sapiens
SQHRRKSLP

SEQ ID NO: 1312993 - protein, 9 aa, Homo Sapiens
FSFITQLSD

SEQ ID NO: 1312994 - protein, 9 aa, Homo Sapiens
YSSVTADLM

SEQ ID NO: 1312995 - protein, 9 aa, Homo Sapiens
ESLPSSSSS

SEQ ID NO: 1312996 - protein, 9 aa, Homo Sapiens
FVREDRVLG

SEQ ID NO: 1312997 - protein, 9 aa, Homo Sapiens
FQEGFASSI

SEQ ID NO: 1312998 - protein, 9 aa, Homo Sapiens
ESPYTPPSD

SEQ ID NO: 1312999 - protein, 9 aa, Homo Sapiens
EALHHPYGC

SEQ ID NO: 1313000 - protein, 9 aa, Homo Sapiens
NDTLIFLPP

SEQ ID NO: 1313001 - protein, 9 aa, Homo Sapiens
RDARMHLMK

SEQ ID NO: 1313002 - protein, 9 aa, Homo Sapiens
ITRDLILLN

SEQ ID NO: 1313003 - protein, 9 aa, Homo Sapiens
NHRSSPYPS

SEQ ID NO: 1313004 - protein, 9 aa, Homo Sapiens
PWVLQDYMS

SEQ ID NO: 1313005 - protein, 9 aa, Homo Sapiens
DKHFNIFSK

SEQ ID NO: 1313006 - protein, 9 aa, Homo Sapiens
LQETITEFL

SEQ ID NO: 1313007 - protein, 9 aa, Homo Sapiens
KILKILLHN

SEQ ID NO: 1313008 - protein, 9 aa, Homo Sapiens
QRWSEKKAR

SEQ ID NO: 1313009 - protein, 9 aa, Homo Sapiens
QKPHQVADA

SEQ ID NO: 1313010 - protein, 9 aa, Homo Sapiens
TIGEFIALY

SEQ ID NO: 1313011 - protein, 9 aa, Homo Sapiens
TDAPQVDVP

SEQ ID NO: 1313012 - protein, 9 aa, Homo Sapiens
IFVRNQEKI

SEQ ID NO: 1313013 - protein, 9 aa, Homo Sapiens
KSMEWFTGI

SEQ ID NO: 1313014 - protein, 9 aa, Homo Sapiens
KQVLYLMFD

SEQ ID NO: 1313015 - protein, 9 aa, Homo Sapiens
ENLDFKVII

SEQ ID NO: 1313016 - protein, 9 aa, Homo Sapiens
SAYSSVTAD

SEQ ID NO: 1313017 - protein, 9 aa, Homo Sapiens
NNHLVPVER

SEQ ID NO: 1313018 - protein, 9 aa, Homo Sapiens
EMAGWPETP

SEQ ID NO: 1313019 - protein, 9 aa, Homo Sapiens
LLSMVNSGP

SEQ ID NO: 1313020 - protein, 9 aa, Homo Sapiens
EAKEGEDED

SEQ ID NO: 1313021 - protein, 9 aa, Homo Sapiens
LGSYSSSPC

SEQ ID NO: 1313022 - protein, 9 aa, Homo Sapiens
AMSENDNMF

SEQ ID NO: 1313023 - protein, 9 aa, Homo Sapiens
CRKLCHTLA

SEQ ID NO: 1313024 - protein, 9 aa, Homo Sapiens
IKGDFQNPG

SEQ ID NO: 1313025 - protein, 9 aa, Homo Sapiens
TFNYMLYPI

SEQ ID NO: 1313026 - protein, 9 aa, Homo Sapiens
EKRQLQEEI

SEQ ID NO: 1313027 - protein, 9 aa, Homo Sapiens
SEGKQILFP

SEQ ID NO: 1313028 - protein, 9 aa, Homo Sapiens
LTQVCGYSE

SEQ ID NO: 1313029 - protein, 9 aa, Homo Sapiens
YNDDLAETV

SEQ ID NO: 1313030 - protein, 9 aa, Homo Sapiens
MLDIVAMFH

SEQ ID NO: 1313031 - protein, 9 aa, Homo Sapiens
RCGIIEFHV

SEQ ID NO: 1313032 - protein, 9 aa, Homo Sapiens
HLGPGRIHH

SEQ ID NO: 1313033 - protein, 9 aa, Homo Sapiens
SYQVPKEDV

SEQ ID NO: 1313034 - protein, 9 aa, Homo Sapiens
LTTEGTGLR

SEQ ID NO: 1313035 - protein, 9 aa, Homo Sapiens
ITRTYYRNS

SEQ ID NO: 1313036 - protein, 9 aa, Homo Sapiens
PLQRPGMLK

SEQ ID NO: 1313037 - protein, 9 aa, Homo Sapiens
TTNIWLKQE

SEQ ID NO: 1313038 - protein, 9 aa, Homo Sapiens
LMQYPARAI

SEQ ID NO: 1313039 - protein, 9 aa, Homo Sapiens
QDTQAHLGV

SEQ ID NO: 1313040 - protein, 9 aa, Homo Sapiens
QQALHRPPN

SEQ ID NO: 1313041 - protein, 9 aa, Homo Sapiens
DMVINRSLV

SEQ ID NO: 1313042 - protein, 9 aa, Homo Sapiens
VSKWPVDRE

SEQ ID NO: 1313043 - protein, 9 aa, Homo Sapiens
LHTSVWILY

SEQ ID NO: 1313044 - protein, 9 aa, Homo Sapiens
SPVSSQDKL

SEQ ID NO: 1313045 - protein, 9 aa, Homo Sapiens
PPDVYAIMR

SEQ ID NO: 1313046 - protein, 9 aa, Homo Sapiens
AITKHNQVE

SEQ ID NO: 1313047 - protein, 9 aa, Homo Sapiens
TLEEVSAAE

SEQ ID NO: 1313048 - protein, 9 aa, Homo Sapiens
DTMVDYFFQ

SEQ ID NO: 1313049 - protein, 9 aa, Homo Sapiens
WTKLDLPLQ

SEQ ID NO: 1313050 - protein, 9 aa, Homo Sapiens
YLDELHLAV

SEQ ID NO: 1313051 - protein, 9 aa, Homo Sapiens
MTSAEVGSA

SEQ ID NO: 1313052 - protein, 9 aa, Homo Sapiens
SLFHQCYAD

SEQ ID NO: 1313053 - protein, 9 aa, Homo Sapiens
QSLVHSVDF

SEQ ID NO: 1313054 - protein, 9 aa, Homo Sapiens
GAEAHINTC

SEQ ID NO: 1313055 - protein, 9 aa, Homo Sapiens
STGPNILTD

SEQ ID NO: 1313056 - protein, 9 aa, Homo Sapiens
CPPVLTASR

SEQ ID NO: 1313057 - protein, 9 aa, Homo Sapiens
ASAYTGHLS

SEQ ID NO: 1313058 - protein, 9 aa, Homo Sapiens
VRSAEEVAS

SEQ ID NO: 1313059 - protein, 9 aa, Homo Sapiens
YRHSRLEGI

SEQ ID NO: 1313060 - protein, 9 aa, Homo Sapiens
RSALIPHHS

SEQ ID NO: 1313061 - protein, 9 aa, Homo Sapiens
CALETQPTR

SEQ ID NO: 1313062 - protein, 9 aa, Homo Sapiens
IIFEYYVRF

SEQ ID NO: 1313063 - protein, 9 aa, Homo Sapiens
NKHLPSTHQ

SEQ ID NO: 1313064 - protein, 9 aa, Homo Sapiens
SAHLLTRAH

SEQ ID NO: 1313065 - protein, 9 aa, Homo Sapiens
LLEEFYAGD

SEQ ID NO: 1313066 - protein, 9 aa, Homo Sapiens
TLKIDLQRE

SEQ ID NO: 1313067 - protein, 9 aa, Homo Sapiens
YECPNYQGQ

SEQ ID NO: 1313068 - protein, 9 aa, Homo Sapiens
IQSVFLDDI

SEQ ID NO: 1313069 - protein, 9 aa, Homo Sapiens
TASDHKNLG

SEQ ID NO: 1313070 - protein, 9 aa, Homo Sapiens
HKKYQYIHQ

SEQ ID NO: 1313071 - protein, 9 aa, Homo Sapiens
LLPSLPGSR

SEQ ID NO: 1313072 - protein, 9 aa, Homo Sapiens
IVIAPNGAL

SEQ ID NO: 1313073 - protein, 9 aa, Homo Sapiens
DRRFNIDLV

SEQ ID NO: 1313074 - protein, 9 aa, Homo Sapiens
VAAQGVSQH

SEQ ID NO: 1313075 - protein, 9 aa, Homo Sapiens
DHRYYADGC

SEQ ID NO: 1313076 - protein, 9 aa, Homo Sapiens
DHQQLCPSA

SEQ ID NO: 1313077 - protein, 9 aa, Homo Sapiens
TDPQYRARG

SEQ ID NO: 1313078 - protein, 9 aa, Homo Sapiens
SRFFITSTG

SEQ ID NO: 1313079 - protein, 9 aa, Homo Sapiens
REIQGLPIT

SEQ ID NO: 1313080 - protein, 9 aa, Homo Sapiens
TNKDCKKAQ

SEQ ID NO: 1313081 - protein, 9 aa, Homo Sapiens
NNQFENETI

SEQ ID NO: 1313082 - protein, 9 aa, Homo Sapiens
NSPLSKVVR

SEQ ID NO: 1313083 - protein, 9 aa, Homo Sapiens
ITIAIFQIA

SEQ ID NO: 1313084 - protein, 9 aa, Homo Sapiens
AVTTLDGHS

SEQ ID NO: 1313085 - protein, 9 aa, Homo Sapiens
YKCDCTQTG

SEQ ID NO: 1313086 - protein, 9 aa, Homo Sapiens
EAGFPEQVT

SEQ ID NO: 1313087 - protein, 9 aa, Homo Sapiens
NVFHYLMTF

SEQ ID NO: 1313088 - protein, 9 aa, Homo Sapiens
NQEDVEAAM

SEQ ID NO: 1313089 - protein, 9 aa, Homo Sapiens
CTRGSIVAT

SEQ ID NO: 1313090 - protein, 9 aa, Homo Sapiens
NNVKLVFDP

SEQ ID NO: 1313091 - protein, 9 aa, Homo Sapiens
LTFFTAAFV

SEQ ID NO: 1313092 - protein, 9 aa, Homo Sapiens
KDSQPYMRR

SEQ ID NO: 1313093 - protein, 9 aa, Homo Sapiens
CLAPKVDVR

SEQ ID NO: 1313094 - protein, 9 aa, Homo Sapiens
KERICLARQ

SEQ ID NO: 1313095 - protein, 9 aa, Homo Sapiens
HNNFQALKY

SEQ ID NO: 1313096 - protein, 9 aa, Homo Sapiens
VQYPLTGMS

SEQ ID NO: 1313097 - protein, 9 aa, Homo Sapiens
HHIRQNVAD

SEQ ID NO: 1313098 - protein, 9 aa, Homo Sapiens
GEVKCAVEE

SEQ ID NO: 1313099 - protein, 9 aa, Homo Sapiens
TEENLDFKV

SEQ ID NO: 1313100 - protein, 9 aa, Homo Sapiens
VANMFSIAG

SEQ ID NO: 1313101 - protein, 9 aa, Homo Sapiens
AVFLLFFWQ

SEQ ID NO: 1313102 - protein, 9 aa, Homo Sapiens
DGVLLRRMT

SEQ ID NO: 1313103 - protein, 9 aa, Homo Sapiens
AQLRFLKLK

SEQ ID NO: 1313104 - protein, 9 aa, Homo Sapiens
PDFHIAGDA

SEQ ID NO: 1313105 - protein, 9 aa, Homo Sapiens
KWEALHVAE

SEQ ID NO: 1313106 - protein, 9 aa, Homo Sapiens
IGRITGKGG

SEQ ID NO: 1313107 - protein, 9 aa, Homo Sapiens
HIKQFQTIS

SEQ ID NO: 1313108 - protein, 9 aa, Homo Sapiens
ALGTRKVGV

SEQ ID NO: 1313109 - protein, 9 aa, Homo Sapiens
AQEKQFPMK

SEQ ID NO: 1313110 - protein, 9 aa, Homo Sapiens
EAIKSVLLV

SEQ ID NO: 1313111 - protein, 9 aa, Homo Sapiens
VALPAPAFF

SEQ ID NO: 1313112 - protein, 9 aa, Homo Sapiens
IHSAMEHTP

SEQ ID NO: 1313113 - protein, 9 aa, Homo Sapiens
TCSCTGAST

SEQ ID NO: 1313114 - protein, 9 aa, Homo Sapiens
EYRVSSRLK

SEQ ID NO: 1313115 - protein, 9 aa, Homo Sapiens
DMLMEGVKT

SEQ ID NO: 1313116 - protein, 9 aa, Homo Sapiens
KMILGRKTK

SEQ ID NO: 1313117 - protein, 9 aa, Homo Sapiens
DSIRDRRNN

SEQ ID NO: 1313118 - protein, 9 aa, Homo Sapiens
GSVMSNSFS

SEQ ID NO: 1313119 - protein, 9 aa, Homo Sapiens
HSVPSTPPW

SEQ ID NO: 1313120 - protein, 9 aa, Homo Sapiens
VSQTYSGPI

SEQ ID NO: 1313121 - protein, 9 aa, Homo Sapiens
SEPDISSEE

SEQ ID NO: 1313122 - protein, 9 aa, Homo Sapiens
KRKLGCHVR

SEQ ID NO: 1313123 - protein, 9 aa, Homo Sapiens
SFRLERAQD

SEQ ID NO: 1313124 - protein, 9 aa, Homo Sapiens
PTPPAQDGK

SEQ ID NO: 1313125 - protein, 9 aa, Homo Sapiens
RTALQRPGI

SEQ ID NO: 1313126 - protein, 9 aa, Homo Sapiens
DQEQVSPTA

SEQ ID NO: 1313127 - protein, 9 aa, Homo Sapiens
ERDIMTFAN

SEQ ID NO: 1313128 - protein, 9 aa, Homo Sapiens
GCVRGLWAG

SEQ ID NO: 1313129 - protein, 9 aa, Homo Sapiens
LDIDEREYH

SEQ ID NO: 1313130 - protein, 9 aa, Homo Sapiens
WGTFAQPLP

SEQ ID NO: 1313131 - protein, 9 aa, Homo Sapiens
TFDGLKLNY

SEQ ID NO: 1313132 - protein, 9 aa, Homo Sapiens
IPDFIPAVR

SEQ ID NO: 1313133 - protein, 9 aa, Homo Sapiens
CFCSVFALP

SEQ ID NO: 1313134 - protein, 9 aa, Homo Sapiens
NDSQFFITT

SEQ ID NO: 1313135 - protein, 9 aa, Homo Sapiens
TVSWFYGIT

SEQ ID NO: 1313136 - protein, 9 aa, Homo Sapiens
KQLLWHRTQ

SEQ ID NO: 1313137 - protein, 9 aa, Homo Sapiens
PREGLSRHQ

SEQ ID NO: 1313138 - protein, 9 aa, Homo Sapiens
LLLAYLNSV

SEQ ID NO: 1313139 - protein, 9 aa, Homo Sapiens
SQRFMVQIP

SEQ ID NO: 1313140 - protein, 9 aa, Homo Sapiens
TAVTVGYFI

SEQ ID NO: 1313141 - protein, 9 aa, Homo Sapiens
CPSANVYDL

SEQ ID NO: 1313142 - protein, 9 aa, Homo Sapiens
DAPTGFPCS

SEQ ID NO: 1313143 - protein, 9 aa, Homo Sapiens
YGRSRSKLW

SEQ ID NO: 1313144 - protein, 9 aa, Homo Sapiens
LWGVWLRLR

SEQ ID NO: 1313145 - protein, 9 aa, Homo Sapiens
TTHFTKRVR

SEQ ID NO: 1313146 - protein, 9 aa, Homo Sapiens
LICIMKNQI

SEQ ID NO: 1313147 - protein, 9 aa, Homo Sapiens
IKVVKVFHS

SEQ ID NO: 1313148 - protein, 9 aa, Homo Sapiens
GHPPGSPQI

SEQ ID NO: 1313149 - protein, 9 aa, Homo Sapiens
MNVDLRECF

SEQ ID NO: 1313150 - protein, 9 aa, Homo Sapiens
YQASTSNMV

SEQ ID NO: 1313151 - protein, 9 aa, Homo Sapiens
GFDEDKDDD

SEQ ID NO: 1313152 - protein, 9 aa, Homo Sapiens
MTNITWMAN

SEQ ID NO: 1313153 - protein, 9 aa, Homo Sapiens
SCTMWGLPC

SEQ ID NO: 1313154 - protein, 9 aa, Homo Sapiens
GSYSSSPCP

SEQ ID NO: 1313155 - protein, 9 aa, Homo Sapiens
VQEKWGLKD

SEQ ID NO: 1313156 - protein, 9 aa, Homo Sapiens
RKVPNGYLC

SEQ ID NO: 1313157 - protein, 9 aa, Homo Sapiens
TYEQLLSRL

SEQ ID NO: 1313158 - protein, 9 aa, Homo Sapiens
LRQVNGINP

SEQ ID NO: 1313159 - protein, 9 aa, Homo Sapiens
VQPVCPTFT

SEQ ID NO: 1313160 - protein, 9 aa, Homo Sapiens
AAVPPQYHK

SEQ ID NO: 1313161 - protein, 9 aa, Homo Sapiens
VHHPGFYAE

SEQ ID NO: 1313162 - protein, 9 aa, Homo Sapiens
GLHLGTDTL

SEQ ID NO: 1313163 - protein, 9 aa, Homo Sapiens
KNEGCLYMT

SEQ ID NO: 1313164 - protein, 9 aa, Homo Sapiens
ATELYRIGK

SEQ ID NO: 1313165 - protein, 9 aa, Homo Sapiens
MFHQYSGDD

SEQ ID NO: 1313166 - protein, 9 aa, Homo Sapiens
PESNGMHRW

SEQ ID NO: 1313167 - protein, 9 aa, Homo Sapiens
MYFPSEAFS

SEQ ID NO: 1313168 - protein, 9 aa, Homo Sapiens
NVSCRLEKQ

SEQ ID NO: 1313169 - protein, 9 aa, Homo Sapiens
YHPLITLKW

SEQ ID NO: 1313170 - protein, 9 aa, Homo Sapiens
SPKVSDTMV

SEQ ID NO: 1313171 - protein, 9 aa, Homo Sapiens
ALNGIHFDP

SEQ ID NO: 1313172 - protein, 9 aa, Homo Sapiens
EEEDTETAQ

SEQ ID NO: 1313173 - protein, 9 aa, Homo Sapiens
GKPDMAYCL

SEQ ID NO: 1313174 - protein, 9 aa, Homo Sapiens
QGLHYITVG

SEQ ID NO: 1313175 - protein, 9 aa, Homo Sapiens
NRLYHEGHV

SEQ ID NO: 1313176 - protein, 9 aa, Homo Sapiens
KEDTQLGTV

SEQ ID NO: 1313177 - protein, 9 aa, Homo Sapiens
HAWNTHHIL

SEQ ID NO: 1313178 - protein, 9 aa, Homo Sapiens
AEYAHVQKR

SEQ ID NO: 1313179 - protein, 9 aa, Homo Sapiens
LTSLRSEQS

SEQ ID NO: 1313180 - protein, 9 aa, Homo Sapiens
LLPALVLCV

SEQ ID NO: 1313181 - protein, 9 aa, Homo Sapiens
KQRKPKRAN

SEQ ID NO: 1313182 - protein, 9 aa, Homo Sapiens
ELWNLPPHA

SEQ ID NO: 1313183 - protein, 9 aa, Homo Sapiens
FDKISDARV

SEQ ID NO: 1313184 - protein, 9 aa, Homo Sapiens
RAGVSPGRA

SEQ ID NO: 1313185 - protein, 9 aa, Homo Sapiens
SGCHVNIIP

SEQ ID NO: 1313186 - protein, 9 aa, Homo Sapiens
DPQGPLKDY

SEQ ID NO: 1313187 - protein, 9 aa, Homo Sapiens
SQDVLHHYI

SEQ ID NO: 1313188 - protein, 9 aa, Homo Sapiens
GKWRDYDQY

SEQ ID NO: 1313189 - protein, 9 aa, Homo Sapiens
FGICHQDIK

SEQ ID NO: 1313190 - protein, 9 aa, Homo Sapiens
IYCRLRKPK

SEQ ID NO: 1313191 - protein, 9 aa, Homo Sapiens
PSLDVTPQA

SEQ ID NO: 1313192 - protein, 9 aa, Homo Sapiens
AATRTCSCT

SEQ ID NO: 1313193 - protein, 9 aa, Homo Sapiens
LYIIHLAEQ

SEQ ID NO: 1313194 - protein, 9 aa, Homo Sapiens
CFSSFRVVG

SEQ ID NO: 1313195 - protein, 9 aa, Homo Sapiens
GSAIFVKKE

SEQ ID NO: 1313196 - protein, 9 aa, Homo Sapiens
VTGRQEDVA

SEQ ID NO: 1313197 - protein, 9 aa, Homo Sapiens
TSTMSLELD

SEQ ID NO: 1313198 - protein, 9 aa, Homo Sapiens
ELFPNQQSQ

SEQ ID NO: 1313199 - protein, 9 aa, Homo Sapiens
KWDYMMPEQ

SEQ ID NO: 1313200 - protein, 9 aa, Homo Sapiens
PQVDVPKVP

SEQ ID NO: 1313201 - protein, 9 aa, Homo Sapiens
LWMVDACAS

SEQ ID NO: 1313202 - protein, 9 aa, Homo Sapiens
ICPPKYYTY

SEQ ID NO: 1313203 - protein, 9 aa, Homo Sapiens
QRITLYCHQ

SEQ ID NO: 1313204 - protein, 9 aa, Homo Sapiens
LIFHSLDRN

SEQ ID NO: 1313205 - protein, 9 aa, Homo Sapiens
AWALADTQV

SEQ ID NO: 1313206 - protein, 9 aa, Homo Sapiens
TTLKLILVM

SEQ ID NO: 1313207 - protein, 9 aa, Homo Sapiens
STVVWAFRT

SEQ ID NO: 1313208 - protein, 9 aa, Homo Sapiens
RTALRSCSL

SEQ ID NO: 1313209 - protein, 9 aa, Homo Sapiens
NSLPQGAGS

SEQ ID NO: 1313210 - protein, 9 aa, Homo Sapiens
EIFALFIPC

SEQ ID NO: 1313211 - protein, 9 aa, Homo Sapiens
CDRFYLISL

SEQ ID NO: 1313212 - protein, 9 aa, Homo Sapiens
ESPSSGTGI

SEQ ID NO: 1313213 - protein, 9 aa, Homo Sapiens
HSGDPSLQA

SEQ ID NO: 1313214 - protein, 9 aa, Homo Sapiens
EHEVCMSHL

SEQ ID NO: 1313215 - protein, 9 aa, Homo Sapiens
DVLHHYIED

SEQ ID NO: 1313216 - protein, 9 aa, Homo Sapiens
GDIVKRVYE

SEQ ID NO: 1313217 - protein, 9 aa, Homo Sapiens
IKQCHVRKK

SEQ ID NO: 1313218 - protein, 9 aa, Homo Sapiens
EVNMCKKCG

SEQ ID NO: 1313219 - protein, 9 aa, Homo Sapiens
SVTPERIAD

SEQ ID NO: 1313220 - protein, 9 aa, Homo Sapiens
CAKSPWMMV

SEQ ID NO: 1313221 - protein, 9 aa, Homo Sapiens
TNTHVLPGS

SEQ ID NO: 1313222 - protein, 9 aa, Homo Sapiens
TVVIILGAS

SEQ ID NO: 1313223 - protein, 9 aa, Homo Sapiens
NIRKYWSHY

SEQ ID NO: 1313224 - protein, 9 aa, Homo Sapiens
VKRKNVTFL

SEQ ID NO: 1313225 - protein, 9 aa, Homo Sapiens
RWLLENMDV

SEQ ID NO: 1313226 - protein, 9 aa, Homo Sapiens
VEMVPCGTV

SEQ ID NO: 1313227 - protein, 9 aa, Homo Sapiens
GEKMGHFQV

SEQ ID NO: 1313228 - protein, 9 aa, Homo Sapiens
KLHSGMKMY

SEQ ID NO: 1313229 - protein, 9 aa, Homo Sapiens
MLVEEMETT

SEQ ID NO: 1313230 - protein, 9 aa, Homo Sapiens
GYRLMNSSI

SEQ ID NO: 1313231 - protein, 9 aa, Homo Sapiens
VEYHKIKAT

SEQ ID NO: 1313232 - protein, 9 aa, Homo Sapiens
ALTMLLQET

SEQ ID NO: 1313233 - protein, 9 aa, Homo Sapiens
TSMDGPGQD

SEQ ID NO: 1313234 - protein, 9 aa, Homo Sapiens
TTSDSKGTS

SEQ ID NO: 1313235 - protein, 9 aa, Homo Sapiens
PQMSATFAK

SEQ ID NO: 1313236 - protein, 9 aa, Homo Sapiens
FDCLEGRPD

SEQ ID NO: 1313237 - protein, 9 aa, Homo Sapiens
FKWDYMMPE

SEQ ID NO: 1313238 - protein, 9 aa, Homo Sapiens
AVAWVIPVP

SEQ ID NO: 1313239 - protein, 9 aa, Homo Sapiens
TTRHSALHL

SEQ ID NO: 1313240 - protein, 9 aa, Homo Sapiens
KFLLSRGTN

SEQ ID NO: 1313241 - protein, 9 aa, Homo Sapiens
AIFVQGPAW

SEQ ID NO: 1313242 - protein, 9 aa, Homo Sapiens
PRSKQEAYA

SEQ ID NO: 1313243 - protein, 9 aa, Homo Sapiens
LNGSSPIYQ

SEQ ID NO: 1313244 - protein, 9 aa, Homo Sapiens
KERLEVQTR

SEQ ID NO: 1313245 - protein, 9 aa, Homo Sapiens
LSSSSQHRP

SEQ ID NO: 1313246 - protein, 9 aa, Homo Sapiens
RQQPPRQNQ

SEQ ID NO: 1313247 - protein, 9 aa, Homo Sapiens
AQYCIKRML

SEQ ID NO: 1313248 - protein, 9 aa, Homo Sapiens
SPPAGPNNV

SEQ ID NO: 1313249 - protein, 9 aa, Homo Sapiens
PEDLEVIKN

SEQ ID NO: 1313250 - protein, 9 aa, Homo Sapiens
TCQCHHGET

SEQ ID NO: 1313251 - protein, 9 aa, Homo Sapiens
KTMWNLENR

SEQ ID NO: 1313252 - protein, 9 aa, Homo Sapiens
MQAIRNYSG

SEQ ID NO: 1313253 - protein, 9 aa, Homo Sapiens
EEMWRLWQK

SEQ ID NO: 1313254 - protein, 9 aa, Homo Sapiens
RETLKNRKK

SEQ ID NO: 1313255 - protein, 9 aa, Homo Sapiens
GETVSETLQ

SEQ ID NO: 1313256 - protein, 9 aa, Homo Sapiens
NTDMLMEGV

SEQ ID NO: 1313257 - protein, 9 aa, Homo Sapiens
GDPGFPGIK

SEQ ID NO: 1313258 - protein, 9 aa, Homo Sapiens
ISCMQYAPN

SEQ ID NO: 1313259 - protein, 9 aa, Homo Sapiens
KPKGPNPAT

SEQ ID NO: 1313260 - protein, 9 aa, Homo Sapiens
EKVWQIHVD

SEQ ID NO: 1313261 - protein, 9 aa, Homo Sapiens
EWFTGIEHY

SEQ ID NO: 1313262 - protein, 9 aa, Homo Sapiens
QSVPVFQVE

SEQ ID NO: 1313263 - protein, 9 aa, Homo Sapiens
YCVHWQTYV

SEQ ID NO: 1313264 - protein, 9 aa, Homo Sapiens
LNRFLEENL

SEQ ID NO: 1313265 - protein, 9 aa, Homo Sapiens
RMNNLMDED

SEQ ID NO: 1313266 - protein, 9 aa, Homo Sapiens
EEVSWLRLR

SEQ ID NO: 1313267 - protein, 9 aa, Homo Sapiens
QTEPRNHQG

SEQ ID NO: 1313268 - protein, 9 aa, Homo Sapiens
GEWGTIGDD

SEQ ID NO: 1313269 - protein, 9 aa, Homo Sapiens
ASQKNFILK

SEQ ID NO: 1313270 - protein, 9 aa, Homo Sapiens
KKQKTNIFV

SEQ ID NO: 1313271 - protein, 9 aa, Homo Sapiens
SSTDHQTPQ

SEQ ID NO: 1313272 - protein, 9 aa, Homo Sapiens
QAREQDCAH

SEQ ID NO: 1313273 - protein, 9 aa, Homo Sapiens
PELHNFLCI

SEQ ID NO: 1313274 - protein, 9 aa, Homo Sapiens
MACQYVLSN

SEQ ID NO: 1313275 - protein, 9 aa, Homo Sapiens
LKLDHYRTA

SEQ ID NO: 1313276 - protein, 9 aa, Homo Sapiens
LEYVNDNHP

SEQ ID NO: 1313277 - protein, 9 aa, Homo Sapiens
SKRKFQYEE

SEQ ID NO: 1313278 - protein, 9 aa, Homo Sapiens
SGPGRRLCT

SEQ ID NO: 1313279 - protein, 9 aa, Homo Sapiens
TTTEQGMRQ

SEQ ID NO: 1313280 - protein, 9 aa, Homo Sapiens
MTQEEHDDS

SEQ ID NO: 1313281 - protein, 9 aa, Homo Sapiens
RDTVQGRIT

SEQ ID NO: 1313282 - protein, 9 aa, Homo Sapiens
CAQTEGINI

SEQ ID NO: 1313283 - protein, 9 aa, Homo Sapiens
WFSFELVVH

SEQ ID NO: 1313284 - protein, 9 aa, Homo Sapiens
SFSSGSSSS

SEQ ID NO: 1313285 - protein, 9 aa, Homo Sapiens
CMTCHETKF

SEQ ID NO: 1313286 - protein, 9 aa, Homo Sapiens
TDFVRKIIF

SEQ ID NO: 1313287 - protein, 9 aa, Homo Sapiens
VVTCLERWH

SEQ ID NO: 1313288 - protein, 9 aa, Homo Sapiens
ACKLMRERK

SEQ ID NO: 1313289 - protein, 9 aa, Homo Sapiens
LYNKSHNEK

SEQ ID NO: 1313290 - protein, 9 aa, Homo Sapiens
QRELRSRLC

SEQ ID NO: 1313291 - protein, 9 aa, Homo Sapiens
GEVRIHIRV

SEQ ID NO: 1313292 - protein, 9 aa, Homo Sapiens
TTYWKTLVQ

SEQ ID NO: 1313293 - protein, 9 aa, Homo Sapiens
CGLVVGDQV

SEQ ID NO: 1313294 - protein, 9 aa, Homo Sapiens
LALEENDYF

SEQ ID NO: 1313295 - protein, 9 aa, Homo Sapiens
FTVLSAEST

SEQ ID NO: 1313296 - protein, 9 aa, Homo Sapiens
HHSAGCDST

SEQ ID NO: 1313297 - protein, 9 aa, Homo Sapiens
AAETRQESK

SEQ ID NO: 1313298 - protein, 9 aa, Homo Sapiens
LNIRKSTPG

SEQ ID NO: 1313299 - protein, 9 aa, Homo Sapiens
STVLTGLRL

SEQ ID NO: 1313300 - protein, 9 aa, Homo Sapiens
SPGSSLSSL

SEQ ID NO: 1313301 - protein, 9 aa, Homo Sapiens
DIDLKYDLG

SEQ ID NO: 1313302 - protein, 9 aa, Homo Sapiens
TVLVPPSVP

SEQ ID NO: 1313303 - protein, 9 aa, Homo Sapiens
QPLRQQAFL

SEQ ID NO: 1313304 - protein, 9 aa, Homo Sapiens
YFNDTLIFL

SEQ ID NO: 1313305 - protein, 9 aa, Homo Sapiens
EYANDSLAP

SEQ ID NO: 1313306 - protein, 9 aa, Homo Sapiens
QSLKKENHT

SEQ ID NO: 1313307 - protein, 9 aa, Homo Sapiens
NSPLDWQLR

SEQ ID NO: 1313308 - protein, 9 aa, Homo Sapiens
LFKVPGNLF

SEQ ID NO: 1313309 - protein, 9 aa, Homo Sapiens
VKETLQVMI

SEQ ID NO: 1313310 - protein, 9 aa, Homo Sapiens
ALTRVYGVI

SEQ ID NO: 1313311 - protein, 9 aa, Homo Sapiens
TPLSMTCCR

SEQ ID NO: 1313312 - protein, 9 aa, Homo Sapiens
PNVRYSAIK

SEQ ID NO: 1313313 - protein, 9 aa, Homo Sapiens
QQLDATFSM

SEQ ID NO: 1313314 - protein, 9 aa, Homo Sapiens
LKSHSMVRT

SEQ ID NO: 1313315 - protein, 9 aa, Homo Sapiens
CCDCGPGLL

SEQ ID NO: 1313316 - protein, 9 aa, Homo Sapiens
KSLVASMRK

SEQ ID NO: 1313317 - protein, 9 aa, Homo Sapiens
CKKAPLVPS

SEQ ID NO: 1313318 - protein, 9 aa, Homo Sapiens
HTLNEKCIL

SEQ ID NO: 1313319 - protein, 9 aa, Homo Sapiens
QWDRALAVL

SEQ ID NO: 1313320 - protein, 9 aa, Homo Sapiens
GLVNDIVTA

SEQ ID NO: 1313321 - protein, 9 aa, Homo Sapiens
SGARLEAES

SEQ ID NO: 1313322 - protein, 9 aa, Homo Sapiens
DLPCMENTV

SEQ ID NO: 1313323 - protein, 9 aa, Homo Sapiens
KGASRGTLW

SEQ ID NO: 1313324 - protein, 9 aa, Homo Sapiens
TVLSFSLYR

SEQ ID NO: 1313325 - protein, 9 aa, Homo Sapiens
LWKYGFFKR

SEQ ID NO: 1313326 - protein, 9 aa, Homo Sapiens
TLTVASLHL

SEQ ID NO: 1313327 - protein, 9 aa, Homo Sapiens
DKGILNDFH

SEQ ID NO: 1313328 - protein, 9 aa, Homo Sapiens
YEVDAQWKE

SEQ ID NO: 1313329 - protein, 9 aa, Homo Sapiens
PSKLAFSSS

SEQ ID NO: 1313330 - protein, 9 aa, Homo Sapiens
RSTCPLANS

SEQ ID NO: 1313331 - protein, 9 aa, Homo Sapiens
EEVKMTAVR

SEQ ID NO: 1313332 - protein, 9 aa, Homo Sapiens
FASSIVGSY

SEQ ID NO: 1313333 - protein, 9 aa, Homo Sapiens
VDEINVKYF

SEQ ID NO: 1313334 - protein, 9 aa, Homo Sapiens
KKKMARETE

SEQ ID NO: 1313335 - protein, 9 aa, Homo Sapiens
KHISLAGCG

SEQ ID NO: 1313336 - protein, 9 aa, Homo Sapiens
VVLDHVYHG

SEQ ID NO: 1313337 - protein, 9 aa, Homo Sapiens
PKRANCVIQ

SEQ ID NO: 1313338 - protein, 9 aa, Homo Sapiens
QTVPTLMSL

SEQ ID NO: 1313339 - protein, 9 aa, Homo Sapiens
RGWEVVFRQ

SEQ ID NO: 1313340 - protein, 9 aa, Homo Sapiens
CNNGILEIE

SEQ ID NO: 1313341 - protein, 9 aa, Homo Sapiens
DLKYDLGNT

SEQ ID NO: 1313342 - protein, 9 aa, Homo Sapiens
HACALGSEQ

SEQ ID NO: 1313343 - protein, 9 aa, Homo Sapiens
ILVIHYFRA

SEQ ID NO: 1313344 - protein, 9 aa, Homo Sapiens
ANKKSCFLY

SEQ ID NO: 1313345 - protein, 9 aa, Homo Sapiens
FLLAGILIC

SEQ ID NO: 1313346 - protein, 9 aa, Homo Sapiens
SNVVKESTR

SEQ ID NO: 1313347 - protein, 9 aa, Homo Sapiens
CRFSMEVRA

SEQ ID NO: 1313348 - protein, 9 aa, Homo Sapiens
KEKADTLQG

SEQ ID NO: 1313349 - protein, 9 aa, Homo Sapiens
IMWLGRKHR

SEQ ID NO: 1313350 - protein, 9 aa, Homo Sapiens
FASTLSHLH

SEQ ID NO: 1313351 - protein, 9 aa, Homo Sapiens
EVYGERCCL

SEQ ID NO: 1313352 - protein, 9 aa, Homo Sapiens
GNSTLAMGP

SEQ ID NO: 1313353 - protein, 9 aa, Homo Sapiens
NAQQVSQFL

SEQ ID NO: 1313354 - protein, 9 aa, Homo Sapiens
NHRFHRISA

SEQ ID NO: 1313355 - protein, 9 aa, Homo Sapiens
MLVSSWSVD

SEQ ID NO: 1313356 - protein, 9 aa, Homo Sapiens
SGCGSFAPG

SEQ ID NO: 1313357 - protein, 9 aa, Homo Sapiens
ATPMTSATG

SEQ ID NO: 1313358 - protein, 9 aa, Homo Sapiens
CLLTRGRHT

SEQ ID NO: 1313359 - protein, 9 aa, Homo Sapiens
SARTGRCVS

SEQ ID NO: 1313360 - protein, 9 aa, Homo Sapiens
GQLEKSPFK

SEQ ID NO: 1313361 - protein, 9 aa, Homo Sapiens
PIIASEVKV

SEQ ID NO: 1313362 - protein, 9 aa, Homo Sapiens
AQQRVPEGD

SEQ ID NO: 1313363 - protein, 9 aa, Homo Sapiens
TTFEGALNG

SEQ ID NO: 1313364 - protein, 9 aa, Homo Sapiens
YTPRVSIQA

SEQ ID NO: 1313365 - protein, 9 aa, Homo Sapiens
MPRVRKLKT

SEQ ID NO: 1313366 - protein, 9 aa, Homo Sapiens
PIKGFRYQS

SEQ ID NO: 1313367 - protein, 9 aa, Homo Sapiens
DQDGRMNYE

SEQ ID NO: 1313368 - protein, 9 aa, Homo Sapiens
SRSQSSFSN

SEQ ID NO: 1313369 - protein, 9 aa, Homo Sapiens
KGILNDFHK

SEQ ID NO: 1313370 - protein, 9 aa, Homo Sapiens
TALLAAMLR

SEQ ID NO: 1313371 - protein, 9 aa, Homo Sapiens
EPAKKKRKE

SEQ ID NO: 1313372 - protein, 9 aa, Homo Sapiens
DSEIEQYLC

SEQ ID NO: 1313373 - protein, 9 aa, Homo Sapiens
NRENVMGDF

SEQ ID NO: 1313374 - protein, 9 aa, Homo Sapiens
SPHKMAFAK

SEQ ID NO: 1313375 - protein, 9 aa, Homo Sapiens
KLSKDPHFS

SEQ ID NO: 1313376 - protein, 9 aa, Homo Sapiens
SSPGEGANP

SEQ ID NO: 1313377 - protein, 9 aa, Homo Sapiens
HTDSPDDLT

SEQ ID NO: 1313378 - protein, 9 aa, Homo Sapiens
DHLSLHRCR

SEQ ID NO: 1313379 - protein, 9 aa, Homo Sapiens
NMLAKLYIE

SEQ ID NO: 1313380 - protein, 9 aa, Homo Sapiens
PQAQRPGPP

SEQ ID NO: 1313381 - protein, 9 aa, Homo Sapiens
QIYHFKIFC

SEQ ID NO: 1313382 - protein, 9 aa, Homo Sapiens
AGSFQIPRG

SEQ ID NO: 1313383 - protein, 9 aa, Homo Sapiens
PRLRREEHA

SEQ ID NO: 1313384 - protein, 9 aa, Homo Sapiens
LQSEVDTDI

SEQ ID NO: 1313385 - protein, 9 aa, Homo Sapiens
CVAVIVTFQ

SEQ ID NO: 1313386 - protein, 9 aa, Homo Sapiens
ETRGKLRHR

SEQ ID NO: 1313387 - protein, 9 aa, Homo Sapiens
PFGGPNYHI

SEQ ID NO: 1313388 - protein, 9 aa, Homo Sapiens
ILQSTSFLT

SEQ ID NO: 1313389 - protein, 9 aa, Homo Sapiens
PRVEAGTPS

SEQ ID NO: 1313390 - protein, 9 aa, Homo Sapiens
TEQLRKIGR

SEQ ID NO: 1313391 - protein, 9 aa, Homo Sapiens
CGQKRKSGY

SEQ ID NO: 1313392 - protein, 9 aa, Homo Sapiens
TETINEVSK

SEQ ID NO: 1313393 - protein, 9 aa, Homo Sapiens
FRKVSQHTE

SEQ ID NO: 1313394 - protein, 9 aa, Homo Sapiens
TRHSQTTTI

SEQ ID NO: 1313395 - protein, 9 aa, Homo Sapiens
GEKVFCVNV

SEQ ID NO: 1313396 - protein, 9 aa, Homo Sapiens
FPAHVVPAS

SEQ ID NO: 1313397 - protein, 9 aa, Homo Sapiens
MTHGCFLNA

SEQ ID NO: 1313398 - protein, 9 aa, Homo Sapiens
QSSPRTQAS

SEQ ID NO: 1313399 - protein, 9 aa, Homo Sapiens
GNLFSLWVM

SEQ ID NO: 1313400 - protein, 9 aa, Homo Sapiens
VTVSWFYGI

SEQ ID NO: 1313401 - protein, 9 aa, Homo Sapiens
TPLPRPGAV

SEQ ID NO: 1313402 - protein, 9 aa, Homo Sapiens
NSDNKDLEV

SEQ ID NO: 1313403 - protein, 9 aa, Homo Sapiens
EWSFPRASE

SEQ ID NO: 1313404 - protein, 9 aa, Homo Sapiens
KQEQTDFTY

SEQ ID NO: 1313405 - protein, 9 aa, Homo Sapiens
IPLDESTIV

SEQ ID NO: 1313406 - protein, 9 aa, Homo Sapiens
SPSTRGRTR

SEQ ID NO: 1313407 - protein, 9 aa, Homo Sapiens
FKVTTMSIE

SEQ ID NO: 1313408 - protein, 9 aa, Homo Sapiens
TVANNVPPT

SEQ ID NO: 1313409 - protein, 9 aa, Homo Sapiens
PPMPLPVIS

SEQ ID NO: 1313410 - protein, 9 aa, Homo Sapiens
NKTTQNLTQ

SEQ ID NO: 1313411 - protein, 9 aa, Homo Sapiens
MYNFFIVLF

SEQ ID NO: 1313412 - protein, 9 aa, Homo Sapiens
IKGNSVSKT

SEQ ID NO: 1313413 - protein, 9 aa, Homo Sapiens
RARSPTSAA

SEQ ID NO: 1313414 - protein, 9 aa, Homo Sapiens
VERAAISSG

SEQ ID NO: 1313415 - protein, 9 aa, Homo Sapiens
MSVCLSGYL

SEQ ID NO: 1313416 - protein, 9 aa, Homo Sapiens
SSSDLSCKV

SEQ ID NO: 1313417 - protein, 9 aa, Homo Sapiens
ARNCLLSCT

SEQ ID NO: 1313418 - protein, 9 aa, Homo Sapiens
ACRLHCSVL

SEQ ID NO: 1313419 - protein, 9 aa, Homo Sapiens
TRDMFHLRL

SEQ ID NO: 1313420 - protein, 9 aa, Homo Sapiens
AQRIQEGAH

SEQ ID NO: 1313421 - protein, 9 aa, Homo Sapiens
AFNLFMLVL

SEQ ID NO: 1313422 - protein, 9 aa, Homo Sapiens
WLLSTYICK

SEQ ID NO: 1313423 - protein, 9 aa, Homo Sapiens
YAPPPPPPS

SEQ ID NO: 1313424 - protein, 9 aa, Homo Sapiens
PSTAASVGR

SEQ ID NO: 1313425 - protein, 9 aa, Homo Sapiens
VSGSRFFIT

SEQ ID NO: 1313426 - protein, 9 aa, Homo Sapiens
YMLAVANTT

SEQ ID NO: 1313427 - protein, 9 aa, Homo Sapiens
TLPSLCRLN

SEQ ID NO: 1313428 - protein, 9 aa, Homo Sapiens
IENPDLKLT

SEQ ID NO: 1313429 - protein, 9 aa, Homo Sapiens
LHPRGERRA

SEQ ID NO: 1313430 - protein, 9 aa, Homo Sapiens
VKDAQELLC

SEQ ID NO: 1313431 - protein, 9 aa, Homo Sapiens
HQQMMHWLK

SEQ ID NO: 1313432 - protein, 9 aa, Homo Sapiens
TVCIWHSST

SEQ ID NO: 1313433 - protein, 9 aa, Homo Sapiens
LHIAARENH

SEQ ID NO: 1313434 - protein, 9 aa, Homo Sapiens
HRVTLSMAL

SEQ ID NO: 1313435 - protein, 9 aa, Homo Sapiens
EVSYCDCCL

SEQ ID NO: 1313436 - protein, 9 aa, Homo Sapiens
TQARSPSTA

SEQ ID NO: 1313437 - protein, 9 aa, Homo Sapiens
EAERTLVLY

SEQ ID NO: 1313438 - protein, 9 aa, Homo Sapiens
GDTRSILYV

SEQ ID NO: 1313439 - protein, 9 aa, Homo Sapiens
SIIMISLTA

SEQ ID NO: 1313440 - protein, 9 aa, Homo Sapiens
TFGPVVDGD

SEQ ID NO: 1313441 - protein, 9 aa, Homo Sapiens
HPINLTCSV

SEQ ID NO: 1313442 - protein, 9 aa, Homo Sapiens
PCQQVLVHL

SEQ ID NO: 1313443 - protein, 9 aa, Homo Sapiens
PFRMSTHLN

SEQ ID NO: 1313444 - protein, 9 aa, Homo Sapiens
AYNNIFCVK

SEQ ID NO: 1313445 - protein, 9 aa, Homo Sapiens
LLLPHQRSL

SEQ ID NO: 1313446 - protein, 9 aa, Homo Sapiens
HLGTDTLRV

SEQ ID NO: 1313447 - protein, 9 aa, Homo Sapiens
PCTWVMTCA

SEQ ID NO: 1313448 - protein, 9 aa, Homo Sapiens
GPNEIYNFF

SEQ ID NO: 1313449 - protein, 9 aa, Homo Sapiens
KGKMMFCVL

SEQ ID NO: 1313450 - protein, 9 aa, Homo Sapiens
DMNYEIMGR

SEQ ID NO: 1313451 - protein, 9 aa, Homo Sapiens
TQLFNSLSG

SEQ ID NO: 1313452 - protein, 9 aa, Homo Sapiens
KKNFCDKAS

SEQ ID NO: 1313453 - protein, 9 aa, Homo Sapiens
PRKEHTRSD

SEQ ID NO: 1313454 - protein, 9 aa, Homo Sapiens
LGAAVSRHQ

SEQ ID NO: 1313455 - protein, 9 aa, Homo Sapiens
LPQKDHFAW

SEQ ID NO: 1313456 - protein, 9 aa, Homo Sapiens
KCIAYKRCI

SEQ ID NO: 1313457 - protein, 9 aa, Homo Sapiens
FHHPLLSSG

SEQ ID NO: 1313458 - protein, 9 aa, Homo Sapiens
KAVLWDSNG

SEQ ID NO: 1313459 - protein, 9 aa, Homo Sapiens
VGLTIACND

SEQ ID NO: 1313460 - protein, 9 aa, Homo Sapiens
HDTILGIDL

SEQ ID NO: 1313461 - protein, 9 aa, Homo Sapiens
VLTGLRLGV

SEQ ID NO: 1313462 - protein, 9 aa, Homo Sapiens
SIWLMFPTP

SEQ ID NO: 1313463 - protein, 9 aa, Homo Sapiens
PEDLHRVSE

SEQ ID NO: 1313464 - protein, 9 aa, Homo Sapiens
ANPQMFHTV

SEQ ID NO: 1313465 - protein, 9 aa, Homo Sapiens
LRAKEKELH

SEQ ID NO: 1313466 - protein, 9 aa, Homo Sapiens
FLADLYVLV

SEQ ID NO: 1313467 - protein, 9 aa, Homo Sapiens
PQKPHQVAD

SEQ ID NO: 1313468 - protein, 9 aa, Homo Sapiens
ITLSWLDLR

SEQ ID NO: 1313469 - protein, 9 aa, Homo Sapiens
NELMQKHND

SEQ ID NO: 1313470 - protein, 9 aa, Homo Sapiens
RCRIIQWLE

SEQ ID NO: 1313471 - protein, 9 aa, Homo Sapiens
ESKPILALC

SEQ ID NO: 1313472 - protein, 9 aa, Homo Sapiens
TQEHTRTEH

SEQ ID NO: 1313473 - protein, 9 aa, Homo Sapiens
NRKLLEKYC

SEQ ID NO: 1313474 - protein, 9 aa, Homo Sapiens
IPSSTTSLC

SEQ ID NO: 1313475 - protein, 9 aa, Homo Sapiens
VGECRSPPL

SEQ ID NO: 1313476 - protein, 9 aa, Homo Sapiens
TIMSPNDSP

SEQ ID NO: 1313477 - protein, 9 aa, Homo Sapiens
KSEITDEIK

SEQ ID NO: 1313478 - protein, 9 aa, Homo Sapiens
EATIQIAIN

SEQ ID NO: 1313479 - protein, 9 aa, Homo Sapiens
IVQAHSIYP

SEQ ID NO: 1313480 - protein, 9 aa, Homo Sapiens
GNMSRTETA

SEQ ID NO: 1313481 - protein, 9 aa, Homo Sapiens
HRQFMDHTH

SEQ ID NO: 1313482 - protein, 9 aa, Homo Sapiens
VSHLDWTAH

SEQ ID NO: 1313483 - protein, 9 aa, Homo Sapiens
SSYVLRMGP

SEQ ID NO: 1313484 - protein, 9 aa, Homo Sapiens
SCTTFGSFN

SEQ ID NO: 1313485 - protein, 9 aa, Homo Sapiens
DNNIQLFLT

SEQ ID NO: 1313486 - protein, 9 aa, Homo Sapiens
PLSSSPIVP

SEQ ID NO: 1313487 - protein, 9 aa, Homo Sapiens
AIPMLSPLI

SEQ ID NO: 1313488 - protein, 9 aa, Homo Sapiens
TVLALAQIE

SEQ ID NO: 1313489 - protein, 9 aa, Homo Sapiens
MIPEISNIT

SEQ ID NO: 1313490 - protein, 9 aa, Homo Sapiens
TSTTAKGDI

SEQ ID NO: 1313491 - protein, 9 aa, Homo Sapiens
SLCLMVVMN

SEQ ID NO: 1313492 - protein, 9 aa, Homo Sapiens
IFSPVVVIL

SEQ ID NO: 1313493 - protein, 9 aa, Homo Sapiens
GSPWWSCGE

SEQ ID NO: 1313494 - protein, 9 aa, Homo Sapiens
GMYKQCLPP

SEQ ID NO: 1313495 - protein, 9 aa, Homo Sapiens
QRRGRGKGA

SEQ ID NO: 1313496 - protein, 9 aa, Homo Sapiens
YHQDFFQEI

SEQ ID NO: 1313497 - protein, 9 aa, Homo Sapiens
KSDTSCMSQ

SEQ ID NO: 1313498 - protein, 9 aa, Homo Sapiens
WSHYYQGSQ

SEQ ID NO: 1313499 - protein, 9 aa, Homo Sapiens
KNDFLSAPQ

SEQ ID NO: 1313500 - protein, 9 aa, Homo Sapiens
QSLMHQSKG

SEQ ID NO: 1313501 - protein, 9 aa, Homo Sapiens
QVYSPEKGC

SEQ ID NO: 1313502 - protein, 9 aa, Homo Sapiens
RKSTLKTRL

SEQ ID NO: 1313503 - protein, 9 aa, Homo Sapiens
MAECEGVMD

SEQ ID NO: 1313504 - protein, 9 aa, Homo Sapiens
LTHTQDLTP

SEQ ID NO: 1313505 - protein, 9 aa, Homo Sapiens
SVKSLLQIE

SEQ ID NO: 1313506 - protein, 9 aa, Homo Sapiens
LGCVVLMQD

SEQ ID NO: 1313507 - protein, 9 aa, Homo Sapiens
SDGSNDSCK

SEQ ID NO: 1313508 - protein, 9 aa, Homo Sapiens
ENGWLLGQM

SEQ ID NO: 1313509 - protein, 9 aa, Homo Sapiens
EWRVLLVMS

SEQ ID NO: 1313510 - protein, 9 aa, Homo Sapiens
GKKGTHVLI

SEQ ID NO: 1313511 - protein, 9 aa, Homo Sapiens
LKHFSFSPT

SEQ ID NO: 1313512 - protein, 9 aa, Homo Sapiens
FVPLGAAQW

SEQ ID NO: 1313513 - protein, 9 aa, Homo Sapiens
YHTLSQHLN

SEQ ID NO: 1313514 - protein, 9 aa, Homo Sapiens
QKCKPDIML

SEQ ID NO: 1313515 - protein, 9 aa, Homo Sapiens
RNGDFLPTG

SEQ ID NO: 1313516 - protein, 9 aa, Homo Sapiens
TLAHSAIFS

SEQ ID NO: 1313517 - protein, 9 aa, Homo Sapiens
ALTVHMTQP

SEQ ID NO: 1313518 - protein, 9 aa, Homo Sapiens
EGKSLDSAL

SEQ ID NO: 1313519 - protein, 9 aa, Homo Sapiens
LPPQDSCWQ

SEQ ID NO: 1313520 - protein, 9 aa, Homo Sapiens
LEEDHAQYL

SEQ ID NO: 1313521 - protein, 9 aa, Homo Sapiens
LVTATRNFG

SEQ ID NO: 1313522 - protein, 9 aa, Homo Sapiens
EALSQLWEF

SEQ ID NO: 1313523 - protein, 9 aa, Homo Sapiens
IPPAKKCSL

SEQ ID NO: 1313524 - protein, 9 aa, Homo Sapiens
KIYDCQISK

SEQ ID NO: 1313525 - protein, 9 aa, Homo Sapiens
RGKNIQGGR

SEQ ID NO: 1313526 - protein, 9 aa, Homo Sapiens
LTQLEMTFN

SEQ ID NO: 1313527 - protein, 9 aa, Homo Sapiens
IVDAYCQAL

SEQ ID NO: 1313528 - protein, 9 aa, Homo Sapiens
RSVPLTQVM

SEQ ID NO: 1313529 - protein, 9 aa, Homo Sapiens
CNLLLYFTF

SEQ ID NO: 1313530 - protein, 9 aa, Homo Sapiens
DPTLQICCH

SEQ ID NO: 1313531 - protein, 9 aa, Homo Sapiens
MLGTMFGGD

SEQ ID NO: 1313532 - protein, 9 aa, Homo Sapiens
KQKSIILLK

SEQ ID NO: 1313533 - protein, 9 aa, Homo Sapiens
AVTVGYFIF

SEQ ID NO: 1313534 - protein, 9 aa, Homo Sapiens
PKDRTVAAN

SEQ ID NO: 1313535 - protein, 9 aa, Homo Sapiens
GLPITSYVS

SEQ ID NO: 1313536 - protein, 9 aa, Homo Sapiens
IDHYYAVCD

SEQ ID NO: 1313537 - protein, 9 aa, Homo Sapiens
SHSRSRERK

SEQ ID NO: 1313538 - protein, 9 aa, Homo Sapiens
RAGLPTAQQ

SEQ ID NO: 1313539 - protein, 9 aa, Homo Sapiens
GRRQWQSIE

SEQ ID NO: 1313540 - protein, 9 aa, Homo Sapiens
AAPSTVATP

SEQ ID NO: 1313541 - protein, 9 aa, Homo Sapiens
GNWSPHPPR

SEQ ID NO: 1313542 - protein, 9 aa, Homo Sapiens
DACSTKIDC

SEQ ID NO: 1313543 - protein, 9 aa, Homo Sapiens
REQTKNPDL

SEQ ID NO: 1313544 - protein, 9 aa, Homo Sapiens
DFAGLVQEI

SEQ ID NO: 1313545 - protein, 9 aa, Homo Sapiens
KAWGARCQC

SEQ ID NO: 1313546 - protein, 9 aa, Homo Sapiens
QGEFQVSKL

SEQ ID NO: 1313547 - protein, 9 aa, Homo Sapiens
FSRAEVVEL

SEQ ID NO: 1313548 - protein, 9 aa, Homo Sapiens
RCMVKKSRT

SEQ ID NO: 1313549 - protein, 9 aa, Homo Sapiens
GLCNRSTCP

SEQ ID NO: 1313550 - protein, 9 aa, Homo Sapiens
RHMYNSELL

SEQ ID NO: 1313551 - protein, 9 aa, Homo Sapiens
DLAGWELPD

SEQ ID NO: 1313552 - protein, 9 aa, Homo Sapiens
KPCRLLKMV

SEQ ID NO: 1313553 - protein, 9 aa, Homo Sapiens
TILFCIIAI

SEQ ID NO: 1313554 - protein, 9 aa, Homo Sapiens
LQGHRLDNL

SEQ ID NO: 1313555 - protein, 9 aa, Homo Sapiens
TCHDGASSD

SEQ ID NO: 1313556 - protein, 9 aa, Homo Sapiens
LLTQMVEIG

SEQ ID NO: 1313557 - protein, 9 aa, Homo Sapiens
DFEMIDAGY

SEQ ID NO: 1313558 - protein, 9 aa, Homo Sapiens
VFIPKKLNI

SEQ ID NO: 1313559 - protein, 9 aa, Homo Sapiens
RMTLEIGAL

SEQ ID NO: 1313560 - protein, 9 aa, Homo Sapiens
HRYYADGCS

SEQ ID NO: 1313561 - protein, 9 aa, Homo Sapiens
TVPQKPHQV

SEQ ID NO: 1313562 - protein, 9 aa, Homo Sapiens
DADEDMTKT

SEQ ID NO: 1313563 - protein, 9 aa, Homo Sapiens
SRKKPEFHS

SEQ ID NO: 1313564 - protein, 9 aa, Homo Sapiens
LRQQILPVK

SEQ ID NO: 1313565 - protein, 9 aa, Homo Sapiens
VGTFQQMLM

SEQ ID NO: 1313566 - protein, 9 aa, Homo Sapiens
ESQEAQNIT

SEQ ID NO: 1313567 - protein, 9 aa, Homo Sapiens
GTNVLSLLI

SEQ ID NO: 1313568 - protein, 9 aa, Homo Sapiens
RVDLEYVND

SEQ ID NO: 1313569 - protein, 9 aa, Homo Sapiens
NVTSPGVNS

SEQ ID NO: 1313570 - protein, 9 aa, Homo Sapiens
AGGSGGHSG

SEQ ID NO: 1313571 - protein, 9 aa, Homo Sapiens
PPLGQTNPT

SEQ ID NO: 1313572 - protein, 9 aa, Homo Sapiens
EEECGADTA

SEQ ID NO: 1313573 - protein, 9 aa, Homo Sapiens
YVLSINEEE

SEQ ID NO: 1313574 - protein, 9 aa, Homo Sapiens
TLTVSRWMT

SEQ ID NO: 1313575 - protein, 9 aa, Homo Sapiens
LRQARHQAE

SEQ ID NO: 1313576 - protein, 9 aa, Homo Sapiens
GDDDFTLQA

SEQ ID NO: 1313577 - protein, 9 aa, Homo Sapiens
FHRNRKSFS

SEQ ID NO: 1313578 - protein, 9 aa, Homo Sapiens
KPMGVSVIY

SEQ ID NO: 1313579 - protein, 9 aa, Homo Sapiens
LMKPYIKCA

SEQ ID NO: 1313580 - protein, 9 aa, Homo Sapiens
PVLPAVRSP

SEQ ID NO: 1313581 - protein, 9 aa, Homo Sapiens
WLPVSDDTC

SEQ ID NO: 1313582 - protein, 9 aa, Homo Sapiens
WHSLHPGYY

SEQ ID NO: 1313583 - protein, 9 aa, Homo Sapiens
RNGHMRISE

SEQ ID NO: 1313584 - protein, 9 aa, Homo Sapiens
PIPECPPLA

SEQ ID NO: 1313585 - protein, 9 aa, Homo Sapiens
LPHVFNEGW

SEQ ID NO: 1313586 - protein, 9 aa, Homo Sapiens
RQIYPPSTC

SEQ ID NO: 1313587 - protein, 9 aa, Homo Sapiens
KWVNGFNLA

SEQ ID NO: 1313588 - protein, 9 aa, Homo Sapiens
GVPPPGQSG

SEQ ID NO: 1313589 - protein, 9 aa, Homo Sapiens
NKTKLFPSI

SEQ ID NO: 1313590 - protein, 9 aa, Homo Sapiens
LATAQEKQF

SEQ ID NO: 1313591 - protein, 9 aa, Homo Sapiens
LSPAPSLGS

SEQ ID NO: 1313592 - protein, 9 aa, Homo Sapiens
KETLQVMIL

SEQ ID NO: 1313593 - protein, 9 aa, Homo Sapiens
KQKEEEQVR

SEQ ID NO: 1313594 - protein, 9 aa, Homo Sapiens
ADEDMTKTR

SEQ ID NO: 1313595 - protein, 9 aa, Homo Sapiens
LVTLVPPQA

SEQ ID NO: 1313596 - protein, 9 aa, Homo Sapiens
VSEAPGGQV

SEQ ID NO: 1313597 - protein, 9 aa, Homo Sapiens
GADHNAYVW

SEQ ID NO: 1313598 - protein, 9 aa, Homo Sapiens
ESDDILIPE

SEQ ID NO: 1313599 - protein, 9 aa, Homo Sapiens
KQVSSSRTV

SEQ ID NO: 1313600 - protein, 9 aa, Homo Sapiens
EDPVRHSSS

SEQ ID NO: 1313601 - protein, 9 aa, Homo Sapiens
GMHEFLTPR

SEQ ID NO: 1313602 - protein, 9 aa, Homo Sapiens
PYHENVEQS

SEQ ID NO: 1313603 - protein, 9 aa, Homo Sapiens
NQVRKDLCS

SEQ ID NO: 1313604 - protein, 9 aa, Homo Sapiens
KYAHEYDSG

SEQ ID NO: 1313605 - protein, 9 aa, Homo Sapiens
FASSIQDEL

SEQ ID NO: 1313606 - protein, 9 aa, Homo Sapiens
EIISQVYSG

SEQ ID NO: 1313607 - protein, 9 aa, Homo Sapiens
ITTILREIL

SEQ ID NO: 1313608 - protein, 9 aa, Homo Sapiens
VATANALDP

SEQ ID NO: 1313609 - protein, 9 aa, Homo Sapiens
RNLLKTDDI

SEQ ID NO: 1313610 - protein, 9 aa, Homo Sapiens
YFCDYTEDE

SEQ ID NO: 1313611 - protein, 9 aa, Homo Sapiens
QDWDRVVAI

SEQ ID NO: 1313612 - protein, 9 aa, Homo Sapiens
AADNHSLIS

SEQ ID NO: 1313613 - protein, 9 aa, Homo Sapiens
MTIYIFLSV

SEQ ID NO: 1313614 - protein, 9 aa, Homo Sapiens
DDLYWTATE

SEQ ID NO: 1313615 - protein, 9 aa, Homo Sapiens
TQQWVVFPN

SEQ ID NO: 1313616 - protein, 9 aa, Homo Sapiens
KLYECKEYG

SEQ ID NO: 1313617 - protein, 9 aa, Homo Sapiens
YHTSGHSVA

SEQ ID NO: 1313618 - protein, 9 aa, Homo Sapiens
IMGRALRYY

SEQ ID NO: 1313619 - protein, 9 aa, Homo Sapiens
SGQGKYSDM

SEQ ID NO: 1313620 - protein, 9 aa, Homo Sapiens
LQRLSYSKV

SEQ ID NO: 1313621 - protein, 9 aa, Homo Sapiens
SLRSLHFLQ

SEQ ID NO: 1313622 - protein, 9 aa, Homo Sapiens
NDMPIVRAS

SEQ ID NO: 1313623 - protein, 9 aa, Homo Sapiens
VPTFTQTSY

SEQ ID NO: 1313624 - protein, 9 aa, Homo Sapiens
DDLHLCTVK

SEQ ID NO: 1313625 - protein, 9 aa, Homo Sapiens
EAEFQKMWR

SEQ ID NO: 1313626 - protein, 9 aa, Homo Sapiens
ESNSSHMCM

SEQ ID NO: 1313627 - protein, 9 aa, Homo Sapiens
VVLESEEMN

SEQ ID NO: 1313628 - protein, 9 aa, Homo Sapiens
IFRRVYYSP

SEQ ID NO: 1313629 - protein, 9 aa, Homo Sapiens
GVKCVPGEA

SEQ ID NO: 1313630 - protein, 9 aa, Homo Sapiens
ACSHKQLYM

SEQ ID NO: 1313631 - protein, 9 aa, Homo Sapiens
IGLCGAIRL

SEQ ID NO: 1313632 - protein, 9 aa, Homo Sapiens
PGGGSLPPQ

SEQ ID NO: 1313633 - protein, 9 aa, Homo Sapiens
LHHTLPPAP

SEQ ID NO: 1313634 - protein, 9 aa, Homo Sapiens
CLLHITRLY

SEQ ID NO: 1313635 - protein, 9 aa, Homo Sapiens
YVSWAITYL

SEQ ID NO: 1313636 - protein, 9 aa, Homo Sapiens
DANGFMEYL

SEQ ID NO: 1313637 - protein, 9 aa, Homo Sapiens
ESQSQSVWT

SEQ ID NO: 1313638 - protein, 9 aa, Homo Sapiens
QIPCIPKEG

SEQ ID NO: 1313639 - protein, 9 aa, Homo Sapiens
GPYCTSKAY

SEQ ID NO: 1313640 - protein, 9 aa, Homo Sapiens
HLTDADFTL

SEQ ID NO: 1313641 - protein, 9 aa, Homo Sapiens
DHTYCVFKT

SEQ ID NO: 1313642 - protein, 9 aa, Homo Sapiens
SSVAYGFLI

SEQ ID NO: 1313643 - protein, 9 aa, Homo Sapiens
KSVGQVARN

SEQ ID NO: 1313644 - protein, 9 aa, Homo Sapiens
MHFRDNTPN

SEQ ID NO: 1313645 - protein, 9 aa, Homo Sapiens
DINIIPGEL

SEQ ID NO: 1313646 - protein, 9 aa, Homo Sapiens
RVLLATGQQ

SEQ ID NO: 1313647 - protein, 9 aa, Homo Sapiens
AEPLGQVKL

SEQ ID NO: 1313648 - protein, 9 aa, Homo Sapiens
YKLQTPHIN

SEQ ID NO: 1313649 - protein, 9 aa, Homo Sapiens
RGHNKTREF

SEQ ID NO: 1313650 - protein, 9 aa, Homo Sapiens
MLTCIICQD

SEQ ID NO: 1313651 - protein, 9 aa, Homo Sapiens
AGTAGRRLT

SEQ ID NO: 1313652 - protein, 9 aa, Homo Sapiens
PVRQDMEKE

SEQ ID NO: 1313653 - protein, 9 aa, Homo Sapiens
HGSTKHMKI

SEQ ID NO: 1313654 - protein, 9 aa, Homo Sapiens
PGAHPMPVY

SEQ ID NO: 1313655 - protein, 9 aa, Homo Sapiens
LIQLPELYR

SEQ ID NO: 1313656 - protein, 9 aa, Homo Sapiens
AVFPEVVVA

SEQ ID NO: 1313657 - protein, 9 aa, Homo Sapiens
CNRSTCPLA

SEQ ID NO: 1313658 - protein, 9 aa, Homo Sapiens
FILHQRGHT

SEQ ID NO: 1313659 - protein, 9 aa, Homo Sapiens
VTMQIWDMA

SEQ ID NO: 1313660 - protein, 9 aa, Homo Sapiens
VFKNDATEI

SEQ ID NO: 1313661 - protein, 9 aa, Homo Sapiens
TSHLRIHTG

SEQ ID NO: 1313662 - protein, 9 aa, Homo Sapiens
AISAFANDP

SEQ ID NO: 1313663 - protein, 9 aa, Homo Sapiens
VRRSGAIIA

SEQ ID NO: 1313664 - protein, 9 aa, Homo Sapiens
KPDMAYCLI

SEQ ID NO: 1313665 - protein, 9 aa, Homo Sapiens
LISLSSVMD

SEQ ID NO: 1313666 - protein, 9 aa, Homo Sapiens
RRDNMFYYY

SEQ ID NO: 1313667 - protein, 9 aa, Homo Sapiens
TVLCDMDTN

SEQ ID NO: 1313668 - protein, 9 aa, Homo Sapiens
NACVSHISC

SEQ ID NO: 1313669 - protein, 9 aa, Homo Sapiens
RAPHPPQPK

SEQ ID NO: 1313670 - protein, 9 aa, Homo Sapiens
EYVNDNHPV

SEQ ID NO: 1313671 - protein, 9 aa, Homo Sapiens
ATLTAGQLT

SEQ ID NO: 1313672 - protein, 9 aa, Homo Sapiens
FWALIAEPR

SEQ ID NO: 1313673 - protein, 9 aa, Homo Sapiens
CGFRQVKDP

SEQ ID NO: 1313674 - protein, 9 aa, Homo Sapiens
FRRGVSTWR

SEQ ID NO: 1313675 - protein, 9 aa, Homo Sapiens
VRMREVDEE

SEQ ID NO: 1313676 - protein, 9 aa, Homo Sapiens
GDIHAITTA

SEQ ID NO: 1313677 - protein, 9 aa, Homo Sapiens
SDGCFLRGY

SEQ ID NO: 1313678 - protein, 9 aa, Homo Sapiens
WVYSLLRIC

SEQ ID NO: 1313679 - protein, 9 aa, Homo Sapiens
GRGIMPSFG

SEQ ID NO: 1313680 - protein, 9 aa, Homo Sapiens
YECKEYGKA

SEQ ID NO: 1313681 - protein, 9 aa, Homo Sapiens
WLLGQMEEE

SEQ ID NO: 1313682 - protein, 9 aa, Homo Sapiens
LGDAVPPGS

SEQ ID NO: 1313683 - protein, 9 aa, Homo Sapiens
WAVLHLGLP

SEQ ID NO: 1313684 - protein, 9 aa, Homo Sapiens
DYCFVREDR

SEQ ID NO: 1313685 - protein, 9 aa, Homo Sapiens
LHSAHNRNN

SEQ ID NO: 1313686 - protein, 9 aa, Homo Sapiens
QQLVEIDKN

SEQ ID NO: 1313687 - protein, 9 aa, Homo Sapiens
VLDRGAGLH

SEQ ID NO: 1313688 - protein, 9 aa, Homo Sapiens
QTRTNAKCK

SEQ ID NO: 1313689 - protein, 9 aa, Homo Sapiens
FLQRASKIG

SEQ ID NO: 1313690 - protein, 9 aa, Homo Sapiens
HHYIACVSH

SEQ ID NO: 1313691 - protein, 9 aa, Homo Sapiens
KNRGAVFQH

SEQ ID NO: 1313692 - protein, 9 aa, Homo Sapiens
KTKGKNKLN

SEQ ID NO: 1313693 - protein, 9 aa, Homo Sapiens
AWVLPFASG

SEQ ID NO: 1313694 - protein, 9 aa, Homo Sapiens
ECLPLEGNT

SEQ ID NO: 1313695 - protein, 9 aa, Homo Sapiens
TQVALTLRP

SEQ ID NO: 1313696 - protein, 9 aa, Homo Sapiens
TIILISDVV

SEQ ID NO: 1313697 - protein, 9 aa, Homo Sapiens
PDLLYLTPM

SEQ ID NO: 1313698 - protein, 9 aa, Homo Sapiens
SFKCEQCGK

SEQ ID NO: 1313699 - protein, 9 aa, Homo Sapiens
HHIQRAISL

SEQ ID NO: 1313700 - protein, 9 aa, Homo Sapiens
AKVLATMCG

SEQ ID NO: 1313701 - protein, 9 aa, Homo Sapiens
CFVEFADLV

SEQ ID NO: 1313702 - protein, 9 aa, Homo Sapiens
GLYRLEHAW

SEQ ID NO: 1313703 - protein, 9 aa, Homo Sapiens
GKYKCVFSV

SEQ ID NO: 1313704 - protein, 9 aa, Homo Sapiens
SEGESPNFP

SEQ ID NO: 1313705 - protein, 9 aa, Homo Sapiens
NDKAKLSFQ

SEQ ID NO: 1313706 - protein, 9 aa, Homo Sapiens
VTLLTLLIA

SEQ ID NO: 1313707 - protein, 9 aa, Homo Sapiens
LCRTFDKIF

SEQ ID NO: 1313708 - protein, 9 aa, Homo Sapiens
AAEHGLSTE

SEQ ID NO: 1313709 - protein, 9 aa, Homo Sapiens
DQTSLATFH

SEQ ID NO: 1313710 - protein, 9 aa, Homo Sapiens
SPQVYNNQE

SEQ ID NO: 1313711 - protein, 9 aa, Homo Sapiens
NAVLTSLLP

SEQ ID NO: 1313712 - protein, 9 aa, Homo Sapiens
CTFFFLHKE

SEQ ID NO: 1313713 - protein, 9 aa, Homo Sapiens
FLSVLWDPT

SEQ ID NO: 1313714 - protein, 9 aa, Homo Sapiens
LHRPRIMRI

SEQ ID NO: 1313715 - protein, 9 aa, Homo Sapiens
CNNESESTL

SEQ ID NO: 1313716 - protein, 9 aa, Homo Sapiens
GANPQMFHT

SEQ ID NO: 1313717 - protein, 9 aa, Homo Sapiens
EEGTYLALE

SEQ ID NO: 1313718 - protein, 9 aa, Homo Sapiens
LVSIKSEDE

SEQ ID NO: 1313719 - protein, 9 aa, Homo Sapiens
SQNRKCLYK

SEQ ID NO: 1313720 - protein, 9 aa, Homo Sapiens
GSQRPPRQV

SEQ ID NO: 1313721 - protein, 9 aa, Homo Sapiens
WRGDVVKVL

SEQ ID NO: 1313722 - protein, 9 aa, Homo Sapiens
SLQLKTHLD

SEQ ID NO: 1313723 - protein, 9 aa, Homo Sapiens
RSLEESPYT

SEQ ID NO: 1313724 - protein, 9 aa, Homo Sapiens
KKDTSSSTI

SEQ ID NO: 1313725 - protein, 9 aa, Homo Sapiens
LENPDTSPA

SEQ ID NO: 1313726 - protein, 9 aa, Homo Sapiens
ALEHYTNLY

SEQ ID NO: 1313727 - protein, 9 aa, Homo Sapiens
GAHWMWQLV

SEQ ID NO: 1313728 - protein, 9 aa, Homo Sapiens
KASAKVLGP

SEQ ID NO: 1313729 - protein, 9 aa, Homo Sapiens
FNLLLAAEH

SEQ ID NO: 1313730 - protein, 9 aa, Homo Sapiens
DARLGMKDT

SEQ ID NO: 1313731 - protein, 9 aa, Homo Sapiens
GACTQDGPF

SEQ ID NO: 1313732 - protein, 9 aa, Homo Sapiens
LCVVYFLSI

SEQ ID NO: 1313733 - protein, 9 aa, Homo Sapiens
PTLSPVTQC

SEQ ID NO: 1313734 - protein, 9 aa, Homo Sapiens
PDVAPVTKD

SEQ ID NO: 1313735 - protein, 9 aa, Homo Sapiens
HRTWSKGVR

SEQ ID NO: 1313736 - protein, 9 aa, Homo Sapiens
GRPTGDAFT

SEQ ID NO: 1313737 - protein, 9 aa, Homo Sapiens
SGCCNNHNV

SEQ ID NO: 1313738 - protein, 9 aa, Homo Sapiens
VRPHIALPQ

SEQ ID NO: 1313739 - protein, 9 aa, Homo Sapiens
CPGVTIWGV

SEQ ID NO: 1313740 - protein, 9 aa, Homo Sapiens
LLSPAPKGK

SEQ ID NO: 1313741 - protein, 9 aa, Homo Sapiens
KDKKCHKKR

SEQ ID NO: 1313742 - protein, 9 aa, Homo Sapiens
AAVRSAVCV

SEQ ID NO: 1313743 - protein, 9 aa, Homo Sapiens
PQYHKVLMP

SEQ ID NO: 1313744 - protein, 9 aa, Homo Sapiens
KYMQMNHTL

SEQ ID NO: 1313745 - protein, 9 aa, Homo Sapiens
SRTNLMDRQ

SEQ ID NO: 1313746 - protein, 9 aa, Homo Sapiens
PKKQTLEGK

SEQ ID NO: 1313747 - protein, 9 aa, Homo Sapiens
NPLVSIVAT

SEQ ID NO: 1313748 - protein, 9 aa, Homo Sapiens
PAKSSVPGV

SEQ ID NO: 1313749 - protein, 9 aa, Homo Sapiens
RHSLSLHDM

SEQ ID NO: 1313750 - protein, 9 aa, Homo Sapiens
FFITSTGAL

SEQ ID NO: 1313751 - protein, 9 aa, Homo Sapiens
IINIHSMSC

SEQ ID NO: 1313752 - protein, 9 aa, Homo Sapiens
IEGTKMLAV

SEQ ID NO: 1313753 - protein, 9 aa, Homo Sapiens
RIKNNDSKL

SEQ ID NO: 1313754 - protein, 9 aa, Homo Sapiens
ELVKKSLIE

SEQ ID NO: 1313755 - protein, 9 aa, Homo Sapiens
KLWAAWVAG

SEQ ID NO: 1313756 - protein, 9 aa, Homo Sapiens
GDIARKGRK

SEQ ID NO: 1313757 - protein, 9 aa, Homo Sapiens
GNSFSFSST

SEQ ID NO: 1313758 - protein, 9 aa, Homo Sapiens
YFNSLMTYW

SEQ ID NO: 1313759 - protein, 9 aa, Homo Sapiens
PPGHSAFTP

SEQ ID NO: 1313760 - protein, 9 aa, Homo Sapiens
YIPVLGPDP

SEQ ID NO: 1313761 - protein, 9 aa, Homo Sapiens
PKTIKQCHV

SEQ ID NO: 1313762 - protein, 9 aa, Homo Sapiens
SVVDRVSHA

SEQ ID NO: 1313763 - protein, 9 aa, Homo Sapiens
WAASFYAHF

SEQ ID NO: 1313764 - protein, 9 aa, Homo Sapiens
KGKSLVNKL

SEQ ID NO: 1313765 - protein, 9 aa, Homo Sapiens
ILSGEKQHI

SEQ ID NO: 1313766 - protein, 9 aa, Homo Sapiens
SSMMMLEKL

SEQ ID NO: 1313767 - protein, 9 aa, Homo Sapiens
LEAKEGEDE

SEQ ID NO: 1313768 - protein, 9 aa, Homo Sapiens
RYEFPPDLT

SEQ ID NO: 1313769 - protein, 9 aa, Homo Sapiens
TSMQPPEIP

SEQ ID NO: 1313770 - protein, 9 aa, Homo Sapiens
RQDPNRMPV

SEQ ID NO: 1313771 - protein, 9 aa, Homo Sapiens
SSSDLSMVF

SEQ ID NO: 1313772 - protein, 9 aa, Homo Sapiens
HLISAQQKN

SEQ ID NO: 1313773 - protein, 9 aa, Homo Sapiens
GAPVTYPSV

SEQ ID NO: 1313774 - protein, 9 aa, Homo Sapiens
NCNECQCIP

SEQ ID NO: 1313775 - protein, 9 aa, Homo Sapiens
PPKGALKKP

SEQ ID NO: 1313776 - protein, 9 aa, Homo Sapiens
LLGIFNHIP

SEQ ID NO: 1313777 - protein, 9 aa, Homo Sapiens
CMKSTLTSR

SEQ ID NO: 1313778 - protein, 9 aa, Homo Sapiens
LSRFFSYFR

SEQ ID NO: 1313779 - protein, 9 aa, Homo Sapiens
VMTINGIPT

SEQ ID NO: 1313780 - protein, 9 aa, Homo Sapiens
NITSMLGST

SEQ ID NO: 1313781 - protein, 9 aa, Homo Sapiens
PDPRWCSFL

SEQ ID NO: 1313782 - protein, 9 aa, Homo Sapiens
EHRCIPRGD

SEQ ID NO: 1313783 - protein, 9 aa, Homo Sapiens
IDDNFLLAE

SEQ ID NO: 1313784 - protein, 9 aa, Homo Sapiens
TLQVSKRNS

SEQ ID NO: 1313785 - protein, 9 aa, Homo Sapiens
DADFTLLAR

SEQ ID NO: 1313786 - protein, 9 aa, Homo Sapiens
VERVTVPRN

SEQ ID NO: 1313787 - protein, 9 aa, Homo Sapiens
HTLFSLNGR

SEQ ID NO: 1313788 - protein, 9 aa, Homo Sapiens
LMVTFSIKM

SEQ ID NO: 1313789 - protein, 9 aa, Homo Sapiens
YIIVDEINV

SEQ ID NO: 1313790 - protein, 9 aa, Homo Sapiens
YCKCKALMD

SEQ ID NO: 1313791 - protein, 9 aa, Homo Sapiens
SPSTLSIKK

SEQ ID NO: 1313792 - protein, 9 aa, Homo Sapiens
SLPHIVYAM

SEQ ID NO: 1313793 - protein, 9 aa, Homo Sapiens
RPVDISLSL

SEQ ID NO: 1313794 - protein, 9 aa, Homo Sapiens
ILAALFAAV

SEQ ID NO: 1313795 - protein, 9 aa, Homo Sapiens
VWLRLRPCN

SEQ ID NO: 1313796 - protein, 9 aa, Homo Sapiens
YICSHYYRA

SEQ ID NO: 1313797 - protein, 9 aa, Homo Sapiens
RESDVIDGM

SEQ ID NO: 1313798 - protein, 9 aa, Homo Sapiens
RRRRSSKSP

SEQ ID NO: 1313799 - protein, 9 aa, Homo Sapiens
SGETVSETL

SEQ ID NO: 1313800 - protein, 9 aa, Homo Sapiens
EIYHGSTKH

SEQ ID NO: 1313801 - protein, 9 aa, Homo Sapiens
FGHSLSSDP

SEQ ID NO: 1313802 - protein, 9 aa, Homo Sapiens
SDGTRVLPN

SEQ ID NO: 1313803 - protein, 9 aa, Homo Sapiens
SLNSLLQGY

SEQ ID NO: 1313804 - protein, 9 aa, Homo Sapiens
MATRNVVCL

SEQ ID NO: 1313805 - protein, 9 aa, Homo Sapiens
QLMIYEEIS

SEQ ID NO: 1313806 - protein, 9 aa, Homo Sapiens
PYRVFADLG

SEQ ID NO: 1313807 - protein, 9 aa, Homo Sapiens
LCPQNSLLR

SEQ ID NO: 1313808 - protein, 9 aa, Homo Sapiens
DRFRSFDTL

SEQ ID NO: 1313809 - protein, 9 aa, Homo Sapiens
CSLYGKKLV

SEQ ID NO: 1313810 - protein, 9 aa, Homo Sapiens
SWLRLRLED

SEQ ID NO: 1313811 - protein, 9 aa, Homo Sapiens
DLRVQYLHQ

SEQ ID NO: 1313812 - protein, 9 aa, Homo Sapiens
KQHILKEDM

SEQ ID NO: 1313813 - protein, 9 aa, Homo Sapiens
SVVKCSTAP

SEQ ID NO: 1313814 - protein, 9 aa, Homo Sapiens
HIQYFDLES

SEQ ID NO: 1313815 - protein, 9 aa, Homo Sapiens
ADPFVNGCC

SEQ ID NO: 1313816 - protein, 9 aa, Homo Sapiens
EAQTELCCL

SEQ ID NO: 1313817 - protein, 9 aa, Homo Sapiens
RSKQEAYAD

SEQ ID NO: 1313818 - protein, 9 aa, Homo Sapiens
LPYEFSCSS

SEQ ID NO: 1313819 - protein, 9 aa, Homo Sapiens
IIHTGKKPH

SEQ ID NO: 1313820 - protein, 9 aa, Homo Sapiens
NINLKNKPG

SEQ ID NO: 1313821 - protein, 9 aa, Homo Sapiens
SHQARETLR

SEQ ID NO: 1313822 - protein, 9 aa, Homo Sapiens
FITPRQSTV

SEQ ID NO: 1313823 - protein, 9 aa, Homo Sapiens
DHKVVGLLS

SEQ ID NO: 1313824 - protein, 9 aa, Homo Sapiens
ANGTLGFFC

SEQ ID NO: 1313825 - protein, 9 aa, Homo Sapiens
AARSPSSAT

SEQ ID NO: 1313826 - protein, 9 aa, Homo Sapiens
LVLLVDVTC

SEQ ID NO: 1313827 - protein, 9 aa, Homo Sapiens
DVVSIMNAD

SEQ ID NO: 1313828 - protein, 9 aa, Homo Sapiens
GKDDIFAGA

SEQ ID NO: 1313829 - protein, 9 aa, Homo Sapiens
MLGDMIWDD

SEQ ID NO: 1313830 - protein, 9 aa, Homo Sapiens
NSPIQKRNR

SEQ ID NO: 1313831 - protein, 9 aa, Homo Sapiens
FTALLHAGL

SEQ ID NO: 1313832 - protein, 9 aa, Homo Sapiens
HLQVRLVLG

SEQ ID NO: 1313833 - protein, 9 aa, Homo Sapiens
PGWALTWTF

SEQ ID NO: 1313834 - protein, 9 aa, Homo Sapiens
ELQIINQKW

SEQ ID NO: 1313835 - protein, 9 aa, Homo Sapiens
SIFVVGPRH

SEQ ID NO: 1313836 - protein, 9 aa, Homo Sapiens
ALSEEVCPQ

SEQ ID NO: 1313837 - protein, 9 aa, Homo Sapiens
MSVAWNLLK

SEQ ID NO: 1313838 - protein, 9 aa, Homo Sapiens
TTQAHSSYL

SEQ ID NO: 1313839 - protein, 9 aa, Homo Sapiens
YEAFKASHN

SEQ ID NO: 1313840 - protein, 9 aa, Homo Sapiens
WNKKSVVRP

SEQ ID NO: 1313841 - protein, 9 aa, Homo Sapiens
DEGTFDRLL

SEQ ID NO: 1313842 - protein, 9 aa, Homo Sapiens
SQSSQDTGH

SEQ ID NO: 1313843 - protein, 9 aa, Homo Sapiens
EEAVQAKVM

SEQ ID NO: 1313844 - protein, 9 aa, Homo Sapiens
GLPIPHVSE

SEQ ID NO: 1313845 - protein, 9 aa, Homo Sapiens
PYLRVPCPA

SEQ ID NO: 1313846 - protein, 9 aa, Homo Sapiens
PEQRELRSR

SEQ ID NO: 1313847 - protein, 9 aa, Homo Sapiens
LNTRHKVDW

SEQ ID NO: 1313848 - protein, 9 aa, Homo Sapiens
VFQILTDED

SEQ ID NO: 1313849 - protein, 9 aa, Homo Sapiens
FKEMRETHL

SEQ ID NO: 1313850 - protein, 9 aa, Homo Sapiens
AETRQESKK

SEQ ID NO: 1313851 - protein, 9 aa, Homo Sapiens
EPFLAVRQV

SEQ ID NO: 1313852 - protein, 9 aa, Homo Sapiens
MGLSHKSSD

SEQ ID NO: 1313853 - protein, 9 aa, Homo Sapiens
EMLISWLQA

SEQ ID NO: 1313854 - protein, 9 aa, Homo Sapiens
ICYGDRPGL

SEQ ID NO: 1313855 - protein, 9 aa, Homo Sapiens
LKWMVIIFT

SEQ ID NO: 1313856 - protein, 9 aa, Homo Sapiens
SDMHTMKHS

SEQ ID NO: 1313857 - protein, 9 aa, Homo Sapiens
EAIYDIYRR

SEQ ID NO: 1313858 - protein, 9 aa, Homo Sapiens
RPRPGTKTG

SEQ ID NO: 1313859 - protein, 9 aa, Homo Sapiens
ALNLKDEFD

SEQ ID NO: 1313860 - protein, 9 aa, Homo Sapiens
AVDLHRLHM

SEQ ID NO: 1313861 - protein, 9 aa, Homo Sapiens
TTMKGLQMT

SEQ ID NO: 1313862 - protein, 9 aa, Homo Sapiens
YNKFIILFV

SEQ ID NO: 1313863 - protein, 9 aa, Homo Sapiens
PDMNYEIMG

SEQ ID NO: 1313864 - protein, 9 aa, Homo Sapiens
EADTPGVIP

SEQ ID NO: 1313865 - protein, 9 aa, Homo Sapiens
SGHFRKILI

SEQ ID NO: 1313866 - protein, 9 aa, Homo Sapiens
GHMRISEIL

SEQ ID NO: 1313867 - protein, 9 aa, Homo Sapiens
RCSACTCGC

SEQ ID NO: 1313868 - protein, 9 aa, Homo Sapiens
GPHLSPLGP

SEQ ID NO: 1313869 - protein, 9 aa, Homo Sapiens
TYVRCTHSV

SEQ ID NO: 1313870 - protein, 9 aa, Homo Sapiens
KIYGCALPL

SEQ ID NO: 1313871 - protein, 9 aa, Homo Sapiens
QHMQEENIT

SEQ ID NO: 1313872 - protein, 9 aa, Homo Sapiens
RLMPKFLNS

SEQ ID NO: 1313873 - protein, 9 aa, Homo Sapiens
NIGGIIGGF

SEQ ID NO: 1313874 - protein, 9 aa, Homo Sapiens
FYWSREDGL

SEQ ID NO: 1313875 - protein, 9 aa, Homo Sapiens
QGWRRRQQE

SEQ ID NO: 1313876 - protein, 9 aa, Homo Sapiens
EQALQDASV

SEQ ID NO: 1313877 - protein, 9 aa, Homo Sapiens
PECPPLASC

SEQ ID NO: 1313878 - protein, 9 aa, Homo Sapiens
NSIFDLQKT

SEQ ID NO: 1313879 - protein, 9 aa, Homo Sapiens
LMSVCGWSQ

SEQ ID NO: 1313880 - protein, 9 aa, Homo Sapiens
PSPPSPSRR

SEQ ID NO: 1313881 - protein, 9 aa, Homo Sapiens
QILLAVYHM

SEQ ID NO: 1313882 - protein, 9 aa, Homo Sapiens
IQLQTPHAE

SEQ ID NO: 1313883 - protein, 9 aa, Homo Sapiens
RLLWIAQRR

SEQ ID NO: 1313884 - protein, 9 aa, Homo Sapiens
GLVVKHDSI

SEQ ID NO: 1313885 - protein, 9 aa, Homo Sapiens
DVLPVMRLT

SEQ ID NO: 1313886 - protein, 9 aa, Homo Sapiens
RASAATRTC

SEQ ID NO: 1313887 - protein, 9 aa, Homo Sapiens
LNLLQHGTE

SEQ ID NO: 1313888 - protein, 9 aa, Homo Sapiens
HTRNNIKPS

SEQ ID NO: 1313889 - protein, 9 aa, Homo Sapiens
RRSLGHQGS

SEQ ID NO: 1313890 - protein, 9 aa, Homo Sapiens
DDGDDLERV

SEQ ID NO: 1313891 - protein, 9 aa, Homo Sapiens
GEELCLCCL

SEQ ID NO: 1313892 - protein, 9 aa, Homo Sapiens
FTTRVHVFQ

SEQ ID NO: 1313893 - protein, 9 aa, Homo Sapiens
SLACTRGSI

SEQ ID NO: 1313894 - protein, 9 aa, Homo Sapiens
KMIKMFFAL

SEQ ID NO: 1313895 - protein, 9 aa, Homo Sapiens
ILFDEDRFR

SEQ ID NO: 1313896 - protein, 9 aa, Homo Sapiens
RLQSSNCVH

SEQ ID NO: 1313897 - protein, 9 aa, Homo Sapiens
YDKEVNSMG

SEQ ID NO: 1313898 - protein, 9 aa, Homo Sapiens
STCSLEHWR

SEQ ID NO: 1313899 - protein, 9 aa, Homo Sapiens
IRKCIRNPS

SEQ ID NO: 1313900 - protein, 9 aa, Homo Sapiens
YINCIACYS

SEQ ID NO: 1313901 - protein, 9 aa, Homo Sapiens
GTHSGHLWN

SEQ ID NO: 1313902 - protein, 9 aa, Homo Sapiens
PQTCPRSNT

SEQ ID NO: 1313903 - protein, 9 aa, Homo Sapiens
VTGFYAEPT

SEQ ID NO: 1313904 - protein, 9 aa, Homo Sapiens
RYLCALYLG

SEQ ID NO: 1313905 - protein, 9 aa, Homo Sapiens
NPAHAFGPA

SEQ ID NO: 1313906 - protein, 9 aa, Homo Sapiens
GTNSEPADS

SEQ ID NO: 1313907 - protein, 9 aa, Homo Sapiens
GHTLTVAIQ

SEQ ID NO: 1313908 - protein, 9 aa, Homo Sapiens
ISVVSVAER

SEQ ID NO: 1313909 - protein, 9 aa, Homo Sapiens
PNKPPLEDY

SEQ ID NO: 1313910 - protein, 9 aa, Homo Sapiens
AFFEEQERH

SEQ ID NO: 1313911 - protein, 9 aa, Homo Sapiens
AGDHQLSAL

SEQ ID NO: 1313912 - protein, 9 aa, Homo Sapiens
IAGGTMQLV

SEQ ID NO: 1313913 - protein, 9 aa, Homo Sapiens
EYIDLMTEW

SEQ ID NO: 1313914 - protein, 9 aa, Homo Sapiens
GPHVPRQLP

SEQ ID NO: 1313915 - protein, 9 aa, Homo Sapiens
VWAFRTQAP

SEQ ID NO: 1313916 - protein, 9 aa, Homo Sapiens
QATPDDRNQ

SEQ ID NO: 1313917 - protein, 9 aa, Homo Sapiens
NNISHILVT

SEQ ID NO: 1313918 - protein, 9 aa, Homo Sapiens
ELKQIQEEC

SEQ ID NO: 1313919 - protein, 9 aa, Homo Sapiens
LQELVNTGC

SEQ ID NO: 1313920 - protein, 9 aa, Homo Sapiens
LKPGNLDTK

SEQ ID NO: 1313921 - protein, 9 aa, Homo Sapiens
CETRCGQIL

SEQ ID NO: 1313922 - protein, 9 aa, Homo Sapiens
DVMLLCQNT

SEQ ID NO: 1313923 - protein, 9 aa, Homo Sapiens
TAKVAEQQE

SEQ ID NO: 1313924 - protein, 9 aa, Homo Sapiens
QYLPYFRTQ

SEQ ID NO: 1313925 - protein, 9 aa, Homo Sapiens
CTGAASTPT

SEQ ID NO: 1313926 - protein, 9 aa, Homo Sapiens
IVPQELVLF

SEQ ID NO: 1313927 - protein, 9 aa, Homo Sapiens
KQNADMALQ

SEQ ID NO: 1313928 - protein, 9 aa, Homo Sapiens
MDGLPAPNN

SEQ ID NO: 1313929 - protein, 9 aa, Homo Sapiens
YNAQLSRHT

SEQ ID NO: 1313930 - protein, 9 aa, Homo Sapiens
PSSATSAAK

SEQ ID NO: 1313931 - protein, 9 aa, Homo Sapiens
LSGQCFTAR

SEQ ID NO: 1313932 - protein, 9 aa, Homo Sapiens
ALVQVYPDD

SEQ ID NO: 1313933 - protein, 9 aa, Homo Sapiens
YGPYGYGSG

SEQ ID NO: 1313934 - protein, 9 aa, Homo Sapiens
HCPSPYSCQ

SEQ ID NO: 1313935 - protein, 9 aa, Homo Sapiens
SVQSWFDDM

SEQ ID NO: 1313936 - protein, 9 aa, Homo Sapiens
LYMTTVLTG

SEQ ID NO: 1313937 - protein, 9 aa, Homo Sapiens
LRTSLTSLR

SEQ ID NO: 1313938 - protein, 9 aa, Homo Sapiens
TQETHECDT

SEQ ID NO: 1313939 - protein, 9 aa, Homo Sapiens
LELTHTTPA

SEQ ID NO: 1313940 - protein, 9 aa, Homo Sapiens
WCELTVRTN

SEQ ID NO: 1313941 - protein, 9 aa, Homo Sapiens
GTEVPWPEV

SEQ ID NO: 1313942 - protein, 9 aa, Homo Sapiens
CSLTLRDDC

SEQ ID NO: 1313943 - protein, 9 aa, Homo Sapiens
FRTHEMPHT

SEQ ID NO: 1313944 - protein, 9 aa, Homo Sapiens
VTFALPDDV

SEQ ID NO: 1313945 - protein, 9 aa, Homo Sapiens
KKKSIRARL

SEQ ID NO: 1313946 - protein, 9 aa, Homo Sapiens
KRHRNVSIL

SEQ ID NO: 1313947 - protein, 9 aa, Homo Sapiens
SRAIGRITG

SEQ ID NO: 1313948 - protein, 9 aa, Homo Sapiens
TKCATILDI

SEQ ID NO: 1313949 - protein, 9 aa, Homo Sapiens
EQGRYSFED

SEQ ID NO: 1313950 - protein, 9 aa, Homo Sapiens
LQIRNMHFL

SEQ ID NO: 1313951 - protein, 9 aa, Homo Sapiens
KIMMDLNHP

SEQ ID NO: 1313952 - protein, 9 aa, Homo Sapiens
AVSTFEIER

SEQ ID NO: 1313953 - protein, 9 aa, Homo Sapiens
SKDDKSPLH

SEQ ID NO: 1313954 - protein, 9 aa, Homo Sapiens
ALIRYAVMQ

SEQ ID NO: 1313955 - protein, 9 aa, Homo Sapiens
ASQVSCFSD

SEQ ID NO: 1313956 - protein, 9 aa, Homo Sapiens
GLSNPEEVK

SEQ ID NO: 1313957 - protein, 9 aa, Homo Sapiens
EITGWDEKT

SEQ ID NO: 1313958 - protein, 9 aa, Homo Sapiens
PSHRKPTSD

SEQ ID NO: 1313959 - protein, 9 aa, Homo Sapiens
LAQAMRWDQ

SEQ ID NO: 1313960 - protein, 9 aa, Homo Sapiens
SSGHHEQDT

SEQ ID NO: 1313961 - protein, 9 aa, Homo Sapiens
SRDDFTEEC

SEQ ID NO: 1313962 - protein, 9 aa, Homo Sapiens
NNKARAGST

SEQ ID NO: 1313963 - protein, 9 aa, Homo Sapiens
HEVIRIEKH

SEQ ID NO: 1313964 - protein, 9 aa, Homo Sapiens
RSYSRSWSR

SEQ ID NO: 1313965 - protein, 9 aa, Homo Sapiens
MWSITTKLY

SEQ ID NO: 1313966 - protein, 9 aa, Homo Sapiens
LVVHTRHYL

SEQ ID NO: 1313967 - protein, 9 aa, Homo Sapiens
LTMLRRQQI

SEQ ID NO: 1313968 - protein, 9 aa, Homo Sapiens
TGRQEDVAT

SEQ ID NO: 1313969 - protein, 9 aa, Homo Sapiens
DMAECEGVM

SEQ ID NO: 1313970 - protein, 9 aa, Homo Sapiens
LRHGWCTGA

SEQ ID NO: 1313971 - protein, 9 aa, Homo Sapiens
PHQRSLWEP

SEQ ID NO: 1313972 - protein, 9 aa, Homo Sapiens
AEKRQLQEE

SEQ ID NO: 1313973 - protein, 9 aa, Homo Sapiens
HLMIPEISN

SEQ ID NO: 1313974 - protein, 9 aa, Homo Sapiens
YISMAVTFG

SEQ ID NO: 1313975 - protein, 9 aa, Homo Sapiens
WMVSIIHRK

SEQ ID NO: 1313976 - protein, 9 aa, Homo Sapiens
AFKASHNLQ

SEQ ID NO: 1313977 - protein, 9 aa, Homo Sapiens
AELDAELLG

SEQ ID NO: 1313978 - protein, 9 aa, Homo Sapiens
DYELGSRFV

SEQ ID NO: 1313979 - protein, 9 aa, Homo Sapiens
VQWGDIVKV

SEQ ID NO: 1313980 - protein, 9 aa, Homo Sapiens
YVPHPKKPE

SEQ ID NO: 1313981 - protein, 9 aa, Homo Sapiens
ETHECDTCG

SEQ ID NO: 1313982 - protein, 9 aa, Homo Sapiens
QLKTHLDEA

SEQ ID NO: 1313983 - protein, 9 aa, Homo Sapiens
MMVVLVGYN

SEQ ID NO: 1313984 - protein, 9 aa, Homo Sapiens
LLAKEHIKE

SEQ ID NO: 1313985 - protein, 9 aa, Homo Sapiens
SLSEDVRHV

SEQ ID NO: 1313986 - protein, 9 aa, Homo Sapiens
TMDIEWLLT

SEQ ID NO: 1313987 - protein, 9 aa, Homo Sapiens
PVTKIIYGD

SEQ ID NO: 1313988 - protein, 9 aa, Homo Sapiens
NSYMILHRR

SEQ ID NO: 1313989 - protein, 9 aa, Homo Sapiens
KCSAMRAVA

SEQ ID NO: 1313990 - protein, 9 aa, Homo Sapiens
GAQVFAFLK

SEQ ID NO: 1313991 - protein, 9 aa, Homo Sapiens
ASAATRTCS

SEQ ID NO: 1313992 - protein, 9 aa, Homo Sapiens
RFQKLEWET

SEQ ID NO: 1313993 - protein, 9 aa, Homo Sapiens
YLSPEMIEG

SEQ ID NO: 1313994 - protein, 9 aa, Homo Sapiens
PLWGVWLRL

SEQ ID NO: 1313995 - protein, 9 aa, Homo Sapiens
GITARDVCQ

SEQ ID NO: 1313996 - protein, 9 aa, Homo Sapiens
DFYFEEVQH

SEQ ID NO: 1313997 - protein, 9 aa, Homo Sapiens
NTHHILSHS

SEQ ID NO: 1313998 - protein, 9 aa, Homo Sapiens
ISLENPDTS

SEQ ID NO: 1313999 - protein, 9 aa, Homo Sapiens
MTQMEFPDT

SEQ ID NO: 1314000 - protein, 9 aa, Homo Sapiens
MPIVRASGR

SEQ ID NO: 1314001 - protein, 9 aa, Homo Sapiens
SPKWSELLK

SEQ ID NO: 1314002 - protein, 9 aa, Homo Sapiens
GLPKMQAIR

SEQ ID NO: 1314003 - protein, 9 aa, Homo Sapiens
ITLVLMEDT

SEQ ID NO: 1314004 - protein, 9 aa, Homo Sapiens
DASSPSPPT

SEQ ID NO: 1314005 - protein, 9 aa, Homo Sapiens
IYLDREKQV

SEQ ID NO: 1314006 - protein, 9 aa, Homo Sapiens
IHVLRIVAK

SEQ ID NO: 1314007 - protein, 9 aa, Homo Sapiens
GTTGTPKCM

SEQ ID NO: 1314008 - protein, 9 aa, Homo Sapiens
AEGAVNKVL

SEQ ID NO: 1314009 - protein, 9 aa, Homo Sapiens
LQNPQPMMP

SEQ ID NO: 1314010 - protein, 9 aa, Homo Sapiens
ELRRCEENT

SEQ ID NO: 1314011 - protein, 9 aa, Homo Sapiens
ERVNMCHIQ

SEQ ID NO: 1314012 - protein, 9 aa, Homo Sapiens
RNWINEAIL

SEQ ID NO: 1314013 - protein, 9 aa, Homo Sapiens
NIPDAPEAP

SEQ ID NO: 1314014 - protein, 9 aa, Homo Sapiens
AWLHALGEL

SEQ ID NO: 1314015 - protein, 9 aa, Homo Sapiens
KEKYDKMCN

SEQ ID NO: 1314016 - protein, 9 aa, Homo Sapiens
EWQEREECR

SEQ ID NO: 1314017 - protein, 9 aa, Homo Sapiens
RGGDISKIT

SEQ ID NO: 1314018 - protein, 9 aa, Homo Sapiens
RELPIVPSH

SEQ ID NO: 1314019 - protein, 9 aa, Homo Sapiens
NEPQTFDCT

SEQ ID NO: 1314020 - protein, 9 aa, Homo Sapiens
IYIFLSVLW

SEQ ID NO: 1314021 - protein, 9 aa, Homo Sapiens
LKKRRNPQL

SEQ ID NO: 1314022 - protein, 9 aa, Homo Sapiens
CVGFLFQKV

SEQ ID NO: 1314023 - protein, 9 aa, Homo Sapiens
HFAWTFHSV

SEQ ID NO: 1314024 - protein, 9 aa, Homo Sapiens
RLKKLWQSP

SEQ ID NO: 1314025 - protein, 9 aa, Homo Sapiens
CPDEGVRGD

SEQ ID NO: 1314026 - protein, 9 aa, Homo Sapiens
TSVAKIMSD

SEQ ID NO: 1314027 - protein, 9 aa, Homo Sapiens
YRTGVKCVP

SEQ ID NO: 1314028 - protein, 9 aa, Homo Sapiens
DESPLGLCR

SEQ ID NO: 1314029 - protein, 9 aa, Homo Sapiens
SLQDITDVL

SEQ ID NO: 1314030 - protein, 9 aa, Homo Sapiens
AKRTKVAAT

SEQ ID NO: 1314031 - protein, 9 aa, Homo Sapiens
EEAVKMEMP

SEQ ID NO: 1314032 - protein, 9 aa, Homo Sapiens
HKVAERLDQ

SEQ ID NO: 1314033 - protein, 9 aa, Homo Sapiens
LLSCTGPSR

SEQ ID NO: 1314034 - protein, 9 aa, Homo Sapiens
AHPENKQHK

SEQ ID NO: 1314035 - protein, 9 aa, Homo Sapiens
LSTAECEQA

SEQ ID NO: 1314036 - protein, 9 aa, Homo Sapiens
LWPEVMETY

SEQ ID NO: 1314037 - protein, 9 aa, Homo Sapiens
GSPTAQTQI

SEQ ID NO: 1314038 - protein, 9 aa, Homo Sapiens
PSPASGSTS

SEQ ID NO: 1314039 - protein, 9 aa, Homo Sapiens
TVITSMNPV

SEQ ID NO: 1314040 - protein, 9 aa, Homo Sapiens
LDRPDVWAV

SEQ ID NO: 1314041 - protein, 9 aa, Homo Sapiens
QDERMWSPQ

SEQ ID NO: 1314042 - protein, 9 aa, Homo Sapiens
LVGPRTSGK

SEQ ID NO: 1314043 - protein, 9 aa, Homo Sapiens
TLKDDRQHM

SEQ ID NO: 1314044 - protein, 9 aa, Homo Sapiens
TQNSPLDWQ

SEQ ID NO: 1314045 - protein, 9 aa, Homo Sapiens
PGNLDTKVE

SEQ ID NO: 1314046 - protein, 9 aa, Homo Sapiens
MGPGESLPH

SEQ ID NO: 1314047 - protein, 9 aa, Homo Sapiens
VGLARTLSI

SEQ ID NO: 1314048 - protein, 9 aa, Homo Sapiens
TSFIHHWRS

SEQ ID NO: 1314049 - protein, 9 aa, Homo Sapiens
PVDRTTISA

SEQ ID NO: 1314050 - protein, 9 aa, Homo Sapiens
LALGVIIII

SEQ ID NO: 1314051 - protein, 9 aa, Homo Sapiens
SAPQGQDST

SEQ ID NO: 1314052 - protein, 9 aa, Homo Sapiens
GNIHSWMNS

SEQ ID NO: 1314053 - protein, 9 aa, Homo Sapiens
MKRWILPDS

SEQ ID NO: 1314054 - protein, 9 aa, Homo Sapiens
SVPRLLLPH

SEQ ID NO: 1314055 - protein, 9 aa, Homo Sapiens
LLFPVVNTQ

SEQ ID NO: 1314056 - protein, 9 aa, Homo Sapiens
SATSAAKPS

SEQ ID NO: 1314057 - protein, 9 aa, Homo Sapiens
AMELTGTCA

SEQ ID NO: 1314058 - protein, 9 aa, Homo Sapiens
SDDLVNVFD

SEQ ID NO: 1314059 - protein, 9 aa, Homo Sapiens
TTFFTENSE

SEQ ID NO: 1314060 - protein, 9 aa, Homo Sapiens
IVSAVEPGT

SEQ ID NO: 1314061 - protein, 9 aa, Homo Sapiens
FTELPDVPY

SEQ ID NO: 1314062 - protein, 9 aa, Homo Sapiens
DLCYLFGEI

SEQ ID NO: 1314063 - protein, 9 aa, Homo Sapiens
NIGDTQAMG

SEQ ID NO: 1314064 - protein, 9 aa, Homo Sapiens
FEYNKDGIT

SEQ ID NO: 1314065 - protein, 9 aa, Homo Sapiens
YKYLHWQVV

SEQ ID NO: 1314066 - protein, 9 aa, Homo Sapiens
RFMVSILKG

SEQ ID NO: 1314067 - protein, 9 aa, Homo Sapiens
SITRSYYHN

SEQ ID NO: 1314068 - protein, 9 aa, Homo Sapiens
GPMMLEVLD

SEQ ID NO: 1314069 - protein, 9 aa, Homo Sapiens
SYLITCCPF

SEQ ID NO: 1314070 - protein, 9 aa, Homo Sapiens
TRGSIVATY

SEQ ID NO: 1314071 - protein, 9 aa, Homo Sapiens
TIESEGCGS

SEQ ID NO: 1314072 - protein, 9 aa, Homo Sapiens
IYMMDIFSE

SEQ ID NO: 1314073 - protein, 9 aa, Homo Sapiens
EDKHISLAG

SEQ ID NO: 1314074 - protein, 9 aa, Homo Sapiens
GRISHLNGL

SEQ ID NO: 1314075 - protein, 9 aa, Homo Sapiens
HWHYFDQIS

SEQ ID NO: 1314076 - protein, 9 aa, Homo Sapiens
WPEGTCEEA

SEQ ID NO: 1314077 - protein, 9 aa, Homo Sapiens
KRAYLAHFL

SEQ ID NO: 1314078 - protein, 9 aa, Homo Sapiens
ECDMRFTRQ

SEQ ID NO: 1314079 - protein, 9 aa, Homo Sapiens
DDIEEAVIV

SEQ ID NO: 1314080 - protein, 9 aa, Homo Sapiens
IPFMLVDMK

SEQ ID NO: 1314081 - protein, 9 aa, Homo Sapiens
SYPDLLYLT

SEQ ID NO: 1314082 - protein, 9 aa, Homo Sapiens
TLNLGEGTI

SEQ ID NO: 1314083 - protein, 9 aa, Homo Sapiens
LPSRRLTLL

SEQ ID NO: 1314084 - protein, 9 aa, Homo Sapiens
ERKNCCALI

SEQ ID NO: 1314085 - protein, 9 aa, Homo Sapiens
VEKSPHLAA

SEQ ID NO: 1314086 - protein, 9 aa, Homo Sapiens
IKKLKELHS

SEQ ID NO: 1314087 - protein, 9 aa, Homo Sapiens
SLQEQTECG

SEQ ID NO: 1314088 - protein, 9 aa, Homo Sapiens
LGEVRIHIR

SEQ ID NO: 1314089 - protein, 9 aa, Homo Sapiens
CVSACCAPR

SEQ ID NO: 1314090 - protein, 9 aa, Homo Sapiens
LLSCNTEAY

SEQ ID NO: 1314091 - protein, 9 aa, Homo Sapiens
AVPTEEAYI

SEQ ID NO: 1314092 - protein, 9 aa, Homo Sapiens
ECMTQVFTL

SEQ ID NO: 1314093 - protein, 9 aa, Homo Sapiens
MEMPIISNA

SEQ ID NO: 1314094 - protein, 9 aa, Homo Sapiens
SWGPTAGAA

SEQ ID NO: 1314095 - protein, 9 aa, Homo Sapiens
NLHQLGSKY

SEQ ID NO: 1314096 - protein, 9 aa, Homo Sapiens
DFTALLHAG

SEQ ID NO: 1314097 - protein, 9 aa, Homo Sapiens
NTSGLTAAD

SEQ ID NO: 1314098 - protein, 9 aa, Homo Sapiens
EGKDTLWET

SEQ ID NO: 1314099 - protein, 9 aa, Homo Sapiens
ITVQAQPEW

SEQ ID NO: 1314100 - protein, 9 aa, Homo Sapiens
ITFFIFVLQ

SEQ ID NO: 1314101 - protein, 9 aa, Homo Sapiens
SPKRSLLGA

SEQ ID NO: 1314102 - protein, 9 aa, Homo Sapiens
PARDCTPAN

SEQ ID NO: 1314103 - protein, 9 aa, Homo Sapiens
NQLWYIHAL

SEQ ID NO: 1314104 - protein, 9 aa, Homo Sapiens
VPAFNVTNG

SEQ ID NO: 1314105 - protein, 9 aa, Homo Sapiens
SSDLSMVFP

SEQ ID NO: 1314106 - protein, 9 aa, Homo Sapiens
GGKQEDVYI

SEQ ID NO: 1314107 - protein, 9 aa, Homo Sapiens
CLPRGSSGV

SEQ ID NO: 1314108 - protein, 9 aa, Homo Sapiens
YSDGSNDSC

SEQ ID NO: 1314109 - protein, 9 aa, Homo Sapiens
FYRNSPSRE

SEQ ID NO: 1314110 - protein, 9 aa, Homo Sapiens
DYRDCEGRD

SEQ ID NO: 1314111 - protein, 9 aa, Homo Sapiens
ADQIDKLTL

SEQ ID NO: 1314112 - protein, 9 aa, Homo Sapiens
QVLSQEGKS

SEQ ID NO: 1314113 - protein, 9 aa, Homo Sapiens
KISGTVNIH

SEQ ID NO: 1314114 - protein, 9 aa, Homo Sapiens
SSVMDKENH

SEQ ID NO: 1314115 - protein, 9 aa, Homo Sapiens
TQVSSNLLA

SEQ ID NO: 1314116 - protein, 9 aa, Homo Sapiens
FTVDKAFLT

SEQ ID NO: 1314117 - protein, 9 aa, Homo Sapiens
TSTVLTTTV

SEQ ID NO: 1314118 - protein, 9 aa, Homo Sapiens
PERVLYIQA

SEQ ID NO: 1314119 - protein, 9 aa, Homo Sapiens
VIGKQPKLM

SEQ ID NO: 1314120 - protein, 9 aa, Homo Sapiens
LEGSVMSNS

SEQ ID NO: 1314121 - protein, 9 aa, Homo Sapiens
TNGVSAGNG

SEQ ID NO: 1314122 - protein, 9 aa, Homo Sapiens
DKSVGQVAR

SEQ ID NO: 1314123 - protein, 9 aa, Homo Sapiens
SVCAKPSAP

SEQ ID NO: 1314124 - protein, 9 aa, Homo Sapiens
QKFPVKVRL

SEQ ID NO: 1314125 - protein, 9 aa, Homo Sapiens
KNKLKEMCS

SEQ ID NO: 1314126 - protein, 9 aa, Homo Sapiens
NPELCQKKL

SEQ ID NO: 1314127 - protein, 9 aa, Homo Sapiens
QLSDLTDHL

SEQ ID NO: 1314128 - protein, 9 aa, Homo Sapiens
RLCQKLTLH

SEQ ID NO: 1314129 - protein, 9 aa, Homo Sapiens
IVGSYSCRC

SEQ ID NO: 1314130 - protein, 9 aa, Homo Sapiens
GFTGVYFEK

SEQ ID NO: 1314131 - protein, 9 aa, Homo Sapiens
DSWNRKLLE

SEQ ID NO: 1314132 - protein, 9 aa, Homo Sapiens
VHRRMNNLM

SEQ ID NO: 1314133 - protein, 9 aa, Homo Sapiens
YKGSFCRNY

SEQ ID NO: 1314134 - protein, 9 aa, Homo Sapiens
GQINDGVSK

SEQ ID NO: 1314135 - protein, 9 aa, Homo Sapiens
DGISQLEHD

SEQ ID NO: 1314136 - protein, 9 aa, Homo Sapiens
LASNGHIPS

SEQ ID NO: 1314137 - protein, 9 aa, Homo Sapiens
HRPESHAPH

SEQ ID NO: 1314138 - protein, 9 aa, Homo Sapiens
RIVTCGADH

SEQ ID NO: 1314139 - protein, 9 aa, Homo Sapiens
RNVYHIISI

SEQ ID NO: 1314140 - protein, 9 aa, Homo Sapiens
TIFHDTILF

SEQ ID NO: 1314141 - protein, 9 aa, Homo Sapiens
YTLLIDYQL

SEQ ID NO: 1314142 - protein, 9 aa, Homo Sapiens
LLHRIVAPG

SEQ ID NO: 1314143 - protein, 9 aa, Homo Sapiens
LGRLPLGIV

SEQ ID NO: 1314144 - protein, 9 aa, Homo Sapiens
FGGPNYHIA

SEQ ID NO: 1314145 - protein, 9 aa, Homo Sapiens
RRREDPTYT

SEQ ID NO: 1314146 - protein, 9 aa, Homo Sapiens
LSVVPGKRA

SEQ ID NO: 1314147 - protein, 9 aa, Homo Sapiens
LALSVEIDD

SEQ ID NO: 1314148 - protein, 9 aa, Homo Sapiens
VCDTETVIK

SEQ ID NO: 1314149 - protein, 9 aa, Homo Sapiens
TRQLLLQQQ

SEQ ID NO: 1314150 - protein, 9 aa, Homo Sapiens
MGAQLWGPM

SEQ ID NO: 1314151 - protein, 9 aa, Homo Sapiens
KATGKMYAC

SEQ ID NO: 1314152 - protein, 9 aa, Homo Sapiens
IMDGPDPGT

SEQ ID NO: 1314153 - protein, 9 aa, Homo Sapiens
HRNSDVRHT

SEQ ID NO: 1314154 - protein, 9 aa, Homo Sapiens
CREVRSRVS

SEQ ID NO: 1314155 - protein, 9 aa, Homo Sapiens
SSANNIVWL

SEQ ID NO: 1314156 - protein, 9 aa, Homo Sapiens
YPHLYEDTL

SEQ ID NO: 1314157 - protein, 9 aa, Homo Sapiens
FRDSLKHFS

SEQ ID NO: 1314158 - protein, 9 aa, Homo Sapiens
ADDVDLTSI

SEQ ID NO: 1314159 - protein, 9 aa, Homo Sapiens
ICTVYIEVI

SEQ ID NO: 1314160 - protein, 9 aa, Homo Sapiens
VSKRKFQYE

SEQ ID NO: 1314161 - protein, 9 aa, Homo Sapiens
DYSMSSAHK

SEQ ID NO: 1314162 - protein, 9 aa, Homo Sapiens
DLILLKYAH

SEQ ID NO: 1314163 - protein, 9 aa, Homo Sapiens
AILPNIPIC

SEQ ID NO: 1314164 - protein, 9 aa, Homo Sapiens
WMQSPCWQA

SEQ ID NO: 1314165 - protein, 9 aa, Homo Sapiens
LMVPARDST

SEQ ID NO: 1314166 - protein, 9 aa, Homo Sapiens
KVQNGAEQY

SEQ ID NO: 1314167 - protein, 9 aa, Homo Sapiens
GGVTEHMPT

SEQ ID NO: 1314168 - protein, 9 aa, Homo Sapiens
NTQLLPFEL

SEQ ID NO: 1314169 - protein, 9 aa, Homo Sapiens
AEPIMFPSG

SEQ ID NO: 1314170 - protein, 9 aa, Homo Sapiens
RLLLQHHVS

SEQ ID NO: 1314171 - protein, 9 aa, Homo Sapiens
CVGVSGALP

SEQ ID NO: 1314172 - protein, 9 aa, Homo Sapiens
FDDLGYGYD

SEQ ID NO: 1314173 - protein, 9 aa, Homo Sapiens
RFISSRQTG

SEQ ID NO: 1314174 - protein, 9 aa, Homo Sapiens
LREEMECIV

SEQ ID NO: 1314175 - protein, 9 aa, Homo Sapiens
ATDINLSGA

SEQ ID NO: 1314176 - protein, 9 aa, Homo Sapiens
GQKVRVVFA

SEQ ID NO: 1314177 - protein, 9 aa, Homo Sapiens
ASIPSIKYY

SEQ ID NO: 1314178 - protein, 9 aa, Homo Sapiens
SSKTGISLN

SEQ ID NO: 1314179 - protein, 9 aa, Homo Sapiens
TNDGISIIL

SEQ ID NO: 1314180 - protein, 9 aa, Homo Sapiens
CGEVINATG

SEQ ID NO: 1314181 - protein, 9 aa, Homo Sapiens
PQGWMGFPQ

SEQ ID NO: 1314182 - protein, 9 aa, Homo Sapiens
WKTYTECRN

SEQ ID NO: 1314183 - protein, 9 aa, Homo Sapiens
QEIQEIHDE

SEQ ID NO: 1314184 - protein, 9 aa, Homo Sapiens
NPEFWALIA

SEQ ID NO: 1314185 - protein, 9 aa, Homo Sapiens
LWEVYGERC

SEQ ID NO: 1314186 - protein, 9 aa, Homo Sapiens
THHPHGKTH

SEQ ID NO: 1314187 - protein, 9 aa, Homo Sapiens
MGGVTGWCV

SEQ ID NO: 1314188 - protein, 9 aa, Homo Sapiens
DITKMPAIS

SEQ ID NO: 1314189 - protein, 9 aa, Homo Sapiens
EGPHKGLAH

SEQ ID NO: 1314190 - protein, 9 aa, Homo Sapiens
REQPSSTML

SEQ ID NO: 1314191 - protein, 9 aa, Homo Sapiens
GATGHISSL

SEQ ID NO: 1314192 - protein, 9 aa, Homo Sapiens
RARSPSSAP

SEQ ID NO: 1314193 - protein, 9 aa, Homo Sapiens
NVMGDFLKR

SEQ ID NO: 1314194 - protein, 9 aa, Homo Sapiens
EAPGGQVTE

SEQ ID NO: 1314195 - protein, 9 aa, Homo Sapiens
IDHGVRLNL

SEQ ID NO: 1314196 - protein, 9 aa, Homo Sapiens
STDTTSEIG

SEQ ID NO: 1314197 - protein, 9 aa, Homo Sapiens
PVRVRMHNH

SEQ ID NO: 1314198 - protein, 9 aa, Homo Sapiens
EKNETKKKK

SEQ ID NO: 1314199 - protein, 9 aa, Homo Sapiens
SFISIDHYY

SEQ ID NO: 1314200 - protein, 9 aa, Homo Sapiens
YMQKLFQRF

SEQ ID NO: 1314201 - protein, 9 aa, Homo Sapiens
TMGTTECVL

SEQ ID NO: 1314202 - protein, 9 aa, Homo Sapiens
RTRRRWSSK

SEQ ID NO: 1314203 - protein, 9 aa, Homo Sapiens
SSAVKVELR

SEQ ID NO: 1314204 - protein, 9 aa, Homo Sapiens
VDNFHPLQP

SEQ ID NO: 1314205 - protein, 9 aa, Homo Sapiens
YDAAKAEHN

SEQ ID NO: 1314206 - protein, 9 aa, Homo Sapiens
WVGIPAARL

SEQ ID NO: 1314207 - protein, 9 aa, Homo Sapiens
RCCLEKLCL

SEQ ID NO: 1314208 - protein, 9 aa, Homo Sapiens
HFLQILRML

SEQ ID NO: 1314209 - protein, 9 aa, Homo Sapiens
HFLQILRMI

SEQ ID NO: 1314210 - protein, 9 aa, Homo Sapiens
FPPEELNGS

SEQ ID NO: 1314211 - protein, 9 aa, Homo Sapiens
ITARAEEFA

SEQ ID NO: 1314212 - protein, 9 aa, Homo Sapiens
EQKVLVNVL

SEQ ID NO: 1314213 - protein, 9 aa, Homo Sapiens
QKVRVVFAE

SEQ ID NO: 1314214 - protein, 9 aa, Homo Sapiens
VLIVTFLTL

SEQ ID NO: 1314215 - protein, 9 aa, Homo Sapiens
TPPWTGSLP

SEQ ID NO: 1314216 - protein, 9 aa, Homo Sapiens
MRCLGLAGE

SEQ ID NO: 1314217 - protein, 9 aa, Homo Sapiens
IRKKKDVCI

SEQ ID NO: 1314218 - protein, 9 aa, Homo Sapiens
LHENRNKKT

SEQ ID NO: 1314219 - protein, 9 aa, Homo Sapiens
SLSPNLGAQ

SEQ ID NO: 1314220 - protein, 9 aa, Homo Sapiens
QYQDYSMSS

SEQ ID NO: 1314221 - protein, 9 aa, Homo Sapiens
ILLTMCHNL

SEQ ID NO: 1314222 - protein, 9 aa, Homo Sapiens
WPLVDDRTG

SEQ ID NO: 1314223 - protein, 9 aa, Homo Sapiens
CKHQVVVIS

SEQ ID NO: 1314224 - protein, 9 aa, Homo Sapiens
TVLVGSQKE

SEQ ID NO: 1314225 - protein, 9 aa, Homo Sapiens
GLFRIPGQA

SEQ ID NO: 1314226 - protein, 9 aa, Homo Sapiens
KDDIFAGAW

SEQ ID NO: 1314227 - protein, 9 aa, Homo Sapiens
SNVVERVTV

SEQ ID NO: 1314228 - protein, 9 aa, Homo Sapiens
SNSYCSLHP

SEQ ID NO: 1314229 - protein, 9 aa, Homo Sapiens
ASPTSQSYS

SEQ ID NO: 1314230 - protein, 9 aa, Homo Sapiens
AEEEWRLHS

SEQ ID NO: 1314231 - protein, 9 aa, Homo Sapiens
QIEQLSVKK

SEQ ID NO: 1314232 - protein, 9 aa, Homo Sapiens
VKPGHVLRV

SEQ ID NO: 1314233 - protein, 9 aa, Homo Sapiens
QHLRFEVHD

SEQ ID NO: 1314234 - protein, 9 aa, Homo Sapiens
HFSFFSSLC

SEQ ID NO: 1314235 - protein, 9 aa, Homo Sapiens
SKGNGFSKT

SEQ ID NO: 1314236 - protein, 9 aa, Homo Sapiens
MFSSGTTGT

SEQ ID NO: 1314237 - protein, 9 aa, Homo Sapiens
TYDLQESSV

SEQ ID NO: 1314238 - protein, 9 aa, Homo Sapiens
GASKTKGKN

SEQ ID NO: 1314239 - protein, 9 aa, Homo Sapiens
WTVFRATPL

SEQ ID NO: 1314240 - protein, 9 aa, Homo Sapiens
KHKLRKMEL

SEQ ID NO: 1314241 - protein, 9 aa, Homo Sapiens
VTKEEPLIS

SEQ ID NO: 1314242 - protein, 9 aa, Homo Sapiens
GKSHTEDGI

SEQ ID NO: 1314243 - protein, 9 aa, Homo Sapiens
GFIFKGRLV

SEQ ID NO: 1314244 - protein, 9 aa, Homo Sapiens
MHSWSKLCH

SEQ ID NO: 1314245 - protein, 9 aa, Homo Sapiens
LFMLVLGVQ

SEQ ID NO: 1314246 - protein, 9 aa, Homo Sapiens
TMVHPLLPG

SEQ ID NO: 1314247 - protein, 9 aa, Homo Sapiens
DLNGDGTVY

SEQ ID NO: 1314248 - protein, 9 aa, Homo Sapiens
NVKSVPPQS

SEQ ID NO: 1314249 - protein, 9 aa, Homo Sapiens
ETPQNSPLS

SEQ ID NO: 1314250 - protein, 9 aa, Homo Sapiens
EVVQYVLPR

SEQ ID NO: 1314251 - protein, 9 aa, Homo Sapiens
VNTCLHKGS

SEQ ID NO: 1314252 - protein, 9 aa, Homo Sapiens
DAFDIYTNL

SEQ ID NO: 1314253 - protein, 9 aa, Homo Sapiens
DDQLCANEL

SEQ ID NO: 1314254 - protein, 9 aa, Homo Sapiens
DRTRNMFKL

SEQ ID NO: 1314255 - protein, 9 aa, Homo Sapiens
STQARSPST

SEQ ID NO: 1314256 - protein, 9 aa, Homo Sapiens
QQQQQSEEL

SEQ ID NO: 1314257 - protein, 9 aa, Homo Sapiens
LASCGHSER

SEQ ID NO: 1314258 - protein, 9 aa, Homo Sapiens
PAEHSARYQ

SEQ ID NO: 1314259 - protein, 9 aa, Homo Sapiens
VPETPKEMP

SEQ ID NO: 1314260 - protein, 9 aa, Homo Sapiens
HASKQIATD

SEQ ID NO: 1314261 - protein, 9 aa, Homo Sapiens
RSRLCTMKK

SEQ ID NO: 1314262 - protein, 9 aa, Homo Sapiens
TKPDTQQVQ

SEQ ID NO: 1314263 - protein, 9 aa, Homo Sapiens
YQSISHPHS

SEQ ID NO: 1314264 - protein, 9 aa, Homo Sapiens
PGGTCIDDG

SEQ ID NO: 1314265 - protein, 9 aa, Homo Sapiens
ASLGEYLKG

SEQ ID NO: 1314266 - protein, 9 aa, Homo Sapiens
LVAFMIQEE

SEQ ID NO: 1314267 - protein, 9 aa, Homo Sapiens
HLNGLSIPV

SEQ ID NO: 1314268 - protein, 9 aa, Homo Sapiens
WWFDVCLSA

SEQ ID NO: 1314269 - protein, 9 aa, Homo Sapiens
VTVSTWLHP

SEQ ID NO: 1314270 - protein, 9 aa, Homo Sapiens
SQERKPMGV

SEQ ID NO: 1314271 - protein, 9 aa, Homo Sapiens
DWRHFKQLE

SEQ ID NO: 1314272 - protein, 9 aa, Homo Sapiens
YGAHMDSPV

SEQ ID NO: 1314273 - protein, 9 aa, Homo Sapiens
EDRMSLSHL

SEQ ID NO: 1314274 - protein, 9 aa, Homo Sapiens
QMALLTDQR

SEQ ID NO: 1314275 - protein, 9 aa, Homo Sapiens
AEAHINTCY

SEQ ID NO: 1314276 - protein, 9 aa, Homo Sapiens
PNRAHNNTH

SEQ ID NO: 1314277 - protein, 9 aa, Homo Sapiens
ELKQLLHRK

SEQ ID NO: 1314278 - protein, 9 aa, Homo Sapiens
NGICVLAFK

SEQ ID NO: 1314279 - protein, 9 aa, Homo Sapiens
YRSKCLMKR

SEQ ID NO: 1314280 - protein, 9 aa, Homo Sapiens
DREENVRHI

SEQ ID NO: 1314281 - protein, 9 aa, Homo Sapiens
YHHIMTVRR

SEQ ID NO: 1314282 - protein, 9 aa, Homo Sapiens
SAHTLTAVC

SEQ ID NO: 1314283 - protein, 9 aa, Homo Sapiens
LSSLHVRKQ

SEQ ID NO: 1314284 - protein, 9 aa, Homo Sapiens
IKEFRKNWC

SEQ ID NO: 1314285 - protein, 9 aa, Homo Sapiens
VSTWLHPRG

SEQ ID NO: 1314286 - protein, 9 aa, Homo Sapiens
KLSPSFTPT

SEQ ID NO: 1314287 - protein, 9 aa, Homo Sapiens
VQQGNIFIA

SEQ ID NO: 1314288 - protein, 9 aa, Homo Sapiens
GEVDNMDGL

SEQ ID NO: 1314289 - protein, 9 aa, Homo Sapiens
GLGTWRTEV

SEQ ID NO: 1314290 - protein, 9 aa, Homo Sapiens
LDEMTKLLQ

SEQ ID NO: 1314291 - protein, 9 aa, Homo Sapiens
GKTIEIGNS

SEQ ID NO: 1314292 - protein, 9 aa, Homo Sapiens
QFKVTMNYL

SEQ ID NO: 1314293 - protein, 9 aa, Homo Sapiens
QKYWLNFYI

SEQ ID NO: 1314294 - protein, 9 aa, Homo Sapiens
AMAEEEWRL

SEQ ID NO: 1314295 - protein, 9 aa, Homo Sapiens
WVCCFFFMV

SEQ ID NO: 1314296 - protein, 9 aa, Homo Sapiens
EDPEDLQDF

SEQ ID NO: 1314297 - protein, 9 aa, Homo Sapiens
LNANQNLTQ

SEQ ID NO: 1314298 - protein, 9 aa, Homo Sapiens
IQKQIHKTH

SEQ ID NO: 1314299 - protein, 9 aa, Homo Sapiens
SEERCAVHE

SEQ ID NO: 1314300 - protein, 9 aa, Homo Sapiens
KPIQIINNT

SEQ ID NO: 1314301 - protein, 9 aa, Homo Sapiens
DPTALAAAM

SEQ ID NO: 1314302 - protein, 9 aa, Homo Sapiens
TSTVVSLLN

SEQ ID NO: 1314303 - protein, 9 aa, Homo Sapiens
PMQTRVVRR

SEQ ID NO: 1314304 - protein, 9 aa, Homo Sapiens
LCCLEEFSA

SEQ ID NO: 1314305 - protein, 9 aa, Homo Sapiens
VVGQPHFVC

SEQ ID NO: 1314306 - protein, 9 aa, Homo Sapiens
LKDINTSIK

SEQ ID NO: 1314307 - protein, 9 aa, Homo Sapiens
PRPEELIEH

SEQ ID NO: 1314308 - protein, 9 aa, Homo Sapiens
NYGFGIMCI

SEQ ID NO: 1314309 - protein, 9 aa, Homo Sapiens
PRPKMTPAN

SEQ ID NO: 1314310 - protein, 9 aa, Homo Sapiens
RPCRMRLYQ

SEQ ID NO: 1314311 - protein, 9 aa, Homo Sapiens
LSHWDAEYF

SEQ ID NO: 1314312 - protein, 9 aa, Homo Sapiens
PENAVSVQS

SEQ ID NO: 1314313 - protein, 9 aa, Homo Sapiens
HLTQIMLLK

SEQ ID NO: 1314314 - protein, 9 aa, Homo Sapiens
PGTGGAHIP

SEQ ID NO: 1314315 - protein, 9 aa, Homo Sapiens
LSHLHRLNS

SEQ ID NO: 1314316 - protein, 9 aa, Homo Sapiens
YIQFISGEE

SEQ ID NO: 1314317 - protein, 9 aa, Homo Sapiens
CAIITNGIT

SEQ ID NO: 1314318 - protein, 9 aa, Homo Sapiens
AAFAIITTL

SEQ ID NO: 1314319 - protein, 9 aa, Homo Sapiens
STYEQLLSR

SEQ ID NO: 1314320 - protein, 9 aa, Homo Sapiens
FVYALKAPK

SEQ ID NO: 1314321 - protein, 9 aa, Homo Sapiens
DAALSNVTP

SEQ ID NO: 1314322 - protein, 9 aa, Homo Sapiens
KSATYRQHV

SEQ ID NO: 1314323 - protein, 9 aa, Homo Sapiens
RQLHEAAHQ

SEQ ID NO: 1314324 - protein, 9 aa, Homo Sapiens
LMSLAKQQP

SEQ ID NO: 1314325 - protein, 9 aa, Homo Sapiens
PIHIGTGCL

SEQ ID NO: 1314326 - protein, 9 aa, Homo Sapiens
EVWTGLTEH

SEQ ID NO: 1314327 - protein, 9 aa, Homo Sapiens
AYPMPTKDL

SEQ ID NO: 1314328 - protein, 9 aa, Homo Sapiens
PHFVCCIKP

SEQ ID NO: 1314329 - protein, 9 aa, Homo Sapiens
SSRDFRDLQ

SEQ ID NO: 1314330 - protein, 9 aa, Homo Sapiens
CKTFVQRNM

SEQ ID NO: 1314331 - protein, 9 aa, Homo Sapiens
WLNFYIQSL

SEQ ID NO: 1314332 - protein, 9 aa, Homo Sapiens
ELHDPNSNR

SEQ ID NO: 1314333 - protein, 9 aa, Homo Sapiens
AVNQLAMGN

SEQ ID NO: 1314334 - protein, 9 aa, Homo Sapiens
CGRGPQPRQ

SEQ ID NO: 1314335 - protein, 9 aa, Homo Sapiens
MNMFYAYVE

SEQ ID NO: 1314336 - protein, 9 aa, Homo Sapiens
NCRYAKKCQ

SEQ ID NO: 1314337 - protein, 9 aa, Homo Sapiens
ESYDYTTDD

SEQ ID NO: 1314338 - protein, 9 aa, Homo Sapiens
VPSPVPLTT

SEQ ID NO: 1314339 - protein, 9 aa, Homo Sapiens
QEMEEYPIS

SEQ ID NO: 1314340 - protein, 9 aa, Homo Sapiens
HYIEDERLS

SEQ ID NO: 1314341 - protein, 9 aa, Homo Sapiens
NLMDEDIAH

SEQ ID NO: 1314342 - protein, 9 aa, Homo Sapiens
EDTLIDEVE

SEQ ID NO: 1314343 - protein, 9 aa, Homo Sapiens
SDSAEKCRL

SEQ ID NO: 1314344 - protein, 9 aa, Homo Sapiens
HSALFSRYS

SEQ ID NO: 1314345 - protein, 9 aa, Homo Sapiens
KNHYHQSTA

SEQ ID NO: 1314346 - protein, 9 aa, Homo Sapiens
LRKSGVDNI

SEQ ID NO: 1314347 - protein, 9 aa, Homo Sapiens
QMIQADTFH

SEQ ID NO: 1314348 - protein, 9 aa, Homo Sapiens
TVTRGETVV

SEQ ID NO: 1314349 - protein, 9 aa, Homo Sapiens
ADTQVALTL

SEQ ID NO: 1314350 - protein, 9 aa, Homo Sapiens
TTGTDVKDT

SEQ ID NO: 1314351 - protein, 9 aa, Homo Sapiens
GMTAVKKKS

SEQ ID NO: 1314352 - protein, 9 aa, Homo Sapiens
SVSLLMNLP

SEQ ID NO: 1314353 - protein, 9 aa, Homo Sapiens
NHVLDELVR

SEQ ID NO: 1314354 - protein, 9 aa, Homo Sapiens
PLAVPGLWV

SEQ ID NO: 1314355 - protein, 9 aa, Homo Sapiens
GEVRYALMD

SEQ ID NO: 1314356 - protein, 9 aa, Homo Sapiens
DTPLHIVIR

SEQ ID NO: 1314357 - protein, 9 aa, Homo Sapiens
LTFKVASRE

SEQ ID NO: 1314358 - protein, 9 aa, Homo Sapiens
SKILTLRIL

SEQ ID NO: 1314359 - protein, 9 aa, Homo Sapiens
VSLHSVPGR

SEQ ID NO: 1314360 - protein, 9 aa, Homo Sapiens
PEATIQIAI

SEQ ID NO: 1314361 - protein, 9 aa, Homo Sapiens
DGKSNNLVL

SEQ ID NO: 1314362 - protein, 9 aa, Homo Sapiens
SEESPRRDF

SEQ ID NO: 1314363 - protein, 9 aa, Homo Sapiens
GLPEDAIIY

SEQ ID NO: 1314364 - protein, 9 aa, Homo Sapiens
SGPDGHYTM

SEQ ID NO: 1314365 - protein, 9 aa, Homo Sapiens
DVYAIMRGC

SEQ ID NO: 1314366 - protein, 9 aa, Homo Sapiens
CTKEPGGKG

SEQ ID NO: 1314367 - protein, 9 aa, Homo Sapiens
GDQHVDDVS

SEQ ID NO: 1314368 - protein, 9 aa, Homo Sapiens
GASTPARSP

SEQ ID NO: 1314369 - protein, 9 aa, Homo Sapiens
DQNVQTRWK

SEQ ID NO: 1314370 - protein, 9 aa, Homo Sapiens
KKAVDWCLF

SEQ ID NO: 1314371 - protein, 9 aa, Homo Sapiens
KAFRLCQKL

SEQ ID NO: 1314372 - protein, 9 aa, Homo Sapiens
EKDANWTRL

SEQ ID NO: 1314373 - protein, 9 aa, Homo Sapiens
TVSDPETIH

SEQ ID NO: 1314374 - protein, 9 aa, Homo Sapiens
FSIAGADHI

SEQ ID NO: 1314375 - protein, 9 aa, Homo Sapiens
IWIDGTDKA

SEQ ID NO: 1314376 - protein, 9 aa, Homo Sapiens
EWIPRLLFA

SEQ ID NO: 1314377 - protein, 9 aa, Homo Sapiens
PVNETATTS

SEQ ID NO: 1314378 - protein, 9 aa, Homo Sapiens
NSTRVIYSI

SEQ ID NO: 1314379 - protein, 9 aa, Homo Sapiens
KREVDEATN

SEQ ID NO: 1314380 - protein, 9 aa, Homo Sapiens
ILTCNMSLE

SEQ ID NO: 1314381 - protein, 9 aa, Homo Sapiens
PHVLKMEPA

SEQ ID NO: 1314382 - protein, 9 aa, Homo Sapiens
CTVYIEVIP

SEQ ID NO: 1314383 - protein, 9 aa, Homo Sapiens
EEGPEENST

SEQ ID NO: 1314384 - protein, 9 aa, Homo Sapiens
KYLDVFART

SEQ ID NO: 1314385 - protein, 9 aa, Homo Sapiens
QRPGDLMWI

SEQ ID NO: 1314386 - protein, 9 aa, Homo Sapiens
KERCNQEAH

SEQ ID NO: 1314387 - protein, 9 aa, Homo Sapiens
PIDTVDFEW

SEQ ID NO: 1314388 - protein, 9 aa, Homo Sapiens
LSMTCCRFS

SEQ ID NO: 1314389 - protein, 9 aa, Homo Sapiens
EELLPSTSS

SEQ ID NO: 1314390 - protein, 9 aa, Homo Sapiens
DHSFILILG

SEQ ID NO: 1314391 - protein, 9 aa, Homo Sapiens
PLCPHARAS

SEQ ID NO: 1314392 - protein, 9 aa, Homo Sapiens
SSEKIAVIA

SEQ ID NO: 1314393 - protein, 9 aa, Homo Sapiens
KTAVWGGHE

SEQ ID NO: 1314394 - protein, 9 aa, Homo Sapiens
SLSSNPSSC

SEQ ID NO: 1314395 - protein, 9 aa, Homo Sapiens
VSVVDRVSH

SEQ ID NO: 1314396 - protein, 9 aa, Homo Sapiens
WWLVDSAEI

SEQ ID NO: 1314397 - protein, 9 aa, Homo Sapiens
LQPLRQQIL

SEQ ID NO: 1314398 - protein, 9 aa, Homo Sapiens
VFEMCFAKM

SEQ ID NO: 1314399 - protein, 9 aa, Homo Sapiens
CKKFEGNIM

SEQ ID NO: 1314400 - protein, 9 aa, Homo Sapiens
RQLGKGTEV

SEQ ID NO: 1314401 - protein, 9 aa, Homo Sapiens
RVSVFRPMD

SEQ ID NO: 1314402 - protein, 9 aa, Homo Sapiens
SSPFYIWTA

SEQ ID NO: 1314403 - protein, 9 aa, Homo Sapiens
HAAGECAHN

SEQ ID NO: 1314404 - protein, 9 aa, Homo Sapiens
RNVVCLWLH

SEQ ID NO: 1314405 - protein, 9 aa, Homo Sapiens
HILVRCIHF

SEQ ID NO: 1314406 - protein, 9 aa, Homo Sapiens
APEVTEPSH

SEQ ID NO: 1314407 - protein, 9 aa, Homo Sapiens
RGRHTASVR

SEQ ID NO: 1314408 - protein, 9 aa, Homo Sapiens
DVWAVLHLG

SEQ ID NO: 1314409 - protein, 9 aa, Homo Sapiens
NCMQTTICQ

SEQ ID NO: 1314410 - protein, 9 aa, Homo Sapiens
ERALDWIFN

SEQ ID NO: 1314411 - protein, 9 aa, Homo Sapiens
VLGALINTL

SEQ ID NO: 1314412 - protein, 9 aa, Homo Sapiens
LLLGKCTYT

SEQ ID NO: 1314413 - protein, 9 aa, Homo Sapiens
VIYLQFVPK

SEQ ID NO: 1314414 - protein, 9 aa, Homo Sapiens
NSLSTMYNL

SEQ ID NO: 1314415 - protein, 9 aa, Homo Sapiens
WIIEVVKAS

SEQ ID NO: 1314416 - protein, 9 aa, Homo Sapiens
PKKQVLYLM

SEQ ID NO: 1314417 - protein, 9 aa, Homo Sapiens
SICLITLLP

SEQ ID NO: 1314418 - protein, 9 aa, Homo Sapiens
ENMERRNHY

SEQ ID NO: 1314419 - protein, 9 aa, Homo Sapiens
TQHYSDASK

SEQ ID NO: 1314420 - protein, 9 aa, Homo Sapiens
LHTWEEELT

SEQ ID NO: 1314421 - protein, 9 aa, Homo Sapiens
LDEITQMMV

SEQ ID NO: 1314422 - protein, 9 aa, Homo Sapiens
ERCAVHEAS

SEQ ID NO: 1314423 - protein, 9 aa, Homo Sapiens
ETLKDINTS

SEQ ID NO: 1314424 - protein, 9 aa, Homo Sapiens
SGRNFYHMP

SEQ ID NO: 1314425 - protein, 9 aa, Homo Sapiens
NGDLGAMTS

SEQ ID NO: 1314426 - protein, 9 aa, Homo Sapiens
CLDQDAAIA

SEQ ID NO: 1314427 - protein, 9 aa, Homo Sapiens
KRHPERKYD

SEQ ID NO: 1314428 - protein, 9 aa, Homo Sapiens
APATYHAEG

SEQ ID NO: 1314429 - protein, 9 aa, Homo Sapiens
MLLCTPFRV

SEQ ID NO: 1314430 - protein, 9 aa, Homo Sapiens
TSQRFMVQI

SEQ ID NO: 1314431 - protein, 9 aa, Homo Sapiens
VRRAPLGTN

SEQ ID NO: 1314432 - protein, 9 aa, Homo Sapiens
EEQAGGPPR

SEQ ID NO: 1314433 - protein, 9 aa, Homo Sapiens
QIVPDTHKD

SEQ ID NO: 1314434 - protein, 9 aa, Homo Sapiens
TVVSLLNET

SEQ ID NO: 1314435 - protein, 9 aa, Homo Sapiens
GAWKHHYIA

SEQ ID NO: 1314436 - protein, 9 aa, Homo Sapiens
EKSFKCEQC

SEQ ID NO: 1314437 - protein, 9 aa, Homo Sapiens
TDKDGIGDK

SEQ ID NO: 1314438 - protein, 9 aa, Homo Sapiens
NQIEQLSVK

SEQ ID NO: 1314439 - protein, 9 aa, Homo Sapiens
KVLGPRREI

SEQ ID NO: 1314440 - protein, 9 aa, Homo Sapiens
CMMDSSQIL

SEQ ID NO: 1314441 - protein, 9 aa, Homo Sapiens
DEEGCMPFY

SEQ ID NO: 1314442 - protein, 9 aa, Homo Sapiens
LCNFILACQ

SEQ ID NO: 1314443 - protein, 9 aa, Homo Sapiens
STGARTSLS

SEQ ID NO: 1314444 - protein, 9 aa, Homo Sapiens
RDSRKERLG

SEQ ID NO: 1314445 - protein, 9 aa, Homo Sapiens
IQLPELYRS

SEQ ID NO: 1314446 - protein, 9 aa, Homo Sapiens
ESNGMHRWW

SEQ ID NO: 1314447 - protein, 9 aa, Homo Sapiens
RTFQEKASW

SEQ ID NO: 1314448 - protein, 9 aa, Homo Sapiens
KTTDDETRK

SEQ ID NO: 1314449 - protein, 9 aa, Homo Sapiens
HRISAMDEN

SEQ ID NO: 1314450 - protein, 9 aa, Homo Sapiens
HFVLFIALT

SEQ ID NO: 1314451 - protein, 9 aa, Homo Sapiens
PKELKIISL

SEQ ID NO: 1314452 - protein, 9 aa, Homo Sapiens
KVVNAVGMS

SEQ ID NO: 1314453 - protein, 9 aa, Homo Sapiens
VGGSLSSCG

SEQ ID NO: 1314454 - protein, 9 aa, Homo Sapiens
SHFMSVIYH

SEQ ID NO: 1314455 - protein, 9 aa, Homo Sapiens
PQMISEGDI

SEQ ID NO: 1314456 - protein, 9 aa, Homo Sapiens
RHCCLPQPG

SEQ ID NO: 1314457 - protein, 9 aa, Homo Sapiens
GNCLMYATS

SEQ ID NO: 1314458 - protein, 9 aa, Homo Sapiens
KGQKKIRKT

SEQ ID NO: 1314459 - protein, 9 aa, Homo Sapiens
ICKGPMTKH

SEQ ID NO: 1314460 - protein, 9 aa, Homo Sapiens
CRYAKKCQV

SEQ ID NO: 1314461 - protein, 9 aa, Homo Sapiens
VDTWLKSVM

SEQ ID NO: 1314462 - protein, 9 aa, Homo Sapiens
PPGWEKCTD

SEQ ID NO: 1314463 - protein, 9 aa, Homo Sapiens
RHRAVKMVT

SEQ ID NO: 1314464 - protein, 9 aa, Homo Sapiens
TIYIVGGVS

SEQ ID NO: 1314465 - protein, 9 aa, Homo Sapiens
KSFLHDNYE

SEQ ID NO: 1314466 - protein, 9 aa, Homo Sapiens
PWTVFRATP

SEQ ID NO: 1314467 - protein, 9 aa, Homo Sapiens
IYGLMKVGA

SEQ ID NO: 1314468 - protein, 9 aa, Homo Sapiens
RTIITKSFA

SEQ ID NO: 1314469 - protein, 9 aa, Homo Sapiens
MSPTFTWNN

SEQ ID NO: 1314470 - protein, 9 aa, Homo Sapiens
WSQYLAIRP

SEQ ID NO: 1314471 - protein, 9 aa, Homo Sapiens
LRRYHQDFF

SEQ ID NO: 1314472 - protein, 9 aa, Homo Sapiens
GPEDLRTRT

SEQ ID NO: 1314473 - protein, 9 aa, Homo Sapiens
SFEDLRRDM

SEQ ID NO: 1314474 - protein, 9 aa, Homo Sapiens
QEMCDKVHI

SEQ ID NO: 1314475 - protein, 9 aa, Homo Sapiens
SMRGGHLGV

SEQ ID NO: 1314476 - protein, 9 aa, Homo Sapiens
YDIYRRNLD

SEQ ID NO: 1314477 - protein, 9 aa, Homo Sapiens
RKRGEGGQF

SEQ ID NO: 1314478 - protein, 9 aa, Homo Sapiens
ITIFHDTIL

SEQ ID NO: 1314479 - protein, 9 aa, Homo Sapiens
GENVAQTPR

SEQ ID NO: 1314480 - protein, 9 aa, Homo Sapiens
GHYTMDNIT

SEQ ID NO: 1314481 - protein, 9 aa, Homo Sapiens
TEEAYIIYD

SEQ ID NO: 1314482 - protein, 9 aa, Homo Sapiens
LVDDFYYGW

SEQ ID NO: 1314483 - protein, 9 aa, Homo Sapiens
YQPACCVSS

SEQ ID NO: 1314484 - protein, 9 aa, Homo Sapiens
SNYVCRELL

SEQ ID NO: 1314485 - protein, 9 aa, Homo Sapiens
AHDTRGSSI

SEQ ID NO: 1314486 - protein, 9 aa, Homo Sapiens
PTAQQQEGS

SEQ ID NO: 1314487 - protein, 9 aa, Homo Sapiens
RHAQVSQPF

SEQ ID NO: 1314488 - protein, 9 aa, Homo Sapiens
GDDCFSLRH

SEQ ID NO: 1314489 - protein, 9 aa, Homo Sapiens
AELALVGPH

SEQ ID NO: 1314490 - protein, 9 aa, Homo Sapiens
SKVCSSVAY

SEQ ID NO: 1314491 - protein, 9 aa, Homo Sapiens
DPGMTDRGR

SEQ ID NO: 1314492 - protein, 9 aa, Homo Sapiens
TSSSEFYKV

SEQ ID NO: 1314493 - protein, 9 aa, Homo Sapiens
VVTLPAPPP

SEQ ID NO: 1314494 - protein, 9 aa, Homo Sapiens
YMMSSHSNH

SEQ ID NO: 1314495 - protein, 9 aa, Homo Sapiens
AFTLFACEE

SEQ ID NO: 1314496 - protein, 9 aa, Homo Sapiens
PGTPVKLPC

SEQ ID NO: 1314497 - protein, 9 aa, Homo Sapiens
NSQCLSAPS

SEQ ID NO: 1314498 - protein, 9 aa, Homo Sapiens
VPIPPQMGS

SEQ ID NO: 1314499 - protein, 9 aa, Homo Sapiens
FNDRNKPHY

SEQ ID NO: 1314500 - protein, 9 aa, Homo Sapiens
VIFFLLLCV

SEQ ID NO: 1314501 - protein, 9 aa, Homo Sapiens
HDENVDLWS

SEQ ID NO: 1314502 - protein, 9 aa, Homo Sapiens
QEPGSEVNT

SEQ ID NO: 1314503 - protein, 9 aa, Homo Sapiens
TVSETLQFK

SEQ ID NO: 1314504 - protein, 9 aa, Homo Sapiens
LTCNMSLEY

SEQ ID NO: 1314505 - protein, 9 aa, Homo Sapiens
HLDLPPYPS

SEQ ID NO: 1314506 - protein, 9 aa, Homo Sapiens
FNKTTQNLT

SEQ ID NO: 1314507 - protein, 9 aa, Homo Sapiens
QYVPAFWYN

SEQ ID NO: 1314508 - protein, 9 aa, Homo Sapiens
YPMPTKDLH

SEQ ID NO: 1314509 - protein, 9 aa, Homo Sapiens
PSPWQGSKP

SEQ ID NO: 1314510 - protein, 9 aa, Homo Sapiens
LPNKPPLED

SEQ ID NO: 1314511 - protein, 9 aa, Homo Sapiens
LMEIIQAKD

SEQ ID NO: 1314512 - protein, 9 aa, Homo Sapiens
HKPTSQWSQ

SEQ ID NO: 1314513 - protein, 9 aa, Homo Sapiens
AQYNVGLCH

SEQ ID NO: 1314514 - protein, 9 aa, Homo Sapiens
DMWWYQRCC

SEQ ID NO: 1314515 - protein, 9 aa, Homo Sapiens
VWLITVPID

SEQ ID NO: 1314516 - protein, 9 aa, Homo Sapiens
TGTPKCMVH

SEQ ID NO: 1314517 - protein, 9 aa, Homo Sapiens
SSKGTLNLE

SEQ ID NO: 1314518 - protein, 9 aa, Homo Sapiens
FHLFDFTAC

SEQ ID NO: 1314519 - protein, 9 aa, Homo Sapiens
QSLAWRKQH

SEQ ID NO: 1314520 - protein, 9 aa, Homo Sapiens
VALVVEANT

SEQ ID NO: 1314521 - protein, 9 aa, Homo Sapiens
LIMGFMLVT

SEQ ID NO: 1314522 - protein, 9 aa, Homo Sapiens
RHRVHFQSH

SEQ ID NO: 1314523 - protein, 9 aa, Homo Sapiens
MRVYDNVRE

SEQ ID NO: 1314524 - protein, 9 aa, Homo Sapiens
LKQMVGGSL

SEQ ID NO: 1314525 - protein, 9 aa, Homo Sapiens
YDLQESSVR

SEQ ID NO: 1314526 - protein, 9 aa, Homo Sapiens
PHHRVACVC

SEQ ID NO: 1314527 - protein, 9 aa, Homo Sapiens
VIPDAVLKE

SEQ ID NO: 1314528 - protein, 9 aa, Homo Sapiens
EDTETAQML

SEQ ID NO: 1314529 - protein, 9 aa, Homo Sapiens
EQKVTHLTE

SEQ ID NO: 1314530 - protein, 9 aa, Homo Sapiens
VNTGCDQEM

SEQ ID NO: 1314531 - protein, 9 aa, Homo Sapiens
PVIHSNING

SEQ ID NO: 1314532 - protein, 9 aa, Homo Sapiens
RCHYRDKHG

SEQ ID NO: 1314533 - protein, 9 aa, Homo Sapiens
ELQEVLGCV

SEQ ID NO: 1314534 - protein, 9 aa, Homo Sapiens
NSILHYLAR

SEQ ID NO: 1314535 - protein, 9 aa, Homo Sapiens
RFDNEMKDK

SEQ ID NO: 1314536 - protein, 9 aa, Homo Sapiens
RRYLVERTR

SEQ ID NO: 1314537 - protein, 9 aa, Homo Sapiens
EICIKDEET

SEQ ID NO: 1314538 - protein, 9 aa, Homo Sapiens
KDVTLHWKK

SEQ ID NO: 1314539 - protein, 9 aa, Homo Sapiens
SLMTYWQEL

SEQ ID NO: 1314540 - protein, 9 aa, Homo Sapiens
TWWSAAATM

SEQ ID NO: 1314541 - protein, 9 aa, Homo Sapiens
GLCGAIRLP

SEQ ID NO: 1314542 - protein, 9 aa, Homo Sapiens
TFHHLHHLE

SEQ ID NO: 1314543 - protein, 9 aa, Homo Sapiens
KSFVILFIT

SEQ ID NO: 1314544 - protein, 9 aa, Homo Sapiens
VIAGGTMQL

SEQ ID NO: 1314545 - protein, 9 aa, Homo Sapiens
EAKKKCDEE

SEQ ID NO: 1314546 - protein, 9 aa, Homo Sapiens
KLEKEKSWV

SEQ ID NO: 1314547 - protein, 9 aa, Homo Sapiens
LQIRGMMLY

SEQ ID NO: 1314548 - protein, 9 aa, Homo Sapiens
WLVDSAEIQ

SEQ ID NO: 1314549 - protein, 9 aa, Homo Sapiens
KRVICGFDA

SEQ ID NO: 1314550 - protein, 9 aa, Homo Sapiens
GAHNISNQL

SEQ ID NO: 1314551 - protein, 9 aa, Homo Sapiens
RRLTSAMNA

SEQ ID NO: 1314552 - protein, 9 aa, Homo Sapiens
NWCANDTPL

SEQ ID NO: 1314553 - protein, 9 aa, Homo Sapiens
MILVVFKSA

SEQ ID NO: 1314554 - protein, 9 aa, Homo Sapiens
PLIRPETLV

SEQ ID NO: 1314555 - protein, 9 aa, Homo Sapiens
TQKGVECDR

SEQ ID NO: 1314556 - protein, 9 aa, Homo Sapiens
LLKVQLAQL

SEQ ID NO: 1314557 - protein, 9 aa, Homo Sapiens
ASKQIATDK

SEQ ID NO: 1314558 - protein, 9 aa, Homo Sapiens
AGNNHLVPV

SEQ ID NO: 1314559 - protein, 9 aa, Homo Sapiens
TDFKRSRIT

SEQ ID NO: 1314560 - protein, 9 aa, Homo Sapiens
TETVIKPVK

SEQ ID NO: 1314561 - protein, 9 aa, Homo Sapiens
SSLEMAGWP

SEQ ID NO: 1314562 - protein, 9 aa, Homo Sapiens
YRQHVQPPK

SEQ ID NO: 1314563 - protein, 9 aa, Homo Sapiens
YFLPRMIHD

SEQ ID NO: 1314564 - protein, 9 aa, Homo Sapiens
FVVEGKAPS

SEQ ID NO: 1314565 - protein, 9 aa, Homo Sapiens
PHIFTSIGE

SEQ ID NO: 1314566 - protein, 9 aa, Homo Sapiens
VCIENMEDK

SEQ ID NO: 1314567 - protein, 9 aa, Homo Sapiens
EGESPNFPE

SEQ ID NO: 1314568 - protein, 9 aa, Homo Sapiens
WPISSWTCL

SEQ ID NO: 1314569 - protein, 9 aa, Homo Sapiens
EDDEKHIQA

SEQ ID NO: 1314570 - protein, 9 aa, Homo Sapiens
PEPTMCIPK

SEQ ID NO: 1314571 - protein, 9 aa, Homo Sapiens
VDLRNTSGL

SEQ ID NO: 1314572 - protein, 9 aa, Homo Sapiens
MDSLPQLTS

SEQ ID NO: 1314573 - protein, 9 aa, Homo Sapiens
PGPGDQESC

SEQ ID NO: 1314574 - protein, 9 aa, Homo Sapiens
TTGSAHTLT

SEQ ID NO: 1314575 - protein, 9 aa, Homo Sapiens
SFARVMEQC

SEQ ID NO: 1314576 - protein, 9 aa, Homo Sapiens
KATRGCLLH

SEQ ID NO: 1314577 - protein, 9 aa, Homo Sapiens
VFLLLKWRF

SEQ ID NO: 1314578 - protein, 9 aa, Homo Sapiens
IFKITVSPN

SEQ ID NO: 1314579 - protein, 9 aa, Homo Sapiens
MTVFQILTD

SEQ ID NO: 1314580 - protein, 9 aa, Homo Sapiens
VQPLEDNLF

SEQ ID NO: 1314581 - protein, 9 aa, Homo Sapiens
RGFSNKLHL

SEQ ID NO: 1314582 - protein, 9 aa, Homo Sapiens
QMVKETLQV

SEQ ID NO: 1314583 - protein, 9 aa, Homo Sapiens
QMMTKEDDK

SEQ ID NO: 1314584 - protein, 9 aa, Homo Sapiens
QDRTPFSVG

SEQ ID NO: 1314585 - protein, 9 aa, Homo Sapiens
TLCYTPLIQ

SEQ ID NO: 1314586 - protein, 9 aa, Homo Sapiens
TIPSCPEGT

SEQ ID NO: 1314587 - protein, 9 aa, Homo Sapiens
KVFLILSYL

SEQ ID NO: 1314588 - protein, 9 aa, Homo Sapiens
DTIGEFIAL

SEQ ID NO: 1314589 - protein, 9 aa, Homo Sapiens
PLPAWGHEV

SEQ ID NO: 1314590 - protein, 9 aa, Homo Sapiens
QEEGKYYNV

SEQ ID NO: 1314591 - protein, 9 aa, Homo Sapiens
FLRRLHLWM

SEQ ID NO: 1314592 - protein, 9 aa, Homo Sapiens
NSNERRHMQ

SEQ ID NO: 1314593 - protein, 9 aa, Homo Sapiens
HIIVSTTGP

SEQ ID NO: 1314594 - protein, 9 aa, Homo Sapiens
RGFTMPKKF

SEQ ID NO: 1314595 - protein, 9 aa, Homo Sapiens
TFVTHVYAS

SEQ ID NO: 1314596 - protein, 9 aa, Homo Sapiens
CQCAKLEAA

SEQ ID NO: 1314597 - protein, 9 aa, Homo Sapiens
LLSDQGFNL

SEQ ID NO: 1314598 - protein, 9 aa, Homo Sapiens
QSCIDWNCE

SEQ ID NO: 1314599 - protein, 9 aa, Homo Sapiens
PGHRPPIWV

SEQ ID NO: 1314600 - protein, 9 aa, Homo Sapiens
PRRSPRSTP

SEQ ID NO: 1314601 - protein, 9 aa, Homo Sapiens
PRLLFRHYL

SEQ ID NO: 1314602 - protein, 9 aa, Homo Sapiens
VEDECRHAD

SEQ ID NO: 1314603 - protein, 9 aa, Homo Sapiens
RIHELGYNM

SEQ ID NO: 1314604 - protein, 9 aa, Homo Sapiens
NHISTIVPK

SEQ ID NO: 1314605 - protein, 9 aa, Homo Sapiens
SGRRVLYVD

SEQ ID NO: 1314606 - protein, 9 aa, Homo Sapiens
EQQYKDEEG

SEQ ID NO: 1314607 - protein, 9 aa, Homo Sapiens
CESHKHRGN

SEQ ID NO: 1314608 - protein, 9 aa, Homo Sapiens
IEQYLCTPQ

SEQ ID NO: 1314609 - protein, 9 aa, Homo Sapiens
KDGSIVGFF

SEQ ID NO: 1314610 - protein, 9 aa, Homo Sapiens
SETVHTSAV

SEQ ID NO: 1314611 - protein, 9 aa, Homo Sapiens
QDALDTLCK

SEQ ID NO: 1314612 - protein, 9 aa, Homo Sapiens
HLQKQDKDN

SEQ ID NO: 1314613 - protein, 9 aa, Homo Sapiens
SLWKAVKTA

SEQ ID NO: 1314614 - protein, 9 aa, Homo Sapiens
MKGLYTDTE

SEQ ID NO: 1314615 - protein, 9 aa, Homo Sapiens
TGFGGHRGW

SEQ ID NO: 1314616 - protein, 9 aa, Homo Sapiens
EYEELHTHT

SEQ ID NO: 1314617 - protein, 9 aa, Homo Sapiens
FGSTMGEIC

SEQ ID NO: 1314618 - protein, 9 aa, Homo Sapiens
CCHIRFTWA

SEQ ID NO: 1314619 - protein, 9 aa, Homo Sapiens
HSLSLHDMF

SEQ ID NO: 1314620 - protein, 9 aa, Homo Sapiens
HDFSLSIPS

SEQ ID NO: 1314621 - protein, 9 aa, Homo Sapiens
KEAPDVHFT

SEQ ID NO: 1314622 - protein, 9 aa, Homo Sapiens
VVHELGVAV

SEQ ID NO: 1314623 - protein, 9 aa, Homo Sapiens
KKIPLNPSP

SEQ ID NO: 1314624 - protein, 9 aa, Homo Sapiens
SFTPTHLHP

SEQ ID NO: 1314625 - protein, 9 aa, Homo Sapiens
IQTSESYPL

SEQ ID NO: 1314626 - protein, 9 aa, Homo Sapiens
ERAISMHNA

SEQ ID NO: 1314627 - protein, 9 aa, Homo Sapiens
EPLGYHQDD

SEQ ID NO: 1314628 - protein, 9 aa, Homo Sapiens
NSSVPSPGI

SEQ ID NO: 1314629 - protein, 9 aa, Homo Sapiens
KVEAEEENT

SEQ ID NO: 1314630 - protein, 9 aa, Homo Sapiens
RVTCRFKHP

SEQ ID NO: 1314631 - protein, 9 aa, Homo Sapiens
FSIIITEVR

SEQ ID NO: 1314632 - protein, 9 aa, Homo Sapiens
KSQLTEHKI

SEQ ID NO: 1314633 - protein, 9 aa, Homo Sapiens
SRVANHVLD

SEQ ID NO: 1314634 - protein, 9 aa, Homo Sapiens
DCGCGSFRR

SEQ ID NO: 1314635 - protein, 9 aa, Homo Sapiens
EKLRDFTRT

SEQ ID NO: 1314636 - protein, 9 aa, Homo Sapiens
LSLKAKRVK

SEQ ID NO: 1314637 - protein, 9 aa, Homo Sapiens
TEAWCRTTL

SEQ ID NO: 1314638 - protein, 9 aa, Homo Sapiens
QKGMRTVEG

SEQ ID NO: 1314639 - protein, 9 aa, Homo Sapiens
KGFTFISFH

SEQ ID NO: 1314640 - protein, 9 aa, Homo Sapiens
QIINNTIEM

SEQ ID NO: 1314641 - protein, 9 aa, Homo Sapiens
ISLDLPVSC

SEQ ID NO: 1314642 - protein, 9 aa, Homo Sapiens
DLLQGPRPS

SEQ ID NO: 1314643 - protein, 9 aa, Homo Sapiens
EEVTTCVGR

SEQ ID NO: 1314644 - protein, 9 aa, Homo Sapiens
DHHVELYKV

SEQ ID NO: 1314645 - protein, 9 aa, Homo Sapiens
GDGYVDTEI

SEQ ID NO: 1314646 - protein, 9 aa, Homo Sapiens
DYCTSKVSA

SEQ ID NO: 1314647 - protein, 9 aa, Homo Sapiens
AKQTLHHFL

SEQ ID NO: 1314648 - protein, 9 aa, Homo Sapiens
DSSPLLCCA

SEQ ID NO: 1314649 - protein, 9 aa, Homo Sapiens
SIQVCKLAQ

SEQ ID NO: 1314650 - protein, 9 aa, Homo Sapiens
CPEIFTMHQ

SEQ ID NO: 1314651 - protein, 9 aa, Homo Sapiens
VLHSFTDVI

SEQ ID NO: 1314652 - protein, 9 aa, Homo Sapiens
IMAVWRPGC

SEQ ID NO: 1314653 - protein, 9 aa, Homo Sapiens
VTVLQPPVS

SEQ ID NO: 1314654 - protein, 9 aa, Homo Sapiens
PMDSNDSHG

SEQ ID NO: 1314655 - protein, 9 aa, Homo Sapiens
KLCNFILAC

SEQ ID NO: 1314656 - protein, 9 aa, Homo Sapiens
PRSVPLTQV

SEQ ID NO: 1314657 - protein, 9 aa, Homo Sapiens
PEMTPQSEP

SEQ ID NO: 1314658 - protein, 9 aa, Homo Sapiens
STGASTPAR

SEQ ID NO: 1314659 - protein, 9 aa, Homo Sapiens
SLSTRGCTA

SEQ ID NO: 1314660 - protein, 9 aa, Homo Sapiens
TMSTHLSNG

SEQ ID NO: 1314661 - protein, 9 aa, Homo Sapiens
EQYLCTPQE

SEQ ID NO: 1314662 - protein, 9 aa, Homo Sapiens
IGKQKMAIT

SEQ ID NO: 1314663 - protein, 9 aa, Homo Sapiens
LDKRQSLNS

SEQ ID NO: 1314664 - protein, 9 aa, Homo Sapiens
ENKLYDELE

SEQ ID NO: 1314665 - protein, 9 aa, Homo Sapiens
QIQWPTVHG

SEQ ID NO: 1314666 - protein, 9 aa, Homo Sapiens
ACDLRRGHY

SEQ ID NO: 1314667 - protein, 9 aa, Homo Sapiens
GHQLYQPKL

SEQ ID NO: 1314668 - protein, 9 aa, Homo Sapiens
APRLPVRPW

SEQ ID NO: 1314669 - protein, 9 aa, Homo Sapiens
HMKIMALMD

SEQ ID NO: 1314670 - protein, 9 aa, Homo Sapiens
YRPVNWCAN

SEQ ID NO: 1314671 - protein, 9 aa, Homo Sapiens
TAACAPTPL

SEQ ID NO: 1314672 - protein, 9 aa, Homo Sapiens
NLMIEVSDK

SEQ ID NO: 1314673 - protein, 9 aa, Homo Sapiens
IVRFIAMAL

SEQ ID NO: 1314674 - protein, 9 aa, Homo Sapiens
DVRKYVGSN

SEQ ID NO: 1314675 - protein, 9 aa, Homo Sapiens
CRKAREETQ

SEQ ID NO: 1314676 - protein, 9 aa, Homo Sapiens
YLPDLSVTS

SEQ ID NO: 1314677 - protein, 9 aa, Homo Sapiens
QTQALGITL

SEQ ID NO: 1314678 - protein, 9 aa, Homo Sapiens
YLYGVILLV

SEQ ID NO: 1314679 - protein, 9 aa, Homo Sapiens
LHRTLRLQR

SEQ ID NO: 1314680 - protein, 9 aa, Homo Sapiens
SDTDSDSPD

SEQ ID NO: 1314681 - protein, 9 aa, Homo Sapiens
YGLNGMLTG

SEQ ID NO: 1314682 - protein, 9 aa, Homo Sapiens
LGQHMAEQL

SEQ ID NO: 1314683 - protein, 9 aa, Homo Sapiens
APVAQPPAV

SEQ ID NO: 1314684 - protein, 9 aa, Homo Sapiens
QKLFQRFPK

SEQ ID NO: 1314685 - protein, 9 aa, Homo Sapiens
RSSKSPKPS

SEQ ID NO: 1314686 - protein, 9 aa, Homo Sapiens
GHYLTVACI

SEQ ID NO: 1314687 - protein, 9 aa, Homo Sapiens
GHGLQGPHT

SEQ ID NO: 1314688 - protein, 9 aa, Homo Sapiens
TMVPSPEAG

SEQ ID NO: 1314689 - protein, 9 aa, Homo Sapiens
EYKLQTPHI

SEQ ID NO: 1314690 - protein, 9 aa, Homo Sapiens
PHQEKLEKA

SEQ ID NO: 1314691 - protein, 9 aa, Homo Sapiens
GPGGETKCA

SEQ ID NO: 1314692 - protein, 9 aa, Homo Sapiens
ENAKCQCAK

SEQ ID NO: 1314693 - protein, 9 aa, Homo Sapiens
TSHVVAVLA

SEQ ID NO: 1314694 - protein, 9 aa, Homo Sapiens
VKKKAALQT

SEQ ID NO: 1314695 - protein, 9 aa, Homo Sapiens
KASEPGLFV

SEQ ID NO: 1314696 - protein, 9 aa, Homo Sapiens
VTHLTEELN

SEQ ID NO: 1314697 - protein, 9 aa, Homo Sapiens
WKNHQQNTI

SEQ ID NO: 1314698 - protein, 9 aa, Homo Sapiens
PPTILPTLH

SEQ ID NO: 1314699 - protein, 9 aa, Homo Sapiens
THDYLSVAP

SEQ ID NO: 1314700 - protein, 9 aa, Homo Sapiens
VIVRILHGG

SEQ ID NO: 1314701 - protein, 9 aa, Homo Sapiens
AIITTLLML

SEQ ID NO: 1314702 - protein, 9 aa, Homo Sapiens
YTPTMESVC

SEQ ID NO: 1314703 - protein, 9 aa, Homo Sapiens
LQNDVYSEL

SEQ ID NO: 1314704 - protein, 9 aa, Homo Sapiens
SMSNKYTQA

SEQ ID NO: 1314705 - protein, 9 aa, Homo Sapiens
LRSKTLDGT

SEQ ID NO: 1314706 - protein, 9 aa, Homo Sapiens
NIQSKDDKS

SEQ ID NO: 1314707 - protein, 9 aa, Homo Sapiens
LQKVNTIWA

SEQ ID NO: 1314708 - protein, 9 aa, Homo Sapiens
DYSSMVIDE

SEQ ID NO: 1314709 - protein, 9 aa, Homo Sapiens
KQKTINCFL

SEQ ID NO: 1314710 - protein, 9 aa, Homo Sapiens
VQLEAILSA

SEQ ID NO: 1314711 - protein, 9 aa, Homo Sapiens
NLVSEYQQY

SEQ ID NO: 1314712 - protein, 9 aa, Homo Sapiens
PEVPIFHDF

SEQ ID NO: 1314713 - protein, 9 aa, Homo Sapiens
KRAHTGEKT

SEQ ID NO: 1314714 - protein, 9 aa, Homo Sapiens
GGPPRSRLA

SEQ ID NO: 1314715 - protein, 9 aa, Homo Sapiens
WLRSKKRKA

SEQ ID NO: 1314716 - protein, 9 aa, Homo Sapiens
ATYTVIEAP

SEQ ID NO: 1314717 - protein, 9 aa, Homo Sapiens
PEGDPCWTH

SEQ ID NO: 1314718 - protein, 9 aa, Homo Sapiens
ISKGFFGSH

SEQ ID NO: 1314719 - protein, 9 aa, Homo Sapiens
NSMNDGFFL

SEQ ID NO: 1314720 - protein, 9 aa, Homo Sapiens
NEIISQVYS

SEQ ID NO: 1314721 - protein, 9 aa, Homo Sapiens
LYECPNYQG

SEQ ID NO: 1314722 - protein, 9 aa, Homo Sapiens
GKCVFDSAN

SEQ ID NO: 1314723 - protein, 9 aa, Homo Sapiens
APLQELSPT

SEQ ID NO: 1314724 - protein, 9 aa, Homo Sapiens
TQLEMTFNL

SEQ ID NO: 1314725 - protein, 9 aa, Homo Sapiens
LHTIFLKDV

SEQ ID NO: 1314726 - protein, 9 aa, Homo Sapiens
VAWTLPRSP

SEQ ID NO: 1314727 - protein, 9 aa, Homo Sapiens
PSLPRRLWR

SEQ ID NO: 1314728 - protein, 9 aa, Homo Sapiens
ILSLENCRR

SEQ ID NO: 1314729 - protein, 9 aa, Homo Sapiens
QGLFVQLIQ

SEQ ID NO: 1314730 - protein, 9 aa, Homo Sapiens
FDLSDMDNL

SEQ ID NO: 1314731 - protein, 9 aa, Homo Sapiens
WSPLHIVAS

SEQ ID NO: 1314732 - protein, 9 aa, Homo Sapiens
AQAQSLSRH

SEQ ID NO: 1314733 - protein, 9 aa, Homo Sapiens
VMLFCGFII

SEQ ID NO: 1314734 - protein, 9 aa, Homo Sapiens
ADRHAFIIT

SEQ ID NO: 1314735 - protein, 9 aa, Homo Sapiens
FGSGGGGGD

SEQ ID NO: 1314736 - protein, 9 aa, Homo Sapiens
EPAVIAHPG

SEQ ID NO: 1314737 - protein, 9 aa, Homo Sapiens
LACTRGSIV

SEQ ID NO: 1314738 - protein, 9 aa, Homo Sapiens
GTKIKAMES

SEQ ID NO: 1314739 - protein, 9 aa, Homo Sapiens
ELSSSSQHR

SEQ ID NO: 1314740 - protein, 9 aa, Homo Sapiens
MSAHKSSDA

SEQ ID NO: 1314741 - protein, 9 aa, Homo Sapiens
HRFHRISAM

SEQ ID NO: 1314742 - protein, 9 aa, Homo Sapiens
LLRRVSHLL

SEQ ID NO: 1314743 - protein, 9 aa, Homo Sapiens
MIQAAGKLA

SEQ ID NO: 1314744 - protein, 9 aa, Homo Sapiens
ISRYIVSDN

SEQ ID NO: 1314745 - protein, 9 aa, Homo Sapiens
KVIHIIFTL

SEQ ID NO: 1314746 - protein, 9 aa, Homo Sapiens
LQAAKGGLE

SEQ ID NO: 1314747 - protein, 9 aa, Homo Sapiens
QGHDPEADV

SEQ ID NO: 1314748 - protein, 9 aa, Homo Sapiens
ECARRELHT

SEQ ID NO: 1314749 - protein, 9 aa, Homo Sapiens
CYVAFLPEE

SEQ ID NO: 1314750 - protein, 9 aa, Homo Sapiens
QIKKQKTNI

SEQ ID NO: 1314751 - protein, 9 aa, Homo Sapiens
LNGDGTVYF

SEQ ID NO: 1314752 - protein, 9 aa, Homo Sapiens
EVRAIRHSF

SEQ ID NO: 1314753 - protein, 9 aa, Homo Sapiens
KQIIKICAQ

SEQ ID NO: 1314754 - protein, 9 aa, Homo Sapiens
ELIKILAYD

SEQ ID NO: 1314755 - protein, 9 aa, Homo Sapiens
VLVVLDTSW

SEQ ID NO: 1314756 - protein, 9 aa, Homo Sapiens
CEMSTMNID

SEQ ID NO: 1314757 - protein, 9 aa, Homo Sapiens
PSRNPSATP

SEQ ID NO: 1314758 - protein, 9 aa, Homo Sapiens
FPCSRLLPW

SEQ ID NO: 1314759 - protein, 9 aa, Homo Sapiens
CDGTFVKEY

SEQ ID NO: 1314760 - protein, 9 aa, Homo Sapiens
DFPSQLQMK

SEQ ID NO: 1314761 - protein, 9 aa, Homo Sapiens
RHMQSINAG

SEQ ID NO: 1314762 - protein, 9 aa, Homo Sapiens
HGLQGPHTA

SEQ ID NO: 1314763 - protein, 9 aa, Homo Sapiens
VSNYWMNVI

SEQ ID NO: 1314764 - protein, 9 aa, Homo Sapiens
QNPPIFPPP

SEQ ID NO: 1314765 - protein, 9 aa, Homo Sapiens
SMLKQRRES

SEQ ID NO: 1314766 - protein, 9 aa, Homo Sapiens
TGRSRKMHS

SEQ ID NO: 1314767 - protein, 9 aa, Homo Sapiens
AALALDVAV

SEQ ID NO: 1314768 - protein, 9 aa, Homo Sapiens
SIPAKSSVP

SEQ ID NO: 1314769 - protein, 9 aa, Homo Sapiens
GAGPGGSQS

SEQ ID NO: 1314770 - protein, 9 aa, Homo Sapiens
VPQQPTLSP

SEQ ID NO: 1314771 - protein, 9 aa, Homo Sapiens
RPSEGPHKG

SEQ ID NO: 1314772 - protein, 9 aa, Homo Sapiens
KSISLTKAS

SEQ ID NO: 1314773 - protein, 9 aa, Homo Sapiens
AGYAYRHIF

SEQ ID NO: 1314774 - protein, 9 aa, Homo Sapiens
SGRRQWQSI

SEQ ID NO: 1314775 - protein, 9 aa, Homo Sapiens
LIAHVHQHT

SEQ ID NO: 1314776 - protein, 9 aa, Homo Sapiens
RGPFGGPNY

SEQ ID NO: 1314777 - protein, 9 aa, Homo Sapiens
SRLHRVGRF

SEQ ID NO: 1314778 - protein, 9 aa, Homo Sapiens
WFPGSPQAA

SEQ ID NO: 1314779 - protein, 9 aa, Homo Sapiens
DGRMNYEEF

SEQ ID NO: 1314780 - protein, 9 aa, Homo Sapiens
CLARQIEKS

SEQ ID NO: 1314781 - protein, 9 aa, Homo Sapiens
FPNYCTPPH

SEQ ID NO: 1314782 - protein, 9 aa, Homo Sapiens
ALSCRTRRR

SEQ ID NO: 1314783 - protein, 9 aa, Homo Sapiens
VEDCNNCRC

SEQ ID NO: 1314784 - protein, 9 aa, Homo Sapiens
QSLNQFMTV

SEQ ID NO: 1314785 - protein, 9 aa, Homo Sapiens
ASTQARSPS

SEQ ID NO: 1314786 - protein, 9 aa, Homo Sapiens
LIGEKDLHL

SEQ ID NO: 1314787 - protein, 9 aa, Homo Sapiens
LFFCFGISQ

SEQ ID NO: 1314788 - protein, 9 aa, Homo Sapiens
HQSKGLEEE

SEQ ID NO: 1314789 - protein, 9 aa, Homo Sapiens
ESEMVFNDC

SEQ ID NO: 1314790 - protein, 9 aa, Homo Sapiens
PVDISLSLY

SEQ ID NO: 1314791 - protein, 9 aa, Homo Sapiens
LVLFNCSIA

SEQ ID NO: 1314792 - protein, 9 aa, Homo Sapiens
DPDGRRRRH

SEQ ID NO: 1314793 - protein, 9 aa, Homo Sapiens
HADAENAMR

SEQ ID NO: 1314794 - protein, 9 aa, Homo Sapiens
VDFANDQEQ

SEQ ID NO: 1314795 - protein, 9 aa, Homo Sapiens
SRTSPVTRH

SEQ ID NO: 1314796 - protein, 9 aa, Homo Sapiens
LCPHARASW

SEQ ID NO: 1314797 - protein, 9 aa, Homo Sapiens
RAETSPSSA

SEQ ID NO: 1314798 - protein, 9 aa, Homo Sapiens
RMEQMVFLS

SEQ ID NO: 1314799 - protein, 9 aa, Homo Sapiens
GRMNYEEFA

SEQ ID NO: 1314800 - protein, 9 aa, Homo Sapiens
CMPQSVFLQ

SEQ ID NO: 1314801 - protein, 9 aa, Homo Sapiens
CSAVGLNIF

SEQ ID NO: 1314802 - protein, 9 aa, Homo Sapiens
KPTTPVSPS

SEQ ID NO: 1314803 - protein, 9 aa, Homo Sapiens
PCPSMFAHG

SEQ ID NO: 1314804 - protein, 9 aa, Homo Sapiens
IAHRLSTVH

SEQ ID NO: 1314805 - protein, 9 aa, Homo Sapiens
IRDVKCVSN

SEQ ID NO: 1314806 - protein, 9 aa, Homo Sapiens
WKHVFVLSE

SEQ ID NO: 1314807 - protein, 9 aa, Homo Sapiens
TCGEAFNCR

SEQ ID NO: 1314808 - protein, 9 aa, Homo Sapiens
VRGEWRQGG

SEQ ID NO: 1314809 - protein, 9 aa, Homo Sapiens
LMPKFLNST

SEQ ID NO: 1314810 - protein, 9 aa, Homo Sapiens
KKQIVPLIK

SEQ ID NO: 1314811 - protein, 9 aa, Homo Sapiens
LEGRPDGLH

SEQ ID NO: 1314812 - protein, 9 aa, Homo Sapiens
PFITVPLMP

SEQ ID NO: 1314813 - protein, 9 aa, Homo Sapiens
QEEENEEDG

SEQ ID NO: 1314814 - protein, 9 aa, Homo Sapiens
FLYKDRYEE

SEQ ID NO: 1314815 - protein, 9 aa, Homo Sapiens
TREGLPVRL

SEQ ID NO: 1314816 - protein, 9 aa, Homo Sapiens
VPEAAAQSP

SEQ ID NO: 1314817 - protein, 9 aa, Homo Sapiens
SELLFECYR

SEQ ID NO: 1314818 - protein, 9 aa, Homo Sapiens
IMKQIQDAK

SEQ ID NO: 1314819 - protein, 9 aa, Homo Sapiens
ASKSVLSAI

SEQ ID NO: 1314820 - protein, 9 aa, Homo Sapiens
IQLREAKGN

SEQ ID NO: 1314821 - protein, 9 aa, Homo Sapiens
DEPHDTVPK

SEQ ID NO: 1314822 - protein, 9 aa, Homo Sapiens
PYNSRRVLY

SEQ ID NO: 1314823 - protein, 9 aa, Homo Sapiens
RVSKRKLGC

SEQ ID NO: 1314824 - protein, 9 aa, Homo Sapiens
ICGTRYKKR

SEQ ID NO: 1314825 - protein, 9 aa, Homo Sapiens
PEYLYHVNK

SEQ ID NO: 1314826 - protein, 9 aa, Homo Sapiens
VGLVQQCQT

SEQ ID NO: 1314827 - protein, 9 aa, Homo Sapiens
STWRSAYAF

SEQ ID NO: 1314828 - protein, 9 aa, Homo Sapiens
LVYLIPHDV

SEQ ID NO: 1314829 - protein, 9 aa, Homo Sapiens
YAITDVAFC

SEQ ID NO: 1314830 - protein, 9 aa, Homo Sapiens
IGLSRAWRP

SEQ ID NO: 1314831 - protein, 9 aa, Homo Sapiens
LCQCDKKRG

SEQ ID NO: 1314832 - protein, 9 aa, Homo Sapiens
LSLPSRWDD

SEQ ID NO: 1314833 - protein, 9 aa, Homo Sapiens
KCLMKRHVH

SEQ ID NO: 1314834 - protein, 9 aa, Homo Sapiens
KKLQKKKNK

SEQ ID NO: 1314835 - protein, 9 aa, Homo Sapiens
NSSIYSHPI

SEQ ID NO: 1314836 - protein, 9 aa, Homo Sapiens
KKCRACFGL

SEQ ID NO: 1314837 - protein, 9 aa, Homo Sapiens
PKGKKGESG

SEQ ID NO: 1314838 - protein, 9 aa, Homo Sapiens
QKRQTRESN

SEQ ID NO: 1314839 - protein, 9 aa, Homo Sapiens
ISMHNAARE

SEQ ID NO: 1314840 - protein, 9 aa, Homo Sapiens
GLVFTTQLG

SEQ ID NO: 1314841 - protein, 9 aa, Homo Sapiens
SLYKDKEKA

SEQ ID NO: 1314842 - protein, 9 aa, Homo Sapiens
DRYIKINQS

SEQ ID NO: 1314843 - protein, 9 aa, Homo Sapiens
QLLHRKSKS

SEQ ID NO: 1314844 - protein, 9 aa, Homo Sapiens
SVILNQCTG

SEQ ID NO: 1314845 - protein, 9 aa, Homo Sapiens
LQEVLGCVV

SEQ ID NO: 1314846 - protein, 9 aa, Homo Sapiens
LEADHVISV

SEQ ID NO: 1314847 - protein, 9 aa, Homo Sapiens
QLRLPLGNG

SEQ ID NO: 1314848 - protein, 9 aa, Homo Sapiens
HRRMNNLMD

SEQ ID NO: 1314849 - protein, 9 aa, Homo Sapiens
LSTEQVYNA

SEQ ID NO: 1314850 - protein, 9 aa, Homo Sapiens
CWPGTKKTF

SEQ ID NO: 1314851 - protein, 9 aa, Homo Sapiens
EVMYPALPP

SEQ ID NO: 1314852 - protein, 9 aa, Homo Sapiens
ENVCNWVVN

SEQ ID NO: 1314853 - protein, 9 aa, Homo Sapiens
SQHKGGHEP

SEQ ID NO: 1314854 - protein, 9 aa, Homo Sapiens
CLPFCGHNI

SEQ ID NO: 1314855 - protein, 9 aa, Homo Sapiens
SNTPAHKIT

SEQ ID NO: 1314856 - protein, 9 aa, Homo Sapiens
TMGFKTLRT

SEQ ID NO: 1314857 - protein, 9 aa, Homo Sapiens
PPVKSTLIL

SEQ ID NO: 1314858 - protein, 9 aa, Homo Sapiens
GSLSSCGWA

SEQ ID NO: 1314859 - protein, 9 aa, Homo Sapiens
HAAALALDV

SEQ ID NO: 1314860 - protein, 9 aa, Homo Sapiens
QEREECRAE

SEQ ID NO: 1314861 - protein, 9 aa, Homo Sapiens
NCRGVIANS

SEQ ID NO: 1314862 - protein, 9 aa, Homo Sapiens
PKDKKDIPV

SEQ ID NO: 1314863 - protein, 9 aa, Homo Sapiens
TTYVSSLTR

SEQ ID NO: 1314864 - protein, 9 aa, Homo Sapiens
SFITQLSDL

SEQ ID NO: 1314865 - protein, 9 aa, Homo Sapiens
EMKKGSNDY

SEQ ID NO: 1314866 - protein, 9 aa, Homo Sapiens
AEAKVVCEF

SEQ ID NO: 1314867 - protein, 9 aa, Homo Sapiens
FTMHQQDIN

SEQ ID NO: 1314868 - protein, 9 aa, Homo Sapiens
LMLNTWPAI

SEQ ID NO: 1314869 - protein, 9 aa, Homo Sapiens
TREAHEAAR

SEQ ID NO: 1314870 - protein, 9 aa, Homo Sapiens
CIYKYIEYH

SEQ ID NO: 1314871 - protein, 9 aa, Homo Sapiens
RTRPNRVLT

SEQ ID NO: 1314872 - protein, 9 aa, Homo Sapiens
RSPLRTSLT

SEQ ID NO: 1314873 - protein, 9 aa, Homo Sapiens
HVSHSQYQG

SEQ ID NO: 1314874 - protein, 9 aa, Homo Sapiens
GAGSPTLGR

SEQ ID NO: 1314875 - protein, 9 aa, Homo Sapiens
TVALIEAVT

SEQ ID NO: 1314876 - protein, 9 aa, Homo Sapiens
RRLWRSSSL

SEQ ID NO: 1314877 - protein, 9 aa, Homo Sapiens
LETGDEHSS

SEQ ID NO: 1314878 - protein, 9 aa, Homo Sapiens
RVLESELKH

SEQ ID NO: 1314879 - protein, 9 aa, Homo Sapiens
NTNSISVFQ

SEQ ID NO: 1314880 - protein, 9 aa, Homo Sapiens
YRIPKVAYG

SEQ ID NO: 1314881 - protein, 9 aa, Homo Sapiens
HGMPKRIVN

SEQ ID NO: 1314882 - protein, 9 aa, Homo Sapiens
VNQFAGKAP

SEQ ID NO: 1314883 - protein, 9 aa, Homo Sapiens
NIFIADFEL

SEQ ID NO: 1314884 - protein, 9 aa, Homo Sapiens
KLMRDVKIY

SEQ ID NO: 1314885 - protein, 9 aa, Homo Sapiens
GHEPHCLCI

SEQ ID NO: 1314886 - protein, 9 aa, Homo Sapiens
VPRLLLPHQ

SEQ ID NO: 1314887 - protein, 9 aa, Homo Sapiens
CHLCKKQGA

SEQ ID NO: 1314888 - protein, 9 aa, Homo Sapiens
SFHSPEKLG

SEQ ID NO: 1314889 - protein, 9 aa, Homo Sapiens
AKVVCEFEG

SEQ ID NO: 1314890 - protein, 9 aa, Homo Sapiens
ECNECGNVF

SEQ ID NO: 1314891 - protein, 9 aa, Homo Sapiens
SPNLDKRQS

SEQ ID NO: 1314892 - protein, 9 aa, Homo Sapiens
GPLEQILPP

SEQ ID NO: 1314893 - protein, 9 aa, Homo Sapiens
GVLMFEMMT

SEQ ID NO: 1314894 - protein, 9 aa, Homo Sapiens
GTGCIADLL

SEQ ID NO: 1314895 - protein, 9 aa, Homo Sapiens
VQDAMELAA

SEQ ID NO: 1314896 - protein, 9 aa, Homo Sapiens
ICNGKQPNM

SEQ ID NO: 1314897 - protein, 9 aa, Homo Sapiens
EDLRTRTQL

SEQ ID NO: 1314898 - protein, 9 aa, Homo Sapiens
LHFVKDEKN

SEQ ID NO: 1314899 - protein, 9 aa, Homo Sapiens
DTLCKRLYR

SEQ ID NO: 1314900 - protein, 9 aa, Homo Sapiens
SLNVLPKKG

SEQ ID NO: 1314901 - protein, 9 aa, Homo Sapiens
MDKYTNLVT

SEQ ID NO: 1314902 - protein, 9 aa, Homo Sapiens
PCCPCMTLA

SEQ ID NO: 1314903 - protein, 9 aa, Homo Sapiens
LSLLIDTLL

SEQ ID NO: 1314904 - protein, 9 aa, Homo Sapiens
PPTTKEDVM

SEQ ID NO: 1314905 - protein, 9 aa, Homo Sapiens
EWLCLENTP

SEQ ID NO: 1314906 - protein, 9 aa, Homo Sapiens
WAPFSVGLH

SEQ ID NO: 1314907 - protein, 9 aa, Homo Sapiens
PMCSERCCS

SEQ ID NO: 1314908 - protein, 9 aa, Homo Sapiens
AAVATVLSF

SEQ ID NO: 1314909 - protein, 9 aa, Homo Sapiens
FYEWSIKLN

SEQ ID NO: 1314910 - protein, 9 aa, Homo Sapiens
DPKGRHSFQ

SEQ ID NO: 1314911 - protein, 9 aa, Homo Sapiens
VDWCLFRNI

SEQ ID NO: 1314912 - protein, 9 aa, Homo Sapiens
GCTEPEIWD

SEQ ID NO: 1314913 - protein, 9 aa, Homo Sapiens
VRDVSTTFL

SEQ ID NO: 1314914 - protein, 9 aa, Homo Sapiens
LKRFFLLKH

SEQ ID NO: 1314915 - protein, 9 aa, Homo Sapiens
RMYFQPYTY

SEQ ID NO: 1314916 - protein, 9 aa, Homo Sapiens
YCVFKTVNR

SEQ ID NO: 1314917 - protein, 9 aa, Homo Sapiens
GPNLILCSV

SEQ ID NO: 1314918 - protein, 9 aa, Homo Sapiens
EEERWAEFY

SEQ ID NO: 1314919 - protein, 9 aa, Homo Sapiens
SPVEEKDKS

SEQ ID NO: 1314920 - protein, 9 aa, Homo Sapiens
LFHSRQYLP

SEQ ID NO: 1314921 - protein, 9 aa, Homo Sapiens
PRSGTSSKG

SEQ ID NO: 1314922 - protein, 9 aa, Homo Sapiens
ASTPRDEEP

SEQ ID NO: 1314923 - protein, 9 aa, Homo Sapiens
SSRQTGIPA

SEQ ID NO: 1314924 - protein, 9 aa, Homo Sapiens
WRLGQEIMH

SEQ ID NO: 1314925 - protein, 9 aa, Homo Sapiens
WGQLLLLLL

SEQ ID NO: 1314926 - protein, 9 aa, Homo Sapiens
EIEFLQNME

SEQ ID NO: 1314927 - protein, 9 aa, Homo Sapiens
AQRPGPPHP

SEQ ID NO: 1314928 - protein, 9 aa, Homo Sapiens
EEMLTCIIC

SEQ ID NO: 1314929 - protein, 9 aa, Homo Sapiens
LFFWQCGCH

SEQ ID NO: 1314930 - protein, 9 aa, Homo Sapiens
DRAWYLIVW

SEQ ID NO: 1314931 - protein, 9 aa, Homo Sapiens
SKPDVIMLL

SEQ ID NO: 1314932 - protein, 9 aa, Homo Sapiens
LHARAGERA

SEQ ID NO: 1314933 - protein, 9 aa, Homo Sapiens
LRHGVCVLR

SEQ ID NO: 1314934 - protein, 9 aa, Homo Sapiens
KMYGCELCG

SEQ ID NO: 1314935 - protein, 9 aa, Homo Sapiens
ESLILQSQV

SEQ ID NO: 1314936 - protein, 9 aa, Homo Sapiens
TLNAEQSEV

SEQ ID NO: 1314937 - protein, 9 aa, Homo Sapiens
AREQDCAHA

SEQ ID NO: 1314938 - protein, 9 aa, Homo Sapiens
QVAFDSFIL

SEQ ID NO: 1314939 - protein, 9 aa, Homo Sapiens
GGCCREDVM

SEQ ID NO: 1314940 - protein, 9 aa, Homo Sapiens
LAVGLALFL

SEQ ID NO: 1314941 - protein, 9 aa, Homo Sapiens
TWRTEVVFS

SEQ ID NO: 1314942 - protein, 9 aa, Homo Sapiens
KLFNLLDED

SEQ ID NO: 1314943 - protein, 9 aa, Homo Sapiens
LLLQHNLWK

SEQ ID NO: 1314944 - protein, 9 aa, Homo Sapiens
YNIHTDSWT

SEQ ID NO: 1314945 - protein, 9 aa, Homo Sapiens
VAELALVGP

SEQ ID NO: 1314946 - protein, 9 aa, Homo Sapiens
WWSCGEKTV

SEQ ID NO: 1314947 - protein, 9 aa, Homo Sapiens
VLYVDSRSY

SEQ ID NO: 1314948 - protein, 9 aa, Homo Sapiens
TFFNIPLMA

SEQ ID NO: 1314949 - protein, 9 aa, Homo Sapiens
SAHPSRPCR

SEQ ID NO: 1314950 - protein, 9 aa, Homo Sapiens
GRSRKMHSW

SEQ ID NO: 1314951 - protein, 9 aa, Homo Sapiens
ARMHLMKHD

SEQ ID NO: 1314952 - protein, 9 aa, Homo Sapiens
GAMAEEEWR

SEQ ID NO: 1314953 - protein, 9 aa, Homo Sapiens
YRDWTLCYT

SEQ ID NO: 1314954 - protein, 9 aa, Homo Sapiens
EVRSRVSIA

SEQ ID NO: 1314955 - protein, 9 aa, Homo Sapiens
SPEPLQRPG

SEQ ID NO: 1314956 - protein, 9 aa, Homo Sapiens
MTVRRSGAI

SEQ ID NO: 1314957 - protein, 9 aa, Homo Sapiens
AGNAKLSGS

SEQ ID NO: 1314958 - protein, 9 aa, Homo Sapiens
VKKIMSLVR

SEQ ID NO: 1314959 - protein, 9 aa, Homo Sapiens
KEERCRVEE

SEQ ID NO: 1314960 - protein, 9 aa, Homo Sapiens
RVLGKAVLW

SEQ ID NO: 1314961 - protein, 9 aa, Homo Sapiens
LPIILMTIA

SEQ ID NO: 1314962 - protein, 9 aa, Homo Sapiens
LCRFRIYSN

SEQ ID NO: 1314963 - protein, 9 aa, Homo Sapiens
ADLIEWDRT

SEQ ID NO: 1314964 - protein, 9 aa, Homo Sapiens
RPSTAARAS

SEQ ID NO: 1314965 - protein, 9 aa, Homo Sapiens
MKELNERQQ

SEQ ID NO: 1314966 - protein, 9 aa, Homo Sapiens
HIHCWLSPP

SEQ ID NO: 1314967 - protein, 9 aa, Homo Sapiens
NLSNTIMGS

SEQ ID NO: 1314968 - protein, 9 aa, Homo Sapiens
QQPWDPQMS

SEQ ID NO: 1314969 - protein, 9 aa, Homo Sapiens
MSTTGWLER

SEQ ID NO: 1314970 - protein, 9 aa, Homo Sapiens
LDKRTKVCG

SEQ ID NO: 1314971 - protein, 9 aa, Homo Sapiens
LTAVEFITV

SEQ ID NO: 1314972 - protein, 9 aa, Homo Sapiens
RAWSSFCTS

SEQ ID NO: 1314973 - protein, 9 aa, Homo Sapiens
VVVHELGVA

SEQ ID NO: 1314974 - protein, 9 aa, Homo Sapiens
ISFMKGKMM

SEQ ID NO: 1314975 - protein, 9 aa, Homo Sapiens
RDIMTFANS

SEQ ID NO: 1314976 - protein, 9 aa, Homo Sapiens
ITQLSDLTD

SEQ ID NO: 1314977 - protein, 9 aa, Homo Sapiens
MWICMELMD

SEQ ID NO: 1314978 - protein, 9 aa, Homo Sapiens
NRGAVFQHG

SEQ ID NO: 1314979 - protein, 9 aa, Homo Sapiens
RCNTLQLHR

SEQ ID NO: 1314980 - protein, 9 aa, Homo Sapiens
VQVTRETEW

SEQ ID NO: 1314981 - protein, 9 aa, Homo Sapiens
KQMVGGSLS

SEQ ID NO: 1314982 - protein, 9 aa, Homo Sapiens
GERYIASVQ

SEQ ID NO: 1314983 - protein, 9 aa, Homo Sapiens
TVKAHDNSC

SEQ ID NO: 1314984 - protein, 9 aa, Homo Sapiens
LVTQQVAQQ

SEQ ID NO: 1314985 - protein, 9 aa, Homo Sapiens
SPKSPANGV

SEQ ID NO: 1314986 - protein, 9 aa, Homo Sapiens
ADLVTAEKC

SEQ ID NO: 1314987 - protein, 9 aa, Homo Sapiens
GPDPGSLAP

SEQ ID NO: 1314988 - protein, 9 aa, Homo Sapiens
STLMDISDM

SEQ ID NO: 1314989 - protein, 9 aa, Homo Sapiens
GPHKGLAHC

SEQ ID NO: 1314990 - protein, 9 aa, Homo Sapiens
FSPQSSSLH

SEQ ID NO: 1314991 - protein, 9 aa, Homo Sapiens
ESGSGFNPF

SEQ ID NO: 1314992 - protein, 9 aa, Homo Sapiens
AVGCTEPEI

SEQ ID NO: 1314993 - protein, 9 aa, Homo Sapiens
FVQELRKWG

SEQ ID NO: 1314994 - protein, 9 aa, Homo Sapiens
VVLARDIEH

SEQ ID NO: 1314995 - protein, 9 aa, Homo Sapiens
TQSQPSGAP

SEQ ID NO: 1314996 - protein, 9 aa, Homo Sapiens
PTLSTDTLC

SEQ ID NO: 1314997 - protein, 9 aa, Homo Sapiens
KPSLDQQCS

SEQ ID NO: 1314998 - protein, 9 aa, Homo Sapiens
EGHIYLKNK

SEQ ID NO: 1314999 - protein, 9 aa, Homo Sapiens
DPSPDYCVH

SEQ ID NO: 1315000 - protein, 9 aa, Homo Sapiens
SVVVCVLLW

SEQ ID NO: 1315001 - protein, 9 aa, Homo Sapiens
SQMGPWDVI

SEQ ID NO: 1315002 - protein, 9 aa, Homo Sapiens
WSLDPVSQD

SEQ ID NO: 1315003 - protein, 9 aa, Homo Sapiens
DQAHLYSCL

SEQ ID NO: 1315004 - protein, 9 aa, Homo Sapiens
LFIVLFAIG

SEQ ID NO: 1315005 - protein, 9 aa, Homo Sapiens
VCCPEKICH

SEQ ID NO: 1315006 - protein, 9 aa, Homo Sapiens
QSVGDYSGR

SEQ ID NO: 1315007 - protein, 9 aa, Homo Sapiens
PMSNPIDEM

SEQ ID NO: 1315008 - protein, 9 aa, Homo Sapiens
PECYPDNPV

SEQ ID NO: 1315009 - protein, 9 aa, Homo Sapiens
TERSPASTS

SEQ ID NO: 1315010 - protein, 9 aa, Homo Sapiens
LRPVDIDGS

SEQ ID NO: 1315011 - protein, 9 aa, Homo Sapiens
LLRQLGKGT

SEQ ID NO: 1315012 - protein, 9 aa, Homo Sapiens
QSPLIFIFA

SEQ ID NO: 1315013 - protein, 9 aa, Homo Sapiens
WNAICIGMY

SEQ ID NO: 1315014 - protein, 9 aa, Homo Sapiens
MITDYMFWL

SEQ ID NO: 1315015 - protein, 9 aa, Homo Sapiens
MYSHITARA

SEQ ID NO: 1315016 - protein, 9 aa, Homo Sapiens
TTYRSKCLM

SEQ ID NO: 1315017 - protein, 9 aa, Homo Sapiens
SPGSVPVPG

SEQ ID NO: 1315018 - protein, 9 aa, Homo Sapiens
VVIVFFVIF

SEQ ID NO: 1315019 - protein, 9 aa, Homo Sapiens
SFPPGSCKK

SEQ ID NO: 1315020 - protein, 9 aa, Homo Sapiens
APAAPKILR

SEQ ID NO: 1315021 - protein, 9 aa, Homo Sapiens
LHQSPSGTR

SEQ ID NO: 1315022 - protein, 9 aa, Homo Sapiens
EGLYTCQTC

SEQ ID NO: 1315023 - protein, 9 aa, Homo Sapiens
QFINGEMQF

SEQ ID NO: 1315024 - protein, 9 aa, Homo Sapiens
ACTSTLTTT

SEQ ID NO: 1315025 - protein, 9 aa, Homo Sapiens
IVDVINENV

SEQ ID NO: 1315026 - protein, 9 aa, Homo Sapiens
KRQLQEEIR

SEQ ID NO: 1315027 - protein, 9 aa, Homo Sapiens
PSGSSSDSS

SEQ ID NO: 1315028 - protein, 9 aa, Homo Sapiens
SHNDDTLLK

SEQ ID NO: 1315029 - protein, 9 aa, Homo Sapiens
HPSPCMRRS

SEQ ID NO: 1315030 - protein, 9 aa, Homo Sapiens
TDVIFDEWM

SEQ ID NO: 1315031 - protein, 9 aa, Homo Sapiens
RDRSPLCRA

SEQ ID NO: 1315032 - protein, 9 aa, Homo Sapiens
GHLHTHSVS

SEQ ID NO: 1315033 - protein, 9 aa, Homo Sapiens
MKPCRLLKM

SEQ ID NO: 1315034 - protein, 9 aa, Homo Sapiens
STMDADSEE

SEQ ID NO: 1315035 - protein, 9 aa, Homo Sapiens
HGTPDSKEK

SEQ ID NO: 1315036 - protein, 9 aa, Homo Sapiens
RMVPSNAHF

SEQ ID NO: 1315037 - protein, 9 aa, Homo Sapiens
TIQIAINNG

SEQ ID NO: 1315038 - protein, 9 aa, Homo Sapiens
DTVRVIFTD

SEQ ID NO: 1315039 - protein, 9 aa, Homo Sapiens
VPENLALGM

SEQ ID NO: 1315040 - protein, 9 aa, Homo Sapiens
ICGFRQVKD

SEQ ID NO: 1315041 - protein, 9 aa, Homo Sapiens
HFFITPRQS

SEQ ID NO: 1315042 - protein, 9 aa, Homo Sapiens
KKMCTKIDY

SEQ ID NO: 1315043 - protein, 9 aa, Homo Sapiens
PYGYGSGWS

SEQ ID NO: 1315044 - protein, 9 aa, Homo Sapiens
KKPEFHSCF

SEQ ID NO: 1315045 - protein, 9 aa, Homo Sapiens
FILAVSRPH

SEQ ID NO: 1315046 - protein, 9 aa, Homo Sapiens
QGLTCNRSS

SEQ ID NO: 1315047 - protein, 9 aa, Homo Sapiens
PPRQNQVPR

SEQ ID NO: 1315048 - protein, 9 aa, Homo Sapiens
STCSLPCRG

SEQ ID NO: 1315049 - protein, 9 aa, Homo Sapiens
AHRKMHAAE

SEQ ID NO: 1315050 - protein, 9 aa, Homo Sapiens
TVSVMSAPA

SEQ ID NO: 1315051 - protein, 9 aa, Homo Sapiens
GTVALHEIR

SEQ ID NO: 1315052 - protein, 9 aa, Homo Sapiens
GAHPMPVYA

SEQ ID NO: 1315053 - protein, 9 aa, Homo Sapiens
ARKDLRVKM

SEQ ID NO: 1315054 - protein, 9 aa, Homo Sapiens
GHFQVRGNP

SEQ ID NO: 1315055 - protein, 9 aa, Homo Sapiens
VPKRPDTCF

SEQ ID NO: 1315056 - protein, 9 aa, Homo Sapiens
ITFNPTNNK

SEQ ID NO: 1315057 - protein, 9 aa, Homo Sapiens
NEDNVKSVP

SEQ ID NO: 1315058 - protein, 9 aa, Homo Sapiens
HYERLVLSY

SEQ ID NO: 1315059 - protein, 9 aa, Homo Sapiens
WSGRIVSWW

SEQ ID NO: 1315060 - protein, 9 aa, Homo Sapiens
LEVAVHGRT

SEQ ID NO: 1315061 - protein, 9 aa, Homo Sapiens
HQRSLWEPS

SEQ ID NO: 1315062 - protein, 9 aa, Homo Sapiens
LLPPKDDTA

SEQ ID NO: 1315063 - protein, 9 aa, Homo Sapiens
LKGEADQSA

SEQ ID NO: 1315064 - protein, 9 aa, Homo Sapiens
EVAVHGRTA

SEQ ID NO: 1315065 - protein, 9 aa, Homo Sapiens
QEERAAGTG

SEQ ID NO: 1315066 - protein, 9 aa, Homo Sapiens
FMLMLDVLM

SEQ ID NO: 1315067 - protein, 9 aa, Homo Sapiens
DRTGVTGYH

SEQ ID NO: 1315068 - protein, 9 aa, Homo Sapiens
NVRYSAIKT

SEQ ID NO: 1315069 - protein, 9 aa, Homo Sapiens
DCQMCSSQK

SEQ ID NO: 1315070 - protein, 9 aa, Homo Sapiens
SSAPSRTWQ

SEQ ID NO: 1315071 - protein, 9 aa, Homo Sapiens
DIWAIHVLR

SEQ ID NO: 1315072 - protein, 9 aa, Homo Sapiens
SGEAVRHPI

SEQ ID NO: 1315073 - protein, 9 aa, Homo Sapiens
QQATPDDRN

SEQ ID NO: 1315074 - protein, 9 aa, Homo Sapiens
PMLPSQHTQ

SEQ ID NO: 1315075 - protein, 9 aa, Homo Sapiens
GKTMVMNMF

SEQ ID NO: 1315076 - protein, 9 aa, Homo Sapiens
YGMLHFLLG

SEQ ID NO: 1315077 - protein, 9 aa, Homo Sapiens
LVNDIVTAG

SEQ ID NO: 1315078 - protein, 9 aa, Homo Sapiens
EQARVRAAR

SEQ ID NO: 1315079 - protein, 9 aa, Homo Sapiens
TLIGEPAVI

SEQ ID NO: 1315080 - protein, 9 aa, Homo Sapiens
RSGPHRQLN

SEQ ID NO: 1315081 - protein, 9 aa, Homo Sapiens
VCCRRCESM

SEQ ID NO: 1315082 - protein, 9 aa, Homo Sapiens
PPHRSEPIY

SEQ ID NO: 1315083 - protein, 9 aa, Homo Sapiens
NNPHKNICW

SEQ ID NO: 1315084 - protein, 9 aa, Homo Sapiens
GTVTTLTDL

SEQ ID NO: 1315085 - protein, 9 aa, Homo Sapiens
LGLDQKMCP

SEQ ID NO: 1315086 - protein, 9 aa, Homo Sapiens
GELVIVRIL

SEQ ID NO: 1315087 - protein, 9 aa, Homo Sapiens
VRDKLTGRG

SEQ ID NO: 1315088 - protein, 9 aa, Homo Sapiens
GSAKNPQPV

SEQ ID NO: 1315089 - protein, 9 aa, Homo Sapiens
SLNSSATGH

SEQ ID NO: 1315090 - protein, 9 aa, Homo Sapiens
LPRCVCSTA

SEQ ID NO: 1315091 - protein, 9 aa, Homo Sapiens
ISRVIRLQH

SEQ ID NO: 1315092 - protein, 9 aa, Homo Sapiens
IGRTVMYLY

SEQ ID NO: 1315093 - protein, 9 aa, Homo Sapiens
STRKKWCPY

SEQ ID NO: 1315094 - protein, 9 aa, Homo Sapiens
WWCATSDPE

SEQ ID NO: 1315095 - protein, 9 aa, Homo Sapiens
QKSHFYLVT

SEQ ID NO: 1315096 - protein, 9 aa, Homo Sapiens
VGIRHGSRC

SEQ ID NO: 1315097 - protein, 9 aa, Homo Sapiens
RKWMKTEGD

SEQ ID NO: 1315098 - protein, 9 aa, Homo Sapiens
FITWLRDNR

SEQ ID NO: 1315099 - protein, 9 aa, Homo Sapiens
VGVHLVSEF

SEQ ID NO: 1315100 - protein, 9 aa, Homo Sapiens
YSENCLLAC

SEQ ID NO: 1315101 - protein, 9 aa, Homo Sapiens
EEEPAEVRH

SEQ ID NO: 1315102 - protein, 9 aa, Homo Sapiens
MVDGSMWSI

SEQ ID NO: 1315103 - protein, 9 aa, Homo Sapiens
KKGKKIIEY

SEQ ID NO: 1315104 - protein, 9 aa, Homo Sapiens
VIITLVTCV

SEQ ID NO: 1315105 - protein, 9 aa, Homo Sapiens
HITTITGST

SEQ ID NO: 1315106 - protein, 9 aa, Homo Sapiens
PTDFVRKII

SEQ ID NO: 1315107 - protein, 9 aa, Homo Sapiens
VRYILKDYV

SEQ ID NO: 1315108 - protein, 9 aa, Homo Sapiens
QKKKNKEEE

SEQ ID NO: 1315109 - protein, 9 aa, Homo Sapiens
ISLSSVMDK

SEQ ID NO: 1315110 - protein, 9 aa, Homo Sapiens
VRRRGRRSM

SEQ ID NO: 1315111 - protein, 9 aa, Homo Sapiens
HGDWRDDQC

SEQ ID NO: 1315112 - protein, 9 aa, Homo Sapiens
HPNTFSTFT

SEQ ID NO: 1315113 - protein, 9 aa, Homo Sapiens
AVGLNIFLE

SEQ ID NO: 1315114 - protein, 9 aa, Homo Sapiens
QVTRETEWS

SEQ ID NO: 1315115 - protein, 9 aa, Homo Sapiens
VGAVTAASG

SEQ ID NO: 1315116 - protein, 9 aa, Homo Sapiens
NVQVTNTHV

SEQ ID NO: 1315117 - protein, 9 aa, Homo Sapiens
FSLIVGLTI

SEQ ID NO: 1315118 - protein, 9 aa, Homo Sapiens
GGIIGGFWL

SEQ ID NO: 1315119 - protein, 9 aa, Homo Sapiens
PEELKGLAP

SEQ ID NO: 1315120 - protein, 9 aa, Homo Sapiens
CTVENLSME

SEQ ID NO: 1315121 - protein, 9 aa, Homo Sapiens
SRPPVHIEE

SEQ ID NO: 1315122 - protein, 9 aa, Homo Sapiens
QYNVGLCHE

SEQ ID NO: 1315123 - protein, 9 aa, Homo Sapiens
EEADTPGVI

SEQ ID NO: 1315124 - protein, 9 aa, Homo Sapiens
IGVIKTALP

SEQ ID NO: 1315125 - protein, 9 aa, Homo Sapiens
HRFNRPLLK

SEQ ID NO: 1315126 - protein, 9 aa, Homo Sapiens
ASGSTSRRT

SEQ ID NO: 1315127 - protein, 9 aa, Homo Sapiens
VFSTPNYCD

SEQ ID NO: 1315128 - protein, 9 aa, Homo Sapiens
AAVSRHQTT

SEQ ID NO: 1315129 - protein, 9 aa, Homo Sapiens
GALARKSTL

SEQ ID NO: 1315130 - protein, 9 aa, Homo Sapiens
YRVFADLGL

SEQ ID NO: 1315131 - protein, 9 aa, Homo Sapiens
VLGAQVFAF

SEQ ID NO: 1315132 - protein, 9 aa, Homo Sapiens
DKHLDPLKS

SEQ ID NO: 1315133 - protein, 9 aa, Homo Sapiens
LHLNSLADR

SEQ ID NO: 1315134 - protein, 9 aa, Homo Sapiens
NTVLALAQI

SEQ ID NO: 1315135 - protein, 9 aa, Homo Sapiens
NMERRNHYL

SEQ ID NO: 1315136 - protein, 9 aa, Homo Sapiens
HISSPLASY

SEQ ID NO: 1315137 - protein, 9 aa, Homo Sapiens
LHINSKGCV

SEQ ID NO: 1315138 - protein, 9 aa, Homo Sapiens
LLSALNEEC

SEQ ID NO: 1315139 - protein, 9 aa, Homo Sapiens
SDPQRPHLT

SEQ ID NO: 1315140 - protein, 9 aa, Homo Sapiens
LKKKRIVEN

SEQ ID NO: 1315141 - protein, 9 aa, Homo Sapiens
RDKVYLIRP

SEQ ID NO: 1315142 - protein, 9 aa, Homo Sapiens
FYLPTLLMI

SEQ ID NO: 1315143 - protein, 9 aa, Homo Sapiens
QGLFQYLMR

SEQ ID NO: 1315144 - protein, 9 aa, Homo Sapiens
LIPALVKVL

SEQ ID NO: 1315145 - protein, 9 aa, Homo Sapiens
RSFDTLLAD

SEQ ID NO: 1315146 - protein, 9 aa, Homo Sapiens
KGCTFVKFQ

SEQ ID NO: 1315147 - protein, 9 aa, Homo Sapiens
LGATLFPRK

SEQ ID NO: 1315148 - protein, 9 aa, Homo Sapiens
KLTYAEAKV

SEQ ID NO: 1315149 - protein, 9 aa, Homo Sapiens
TTTVGQMGW

SEQ ID NO: 1315150 - protein, 9 aa, Homo Sapiens
HQPEMAAMR

SEQ ID NO: 1315151 - protein, 9 aa, Homo Sapiens
HSIEGKDCI

SEQ ID NO: 1315152 - protein, 9 aa, Homo Sapiens
VHREFQLDL

SEQ ID NO: 1315153 - protein, 9 aa, Homo Sapiens
LNQCTGKCS

SEQ ID NO: 1315154 - protein, 9 aa, Homo Sapiens
LATDKHFNI

SEQ ID NO: 1315155 - protein, 9 aa, Homo Sapiens
LLIASLFTF

SEQ ID NO: 1315156 - protein, 9 aa, Homo Sapiens
SAVTHLVGF

SEQ ID NO: 1315157 - protein, 9 aa, Homo Sapiens
SYGQILLAV

SEQ ID NO: 1315158 - protein, 9 aa, Homo Sapiens
VIVTFQLTA

SEQ ID NO: 1315159 - protein, 9 aa, Homo Sapiens
IMVTWYWCT

SEQ ID NO: 1315160 - protein, 9 aa, Homo Sapiens
TFMFYCVHW

SEQ ID NO: 1315161 - protein, 9 aa, Homo Sapiens
SLGHQGSWG

SEQ ID NO: 1315162 - protein, 9 aa, Homo Sapiens
ATREEAKIV

SEQ ID NO: 1315163 - protein, 9 aa, Homo Sapiens
FKKTTELTE

SEQ ID NO: 1315164 - protein, 9 aa, Homo Sapiens
PDGHLLFSS

SEQ ID NO: 1315165 - protein, 9 aa, Homo Sapiens
VILNQCTGK

SEQ ID NO: 1315166 - protein, 9 aa, Homo Sapiens
IGHQKCKPD

SEQ ID NO: 1315167 - protein, 9 aa, Homo Sapiens
LVQFHIPNY

SEQ ID NO: 1315168 - protein, 9 aa, Homo Sapiens
LVDIILNFH

SEQ ID NO: 1315169 - protein, 9 aa, Homo Sapiens
HMGIGKWKG

SEQ ID NO: 1315170 - protein, 9 aa, Homo Sapiens
LRGNQLIYY

SEQ ID NO: 1315171 - protein, 9 aa, Homo Sapiens
SDKDQLMAV

SEQ ID NO: 1315172 - protein, 9 aa, Homo Sapiens
GISSYVLRM

SEQ ID NO: 1315173 - protein, 9 aa, Homo Sapiens
STHMVLISG

SEQ ID NO: 1315174 - protein, 9 aa, Homo Sapiens
KKMCAHLFT

SEQ ID NO: 1315175 - protein, 9 aa, Homo Sapiens
IWEEKHITF

SEQ ID NO: 1315176 - protein, 9 aa, Homo Sapiens
LLFYECVLS

SEQ ID NO: 1315177 - protein, 9 aa, Homo Sapiens
VEVHIPENV

SEQ ID NO: 1315178 - protein, 9 aa, Homo Sapiens
HGWCTGAII

SEQ ID NO: 1315179 - protein, 9 aa, Homo Sapiens
HKKTRLLVV

SEQ ID NO: 1315180 - protein, 9 aa, Homo Sapiens
SKKFRLPKG

SEQ ID NO: 1315181 - protein, 9 aa, Homo Sapiens
FTGIEHYHR

SEQ ID NO: 1315182 - protein, 9 aa, Homo Sapiens
GGPNYHIAP

SEQ ID NO: 1315183 - protein, 9 aa, Homo Sapiens
AAHVLRQTP

SEQ ID NO: 1315184 - protein, 9 aa, Homo Sapiens
LRLEATEMQ

SEQ ID NO: 1315185 - protein, 9 aa, Homo Sapiens
QLSLADTLI

SEQ ID NO: 1315186 - protein, 9 aa, Homo Sapiens
DATRNVYHI

SEQ ID NO: 1315187 - protein, 9 aa, Homo Sapiens
SSVQHQLYT

SEQ ID NO: 1315188 - protein, 9 aa, Homo Sapiens
IEEAVKMEM

SEQ ID NO: 1315189 - protein, 9 aa, Homo Sapiens
TVRQETNYV

SEQ ID NO: 1315190 - protein, 9 aa, Homo Sapiens
DTVPLPGSQ

SEQ ID NO: 1315191 - protein, 9 aa, Homo Sapiens
TCQDWLTGI

SEQ ID NO: 1315192 - protein, 9 aa, Homo Sapiens
SNGMHRWWQ

SEQ ID NO: 1315193 - protein, 9 aa, Homo Sapiens
EVGRYKGHR

SEQ ID NO: 1315194 - protein, 9 aa, Homo Sapiens
WAKVTMNDF

SEQ ID NO: 1315195 - protein, 9 aa, Homo Sapiens
KQESYEESS

SEQ ID NO: 1315196 - protein, 9 aa, Homo Sapiens
EPSMTSVTS

SEQ ID NO: 1315197 - protein, 9 aa, Homo Sapiens
PTSSWAVLS

SEQ ID NO: 1315198 - protein, 9 aa, Homo Sapiens
FFSLIVGLT

SEQ ID NO: 1315199 - protein, 9 aa, Homo Sapiens
PARYRKPLE

SEQ ID NO: 1315200 - protein, 9 aa, Homo Sapiens
NHYHQSTAV

SEQ ID NO: 1315201 - protein, 9 aa, Homo Sapiens
GMQLLVVNA

SEQ ID NO: 1315202 - protein, 9 aa, Homo Sapiens
MFSPTHPGR

SEQ ID NO: 1315203 - protein, 9 aa, Homo Sapiens
PNNSNKCVV

SEQ ID NO: 1315204 - protein, 9 aa, Homo Sapiens
VGQPHFVCC

SEQ ID NO: 1315205 - protein, 9 aa, Homo Sapiens
ALGEEHCKV

SEQ ID NO: 1315206 - protein, 9 aa, Homo Sapiens
PYGLPVHGD

SEQ ID NO: 1315207 - protein, 9 aa, Homo Sapiens
KCPDYACPI

SEQ ID NO: 1315208 - protein, 9 aa, Homo Sapiens
ILMPPFVPS

SEQ ID NO: 1315209 - protein, 9 aa, Homo Sapiens
IRINQEPLD

SEQ ID NO: 1315210 - protein, 9 aa, Homo Sapiens
EMCFAKMPD

SEQ ID NO: 1315211 - protein, 9 aa, Homo Sapiens
WSRSRSRDR

SEQ ID NO: 1315212 - protein, 9 aa, Homo Sapiens
HSSLNMHIR

SEQ ID NO: 1315213 - protein, 9 aa, Homo Sapiens
HLGERAQDL

SEQ ID NO: 1315214 - protein, 9 aa, Homo Sapiens
HQGHTIIFC

SEQ ID NO: 1315215 - protein, 9 aa, Homo Sapiens
NNVPPTATS

SEQ ID NO: 1315216 - protein, 9 aa, Homo Sapiens
LSNTDLNKR

SEQ ID NO: 1315217 - protein, 9 aa, Homo Sapiens
YRVWKWGES

SEQ ID NO: 1315218 - protein, 9 aa, Homo Sapiens
CSACTCGCT

SEQ ID NO: 1315219 - protein, 9 aa, Homo Sapiens
QHRRKSLPV

SEQ ID NO: 1315220 - protein, 9 aa, Homo Sapiens
GEKCTKEPG

SEQ ID NO: 1315221 - protein, 9 aa, Homo Sapiens
DTEGKKSGD

SEQ ID NO: 1315222 - protein, 9 aa, Homo Sapiens
GLLPSHVSY

SEQ ID NO: 1315223 - protein, 9 aa, Homo Sapiens
SDYVLHNMM

SEQ ID NO: 1315224 - protein, 9 aa, Homo Sapiens
VFKMHKKGW

SEQ ID NO: 1315225 - protein, 9 aa, Homo Sapiens
PEEVYAVTK

SEQ ID NO: 1315226 - protein, 9 aa, Homo Sapiens
IMVPEDYIN

SEQ ID NO: 1315227 - protein, 9 aa, Homo Sapiens
HWGPYFAEY

SEQ ID NO: 1315228 - protein, 9 aa, Homo Sapiens
EEENEEDGD

SEQ ID NO: 1315229 - protein, 9 aa, Homo Sapiens
NGSVTTSAT

SEQ ID NO: 1315230 - protein, 9 aa, Homo Sapiens
STCFCSVFA

SEQ ID NO: 1315231 - protein, 9 aa, Homo Sapiens
NQVSATSEE

SEQ ID NO: 1315232 - protein, 9 aa, Homo Sapiens
FPRMTPWRP

SEQ ID NO: 1315233 - protein, 9 aa, Homo Sapiens
REVVTRFLM

SEQ ID NO: 1315234 - protein, 9 aa, Homo Sapiens
VRCGVEPKP

SEQ ID NO: 1315235 - protein, 9 aa, Homo Sapiens
SLSKVVQGL

SEQ ID NO: 1315236 - protein, 9 aa, Homo Sapiens
HEASVPASV

SEQ ID NO: 1315237 - protein, 9 aa, Homo Sapiens
PEWCHLAAQ

SEQ ID NO: 1315238 - protein, 9 aa, Homo Sapiens
RAGHQHNAS

SEQ ID NO: 1315239 - protein, 9 aa, Homo Sapiens
THPGRPHTG

SEQ ID NO: 1315240 - protein, 9 aa, Homo Sapiens
DKIFTNTKV

SEQ ID NO: 1315241 - protein, 9 aa, Homo Sapiens
LMSSGDVWI

SEQ ID NO: 1315242 - protein, 9 aa, Homo Sapiens
TSSIVHLCT

SEQ ID NO: 1315243 - protein, 9 aa, Homo Sapiens
ERRHMQSIN

SEQ ID NO: 1315244 - protein, 9 aa, Homo Sapiens
RSLWEPSLP

SEQ ID NO: 1315245 - protein, 9 aa, Homo Sapiens
FRANATKML

SEQ ID NO: 1315246 - protein, 9 aa, Homo Sapiens
YLRHLEGGI

SEQ ID NO: 1315247 - protein, 9 aa, Homo Sapiens
TYFIQLSFV

SEQ ID NO: 1315248 - protein, 9 aa, Homo Sapiens
RAADQTTTE

SEQ ID NO: 1315249 - protein, 9 aa, Homo Sapiens
VVEGKAPSS

SEQ ID NO: 1315250 - protein, 9 aa, Homo Sapiens
PGGNMNITC

SEQ ID NO: 1315251 - protein, 9 aa, Homo Sapiens
QQSASTSVP

SEQ ID NO: 1315252 - protein, 9 aa, Homo Sapiens
LSERCMVKK

SEQ ID NO: 1315253 - protein, 9 aa, Homo Sapiens
PLELFGKVF

SEQ ID NO: 1315254 - protein, 9 aa, Homo Sapiens
LLLAKVMCF

SEQ ID NO: 1315255 - protein, 9 aa, Homo Sapiens
DAATAKTQF

SEQ ID NO: 1315256 - protein, 9 aa, Homo Sapiens
PVNQIQEII

SEQ ID NO: 1315257 - protein, 9 aa, Homo Sapiens
DVIAQLELE

SEQ ID NO: 1315258 - protein, 9 aa, Homo Sapiens
TASDLAHLH

SEQ ID NO: 1315259 - protein, 9 aa, Homo Sapiens
LLFVISSIV

SEQ ID NO: 1315260 - protein, 9 aa, Homo Sapiens
WFPSYLNLI

SEQ ID NO: 1315261 - protein, 9 aa, Homo Sapiens
DKVLADDLE

SEQ ID NO: 1315262 - protein, 9 aa, Homo Sapiens
WGHEVILES

SEQ ID NO: 1315263 - protein, 9 aa, Homo Sapiens
DYEKAFFKM

SEQ ID NO: 1315264 - protein, 9 aa, Homo Sapiens
STEQVYNAD

SEQ ID NO: 1315265 - protein, 9 aa, Homo Sapiens
SRRTRPNRV

SEQ ID NO: 1315266 - protein, 9 aa, Homo Sapiens
GDSKEVSLI

SEQ ID NO: 1315267 - protein, 9 aa, Homo Sapiens
CDKAFRVHV

SEQ ID NO: 1315268 - protein, 9 aa, Homo Sapiens
TNGSVTTSA

SEQ ID NO: 1315269 - protein, 9 aa, Homo Sapiens
HKMEVAFMV

SEQ ID NO: 1315270 - protein, 9 aa, Homo Sapiens
NDNTPAFAQ

SEQ ID NO: 1315271 - protein, 9 aa, Homo Sapiens
CWCPTNSTG

SEQ ID NO: 1315272 - protein, 9 aa, Homo Sapiens
LSGLLDAGK

SEQ ID NO: 1315273 - protein, 9 aa, Homo Sapiens
GHITFNKIN

SEQ ID NO: 1315274 - protein, 9 aa, Homo Sapiens
KERLGLVKL

SEQ ID NO: 1315275 - protein, 9 aa, Homo Sapiens
VAVDGVRAF

SEQ ID NO: 1315276 - protein, 9 aa, Homo Sapiens
QDVRDVSTT

SEQ ID NO: 1315277 - protein, 9 aa, Homo Sapiens
NKTPKEKDT

SEQ ID NO: 1315278 - protein, 9 aa, Homo Sapiens
DNIVEVLRQ

SEQ ID NO: 1315279 - protein, 9 aa, Homo Sapiens
ISKPIMGPG

SEQ ID NO: 1315280 - protein, 9 aa, Homo Sapiens
GHPLSFQQP

SEQ ID NO: 1315281 - protein, 9 aa, Homo Sapiens
KGSNQFHAT

SEQ ID NO: 1315282 - protein, 9 aa, Homo Sapiens
GCVGVSGAL

SEQ ID NO: 1315283 - protein, 9 aa, Homo Sapiens
LVDPKNIDT

SEQ ID NO: 1315284 - protein, 9 aa, Homo Sapiens
PHVFNEGWG

SEQ ID NO: 1315285 - protein, 9 aa, Homo Sapiens
SCLLHITRL

SEQ ID NO: 1315286 - protein, 9 aa, Homo Sapiens
ISKAGEYIR

SEQ ID NO: 1315287 - protein, 9 aa, Homo Sapiens
QCRLETIRN

SEQ ID NO: 1315288 - protein, 9 aa, Homo Sapiens
NIVTYHGSY

SEQ ID NO: 1315289 - protein, 9 aa, Homo Sapiens
NNNISHILV

SEQ ID NO: 1315290 - protein, 9 aa, Homo Sapiens
SRSDLQCCS

SEQ ID NO: 1315291 - protein, 9 aa, Homo Sapiens
TEMQLPIYT

SEQ ID NO: 1315292 - protein, 9 aa, Homo Sapiens
RSLSPKPCD

SEQ ID NO: 1315293 - protein, 9 aa, Homo Sapiens
KCGAHMMRR

SEQ ID NO: 1315294 - protein, 9 aa, Homo Sapiens
LRCTIWIIT

SEQ ID NO: 1315295 - protein, 9 aa, Homo Sapiens
PTQLTQGCM

SEQ ID NO: 1315296 - protein, 9 aa, Homo Sapiens
DQATHLQKS

SEQ ID NO: 1315297 - protein, 9 aa, Homo Sapiens
CQRRAGTKW

SEQ ID NO: 1315298 - protein, 9 aa, Homo Sapiens
IQLFLTLAA

SEQ ID NO: 1315299 - protein, 9 aa, Homo Sapiens
ETDTIGEFI

SEQ ID NO: 1315300 - protein, 9 aa, Homo Sapiens
PGRAGRVAA

SEQ ID NO: 1315301 - protein, 9 aa, Homo Sapiens
DHDYRIQYH

SEQ ID NO: 1315302 - protein, 9 aa, Homo Sapiens
RNNVDLWYN

SEQ ID NO: 1315303 - protein, 9 aa, Homo Sapiens
DDLAETVVK

SEQ ID NO: 1315304 - protein, 9 aa, Homo Sapiens
KPDVIAQLE

SEQ ID NO: 1315305 - protein, 9 aa, Homo Sapiens
ELLPSTSSE

SEQ ID NO: 1315306 - protein, 9 aa, Homo Sapiens
RQHMWRPKR

SEQ ID NO: 1315307 - protein, 9 aa, Homo Sapiens
AFTSLKRSL

SEQ ID NO: 1315308 - protein, 9 aa, Homo Sapiens
LRSSKGTLN

SEQ ID NO: 1315309 - protein, 9 aa, Homo Sapiens
TSMLGSTDI

SEQ ID NO: 1315310 - protein, 9 aa, Homo Sapiens
KKCPDYACP

SEQ ID NO: 1315311 - protein, 9 aa, Homo Sapiens
RQMSFASVH

SEQ ID NO: 1315312 - protein, 9 aa, Homo Sapiens
DLVFMEGPE

SEQ ID NO: 1315313 - protein, 9 aa, Homo Sapiens
EHTLNEKCI

SEQ ID NO: 1315314 - protein, 9 aa, Homo Sapiens
MSGQPPPSS

SEQ ID NO: 1315315 - protein, 9 aa, Homo Sapiens
ASRPTTRSW

SEQ ID NO: 1315316 - protein, 9 aa, Homo Sapiens
PSDYPCLPP

SEQ ID NO: 1315317 - protein, 9 aa, Homo Sapiens
QEHEVCMSH

SEQ ID NO: 1315318 - protein, 9 aa, Homo Sapiens
NFKWKFLTG

SEQ ID NO: 1315319 - protein, 9 aa, Homo Sapiens
TDHQTPQPH

SEQ ID NO: 1315320 - protein, 9 aa, Homo Sapiens
AYTKVKSKD

SEQ ID NO: 1315321 - protein, 9 aa, Homo Sapiens
YRNLHCALC

SEQ ID NO: 1315322 - protein, 9 aa, Homo Sapiens
RHHIEKKIL

SEQ ID NO: 1315323 - protein, 9 aa, Homo Sapiens
IPLRKLKMW

SEQ ID NO: 1315324 - protein, 9 aa, Homo Sapiens
RQHKFYLET

SEQ ID NO: 1315325 - protein, 9 aa, Homo Sapiens
HARTSRPLR

SEQ ID NO: 1315326 - protein, 9 aa, Homo Sapiens
CISSFTPQG

SEQ ID NO: 1315327 - protein, 9 aa, Homo Sapiens
TYQVRLQQS

SEQ ID NO: 1315328 - protein, 9 aa, Homo Sapiens
KENATVTHL

SEQ ID NO: 1315329 - protein, 9 aa, Homo Sapiens
TRNVVCLWL

SEQ ID NO: 1315330 - protein, 9 aa, Homo Sapiens
APFSVGLHM

SEQ ID NO: 1315331 - protein, 9 aa, Homo Sapiens
FQLKNGMGL

SEQ ID NO: 1315332 - protein, 9 aa, Homo Sapiens
ISIFVVGPR

SEQ ID NO: 1315333 - protein, 9 aa, Homo Sapiens
AYSAATAAG

SEQ ID NO: 1315334 - protein, 9 aa, Homo Sapiens
FGHHDIFKI

SEQ ID NO: 1315335 - protein, 9 aa, Homo Sapiens
ALFREGDMW

SEQ ID NO: 1315336 - protein, 9 aa, Homo Sapiens
GALVTATRN

SEQ ID NO: 1315337 - protein, 9 aa, Homo Sapiens
SLCGTRANA

SEQ ID NO: 1315338 - protein, 9 aa, Homo Sapiens
PTATSLIDL

SEQ ID NO: 1315339 - protein, 9 aa, Homo Sapiens
QLSASANSI

SEQ ID NO: 1315340 - protein, 9 aa, Homo Sapiens
AFGPLEALH

SEQ ID NO: 1315341 - protein, 9 aa, Homo Sapiens
EIAGHEPHI

SEQ ID NO: 1315342 - protein, 9 aa, Homo Sapiens
ECLYLNIWV

SEQ ID NO: 1315343 - protein, 9 aa, Homo Sapiens
YCGQRMPAV

SEQ ID NO: 1315344 - protein, 9 aa, Homo Sapiens
VCFEHQFKK

SEQ ID NO: 1315345 - protein, 9 aa, Homo Sapiens
SEHTTIPTR

SEQ ID NO: 1315346 - protein, 9 aa, Homo Sapiens
FQYLMRPKA

SEQ ID NO: 1315347 - protein, 9 aa, Homo Sapiens
LYSIVCGKL

SEQ ID NO: 1315348 - protein, 9 aa, Homo Sapiens
SASTLDQPS

SEQ ID NO: 1315349 - protein, 9 aa, Homo Sapiens
TAMAISEEC

SEQ ID NO: 1315350 - protein, 9 aa, Homo Sapiens
MKDQHLVFH

SEQ ID NO: 1315351 - protein, 9 aa, Homo Sapiens
HPVYESDKN

SEQ ID NO: 1315352 - protein, 9 aa, Homo Sapiens
SQVGGTQEV

SEQ ID NO: 1315353 - protein, 9 aa, Homo Sapiens
DLTSIAENM

SEQ ID NO: 1315354 - protein, 9 aa, Homo Sapiens
KAEYEERTA

SEQ ID NO: 1315355 - protein, 9 aa, Homo Sapiens
KETAGENSE

SEQ ID NO: 1315356 - protein, 9 aa, Homo Sapiens
LLIVKKVCQ

SEQ ID NO: 1315357 - protein, 9 aa, Homo Sapiens
TFDLSDMDN

SEQ ID NO: 1315358 - protein, 9 aa, Homo Sapiens
RYALMDGAH

SEQ ID NO: 1315359 - protein, 9 aa, Homo Sapiens
MAYCLISAK

SEQ ID NO: 1315360 - protein, 9 aa, Homo Sapiens
SEMEYVIRC

SEQ ID NO: 1315361 - protein, 9 aa, Homo Sapiens
SVGDYSGRL

SEQ ID NO: 1315362 - protein, 9 aa, Homo Sapiens
PNNIKKNRY

SEQ ID NO: 1315363 - protein, 9 aa, Homo Sapiens
RVAFFGQAV

SEQ ID NO: 1315364 - protein, 9 aa, Homo Sapiens
IEGKYEKND

SEQ ID NO: 1315365 - protein, 9 aa, Homo Sapiens
TQVVPPEWR

SEQ ID NO: 1315366 - protein, 9 aa, Homo Sapiens
ELVKDVLNI

SEQ ID NO: 1315367 - protein, 9 aa, Homo Sapiens
IGSICLLSV

SEQ ID NO: 1315368 - protein, 9 aa, Homo Sapiens
HCWTKEWRV

SEQ ID NO: 1315369 - protein, 9 aa, Homo Sapiens
SATFAKLCR

SEQ ID NO: 1315370 - protein, 9 aa, Homo Sapiens
SSLKAVTRE

SEQ ID NO: 1315371 - protein, 9 aa, Homo Sapiens
LEHAWLTQH

SEQ ID NO: 1315372 - protein, 9 aa, Homo Sapiens
DGDDFKEPY

SEQ ID NO: 1315373 - protein, 9 aa, Homo Sapiens
REFMRNAVD

SEQ ID NO: 1315374 - protein, 9 aa, Homo Sapiens
TAERCVSLH

SEQ ID NO: 1315375 - protein, 9 aa, Homo Sapiens
KYFRFIVRF

SEQ ID NO: 1315376 - protein, 9 aa, Homo Sapiens
RSSSVGGTS

SEQ ID NO: 1315377 - protein, 9 aa, Homo Sapiens
PDLEDLKHQ

SEQ ID NO: 1315378 - protein, 9 aa, Homo Sapiens
RDYICEYCD

SEQ ID NO: 1315379 - protein, 9 aa, Homo Sapiens
AKNALNGIH

SEQ ID NO: 1315380 - protein, 9 aa, Homo Sapiens
SRKERLGLV

SEQ ID NO: 1315381 - protein, 9 aa, Homo Sapiens
MQMAISRVI

SEQ ID NO: 1315382 - protein, 9 aa, Homo Sapiens
LTVQGHPPG

SEQ ID NO: 1315383 - protein, 9 aa, Homo Sapiens
GVLIPGNLS

SEQ ID NO: 1315384 - protein, 9 aa, Homo Sapiens
FICGFQLTE

SEQ ID NO: 1315385 - protein, 9 aa, Homo Sapiens
TQERHYECA

SEQ ID NO: 1315386 - protein, 9 aa, Homo Sapiens
SLKVLHKLT

SEQ ID NO: 1315387 - protein, 9 aa, Homo Sapiens
PGIKFSTEA

SEQ ID NO: 1315388 - protein, 9 aa, Homo Sapiens
KKKKKERER

SEQ ID NO: 1315389 - protein, 9 aa, Homo Sapiens
TEEDISGLH

SEQ ID NO: 1315390 - protein, 9 aa, Homo Sapiens
GDAAMYGAH

SEQ ID NO: 1315391 - protein, 9 aa, Homo Sapiens
AAKWNQVRK

SEQ ID NO: 1315392 - protein, 9 aa, Homo Sapiens
QWQARHYHQ

SEQ ID NO: 1315393 - protein, 9 aa, Homo Sapiens
HSVFRNPHH

SEQ ID NO: 1315394 - protein, 9 aa, Homo Sapiens
THRRKLWAA

SEQ ID NO: 1315395 - protein, 9 aa, Homo Sapiens
ALATLSAPY

SEQ ID NO: 1315396 - protein, 9 aa, Homo Sapiens
NMDGLPAPN

SEQ ID NO: 1315397 - protein, 9 aa, Homo Sapiens
LVVVIMGVV

SEQ ID NO: 1315398 - protein, 9 aa, Homo Sapiens
HKHHDKFTD

SEQ ID NO: 1315399 - protein, 9 aa, Homo Sapiens
GDKQCTYTF

SEQ ID NO: 1315400 - protein, 9 aa, Homo Sapiens
WNRIFNFTR

SEQ ID NO: 1315401 - protein, 9 aa, Homo Sapiens
VIEYAACDT

SEQ ID NO: 1315402 - protein, 9 aa, Homo Sapiens
RRSYQRRGK

SEQ ID NO: 1315403 - protein, 9 aa, Homo Sapiens
VIPVPQSKP

SEQ ID NO: 1315404 - protein, 9 aa, Homo Sapiens
LQVPAVLPR

SEQ ID NO: 1315405 - protein, 9 aa, Homo Sapiens
HLQSSVPAY

SEQ ID NO: 1315406 - protein, 9 aa, Homo Sapiens
SHPSTLLTN

SEQ ID NO: 1315407 - protein, 9 aa, Homo Sapiens
GLSEARMQV

SEQ ID NO: 1315408 - protein, 9 aa, Homo Sapiens
HLRFNSTMK

SEQ ID NO: 1315409 - protein, 9 aa, Homo Sapiens
KVCQLEQEN

SEQ ID NO: 1315410 - protein, 9 aa, Homo Sapiens
PSQHTQFEY

SEQ ID NO: 1315411 - protein, 9 aa, Homo Sapiens
ASDLLQGPR

SEQ ID NO: 1315412 - protein, 9 aa, Homo Sapiens
PTSLQDITD

SEQ ID NO: 1315413 - protein, 9 aa, Homo Sapiens
ACPPDVYAI

SEQ ID NO: 1315414 - protein, 9 aa, Homo Sapiens
GALKGEADQ

SEQ ID NO: 1315415 - protein, 9 aa, Homo Sapiens
NSDVRHTPA

SEQ ID NO: 1315416 - protein, 9 aa, Homo Sapiens
PPSPMDPSN

SEQ ID NO: 1315417 - protein, 9 aa, Homo Sapiens
AIITNGITK

SEQ ID NO: 1315418 - protein, 9 aa, Homo Sapiens
GHHDIFKIL

SEQ ID NO: 1315419 - protein, 9 aa, Homo Sapiens
WKWGESLRV

SEQ ID NO: 1315420 - protein, 9 aa, Homo Sapiens
SLLLQHNLW

SEQ ID NO: 1315421 - protein, 9 aa, Homo Sapiens
VAQPTMEEG

SEQ ID NO: 1315422 - protein, 9 aa, Homo Sapiens
DLLVPKVDE

SEQ ID NO: 1315423 - protein, 9 aa, Homo Sapiens
GGIDRADEN

SEQ ID NO: 1315424 - protein, 9 aa, Homo Sapiens
EKKDVYKVG

SEQ ID NO: 1315425 - protein, 9 aa, Homo Sapiens
QKSSRDSLR

SEQ ID NO: 1315426 - protein, 9 aa, Homo Sapiens
KNQSLLSSE

SEQ ID NO: 1315427 - protein, 9 aa, Homo Sapiens
MTRTMVPSP

SEQ ID NO: 1315428 - protein, 9 aa, Homo Sapiens
VVAAHIQEV

SEQ ID NO: 1315429 - protein, 9 aa, Homo Sapiens
QWGDIVKVV

SEQ ID NO: 1315430 - protein, 9 aa, Homo Sapiens
PWTNQKICK

SEQ ID NO: 1315431 - protein, 9 aa, Homo Sapiens
MYGVDMYVV

SEQ ID NO: 1315432 - protein, 9 aa, Homo Sapiens
GDCFCIPRE

SEQ ID NO: 1315433 - protein, 9 aa, Homo Sapiens
VRCTHSVSI

SEQ ID NO: 1315434 - protein, 9 aa, Homo Sapiens
YSTVVTSKM

SEQ ID NO: 1315435 - protein, 9 aa, Homo Sapiens
HSAMEHTPP

SEQ ID NO: 1315436 - protein, 9 aa, Homo Sapiens
IFHDFSLSI

SEQ ID NO: 1315437 - protein, 9 aa, Homo Sapiens
KVLADDLEK

SEQ ID NO: 1315438 - protein, 9 aa, Homo Sapiens
PDVNRRIER

SEQ ID NO: 1315439 - protein, 9 aa, Homo Sapiens
LVVEANTKY

SEQ ID NO: 1315440 - protein, 9 aa, Homo Sapiens
TSLQRSLFL

SEQ ID NO: 1315441 - protein, 9 aa, Homo Sapiens
SPLEAPAEP

SEQ ID NO: 1315442 - protein, 9 aa, Homo Sapiens
MTPANDTYE

SEQ ID NO: 1315443 - protein, 9 aa, Homo Sapiens
TTEVPMSSS

SEQ ID NO: 1315444 - protein, 9 aa, Homo Sapiens
VQTCHVTWA

SEQ ID NO: 1315445 - protein, 9 aa, Homo Sapiens
GQEDLVEMV

SEQ ID NO: 1315446 - protein, 9 aa, Homo Sapiens
EFIRNTRRT

SEQ ID NO: 1315447 - protein, 9 aa, Homo Sapiens
ELRDVWGNQ

SEQ ID NO: 1315448 - protein, 9 aa, Homo Sapiens
AEQSEVVAT

SEQ ID NO: 1315449 - protein, 9 aa, Homo Sapiens
VRSRGHVKL

SEQ ID NO: 1315450 - protein, 9 aa, Homo Sapiens
QTQEYMLKP

SEQ ID NO: 1315451 - protein, 9 aa, Homo Sapiens
VPLDTPHQR

SEQ ID NO: 1315452 - protein, 9 aa, Homo Sapiens
NQRIADNTF

SEQ ID NO: 1315453 - protein, 9 aa, Homo Sapiens
DSKEVSLIF

SEQ ID NO: 1315454 - protein, 9 aa, Homo Sapiens
GDNDHITVE

SEQ ID NO: 1315455 - protein, 9 aa, Homo Sapiens
KETNQDFLP

SEQ ID NO: 1315456 - protein, 9 aa, Homo Sapiens
KEVICSSLK

SEQ ID NO: 1315457 - protein, 9 aa, Homo Sapiens
QKGVECDRS

SEQ ID NO: 1315458 - protein, 9 aa, Homo Sapiens
NFFIGAVNL

SEQ ID NO: 1315459 - protein, 9 aa, Homo Sapiens
LQKPRVYEF

SEQ ID NO: 1315460 - protein, 9 aa, Homo Sapiens
GHRDGRWAV

SEQ ID NO: 1315461 - protein, 9 aa, Homo Sapiens
VPKTEICDE

SEQ ID NO: 1315462 - protein, 9 aa, Homo Sapiens
DKTRKRCSA

SEQ ID NO: 1315463 - protein, 9 aa, Homo Sapiens
DNFVTPVIH

SEQ ID NO: 1315464 - protein, 9 aa, Homo Sapiens
PTPQMLRHQ

SEQ ID NO: 1315465 - protein, 9 aa, Homo Sapiens
RMNMCVPHP

SEQ ID NO: 1315466 - protein, 9 aa, Homo Sapiens
GEWIPRLLF

SEQ ID NO: 1315467 - protein, 9 aa, Homo Sapiens
QCTISLVFS

SEQ ID NO: 1315468 - protein, 9 aa, Homo Sapiens
ALRGRLRAQ

SEQ ID NO: 1315469 - protein, 9 aa, Homo Sapiens
HLEEPMSNP

SEQ ID NO: 1315470 - protein, 9 aa, Homo Sapiens
NRHILLSST

SEQ ID NO: 1315471 - protein, 9 aa, Homo Sapiens
RLPEPTMCI

SEQ ID NO: 1315472 - protein, 9 aa, Homo Sapiens
NSALIMVVA

SEQ ID NO: 1315473 - protein, 9 aa, Homo Sapiens
VLKEGLSGD

SEQ ID NO: 1315474 - protein, 9 aa, Homo Sapiens
WMRPKKCPL

SEQ ID NO: 1315475 - protein, 9 aa, Homo Sapiens
VESFVPHIC

SEQ ID NO: 1315476 - protein, 9 aa, Homo Sapiens
RTGEKPFRC

SEQ ID NO: 1315477 - protein, 9 aa, Homo Sapiens
LMMISKQIH

SEQ ID NO: 1315478 - protein, 9 aa, Homo Sapiens
LRKMDTTTS

SEQ ID NO: 1315479 - protein, 9 aa, Homo Sapiens
WGPMDTSNF

SEQ ID NO: 1315480 - protein, 9 aa, Homo Sapiens
PPSSKHLMS

SEQ ID NO: 1315481 - protein, 9 aa, Homo Sapiens
LYWGTATTG

SEQ ID NO: 1315482 - protein, 9 aa, Homo Sapiens
STLKTRLSD

SEQ ID NO: 1315483 - protein, 9 aa, Homo Sapiens
SILVDGEEA

SEQ ID NO: 1315484 - protein, 9 aa, Homo Sapiens
ENHQDYFDY

SEQ ID NO: 1315485 - protein, 9 aa, Homo Sapiens
MVHTAEKLC

SEQ ID NO: 1315486 - protein, 9 aa, Homo Sapiens
GTGPSIQLQ

SEQ ID NO: 1315487 - protein, 9 aa, Homo Sapiens
SQITAEDSA

SEQ ID NO: 1315488 - protein, 9 aa, Homo Sapiens
FQILTDEDW

SEQ ID NO: 1315489 - protein, 9 aa, Homo Sapiens
ALMFSPTHP

SEQ ID NO: 1315490 - protein, 9 aa, Homo Sapiens
GGALPAYVI

SEQ ID NO: 1315491 - protein, 9 aa, Homo Sapiens
DKSSVNWMR

SEQ ID NO: 1315492 - protein, 9 aa, Homo Sapiens
GSTEFFLLD

SEQ ID NO: 1315493 - protein, 9 aa, Homo Sapiens
HQLFHRIQQ

SEQ ID NO: 1315494 - protein, 9 aa, Homo Sapiens
SIQDRTPFS

SEQ ID NO: 1315495 - protein, 9 aa, Homo Sapiens
SCSDCSYHD

SEQ ID NO: 1315496 - protein, 9 aa, Homo Sapiens
NDNRVQHKQ

SEQ ID NO: 1315497 - protein, 9 aa, Homo Sapiens
AERPRGGRC

SEQ ID NO: 1315498 - protein, 9 aa, Homo Sapiens
CPFAYHKLL

SEQ ID NO: 1315499 - protein, 9 aa, Homo Sapiens
AKEVERVVG

SEQ ID NO: 1315500 - protein, 9 aa, Homo Sapiens
YVPAFWYNP

SEQ ID NO: 1315501 - protein, 9 aa, Homo Sapiens
ELRIFGFIH

SEQ ID NO: 1315502 - protein, 9 aa, Homo Sapiens
EDRFRFVWL

SEQ ID NO: 1315503 - protein, 9 aa, Homo Sapiens
KEKKVQEAE

SEQ ID NO: 1315504 - protein, 9 aa, Homo Sapiens
PLPLHFLQR

SEQ ID NO: 1315505 - protein, 9 aa, Homo Sapiens
LCQDMWWYQ

SEQ ID NO: 1315506 - protein, 9 aa, Homo Sapiens
LMTAFSWIM

SEQ ID NO: 1315507 - protein, 9 aa, Homo Sapiens
IIKCTHCGC

SEQ ID NO: 1315508 - protein, 9 aa, Homo Sapiens
VFLFIGSDT

SEQ ID NO: 1315509 - protein, 9 aa, Homo Sapiens
MAISEECKA

SEQ ID NO: 1315510 - protein, 9 aa, Homo Sapiens
VILIATAIC

SEQ ID NO: 1315511 - protein, 9 aa, Homo Sapiens
VGSKFTGGL

SEQ ID NO: 1315512 - protein, 9 aa, Homo Sapiens
YEAITKHNQ

SEQ ID NO: 1315513 - protein, 9 aa, Homo Sapiens
EFCGYEANY

SEQ ID NO: 1315514 - protein, 9 aa, Homo Sapiens
PRPGIKKAQ

SEQ ID NO: 1315515 - protein, 9 aa, Homo Sapiens
KIYKGPLDC

SEQ ID NO: 1315516 - protein, 9 aa, Homo Sapiens
RLLGNVVTS

SEQ ID NO: 1315517 - protein, 9 aa, Homo Sapiens
IAPIFSEDG

SEQ ID NO: 1315518 - protein, 9 aa, Homo Sapiens
GFDQAHLYS

SEQ ID NO: 1315519 - protein, 9 aa, Homo Sapiens
GPPGNWSPH

SEQ ID NO: 1315520 - protein, 9 aa, Homo Sapiens
QGCLLGLRA

SEQ ID NO: 1315521 - protein, 9 aa, Homo Sapiens
AFLPREVVT

SEQ ID NO: 1315522 - protein, 9 aa, Homo Sapiens
STCNNESES

SEQ ID NO: 1315523 - protein, 9 aa, Homo Sapiens
YHKVLMPKL

SEQ ID NO: 1315524 - protein, 9 aa, Homo Sapiens
EVLDGFFFV

SEQ ID NO: 1315525 - protein, 9 aa, Homo Sapiens
KLLKNMQSL

SEQ ID NO: 1315526 - protein, 9 aa, Homo Sapiens
KEISESEYC

SEQ ID NO: 1315527 - protein, 9 aa, Homo Sapiens
DRYEEAVGE

SEQ ID NO: 1315528 - protein, 9 aa, Homo Sapiens
PSFTPTHLH

SEQ ID NO: 1315529 - protein, 9 aa, Homo Sapiens
VPPSESQNV

SEQ ID NO: 1315530 - protein, 9 aa, Homo Sapiens
FPSQLQMKP

SEQ ID NO: 1315531 - protein, 9 aa, Homo Sapiens
AGPKGAGLQ

SEQ ID NO: 1315532 - protein, 9 aa, Homo Sapiens
NQEILNTNS

SEQ ID NO: 1315533 - protein, 9 aa, Homo Sapiens
RELKLYWGT

SEQ ID NO: 1315534 - protein, 9 aa, Homo Sapiens
PKDKETNQD

SEQ ID NO: 1315535 - protein, 9 aa, Homo Sapiens
NALTSIANV

SEQ ID NO: 1315536 - protein, 9 aa, Homo Sapiens
AADPRGIDS

SEQ ID NO: 1315537 - protein, 9 aa, Homo Sapiens
LYKGSFCRN

SEQ ID NO: 1315538 - protein, 9 aa, Homo Sapiens
AKCKLSDDP

SEQ ID NO: 1315539 - protein, 9 aa, Homo Sapiens
FISCMQYAP

SEQ ID NO: 1315540 - protein, 9 aa, Homo Sapiens
LAQGLHKMF

SEQ ID NO: 1315541 - protein, 9 aa, Homo Sapiens
CDRYPTLRN

SEQ ID NO: 1315542 - protein, 9 aa, Homo Sapiens
SLVIYRLPT

SEQ ID NO: 1315543 - protein, 9 aa, Homo Sapiens
SSKRRFECD

SEQ ID NO: 1315544 - protein, 9 aa, Homo Sapiens
QLQGLWHRF

SEQ ID NO: 1315545 - protein, 9 aa, Homo Sapiens
TPLLLHAPR

SEQ ID NO: 1315546 - protein, 9 aa, Homo Sapiens
SMDSAKRWH

SEQ ID NO: 1315547 - protein, 9 aa, Homo Sapiens
QFLQKFTVS

SEQ ID NO: 1315548 - protein, 9 aa, Homo Sapiens
AAINVAGLI

SEQ ID NO: 1315549 - protein, 9 aa, Homo Sapiens
MSSLVEVRG

SEQ ID NO: 1315550 - protein, 9 aa, Homo Sapiens
QGTGSLQEL

SEQ ID NO: 1315551 - protein, 9 aa, Homo Sapiens
PDEGYCQVQ

SEQ ID NO: 1315552 - protein, 9 aa, Homo Sapiens
GKGTWQWIN

SEQ ID NO: 1315553 - protein, 9 aa, Homo Sapiens
VPFSGCCFS

SEQ ID NO: 1315554 - protein, 9 aa, Homo Sapiens
AVIAHPGCV

SEQ ID NO: 1315555 - protein, 9 aa, Homo Sapiens
TFGHSLSSD

SEQ ID NO: 1315556 - protein, 9 aa, Homo Sapiens
HHISGEKTV

SEQ ID NO: 1315557 - protein, 9 aa, Homo Sapiens
GWLLGQMEE

SEQ ID NO: 1315558 - protein, 9 aa, Homo Sapiens
EGKYEKNDN

SEQ ID NO: 1315559 - protein, 9 aa, Homo Sapiens
KRMFPVFHD

SEQ ID NO: 1315560 - protein, 9 aa, Homo Sapiens
MPADEYDQP

SEQ ID NO: 1315561 - protein, 9 aa, Homo Sapiens
NIFKRDDSD

SEQ ID NO: 1315562 - protein, 9 aa, Homo Sapiens
MSKLRFEVF

SEQ ID NO: 1315563 - protein, 9 aa, Homo Sapiens
AVADRMQRQ

SEQ ID NO: 1315564 - protein, 9 aa, Homo Sapiens
IIAEKDANW

SEQ ID NO: 1315565 - protein, 9 aa, Homo Sapiens
DKAHGDASK

SEQ ID NO: 1315566 - protein, 9 aa, Homo Sapiens
LGERDYGPS

SEQ ID NO: 1315567 - protein, 9 aa, Homo Sapiens
LAKEERRTI

SEQ ID NO: 1315568 - protein, 9 aa, Homo Sapiens
LFLVALLAH

SEQ ID NO: 1315569 - protein, 9 aa, Homo Sapiens
TPVSPSTSR

SEQ ID NO: 1315570 - protein, 9 aa, Homo Sapiens
KVWQIHVDL

SEQ ID NO: 1315571 - protein, 9 aa, Homo Sapiens
EEARRRTHE

SEQ ID NO: 1315572 - protein, 9 aa, Homo Sapiens
WCCKRYGHR

SEQ ID NO: 1315573 - protein, 9 aa, Homo Sapiens
ESELERGTR

SEQ ID NO: 1315574 - protein, 9 aa, Homo Sapiens
MLQNCSGLV

SEQ ID NO: 1315575 - protein, 9 aa, Homo Sapiens
GLRGSTKIW

SEQ ID NO: 1315576 - protein, 9 aa, Homo Sapiens
VGAAVATVL

SEQ ID NO: 1315577 - protein, 9 aa, Homo Sapiens
KEGDQHVDD

SEQ ID NO: 1315578 - protein, 9 aa, Homo Sapiens
TKIIRNNSW

SEQ ID NO: 1315579 - protein, 9 aa, Homo Sapiens
CQMCSSQKP

SEQ ID NO: 1315580 - protein, 9 aa, Homo Sapiens
TSAYYRGTV

SEQ ID NO: 1315581 - protein, 9 aa, Homo Sapiens
PSFYHPYSP

SEQ ID NO: 1315582 - protein, 9 aa, Homo Sapiens
APQDSIRIN

SEQ ID NO: 1315583 - protein, 9 aa, Homo Sapiens
CALFFRFVD

SEQ ID NO: 1315584 - protein, 9 aa, Homo Sapiens
YYVQQEVIM

SEQ ID NO: 1315585 - protein, 9 aa, Homo Sapiens
HHPLLSSGG

SEQ ID NO: 1315586 - protein, 9 aa, Homo Sapiens
FLPTGLQAQ

SEQ ID NO: 1315587 - protein, 9 aa, Homo Sapiens
APELHVPLF

SEQ ID NO: 1315588 - protein, 9 aa, Homo Sapiens
IISKQVIIL

SEQ ID NO: 1315589 - protein, 9 aa, Homo Sapiens
IDLLEPREF

SEQ ID NO: 1315590 - protein, 9 aa, Homo Sapiens
ISTKEYTYL

SEQ ID NO: 1315591 - protein, 9 aa, Homo Sapiens
FWSTGASTP

SEQ ID NO: 1315592 - protein, 9 aa, Homo Sapiens
GSSTTYNTQ

SEQ ID NO: 1315593 - protein, 9 aa, Homo Sapiens
NCKEPVIAG

SEQ ID NO: 1315594 - protein, 9 aa, Homo Sapiens
QTEGIFGMY

SEQ ID NO: 1315595 - protein, 9 aa, Homo Sapiens
RTSSRRWTW

SEQ ID NO: 1315596 - protein, 9 aa, Homo Sapiens
QPRVPLVLE

SEQ ID NO: 1315597 - protein, 9 aa, Homo Sapiens
QSRLYVCPS

SEQ ID NO: 1315598 - protein, 9 aa, Homo Sapiens
ALSQLWEFC

SEQ ID NO: 1315599 - protein, 9 aa, Homo Sapiens
WRLWSLPRR

SEQ ID NO: 1315600 - protein, 9 aa, Homo Sapiens
HGETCHPQD

SEQ ID NO: 1315601 - protein, 9 aa, Homo Sapiens
QYRARGSPH

SEQ ID NO: 1315602 - protein, 9 aa, Homo Sapiens
LPKKKKEAY

SEQ ID NO: 1315603 - protein, 9 aa, Homo Sapiens
HYREPRRML

SEQ ID NO: 1315604 - protein, 9 aa, Homo Sapiens
MSFDVTDTV

SEQ ID NO: 1315605 - protein, 9 aa, Homo Sapiens
NVTKEEPLI

SEQ ID NO: 1315606 - protein, 9 aa, Homo Sapiens
EKLQKEMTD

SEQ ID NO: 1315607 - protein, 9 aa, Homo Sapiens
FLKQMVGGS

SEQ ID NO: 1315608 - protein, 9 aa, Homo Sapiens
LPGYKVHEI

SEQ ID NO: 1315609 - protein, 9 aa, Homo Sapiens
LFQKFPVKV

SEQ ID NO: 1315610 - protein, 9 aa, Homo Sapiens
AGTELSVCA

SEQ ID NO: 1315611 - protein, 9 aa, Homo Sapiens
IGYGYHCVT

SEQ ID NO: 1315612 - protein, 9 aa, Homo Sapiens
CLIGEKDLH

SEQ ID NO: 1315613 - protein, 9 aa, Homo Sapiens
SECDKAFSR

SEQ ID NO: 1315614 - protein, 9 aa, Homo Sapiens
VWCWPDLQS

SEQ ID NO: 1315615 - protein, 9 aa, Homo Sapiens
TIGYGYHCV

SEQ ID NO: 1315616 - protein, 9 aa, Homo Sapiens
ERNGINSVR

SEQ ID NO: 1315617 - protein, 9 aa, Homo Sapiens
HVSDPYSLN

SEQ ID NO: 1315618 - protein, 9 aa, Homo Sapiens
ACSLGEELC

SEQ ID NO: 1315619 - protein, 9 aa, Homo Sapiens
LVQVYPDDI

SEQ ID NO: 1315620 - protein, 9 aa, Homo Sapiens
LGAILQQVV

SEQ ID NO: 1315621 - protein, 9 aa, Homo Sapiens
DNKPDNEGC

SEQ ID NO: 1315622 - protein, 9 aa, Homo Sapiens
TCFDAVQGK

SEQ ID NO: 1315623 - protein, 9 aa, Homo Sapiens
TTSLCSRKT

SEQ ID NO: 1315624 - protein, 9 aa, Homo Sapiens
NGPRAIEAA

SEQ ID NO: 1315625 - protein, 9 aa, Homo Sapiens
SLKHFSFSP

SEQ ID NO: 1315626 - protein, 9 aa, Homo Sapiens
IQSKHHPLD

SEQ ID NO: 1315627 - protein, 9 aa, Homo Sapiens
LDLEDRLTK

SEQ ID NO: 1315628 - protein, 9 aa, Homo Sapiens
HIFKWVPVV

SEQ ID NO: 1315629 - protein, 9 aa, Homo Sapiens
DWTLCYTPL

SEQ ID NO: 1315630 - protein, 9 aa, Homo Sapiens
YTKSRGRAV

SEQ ID NO: 1315631 - protein, 9 aa, Homo Sapiens
EDTKAPRVP

SEQ ID NO: 1315632 - protein, 9 aa, Homo Sapiens
ASHEDNPKG

SEQ ID NO: 1315633 - protein, 9 aa, Homo Sapiens
EVKMTAVRG

SEQ ID NO: 1315634 - protein, 9 aa, Homo Sapiens
SMYDKLRML

SEQ ID NO: 1315635 - protein, 9 aa, Homo Sapiens
KPYIKCAEC

SEQ ID NO: 1315636 - protein, 9 aa, Homo Sapiens
VNIIPNPTT

SEQ ID NO: 1315637 - protein, 9 aa, Homo Sapiens
LQVDYIFRG

SEQ ID NO: 1315638 - protein, 9 aa, Homo Sapiens
LVPARYRKP

SEQ ID NO: 1315639 - protein, 9 aa, Homo Sapiens
TTILREILK

SEQ ID NO: 1315640 - protein, 9 aa, Homo Sapiens
RRWTNKENA

SEQ ID NO: 1315641 - protein, 9 aa, Homo Sapiens
SASSATEKD

SEQ ID NO: 1315642 - protein, 9 aa, Homo Sapiens
NKEVMGAVR

SEQ ID NO: 1315643 - protein, 9 aa, Homo Sapiens
KDSLPMTSE

SEQ ID NO: 1315644 - protein, 9 aa, Homo Sapiens
ENSPLSKVV

SEQ ID NO: 1315645 - protein, 9 aa, Homo Sapiens
PNFPEELEK

SEQ ID NO: 1315646 - protein, 9 aa, Homo Sapiens
PQLWARHMG

SEQ ID NO: 1315647 - protein, 9 aa, Homo Sapiens
PLKDYIFDL

SEQ ID NO: 1315648 - protein, 9 aa, Homo Sapiens
RANMGTSFK

SEQ ID NO: 1315649 - protein, 9 aa, Homo Sapiens
GMAFINTQL

SEQ ID NO: 1315650 - protein, 9 aa, Homo Sapiens
RAYGRLWRP

SEQ ID NO: 1315651 - protein, 9 aa, Homo Sapiens
EYVRHLTGE

SEQ ID NO: 1315652 - protein, 9 aa, Homo Sapiens
CKHSPSTPS

SEQ ID NO: 1315653 - protein, 9 aa, Homo Sapiens
SLLTCTSKN

SEQ ID NO: 1315654 - protein, 9 aa, Homo Sapiens
ITIESEGCG

SEQ ID NO: 1315655 - protein, 9 aa, Homo Sapiens
LVKKIMSLV

SEQ ID NO: 1315656 - protein, 9 aa, Homo Sapiens
FNALIESTV

SEQ ID NO: 1315657 - protein, 9 aa, Homo Sapiens
FYVAIRHRP

SEQ ID NO: 1315658 - protein, 9 aa, Homo Sapiens
LLALEENDY

SEQ ID NO: 1315659 - protein, 9 aa, Homo Sapiens
KTSVSEGNP

SEQ ID NO: 1315660 - protein, 9 aa, Homo Sapiens
GMPVASKLQ

SEQ ID NO: 1315661 - protein, 9 aa, Homo Sapiens
MHYLFIISV

SEQ ID NO: 1315662 - protein, 9 aa, Homo Sapiens
SKNTQDMQV

SEQ ID NO: 1315663 - protein, 9 aa, Homo Sapiens
ERVSSRRKG

SEQ ID NO: 1315664 - protein, 9 aa, Homo Sapiens
KRGASSSTS

SEQ ID NO: 1315665 - protein, 9 aa, Homo Sapiens
SNDHGYTIY

SEQ ID NO: 1315666 - protein, 9 aa, Homo Sapiens
HSVLELVRQ

SEQ ID NO: 1315667 - protein, 9 aa, Homo Sapiens
RSAACPTAS

SEQ ID NO: 1315668 - protein, 9 aa, Homo Sapiens
VNLTNLLIH

SEQ ID NO: 1315669 - protein, 9 aa, Homo Sapiens
ELRCRIIQW

SEQ ID NO: 1315670 - protein, 9 aa, Homo Sapiens
RPKMTPAND

SEQ ID NO: 1315671 - protein, 9 aa, Homo Sapiens
LKKLWQSPA

SEQ ID NO: 1315672 - protein, 9 aa, Homo Sapiens
GWPETPLGH

SEQ ID NO: 1315673 - protein, 9 aa, Homo Sapiens
FLLAEAWDF

SEQ ID NO: 1315674 - protein, 9 aa, Homo Sapiens
TMADMLQRD

SEQ ID NO: 1315675 - protein, 9 aa, Homo Sapiens
LWTSLGDSL

SEQ ID NO: 1315676 - protein, 9 aa, Homo Sapiens
SKLVANQST

SEQ ID NO: 1315677 - protein, 9 aa, Homo Sapiens
KKLKLAPLQ

SEQ ID NO: 1315678 - protein, 9 aa, Homo Sapiens
RYKEDDLVC

SEQ ID NO: 1315679 - protein, 9 aa, Homo Sapiens
DYIDRLFQI

SEQ ID NO: 1315680 - protein, 9 aa, Homo Sapiens
QDPEPLSMV

SEQ ID NO: 1315681 - protein, 9 aa, Homo Sapiens
KDDHHLRGC

SEQ ID NO: 1315682 - protein, 9 aa, Homo Sapiens
YMQMNHTLF

SEQ ID NO: 1315683 - protein, 9 aa, Homo Sapiens
SPLLCCALC

SEQ ID NO: 1315684 - protein, 9 aa, Homo Sapiens
GSHGMPKRI

SEQ ID NO: 1315685 - protein, 9 aa, Homo Sapiens
LFVVGLYTG

SEQ ID NO: 1315686 - protein, 9 aa, Homo Sapiens
LLTWLAGTI

SEQ ID NO: 1315687 - protein, 9 aa, Homo Sapiens
SCDVNKRRF

SEQ ID NO: 1315688 - protein, 9 aa, Homo Sapiens
NLQEIYKAE

SEQ ID NO: 1315689 - protein, 9 aa, Homo Sapiens
TDQRSPYAD

SEQ ID NO: 1315690 - protein, 9 aa, Homo Sapiens
DCRHIQYFD

SEQ ID NO: 1315691 - protein, 9 aa, Homo Sapiens
QQSLCESEQ

SEQ ID NO: 1315692 - protein, 9 aa, Homo Sapiens
LRDTDMNKK

SEQ ID NO: 1315693 - protein, 9 aa, Homo Sapiens
VQTRWKQGR

SEQ ID NO: 1315694 - protein, 9 aa, Homo Sapiens
YQGRVQSIL

SEQ ID NO: 1315695 - protein, 9 aa, Homo Sapiens
TRTQLRNEF

SEQ ID NO: 1315696 - protein, 9 aa, Homo Sapiens
ELVMAEALQ

SEQ ID NO: 1315697 - protein, 9 aa, Homo Sapiens
FFKATRQNI

SEQ ID NO: 1315698 - protein, 9 aa, Homo Sapiens
SLQAAKGGL

SEQ ID NO: 1315699 - protein, 9 aa, Homo Sapiens
KIFHINPHL

SEQ ID NO: 1315700 - protein, 9 aa, Homo Sapiens
RWHPKLLAK

SEQ ID NO: 1315701 - protein, 9 aa, Homo Sapiens
QVSYKEDKP

SEQ ID NO: 1315702 - protein, 9 aa, Homo Sapiens
IASEHSYQK

SEQ ID NO: 1315703 - protein, 9 aa, Homo Sapiens
FQKLEWETQ

SEQ ID NO: 1315704 - protein, 9 aa, Homo Sapiens
VILKAVKDQ

SEQ ID NO: 1315705 - protein, 9 aa, Homo Sapiens
QESSVRLKL

SEQ ID NO: 1315706 - protein, 9 aa, Homo Sapiens
DNHWWQVSI

SEQ ID NO: 1315707 - protein, 9 aa, Homo Sapiens
SSPRCAGSA

SEQ ID NO: 1315708 - protein, 9 aa, Homo Sapiens
AGSKKKSIR

SEQ ID NO: 1315709 - protein, 9 aa, Homo Sapiens
IDTGDADIS

SEQ ID NO: 1315710 - protein, 9 aa, Homo Sapiens
KTCDSSPPH

SEQ ID NO: 1315711 - protein, 9 aa, Homo Sapiens
QISFMKGKM

SEQ ID NO: 1315712 - protein, 9 aa, Homo Sapiens
FFIITAVTV

SEQ ID NO: 1315713 - protein, 9 aa, Homo Sapiens
KEDLAVFVE

SEQ ID NO: 1315714 - protein, 9 aa, Homo Sapiens
IDKAREIIC

SEQ ID NO: 1315715 - protein, 9 aa, Homo Sapiens
EKELGKVRC

SEQ ID NO: 1315716 - protein, 9 aa, Homo Sapiens
AMRSYTGQM

SEQ ID NO: 1315717 - protein, 9 aa, Homo Sapiens
KSLLFWLMI

SEQ ID NO: 1315718 - protein, 9 aa, Homo Sapiens
LKRNIGVIV

SEQ ID NO: 1315719 - protein, 9 aa, Homo Sapiens
MEASVEKQR

SEQ ID NO: 1315720 - protein, 9 aa, Homo Sapiens
DVNASSKTF

SEQ ID NO: 1315721 - protein, 9 aa, Homo Sapiens
CVLPHVDFQ

SEQ ID NO: 1315722 - protein, 9 aa, Homo Sapiens
GHRLDNLSI

SEQ ID NO: 1315723 - protein, 9 aa, Homo Sapiens
LLQGPCDTG

SEQ ID NO: 1315724 - protein, 9 aa, Homo Sapiens
IYHFKIFCP

SEQ ID NO: 1315725 - protein, 9 aa, Homo Sapiens
SVPKGKQDI

SEQ ID NO: 1315726 - protein, 9 aa, Homo Sapiens
ASQGEFQVS

SEQ ID NO: 1315727 - protein, 9 aa, Homo Sapiens
YLCALYLGL

SEQ ID NO: 1315728 - protein, 9 aa, Homo Sapiens
SVTSQRFMV

SEQ ID NO: 1315729 - protein, 9 aa, Homo Sapiens
KNKLNTITP

SEQ ID NO: 1315730 - protein, 9 aa, Homo Sapiens
RISVVSVAE

SEQ ID NO: 1315731 - protein, 9 aa, Homo Sapiens
ANEQKPSRI

SEQ ID NO: 1315732 - protein, 9 aa, Homo Sapiens
AKRWHPKLL

SEQ ID NO: 1315733 - protein, 9 aa, Homo Sapiens
EHVYSHTIY

SEQ ID NO: 1315734 - protein, 9 aa, Homo Sapiens
HRSRTTFTA

SEQ ID NO: 1315735 - protein, 9 aa, Homo Sapiens
QPDQPRSVR

SEQ ID NO: 1315736 - protein, 9 aa, Homo Sapiens
FALFIPCMC

SEQ ID NO: 1315737 - protein, 9 aa, Homo Sapiens
KANRLQRCL

SEQ ID NO: 1315738 - protein, 9 aa, Homo Sapiens
KQHFYSCDR

SEQ ID NO: 1315739 - protein, 9 aa, Homo Sapiens
SLGEELCLC

SEQ ID NO: 1315740 - protein, 9 aa, Homo Sapiens
TYTCPCPSM

SEQ ID NO: 1315741 - protein, 9 aa, Homo Sapiens
NKLYDELEQ

SEQ ID NO: 1315742 - protein, 9 aa, Homo Sapiens
NEPVIYNRT

SEQ ID NO: 1315743 - protein, 9 aa, Homo Sapiens
CIYGLKEDE

SEQ ID NO: 1315744 - protein, 9 aa, Homo Sapiens
FVQRVLCRS

SEQ ID NO: 1315745 - protein, 9 aa, Homo Sapiens
SLHFLQILR

SEQ ID NO: 1315746 - protein, 9 aa, Homo Sapiens
QVRKHLGTG

SEQ ID NO: 1315747 - protein, 9 aa, Homo Sapiens
RSPTSAASA

SEQ ID NO: 1315748 - protein, 9 aa, Homo Sapiens
ERFDNEMKD

SEQ ID NO: 1315749 - protein, 9 aa, Homo Sapiens
TSSDLNSQC

SEQ ID NO: 1315750 - protein, 9 aa, Homo Sapiens
PAHKITGDH

SEQ ID NO: 1315751 - protein, 9 aa, Homo Sapiens
SKEAWGMHE

SEQ ID NO: 1315752 - protein, 9 aa, Homo Sapiens
YRDCEGRDT

SEQ ID NO: 1315753 - protein, 9 aa, Homo Sapiens
TLIMAPSGV

SEQ ID NO: 1315754 - protein, 9 aa, Homo Sapiens
SMDTPPDID

SEQ ID NO: 1315755 - protein, 9 aa, Homo Sapiens
GEKKDVYKV

SEQ ID NO: 1315756 - protein, 9 aa, Homo Sapiens
CYNLQSALR

SEQ ID NO: 1315757 - protein, 9 aa, Homo Sapiens
ETLENTNRT

SEQ ID NO: 1315758 - protein, 9 aa, Homo Sapiens
GESSHSIYP

SEQ ID NO: 1315759 - protein, 9 aa, Homo Sapiens
PLGLCRILS

SEQ ID NO: 1315760 - protein, 9 aa, Homo Sapiens
VGVYHSPVD

SEQ ID NO: 1315761 - protein, 9 aa, Homo Sapiens
CLEDTGHDM

SEQ ID NO: 1315762 - protein, 9 aa, Homo Sapiens
DEKTLRSFR

SEQ ID NO: 1315763 - protein, 9 aa, Homo Sapiens
TGGYVYCGC

SEQ ID NO: 1315764 - protein, 9 aa, Homo Sapiens
DPGFPGIKG

SEQ ID NO: 1315765 - protein, 9 aa, Homo Sapiens
PWNLTFPRF

SEQ ID NO: 1315766 - protein, 9 aa, Homo Sapiens
KMARETEFE

SEQ ID NO: 1315767 - protein, 9 aa, Homo Sapiens
RRFGSHSCC

SEQ ID NO: 1315768 - protein, 9 aa, Homo Sapiens
GHLSDTHWC

SEQ ID NO: 1315769 - protein, 9 aa, Homo Sapiens
TSAMNAARP

SEQ ID NO: 1315770 - protein, 9 aa, Homo Sapiens
THTLGLFIV

SEQ ID NO: 1315771 - protein, 9 aa, Homo Sapiens
QCAKLEAAV

SEQ ID NO: 1315772 - protein, 9 aa, Homo Sapiens
CRNKCIAYK

SEQ ID NO: 1315773 - protein, 9 aa, Homo Sapiens
RLTAEGKNI

SEQ ID NO: 1315774 - protein, 9 aa, Homo Sapiens
SGYHIGPAE

SEQ ID NO: 1315775 - protein, 9 aa, Homo Sapiens
GNSTRVIYS

SEQ ID NO: 1315776 - protein, 9 aa, Homo Sapiens
VGPHARVDA

SEQ ID NO: 1315777 - protein, 9 aa, Homo Sapiens
GADMSSLVE

SEQ ID NO: 1315778 - protein, 9 aa, Homo Sapiens
ENHTCSGWL

SEQ ID NO: 1315779 - protein, 9 aa, Homo Sapiens
GNRFVQVHP

SEQ ID NO: 1315780 - protein, 9 aa, Homo Sapiens
IKHGNLLFL

SEQ ID NO: 1315781 - protein, 9 aa, Homo Sapiens
IELPYGRED

SEQ ID NO: 1315782 - protein, 9 aa, Homo Sapiens
FASVHIGLY

SEQ ID NO: 1315783 - protein, 9 aa, Homo Sapiens
RVTQLALLD

SEQ ID NO: 1315784 - protein, 9 aa, Homo Sapiens
DLEKCRQIY

SEQ ID NO: 1315785 - protein, 9 aa, Homo Sapiens
GARPSDWAP

SEQ ID NO: 1315786 - protein, 9 aa, Homo Sapiens
LKMKQSVNI

SEQ ID NO: 1315787 - protein, 9 aa, Homo Sapiens
TLVIAEYAN

SEQ ID NO: 1315788 - protein, 9 aa, Homo Sapiens
DRNNVDLWY

SEQ ID NO: 1315789 - protein, 9 aa, Homo Sapiens
LRNTKEQHD

SEQ ID NO: 1315790 - protein, 9 aa, Homo Sapiens
TTDGESVMF

SEQ ID NO: 1315791 - protein, 9 aa, Homo Sapiens
DWVEMDTRQ

SEQ ID NO: 1315792 - protein, 9 aa, Homo Sapiens
SKICVNGDN

SEQ ID NO: 1315793 - protein, 9 aa, Homo Sapiens
YLKEMKNLH

SEQ ID NO: 1315794 - protein, 9 aa, Homo Sapiens
GVPSPPRIH

SEQ ID NO: 1315795 - protein, 9 aa, Homo Sapiens
VYASGNNLK

SEQ ID NO: 1315796 - protein, 9 aa, Homo Sapiens
PPPGSQSSP

SEQ ID NO: 1315797 - protein, 9 aa, Homo Sapiens
VTQMPRERV

SEQ ID NO: 1315798 - protein, 9 aa, Homo Sapiens
MGTMPRPGI

SEQ ID NO: 1315799 - protein, 9 aa, Homo Sapiens
AFLWGGLTD

SEQ ID NO: 1315800 - protein, 9 aa, Homo Sapiens
LRLVQATPA

SEQ ID NO: 1315801 - protein, 9 aa, Homo Sapiens
TLRTQQTPV

SEQ ID NO: 1315802 - protein, 9 aa, Homo Sapiens
ARAVVFAAA

SEQ ID NO: 1315803 - protein, 9 aa, Homo Sapiens
GNCGPYCTS

SEQ ID NO: 1315804 - protein, 9 aa, Homo Sapiens
KFTNTHITE

SEQ ID NO: 1315805 - protein, 9 aa, Homo Sapiens
EISGQASGS

SEQ ID NO: 1315806 - protein, 9 aa, Homo Sapiens
SVAKIMSDR

SEQ ID NO: 1315807 - protein, 9 aa, Homo Sapiens
GGLEDECKT

SEQ ID NO: 1315808 - protein, 9 aa, Homo Sapiens
SDLSMVFPH

SEQ ID NO: 1315809 - protein, 9 aa, Homo Sapiens
KLMAEVLAM

SEQ ID NO: 1315810 - protein, 9 aa, Homo Sapiens
VLQSVPVFQ

SEQ ID NO: 1315811 - protein, 9 aa, Homo Sapiens
AHQDAHRHQ

SEQ ID NO: 1315812 - protein, 9 aa, Homo Sapiens
HGLSTEQVY

SEQ ID NO: 1315813 - protein, 9 aa, Homo Sapiens
LLLCSNMSC

SEQ ID NO: 1315814 - protein, 9 aa, Homo Sapiens
TKSTRFFAK

SEQ ID NO: 1315815 - protein, 9 aa, Homo Sapiens
RLTCADTWV

SEQ ID NO: 1315816 - protein, 9 aa, Homo Sapiens
PIIVMVLNA

SEQ ID NO: 1315817 - protein, 9 aa, Homo Sapiens
KLLVKKIMS

SEQ ID NO: 1315818 - protein, 9 aa, Homo Sapiens
EEQKEERCR

SEQ ID NO: 1315819 - protein, 9 aa, Homo Sapiens
EVESDNPEF

SEQ ID NO: 1315820 - protein, 9 aa, Homo Sapiens
RQGKEAYPM

SEQ ID NO: 1315821 - protein, 9 aa, Homo Sapiens
MAAVIHYLY

SEQ ID NO: 1315822 - protein, 9 aa, Homo Sapiens
ADTPGVIPG

SEQ ID NO: 1315823 - protein, 9 aa, Homo Sapiens
KKGEDLFPA

SEQ ID NO: 1315824 - protein, 9 aa, Homo Sapiens
HLSPLGPSK

SEQ ID NO: 1315825 - protein, 9 aa, Homo Sapiens
PMGVSVIYW

SEQ ID NO: 1315826 - protein, 9 aa, Homo Sapiens
YRVSSRLKE

SEQ ID NO: 1315827 - protein, 9 aa, Homo Sapiens
TPLYGNIHS

SEQ ID NO: 1315828 - protein, 9 aa, Homo Sapiens
ELLAKEHIK

SEQ ID NO: 1315829 - protein, 9 aa, Homo Sapiens
QAVHCMHAI

SEQ ID NO: 1315830 - protein, 9 aa, Homo Sapiens
QHSVNEGAY

SEQ ID NO: 1315831 - protein, 9 aa, Homo Sapiens
YVAVFVICW

SEQ ID NO: 1315832 - protein, 9 aa, Homo Sapiens
QIRLVVSRL

SEQ ID NO: 1315833 - protein, 9 aa, Homo Sapiens
SPDYCVHNE

SEQ ID NO: 1315834 - protein, 9 aa, Homo Sapiens
SSGDVWIVR

SEQ ID NO: 1315835 - protein, 9 aa, Homo Sapiens
KLWDTKIVI

SEQ ID NO: 1315836 - protein, 9 aa, Homo Sapiens
PETPLGHLE

SEQ ID NO: 1315837 - protein, 9 aa, Homo Sapiens
HDNAFFKDK

SEQ ID NO: 1315838 - protein, 9 aa, Homo Sapiens
LHIFQVYMA

SEQ ID NO: 1315839 - protein, 9 aa, Homo Sapiens
EKQHISRGY

SEQ ID NO: 1315840 - protein, 9 aa, Homo Sapiens
EFYAGDWHY

SEQ ID NO: 1315841 - protein, 9 aa, Homo Sapiens
SGKCGRPSG

SEQ ID NO: 1315842 - protein, 9 aa, Homo Sapiens
IFQHNGKKW

SEQ ID NO: 1315843 - protein, 9 aa, Homo Sapiens
EYAHVQKRK

SEQ ID NO: 1315844 - protein, 9 aa, Homo Sapiens
NLNKNHFQP

SEQ ID NO: 1315845 - protein, 9 aa, Homo Sapiens
RPSGHRRRC

SEQ ID NO: 1315846 - protein, 9 aa, Homo Sapiens
EGRMHDENV

SEQ ID NO: 1315847 - protein, 9 aa, Homo Sapiens
VTYHGSYLW

SEQ ID NO: 1315848 - protein, 9 aa, Homo Sapiens
TLGQVIHKW

SEQ ID NO: 1315849 - protein, 9 aa, Homo Sapiens
QICIQYKPS

SEQ ID NO: 1315850 - protein, 9 aa, Homo Sapiens
CYVCCRRCE

SEQ ID NO: 1315851 - protein, 9 aa, Homo Sapiens
SFNRPFQSQ

SEQ ID NO: 1315852 - protein, 9 aa, Homo Sapiens
VECDRSKKI

SEQ ID NO: 1315853 - protein, 9 aa, Homo Sapiens
GFPEQVTAF

SEQ ID NO: 1315854 - protein, 9 aa, Homo Sapiens
PCMTLAQEP

SEQ ID NO: 1315855 - protein, 9 aa, Homo Sapiens
KSSSLLHSI

SEQ ID NO: 1315856 - protein, 9 aa, Homo Sapiens
TAQTQIDLL

SEQ ID NO: 1315857 - protein, 9 aa, Homo Sapiens
GAPWGGRGQ

SEQ ID NO: 1315858 - protein, 9 aa, Homo Sapiens
RNERAKVCL

SEQ ID NO: 1315859 - protein, 9 aa, Homo Sapiens
VGTEIIQSS

SEQ ID NO: 1315860 - protein, 9 aa, Homo Sapiens
NKLPPLALY

SEQ ID NO: 1315861 - protein, 9 aa, Homo Sapiens
LVLSYVRHL

SEQ ID NO: 1315862 - protein, 9 aa, Homo Sapiens
QEVLYHISM

SEQ ID NO: 1315863 - protein, 9 aa, Homo Sapiens
EGYCQVQAP

SEQ ID NO: 1315864 - protein, 9 aa, Homo Sapiens
VSRENPVTS

SEQ ID NO: 1315865 - protein, 9 aa, Homo Sapiens
KEEVRQDVE

SEQ ID NO: 1315866 - protein, 9 aa, Homo Sapiens
TRWPGDILA

SEQ ID NO: 1315867 - protein, 9 aa, Homo Sapiens
KQILQELVL

SEQ ID NO: 1315868 - protein, 9 aa, Homo Sapiens
RDQIKKRMA

SEQ ID NO: 1315869 - protein, 9 aa, Homo Sapiens
KWRPGASRR

SEQ ID NO: 1315870 - protein, 9 aa, Homo Sapiens
GWMGFPQGF

SEQ ID NO: 1315871 - protein, 9 aa, Homo Sapiens
CARRELHTT

SEQ ID NO: 1315872 - protein, 9 aa, Homo Sapiens
LATDINLSG

SEQ ID NO: 1315873 - protein, 9 aa, Homo Sapiens
GKMMFCVLL

SEQ ID NO: 1315874 - protein, 9 aa, Homo Sapiens
SELWNLPPH

SEQ ID NO: 1315875 - protein, 9 aa, Homo Sapiens
EMNQTNKDK

SEQ ID NO: 1315876 - protein, 9 aa, Homo Sapiens
MDIEYIQSH

SEQ ID NO: 1315877 - protein, 9 aa, Homo Sapiens
QGYLSEVGA

SEQ ID NO: 1315878 - protein, 9 aa, Homo Sapiens
NTPAHKITG

SEQ ID NO: 1315879 - protein, 9 aa, Homo Sapiens
APVPSVCFR

SEQ ID NO: 1315880 - protein, 9 aa, Homo Sapiens
LSREAIAAD

SEQ ID NO: 1315881 - protein, 9 aa, Homo Sapiens
RPVLAGTDG

SEQ ID NO: 1315882 - protein, 9 aa, Homo Sapiens
QPPHDSAGY

SEQ ID NO: 1315883 - protein, 9 aa, Homo Sapiens
PEGDNPKES

SEQ ID NO: 1315884 - protein, 9 aa, Homo Sapiens
ERWLLHHTL

SEQ ID NO: 1315885 - protein, 9 aa, Homo Sapiens
EHAKEGECS

SEQ ID NO: 1315886 - protein, 9 aa, Homo Sapiens
NNSPKWSEL

SEQ ID NO: 1315887 - protein, 9 aa, Homo Sapiens
NAEQSEVVA

SEQ ID NO: 1315888 - protein, 9 aa, Homo Sapiens
ETIHQGIKH

SEQ ID NO: 1315889 - protein, 9 aa, Homo Sapiens
NMVVFVTYE

SEQ ID NO: 1315890 - protein, 9 aa, Homo Sapiens
CRTRRRWSS

SEQ ID NO: 1315891 - protein, 9 aa, Homo Sapiens
RITYSDEVR

SEQ ID NO: 1315892 - protein, 9 aa, Homo Sapiens
ALVKVLLYS

SEQ ID NO: 1315893 - protein, 9 aa, Homo Sapiens
TKGKNKLNT

SEQ ID NO: 1315894 - protein, 9 aa, Homo Sapiens
DKQDVLNSI

SEQ ID NO: 1315895 - protein, 9 aa, Homo Sapiens
FTSAHPSRP

SEQ ID NO: 1315896 - protein, 9 aa, Homo Sapiens
FTSLKRSLA

SEQ ID NO: 1315897 - protein, 9 aa, Homo Sapiens
EREKHNIYK

SEQ ID NO: 1315898 - protein, 9 aa, Homo Sapiens
IMDLLLHLL

SEQ ID NO: 1315899 - protein, 9 aa, Homo Sapiens
CNKRTARKA

SEQ ID NO: 1315900 - protein, 9 aa, Homo Sapiens
DRGAGLHRD

SEQ ID NO: 1315901 - protein, 9 aa, Homo Sapiens
TDVVKLGAK

SEQ ID NO: 1315902 - protein, 9 aa, Homo Sapiens
SQNVISFFN

SEQ ID NO: 1315903 - protein, 9 aa, Homo Sapiens
GSGGNTDML

SEQ ID NO: 1315904 - protein, 9 aa, Homo Sapiens
KPVKHIQEE

SEQ ID NO: 1315905 - protein, 9 aa, Homo Sapiens
LDEDGEKEV

SEQ ID NO: 1315906 - protein, 9 aa, Homo Sapiens
EAARSAMIT

SEQ ID NO: 1315907 - protein, 9 aa, Homo Sapiens
ISRKELVMA

SEQ ID NO: 1315908 - protein, 9 aa, Homo Sapiens
NVISFFNVG

SEQ ID NO: 1315909 - protein, 9 aa, Homo Sapiens
TGASTQARS

SEQ ID NO: 1315910 - protein, 9 aa, Homo Sapiens
FNYMLYPIT

SEQ ID NO: 1315911 - protein, 9 aa, Homo Sapiens
AKGWRKAFG

SEQ ID NO: 1315912 - protein, 9 aa, Homo Sapiens
CVASGPHLF

SEQ ID NO: 1315913 - protein, 9 aa, Homo Sapiens
MWEEDFIQP

SEQ ID NO: 1315914 - protein, 9 aa, Homo Sapiens
GTLSSNVIL

SEQ ID NO: 1315915 - protein, 9 aa, Homo Sapiens
TSIYLTSSP

SEQ ID NO: 1315916 - protein, 9 aa, Homo Sapiens
HTVTPSGQV

SEQ ID NO: 1315917 - protein, 9 aa, Homo Sapiens
PVFTFHHPL

SEQ ID NO: 1315918 - protein, 9 aa, Homo Sapiens
HNMMVTGQL

SEQ ID NO: 1315919 - protein, 9 aa, Homo Sapiens
SGTGVHKNK

SEQ ID NO: 1315920 - protein, 9 aa, Homo Sapiens
SVGQVARNT

SEQ ID NO: 1315921 - protein, 9 aa, Homo Sapiens
QASRHFGTM

SEQ ID NO: 1315922 - protein, 9 aa, Homo Sapiens
AWYLIVWEN

SEQ ID NO: 1315923 - protein, 9 aa, Homo Sapiens
FPGGKGTWQ

SEQ ID NO: 1315924 - protein, 9 aa, Homo Sapiens
EFLLKSILC

SEQ ID NO: 1315925 - protein, 9 aa, Homo Sapiens
VTMVLVSWI

SEQ ID NO: 1315926 - protein, 9 aa, Homo Sapiens
AFNQFLILN

SEQ ID NO: 1315927 - protein, 9 aa, Homo Sapiens
FVEHRCLLF

SEQ ID NO: 1315928 - protein, 9 aa, Homo Sapiens
LERKRHEVT

SEQ ID NO: 1315929 - protein, 9 aa, Homo Sapiens
IHNRCPVKC

SEQ ID NO: 1315930 - protein, 9 aa, Homo Sapiens
KVETLTIQR

SEQ ID NO: 1315931 - protein, 9 aa, Homo Sapiens
MMVNNYHPL

SEQ ID NO: 1315932 - protein, 9 aa, Homo Sapiens
TWMNDTVII

SEQ ID NO: 1315933 - protein, 9 aa, Homo Sapiens
LYLVMLVNA

SEQ ID NO: 1315934 - protein, 9 aa, Homo Sapiens
HFVCCIKPN

SEQ ID NO: 1315935 - protein, 9 aa, Homo Sapiens
KELLLKCTV

SEQ ID NO: 1315936 - protein, 9 aa, Homo Sapiens
LRMDSTNTD

SEQ ID NO: 1315937 - protein, 9 aa, Homo Sapiens
TTSLENTKP

SEQ ID NO: 1315938 - protein, 9 aa, Homo Sapiens
GKSFLHDNY

SEQ ID NO: 1315939 - protein, 9 aa, Homo Sapiens
LYHLDTYIP

SEQ ID NO: 1315940 - protein, 9 aa, Homo Sapiens
KINTMILDL

SEQ ID NO: 1315941 - protein, 9 aa, Homo Sapiens
IRQDPNRMP

SEQ ID NO: 1315942 - protein, 9 aa, Homo Sapiens
FEKQDELKC

SEQ ID NO: 1315943 - protein, 9 aa, Homo Sapiens
TVFKKIPLN

SEQ ID NO: 1315944 - protein, 9 aa, Homo Sapiens
LMRLPHMFK

SEQ ID NO: 1315945 - protein, 9 aa, Homo Sapiens
MLLCQNTQT

SEQ ID NO: 1315946 - protein, 9 aa, Homo Sapiens
VTGGYVYCG

SEQ ID NO: 1315947 - protein, 9 aa, Homo Sapiens
GDLCVSFSY

SEQ ID NO: 1315948 - protein, 9 aa, Homo Sapiens
PSQIKFMEK

SEQ ID NO: 1315949 - protein, 9 aa, Homo Sapiens
QNMEMKSVN

SEQ ID NO: 1315950 - protein, 9 aa, Homo Sapiens
RELHTTTPV

SEQ ID NO: 1315951 - protein, 9 aa, Homo Sapiens
SILYNLYGL

SEQ ID NO: 1315952 - protein, 9 aa, Homo Sapiens
RSPFFPNMY

SEQ ID NO: 1315953 - protein, 9 aa, Homo Sapiens
NKLTLKTIM

SEQ ID NO: 1315954 - protein, 9 aa, Homo Sapiens
NVSFLSDSE

SEQ ID NO: 1315955 - protein, 9 aa, Homo Sapiens
MRQDLMRHQ

SEQ ID NO: 1315956 - protein, 9 aa, Homo Sapiens
DNFGELRLG

SEQ ID NO: 1315957 - protein, 9 aa, Homo Sapiens
VGPQGPPHY

SEQ ID NO: 1315958 - protein, 9 aa, Homo Sapiens
RKVNYLMSL

SEQ ID NO: 1315959 - protein, 9 aa, Homo Sapiens
MAISRVIRL

SEQ ID NO: 1315960 - protein, 9 aa, Homo Sapiens
KHIYTKLFN

SEQ ID NO: 1315961 - protein, 9 aa, Homo Sapiens
ILESSSYLI

SEQ ID NO: 1315962 - protein, 9 aa, Homo Sapiens
ASRFIVITD

SEQ ID NO: 1315963 - protein, 9 aa, Homo Sapiens
EYMLKPKYF

SEQ ID NO: 1315964 - protein, 9 aa, Homo Sapiens
LRQHKFYLE

SEQ ID NO: 1315965 - protein, 9 aa, Homo Sapiens
CFSGMTGTS

SEQ ID NO: 1315966 - protein, 9 aa, Homo Sapiens
QLSALRCGH

SEQ ID NO: 1315967 - protein, 9 aa, Homo Sapiens
LSSRSSSRI

SEQ ID NO: 1315968 - protein, 9 aa, Homo Sapiens
IAEGFVKTT

SEQ ID NO: 1315969 - protein, 9 aa, Homo Sapiens
TSNIVISVV

SEQ ID NO: 1315970 - protein, 9 aa, Homo Sapiens
KITQLQDGR

SEQ ID NO: 1315971 - protein, 9 aa, Homo Sapiens
QLRCTIWII

SEQ ID NO: 1315972 - protein, 9 aa, Homo Sapiens
TKWSSRSSH

SEQ ID NO: 1315973 - protein, 9 aa, Homo Sapiens
IRDMVRYAC

SEQ ID NO: 1315974 - protein, 9 aa, Homo Sapiens
DCARHHCSN

SEQ ID NO: 1315975 - protein, 9 aa, Homo Sapiens
FVPQTCPRS

SEQ ID NO: 1315976 - protein, 9 aa, Homo Sapiens
TYDSDVTGC

SEQ ID NO: 1315977 - protein, 9 aa, Homo Sapiens
PCVLCPATA

SEQ ID NO: 1315978 - protein, 9 aa, Homo Sapiens
FHQYSGDDG

SEQ ID NO: 1315979 - protein, 9 aa, Homo Sapiens
SKLASVSEK

SEQ ID NO: 1315980 - protein, 9 aa, Homo Sapiens
LPAPSTKEH

SEQ ID NO: 1315981 - protein, 9 aa, Homo Sapiens
VLLSFAMLF

SEQ ID NO: 1315982 - protein, 9 aa, Homo Sapiens
MMLPTSGIP

SEQ ID NO: 1315983 - protein, 9 aa, Homo Sapiens
QGPYVSMTF

SEQ ID NO: 1315984 - protein, 9 aa, Homo Sapiens
LPANFWVTS

SEQ ID NO: 1315985 - protein, 9 aa, Homo Sapiens
AIMATLTIR

SEQ ID NO: 1315986 - protein, 9 aa, Homo Sapiens
KETGKILSN

SEQ ID NO: 1315987 - protein, 9 aa, Homo Sapiens
SSYVFYWWD

SEQ ID NO: 1315988 - protein, 9 aa, Homo Sapiens
VGWLTTWSQ

SEQ ID NO: 1315989 - protein, 9 aa, Homo Sapiens
RHRPQPYPY

SEQ ID NO: 1315990 - protein, 9 aa, Homo Sapiens
ELHKQWDRA

SEQ ID NO: 1315991 - protein, 9 aa, Homo Sapiens
IDKNMLDSF

SEQ ID NO: 1315992 - protein, 9 aa, Homo Sapiens
FFTENSETT

SEQ ID NO: 1315993 - protein, 9 aa, Homo Sapiens
SLPMTSEAG

SEQ ID NO: 1315994 - protein, 9 aa, Homo Sapiens
AHDYRDCEG

SEQ ID NO: 1315995 - protein, 9 aa, Homo Sapiens
EEFMNKFHS

SEQ ID NO: 1315996 - protein, 9 aa, Homo Sapiens
GPCHAAALA

SEQ ID NO: 1315997 - protein, 9 aa, Homo Sapiens
TDEDWNEVM

SEQ ID NO: 1315998 - protein, 9 aa, Homo Sapiens
WRSSSLWKA

SEQ ID NO: 1315999 - protein, 9 aa, Homo Sapiens
ALMWYSEAM

SEQ ID NO: 1316000 - protein, 9 aa, Homo Sapiens
CPDYACPIT

SEQ ID NO: 1316001 - protein, 9 aa, Homo Sapiens
EDAACITYI

SEQ ID NO: 1316002 - protein, 9 aa, Homo Sapiens
SLFLCISSF

SEQ ID NO: 1316003 - protein, 9 aa, Homo Sapiens
FVSSRSASD

SEQ ID NO: 1316004 - protein, 9 aa, Homo Sapiens
TPPYNKVCT

SEQ ID NO: 1316005 - protein, 9 aa, Homo Sapiens
CKPWATPDP

SEQ ID NO: 1316006 - protein, 9 aa, Homo Sapiens
LYYTHMDDP

SEQ ID NO: 1316007 - protein, 9 aa, Homo Sapiens
TKHWLAQLV

SEQ ID NO: 1316008 - protein, 9 aa, Homo Sapiens
ARRPSTAAR

SEQ ID NO: 1316009 - protein, 9 aa, Homo Sapiens
LRFMVSILK

SEQ ID NO: 1316010 - protein, 9 aa, Homo Sapiens
TALTPPSPS

SEQ ID NO: 1316011 - protein, 9 aa, Homo Sapiens
QRRILLRSL

SEQ ID NO: 1316012 - protein, 9 aa, Homo Sapiens
DLLVVHTRH

SEQ ID NO: 1316013 - protein, 9 aa, Homo Sapiens
GVDAGETAC

SEQ ID NO: 1316014 - protein, 9 aa, Homo Sapiens
FELLAKEHI

SEQ ID NO: 1316015 - protein, 9 aa, Homo Sapiens
KPDKMEEML

SEQ ID NO: 1316016 - protein, 9 aa, Homo Sapiens
RTTVSLNIR

SEQ ID NO: 1316017 - protein, 9 aa, Homo Sapiens
VPCLPVTYQ

SEQ ID NO: 1316018 - protein, 9 aa, Homo Sapiens
NDDTVSIES

SEQ ID NO: 1316019 - protein, 9 aa, Homo Sapiens
IFLIFQIHS

SEQ ID NO: 1316020 - protein, 9 aa, Homo Sapiens
TSDSTDAAT

SEQ ID NO: 1316021 - protein, 9 aa, Homo Sapiens
FSADNLAVT

SEQ ID NO: 1316022 - protein, 9 aa, Homo Sapiens
VIHDVDHPG

SEQ ID NO: 1316023 - protein, 9 aa, Homo Sapiens
DIFKILQEY

SEQ ID NO: 1316024 - protein, 9 aa, Homo Sapiens
RAVGCTEPE

SEQ ID NO: 1316025 - protein, 9 aa, Homo Sapiens
APCVPGPKG

SEQ ID NO: 1316026 - protein, 9 aa, Homo Sapiens
AWVQLGTQK

SEQ ID NO: 1316027 - protein, 9 aa, Homo Sapiens
MVNNYHPLQ

SEQ ID NO: 1316028 - protein, 9 aa, Homo Sapiens
ITSVKSLLQ

SEQ ID NO: 1316029 - protein, 9 aa, Homo Sapiens
QRLGTKLGF

SEQ ID NO: 1316030 - protein, 9 aa, Homo Sapiens
VNDIVTAGS

SEQ ID NO: 1316031 - protein, 9 aa, Homo Sapiens
AQKFKEFQE

SEQ ID NO: 1316032 - protein, 9 aa, Homo Sapiens
LDRLLSVWP

SEQ ID NO: 1316033 - protein, 9 aa, Homo Sapiens
LDDKKRLVH

SEQ ID NO: 1316034 - protein, 9 aa, Homo Sapiens
SVKSKKTKL

SEQ ID NO: 1316035 - protein, 9 aa, Homo Sapiens
GPLPCVLPH

SEQ ID NO: 1316036 - protein, 9 aa, Homo Sapiens
LRNGHKGLQ

SEQ ID NO: 1316037 - protein, 9 aa, Homo Sapiens
SGEKQHISR

SEQ ID NO: 1316038 - protein, 9 aa, Homo Sapiens
QGSVTVICR

SEQ ID NO: 1316039 - protein, 9 aa, Homo Sapiens
LAPPCAGFL

SEQ ID NO: 1316040 - protein, 9 aa, Homo Sapiens
GAFEGTLHD

SEQ ID NO: 1316041 - protein, 9 aa, Homo Sapiens
LWNEDYKSY

SEQ ID NO: 1316042 - protein, 9 aa, Homo Sapiens
EGRPDGLHP

SEQ ID NO: 1316043 - protein, 9 aa, Homo Sapiens
EAVAICKGP

SEQ ID NO: 1316044 - protein, 9 aa, Homo Sapiens
VKTEAISGD

SEQ ID NO: 1316045 - protein, 9 aa, Homo Sapiens
QETMQRWRS

SEQ ID NO: 1316046 - protein, 9 aa, Homo Sapiens
ECFLKGEGL

SEQ ID NO: 1316047 - protein, 9 aa, Homo Sapiens
CTISNDHGY

SEQ ID NO: 1316048 - protein, 9 aa, Homo Sapiens
ETLFKLFNL

SEQ ID NO: 1316049 - protein, 9 aa, Homo Sapiens
ARGEHKNQD

SEQ ID NO: 1316050 - protein, 9 aa, Homo Sapiens
QMRQSLVHS

SEQ ID NO: 1316051 - protein, 9 aa, Homo Sapiens
NILATCLSG

SEQ ID NO: 1316052 - protein, 9 aa, Homo Sapiens
HPEAELQKY

SEQ ID NO: 1316053 - protein, 9 aa, Homo Sapiens
EVKAKPTGA

SEQ ID NO: 1316054 - protein, 9 aa, Homo Sapiens
VPWPEVWKE

SEQ ID NO: 1316055 - protein, 9 aa, Homo Sapiens
KLSTGITLI

SEQ ID NO: 1316056 - protein, 9 aa, Homo Sapiens
CSHQHCLGL

SEQ ID NO: 1316057 - protein, 9 aa, Homo Sapiens
QARIATLES

SEQ ID NO: 1316058 - protein, 9 aa, Homo Sapiens
ISTLHDGHT

SEQ ID NO: 1316059 - protein, 9 aa, Homo Sapiens
VRYSAIKTI

SEQ ID NO: 1316060 - protein, 9 aa, Homo Sapiens
SSTMLQGQQ

SEQ ID NO: 1316061 - protein, 9 aa, Homo Sapiens
VKDIPSTLK

SEQ ID NO: 1316062 - protein, 9 aa, Homo Sapiens
INQEERDLR

SEQ ID NO: 1316063 - protein, 9 aa, Homo Sapiens
EAAAELDAE

SEQ ID NO: 1316064 - protein, 9 aa, Homo Sapiens
VLCTRTVRT

SEQ ID NO: 1316065 - protein, 9 aa, Homo Sapiens
GVNTGVICH

SEQ ID NO: 1316066 - protein, 9 aa, Homo Sapiens
KLDHYRTAL

SEQ ID NO: 1316067 - protein, 9 aa, Homo Sapiens
DVNIQSKDD

SEQ ID NO: 1316068 - protein, 9 aa, Homo Sapiens
RKFSLLKRE

SEQ ID NO: 1316069 - protein, 9 aa, Homo Sapiens
SHARFNCTV

SEQ ID NO: 1316070 - protein, 9 aa, Homo Sapiens
TRIHQEIQE

SEQ ID NO: 1316071 - protein, 9 aa, Homo Sapiens
STATSSSSF

SEQ ID NO: 1316072 - protein, 9 aa, Homo Sapiens
VHSPFVFGH

SEQ ID NO: 1316073 - protein, 9 aa, Homo Sapiens
QFLHTYSAA

SEQ ID NO: 1316074 - protein, 9 aa, Homo Sapiens
KCSILGLGQ

SEQ ID NO: 1316075 - protein, 9 aa, Homo Sapiens
FRKNWCALC

SEQ ID NO: 1316076 - protein, 9 aa, Homo Sapiens
VWTLFLELI

SEQ ID NO: 1316077 - protein, 9 aa, Homo Sapiens
SSKNQGIEE

SEQ ID NO: 1316078 - protein, 9 aa, Homo Sapiens
HFDPENPQT

SEQ ID NO: 1316079 - protein, 9 aa, Homo Sapiens
VLNANLSTL

SEQ ID NO: 1316080 - protein, 9 aa, Homo Sapiens
KSQLVEIVG

SEQ ID NO: 1316081 - protein, 9 aa, Homo Sapiens
IMMIKDKQQ

SEQ ID NO: 1316082 - protein, 9 aa, Homo Sapiens
PMHSVQHRH

SEQ ID NO: 1316083 - protein, 9 aa, Homo Sapiens
RLGRLLILR

SEQ ID NO: 1316084 - protein, 9 aa, Homo Sapiens
TSLFDAKER

SEQ ID NO: 1316085 - protein, 9 aa, Homo Sapiens
TSVPISSSA

SEQ ID NO: 1316086 - protein, 9 aa, Homo Sapiens
GYVYCGCES

SEQ ID NO: 1316087 - protein, 9 aa, Homo Sapiens
VYSPEKGCW

SEQ ID NO: 1316088 - protein, 9 aa, Homo Sapiens
MVINRSLVL

SEQ ID NO: 1316089 - protein, 9 aa, Homo Sapiens
GEFIALYQS

SEQ ID NO: 1316090 - protein, 9 aa, Homo Sapiens
HSSPGEGAN

SEQ ID NO: 1316091 - protein, 9 aa, Homo Sapiens
NSLVIYRLP

SEQ ID NO: 1316092 - protein, 9 aa, Homo Sapiens
QSSQDTGHL

SEQ ID NO: 1316093 - protein, 9 aa, Homo Sapiens
NMGGNRSIC

SEQ ID NO: 1316094 - protein, 9 aa, Homo Sapiens
THLPDCKGD

SEQ ID NO: 1316095 - protein, 9 aa, Homo Sapiens
TSGHSVAYK

SEQ ID NO: 1316096 - protein, 9 aa, Homo Sapiens
AYLQRITLY

SEQ ID NO: 1316097 - protein, 9 aa, Homo Sapiens
MSVTSQRFM

SEQ ID NO: 1316098 - protein, 9 aa, Homo Sapiens
IMRNHKRVK

SEQ ID NO: 1316099 - protein, 9 aa, Homo Sapiens
PYDVVPSMQ

SEQ ID NO: 1316100 - protein, 9 aa, Homo Sapiens
NFTRSRHSG

SEQ ID NO: 1316101 - protein, 9 aa, Homo Sapiens
LPLIFQVAP

SEQ ID NO: 1316102 - protein, 9 aa, Homo Sapiens
LTYAEAKVV

SEQ ID NO: 1316103 - protein, 9 aa, Homo Sapiens
AVTPELCPG

SEQ ID NO: 1316104 - protein, 9 aa, Homo Sapiens
RNQNLINVC

SEQ ID NO: 1316105 - protein, 9 aa, Homo Sapiens
PTYKQAKCN

SEQ ID NO: 1316106 - protein, 9 aa, Homo Sapiens
PDPGSLAPG

SEQ ID NO: 1316107 - protein, 9 aa, Homo Sapiens
HHIMTVRRS

SEQ ID NO: 1316108 - protein, 9 aa, Homo Sapiens
VQKELQIIN

SEQ ID NO: 1316109 - protein, 9 aa, Homo Sapiens
SLGEGCPPV

SEQ ID NO: 1316110 - protein, 9 aa, Homo Sapiens
VYTWNLDTL

SEQ ID NO: 1316111 - protein, 9 aa, Homo Sapiens
AAKNGSPVS

SEQ ID NO: 1316112 - protein, 9 aa, Homo Sapiens
PRSGGNRRS

SEQ ID NO: 1316113 - protein, 9 aa, Homo Sapiens
TKDIPFTCE

SEQ ID NO: 1316114 - protein, 9 aa, Homo Sapiens
SSNPVTKII

SEQ ID NO: 1316115 - protein, 9 aa, Homo Sapiens
NVTQMPRER

SEQ ID NO: 1316116 - protein, 9 aa, Homo Sapiens
VCGWWPFSK

SEQ ID NO: 1316117 - protein, 9 aa, Homo Sapiens
MVEKIIGRA

SEQ ID NO: 1316118 - protein, 9 aa, Homo Sapiens
AELQEVLGC

SEQ ID NO: 1316119 - protein, 9 aa, Homo Sapiens
FSILHAFLL

SEQ ID NO: 1316120 - protein, 9 aa, Homo Sapiens
VPKSGVKLD

SEQ ID NO: 1316121 - protein, 9 aa, Homo Sapiens
ANGFMEYLR

SEQ ID NO: 1316122 - protein, 9 aa, Homo Sapiens
YDVCYAPSC

SEQ ID NO: 1316123 - protein, 9 aa, Homo Sapiens
AMQRTMCTR

SEQ ID NO: 1316124 - protein, 9 aa, Homo Sapiens
SGIGVGECS

SEQ ID NO: 1316125 - protein, 9 aa, Homo Sapiens
EDLYILIGT

SEQ ID NO: 1316126 - protein, 9 aa, Homo Sapiens
SLHVPHPAQ

SEQ ID NO: 1316127 - protein, 9 aa, Homo Sapiens
ADNLAVTDD

SEQ ID NO: 1316128 - protein, 9 aa, Homo Sapiens
LTRLTHDYL

SEQ ID NO: 1316129 - protein, 9 aa, Homo Sapiens
SKVMYITSN

SEQ ID NO: 1316130 - protein, 9 aa, Homo Sapiens
REAEFQKMW

SEQ ID NO: 1316131 - protein, 9 aa, Homo Sapiens
MAAMRLMPK

SEQ ID NO: 1316132 - protein, 9 aa, Homo Sapiens
ASVTTGKVP

SEQ ID NO: 1316133 - protein, 9 aa, Homo Sapiens
YHQDDPSYR

SEQ ID NO: 1316134 - protein, 9 aa, Homo Sapiens
FSNRPVLAG

SEQ ID NO: 1316135 - protein, 9 aa, Homo Sapiens
AWRPHNAIF

SEQ ID NO: 1316136 - protein, 9 aa, Homo Sapiens
DTNDSQFFI

SEQ ID NO: 1316137 - protein, 9 aa, Homo Sapiens
LPSPPTPPA

SEQ ID NO: 1316138 - protein, 9 aa, Homo Sapiens
IVMLQRWMP

SEQ ID NO: 1316139 - protein, 9 aa, Homo Sapiens
VTYEGIIEE

SEQ ID NO: 1316140 - protein, 9 aa, Homo Sapiens
SHLTDADFT

SEQ ID NO: 1316141 - protein, 9 aa, Homo Sapiens
GRILHQPEM

SEQ ID NO: 1316142 - protein, 9 aa, Homo Sapiens
ANSVWEETS

SEQ ID NO: 1316143 - protein, 9 aa, Homo Sapiens
NPSATPCRK

SEQ ID NO: 1316144 - protein, 9 aa, Homo Sapiens
AGVSPGRAE

SEQ ID NO: 1316145 - protein, 9 aa, Homo Sapiens
IQDLAPPCA

SEQ ID NO: 1316146 - protein, 9 aa, Homo Sapiens
TEMRRRTPW

SEQ ID NO: 1316147 - protein, 9 aa, Homo Sapiens
KFWCKAGGG

SEQ ID NO: 1316148 - protein, 9 aa, Homo Sapiens
VENEKTPIT

SEQ ID NO: 1316149 - protein, 9 aa, Homo Sapiens
VADRMQRQE

SEQ ID NO: 1316150 - protein, 9 aa, Homo Sapiens
CRLRKPKIT

SEQ ID NO: 1316151 - protein, 9 aa, Homo Sapiens
HTSHATTAS

SEQ ID NO: 1316152 - protein, 9 aa, Homo Sapiens
ATSSSSFIS

SEQ ID NO: 1316153 - protein, 9 aa, Homo Sapiens
HNKLKASQV

SEQ ID NO: 1316154 - protein, 9 aa, Homo Sapiens
RRITELEMT

SEQ ID NO: 1316155 - protein, 9 aa, Homo Sapiens
HHIVAPPGG

SEQ ID NO: 1316156 - protein, 9 aa, Homo Sapiens
HLRFTRPLQ

SEQ ID NO: 1316157 - protein, 9 aa, Homo Sapiens
KGSDIWSFG

SEQ ID NO: 1316158 - protein, 9 aa, Homo Sapiens
TMLTYSLTY

SEQ ID NO: 1316159 - protein, 9 aa, Homo Sapiens
HRLDNLSIL

SEQ ID NO: 1316160 - protein, 9 aa, Homo Sapiens
VPQDHLAYR

SEQ ID NO: 1316161 - protein, 9 aa, Homo Sapiens
QAPGSWGSL

SEQ ID NO: 1316162 - protein, 9 aa, Homo Sapiens
RFIVITDFR

SEQ ID NO: 1316163 - protein, 9 aa, Homo Sapiens
KRCSPSLSS

SEQ ID NO: 1316164 - protein, 9 aa, Homo Sapiens
RKCLANSSW

SEQ ID NO: 1316165 - protein, 9 aa, Homo Sapiens
VTWYWCTDQ

SEQ ID NO: 1316166 - protein, 9 aa, Homo Sapiens
HTEVAKTMW

SEQ ID NO: 1316167 - protein, 9 aa, Homo Sapiens
PDDKNEEHE

SEQ ID NO: 1316168 - protein, 9 aa, Homo Sapiens
FYVIVEYAS

SEQ ID NO: 1316169 - protein, 9 aa, Homo Sapiens
HHRVMNQQH

SEQ ID NO: 1316170 - protein, 9 aa, Homo Sapiens
DYMREWCAK

SEQ ID NO: 1316171 - protein, 9 aa, Homo Sapiens
DLPILDDQI

SEQ ID NO: 1316172 - protein, 9 aa, Homo Sapiens
TSFSILMPP

SEQ ID NO: 1316173 - protein, 9 aa, Homo Sapiens
LGAFLAQSP

SEQ ID NO: 1316174 - protein, 9 aa, Homo Sapiens
KGDIYAKTL

SEQ ID NO: 1316175 - protein, 9 aa, Homo Sapiens
SQINGASRS

SEQ ID NO: 1316176 - protein, 9 aa, Homo Sapiens
DLVTAEKCL

SEQ ID NO: 1316177 - protein, 9 aa, Homo Sapiens
QITAEDSAE

SEQ ID NO: 1316178 - protein, 9 aa, Homo Sapiens
DKKCPDYAC

SEQ ID NO: 1316179 - protein, 9 aa, Homo Sapiens
EFGMSTVSC

SEQ ID NO: 1316180 - protein, 9 aa, Homo Sapiens
HHLHHLEVL

SEQ ID NO: 1316181 - protein, 9 aa, Homo Sapiens
VMRLTCADT

SEQ ID NO: 1316182 - protein, 9 aa, Homo Sapiens
HILSEFYEP

SEQ ID NO: 1316183 - protein, 9 aa, Homo Sapiens
TAELLGHRE

SEQ ID NO: 1316184 - protein, 9 aa, Homo Sapiens
RWMPQTFRD

SEQ ID NO: 1316185 - protein, 9 aa, Homo Sapiens
IKHIDCHMT

SEQ ID NO: 1316186 - protein, 9 aa, Homo Sapiens
RHIVESDVG

SEQ ID NO: 1316187 - protein, 9 aa, Homo Sapiens
YSPEKGCWT

SEQ ID NO: 1316188 - protein, 9 aa, Homo Sapiens
AMIMYNFFI

SEQ ID NO: 1316189 - protein, 9 aa, Homo Sapiens
HLVPVERVT

SEQ ID NO: 1316190 - protein, 9 aa, Homo Sapiens
GGSQSDRGG

SEQ ID NO: 1316191 - protein, 9 aa, Homo Sapiens
SEDKHISLA

SEQ ID NO: 1316192 - protein, 9 aa, Homo Sapiens
DPVSQDMFD

SEQ ID NO: 1316193 - protein, 9 aa, Homo Sapiens
MTCCRFSPT

SEQ ID NO: 1316194 - protein, 9 aa, Homo Sapiens
CGLIIVVFV

SEQ ID NO: 1316195 - protein, 9 aa, Homo Sapiens
SLHTSSSTM

SEQ ID NO: 1316196 - protein, 9 aa, Homo Sapiens
PIPHVSESP

SEQ ID NO: 1316197 - protein, 9 aa, Homo Sapiens
RMTEQQGEY

SEQ ID NO: 1316198 - protein, 9 aa, Homo Sapiens
LCCLFLQMN

SEQ ID NO: 1316199 - protein, 9 aa, Homo Sapiens
TLRTSKEAI

SEQ ID NO: 1316200 - protein, 9 aa, Homo Sapiens
RYITIRWKS

SEQ ID NO: 1316201 - protein, 9 aa, Homo Sapiens
HQEPGAVVP

SEQ ID NO: 1316202 - protein, 9 aa, Homo Sapiens
VTMSYPMHS

SEQ ID NO: 1316203 - protein, 9 aa, Homo Sapiens
SSSSGSSFS

SEQ ID NO: 1316204 - protein, 9 aa, Homo Sapiens
IWAIHVLRI

SEQ ID NO: 1316205 - protein, 9 aa, Homo Sapiens
SKELSKCQF

SEQ ID NO: 1316206 - protein, 9 aa, Homo Sapiens
RFMLRMTEQ

SEQ ID NO: 1316207 - protein, 9 aa, Homo Sapiens
ARVLKGSHA

SEQ ID NO: 1316208 - protein, 9 aa, Homo Sapiens
PHDTLCLTA

SEQ ID NO: 1316209 - protein, 9 aa, Homo Sapiens
MRPSGHRRR

SEQ ID NO: 1316210 - protein, 9 aa, Homo Sapiens
KKPVCVFRL

SEQ ID NO: 1316211 - protein, 9 aa, Homo Sapiens
RLFNSPLKL

SEQ ID NO: 1316212 - protein, 9 aa, Homo Sapiens
VSNSEQASH

SEQ ID NO: 1316213 - protein, 9 aa, Homo Sapiens
ALGMQLLVV

SEQ ID NO: 1316214 - protein, 9 aa, Homo Sapiens
HSLISSYNL

SEQ ID NO: 1316215 - protein, 9 aa, Homo Sapiens
GRVTHLTGI

SEQ ID NO: 1316216 - protein, 9 aa, Homo Sapiens
SPLTSSGHH

SEQ ID NO: 1316217 - protein, 9 aa, Homo Sapiens
TCADTWVHE

SEQ ID NO: 1316218 - protein, 9 aa, Homo Sapiens
RLDDNHIST

SEQ ID NO: 1316219 - protein, 9 aa, Homo Sapiens
SQEVQLEAI

SEQ ID NO: 1316220 - protein, 9 aa, Homo Sapiens
AVSRENPVT

SEQ ID NO: 1316221 - protein, 9 aa, Homo Sapiens
HGTNSEPAD

SEQ ID NO: 1316222 - protein, 9 aa, Homo Sapiens
RAIEAAGAK

SEQ ID NO: 1316223 - protein, 9 aa, Homo Sapiens
HPAPGYPSQ

SEQ ID NO: 1316224 - protein, 9 aa, Homo Sapiens
LTWLENGNM

SEQ ID NO: 1316225 - protein, 9 aa, Homo Sapiens
YCQHMQEEN

SEQ ID NO: 1316226 - protein, 9 aa, Homo Sapiens
HPGFYAEWF

SEQ ID NO: 1316227 - protein, 9 aa, Homo Sapiens
GIRGQEVNM

SEQ ID NO: 1316228 - protein, 9 aa, Homo Sapiens
GKPDLNMAL

SEQ ID NO: 1316229 - protein, 9 aa, Homo Sapiens
KFEGNIMSP

SEQ ID NO: 1316230 - protein, 9 aa, Homo Sapiens
SEGPHKGLA

SEQ ID NO: 1316231 - protein, 9 aa, Homo Sapiens
VLLIVKKVC

SEQ ID NO: 1316232 - protein, 9 aa, Homo Sapiens
ARKRGEGGQ

SEQ ID NO: 1316233 - protein, 9 aa, Homo Sapiens
ALDTDFRKL

SEQ ID NO: 1316234 - protein, 9 aa, Homo Sapiens
GAALYTYML

SEQ ID NO: 1316235 - protein, 9 aa, Homo Sapiens
INVKYFLHM

SEQ ID NO: 1316236 - protein, 9 aa, Homo Sapiens
VDSAQLLMA

SEQ ID NO: 1316237 - protein, 9 aa, Homo Sapiens
GKYSDMHTM

SEQ ID NO: 1316238 - protein, 9 aa, Homo Sapiens
TPITIEIEH

SEQ ID NO: 1316239 - protein, 9 aa, Homo Sapiens
RKLKSILPI

SEQ ID NO: 1316240 - protein, 9 aa, Homo Sapiens
NQISRVQLI

SEQ ID NO: 1316241 - protein, 9 aa, Homo Sapiens
LWAASFYAH

SEQ ID NO: 1316242 - protein, 9 aa, Homo Sapiens
QEVSPPVEQ

SEQ ID NO: 1316243 - protein, 9 aa, Homo Sapiens
HIKGLEASS

SEQ ID NO: 1316244 - protein, 9 aa, Homo Sapiens
THLKRLVKL

SEQ ID NO: 1316245 - protein, 9 aa, Homo Sapiens
ITSMLGSTD

SEQ ID NO: 1316246 - protein, 9 aa, Homo Sapiens
RALRGRLRA

SEQ ID NO: 1316247 - protein, 9 aa, Homo Sapiens
MTINGIPTE

SEQ ID NO: 1316248 - protein, 9 aa, Homo Sapiens
TKPIRSPVM

SEQ ID NO: 1316249 - protein, 9 aa, Homo Sapiens
VQQEVIMLF

SEQ ID NO: 1316250 - protein, 9 aa, Homo Sapiens
PRLREEMEC

SEQ ID NO: 1316251 - protein, 9 aa, Homo Sapiens
QDFPCNCWV

SEQ ID NO: 1316252 - protein, 9 aa, Homo Sapiens
LRTQLDLCR

SEQ ID NO: 1316253 - protein, 9 aa, Homo Sapiens
NLQEDVEEN

SEQ ID NO: 1316254 - protein, 9 aa, Homo Sapiens
LQREDWLGV

SEQ ID NO: 1316255 - protein, 9 aa, Homo Sapiens
LLRQGVPQA

SEQ ID NO: 1316256 - protein, 9 aa, Homo Sapiens
TTIEKLRME

SEQ ID NO: 1316257 - protein, 9 aa, Homo Sapiens
CIVMTDLKD

SEQ ID NO: 1316258 - protein, 9 aa, Homo Sapiens
VDGSMWSIT

SEQ ID NO: 1316259 - protein, 9 aa, Homo Sapiens
LTHSKLQRV

SEQ ID NO: 1316260 - protein, 9 aa, Homo Sapiens
LQLEKVMTE

SEQ ID NO: 1316261 - protein, 9 aa, Homo Sapiens
MDSTNTDAL

SEQ ID NO: 1316262 - protein, 9 aa, Homo Sapiens
RASGPTSAA

SEQ ID NO: 1316263 - protein, 9 aa, Homo Sapiens
YIEVIPPNN

SEQ ID NO: 1316264 - protein, 9 aa, Homo Sapiens
GIGHQKCKP

SEQ ID NO: 1316265 - protein, 9 aa, Homo Sapiens
QEGQLRVYG

SEQ ID NO: 1316266 - protein, 9 aa, Homo Sapiens
STAPVSEVN

SEQ ID NO: 1316267 - protein, 9 aa, Homo Sapiens
AEGTGAELS

SEQ ID NO: 1316268 - protein, 9 aa, Homo Sapiens
QLIKDKKAT

SEQ ID NO: 1316269 - protein, 9 aa, Homo Sapiens
NGLVRALGE

SEQ ID NO: 1316270 - protein, 9 aa, Homo Sapiens
PKKPEALIV

SEQ ID NO: 1316271 - protein, 9 aa, Homo Sapiens
EEMNQTNKD

SEQ ID NO: 1316272 - protein, 9 aa, Homo Sapiens
VIENCICVN

SEQ ID NO: 1316273 - protein, 9 aa, Homo Sapiens
QERVEYIKS

SEQ ID NO: 1316274 - protein, 9 aa, Homo Sapiens
GKMYGWSSS

SEQ ID NO: 1316275 - protein, 9 aa, Homo Sapiens
QEHRCIPRG

SEQ ID NO: 1316276 - protein, 9 aa, Homo Sapiens
DRMYSYPAH

SEQ ID NO: 1316277 - protein, 9 aa, Homo Sapiens
EFVEYHKIK

SEQ ID NO: 1316278 - protein, 9 aa, Homo Sapiens
SSTPSMCYW

SEQ ID NO: 1316279 - protein, 9 aa, Homo Sapiens
TAVKKKSLC

SEQ ID NO: 1316280 - protein, 9 aa, Homo Sapiens
RKPTSDEAP

SEQ ID NO: 1316281 - protein, 9 aa, Homo Sapiens
RTQLDLCRF

SEQ ID NO: 1316282 - protein, 9 aa, Homo Sapiens
MCYEPANSH

SEQ ID NO: 1316283 - protein, 9 aa, Homo Sapiens
GVGLGPVLP

SEQ ID NO: 1316284 - protein, 9 aa, Homo Sapiens
ETPCDDIKN

SEQ ID NO: 1316285 - protein, 9 aa, Homo Sapiens
LERIKNNDS

SEQ ID NO: 1316286 - protein, 9 aa, Homo Sapiens
LQQQKICQN

SEQ ID NO: 1316287 - protein, 9 aa, Homo Sapiens
SRLSVRNVG

SEQ ID NO: 1316288 - protein, 9 aa, Homo Sapiens
GRTIITKSF

SEQ ID NO: 1316289 - protein, 9 aa, Homo Sapiens
TVRFTLRRM

SEQ ID NO: 1316290 - protein, 9 aa, Homo Sapiens
KKKADSYIE

SEQ ID NO: 1316291 - protein, 9 aa, Homo Sapiens
CYWLEEAEC

SEQ ID NO: 1316292 - protein, 9 aa, Homo Sapiens
PLPAAIHTA

SEQ ID NO: 1316293 - protein, 9 aa, Homo Sapiens
PVRPGPHQL

SEQ ID NO: 1316294 - protein, 9 aa, Homo Sapiens
TPVVPIPPQ

SEQ ID NO: 1316295 - protein, 9 aa, Homo Sapiens
QKTINCFLM

SEQ ID NO: 1316296 - protein, 9 aa, Homo Sapiens
APEVLDENL

SEQ ID NO: 1316297 - protein, 9 aa, Homo Sapiens
CIAVCIPMH

SEQ ID NO: 1316298 - protein, 9 aa, Homo Sapiens
RKHLVECGS

SEQ ID NO: 1316299 - protein, 9 aa, Homo Sapiens
AALRYERAI

SEQ ID NO: 1316300 - protein, 9 aa, Homo Sapiens
QVYPDDIRH

SEQ ID NO: 1316301 - protein, 9 aa, Homo Sapiens
SKPKCQKSS

SEQ ID NO: 1316302 - protein, 9 aa, Homo Sapiens
CSERCCSLA

SEQ ID NO: 1316303 - protein, 9 aa, Homo Sapiens
KCTDPRGRF

SEQ ID NO: 1316304 - protein, 9 aa, Homo Sapiens
AEVRSSLKS

SEQ ID NO: 1316305 - protein, 9 aa, Homo Sapiens
HNLDQLRFS

SEQ ID NO: 1316306 - protein, 9 aa, Homo Sapiens
RMDSTNTDA

SEQ ID NO: 1316307 - protein, 9 aa, Homo Sapiens
HDGTIRDLV

SEQ ID NO: 1316308 - protein, 9 aa, Homo Sapiens
EQFLRVMTW

SEQ ID NO: 1316309 - protein, 9 aa, Homo Sapiens
DISLDLPVS

SEQ ID NO: 1316310 - protein, 9 aa, Homo Sapiens
GAAEQKYVG

SEQ ID NO: 1316311 - protein, 9 aa, Homo Sapiens
RAKAIFENM

SEQ ID NO: 1316312 - protein, 9 aa, Homo Sapiens
PKDIFDELF

SEQ ID NO: 1316313 - protein, 9 aa, Homo Sapiens
GIMHTSYRQ

SEQ ID NO: 1316314 - protein, 9 aa, Homo Sapiens
GAGTAGRRL

SEQ ID NO: 1316315 - protein, 9 aa, Homo Sapiens
VQRNIRLVS

SEQ ID NO: 1316316 - protein, 9 aa, Homo Sapiens
RQGGSPVGD

SEQ ID NO: 1316317 - protein, 9 aa, Homo Sapiens
PHLNGPWIS

SEQ ID NO: 1316318 - protein, 9 aa, Homo Sapiens
ADYLHAMCT

SEQ ID NO: 1316319 - protein, 9 aa, Homo Sapiens
YIQMEKYAC

SEQ ID NO: 1316320 - protein, 9 aa, Homo Sapiens
KDIGYLDDL

SEQ ID NO: 1316321 - protein, 9 aa, Homo Sapiens
TSQGRTKPS

SEQ ID NO: 1316322 - protein, 9 aa, Homo Sapiens
INDLYSVSD

SEQ ID NO: 1316323 - protein, 9 aa, Homo Sapiens
NIVGSYSCR

SEQ ID NO: 1316324 - protein, 9 aa, Homo Sapiens
VLGPDPRWC

SEQ ID NO: 1316325 - protein, 9 aa, Homo Sapiens
RPLCPHARA

SEQ ID NO: 1316326 - protein, 9 aa, Homo Sapiens
HSCFPGRSA

SEQ ID NO: 1316327 - protein, 9 aa, Homo Sapiens
AEGPKGKKG

SEQ ID NO: 1316328 - protein, 9 aa, Homo Sapiens
SKKLPSQST

SEQ ID NO: 1316329 - protein, 9 aa, Homo Sapiens
GSITLLGLV

SEQ ID NO: 1316330 - protein, 9 aa, Homo Sapiens
CLITLLPFM

SEQ ID NO: 1316331 - protein, 9 aa, Homo Sapiens
LEATEMQLP

SEQ ID NO: 1316332 - protein, 9 aa, Homo Sapiens
DITDVLGTE

SEQ ID NO: 1316333 - protein, 9 aa, Homo Sapiens
IFAYLIFAL

SEQ ID NO: 1316334 - protein, 9 aa, Homo Sapiens
VRDLLSKML

SEQ ID NO: 1316335 - protein, 9 aa, Homo Sapiens
STMYNLHQQ

SEQ ID NO: 1316336 - protein, 9 aa, Homo Sapiens
LEDMLYVPL

SEQ ID NO: 1316337 - protein, 9 aa, Homo Sapiens
SGITSCVFT

SEQ ID NO: 1316338 - protein, 9 aa, Homo Sapiens
FCTSPPSCR

SEQ ID NO: 1316339 - protein, 9 aa, Homo Sapiens
HFVKDEKNR

SEQ ID NO: 1316340 - protein, 9 aa, Homo Sapiens
FISLATTDC

SEQ ID NO: 1316341 - protein, 9 aa, Homo Sapiens
STILCCITF

SEQ ID NO: 1316342 - protein, 9 aa, Homo Sapiens
FWLKKLHES

SEQ ID NO: 1316343 - protein, 9 aa, Homo Sapiens
KCDDDDDND

SEQ ID NO: 1316344 - protein, 9 aa, Homo Sapiens
KKNNSHMIL

SEQ ID NO: 1316345 - protein, 9 aa, Homo Sapiens
PAFRRGCLR

SEQ ID NO: 1316346 - protein, 9 aa, Homo Sapiens
SMQVPFSGC

SEQ ID NO: 1316347 - protein, 9 aa, Homo Sapiens
DERMWSPQN

SEQ ID NO: 1316348 - protein, 9 aa, Homo Sapiens
HGHSTPQMS

SEQ ID NO: 1316349 - protein, 9 aa, Homo Sapiens
VSQVAFDSF

SEQ ID NO: 1316350 - protein, 9 aa, Homo Sapiens
EKEAPDVHF

SEQ ID NO: 1316351 - protein, 9 aa, Homo Sapiens
PKKNNSHMI

SEQ ID NO: 1316352 - protein, 9 aa, Homo Sapiens
HIMEDDIME

SEQ ID NO: 1316353 - protein, 9 aa, Homo Sapiens
RVVLVGLDI

SEQ ID NO: 1316354 - protein, 9 aa, Homo Sapiens
RSQDDTMVD

SEQ ID NO: 1316355 - protein, 9 aa, Homo Sapiens
REVIHLAQD

SEQ ID NO: 1316356 - protein, 9 aa, Homo Sapiens
GECGAPGPA

SEQ ID NO: 1316357 - protein, 9 aa, Homo Sapiens
PGDDWHCLQ

SEQ ID NO: 1316358 - protein, 9 aa, Homo Sapiens
TGKTMVMNM

SEQ ID NO: 1316359 - protein, 9 aa, Homo Sapiens
VSRHLVSLI

SEQ ID NO: 1316360 - protein, 9 aa, Homo Sapiens
DMVSQEETQ

SEQ ID NO: 1316361 - protein, 9 aa, Homo Sapiens
HIPNYGAIP

SEQ ID NO: 1316362 - protein, 9 aa, Homo Sapiens
SLDVTPQAI

SEQ ID NO: 1316363 - protein, 9 aa, Homo Sapiens
VDGAWGQWT

SEQ ID NO: 1316364 - protein, 9 aa, Homo Sapiens
NETATTSDS

SEQ ID NO: 1316365 - protein, 9 aa, Homo Sapiens
CLVTAPVAS

SEQ ID NO: 1316366 - protein, 9 aa, Homo Sapiens
HKIYLRPAI

SEQ ID NO: 1316367 - protein, 9 aa, Homo Sapiens
LTKCKGTIL

SEQ ID NO: 1316368 - protein, 9 aa, Homo Sapiens
EANDGEGSS

SEQ ID NO: 1316369 - protein, 9 aa, Homo Sapiens
HSGSSLVSP

SEQ ID NO: 1316370 - protein, 9 aa, Homo Sapiens
IEDLVCGEF

SEQ ID NO: 1316371 - protein, 9 aa, Homo Sapiens
ILFIVLFAI

SEQ ID NO: 1316372 - protein, 9 aa, Homo Sapiens
KMTTFFTEN

SEQ ID NO: 1316373 - protein, 9 aa, Homo Sapiens
DVFEMCFAK

SEQ ID NO: 1316374 - protein, 9 aa, Homo Sapiens
NSSAEDEKN

SEQ ID NO: 1316375 - protein, 9 aa, Homo Sapiens
TDADFTLLA

SEQ ID NO: 1316376 - protein, 9 aa, Homo Sapiens
LSDGVLAWG

SEQ ID NO: 1316377 - protein, 9 aa, Homo Sapiens
CRFKHPVNV

SEQ ID NO: 1316378 - protein, 9 aa, Homo Sapiens
KQCMMVRAA

SEQ ID NO: 1316379 - protein, 9 aa, Homo Sapiens
VFRASVDLT

SEQ ID NO: 1316380 - protein, 9 aa, Homo Sapiens
MEIKGMVTE

SEQ ID NO: 1316381 - protein, 9 aa, Homo Sapiens
SGRRCWGQT

SEQ ID NO: 1316382 - protein, 9 aa, Homo Sapiens
NQIQEIISD

SEQ ID NO: 1316383 - protein, 9 aa, Homo Sapiens
MCFAKMPDE

SEQ ID NO: 1316384 - protein, 9 aa, Homo Sapiens
KPMQTRVVR

SEQ ID NO: 1316385 - protein, 9 aa, Homo Sapiens
LRRVSHLLT

SEQ ID NO: 1316386 - protein, 9 aa, Homo Sapiens
ALEAIERVA

SEQ ID NO: 1316387 - protein, 9 aa, Homo Sapiens
SSEFYKVQG

SEQ ID NO: 1316388 - protein, 9 aa, Homo Sapiens
DMGSLVSAW

SEQ ID NO: 1316389 - protein, 9 aa, Homo Sapiens
WDTSNHGLA

SEQ ID NO: 1316390 - protein, 9 aa, Homo Sapiens
VAPGHALSC

SEQ ID NO: 1316391 - protein, 9 aa, Homo Sapiens
YILTCNMSL

SEQ ID NO: 1316392 - protein, 9 aa, Homo Sapiens
DMHTMKHSD

SEQ ID NO: 1316393 - protein, 9 aa, Homo Sapiens
YTFNALIES

SEQ ID NO: 1316394 - protein, 9 aa, Homo Sapiens
KETSMQPPE

SEQ ID NO: 1316395 - protein, 9 aa, Homo Sapiens
TLKTRLSDA

SEQ ID NO: 1316396 - protein, 9 aa, Homo Sapiens
QGKSNFEEY

SEQ ID NO: 1316397 - protein, 9 aa, Homo Sapiens
GAHKGQIVI

SEQ ID NO: 1316398 - protein, 9 aa, Homo Sapiens
GEDSTTRGN

SEQ ID NO: 1316399 - protein, 9 aa, Homo Sapiens
RNYGFGIMC

SEQ ID NO: 1316400 - protein, 9 aa, Homo Sapiens
RGTRYPDVN

SEQ ID NO: 1316401 - protein, 9 aa, Homo Sapiens
ESELKHRSI

SEQ ID NO: 1316402 - protein, 9 aa, Homo Sapiens
WLLITAWER

SEQ ID NO: 1316403 - protein, 9 aa, Homo Sapiens
HMGKKPYTC

SEQ ID NO: 1316404 - protein, 9 aa, Homo Sapiens
QEVEIGTVV

SEQ ID NO: 1316405 - protein, 9 aa, Homo Sapiens
PSGDVSPIS

SEQ ID NO: 1316406 - protein, 9 aa, Homo Sapiens
EQVHRRMNN

SEQ ID NO: 1316407 - protein, 9 aa, Homo Sapiens
PKTSRRCWA

SEQ ID NO: 1316408 - protein, 9 aa, Homo Sapiens
VIEDDVCFE

SEQ ID NO: 1316409 - protein, 9 aa, Homo Sapiens
EVIIPLPTW

SEQ ID NO: 1316410 - protein, 9 aa, Homo Sapiens
WCEEMKYCK

SEQ ID NO: 1316411 - protein, 9 aa, Homo Sapiens
HESLNIENT

SEQ ID NO: 1316412 - protein, 9 aa, Homo Sapiens
HATEKQKKK

SEQ ID NO: 1316413 - protein, 9 aa, Homo Sapiens
LRDGTVTTY

SEQ ID NO: 1316414 - protein, 9 aa, Homo Sapiens
HTCFNHLDL

SEQ ID NO: 1316415 - protein, 9 aa, Homo Sapiens
YTDTEMKSD

SEQ ID NO: 1316416 - protein, 9 aa, Homo Sapiens
ALVAELALV

SEQ ID NO: 1316417 - protein, 9 aa, Homo Sapiens
YVCPSTQDI

SEQ ID NO: 1316418 - protein, 9 aa, Homo Sapiens
DNAFFKDKQ

SEQ ID NO: 1316419 - protein, 9 aa, Homo Sapiens
RRRSSKSPK

SEQ ID NO: 1316420 - protein, 9 aa, Homo Sapiens
CVQGKTPPR

SEQ ID NO: 1316421 - protein, 9 aa, Homo Sapiens
LTNLEYHRT

SEQ ID NO: 1316422 - protein, 9 aa, Homo Sapiens
PLDCSERAS

SEQ ID NO: 1316423 - protein, 9 aa, Homo Sapiens
LREWEERVV

SEQ ID NO: 1316424 - protein, 9 aa, Homo Sapiens
PELAKMIKM

SEQ ID NO: 1316425 - protein, 9 aa, Homo Sapiens
LILWPQAAP

SEQ ID NO: 1316426 - protein, 9 aa, Homo Sapiens
SNTNQADHD

SEQ ID NO: 1316427 - protein, 9 aa, Homo Sapiens
IHRDLTARN

SEQ ID NO: 1316428 - protein, 9 aa, Homo Sapiens
TPRTSLHTS

SEQ ID NO: 1316429 - protein, 9 aa, Homo Sapiens
PVKDLTLHN

SEQ ID NO: 1316430 - protein, 9 aa, Homo Sapiens
KSTSPKKAV

SEQ ID NO: 1316431 - protein, 9 aa, Homo Sapiens
MRPKASGAT

SEQ ID NO: 1316432 - protein, 9 aa, Homo Sapiens
RKLGLYMTT

SEQ ID NO: 1316433 - protein, 9 aa, Homo Sapiens
ITLQEEADY

SEQ ID NO: 1316434 - protein, 9 aa, Homo Sapiens
LANSVWEET

SEQ ID NO: 1316435 - protein, 9 aa, Homo Sapiens
EEHDDSLRF

SEQ ID NO: 1316436 - protein, 9 aa, Homo Sapiens
DCEAEVWAA

SEQ ID NO: 1316437 - protein, 9 aa, Homo Sapiens
SMHYLFIIS

SEQ ID NO: 1316438 - protein, 9 aa, Homo Sapiens
DIGYLDDLL

SEQ ID NO: 1316439 - protein, 9 aa, Homo Sapiens
LWVLCTVIT

SEQ ID NO: 1316440 - protein, 9 aa, Homo Sapiens
SSVMKQAPQ

SEQ ID NO: 1316441 - protein, 9 aa, Homo Sapiens
QQKGQHFGL

SEQ ID NO: 1316442 - protein, 9 aa, Homo Sapiens
LQPQKINNE

SEQ ID NO: 1316443 - protein, 9 aa, Homo Sapiens
QHLLSGCHV

SEQ ID NO: 1316444 - protein, 9 aa, Homo Sapiens
RRAPPRSGR

SEQ ID NO: 1316445 - protein, 9 aa, Homo Sapiens
VQLIQANTP

SEQ ID NO: 1316446 - protein, 9 aa, Homo Sapiens
ADIESIMAL

SEQ ID NO: 1316447 - protein, 9 aa, Homo Sapiens
HELGDFTAL

SEQ ID NO: 1316448 - protein, 9 aa, Homo Sapiens
EDTLVGDSV

SEQ ID NO: 1316449 - protein, 9 aa, Homo Sapiens
AQDPFQFSA

SEQ ID NO: 1316450 - protein, 9 aa, Homo Sapiens
MKLERHWHY

SEQ ID NO: 1316451 - protein, 9 aa, Homo Sapiens
FRDESALFL

SEQ ID NO: 1316452 - protein, 9 aa, Homo Sapiens
LSGFIKKTF

SEQ ID NO: 1316453 - protein, 9 aa, Homo Sapiens
QEAYADSWS

SEQ ID NO: 1316454 - protein, 9 aa, Homo Sapiens
SGGRGEDGT

SEQ ID NO: 1316455 - protein, 9 aa, Homo Sapiens
DKKMCTKID

SEQ ID NO: 1316456 - protein, 9 aa, Homo Sapiens
PSTRGRTRA

SEQ ID NO: 1316457 - protein, 9 aa, Homo Sapiens
WEKLLKNMQ

SEQ ID NO: 1316458 - protein, 9 aa, Homo Sapiens
KEEPLISAF

SEQ ID NO: 1316459 - protein, 9 aa, Homo Sapiens
HMKTHNGEK

SEQ ID NO: 1316460 - protein, 9 aa, Homo Sapiens
WILYLFLAL

SEQ ID NO: 1316461 - protein, 9 aa, Homo Sapiens
GTTMKGLQM

SEQ ID NO: 1316462 - protein, 9 aa, Homo Sapiens
KVTMQNLNN

SEQ ID NO: 1316463 - protein, 9 aa, Homo Sapiens
SLFANRWGS

SEQ ID NO: 1316464 - protein, 9 aa, Homo Sapiens
VTLVIVCAC

SEQ ID NO: 1316465 - protein, 9 aa, Homo Sapiens
EISKAGEYI

SEQ ID NO: 1316466 - protein, 9 aa, Homo Sapiens
RGIIHHTWP

SEQ ID NO: 1316467 - protein, 9 aa, Homo Sapiens
KKSRHHGRI

SEQ ID NO: 1316468 - protein, 9 aa, Homo Sapiens
VRKWSVTCR

SEQ ID NO: 1316469 - protein, 9 aa, Homo Sapiens
SAPDNEAGR

SEQ ID NO: 1316470 - protein, 9 aa, Homo Sapiens
PLAEHCFSR

SEQ ID NO: 1316471 - protein, 9 aa, Homo Sapiens
FTDLKLWDT

SEQ ID NO: 1316472 - protein, 9 aa, Homo Sapiens
LGKIRTAVD

SEQ ID NO: 1316473 - protein, 9 aa, Homo Sapiens
MTVPIQMTQ

SEQ ID NO: 1316474 - protein, 9 aa, Homo Sapiens
GWAPFSVGL

SEQ ID NO: 1316475 - protein, 9 aa, Homo Sapiens
ANGDKAAAE

SEQ ID NO: 1316476 - protein, 9 aa, Homo Sapiens
VDAFVEHRC

SEQ ID NO: 1316477 - protein, 9 aa, Homo Sapiens
LCHFRKLHC

SEQ ID NO: 1316478 - protein, 9 aa, Homo Sapiens
SVDPYNPSS

SEQ ID NO: 1316479 - protein, 9 aa, Homo Sapiens
SPAKGELSL

SEQ ID NO: 1316480 - protein, 9 aa, Homo Sapiens
RLIFLHSAD

SEQ ID NO: 1316481 - protein, 9 aa, Homo Sapiens
AAQRGHWHS

SEQ ID NO: 1316482 - protein, 9 aa, Homo Sapiens
VASNTTRGF

SEQ ID NO: 1316483 - protein, 9 aa, Homo Sapiens
IEYYLRHLE

SEQ ID NO: 1316484 - protein, 9 aa, Homo Sapiens
GSLAPLGYP

SEQ ID NO: 1316485 - protein, 9 aa, Homo Sapiens
PLCNHPVSF

SEQ ID NO: 1316486 - protein, 9 aa, Homo Sapiens
ENLDPSASE

SEQ ID NO: 1316487 - protein, 9 aa, Homo Sapiens
ITGVCHHTQ

SEQ ID NO: 1316488 - protein, 9 aa, Homo Sapiens
QEFGDVELI

SEQ ID NO: 1316489 - protein, 9 aa, Homo Sapiens
GLYTDTEMK

SEQ ID NO: 1316490 - protein, 9 aa, Homo Sapiens
ACRLKIHLQ

SEQ ID NO: 1316491 - protein, 9 aa, Homo Sapiens
AFFGQAVQY

SEQ ID NO: 1316492 - protein, 9 aa, Homo Sapiens
RTVSSSSER

SEQ ID NO: 1316493 - protein, 9 aa, Homo Sapiens
SVVHIHCWL

SEQ ID NO: 1316494 - protein, 9 aa, Homo Sapiens
FITPLLLLP

SEQ ID NO: 1316495 - protein, 9 aa, Homo Sapiens
WKLHRVLQA

SEQ ID NO: 1316496 - protein, 9 aa, Homo Sapiens
NWGVHRRSL

SEQ ID NO: 1316497 - protein, 9 aa, Homo Sapiens
TFKLSAKDL

SEQ ID NO: 1316498 - protein, 9 aa, Homo Sapiens
QMSPCSECE

SEQ ID NO: 1316499 - protein, 9 aa, Homo Sapiens
QPELDKEAA

SEQ ID NO: 1316500 - protein, 9 aa, Homo Sapiens
EDLHVFTPT

SEQ ID NO: 1316501 - protein, 9 aa, Homo Sapiens
RGEGDCNVV

SEQ ID NO: 1316502 - protein, 9 aa, Homo Sapiens
VSAKTILES

SEQ ID NO: 1316503 - protein, 9 aa, Homo Sapiens
FGIQEPGSE

SEQ ID NO: 1316504 - protein, 9 aa, Homo Sapiens
TVTGESPPQ

SEQ ID NO: 1316505 - protein, 9 aa, Homo Sapiens
QLIREMLIS

SEQ ID NO: 1316506 - protein, 9 aa, Homo Sapiens
FEAITWEMA

SEQ ID NO: 1316507 - protein, 9 aa, Homo Sapiens
KEYGKAFNQ

SEQ ID NO: 1316508 - protein, 9 aa, Homo Sapiens
KCKGTILSP

SEQ ID NO: 1316509 - protein, 9 aa, Homo Sapiens
LNLKDEFDR

SEQ ID NO: 1316510 - protein, 9 aa, Homo Sapiens
PCPYFSPYA

SEQ ID NO: 1316511 - protein, 9 aa, Homo Sapiens
HSWSKLCHI

SEQ ID NO: 1316512 - protein, 9 aa, Homo Sapiens
QVQKELQII

SEQ ID NO: 1316513 - protein, 9 aa, Homo Sapiens
RSAVDSWGL

SEQ ID NO: 1316514 - protein, 9 aa, Homo Sapiens
KHRILPKEQ

SEQ ID NO: 1316515 - protein, 9 aa, Homo Sapiens
TQRNSSLLM

SEQ ID NO: 1316516 - protein, 9 aa, Homo Sapiens
CKQCMLARE

SEQ ID NO: 1316517 - protein, 9 aa, Homo Sapiens
TSNMVSKLL

SEQ ID NO: 1316518 - protein, 9 aa, Homo Sapiens
LKGVHLGER

SEQ ID NO: 1316519 - protein, 9 aa, Homo Sapiens
ANKITTESF

SEQ ID NO: 1316520 - protein, 9 aa, Homo Sapiens
RELPSSVTE

SEQ ID NO: 1316521 - protein, 9 aa, Homo Sapiens
YHSPVDRVM

SEQ ID NO: 1316522 - protein, 9 aa, Homo Sapiens
LSIGPHLHG

SEQ ID NO: 1316523 - protein, 9 aa, Homo Sapiens
EFNPEHFWM

SEQ ID NO: 1316524 - protein, 9 aa, Homo Sapiens
CIKRMLAYS

SEQ ID NO: 1316525 - protein, 9 aa, Homo Sapiens
DEGWPLDPE

SEQ ID NO: 1316526 - protein, 9 aa, Homo Sapiens
LSLHRCRHD

SEQ ID NO: 1316527 - protein, 9 aa, Homo Sapiens
GILICIMKN

SEQ ID NO: 1316528 - protein, 9 aa, Homo Sapiens
IDMVINRSL

SEQ ID NO: 1316529 - protein, 9 aa, Homo Sapiens
EKQFPMKKF

SEQ ID NO: 1316530 - protein, 9 aa, Homo Sapiens
APAPEWCHL

SEQ ID NO: 1316531 - protein, 9 aa, Homo Sapiens
PFHQGHPLP

SEQ ID NO: 1316532 - protein, 9 aa, Homo Sapiens
SSGTLSSNV

SEQ ID NO: 1316533 - protein, 9 aa, Homo Sapiens
TASLMLKED

SEQ ID NO: 1316534 - protein, 9 aa, Homo Sapiens
SHFDALFCW

SEQ ID NO: 1316535 - protein, 9 aa, Homo Sapiens
MHTSYRQIS

SEQ ID NO: 1316536 - protein, 9 aa, Homo Sapiens
NTLFLCFLE

SEQ ID NO: 1316537 - protein, 9 aa, Homo Sapiens
HVFHGNETT

SEQ ID NO: 1316538 - protein, 9 aa, Homo Sapiens
HYHSFHTDK

SEQ ID NO: 1316539 - protein, 9 aa, Homo Sapiens
KKKCCYVAF

SEQ ID NO: 1316540 - protein, 9 aa, Homo Sapiens
LTQGTDKLQ

SEQ ID NO: 1316541 - protein, 9 aa, Homo Sapiens
GKVFGNFNL

SEQ ID NO: 1316542 - protein, 9 aa, Homo Sapiens
REVTGIDLE

SEQ ID NO: 1316543 - protein, 9 aa, Homo Sapiens
LMNPVAAKK

SEQ ID NO: 1316544 - protein, 9 aa, Homo Sapiens
QPRRISVVS

SEQ ID NO: 1316545 - protein, 9 aa, Homo Sapiens
PLKTLEDTL

SEQ ID NO: 1316546 - protein, 9 aa, Homo Sapiens
QGHLGPGRI

SEQ ID NO: 1316547 - protein, 9 aa, Homo Sapiens
NCDETEDKL

SEQ ID NO: 1316548 - protein, 9 aa, Homo Sapiens
PLSQAPQAV

SEQ ID NO: 1316549 - protein, 9 aa, Homo Sapiens
CGNVFYVKA

SEQ ID NO: 1316550 - protein, 9 aa, Homo Sapiens
HYDCVVLFL

SEQ ID NO: 1316551 - protein, 9 aa, Homo Sapiens
PYKTSVSEG

SEQ ID NO: 1316552 - protein, 9 aa, Homo Sapiens
CSADEPMTT

SEQ ID NO: 1316553 - protein, 9 aa, Homo Sapiens
SKINAAKSL

SEQ ID NO: 1316554 - protein, 9 aa, Homo Sapiens
ETLLLQAEC

SEQ ID NO: 1316555 - protein, 9 aa, Homo Sapiens
VSREDFVIC

SEQ ID NO: 1316556 - protein, 9 aa, Homo Sapiens
DNGSMLQSQ

SEQ ID NO: 1316557 - protein, 9 aa, Homo Sapiens
QIWKFQHHD

SEQ ID NO: 1316558 - protein, 9 aa, Homo Sapiens
SGTSVEEAL

SEQ ID NO: 1316559 - protein, 9 aa, Homo Sapiens
CGSALTFFT

SEQ ID NO: 1316560 - protein, 9 aa, Homo Sapiens
LSLIRAPWN

SEQ ID NO: 1316561 - protein, 9 aa, Homo Sapiens
TATTSDSKG

SEQ ID NO: 1316562 - protein, 9 aa, Homo Sapiens
TFSMNASLE

SEQ ID NO: 1316563 - protein, 9 aa, Homo Sapiens
MRGGHLGVF

SEQ ID NO: 1316564 - protein, 9 aa, Homo Sapiens
VRVPYVENP

SEQ ID NO: 1316565 - protein, 9 aa, Homo Sapiens
GNTDGAACH

SEQ ID NO: 1316566 - protein, 9 aa, Homo Sapiens
ASGSKLASV

SEQ ID NO: 1316567 - protein, 9 aa, Homo Sapiens
DTVLCAYNS

SEQ ID NO: 1316568 - protein, 9 aa, Homo Sapiens
IMCWFRRHK

SEQ ID NO: 1316569 - protein, 9 aa, Homo Sapiens
LCTKSLPCR

SEQ ID NO: 1316570 - protein, 9 aa, Homo Sapiens
EDLKQCLGH

SEQ ID NO: 1316571 - protein, 9 aa, Homo Sapiens
SFFIITAVT

SEQ ID NO: 1316572 - protein, 9 aa, Homo Sapiens
RSGLKQCYQ

SEQ ID NO: 1316573 - protein, 9 aa, Homo Sapiens
AYIHKKTRL

SEQ ID NO: 1316574 - protein, 9 aa, Homo Sapiens
KAHGDASKV

SEQ ID NO: 1316575 - protein, 9 aa, Homo Sapiens
AAYNQVERH

SEQ ID NO: 1316576 - protein, 9 aa, Homo Sapiens
WGGLTDRLG

SEQ ID NO: 1316577 - protein, 9 aa, Homo Sapiens
VFVLPILQK

SEQ ID NO: 1316578 - protein, 9 aa, Homo Sapiens
FTNLTSLCR

SEQ ID NO: 1316579 - protein, 9 aa, Homo Sapiens
EMLTCIICQ

SEQ ID NO: 1316580 - protein, 9 aa, Homo Sapiens
GRASSCAAS

SEQ ID NO: 1316581 - protein, 9 aa, Homo Sapiens
QHYYVYNSV

SEQ ID NO: 1316582 - protein, 9 aa, Homo Sapiens
RLKQEIEHL

SEQ ID NO: 1316583 - protein, 9 aa, Homo Sapiens
HFFDVEWAA

SEQ ID NO: 1316584 - protein, 9 aa, Homo Sapiens
HTPRASNEA

SEQ ID NO: 1316585 - protein, 9 aa, Homo Sapiens
PCGGILTKC

SEQ ID NO: 1316586 - protein, 9 aa, Homo Sapiens
NAKCQCAKL

SEQ ID NO: 1316587 - protein, 9 aa, Homo Sapiens
LYDELEQIR

SEQ ID NO: 1316588 - protein, 9 aa, Homo Sapiens
MKSLPFYEV

SEQ ID NO: 1316589 - protein, 9 aa, Homo Sapiens
VSMLVSSWS

SEQ ID NO: 1316590 - protein, 9 aa, Homo Sapiens
FPVPVGPFD

SEQ ID NO: 1316591 - protein, 9 aa, Homo Sapiens
HTLSQHLND

SEQ ID NO: 1316592 - protein, 9 aa, Homo Sapiens
LARTQQLIQ

SEQ ID NO: 1316593 - protein, 9 aa, Homo Sapiens
RTILKRFFL

SEQ ID NO: 1316594 - protein, 9 aa, Homo Sapiens
ECQANQVSA

SEQ ID NO: 1316595 - protein, 9 aa, Homo Sapiens
PGMGPHVPR

SEQ ID NO: 1316596 - protein, 9 aa, Homo Sapiens
SVSSHSDIE

SEQ ID NO: 1316597 - protein, 9 aa, Homo Sapiens
VRLQQSFPG

SEQ ID NO: 1316598 - protein, 9 aa, Homo Sapiens
IPDYTPLCS

SEQ ID NO: 1316599 - protein, 9 aa, Homo Sapiens
VTLDKVPED

SEQ ID NO: 1316600 - protein, 9 aa, Homo Sapiens
GVQNYITFN

SEQ ID NO: 1316601 - protein, 9 aa, Homo Sapiens
NWEVDVTFR

SEQ ID NO: 1316602 - protein, 9 aa, Homo Sapiens
ESHPSTLLT

SEQ ID NO: 1316603 - protein, 9 aa, Homo Sapiens
VHIPENVPV

SEQ ID NO: 1316604 - protein, 9 aa, Homo Sapiens
YILIGTVPS

SEQ ID NO: 1316605 - protein, 9 aa, Homo Sapiens
ECNICGTRY

SEQ ID NO: 1316606 - protein, 9 aa, Homo Sapiens
VVKDSEGNV

SEQ ID NO: 1316607 - protein, 9 aa, Homo Sapiens
HCGDSPNSE

SEQ ID NO: 1316608 - protein, 9 aa, Homo Sapiens
DTCFMAYTF

SEQ ID NO: 1316609 - protein, 9 aa, Homo Sapiens
VNIQDLAPP

SEQ ID NO: 1316610 - protein, 9 aa, Homo Sapiens
QVQYPLTGM

SEQ ID NO: 1316611 - protein, 9 aa, Homo Sapiens
ELKGLAPGT

SEQ ID NO: 1316612 - protein, 9 aa, Homo Sapiens
MHRRSRSCR

SEQ ID NO: 1316613 - protein, 9 aa, Homo Sapiens
EKNEGCLYM

SEQ ID NO: 1316614 - protein, 9 aa, Homo Sapiens
HYLARVATT

SEQ ID NO: 1316615 - protein, 9 aa, Homo Sapiens
TRSTLMSCT

SEQ ID NO: 1316616 - protein, 9 aa, Homo Sapiens
PVSPGTVLV

SEQ ID NO: 1316617 - protein, 9 aa, Homo Sapiens
LNDGTMLST

SEQ ID NO: 1316618 - protein, 9 aa, Homo Sapiens
PLHVAVRLG

SEQ ID NO: 1316619 - protein, 9 aa, Homo Sapiens
NACVAMSHK

SEQ ID NO: 1316620 - protein, 9 aa, Homo Sapiens
HDVVSKANF

SEQ ID NO: 1316621 - protein, 9 aa, Homo Sapiens
KSLPFYEVY

SEQ ID NO: 1316622 - protein, 9 aa, Homo Sapiens
SDLSCKVCL

SEQ ID NO: 1316623 - protein, 9 aa, Homo Sapiens
DVWIVRIWD

SEQ ID NO: 1316624 - protein, 9 aa, Homo Sapiens
PRPQGQHWI

SEQ ID NO: 1316625 - protein, 9 aa, Homo Sapiens
TANLTSSLM

SEQ ID NO: 1316626 - protein, 9 aa, Homo Sapiens
KLDVVCSFL

SEQ ID NO: 1316627 - protein, 9 aa, Homo Sapiens
IVWENSSVP

SEQ ID NO: 1316628 - protein, 9 aa, Homo Sapiens
EIQILLHFR

SEQ ID NO: 1316629 - protein, 9 aa, Homo Sapiens
RHISVICRS

SEQ ID NO: 1316630 - protein, 9 aa, Homo Sapiens
PLDETQITT

SEQ ID NO: 1316631 - protein, 9 aa, Homo Sapiens
EWASLYPTQ

SEQ ID NO: 1316632 - protein, 9 aa, Homo Sapiens
ILMNPVAAK

SEQ ID NO: 1316633 - protein, 9 aa, Homo Sapiens
GPPSSPTPR

SEQ ID NO: 1316634 - protein, 9 aa, Homo Sapiens
CAPVMSWAR

SEQ ID NO: 1316635 - protein, 9 aa, Homo Sapiens
KYIMTRILH

SEQ ID NO: 1316636 - protein, 9 aa, Homo Sapiens
CDRAFKSSH

SEQ ID NO: 1316637 - protein, 9 aa, Homo Sapiens
PELQPAVPS

SEQ ID NO: 1316638 - protein, 9 aa, Homo Sapiens
CMQYAPNTQ

SEQ ID NO: 1316639 - protein, 9 aa, Homo Sapiens
ARCFLMVCE

SEQ ID NO: 1316640 - protein, 9 aa, Homo Sapiens
YMSIDALKD

SEQ ID NO: 1316641 - protein, 9 aa, Homo Sapiens
TSFTSLAAL

SEQ ID NO: 1316642 - protein, 9 aa, Homo Sapiens
IPQSNSYCS

SEQ ID NO: 1316643 - protein, 9 aa, Homo Sapiens
RHGVCVLRA

SEQ ID NO: 1316644 - protein, 9 aa, Homo Sapiens
FHCTSPHKM

SEQ ID NO: 1316645 - protein, 9 aa, Homo Sapiens
VHNESTGSL

SEQ ID NO: 1316646 - protein, 9 aa, Homo Sapiens
DNGICVLAF

SEQ ID NO: 1316647 - protein, 9 aa, Homo Sapiens
KTINCFLMR

SEQ ID NO: 1316648 - protein, 9 aa, Homo Sapiens
VWCQQRLAL

SEQ ID NO: 1316649 - protein, 9 aa, Homo Sapiens
SPSLVKTCD

SEQ ID NO: 1316650 - protein, 9 aa, Homo Sapiens
MLPSQHTQF

SEQ ID NO: 1316651 - protein, 9 aa, Homo Sapiens
GPKRGERAW

SEQ ID NO: 1316652 - protein, 9 aa, Homo Sapiens
IHYLANVLL

SEQ ID NO: 1316653 - protein, 9 aa, Homo Sapiens
IVQEYIEKS

SEQ ID NO: 1316654 - protein, 9 aa, Homo Sapiens
TTYGAFLYK

SEQ ID NO: 1316655 - protein, 9 aa, Homo Sapiens
LSIDADVFE

SEQ ID NO: 1316656 - protein, 9 aa, Homo Sapiens
AGSLSQYQL

SEQ ID NO: 1316657 - protein, 9 aa, Homo Sapiens
MCCANATCL

SEQ ID NO: 1316658 - protein, 9 aa, Homo Sapiens
EKWILAAVT

SEQ ID NO: 1316659 - protein, 9 aa, Homo Sapiens
HFLLPETKI

SEQ ID NO: 1316660 - protein, 9 aa, Homo Sapiens
FYTERDASH

SEQ ID NO: 1316661 - protein, 9 aa, Homo Sapiens
STTTLLPPL

SEQ ID NO: 1316662 - protein, 9 aa, Homo Sapiens
VVKCSTAPF

SEQ ID NO: 1316663 - protein, 9 aa, Homo Sapiens
CIPLLLCHG

SEQ ID NO: 1316664 - protein, 9 aa, Homo Sapiens
QSSKNLSRG

SEQ ID NO: 1316665 - protein, 9 aa, Homo Sapiens
AGRRLTSAM

SEQ ID NO: 1316666 - protein, 9 aa, Homo Sapiens
PAPAPATYH

SEQ ID NO: 1316667 - protein, 9 aa, Homo Sapiens
RDDFTEECL

SEQ ID NO: 1316668 - protein, 9 aa, Homo Sapiens
YIPVLCILP

SEQ ID NO: 1316669 - protein, 9 aa, Homo Sapiens
FRLCQKLTL

SEQ ID NO: 1316670 - protein, 9 aa, Homo Sapiens
PCRKLCHTL

SEQ ID NO: 1316671 - protein, 9 aa, Homo Sapiens
RRVIAQPVG

SEQ ID NO: 1316672 - protein, 9 aa, Homo Sapiens
RVAQVAQDE

SEQ ID NO: 1316673 - protein, 9 aa, Homo Sapiens
GHDCRHIQY

SEQ ID NO: 1316674 - protein, 9 aa, Homo Sapiens
QKSSPRCAG

SEQ ID NO: 1316675 - protein, 9 aa, Homo Sapiens
NESTDTTSE

SEQ ID NO: 1316676 - protein, 9 aa, Homo Sapiens
STDTLCKRL

SEQ ID NO: 1316677 - protein, 9 aa, Homo Sapiens
FRFVWLELK

SEQ ID NO: 1316678 - protein, 9 aa, Homo Sapiens
LSLQKIMMD

SEQ ID NO: 1316679 - protein, 9 aa, Homo Sapiens
FLDTYNKLT

SEQ ID NO: 1316680 - protein, 9 aa, Homo Sapiens
KKSMEWFTG

SEQ ID NO: 1316681 - protein, 9 aa, Homo Sapiens
HGEVQDAES

SEQ ID NO: 1316682 - protein, 9 aa, Homo Sapiens
HYSIGKQKM

SEQ ID NO: 1316683 - protein, 9 aa, Homo Sapiens
RPQCATSNV

SEQ ID NO: 1316684 - protein, 9 aa, Homo Sapiens
KSGVDNIFI

SEQ ID NO: 1316685 - protein, 9 aa, Homo Sapiens
DETQITTIL

SEQ ID NO: 1316686 - protein, 9 aa, Homo Sapiens
DIPEHYPGL

SEQ ID NO: 1316687 - protein, 9 aa, Homo Sapiens
TLGFMLMLD

SEQ ID NO: 1316688 - protein, 9 aa, Homo Sapiens
SRSQGATCT

SEQ ID NO: 1316689 - protein, 9 aa, Homo Sapiens
HFEKLMEYF

SEQ ID NO: 1316690 - protein, 9 aa, Homo Sapiens
ILDECLTHF

SEQ ID NO: 1316691 - protein, 9 aa, Homo Sapiens
LPSYYPPSI

SEQ ID NO: 1316692 - protein, 9 aa, Homo Sapiens
NHYTVAWFL

SEQ ID NO: 1316693 - protein, 9 aa, Homo Sapiens
EKVTGIESH

SEQ ID NO: 1316694 - protein, 9 aa, Homo Sapiens
VPYSQIPPP

SEQ ID NO: 1316695 - protein, 9 aa, Homo Sapiens
LQFLPEQIF

SEQ ID NO: 1316696 - protein, 9 aa, Homo Sapiens
DDIIYLTRH

SEQ ID NO: 1316697 - protein, 9 aa, Homo Sapiens
KEHIKEMHE

SEQ ID NO: 1316698 - protein, 9 aa, Homo Sapiens
HIPQSNSYC

SEQ ID NO: 1316699 - protein, 9 aa, Homo Sapiens
ATGHISSLD

SEQ ID NO: 1316700 - protein, 9 aa, Homo Sapiens
KKTFDAESP

SEQ ID NO: 1316701 - protein, 9 aa, Homo Sapiens
AGSFQAWLR

SEQ ID NO: 1316702 - protein, 9 aa, Homo Sapiens
AHLVLRHSY

SEQ ID NO: 1316703 - protein, 9 aa, Homo Sapiens
AGSVTDLTF

SEQ ID NO: 1316704 - protein, 9 aa, Homo Sapiens
GFSHDDTLD

SEQ ID NO: 1316705 - protein, 9 aa, Homo Sapiens
APGSWGSLG

SEQ ID NO: 1316706 - protein, 9 aa, Homo Sapiens
AVMLFCGFI

SEQ ID NO: 1316707 - protein, 9 aa, Homo Sapiens
RDPHHDLDR

SEQ ID NO: 1316708 - protein, 9 aa, Homo Sapiens
INPNGDSAE

SEQ ID NO: 1316709 - protein, 9 aa, Homo Sapiens
TTLGKLNAV

SEQ ID NO: 1316710 - protein, 9 aa, Homo Sapiens
HGSECLCIP

SEQ ID NO: 1316711 - protein, 9 aa, Homo Sapiens
KCKLSDDPC

SEQ ID NO: 1316712 - protein, 9 aa, Homo Sapiens
VQATINLYV

SEQ ID NO: 1316713 - protein, 9 aa, Homo Sapiens
DAYILTCNM

SEQ ID NO: 1316714 - protein, 9 aa, Homo Sapiens
DYRIQYHKF

SEQ ID NO: 1316715 - protein, 9 aa, Homo Sapiens
QTMDLSIRT

SEQ ID NO: 1316716 - protein, 9 aa, Homo Sapiens
GLVQQCQTI

SEQ ID NO: 1316717 - protein, 9 aa, Homo Sapiens
TSQSYSYHS

SEQ ID NO: 1316718 - protein, 9 aa, Homo Sapiens
PATFEIDLK

SEQ ID NO: 1316719 - protein, 9 aa, Homo Sapiens
CCRFSPTRT

SEQ ID NO: 1316720 - protein, 9 aa, Homo Sapiens
LSPVSSQDK

SEQ ID NO: 1316721 - protein, 9 aa, Homo Sapiens
VDFILQWEP

SEQ ID NO: 1316722 - protein, 9 aa, Homo Sapiens
SPEKLGAFL

SEQ ID NO: 1316723 - protein, 9 aa, Homo Sapiens
PQSSKNLSR

SEQ ID NO: 1316724 - protein, 9 aa, Homo Sapiens
DILLVSPSS

SEQ ID NO: 1316725 - protein, 9 aa, Homo Sapiens
EFPDTSFQV

SEQ ID NO: 1316726 - protein, 9 aa, Homo Sapiens
KQDHTYCVF

SEQ ID NO: 1316727 - protein, 9 aa, Homo Sapiens
TCNMSLEYE

SEQ ID NO: 1316728 - protein, 9 aa, Homo Sapiens
MENLQDVIG

SEQ ID NO: 1316729 - protein, 9 aa, Homo Sapiens
ELADKKDHD

SEQ ID NO: 1316730 - protein, 9 aa, Homo Sapiens
VQYLHQIHA

SEQ ID NO: 1316731 - protein, 9 aa, Homo Sapiens
PPFPVSCHD

SEQ ID NO: 1316732 - protein, 9 aa, Homo Sapiens
VVIILGASV

SEQ ID NO: 1316733 - protein, 9 aa, Homo Sapiens
CNMSLEYEK

SEQ ID NO: 1316734 - protein, 9 aa, Homo Sapiens
DTSLWTPPQ

SEQ ID NO: 1316735 - protein, 9 aa, Homo Sapiens
NNNVIVRNV

SEQ ID NO: 1316736 - protein, 9 aa, Homo Sapiens
PTLQLLRTF

SEQ ID NO: 1316737 - protein, 9 aa, Homo Sapiens
SPQELCMPQ

SEQ ID NO: 1316738 - protein, 9 aa, Homo Sapiens
WTLPRSPEV

SEQ ID NO: 1316739 - protein, 9 aa, Homo Sapiens
QKVCFFTGQ

SEQ ID NO: 1316740 - protein, 9 aa, Homo Sapiens
EDDKHHEVN

SEQ ID NO: 1316741 - protein, 9 aa, Homo Sapiens
PKSLPSECI

SEQ ID NO: 1316742 - protein, 9 aa, Homo Sapiens
TSLSTRGCT

SEQ ID NO: 1316743 - protein, 9 aa, Homo Sapiens
RKMDTTTSL

SEQ ID NO: 1316744 - protein, 9 aa, Homo Sapiens
GYGHTAPGT

SEQ ID NO: 1316745 - protein, 9 aa, Homo Sapiens
TDKHLDPLK

SEQ ID NO: 1316746 - protein, 9 aa, Homo Sapiens
EIMRNHKRV

SEQ ID NO: 1316747 - protein, 9 aa, Homo Sapiens
LSALGELRQ

SEQ ID NO: 1316748 - protein, 9 aa, Homo Sapiens
GTEIIQSST

SEQ ID NO: 1316749 - protein, 9 aa, Homo Sapiens
HLSDTSTMS

SEQ ID NO: 1316750 - protein, 9 aa, Homo Sapiens
GWGQLLLLL

SEQ ID NO: 1316751 - protein, 9 aa, Homo Sapiens
LKRPKCSLF

SEQ ID NO: 1316752 - protein, 9 aa, Homo Sapiens
GKHVPKSGV

SEQ ID NO: 1316753 - protein, 9 aa, Homo Sapiens
EETPLHVAV

SEQ ID NO: 1316754 - protein, 9 aa, Homo Sapiens
QVCKLAQSN

SEQ ID NO: 1316755 - protein, 9 aa, Homo Sapiens
PGYKVHEIV

SEQ ID NO: 1316756 - protein, 9 aa, Homo Sapiens
DGPFYVIVE

SEQ ID NO: 1316757 - protein, 9 aa, Homo Sapiens
RDVPEAAAQ

SEQ ID NO: 1316758 - protein, 9 aa, Homo Sapiens
STSWGPTAG

SEQ ID NO: 1316759 - protein, 9 aa, Homo Sapiens
LRNLTKVYC

SEQ ID NO: 1316760 - protein, 9 aa, Homo Sapiens
DCLKIIEEK

SEQ ID NO: 1316761 - protein, 9 aa, Homo Sapiens
DDTISINHK

SEQ ID NO: 1316762 - protein, 9 aa, Homo Sapiens
IMDGNCRYA

SEQ ID NO: 1316763 - protein, 9 aa, Homo Sapiens
MKHEVSAHF

SEQ ID NO: 1316764 - protein, 9 aa, Homo Sapiens
PHLSPLGPS

SEQ ID NO: 1316765 - protein, 9 aa, Homo Sapiens
VYRHIVESD

SEQ ID NO: 1316766 - protein, 9 aa, Homo Sapiens
SMKTERSPA

SEQ ID NO: 1316767 - protein, 9 aa, Homo Sapiens
TQMVEIGTE

SEQ ID NO: 1316768 - protein, 9 aa, Homo Sapiens
KIDLQKNKL

SEQ ID NO: 1316769 - protein, 9 aa, Homo Sapiens
HFTKVEHIP

SEQ ID NO: 1316770 - protein, 9 aa, Homo Sapiens
PSPQNRSRT

SEQ ID NO: 1316771 - protein, 9 aa, Homo Sapiens
DVAQDTTLI

SEQ ID NO: 1316772 - protein, 9 aa, Homo Sapiens
PITLGGPLP

SEQ ID NO: 1316773 - protein, 9 aa, Homo Sapiens
NMMKFFFDN

SEQ ID NO: 1316774 - protein, 9 aa, Homo Sapiens
TRVCGPATF

SEQ ID NO: 1316775 - protein, 9 aa, Homo Sapiens
NVLSLLIDT

SEQ ID NO: 1316776 - protein, 9 aa, Homo Sapiens
SADGLKSSC

SEQ ID NO: 1316777 - protein, 9 aa, Homo Sapiens
EPYHENVEQ

SEQ ID NO: 1316778 - protein, 9 aa, Homo Sapiens
NSRRVLYAF

SEQ ID NO: 1316779 - protein, 9 aa, Homo Sapiens
LHCSVLEAR

SEQ ID NO: 1316780 - protein, 9 aa, Homo Sapiens
LTVSSPLKL

SEQ ID NO: 1316781 - protein, 9 aa, Homo Sapiens
PDTITGADM

SEQ ID NO: 1316782 - protein, 9 aa, Homo Sapiens
GIEHYHRTS

SEQ ID NO: 1316783 - protein, 9 aa, Homo Sapiens
RTRTQLRNE

SEQ ID NO: 1316784 - protein, 9 aa, Homo Sapiens
EHHDVVSKA

SEQ ID NO: 1316785 - protein, 9 aa, Homo Sapiens
LTSPTPPYN

SEQ ID NO: 1316786 - protein, 9 aa, Homo Sapiens
VTSANFSNR

SEQ ID NO: 1316787 - protein, 9 aa, Homo Sapiens
ETSPAFHIL

SEQ ID NO: 1316788 - protein, 9 aa, Homo Sapiens
SDPYLPSYY

SEQ ID NO: 1316789 - protein, 9 aa, Homo Sapiens
WCWHPYTNT

SEQ ID NO: 1316790 - protein, 9 aa, Homo Sapiens
QVTNTHVLP

SEQ ID NO: 1316791 - protein, 9 aa, Homo Sapiens
RHAAGEKCT

SEQ ID NO: 1316792 - protein, 9 aa, Homo Sapiens
KNQRLNRAV

SEQ ID NO: 1316793 - protein, 9 aa, Homo Sapiens
PKRQQLSAS

SEQ ID NO: 1316794 - protein, 9 aa, Homo Sapiens
SVMNQVMEE

SEQ ID NO: 1316795 - protein, 9 aa, Homo Sapiens
RPLRSNIAC

SEQ ID NO: 1316796 - protein, 9 aa, Homo Sapiens
HFGPQPRHH

SEQ ID NO: 1316797 - protein, 9 aa, Homo Sapiens
CVAKMVKSY

SEQ ID NO: 1316798 - protein, 9 aa, Homo Sapiens
IPWAYIKMM

SEQ ID NO: 1316799 - protein, 9 aa, Homo Sapiens
AVAKTTSEM

SEQ ID NO: 1316800 - protein, 9 aa, Homo Sapiens
DSDYVLHNM

SEQ ID NO: 1316801 - protein, 9 aa, Homo Sapiens
LVFTTQLGA

SEQ ID NO: 1316802 - protein, 9 aa, Homo Sapiens
LSTRGCTAR

SEQ ID NO: 1316803 - protein, 9 aa, Homo Sapiens
SFEKQCNNG

SEQ ID NO: 1316804 - protein, 9 aa, Homo Sapiens
YEWECKQCM

SEQ ID NO: 1316805 - protein, 9 aa, Homo Sapiens
REWEERVVN

SEQ ID NO: 1316806 - protein, 9 aa, Homo Sapiens
TCQTCSVLG

SEQ ID NO: 1316807 - protein, 9 aa, Homo Sapiens
TLTIRSLQI

SEQ ID NO: 1316808 - protein, 9 aa, Homo Sapiens
KACVSFWKK

SEQ ID NO: 1316809 - protein, 9 aa, Homo Sapiens
ANTFEMILG

SEQ ID NO: 1316810 - protein, 9 aa, Homo Sapiens
SKGFTFISF

SEQ ID NO: 1316811 - protein, 9 aa, Homo Sapiens
YPFHLFDFT

SEQ ID NO: 1316812 - protein, 9 aa, Homo Sapiens
LMRDVKIYQ

SEQ ID NO: 1316813 - protein, 9 aa, Homo Sapiens
IKINQSIQQ

SEQ ID NO: 1316814 - protein, 9 aa, Homo Sapiens
LFVAAIICY

SEQ ID NO: 1316815 - protein, 9 aa, Homo Sapiens
IVVLALFWQ

SEQ ID NO: 1316816 - protein, 9 aa, Homo Sapiens
PLRSAVDSW

SEQ ID NO: 1316817 - protein, 9 aa, Homo Sapiens
DWNDMEHIW

SEQ ID NO: 1316818 - protein, 9 aa, Homo Sapiens
EEAVIVARE

SEQ ID NO: 1316819 - protein, 9 aa, Homo Sapiens
LSTILCCIT

SEQ ID NO: 1316820 - protein, 9 aa, Homo Sapiens
KQYGHMKIM

SEQ ID NO: 1316821 - protein, 9 aa, Homo Sapiens
RLGMKDTAE

SEQ ID NO: 1316822 - protein, 9 aa, Homo Sapiens
TDMLGHVRC

SEQ ID NO: 1316823 - protein, 9 aa, Homo Sapiens
EAVKVNSAV

SEQ ID NO: 1316824 - protein, 9 aa, Homo Sapiens
RKWSVTCRG

SEQ ID NO: 1316825 - protein, 9 aa, Homo Sapiens
IPLLLCHGF

SEQ ID NO: 1316826 - protein, 9 aa, Homo Sapiens
EVTPPKAKE

SEQ ID NO: 1316827 - protein, 9 aa, Homo Sapiens
TAGRASAAT

SEQ ID NO: 1316828 - protein, 9 aa, Homo Sapiens
WVRSHFDAL

SEQ ID NO: 1316829 - protein, 9 aa, Homo Sapiens
VLRWIIEVV

SEQ ID NO: 1316830 - protein, 9 aa, Homo Sapiens
LEPAVIAHP

SEQ ID NO: 1316831 - protein, 9 aa, Homo Sapiens
QQLCPSANV

SEQ ID NO: 1316832 - protein, 9 aa, Homo Sapiens
STPSQNRKC

SEQ ID NO: 1316833 - protein, 9 aa, Homo Sapiens
EDSTTRGNR

SEQ ID NO: 1316834 - protein, 9 aa, Homo Sapiens
KVYCQHMQE

SEQ ID NO: 1316835 - protein, 9 aa, Homo Sapiens
LMEPTLQLL

SEQ ID NO: 1316836 - protein, 9 aa, Homo Sapiens
FVPNALRYA

SEQ ID NO: 1316837 - protein, 9 aa, Homo Sapiens
KQCNNGILE

SEQ ID NO: 1316838 - protein, 9 aa, Homo Sapiens
MLEYVLKQE

SEQ ID NO: 1316839 - protein, 9 aa, Homo Sapiens
LEPPVIVVP

SEQ ID NO: 1316840 - protein, 9 aa, Homo Sapiens
VSPKHVGFV

SEQ ID NO: 1316841 - protein, 9 aa, Homo Sapiens
SVWTLFLEL

SEQ ID NO: 1316842 - protein, 9 aa, Homo Sapiens
NIFVSMRVM

SEQ ID NO: 1316843 - protein, 9 aa, Homo Sapiens
QSEVDTDIH

SEQ ID NO: 1316844 - protein, 9 aa, Homo Sapiens
INQELHSQL

SEQ ID NO: 1316845 - protein, 9 aa, Homo Sapiens
QQRLTEPQH

SEQ ID NO: 1316846 - protein, 9 aa, Homo Sapiens
CLLHNCFDY

SEQ ID NO: 1316847 - protein, 9 aa, Homo Sapiens
FVADGALLR

SEQ ID NO: 1316848 - protein, 9 aa, Homo Sapiens
VHIKGRLID

SEQ ID NO: 1316849 - protein, 9 aa, Homo Sapiens
NLNWPQGEL

SEQ ID NO: 1316850 - protein, 9 aa, Homo Sapiens
LIMVVAGSL

SEQ ID NO: 1316851 - protein, 9 aa, Homo Sapiens
DRLPRCVCS

SEQ ID NO: 1316852 - protein, 9 aa, Homo Sapiens
GWRWLIRIA

SEQ ID NO: 1316853 - protein, 9 aa, Homo Sapiens
QIRSLGLDQ

SEQ ID NO: 1316854 - protein, 9 aa, Homo Sapiens
LSIPRVGKR

SEQ ID NO: 1316855 - protein, 9 aa, Homo Sapiens
FSDIVGFTV

SEQ ID NO: 1316856 - protein, 9 aa, Homo Sapiens
LTPLFDNPK

SEQ ID NO: 1316857 - protein, 9 aa, Homo Sapiens
DAGLGTSQH

SEQ ID NO: 1316858 - protein, 9 aa, Homo Sapiens
EWSEKVAHS

SEQ ID NO: 1316859 - protein, 9 aa, Homo Sapiens
KEEMDVSIK

SEQ ID NO: 1316860 - protein, 9 aa, Homo Sapiens
RIVFCHLAD

SEQ ID NO: 1316861 - protein, 9 aa, Homo Sapiens
SPVTATSHL

SEQ ID NO: 1316862 - protein, 9 aa, Homo Sapiens
LDGCLQMAD

SEQ ID NO: 1316863 - protein, 9 aa, Homo Sapiens
PTSFTSLAA

SEQ ID NO: 1316864 - protein, 9 aa, Homo Sapiens
DCMHGYIFG

SEQ ID NO: 1316865 - protein, 9 aa, Homo Sapiens
IQLPRPKMT

SEQ ID NO: 1316866 - protein, 9 aa, Homo Sapiens
EVVFSEEAL

SEQ ID NO: 1316867 - protein, 9 aa, Homo Sapiens
PSPCMRRST

SEQ ID NO: 1316868 - protein, 9 aa, Homo Sapiens
ERPSHRKPT

SEQ ID NO: 1316869 - protein, 9 aa, Homo Sapiens
NQIRKLKSI

SEQ ID NO: 1316870 - protein, 9 aa, Homo Sapiens
LTWTFPRMT

SEQ ID NO: 1316871 - protein, 9 aa, Homo Sapiens
RLIPEKAFV

SEQ ID NO: 1316872 - protein, 9 aa, Homo Sapiens
EANIPHAYL

SEQ ID NO: 1316873 - protein, 9 aa, Homo Sapiens
GHMDYKYLH

SEQ ID NO: 1316874 - protein, 9 aa, Homo Sapiens
NADFFKHLL

SEQ ID NO: 1316875 - protein, 9 aa, Homo Sapiens
LGDSLTRPG

SEQ ID NO: 1316876 - protein, 9 aa, Homo Sapiens
RPVRQYVYR

SEQ ID NO: 1316877 - protein, 9 aa, Homo Sapiens
GDVDEFKKF

SEQ ID NO: 1316878 - protein, 9 aa, Homo Sapiens
SVRLRLSSF

SEQ ID NO: 1316879 - protein, 9 aa, Homo Sapiens
RHLGAAVSR

SEQ ID NO: 1316880 - protein, 9 aa, Homo Sapiens
TETTEDEHK

SEQ ID NO: 1316881 - protein, 9 aa, Homo Sapiens
LIRLHGWLQ

SEQ ID NO: 1316882 - protein, 9 aa, Homo Sapiens
WTPDIMCGG

SEQ ID NO: 1316883 - protein, 9 aa, Homo Sapiens
CNTEAYILN

SEQ ID NO: 1316884 - protein, 9 aa, Homo Sapiens
FFLFPLGYL

SEQ ID NO: 1316885 - protein, 9 aa, Homo Sapiens
NPLGSGAYR

SEQ ID NO: 1316886 - protein, 9 aa, Homo Sapiens
PTPPYNKVC

SEQ ID NO: 1316887 - protein, 9 aa, Homo Sapiens
EEENTDKSK

SEQ ID NO: 1316888 - protein, 9 aa, Homo Sapiens
HQHMGQYYL

SEQ ID NO: 1316889 - protein, 9 aa, Homo Sapiens
NEECLKGQL

SEQ ID NO: 1316890 - protein, 9 aa, Homo Sapiens
TRIQGRVTH

SEQ ID NO: 1316891 - protein, 9 aa, Homo Sapiens
IIGSLDTEA

SEQ ID NO: 1316892 - protein, 9 aa, Homo Sapiens
VLQALRHPW

SEQ ID NO: 1316893 - protein, 9 aa, Homo Sapiens
LCSILEEHR

SEQ ID NO: 1316894 - protein, 9 aa, Homo Sapiens
FEPQSVGDY

SEQ ID NO: 1316895 - protein, 9 aa, Homo Sapiens
VSSQDPHTK

SEQ ID NO: 1316896 - protein, 9 aa, Homo Sapiens
PDYTPLCSP

SEQ ID NO: 1316897 - protein, 9 aa, Homo Sapiens
RWGRKEEPE

SEQ ID NO: 1316898 - protein, 9 aa, Homo Sapiens
RTNLMDRQA

SEQ ID NO: 1316899 - protein, 9 aa, Homo Sapiens
RPEELIEHV

SEQ ID NO: 1316900 - protein, 9 aa, Homo Sapiens
HMTQPKDGG

SEQ ID NO: 1316901 - protein, 9 aa, Homo Sapiens
QEEHDDSLR

SEQ ID NO: 1316902 - protein, 9 aa, Homo Sapiens
WLGIFYCAK

SEQ ID NO: 1316903 - protein, 9 aa, Homo Sapiens
DIQLEAAIR

SEQ ID NO: 1316904 - protein, 9 aa, Homo Sapiens
TEIDMVINR

SEQ ID NO: 1316905 - protein, 9 aa, Homo Sapiens
PYLVTKLVE

SEQ ID NO: 1316906 - protein, 9 aa, Homo Sapiens
YIVWNLPLE

SEQ ID NO: 1316907 - protein, 9 aa, Homo Sapiens
EQFLTIVRR

SEQ ID NO: 1316908 - protein, 9 aa, Homo Sapiens
FPPGSCKKA

SEQ ID NO: 1316909 - protein, 9 aa, Homo Sapiens
ITRSPFHVV

SEQ ID NO: 1316910 - protein, 9 aa, Homo Sapiens
DGYVDTEIK

SEQ ID NO: 1316911 - protein, 9 aa, Homo Sapiens
EMVPCGTVP

SEQ ID NO: 1316912 - protein, 9 aa, Homo Sapiens
NDLEKCRQI

SEQ ID NO: 1316913 - protein, 9 aa, Homo Sapiens
LAAASGPCH

SEQ ID NO: 1316914 - protein, 9 aa, Homo Sapiens
WQEREECRA

SEQ ID NO: 1316915 - protein, 9 aa, Homo Sapiens
FSTPNYCDQ

SEQ ID NO: 1316916 - protein, 9 aa, Homo Sapiens
LVDGEEASL

SEQ ID NO: 1316917 - protein, 9 aa, Homo Sapiens
HDAASSSGQ

SEQ ID NO: 1316918 - protein, 9 aa, Homo Sapiens
LRELDVENT

SEQ ID NO: 1316919 - protein, 9 aa, Homo Sapiens
QASRGYMPS

SEQ ID NO: 1316920 - protein, 9 aa, Homo Sapiens
RYYYNKHIL

SEQ ID NO: 1316921 - protein, 9 aa, Homo Sapiens
NPILSELTF

SEQ ID NO: 1316922 - protein, 9 aa, Homo Sapiens
ERLKQEIEH

SEQ ID NO: 1316923 - protein, 9 aa, Homo Sapiens
IQMPTIIGH

SEQ ID NO: 1316924 - protein, 9 aa, Homo Sapiens
DGKPENEFV

SEQ ID NO: 1316925 - protein, 9 aa, Homo Sapiens
ANPHIGDVI

SEQ ID NO: 1316926 - protein, 9 aa, Homo Sapiens
VHIQSMLHR

SEQ ID NO: 1316927 - protein, 9 aa, Homo Sapiens
YVRYWDLHT

SEQ ID NO: 1316928 - protein, 9 aa, Homo Sapiens
TIQRLHIPR

SEQ ID NO: 1316929 - protein, 9 aa, Homo Sapiens
EPEKELDLF

SEQ ID NO: 1316930 - protein, 9 aa, Homo Sapiens
SFTDEPEKE

SEQ ID NO: 1316931 - protein, 9 aa, Homo Sapiens
AFHILSVEP

SEQ ID NO: 1316932 - protein, 9 aa, Homo Sapiens
KMFEAITWE

SEQ ID NO: 1316933 - protein, 9 aa, Homo Sapiens
PLTRDAHLC

SEQ ID NO: 1316934 - protein, 9 aa, Homo Sapiens
VKHLKYVEQ

SEQ ID NO: 1316935 - protein, 9 aa, Homo Sapiens
VILLVIDQK

SEQ ID NO: 1316936 - protein, 9 aa, Homo Sapiens
LLKVVHTES

SEQ ID NO: 1316937 - protein, 9 aa, Homo Sapiens
DLVANMEPV

SEQ ID NO: 1316938 - protein, 9 aa, Homo Sapiens
QCYADFAPS

SEQ ID NO: 1316939 - protein, 9 aa, Homo Sapiens
YEFENYMCQ

SEQ ID NO: 1316940 - protein, 9 aa, Homo Sapiens
GAGRANGEI

SEQ ID NO: 1316941 - protein, 9 aa, Homo Sapiens
QQQSEELLA

SEQ ID NO: 1316942 - protein, 9 aa, Homo Sapiens
ENLALGMQL

SEQ ID NO: 1316943 - protein, 9 aa, Homo Sapiens
ISQLITMAC

SEQ ID NO: 1316944 - protein, 9 aa, Homo Sapiens
AFYGQDCQM

SEQ ID NO: 1316945 - protein, 9 aa, Homo Sapiens
CDSYVCPCT

SEQ ID NO: 1316946 - protein, 9 aa, Homo Sapiens
EDVAALLME

SEQ ID NO: 1316947 - protein, 9 aa, Homo Sapiens
HVLRIVAKY

SEQ ID NO: 1316948 - protein, 9 aa, Homo Sapiens
LLVCCEVST

SEQ ID NO: 1316949 - protein, 9 aa, Homo Sapiens
LVINGSNLP

SEQ ID NO: 1316950 - protein, 9 aa, Homo Sapiens
EGTGAELSL

SEQ ID NO: 1316951 - protein, 9 aa, Homo Sapiens
LEEQGRPDA

SEQ ID NO: 1316952 - protein, 9 aa, Homo Sapiens
QSLNDSYMR

SEQ ID NO: 1316953 - protein, 9 aa, Homo Sapiens
ESYERIHHS

SEQ ID NO: 1316954 - protein, 9 aa, Homo Sapiens
DLLSQMYHY

SEQ ID NO: 1316955 - protein, 9 aa, Homo Sapiens
CHYRDKHGG

SEQ ID NO: 1316956 - protein, 9 aa, Homo Sapiens
AITTANNLL

SEQ ID NO: 1316957 - protein, 9 aa, Homo Sapiens
EGFVPLDTP

SEQ ID NO: 1316958 - protein, 9 aa, Homo Sapiens
SNLRELPIV

SEQ ID NO: 1316959 - protein, 9 aa, Homo Sapiens
TARNFGFVF

SEQ ID NO: 1316960 - protein, 9 aa, Homo Sapiens
LQLIPKRSS

SEQ ID NO: 1316961 - protein, 9 aa, Homo Sapiens
LVTKWYISP

SEQ ID NO: 1316962 - protein, 9 aa, Homo Sapiens
DTLLFLIRN

SEQ ID NO: 1316963 - protein, 9 aa, Homo Sapiens
QQKRVCGWW

SEQ ID NO: 1316964 - protein, 9 aa, Homo Sapiens
WVEMDTRQS

SEQ ID NO: 1316965 - protein, 9 aa, Homo Sapiens
IEDDVCFEH

SEQ ID NO: 1316966 - protein, 9 aa, Homo Sapiens
SGVKLTLVS

SEQ ID NO: 1316967 - protein, 9 aa, Homo Sapiens
ISTYDNQME

SEQ ID NO: 1316968 - protein, 9 aa, Homo Sapiens
GGTAIILIA

SEQ ID NO: 1316969 - protein, 9 aa, Homo Sapiens
EEDTETAQM

SEQ ID NO: 1316970 - protein, 9 aa, Homo Sapiens
GGSGGHSGD

SEQ ID NO: 1316971 - protein, 9 aa, Homo Sapiens
TLNRLDQHE

SEQ ID NO: 1316972 - protein, 9 aa, Homo Sapiens
FTCVRHWHL

SEQ ID NO: 1316973 - protein, 9 aa, Homo Sapiens
TQKKLADKF

SEQ ID NO: 1316974 - protein, 9 aa, Homo Sapiens
KHNLELTIS

SEQ ID NO: 1316975 - protein, 9 aa, Homo Sapiens
VVLEVVVVH

SEQ ID NO: 1316976 - protein, 9 aa, Homo Sapiens
LMGRICISR

SEQ ID NO: 1316977 - protein, 9 aa, Homo Sapiens
NFNWGVHRR

SEQ ID NO: 1316978 - protein, 9 aa, Homo Sapiens
KPREEVTVL

SEQ ID NO: 1316979 - protein, 9 aa, Homo Sapiens
VISPQCIPA

SEQ ID NO: 1316980 - protein, 9 aa, Homo Sapiens
SEELQKDIE

SEQ ID NO: 1316981 - protein, 9 aa, Homo Sapiens
GTEISGQAS

SEQ ID NO: 1316982 - protein, 9 aa, Homo Sapiens
TDNIVEVLR

SEQ ID NO: 1316983 - protein, 9 aa, Homo Sapiens
NKHIKRSLL

SEQ ID NO: 1316984 - protein, 9 aa, Homo Sapiens
TFIFFFSLS

SEQ ID NO: 1316985 - protein, 9 aa, Homo Sapiens
LLMSSGDVW

SEQ ID NO: 1316986 - protein, 9 aa, Homo Sapiens
GLGVFATGR

SEQ ID NO: 1316987 - protein, 9 aa, Homo Sapiens
RVKVVNAVG

SEQ ID NO: 1316988 - protein, 9 aa, Homo Sapiens
LRWRKAHFQ

SEQ ID NO: 1316989 - protein, 9 aa, Homo Sapiens
VVSIMNADI

SEQ ID NO: 1316990 - protein, 9 aa, Homo Sapiens
CDHMIRSLQ

SEQ ID NO: 1316991 - protein, 9 aa, Homo Sapiens
PEDAVSTFE

SEQ ID NO: 1316992 - protein, 9 aa, Homo Sapiens
KLDQDLLRD

SEQ ID NO: 1316993 - protein, 9 aa, Homo Sapiens
MLFPEVQRL

SEQ ID NO: 1316994 - protein, 9 aa, Homo Sapiens
EKLIFEFCG

SEQ ID NO: 1316995 - protein, 9 aa, Homo Sapiens
HSSMMCYDD

SEQ ID NO: 1316996 - protein, 9 aa, Homo Sapiens
ERCRVEEQQ

SEQ ID NO: 1316997 - protein, 9 aa, Homo Sapiens
YLQYLAVLN

SEQ ID NO: 1316998 - protein, 9 aa, Homo Sapiens
PQTSGGVLW

SEQ ID NO: 1316999 - protein, 9 aa, Homo Sapiens
PYVSMTFIT

SEQ ID NO: 1317000 - protein, 9 aa, Homo Sapiens
SFPQEVAEQ

SEQ ID NO: 1317001 - protein, 9 aa, Homo Sapiens
TAARASPST

SEQ ID NO: 1317002 - protein, 9 aa, Homo Sapiens
ENEKTPITI

SEQ ID NO: 1317003 - protein, 9 aa, Homo Sapiens
YLSSKCIAM

SEQ ID NO: 1317004 - protein, 9 aa, Homo Sapiens
MRTSCLIKY

SEQ ID NO: 1317005 - protein, 9 aa, Homo Sapiens
RPDDVLLHH

SEQ ID NO: 1317006 - protein, 9 aa, Homo Sapiens
IYKPKRGRS

SEQ ID NO: 1317007 - protein, 9 aa, Homo Sapiens
ENEEDTSLK

SEQ ID NO: 1317008 - protein, 9 aa, Homo Sapiens
WHDTEDAGA

SEQ ID NO: 1317009 - protein, 9 aa, Homo Sapiens
HGLLRQLGK

SEQ ID NO: 1317010 - protein, 9 aa, Homo Sapiens
IDDIYTPAY

SEQ ID NO: 1317011 - protein, 9 aa, Homo Sapiens
VPGSLCSME

SEQ ID NO: 1317012 - protein, 9 aa, Homo Sapiens
SFGIFLYIL

SEQ ID NO: 1317013 - protein, 9 aa, Homo Sapiens
LGIVNTSIS

SEQ ID NO: 1317014 - protein, 9 aa, Homo Sapiens
VRRLQKPCF

SEQ ID NO: 1317015 - protein, 9 aa, Homo Sapiens
PGASVQGQP

SEQ ID NO: 1317016 - protein, 9 aa, Homo Sapiens
TSCQATGQP

SEQ ID NO: 1317017 - protein, 9 aa, Homo Sapiens
YQNRFLHMH

SEQ ID NO: 1317018 - protein, 9 aa, Homo Sapiens
NMSLEYEKT

SEQ ID NO: 1317019 - protein, 9 aa, Homo Sapiens
KFSDTEGLI

SEQ ID NO: 1317020 - protein, 9 aa, Homo Sapiens
GASTQARSP

SEQ ID NO: 1317021 - protein, 9 aa, Homo Sapiens
GQSVCENGC

SEQ ID NO: 1317022 - protein, 9 aa, Homo Sapiens
FMSVIYHQR

SEQ ID NO: 1317023 - protein, 9 aa, Homo Sapiens
GPTHVPWLL

SEQ ID NO: 1317024 - protein, 9 aa, Homo Sapiens
MLLSAYWHS

SEQ ID NO: 1317025 - protein, 9 aa, Homo Sapiens
VSSLTRSMS

SEQ ID NO: 1317026 - protein, 9 aa, Homo Sapiens
RNCLLSCTG

SEQ ID NO: 1317027 - protein, 9 aa, Homo Sapiens
DHYHVQPLE

SEQ ID NO: 1317028 - protein, 9 aa, Homo Sapiens
KHVPKSGVK

SEQ ID NO: 1317029 - protein, 9 aa, Homo Sapiens
NYVPQQEIS

SEQ ID NO: 1317030 - protein, 9 aa, Homo Sapiens
QRRGKSQQQ

SEQ ID NO: 1317031 - protein, 9 aa, Homo Sapiens
DPQRPHLTG

SEQ ID NO: 1317032 - protein, 9 aa, Homo Sapiens
TIVSTQRSQ

SEQ ID NO: 1317033 - protein, 9 aa, Homo Sapiens
GAVNMAGMG

SEQ ID NO: 1317034 - protein, 9 aa, Homo Sapiens
MYACKKLNK

SEQ ID NO: 1317035 - protein, 9 aa, Homo Sapiens
FCPPCYDVC

SEQ ID NO: 1317036 - protein, 9 aa, Homo Sapiens
PLEKVIHII

SEQ ID NO: 1317037 - protein, 9 aa, Homo Sapiens
ISHLNGLSI

SEQ ID NO: 1317038 - protein, 9 aa, Homo Sapiens
LRKTRPILD

SEQ ID NO: 1317039 - protein, 9 aa, Homo Sapiens
LEITIPNDL

SEQ ID NO: 1317040 - protein, 9 aa, Homo Sapiens
KFNMDKYTN

SEQ ID NO: 1317041 - protein, 9 aa, Homo Sapiens
SMWRLSSIK

SEQ ID NO: 1317042 - protein, 9 aa, Homo Sapiens
QIAIVPQEL

SEQ ID NO: 1317043 - protein, 9 aa, Homo Sapiens
CGSTFAKAS

SEQ ID NO: 1317044 - protein, 9 aa, Homo Sapiens
TYIRLTQYI

SEQ ID NO: 1317045 - protein, 9 aa, Homo Sapiens
DHHLRGCGY

SEQ ID NO: 1317046 - protein, 9 aa, Homo Sapiens
AVHCMHAIF

SEQ ID NO: 1317047 - protein, 9 aa, Homo Sapiens
ERRRRRHRS

SEQ ID NO: 1317048 - protein, 9 aa, Homo Sapiens
FSKWLLSTY

SEQ ID NO: 1317049 - protein, 9 aa, Homo Sapiens
VGSFTDPDD

SEQ ID NO: 1317050 - protein, 9 aa, Homo Sapiens
SGPKRGERA

SEQ ID NO: 1317051 - protein, 9 aa, Homo Sapiens
SERFSRAAT

SEQ ID NO: 1317052 - protein, 9 aa, Homo Sapiens
MEEPQMVLY

SEQ ID NO: 1317053 - protein, 9 aa, Homo Sapiens
LLYAALTHP

SEQ ID NO: 1317054 - protein, 9 aa, Homo Sapiens
VYYSPTPGD

SEQ ID NO: 1317055 - protein, 9 aa, Homo Sapiens
HSGYQFTSC

SEQ ID NO: 1317056 - protein, 9 aa, Homo Sapiens
KAHTTFEGA

SEQ ID NO: 1317057 - protein, 9 aa, Homo Sapiens
LPSLCRLNL

SEQ ID NO: 1317058 - protein, 9 aa, Homo Sapiens
TIFQNFSMA

SEQ ID NO: 1317059 - protein, 9 aa, Homo Sapiens
FPAGSFQAW

SEQ ID NO: 1317060 - protein, 9 aa, Homo Sapiens
ARPEVPIFH

SEQ ID NO: 1317061 - protein, 9 aa, Homo Sapiens
PHWLEVWRV

SEQ ID NO: 1317062 - protein, 9 aa, Homo Sapiens
RLRQHSVNE

SEQ ID NO: 1317063 - protein, 9 aa, Homo Sapiens
AKSQQDKHL

SEQ ID NO: 1317064 - protein, 9 aa, Homo Sapiens
PGSSLSSLH

SEQ ID NO: 1317065 - protein, 9 aa, Homo Sapiens
TTGQSKGFT

SEQ ID NO: 1317066 - protein, 9 aa, Homo Sapiens
FASTSIKIA

SEQ ID NO: 1317067 - protein, 9 aa, Homo Sapiens
ICISRNFLP

SEQ ID NO: 1317068 - protein, 9 aa, Homo Sapiens
VIVKKQIVK

SEQ ID NO: 1317069 - protein, 9 aa, Homo Sapiens
LNKHQHFGY

SEQ ID NO: 1317070 - protein, 9 aa, Homo Sapiens
MRHMYNSEL

SEQ ID NO: 1317071 - protein, 9 aa, Homo Sapiens
EVYAVTKLA

SEQ ID NO: 1317072 - protein, 9 aa, Homo Sapiens
ARQSAYIHK

SEQ ID NO: 1317073 - protein, 9 aa, Homo Sapiens
PWPSRKEDG

SEQ ID NO: 1317074 - protein, 9 aa, Homo Sapiens
SGGGRGASP

SEQ ID NO: 1317075 - protein, 9 aa, Homo Sapiens
TDGLVMTWS

SEQ ID NO: 1317076 - protein, 9 aa, Homo Sapiens
HSEHHDHVI

SEQ ID NO: 1317077 - protein, 9 aa, Homo Sapiens
RFLSGLLDA

SEQ ID NO: 1317078 - protein, 9 aa, Homo Sapiens
RCSTGARTS

SEQ ID NO: 1317079 - protein, 9 aa, Homo Sapiens
QDSDSDQPL

SEQ ID NO: 1317080 - protein, 9 aa, Homo Sapiens
LKDEFDRLD

SEQ ID NO: 1317081 - protein, 9 aa, Homo Sapiens
SEHHDHVIF

SEQ ID NO: 1317082 - protein, 9 aa, Homo Sapiens
ASLVEIAGR

SEQ ID NO: 1317083 - protein, 9 aa, Homo Sapiens
NWSPHPPRA

SEQ ID NO: 1317084 - protein, 9 aa, Homo Sapiens
TEVDTRLSF

SEQ ID NO: 1317085 - protein, 9 aa, Homo Sapiens
QPTLSPVTQ

SEQ ID NO: 1317086 - protein, 9 aa, Homo Sapiens
KEERMWADV

SEQ ID NO: 1317087 - protein, 9 aa, Homo Sapiens
YENKLYDEL

SEQ ID NO: 1317088 - protein, 9 aa, Homo Sapiens
EVSFPQSSS

SEQ ID NO: 1317089 - protein, 9 aa, Homo Sapiens
QRDVFLRID

SEQ ID NO: 1317090 - protein, 9 aa, Homo Sapiens
RREGIHYAR

SEQ ID NO: 1317091 - protein, 9 aa, Homo Sapiens
LEQCHYRFK

SEQ ID NO: 1317092 - protein, 9 aa, Homo Sapiens
NMLNWAQAV

SEQ ID NO: 1317093 - protein, 9 aa, Homo Sapiens
VLSRQLCEP

SEQ ID NO: 1317094 - protein, 9 aa, Homo Sapiens
ENYQALDTD

SEQ ID NO: 1317095 - protein, 9 aa, Homo Sapiens
IKYEVVRDA

SEQ ID NO: 1317096 - protein, 9 aa, Homo Sapiens
IGCRSLSRS

SEQ ID NO: 1317097 - protein, 9 aa, Homo Sapiens
EGRGTPCTS

SEQ ID NO: 1317098 - protein, 9 aa, Homo Sapiens
CMLAREERH

SEQ ID NO: 1317099 - protein, 9 aa, Homo Sapiens
AAYANFFIG

SEQ ID NO: 1317100 - protein, 9 aa, Homo Sapiens
TSDTSLWTP

SEQ ID NO: 1317101 - protein, 9 aa, Homo Sapiens
EYVGQITLM

SEQ ID NO: 1317102 - protein, 9 aa, Homo Sapiens
EAGRVNRRQ

SEQ ID NO: 1317103 - protein, 9 aa, Homo Sapiens
GQDPIKGQV

SEQ ID NO: 1317104 - protein, 9 aa, Homo Sapiens
ICSHYYRAP

SEQ ID NO: 1317105 - protein, 9 aa, Homo Sapiens
QEILNTNSI

SEQ ID NO: 1317106 - protein, 9 aa, Homo Sapiens
PSSCDSSPS

SEQ ID NO: 1317107 - protein, 9 aa, Homo Sapiens
FQMCLVLII

SEQ ID NO: 1317108 - protein, 9 aa, Homo Sapiens
AITDVAFCM

SEQ ID NO: 1317109 - protein, 9 aa, Homo Sapiens
LFLAYLFFA

SEQ ID NO: 1317110 - protein, 9 aa, Homo Sapiens
SRCLHCCDP

SEQ ID NO: 1317111 - protein, 9 aa, Homo Sapiens
FSSSFSLFS

SEQ ID NO: 1317112 - protein, 9 aa, Homo Sapiens
ELADDVDLT

SEQ ID NO: 1317113 - protein, 9 aa, Homo Sapiens
SSLSSLHVR

SEQ ID NO: 1317114 - protein, 9 aa, Homo Sapiens
VVAFYSGKS

SEQ ID NO: 1317115 - protein, 9 aa, Homo Sapiens
KALQTAIEM

SEQ ID NO: 1317116 - protein, 9 aa, Homo Sapiens
TYYLEPLPL

SEQ ID NO: 1317117 - protein, 9 aa, Homo Sapiens
GGHPISELI

SEQ ID NO: 1317118 - protein, 9 aa, Homo Sapiens
NRKCLYKVI

SEQ ID NO: 1317119 - protein, 9 aa, Homo Sapiens
LQSTSFLTA

SEQ ID NO: 1317120 - protein, 9 aa, Homo Sapiens
LESEEMNQT

SEQ ID NO: 1317121 - protein, 9 aa, Homo Sapiens
LANELHVSC

SEQ ID NO: 1317122 - protein, 9 aa, Homo Sapiens
NDDTLLKNY

SEQ ID NO: 1317123 - protein, 9 aa, Homo Sapiens
TDALYVRGL

SEQ ID NO: 1317124 - protein, 9 aa, Homo Sapiens
PSSKHLMSP

SEQ ID NO: 1317125 - protein, 9 aa, Homo Sapiens
GRLMRICVQ

SEQ ID NO: 1317126 - protein, 9 aa, Homo Sapiens
HKSGRRCWG

SEQ ID NO: 1317127 - protein, 9 aa, Homo Sapiens
KGVIQYYTA

SEQ ID NO: 1317128 - protein, 9 aa, Homo Sapiens
YFNTYEGLV

SEQ ID NO: 1317129 - protein, 9 aa, Homo Sapiens
RVTVSHLDW

SEQ ID NO: 1317130 - protein, 9 aa, Homo Sapiens
PEPPLPYEF

SEQ ID NO: 1317131 - protein, 9 aa, Homo Sapiens
KITVRDNQA

SEQ ID NO: 1317132 - protein, 9 aa, Homo Sapiens
SSPEGDNPK

SEQ ID NO: 1317133 - protein, 9 aa, Homo Sapiens
PQDSCWQTS

SEQ ID NO: 1317134 - protein, 9 aa, Homo Sapiens
SSLSQEVQL

SEQ ID NO: 1317135 - protein, 9 aa, Homo Sapiens
ALNCVVGSH

SEQ ID NO: 1317136 - protein, 9 aa, Homo Sapiens
KELNMMKFF

SEQ ID NO: 1317137 - protein, 9 aa, Homo Sapiens
CIAVCVHQC

SEQ ID NO: 1317138 - protein, 9 aa, Homo Sapiens
SRTMILVVF

SEQ ID NO: 1317139 - protein, 9 aa, Homo Sapiens
MAQKFKEFQ

SEQ ID NO: 1317140 - protein, 9 aa, Homo Sapiens
FSVFDIDED

SEQ ID NO: 1317141 - protein, 9 aa, Homo Sapiens
WMPQTFRDP

SEQ ID NO: 1317142 - protein, 9 aa, Homo Sapiens
NDMIGLSDF

SEQ ID NO: 1317143 - protein, 9 aa, Homo Sapiens
DDKQKVKNL

SEQ ID NO: 1317144 - protein, 9 aa, Homo Sapiens
FTCTVDTEN

SEQ ID NO: 1317145 - protein, 9 aa, Homo Sapiens
NIKYLDVFA

SEQ ID NO: 1317146 - protein, 9 aa, Homo Sapiens
VEIGTERYQ

SEQ ID NO: 1317147 - protein, 9 aa, Homo Sapiens
EKADTLQGA

SEQ ID NO: 1317148 - protein, 9 aa, Homo Sapiens
LALAMSQAR

SEQ ID NO: 1317149 - protein, 9 aa, Homo Sapiens
PEDTYERCI

SEQ ID NO: 1317150 - protein, 9 aa, Homo Sapiens
ESRVQRNIR

SEQ ID NO: 1317151 - protein, 9 aa, Homo Sapiens
FEDLRRDMF

SEQ ID NO: 1317152 - protein, 9 aa, Homo Sapiens
LKTLEAREK

SEQ ID NO: 1317153 - protein, 9 aa, Homo Sapiens
VTESDGSPV

SEQ ID NO: 1317154 - protein, 9 aa, Homo Sapiens
KLYWGTATT

SEQ ID NO: 1317155 - protein, 9 aa, Homo Sapiens
AQLTMKGSN

SEQ ID NO: 1317156 - protein, 9 aa, Homo Sapiens
LGLYMTTVL

SEQ ID NO: 1317157 - protein, 9 aa, Homo Sapiens
HTCSGWLHN

SEQ ID NO: 1317158 - protein, 9 aa, Homo Sapiens
FPESTVFMY

SEQ ID NO: 1317159 - protein, 9 aa, Homo Sapiens
LTNLLIHYG

SEQ ID NO: 1317160 - protein, 9 aa, Homo Sapiens
AHKITGDHL

SEQ ID NO: 1317161 - protein, 9 aa, Homo Sapiens
QVTEVTLWM

SEQ ID NO: 1317162 - protein, 9 aa, Homo Sapiens
EREYHADGG

SEQ ID NO: 1317163 - protein, 9 aa, Homo Sapiens
APWGGRGQD

SEQ ID NO: 1317164 - protein, 9 aa, Homo Sapiens
HRKNHSIVT

SEQ ID NO: 1317165 - protein, 9 aa, Homo Sapiens
TTESFDPLF

SEQ ID NO: 1317166 - protein, 9 aa, Homo Sapiens
IVGLTIACN

SEQ ID NO: 1317167 - protein, 9 aa, Homo Sapiens
SLGEAIIKR

SEQ ID NO: 1317168 - protein, 9 aa, Homo Sapiens
VIRGRSRKL

SEQ ID NO: 1317169 - protein, 9 aa, Homo Sapiens
KPLHKKKSV

SEQ ID NO: 1317170 - protein, 9 aa, Homo Sapiens
GTGCLVTGL

SEQ ID NO: 1317171 - protein, 9 aa, Homo Sapiens
QFLTIVRRR

SEQ ID NO: 1317172 - protein, 9 aa, Homo Sapiens
HASLYLSSP

SEQ ID NO: 1317173 - protein, 9 aa, Homo Sapiens
EIENWTTEC

SEQ ID NO: 1317174 - protein, 9 aa, Homo Sapiens
HVVPASVPA

SEQ ID NO: 1317175 - protein, 9 aa, Homo Sapiens
VTEKLKANA

SEQ ID NO: 1317176 - protein, 9 aa, Homo Sapiens
RSAEEVASV

SEQ ID NO: 1317177 - protein, 9 aa, Homo Sapiens
PPMVPQGWM

SEQ ID NO: 1317178 - protein, 9 aa, Homo Sapiens
DATPLPRPG

SEQ ID NO: 1317179 - protein, 9 aa, Homo Sapiens
KIECLPLEG

SEQ ID NO: 1317180 - protein, 9 aa, Homo Sapiens
HRLHQSPSG

SEQ ID NO: 1317181 - protein, 9 aa, Homo Sapiens
AQDLENIVV

SEQ ID NO: 1317182 - protein, 9 aa, Homo Sapiens
MAGQERFRS

SEQ ID NO: 1317183 - protein, 9 aa, Homo Sapiens
VDYKGGYKH

SEQ ID NO: 1317184 - protein, 9 aa, Homo Sapiens
NQALPGTIS

SEQ ID NO: 1317185 - protein, 9 aa, Homo Sapiens
GEEHCKVSA

SEQ ID NO: 1317186 - protein, 9 aa, Homo Sapiens
REEKIRIRD

SEQ ID NO: 1317187 - protein, 9 aa, Homo Sapiens
PRKRHATEK

SEQ ID NO: 1317188 - protein, 9 aa, Homo Sapiens
STAARASPS

SEQ ID NO: 1317189 - protein, 9 aa, Homo Sapiens
VVAKRTHQW

SEQ ID NO: 1317190 - protein, 9 aa, Homo Sapiens
WEQLSLVLI

SEQ ID NO: 1317191 - protein, 9 aa, Homo Sapiens
EEKCHSIRR

SEQ ID NO: 1317192 - protein, 9 aa, Homo Sapiens
HMQSINAGF

SEQ ID NO: 1317193 - protein, 9 aa, Homo Sapiens
ERVKEKADT

SEQ ID NO: 1317194 - protein, 9 aa, Homo Sapiens
PGWRRRHRA

SEQ ID NO: 1317195 - protein, 9 aa, Homo Sapiens
FLENSSRDL

SEQ ID NO: 1317196 - protein, 9 aa, Homo Sapiens
VALHEIRRY

SEQ ID NO: 1317197 - protein, 9 aa, Homo Sapiens
TIKDDIIYL

SEQ ID NO: 1317198 - protein, 9 aa, Homo Sapiens
VLWLLITAW

SEQ ID NO: 1317199 - protein, 9 aa, Homo Sapiens
HLRFEVHDI

SEQ ID NO: 1317200 - protein, 9 aa, Homo Sapiens
DDTCHGNPS

SEQ ID NO: 1317201 - protein, 9 aa, Homo Sapiens
RRRRLEMMS

SEQ ID NO: 1317202 - protein, 9 aa, Homo Sapiens
KDANWTRLQ

SEQ ID NO: 1317203 - protein, 9 aa, Homo Sapiens
AAVAEVSGY

SEQ ID NO: 1317204 - protein, 9 aa, Homo Sapiens
GCDNIIDLF

SEQ ID NO: 1317205 - protein, 9 aa, Homo Sapiens
DLTAILSLE

SEQ ID NO: 1317206 - protein, 9 aa, Homo Sapiens
DTVQGRITV

SEQ ID NO: 1317207 - protein, 9 aa, Homo Sapiens
RKLKTTPTP

SEQ ID NO: 1317208 - protein, 9 aa, Homo Sapiens
QQAEHCQKM

SEQ ID NO: 1317209 - protein, 9 aa, Homo Sapiens
LDELHLAVA

SEQ ID NO: 1317210 - protein, 9 aa, Homo Sapiens
SSSTNTCSA

SEQ ID NO: 1317211 - protein, 9 aa, Homo Sapiens
CDNFGELRL

SEQ ID NO: 1317212 - protein, 9 aa, Homo Sapiens
SRWRAWSSF

SEQ ID NO: 1317213 - protein, 9 aa, Homo Sapiens
DSPIPTLKG

SEQ ID NO: 1317214 - protein, 9 aa, Homo Sapiens
INLSFAYME

SEQ ID NO: 1317215 - protein, 9 aa, Homo Sapiens
KGKKIIEYY

SEQ ID NO: 1317216 - protein, 9 aa, Homo Sapiens
FSLELTHTT

SEQ ID NO: 1317217 - protein, 9 aa, Homo Sapiens
CLAACWVQG

SEQ ID NO: 1317218 - protein, 9 aa, Homo Sapiens
ALMDGAHGT

SEQ ID NO: 1317219 - protein, 9 aa, Homo Sapiens
HLLGGSGDN

SEQ ID NO: 1317220 - protein, 9 aa, Homo Sapiens
GKQKMAITK

SEQ ID NO: 1317221 - protein, 9 aa, Homo Sapiens
HFVFVLSPL

SEQ ID NO: 1317222 - protein, 9 aa, Homo Sapiens
MRISEILLD

SEQ ID NO: 1317223 - protein, 9 aa, Homo Sapiens
DEVCVKLGL

SEQ ID NO: 1317224 - protein, 9 aa, Homo Sapiens
GVTSEDFLI

SEQ ID NO: 1317225 - protein, 9 aa, Homo Sapiens
LPSLPGSRH

SEQ ID NO: 1317226 - protein, 9 aa, Homo Sapiens
GYEAFRTPA

SEQ ID NO: 1317227 - protein, 9 aa, Homo Sapiens
KYQGRDDDA

SEQ ID NO: 1317228 - protein, 9 aa, Homo Sapiens
SQLGIVNTS

SEQ ID NO: 1317229 - protein, 9 aa, Homo Sapiens
EISQGHLGP

SEQ ID NO: 1317230 - protein, 9 aa, Homo Sapiens
EVVTLGGSL

SEQ ID NO: 1317231 - protein, 9 aa, Homo Sapiens
AGPPHDTLC

SEQ ID NO: 1317232 - protein, 9 aa, Homo Sapiens
HCYTESLDM

SEQ ID NO: 1317233 - protein, 9 aa, Homo Sapiens
IFALFIPCM

SEQ ID NO: 1317234 - protein, 9 aa, Homo Sapiens
LGMQLVLPC

SEQ ID NO: 1317235 - protein, 9 aa, Homo Sapiens
EAPMLVRLA

SEQ ID NO: 1317236 - protein, 9 aa, Homo Sapiens
ANGTYEVSV

SEQ ID NO: 1317237 - protein, 9 aa, Homo Sapiens
AHRRMVVEY

SEQ ID NO: 1317238 - protein, 9 aa, Homo Sapiens
TGADMSSLV

SEQ ID NO: 1317239 - protein, 9 aa, Homo Sapiens
EANMACLDL

SEQ ID NO: 1317240 - protein, 9 aa, Homo Sapiens
LTATPDGHL

SEQ ID NO: 1317241 - protein, 9 aa, Homo Sapiens
IKANISMKT

SEQ ID NO: 1317242 - protein, 9 aa, Homo Sapiens
TSNAFLWPC

SEQ ID NO: 1317243 - protein, 9 aa, Homo Sapiens
PMSSMSPPP

SEQ ID NO: 1317244 - protein, 9 aa, Homo Sapiens
LDHYRTALR

SEQ ID NO: 1317245 - protein, 9 aa, Homo Sapiens
KVLLKPITG

SEQ ID NO: 1317246 - protein, 9 aa, Homo Sapiens
GHHEQDTEL

SEQ ID NO: 1317247 - protein, 9 aa, Homo Sapiens
IPVHILFFS

SEQ ID NO: 1317248 - protein, 9 aa, Homo Sapiens
FYSTCTKGG

SEQ ID NO: 1317249 - protein, 9 aa, Homo Sapiens
FPTPCPLPC

SEQ ID NO: 1317250 - protein, 9 aa, Homo Sapiens
YYADGCSPH

SEQ ID NO: 1317251 - protein, 9 aa, Homo Sapiens
HLCTVKLCP

SEQ ID NO: 1317252 - protein, 9 aa, Homo Sapiens
SLYPTDNED

SEQ ID NO: 1317253 - protein, 9 aa, Homo Sapiens
DQAREQDCA

SEQ ID NO: 1317254 - protein, 9 aa, Homo Sapiens
DGDAAMYGA

SEQ ID NO: 1317255 - protein, 9 aa, Homo Sapiens
LLPGIETLE

SEQ ID NO: 1317256 - protein, 9 aa, Homo Sapiens
DHLLGENDD

SEQ ID NO: 1317257 - protein, 9 aa, Homo Sapiens
SYVLRMGPP

SEQ ID NO: 1317258 - protein, 9 aa, Homo Sapiens
VIEPGCIRV

SEQ ID NO: 1317259 - protein, 9 aa, Homo Sapiens
FVILFITPL

SEQ ID NO: 1317260 - protein, 9 aa, Homo Sapiens
KIISLIFEK

SEQ ID NO: 1317261 - protein, 9 aa, Homo Sapiens
SELAQAMRW

SEQ ID NO: 1317262 - protein, 9 aa, Homo Sapiens
IDLKYDLGN

SEQ ID NO: 1317263 - protein, 9 aa, Homo Sapiens
TRKKWCPYT

SEQ ID NO: 1317264 - protein, 9 aa, Homo Sapiens
AEQFLRVMT

SEQ ID NO: 1317265 - protein, 9 aa, Homo Sapiens
FEKAHHSKK

SEQ ID NO: 1317266 - protein, 9 aa, Homo Sapiens
PVIISSMMM

SEQ ID NO: 1317267 - protein, 9 aa, Homo Sapiens
DPRWCSFLD

SEQ ID NO: 1317268 - protein, 9 aa, Homo Sapiens
IESTVCAIN

SEQ ID NO: 1317269 - protein, 9 aa, Homo Sapiens
VKLGLCRCK

SEQ ID NO: 1317270 - protein, 9 aa, Homo Sapiens
INANRNWNS

SEQ ID NO: 1317271 - protein, 9 aa, Homo Sapiens
RVPPSESQN

SEQ ID NO: 1317272 - protein, 9 aa, Homo Sapiens
SGAEAVMNW

SEQ ID NO: 1317273 - protein, 9 aa, Homo Sapiens
RSFFLWNSR

SEQ ID NO: 1317274 - protein, 9 aa, Homo Sapiens
SPRKKSRHH

SEQ ID NO: 1317275 - protein, 9 aa, Homo Sapiens
HMCMPLSKM

SEQ ID NO: 1317276 - protein, 9 aa, Homo Sapiens
CWEFFPTGD

SEQ ID NO: 1317277 - protein, 9 aa, Homo Sapiens
GLTETINEV

SEQ ID NO: 1317278 - protein, 9 aa, Homo Sapiens
HDLHNRLRE

SEQ ID NO: 1317279 - protein, 9 aa, Homo Sapiens
EMECIVTTH

SEQ ID NO: 1317280 - protein, 9 aa, Homo Sapiens
KYRNVIKRT

SEQ ID NO: 1317281 - protein, 9 aa, Homo Sapiens
PPLPYEFSC

SEQ ID NO: 1317282 - protein, 9 aa, Homo Sapiens
SENCLLACG

SEQ ID NO: 1317283 - protein, 9 aa, Homo Sapiens
CANDTPLTW

SEQ ID NO: 1317284 - protein, 9 aa, Homo Sapiens
GAGTELSVC

SEQ ID NO: 1317285 - protein, 9 aa, Homo Sapiens
EDVRKYVGS

SEQ ID NO: 1317286 - protein, 9 aa, Homo Sapiens
SHNLITANV

SEQ ID NO: 1317287 - protein, 9 aa, Homo Sapiens
CKYHALCSR

SEQ ID NO: 1317288 - protein, 9 aa, Homo Sapiens
SSTVKAHDN

SEQ ID NO: 1317289 - protein, 9 aa, Homo Sapiens
EVFFFTIGI

SEQ ID NO: 1317290 - protein, 9 aa, Homo Sapiens
ISSLDAREV

SEQ ID NO: 1317291 - protein, 9 aa, Homo Sapiens
KVPNGYLCF

SEQ ID NO: 1317292 - protein, 9 aa, Homo Sapiens
KHISSPLAS

SEQ ID NO: 1317293 - protein, 9 aa, Homo Sapiens
SSQDPHTKA

SEQ ID NO: 1317294 - protein, 9 aa, Homo Sapiens
FEISQGHLG

SEQ ID NO: 1317295 - protein, 9 aa, Homo Sapiens
HPLITLKWL

SEQ ID NO: 1317296 - protein, 9 aa, Homo Sapiens
AITFIVRRL

SEQ ID NO: 1317297 - protein, 9 aa, Homo Sapiens
NFNLLHGKT

SEQ ID NO: 1317298 - protein, 9 aa, Homo Sapiens
NLELTISPH

SEQ ID NO: 1317299 - protein, 9 aa, Homo Sapiens
KIMGVEEDD

SEQ ID NO: 1317300 - protein, 9 aa, Homo Sapiens
FTVVTWDPR

SEQ ID NO: 1317301 - protein, 9 aa, Homo Sapiens
PSPGGWKVI

SEQ ID NO: 1317302 - protein, 9 aa, Homo Sapiens
GIGRTVMYL

SEQ ID NO: 1317303 - protein, 9 aa, Homo Sapiens
EIDMVINRS

SEQ ID NO: 1317304 - protein, 9 aa, Homo Sapiens
HGFIFKGRL

SEQ ID NO: 1317305 - protein, 9 aa, Homo Sapiens
DFHIAGDAC

SEQ ID NO: 1317306 - protein, 9 aa, Homo Sapiens
YNTSTDRLL

SEQ ID NO: 1317307 - protein, 9 aa, Homo Sapiens
YRSHQARET

SEQ ID NO: 1317308 - protein, 9 aa, Homo Sapiens
PLLLVYIMS

SEQ ID NO: 1317309 - protein, 9 aa, Homo Sapiens
MCNHTSGLI

SEQ ID NO: 1317310 - protein, 9 aa, Homo Sapiens
VEDIEQLYG

SEQ ID NO: 1317311 - protein, 9 aa, Homo Sapiens
DLMLRHGWC

SEQ ID NO: 1317312 - protein, 9 aa, Homo Sapiens
VWKWGESLR

SEQ ID NO: 1317313 - protein, 9 aa, Homo Sapiens
EEVASVLAT

SEQ ID NO: 1317314 - protein, 9 aa, Homo Sapiens
ELHVPLFIM

SEQ ID NO: 1317315 - protein, 9 aa, Homo Sapiens
GDNPKESPP

SEQ ID NO: 1317316 - protein, 9 aa, Homo Sapiens
PDGLHPLWP

SEQ ID NO: 1317317 - protein, 9 aa, Homo Sapiens
PIFDEIILS

SEQ ID NO: 1317318 - protein, 9 aa, Homo Sapiens
QISDWTGSL

SEQ ID NO: 1317319 - protein, 9 aa, Homo Sapiens
INTFLNYIC

SEQ ID NO: 1317320 - protein, 9 aa, Homo Sapiens
PQKDHFAWQ

SEQ ID NO: 1317321 - protein, 9 aa, Homo Sapiens
ANMPNKEMM

SEQ ID NO: 1317322 - protein, 9 aa, Homo Sapiens
SDTEEVDRT

SEQ ID NO: 1317323 - protein, 9 aa, Homo Sapiens
ADRITLKLV

SEQ ID NO: 1317324 - protein, 9 aa, Homo Sapiens
LYTCLKCGE

SEQ ID NO: 1317325 - protein, 9 aa, Homo Sapiens
PQPSLGDGL

SEQ ID NO: 1317326 - protein, 9 aa, Homo Sapiens
AWTLPRSPE

SEQ ID NO: 1317327 - protein, 9 aa, Homo Sapiens
RQVPVSEPN

SEQ ID NO: 1317328 - protein, 9 aa, Homo Sapiens
MIQMTVKDY

SEQ ID NO: 1317329 - protein, 9 aa, Homo Sapiens
IEEKTAAYD

SEQ ID NO: 1317330 - protein, 9 aa, Homo Sapiens
QRPPRQVRE

SEQ ID NO: 1317331 - protein, 9 aa, Homo Sapiens
QEPHLFLGL

SEQ ID NO: 1317332 - protein, 9 aa, Homo Sapiens
YLLKSVQRI

SEQ ID NO: 1317333 - protein, 9 aa, Homo Sapiens
SLSPAPSLG

SEQ ID NO: 1317334 - protein, 9 aa, Homo Sapiens
HSSLEEHKE

SEQ ID NO: 1317335 - protein, 9 aa, Homo Sapiens
NLGHYWNIG

SEQ ID NO: 1317336 - protein, 9 aa, Homo Sapiens
LQQVVDMKK

SEQ ID NO: 1317337 - protein, 9 aa, Homo Sapiens
TINEVSKLS

SEQ ID NO: 1317338 - protein, 9 aa, Homo Sapiens
DNHSLISSY

SEQ ID NO: 1317339 - protein, 9 aa, Homo Sapiens
IALDYEGDT

SEQ ID NO: 1317340 - protein, 9 aa, Homo Sapiens
RAIIQHHHP

SEQ ID NO: 1317341 - protein, 9 aa, Homo Sapiens
DLREDTLDD

SEQ ID NO: 1317342 - protein, 9 aa, Homo Sapiens
YGESSSLVT

SEQ ID NO: 1317343 - protein, 9 aa, Homo Sapiens
KHFNIFSKP

SEQ ID NO: 1317344 - protein, 9 aa, Homo Sapiens
LGLWTTCVD

SEQ ID NO: 1317345 - protein, 9 aa, Homo Sapiens
LRKCVLDME

SEQ ID NO: 1317346 - protein, 9 aa, Homo Sapiens
PGDHIQSSR

SEQ ID NO: 1317347 - protein, 9 aa, Homo Sapiens
GEIRKMKDR

SEQ ID NO: 1317348 - protein, 9 aa, Homo Sapiens
MGAEAHINT

SEQ ID NO: 1317349 - protein, 9 aa, Homo Sapiens
SRSSLRCCH

SEQ ID NO: 1317350 - protein, 9 aa, Homo Sapiens
GEKDLHLLE

SEQ ID NO: 1317351 - protein, 9 aa, Homo Sapiens
YHVNKRLEE

SEQ ID NO: 1317352 - protein, 9 aa, Homo Sapiens
ISKEGNHLL

SEQ ID NO: 1317353 - protein, 9 aa, Homo Sapiens
SYMEEPSQH

SEQ ID NO: 1317354 - protein, 9 aa, Homo Sapiens
VIFDEWMKR

SEQ ID NO: 1317355 - protein, 9 aa, Homo Sapiens
TWGASPAPN

SEQ ID NO: 1317356 - protein, 9 aa, Homo Sapiens
MDSETLQRV

SEQ ID NO: 1317357 - protein, 9 aa, Homo Sapiens
FKASHNLQD

SEQ ID NO: 1317358 - protein, 9 aa, Homo Sapiens
GDPPVNYVP

SEQ ID NO: 1317359 - protein, 9 aa, Homo Sapiens
THWRIYRPT

SEQ ID NO: 1317360 - protein, 9 aa, Homo Sapiens
VGTALLGKE

SEQ ID NO: 1317361 - protein, 9 aa, Homo Sapiens
TKDSLPMTS

SEQ ID NO: 1317362 - protein, 9 aa, Homo Sapiens
RCFSLCMKS

SEQ ID NO: 1317363 - protein, 9 aa, Homo Sapiens
TSLTQKWFP

SEQ ID NO: 1317364 - protein, 9 aa, Homo Sapiens
AVIMAVWRP

SEQ ID NO: 1317365 - protein, 9 aa, Homo Sapiens
GQALANILM

SEQ ID NO: 1317366 - protein, 9 aa, Homo Sapiens
WDVILKAVK

SEQ ID NO: 1317367 - protein, 9 aa, Homo Sapiens
ASITHYLYI

SEQ ID NO: 1317368 - protein, 9 aa, Homo Sapiens
DKDGSIVGF

SEQ ID NO: 1317369 - protein, 9 aa, Homo Sapiens
KNEEHEDEV

SEQ ID NO: 1317370 - protein, 9 aa, Homo Sapiens
GRTRARSPS

SEQ ID NO: 1317371 - protein, 9 aa, Homo Sapiens
VQLGLDWQC

SEQ ID NO: 1317372 - protein, 9 aa, Homo Sapiens
TIQCVRFKV

SEQ ID NO: 1317373 - protein, 9 aa, Homo Sapiens
TQAVFLEVD

SEQ ID NO: 1317374 - protein, 9 aa, Homo Sapiens
CGSFAPGGA

SEQ ID NO: 1317375 - protein, 9 aa, Homo Sapiens
PVLEKLQSI

SEQ ID NO: 1317376 - protein, 9 aa, Homo Sapiens
VLGATEAQP

SEQ ID NO: 1317377 - protein, 9 aa, Homo Sapiens
LPGVGLAPQ

SEQ ID NO: 1317378 - protein, 9 aa, Homo Sapiens
ARSPSPPHR

SEQ ID NO: 1317379 - protein, 9 aa, Homo Sapiens
EVSHLRTLR

SEQ ID NO: 1317380 - protein, 9 aa, Homo Sapiens
LMTMMGLRY

SEQ ID NO: 1317381 - protein, 9 aa, Homo Sapiens
SNMTFLAET

SEQ ID NO: 1317382 - protein, 9 aa, Homo Sapiens
WSEAMTHGC

SEQ ID NO: 1317383 - protein, 9 aa, Homo Sapiens
GSTCNNESE

SEQ ID NO: 1317384 - protein, 9 aa, Homo Sapiens
SDFDVHILP

SEQ ID NO: 1317385 - protein, 9 aa, Homo Sapiens
KNLLEEILK

SEQ ID NO: 1317386 - protein, 9 aa, Homo Sapiens
SVVPSALQL

SEQ ID NO: 1317387 - protein, 9 aa, Homo Sapiens
SPGTVLVGS

SEQ ID NO: 1317388 - protein, 9 aa, Homo Sapiens
WIAQRRKTL

SEQ ID NO: 1317389 - protein, 9 aa, Homo Sapiens
IDVMSTDFF

SEQ ID NO: 1317390 - protein, 9 aa, Homo Sapiens
YSSVLEYTI

SEQ ID NO: 1317391 - protein, 9 aa, Homo Sapiens
QMDTNGLVR

SEQ ID NO: 1317392 - protein, 9 aa, Homo Sapiens
FLGLWTTCV

SEQ ID NO: 1317393 - protein, 9 aa, Homo Sapiens
NTASLIFNQ

SEQ ID NO: 1317394 - protein, 9 aa, Homo Sapiens
KDGWPLCML

SEQ ID NO: 1317395 - protein, 9 aa, Homo Sapiens
MLEVKNSPR

SEQ ID NO: 1317396 - protein, 9 aa, Homo Sapiens
HWCWVESRG

SEQ ID NO: 1317397 - protein, 9 aa, Homo Sapiens
KHRRKITVV

SEQ ID NO: 1317398 - protein, 9 aa, Homo Sapiens
RRNNMKLQH

SEQ ID NO: 1317399 - protein, 9 aa, Homo Sapiens
PASTFTLSS

SEQ ID NO: 1317400 - protein, 9 aa, Homo Sapiens
ITSLRSLNL

SEQ ID NO: 1317401 - protein, 9 aa, Homo Sapiens
TKSSHLKTH

SEQ ID NO: 1317402 - protein, 9 aa, Homo Sapiens
FVVKNYYFN

SEQ ID NO: 1317403 - protein, 9 aa, Homo Sapiens
QKISFKYNR

SEQ ID NO: 1317404 - protein, 9 aa, Homo Sapiens
TGHLSMAAA

SEQ ID NO: 1317405 - protein, 9 aa, Homo Sapiens
TAILSLENC

SEQ ID NO: 1317406 - protein, 9 aa, Homo Sapiens
PRREIENWT

SEQ ID NO: 1317407 - protein, 9 aa, Homo Sapiens
DLNYSIDTV

SEQ ID NO: 1317408 - protein, 9 aa, Homo Sapiens
TKMLSWDTV

SEQ ID NO: 1317409 - protein, 9 aa, Homo Sapiens
ERDIWKADP

SEQ ID NO: 1317410 - protein, 9 aa, Homo Sapiens
NSHTVMNGA

SEQ ID NO: 1317411 - protein, 9 aa, Homo Sapiens
TARKVLSRE

SEQ ID NO: 1317412 - protein, 9 aa, Homo Sapiens
AQKRKKEDG

SEQ ID NO: 1317413 - protein, 9 aa, Homo Sapiens
GTFLIRPSE

SEQ ID NO: 1317414 - protein, 9 aa, Homo Sapiens
MATAEDLSL

SEQ ID NO: 1317415 - protein, 9 aa, Homo Sapiens
AATARRPST

SEQ ID NO: 1317416 - protein, 9 aa, Homo Sapiens
QNISQSSSN

SEQ ID NO: 1317417 - protein, 9 aa, Homo Sapiens
CSLEAYFAV

SEQ ID NO: 1317418 - protein, 9 aa, Homo Sapiens
IIKGDFQNP

SEQ ID NO: 1317419 - protein, 9 aa, Homo Sapiens
DYMSPTLDL

SEQ ID NO: 1317420 - protein, 9 aa, Homo Sapiens
TTRVHVFQI

SEQ ID NO: 1317421 - protein, 9 aa, Homo Sapiens
IWNQKDALL

SEQ ID NO: 1317422 - protein, 9 aa, Homo Sapiens
LSPNLGAQQ

SEQ ID NO: 1317423 - protein, 9 aa, Homo Sapiens
QRWMPQTFR

SEQ ID NO: 1317424 - protein, 9 aa, Homo Sapiens
LGLCRCKPG

SEQ ID NO: 1317425 - protein, 9 aa, Homo Sapiens
FTSTLPLPP

SEQ ID NO: 1317426 - protein, 9 aa, Homo Sapiens
EELWFNTDE

SEQ ID NO: 1317427 - protein, 9 aa, Homo Sapiens
IDYQLTFSL

SEQ ID NO: 1317428 - protein, 9 aa, Homo Sapiens
WSEKVAHSI

SEQ ID NO: 1317429 - protein, 9 aa, Homo Sapiens
EKEKKVQEA

SEQ ID NO: 1317430 - protein, 9 aa, Homo Sapiens
CDLLEGQEK

SEQ ID NO: 1317431 - protein, 9 aa, Homo Sapiens
LADDVDLTS

SEQ ID NO: 1317432 - protein, 9 aa, Homo Sapiens
VVYHRGHYF

SEQ ID NO: 1317433 - protein, 9 aa, Homo Sapiens
TGPSRVAKI

SEQ ID NO: 1317434 - protein, 9 aa, Homo Sapiens
QQVSYKEDK

SEQ ID NO: 1317435 - protein, 9 aa, Homo Sapiens
MAIQAPAKM

SEQ ID NO: 1317436 - protein, 9 aa, Homo Sapiens
TDVTVQGNY

SEQ ID NO: 1317437 - protein, 9 aa, Homo Sapiens
WDPRQKDDL

SEQ ID NO: 1317438 - protein, 9 aa, Homo Sapiens
SHATTASTR

SEQ ID NO: 1317439 - protein, 9 aa, Homo Sapiens
GHNLFFKCE

SEQ ID NO: 1317440 - protein, 9 aa, Homo Sapiens
GILQLTFFN

SEQ ID NO: 1317441 - protein, 9 aa, Homo Sapiens
RRVQPSCPS

SEQ ID NO: 1317442 - protein, 9 aa, Homo Sapiens
LGMSRCEDL

SEQ ID NO: 1317443 - protein, 9 aa, Homo Sapiens
IHRMGAVAH

SEQ ID NO: 1317444 - protein, 9 aa, Homo Sapiens
PNGPTHVPW

SEQ ID NO: 1317445 - protein, 9 aa, Homo Sapiens
CAPKSIAMI

SEQ ID NO: 1317446 - protein, 9 aa, Homo Sapiens
ALHLSIQTD

SEQ ID NO: 1317447 - protein, 9 aa, Homo Sapiens
IQFISGEEA

SEQ ID NO: 1317448 - protein, 9 aa, Homo Sapiens
MAELESDDI

SEQ ID NO: 1317449 - protein, 9 aa, Homo Sapiens
GLAQGLHKM

SEQ ID NO: 1317450 - protein, 9 aa, Homo Sapiens
FTSDMSSRM

SEQ ID NO: 1317451 - protein, 9 aa, Homo Sapiens
EFCLQWLRP

SEQ ID NO: 1317452 - protein, 9 aa, Homo Sapiens
LADTLIIGN

SEQ ID NO: 1317453 - protein, 9 aa, Homo Sapiens
ENGNMSRTE

SEQ ID NO: 1317454 - protein, 9 aa, Homo Sapiens
HLLGTSNSG

SEQ ID NO: 1317455 - protein, 9 aa, Homo Sapiens
VWTGLTEHM

SEQ ID NO: 1317456 - protein, 9 aa, Homo Sapiens
SRKELVMAE

SEQ ID NO: 1317457 - protein, 9 aa, Homo Sapiens
PHVPRQLPG

SEQ ID NO: 1317458 - protein, 9 aa, Homo Sapiens
ERHYEELHA

SEQ ID NO: 1317459 - protein, 9 aa, Homo Sapiens
EPHMRPRHP

SEQ ID NO: 1317460 - protein, 9 aa, Homo Sapiens
FLYKMHDIL

SEQ ID NO: 1317461 - protein, 9 aa, Homo Sapiens
GNVVTSLAQ

SEQ ID NO: 1317462 - protein, 9 aa, Homo Sapiens
PVVWKLHRV

SEQ ID NO: 1317463 - protein, 9 aa, Homo Sapiens
PLQPQKINN

SEQ ID NO: 1317464 - protein, 9 aa, Homo Sapiens
ESLQLKTHL

SEQ ID NO: 1317465 - protein, 9 aa, Homo Sapiens
PPVHIEELI

SEQ ID NO: 1317466 - protein, 9 aa, Homo Sapiens
LNIPFMLVD

SEQ ID NO: 1317467 - protein, 9 aa, Homo Sapiens
DSYDPGEED

SEQ ID NO: 1317468 - protein, 9 aa, Homo Sapiens
ASNAQDQLS

SEQ ID NO: 1317469 - protein, 9 aa, Homo Sapiens
HFVNQLWYI

SEQ ID NO: 1317470 - protein, 9 aa, Homo Sapiens
AKQILQELV

SEQ ID NO: 1317471 - protein, 9 aa, Homo Sapiens
IKQRKKKVL

SEQ ID NO: 1317472 - protein, 9 aa, Homo Sapiens
RIPKVAYGI

SEQ ID NO: 1317473 - protein, 9 aa, Homo Sapiens
MTPYGSPWW

SEQ ID NO: 1317474 - protein, 9 aa, Homo Sapiens
LPDVAPVTK

SEQ ID NO: 1317475 - protein, 9 aa, Homo Sapiens
ATINLYVDS

SEQ ID NO: 1317476 - protein, 9 aa, Homo Sapiens
VIYKVQCVA

SEQ ID NO: 1317477 - protein, 9 aa, Homo Sapiens
EKQIWLCCI

SEQ ID NO: 1317478 - protein, 9 aa, Homo Sapiens
VGEYQCEVS

SEQ ID NO: 1317479 - protein, 9 aa, Homo Sapiens
NASPPAGPN

SEQ ID NO: 1317480 - protein, 9 aa, Homo Sapiens
QRACCKSVH

SEQ ID NO: 1317481 - protein, 9 aa, Homo Sapiens
PEVMCSDSE

SEQ ID NO: 1317482 - protein, 9 aa, Homo Sapiens
QFQQQQLQI

SEQ ID NO: 1317483 - protein, 9 aa, Homo Sapiens
SKNVRHICY

SEQ ID NO: 1317484 - protein, 9 aa, Homo Sapiens
QLRVGHPNH

SEQ ID NO: 1317485 - protein, 9 aa, Homo Sapiens
KTQSNIHDY

SEQ ID NO: 1317486 - protein, 9 aa, Homo Sapiens
FRMEQMVFL

SEQ ID NO: 1317487 - protein, 9 aa, Homo Sapiens
PAVPSSSAA

SEQ ID NO: 1317488 - protein, 9 aa, Homo Sapiens
LTGAGIYTY

SEQ ID NO: 1317489 - protein, 9 aa, Homo Sapiens
PQCLKKNSK

SEQ ID NO: 1317490 - protein, 9 aa, Homo Sapiens
EVSLIFTQF

SEQ ID NO: 1317491 - protein, 9 aa, Homo Sapiens
RNPVINITS

SEQ ID NO: 1317492 - protein, 9 aa, Homo Sapiens
SGNTPKLLP

SEQ ID NO: 1317493 - protein, 9 aa, Homo Sapiens
ECVEHLSEF

SEQ ID NO: 1317494 - protein, 9 aa, Homo Sapiens
TEDAGAPLV

SEQ ID NO: 1317495 - protein, 9 aa, Homo Sapiens
CTSKVSAFA

SEQ ID NO: 1317496 - protein, 9 aa, Homo Sapiens
CDVSKWPVD

SEQ ID NO: 1317497 - protein, 9 aa, Homo Sapiens
SIAQKCALF

SEQ ID NO: 1317498 - protein, 9 aa, Homo Sapiens
SGNWELIKI

SEQ ID NO: 1317499 - protein, 9 aa, Homo Sapiens
DHTHYLLTF

SEQ ID NO: 1317500 - protein, 9 aa, Homo Sapiens
DLWKEDLAV

SEQ ID NO: 1317501 - protein, 9 aa, Homo Sapiens
LHHFEKLME

SEQ ID NO: 1317502 - protein, 9 aa, Homo Sapiens
REECRAEEE

SEQ ID NO: 1317503 - protein, 9 aa, Homo Sapiens
KEGMEASVE

SEQ ID NO: 1317504 - protein, 9 aa, Homo Sapiens
RSARTGRCV

SEQ ID NO: 1317505 - protein, 9 aa, Homo Sapiens
FLLALTTHF

SEQ ID NO: 1317506 - protein, 9 aa, Homo Sapiens
APKKKPSVM

SEQ ID NO: 1317507 - protein, 9 aa, Homo Sapiens
TWNSHASWV

SEQ ID NO: 1317508 - protein, 9 aa, Homo Sapiens
LKKHQVLSV

SEQ ID NO: 1317509 - protein, 9 aa, Homo Sapiens
DPKAMLSYL

SEQ ID NO: 1317510 - protein, 9 aa, Homo Sapiens
SHMCMPLSK

SEQ ID NO: 1317511 - protein, 9 aa, Homo Sapiens
SNRKDLIHH

SEQ ID NO: 1317512 - protein, 9 aa, Homo Sapiens
CPHAHLRVP

SEQ ID NO: 1317513 - protein, 9 aa, Homo Sapiens
ELHSQLAES

SEQ ID NO: 1317514 - protein, 9 aa, Homo Sapiens
KTKLFPSIE

SEQ ID NO: 1317515 - protein, 9 aa, Homo Sapiens
DSNEQISVV

SEQ ID NO: 1317516 - protein, 9 aa, Homo Sapiens
LGPVLPPPP

SEQ ID NO: 1317517 - protein, 9 aa, Homo Sapiens
HIVESDVGD

SEQ ID NO: 1317518 - protein, 9 aa, Homo Sapiens
LFDVDGIFG

SEQ ID NO: 1317519 - protein, 9 aa, Homo Sapiens
LDVTPQAIS

SEQ ID NO: 1317520 - protein, 9 aa, Homo Sapiens
FEGNNCELD

SEQ ID NO: 1317521 - protein, 9 aa, Homo Sapiens
QHSPAFTSL

SEQ ID NO: 1317522 - protein, 9 aa, Homo Sapiens
VHTRHYLNE

SEQ ID NO: 1317523 - protein, 9 aa, Homo Sapiens
DTLDDSVSS

SEQ ID NO: 1317524 - protein, 9 aa, Homo Sapiens
CDMSPILAL

SEQ ID NO: 1317525 - protein, 9 aa, Homo Sapiens
DHNWKITHV

SEQ ID NO: 1317526 - protein, 9 aa, Homo Sapiens
STTRGNRPV

SEQ ID NO: 1317527 - protein, 9 aa, Homo Sapiens
ITLKLVGPE

SEQ ID NO: 1317528 - protein, 9 aa, Homo Sapiens
TYIPVLCIL

SEQ ID NO: 1317529 - protein, 9 aa, Homo Sapiens
SLIQVLKKR

SEQ ID NO: 1317530 - protein, 9 aa, Homo Sapiens
WYGHRLGGG

SEQ ID NO: 1317531 - protein, 9 aa, Homo Sapiens
CYDVCYAPS

SEQ ID NO: 1317532 - protein, 9 aa, Homo Sapiens
IVSKRKFQY

SEQ ID NO: 1317533 - protein, 9 aa, Homo Sapiens
CKAWASFDP

SEQ ID NO: 1317534 - protein, 9 aa, Homo Sapiens
CTYHTPAAS

SEQ ID NO: 1317535 - protein, 9 aa, Homo Sapiens
MKLKSPEEE

SEQ ID NO: 1317536 - protein, 9 aa, Homo Sapiens
MSLIQVLKK

SEQ ID NO: 1317537 - protein, 9 aa, Homo Sapiens
LAFLQHMDM

SEQ ID NO: 1317538 - protein, 9 aa, Homo Sapiens
EMEACSNGV

SEQ ID NO: 1317539 - protein, 9 aa, Homo Sapiens
KFKMKQHIL

SEQ ID NO: 1317540 - protein, 9 aa, Homo Sapiens
GQEKNLLEE

SEQ ID NO: 1317541 - protein, 9 aa, Homo Sapiens
KRPKTIKQC

SEQ ID NO: 1317542 - protein, 9 aa, Homo Sapiens
TKNYDCDSG

SEQ ID NO: 1317543 - protein, 9 aa, Homo Sapiens
RIDSQLADS

SEQ ID NO: 1317544 - protein, 9 aa, Homo Sapiens
NTDLEVKIR

SEQ ID NO: 1317545 - protein, 9 aa, Homo Sapiens
HEELLHLWQ

SEQ ID NO: 1317546 - protein, 9 aa, Homo Sapiens
KGKQDITLL

SEQ ID NO: 1317547 - protein, 9 aa, Homo Sapiens
PLVIISDAL

SEQ ID NO: 1317548 - protein, 9 aa, Homo Sapiens
KSSRDSLRY

SEQ ID NO: 1317549 - protein, 9 aa, Homo Sapiens
EEVKKPPVC

SEQ ID NO: 1317550 - protein, 9 aa, Homo Sapiens
NTYFRPILD

SEQ ID NO: 1317551 - protein, 9 aa, Homo Sapiens
NDFWWLVDS

SEQ ID NO: 1317552 - protein, 9 aa, Homo Sapiens
GGNMNITCV

SEQ ID NO: 1317553 - protein, 9 aa, Homo Sapiens
EALIRYAVM

SEQ ID NO: 1317554 - protein, 9 aa, Homo Sapiens
EKVRPHIAL

SEQ ID NO: 1317555 - protein, 9 aa, Homo Sapiens
LLTMCHNLI

SEQ ID NO: 1317556 - protein, 9 aa, Homo Sapiens
TPCPYFSPY

SEQ ID NO: 1317557 - protein, 9 aa, Homo Sapiens
GLTMGTTEC

SEQ ID NO: 1317558 - protein, 9 aa, Homo Sapiens
YTIIQERKK

SEQ ID NO: 1317559 - protein, 9 aa, Homo Sapiens
PSPRPQGQH

SEQ ID NO: 1317560 - protein, 9 aa, Homo Sapiens
SLIPAEIMD

SEQ ID NO: 1317561 - protein, 9 aa, Homo Sapiens
NYETLISLD

SEQ ID NO: 1317562 - protein, 9 aa, Homo Sapiens
ISKEYEHFS

SEQ ID NO: 1317563 - protein, 9 aa, Homo Sapiens
TPACEVLPR

SEQ ID NO: 1317564 - protein, 9 aa, Homo Sapiens
IYFQFQNLH

SEQ ID NO: 1317565 - protein, 9 aa, Homo Sapiens
VVVLDHVYH

SEQ ID NO: 1317566 - protein, 9 aa, Homo Sapiens
NMYPGERTC

SEQ ID NO: 1317567 - protein, 9 aa, Homo Sapiens
DIWEEKHIT

SEQ ID NO: 1317568 - protein, 9 aa, Homo Sapiens
QQQQSEELL

SEQ ID NO: 1317569 - protein, 9 aa, Homo Sapiens
PQHLPPTHH

SEQ ID NO: 1317570 - protein, 9 aa, Homo Sapiens
STIVVKIQG

SEQ ID NO: 1317571 - protein, 9 aa, Homo Sapiens
LDTSWVGWG

SEQ ID NO: 1317572 - protein, 9 aa, Homo Sapiens
VYCGQRMPA

SEQ ID NO: 1317573 - protein, 9 aa, Homo Sapiens
HQGVQVPVL

SEQ ID NO: 1317574 - protein, 9 aa, Homo Sapiens
SAATVELSK

SEQ ID NO: 1317575 - protein, 9 aa, Homo Sapiens
LEVIAEKRQ

SEQ ID NO: 1317576 - protein, 9 aa, Homo Sapiens
LAALAETLK

SEQ ID NO: 1317577 - protein, 9 aa, Homo Sapiens
DKKRGASSS

SEQ ID NO: 1317578 - protein, 9 aa, Homo Sapiens
DSYIEELTK

SEQ ID NO: 1317579 - protein, 9 aa, Homo Sapiens
QHHHPFIEW

SEQ ID NO: 1317580 - protein, 9 aa, Homo Sapiens
ITGADMSSL

SEQ ID NO: 1317581 - protein, 9 aa, Homo Sapiens
KEEGQCKAW

SEQ ID NO: 1317582 - protein, 9 aa, Homo Sapiens
PVTYLRFLE

SEQ ID NO: 1317583 - protein, 9 aa, Homo Sapiens
TPKGISRYI

SEQ ID NO: 1317584 - protein, 9 aa, Homo Sapiens
TIWAHDNPV

SEQ ID NO: 1317585 - protein, 9 aa, Homo Sapiens
QELLCKVDS

SEQ ID NO: 1317586 - protein, 9 aa, Homo Sapiens
LNMALPVRQ

SEQ ID NO: 1317587 - protein, 9 aa, Homo Sapiens
TTIQCVRFK

SEQ ID NO: 1317588 - protein, 9 aa, Homo Sapiens
LSSVMKQAP

SEQ ID NO: 1317589 - protein, 9 aa, Homo Sapiens
NKRRFFPGS

SEQ ID NO: 1317590 - protein, 9 aa, Homo Sapiens
KLERHWHYF

SEQ ID NO: 1317591 - protein, 9 aa, Homo Sapiens
TEFFLLDVM

SEQ ID NO: 1317592 - protein, 9 aa, Homo Sapiens
HARALVHYD

SEQ ID NO: 1317593 - protein, 9 aa, Homo Sapiens
EWMSFDVTD

SEQ ID NO: 1317594 - protein, 9 aa, Homo Sapiens
DMPIVRASG

SEQ ID NO: 1317595 - protein, 9 aa, Homo Sapiens
FFFLHKEFL

SEQ ID NO: 1317596 - protein, 9 aa, Homo Sapiens
AELMIYISM

SEQ ID NO: 1317597 - protein, 9 aa, Homo Sapiens
PVPSFEGYR

SEQ ID NO: 1317598 - protein, 9 aa, Homo Sapiens
ITVGLLLLL

SEQ ID NO: 1317599 - protein, 9 aa, Homo Sapiens
DLDWPNLVD

SEQ ID NO: 1317600 - protein, 9 aa, Homo Sapiens
QASVTTGKV

SEQ ID NO: 1317601 - protein, 9 aa, Homo Sapiens
PLHRLIMMI

SEQ ID NO: 1317602 - protein, 9 aa, Homo Sapiens
RPSPATHPS

SEQ ID NO: 1317603 - protein, 9 aa, Homo Sapiens
LFFHLPIFS

SEQ ID NO: 1317604 - protein, 9 aa, Homo Sapiens
EKALEVESD

SEQ ID NO: 1317605 - protein, 9 aa, Homo Sapiens
CGPLEGNAN

SEQ ID NO: 1317606 - protein, 9 aa, Homo Sapiens
RQTRESNSD

SEQ ID NO: 1317607 - protein, 9 aa, Homo Sapiens
ESREPKSKS

SEQ ID NO: 1317608 - protein, 9 aa, Homo Sapiens
QEIADACHL

SEQ ID NO: 1317609 - protein, 9 aa, Homo Sapiens
TVLTTTVTM

SEQ ID NO: 1317610 - protein, 9 aa, Homo Sapiens
PSPGIAGPV

SEQ ID NO: 1317611 - protein, 9 aa, Homo Sapiens
VIHGTNSEP

SEQ ID NO: 1317612 - protein, 9 aa, Homo Sapiens
EVSKYIMQY

SEQ ID NO: 1317613 - protein, 9 aa, Homo Sapiens
EQVETQPRV

SEQ ID NO: 1317614 - protein, 9 aa, Homo Sapiens
RRVLSNYEM

SEQ ID NO: 1317615 - protein, 9 aa, Homo Sapiens
KAGKGQTGV

SEQ ID NO: 1317616 - protein, 9 aa, Homo Sapiens
YKYIEYHGA

SEQ ID NO: 1317617 - protein, 9 aa, Homo Sapiens
LHLLTCVER

SEQ ID NO: 1317618 - protein, 9 aa, Homo Sapiens
DGHFLLPET

SEQ ID NO: 1317619 - protein, 9 aa, Homo Sapiens
GTLWRLWSL

SEQ ID NO: 1317620 - protein, 9 aa, Homo Sapiens
EGFASSIQD

SEQ ID NO: 1317621 - protein, 9 aa, Homo Sapiens
RVCGRPLMR

SEQ ID NO: 1317622 - protein, 9 aa, Homo Sapiens
VVTRFLMSC

SEQ ID NO: 1317623 - protein, 9 aa, Homo Sapiens
PDKQDVLNS

SEQ ID NO: 1317624 - protein, 9 aa, Homo Sapiens
KNPWVCLTC

SEQ ID NO: 1317625 - protein, 9 aa, Homo Sapiens
GHWHQVDVV

SEQ ID NO: 1317626 - protein, 9 aa, Homo Sapiens
DIVTDVSPL

SEQ ID NO: 1317627 - protein, 9 aa, Homo Sapiens
MTTYGAFLY

SEQ ID NO: 1317628 - protein, 9 aa, Homo Sapiens
KCVVAFYSG

SEQ ID NO: 1317629 - protein, 9 aa, Homo Sapiens
ALKNNPPYI

SEQ ID NO: 1317630 - protein, 9 aa, Homo Sapiens
PCMCHDLDH

SEQ ID NO: 1317631 - protein, 9 aa, Homo Sapiens
PAEPLGQVK

SEQ ID NO: 1317632 - protein, 9 aa, Homo Sapiens
SKLVIQNVN

SEQ ID NO: 1317633 - protein, 9 aa, Homo Sapiens
LRGTRLKYV

SEQ ID NO: 1317634 - protein, 9 aa, Homo Sapiens
MYNSELLDV

SEQ ID NO: 1317635 - protein, 9 aa, Homo Sapiens
TSPKGKQLT

SEQ ID NO: 1317636 - protein, 9 aa, Homo Sapiens
WNSPLSFSL

SEQ ID NO: 1317637 - protein, 9 aa, Homo Sapiens
LGNCGPYCT

SEQ ID NO: 1317638 - protein, 9 aa, Homo Sapiens
LMYDILNWK

SEQ ID NO: 1317639 - protein, 9 aa, Homo Sapiens
VLSLLIDTL

SEQ ID NO: 1317640 - protein, 9 aa, Homo Sapiens
LILSTQDGS

SEQ ID NO: 1317641 - protein, 9 aa, Homo Sapiens
KLGVSELRV

SEQ ID NO: 1317642 - protein, 9 aa, Homo Sapiens
PFIIGVNVA

SEQ ID NO: 1317643 - protein, 9 aa, Homo Sapiens
RAIWIDGTD

SEQ ID NO: 1317644 - protein, 9 aa, Homo Sapiens
HHLRGCGYL

SEQ ID NO: 1317645 - protein, 9 aa, Homo Sapiens
SDLIAAVIL

SEQ ID NO: 1317646 - protein, 9 aa, Homo Sapiens
RAPWNLTFP

SEQ ID NO: 1317647 - protein, 9 aa, Homo Sapiens
TGSIRQLLH

SEQ ID NO: 1317648 - protein, 9 aa, Homo Sapiens
HMAVLHGAV

SEQ ID NO: 1317649 - protein, 9 aa, Homo Sapiens
PASQHKGGH

SEQ ID NO: 1317650 - protein, 9 aa, Homo Sapiens
DNPNSLVIY

SEQ ID NO: 1317651 - protein, 9 aa, Homo Sapiens
SMPNVLTTQ

SEQ ID NO: 1317652 - protein, 9 aa, Homo Sapiens
EWCWHPYTN

SEQ ID NO: 1317653 - protein, 9 aa, Homo Sapiens
VNLLLGKCT

SEQ ID NO: 1317654 - protein, 9 aa, Homo Sapiens
NQETTYVSS

SEQ ID NO: 1317655 - protein, 9 aa, Homo Sapiens
SFKYNRPVE

SEQ ID NO: 1317656 - protein, 9 aa, Homo Sapiens
APEPVVGIP

SEQ ID NO: 1317657 - protein, 9 aa, Homo Sapiens
NWELIKILA

SEQ ID NO: 1317658 - protein, 9 aa, Homo Sapiens
ALTWTFPRM

SEQ ID NO: 1317659 - protein, 9 aa, Homo Sapiens
EYIIRLVGE

SEQ ID NO: 1317660 - protein, 9 aa, Homo Sapiens
TPEAIKSVL

SEQ ID NO: 1317661 - protein, 9 aa, Homo Sapiens
NTCILWDIN

SEQ ID NO: 1317662 - protein, 9 aa, Homo Sapiens
CTSPHKMAF

SEQ ID NO: 1317663 - protein, 9 aa, Homo Sapiens
AKTMWNLEN

SEQ ID NO: 1317664 - protein, 9 aa, Homo Sapiens
SLQIFPRAC

SEQ ID NO: 1317665 - protein, 9 aa, Homo Sapiens
GRHSFQYFL

SEQ ID NO: 1317666 - protein, 9 aa, Homo Sapiens
WLQKWYITL

SEQ ID NO: 1317667 - protein, 9 aa, Homo Sapiens
RLEIYEDIL

SEQ ID NO: 1317668 - protein, 9 aa, Homo Sapiens
ITSPLNVID

SEQ ID NO: 1317669 - protein, 9 aa, Homo Sapiens
DIKTSNLLL

SEQ ID NO: 1317670 - protein, 9 aa, Homo Sapiens
NVGRCSTGA

SEQ ID NO: 1317671 - protein, 9 aa, Homo Sapiens
CPTPCQMTY

SEQ ID NO: 1317672 - protein, 9 aa, Homo Sapiens
IQWPTVHGL

SEQ ID NO: 1317673 - protein, 9 aa, Homo Sapiens
LDQKMCPFG

SEQ ID NO: 1317674 - protein, 9 aa, Homo Sapiens
REQRLLLIF

SEQ ID NO: 1317675 - protein, 9 aa, Homo Sapiens
TRFYVYNKK

SEQ ID NO: 1317676 - protein, 9 aa, Homo Sapiens
RMHLEASKL

SEQ ID NO: 1317677 - protein, 9 aa, Homo Sapiens
RMRHYIKNP

SEQ ID NO: 1317678 - protein, 9 aa, Homo Sapiens
TPWRPLSIG

SEQ ID NO: 1317679 - protein, 9 aa, Homo Sapiens
NGDTKNYDC

SEQ ID NO: 1317680 - protein, 9 aa, Homo Sapiens
HEWKIAASE

SEQ ID NO: 1317681 - protein, 9 aa, Homo Sapiens
AYNIHTDSW

SEQ ID NO: 1317682 - protein, 9 aa, Homo Sapiens
EQRELRSRL

SEQ ID NO: 1317683 - protein, 9 aa, Homo Sapiens
RTIQVWQRG

SEQ ID NO: 1317684 - protein, 9 aa, Homo Sapiens
GSSNTFPIW

SEQ ID NO: 1317685 - protein, 9 aa, Homo Sapiens
SLLCSPLRL

SEQ ID NO: 1317686 - protein, 9 aa, Homo Sapiens
FFEEQERHS

SEQ ID NO: 1317687 - protein, 9 aa, Homo Sapiens
EIRRWVRSH

SEQ ID NO: 1317688 - protein, 9 aa, Homo Sapiens
PLTLAIQRF

SEQ ID NO: 1317689 - protein, 9 aa, Homo Sapiens
GQSLLENGI

SEQ ID NO: 1317690 - protein, 9 aa, Homo Sapiens
AHYVWDYTD

SEQ ID NO: 1317691 - protein, 9 aa, Homo Sapiens
SGPHLFISQ

SEQ ID NO: 1317692 - protein, 9 aa, Homo Sapiens
TNPQPGSCS

SEQ ID NO: 1317693 - protein, 9 aa, Homo Sapiens
ELKHRSIKK

SEQ ID NO: 1317694 - protein, 9 aa, Homo Sapiens
DENLTGCLT

SEQ ID NO: 1317695 - protein, 9 aa, Homo Sapiens
GQEIMHFSF

SEQ ID NO: 1317696 - protein, 9 aa, Homo Sapiens
VSCTSFWPM

SEQ ID NO: 1317697 - protein, 9 aa, Homo Sapiens
ELVVHFFAC

SEQ ID NO: 1317698 - protein, 9 aa, Homo Sapiens
VLCTVITEG

SEQ ID NO: 1317699 - protein, 9 aa, Homo Sapiens
AILRYIAHK

SEQ ID NO: 1317700 - protein, 9 aa, Homo Sapiens
EEAALVAQA

SEQ ID NO: 1317701 - protein, 9 aa, Homo Sapiens
AVFYVAEIS

SEQ ID NO: 1317702 - protein, 9 aa, Homo Sapiens
GVNADFFKH

SEQ ID NO: 1317703 - protein, 9 aa, Homo Sapiens
PTQALMSNS

SEQ ID NO: 1317704 - protein, 9 aa, Homo Sapiens
GDVGLGVQV

SEQ ID NO: 1317705 - protein, 9 aa, Homo Sapiens
QPNRAHNNT

SEQ ID NO: 1317706 - protein, 9 aa, Homo Sapiens
HLWKHYSDY

SEQ ID NO: 1317707 - protein, 9 aa, Homo Sapiens
YLGKSLIKF

SEQ ID NO: 1317708 - protein, 9 aa, Homo Sapiens
LHVFTPTSS

SEQ ID NO: 1317709 - protein, 9 aa, Homo Sapiens
PQGDVEVMY

SEQ ID NO: 1317710 - protein, 9 aa, Homo Sapiens
HFEESFTDE

SEQ ID NO: 1317711 - protein, 9 aa, Homo Sapiens
KNIHSSSRI

SEQ ID NO: 1317712 - protein, 9 aa, Homo Sapiens
SAPTPTSSC

SEQ ID NO: 1317713 - protein, 9 aa, Homo Sapiens
HNISNQLSI

SEQ ID NO: 1317714 - protein, 9 aa, Homo Sapiens
TMPEVETIR

SEQ ID NO: 1317715 - protein, 9 aa, Homo Sapiens
NHQGARLST

SEQ ID NO: 1317716 - protein, 9 aa, Homo Sapiens
TFTTGMTAV

SEQ ID NO: 1317717 - protein, 9 aa, Homo Sapiens
CPEKICHKS

SEQ ID NO: 1317718 - protein, 9 aa, Homo Sapiens
TQEWERGWE

SEQ ID NO: 1317719 - protein, 9 aa, Homo Sapiens
QKNIHSSSR

SEQ ID NO: 1317720 - protein, 9 aa, Homo Sapiens
LGISENMVV

SEQ ID NO: 1317721 - protein, 9 aa, Homo Sapiens
GHVAVWGLS

SEQ ID NO: 1317722 - protein, 9 aa, Homo Sapiens
DSGEVQQVW

SEQ ID NO: 1317723 - protein, 9 aa, Homo Sapiens
GEGNIIEIF

SEQ ID NO: 1317724 - protein, 9 aa, Homo Sapiens
ANYEMSGET

SEQ ID NO: 1317725 - protein, 9 aa, Homo Sapiens
DVIFMKGNC

SEQ ID NO: 1317726 - protein, 9 aa, Homo Sapiens
TQDGLGPCT

SEQ ID NO: 1317727 - protein, 9 aa, Homo Sapiens
GGCITIPES

SEQ ID NO: 1317728 - protein, 9 aa, Homo Sapiens
VGFVEAARL

SEQ ID NO: 1317729 - protein, 9 aa, Homo Sapiens
SLTHILTLQ

SEQ ID NO: 1317730 - protein, 9 aa, Homo Sapiens
LEGVNMRHL

SEQ ID NO: 1317731 - protein, 9 aa, Homo Sapiens
NQLMTTNIW

SEQ ID NO: 1317732 - protein, 9 aa, Homo Sapiens
FPACLKVSA

SEQ ID NO: 1317733 - protein, 9 aa, Homo Sapiens
EGCMPFYAE

SEQ ID NO: 1317734 - protein, 9 aa, Homo Sapiens
HVIELKSGS

SEQ ID NO: 1317735 - protein, 9 aa, Homo Sapiens
HVPENPILS

SEQ ID NO: 1317736 - protein, 9 aa, Homo Sapiens
GPKGKKGES

SEQ ID NO: 1317737 - protein, 9 aa, Homo Sapiens
NTIWAHDNP

SEQ ID NO: 1317738 - protein, 9 aa, Homo Sapiens
VKRVYEVIS

SEQ ID NO: 1317739 - protein, 9 aa, Homo Sapiens
GRGFSNKLH

SEQ ID NO: 1317740 - protein, 9 aa, Homo Sapiens
NKLHLLRHQ

SEQ ID NO: 1317741 - protein, 9 aa, Homo Sapiens
CSSYLMKPY

SEQ ID NO: 1317742 - protein, 9 aa, Homo Sapiens
NRQAINVAL

SEQ ID NO: 1317743 - protein, 9 aa, Homo Sapiens
CYADFTLLS

SEQ ID NO: 1317744 - protein, 9 aa, Homo Sapiens
DDTTRELKT

SEQ ID NO: 1317745 - protein, 9 aa, Homo Sapiens
SWNAICIGM

SEQ ID NO: 1317746 - protein, 9 aa, Homo Sapiens
EDSAPGVWW

SEQ ID NO: 1317747 - protein, 9 aa, Homo Sapiens
SGTVMAIGT

SEQ ID NO: 1317748 - protein, 9 aa, Homo Sapiens
GKTPPRQVS

SEQ ID NO: 1317749 - protein, 9 aa, Homo Sapiens
GEDIVDVIN

SEQ ID NO: 1317750 - protein, 9 aa, Homo Sapiens
CTISLDRYW

SEQ ID NO: 1317751 - protein, 9 aa, Homo Sapiens
RANGEILPT

SEQ ID NO: 1317752 - protein, 9 aa, Homo Sapiens
SLPCRQPAP

SEQ ID NO: 1317753 - protein, 9 aa, Homo Sapiens
FAGKAPSGT

SEQ ID NO: 1317754 - protein, 9 aa, Homo Sapiens
VDVLHTYMR

SEQ ID NO: 1317755 - protein, 9 aa, Homo Sapiens
RLLKMVILN

SEQ ID NO: 1317756 - protein, 9 aa, Homo Sapiens
DLAPPCAGF

SEQ ID NO: 1317757 - protein, 9 aa, Homo Sapiens
HSYMRLTEK

SEQ ID NO: 1317758 - protein, 9 aa, Homo Sapiens
VLMMISKQI

SEQ ID NO: 1317759 - protein, 9 aa, Homo Sapiens
KPSISAATV

SEQ ID NO: 1317760 - protein, 9 aa, Homo Sapiens
PKITQLQDG

SEQ ID NO: 1317761 - protein, 9 aa, Homo Sapiens
WPIMEAVAF

SEQ ID NO: 1317762 - protein, 9 aa, Homo Sapiens
AQLTAECTI

SEQ ID NO: 1317763 - protein, 9 aa, Homo Sapiens
LATWLGIFY

SEQ ID NO: 1317764 - protein, 9 aa, Homo Sapiens
HPSGTVMAI

SEQ ID NO: 1317765 - protein, 9 aa, Homo Sapiens
YVGCVISAL

SEQ ID NO: 1317766 - protein, 9 aa, Homo Sapiens
AGLMSMPNV

SEQ ID NO: 1317767 - protein, 9 aa, Homo Sapiens
CGWRFSCSD

SEQ ID NO: 1317768 - protein, 9 aa, Homo Sapiens
FRSWDVDDL

SEQ ID NO: 1317769 - protein, 9 aa, Homo Sapiens
DVAFVQPVC

SEQ ID NO: 1317770 - protein, 9 aa, Homo Sapiens
NKINGLRKD

SEQ ID NO: 1317771 - protein, 9 aa, Homo Sapiens
GSVSVTQTL

SEQ ID NO: 1317772 - protein, 9 aa, Homo Sapiens
TTAMVILCH

SEQ ID NO: 1317773 - protein, 9 aa, Homo Sapiens
VPAEIQKED

SEQ ID NO: 1317774 - protein, 9 aa, Homo Sapiens
LPFFLAHVL

SEQ ID NO: 1317775 - protein, 9 aa, Homo Sapiens
SGNDPSIHL

SEQ ID NO: 1317776 - protein, 9 aa, Homo Sapiens
NCLRSSTSS

SEQ ID NO: 1317777 - protein, 9 aa, Homo Sapiens
EFSRFFDVW

SEQ ID NO: 1317778 - protein, 9 aa, Homo Sapiens
IIGLPGQRG

SEQ ID NO: 1317779 - protein, 9 aa, Homo Sapiens
KDMLRKRHY

SEQ ID NO: 1317780 - protein, 9 aa, Homo Sapiens
FSRQGKLWL

SEQ ID NO: 1317781 - protein, 9 aa, Homo Sapiens
GLILNVTAL

SEQ ID NO: 1317782 - protein, 9 aa, Homo Sapiens
LSVVVCVLL

SEQ ID NO: 1317783 - protein, 9 aa, Homo Sapiens
QILQANNYN

SEQ ID NO: 1317784 - protein, 9 aa, Homo Sapiens
DDLTTENPE

SEQ ID NO: 1317785 - protein, 9 aa, Homo Sapiens
KTVVNCSSD

SEQ ID NO: 1317786 - protein, 9 aa, Homo Sapiens
FVDDDDGDD

SEQ ID NO: 1317787 - protein, 9 aa, Homo Sapiens
ERLVLSYVR

SEQ ID NO: 1317788 - protein, 9 aa, Homo Sapiens
QSVTDCLMA

SEQ ID NO: 1317789 - protein, 9 aa, Homo Sapiens
RYWDLHTSV

SEQ ID NO: 1317790 - protein, 9 aa, Homo Sapiens
STIHIHYRE

SEQ ID NO: 1317791 - protein, 9 aa, Homo Sapiens
CALILSPTR

SEQ ID NO: 1317792 - protein, 9 aa, Homo Sapiens
WAPKSHAFV

SEQ ID NO: 1317793 - protein, 9 aa, Homo Sapiens
RDNEVISVM

SEQ ID NO: 1317794 - protein, 9 aa, Homo Sapiens
PSSGFNQEA

SEQ ID NO: 1317795 - protein, 9 aa, Homo Sapiens
EDYHPLITL

SEQ ID NO: 1317796 - protein, 9 aa, Homo Sapiens
QPSPHMTSP

SEQ ID NO: 1317797 - protein, 9 aa, Homo Sapiens
FLLYGHDVS

SEQ ID NO: 1317798 - protein, 9 aa, Homo Sapiens
TSLPSSGFN

SEQ ID NO: 1317799 - protein, 9 aa, Homo Sapiens
INEVSKLSN

SEQ ID NO: 1317800 - protein, 9 aa, Homo Sapiens
IAMELTGTC

SEQ ID NO: 1317801 - protein, 9 aa, Homo Sapiens
FYNCRNIDS

SEQ ID NO: 1317802 - protein, 9 aa, Homo Sapiens
EDLKHQVQQ

SEQ ID NO: 1317803 - protein, 9 aa, Homo Sapiens
EKYHDSIEK

SEQ ID NO: 1317804 - protein, 9 aa, Homo Sapiens
WLLCPIRTY

SEQ ID NO: 1317805 - protein, 9 aa, Homo Sapiens
RFKIERRAV

SEQ ID NO: 1317806 - protein, 9 aa, Homo Sapiens
TRMHLEASK

SEQ ID NO: 1317807 - protein, 9 aa, Homo Sapiens
LPVRQDMEK

SEQ ID NO: 1317808 - protein, 9 aa, Homo Sapiens
MPLERKRHE

SEQ ID NO: 1317809 - protein, 9 aa, Homo Sapiens
HPMTNITWM

SEQ ID NO: 1317810 - protein, 9 aa, Homo Sapiens
EFIALYQSQ

SEQ ID NO: 1317811 - protein, 9 aa, Homo Sapiens
SRLCTMKKG

SEQ ID NO: 1317812 - protein, 9 aa, Homo Sapiens
FPSCTYILH

SEQ ID NO: 1317813 - protein, 9 aa, Homo Sapiens
SDAKSLHIV

SEQ ID NO: 1317814 - protein, 9 aa, Homo Sapiens
PMANYSLIP

SEQ ID NO: 1317815 - protein, 9 aa, Homo Sapiens
PCNCWVSIN

SEQ ID NO: 1317816 - protein, 9 aa, Homo Sapiens
EPREHQPLS

SEQ ID NO: 1317817 - protein, 9 aa, Homo Sapiens
QQKICQNRA

SEQ ID NO: 1317818 - protein, 9 aa, Homo Sapiens
CVIQRRAKM

SEQ ID NO: 1317819 - protein, 9 aa, Homo Sapiens
MIFSPVVVI

SEQ ID NO: 1317820 - protein, 9 aa, Homo Sapiens
KTMPRVRKL

SEQ ID NO: 1317821 - protein, 9 aa, Homo Sapiens
VGLLLLLLP

SEQ ID NO: 1317822 - protein, 9 aa, Homo Sapiens
ITIQEALRH

SEQ ID NO: 1317823 - protein, 9 aa, Homo Sapiens
IRDQPNERH

SEQ ID NO: 1317824 - protein, 9 aa, Homo Sapiens
LNEKCILQA

SEQ ID NO: 1317825 - protein, 9 aa, Homo Sapiens
THRSGGREW

SEQ ID NO: 1317826 - protein, 9 aa, Homo Sapiens
SGITARDVC

SEQ ID NO: 1317827 - protein, 9 aa, Homo Sapiens
ETRQESKKF

SEQ ID NO: 1317828 - protein, 9 aa, Homo Sapiens
WGLPCGSVF

SEQ ID NO: 1317829 - protein, 9 aa, Homo Sapiens
TQVRGIKTF

SEQ ID NO: 1317830 - protein, 9 aa, Homo Sapiens
KVLWLLITA

SEQ ID NO: 1317831 - protein, 9 aa, Homo Sapiens
NDSHGSVLR

SEQ ID NO: 1317832 - protein, 9 aa, Homo Sapiens
EQVRQFLIL

SEQ ID NO: 1317833 - protein, 9 aa, Homo Sapiens
MHWLKGERP

SEQ ID NO: 1317834 - protein, 9 aa, Homo Sapiens
LQDYMSPTL

SEQ ID NO: 1317835 - protein, 9 aa, Homo Sapiens
PFKVKADQI

SEQ ID NO: 1317836 - protein, 9 aa, Homo Sapiens
HIKIPSTPR

SEQ ID NO: 1317837 - protein, 9 aa, Homo Sapiens
RNMELEHFD

SEQ ID NO: 1317838 - protein, 9 aa, Homo Sapiens
NDMEHIWQY

SEQ ID NO: 1317839 - protein, 9 aa, Homo Sapiens
FVPHWTPPS

SEQ ID NO: 1317840 - protein, 9 aa, Homo Sapiens
HAPARAPAC

SEQ ID NO: 1317841 - protein, 9 aa, Homo Sapiens
PQYRARGSP

SEQ ID NO: 1317842 - protein, 9 aa, Homo Sapiens
PHIALPQTE

SEQ ID NO: 1317843 - protein, 9 aa, Homo Sapiens
IKVDSQEHN

SEQ ID NO: 1317844 - protein, 9 aa, Homo Sapiens
KAYNNQPTM

SEQ ID NO: 1317845 - protein, 9 aa, Homo Sapiens
SRLLSCKHS

SEQ ID NO: 1317846 - protein, 9 aa, Homo Sapiens
KMWYQTSED

SEQ ID NO: 1317847 - protein, 9 aa, Homo Sapiens
PTHREPVSD

SEQ ID NO: 1317848 - protein, 9 aa, Homo Sapiens
MLKRNIGVI

SEQ ID NO: 1317849 - protein, 9 aa, Homo Sapiens
SKDGLYTSL

SEQ ID NO: 1317850 - protein, 9 aa, Homo Sapiens
SRKDISVKI

SEQ ID NO: 1317851 - protein, 9 aa, Homo Sapiens
SFGICHQDI

SEQ ID NO: 1317852 - protein, 9 aa, Homo Sapiens
IRFSSRESV

SEQ ID NO: 1317853 - protein, 9 aa, Homo Sapiens
LQSLHLMIP

SEQ ID NO: 1317854 - protein, 9 aa, Homo Sapiens
LSCVASGPH

SEQ ID NO: 1317855 - protein, 9 aa, Homo Sapiens
REAHEAARS

SEQ ID NO: 1317856 - protein, 9 aa, Homo Sapiens
PTMESVCGY

SEQ ID NO: 1317857 - protein, 9 aa, Homo Sapiens
SHLMQYPAR

SEQ ID NO: 1317858 - protein, 9 aa, Homo Sapiens
ERVLLATGQ

SEQ ID NO: 1317859 - protein, 9 aa, Homo Sapiens
EVMYDVVSI

SEQ ID NO: 1317860 - protein, 9 aa, Homo Sapiens
VITEKPPGG

SEQ ID NO: 1317861 - protein, 9 aa, Homo Sapiens
LQHNLWKFC

SEQ ID NO: 1317862 - protein, 9 aa, Homo Sapiens
FFLAHVLNT

SEQ ID NO: 1317863 - protein, 9 aa, Homo Sapiens
HYITVGLLL

SEQ ID NO: 1317864 - protein, 9 aa, Homo Sapiens
VTDDDNEMN

SEQ ID NO: 1317865 - protein, 9 aa, Homo Sapiens
PENLTNGVS

SEQ ID NO: 1317866 - protein, 9 aa, Homo Sapiens
GDGKSNNLV

SEQ ID NO: 1317867 - protein, 9 aa, Homo Sapiens
EKGPAGECG

SEQ ID NO: 1317868 - protein, 9 aa, Homo Sapiens
ERTRDARVV

SEQ ID NO: 1317869 - protein, 9 aa, Homo Sapiens
SKPESQGIK

SEQ ID NO: 1317870 - protein, 9 aa, Homo Sapiens
GERAWTHRL

SEQ ID NO: 1317871 - protein, 9 aa, Homo Sapiens
VPAVLPRLR

SEQ ID NO: 1317872 - protein, 9 aa, Homo Sapiens
IPACVIGAP

SEQ ID NO: 1317873 - protein, 9 aa, Homo Sapiens
MQELFRGHN

SEQ ID NO: 1317874 - protein, 9 aa, Homo Sapiens
KRDFFLANV

SEQ ID NO: 1317875 - protein, 9 aa, Homo Sapiens
VTPVIHSNI

SEQ ID NO: 1317876 - protein, 9 aa, Homo Sapiens
EQTRITLQE

SEQ ID NO: 1317877 - protein, 9 aa, Homo Sapiens
PQSSSLHPP

SEQ ID NO: 1317878 - protein, 9 aa, Homo Sapiens
DRNSTWKDD

SEQ ID NO: 1317879 - protein, 9 aa, Homo Sapiens
LEERCGIIE

SEQ ID NO: 1317880 - protein, 9 aa, Homo Sapiens
LLFRHYLRA

SEQ ID NO: 1317881 - protein, 9 aa, Homo Sapiens
FGQAVQYQF

SEQ ID NO: 1317882 - protein, 9 aa, Homo Sapiens
VLFIVLALV

SEQ ID NO: 1317883 - protein, 9 aa, Homo Sapiens
PHTNHPNTW

SEQ ID NO: 1317884 - protein, 9 aa, Homo Sapiens
RCLHCCDPG

SEQ ID NO: 1317885 - protein, 9 aa, Homo Sapiens
NCRNIDSEF

SEQ ID NO: 1317886 - protein, 9 aa, Homo Sapiens
APGRASSCA

SEQ ID NO: 1317887 - protein, 9 aa, Homo Sapiens
AIEERYEAI

SEQ ID NO: 1317888 - protein, 9 aa, Homo Sapiens
DLSIRTPED

SEQ ID NO: 1317889 - protein, 9 aa, Homo Sapiens
WEFFPTGDC

SEQ ID NO: 1317890 - protein, 9 aa, Homo Sapiens
SLLRSKQRD

SEQ ID NO: 1317891 - protein, 9 aa, Homo Sapiens
TSDEAPPGA

SEQ ID NO: 1317892 - protein, 9 aa, Homo Sapiens
LRVKMMTTC

SEQ ID NO: 1317893 - protein, 9 aa, Homo Sapiens
LRRFDFTGN

SEQ ID NO: 1317894 - protein, 9 aa, Homo Sapiens
RLPHMFKQE

SEQ ID NO: 1317895 - protein, 9 aa, Homo Sapiens
MGQLLLWAK

SEQ ID NO: 1317896 - protein, 9 aa, Homo Sapiens
AATPVVPIP

SEQ ID NO: 1317897 - protein, 9 aa, Homo Sapiens
NFSLELTHT

SEQ ID NO: 1317898 - protein, 9 aa, Homo Sapiens
RHGESQYVP

SEQ ID NO: 1317899 - protein, 9 aa, Homo Sapiens
ILWAHQLFH

SEQ ID NO: 1317900 - protein, 9 aa, Homo Sapiens
QHSQTSSIP

SEQ ID NO: 1317901 - protein, 9 aa, Homo Sapiens
LWKFCRDIQ

SEQ ID NO: 1317902 - protein, 9 aa, Homo Sapiens
APKKQVLYL

SEQ ID NO: 1317903 - protein, 9 aa, Homo Sapiens
QDPSQIDWV

SEQ ID NO: 1317904 - protein, 9 aa, Homo Sapiens
RHKPTSQWS

SEQ ID NO: 1317905 - protein, 9 aa, Homo Sapiens
GYTKSGVQL

SEQ ID NO: 1317906 - protein, 9 aa, Homo Sapiens
VILVLQSVP

SEQ ID NO: 1317907 - protein, 9 aa, Homo Sapiens
ALIYYCMCC

SEQ ID NO: 1317908 - protein, 9 aa, Homo Sapiens
QRPGPPHPH

SEQ ID NO: 1317909 - protein, 9 aa, Homo Sapiens
NTFSRLQNL

SEQ ID NO: 1317910 - protein, 9 aa, Homo Sapiens
EFLQNMEMK

SEQ ID NO: 1317911 - protein, 9 aa, Homo Sapiens
AMKVRKQCT

SEQ ID NO: 1317912 - protein, 9 aa, Homo Sapiens
HDNSCPQFI

SEQ ID NO: 1317913 - protein, 9 aa, Homo Sapiens
TAGSFQIPR

SEQ ID NO: 1317914 - protein, 9 aa, Homo Sapiens
AVPPGSPSS

SEQ ID NO: 1317915 - protein, 9 aa, Homo Sapiens
ICGFQLTEH

SEQ ID NO: 1317916 - protein, 9 aa, Homo Sapiens
NSIRHSLSL

SEQ ID NO: 1317917 - protein, 9 aa, Homo Sapiens
LGASVVCWT

SEQ ID NO: 1317918 - protein, 9 aa, Homo Sapiens
AWDFTGVVA

SEQ ID NO: 1317919 - protein, 9 aa, Homo Sapiens
QACLDQDAA

SEQ ID NO: 1317920 - protein, 9 aa, Homo Sapiens
IMVVAGSLS

SEQ ID NO: 1317921 - protein, 9 aa, Homo Sapiens
SIRDPPEDV

SEQ ID NO: 1317922 - protein, 9 aa, Homo Sapiens
VVAEYAHVQ

SEQ ID NO: 1317923 - protein, 9 aa, Homo Sapiens
NYVSSLKWQ

SEQ ID NO: 1317924 - protein, 9 aa, Homo Sapiens
DTRSILYVL

SEQ ID NO: 1317925 - protein, 9 aa, Homo Sapiens
KRLHRKRPP

SEQ ID NO: 1317926 - protein, 9 aa, Homo Sapiens
DQLSCSWTL

SEQ ID NO: 1317927 - protein, 9 aa, Homo Sapiens
SSHVTVVGL

SEQ ID NO: 1317928 - protein, 9 aa, Homo Sapiens
DGGKIKETY

SEQ ID NO: 1317929 - protein, 9 aa, Homo Sapiens
CNVAAASAA

SEQ ID NO: 1317930 - protein, 9 aa, Homo Sapiens
VKCAVEEIR

SEQ ID NO: 1317931 - protein, 9 aa, Homo Sapiens
DSEARASDL

SEQ ID NO: 1317932 - protein, 9 aa, Homo Sapiens
SSPIYQLER

SEQ ID NO: 1317933 - protein, 9 aa, Homo Sapiens
LPCSGARAN

SEQ ID NO: 1317934 - protein, 9 aa, Homo Sapiens
GTAIILIAF

SEQ ID NO: 1317935 - protein, 9 aa, Homo Sapiens
EVICSSLKA

SEQ ID NO: 1317936 - protein, 9 aa, Homo Sapiens
LPKITVRDN

SEQ ID NO: 1317937 - protein, 9 aa, Homo Sapiens
LIGDHQQLC

SEQ ID NO: 1317938 - protein, 9 aa, Homo Sapiens
THEFEDRDR

SEQ ID NO: 1317939 - protein, 9 aa, Homo Sapiens
EDLVCGEFL

SEQ ID NO: 1317940 - protein, 9 aa, Homo Sapiens
IQEPGSEVN

SEQ ID NO: 1317941 - protein, 9 aa, Homo Sapiens
HYARIQLCD

SEQ ID NO: 1317942 - protein, 9 aa, Homo Sapiens
GLPVPSGTQ

SEQ ID NO: 1317943 - protein, 9 aa, Homo Sapiens
RREIKLHLL

SEQ ID NO: 1317944 - protein, 9 aa, Homo Sapiens
LGVIIIILM

SEQ ID NO: 1317945 - protein, 9 aa, Homo Sapiens
LGHVRCHMN

SEQ ID NO: 1317946 - protein, 9 aa, Homo Sapiens
PRSGRGSLR

SEQ ID NO: 1317947 - protein, 9 aa, Homo Sapiens
STGESPWES

SEQ ID NO: 1317948 - protein, 9 aa, Homo Sapiens
SQHLLPPFH

SEQ ID NO: 1317949 - protein, 9 aa, Homo Sapiens
WSTGASTPA

SEQ ID NO: 1317950 - protein, 9 aa, Homo Sapiens
STRGCTARG

SEQ ID NO: 1317951 - protein, 9 aa, Homo Sapiens
VMSLIQVLK

SEQ ID NO: 1317952 - protein, 9 aa, Homo Sapiens
ELVIVRILH

SEQ ID NO: 1317953 - protein, 9 aa, Homo Sapiens
PPCYDVCYA

SEQ ID NO: 1317954 - protein, 9 aa, Homo Sapiens
MHTSFKHHQ

SEQ ID NO: 1317955 - protein, 9 aa, Homo Sapiens
SSSKINVLM

SEQ ID NO: 1317956 - protein, 9 aa, Homo Sapiens
SLVDTLLFV

SEQ ID NO: 1317957 - protein, 9 aa, Homo Sapiens
ETGKILSNN

SEQ ID NO: 1317958 - protein, 9 aa, Homo Sapiens
SDIWAIHVL

SEQ ID NO: 1317959 - protein, 9 aa, Homo Sapiens
HRGHYFKVW

SEQ ID NO: 1317960 - protein, 9 aa, Homo Sapiens
KMMKKFLHK

SEQ ID NO: 1317961 - protein, 9 aa, Homo Sapiens
LLFFLHQSV

SEQ ID NO: 1317962 - protein, 9 aa, Homo Sapiens
RQEDVGEYQ

SEQ ID NO: 1317963 - protein, 9 aa, Homo Sapiens
SGIKANISM

SEQ ID NO: 1317964 - protein, 9 aa, Homo Sapiens
TLLSLKVLH

SEQ ID NO: 1317965 - protein, 9 aa, Homo Sapiens
PEFHSCFPG

SEQ ID NO: 1317966 - protein, 9 aa, Homo Sapiens
LEHTFTFRN

SEQ ID NO: 1317967 - protein, 9 aa, Homo Sapiens
SVFGIQEPG

SEQ ID NO: 1317968 - protein, 9 aa, Homo Sapiens
HKEKYDKMC

SEQ ID NO: 1317969 - protein, 9 aa, Homo Sapiens
TFGNSTLAM

SEQ ID NO: 1317970 - protein, 9 aa, Homo Sapiens
RNSYMILHR

SEQ ID NO: 1317971 - protein, 9 aa, Homo Sapiens
EEMEVCDEA

SEQ ID NO: 1317972 - protein, 9 aa, Homo Sapiens
LKRSRCMPR

SEQ ID NO: 1317973 - protein, 9 aa, Homo Sapiens
GLKDVMLMG

SEQ ID NO: 1317974 - protein, 9 aa, Homo Sapiens
VFFVDYDNK

SEQ ID NO: 1317975 - protein, 9 aa, Homo Sapiens
QKPGDIDNQ

SEQ ID NO: 1317976 - protein, 9 aa, Homo Sapiens
WRYLCALYL

SEQ ID NO: 1317977 - protein, 9 aa, Homo Sapiens
FHSPEKLGA

SEQ ID NO: 1317978 - protein, 9 aa, Homo Sapiens
QSKEAWGMH

SEQ ID NO: 1317979 - protein, 9 aa, Homo Sapiens
ALEDDGFCL

SEQ ID NO: 1317980 - protein, 9 aa, Homo Sapiens
ELSVTERWK

SEQ ID NO: 1317981 - protein, 9 aa, Homo Sapiens
QLKEICIKD

SEQ ID NO: 1317982 - protein, 9 aa, Homo Sapiens
MGKKPYTCD

SEQ ID NO: 1317983 - protein, 9 aa, Homo Sapiens
VVFSEEALI

SEQ ID NO: 1317984 - protein, 9 aa, Homo Sapiens
LSTLFDVDG

SEQ ID NO: 1317985 - protein, 9 aa, Homo Sapiens
GWKKEAISD

SEQ ID NO: 1317986 - protein, 9 aa, Homo Sapiens
SQMILMFLL

SEQ ID NO: 1317987 - protein, 9 aa, Homo Sapiens
YGIKENMLA

SEQ ID NO: 1317988 - protein, 9 aa, Homo Sapiens
DHDASPSKE

SEQ ID NO: 1317989 - protein, 9 aa, Homo Sapiens
SVSVTQTLD

SEQ ID NO: 1317990 - protein, 9 aa, Homo Sapiens
AKKGIRLEG

SEQ ID NO: 1317991 - protein, 9 aa, Homo Sapiens
RDVSTTFLS

SEQ ID NO: 1317992 - protein, 9 aa, Homo Sapiens
GQLIESLQI

SEQ ID NO: 1317993 - protein, 9 aa, Homo Sapiens
CPLPCSPDT

SEQ ID NO: 1317994 - protein, 9 aa, Homo Sapiens
LNQCRGFLC

SEQ ID NO: 1317995 - protein, 9 aa, Homo Sapiens
TKTCTKEPG

SEQ ID NO: 1317996 - protein, 9 aa, Homo Sapiens
YPRLPEPTM

SEQ ID NO: 1317997 - protein, 9 aa, Homo Sapiens
VNMCEQVLL

SEQ ID NO: 1317998 - protein, 9 aa, Homo Sapiens
NIMVPEDYI

SEQ ID NO: 1317999 - protein, 9 aa, Homo Sapiens
FYNITGPGA

SEQ ID NO: 1318000 - protein, 9 aa, Homo Sapiens
NGTSSDLNS

SEQ ID NO: 1318001 - protein, 9 aa, Homo Sapiens
VTQITCGRW

SEQ ID NO: 1318002 - protein, 9 aa, Homo Sapiens
NVLMHALTD

SEQ ID NO: 1318003 - protein, 9 aa, Homo Sapiens
DQEQASWVC

SEQ ID NO: 1318004 - protein, 9 aa, Homo Sapiens
IICYGDRPG

SEQ ID NO: 1318005 - protein, 9 aa, Homo Sapiens
ENTKLYLDF

SEQ ID NO: 1318006 - protein, 9 aa, Homo Sapiens
KTIEIGNSL

SEQ ID NO: 1318007 - protein, 9 aa, Homo Sapiens
RPKCSLFFN

SEQ ID NO: 1318008 - protein, 9 aa, Homo Sapiens
IEEMWRLWQ

SEQ ID NO: 1318009 - protein, 9 aa, Homo Sapiens
NPKESPPEI

SEQ ID NO: 1318010 - protein, 9 aa, Homo Sapiens
LKKENHTCS

SEQ ID NO: 1318011 - protein, 9 aa, Homo Sapiens
HGPCIPDVL

SEQ ID NO: 1318012 - protein, 9 aa, Homo Sapiens
EWETQALEN

SEQ ID NO: 1318013 - protein, 9 aa, Homo Sapiens
NMTEIFRRV

SEQ ID NO: 1318014 - protein, 9 aa, Homo Sapiens
VADTGFGGH

SEQ ID NO: 1318015 - protein, 9 aa, Homo Sapiens
PTLHSALFS

SEQ ID NO: 1318016 - protein, 9 aa, Homo Sapiens
FIPCMCHDL

SEQ ID NO: 1318017 - protein, 9 aa, Homo Sapiens
RKECEKEDY

SEQ ID NO: 1318018 - protein, 9 aa, Homo Sapiens
LYLPMAQSA

SEQ ID NO: 1318019 - protein, 9 aa, Homo Sapiens
MSLEYEKTE

SEQ ID NO: 1318020 - protein, 9 aa, Homo Sapiens
EPPPSASAC

SEQ ID NO: 1318021 - protein, 9 aa, Homo Sapiens
LDDDQQMEW

SEQ ID NO: 1318022 - protein, 9 aa, Homo Sapiens
GAHVDLRNT

SEQ ID NO: 1318023 - protein, 9 aa, Homo Sapiens
DAGETACKL

SEQ ID NO: 1318024 - protein, 9 aa, Homo Sapiens
PVIYNRTRF

SEQ ID NO: 1318025 - protein, 9 aa, Homo Sapiens
CSKGNGFSK

SEQ ID NO: 1318026 - protein, 9 aa, Homo Sapiens
ERDYGPSID

SEQ ID NO: 1318027 - protein, 9 aa, Homo Sapiens
PRGSIVTRG

SEQ ID NO: 1318028 - protein, 9 aa, Homo Sapiens
IDLQRETVK

SEQ ID NO: 1318029 - protein, 9 aa, Homo Sapiens
DIIVSKRKF

SEQ ID NO: 1318030 - protein, 9 aa, Homo Sapiens
ALTFFTAAF

SEQ ID NO: 1318031 - protein, 9 aa, Homo Sapiens
TLAALRDVK

SEQ ID NO: 1318032 - protein, 9 aa, Homo Sapiens
PSGWPVFPI

SEQ ID NO: 1318033 - protein, 9 aa, Homo Sapiens
RLVALEPDL

SEQ ID NO: 1318034 - protein, 9 aa, Homo Sapiens
ADTECCLLT

SEQ ID NO: 1318035 - protein, 9 aa, Homo Sapiens
FYCVHWQTY

SEQ ID NO: 1318036 - protein, 9 aa, Homo Sapiens
VSQFLHTYS

SEQ ID NO: 1318037 - protein, 9 aa, Homo Sapiens
MVPQGWMGF

SEQ ID NO: 1318038 - protein, 9 aa, Homo Sapiens
TQPRRISVV

SEQ ID NO: 1318039 - protein, 9 aa, Homo Sapiens
QVNGINPNG

SEQ ID NO: 1318040 - protein, 9 aa, Homo Sapiens
LTLEDMLYV

SEQ ID NO: 1318041 - protein, 9 aa, Homo Sapiens
LSGDENDDT

SEQ ID NO: 1318042 - protein, 9 aa, Homo Sapiens
HMMRRLLAQ

SEQ ID NO: 1318043 - protein, 9 aa, Homo Sapiens
LEMMSRGRE

SEQ ID NO: 1318044 - protein, 9 aa, Homo Sapiens
TCAYAPSGC

SEQ ID NO: 1318045 - protein, 9 aa, Homo Sapiens
GKSEITDEI

SEQ ID NO: 1318046 - protein, 9 aa, Homo Sapiens
KNSVRFHIA

SEQ ID NO: 1318047 - protein, 9 aa, Homo Sapiens
KFEIPVCLH

SEQ ID NO: 1318048 - protein, 9 aa, Homo Sapiens
HMGFSTPAT

SEQ ID NO: 1318049 - protein, 9 aa, Homo Sapiens
AKRSKPESQ

SEQ ID NO: 1318050 - protein, 9 aa, Homo Sapiens
EYQNRFLHM

SEQ ID NO: 1318051 - protein, 9 aa, Homo Sapiens
MTDPEVVVS

SEQ ID NO: 1318052 - protein, 9 aa, Homo Sapiens
MVPEDYING

SEQ ID NO: 1318053 - protein, 9 aa, Homo Sapiens
EMVFNDCFS

SEQ ID NO: 1318054 - protein, 9 aa, Homo Sapiens
MQKFLGSFL

SEQ ID NO: 1318055 - protein, 9 aa, Homo Sapiens
TGDCFRKQY

SEQ ID NO: 1318056 - protein, 9 aa, Homo Sapiens
WAAWVAGGA

SEQ ID NO: 1318057 - protein, 9 aa, Homo Sapiens
AFEARDHNL

SEQ ID NO: 1318058 - protein, 9 aa, Homo Sapiens
VALEPDLLP

SEQ ID NO: 1318059 - protein, 9 aa, Homo Sapiens
ISGLESFQL

SEQ ID NO: 1318060 - protein, 9 aa, Homo Sapiens
VPAFLKGKG

SEQ ID NO: 1318061 - protein, 9 aa, Homo Sapiens
VFAMAQLRF

SEQ ID NO: 1318062 - protein, 9 aa, Homo Sapiens
TNDLEKCRQ

SEQ ID NO: 1318063 - protein, 9 aa, Homo Sapiens
QLSLVLIDD

SEQ ID NO: 1318064 - protein, 9 aa, Homo Sapiens
SRSKLWSAI

SEQ ID NO: 1318065 - protein, 9 aa, Homo Sapiens
HYLKMNIMV

SEQ ID NO: 1318066 - protein, 9 aa, Homo Sapiens
LPHMFKQEF

SEQ ID NO: 1318067 - protein, 9 aa, Homo Sapiens
RQFMDHTHY

SEQ ID NO: 1318068 - protein, 9 aa, Homo Sapiens
QLEQLEGKH

SEQ ID NO: 1318069 - protein, 9 aa, Homo Sapiens
KQKVKNLGY

SEQ ID NO: 1318070 - protein, 9 aa, Homo Sapiens
KQRINLARA

SEQ ID NO: 1318071 - protein, 9 aa, Homo Sapiens
LATFVTHVY

SEQ ID NO: 1318072 - protein, 9 aa, Homo Sapiens
FRANMGTSF

SEQ ID NO: 1318073 - protein, 9 aa, Homo Sapiens
LAQYLNRNY

SEQ ID NO: 1318074 - protein, 9 aa, Homo Sapiens
CPSKRHRPQ

SEQ ID NO: 1318075 - protein, 9 aa, Homo Sapiens
DTLVPARQQ

SEQ ID NO: 1318076 - protein, 9 aa, Homo Sapiens
VICSSLKAY

SEQ ID NO: 1318077 - protein, 9 aa, Homo Sapiens
YMTCAKCNH

SEQ ID NO: 1318078 - protein, 9 aa, Homo Sapiens
MGVSVIYWE

SEQ ID NO: 1318079 - protein, 9 aa, Homo Sapiens
QDAAIASFD

SEQ ID NO: 1318080 - protein, 9 aa, Homo Sapiens
LLLQQLCPQ

SEQ ID NO: 1318081 - protein, 9 aa, Homo Sapiens
ELSQKSPLF

SEQ ID NO: 1318082 - protein, 9 aa, Homo Sapiens
QPFHQGHPL

SEQ ID NO: 1318083 - protein, 9 aa, Homo Sapiens
GMTGTSTSS

SEQ ID NO: 1318084 - protein, 9 aa, Homo Sapiens
VKAKPTGAR

SEQ ID NO: 1318085 - protein, 9 aa, Homo Sapiens
TAADTVLCA

SEQ ID NO: 1318086 - protein, 9 aa, Homo Sapiens
QLPKLHLDT

SEQ ID NO: 1318087 - protein, 9 aa, Homo Sapiens
LSSLKSMVE

SEQ ID NO: 1318088 - protein, 9 aa, Homo Sapiens
ATKHCNSEE

SEQ ID NO: 1318089 - protein, 9 aa, Homo Sapiens
VHVDKCPRT

SEQ ID NO: 1318090 - protein, 9 aa, Homo Sapiens
HNQAKEKLQ

SEQ ID NO: 1318091 - protein, 9 aa, Homo Sapiens
IISLIFEKI

SEQ ID NO: 1318092 - protein, 9 aa, Homo Sapiens
CPCTLVRIC

SEQ ID NO: 1318093 - protein, 9 aa, Homo Sapiens
IFNFTRSRH

SEQ ID NO: 1318094 - protein, 9 aa, Homo Sapiens
NENADALAQ

SEQ ID NO: 1318095 - protein, 9 aa, Homo Sapiens
HSIECYSIN

SEQ ID NO: 1318096 - protein, 9 aa, Homo Sapiens
REDDIPFTA

SEQ ID NO: 1318097 - protein, 9 aa, Homo Sapiens
CGRTFRRRL

SEQ ID NO: 1318098 - protein, 9 aa, Homo Sapiens
EECGKPFNH

SEQ ID NO: 1318099 - protein, 9 aa, Homo Sapiens
ETNQDFLPS

SEQ ID NO: 1318100 - protein, 9 aa, Homo Sapiens
HEREKEVIL

SEQ ID NO: 1318101 - protein, 9 aa, Homo Sapiens
SLIFNQSPS

SEQ ID NO: 1318102 - protein, 9 aa, Homo Sapiens
RLPGGHINC

SEQ ID NO: 1318103 - protein, 9 aa, Homo Sapiens
ILTQLEMTF

SEQ ID NO: 1318104 - protein, 9 aa, Homo Sapiens
SPRAVGCTE

SEQ ID NO: 1318105 - protein, 9 aa, Homo Sapiens
LMEAQMQAE

SEQ ID NO: 1318106 - protein, 9 aa, Homo Sapiens
NVVERVTVP

SEQ ID NO: 1318107 - protein, 9 aa, Homo Sapiens
ERYEAIARA

SEQ ID NO: 1318108 - protein, 9 aa, Homo Sapiens
QLFQKFPVK

SEQ ID NO: 1318109 - protein, 9 aa, Homo Sapiens
SEDAELLWH

SEQ ID NO: 1318110 - protein, 9 aa, Homo Sapiens
LKMNIMVPE

SEQ ID NO: 1318111 - protein, 9 aa, Homo Sapiens
QNTKTCTKE

SEQ ID NO: 1318112 - protein, 9 aa, Homo Sapiens
KRWIHDIRT

SEQ ID NO: 1318113 - protein, 9 aa, Homo Sapiens
VDSYDMILA

SEQ ID NO: 1318114 - protein, 9 aa, Homo Sapiens
RETYNVLTN

SEQ ID NO: 1318115 - protein, 9 aa, Homo Sapiens
WLIRIASIP

SEQ ID NO: 1318116 - protein, 9 aa, Homo Sapiens
MVTGRQEDV

SEQ ID NO: 1318117 - protein, 9 aa, Homo Sapiens
GAGMDSYFE

SEQ ID NO: 1318118 - protein, 9 aa, Homo Sapiens
ELQLNVSSV

SEQ ID NO: 1318119 - protein, 9 aa, Homo Sapiens
CESEQARVR

SEQ ID NO: 1318120 - protein, 9 aa, Homo Sapiens
DQRSPYADI

SEQ ID NO: 1318121 - protein, 9 aa, Homo Sapiens
LCDHTSTLV

SEQ ID NO: 1318122 - protein, 9 aa, Homo Sapiens
ERRMKIEEM

SEQ ID NO: 1318123 - protein, 9 aa, Homo Sapiens
GTHCYTESL

SEQ ID NO: 1318124 - protein, 9 aa, Homo Sapiens
LSMVNSGPS

SEQ ID NO: 1318125 - protein, 9 aa, Homo Sapiens
LTKASILKD

SEQ ID NO: 1318126 - protein, 9 aa, Homo Sapiens
TCRHANIVT

SEQ ID NO: 1318127 - protein, 9 aa, Homo Sapiens
QMQAELLYA

SEQ ID NO: 1318128 - protein, 9 aa, Homo Sapiens
ELHSMLMEQ

SEQ ID NO: 1318129 - protein, 9 aa, Homo Sapiens
ITHVVLKEE

SEQ ID NO: 1318130 - protein, 9 aa, Homo Sapiens
MALQNLRVV

SEQ ID NO: 1318131 - protein, 9 aa, Homo Sapiens
AEVDLEHTF

SEQ ID NO: 1318132 - protein, 9 aa, Homo Sapiens
LDTIDNLPV

SEQ ID NO: 1318133 - protein, 9 aa, Homo Sapiens
CMKSVLIGE

SEQ ID NO: 1318134 - protein, 9 aa, Homo Sapiens
KVKRVAKEL

SEQ ID NO: 1318135 - protein, 9 aa, Homo Sapiens
SSLNMHIRA

SEQ ID NO: 1318136 - protein, 9 aa, Homo Sapiens
EAAEMAKKQ

SEQ ID NO: 1318137 - protein, 9 aa, Homo Sapiens
RPFDDTCHG

SEQ ID NO: 1318138 - protein, 9 aa, Homo Sapiens
SPAALPPRP

SEQ ID NO: 1318139 - protein, 9 aa, Homo Sapiens
DNLTMHMWC

SEQ ID NO: 1318140 - protein, 9 aa, Homo Sapiens
TTLNQHKKI

SEQ ID NO: 1318141 - protein, 9 aa, Homo Sapiens
SKVFSAYSS

SEQ ID NO: 1318142 - protein, 9 aa, Homo Sapiens
YIHVPQDHL

SEQ ID NO: 1318143 - protein, 9 aa, Homo Sapiens
SHHLDAVAC

SEQ ID NO: 1318144 - protein, 9 aa, Homo Sapiens
CLKRSRCMP

SEQ ID NO: 1318145 - protein, 9 aa, Homo Sapiens
HHKKYQYIH

SEQ ID NO: 1318146 - protein, 9 aa, Homo Sapiens
LCEIPWKLD

SEQ ID NO: 1318147 - protein, 9 aa, Homo Sapiens
MANYSLIPA

SEQ ID NO: 1318148 - protein, 9 aa, Homo Sapiens
WVIQVQLRS

SEQ ID NO: 1318149 - protein, 9 aa, Homo Sapiens
STTYNTQEG

SEQ ID NO: 1318150 - protein, 9 aa, Homo Sapiens
EKQDELKCS

SEQ ID NO: 1318151 - protein, 9 aa, Homo Sapiens
VLHDSKIMV

SEQ ID NO: 1318152 - protein, 9 aa, Homo Sapiens
KVETERIRA

SEQ ID NO: 1318153 - protein, 9 aa, Homo Sapiens
VSDDTCYRE

SEQ ID NO: 1318154 - protein, 9 aa, Homo Sapiens
LSVKKAERF

SEQ ID NO: 1318155 - protein, 9 aa, Homo Sapiens
EDTKIIRNN

SEQ ID NO: 1318156 - protein, 9 aa, Homo Sapiens
FLWNSREKG

SEQ ID NO: 1318157 - protein, 9 aa, Homo Sapiens
QCKLRYGML

SEQ ID NO: 1318158 - protein, 9 aa, Homo Sapiens
PADRKCQLS

SEQ ID NO: 1318159 - protein, 9 aa, Homo Sapiens
TSPAFHILS

SEQ ID NO: 1318160 - protein, 9 aa, Homo Sapiens
TLFKLFNLL

SEQ ID NO: 1318161 - protein, 9 aa, Homo Sapiens
NHKWVNGFN

SEQ ID NO: 1318162 - protein, 9 aa, Homo Sapiens
ESSKSPKMM

SEQ ID NO: 1318163 - protein, 9 aa, Homo Sapiens
RTSRPLRAE

SEQ ID NO: 1318164 - protein, 9 aa, Homo Sapiens
PVFHDMSVK

SEQ ID NO: 1318165 - protein, 9 aa, Homo Sapiens
AHELGHMLG

SEQ ID NO: 1318166 - protein, 9 aa, Homo Sapiens
MERADYVAL

SEQ ID NO: 1318167 - protein, 9 aa, Homo Sapiens
AHIPVIRRV

SEQ ID NO: 1318168 - protein, 9 aa, Homo Sapiens
CVNVEDENH

SEQ ID NO: 1318169 - protein, 9 aa, Homo Sapiens
PGVYVHVSR

SEQ ID NO: 1318170 - protein, 9 aa, Homo Sapiens
SVRLKLTIV

SEQ ID NO: 1318171 - protein, 9 aa, Homo Sapiens
RDKRTLKQF

SEQ ID NO: 1318172 - protein, 9 aa, Homo Sapiens
HGPELDADS

SEQ ID NO: 1318173 - protein, 9 aa, Homo Sapiens
MAPEVLDEN

SEQ ID NO: 1318174 - protein, 9 aa, Homo Sapiens
GNAKLSGSS

SEQ ID NO: 1318175 - protein, 9 aa, Homo Sapiens
SSRIRFSSR

SEQ ID NO: 1318176 - protein, 9 aa, Homo Sapiens
NNKLRWGDI

SEQ ID NO: 1318177 - protein, 9 aa, Homo Sapiens
VNMSVSRLS

SEQ ID NO: 1318178 - protein, 9 aa, Homo Sapiens
VLVFVESTY

SEQ ID NO: 1318179 - protein, 9 aa, Homo Sapiens
SGLKQCYQI

SEQ ID NO: 1318180 - protein, 9 aa, Homo Sapiens
LLAHVLVKR

SEQ ID NO: 1318181 - protein, 9 aa, Homo Sapiens
QIAINNGTV

SEQ ID NO: 1318182 - protein, 9 aa, Homo Sapiens
LLTISTICE

SEQ ID NO: 1318183 - protein, 9 aa, Homo Sapiens
LGKAVLWDS

SEQ ID NO: 1318184 - protein, 9 aa, Homo Sapiens
MSNANFAKL

SEQ ID NO: 1318185 - protein, 9 aa, Homo Sapiens
SPHPPRAGE

SEQ ID NO: 1318186 - protein, 9 aa, Homo Sapiens
TADEKVDIY

SEQ ID NO: 1318187 - protein, 9 aa, Homo Sapiens
LQLLGRNTV

SEQ ID NO: 1318188 - protein, 9 aa, Homo Sapiens
LLFHSRQYL

SEQ ID NO: 1318189 - protein, 9 aa, Homo Sapiens
RMSLARAVY

SEQ ID NO: 1318190 - protein, 9 aa, Homo Sapiens
LLSAAGPAG

SEQ ID NO: 1318191 - protein, 9 aa, Homo Sapiens
SVKTCSERQ

SEQ ID NO: 1318192 - protein, 9 aa, Homo Sapiens
EEEKRVLRY

SEQ ID NO: 1318193 - protein, 9 aa, Homo Sapiens
RLVSCEKCC

SEQ ID NO: 1318194 - protein, 9 aa, Homo Sapiens
ILWPEVMET

SEQ ID NO: 1318195 - protein, 9 aa, Homo Sapiens
SRNFLPGGR

SEQ ID NO: 1318196 - protein, 9 aa, Homo Sapiens
KILRLVQAT

SEQ ID NO: 1318197 - protein, 9 aa, Homo Sapiens
KEHHSSKIR

SEQ ID NO: 1318198 - protein, 9 aa, Homo Sapiens
WHPKLLAKA

SEQ ID NO: 1318199 - protein, 9 aa, Homo Sapiens
SEKKKRRWG

SEQ ID NO: 1318200 - protein, 9 aa, Homo Sapiens
NIREEVNNK

SEQ ID NO: 1318201 - protein, 9 aa, Homo Sapiens
TSPSSASTD

SEQ ID NO: 1318202 - protein, 9 aa, Homo Sapiens
MFLGLTMGT

SEQ ID NO: 1318203 - protein, 9 aa, Homo Sapiens
SQRPPRQVR

SEQ ID NO: 1318204 - protein, 9 aa, Homo Sapiens
DVSSDEMDA

SEQ ID NO: 1318205 - protein, 9 aa, Homo Sapiens
HSVSIPAPA

SEQ ID NO: 1318206 - protein, 9 aa, Homo Sapiens
WKYGFFKRA

SEQ ID NO: 1318207 - protein, 9 aa, Homo Sapiens
QGPGGETKC

SEQ ID NO: 1318208 - protein, 9 aa, Homo Sapiens
QARIQHLSS

SEQ ID NO: 1318209 - protein, 9 aa, Homo Sapiens
ACTCGCTPA

SEQ ID NO: 1318210 - protein, 9 aa, Homo Sapiens
QKPTLTIIG

SEQ ID NO: 1318211 - protein, 9 aa, Homo Sapiens
SDHYHSFHT

SEQ ID NO: 1318212 - protein, 9 aa, Homo Sapiens
DDSILSITV

SEQ ID NO: 1318213 - protein, 9 aa, Homo Sapiens
ILFITPLLL

SEQ ID NO: 1318214 - protein, 9 aa, Homo Sapiens
QEECDERHK

SEQ ID NO: 1318215 - protein, 9 aa, Homo Sapiens
IRIHSLQGR

SEQ ID NO: 1318216 - protein, 9 aa, Homo Sapiens
QCLCVTTKT

SEQ ID NO: 1318217 - protein, 9 aa, Homo Sapiens
LRVQYLHQI

SEQ ID NO: 1318218 - protein, 9 aa, Homo Sapiens
SSDQQFSPK

SEQ ID NO: 1318219 - protein, 9 aa, Homo Sapiens
TIYNTSTDR

SEQ ID NO: 1318220 - protein, 9 aa, Homo Sapiens
TAEWMSFDV

SEQ ID NO: 1318221 - protein, 9 aa, Homo Sapiens
DFMHGPPSS

SEQ ID NO: 1318222 - protein, 9 aa, Homo Sapiens
QNEWASLYP

SEQ ID NO: 1318223 - protein, 9 aa, Homo Sapiens
MGAPLCNYL

SEQ ID NO: 1318224 - protein, 9 aa, Homo Sapiens
LSKKKGEDL

SEQ ID NO: 1318225 - protein, 9 aa, Homo Sapiens
SCESLPSSS

SEQ ID NO: 1318226 - protein, 9 aa, Homo Sapiens
SPATHPSPC

SEQ ID NO: 1318227 - protein, 9 aa, Homo Sapiens
GPHAGQGVH

SEQ ID NO: 1318228 - protein, 9 aa, Homo Sapiens
LVCQCLAPA

SEQ ID NO: 1318229 - protein, 9 aa, Homo Sapiens
IGDHQAGLV

SEQ ID NO: 1318230 - protein, 9 aa, Homo Sapiens
KDKETNQDF

SEQ ID NO: 1318231 - protein, 9 aa, Homo Sapiens
SAVSIYVPF

SEQ ID NO: 1318232 - protein, 9 aa, Homo Sapiens
TPHPTTLDP

SEQ ID NO: 1318233 - protein, 9 aa, Homo Sapiens
ACVLWKKGL

SEQ ID NO: 1318234 - protein, 9 aa, Homo Sapiens
HFQSHGLEG

SEQ ID NO: 1318235 - protein, 9 aa, Homo Sapiens
EDCNNCRCL

SEQ ID NO: 1318236 - protein, 9 aa, Homo Sapiens
GIIISVKTC

SEQ ID NO: 1318237 - protein, 9 aa, Homo Sapiens
HRIDVIFCD

SEQ ID NO: 1318238 - protein, 9 aa, Homo Sapiens
YMVPMNQSQ

SEQ ID NO: 1318239 - protein, 9 aa, Homo Sapiens
WLALGLALT

SEQ ID NO: 1318240 - protein, 9 aa, Homo Sapiens
LKIIEEKTA

SEQ ID NO: 1318241 - protein, 9 aa, Homo Sapiens
LPEPTMCIP

SEQ ID NO: 1318242 - protein, 9 aa, Homo Sapiens
EEYPISKKR

SEQ ID NO: 1318243 - protein, 9 aa, Homo Sapiens
EETLDEITQ

SEQ ID NO: 1318244 - protein, 9 aa, Homo Sapiens
CHPFDTVFI

SEQ ID NO: 1318245 - protein, 9 aa, Homo Sapiens
GQMDTNGLV

SEQ ID NO: 1318246 - protein, 9 aa, Homo Sapiens
EMKQAFIKA

SEQ ID NO: 1318247 - protein, 9 aa, Homo Sapiens
VSGALPPPS

SEQ ID NO: 1318248 - protein, 9 aa, Homo Sapiens
TDVSHGHLD

SEQ ID NO: 1318249 - protein, 9 aa, Homo Sapiens
ASYVVWKCC

SEQ ID NO: 1318250 - protein, 9 aa, Homo Sapiens
ATMPHGQLE

SEQ ID NO: 1318251 - protein, 9 aa, Homo Sapiens
RMHLMKHDV

SEQ ID NO: 1318252 - protein, 9 aa, Homo Sapiens
ALKKPIHAA

SEQ ID NO: 1318253 - protein, 9 aa, Homo Sapiens
TSEDFLIIL

SEQ ID NO: 1318254 - protein, 9 aa, Homo Sapiens
ESIQVCKLA

SEQ ID NO: 1318255 - protein, 9 aa, Homo Sapiens
SGLHATIEC

SEQ ID NO: 1318256 - protein, 9 aa, Homo Sapiens
YGNSTRVIY

SEQ ID NO: 1318257 - protein, 9 aa, Homo Sapiens
TFSHFMSVI

SEQ ID NO: 1318258 - protein, 9 aa, Homo Sapiens
HHPGQSSAP

SEQ ID NO: 1318259 - protein, 9 aa, Homo Sapiens
RIAKQILQE

SEQ ID NO: 1318260 - protein, 9 aa, Homo Sapiens
KMRRRSWQR

SEQ ID NO: 1318261 - protein, 9 aa, Homo Sapiens
FGPTFQAEN

SEQ ID NO: 1318262 - protein, 9 aa, Homo Sapiens
IIYLTRHLA

SEQ ID NO: 1318263 - protein, 9 aa, Homo Sapiens
RVEYIKSFG

SEQ ID NO: 1318264 - protein, 9 aa, Homo Sapiens
PRVRKLKTT

SEQ ID NO: 1318265 - protein, 9 aa, Homo Sapiens
RVIKVNKGC

SEQ ID NO: 1318266 - protein, 9 aa, Homo Sapiens
QIFCSEDEQ

SEQ ID NO: 1318267 - protein, 9 aa, Homo Sapiens
CSLGAVHAS

SEQ ID NO: 1318268 - protein, 9 aa, Homo Sapiens
TTLICPKPD

SEQ ID NO: 1318269 - protein, 9 aa, Homo Sapiens
LFYSGTGVH

SEQ ID NO: 1318270 - protein, 9 aa, Homo Sapiens
RTFCLADSD

SEQ ID NO: 1318271 - protein, 9 aa, Homo Sapiens
TGAHWMWQL

SEQ ID NO: 1318272 - protein, 9 aa, Homo Sapiens
THLRPRPRT

SEQ ID NO: 1318273 - protein, 9 aa, Homo Sapiens
SAIQAASQA

SEQ ID NO: 1318274 - protein, 9 aa, Homo Sapiens
YELGSRFVV

SEQ ID NO: 1318275 - protein, 9 aa, Homo Sapiens
RARNNIVII

SEQ ID NO: 1318276 - protein, 9 aa, Homo Sapiens
RHAFIITLN

SEQ ID NO: 1318277 - protein, 9 aa, Homo Sapiens
RSLQIDSSS

SEQ ID NO: 1318278 - protein, 9 aa, Homo Sapiens
RSNIACDGD

SEQ ID NO: 1318279 - protein, 9 aa, Homo Sapiens
AISMSAYLQ

SEQ ID NO: 1318280 - protein, 9 aa, Homo Sapiens
EATKHCNSE

SEQ ID NO: 1318281 - protein, 9 aa, Homo Sapiens
LPGGHINCP

SEQ ID NO: 1318282 - protein, 9 aa, Homo Sapiens
IAITFIVRR

SEQ ID NO: 1318283 - protein, 9 aa, Homo Sapiens
VFKYCHFSL

SEQ ID NO: 1318284 - protein, 9 aa, Homo Sapiens
FMSVVSGRA

SEQ ID NO: 1318285 - protein, 9 aa, Homo Sapiens
RKVAAGELQ

SEQ ID NO: 1318286 - protein, 9 aa, Homo Sapiens
INQSIQQRK

SEQ ID NO: 1318287 - protein, 9 aa, Homo Sapiens
MAYGIKENM

SEQ ID NO: 1318288 - protein, 9 aa, Homo Sapiens
IPRGRHISV

SEQ ID NO: 1318289 - protein, 9 aa, Homo Sapiens
CALYLGLQS

SEQ ID NO: 1318290 - protein, 9 aa, Homo Sapiens
CLHAGGVGL

SEQ ID NO: 1318291 - protein, 9 aa, Homo Sapiens
DNLPVNLIS

SEQ ID NO: 1318292 - protein, 9 aa, Homo Sapiens
CVVLMQDKA

SEQ ID NO: 1318293 - protein, 9 aa, Homo Sapiens
VNRSLVLPW

SEQ ID NO: 1318294 - protein, 9 aa, Homo Sapiens
RLMWLLWLF

SEQ ID NO: 1318295 - protein, 9 aa, Homo Sapiens
VMVASRLTP

SEQ ID NO: 1318296 - protein, 9 aa, Homo Sapiens
FLTSTNKSE

SEQ ID NO: 1318297 - protein, 9 aa, Homo Sapiens
EESEDIVTD

SEQ ID NO: 1318298 - protein, 9 aa, Homo Sapiens
WEVDVTFRV

SEQ ID NO: 1318299 - protein, 9 aa, Homo Sapiens
RMDQDIFDI

SEQ ID NO: 1318300 - protein, 9 aa, Homo Sapiens
IAQKCALFF

SEQ ID NO: 1318301 - protein, 9 aa, Homo Sapiens
RNSPSRELH

SEQ ID NO: 1318302 - protein, 9 aa, Homo Sapiens
VQMYRCYRS

SEQ ID NO: 1318303 - protein, 9 aa, Homo Sapiens
KRKRCQPHP

SEQ ID NO: 1318304 - protein, 9 aa, Homo Sapiens
WGGPMRGGP

SEQ ID NO: 1318305 - protein, 9 aa, Homo Sapiens
TPARSPSSA

SEQ ID NO: 1318306 - protein, 9 aa, Homo Sapiens
HKHLKSNQT

SEQ ID NO: 1318307 - protein, 9 aa, Homo Sapiens
YSYWLHTSP

SEQ ID NO: 1318308 - protein, 9 aa, Homo Sapiens
RCSAKEVER

SEQ ID NO: 1318309 - protein, 9 aa, Homo Sapiens
NKRCYSFRV

SEQ ID NO: 1318310 - protein, 9 aa, Homo Sapiens
CAKPSAPVV

SEQ ID NO: 1318311 - protein, 9 aa, Homo Sapiens
YWCELTVRT

SEQ ID NO: 1318312 - protein, 9 aa, Homo Sapiens
LQRRDNMFY

SEQ ID NO: 1318313 - protein, 9 aa, Homo Sapiens
ALDWIFNHP

SEQ ID NO: 1318314 - protein, 9 aa, Homo Sapiens
SRKQRKEHK

SEQ ID NO: 1318315 - protein, 9 aa, Homo Sapiens
LDRYIKINQ

SEQ ID NO: 1318316 - protein, 9 aa, Homo Sapiens
DISRHETMG

SEQ ID NO: 1318317 - protein, 9 aa, Homo Sapiens
RTYYLEPLP

SEQ ID NO: 1318318 - protein, 9 aa, Homo Sapiens
VVSVDDSGT

SEQ ID NO: 1318319 - protein, 9 aa, Homo Sapiens
LSFVESRFF

SEQ ID NO: 1318320 - protein, 9 aa, Homo Sapiens
KSVSSHSDI

SEQ ID NO: 1318321 - protein, 9 aa, Homo Sapiens
SINHKWVNG

SEQ ID NO: 1318322 - protein, 9 aa, Homo Sapiens
TVLTLYTDP

SEQ ID NO: 1318323 - protein, 9 aa, Homo Sapiens
VLSRITLVL

SEQ ID NO: 1318324 - protein, 9 aa, Homo Sapiens
EEWPLVDDR

SEQ ID NO: 1318325 - protein, 9 aa, Homo Sapiens
KCSLYGKKL

SEQ ID NO: 1318326 - protein, 9 aa, Homo Sapiens
EEKRVLRYL

SEQ ID NO: 1318327 - protein, 9 aa, Homo Sapiens
VVGTEIIQS

SEQ ID NO: 1318328 - protein, 9 aa, Homo Sapiens
PLLDVDHIS

SEQ ID NO: 1318329 - protein, 9 aa, Homo Sapiens
YDQYYERNE

SEQ ID NO: 1318330 - protein, 9 aa, Homo Sapiens
SLTSLRSEQ

SEQ ID NO: 1318331 - protein, 9 aa, Homo Sapiens
KPCDKSRRS

SEQ ID NO: 1318332 - protein, 9 aa, Homo Sapiens
NRVQHKQFL

SEQ ID NO: 1318333 - protein, 9 aa, Homo Sapiens
DTGFGGHRG

SEQ ID NO: 1318334 - protein, 9 aa, Homo Sapiens
IPLPTWNAR

SEQ ID NO: 1318335 - protein, 9 aa, Homo Sapiens
IPFEFETRG

SEQ ID NO: 1318336 - protein, 9 aa, Homo Sapiens
VAHIPVIRR

SEQ ID NO: 1318337 - protein, 9 aa, Homo Sapiens
SRFIVITDF

SEQ ID NO: 1318338 - protein, 9 aa, Homo Sapiens
LAKTTSRSG

SEQ ID NO: 1318339 - protein, 9 aa, Homo Sapiens
VRNPPVVSK

SEQ ID NO: 1318340 - protein, 9 aa, Homo Sapiens
QKDHFAWQS

SEQ ID NO: 1318341 - protein, 9 aa, Homo Sapiens
IGETPKGIS

SEQ ID NO: 1318342 - protein, 9 aa, Homo Sapiens
SSIFLFVFL

SEQ ID NO: 1318343 - protein, 9 aa, Homo Sapiens
NSGKIDVKM

SEQ ID NO: 1318344 - protein, 9 aa, Homo Sapiens
LLDTSCQAT

SEQ ID NO: 1318345 - protein, 9 aa, Homo Sapiens
QRINLARAV

SEQ ID NO: 1318346 - protein, 9 aa, Homo Sapiens
SHLNLDEMT

SEQ ID NO: 1318347 - protein, 9 aa, Homo Sapiens
EAFGNALIQ

SEQ ID NO: 1318348 - protein, 9 aa, Homo Sapiens
YGLKEDEAG

SEQ ID NO: 1318349 - protein, 9 aa, Homo Sapiens
CIEAYTSYS

SEQ ID NO: 1318350 - protein, 9 aa, Homo Sapiens
PEPEPPGPV

SEQ ID NO: 1318351 - protein, 9 aa, Homo Sapiens
MQPRTRCTK

SEQ ID NO: 1318352 - protein, 9 aa, Homo Sapiens
HSARYQYFV

SEQ ID NO: 1318353 - protein, 9 aa, Homo Sapiens
REKEVILLR

SEQ ID NO: 1318354 - protein, 9 aa, Homo Sapiens
GRKLMWLYQ

SEQ ID NO: 1318355 - protein, 9 aa, Homo Sapiens
LRKIGRWRE

SEQ ID NO: 1318356 - protein, 9 aa, Homo Sapiens
PHSLEGADP

SEQ ID NO: 1318357 - protein, 9 aa, Homo Sapiens
EVGRIIKCT

SEQ ID NO: 1318358 - protein, 9 aa, Homo Sapiens
AGEENEKER

SEQ ID NO: 1318359 - protein, 9 aa, Homo Sapiens
SSATEKDEW

SEQ ID NO: 1318360 - protein, 9 aa, Homo Sapiens
LVVSDGEAD

SEQ ID NO: 1318361 - protein, 9 aa, Homo Sapiens
ILPKELKII

SEQ ID NO: 1318362 - protein, 9 aa, Homo Sapiens
MLTGQAYKM

SEQ ID NO: 1318363 - protein, 9 aa, Homo Sapiens
SHPKAEAVF

SEQ ID NO: 1318364 - protein, 9 aa, Homo Sapiens
KQICLILVG

SEQ ID NO: 1318365 - protein, 9 aa, Homo Sapiens
YVFYWWDYF

SEQ ID NO: 1318366 - protein, 9 aa, Homo Sapiens
EWECKQCML

SEQ ID NO: 1318367 - protein, 9 aa, Homo Sapiens
AAKWEQLSL

SEQ ID NO: 1318368 - protein, 9 aa, Homo Sapiens
WVLVVLDTS

SEQ ID NO: 1318369 - protein, 9 aa, Homo Sapiens
WCPVIKQEG

SEQ ID NO: 1318370 - protein, 9 aa, Homo Sapiens
EFKKFRENM

SEQ ID NO: 1318371 - protein, 9 aa, Homo Sapiens
FLILNKHKR

SEQ ID NO: 1318372 - protein, 9 aa, Homo Sapiens
CLCTVENLS

SEQ ID NO: 1318373 - protein, 9 aa, Homo Sapiens
EKDRYPQAG

SEQ ID NO: 1318374 - protein, 9 aa, Homo Sapiens
GNHLLGGSG

SEQ ID NO: 1318375 - protein, 9 aa, Homo Sapiens
FTMIMQRVS

SEQ ID NO: 1318376 - protein, 9 aa, Homo Sapiens
FTFHHPLLS

SEQ ID NO: 1318377 - protein, 9 aa, Homo Sapiens
DGQTGSGQH

SEQ ID NO: 1318378 - protein, 9 aa, Homo Sapiens
KDVMLMGDF

SEQ ID NO: 1318379 - protein, 9 aa, Homo Sapiens
TYGAFLYKG

SEQ ID NO: 1318380 - protein, 9 aa, Homo Sapiens
STRARSPTS

SEQ ID NO: 1318381 - protein, 9 aa, Homo Sapiens
HRPLCQRFP

SEQ ID NO: 1318382 - protein, 9 aa, Homo Sapiens
LEIEEHNFA

SEQ ID NO: 1318383 - protein, 9 aa, Homo Sapiens
SPVVVILEK

SEQ ID NO: 1318384 - protein, 9 aa, Homo Sapiens
DAKGEPGEK

SEQ ID NO: 1318385 - protein, 9 aa, Homo Sapiens
NPCEREKHN

SEQ ID NO: 1318386 - protein, 9 aa, Homo Sapiens
PLGMAFITF

SEQ ID NO: 1318387 - protein, 9 aa, Homo Sapiens
KNQLMTTNI

SEQ ID NO: 1318388 - protein, 9 aa, Homo Sapiens
KDDDEGSPG

SEQ ID NO: 1318389 - protein, 9 aa, Homo Sapiens
IIQHHHPFI

SEQ ID NO: 1318390 - protein, 9 aa, Homo Sapiens
LCHQLGCGQ

SEQ ID NO: 1318391 - protein, 9 aa, Homo Sapiens
DEDKDDDEG

SEQ ID NO: 1318392 - protein, 9 aa, Homo Sapiens
ACNVAAASA

SEQ ID NO: 1318393 - protein, 9 aa, Homo Sapiens
IVSTQVATV

SEQ ID NO: 1318394 - protein, 9 aa, Homo Sapiens
LPQDLGSAY

SEQ ID NO: 1318395 - protein, 9 aa, Homo Sapiens
VDYILATWA

SEQ ID NO: 1318396 - protein, 9 aa, Homo Sapiens
PICLASRAK

SEQ ID NO: 1318397 - protein, 9 aa, Homo Sapiens
DTPHQRGCR

SEQ ID NO: 1318398 - protein, 9 aa, Homo Sapiens
CESCRARLL

SEQ ID NO: 1318399 - protein, 9 aa, Homo Sapiens
RRLPSVIPT

SEQ ID NO: 1318400 - protein, 9 aa, Homo Sapiens
LQNYYTGGW

SEQ ID NO: 1318401 - protein, 9 aa, Homo Sapiens
RPGRAGRVA

SEQ ID NO: 1318402 - protein, 9 aa, Homo Sapiens
AVLHENRNK

SEQ ID NO: 1318403 - protein, 9 aa, Homo Sapiens
YEGIIEENG

SEQ ID NO: 1318404 - protein, 9 aa, Homo Sapiens
LPPTPPAPA

SEQ ID NO: 1318405 - protein, 9 aa, Homo Sapiens
RVDVAQDTT

SEQ ID NO: 1318406 - protein, 9 aa, Homo Sapiens
QLWATVVLG

SEQ ID NO: 1318407 - protein, 9 aa, Homo Sapiens
ARHLIVHLL

SEQ ID NO: 1318408 - protein, 9 aa, Homo Sapiens
YQGPYVSMT

SEQ ID NO: 1318409 - protein, 9 aa, Homo Sapiens
WRSAYAFSH

SEQ ID NO: 1318410 - protein, 9 aa, Homo Sapiens
QTLLPALVL

SEQ ID NO: 1318411 - protein, 9 aa, Homo Sapiens
PAYVISNIL

SEQ ID NO: 1318412 - protein, 9 aa, Homo Sapiens
PEAARLTQG

SEQ ID NO: 1318413 - protein, 9 aa, Homo Sapiens
RDGVKCCCQ

SEQ ID NO: 1318414 - protein, 9 aa, Homo Sapiens
SFEPLSNPD

SEQ ID NO: 1318415 - protein, 9 aa, Homo Sapiens
KLIFEFCGY

SEQ ID NO: 1318416 - protein, 9 aa, Homo Sapiens
AINLNLRAG

SEQ ID NO: 1318417 - protein, 9 aa, Homo Sapiens
VVAAHVLRQ

SEQ ID NO: 1318418 - protein, 9 aa, Homo Sapiens
LVTTARNFG

SEQ ID NO: 1318419 - protein, 9 aa, Homo Sapiens
AKSLLFWLM

SEQ ID NO: 1318420 - protein, 9 aa, Homo Sapiens
TSSSSFISS

SEQ ID NO: 1318421 - protein, 9 aa, Homo Sapiens
LNGMLTGQA

SEQ ID NO: 1318422 - protein, 9 aa, Homo Sapiens
NCPKGFTRF

SEQ ID NO: 1318423 - protein, 9 aa, Homo Sapiens
YLQEQRREL

SEQ ID NO: 1318424 - protein, 9 aa, Homo Sapiens
AWILTGGIN

SEQ ID NO: 1318425 - protein, 9 aa, Homo Sapiens
TSRDSRSFF

SEQ ID NO: 1318426 - protein, 9 aa, Homo Sapiens
VYGSVYAIT

SEQ ID NO: 1318427 - protein, 9 aa, Homo Sapiens
HPGLTEKSL

SEQ ID NO: 1318428 - protein, 9 aa, Homo Sapiens
PWPIMEAVA

SEQ ID NO: 1318429 - protein, 9 aa, Homo Sapiens
CIASLPFQV

SEQ ID NO: 1318430 - protein, 9 aa, Homo Sapiens
TCSGWLHNT

SEQ ID NO: 1318431 - protein, 9 aa, Homo Sapiens
PPRQVSQKS

SEQ ID NO: 1318432 - protein, 9 aa, Homo Sapiens
ETADLPYQF

SEQ ID NO: 1318433 - protein, 9 aa, Homo Sapiens
VAVRLGHVE

SEQ ID NO: 1318434 - protein, 9 aa, Homo Sapiens
VHGSCRGSI

SEQ ID NO: 1318435 - protein, 9 aa, Homo Sapiens
QVPFSGCCF

SEQ ID NO: 1318436 - protein, 9 aa, Homo Sapiens
SRTVIQRGS

SEQ ID NO: 1318437 - protein, 9 aa, Homo Sapiens
EENANLGLQ

SEQ ID NO: 1318438 - protein, 9 aa, Homo Sapiens
SAYIVESLI

SEQ ID NO: 1318439 - protein, 9 aa, Homo Sapiens
EMEVLQERM

SEQ ID NO: 1318440 - protein, 9 aa, Homo Sapiens
PAQQNQYIH

SEQ ID NO: 1318441 - protein, 9 aa, Homo Sapiens
PTERCFSLC

SEQ ID NO: 1318442 - protein, 9 aa, Homo Sapiens
LRERKQLMI

SEQ ID NO: 1318443 - protein, 9 aa, Homo Sapiens
ARNGHMRIS

SEQ ID NO: 1318444 - protein, 9 aa, Homo Sapiens
HLNGPWIST

SEQ ID NO: 1318445 - protein, 9 aa, Homo Sapiens
SIAELVPKY

SEQ ID NO: 1318446 - protein, 9 aa, Homo Sapiens
STHFLVFNS

SEQ ID NO: 1318447 - protein, 9 aa, Homo Sapiens
VNTGVICHV

SEQ ID NO: 1318448 - protein, 9 aa, Homo Sapiens
VLMAWLGVF

SEQ ID NO: 1318449 - protein, 9 aa, Homo Sapiens
LSPEENIII

SEQ ID NO: 1318450 - protein, 9 aa, Homo Sapiens
LHLLRHQRT

SEQ ID NO: 1318451 - protein, 9 aa, Homo Sapiens
HEVCMSHLE

SEQ ID NO: 1318452 - protein, 9 aa, Homo Sapiens
KCCYVAFLP

SEQ ID NO: 1318453 - protein, 9 aa, Homo Sapiens
LGFFCVDEG

SEQ ID NO: 1318454 - protein, 9 aa, Homo Sapiens
YCVHNESTG

SEQ ID NO: 1318455 - protein, 9 aa, Homo Sapiens
RTLSILISF

SEQ ID NO: 1318456 - protein, 9 aa, Homo Sapiens
DVTLHWKKD

SEQ ID NO: 1318457 - protein, 9 aa, Homo Sapiens
QRNIRLVSV

SEQ ID NO: 1318458 - protein, 9 aa, Homo Sapiens
YLKSHQFPC

SEQ ID NO: 1318459 - protein, 9 aa, Homo Sapiens
HNASDLLDI

SEQ ID NO: 1318460 - protein, 9 aa, Homo Sapiens
YTGHLSMAA

SEQ ID NO: 1318461 - protein, 9 aa, Homo Sapiens
LPLWDDLCC

SEQ ID NO: 1318462 - protein, 9 aa, Homo Sapiens
LYTFDVAFV

SEQ ID NO: 1318463 - protein, 9 aa, Homo Sapiens
VQSVLLAPS

SEQ ID NO: 1318464 - protein, 9 aa, Homo Sapiens
PEDLRTRTQ

SEQ ID NO: 1318465 - protein, 9 aa, Homo Sapiens
PEEVTTCVG

SEQ ID NO: 1318466 - protein, 9 aa, Homo Sapiens
ANRTFQEKA

SEQ ID NO: 1318467 - protein, 9 aa, Homo Sapiens
ILFPNRQPQ

SEQ ID NO: 1318468 - protein, 9 aa, Homo Sapiens
TLECLETIF

SEQ ID NO: 1318469 - protein, 9 aa, Homo Sapiens
ERLQKGLDR

SEQ ID NO: 1318470 - protein, 9 aa, Homo Sapiens
RVFLLLKWR

SEQ ID NO: 1318471 - protein, 9 aa, Homo Sapiens
AKLVRAGVS

SEQ ID NO: 1318472 - protein, 9 aa, Homo Sapiens
RTGENRNHL

SEQ ID NO: 1318473 - protein, 9 aa, Homo Sapiens
TGAGTAGRR

SEQ ID NO: 1318474 - protein, 9 aa, Homo Sapiens
LELLSALGE

SEQ ID NO: 1318475 - protein, 9 aa, Homo Sapiens
IDKITTVQV

SEQ ID NO: 1318476 - protein, 9 aa, Homo Sapiens
GQASMIPQL

SEQ ID NO: 1318477 - protein, 9 aa, Homo Sapiens
GCQQYIQFI

SEQ ID NO: 1318478 - protein, 9 aa, Homo Sapiens
SLVDPKNID

SEQ ID NO: 1318479 - protein, 9 aa, Homo Sapiens
LMNSSIYSH

SEQ ID NO: 1318480 - protein, 9 aa, Homo Sapiens
AREEKKKNK

SEQ ID NO: 1318481 - protein, 9 aa, Homo Sapiens
RFHIAWSRL

SEQ ID NO: 1318482 - protein, 9 aa, Homo Sapiens
VQYQFTDSE

SEQ ID NO: 1318483 - protein, 9 aa, Homo Sapiens
DAPSEVDFQ

SEQ ID NO: 1318484 - protein, 9 aa, Homo Sapiens
MSRCEDLMY

SEQ ID NO: 1318485 - protein, 9 aa, Homo Sapiens
GDRFKIERR

SEQ ID NO: 1318486 - protein, 9 aa, Homo Sapiens
KVLIDNKHI

SEQ ID NO: 1318487 - protein, 9 aa, Homo Sapiens
HGNLLFLFP

SEQ ID NO: 1318488 - protein, 9 aa, Homo Sapiens
VTMVHPLLP

SEQ ID NO: 1318489 - protein, 9 aa, Homo Sapiens
RLVVKTTLK

SEQ ID NO: 1318490 - protein, 9 aa, Homo Sapiens
DGVASSCHA

SEQ ID NO: 1318491 - protein, 9 aa, Homo Sapiens
PQACSPERA

SEQ ID NO: 1318492 - protein, 9 aa, Homo Sapiens
SRGPCSDTL

SEQ ID NO: 1318493 - protein, 9 aa, Homo Sapiens
LTIHNRGKE

SEQ ID NO: 1318494 - protein, 9 aa, Homo Sapiens
TFDVAFVQP

SEQ ID NO: 1318495 - protein, 9 aa, Homo Sapiens
IPFTARVGG

SEQ ID NO: 1318496 - protein, 9 aa, Homo Sapiens
AMYVDNNCS

SEQ ID NO: 1318497 - protein, 9 aa, Homo Sapiens
YMADLGSRA

SEQ ID NO: 1318498 - protein, 9 aa, Homo Sapiens
QSLTHILTL

SEQ ID NO: 1318499 - protein, 9 aa, Homo Sapiens
SLATNLQED

SEQ ID NO: 1318500 - protein, 9 aa, Homo Sapiens
IQDAHINML

SEQ ID NO: 1318501 - protein, 9 aa, Homo Sapiens
IQPERVLYI

SEQ ID NO: 1318502 - protein, 9 aa, Homo Sapiens
DVLKWMVII

SEQ ID NO: 1318503 - protein, 9 aa, Homo Sapiens
DVRHVIFGD

SEQ ID NO: 1318504 - protein, 9 aa, Homo Sapiens
KCIRYVVDL

SEQ ID NO: 1318505 - protein, 9 aa, Homo Sapiens
NMFYAYVEM

SEQ ID NO: 1318506 - protein, 9 aa, Homo Sapiens
LIATAICAP

SEQ ID NO: 1318507 - protein, 9 aa, Homo Sapiens
SRMKHEVSA

SEQ ID NO: 1318508 - protein, 9 aa, Homo Sapiens
DKAFTWSSS

SEQ ID NO: 1318509 - protein, 9 aa, Homo Sapiens
PLWDDLCCR

SEQ ID NO: 1318510 - protein, 9 aa, Homo Sapiens
QADQNNPHK

SEQ ID NO: 1318511 - protein, 9 aa, Homo Sapiens
NGASCFSGM

SEQ ID NO: 1318512 - protein, 9 aa, Homo Sapiens
QKMCPFGRA

SEQ ID NO: 1318513 - protein, 9 aa, Homo Sapiens
HEGGYWCEL

SEQ ID NO: 1318514 - protein, 9 aa, Homo Sapiens
DVYRTGVKC

SEQ ID NO: 1318515 - protein, 9 aa, Homo Sapiens
PISPKEIEW

SEQ ID NO: 1318516 - protein, 9 aa, Homo Sapiens
EATCNDFLF

SEQ ID NO: 1318517 - protein, 9 aa, Homo Sapiens
EHSVLELVR

SEQ ID NO: 1318518 - protein, 9 aa, Homo Sapiens
DGEFVPQTC

SEQ ID NO: 1318519 - protein, 9 aa, Homo Sapiens
IEKTRMHLE

SEQ ID NO: 1318520 - protein, 9 aa, Homo Sapiens
YNVGLCHEH

SEQ ID NO: 1318521 - protein, 9 aa, Homo Sapiens
YHYYSRCLA

SEQ ID NO: 1318522 - protein, 9 aa, Homo Sapiens
VREDRVLGL

SEQ ID NO: 1318523 - protein, 9 aa, Homo Sapiens
VSNHVFNQS

SEQ ID NO: 1318524 - protein, 9 aa, Homo Sapiens
STVVTSKML

SEQ ID NO: 1318525 - protein, 9 aa, Homo Sapiens
NDDLAETVV

SEQ ID NO: 1318526 - protein, 9 aa, Homo Sapiens
LTESEQYSL

SEQ ID NO: 1318527 - protein, 9 aa, Homo Sapiens
AIINPQTAL

SEQ ID NO: 1318528 - protein, 9 aa, Homo Sapiens
VLVGSQKEP

SEQ ID NO: 1318529 - protein, 9 aa, Homo Sapiens
ISLSPMSFP

SEQ ID NO: 1318530 - protein, 9 aa, Homo Sapiens
LFKGFFPVT

SEQ ID NO: 1318531 - protein, 9 aa, Homo Sapiens
NPDPSNTAN

SEQ ID NO: 1318532 - protein, 9 aa, Homo Sapiens
GGSGDPFHS

SEQ ID NO: 1318533 - protein, 9 aa, Homo Sapiens
SLIRAPWNL

SEQ ID NO: 1318534 - protein, 9 aa, Homo Sapiens
IKYIGHYFI

SEQ ID NO: 1318535 - protein, 9 aa, Homo Sapiens
LGIYLPDLS

SEQ ID NO: 1318536 - protein, 9 aa, Homo Sapiens
AAMMTQSQP

SEQ ID NO: 1318537 - protein, 9 aa, Homo Sapiens
GIYGEWIPR

SEQ ID NO: 1318538 - protein, 9 aa, Homo Sapiens
EECLYLNIW

SEQ ID NO: 1318539 - protein, 9 aa, Homo Sapiens
RRIPRGRHI

SEQ ID NO: 1318540 - protein, 9 aa, Homo Sapiens
MRHYIKNPR

SEQ ID NO: 1318541 - protein, 9 aa, Homo Sapiens
CGCHVFEIL

SEQ ID NO: 1318542 - protein, 9 aa, Homo Sapiens
LLWKYGFFK

SEQ ID NO: 1318543 - protein, 9 aa, Homo Sapiens
PPLTPCPYF

SEQ ID NO: 1318544 - protein, 9 aa, Homo Sapiens
YIIRLVGEL

SEQ ID NO: 1318545 - protein, 9 aa, Homo Sapiens
SWFSDLLVP

SEQ ID NO: 1318546 - protein, 9 aa, Homo Sapiens
EVMEGSNMT

SEQ ID NO: 1318547 - protein, 9 aa, Homo Sapiens
DLADGAHVW

SEQ ID NO: 1318548 - protein, 9 aa, Homo Sapiens
GTPGPGPHL

SEQ ID NO: 1318549 - protein, 9 aa, Homo Sapiens
PGGCITIPE

SEQ ID NO: 1318550 - protein, 9 aa, Homo Sapiens
DGLGPCTME

SEQ ID NO: 1318551 - protein, 9 aa, Homo Sapiens
GFVCTALQH

SEQ ID NO: 1318552 - protein, 9 aa, Homo Sapiens
TPRTVYTKS

SEQ ID NO: 1318553 - protein, 9 aa, Homo Sapiens
IMAELESDD

SEQ ID NO: 1318554 - protein, 9 aa, Homo Sapiens
QYVYRVLFS

SEQ ID NO: 1318555 - protein, 9 aa, Homo Sapiens
QCTYTFGKE

SEQ ID NO: 1318556 - protein, 9 aa, Homo Sapiens
WGVSEAPGG

SEQ ID NO: 1318557 - protein, 9 aa, Homo Sapiens
RLCLLPTGT

SEQ ID NO: 1318558 - protein, 9 aa, Homo Sapiens
ALRTIQVWQ

SEQ ID NO: 1318559 - protein, 9 aa, Homo Sapiens
IIPNGVKYL

SEQ ID NO: 1318560 - protein, 9 aa, Homo Sapiens
LERVTVSHL

SEQ ID NO: 1318561 - protein, 9 aa, Homo Sapiens
GISLNVLPK

SEQ ID NO: 1318562 - protein, 9 aa, Homo Sapiens
RHQVLTRIG

SEQ ID NO: 1318563 - protein, 9 aa, Homo Sapiens
RIRDVKCVS

SEQ ID NO: 1318564 - protein, 9 aa, Homo Sapiens
VLHTIRMTI

SEQ ID NO: 1318565 - protein, 9 aa, Homo Sapiens
SATPLYGNI

SEQ ID NO: 1318566 - protein, 9 aa, Homo Sapiens
DLEDLKHQV

SEQ ID NO: 1318567 - protein, 9 aa, Homo Sapiens
PGVGLAPQL

SEQ ID NO: 1318568 - protein, 9 aa, Homo Sapiens
EFLLRVGAI

SEQ ID NO: 1318569 - protein, 9 aa, Homo Sapiens
YCGCESPNL

SEQ ID NO: 1318570 - protein, 9 aa, Homo Sapiens
HSTPQMSAT

SEQ ID NO: 1318571 - protein, 9 aa, Homo Sapiens
SASTPVRSP

SEQ ID NO: 1318572 - protein, 9 aa, Homo Sapiens
KHAPARAPA

SEQ ID NO: 1318573 - protein, 9 aa, Homo Sapiens
GNQALYSWP

SEQ ID NO: 1318574 - protein, 9 aa, Homo Sapiens
AKDLGSQPC

SEQ ID NO: 1318575 - protein, 9 aa, Homo Sapiens
ALWRTDRPK

SEQ ID NO: 1318576 - protein, 9 aa, Homo Sapiens
GIHGGDPED

SEQ ID NO: 1318577 - protein, 9 aa, Homo Sapiens
LGSRPPCSV

SEQ ID NO: 1318578 - protein, 9 aa, Homo Sapiens
GYLGKSLIK

SEQ ID NO: 1318579 - protein, 9 aa, Homo Sapiens
AWDTSNHGL

SEQ ID NO: 1318580 - protein, 9 aa, Homo Sapiens
SACGHHGPC

SEQ ID NO: 1318581 - protein, 9 aa, Homo Sapiens
VEEKDKSPV

SEQ ID NO: 1318582 - protein, 9 aa, Homo Sapiens
IENCICVNM

SEQ ID NO: 1318583 - protein, 9 aa, Homo Sapiens
PTSLQRSLF

SEQ ID NO: 1318584 - protein, 9 aa, Homo Sapiens
KMLAVYLYE

SEQ ID NO: 1318585 - protein, 9 aa, Homo Sapiens
DRCVSILCY

SEQ ID NO: 1318586 - protein, 9 aa, Homo Sapiens
RVSHASVWL

SEQ ID NO: 1318587 - protein, 9 aa, Homo Sapiens
QPGSEAPAL

SEQ ID NO: 1318588 - protein, 9 aa, Homo Sapiens
TQGTDKLQC

SEQ ID NO: 1318589 - protein, 9 aa, Homo Sapiens
HCNSEEMWR

SEQ ID NO: 1318590 - protein, 9 aa, Homo Sapiens
QQLKVSVKN

SEQ ID NO: 1318591 - protein, 9 aa, Homo Sapiens
TLGGPLPPT

SEQ ID NO: 1318592 - protein, 9 aa, Homo Sapiens
SSHIPQSNS

SEQ ID NO: 1318593 - protein, 9 aa, Homo Sapiens
LPNIPICLA

SEQ ID NO: 1318594 - protein, 9 aa, Homo Sapiens
AMAFDRFMA

SEQ ID NO: 1318595 - protein, 9 aa, Homo Sapiens
TSASTRASG

SEQ ID NO: 1318596 - protein, 9 aa, Homo Sapiens
WAMRSYTGQ

SEQ ID NO: 1318597 - protein, 9 aa, Homo Sapiens
LDGQDSPIP

SEQ ID NO: 1318598 - protein, 9 aa, Homo Sapiens
ENPDTSPAL

SEQ ID NO: 1318599 - protein, 9 aa, Homo Sapiens
TPMLGLDES

SEQ ID NO: 1318600 - protein, 9 aa, Homo Sapiens
HDIHTILSA

SEQ ID NO: 1318601 - protein, 9 aa, Homo Sapiens
GQALHLNRS

SEQ ID NO: 1318602 - protein, 9 aa, Homo Sapiens
KSPWMMVIG

SEQ ID NO: 1318603 - protein, 9 aa, Homo Sapiens
SRKSQEPDF

SEQ ID NO: 1318604 - protein, 9 aa, Homo Sapiens
YNKLTLKTI

SEQ ID NO: 1318605 - protein, 9 aa, Homo Sapiens
TKETGKILS

SEQ ID NO: 1318606 - protein, 9 aa, Homo Sapiens
LKKRAYLAH

SEQ ID NO: 1318607 - protein, 9 aa, Homo Sapiens
NFTLNHIEM

SEQ ID NO: 1318608 - protein, 9 aa, Homo Sapiens
REWCAKVQG

SEQ ID NO: 1318609 - protein, 9 aa, Homo Sapiens
MRRSYEAIT

SEQ ID NO: 1318610 - protein, 9 aa, Homo Sapiens
AVQVVRARE

SEQ ID NO: 1318611 - protein, 9 aa, Homo Sapiens
HFETPCDDI

SEQ ID NO: 1318612 - protein, 9 aa, Homo Sapiens
PCWTHARTS

SEQ ID NO: 1318613 - protein, 9 aa, Homo Sapiens
DKETNQDFL

SEQ ID NO: 1318614 - protein, 9 aa, Homo Sapiens
KPPLVDNPN

SEQ ID NO: 1318615 - protein, 9 aa, Homo Sapiens
PQKGISVMP

SEQ ID NO: 1318616 - protein, 9 aa, Homo Sapiens
WDMCNHTSG

SEQ ID NO: 1318617 - protein, 9 aa, Homo Sapiens
ILSEFYEPE

SEQ ID NO: 1318618 - protein, 9 aa, Homo Sapiens
VCALLCGVG

SEQ ID NO: 1318619 - protein, 9 aa, Homo Sapiens
AERERAARA

SEQ ID NO: 1318620 - protein, 9 aa, Homo Sapiens
KVNTIWAHD

SEQ ID NO: 1318621 - protein, 9 aa, Homo Sapiens
ACITYIRLT

SEQ ID NO: 1318622 - protein, 9 aa, Homo Sapiens
FMLPIHLQS

SEQ ID NO: 1318623 - protein, 9 aa, Homo Sapiens
PWMMNIKED

SEQ ID NO: 1318624 - protein, 9 aa, Homo Sapiens
ETWEGTGPS

SEQ ID NO: 1318625 - protein, 9 aa, Homo Sapiens
DGAYIHVPQ

SEQ ID NO: 1318626 - protein, 9 aa, Homo Sapiens
ANFWVTSSM

SEQ ID NO: 1318627 - protein, 9 aa, Homo Sapiens
RDKTRKRCS

SEQ ID NO: 1318628 - protein, 9 aa, Homo Sapiens
TGQPPAWYG

SEQ ID NO: 1318629 - protein, 9 aa, Homo Sapiens
DSMLQMLEQ

SEQ ID NO: 1318630 - protein, 9 aa, Homo Sapiens
CVLWKKGLS

SEQ ID NO: 1318631 - protein, 9 aa, Homo Sapiens
APPPPPPSP

SEQ ID NO: 1318632 - protein, 9 aa, Homo Sapiens
KSGKMTHPL

SEQ ID NO: 1318633 - protein, 9 aa, Homo Sapiens
TSLKGIPKQ

SEQ ID NO: 1318634 - protein, 9 aa, Homo Sapiens
RDSAKERVS

SEQ ID NO: 1318635 - protein, 9 aa, Homo Sapiens
AEIQKEDPK

SEQ ID NO: 1318636 - protein, 9 aa, Homo Sapiens
LTNGVSAGN

SEQ ID NO: 1318637 - protein, 9 aa, Homo Sapiens
VEYITHSCD

SEQ ID NO: 1318638 - protein, 9 aa, Homo Sapiens
LDQVRKHLG

SEQ ID NO: 1318639 - protein, 9 aa, Homo Sapiens
NTRQKTRES

SEQ ID NO: 1318640 - protein, 9 aa, Homo Sapiens
YSDLSDTLV

SEQ ID NO: 1318641 - protein, 9 aa, Homo Sapiens
CHKSLSLGE

SEQ ID NO: 1318642 - protein, 9 aa, Homo Sapiens
GSEDGTVCI

SEQ ID NO: 1318643 - protein, 9 aa, Homo Sapiens
FNHPEFEED

SEQ ID NO: 1318644 - protein, 9 aa, Homo Sapiens
HYPKASVQY

SEQ ID NO: 1318645 - protein, 9 aa, Homo Sapiens
HARSTRKKW

SEQ ID NO: 1318646 - protein, 9 aa, Homo Sapiens
VFQVIRCPL

SEQ ID NO: 1318647 - protein, 9 aa, Homo Sapiens
SHIDVMSTD

SEQ ID NO: 1318648 - protein, 9 aa, Homo Sapiens
DYVLHNMMV

SEQ ID NO: 1318649 - protein, 9 aa, Homo Sapiens
LENTHYQLY

SEQ ID NO: 1318650 - protein, 9 aa, Homo Sapiens
LPTYFSPYN

SEQ ID NO: 1318651 - protein, 9 aa, Homo Sapiens
HGSRCYGVC

SEQ ID NO: 1318652 - protein, 9 aa, Homo Sapiens
ATGECHDAL

SEQ ID NO: 1318653 - protein, 9 aa, Homo Sapiens
QKKIRKTSQ

SEQ ID NO: 1318654 - protein, 9 aa, Homo Sapiens
CPVDRTTIS

SEQ ID NO: 1318655 - protein, 9 aa, Homo Sapiens
LAYSGPGSV

SEQ ID NO: 1318656 - protein, 9 aa, Homo Sapiens
KLRGFSWWS

SEQ ID NO: 1318657 - protein, 9 aa, Homo Sapiens
RSPRSGTSS

SEQ ID NO: 1318658 - protein, 9 aa, Homo Sapiens
SSIFTKDLD

SEQ ID NO: 1318659 - protein, 9 aa, Homo Sapiens
VAQGELKRV

SEQ ID NO: 1318660 - protein, 9 aa, Homo Sapiens
GFPEPFHSK

SEQ ID NO: 1318661 - protein, 9 aa, Homo Sapiens
LTMGMIFFC

SEQ ID NO: 1318662 - protein, 9 aa, Homo Sapiens
FHFQVFKMH

SEQ ID NO: 1318663 - protein, 9 aa, Homo Sapiens
TSLVLNDIR

SEQ ID NO: 1318664 - protein, 9 aa, Homo Sapiens
QALPGTISQ

SEQ ID NO: 1318665 - protein, 9 aa, Homo Sapiens
LWRTAMRVS

SEQ ID NO: 1318666 - protein, 9 aa, Homo Sapiens
IVITDFRKD

SEQ ID NO: 1318667 - protein, 9 aa, Homo Sapiens
DYIEAIYSL

SEQ ID NO: 1318668 - protein, 9 aa, Homo Sapiens
YSPENGSIT

SEQ ID NO: 1318669 - protein, 9 aa, Homo Sapiens
RVSGPSSAC

SEQ ID NO: 1318670 - protein, 9 aa, Homo Sapiens
RNHQGARLS

SEQ ID NO: 1318671 - protein, 9 aa, Homo Sapiens
STYGDEECL

SEQ ID NO: 1318672 - protein, 9 aa, Homo Sapiens
RVGAICFGL

SEQ ID NO: 1318673 - protein, 9 aa, Homo Sapiens
ESEQARVRA

SEQ ID NO: 1318674 - protein, 9 aa, Homo Sapiens
SWITRSPFH

SEQ ID NO: 1318675 - protein, 9 aa, Homo Sapiens
SVVPGKRAH

SEQ ID NO: 1318676 - protein, 9 aa, Homo Sapiens
MGLEITCTA

SEQ ID NO: 1318677 - protein, 9 aa, Homo Sapiens
VILHQGCLL

SEQ ID NO: 1318678 - protein, 9 aa, Homo Sapiens
IWDMAGQER

SEQ ID NO: 1318679 - protein, 9 aa, Homo Sapiens
IQIDATINY

SEQ ID NO: 1318680 - protein, 9 aa, Homo Sapiens
GQIIPIYSF

SEQ ID NO: 1318681 - protein, 9 aa, Homo Sapiens
IFDEIILST

SEQ ID NO: 1318682 - protein, 9 aa, Homo Sapiens
SPVDRVMKQ

SEQ ID NO: 1318683 - protein, 9 aa, Homo Sapiens
DSVSLIAQY

SEQ ID NO: 1318684 - protein, 9 aa, Homo Sapiens
ELGYNMYAS

SEQ ID NO: 1318685 - protein, 9 aa, Homo Sapiens
RQDLMRHQE

SEQ ID NO: 1318686 - protein, 9 aa, Homo Sapiens
HIEMTWKCL

SEQ ID NO: 1318687 - protein, 9 aa, Homo Sapiens
LGQYGFVLE

SEQ ID NO: 1318688 - protein, 9 aa, Homo Sapiens
LYEQGRYSF

SEQ ID NO: 1318689 - protein, 9 aa, Homo Sapiens
STCTSASTR

SEQ ID NO: 1318690 - protein, 9 aa, Homo Sapiens
YVLKQERAK

SEQ ID NO: 1318691 - protein, 9 aa, Homo Sapiens
HTVALTRDS

SEQ ID NO: 1318692 - protein, 9 aa, Homo Sapiens
SKVSAFAFM

SEQ ID NO: 1318693 - protein, 9 aa, Homo Sapiens
FFFIFIFFR

SEQ ID NO: 1318694 - protein, 9 aa, Homo Sapiens
EMTWKCLVR

SEQ ID NO: 1318695 - protein, 9 aa, Homo Sapiens
AFAPVTYLR

SEQ ID NO: 1318696 - protein, 9 aa, Homo Sapiens
HDLDLRVCC

SEQ ID NO: 1318697 - protein, 9 aa, Homo Sapiens
MKALSTVRG

SEQ ID NO: 1318698 - protein, 9 aa, Homo Sapiens
GWCTGAIIP

SEQ ID NO: 1318699 - protein, 9 aa, Homo Sapiens
ATCFDAVQG

SEQ ID NO: 1318700 - protein, 9 aa, Homo Sapiens
PEELKQLLH

SEQ ID NO: 1318701 - protein, 9 aa, Homo Sapiens
RYLRMTVLT

SEQ ID NO: 1318702 - protein, 9 aa, Homo Sapiens
EKKFFVKTA

SEQ ID NO: 1318703 - protein, 9 aa, Homo Sapiens
MLPQSYHTP

SEQ ID NO: 1318704 - protein, 9 aa, Homo Sapiens
PPSSPTPRT

SEQ ID NO: 1318705 - protein, 9 aa, Homo Sapiens
THPLCKCGR

SEQ ID NO: 1318706 - protein, 9 aa, Homo Sapiens
LLGENDDMP

SEQ ID NO: 1318707 - protein, 9 aa, Homo Sapiens
WRPELLWMC

SEQ ID NO: 1318708 - protein, 9 aa, Homo Sapiens
SMLQMLEQY

SEQ ID NO: 1318709 - protein, 9 aa, Homo Sapiens
CSPPSPQNR

SEQ ID NO: 1318710 - protein, 9 aa, Homo Sapiens
FYDQKVNHF

SEQ ID NO: 1318711 - protein, 9 aa, Homo Sapiens
KGRHSFQYF

SEQ ID NO: 1318712 - protein, 9 aa, Homo Sapiens
CVQKDSQPY

SEQ ID NO: 1318713 - protein, 9 aa, Homo Sapiens
HSQTSSIPQ

SEQ ID NO: 1318714 - protein, 9 aa, Homo Sapiens
ISVIPASVL

SEQ ID NO: 1318715 - protein, 9 aa, Homo Sapiens
CRLLWIAQR

SEQ ID NO: 1318716 - protein, 9 aa, Homo Sapiens
HLDQNDPHF

SEQ ID NO: 1318717 - protein, 9 aa, Homo Sapiens
LSSGLVMAA

SEQ ID NO: 1318718 - protein, 9 aa, Homo Sapiens
FWLRSKKRK

SEQ ID NO: 1318719 - protein, 9 aa, Homo Sapiens
LPIVPSHVI

SEQ ID NO: 1318720 - protein, 9 aa, Homo Sapiens
RLHRVGRFS

SEQ ID NO: 1318721 - protein, 9 aa, Homo Sapiens
CVHKVAERL

SEQ ID NO: 1318722 - protein, 9 aa, Homo Sapiens
DQTTTEQGM

SEQ ID NO: 1318723 - protein, 9 aa, Homo Sapiens
YHPQFCLSK

SEQ ID NO: 1318724 - protein, 9 aa, Homo Sapiens
EEVEVTPPK

SEQ ID NO: 1318725 - protein, 9 aa, Homo Sapiens
GQIVISLDL

SEQ ID NO: 1318726 - protein, 9 aa, Homo Sapiens
ERIHHSNLV

SEQ ID NO: 1318727 - protein, 9 aa, Homo Sapiens
DHWGPYFAE

SEQ ID NO: 1318728 - protein, 9 aa, Homo Sapiens
GWDEKTLRS

SEQ ID NO: 1318729 - protein, 9 aa, Homo Sapiens
LDDHLSRYQ

SEQ ID NO: 1318730 - protein, 9 aa, Homo Sapiens
IYGLKEDEA

SEQ ID NO: 1318731 - protein, 9 aa, Homo Sapiens
DDIPFTARV

SEQ ID NO: 1318732 - protein, 9 aa, Homo Sapiens
HKKEETRCK

SEQ ID NO: 1318733 - protein, 9 aa, Homo Sapiens
VVEVMEGSN

SEQ ID NO: 1318734 - protein, 9 aa, Homo Sapiens
ASYTANLVA

SEQ ID NO: 1318735 - protein, 9 aa, Homo Sapiens
AYIIGRRKS

SEQ ID NO: 1318736 - protein, 9 aa, Homo Sapiens
SAGRAPGRA

SEQ ID NO: 1318737 - protein, 9 aa, Homo Sapiens
WIITQRNSS

SEQ ID NO: 1318738 - protein, 9 aa, Homo Sapiens
GYRCNIDRT

SEQ ID NO: 1318739 - protein, 9 aa, Homo Sapiens
RIKNQRLNR

SEQ ID NO: 1318740 - protein, 9 aa, Homo Sapiens
LPKKQQVSA

SEQ ID NO: 1318741 - protein, 9 aa, Homo Sapiens
IYLPDLSVT

SEQ ID NO: 1318742 - protein, 9 aa, Homo Sapiens
IMARRQHLK

SEQ ID NO: 1318743 - protein, 9 aa, Homo Sapiens
DALNTEELC

SEQ ID NO: 1318744 - protein, 9 aa, Homo Sapiens
IRAPPAATN

SEQ ID NO: 1318745 - protein, 9 aa, Homo Sapiens
RGHYFKVWL

SEQ ID NO: 1318746 - protein, 9 aa, Homo Sapiens
AVILIATAI

SEQ ID NO: 1318747 - protein, 9 aa, Homo Sapiens
QDHTYCVFK

SEQ ID NO: 1318748 - protein, 9 aa, Homo Sapiens
EHSARYQYF

SEQ ID NO: 1318749 - protein, 9 aa, Homo Sapiens
FLANVSRAR

SEQ ID NO: 1318750 - protein, 9 aa, Homo Sapiens
SSSQHRPSY

SEQ ID NO: 1318751 - protein, 9 aa, Homo Sapiens
PSVIPTRTA

SEQ ID NO: 1318752 - protein, 9 aa, Homo Sapiens
PLQVTTTLK

SEQ ID NO: 1318753 - protein, 9 aa, Homo Sapiens
GKDKKFLEK

SEQ ID NO: 1318754 - protein, 9 aa, Homo Sapiens
QFLCAWDFN

SEQ ID NO: 1318755 - protein, 9 aa, Homo Sapiens
ATLESAKGA

SEQ ID NO: 1318756 - protein, 9 aa, Homo Sapiens
YTCPCPSMF

SEQ ID NO: 1318757 - protein, 9 aa, Homo Sapiens
DQERVLLAT

SEQ ID NO: 1318758 - protein, 9 aa, Homo Sapiens
RDQDLFLLR

SEQ ID NO: 1318759 - protein, 9 aa, Homo Sapiens
KECGKTFGS

SEQ ID NO: 1318760 - protein, 9 aa, Homo Sapiens
RVGHPNHNK

SEQ ID NO: 1318761 - protein, 9 aa, Homo Sapiens
EPMSNPIDE

SEQ ID NO: 1318762 - protein, 9 aa, Homo Sapiens
YYADITKMP

SEQ ID NO: 1318763 - protein, 9 aa, Homo Sapiens
KAQCYADFT

SEQ ID NO: 1318764 - protein, 9 aa, Homo Sapiens
RYKGIHPAP

SEQ ID NO: 1318765 - protein, 9 aa, Homo Sapiens
DVMSTDFFL

SEQ ID NO: 1318766 - protein, 9 aa, Homo Sapiens
PAKKCSLTL

SEQ ID NO: 1318767 - protein, 9 aa, Homo Sapiens
SAEITWYHA

SEQ ID NO: 1318768 - protein, 9 aa, Homo Sapiens
RSLLGAVNM

SEQ ID NO: 1318769 - protein, 9 aa, Homo Sapiens
EQIFFRWHY

SEQ ID NO: 1318770 - protein, 9 aa, Homo Sapiens
VMQLYQPGA

SEQ ID NO: 1318771 - protein, 9 aa, Homo Sapiens
WCHYFQNTQ

SEQ ID NO: 1318772 - protein, 9 aa, Homo Sapiens
THMQTVRGV

SEQ ID NO: 1318773 - protein, 9 aa, Homo Sapiens
VDQRKCEHL

SEQ ID NO: 1318774 - protein, 9 aa, Homo Sapiens
PNEIYNFFC

SEQ ID NO: 1318775 - protein, 9 aa, Homo Sapiens
GLSVSPMND

SEQ ID NO: 1318776 - protein, 9 aa, Homo Sapiens
RALQGGLRA

SEQ ID NO: 1318777 - protein, 9 aa, Homo Sapiens
KMMVNNYHP

SEQ ID NO: 1318778 - protein, 9 aa, Homo Sapiens
YDHYAAVCK

SEQ ID NO: 1318779 - protein, 9 aa, Homo Sapiens
GKIRTAVDS

SEQ ID NO: 1318780 - protein, 9 aa, Homo Sapiens
PAGSCESLP

SEQ ID NO: 1318781 - protein, 9 aa, Homo Sapiens
QNKLLARAV

SEQ ID NO: 1318782 - protein, 9 aa, Homo Sapiens
NHKFNESLV

SEQ ID NO: 1318783 - protein, 9 aa, Homo Sapiens
TVDFEWECG

SEQ ID NO: 1318784 - protein, 9 aa, Homo Sapiens
ITDLMEKSS

SEQ ID NO: 1318785 - protein, 9 aa, Homo Sapiens
MFGASTGPG

SEQ ID NO: 1318786 - protein, 9 aa, Homo Sapiens
VFSILVLWT

SEQ ID NO: 1318787 - protein, 9 aa, Homo Sapiens
SHASWVTND

SEQ ID NO: 1318788 - protein, 9 aa, Homo Sapiens
PIIYVFLSE

SEQ ID NO: 1318789 - protein, 9 aa, Homo Sapiens
IRKHIVLEK

SEQ ID NO: 1318790 - protein, 9 aa, Homo Sapiens
QSVRKALDS

SEQ ID NO: 1318791 - protein, 9 aa, Homo Sapiens
SFVESRFFP

SEQ ID NO: 1318792 - protein, 9 aa, Homo Sapiens
EAWKTYTEC

SEQ ID NO: 1318793 - protein, 9 aa, Homo Sapiens
ERLQAITAA

SEQ ID NO: 1318794 - protein, 9 aa, Homo Sapiens
EEPKDRTVA

SEQ ID NO: 1318795 - protein, 9 aa, Homo Sapiens
RHDSGIKAN

SEQ ID NO: 1318796 - protein, 9 aa, Homo Sapiens
GEWRQGGSP

SEQ ID NO: 1318797 - protein, 9 aa, Homo Sapiens
GPATFEIDL

SEQ ID NO: 1318798 - protein, 9 aa, Homo Sapiens
VVPQQPTLS

SEQ ID NO: 1318799 - protein, 9 aa, Homo Sapiens
EHREHILEL

SEQ ID NO: 1318800 - protein, 9 aa, Homo Sapiens
IPVFEGEHS

SEQ ID NO: 1318801 - protein, 9 aa, Homo Sapiens
ILVMLEIVT

SEQ ID NO: 1318802 - protein, 9 aa, Homo Sapiens
KIVMEKLSG

SEQ ID NO: 1318803 - protein, 9 aa, Homo Sapiens
VGLSLCIAV

SEQ ID NO: 1318804 - protein, 9 aa, Homo Sapiens
PCIEQVQHT

SEQ ID NO: 1318805 - protein, 9 aa, Homo Sapiens
GHLSMAAAD

SEQ ID NO: 1318806 - protein, 9 aa, Homo Sapiens
GLTHRRKLW

SEQ ID NO: 1318807 - protein, 9 aa, Homo Sapiens
REKHNIYKR

SEQ ID NO: 1318808 - protein, 9 aa, Homo Sapiens
LEVVVVHEL

SEQ ID NO: 1318809 - protein, 9 aa, Homo Sapiens
KINNENADA

SEQ ID NO: 1318810 - protein, 9 aa, Homo Sapiens
TQLRKKPTT

SEQ ID NO: 1318811 - protein, 9 aa, Homo Sapiens
ASGPHLFIS

SEQ ID NO: 1318812 - protein, 9 aa, Homo Sapiens
ASILRIRSA

SEQ ID NO: 1318813 - protein, 9 aa, Homo Sapiens
KEKDTEGKK

SEQ ID NO: 1318814 - protein, 9 aa, Homo Sapiens
NKHILSEFY

SEQ ID NO: 1318815 - protein, 9 aa, Homo Sapiens
MAPSGVEAQ

SEQ ID NO: 1318816 - protein, 9 aa, Homo Sapiens
NDVYSELSV

SEQ ID NO: 1318817 - protein, 9 aa, Homo Sapiens
TVAKLCESC

SEQ ID NO: 1318818 - protein, 9 aa, Homo Sapiens
RSDLQCCSE

SEQ ID NO: 1318819 - protein, 9 aa, Homo Sapiens
FEPGTWMCY

SEQ ID NO: 1318820 - protein, 9 aa, Homo Sapiens
QAFPALHFL

SEQ ID NO: 1318821 - protein, 9 aa, Homo Sapiens
AFTPEFQQT

SEQ ID NO: 1318822 - protein, 9 aa, Homo Sapiens
SEMVFNDCF

SEQ ID NO: 1318823 - protein, 9 aa, Homo Sapiens
RHSPGVMVT

SEQ ID NO: 1318824 - protein, 9 aa, Homo Sapiens
TVSSSSERG

SEQ ID NO: 1318825 - protein, 9 aa, Homo Sapiens
IEAYTSYSV

SEQ ID NO: 1318826 - protein, 9 aa, Homo Sapiens
KKSVWQRRR

SEQ ID NO: 1318827 - protein, 9 aa, Homo Sapiens
TPSSETSSS

SEQ ID NO: 1318828 - protein, 9 aa, Homo Sapiens
PSSVVKCST

SEQ ID NO: 1318829 - protein, 9 aa, Homo Sapiens
DCSHQHCLG

SEQ ID NO: 1318830 - protein, 9 aa, Homo Sapiens
LATNLQEDV

SEQ ID NO: 1318831 - protein, 9 aa, Homo Sapiens
GYLDILTEK

SEQ ID NO: 1318832 - protein, 9 aa, Homo Sapiens
TAIEMKDTK

SEQ ID NO: 1318833 - protein, 9 aa, Homo Sapiens
KMWLKLGLT

SEQ ID NO: 1318834 - protein, 9 aa, Homo Sapiens
MVGLARTLS

SEQ ID NO: 1318835 - protein, 9 aa, Homo Sapiens
PDMAYCLIS

SEQ ID NO: 1318836 - protein, 9 aa, Homo Sapiens
WHVVDEGAD

SEQ ID NO: 1318837 - protein, 9 aa, Homo Sapiens
NDQQVTEIS

SEQ ID NO: 1318838 - protein, 9 aa, Homo Sapiens
VAFLVLDEI

SEQ ID NO: 1318839 - protein, 9 aa, Homo Sapiens
NTQITMLQM

SEQ ID NO: 1318840 - protein, 9 aa, Homo Sapiens
LFLQCTISL

SEQ ID NO: 1318841 - protein, 9 aa, Homo Sapiens
YNESLQLKT

SEQ ID NO: 1318842 - protein, 9 aa, Homo Sapiens
SFHSSLATA

SEQ ID NO: 1318843 - protein, 9 aa, Homo Sapiens
IPKKLNIVR

SEQ ID NO: 1318844 - protein, 9 aa, Homo Sapiens
DLLLTRTIG

SEQ ID NO: 1318845 - protein, 9 aa, Homo Sapiens
YCKKIPSNN

SEQ ID NO: 1318846 - protein, 9 aa, Homo Sapiens
NTLPSFYHP

SEQ ID NO: 1318847 - protein, 9 aa, Homo Sapiens
MPNKEMMET

SEQ ID NO: 1318848 - protein, 9 aa, Homo Sapiens
EDPTYTPRE

SEQ ID NO: 1318849 - protein, 9 aa, Homo Sapiens
CQKLTLHQS

SEQ ID NO: 1318850 - protein, 9 aa, Homo Sapiens
QAEARHPVY

SEQ ID NO: 1318851 - protein, 9 aa, Homo Sapiens
GITGVCHHT

SEQ ID NO: 1318852 - protein, 9 aa, Homo Sapiens
PYGQPQPPI

SEQ ID NO: 1318853 - protein, 9 aa, Homo Sapiens
MWLKLGLTI

SEQ ID NO: 1318854 - protein, 9 aa, Homo Sapiens
SPSRELHLP

SEQ ID NO: 1318855 - protein, 9 aa, Homo Sapiens
GWPLCMLRL

SEQ ID NO: 1318856 - protein, 9 aa, Homo Sapiens
MTSECHPPL

SEQ ID NO: 1318857 - protein, 9 aa, Homo Sapiens
YFRLHLRYE

SEQ ID NO: 1318858 - protein, 9 aa, Homo Sapiens
PACADPHHV

SEQ ID NO: 1318859 - protein, 9 aa, Homo Sapiens
AEKPVRALL

SEQ ID NO: 1318860 - protein, 9 aa, Homo Sapiens
TYERCIMVD

SEQ ID NO: 1318861 - protein, 9 aa, Homo Sapiens
VMEKLSGHQ

SEQ ID NO: 1318862 - protein, 9 aa, Homo Sapiens
FLLFFSSVI

SEQ ID NO: 1318863 - protein, 9 aa, Homo Sapiens
FSYLGHDPV

SEQ ID NO: 1318864 - protein, 9 aa, Homo Sapiens
SCYDFFLLV

SEQ ID NO: 1318865 - protein, 9 aa, Homo Sapiens
GLEKDQIKM

SEQ ID NO: 1318866 - protein, 9 aa, Homo Sapiens
VDRTTISAG

SEQ ID NO: 1318867 - protein, 9 aa, Homo Sapiens
YFQFQNLHQ

SEQ ID NO: 1318868 - protein, 9 aa, Homo Sapiens
FEESFTDEP

SEQ ID NO: 1318869 - protein, 9 aa, Homo Sapiens
PGLPIHQTY

SEQ ID NO: 1318870 - protein, 9 aa, Homo Sapiens
NYRHSRLEG

SEQ ID NO: 1318871 - protein, 9 aa, Homo Sapiens
KYGKAHFLQ

SEQ ID NO: 1318872 - protein, 9 aa, Homo Sapiens
VAGAMTEKW

SEQ ID NO: 1318873 - protein, 9 aa, Homo Sapiens
ALSSIASTM

SEQ ID NO: 1318874 - protein, 9 aa, Homo Sapiens
VTGIDLENI

SEQ ID NO: 1318875 - protein, 9 aa, Homo Sapiens
MPGSHFVAV

SEQ ID NO: 1318876 - protein, 9 aa, Homo Sapiens
ERRWSRSRS

SEQ ID NO: 1318877 - protein, 9 aa, Homo Sapiens
NEKGVLKRR

SEQ ID NO: 1318878 - protein, 9 aa, Homo Sapiens
EENDQQVTE

SEQ ID NO: 1318879 - protein, 9 aa, Homo Sapiens
DTKAPRVPD

SEQ ID NO: 1318880 - protein, 9 aa, Homo Sapiens
RKPEELKGL

SEQ ID NO: 1318881 - protein, 9 aa, Homo Sapiens
VTATRNFGF

SEQ ID NO: 1318882 - protein, 9 aa, Homo Sapiens
IDWGKHCVD

SEQ ID NO: 1318883 - protein, 9 aa, Homo Sapiens
DHTASGHRT

SEQ ID NO: 1318884 - protein, 9 aa, Homo Sapiens
NLNPEFIQS

SEQ ID NO: 1318885 - protein, 9 aa, Homo Sapiens
VTPELCPGV

SEQ ID NO: 1318886 - protein, 9 aa, Homo Sapiens
AGILICIMK

SEQ ID NO: 1318887 - protein, 9 aa, Homo Sapiens
IYVFLSENF

SEQ ID NO: 1318888 - protein, 9 aa, Homo Sapiens
GVLSLPTYF

SEQ ID NO: 1318889 - protein, 9 aa, Homo Sapiens
HKYLIGMLA

SEQ ID NO: 1318890 - protein, 9 aa, Homo Sapiens
EEPLVSIPF

SEQ ID NO: 1318891 - protein, 9 aa, Homo Sapiens
HINNKLRWG

SEQ ID NO: 1318892 - protein, 9 aa, Homo Sapiens
DHYYAVCDP

SEQ ID NO: 1318893 - protein, 9 aa, Homo Sapiens
FSRRRRLEM

SEQ ID NO: 1318894 - protein, 9 aa, Homo Sapiens
RALDVPSGI

SEQ ID NO: 1318895 - protein, 9 aa, Homo Sapiens
SAHTRLQEM

SEQ ID NO: 1318896 - protein, 9 aa, Homo Sapiens
ALSMYQLEL

SEQ ID NO: 1318897 - protein, 9 aa, Homo Sapiens
CQYVLSNQY

SEQ ID NO: 1318898 - protein, 9 aa, Homo Sapiens
DDQCPAGPK

SEQ ID NO: 1318899 - protein, 9 aa, Homo Sapiens
HQEHEVCMS

SEQ ID NO: 1318900 - protein, 9 aa, Homo Sapiens
SVHLKEGDQ

SEQ ID NO: 1318901 - protein, 9 aa, Homo Sapiens
GITFVPHWT

SEQ ID NO: 1318902 - protein, 9 aa, Homo Sapiens
IPPTSISCS

SEQ ID NO: 1318903 - protein, 9 aa, Homo Sapiens
KGISRYIVS

SEQ ID NO: 1318904 - protein, 9 aa, Homo Sapiens
KYQYIHQKS

SEQ ID NO: 1318905 - protein, 9 aa, Homo Sapiens
FDHVFHGNE

SEQ ID NO: 1318906 - protein, 9 aa, Homo Sapiens
DFWWLVDSA

SEQ ID NO: 1318907 - protein, 9 aa, Homo Sapiens
RQHHLVHAQ

SEQ ID NO: 1318908 - protein, 9 aa, Homo Sapiens
ILVEKVQMY

SEQ ID NO: 1318909 - protein, 9 aa, Homo Sapiens
IGPNMAILF

SEQ ID NO: 1318910 - protein, 9 aa, Homo Sapiens
HRKPTSDEA

SEQ ID NO: 1318911 - protein, 9 aa, Homo Sapiens
YLEIEEHNF

SEQ ID NO: 1318912 - protein, 9 aa, Homo Sapiens
DDDASNLVG

SEQ ID NO: 1318913 - protein, 9 aa, Homo Sapiens
KKLQRRDNM

SEQ ID NO: 1318914 - protein, 9 aa, Homo Sapiens
VTDLRHTLQ

SEQ ID NO: 1318915 - protein, 9 aa, Homo Sapiens
DAMELAARA

SEQ ID NO: 1318916 - protein, 9 aa, Homo Sapiens
TPRKMRHMY

SEQ ID NO: 1318917 - protein, 9 aa, Homo Sapiens
DNCKELEWL

SEQ ID NO: 1318918 - protein, 9 aa, Homo Sapiens
SHSGREDTR

SEQ ID NO: 1318919 - protein, 9 aa, Homo Sapiens
QEIEHLTRE

SEQ ID NO: 1318920 - protein, 9 aa, Homo Sapiens
SHQPGSEAP

SEQ ID NO: 1318921 - protein, 9 aa, Homo Sapiens
TSHFAWTFH

SEQ ID NO: 1318922 - protein, 9 aa, Homo Sapiens
VKFKYAHEY

SEQ ID NO: 1318923 - protein, 9 aa, Homo Sapiens
TRGRTRARS

SEQ ID NO: 1318924 - protein, 9 aa, Homo Sapiens
VGGVSTSWG

SEQ ID NO: 1318925 - protein, 9 aa, Homo Sapiens
ANIGDTQAM

SEQ ID NO: 1318926 - protein, 9 aa, Homo Sapiens
KEWERAILS

SEQ ID NO: 1318927 - protein, 9 aa, Homo Sapiens
QSQVAASTH

SEQ ID NO: 1318928 - protein, 9 aa, Homo Sapiens
SQIPRCQPK

SEQ ID NO: 1318929 - protein, 9 aa, Homo Sapiens
NRSTCPLAN

SEQ ID NO: 1318930 - protein, 9 aa, Homo Sapiens
GIYTYLLEK

SEQ ID NO: 1318931 - protein, 9 aa, Homo Sapiens
SESLTVSSP

SEQ ID NO: 1318932 - protein, 9 aa, Homo Sapiens
TIEKLRMEP

SEQ ID NO: 1318933 - protein, 9 aa, Homo Sapiens
GNLDTKVEY

SEQ ID NO: 1318934 - protein, 9 aa, Homo Sapiens
QINMTDGPH

SEQ ID NO: 1318935 - protein, 9 aa, Homo Sapiens
GKDCIASLP

SEQ ID NO: 1318936 - protein, 9 aa, Homo Sapiens
HSGVSVQDQ

SEQ ID NO: 1318937 - protein, 9 aa, Homo Sapiens
TLFSLNGRT

SEQ ID NO: 1318938 - protein, 9 aa, Homo Sapiens
GPVMMVLQG

SEQ ID NO: 1318939 - protein, 9 aa, Homo Sapiens
ACDVERLQQ

SEQ ID NO: 1318940 - protein, 9 aa, Homo Sapiens
ILIKNALNL

SEQ ID NO: 1318941 - protein, 9 aa, Homo Sapiens
QDYSSMVID

SEQ ID NO: 1318942 - protein, 9 aa, Homo Sapiens
FPPSKLAFS

SEQ ID NO: 1318943 - protein, 9 aa, Homo Sapiens
CDKQGYNAV

SEQ ID NO: 1318944 - protein, 9 aa, Homo Sapiens
EEFVIVERI

SEQ ID NO: 1318945 - protein, 9 aa, Homo Sapiens
WWERADMWP

SEQ ID NO: 1318946 - protein, 9 aa, Homo Sapiens
HIPENVPVG

SEQ ID NO: 1318947 - protein, 9 aa, Homo Sapiens
SVTSCLASL

SEQ ID NO: 1318948 - protein, 9 aa, Homo Sapiens
WRRRQQERR

SEQ ID NO: 1318949 - protein, 9 aa, Homo Sapiens
IQAAGKLAL

SEQ ID NO: 1318950 - protein, 9 aa, Homo Sapiens
MCEQVLLIK

SEQ ID NO: 1318951 - protein, 9 aa, Homo Sapiens
VDISLSLYP

SEQ ID NO: 1318952 - protein, 9 aa, Homo Sapiens
VLPDEVISI

SEQ ID NO: 1318953 - protein, 9 aa, Homo Sapiens
RNPYLVTKL

SEQ ID NO: 1318954 - protein, 9 aa, Homo Sapiens
KNVGSKRHA

SEQ ID NO: 1318955 - protein, 9 aa, Homo Sapiens
ALGHTWHNT

SEQ ID NO: 1318956 - protein, 9 aa, Homo Sapiens
TNTHITEHY

SEQ ID NO: 1318957 - protein, 9 aa, Homo Sapiens
FVETSELWN

SEQ ID NO: 1318958 - protein, 9 aa, Homo Sapiens
QIPSHLMQY

SEQ ID NO: 1318959 - protein, 9 aa, Homo Sapiens
EQELVKHAD

SEQ ID NO: 1318960 - protein, 9 aa, Homo Sapiens
CLADLEGVN

SEQ ID NO: 1318961 - protein, 9 aa, Homo Sapiens
AVHEASVPA

SEQ ID NO: 1318962 - protein, 9 aa, Homo Sapiens
NNVIVRNVE

SEQ ID NO: 1318963 - protein, 9 aa, Homo Sapiens
SMQPVVLVG

SEQ ID NO: 1318964 - protein, 9 aa, Homo Sapiens
TYNSYLAKH

SEQ ID NO: 1318965 - protein, 9 aa, Homo Sapiens
LRAIYTIMC

SEQ ID NO: 1318966 - protein, 9 aa, Homo Sapiens
KSHAFVGSV

SEQ ID NO: 1318967 - protein, 9 aa, Homo Sapiens
ESGAGKTEV

SEQ ID NO: 1318968 - protein, 9 aa, Homo Sapiens
DCTPANWTL

SEQ ID NO: 1318969 - protein, 9 aa, Homo Sapiens
FYLRNFNNC

SEQ ID NO: 1318970 - protein, 9 aa, Homo Sapiens
KEAYSAATA

SEQ ID NO: 1318971 - protein, 9 aa, Homo Sapiens
MQDEFLLKS

SEQ ID NO: 1318972 - protein, 9 aa, Homo Sapiens
DRLSHRLHQ

SEQ ID NO: 1318973 - protein, 9 aa, Homo Sapiens
PRAIEAAGA

SEQ ID NO: 1318974 - protein, 9 aa, Homo Sapiens
HWDAEYFLF

SEQ ID NO: 1318975 - protein, 9 aa, Homo Sapiens
PIPNLVGIH

SEQ ID NO: 1318976 - protein, 9 aa, Homo Sapiens
SGTPSGSSS

SEQ ID NO: 1318977 - protein, 9 aa, Homo Sapiens
MIYLLPRCT

SEQ ID NO: 1318978 - protein, 9 aa, Homo Sapiens
QPVGSSVRL

SEQ ID NO: 1318979 - protein, 9 aa, Homo Sapiens
RAWYLIVWE

SEQ ID NO: 1318980 - protein, 9 aa, Homo Sapiens
MCGGDGTSM

SEQ ID NO: 1318981 - protein, 9 aa, Homo Sapiens
MYHYNAGVK

SEQ ID NO: 1318982 - protein, 9 aa, Homo Sapiens
SPLRESTLM

SEQ ID NO: 1318983 - protein, 9 aa, Homo Sapiens
VVTWDPRGY

SEQ ID NO: 1318984 - protein, 9 aa, Homo Sapiens
NIIDSMLQM

SEQ ID NO: 1318985 - protein, 9 aa, Homo Sapiens
YLVVGNYRL

SEQ ID NO: 1318986 - protein, 9 aa, Homo Sapiens
HNILTQLEM

SEQ ID NO: 1318987 - protein, 9 aa, Homo Sapiens
KMRMVIGVI

SEQ ID NO: 1318988 - protein, 9 aa, Homo Sapiens
ELAILLCDG

SEQ ID NO: 1318989 - protein, 9 aa, Homo Sapiens
KIGCDNFGE

SEQ ID NO: 1318990 - protein, 9 aa, Homo Sapiens
IMTFFKKSK

SEQ ID NO: 1318991 - protein, 9 aa, Homo Sapiens
VMGSTSIPL

SEQ ID NO: 1318992 - protein, 9 aa, Homo Sapiens
MAVELLFRD

SEQ ID NO: 1318993 - protein, 9 aa, Homo Sapiens
VKMPFVVEI

SEQ ID NO: 1318994 - protein, 9 aa, Homo Sapiens
SLMCEKWIL

SEQ ID NO: 1318995 - protein, 9 aa, Homo Sapiens
SEPNTHNGT

SEQ ID NO: 1318996 - protein, 9 aa, Homo Sapiens
NVVKESTRA

SEQ ID NO: 1318997 - protein, 9 aa, Homo Sapiens
SQHTELVFG

SEQ ID NO: 1318998 - protein, 9 aa, Homo Sapiens
SSGFNQEAN

SEQ ID NO: 1318999 - protein, 9 aa, Homo Sapiens
LVWYRHYFR

SEQ ID NO: 1319000 - protein, 9 aa, Homo Sapiens
CVKDYCFVR

SEQ ID NO: 1319001 - protein, 9 aa, Homo Sapiens
VQDQLSALS

SEQ ID NO: 1319002 - protein, 9 aa, Homo Sapiens
KYVTRVCGP

SEQ ID NO: 1319003 - protein, 9 aa, Homo Sapiens
KRGEGGQFF

SEQ ID NO: 1319004 - protein, 9 aa, Homo Sapiens
AHHSKKILS

SEQ ID NO: 1319005 - protein, 9 aa, Homo Sapiens
IILYWEHHS

SEQ ID NO: 1319006 - protein, 9 aa, Homo Sapiens
FLINPLLYT

SEQ ID NO: 1319007 - protein, 9 aa, Homo Sapiens
QNITGGSMM

SEQ ID NO: 1319008 - protein, 9 aa, Homo Sapiens
IQGLPITSY

SEQ ID NO: 1319009 - protein, 9 aa, Homo Sapiens
ITTGKNGYI

SEQ ID NO: 1319010 - protein, 9 aa, Homo Sapiens
RKRHEVTLK

SEQ ID NO: 1319011 - protein, 9 aa, Homo Sapiens
CDVNKRRFF

SEQ ID NO: 1319012 - protein, 9 aa, Homo Sapiens
ELSEIRAPP

SEQ ID NO: 1319013 - protein, 9 aa, Homo Sapiens
AATVELSKE

SEQ ID NO: 1319014 - protein, 9 aa, Homo Sapiens
LSFNRPFQS

SEQ ID NO: 1319015 - protein, 9 aa, Homo Sapiens
GGTADHCIR

SEQ ID NO: 1319016 - protein, 9 aa, Homo Sapiens
TVVAAHVLR

SEQ ID NO: 1319017 - protein, 9 aa, Homo Sapiens
HPTIVLDLQ

SEQ ID NO: 1319018 - protein, 9 aa, Homo Sapiens
QLRKTRPIL

SEQ ID NO: 1319019 - protein, 9 aa, Homo Sapiens
KILENAVPS

SEQ ID NO: 1319020 - protein, 9 aa, Homo Sapiens
SLDLPVSCT

SEQ ID NO: 1319021 - protein, 9 aa, Homo Sapiens
IVQLNKCPD

SEQ ID NO: 1319022 - protein, 9 aa, Homo Sapiens
ENLKMMWRI

SEQ ID NO: 1319023 - protein, 9 aa, Homo Sapiens
GSTVEVRVP

SEQ ID NO: 1319024 - protein, 9 aa, Homo Sapiens
TGQMTPKNP

SEQ ID NO: 1319025 - protein, 9 aa, Homo Sapiens
SMPLEENVV

SEQ ID NO: 1319026 - protein, 9 aa, Homo Sapiens
SPSSATSAA

SEQ ID NO: 1319027 - protein, 9 aa, Homo Sapiens
QIQEECDER

SEQ ID NO: 1319028 - protein, 9 aa, Homo Sapiens
ASDAGGRQF

SEQ ID NO: 1319029 - protein, 9 aa, Homo Sapiens
VVSVAERVA

SEQ ID NO: 1319030 - protein, 9 aa, Homo Sapiens
MLDPAQKSH

SEQ ID NO: 1319031 - protein, 9 aa, Homo Sapiens
AFSWIMGSM

SEQ ID NO: 1319032 - protein, 9 aa, Homo Sapiens
PTEEAYIIY

SEQ ID NO: 1319033 - protein, 9 aa, Homo Sapiens
LLTQKVTSL

SEQ ID NO: 1319034 - protein, 9 aa, Homo Sapiens
MIWDDLSEC

SEQ ID NO: 1319035 - protein, 9 aa, Homo Sapiens
MLLMYQLQC

SEQ ID NO: 1319036 - protein, 9 aa, Homo Sapiens
KPVIAKKEN

SEQ ID NO: 1319037 - protein, 9 aa, Homo Sapiens
KVCSSVAYA

SEQ ID NO: 1319038 - protein, 9 aa, Homo Sapiens
IRSEFKRKH

SEQ ID NO: 1319039 - protein, 9 aa, Homo Sapiens
EPQTFDCTL

SEQ ID NO: 1319040 - protein, 9 aa, Homo Sapiens
LLAYLQRIT

SEQ ID NO: 1319041 - protein, 9 aa, Homo Sapiens
YTSKDMLRK

SEQ ID NO: 1319042 - protein, 9 aa, Homo Sapiens
PVLPQLIIL

SEQ ID NO: 1319043 - protein, 9 aa, Homo Sapiens
KPLKTLEDT

SEQ ID NO: 1319044 - protein, 9 aa, Homo Sapiens
NVLKNYRTA

SEQ ID NO: 1319045 - protein, 9 aa, Homo Sapiens
WILAAVTSA

SEQ ID NO: 1319046 - protein, 9 aa, Homo Sapiens
THLDEARTL

SEQ ID NO: 1319047 - protein, 9 aa, Homo Sapiens
TNKNLFKVP

SEQ ID NO: 1319048 - protein, 9 aa, Homo Sapiens
ENTGTQQGR

SEQ ID NO: 1319049 - protein, 9 aa, Homo Sapiens
DKKCHKKRG

SEQ ID NO: 1319050 - protein, 9 aa, Homo Sapiens
IAILSTMDA

SEQ ID NO: 1319051 - protein, 9 aa, Homo Sapiens
LWRLWSLPR

SEQ ID NO: 1319052 - protein, 9 aa, Homo Sapiens
FVEWMRLDM

SEQ ID NO: 1319053 - protein, 9 aa, Homo Sapiens
HYKAEEGLQ

SEQ ID NO: 1319054 - protein, 9 aa, Homo Sapiens
SRHAAHRPL

SEQ ID NO: 1319055 - protein, 9 aa, Homo Sapiens
SLRVERSPS

SEQ ID NO: 1319056 - protein, 9 aa, Homo Sapiens
LDIWNSQDR

SEQ ID NO: 1319057 - protein, 9 aa, Homo Sapiens
ASEVKVLNA

SEQ ID NO: 1319058 - protein, 9 aa, Homo Sapiens
SHAAGECAH

SEQ ID NO: 1319059 - protein, 9 aa, Homo Sapiens
SVMDKENHY

SEQ ID NO: 1319060 - protein, 9 aa, Homo Sapiens
PGMLKEETR

SEQ ID NO: 1319061 - protein, 9 aa, Homo Sapiens
QQELRVPCL

SEQ ID NO: 1319062 - protein, 9 aa, Homo Sapiens
PSTLKFFHS

SEQ ID NO: 1319063 - protein, 9 aa, Homo Sapiens
GGNTDMLME

SEQ ID NO: 1319064 - protein, 9 aa, Homo Sapiens
DYILATWAV

SEQ ID NO: 1319065 - protein, 9 aa, Homo Sapiens
FCYFINDLY

SEQ ID NO: 1319066 - protein, 9 aa, Homo Sapiens
PMPVYAFSI

SEQ ID NO: 1319067 - protein, 9 aa, Homo Sapiens
SAKTILESS

SEQ ID NO: 1319068 - protein, 9 aa, Homo Sapiens
MAIIRIHSL

SEQ ID NO: 1319069 - protein, 9 aa, Homo Sapiens
VRQFLILKN

SEQ ID NO: 1319070 - protein, 9 aa, Homo Sapiens
AAYSPRNIW

SEQ ID NO: 1319071 - protein, 9 aa, Homo Sapiens
EIRPVSRCT

SEQ ID NO: 1319072 - protein, 9 aa, Homo Sapiens
PLVNLTNLL

SEQ ID NO: 1319073 - protein, 9 aa, Homo Sapiens
KEHLPPPVK

SEQ ID NO: 1319074 - protein, 9 aa, Homo Sapiens
GRLLGRWKT

SEQ ID NO: 1319075 - protein, 9 aa, Homo Sapiens
DVDGRMDQD

SEQ ID NO: 1319076 - protein, 9 aa, Homo Sapiens
KLCLRNDWE

SEQ ID NO: 1319077 - protein, 9 aa, Homo Sapiens
YISPRLLLS

SEQ ID NO: 1319078 - protein, 9 aa, Homo Sapiens
MCLGFLRLQ

SEQ ID NO: 1319079 - protein, 9 aa, Homo Sapiens
RRRTRVQGA

SEQ ID NO: 1319080 - protein, 9 aa, Homo Sapiens
VLESELKHR

SEQ ID NO: 1319081 - protein, 9 aa, Homo Sapiens
VLDENLNKN

SEQ ID NO: 1319082 - protein, 9 aa, Homo Sapiens
SWNRKLLEK

SEQ ID NO: 1319083 - protein, 9 aa, Homo Sapiens
ESVTEFEQC

SEQ ID NO: 1319084 - protein, 9 aa, Homo Sapiens
KAMIMYNFF

SEQ ID NO: 1319085 - protein, 9 aa, Homo Sapiens
LSDPSTEFD

SEQ ID NO: 1319086 - protein, 9 aa, Homo Sapiens
DVFETRQDL

SEQ ID NO: 1319087 - protein, 9 aa, Homo Sapiens
EPRNHQGAR

SEQ ID NO: 1319088 - protein, 9 aa, Homo Sapiens
RRFCWSCHH

SEQ ID NO: 1319089 - protein, 9 aa, Homo Sapiens
VLNKYGKAH

SEQ ID NO: 1319090 - protein, 9 aa, Homo Sapiens
HTRDNKVHG

SEQ ID NO: 1319091 - protein, 9 aa, Homo Sapiens
PSSLGQPSS

SEQ ID NO: 1319092 - protein, 9 aa, Homo Sapiens
STKPIRSPV

SEQ ID NO: 1319093 - protein, 9 aa, Homo Sapiens
LSDTSTMSL

SEQ ID NO: 1319094 - protein, 9 aa, Homo Sapiens
EKSISVFIN

SEQ ID NO: 1319095 - protein, 9 aa, Homo Sapiens
TTDGNILRR

SEQ ID NO: 1319096 - protein, 9 aa, Homo Sapiens
AQCSDGITN

SEQ ID NO: 1319097 - protein, 9 aa, Homo Sapiens
NGGGWTVFQ

SEQ ID NO: 1319098 - protein, 9 aa, Homo Sapiens
TAMTTQAHS

SEQ ID NO: 1319099 - protein, 9 aa, Homo Sapiens
LELGHRTQL

SEQ ID NO: 1319100 - protein, 9 aa, Homo Sapiens
SMGLEITCT

SEQ ID NO: 1319101 - protein, 9 aa, Homo Sapiens
ASEHSYQKP

SEQ ID NO: 1319102 - protein, 9 aa, Homo Sapiens
LIRKCFLCL

SEQ ID NO: 1319103 - protein, 9 aa, Homo Sapiens
NEAIYDIYR

SEQ ID NO: 1319104 - protein, 9 aa, Homo Sapiens
VLGESREPK

SEQ ID NO: 1319105 - protein, 9 aa, Homo Sapiens
GQGVQFLEA

SEQ ID NO: 1319106 - protein, 9 aa, Homo Sapiens
WQATIMSPN

SEQ ID NO: 1319107 - protein, 9 aa, Homo Sapiens
LACVPCPVD

SEQ ID NO: 1319108 - protein, 9 aa, Homo Sapiens
VNVAPENTG

SEQ ID NO: 1319109 - protein, 9 aa, Homo Sapiens
SLIQFMKHV

SEQ ID NO: 1319110 - protein, 9 aa, Homo Sapiens
VKDLTLHNR

SEQ ID NO: 1319111 - protein, 9 aa, Homo Sapiens
GRTFRRRLN

SEQ ID NO: 1319112 - protein, 9 aa, Homo Sapiens
KGKQLTTAE

SEQ ID NO: 1319113 - protein, 9 aa, Homo Sapiens
LLHRKSKSQ

SEQ ID NO: 1319114 - protein, 9 aa, Homo Sapiens
VKCPTPCQM

SEQ ID NO: 1319115 - protein, 9 aa, Homo Sapiens
IQSATMPHG

SEQ ID NO: 1319116 - protein, 9 aa, Homo Sapiens
KSLLQIEAG

SEQ ID NO: 1319117 - protein, 9 aa, Homo Sapiens
WNLTFPRFK

SEQ ID NO: 1319118 - protein, 9 aa, Homo Sapiens
CHAAALALD

SEQ ID NO: 1319119 - protein, 9 aa, Homo Sapiens
GKHCELNIN

SEQ ID NO: 1319120 - protein, 9 aa, Homo Sapiens
ISKPDVIML

SEQ ID NO: 1319121 - protein, 9 aa, Homo Sapiens
PIPGENGKI

SEQ ID NO: 1319122 - protein, 9 aa, Homo Sapiens
MLLGQKSQH

SEQ ID NO: 1319123 - protein, 9 aa, Homo Sapiens
INLVTETRR

SEQ ID NO: 1319124 - protein, 9 aa, Homo Sapiens
NISKPIMGP

SEQ ID NO: 1319125 - protein, 9 aa, Homo Sapiens
VFGMCVNTL

SEQ ID NO: 1319126 - protein, 9 aa, Homo Sapiens
DFHVKDSKP

SEQ ID NO: 1319127 - protein, 9 aa, Homo Sapiens
TLEIGALHL

SEQ ID NO: 1319128 - protein, 9 aa, Homo Sapiens
QEERQDECD

SEQ ID NO: 1319129 - protein, 9 aa, Homo Sapiens
RITDREEKH

SEQ ID NO: 1319130 - protein, 9 aa, Homo Sapiens
NSMGSRSSS

SEQ ID NO: 1319131 - protein, 9 aa, Homo Sapiens
YGHMKIMAL

SEQ ID NO: 1319132 - protein, 9 aa, Homo Sapiens
GIAVSHRNN

SEQ ID NO: 1319133 - protein, 9 aa, Homo Sapiens
VWPISSWTC

SEQ ID NO: 1319134 - protein, 9 aa, Homo Sapiens
DKVTCHDGA

SEQ ID NO: 1319135 - protein, 9 aa, Homo Sapiens
HIVIRGRSR

SEQ ID NO: 1319136 - protein, 9 aa, Homo Sapiens
VHMGKKPYT

SEQ ID NO: 1319137 - protein, 9 aa, Homo Sapiens
EEYVGQITL

SEQ ID NO: 1319138 - protein, 9 aa, Homo Sapiens
ESASDTIKF

SEQ ID NO: 1319139 - protein, 9 aa, Homo Sapiens
SKAKQRWSE

SEQ ID NO: 1319140 - protein, 9 aa, Homo Sapiens
IRKYWSHYY

SEQ ID NO: 1319141 - protein, 9 aa, Homo Sapiens
AVCLELKPD

SEQ ID NO: 1319142 - protein, 9 aa, Homo Sapiens
ISKITPRTV

SEQ ID NO: 1319143 - protein, 9 aa, Homo Sapiens
HCILAAFEV

SEQ ID NO: 1319144 - protein, 9 aa, Homo Sapiens
GSYMRCDHK

SEQ ID NO: 1319145 - protein, 9 aa, Homo Sapiens
KSHRSQTHS

SEQ ID NO: 1319146 - protein, 9 aa, Homo Sapiens
LEDTGHDML

SEQ ID NO: 1319147 - protein, 9 aa, Homo Sapiens
NKRTARKAP

SEQ ID NO: 1319148 - protein, 9 aa, Homo Sapiens
EDGEAGTED

SEQ ID NO: 1319149 - protein, 9 aa, Homo Sapiens
KKLYEYGEC

SEQ ID NO: 1319150 - protein, 9 aa, Homo Sapiens
DLGDAVPPG

SEQ ID NO: 1319151 - protein, 9 aa, Homo Sapiens
QHLPPTHHP

SEQ ID NO: 1319152 - protein, 9 aa, Homo Sapiens
EHLPPPVKS

SEQ ID NO: 1319153 - protein, 9 aa, Homo Sapiens
EIRDQEMLL

SEQ ID NO: 1319154 - protein, 9 aa, Homo Sapiens
WVLHSIGHS

SEQ ID NO: 1319155 - protein, 9 aa, Homo Sapiens
PPALQPFPV

SEQ ID NO: 1319156 - protein, 9 aa, Homo Sapiens
ISVTGCIVD

SEQ ID NO: 1319157 - protein, 9 aa, Homo Sapiens
VLMHALTDL

SEQ ID NO: 1319158 - protein, 9 aa, Homo Sapiens
EDANGFMEY

SEQ ID NO: 1319159 - protein, 9 aa, Homo Sapiens
IREEVNNKL

SEQ ID NO: 1319160 - protein, 9 aa, Homo Sapiens
KNLYKISLR

SEQ ID NO: 1319161 - protein, 9 aa, Homo Sapiens
SFQIPRGVP

SEQ ID NO: 1319162 - protein, 9 aa, Homo Sapiens
FQVYMADLG

SEQ ID NO: 1319163 - protein, 9 aa, Homo Sapiens
QLTGAGIYT

SEQ ID NO: 1319164 - protein, 9 aa, Homo Sapiens
TSETPATRM

SEQ ID NO: 1319165 - protein, 9 aa, Homo Sapiens
ARTLSILIS

SEQ ID NO: 1319166 - protein, 9 aa, Homo Sapiens
IMPEKPAEE

SEQ ID NO: 1319167 - protein, 9 aa, Homo Sapiens
LHREFMRNA

SEQ ID NO: 1319168 - protein, 9 aa, Homo Sapiens
FEKALEVES

SEQ ID NO: 1319169 - protein, 9 aa, Homo Sapiens
HCSTFQMSK

SEQ ID NO: 1319170 - protein, 9 aa, Homo Sapiens
HTRTEHSVL

SEQ ID NO: 1319171 - protein, 9 aa, Homo Sapiens
FTKNQKDSG

SEQ ID NO: 1319172 - protein, 9 aa, Homo Sapiens
CCSAYEYYV

SEQ ID NO: 1319173 - protein, 9 aa, Homo Sapiens
STGDNWNRI

SEQ ID NO: 1319174 - protein, 9 aa, Homo Sapiens
NSPTLHIGS

SEQ ID NO: 1319175 - protein, 9 aa, Homo Sapiens
HMIDYDSAE

SEQ ID NO: 1319176 - protein, 9 aa, Homo Sapiens
FHSCFPGRS

SEQ ID NO: 1319177 - protein, 9 aa, Homo Sapiens
QSLCESEQA

SEQ ID NO: 1319178 - protein, 9 aa, Homo Sapiens
PEKRVTSYQ

SEQ ID NO: 1319179 - protein, 9 aa, Homo Sapiens
KTKDPPAMR

SEQ ID NO: 1319180 - protein, 9 aa, Homo Sapiens
KIAKRMAVD

SEQ ID NO: 1319181 - protein, 9 aa, Homo Sapiens
KCWFQLGHS

SEQ ID NO: 1319182 - protein, 9 aa, Homo Sapiens
GRRLCTGED

SEQ ID NO: 1319183 - protein, 9 aa, Homo Sapiens
LPDDVETED

SEQ ID NO: 1319184 - protein, 9 aa, Homo Sapiens
QKQRINLAR

SEQ ID NO: 1319185 - protein, 9 aa, Homo Sapiens
SIPQAIFVQ

SEQ ID NO: 1319186 - protein, 9 aa, Homo Sapiens
GIALDYEGD

SEQ ID NO: 1319187 - protein, 9 aa, Homo Sapiens
DVIMLLEQE

SEQ ID NO: 1319188 - protein, 9 aa, Homo Sapiens
SRIVFCHLA

SEQ ID NO: 1319189 - protein, 9 aa, Homo Sapiens
KKKRRWGRK

SEQ ID NO: 1319190 - protein, 9 aa, Homo Sapiens
TEIIQSSTG

SEQ ID NO: 1319191 - protein, 9 aa, Homo Sapiens
FSSVISDCT

SEQ ID NO: 1319192 - protein, 9 aa, Homo Sapiens
VIMLFCETV

SEQ ID NO: 1319193 - protein, 9 aa, Homo Sapiens
VKLALVIEI

SEQ ID NO: 1319194 - protein, 9 aa, Homo Sapiens
LFPRKPLQP

SEQ ID NO: 1319195 - protein, 9 aa, Homo Sapiens
NHFAYRTGS

SEQ ID NO: 1319196 - protein, 9 aa, Homo Sapiens
AAWVLPFAS

SEQ ID NO: 1319197 - protein, 9 aa, Homo Sapiens
DEFDNGSML

SEQ ID NO: 1319198 - protein, 9 aa, Homo Sapiens
NFVTAMMSK

SEQ ID NO: 1319199 - protein, 9 aa, Homo Sapiens
DCTEIIIVV

SEQ ID NO: 1319200 - protein, 9 aa, Homo Sapiens
AFNLMFGAS

SEQ ID NO: 1319201 - protein, 9 aa, Homo Sapiens
YYVTLLTLL

SEQ ID NO: 1319202 - protein, 9 aa, Homo Sapiens
WRPDVKVLR

SEQ ID NO: 1319203 - protein, 9 aa, Homo Sapiens
TEFLYIARP

SEQ ID NO: 1319204 - protein, 9 aa, Homo Sapiens
KVFCVNVED

SEQ ID NO: 1319205 - protein, 9 aa, Homo Sapiens
LYMYGVSKH

SEQ ID NO: 1319206 - protein, 9 aa, Homo Sapiens
QQYIQFISG

SEQ ID NO: 1319207 - protein, 9 aa, Homo Sapiens
KVFWNTRIV

SEQ ID NO: 1319208 - protein, 9 aa, Homo Sapiens
LMALQMGIN

SEQ ID NO: 1319209 - protein, 9 aa, Homo Sapiens
EYHRTESEW

SEQ ID NO: 1319210 - protein, 9 aa, Homo Sapiens
SIAAPEKCS

SEQ ID NO: 1319211 - protein, 9 aa, Homo Sapiens
NGVPESTSM

SEQ ID NO: 1319212 - protein, 9 aa, Homo Sapiens
NIPFMLVDM

SEQ ID NO: 1319213 - protein, 9 aa, Homo Sapiens
VVGLYTGEV

SEQ ID NO: 1319214 - protein, 9 aa, Homo Sapiens
IRFVYTPTM

SEQ ID NO: 1319215 - protein, 9 aa, Homo Sapiens
PQQLKQRMF

SEQ ID NO: 1319216 - protein, 9 aa, Homo Sapiens
KAKQRWSEK

SEQ ID NO: 1319217 - protein, 9 aa, Homo Sapiens
TPIQTPCGR

SEQ ID NO: 1319218 - protein, 9 aa, Homo Sapiens
PYKYMLQLC

SEQ ID NO: 1319219 - protein, 9 aa, Homo Sapiens
DIVGFTVLS

SEQ ID NO: 1319220 - protein, 9 aa, Homo Sapiens
PGKLLLVCK

SEQ ID NO: 1319221 - protein, 9 aa, Homo Sapiens
KHATFVDGL

SEQ ID NO: 1319222 - protein, 9 aa, Homo Sapiens
PPRQVREHV

SEQ ID NO: 1319223 - protein, 9 aa, Homo Sapiens
AYRDVMLEN

SEQ ID NO: 1319224 - protein, 9 aa, Homo Sapiens
AVPSSSAAQ

SEQ ID NO: 1319225 - protein, 9 aa, Homo Sapiens
QKITSVKSL

SEQ ID NO: 1319226 - protein, 9 aa, Homo Sapiens
HDDISRLTV

SEQ ID NO: 1319227 - protein, 9 aa, Homo Sapiens
VAQEEYSRK

SEQ ID NO: 1319228 - protein, 9 aa, Homo Sapiens
MCIYKGDLV

SEQ ID NO: 1319229 - protein, 9 aa, Homo Sapiens
LYLIDCVNN

SEQ ID NO: 1319230 - protein, 9 aa, Homo Sapiens
PSSGTGIMG

SEQ ID NO: 1319231 - protein, 9 aa, Homo Sapiens
SFTDPDDLP

SEQ ID NO: 1319232 - protein, 9 aa, Homo Sapiens
GGDLLRQMK

SEQ ID NO: 1319233 - protein, 9 aa, Homo Sapiens
SKEPEEVTT

SEQ ID NO: 1319234 - protein, 9 aa, Homo Sapiens
GSSYWDHCV

SEQ ID NO: 1319235 - protein, 9 aa, Homo Sapiens
AGGTMQLVS

SEQ ID NO: 1319236 - protein, 9 aa, Homo Sapiens
WEHNEYLNE

SEQ ID NO: 1319237 - protein, 9 aa, Homo Sapiens
EAEVWAAAA

SEQ ID NO: 1319238 - protein, 9 aa, Homo Sapiens
DPHTKAGLY

SEQ ID NO: 1319239 - protein, 9 aa, Homo Sapiens
CSCTGASTA

SEQ ID NO: 1319240 - protein, 9 aa, Homo Sapiens
LHAMCTLSE

SEQ ID NO: 1319241 - protein, 9 aa, Homo Sapiens
KKEETRCKT

SEQ ID NO: 1319242 - protein, 9 aa, Homo Sapiens
SNCLPLHFW

SEQ ID NO: 1319243 - protein, 9 aa, Homo Sapiens
ILSITVDGK

SEQ ID NO: 1319244 - protein, 9 aa, Homo Sapiens
VPTGEKIYV

SEQ ID NO: 1319245 - protein, 9 aa, Homo Sapiens
FSLKSHFIL

SEQ ID NO: 1319246 - protein, 9 aa, Homo Sapiens
HSRSRERKR

SEQ ID NO: 1319247 - protein, 9 aa, Homo Sapiens
PLLCCALCI

SEQ ID NO: 1319248 - protein, 9 aa, Homo Sapiens
ADPGMTDRG

SEQ ID NO: 1319249 - protein, 9 aa, Homo Sapiens
KMEMLTGCG

SEQ ID NO: 1319250 - protein, 9 aa, Homo Sapiens
DNIYIAQNG

SEQ ID NO: 1319251 - protein, 9 aa, Homo Sapiens
TPKIQEQYH

SEQ ID NO: 1319252 - protein, 9 aa, Homo Sapiens
FCKRWAKQD

SEQ ID NO: 1319253 - protein, 9 aa, Homo Sapiens
LFFTTIFQN

SEQ ID NO: 1319254 - protein, 9 aa, Homo Sapiens
ASAVTVTVG

SEQ ID NO: 1319255 - protein, 9 aa, Homo Sapiens
VWLDPGAGS

SEQ ID NO: 1319256 - protein, 9 aa, Homo Sapiens
PTEEEALRM

SEQ ID NO: 1319257 - protein, 9 aa, Homo Sapiens
LPVISPLLP

SEQ ID NO: 1319258 - protein, 9 aa, Homo Sapiens
EHNFAEFNF

SEQ ID NO: 1319259 - protein, 9 aa, Homo Sapiens
KDCEAEVWA

SEQ ID NO: 1319260 - protein, 9 aa, Homo Sapiens
EERPTQRDC

SEQ ID NO: 1319261 - protein, 9 aa, Homo Sapiens
AQNVLRKHK

SEQ ID NO: 1319262 - protein, 9 aa, Homo Sapiens
NSNTWMNDT

SEQ ID NO: 1319263 - protein, 9 aa, Homo Sapiens
DPGTPVKLP

SEQ ID NO: 1319264 - protein, 9 aa, Homo Sapiens
ISLTKASIL

SEQ ID NO: 1319265 - protein, 9 aa, Homo Sapiens
LGLALTLGP

SEQ ID NO: 1319266 - protein, 9 aa, Homo Sapiens
AGVESLYFR

SEQ ID NO: 1319267 - protein, 9 aa, Homo Sapiens
KCQFSSGLN

SEQ ID NO: 1319268 - protein, 9 aa, Homo Sapiens
RQCLGRRIT

SEQ ID NO: 1319269 - protein, 9 aa, Homo Sapiens
MGPHVPRQL

SEQ ID NO: 1319270 - protein, 9 aa, Homo Sapiens
SANARHLIV

SEQ ID NO: 1319271 - protein, 9 aa, Homo Sapiens
CDFTYRDVS

SEQ ID NO: 1319272 - protein, 9 aa, Homo Sapiens
MVPCGTVPG

SEQ ID NO: 1319273 - protein, 9 aa, Homo Sapiens
KWRFHGMLL

SEQ ID NO: 1319274 - protein, 9 aa, Homo Sapiens
TRKRITIQE

SEQ ID NO: 1319275 - protein, 9 aa, Homo Sapiens
PYSSVPRLL

SEQ ID NO: 1319276 - protein, 9 aa, Homo Sapiens
NKREQTKNP

SEQ ID NO: 1319277 - protein, 9 aa, Homo Sapiens
CDKSRRSRS

SEQ ID NO: 1319278 - protein, 9 aa, Homo Sapiens
AFLRAHAAL

SEQ ID NO: 1319279 - protein, 9 aa, Homo Sapiens
LGQPSSETR

SEQ ID NO: 1319280 - protein, 9 aa, Homo Sapiens
VTDCLMAVK

SEQ ID NO: 1319281 - protein, 9 aa, Homo Sapiens
HKQYLTYHC

SEQ ID NO: 1319282 - protein, 9 aa, Homo Sapiens
QSGSELEEF

SEQ ID NO: 1319283 - protein, 9 aa, Homo Sapiens
HTAPGTDAG

SEQ ID NO: 1319284 - protein, 9 aa, Homo Sapiens
LCLMVVMNK

SEQ ID NO: 1319285 - protein, 9 aa, Homo Sapiens
YIRSKASYD

SEQ ID NO: 1319286 - protein, 9 aa, Homo Sapiens
PVHIEELIE

SEQ ID NO: 1319287 - protein, 9 aa, Homo Sapiens
WLKKLHESG

SEQ ID NO: 1319288 - protein, 9 aa, Homo Sapiens
VVLQRVERL

SEQ ID NO: 1319289 - protein, 9 aa, Homo Sapiens
ENSEKKQGP

SEQ ID NO: 1319290 - protein, 9 aa, Homo Sapiens
WDRALAVLT

SEQ ID NO: 1319291 - protein, 9 aa, Homo Sapiens
LYNNANGTY

SEQ ID NO: 1319292 - protein, 9 aa, Homo Sapiens
CYFDPLRNE

SEQ ID NO: 1319293 - protein, 9 aa, Homo Sapiens
WIVRIWDTD

SEQ ID NO: 1319294 - protein, 9 aa, Homo Sapiens
GSPTLGRVP

SEQ ID NO: 1319295 - protein, 9 aa, Homo Sapiens
HPLSFQQPQ

SEQ ID NO: 1319296 - protein, 9 aa, Homo Sapiens
DWHCLQRED

SEQ ID NO: 1319297 - protein, 9 aa, Homo Sapiens
CSYSVPLMS

SEQ ID NO: 1319298 - protein, 9 aa, Homo Sapiens
SLISSLRVE

SEQ ID NO: 1319299 - protein, 9 aa, Homo Sapiens
VRVTVDVIS

SEQ ID NO: 1319300 - protein, 9 aa, Homo Sapiens
PHDVGSSED

SEQ ID NO: 1319301 - protein, 9 aa, Homo Sapiens
ATAAGISQL

SEQ ID NO: 1319302 - protein, 9 aa, Homo Sapiens
VLHTYMRSF

SEQ ID NO: 1319303 - protein, 9 aa, Homo Sapiens
ETRFGQVFD

SEQ ID NO: 1319304 - protein, 9 aa, Homo Sapiens
NLSYNTKFT

SEQ ID NO: 1319305 - protein, 9 aa, Homo Sapiens
ELHNPDPAW

SEQ ID NO: 1319306 - protein, 9 aa, Homo Sapiens
EPIMFPSGG

SEQ ID NO: 1319307 - protein, 9 aa, Homo Sapiens
SYVRYNSMN

SEQ ID NO: 1319308 - protein, 9 aa, Homo Sapiens
IHFLCLRFK

SEQ ID NO: 1319309 - protein, 9 aa, Homo Sapiens
KKVCQKKQD

SEQ ID NO: 1319310 - protein, 9 aa, Homo Sapiens
SAHYVLFIV

SEQ ID NO: 1319311 - protein, 9 aa, Homo Sapiens
MKFFFDNLV

SEQ ID NO: 1319312 - protein, 9 aa, Homo Sapiens
AKAHPENKQ

SEQ ID NO: 1319313 - protein, 9 aa, Homo Sapiens
YINARELWI

SEQ ID NO: 1319314 - protein, 9 aa, Homo Sapiens
SPNLGAQQK

SEQ ID NO: 1319315 - protein, 9 aa, Homo Sapiens
IGALLRGSC

SEQ ID NO: 1319316 - protein, 9 aa, Homo Sapiens
RAVYDTLMT

SEQ ID NO: 1319317 - protein, 9 aa, Homo Sapiens
ICTLLFALM

SEQ ID NO: 1319318 - protein, 9 aa, Homo Sapiens
NRDDPADIW

SEQ ID NO: 1319319 - protein, 9 aa, Homo Sapiens
AVVLCMDMG

SEQ ID NO: 1319320 - protein, 9 aa, Homo Sapiens
SPVGESKHH

SEQ ID NO: 1319321 - protein, 9 aa, Homo Sapiens
TMQRWRSSE

SEQ ID NO: 1319322 - protein, 9 aa, Homo Sapiens
TNSEPADST

SEQ ID NO: 1319323 - protein, 9 aa, Homo Sapiens
LNVTLLRSL

SEQ ID NO: 1319324 - protein, 9 aa, Homo Sapiens
QRRRKQGTG

SEQ ID NO: 1319325 - protein, 9 aa, Homo Sapiens
ISMAVTFGF

SEQ ID NO: 1319326 - protein, 9 aa, Homo Sapiens
SLSTMYNLH

SEQ ID NO: 1319327 - protein, 9 aa, Homo Sapiens
GRRLTSAMN

SEQ ID NO: 1319328 - protein, 9 aa, Homo Sapiens
LQTPHAEKR

SEQ ID NO: 1319329 - protein, 9 aa, Homo Sapiens
VRQGLCWLH

SEQ ID NO: 1319330 - protein, 9 aa, Homo Sapiens
LVIEDDVCF

SEQ ID NO: 1319331 - protein, 9 aa, Homo Sapiens
DDILWQWAI

SEQ ID NO: 1319332 - protein, 9 aa, Homo Sapiens
CTGEDVAAL

SEQ ID NO: 1319333 - protein, 9 aa, Homo Sapiens
PCSDTDSDS

SEQ ID NO: 1319334 - protein, 9 aa, Homo Sapiens
YAACERSYV

SEQ ID NO: 1319335 - protein, 9 aa, Homo Sapiens
QTSNDCGGI

SEQ ID NO: 1319336 - protein, 9 aa, Homo Sapiens
KTHNGVKPY

SEQ ID NO: 1319337 - protein, 9 aa, Homo Sapiens
TKLGFVSGL

SEQ ID NO: 1319338 - protein, 9 aa, Homo Sapiens
GSSPSVLVV

SEQ ID NO: 1319339 - protein, 9 aa, Homo Sapiens
CCHAYHQDC

SEQ ID NO: 1319340 - protein, 9 aa, Homo Sapiens
CIPDVLFWC

SEQ ID NO: 1319341 - protein, 9 aa, Homo Sapiens
QLKNGMGLE

SEQ ID NO: 1319342 - protein, 9 aa, Homo Sapiens
RQCEWCSID

SEQ ID NO: 1319343 - protein, 9 aa, Homo Sapiens
PEDWVEMDT

SEQ ID NO: 1319344 - protein, 9 aa, Homo Sapiens
TARRPSTAA

SEQ ID NO: 1319345 - protein, 9 aa, Homo Sapiens
LQARIATLE

SEQ ID NO: 1319346 - protein, 9 aa, Homo Sapiens
FFWPSLLCM

SEQ ID NO: 1319347 - protein, 9 aa, Homo Sapiens
LGNCMHTMG

SEQ ID NO: 1319348 - protein, 9 aa, Homo Sapiens
CVCSTARLA

SEQ ID NO: 1319349 - protein, 9 aa, Homo Sapiens
LHTSPEDIN

SEQ ID NO: 1319350 - protein, 9 aa, Homo Sapiens
WSEKKARKA

SEQ ID NO: 1319351 - protein, 9 aa, Homo Sapiens
LAIEERYEA

SEQ ID NO: 1319352 - protein, 9 aa, Homo Sapiens
MEIIQAKDE

SEQ ID NO: 1319353 - protein, 9 aa, Homo Sapiens
KGLEASSVP

SEQ ID NO: 1319354 - protein, 9 aa, Homo Sapiens
ERFRFNRCD

SEQ ID NO: 1319355 - protein, 9 aa, Homo Sapiens
TASNAQDQL

SEQ ID NO: 1319356 - protein, 9 aa, Homo Sapiens
ASLVGTMLT

SEQ ID NO: 1319357 - protein, 9 aa, Homo Sapiens
TAVVLSAHT

SEQ ID NO: 1319358 - protein, 9 aa, Homo Sapiens
FKSGRPTTM

SEQ ID NO: 1319359 - protein, 9 aa, Homo Sapiens
IIEVVKASY

SEQ ID NO: 1319360 - protein, 9 aa, Homo Sapiens
LQVIDLLPG

SEQ ID NO: 1319361 - protein, 9 aa, Homo Sapiens
WEERVVNHM

SEQ ID NO: 1319362 - protein, 9 aa, Homo Sapiens
QSHTGERPF

SEQ ID NO: 1319363 - protein, 9 aa, Homo Sapiens
YYLPNSVEK

SEQ ID NO: 1319364 - protein, 9 aa, Homo Sapiens
REYHADGGK

SEQ ID NO: 1319365 - protein, 9 aa, Homo Sapiens
NKPDMNYEI

SEQ ID NO: 1319366 - protein, 9 aa, Homo Sapiens
EECGNTFYR

SEQ ID NO: 1319367 - protein, 9 aa, Homo Sapiens
EHKILLDSV

SEQ ID NO: 1319368 - protein, 9 aa, Homo Sapiens
ASTMAASSA

SEQ ID NO: 1319369 - protein, 9 aa, Homo Sapiens
FNRCDLIGF

SEQ ID NO: 1319370 - protein, 9 aa, Homo Sapiens
GDSSLATNL

SEQ ID NO: 1319371 - protein, 9 aa, Homo Sapiens
KQCLSFVFF

SEQ ID NO: 1319372 - protein, 9 aa, Homo Sapiens
LMCLGFLRL

SEQ ID NO: 1319373 - protein, 9 aa, Homo Sapiens
ERCCLEKLC

SEQ ID NO: 1319374 - protein, 9 aa, Homo Sapiens
YEQGMIQMT

SEQ ID NO: 1319375 - protein, 9 aa, Homo Sapiens
PFDDTCHGN

SEQ ID NO: 1319376 - protein, 9 aa, Homo Sapiens
RIASIPGII

SEQ ID NO: 1319377 - protein, 9 aa, Homo Sapiens
LALVRHCVC

SEQ ID NO: 1319378 - protein, 9 aa, Homo Sapiens
EAPDVHFTV

SEQ ID NO: 1319379 - protein, 9 aa, Homo Sapiens
MSLWPQDSR

SEQ ID NO: 1319380 - protein, 9 aa, Homo Sapiens
FAHDDSVIY

SEQ ID NO: 1319381 - protein, 9 aa, Homo Sapiens
NKCVVAFYS

SEQ ID NO: 1319382 - protein, 9 aa, Homo Sapiens
RRGCLRWMR

SEQ ID NO: 1319383 - protein, 9 aa, Homo Sapiens
YTFGKEVEF

SEQ ID NO: 1319384 - protein, 9 aa, Homo Sapiens
RKNWCALCN

SEQ ID NO: 1319385 - protein, 9 aa, Homo Sapiens
EDVRHVIFG

SEQ ID NO: 1319386 - protein, 9 aa, Homo Sapiens
VPYDSDSGE

SEQ ID NO: 1319387 - protein, 9 aa, Homo Sapiens
FSWWSGRIV

SEQ ID NO: 1319388 - protein, 9 aa, Homo Sapiens
SVPHNRIGV

SEQ ID NO: 1319389 - protein, 9 aa, Homo Sapiens
EGNRLYHEG

SEQ ID NO: 1319390 - protein, 9 aa, Homo Sapiens
LECLGSPGS

SEQ ID NO: 1319391 - protein, 9 aa, Homo Sapiens
NSSSGITSC

SEQ ID NO: 1319392 - protein, 9 aa, Homo Sapiens
QGLAEPGSF

SEQ ID NO: 1319393 - protein, 9 aa, Homo Sapiens
SGYYRMDGI

SEQ ID NO: 1319394 - protein, 9 aa, Homo Sapiens
GATTTQHYS

SEQ ID NO: 1319395 - protein, 9 aa, Homo Sapiens
LVKKCSKGN

SEQ ID NO: 1319396 - protein, 9 aa, Homo Sapiens
ALNPDKKMC

SEQ ID NO: 1319397 - protein, 9 aa, Homo Sapiens
ASLCLMVVM

SEQ ID NO: 1319398 - protein, 9 aa, Homo Sapiens
SSTVQGNTE

SEQ ID NO: 1319399 - protein, 9 aa, Homo Sapiens
GSLFSGQRY

SEQ ID NO: 1319400 - protein, 9 aa, Homo Sapiens
FIVITDFRK

SEQ ID NO: 1319401 - protein, 9 aa, Homo Sapiens
AHVLRQTPP

SEQ ID NO: 1319402 - protein, 9 aa, Homo Sapiens
GSFVSPESD

SEQ ID NO: 1319403 - protein, 9 aa, Homo Sapiens
LPLHFWVNV

SEQ ID NO: 1319404 - protein, 9 aa, Homo Sapiens
LSGFDQAHL

SEQ ID NO: 1319405 - protein, 9 aa, Homo Sapiens
RCEDLMYKP

SEQ ID NO: 1319406 - protein, 9 aa, Homo Sapiens
LSMEMEVLQ

SEQ ID NO: 1319407 - protein, 9 aa, Homo Sapiens
VDKSVGQVA

SEQ ID NO: 1319408 - protein, 9 aa, Homo Sapiens
DKDQLMAVT

SEQ ID NO: 1319409 - protein, 9 aa, Homo Sapiens
ESFTDEPEK

SEQ ID NO: 1319410 - protein, 9 aa, Homo Sapiens
TDINLSGAV

SEQ ID NO: 1319411 - protein, 9 aa, Homo Sapiens
DTPGVIPGI

SEQ ID NO: 1319412 - protein, 9 aa, Homo Sapiens
TAGANGTLG

SEQ ID NO: 1319413 - protein, 9 aa, Homo Sapiens
LACVLWKKG

SEQ ID NO: 1319414 - protein, 9 aa, Homo Sapiens
RSRVSIAVA

SEQ ID NO: 1319415 - protein, 9 aa, Homo Sapiens
HTSGHSVAY

SEQ ID NO: 1319416 - protein, 9 aa, Homo Sapiens
VFGHPLSFQ

SEQ ID NO: 1319417 - protein, 9 aa, Homo Sapiens
HMVVGDVLQ

SEQ ID NO: 1319418 - protein, 9 aa, Homo Sapiens
KPQGDDNHW

SEQ ID NO: 1319419 - protein, 9 aa, Homo Sapiens
ELDSLDGGM

SEQ ID NO: 1319420 - protein, 9 aa, Homo Sapiens
TVICRNKQW

SEQ ID NO: 1319421 - protein, 9 aa, Homo Sapiens
LRFEPSAHI

SEQ ID NO: 1319422 - protein, 9 aa, Homo Sapiens
ENYMCQQLL

SEQ ID NO: 1319423 - protein, 9 aa, Homo Sapiens
YSRCLAPKV

SEQ ID NO: 1319424 - protein, 9 aa, Homo Sapiens
RALTQVCGY

SEQ ID NO: 1319425 - protein, 9 aa, Homo Sapiens
TRGHALLRW

SEQ ID NO: 1319426 - protein, 9 aa, Homo Sapiens
HRCLVTAPV

SEQ ID NO: 1319427 - protein, 9 aa, Homo Sapiens
GCCFSFAEQ

SEQ ID NO: 1319428 - protein, 9 aa, Homo Sapiens
NTDKSKAAP

SEQ ID NO: 1319429 - protein, 9 aa, Homo Sapiens
YGDEECLYL

SEQ ID NO: 1319430 - protein, 9 aa, Homo Sapiens
CAFYTHMQT

SEQ ID NO: 1319431 - protein, 9 aa, Homo Sapiens
CTLVALSWR

SEQ ID NO: 1319432 - protein, 9 aa, Homo Sapiens
QEPLPAWGH

SEQ ID NO: 1319433 - protein, 9 aa, Homo Sapiens
ISGTVNIHT

SEQ ID NO: 1319434 - protein, 9 aa, Homo Sapiens
GCCSAYEYY

SEQ ID NO: 1319435 - protein, 9 aa, Homo Sapiens
EVGAYLVDN

SEQ ID NO: 1319436 - protein, 9 aa, Homo Sapiens
NPDLKLTIV

SEQ ID NO: 1319437 - protein, 9 aa, Homo Sapiens
KKKNKEEER

SEQ ID NO: 1319438 - protein, 9 aa, Homo Sapiens
HCIRKRKMV

SEQ ID NO: 1319439 - protein, 9 aa, Homo Sapiens
LCLPPGFPV

SEQ ID NO: 1319440 - protein, 9 aa, Homo Sapiens
NKLKITAVD

SEQ ID NO: 1319441 - protein, 9 aa, Homo Sapiens
DRIHTPRAS

SEQ ID NO: 1319442 - protein, 9 aa, Homo Sapiens
AEDFKQQVS

SEQ ID NO: 1319443 - protein, 9 aa, Homo Sapiens
EGCRPRTFC

SEQ ID NO: 1319444 - protein, 9 aa, Homo Sapiens
RMKHEVSAH

SEQ ID NO: 1319445 - protein, 9 aa, Homo Sapiens
NTIIITLSW

SEQ ID NO: 1319446 - protein, 9 aa, Homo Sapiens
FELPREYQN

SEQ ID NO: 1319447 - protein, 9 aa, Homo Sapiens
DLSSVPSLH

SEQ ID NO: 1319448 - protein, 9 aa, Homo Sapiens
DQVARHLRD

SEQ ID NO: 1319449 - protein, 9 aa, Homo Sapiens
TLLLQAECR

SEQ ID NO: 1319450 - protein, 9 aa, Homo Sapiens
LRYGMLHFL

SEQ ID NO: 1319451 - protein, 9 aa, Homo Sapiens
SPPTPPAQD

SEQ ID NO: 1319452 - protein, 9 aa, Homo Sapiens
YANKITTES

SEQ ID NO: 1319453 - protein, 9 aa, Homo Sapiens
VCFNIVGSY

SEQ ID NO: 1319454 - protein, 9 aa, Homo Sapiens
QGWMGFPQG

SEQ ID NO: 1319455 - protein, 9 aa, Homo Sapiens
PFNHFSYLT

SEQ ID NO: 1319456 - protein, 9 aa, Homo Sapiens
SALIPHHSA

SEQ ID NO: 1319457 - protein, 9 aa, Homo Sapiens
VCAFYTHMQ

SEQ ID NO: 1319458 - protein, 9 aa, Homo Sapiens
AADLDWPNL

SEQ ID NO: 1319459 - protein, 9 aa, Homo Sapiens
MPGGCITIP

SEQ ID NO: 1319460 - protein, 9 aa, Homo Sapiens
STPSTDVTV

SEQ ID NO: 1319461 - protein, 9 aa, Homo Sapiens
GMRALQGGL

SEQ ID NO: 1319462 - protein, 9 aa, Homo Sapiens
SFSSHNLIT

SEQ ID NO: 1319463 - protein, 9 aa, Homo Sapiens
ETREYIIRL

SEQ ID NO: 1319464 - protein, 9 aa, Homo Sapiens
DSMLGTMFG

SEQ ID NO: 1319465 - protein, 9 aa, Homo Sapiens
RKRITIQEA

SEQ ID NO: 1319466 - protein, 9 aa, Homo Sapiens
GMVGGSVPI

SEQ ID NO: 1319467 - protein, 9 aa, Homo Sapiens
EQLRLPLGN

SEQ ID NO: 1319468 - protein, 9 aa, Homo Sapiens
CAKVQGTVH

SEQ ID NO: 1319469 - protein, 9 aa, Homo Sapiens
PGVWWEISV

SEQ ID NO: 1319470 - protein, 9 aa, Homo Sapiens
VTNGMEFLA

SEQ ID NO: 1319471 - protein, 9 aa, Homo Sapiens
RAHNNTHSN

SEQ ID NO: 1319472 - protein, 9 aa, Homo Sapiens
REDVMVASR

SEQ ID NO: 1319473 - protein, 9 aa, Homo Sapiens
GCIADLLLP

SEQ ID NO: 1319474 - protein, 9 aa, Homo Sapiens
TAILPPHLN

SEQ ID NO: 1319475 - protein, 9 aa, Homo Sapiens
NQYTYTIIQ

SEQ ID NO: 1319476 - protein, 9 aa, Homo Sapiens
KLVTEMVIS

SEQ ID NO: 1319477 - protein, 9 aa, Homo Sapiens
DHVYHGHLS

SEQ ID NO: 1319478 - protein, 9 aa, Homo Sapiens
SIRINVTTL

SEQ ID NO: 1319479 - protein, 9 aa, Homo Sapiens
MLYPITFPS

SEQ ID NO: 1319480 - protein, 9 aa, Homo Sapiens
TIIGLIKPL

SEQ ID NO: 1319481 - protein, 9 aa, Homo Sapiens
TLDYLSPEM

SEQ ID NO: 1319482 - protein, 9 aa, Homo Sapiens
NSLITLREF

SEQ ID NO: 1319483 - protein, 9 aa, Homo Sapiens
ARLEERCGI

SEQ ID NO: 1319484 - protein, 9 aa, Homo Sapiens
LPAPWPPPA

SEQ ID NO: 1319485 - protein, 9 aa, Homo Sapiens
RELDNNCSA

SEQ ID NO: 1319486 - protein, 9 aa, Homo Sapiens
LDEDNKPDN

SEQ ID NO: 1319487 - protein, 9 aa, Homo Sapiens
RTQDGLGPC

SEQ ID NO: 1319488 - protein, 9 aa, Homo Sapiens
KKLPSQSTT

SEQ ID NO: 1319489 - protein, 9 aa, Homo Sapiens
LATWAVPQV

SEQ ID NO: 1319490 - protein, 9 aa, Homo Sapiens
SVAYGFLIT

SEQ ID NO: 1319491 - protein, 9 aa, Homo Sapiens
GQEVNMCKK

SEQ ID NO: 1319492 - protein, 9 aa, Homo Sapiens
CVDENMERR

SEQ ID NO: 1319493 - protein, 9 aa, Homo Sapiens
GICTLLFAL

SEQ ID NO: 1319494 - protein, 9 aa, Homo Sapiens
ANGTNVLSL

SEQ ID NO: 1319495 - protein, 9 aa, Homo Sapiens
TVLKHMDKN

SEQ ID NO: 1319496 - protein, 9 aa, Homo Sapiens
VDYDNKSHV

SEQ ID NO: 1319497 - protein, 9 aa, Homo Sapiens
WAIHVLRIV

SEQ ID NO: 1319498 - protein, 9 aa, Homo Sapiens
FLFFTTIFQ

SEQ ID NO: 1319499 - protein, 9 aa, Homo Sapiens
LVAELALVG

SEQ ID NO: 1319500 - protein, 9 aa, Homo Sapiens
RKAATKTRA

SEQ ID NO: 1319501 - protein, 9 aa, Homo Sapiens
CNFILACQD

SEQ ID NO: 1319502 - protein, 9 aa, Homo Sapiens
EIFQCCDCG

SEQ ID NO: 1319503 - protein, 9 aa, Homo Sapiens
RYSAFWLSW

SEQ ID NO: 1319504 - protein, 9 aa, Homo Sapiens
KQAVHCMHA

SEQ ID NO: 1319505 - protein, 9 aa, Homo Sapiens
MKNLHKLVF

SEQ ID NO: 1319506 - protein, 9 aa, Homo Sapiens
AVVHKYALA

SEQ ID NO: 1319507 - protein, 9 aa, Homo Sapiens
TDPSCTTFG

SEQ ID NO: 1319508 - protein, 9 aa, Homo Sapiens
EPHDTVPKP

SEQ ID NO: 1319509 - protein, 9 aa, Homo Sapiens
VKDDSILSI

SEQ ID NO: 1319510 - protein, 9 aa, Homo Sapiens
IINCDRFYL

SEQ ID NO: 1319511 - protein, 9 aa, Homo Sapiens
NEVTMVLVS

SEQ ID NO: 1319512 - protein, 9 aa, Homo Sapiens
VAHELGHML

SEQ ID NO: 1319513 - protein, 9 aa, Homo Sapiens
TLSMALPCP

SEQ ID NO: 1319514 - protein, 9 aa, Homo Sapiens
LQPGTGGAH

SEQ ID NO: 1319515 - protein, 9 aa, Homo Sapiens
CSLFFNRDD

SEQ ID NO: 1319516 - protein, 9 aa, Homo Sapiens
PLHIVASAG

SEQ ID NO: 1319517 - protein, 9 aa, Homo Sapiens
DSDSDQPLN

SEQ ID NO: 1319518 - protein, 9 aa, Homo Sapiens
HISTIVPKM

SEQ ID NO: 1319519 - protein, 9 aa, Homo Sapiens
FVYTPTMES

SEQ ID NO: 1319520 - protein, 9 aa, Homo Sapiens
NKPGVYVHV

SEQ ID NO: 1319521 - protein, 9 aa, Homo Sapiens
GLWNEDYKS

SEQ ID NO: 1319522 - protein, 9 aa, Homo Sapiens
MLKQRRESL

SEQ ID NO: 1319523 - protein, 9 aa, Homo Sapiens
KSHPKAEAV

SEQ ID NO: 1319524 - protein, 9 aa, Homo Sapiens
PVSIPSDVV

SEQ ID NO: 1319525 - protein, 9 aa, Homo Sapiens
CLVVPLLAE

SEQ ID NO: 1319526 - protein, 9 aa, Homo Sapiens
LKYHEDIIN

SEQ ID NO: 1319527 - protein, 9 aa, Homo Sapiens
FDANDNTPV

SEQ ID NO: 1319528 - protein, 9 aa, Homo Sapiens
SRTWQGNGE

SEQ ID NO: 1319529 - protein, 9 aa, Homo Sapiens
IISQVYSGV

SEQ ID NO: 1319530 - protein, 9 aa, Homo Sapiens
HPPSFSPQS

SEQ ID NO: 1319531 - protein, 9 aa, Homo Sapiens
LKPITGRTH

SEQ ID NO: 1319532 - protein, 9 aa, Homo Sapiens
QDCQMCSSQ

SEQ ID NO: 1319533 - protein, 9 aa, Homo Sapiens
PTPCQMTYI

SEQ ID NO: 1319534 - protein, 9 aa, Homo Sapiens
ISPRLLLSP

SEQ ID NO: 1319535 - protein, 9 aa, Homo Sapiens
LIYYCMCCG

SEQ ID NO: 1319536 - protein, 9 aa, Homo Sapiens
TALRSCSLV

SEQ ID NO: 1319537 - protein, 9 aa, Homo Sapiens
RRTRVQGAW

SEQ ID NO: 1319538 - protein, 9 aa, Homo Sapiens
RPPRDCVQG

SEQ ID NO: 1319539 - protein, 9 aa, Homo Sapiens
LLLHLLTCV

SEQ ID NO: 1319540 - protein, 9 aa, Homo Sapiens
LSRGTNPNL

SEQ ID NO: 1319541 - protein, 9 aa, Homo Sapiens
CDSGYTCHQ

SEQ ID NO: 1319542 - protein, 9 aa, Homo Sapiens
RHSYHLTTF

SEQ ID NO: 1319543 - protein, 9 aa, Homo Sapiens
LNGVSSITN

SEQ ID NO: 1319544 - protein, 9 aa, Homo Sapiens
ECGLVVGDQ

SEQ ID NO: 1319545 - protein, 9 aa, Homo Sapiens
SVPWTVFRA

SEQ ID NO: 1319546 - protein, 9 aa, Homo Sapiens
GAQVFVVEG

SEQ ID NO: 1319547 - protein, 9 aa, Homo Sapiens
ARLTQGTDK

SEQ ID NO: 1319548 - protein, 9 aa, Homo Sapiens
MSVPHNRIG

SEQ ID NO: 1319549 - protein, 9 aa, Homo Sapiens
VPSPEAGRV

SEQ ID NO: 1319550 - protein, 9 aa, Homo Sapiens
TTSHKDVLQ

SEQ ID NO: 1319551 - protein, 9 aa, Homo Sapiens
PYIPELWGP

SEQ ID NO: 1319552 - protein, 9 aa, Homo Sapiens
QGFNLMNKF

SEQ ID NO: 1319553 - protein, 9 aa, Homo Sapiens
IPGKKGTHV

SEQ ID NO: 1319554 - protein, 9 aa, Homo Sapiens
TSPYRLRRG

SEQ ID NO: 1319555 - protein, 9 aa, Homo Sapiens
KNQIRKLKS

SEQ ID NO: 1319556 - protein, 9 aa, Homo Sapiens
LQEQRRELY

SEQ ID NO: 1319557 - protein, 9 aa, Homo Sapiens
AQTWTDSHL

SEQ ID NO: 1319558 - protein, 9 aa, Homo Sapiens
YEKAFFKMD

SEQ ID NO: 1319559 - protein, 9 aa, Homo Sapiens
LSMHYLFII

SEQ ID NO: 1319560 - protein, 9 aa, Homo Sapiens
AGRASAATR

SEQ ID NO: 1319561 - protein, 9 aa, Homo Sapiens
STVTQLKEC

SEQ ID NO: 1319562 - protein, 9 aa, Homo Sapiens
HSNCCHFCY

SEQ ID NO: 1319563 - protein, 9 aa, Homo Sapiens
HLFLGLEAV

SEQ ID NO: 1319564 - protein, 9 aa, Homo Sapiens
GTFDGLKLN

SEQ ID NO: 1319565 - protein, 9 aa, Homo Sapiens
LNLDEMTKL

SEQ ID NO: 1319566 - protein, 9 aa, Homo Sapiens
STLVIAEYA

SEQ ID NO: 1319567 - protein, 9 aa, Homo Sapiens
ITRWPGDIL

SEQ ID NO: 1319568 - protein, 9 aa, Homo Sapiens
FLSKMSEAE

SEQ ID NO: 1319569 - protein, 9 aa, Homo Sapiens
FSSIFLFVF

SEQ ID NO: 1319570 - protein, 9 aa, Homo Sapiens
VPIFDEIIL

SEQ ID NO: 1319571 - protein, 9 aa, Homo Sapiens
GIESSGINE

SEQ ID NO: 1319572 - protein, 9 aa, Homo Sapiens
SLNIENTLW

SEQ ID NO: 1319573 - protein, 9 aa, Homo Sapiens
QHQLYTECL

SEQ ID NO: 1319574 - protein, 9 aa, Homo Sapiens
TGSDFDVHI

SEQ ID NO: 1319575 - protein, 9 aa, Homo Sapiens
GMSTVSCGN

SEQ ID NO: 1319576 - protein, 9 aa, Homo Sapiens
CNDLVTSVD

SEQ ID NO: 1319577 - protein, 9 aa, Homo Sapiens
EVDIISLSE

SEQ ID NO: 1319578 - protein, 9 aa, Homo Sapiens
AVTKLAGLH

SEQ ID NO: 1319579 - protein, 9 aa, Homo Sapiens
CGPATFEID

SEQ ID NO: 1319580 - protein, 9 aa, Homo Sapiens
WMWINHFVI

SEQ ID NO: 1319581 - protein, 9 aa, Homo Sapiens
VSAWEVEAM

SEQ ID NO: 1319582 - protein, 9 aa, Homo Sapiens
SPASGSTSR

SEQ ID NO: 1319583 - protein, 9 aa, Homo Sapiens
LGSHGVSGG

SEQ ID NO: 1319584 - protein, 9 aa, Homo Sapiens
CLELKPDPT

SEQ ID NO: 1319585 - protein, 9 aa, Homo Sapiens
VQHQLYTEC

SEQ ID NO: 1319586 - protein, 9 aa, Homo Sapiens
MPVASKLQV

SEQ ID NO: 1319587 - protein, 9 aa, Homo Sapiens
DRYPTLRNH

SEQ ID NO: 1319588 - protein, 9 aa, Homo Sapiens
RYNTSFIHH

SEQ ID NO: 1319589 - protein, 9 aa, Homo Sapiens
TCTETPLII

SEQ ID NO: 1319590 - protein, 9 aa, Homo Sapiens
CWARCCAST

SEQ ID NO: 1319591 - protein, 9 aa, Homo Sapiens
TIGYGHTAP

SEQ ID NO: 1319592 - protein, 9 aa, Homo Sapiens
KLPSQSTTD

SEQ ID NO: 1319593 - protein, 9 aa, Homo Sapiens
RGIAIHMWK

SEQ ID NO: 1319594 - protein, 9 aa, Homo Sapiens
YNGEANDGE

SEQ ID NO: 1319595 - protein, 9 aa, Homo Sapiens
VLTIFYRTY

SEQ ID NO: 1319596 - protein, 9 aa, Homo Sapiens
SRCLAPKVD

SEQ ID NO: 1319597 - protein, 9 aa, Homo Sapiens
DFLIILPLL

SEQ ID NO: 1319598 - protein, 9 aa, Homo Sapiens
VVLVGLDIW

SEQ ID NO: 1319599 - protein, 9 aa, Homo Sapiens
APLFMDRDS

SEQ ID NO: 1319600 - protein, 9 aa, Homo Sapiens
IIIALTDGE

SEQ ID NO: 1319601 - protein, 9 aa, Homo Sapiens
ESEQYSLDG

SEQ ID NO: 1319602 - protein, 9 aa, Homo Sapiens
RIGKKSHLR

SEQ ID NO: 1319603 - protein, 9 aa, Homo Sapiens
NDWRHFKQL

SEQ ID NO: 1319604 - protein, 9 aa, Homo Sapiens
DQVAHIPVI

SEQ ID NO: 1319605 - protein, 9 aa, Homo Sapiens
YAVDGRQEE

SEQ ID NO: 1319606 - protein, 9 aa, Homo Sapiens
KKRAYLAHF

SEQ ID NO: 1319607 - protein, 9 aa, Homo Sapiens
CWTSHQDAS

SEQ ID NO: 1319608 - protein, 9 aa, Homo Sapiens
DDIIPNGVK

SEQ ID NO: 1319609 - protein, 9 aa, Homo Sapiens
VYSGKMNLN

SEQ ID NO: 1319610 - protein, 9 aa, Homo Sapiens
LSTCFCSVF

SEQ ID NO: 1319611 - protein, 9 aa, Homo Sapiens
DRFAWDTSN

SEQ ID NO: 1319612 - protein, 9 aa, Homo Sapiens
HGEGFQRLV

SEQ ID NO: 1319613 - protein, 9 aa, Homo Sapiens
PPAVAPPSA

SEQ ID NO: 1319614 - protein, 9 aa, Homo Sapiens
KAAVKGDTA

SEQ ID NO: 1319615 - protein, 9 aa, Homo Sapiens
EPEVSNYWM

SEQ ID NO: 1319616 - protein, 9 aa, Homo Sapiens
QRQAKVWMI

SEQ ID NO: 1319617 - protein, 9 aa, Homo Sapiens
SPASTSVAA

SEQ ID NO: 1319618 - protein, 9 aa, Homo Sapiens
LLTEKDVSH

SEQ ID NO: 1319619 - protein, 9 aa, Homo Sapiens
HYVWDYTDH

SEQ ID NO: 1319620 - protein, 9 aa, Homo Sapiens
MAFYTGLSH

SEQ ID NO: 1319621 - protein, 9 aa, Homo Sapiens
LWASLETQR

SEQ ID NO: 1319622 - protein, 9 aa, Homo Sapiens
SSYSGELQL

SEQ ID NO: 1319623 - protein, 9 aa, Homo Sapiens
NHTCSGWLH

SEQ ID NO: 1319624 - protein, 9 aa, Homo Sapiens
KKRPQCATS

SEQ ID NO: 1319625 - protein, 9 aa, Homo Sapiens
DRDQDLFLL

SEQ ID NO: 1319626 - protein, 9 aa, Homo Sapiens
NQCGKPFRM

SEQ ID NO: 1319627 - protein, 9 aa, Homo Sapiens
RQQQQRRQQ

SEQ ID NO: 1319628 - protein, 9 aa, Homo Sapiens
KYTNLVTVS

SEQ ID NO: 1319629 - protein, 9 aa, Homo Sapiens
VQTDVTMKG

SEQ ID NO: 1319630 - protein, 9 aa, Homo Sapiens
INTCYKHFY

SEQ ID NO: 1319631 - protein, 9 aa, Homo Sapiens
LGEAIIKRA

SEQ ID NO: 1319632 - protein, 9 aa, Homo Sapiens
KDAALSNVT

SEQ ID NO: 1319633 - protein, 9 aa, Homo Sapiens
HNIYKRTCS

SEQ ID NO: 1319634 - protein, 9 aa, Homo Sapiens
DLLMDLLRD

SEQ ID NO: 1319635 - protein, 9 aa, Homo Sapiens
LGGPLPPTN

SEQ ID NO: 1319636 - protein, 9 aa, Homo Sapiens
SWSRGWYSR

SEQ ID NO: 1319637 - protein, 9 aa, Homo Sapiens
GCMNPAHAF

SEQ ID NO: 1319638 - protein, 9 aa, Homo Sapiens
ELHTTTPVE

SEQ ID NO: 1319639 - protein, 9 aa, Homo Sapiens
RLCRTFDKI

SEQ ID NO: 1319640 - protein, 9 aa, Homo Sapiens
FPSYLNLIK

SEQ ID NO: 1319641 - protein, 9 aa, Homo Sapiens
KRALIGDDI

SEQ ID NO: 1319642 - protein, 9 aa, Homo Sapiens
SSGQYIVIA

SEQ ID NO: 1319643 - protein, 9 aa, Homo Sapiens
DVLTRKTHA

SEQ ID NO: 1319644 - protein, 9 aa, Homo Sapiens
LITVPIDHG

SEQ ID NO: 1319645 - protein, 9 aa, Homo Sapiens
KRNVMILMN

SEQ ID NO: 1319646 - protein, 9 aa, Homo Sapiens
LPIPWAYIK

SEQ ID NO: 1319647 - protein, 9 aa, Homo Sapiens
CQAINDGVT

SEQ ID NO: 1319648 - protein, 9 aa, Homo Sapiens
DDDIVDTGA

SEQ ID NO: 1319649 - protein, 9 aa, Homo Sapiens
TPFVFLILC

SEQ ID NO: 1319650 - protein, 9 aa, Homo Sapiens
HNFLEGDWK

SEQ ID NO: 1319651 - protein, 9 aa, Homo Sapiens
LRLSFNRPF

SEQ ID NO: 1319652 - protein, 9 aa, Homo Sapiens
VGFVTIPRN

SEQ ID NO: 1319653 - protein, 9 aa, Homo Sapiens
RGERAWTHR

SEQ ID NO: 1319654 - protein, 9 aa, Homo Sapiens
ICHKSLSLG

SEQ ID NO: 1319655 - protein, 9 aa, Homo Sapiens
HGQLEKSPF

SEQ ID NO: 1319656 - protein, 9 aa, Homo Sapiens
CHKYLIGML

SEQ ID NO: 1319657 - protein, 9 aa, Homo Sapiens
MAWLGVFRA

SEQ ID NO: 1319658 - protein, 9 aa, Homo Sapiens
VKEKADTLQ

SEQ ID NO: 1319659 - protein, 9 aa, Homo Sapiens
EGSCPEHIT

SEQ ID NO: 1319660 - protein, 9 aa, Homo Sapiens
ITYLLGLIC

SEQ ID NO: 1319661 - protein, 9 aa, Homo Sapiens
YKFCKQVLS

SEQ ID NO: 1319662 - protein, 9 aa, Homo Sapiens
WQRRRLPSV

SEQ ID NO: 1319663 - protein, 9 aa, Homo Sapiens
AAPGCVGVS

SEQ ID NO: 1319664 - protein, 9 aa, Homo Sapiens
ATTYKHDVL

SEQ ID NO: 1319665 - protein, 9 aa, Homo Sapiens
LEAFHMYLV

SEQ ID NO: 1319666 - protein, 9 aa, Homo Sapiens
PHCLCIPHP

SEQ ID NO: 1319667 - protein, 9 aa, Homo Sapiens
EYYVSCCLQ

SEQ ID NO: 1319668 - protein, 9 aa, Homo Sapiens
KKIGCDNFG

SEQ ID NO: 1319669 - protein, 9 aa, Homo Sapiens
RPRACPPDV

SEQ ID NO: 1319670 - protein, 9 aa, Homo Sapiens
ITELEMTIF

SEQ ID NO: 1319671 - protein, 9 aa, Homo Sapiens
QLGATLFPR

SEQ ID NO: 1319672 - protein, 9 aa, Homo Sapiens
FFSSVISDC

SEQ ID NO: 1319673 - protein, 9 aa, Homo Sapiens
LLCKPRCSL

SEQ ID NO: 1319674 - protein, 9 aa, Homo Sapiens
TPAFLPHRI

SEQ ID NO: 1319675 - protein, 9 aa, Homo Sapiens
CRAEEEQLQ

SEQ ID NO: 1319676 - protein, 9 aa, Homo Sapiens
EEIIKKQEE

SEQ ID NO: 1319677 - protein, 9 aa, Homo Sapiens
SAVEPGTFN

SEQ ID NO: 1319678 - protein, 9 aa, Homo Sapiens
QPTQVTLIM

SEQ ID NO: 1319679 - protein, 9 aa, Homo Sapiens
IKDLSHEVI

SEQ ID NO: 1319680 - protein, 9 aa, Homo Sapiens
LIKQRKKKV

SEQ ID NO: 1319681 - protein, 9 aa, Homo Sapiens
RMYSHITAR

SEQ ID NO: 1319682 - protein, 9 aa, Homo Sapiens
NKLNTITPV

SEQ ID NO: 1319683 - protein, 9 aa, Homo Sapiens
IEGLFFHLP

SEQ ID NO: 1319684 - protein, 9 aa, Homo Sapiens
KKKSVWQRR

SEQ ID NO: 1319685 - protein, 9 aa, Homo Sapiens
CLMAVKEET

SEQ ID NO: 1319686 - protein, 9 aa, Homo Sapiens
AQQQATGKE

SEQ ID NO: 1319687 - protein, 9 aa, Homo Sapiens
SRSPDRRRH

SEQ ID NO: 1319688 - protein, 9 aa, Homo Sapiens
KCGGTIEER

SEQ ID NO: 1319689 - protein, 9 aa, Homo Sapiens
VCPCTLVRI

SEQ ID NO: 1319690 - protein, 9 aa, Homo Sapiens
NPTADCKTV

SEQ ID NO: 1319691 - protein, 9 aa, Homo Sapiens
SSIVGSYDE

SEQ ID NO: 1319692 - protein, 9 aa, Homo Sapiens
VTIPRNYTM

SEQ ID NO: 1319693 - protein, 9 aa, Homo Sapiens
TSPEAMRPS

SEQ ID NO: 1319694 - protein, 9 aa, Homo Sapiens
SCLYDLETT

SEQ ID NO: 1319695 - protein, 9 aa, Homo Sapiens
AQAANFQLC

SEQ ID NO: 1319696 - protein, 9 aa, Homo Sapiens
HQDYFDYES

SEQ ID NO: 1319697 - protein, 9 aa, Homo Sapiens
PAFLPHRIL

SEQ ID NO: 1319698 - protein, 9 aa, Homo Sapiens
AVLTLYVDM

SEQ ID NO: 1319699 - protein, 9 aa, Homo Sapiens
LSYSKVYDP

SEQ ID NO: 1319700 - protein, 9 aa, Homo Sapiens
WGQSPSPTP

SEQ ID NO: 1319701 - protein, 9 aa, Homo Sapiens
NITGGSMMM

SEQ ID NO: 1319702 - protein, 9 aa, Homo Sapiens
RTSPVTRHR

SEQ ID NO: 1319703 - protein, 9 aa, Homo Sapiens
GEGCPPVLT

SEQ ID NO: 1319704 - protein, 9 aa, Homo Sapiens
KNEELIDLC

SEQ ID NO: 1319705 - protein, 9 aa, Homo Sapiens
YPFPSPGPP

SEQ ID NO: 1319706 - protein, 9 aa, Homo Sapiens
SILPIPWAY

SEQ ID NO: 1319707 - protein, 9 aa, Homo Sapiens
THARTSRPL

SEQ ID NO: 1319708 - protein, 9 aa, Homo Sapiens
GELMGYIMD

SEQ ID NO: 1319709 - protein, 9 aa, Homo Sapiens
DGTFVPLGA

SEQ ID NO: 1319710 - protein, 9 aa, Homo Sapiens
IRLIPEKAF

SEQ ID NO: 1319711 - protein, 9 aa, Homo Sapiens
ITSYVSINS

SEQ ID NO: 1319712 - protein, 9 aa, Homo Sapiens
TLEKKIYDC

SEQ ID NO: 1319713 - protein, 9 aa, Homo Sapiens
DNRVQHKQF

SEQ ID NO: 1319714 - protein, 9 aa, Homo Sapiens
NEIYKKVKD

SEQ ID NO: 1319715 - protein, 9 aa, Homo Sapiens
TIFPNSYPN

SEQ ID NO: 1319716 - protein, 9 aa, Homo Sapiens
QLIYYKILG

SEQ ID NO: 1319717 - protein, 9 aa, Homo Sapiens
RHAMWKMML

SEQ ID NO: 1319718 - protein, 9 aa, Homo Sapiens
LGSSDPSLQ

SEQ ID NO: 1319719 - protein, 9 aa, Homo Sapiens
TPSQIKFME

SEQ ID NO: 1319720 - protein, 9 aa, Homo Sapiens
AQLLSKLDS

SEQ ID NO: 1319721 - protein, 9 aa, Homo Sapiens
ILVLQSVPV

SEQ ID NO: 1319722 - protein, 9 aa, Homo Sapiens
TPRQSTVDP

SEQ ID NO: 1319723 - protein, 9 aa, Homo Sapiens
SSCHACALG

SEQ ID NO: 1319724 - protein, 9 aa, Homo Sapiens
RIFKLAQDA

SEQ ID NO: 1319725 - protein, 9 aa, Homo Sapiens
SLAWRKQHQ

SEQ ID NO: 1319726 - protein, 9 aa, Homo Sapiens
WTGLTEHMC

SEQ ID NO: 1319727 - protein, 9 aa, Homo Sapiens
TCYRETCPY

SEQ ID NO: 1319728 - protein, 9 aa, Homo Sapiens
YIIPELLTK

SEQ ID NO: 1319729 - protein, 9 aa, Homo Sapiens
TGPSIQLQL

SEQ ID NO: 1319730 - protein, 9 aa, Homo Sapiens
GEADLADGA

SEQ ID NO: 1319731 - protein, 9 aa, Homo Sapiens
PDGSAVSIY

SEQ ID NO: 1319732 - protein, 9 aa, Homo Sapiens
RSHSLLRSK

SEQ ID NO: 1319733 - protein, 9 aa, Homo Sapiens
DDSVIYLQF

SEQ ID NO: 1319734 - protein, 9 aa, Homo Sapiens
IIITEVRAR

SEQ ID NO: 1319735 - protein, 9 aa, Homo Sapiens
QIPRCQPKK

SEQ ID NO: 1319736 - protein, 9 aa, Homo Sapiens
SQFINGEMQ

SEQ ID NO: 1319737 - protein, 9 aa, Homo Sapiens
CSSVAYAVS

SEQ ID NO: 1319738 - protein, 9 aa, Homo Sapiens
TLSWLDLRL

SEQ ID NO: 1319739 - protein, 9 aa, Homo Sapiens
PFGRPTSFT

SEQ ID NO: 1319740 - protein, 9 aa, Homo Sapiens
VEVMYPALP

SEQ ID NO: 1319741 - protein, 9 aa, Homo Sapiens
LTGCGAGMC

SEQ ID NO: 1319742 - protein, 9 aa, Homo Sapiens
FGDTQKTAS

SEQ ID NO: 1319743 - protein, 9 aa, Homo Sapiens
HGAEKEWGD

SEQ ID NO: 1319744 - protein, 9 aa, Homo Sapiens
NPVNQFAGK

SEQ ID NO: 1319745 - protein, 9 aa, Homo Sapiens
TNTSETPAT

SEQ ID NO: 1319746 - protein, 9 aa, Homo Sapiens
LSLPEKDED

SEQ ID NO: 1319747 - protein, 9 aa, Homo Sapiens
AQMVHREFQ

SEQ ID NO: 1319748 - protein, 9 aa, Homo Sapiens
PGLTAPSLT

SEQ ID NO: 1319749 - protein, 9 aa, Homo Sapiens
DHFKEVICS

SEQ ID NO: 1319750 - protein, 9 aa, Homo Sapiens
YSGHQGHTI

SEQ ID NO: 1319751 - protein, 9 aa, Homo Sapiens
SRSALPDVA

SEQ ID NO: 1319752 - protein, 9 aa, Homo Sapiens
YNTKFTIPD

SEQ ID NO: 1319753 - protein, 9 aa, Homo Sapiens
QTREDIWNA

SEQ ID NO: 1319754 - protein, 9 aa, Homo Sapiens
RTETTEDEH

SEQ ID NO: 1319755 - protein, 9 aa, Homo Sapiens
QEGTKMAVR

SEQ ID NO: 1319756 - protein, 9 aa, Homo Sapiens
DEDVSIRCQ

SEQ ID NO: 1319757 - protein, 9 aa, Homo Sapiens
MWNLENRLE

SEQ ID NO: 1319758 - protein, 9 aa, Homo Sapiens
QLCPSANVY

SEQ ID NO: 1319759 - protein, 9 aa, Homo Sapiens
HQTPQPHLC

SEQ ID NO: 1319760 - protein, 9 aa, Homo Sapiens
LKTTPTPRK

SEQ ID NO: 1319761 - protein, 9 aa, Homo Sapiens
YRKPLELFG

SEQ ID NO: 1319762 - protein, 9 aa, Homo Sapiens
TDTIEANED

SEQ ID NO: 1319763 - protein, 9 aa, Homo Sapiens
WASLETQRA

SEQ ID NO: 1319764 - protein, 9 aa, Homo Sapiens
LHTSVRKCV

SEQ ID NO: 1319765 - protein, 9 aa, Homo Sapiens
HGSVQLSFC

SEQ ID NO: 1319766 - protein, 9 aa, Homo Sapiens
IDGLVDLTV

SEQ ID NO: 1319767 - protein, 9 aa, Homo Sapiens
WEMKQAFIK

SEQ ID NO: 1319768 - protein, 9 aa, Homo Sapiens
QITPPGMPS

SEQ ID NO: 1319769 - protein, 9 aa, Homo Sapiens
SRDPAKMRR

SEQ ID NO: 1319770 - protein, 9 aa, Homo Sapiens
RTPGPPRSM

SEQ ID NO: 1319771 - protein, 9 aa, Homo Sapiens
SLKKFVYAL

SEQ ID NO: 1319772 - protein, 9 aa, Homo Sapiens
HLTTPIMFS

SEQ ID NO: 1319773 - protein, 9 aa, Homo Sapiens
LCFKNGILD

SEQ ID NO: 1319774 - protein, 9 aa, Homo Sapiens
GKADETTAK

SEQ ID NO: 1319775 - protein, 9 aa, Homo Sapiens
RQGLCWLHI

SEQ ID NO: 1319776 - protein, 9 aa, Homo Sapiens
KAPKDPAVC

SEQ ID NO: 1319777 - protein, 9 aa, Homo Sapiens
ISKQIHQHL

SEQ ID NO: 1319778 - protein, 9 aa, Homo Sapiens
RSAEGRSKA

SEQ ID NO: 1319779 - protein, 9 aa, Homo Sapiens
RKCFLCLGW

SEQ ID NO: 1319780 - protein, 9 aa, Homo Sapiens
LKAGLPHPQ

SEQ ID NO: 1319781 - protein, 9 aa, Homo Sapiens
MIDAERVDQ

SEQ ID NO: 1319782 - protein, 9 aa, Homo Sapiens
QHEREKEVI

SEQ ID NO: 1319783 - protein, 9 aa, Homo Sapiens
PASNIYEKL

SEQ ID NO: 1319784 - protein, 9 aa, Homo Sapiens
GMVTEFKHP

SEQ ID NO: 1319785 - protein, 9 aa, Homo Sapiens
DGTPIITFP

SEQ ID NO: 1319786 - protein, 9 aa, Homo Sapiens
HHDIFKILQ

SEQ ID NO: 1319787 - protein, 9 aa, Homo Sapiens
AVLMALRRG

SEQ ID NO: 1319788 - protein, 9 aa, Homo Sapiens
LKSSCIVLT

SEQ ID NO: 1319789 - protein, 9 aa, Homo Sapiens
LPVMRLTCA

SEQ ID NO: 1319790 - protein, 9 aa, Homo Sapiens
QTTTEQGMR

SEQ ID NO: 1319791 - protein, 9 aa, Homo Sapiens
FHQSVRHAM

SEQ ID NO: 1319792 - protein, 9 aa, Homo Sapiens
GQIIKIPDQ

SEQ ID NO: 1319793 - protein, 9 aa, Homo Sapiens
SFICFTPYH

SEQ ID NO: 1319794 - protein, 9 aa, Homo Sapiens
YECPIAFTA

SEQ ID NO: 1319795 - protein, 9 aa, Homo Sapiens
NSGAEAVMN

SEQ ID NO: 1319796 - protein, 9 aa, Homo Sapiens
FSTPATSLH

SEQ ID NO: 1319797 - protein, 9 aa, Homo Sapiens
QEHNIILYE

SEQ ID NO: 1319798 - protein, 9 aa, Homo Sapiens
QVLQNYYTG

SEQ ID NO: 1319799 - protein, 9 aa, Homo Sapiens
VVYTLINAE

SEQ ID NO: 1319800 - protein, 9 aa, Homo Sapiens
TLKLQDQLS

SEQ ID NO: 1319801 - protein, 9 aa, Homo Sapiens
NLTMHMWCH

SEQ ID NO: 1319802 - protein, 9 aa, Homo Sapiens
LPLQSLVGQ

SEQ ID NO: 1319803 - protein, 9 aa, Homo Sapiens
EEMKHEERA

SEQ ID NO: 1319804 - protein, 9 aa, Homo Sapiens
LVLPGEADL

SEQ ID NO: 1319805 - protein, 9 aa, Homo Sapiens
SGLMHDLKD

SEQ ID NO: 1319806 - protein, 9 aa, Homo Sapiens
VTHLVGALR

SEQ ID NO: 1319807 - protein, 9 aa, Homo Sapiens
CSSIGSGGV

SEQ ID NO: 1319808 - protein, 9 aa, Homo Sapiens
ATAICAPAS

SEQ ID NO: 1319809 - protein, 9 aa, Homo Sapiens
KVLHKLTVN

SEQ ID NO: 1319810 - protein, 9 aa, Homo Sapiens
TDSNFTLLV

SEQ ID NO: 1319811 - protein, 9 aa, Homo Sapiens
RHYERLVLS

SEQ ID NO: 1319812 - protein, 9 aa, Homo Sapiens
YSGWNKKSV

SEQ ID NO: 1319813 - protein, 9 aa, Homo Sapiens
KIMPEKPAE

SEQ ID NO: 1319814 - protein, 9 aa, Homo Sapiens
LPSNTLSTV

SEQ ID NO: 1319815 - protein, 9 aa, Homo Sapiens
FAWDTSNHG

SEQ ID NO: 1319816 - protein, 9 aa, Homo Sapiens
GPPSQVADT

SEQ ID NO: 1319817 - protein, 9 aa, Homo Sapiens
PFYVIVEYA

SEQ ID NO: 1319818 - protein, 9 aa, Homo Sapiens
VIFLIFQIH

SEQ ID NO: 1319819 - protein, 9 aa, Homo Sapiens
QMVKQKISF

SEQ ID NO: 1319820 - protein, 9 aa, Homo Sapiens
NSVHGSCRG

SEQ ID NO: 1319821 - protein, 9 aa, Homo Sapiens
GNSLPQGAG

SEQ ID NO: 1319822 - protein, 9 aa, Homo Sapiens
RGARLGLLV

SEQ ID NO: 1319823 - protein, 9 aa, Homo Sapiens
LKEDEAGTP

SEQ ID NO: 1319824 - protein, 9 aa, Homo Sapiens
DIRHIRADK

SEQ ID NO: 1319825 - protein, 9 aa, Homo Sapiens
KGIWMWYVP

SEQ ID NO: 1319826 - protein, 9 aa, Homo Sapiens
EPKIGVIKT

SEQ ID NO: 1319827 - protein, 9 aa, Homo Sapiens
DRPYERPPL

SEQ ID NO: 1319828 - protein, 9 aa, Homo Sapiens
SPTFTWNNS

SEQ ID NO: 1319829 - protein, 9 aa, Homo Sapiens
VSYFTGDYT

SEQ ID NO: 1319830 - protein, 9 aa, Homo Sapiens
MMKEKDEFN

SEQ ID NO: 1319831 - protein, 9 aa, Homo Sapiens
TPQMSATFA

SEQ ID NO: 1319832 - protein, 9 aa, Homo Sapiens
QISRVQLID

SEQ ID NO: 1319833 - protein, 9 aa, Homo Sapiens
IVWNLPLEN

SEQ ID NO: 1319834 - protein, 9 aa, Homo Sapiens
LVHLAQLTI

SEQ ID NO: 1319835 - protein, 9 aa, Homo Sapiens
HAGKAVLRS

SEQ ID NO: 1319836 - protein, 9 aa, Homo Sapiens
GTNTSETPA

SEQ ID NO: 1319837 - protein, 9 aa, Homo Sapiens
FLRSVSLLM

SEQ ID NO: 1319838 - protein, 9 aa, Homo Sapiens
KRRFFPGSE

SEQ ID NO: 1319839 - protein, 9 aa, Homo Sapiens
HQHFGYVQH

SEQ ID NO: 1319840 - protein, 9 aa, Homo Sapiens
VGFSYQVTN

SEQ ID NO: 1319841 - protein, 9 aa, Homo Sapiens
FCEAPMLVR

SEQ ID NO: 1319842 - protein, 9 aa, Homo Sapiens
IYECNICGT

SEQ ID NO: 1319843 - protein, 9 aa, Homo Sapiens
DPGVQLCIT

SEQ ID NO: 1319844 - protein, 9 aa, Homo Sapiens
VFSAYSSVT

SEQ ID NO: 1319845 - protein, 9 aa, Homo Sapiens
QIRALQETM

SEQ ID NO: 1319846 - protein, 9 aa, Homo Sapiens
VYRVLFSLA

SEQ ID NO: 1319847 - protein, 9 aa, Homo Sapiens
TLPVGGMAA

SEQ ID NO: 1319848 - protein, 9 aa, Homo Sapiens
IWERVKQGL

SEQ ID NO: 1319849 - protein, 9 aa, Homo Sapiens
TPEDAVSTF

SEQ ID NO: 1319850 - protein, 9 aa, Homo Sapiens
SDVIDGMEK

SEQ ID NO: 1319851 - protein, 9 aa, Homo Sapiens
LEDFKEMRE

SEQ ID NO: 1319852 - protein, 9 aa, Homo Sapiens
SMVFAGAPL

SEQ ID NO: 1319853 - protein, 9 aa, Homo Sapiens
NEMDIEYIQ

SEQ ID NO: 1319854 - protein, 9 aa, Homo Sapiens
KPTSQWSQY

SEQ ID NO: 1319855 - protein, 9 aa, Homo Sapiens
AFYTHMQTV

SEQ ID NO: 1319856 - protein, 9 aa, Homo Sapiens
PPPPPPSPM

SEQ ID NO: 1319857 - protein, 9 aa, Homo Sapiens
DGPGDPMWG

SEQ ID NO: 1319858 - protein, 9 aa, Homo Sapiens
ATEKDEWLE

SEQ ID NO: 1319859 - protein, 9 aa, Homo Sapiens
GINYHFHSW

SEQ ID NO: 1319860 - protein, 9 aa, Homo Sapiens
RVHFQSHGL

SEQ ID NO: 1319861 - protein, 9 aa, Homo Sapiens
IRANIGDTQ

SEQ ID NO: 1319862 - protein, 9 aa, Homo Sapiens
NVSDLTTKN

SEQ ID NO: 1319863 - protein, 9 aa, Homo Sapiens
PASRCLHCC

SEQ ID NO: 1319864 - protein, 9 aa, Homo Sapiens
RKYQESDHK

SEQ ID NO: 1319865 - protein, 9 aa, Homo Sapiens
PSDDIEEAV

SEQ ID NO: 1319866 - protein, 9 aa, Homo Sapiens
KKQICLILV

SEQ ID NO: 1319867 - protein, 9 aa, Homo Sapiens
TNVKKAKRS

SEQ ID NO: 1319868 - protein, 9 aa, Homo Sapiens
KSNNLVLSC

SEQ ID NO: 1319869 - protein, 9 aa, Homo Sapiens
NTDLNKRRK

SEQ ID NO: 1319870 - protein, 9 aa, Homo Sapiens
CRDLGNCMH

SEQ ID NO: 1319871 - protein, 9 aa, Homo Sapiens
SATTAACAP

SEQ ID NO: 1319872 - protein, 9 aa, Homo Sapiens
IFCPIPWIA

SEQ ID NO: 1319873 - protein, 9 aa, Homo Sapiens
IHSWMNSER

SEQ ID NO: 1319874 - protein, 9 aa, Homo Sapiens
PSTAILPPH

SEQ ID NO: 1319875 - protein, 9 aa, Homo Sapiens
HPAISTLAH

SEQ ID NO: 1319876 - protein, 9 aa, Homo Sapiens
RRSYEAITK

SEQ ID NO: 1319877 - protein, 9 aa, Homo Sapiens
VLHGAVFAF

SEQ ID NO: 1319878 - protein, 9 aa, Homo Sapiens
RMEDAPSEV

SEQ ID NO: 1319879 - protein, 9 aa, Homo Sapiens
GPGDDFFSS

SEQ ID NO: 1319880 - protein, 9 aa, Homo Sapiens
VCIPVGSRE

SEQ ID NO: 1319881 - protein, 9 aa, Homo Sapiens
VDPNFGFEE

SEQ ID NO: 1319882 - protein, 9 aa, Homo Sapiens
KTTLKLLLV

SEQ ID NO: 1319883 - protein, 9 aa, Homo Sapiens
RSLDDVRNR

SEQ ID NO: 1319884 - protein, 9 aa, Homo Sapiens
PRTQASRST

SEQ ID NO: 1319885 - protein, 9 aa, Homo Sapiens
ELASCGHSE

SEQ ID NO: 1319886 - protein, 9 aa, Homo Sapiens
TCVDAGRIP

SEQ ID NO: 1319887 - protein, 9 aa, Homo Sapiens
MLSTYPKRT

SEQ ID NO: 1319888 - protein, 9 aa, Homo Sapiens
PKFLNSTNS

SEQ ID NO: 1319889 - protein, 9 aa, Homo Sapiens
VASKVQTDV

SEQ ID NO: 1319890 - protein, 9 aa, Homo Sapiens
VLPQLIILI

SEQ ID NO: 1319891 - protein, 9 aa, Homo Sapiens
CVVGSHGMP

SEQ ID NO: 1319892 - protein, 9 aa, Homo Sapiens
DQPRSVRYI

SEQ ID NO: 1319893 - protein, 9 aa, Homo Sapiens
EVTEPSHLV

SEQ ID NO: 1319894 - protein, 9 aa, Homo Sapiens
GPGWEEASQ

SEQ ID NO: 1319895 - protein, 9 aa, Homo Sapiens
KMNIMVPED

SEQ ID NO: 1319896 - protein, 9 aa, Homo Sapiens
HTCTPTFST

SEQ ID NO: 1319897 - protein, 9 aa, Homo Sapiens
NGDSWKEYF

SEQ ID NO: 1319898 - protein, 9 aa, Homo Sapiens
HNKTREFLA

SEQ ID NO: 1319899 - protein, 9 aa, Homo Sapiens
LDVVDSKRC

SEQ ID NO: 1319900 - protein, 9 aa, Homo Sapiens
SHRECQQSH

SEQ ID NO: 1319901 - protein, 9 aa, Homo Sapiens
NGDFLPTGL

SEQ ID NO: 1319902 - protein, 9 aa, Homo Sapiens
VSAGNGDDG

SEQ ID NO: 1319903 - protein, 9 aa, Homo Sapiens
SGSEHCYVI

SEQ ID NO: 1319904 - protein, 9 aa, Homo Sapiens
LLSLPPKKC

SEQ ID NO: 1319905 - protein, 9 aa, Homo Sapiens
YRHKMRWLK

SEQ ID NO: 1319906 - protein, 9 aa, Homo Sapiens
SDYALARLE

SEQ ID NO: 1319907 - protein, 9 aa, Homo Sapiens
RCDVSKWPV

SEQ ID NO: 1319908 - protein, 9 aa, Homo Sapiens
MPQSVFLQC

SEQ ID NO: 1319909 - protein, 9 aa, Homo Sapiens
VRKLKTTPT

SEQ ID NO: 1319910 - protein, 9 aa, Homo Sapiens
RSKTLDGTH

SEQ ID NO: 1319911 - protein, 9 aa, Homo Sapiens
ILLGIFNHI

SEQ ID NO: 1319912 - protein, 9 aa, Homo Sapiens
GQGPSDHYH

SEQ ID NO: 1319913 - protein, 9 aa, Homo Sapiens
LHFWVNVIK

SEQ ID NO: 1319914 - protein, 9 aa, Homo Sapiens
ENIDARKND

SEQ ID NO: 1319915 - protein, 9 aa, Homo Sapiens
HQYSGDDGR

SEQ ID NO: 1319916 - protein, 9 aa, Homo Sapiens
ELRKCVLDM

SEQ ID NO: 1319917 - protein, 9 aa, Homo Sapiens
EELQKDIEE

SEQ ID NO: 1319918 - protein, 9 aa, Homo Sapiens
LSPSFTPTH

SEQ ID NO: 1319919 - protein, 9 aa, Homo Sapiens
NLHCALCPL

SEQ ID NO: 1319920 - protein, 9 aa, Homo Sapiens
LENIVVIHC

SEQ ID NO: 1319921 - protein, 9 aa, Homo Sapiens
EVNGPRAIE

SEQ ID NO: 1319922 - protein, 9 aa, Homo Sapiens
VSARSPRLR

SEQ ID NO: 1319923 - protein, 9 aa, Homo Sapiens
PRVPLVLEK

SEQ ID NO: 1319924 - protein, 9 aa, Homo Sapiens
NSLLLFGQC

SEQ ID NO: 1319925 - protein, 9 aa, Homo Sapiens
RFECDCKEA

SEQ ID NO: 1319926 - protein, 9 aa, Homo Sapiens
SMKLERHWH

SEQ ID NO: 1319927 - protein, 9 aa, Homo Sapiens
LAPRAETSP

SEQ ID NO: 1319928 - protein, 9 aa, Homo Sapiens
LPGPAPRRS

SEQ ID NO: 1319929 - protein, 9 aa, Homo Sapiens
CHQYWPAEH

SEQ ID NO: 1319930 - protein, 9 aa, Homo Sapiens
FLEEPKDRT

SEQ ID NO: 1319931 - protein, 9 aa, Homo Sapiens
NQKDALLFS

SEQ ID NO: 1319932 - protein, 9 aa, Homo Sapiens
HNENLNGVS

SEQ ID NO: 1319933 - protein, 9 aa, Homo Sapiens
YSGTGVHKN

SEQ ID NO: 1319934 - protein, 9 aa, Homo Sapiens
PVLPPPPPY

SEQ ID NO: 1319935 - protein, 9 aa, Homo Sapiens
IFIFAYLIF

SEQ ID NO: 1319936 - protein, 9 aa, Homo Sapiens
QTTIEKLRM

SEQ ID NO: 1319937 - protein, 9 aa, Homo Sapiens
ASGLGAWSH

SEQ ID NO: 1319938 - protein, 9 aa, Homo Sapiens
LQETMQRWR

SEQ ID NO: 1319939 - protein, 9 aa, Homo Sapiens
GRSKSKEMP

SEQ ID NO: 1319940 - protein, 9 aa, Homo Sapiens
KVEAGEAGQ

SEQ ID NO: 1319941 - protein, 9 aa, Homo Sapiens
TNPTFPGEK

SEQ ID NO: 1319942 - protein, 9 aa, Homo Sapiens
YIHISSSPQ

SEQ ID NO: 1319943 - protein, 9 aa, Homo Sapiens
RHWHYFDQI

SEQ ID NO: 1319944 - protein, 9 aa, Homo Sapiens
SPPRIHVRS

SEQ ID NO: 1319945 - protein, 9 aa, Homo Sapiens
RWIHDIRTI

SEQ ID NO: 1319946 - protein, 9 aa, Homo Sapiens
TEEECGADT

SEQ ID NO: 1319947 - protein, 9 aa, Homo Sapiens
TSLQDITDV

SEQ ID NO: 1319948 - protein, 9 aa, Homo Sapiens
PSSHLLTVS

SEQ ID NO: 1319949 - protein, 9 aa, Homo Sapiens
LNLIQDQNV

SEQ ID NO: 1319950 - protein, 9 aa, Homo Sapiens
GDEHSSMNR

SEQ ID NO: 1319951 - protein, 9 aa, Homo Sapiens
QQLANEQKP

SEQ ID NO: 1319952 - protein, 9 aa, Homo Sapiens
TFFTENSET

SEQ ID NO: 1319953 - protein, 9 aa, Homo Sapiens
EYIKSFGFN

SEQ ID NO: 1319954 - protein, 9 aa, Homo Sapiens
LCSNMSCCR

SEQ ID NO: 1319955 - protein, 9 aa, Homo Sapiens
VLGPHAGQG

SEQ ID NO: 1319956 - protein, 9 aa, Homo Sapiens
LKMGSAIFV

SEQ ID NO: 1319957 - protein, 9 aa, Homo Sapiens
RRFSRSAIS

SEQ ID NO: 1319958 - protein, 9 aa, Homo Sapiens
SATDSPCIH

SEQ ID NO: 1319959 - protein, 9 aa, Homo Sapiens
ADHSFILIL

SEQ ID NO: 1319960 - protein, 9 aa, Homo Sapiens
HDTRGSSIP

SEQ ID NO: 1319961 - protein, 9 aa, Homo Sapiens
SLPSSSSSE

SEQ ID NO: 1319962 - protein, 9 aa, Homo Sapiens
TPTSSWAVL

SEQ ID NO: 1319963 - protein, 9 aa, Homo Sapiens
CNCWVSING

SEQ ID NO: 1319964 - protein, 9 aa, Homo Sapiens
LLCQNTQTF

SEQ ID NO: 1319965 - protein, 9 aa, Homo Sapiens
IITSTYGWT

SEQ ID NO: 1319966 - protein, 9 aa, Homo Sapiens
LFPSIEEAW

SEQ ID NO: 1319967 - protein, 9 aa, Homo Sapiens
KRLLSRKDI

SEQ ID NO: 1319968 - protein, 9 aa, Homo Sapiens
YFVDKATAR

SEQ ID NO: 1319969 - protein, 9 aa, Homo Sapiens
NDLIAQSAA

SEQ ID NO: 1319970 - protein, 9 aa, Homo Sapiens
LIFGETNQG

SEQ ID NO: 1319971 - protein, 9 aa, Homo Sapiens
FTTYDMNGR

SEQ ID NO: 1319972 - protein, 9 aa, Homo Sapiens
LNWKRQHQH

SEQ ID NO: 1319973 - protein, 9 aa, Homo Sapiens
TVGQAFELC

SEQ ID NO: 1319974 - protein, 9 aa, Homo Sapiens
WEVVFRQRQ

SEQ ID NO: 1319975 - protein, 9 aa, Homo Sapiens
IPWTNQKIC

SEQ ID NO: 1319976 - protein, 9 aa, Homo Sapiens
MPLLLAYLN

SEQ ID NO: 1319977 - protein, 9 aa, Homo Sapiens
QQSHQESTC

SEQ ID NO: 1319978 - protein, 9 aa, Homo Sapiens
NRLANIRKC

SEQ ID NO: 1319979 - protein, 9 aa, Homo Sapiens
MLSTSEQFY

SEQ ID NO: 1319980 - protein, 9 aa, Homo Sapiens
KEGEEADTP

SEQ ID NO: 1319981 - protein, 9 aa, Homo Sapiens
PSVGAQGVN

SEQ ID NO: 1319982 - protein, 9 aa, Homo Sapiens
LSRFNVCNR

SEQ ID NO: 1319983 - protein, 9 aa, Homo Sapiens
SRRRAPPRS

SEQ ID NO: 1319984 - protein, 9 aa, Homo Sapiens
QDAVQQYRH

SEQ ID NO: 1319985 - protein, 9 aa, Homo Sapiens
QESKMACVA

SEQ ID NO: 1319986 - protein, 9 aa, Homo Sapiens
APTPTSSCT

SEQ ID NO: 1319987 - protein, 9 aa, Homo Sapiens
EGDGSSTTY

SEQ ID NO: 1319988 - protein, 9 aa, Homo Sapiens
AETSPSSAA

SEQ ID NO: 1319989 - protein, 9 aa, Homo Sapiens
MHSIEGKDC

SEQ ID NO: 1319990 - protein, 9 aa, Homo Sapiens
FVFSILVLW

SEQ ID NO: 1319991 - protein, 9 aa, Homo Sapiens
DFKQQVSYK

SEQ ID NO: 1319992 - protein, 9 aa, Homo Sapiens
NFLINPLLY

SEQ ID NO: 1319993 - protein, 9 aa, Homo Sapiens
EMEVCDEAA

SEQ ID NO: 1319994 - protein, 9 aa, Homo Sapiens
STVVSLLNE

SEQ ID NO: 1319995 - protein, 9 aa, Homo Sapiens
TTFYFGSNY

SEQ ID NO: 1319996 - protein, 9 aa, Homo Sapiens
LVILLMSEC

SEQ ID NO: 1319997 - protein, 9 aa, Homo Sapiens
ITPSSETSS

SEQ ID NO: 1319998 - protein, 9 aa, Homo Sapiens
LYGKKLVKI

SEQ ID NO: 1319999 - protein, 9 aa, Homo Sapiens
NPHSHHIQN

SEQ ID NO: 1320000 - protein, 9 aa, Homo Sapiens
YMTTVLTGL

SEQ ID NO: 1320001 - protein, 9 aa, Homo Sapiens
HINLWHLAI

SEQ ID NO: 1320002 - protein, 9 aa, Homo Sapiens
ILAAFEVKH

SEQ ID NO: 1320003 - protein, 9 aa, Homo Sapiens
TKEDDKHHE

SEQ ID NO: 1320004 - protein, 9 aa, Homo Sapiens
FFPETAHEV

SEQ ID NO: 1320005 - protein, 9 aa, Homo Sapiens
EQAGGPPRS

SEQ ID NO: 1320006 - protein, 9 aa, Homo Sapiens
EKEKSWVSK

SEQ ID NO: 1320007 - protein, 9 aa, Homo Sapiens
DGSSNTFPI

SEQ ID NO: 1320008 - protein, 9 aa, Homo Sapiens
TFIRYNDMP

SEQ ID NO: 1320009 - protein, 9 aa, Homo Sapiens
SNSNDCMMD

SEQ ID NO: 1320010 - protein, 9 aa, Homo Sapiens
NATKMLSWD

SEQ ID NO: 1320011 - protein, 9 aa, Homo Sapiens
MCKKCGATC

SEQ ID NO: 1320012 - protein, 9 aa, Homo Sapiens
LTERSNAQW

SEQ ID NO: 1320013 - protein, 9 aa, Homo Sapiens
SLEMAGWPE

SEQ ID NO: 1320014 - protein, 9 aa, Homo Sapiens
RESLILQSQ

SEQ ID NO: 1320015 - protein, 9 aa, Homo Sapiens
LKLAPLQVT

SEQ ID NO: 1320016 - protein, 9 aa, Homo Sapiens
TFSAGLGGA

SEQ ID NO: 1320017 - protein, 9 aa, Homo Sapiens
EYEERTAKV

SEQ ID NO: 1320018 - protein, 9 aa, Homo Sapiens
ASSCHACAL

SEQ ID NO: 1320019 - protein, 9 aa, Homo Sapiens
ACVAQNASL

SEQ ID NO: 1320020 - protein, 9 aa, Homo Sapiens
SMLQATTEA

SEQ ID NO: 1320021 - protein, 9 aa, Homo Sapiens
ECLGSPGSS

SEQ ID NO: 1320022 - protein, 9 aa, Homo Sapiens
EPPHPPSSL

SEQ ID NO: 1320023 - protein, 9 aa, Homo Sapiens
IKMAMGIED

SEQ ID NO: 1320024 - protein, 9 aa, Homo Sapiens
KKADVVRVI

SEQ ID NO: 1320025 - protein, 9 aa, Homo Sapiens
EILNTNSIS

SEQ ID NO: 1320026 - protein, 9 aa, Homo Sapiens
RTCPTTWPP

SEQ ID NO: 1320027 - protein, 9 aa, Homo Sapiens
KKVKDDVDK

SEQ ID NO: 1320028 - protein, 9 aa, Homo Sapiens
VLVKVFNTY

SEQ ID NO: 1320029 - protein, 9 aa, Homo Sapiens
LDRSLRKCL

SEQ ID NO: 1320030 - protein, 9 aa, Homo Sapiens
NPQPVQAWL

SEQ ID NO: 1320031 - protein, 9 aa, Homo Sapiens
MKEFSSTVQ

SEQ ID NO: 1320032 - protein, 9 aa, Homo Sapiens
FLGHVVFLL

SEQ ID NO: 1320033 - protein, 9 aa, Homo Sapiens
ATWLGIFYC

SEQ ID NO: 1320034 - protein, 9 aa, Homo Sapiens
VMNWVMSHM

SEQ ID NO: 1320035 - protein, 9 aa, Homo Sapiens
DEHDTILGI

SEQ ID NO: 1320036 - protein, 9 aa, Homo Sapiens
FKDYEICQY

SEQ ID NO: 1320037 - protein, 9 aa, Homo Sapiens
GFEAHYVWD

SEQ ID NO: 1320038 - protein, 9 aa, Homo Sapiens
EVAEQFLRV

SEQ ID NO: 1320039 - protein, 9 aa, Homo Sapiens
YSAATAAGI

SEQ ID NO: 1320040 - protein, 9 aa, Homo Sapiens
DGIGDKCDD

SEQ ID NO: 1320041 - protein, 9 aa, Homo Sapiens
CTRKRRKMY

SEQ ID NO: 1320042 - protein, 9 aa, Homo Sapiens
FEPLSNPDG

SEQ ID NO: 1320043 - protein, 9 aa, Homo Sapiens
ATEDENVTK

SEQ ID NO: 1320044 - protein, 9 aa, Homo Sapiens
SVIMMIYLL

SEQ ID NO: 1320045 - protein, 9 aa, Homo Sapiens
LPRGRGIMP

SEQ ID NO: 1320046 - protein, 9 aa, Homo Sapiens
KLHLDTFAM

SEQ ID NO: 1320047 - protein, 9 aa, Homo Sapiens
IVTFLTLEL

SEQ ID NO: 1320048 - protein, 9 aa, Homo Sapiens
PHPPSSLSP

SEQ ID NO: 1320049 - protein, 9 aa, Homo Sapiens
SVTADLMDF

SEQ ID NO: 1320050 - protein, 9 aa, Homo Sapiens
SKRHRPQPY

SEQ ID NO: 1320051 - protein, 9 aa, Homo Sapiens
HNDPTDFVR

SEQ ID NO: 1320052 - protein, 9 aa, Homo Sapiens
GQHFGLGSL

SEQ ID NO: 1320053 - protein, 9 aa, Homo Sapiens
NEVDSFIVT

SEQ ID NO: 1320054 - protein, 9 aa, Homo Sapiens
QVAGGVLGA

SEQ ID NO: 1320055 - protein, 9 aa, Homo Sapiens
GGSPVGDVG

SEQ ID NO: 1320056 - protein, 9 aa, Homo Sapiens
RAIRHSFID

SEQ ID NO: 1320057 - protein, 9 aa, Homo Sapiens
AQDTTRHSA

SEQ ID NO: 1320058 - protein, 9 aa, Homo Sapiens
PYITNHTFM

SEQ ID NO: 1320059 - protein, 9 aa, Homo Sapiens
FQGKSNFEE

SEQ ID NO: 1320060 - protein, 9 aa, Homo Sapiens
ISRSQSSFS

SEQ ID NO: 1320061 - protein, 9 aa, Homo Sapiens
KEPLENDKA

SEQ ID NO: 1320062 - protein, 9 aa, Homo Sapiens
RHIQYFDLE

SEQ ID NO: 1320063 - protein, 9 aa, Homo Sapiens
IANSNERRH

SEQ ID NO: 1320064 - protein, 9 aa, Homo Sapiens
GRSYKQHSS

SEQ ID NO: 1320065 - protein, 9 aa, Homo Sapiens
KVEHIPKAL

SEQ ID NO: 1320066 - protein, 9 aa, Homo Sapiens
KGKQPKEDI

SEQ ID NO: 1320067 - protein, 9 aa, Homo Sapiens
HVRCHMNKG

SEQ ID NO: 1320068 - protein, 9 aa, Homo Sapiens
PLPNKPPLE

SEQ ID NO: 1320069 - protein, 9 aa, Homo Sapiens
VAAIICYGD

SEQ ID NO: 1320070 - protein, 9 aa, Homo Sapiens
HVPRQLPGP

SEQ ID NO: 1320071 - protein, 9 aa, Homo Sapiens
KFISLIRGG

SEQ ID NO: 1320072 - protein, 9 aa, Homo Sapiens
ITICREEGI

SEQ ID NO: 1320073 - protein, 9 aa, Homo Sapiens
LVLMFGLYE

SEQ ID NO: 1320074 - protein, 9 aa, Homo Sapiens
ELHARAGER

SEQ ID NO: 1320075 - protein, 9 aa, Homo Sapiens
PPCIYMVPM

SEQ ID NO: 1320076 - protein, 9 aa, Homo Sapiens
DTGHDMLAS

SEQ ID NO: 1320077 - protein, 9 aa, Homo Sapiens
HPDKDEGTF

SEQ ID NO: 1320078 - protein, 9 aa, Homo Sapiens
SSSYGPYGY

SEQ ID NO: 1320079 - protein, 9 aa, Homo Sapiens
KTIKQCHVR

SEQ ID NO: 1320080 - protein, 9 aa, Homo Sapiens
HTRHYLNEL

SEQ ID NO: 1320081 - protein, 9 aa, Homo Sapiens
AFLYKGSFC

SEQ ID NO: 1320082 - protein, 9 aa, Homo Sapiens
KAFNQFLIL

SEQ ID NO: 1320083 - protein, 9 aa, Homo Sapiens
QFENETIKI

SEQ ID NO: 1320084 - protein, 9 aa, Homo Sapiens
LIEVVTPTT

SEQ ID NO: 1320085 - protein, 9 aa, Homo Sapiens
LIFLPPVGS

SEQ ID NO: 1320086 - protein, 9 aa, Homo Sapiens
ISEQIISST

SEQ ID NO: 1320087 - protein, 9 aa, Homo Sapiens
EVPWPEVWK

SEQ ID NO: 1320088 - protein, 9 aa, Homo Sapiens
TLPSFYHPY

SEQ ID NO: 1320089 - protein, 9 aa, Homo Sapiens
PAFPQAQAA

SEQ ID NO: 1320090 - protein, 9 aa, Homo Sapiens
GEYECHTSN

SEQ ID NO: 1320091 - protein, 9 aa, Homo Sapiens
QGRPDAKDV

SEQ ID NO: 1320092 - protein, 9 aa, Homo Sapiens
ITAAHGHLE

SEQ ID NO: 1320093 - protein, 9 aa, Homo Sapiens
ACRKTQSNI

SEQ ID NO: 1320094 - protein, 9 aa, Homo Sapiens
RKPMGVSVI

SEQ ID NO: 1320095 - protein, 9 aa, Homo Sapiens
VQPNGLGGN

SEQ ID NO: 1320096 - protein, 9 aa, Homo Sapiens
AGGPPRSRL

SEQ ID NO: 1320097 - protein, 9 aa, Homo Sapiens
LCFKQYLHS

SEQ ID NO: 1320098 - protein, 9 aa, Homo Sapiens
NEMEEFVEA

SEQ ID NO: 1320099 - protein, 9 aa, Homo Sapiens
SLTQKWFPE

SEQ ID NO: 1320100 - protein, 9 aa, Homo Sapiens
VETSELWNL

SEQ ID NO: 1320101 - protein, 9 aa, Homo Sapiens
QKVKNLGYR

SEQ ID NO: 1320102 - protein, 9 aa, Homo Sapiens
ESEQSLILR

SEQ ID NO: 1320103 - protein, 9 aa, Homo Sapiens
HFIHNIPFP

SEQ ID NO: 1320104 - protein, 9 aa, Homo Sapiens
LFFLHQSVK

SEQ ID NO: 1320105 - protein, 9 aa, Homo Sapiens
LVAVFKYCH

SEQ ID NO: 1320106 - protein, 9 aa, Homo Sapiens
DVEWCWHPY

SEQ ID NO: 1320107 - protein, 9 aa, Homo Sapiens
ENAVSVQSW

SEQ ID NO: 1320108 - protein, 9 aa, Homo Sapiens
DIAKRVKLT

SEQ ID NO: 1320109 - protein, 9 aa, Homo Sapiens
YWVSICFPV

SEQ ID NO: 1320110 - protein, 9 aa, Homo Sapiens
LYKFKMKQH

SEQ ID NO: 1320111 - protein, 9 aa, Homo Sapiens
RIARTILVL

SEQ ID NO: 1320112 - protein, 9 aa, Homo Sapiens
ILHSSPKRS

SEQ ID NO: 1320113 - protein, 9 aa, Homo Sapiens
FILVVQSAK

SEQ ID NO: 1320114 - protein, 9 aa, Homo Sapiens
SPLCRAAAM

SEQ ID NO: 1320115 - protein, 9 aa, Homo Sapiens
QLQKATCHH

SEQ ID NO: 1320116 - protein, 9 aa, Homo Sapiens
EQSAALALD

SEQ ID NO: 1320117 - protein, 9 aa, Homo Sapiens
SLMSPGRHK

SEQ ID NO: 1320118 - protein, 9 aa, Homo Sapiens
LNPVVYTLI

SEQ ID NO: 1320119 - protein, 9 aa, Homo Sapiens
TGKKLYEYG

SEQ ID NO: 1320120 - protein, 9 aa, Homo Sapiens
DCLCPSKRH

SEQ ID NO: 1320121 - protein, 9 aa, Homo Sapiens
ATTASTRAR

SEQ ID NO: 1320122 - protein, 9 aa, Homo Sapiens
SLHTSVWIL

SEQ ID NO: 1320123 - protein, 9 aa, Homo Sapiens
FQFLWMVDA

SEQ ID NO: 1320124 - protein, 9 aa, Homo Sapiens
RPLCQRFPT

SEQ ID NO: 1320125 - protein, 9 aa, Homo Sapiens
LLNPYMLAV

SEQ ID NO: 1320126 - protein, 9 aa, Homo Sapiens
ERLHRLLAE

SEQ ID NO: 1320127 - protein, 9 aa, Homo Sapiens
SLPQGAGSP

SEQ ID NO: 1320128 - protein, 9 aa, Homo Sapiens
QCIPSKVTK

SEQ ID NO: 1320129 - protein, 9 aa, Homo Sapiens
RTQYEPLFH

SEQ ID NO: 1320130 - protein, 9 aa, Homo Sapiens
FDLDQVRKH

SEQ ID NO: 1320131 - protein, 9 aa, Homo Sapiens
VNPIIYVFL

SEQ ID NO: 1320132 - protein, 9 aa, Homo Sapiens
IGPHLHGHL

SEQ ID NO: 1320133 - protein, 9 aa, Homo Sapiens
TQDQVAGEC

SEQ ID NO: 1320134 - protein, 9 aa, Homo Sapiens
QQPNRAHNN

SEQ ID NO: 1320135 - protein, 9 aa, Homo Sapiens
APQMISEGD

SEQ ID NO: 1320136 - protein, 9 aa, Homo Sapiens
AQGVTIKFG

SEQ ID NO: 1320137 - protein, 9 aa, Homo Sapiens
KIPGLKTGT

SEQ ID NO: 1320138 - protein, 9 aa, Homo Sapiens
YLCITAKVR

SEQ ID NO: 1320139 - protein, 9 aa, Homo Sapiens
PITFKDFIL

SEQ ID NO: 1320140 - protein, 9 aa, Homo Sapiens
KNKMSSEFQ

SEQ ID NO: 1320141 - protein, 9 aa, Homo Sapiens
CPTNSTGKF

SEQ ID NO: 1320142 - protein, 9 aa, Homo Sapiens
QWSQYLAIR

SEQ ID NO: 1320143 - protein, 9 aa, Homo Sapiens
DREPFQMCL

SEQ ID NO: 1320144 - protein, 9 aa, Homo Sapiens
SREAIAADP

SEQ ID NO: 1320145 - protein, 9 aa, Homo Sapiens
REIENWTTE

SEQ ID NO: 1320146 - protein, 9 aa, Homo Sapiens
TADHCIRFW

SEQ ID NO: 1320147 - protein, 9 aa, Homo Sapiens
LLPAPWPPP

SEQ ID NO: 1320148 - protein, 9 aa, Homo Sapiens
WLCISASPG

SEQ ID NO: 1320149 - protein, 9 aa, Homo Sapiens
NTYVRVLRF

SEQ ID NO: 1320150 - protein, 9 aa, Homo Sapiens
AIEMKDTKI

SEQ ID NO: 1320151 - protein, 9 aa, Homo Sapiens
TVCMPHQLF

SEQ ID NO: 1320152 - protein, 9 aa, Homo Sapiens
PENPILSEL

SEQ ID NO: 1320153 - protein, 9 aa, Homo Sapiens
PLGYLLVPA

SEQ ID NO: 1320154 - protein, 9 aa, Homo Sapiens
EVPIEPYSI

SEQ ID NO: 1320155 - protein, 9 aa, Homo Sapiens
TEDGIIIAT

SEQ ID NO: 1320156 - protein, 9 aa, Homo Sapiens
DTFMEVEMA

SEQ ID NO: 1320157 - protein, 9 aa, Homo Sapiens
PPTPRPERP

SEQ ID NO: 1320158 - protein, 9 aa, Homo Sapiens
YLVWLGPDQ

SEQ ID NO: 1320159 - protein, 9 aa, Homo Sapiens
RRHNLRSFT

SEQ ID NO: 1320160 - protein, 9 aa, Homo Sapiens
EDPWCVAKM

SEQ ID NO: 1320161 - protein, 9 aa, Homo Sapiens
EHTTIPTRA

SEQ ID NO: 1320162 - protein, 9 aa, Homo Sapiens
KKLYLIDCV

SEQ ID NO: 1320163 - protein, 9 aa, Homo Sapiens
IAKRMAVDL

SEQ ID NO: 1320164 - protein, 9 aa, Homo Sapiens
QFWEGPVVH

SEQ ID NO: 1320165 - protein, 9 aa, Homo Sapiens
PEVTEPSHL

SEQ ID NO: 1320166 - protein, 9 aa, Homo Sapiens
VSVERVQPF

SEQ ID NO: 1320167 - protein, 9 aa, Homo Sapiens
TSPSSAAVS

SEQ ID NO: 1320168 - protein, 9 aa, Homo Sapiens
LRHTLQGLE

SEQ ID NO: 1320169 - protein, 9 aa, Homo Sapiens
PKIMPEKPA

SEQ ID NO: 1320170 - protein, 9 aa, Homo Sapiens
RWRAWSSFC

SEQ ID NO: 1320171 - protein, 9 aa, Homo Sapiens
SQPSGAPMA

SEQ ID NO: 1320172 - protein, 9 aa, Homo Sapiens
DVHISQHAP

SEQ ID NO: 1320173 - protein, 9 aa, Homo Sapiens
SSKINVLMH

SEQ ID NO: 1320174 - protein, 9 aa, Homo Sapiens
VHFVNQLWY

SEQ ID NO: 1320175 - protein, 9 aa, Homo Sapiens
IHLQSSVPA

SEQ ID NO: 1320176 - protein, 9 aa, Homo Sapiens
GEKTQVLIG

SEQ ID NO: 1320177 - protein, 9 aa, Homo Sapiens
RMVVEYLRA

SEQ ID NO: 1320178 - protein, 9 aa, Homo Sapiens
ILIFWIICL

SEQ ID NO: 1320179 - protein, 9 aa, Homo Sapiens
SYGNSTRVI

SEQ ID NO: 1320180 - protein, 9 aa, Homo Sapiens
KQALATLSA

SEQ ID NO: 1320181 - protein, 9 aa, Homo Sapiens
LTMGTTECV

SEQ ID NO: 1320182 - protein, 9 aa, Homo Sapiens
PKETSMQPP

SEQ ID NO: 1320183 - protein, 9 aa, Homo Sapiens
TQEVEIGTV

SEQ ID NO: 1320184 - protein, 9 aa, Homo Sapiens
HEDIINVRT

SEQ ID NO: 1320185 - protein, 9 aa, Homo Sapiens
CHGFIFKGR

SEQ ID NO: 1320186 - protein, 9 aa, Homo Sapiens
QERVLLATG

SEQ ID NO: 1320187 - protein, 9 aa, Homo Sapiens
QLLLLLLLD

SEQ ID NO: 1320188 - protein, 9 aa, Homo Sapiens
QQAFLRSVS

SEQ ID NO: 1320189 - protein, 9 aa, Homo Sapiens
EMDRVLMER

SEQ ID NO: 1320190 - protein, 9 aa, Homo Sapiens
PLHNAVCTG

SEQ ID NO: 1320191 - protein, 9 aa, Homo Sapiens
SITPSSETS

SEQ ID NO: 1320192 - protein, 9 aa, Homo Sapiens
DDDDGDDLE

SEQ ID NO: 1320193 - protein, 9 aa, Homo Sapiens
LGAMTSECH

SEQ ID NO: 1320194 - protein, 9 aa, Homo Sapiens
DVQEKWGLK

SEQ ID NO: 1320195 - protein, 9 aa, Homo Sapiens
DRPEARRPY

SEQ ID NO: 1320196 - protein, 9 aa, Homo Sapiens
LHMHGPNLI

SEQ ID NO: 1320197 - protein, 9 aa, Homo Sapiens
VVPSMQPVV

SEQ ID NO: 1320198 - protein, 9 aa, Homo Sapiens
LELPIASRI

SEQ ID NO: 1320199 - protein, 9 aa, Homo Sapiens
IREKERCNQ

SEQ ID NO: 1320200 - protein, 9 aa, Homo Sapiens
PLHYAGEIC

SEQ ID NO: 1320201 - protein, 9 aa, Homo Sapiens
HTALLAAML

SEQ ID NO: 1320202 - protein, 9 aa, Homo Sapiens
AMFHQYSGD

SEQ ID NO: 1320203 - protein, 9 aa, Homo Sapiens
APTPQMLRH

SEQ ID NO: 1320204 - protein, 9 aa, Homo Sapiens
QEFNPEHFW

SEQ ID NO: 1320205 - protein, 9 aa, Homo Sapiens
FPQEVAEQF

SEQ ID NO: 1320206 - protein, 9 aa, Homo Sapiens
RKYPEPLCF

SEQ ID NO: 1320207 - protein, 9 aa, Homo Sapiens
CENVQLRKY

SEQ ID NO: 1320208 - protein, 9 aa, Homo Sapiens
REAKPHSLR

SEQ ID NO: 1320209 - protein, 9 aa, Homo Sapiens
PRTFCLADS

SEQ ID NO: 1320210 - protein, 9 aa, Homo Sapiens
MKSGARLEA

SEQ ID NO: 1320211 - protein, 9 aa, Homo Sapiens
TRVHVFQID

SEQ ID NO: 1320212 - protein, 9 aa, Homo Sapiens
ELPDVPYDS

SEQ ID NO: 1320213 - protein, 9 aa, Homo Sapiens
VCSKDSDCH

SEQ ID NO: 1320214 - protein, 9 aa, Homo Sapiens
STASDLAHL

SEQ ID NO: 1320215 - protein, 9 aa, Homo Sapiens
LSQEAWHPE

SEQ ID NO: 1320216 - protein, 9 aa, Homo Sapiens
QARVRAARK

SEQ ID NO: 1320217 - protein, 9 aa, Homo Sapiens
EIEVDKVFW

SEQ ID NO: 1320218 - protein, 9 aa, Homo Sapiens
KRVCGWWPF

SEQ ID NO: 1320219 - protein, 9 aa, Homo Sapiens
YVSSLKWQI

SEQ ID NO: 1320220 - protein, 9 aa, Homo Sapiens
GTQEVEIGT

SEQ ID NO: 1320221 - protein, 9 aa, Homo Sapiens
TDSPCIHCL

SEQ ID NO: 1320222 - protein, 9 aa, Homo Sapiens
CIHCLRPIW

SEQ ID NO: 1320223 - protein, 9 aa, Homo Sapiens
VRNINNKRC

SEQ ID NO: 1320224 - protein, 9 aa, Homo Sapiens
TVVSMLVSS

SEQ ID NO: 1320225 - protein, 9 aa, Homo Sapiens
HIERYEFPP

SEQ ID NO: 1320226 - protein, 9 aa, Homo Sapiens
DFYYGTCVL

SEQ ID NO: 1320227 - protein, 9 aa, Homo Sapiens
GPLGLSGAS

SEQ ID NO: 1320228 - protein, 9 aa, Homo Sapiens
INPHLPSDL

SEQ ID NO: 1320229 - protein, 9 aa, Homo Sapiens
RTMVPSPEA

SEQ ID NO: 1320230 - protein, 9 aa, Homo Sapiens
DDIYTPAYG

SEQ ID NO: 1320231 - protein, 9 aa, Homo Sapiens
DRFRFVWLE

SEQ ID NO: 1320232 - protein, 9 aa, Homo Sapiens
WARHMGKCK

SEQ ID NO: 1320233 - protein, 9 aa, Homo Sapiens
MALMDTYSP

SEQ ID NO: 1320234 - protein, 9 aa, Homo Sapiens
KQTRTNAKC

SEQ ID NO: 1320235 - protein, 9 aa, Homo Sapiens
VQGKTPPRQ

SEQ ID NO: 1320236 - protein, 9 aa, Homo Sapiens
ELGDFTALL

SEQ ID NO: 1320237 - protein, 9 aa, Homo Sapiens
SYSTVTRFI

SEQ ID NO: 1320238 - protein, 9 aa, Homo Sapiens
APLSGRQWV

SEQ ID NO: 1320239 - protein, 9 aa, Homo Sapiens
RGKQGGKAC

SEQ ID NO: 1320240 - protein, 9 aa, Homo Sapiens
NTFPIWFEY

SEQ ID NO: 1320241 - protein, 9 aa, Homo Sapiens
QEGFVPLDT

SEQ ID NO: 1320242 - protein, 9 aa, Homo Sapiens
ESKNTQDMQ

SEQ ID NO: 1320243 - protein, 9 aa, Homo Sapiens
SSACTRSTL

SEQ ID NO: 1320244 - protein, 9 aa, Homo Sapiens
MVKRKWTRP

SEQ ID NO: 1320245 - protein, 9 aa, Homo Sapiens
LHPPLNICV

SEQ ID NO: 1320246 - protein, 9 aa, Homo Sapiens
NCNKAFVNY

SEQ ID NO: 1320247 - protein, 9 aa, Homo Sapiens
EQDREPLHT

SEQ ID NO: 1320248 - protein, 9 aa, Homo Sapiens
VGGPTEEKL

SEQ ID NO: 1320249 - protein, 9 aa, Homo Sapiens
ETKWVALPE

SEQ ID NO: 1320250 - protein, 9 aa, Homo Sapiens
IKLLYAALT

SEQ ID NO: 1320251 - protein, 9 aa, Homo Sapiens
GKTAVFVLP

SEQ ID NO: 1320252 - protein, 9 aa, Homo Sapiens
LSAIVSCLE

SEQ ID NO: 1320253 - protein, 9 aa, Homo Sapiens
ETILYACRQ

SEQ ID NO: 1320254 - protein, 9 aa, Homo Sapiens
TYRDVSYLS

SEQ ID NO: 1320255 - protein, 9 aa, Homo Sapiens
TNIWLKQEW

SEQ ID NO: 1320256 - protein, 9 aa, Homo Sapiens
DPRQKDDLV

SEQ ID NO: 1320257 - protein, 9 aa, Homo Sapiens
TSHLAHPNK

SEQ ID NO: 1320258 - protein, 9 aa, Homo Sapiens
CFKQYLHSP

SEQ ID NO: 1320259 - protein, 9 aa, Homo Sapiens
QFAQHPAGR

SEQ ID NO: 1320260 - protein, 9 aa, Homo Sapiens
HSDTYVIRI

SEQ ID NO: 1320261 - protein, 9 aa, Homo Sapiens
YQGPGWEEA

SEQ ID NO: 1320262 - protein, 9 aa, Homo Sapiens
QRHSPGVMV

SEQ ID NO: 1320263 - protein, 9 aa, Homo Sapiens
EVVSKWVGI

SEQ ID NO: 1320264 - protein, 9 aa, Homo Sapiens
VVPGKRAHV

SEQ ID NO: 1320265 - protein, 9 aa, Homo Sapiens
KKFLEKEVQ

SEQ ID NO: 1320266 - protein, 9 aa, Homo Sapiens
YSVLSTLRG

SEQ ID NO: 1320267 - protein, 9 aa, Homo Sapiens
KAHPENKQH

SEQ ID NO: 1320268 - protein, 9 aa, Homo Sapiens
QQQQRQRQR

SEQ ID NO: 1320269 - protein, 9 aa, Homo Sapiens
FKRKHGKSL

SEQ ID NO: 1320270 - protein, 9 aa, Homo Sapiens
SISFLTPLH

SEQ ID NO: 1320271 - protein, 9 aa, Homo Sapiens
MVYKIFHIL

SEQ ID NO: 1320272 - protein, 9 aa, Homo Sapiens
FDFTGNLIE

SEQ ID NO: 1320273 - protein, 9 aa, Homo Sapiens
EMSEHPSQS

SEQ ID NO: 1320274 - protein, 9 aa, Homo Sapiens
SRKMHSWSK

SEQ ID NO: 1320275 - protein, 9 aa, Homo Sapiens
LDKLLDHME

SEQ ID NO: 1320276 - protein, 9 aa, Homo Sapiens
DFIFHPVSV

SEQ ID NO: 1320277 - protein, 9 aa, Homo Sapiens
SMTSVTSCL

SEQ ID NO: 1320278 - protein, 9 aa, Homo Sapiens
QIRGMMLYH

SEQ ID NO: 1320279 - protein, 9 aa, Homo Sapiens
RMHTSFKHH

SEQ ID NO: 1320280 - protein, 9 aa, Homo Sapiens
EEGRPKDDH

SEQ ID NO: 1320281 - protein, 9 aa, Homo Sapiens
TSANFSNRP

SEQ ID NO: 1320282 - protein, 9 aa, Homo Sapiens
NGSSNVEVF

SEQ ID NO: 1320283 - protein, 9 aa, Homo Sapiens
NSAAQYLQQ

SEQ ID NO: 1320284 - protein, 9 aa, Homo Sapiens
HVRIQLKDH

SEQ ID NO: 1320285 - protein, 9 aa, Homo Sapiens
AENTYLCQR

SEQ ID NO: 1320286 - protein, 9 aa, Homo Sapiens
VNMRHLWRP

SEQ ID NO: 1320287 - protein, 9 aa, Homo Sapiens
GPIHIGTGC

SEQ ID NO: 1320288 - protein, 9 aa, Homo Sapiens
RQAEDSDLF

SEQ ID NO: 1320289 - protein, 9 aa, Homo Sapiens
PTSLVLNDI

SEQ ID NO: 1320290 - protein, 9 aa, Homo Sapiens
DDRTGVTGY

SEQ ID NO: 1320291 - protein, 9 aa, Homo Sapiens
PMPKNKHKL

SEQ ID NO: 1320292 - protein, 9 aa, Homo Sapiens
LWKKSPTTQ

SEQ ID NO: 1320293 - protein, 9 aa, Homo Sapiens
DLFLLRKDS

SEQ ID NO: 1320294 - protein, 9 aa, Homo Sapiens
GNTGTSPYR

SEQ ID NO: 1320295 - protein, 9 aa, Homo Sapiens
IWMWYVPHP

SEQ ID NO: 1320296 - protein, 9 aa, Homo Sapiens
ALLLKICGV

SEQ ID NO: 1320297 - protein, 9 aa, Homo Sapiens
VFYVKARLI

SEQ ID NO: 1320298 - protein, 9 aa, Homo Sapiens
LNVQVTNTH

SEQ ID NO: 1320299 - protein, 9 aa, Homo Sapiens
RRLTLLERR

SEQ ID NO: 1320300 - protein, 9 aa, Homo Sapiens
EGIIEENGQ

SEQ ID NO: 1320301 - protein, 9 aa, Homo Sapiens
LMVRFTSLF

SEQ ID NO: 1320302 - protein, 9 aa, Homo Sapiens
KWCPYTKHQ

SEQ ID NO: 1320303 - protein, 9 aa, Homo Sapiens
NPQPGSCSV

SEQ ID NO: 1320304 - protein, 9 aa, Homo Sapiens
HRSLRLPPT

SEQ ID NO: 1320305 - protein, 9 aa, Homo Sapiens
TFKVASREL

SEQ ID NO: 1320306 - protein, 9 aa, Homo Sapiens
QIKKRMAKP

SEQ ID NO: 1320307 - protein, 9 aa, Homo Sapiens
PNIPICLAS

SEQ ID NO: 1320308 - protein, 9 aa, Homo Sapiens
VVHIHCWLS

SEQ ID NO: 1320309 - protein, 9 aa, Homo Sapiens
TKKKMARET

SEQ ID NO: 1320310 - protein, 9 aa, Homo Sapiens
TPCGRGPQP

SEQ ID NO: 1320311 - protein, 9 aa, Homo Sapiens
KEVNSMGSR

SEQ ID NO: 1320312 - protein, 9 aa, Homo Sapiens
TVEKEAPDV

SEQ ID NO: 1320313 - protein, 9 aa, Homo Sapiens
VQPSCPSQL

SEQ ID NO: 1320314 - protein, 9 aa, Homo Sapiens
DILFFLSKK

SEQ ID NO: 1320315 - protein, 9 aa, Homo Sapiens
EAMFLEANI

SEQ ID NO: 1320316 - protein, 9 aa, Homo Sapiens
CVRVTVQAH

SEQ ID NO: 1320317 - protein, 9 aa, Homo Sapiens
NTGVICHVG

SEQ ID NO: 1320318 - protein, 9 aa, Homo Sapiens
KRKKEDGIR

SEQ ID NO: 1320319 - protein, 9 aa, Homo Sapiens
AIEFPGGKG

SEQ ID NO: 1320320 - protein, 9 aa, Homo Sapiens
KKDHDASPS

SEQ ID NO: 1320321 - protein, 9 aa, Homo Sapiens
VVCSIALFF

SEQ ID NO: 1320322 - protein, 9 aa, Homo Sapiens
DCHTPLAEH

SEQ ID NO: 1320323 - protein, 9 aa, Homo Sapiens
YRGTVGALL

SEQ ID NO: 1320324 - protein, 9 aa, Homo Sapiens
LVRMYRDDI

SEQ ID NO: 1320325 - protein, 9 aa, Homo Sapiens
APGWALTWT

SEQ ID NO: 1320326 - protein, 9 aa, Homo Sapiens
STRASFSVL

SEQ ID NO: 1320327 - protein, 9 aa, Homo Sapiens
LLLFKELQP

SEQ ID NO: 1320328 - protein, 9 aa, Homo Sapiens
TYLQMSPTS

SEQ ID NO: 1320329 - protein, 9 aa, Homo Sapiens
VASSCHACA

SEQ ID NO: 1320330 - protein, 9 aa, Homo Sapiens
KIWCFGPDS

SEQ ID NO: 1320331 - protein, 9 aa, Homo Sapiens
VIKVNKGCV

SEQ ID NO: 1320332 - protein, 9 aa, Homo Sapiens
EITQETAQL

SEQ ID NO: 1320333 - protein, 9 aa, Homo Sapiens
MYRPVNWCA

SEQ ID NO: 1320334 - protein, 9 aa, Homo Sapiens
RHLEGGITF

SEQ ID NO: 1320335 - protein, 9 aa, Homo Sapiens
CDRSKKILP

SEQ ID NO: 1320336 - protein, 9 aa, Homo Sapiens
AISEECKAG

SEQ ID NO: 1320337 - protein, 9 aa, Homo Sapiens
RHKSESQRK

SEQ ID NO: 1320338 - protein, 9 aa, Homo Sapiens
RTKVAATAG

SEQ ID NO: 1320339 - protein, 9 aa, Homo Sapiens
KYIGHYFIT

SEQ ID NO: 1320340 - protein, 9 aa, Homo Sapiens
CPNHPIIQW

SEQ ID NO: 1320341 - protein, 9 aa, Homo Sapiens
PSVIRINQE

SEQ ID NO: 1320342 - protein, 9 aa, Homo Sapiens
EDTGHDMLA

SEQ ID NO: 1320343 - protein, 9 aa, Homo Sapiens
AGGHVKPQG

SEQ ID NO: 1320344 - protein, 9 aa, Homo Sapiens
KTIHTGKQP

SEQ ID NO: 1320345 - protein, 9 aa, Homo Sapiens
CYFINDLYS

SEQ ID NO: 1320346 - protein, 9 aa, Homo Sapiens
ANTNGSSPE

SEQ ID NO: 1320347 - protein, 9 aa, Homo Sapiens
HQLSALRCG

SEQ ID NO: 1320348 - protein, 9 aa, Homo Sapiens
MAEQLLARG

SEQ ID NO: 1320349 - protein, 9 aa, Homo Sapiens
VSQDMFDNG

SEQ ID NO: 1320350 - protein, 9 aa, Homo Sapiens
LFYDICKLS

SEQ ID NO: 1320351 - protein, 9 aa, Homo Sapiens
TRAADQTTT

SEQ ID NO: 1320352 - protein, 9 aa, Homo Sapiens
DVEWAAKAA

SEQ ID NO: 1320353 - protein, 9 aa, Homo Sapiens
PSEALTMLL

SEQ ID NO: 1320354 - protein, 9 aa, Homo Sapiens
MTDIVEASR

SEQ ID NO: 1320355 - protein, 9 aa, Homo Sapiens
PVRQPTQLT

SEQ ID NO: 1320356 - protein, 9 aa, Homo Sapiens
SFHLYLFFC

SEQ ID NO: 1320357 - protein, 9 aa, Homo Sapiens
EIEHIKIES

SEQ ID NO: 1320358 - protein, 9 aa, Homo Sapiens
KVKEAVKVV

SEQ ID NO: 1320359 - protein, 9 aa, Homo Sapiens
FFITLVFFL

SEQ ID NO: 1320360 - protein, 9 aa, Homo Sapiens
IGKKSHLRK

SEQ ID NO: 1320361 - protein, 9 aa, Homo Sapiens
VFCVNVEDE

SEQ ID NO: 1320362 - protein, 9 aa, Homo Sapiens
PQNGCQDVH

SEQ ID NO: 1320363 - protein, 9 aa, Homo Sapiens
VRLQWMESQ

SEQ ID NO: 1320364 - protein, 9 aa, Homo Sapiens
VRFTLFQTH

SEQ ID NO: 1320365 - protein, 9 aa, Homo Sapiens
TSKDVTLHW

SEQ ID NO: 1320366 - protein, 9 aa, Homo Sapiens
ARGIAIHMW

SEQ ID NO: 1320367 - protein, 9 aa, Homo Sapiens
ANFSNRPVL

SEQ ID NO: 1320368 - protein, 9 aa, Homo Sapiens
LQPYNSRRV

SEQ ID NO: 1320369 - protein, 9 aa, Homo Sapiens
SKEWERAIL

SEQ ID NO: 1320370 - protein, 9 aa, Homo Sapiens
KYSVLSTLR

SEQ ID NO: 1320371 - protein, 9 aa, Homo Sapiens
RITELEMTI

SEQ ID NO: 1320372 - protein, 9 aa, Homo Sapiens
WDYFEDQPL

SEQ ID NO: 1320373 - protein, 9 aa, Homo Sapiens
GYSFTLQIM

SEQ ID NO: 1320374 - protein, 9 aa, Homo Sapiens
QYYERNELY

SEQ ID NO: 1320375 - protein, 9 aa, Homo Sapiens
AKQRWSEKK

SEQ ID NO: 1320376 - protein, 9 aa, Homo Sapiens
SEQSLILRQ

SEQ ID NO: 1320377 - protein, 9 aa, Homo Sapiens
ILMALQMGI

SEQ ID NO: 1320378 - protein, 9 aa, Homo Sapiens
YKFRDSLKH

SEQ ID NO: 1320379 - protein, 9 aa, Homo Sapiens
YTYTIIQER

SEQ ID NO: 1320380 - protein, 9 aa, Homo Sapiens
SSKQESYEE

SEQ ID NO: 1320381 - protein, 9 aa, Homo Sapiens
IYYRSALMT

SEQ ID NO: 1320382 - protein, 9 aa, Homo Sapiens
NEIYNFFCD

SEQ ID NO: 1320383 - protein, 9 aa, Homo Sapiens
HEYQVNGKM

SEQ ID NO: 1320384 - protein, 9 aa, Homo Sapiens
DSQLADSLI

SEQ ID NO: 1320385 - protein, 9 aa, Homo Sapiens
IKYLDVFAR

SEQ ID NO: 1320386 - protein, 9 aa, Homo Sapiens
RYPQAGPRE

SEQ ID NO: 1320387 - protein, 9 aa, Homo Sapiens
FPLGYLLVP

SEQ ID NO: 1320388 - protein, 9 aa, Homo Sapiens
TFSEVIRFN

SEQ ID NO: 1320389 - protein, 9 aa, Homo Sapiens
QSVCENGCQ

SEQ ID NO: 1320390 - protein, 9 aa, Homo Sapiens
DPLKSLGGR

SEQ ID NO: 1320391 - protein, 9 aa, Homo Sapiens
TKEDVMMAT

SEQ ID NO: 1320392 - protein, 9 aa, Homo Sapiens
EASVEKQRV

SEQ ID NO: 1320393 - protein, 9 aa, Homo Sapiens
VYANQEVSP

SEQ ID NO: 1320394 - protein, 9 aa, Homo Sapiens
FNLLDEDKD

SEQ ID NO: 1320395 - protein, 9 aa, Homo Sapiens
DLIHHFSIH

SEQ ID NO: 1320396 - protein, 9 aa, Homo Sapiens
SIVRNLHYD

SEQ ID NO: 1320397 - protein, 9 aa, Homo Sapiens
SQSVRKALD

SEQ ID NO: 1320398 - protein, 9 aa, Homo Sapiens
ETAEEVVTL

SEQ ID NO: 1320399 - protein, 9 aa, Homo Sapiens
TAEDSAEIT

SEQ ID NO: 1320400 - protein, 9 aa, Homo Sapiens
PHLYEDTLI

SEQ ID NO: 1320401 - protein, 9 aa, Homo Sapiens
ALQATRQLL

SEQ ID NO: 1320402 - protein, 9 aa, Homo Sapiens
LMKVGALEG

SEQ ID NO: 1320403 - protein, 9 aa, Homo Sapiens
NVIFLIFQI

SEQ ID NO: 1320404 - protein, 9 aa, Homo Sapiens
LNDEWVQCA

SEQ ID NO: 1320405 - protein, 9 aa, Homo Sapiens
RNRFQNRVH

SEQ ID NO: 1320406 - protein, 9 aa, Homo Sapiens
DYQHYLRMW

SEQ ID NO: 1320407 - protein, 9 aa, Homo Sapiens
NEGWGPKQP

SEQ ID NO: 1320408 - protein, 9 aa, Homo Sapiens
FVPYSQIPP

SEQ ID NO: 1320409 - protein, 9 aa, Homo Sapiens
VCTKDMPPM

SEQ ID NO: 1320410 - protein, 9 aa, Homo Sapiens
RLSYSKVYD

SEQ ID NO: 1320411 - protein, 9 aa, Homo Sapiens
GKQLVKQGS

SEQ ID NO: 1320412 - protein, 9 aa, Homo Sapiens
TNCHTKIHH

SEQ ID NO: 1320413 - protein, 9 aa, Homo Sapiens
MYTCLLWLP

SEQ ID NO: 1320414 - protein, 9 aa, Homo Sapiens
FEEVQHLRF

SEQ ID NO: 1320415 - protein, 9 aa, Homo Sapiens
SMNASLEIF

SEQ ID NO: 1320416 - protein, 9 aa, Homo Sapiens
AVNKRTVCM

SEQ ID NO: 1320417 - protein, 9 aa, Homo Sapiens
TPQPHLCRE

SEQ ID NO: 1320418 - protein, 9 aa, Homo Sapiens
CSSHVTVVG

SEQ ID NO: 1320419 - protein, 9 aa, Homo Sapiens
RMWSPQNLH

SEQ ID NO: 1320420 - protein, 9 aa, Homo Sapiens
RREASKSVL

SEQ ID NO: 1320421 - protein, 9 aa, Homo Sapiens
RFSPTRTRL

SEQ ID NO: 1320422 - protein, 9 aa, Homo Sapiens
TLRVSVFRP

SEQ ID NO: 1320423 - protein, 9 aa, Homo Sapiens
LVEEMETTT

SEQ ID NO: 1320424 - protein, 9 aa, Homo Sapiens
DQYYERNEL

SEQ ID NO: 1320425 - protein, 9 aa, Homo Sapiens
TTPSPASGS

SEQ ID NO: 1320426 - protein, 9 aa, Homo Sapiens
LYGLLVNEI

SEQ ID NO: 1320427 - protein, 9 aa, Homo Sapiens
RLQALLSSI

SEQ ID NO: 1320428 - protein, 9 aa, Homo Sapiens
STLMSCTEA

SEQ ID NO: 1320429 - protein, 9 aa, Homo Sapiens
VKSVPPQSR

SEQ ID NO: 1320430 - protein, 9 aa, Homo Sapiens
ISENSLITL

SEQ ID NO: 1320431 - protein, 9 aa, Homo Sapiens
KDIPFTCET

SEQ ID NO: 1320432 - protein, 9 aa, Homo Sapiens
TKGIWMWYV

SEQ ID NO: 1320433 - protein, 9 aa, Homo Sapiens
RLTQGTDKL

SEQ ID NO: 1320434 - protein, 9 aa, Homo Sapiens
PSSLSPPSD

SEQ ID NO: 1320435 - protein, 9 aa, Homo Sapiens
LALTDMFLG

SEQ ID NO: 1320436 - protein, 9 aa, Homo Sapiens
GTRPQRRHT

SEQ ID NO: 1320437 - protein, 9 aa, Homo Sapiens
GTFDRLLIS

SEQ ID NO: 1320438 - protein, 9 aa, Homo Sapiens
RSWGCVGTV

SEQ ID NO: 1320439 - protein, 9 aa, Homo Sapiens
TLMSCTEAS

SEQ ID NO: 1320440 - protein, 9 aa, Homo Sapiens
SPWWSCGEK

SEQ ID NO: 1320441 - protein, 9 aa, Homo Sapiens
TSISLLVVL

SEQ ID NO: 1320442 - protein, 9 aa, Homo Sapiens
VLEHLNTIV

SEQ ID NO: 1320443 - protein, 9 aa, Homo Sapiens
IQKEDPKAM

SEQ ID NO: 1320444 - protein, 9 aa, Homo Sapiens
YPYQVVRAH

SEQ ID NO: 1320445 - protein, 9 aa, Homo Sapiens
ALYLYGVIL

SEQ ID NO: 1320446 - protein, 9 aa, Homo Sapiens
VPEELKQLL

SEQ ID NO: 1320447 - protein, 9 aa, Homo Sapiens
AFLHHIRQN

SEQ ID NO: 1320448 - protein, 9 aa, Homo Sapiens
LDALTHTKP

SEQ ID NO: 1320449 - protein, 9 aa, Homo Sapiens
VVRIWALKM

SEQ ID NO: 1320450 - protein, 9 aa, Homo Sapiens
GLMKVGALE

SEQ ID NO: 1320451 - protein, 9 aa, Homo Sapiens
DHKMEVAFM

SEQ ID NO: 1320452 - protein, 9 aa, Homo Sapiens
VRLGHVELA

SEQ ID NO: 1320453 - protein, 9 aa, Homo Sapiens
INSKGCVEY

SEQ ID NO: 1320454 - protein, 9 aa, Homo Sapiens
YRTIDEHDV

SEQ ID NO: 1320455 - protein, 9 aa, Homo Sapiens
PQVYNNQEP

SEQ ID NO: 1320456 - protein, 9 aa, Homo Sapiens
YLALPLNHL

SEQ ID NO: 1320457 - protein, 9 aa, Homo Sapiens
RRRRHNLRS

SEQ ID NO: 1320458 - protein, 9 aa, Homo Sapiens
ITVITSMNP

SEQ ID NO: 1320459 - protein, 9 aa, Homo Sapiens
KVRPHIALP

SEQ ID NO: 1320460 - protein, 9 aa, Homo Sapiens
WLLVCERAS

SEQ ID NO: 1320461 - protein, 9 aa, Homo Sapiens
KINAAKSLL

SEQ ID NO: 1320462 - protein, 9 aa, Homo Sapiens
VSPSGEDFI

SEQ ID NO: 1320463 - protein, 9 aa, Homo Sapiens
STHQQSAST

SEQ ID NO: 1320464 - protein, 9 aa, Homo Sapiens
TIAIFQIAA

SEQ ID NO: 1320465 - protein, 9 aa, Homo Sapiens
VKMEMPIIS

SEQ ID NO: 1320466 - protein, 9 aa, Homo Sapiens
VGDTRSILY

SEQ ID NO: 1320467 - protein, 9 aa, Homo Sapiens
SHMILRKGS

SEQ ID NO: 1320468 - protein, 9 aa, Homo Sapiens
SLILQSQVK

SEQ ID NO: 1320469 - protein, 9 aa, Homo Sapiens
KGMRTVEGG

SEQ ID NO: 1320470 - protein, 9 aa, Homo Sapiens
EQGLSTFYL

SEQ ID NO: 1320471 - protein, 9 aa, Homo Sapiens
FGSNYMSID

SEQ ID NO: 1320472 - protein, 9 aa, Homo Sapiens
FFTDLKLWD

SEQ ID NO: 1320473 - protein, 9 aa, Homo Sapiens
LCALYLGLQ

SEQ ID NO: 1320474 - protein, 9 aa, Homo Sapiens
RKVGGQLNL

SEQ ID NO: 1320475 - protein, 9 aa, Homo Sapiens
GEAGTEDKR

SEQ ID NO: 1320476 - protein, 9 aa, Homo Sapiens
LHHFLEQHE

SEQ ID NO: 1320477 - protein, 9 aa, Homo Sapiens
TKMAVRLAD

SEQ ID NO: 1320478 - protein, 9 aa, Homo Sapiens
KNMQSLWEK

SEQ ID NO: 1320479 - protein, 9 aa, Homo Sapiens
NHLDLPPYP

SEQ ID NO: 1320480 - protein, 9 aa, Homo Sapiens
ADAFAPVTY

SEQ ID NO: 1320481 - protein, 9 aa, Homo Sapiens
HFKVTTMSI

SEQ ID NO: 1320482 - protein, 9 aa, Homo Sapiens
GKGLRGSTK

SEQ ID NO: 1320483 - protein, 9 aa, Homo Sapiens
REDPTYTPR

SEQ ID NO: 1320484 - protein, 9 aa, Homo Sapiens
ITYSDEVRN

SEQ ID NO: 1320485 - protein, 9 aa, Homo Sapiens
WGSDSEKRS

SEQ ID NO: 1320486 - protein, 9 aa, Homo Sapiens
IIIQQDTSE

SEQ ID NO: 1320487 - protein, 9 aa, Homo Sapiens
AEFVDFTPQ

SEQ ID NO: 1320488 - protein, 9 aa, Homo Sapiens
ALGPHSLEG

SEQ ID NO: 1320489 - protein, 9 aa, Homo Sapiens
RFAQNPPIF

SEQ ID NO: 1320490 - protein, 9 aa, Homo Sapiens
TEAETWEGT

SEQ ID NO: 1320491 - protein, 9 aa, Homo Sapiens
LKWEALHVA

SEQ ID NO: 1320492 - protein, 9 aa, Homo Sapiens
VIPTRTARW

SEQ ID NO: 1320493 - protein, 9 aa, Homo Sapiens
TVCIENMED

SEQ ID NO: 1320494 - protein, 9 aa, Homo Sapiens
QDFFQEILH

SEQ ID NO: 1320495 - protein, 9 aa, Homo Sapiens
QEVLGCVVL

SEQ ID NO: 1320496 - protein, 9 aa, Homo Sapiens
WYLIVWENS

SEQ ID NO: 1320497 - protein, 9 aa, Homo Sapiens
HIVLEKLSK

SEQ ID NO: 1320498 - protein, 9 aa, Homo Sapiens
VAASTHMVL

SEQ ID NO: 1320499 - protein, 9 aa, Homo Sapiens
SRSSSVGGT

SEQ ID NO: 1320500 - protein, 9 aa, Homo Sapiens
DFTYDSDVT

SEQ ID NO: 1320501 - protein, 9 aa, Homo Sapiens
HYLRAYFPD

SEQ ID NO: 1320502 - protein, 9 aa, Homo Sapiens
AKQDCAHFV

SEQ ID NO: 1320503 - protein, 9 aa, Homo Sapiens
FTGLVLDSG

SEQ ID NO: 1320504 - protein, 9 aa, Homo Sapiens
VQAHSIYPI

SEQ ID NO: 1320505 - protein, 9 aa, Homo Sapiens
ADKKDHDAS

SEQ ID NO: 1320506 - protein, 9 aa, Homo Sapiens
LLDYIDRLF

SEQ ID NO: 1320507 - protein, 9 aa, Homo Sapiens
QTTVPQKPH

SEQ ID NO: 1320508 - protein, 9 aa, Homo Sapiens
RRRHRSFSG

SEQ ID NO: 1320509 - protein, 9 aa, Homo Sapiens
LFPPSKLAF

SEQ ID NO: 1320510 - protein, 9 aa, Homo Sapiens
KLGLTITAR

SEQ ID NO: 1320511 - protein, 9 aa, Homo Sapiens
YLPSYYPPS

SEQ ID NO: 1320512 - protein, 9 aa, Homo Sapiens
CSPCSPTTP

SEQ ID NO: 1320513 - protein, 9 aa, Homo Sapiens
KEDDKHHEV

SEQ ID NO: 1320514 - protein, 9 aa, Homo Sapiens
LCIPACVIG

SEQ ID NO: 1320515 - protein, 9 aa, Homo Sapiens
IHGYSISHM

SEQ ID NO: 1320516 - protein, 9 aa, Homo Sapiens
KLLADLDPV

SEQ ID NO: 1320517 - protein, 9 aa, Homo Sapiens
RAREKCRKA

SEQ ID NO: 1320518 - protein, 9 aa, Homo Sapiens
VYALKAPKS

SEQ ID NO: 1320519 - protein, 9 aa, Homo Sapiens
FAYLIFALG

SEQ ID NO: 1320520 - protein, 9 aa, Homo Sapiens
TRDAHLCPQ

SEQ ID NO: 1320521 - protein, 9 aa, Homo Sapiens
TYTVLLDGC

SEQ ID NO: 1320522 - protein, 9 aa, Homo Sapiens
TSGQKLASW

SEQ ID NO: 1320523 - protein, 9 aa, Homo Sapiens
EEQGRPDAK

SEQ ID NO: 1320524 - protein, 9 aa, Homo Sapiens
LQPAVPSSS

SEQ ID NO: 1320525 - protein, 9 aa, Homo Sapiens
SPHLAALIL

SEQ ID NO: 1320526 - protein, 9 aa, Homo Sapiens
TTLDGHSGQ

SEQ ID NO: 1320527 - protein, 9 aa, Homo Sapiens
HRPPNSAAQ

SEQ ID NO: 1320528 - protein, 9 aa, Homo Sapiens
RSYKQHSSL

SEQ ID NO: 1320529 - protein, 9 aa, Homo Sapiens
VNTLFLCFL

SEQ ID NO: 1320530 - protein, 9 aa, Homo Sapiens
PVVVILEKM

SEQ ID NO: 1320531 - protein, 9 aa, Homo Sapiens
LARKSTLKT

SEQ ID NO: 1320532 - protein, 9 aa, Homo Sapiens
DVILKAVKD

SEQ ID NO: 1320533 - protein, 9 aa, Homo Sapiens
SDVSSAPDN

SEQ ID NO: 1320534 - protein, 9 aa, Homo Sapiens
GEKGEPVDP

SEQ ID NO: 1320535 - protein, 9 aa, Homo Sapiens
QHILKEDML

SEQ ID NO: 1320536 - protein, 9 aa, Homo Sapiens
KKGLLRRYH

SEQ ID NO: 1320537 - protein, 9 aa, Homo Sapiens
IVKKVCQKK

SEQ ID NO: 1320538 - protein, 9 aa, Homo Sapiens
NLSKILTLR

SEQ ID NO: 1320539 - protein, 9 aa, Homo Sapiens
STSASTLDQ

SEQ ID NO: 1320540 - protein, 9 aa, Homo Sapiens
SPKDVFETR

SEQ ID NO: 1320541 - protein, 9 aa, Homo Sapiens
ICSEVGLPA

SEQ ID NO: 1320542 - protein, 9 aa, Homo Sapiens
CELTVRTNS

SEQ ID NO: 1320543 - protein, 9 aa, Homo Sapiens
EQESPRSPL

SEQ ID NO: 1320544 - protein, 9 aa, Homo Sapiens
THQWRTSTT

SEQ ID NO: 1320545 - protein, 9 aa, Homo Sapiens
FQELREVTG

SEQ ID NO: 1320546 - protein, 9 aa, Homo Sapiens
LTPLLLHAP

SEQ ID NO: 1320547 - protein, 9 aa, Homo Sapiens
MILAGSPTE

SEQ ID NO: 1320548 - protein, 9 aa, Homo Sapiens
FFLHQSVKN

SEQ ID NO: 1320549 - protein, 9 aa, Homo Sapiens
NRFSLALEC

SEQ ID NO: 1320550 - protein, 9 aa, Homo Sapiens
WWEARSITT

SEQ ID NO: 1320551 - protein, 9 aa, Homo Sapiens
PVIYKVQCV

SEQ ID NO: 1320552 - protein, 9 aa, Homo Sapiens
ANWTRLQQL

SEQ ID NO: 1320553 - protein, 9 aa, Homo Sapiens
NEKGMDAVP

SEQ ID NO: 1320554 - protein, 9 aa, Homo Sapiens
SHTVMNGAL

SEQ ID NO: 1320555 - protein, 9 aa, Homo Sapiens
DNLITLEEH

SEQ ID NO: 1320556 - protein, 9 aa, Homo Sapiens
LCRELHPRY

SEQ ID NO: 1320557 - protein, 9 aa, Homo Sapiens
KSDKYDACD

SEQ ID NO: 1320558 - protein, 9 aa, Homo Sapiens
KGVLKRRAG

SEQ ID NO: 1320559 - protein, 9 aa, Homo Sapiens
LGRRITELE

SEQ ID NO: 1320560 - protein, 9 aa, Homo Sapiens
LDENLNKNH

SEQ ID NO: 1320561 - protein, 9 aa, Homo Sapiens
MARRQHLKS

SEQ ID NO: 1320562 - protein, 9 aa, Homo Sapiens
EHTPPHLLK

SEQ ID NO: 1320563 - protein, 9 aa, Homo Sapiens
IMPGGNMNI

SEQ ID NO: 1320564 - protein, 9 aa, Homo Sapiens
DYTPRVSIQ

SEQ ID NO: 1320565 - protein, 9 aa, Homo Sapiens
SVVRRTQHY

SEQ ID NO: 1320566 - protein, 9 aa, Homo Sapiens
EKCCHAYHQ

SEQ ID NO: 1320567 - protein, 9 aa, Homo Sapiens
PPLIKMACD

SEQ ID NO: 1320568 - protein, 9 aa, Homo Sapiens
NRKDLIHHF

SEQ ID NO: 1320569 - protein, 9 aa, Homo Sapiens
SSLTVMDLE

SEQ ID NO: 1320570 - protein, 9 aa, Homo Sapiens
MPYGQPQPP

SEQ ID NO: 1320571 - protein, 9 aa, Homo Sapiens
PGTSSVAYG

SEQ ID NO: 1320572 - protein, 9 aa, Homo Sapiens
QKIFHINPH

SEQ ID NO: 1320573 - protein, 9 aa, Homo Sapiens
SGAKVLATM

SEQ ID NO: 1320574 - protein, 9 aa, Homo Sapiens
RKWTRPTKS

SEQ ID NO: 1320575 - protein, 9 aa, Homo Sapiens
GPSALPSPP

SEQ ID NO: 1320576 - protein, 9 aa, Homo Sapiens
PAPWPPPAG

SEQ ID NO: 1320577 - protein, 9 aa, Homo Sapiens
VCYSTVVTS

SEQ ID NO: 1320578 - protein, 9 aa, Homo Sapiens
HVLRVKHAG

SEQ ID NO: 1320579 - protein, 9 aa, Homo Sapiens
DSCSDCSYH

SEQ ID NO: 1320580 - protein, 9 aa, Homo Sapiens
KAEFPDEES

SEQ ID NO: 1320581 - protein, 9 aa, Homo Sapiens
AESGEAVRH

SEQ ID NO: 1320582 - protein, 9 aa, Homo Sapiens
SDHKVVGLL

SEQ ID NO: 1320583 - protein, 9 aa, Homo Sapiens
HNFIYEQSC

SEQ ID NO: 1320584 - protein, 9 aa, Homo Sapiens
TGLSHVSDH

SEQ ID NO: 1320585 - protein, 9 aa, Homo Sapiens
KDLIHHFSI

SEQ ID NO: 1320586 - protein, 9 aa, Homo Sapiens
EKKMLEQIR

SEQ ID NO: 1320587 - protein, 9 aa, Homo Sapiens
PENEFVFNA

SEQ ID NO: 1320588 - protein, 9 aa, Homo Sapiens
RNLKMEMLT

SEQ ID NO: 1320589 - protein, 9 aa, Homo Sapiens
MEQLWLLVC

SEQ ID NO: 1320590 - protein, 9 aa, Homo Sapiens
FKIERRAVV

SEQ ID NO: 1320591 - protein, 9 aa, Homo Sapiens
SSKGPWSST

SEQ ID NO: 1320592 - protein, 9 aa, Homo Sapiens
TQIKVVKVF

SEQ ID NO: 1320593 - protein, 9 aa, Homo Sapiens
EMFSRLHRV

SEQ ID NO: 1320594 - protein, 9 aa, Homo Sapiens
GRSLPAGPS

SEQ ID NO: 1320595 - protein, 9 aa, Homo Sapiens
TSNDCGGIY

SEQ ID NO: 1320596 - protein, 9 aa, Homo Sapiens
PGPLSQAPQ

SEQ ID NO: 1320597 - protein, 9 aa, Homo Sapiens
GENSEKKQG

SEQ ID NO: 1320598 - protein, 9 aa, Homo Sapiens
EFSKWLLST

SEQ ID NO: 1320599 - protein, 9 aa, Homo Sapiens
FLQKFTVSQ

SEQ ID NO: 1320600 - protein, 9 aa, Homo Sapiens
HTPAEEMPE

SEQ ID NO: 1320601 - protein, 9 aa, Homo Sapiens
NCMHTMGYM

SEQ ID NO: 1320602 - protein, 9 aa, Homo Sapiens
LSEAPHVDG

SEQ ID NO: 1320603 - protein, 9 aa, Homo Sapiens
PSYLSSKCI

SEQ ID NO: 1320604 - protein, 9 aa, Homo Sapiens
IQRGSLGVD

SEQ ID NO: 1320605 - protein, 9 aa, Homo Sapiens
QELVLFNCS

SEQ ID NO: 1320606 - protein, 9 aa, Homo Sapiens
HYFCGHNES

SEQ ID NO: 1320607 - protein, 9 aa, Homo Sapiens
DGMGNLRVA

SEQ ID NO: 1320608 - protein, 9 aa, Homo Sapiens
SGIPLDQTL

SEQ ID NO: 1320609 - protein, 9 aa, Homo Sapiens
RIDSVIPHV

SEQ ID NO: 1320610 - protein, 9 aa, Homo Sapiens
KKLKELHSM

SEQ ID NO: 1320611 - protein, 9 aa, Homo Sapiens
FGLGSKYFT

SEQ ID NO: 1320612 - protein, 9 aa, Homo Sapiens
PGLPKMQAI

SEQ ID NO: 1320613 - protein, 9 aa, Homo Sapiens
DEAKQRGLT

SEQ ID NO: 1320614 - protein, 9 aa, Homo Sapiens
FTPEFQQTD

SEQ ID NO: 1320615 - protein, 9 aa, Homo Sapiens
ITLLASLLQ

SEQ ID NO: 1320616 - protein, 9 aa, Homo Sapiens
TAVQKEEVR

SEQ ID NO: 1320617 - protein, 9 aa, Homo Sapiens
HSLEGADPG

SEQ ID NO: 1320618 - protein, 9 aa, Homo Sapiens
CQCHHGETC

SEQ ID NO: 1320619 - protein, 9 aa, Homo Sapiens
GKIKKVYPG

SEQ ID NO: 1320620 - protein, 9 aa, Homo Sapiens
RQRAPHLLQ

SEQ ID NO: 1320621 - protein, 9 aa, Homo Sapiens
RYLVERTRD

SEQ ID NO: 1320622 - protein, 9 aa, Homo Sapiens
KTEYENKLY

SEQ ID NO: 1320623 - protein, 9 aa, Homo Sapiens
DRMAFCVTS

SEQ ID NO: 1320624 - protein, 9 aa, Homo Sapiens
IYIINIHSM

SEQ ID NO: 1320625 - protein, 9 aa, Homo Sapiens
SICLLSVFQ

SEQ ID NO: 1320626 - protein, 9 aa, Homo Sapiens
TEASRDPAK

SEQ ID NO: 1320627 - protein, 9 aa, Homo Sapiens
SASTRASGP

SEQ ID NO: 1320628 - protein, 9 aa, Homo Sapiens
DNLEEVKMT

SEQ ID NO: 1320629 - protein, 9 aa, Homo Sapiens
QLIPALVKV

SEQ ID NO: 1320630 - protein, 9 aa, Homo Sapiens
ISHPHSCRD

SEQ ID NO: 1320631 - protein, 9 aa, Homo Sapiens
VAAKWEQLS

SEQ ID NO: 1320632 - protein, 9 aa, Homo Sapiens
KQPHHHRSK

SEQ ID NO: 1320633 - protein, 9 aa, Homo Sapiens
EARHPVYES

SEQ ID NO: 1320634 - protein, 9 aa, Homo Sapiens
ACTISNDHG

SEQ ID NO: 1320635 - protein, 9 aa, Homo Sapiens
MMGLRYSAF

SEQ ID NO: 1320636 - protein, 9 aa, Homo Sapiens
QLWRTAMRV

SEQ ID NO: 1320637 - protein, 9 aa, Homo Sapiens
SGHRTFETK

SEQ ID NO: 1320638 - protein, 9 aa, Homo Sapiens
RPDVWAVLH

SEQ ID NO: 1320639 - protein, 9 aa, Homo Sapiens
ENDNMFCAQ

SEQ ID NO: 1320640 - protein, 9 aa, Homo Sapiens
LQSGCPPWL

SEQ ID NO: 1320641 - protein, 9 aa, Homo Sapiens
DDKHHEVNV

SEQ ID NO: 1320642 - protein, 9 aa, Homo Sapiens
DVYSELSVF

SEQ ID NO: 1320643 - protein, 9 aa, Homo Sapiens
YYRLKEALQ

SEQ ID NO: 1320644 - protein, 9 aa, Homo Sapiens
HDDSLRFNE

SEQ ID NO: 1320645 - protein, 9 aa, Homo Sapiens
YIIYDEDYE

SEQ ID NO: 1320646 - protein, 9 aa, Homo Sapiens
NTKLYLDFI

SEQ ID NO: 1320647 - protein, 9 aa, Homo Sapiens
EVVVAEGPF

SEQ ID NO: 1320648 - protein, 9 aa, Homo Sapiens
ADACHLTLD

SEQ ID NO: 1320649 - protein, 9 aa, Homo Sapiens
SILVLWTTL

SEQ ID NO: 1320650 - protein, 9 aa, Homo Sapiens
AMNAARPSP

SEQ ID NO: 1320651 - protein, 9 aa, Homo Sapiens
LIIVVFVAV

SEQ ID NO: 1320652 - protein, 9 aa, Homo Sapiens
YRLCWSLHN

SEQ ID NO: 1320653 - protein, 9 aa, Homo Sapiens
QDVETLYKE

SEQ ID NO: 1320654 - protein, 9 aa, Homo Sapiens
LSLCIAVCI

SEQ ID NO: 1320655 - protein, 9 aa, Homo Sapiens
KRMHTSFKH

SEQ ID NO: 1320656 - protein, 9 aa, Homo Sapiens
TYGDEECLY

SEQ ID NO: 1320657 - protein, 9 aa, Homo Sapiens
LRESDVIDG

SEQ ID NO: 1320658 - protein, 9 aa, Homo Sapiens
ATMYHCLQF

SEQ ID NO: 1320659 - protein, 9 aa, Homo Sapiens
NHWWQVSIT

SEQ ID NO: 1320660 - protein, 9 aa, Homo Sapiens
QDLGSAYYL

SEQ ID NO: 1320661 - protein, 9 aa, Homo Sapiens
GQTNPTFPG

SEQ ID NO: 1320662 - protein, 9 aa, Homo Sapiens
KSGVKLDAA

SEQ ID NO: 1320663 - protein, 9 aa, Homo Sapiens
SNKYTQAVF

SEQ ID NO: 1320664 - protein, 9 aa, Homo Sapiens
LEITCTALA

SEQ ID NO: 1320665 - protein, 9 aa, Homo Sapiens
PELHVPLFI

SEQ ID NO: 1320666 - protein, 9 aa, Homo Sapiens
AQWPPGPRY

SEQ ID NO: 1320667 - protein, 9 aa, Homo Sapiens
LQALLSSIN

SEQ ID NO: 1320668 - protein, 9 aa, Homo Sapiens
SKEVSLIFT

SEQ ID NO: 1320669 - protein, 9 aa, Homo Sapiens
AANLFQFLW

SEQ ID NO: 1320670 - protein, 9 aa, Homo Sapiens
GYKHATFVD

SEQ ID NO: 1320671 - protein, 9 aa, Homo Sapiens
ELPEQQVGH

SEQ ID NO: 1320672 - protein, 9 aa, Homo Sapiens
TDDICLDII

SEQ ID NO: 1320673 - protein, 9 aa, Homo Sapiens
KRDDSDVIY

SEQ ID NO: 1320674 - protein, 9 aa, Homo Sapiens
HMWKGYRDA

SEQ ID NO: 1320675 - protein, 9 aa, Homo Sapiens
PQSPVGENA

SEQ ID NO: 1320676 - protein, 9 aa, Homo Sapiens
RKYVGSNIV

SEQ ID NO: 1320677 - protein, 9 aa, Homo Sapiens
DIPSSTTSL

SEQ ID NO: 1320678 - protein, 9 aa, Homo Sapiens
LTLVEAYRE

SEQ ID NO: 1320679 - protein, 9 aa, Homo Sapiens
KDIEEVKVL

SEQ ID NO: 1320680 - protein, 9 aa, Homo Sapiens
SFTGQGTNT

SEQ ID NO: 1320681 - protein, 9 aa, Homo Sapiens
ARSTRKKWC

SEQ ID NO: 1320682 - protein, 9 aa, Homo Sapiens
HFGHHDIFK

SEQ ID NO: 1320683 - protein, 9 aa, Homo Sapiens
RDTEGTELS

SEQ ID NO: 1320684 - protein, 9 aa, Homo Sapiens
YSLDGKKLG

SEQ ID NO: 1320685 - protein, 9 aa, Homo Sapiens
SNVAPPAFS

SEQ ID NO: 1320686 - protein, 9 aa, Homo Sapiens
GHRNVVYVI

SEQ ID NO: 1320687 - protein, 9 aa, Homo Sapiens
ICLGSLSKL

SEQ ID NO: 1320688 - protein, 9 aa, Homo Sapiens
NAGDHQLSA

SEQ ID NO: 1320689 - protein, 9 aa, Homo Sapiens
GTAVAKTTS

SEQ ID NO: 1320690 - protein, 9 aa, Homo Sapiens
LFLLFTGLL

SEQ ID NO: 1320691 - protein, 9 aa, Homo Sapiens
PSSASTDHT

SEQ ID NO: 1320692 - protein, 9 aa, Homo Sapiens
SNEQISVVS

SEQ ID NO: 1320693 - protein, 9 aa, Homo Sapiens
FQGLFQYLM

SEQ ID NO: 1320694 - protein, 9 aa, Homo Sapiens
LVSSWSVDD

SEQ ID NO: 1320695 - protein, 9 aa, Homo Sapiens
DYIIPKNML

SEQ ID NO: 1320696 - protein, 9 aa, Homo Sapiens
EETTRIHQE

SEQ ID NO: 1320697 - protein, 9 aa, Homo Sapiens
YKEDDLVCG

SEQ ID NO: 1320698 - protein, 9 aa, Homo Sapiens
HTWPWVNFY

SEQ ID NO: 1320699 - protein, 9 aa, Homo Sapiens
WHHPGDSDL

SEQ ID NO: 1320700 - protein, 9 aa, Homo Sapiens
NPVINITSM

SEQ ID NO: 1320701 - protein, 9 aa, Homo Sapiens
SSSGDPPVN

SEQ ID NO: 1320702 - protein, 9 aa, Homo Sapiens
CVYITEIAP

SEQ ID NO: 1320703 - protein, 9 aa, Homo Sapiens
RSFLVFIRE

SEQ ID NO: 1320704 - protein, 9 aa, Homo Sapiens
QHHKEVKAK

SEQ ID NO: 1320705 - protein, 9 aa, Homo Sapiens
AYEAFKASH

SEQ ID NO: 1320706 - protein, 9 aa, Homo Sapiens
NYVSRPHRC

SEQ ID NO: 1320707 - protein, 9 aa, Homo Sapiens
ISCRWWGSA

SEQ ID NO: 1320708 - protein, 9 aa, Homo Sapiens
NTCSAHTTC

SEQ ID NO: 1320709 - protein, 9 aa, Homo Sapiens
DKDKKCHKK

SEQ ID NO: 1320710 - protein, 9 aa, Homo Sapiens
AERFLAKTY

SEQ ID NO: 1320711 - protein, 9 aa, Homo Sapiens
LDDIIPNGV

SEQ ID NO: 1320712 - protein, 9 aa, Homo Sapiens
TEFEAEQER

SEQ ID NO: 1320713 - protein, 9 aa, Homo Sapiens
YVQWGKGLA

SEQ ID NO: 1320714 - protein, 9 aa, Homo Sapiens
KVVKVFHSS

SEQ ID NO: 1320715 - protein, 9 aa, Homo Sapiens
LYYDNRIHM

SEQ ID NO: 1320716 - protein, 9 aa, Homo Sapiens
QSVLLAPSH

SEQ ID NO: 1320717 - protein, 9 aa, Homo Sapiens
LHTTTPVEH

SEQ ID NO: 1320718 - protein, 9 aa, Homo Sapiens
QQQVAGGVL

SEQ ID NO: 1320719 - protein, 9 aa, Homo Sapiens
LSGHRFLYI

SEQ ID NO: 1320720 - protein, 9 aa, Homo Sapiens
RRTAQNISE

SEQ ID NO: 1320721 - protein, 9 aa, Homo Sapiens
HVKRKNVTF

SEQ ID NO: 1320722 - protein, 9 aa, Homo Sapiens
HHLVEKITK

SEQ ID NO: 1320723 - protein, 9 aa, Homo Sapiens
HLVLRHSYH

SEQ ID NO: 1320724 - protein, 9 aa, Homo Sapiens
QGKLWLQKW

SEQ ID NO: 1320725 - protein, 9 aa, Homo Sapiens
DLRVKMMTT

SEQ ID NO: 1320726 - protein, 9 aa, Homo Sapiens
GIRQDGSQR

SEQ ID NO: 1320727 - protein, 9 aa, Homo Sapiens
DNMFYYYNK

SEQ ID NO: 1320728 - protein, 9 aa, Homo Sapiens
MTEQLRKIG

SEQ ID NO: 1320729 - protein, 9 aa, Homo Sapiens
FSHFMSVIY

SEQ ID NO: 1320730 - protein, 9 aa, Homo Sapiens
FYYGWDGGK

SEQ ID NO: 1320731 - protein, 9 aa, Homo Sapiens
PTLTIIGLI

SEQ ID NO: 1320732 - protein, 9 aa, Homo Sapiens
ICGGEIRKM

SEQ ID NO: 1320733 - protein, 9 aa, Homo Sapiens
LEINQELHS

SEQ ID NO: 1320734 - protein, 9 aa, Homo Sapiens
AEPSARTTV

SEQ ID NO: 1320735 - protein, 9 aa, Homo Sapiens
TRIYPSAYH

SEQ ID NO: 1320736 - protein, 9 aa, Homo Sapiens
NELHNPDPA

SEQ ID NO: 1320737 - protein, 9 aa, Homo Sapiens
HILELSTQA

SEQ ID NO: 1320738 - protein, 9 aa, Homo Sapiens
VVVIMGVVL

SEQ ID NO: 1320739 - protein, 9 aa, Homo Sapiens
IEKNEGCLY

SEQ ID NO: 1320740 - protein, 9 aa, Homo Sapiens
LTTPAQPPT

SEQ ID NO: 1320741 - protein, 9 aa, Homo Sapiens
PWDVILKAV

SEQ ID NO: 1320742 - protein, 9 aa, Homo Sapiens
HTFSAGLGG

SEQ ID NO: 1320743 - protein, 9 aa, Homo Sapiens
QCGCHVFEI

SEQ ID NO: 1320744 - protein, 9 aa, Homo Sapiens
QKYLYRSVM

SEQ ID NO: 1320745 - protein, 9 aa, Homo Sapiens
LFLYCYPPD

SEQ ID NO: 1320746 - protein, 9 aa, Homo Sapiens
FTTLNRLDQ

SEQ ID NO: 1320747 - protein, 9 aa, Homo Sapiens
KPDMNYEIM

SEQ ID NO: 1320748 - protein, 9 aa, Homo Sapiens
RMRQISDWT

SEQ ID NO: 1320749 - protein, 9 aa, Homo Sapiens
YMILHRRIH

SEQ ID NO: 1320750 - protein, 9 aa, Homo Sapiens
KKMPHGSVQ

SEQ ID NO: 1320751 - protein, 9 aa, Homo Sapiens
QSVSLKSQL

SEQ ID NO: 1320752 - protein, 9 aa, Homo Sapiens
GHHRVMNQQ

SEQ ID NO: 1320753 - protein, 9 aa, Homo Sapiens
WEEKHITFT

SEQ ID NO: 1320754 - protein, 9 aa, Homo Sapiens
VLHFFASMW

SEQ ID NO: 1320755 - protein, 9 aa, Homo Sapiens
SRITYSDEV

SEQ ID NO: 1320756 - protein, 9 aa, Homo Sapiens
GPLGPPGPV

SEQ ID NO: 1320757 - protein, 9 aa, Homo Sapiens
GRHTASVRA

SEQ ID NO: 1320758 - protein, 9 aa, Homo Sapiens
DELRCRIIQ

SEQ ID NO: 1320759 - protein, 9 aa, Homo Sapiens
VKLVEKWAF

SEQ ID NO: 1320760 - protein, 9 aa, Homo Sapiens
SSKRNRHHI

SEQ ID NO: 1320761 - protein, 9 aa, Homo Sapiens
EDYEKAFFK

SEQ ID NO: 1320762 - protein, 9 aa, Homo Sapiens
ESAKMHLRQ

SEQ ID NO: 1320763 - protein, 9 aa, Homo Sapiens
CHFRKLHCT

SEQ ID NO: 1320764 - protein, 9 aa, Homo Sapiens
GTLEEVSAA

SEQ ID NO: 1320765 - protein, 9 aa, Homo Sapiens
KRRMHSQPQ

SEQ ID NO: 1320766 - protein, 9 aa, Homo Sapiens
FGMSTVSCG

SEQ ID NO: 1320767 - protein, 9 aa, Homo Sapiens
KTCSERQLL

SEQ ID NO: 1320768 - protein, 9 aa, Homo Sapiens
ECHDALYVV

SEQ ID NO: 1320769 - protein, 9 aa, Homo Sapiens
NTLSLWSHC

SEQ ID NO: 1320770 - protein, 9 aa, Homo Sapiens
PSPGAPTFW

SEQ ID NO: 1320771 - protein, 9 aa, Homo Sapiens
QLMEQLWLL

SEQ ID NO: 1320772 - protein, 9 aa, Homo Sapiens
NENLNGVSS

SEQ ID NO: 1320773 - protein, 9 aa, Homo Sapiens
MWLYQLSKG

SEQ ID NO: 1320774 - protein, 9 aa, Homo Sapiens
QMNHTLFSL

SEQ ID NO: 1320775 - protein, 9 aa, Homo Sapiens
RVAFKLHIN

SEQ ID NO: 1320776 - protein, 9 aa, Homo Sapiens
NHCYIAILS

SEQ ID NO: 1320777 - protein, 9 aa, Homo Sapiens
GGVQCENVG

SEQ ID NO: 1320778 - protein, 9 aa, Homo Sapiens
SCIVLTLVN

SEQ ID NO: 1320779 - protein, 9 aa, Homo Sapiens
WRRRHRAVK

SEQ ID NO: 1320780 - protein, 9 aa, Homo Sapiens
AKRIKNQRL

SEQ ID NO: 1320781 - protein, 9 aa, Homo Sapiens
TATSSSSFI

SEQ ID NO: 1320782 - protein, 9 aa, Homo Sapiens
KDDSSEHGT

SEQ ID NO: 1320783 - protein, 9 aa, Homo Sapiens
TPYGSPWWS

SEQ ID NO: 1320784 - protein, 9 aa, Homo Sapiens
SLADRSCND

SEQ ID NO: 1320785 - protein, 9 aa, Homo Sapiens
NRGGMSGCG

SEQ ID NO: 1320786 - protein, 9 aa, Homo Sapiens
SSSKRNRHH

SEQ ID NO: 1320787 - protein, 9 aa, Homo Sapiens
KLPQDDDMP

SEQ ID NO: 1320788 - protein, 9 aa, Homo Sapiens
VRQETNYVE

SEQ ID NO: 1320789 - protein, 9 aa, Homo Sapiens
PGWEEASQV

SEQ ID NO: 1320790 - protein, 9 aa, Homo Sapiens
GTGIMGSAG

SEQ ID NO: 1320791 - protein, 9 aa, Homo Sapiens
WGPMDVQDP

SEQ ID NO: 1320792 - protein, 9 aa, Homo Sapiens
SDEHGCLLR

SEQ ID NO: 1320793 - protein, 9 aa, Homo Sapiens
SAIVQAHSI

SEQ ID NO: 1320794 - protein, 9 aa, Homo Sapiens
CQHMQEENI

SEQ ID NO: 1320795 - protein, 9 aa, Homo Sapiens
ELTRLTHDY

SEQ ID NO: 1320796 - protein, 9 aa, Homo Sapiens
VDKAHGDAS

SEQ ID NO: 1320797 - protein, 9 aa, Homo Sapiens
RVFDSIVNK

SEQ ID NO: 1320798 - protein, 9 aa, Homo Sapiens
LTRPGLELS

SEQ ID NO: 1320799 - protein, 9 aa, Homo Sapiens
QFVQQKGQH

SEQ ID NO: 1320800 - protein, 9 aa, Homo Sapiens
PSSRHAAHR

SEQ ID NO: 1320801 - protein, 9 aa, Homo Sapiens
LIQLTQGGG

SEQ ID NO: 1320802 - protein, 9 aa, Homo Sapiens
IHLAQDAEV

SEQ ID NO: 1320803 - protein, 9 aa, Homo Sapiens
DKKEKKNDK

SEQ ID NO: 1320804 - protein, 9 aa, Homo Sapiens
NQVPRLTGG

SEQ ID NO: 1320805 - protein, 9 aa, Homo Sapiens
PKPLSPVSS

SEQ ID NO: 1320806 - protein, 9 aa, Homo Sapiens
CLKIIEEKT

SEQ ID NO: 1320807 - protein, 9 aa, Homo Sapiens
QLEMTFNLS

SEQ ID NO: 1320808 - protein, 9 aa, Homo Sapiens
RGCSPPYQL

SEQ ID NO: 1320809 - protein, 9 aa, Homo Sapiens
MSRGEGDCN

SEQ ID NO: 1320810 - protein, 9 aa, Homo Sapiens
SSDAGAAST

SEQ ID NO: 1320811 - protein, 9 aa, Homo Sapiens
SIQWKIQNS

SEQ ID NO: 1320812 - protein, 9 aa, Homo Sapiens
EMRRRTPWS

SEQ ID NO: 1320813 - protein, 9 aa, Homo Sapiens
EKPVSIPSD

SEQ ID NO: 1320814 - protein, 9 aa, Homo Sapiens
PKEPLENDK

SEQ ID NO: 1320815 - protein, 9 aa, Homo Sapiens
GLLVPRLVQ

SEQ ID NO: 1320816 - protein, 9 aa, Homo Sapiens
HRPPIWVIQ

SEQ ID NO: 1320817 - protein, 9 aa, Homo Sapiens
VNAEFGGGT

SEQ ID NO: 1320818 - protein, 9 aa, Homo Sapiens
LQKLLRRVS

SEQ ID NO: 1320819 - protein, 9 aa, Homo Sapiens
INTSYEGYA

SEQ ID NO: 1320820 - protein, 9 aa, Homo Sapiens
QKKKDVYRH

SEQ ID NO: 1320821 - protein, 9 aa, Homo Sapiens
VSIRGFTMP

SEQ ID NO: 1320822 - protein, 9 aa, Homo Sapiens
VRGIKTFPV

SEQ ID NO: 1320823 - protein, 9 aa, Homo Sapiens
GDHIQSSRA

SEQ ID NO: 1320824 - protein, 9 aa, Homo Sapiens
VPQSKVMYI

SEQ ID NO: 1320825 - protein, 9 aa, Homo Sapiens
ALSTASDLA

SEQ ID NO: 1320826 - protein, 9 aa, Homo Sapiens
GTSLYMSPE

SEQ ID NO: 1320827 - protein, 9 aa, Homo Sapiens
GSAAGGAQA

SEQ ID NO: 1320828 - protein, 9 aa, Homo Sapiens
FCAFNLMFG

SEQ ID NO: 1320829 - protein, 9 aa, Homo Sapiens
LALVIEIAT

SEQ ID NO: 1320830 - protein, 9 aa, Homo Sapiens
ARLLDIDER

SEQ ID NO: 1320831 - protein, 9 aa, Homo Sapiens
KGLAHCPGM

SEQ ID NO: 1320832 - protein, 9 aa, Homo Sapiens
FPSPQGPLF

SEQ ID NO: 1320833 - protein, 9 aa, Homo Sapiens
CIWNQKDAL

SEQ ID NO: 1320834 - protein, 9 aa, Homo Sapiens
WWSGRIVSW

SEQ ID NO: 1320835 - protein, 9 aa, Homo Sapiens
DFEIWLDNI

SEQ ID NO: 1320836 - protein, 9 aa, Homo Sapiens
FDPTVFAAS

SEQ ID NO: 1320837 - protein, 9 aa, Homo Sapiens
DVTMKGVTK

SEQ ID NO: 1320838 - protein, 9 aa, Homo Sapiens
QCCDCGPGL

SEQ ID NO: 1320839 - protein, 9 aa, Homo Sapiens
STGSGQRHP

SEQ ID NO: 1320840 - protein, 9 aa, Homo Sapiens
PDCSDFLSC

SEQ ID NO: 1320841 - protein, 9 aa, Homo Sapiens
EKCRKAREE

SEQ ID NO: 1320842 - protein, 9 aa, Homo Sapiens
AATDLERFF

SEQ ID NO: 1320843 - protein, 9 aa, Homo Sapiens
TLLFFLHQS

SEQ ID NO: 1320844 - protein, 9 aa, Homo Sapiens
KHLWVLHLK

SEQ ID NO: 1320845 - protein, 9 aa, Homo Sapiens
YLRMTVLTL

SEQ ID NO: 1320846 - protein, 9 aa, Homo Sapiens
RRTHEFEDR

SEQ ID NO: 1320847 - protein, 9 aa, Homo Sapiens
KMFSYAGWM

SEQ ID NO: 1320848 - protein, 9 aa, Homo Sapiens
HGVCVLRAV

SEQ ID NO: 1320849 - protein, 9 aa, Homo Sapiens
ITFKDFILS

SEQ ID NO: 1320850 - protein, 9 aa, Homo Sapiens
ELTGMAFIN

SEQ ID NO: 1320851 - protein, 9 aa, Homo Sapiens
FTLSVNASR

SEQ ID NO: 1320852 - protein, 9 aa, Homo Sapiens
GHTDQEIKI

SEQ ID NO: 1320853 - protein, 9 aa, Homo Sapiens
TLFPRKPLQ

SEQ ID NO: 1320854 - protein, 9 aa, Homo Sapiens
RRKLWAAWV

SEQ ID NO: 1320855 - protein, 9 aa, Homo Sapiens
KPEELKGLA

SEQ ID NO: 1320856 - protein, 9 aa, Homo Sapiens
DHRNPDEQV

SEQ ID NO: 1320857 - protein, 9 aa, Homo Sapiens
QPFPVPVGP

SEQ ID NO: 1320858 - protein, 9 aa, Homo Sapiens
TVALTRDSE

SEQ ID NO: 1320859 - protein, 9 aa, Homo Sapiens
NPGWPGAPC

SEQ ID NO: 1320860 - protein, 9 aa, Homo Sapiens
VLTEIGPKC

SEQ ID NO: 1320861 - protein, 9 aa, Homo Sapiens
VLGCVVLMQ

SEQ ID NO: 1320862 - protein, 9 aa, Homo Sapiens
IYGNKLPPL

SEQ ID NO: 1320863 - protein, 9 aa, Homo Sapiens
IAHIPLLRD

SEQ ID NO: 1320864 - protein, 9 aa, Homo Sapiens
QMSGQPPPS

SEQ ID NO: 1320865 - protein, 9 aa, Homo Sapiens
RDLLEEECH

SEQ ID NO: 1320866 - protein, 9 aa, Homo Sapiens
DPEVWVLHS

SEQ ID NO: 1320867 - protein, 9 aa, Homo Sapiens
HVNIIPNPT

SEQ ID NO: 1320868 - protein, 9 aa, Homo Sapiens
ALDLTMKHR

SEQ ID NO: 1320869 - protein, 9 aa, Homo Sapiens
CAARNGHMR

SEQ ID NO: 1320870 - protein, 9 aa, Homo Sapiens
KKFISDKDG

SEQ ID NO: 1320871 - protein, 9 aa, Homo Sapiens
EAHEAARSP

SEQ ID NO: 1320872 - protein, 9 aa, Homo Sapiens
GQKQRINLA

SEQ ID NO: 1320873 - protein, 9 aa, Homo Sapiens
VWQIHVDLH

SEQ ID NO: 1320874 - protein, 9 aa, Homo Sapiens
LGHSNCCHF

SEQ ID NO: 1320875 - protein, 9 aa, Homo Sapiens
KVDSQEHNI

SEQ ID NO: 1320876 - protein, 9 aa, Homo Sapiens
GTHNDNGDL

SEQ ID NO: 1320877 - protein, 9 aa, Homo Sapiens
LWEFCLQWL

SEQ ID NO: 1320878 - protein, 9 aa, Homo Sapiens
YMLYPITFP

SEQ ID NO: 1320879 - protein, 9 aa, Homo Sapiens
EKIAVIAEK

SEQ ID NO: 1320880 - protein, 9 aa, Homo Sapiens
KLYIVMSAC

SEQ ID NO: 1320881 - protein, 9 aa, Homo Sapiens
WLDSDVRNP

SEQ ID NO: 1320882 - protein, 9 aa, Homo Sapiens
QLYTECLYR

SEQ ID NO: 1320883 - protein, 9 aa, Homo Sapiens
SRRLTLLER

SEQ ID NO: 1320884 - protein, 9 aa, Homo Sapiens
LKYVEQRKK

SEQ ID NO: 1320885 - protein, 9 aa, Homo Sapiens
TTFLSDLEE

SEQ ID NO: 1320886 - protein, 9 aa, Homo Sapiens
EYGVQNYIT

SEQ ID NO: 1320887 - protein, 9 aa, Homo Sapiens
SKPILALCV

SEQ ID NO: 1320888 - protein, 9 aa, Homo Sapiens
ESLLTCTSK

SEQ ID NO: 1320889 - protein, 9 aa, Homo Sapiens
RHTASVRAD

SEQ ID NO: 1320890 - protein, 9 aa, Homo Sapiens
EMKTRFLIF

SEQ ID NO: 1320891 - protein, 9 aa, Homo Sapiens
TKSSKNQGI

SEQ ID NO: 1320892 - protein, 9 aa, Homo Sapiens
HVLYVYAAC

SEQ ID NO: 1320893 - protein, 9 aa, Homo Sapiens
ALSNVTPRP

SEQ ID NO: 1320894 - protein, 9 aa, Homo Sapiens
RCLAPKVDV

SEQ ID NO: 1320895 - protein, 9 aa, Homo Sapiens
KLPPLALYC

SEQ ID NO: 1320896 - protein, 9 aa, Homo Sapiens
ACDTTYNEI

SEQ ID NO: 1320897 - protein, 9 aa, Homo Sapiens
CIAYKRCIT

SEQ ID NO: 1320898 - protein, 9 aa, Homo Sapiens
SSCKKQAAS

SEQ ID NO: 1320899 - protein, 9 aa, Homo Sapiens
LLNPPEALN

SEQ ID NO: 1320900 - protein, 9 aa, Homo Sapiens
ELPSSVTES

SEQ ID NO: 1320901 - protein, 9 aa, Homo Sapiens
TSLTNSVFQ

SEQ ID NO: 1320902 - protein, 9 aa, Homo Sapiens
RSPTSAAPA

SEQ ID NO: 1320903 - protein, 9 aa, Homo Sapiens
ADNHSLISS

SEQ ID NO: 1320904 - protein, 9 aa, Homo Sapiens
PLSPVSSQD

SEQ ID NO: 1320905 - protein, 9 aa, Homo Sapiens
VGEDIVDVI

SEQ ID NO: 1320906 - protein, 9 aa, Homo Sapiens
CYIEYVIRG

SEQ ID NO: 1320907 - protein, 9 aa, Homo Sapiens
LPPGMRELL

SEQ ID NO: 1320908 - protein, 9 aa, Homo Sapiens
VHYDNVICQ

SEQ ID NO: 1320909 - protein, 9 aa, Homo Sapiens
SARQSAYIH

SEQ ID NO: 1320910 - protein, 9 aa, Homo Sapiens
SVITNVVEM

SEQ ID NO: 1320911 - protein, 9 aa, Homo Sapiens
APRRSLGHQ

SEQ ID NO: 1320912 - protein, 9 aa, Homo Sapiens
KGWTYASTS

SEQ ID NO: 1320913 - protein, 9 aa, Homo Sapiens
KQLVKQGSK

SEQ ID NO: 1320914 - protein, 9 aa, Homo Sapiens
AINVALTQA

SEQ ID NO: 1320915 - protein, 9 aa, Homo Sapiens
CQSLAWRKQ

SEQ ID NO: 1320916 - protein, 9 aa, Homo Sapiens
VGLNIFLEK

SEQ ID NO: 1320917 - protein, 9 aa, Homo Sapiens
PEVVVAEGP

SEQ ID NO: 1320918 - protein, 9 aa, Homo Sapiens
DSTNTDALY

SEQ ID NO: 1320919 - protein, 9 aa, Homo Sapiens
VQTPRPQNK

SEQ ID NO: 1320920 - protein, 9 aa, Homo Sapiens
LPTEQHILM

SEQ ID NO: 1320921 - protein, 9 aa, Homo Sapiens
PQRQAIKGV

SEQ ID NO: 1320922 - protein, 9 aa, Homo Sapiens
IFTKDLDRI

SEQ ID NO: 1320923 - protein, 9 aa, Homo Sapiens
RIVAPGHAL

SEQ ID NO: 1320924 - protein, 9 aa, Homo Sapiens
GTRGGDHHV

SEQ ID NO: 1320925 - protein, 9 aa, Homo Sapiens
SDLTDHLPV

SEQ ID NO: 1320926 - protein, 9 aa, Homo Sapiens
TGDNWNRIM

SEQ ID NO: 1320927 - protein, 9 aa, Homo Sapiens
NHKRVKEIN

SEQ ID NO: 1320928 - protein, 9 aa, Homo Sapiens
AVQMFLGLT

SEQ ID NO: 1320929 - protein, 9 aa, Homo Sapiens
ASNGHIPSE

SEQ ID NO: 1320930 - protein, 9 aa, Homo Sapiens
AYHIDSSNF

SEQ ID NO: 1320931 - protein, 9 aa, Homo Sapiens
DYIFRGVEH

SEQ ID NO: 1320932 - protein, 9 aa, Homo Sapiens
LMRQDLMRH

SEQ ID NO: 1320933 - protein, 9 aa, Homo Sapiens
WRWLIRIAS

SEQ ID NO: 1320934 - protein, 9 aa, Homo Sapiens
SDPYSLNPL

SEQ ID NO: 1320935 - protein, 9 aa, Homo Sapiens
FLGQHMAEQ

SEQ ID NO: 1320936 - protein, 9 aa, Homo Sapiens
DELYVQWGK

SEQ ID NO: 1320937 - protein, 9 aa, Homo Sapiens
VSERKNCCA

SEQ ID NO: 1320938 - protein, 9 aa, Homo Sapiens
RQSLVHSVD

SEQ ID NO: 1320939 - protein, 9 aa, Homo Sapiens
VFEILSHLL

SEQ ID NO: 1320940 - protein, 9 aa, Homo Sapiens
LPTLHSALF

SEQ ID NO: 1320941 - protein, 9 aa, Homo Sapiens
ESIMALNPR

SEQ ID NO: 1320942 - protein, 9 aa, Homo Sapiens
LCTVENLSM

SEQ ID NO: 1320943 - protein, 9 aa, Homo Sapiens
HLTGEVAKE

SEQ ID NO: 1320944 - protein, 9 aa, Homo Sapiens
PIFPPPSLP

SEQ ID NO: 1320945 - protein, 9 aa, Homo Sapiens
DITLLASLL

SEQ ID NO: 1320946 - protein, 9 aa, Homo Sapiens
TGRYECVAR

SEQ ID NO: 1320947 - protein, 9 aa, Homo Sapiens
DKPYVPLLE

SEQ ID NO: 1320948 - protein, 9 aa, Homo Sapiens
LLVPARYRK

SEQ ID NO: 1320949 - protein, 9 aa, Homo Sapiens
DMLGHVRCH

SEQ ID NO: 1320950 - protein, 9 aa, Homo Sapiens
SPNAFSENH

SEQ ID NO: 1320951 - protein, 9 aa, Homo Sapiens
ILKILLHNM

SEQ ID NO: 1320952 - protein, 9 aa, Homo Sapiens
LLAAISYDR

SEQ ID NO: 1320953 - protein, 9 aa, Homo Sapiens
NTSTDRLLW

SEQ ID NO: 1320954 - protein, 9 aa, Homo Sapiens
SEYCKCKAL

SEQ ID NO: 1320955 - protein, 9 aa, Homo Sapiens
FDTLLADLT

SEQ ID NO: 1320956 - protein, 9 aa, Homo Sapiens
YMLEVKNSP

SEQ ID NO: 1320957 - protein, 9 aa, Homo Sapiens
RFFNSLNEV

SEQ ID NO: 1320958 - protein, 9 aa, Homo Sapiens
HPQPSLGDG

SEQ ID NO: 1320959 - protein, 9 aa, Homo Sapiens
ETTVVDVEE

SEQ ID NO: 1320960 - protein, 9 aa, Homo Sapiens
MTTQAHSSY

SEQ ID NO: 1320961 - protein, 9 aa, Homo Sapiens
RMQVWFQNR

SEQ ID NO: 1320962 - protein, 9 aa, Homo Sapiens
MLTLPEDLV

SEQ ID NO: 1320963 - protein, 9 aa, Homo Sapiens
GQLTQQPHH

SEQ ID NO: 1320964 - protein, 9 aa, Homo Sapiens
CRALTQVCG

SEQ ID NO: 1320965 - protein, 9 aa, Homo Sapiens
PMSEEPWSA

SEQ ID NO: 1320966 - protein, 9 aa, Homo Sapiens
NKNLFKVPG

SEQ ID NO: 1320967 - protein, 9 aa, Homo Sapiens
ARCCASTWT

SEQ ID NO: 1320968 - protein, 9 aa, Homo Sapiens
PTHLSVVVC

SEQ ID NO: 1320969 - protein, 9 aa, Homo Sapiens
HGHDAASSS

SEQ ID NO: 1320970 - protein, 9 aa, Homo Sapiens
RYPDVNRRI

SEQ ID NO: 1320971 - protein, 9 aa, Homo Sapiens
LEEIIGSLD

SEQ ID NO: 1320972 - protein, 9 aa, Homo Sapiens
VCAMGPRVE

SEQ ID NO: 1320973 - protein, 9 aa, Homo Sapiens
ALGCQQYIQ

SEQ ID NO: 1320974 - protein, 9 aa, Homo Sapiens
GLDRPDVWA

SEQ ID NO: 1320975 - protein, 9 aa, Homo Sapiens
NLVSLGIYL

SEQ ID NO: 1320976 - protein, 9 aa, Homo Sapiens
VSRYHPQIV

SEQ ID NO: 1320977 - protein, 9 aa, Homo Sapiens
SAEGFSKRK

SEQ ID NO: 1320978 - protein, 9 aa, Homo Sapiens
MVEPYNATL

SEQ ID NO: 1320979 - protein, 9 aa, Homo Sapiens
LHITRLYGE

SEQ ID NO: 1320980 - protein, 9 aa, Homo Sapiens
ISSSACLNP

SEQ ID NO: 1320981 - protein, 9 aa, Homo Sapiens
HVWLLPGMG

SEQ ID NO: 1320982 - protein, 9 aa, Homo Sapiens
APGGTCIDD

SEQ ID NO: 1320983 - protein, 9 aa, Homo Sapiens
SQLEHDLQV

SEQ ID NO: 1320984 - protein, 9 aa, Homo Sapiens
TTNFLHWCR

SEQ ID NO: 1320985 - protein, 9 aa, Homo Sapiens
EMISELRQH

SEQ ID NO: 1320986 - protein, 9 aa, Homo Sapiens
ILCCITFFI

SEQ ID NO: 1320987 - protein, 9 aa, Homo Sapiens
RPSTCTSAS

SEQ ID NO: 1320988 - protein, 9 aa, Homo Sapiens
ASANQRPGR

SEQ ID NO: 1320989 - protein, 9 aa, Homo Sapiens
IHPTLLWEL

SEQ ID NO: 1320990 - protein, 9 aa, Homo Sapiens
LQTAIEMKD

SEQ ID NO: 1320991 - protein, 9 aa, Homo Sapiens
KATMYEMYF

SEQ ID NO: 1320992 - protein, 9 aa, Homo Sapiens
TESGKADET

SEQ ID NO: 1320993 - protein, 9 aa, Homo Sapiens
DTKAVVAAH

SEQ ID NO: 1320994 - protein, 9 aa, Homo Sapiens
YRRTVRAMV

SEQ ID NO: 1320995 - protein, 9 aa, Homo Sapiens
DPAKRLCYF

SEQ ID NO: 1320996 - protein, 9 aa, Homo Sapiens
EMYGVDMYV

SEQ ID NO: 1320997 - protein, 9 aa, Homo Sapiens
LNLEEGNDQ

SEQ ID NO: 1320998 - protein, 9 aa, Homo Sapiens
PPGPVPQLP

SEQ ID NO: 1320999 - protein, 9 aa, Homo Sapiens
TWVLLNQCR

SEQ ID NO: 1321000 - protein, 9 aa, Homo Sapiens
NMNNLVSEY

SEQ ID NO: 1321001 - protein, 9 aa, Homo Sapiens
HRSQTHSRS

SEQ ID NO: 1321002 - protein, 9 aa, Homo Sapiens
VIDAEYRHI

SEQ ID NO: 1321003 - protein, 9 aa, Homo Sapiens
TQALGITLT

SEQ ID NO: 1321004 - protein, 9 aa, Homo Sapiens
KQVFTEANL

SEQ ID NO: 1321005 - protein, 9 aa, Homo Sapiens
TLKQFEERL

SEQ ID NO: 1321006 - protein, 9 aa, Homo Sapiens
PIPPQMGSF

SEQ ID NO: 1321007 - protein, 9 aa, Homo Sapiens
TRTCSCTGA

SEQ ID NO: 1321008 - protein, 9 aa, Homo Sapiens
KYVHLHELS

SEQ ID NO: 1321009 - protein, 9 aa, Homo Sapiens
PCWQAVWPV

SEQ ID NO: 1321010 - protein, 9 aa, Homo Sapiens
DKTLSLMLI

SEQ ID NO: 1321011 - protein, 9 aa, Homo Sapiens
TFNALIEST

SEQ ID NO: 1321012 - protein, 9 aa, Homo Sapiens
PLRKLKMWY

SEQ ID NO: 1321013 - protein, 9 aa, Homo Sapiens
KIIEEKTAA

SEQ ID NO: 1321014 - protein, 9 aa, Homo Sapiens
ELHPRYLPV

SEQ ID NO: 1321015 - protein, 9 aa, Homo Sapiens
ENTYLCQRA

SEQ ID NO: 1321016 - protein, 9 aa, Homo Sapiens
RRRHKMIST

SEQ ID NO: 1321017 - protein, 9 aa, Homo Sapiens
AIEGYTKSG

SEQ ID NO: 1321018 - protein, 9 aa, Homo Sapiens
PGTIAPLQG

SEQ ID NO: 1321019 - protein, 9 aa, Homo Sapiens
TAPTQALMS

SEQ ID NO: 1321020 - protein, 9 aa, Homo Sapiens
PSSACNVAA

SEQ ID NO: 1321021 - protein, 9 aa, Homo Sapiens
SAKNPQPVQ

SEQ ID NO: 1321022 - protein, 9 aa, Homo Sapiens
PELFQCVGI

SEQ ID NO: 1321023 - protein, 9 aa, Homo Sapiens
DWVALAQAW

SEQ ID NO: 1321024 - protein, 9 aa, Homo Sapiens
LFECYRIPK

SEQ ID NO: 1321025 - protein, 9 aa, Homo Sapiens
RWVRSHFDA

SEQ ID NO: 1321026 - protein, 9 aa, Homo Sapiens
RVPQSKVMY

SEQ ID NO: 1321027 - protein, 9 aa, Homo Sapiens
SFSILMPPF

SEQ ID NO: 1321028 - protein, 9 aa, Homo Sapiens
CLREWEERV

SEQ ID NO: 1321029 - protein, 9 aa, Homo Sapiens
HFGYVQHYG

SEQ ID NO: 1321030 - protein, 9 aa, Homo Sapiens
GQLNLVVPF

SEQ ID NO: 1321031 - protein, 9 aa, Homo Sapiens
PGRHKSESQ

SEQ ID NO: 1321032 - protein, 9 aa, Homo Sapiens
SVPVPGTQP

SEQ ID NO: 1321033 - protein, 9 aa, Homo Sapiens
APEAPPCYM

SEQ ID NO: 1321034 - protein, 9 aa, Homo Sapiens
QCHVRKKRK

SEQ ID NO: 1321035 - protein, 9 aa, Homo Sapiens
DACHLTLDE

SEQ ID NO: 1321036 - protein, 9 aa, Homo Sapiens
KSGGKCVFD

SEQ ID NO: 1321037 - protein, 9 aa, Homo Sapiens
QLTFSLSQE

SEQ ID NO: 1321038 - protein, 9 aa, Homo Sapiens
TTLRVSVFR

SEQ ID NO: 1321039 - protein, 9 aa, Homo Sapiens
ATSDSVSLI

SEQ ID NO: 1321040 - protein, 9 aa, Homo Sapiens
EEQVRATSQ

SEQ ID NO: 1321041 - protein, 9 aa, Homo Sapiens
TLDTIDNLP

SEQ ID NO: 1321042 - protein, 9 aa, Homo Sapiens
CGRPSGTTK

SEQ ID NO: 1321043 - protein, 9 aa, Homo Sapiens
FMMLPTSGI

SEQ ID NO: 1321044 - protein, 9 aa, Homo Sapiens
LAPGGTCID

SEQ ID NO: 1321045 - protein, 9 aa, Homo Sapiens
RENPVTSDS

SEQ ID NO: 1321046 - protein, 9 aa, Homo Sapiens
KKMTDTICI

SEQ ID NO: 1321047 - protein, 9 aa, Homo Sapiens
GGKCVFDSA

SEQ ID NO: 1321048 - protein, 9 aa, Homo Sapiens
VEVRVPYVE

SEQ ID NO: 1321049 - protein, 9 aa, Homo Sapiens
NSNKCVVAF

SEQ ID NO: 1321050 - protein, 9 aa, Homo Sapiens
KSNCLPLHF

SEQ ID NO: 1321051 - protein, 9 aa, Homo Sapiens
THNITQGIV

SEQ ID NO: 1321052 - protein, 9 aa, Homo Sapiens
PPAIINPQT

SEQ ID NO: 1321053 - protein, 9 aa, Homo Sapiens
PSRRLTLLE

SEQ ID NO: 1321054 - protein, 9 aa, Homo Sapiens
MLQATTEAN

SEQ ID NO: 1321055 - protein, 9 aa, Homo Sapiens
VIAEKRQLQ

SEQ ID NO: 1321056 - protein, 9 aa, Homo Sapiens
IVGLIFAVY

SEQ ID NO: 1321057 - protein, 9 aa, Homo Sapiens
SHQPHLRCA

SEQ ID NO: 1321058 - protein, 9 aa, Homo Sapiens
LELQLNVSS

SEQ ID NO: 1321059 - protein, 9 aa, Homo Sapiens
MQYPARAIK

SEQ ID NO: 1321060 - protein, 9 aa, Homo Sapiens
TSLENTKPQ

SEQ ID NO: 1321061 - protein, 9 aa, Homo Sapiens
EGLFFHLPI

SEQ ID NO: 1321062 - protein, 9 aa, Homo Sapiens
VTPPKAKEV

SEQ ID NO: 1321063 - protein, 9 aa, Homo Sapiens
MQRAVQTPR

SEQ ID NO: 1321064 - protein, 9 aa, Homo Sapiens
SRDSLRYSS

SEQ ID NO: 1321065 - protein, 9 aa, Homo Sapiens
SRDKLKFFL

SEQ ID NO: 1321066 - protein, 9 aa, Homo Sapiens
EVKVLNANL

SEQ ID NO: 1321067 - protein, 9 aa, Homo Sapiens
DDGFCLFFT

SEQ ID NO: 1321068 - protein, 9 aa, Homo Sapiens
FLIDKITTV

SEQ ID NO: 1321069 - protein, 9 aa, Homo Sapiens
VIQYYTAAP

SEQ ID NO: 1321070 - protein, 9 aa, Homo Sapiens
FPRPLRSNI

SEQ ID NO: 1321071 - protein, 9 aa, Homo Sapiens
LQSAAYNLL

SEQ ID NO: 1321072 - protein, 9 aa, Homo Sapiens
TMKGLQMTG

SEQ ID NO: 1321073 - protein, 9 aa, Homo Sapiens
ESMNTYLQM

SEQ ID NO: 1321074 - protein, 9 aa, Homo Sapiens
KKKKERERG

SEQ ID NO: 1321075 - protein, 9 aa, Homo Sapiens
MHTMKHSDD

SEQ ID NO: 1321076 - protein, 9 aa, Homo Sapiens
GYSRHRVHF

SEQ ID NO: 1321077 - protein, 9 aa, Homo Sapiens
EVAQNVLLC

SEQ ID NO: 1321078 - protein, 9 aa, Homo Sapiens
GVILIVSHS

SEQ ID NO: 1321079 - protein, 9 aa, Homo Sapiens
HVFTPTSSW

SEQ ID NO: 1321080 - protein, 9 aa, Homo Sapiens
GTEVNKADN

SEQ ID NO: 1321081 - protein, 9 aa, Homo Sapiens
QPITLGGPL

SEQ ID NO: 1321082 - protein, 9 aa, Homo Sapiens
LWKAVKTAV

SEQ ID NO: 1321083 - protein, 9 aa, Homo Sapiens
PWDHEERPT

SEQ ID NO: 1321084 - protein, 9 aa, Homo Sapiens
TTGKNGYIP

SEQ ID NO: 1321085 - protein, 9 aa, Homo Sapiens
SGGQKVRVV

SEQ ID NO: 1321086 - protein, 9 aa, Homo Sapiens
IIDSNSTIP

SEQ ID NO: 1321087 - protein, 9 aa, Homo Sapiens
MEAVAFQSG

SEQ ID NO: 1321088 - protein, 9 aa, Homo Sapiens
DYVFYLVVG

SEQ ID NO: 1321089 - protein, 9 aa, Homo Sapiens
VPQTNTWNF

SEQ ID NO: 1321090 - protein, 9 aa, Homo Sapiens
RQYVYRVLF

SEQ ID NO: 1321091 - protein, 9 aa, Homo Sapiens
DKLKFFLKQ

SEQ ID NO: 1321092 - protein, 9 aa, Homo Sapiens
DHVFHGNET

SEQ ID NO: 1321093 - protein, 9 aa, Homo Sapiens
LPHVDFQLV

SEQ ID NO: 1321094 - protein, 9 aa, Homo Sapiens
TLVFFLYRR

SEQ ID NO: 1321095 - protein, 9 aa, Homo Sapiens
PSSPTSPSW

SEQ ID NO: 1321096 - protein, 9 aa, Homo Sapiens
LAALFAAVI

SEQ ID NO: 1321097 - protein, 9 aa, Homo Sapiens
CNICGTRYK

SEQ ID NO: 1321098 - protein, 9 aa, Homo Sapiens
TNGGSHAGN

SEQ ID NO: 1321099 - protein, 9 aa, Homo Sapiens
SRKDFRMNM

SEQ ID NO: 1321100 - protein, 9 aa, Homo Sapiens
SETLQRVKI

SEQ ID NO: 1321101 - protein, 9 aa, Homo Sapiens
LTNPELFQC

SEQ ID NO: 1321102 - protein, 9 aa, Homo Sapiens
SGGQDLTID

SEQ ID NO: 1321103 - protein, 9 aa, Homo Sapiens
TERCFSLCM

SEQ ID NO: 1321104 - protein, 9 aa, Homo Sapiens
LGCHVRALV

SEQ ID NO: 1321105 - protein, 9 aa, Homo Sapiens
ADVVRVITF

SEQ ID NO: 1321106 - protein, 9 aa, Homo Sapiens
KVVQGLMRL

SEQ ID NO: 1321107 - protein, 9 aa, Homo Sapiens
LTFILVVQS

SEQ ID NO: 1321108 - protein, 9 aa, Homo Sapiens
DTDFRKLRQ

SEQ ID NO: 1321109 - protein, 9 aa, Homo Sapiens
KKIYDCQIS

SEQ ID NO: 1321110 - protein, 9 aa, Homo Sapiens
WHRFNRPLL

SEQ ID NO: 1321111 - protein, 9 aa, Homo Sapiens
DIMAELESD

SEQ ID NO: 1321112 - protein, 9 aa, Homo Sapiens
YTFDVAFVQ

SEQ ID NO: 1321113 - protein, 9 aa, Homo Sapiens
AEKPNNIKK

SEQ ID NO: 1321114 - protein, 9 aa, Homo Sapiens
KHEERALLA

SEQ ID NO: 1321115 - protein, 9 aa, Homo Sapiens
APKQCLSFV

SEQ ID NO: 1321116 - protein, 9 aa, Homo Sapiens
RNKQIKVTI

SEQ ID NO: 1321117 - protein, 9 aa, Homo Sapiens
AYQEARGVT

SEQ ID NO: 1321118 - protein, 9 aa, Homo Sapiens
EGVTLEEEV

SEQ ID NO: 1321119 - protein, 9 aa, Homo Sapiens
NMFCAQLQC

SEQ ID NO: 1321120 - protein, 9 aa, Homo Sapiens
TFPVRSEKQ

SEQ ID NO: 1321121 - protein, 9 aa, Homo Sapiens
FNHLDLPPY

SEQ ID NO: 1321122 - protein, 9 aa, Homo Sapiens
IKKQEEGVP

SEQ ID NO: 1321123 - protein, 9 aa, Homo Sapiens
VKTCDSSPP

SEQ ID NO: 1321124 - protein, 9 aa, Homo Sapiens
SQQRERERR

SEQ ID NO: 1321125 - protein, 9 aa, Homo Sapiens
TEQHILMKS

SEQ ID NO: 1321126 - protein, 9 aa, Homo Sapiens
KEHILEMLV

SEQ ID NO: 1321127 - protein, 9 aa, Homo Sapiens
CAVLYQNTH

SEQ ID NO: 1321128 - protein, 9 aa, Homo Sapiens
RIRQDPNRM

SEQ ID NO: 1321129 - protein, 9 aa, Homo Sapiens
EQLSVKKAE

SEQ ID NO: 1321130 - protein, 9 aa, Homo Sapiens
GTRKVGVPK

SEQ ID NO: 1321131 - protein, 9 aa, Homo Sapiens
YVPLVLKPN

SEQ ID NO: 1321132 - protein, 9 aa, Homo Sapiens
HPYGCDVEP

SEQ ID NO: 1321133 - protein, 9 aa, Homo Sapiens
SSRRWTWWS

SEQ ID NO: 1321134 - protein, 9 aa, Homo Sapiens
DYDFVSALV

SEQ ID NO: 1321135 - protein, 9 aa, Homo Sapiens
SEIEHIFEL

SEQ ID NO: 1321136 - protein, 9 aa, Homo Sapiens
YLNSVPLGH

SEQ ID NO: 1321137 - protein, 9 aa, Homo Sapiens
KLKSPEEEV

SEQ ID NO: 1321138 - protein, 9 aa, Homo Sapiens
IMCCANATC

SEQ ID NO: 1321139 - protein, 9 aa, Homo Sapiens
IAINNGTVK

SEQ ID NO: 1321140 - protein, 9 aa, Homo Sapiens
EGNDQSENG

SEQ ID NO: 1321141 - protein, 9 aa, Homo Sapiens
RTVEGGDQS

SEQ ID NO: 1321142 - protein, 9 aa, Homo Sapiens
CWQAGATPW

SEQ ID NO: 1321143 - protein, 9 aa, Homo Sapiens
PMMLEVLDG

SEQ ID NO: 1321144 - protein, 9 aa, Homo Sapiens
PQSVGDYSG

SEQ ID NO: 1321145 - protein, 9 aa, Homo Sapiens
MNYEEFARM

SEQ ID NO: 1321146 - protein, 9 aa, Homo Sapiens
VPHICSLVI

SEQ ID NO: 1321147 - protein, 9 aa, Homo Sapiens
SYIEELTKE

SEQ ID NO: 1321148 - protein, 9 aa, Homo Sapiens
HRLAASLSS

SEQ ID NO: 1321149 - protein, 9 aa, Homo Sapiens
DVSYIERHK

SEQ ID NO: 1321150 - protein, 9 aa, Homo Sapiens
AVEFITVIT

SEQ ID NO: 1321151 - protein, 9 aa, Homo Sapiens
APWNLTFPR

SEQ ID NO: 1321152 - protein, 9 aa, Homo Sapiens
GTKMAVRLA

SEQ ID NO: 1321153 - protein, 9 aa, Homo Sapiens
ASSSDLSCK

SEQ ID NO: 1321154 - protein, 9 aa, Homo Sapiens
PVNYVPQQE

SEQ ID NO: 1321155 - protein, 9 aa, Homo Sapiens
ACDHLSRFN

SEQ ID NO: 1321156 - protein, 9 aa, Homo Sapiens
EMKSGARLE

SEQ ID NO: 1321157 - protein, 9 aa, Homo Sapiens
LAYLFFADI

SEQ ID NO: 1321158 - protein, 9 aa, Homo Sapiens
MERRNHYLD

SEQ ID NO: 1321159 - protein, 9 aa, Homo Sapiens
QSPVRVRMH

SEQ ID NO: 1321160 - protein, 9 aa, Homo Sapiens
SPQSSSLHP

SEQ ID NO: 1321161 - protein, 9 aa, Homo Sapiens
YHSNCKEPV

SEQ ID NO: 1321162 - protein, 9 aa, Homo Sapiens
GRDECWCPT

SEQ ID NO: 1321163 - protein, 9 aa, Homo Sapiens
SGIRIKEGG

SEQ ID NO: 1321164 - protein, 9 aa, Homo Sapiens
AWEHNEYLN

SEQ ID NO: 1321165 - protein, 9 aa, Homo Sapiens
INGLRKDFD

SEQ ID NO: 1321166 - protein, 9 aa, Homo Sapiens
CYRIPKVAY

SEQ ID NO: 1321167 - protein, 9 aa, Homo Sapiens
HPQLREAYA

SEQ ID NO: 1321168 - protein, 9 aa, Homo Sapiens
EVRHCTWFY

SEQ ID NO: 1321169 - protein, 9 aa, Homo Sapiens
CDTMADMLQ

SEQ ID NO: 1321170 - protein, 9 aa, Homo Sapiens
YLLAGSMVH

SEQ ID NO: 1321171 - protein, 9 aa, Homo Sapiens
HLAATHGYS

SEQ ID NO: 1321172 - protein, 9 aa, Homo Sapiens
GVRAGRDHF

SEQ ID NO: 1321173 - protein, 9 aa, Homo Sapiens
LKICGVINQ

SEQ ID NO: 1321174 - protein, 9 aa, Homo Sapiens
MGSMDAIID

SEQ ID NO: 1321175 - protein, 9 aa, Homo Sapiens
LFIGSDTFN

SEQ ID NO: 1321176 - protein, 9 aa, Homo Sapiens
TMLRRQQIK

SEQ ID NO: 1321177 - protein, 9 aa, Homo Sapiens
GDTQAMGQQ

SEQ ID NO: 1321178 - protein, 9 aa, Homo Sapiens
ATCVGSIAE

SEQ ID NO: 1321179 - protein, 9 aa, Homo Sapiens
SWTDVVKLG

SEQ ID NO: 1321180 - protein, 9 aa, Homo Sapiens
PDEGALVTT

SEQ ID NO: 1321181 - protein, 9 aa, Homo Sapiens
PKSMLQATT

SEQ ID NO: 1321182 - protein, 9 aa, Homo Sapiens
NVAPENTGT

SEQ ID NO: 1321183 - protein, 9 aa, Homo Sapiens
ERPPKQKGC

SEQ ID NO: 1321184 - protein, 9 aa, Homo Sapiens
ACDECDMRF

SEQ ID NO: 1321185 - protein, 9 aa, Homo Sapiens
AEQKVTHLT

SEQ ID NO: 1321186 - protein, 9 aa, Homo Sapiens
QAEDSDLFE

SEQ ID NO: 1321187 - protein, 9 aa, Homo Sapiens
VSSNLLALV

SEQ ID NO: 1321188 - protein, 9 aa, Homo Sapiens
KQIATDKQY

SEQ ID NO: 1321189 - protein, 9 aa, Homo Sapiens
AGIRGIIHH

SEQ ID NO: 1321190 - protein, 9 aa, Homo Sapiens
KLQVLGESR

SEQ ID NO: 1321191 - protein, 9 aa, Homo Sapiens
DEPPKDIFD

SEQ ID NO: 1321192 - protein, 9 aa, Homo Sapiens
NEIRPVSRC

SEQ ID NO: 1321193 - protein, 9 aa, Homo Sapiens
TLEDMLYVP

SEQ ID NO: 1321194 - protein, 9 aa, Homo Sapiens
AWSHFVFVL

SEQ ID NO: 1321195 - protein, 9 aa, Homo Sapiens
QRREIKLHL

SEQ ID NO: 1321196 - protein, 9 aa, Homo Sapiens
MACDGTFVK

SEQ ID NO: 1321197 - protein, 9 aa, Homo Sapiens
FHQGHPLPA

SEQ ID NO: 1321198 - protein, 9 aa, Homo Sapiens
TERVIARLA

SEQ ID NO: 1321199 - protein, 9 aa, Homo Sapiens
IQHHLVEKI

SEQ ID NO: 1321200 - protein, 9 aa, Homo Sapiens
RMWADVSHL

SEQ ID NO: 1321201 - protein, 9 aa, Homo Sapiens
SASWFPSYL

SEQ ID NO: 1321202 - protein, 9 aa, Homo Sapiens
FQAWLRLRV

SEQ ID NO: 1321203 - protein, 9 aa, Homo Sapiens
SLDSYLLKS

SEQ ID NO: 1321204 - protein, 9 aa, Homo Sapiens
MSTHLSNGQ

SEQ ID NO: 1321205 - protein, 9 aa, Homo Sapiens
TGSRTHGRW

SEQ ID NO: 1321206 - protein, 9 aa, Homo Sapiens
AVFVRPYPA

SEQ ID NO: 1321207 - protein, 9 aa, Homo Sapiens
ISHMKRVLD

SEQ ID NO: 1321208 - protein, 9 aa, Homo Sapiens
SGKDDIFAG

SEQ ID NO: 1321209 - protein, 9 aa, Homo Sapiens
LCISSFTPQ

SEQ ID NO: 1321210 - protein, 9 aa, Homo Sapiens
VFVHRCLLA

SEQ ID NO: 1321211 - protein, 9 aa, Homo Sapiens
HKEVKAKPT

SEQ ID NO: 1321212 - protein, 9 aa, Homo Sapiens
LVVQSAKWF

SEQ ID NO: 1321213 - protein, 9 aa, Homo Sapiens
DSLPMTSEA

SEQ ID NO: 1321214 - protein, 9 aa, Homo Sapiens
NLKMEMLTG

SEQ ID NO: 1321215 - protein, 9 aa, Homo Sapiens
QFLILNKHK

SEQ ID NO: 1321216 - protein, 9 aa, Homo Sapiens
LLGDTYNMR

SEQ ID NO: 1321217 - protein, 9 aa, Homo Sapiens
AEFSRFFDV

SEQ ID NO: 1321218 - protein, 9 aa, Homo Sapiens
IRKCFLCLG

SEQ ID NO: 1321219 - protein, 9 aa, Homo Sapiens
KHMRESAMQ

SEQ ID NO: 1321220 - protein, 9 aa, Homo Sapiens
ITLLDPRLK

SEQ ID NO: 1321221 - protein, 9 aa, Homo Sapiens
QLMRTKSDT

SEQ ID NO: 1321222 - protein, 9 aa, Homo Sapiens
PERQQHIAQ

SEQ ID NO: 1321223 - protein, 9 aa, Homo Sapiens
KWSELLKLP

SEQ ID NO: 1321224 - protein, 9 aa, Homo Sapiens
LVVHFFACP

SEQ ID NO: 1321225 - protein, 9 aa, Homo Sapiens
VVNAVGMSE

SEQ ID NO: 1321226 - protein, 9 aa, Homo Sapiens
HYKDAMEQC

SEQ ID NO: 1321227 - protein, 9 aa, Homo Sapiens
AELLWHLAR

SEQ ID NO: 1321228 - protein, 9 aa, Homo Sapiens
MVPRELPTC

SEQ ID NO: 1321229 - protein, 9 aa, Homo Sapiens
DGTHWRIYR

SEQ ID NO: 1321230 - protein, 9 aa, Homo Sapiens
IPHIIVLGL

SEQ ID NO: 1321231 - protein, 9 aa, Homo Sapiens
ILLCDGSEN

SEQ ID NO: 1321232 - protein, 9 aa, Homo Sapiens
GQPEMTPQS

SEQ ID NO: 1321233 - protein, 9 aa, Homo Sapiens
PRMTPWRPL

SEQ ID NO: 1321234 - protein, 9 aa, Homo Sapiens
LLSVAPKGI

SEQ ID NO: 1321235 - protein, 9 aa, Homo Sapiens
TRLTHDYLS

SEQ ID NO: 1321236 - protein, 9 aa, Homo Sapiens
WGRAAAVML

SEQ ID NO: 1321237 - protein, 9 aa, Homo Sapiens
KTMVMNMFY

SEQ ID NO: 1321238 - protein, 9 aa, Homo Sapiens
SLHRCRHDT

SEQ ID NO: 1321239 - protein, 9 aa, Homo Sapiens
AHTIKHAKA

SEQ ID NO: 1321240 - protein, 9 aa, Homo Sapiens
DPHFQDSSS

SEQ ID NO: 1321241 - protein, 9 aa, Homo Sapiens
HRNIIMWLD

SEQ ID NO: 1321242 - protein, 9 aa, Homo Sapiens
DHNAYVWSQ

SEQ ID NO: 1321243 - protein, 9 aa, Homo Sapiens
FGTEAEKLA

SEQ ID NO: 1321244 - protein, 9 aa, Homo Sapiens
NISRTVIQR

SEQ ID NO: 1321245 - protein, 9 aa, Homo Sapiens
ILPPHLNGP

SEQ ID NO: 1321246 - protein, 9 aa, Homo Sapiens
VSEVNITQF

SEQ ID NO: 1321247 - protein, 9 aa, Homo Sapiens
LQLLFVFEY

SEQ ID NO: 1321248 - protein, 9 aa, Homo Sapiens
VVTLSTSKS

SEQ ID NO: 1321249 - protein, 9 aa, Homo Sapiens
TGSEDGTVC

SEQ ID NO: 1321250 - protein, 9 aa, Homo Sapiens
TRVQGAWAA

SEQ ID NO: 1321251 - protein, 9 aa, Homo Sapiens
GDTPLHIVI

SEQ ID NO: 1321252 - protein, 9 aa, Homo Sapiens
YYQLNKHLP

SEQ ID NO: 1321253 - protein, 9 aa, Homo Sapiens
RSGKCGRPS

SEQ ID NO: 1321254 - protein, 9 aa, Homo Sapiens
AICIGMYVL

SEQ ID NO: 1321255 - protein, 9 aa, Homo Sapiens
MNYEIMGRA

SEQ ID NO: 1321256 - protein, 9 aa, Homo Sapiens
SLCSMEIPG

SEQ ID NO: 1321257 - protein, 9 aa, Homo Sapiens
TNGSSPEPV

SEQ ID NO: 1321258 - protein, 9 aa, Homo Sapiens
EDFYCMTCH

SEQ ID NO: 1321259 - protein, 9 aa, Homo Sapiens
STFSKGSDI

SEQ ID NO: 1321260 - protein, 9 aa, Homo Sapiens
IYFFRAESK

SEQ ID NO: 1321261 - protein, 9 aa, Homo Sapiens
ASIIIALTD

SEQ ID NO: 1321262 - protein, 9 aa, Homo Sapiens
CSAMAAVIH

SEQ ID NO: 1321263 - protein, 9 aa, Homo Sapiens
YQHYLRMWA

SEQ ID NO: 1321264 - protein, 9 aa, Homo Sapiens
VVFLLQQVC

SEQ ID NO: 1321265 - protein, 9 aa, Homo Sapiens
TFLIRPSES

SEQ ID NO: 1321266 - protein, 9 aa, Homo Sapiens
FPVVNTQLL

SEQ ID NO: 1321267 - protein, 9 aa, Homo Sapiens
REDDEKHIQ

SEQ ID NO: 1321268 - protein, 9 aa, Homo Sapiens
GDPGVQLCI

SEQ ID NO: 1321269 - protein, 9 aa, Homo Sapiens
DYFTEMQLK

SEQ ID NO: 1321270 - protein, 9 aa, Homo Sapiens
AHDDSVIYL

SEQ ID NO: 1321271 - protein, 9 aa, Homo Sapiens
LYKDKEKAA

SEQ ID NO: 1321272 - protein, 9 aa, Homo Sapiens
GTLAAYPQT

SEQ ID NO: 1321273 - protein, 9 aa, Homo Sapiens
SGLEGRLPP

SEQ ID NO: 1321274 - protein, 9 aa, Homo Sapiens
PRHDKVTFV

SEQ ID NO: 1321275 - protein, 9 aa, Homo Sapiens
HNCNECQCI

SEQ ID NO: 1321276 - protein, 9 aa, Homo Sapiens
PGEGANPQM

SEQ ID NO: 1321277 - protein, 9 aa, Homo Sapiens
EITLVHWEN

SEQ ID NO: 1321278 - protein, 9 aa, Homo Sapiens
LYLGTKLLD

SEQ ID NO: 1321279 - protein, 9 aa, Homo Sapiens
NFIYYRSAD

SEQ ID NO: 1321280 - protein, 9 aa, Homo Sapiens
VYLYKLKEL

SEQ ID NO: 1321281 - protein, 9 aa, Homo Sapiens
GCIRVVRGE

SEQ ID NO: 1321282 - protein, 9 aa, Homo Sapiens
GDHHVELYK

SEQ ID NO: 1321283 - protein, 9 aa, Homo Sapiens
QPEDQESPH

SEQ ID NO: 1321284 - protein, 9 aa, Homo Sapiens
RRCWGQTIF

SEQ ID NO: 1321285 - protein, 9 aa, Homo Sapiens
LSIIRSCMV

SEQ ID NO: 1321286 - protein, 9 aa, Homo Sapiens
CTLLFALMM

SEQ ID NO: 1321287 - protein, 9 aa, Homo Sapiens
VTTARNFGF

SEQ ID NO: 1321288 - protein, 9 aa, Homo Sapiens
CKLRYGMLH

SEQ ID NO: 1321289 - protein, 9 aa, Homo Sapiens
CVVAFYSGK

SEQ ID NO: 1321290 - protein, 9 aa, Homo Sapiens
RCSRWVRPR

SEQ ID NO: 1321291 - protein, 9 aa, Homo Sapiens
FNMDKYTNL

SEQ ID NO: 1321292 - protein, 9 aa, Homo Sapiens
DENVDLWSL

SEQ ID NO: 1321293 - protein, 9 aa, Homo Sapiens
RKLGMQLVL

SEQ ID NO: 1321294 - protein, 9 aa, Homo Sapiens
SAVGHVLWI

SEQ ID NO: 1321295 - protein, 9 aa, Homo Sapiens
QAVFFILFV

SEQ ID NO: 1321296 - protein, 9 aa, Homo Sapiens
LKSGIRIKE

SEQ ID NO: 1321297 - protein, 9 aa, Homo Sapiens
FPKTNVTSP

SEQ ID NO: 1321298 - protein, 9 aa, Homo Sapiens
QKGLDRRAR

SEQ ID NO: 1321299 - protein, 9 aa, Homo Sapiens
FLQTFNYML

SEQ ID NO: 1321300 - protein, 9 aa, Homo Sapiens
HHATAYRVV

SEQ ID NO: 1321301 - protein, 9 aa, Homo Sapiens
IYPAQVELQ

SEQ ID NO: 1321302 - protein, 9 aa, Homo Sapiens
PKSPVEEKD

SEQ ID NO: 1321303 - protein, 9 aa, Homo Sapiens
LRQDRMAFC

SEQ ID NO: 1321304 - protein, 9 aa, Homo Sapiens
CLSDLIAAV

SEQ ID NO: 1321305 - protein, 9 aa, Homo Sapiens
PPLPQKDHF

SEQ ID NO: 1321306 - protein, 9 aa, Homo Sapiens
CTWVMTCAY

SEQ ID NO: 1321307 - protein, 9 aa, Homo Sapiens
GLGQIIKIP

SEQ ID NO: 1321308 - protein, 9 aa, Homo Sapiens
PSISAATVE

SEQ ID NO: 1321309 - protein, 9 aa, Homo Sapiens
EPVVGIPDN

SEQ ID NO: 1321310 - protein, 9 aa, Homo Sapiens
QDRPVSKLV

SEQ ID NO: 1321311 - protein, 9 aa, Homo Sapiens
LETTSCSTF

SEQ ID NO: 1321312 - protein, 9 aa, Homo Sapiens
DIWNSQDRF

SEQ ID NO: 1321313 - protein, 9 aa, Homo Sapiens
SVLGHSNCC

SEQ ID NO: 1321314 - protein, 9 aa, Homo Sapiens
RVLSNYEMP

SEQ ID NO: 1321315 - protein, 9 aa, Homo Sapiens
LEAAHHHEN

SEQ ID NO: 1321316 - protein, 9 aa, Homo Sapiens
CQDWLTGIR

SEQ ID NO: 1321317 - protein, 9 aa, Homo Sapiens
FEHTLQLIW

SEQ ID NO: 1321318 - protein, 9 aa, Homo Sapiens
LGYGYDCGC

SEQ ID NO: 1321319 - protein, 9 aa, Homo Sapiens
RTAGANGTL

SEQ ID NO: 1321320 - protein, 9 aa, Homo Sapiens
KTRPILDVV

SEQ ID NO: 1321321 - protein, 9 aa, Homo Sapiens
QPSSTMLQG

SEQ ID NO: 1321322 - protein, 9 aa, Homo Sapiens
PTAGRASAA

SEQ ID NO: 1321323 - protein, 9 aa, Homo Sapiens
CTSASTRAS

SEQ ID NO: 1321324 - protein, 9 aa, Homo Sapiens
ISEGSCPEH

SEQ ID NO: 1321325 - protein, 9 aa, Homo Sapiens
IILNSSALH

SEQ ID NO: 1321326 - protein, 9 aa, Homo Sapiens
TMHDTRGCS

SEQ ID NO: 1321327 - protein, 9 aa, Homo Sapiens
TPAFAQPEY

SEQ ID NO: 1321328 - protein, 9 aa, Homo Sapiens
LLAGSMVHV

SEQ ID NO: 1321329 - protein, 9 aa, Homo Sapiens
IEEVKVLLE

SEQ ID NO: 1321330 - protein, 9 aa, Homo Sapiens
PCVPGPKGD

SEQ ID NO: 1321331 - protein, 9 aa, Homo Sapiens
KTHNGEKPF

SEQ ID NO: 1321332 - protein, 9 aa, Homo Sapiens
SDINDNPPI

SEQ ID NO: 1321333 - protein, 9 aa, Homo Sapiens
ATEMQLPIY

SEQ ID NO: 1321334 - protein, 9 aa, Homo Sapiens
QTYVKCPTP

SEQ ID NO: 1321335 - protein, 9 aa, Homo Sapiens
RDIEHMVEA

SEQ ID NO: 1321336 - protein, 9 aa, Homo Sapiens
VARYEETMF

SEQ ID NO: 1321337 - protein, 9 aa, Homo Sapiens
QNTHHKSSE

SEQ ID NO: 1321338 - protein, 9 aa, Homo Sapiens
DVTAQDTTR

SEQ ID NO: 1321339 - protein, 9 aa, Homo Sapiens
PETNPQPGS

SEQ ID NO: 1321340 - protein, 9 aa, Homo Sapiens
SAHKSSDAS

SEQ ID NO: 1321341 - protein, 9 aa, Homo Sapiens
FSSGSSSSR

SEQ ID NO: 1321342 - protein, 9 aa, Homo Sapiens
KKRRWGRKE

SEQ ID NO: 1321343 - protein, 9 aa, Homo Sapiens
AQSAAVGPL

SEQ ID NO: 1321344 - protein, 9 aa, Homo Sapiens
YVVICFPLH

SEQ ID NO: 1321345 - protein, 9 aa, Homo Sapiens
GKNIQGGRP

SEQ ID NO: 1321346 - protein, 9 aa, Homo Sapiens
TFNCCTFLS

SEQ ID NO: 1321347 - protein, 9 aa, Homo Sapiens
FVEYYSHAD

SEQ ID NO: 1321348 - protein, 9 aa, Homo Sapiens
CLENMAQKF

SEQ ID NO: 1321349 - protein, 9 aa, Homo Sapiens
WVTYQGRVQ

SEQ ID NO: 1321350 - protein, 9 aa, Homo Sapiens
LPREVVTRF

SEQ ID NO: 1321351 - protein, 9 aa, Homo Sapiens
QVWRYLCAL

SEQ ID NO: 1321352 - protein, 9 aa, Homo Sapiens
ARCDVSKWP

SEQ ID NO: 1321353 - protein, 9 aa, Homo Sapiens
SDRTRNMFK

SEQ ID NO: 1321354 - protein, 9 aa, Homo Sapiens
QTPIQTPCG

SEQ ID NO: 1321355 - protein, 9 aa, Homo Sapiens
EEVTVSTWL

SEQ ID NO: 1321356 - protein, 9 aa, Homo Sapiens
LDKKEKKND

SEQ ID NO: 1321357 - protein, 9 aa, Homo Sapiens
SQAPQAVHT

SEQ ID NO: 1321358 - protein, 9 aa, Homo Sapiens
EDGIIIATK

SEQ ID NO: 1321359 - protein, 9 aa, Homo Sapiens
ATSTGKSKS

SEQ ID NO: 1321360 - protein, 9 aa, Homo Sapiens
PTPRIDSQL

SEQ ID NO: 1321361 - protein, 9 aa, Homo Sapiens
SSISCAQIP

SEQ ID NO: 1321362 - protein, 9 aa, Homo Sapiens
GCPDAKGEP

SEQ ID NO: 1321363 - protein, 9 aa, Homo Sapiens
MFNMFCYLG

SEQ ID NO: 1321364 - protein, 9 aa, Homo Sapiens
RHTLQGLEI

SEQ ID NO: 1321365 - protein, 9 aa, Homo Sapiens
KDSGVLDRM

SEQ ID NO: 1321366 - protein, 9 aa, Homo Sapiens
VYHSPVDRV

SEQ ID NO: 1321367 - protein, 9 aa, Homo Sapiens
IPPQMGSFK

SEQ ID NO: 1321368 - protein, 9 aa, Homo Sapiens
PDKDKKCHK

SEQ ID NO: 1321369 - protein, 9 aa, Homo Sapiens
RSRSKLWSA

SEQ ID NO: 1321370 - protein, 9 aa, Homo Sapiens
SCKKAPLVP

SEQ ID NO: 1321371 - protein, 9 aa, Homo Sapiens
LCHLCKKQG

SEQ ID NO: 1321372 - protein, 9 aa, Homo Sapiens
PSKRHRPQP

SEQ ID NO: 1321373 - protein, 9 aa, Homo Sapiens
LEENLDPSA

SEQ ID NO: 1321374 - protein, 9 aa, Homo Sapiens
NAVISFLCG

SEQ ID NO: 1321375 - protein, 9 aa, Homo Sapiens
RDVKIYQIY

SEQ ID NO: 1321376 - protein, 9 aa, Homo Sapiens
RGASPEEAV

SEQ ID NO: 1321377 - protein, 9 aa, Homo Sapiens
TLSTVLPGL

SEQ ID NO: 1321378 - protein, 9 aa, Homo Sapiens
NKPHYPKAS

SEQ ID NO: 1321379 - protein, 9 aa, Homo Sapiens
RPSAAARCS

SEQ ID NO: 1321380 - protein, 9 aa, Homo Sapiens
TYPSVGAQG

SEQ ID NO: 1321381 - protein, 9 aa, Homo Sapiens
ELHVSCMER

SEQ ID NO: 1321382 - protein, 9 aa, Homo Sapiens
SNTPLGAVL

SEQ ID NO: 1321383 - protein, 9 aa, Homo Sapiens
QHKMLCLRL

SEQ ID NO: 1321384 - protein, 9 aa, Homo Sapiens
SQSSPRTQA

SEQ ID NO: 1321385 - protein, 9 aa, Homo Sapiens
MDDYTYISV

SEQ ID NO: 1321386 - protein, 9 aa, Homo Sapiens
SVPPQSRLS

SEQ ID NO: 1321387 - protein, 9 aa, Homo Sapiens
MVVLVGYNT

SEQ ID NO: 1321388 - protein, 9 aa, Homo Sapiens
ISWQGRTRQ

SEQ ID NO: 1321389 - protein, 9 aa, Homo Sapiens
KICGVINQL

SEQ ID NO: 1321390 - protein, 9 aa, Homo Sapiens
RASVRIHSS

SEQ ID NO: 1321391 - protein, 9 aa, Homo Sapiens
NHTLFSLNG

SEQ ID NO: 1321392 - protein, 9 aa, Homo Sapiens
FYYDVGHCP

SEQ ID NO: 1321393 - protein, 9 aa, Homo Sapiens
ANDNTPVFT

SEQ ID NO: 1321394 - protein, 9 aa, Homo Sapiens
LEEGNDQSE

SEQ ID NO: 1321395 - protein, 9 aa, Homo Sapiens
GKIDVKMPF

SEQ ID NO: 1321396 - protein, 9 aa, Homo Sapiens
EVITNCPKG

SEQ ID NO: 1321397 - protein, 9 aa, Homo Sapiens
MQEMEEYPI

SEQ ID NO: 1321398 - protein, 9 aa, Homo Sapiens
TYNMRHPLT

SEQ ID NO: 1321399 - protein, 9 aa, Homo Sapiens
AFSDSLRWD

SEQ ID NO: 1321400 - protein, 9 aa, Homo Sapiens
VKDTKVISV

SEQ ID NO: 1321401 - protein, 9 aa, Homo Sapiens
AMHAASSSD

SEQ ID NO: 1321402 - protein, 9 aa, Homo Sapiens
VVIVALISI

SEQ ID NO: 1321403 - protein, 9 aa, Homo Sapiens
WLMFPTPFV

SEQ ID NO: 1321404 - protein, 9 aa, Homo Sapiens
MATLTIRSL

SEQ ID NO: 1321405 - protein, 9 aa, Homo Sapiens
SLDEDEEEE

SEQ ID NO: 1321406 - protein, 9 aa, Homo Sapiens
VMEQCLAQL

SEQ ID NO: 1321407 - protein, 9 aa, Homo Sapiens
RISTAGYII

SEQ ID NO: 1321408 - protein, 9 aa, Homo Sapiens
GPSDHYHSF

SEQ ID NO: 1321409 - protein, 9 aa, Homo Sapiens
IMRICLRDL

SEQ ID NO: 1321410 - protein, 9 aa, Homo Sapiens
SSLISSATS

SEQ ID NO: 1321411 - protein, 9 aa, Homo Sapiens
DIRELKATD

SEQ ID NO: 1321412 - protein, 9 aa, Homo Sapiens
HQRVHMGKK

SEQ ID NO: 1321413 - protein, 9 aa, Homo Sapiens
VFRNPHHSQ

SEQ ID NO: 1321414 - protein, 9 aa, Homo Sapiens
LGEQHYKDA

SEQ ID NO: 1321415 - protein, 9 aa, Homo Sapiens
GRDHFAFGE

SEQ ID NO: 1321416 - protein, 9 aa, Homo Sapiens
HCLCTVENL

SEQ ID NO: 1321417 - protein, 9 aa, Homo Sapiens
ATLSAPYGF

SEQ ID NO: 1321418 - protein, 9 aa, Homo Sapiens
RIADNFKVF

SEQ ID NO: 1321419 - protein, 9 aa, Homo Sapiens
IRTAVDSAQ

SEQ ID NO: 1321420 - protein, 9 aa, Homo Sapiens
PGAASTPRD

SEQ ID NO: 1321421 - protein, 9 aa, Homo Sapiens
PGPELDSGT

SEQ ID NO: 1321422 - protein, 9 aa, Homo Sapiens
GTEYFRVPT

SEQ ID NO: 1321423 - protein, 9 aa, Homo Sapiens
HWHQVDVVL

SEQ ID NO: 1321424 - protein, 9 aa, Homo Sapiens
HYLKSHQFP

SEQ ID NO: 1321425 - protein, 9 aa, Homo Sapiens
HVTVVGLFY

SEQ ID NO: 1321426 - protein, 9 aa, Homo Sapiens
GDDFFSSAF

SEQ ID NO: 1321427 - protein, 9 aa, Homo Sapiens
KNFCDKASA

SEQ ID NO: 1321428 - protein, 9 aa, Homo Sapiens
NFQRDVFLR

SEQ ID NO: 1321429 - protein, 9 aa, Homo Sapiens
FSILMPPFV

SEQ ID NO: 1321430 - protein, 9 aa, Homo Sapiens
LLQPYTECV

SEQ ID NO: 1321431 - protein, 9 aa, Homo Sapiens
RNRHHIEKK

SEQ ID NO: 1321432 - protein, 9 aa, Homo Sapiens
RMLAYSGPG

SEQ ID NO: 1321433 - protein, 9 aa, Homo Sapiens
TATKIEAPA

SEQ ID NO: 1321434 - protein, 9 aa, Homo Sapiens
QAKSQQDKH

SEQ ID NO: 1321435 - protein, 9 aa, Homo Sapiens
ADTVLCAYN

SEQ ID NO: 1321436 - protein, 9 aa, Homo Sapiens
CRACFGLDQ

SEQ ID NO: 1321437 - protein, 9 aa, Homo Sapiens
PDGISQLEH

SEQ ID NO: 1321438 - protein, 9 aa, Homo Sapiens
SLSGGGMVR

SEQ ID NO: 1321439 - protein, 9 aa, Homo Sapiens
LPEPPLPYE

SEQ ID NO: 1321440 - protein, 9 aa, Homo Sapiens
VSTVHADYS

SEQ ID NO: 1321441 - protein, 9 aa, Homo Sapiens
SLPIILMTI

SEQ ID NO: 1321442 - protein, 9 aa, Homo Sapiens
HPKHWFQLC

SEQ ID NO: 1321443 - protein, 9 aa, Homo Sapiens
LAYLCNTQI

SEQ ID NO: 1321444 - protein, 9 aa, Homo Sapiens
IAKQILQEL

SEQ ID NO: 1321445 - protein, 9 aa, Homo Sapiens
LKMEGTYIA

SEQ ID NO: 1321446 - protein, 9 aa, Homo Sapiens
AHLLDITMG

SEQ ID NO: 1321447 - protein, 9 aa, Homo Sapiens
YVMASFYSM

SEQ ID NO: 1321448 - protein, 9 aa, Homo Sapiens
CQLDPAGLH

SEQ ID NO: 1321449 - protein, 9 aa, Homo Sapiens
VANHVLDEL

SEQ ID NO: 1321450 - protein, 9 aa, Homo Sapiens
PRQKDDLVA

SEQ ID NO: 1321451 - protein, 9 aa, Homo Sapiens
VKNDFVFLL

SEQ ID NO: 1321452 - protein, 9 aa, Homo Sapiens
DLNDEWVQC

SEQ ID NO: 1321453 - protein, 9 aa, Homo Sapiens
LSLACTRGS

SEQ ID NO: 1321454 - protein, 9 aa, Homo Sapiens
ATGQPPAWY

SEQ ID NO: 1321455 - protein, 9 aa, Homo Sapiens
QTELCCLFL

SEQ ID NO: 1321456 - protein, 9 aa, Homo Sapiens
TRLAQHFGP

SEQ ID NO: 1321457 - protein, 9 aa, Homo Sapiens
GESQYVPAF

SEQ ID NO: 1321458 - protein, 9 aa, Homo Sapiens
EAIERVAFF

SEQ ID NO: 1321459 - protein, 9 aa, Homo Sapiens
DALVGSHLS

SEQ ID NO: 1321460 - protein, 9 aa, Homo Sapiens
SQDPYSHVS

SEQ ID NO: 1321461 - protein, 9 aa, Homo Sapiens
VEGQGWQVF

SEQ ID NO: 1321462 - protein, 9 aa, Homo Sapiens
PCPLEIEHI

SEQ ID NO: 1321463 - protein, 9 aa, Homo Sapiens
NGIIIIKDN

SEQ ID NO: 1321464 - protein, 9 aa, Homo Sapiens
IMFVDSYDM

SEQ ID NO: 1321465 - protein, 9 aa, Homo Sapiens
LLVCKQLTG

SEQ ID NO: 1321466 - protein, 9 aa, Homo Sapiens
EVVATEAQG

SEQ ID NO: 1321467 - protein, 9 aa, Homo Sapiens
VVRHFHSPP

SEQ ID NO: 1321468 - protein, 9 aa, Homo Sapiens
YCEFNARFG

SEQ ID NO: 1321469 - protein, 9 aa, Homo Sapiens
MSEAEENKQ

SEQ ID NO: 1321470 - protein, 9 aa, Homo Sapiens
GVESLYFRL

SEQ ID NO: 1321471 - protein, 9 aa, Homo Sapiens
FFADISSIS

SEQ ID NO: 1321472 - protein, 9 aa, Homo Sapiens
PKRSSLEKP

SEQ ID NO: 1321473 - protein, 9 aa, Homo Sapiens
KPFNHFSYL

SEQ ID NO: 1321474 - protein, 9 aa, Homo Sapiens
SVTGGYVYC

SEQ ID NO: 1321475 - protein, 9 aa, Homo Sapiens
HCWALQMQH

SEQ ID NO: 1321476 - protein, 9 aa, Homo Sapiens
LHDGHTDQE

SEQ ID NO: 1321477 - protein, 9 aa, Homo Sapiens
TLLGLVGTT

SEQ ID NO: 1321478 - protein, 9 aa, Homo Sapiens
RTRVQGAWA

SEQ ID NO: 1321479 - protein, 9 aa, Homo Sapiens
QLADSLIGK

SEQ ID NO: 1321480 - protein, 9 aa, Homo Sapiens
VMVVDTAWI

SEQ ID NO: 1321481 - protein, 9 aa, Homo Sapiens
SEMLKRQHS

SEQ ID NO: 1321482 - protein, 9 aa, Homo Sapiens
NADMALQNL

SEQ ID NO: 1321483 - protein, 9 aa, Homo Sapiens
HLSAHTIKH

SEQ ID NO: 1321484 - protein, 9 aa, Homo Sapiens
PNVSYICSH

SEQ ID NO: 1321485 - protein, 9 aa, Homo Sapiens
KGHPGYTAV

SEQ ID NO: 1321486 - protein, 9 aa, Homo Sapiens
FTLHLFGCM

SEQ ID NO: 1321487 - protein, 9 aa, Homo Sapiens
SYHNAVHAA

SEQ ID NO: 1321488 - protein, 9 aa, Homo Sapiens
YPDLLYLTP

SEQ ID NO: 1321489 - protein, 9 aa, Homo Sapiens
DTACTLGAY

SEQ ID NO: 1321490 - protein, 9 aa, Homo Sapiens
AKRTHQWRT

SEQ ID NO: 1321491 - protein, 9 aa, Homo Sapiens
GSMVLAYSG

SEQ ID NO: 1321492 - protein, 9 aa, Homo Sapiens
VIILNSSAL

SEQ ID NO: 1321493 - protein, 9 aa, Homo Sapiens
RRSDLDHFW

SEQ ID NO: 1321494 - protein, 9 aa, Homo Sapiens
RVQPSCPSQ

SEQ ID NO: 1321495 - protein, 9 aa, Homo Sapiens
LSAISIIMI

SEQ ID NO: 1321496 - protein, 9 aa, Homo Sapiens
TMLLQETTG

SEQ ID NO: 1321497 - protein, 9 aa, Homo Sapiens
QVGHPKHLE

SEQ ID NO: 1321498 - protein, 9 aa, Homo Sapiens
WGVWLRLRP

SEQ ID NO: 1321499 - protein, 9 aa, Homo Sapiens
HLLGENDDM

SEQ ID NO: 1321500 - protein, 9 aa, Homo Sapiens
RSKSKEMPQ

SEQ ID NO: 1321501 - protein, 9 aa, Homo Sapiens
QHMAEQLLA

SEQ ID NO: 1321502 - protein, 9 aa, Homo Sapiens
WPWTRCLRM

SEQ ID NO: 1321503 - protein, 9 aa, Homo Sapiens
GKTEVSKYI

SEQ ID NO: 1321504 - protein, 9 aa, Homo Sapiens
RAPQACSPE

SEQ ID NO: 1321505 - protein, 9 aa, Homo Sapiens
TYVRVLRFF

SEQ ID NO: 1321506 - protein, 9 aa, Homo Sapiens
LVVSVPAPT

SEQ ID NO: 1321507 - protein, 9 aa, Homo Sapiens
LCPGVTIWG

SEQ ID NO: 1321508 - protein, 9 aa, Homo Sapiens
EIIKKQEEG

SEQ ID NO: 1321509 - protein, 9 aa, Homo Sapiens
EVTTCVGRN

SEQ ID NO: 1321510 - protein, 9 aa, Homo Sapiens
ALDVPSGIT

SEQ ID NO: 1321511 - protein, 9 aa, Homo Sapiens
NFVCAMGPR

SEQ ID NO: 1321512 - protein, 9 aa, Homo Sapiens
AQLWGPMDV

SEQ ID NO: 1321513 - protein, 9 aa, Homo Sapiens
RIRNKDRPV

SEQ ID NO: 1321514 - protein, 9 aa, Homo Sapiens
NIHTDSWTT

SEQ ID NO: 1321515 - protein, 9 aa, Homo Sapiens
VAIPMLSPL

SEQ ID NO: 1321516 - protein, 9 aa, Homo Sapiens
QHVLGAQVF

SEQ ID NO: 1321517 - protein, 9 aa, Homo Sapiens
EKLGAFLAQ

SEQ ID NO: 1321518 - protein, 9 aa, Homo Sapiens
APQNGCQDV

SEQ ID NO: 1321519 - protein, 9 aa, Homo Sapiens
EGVHLGQSL

SEQ ID NO: 1321520 - protein, 9 aa, Homo Sapiens
CKRWAKQDC

SEQ ID NO: 1321521 - protein, 9 aa, Homo Sapiens
CTMESAPRG

SEQ ID NO: 1321522 - protein, 9 aa, Homo Sapiens
EAQKRKKED

SEQ ID NO: 1321523 - protein, 9 aa, Homo Sapiens
ETIWYVHFL

SEQ ID NO: 1321524 - protein, 9 aa, Homo Sapiens
KTTQNLTQK

SEQ ID NO: 1321525 - protein, 9 aa, Homo Sapiens
PPKITSPLN

SEQ ID NO: 1321526 - protein, 9 aa, Homo Sapiens
ELRSRLCTM

SEQ ID NO: 1321527 - protein, 9 aa, Homo Sapiens
LVLMMISKQ

SEQ ID NO: 1321528 - protein, 9 aa, Homo Sapiens
STTMNNDMT

SEQ ID NO: 1321529 - protein, 9 aa, Homo Sapiens
QLPHIFTSI

SEQ ID NO: 1321530 - protein, 9 aa, Homo Sapiens
PSSTTSLCS

SEQ ID NO: 1321531 - protein, 9 aa, Homo Sapiens
SPPACADPH

SEQ ID NO: 1321532 - protein, 9 aa, Homo Sapiens
SMMCYDDHT

SEQ ID NO: 1321533 - protein, 9 aa, Homo Sapiens
IKEHLPPPV

SEQ ID NO: 1321534 - protein, 9 aa, Homo Sapiens
FSILVLWTT

SEQ ID NO: 1321535 - protein, 9 aa, Homo Sapiens
EFSLSPNLG

SEQ ID NO: 1321536 - protein, 9 aa, Homo Sapiens
ACVAMSHKI

SEQ ID NO: 1321537 - protein, 9 aa, Homo Sapiens
AGAARARTC

SEQ ID NO: 1321538 - protein, 9 aa, Homo Sapiens
LYLRSLEMD

SEQ ID NO: 1321539 - protein, 9 aa, Homo Sapiens
SLSSEGLAR

SEQ ID NO: 1321540 - protein, 9 aa, Homo Sapiens
MRYQQNCLR

SEQ ID NO: 1321541 - protein, 9 aa, Homo Sapiens
EMRETHLNE

SEQ ID NO: 1321542 - protein, 9 aa, Homo Sapiens
HCLQREDWL

SEQ ID NO: 1321543 - protein, 9 aa, Homo Sapiens
AETLKEVSL

SEQ ID NO: 1321544 - protein, 9 aa, Homo Sapiens
LQRPLVIIS

SEQ ID NO: 1321545 - protein, 9 aa, Homo Sapiens
NMQSLWEKA

SEQ ID NO: 1321546 - protein, 9 aa, Homo Sapiens
PDGTSKGCT

SEQ ID NO: 1321547 - protein, 9 aa, Homo Sapiens
TLHDGHTDQ

SEQ ID NO: 1321548 - protein, 9 aa, Homo Sapiens
LYDLETTSC

SEQ ID NO: 1321549 - protein, 9 aa, Homo Sapiens
IQEQYHRIG

SEQ ID NO: 1321550 - protein, 9 aa, Homo Sapiens
LCLDHFFIT

SEQ ID NO: 1321551 - protein, 9 aa, Homo Sapiens
RRGPHAPVG

SEQ ID NO: 1321552 - protein, 9 aa, Homo Sapiens
DYHPLITLK

SEQ ID NO: 1321553 - protein, 9 aa, Homo Sapiens
RIGQKKPVC

SEQ ID NO: 1321554 - protein, 9 aa, Homo Sapiens
TEVPMSSSG

SEQ ID NO: 1321555 - protein, 9 aa, Homo Sapiens
RSIHSAMEH

SEQ ID NO: 1321556 - protein, 9 aa, Homo Sapiens
MTAFSWIMG

SEQ ID NO: 1321557 - protein, 9 aa, Homo Sapiens
SSLEYRVSS

SEQ ID NO: 1321558 - protein, 9 aa, Homo Sapiens
SKHPMTNIT

SEQ ID NO: 1321559 - protein, 9 aa, Homo Sapiens
QPKLMDGIL

SEQ ID NO: 1321560 - protein, 9 aa, Homo Sapiens
FLRGSREHV

SEQ ID NO: 1321561 - protein, 9 aa, Homo Sapiens
DCKTVVNCS

SEQ ID NO: 1321562 - protein, 9 aa, Homo Sapiens
HRGSKVLAA

SEQ ID NO: 1321563 - protein, 9 aa, Homo Sapiens
FRATFVSHV

SEQ ID NO: 1321564 - protein, 9 aa, Homo Sapiens
VPSSRFPLM

SEQ ID NO: 1321565 - protein, 9 aa, Homo Sapiens
ELEKDMAAT

SEQ ID NO: 1321566 - protein, 9 aa, Homo Sapiens
YSIQDRTPF

SEQ ID NO: 1321567 - protein, 9 aa, Homo Sapiens
LKGKSKWEA

SEQ ID NO: 1321568 - protein, 9 aa, Homo Sapiens
LQRITLYCH

SEQ ID NO: 1321569 - protein, 9 aa, Homo Sapiens
VCPQDTVSV

SEQ ID NO: 1321570 - protein, 9 aa, Homo Sapiens
KVFRASVDL

SEQ ID NO: 1321571 - protein, 9 aa, Homo Sapiens
DNFKVFDFE

SEQ ID NO: 1321572 - protein, 9 aa, Homo Sapiens
VVVLHEWYL

SEQ ID NO: 1321573 - protein, 9 aa, Homo Sapiens
TRTIGDRMG

SEQ ID NO: 1321574 - protein, 9 aa, Homo Sapiens
ILQLTFFNI

SEQ ID NO: 1321575 - protein, 9 aa, Homo Sapiens
FGNACVAMS

SEQ ID NO: 1321576 - protein, 9 aa, Homo Sapiens
DFANDQEQA

SEQ ID NO: 1321577 - protein, 9 aa, Homo Sapiens
LGHQGSWGV

SEQ ID NO: 1321578 - protein, 9 aa, Homo Sapiens
EDLRRDMFN

SEQ ID NO: 1321579 - protein, 9 aa, Homo Sapiens
ELYYDTACT

SEQ ID NO: 1321580 - protein, 9 aa, Homo Sapiens
RETEWSFPR

SEQ ID NO: 1321581 - protein, 9 aa, Homo Sapiens
DCGGIYGEW

SEQ ID NO: 1321582 - protein, 9 aa, Homo Sapiens
VQTLQIRGM

SEQ ID NO: 1321583 - protein, 9 aa, Homo Sapiens
VSSAPDNEA

SEQ ID NO: 1321584 - protein, 9 aa, Homo Sapiens
MCLHAEDSA

SEQ ID NO: 1321585 - protein, 9 aa, Homo Sapiens
LEAEVESFH

SEQ ID NO: 1321586 - protein, 9 aa, Homo Sapiens
AAVVLCMDM

SEQ ID NO: 1321587 - protein, 9 aa, Homo Sapiens
ESTYSQLGQ

SEQ ID NO: 1321588 - protein, 9 aa, Homo Sapiens
TDLNKRRKE

SEQ ID NO: 1321589 - protein, 9 aa, Homo Sapiens
FSLPGTIAP

SEQ ID NO: 1321590 - protein, 9 aa, Homo Sapiens
GDSSMVFLS

SEQ ID NO: 1321591 - protein, 9 aa, Homo Sapiens
ALVHYDNVI

SEQ ID NO: 1321592 - protein, 9 aa, Homo Sapiens
VPNGYLCFH

SEQ ID NO: 1321593 - protein, 9 aa, Homo Sapiens
PTILKSTVF

SEQ ID NO: 1321594 - protein, 9 aa, Homo Sapiens
TEVAKTMWN

SEQ ID NO: 1321595 - protein, 9 aa, Homo Sapiens
GHRFLYIVN

SEQ ID NO: 1321596 - protein, 9 aa, Homo Sapiens
SYLETAEEV

SEQ ID NO: 1321597 - protein, 9 aa, Homo Sapiens
INIIPGELT

SEQ ID NO: 1321598 - protein, 9 aa, Homo Sapiens
RCPILSATV

SEQ ID NO: 1321599 - protein, 9 aa, Homo Sapiens
VSRETLKNR

SEQ ID NO: 1321600 - protein, 9 aa, Homo Sapiens
PSSTSASTL

SEQ ID NO: 1321601 - protein, 9 aa, Homo Sapiens
DVRDVSTTF

SEQ ID NO: 1321602 - protein, 9 aa, Homo Sapiens
LFQRFPKTP

SEQ ID NO: 1321603 - protein, 9 aa, Homo Sapiens
VPGGPLFNE

SEQ ID NO: 1321604 - protein, 9 aa, Homo Sapiens
TFYIIMKLR

SEQ ID NO: 1321605 - protein, 9 aa, Homo Sapiens
AKNPQPVQA

SEQ ID NO: 1321606 - protein, 9 aa, Homo Sapiens
ISLSLYPTD

SEQ ID NO: 1321607 - protein, 9 aa, Homo Sapiens
REMLISWLQ

SEQ ID NO: 1321608 - protein, 9 aa, Homo Sapiens
DYDITLMRL

SEQ ID NO: 1321609 - protein, 9 aa, Homo Sapiens
VPSLHVPHP

SEQ ID NO: 1321610 - protein, 9 aa, Homo Sapiens
FQNLHQLGS

SEQ ID NO: 1321611 - protein, 9 aa, Homo Sapiens
SHLAHPNKP

SEQ ID NO: 1321612 - protein, 9 aa, Homo Sapiens
RITVQAQPE

SEQ ID NO: 1321613 - protein, 9 aa, Homo Sapiens
SYQVTNGME

SEQ ID NO: 1321614 - protein, 9 aa, Homo Sapiens
TSTWLEDEG

SEQ ID NO: 1321615 - protein, 9 aa, Homo Sapiens
IQADTFHHL

SEQ ID NO: 1321616 - protein, 9 aa, Homo Sapiens
GLHRTLRLQ

SEQ ID NO: 1321617 - protein, 9 aa, Homo Sapiens
DSDSESDTN

SEQ ID NO: 1321618 - protein, 9 aa, Homo Sapiens
IEMTWKCLV

SEQ ID NO: 1321619 - protein, 9 aa, Homo Sapiens
SRMFLATHK

SEQ ID NO: 1321620 - protein, 9 aa, Homo Sapiens
TNITWMANH

SEQ ID NO: 1321621 - protein, 9 aa, Homo Sapiens
KSTRFFAKK

SEQ ID NO: 1321622 - protein, 9 aa, Homo Sapiens
STVRGCYEA

SEQ ID NO: 1321623 - protein, 9 aa, Homo Sapiens
SRETVKRIQ

SEQ ID NO: 1321624 - protein, 9 aa, Homo Sapiens
FFMMLPTSG

SEQ ID NO: 1321625 - protein, 9 aa, Homo Sapiens
LQGVAQPTM

SEQ ID NO: 1321626 - protein, 9 aa, Homo Sapiens
SLPCENQKI

SEQ ID NO: 1321627 - protein, 9 aa, Homo Sapiens
EGLQQVVDM

SEQ ID NO: 1321628 - protein, 9 aa, Homo Sapiens
CYVIYRLYH

SEQ ID NO: 1321629 - protein, 9 aa, Homo Sapiens
IQEEMEVCD

SEQ ID NO: 1321630 - protein, 9 aa, Homo Sapiens
KSVLSAIVS

SEQ ID NO: 1321631 - protein, 9 aa, Homo Sapiens
EEVTVLQPP

SEQ ID NO: 1321632 - protein, 9 aa, Homo Sapiens
SKRRFECDC

SEQ ID NO: 1321633 - protein, 9 aa, Homo Sapiens
HSFGICHQD

SEQ ID NO: 1321634 - protein, 9 aa, Homo Sapiens
ELDNNCSAL

SEQ ID NO: 1321635 - protein, 9 aa, Homo Sapiens
GFCLFFTSV

SEQ ID NO: 1321636 - protein, 9 aa, Homo Sapiens
LPSQSTTDT

SEQ ID NO: 1321637 - protein, 9 aa, Homo Sapiens
ASQMILMFL

SEQ ID NO: 1321638 - protein, 9 aa, Homo Sapiens
LIESLQIFP

SEQ ID NO: 1321639 - protein, 9 aa, Homo Sapiens
KESGLEGRL

SEQ ID NO: 1321640 - protein, 9 aa, Homo Sapiens
HSPFVFGHP

SEQ ID NO: 1321641 - protein, 9 aa, Homo Sapiens
FLGLTMGTT

SEQ ID NO: 1321642 - protein, 9 aa, Homo Sapiens
NPITMQTVY

SEQ ID NO: 1321643 - protein, 9 aa, Homo Sapiens
HASQRPDRQ

SEQ ID NO: 1321644 - protein, 9 aa, Homo Sapiens
PRSVRYILK

SEQ ID NO: 1321645 - protein, 9 aa, Homo Sapiens
VGKLSFIIQ

SEQ ID NO: 1321646 - protein, 9 aa, Homo Sapiens
KPWVYSLLR

SEQ ID NO: 1321647 - protein, 9 aa, Homo Sapiens
GDRVMTING

SEQ ID NO: 1321648 - protein, 9 aa, Homo Sapiens
SHLLTVSVM

SEQ ID NO: 1321649 - protein, 9 aa, Homo Sapiens
GTQLPSHIT

SEQ ID NO: 1321650 - protein, 9 aa, Homo Sapiens
YITVGLLLL

SEQ ID NO: 1321651 - protein, 9 aa, Homo Sapiens
EQRYLTALW

SEQ ID NO: 1321652 - protein, 9 aa, Homo Sapiens
ETQGLPSSE

SEQ ID NO: 1321653 - protein, 9 aa, Homo Sapiens
AKRQKVHEE

SEQ ID NO: 1321654 - protein, 9 aa, Homo Sapiens
VAEYAHVQK

SEQ ID NO: 1321655 - protein, 9 aa, Homo Sapiens
VSTTFLSDL

SEQ ID NO: 1321656 - protein, 9 aa, Homo Sapiens
PGSTTSSSL

SEQ ID NO: 1321657 - protein, 9 aa, Homo Sapiens
RSSKGTLNL

SEQ ID NO: 1321658 - protein, 9 aa, Homo Sapiens
VLWTVETKA

SEQ ID NO: 1321659 - protein, 9 aa, Homo Sapiens
GILTKCKGT

SEQ ID NO: 1321660 - protein, 9 aa, Homo Sapiens
LLSVMTYDR

SEQ ID NO: 1321661 - protein, 9 aa, Homo Sapiens
AKPSAPTPT

SEQ ID NO: 1321662 - protein, 9 aa, Homo Sapiens
DACDVERLQ

SEQ ID NO: 1321663 - protein, 9 aa, Homo Sapiens
KASANQRPG

SEQ ID NO: 1321664 - protein, 9 aa, Homo Sapiens
VVLLPQPPK

SEQ ID NO: 1321665 - protein, 9 aa, Homo Sapiens
LFITPLLLL

SEQ ID NO: 1321666 - protein, 9 aa, Homo Sapiens
LLSRGTNPN

SEQ ID NO: 1321667 - protein, 9 aa, Homo Sapiens
HFNIFSKPV

SEQ ID NO: 1321668 - protein, 9 aa, Homo Sapiens
QMKPCRLLK

SEQ ID NO: 1321669 - protein, 9 aa, Homo Sapiens
LIRIASIPG

SEQ ID NO: 1321670 - protein, 9 aa, Homo Sapiens
HFIVDKLNA

SEQ ID NO: 1321671 - protein, 9 aa, Homo Sapiens
LTAEKLDFA

SEQ ID NO: 1321672 - protein, 9 aa, Homo Sapiens
PSESQNVPS

SEQ ID NO: 1321673 - protein, 9 aa, Homo Sapiens
LLNCRGVIA

SEQ ID NO: 1321674 - protein, 9 aa, Homo Sapiens
SCGVGVRKW

SEQ ID NO: 1321675 - protein, 9 aa, Homo Sapiens
ALEENDYFT

SEQ ID NO: 1321676 - protein, 9 aa, Homo Sapiens
ISPEKTHHL

SEQ ID NO: 1321677 - protein, 9 aa, Homo Sapiens
TEISGQASG

SEQ ID NO: 1321678 - protein, 9 aa, Homo Sapiens
LSEARMQVW

SEQ ID NO: 1321679 - protein, 9 aa, Homo Sapiens
IRSLLDVVM

SEQ ID NO: 1321680 - protein, 9 aa, Homo Sapiens
IPELAKMIK

SEQ ID NO: 1321681 - protein, 9 aa, Homo Sapiens
ATEAWCRTT

SEQ ID NO: 1321682 - protein, 9 aa, Homo Sapiens
AIDYCTSKV

SEQ ID NO: 1321683 - protein, 9 aa, Homo Sapiens
EFLSFLITH

SEQ ID NO: 1321684 - protein, 9 aa, Homo Sapiens
ALFLYCYPP

SEQ ID NO: 1321685 - protein, 9 aa, Homo Sapiens
SRVQRNIRL

SEQ ID NO: 1321686 - protein, 9 aa, Homo Sapiens
MVSQEETQG

SEQ ID NO: 1321687 - protein, 9 aa, Homo Sapiens
LGKCTYTSS

SEQ ID NO: 1321688 - protein, 9 aa, Homo Sapiens
ATFIRYNDM

SEQ ID NO: 1321689 - protein, 9 aa, Homo Sapiens
NSPKWSELL

SEQ ID NO: 1321690 - protein, 9 aa, Homo Sapiens
FIECRPVIP

SEQ ID NO: 1321691 - protein, 9 aa, Homo Sapiens
EGNNCELDV

SEQ ID NO: 1321692 - protein, 9 aa, Homo Sapiens
PSTCSLEHW

SEQ ID NO: 1321693 - protein, 9 aa, Homo Sapiens
TGARTSLST

SEQ ID NO: 1321694 - protein, 9 aa, Homo Sapiens
KATCHHPSY

SEQ ID NO: 1321695 - protein, 9 aa, Homo Sapiens
DALLQTAQT

SEQ ID NO: 1321696 - protein, 9 aa, Homo Sapiens
LIIDYSENC

SEQ ID NO: 1321697 - protein, 9 aa, Homo Sapiens
QLNKCPDEG

SEQ ID NO: 1321698 - protein, 9 aa, Homo Sapiens
KQGKYQDVE

SEQ ID NO: 1321699 - protein, 9 aa, Homo Sapiens
HAASSSDLS

SEQ ID NO: 1321700 - protein, 9 aa, Homo Sapiens
KAVDWCLFR

SEQ ID NO: 1321701 - protein, 9 aa, Homo Sapiens
KHHPLDERA

SEQ ID NO: 1321702 - protein, 9 aa, Homo Sapiens
RQYLPYFRT

SEQ ID NO: 1321703 - protein, 9 aa, Homo Sapiens
ADNCDETED

SEQ ID NO: 1321704 - protein, 9 aa, Homo Sapiens
SIRGFTMPK

SEQ ID NO: 1321705 - protein, 9 aa, Homo Sapiens
YISMAVVDG

SEQ ID NO: 1321706 - protein, 9 aa, Homo Sapiens
QDSCWQTSN

SEQ ID NO: 1321707 - protein, 9 aa, Homo Sapiens
LWDSNGKRL

SEQ ID NO: 1321708 - protein, 9 aa, Homo Sapiens
EDMLYVPLV

SEQ ID NO: 1321709 - protein, 9 aa, Homo Sapiens
VHCMHAIFT

SEQ ID NO: 1321710 - protein, 9 aa, Homo Sapiens
KEMKNLHKL

SEQ ID NO: 1321711 - protein, 9 aa, Homo Sapiens
ECKQCMLAR

SEQ ID NO: 1321712 - protein, 9 aa, Homo Sapiens
IAHKHNMCG

SEQ ID NO: 1321713 - protein, 9 aa, Homo Sapiens
KGPLDCSER

SEQ ID NO: 1321714 - protein, 9 aa, Homo Sapiens
VTVVGLFYG

SEQ ID NO: 1321715 - protein, 9 aa, Homo Sapiens
HTSLWPLEA

SEQ ID NO: 1321716 - protein, 9 aa, Homo Sapiens
LSGAPQDSI

SEQ ID NO: 1321717 - protein, 9 aa, Homo Sapiens
IGVKPLSCD

SEQ ID NO: 1321718 - protein, 9 aa, Homo Sapiens
QCFTARDDF

SEQ ID NO: 1321719 - protein, 9 aa, Homo Sapiens
AFRLCQKLT

SEQ ID NO: 1321720 - protein, 9 aa, Homo Sapiens
LLIEHQRVH

SEQ ID NO: 1321721 - protein, 9 aa, Homo Sapiens
YRLEHAWLT

SEQ ID NO: 1321722 - protein, 9 aa, Homo Sapiens
EHIQVGYYT

SEQ ID NO: 1321723 - protein, 9 aa, Homo Sapiens
CTCIVDGKK

SEQ ID NO: 1321724 - protein, 9 aa, Homo Sapiens
KGFKKAGVK

SEQ ID NO: 1321725 - protein, 9 aa, Homo Sapiens
ANREKQCLI

SEQ ID NO: 1321726 - protein, 9 aa, Homo Sapiens
VMTQVVKKV

SEQ ID NO: 1321727 - protein, 9 aa, Homo Sapiens
VAFQSGSLY

SEQ ID NO: 1321728 - protein, 9 aa, Homo Sapiens
RQEVFVHRC

SEQ ID NO: 1321729 - protein, 9 aa, Homo Sapiens
LQSSVQQRL

SEQ ID NO: 1321730 - protein, 9 aa, Homo Sapiens
FSSLSSVMK

SEQ ID NO: 1321731 - protein, 9 aa, Homo Sapiens
GQYGFVLED

SEQ ID NO: 1321732 - protein, 9 aa, Homo Sapiens
ILDLCHKPG

SEQ ID NO: 1321733 - protein, 9 aa, Homo Sapiens
ILFFPSALF

SEQ ID NO: 1321734 - protein, 9 aa, Homo Sapiens
RVKEKADTL

SEQ ID NO: 1321735 - protein, 9 aa, Homo Sapiens
IALDPSGWP

SEQ ID NO: 1321736 - protein, 9 aa, Homo Sapiens
TCIDDGDKT

SEQ ID NO: 1321737 - protein, 9 aa, Homo Sapiens
FMASGVKLT

SEQ ID NO: 1321738 - protein, 9 aa, Homo Sapiens
LQKKKNKEE

SEQ ID NO: 1321739 - protein, 9 aa, Homo Sapiens
WEGPVVHHH

SEQ ID NO: 1321740 - protein, 9 aa, Homo Sapiens
FTWNNSKLP

SEQ ID NO: 1321741 - protein, 9 aa, Homo Sapiens
NNIVIIWIV

SEQ ID NO: 1321742 - protein, 9 aa, Homo Sapiens
HRLIVVLAL

SEQ ID NO: 1321743 - protein, 9 aa, Homo Sapiens
CPEAATTMY

SEQ ID NO: 1321744 - protein, 9 aa, Homo Sapiens
HEMSALWFL

SEQ ID NO: 1321745 - protein, 9 aa, Homo Sapiens
MEQMVFLSR

SEQ ID NO: 1321746 - protein, 9 aa, Homo Sapiens
YIRVKLQLN

SEQ ID NO: 1321747 - protein, 9 aa, Homo Sapiens
GALLRGYLQ

SEQ ID NO: 1321748 - protein, 9 aa, Homo Sapiens
RLYRRSRAA

SEQ ID NO: 1321749 - protein, 9 aa, Homo Sapiens
IRDRENHTS

SEQ ID NO: 1321750 - protein, 9 aa, Homo Sapiens
SLVLNDIRN

SEQ ID NO: 1321751 - protein, 9 aa, Homo Sapiens
SVPLTQVMY

SEQ ID NO: 1321752 - protein, 9 aa, Homo Sapiens
HHCAKYVSD

SEQ ID NO: 1321753 - protein, 9 aa, Homo Sapiens
IIGRRKSYA

SEQ ID NO: 1321754 - protein, 9 aa, Homo Sapiens
NQVKEALMW

SEQ ID NO: 1321755 - protein, 9 aa, Homo Sapiens
VQVPVLHEE

SEQ ID NO: 1321756 - protein, 9 aa, Homo Sapiens
KTFGSGSNL

SEQ ID NO: 1321757 - protein, 9 aa, Homo Sapiens
SMATVAKLC

SEQ ID NO: 1321758 - protein, 9 aa, Homo Sapiens
LLMVTFSIK

SEQ ID NO: 1321759 - protein, 9 aa, Homo Sapiens
RVSSRRKGC

SEQ ID NO: 1321760 - protein, 9 aa, Homo Sapiens
LIFFYEWSI

SEQ ID NO: 1321761 - protein, 9 aa, Homo Sapiens
KTRATESQT

SEQ ID NO: 1321762 - protein, 9 aa, Homo Sapiens
RLSHRLHQS

SEQ ID NO: 1321763 - protein, 9 aa, Homo Sapiens
SAAESAGPP

SEQ ID NO: 1321764 - protein, 9 aa, Homo Sapiens
FSPHPLKFT

SEQ ID NO: 1321765 - protein, 9 aa, Homo Sapiens
YNRTRFYVY

SEQ ID NO: 1321766 - protein, 9 aa, Homo Sapiens
NEFVFNAEF

SEQ ID NO: 1321767 - protein, 9 aa, Homo Sapiens
PGSRHRPLP

SEQ ID NO: 1321768 - protein, 9 aa, Homo Sapiens
SLYFRLHLR

SEQ ID NO: 1321769 - protein, 9 aa, Homo Sapiens
EELNGSSPI

SEQ ID NO: 1321770 - protein, 9 aa, Homo Sapiens
EMPEILKTE

SEQ ID NO: 1321771 - protein, 9 aa, Homo Sapiens
KMPHGSVQL

SEQ ID NO: 1321772 - protein, 9 aa, Homo Sapiens
EVTLKACSP

SEQ ID NO: 1321773 - protein, 9 aa, Homo Sapiens
MGTLISELA

SEQ ID NO: 1321774 - protein, 9 aa, Homo Sapiens
KLQTTIEKL

SEQ ID NO: 1321775 - protein, 9 aa, Homo Sapiens
RRTRHYNVL

SEQ ID NO: 1321776 - protein, 9 aa, Homo Sapiens
AGWMQTCNT

SEQ ID NO: 1321777 - protein, 9 aa, Homo Sapiens
CNECGNVFY

SEQ ID NO: 1321778 - protein, 9 aa, Homo Sapiens
SEDGLTTPA

SEQ ID NO: 1321779 - protein, 9 aa, Homo Sapiens
DLNHKFNES

SEQ ID NO: 1321780 - protein, 9 aa, Homo Sapiens
SAHTTCLAA

SEQ ID NO: 1321781 - protein, 9 aa, Homo Sapiens
CTKAPKDPA

SEQ ID NO: 1321782 - protein, 9 aa, Homo Sapiens
LALKNNPPY

SEQ ID NO: 1321783 - protein, 9 aa, Homo Sapiens
SVSRETLKN

SEQ ID NO: 1321784 - protein, 9 aa, Homo Sapiens
DDDHNWKIT

SEQ ID NO: 1321785 - protein, 9 aa, Homo Sapiens
SNAQDQLSC

SEQ ID NO: 1321786 - protein, 9 aa, Homo Sapiens
APQTLLPAL

SEQ ID NO: 1321787 - protein, 9 aa, Homo Sapiens
IRTLFCSSD

SEQ ID NO: 1321788 - protein, 9 aa, Homo Sapiens
KQTITRWPG

SEQ ID NO: 1321789 - protein, 9 aa, Homo Sapiens
EHMVEARLA

SEQ ID NO: 1321790 - protein, 9 aa, Homo Sapiens
PQLMEKCTA

SEQ ID NO: 1321791 - protein, 9 aa, Homo Sapiens
YVFLSENFR

SEQ ID NO: 1321792 - protein, 9 aa, Homo Sapiens
EDEPHDTVP

SEQ ID NO: 1321793 - protein, 9 aa, Homo Sapiens
PFQMCLVLI

SEQ ID NO: 1321794 - protein, 9 aa, Homo Sapiens
RSGVMQARI

SEQ ID NO: 1321795 - protein, 9 aa, Homo Sapiens
EGATLARTQ

SEQ ID NO: 1321796 - protein, 9 aa, Homo Sapiens
EDENVTKDS

SEQ ID NO: 1321797 - protein, 9 aa, Homo Sapiens
GVGECSSIG

SEQ ID NO: 1321798 - protein, 9 aa, Homo Sapiens
LVSDFRQQL

SEQ ID NO: 1321799 - protein, 9 aa, Homo Sapiens
DNMDGLPAP

SEQ ID NO: 1321800 - protein, 9 aa, Homo Sapiens
LSRLLSCKH

SEQ ID NO: 1321801 - protein, 9 aa, Homo Sapiens
MTTNIWLKQ

SEQ ID NO: 1321802 - protein, 9 aa, Homo Sapiens
WLKSVMNQV

SEQ ID NO: 1321803 - protein, 9 aa, Homo Sapiens
FRRGCLRWM

SEQ ID NO: 1321804 - protein, 9 aa, Homo Sapiens
DWGKHCVDK

SEQ ID NO: 1321805 - protein, 9 aa, Homo Sapiens
ADWHYLVSW

SEQ ID NO: 1321806 - protein, 9 aa, Homo Sapiens
DDEEESGVK

SEQ ID NO: 1321807 - protein, 9 aa, Homo Sapiens
CGQRMPAVD

SEQ ID NO: 1321808 - protein, 9 aa, Homo Sapiens
QSKHHPLDE

SEQ ID NO: 1321809 - protein, 9 aa, Homo Sapiens
SMEMEVLQE

SEQ ID NO: 1321810 - protein, 9 aa, Homo Sapiens
TKNSVRFHI

SEQ ID NO: 1321811 - protein, 9 aa, Homo Sapiens
ENMLSTYPK

SEQ ID NO: 1321812 - protein, 9 aa, Homo Sapiens
HRPQPYPYP

SEQ ID NO: 1321813 - protein, 9 aa, Homo Sapiens
QEQELVKHA

SEQ ID NO: 1321814 - protein, 9 aa, Homo Sapiens
VGTPGPGPH

SEQ ID NO: 1321815 - protein, 9 aa, Homo Sapiens
GRLIDTVAQ

SEQ ID NO: 1321816 - protein, 9 aa, Homo Sapiens
EICSEVGLP

SEQ ID NO: 1321817 - protein, 9 aa, Homo Sapiens
APTAGRASA

SEQ ID NO: 1321818 - protein, 9 aa, Homo Sapiens
ENDTFMEVE

SEQ ID NO: 1321819 - protein, 9 aa, Homo Sapiens
QAVQYQFTD

SEQ ID NO: 1321820 - protein, 9 aa, Homo Sapiens
RFVWLELKS

SEQ ID NO: 1321821 - protein, 9 aa, Homo Sapiens
YHITFGPVV

SEQ ID NO: 1321822 - protein, 9 aa, Homo Sapiens
ILKRFFLLK

SEQ ID NO: 1321823 - protein, 9 aa, Homo Sapiens
KKKVLNKYG

SEQ ID NO: 1321824 - protein, 9 aa, Homo Sapiens
AILLCDGSE

SEQ ID NO: 1321825 - protein, 9 aa, Homo Sapiens
CTVAKELAH

SEQ ID NO: 1321826 - protein, 9 aa, Homo Sapiens
AISSPALSL

SEQ ID NO: 1321827 - protein, 9 aa, Homo Sapiens
HRGSPFLKR

SEQ ID NO: 1321828 - protein, 9 aa, Homo Sapiens
YLSEVGAYL

SEQ ID NO: 1321829 - protein, 9 aa, Homo Sapiens
EKELNMMKF

SEQ ID NO: 1321830 - protein, 9 aa, Homo Sapiens
EIIIVVNQE

SEQ ID NO: 1321831 - protein, 9 aa, Homo Sapiens
THSKLQRVF

SEQ ID NO: 1321832 - protein, 9 aa, Homo Sapiens
MALNPRTQT

SEQ ID NO: 1321833 - protein, 9 aa, Homo Sapiens
MAGHHRVMN

SEQ ID NO: 1321834 - protein, 9 aa, Homo Sapiens
VTTMSIESP

SEQ ID NO: 1321835 - protein, 9 aa, Homo Sapiens
DTNGGGWTV

SEQ ID NO: 1321836 - protein, 9 aa, Homo Sapiens
KKTKPEYPC

SEQ ID NO: 1321837 - protein, 9 aa, Homo Sapiens
VVHKYALAV

SEQ ID NO: 1321838 - protein, 9 aa, Homo Sapiens
ILDVVDSKR

SEQ ID NO: 1321839 - protein, 9 aa, Homo Sapiens
SGPMSEEPW

SEQ ID NO: 1321840 - protein, 9 aa, Homo Sapiens
SQIPELAKM

SEQ ID NO: 1321841 - protein, 9 aa, Homo Sapiens
FMGGIDRAD

SEQ ID NO: 1321842 - protein, 9 aa, Homo Sapiens
RGHYLTVAC

SEQ ID NO: 1321843 - protein, 9 aa, Homo Sapiens
SLPQLTSVL

SEQ ID NO: 1321844 - protein, 9 aa, Homo Sapiens
QGRITVQAQ

SEQ ID NO: 1321845 - protein, 9 aa, Homo Sapiens
TYCEFNARF

SEQ ID NO: 1321846 - protein, 9 aa, Homo Sapiens
KVFVRDTVN

SEQ ID NO: 1321847 - protein, 9 aa, Homo Sapiens
ENCRMFFIP

SEQ ID NO: 1321848 - protein, 9 aa, Homo Sapiens
MEWFTGIEH

SEQ ID NO: 1321849 - protein, 9 aa, Homo Sapiens
QCGKPFRMS

SEQ ID NO: 1321850 - protein, 9 aa, Homo Sapiens
PGDIDNQPL

SEQ ID NO: 1321851 - protein, 9 aa, Homo Sapiens
DTSNHGLAD

SEQ ID NO: 1321852 - protein, 9 aa, Homo Sapiens
VPTRFGNTD

SEQ ID NO: 1321853 - protein, 9 aa, Homo Sapiens
SVCFRNICK

SEQ ID NO: 1321854 - protein, 9 aa, Homo Sapiens
HVSESPVLS

SEQ ID NO: 1321855 - protein, 9 aa, Homo Sapiens
SKQIATDKQ

SEQ ID NO: 1321856 - protein, 9 aa, Homo Sapiens
HDPKAEEKS

SEQ ID NO: 1321857 - protein, 9 aa, Homo Sapiens
ERSQQRERE

SEQ ID NO: 1321858 - protein, 9 aa, Homo Sapiens
HFKLWRHPI

SEQ ID NO: 1321859 - protein, 9 aa, Homo Sapiens
FGIMCIYKG

SEQ ID NO: 1321860 - protein, 9 aa, Homo Sapiens
SCAASAGRR

SEQ ID NO: 1321861 - protein, 9 aa, Homo Sapiens
TPCGYVCSE

SEQ ID NO: 1321862 - protein, 9 aa, Homo Sapiens
FLKTYTQVG

SEQ ID NO: 1321863 - protein, 9 aa, Homo Sapiens
SLEKPNGAT

SEQ ID NO: 1321864 - protein, 9 aa, Homo Sapiens
PSLPGSRHR

SEQ ID NO: 1321865 - protein, 9 aa, Homo Sapiens
TIEENDQQV

SEQ ID NO: 1321866 - protein, 9 aa, Homo Sapiens
TTYDMNGRY

SEQ ID NO: 1321867 - protein, 9 aa, Homo Sapiens
TQALMSNSP

SEQ ID NO: 1321868 - protein, 9 aa, Homo Sapiens
PTDGEMSVQ

SEQ ID NO: 1321869 - protein, 9 aa, Homo Sapiens
HNEIMSRLM

SEQ ID NO: 1321870 - protein, 9 aa, Homo Sapiens
ERIADNFKV

SEQ ID NO: 1321871 - protein, 9 aa, Homo Sapiens
AYDHYAAVC

SEQ ID NO: 1321872 - protein, 9 aa, Homo Sapiens
NGTLGFFCV

SEQ ID NO: 1321873 - protein, 9 aa, Homo Sapiens
DQTLQVLSD

SEQ ID NO: 1321874 - protein, 9 aa, Homo Sapiens
HTLPVGGMA

SEQ ID NO: 1321875 - protein, 9 aa, Homo Sapiens
KKLKMKQSV

SEQ ID NO: 1321876 - protein, 9 aa, Homo Sapiens
IENWTTECK

SEQ ID NO: 1321877 - protein, 9 aa, Homo Sapiens
FVGRITQDL

SEQ ID NO: 1321878 - protein, 9 aa, Homo Sapiens
LCKPRCSLI

SEQ ID NO: 1321879 - protein, 9 aa, Homo Sapiens
RVPEGDPCW

SEQ ID NO: 1321880 - protein, 9 aa, Homo Sapiens
WKGTANARM

SEQ ID NO: 1321881 - protein, 9 aa, Homo Sapiens
INQLICQLN

SEQ ID NO: 1321882 - protein, 9 aa, Homo Sapiens
KLLGEQHYK

SEQ ID NO: 1321883 - protein, 9 aa, Homo Sapiens
SLFVSSRSA

SEQ ID NO: 1321884 - protein, 9 aa, Homo Sapiens
VFTLHLFGC

SEQ ID NO: 1321885 - protein, 9 aa, Homo Sapiens
QELVLMMIS

SEQ ID NO: 1321886 - protein, 9 aa, Homo Sapiens
HHPFIEWAR

SEQ ID NO: 1321887 - protein, 9 aa, Homo Sapiens
MLAVANTTF

SEQ ID NO: 1321888 - protein, 9 aa, Homo Sapiens
EIMHFSFFS

SEQ ID NO: 1321889 - protein, 9 aa, Homo Sapiens
VNIQSKDDK

SEQ ID NO: 1321890 - protein, 9 aa, Homo Sapiens
KQPKEDIPE

SEQ ID NO: 1321891 - protein, 9 aa, Homo Sapiens
KNKHKLRKM

SEQ ID NO: 1321892 - protein, 9 aa, Homo Sapiens
LDQDLLRDA

SEQ ID NO: 1321893 - protein, 9 aa, Homo Sapiens
TECVEHLSE

SEQ ID NO: 1321894 - protein, 9 aa, Homo Sapiens
DTLLVCCEV

SEQ ID NO: 1321895 - protein, 9 aa, Homo Sapiens
RPSAATRPS

SEQ ID NO: 1321896 - protein, 9 aa, Homo Sapiens
KCMDHIQHH

SEQ ID NO: 1321897 - protein, 9 aa, Homo Sapiens
EKKQDHTYC

SEQ ID NO: 1321898 - protein, 9 aa, Homo Sapiens
SPTRTRLAS

SEQ ID NO: 1321899 - protein, 9 aa, Homo Sapiens
WCCYVCCRR

SEQ ID NO: 1321900 - protein, 9 aa, Homo Sapiens
RQVSQKSSP

SEQ ID NO: 1321901 - protein, 9 aa, Homo Sapiens
DTAEMERCL

SEQ ID NO: 1321902 - protein, 9 aa, Homo Sapiens
GEGNMCKKF

SEQ ID NO: 1321903 - protein, 9 aa, Homo Sapiens
PGNSSDAGA

SEQ ID NO: 1321904 - protein, 9 aa, Homo Sapiens
AVCTGHHHI

SEQ ID NO: 1321905 - protein, 9 aa, Homo Sapiens
CILDQYSYH

SEQ ID NO: 1321906 - protein, 9 aa, Homo Sapiens
CEHLLLYLY

SEQ ID NO: 1321907 - protein, 9 aa, Homo Sapiens
CGKAFNQFL

SEQ ID NO: 1321908 - protein, 9 aa, Homo Sapiens
TTSRSGCKV

SEQ ID NO: 1321909 - protein, 9 aa, Homo Sapiens
DMWSLGVML

SEQ ID NO: 1321910 - protein, 9 aa, Homo Sapiens
ITEEVWDQL

SEQ ID NO: 1321911 - protein, 9 aa, Homo Sapiens
NNIKKNRYK

SEQ ID NO: 1321912 - protein, 9 aa, Homo Sapiens
QADTFHHLH

SEQ ID NO: 1321913 - protein, 9 aa, Homo Sapiens
SSSFLIDKI

SEQ ID NO: 1321914 - protein, 9 aa, Homo Sapiens
QQQQVAGGV

SEQ ID NO: 1321915 - protein, 9 aa, Homo Sapiens
SILSITVDG

SEQ ID NO: 1321916 - protein, 9 aa, Homo Sapiens
SVDLTPTAP

SEQ ID NO: 1321917 - protein, 9 aa, Homo Sapiens
LIVIFSLFM

SEQ ID NO: 1321918 - protein, 9 aa, Homo Sapiens
HTSSSTMYS

SEQ ID NO: 1321919 - protein, 9 aa, Homo Sapiens
SGHPINLTC

SEQ ID NO: 1321920 - protein, 9 aa, Homo Sapiens
DDMPADEYD

SEQ ID NO: 1321921 - protein, 9 aa, Homo Sapiens
TSALRSLHF

SEQ ID NO: 1321922 - protein, 9 aa, Homo Sapiens
VSDKNLRWR

SEQ ID NO: 1321923 - protein, 9 aa, Homo Sapiens
QTTTIPSCP

SEQ ID NO: 1321924 - protein, 9 aa, Homo Sapiens
VQHKQFLRL

SEQ ID NO: 1321925 - protein, 9 aa, Homo Sapiens
RSTCPRFLS

SEQ ID NO: 1321926 - protein, 9 aa, Homo Sapiens
HRHAAGEKC

SEQ ID NO: 1321927 - protein, 9 aa, Homo Sapiens
LRKLKMWYQ

SEQ ID NO: 1321928 - protein, 9 aa, Homo Sapiens
SAIFVKKEL

SEQ ID NO: 1321929 - protein, 9 aa, Homo Sapiens
REEMECIVT

SEQ ID NO: 1321930 - protein, 9 aa, Homo Sapiens
TTANNLLAA

SEQ ID NO: 1321931 - protein, 9 aa, Homo Sapiens
LRDPHHDLD

SEQ ID NO: 1321932 - protein, 9 aa, Homo Sapiens
LQFLCAWDF

SEQ ID NO: 1321933 - protein, 9 aa, Homo Sapiens
TPSGSSSDS

SEQ ID NO: 1321934 - protein, 9 aa, Homo Sapiens
EMMTGRSPF

SEQ ID NO: 1321935 - protein, 9 aa, Homo Sapiens
CCYVCCRRC

SEQ ID NO: 1321936 - protein, 9 aa, Homo Sapiens
EDISGITSC

SEQ ID NO: 1321937 - protein, 9 aa, Homo Sapiens
FNLMNKFLT

SEQ ID NO: 1321938 - protein, 9 aa, Homo Sapiens
IVAKSWTDV

SEQ ID NO: 1321939 - protein, 9 aa, Homo Sapiens
RHRSRSRTP

SEQ ID NO: 1321940 - protein, 9 aa, Homo Sapiens
EVDSFIVTF

SEQ ID NO: 1321941 - protein, 9 aa, Homo Sapiens
LMNNFQVMI

SEQ ID NO: 1321942 - protein, 9 aa, Homo Sapiens
LSGGQDLTI

SEQ ID NO: 1321943 - protein, 9 aa, Homo Sapiens
KLTIVMLIV

SEQ ID NO: 1321944 - protein, 9 aa, Homo Sapiens
ENSTYEQLL

SEQ ID NO: 1321945 - protein, 9 aa, Homo Sapiens
KDTLQVSKR

SEQ ID NO: 1321946 - protein, 9 aa, Homo Sapiens
GNVSFLSDS

SEQ ID NO: 1321947 - protein, 9 aa, Homo Sapiens
HTEEDISGL

SEQ ID NO: 1321948 - protein, 9 aa, Homo Sapiens
ANRWGSDSE

SEQ ID NO: 1321949 - protein, 9 aa, Homo Sapiens
APTGFPCSR

SEQ ID NO: 1321950 - protein, 9 aa, Homo Sapiens
ATCLSGAQV

SEQ ID NO: 1321951 - protein, 9 aa, Homo Sapiens
TQLNEATCN

SEQ ID NO: 1321952 - protein, 9 aa, Homo Sapiens
TASRPTTRS

SEQ ID NO: 1321953 - protein, 9 aa, Homo Sapiens
PGDPGFPGI

SEQ ID NO: 1321954 - protein, 9 aa, Homo Sapiens
NMAILFHIL

SEQ ID NO: 1321955 - protein, 9 aa, Homo Sapiens
EWLTSLYKG

SEQ ID NO: 1321956 - protein, 9 aa, Homo Sapiens
KLKMKQSVN

SEQ ID NO: 1321957 - protein, 9 aa, Homo Sapiens
REAIAADPR

SEQ ID NO: 1321958 - protein, 9 aa, Homo Sapiens
YVIRGEFSQ

SEQ ID NO: 1321959 - protein, 9 aa, Homo Sapiens
DKAQCYADF

SEQ ID NO: 1321960 - protein, 9 aa, Homo Sapiens
CIENMEDKA

SEQ ID NO: 1321961 - protein, 9 aa, Homo Sapiens
YTIMCWFRR

SEQ ID NO: 1321962 - protein, 9 aa, Homo Sapiens
IEHLTREVE

SEQ ID NO: 1321963 - protein, 9 aa, Homo Sapiens
AAINASYVV

SEQ ID NO: 1321964 - protein, 9 aa, Homo Sapiens
SSNCVHKVA

SEQ ID NO: 1321965 - protein, 9 aa, Homo Sapiens
HYVLSWCVT

SEQ ID NO: 1321966 - protein, 9 aa, Homo Sapiens
YCDRAFKSS

SEQ ID NO: 1321967 - protein, 9 aa, Homo Sapiens
YEMLTSLTQ

SEQ ID NO: 1321968 - protein, 9 aa, Homo Sapiens
ANSNERRHM

SEQ ID NO: 1321969 - protein, 9 aa, Homo Sapiens
CTEASRDPA

SEQ ID NO: 1321970 - protein, 9 aa, Homo Sapiens
QSASTSVPK

SEQ ID NO: 1321971 - protein, 9 aa, Homo Sapiens
LFSAVGHVL

SEQ ID NO: 1321972 - protein, 9 aa, Homo Sapiens
WDRTYLAAL

SEQ ID NO: 1321973 - protein, 9 aa, Homo Sapiens
ARSPSSAAS

SEQ ID NO: 1321974 - protein, 9 aa, Homo Sapiens
KQMMTKEDD

SEQ ID NO: 1321975 - protein, 9 aa, Homo Sapiens
QGVPQAQRP

SEQ ID NO: 1321976 - protein, 9 aa, Homo Sapiens
RPWVLLPKL

SEQ ID NO: 1321977 - protein, 9 aa, Homo Sapiens
AKSWTDVVK

SEQ ID NO: 1321978 - protein, 9 aa, Homo Sapiens
SLVRRSYQR

SEQ ID NO: 1321979 - protein, 9 aa, Homo Sapiens
TYYRNSVGG

SEQ ID NO: 1321980 - protein, 9 aa, Homo Sapiens
SQDERMWSP

SEQ ID NO: 1321981 - protein, 9 aa, Homo Sapiens
GGRGASPEE

SEQ ID NO: 1321982 - protein, 9 aa, Homo Sapiens
KDIPSTLKF

SEQ ID NO: 1321983 - protein, 9 aa, Homo Sapiens
VLRHQQFQF

SEQ ID NO: 1321984 - protein, 9 aa, Homo Sapiens
SSLGKEKRT

SEQ ID NO: 1321985 - protein, 9 aa, Homo Sapiens
PVSQTQHTS

SEQ ID NO: 1321986 - protein, 9 aa, Homo Sapiens
LKSHQFPCH

SEQ ID NO: 1321987 - protein, 9 aa, Homo Sapiens
NTYLQMSPT

SEQ ID NO: 1321988 - protein, 9 aa, Homo Sapiens
RPYPMIDAE

SEQ ID NO: 1321989 - protein, 9 aa, Homo Sapiens
MLPKSALVT

SEQ ID NO: 1321990 - protein, 9 aa, Homo Sapiens
CSVSNSEQA

SEQ ID NO: 1321991 - protein, 9 aa, Homo Sapiens
DEKNRFSLA

SEQ ID NO: 1321992 - protein, 9 aa, Homo Sapiens
NYGQEWTYE

SEQ ID NO: 1321993 - protein, 9 aa, Homo Sapiens
PLSGAPQDS

SEQ ID NO: 1321994 - protein, 9 aa, Homo Sapiens
DHTWVPPFP

SEQ ID NO: 1321995 - protein, 9 aa, Homo Sapiens
SSGINETTF

SEQ ID NO: 1321996 - protein, 9 aa, Homo Sapiens
KDLLSQMYH

SEQ ID NO: 1321997 - protein, 9 aa, Homo Sapiens
FSFDYSYWL

SEQ ID NO: 1321998 - protein, 9 aa, Homo Sapiens
MAGWPETPL

SEQ ID NO: 1321999 - protein, 9 aa, Homo Sapiens
MDIEWLLTD

SEQ ID NO: 1322000 - protein, 9 aa, Homo Sapiens
RKYDLKEPT

SEQ ID NO: 1322001 - protein, 9 aa, Homo Sapiens
GERLQKGLD

SEQ ID NO: 1322002 - protein, 9 aa, Homo Sapiens
NLTSSLMSV

SEQ ID NO: 1322003 - protein, 9 aa, Homo Sapiens
LEHDLQVFD

SEQ ID NO: 1322004 - protein, 9 aa, Homo Sapiens
SPLCDHTST

SEQ ID NO: 1322005 - protein, 9 aa, Homo Sapiens
PVAQPPAVA

SEQ ID NO: 1322006 - protein, 9 aa, Homo Sapiens
YCGQSVCEN

SEQ ID NO: 1322007 - protein, 9 aa, Homo Sapiens
LLFVFEYVG

SEQ ID NO: 1322008 - protein, 9 aa, Homo Sapiens
AHTLTAVCN

SEQ ID NO: 1322009 - protein, 9 aa, Homo Sapiens
GSSKINAAK

SEQ ID NO: 1322010 - protein, 9 aa, Homo Sapiens
LCIAVCIPM

SEQ ID NO: 1322011 - protein, 9 aa, Homo Sapiens
HVIFLTRQD

SEQ ID NO: 1322012 - protein, 9 aa, Homo Sapiens
YGAFLYKGS

SEQ ID NO: 1322013 - protein, 9 aa, Homo Sapiens
EIVSTVHAD

SEQ ID NO: 1322014 - protein, 9 aa, Homo Sapiens
DGTLAAYPQ

SEQ ID NO: 1322015 - protein, 9 aa, Homo Sapiens
AISEQIISS

SEQ ID NO: 1322016 - protein, 9 aa, Homo Sapiens
FLLTATLKL

SEQ ID NO: 1322017 - protein, 9 aa, Homo Sapiens
AFYTGLSHV

SEQ ID NO: 1322018 - protein, 9 aa, Homo Sapiens
HKSLVKEGG

SEQ ID NO: 1322019 - protein, 9 aa, Homo Sapiens
LAKEHIKEM

SEQ ID NO: 1322020 - protein, 9 aa, Homo Sapiens
RRISVVSVA

SEQ ID NO: 1322021 - protein, 9 aa, Homo Sapiens
QPTAAPAST

SEQ ID NO: 1322022 - protein, 9 aa, Homo Sapiens
GVSEAPGGQ

SEQ ID NO: 1322023 - protein, 9 aa, Homo Sapiens
KDSDMDYIQ

SEQ ID NO: 1322024 - protein, 9 aa, Homo Sapiens
SSRSSSRIR

SEQ ID NO: 1322025 - protein, 9 aa, Homo Sapiens
RFTGLVLDS

SEQ ID NO: 1322026 - protein, 9 aa, Homo Sapiens
LVEYVVVQV

SEQ ID NO: 1322027 - protein, 9 aa, Homo Sapiens
HLSMAAADI

SEQ ID NO: 1322028 - protein, 9 aa, Homo Sapiens
FYYGTCVLL

SEQ ID NO: 1322029 - protein, 9 aa, Homo Sapiens
PMPTKDLHQ

SEQ ID NO: 1322030 - protein, 9 aa, Homo Sapiens
VQQKGQHFG

SEQ ID NO: 1322031 - protein, 9 aa, Homo Sapiens
FKKIPLNPS

SEQ ID NO: 1322032 - protein, 9 aa, Homo Sapiens
MFGHLPYKG

SEQ ID NO: 1322033 - protein, 9 aa, Homo Sapiens
HEIVCPKKI

SEQ ID NO: 1322034 - protein, 9 aa, Homo Sapiens
QSGCPPWLH

SEQ ID NO: 1322035 - protein, 9 aa, Homo Sapiens
SISKPDVIM

SEQ ID NO: 1322036 - protein, 9 aa, Homo Sapiens
MTAVKKKSL

SEQ ID NO: 1322037 - protein, 9 aa, Homo Sapiens
FSMCPDLCA

SEQ ID NO: 1322038 - protein, 9 aa, Homo Sapiens
EYTYLKGTV

SEQ ID NO: 1322039 - protein, 9 aa, Homo Sapiens
HREFQLDLD

SEQ ID NO: 1322040 - protein, 9 aa, Homo Sapiens
SAPEPVVGI

SEQ ID NO: 1322041 - protein, 9 aa, Homo Sapiens
VLAHLTPLF

SEQ ID NO: 1322042 - protein, 9 aa, Homo Sapiens
ESVMFHLFD

SEQ ID NO: 1322043 - protein, 9 aa, Homo Sapiens
ENAVPSSRF

SEQ ID NO: 1322044 - protein, 9 aa, Homo Sapiens
HWGVFSGRT

SEQ ID NO: 1322045 - protein, 9 aa, Homo Sapiens
YFVSYDIRC

SEQ ID NO: 1322046 - protein, 9 aa, Homo Sapiens
KCRLQELCS

SEQ ID NO: 1322047 - protein, 9 aa, Homo Sapiens
VFFFIFIFF

SEQ ID NO: 1322048 - protein, 9 aa, Homo Sapiens
SMLGTMFGG

SEQ ID NO: 1322049 - protein, 9 aa, Homo Sapiens
HTCQALAAR

SEQ ID NO: 1322050 - protein, 9 aa, Homo Sapiens
KAFTNTATV

SEQ ID NO: 1322051 - protein, 9 aa, Homo Sapiens
MEEMLTCII

SEQ ID NO: 1322052 - protein, 9 aa, Homo Sapiens
VATGVVGPG

SEQ ID NO: 1322053 - protein, 9 aa, Homo Sapiens
SGAEGDMSS

SEQ ID NO: 1322054 - protein, 9 aa, Homo Sapiens
MCVNTLFLC

SEQ ID NO: 1322055 - protein, 9 aa, Homo Sapiens
QGFTVDKAF

SEQ ID NO: 1322056 - protein, 9 aa, Homo Sapiens
PDLRVQYLH

SEQ ID NO: 1322057 - protein, 9 aa, Homo Sapiens
CAEGPKGKK

SEQ ID NO: 1322058 - protein, 9 aa, Homo Sapiens
KKKCQRRIL

SEQ ID NO: 1322059 - protein, 9 aa, Homo Sapiens
MSWFSDLLV

SEQ ID NO: 1322060 - protein, 9 aa, Homo Sapiens
GCYSCFASN

SEQ ID NO: 1322061 - protein, 9 aa, Homo Sapiens
DASFLQSED

SEQ ID NO: 1322062 - protein, 9 aa, Homo Sapiens
THILTLQEE

SEQ ID NO: 1322063 - protein, 9 aa, Homo Sapiens
RDYDQYYER

SEQ ID NO: 1322064 - protein, 9 aa, Homo Sapiens
HRSGGREWG

SEQ ID NO: 1322065 - protein, 9 aa, Homo Sapiens
TMILVVFKS

SEQ ID NO: 1322066 - protein, 9 aa, Homo Sapiens
LNLGEGTIA

SEQ ID NO: 1322067 - protein, 9 aa, Homo Sapiens
MPFGFGMRQ

SEQ ID NO: 1322068 - protein, 9 aa, Homo Sapiens
KNGILDECL

SEQ ID NO: 1322069 - protein, 9 aa, Homo Sapiens
PFVFLILCL

SEQ ID NO: 1322070 - protein, 9 aa, Homo Sapiens
PQPYPAQWP

SEQ ID NO: 1322071 - protein, 9 aa, Homo Sapiens
PISPSRRVQ

SEQ ID NO: 1322072 - protein, 9 aa, Homo Sapiens
REFHKSLVK

SEQ ID NO: 1322073 - protein, 9 aa, Homo Sapiens
YCTSKVSAF

SEQ ID NO: 1322074 - protein, 9 aa, Homo Sapiens
TTGSLCVSE

SEQ ID NO: 1322075 - protein, 9 aa, Homo Sapiens
AREQRKRRK

SEQ ID NO: 1322076 - protein, 9 aa, Homo Sapiens
GEAVRHPIF

SEQ ID NO: 1322077 - protein, 9 aa, Homo Sapiens
KMDGNWRWG

SEQ ID NO: 1322078 - protein, 9 aa, Homo Sapiens
ALVGSHLSH

SEQ ID NO: 1322079 - protein, 9 aa, Homo Sapiens
IMEEKPLKV

SEQ ID NO: 1322080 - protein, 9 aa, Homo Sapiens
IRNPYLVTK

SEQ ID NO: 1322081 - protein, 9 aa, Homo Sapiens
VRLIRNLNV

SEQ ID NO: 1322082 - protein, 9 aa, Homo Sapiens
CPIAFTARS

SEQ ID NO: 1322083 - protein, 9 aa, Homo Sapiens
LSVLGHSNC

SEQ ID NO: 1322084 - protein, 9 aa, Homo Sapiens
HALGELLRR

SEQ ID NO: 1322085 - protein, 9 aa, Homo Sapiens
ILVFYSQET

SEQ ID NO: 1322086 - protein, 9 aa, Homo Sapiens
VLRGPMDSN

SEQ ID NO: 1322087 - protein, 9 aa, Homo Sapiens
LYEWECKQC

SEQ ID NO: 1322088 - protein, 9 aa, Homo Sapiens
LISAFASEP

SEQ ID NO: 1322089 - protein, 9 aa, Homo Sapiens
DNVKSVPPQ

SEQ ID NO: 1322090 - protein, 9 aa, Homo Sapiens
MCGGVQCEN

SEQ ID NO: 1322091 - protein, 9 aa, Homo Sapiens
ESLQIFPRA

SEQ ID NO: 1322092 - protein, 9 aa, Homo Sapiens
VYHRGHYFK

SEQ ID NO: 1322093 - protein, 9 aa, Homo Sapiens
HWQVVDTPG

SEQ ID NO: 1322094 - protein, 9 aa, Homo Sapiens
TPKCMVHSA

SEQ ID NO: 1322095 - protein, 9 aa, Homo Sapiens
LVDSKTYAD

SEQ ID NO: 1322096 - protein, 9 aa, Homo Sapiens
IPNYGAIPY

SEQ ID NO: 1322097 - protein, 9 aa, Homo Sapiens
VVITRNRDD

SEQ ID NO: 1322098 - protein, 9 aa, Homo Sapiens
KDKSSVNWM

SEQ ID NO: 1322099 - protein, 9 aa, Homo Sapiens
NCHTKIHHV

SEQ ID NO: 1322100 - protein, 9 aa, Homo Sapiens
ISLRNLVGR

SEQ ID NO: 1322101 - protein, 9 aa, Homo Sapiens
DVALVVEAN

SEQ ID NO: 1322102 - protein, 9 aa, Homo Sapiens
RTLVLYLVM

SEQ ID NO: 1322103 - protein, 9 aa, Homo Sapiens
TEMKSDNVK

SEQ ID NO: 1322104 - protein, 9 aa, Homo Sapiens
AGGVTCGWD

SEQ ID NO: 1322105 - protein, 9 aa, Homo Sapiens
NLLQAVFFI

SEQ ID NO: 1322106 - protein, 9 aa, Homo Sapiens
QHMDMKPLV

SEQ ID NO: 1322107 - protein, 9 aa, Homo Sapiens
SSPSNYVCR

SEQ ID NO: 1322108 - protein, 9 aa, Homo Sapiens
EICISRNFL

SEQ ID NO: 1322109 - protein, 9 aa, Homo Sapiens
ENSFPDWEW

SEQ ID NO: 1322110 - protein, 9 aa, Homo Sapiens
TQLDLCRFR

SEQ ID NO: 1322111 - protein, 9 aa, Homo Sapiens
EEVDRTSSK

SEQ ID NO: 1322112 - protein, 9 aa, Homo Sapiens
RVVAIFVQG

SEQ ID NO: 1322113 - protein, 9 aa, Homo Sapiens
LDSYLLKSV

SEQ ID NO: 1322114 - protein, 9 aa, Homo Sapiens
GVKLTLVSR

SEQ ID NO: 1322115 - protein, 9 aa, Homo Sapiens
HRAVKMVTC

SEQ ID NO: 1322116 - protein, 9 aa, Homo Sapiens
TYVRYWDLH

SEQ ID NO: 1322117 - protein, 9 aa, Homo Sapiens
REDWAPKSH

SEQ ID NO: 1322118 - protein, 9 aa, Homo Sapiens
RYKGHRPES

SEQ ID NO: 1322119 - protein, 9 aa, Homo Sapiens
SQMSTVSGP

SEQ ID NO: 1322120 - protein, 9 aa, Homo Sapiens
KVVIDAEYR

SEQ ID NO: 1322121 - protein, 9 aa, Homo Sapiens
CLHNETYSA

SEQ ID NO: 1322122 - protein, 9 aa, Homo Sapiens
PREDWAPKS

SEQ ID NO: 1322123 - protein, 9 aa, Homo Sapiens
DRLPKKQQV

SEQ ID NO: 1322124 - protein, 9 aa, Homo Sapiens
RISHLNGLS

SEQ ID NO: 1322125 - protein, 9 aa, Homo Sapiens
KWREEAALV

SEQ ID NO: 1322126 - protein, 9 aa, Homo Sapiens
WTLCYTPLI

SEQ ID NO: 1322127 - protein, 9 aa, Homo Sapiens
GMRTVEGGD

SEQ ID NO: 1322128 - protein, 9 aa, Homo Sapiens
DFTEECLAK

SEQ ID NO: 1322129 - protein, 9 aa, Homo Sapiens
LSDTHWCWV

SEQ ID NO: 1322130 - protein, 9 aa, Homo Sapiens
MFVLCTRTV

SEQ ID NO: 1322131 - protein, 9 aa, Homo Sapiens
YHDSIEKAA

SEQ ID NO: 1322132 - protein, 9 aa, Homo Sapiens
VCGAEPRSC

SEQ ID NO: 1322133 - protein, 9 aa, Homo Sapiens
SLGDGLESI

SEQ ID NO: 1322134 - protein, 9 aa, Homo Sapiens
KMHSWSKLC

SEQ ID NO: 1322135 - protein, 9 aa, Homo Sapiens
YWMNVITGT

SEQ ID NO: 1322136 - protein, 9 aa, Homo Sapiens
SDLAHLHME

SEQ ID NO: 1322137 - protein, 9 aa, Homo Sapiens
PDVTMKSLP

SEQ ID NO: 1322138 - protein, 9 aa, Homo Sapiens
LGLTRMYFQ

SEQ ID NO: 1322139 - protein, 9 aa, Homo Sapiens
TGSSGAMGP

SEQ ID NO: 1322140 - protein, 9 aa, Homo Sapiens
SIPPGLYHT

SEQ ID NO: 1322141 - protein, 9 aa, Homo Sapiens
CLRLPNLKM

SEQ ID NO: 1322142 - protein, 9 aa, Homo Sapiens
MAIGTHSGR

SEQ ID NO: 1322143 - protein, 9 aa, Homo Sapiens
KKKGEDLFP

SEQ ID NO: 1322144 - protein, 9 aa, Homo Sapiens
AMAAVIHYL

SEQ ID NO: 1322145 - protein, 9 aa, Homo Sapiens
EAFNILQKS

SEQ ID NO: 1322146 - protein, 9 aa, Homo Sapiens
EAFSDSLRW

SEQ ID NO: 1322147 - protein, 9 aa, Homo Sapiens
TQGLIEHLK

SEQ ID NO: 1322148 - protein, 9 aa, Homo Sapiens
YYTAAPLPG

SEQ ID NO: 1322149 - protein, 9 aa, Homo Sapiens
PLGLQETIT

SEQ ID NO: 1322150 - protein, 9 aa, Homo Sapiens
LPPKKCSIL

SEQ ID NO: 1322151 - protein, 9 aa, Homo Sapiens
TLLIDYQLT

SEQ ID NO: 1322152 - protein, 9 aa, Homo Sapiens
NRVDFANDQ

SEQ ID NO: 1322153 - protein, 9 aa, Homo Sapiens
LLLAAEHIQ

SEQ ID NO: 1322154 - protein, 9 aa, Homo Sapiens
VQEYIEKSF

SEQ ID NO: 1322155 - protein, 9 aa, Homo Sapiens
TYDMNGRYS

SEQ ID NO: 1322156 - protein, 9 aa, Homo Sapiens
SEKKQGPCM

SEQ ID NO: 1322157 - protein, 9 aa, Homo Sapiens
LPPPFPAHV

SEQ ID NO: 1322158 - protein, 9 aa, Homo Sapiens
SWVTNDTFD

SEQ ID NO: 1322159 - protein, 9 aa, Homo Sapiens
IQFQEGFAS

SEQ ID NO: 1322160 - protein, 9 aa, Homo Sapiens
KGKGGKNRH

SEQ ID NO: 1322161 - protein, 9 aa, Homo Sapiens
SSDDLVNVF

SEQ ID NO: 1322162 - protein, 9 aa, Homo Sapiens
RTVRTRLFS

SEQ ID NO: 1322163 - protein, 9 aa, Homo Sapiens
KPILALCVI

SEQ ID NO: 1322164 - protein, 9 aa, Homo Sapiens
KSVRLRLSS

SEQ ID NO: 1322165 - protein, 9 aa, Homo Sapiens
IQYLVWLGP

SEQ ID NO: 1322166 - protein, 9 aa, Homo Sapiens
VSSSRTVHE

SEQ ID NO: 1322167 - protein, 9 aa, Homo Sapiens
KLKYGWKKE

SEQ ID NO: 1322168 - protein, 9 aa, Homo Sapiens
LTPLHNFLE

SEQ ID NO: 1322169 - protein, 9 aa, Homo Sapiens
PPGSCKKAP

SEQ ID NO: 1322170 - protein, 9 aa, Homo Sapiens
SEVDTDIHT

SEQ ID NO: 1322171 - protein, 9 aa, Homo Sapiens
YAYFVMTHQ

SEQ ID NO: 1322172 - protein, 9 aa, Homo Sapiens
WEERDIMTF

SEQ ID NO: 1322173 - protein, 9 aa, Homo Sapiens
LHKLTVNGF

SEQ ID NO: 1322174 - protein, 9 aa, Homo Sapiens
NTGTQQGRA

SEQ ID NO: 1322175 - protein, 9 aa, Homo Sapiens
SECILPALS

SEQ ID NO: 1322176 - protein, 9 aa, Homo Sapiens
NQMRREGIH

SEQ ID NO: 1322177 - protein, 9 aa, Homo Sapiens
ASYSTVTRF

SEQ ID NO: 1322178 - protein, 9 aa, Homo Sapiens
HVYIVWNLP

SEQ ID NO: 1322179 - protein, 9 aa, Homo Sapiens
DFLSERCMV

SEQ ID NO: 1322180 - protein, 9 aa, Homo Sapiens
RHRPSLYII

SEQ ID NO: 1322181 - protein, 9 aa, Homo Sapiens
CRAFRCSRW

SEQ ID NO: 1322182 - protein, 9 aa, Homo Sapiens
SEKQRWLLY

SEQ ID NO: 1322183 - protein, 9 aa, Homo Sapiens
SRLRQHSVN

SEQ ID NO: 1322184 - protein, 9 aa, Homo Sapiens
VIYRLYHSC

SEQ ID NO: 1322185 - protein, 9 aa, Homo Sapiens
KLLISLSSV

SEQ ID NO: 1322186 - protein, 9 aa, Homo Sapiens
SHAFVGSVK

SEQ ID NO: 1322187 - protein, 9 aa, Homo Sapiens
KPVMVKRKW

SEQ ID NO: 1322188 - protein, 9 aa, Homo Sapiens
QSSNCVHKV

SEQ ID NO: 1322189 - protein, 9 aa, Homo Sapiens
HRILPKEQW

SEQ ID NO: 1322190 - protein, 9 aa, Homo Sapiens
HKNLGLVMS

SEQ ID NO: 1322191 - protein, 9 aa, Homo Sapiens
FFSIPAHKA

SEQ ID NO: 1322192 - protein, 9 aa, Homo Sapiens
SSKMTTFFT

SEQ ID NO: 1322193 - protein, 9 aa, Homo Sapiens
GQHMFEDLF

SEQ ID NO: 1322194 - protein, 9 aa, Homo Sapiens
PPHWLEVWR

SEQ ID NO: 1322195 - protein, 9 aa, Homo Sapiens
FDQISFMKG

SEQ ID NO: 1322196 - protein, 9 aa, Homo Sapiens
NRNHLTQIM

SEQ ID NO: 1322197 - protein, 9 aa, Homo Sapiens
TTHFETPCD

SEQ ID NO: 1322198 - protein, 9 aa, Homo Sapiens
PYPAEAKSM

SEQ ID NO: 1322199 - protein, 9 aa, Homo Sapiens
AKFLLDNVR

SEQ ID NO: 1322200 - protein, 9 aa, Homo Sapiens
VFDSIVNKD

SEQ ID NO: 1322201 - protein, 9 aa, Homo Sapiens
IMVYKIFHI

SEQ ID NO: 1322202 - protein, 9 aa, Homo Sapiens
RGEHKNQDP

SEQ ID NO: 1322203 - protein, 9 aa, Homo Sapiens
YAGWMQTCN

SEQ ID NO: 1322204 - protein, 9 aa, Homo Sapiens
HIPPHTFLF

SEQ ID NO: 1322205 - protein, 9 aa, Homo Sapiens
IFVHRYCDA

SEQ ID NO: 1322206 - protein, 9 aa, Homo Sapiens
SIEVADPKY

SEQ ID NO: 1322207 - protein, 9 aa, Homo Sapiens
CDKRCNKKQ

SEQ ID NO: 1322208 - protein, 9 aa, Homo Sapiens
ICWPGTKKT

SEQ ID NO: 1322209 - protein, 9 aa, Homo Sapiens
FYAKNEWLL

SEQ ID NO: 1322210 - protein, 9 aa, Homo Sapiens
IDVIFCDKT

SEQ ID NO: 1322211 - protein, 9 aa, Homo Sapiens
SSLNDERIQ

SEQ ID NO: 1322212 - protein, 9 aa, Homo Sapiens
LRKAVNAEF

SEQ ID NO: 1322213 - protein, 9 aa, Homo Sapiens
EWRDRHITL

SEQ ID NO: 1322214 - protein, 9 aa, Homo Sapiens
LRMREREPD

SEQ ID NO: 1322215 - protein, 9 aa, Homo Sapiens
DTVSIESGT

SEQ ID NO: 1322216 - protein, 9 aa, Homo Sapiens
NVLTNWLTD

SEQ ID NO: 1322217 - protein, 9 aa, Homo Sapiens
AYDRYVVIC

SEQ ID NO: 1322218 - protein, 9 aa, Homo Sapiens
LLDNVRIVS

SEQ ID NO: 1322219 - protein, 9 aa, Homo Sapiens
TASLIFNQS

SEQ ID NO: 1322220 - protein, 9 aa, Homo Sapiens
NPELFQCVG

SEQ ID NO: 1322221 - protein, 9 aa, Homo Sapiens
GWMEAMQDE

SEQ ID NO: 1322222 - protein, 9 aa, Homo Sapiens
VKHADVAGT

SEQ ID NO: 1322223 - protein, 9 aa, Homo Sapiens
TDEMKCMFN

SEQ ID NO: 1322224 - protein, 9 aa, Homo Sapiens
GLSHVSDHK

SEQ ID NO: 1322225 - protein, 9 aa, Homo Sapiens
GNALIQRLE

SEQ ID NO: 1322226 - protein, 9 aa, Homo Sapiens
MTQPKDGGF

SEQ ID NO: 1322227 - protein, 9 aa, Homo Sapiens
TNHTFMLAK

SEQ ID NO: 1322228 - protein, 9 aa, Homo Sapiens
DFITLCLPP

SEQ ID NO: 1322229 - protein, 9 aa, Homo Sapiens
VGIPDNKLD

SEQ ID NO: 1322230 - protein, 9 aa, Homo Sapiens
VFEYVGKKY

SEQ ID NO: 1322231 - protein, 9 aa, Homo Sapiens
SLHIVERES

SEQ ID NO: 1322232 - protein, 9 aa, Homo Sapiens
TPDMAFEVI

SEQ ID NO: 1322233 - protein, 9 aa, Homo Sapiens
YQWIDRIHT

SEQ ID NO: 1322234 - protein, 9 aa, Homo Sapiens
KKVVSKSKV

SEQ ID NO: 1322235 - protein, 9 aa, Homo Sapiens
GQKQRMSLA

SEQ ID NO: 1322236 - protein, 9 aa, Homo Sapiens
CGHAWNTHH

SEQ ID NO: 1322237 - protein, 9 aa, Homo Sapiens
ACTQDGPFY

SEQ ID NO: 1322238 - protein, 9 aa, Homo Sapiens
RPGSGQHDL

SEQ ID NO: 1322239 - protein, 9 aa, Homo Sapiens
LDNNCSALS

SEQ ID NO: 1322240 - protein, 9 aa, Homo Sapiens
QDTPQYNLM

SEQ ID NO: 1322241 - protein, 9 aa, Homo Sapiens
AWDFNIDKA

SEQ ID NO: 1322242 - protein, 9 aa, Homo Sapiens
FFPSCTYIL

SEQ ID NO: 1322243 - protein, 9 aa, Homo Sapiens
TYVLYMACQ

SEQ ID NO: 1322244 - protein, 9 aa, Homo Sapiens
VNKRRFFPG

SEQ ID NO: 1322245 - protein, 9 aa, Homo Sapiens
ATPLVNKHH

SEQ ID NO: 1322246 - protein, 9 aa, Homo Sapiens
LTDTVPLPG

SEQ ID NO: 1322247 - protein, 9 aa, Homo Sapiens
LVSIPFLQT

SEQ ID NO: 1322248 - protein, 9 aa, Homo Sapiens
CWSCHHDKA

SEQ ID NO: 1322249 - protein, 9 aa, Homo Sapiens
SPPSPSRRR

SEQ ID NO: 1322250 - protein, 9 aa, Homo Sapiens
DTSLKRHLT

SEQ ID NO: 1322251 - protein, 9 aa, Homo Sapiens
SSSTIVSTQ

SEQ ID NO: 1322252 - protein, 9 aa, Homo Sapiens
QQGSYTSIN

SEQ ID NO: 1322253 - protein, 9 aa, Homo Sapiens
VSSKSDEGR

SEQ ID NO: 1322254 - protein, 9 aa, Homo Sapiens
QGHRLDNLS

SEQ ID NO: 1322255 - protein, 9 aa, Homo Sapiens
MPVDMGSLV

SEQ ID NO: 1322256 - protein, 9 aa, Homo Sapiens
LLSRVFLLL

SEQ ID NO: 1322257 - protein, 9 aa, Homo Sapiens
LPSPGGWKV

SEQ ID NO: 1322258 - protein, 9 aa, Homo Sapiens
TFWLWCSLL

SEQ ID NO: 1322259 - protein, 9 aa, Homo Sapiens
QHKQFLRLL

SEQ ID NO: 1322260 - protein, 9 aa, Homo Sapiens
DLVEMVLLM

SEQ ID NO: 1322261 - protein, 9 aa, Homo Sapiens
YVNFLINPL

SEQ ID NO: 1322262 - protein, 9 aa, Homo Sapiens
DFFKHLLEL

SEQ ID NO: 1322263 - protein, 9 aa, Homo Sapiens
GDFTALLHA

SEQ ID NO: 1322264 - protein, 9 aa, Homo Sapiens
SLYNWGFSL

SEQ ID NO: 1322265 - protein, 9 aa, Homo Sapiens
LLFIHYLAN

SEQ ID NO: 1322266 - protein, 9 aa, Homo Sapiens
RTSLSTRGC

SEQ ID NO: 1322267 - protein, 9 aa, Homo Sapiens
REEVNNKLI

SEQ ID NO: 1322268 - protein, 9 aa, Homo Sapiens
GHSGSSLVS

SEQ ID NO: 1322269 - protein, 9 aa, Homo Sapiens
VSFVKLFVA

SEQ ID NO: 1322270 - protein, 9 aa, Homo Sapiens
AGYIIPELL

SEQ ID NO: 1322271 - protein, 9 aa, Homo Sapiens
SAMEHTPPH

SEQ ID NO: 1322272 - protein, 9 aa, Homo Sapiens
NDMTLLKLA

SEQ ID NO: 1322273 - protein, 9 aa, Homo Sapiens
PCGYVCSEK

SEQ ID NO: 1322274 - protein, 9 aa, Homo Sapiens
LESGHPINL

SEQ ID NO: 1322275 - protein, 9 aa, Homo Sapiens
TMYHCLQFA

SEQ ID NO: 1322276 - protein, 9 aa, Homo Sapiens
IIETVVPNS

SEQ ID NO: 1322277 - protein, 9 aa, Homo Sapiens
QEDYHSQNS

SEQ ID NO: 1322278 - protein, 9 aa, Homo Sapiens
LFVSSRSAS

SEQ ID NO: 1322279 - protein, 9 aa, Homo Sapiens
GVGQRIRDV

SEQ ID NO: 1322280 - protein, 9 aa, Homo Sapiens
LIFALALVA

SEQ ID NO: 1322281 - protein, 9 aa, Homo Sapiens
KQCLPPRTV

SEQ ID NO: 1322282 - protein, 9 aa, Homo Sapiens
HGGDPEDND

SEQ ID NO: 1322283 - protein, 9 aa, Homo Sapiens
AYTGHLSMA

SEQ ID NO: 1322284 - protein, 9 aa, Homo Sapiens
QDASLCLMV

SEQ ID NO: 1322285 - protein, 9 aa, Homo Sapiens
IKTISLLFN

SEQ ID NO: 1322286 - protein, 9 aa, Homo Sapiens
GDSDAKSLH

SEQ ID NO: 1322287 - protein, 9 aa, Homo Sapiens
HNLQDVVER

SEQ ID NO: 1322288 - protein, 9 aa, Homo Sapiens
NTEMRTSCL

SEQ ID NO: 1322289 - protein, 9 aa, Homo Sapiens
AVISFLCGV

SEQ ID NO: 1322290 - protein, 9 aa, Homo Sapiens
IKMLSTSEQ

SEQ ID NO: 1322291 - protein, 9 aa, Homo Sapiens
NIFLEKNKM

SEQ ID NO: 1322292 - protein, 9 aa, Homo Sapiens
LLRRYHQDF

SEQ ID NO: 1322293 - protein, 9 aa, Homo Sapiens
IQSKDDKSP

SEQ ID NO: 1322294 - protein, 9 aa, Homo Sapiens
GSHGVSGGG

SEQ ID NO: 1322295 - protein, 9 aa, Homo Sapiens
VPRLVQFEQ

SEQ ID NO: 1322296 - protein, 9 aa, Homo Sapiens
QQPPRQNQV

SEQ ID NO: 1322297 - protein, 9 aa, Homo Sapiens
SAHNQQLWE

SEQ ID NO: 1322298 - protein, 9 aa, Homo Sapiens
GLHYITVGL

SEQ ID NO: 1322299 - protein, 9 aa, Homo Sapiens
WCHTSVKPH

SEQ ID NO: 1322300 - protein, 9 aa, Homo Sapiens
SQSTTDTST

SEQ ID NO: 1322301 - protein, 9 aa, Homo Sapiens
LIEHVTACL

SEQ ID NO: 1322302 - protein, 9 aa, Homo Sapiens
REPKSKSPL

SEQ ID NO: 1322303 - protein, 9 aa, Homo Sapiens
HPVLEKLQS

SEQ ID NO: 1322304 - protein, 9 aa, Homo Sapiens
CQVCRNKCI

SEQ ID NO: 1322305 - protein, 9 aa, Homo Sapiens
MREVDEENR

SEQ ID NO: 1322306 - protein, 9 aa, Homo Sapiens
GTTSHKDVL

SEQ ID NO: 1322307 - protein, 9 aa, Homo Sapiens
WDFNIDKAR

SEQ ID NO: 1322308 - protein, 9 aa, Homo Sapiens
QIGSFVSPE

SEQ ID NO: 1322309 - protein, 9 aa, Homo Sapiens
SSEGKQILF

SEQ ID NO: 1322310 - protein, 9 aa, Homo Sapiens
VGGQTLAAE

SEQ ID NO: 1322311 - protein, 9 aa, Homo Sapiens
NVPSHQGLT

SEQ ID NO: 1322312 - protein, 9 aa, Homo Sapiens
VFLLIIIIV

SEQ ID NO: 1322313 - protein, 9 aa, Homo Sapiens
GEHSNIVDL

SEQ ID NO: 1322314 - protein, 9 aa, Homo Sapiens
RVTNDNVSC

SEQ ID NO: 1322315 - protein, 9 aa, Homo Sapiens
MHLLNIPLE

SEQ ID NO: 1322316 - protein, 9 aa, Homo Sapiens
ATFPDPNIK

SEQ ID NO: 1322317 - protein, 9 aa, Homo Sapiens
CVAQNASLL

SEQ ID NO: 1322318 - protein, 9 aa, Homo Sapiens
YLTALWKEK

SEQ ID NO: 1322319 - protein, 9 aa, Homo Sapiens
SSCTGASTQ

SEQ ID NO: 1322320 - protein, 9 aa, Homo Sapiens
PVGPKSNHG

SEQ ID NO: 1322321 - protein, 9 aa, Homo Sapiens
GTFKLSAKD

SEQ ID NO: 1322322 - protein, 9 aa, Homo Sapiens
SPHKNPCKE

SEQ ID NO: 1322323 - protein, 9 aa, Homo Sapiens
TIYIFLSVL

SEQ ID NO: 1322324 - protein, 9 aa, Homo Sapiens
EMTPQSEPR

SEQ ID NO: 1322325 - protein, 9 aa, Homo Sapiens
GEHHDVVSK

SEQ ID NO: 1322326 - protein, 9 aa, Homo Sapiens
TEDEHKILL

SEQ ID NO: 1322327 - protein, 9 aa, Homo Sapiens
TYNKLTLKT

SEQ ID NO: 1322328 - protein, 9 aa, Homo Sapiens
LDGTFVPLG

SEQ ID NO: 1322329 - protein, 9 aa, Homo Sapiens
EWNSPLSFS

SEQ ID NO: 1322330 - protein, 9 aa, Homo Sapiens
LIDYQLTFS

SEQ ID NO: 1322331 - protein, 9 aa, Homo Sapiens
VSSQDKLPP

SEQ ID NO: 1322332 - protein, 9 aa, Homo Sapiens
VHTSHATTA

SEQ ID NO: 1322333 - protein, 9 aa, Homo Sapiens
AASQGLHYI

SEQ ID NO: 1322334 - protein, 9 aa, Homo Sapiens
KDHDASPSK

SEQ ID NO: 1322335 - protein, 9 aa, Homo Sapiens
PTSIEPISS

SEQ ID NO: 1322336 - protein, 9 aa, Homo Sapiens
DAVHPFFLA

SEQ ID NO: 1322337 - protein, 9 aa, Homo Sapiens
QHNVFLATD

SEQ ID NO: 1322338 - protein, 9 aa, Homo Sapiens
LLDLPILDD

SEQ ID NO: 1322339 - protein, 9 aa, Homo Sapiens
PSTCTSAST

SEQ ID NO: 1322340 - protein, 9 aa, Homo Sapiens
NSNDCMMDS

SEQ ID NO: 1322341 - protein, 9 aa, Homo Sapiens
GVGTALLGK

SEQ ID NO: 1322342 - protein, 9 aa, Homo Sapiens
AKHLQEEKE

SEQ ID NO: 1322343 - protein, 9 aa, Homo Sapiens
ADSKFQECH

SEQ ID NO: 1322344 - protein, 9 aa, Homo Sapiens
TSLTSLRSE

SEQ ID NO: 1322345 - protein, 9 aa, Homo Sapiens
AELEDCRQL

SEQ ID NO: 1322346 - protein, 9 aa, Homo Sapiens
TIEGLFFHL

SEQ ID NO: 1322347 - protein, 9 aa, Homo Sapiens
LTAGSFQIP

SEQ ID NO: 1322348 - protein, 9 aa, Homo Sapiens
WPGAPCVPG

SEQ ID NO: 1322349 - protein, 9 aa, Homo Sapiens
IFSLVKTPQ

SEQ ID NO: 1322350 - protein, 9 aa, Homo Sapiens
SKLSTAECE

SEQ ID NO: 1322351 - protein, 9 aa, Homo Sapiens
IERYEFPPD

SEQ ID NO: 1322352 - protein, 9 aa, Homo Sapiens
WGESLRVDT

SEQ ID NO: 1322353 - protein, 9 aa, Homo Sapiens
KDSEGNVSF

SEQ ID NO: 1322354 - protein, 9 aa, Homo Sapiens
ECHMKREHP

SEQ ID NO: 1322355 - protein, 9 aa, Homo Sapiens
GTMFGGDFP

SEQ ID NO: 1322356 - protein, 9 aa, Homo Sapiens
VIPASVLSE

SEQ ID NO: 1322357 - protein, 9 aa, Homo Sapiens
EDTLDDSVS

SEQ ID NO: 1322358 - protein, 9 aa, Homo Sapiens
TLMSLAKQQ

SEQ ID NO: 1322359 - protein, 9 aa, Homo Sapiens
SSTIVSTQR

SEQ ID NO: 1322360 - protein, 9 aa, Homo Sapiens
HSIVTNMDK

SEQ ID NO: 1322361 - protein, 9 aa, Homo Sapiens
HISVICRSL

SEQ ID NO: 1322362 - protein, 9 aa, Homo Sapiens
ELAFFPSYL

SEQ ID NO: 1322363 - protein, 9 aa, Homo Sapiens
VVKHDSILN

SEQ ID NO: 1322364 - protein, 9 aa, Homo Sapiens
VNITQFLPL

SEQ ID NO: 1322365 - protein, 9 aa, Homo Sapiens
TGHITFNKI

SEQ ID NO: 1322366 - protein, 9 aa, Homo Sapiens
SGYQFTSCS

SEQ ID NO: 1322367 - protein, 9 aa, Homo Sapiens
YSRYITIRW

SEQ ID NO: 1322368 - protein, 9 aa, Homo Sapiens
MHIKGLEAS

SEQ ID NO: 1322369 - protein, 9 aa, Homo Sapiens
YYHNSVGGF

SEQ ID NO: 1322370 - protein, 9 aa, Homo Sapiens
MLTSLTQKW

SEQ ID NO: 1322371 - protein, 9 aa, Homo Sapiens
FREAKPHSL

SEQ ID NO: 1322372 - protein, 9 aa, Homo Sapiens
DQNDPHFIG

SEQ ID NO: 1322373 - protein, 9 aa, Homo Sapiens
GLALFLYCY

SEQ ID NO: 1322374 - protein, 9 aa, Homo Sapiens
HTHTKELKT

SEQ ID NO: 1322375 - protein, 9 aa, Homo Sapiens
NYCKKIPSN

SEQ ID NO: 1322376 - protein, 9 aa, Homo Sapiens
LCLQVIDLL

SEQ ID NO: 1322377 - protein, 9 aa, Homo Sapiens
TFSFEPLSN

SEQ ID NO: 1322378 - protein, 9 aa, Homo Sapiens
KLVIQNVNV

SEQ ID NO: 1322379 - protein, 9 aa, Homo Sapiens
SCRGSISSM

SEQ ID NO: 1322380 - protein, 9 aa, Homo Sapiens
QYCIKRMLA

SEQ ID NO: 1322381 - protein, 9 aa, Homo Sapiens
LREVLWTVE

SEQ ID NO: 1322382 - protein, 9 aa, Homo Sapiens
SLVVWHRGS

SEQ ID NO: 1322383 - protein, 9 aa, Homo Sapiens
CYRNGGGTF

SEQ ID NO: 1322384 - protein, 9 aa, Homo Sapiens
NTCLHKGSR

SEQ ID NO: 1322385 - protein, 9 aa, Homo Sapiens
KHVHIFLAD

SEQ ID NO: 1322386 - protein, 9 aa, Homo Sapiens
GLSEDFHVK

SEQ ID NO: 1322387 - protein, 9 aa, Homo Sapiens
AKEGECSPH

SEQ ID NO: 1322388 - protein, 9 aa, Homo Sapiens
AIERVAFFV

SEQ ID NO: 1322389 - protein, 9 aa, Homo Sapiens
KLYTCLKCG

SEQ ID NO: 1322390 - protein, 9 aa, Homo Sapiens
QFHGDSANC

SEQ ID NO: 1322391 - protein, 9 aa, Homo Sapiens
WGSALHFEV

SEQ ID NO: 1322392 - protein, 9 aa, Homo Sapiens
RVLYVDSRS

SEQ ID NO: 1322393 - protein, 9 aa, Homo Sapiens
HVDFQLVLP

SEQ ID NO: 1322394 - protein, 9 aa, Homo Sapiens
FLFLSLACT

SEQ ID NO: 1322395 - protein, 9 aa, Homo Sapiens
TGEKIYVCI

SEQ ID NO: 1322396 - protein, 9 aa, Homo Sapiens
RLPALTVHM

SEQ ID NO: 1322397 - protein, 9 aa, Homo Sapiens
PLRFLWFTH

SEQ ID NO: 1322398 - protein, 9 aa, Homo Sapiens
YNSHTVMNG

SEQ ID NO: 1322399 - protein, 9 aa, Homo Sapiens
AKRVKLTGS

SEQ ID NO: 1322400 - protein, 9 aa, Homo Sapiens
WHCLQREDW

SEQ ID NO: 1322401 - protein, 9 aa, Homo Sapiens
VQQCQTIHG

SEQ ID NO: 1322402 - protein, 9 aa, Homo Sapiens
VIFSLFMLT

SEQ ID NO: 1322403 - protein, 9 aa, Homo Sapiens
LPMDADEDM

SEQ ID NO: 1322404 - protein, 9 aa, Homo Sapiens
TRGRDQIKK

SEQ ID NO: 1322405 - protein, 9 aa, Homo Sapiens
STEALRCHL

SEQ ID NO: 1322406 - protein, 9 aa, Homo Sapiens
PSVMPAPPE

SEQ ID NO: 1322407 - protein, 9 aa, Homo Sapiens
PPTPFLPFT

SEQ ID NO: 1322408 - protein, 9 aa, Homo Sapiens
GFSWWSGRI

SEQ ID NO: 1322409 - protein, 9 aa, Homo Sapiens
NSSATGHCL

SEQ ID NO: 1322410 - protein, 9 aa, Homo Sapiens
ASKHIPEAR

SEQ ID NO: 1322411 - protein, 9 aa, Homo Sapiens
HISLAGCGA

SEQ ID NO: 1322412 - protein, 9 aa, Homo Sapiens
EEVVTLGGS

SEQ ID NO: 1322413 - protein, 9 aa, Homo Sapiens
NEKGRKVLW

SEQ ID NO: 1322414 - protein, 9 aa, Homo Sapiens
QCSDGITNS

SEQ ID NO: 1322415 - protein, 9 aa, Homo Sapiens
ASLYLSSPC

SEQ ID NO: 1322416 - protein, 9 aa, Homo Sapiens
HVVAVLASL

SEQ ID NO: 1322417 - protein, 9 aa, Homo Sapiens
VQLHVKEPH

SEQ ID NO: 1322418 - protein, 9 aa, Homo Sapiens
QIDPKKLKM

SEQ ID NO: 1322419 - protein, 9 aa, Homo Sapiens
PSTSVHTSH

SEQ ID NO: 1322420 - protein, 9 aa, Homo Sapiens
SHRLIVVLA

SEQ ID NO: 1322421 - protein, 9 aa, Homo Sapiens
KKGSNDYGF

SEQ ID NO: 1322422 - protein, 9 aa, Homo Sapiens
VHLCTISLD

SEQ ID NO: 1322423 - protein, 9 aa, Homo Sapiens
DLHINLWHL

SEQ ID NO: 1322424 - protein, 9 aa, Homo Sapiens
NKDRPVMQL

SEQ ID NO: 1322425 - protein, 9 aa, Homo Sapiens
EKVEAGEAG

SEQ ID NO: 1322426 - protein, 9 aa, Homo Sapiens
HCCDPGTSM

SEQ ID NO: 1322427 - protein, 9 aa, Homo Sapiens
VALQRGKQD

SEQ ID NO: 1322428 - protein, 9 aa, Homo Sapiens
ATEIDMVIN

SEQ ID NO: 1322429 - protein, 9 aa, Homo Sapiens
AIHMWKGYR

SEQ ID NO: 1322430 - protein, 9 aa, Homo Sapiens
VGNGKVYPT

SEQ ID NO: 1322431 - protein, 9 aa, Homo Sapiens
ECSPHKNPC

SEQ ID NO: 1322432 - protein, 9 aa, Homo Sapiens
NISHILVTS

SEQ ID NO: 1322433 - protein, 9 aa, Homo Sapiens
KHSSRNWPS

SEQ ID NO: 1322434 - protein, 9 aa, Homo Sapiens
GSRFFITST

SEQ ID NO: 1322435 - protein, 9 aa, Homo Sapiens
YVQDAMELA

SEQ ID NO: 1322436 - protein, 9 aa, Homo Sapiens
MAVNKRTVC

SEQ ID NO: 1322437 - protein, 9 aa, Homo Sapiens
FSGQRYVHE

SEQ ID NO: 1322438 - protein, 9 aa, Homo Sapiens
LWTVETKAT

SEQ ID NO: 1322439 - protein, 9 aa, Homo Sapiens
LLDVDHISS

SEQ ID NO: 1322440 - protein, 9 aa, Homo Sapiens
RFHGMLLPG

SEQ ID NO: 1322441 - protein, 9 aa, Homo Sapiens
RTIMTIGTF

SEQ ID NO: 1322442 - protein, 9 aa, Homo Sapiens
FMTEQLRKI

SEQ ID NO: 1322443 - protein, 9 aa, Homo Sapiens
VHPDVTMKS

SEQ ID NO: 1322444 - protein, 9 aa, Homo Sapiens
VFNRHKMLS

SEQ ID NO: 1322445 - protein, 9 aa, Homo Sapiens
WLITVPIDH

SEQ ID NO: 1322446 - protein, 9 aa, Homo Sapiens
QRTMCTRKR

SEQ ID NO: 1322447 - protein, 9 aa, Homo Sapiens
QWVVFPNNS

SEQ ID NO: 1322448 - protein, 9 aa, Homo Sapiens
DKGATYTPR

SEQ ID NO: 1322449 - protein, 9 aa, Homo Sapiens
VIAPNGALQ

SEQ ID NO: 1322450 - protein, 9 aa, Homo Sapiens
GHILLILWR

SEQ ID NO: 1322451 - protein, 9 aa, Homo Sapiens
RPGTVALHE

SEQ ID NO: 1322452 - protein, 9 aa, Homo Sapiens
AEIIQEVED

SEQ ID NO: 1322453 - protein, 9 aa, Homo Sapiens
RICLARQIE

SEQ ID NO: 1322454 - protein, 9 aa, Homo Sapiens
AISNYCKKI

SEQ ID NO: 1322455 - protein, 9 aa, Homo Sapiens
LPAVRSPAL

SEQ ID NO: 1322456 - protein, 9 aa, Homo Sapiens
STQYYDMCW

SEQ ID NO: 1322457 - protein, 9 aa, Homo Sapiens
IGDRVMTIN

SEQ ID NO: 1322458 - protein, 9 aa, Homo Sapiens
GVSGKDDIF

SEQ ID NO: 1322459 - protein, 9 aa, Homo Sapiens
VSVQSWFDD

SEQ ID NO: 1322460 - protein, 9 aa, Homo Sapiens
DVETLYKEI

SEQ ID NO: 1322461 - protein, 9 aa, Homo Sapiens
PFFLAHVLN

SEQ ID NO: 1322462 - protein, 9 aa, Homo Sapiens
STIMRDPKR

SEQ ID NO: 1322463 - protein, 9 aa, Homo Sapiens
GFMLMLDVL

SEQ ID NO: 1322464 - protein, 9 aa, Homo Sapiens
ATKLPLQSL

SEQ ID NO: 1322465 - protein, 9 aa, Homo Sapiens
HCSVLEARD

SEQ ID NO: 1322466 - protein, 9 aa, Homo Sapiens
NTPLGAVLV

SEQ ID NO: 1322467 - protein, 9 aa, Homo Sapiens
TDIVEASRT

SEQ ID NO: 1322468 - protein, 9 aa, Homo Sapiens
QDWLTGIRL

SEQ ID NO: 1322469 - protein, 9 aa, Homo Sapiens
LWLQKWYIT

SEQ ID NO: 1322470 - protein, 9 aa, Homo Sapiens
ASSAPSRTW

SEQ ID NO: 1322471 - protein, 9 aa, Homo Sapiens
VHPATFTAH

SEQ ID NO: 1322472 - protein, 9 aa, Homo Sapiens
GDAFTLFAC

SEQ ID NO: 1322473 - protein, 9 aa, Homo Sapiens
GWEVVFRQR

SEQ ID NO: 1322474 - protein, 9 aa, Homo Sapiens
PQAETREAH

SEQ ID NO: 1322475 - protein, 9 aa, Homo Sapiens
VEEHCGDSP

SEQ ID NO: 1322476 - protein, 9 aa, Homo Sapiens
IACLQFSVS

SEQ ID NO: 1322477 - protein, 9 aa, Homo Sapiens
EEQERHSQN

SEQ ID NO: 1322478 - protein, 9 aa, Homo Sapiens
DGQDSPIPT

SEQ ID NO: 1322479 - protein, 9 aa, Homo Sapiens
CDEAFTYNS

SEQ ID NO: 1322480 - protein, 9 aa, Homo Sapiens
TFILVVQSA

SEQ ID NO: 1322481 - protein, 9 aa, Homo Sapiens
TDAATAKTQ

SEQ ID NO: 1322482 - protein, 9 aa, Homo Sapiens
FHIPNYGAI

SEQ ID NO: 1322483 - protein, 9 aa, Homo Sapiens
DQESPHQEK

SEQ ID NO: 1322484 - protein, 9 aa, Homo Sapiens
PEQGLSTFY

SEQ ID NO: 1322485 - protein, 9 aa, Homo Sapiens
STQKKLADK

SEQ ID NO: 1322486 - protein, 9 aa, Homo Sapiens
TGTDVKDTK

SEQ ID NO: 1322487 - protein, 9 aa, Homo Sapiens
QKLPKKKKE

SEQ ID NO: 1322488 - protein, 9 aa, Homo Sapiens
WHLARASRD

SEQ ID NO: 1322489 - protein, 9 aa, Homo Sapiens
LFLFFTTIF

SEQ ID NO: 1322490 - protein, 9 aa, Homo Sapiens
CPSPYSCQH

SEQ ID NO: 1322491 - protein, 9 aa, Homo Sapiens
TQQTPVAAA

SEQ ID NO: 1322492 - protein, 9 aa, Homo Sapiens
LPPPLLRHH

SEQ ID NO: 1322493 - protein, 9 aa, Homo Sapiens
VAEALKRLH

SEQ ID NO: 1322494 - protein, 9 aa, Homo Sapiens
QEGFASSIQ

SEQ ID NO: 1322495 - protein, 9 aa, Homo Sapiens
LGEELCLCC

SEQ ID NO: 1322496 - protein, 9 aa, Homo Sapiens
LMIEVSDKD

SEQ ID NO: 1322497 - protein, 9 aa, Homo Sapiens
GSQGGRPSS

SEQ ID NO: 1322498 - protein, 9 aa, Homo Sapiens
HPKHLEQQE

SEQ ID NO: 1322499 - protein, 9 aa, Homo Sapiens
PLKLSNVEQ

SEQ ID NO: 1322500 - protein, 9 aa, Homo Sapiens
GLRMLFPEV

SEQ ID NO: 1322501 - protein, 9 aa, Homo Sapiens
ITLCLPPGF

SEQ ID NO: 1322502 - protein, 9 aa, Homo Sapiens
QEQYHRIGG

SEQ ID NO: 1322503 - protein, 9 aa, Homo Sapiens
RFVYTPTME

SEQ ID NO: 1322504 - protein, 9 aa, Homo Sapiens
KMNLNWPQG

SEQ ID NO: 1322505 - protein, 9 aa, Homo Sapiens
HMVAHTKDI

SEQ ID NO: 1322506 - protein, 9 aa, Homo Sapiens
SQLADSLIG

SEQ ID NO: 1322507 - protein, 9 aa, Homo Sapiens
KERKEENTR

SEQ ID NO: 1322508 - protein, 9 aa, Homo Sapiens
EERAAGTGE

SEQ ID NO: 1322509 - protein, 9 aa, Homo Sapiens
PIPQKLQMS

SEQ ID NO: 1322510 - protein, 9 aa, Homo Sapiens
PSQHDDISR

SEQ ID NO: 1322511 - protein, 9 aa, Homo Sapiens
KLFQRFPKT

SEQ ID NO: 1322512 - protein, 9 aa, Homo Sapiens
QIIKICAQT

SEQ ID NO: 1322513 - protein, 9 aa, Homo Sapiens
KDVAEIVLE

SEQ ID NO: 1322514 - protein, 9 aa, Homo Sapiens
ASVEAENTY

SEQ ID NO: 1322515 - protein, 9 aa, Homo Sapiens
SSNSIFDLQ

SEQ ID NO: 1322516 - protein, 9 aa, Homo Sapiens
MTVYKLNDN

SEQ ID NO: 1322517 - protein, 9 aa, Homo Sapiens
WALKMLLTI

SEQ ID NO: 1322518 - protein, 9 aa, Homo Sapiens
SEDTLVGDS

SEQ ID NO: 1322519 - protein, 9 aa, Homo Sapiens
HNLELTISP

SEQ ID NO: 1322520 - protein, 9 aa, Homo Sapiens
EAFHMYLVL

SEQ ID NO: 1322521 - protein, 9 aa, Homo Sapiens
HCPVKTCAG

SEQ ID NO: 1322522 - protein, 9 aa, Homo Sapiens
GCLLHNCFD

SEQ ID NO: 1322523 - protein, 9 aa, Homo Sapiens
VTFQIGSFV

SEQ ID NO: 1322524 - protein, 9 aa, Homo Sapiens
SFDPLFVEQ

SEQ ID NO: 1322525 - protein, 9 aa, Homo Sapiens
EAVHFSFAF

SEQ ID NO: 1322526 - protein, 9 aa, Homo Sapiens
TVEVRVPYV

SEQ ID NO: 1322527 - protein, 9 aa, Homo Sapiens
SHLIFQVLD

SEQ ID NO: 1322528 - protein, 9 aa, Homo Sapiens
YLNFIYYRS

SEQ ID NO: 1322529 - protein, 9 aa, Homo Sapiens
AVFFILFVL

SEQ ID NO: 1322530 - protein, 9 aa, Homo Sapiens
PRSRLAAAS

SEQ ID NO: 1322531 - protein, 9 aa, Homo Sapiens
TSLGDSLTR

SEQ ID NO: 1322532 - protein, 9 aa, Homo Sapiens
ATIPAYHLR

SEQ ID NO: 1322533 - protein, 9 aa, Homo Sapiens
VLKNNVLSY

SEQ ID NO: 1322534 - protein, 9 aa, Homo Sapiens
CMDHIQHHL

SEQ ID NO: 1322535 - protein, 9 aa, Homo Sapiens
HTLQLIWER

SEQ ID NO: 1322536 - protein, 9 aa, Homo Sapiens
DCKDNVIKY

SEQ ID NO: 1322537 - protein, 9 aa, Homo Sapiens
LRHSYHLTT

SEQ ID NO: 1322538 - protein, 9 aa, Homo Sapiens
MSVVVVQSA

SEQ ID NO: 1322539 - protein, 9 aa, Homo Sapiens
RVTQITCGR

SEQ ID NO: 1322540 - protein, 9 aa, Homo Sapiens
SRQLGEQQR

SEQ ID NO: 1322541 - protein, 9 aa, Homo Sapiens
GGRPSPCLS

SEQ ID NO: 1322542 - protein, 9 aa, Homo Sapiens
CEYCDRAFK

SEQ ID NO: 1322543 - protein, 9 aa, Homo Sapiens
QLSSALHTI

SEQ ID NO: 1322544 - protein, 9 aa, Homo Sapiens
VVGNYRLKE

SEQ ID NO: 1322545 - protein, 9 aa, Homo Sapiens
YNTSFIHHW

SEQ ID NO: 1322546 - protein, 9 aa, Homo Sapiens
DSGLMHDLK

SEQ ID NO: 1322547 - protein, 9 aa, Homo Sapiens
PWCCPGRWG

SEQ ID NO: 1322548 - protein, 9 aa, Homo Sapiens
GSWGSLGDS

SEQ ID NO: 1322549 - protein, 9 aa, Homo Sapiens
ATLKAAGQS

SEQ ID NO: 1322550 - protein, 9 aa, Homo Sapiens
KIKKVYPGK

SEQ ID NO: 1322551 - protein, 9 aa, Homo Sapiens
ESKQLQIQL

SEQ ID NO: 1322552 - protein, 9 aa, Homo Sapiens
FFTGDLPPP

SEQ ID NO: 1322553 - protein, 9 aa, Homo Sapiens
RAAAVMLFC

SEQ ID NO: 1322554 - protein, 9 aa, Homo Sapiens
VTLKACSPL

SEQ ID NO: 1322555 - protein, 9 aa, Homo Sapiens
SRCTPQHIG

SEQ ID NO: 1322556 - protein, 9 aa, Homo Sapiens
WKDDMNDKF

SEQ ID NO: 1322557 - protein, 9 aa, Homo Sapiens
RNPHHSQKM

SEQ ID NO: 1322558 - protein, 9 aa, Homo Sapiens
AAGASSAAT

SEQ ID NO: 1322559 - protein, 9 aa, Homo Sapiens
NGKITGIKD

SEQ ID NO: 1322560 - protein, 9 aa, Homo Sapiens
EFMNKFHSM

SEQ ID NO: 1322561 - protein, 9 aa, Homo Sapiens
PSLQSSVQQ

SEQ ID NO: 1322562 - protein, 9 aa, Homo Sapiens
MMNRLANIR

SEQ ID NO: 1322563 - protein, 9 aa, Homo Sapiens
KPTLTIIGL

SEQ ID NO: 1322564 - protein, 9 aa, Homo Sapiens
FIIGVNVAF

SEQ ID NO: 1322565 - protein, 9 aa, Homo Sapiens
AVRSPALAG

SEQ ID NO: 1322566 - protein, 9 aa, Homo Sapiens
RCAQTREKT

SEQ ID NO: 1322567 - protein, 9 aa, Homo Sapiens
VVDTAWIFL

SEQ ID NO: 1322568 - protein, 9 aa, Homo Sapiens
REGDVGFGR

SEQ ID NO: 1322569 - protein, 9 aa, Homo Sapiens
EHIPKALEV

SEQ ID NO: 1322570 - protein, 9 aa, Homo Sapiens
QHFGLGSLA

SEQ ID NO: 1322571 - protein, 9 aa, Homo Sapiens
VHFSFAFSF

SEQ ID NO: 1322572 - protein, 9 aa, Homo Sapiens
HTSHRLIVV

SEQ ID NO: 1322573 - protein, 9 aa, Homo Sapiens
VVSDGEADP

SEQ ID NO: 1322574 - protein, 9 aa, Homo Sapiens
PKGAGLQFW

SEQ ID NO: 1322575 - protein, 9 aa, Homo Sapiens
WRLSRIVFC

SEQ ID NO: 1322576 - protein, 9 aa, Homo Sapiens
RMFFIPLCL

SEQ ID NO: 1322577 - protein, 9 aa, Homo Sapiens
LERSFLGHV

SEQ ID NO: 1322578 - protein, 9 aa, Homo Sapiens
MFPTPFVHP

SEQ ID NO: 1322579 - protein, 9 aa, Homo Sapiens
SLPSSGFNQ

SEQ ID NO: 1322580 - protein, 9 aa, Homo Sapiens
RRMTLEIGA

SEQ ID NO: 1322581 - protein, 9 aa, Homo Sapiens
NDHITVELY

SEQ ID NO: 1322582 - protein, 9 aa, Homo Sapiens
VKPLSCDSA

SEQ ID NO: 1322583 - protein, 9 aa, Homo Sapiens
LQEEVSWLR

SEQ ID NO: 1322584 - protein, 9 aa, Homo Sapiens
VKASEKPPE

SEQ ID NO: 1322585 - protein, 9 aa, Homo Sapiens
VLYMACQYV

SEQ ID NO: 1322586 - protein, 9 aa, Homo Sapiens
NSVFQAESK

SEQ ID NO: 1322587 - protein, 9 aa, Homo Sapiens
FKLFNLLDE

SEQ ID NO: 1322588 - protein, 9 aa, Homo Sapiens
HQDDPSYRS

SEQ ID NO: 1322589 - protein, 9 aa, Homo Sapiens
ANGRFTGLV

SEQ ID NO: 1322590 - protein, 9 aa, Homo Sapiens
MMLEVLDGF

SEQ ID NO: 1322591 - protein, 9 aa, Homo Sapiens
RGFSWWSGR

SEQ ID NO: 1322592 - protein, 9 aa, Homo Sapiens
DGVKCCCQL

SEQ ID NO: 1322593 - protein, 9 aa, Homo Sapiens
PRTPPKITS

SEQ ID NO: 1322594 - protein, 9 aa, Homo Sapiens
DHQLSALRC

SEQ ID NO: 1322595 - protein, 9 aa, Homo Sapiens
DFPMDTHAC

SEQ ID NO: 1322596 - protein, 9 aa, Homo Sapiens
AKPHSLRFT

SEQ ID NO: 1322597 - protein, 9 aa, Homo Sapiens
HTILYPFVR

SEQ ID NO: 1322598 - protein, 9 aa, Homo Sapiens
PSLDQQCSC

SEQ ID NO: 1322599 - protein, 9 aa, Homo Sapiens
LHESGLFCA

SEQ ID NO: 1322600 - protein, 9 aa, Homo Sapiens
YIASEHSYQ

SEQ ID NO: 1322601 - protein, 9 aa, Homo Sapiens
PSSETSSSS

SEQ ID NO: 1322602 - protein, 9 aa, Homo Sapiens
SMWSELQAR

SEQ ID NO: 1322603 - protein, 9 aa, Homo Sapiens
GLQIFCSED

SEQ ID NO: 1322604 - protein, 9 aa, Homo Sapiens
GHNDPTDFV

SEQ ID NO: 1322605 - protein, 9 aa, Homo Sapiens
LEGSRVWRV

SEQ ID NO: 1322606 - protein, 9 aa, Homo Sapiens
DGYQCCMMA

SEQ ID NO: 1322607 - protein, 9 aa, Homo Sapiens
TLSVNASRD

SEQ ID NO: 1322608 - protein, 9 aa, Homo Sapiens
NLTNLLIHY

SEQ ID NO: 1322609 - protein, 9 aa, Homo Sapiens
TRYPDVNRR

SEQ ID NO: 1322610 - protein, 9 aa, Homo Sapiens
TFLRELLKN

SEQ ID NO: 1322611 - protein, 9 aa, Homo Sapiens
NSLWTTPLL

SEQ ID NO: 1322612 - protein, 9 aa, Homo Sapiens
AHLLTRAHV

SEQ ID NO: 1322613 - protein, 9 aa, Homo Sapiens
TEPEIWDPS

SEQ ID NO: 1322614 - protein, 9 aa, Homo Sapiens
DVWGNQQAL

SEQ ID NO: 1322615 - protein, 9 aa, Homo Sapiens
ERYYADITK

SEQ ID NO: 1322616 - protein, 9 aa, Homo Sapiens
ALVMVGLAR

SEQ ID NO: 1322617 - protein, 9 aa, Homo Sapiens
WYVPHPKKP

SEQ ID NO: 1322618 - protein, 9 aa, Homo Sapiens
SPSSTSAST

SEQ ID NO: 1322619 - protein, 9 aa, Homo Sapiens
SEEPLVPSD

SEQ ID NO: 1322620 - protein, 9 aa, Homo Sapiens
CKLEASGKG

SEQ ID NO: 1322621 - protein, 9 aa, Homo Sapiens
PGRFRDNHM

SEQ ID NO: 1322622 - protein, 9 aa, Homo Sapiens
TLEGKAGHG

SEQ ID NO: 1322623 - protein, 9 aa, Homo Sapiens
AMEHTPPHL

SEQ ID NO: 1322624 - protein, 9 aa, Homo Sapiens
LHQGCLLGL

SEQ ID NO: 1322625 - protein, 9 aa, Homo Sapiens
KSPKSVSSH

SEQ ID NO: 1322626 - protein, 9 aa, Homo Sapiens
FQLCSPICP

SEQ ID NO: 1322627 - protein, 9 aa, Homo Sapiens
LQIHLSAHT

SEQ ID NO: 1322628 - protein, 9 aa, Homo Sapiens
EMTDIVEAS

SEQ ID NO: 1322629 - protein, 9 aa, Homo Sapiens
RACFGLDQQ

SEQ ID NO: 1322630 - protein, 9 aa, Homo Sapiens
SHVSDHKHH

SEQ ID NO: 1322631 - protein, 9 aa, Homo Sapiens
SNAQWQLIV

SEQ ID NO: 1322632 - protein, 9 aa, Homo Sapiens
LADLIEWDR

SEQ ID NO: 1322633 - protein, 9 aa, Homo Sapiens
LKIKHGNLL

SEQ ID NO: 1322634 - protein, 9 aa, Homo Sapiens
FTGVYFEKI

SEQ ID NO: 1322635 - protein, 9 aa, Homo Sapiens
KGSSATTAA

SEQ ID NO: 1322636 - protein, 9 aa, Homo Sapiens
RYFVDKATA

SEQ ID NO: 1322637 - protein, 9 aa, Homo Sapiens
RELDPVWLM

SEQ ID NO: 1322638 - protein, 9 aa, Homo Sapiens
VAVDAQVGP

SEQ ID NO: 1322639 - protein, 9 aa, Homo Sapiens
YISVTGCIV

SEQ ID NO: 1322640 - protein, 9 aa, Homo Sapiens
RHCWTKEWR

SEQ ID NO: 1322641 - protein, 9 aa, Homo Sapiens
CTVDTENIR

SEQ ID NO: 1322642 - protein, 9 aa, Homo Sapiens
GIAIHMWKG

SEQ ID NO: 1322643 - protein, 9 aa, Homo Sapiens
IPTRTARWP

SEQ ID NO: 1322644 - protein, 9 aa, Homo Sapiens
WHFETRKSQ

SEQ ID NO: 1322645 - protein, 9 aa, Homo Sapiens
VDVPKVPVQ

SEQ ID NO: 1322646 - protein, 9 aa, Homo Sapiens
QCWCCKRYG

SEQ ID NO: 1322647 - protein, 9 aa, Homo Sapiens
KCLYKVIRK

SEQ ID NO: 1322648 - protein, 9 aa, Homo Sapiens
RPEVPIFHD

SEQ ID NO: 1322649 - protein, 9 aa, Homo Sapiens
FISDKDGSI

SEQ ID NO: 1322650 - protein, 9 aa, Homo Sapiens
YAFLPREVV

SEQ ID NO: 1322651 - protein, 9 aa, Homo Sapiens
PSTPSQSSV

SEQ ID NO: 1322652 - protein, 9 aa, Homo Sapiens
SLVKTPQCQ

SEQ ID NO: 1322653 - protein, 9 aa, Homo Sapiens
PPPGHSAFT

SEQ ID NO: 1322654 - protein, 9 aa, Homo Sapiens
VQFHIPNYG

SEQ ID NO: 1322655 - protein, 9 aa, Homo Sapiens
LAAEHGLST

SEQ ID NO: 1322656 - protein, 9 aa, Homo Sapiens
IETLEECWA

SEQ ID NO: 1322657 - protein, 9 aa, Homo Sapiens
DTGSTGPGY

SEQ ID NO: 1322658 - protein, 9 aa, Homo Sapiens
SVQNMLNWA

SEQ ID NO: 1322659 - protein, 9 aa, Homo Sapiens
LSGGITILG

SEQ ID NO: 1322660 - protein, 9 aa, Homo Sapiens
LRAEPRPPR

SEQ ID NO: 1322661 - protein, 9 aa, Homo Sapiens
LSDMDNLSS

SEQ ID NO: 1322662 - protein, 9 aa, Homo Sapiens
EQCHYRFKN

SEQ ID NO: 1322663 - protein, 9 aa, Homo Sapiens
GCLLGLRAN

SEQ ID NO: 1322664 - protein, 9 aa, Homo Sapiens
EMLTSLTQK

SEQ ID NO: 1322665 - protein, 9 aa, Homo Sapiens
ISGDCPLQG

SEQ ID NO: 1322666 - protein, 9 aa, Homo Sapiens
LPGPHDDFV

SEQ ID NO: 1322667 - protein, 9 aa, Homo Sapiens
YAAFAIITT

SEQ ID NO: 1322668 - protein, 9 aa, Homo Sapiens
GVLLRRMTL

SEQ ID NO: 1322669 - protein, 9 aa, Homo Sapiens
GGEFGMSTV

SEQ ID NO: 1322670 - protein, 9 aa, Homo Sapiens
ANLTSSLMS

SEQ ID NO: 1322671 - protein, 9 aa, Homo Sapiens
LPCVLPHVD

SEQ ID NO: 1322672 - protein, 9 aa, Homo Sapiens
TSFEGRHDS

SEQ ID NO: 1322673 - protein, 9 aa, Homo Sapiens
WSITTKLYD

SEQ ID NO: 1322674 - protein, 9 aa, Homo Sapiens
WGDIVKVVP

SEQ ID NO: 1322675 - protein, 9 aa, Homo Sapiens
VEVTPPKAK

SEQ ID NO: 1322676 - protein, 9 aa, Homo Sapiens
TIPVEPGCQ

SEQ ID NO: 1322677 - protein, 9 aa, Homo Sapiens
IKFLKLVAA

SEQ ID NO: 1322678 - protein, 9 aa, Homo Sapiens
DNWNRIMKD

SEQ ID NO: 1322679 - protein, 9 aa, Homo Sapiens
LQELVLMMI

SEQ ID NO: 1322680 - protein, 9 aa, Homo Sapiens
TLHLFGCME

SEQ ID NO: 1322681 - protein, 9 aa, Homo Sapiens
PSHYSQDMP

SEQ ID NO: 1322682 - protein, 9 aa, Homo Sapiens
IIRNNSWLY

SEQ ID NO: 1322683 - protein, 9 aa, Homo Sapiens
DHCVVGGYL

SEQ ID NO: 1322684 - protein, 9 aa, Homo Sapiens
KDQHLVFHS

SEQ ID NO: 1322685 - protein, 9 aa, Homo Sapiens
LRYIAHKHN

SEQ ID NO: 1322686 - protein, 9 aa, Homo Sapiens
MLVRLACAD

SEQ ID NO: 1322687 - protein, 9 aa, Homo Sapiens
VSPGRAEPW

SEQ ID NO: 1322688 - protein, 9 aa, Homo Sapiens
SKGFFGSHL

SEQ ID NO: 1322689 - protein, 9 aa, Homo Sapiens
NFFIHNLDQ

SEQ ID NO: 1322690 - protein, 9 aa, Homo Sapiens
QVLIGVSEL

SEQ ID NO: 1322691 - protein, 9 aa, Homo Sapiens
MFWLKKLHE

SEQ ID NO: 1322692 - protein, 9 aa, Homo Sapiens
LTSIAENME

SEQ ID NO: 1322693 - protein, 9 aa, Homo Sapiens
STSNMVSKL

SEQ ID NO: 1322694 - protein, 9 aa, Homo Sapiens
DILTEKEIF

SEQ ID NO: 1322695 - protein, 9 aa, Homo Sapiens
AHLISAQQK

SEQ ID NO: 1322696 - protein, 9 aa, Homo Sapiens
LNYIRSLIR

SEQ ID NO: 1322697 - protein, 9 aa, Homo Sapiens
SPSSDQQFS

SEQ ID NO: 1322698 - protein, 9 aa, Homo Sapiens
VCVKLGLCR

SEQ ID NO: 1322699 - protein, 9 aa, Homo Sapiens
EARMQVWFQ

SEQ ID NO: 1322700 - protein, 9 aa, Homo Sapiens
SHLLSVLGH

SEQ ID NO: 1322701 - protein, 9 aa, Homo Sapiens
TCNNESEST

SEQ ID NO: 1322702 - protein, 9 aa, Homo Sapiens
EDHNGKSCG

SEQ ID NO: 1322703 - protein, 9 aa, Homo Sapiens
CLSHSVFDY

SEQ ID NO: 1322704 - protein, 9 aa, Homo Sapiens
QEDVATARR

SEQ ID NO: 1322705 - protein, 9 aa, Homo Sapiens
TPLCSPPSP

SEQ ID NO: 1322706 - protein, 9 aa, Homo Sapiens
NSHASWVTN

SEQ ID NO: 1322707 - protein, 9 aa, Homo Sapiens
DTRTREASD

SEQ ID NO: 1322708 - protein, 9 aa, Homo Sapiens
TVPIDHGVR

SEQ ID NO: 1322709 - protein, 9 aa, Homo Sapiens
VLLKMKTSK

SEQ ID NO: 1322710 - protein, 9 aa, Homo Sapiens
LTIDGLVDL

SEQ ID NO: 1322711 - protein, 9 aa, Homo Sapiens
LFACEVATG

SEQ ID NO: 1322712 - protein, 9 aa, Homo Sapiens
ESTRASFSV

SEQ ID NO: 1322713 - protein, 9 aa, Homo Sapiens
PKKLKMKQS

SEQ ID NO: 1322714 - protein, 9 aa, Homo Sapiens
CSNMSCCRC

SEQ ID NO: 1322715 - protein, 9 aa, Homo Sapiens
GAWMKDPLT

SEQ ID NO: 1322716 - protein, 9 aa, Homo Sapiens
QEHTRTEHS

SEQ ID NO: 1322717 - protein, 9 aa, Homo Sapiens
EPPSTVGIR

SEQ ID NO: 1322718 - protein, 9 aa, Homo Sapiens
DTCYRETCP

SEQ ID NO: 1322719 - protein, 9 aa, Homo Sapiens
QQMSLQGMP

SEQ ID NO: 1322720 - protein, 9 aa, Homo Sapiens
ATKMLSWDT

SEQ ID NO: 1322721 - protein, 9 aa, Homo Sapiens
DIFTNLGYR

SEQ ID NO: 1322722 - protein, 9 aa, Homo Sapiens
CWLPFFLAH

SEQ ID NO: 1322723 - protein, 9 aa, Homo Sapiens
QNNPHKNIC

SEQ ID NO: 1322724 - protein, 9 aa, Homo Sapiens
ENMAQKFKE

SEQ ID NO: 1322725 - protein, 9 aa, Homo Sapiens
PPVSPGTVL

SEQ ID NO: 1322726 - protein, 9 aa, Homo Sapiens
SVGGTSAVE

SEQ ID NO: 1322727 - protein, 9 aa, Homo Sapiens
RHHQKTHHL

SEQ ID NO: 1322728 - protein, 9 aa, Homo Sapiens
FATCSSYSG

SEQ ID NO: 1322729 - protein, 9 aa, Homo Sapiens
SRLVVKTTL

SEQ ID NO: 1322730 - protein, 9 aa, Homo Sapiens
IIGHQKNHT

SEQ ID NO: 1322731 - protein, 9 aa, Homo Sapiens
PGHISTSPT

SEQ ID NO: 1322732 - protein, 9 aa, Homo Sapiens
TAEGTSFRL

SEQ ID NO: 1322733 - protein, 9 aa, Homo Sapiens
QLGTQKVAI

SEQ ID NO: 1322734 - protein, 9 aa, Homo Sapiens
LFMDRDSDG

SEQ ID NO: 1322735 - protein, 9 aa, Homo Sapiens
SHQHCLGLG

SEQ ID NO: 1322736 - protein, 9 aa, Homo Sapiens
LYSGHLQVR

SEQ ID NO: 1322737 - protein, 9 aa, Homo Sapiens
EQKYVGKFL

SEQ ID NO: 1322738 - protein, 9 aa, Homo Sapiens
PQQHVLGAQ

SEQ ID NO: 1322739 - protein, 9 aa, Homo Sapiens
DLGNLCYWL

SEQ ID NO: 1322740 - protein, 9 aa, Homo Sapiens
TSSSKINVL

SEQ ID NO: 1322741 - protein, 9 aa, Homo Sapiens
FKSEKGCNK

SEQ ID NO: 1322742 - protein, 9 aa, Homo Sapiens
TQVDMRVAQ

SEQ ID NO: 1322743 - protein, 9 aa, Homo Sapiens
GLDWQCRCD

SEQ ID NO: 1322744 - protein, 9 aa, Homo Sapiens
LPIPHVSES

SEQ ID NO: 1322745 - protein, 9 aa, Homo Sapiens
AALLMEGFL

SEQ ID NO: 1322746 - protein, 9 aa, Homo Sapiens
CGVPVLPAV

SEQ ID NO: 1322747 - protein, 9 aa, Homo Sapiens
PYSQIPPPL

SEQ ID NO: 1322748 - protein, 9 aa, Homo Sapiens
STQDTTSES

SEQ ID NO: 1322749 - protein, 9 aa, Homo Sapiens
GSGLTAADT

SEQ ID NO: 1322750 - protein, 9 aa, Homo Sapiens
CMENTVLAL

SEQ ID NO: 1322751 - protein, 9 aa, Homo Sapiens
SSATTAACA

SEQ ID NO: 1322752 - protein, 9 aa, Homo Sapiens
VFRGANTFE

SEQ ID NO: 1322753 - protein, 9 aa, Homo Sapiens
WATVVLGSL

SEQ ID NO: 1322754 - protein, 9 aa, Homo Sapiens
FPSYLSSKC

SEQ ID NO: 1322755 - protein, 9 aa, Homo Sapiens
PCQMESGYK

SEQ ID NO: 1322756 - protein, 9 aa, Homo Sapiens
MPTKDLHQP

SEQ ID NO: 1322757 - protein, 9 aa, Homo Sapiens
SFHCTSPHK

SEQ ID NO: 1322758 - protein, 9 aa, Homo Sapiens
SCDSAQIWQ

SEQ ID NO: 1322759 - protein, 9 aa, Homo Sapiens
SEKKNFCDK

SEQ ID NO: 1322760 - protein, 9 aa, Homo Sapiens
FALPDDVET

SEQ ID NO: 1322761 - protein, 9 aa, Homo Sapiens
RTIQFVDLC

SEQ ID NO: 1322762 - protein, 9 aa, Homo Sapiens
VSEPNTHNG

SEQ ID NO: 1322763 - protein, 9 aa, Homo Sapiens
GAMGPPERR

SEQ ID NO: 1322764 - protein, 9 aa, Homo Sapiens
VELHDPNSN

SEQ ID NO: 1322765 - protein, 9 aa, Homo Sapiens
ELKCSAMRA

SEQ ID NO: 1322766 - protein, 9 aa, Homo Sapiens
LLGRNTVAG

SEQ ID NO: 1322767 - protein, 9 aa, Homo Sapiens
MHSQPQSRG

SEQ ID NO: 1322768 - protein, 9 aa, Homo Sapiens
AWLSMEMEV

SEQ ID NO: 1322769 - protein, 9 aa, Homo Sapiens
ENRNHLTQI

SEQ ID NO: 1322770 - protein, 9 aa, Homo Sapiens
EDGLPVPSG

SEQ ID NO: 1322771 - protein, 9 aa, Homo Sapiens
FYGQDCQMC

SEQ ID NO: 1322772 - protein, 9 aa, Homo Sapiens
KRHRPQPYP

SEQ ID NO: 1322773 - protein, 9 aa, Homo Sapiens
EKKKRRWGR

SEQ ID NO: 1322774 - protein, 9 aa, Homo Sapiens
HQNNVGRMQ

SEQ ID NO: 1322775 - protein, 9 aa, Homo Sapiens
HSNLVGMGV

SEQ ID NO: 1322776 - protein, 9 aa, Homo Sapiens
VCIWHSSTY

SEQ ID NO: 1322777 - protein, 9 aa, Homo Sapiens
EQMVFLSRS

SEQ ID NO: 1322778 - protein, 9 aa, Homo Sapiens
LKYDLGNTL

SEQ ID NO: 1322779 - protein, 9 aa, Homo Sapiens
ISNILLAYR

SEQ ID NO: 1322780 - protein, 9 aa, Homo Sapiens
RLTHDYLSV

SEQ ID NO: 1322781 - protein, 9 aa, Homo Sapiens
EENTDKSKA

SEQ ID NO: 1322782 - protein, 9 aa, Homo Sapiens
TVGGHPGLT

SEQ ID NO: 1322783 - protein, 9 aa, Homo Sapiens
YCENKCGAH

SEQ ID NO: 1322784 - protein, 9 aa, Homo Sapiens
HHIQNVVTS

SEQ ID NO: 1322785 - protein, 9 aa, Homo Sapiens
LNQYTYTII

SEQ ID NO: 1322786 - protein, 9 aa, Homo Sapiens
FLKFTSVFQ

SEQ ID NO: 1322787 - protein, 9 aa, Homo Sapiens
DYLSVAPFA

SEQ ID NO: 1322788 - protein, 9 aa, Homo Sapiens
TSLKRSLAG

SEQ ID NO: 1322789 - protein, 9 aa, Homo Sapiens
SRETYNVLT

SEQ ID NO: 1322790 - protein, 9 aa, Homo Sapiens
RLSSGLVMA

SEQ ID NO: 1322791 - protein, 9 aa, Homo Sapiens
PPLEDYYEE

SEQ ID NO: 1322792 - protein, 9 aa, Homo Sapiens
NFNYLKSGI

SEQ ID NO: 1322793 - protein, 9 aa, Homo Sapiens
TDRILMKVT

SEQ ID NO: 1322794 - protein, 9 aa, Homo Sapiens
KHLMSPRTG

SEQ ID NO: 1322795 - protein, 9 aa, Homo Sapiens
VKGDTAEME

SEQ ID NO: 1322796 - protein, 9 aa, Homo Sapiens
AHYVLFIVL

SEQ ID NO: 1322797 - protein, 9 aa, Homo Sapiens
LCAHWQVHH

SEQ ID NO: 1322798 - protein, 9 aa, Homo Sapiens
KIFHILVPG

SEQ ID NO: 1322799 - protein, 9 aa, Homo Sapiens
NEYGAWKHH

SEQ ID NO: 1322800 - protein, 9 aa, Homo Sapiens
VATMYHCLQ

SEQ ID NO: 1322801 - protein, 9 aa, Homo Sapiens
DVSIRCQAI

SEQ ID NO: 1322802 - protein, 9 aa, Homo Sapiens
LDLLELPIA

SEQ ID NO: 1322803 - protein, 9 aa, Homo Sapiens
KNIQTSESY

SEQ ID NO: 1322804 - protein, 9 aa, Homo Sapiens
CLCVAVIVT

SEQ ID NO: 1322805 - protein, 9 aa, Homo Sapiens
AWTFHSVAE

SEQ ID NO: 1322806 - protein, 9 aa, Homo Sapiens
GATYTVIEA

SEQ ID NO: 1322807 - protein, 9 aa, Homo Sapiens
WTDSHLRFN

SEQ ID NO: 1322808 - protein, 9 aa, Homo Sapiens
LVNVPSHQG

SEQ ID NO: 1322809 - protein, 9 aa, Homo Sapiens
EIESYDYTT

SEQ ID NO: 1322810 - protein, 9 aa, Homo Sapiens
GTMPRPGIK

SEQ ID NO: 1322811 - protein, 9 aa, Homo Sapiens
DAYCQALPQ

SEQ ID NO: 1322812 - protein, 9 aa, Homo Sapiens
VPFPYLYLR

SEQ ID NO: 1322813 - protein, 9 aa, Homo Sapiens
QVSRRFGSH

SEQ ID NO: 1322814 - protein, 9 aa, Homo Sapiens
RAQNSSGTL

SEQ ID NO: 1322815 - protein, 9 aa, Homo Sapiens
YHIFRLPNN

SEQ ID NO: 1322816 - protein, 9 aa, Homo Sapiens
VGAQGVNNT

SEQ ID NO: 1322817 - protein, 9 aa, Homo Sapiens
SLVDEAKQR

SEQ ID NO: 1322818 - protein, 9 aa, Homo Sapiens
QLANEQKPS

SEQ ID NO: 1322819 - protein, 9 aa, Homo Sapiens
LYLTPMLGL

SEQ ID NO: 1322820 - protein, 9 aa, Homo Sapiens
VSGSSDDLV

SEQ ID NO: 1322821 - protein, 9 aa, Homo Sapiens
VAMATVAGA

SEQ ID NO: 1322822 - protein, 9 aa, Homo Sapiens
LTHTTPAVE

SEQ ID NO: 1322823 - protein, 9 aa, Homo Sapiens
EGDVGFGRS

SEQ ID NO: 1322824 - protein, 9 aa, Homo Sapiens
DEITQMMVY

SEQ ID NO: 1322825 - protein, 9 aa, Homo Sapiens
QQQASVTTG

SEQ ID NO: 1322826 - protein, 9 aa, Homo Sapiens
GVQVPVLHE

SEQ ID NO: 1322827 - protein, 9 aa, Homo Sapiens
THHKSSEED

SEQ ID NO: 1322828 - protein, 9 aa, Homo Sapiens
CQRFPTLTV

SEQ ID NO: 1322829 - protein, 9 aa, Homo Sapiens
SAPGLLSMV

SEQ ID NO: 1322830 - protein, 9 aa, Homo Sapiens
IDTSMRGGH

SEQ ID NO: 1322831 - protein, 9 aa, Homo Sapiens
RRRSWQRRR

SEQ ID NO: 1322832 - protein, 9 aa, Homo Sapiens
VMVKRKWTR

SEQ ID NO: 1322833 - protein, 9 aa, Homo Sapiens
PEASVSSKS

SEQ ID NO: 1322834 - protein, 9 aa, Homo Sapiens
RFFSYFRSW

SEQ ID NO: 1322835 - protein, 9 aa, Homo Sapiens
MMDVDMYIN

SEQ ID NO: 1322836 - protein, 9 aa, Homo Sapiens
ADYPEGDDN

SEQ ID NO: 1322837 - protein, 9 aa, Homo Sapiens
TCLASLSIL

SEQ ID NO: 1322838 - protein, 9 aa, Homo Sapiens
LCESCRARL

SEQ ID NO: 1322839 - protein, 9 aa, Homo Sapiens
ALFAAVIHD

SEQ ID NO: 1322840 - protein, 9 aa, Homo Sapiens
EEDKGILND

SEQ ID NO: 1322841 - protein, 9 aa, Homo Sapiens
PSQSTTDTS

SEQ ID NO: 1322842 - protein, 9 aa, Homo Sapiens
SEMTWRAMG

SEQ ID NO: 1322843 - protein, 9 aa, Homo Sapiens
PFTIVTSNI

SEQ ID NO: 1322844 - protein, 9 aa, Homo Sapiens
IERRAVVPG

SEQ ID NO: 1322845 - protein, 9 aa, Homo Sapiens
VLQSLHLMI

SEQ ID NO: 1322846 - protein, 9 aa, Homo Sapiens
RCLSSLNDE

SEQ ID NO: 1322847 - protein, 9 aa, Homo Sapiens
VLTSLLPII

SEQ ID NO: 1322848 - protein, 9 aa, Homo Sapiens
SPRLRSIFF

SEQ ID NO: 1322849 - protein, 9 aa, Homo Sapiens
SRLAAASGP

SEQ ID NO: 1322850 - protein, 9 aa, Homo Sapiens
ISIHQPGVQ

SEQ ID NO: 1322851 - protein, 9 aa, Homo Sapiens
MVCHKLGNI

SEQ ID NO: 1322852 - protein, 9 aa, Homo Sapiens
LLDVIFMKG

SEQ ID NO: 1322853 - protein, 9 aa, Homo Sapiens
MRALQGGLR

SEQ ID NO: 1322854 - protein, 9 aa, Homo Sapiens
ALTREGLPV

SEQ ID NO: 1322855 - protein, 9 aa, Homo Sapiens
KMTAVRGLR

SEQ ID NO: 1322856 - protein, 9 aa, Homo Sapiens
SNGVLIPGN

SEQ ID NO: 1322857 - protein, 9 aa, Homo Sapiens
NEKCILQAV

SEQ ID NO: 1322858 - protein, 9 aa, Homo Sapiens
LAADDPEVW

SEQ ID NO: 1322859 - protein, 9 aa, Homo Sapiens
CMHGYIFGN

SEQ ID NO: 1322860 - protein, 9 aa, Homo Sapiens
RITQDLGLE

SEQ ID NO: 1322861 - protein, 9 aa, Homo Sapiens
TRDARVVGL

SEQ ID NO: 1322862 - protein, 9 aa, Homo Sapiens
PESSAEQLR

SEQ ID NO: 1322863 - protein, 9 aa, Homo Sapiens
EGLSRHQVL

SEQ ID NO: 1322864 - protein, 9 aa, Homo Sapiens
LKMLIMMVV

SEQ ID NO: 1322865 - protein, 9 aa, Homo Sapiens
CQLEQENAS

SEQ ID NO: 1322866 - protein, 9 aa, Homo Sapiens
ERELKLYWG

SEQ ID NO: 1322867 - protein, 9 aa, Homo Sapiens
RNYVSSLKW

SEQ ID NO: 1322868 - protein, 9 aa, Homo Sapiens
HYWNIGPQK

SEQ ID NO: 1322869 - protein, 9 aa, Homo Sapiens
KNLNRSGKC

SEQ ID NO: 1322870 - protein, 9 aa, Homo Sapiens
KGGNKKFFG

SEQ ID NO: 1322871 - protein, 9 aa, Homo Sapiens
VGTGFCDGL

SEQ ID NO: 1322872 - protein, 9 aa, Homo Sapiens
KQGSKGSDD

SEQ ID NO: 1322873 - protein, 9 aa, Homo Sapiens
YKNHYHQST

SEQ ID NO: 1322874 - protein, 9 aa, Homo Sapiens
IICQSLAWR

SEQ ID NO: 1322875 - protein, 9 aa, Homo Sapiens
DSSLATNLQ

SEQ ID NO: 1322876 - protein, 9 aa, Homo Sapiens
TQYQDYSMS

SEQ ID NO: 1322877 - protein, 9 aa, Homo Sapiens
GDSHRNIIM

SEQ ID NO: 1322878 - protein, 9 aa, Homo Sapiens
CLTHKEFRS

SEQ ID NO: 1322879 - protein, 9 aa, Homo Sapiens
NDQSPMAAL

SEQ ID NO: 1322880 - protein, 9 aa, Homo Sapiens
LMLRHGWCT

SEQ ID NO: 1322881 - protein, 9 aa, Homo Sapiens
MVIIFTRKE

SEQ ID NO: 1322882 - protein, 9 aa, Homo Sapiens
LQYQSSQTH

SEQ ID NO: 1322883 - protein, 9 aa, Homo Sapiens
VKWGEENTD

SEQ ID NO: 1322884 - protein, 9 aa, Homo Sapiens
YCQALPQVR

SEQ ID NO: 1322885 - protein, 9 aa, Homo Sapiens
GINFCDSAQ

SEQ ID NO: 1322886 - protein, 9 aa, Homo Sapiens
YSVDPYNPS

SEQ ID NO: 1322887 - protein, 9 aa, Homo Sapiens
YKHFFSLPD

SEQ ID NO: 1322888 - protein, 9 aa, Homo Sapiens
TKSDTSCMS

SEQ ID NO: 1322889 - protein, 9 aa, Homo Sapiens
VLIVIFSLF

SEQ ID NO: 1322890 - protein, 9 aa, Homo Sapiens
LGTSQHRRK

SEQ ID NO: 1322891 - protein, 9 aa, Homo Sapiens
STPLEVSFP

SEQ ID NO: 1322892 - protein, 9 aa, Homo Sapiens
PLPQKDHFA

SEQ ID NO: 1322893 - protein, 9 aa, Homo Sapiens
NADIDLKYD

SEQ ID NO: 1322894 - protein, 9 aa, Homo Sapiens
FGHHMAVLH

SEQ ID NO: 1322895 - protein, 9 aa, Homo Sapiens
VQEEDRRKE

SEQ ID NO: 1322896 - protein, 9 aa, Homo Sapiens
ENSSRDLAF

SEQ ID NO: 1322897 - protein, 9 aa, Homo Sapiens
VGECSSIGS

SEQ ID NO: 1322898 - protein, 9 aa, Homo Sapiens
PAWYGNQNP

SEQ ID NO: 1322899 - protein, 9 aa, Homo Sapiens
CPQQHVLGA

SEQ ID NO: 1322900 - protein, 9 aa, Homo Sapiens
INFCDSAQA

SEQ ID NO: 1322901 - protein, 9 aa, Homo Sapiens
GDISKITPR

SEQ ID NO: 1322902 - protein, 9 aa, Homo Sapiens
HVPLFIMFT

SEQ ID NO: 1322903 - protein, 9 aa, Homo Sapiens
TCGWDNLLA

SEQ ID NO: 1322904 - protein, 9 aa, Homo Sapiens
NSAVTHLVG

SEQ ID NO: 1322905 - protein, 9 aa, Homo Sapiens
HIAEVAKLF

SEQ ID NO: 1322906 - protein, 9 aa, Homo Sapiens
LKEMCSDVM

SEQ ID NO: 1322907 - protein, 9 aa, Homo Sapiens
EGDAPAKLF

SEQ ID NO: 1322908 - protein, 9 aa, Homo Sapiens
YLKSVHYIE

SEQ ID NO: 1322909 - protein, 9 aa, Homo Sapiens
SQPYMRRMV

SEQ ID NO: 1322910 - protein, 9 aa, Homo Sapiens
RGRGREENL

SEQ ID NO: 1322911 - protein, 9 aa, Homo Sapiens
QELSPTEEE

SEQ ID NO: 1322912 - protein, 9 aa, Homo Sapiens
HPNTWGASP

SEQ ID NO: 1322913 - protein, 9 aa, Homo Sapiens
ARDHREGDV

SEQ ID NO: 1322914 - protein, 9 aa, Homo Sapiens
KLKEVGYSM

SEQ ID NO: 1322915 - protein, 9 aa, Homo Sapiens
TMNYLQLYN

SEQ ID NO: 1322916 - protein, 9 aa, Homo Sapiens
CAPTPLSMT

SEQ ID NO: 1322917 - protein, 9 aa, Homo Sapiens
NRWGSDSEK

SEQ ID NO: 1322918 - protein, 9 aa, Homo Sapiens
RYSSGYSTQ

SEQ ID NO: 1322919 - protein, 9 aa, Homo Sapiens
SVNWMRYVN

SEQ ID NO: 1322920 - protein, 9 aa, Homo Sapiens
ATAAPHRKR

SEQ ID NO: 1322921 - protein, 9 aa, Homo Sapiens
SDSENMLCD

SEQ ID NO: 1322922 - protein, 9 aa, Homo Sapiens
CMVLRATEA

SEQ ID NO: 1322923 - protein, 9 aa, Homo Sapiens
FSPLCDHTS

SEQ ID NO: 1322924 - protein, 9 aa, Homo Sapiens
TLVIFQLYE

SEQ ID NO: 1322925 - protein, 9 aa, Homo Sapiens
NIPHAYLKG

SEQ ID NO: 1322926 - protein, 9 aa, Homo Sapiens
HLSRFNVCN

SEQ ID NO: 1322927 - protein, 9 aa, Homo Sapiens
GKQPKLMDG

SEQ ID NO: 1322928 - protein, 9 aa, Homo Sapiens
TRHKVDWLT

SEQ ID NO: 1322929 - protein, 9 aa, Homo Sapiens
SAVTVTVGA

SEQ ID NO: 1322930 - protein, 9 aa, Homo Sapiens
HIDSSNFNP

SEQ ID NO: 1322931 - protein, 9 aa, Homo Sapiens
ANCVIQRRA

SEQ ID NO: 1322932 - protein, 9 aa, Homo Sapiens
PQGDDNHWW

SEQ ID NO: 1322933 - protein, 9 aa, Homo Sapiens
SRYFTTYDM

SEQ ID NO: 1322934 - protein, 9 aa, Homo Sapiens
ASRSLDDVR

SEQ ID NO: 1322935 - protein, 9 aa, Homo Sapiens
IVFCHLADH

SEQ ID NO: 1322936 - protein, 9 aa, Homo Sapiens
DMSPILALS

SEQ ID NO: 1322937 - protein, 9 aa, Homo Sapiens
LPSGTEISG

SEQ ID NO: 1322938 - protein, 9 aa, Homo Sapiens
KRHATEKQK

SEQ ID NO: 1322939 - protein, 9 aa, Homo Sapiens
PSVALPAPA

SEQ ID NO: 1322940 - protein, 9 aa, Homo Sapiens
APYIPELWG

SEQ ID NO: 1322941 - protein, 9 aa, Homo Sapiens
SKQLQIQLD

SEQ ID NO: 1322942 - protein, 9 aa, Homo Sapiens
VFIFLWYPL

SEQ ID NO: 1322943 - protein, 9 aa, Homo Sapiens
TMAGHHRVM

SEQ ID NO: 1322944 - protein, 9 aa, Homo Sapiens
SSAPTAGRA

SEQ ID NO: 1322945 - protein, 9 aa, Homo Sapiens
KIPSNNITC

SEQ ID NO: 1322946 - protein, 9 aa, Homo Sapiens
DMRFTRQYR

SEQ ID NO: 1322947 - protein, 9 aa, Homo Sapiens
IIVSTTGPN

SEQ ID NO: 1322948 - protein, 9 aa, Homo Sapiens
EVTMVLVSW

SEQ ID NO: 1322949 - protein, 9 aa, Homo Sapiens
EGFQAAHTL

SEQ ID NO: 1322950 - protein, 9 aa, Homo Sapiens
QCALHFAIS

SEQ ID NO: 1322951 - protein, 9 aa, Homo Sapiens
ESVNDLIRY

SEQ ID NO: 1322952 - protein, 9 aa, Homo Sapiens
IIRSCMVLR

SEQ ID NO: 1322953 - protein, 9 aa, Homo Sapiens
KRCSAKEVE

SEQ ID NO: 1322954 - protein, 9 aa, Homo Sapiens
ESCWKQYLE

SEQ ID NO: 1322955 - protein, 9 aa, Homo Sapiens
VKTPNTEMR

SEQ ID NO: 1322956 - protein, 9 aa, Homo Sapiens
VKVVNAVGM

SEQ ID NO: 1322957 - protein, 9 aa, Homo Sapiens
RCCDHMIRS

SEQ ID NO: 1322958 - protein, 9 aa, Homo Sapiens
TVGALLVYD

SEQ ID NO: 1322959 - protein, 9 aa, Homo Sapiens
MSPPACADP

SEQ ID NO: 1322960 - protein, 9 aa, Homo Sapiens
HKDMVCIPV

SEQ ID NO: 1322961 - protein, 9 aa, Homo Sapiens
HNLRSFTER

SEQ ID NO: 1322962 - protein, 9 aa, Homo Sapiens
YNSMNDGFF

SEQ ID NO: 1322963 - protein, 9 aa, Homo Sapiens
HRRRLAVPA

SEQ ID NO: 1322964 - protein, 9 aa, Homo Sapiens
MSPNDSPYQ

SEQ ID NO: 1322965 - protein, 9 aa, Homo Sapiens
EVEELRKCV

SEQ ID NO: 1322966 - protein, 9 aa, Homo Sapiens
VSSRRKGCS

SEQ ID NO: 1322967 - protein, 9 aa, Homo Sapiens
QELRSGPHR

SEQ ID NO: 1322968 - protein, 9 aa, Homo Sapiens
ELESDDILI

SEQ ID NO: 1322969 - protein, 9 aa, Homo Sapiens
KTAVMSLIQ

SEQ ID NO: 1322970 - protein, 9 aa, Homo Sapiens
SPTSQSYSY

SEQ ID NO: 1322971 - protein, 9 aa, Homo Sapiens
PERIADNFK

SEQ ID NO: 1322972 - protein, 9 aa, Homo Sapiens
LPGRKRKRC

SEQ ID NO: 1322973 - protein, 9 aa, Homo Sapiens
SIVGSKFTG

SEQ ID NO: 1322974 - protein, 9 aa, Homo Sapiens
PRSMLCSYR

SEQ ID NO: 1322975 - protein, 9 aa, Homo Sapiens
ILNLLCKHQ

SEQ ID NO: 1322976 - protein, 9 aa, Homo Sapiens
QEPSMTSVT

SEQ ID NO: 1322977 - protein, 9 aa, Homo Sapiens
PDGQEMGLS

SEQ ID NO: 1322978 - protein, 9 aa, Homo Sapiens
IAGMYKQCL

SEQ ID NO: 1322979 - protein, 9 aa, Homo Sapiens
LTRTIGDRM

SEQ ID NO: 1322980 - protein, 9 aa, Homo Sapiens
FAWEHNEYL

SEQ ID NO: 1322981 - protein, 9 aa, Homo Sapiens
VMRGEGTFT

SEQ ID NO: 1322982 - protein, 9 aa, Homo Sapiens
KFFFDNLVY

SEQ ID NO: 1322983 - protein, 9 aa, Homo Sapiens
AADGYQCCM

SEQ ID NO: 1322984 - protein, 9 aa, Homo Sapiens
KNLFKVPGN

SEQ ID NO: 1322985 - protein, 9 aa, Homo Sapiens
RNDANPGIC

SEQ ID NO: 1322986 - protein, 9 aa, Homo Sapiens
LPIKLARYR

SEQ ID NO: 1322987 - protein, 9 aa, Homo Sapiens
NYGKKCWTS

SEQ ID NO: 1322988 - protein, 9 aa, Homo Sapiens
FHGLGSRPP

SEQ ID NO: 1322989 - protein, 9 aa, Homo Sapiens
PHIVYAMAA

SEQ ID NO: 1322990 - protein, 9 aa, Homo Sapiens
VIKRTSPSD

SEQ ID NO: 1322991 - protein, 9 aa, Homo Sapiens
CKKLQKKKN

SEQ ID NO: 1322992 - protein, 9 aa, Homo Sapiens
SPKGERHME

SEQ ID NO: 1322993 - protein, 9 aa, Homo Sapiens
MNPVAAKKN

SEQ ID NO: 1322994 - protein, 9 aa, Homo Sapiens
TMLSTHTKC

SEQ ID NO: 1322995 - protein, 9 aa, Homo Sapiens
TPLPSAYVP

SEQ ID NO: 1322996 - protein, 9 aa, Homo Sapiens
IRDLQTTHS

SEQ ID NO: 1322997 - protein, 9 aa, Homo Sapiens
TKMDGNWRW

SEQ ID NO: 1322998 - protein, 9 aa, Homo Sapiens
QNTLPSFYH

SEQ ID NO: 1322999 - protein, 9 aa, Homo Sapiens
STPGRSRLS

SEQ ID NO: 1323000 - protein, 9 aa, Homo Sapiens
QHFGYVQHY

SEQ ID NO: 1323001 - protein, 9 aa, Homo Sapiens
NWAQAVNSG

SEQ ID NO: 1323002 - protein, 9 aa, Homo Sapiens
KVAAGELQE

SEQ ID NO: 1323003 - protein, 9 aa, Homo Sapiens
RFTYTVLLD

SEQ ID NO: 1323004 - protein, 9 aa, Homo Sapiens
TNLEYHRTE

SEQ ID NO: 1323005 - protein, 9 aa, Homo Sapiens
QVRLQQSFP

SEQ ID NO: 1323006 - protein, 9 aa, Homo Sapiens
HAPVGHNAP

SEQ ID NO: 1323007 - protein, 9 aa, Homo Sapiens
ALLVLLSFA

SEQ ID NO: 1323008 - protein, 9 aa, Homo Sapiens
VRVDLEYVN

SEQ ID NO: 1323009 - protein, 9 aa, Homo Sapiens
VLLPPVFID

SEQ ID NO: 1323010 - protein, 9 aa, Homo Sapiens
SKMTTFFTE

SEQ ID NO: 1323011 - protein, 9 aa, Homo Sapiens
QELRALRGR

SEQ ID NO: 1323012 - protein, 9 aa, Homo Sapiens
MTAVRGLRH

SEQ ID NO: 1323013 - protein, 9 aa, Homo Sapiens
LGGHTEPVM

SEQ ID NO: 1323014 - protein, 9 aa, Homo Sapiens
FDNNIQLFL

SEQ ID NO: 1323015 - protein, 9 aa, Homo Sapiens
SEKVDKAQC

SEQ ID NO: 1323016 - protein, 9 aa, Homo Sapiens
ITCGRWHTL

SEQ ID NO: 1323017 - protein, 9 aa, Homo Sapiens
IRQKVGTFQ

SEQ ID NO: 1323018 - protein, 9 aa, Homo Sapiens
PQTNTWNFI

SEQ ID NO: 1323019 - protein, 9 aa, Homo Sapiens
ELLKKCSLY

SEQ ID NO: 1323020 - protein, 9 aa, Homo Sapiens
LKARMRQIS

SEQ ID NO: 1323021 - protein, 9 aa, Homo Sapiens
HVFEILSHL

SEQ ID NO: 1323022 - protein, 9 aa, Homo Sapiens
DTNGLVRAL

SEQ ID NO: 1323023 - protein, 9 aa, Homo Sapiens
FILVIVGLI

SEQ ID NO: 1323024 - protein, 9 aa, Homo Sapiens
AGHCYKSHI

SEQ ID NO: 1323025 - protein, 9 aa, Homo Sapiens
FCYPCSLFQ

SEQ ID NO: 1323026 - protein, 9 aa, Homo Sapiens
LGYNMYASR

SEQ ID NO: 1323027 - protein, 9 aa, Homo Sapiens
VKKLYLIDC

SEQ ID NO: 1323028 - protein, 9 aa, Homo Sapiens
SRGFTFVTF

SEQ ID NO: 1323029 - protein, 9 aa, Homo Sapiens
WCHMTQEEH

SEQ ID NO: 1323030 - protein, 9 aa, Homo Sapiens
TLPANFWVT

SEQ ID NO: 1323031 - protein, 9 aa, Homo Sapiens
QNSSGTLSS

SEQ ID NO: 1323032 - protein, 9 aa, Homo Sapiens
VVPLMPDQQ

SEQ ID NO: 1323033 - protein, 9 aa, Homo Sapiens
DSDMDYIQI

SEQ ID NO: 1323034 - protein, 9 aa, Homo Sapiens
PVGESKHHP

SEQ ID NO: 1323035 - protein, 9 aa, Homo Sapiens
HCCLPQPGE

SEQ ID NO: 1323036 - protein, 9 aa, Homo Sapiens
LAHLTPLFD

SEQ ID NO: 1323037 - protein, 9 aa, Homo Sapiens
FLVLLVDVT

SEQ ID NO: 1323038 - protein, 9 aa, Homo Sapiens
VDLTSIAEN

SEQ ID NO: 1323039 - protein, 9 aa, Homo Sapiens
RRTIDIYML

SEQ ID NO: 1323040 - protein, 9 aa, Homo Sapiens
KFTSVFQPP

SEQ ID NO: 1323041 - protein, 9 aa, Homo Sapiens
TTADFLDAL

SEQ ID NO: 1323042 - protein, 9 aa, Homo Sapiens
KTEGDAPAK

SEQ ID NO: 1323043 - protein, 9 aa, Homo Sapiens
RGTAEWMSF

SEQ ID NO: 1323044 - protein, 9 aa, Homo Sapiens
SNPIDEMTE

SEQ ID NO: 1323045 - protein, 9 aa, Homo Sapiens
LRASLVEIA

SEQ ID NO: 1323046 - protein, 9 aa, Homo Sapiens
SFSWCSRLQ

SEQ ID NO: 1323047 - protein, 9 aa, Homo Sapiens
DVAPVTKDN

SEQ ID NO: 1323048 - protein, 9 aa, Homo Sapiens
GWIVADNCD

SEQ ID NO: 1323049 - protein, 9 aa, Homo Sapiens
KNQKDSGVL

SEQ ID NO: 1323050 - protein, 9 aa, Homo Sapiens
KIPKTQVSS

SEQ ID NO: 1323051 - protein, 9 aa, Homo Sapiens
QHQQMMHWL

SEQ ID NO: 1323052 - protein, 9 aa, Homo Sapiens
FVSPESDFE

SEQ ID NO: 1323053 - protein, 9 aa, Homo Sapiens
MRLDMMDEE

SEQ ID NO: 1323054 - protein, 9 aa, Homo Sapiens
PMVPRELPT

SEQ ID NO: 1323055 - protein, 9 aa, Homo Sapiens
ADVFAQINC

SEQ ID NO: 1323056 - protein, 9 aa, Homo Sapiens
YFTTYDMNG

SEQ ID NO: 1323057 - protein, 9 aa, Homo Sapiens
GMLTGQAYK

SEQ ID NO: 1323058 - protein, 9 aa, Homo Sapiens
EWEERVVNH

SEQ ID NO: 1323059 - protein, 9 aa, Homo Sapiens
QVETQPRVV

SEQ ID NO: 1323060 - protein, 9 aa, Homo Sapiens
PLGQTNPTF

SEQ ID NO: 1323061 - protein, 9 aa, Homo Sapiens
AVKVNSAVT

SEQ ID NO: 1323062 - protein, 9 aa, Homo Sapiens
QTAQTEGIF

SEQ ID NO: 1323063 - protein, 9 aa, Homo Sapiens
LYLSSPCFL

SEQ ID NO: 1323064 - protein, 9 aa, Homo Sapiens
DIWKADPGM

SEQ ID NO: 1323065 - protein, 9 aa, Homo Sapiens
IWYVHFLWE

SEQ ID NO: 1323066 - protein, 9 aa, Homo Sapiens
NTSETPATR

SEQ ID NO: 1323067 - protein, 9 aa, Homo Sapiens
SRSFFLWNS

SEQ ID NO: 1323068 - protein, 9 aa, Homo Sapiens
KERFDNEMK

SEQ ID NO: 1323069 - protein, 9 aa, Homo Sapiens
AKGSSATTA

SEQ ID NO: 1323070 - protein, 9 aa, Homo Sapiens
VFCHLADHG

SEQ ID NO: 1323071 - protein, 9 aa, Homo Sapiens
DIDEDERNV

SEQ ID NO: 1323072 - protein, 9 aa, Homo Sapiens
EPVIAGLMK

SEQ ID NO: 1323073 - protein, 9 aa, Homo Sapiens
PTFWSTGAS

SEQ ID NO: 1323074 - protein, 9 aa, Homo Sapiens
MTHPLCKCG

SEQ ID NO: 1323075 - protein, 9 aa, Homo Sapiens
EDDVCFEHQ

SEQ ID NO: 1323076 - protein, 9 aa, Homo Sapiens
LHPINTLFF

SEQ ID NO: 1323077 - protein, 9 aa, Homo Sapiens
DKYSMVELH

SEQ ID NO: 1323078 - protein, 9 aa, Homo Sapiens
RMHNHPPRK

SEQ ID NO: 1323079 - protein, 9 aa, Homo Sapiens
MATQAPGSW

SEQ ID NO: 1323080 - protein, 9 aa, Homo Sapiens
VMTMFYPAD

SEQ ID NO: 1323081 - protein, 9 aa, Homo Sapiens
SYSKVYDPE

SEQ ID NO: 1323082 - protein, 9 aa, Homo Sapiens
FEGNIMSPT

SEQ ID NO: 1323083 - protein, 9 aa, Homo Sapiens
CRTYFTPHW

SEQ ID NO: 1323084 - protein, 9 aa, Homo Sapiens
APEFLVLLV

SEQ ID NO: 1323085 - protein, 9 aa, Homo Sapiens
GPHSLEGAD

SEQ ID NO: 1323086 - protein, 9 aa, Homo Sapiens
HRRKSLPVH

SEQ ID NO: 1323087 - protein, 9 aa, Homo Sapiens
RHVSHSQYQ

SEQ ID NO: 1323088 - protein, 9 aa, Homo Sapiens
EFVIVERIP

SEQ ID NO: 1323089 - protein, 9 aa, Homo Sapiens
DQLRFSGLP

SEQ ID NO: 1323090 - protein, 9 aa, Homo Sapiens
FFAKKQICL

SEQ ID NO: 1323091 - protein, 9 aa, Homo Sapiens
VKGKPDLNM

SEQ ID NO: 1323092 - protein, 9 aa, Homo Sapiens
QTPRKMRHM

SEQ ID NO: 1323093 - protein, 9 aa, Homo Sapiens
ECKEYGKAF

SEQ ID NO: 1323094 - protein, 9 aa, Homo Sapiens
VTQPNTKYI

SEQ ID NO: 1323095 - protein, 9 aa, Homo Sapiens
GMLHFLLGD

SEQ ID NO: 1323096 - protein, 9 aa, Homo Sapiens
RKSNCSHCV

SEQ ID NO: 1323097 - protein, 9 aa, Homo Sapiens
MGINYHFHS

SEQ ID NO: 1323098 - protein, 9 aa, Homo Sapiens
QGTGCIADL

SEQ ID NO: 1323099 - protein, 9 aa, Homo Sapiens
PSSVTESDG

SEQ ID NO: 1323100 - protein, 9 aa, Homo Sapiens
TRKVNYLMS

SEQ ID NO: 1323101 - protein, 9 aa, Homo Sapiens
HQHCLGLGV

SEQ ID NO: 1323102 - protein, 9 aa, Homo Sapiens
GDNAHPLWK

SEQ ID NO: 1323103 - protein, 9 aa, Homo Sapiens
NTTRGFICK

SEQ ID NO: 1323104 - protein, 9 aa, Homo Sapiens
MVCIPVGSR

SEQ ID NO: 1323105 - protein, 9 aa, Homo Sapiens
ALLTQCNRT

SEQ ID NO: 1323106 - protein, 9 aa, Homo Sapiens
LMAMRCLGL

SEQ ID NO: 1323107 - protein, 9 aa, Homo Sapiens
VSCFSDGYP

SEQ ID NO: 1323108 - protein, 9 aa, Homo Sapiens
EYHKIKATN

SEQ ID NO: 1323109 - protein, 9 aa, Homo Sapiens
FCIWAVAWV

SEQ ID NO: 1323110 - protein, 9 aa, Homo Sapiens
NLQFKAEHI

SEQ ID NO: 1323111 - protein, 9 aa, Homo Sapiens
QESSSPSTL

SEQ ID NO: 1323112 - protein, 9 aa, Homo Sapiens
VRQPTQLTQ

SEQ ID NO: 1323113 - protein, 9 aa, Homo Sapiens
NTKTCTKEP

SEQ ID NO: 1323114 - protein, 9 aa, Homo Sapiens
VESTYSQLG

SEQ ID NO: 1323115 - protein, 9 aa, Homo Sapiens
MLINVPMDS

SEQ ID NO: 1323116 - protein, 9 aa, Homo Sapiens
LTSLLETFA

SEQ ID NO: 1323117 - protein, 9 aa, Homo Sapiens
TTKTHWYSG

SEQ ID NO: 1323118 - protein, 9 aa, Homo Sapiens
HLERLQIDE

SEQ ID NO: 1323119 - protein, 9 aa, Homo Sapiens
QPAWALADT

SEQ ID NO: 1323120 - protein, 9 aa, Homo Sapiens
YVVVQVMLN

SEQ ID NO: 1323121 - protein, 9 aa, Homo Sapiens
MNITCVAVG

SEQ ID NO: 1323122 - protein, 9 aa, Homo Sapiens
KEVERVVGQ

SEQ ID NO: 1323123 - protein, 9 aa, Homo Sapiens
DLTARNCLV

SEQ ID NO: 1323124 - protein, 9 aa, Homo Sapiens
TIDNLPVNL

SEQ ID NO: 1323125 - protein, 9 aa, Homo Sapiens
HILEMLVLE

SEQ ID NO: 1323126 - protein, 9 aa, Homo Sapiens
DHNGKSCGL

SEQ ID NO: 1323127 - protein, 9 aa, Homo Sapiens
HIPPAYTKV

SEQ ID NO: 1323128 - protein, 9 aa, Homo Sapiens
PMTKHPGKR

SEQ ID NO: 1323129 - protein, 9 aa, Homo Sapiens
EFKKTTELT

SEQ ID NO: 1323130 - protein, 9 aa, Homo Sapiens
MCGSALTFF

SEQ ID NO: 1323131 - protein, 9 aa, Homo Sapiens
LRYSSGYST

SEQ ID NO: 1323132 - protein, 9 aa, Homo Sapiens
RKITVVEED

SEQ ID NO: 1323133 - protein, 9 aa, Homo Sapiens
QPPVSPGTV

SEQ ID NO: 1323134 - protein, 9 aa, Homo Sapiens
AGWELPDYL

SEQ ID NO: 1323135 - protein, 9 aa, Homo Sapiens
HELGVAVDA

SEQ ID NO: 1323136 - protein, 9 aa, Homo Sapiens
PITGRTHQL

SEQ ID NO: 1323137 - protein, 9 aa, Homo Sapiens
VLRHTSLWP

SEQ ID NO: 1323138 - protein, 9 aa, Homo Sapiens
WQGSKPREH

SEQ ID NO: 1323139 - protein, 9 aa, Homo Sapiens
DEHILQFLC

SEQ ID NO: 1323140 - protein, 9 aa, Homo Sapiens
TVIKPVKPR

SEQ ID NO: 1323141 - protein, 9 aa, Homo Sapiens
PLGGFQIHP

SEQ ID NO: 1323142 - protein, 9 aa, Homo Sapiens
ACHTSHRLI

SEQ ID NO: 1323143 - protein, 9 aa, Homo Sapiens
WPSSSTNTC

SEQ ID NO: 1323144 - protein, 9 aa, Homo Sapiens
HVNGLTLVS

SEQ ID NO: 1323145 - protein, 9 aa, Homo Sapiens
KKKDVCIEA

SEQ ID NO: 1323146 - protein, 9 aa, Homo Sapiens
KKVLNKYGK

SEQ ID NO: 1323147 - protein, 9 aa, Homo Sapiens
AGIGAGMDS

SEQ ID NO: 1323148 - protein, 9 aa, Homo Sapiens
CLQREDWLG

SEQ ID NO: 1323149 - protein, 9 aa, Homo Sapiens
KDDTTRELK

SEQ ID NO: 1323150 - protein, 9 aa, Homo Sapiens
QVSASTDGV

SEQ ID NO: 1323151 - protein, 9 aa, Homo Sapiens
TDKHFNIFS

SEQ ID NO: 1323152 - protein, 9 aa, Homo Sapiens
MFYCVHWQT

SEQ ID NO: 1323153 - protein, 9 aa, Homo Sapiens
IIIIKDNMA

SEQ ID NO: 1323154 - protein, 9 aa, Homo Sapiens
DDHLSRYQN

SEQ ID NO: 1323155 - protein, 9 aa, Homo Sapiens
QVLYLMFDT

SEQ ID NO: 1323156 - protein, 9 aa, Homo Sapiens
IKGFRYQSL

SEQ ID NO: 1323157 - protein, 9 aa, Homo Sapiens
SVTESDGSP

SEQ ID NO: 1323158 - protein, 9 aa, Homo Sapiens
NRNSYMILH

SEQ ID NO: 1323159 - protein, 9 aa, Homo Sapiens
VSFFIITAV

SEQ ID NO: 1323160 - protein, 9 aa, Homo Sapiens
CHTSNSQGQ

SEQ ID NO: 1323161 - protein, 9 aa, Homo Sapiens
LHLMIPEIS

SEQ ID NO: 1323162 - protein, 9 aa, Homo Sapiens
TPGPPRSMP

SEQ ID NO: 1323163 - protein, 9 aa, Homo Sapiens
SRTNGSVTT

SEQ ID NO: 1323164 - protein, 9 aa, Homo Sapiens
PSLTQPELD

SEQ ID NO: 1323165 - protein, 9 aa, Homo Sapiens
SAYLQEQRR

SEQ ID NO: 1323166 - protein, 9 aa, Homo Sapiens
ALHTIHTAG

SEQ ID NO: 1323167 - protein, 9 aa, Homo Sapiens
RQRRRKQGT

SEQ ID NO: 1323168 - protein, 9 aa, Homo Sapiens
HSSTLDSCT

SEQ ID NO: 1323169 - protein, 9 aa, Homo Sapiens
LDKYRNVIK

SEQ ID NO: 1323170 - protein, 9 aa, Homo Sapiens
APKSHAFVG

SEQ ID NO: 1323171 - protein, 9 aa, Homo Sapiens
IMFSPEHPV

SEQ ID NO: 1323172 - protein, 9 aa, Homo Sapiens
TGKIECLPL

SEQ ID NO: 1323173 - protein, 9 aa, Homo Sapiens
TLSAISIIM

SEQ ID NO: 1323174 - protein, 9 aa, Homo Sapiens
ISTPTDFLW

SEQ ID NO: 1323175 - protein, 9 aa, Homo Sapiens
ERKAFKAIE

SEQ ID NO: 1323176 - protein, 9 aa, Homo Sapiens
RHRGKNENE

SEQ ID NO: 1323177 - protein, 9 aa, Homo Sapiens
EQVSPTAIK

SEQ ID NO: 1323178 - protein, 9 aa, Homo Sapiens
ELNINECFS

SEQ ID NO: 1323179 - protein, 9 aa, Homo Sapiens
IHDIRTIAE

SEQ ID NO: 1323180 - protein, 9 aa, Homo Sapiens
CVLCPATAS

SEQ ID NO: 1323181 - protein, 9 aa, Homo Sapiens
SSQGSGRPR

SEQ ID NO: 1323182 - protein, 9 aa, Homo Sapiens
SFLGHVVFL

SEQ ID NO: 1323183 - protein, 9 aa, Homo Sapiens
IEEAVIVAR

SEQ ID NO: 1323184 - protein, 9 aa, Homo Sapiens
IKRRTAPIN

SEQ ID NO: 1323185 - protein, 9 aa, Homo Sapiens
RRFMLRMTE

SEQ ID NO: 1323186 - protein, 9 aa, Homo Sapiens
TIPNDLKLK

SEQ ID NO: 1323187 - protein, 9 aa, Homo Sapiens
FLLFTGLLQ

SEQ ID NO: 1323188 - protein, 9 aa, Homo Sapiens
CRHADQYKE

SEQ ID NO: 1323189 - protein, 9 aa, Homo Sapiens
YPPGWSLTL

SEQ ID NO: 1323190 - protein, 9 aa, Homo Sapiens
ATMNVKQAA

SEQ ID NO: 1323191 - protein, 9 aa, Homo Sapiens
VALTVQGHP

SEQ ID NO: 1323192 - protein, 9 aa, Homo Sapiens
PGGRGWEVV

SEQ ID NO: 1323193 - protein, 9 aa, Homo Sapiens
TDFEKAHHS

SEQ ID NO: 1323194 - protein, 9 aa, Homo Sapiens
GRTVMYLYK

SEQ ID NO: 1323195 - protein, 9 aa, Homo Sapiens
AFGDHWGPY

SEQ ID NO: 1323196 - protein, 9 aa, Homo Sapiens
SRRVQPSCP

SEQ ID NO: 1323197 - protein, 9 aa, Homo Sapiens
YCLSVFATF

SEQ ID NO: 1323198 - protein, 9 aa, Homo Sapiens
ITFGPVVDG

SEQ ID NO: 1323199 - protein, 9 aa, Homo Sapiens
LVPKTEICD

SEQ ID NO: 1323200 - protein, 9 aa, Homo Sapiens
RVRRGTGLP

SEQ ID NO: 1323201 - protein, 9 aa, Homo Sapiens
RTEHSVLEL

SEQ ID NO: 1323202 - protein, 9 aa, Homo Sapiens
DICKLSYPQ

SEQ ID NO: 1323203 - protein, 9 aa, Homo Sapiens
AGRRSARAP

SEQ ID NO: 1323204 - protein, 9 aa, Homo Sapiens
IIFGFTIDN

SEQ ID NO: 1323205 - protein, 9 aa, Homo Sapiens
DLSQMTVPI

SEQ ID NO: 1323206 - protein, 9 aa, Homo Sapiens
GYLDLLPCH

SEQ ID NO: 1323207 - protein, 9 aa, Homo Sapiens
TGPSEALTM

SEQ ID NO: 1323208 - protein, 9 aa, Homo Sapiens
NESAAERYT

SEQ ID NO: 1323209 - protein, 9 aa, Homo Sapiens
EKRVLRYLE

SEQ ID NO: 1323210 - protein, 9 aa, Homo Sapiens
SHVTVVGLF

SEQ ID NO: 1323211 - protein, 9 aa, Homo Sapiens
GFNQEANIP

SEQ ID NO: 1323212 - protein, 9 aa, Homo Sapiens
FPKDKETNQ

SEQ ID NO: 1323213 - protein, 9 aa, Homo Sapiens
GNYWSLDPV

SEQ ID NO: 1323214 - protein, 9 aa, Homo Sapiens
MNNDMTLLK

SEQ ID NO: 1323215 - protein, 9 aa, Homo Sapiens
FVICWLPYH

SEQ ID NO: 1323216 - protein, 9 aa, Homo Sapiens
FTIVTSNIV

SEQ ID NO: 1323217 - protein, 9 aa, Homo Sapiens
KDYCFVRED

SEQ ID NO: 1323218 - protein, 9 aa, Homo Sapiens
NIIQSTEHL

SEQ ID NO: 1323219 - protein, 9 aa, Homo Sapiens
TSLVDEAKQ

SEQ ID NO: 1323220 - protein, 9 aa, Homo Sapiens
AQIPCIPKE

SEQ ID NO: 1323221 - protein, 9 aa, Homo Sapiens
GPHARVDAH

SEQ ID NO: 1323222 - protein, 9 aa, Homo Sapiens
DLRNTSGLT

SEQ ID NO: 1323223 - protein, 9 aa, Homo Sapiens
VRHAMWKMM

SEQ ID NO: 1323224 - protein, 9 aa, Homo Sapiens
PNSAAQYLQ

SEQ ID NO: 1323225 - protein, 9 aa, Homo Sapiens
ATLFPRKPL

SEQ ID NO: 1323226 - protein, 9 aa, Homo Sapiens
QMVFLSRSD

SEQ ID NO: 1323227 - protein, 9 aa, Homo Sapiens
SQRSSACTR

SEQ ID NO: 1323228 - protein, 9 aa, Homo Sapiens
FITQLSDLT

SEQ ID NO: 1323229 - protein, 9 aa, Homo Sapiens
DPSSPTSPS

SEQ ID NO: 1323230 - protein, 9 aa, Homo Sapiens
RCLSQAEER

SEQ ID NO: 1323231 - protein, 9 aa, Homo Sapiens
YDDLCYLFG

SEQ ID NO: 1323232 - protein, 9 aa, Homo Sapiens
SVACQNEPL

SEQ ID NO: 1323233 - protein, 9 aa, Homo Sapiens
NIILYENPN

SEQ ID NO: 1323234 - protein, 9 aa, Homo Sapiens
FCDKASAKV

SEQ ID NO: 1323235 - protein, 9 aa, Homo Sapiens
RVQPFHQGH

SEQ ID NO: 1323236 - protein, 9 aa, Homo Sapiens
TSAAKPSAP

SEQ ID NO: 1323237 - protein, 9 aa, Homo Sapiens
NLLHQLHPN

SEQ ID NO: 1323238 - protein, 9 aa, Homo Sapiens
NVGKLSFII

SEQ ID NO: 1323239 - protein, 9 aa, Homo Sapiens
GGYVYCGCE

SEQ ID NO: 1323240 - protein, 9 aa, Homo Sapiens
SDYAHYSGS

SEQ ID NO: 1323241 - protein, 9 aa, Homo Sapiens
NPTASAGAS

SEQ ID NO: 1323242 - protein, 9 aa, Homo Sapiens
LLSSHDNAF

SEQ ID NO: 1323243 - protein, 9 aa, Homo Sapiens
ILEEEEEPP

SEQ ID NO: 1323244 - protein, 9 aa, Homo Sapiens
NLIGLSRAW

SEQ ID NO: 1323245 - protein, 9 aa, Homo Sapiens
PARHITIPL

SEQ ID NO: 1323246 - protein, 9 aa, Homo Sapiens
KERELKLYW

SEQ ID NO: 1323247 - protein, 9 aa, Homo Sapiens
DHYAAVCKP

SEQ ID NO: 1323248 - protein, 9 aa, Homo Sapiens
KERASQGEF

SEQ ID NO: 1323249 - protein, 9 aa, Homo Sapiens
WLDLCKLGP

SEQ ID NO: 1323250 - protein, 9 aa, Homo Sapiens
LHQSVKNVT

SEQ ID NO: 1323251 - protein, 9 aa, Homo Sapiens
PHTKAGLYW

SEQ ID NO: 1323252 - protein, 9 aa, Homo Sapiens
NSRRSSKKK

SEQ ID NO: 1323253 - protein, 9 aa, Homo Sapiens
RRFECDCKE

SEQ ID NO: 1323254 - protein, 9 aa, Homo Sapiens
EKRVLAHLT

SEQ ID NO: 1323255 - protein, 9 aa, Homo Sapiens
QKAREEKKK

SEQ ID NO: 1323256 - protein, 9 aa, Homo Sapiens
YERCIMVDK

SEQ ID NO: 1323257 - protein, 9 aa, Homo Sapiens
VYSGHQGHT

SEQ ID NO: 1323258 - protein, 9 aa, Homo Sapiens
EFVFNAEFK

SEQ ID NO: 1323259 - protein, 9 aa, Homo Sapiens
FHSIECYSI

SEQ ID NO: 1323260 - protein, 9 aa, Homo Sapiens
LCNECGNIF

SEQ ID NO: 1323261 - protein, 9 aa, Homo Sapiens
ETVILHQGC

SEQ ID NO: 1323262 - protein, 9 aa, Homo Sapiens
GLFDKSAGE

SEQ ID NO: 1323263 - protein, 9 aa, Homo Sapiens
FPMKKFREC

SEQ ID NO: 1323264 - protein, 9 aa, Homo Sapiens
AKVPYDDLC

SEQ ID NO: 1323265 - protein, 9 aa, Homo Sapiens
NTVGMHLLN

SEQ ID NO: 1323266 - protein, 9 aa, Homo Sapiens
GKTFGSGSN

SEQ ID NO: 1323267 - protein, 9 aa, Homo Sapiens
QGLSTFYLS

SEQ ID NO: 1323268 - protein, 9 aa, Homo Sapiens
ETMQRWRSS

SEQ ID NO: 1323269 - protein, 9 aa, Homo Sapiens
LKLRKFIFS

SEQ ID NO: 1323270 - protein, 9 aa, Homo Sapiens
HSGQCVTWL

SEQ ID NO: 1323271 - protein, 9 aa, Homo Sapiens
VVAQTVEEL

SEQ ID NO: 1323272 - protein, 9 aa, Homo Sapiens
GVKKLYLID

SEQ ID NO: 1323273 - protein, 9 aa, Homo Sapiens
NGWETASAI

SEQ ID NO: 1323274 - protein, 9 aa, Homo Sapiens
DGHTDQEIK

SEQ ID NO: 1323275 - protein, 9 aa, Homo Sapiens
LRQATKCAT

SEQ ID NO: 1323276 - protein, 9 aa, Homo Sapiens
AAHRPLCQR

SEQ ID NO: 1323277 - protein, 9 aa, Homo Sapiens
CRKNYGLMC

SEQ ID NO: 1323278 - protein, 9 aa, Homo Sapiens
QRIQEGAHN

SEQ ID NO: 1323279 - protein, 9 aa, Homo Sapiens
SSSTSRDSR

SEQ ID NO: 1323280 - protein, 9 aa, Homo Sapiens
ILQQVVNLN

SEQ ID NO: 1323281 - protein, 9 aa, Homo Sapiens
DGEVMSVVV

SEQ ID NO: 1323282 - protein, 9 aa, Homo Sapiens
SSLSSVMKQ

SEQ ID NO: 1323283 - protein, 9 aa, Homo Sapiens
TKCPVEWAK

SEQ ID NO: 1323284 - protein, 9 aa, Homo Sapiens
NEKTPITIE

SEQ ID NO: 1323285 - protein, 9 aa, Homo Sapiens
NPDGPVIIQ

SEQ ID NO: 1323286 - protein, 9 aa, Homo Sapiens
FIPKKLNIV

SEQ ID NO: 1323287 - protein, 9 aa, Homo Sapiens
EIMPGGNMN

SEQ ID NO: 1323288 - protein, 9 aa, Homo Sapiens
TQPEDWVEM

SEQ ID NO: 1323289 - protein, 9 aa, Homo Sapiens
TNVTSPGVN

SEQ ID NO: 1323290 - protein, 9 aa, Homo Sapiens
PKCDASFLQ

SEQ ID NO: 1323291 - protein, 9 aa, Homo Sapiens
MRYVQFMGG

SEQ ID NO: 1323292 - protein, 9 aa, Homo Sapiens
TIRNPKDTP

SEQ ID NO: 1323293 - protein, 9 aa, Homo Sapiens
EDVSYIERH

SEQ ID NO: 1323294 - protein, 9 aa, Homo Sapiens
QEQIKKQKT

SEQ ID NO: 1323295 - protein, 9 aa, Homo Sapiens
SAKFLLDNV

SEQ ID NO: 1323296 - protein, 9 aa, Homo Sapiens
EAIAADPRG

SEQ ID NO: 1323297 - protein, 9 aa, Homo Sapiens
LLNILNARV

SEQ ID NO: 1323298 - protein, 9 aa, Homo Sapiens
IPALVKVLL

SEQ ID NO: 1323299 - protein, 9 aa, Homo Sapiens
TLNQHKKIH

SEQ ID NO: 1323300 - protein, 9 aa, Homo Sapiens
CGGEIRKMK

SEQ ID NO: 1323301 - protein, 9 aa, Homo Sapiens
PICPPKYYT

SEQ ID NO: 1323302 - protein, 9 aa, Homo Sapiens
LASAYTGHL

SEQ ID NO: 1323303 - protein, 9 aa, Homo Sapiens
SPKMMKKFL

SEQ ID NO: 1323304 - protein, 9 aa, Homo Sapiens
CDHKMEVAF

SEQ ID NO: 1323305 - protein, 9 aa, Homo Sapiens
AVISEDTLV

SEQ ID NO: 1323306 - protein, 9 aa, Homo Sapiens
QAIFVQRVL

SEQ ID NO: 1323307 - protein, 9 aa, Homo Sapiens
NFLICEDGN

SEQ ID NO: 1323308 - protein, 9 aa, Homo Sapiens
DRPEKRVTS

SEQ ID NO: 1323309 - protein, 9 aa, Homo Sapiens
LGQVWRYLC

SEQ ID NO: 1323310 - protein, 9 aa, Homo Sapiens
KNPQPVQAW

SEQ ID NO: 1323311 - protein, 9 aa, Homo Sapiens
YFTPHWKQE

SEQ ID NO: 1323312 - protein, 9 aa, Homo Sapiens
CLESVNDLI

SEQ ID NO: 1323313 - protein, 9 aa, Homo Sapiens
DDVSLVEVC

SEQ ID NO: 1323314 - protein, 9 aa, Homo Sapiens
QNSPLDWQL

SEQ ID NO: 1323315 - protein, 9 aa, Homo Sapiens
IITTLASGA

SEQ ID NO: 1323316 - protein, 9 aa, Homo Sapiens
MIHDLTKQE

SEQ ID NO: 1323317 - protein, 9 aa, Homo Sapiens
TLIIGNCNN

SEQ ID NO: 1323318 - protein, 9 aa, Homo Sapiens
QECHMKREH

SEQ ID NO: 1323319 - protein, 9 aa, Homo Sapiens
LYQNTHHKS

SEQ ID NO: 1323320 - protein, 9 aa, Homo Sapiens
FEYFQTTWS

SEQ ID NO: 1323321 - protein, 9 aa, Homo Sapiens
LMRPKASGA

SEQ ID NO: 1323322 - protein, 9 aa, Homo Sapiens
VDAGRIPQP

SEQ ID NO: 1323323 - protein, 9 aa, Homo Sapiens
DFVSALVFL

SEQ ID NO: 1323324 - protein, 9 aa, Homo Sapiens
ASKKLPSQS

SEQ ID NO: 1323325 - protein, 9 aa, Homo Sapiens
CILAAFEVK

SEQ ID NO: 1323326 - protein, 9 aa, Homo Sapiens
VDQWHWGVF

SEQ ID NO: 1323327 - protein, 9 aa, Homo Sapiens
MLHRWFVET

SEQ ID NO: 1323328 - protein, 9 aa, Homo Sapiens
DYLHAMCTL

SEQ ID NO: 1323329 - protein, 9 aa, Homo Sapiens
TSRRTRPNR

SEQ ID NO: 1323330 - protein, 9 aa, Homo Sapiens
EFALEYHTT

SEQ ID NO: 1323331 - protein, 9 aa, Homo Sapiens
LLVDVTCLL

SEQ ID NO: 1323332 - protein, 9 aa, Homo Sapiens
EDDLVCGAE

SEQ ID NO: 1323333 - protein, 9 aa, Homo Sapiens
HSDSLTSQQ

SEQ ID NO: 1323334 - protein, 9 aa, Homo Sapiens
VSITQFVTS

SEQ ID NO: 1323335 - protein, 9 aa, Homo Sapiens
RSCKPWATP

SEQ ID NO: 1323336 - protein, 9 aa, Homo Sapiens
LVDEAKQRG

SEQ ID NO: 1323337 - protein, 9 aa, Homo Sapiens
ETIRNPKDT

SEQ ID NO: 1323338 - protein, 9 aa, Homo Sapiens
KKQKEEEQV

SEQ ID NO: 1323339 - protein, 9 aa, Homo Sapiens
KNTQPEDWV

SEQ ID NO: 1323340 - protein, 9 aa, Homo Sapiens
FKPSSVVKC

SEQ ID NO: 1323341 - protein, 9 aa, Homo Sapiens
LENDKAKLS

SEQ ID NO: 1323342 - protein, 9 aa, Homo Sapiens
HQGARLSTT

SEQ ID NO: 1323343 - protein, 9 aa, Homo Sapiens
SVFRNPHHS

SEQ ID NO: 1323344 - protein, 9 aa, Homo Sapiens
REWGRSKER

SEQ ID NO: 1323345 - protein, 9 aa, Homo Sapiens
EQSKEAWGM

SEQ ID NO: 1323346 - protein, 9 aa, Homo Sapiens
LGHVVFLLQ

SEQ ID NO: 1323347 - protein, 9 aa, Homo Sapiens
TNLTSLCRL

SEQ ID NO: 1323348 - protein, 9 aa, Homo Sapiens
LSCRTRRRW

SEQ ID NO: 1323349 - protein, 9 aa, Homo Sapiens
TYHGSYLWL

SEQ ID NO: 1323350 - protein, 9 aa, Homo Sapiens
ATIDTGDAD

SEQ ID NO: 1323351 - protein, 9 aa, Homo Sapiens
RQLQEEIRA

SEQ ID NO: 1323352 - protein, 9 aa, Homo Sapiens
VPNSPAAIA

SEQ ID NO: 1323353 - protein, 9 aa, Homo Sapiens
RAAGTGEDA

SEQ ID NO: 1323354 - protein, 9 aa, Homo Sapiens
RVDFANDQE

SEQ ID NO: 1323355 - protein, 9 aa, Homo Sapiens
EDYMREWCA

SEQ ID NO: 1323356 - protein, 9 aa, Homo Sapiens
QFVTSLNFF

SEQ ID NO: 1323357 - protein, 9 aa, Homo Sapiens
PQNSPLSSS

SEQ ID NO: 1323358 - protein, 9 aa, Homo Sapiens
DAELLWHLA

SEQ ID NO: 1323359 - protein, 9 aa, Homo Sapiens
APLCNYLSH

SEQ ID NO: 1323360 - protein, 9 aa, Homo Sapiens
EALANRHIL

SEQ ID NO: 1323361 - protein, 9 aa, Homo Sapiens
DPKGSLDNA

SEQ ID NO: 1323362 - protein, 9 aa, Homo Sapiens
DLHLCTVKL

SEQ ID NO: 1323363 - protein, 9 aa, Homo Sapiens
FYIDITKEE

SEQ ID NO: 1323364 - protein, 9 aa, Homo Sapiens
DFEEVQCCT

SEQ ID NO: 1323365 - protein, 9 aa, Homo Sapiens
MLMLDVLMA

SEQ ID NO: 1323366 - protein, 9 aa, Homo Sapiens
TCKQLTYYS

SEQ ID NO: 1323367 - protein, 9 aa, Homo Sapiens
GGVTCGWDN

SEQ ID NO: 1323368 - protein, 9 aa, Homo Sapiens
NMELEHFDE

SEQ ID NO: 1323369 - protein, 9 aa, Homo Sapiens
SIHSNINDN

SEQ ID NO: 1323370 - protein, 9 aa, Homo Sapiens
TASAGASLE

SEQ ID NO: 1323371 - protein, 9 aa, Homo Sapiens
ITRKDTSTS

SEQ ID NO: 1323372 - protein, 9 aa, Homo Sapiens
DFRMNMCVP

SEQ ID NO: 1323373 - protein, 9 aa, Homo Sapiens
KESTRASFS

SEQ ID NO: 1323374 - protein, 9 aa, Homo Sapiens
FFFITLVFF

SEQ ID NO: 1323375 - protein, 9 aa, Homo Sapiens
DNPYEVTRA

SEQ ID NO: 1323376 - protein, 9 aa, Homo Sapiens
LADGAHVWL

SEQ ID NO: 1323377 - protein, 9 aa, Homo Sapiens
EQQVGHPKH

SEQ ID NO: 1323378 - protein, 9 aa, Homo Sapiens
DLEGVNMRH

SEQ ID NO: 1323379 - protein, 9 aa, Homo Sapiens
ARHCWTKEW

SEQ ID NO: 1323380 - protein, 9 aa, Homo Sapiens
QVEDECRHA

SEQ ID NO: 1323381 - protein, 9 aa, Homo Sapiens
QSRKGQKKI

SEQ ID NO: 1323382 - protein, 9 aa, Homo Sapiens
KVFHSSLHE

SEQ ID NO: 1323383 - protein, 9 aa, Homo Sapiens
FEEDTGCYS

SEQ ID NO: 1323384 - protein, 9 aa, Homo Sapiens
PSPQGPLFL

SEQ ID NO: 1323385 - protein, 9 aa, Homo Sapiens
SCVASGPHL

SEQ ID NO: 1323386 - protein, 9 aa, Homo Sapiens
TELYRIGKK

SEQ ID NO: 1323387 - protein, 9 aa, Homo Sapiens
SSGSSFSSG

SEQ ID NO: 1323388 - protein, 9 aa, Homo Sapiens
KEVKAKPTG

SEQ ID NO: 1323389 - protein, 9 aa, Homo Sapiens
GEKQHISRG

SEQ ID NO: 1323390 - protein, 9 aa, Homo Sapiens
DSHLRFNST

SEQ ID NO: 1323391 - protein, 9 aa, Homo Sapiens
SVMTYDRYV

SEQ ID NO: 1323392 - protein, 9 aa, Homo Sapiens
PVTSDSYEA

SEQ ID NO: 1323393 - protein, 9 aa, Homo Sapiens
FQRRQNQCR

SEQ ID NO: 1323394 - protein, 9 aa, Homo Sapiens
QKFTVSQYV

SEQ ID NO: 1323395 - protein, 9 aa, Homo Sapiens
KTTELTEAG

SEQ ID NO: 1323396 - protein, 9 aa, Homo Sapiens
TITARKIRE

SEQ ID NO: 1323397 - protein, 9 aa, Homo Sapiens
TIEDEDTKA

SEQ ID NO: 1323398 - protein, 9 aa, Homo Sapiens
CLYEQGRYS

SEQ ID NO: 1323399 - protein, 9 aa, Homo Sapiens
LSWSSRIVA

SEQ ID NO: 1323400 - protein, 9 aa, Homo Sapiens
SHFIHNIPF

SEQ ID NO: 1323401 - protein, 9 aa, Homo Sapiens
KFSLLKRES

SEQ ID NO: 1323402 - protein, 9 aa, Homo Sapiens
GHTYDRSIL

SEQ ID NO: 1323403 - protein, 9 aa, Homo Sapiens
ICLYEQGRY

SEQ ID NO: 1323404 - protein, 9 aa, Homo Sapiens
KPKKQTLEG

SEQ ID NO: 1323405 - protein, 9 aa, Homo Sapiens
LSRHAQVSQ

SEQ ID NO: 1323406 - protein, 9 aa, Homo Sapiens
ITKTQKVCF

SEQ ID NO: 1323407 - protein, 9 aa, Homo Sapiens
WVLCLLKLV

SEQ ID NO: 1323408 - protein, 9 aa, Homo Sapiens
LCHLDDTCV

SEQ ID NO: 1323409 - protein, 9 aa, Homo Sapiens
IIASEVKVL

SEQ ID NO: 1323410 - protein, 9 aa, Homo Sapiens
QEAKEKVTG

SEQ ID NO: 1323411 - protein, 9 aa, Homo Sapiens
GKCGRPSGT

SEQ ID NO: 1323412 - protein, 9 aa, Homo Sapiens
LWGENDTFM

SEQ ID NO: 1323413 - protein, 9 aa, Homo Sapiens
ASSIVGSYD

SEQ ID NO: 1323414 - protein, 9 aa, Homo Sapiens
QLKLDHYRT

SEQ ID NO: 1323415 - protein, 9 aa, Homo Sapiens
NIHSSSRIF

SEQ ID NO: 1323416 - protein, 9 aa, Homo Sapiens
VTRVCGPAT

SEQ ID NO: 1323417 - protein, 9 aa, Homo Sapiens
LVFIFLWYP

SEQ ID NO: 1323418 - protein, 9 aa, Homo Sapiens
QPVVLVGPS

SEQ ID NO: 1323419 - protein, 9 aa, Homo Sapiens
RKHKTIHTG

SEQ ID NO: 1323420 - protein, 9 aa, Homo Sapiens
PNFSYMGAP

SEQ ID NO: 1323421 - protein, 9 aa, Homo Sapiens
SSGAEGDMS

SEQ ID NO: 1323422 - protein, 9 aa, Homo Sapiens
GYTIYNTST

SEQ ID NO: 1323423 - protein, 9 aa, Homo Sapiens
LSNTIMGSG

SEQ ID NO: 1323424 - protein, 9 aa, Homo Sapiens
PAGEVRYAL

SEQ ID NO: 1323425 - protein, 9 aa, Homo Sapiens
FVAVDGVRA

SEQ ID NO: 1323426 - protein, 9 aa, Homo Sapiens
PGEKKSQAS

SEQ ID NO: 1323427 - protein, 9 aa, Homo Sapiens
HVLKRSAEG

SEQ ID NO: 1323428 - protein, 9 aa, Homo Sapiens
EVDKVLADD

SEQ ID NO: 1323429 - protein, 9 aa, Homo Sapiens
PCRRKKKVR

SEQ ID NO: 1323430 - protein, 9 aa, Homo Sapiens
EGIHYARIQ

SEQ ID NO: 1323431 - protein, 9 aa, Homo Sapiens
SSITNPIKT

SEQ ID NO: 1323432 - protein, 9 aa, Homo Sapiens
ESSEEPLVP

SEQ ID NO: 1323433 - protein, 9 aa, Homo Sapiens
ERERAARAC

SEQ ID NO: 1323434 - protein, 9 aa, Homo Sapiens
PSRRVRRAP

SEQ ID NO: 1323435 - protein, 9 aa, Homo Sapiens
ALHFGHHDI

SEQ ID NO: 1323436 - protein, 9 aa, Homo Sapiens
HNSKEERID

SEQ ID NO: 1323437 - protein, 9 aa, Homo Sapiens
LCQKKLYCL

SEQ ID NO: 1323438 - protein, 9 aa, Homo Sapiens
VIYNRTRFY

SEQ ID NO: 1323439 - protein, 9 aa, Homo Sapiens
KVSDTMVEP

SEQ ID NO: 1323440 - protein, 9 aa, Homo Sapiens
INLKNKPGW

SEQ ID NO: 1323441 - protein, 9 aa, Homo Sapiens
GQVRKLLLF

SEQ ID NO: 1323442 - protein, 9 aa, Homo Sapiens
PLTPCPYFS

SEQ ID NO: 1323443 - protein, 9 aa, Homo Sapiens
HILHPKFIV

SEQ ID NO: 1323444 - protein, 9 aa, Homo Sapiens
ASMRKFSLL

SEQ ID NO: 1323445 - protein, 9 aa, Homo Sapiens
TYFTPHWKQ

SEQ ID NO: 1323446 - protein, 9 aa, Homo Sapiens
EAVKVVIDA

SEQ ID NO: 1323447 - protein, 9 aa, Homo Sapiens
TSKMLVNFL

SEQ ID NO: 1323448 - protein, 9 aa, Homo Sapiens
VEVCRKLNE

SEQ ID NO: 1323449 - protein, 9 aa, Homo Sapiens
YFHTAQKSG

SEQ ID NO: 1323450 - protein, 9 aa, Homo Sapiens
PLCQRFPTL

SEQ ID NO: 1323451 - protein, 9 aa, Homo Sapiens
TYLKGTVLF

SEQ ID NO: 1323452 - protein, 9 aa, Homo Sapiens
PSALPSPPS

SEQ ID NO: 1323453 - protein, 9 aa, Homo Sapiens
LFFFVFTHS

SEQ ID NO: 1323454 - protein, 9 aa, Homo Sapiens
SEDDIYMMD

SEQ ID NO: 1323455 - protein, 9 aa, Homo Sapiens
PVPAFNVTN

SEQ ID NO: 1323456 - protein, 9 aa, Homo Sapiens
VLSRLLSCK

SEQ ID NO: 1323457 - protein, 9 aa, Homo Sapiens
HGVSGGGKC

SEQ ID NO: 1323458 - protein, 9 aa, Homo Sapiens
RPYKCTVCE

SEQ ID NO: 1323459 - protein, 9 aa, Homo Sapiens
RSSERYMQK

SEQ ID NO: 1323460 - protein, 9 aa, Homo Sapiens
SIYVPFLIV

SEQ ID NO: 1323461 - protein, 9 aa, Homo Sapiens
RSAVCVGIA

SEQ ID NO: 1323462 - protein, 9 aa, Homo Sapiens
KVSLWDCFN

SEQ ID NO: 1323463 - protein, 9 aa, Homo Sapiens
KTPIITTLA

SEQ ID NO: 1323464 - protein, 9 aa, Homo Sapiens
LMTFLRELL

SEQ ID NO: 1323465 - protein, 9 aa, Homo Sapiens
QNEKYYILW

SEQ ID NO: 1323466 - protein, 9 aa, Homo Sapiens
LFLHQNTHT

SEQ ID NO: 1323467 - protein, 9 aa, Homo Sapiens
NRHHIEKKI

SEQ ID NO: 1323468 - protein, 9 aa, Homo Sapiens
LSTASDLAH

SEQ ID NO: 1323469 - protein, 9 aa, Homo Sapiens
PLSSLKSMV

SEQ ID NO: 1323470 - protein, 9 aa, Homo Sapiens
SRPVSRHLV

SEQ ID NO: 1323471 - protein, 9 aa, Homo Sapiens
VPEKNWNLL

SEQ ID NO: 1323472 - protein, 9 aa, Homo Sapiens
NLLHGKTIE

SEQ ID NO: 1323473 - protein, 9 aa, Homo Sapiens
FPQCTFFFL

SEQ ID NO: 1323474 - protein, 9 aa, Homo Sapiens
FMHGPPSSP

SEQ ID NO: 1323475 - protein, 9 aa, Homo Sapiens
IKQEQTDFT

SEQ ID NO: 1323476 - protein, 9 aa, Homo Sapiens
DSAHQDAHR

SEQ ID NO: 1323477 - protein, 9 aa, Homo Sapiens
YCYGLCAPT

SEQ ID NO: 1323478 - protein, 9 aa, Homo Sapiens
RVIIPVKWG

SEQ ID NO: 1323479 - protein, 9 aa, Homo Sapiens
EFEQCHHCL

SEQ ID NO: 1323480 - protein, 9 aa, Homo Sapiens
PSMQPVVLV

SEQ ID NO: 1323481 - protein, 9 aa, Homo Sapiens
LKLEKEKSW

SEQ ID NO: 1323482 - protein, 9 aa, Homo Sapiens
RILVEKVQM

SEQ ID NO: 1323483 - protein, 9 aa, Homo Sapiens
PLLSMTPIS

SEQ ID NO: 1323484 - protein, 9 aa, Homo Sapiens
EISKEGNHL

SEQ ID NO: 1323485 - protein, 9 aa, Homo Sapiens
AMYGAHMDS

SEQ ID NO: 1323486 - protein, 9 aa, Homo Sapiens
KKPSIEVAD

SEQ ID NO: 1323487 - protein, 9 aa, Homo Sapiens
KGCVASQCQ

SEQ ID NO: 1323488 - protein, 9 aa, Homo Sapiens
LPAWGHEVI

SEQ ID NO: 1323489 - protein, 9 aa, Homo Sapiens
DSIITICRE

SEQ ID NO: 1323490 - protein, 9 aa, Homo Sapiens
LLLQAECRA

SEQ ID NO: 1323491 - protein, 9 aa, Homo Sapiens
TVFPKTNVT

SEQ ID NO: 1323492 - protein, 9 aa, Homo Sapiens
QYKDEEGVT

SEQ ID NO: 1323493 - protein, 9 aa, Homo Sapiens
WCSIDGSIV

SEQ ID NO: 1323494 - protein, 9 aa, Homo Sapiens
YKTSVSEGN

SEQ ID NO: 1323495 - protein, 9 aa, Homo Sapiens
MRETHLNEL

SEQ ID NO: 1323496 - protein, 9 aa, Homo Sapiens
GEVMSVVVV

SEQ ID NO: 1323497 - protein, 9 aa, Homo Sapiens
SIHHLTLER

SEQ ID NO: 1323498 - protein, 9 aa, Homo Sapiens
VARGEDPTL

SEQ ID NO: 1323499 - protein, 9 aa, Homo Sapiens
KKPEALIVP

SEQ ID NO: 1323500 - protein, 9 aa, Homo Sapiens
TMHYSIGKQ

SEQ ID NO: 1323501 - protein, 9 aa, Homo Sapiens
STWLHPRGE

SEQ ID NO: 1323502 - protein, 9 aa, Homo Sapiens
ESCTMWGLP

SEQ ID NO: 1323503 - protein, 9 aa, Homo Sapiens
NTDKHLDPL

SEQ ID NO: 1323504 - protein, 9 aa, Homo Sapiens
YKAVSYHTS

SEQ ID NO: 1323505 - protein, 9 aa, Homo Sapiens
LRMLFPEVQ

SEQ ID NO: 1323506 - protein, 9 aa, Homo Sapiens
CRGVIANSL

SEQ ID NO: 1323507 - protein, 9 aa, Homo Sapiens
HSHHIQNVV

SEQ ID NO: 1323508 - protein, 9 aa, Homo Sapiens
VLLVDVTCL

SEQ ID NO: 1323509 - protein, 9 aa, Homo Sapiens
TKAPKDPAV

SEQ ID NO: 1323510 - protein, 9 aa, Homo Sapiens
TGEKPHACT

SEQ ID NO: 1323511 - protein, 9 aa, Homo Sapiens
WDQEERMWE

SEQ ID NO: 1323512 - protein, 9 aa, Homo Sapiens
NIIPGELTD

SEQ ID NO: 1323513 - protein, 9 aa, Homo Sapiens
DFEGINFKW

SEQ ID NO: 1323514 - protein, 9 aa, Homo Sapiens
SIAEGHISL

SEQ ID NO: 1323515 - protein, 9 aa, Homo Sapiens
FNALVEKTL

SEQ ID NO: 1323516 - protein, 9 aa, Homo Sapiens
VYCGCESPN

SEQ ID NO: 1323517 - protein, 9 aa, Homo Sapiens
NFPESTVFM

SEQ ID NO: 1323518 - protein, 9 aa, Homo Sapiens
GVWWEISVC

SEQ ID NO: 1323519 - protein, 9 aa, Homo Sapiens
LLLCWGGGH

SEQ ID NO: 1323520 - protein, 9 aa, Homo Sapiens
ALEMSCNRI

SEQ ID NO: 1323521 - protein, 9 aa, Homo Sapiens
TNHPNTWGA

SEQ ID NO: 1323522 - protein, 9 aa, Homo Sapiens
CIQYKPSLF

SEQ ID NO: 1323523 - protein, 9 aa, Homo Sapiens
RKNHSIVTN

SEQ ID NO: 1323524 - protein, 9 aa, Homo Sapiens
RKCVLDMEG

SEQ ID NO: 1323525 - protein, 9 aa, Homo Sapiens
QASKHIPEA

SEQ ID NO: 1323526 - protein, 9 aa, Homo Sapiens
SDPETIHQG

SEQ ID NO: 1323527 - protein, 9 aa, Homo Sapiens
QPARYHITF

SEQ ID NO: 1323528 - protein, 9 aa, Homo Sapiens
VKTETVGPQ

SEQ ID NO: 1323529 - protein, 9 aa, Homo Sapiens
RPGTPPPLI

SEQ ID NO: 1323530 - protein, 9 aa, Homo Sapiens
GCLLRRTLM

SEQ ID NO: 1323531 - protein, 9 aa, Homo Sapiens
RNPSATPCR

SEQ ID NO: 1323532 - protein, 9 aa, Homo Sapiens
LWDDLCCRS

SEQ ID NO: 1323533 - protein, 9 aa, Homo Sapiens
HLVHHQRVH

SEQ ID NO: 1323534 - protein, 9 aa, Homo Sapiens
EVIRFNADY

SEQ ID NO: 1323535 - protein, 9 aa, Homo Sapiens
LSEDVRHVI

SEQ ID NO: 1323536 - protein, 9 aa, Homo Sapiens
GPYGYGSGW

SEQ ID NO: 1323537 - protein, 9 aa, Homo Sapiens
ALIEAVTVS

SEQ ID NO: 1323538 - protein, 9 aa, Homo Sapiens
IEGEEWNKV

SEQ ID NO: 1323539 - protein, 9 aa, Homo Sapiens
FYEMIAEKL

SEQ ID NO: 1323540 - protein, 9 aa, Homo Sapiens
ESSKRRFEC

SEQ ID NO: 1323541 - protein, 9 aa, Homo Sapiens
GLEGRLPPF

SEQ ID NO: 1323542 - protein, 9 aa, Homo Sapiens
KQKSEEPLV

SEQ ID NO: 1323543 - protein, 9 aa, Homo Sapiens
WKEVQLHKT

SEQ ID NO: 1323544 - protein, 9 aa, Homo Sapiens
YLCNECGNI

SEQ ID NO: 1323545 - protein, 9 aa, Homo Sapiens
EENLDPSAS

SEQ ID NO: 1323546 - protein, 9 aa, Homo Sapiens
RYQQNCLRS

SEQ ID NO: 1323547 - protein, 9 aa, Homo Sapiens
IWFEYPVQI

SEQ ID NO: 1323548 - protein, 9 aa, Homo Sapiens
AAVILRYTD

SEQ ID NO: 1323549 - protein, 9 aa, Homo Sapiens
VDIISLSEP

SEQ ID NO: 1323550 - protein, 9 aa, Homo Sapiens
LVKKSLIED

SEQ ID NO: 1323551 - protein, 9 aa, Homo Sapiens
AHNISNQLS

SEQ ID NO: 1323552 - protein, 9 aa, Homo Sapiens
VQAWLFSDH

SEQ ID NO: 1323553 - protein, 9 aa, Homo Sapiens
VFLRIDMYA

SEQ ID NO: 1323554 - protein, 9 aa, Homo Sapiens
GVPETPKEM

SEQ ID NO: 1323555 - protein, 9 aa, Homo Sapiens
SGTVNIHTR

SEQ ID NO: 1323556 - protein, 9 aa, Homo Sapiens
FQAENSQSR

SEQ ID NO: 1323557 - protein, 9 aa, Homo Sapiens
PPLRFLWFT

SEQ ID NO: 1323558 - protein, 9 aa, Homo Sapiens
EDTYERCIM

SEQ ID NO: 1323559 - protein, 9 aa, Homo Sapiens
PATPMTSAT

SEQ ID NO: 1323560 - protein, 9 aa, Homo Sapiens
QVAEGFISC

SEQ ID NO: 1323561 - protein, 9 aa, Homo Sapiens
KELSKCQFS

SEQ ID NO: 1323562 - protein, 9 aa, Homo Sapiens
FIRYNDMPI

SEQ ID NO: 1323563 - protein, 9 aa, Homo Sapiens
DFEKAHHSK

SEQ ID NO: 1323564 - protein, 9 aa, Homo Sapiens
DEMKCMFNQ

SEQ ID NO: 1323565 - protein, 9 aa, Homo Sapiens
KQRRESLIL

SEQ ID NO: 1323566 - protein, 9 aa, Homo Sapiens
MISIWIFFF

SEQ ID NO: 1323567 - protein, 9 aa, Homo Sapiens
SSGVPPPGQ

SEQ ID NO: 1323568 - protein, 9 aa, Homo Sapiens
IASHYPTLW

SEQ ID NO: 1323569 - protein, 9 aa, Homo Sapiens
YGALGMSRC

SEQ ID NO: 1323570 - protein, 9 aa, Homo Sapiens
GAFPTPCPL

SEQ ID NO: 1323571 - protein, 9 aa, Homo Sapiens
IIQEVEDEY

SEQ ID NO: 1323572 - protein, 9 aa, Homo Sapiens
QNPMANYSL

SEQ ID NO: 1323573 - protein, 9 aa, Homo Sapiens
ALLSCNTEA

SEQ ID NO: 1323574 - protein, 9 aa, Homo Sapiens
DSKIMVCEK

SEQ ID NO: 1323575 - protein, 9 aa, Homo Sapiens
HIGDVIQKL

SEQ ID NO: 1323576 - protein, 9 aa, Homo Sapiens
GLQVDYIFR

SEQ ID NO: 1323577 - protein, 9 aa, Homo Sapiens
EEPQMVLYL

SEQ ID NO: 1323578 - protein, 9 aa, Homo Sapiens
LGKLNAVIS

SEQ ID NO: 1323579 - protein, 9 aa, Homo Sapiens
EWRYRNVES

SEQ ID NO: 1323580 - protein, 9 aa, Homo Sapiens
MSVTYCVGD

SEQ ID NO: 1323581 - protein, 9 aa, Homo Sapiens
LKGHPGYTA

SEQ ID NO: 1323582 - protein, 9 aa, Homo Sapiens
KYIELPYGR

SEQ ID NO: 1323583 - protein, 9 aa, Homo Sapiens
SCTNKNLFK

SEQ ID NO: 1323584 - protein, 9 aa, Homo Sapiens
MRAFQHNTV

SEQ ID NO: 1323585 - protein, 9 aa, Homo Sapiens
GEAVHMTHL

SEQ ID NO: 1323586 - protein, 9 aa, Homo Sapiens
LYFTFYIIM

SEQ ID NO: 1323587 - protein, 9 aa, Homo Sapiens
MTYDRYVAI

SEQ ID NO: 1323588 - protein, 9 aa, Homo Sapiens
TMHMWCHTS

SEQ ID NO: 1323589 - protein, 9 aa, Homo Sapiens
PLYSKHFSI

SEQ ID NO: 1323590 - protein, 9 aa, Homo Sapiens
HPQIVLTSQ

SEQ ID NO: 1323591 - protein, 9 aa, Homo Sapiens
PKITSPLNV

SEQ ID NO: 1323592 - protein, 9 aa, Homo Sapiens
GTAGSLDED

SEQ ID NO: 1323593 - protein, 9 aa, Homo Sapiens
KYDACDVER

SEQ ID NO: 1323594 - protein, 9 aa, Homo Sapiens
LCCITQHTL

SEQ ID NO: 1323595 - protein, 9 aa, Homo Sapiens
MDGPGQDAP

SEQ ID NO: 1323596 - protein, 9 aa, Homo Sapiens
KGEPVDPGP

SEQ ID NO: 1323597 - protein, 9 aa, Homo Sapiens
EHTFTFRNS

SEQ ID NO: 1323598 - protein, 9 aa, Homo Sapiens
PGSWGSLGD

SEQ ID NO: 1323599 - protein, 9 aa, Homo Sapiens
HPKGCDNII

SEQ ID NO: 1323600 - protein, 9 aa, Homo Sapiens
GRGVEKSPH

SEQ ID NO: 1323601 - protein, 9 aa, Homo Sapiens
RSRTNGSVT

SEQ ID NO: 1323602 - protein, 9 aa, Homo Sapiens
HCKVSAFVM

SEQ ID NO: 1323603 - protein, 9 aa, Homo Sapiens
FYSGTGVHK

SEQ ID NO: 1323604 - protein, 9 aa, Homo Sapiens
GWLDLILLK

SEQ ID NO: 1323605 - protein, 9 aa, Homo Sapiens
EFSVILNQC

SEQ ID NO: 1323606 - protein, 9 aa, Homo Sapiens
VQPPKPSSD

SEQ ID NO: 1323607 - protein, 9 aa, Homo Sapiens
ARAPPSRCT

SEQ ID NO: 1323608 - protein, 9 aa, Homo Sapiens
FQHNTVLTE

SEQ ID NO: 1323609 - protein, 9 aa, Homo Sapiens
DTTRHSALH

SEQ ID NO: 1323610 - protein, 9 aa, Homo Sapiens
SLKGHPGYT

SEQ ID NO: 1323611 - protein, 9 aa, Homo Sapiens
TKSLPCRQP

SEQ ID NO: 1323612 - protein, 9 aa, Homo Sapiens
REGRRPPTS

SEQ ID NO: 1323613 - protein, 9 aa, Homo Sapiens
QALRHGVCV

SEQ ID NO: 1323614 - protein, 9 aa, Homo Sapiens
NHPIIQWFW

SEQ ID NO: 1323615 - protein, 9 aa, Homo Sapiens
SGLGAWSHF

SEQ ID NO: 1323616 - protein, 9 aa, Homo Sapiens
GRRGMRALQ

SEQ ID NO: 1323617 - protein, 9 aa, Homo Sapiens
RTRIQGRVT

SEQ ID NO: 1323618 - protein, 9 aa, Homo Sapiens
LKYKVISEE

SEQ ID NO: 1323619 - protein, 9 aa, Homo Sapiens
GTEAEKLAR

SEQ ID NO: 1323620 - protein, 9 aa, Homo Sapiens
WKSGKMTHP

SEQ ID NO: 1323621 - protein, 9 aa, Homo Sapiens
IIISVKTCS

SEQ ID NO: 1323622 - protein, 9 aa, Homo Sapiens
WRQGGSPVG

SEQ ID NO: 1323623 - protein, 9 aa, Homo Sapiens
FEYYVRFTL

SEQ ID NO: 1323624 - protein, 9 aa, Homo Sapiens
GSSNVEVFI

SEQ ID NO: 1323625 - protein, 9 aa, Homo Sapiens
FPQAQAALQ

SEQ ID NO: 1323626 - protein, 9 aa, Homo Sapiens
YHDKPGSSL

SEQ ID NO: 1323627 - protein, 9 aa, Homo Sapiens
IPPPLPTMP

SEQ ID NO: 1323628 - protein, 9 aa, Homo Sapiens
TPARSPTGA

SEQ ID NO: 1323629 - protein, 9 aa, Homo Sapiens
SDIPSSTTS

SEQ ID NO: 1323630 - protein, 9 aa, Homo Sapiens
LLHHTHDEI

SEQ ID NO: 1323631 - protein, 9 aa, Homo Sapiens
TRPSSCTSA

SEQ ID NO: 1323632 - protein, 9 aa, Homo Sapiens
LMHDLKDQG

SEQ ID NO: 1323633 - protein, 9 aa, Homo Sapiens
TWNNSKLPN

SEQ ID NO: 1323634 - protein, 9 aa, Homo Sapiens
TWTFPRMTP

SEQ ID NO: 1323635 - protein, 9 aa, Homo Sapiens
QFMDHTHYL

SEQ ID NO: 1323636 - protein, 9 aa, Homo Sapiens
KEETRCKTE

SEQ ID NO: 1323637 - protein, 9 aa, Homo Sapiens
KLGNISKPI

SEQ ID NO: 1323638 - protein, 9 aa, Homo Sapiens
DIILYWEHH

SEQ ID NO: 1323639 - protein, 9 aa, Homo Sapiens
FFGGKQEDV

SEQ ID NO: 1323640 - protein, 9 aa, Homo Sapiens
VALISIFVV

SEQ ID NO: 1323641 - protein, 9 aa, Homo Sapiens
DGKSFLHDN

SEQ ID NO: 1323642 - protein, 9 aa, Homo Sapiens
KLCKSEECG

SEQ ID NO: 1323643 - protein, 9 aa, Homo Sapiens
LGSITLLGL

SEQ ID NO: 1323644 - protein, 9 aa, Homo Sapiens
SQASRHFGT

SEQ ID NO: 1323645 - protein, 9 aa, Homo Sapiens
LVKTCDSSP

SEQ ID NO: 1323646 - protein, 9 aa, Homo Sapiens
HVSSEAGNM

SEQ ID NO: 1323647 - protein, 9 aa, Homo Sapiens
CAQIPCIPK

SEQ ID NO: 1323648 - protein, 9 aa, Homo Sapiens
KALSTVRGC

SEQ ID NO: 1323649 - protein, 9 aa, Homo Sapiens
RETILNLLC

SEQ ID NO: 1323650 - protein, 9 aa, Homo Sapiens
KSTPGRSRL

SEQ ID NO: 1323651 - protein, 9 aa, Homo Sapiens
TMSYPMHSV

SEQ ID NO: 1323652 - protein, 9 aa, Homo Sapiens
VSLNIRKST

SEQ ID NO: 1323653 - protein, 9 aa, Homo Sapiens
CMSVAWNLL

SEQ ID NO: 1323654 - protein, 9 aa, Homo Sapiens
VHFTVDKQN

SEQ ID NO: 1323655 - protein, 9 aa, Homo Sapiens
HLKYVEQRK

SEQ ID NO: 1323656 - protein, 9 aa, Homo Sapiens
YMALGILGF

SEQ ID NO: 1323657 - protein, 9 aa, Homo Sapiens
VAMSHKIGR

SEQ ID NO: 1323658 - protein, 9 aa, Homo Sapiens
SVIPASVLS

SEQ ID NO: 1323659 - protein, 9 aa, Homo Sapiens
VVCGSTCNN

SEQ ID NO: 1323660 - protein, 9 aa, Homo Sapiens
HGMLLPGIE

SEQ ID NO: 1323661 - protein, 9 aa, Homo Sapiens
RSRLSVRNV

SEQ ID NO: 1323662 - protein, 9 aa, Homo Sapiens
HNTCFICAV

SEQ ID NO: 1323663 - protein, 9 aa, Homo Sapiens
ASILKQLVV

SEQ ID NO: 1323664 - protein, 9 aa, Homo Sapiens
IFREDPIIV

SEQ ID NO: 1323665 - protein, 9 aa, Homo Sapiens
FEAHYVWDY

SEQ ID NO: 1323666 - protein, 9 aa, Homo Sapiens
KGICTLLFA

SEQ ID NO: 1323667 - protein, 9 aa, Homo Sapiens
ESTSMDTPP

SEQ ID NO: 1323668 - protein, 9 aa, Homo Sapiens
IPHPEVPRH

SEQ ID NO: 1323669 - protein, 9 aa, Homo Sapiens
LTMHMWCHT

SEQ ID NO: 1323670 - protein, 9 aa, Homo Sapiens
MTEAKMKKF

SEQ ID NO: 1323671 - protein, 9 aa, Homo Sapiens
YLLAAISYD

SEQ ID NO: 1323672 - protein, 9 aa, Homo Sapiens
AHPSRPCRM

SEQ ID NO: 1323673 - protein, 9 aa, Homo Sapiens
IHHWRDRHH

SEQ ID NO: 1323674 - protein, 9 aa, Homo Sapiens
SLLQIEAGP

SEQ ID NO: 1323675 - protein, 9 aa, Homo Sapiens
LHLLGTSNS

SEQ ID NO: 1323676 - protein, 9 aa, Homo Sapiens
AEWNSPLSF

SEQ ID NO: 1323677 - protein, 9 aa, Homo Sapiens
GGSCPFRHC

SEQ ID NO: 1323678 - protein, 9 aa, Homo Sapiens
LTAEGKNID

SEQ ID NO: 1323679 - protein, 9 aa, Homo Sapiens
EKTVSRRSS

SEQ ID NO: 1323680 - protein, 9 aa, Homo Sapiens
THVPENPIL

SEQ ID NO: 1323681 - protein, 9 aa, Homo Sapiens
MFSPEHPVE

SEQ ID NO: 1323682 - protein, 9 aa, Homo Sapiens
DEGDGKSNN

SEQ ID NO: 1323683 - protein, 9 aa, Homo Sapiens
NYEIMGRAL

SEQ ID NO: 1323684 - protein, 9 aa, Homo Sapiens
MWGRVLRKA

SEQ ID NO: 1323685 - protein, 9 aa, Homo Sapiens
TDLKLWDTK

SEQ ID NO: 1323686 - protein, 9 aa, Homo Sapiens
LGGEEVRPN

SEQ ID NO: 1323687 - protein, 9 aa, Homo Sapiens
GLNGMLTGQ

SEQ ID NO: 1323688 - protein, 9 aa, Homo Sapiens
VYAVTKLAG

SEQ ID NO: 1323689 - protein, 9 aa, Homo Sapiens
GDVEKEKKV

SEQ ID NO: 1323690 - protein, 9 aa, Homo Sapiens
SGASGLDGK

SEQ ID NO: 1323691 - protein, 9 aa, Homo Sapiens
HFFCEAPML

SEQ ID NO: 1323692 - protein, 9 aa, Homo Sapiens
ATTSLENTK

SEQ ID NO: 1323693 - protein, 9 aa, Homo Sapiens
SMAYDHYAA

SEQ ID NO: 1323694 - protein, 9 aa, Homo Sapiens
GFGTEAEKL

SEQ ID NO: 1323695 - protein, 9 aa, Homo Sapiens
QKSSSLLHS

SEQ ID NO: 1323696 - protein, 9 aa, Homo Sapiens
HHIEKKILT

SEQ ID NO: 1323697 - protein, 9 aa, Homo Sapiens
RVSIAVAPF

SEQ ID NO: 1323698 - protein, 9 aa, Homo Sapiens
MTPFMSVVS

SEQ ID NO: 1323699 - protein, 9 aa, Homo Sapiens
TRVIYSILQ

SEQ ID NO: 1323700 - protein, 9 aa, Homo Sapiens
GASVQGQPL

SEQ ID NO: 1323701 - protein, 9 aa, Homo Sapiens
QDECDVSAV

SEQ ID NO: 1323702 - protein, 9 aa, Homo Sapiens
GLFQYLMRP

SEQ ID NO: 1323703 - protein, 9 aa, Homo Sapiens
HYYVYNSVS

SEQ ID NO: 1323704 - protein, 9 aa, Homo Sapiens
ISSLSKVVQ

SEQ ID NO: 1323705 - protein, 9 aa, Homo Sapiens
CVRHWHLWK

SEQ ID NO: 1323706 - protein, 9 aa, Homo Sapiens
KLYVCSECG

SEQ ID NO: 1323707 - protein, 9 aa, Homo Sapiens
RSCGHTRAP

SEQ ID NO: 1323708 - protein, 9 aa, Homo Sapiens
QTCPRSNTL

SEQ ID NO: 1323709 - protein, 9 aa, Homo Sapiens
FLPRGRGIM

SEQ ID NO: 1323710 - protein, 9 aa, Homo Sapiens
FFTTIFQNF

SEQ ID NO: 1323711 - protein, 9 aa, Homo Sapiens
GGVTGWCVG

SEQ ID NO: 1323712 - protein, 9 aa, Homo Sapiens
TTELFLVME

SEQ ID NO: 1323713 - protein, 9 aa, Homo Sapiens
SLGSYSSSP

SEQ ID NO: 1323714 - protein, 9 aa, Homo Sapiens
YTYISVTGC

SEQ ID NO: 1323715 - protein, 9 aa, Homo Sapiens
KYKPRPKCT

SEQ ID NO: 1323716 - protein, 9 aa, Homo Sapiens
NNQEPLREE

SEQ ID NO: 1323717 - protein, 9 aa, Homo Sapiens
NCMKSVLIG

SEQ ID NO: 1323718 - protein, 9 aa, Homo Sapiens
TFLPRGRGI

SEQ ID NO: 1323719 - protein, 9 aa, Homo Sapiens
RLTNILKEI

SEQ ID NO: 1323720 - protein, 9 aa, Homo Sapiens
NNRMSPGMA

SEQ ID NO: 1323721 - protein, 9 aa, Homo Sapiens
KLLARAVPA

SEQ ID NO: 1323722 - protein, 9 aa, Homo Sapiens
LSFLITHII

SEQ ID NO: 1323723 - protein, 9 aa, Homo Sapiens
KANPHPFTC

SEQ ID NO: 1323724 - protein, 9 aa, Homo Sapiens
GYYRMDGIL

SEQ ID NO: 1323725 - protein, 9 aa, Homo Sapiens
MIEVLISDI

SEQ ID NO: 1323726 - protein, 9 aa, Homo Sapiens
ARTCSPCSP

SEQ ID NO: 1323727 - protein, 9 aa, Homo Sapiens
CDKKRGASS

SEQ ID NO: 1323728 - protein, 9 aa, Homo Sapiens
DDCGHIISL

SEQ ID NO: 1323729 - protein, 9 aa, Homo Sapiens
VRLYRRSRA

SEQ ID NO: 1323730 - protein, 9 aa, Homo Sapiens
VPWYSEACT

SEQ ID NO: 1323731 - protein, 9 aa, Homo Sapiens
LQGTRVPSS

SEQ ID NO: 1323732 - protein, 9 aa, Homo Sapiens
LHRCRHDTM

SEQ ID NO: 1323733 - protein, 9 aa, Homo Sapiens
NEELIDLCQ

SEQ ID NO: 1323734 - protein, 9 aa, Homo Sapiens
QPYNSRRVL

SEQ ID NO: 1323735 - protein, 9 aa, Homo Sapiens
CGHHGPCIP

SEQ ID NO: 1323736 - protein, 9 aa, Homo Sapiens
GAVFQHGMR

SEQ ID NO: 1323737 - protein, 9 aa, Homo Sapiens
KPHACTQCG

SEQ ID NO: 1323738 - protein, 9 aa, Homo Sapiens
WELIKILAY

SEQ ID NO: 1323739 - protein, 9 aa, Homo Sapiens
LAMGTRATS

SEQ ID NO: 1323740 - protein, 9 aa, Homo Sapiens
TSRSSAATA

SEQ ID NO: 1323741 - protein, 9 aa, Homo Sapiens
MRDPKRLRP

SEQ ID NO: 1323742 - protein, 9 aa, Homo Sapiens
DKNMLDSFI

SEQ ID NO: 1323743 - protein, 9 aa, Homo Sapiens
YVYRVLFSL

SEQ ID NO: 1323744 - protein, 9 aa, Homo Sapiens
TMEEGSGQL

SEQ ID NO: 1323745 - protein, 9 aa, Homo Sapiens
LMFGASTGP

SEQ ID NO: 1323746 - protein, 9 aa, Homo Sapiens
NMCKKCGAT

SEQ ID NO: 1323747 - protein, 9 aa, Homo Sapiens
QSTILPSEP

SEQ ID NO: 1323748 - protein, 9 aa, Homo Sapiens
CNFQAIIIS

SEQ ID NO: 1323749 - protein, 9 aa, Homo Sapiens
GDTVTFTNA

SEQ ID NO: 1323750 - protein, 9 aa, Homo Sapiens
LPHQRSLWE

SEQ ID NO: 1323751 - protein, 9 aa, Homo Sapiens
GPDTVAYAC

SEQ ID NO: 1323752 - protein, 9 aa, Homo Sapiens
MLISWLQAQ

SEQ ID NO: 1323753 - protein, 9 aa, Homo Sapiens
NGEILPTPG

SEQ ID NO: 1323754 - protein, 9 aa, Homo Sapiens
QQYRHKMRW

SEQ ID NO: 1323755 - protein, 9 aa, Homo Sapiens
TILMVVMEV

SEQ ID NO: 1323756 - protein, 9 aa, Homo Sapiens
HWIWFNLEP

SEQ ID NO: 1323757 - protein, 9 aa, Homo Sapiens
RQNISQSSS

SEQ ID NO: 1323758 - protein, 9 aa, Homo Sapiens
WRYRNVESL

SEQ ID NO: 1323759 - protein, 9 aa, Homo Sapiens
KTVGFSLGV

SEQ ID NO: 1323760 - protein, 9 aa, Homo Sapiens
QEDVEAAMR

SEQ ID NO: 1323761 - protein, 9 aa, Homo Sapiens
EHMRVYDNV

SEQ ID NO: 1323762 - protein, 9 aa, Homo Sapiens
LPNALPSAI

SEQ ID NO: 1323763 - protein, 9 aa, Homo Sapiens
PHPLKFTEK

SEQ ID NO: 1323764 - protein, 9 aa, Homo Sapiens
EDAELLWHL

SEQ ID NO: 1323765 - protein, 9 aa, Homo Sapiens
HTATKIEAP

SEQ ID NO: 1323766 - protein, 9 aa, Homo Sapiens
QKTNIFVPS

SEQ ID NO: 1323767 - protein, 9 aa, Homo Sapiens
DVFLRIDMY

SEQ ID NO: 1323768 - protein, 9 aa, Homo Sapiens
QRWRSSERY

SEQ ID NO: 1323769 - protein, 9 aa, Homo Sapiens
DATTHFETP

SEQ ID NO: 1323770 - protein, 9 aa, Homo Sapiens
QPHLRCACV

SEQ ID NO: 1323771 - protein, 9 aa, Homo Sapiens
TCTSASTRA

SEQ ID NO: 1323772 - protein, 9 aa, Homo Sapiens
LLKPEQVST

SEQ ID NO: 1323773 - protein, 9 aa, Homo Sapiens
TVFDNFFYQ

SEQ ID NO: 1323774 - protein, 9 aa, Homo Sapiens
SENCEMSTM

SEQ ID NO: 1323775 - protein, 9 aa, Homo Sapiens
ASQLQALNI

SEQ ID NO: 1323776 - protein, 9 aa, Homo Sapiens
LQRCLSQAE

SEQ ID NO: 1323777 - protein, 9 aa, Homo Sapiens
VHMTHLLVQ

SEQ ID NO: 1323778 - protein, 9 aa, Homo Sapiens
GEKHYECEE

SEQ ID NO: 1323779 - protein, 9 aa, Homo Sapiens
YIKSFGFNL

SEQ ID NO: 1323780 - protein, 9 aa, Homo Sapiens
QEALEMSCN

SEQ ID NO: 1323781 - protein, 9 aa, Homo Sapiens
LLGRWKTLL

SEQ ID NO: 1323782 - protein, 9 aa, Homo Sapiens
KHLGTGLSP

SEQ ID NO: 1323783 - protein, 9 aa, Homo Sapiens
ANVSRARSE

SEQ ID NO: 1323784 - protein, 9 aa, Homo Sapiens
RVVIKDKQE

SEQ ID NO: 1323785 - protein, 9 aa, Homo Sapiens
SSRSASDSV

SEQ ID NO: 1323786 - protein, 9 aa, Homo Sapiens
TYNGEANDG

SEQ ID NO: 1323787 - protein, 9 aa, Homo Sapiens
RKTRPILDV

SEQ ID NO: 1323788 - protein, 9 aa, Homo Sapiens
ASTPVRSPT

SEQ ID NO: 1323789 - protein, 9 aa, Homo Sapiens
KKQEEGVPD

SEQ ID NO: 1323790 - protein, 9 aa, Homo Sapiens
SGRTVGNGK

SEQ ID NO: 1323791 - protein, 9 aa, Homo Sapiens
QTWTDSHLR

SEQ ID NO: 1323792 - protein, 9 aa, Homo Sapiens
LNSLADRSC

SEQ ID NO: 1323793 - protein, 9 aa, Homo Sapiens
GHALHNNFQ

SEQ ID NO: 1323794 - protein, 9 aa, Homo Sapiens
WILPDSQEE

SEQ ID NO: 1323795 - protein, 9 aa, Homo Sapiens
ETYFDTQNN

SEQ ID NO: 1323796 - protein, 9 aa, Homo Sapiens
VTCRFKHPV

SEQ ID NO: 1323797 - protein, 9 aa, Homo Sapiens
DLHLLEKLG

SEQ ID NO: 1323798 - protein, 9 aa, Homo Sapiens
SGKMTHPLC

SEQ ID NO: 1323799 - protein, 9 aa, Homo Sapiens
NEKYYILWP

SEQ ID NO: 1323800 - protein, 9 aa, Homo Sapiens
QKKKADSYI

SEQ ID NO: 1323801 - protein, 9 aa, Homo Sapiens
FRGANTFEM

SEQ ID NO: 1323802 - protein, 9 aa, Homo Sapiens
HEERPTQRD

SEQ ID NO: 1323803 - protein, 9 aa, Homo Sapiens
QNISRTVIQ

SEQ ID NO: 1323804 - protein, 9 aa, Homo Sapiens
TRITLQEEA

SEQ ID NO: 1323805 - protein, 9 aa, Homo Sapiens
PQMVLYLQQ

SEQ ID NO: 1323806 - protein, 9 aa, Homo Sapiens
HFVKFKYAH

SEQ ID NO: 1323807 - protein, 9 aa, Homo Sapiens
ARASDLLQG

SEQ ID NO: 1323808 - protein, 9 aa, Homo Sapiens
FTLWRQFIK

SEQ ID NO: 1323809 - protein, 9 aa, Homo Sapiens
RNATHEQTA

SEQ ID NO: 1323810 - protein, 9 aa, Homo Sapiens
FTGGLKNSK

SEQ ID NO: 1323811 - protein, 9 aa, Homo Sapiens
VLGKAVLWD

SEQ ID NO: 1323812 - protein, 9 aa, Homo Sapiens
AFSYLNSFQ

SEQ ID NO: 1323813 - protein, 9 aa, Homo Sapiens
LDESTIVVK

SEQ ID NO: 1323814 - protein, 9 aa, Homo Sapiens
VGDLCVSFS

SEQ ID NO: 1323815 - protein, 9 aa, Homo Sapiens
RCIHFLCLR

SEQ ID NO: 1323816 - protein, 9 aa, Homo Sapiens
FTGTHSGHL

SEQ ID NO: 1323817 - protein, 9 aa, Homo Sapiens
TELVLPDEV

SEQ ID NO: 1323818 - protein, 9 aa, Homo Sapiens
ICNLLLYFT

SEQ ID NO: 1323819 - protein, 9 aa, Homo Sapiens
LCCTLVALS

SEQ ID NO: 1323820 - protein, 9 aa, Homo Sapiens
LCRILSQST

SEQ ID NO: 1323821 - protein, 9 aa, Homo Sapiens
DCIASLPFQ

SEQ ID NO: 1323822 - protein, 9 aa, Homo Sapiens
ATATLTAGQ

SEQ ID NO: 1323823 - protein, 9 aa, Homo Sapiens
FFIHNLDQL

SEQ ID NO: 1323824 - protein, 9 aa, Homo Sapiens
EDLEVIKNP

SEQ ID NO: 1323825 - protein, 9 aa, Homo Sapiens
IRKLKSILP

SEQ ID NO: 1323826 - protein, 9 aa, Homo Sapiens
AEMAKKQLN

SEQ ID NO: 1323827 - protein, 9 aa, Homo Sapiens
PQPGSCSVG

SEQ ID NO: 1323828 - protein, 9 aa, Homo Sapiens
TTTSLKGIP

SEQ ID NO: 1323829 - protein, 9 aa, Homo Sapiens
PLGPPGPVG

SEQ ID NO: 1323830 - protein, 9 aa, Homo Sapiens
PRKKSRHHG

SEQ ID NO: 1323831 - protein, 9 aa, Homo Sapiens
TQMPRERVV

SEQ ID NO: 1323832 - protein, 9 aa, Homo Sapiens
QTYIRKVGG

SEQ ID NO: 1323833 - protein, 9 aa, Homo Sapiens
WKEYFCDYT

SEQ ID NO: 1323834 - protein, 9 aa, Homo Sapiens
VTSEDFLII

SEQ ID NO: 1323835 - protein, 9 aa, Homo Sapiens
SSSSQHRPS

SEQ ID NO: 1323836 - protein, 9 aa, Homo Sapiens
GKKQSPLIF

SEQ ID NO: 1323837 - protein, 9 aa, Homo Sapiens
PNERHVRIQ

SEQ ID NO: 1323838 - protein, 9 aa, Homo Sapiens
YGEWIPRLL

SEQ ID NO: 1323839 - protein, 9 aa, Homo Sapiens
HASWVTNDT

SEQ ID NO: 1323840 - protein, 9 aa, Homo Sapiens
SDLSDTLVI

SEQ ID NO: 1323841 - protein, 9 aa, Homo Sapiens
LAAGASSAA

SEQ ID NO: 1323842 - protein, 9 aa, Homo Sapiens
EGSRVWRVS

SEQ ID NO: 1323843 - protein, 9 aa, Homo Sapiens
WRGKYKCVF

SEQ ID NO: 1323844 - protein, 9 aa, Homo Sapiens
ASMAYDRYM

SEQ ID NO: 1323845 - protein, 9 aa, Homo Sapiens
PFHSKVLKD

SEQ ID NO: 1323846 - protein, 9 aa, Homo Sapiens
YQLTFSLSQ

SEQ ID NO: 1323847 - protein, 9 aa, Homo Sapiens
SILYVLTGS

SEQ ID NO: 1323848 - protein, 9 aa, Homo Sapiens
ECDKAFTWS

SEQ ID NO: 1323849 - protein, 9 aa, Homo Sapiens
HMDMKPLVV

SEQ ID NO: 1323850 - protein, 9 aa, Homo Sapiens
EWSIKLNWT

SEQ ID NO: 1323851 - protein, 9 aa, Homo Sapiens
SAIMDLLLH

SEQ ID NO: 1323852 - protein, 9 aa, Homo Sapiens
KHHPTFTRS

SEQ ID NO: 1323853 - protein, 9 aa, Homo Sapiens
CFNHLDLPP

SEQ ID NO: 1323854 - protein, 9 aa, Homo Sapiens
RSQTHSRSR

SEQ ID NO: 1323855 - protein, 9 aa, Homo Sapiens
PVMVVDTAW

SEQ ID NO: 1323856 - protein, 9 aa, Homo Sapiens
NNTGYINTS

SEQ ID NO: 1323857 - protein, 9 aa, Homo Sapiens
KKQSPLIFI

SEQ ID NO: 1323858 - protein, 9 aa, Homo Sapiens
TEHISIHQP

SEQ ID NO: 1323859 - protein, 9 aa, Homo Sapiens
LNALREENA

SEQ ID NO: 1323860 - protein, 9 aa, Homo Sapiens
WGEENTDYV

SEQ ID NO: 1323861 - protein, 9 aa, Homo Sapiens
SLSPMSFPT

SEQ ID NO: 1323862 - protein, 9 aa, Homo Sapiens
LQLSHQPHL

SEQ ID NO: 1323863 - protein, 9 aa, Homo Sapiens
ASGPTSAAP

SEQ ID NO: 1323864 - protein, 9 aa, Homo Sapiens
FRRVYYSPT

SEQ ID NO: 1323865 - protein, 9 aa, Homo Sapiens
PDAKDVLIQ

SEQ ID NO: 1323866 - protein, 9 aa, Homo Sapiens
LRYYYNKHI

SEQ ID NO: 1323867 - protein, 9 aa, Homo Sapiens
GERRALACV

SEQ ID NO: 1323868 - protein, 9 aa, Homo Sapiens
RDPPASHED

SEQ ID NO: 1323869 - protein, 9 aa, Homo Sapiens
RLHHYLNFI

SEQ ID NO: 1323870 - protein, 9 aa, Homo Sapiens
EKKMPHGSV

SEQ ID NO: 1323871 - protein, 9 aa, Homo Sapiens
KYLHWQVVD

SEQ ID NO: 1323872 - protein, 9 aa, Homo Sapiens
CSLLLCWGG

SEQ ID NO: 1323873 - protein, 9 aa, Homo Sapiens
EDTVRFTLR

SEQ ID NO: 1323874 - protein, 9 aa, Homo Sapiens
THLHPCRRL

SEQ ID NO: 1323875 - protein, 9 aa, Homo Sapiens
LGIESSGIN

SEQ ID NO: 1323876 - protein, 9 aa, Homo Sapiens
PKLLPAGHS

SEQ ID NO: 1323877 - protein, 9 aa, Homo Sapiens
ENLTGCLTH

SEQ ID NO: 1323878 - protein, 9 aa, Homo Sapiens
YSKVYDPED

SEQ ID NO: 1323879 - protein, 9 aa, Homo Sapiens
DICFYIDIT

SEQ ID NO: 1323880 - protein, 9 aa, Homo Sapiens
RYHPQIVLT

SEQ ID NO: 1323881 - protein, 9 aa, Homo Sapiens
LHFLLGDKA

SEQ ID NO: 1323882 - protein, 9 aa, Homo Sapiens
GQWTPWGDC

SEQ ID NO: 1323883 - protein, 9 aa, Homo Sapiens
PSSTMLQGQ

SEQ ID NO: 1323884 - protein, 9 aa, Homo Sapiens
PDYCVHNES

SEQ ID NO: 1323885 - protein, 9 aa, Homo Sapiens
RVCGWWPFS

SEQ ID NO: 1323886 - protein, 9 aa, Homo Sapiens
EHKNQDPGT

SEQ ID NO: 1323887 - protein, 9 aa, Homo Sapiens
QDITLLASL

SEQ ID NO: 1323888 - protein, 9 aa, Homo Sapiens
FGNALIQRL

SEQ ID NO: 1323889 - protein, 9 aa, Homo Sapiens
INSLWTTPL

SEQ ID NO: 1323890 - protein, 9 aa, Homo Sapiens
RYVHETQEL

SEQ ID NO: 1323891 - protein, 9 aa, Homo Sapiens
LLTDTVPLP

SEQ ID NO: 1323892 - protein, 9 aa, Homo Sapiens
RFKHPVNVP

SEQ ID NO: 1323893 - protein, 9 aa, Homo Sapiens
HVSPSDYPC

SEQ ID NO: 1323894 - protein, 9 aa, Homo Sapiens
SCHDIRKVG

SEQ ID NO: 1323895 - protein, 9 aa, Homo Sapiens
SDCTEIIIV

SEQ ID NO: 1323896 - protein, 9 aa, Homo Sapiens
LLYVQGVAL

SEQ ID NO: 1323897 - protein, 9 aa, Homo Sapiens
DRITLKLVG

SEQ ID NO: 1323898 - protein, 9 aa, Homo Sapiens
RTHICCLNC

SEQ ID NO: 1323899 - protein, 9 aa, Homo Sapiens
PAAMMTQSQ

SEQ ID NO: 1323900 - protein, 9 aa, Homo Sapiens
DDKKRLVHK

SEQ ID NO: 1323901 - protein, 9 aa, Homo Sapiens
GKAGGHVKP

SEQ ID NO: 1323902 - protein, 9 aa, Homo Sapiens
YTACRPSVY

SEQ ID NO: 1323903 - protein, 9 aa, Homo Sapiens
NVVVGKRQD

SEQ ID NO: 1323904 - protein, 9 aa, Homo Sapiens
ELSVCAKPS

SEQ ID NO: 1323905 - protein, 9 aa, Homo Sapiens
PQASRGYMP

SEQ ID NO: 1323906 - protein, 9 aa, Homo Sapiens
YHMPFGFGM

SEQ ID NO: 1323907 - protein, 9 aa, Homo Sapiens
FLHQNTHTG

SEQ ID NO: 1323908 - protein, 9 aa, Homo Sapiens
MCDKVHISD

SEQ ID NO: 1323909 - protein, 9 aa, Homo Sapiens
NLKDEFDRL

SEQ ID NO: 1323910 - protein, 9 aa, Homo Sapiens
PEFIQSATM

SEQ ID NO: 1323911 - protein, 9 aa, Homo Sapiens
VWGLSKGFG

SEQ ID NO: 1323912 - protein, 9 aa, Homo Sapiens
PSQSSVQHQ

SEQ ID NO: 1323913 - protein, 9 aa, Homo Sapiens
VFLDDIIPN

SEQ ID NO: 1323914 - protein, 9 aa, Homo Sapiens
PDFIPAVRD

SEQ ID NO: 1323915 - protein, 9 aa, Homo Sapiens
GEAIIKRAG

SEQ ID NO: 1323916 - protein, 9 aa, Homo Sapiens
YERIHHSNL

SEQ ID NO: 1323917 - protein, 9 aa, Homo Sapiens
EGAHNISNQ

SEQ ID NO: 1323918 - protein, 9 aa, Homo Sapiens
AVPAFLKGK

SEQ ID NO: 1323919 - protein, 9 aa, Homo Sapiens
GLPSPVEEH

SEQ ID NO: 1323920 - protein, 9 aa, Homo Sapiens
IEERYEAIA

SEQ ID NO: 1323921 - protein, 9 aa, Homo Sapiens
EVRLIRNLN

SEQ ID NO: 1323922 - protein, 9 aa, Homo Sapiens
SSGTGIMGS

SEQ ID NO: 1323923 - protein, 9 aa, Homo Sapiens
VLDGFFFVV

SEQ ID NO: 1323924 - protein, 9 aa, Homo Sapiens
WFHGLGSRP

SEQ ID NO: 1323925 - protein, 9 aa, Homo Sapiens
LDIKTSNLL

SEQ ID NO: 1323926 - protein, 9 aa, Homo Sapiens
WKHSRTMIL

SEQ ID NO: 1323927 - protein, 9 aa, Homo Sapiens
MSLELDSRR

SEQ ID NO: 1323928 - protein, 9 aa, Homo Sapiens
RLWVLVVLD

SEQ ID NO: 1323929 - protein, 9 aa, Homo Sapiens
LREIQILLH

SEQ ID NO: 1323930 - protein, 9 aa, Homo Sapiens
WQIHVDLHL

SEQ ID NO: 1323931 - protein, 9 aa, Homo Sapiens
KLGLYMTTV

SEQ ID NO: 1323932 - protein, 9 aa, Homo Sapiens
HPHPREALQ

SEQ ID NO: 1323933 - protein, 9 aa, Homo Sapiens
FKRLPGGHI

SEQ ID NO: 1323934 - protein, 9 aa, Homo Sapiens
CIADLLLPG

SEQ ID NO: 1323935 - protein, 9 aa, Homo Sapiens
DGSIVGFFD

SEQ ID NO: 1323936 - protein, 9 aa, Homo Sapiens
WNRKLLEKY

SEQ ID NO: 1323937 - protein, 9 aa, Homo Sapiens
WYISPRLLL

SEQ ID NO: 1323938 - protein, 9 aa, Homo Sapiens
ASTFTLSSQ

SEQ ID NO: 1323939 - protein, 9 aa, Homo Sapiens
SPVGDVGLG

SEQ ID NO: 1323940 - protein, 9 aa, Homo Sapiens
YRVLFSLAE

SEQ ID NO: 1323941 - protein, 9 aa, Homo Sapiens
EKKKQKEEE

SEQ ID NO: 1323942 - protein, 9 aa, Homo Sapiens
FTRHSQTTT

SEQ ID NO: 1323943 - protein, 9 aa, Homo Sapiens
KAATKTRAT

SEQ ID NO: 1323944 - protein, 9 aa, Homo Sapiens
PDSTGPNIL

SEQ ID NO: 1323945 - protein, 9 aa, Homo Sapiens
ALTTHFTKR

SEQ ID NO: 1323946 - protein, 9 aa, Homo Sapiens
LKDDTTTKH

SEQ ID NO: 1323947 - protein, 9 aa, Homo Sapiens
TSVEEALER

SEQ ID NO: 1323948 - protein, 9 aa, Homo Sapiens
SLCESEQAR

SEQ ID NO: 1323949 - protein, 9 aa, Homo Sapiens
SIDLWGAGC

SEQ ID NO: 1323950 - protein, 9 aa, Homo Sapiens
PHRQLNFDS

SEQ ID NO: 1323951 - protein, 9 aa, Homo Sapiens
CVQAHCGAG

SEQ ID NO: 1323952 - protein, 9 aa, Homo Sapiens
RVPLVLEKA

SEQ ID NO: 1323953 - protein, 9 aa, Homo Sapiens
PHMIDYDSA

SEQ ID NO: 1323954 - protein, 9 aa, Homo Sapiens
PPPLLRHHL

SEQ ID NO: 1323955 - protein, 9 aa, Homo Sapiens
ISLATTDCI

SEQ ID NO: 1323956 - protein, 9 aa, Homo Sapiens
LSTSHFAWT

SEQ ID NO: 1323957 - protein, 9 aa, Homo Sapiens
REALVAELA

SEQ ID NO: 1323958 - protein, 9 aa, Homo Sapiens
QVNGQLIES

SEQ ID NO: 1323959 - protein, 9 aa, Homo Sapiens
DIDPELAQY

SEQ ID NO: 1323960 - protein, 9 aa, Homo Sapiens
PGQLTQQPH

SEQ ID NO: 1323961 - protein, 9 aa, Homo Sapiens
SNSHLVHHQ

SEQ ID NO: 1323962 - protein, 9 aa, Homo Sapiens
DSQEHNIIL

SEQ ID NO: 1323963 - protein, 9 aa, Homo Sapiens
RTVGNGKVY

SEQ ID NO: 1323964 - protein, 9 aa, Homo Sapiens
RISSNPVTK

SEQ ID NO: 1323965 - protein, 9 aa, Homo Sapiens
LLRGSCVVA

SEQ ID NO: 1323966 - protein, 9 aa, Homo Sapiens
GRAPGRASS

SEQ ID NO: 1323967 - protein, 9 aa, Homo Sapiens
KITSPLNVI

SEQ ID NO: 1323968 - protein, 9 aa, Homo Sapiens
GMGPHVPRQ

SEQ ID NO: 1323969 - protein, 9 aa, Homo Sapiens
KKTRHLGAA

SEQ ID NO: 1323970 - protein, 9 aa, Homo Sapiens
TKLPLQSLV

SEQ ID NO: 1323971 - protein, 9 aa, Homo Sapiens
IHHSNLVGM

SEQ ID NO: 1323972 - protein, 9 aa, Homo Sapiens
TVQGNTEVI

SEQ ID NO: 1323973 - protein, 9 aa, Homo Sapiens
SHFVAVDGV

SEQ ID NO: 1323974 - protein, 9 aa, Homo Sapiens
DAVQQYRHK

SEQ ID NO: 1323975 - protein, 9 aa, Homo Sapiens
NGVKPYQCK

SEQ ID NO: 1323976 - protein, 9 aa, Homo Sapiens
DSVVVYVYV

SEQ ID NO: 1323977 - protein, 9 aa, Homo Sapiens
RYRNVESLC

SEQ ID NO: 1323978 - protein, 9 aa, Homo Sapiens
ETVIKPVKP

SEQ ID NO: 1323979 - protein, 9 aa, Homo Sapiens
ECQCIPSKV

SEQ ID NO: 1323980 - protein, 9 aa, Homo Sapiens
VSKLVIQNV

SEQ ID NO: 1323981 - protein, 9 aa, Homo Sapiens
LPFDDQNLK

SEQ ID NO: 1323982 - protein, 9 aa, Homo Sapiens
KHIQAEVEA

SEQ ID NO: 1323983 - protein, 9 aa, Homo Sapiens
KYPEPLCFF

SEQ ID NO: 1323984 - protein, 9 aa, Homo Sapiens
HHWRSYHTG

SEQ ID NO: 1323985 - protein, 9 aa, Homo Sapiens
LSRLVVKTT

SEQ ID NO: 1323986 - protein, 9 aa, Homo Sapiens
QALNIPFML

SEQ ID NO: 1323987 - protein, 9 aa, Homo Sapiens
ILLVIDQKI

SEQ ID NO: 1323988 - protein, 9 aa, Homo Sapiens
QALHRVTLS

SEQ ID NO: 1323989 - protein, 9 aa, Homo Sapiens
QVSSEGKQI

SEQ ID NO: 1323990 - protein, 9 aa, Homo Sapiens
HRKMHAAEE

SEQ ID NO: 1323991 - protein, 9 aa, Homo Sapiens
PRPLRSNIA

SEQ ID NO: 1323992 - protein, 9 aa, Homo Sapiens
DAQGTHIGC

SEQ ID NO: 1323993 - protein, 9 aa, Homo Sapiens
LSAAGPAGG

SEQ ID NO: 1323994 - protein, 9 aa, Homo Sapiens
GTMLSTHTK

SEQ ID NO: 1323995 - protein, 9 aa, Homo Sapiens
KKLYCLDNP

SEQ ID NO: 1323996 - protein, 9 aa, Homo Sapiens
PKSHPKAEA

SEQ ID NO: 1323997 - protein, 9 aa, Homo Sapiens
LSKCQFSSG

SEQ ID NO: 1323998 - protein, 9 aa, Homo Sapiens
ERSFLGHVV

SEQ ID NO: 1323999 - protein, 9 aa, Homo Sapiens
RCLKRSRCM

SEQ ID NO: 1324000 - protein, 9 aa, Homo Sapiens
FQMSKDVII

SEQ ID NO: 1324001 - protein, 9 aa, Homo Sapiens
LQVLGESRE

SEQ ID NO: 1324002 - protein, 9 aa, Homo Sapiens
YNDMPIVRA

SEQ ID NO: 1324003 - protein, 9 aa, Homo Sapiens
QVQHTCQAL

SEQ ID NO: 1324004 - protein, 9 aa, Homo Sapiens
RSMSDNGIC

SEQ ID NO: 1324005 - protein, 9 aa, Homo Sapiens
EHLRQAVEL

SEQ ID NO: 1324006 - protein, 9 aa, Homo Sapiens
NIAGNNHLV

SEQ ID NO: 1324007 - protein, 9 aa, Homo Sapiens
DRRREDPTY

SEQ ID NO: 1324008 - protein, 9 aa, Homo Sapiens
ALTVQGHPP

SEQ ID NO: 1324009 - protein, 9 aa, Homo Sapiens
ELVLKYHED

SEQ ID NO: 1324010 - protein, 9 aa, Homo Sapiens
DSNDSHGSV

SEQ ID NO: 1324011 - protein, 9 aa, Homo Sapiens
QHHDLIEEY

SEQ ID NO: 1324012 - protein, 9 aa, Homo Sapiens
DLPMDADED

SEQ ID NO: 1324013 - protein, 9 aa, Homo Sapiens
GFHSNNIRL

SEQ ID NO: 1324014 - protein, 9 aa, Homo Sapiens
PTSQWSQYL

SEQ ID NO: 1324015 - protein, 9 aa, Homo Sapiens
SRQGLAEPG

SEQ ID NO: 1324016 - protein, 9 aa, Homo Sapiens
NPKDTPFST

SEQ ID NO: 1324017 - protein, 9 aa, Homo Sapiens
AHYLEPGIP

SEQ ID NO: 1324018 - protein, 9 aa, Homo Sapiens
LMLLCTSFY

SEQ ID NO: 1324019 - protein, 9 aa, Homo Sapiens
SWGCVGTVI

SEQ ID NO: 1324020 - protein, 9 aa, Homo Sapiens
PSYYPPSIG

SEQ ID NO: 1324021 - protein, 9 aa, Homo Sapiens
CFTARDDFA

SEQ ID NO: 1324022 - protein, 9 aa, Homo Sapiens
EFPPDLTLS

SEQ ID NO: 1324023 - protein, 9 aa, Homo Sapiens
QILLHFRHE

SEQ ID NO: 1324024 - protein, 9 aa, Homo Sapiens
LLTQILFPN

SEQ ID NO: 1324025 - protein, 9 aa, Homo Sapiens
AASPLKSCK

SEQ ID NO: 1324026 - protein, 9 aa, Homo Sapiens
SAWSSVFLR

SEQ ID NO: 1324027 - protein, 9 aa, Homo Sapiens
EFIQSATMP

SEQ ID NO: 1324028 - protein, 9 aa, Homo Sapiens
DMAGQERFR

SEQ ID NO: 1324029 - protein, 9 aa, Homo Sapiens
SELEQLWRT

SEQ ID NO: 1324030 - protein, 9 aa, Homo Sapiens
LDAVACSTT

SEQ ID NO: 1324031 - protein, 9 aa, Homo Sapiens
GAPLFMDRD

SEQ ID NO: 1324032 - protein, 9 aa, Homo Sapiens
TVLRPSGAV

SEQ ID NO: 1324033 - protein, 9 aa, Homo Sapiens
MGVLFGGCS

SEQ ID NO: 1324034 - protein, 9 aa, Homo Sapiens
AKRWIHDIR

SEQ ID NO: 1324035 - protein, 9 aa, Homo Sapiens
WRVSVAHFG

SEQ ID NO: 1324036 - protein, 9 aa, Homo Sapiens
PTMVLRHQQ

SEQ ID NO: 1324037 - protein, 9 aa, Homo Sapiens
GFLGQHMAE

SEQ ID NO: 1324038 - protein, 9 aa, Homo Sapiens
TIVTLVYLE

SEQ ID NO: 1324039 - protein, 9 aa, Homo Sapiens
YIQIDATIN

SEQ ID NO: 1324040 - protein, 9 aa, Homo Sapiens
VISDCTEII

SEQ ID NO: 1324041 - protein, 9 aa, Homo Sapiens
MRELLGGPK

SEQ ID NO: 1324042 - protein, 9 aa, Homo Sapiens
IIVVNQEIL

SEQ ID NO: 1324043 - protein, 9 aa, Homo Sapiens
VAWVIPVPQ

SEQ ID NO: 1324044 - protein, 9 aa, Homo Sapiens
VLKKRRNPQ

SEQ ID NO: 1324045 - protein, 9 aa, Homo Sapiens
VNVCCLVRE

SEQ ID NO: 1324046 - protein, 9 aa, Homo Sapiens
RDLKEALIR

SEQ ID NO: 1324047 - protein, 9 aa, Homo Sapiens
LLHLLATNY

SEQ ID NO: 1324048 - protein, 9 aa, Homo Sapiens
VEALLARDA

SEQ ID NO: 1324049 - protein, 9 aa, Homo Sapiens
TLFCSSDDE

SEQ ID NO: 1324050 - protein, 9 aa, Homo Sapiens
HGAVFAFLG

SEQ ID NO: 1324051 - protein, 9 aa, Homo Sapiens
HPSTLLTNL

SEQ ID NO: 1324052 - protein, 9 aa, Homo Sapiens
HPPSSLSPP

SEQ ID NO: 1324053 - protein, 9 aa, Homo Sapiens
THEQTAAAL

SEQ ID NO: 1324054 - protein, 9 aa, Homo Sapiens
PCIKYIGHY

SEQ ID NO: 1324055 - protein, 9 aa, Homo Sapiens
ALYYTHMDD

SEQ ID NO: 1324056 - protein, 9 aa, Homo Sapiens
EKLYTCLKC

SEQ ID NO: 1324057 - protein, 9 aa, Homo Sapiens
LLSVLGHSN

SEQ ID NO: 1324058 - protein, 9 aa, Homo Sapiens
RPQSPVGEN

SEQ ID NO: 1324059 - protein, 9 aa, Homo Sapiens
AVPQVLQNY

SEQ ID NO: 1324060 - protein, 9 aa, Homo Sapiens
VDNMDGLPA

SEQ ID NO: 1324061 - protein, 9 aa, Homo Sapiens
LRRLHLWMG

SEQ ID NO: 1324062 - protein, 9 aa, Homo Sapiens
ISINHKWVN

SEQ ID NO: 1324063 - protein, 9 aa, Homo Sapiens
NALIESTVC

SEQ ID NO: 1324064 - protein, 9 aa, Homo Sapiens
LTLLERRRI

SEQ ID NO: 1324065 - protein, 9 aa, Homo Sapiens
TVDTENIRR

SEQ ID NO: 1324066 - protein, 9 aa, Homo Sapiens
DCVPNAYHP

SEQ ID NO: 1324067 - protein, 9 aa, Homo Sapiens
MKWPRLLST

SEQ ID NO: 1324068 - protein, 9 aa, Homo Sapiens
LSSVMDKEN

SEQ ID NO: 1324069 - protein, 9 aa, Homo Sapiens
ERKDFEIWL

SEQ ID NO: 1324070 - protein, 9 aa, Homo Sapiens
FQFSAPGVS

SEQ ID NO: 1324071 - protein, 9 aa, Homo Sapiens
GGHEVKQGI

SEQ ID NO: 1324072 - protein, 9 aa, Homo Sapiens
SELERGTRM

SEQ ID NO: 1324073 - protein, 9 aa, Homo Sapiens
PPGWSLTLS

SEQ ID NO: 1324074 - protein, 9 aa, Homo Sapiens
TITRWPGDI

SEQ ID NO: 1324075 - protein, 9 aa, Homo Sapiens
VIAILSTMD

SEQ ID NO: 1324076 - protein, 9 aa, Homo Sapiens
NTNDLEKCR

SEQ ID NO: 1324077 - protein, 9 aa, Homo Sapiens
GADKSIYFH

SEQ ID NO: 1324078 - protein, 9 aa, Homo Sapiens
KTLEDTLHC

SEQ ID NO: 1324079 - protein, 9 aa, Homo Sapiens
QINFVFALI

SEQ ID NO: 1324080 - protein, 9 aa, Homo Sapiens
QAELGGFHK

SEQ ID NO: 1324081 - protein, 9 aa, Homo Sapiens
SLSLHDMFV

SEQ ID NO: 1324082 - protein, 9 aa, Homo Sapiens
LENMAQKFK

SEQ ID NO: 1324083 - protein, 9 aa, Homo Sapiens
VPKDKKDIP

SEQ ID NO: 1324084 - protein, 9 aa, Homo Sapiens
GVHRRSLDS

SEQ ID NO: 1324085 - protein, 9 aa, Homo Sapiens
NGVSAGNGD

SEQ ID NO: 1324086 - protein, 9 aa, Homo Sapiens
SSPEALHHP

SEQ ID NO: 1324087 - protein, 9 aa, Homo Sapiens
KGYLDQWAI

SEQ ID NO: 1324088 - protein, 9 aa, Homo Sapiens
DLQESSVRL

SEQ ID NO: 1324089 - protein, 9 aa, Homo Sapiens
HIRFTWALA

SEQ ID NO: 1324090 - protein, 9 aa, Homo Sapiens
SYAGWMQTC

SEQ ID NO: 1324091 - protein, 9 aa, Homo Sapiens
DVVCSFLHA

SEQ ID NO: 1324092 - protein, 9 aa, Homo Sapiens
GRFRPPEPH

SEQ ID NO: 1324093 - protein, 9 aa, Homo Sapiens
PLKDMPSSS

SEQ ID NO: 1324094 - protein, 9 aa, Homo Sapiens
EPVPEKNWN

SEQ ID NO: 1324095 - protein, 9 aa, Homo Sapiens
AKIRNLASP

SEQ ID NO: 1324096 - protein, 9 aa, Homo Sapiens
GQLRVYGAG

SEQ ID NO: 1324097 - protein, 9 aa, Homo Sapiens
MGSAIFVKK

SEQ ID NO: 1324098 - protein, 9 aa, Homo Sapiens
AEIAGHEPH

SEQ ID NO: 1324099 - protein, 9 aa, Homo Sapiens
EKEYQPHII

SEQ ID NO: 1324100 - protein, 9 aa, Homo Sapiens
KPCTLLFFL

SEQ ID NO: 1324101 - protein, 9 aa, Homo Sapiens
FLNTRHKVD

SEQ ID NO: 1324102 - protein, 9 aa, Homo Sapiens
SFRVKWLVV

SEQ ID NO: 1324103 - protein, 9 aa, Homo Sapiens
PLCRAAAML

SEQ ID NO: 1324104 - protein, 9 aa, Homo Sapiens
QEVAEQFLR

SEQ ID NO: 1324105 - protein, 9 aa, Homo Sapiens
KHVGFVTIP

SEQ ID NO: 1324106 - protein, 9 aa, Homo Sapiens
RQVQYPLTG

SEQ ID NO: 1324107 - protein, 9 aa, Homo Sapiens
VMAALYGRL

SEQ ID NO: 1324108 - protein, 9 aa, Homo Sapiens
CRELLRRTW

SEQ ID NO: 1324109 - protein, 9 aa, Homo Sapiens
SKDMLRKRH

SEQ ID NO: 1324110 - protein, 9 aa, Homo Sapiens
YGSPWWSCG

SEQ ID NO: 1324111 - protein, 9 aa, Homo Sapiens
TSKYWSKDK

SEQ ID NO: 1324112 - protein, 9 aa, Homo Sapiens
RVLALSVEI

SEQ ID NO: 1324113 - protein, 9 aa, Homo Sapiens
RSLYNWGFS

SEQ ID NO: 1324114 - protein, 9 aa, Homo Sapiens
HDGHTDQEI

SEQ ID NO: 1324115 - protein, 9 aa, Homo Sapiens
ITPPGMPSS

SEQ ID NO: 1324116 - protein, 9 aa, Homo Sapiens
KSTGSIRQL

SEQ ID NO: 1324117 - protein, 9 aa, Homo Sapiens
MLYECPNYQ

SEQ ID NO: 1324118 - protein, 9 aa, Homo Sapiens
LLSLKVLHK

SEQ ID NO: 1324119 - protein, 9 aa, Homo Sapiens
VNMSLSGHY

SEQ ID NO: 1324120 - protein, 9 aa, Homo Sapiens
EMEEFVEAE

SEQ ID NO: 1324121 - protein, 9 aa, Homo Sapiens
RFGGSTHNI

SEQ ID NO: 1324122 - protein, 9 aa, Homo Sapiens
PSLLCSPLR

SEQ ID NO: 1324123 - protein, 9 aa, Homo Sapiens
TQPELDKEA

SEQ ID NO: 1324124 - protein, 9 aa, Homo Sapiens
VVWHRGSKV

SEQ ID NO: 1324125 - protein, 9 aa, Homo Sapiens
KAFEKLQTT

SEQ ID NO: 1324126 - protein, 9 aa, Homo Sapiens
EEWRSQWKH

SEQ ID NO: 1324127 - protein, 9 aa, Homo Sapiens
LRARNIIQS

SEQ ID NO: 1324128 - protein, 9 aa, Homo Sapiens
SSSTMYSNT

SEQ ID NO: 1324129 - protein, 9 aa, Homo Sapiens
YIIEQEVCD

SEQ ID NO: 1324130 - protein, 9 aa, Homo Sapiens
FFLLDVMSY

SEQ ID NO: 1324131 - protein, 9 aa, Homo Sapiens
IRAPWNLTF

SEQ ID NO: 1324132 - protein, 9 aa, Homo Sapiens
NSSHMCMPL

SEQ ID NO: 1324133 - protein, 9 aa, Homo Sapiens
EMSGETLKV

SEQ ID NO: 1324134 - protein, 9 aa, Homo Sapiens
LEASSVPYA

SEQ ID NO: 1324135 - protein, 9 aa, Homo Sapiens
QKKLADKFI

SEQ ID NO: 1324136 - protein, 9 aa, Homo Sapiens
MLLTISTIC

SEQ ID NO: 1324137 - protein, 9 aa, Homo Sapiens
TMQTVYVQH

SEQ ID NO: 1324138 - protein, 9 aa, Homo Sapiens
VMTHQEYVY

SEQ ID NO: 1324139 - protein, 9 aa, Homo Sapiens
SGYLGKSLI

SEQ ID NO: 1324140 - protein, 9 aa, Homo Sapiens
GDGRPWMMN

SEQ ID NO: 1324141 - protein, 9 aa, Homo Sapiens
EDEKNETKK

SEQ ID NO: 1324142 - protein, 9 aa, Homo Sapiens
HNLQEGNLE

SEQ ID NO: 1324143 - protein, 9 aa, Homo Sapiens
NAQDQLSCS

SEQ ID NO: 1324144 - protein, 9 aa, Homo Sapiens
YTGGWHHHD

SEQ ID NO: 1324145 - protein, 9 aa, Homo Sapiens
SDHDYRIQY

SEQ ID NO: 1324146 - protein, 9 aa, Homo Sapiens
YLVLVKVFN

SEQ ID NO: 1324147 - protein, 9 aa, Homo Sapiens
HRVHFQSHG

SEQ ID NO: 1324148 - protein, 9 aa, Homo Sapiens
ALTSQFING

SEQ ID NO: 1324149 - protein, 9 aa, Homo Sapiens
WSPQNLHSQ

SEQ ID NO: 1324150 - protein, 9 aa, Homo Sapiens
VESGHIAHI

SEQ ID NO: 1324151 - protein, 9 aa, Homo Sapiens
FPQDRPFDD

SEQ ID NO: 1324152 - protein, 9 aa, Homo Sapiens
DTGSDHLRE

SEQ ID NO: 1324153 - protein, 9 aa, Homo Sapiens
VYKVGEQVT

SEQ ID NO: 1324154 - protein, 9 aa, Homo Sapiens
FHWQATIMS

SEQ ID NO: 1324155 - protein, 9 aa, Homo Sapiens
WFTGIEHYH

SEQ ID NO: 1324156 - protein, 9 aa, Homo Sapiens
HLSVVPGKR

SEQ ID NO: 1324157 - protein, 9 aa, Homo Sapiens
SLLTFIFFF

SEQ ID NO: 1324158 - protein, 9 aa, Homo Sapiens
TESEMEYVI

SEQ ID NO: 1324159 - protein, 9 aa, Homo Sapiens
NNSNKCVVA

SEQ ID NO: 1324160 - protein, 9 aa, Homo Sapiens
LHEEDTLLK

SEQ ID NO: 1324161 - protein, 9 aa, Homo Sapiens
KTFDIDLSV

SEQ ID NO: 1324162 - protein, 9 aa, Homo Sapiens
CRRKKKVRS

SEQ ID NO: 1324163 - protein, 9 aa, Homo Sapiens
GEMFSRLHR

SEQ ID NO: 1324164 - protein, 9 aa, Homo Sapiens
FLKRGKDGL

SEQ ID NO: 1324165 - protein, 9 aa, Homo Sapiens
ALLSSINQE

SEQ ID NO: 1324166 - protein, 9 aa, Homo Sapiens
EQITNVQIL

SEQ ID NO: 1324167 - protein, 9 aa, Homo Sapiens
LKEEGQCKA

SEQ ID NO: 1324168 - protein, 9 aa, Homo Sapiens
NSTTMNNDM

SEQ ID NO: 1324169 - protein, 9 aa, Homo Sapiens
EVNQNTSEN

SEQ ID NO: 1324170 - protein, 9 aa, Homo Sapiens
LPFSPLWVC

SEQ ID NO: 1324171 - protein, 9 aa, Homo Sapiens
NFCDSAQAA

SEQ ID NO: 1324172 - protein, 9 aa, Homo Sapiens
TSPQVYNNQ

SEQ ID NO: 1324173 - protein, 9 aa, Homo Sapiens
DMVCIPVGS

SEQ ID NO: 1324174 - protein, 9 aa, Homo Sapiens
ALQETMQRW

SEQ ID NO: 1324175 - protein, 9 aa, Homo Sapiens
REGLPVRLQ

SEQ ID NO: 1324176 - protein, 9 aa, Homo Sapiens
VDMGSLVSA

SEQ ID NO: 1324177 - protein, 9 aa, Homo Sapiens
MTVLTLYTD

SEQ ID NO: 1324178 - protein, 9 aa, Homo Sapiens
NLLTQILFP

SEQ ID NO: 1324179 - protein, 9 aa, Homo Sapiens
SFAQLTMKG

SEQ ID NO: 1324180 - protein, 9 aa, Homo Sapiens
VCCFFFMVV

SEQ ID NO: 1324181 - protein, 9 aa, Homo Sapiens
PGRSLPAGP

SEQ ID NO: 1324182 - protein, 9 aa, Homo Sapiens
VEAAMRYVQ

SEQ ID NO: 1324183 - protein, 9 aa, Homo Sapiens
TCLADLEGV

SEQ ID NO: 1324184 - protein, 9 aa, Homo Sapiens
DDTLLVCCE

SEQ ID NO: 1324185 - protein, 9 aa, Homo Sapiens
QQRQRQRQQ

SEQ ID NO: 1324186 - protein, 9 aa, Homo Sapiens
GALGMSRCE

SEQ ID NO: 1324187 - protein, 9 aa, Homo Sapiens
YPILSLSVP

SEQ ID NO: 1324188 - protein, 9 aa, Homo Sapiens
HLVEKITKM

SEQ ID NO: 1324189 - protein, 9 aa, Homo Sapiens
KSFKCEQCG

SEQ ID NO: 1324190 - protein, 9 aa, Homo Sapiens
CILQREEEE

SEQ ID NO: 1324191 - protein, 9 aa, Homo Sapiens
TGAPQEPTF

SEQ ID NO: 1324192 - protein, 9 aa, Homo Sapiens
NTPVFTLPE

SEQ ID NO: 1324193 - protein, 9 aa, Homo Sapiens
QGWQVFKND

SEQ ID NO: 1324194 - protein, 9 aa, Homo Sapiens
KSQEPDFHI

SEQ ID NO: 1324195 - protein, 9 aa, Homo Sapiens
SLRCCHIRF

SEQ ID NO: 1324196 - protein, 9 aa, Homo Sapiens
WIFNHPEFE

SEQ ID NO: 1324197 - protein, 9 aa, Homo Sapiens
YSGPDGHYT

SEQ ID NO: 1324198 - protein, 9 aa, Homo Sapiens
ELPEDKSRL

SEQ ID NO: 1324199 - protein, 9 aa, Homo Sapiens
TRLSFDKDA

SEQ ID NO: 1324200 - protein, 9 aa, Homo Sapiens
GKGGMCPFH

SEQ ID NO: 1324201 - protein, 9 aa, Homo Sapiens
PIRQEDVGE

SEQ ID NO: 1324202 - protein, 9 aa, Homo Sapiens
GAASAARPS

SEQ ID NO: 1324203 - protein, 9 aa, Homo Sapiens
VTHPRMRHY

SEQ ID NO: 1324204 - protein, 9 aa, Homo Sapiens
GKAVLWDSN

SEQ ID NO: 1324205 - protein, 9 aa, Homo Sapiens
HLLTVSVMS

SEQ ID NO: 1324206 - protein, 9 aa, Homo Sapiens
RHQDWRSGK

SEQ ID NO: 1324207 - protein, 9 aa, Homo Sapiens
WECGVGVIV

SEQ ID NO: 1324208 - protein, 9 aa, Homo Sapiens
RAWTHRLRE

SEQ ID NO: 1324209 - protein, 9 aa, Homo Sapiens
LLTIQYLVW

SEQ ID NO: 1324210 - protein, 9 aa, Homo Sapiens
FWCLLMVTF

SEQ ID NO: 1324211 - protein, 9 aa, Homo Sapiens
DNFHPLQPL

SEQ ID NO: 1324212 - protein, 9 aa, Homo Sapiens
GFVKTTTVG

SEQ ID NO: 1324213 - protein, 9 aa, Homo Sapiens
TFYLSYFDM

SEQ ID NO: 1324214 - protein, 9 aa, Homo Sapiens
EPHLRFTRP

SEQ ID NO: 1324215 - protein, 9 aa, Homo Sapiens
GYLDDLLPL

SEQ ID NO: 1324216 - protein, 9 aa, Homo Sapiens
AATFPDPNI

SEQ ID NO: 1324217 - protein, 9 aa, Homo Sapiens
RRWSRSRSR

SEQ ID NO: 1324218 - protein, 9 aa, Homo Sapiens
LQRVFDSIV

SEQ ID NO: 1324219 - protein, 9 aa, Homo Sapiens
GETTFKCDR

SEQ ID NO: 1324220 - protein, 9 aa, Homo Sapiens
SPKRQCLSH

SEQ ID NO: 1324221 - protein, 9 aa, Homo Sapiens
HLLTRAHVE

SEQ ID NO: 1324222 - protein, 9 aa, Homo Sapiens
FQVSSEGKQ

SEQ ID NO: 1324223 - protein, 9 aa, Homo Sapiens
MSDNGICVL

SEQ ID NO: 1324224 - protein, 9 aa, Homo Sapiens
FPTDGEMSV

SEQ ID NO: 1324225 - protein, 9 aa, Homo Sapiens
IHSNINGKQ

SEQ ID NO: 1324226 - protein, 9 aa, Homo Sapiens
KHDVLTRKT

SEQ ID NO: 1324227 - protein, 9 aa, Homo Sapiens
LNKCPDEGV

SEQ ID NO: 1324228 - protein, 9 aa, Homo Sapiens
TMCTRKRRK

SEQ ID NO: 1324229 - protein, 9 aa, Homo Sapiens
LSSERMKLS

SEQ ID NO: 1324230 - protein, 9 aa, Homo Sapiens
MPGGNMNIT

SEQ ID NO: 1324231 - protein, 9 aa, Homo Sapiens
RSLLDVVMW

SEQ ID NO: 1324232 - protein, 9 aa, Homo Sapiens
GASATTGRS

SEQ ID NO: 1324233 - protein, 9 aa, Homo Sapiens
CHVIATPSM

SEQ ID NO: 1324234 - protein, 9 aa, Homo Sapiens
QNCLRSSTS

SEQ ID NO: 1324235 - protein, 9 aa, Homo Sapiens
SLIFTQFLD

SEQ ID NO: 1324236 - protein, 9 aa, Homo Sapiens
LDNLSILDR

SEQ ID NO: 1324237 - protein, 9 aa, Homo Sapiens
LPPKDDTAI

SEQ ID NO: 1324238 - protein, 9 aa, Homo Sapiens
KMKTSKYWS

SEQ ID NO: 1324239 - protein, 9 aa, Homo Sapiens
HKQFLRLLQ

SEQ ID NO: 1324240 - protein, 9 aa, Homo Sapiens
GECSSIGSG

SEQ ID NO: 1324241 - protein, 9 aa, Homo Sapiens
HGKQDFLKE

SEQ ID NO: 1324242 - protein, 9 aa, Homo Sapiens
ILCHFRKLH

SEQ ID NO: 1324243 - protein, 9 aa, Homo Sapiens
WKNSIRHSL

SEQ ID NO: 1324244 - protein, 9 aa, Homo Sapiens
QETAQLLSK

SEQ ID NO: 1324245 - protein, 9 aa, Homo Sapiens
GYINTSHIK

SEQ ID NO: 1324246 - protein, 9 aa, Homo Sapiens
AGQEDLVEM

SEQ ID NO: 1324247 - protein, 9 aa, Homo Sapiens
WGPLKKSNA

SEQ ID NO: 1324248 - protein, 9 aa, Homo Sapiens
FFLWNSREK

SEQ ID NO: 1324249 - protein, 9 aa, Homo Sapiens
PMDTHACPL

SEQ ID NO: 1324250 - protein, 9 aa, Homo Sapiens
VGKRHAGLY

SEQ ID NO: 1324251 - protein, 9 aa, Homo Sapiens
KHWLAQLVK

SEQ ID NO: 1324252 - protein, 9 aa, Homo Sapiens
GCENVQLRK

SEQ ID NO: 1324253 - protein, 9 aa, Homo Sapiens
CDVERLQQD

SEQ ID NO: 1324254 - protein, 9 aa, Homo Sapiens
PIMEAVAFQ

SEQ ID NO: 1324255 - protein, 9 aa, Homo Sapiens
QAVFYVAEI

SEQ ID NO: 1324256 - protein, 9 aa, Homo Sapiens
RIQYHKFTA

SEQ ID NO: 1324257 - protein, 9 aa, Homo Sapiens
HLMKHDVNL

SEQ ID NO: 1324258 - protein, 9 aa, Homo Sapiens
TAILNAVLT

SEQ ID NO: 1324259 - protein, 9 aa, Homo Sapiens
KLYALTSQF

SEQ ID NO: 1324260 - protein, 9 aa, Homo Sapiens
APESNGMHR

SEQ ID NO: 1324261 - protein, 9 aa, Homo Sapiens
DTLPLRSAV

SEQ ID NO: 1324262 - protein, 9 aa, Homo Sapiens
PHMFKQEFT

SEQ ID NO: 1324263 - protein, 9 aa, Homo Sapiens
RDYVFYLVV

SEQ ID NO: 1324264 - protein, 9 aa, Homo Sapiens
WVTSSMSSP

SEQ ID NO: 1324265 - protein, 9 aa, Homo Sapiens
IIIIQQDTS

SEQ ID NO: 1324266 - protein, 9 aa, Homo Sapiens
YSTVTRFIE

SEQ ID NO: 1324267 - protein, 9 aa, Homo Sapiens
TKVKSKDAS

SEQ ID NO: 1324268 - protein, 9 aa, Homo Sapiens
HNNTHSNLH

SEQ ID NO: 1324269 - protein, 9 aa, Homo Sapiens
FLHPVNVCC

SEQ ID NO: 1324270 - protein, 9 aa, Homo Sapiens
RELREVLWT

SEQ ID NO: 1324271 - protein, 9 aa, Homo Sapiens
TERSNAQWQ

SEQ ID NO: 1324272 - protein, 9 aa, Homo Sapiens
LEKAQLKTG

SEQ ID NO: 1324273 - protein, 9 aa, Homo Sapiens
SNYETLISL

SEQ ID NO: 1324274 - protein, 9 aa, Homo Sapiens
VKMTAVRGL

SEQ ID NO: 1324275 - protein, 9 aa, Homo Sapiens
LNWPQGELL

SEQ ID NO: 1324276 - protein, 9 aa, Homo Sapiens
TGTHSGHLW

SEQ ID NO: 1324277 - protein, 9 aa, Homo Sapiens
PEIHSKEHI

SEQ ID NO: 1324278 - protein, 9 aa, Homo Sapiens
PDTHKDHAL

SEQ ID NO: 1324279 - protein, 9 aa, Homo Sapiens
VEKIIGRAI

SEQ ID NO: 1324280 - protein, 9 aa, Homo Sapiens
GKETLKDIN

SEQ ID NO: 1324281 - protein, 9 aa, Homo Sapiens
QSVPGAHPM

SEQ ID NO: 1324282 - protein, 9 aa, Homo Sapiens
TEEVWDQLL

SEQ ID NO: 1324283 - protein, 9 aa, Homo Sapiens
GRDKTRKRC

SEQ ID NO: 1324284 - protein, 9 aa, Homo Sapiens
ELNTRPMEV

SEQ ID NO: 1324285 - protein, 9 aa, Homo Sapiens
KKPTSMDGP

SEQ ID NO: 1324286 - protein, 9 aa, Homo Sapiens
SEDHNGKSC

SEQ ID NO: 1324287 - protein, 9 aa, Homo Sapiens
TYRQHVQPP

SEQ ID NO: 1324288 - protein, 9 aa, Homo Sapiens
DDPDKDKKC

SEQ ID NO: 1324289 - protein, 9 aa, Homo Sapiens
QTCHVTWAL

SEQ ID NO: 1324290 - protein, 9 aa, Homo Sapiens
FETRKSQIL

SEQ ID NO: 1324291 - protein, 9 aa, Homo Sapiens
THCYTESLD

SEQ ID NO: 1324292 - protein, 9 aa, Homo Sapiens
AFEVKHFNI

SEQ ID NO: 1324293 - protein, 9 aa, Homo Sapiens
AKVMCFERF

SEQ ID NO: 1324294 - protein, 9 aa, Homo Sapiens
PGDGLTVKA

SEQ ID NO: 1324295 - protein, 9 aa, Homo Sapiens
CGCENVQLR

SEQ ID NO: 1324296 - protein, 9 aa, Homo Sapiens
DLTIDGLVD

SEQ ID NO: 1324297 - protein, 9 aa, Homo Sapiens
ILYWEHHSS

SEQ ID NO: 1324298 - protein, 9 aa, Homo Sapiens
QHHSYMRLT

SEQ ID NO: 1324299 - protein, 9 aa, Homo Sapiens
AISTLAHSA

SEQ ID NO: 1324300 - protein, 9 aa, Homo Sapiens
ARPSPATHP

SEQ ID NO: 1324301 - protein, 9 aa, Homo Sapiens
LVVKHDSIL

SEQ ID NO: 1324302 - protein, 9 aa, Homo Sapiens
SETILYACR

SEQ ID NO: 1324303 - protein, 9 aa, Homo Sapiens
GQVVCSIAL

SEQ ID NO: 1324304 - protein, 9 aa, Homo Sapiens
RKEDISGIT

SEQ ID NO: 1324305 - protein, 9 aa, Homo Sapiens
CDKDFNMKQ

SEQ ID NO: 1324306 - protein, 9 aa, Homo Sapiens
SSKINAAKS

SEQ ID NO: 1324307 - protein, 9 aa, Homo Sapiens
ELCCLFLQM

SEQ ID NO: 1324308 - protein, 9 aa, Homo Sapiens
TISPEKTHH

SEQ ID NO: 1324309 - protein, 9 aa, Homo Sapiens
FTVSQYVQA

SEQ ID NO: 1324310 - protein, 9 aa, Homo Sapiens
QNTLKAKLQ

SEQ ID NO: 1324311 - protein, 9 aa, Homo Sapiens
TLNLEDIFP

SEQ ID NO: 1324312 - protein, 9 aa, Homo Sapiens
VTSIDDVLG

SEQ ID NO: 1324313 - protein, 9 aa, Homo Sapiens
CARHHCSNT

SEQ ID NO: 1324314 - protein, 9 aa, Homo Sapiens
LVKQGSKGS

SEQ ID NO: 1324315 - protein, 9 aa, Homo Sapiens
DRKKKSRTL

SEQ ID NO: 1324316 - protein, 9 aa, Homo Sapiens
LLTCTSKNS

SEQ ID NO: 1324317 - protein, 9 aa, Homo Sapiens
FHEGGYWCE

SEQ ID NO: 1324318 - protein, 9 aa, Homo Sapiens
QPERVLYIQ

SEQ ID NO: 1324319 - protein, 9 aa, Homo Sapiens
KMACDGTFV

SEQ ID NO: 1324320 - protein, 9 aa, Homo Sapiens
VFVESTYSQ

SEQ ID NO: 1324321 - protein, 9 aa, Homo Sapiens
TPRRSPRST

SEQ ID NO: 1324322 - protein, 9 aa, Homo Sapiens
NAFGDHWGP

SEQ ID NO: 1324323 - protein, 9 aa, Homo Sapiens
PISDRTRNM

SEQ ID NO: 1324324 - protein, 9 aa, Homo Sapiens
SGLTAADTV

SEQ ID NO: 1324325 - protein, 9 aa, Homo Sapiens
VNQNTSENI

SEQ ID NO: 1324326 - protein, 9 aa, Homo Sapiens
TTGMTAVKK

SEQ ID NO: 1324327 - protein, 9 aa, Homo Sapiens
YPLDKLLDH

SEQ ID NO: 1324328 - protein, 9 aa, Homo Sapiens
VNCAIITNG

SEQ ID NO: 1324329 - protein, 9 aa, Homo Sapiens
RNPDEQVRQ

SEQ ID NO: 1324330 - protein, 9 aa, Homo Sapiens
CFHYGTEDS

SEQ ID NO: 1324331 - protein, 9 aa, Homo Sapiens
GAHIPFRVG

SEQ ID NO: 1324332 - protein, 9 aa, Homo Sapiens
MSNPIDEMT

SEQ ID NO: 1324333 - protein, 9 aa, Homo Sapiens
VIQVQLRSR

SEQ ID NO: 1324334 - protein, 9 aa, Homo Sapiens
HTIFLKDVL

SEQ ID NO: 1324335 - protein, 9 aa, Homo Sapiens
SSSVGGTSA

SEQ ID NO: 1324336 - protein, 9 aa, Homo Sapiens
HPGQSSAPA

SEQ ID NO: 1324337 - protein, 9 aa, Homo Sapiens
MHDTRGCSP

SEQ ID NO: 1324338 - protein, 9 aa, Homo Sapiens
PWPSSSTNT

SEQ ID NO: 1324339 - protein, 9 aa, Homo Sapiens
VLPSRRLTL

SEQ ID NO: 1324340 - protein, 9 aa, Homo Sapiens
GNPEEERWA

SEQ ID NO: 1324341 - protein, 9 aa, Homo Sapiens
PMAEDPVRH

SEQ ID NO: 1324342 - protein, 9 aa, Homo Sapiens
APSLGSYSS

SEQ ID NO: 1324343 - protein, 9 aa, Homo Sapiens
WRTAMRVSP

SEQ ID NO: 1324344 - protein, 9 aa, Homo Sapiens
IIDSKTEQS

SEQ ID NO: 1324345 - protein, 9 aa, Homo Sapiens
EHPSQSVRK

SEQ ID NO: 1324346 - protein, 9 aa, Homo Sapiens
TVGNGKVYP

SEQ ID NO: 1324347 - protein, 9 aa, Homo Sapiens
LKSHFILHQ

SEQ ID NO: 1324348 - protein, 9 aa, Homo Sapiens
ESEEMNQTN

SEQ ID NO: 1324349 - protein, 9 aa, Homo Sapiens
EPLSMVFAG

SEQ ID NO: 1324350 - protein, 9 aa, Homo Sapiens
WKVFLILSY

SEQ ID NO: 1324351 - protein, 9 aa, Homo Sapiens
MVSKLLEKS

SEQ ID NO: 1324352 - protein, 9 aa, Homo Sapiens
LFLTLAALS

SEQ ID NO: 1324353 - protein, 9 aa, Homo Sapiens
LTHILTLQE

SEQ ID NO: 1324354 - protein, 9 aa, Homo Sapiens
TSSGHHEQD

SEQ ID NO: 1324355 - protein, 9 aa, Homo Sapiens
KKQQVSAST

SEQ ID NO: 1324356 - protein, 9 aa, Homo Sapiens
ARPSEGPHK

SEQ ID NO: 1324357 - protein, 9 aa, Homo Sapiens
QHEQICMRS

SEQ ID NO: 1324358 - protein, 9 aa, Homo Sapiens
GSFDLVTND

SEQ ID NO: 1324359 - protein, 9 aa, Homo Sapiens
PNVLTTQQQ

SEQ ID NO: 1324360 - protein, 9 aa, Homo Sapiens
PINTLFFFV

SEQ ID NO: 1324361 - protein, 9 aa, Homo Sapiens
GQWYKMDDV

SEQ ID NO: 1324362 - protein, 9 aa, Homo Sapiens
RVLFSLAES

SEQ ID NO: 1324363 - protein, 9 aa, Homo Sapiens
AVMNWVMSH

SEQ ID NO: 1324364 - protein, 9 aa, Homo Sapiens
TTSEMVLAD

SEQ ID NO: 1324365 - protein, 9 aa, Homo Sapiens
LLRQGHDPE

SEQ ID NO: 1324366 - protein, 9 aa, Homo Sapiens
YTTLNQHKK

SEQ ID NO: 1324367 - protein, 9 aa, Homo Sapiens
DEGPAEPPH

SEQ ID NO: 1324368 - protein, 9 aa, Homo Sapiens
PSPPTPRPE

SEQ ID NO: 1324369 - protein, 9 aa, Homo Sapiens
RTSLTSLRS

SEQ ID NO: 1324370 - protein, 9 aa, Homo Sapiens
PTDEQTRIT

SEQ ID NO: 1324371 - protein, 9 aa, Homo Sapiens
CMTQVFTLH

SEQ ID NO: 1324372 - protein, 9 aa, Homo Sapiens
LSEQESPRS

SEQ ID NO: 1324373 - protein, 9 aa, Homo Sapiens
MSPPPGMMF

SEQ ID NO: 1324374 - protein, 9 aa, Homo Sapiens
WMVWSEAMT

SEQ ID NO: 1324375 - protein, 9 aa, Homo Sapiens
TLVHWENEE

SEQ ID NO: 1324376 - protein, 9 aa, Homo Sapiens
MGSLVSAWE

SEQ ID NO: 1324377 - protein, 9 aa, Homo Sapiens
QEQVSPTAI

SEQ ID NO: 1324378 - protein, 9 aa, Homo Sapiens
LEKVCQLEQ

SEQ ID NO: 1324379 - protein, 9 aa, Homo Sapiens
EELCTLCRR

SEQ ID NO: 1324380 - protein, 9 aa, Homo Sapiens
VKCCCQLFR

SEQ ID NO: 1324381 - protein, 9 aa, Homo Sapiens
TMFYPADHS

SEQ ID NO: 1324382 - protein, 9 aa, Homo Sapiens
VEVKPGHVL

SEQ ID NO: 1324383 - protein, 9 aa, Homo Sapiens
QSSTLRQHH

SEQ ID NO: 1324384 - protein, 9 aa, Homo Sapiens
ATCSKYIEL

SEQ ID NO: 1324385 - protein, 9 aa, Homo Sapiens
QFPALTQEQ

SEQ ID NO: 1324386 - protein, 9 aa, Homo Sapiens
SRSFFTSAH

SEQ ID NO: 1324387 - protein, 9 aa, Homo Sapiens
VMWDYSSNT

SEQ ID NO: 1324388 - protein, 9 aa, Homo Sapiens
NQPCVLGWE

SEQ ID NO: 1324389 - protein, 9 aa, Homo Sapiens
DEGALVTAT

SEQ ID NO: 1324390 - protein, 9 aa, Homo Sapiens
PAEIQKEDP

SEQ ID NO: 1324391 - protein, 9 aa, Homo Sapiens
EVIAEKRQL

SEQ ID NO: 1324392 - protein, 9 aa, Homo Sapiens
GVKPLSCDS

SEQ ID NO: 1324393 - protein, 9 aa, Homo Sapiens
LYVCSECGR

SEQ ID NO: 1324394 - protein, 9 aa, Homo Sapiens
GHEYVRHLT

SEQ ID NO: 1324395 - protein, 9 aa, Homo Sapiens
GRPGHPDTP

SEQ ID NO: 1324396 - protein, 9 aa, Homo Sapiens
WQGRTRQAL

SEQ ID NO: 1324397 - protein, 9 aa, Homo Sapiens
LTYLQLKEI

SEQ ID NO: 1324398 - protein, 9 aa, Homo Sapiens
HTFTFRNSK

SEQ ID NO: 1324399 - protein, 9 aa, Homo Sapiens
IMRAFQHNT

SEQ ID NO: 1324400 - protein, 9 aa, Homo Sapiens
PYSIPLSQA

SEQ ID NO: 1324401 - protein, 9 aa, Homo Sapiens
WRPHNAIFV

SEQ ID NO: 1324402 - protein, 9 aa, Homo Sapiens
DTIKYKGEK

SEQ ID NO: 1324403 - protein, 9 aa, Homo Sapiens
IRDPKGRHS

SEQ ID NO: 1324404 - protein, 9 aa, Homo Sapiens
HQPHLRCAC

SEQ ID NO: 1324405 - protein, 9 aa, Homo Sapiens
WKKGLSLSY

SEQ ID NO: 1324406 - protein, 9 aa, Homo Sapiens
IPFTCETCG

SEQ ID NO: 1324407 - protein, 9 aa, Homo Sapiens
KYWSHYYQG

SEQ ID NO: 1324408 - protein, 9 aa, Homo Sapiens
QLHPNTFST

SEQ ID NO: 1324409 - protein, 9 aa, Homo Sapiens
RISPLVKDI

SEQ ID NO: 1324410 - protein, 9 aa, Homo Sapiens
ADKNCARVE

SEQ ID NO: 1324411 - protein, 9 aa, Homo Sapiens
YIAMGQHMF

SEQ ID NO: 1324412 - protein, 9 aa, Homo Sapiens
TLQIRGMML

SEQ ID NO: 1324413 - protein, 9 aa, Homo Sapiens
ACLDQDAAI

SEQ ID NO: 1324414 - protein, 9 aa, Homo Sapiens
QTPLFTDVS

SEQ ID NO: 1324415 - protein, 9 aa, Homo Sapiens
HTYDRSILV

SEQ ID NO: 1324416 - protein, 9 aa, Homo Sapiens
HNLFFKCEL

SEQ ID NO: 1324417 - protein, 9 aa, Homo Sapiens
FVSHVQPGQ

SEQ ID NO: 1324418 - protein, 9 aa, Homo Sapiens
RNSRRSSKK

SEQ ID NO: 1324419 - protein, 9 aa, Homo Sapiens
ESEMLKRQH

SEQ ID NO: 1324420 - protein, 9 aa, Homo Sapiens
KTHHLHGKT

SEQ ID NO: 1324421 - protein, 9 aa, Homo Sapiens
QWAIRAYSS

SEQ ID NO: 1324422 - protein, 9 aa, Homo Sapiens
EGDMSSERE

SEQ ID NO: 1324423 - protein, 9 aa, Homo Sapiens
YVIAFNNPY

SEQ ID NO: 1324424 - protein, 9 aa, Homo Sapiens
IKNNDSKLE

SEQ ID NO: 1324425 - protein, 9 aa, Homo Sapiens
RKFIFSTEE

SEQ ID NO: 1324426 - protein, 9 aa, Homo Sapiens
NIQDTQAHL

SEQ ID NO: 1324427 - protein, 9 aa, Homo Sapiens
LCGAIRLPS

SEQ ID NO: 1324428 - protein, 9 aa, Homo Sapiens
QLDDIVIPS

SEQ ID NO: 1324429 - protein, 9 aa, Homo Sapiens
HLNHPPMGI

SEQ ID NO: 1324430 - protein, 9 aa, Homo Sapiens
GCGSTFAKA

SEQ ID NO: 1324431 - protein, 9 aa, Homo Sapiens
VSAFAFMES

SEQ ID NO: 1324432 - protein, 9 aa, Homo Sapiens
LMEFCRLYH

SEQ ID NO: 1324433 - protein, 9 aa, Homo Sapiens
AVLLECLGS

SEQ ID NO: 1324434 - protein, 9 aa, Homo Sapiens
GNFFMMLPT

SEQ ID NO: 1324435 - protein, 9 aa, Homo Sapiens
DLEDNYGQE

SEQ ID NO: 1324436 - protein, 9 aa, Homo Sapiens
KCTCIVDGK

SEQ ID NO: 1324437 - protein, 9 aa, Homo Sapiens
HIQRADGDC

SEQ ID NO: 1324438 - protein, 9 aa, Homo Sapiens
PEDLVRMYR

SEQ ID NO: 1324439 - protein, 9 aa, Homo Sapiens
ECEGVMDIY

SEQ ID NO: 1324440 - protein, 9 aa, Homo Sapiens
VAAGELQED

SEQ ID NO: 1324441 - protein, 9 aa, Homo Sapiens
KKKNRGAVF

SEQ ID NO: 1324442 - protein, 9 aa, Homo Sapiens
PRIDSQLAD

SEQ ID NO: 1324443 - protein, 9 aa, Homo Sapiens
IRSPFFPNM

SEQ ID NO: 1324444 - protein, 9 aa, Homo Sapiens
NGNTLRIRQ

SEQ ID NO: 1324445 - protein, 9 aa, Homo Sapiens
LFIYIRSKA

SEQ ID NO: 1324446 - protein, 9 aa, Homo Sapiens
VAVHGRTAK

SEQ ID NO: 1324447 - protein, 9 aa, Homo Sapiens
GSEPVPEKN

SEQ ID NO: 1324448 - protein, 9 aa, Homo Sapiens
DPIKGQVSV

SEQ ID NO: 1324449 - protein, 9 aa, Homo Sapiens
RVRMHNHPP

SEQ ID NO: 1324450 - protein, 9 aa, Homo Sapiens
YGLCAPTPQ

SEQ ID NO: 1324451 - protein, 9 aa, Homo Sapiens
TMQLVSDFR

SEQ ID NO: 1324452 - protein, 9 aa, Homo Sapiens
MAMGIEDSE

SEQ ID NO: 1324453 - protein, 9 aa, Homo Sapiens
THTQDLTPA

SEQ ID NO: 1324454 - protein, 9 aa, Homo Sapiens
SCSAMAAVI

SEQ ID NO: 1324455 - protein, 9 aa, Homo Sapiens
SHEVIRIEK

SEQ ID NO: 1324456 - protein, 9 aa, Homo Sapiens
HYHQSTAVA

SEQ ID NO: 1324457 - protein, 9 aa, Homo Sapiens
VSICFPVCV

SEQ ID NO: 1324458 - protein, 9 aa, Homo Sapiens
PAFHILSVE

SEQ ID NO: 1324459 - protein, 9 aa, Homo Sapiens
GGLDDQLCA

SEQ ID NO: 1324460 - protein, 9 aa, Homo Sapiens
GQAVQYQFT

SEQ ID NO: 1324461 - protein, 9 aa, Homo Sapiens
LGFMLMLDV

SEQ ID NO: 1324462 - protein, 9 aa, Homo Sapiens
KFQECHMKR

SEQ ID NO: 1324463 - protein, 9 aa, Homo Sapiens
TTGKVPEVV

SEQ ID NO: 1324464 - protein, 9 aa, Homo Sapiens
LHNPCAEED

SEQ ID NO: 1324465 - protein, 9 aa, Homo Sapiens
DVEEIVDIG

SEQ ID NO: 1324466 - protein, 9 aa, Homo Sapiens
MAQLRFLKL

SEQ ID NO: 1324467 - protein, 9 aa, Homo Sapiens
SRETLKNRK

SEQ ID NO: 1324468 - protein, 9 aa, Homo Sapiens
HMTQEEHDD

SEQ ID NO: 1324469 - protein, 9 aa, Homo Sapiens
ATKIEAPAL

SEQ ID NO: 1324470 - protein, 9 aa, Homo Sapiens
DHFAFGEPR

SEQ ID NO: 1324471 - protein, 9 aa, Homo Sapiens
KHFKLWRHP

SEQ ID NO: 1324472 - protein, 9 aa, Homo Sapiens
KCFLCLGWG

SEQ ID NO: 1324473 - protein, 9 aa, Homo Sapiens
PPVYPVALS

SEQ ID NO: 1324474 - protein, 9 aa, Homo Sapiens
RWLLHHTLP

SEQ ID NO: 1324475 - protein, 9 aa, Homo Sapiens
SGHLQVRLV

SEQ ID NO: 1324476 - protein, 9 aa, Homo Sapiens
SRPKKNNSH

SEQ ID NO: 1324477 - protein, 9 aa, Homo Sapiens
HTTCLAACW

SEQ ID NO: 1324478 - protein, 9 aa, Homo Sapiens
LPDVPYDSD

SEQ ID NO: 1324479 - protein, 9 aa, Homo Sapiens
LMPYGQPQP

SEQ ID NO: 1324480 - protein, 9 aa, Homo Sapiens
IHKWCEEMK

SEQ ID NO: 1324481 - protein, 9 aa, Homo Sapiens
TQKKKADSY

SEQ ID NO: 1324482 - protein, 9 aa, Homo Sapiens
FLLLNILNA

SEQ ID NO: 1324483 - protein, 9 aa, Homo Sapiens
AGGLDLLMD

SEQ ID NO: 1324484 - protein, 9 aa, Homo Sapiens
TKTRATESQ

SEQ ID NO: 1324485 - protein, 9 aa, Homo Sapiens
NSREKGSKE

SEQ ID NO: 1324486 - protein, 9 aa, Homo Sapiens
ANMGTSFKV

SEQ ID NO: 1324487 - protein, 9 aa, Homo Sapiens
NHVNGLTLV

SEQ ID NO: 1324488 - protein, 9 aa, Homo Sapiens
PEMAAMRLM

SEQ ID NO: 1324489 - protein, 9 aa, Homo Sapiens
QQALEHYTN

SEQ ID NO: 1324490 - protein, 9 aa, Homo Sapiens
DIHAITTAN

SEQ ID NO: 1324491 - protein, 9 aa, Homo Sapiens
KEQLLQEPH

SEQ ID NO: 1324492 - protein, 9 aa, Homo Sapiens
TTRGNRPVA

SEQ ID NO: 1324493 - protein, 9 aa, Homo Sapiens
HMGIYVGAK

SEQ ID NO: 1324494 - protein, 9 aa, Homo Sapiens
HLYQECEKL

SEQ ID NO: 1324495 - protein, 9 aa, Homo Sapiens
HLLEKLGDG

SEQ ID NO: 1324496 - protein, 9 aa, Homo Sapiens
LNILIGVVS

SEQ ID NO: 1324497 - protein, 9 aa, Homo Sapiens
YAPLLNPYM

SEQ ID NO: 1324498 - protein, 9 aa, Homo Sapiens
MRKKFPLPR

SEQ ID NO: 1324499 - protein, 9 aa, Homo Sapiens
FFCDMSPIL

SEQ ID NO: 1324500 - protein, 9 aa, Homo Sapiens
GLPIHQTYI

SEQ ID NO: 1324501 - protein, 9 aa, Homo Sapiens
MQQKYWEMK

SEQ ID NO: 1324502 - protein, 9 aa, Homo Sapiens
QHVFAWEHN

SEQ ID NO: 1324503 - protein, 9 aa, Homo Sapiens
YSAFWLSWG

SEQ ID NO: 1324504 - protein, 9 aa, Homo Sapiens
LSIIQGEVD

SEQ ID NO: 1324505 - protein, 9 aa, Homo Sapiens
RKCIRNPSI

SEQ ID NO: 1324506 - protein, 9 aa, Homo Sapiens
KRMLAYSGP

SEQ ID NO: 1324507 - protein, 9 aa, Homo Sapiens
SLMLNTWPA

SEQ ID NO: 1324508 - protein, 9 aa, Homo Sapiens
ETGDEHSSM

SEQ ID NO: 1324509 - protein, 9 aa, Homo Sapiens
NGKSCGLCG

SEQ ID NO: 1324510 - protein, 9 aa, Homo Sapiens
WQCGCHVFE

SEQ ID NO: 1324511 - protein, 9 aa, Homo Sapiens
IIGRAITSL

SEQ ID NO: 1324512 - protein, 9 aa, Homo Sapiens
LSAYWHSLH

SEQ ID NO: 1324513 - protein, 9 aa, Homo Sapiens
ARCLSSLND

SEQ ID NO: 1324514 - protein, 9 aa, Homo Sapiens
PQTALYTAN

SEQ ID NO: 1324515 - protein, 9 aa, Homo Sapiens
GGSLPPQDS

SEQ ID NO: 1324516 - protein, 9 aa, Homo Sapiens
VRHLSHSDT

SEQ ID NO: 1324517 - protein, 9 aa, Homo Sapiens
RTLEQCHYR

SEQ ID NO: 1324518 - protein, 9 aa, Homo Sapiens
PSDVVKTGE

SEQ ID NO: 1324519 - protein, 9 aa, Homo Sapiens
IANVEPKTE

SEQ ID NO: 1324520 - protein, 9 aa, Homo Sapiens
SNSIFDLQK

SEQ ID NO: 1324521 - protein, 9 aa, Homo Sapiens
PNLGAQQKI

SEQ ID NO: 1324522 - protein, 9 aa, Homo Sapiens
EVEIGTVVV

SEQ ID NO: 1324523 - protein, 9 aa, Homo Sapiens
ASAGRPSAA

SEQ ID NO: 1324524 - protein, 9 aa, Homo Sapiens
TDQEIQEIH

SEQ ID NO: 1324525 - protein, 9 aa, Homo Sapiens
PSGRINVSD

SEQ ID NO: 1324526 - protein, 9 aa, Homo Sapiens
RPPEPHFTL

SEQ ID NO: 1324527 - protein, 9 aa, Homo Sapiens
IVTRGALPV

SEQ ID NO: 1324528 - protein, 9 aa, Homo Sapiens
RLGLDGTFV

SEQ ID NO: 1324529 - protein, 9 aa, Homo Sapiens
AVLMAWLGV

SEQ ID NO: 1324530 - protein, 9 aa, Homo Sapiens
PSQNVISFF

SEQ ID NO: 1324531 - protein, 9 aa, Homo Sapiens
PNEIIDMVK

SEQ ID NO: 1324532 - protein, 9 aa, Homo Sapiens
VERSLKTLE

SEQ ID NO: 1324533 - protein, 9 aa, Homo Sapiens
PVEEHCGDS

SEQ ID NO: 1324534 - protein, 9 aa, Homo Sapiens
TSPPSCRAF

SEQ ID NO: 1324535 - protein, 9 aa, Homo Sapiens
AWHPEAPTG

SEQ ID NO: 1324536 - protein, 9 aa, Homo Sapiens
INQKLMAEV

SEQ ID NO: 1324537 - protein, 9 aa, Homo Sapiens
DKVHISDSH

SEQ ID NO: 1324538 - protein, 9 aa, Homo Sapiens
FDIDLSVPQ

SEQ ID NO: 1324539 - protein, 9 aa, Homo Sapiens
MNSSIYSHP

SEQ ID NO: 1324540 - protein, 9 aa, Homo Sapiens
MNTYLQMSP

SEQ ID NO: 1324541 - protein, 9 aa, Homo Sapiens
ARTQQLIQT

SEQ ID NO: 1324542 - protein, 9 aa, Homo Sapiens
YLQMSPTSS

SEQ ID NO: 1324543 - protein, 9 aa, Homo Sapiens
FSVCVQMEE

SEQ ID NO: 1324544 - protein, 9 aa, Homo Sapiens
VHIGLYDSV

SEQ ID NO: 1324545 - protein, 9 aa, Homo Sapiens
RGPMDSNDS

SEQ ID NO: 1324546 - protein, 9 aa, Homo Sapiens
GELSLPEKD

SEQ ID NO: 1324547 - protein, 9 aa, Homo Sapiens
IRCLKRSRC

SEQ ID NO: 1324548 - protein, 9 aa, Homo Sapiens
TLLIPPSSP

SEQ ID NO: 1324549 - protein, 9 aa, Homo Sapiens
GKLRTHICC

SEQ ID NO: 1324550 - protein, 9 aa, Homo Sapiens
VISFFNVGH

SEQ ID NO: 1324551 - protein, 9 aa, Homo Sapiens
VSYKEDKPQ

SEQ ID NO: 1324552 - protein, 9 aa, Homo Sapiens
SAAGGAQAA

SEQ ID NO: 1324553 - protein, 9 aa, Homo Sapiens
PGIKKAQNS

SEQ ID NO: 1324554 - protein, 9 aa, Homo Sapiens
MMRKGTTMK

SEQ ID NO: 1324555 - protein, 9 aa, Homo Sapiens
FRNWINEAI

SEQ ID NO: 1324556 - protein, 9 aa, Homo Sapiens
FEHISTYDN

SEQ ID NO: 1324557 - protein, 9 aa, Homo Sapiens
GLQGPHTAL

SEQ ID NO: 1324558 - protein, 9 aa, Homo Sapiens
GAGLHRDVL

SEQ ID NO: 1324559 - protein, 9 aa, Homo Sapiens
RLVGQINDG

SEQ ID NO: 1324560 - protein, 9 aa, Homo Sapiens
RVYTVLAVA

SEQ ID NO: 1324561 - protein, 9 aa, Homo Sapiens
INVCTKDMP

SEQ ID NO: 1324562 - protein, 9 aa, Homo Sapiens
TEYMENEDL

SEQ ID NO: 1324563 - protein, 9 aa, Homo Sapiens
SFLQPLRQQ

SEQ ID NO: 1324564 - protein, 9 aa, Homo Sapiens
PDTSPALEA

SEQ ID NO: 1324565 - protein, 9 aa, Homo Sapiens
WLDPGAGSI

SEQ ID NO: 1324566 - protein, 9 aa, Homo Sapiens
TFSSMSKNV

SEQ ID NO: 1324567 - protein, 9 aa, Homo Sapiens
VRLDTVRQE

SEQ ID NO: 1324568 - protein, 9 aa, Homo Sapiens
MQTCNTLFF

SEQ ID NO: 1324569 - protein, 9 aa, Homo Sapiens
ERLGLVKLS

SEQ ID NO: 1324570 - protein, 9 aa, Homo Sapiens
RHRPLPAAI

SEQ ID NO: 1324571 - protein, 9 aa, Homo Sapiens
MVILNLIFS

SEQ ID NO: 1324572 - protein, 9 aa, Homo Sapiens
LLTSVSLHF

SEQ ID NO: 1324573 - protein, 9 aa, Homo Sapiens
GPCIPDVLF

SEQ ID NO: 1324574 - protein, 9 aa, Homo Sapiens
VAHSILSGA

SEQ ID NO: 1324575 - protein, 9 aa, Homo Sapiens
TFQIGSFVS

SEQ ID NO: 1324576 - protein, 9 aa, Homo Sapiens
FPNYRHSRL

SEQ ID NO: 1324577 - protein, 9 aa, Homo Sapiens
MREWCAKVQ

SEQ ID NO: 1324578 - protein, 9 aa, Homo Sapiens
EQEQKMWDQ

SEQ ID NO: 1324579 - protein, 9 aa, Homo Sapiens
EKARQAKAH

SEQ ID NO: 1324580 - protein, 9 aa, Homo Sapiens
HIFELAKSL

SEQ ID NO: 1324581 - protein, 9 aa, Homo Sapiens
ESPSVKSLH

SEQ ID NO: 1324582 - protein, 9 aa, Homo Sapiens
PEFLVLLVD

SEQ ID NO: 1324583 - protein, 9 aa, Homo Sapiens
YCRLRKPKI

SEQ ID NO: 1324584 - protein, 9 aa, Homo Sapiens
RACRLHCSV

SEQ ID NO: 1324585 - protein, 9 aa, Homo Sapiens
KLAPLQVTT

SEQ ID NO: 1324586 - protein, 9 aa, Homo Sapiens
SHILVTSFN

SEQ ID NO: 1324587 - protein, 9 aa, Homo Sapiens
IGHTLTVAI

SEQ ID NO: 1324588 - protein, 9 aa, Homo Sapiens
KKSRTLGNC

SEQ ID NO: 1324589 - protein, 9 aa, Homo Sapiens
GHPGLTEKS

SEQ ID NO: 1324590 - protein, 9 aa, Homo Sapiens
CTYTCPCPS

SEQ ID NO: 1324591 - protein, 9 aa, Homo Sapiens
VRSEKQKSI

SEQ ID NO: 1324592 - protein, 9 aa, Homo Sapiens
QGNLLCRYT

SEQ ID NO: 1324593 - protein, 9 aa, Homo Sapiens
LQALNIPFM

SEQ ID NO: 1324594 - protein, 9 aa, Homo Sapiens
KMYACKKLN

SEQ ID NO: 1324595 - protein, 9 aa, Homo Sapiens
TTKHWLAQL

SEQ ID NO: 1324596 - protein, 9 aa, Homo Sapiens
LRQLGKGTE

SEQ ID NO: 1324597 - protein, 9 aa, Homo Sapiens
VVVARYEET

SEQ ID NO: 1324598 - protein, 9 aa, Homo Sapiens
MFLHPVNVC

SEQ ID NO: 1324599 - protein, 9 aa, Homo Sapiens
LHPKHWFQL

SEQ ID NO: 1324600 - protein, 9 aa, Homo Sapiens
LEKKIYDCQ

SEQ ID NO: 1324601 - protein, 9 aa, Homo Sapiens
DSLVGPRTS

SEQ ID NO: 1324602 - protein, 9 aa, Homo Sapiens
YSISHMKRV

SEQ ID NO: 1324603 - protein, 9 aa, Homo Sapiens
QGPIHIGTG

SEQ ID NO: 1324604 - protein, 9 aa, Homo Sapiens
VAPYPSTCS

SEQ ID NO: 1324605 - protein, 9 aa, Homo Sapiens
TWLKSVMNQ

SEQ ID NO: 1324606 - protein, 9 aa, Homo Sapiens
AKKQICLIL

SEQ ID NO: 1324607 - protein, 9 aa, Homo Sapiens
HKGGHEPRS

SEQ ID NO: 1324608 - protein, 9 aa, Homo Sapiens
GQPDQPRSV

SEQ ID NO: 1324609 - protein, 9 aa, Homo Sapiens
HQDASLCLM

SEQ ID NO: 1324610 - protein, 9 aa, Homo Sapiens
VLHHYIEDE

SEQ ID NO: 1324611 - protein, 9 aa, Homo Sapiens
NCQEFTLSV

SEQ ID NO: 1324612 - protein, 9 aa, Homo Sapiens
RPPVHIEEL

SEQ ID NO: 1324613 - protein, 9 aa, Homo Sapiens
LMSLPCENQ

SEQ ID NO: 1324614 - protein, 9 aa, Homo Sapiens
IDLMEPTLQ

SEQ ID NO: 1324615 - protein, 9 aa, Homo Sapiens
VDKVFWNTR

SEQ ID NO: 1324616 - protein, 9 aa, Homo Sapiens
LCPQQHVLG

SEQ ID NO: 1324617 - protein, 9 aa, Homo Sapiens
QPPQGDVEV

SEQ ID NO: 1324618 - protein, 9 aa, Homo Sapiens
LSLGHNDPT

SEQ ID NO: 1324619 - protein, 9 aa, Homo Sapiens
GYIQSIRCH

SEQ ID NO: 1324620 - protein, 9 aa, Homo Sapiens
TRFLIFGET

SEQ ID NO: 1324621 - protein, 9 aa, Homo Sapiens
TLEEHLHAQ

SEQ ID NO: 1324622 - protein, 9 aa, Homo Sapiens
ILIVSHSST

SEQ ID NO: 1324623 - protein, 9 aa, Homo Sapiens
LGVGTALLG

SEQ ID NO: 1324624 - protein, 9 aa, Homo Sapiens
TVGFSLGVT

SEQ ID NO: 1324625 - protein, 9 aa, Homo Sapiens
LYGGSDYAL

SEQ ID NO: 1324626 - protein, 9 aa, Homo Sapiens
WPPSRNPSA

SEQ ID NO: 1324627 - protein, 9 aa, Homo Sapiens
SPAATQPTK

SEQ ID NO: 1324628 - protein, 9 aa, Homo Sapiens
SPFHVVWLN

SEQ ID NO: 1324629 - protein, 9 aa, Homo Sapiens
NVIGHMSFQ

SEQ ID NO: 1324630 - protein, 9 aa, Homo Sapiens
SQGTTSDTS

SEQ ID NO: 1324631 - protein, 9 aa, Homo Sapiens
TIQGGLLPL

SEQ ID NO: 1324632 - protein, 9 aa, Homo Sapiens
DCDLLEGQE

SEQ ID NO: 1324633 - protein, 9 aa, Homo Sapiens
VEYYSHADA

SEQ ID NO: 1324634 - protein, 9 aa, Homo Sapiens
LGHYWNIGP

SEQ ID NO: 1324635 - protein, 9 aa, Homo Sapiens
ISLNVLPKK

SEQ ID NO: 1324636 - protein, 9 aa, Homo Sapiens
ENSLYTISK

SEQ ID NO: 1324637 - protein, 9 aa, Homo Sapiens
RDSRSFFTS

SEQ ID NO: 1324638 - protein, 9 aa, Homo Sapiens
NGYRLMNSS

SEQ ID NO: 1324639 - protein, 9 aa, Homo Sapiens
NDLKLKEAE

SEQ ID NO: 1324640 - protein, 9 aa, Homo Sapiens
LVLWSGKAM

SEQ ID NO: 1324641 - protein, 9 aa, Homo Sapiens
TIMCWFRRH

SEQ ID NO: 1324642 - protein, 9 aa, Homo Sapiens
KGFVCTALQ

SEQ ID NO: 1324643 - protein, 9 aa, Homo Sapiens
QEPTFSGEE

SEQ ID NO: 1324644 - protein, 9 aa, Homo Sapiens
GRITGKGGK

SEQ ID NO: 1324645 - protein, 9 aa, Homo Sapiens
VTNTHVLPG

SEQ ID NO: 1324646 - protein, 9 aa, Homo Sapiens
RELHPRYLP

SEQ ID NO: 1324647 - protein, 9 aa, Homo Sapiens
KVTSLSLDI

SEQ ID NO: 1324648 - protein, 9 aa, Homo Sapiens
EDNVKSVPP

SEQ ID NO: 1324649 - protein, 9 aa, Homo Sapiens
MCHIQRADG

SEQ ID NO: 1324650 - protein, 9 aa, Homo Sapiens
HQKCKPDIM

SEQ ID NO: 1324651 - protein, 9 aa, Homo Sapiens
HLVSLIFNS

SEQ ID NO: 1324652 - protein, 9 aa, Homo Sapiens
GVYHSPVDR

SEQ ID NO: 1324653 - protein, 9 aa, Homo Sapiens
SHRRSVSQD

SEQ ID NO: 1324654 - protein, 9 aa, Homo Sapiens
SDTLVIFQL

SEQ ID NO: 1324655 - protein, 9 aa, Homo Sapiens
KVYLIRPKV

SEQ ID NO: 1324656 - protein, 9 aa, Homo Sapiens
SHCTHCLCT

SEQ ID NO: 1324657 - protein, 9 aa, Homo Sapiens
SVNVAPENT

SEQ ID NO: 1324658 - protein, 9 aa, Homo Sapiens
ILPDSQEEE

SEQ ID NO: 1324659 - protein, 9 aa, Homo Sapiens
SLVQFHIPN

SEQ ID NO: 1324660 - protein, 9 aa, Homo Sapiens
HSIYPITRT

SEQ ID NO: 1324661 - protein, 9 aa, Homo Sapiens
LFVFLLIII

SEQ ID NO: 1324662 - protein, 9 aa, Homo Sapiens
YSIAQKCAL

SEQ ID NO: 1324663 - protein, 9 aa, Homo Sapiens
HPRMRHYIK

SEQ ID NO: 1324664 - protein, 9 aa, Homo Sapiens
CILQAVNFP

SEQ ID NO: 1324665 - protein, 9 aa, Homo Sapiens
LSPKPCDKS

SEQ ID NO: 1324666 - protein, 9 aa, Homo Sapiens
EEAAAELDA

SEQ ID NO: 1324667 - protein, 9 aa, Homo Sapiens
VDLNIPDAP

SEQ ID NO: 1324668 - protein, 9 aa, Homo Sapiens
AIHVLRIVA

SEQ ID NO: 1324669 - protein, 9 aa, Homo Sapiens
KRRTAPINS

SEQ ID NO: 1324670 - protein, 9 aa, Homo Sapiens
ATPRRSPRS

SEQ ID NO: 1324671 - protein, 9 aa, Homo Sapiens
EAAHHHENS

SEQ ID NO: 1324672 - protein, 9 aa, Homo Sapiens
VFDNFFYQE

SEQ ID NO: 1324673 - protein, 9 aa, Homo Sapiens
HDISSNVIF

SEQ ID NO: 1324674 - protein, 9 aa, Homo Sapiens
FSYAGWMQT

SEQ ID NO: 1324675 - protein, 9 aa, Homo Sapiens
YVHVSRFVT

SEQ ID NO: 1324676 - protein, 9 aa, Homo Sapiens
MMTQSQPSG

SEQ ID NO: 1324677 - protein, 9 aa, Homo Sapiens
GRDQIKKRM

SEQ ID NO: 1324678 - protein, 9 aa, Homo Sapiens
YSFEDEGRW

SEQ ID NO: 1324679 - protein, 9 aa, Homo Sapiens
LKQCLGHRL

SEQ ID NO: 1324680 - protein, 9 aa, Homo Sapiens
LAVYLYEVS

SEQ ID NO: 1324681 - protein, 9 aa, Homo Sapiens
ACVPCPVDR

SEQ ID NO: 1324682 - protein, 9 aa, Homo Sapiens
TDVTMKGVT

SEQ ID NO: 1324683 - protein, 9 aa, Homo Sapiens
ATTGRSRKM

SEQ ID NO: 1324684 - protein, 9 aa, Homo Sapiens
NLALGMQLL

SEQ ID NO: 1324685 - protein, 9 aa, Homo Sapiens
GVPVLPAVR

SEQ ID NO: 1324686 - protein, 9 aa, Homo Sapiens
QELTRLTHD

SEQ ID NO: 1324687 - protein, 9 aa, Homo Sapiens
SCTGASTAA

SEQ ID NO: 1324688 - protein, 9 aa, Homo Sapiens
VLGLVRIRC

SEQ ID NO: 1324689 - protein, 9 aa, Homo Sapiens
IPLCNHPVS

SEQ ID NO: 1324690 - protein, 9 aa, Homo Sapiens
PVAAASGPT

SEQ ID NO: 1324691 - protein, 9 aa, Homo Sapiens
EAISGDCPL

SEQ ID NO: 1324692 - protein, 9 aa, Homo Sapiens
NLRRFDFTG

SEQ ID NO: 1324693 - protein, 9 aa, Homo Sapiens
LNPSPSKKF

SEQ ID NO: 1324694 - protein, 9 aa, Homo Sapiens
ALGPMMLEV

SEQ ID NO: 1324695 - protein, 9 aa, Homo Sapiens
GSAYYLTSQ

SEQ ID NO: 1324696 - protein, 9 aa, Homo Sapiens
GIFYCAKVA

SEQ ID NO: 1324697 - protein, 9 aa, Homo Sapiens
DVINENVKK

SEQ ID NO: 1324698 - protein, 9 aa, Homo Sapiens
NILIGVVSA

SEQ ID NO: 1324699 - protein, 9 aa, Homo Sapiens
LHRVGRFSE

SEQ ID NO: 1324700 - protein, 9 aa, Homo Sapiens
ASGGGTADH

SEQ ID NO: 1324701 - protein, 9 aa, Homo Sapiens
AHTVTPSGQ

SEQ ID NO: 1324702 - protein, 9 aa, Homo Sapiens
YRMDGILFG

SEQ ID NO: 1324703 - protein, 9 aa, Homo Sapiens
LCALETQPT

SEQ ID NO: 1324704 - protein, 9 aa, Homo Sapiens
WIHDIRTIA

SEQ ID NO: 1324705 - protein, 9 aa, Homo Sapiens
EVWKEVRGE

SEQ ID NO: 1324706 - protein, 9 aa, Homo Sapiens
VRDIDAFLK

SEQ ID NO: 1324707 - protein, 9 aa, Homo Sapiens
WFYDQKVNH

SEQ ID NO: 1324708 - protein, 9 aa, Homo Sapiens
STSFLTANG

SEQ ID NO: 1324709 - protein, 9 aa, Homo Sapiens
KQIQDAKKA

SEQ ID NO: 1324710 - protein, 9 aa, Homo Sapiens
EERYEAIAR

SEQ ID NO: 1324711 - protein, 9 aa, Homo Sapiens
EMDSETLQR

SEQ ID NO: 1324712 - protein, 9 aa, Homo Sapiens
FANRWGSDS

SEQ ID NO: 1324713 - protein, 9 aa, Homo Sapiens
GTHVLIWNI

SEQ ID NO: 1324714 - protein, 9 aa, Homo Sapiens
CFLMVCEKP

SEQ ID NO: 1324715 - protein, 9 aa, Homo Sapiens
AIFVKKELQ

SEQ ID NO: 1324716 - protein, 9 aa, Homo Sapiens
DPTVFAASQ

SEQ ID NO: 1324717 - protein, 9 aa, Homo Sapiens
ESSSPSTLS

SEQ ID NO: 1324718 - protein, 9 aa, Homo Sapiens
ETPKGISRS

SEQ ID NO: 1324719 - protein, 9 aa, Homo Sapiens
QNLNNRLAS

SEQ ID NO: 1324720 - protein, 9 aa, Homo Sapiens
ETPKGISRY

SEQ ID NO: 1324721 - protein, 9 aa, Homo Sapiens
VSSLKWQIA

SEQ ID NO: 1324722 - protein, 9 aa, Homo Sapiens
ATVAKLCES

SEQ ID NO: 1324723 - protein, 9 aa, Homo Sapiens
QSSSKRNRH

SEQ ID NO: 1324724 - protein, 9 aa, Homo Sapiens
SQEGSPSSD

SEQ ID NO: 1324725 - protein, 9 aa, Homo Sapiens
ETPKGISRK

SEQ ID NO: 1324726 - protein, 9 aa, Homo Sapiens
HRNPDEQVR

SEQ ID NO: 1324727 - protein, 9 aa, Homo Sapiens
IVRSRGHVK

SEQ ID NO: 1324728 - protein, 9 aa, Homo Sapiens
VEHILCTKS

SEQ ID NO: 1324729 - protein, 9 aa, Homo Sapiens
ICAPASASP

SEQ ID NO: 1324730 - protein, 9 aa, Homo Sapiens
HWLKGERPG

SEQ ID NO: 1324731 - protein, 9 aa, Homo Sapiens
EARSITTGK

SEQ ID NO: 1324732 - protein, 9 aa, Homo Sapiens
SEVGAYLVD

SEQ ID NO: 1324733 - protein, 9 aa, Homo Sapiens
PENVPVGTS

SEQ ID NO: 1324734 - protein, 9 aa, Homo Sapiens
GSITQVVSL

SEQ ID NO: 1324735 - protein, 9 aa, Homo Sapiens
ICDSYVCPC

SEQ ID NO: 1324736 - protein, 9 aa, Homo Sapiens
RVTVQAHVM

SEQ ID NO: 1324737 - protein, 9 aa, Homo Sapiens
IGGIIGGFW

SEQ ID NO: 1324738 - protein, 9 aa, Homo Sapiens
TGWLERAYG

SEQ ID NO: 1324739 - protein, 9 aa, Homo Sapiens
YPALDDHLS

SEQ ID NO: 1324740 - protein, 9 aa, Homo Sapiens
ENLNKNHFQ

SEQ ID NO: 1324741 - protein, 9 aa, Homo Sapiens
CFLKGEGLQ

SEQ ID NO: 1324742 - protein, 9 aa, Homo Sapiens
KKPIHAAKL

SEQ ID NO: 1324743 - protein, 9 aa, Homo Sapiens
TGLRLGVEY

SEQ ID NO: 1324744 - protein, 9 aa, Homo Sapiens
LSGHYLEEL

SEQ ID NO: 1324745 - protein, 9 aa, Homo Sapiens
ASIPGCIVM

SEQ ID NO: 1324746 - protein, 9 aa, Homo Sapiens
YSLIPAEIM

SEQ ID NO: 1324747 - protein, 9 aa, Homo Sapiens
VGDVGLGVQ

SEQ ID NO: 1324748 - protein, 9 aa, Homo Sapiens
ANQRPGRAG

SEQ ID NO: 1324749 - protein, 9 aa, Homo Sapiens
LSRITLVLM

SEQ ID NO: 1324750 - protein, 9 aa, Homo Sapiens
CSGLVDPNF

SEQ ID NO: 1324751 - protein, 9 aa, Homo Sapiens
QMSFASVHI

SEQ ID NO: 1324752 - protein, 9 aa, Homo Sapiens
KCTKEPGGK

SEQ ID NO: 1324753 - protein, 9 aa, Homo Sapiens
MPEQRRSRQ

SEQ ID NO: 1324754 - protein, 9 aa, Homo Sapiens
SLPFYEVYG

SEQ ID NO: 1324755 - protein, 9 aa, Homo Sapiens
IPLSSPLKV

SEQ ID NO: 1324756 - protein, 9 aa, Homo Sapiens
KMDTTTSLK

SEQ ID NO: 1324757 - protein, 9 aa, Homo Sapiens
YQHILQLRT

SEQ ID NO: 1324758 - protein, 9 aa, Homo Sapiens
LLKPGNLDT

SEQ ID NO: 1324759 - protein, 9 aa, Homo Sapiens
HRNRKSFSS

SEQ ID NO: 1324760 - protein, 9 aa, Homo Sapiens
CCKRYGHRT

SEQ ID NO: 1324761 - protein, 9 aa, Homo Sapiens
NVDLRECFA

SEQ ID NO: 1324762 - protein, 9 aa, Homo Sapiens
VRPYPAEAK

SEQ ID NO: 1324763 - protein, 9 aa, Homo Sapiens
MCWFRRHKV

SEQ ID NO: 1324764 - protein, 9 aa, Homo Sapiens
YQHLYIIHL

SEQ ID NO: 1324765 - protein, 9 aa, Homo Sapiens
SAMDENLSS

SEQ ID NO: 1324766 - protein, 9 aa, Homo Sapiens
FYSILVIHY

SEQ ID NO: 1324767 - protein, 9 aa, Homo Sapiens
SPKHEWKIA

SEQ ID NO: 1324768 - protein, 9 aa, Homo Sapiens
FFRNICLLT

SEQ ID NO: 1324769 - protein, 9 aa, Homo Sapiens
SPSSASTDH

SEQ ID NO: 1324770 - protein, 9 aa, Homo Sapiens
EKLCKSEEC

SEQ ID NO: 1324771 - protein, 9 aa, Homo Sapiens
SYMALGILG

SEQ ID NO: 1324772 - protein, 9 aa, Homo Sapiens
KLGLCRCKP

SEQ ID NO: 1324773 - protein, 9 aa, Homo Sapiens
FPNIPYKRV

SEQ ID NO: 1324774 - protein, 9 aa, Homo Sapiens
PNPLVSIVA

SEQ ID NO: 1324775 - protein, 9 aa, Homo Sapiens
ERMEDAPSE

SEQ ID NO: 1324776 - protein, 9 aa, Homo Sapiens
FDSFILCKE

SEQ ID NO: 1324777 - protein, 9 aa, Homo Sapiens
ARYHITFGP

SEQ ID NO: 1324778 - protein, 9 aa, Homo Sapiens
EKKLQNDVY

SEQ ID NO: 1324779 - protein, 9 aa, Homo Sapiens
ILFACEVAT

SEQ ID NO: 1324780 - protein, 9 aa, Homo Sapiens
GNCRFPNCF

SEQ ID NO: 1324781 - protein, 9 aa, Homo Sapiens
HFILHQRGH

SEQ ID NO: 1324782 - protein, 9 aa, Homo Sapiens
SSSVQAVTV

SEQ ID NO: 1324783 - protein, 9 aa, Homo Sapiens
AIIYCNFNQ

SEQ ID NO: 1324784 - protein, 9 aa, Homo Sapiens
AFEVIVKKQ

SEQ ID NO: 1324785 - protein, 9 aa, Homo Sapiens
WDIAKRVKL

SEQ ID NO: 1324786 - protein, 9 aa, Homo Sapiens
MWSAHLLTR

SEQ ID NO: 1324787 - protein, 9 aa, Homo Sapiens
VGFGRSSTR

SEQ ID NO: 1324788 - protein, 9 aa, Homo Sapiens
KEGEDEDED

SEQ ID NO: 1324789 - protein, 9 aa, Homo Sapiens
GCPASSRHR

SEQ ID NO: 1324790 - protein, 9 aa, Homo Sapiens
IYLTSSPEV

SEQ ID NO: 1324791 - protein, 9 aa, Homo Sapiens
PKTEICDEA

SEQ ID NO: 1324792 - protein, 9 aa, Homo Sapiens
GPMDSNDSH

SEQ ID NO: 1324793 - protein, 9 aa, Homo Sapiens
FNFTRSRHS

SEQ ID NO: 1324794 - protein, 9 aa, Homo Sapiens
EEGIGEELT

SEQ ID NO: 1324795 - protein, 9 aa, Homo Sapiens
RELEAFNIL

SEQ ID NO: 1324796 - protein, 9 aa, Homo Sapiens
TTFGSFNSL

SEQ ID NO: 1324797 - protein, 9 aa, Homo Sapiens
ACVSFWKKP

SEQ ID NO: 1324798 - protein, 9 aa, Homo Sapiens
KGLAPRAET

SEQ ID NO: 1324799 - protein, 9 aa, Homo Sapiens
HICSLVIDS

SEQ ID NO: 1324800 - protein, 9 aa, Homo Sapiens
VEAFQKITS

SEQ ID NO: 1324801 - protein, 9 aa, Homo Sapiens
ALGISENMV

SEQ ID NO: 1324802 - protein, 9 aa, Homo Sapiens
QQPGHILLI

SEQ ID NO: 1324803 - protein, 9 aa, Homo Sapiens
GTCDLVLKD

SEQ ID NO: 1324804 - protein, 9 aa, Homo Sapiens
QQVSQFLHT

SEQ ID NO: 1324805 - protein, 9 aa, Homo Sapiens
HLKEGDQHV

SEQ ID NO: 1324806 - protein, 9 aa, Homo Sapiens
VAASYSTVT

SEQ ID NO: 1324807 - protein, 9 aa, Homo Sapiens
RMTSAEVGS

SEQ ID NO: 1324808 - protein, 9 aa, Homo Sapiens
IADRITLKL

SEQ ID NO: 1324809 - protein, 9 aa, Homo Sapiens
AEELPAMKW

SEQ ID NO: 1324810 - protein, 9 aa, Homo Sapiens
AQQNQYIHI

SEQ ID NO: 1324811 - protein, 9 aa, Homo Sapiens
SLRNLVGRS

SEQ ID NO: 1324812 - protein, 9 aa, Homo Sapiens
EEHADSAHQ

SEQ ID NO: 1324813 - protein, 9 aa, Homo Sapiens
IKFSTEALR

SEQ ID NO: 1324814 - protein, 9 aa, Homo Sapiens
RAAGAGNET

SEQ ID NO: 1324815 - protein, 9 aa, Homo Sapiens
AVSVIMMIY

SEQ ID NO: 1324816 - protein, 9 aa, Homo Sapiens
QGMIQMTVK

SEQ ID NO: 1324817 - protein, 9 aa, Homo Sapiens
SPASTFTLS

SEQ ID NO: 1324818 - protein, 9 aa, Homo Sapiens
AADMWSLGV

SEQ ID NO: 1324819 - protein, 9 aa, Homo Sapiens
PEDLQDFNT

SEQ ID NO: 1324820 - protein, 9 aa, Homo Sapiens
RQNQVPRLT

SEQ ID NO: 1324821 - protein, 9 aa, Homo Sapiens
SRLANELHV

SEQ ID NO: 1324822 - protein, 9 aa, Homo Sapiens
LDTTITSRL

SEQ ID NO: 1324823 - protein, 9 aa, Homo Sapiens
LKSMVERAA

SEQ ID NO: 1324824 - protein, 9 aa, Homo Sapiens
DTSETLPGH

SEQ ID NO: 1324825 - protein, 9 aa, Homo Sapiens
WMRLDMMDE

SEQ ID NO: 1324826 - protein, 9 aa, Homo Sapiens
VANSGFICL

SEQ ID NO: 1324827 - protein, 9 aa, Homo Sapiens
GIIGLPGQR

SEQ ID NO: 1324828 - protein, 9 aa, Homo Sapiens
SLSRHAQVS

SEQ ID NO: 1324829 - protein, 9 aa, Homo Sapiens
KIMSDRNLP

SEQ ID NO: 1324830 - protein, 9 aa, Homo Sapiens
YREELRMRE

SEQ ID NO: 1324831 - protein, 9 aa, Homo Sapiens
GILAIMRAF

SEQ ID NO: 1324832 - protein, 9 aa, Homo Sapiens
SPSWLLPAP

SEQ ID NO: 1324833 - protein, 9 aa, Homo Sapiens
HLCTISLDR

SEQ ID NO: 1324834 - protein, 9 aa, Homo Sapiens
QGKYQDVET

SEQ ID NO: 1324835 - protein, 9 aa, Homo Sapiens
IWKWGQSPS

SEQ ID NO: 1324836 - protein, 9 aa, Homo Sapiens
LELKPDPTK

SEQ ID NO: 1324837 - protein, 9 aa, Homo Sapiens
LPGHRHSTF

SEQ ID NO: 1324838 - protein, 9 aa, Homo Sapiens
KTTTVGQMG

SEQ ID NO: 1324839 - protein, 9 aa, Homo Sapiens
PNYCTPPHR

SEQ ID NO: 1324840 - protein, 9 aa, Homo Sapiens
YSNRSLALA

SEQ ID NO: 1324841 - protein, 9 aa, Homo Sapiens
PYPMIDAER

SEQ ID NO: 1324842 - protein, 9 aa, Homo Sapiens
SMSDPYLPS

SEQ ID NO: 1324843 - protein, 9 aa, Homo Sapiens
RLHLWMGLS

SEQ ID NO: 1324844 - protein, 9 aa, Homo Sapiens
TWDTSSNTL

SEQ ID NO: 1324845 - protein, 9 aa, Homo Sapiens
KRYLRMTVL

SEQ ID NO: 1324846 - protein, 9 aa, Homo Sapiens
TESEQYSLD

SEQ ID NO: 1324847 - protein, 9 aa, Homo Sapiens
QGAHSPAHR

SEQ ID NO: 1324848 - protein, 9 aa, Homo Sapiens
ALLSDQGFN

SEQ ID NO: 1324849 - protein, 9 aa, Homo Sapiens
KGEDFYCMT

SEQ ID NO: 1324850 - protein, 9 aa, Homo Sapiens
NSIKWQTVI

SEQ ID NO: 1324851 - protein, 9 aa, Homo Sapiens
ARLGMKDTA

SEQ ID NO: 1324852 - protein, 9 aa, Homo Sapiens
MERLTKQLK

SEQ ID NO: 1324853 - protein, 9 aa, Homo Sapiens
LRFSVFDID

SEQ ID NO: 1324854 - protein, 9 aa, Homo Sapiens
YLQPYNSRR

SEQ ID NO: 1324855 - protein, 9 aa, Homo Sapiens
ALETALYYT

SEQ ID NO: 1324856 - protein, 9 aa, Homo Sapiens
FKDLGNLCY

SEQ ID NO: 1324857 - protein, 9 aa, Homo Sapiens
PPASHEDNP

SEQ ID NO: 1324858 - protein, 9 aa, Homo Sapiens
HLYSDLSDT

SEQ ID NO: 1324859 - protein, 9 aa, Homo Sapiens
GIFNHIPPH

SEQ ID NO: 1324860 - protein, 9 aa, Homo Sapiens
HVLEEVIRE

SEQ ID NO: 1324861 - protein, 9 aa, Homo Sapiens
TAVFVLPIL

SEQ ID NO: 1324862 - protein, 9 aa, Homo Sapiens
QDVEDTTAI

SEQ ID NO: 1324863 - protein, 9 aa, Homo Sapiens
KKAPLVPSS

SEQ ID NO: 1324864 - protein, 9 aa, Homo Sapiens
EVQSVLLAP

SEQ ID NO: 1324865 - protein, 9 aa, Homo Sapiens
KNRHRGKNE

SEQ ID NO: 1324866 - protein, 9 aa, Homo Sapiens
MEKSSKALP

SEQ ID NO: 1324867 - protein, 9 aa, Homo Sapiens
VKGVIQYYT

SEQ ID NO: 1324868 - protein, 9 aa, Homo Sapiens
GHEVKQGID

SEQ ID NO: 1324869 - protein, 9 aa, Homo Sapiens
THLSVVVCV

SEQ ID NO: 1324870 - protein, 9 aa, Homo Sapiens
FNSLPQAFP

SEQ ID NO: 1324871 - protein, 9 aa, Homo Sapiens
SHKIGRIIE

SEQ ID NO: 1324872 - protein, 9 aa, Homo Sapiens
CEAEVWAAA

SEQ ID NO: 1324873 - protein, 9 aa, Homo Sapiens
FMLRMTEQQ

SEQ ID NO: 1324874 - protein, 9 aa, Homo Sapiens
LMAPQMISE

SEQ ID NO: 1324875 - protein, 9 aa, Homo Sapiens
GHSSLNMHI

SEQ ID NO: 1324876 - protein, 9 aa, Homo Sapiens
VLLKVVHTE

SEQ ID NO: 1324877 - protein, 9 aa, Homo Sapiens
SMEAIRLIH

SEQ ID NO: 1324878 - protein, 9 aa, Homo Sapiens
NSFYYDVGH

SEQ ID NO: 1324879 - protein, 9 aa, Homo Sapiens
PLCNYLSHH

SEQ ID NO: 1324880 - protein, 9 aa, Homo Sapiens
QLSIMDLML

SEQ ID NO: 1324881 - protein, 9 aa, Homo Sapiens
VQLNYMLCP

SEQ ID NO: 1324882 - protein, 9 aa, Homo Sapiens
TPQMLRHQG

SEQ ID NO: 1324883 - protein, 9 aa, Homo Sapiens
TNPNLRNFN

SEQ ID NO: 1324884 - protein, 9 aa, Homo Sapiens
GPWNTASLI

SEQ ID NO: 1324885 - protein, 9 aa, Homo Sapiens
FGRYTTLNQ

SEQ ID NO: 1324886 - protein, 9 aa, Homo Sapiens
SVHTSHATT

SEQ ID NO: 1324887 - protein, 9 aa, Homo Sapiens
HRRRKEIMV

SEQ ID NO: 1324888 - protein, 9 aa, Homo Sapiens
RPLVIISDA

SEQ ID NO: 1324889 - protein, 9 aa, Homo Sapiens
ARSPTSAAP

SEQ ID NO: 1324890 - protein, 9 aa, Homo Sapiens
EESFTDEPE

SEQ ID NO: 1324891 - protein, 9 aa, Homo Sapiens
GAGGAPIQG

SEQ ID NO: 1324892 - protein, 9 aa, Homo Sapiens
VFPEVVVAE

SEQ ID NO: 1324893 - protein, 9 aa, Homo Sapiens
GLGLQLALF

SEQ ID NO: 1324894 - protein, 9 aa, Homo Sapiens
SGTSSKGPW

SEQ ID NO: 1324895 - protein, 9 aa, Homo Sapiens
LEGRLPPFA

SEQ ID NO: 1324896 - protein, 9 aa, Homo Sapiens
SPSMKTERS

SEQ ID NO: 1324897 - protein, 9 aa, Homo Sapiens
NLDFKVIID

SEQ ID NO: 1324898 - protein, 9 aa, Homo Sapiens
CGRSGERSG

SEQ ID NO: 1324899 - protein, 9 aa, Homo Sapiens
KVSQHTELV

SEQ ID NO: 1324900 - protein, 9 aa, Homo Sapiens
EDPTSIEPI

SEQ ID NO: 1324901 - protein, 9 aa, Homo Sapiens
PRGSSLTPL

SEQ ID NO: 1324902 - protein, 9 aa, Homo Sapiens
LVRAGVSPG

SEQ ID NO: 1324903 - protein, 9 aa, Homo Sapiens
IEEGIDTDT

SEQ ID NO: 1324904 - protein, 9 aa, Homo Sapiens
SISHPHSCR

SEQ ID NO: 1324905 - protein, 9 aa, Homo Sapiens
TLMAPQMIS

SEQ ID NO: 1324906 - protein, 9 aa, Homo Sapiens
LTPRGSIVT

SEQ ID NO: 1324907 - protein, 9 aa, Homo Sapiens
QCDKKRGAS

SEQ ID NO: 1324908 - protein, 9 aa, Homo Sapiens
LWGPMDTSN

SEQ ID NO: 1324909 - protein, 9 aa, Homo Sapiens
SSLKSGRKR

SEQ ID NO: 1324910 - protein, 9 aa, Homo Sapiens
YLRNFNNCM

SEQ ID NO: 1324911 - protein, 9 aa, Homo Sapiens
QQDTSETLP

SEQ ID NO: 1324912 - protein, 9 aa, Homo Sapiens
HLEVQQLKV

SEQ ID NO: 1324913 - protein, 9 aa, Homo Sapiens
DAVLKEGLS

SEQ ID NO: 1324914 - protein, 9 aa, Homo Sapiens
VNDNVPTFT

SEQ ID NO: 1324915 - protein, 9 aa, Homo Sapiens
MSGDKQCTY

SEQ ID NO: 1324916 - protein, 9 aa, Homo Sapiens
LLFWLMIFS

SEQ ID NO: 1324917 - protein, 9 aa, Homo Sapiens
KHFKVTTMS

SEQ ID NO: 1324918 - protein, 9 aa, Homo Sapiens
KKIQPLAKT

SEQ ID NO: 1324919 - protein, 9 aa, Homo Sapiens
EIHDEQANP

SEQ ID NO: 1324920 - protein, 9 aa, Homo Sapiens
TVTTLTDLT

SEQ ID NO: 1324921 - protein, 9 aa, Homo Sapiens
VLMCGGDGT

SEQ ID NO: 1324922 - protein, 9 aa, Homo Sapiens
ATPVVPIPP

SEQ ID NO: 1324923 - protein, 9 aa, Homo Sapiens
SLLLCWGGG

SEQ ID NO: 1324924 - protein, 9 aa, Homo Sapiens
ISAATVELS

SEQ ID NO: 1324925 - protein, 9 aa, Homo Sapiens
PLYGNIHSW

SEQ ID NO: 1324926 - protein, 9 aa, Homo Sapiens
NQDSTAVAL

SEQ ID NO: 1324927 - protein, 9 aa, Homo Sapiens
MHIRADTGH

SEQ ID NO: 1324928 - protein, 9 aa, Homo Sapiens
IMHFSFFSS

SEQ ID NO: 1324929 - protein, 9 aa, Homo Sapiens
FLSERCMVK

SEQ ID NO: 1324930 - protein, 9 aa, Homo Sapiens
LLLDLPILD

SEQ ID NO: 1324931 - protein, 9 aa, Homo Sapiens
NLMFGASTG

SEQ ID NO: 1324932 - protein, 9 aa, Homo Sapiens
VATPPRALA

SEQ ID NO: 1324933 - protein, 9 aa, Homo Sapiens
ISSATSAAL

SEQ ID NO: 1324934 - protein, 9 aa, Homo Sapiens
FAEAHLISA

SEQ ID NO: 1324935 - protein, 9 aa, Homo Sapiens
METTTELFL

SEQ ID NO: 1324936 - protein, 9 aa, Homo Sapiens
LSVPQIGVV

SEQ ID NO: 1324937 - protein, 9 aa, Homo Sapiens
GQNSSSGIT

SEQ ID NO: 1324938 - protein, 9 aa, Homo Sapiens
QEDSSPLLC

SEQ ID NO: 1324939 - protein, 9 aa, Homo Sapiens
QLTQGCMLC

SEQ ID NO: 1324940 - protein, 9 aa, Homo Sapiens
PKGPNPATP

SEQ ID NO: 1324941 - protein, 9 aa, Homo Sapiens
FFHLPIFSS

SEQ ID NO: 1324942 - protein, 9 aa, Homo Sapiens
ELGGHPISE

SEQ ID NO: 1324943 - protein, 9 aa, Homo Sapiens
HPINTLFFF

SEQ ID NO: 1324944 - protein, 9 aa, Homo Sapiens
LPRDEVLPE

SEQ ID NO: 1324945 - protein, 9 aa, Homo Sapiens
NAHFLTLDT

SEQ ID NO: 1324946 - protein, 9 aa, Homo Sapiens
HRRKLWAAW

SEQ ID NO: 1324947 - protein, 9 aa, Homo Sapiens
KRPDTCFMA

SEQ ID NO: 1324948 - protein, 9 aa, Homo Sapiens
ASSLTVMDL

SEQ ID NO: 1324949 - protein, 9 aa, Homo Sapiens
YDCGCGSFR

SEQ ID NO: 1324950 - protein, 9 aa, Homo Sapiens
SPSPTPVPR

SEQ ID NO: 1324951 - protein, 9 aa, Homo Sapiens
DPSQIDWVA

SEQ ID NO: 1324952 - protein, 9 aa, Homo Sapiens
QNCSGLVDP

SEQ ID NO: 1324953 - protein, 9 aa, Homo Sapiens
VSFWKKPTL

SEQ ID NO: 1324954 - protein, 9 aa, Homo Sapiens
QYQSSQTHS

SEQ ID NO: 1324955 - protein, 9 aa, Homo Sapiens
EVDAQWKEA

SEQ ID NO: 1324956 - protein, 9 aa, Homo Sapiens
RFYLISLKG

SEQ ID NO: 1324957 - protein, 9 aa, Homo Sapiens
RCFLMVCEK

SEQ ID NO: 1324958 - protein, 9 aa, Homo Sapiens
DKMEEMLTC

SEQ ID NO: 1324959 - protein, 9 aa, Homo Sapiens
TARNCLVSV

SEQ ID NO: 1324960 - protein, 9 aa, Homo Sapiens
NTLSTVLPG

SEQ ID NO: 1324961 - protein, 9 aa, Homo Sapiens
LPSLRASLV

SEQ ID NO: 1324962 - protein, 9 aa, Homo Sapiens
SKASYDPAT

SEQ ID NO: 1324963 - protein, 9 aa, Homo Sapiens
QLTQQPHHR

SEQ ID NO: 1324964 - protein, 9 aa, Homo Sapiens
PLGHLEMPK

SEQ ID NO: 1324965 - protein, 9 aa, Homo Sapiens
PQEFGDVEL

SEQ ID NO: 1324966 - protein, 9 aa, Homo Sapiens
EDLHRVSEP

SEQ ID NO: 1324967 - protein, 9 aa, Homo Sapiens
FFILFVLSV

SEQ ID NO: 1324968 - protein, 9 aa, Homo Sapiens
SLGDSLTRP

SEQ ID NO: 1324969 - protein, 9 aa, Homo Sapiens
NRLASYLDK

SEQ ID NO: 1324970 - protein, 9 aa, Homo Sapiens
LHHIRQNVA

SEQ ID NO: 1324971 - protein, 9 aa, Homo Sapiens
NLLEEILKQ

SEQ ID NO: 1324972 - protein, 9 aa, Homo Sapiens
NQLIYYKIL

SEQ ID NO: 1324973 - protein, 9 aa, Homo Sapiens
KDDTLLVCC

SEQ ID NO: 1324974 - protein, 9 aa, Homo Sapiens
CDEAEKPLI

SEQ ID NO: 1324975 - protein, 9 aa, Homo Sapiens
PDGHFSILH

SEQ ID NO: 1324976 - protein, 9 aa, Homo Sapiens
LDFKVIIDG

SEQ ID NO: 1324977 - protein, 9 aa, Homo Sapiens
MSVVPSALQ

SEQ ID NO: 1324978 - protein, 9 aa, Homo Sapiens
ASQRPDRQA

SEQ ID NO: 1324979 - protein, 9 aa, Homo Sapiens
DDDVSLVEV

SEQ ID NO: 1324980 - protein, 9 aa, Homo Sapiens
GSLCSMEIP

SEQ ID NO: 1324981 - protein, 9 aa, Homo Sapiens
SSGPRLGVL

SEQ ID NO: 1324982 - protein, 9 aa, Homo Sapiens
PPAPEDLHR

SEQ ID NO: 1324983 - protein, 9 aa, Homo Sapiens
HFWVNVIKN

SEQ ID NO: 1324984 - protein, 9 aa, Homo Sapiens
SFVILFITP

SEQ ID NO: 1324985 - protein, 9 aa, Homo Sapiens
QRVPEGDPC

SEQ ID NO: 1324986 - protein, 9 aa, Homo Sapiens
NMVSKLLEK

SEQ ID NO: 1324987 - protein, 9 aa, Homo Sapiens
KSRHHGRIG

SEQ ID NO: 1324988 - protein, 9 aa, Homo Sapiens
LLRHHLKTH

SEQ ID NO: 1324989 - protein, 9 aa, Homo Sapiens
GYLCFHYGT

SEQ ID NO: 1324990 - protein, 9 aa, Homo Sapiens
IKVPVNTDL

SEQ ID NO: 1324991 - protein, 9 aa, Homo Sapiens
PRDLNLMVL

SEQ ID NO: 1324992 - protein, 9 aa, Homo Sapiens
FVNSLHKYI

SEQ ID NO: 1324993 - protein, 9 aa, Homo Sapiens
RFGSHSCCQ

SEQ ID NO: 1324994 - protein, 9 aa, Homo Sapiens
QCLAQLFMM

SEQ ID NO: 1324995 - protein, 9 aa, Homo Sapiens
VYIEVIPPN

SEQ ID NO: 1324996 - protein, 9 aa, Homo Sapiens
REETTRIHQ

SEQ ID NO: 1324997 - protein, 9 aa, Homo Sapiens
YANDSLAPI

SEQ ID NO: 1324998 - protein, 9 aa, Homo Sapiens
GEPLGYHQD

SEQ ID NO: 1324999 - protein, 9 aa, Homo Sapiens
TTAIQGYKL

SEQ ID NO: 1325000 - protein, 9 aa, Homo Sapiens
RCSGCCNNH

SEQ ID NO: 1325001 - protein, 9 aa, Homo Sapiens
DTHWCWVES

SEQ ID NO: 1325002 - protein, 9 aa, Homo Sapiens
KDGIGDKCD

SEQ ID NO: 1325003 - protein, 9 aa, Homo Sapiens
GAEKFISLI

SEQ ID NO: 1325004 - protein, 9 aa, Homo Sapiens
SEKGCNKFV

SEQ ID NO: 1325005 - protein, 9 aa, Homo Sapiens
VVPGREFIC

SEQ ID NO: 1325006 - protein, 9 aa, Homo Sapiens
TCTKEPGTV

SEQ ID NO: 1325007 - protein, 9 aa, Homo Sapiens
LSATTYKHD

SEQ ID NO: 1325008 - protein, 9 aa, Homo Sapiens
HPGCVNLSL

SEQ ID NO: 1325009 - protein, 9 aa, Homo Sapiens
SMLVSSWSV

SEQ ID NO: 1325010 - protein, 9 aa, Homo Sapiens
STEFDKIHS

SEQ ID NO: 1325011 - protein, 9 aa, Homo Sapiens
APVTYPSVG

SEQ ID NO: 1325012 - protein, 9 aa, Homo Sapiens
SSMSPPPGM

SEQ ID NO: 1325013 - protein, 9 aa, Homo Sapiens
KLCSVPWTV

SEQ ID NO: 1325014 - protein, 9 aa, Homo Sapiens
IYPVEDLAT

SEQ ID NO: 1325015 - protein, 9 aa, Homo Sapiens
GLTITARKI

SEQ ID NO: 1325016 - protein, 9 aa, Homo Sapiens
APFTLKSDG

SEQ ID NO: 1325017 - protein, 9 aa, Homo Sapiens
LCSYRQMSI

SEQ ID NO: 1325018 - protein, 9 aa, Homo Sapiens
SYHLTTFLR

SEQ ID NO: 1325019 - protein, 9 aa, Homo Sapiens
LHLWMGLSK

SEQ ID NO: 1325020 - protein, 9 aa, Homo Sapiens
WLYHTATKI

SEQ ID NO: 1325021 - protein, 9 aa, Homo Sapiens
DGSEVMYDV

SEQ ID NO: 1325022 - protein, 9 aa, Homo Sapiens
TTSEIGSAF

SEQ ID NO: 1325023 - protein, 9 aa, Homo Sapiens
WVIPVPQSK

SEQ ID NO: 1325024 - protein, 9 aa, Homo Sapiens
KGVECDRSK

SEQ ID NO: 1325025 - protein, 9 aa, Homo Sapiens
VSVIMMIYL

SEQ ID NO: 1325026 - protein, 9 aa, Homo Sapiens
IASCSLGAV

SEQ ID NO: 1325027 - protein, 9 aa, Homo Sapiens
YFSVEPKIG

SEQ ID NO: 1325028 - protein, 9 aa, Homo Sapiens
WMCLHAEDS

SEQ ID NO: 1325029 - protein, 9 aa, Homo Sapiens
TFVTFESPA

SEQ ID NO: 1325030 - protein, 9 aa, Homo Sapiens
PKSNHGHSV

SEQ ID NO: 1325031 - protein, 9 aa, Homo Sapiens
AAMRLMPKF

SEQ ID NO: 1325032 - protein, 9 aa, Homo Sapiens
FFTYHVLMC

SEQ ID NO: 1325033 - protein, 9 aa, Homo Sapiens
RRVLYVDSR

SEQ ID NO: 1325034 - protein, 9 aa, Homo Sapiens
GKQGGKACA

SEQ ID NO: 1325035 - protein, 9 aa, Homo Sapiens
TQNVLKNYR

SEQ ID NO: 1325036 - protein, 9 aa, Homo Sapiens
ASTPLMLWP

SEQ ID NO: 1325037 - protein, 9 aa, Homo Sapiens
QSNIHDYYW

SEQ ID NO: 1325038 - protein, 9 aa, Homo Sapiens
AGATPWNIF

SEQ ID NO: 1325039 - protein, 9 aa, Homo Sapiens
ERPTQRDCS

SEQ ID NO: 1325040 - protein, 9 aa, Homo Sapiens
QTCSVLGCA

SEQ ID NO: 1325041 - protein, 9 aa, Homo Sapiens
RQAKAHPEN

SEQ ID NO: 1325042 - protein, 9 aa, Homo Sapiens
QAHLGVSDD

SEQ ID NO: 1325043 - protein, 9 aa, Homo Sapiens
LIDTVAQVI

SEQ ID NO: 1325044 - protein, 9 aa, Homo Sapiens
PENFDVDGR

SEQ ID NO: 1325045 - protein, 9 aa, Homo Sapiens
QFPMKKFRE

SEQ ID NO: 1325046 - protein, 9 aa, Homo Sapiens
YPVLSRLLS

SEQ ID NO: 1325047 - protein, 9 aa, Homo Sapiens
DHSRMKHEV

SEQ ID NO: 1325048 - protein, 9 aa, Homo Sapiens
PKTSTSRTQ

SEQ ID NO: 1325049 - protein, 9 aa, Homo Sapiens
FTSLAALSN

SEQ ID NO: 1325050 - protein, 9 aa, Homo Sapiens
CVHNESTGS

SEQ ID NO: 1325051 - protein, 9 aa, Homo Sapiens
PMTSEAGLP

SEQ ID NO: 1325052 - protein, 9 aa, Homo Sapiens
LNKSQLVEI

SEQ ID NO: 1325053 - protein, 9 aa, Homo Sapiens
PSECILPAL

SEQ ID NO: 1325054 - protein, 9 aa, Homo Sapiens
YTMDNITRQ

SEQ ID NO: 1325055 - protein, 9 aa, Homo Sapiens
PAIRVLASN

SEQ ID NO: 1325056 - protein, 9 aa, Homo Sapiens
SRDYISMAV

SEQ ID NO: 1325057 - protein, 9 aa, Homo Sapiens
WLATWLGIF

SEQ ID NO: 1325058 - protein, 9 aa, Homo Sapiens
GECHDALYV

SEQ ID NO: 1325059 - protein, 9 aa, Homo Sapiens
RHWHLWKHY

SEQ ID NO: 1325060 - protein, 9 aa, Homo Sapiens
GDQVIDVGS

SEQ ID NO: 1325061 - protein, 9 aa, Homo Sapiens
NQKICKTFV

SEQ ID NO: 1325062 - protein, 9 aa, Homo Sapiens
PFHHISGEK

SEQ ID NO: 1325063 - protein, 9 aa, Homo Sapiens
DFRDLQLAC

SEQ ID NO: 1325064 - protein, 9 aa, Homo Sapiens
IWAHDNPVC

SEQ ID NO: 1325065 - protein, 9 aa, Homo Sapiens
CDERHKTKG

SEQ ID NO: 1325066 - protein, 9 aa, Homo Sapiens
IFHDTILFL

SEQ ID NO: 1325067 - protein, 9 aa, Homo Sapiens
SQKPETDTY

SEQ ID NO: 1325068 - protein, 9 aa, Homo Sapiens
IGSFVSPES

SEQ ID NO: 1325069 - protein, 9 aa, Homo Sapiens
IHFQDYSSM

SEQ ID NO: 1325070 - protein, 9 aa, Homo Sapiens
KQEGQLRVY

SEQ ID NO: 1325071 - protein, 9 aa, Homo Sapiens
SPDITLPRR

SEQ ID NO: 1325072 - protein, 9 aa, Homo Sapiens
LLSTCFCSV

SEQ ID NO: 1325073 - protein, 9 aa, Homo Sapiens
CHKKRGIFP

SEQ ID NO: 1325074 - protein, 9 aa, Homo Sapiens
VLTLYVDML

SEQ ID NO: 1325075 - protein, 9 aa, Homo Sapiens
RFNEKHNFI

SEQ ID NO: 1325076 - protein, 9 aa, Homo Sapiens
SAYHIDSSN

SEQ ID NO: 1325077 - protein, 9 aa, Homo Sapiens
VAKRTHQWR

SEQ ID NO: 1325078 - protein, 9 aa, Homo Sapiens
NAFSENHQD

SEQ ID NO: 1325079 - protein, 9 aa, Homo Sapiens
DMLYVPLVL

SEQ ID NO: 1325080 - protein, 9 aa, Homo Sapiens
QSCESHKHR

SEQ ID NO: 1325081 - protein, 9 aa, Homo Sapiens
EVTVSTWLH

SEQ ID NO: 1325082 - protein, 9 aa, Homo Sapiens
QFLPEQIFF

SEQ ID NO: 1325083 - protein, 9 aa, Homo Sapiens
RDVWGNQQA

SEQ ID NO: 1325084 - protein, 9 aa, Homo Sapiens
RAEVVELQL

SEQ ID NO: 1325085 - protein, 9 aa, Homo Sapiens
CHDGASSDG

SEQ ID NO: 1325086 - protein, 9 aa, Homo Sapiens
GAVCAWESR

SEQ ID NO: 1325087 - protein, 9 aa, Homo Sapiens
DQYKCDCTQ

SEQ ID NO: 1325088 - protein, 9 aa, Homo Sapiens
LVIAEYAND

SEQ ID NO: 1325089 - protein, 9 aa, Homo Sapiens
CRAAAGGLA

SEQ ID NO: 1325090 - protein, 9 aa, Homo Sapiens
HINTCYKHF

SEQ ID NO: 1325091 - protein, 9 aa, Homo Sapiens
RELTMLRRQ

SEQ ID NO: 1325092 - protein, 9 aa, Homo Sapiens
IDPKKLKMK

SEQ ID NO: 1325093 - protein, 9 aa, Homo Sapiens
SHQASGQPY

SEQ ID NO: 1325094 - protein, 9 aa, Homo Sapiens
TLTIIGLIK

SEQ ID NO: 1325095 - protein, 9 aa, Homo Sapiens
RKRCSASSG

SEQ ID NO: 1325096 - protein, 9 aa, Homo Sapiens
WYLPSHDRR

SEQ ID NO: 1325097 - protein, 9 aa, Homo Sapiens
RLTKQLKLE

SEQ ID NO: 1325098 - protein, 9 aa, Homo Sapiens
RDFITLCLP

SEQ ID NO: 1325099 - protein, 9 aa, Homo Sapiens
IETGNRGET

SEQ ID NO: 1325100 - protein, 9 aa, Homo Sapiens
FCPIPWIAF

SEQ ID NO: 1325101 - protein, 9 aa, Homo Sapiens
YWLHTSPED

SEQ ID NO: 1325102 - protein, 9 aa, Homo Sapiens
HCAARNGHM

SEQ ID NO: 1325103 - protein, 9 aa, Homo Sapiens
PHHHRSKSQ

SEQ ID NO: 1325104 - protein, 9 aa, Homo Sapiens
GGRRRRSSK

SEQ ID NO: 1325105 - protein, 9 aa, Homo Sapiens
GLELFRIEL

SEQ ID NO: 1325106 - protein, 9 aa, Homo Sapiens
TASSAPSRT

SEQ ID NO: 1325107 - protein, 9 aa, Homo Sapiens
EPQSVGDYS

SEQ ID NO: 1325108 - protein, 9 aa, Homo Sapiens
PDDVLLHHT

SEQ ID NO: 1325109 - protein, 9 aa, Homo Sapiens
PGPVGPTGE

SEQ ID NO: 1325110 - protein, 9 aa, Homo Sapiens
SSVQAVTVT

SEQ ID NO: 1325111 - protein, 9 aa, Homo Sapiens
CDPATLKLF

SEQ ID NO: 1325112 - protein, 9 aa, Homo Sapiens
LFQWVVSRA

SEQ ID NO: 1325113 - protein, 9 aa, Homo Sapiens
CLLACGSLY

SEQ ID NO: 1325114 - protein, 9 aa, Homo Sapiens
GRPWMMNIK

SEQ ID NO: 1325115 - protein, 9 aa, Homo Sapiens
IEDVTEKLK

SEQ ID NO: 1325116 - protein, 9 aa, Homo Sapiens
LTAILSLEN

SEQ ID NO: 1325117 - protein, 9 aa, Homo Sapiens
HDLTKQETV

SEQ ID NO: 1325118 - protein, 9 aa, Homo Sapiens
TPANDTYES

SEQ ID NO: 1325119 - protein, 9 aa, Homo Sapiens
LFKLFNLLD

SEQ ID NO: 1325120 - protein, 9 aa, Homo Sapiens
STVCFNIVG

SEQ ID NO: 1325121 - protein, 9 aa, Homo Sapiens
TVQGHPPGS

SEQ ID NO: 1325122 - protein, 9 aa, Homo Sapiens
NTLRIRQDP

SEQ ID NO: 1325123 - protein, 9 aa, Homo Sapiens
QVVESFVPH

SEQ ID NO: 1325124 - protein, 9 aa, Homo Sapiens
IEGKDCIAS

SEQ ID NO: 1325125 - protein, 9 aa, Homo Sapiens
DNFFYQERA

SEQ ID NO: 1325126 - protein, 9 aa, Homo Sapiens
YGNQNPVNQ

SEQ ID NO: 1325127 - protein, 9 aa, Homo Sapiens
KICAQTEGI

SEQ ID NO: 1325128 - protein, 9 aa, Homo Sapiens
NNIQLFLTL

SEQ ID NO: 1325129 - protein, 9 aa, Homo Sapiens
VICNGKQPN

SEQ ID NO: 1325130 - protein, 9 aa, Homo Sapiens
YNLYGLLVN

SEQ ID NO: 1325131 - protein, 9 aa, Homo Sapiens
VALGPHSLE

SEQ ID NO: 1325132 - protein, 9 aa, Homo Sapiens
DRLEIYEDI

SEQ ID NO: 1325133 - protein, 9 aa, Homo Sapiens
LTQILFPNR

SEQ ID NO: 1325134 - protein, 9 aa, Homo Sapiens
KFSPHPLKF

SEQ ID NO: 1325135 - protein, 9 aa, Homo Sapiens
MVFMCAAVS

SEQ ID NO: 1325136 - protein, 9 aa, Homo Sapiens
SSTNTCSAH

SEQ ID NO: 1325137 - protein, 9 aa, Homo Sapiens
NAILRYIAH

SEQ ID NO: 1325138 - protein, 9 aa, Homo Sapiens
NRIFNFTRS

SEQ ID NO: 1325139 - protein, 9 aa, Homo Sapiens
LPMAQSAAV

SEQ ID NO: 1325140 - protein, 9 aa, Homo Sapiens
SPVRLARNV

SEQ ID NO: 1325141 - protein, 9 aa, Homo Sapiens
SKPCAHQCS

SEQ ID NO: 1325142 - protein, 9 aa, Homo Sapiens
VTIVSGKKC

SEQ ID NO: 1325143 - protein, 9 aa, Homo Sapiens
PIWVIQVQL

SEQ ID NO: 1325144 - protein, 9 aa, Homo Sapiens
PVISYSIQD

SEQ ID NO: 1325145 - protein, 9 aa, Homo Sapiens
EHNPLGSGA

SEQ ID NO: 1325146 - protein, 9 aa, Homo Sapiens
QMSPTSSFI

SEQ ID NO: 1325147 - protein, 9 aa, Homo Sapiens
HLEKVHVVI

SEQ ID NO: 1325148 - protein, 9 aa, Homo Sapiens
LTGTCAEKL

SEQ ID NO: 1325149 - protein, 9 aa, Homo Sapiens
GQEMGLSNP

SEQ ID NO: 1325150 - protein, 9 aa, Homo Sapiens
AEQLLARGY

SEQ ID NO: 1325151 - protein, 9 aa, Homo Sapiens
DNPKESPPE

SEQ ID NO: 1325152 - protein, 9 aa, Homo Sapiens
STSPKKAVE

SEQ ID NO: 1325153 - protein, 9 aa, Homo Sapiens
IIHHTWPWV

SEQ ID NO: 1325154 - protein, 9 aa, Homo Sapiens
GWALTWTFP

SEQ ID NO: 1325155 - protein, 9 aa, Homo Sapiens
PSVLVCAGY

SEQ ID NO: 1325156 - protein, 9 aa, Homo Sapiens
LEMDSSLIL

SEQ ID NO: 1325157 - protein, 9 aa, Homo Sapiens
EATADVEWC

SEQ ID NO: 1325158 - protein, 9 aa, Homo Sapiens
ESTCGRSGE

SEQ ID NO: 1325159 - protein, 9 aa, Homo Sapiens
CHVRALVLE

SEQ ID NO: 1325160 - protein, 9 aa, Homo Sapiens
EEKLLKLLD

SEQ ID NO: 1325161 - protein, 9 aa, Homo Sapiens
VEPLFVPAP

SEQ ID NO: 1325162 - protein, 9 aa, Homo Sapiens
GRGASPEEA

SEQ ID NO: 1325163 - protein, 9 aa, Homo Sapiens
KTTSEMVLA

SEQ ID NO: 1325164 - protein, 9 aa, Homo Sapiens
MNNFQVMIM

SEQ ID NO: 1325165 - protein, 9 aa, Homo Sapiens
CMKRKKQIC

SEQ ID NO: 1325166 - protein, 9 aa, Homo Sapiens
GIPDNKLDA

SEQ ID NO: 1325167 - protein, 9 aa, Homo Sapiens
DQSAGHPSE

SEQ ID NO: 1325168 - protein, 9 aa, Homo Sapiens
GQFFSPKEK

SEQ ID NO: 1325169 - protein, 9 aa, Homo Sapiens
YGKKLVKIS

SEQ ID NO: 1325170 - protein, 9 aa, Homo Sapiens
SEALLLKIC

SEQ ID NO: 1325171 - protein, 9 aa, Homo Sapiens
SFLHDNYEE

SEQ ID NO: 1325172 - protein, 9 aa, Homo Sapiens
IRDQEMLLM

SEQ ID NO: 1325173 - protein, 9 aa, Homo Sapiens
AKELAILLC

SEQ ID NO: 1325174 - protein, 9 aa, Homo Sapiens
EGNIIEIFY

SEQ ID NO: 1325175 - protein, 9 aa, Homo Sapiens
LHLYPGPMV

SEQ ID NO: 1325176 - protein, 9 aa, Homo Sapiens
MQNHYTVAW

SEQ ID NO: 1325177 - protein, 9 aa, Homo Sapiens
NNQPGILTS

SEQ ID NO: 1325178 - protein, 9 aa, Homo Sapiens
IVESLIQLT

SEQ ID NO: 1325179 - protein, 9 aa, Homo Sapiens
VQSLTHILT

SEQ ID NO: 1325180 - protein, 9 aa, Homo Sapiens
YTYMLPQSY

SEQ ID NO: 1325181 - protein, 9 aa, Homo Sapiens
ESLTVSSPL

SEQ ID NO: 1325182 - protein, 9 aa, Homo Sapiens
VRSPTSAAS

SEQ ID NO: 1325183 - protein, 9 aa, Homo Sapiens
IYTPAYGDF

SEQ ID NO: 1325184 - protein, 9 aa, Homo Sapiens
KMMWRINPA

SEQ ID NO: 1325185 - protein, 9 aa, Homo Sapiens
YLTYHCRCH

SEQ ID NO: 1325186 - protein, 9 aa, Homo Sapiens
IELDKYIQG

SEQ ID NO: 1325187 - protein, 9 aa, Homo Sapiens
SNVEQITNV

SEQ ID NO: 1325188 - protein, 9 aa, Homo Sapiens
TFANSPWVV

SEQ ID NO: 1325189 - protein, 9 aa, Homo Sapiens
LQMLEQYSS

SEQ ID NO: 1325190 - protein, 9 aa, Homo Sapiens
SDSVSLIAQ

SEQ ID NO: 1325191 - protein, 9 aa, Homo Sapiens
HDIFKILQE

SEQ ID NO: 1325192 - protein, 9 aa, Homo Sapiens
YTHMDDPSP

SEQ ID NO: 1325193 - protein, 9 aa, Homo Sapiens
LSLHTSVWI

SEQ ID NO: 1325194 - protein, 9 aa, Homo Sapiens
PSHSDSLTS

SEQ ID NO: 1325195 - protein, 9 aa, Homo Sapiens
LPVHGDPGV

SEQ ID NO: 1325196 - protein, 9 aa, Homo Sapiens
GRLWRPTAI

SEQ ID NO: 1325197 - protein, 9 aa, Homo Sapiens
SKHHPLDER

SEQ ID NO: 1325198 - protein, 9 aa, Homo Sapiens
SSAATWART

SEQ ID NO: 1325199 - protein, 9 aa, Homo Sapiens
RTMNDLEDN

SEQ ID NO: 1325200 - protein, 9 aa, Homo Sapiens
RRILSRDAT

SEQ ID NO: 1325201 - protein, 9 aa, Homo Sapiens
TANEIYKKV

SEQ ID NO: 1325202 - protein, 9 aa, Homo Sapiens
YMSPTLDLS

SEQ ID NO: 1325203 - protein, 9 aa, Homo Sapiens
KFSVFIPKK

SEQ ID NO: 1325204 - protein, 9 aa, Homo Sapiens
LQSLVGQYN

SEQ ID NO: 1325205 - protein, 9 aa, Homo Sapiens
GGEPSPWQG

SEQ ID NO: 1325206 - protein, 9 aa, Homo Sapiens
VIAYIIGRR

SEQ ID NO: 1325207 - protein, 9 aa, Homo Sapiens
GLAVGLALF

SEQ ID NO: 1325208 - protein, 9 aa, Homo Sapiens
AYCLISAKM

SEQ ID NO: 1325209 - protein, 9 aa, Homo Sapiens
PATKNSVRF

SEQ ID NO: 1325210 - protein, 9 aa, Homo Sapiens
LDTPHQRGC

SEQ ID NO: 1325211 - protein, 9 aa, Homo Sapiens
SALRKHKTI

SEQ ID NO: 1325212 - protein, 9 aa, Homo Sapiens
STFYRNSPS

SEQ ID NO: 1325213 - protein, 9 aa, Homo Sapiens
DDLSECLIK

SEQ ID NO: 1325214 - protein, 9 aa, Homo Sapiens
TSQFINGEM

SEQ ID NO: 1325215 - protein, 9 aa, Homo Sapiens
VAYKKEKWW

SEQ ID NO: 1325216 - protein, 9 aa, Homo Sapiens
VLATMCGQE

SEQ ID NO: 1325217 - protein, 9 aa, Homo Sapiens
LPTAQQQEG

SEQ ID NO: 1325218 - protein, 9 aa, Homo Sapiens
IACSYGQIL

SEQ ID NO: 1325219 - protein, 9 aa, Homo Sapiens
TQLLPFELE

SEQ ID NO: 1325220 - protein, 9 aa, Homo Sapiens
LSEIRAPPA

SEQ ID NO: 1325221 - protein, 9 aa, Homo Sapiens
AVATVLSFS

SEQ ID NO: 1325222 - protein, 9 aa, Homo Sapiens
ELQKAIEGY

SEQ ID NO: 1325223 - protein, 9 aa, Homo Sapiens
VPYVENPGY

SEQ ID NO: 1325224 - protein, 9 aa, Homo Sapiens
YHCRCHTGE

SEQ ID NO: 1325225 - protein, 9 aa, Homo Sapiens
RDPKGRHSF

SEQ ID NO: 1325226 - protein, 9 aa, Homo Sapiens
EVAAEKPVR

SEQ ID NO: 1325227 - protein, 9 aa, Homo Sapiens
RNIIQSTEH

SEQ ID NO: 1325228 - protein, 9 aa, Homo Sapiens
CLWKNHQQN

SEQ ID NO: 1325229 - protein, 9 aa, Homo Sapiens
LPKELKIIS

SEQ ID NO: 1325230 - protein, 9 aa, Homo Sapiens
LNRVDFAND

SEQ ID NO: 1325231 - protein, 9 aa, Homo Sapiens
KDDRQHMWR

SEQ ID NO: 1325232 - protein, 9 aa, Homo Sapiens
NLLLYFTFY

SEQ ID NO: 1325233 - protein, 9 aa, Homo Sapiens
HIRQNVADS

SEQ ID NO: 1325234 - protein, 9 aa, Homo Sapiens
CMLQIRNMH

SEQ ID NO: 1325235 - protein, 9 aa, Homo Sapiens
EGKPKSFWI

SEQ ID NO: 1325236 - protein, 9 aa, Homo Sapiens
PLGLSGASG

SEQ ID NO: 1325237 - protein, 9 aa, Homo Sapiens
SSKHLMSPR

SEQ ID NO: 1325238 - protein, 9 aa, Homo Sapiens
YPSAYHIDS

SEQ ID NO: 1325239 - protein, 9 aa, Homo Sapiens
HRMGAVAHA

SEQ ID NO: 1325240 - protein, 9 aa, Homo Sapiens
KSEKERLEV

SEQ ID NO: 1325241 - protein, 9 aa, Homo Sapiens
HSAQTGACA

SEQ ID NO: 1325242 - protein, 9 aa, Homo Sapiens
NRYLDFSII

SEQ ID NO: 1325243 - protein, 9 aa, Homo Sapiens
EHQRVHTKE

SEQ ID NO: 1325244 - protein, 9 aa, Homo Sapiens
WKYVVMVID

SEQ ID NO: 1325245 - protein, 9 aa, Homo Sapiens
TYDRSILVD

SEQ ID NO: 1325246 - protein, 9 aa, Homo Sapiens
KLLDHMENY

SEQ ID NO: 1325247 - protein, 9 aa, Homo Sapiens
KFSYLGHDP

SEQ ID NO: 1325248 - protein, 9 aa, Homo Sapiens
FKLQEPRGA

SEQ ID NO: 1325249 - protein, 9 aa, Homo Sapiens
SAAPAARPS

SEQ ID NO: 1325250 - protein, 9 aa, Homo Sapiens
SCTEASRDP

SEQ ID NO: 1325251 - protein, 9 aa, Homo Sapiens
ETQPRVVSR

SEQ ID NO: 1325252 - protein, 9 aa, Homo Sapiens
VTWDPRGYG

SEQ ID NO: 1325253 - protein, 9 aa, Homo Sapiens
HSPVDRVMK

SEQ ID NO: 1325254 - protein, 9 aa, Homo Sapiens
IHIRVGVVG

SEQ ID NO: 1325255 - protein, 9 aa, Homo Sapiens
DSDVRNPPV

SEQ ID NO: 1325256 - protein, 9 aa, Homo Sapiens
ATDKHFNIF

SEQ ID NO: 1325257 - protein, 9 aa, Homo Sapiens
GDTKNYDCD

SEQ ID NO: 1325258 - protein, 9 aa, Homo Sapiens
YNRHTFETA

SEQ ID NO: 1325259 - protein, 9 aa, Homo Sapiens
QPSLLCSPL

SEQ ID NO: 1325260 - protein, 9 aa, Homo Sapiens
MMKFFFDNL

SEQ ID NO: 1325261 - protein, 9 aa, Homo Sapiens
KLQDQLSAL

SEQ ID NO: 1325262 - protein, 9 aa, Homo Sapiens
RFSVFDIDE

SEQ ID NO: 1325263 - protein, 9 aa, Homo Sapiens
LARVLIVTF

SEQ ID NO: 1325264 - protein, 9 aa, Homo Sapiens
RASLVEIAG

SEQ ID NO: 1325265 - protein, 9 aa, Homo Sapiens
YHYYQNVCT

SEQ ID NO: 1325266 - protein, 9 aa, Homo Sapiens
RFPASNIYE

SEQ ID NO: 1325267 - protein, 9 aa, Homo Sapiens
DLHQHMGQY

SEQ ID NO: 1325268 - protein, 9 aa, Homo Sapiens
SKTEQSAAL

SEQ ID NO: 1325269 - protein, 9 aa, Homo Sapiens
AIQAVADRM

SEQ ID NO: 1325270 - protein, 9 aa, Homo Sapiens
ARMTVLQAL

SEQ ID NO: 1325271 - protein, 9 aa, Homo Sapiens
SHTIMIACV

SEQ ID NO: 1325272 - protein, 9 aa, Homo Sapiens
GFQIHPTLL

SEQ ID NO: 1325273 - protein, 9 aa, Homo Sapiens
SLYGKKLVK

SEQ ID NO: 1325274 - protein, 9 aa, Homo Sapiens
SVSKTRLCR

SEQ ID NO: 1325275 - protein, 9 aa, Homo Sapiens
CHFDPTVFA

SEQ ID NO: 1325276 - protein, 9 aa, Homo Sapiens
LQKGLDRRA

SEQ ID NO: 1325277 - protein, 9 aa, Homo Sapiens
IGVSLGSIV

SEQ ID NO: 1325278 - protein, 9 aa, Homo Sapiens
IGHMSFQLP

SEQ ID NO: 1325279 - protein, 9 aa, Homo Sapiens
LNIHTFSAG

SEQ ID NO: 1325280 - protein, 9 aa, Homo Sapiens
IELAFFPSY

SEQ ID NO: 1325281 - protein, 9 aa, Homo Sapiens
TGLTEHMCP

SEQ ID NO: 1325282 - protein, 9 aa, Homo Sapiens
AQQVSQFLH

SEQ ID NO: 1325283 - protein, 9 aa, Homo Sapiens
ISPAATQPT

SEQ ID NO: 1325284 - protein, 9 aa, Homo Sapiens
NDNMFCAQL

SEQ ID NO: 1325285 - protein, 9 aa, Homo Sapiens
NKFIILFVE

SEQ ID NO: 1325286 - protein, 9 aa, Homo Sapiens
IGNQINTFL

SEQ ID NO: 1325287 - protein, 9 aa, Homo Sapiens
AILPKELKI

SEQ ID NO: 1325288 - protein, 9 aa, Homo Sapiens
MLSSNRECF

SEQ ID NO: 1325289 - protein, 9 aa, Homo Sapiens
DGAHVWLLP

SEQ ID NO: 1325290 - protein, 9 aa, Homo Sapiens
VVWKLHRVL

SEQ ID NO: 1325291 - protein, 9 aa, Homo Sapiens
LVSGSRFFI

SEQ ID NO: 1325292 - protein, 9 aa, Homo Sapiens
DSTGESPWE

SEQ ID NO: 1325293 - protein, 9 aa, Homo Sapiens
QREVATRTV

SEQ ID NO: 1325294 - protein, 9 aa, Homo Sapiens
TFPINPGLF

SEQ ID NO: 1325295 - protein, 9 aa, Homo Sapiens
GTGGAHIPF

SEQ ID NO: 1325296 - protein, 9 aa, Homo Sapiens
EEEPPPSAS

SEQ ID NO: 1325297 - protein, 9 aa, Homo Sapiens
SQLSMKSSL

SEQ ID NO: 1325298 - protein, 9 aa, Homo Sapiens
QVIRCPLQI

SEQ ID NO: 1325299 - protein, 9 aa, Homo Sapiens
QWLDLCKLG

SEQ ID NO: 1325300 - protein, 9 aa, Homo Sapiens
TCQTYECPI

SEQ ID NO: 1325301 - protein, 9 aa, Homo Sapiens
NLTKFMSDR

SEQ ID NO: 1325302 - protein, 9 aa, Homo Sapiens
STGSIRQLL

SEQ ID NO: 1325303 - protein, 9 aa, Homo Sapiens
PSKKKLKLA

SEQ ID NO: 1325304 - protein, 9 aa, Homo Sapiens
SADAFAPVT

SEQ ID NO: 1325305 - protein, 9 aa, Homo Sapiens
QTSIYLTSS

SEQ ID NO: 1325306 - protein, 9 aa, Homo Sapiens
AGQRGIIGL

SEQ ID NO: 1325307 - protein, 9 aa, Homo Sapiens
QSIQQRKAI

SEQ ID NO: 1325308 - protein, 9 aa, Homo Sapiens
KEYFCDYTE

SEQ ID NO: 1325309 - protein, 9 aa, Homo Sapiens
IWSLVQFHI

SEQ ID NO: 1325310 - protein, 9 aa, Homo Sapiens
GPNNVPKFG

SEQ ID NO: 1325311 - protein, 9 aa, Homo Sapiens
WINEAILVP

SEQ ID NO: 1325312 - protein, 9 aa, Homo Sapiens
SVATCKQLT

SEQ ID NO: 1325313 - protein, 9 aa, Homo Sapiens
SNHVFNQSA

SEQ ID NO: 1325314 - protein, 9 aa, Homo Sapiens
IISVVHRLS

SEQ ID NO: 1325315 - protein, 9 aa, Homo Sapiens
AGEVRYALM

SEQ ID NO: 1325316 - protein, 9 aa, Homo Sapiens
MVEAEYPFN

SEQ ID NO: 1325317 - protein, 9 aa, Homo Sapiens
GGPRGLMPL

SEQ ID NO: 1325318 - protein, 9 aa, Homo Sapiens
HNFAEFNFI

SEQ ID NO: 1325319 - protein, 9 aa, Homo Sapiens
GAQTSIYLT

SEQ ID NO: 1325320 - protein, 9 aa, Homo Sapiens
VLIPGNLSK

SEQ ID NO: 1325321 - protein, 9 aa, Homo Sapiens
LPPTHHPIS

SEQ ID NO: 1325322 - protein, 9 aa, Homo Sapiens
DEFDRLDSS

SEQ ID NO: 1325323 - protein, 9 aa, Homo Sapiens
DMVRYACNV

SEQ ID NO: 1325324 - protein, 9 aa, Homo Sapiens
HFQDYSSMV

SEQ ID NO: 1325325 - protein, 9 aa, Homo Sapiens
SSSSFISSS

SEQ ID NO: 1325326 - protein, 9 aa, Homo Sapiens
KDGITFIEK

SEQ ID NO: 1325327 - protein, 9 aa, Homo Sapiens
KKTKLLLFK

SEQ ID NO: 1325328 - protein, 9 aa, Homo Sapiens
PVAASYSTV

SEQ ID NO: 1325329 - protein, 9 aa, Homo Sapiens
VAFFVALDE

SEQ ID NO: 1325330 - protein, 9 aa, Homo Sapiens
KQPNMETDS

SEQ ID NO: 1325331 - protein, 9 aa, Homo Sapiens
KKSLHLSVV

SEQ ID NO: 1325332 - protein, 9 aa, Homo Sapiens
PCTEVWTGL

SEQ ID NO: 1325333 - protein, 9 aa, Homo Sapiens
AGTSRSSAA

SEQ ID NO: 1325334 - protein, 9 aa, Homo Sapiens
LATCLSGAQ

SEQ ID NO: 1325335 - protein, 9 aa, Homo Sapiens
RSSLRCCHI

SEQ ID NO: 1325336 - protein, 9 aa, Homo Sapiens
TRDTIFDVS

SEQ ID NO: 1325337 - protein, 9 aa, Homo Sapiens
HCVCREVGL

SEQ ID NO: 1325338 - protein, 9 aa, Homo Sapiens
VIEIATYRK

SEQ ID NO: 1325339 - protein, 9 aa, Homo Sapiens
AWGQWTPWG

SEQ ID NO: 1325340 - protein, 9 aa, Homo Sapiens
KSKWEAWNL

SEQ ID NO: 1325341 - protein, 9 aa, Homo Sapiens
SNRSLALAM

SEQ ID NO: 1325342 - protein, 9 aa, Homo Sapiens
FMFYCVHWQ

SEQ ID NO: 1325343 - protein, 9 aa, Homo Sapiens
YFEEVQHLR

SEQ ID NO: 1325344 - protein, 9 aa, Homo Sapiens
YNPQKGISV

SEQ ID NO: 1325345 - protein, 9 aa, Homo Sapiens
KGIHPAPGY

SEQ ID NO: 1325346 - protein, 9 aa, Homo Sapiens
MSKNVRHIC

SEQ ID NO: 1325347 - protein, 9 aa, Homo Sapiens
VHQHTGEKP

SEQ ID NO: 1325348 - protein, 9 aa, Homo Sapiens
LKILTNESS

SEQ ID NO: 1325349 - protein, 9 aa, Homo Sapiens
EKVWPEGTC

SEQ ID NO: 1325350 - protein, 9 aa, Homo Sapiens
RGNQLIYYK

SEQ ID NO: 1325351 - protein, 9 aa, Homo Sapiens
DDLARWKSH

SEQ ID NO: 1325352 - protein, 9 aa, Homo Sapiens
WLHHPKAGL

SEQ ID NO: 1325353 - protein, 9 aa, Homo Sapiens
PSLGDGLES

SEQ ID NO: 1325354 - protein, 9 aa, Homo Sapiens
DYPEGDDNW

SEQ ID NO: 1325355 - protein, 9 aa, Homo Sapiens
SKQVIILNS

SEQ ID NO: 1325356 - protein, 9 aa, Homo Sapiens
EKMNVIGHM

SEQ ID NO: 1325357 - protein, 9 aa, Homo Sapiens
KEKSWVSKL

SEQ ID NO: 1325358 - protein, 9 aa, Homo Sapiens
VDDSGTFEV

SEQ ID NO: 1325359 - protein, 9 aa, Homo Sapiens
APGLLSMVN

SEQ ID NO: 1325360 - protein, 9 aa, Homo Sapiens
TVVLQCIAG

SEQ ID NO: 1325361 - protein, 9 aa, Homo Sapiens
ESSSGDPPV

SEQ ID NO: 1325362 - protein, 9 aa, Homo Sapiens
SPLWSLQPL

SEQ ID NO: 1325363 - protein, 9 aa, Homo Sapiens
VANHVVQVL

SEQ ID NO: 1325364 - protein, 9 aa, Homo Sapiens
DNHMDRREH

SEQ ID NO: 1325365 - protein, 9 aa, Homo Sapiens
MWWYQRCCQ

SEQ ID NO: 1325366 - protein, 9 aa, Homo Sapiens
DQHLVFHSK

SEQ ID NO: 1325367 - protein, 9 aa, Homo Sapiens
NDDDVYHSL

SEQ ID NO: 1325368 - protein, 9 aa, Homo Sapiens
KMKQHILKE

SEQ ID NO: 1325369 - protein, 9 aa, Homo Sapiens
FCLQWLRPE

SEQ ID NO: 1325370 - protein, 9 aa, Homo Sapiens
GPRFPASNI

SEQ ID NO: 1325371 - protein, 9 aa, Homo Sapiens
EQAHYLEPG

SEQ ID NO: 1325372 - protein, 9 aa, Homo Sapiens
TEHFLKFTS

SEQ ID NO: 1325373 - protein, 9 aa, Homo Sapiens
VAVSKAWAK

SEQ ID NO: 1325374 - protein, 9 aa, Homo Sapiens
IIVGDDCGH

SEQ ID NO: 1325375 - protein, 9 aa, Homo Sapiens
PVRLQWMES

SEQ ID NO: 1325376 - protein, 9 aa, Homo Sapiens
RSLKTLEAR

SEQ ID NO: 1325377 - protein, 9 aa, Homo Sapiens
DQANKLKKM

SEQ ID NO: 1325378 - protein, 9 aa, Homo Sapiens
EIFRKVSQH

SEQ ID NO: 1325379 - protein, 9 aa, Homo Sapiens
IILMYRRKS

SEQ ID NO: 1325380 - protein, 9 aa, Homo Sapiens
APRKKQIVP

SEQ ID NO: 1325381 - protein, 9 aa, Homo Sapiens
FGQDILDDL

SEQ ID NO: 1325382 - protein, 9 aa, Homo Sapiens
HRYFVDKAT

SEQ ID NO: 1325383 - protein, 9 aa, Homo Sapiens
QRQQQQRRQ

SEQ ID NO: 1325384 - protein, 9 aa, Homo Sapiens
AHEYDSGTY

SEQ ID NO: 1325385 - protein, 9 aa, Homo Sapiens
PVEDLATTS

SEQ ID NO: 1325386 - protein, 9 aa, Homo Sapiens
EQYSLDGKK

SEQ ID NO: 1325387 - protein, 9 aa, Homo Sapiens
IYYQLNKHL

SEQ ID NO: 1325388 - protein, 9 aa, Homo Sapiens
RVKMMTTCL

SEQ ID NO: 1325389 - protein, 9 aa, Homo Sapiens
FLAYLFFAD

SEQ ID NO: 1325390 - protein, 9 aa, Homo Sapiens
FVTSIDDVL

SEQ ID NO: 1325391 - protein, 9 aa, Homo Sapiens
HNKQPKRCP

SEQ ID NO: 1325392 - protein, 9 aa, Homo Sapiens
AYHPQFCLS

SEQ ID NO: 1325393 - protein, 9 aa, Homo Sapiens
YKGVWKPPL

SEQ ID NO: 1325394 - protein, 9 aa, Homo Sapiens
RTWGVWHVS

SEQ ID NO: 1325395 - protein, 9 aa, Homo Sapiens
QHISRGYDF

SEQ ID NO: 1325396 - protein, 9 aa, Homo Sapiens
AEAWDFTGV

SEQ ID NO: 1325397 - protein, 9 aa, Homo Sapiens
AGPGGSQSD

SEQ ID NO: 1325398 - protein, 9 aa, Homo Sapiens
CRLTIIECG

SEQ ID NO: 1325399 - protein, 9 aa, Homo Sapiens
CHIQRADGD

SEQ ID NO: 1325400 - protein, 9 aa, Homo Sapiens
YITNHTFML

SEQ ID NO: 1325401 - protein, 9 aa, Homo Sapiens
VHLDQNDPH

SEQ ID NO: 1325402 - protein, 9 aa, Homo Sapiens
RIMRICLRD

SEQ ID NO: 1325403 - protein, 9 aa, Homo Sapiens
FHSRQYLPY

SEQ ID NO: 1325404 - protein, 9 aa, Homo Sapiens
RFPTCFSSF

SEQ ID NO: 1325405 - protein, 9 aa, Homo Sapiens
HDDSVIYLQ

SEQ ID NO: 1325406 - protein, 9 aa, Homo Sapiens
EVATGIWGF

SEQ ID NO: 1325407 - protein, 9 aa, Homo Sapiens
SYAFLPREV

SEQ ID NO: 1325408 - protein, 9 aa, Homo Sapiens
VARGIAIHM

SEQ ID NO: 1325409 - protein, 9 aa, Homo Sapiens
SATEDENVT

SEQ ID NO: 1325410 - protein, 9 aa, Homo Sapiens
VFKRHSMWE

SEQ ID NO: 1325411 - protein, 9 aa, Homo Sapiens
GAVIISTPQ

SEQ ID NO: 1325412 - protein, 9 aa, Homo Sapiens
GRITVQAQP

SEQ ID NO: 1325413 - protein, 9 aa, Homo Sapiens
VVLSLPECV

SEQ ID NO: 1325414 - protein, 9 aa, Homo Sapiens
QDPFQFSAP

SEQ ID NO: 1325415 - protein, 9 aa, Homo Sapiens
QQCSCPTCT

SEQ ID NO: 1325416 - protein, 9 aa, Homo Sapiens
AEGFVKTTT

SEQ ID NO: 1325417 - protein, 9 aa, Homo Sapiens
SKKGFKKAG

SEQ ID NO: 1325418 - protein, 9 aa, Homo Sapiens
YNCSLHGVS

SEQ ID NO: 1325419 - protein, 9 aa, Homo Sapiens
VTVVVDDLH

SEQ ID NO: 1325420 - protein, 9 aa, Homo Sapiens
VESELERGT

SEQ ID NO: 1325421 - protein, 9 aa, Homo Sapiens
ASLLTWLAG

SEQ ID NO: 1325422 - protein, 9 aa, Homo Sapiens
SISHMKRVL

SEQ ID NO: 1325423 - protein, 9 aa, Homo Sapiens
CTYTSSEES

SEQ ID NO: 1325424 - protein, 9 aa, Homo Sapiens
SLLTESEQY

SEQ ID NO: 1325425 - protein, 9 aa, Homo Sapiens
LYPTQRALY

SEQ ID NO: 1325426 - protein, 9 aa, Homo Sapiens
WNLENRLEK

SEQ ID NO: 1325427 - protein, 9 aa, Homo Sapiens
TTGRSRKMH

SEQ ID NO: 1325428 - protein, 9 aa, Homo Sapiens
QSSSLHPPF

SEQ ID NO: 1325429 - protein, 9 aa, Homo Sapiens
SCTGPSRVA

SEQ ID NO: 1325430 - protein, 9 aa, Homo Sapiens
GGNRSICLT

SEQ ID NO: 1325431 - protein, 9 aa, Homo Sapiens
PNGAFVYLY

SEQ ID NO: 1325432 - protein, 9 aa, Homo Sapiens
NGPTHVPWL

SEQ ID NO: 1325433 - protein, 9 aa, Homo Sapiens
SAAPARRPS

SEQ ID NO: 1325434 - protein, 9 aa, Homo Sapiens
MVPLGGLPS

SEQ ID NO: 1325435 - protein, 9 aa, Homo Sapiens
MLYKKIEKN

SEQ ID NO: 1325436 - protein, 9 aa, Homo Sapiens
KVRKQCTLA

SEQ ID NO: 1325437 - protein, 9 aa, Homo Sapiens
VIQNVNVSA

SEQ ID NO: 1325438 - protein, 9 aa, Homo Sapiens
THITDDICL

SEQ ID NO: 1325439 - protein, 9 aa, Homo Sapiens
NIRKSTPGR

SEQ ID NO: 1325440 - protein, 9 aa, Homo Sapiens
GRANGEILP

SEQ ID NO: 1325441 - protein, 9 aa, Homo Sapiens
GTFLIQAHT

SEQ ID NO: 1325442 - protein, 9 aa, Homo Sapiens
YPAQWPPGP

SEQ ID NO: 1325443 - protein, 9 aa, Homo Sapiens
HRPRIMRIC

SEQ ID NO: 1325444 - protein, 9 aa, Homo Sapiens
KKQGPCMSV

SEQ ID NO: 1325445 - protein, 9 aa, Homo Sapiens
DPDAWLHAL

SEQ ID NO: 1325446 - protein, 9 aa, Homo Sapiens
GTGVHKNKT

SEQ ID NO: 1325447 - protein, 9 aa, Homo Sapiens
EYLYHVNKR

SEQ ID NO: 1325448 - protein, 9 aa, Homo Sapiens
LRHCCLPQP

SEQ ID NO: 1325449 - protein, 9 aa, Homo Sapiens
VCTGHHHIV

SEQ ID NO: 1325450 - protein, 9 aa, Homo Sapiens
VRKLLLFDR

SEQ ID NO: 1325451 - protein, 9 aa, Homo Sapiens
LPSRWDDRR

SEQ ID NO: 1325452 - protein, 9 aa, Homo Sapiens
HIVEHPSDL

SEQ ID NO: 1325453 - protein, 9 aa, Homo Sapiens
VTGVEGDDI

SEQ ID NO: 1325454 - protein, 9 aa, Homo Sapiens
AFSLKSHFI

SEQ ID NO: 1325455 - protein, 9 aa, Homo Sapiens
YPLRQFHFT

SEQ ID NO: 1325456 - protein, 9 aa, Homo Sapiens
QDVFEMCFA

SEQ ID NO: 1325457 - protein, 9 aa, Homo Sapiens
VFHEGGYWC

SEQ ID NO: 1325458 - protein, 9 aa, Homo Sapiens
RKKKEMPEI

SEQ ID NO: 1325459 - protein, 9 aa, Homo Sapiens
MGVSGKDDI

SEQ ID NO: 1325460 - protein, 9 aa, Homo Sapiens
PHAEKRSLG

SEQ ID NO: 1325461 - protein, 9 aa, Homo Sapiens
IMAFTLDGH

SEQ ID NO: 1325462 - protein, 9 aa, Homo Sapiens
QSRGRPSRR

SEQ ID NO: 1325463 - protein, 9 aa, Homo Sapiens
VRNVEDIEQ

SEQ ID NO: 1325464 - protein, 9 aa, Homo Sapiens
FIDTASYKI

SEQ ID NO: 1325465 - protein, 9 aa, Homo Sapiens
IHSMSCNKQ

SEQ ID NO: 1325466 - protein, 9 aa, Homo Sapiens
SYMGAPLCN

SEQ ID NO: 1325467 - protein, 9 aa, Homo Sapiens
IGTGCLVTG

SEQ ID NO: 1325468 - protein, 9 aa, Homo Sapiens
EYVVVQVML

SEQ ID NO: 1325469 - protein, 9 aa, Homo Sapiens
AKVWMIAAE

SEQ ID NO: 1325470 - protein, 9 aa, Homo Sapiens
PEPEGRYFC

SEQ ID NO: 1325471 - protein, 9 aa, Homo Sapiens
IRSKASYDP

SEQ ID NO: 1325472 - protein, 9 aa, Homo Sapiens
RHITIPLVI

SEQ ID NO: 1325473 - protein, 9 aa, Homo Sapiens
APHPPQPKK

SEQ ID NO: 1325474 - protein, 9 aa, Homo Sapiens
RKPLELFGK

SEQ ID NO: 1325475 - protein, 9 aa, Homo Sapiens
LSLPTYFSP

SEQ ID NO: 1325476 - protein, 9 aa, Homo Sapiens
SQSVWTLFL

SEQ ID NO: 1325477 - protein, 9 aa, Homo Sapiens
IRIEKHQNR

SEQ ID NO: 1325478 - protein, 9 aa, Homo Sapiens
DTLCLTALP

SEQ ID NO: 1325479 - protein, 9 aa, Homo Sapiens
QIGDRVMTI

SEQ ID NO: 1325480 - protein, 9 aa, Homo Sapiens
LPPVFIDTA

SEQ ID NO: 1325481 - protein, 9 aa, Homo Sapiens
QQVAGGVLG

SEQ ID NO: 1325482 - protein, 9 aa, Homo Sapiens
SSFEKQCNN

SEQ ID NO: 1325483 - protein, 9 aa, Homo Sapiens
HGFSMCPDL

SEQ ID NO: 1325484 - protein, 9 aa, Homo Sapiens
VHTKEKPYG

SEQ ID NO: 1325485 - protein, 9 aa, Homo Sapiens
AVLRSSSIP

SEQ ID NO: 1325486 - protein, 9 aa, Homo Sapiens
PSAYHIDSS

SEQ ID NO: 1325487 - protein, 9 aa, Homo Sapiens
VILDRKKKS

SEQ ID NO: 1325488 - protein, 9 aa, Homo Sapiens
INVLMHALT

SEQ ID NO: 1325489 - protein, 9 aa, Homo Sapiens
VSKSKVPHL

SEQ ID NO: 1325490 - protein, 9 aa, Homo Sapiens
DDTLLKNYG

SEQ ID NO: 1325491 - protein, 9 aa, Homo Sapiens
YSMVELHDP

SEQ ID NO: 1325492 - protein, 9 aa, Homo Sapiens
GYTDHILHP

SEQ ID NO: 1325493 - protein, 9 aa, Homo Sapiens
YSVSDAVVT

SEQ ID NO: 1325494 - protein, 9 aa, Homo Sapiens
EMAAMRLMP

SEQ ID NO: 1325495 - protein, 9 aa, Homo Sapiens
IKWQTVITT

SEQ ID NO: 1325496 - protein, 9 aa, Homo Sapiens
THSHIPLHP

SEQ ID NO: 1325497 - protein, 9 aa, Homo Sapiens
SWFPSYLNL

SEQ ID NO: 1325498 - protein, 9 aa, Homo Sapiens
HYIKNPRIV

SEQ ID NO: 1325499 - protein, 9 aa, Homo Sapiens
VLLRTADLQ

SEQ ID NO: 1325500 - protein, 9 aa, Homo Sapiens
NANGGLVDG

SEQ ID NO: 1325501 - protein, 9 aa, Homo Sapiens
DPELAQYLN

SEQ ID NO: 1325502 - protein, 9 aa, Homo Sapiens
ELCQKKLYC

SEQ ID NO: 1325503 - protein, 9 aa, Homo Sapiens
AQTSIYLTS

SEQ ID NO: 1325504 - protein, 9 aa, Homo Sapiens
TGIEHYHRT

SEQ ID NO: 1325505 - protein, 9 aa, Homo Sapiens
SILRIRSAE

SEQ ID NO: 1325506 - protein, 9 aa, Homo Sapiens
ISIIMISLT

SEQ ID NO: 1325507 - protein, 9 aa, Homo Sapiens
DAAIASFDQ

SEQ ID NO: 1325508 - protein, 9 aa, Homo Sapiens
MKHMRESAM

SEQ ID NO: 1325509 - protein, 9 aa, Homo Sapiens
YDMILAGSP

SEQ ID NO: 1325510 - protein, 9 aa, Homo Sapiens
VAAASGPTP

SEQ ID NO: 1325511 - protein, 9 aa, Homo Sapiens
LGEGTIACL

SEQ ID NO: 1325512 - protein, 9 aa, Homo Sapiens
STKKRRKLG

SEQ ID NO: 1325513 - protein, 9 aa, Homo Sapiens
CFDCMHGYI

SEQ ID NO: 1325514 - protein, 9 aa, Homo Sapiens
RRIQRANLV

SEQ ID NO: 1325515 - protein, 9 aa, Homo Sapiens
SFSFSSTSS

SEQ ID NO: 1325516 - protein, 9 aa, Homo Sapiens
GVLALCCLE

SEQ ID NO: 1325517 - protein, 9 aa, Homo Sapiens
DKEKAAIIE

SEQ ID NO: 1325518 - protein, 9 aa, Homo Sapiens
QYNAQLSRH

SEQ ID NO: 1325519 - protein, 9 aa, Homo Sapiens
RNLTKVYCG

SEQ ID NO: 1325520 - protein, 9 aa, Homo Sapiens
AISQRLCEL

SEQ ID NO: 1325521 - protein, 9 aa, Homo Sapiens
VLMVRFTSL

SEQ ID NO: 1325522 - protein, 9 aa, Homo Sapiens
PPAKKCSLT

SEQ ID NO: 1325523 - protein, 9 aa, Homo Sapiens
RKKQICIQY

SEQ ID NO: 1325524 - protein, 9 aa, Homo Sapiens
PFTSTLPLP

SEQ ID NO: 1325525 - protein, 9 aa, Homo Sapiens
EVVTRFLMS

SEQ ID NO: 1325526 - protein, 9 aa, Homo Sapiens
VLPRLRREE

SEQ ID NO: 1325527 - protein, 9 aa, Homo Sapiens
IMLFCETVE

SEQ ID NO: 1325528 - protein, 9 aa, Homo Sapiens
FYAGDWHYQ

SEQ ID NO: 1325529 - protein, 9 aa, Homo Sapiens
AWMKDPLTK

SEQ ID NO: 1325530 - protein, 9 aa, Homo Sapiens
NMLSTYPKR

SEQ ID NO: 1325531 - protein, 9 aa, Homo Sapiens
PENTGTQQG

SEQ ID NO: 1325532 - protein, 9 aa, Homo Sapiens
MLLMRLPHM

SEQ ID NO: 1325533 - protein, 9 aa, Homo Sapiens
SLPQAFPAL

SEQ ID NO: 1325534 - protein, 9 aa, Homo Sapiens
ELFGKVFGN

SEQ ID NO: 1325535 - protein, 9 aa, Homo Sapiens
WHQVDVVLH

SEQ ID NO: 1325536 - protein, 9 aa, Homo Sapiens
DGAIMTFFK

SEQ ID NO: 1325537 - protein, 9 aa, Homo Sapiens
DVNKRRFFP

SEQ ID NO: 1325538 - protein, 9 aa, Homo Sapiens
SLHLMIPEI

SEQ ID NO: 1325539 - protein, 9 aa, Homo Sapiens
QLPQDLGSA

SEQ ID NO: 1325540 - protein, 9 aa, Homo Sapiens
ITHSCDVVT

SEQ ID NO: 1325541 - protein, 9 aa, Homo Sapiens
FLLCKPRCS

SEQ ID NO: 1325542 - protein, 9 aa, Homo Sapiens
FSALRKHKT

SEQ ID NO: 1325543 - protein, 9 aa, Homo Sapiens
QMKPNAPGW

SEQ ID NO: 1325544 - protein, 9 aa, Homo Sapiens
SMVFPHVTS

SEQ ID NO: 1325545 - protein, 9 aa, Homo Sapiens
RSITRTYYR

SEQ ID NO: 1325546 - protein, 9 aa, Homo Sapiens
EAAQNDQSP

SEQ ID NO: 1325547 - protein, 9 aa, Homo Sapiens
LNRSGKCGR

SEQ ID NO: 1325548 - protein, 9 aa, Homo Sapiens
YSYPAHVPP

SEQ ID NO: 1325549 - protein, 9 aa, Homo Sapiens
LSQKSPLFQ

SEQ ID NO: 1325550 - protein, 9 aa, Homo Sapiens
EGPKGKKGE

SEQ ID NO: 1325551 - protein, 9 aa, Homo Sapiens
WLQETHKGE

SEQ ID NO: 1325552 - protein, 9 aa, Homo Sapiens
PSTEFDKIH

SEQ ID NO: 1325553 - protein, 9 aa, Homo Sapiens
ARDADLTTE

SEQ ID NO: 1325554 - protein, 9 aa, Homo Sapiens
VGLCHEHGR

SEQ ID NO: 1325555 - protein, 9 aa, Homo Sapiens
VGGHPGLTE

SEQ ID NO: 1325556 - protein, 9 aa, Homo Sapiens
TAVDSAQLL

SEQ ID NO: 1325557 - protein, 9 aa, Homo Sapiens
DFQAHVREQ

SEQ ID NO: 1325558 - protein, 9 aa, Homo Sapiens
AVGHVLWIW

SEQ ID NO: 1325559 - protein, 9 aa, Homo Sapiens
ISKEWERAI

SEQ ID NO: 1325560 - protein, 9 aa, Homo Sapiens
DMEHIWQYV

SEQ ID NO: 1325561 - protein, 9 aa, Homo Sapiens
RYPTLRNHR

SEQ ID NO: 1325562 - protein, 9 aa, Homo Sapiens
YGRLWRPTA

SEQ ID NO: 1325563 - protein, 9 aa, Homo Sapiens
KDNVIKYLA

SEQ ID NO: 1325564 - protein, 9 aa, Homo Sapiens
LNVAHGRWN

SEQ ID NO: 1325565 - protein, 9 aa, Homo Sapiens
KVYPLVCQC

SEQ ID NO: 1325566 - protein, 9 aa, Homo Sapiens
FYLVHLFHF

SEQ ID NO: 1325567 - protein, 9 aa, Homo Sapiens
WEKKLQNDV

SEQ ID NO: 1325568 - protein, 9 aa, Homo Sapiens
NASTMARRG

SEQ ID NO: 1325569 - protein, 9 aa, Homo Sapiens
SSDPSLQSA

SEQ ID NO: 1325570 - protein, 9 aa, Homo Sapiens
TINGIPTED

SEQ ID NO: 1325571 - protein, 9 aa, Homo Sapiens
RNKPHYPKA

SEQ ID NO: 1325572 - protein, 9 aa, Homo Sapiens
PAHAFGPAV

SEQ ID NO: 1325573 - protein, 9 aa, Homo Sapiens
QRGHWHSNV

SEQ ID NO: 1325574 - protein, 9 aa, Homo Sapiens
KPLAVSKNP

SEQ ID NO: 1325575 - protein, 9 aa, Homo Sapiens
QGKTPPRQV

SEQ ID NO: 1325576 - protein, 9 aa, Homo Sapiens
VFNQSAELK

SEQ ID NO: 1325577 - protein, 9 aa, Homo Sapiens
MLANQPSPH

SEQ ID NO: 1325578 - protein, 9 aa, Homo Sapiens
PTTPVSPST

SEQ ID NO: 1325579 - protein, 9 aa, Homo Sapiens
SSLGQPSSE

SEQ ID NO: 1325580 - protein, 9 aa, Homo Sapiens
LLKKCSLYG

SEQ ID NO: 1325581 - protein, 9 aa, Homo Sapiens
VVQVLLNQK

SEQ ID NO: 1325582 - protein, 9 aa, Homo Sapiens
VNNKLIGSI

SEQ ID NO: 1325583 - protein, 9 aa, Homo Sapiens
AVQKEEVRQ

SEQ ID NO: 1325584 - protein, 9 aa, Homo Sapiens
QCMMVRAAV

SEQ ID NO: 1325585 - protein, 9 aa, Homo Sapiens
TGLTETINE

SEQ ID NO: 1325586 - protein, 9 aa, Homo Sapiens
TNLCDANKV

SEQ ID NO: 1325587 - protein, 9 aa, Homo Sapiens
PWTRCLRMR

SEQ ID NO: 1325588 - protein, 9 aa, Homo Sapiens
SEEFWERSQ

SEQ ID NO: 1325589 - protein, 9 aa, Homo Sapiens
YHRIGGGSP

SEQ ID NO: 1325590 - protein, 9 aa, Homo Sapiens
WCPFGFEGN

SEQ ID NO: 1325591 - protein, 9 aa, Homo Sapiens
IAMAIIRIH

SEQ ID NO: 1325592 - protein, 9 aa, Homo Sapiens
TVVWAFRTQ

SEQ ID NO: 1325593 - protein, 9 aa, Homo Sapiens
CPNYQGQQY

SEQ ID NO: 1325594 - protein, 9 aa, Homo Sapiens
SGFLGQHMA

SEQ ID NO: 1325595 - protein, 9 aa, Homo Sapiens
HIAARENHY

SEQ ID NO: 1325596 - protein, 9 aa, Homo Sapiens
HCFSRGESV

SEQ ID NO: 1325597 - protein, 9 aa, Homo Sapiens
PSSPEGDNP

SEQ ID NO: 1325598 - protein, 9 aa, Homo Sapiens
REESRRRHK

SEQ ID NO: 1325599 - protein, 9 aa, Homo Sapiens
ASQRSSACT

SEQ ID NO: 1325600 - protein, 9 aa, Homo Sapiens
VVDPTVLKH

SEQ ID NO: 1325601 - protein, 9 aa, Homo Sapiens
RDRDSGDNR

SEQ ID NO: 1325602 - protein, 9 aa, Homo Sapiens
RNNIVIIWI

SEQ ID NO: 1325603 - protein, 9 aa, Homo Sapiens
CYGLCAPTP

SEQ ID NO: 1325604 - protein, 9 aa, Homo Sapiens
HKFYLETQA

SEQ ID NO: 1325605 - protein, 9 aa, Homo Sapiens
QNTDSNFTL

SEQ ID NO: 1325606 - protein, 9 aa, Homo Sapiens
EAGTPSPRG

SEQ ID NO: 1325607 - protein, 9 aa, Homo Sapiens
QGVAQPTME

SEQ ID NO: 1325608 - protein, 9 aa, Homo Sapiens
LMKACVSFW

SEQ ID NO: 1325609 - protein, 9 aa, Homo Sapiens
WLTGIRLSI

SEQ ID NO: 1325610 - protein, 9 aa, Homo Sapiens
RKAVNAEFG

SEQ ID NO: 1325611 - protein, 9 aa, Homo Sapiens
FNHKQYLTY

SEQ ID NO: 1325612 - protein, 9 aa, Homo Sapiens
HSCRDVPDD

SEQ ID NO: 1325613 - protein, 9 aa, Homo Sapiens
ITLLPFMQA

SEQ ID NO: 1325614 - protein, 9 aa, Homo Sapiens
FRNICLLTI

SEQ ID NO: 1325615 - protein, 9 aa, Homo Sapiens
LSETSPAFH

SEQ ID NO: 1325616 - protein, 9 aa, Homo Sapiens
IDNLPVNLI

SEQ ID NO: 1325617 - protein, 9 aa, Homo Sapiens
KDREPFQMC

SEQ ID NO: 1325618 - protein, 9 aa, Homo Sapiens
SMVELHDPN

SEQ ID NO: 1325619 - protein, 9 aa, Homo Sapiens
CIYMVPMNQ

SEQ ID NO: 1325620 - protein, 9 aa, Homo Sapiens
KEFSSTVQG

SEQ ID NO: 1325621 - protein, 9 aa, Homo Sapiens
ESDKGWTYA

SEQ ID NO: 1325622 - protein, 9 aa, Homo Sapiens
RCWEFFPTG

SEQ ID NO: 1325623 - protein, 9 aa, Homo Sapiens
ADTGRYECV

SEQ ID NO: 1325624 - protein, 9 aa, Homo Sapiens
PPSSLSPPS

SEQ ID NO: 1325625 - protein, 9 aa, Homo Sapiens
LLQHHVSSD

SEQ ID NO: 1325626 - protein, 9 aa, Homo Sapiens
KLHPEVWEL

SEQ ID NO: 1325627 - protein, 9 aa, Homo Sapiens
TECRNALRE

SEQ ID NO: 1325628 - protein, 9 aa, Homo Sapiens
PTCFSSFRV

SEQ ID NO: 1325629 - protein, 9 aa, Homo Sapiens
VPSPMPTHR

SEQ ID NO: 1325630 - protein, 9 aa, Homo Sapiens
KIIEYYLRH

SEQ ID NO: 1325631 - protein, 9 aa, Homo Sapiens
DANYEMSGE

SEQ ID NO: 1325632 - protein, 9 aa, Homo Sapiens
RPEKDRYPQ

SEQ ID NO: 1325633 - protein, 9 aa, Homo Sapiens
DCILFGLMA

SEQ ID NO: 1325634 - protein, 9 aa, Homo Sapiens
GDDLERVSW

SEQ ID NO: 1325635 - protein, 9 aa, Homo Sapiens
SFQAWLRLR

SEQ ID NO: 1325636 - protein, 9 aa, Homo Sapiens
DAEIEVDKV

SEQ ID NO: 1325637 - protein, 9 aa, Homo Sapiens
EDPKAMLSY

SEQ ID NO: 1325638 - protein, 9 aa, Homo Sapiens
LLRGLGLQL

SEQ ID NO: 1325639 - protein, 9 aa, Homo Sapiens
ALAFLQHMD

SEQ ID NO: 1325640 - protein, 9 aa, Homo Sapiens
IFLVDIILN

SEQ ID NO: 1325641 - protein, 9 aa, Homo Sapiens
PAFTSLKRS

SEQ ID NO: 1325642 - protein, 9 aa, Homo Sapiens
VKTCSERQL

SEQ ID NO: 1325643 - protein, 9 aa, Homo Sapiens
RSSEGESPN

SEQ ID NO: 1325644 - protein, 9 aa, Homo Sapiens
CHDIRKVGI

SEQ ID NO: 1325645 - protein, 9 aa, Homo Sapiens
RIRSAEGRS

SEQ ID NO: 1325646 - protein, 9 aa, Homo Sapiens
SAVKVELRQ

SEQ ID NO: 1325647 - protein, 9 aa, Homo Sapiens
LQKIMMDLN

SEQ ID NO: 1325648 - protein, 9 aa, Homo Sapiens
FQRDVFLRI

SEQ ID NO: 1325649 - protein, 9 aa, Homo Sapiens
ITRSYYHNS

SEQ ID NO: 1325650 - protein, 9 aa, Homo Sapiens
NESLQLKTH

SEQ ID NO: 1325651 - protein, 9 aa, Homo Sapiens
KEAANGDKA

SEQ ID NO: 1325652 - protein, 9 aa, Homo Sapiens
CSVFALPLL

SEQ ID NO: 1325653 - protein, 9 aa, Homo Sapiens
LSSALHTIH

SEQ ID NO: 1325654 - protein, 9 aa, Homo Sapiens
FYIWTADMV

SEQ ID NO: 1325655 - protein, 9 aa, Homo Sapiens
NIDTTPVVN

SEQ ID NO: 1325656 - protein, 9 aa, Homo Sapiens
VGPRTSGKV

SEQ ID NO: 1325657 - protein, 9 aa, Homo Sapiens
VKQNADMAL

SEQ ID NO: 1325658 - protein, 9 aa, Homo Sapiens
VITDFRKDS

SEQ ID NO: 1325659 - protein, 9 aa, Homo Sapiens
SEKIAVIAE

SEQ ID NO: 1325660 - protein, 9 aa, Homo Sapiens
PKGCDNIID

SEQ ID NO: 1325661 - protein, 9 aa, Homo Sapiens
TGAVIISTP

SEQ ID NO: 1325662 - protein, 9 aa, Homo Sapiens
PLSMHYLFI

SEQ ID NO: 1325663 - protein, 9 aa, Homo Sapiens
IPWKLDKRT

SEQ ID NO: 1325664 - protein, 9 aa, Homo Sapiens
QTTIWRRLH

SEQ ID NO: 1325665 - protein, 9 aa, Homo Sapiens
DSDSPDEGL

SEQ ID NO: 1325666 - protein, 9 aa, Homo Sapiens
TQKYKHTLP

SEQ ID NO: 1325667 - protein, 9 aa, Homo Sapiens
SRIRFSSRE

SEQ ID NO: 1325668 - protein, 9 aa, Homo Sapiens
DFSNNDGVD

SEQ ID NO: 1325669 - protein, 9 aa, Homo Sapiens
LVKVLLYSL

SEQ ID NO: 1325670 - protein, 9 aa, Homo Sapiens
TTTGSAHTL

SEQ ID NO: 1325671 - protein, 9 aa, Homo Sapiens
SLGRGRGRE

SEQ ID NO: 1325672 - protein, 9 aa, Homo Sapiens
PECVEPDRL

SEQ ID NO: 1325673 - protein, 9 aa, Homo Sapiens
EHFLSKMSE

SEQ ID NO: 1325674 - protein, 9 aa, Homo Sapiens
GWSPLHIVA

SEQ ID NO: 1325675 - protein, 9 aa, Homo Sapiens
PEEYVGQIT

SEQ ID NO: 1325676 - protein, 9 aa, Homo Sapiens
TKSRGRAVK

SEQ ID NO: 1325677 - protein, 9 aa, Homo Sapiens
RSHFDALFC

SEQ ID NO: 1325678 - protein, 9 aa, Homo Sapiens
VMPGGCITI

SEQ ID NO: 1325679 - protein, 9 aa, Homo Sapiens
LATTSVTIF

SEQ ID NO: 1325680 - protein, 9 aa, Homo Sapiens
PTSRFGGST

SEQ ID NO: 1325681 - protein, 9 aa, Homo Sapiens
KHEWKIAAS

SEQ ID NO: 1325682 - protein, 9 aa, Homo Sapiens
RVGFVEAAR

SEQ ID NO: 1325683 - protein, 9 aa, Homo Sapiens
ADKSIYFHT

SEQ ID NO: 1325684 - protein, 9 aa, Homo Sapiens
ISELIYIHS

SEQ ID NO: 1325685 - protein, 9 aa, Homo Sapiens
NCRFPNCFR

SEQ ID NO: 1325686 - protein, 9 aa, Homo Sapiens
LVMAEALQM

SEQ ID NO: 1325687 - protein, 9 aa, Homo Sapiens
STTGWLERA

SEQ ID NO: 1325688 - protein, 9 aa, Homo Sapiens
GRFFIDRPN

SEQ ID NO: 1325689 - protein, 9 aa, Homo Sapiens
PDGTALTPP

SEQ ID NO: 1325690 - protein, 9 aa, Homo Sapiens
RPILDVVDS

SEQ ID NO: 1325691 - protein, 9 aa, Homo Sapiens
GIIEENGQG

SEQ ID NO: 1325692 - protein, 9 aa, Homo Sapiens
PCDKYNTQP

SEQ ID NO: 1325693 - protein, 9 aa, Homo Sapiens
EKGLELFRI

SEQ ID NO: 1325694 - protein, 9 aa, Homo Sapiens
LNTTVNLIR

SEQ ID NO: 1325695 - protein, 9 aa, Homo Sapiens
YDCDSGYTC

SEQ ID NO: 1325696 - protein, 9 aa, Homo Sapiens
TTSCSTFNL

SEQ ID NO: 1325697 - protein, 9 aa, Homo Sapiens
QTQIDLLEP

SEQ ID NO: 1325698 - protein, 9 aa, Homo Sapiens
SYFRSWDVD

SEQ ID NO: 1325699 - protein, 9 aa, Homo Sapiens
KCQKSSTKL

SEQ ID NO: 1325700 - protein, 9 aa, Homo Sapiens
PGWSLTLSP

SEQ ID NO: 1325701 - protein, 9 aa, Homo Sapiens
TGDYTPRVS

SEQ ID NO: 1325702 - protein, 9 aa, Homo Sapiens
FIGAVNLPA

SEQ ID NO: 1325703 - protein, 9 aa, Homo Sapiens
YPVALSMYQ

SEQ ID NO: 1325704 - protein, 9 aa, Homo Sapiens
SLLTTEGTG

SEQ ID NO: 1325705 - protein, 9 aa, Homo Sapiens
QSQAQVLSQ

SEQ ID NO: 1325706 - protein, 9 aa, Homo Sapiens
GGQLVSIKS

SEQ ID NO: 1325707 - protein, 9 aa, Homo Sapiens
VFLSPKARS

SEQ ID NO: 1325708 - protein, 9 aa, Homo Sapiens
QHQQPNRAH

SEQ ID NO: 1325709 - protein, 9 aa, Homo Sapiens
GEFGMSTVS

SEQ ID NO: 1325710 - protein, 9 aa, Homo Sapiens
SNHTGYVHW

SEQ ID NO: 1325711 - protein, 9 aa, Homo Sapiens
PGPPRSMPL

SEQ ID NO: 1325712 - protein, 9 aa, Homo Sapiens
QGVTIKFGK

SEQ ID NO: 1325713 - protein, 9 aa, Homo Sapiens
GTSSVAYGF

SEQ ID NO: 1325714 - protein, 9 aa, Homo Sapiens
DWHYQDIDG

SEQ ID NO: 1325715 - protein, 9 aa, Homo Sapiens
DLCKGKSLV

SEQ ID NO: 1325716 - protein, 9 aa, Homo Sapiens
LNDSFKHLI

SEQ ID NO: 1325717 - protein, 9 aa, Homo Sapiens
TFNHVNGLT

SEQ ID NO: 1325718 - protein, 9 aa, Homo Sapiens
TRKSQILKC

SEQ ID NO: 1325719 - protein, 9 aa, Homo Sapiens
IPSHLMQYP

SEQ ID NO: 1325720 - protein, 9 aa, Homo Sapiens
DVSKWPVDR

SEQ ID NO: 1325721 - protein, 9 aa, Homo Sapiens
AEHIKIPST

SEQ ID NO: 1325722 - protein, 9 aa, Homo Sapiens
ETLPANFWV

SEQ ID NO: 1325723 - protein, 9 aa, Homo Sapiens
RPLWCHYFQ

SEQ ID NO: 1325724 - protein, 9 aa, Homo Sapiens
VLDTSWVGW

SEQ ID NO: 1325725 - protein, 9 aa, Homo Sapiens
SLCMKSTLT

SEQ ID NO: 1325726 - protein, 9 aa, Homo Sapiens
IDEVIIPLP

SEQ ID NO: 1325727 - protein, 9 aa, Homo Sapiens
PDDRNQDST

SEQ ID NO: 1325728 - protein, 9 aa, Homo Sapiens
AKEERRTID

SEQ ID NO: 1325729 - protein, 9 aa, Homo Sapiens
CHMNKGETK

SEQ ID NO: 1325730 - protein, 9 aa, Homo Sapiens
GSAHTLTAV

SEQ ID NO: 1325731 - protein, 9 aa, Homo Sapiens
GWNKKSVVR

SEQ ID NO: 1325732 - protein, 9 aa, Homo Sapiens
VLWRADDIS

SEQ ID NO: 1325733 - protein, 9 aa, Homo Sapiens
GALKKPIHA

SEQ ID NO: 1325734 - protein, 9 aa, Homo Sapiens
ATTDCILFG

SEQ ID NO: 1325735 - protein, 9 aa, Homo Sapiens
LLALLCHLC

SEQ ID NO: 1325736 - protein, 9 aa, Homo Sapiens
SHITARAEE

SEQ ID NO: 1325737 - protein, 9 aa, Homo Sapiens
SYPLRQFHF

SEQ ID NO: 1325738 - protein, 9 aa, Homo Sapiens
CSLLSQDKE

SEQ ID NO: 1325739 - protein, 9 aa, Homo Sapiens
LQHGTEVNK

SEQ ID NO: 1325740 - protein, 9 aa, Homo Sapiens
SDPSLQSAA

SEQ ID NO: 1325741 - protein, 9 aa, Homo Sapiens
TPERIADNF

SEQ ID NO: 1325742 - protein, 9 aa, Homo Sapiens
TIDTGDADI

SEQ ID NO: 1325743 - protein, 9 aa, Homo Sapiens
LLRRMTLEI

SEQ ID NO: 1325744 - protein, 9 aa, Homo Sapiens
RYPDSMLGT

SEQ ID NO: 1325745 - protein, 9 aa, Homo Sapiens
EGPSLTQPE

SEQ ID NO: 1325746 - protein, 9 aa, Homo Sapiens
SRMQNRFGK

SEQ ID NO: 1325747 - protein, 9 aa, Homo Sapiens
LLETFAHTD

SEQ ID NO: 1325748 - protein, 9 aa, Homo Sapiens
TRMKSVGIL

SEQ ID NO: 1325749 - protein, 9 aa, Homo Sapiens
AGANGTLGF

SEQ ID NO: 1325750 - protein, 9 aa, Homo Sapiens
KKNKELTLE

SEQ ID NO: 1325751 - protein, 9 aa, Homo Sapiens
ALTGHLHTH

SEQ ID NO: 1325752 - protein, 9 aa, Homo Sapiens
GDNRKMVCS

SEQ ID NO: 1325753 - protein, 9 aa, Homo Sapiens
NHPSAVLMA

SEQ ID NO: 1325754 - protein, 9 aa, Homo Sapiens
QYEFENYMC

SEQ ID NO: 1325755 - protein, 9 aa, Homo Sapiens
SYSRSWSRG

SEQ ID NO: 1325756 - protein, 9 aa, Homo Sapiens
ADIKWTVLR

SEQ ID NO: 1325757 - protein, 9 aa, Homo Sapiens
QQSEELLAE

SEQ ID NO: 1325758 - protein, 9 aa, Homo Sapiens
AISWQGRTR

SEQ ID NO: 1325759 - protein, 9 aa, Homo Sapiens
VCSIALFFY

SEQ ID NO: 1325760 - protein, 9 aa, Homo Sapiens
EAVLRSSSI

SEQ ID NO: 1325761 - protein, 9 aa, Homo Sapiens
TSGVKKLYL

SEQ ID NO: 1325762 - protein, 9 aa, Homo Sapiens
VGSDGCFLR

SEQ ID NO: 1325763 - protein, 9 aa, Homo Sapiens
DEAEKPLII

SEQ ID NO: 1325764 - protein, 9 aa, Homo Sapiens
HHPLDERAL

SEQ ID NO: 1325765 - protein, 9 aa, Homo Sapiens
CVSFWKKPT

SEQ ID NO: 1325766 - protein, 9 aa, Homo Sapiens
FRKKDTLVP

SEQ ID NO: 1325767 - protein, 9 aa, Homo Sapiens
GKFLRVHGI

SEQ ID NO: 1325768 - protein, 9 aa, Homo Sapiens
QDTSETLPG

SEQ ID NO: 1325769 - protein, 9 aa, Homo Sapiens
MRSLKRTAL

SEQ ID NO: 1325770 - protein, 9 aa, Homo Sapiens
RCIPRGDCL

SEQ ID NO: 1325771 - protein, 9 aa, Homo Sapiens
PGYTAVDEV

SEQ ID NO: 1325772 - protein, 9 aa, Homo Sapiens
TSETILYAC

SEQ ID NO: 1325773 - protein, 9 aa, Homo Sapiens
FTIYSILSL

SEQ ID NO: 1325774 - protein, 9 aa, Homo Sapiens
VESFHSSLA

SEQ ID NO: 1325775 - protein, 9 aa, Homo Sapiens
ARTPLPSAY

SEQ ID NO: 1325776 - protein, 9 aa, Homo Sapiens
DVESAKMHL

SEQ ID NO: 1325777 - protein, 9 aa, Homo Sapiens
PKYKGVWKP

SEQ ID NO: 1325778 - protein, 9 aa, Homo Sapiens
YNKIFTIPL

SEQ ID NO: 1325779 - protein, 9 aa, Homo Sapiens
HDLKDQGGE

SEQ ID NO: 1325780 - protein, 9 aa, Homo Sapiens
TQGLPSSEL

SEQ ID NO: 1325781 - protein, 9 aa, Homo Sapiens
FTYRDVSYL

SEQ ID NO: 1325782 - protein, 9 aa, Homo Sapiens
WRQNDKPPY

SEQ ID NO: 1325783 - protein, 9 aa, Homo Sapiens
NVIVANTMS

SEQ ID NO: 1325784 - protein, 9 aa, Homo Sapiens
SEEDKKKKR

SEQ ID NO: 1325785 - protein, 9 aa, Homo Sapiens
LCTSFYMKR

SEQ ID NO: 1325786 - protein, 9 aa, Homo Sapiens
KVGALEGVP

SEQ ID NO: 1325787 - protein, 9 aa, Homo Sapiens
LKLTIVMLI

SEQ ID NO: 1325788 - protein, 9 aa, Homo Sapiens
LNLLDVIFM

SEQ ID NO: 1325789 - protein, 9 aa, Homo Sapiens
TQITMLQML

SEQ ID NO: 1325790 - protein, 9 aa, Homo Sapiens
LIFIFAYLI

SEQ ID NO: 1325791 - protein, 9 aa, Homo Sapiens
ILNDFHKCI

SEQ ID NO: 1325792 - protein, 9 aa, Homo Sapiens
EDWLLLCDG

SEQ ID NO: 1325793 - protein, 9 aa, Homo Sapiens
GTGSLQELA

SEQ ID NO: 1325794 - protein, 9 aa, Homo Sapiens
TAAPLPGFS

SEQ ID NO: 1325795 - protein, 9 aa, Homo Sapiens
LLKSVQRIT

SEQ ID NO: 1325796 - protein, 9 aa, Homo Sapiens
DVSAETLIQ

SEQ ID NO: 1325797 - protein, 9 aa, Homo Sapiens
VSIVATANA

SEQ ID NO: 1325798 - protein, 9 aa, Homo Sapiens
EAILVPLVQ

SEQ ID NO: 1325799 - protein, 9 aa, Homo Sapiens
SMSKNVRHI

SEQ ID NO: 1325800 - protein, 9 aa, Homo Sapiens
LKEVGYSMH

SEQ ID NO: 1325801 - protein, 9 aa, Homo Sapiens
PFLDIYFSE

SEQ ID NO: 1325802 - protein, 9 aa, Homo Sapiens
HTFMLAKEA

SEQ ID NO: 1325803 - protein, 9 aa, Homo Sapiens
GGALGTRKV

SEQ ID NO: 1325804 - protein, 9 aa, Homo Sapiens
KIRALLHLY

SEQ ID NO: 1325805 - protein, 9 aa, Homo Sapiens
VSSVRQENV

SEQ ID NO: 1325806 - protein, 9 aa, Homo Sapiens
GTYMSTAAA

SEQ ID NO: 1325807 - protein, 9 aa, Homo Sapiens
REKCRKARE

SEQ ID NO: 1325808 - protein, 9 aa, Homo Sapiens
PGHSAFTPE

SEQ ID NO: 1325809 - protein, 9 aa, Homo Sapiens
TQVTLIMAP

SEQ ID NO: 1325810 - protein, 9 aa, Homo Sapiens
DYICEYCDR

SEQ ID NO: 1325811 - protein, 9 aa, Homo Sapiens
LQNCSGLVD

SEQ ID NO: 1325812 - protein, 9 aa, Homo Sapiens
MVPSPEAGR

SEQ ID NO: 1325813 - protein, 9 aa, Homo Sapiens
CTLAALRDV

SEQ ID NO: 1325814 - protein, 9 aa, Homo Sapiens
ISSLKAVTR

SEQ ID NO: 1325815 - protein, 9 aa, Homo Sapiens
KLFPSIEEA

SEQ ID NO: 1325816 - protein, 9 aa, Homo Sapiens
DSSYLLHHQ

SEQ ID NO: 1325817 - protein, 9 aa, Homo Sapiens
KNDFWWLVD

SEQ ID NO: 1325818 - protein, 9 aa, Homo Sapiens
ELFRIELDK

SEQ ID NO: 1325819 - protein, 9 aa, Homo Sapiens
DWLTGIRLS

SEQ ID NO: 1325820 - protein, 9 aa, Homo Sapiens
SQRPDRQAY

SEQ ID NO: 1325821 - protein, 9 aa, Homo Sapiens
NVFENEEHL

SEQ ID NO: 1325822 - protein, 9 aa, Homo Sapiens
DILEEEEEP

SEQ ID NO: 1325823 - protein, 9 aa, Homo Sapiens
LILLKYAHM

SEQ ID NO: 1325824 - protein, 9 aa, Homo Sapiens
QDGSTIHIH

SEQ ID NO: 1325825 - protein, 9 aa, Homo Sapiens
KEVMGAVRR

SEQ ID NO: 1325826 - protein, 9 aa, Homo Sapiens
RLIGEHHDV

SEQ ID NO: 1325827 - protein, 9 aa, Homo Sapiens
SGSSSDSST

SEQ ID NO: 1325828 - protein, 9 aa, Homo Sapiens
TQIEDVTEK

SEQ ID NO: 1325829 - protein, 9 aa, Homo Sapiens
NGILDECLT

SEQ ID NO: 1325830 - protein, 9 aa, Homo Sapiens
TLLNCRGVI

SEQ ID NO: 1325831 - protein, 9 aa, Homo Sapiens
SLSGHYLEE

SEQ ID NO: 1325832 - protein, 9 aa, Homo Sapiens
VVDRVSHAS

SEQ ID NO: 1325833 - protein, 9 aa, Homo Sapiens
KDHAPQNSN

SEQ ID NO: 1325834 - protein, 9 aa, Homo Sapiens
RCKANPQDK

SEQ ID NO: 1325835 - protein, 9 aa, Homo Sapiens
DGLVFTTQL

SEQ ID NO: 1325836 - protein, 9 aa, Homo Sapiens
EIPFEFETR

SEQ ID NO: 1325837 - protein, 9 aa, Homo Sapiens
MHAIFTNKE

SEQ ID NO: 1325838 - protein, 9 aa, Homo Sapiens
NLYLWGPLK

SEQ ID NO: 1325839 - protein, 9 aa, Homo Sapiens
IPHVSESPV

SEQ ID NO: 1325840 - protein, 9 aa, Homo Sapiens
YQPHIIVST

SEQ ID NO: 1325841 - protein, 9 aa, Homo Sapiens
HEQLTRALP

SEQ ID NO: 1325842 - protein, 9 aa, Homo Sapiens
PAGPSALPS

SEQ ID NO: 1325843 - protein, 9 aa, Homo Sapiens
AISLSPMSF

SEQ ID NO: 1325844 - protein, 9 aa, Homo Sapiens
LQARLMGRI

SEQ ID NO: 1325845 - protein, 9 aa, Homo Sapiens
VTDFYGQIT

SEQ ID NO: 1325846 - protein, 9 aa, Homo Sapiens
EHSNIVDLL

SEQ ID NO: 1325847 - protein, 9 aa, Homo Sapiens
VYITEIAPQ

SEQ ID NO: 1325848 - protein, 9 aa, Homo Sapiens
MPHGSVQLS

SEQ ID NO: 1325849 - protein, 9 aa, Homo Sapiens
LNAIPKHLC

SEQ ID NO: 1325850 - protein, 9 aa, Homo Sapiens
MTLKDDRQH

SEQ ID NO: 1325851 - protein, 9 aa, Homo Sapiens
DSAQAANFQ

SEQ ID NO: 1325852 - protein, 9 aa, Homo Sapiens
LVIVCACWK

SEQ ID NO: 1325853 - protein, 9 aa, Homo Sapiens
TCSAHTTCL

SEQ ID NO: 1325854 - protein, 9 aa, Homo Sapiens
GAPCVPGPK

SEQ ID NO: 1325855 - protein, 9 aa, Homo Sapiens
CRVWCWPDL

SEQ ID NO: 1325856 - protein, 9 aa, Homo Sapiens
LNSLSGGIT

SEQ ID NO: 1325857 - protein, 9 aa, Homo Sapiens
PPGTTPPGR

SEQ ID NO: 1325858 - protein, 9 aa, Homo Sapiens
EDTVEVLAI

SEQ ID NO: 1325859 - protein, 9 aa, Homo Sapiens
PVSRCTPQH

SEQ ID NO: 1325860 - protein, 9 aa, Homo Sapiens
GMMDDYTYI

SEQ ID NO: 1325861 - protein, 9 aa, Homo Sapiens
HNGKKWNLF

SEQ ID NO: 1325862 - protein, 9 aa, Homo Sapiens
EQRKRRKFM

SEQ ID NO: 1325863 - protein, 9 aa, Homo Sapiens
SWCPVIKQE

SEQ ID NO: 1325864 - protein, 9 aa, Homo Sapiens
VPVGPFDAA

SEQ ID NO: 1325865 - protein, 9 aa, Homo Sapiens
LKEGDQHVD

SEQ ID NO: 1325866 - protein, 9 aa, Homo Sapiens
SASDTIKFV

SEQ ID NO: 1325867 - protein, 9 aa, Homo Sapiens
QQFHYHLCG

SEQ ID NO: 1325868 - protein, 9 aa, Homo Sapiens
FVTYEAVLR

SEQ ID NO: 1325869 - protein, 9 aa, Homo Sapiens
SDEGRTEQS

SEQ ID NO: 1325870 - protein, 9 aa, Homo Sapiens
FQIILNSLL

SEQ ID NO: 1325871 - protein, 9 aa, Homo Sapiens
LCLTALPDY

SEQ ID NO: 1325872 - protein, 9 aa, Homo Sapiens
ISSYVLRMG

SEQ ID NO: 1325873 - protein, 9 aa, Homo Sapiens
SGPRLGVLP

SEQ ID NO: 1325874 - protein, 9 aa, Homo Sapiens
GPKPLSPVS

SEQ ID NO: 1325875 - protein, 9 aa, Homo Sapiens
LNFFKTIAE

SEQ ID NO: 1325876 - protein, 9 aa, Homo Sapiens
IFNHIPPHT

SEQ ID NO: 1325877 - protein, 9 aa, Homo Sapiens
PAHVPPPPP

SEQ ID NO: 1325878 - protein, 9 aa, Homo Sapiens
QRKNFTMTR

SEQ ID NO: 1325879 - protein, 9 aa, Homo Sapiens
QDLTIDGLV

SEQ ID NO: 1325880 - protein, 9 aa, Homo Sapiens
ESHRKNHSI

SEQ ID NO: 1325881 - protein, 9 aa, Homo Sapiens
KGKLGVSEL

SEQ ID NO: 1325882 - protein, 9 aa, Homo Sapiens
GDHLITEPL

SEQ ID NO: 1325883 - protein, 9 aa, Homo Sapiens
RPYPAEAKS

SEQ ID NO: 1325884 - protein, 9 aa, Homo Sapiens
TAPGTDAGK

SEQ ID NO: 1325885 - protein, 9 aa, Homo Sapiens
LNIENTLWA

SEQ ID NO: 1325886 - protein, 9 aa, Homo Sapiens
SISVFQVIR

SEQ ID NO: 1325887 - protein, 9 aa, Homo Sapiens
VLWSGKAME

SEQ ID NO: 1325888 - protein, 9 aa, Homo Sapiens
ETVVKCDIL

SEQ ID NO: 1325889 - protein, 9 aa, Homo Sapiens
SLVEVCRKL

SEQ ID NO: 1325890 - protein, 9 aa, Homo Sapiens
AQRRKTLNF

SEQ ID NO: 1325891 - protein, 9 aa, Homo Sapiens
PAPRRSLGH

SEQ ID NO: 1325892 - protein, 9 aa, Homo Sapiens
WGWGQLLLL

SEQ ID NO: 1325893 - protein, 9 aa, Homo Sapiens
TIQYLVWLG

SEQ ID NO: 1325894 - protein, 9 aa, Homo Sapiens
DCLAEEGHK

SEQ ID NO: 1325895 - protein, 9 aa, Homo Sapiens
PPRSGRGSL

SEQ ID NO: 1325896 - protein, 9 aa, Homo Sapiens
YKSYQVPKE

SEQ ID NO: 1325897 - protein, 9 aa, Homo Sapiens
ASHYPTLWT

SEQ ID NO: 1325898 - protein, 9 aa, Homo Sapiens
RDHREGDVG

SEQ ID NO: 1325899 - protein, 9 aa, Homo Sapiens
QPSCPSQLG

SEQ ID NO: 1325900 - protein, 9 aa, Homo Sapiens
HVRSRGGHV

SEQ ID NO: 1325901 - protein, 9 aa, Homo Sapiens
EVWAPPSPH

SEQ ID NO: 1325902 - protein, 9 aa, Homo Sapiens
SCLEDTGHD

SEQ ID NO: 1325903 - protein, 9 aa, Homo Sapiens
FYVIDCHYP

SEQ ID NO: 1325904 - protein, 9 aa, Homo Sapiens
IILTTQQRR

SEQ ID NO: 1325905 - protein, 9 aa, Homo Sapiens
CAGSAGRAP

SEQ ID NO: 1325906 - protein, 9 aa, Homo Sapiens
VDIILNFHT

SEQ ID NO: 1325907 - protein, 9 aa, Homo Sapiens
ELQSQAQVL

SEQ ID NO: 1325908 - protein, 9 aa, Homo Sapiens
RTAISPKDV

SEQ ID NO: 1325909 - protein, 9 aa, Homo Sapiens
SLLTQMVEI

SEQ ID NO: 1325910 - protein, 9 aa, Homo Sapiens
ETTTELFLV

SEQ ID NO: 1325911 - protein, 9 aa, Homo Sapiens
QDLKDYMCQ

SEQ ID NO: 1325912 - protein, 9 aa, Homo Sapiens
FKHVGLTAV

SEQ ID NO: 1325913 - protein, 9 aa, Homo Sapiens
KRTLKQFEE

SEQ ID NO: 1325914 - protein, 9 aa, Homo Sapiens
KDVYKVGEQ

SEQ ID NO: 1325915 - protein, 9 aa, Homo Sapiens
ITEYMENED

SEQ ID NO: 1325916 - protein, 9 aa, Homo Sapiens
FFLANVSRA

SEQ ID NO: 1325917 - protein, 9 aa, Homo Sapiens
STLECLETI

SEQ ID NO: 1325918 - protein, 9 aa, Homo Sapiens
SGHRFLYIV

SEQ ID NO: 1325919 - protein, 9 aa, Homo Sapiens
GYTAVDEVR

SEQ ID NO: 1325920 - protein, 9 aa, Homo Sapiens
FREHFEELL

SEQ ID NO: 1325921 - protein, 9 aa, Homo Sapiens
LRTHICCLN

SEQ ID NO: 1325922 - protein, 9 aa, Homo Sapiens
NFIYEQSCE

SEQ ID NO: 1325923 - protein, 9 aa, Homo Sapiens
HFTSDMSSR

SEQ ID NO: 1325924 - protein, 9 aa, Homo Sapiens
APPMPLPVI

SEQ ID NO: 1325925 - protein, 9 aa, Homo Sapiens
PQLIILIKN

SEQ ID NO: 1325926 - protein, 9 aa, Homo Sapiens
LTFFNIPLM

SEQ ID NO: 1325927 - protein, 9 aa, Homo Sapiens
FMCQWCDKD

SEQ ID NO: 1325928 - protein, 9 aa, Homo Sapiens
HPLDERALQ

SEQ ID NO: 1325929 - protein, 9 aa, Homo Sapiens
VTYCVGDAA

SEQ ID NO: 1325930 - protein, 9 aa, Homo Sapiens
DNAHPLWKW

SEQ ID NO: 1325931 - protein, 9 aa, Homo Sapiens
WEWTKLDLP

SEQ ID NO: 1325932 - protein, 9 aa, Homo Sapiens
AGLQVDYIF

SEQ ID NO: 1325933 - protein, 9 aa, Homo Sapiens
LTQKKCWEN

SEQ ID NO: 1325934 - protein, 9 aa, Homo Sapiens
RVICGFDAL

SEQ ID NO: 1325935 - protein, 9 aa, Homo Sapiens
EMMSRGREK

SEQ ID NO: 1325936 - protein, 9 aa, Homo Sapiens
DRTPFSVGW

SEQ ID NO: 1325937 - protein, 9 aa, Homo Sapiens
TKDHAPQNS

SEQ ID NO: 1325938 - protein, 9 aa, Homo Sapiens
HHVVVSGDT

SEQ ID NO: 1325939 - protein, 9 aa, Homo Sapiens
KCGGTYQIG

SEQ ID NO: 1325940 - protein, 9 aa, Homo Sapiens
HYEELHARA

SEQ ID NO: 1325941 - protein, 9 aa, Homo Sapiens
VYTVLAVAS

SEQ ID NO: 1325942 - protein, 9 aa, Homo Sapiens
VFVRPYPAE

SEQ ID NO: 1325943 - protein, 9 aa, Homo Sapiens
LHTHTKELK

SEQ ID NO: 1325944 - protein, 9 aa, Homo Sapiens
LKPEQVSTL

SEQ ID NO: 1325945 - protein, 9 aa, Homo Sapiens
QYFRELFGI

SEQ ID NO: 1325946 - protein, 9 aa, Homo Sapiens
QEPGAVVPR

SEQ ID NO: 1325947 - protein, 9 aa, Homo Sapiens
CTVITEGPP

SEQ ID NO: 1325948 - protein, 9 aa, Homo Sapiens
VCREVGLEL

SEQ ID NO: 1325949 - protein, 9 aa, Homo Sapiens
GVSSITNPI

SEQ ID NO: 1325950 - protein, 9 aa, Homo Sapiens
RELLLCSNM

SEQ ID NO: 1325951 - protein, 9 aa, Homo Sapiens
DLQKNKLKE

SEQ ID NO: 1325952 - protein, 9 aa, Homo Sapiens
ATHLQKSPS

SEQ ID NO: 1325953 - protein, 9 aa, Homo Sapiens
SGFEPGTFD

SEQ ID NO: 1325954 - protein, 9 aa, Homo Sapiens
LWAMLIIIC

SEQ ID NO: 1325955 - protein, 9 aa, Homo Sapiens
LLVKKIMSL

SEQ ID NO: 1325956 - protein, 9 aa, Homo Sapiens
KCELCDFTY

SEQ ID NO: 1325957 - protein, 9 aa, Homo Sapiens
NECEQVSKP

SEQ ID NO: 1325958 - protein, 9 aa, Homo Sapiens
AVVLQRVER

SEQ ID NO: 1325959 - protein, 9 aa, Homo Sapiens
SLTRSMSLV

SEQ ID NO: 1325960 - protein, 9 aa, Homo Sapiens
PSSPTPRTC

SEQ ID NO: 1325961 - protein, 9 aa, Homo Sapiens
KMMFCVLLK

SEQ ID NO: 1325962 - protein, 9 aa, Homo Sapiens
LNWAQAVNS

SEQ ID NO: 1325963 - protein, 9 aa, Homo Sapiens
LIVVLALFW

SEQ ID NO: 1325964 - protein, 9 aa, Homo Sapiens
SKERRWSRS

SEQ ID NO: 1325965 - protein, 9 aa, Homo Sapiens
QRLRQVPVS

SEQ ID NO: 1325966 - protein, 9 aa, Homo Sapiens
CPRFLSGLL

SEQ ID NO: 1325967 - protein, 9 aa, Homo Sapiens
SLYPTQRAL

SEQ ID NO: 1325968 - protein, 9 aa, Homo Sapiens
ASTMARRGS

SEQ ID NO: 1325969 - protein, 9 aa, Homo Sapiens
PRSLSLQKI

SEQ ID NO: 1325970 - protein, 9 aa, Homo Sapiens
AHLQDQHMF

SEQ ID NO: 1325971 - protein, 9 aa, Homo Sapiens
PVNSKKSTS

SEQ ID NO: 1325972 - protein, 9 aa, Homo Sapiens
VIISKQVII

SEQ ID NO: 1325973 - protein, 9 aa, Homo Sapiens
IFWIICLAS

SEQ ID NO: 1325974 - protein, 9 aa, Homo Sapiens
IETTKDSLP

SEQ ID NO: 1325975 - protein, 9 aa, Homo Sapiens
DPSCTTFGS

SEQ ID NO: 1325976 - protein, 9 aa, Homo Sapiens
NLTSLCRLY

SEQ ID NO: 1325977 - protein, 9 aa, Homo Sapiens
KLRYGMLHF

SEQ ID NO: 1325978 - protein, 9 aa, Homo Sapiens
ASILKDQWK

SEQ ID NO: 1325979 - protein, 9 aa, Homo Sapiens
HQGCLLGLR

SEQ ID NO: 1325980 - protein, 9 aa, Homo Sapiens
IQTPCGRGP

SEQ ID NO: 1325981 - protein, 9 aa, Homo Sapiens
SPPSCRAFR

SEQ ID NO: 1325982 - protein, 9 aa, Homo Sapiens
LERGTRMKS

SEQ ID NO: 1325983 - protein, 9 aa, Homo Sapiens
TLQEEELTR

SEQ ID NO: 1325984 - protein, 9 aa, Homo Sapiens
QDGEKIISY

SEQ ID NO: 1325985 - protein, 9 aa, Homo Sapiens
EGPAEPPHP

SEQ ID NO: 1325986 - protein, 9 aa, Homo Sapiens
YHTATKIEA

SEQ ID NO: 1325987 - protein, 9 aa, Homo Sapiens
LVDKNEWKN

SEQ ID NO: 1325988 - protein, 9 aa, Homo Sapiens
VSIKSEDEQ

SEQ ID NO: 1325989 - protein, 9 aa, Homo Sapiens
SPTPRTCPT

SEQ ID NO: 1325990 - protein, 9 aa, Homo Sapiens
GTRVPSSLA

SEQ ID NO: 1325991 - protein, 9 aa, Homo Sapiens
QDTTLICPK

SEQ ID NO: 1325992 - protein, 9 aa, Homo Sapiens
LQSQAQVLS

SEQ ID NO: 1325993 - protein, 9 aa, Homo Sapiens
AEQLRLPLG

SEQ ID NO: 1325994 - protein, 9 aa, Homo Sapiens
KGNNKHIKR

SEQ ID NO: 1325995 - protein, 9 aa, Homo Sapiens
GTGPLKDMP

SEQ ID NO: 1325996 - protein, 9 aa, Homo Sapiens
PVPQTNAHK

SEQ ID NO: 1325997 - protein, 9 aa, Homo Sapiens
EEDTGCYSC

SEQ ID NO: 1325998 - protein, 9 aa, Homo Sapiens
DKQKVKNLG

SEQ ID NO: 1325999 - protein, 9 aa, Homo Sapiens
VWKLHRVLQ

SEQ ID NO: 1326000 - protein, 9 aa, Homo Sapiens
GITSLRSLN

SEQ ID NO: 1326001 - protein, 9 aa, Homo Sapiens
RAMAKELAI

SEQ ID NO: 1326002 - protein, 9 aa, Homo Sapiens
VTDLTFKVA

SEQ ID NO: 1326003 - protein, 9 aa, Homo Sapiens
NMFKLQSGT

SEQ ID NO: 1326004 - protein, 9 aa, Homo Sapiens
EGWGPKQPE

SEQ ID NO: 1326005 - protein, 9 aa, Homo Sapiens
DDLCCRSQF

SEQ ID NO: 1326006 - protein, 9 aa, Homo Sapiens
NKEELLTLW

SEQ ID NO: 1326007 - protein, 9 aa, Homo Sapiens
SLVHSVDFT

SEQ ID NO: 1326008 - protein, 9 aa, Homo Sapiens
YRIQYHKFT

SEQ ID NO: 1326009 - protein, 9 aa, Homo Sapiens
NPHTRNNIK

SEQ ID NO: 1326010 - protein, 9 aa, Homo Sapiens
RFKSGRPTT

SEQ ID NO: 1326011 - protein, 9 aa, Homo Sapiens
WFTHLKYVS

SEQ ID NO: 1326012 - protein, 9 aa, Homo Sapiens
QKCALFFRF

SEQ ID NO: 1326013 - protein, 9 aa, Homo Sapiens
AKEGEDEDE

SEQ ID NO: 1326014 - protein, 9 aa, Homo Sapiens
LSPLIYSLR

SEQ ID NO: 1326015 - protein, 9 aa, Homo Sapiens
PGWPGAPCV

SEQ ID NO: 1326016 - protein, 9 aa, Homo Sapiens
EPHLFLGLE

SEQ ID NO: 1326017 - protein, 9 aa, Homo Sapiens
PVPQLPLAV

SEQ ID NO: 1326018 - protein, 9 aa, Homo Sapiens
ANFAKLFLR

SEQ ID NO: 1326019 - protein, 9 aa, Homo Sapiens
GSKPREHPG

SEQ ID NO: 1326020 - protein, 9 aa, Homo Sapiens
TGLLQRYRL

SEQ ID NO: 1326021 - protein, 9 aa, Homo Sapiens
CGGILTKCK

SEQ ID NO: 1326022 - protein, 9 aa, Homo Sapiens
HVKDSKPSS

SEQ ID NO: 1326023 - protein, 9 aa, Homo Sapiens
MHGYIFGNS

SEQ ID NO: 1326024 - protein, 9 aa, Homo Sapiens
GPDDKNEEH

SEQ ID NO: 1326025 - protein, 9 aa, Homo Sapiens
MSVKLALVI

SEQ ID NO: 1326026 - protein, 9 aa, Homo Sapiens
ALALDVAVQ

SEQ ID NO: 1326027 - protein, 9 aa, Homo Sapiens
MLKEHMRVY

SEQ ID NO: 1326028 - protein, 9 aa, Homo Sapiens
EMKCMFNQL

SEQ ID NO: 1326029 - protein, 9 aa, Homo Sapiens
KTKALQTAI

SEQ ID NO: 1326030 - protein, 9 aa, Homo Sapiens
YKVTGWGAT

SEQ ID NO: 1326031 - protein, 9 aa, Homo Sapiens
LDLKGVHLG

SEQ ID NO: 1326032 - protein, 9 aa, Homo Sapiens
RVMNQQHMM

SEQ ID NO: 1326033 - protein, 9 aa, Homo Sapiens
TSPKETSMQ

SEQ ID NO: 1326034 - protein, 9 aa, Homo Sapiens
HMKFWCKAG

SEQ ID NO: 1326035 - protein, 9 aa, Homo Sapiens
VRHICYFLD

SEQ ID NO: 1326036 - protein, 9 aa, Homo Sapiens
EVQQVWLDP

SEQ ID NO: 1326037 - protein, 9 aa, Homo Sapiens
GGELVIVRI

SEQ ID NO: 1326038 - protein, 9 aa, Homo Sapiens
VECSKFGQV

SEQ ID NO: 1326039 - protein, 9 aa, Homo Sapiens
HWHLWKHYS

SEQ ID NO: 1326040 - protein, 9 aa, Homo Sapiens
MKHRILPKE

SEQ ID NO: 1326041 - protein, 9 aa, Homo Sapiens
GIRHGSRCY

SEQ ID NO: 1326042 - protein, 9 aa, Homo Sapiens
EKYACQAIN

SEQ ID NO: 1326043 - protein, 9 aa, Homo Sapiens
KPPLEDYYE

SEQ ID NO: 1326044 - protein, 9 aa, Homo Sapiens
TWTDSHLRF

SEQ ID NO: 1326045 - protein, 9 aa, Homo Sapiens
SGHSGSSLV

SEQ ID NO: 1326046 - protein, 9 aa, Homo Sapiens
LEEADAFIT

SEQ ID NO: 1326047 - protein, 9 aa, Homo Sapiens
RASQMILMF

SEQ ID NO: 1326048 - protein, 9 aa, Homo Sapiens
EAQNITGGS

SEQ ID NO: 1326049 - protein, 9 aa, Homo Sapiens
YTKSSHLKT

SEQ ID NO: 1326050 - protein, 9 aa, Homo Sapiens
LMAAINVAG

SEQ ID NO: 1326051 - protein, 9 aa, Homo Sapiens
GFSTPATSL

SEQ ID NO: 1326052 - protein, 9 aa, Homo Sapiens
GARLGLLVP

SEQ ID NO: 1326053 - protein, 9 aa, Homo Sapiens
QEIMHFSFF

SEQ ID NO: 1326054 - protein, 9 aa, Homo Sapiens
THVKRKNVT

SEQ ID NO: 1326055 - protein, 9 aa, Homo Sapiens
QLVKQGSKG

SEQ ID NO: 1326056 - protein, 9 aa, Homo Sapiens
AVGFEAHYV

SEQ ID NO: 1326057 - protein, 9 aa, Homo Sapiens
LTLAIQRFN

SEQ ID NO: 1326058 - protein, 9 aa, Homo Sapiens
LDSALKPGE

SEQ ID NO: 1326059 - protein, 9 aa, Homo Sapiens
SGYLRETVG

SEQ ID NO: 1326060 - protein, 9 aa, Homo Sapiens
WRWIWIDTS

SEQ ID NO: 1326061 - protein, 9 aa, Homo Sapiens
LDYEGDTVT

SEQ ID NO: 1326062 - protein, 9 aa, Homo Sapiens
IFHSLDRNQ

SEQ ID NO: 1326063 - protein, 9 aa, Homo Sapiens
DVMVASRLT

SEQ ID NO: 1326064 - protein, 9 aa, Homo Sapiens
KAIEKPRIG

SEQ ID NO: 1326065 - protein, 9 aa, Homo Sapiens
DYMMPEQRR

SEQ ID NO: 1326066 - protein, 9 aa, Homo Sapiens
RFPTLTVSR

SEQ ID NO: 1326067 - protein, 9 aa, Homo Sapiens
HKDGDDFKE

SEQ ID NO: 1326068 - protein, 9 aa, Homo Sapiens
QDPGTKGPG

SEQ ID NO: 1326069 - protein, 9 aa, Homo Sapiens
PFTCSVEDP

SEQ ID NO: 1326070 - protein, 9 aa, Homo Sapiens
TEQVYNADE

SEQ ID NO: 1326071 - protein, 9 aa, Homo Sapiens
ELVKHADVA

SEQ ID NO: 1326072 - protein, 9 aa, Homo Sapiens
TCHNFIYEQ

SEQ ID NO: 1326073 - protein, 9 aa, Homo Sapiens
HFETRKSQI

SEQ ID NO: 1326074 - protein, 9 aa, Homo Sapiens
ILMAAINVA

SEQ ID NO: 1326075 - protein, 9 aa, Homo Sapiens
ISPHCVPSK

SEQ ID NO: 1326076 - protein, 9 aa, Homo Sapiens
PDYGESSSL

SEQ ID NO: 1326077 - protein, 9 aa, Homo Sapiens
PHSHHIQNV

SEQ ID NO: 1326078 - protein, 9 aa, Homo Sapiens
LSPTEEEAL

SEQ ID NO: 1326079 - protein, 9 aa, Homo Sapiens
GHTIISVVH

SEQ ID NO: 1326080 - protein, 9 aa, Homo Sapiens
QDEFLLKSI

SEQ ID NO: 1326081 - protein, 9 aa, Homo Sapiens
IEQLSVKKA

SEQ ID NO: 1326082 - protein, 9 aa, Homo Sapiens
HTESLLGLW

SEQ ID NO: 1326083 - protein, 9 aa, Homo Sapiens
PEGTHNDNG

SEQ ID NO: 1326084 - protein, 9 aa, Homo Sapiens
RATSTGKSK

SEQ ID NO: 1326085 - protein, 9 aa, Homo Sapiens
WAEFYHQPW

SEQ ID NO: 1326086 - protein, 9 aa, Homo Sapiens
GTYLALEDE

SEQ ID NO: 1326087 - protein, 9 aa, Homo Sapiens
ELVLMMISK

SEQ ID NO: 1326088 - protein, 9 aa, Homo Sapiens
VSSHSDIEE

SEQ ID NO: 1326089 - protein, 9 aa, Homo Sapiens
PYGDPHMID

SEQ ID NO: 1326090 - protein, 9 aa, Homo Sapiens
DNTPVFTLP

SEQ ID NO: 1326091 - protein, 9 aa, Homo Sapiens
NDYGFYLRA

SEQ ID NO: 1326092 - protein, 9 aa, Homo Sapiens
LPREYQNRF

SEQ ID NO: 1326093 - protein, 9 aa, Homo Sapiens
KGATYTPRH

SEQ ID NO: 1326094 - protein, 9 aa, Homo Sapiens
KFIILFVEK

SEQ ID NO: 1326095 - protein, 9 aa, Homo Sapiens
RGDGRPWMM

SEQ ID NO: 1326096 - protein, 9 aa, Homo Sapiens
GHLGVFCFS

SEQ ID NO: 1326097 - protein, 9 aa, Homo Sapiens
ALGMSRCED

SEQ ID NO: 1326098 - protein, 9 aa, Homo Sapiens
VLSGIPLDQ

SEQ ID NO: 1326099 - protein, 9 aa, Homo Sapiens
FSCYDFFLL

SEQ ID NO: 1326100 - protein, 9 aa, Homo Sapiens
AFELCFKQY

SEQ ID NO: 1326101 - protein, 9 aa, Homo Sapiens
TTGTPKCMV

SEQ ID NO: 1326102 - protein, 9 aa, Homo Sapiens
NRDRCRVTQ

SEQ ID NO: 1326103 - protein, 9 aa, Homo Sapiens
SGFSPRKKS

SEQ ID NO: 1326104 - protein, 9 aa, Homo Sapiens
AINVAGLIF

SEQ ID NO: 1326105 - protein, 9 aa, Homo Sapiens
FTPQCLKKN

SEQ ID NO: 1326106 - protein, 9 aa, Homo Sapiens
PSRLMWLLW

SEQ ID NO: 1326107 - protein, 9 aa, Homo Sapiens
IGDHQQLCP

SEQ ID NO: 1326108 - protein, 9 aa, Homo Sapiens
LLQEDPWCV

SEQ ID NO: 1326109 - protein, 9 aa, Homo Sapiens
EARRRTHEF

SEQ ID NO: 1326110 - protein, 9 aa, Homo Sapiens
SILLGNDTL

SEQ ID NO: 1326111 - protein, 9 aa, Homo Sapiens
TAADLDWPN

SEQ ID NO: 1326112 - protein, 9 aa, Homo Sapiens
LAAQQQATG

SEQ ID NO: 1326113 - protein, 9 aa, Homo Sapiens
SEVGLPAEV

SEQ ID NO: 1326114 - protein, 9 aa, Homo Sapiens
EVQEAKKGL

SEQ ID NO: 1326115 - protein, 9 aa, Homo Sapiens
VKRKWTRPT

SEQ ID NO: 1326116 - protein, 9 aa, Homo Sapiens
DNVSCRLEK

SEQ ID NO: 1326117 - protein, 9 aa, Homo Sapiens
SLSLQKIMM

SEQ ID NO: 1326118 - protein, 9 aa, Homo Sapiens
SCGWAPFSV

SEQ ID NO: 1326119 - protein, 9 aa, Homo Sapiens
EIEHLTREV

SEQ ID NO: 1326120 - protein, 9 aa, Homo Sapiens
DAFTLFACE

SEQ ID NO: 1326121 - protein, 9 aa, Homo Sapiens
KGLPVRQDM

SEQ ID NO: 1326122 - protein, 9 aa, Homo Sapiens
LTDRLGRRQ

SEQ ID NO: 1326123 - protein, 9 aa, Homo Sapiens
TFPDPNIKY

SEQ ID NO: 1326124 - protein, 9 aa, Homo Sapiens
GKAFGRYTT

SEQ ID NO: 1326125 - protein, 9 aa, Homo Sapiens
VLVPFREHF

SEQ ID NO: 1326126 - protein, 9 aa, Homo Sapiens
GWQVFKNDA

SEQ ID NO: 1326127 - protein, 9 aa, Homo Sapiens
GQDIILYWE

SEQ ID NO: 1326128 - protein, 9 aa, Homo Sapiens
LVDGVLALC

SEQ ID NO: 1326129 - protein, 9 aa, Homo Sapiens
KFWLRSKKR

SEQ ID NO: 1326130 - protein, 9 aa, Homo Sapiens
LTPQQTQAL

SEQ ID NO: 1326131 - protein, 9 aa, Homo Sapiens
NSLADRSCN

SEQ ID NO: 1326132 - protein, 9 aa, Homo Sapiens
CYNTEGGVC

SEQ ID NO: 1326133 - protein, 9 aa, Homo Sapiens
TPTHLHPCR

SEQ ID NO: 1326134 - protein, 9 aa, Homo Sapiens
TSLHTSSST

SEQ ID NO: 1326135 - protein, 9 aa, Homo Sapiens
IHHFSIHTG

SEQ ID NO: 1326136 - protein, 9 aa, Homo Sapiens
RVIAQPVGS

SEQ ID NO: 1326137 - protein, 9 aa, Homo Sapiens
VQAKVMRPL

SEQ ID NO: 1326138 - protein, 9 aa, Homo Sapiens
NGEANDGEG

SEQ ID NO: 1326139 - protein, 9 aa, Homo Sapiens
NVLSYYKSE

SEQ ID NO: 1326140 - protein, 9 aa, Homo Sapiens
LDEDEEEEE

SEQ ID NO: 1326141 - protein, 9 aa, Homo Sapiens
NQIRKHIVL

SEQ ID NO: 1326142 - protein, 9 aa, Homo Sapiens
PHTALLAAM

SEQ ID NO: 1326143 - protein, 9 aa, Homo Sapiens
TLMDISDMV

SEQ ID NO: 1326144 - protein, 9 aa, Homo Sapiens
REYQNRFLH

SEQ ID NO: 1326145 - protein, 9 aa, Homo Sapiens
EDGNHFINV

SEQ ID NO: 1326146 - protein, 9 aa, Homo Sapiens
NHLTQIMLL

SEQ ID NO: 1326147 - protein, 9 aa, Homo Sapiens
QRLKKVVPY

SEQ ID NO: 1326148 - protein, 9 aa, Homo Sapiens
HDNYEELYS

SEQ ID NO: 1326149 - protein, 9 aa, Homo Sapiens
VASNPRESH

SEQ ID NO: 1326150 - protein, 9 aa, Homo Sapiens
NAQLSRHTQ

SEQ ID NO: 1326151 - protein, 9 aa, Homo Sapiens
PKDDTAIVG

SEQ ID NO: 1326152 - protein, 9 aa, Homo Sapiens
TPPGTVTTL

SEQ ID NO: 1326153 - protein, 9 aa, Homo Sapiens
KWTRPTKSS

SEQ ID NO: 1326154 - protein, 9 aa, Homo Sapiens
LCLLKLVTE

SEQ ID NO: 1326155 - protein, 9 aa, Homo Sapiens
KKKKEAYSA

SEQ ID NO: 1326156 - protein, 9 aa, Homo Sapiens
RHKCVHNFT

SEQ ID NO: 1326157 - protein, 9 aa, Homo Sapiens
QLYMYGVSK

SEQ ID NO: 1326158 - protein, 9 aa, Homo Sapiens
KNKPPQHLT

SEQ ID NO: 1326159 - protein, 9 aa, Homo Sapiens
LLFVAVRLY

SEQ ID NO: 1326160 - protein, 9 aa, Homo Sapiens
QGQHWIWFN

SEQ ID NO: 1326161 - protein, 9 aa, Homo Sapiens
AHMVVGDVL

SEQ ID NO: 1326162 - protein, 9 aa, Homo Sapiens
LHSGMKMYG

SEQ ID NO: 1326163 - protein, 9 aa, Homo Sapiens
NTHHKSSEE

SEQ ID NO: 1326164 - protein, 9 aa, Homo Sapiens
REGKPKSFW

SEQ ID NO: 1326165 - protein, 9 aa, Homo Sapiens
IWNRIFNFT

SEQ ID NO: 1326166 - protein, 9 aa, Homo Sapiens
ELQEEVSWL

SEQ ID NO: 1326167 - protein, 9 aa, Homo Sapiens
HVIGNQINT

SEQ ID NO: 1326168 - protein, 9 aa, Homo Sapiens
VNASSKTFI

SEQ ID NO: 1326169 - protein, 9 aa, Homo Sapiens
TLTAAMCYE

SEQ ID NO: 1326170 - protein, 9 aa, Homo Sapiens
NATSTVVSL

SEQ ID NO: 1326171 - protein, 9 aa, Homo Sapiens
LHIVASAGR

SEQ ID NO: 1326172 - protein, 9 aa, Homo Sapiens
NFFMMLPTS

SEQ ID NO: 1326173 - protein, 9 aa, Homo Sapiens
FSCSDELSR

SEQ ID NO: 1326174 - protein, 9 aa, Homo Sapiens
TTVPQKPHQ

SEQ ID NO: 1326175 - protein, 9 aa, Homo Sapiens
NNPPYILDL

SEQ ID NO: 1326176 - protein, 9 aa, Homo Sapiens
LEVAQNVLL

SEQ ID NO: 1326177 - protein, 9 aa, Homo Sapiens
EWEEDPTSI

SEQ ID NO: 1326178 - protein, 9 aa, Homo Sapiens
LLVNMGGNR

SEQ ID NO: 1326179 - protein, 9 aa, Homo Sapiens
GCPPWLHHP

SEQ ID NO: 1326180 - protein, 9 aa, Homo Sapiens
ITPRQSTVD

SEQ ID NO: 1326181 - protein, 9 aa, Homo Sapiens
NKRTVCMPH

SEQ ID NO: 1326182 - protein, 9 aa, Homo Sapiens
VIPPNNQSP

SEQ ID NO: 1326183 - protein, 9 aa, Homo Sapiens
VAGRSQDDT

SEQ ID NO: 1326184 - protein, 9 aa, Homo Sapiens
RCIMVDKEE

SEQ ID NO: 1326185 - protein, 9 aa, Homo Sapiens
TMCHNLITF

SEQ ID NO: 1326186 - protein, 9 aa, Homo Sapiens
QVSQFLHTY

SEQ ID NO: 1326187 - protein, 9 aa, Homo Sapiens
GRQCEWCSI

SEQ ID NO: 1326188 - protein, 9 aa, Homo Sapiens
REQKEKIWE

SEQ ID NO: 1326189 - protein, 9 aa, Homo Sapiens
GKIFEKIYL

SEQ ID NO: 1326190 - protein, 9 aa, Homo Sapiens
TNGMEFLAS

SEQ ID NO: 1326191 - protein, 9 aa, Homo Sapiens
EGDPCWTHA

SEQ ID NO: 1326192 - protein, 9 aa, Homo Sapiens
WHWGVFSGR

SEQ ID NO: 1326193 - protein, 9 aa, Homo Sapiens
EADHSRMKH

SEQ ID NO: 1326194 - protein, 9 aa, Homo Sapiens
RDRHHQKTH

SEQ ID NO: 1326195 - protein, 9 aa, Homo Sapiens
LQFWEGPVV

SEQ ID NO: 1326196 - protein, 9 aa, Homo Sapiens
TSFLTANGA

SEQ ID NO: 1326197 - protein, 9 aa, Homo Sapiens
QVMYRSNRM

SEQ ID NO: 1326198 - protein, 9 aa, Homo Sapiens
TQVSRRFGS

SEQ ID NO: 1326199 - protein, 9 aa, Homo Sapiens
STILPSEPA

SEQ ID NO: 1326200 - protein, 9 aa, Homo Sapiens
IEDYMREWC

SEQ ID NO: 1326201 - protein, 9 aa, Homo Sapiens
TSTNKSESN

SEQ ID NO: 1326202 - protein, 9 aa, Homo Sapiens
TMNLEAVNT

SEQ ID NO: 1326203 - protein, 9 aa, Homo Sapiens
YGWDGGKVA

SEQ ID NO: 1326204 - protein, 9 aa, Homo Sapiens
IIAITFIVR

SEQ ID NO: 1326205 - protein, 9 aa, Homo Sapiens
MEGTYIASE

SEQ ID NO: 1326206 - protein, 9 aa, Homo Sapiens
NKDLEVETL

SEQ ID NO: 1326207 - protein, 9 aa, Homo Sapiens
DIVDVINEN

SEQ ID NO: 1326208 - protein, 9 aa, Homo Sapiens
YLQNPQPMM

SEQ ID NO: 1326209 - protein, 9 aa, Homo Sapiens
LHCALCPLD

SEQ ID NO: 1326210 - protein, 9 aa, Homo Sapiens
HVMDRHHGT

SEQ ID NO: 1326211 - protein, 9 aa, Homo Sapiens
GHEPHIKAV

SEQ ID NO: 1326212 - protein, 9 aa, Homo Sapiens
KGTTMKGLQ

SEQ ID NO: 1326213 - protein, 9 aa, Homo Sapiens
ADLEGVNMR

SEQ ID NO: 1326214 - protein, 9 aa, Homo Sapiens
VKQSGEILD

SEQ ID NO: 1326215 - protein, 9 aa, Homo Sapiens
AYLSNTDLN

SEQ ID NO: 1326216 - protein, 9 aa, Homo Sapiens
SQLCALETQ

SEQ ID NO: 1326217 - protein, 9 aa, Homo Sapiens
QAHTVTPSG

SEQ ID NO: 1326218 - protein, 9 aa, Homo Sapiens
CSEESPRRD

SEQ ID NO: 1326219 - protein, 9 aa, Homo Sapiens
GVSTWRSAY

SEQ ID NO: 1326220 - protein, 9 aa, Homo Sapiens
QATINLYVD

SEQ ID NO: 1326221 - protein, 9 aa, Homo Sapiens
DSKEANTNG

SEQ ID NO: 1326222 - protein, 9 aa, Homo Sapiens
RGCSSYLMK

SEQ ID NO: 1326223 - protein, 9 aa, Homo Sapiens
CLPLEGNTM

SEQ ID NO: 1326224 - protein, 9 aa, Homo Sapiens
RVLAHLTPL

SEQ ID NO: 1326225 - protein, 9 aa, Homo Sapiens
ALGVGTALL

SEQ ID NO: 1326226 - protein, 9 aa, Homo Sapiens
SAFTPEFQQ

SEQ ID NO: 1326227 - protein, 9 aa, Homo Sapiens
VLCMDMGFT

SEQ ID NO: 1326228 - protein, 9 aa, Homo Sapiens
TMLQGQQQA

SEQ ID NO: 1326229 - protein, 9 aa, Homo Sapiens
KGTSSPDYQ

SEQ ID NO: 1326230 - protein, 9 aa, Homo Sapiens
TVVNCSSDF

SEQ ID NO: 1326231 - protein, 9 aa, Homo Sapiens
EKDIDWGKH

SEQ ID NO: 1326232 - protein, 9 aa, Homo Sapiens
LANVSRARS

SEQ ID NO: 1326233 - protein, 9 aa, Homo Sapiens
FSYLNSFQT

SEQ ID NO: 1326234 - protein, 9 aa, Homo Sapiens
RTKMKHMRE

SEQ ID NO: 1326235 - protein, 9 aa, Homo Sapiens
RFVVPFGGF

SEQ ID NO: 1326236 - protein, 9 aa, Homo Sapiens
VWELFPNQQ

SEQ ID NO: 1326237 - protein, 9 aa, Homo Sapiens
QDVIGAVNS

SEQ ID NO: 1326238 - protein, 9 aa, Homo Sapiens
CLGYTDHIL

SEQ ID NO: 1326239 - protein, 9 aa, Homo Sapiens
WLRLRLEDS

SEQ ID NO: 1326240 - protein, 9 aa, Homo Sapiens
GNSSDAGAA

SEQ ID NO: 1326241 - protein, 9 aa, Homo Sapiens
LCESEQARV

SEQ ID NO: 1326242 - protein, 9 aa, Homo Sapiens
SAWLSDSYM

SEQ ID NO: 1326243 - protein, 9 aa, Homo Sapiens
ELEDCRQLA

SEQ ID NO: 1326244 - protein, 9 aa, Homo Sapiens
MTHLLVQGP

SEQ ID NO: 1326245 - protein, 9 aa, Homo Sapiens
RNVVYVIAF

SEQ ID NO: 1326246 - protein, 9 aa, Homo Sapiens
STLFGNIEN

SEQ ID NO: 1326247 - protein, 9 aa, Homo Sapiens
ATSGVKKLY

SEQ ID NO: 1326248 - protein, 9 aa, Homo Sapiens
WSHFVFVLS

SEQ ID NO: 1326249 - protein, 9 aa, Homo Sapiens
NTHYQLYTG

SEQ ID NO: 1326250 - protein, 9 aa, Homo Sapiens
LWGGLTDRL

SEQ ID NO: 1326251 - protein, 9 aa, Homo Sapiens
DTEDAGAPL

SEQ ID NO: 1326252 - protein, 9 aa, Homo Sapiens
LGEKTQVLI

SEQ ID NO: 1326253 - protein, 9 aa, Homo Sapiens
DVISVETPQ

SEQ ID NO: 1326254 - protein, 9 aa, Homo Sapiens
ECAHNATCT

SEQ ID NO: 1326255 - protein, 9 aa, Homo Sapiens
VIIDGVESV

SEQ ID NO: 1326256 - protein, 9 aa, Homo Sapiens
LMIYEEISD

SEQ ID NO: 1326257 - protein, 9 aa, Homo Sapiens
NAIMKKQFS

SEQ ID NO: 1326258 - protein, 9 aa, Homo Sapiens
YGQILLAVY

SEQ ID NO: 1326259 - protein, 9 aa, Homo Sapiens
GSCESLPSS

SEQ ID NO: 1326260 - protein, 9 aa, Homo Sapiens
RTLKQFEER

SEQ ID NO: 1326261 - protein, 9 aa, Homo Sapiens
GPLPPTNFL

SEQ ID NO: 1326262 - protein, 9 aa, Homo Sapiens
AEKFISLIR

SEQ ID NO: 1326263 - protein, 9 aa, Homo Sapiens
PRRSLGHQG

SEQ ID NO: 1326264 - protein, 9 aa, Homo Sapiens
HHKSSEEDE

SEQ ID NO: 1326265 - protein, 9 aa, Homo Sapiens
SKHIPEARY

SEQ ID NO: 1326266 - protein, 9 aa, Homo Sapiens
LGTKLLDSQ

SEQ ID NO: 1326267 - protein, 9 aa, Homo Sapiens
VASEKQRWL

SEQ ID NO: 1326268 - protein, 9 aa, Homo Sapiens
VRHSSSVRN

SEQ ID NO: 1326269 - protein, 9 aa, Homo Sapiens
TATLKLQDQ

SEQ ID NO: 1326270 - protein, 9 aa, Homo Sapiens
WMKTEGDAP

SEQ ID NO: 1326271 - protein, 9 aa, Homo Sapiens
THVLPGSAA

SEQ ID NO: 1326272 - protein, 9 aa, Homo Sapiens
SDAGGRQFA

SEQ ID NO: 1326273 - protein, 9 aa, Homo Sapiens
ARYEETMFH

SEQ ID NO: 1326274 - protein, 9 aa, Homo Sapiens
SPTSAAPAA

SEQ ID NO: 1326275 - protein, 9 aa, Homo Sapiens
RAGEWGTIG

SEQ ID NO: 1326276 - protein, 9 aa, Homo Sapiens
VLSLPECVE

SEQ ID NO: 1326277 - protein, 9 aa, Homo Sapiens
DPQPSLLCS

SEQ ID NO: 1326278 - protein, 9 aa, Homo Sapiens
CLRRLWKKS

SEQ ID NO: 1326279 - protein, 9 aa, Homo Sapiens
LWINKPWVY

SEQ ID NO: 1326280 - protein, 9 aa, Homo Sapiens
YAHVQKRKG

SEQ ID NO: 1326281 - protein, 9 aa, Homo Sapiens
RVGISPAAT

SEQ ID NO: 1326282 - protein, 9 aa, Homo Sapiens
QKCPFAYHK

SEQ ID NO: 1326283 - protein, 9 aa, Homo Sapiens
VLYQACEAA

SEQ ID NO: 1326284 - protein, 9 aa, Homo Sapiens
DMMKEKDEF

SEQ ID NO: 1326285 - protein, 9 aa, Homo Sapiens
QEIYKAETL

SEQ ID NO: 1326286 - protein, 9 aa, Homo Sapiens
VLGEFERLH

SEQ ID NO: 1326287 - protein, 9 aa, Homo Sapiens
QNLHQLGSK

SEQ ID NO: 1326288 - protein, 9 aa, Homo Sapiens
TALYYTHMD

SEQ ID NO: 1326289 - protein, 9 aa, Homo Sapiens
VTKIIYGDP

SEQ ID NO: 1326290 - protein, 9 aa, Homo Sapiens
NSQITAEDS

SEQ ID NO: 1326291 - protein, 9 aa, Homo Sapiens
TVIQRGSLG

SEQ ID NO: 1326292 - protein, 9 aa, Homo Sapiens
HTKGIWMWY

SEQ ID NO: 1326293 - protein, 9 aa, Homo Sapiens
LVEDRMSLS

SEQ ID NO: 1326294 - protein, 9 aa, Homo Sapiens
TLGPSVAAA

SEQ ID NO: 1326295 - protein, 9 aa, Homo Sapiens
CGAIRLPSF

SEQ ID NO: 1326296 - protein, 9 aa, Homo Sapiens
KKVSLGEGC

SEQ ID NO: 1326297 - protein, 9 aa, Homo Sapiens
MPRPGIKKA

SEQ ID NO: 1326298 - protein, 9 aa, Homo Sapiens
DFSIIITEV

SEQ ID NO: 1326299 - protein, 9 aa, Homo Sapiens
QKYSVLSTL

SEQ ID NO: 1326300 - protein, 9 aa, Homo Sapiens
YLLGLENTH

SEQ ID NO: 1326301 - protein, 9 aa, Homo Sapiens
GTVLVGSQK

SEQ ID NO: 1326302 - protein, 9 aa, Homo Sapiens
GACALILSP

SEQ ID NO: 1326303 - protein, 9 aa, Homo Sapiens
TWVMTCAYA

SEQ ID NO: 1326304 - protein, 9 aa, Homo Sapiens
PPAQQNQYI

SEQ ID NO: 1326305 - protein, 9 aa, Homo Sapiens
AAGVLCHQL

SEQ ID NO: 1326306 - protein, 9 aa, Homo Sapiens
APMTKIKKI

SEQ ID NO: 1326307 - protein, 9 aa, Homo Sapiens
HLNLDEMTK

SEQ ID NO: 1326308 - protein, 9 aa, Homo Sapiens
ITLVFFLYR

SEQ ID NO: 1326309 - protein, 9 aa, Homo Sapiens
VPPSVPHCQ

SEQ ID NO: 1326310 - protein, 9 aa, Homo Sapiens
GVSLGSIVV

SEQ ID NO: 1326311 - protein, 9 aa, Homo Sapiens
LFFVPFPYL

SEQ ID NO: 1326312 - protein, 9 aa, Homo Sapiens
KQRWLLYNL

SEQ ID NO: 1326313 - protein, 9 aa, Homo Sapiens
IFQVAPLSG

SEQ ID NO: 1326314 - protein, 9 aa, Homo Sapiens
EEGQCKAWA

SEQ ID NO: 1326315 - protein, 9 aa, Homo Sapiens
TTCVDAGRI

SEQ ID NO: 1326316 - protein, 9 aa, Homo Sapiens
KYVGSNIVQ

SEQ ID NO: 1326317 - protein, 9 aa, Homo Sapiens
QPGTGGAHI

SEQ ID NO: 1326318 - protein, 9 aa, Homo Sapiens
AQKCALFFR

SEQ ID NO: 1326319 - protein, 9 aa, Homo Sapiens
PALMFSPTH

SEQ ID NO: 1326320 - protein, 9 aa, Homo Sapiens
FIKGSSNQE

SEQ ID NO: 1326321 - protein, 9 aa, Homo Sapiens
YRSFYGGLD

SEQ ID NO: 1326322 - protein, 9 aa, Homo Sapiens
DTMHFRDNT

SEQ ID NO: 1326323 - protein, 9 aa, Homo Sapiens
MGRICISRR

SEQ ID NO: 1326324 - protein, 9 aa, Homo Sapiens
HVPWLLAHK

SEQ ID NO: 1326325 - protein, 9 aa, Homo Sapiens
SERELEAFN

SEQ ID NO: 1326326 - protein, 9 aa, Homo Sapiens
PSYGNSTRV

SEQ ID NO: 1326327 - protein, 9 aa, Homo Sapiens
EPIPECPPL

SEQ ID NO: 1326328 - protein, 9 aa, Homo Sapiens
EAAVFPEVV

SEQ ID NO: 1326329 - protein, 9 aa, Homo Sapiens
HVSSDLEGT

SEQ ID NO: 1326330 - protein, 9 aa, Homo Sapiens
SRCEDLMYK

SEQ ID NO: 1326331 - protein, 9 aa, Homo Sapiens
EAFTYNSYL

SEQ ID NO: 1326332 - protein, 9 aa, Homo Sapiens
HAMWKMMLN

SEQ ID NO: 1326333 - protein, 9 aa, Homo Sapiens
KPLLLTFIL

SEQ ID NO: 1326334 - protein, 9 aa, Homo Sapiens
ISTQVQQYQ

SEQ ID NO: 1326335 - protein, 9 aa, Homo Sapiens
CCMQNTKTC

SEQ ID NO: 1326336 - protein, 9 aa, Homo Sapiens
LQLNVSSVR

SEQ ID NO: 1326337 - protein, 9 aa, Homo Sapiens
FRQVKDPLY

SEQ ID NO: 1326338 - protein, 9 aa, Homo Sapiens
SQLQMKPCR

SEQ ID NO: 1326339 - protein, 9 aa, Homo Sapiens
SSPSVLVVS

SEQ ID NO: 1326340 - protein, 9 aa, Homo Sapiens
CGHTRAPQA

SEQ ID NO: 1326341 - protein, 9 aa, Homo Sapiens
DGTVTEVTD

SEQ ID NO: 1326342 - protein, 9 aa, Homo Sapiens
RIQRANLVE

SEQ ID NO: 1326343 - protein, 9 aa, Homo Sapiens
TYADARVLV

SEQ ID NO: 1326344 - protein, 9 aa, Homo Sapiens
KNKPGWFFK

SEQ ID NO: 1326345 - protein, 9 aa, Homo Sapiens
IDSFQIILN

SEQ ID NO: 1326346 - protein, 9 aa, Homo Sapiens
CYSKDGLYT

SEQ ID NO: 1326347 - protein, 9 aa, Homo Sapiens
LIFWIICLA

SEQ ID NO: 1326348 - protein, 9 aa, Homo Sapiens
HLMQYPARA

SEQ ID NO: 1326349 - protein, 9 aa, Homo Sapiens
MLLNLSHGK

SEQ ID NO: 1326350 - protein, 9 aa, Homo Sapiens
ASLSSRAEV

SEQ ID NO: 1326351 - protein, 9 aa, Homo Sapiens
DPAILPNIP

SEQ ID NO: 1326352 - protein, 9 aa, Homo Sapiens
CLMYATSQY

SEQ ID NO: 1326353 - protein, 9 aa, Homo Sapiens
PASSLTVMD

SEQ ID NO: 1326354 - protein, 9 aa, Homo Sapiens
AIADLGLVV

SEQ ID NO: 1326355 - protein, 9 aa, Homo Sapiens
LLNQCRGFL

SEQ ID NO: 1326356 - protein, 9 aa, Homo Sapiens
SRRAAWRRC

SEQ ID NO: 1326357 - protein, 9 aa, Homo Sapiens
IITAVTVGY

SEQ ID NO: 1326358 - protein, 9 aa, Homo Sapiens
TSLLPIISW

SEQ ID NO: 1326359 - protein, 9 aa, Homo Sapiens
LPITSYVSI

SEQ ID NO: 1326360 - protein, 9 aa, Homo Sapiens
EDGTPIITF

SEQ ID NO: 1326361 - protein, 9 aa, Homo Sapiens
REIRTLFCS

SEQ ID NO: 1326362 - protein, 9 aa, Homo Sapiens
QRSSACTRS

SEQ ID NO: 1326363 - protein, 9 aa, Homo Sapiens
LGTMPEVET

SEQ ID NO: 1326364 - protein, 9 aa, Homo Sapiens
TSLHIFKWV

SEQ ID NO: 1326365 - protein, 9 aa, Homo Sapiens
LEELCLQVI

SEQ ID NO: 1326366 - protein, 9 aa, Homo Sapiens
LWSGKAMER

SEQ ID NO: 1326367 - protein, 9 aa, Homo Sapiens
TFPIWFEYP

SEQ ID NO: 1326368 - protein, 9 aa, Homo Sapiens
AVKNTVGMH

SEQ ID NO: 1326369 - protein, 9 aa, Homo Sapiens
GLQETITEF

SEQ ID NO: 1326370 - protein, 9 aa, Homo Sapiens
TKQLKLEKE

SEQ ID NO: 1326371 - protein, 9 aa, Homo Sapiens
PTSAPPTSL

SEQ ID NO: 1326372 - protein, 9 aa, Homo Sapiens
SVNASRDII

SEQ ID NO: 1326373 - protein, 9 aa, Homo Sapiens
WNSPPLQGT

SEQ ID NO: 1326374 - protein, 9 aa, Homo Sapiens
FLMVCEKPG

SEQ ID NO: 1326375 - protein, 9 aa, Homo Sapiens
VTTSATEAW

SEQ ID NO: 1326376 - protein, 9 aa, Homo Sapiens
MHQQDINDT

SEQ ID NO: 1326377 - protein, 9 aa, Homo Sapiens
VGQLMEFCR

SEQ ID NO: 1326378 - protein, 9 aa, Homo Sapiens
VQPARYHIT

SEQ ID NO: 1326379 - protein, 9 aa, Homo Sapiens
ECRNALREF

SEQ ID NO: 1326380 - protein, 9 aa, Homo Sapiens
HMRVYDNVR

SEQ ID NO: 1326381 - protein, 9 aa, Homo Sapiens
NRSKHLEKV

SEQ ID NO: 1326382 - protein, 9 aa, Homo Sapiens
PWGGRGQDP

SEQ ID NO: 1326383 - protein, 9 aa, Homo Sapiens
WDLHTSVRK

SEQ ID NO: 1326384 - protein, 9 aa, Homo Sapiens
KRQQLSASA

SEQ ID NO: 1326385 - protein, 9 aa, Homo Sapiens
VKDYCFVRE

SEQ ID NO: 1326386 - protein, 9 aa, Homo Sapiens
EEPLVPSDP

SEQ ID NO: 1326387 - protein, 9 aa, Homo Sapiens
FSAPGVSLK

SEQ ID NO: 1326388 - protein, 9 aa, Homo Sapiens
VFDANDNTP

SEQ ID NO: 1326389 - protein, 9 aa, Homo Sapiens
RFDNQPCVL

SEQ ID NO: 1326390 - protein, 9 aa, Homo Sapiens
GICVLAFKC

SEQ ID NO: 1326391 - protein, 9 aa, Homo Sapiens
AVRQVVAQT

SEQ ID NO: 1326392 - protein, 9 aa, Homo Sapiens
VLALCCLEE

SEQ ID NO: 1326393 - protein, 9 aa, Homo Sapiens
PSKELSKCQ

SEQ ID NO: 1326394 - protein, 9 aa, Homo Sapiens
SREDGLPVP

SEQ ID NO: 1326395 - protein, 9 aa, Homo Sapiens
EIYGNKLPP

SEQ ID NO: 1326396 - protein, 9 aa, Homo Sapiens
KSFTRLAQH

SEQ ID NO: 1326397 - protein, 9 aa, Homo Sapiens
KQLSRFAST

SEQ ID NO: 1326398 - protein, 9 aa, Homo Sapiens
VEAEDGGSS

SEQ ID NO: 1326399 - protein, 9 aa, Homo Sapiens
PKSALVTLV

SEQ ID NO: 1326400 - protein, 9 aa, Homo Sapiens
PCYDVCYAP

SEQ ID NO: 1326401 - protein, 9 aa, Homo Sapiens
VPPGSPSSF

SEQ ID NO: 1326402 - protein, 9 aa, Homo Sapiens
TYSSLAVCD

SEQ ID NO: 1326403 - protein, 9 aa, Homo Sapiens
RGVAEGTGA

SEQ ID NO: 1326404 - protein, 9 aa, Homo Sapiens
PDPSNTANR

SEQ ID NO: 1326405 - protein, 9 aa, Homo Sapiens
SPSVLVVSV

SEQ ID NO: 1326406 - protein, 9 aa, Homo Sapiens
VSKWVGIPA

SEQ ID NO: 1326407 - protein, 9 aa, Homo Sapiens
DSAQLLMAQ

SEQ ID NO: 1326408 - protein, 9 aa, Homo Sapiens
RNITVGLGV

SEQ ID NO: 1326409 - protein, 9 aa, Homo Sapiens
HSFIDGSGS

SEQ ID NO: 1326410 - protein, 9 aa, Homo Sapiens
VHEKQKLFQ

SEQ ID NO: 1326411 - protein, 9 aa, Homo Sapiens
EPLISAFAS

SEQ ID NO: 1326412 - protein, 9 aa, Homo Sapiens
HSNIVDLLF

SEQ ID NO: 1326413 - protein, 9 aa, Homo Sapiens
STMGEICWP

SEQ ID NO: 1326414 - protein, 9 aa, Homo Sapiens
PCSGARANI

SEQ ID NO: 1326415 - protein, 9 aa, Homo Sapiens
KTTSRSGCK

SEQ ID NO: 1326416 - protein, 9 aa, Homo Sapiens
GASRRWRMS

SEQ ID NO: 1326417 - protein, 9 aa, Homo Sapiens
WRKQSCRKV

SEQ ID NO: 1326418 - protein, 9 aa, Homo Sapiens
RHMGIGKWK

SEQ ID NO: 1326419 - protein, 9 aa, Homo Sapiens
LKLQDQLSA

SEQ ID NO: 1326420 - protein, 9 aa, Homo Sapiens
FQWVVSRAL

SEQ ID NO: 1326421 - protein, 9 aa, Homo Sapiens
AFEISLYDT

SEQ ID NO: 1326422 - protein, 9 aa, Homo Sapiens
PADHSFILI

SEQ ID NO: 1326423 - protein, 9 aa, Homo Sapiens
MSCCRCFCV

SEQ ID NO: 1326424 - protein, 9 aa, Homo Sapiens
CATCGAAPS

SEQ ID NO: 1326425 - protein, 9 aa, Homo Sapiens
DISTQVQQY

SEQ ID NO: 1326426 - protein, 9 aa, Homo Sapiens
DEDWNEVMY

SEQ ID NO: 1326427 - protein, 9 aa, Homo Sapiens
WKEVRGEWR

SEQ ID NO: 1326428 - protein, 9 aa, Homo Sapiens
LPQDDDMPA

SEQ ID NO: 1326429 - protein, 9 aa, Homo Sapiens
QPLRQQILP

SEQ ID NO: 1326430 - protein, 9 aa, Homo Sapiens
LGLTITARK

SEQ ID NO: 1326431 - protein, 9 aa, Homo Sapiens
ATSNSQVQV

SEQ ID NO: 1326432 - protein, 9 aa, Homo Sapiens
CPIKGFRYQ

SEQ ID NO: 1326433 - protein, 9 aa, Homo Sapiens
TDLVDKNEW

SEQ ID NO: 1326434 - protein, 9 aa, Homo Sapiens
ALAKHIYTK

SEQ ID NO: 1326435 - protein, 9 aa, Homo Sapiens
PVHILFFSF

SEQ ID NO: 1326436 - protein, 9 aa, Homo Sapiens
GFEPGTFDG

SEQ ID NO: 1326437 - protein, 9 aa, Homo Sapiens
ECGKTFGSG

SEQ ID NO: 1326438 - protein, 9 aa, Homo Sapiens
EEVQCCTAD

SEQ ID NO: 1326439 - protein, 9 aa, Homo Sapiens
GDCNVVKSK

SEQ ID NO: 1326440 - protein, 9 aa, Homo Sapiens
ETFNHVNGL

SEQ ID NO: 1326441 - protein, 9 aa, Homo Sapiens
QVDVVLHLA

SEQ ID NO: 1326442 - protein, 9 aa, Homo Sapiens
PTASRPTTR

SEQ ID NO: 1326443 - protein, 9 aa, Homo Sapiens
PLQELSPTE

SEQ ID NO: 1326444 - protein, 9 aa, Homo Sapiens
SHWDAEYFL

SEQ ID NO: 1326445 - protein, 9 aa, Homo Sapiens
VRPWVLLPK

SEQ ID NO: 1326446 - protein, 9 aa, Homo Sapiens
LGISGLESF

SEQ ID NO: 1326447 - protein, 9 aa, Homo Sapiens
LPYKTSVSE

SEQ ID NO: 1326448 - protein, 9 aa, Homo Sapiens
HYLNFIYYR

SEQ ID NO: 1326449 - protein, 9 aa, Homo Sapiens
PLRQQAFLR

SEQ ID NO: 1326450 - protein, 9 aa, Homo Sapiens
YFDTQNNIS

SEQ ID NO: 1326451 - protein, 9 aa, Homo Sapiens
FRWHFIKRR

SEQ ID NO: 1326452 - protein, 9 aa, Homo Sapiens
SMAYDRYMA

SEQ ID NO: 1326453 - protein, 9 aa, Homo Sapiens
VHILFFSFL

SEQ ID NO: 1326454 - protein, 9 aa, Homo Sapiens
LQNAFGDHW

SEQ ID NO: 1326455 - protein, 9 aa, Homo Sapiens
LLHPPLNIC

SEQ ID NO: 1326456 - protein, 9 aa, Homo Sapiens
FHLSLPSRW

SEQ ID NO: 1326457 - protein, 9 aa, Homo Sapiens
RDECWCPTN

SEQ ID NO: 1326458 - protein, 9 aa, Homo Sapiens
RWGWGQLLL

SEQ ID NO: 1326459 - protein, 9 aa, Homo Sapiens
VSEAFVKFA

SEQ ID NO: 1326460 - protein, 9 aa, Homo Sapiens
GGSDYALAR

SEQ ID NO: 1326461 - protein, 9 aa, Homo Sapiens
LYGHDVSSD

SEQ ID NO: 1326462 - protein, 9 aa, Homo Sapiens
TSISCSYSV

SEQ ID NO: 1326463 - protein, 9 aa, Homo Sapiens
ITQETAQLL

SEQ ID NO: 1326464 - protein, 9 aa, Homo Sapiens
HSPSTPSQS

SEQ ID NO: 1326465 - protein, 9 aa, Homo Sapiens
PNNRMSPGM

SEQ ID NO: 1326466 - protein, 9 aa, Homo Sapiens
HKSSDASAC

SEQ ID NO: 1326467 - protein, 9 aa, Homo Sapiens
PEQIFFRWH

SEQ ID NO: 1326468 - protein, 9 aa, Homo Sapiens
PSRELHLPI

SEQ ID NO: 1326469 - protein, 9 aa, Homo Sapiens
FRFPRVFLS

SEQ ID NO: 1326470 - protein, 9 aa, Homo Sapiens
WDISLDLPV

SEQ ID NO: 1326471 - protein, 9 aa, Homo Sapiens
WGVWHVSEL

SEQ ID NO: 1326472 - protein, 9 aa, Homo Sapiens
LLKMEIGPV

SEQ ID NO: 1326473 - protein, 9 aa, Homo Sapiens
IQESSSPST

SEQ ID NO: 1326474 - protein, 9 aa, Homo Sapiens
GRSCGHTRA

SEQ ID NO: 1326475 - protein, 9 aa, Homo Sapiens
GDSEARASD

SEQ ID NO: 1326476 - protein, 9 aa, Homo Sapiens
IATDKQYKG

SEQ ID NO: 1326477 - protein, 9 aa, Homo Sapiens
LLSGNDPSI

SEQ ID NO: 1326478 - protein, 9 aa, Homo Sapiens
ARKGRKKDK

SEQ ID NO: 1326479 - protein, 9 aa, Homo Sapiens
AQYLNRNYW

SEQ ID NO: 1326480 - protein, 9 aa, Homo Sapiens
SSLENSLEE

SEQ ID NO: 1326481 - protein, 9 aa, Homo Sapiens
AVLYQNTHH

SEQ ID NO: 1326482 - protein, 9 aa, Homo Sapiens
CVHNFTALN

SEQ ID NO: 1326483 - protein, 9 aa, Homo Sapiens
EYCKCKALM

SEQ ID NO: 1326484 - protein, 9 aa, Homo Sapiens
LISLHEAVH

SEQ ID NO: 1326485 - protein, 9 aa, Homo Sapiens
PKILRLVQA

SEQ ID NO: 1326486 - protein, 9 aa, Homo Sapiens
SFYYDVGHC

SEQ ID NO: 1326487 - protein, 9 aa, Homo Sapiens
QRFMVQIPP

SEQ ID NO: 1326488 - protein, 9 aa, Homo Sapiens
LQVSKRNSF

SEQ ID NO: 1326489 - protein, 9 aa, Homo Sapiens
SENMVVPLM

SEQ ID NO: 1326490 - protein, 9 aa, Homo Sapiens
YKVHEIVEK

SEQ ID NO: 1326491 - protein, 9 aa, Homo Sapiens
EEELFSVCV

SEQ ID NO: 1326492 - protein, 9 aa, Homo Sapiens
SNIYEKLLC

SEQ ID NO: 1326493 - protein, 9 aa, Homo Sapiens
LTIQRLHIP

SEQ ID NO: 1326494 - protein, 9 aa, Homo Sapiens
RAGRMGGRH

SEQ ID NO: 1326495 - protein, 9 aa, Homo Sapiens
KSNHGHSVL

SEQ ID NO: 1326496 - protein, 9 aa, Homo Sapiens
QWIDRIHTP

SEQ ID NO: 1326497 - protein, 9 aa, Homo Sapiens
PKRLGRLLI

SEQ ID NO: 1326498 - protein, 9 aa, Homo Sapiens
TQPRVVSRE

SEQ ID NO: 1326499 - protein, 9 aa, Homo Sapiens
LAKHLQEEK

SEQ ID NO: 1326500 - protein, 9 aa, Homo Sapiens
AVLRQARHQ

SEQ ID NO: 1326501 - protein, 9 aa, Homo Sapiens
NHPPMGIPA

SEQ ID NO: 1326502 - protein, 9 aa, Homo Sapiens
ILPSEPADP

SEQ ID NO: 1326503 - protein, 9 aa, Homo Sapiens
PNTYFRPIL

SEQ ID NO: 1326504 - protein, 9 aa, Homo Sapiens
TTCSSTPCY

SEQ ID NO: 1326505 - protein, 9 aa, Homo Sapiens
STRVTNDNV

SEQ ID NO: 1326506 - protein, 9 aa, Homo Sapiens
VAFLPEEEL

SEQ ID NO: 1326507 - protein, 9 aa, Homo Sapiens
IFPNYRHSR

SEQ ID NO: 1326508 - protein, 9 aa, Homo Sapiens
SLLFSLPHI

SEQ ID NO: 1326509 - protein, 9 aa, Homo Sapiens
AVLLKVVHT

SEQ ID NO: 1326510 - protein, 9 aa, Homo Sapiens
DTLCKHLAR

SEQ ID NO: 1326511 - protein, 9 aa, Homo Sapiens
SGVLDRMMK

SEQ ID NO: 1326512 - protein, 9 aa, Homo Sapiens
LTPGAQQQD

SEQ ID NO: 1326513 - protein, 9 aa, Homo Sapiens
NNKHIKRSL

SEQ ID NO: 1326514 - protein, 9 aa, Homo Sapiens
WPDDINPRT

SEQ ID NO: 1326515 - protein, 9 aa, Homo Sapiens
RREEHADSA

SEQ ID NO: 1326516 - protein, 9 aa, Homo Sapiens
IPSNNITCV

SEQ ID NO: 1326517 - protein, 9 aa, Homo Sapiens
TPDIMCGGV

SEQ ID NO: 1326518 - protein, 9 aa, Homo Sapiens
ELNGSSPIY

SEQ ID NO: 1326519 - protein, 9 aa, Homo Sapiens
TVEWRYRNV

SEQ ID NO: 1326520 - protein, 9 aa, Homo Sapiens
RRTAVERSL

SEQ ID NO: 1326521 - protein, 9 aa, Homo Sapiens
YATYYCEGE

SEQ ID NO: 1326522 - protein, 9 aa, Homo Sapiens
CHVGDALKD

SEQ ID NO: 1326523 - protein, 9 aa, Homo Sapiens
DAVSTFEIE

SEQ ID NO: 1326524 - protein, 9 aa, Homo Sapiens
AGFHSLPCS

SEQ ID NO: 1326525 - protein, 9 aa, Homo Sapiens
TQLKECLNR

SEQ ID NO: 1326526 - protein, 9 aa, Homo Sapiens
AHRFTQEYK

SEQ ID NO: 1326527 - protein, 9 aa, Homo Sapiens
GWFFKKNPF

SEQ ID NO: 1326528 - protein, 9 aa, Homo Sapiens
HTEPVMLPV

SEQ ID NO: 1326529 - protein, 9 aa, Homo Sapiens
TEICDEAEK

SEQ ID NO: 1326530 - protein, 9 aa, Homo Sapiens
MVFLSRSDL

SEQ ID NO: 1326531 - protein, 9 aa, Homo Sapiens
SPCLSWSSR

SEQ ID NO: 1326532 - protein, 9 aa, Homo Sapiens
RRPTHLSVV

SEQ ID NO: 1326533 - protein, 9 aa, Homo Sapiens
LTQGLIEHL

SEQ ID NO: 1326534 - protein, 9 aa, Homo Sapiens
EAIADIKWT

SEQ ID NO: 1326535 - protein, 9 aa, Homo Sapiens
ARLEAESVP

SEQ ID NO: 1326536 - protein, 9 aa, Homo Sapiens
QFLLPGPAP

SEQ ID NO: 1326537 - protein, 9 aa, Homo Sapiens
IGDKCDDDD

SEQ ID NO: 1326538 - protein, 9 aa, Homo Sapiens
HHEQDTELG

SEQ ID NO: 1326539 - protein, 9 aa, Homo Sapiens
LCNRSTCPL

SEQ ID NO: 1326540 - protein, 9 aa, Homo Sapiens
TAPSLTPPQ

SEQ ID NO: 1326541 - protein, 9 aa, Homo Sapiens
STKEHHVVV

SEQ ID NO: 1326542 - protein, 9 aa, Homo Sapiens
GNDPSIHLY

SEQ ID NO: 1326543 - protein, 9 aa, Homo Sapiens
ATEKQKKKT

SEQ ID NO: 1326544 - protein, 9 aa, Homo Sapiens
PTSPSWLLP

SEQ ID NO: 1326545 - protein, 9 aa, Homo Sapiens
LATSLRSLH

SEQ ID NO: 1326546 - protein, 9 aa, Homo Sapiens
ATVELSKET

SEQ ID NO: 1326547 - protein, 9 aa, Homo Sapiens
KPCIKYIGH

SEQ ID NO: 1326548 - protein, 9 aa, Homo Sapiens
HTQERHYEC

SEQ ID NO: 1326549 - protein, 9 aa, Homo Sapiens
NINNKRCYS

SEQ ID NO: 1326550 - protein, 9 aa, Homo Sapiens
RLQSGCPPW

SEQ ID NO: 1326551 - protein, 9 aa, Homo Sapiens
PSPKVSDTM

SEQ ID NO: 1326552 - protein, 9 aa, Homo Sapiens
KCQLSPQSK

SEQ ID NO: 1326553 - protein, 9 aa, Homo Sapiens
LDQDAAIAS

SEQ ID NO: 1326554 - protein, 9 aa, Homo Sapiens
PDAPEAPPC

SEQ ID NO: 1326555 - protein, 9 aa, Homo Sapiens
LSLKTLFRK

SEQ ID NO: 1326556 - protein, 9 aa, Homo Sapiens
WEEASQVGG

SEQ ID NO: 1326557 - protein, 9 aa, Homo Sapiens
VRSPALAGL

SEQ ID NO: 1326558 - protein, 9 aa, Homo Sapiens
VVKEEMDVS

SEQ ID NO: 1326559 - protein, 9 aa, Homo Sapiens
RDNMFYYYN

SEQ ID NO: 1326560 - protein, 9 aa, Homo Sapiens
YQSLKQFNV

SEQ ID NO: 1326561 - protein, 9 aa, Homo Sapiens
RPNGIIIIK

SEQ ID NO: 1326562 - protein, 9 aa, Homo Sapiens
YPQTSGGVL

SEQ ID NO: 1326563 - protein, 9 aa, Homo Sapiens
CVGIADGHR

SEQ ID NO: 1326564 - protein, 9 aa, Homo Sapiens
PITRKDTST

SEQ ID NO: 1326565 - protein, 9 aa, Homo Sapiens
GTFAQPLPH

SEQ ID NO: 1326566 - protein, 9 aa, Homo Sapiens
VSPGTVLVG

SEQ ID NO: 1326567 - protein, 9 aa, Homo Sapiens
MKQIIKICA

SEQ ID NO: 1326568 - protein, 9 aa, Homo Sapiens
LHLLATNYP

SEQ ID NO: 1326569 - protein, 9 aa, Homo Sapiens
VLPPARHIT

SEQ ID NO: 1326570 - protein, 9 aa, Homo Sapiens
GREFHKSLV

SEQ ID NO: 1326571 - protein, 9 aa, Homo Sapiens
SDTSTMSLE

SEQ ID NO: 1326572 - protein, 9 aa, Homo Sapiens
PIIQWFWKA

SEQ ID NO: 1326573 - protein, 9 aa, Homo Sapiens
SEDGTVCIW

SEQ ID NO: 1326574 - protein, 9 aa, Homo Sapiens
SLLGAVNMA

SEQ ID NO: 1326575 - protein, 9 aa, Homo Sapiens
VVAIFVQGP

SEQ ID NO: 1326576 - protein, 9 aa, Homo Sapiens
HITFTPESQ

SEQ ID NO: 1326577 - protein, 9 aa, Homo Sapiens
NWNLLFLRR

SEQ ID NO: 1326578 - protein, 9 aa, Homo Sapiens
ELHTWEEEL

SEQ ID NO: 1326579 - protein, 9 aa, Homo Sapiens
DVEDTTAIQ

SEQ ID NO: 1326580 - protein, 9 aa, Homo Sapiens
NMYASRLYR

SEQ ID NO: 1326581 - protein, 9 aa, Homo Sapiens
DVCIEAYTS

SEQ ID NO: 1326582 - protein, 9 aa, Homo Sapiens
ATPEGAGWT

SEQ ID NO: 1326583 - protein, 9 aa, Homo Sapiens
CATSNVFAM

SEQ ID NO: 1326584 - protein, 9 aa, Homo Sapiens
RPAHMVVGD

SEQ ID NO: 1326585 - protein, 9 aa, Homo Sapiens
TIPVHILFF

SEQ ID NO: 1326586 - protein, 9 aa, Homo Sapiens
LRYSAFWLS

SEQ ID NO: 1326587 - protein, 9 aa, Homo Sapiens
EKQVFTEAN

SEQ ID NO: 1326588 - protein, 9 aa, Homo Sapiens
VHRYCDAIA

SEQ ID NO: 1326589 - protein, 9 aa, Homo Sapiens
TLLGDIVKR

SEQ ID NO: 1326590 - protein, 9 aa, Homo Sapiens
LQANNYNIS

SEQ ID NO: 1326591 - protein, 9 aa, Homo Sapiens
EISRLVHER

SEQ ID NO: 1326592 - protein, 9 aa, Homo Sapiens
PWQGLLLIA

SEQ ID NO: 1326593 - protein, 9 aa, Homo Sapiens
FRGHNKTRE

SEQ ID NO: 1326594 - protein, 9 aa, Homo Sapiens
SKGTLNLED

SEQ ID NO: 1326595 - protein, 9 aa, Homo Sapiens
RSALPDVAP

SEQ ID NO: 1326596 - protein, 9 aa, Homo Sapiens
RCRVEEQQR

SEQ ID NO: 1326597 - protein, 9 aa, Homo Sapiens
SPTHADSTG

SEQ ID NO: 1326598 - protein, 9 aa, Homo Sapiens
AVVVLHEWY

SEQ ID NO: 1326599 - protein, 9 aa, Homo Sapiens
ENDVNASSK

SEQ ID NO: 1326600 - protein, 9 aa, Homo Sapiens
HKNKTITCY

SEQ ID NO: 1326601 - protein, 9 aa, Homo Sapiens
VSLVEVCRK

SEQ ID NO: 1326602 - protein, 9 aa, Homo Sapiens
CWKQYLEDE

SEQ ID NO: 1326603 - protein, 9 aa, Homo Sapiens
ATFTAHTAP

SEQ ID NO: 1326604 - protein, 9 aa, Homo Sapiens
SGTGIMGSA

SEQ ID NO: 1326605 - protein, 9 aa, Homo Sapiens
IKVNKGCVR

SEQ ID NO: 1326606 - protein, 9 aa, Homo Sapiens
QLWYIHALY

SEQ ID NO: 1326607 - protein, 9 aa, Homo Sapiens
RFLAKTYST

SEQ ID NO: 1326608 - protein, 9 aa, Homo Sapiens
TMFGGDFPT

SEQ ID NO: 1326609 - protein, 9 aa, Homo Sapiens
RDLQLACVA

SEQ ID NO: 1326610 - protein, 9 aa, Homo Sapiens
YMYGVSKHC

SEQ ID NO: 1326611 - protein, 9 aa, Homo Sapiens
CPGMPLERK

SEQ ID NO: 1326612 - protein, 9 aa, Homo Sapiens
VVVLRLDGS

SEQ ID NO: 1326613 - protein, 9 aa, Homo Sapiens
LTSLCRLYL

SEQ ID NO: 1326614 - protein, 9 aa, Homo Sapiens
TVHMTQPKD

SEQ ID NO: 1326615 - protein, 9 aa, Homo Sapiens
ADNLSDTLN

SEQ ID NO: 1326616 - protein, 9 aa, Homo Sapiens
RTIDEHDVI

SEQ ID NO: 1326617 - protein, 9 aa, Homo Sapiens
VTFGFLGNV

SEQ ID NO: 1326618 - protein, 9 aa, Homo Sapiens
MIHKDGDDF

SEQ ID NO: 1326619 - protein, 9 aa, Homo Sapiens
LLEGQEKNL

SEQ ID NO: 1326620 - protein, 9 aa, Homo Sapiens
LYVYAACER

SEQ ID NO: 1326621 - protein, 9 aa, Homo Sapiens
DPAFRRGCL

SEQ ID NO: 1326622 - protein, 9 aa, Homo Sapiens
TLKMGSAIF

SEQ ID NO: 1326623 - protein, 9 aa, Homo Sapiens
TNVVEMVPC

SEQ ID NO: 1326624 - protein, 9 aa, Homo Sapiens
YPKRLGRLL

SEQ ID NO: 1326625 - protein, 9 aa, Homo Sapiens
MEMEVLQER

SEQ ID NO: 1326626 - protein, 9 aa, Homo Sapiens
QTGVMICAY

SEQ ID NO: 1326627 - protein, 9 aa, Homo Sapiens
VDRFAWDTS

SEQ ID NO: 1326628 - protein, 9 aa, Homo Sapiens
SRQGKLWLQ

SEQ ID NO: 1326629 - protein, 9 aa, Homo Sapiens
VITVVAAHV

SEQ ID NO: 1326630 - protein, 9 aa, Homo Sapiens
DVMMATVMG

SEQ ID NO: 1326631 - protein, 9 aa, Homo Sapiens
EYAACDTTY

SEQ ID NO: 1326632 - protein, 9 aa, Homo Sapiens
LSLDLKGVH

SEQ ID NO: 1326633 - protein, 9 aa, Homo Sapiens
NMQPRTRCT

SEQ ID NO: 1326634 - protein, 9 aa, Homo Sapiens
YEEALANRH

SEQ ID NO: 1326635 - protein, 9 aa, Homo Sapiens
LMEKCTALS

SEQ ID NO: 1326636 - protein, 9 aa, Homo Sapiens
DDVDLTSIA

SEQ ID NO: 1326637 - protein, 9 aa, Homo Sapiens
LVGPVMMVL

SEQ ID NO: 1326638 - protein, 9 aa, Homo Sapiens
HQGSWGVSE

SEQ ID NO: 1326639 - protein, 9 aa, Homo Sapiens
TFYRSSHLT

SEQ ID NO: 1326640 - protein, 9 aa, Homo Sapiens
GTPPPLILW

SEQ ID NO: 1326641 - protein, 9 aa, Homo Sapiens
LGRRQQPQG

SEQ ID NO: 1326642 - protein, 9 aa, Homo Sapiens
VFLRGSREH

SEQ ID NO: 1326643 - protein, 9 aa, Homo Sapiens
LNSLLQGYR

SEQ ID NO: 1326644 - protein, 9 aa, Homo Sapiens
DKHLWVLHL

SEQ ID NO: 1326645 - protein, 9 aa, Homo Sapiens
QKHQRRGRG

SEQ ID NO: 1326646 - protein, 9 aa, Homo Sapiens
RMYSYPAHV

SEQ ID NO: 1326647 - protein, 9 aa, Homo Sapiens
GASRGTLWR

SEQ ID NO: 1326648 - protein, 9 aa, Homo Sapiens
NDDMPKDAK

SEQ ID NO: 1326649 - protein, 9 aa, Homo Sapiens
VWRVSVAHF

SEQ ID NO: 1326650 - protein, 9 aa, Homo Sapiens
LRNAVELVK

SEQ ID NO: 1326651 - protein, 9 aa, Homo Sapiens
LIWKWGQSP

SEQ ID NO: 1326652 - protein, 9 aa, Homo Sapiens
LAAEHIQVG

SEQ ID NO: 1326653 - protein, 9 aa, Homo Sapiens
SKHFSIFLS

SEQ ID NO: 1326654 - protein, 9 aa, Homo Sapiens
TNLQEDVEE

SEQ ID NO: 1326655 - protein, 9 aa, Homo Sapiens
KKGFKKAGV

SEQ ID NO: 1326656 - protein, 9 aa, Homo Sapiens
EKFISLIRG

SEQ ID NO: 1326657 - protein, 9 aa, Homo Sapiens
MEVCDEAAG

SEQ ID NO: 1326658 - protein, 9 aa, Homo Sapiens
RISAMDENL

SEQ ID NO: 1326659 - protein, 9 aa, Homo Sapiens
SLRPNGIII

SEQ ID NO: 1326660 - protein, 9 aa, Homo Sapiens
VLRLDGSQR

SEQ ID NO: 1326661 - protein, 9 aa, Homo Sapiens
IRNLHEEDT

SEQ ID NO: 1326662 - protein, 9 aa, Homo Sapiens
TSNSQVQVV

SEQ ID NO: 1326663 - protein, 9 aa, Homo Sapiens
QAQVLSQEG

SEQ ID NO: 1326664 - protein, 9 aa, Homo Sapiens
EADRHAFII

SEQ ID NO: 1326665 - protein, 9 aa, Homo Sapiens
LGLPPGMRE

SEQ ID NO: 1326666 - protein, 9 aa, Homo Sapiens
DDRQHMWRP

SEQ ID NO: 1326667 - protein, 9 aa, Homo Sapiens
YIFGNSFVW

SEQ ID NO: 1326668 - protein, 9 aa, Homo Sapiens
TGETVYNML

SEQ ID NO: 1326669 - protein, 9 aa, Homo Sapiens
YNTQPVGNW

SEQ ID NO: 1326670 - protein, 9 aa, Homo Sapiens
MTFLRELLK

SEQ ID NO: 1326671 - protein, 9 aa, Homo Sapiens
SLEMDSSLI

SEQ ID NO: 1326672 - protein, 9 aa, Homo Sapiens
SQLPFDPEQ

SEQ ID NO: 1326673 - protein, 9 aa, Homo Sapiens
QRMSLWPQD

SEQ ID NO: 1326674 - protein, 9 aa, Homo Sapiens
LMCGGDGTS

SEQ ID NO: 1326675 - protein, 9 aa, Homo Sapiens
NFHPLQPLM

SEQ ID NO: 1326676 - protein, 9 aa, Homo Sapiens
LDLPILDDQ

SEQ ID NO: 1326677 - protein, 9 aa, Homo Sapiens
QQLSASANS

SEQ ID NO: 1326678 - protein, 9 aa, Homo Sapiens
TIPKFTNTH

SEQ ID NO: 1326679 - protein, 9 aa, Homo Sapiens
SFLQTFNYM

SEQ ID NO: 1326680 - protein, 9 aa, Homo Sapiens
EEVRQDVEA

SEQ ID NO: 1326681 - protein, 9 aa, Homo Sapiens
EPTLQLLRT

SEQ ID NO: 1326682 - protein, 9 aa, Homo Sapiens
IEIFALFIP

SEQ ID NO: 1326683 - protein, 9 aa, Homo Sapiens
ISLAELVVF

SEQ ID NO: 1326684 - protein, 9 aa, Homo Sapiens
CVGTVIGSN

SEQ ID NO: 1326685 - protein, 9 aa, Homo Sapiens
SFSSTSSLS

SEQ ID NO: 1326686 - protein, 9 aa, Homo Sapiens
VVYDFGDTQ

SEQ ID NO: 1326687 - protein, 9 aa, Homo Sapiens
RAGYRCNID

SEQ ID NO: 1326688 - protein, 9 aa, Homo Sapiens
CRVRRGTGL

SEQ ID NO: 1326689 - protein, 9 aa, Homo Sapiens
QSLYTGLVN

SEQ ID NO: 1326690 - protein, 9 aa, Homo Sapiens
DDIYMMDIF

SEQ ID NO: 1326691 - protein, 9 aa, Homo Sapiens
EASDNSGTR

SEQ ID NO: 1326692 - protein, 9 aa, Homo Sapiens
GLTLNSNTW

SEQ ID NO: 1326693 - protein, 9 aa, Homo Sapiens
PEVGDLCVS

SEQ ID NO: 1326694 - protein, 9 aa, Homo Sapiens
QDSIRINVT

SEQ ID NO: 1326695 - protein, 9 aa, Homo Sapiens
DQIKKRMAK

SEQ ID NO: 1326696 - protein, 9 aa, Homo Sapiens
IDLMTEWRF

SEQ ID NO: 1326697 - protein, 9 aa, Homo Sapiens
YKKCGCENV

SEQ ID NO: 1326698 - protein, 9 aa, Homo Sapiens
VICRNKQWS

SEQ ID NO: 1326699 - protein, 9 aa, Homo Sapiens
TKLAGLHDA

SEQ ID NO: 1326700 - protein, 9 aa, Homo Sapiens
FDVWCQQRL

SEQ ID NO: 1326701 - protein, 9 aa, Homo Sapiens
PTFGWVMFV

SEQ ID NO: 1326702 - protein, 9 aa, Homo Sapiens
QMSSFEKQC

SEQ ID NO: 1326703 - protein, 9 aa, Homo Sapiens
LQLCYRVLR

SEQ ID NO: 1326704 - protein, 9 aa, Homo Sapiens
LSPGSTTSS

SEQ ID NO: 1326705 - protein, 9 aa, Homo Sapiens
TLLPPLRFL

SEQ ID NO: 1326706 - protein, 9 aa, Homo Sapiens
SIPSVVRGA

SEQ ID NO: 1326707 - protein, 9 aa, Homo Sapiens
PTGLQAQQD

SEQ ID NO: 1326708 - protein, 9 aa, Homo Sapiens
ISSIVSCKW

SEQ ID NO: 1326709 - protein, 9 aa, Homo Sapiens
LASDHDYRI

SEQ ID NO: 1326710 - protein, 9 aa, Homo Sapiens
TLDKVPEDV

SEQ ID NO: 1326711 - protein, 9 aa, Homo Sapiens
MSVCGWSQT

SEQ ID NO: 1326712 - protein, 9 aa, Homo Sapiens
LITQLTQKP

SEQ ID NO: 1326713 - protein, 9 aa, Homo Sapiens
LRCRIIQWL

SEQ ID NO: 1326714 - protein, 9 aa, Homo Sapiens
MLNWAQAVN

SEQ ID NO: 1326715 - protein, 9 aa, Homo Sapiens
EEPPPSASA

SEQ ID NO: 1326716 - protein, 9 aa, Homo Sapiens
QTPRPQNKM

SEQ ID NO: 1326717 - protein, 9 aa, Homo Sapiens
ERHYECAAC

SEQ ID NO: 1326718 - protein, 9 aa, Homo Sapiens
VCCLVREYG

SEQ ID NO: 1326719 - protein, 9 aa, Homo Sapiens
FMEKGEKVL

SEQ ID NO: 1326720 - protein, 9 aa, Homo Sapiens
DKHISLAGC

SEQ ID NO: 1326721 - protein, 9 aa, Homo Sapiens
VTLIMAPSG

SEQ ID NO: 1326722 - protein, 9 aa, Homo Sapiens
SVFLDDIIP

SEQ ID NO: 1326723 - protein, 9 aa, Homo Sapiens
SVGQPEMTP

SEQ ID NO: 1326724 - protein, 9 aa, Homo Sapiens
ESSAEQLRL

SEQ ID NO: 1326725 - protein, 9 aa, Homo Sapiens
TRSRHSGSL

SEQ ID NO: 1326726 - protein, 9 aa, Homo Sapiens
RNRDDPADI

SEQ ID NO: 1326727 - protein, 9 aa, Homo Sapiens
MDDVEVTVC

SEQ ID NO: 1326728 - protein, 9 aa, Homo Sapiens
QVQTCSADE

SEQ ID NO: 1326729 - protein, 9 aa, Homo Sapiens
FVDSYDMIL

SEQ ID NO: 1326730 - protein, 9 aa, Homo Sapiens
TPAASQGLH

SEQ ID NO: 1326731 - protein, 9 aa, Homo Sapiens
GPSSACNVA

SEQ ID NO: 1326732 - protein, 9 aa, Homo Sapiens
NDFSNNDGV

SEQ ID NO: 1326733 - protein, 9 aa, Homo Sapiens
RDGRWAVRW

SEQ ID NO: 1326734 - protein, 9 aa, Homo Sapiens
CKAGAYLDP

SEQ ID NO: 1326735 - protein, 9 aa, Homo Sapiens
FRKLGLYMT

SEQ ID NO: 1326736 - protein, 9 aa, Homo Sapiens
GSSLTPLLL

SEQ ID NO: 1326737 - protein, 9 aa, Homo Sapiens
VVTLLVWYR

SEQ ID NO: 1326738 - protein, 9 aa, Homo Sapiens
GAGKTEVSK

SEQ ID NO: 1326739 - protein, 9 aa, Homo Sapiens
VNSLHKYIM

SEQ ID NO: 1326740 - protein, 9 aa, Homo Sapiens
PGKKGTHVL

SEQ ID NO: 1326741 - protein, 9 aa, Homo Sapiens
PHIGDVIQK

SEQ ID NO: 1326742 - protein, 9 aa, Homo Sapiens
YGCALPLEA

SEQ ID NO: 1326743 - protein, 9 aa, Homo Sapiens
TGWCVGFLF

SEQ ID NO: 1326744 - protein, 9 aa, Homo Sapiens
LDDNHISTI

SEQ ID NO: 1326745 - protein, 9 aa, Homo Sapiens
VYTLINAEV

SEQ ID NO: 1326746 - protein, 9 aa, Homo Sapiens
MCSERCCSL

SEQ ID NO: 1326747 - protein, 9 aa, Homo Sapiens
RSWITRSPF

SEQ ID NO: 1326748 - protein, 9 aa, Homo Sapiens
TTYNEIVTF

SEQ ID NO: 1326749 - protein, 9 aa, Homo Sapiens
WEPYCRDIN

SEQ ID NO: 1326750 - protein, 9 aa, Homo Sapiens
KLPLQSLVG

SEQ ID NO: 1326751 - protein, 9 aa, Homo Sapiens
LQREVATRT

SEQ ID NO: 1326752 - protein, 9 aa, Homo Sapiens
RANIGDTQA

SEQ ID NO: 1326753 - protein, 9 aa, Homo Sapiens
PAFSFRANM

SEQ ID NO: 1326754 - protein, 9 aa, Homo Sapiens
EKHIQAEVE

SEQ ID NO: 1326755 - protein, 9 aa, Homo Sapiens
RSSGRRQWQ

SEQ ID NO: 1326756 - protein, 9 aa, Homo Sapiens
DEVLPEKEK

SEQ ID NO: 1326757 - protein, 9 aa, Homo Sapiens
IRGIIHHTW

SEQ ID NO: 1326758 - protein, 9 aa, Homo Sapiens
ACEEYAQNV

SEQ ID NO: 1326759 - protein, 9 aa, Homo Sapiens
HSSVEILRV

SEQ ID NO: 1326760 - protein, 9 aa, Homo Sapiens
IPDAPEAPP

SEQ ID NO: 1326761 - protein, 9 aa, Homo Sapiens
GENGKITGI

SEQ ID NO: 1326762 - protein, 9 aa, Homo Sapiens
EQVQHTCQA

SEQ ID NO: 1326763 - protein, 9 aa, Homo Sapiens
LAHSAIFSV

SEQ ID NO: 1326764 - protein, 9 aa, Homo Sapiens
VVPRGQEAP

SEQ ID NO: 1326765 - protein, 9 aa, Homo Sapiens
REELLKKCS

SEQ ID NO: 1326766 - protein, 9 aa, Homo Sapiens
SHCVLLLLH

SEQ ID NO: 1326767 - protein, 9 aa, Homo Sapiens
PSVICEHIK

SEQ ID NO: 1326768 - protein, 9 aa, Homo Sapiens
GHDPEADVW

SEQ ID NO: 1326769 - protein, 9 aa, Homo Sapiens
PLPLIFQVA

SEQ ID NO: 1326770 - protein, 9 aa, Homo Sapiens
CQISKQGMS

SEQ ID NO: 1326771 - protein, 9 aa, Homo Sapiens
ESLIQLTQG

SEQ ID NO: 1326772 - protein, 9 aa, Homo Sapiens
FNPEHFWMP

SEQ ID NO: 1326773 - protein, 9 aa, Homo Sapiens
FARVMEQCL

SEQ ID NO: 1326774 - protein, 9 aa, Homo Sapiens
EAEEENTDK

SEQ ID NO: 1326775 - protein, 9 aa, Homo Sapiens
RSKGNNKHI

SEQ ID NO: 1326776 - protein, 9 aa, Homo Sapiens
RHYLNELKW

SEQ ID NO: 1326777 - protein, 9 aa, Homo Sapiens
PSVPHCQIQ

SEQ ID NO: 1326778 - protein, 9 aa, Homo Sapiens
PPPGLQRPD

SEQ ID NO: 1326779 - protein, 9 aa, Homo Sapiens
RIPGQANLV

SEQ ID NO: 1326780 - protein, 9 aa, Homo Sapiens
KFMEGPLFG

SEQ ID NO: 1326781 - protein, 9 aa, Homo Sapiens
NGMGLECGH

SEQ ID NO: 1326782 - protein, 9 aa, Homo Sapiens
ENTKVFVWP

SEQ ID NO: 1326783 - protein, 9 aa, Homo Sapiens
YPTLRNHRS

SEQ ID NO: 1326784 - protein, 9 aa, Homo Sapiens
STNRSLEES

SEQ ID NO: 1326785 - protein, 9 aa, Homo Sapiens
AQNPPIFPP

SEQ ID NO: 1326786 - protein, 9 aa, Homo Sapiens
GGQKQRMSL

SEQ ID NO: 1326787 - protein, 9 aa, Homo Sapiens
LFPEVQRLE

SEQ ID NO: 1326788 - protein, 9 aa, Homo Sapiens
RAIYTIMCW

SEQ ID NO: 1326789 - protein, 9 aa, Homo Sapiens
LLYFTFYII

SEQ ID NO: 1326790 - protein, 9 aa, Homo Sapiens
SASQVSCFS

SEQ ID NO: 1326791 - protein, 9 aa, Homo Sapiens
KPYECSECD

SEQ ID NO: 1326792 - protein, 9 aa, Homo Sapiens
YHNNSPKWS

SEQ ID NO: 1326793 - protein, 9 aa, Homo Sapiens
SDFHRNRKS

SEQ ID NO: 1326794 - protein, 9 aa, Homo Sapiens
NHSLISSYN

SEQ ID NO: 1326795 - protein, 9 aa, Homo Sapiens
ESKKFRLPK

SEQ ID NO: 1326796 - protein, 9 aa, Homo Sapiens
CRDSAKERV

SEQ ID NO: 1326797 - protein, 9 aa, Homo Sapiens
YNVLTNWLT

SEQ ID NO: 1326798 - protein, 9 aa, Homo Sapiens
LSMKSSLEN

SEQ ID NO: 1326799 - protein, 9 aa, Homo Sapiens
VPKGKQDIT

SEQ ID NO: 1326800 - protein, 9 aa, Homo Sapiens
LPVPSFEGY

SEQ ID NO: 1326801 - protein, 9 aa, Homo Sapiens
SAKLVANMF

SEQ ID NO: 1326802 - protein, 9 aa, Homo Sapiens
GLNIFLEKN

SEQ ID NO: 1326803 - protein, 9 aa, Homo Sapiens
ASTWTVRSA

SEQ ID NO: 1326804 - protein, 9 aa, Homo Sapiens
SPQPKCWQQ

SEQ ID NO: 1326805 - protein, 9 aa, Homo Sapiens
GRSRLSVRN

SEQ ID NO: 1326806 - protein, 9 aa, Homo Sapiens
ERTLVLYLV

SEQ ID NO: 1326807 - protein, 9 aa, Homo Sapiens
SLPHPCQME

SEQ ID NO: 1326808 - protein, 9 aa, Homo Sapiens
CKELEWLTS

SEQ ID NO: 1326809 - protein, 9 aa, Homo Sapiens
SDKDGSIVG

SEQ ID NO: 1326810 - protein, 9 aa, Homo Sapiens
ISRHETMGS

SEQ ID NO: 1326811 - protein, 9 aa, Homo Sapiens
HLVGPVMMV

SEQ ID NO: 1326812 - protein, 9 aa, Homo Sapiens
VGRCSTGAR

SEQ ID NO: 1326813 - protein, 9 aa, Homo Sapiens
RQGYRTASI

SEQ ID NO: 1326814 - protein, 9 aa, Homo Sapiens
GYQFTSCSK

SEQ ID NO: 1326815 - protein, 9 aa, Homo Sapiens
PKKIHILHK

SEQ ID NO: 1326816 - protein, 9 aa, Homo Sapiens
RSASDSVTG

SEQ ID NO: 1326817 - protein, 9 aa, Homo Sapiens
GSPVTATSH

SEQ ID NO: 1326818 - protein, 9 aa, Homo Sapiens
PKCWQQDMS

SEQ ID NO: 1326819 - protein, 9 aa, Homo Sapiens
IPQGPLAVP

SEQ ID NO: 1326820 - protein, 9 aa, Homo Sapiens
VINITSMLG

SEQ ID NO: 1326821 - protein, 9 aa, Homo Sapiens
YEHFSKYMP

SEQ ID NO: 1326822 - protein, 9 aa, Homo Sapiens
DSHLKRRQF

SEQ ID NO: 1326823 - protein, 9 aa, Homo Sapiens
FAAINASYV

SEQ ID NO: 1326824 - protein, 9 aa, Homo Sapiens
PGHALSCRT

SEQ ID NO: 1326825 - protein, 9 aa, Homo Sapiens
STWDTSSNT

SEQ ID NO: 1326826 - protein, 9 aa, Homo Sapiens
RTLRLQRFF

SEQ ID NO: 1326827 - protein, 9 aa, Homo Sapiens
VTQLKECLN

SEQ ID NO: 1326828 - protein, 9 aa, Homo Sapiens
PKMSNANFA

SEQ ID NO: 1326829 - protein, 9 aa, Homo Sapiens
LEESPYTPP

SEQ ID NO: 1326830 - protein, 9 aa, Homo Sapiens
PTFSGEEAK

SEQ ID NO: 1326831 - protein, 9 aa, Homo Sapiens
VLEYTIKCN

SEQ ID NO: 1326832 - protein, 9 aa, Homo Sapiens
AVLIVIFSL

SEQ ID NO: 1326833 - protein, 9 aa, Homo Sapiens
HLSLKAKRV

SEQ ID NO: 1326834 - protein, 9 aa, Homo Sapiens
LKKNKKQCM

SEQ ID NO: 1326835 - protein, 9 aa, Homo Sapiens
YIIHLAEQP

SEQ ID NO: 1326836 - protein, 9 aa, Homo Sapiens
HSSRNWPSH

SEQ ID NO: 1326837 - protein, 9 aa, Homo Sapiens
AEEGHKIYL

SEQ ID NO: 1326838 - protein, 9 aa, Homo Sapiens
SNFTLLVEN

SEQ ID NO: 1326839 - protein, 9 aa, Homo Sapiens
YKCVFSVGT

SEQ ID NO: 1326840 - protein, 9 aa, Homo Sapiens
SFEGRHDSV

SEQ ID NO: 1326841 - protein, 9 aa, Homo Sapiens
PTYTPRECF

SEQ ID NO: 1326842 - protein, 9 aa, Homo Sapiens
RRPYLRVPC

SEQ ID NO: 1326843 - protein, 9 aa, Homo Sapiens
ARHQAEKMG

SEQ ID NO: 1326844 - protein, 9 aa, Homo Sapiens
QEDFPPHIV

SEQ ID NO: 1326845 - protein, 9 aa, Homo Sapiens
LMYATSQYM

SEQ ID NO: 1326846 - protein, 9 aa, Homo Sapiens
GTIEERAQR

SEQ ID NO: 1326847 - protein, 9 aa, Homo Sapiens
CMRHVKEMD

SEQ ID NO: 1326848 - protein, 9 aa, Homo Sapiens
ICLLSVFQV

SEQ ID NO: 1326849 - protein, 9 aa, Homo Sapiens
DEEKCHSIR

SEQ ID NO: 1326850 - protein, 9 aa, Homo Sapiens
VVDVEEIVD

SEQ ID NO: 1326851 - protein, 9 aa, Homo Sapiens
YSFGIFLYI

SEQ ID NO: 1326852 - protein, 9 aa, Homo Sapiens
GKIKETYFD

SEQ ID NO: 1326853 - protein, 9 aa, Homo Sapiens
ANVEPKTEP

SEQ ID NO: 1326854 - protein, 9 aa, Homo Sapiens
ATYQMAVEL

SEQ ID NO: 1326855 - protein, 9 aa, Homo Sapiens
DYVTVKQSG

SEQ ID NO: 1326856 - protein, 9 aa, Homo Sapiens
GVVTLPAPP

SEQ ID NO: 1326857 - protein, 9 aa, Homo Sapiens
FDLVTNDGI

SEQ ID NO: 1326858 - protein, 9 aa, Homo Sapiens
KKKEMPEIL

SEQ ID NO: 1326859 - protein, 9 aa, Homo Sapiens
VVSKSKVPH

SEQ ID NO: 1326860 - protein, 9 aa, Homo Sapiens
EDSSPLLCC

SEQ ID NO: 1326861 - protein, 9 aa, Homo Sapiens
CAIHAKCVT

SEQ ID NO: 1326862 - protein, 9 aa, Homo Sapiens
KGSYMRCDH

SEQ ID NO: 1326863 - protein, 9 aa, Homo Sapiens
ELTIHNRGK

SEQ ID NO: 1326864 - protein, 9 aa, Homo Sapiens
PISELIYIH

SEQ ID NO: 1326865 - protein, 9 aa, Homo Sapiens
PGPHDDFVA

SEQ ID NO: 1326866 - protein, 9 aa, Homo Sapiens
RTEVVFSEE

SEQ ID NO: 1326867 - protein, 9 aa, Homo Sapiens
NTVAGLNQV

SEQ ID NO: 1326868 - protein, 9 aa, Homo Sapiens
TKWVALPET

SEQ ID NO: 1326869 - protein, 9 aa, Homo Sapiens
WTYASTSGK

SEQ ID NO: 1326870 - protein, 9 aa, Homo Sapiens
APQACSPER

SEQ ID NO: 1326871 - protein, 9 aa, Homo Sapiens
GGDTGSTGP

SEQ ID NO: 1326872 - protein, 9 aa, Homo Sapiens
TPPNIYEGG

SEQ ID NO: 1326873 - protein, 9 aa, Homo Sapiens
DYMCQAGEV

SEQ ID NO: 1326874 - protein, 9 aa, Homo Sapiens
ECHTSNSQG

SEQ ID NO: 1326875 - protein, 9 aa, Homo Sapiens
EKQVSSSRT

SEQ ID NO: 1326876 - protein, 9 aa, Homo Sapiens
IHIGTGCLV

SEQ ID NO: 1326877 - protein, 9 aa, Homo Sapiens
CRKTQSNIH

SEQ ID NO: 1326878 - protein, 9 aa, Homo Sapiens
SKSKEMPQL

SEQ ID NO: 1326879 - protein, 9 aa, Homo Sapiens
LAACWVQGM

SEQ ID NO: 1326880 - protein, 9 aa, Homo Sapiens
AGSPSLVKT

SEQ ID NO: 1326881 - protein, 9 aa, Homo Sapiens
FQPFLTSTN

SEQ ID NO: 1326882 - protein, 9 aa, Homo Sapiens
TCAVASNTT

SEQ ID NO: 1326883 - protein, 9 aa, Homo Sapiens
GFPGIKGKA

SEQ ID NO: 1326884 - protein, 9 aa, Homo Sapiens
EFLVLLVDV

SEQ ID NO: 1326885 - protein, 9 aa, Homo Sapiens
SQWSQYLAI

SEQ ID NO: 1326886 - protein, 9 aa, Homo Sapiens
WARCCASTW

SEQ ID NO: 1326887 - protein, 9 aa, Homo Sapiens
DVLMAATHA

SEQ ID NO: 1326888 - protein, 9 aa, Homo Sapiens
GREFICLGS

SEQ ID NO: 1326889 - protein, 9 aa, Homo Sapiens
DCNNCRCLD

SEQ ID NO: 1326890 - protein, 9 aa, Homo Sapiens
RCQPKKPAL

SEQ ID NO: 1326891 - protein, 9 aa, Homo Sapiens
VLCLLKLVT

SEQ ID NO: 1326892 - protein, 9 aa, Homo Sapiens
VLEHHMNPS

SEQ ID NO: 1326893 - protein, 9 aa, Homo Sapiens
STCNFQAII

SEQ ID NO: 1326894 - protein, 9 aa, Homo Sapiens
TMMGLRYSA

SEQ ID NO: 1326895 - protein, 9 aa, Homo Sapiens
VVRVITFTG

SEQ ID NO: 1326896 - protein, 9 aa, Homo Sapiens
EVLLRQGHD

SEQ ID NO: 1326897 - protein, 9 aa, Homo Sapiens
DVGSSEDLK

SEQ ID NO: 1326898 - protein, 9 aa, Homo Sapiens
KSRGFTFVT

SEQ ID NO: 1326899 - protein, 9 aa, Homo Sapiens
GEANDGEGS

SEQ ID NO: 1326900 - protein, 9 aa, Homo Sapiens
LLPFMQACK

SEQ ID NO: 1326901 - protein, 9 aa, Homo Sapiens
FQAHVREQL

SEQ ID NO: 1326902 - protein, 9 aa, Homo Sapiens
PNLRRFDFT

SEQ ID NO: 1326903 - protein, 9 aa, Homo Sapiens
LYVKRHRNV

SEQ ID NO: 1326904 - protein, 9 aa, Homo Sapiens
VIELKSGSN

SEQ ID NO: 1326905 - protein, 9 aa, Homo Sapiens
LDTVRQETN

SEQ ID NO: 1326906 - protein, 9 aa, Homo Sapiens
NAVSVQSWF

SEQ ID NO: 1326907 - protein, 9 aa, Homo Sapiens
SQKTTLLCH

SEQ ID NO: 1326908 - protein, 9 aa, Homo Sapiens
TPKGISRSQ

SEQ ID NO: 1326909 - protein, 9 aa, Homo Sapiens
DVDHISSRL

SEQ ID NO: 1326910 - protein, 9 aa, Homo Sapiens
DDKSPLHMT

SEQ ID NO: 1326911 - protein, 9 aa, Homo Sapiens
GKKSGDSGR

SEQ ID NO: 1326912 - protein, 9 aa, Homo Sapiens
EIGPKCDPA

SEQ ID NO: 1326913 - protein, 9 aa, Homo Sapiens
KWYISPRLL

SEQ ID NO: 1326914 - protein, 9 aa, Homo Sapiens
ARTKMKHMR

SEQ ID NO: 1326915 - protein, 9 aa, Homo Sapiens
IKKRMAKPK

SEQ ID NO: 1326916 - protein, 9 aa, Homo Sapiens
DEDRFRFVW

SEQ ID NO: 1326917 - protein, 9 aa, Homo Sapiens
LSEDHNGKS

SEQ ID NO: 1326918 - protein, 9 aa, Homo Sapiens
DTQAHLGVS

SEQ ID NO: 1326919 - protein, 9 aa, Homo Sapiens
MKTRFLIFG

SEQ ID NO: 1326920 - protein, 9 aa, Homo Sapiens
DIEWRDRHI

SEQ ID NO: 1326921 - protein, 9 aa, Homo Sapiens
MVLPSRRLT

SEQ ID NO: 1326922 - protein, 9 aa, Homo Sapiens
IFEKIYLAP

SEQ ID NO: 1326923 - protein, 9 aa, Homo Sapiens
IFVQRVLCR

SEQ ID NO: 1326924 - protein, 9 aa, Homo Sapiens
SFDTLLADL

SEQ ID NO: 1326925 - protein, 9 aa, Homo Sapiens
QFPCHWSWV

SEQ ID NO: 1326926 - protein, 9 aa, Homo Sapiens
KSHFILHQR

SEQ ID NO: 1326927 - protein, 9 aa, Homo Sapiens
DKPPYSQKE

SEQ ID NO: 1326928 - protein, 9 aa, Homo Sapiens
VPENEEDTS

SEQ ID NO: 1326929 - protein, 9 aa, Homo Sapiens
LSHQPGSEA

SEQ ID NO: 1326930 - protein, 9 aa, Homo Sapiens
LFTIYSILS

SEQ ID NO: 1326931 - protein, 9 aa, Homo Sapiens
TGIWGFVNK

SEQ ID NO: 1326932 - protein, 9 aa, Homo Sapiens
KWVGIPAAR

SEQ ID NO: 1326933 - protein, 9 aa, Homo Sapiens
VFHSSLHES

SEQ ID NO: 1326934 - protein, 9 aa, Homo Sapiens
NDNVSCRLE

SEQ ID NO: 1326935 - protein, 9 aa, Homo Sapiens
VLVSCGSSL

SEQ ID NO: 1326936 - protein, 9 aa, Homo Sapiens
ESSLGKEKR

SEQ ID NO: 1326937 - protein, 9 aa, Homo Sapiens
VWSVGFIFF

SEQ ID NO: 1326938 - protein, 9 aa, Homo Sapiens
ASRGYMPSG

SEQ ID NO: 1326939 - protein, 9 aa, Homo Sapiens
LVGFSYQVT

SEQ ID NO: 1326940 - protein, 9 aa, Homo Sapiens
VEAGEAGQA

SEQ ID NO: 1326941 - protein, 9 aa, Homo Sapiens
MSWSPDQER

SEQ ID NO: 1326942 - protein, 9 aa, Homo Sapiens
LLCVVYFLS

SEQ ID NO: 1326943 - protein, 9 aa, Homo Sapiens
GCALPLEAR

SEQ ID NO: 1326944 - protein, 9 aa, Homo Sapiens
LLLTRTIGD

SEQ ID NO: 1326945 - protein, 9 aa, Homo Sapiens
MLSPLIYSL

SEQ ID NO: 1326946 - protein, 9 aa, Homo Sapiens
NKMLSNVVE

SEQ ID NO: 1326947 - protein, 9 aa, Homo Sapiens
PSIKYYLDN

SEQ ID NO: 1326948 - protein, 9 aa, Homo Sapiens
SQEPDFHIA

SEQ ID NO: 1326949 - protein, 9 aa, Homo Sapiens
TRGTAEWMS

SEQ ID NO: 1326950 - protein, 9 aa, Homo Sapiens
LGPLDGQDS

SEQ ID NO: 1326951 - protein, 9 aa, Homo Sapiens
RNRENVMGD

SEQ ID NO: 1326952 - protein, 9 aa, Homo Sapiens
KSDGTRVLP

SEQ ID NO: 1326953 - protein, 9 aa, Homo Sapiens
SGTHDYLGL

SEQ ID NO: 1326954 - protein, 9 aa, Homo Sapiens
DGERSFRGS

SEQ ID NO: 1326955 - protein, 9 aa, Homo Sapiens
IFPRDLNLM

SEQ ID NO: 1326956 - protein, 9 aa, Homo Sapiens
PVYESDKNK

SEQ ID NO: 1326957 - protein, 9 aa, Homo Sapiens
SIVVIVFFV

SEQ ID NO: 1326958 - protein, 9 aa, Homo Sapiens
IRDPPEDVL

SEQ ID NO: 1326959 - protein, 9 aa, Homo Sapiens
KYWEMKQAF

SEQ ID NO: 1326960 - protein, 9 aa, Homo Sapiens
GLEDYFSEV

SEQ ID NO: 1326961 - protein, 9 aa, Homo Sapiens
DTLIIGNCN

SEQ ID NO: 1326962 - protein, 9 aa, Homo Sapiens
GPKCDPATL

SEQ ID NO: 1326963 - protein, 9 aa, Homo Sapiens
KTPITIEIE

SEQ ID NO: 1326964 - protein, 9 aa, Homo Sapiens
YEKNDNGAS

SEQ ID NO: 1326965 - protein, 9 aa, Homo Sapiens
VTESIQVCK

SEQ ID NO: 1326966 - protein, 9 aa, Homo Sapiens
DPMWGGPMR

SEQ ID NO: 1326967 - protein, 9 aa, Homo Sapiens
LGSIWLMFP

SEQ ID NO: 1326968 - protein, 9 aa, Homo Sapiens
LPSSSSSES

SEQ ID NO: 1326969 - protein, 9 aa, Homo Sapiens
AGHHRVMNQ

SEQ ID NO: 1326970 - protein, 9 aa, Homo Sapiens
VENTKLYLD

SEQ ID NO: 1326971 - protein, 9 aa, Homo Sapiens
GIGVRAGRD

SEQ ID NO: 1326972 - protein, 9 aa, Homo Sapiens
IVATANALD

SEQ ID NO: 1326973 - protein, 9 aa, Homo Sapiens
TSDMSSRMV

SEQ ID NO: 1326974 - protein, 9 aa, Homo Sapiens
RAAGVLCHQ

SEQ ID NO: 1326975 - protein, 9 aa, Homo Sapiens
SLIAHVHQH

SEQ ID NO: 1326976 - protein, 9 aa, Homo Sapiens
SNNLVLSCP

SEQ ID NO: 1326977 - protein, 9 aa, Homo Sapiens
IISVKTCSE

SEQ ID NO: 1326978 - protein, 9 aa, Homo Sapiens
PELWGPMDT

SEQ ID NO: 1326979 - protein, 9 aa, Homo Sapiens
YRLMNSSIY

SEQ ID NO: 1326980 - protein, 9 aa, Homo Sapiens
HNDDTLLKN

SEQ ID NO: 1326981 - protein, 9 aa, Homo Sapiens
GRVPHQVQG

SEQ ID NO: 1326982 - protein, 9 aa, Homo Sapiens
LAPLQVTTT

SEQ ID NO: 1326983 - protein, 9 aa, Homo Sapiens
ASSYVFYWW

SEQ ID NO: 1326984 - protein, 9 aa, Homo Sapiens
PDYQHYLRM

SEQ ID NO: 1326985 - protein, 9 aa, Homo Sapiens
TGESCTMWG

SEQ ID NO: 1326986 - protein, 9 aa, Homo Sapiens
ELDKEAAVA

SEQ ID NO: 1326987 - protein, 9 aa, Homo Sapiens
TKDLDRIFR

SEQ ID NO: 1326988 - protein, 9 aa, Homo Sapiens
DDTVSIESG

SEQ ID NO: 1326989 - protein, 9 aa, Homo Sapiens
FYDICKLSY

SEQ ID NO: 1326990 - protein, 9 aa, Homo Sapiens
ERKQLMIYE

SEQ ID NO: 1326991 - protein, 9 aa, Homo Sapiens
IVGFTVLSA

SEQ ID NO: 1326992 - protein, 9 aa, Homo Sapiens
ILKQLVILL

SEQ ID NO: 1326993 - protein, 9 aa, Homo Sapiens
VQVYPDDIR

SEQ ID NO: 1326994 - protein, 9 aa, Homo Sapiens
SSTTTDGNI

SEQ ID NO: 1326995 - protein, 9 aa, Homo Sapiens
HLYIIHLAE

SEQ ID NO: 1326996 - protein, 9 aa, Homo Sapiens
IQRANLVES

SEQ ID NO: 1326997 - protein, 9 aa, Homo Sapiens
FKKFRENML

SEQ ID NO: 1326998 - protein, 9 aa, Homo Sapiens
GEILPTPGQ

SEQ ID NO: 1326999 - protein, 9 aa, Homo Sapiens
SLDPVSQDM

SEQ ID NO: 1327000 - protein, 9 aa, Homo Sapiens
RQQLSASAN

SEQ ID NO: 1327001 - protein, 9 aa, Homo Sapiens
ACVSLLRQG

SEQ ID NO: 1327002 - protein, 9 aa, Homo Sapiens
VASPLREST

SEQ ID NO: 1327003 - protein, 9 aa, Homo Sapiens
FVDFTPQCL

SEQ ID NO: 1327004 - protein, 9 aa, Homo Sapiens
VNPFNNITV

SEQ ID NO: 1327005 - protein, 9 aa, Homo Sapiens
CQKSSTKLS

SEQ ID NO: 1327006 - protein, 9 aa, Homo Sapiens
TSKAYNNQP

SEQ ID NO: 1327007 - protein, 9 aa, Homo Sapiens
LSKVVRHFH

SEQ ID NO: 1327008 - protein, 9 aa, Homo Sapiens
KSKLNRSKH

SEQ ID NO: 1327009 - protein, 9 aa, Homo Sapiens
RCDHKMEVA

SEQ ID NO: 1327010 - protein, 9 aa, Homo Sapiens
LQTTIEKLR

SEQ ID NO: 1327011 - protein, 9 aa, Homo Sapiens
YIAILSIIQ

SEQ ID NO: 1327012 - protein, 9 aa, Homo Sapiens
QDELKCSAM

SEQ ID NO: 1327013 - protein, 9 aa, Homo Sapiens
CSAMRAVAA

SEQ ID NO: 1327014 - protein, 9 aa, Homo Sapiens
FQQPYITNH

SEQ ID NO: 1327015 - protein, 9 aa, Homo Sapiens
FKEVVQYVL

SEQ ID NO: 1327016 - protein, 9 aa, Homo Sapiens
YIEKSFLME

SEQ ID NO: 1327017 - protein, 9 aa, Homo Sapiens
LKVSADGHP

SEQ ID NO: 1327018 - protein, 9 aa, Homo Sapiens
IQDAFDIYT

SEQ ID NO: 1327019 - protein, 9 aa, Homo Sapiens
VSAVVHKYA

SEQ ID NO: 1327020 - protein, 9 aa, Homo Sapiens
WNEIYGNKL

SEQ ID NO: 1327021 - protein, 9 aa, Homo Sapiens
FLGSFLLAG

SEQ ID NO: 1327022 - protein, 9 aa, Homo Sapiens
CVFRLITDN

SEQ ID NO: 1327023 - protein, 9 aa, Homo Sapiens
QLWEQSEQL

SEQ ID NO: 1327024 - protein, 9 aa, Homo Sapiens
QRAGFGTEA

SEQ ID NO: 1327025 - protein, 9 aa, Homo Sapiens
NFQVMIMVS

SEQ ID NO: 1327026 - protein, 9 aa, Homo Sapiens
FWERSQQRE

SEQ ID NO: 1327027 - protein, 9 aa, Homo Sapiens
PPHDTLCLT

SEQ ID NO: 1327028 - protein, 9 aa, Homo Sapiens
RGVGLGPVL

SEQ ID NO: 1327029 - protein, 9 aa, Homo Sapiens
KYMQKLFQR

SEQ ID NO: 1327030 - protein, 9 aa, Homo Sapiens
TWMRPKKCP

SEQ ID NO: 1327031 - protein, 9 aa, Homo Sapiens
NEPYHENVE

SEQ ID NO: 1327032 - protein, 9 aa, Homo Sapiens
KWGESLRVD

SEQ ID NO: 1327033 - protein, 9 aa, Homo Sapiens
MSSSGHLFT

SEQ ID NO: 1327034 - protein, 9 aa, Homo Sapiens
PVVYTLINA

SEQ ID NO: 1327035 - protein, 9 aa, Homo Sapiens
TQIFLDNCF

SEQ ID NO: 1327036 - protein, 9 aa, Homo Sapiens
VMMATVMGS

SEQ ID NO: 1327037 - protein, 9 aa, Homo Sapiens
PHRRRLAVP

SEQ ID NO: 1327038 - protein, 9 aa, Homo Sapiens
ASMDSAKRW

SEQ ID NO: 1327039 - protein, 9 aa, Homo Sapiens
DDMNDKFTV

SEQ ID NO: 1327040 - protein, 9 aa, Homo Sapiens
GRGSLRKWR

SEQ ID NO: 1327041 - protein, 9 aa, Homo Sapiens
CLKVSADGH

SEQ ID NO: 1327042 - protein, 9 aa, Homo Sapiens
WASLYPTQR

SEQ ID NO: 1327043 - protein, 9 aa, Homo Sapiens
RSVLGFMVQ

SEQ ID NO: 1327044 - protein, 9 aa, Homo Sapiens
TQEYKKDPD

SEQ ID NO: 1327045 - protein, 9 aa, Homo Sapiens
RAEVDLEHT

SEQ ID NO: 1327046 - protein, 9 aa, Homo Sapiens
IGSSKINAA

SEQ ID NO: 1327047 - protein, 9 aa, Homo Sapiens
KIDLQRETV

SEQ ID NO: 1327048 - protein, 9 aa, Homo Sapiens
DAMPLIRPE

SEQ ID NO: 1327049 - protein, 9 aa, Homo Sapiens
LYINARELW

SEQ ID NO: 1327050 - protein, 9 aa, Homo Sapiens
CPTASRPTT

SEQ ID NO: 1327051 - protein, 9 aa, Homo Sapiens
DLGAMTSEC

SEQ ID NO: 1327052 - protein, 9 aa, Homo Sapiens
GGNKKFFGG

SEQ ID NO: 1327053 - protein, 9 aa, Homo Sapiens
SKSHRSQTH

SEQ ID NO: 1327054 - protein, 9 aa, Homo Sapiens
GPLKDMPSS

SEQ ID NO: 1327055 - protein, 9 aa, Homo Sapiens
MEAMQDEFL

SEQ ID NO: 1327056 - protein, 9 aa, Homo Sapiens
PPKDDTAIV

SEQ ID NO: 1327057 - protein, 9 aa, Homo Sapiens
HVDLHLLNH

SEQ ID NO: 1327058 - protein, 9 aa, Homo Sapiens
SCNRIAENL

SEQ ID NO: 1327059 - protein, 9 aa, Homo Sapiens
VHKNSTKAS

SEQ ID NO: 1327060 - protein, 9 aa, Homo Sapiens
FDRQAPGHI

SEQ ID NO: 1327061 - protein, 9 aa, Homo Sapiens
VDPKNIDTT

SEQ ID NO: 1327062 - protein, 9 aa, Homo Sapiens
VIISDALEQ

SEQ ID NO: 1327063 - protein, 9 aa, Homo Sapiens
EDRDQDLFL

SEQ ID NO: 1327064 - protein, 9 aa, Homo Sapiens
CGTRANAKM

SEQ ID NO: 1327065 - protein, 9 aa, Homo Sapiens
HRSEPIYNS

SEQ ID NO: 1327066 - protein, 9 aa, Homo Sapiens
CSPAPPPPA

SEQ ID NO: 1327067 - protein, 9 aa, Homo Sapiens
RGATELYRI

SEQ ID NO: 1327068 - protein, 9 aa, Homo Sapiens
SKVQTDVTM

SEQ ID NO: 1327069 - protein, 9 aa, Homo Sapiens
TNLRLFYDI

SEQ ID NO: 1327070 - protein, 9 aa, Homo Sapiens
ADLGLVVKH

SEQ ID NO: 1327071 - protein, 9 aa, Homo Sapiens
DQHEQICMR

SEQ ID NO: 1327072 - protein, 9 aa, Homo Sapiens
SLPPPPALE

SEQ ID NO: 1327073 - protein, 9 aa, Homo Sapiens
DWLQADMMD

SEQ ID NO: 1327074 - protein, 9 aa, Homo Sapiens
VHVYEQVRA

SEQ ID NO: 1327075 - protein, 9 aa, Homo Sapiens
PASLSGGGM

SEQ ID NO: 1327076 - protein, 9 aa, Homo Sapiens
HLRGEAVHC

SEQ ID NO: 1327077 - protein, 9 aa, Homo Sapiens
MPETYQVRL

SEQ ID NO: 1327078 - protein, 9 aa, Homo Sapiens
VLYHISMIP

SEQ ID NO: 1327079 - protein, 9 aa, Homo Sapiens
YWDLHTSVR

SEQ ID NO: 1327080 - protein, 9 aa, Homo Sapiens
EDFIFHPVS

SEQ ID NO: 1327081 - protein, 9 aa, Homo Sapiens
YAHEYDSGT

SEQ ID NO: 1327082 - protein, 9 aa, Homo Sapiens
LHNFLEGDW

SEQ ID NO: 1327083 - protein, 9 aa, Homo Sapiens
SVDKSVGQV

SEQ ID NO: 1327084 - protein, 9 aa, Homo Sapiens
ISPKSTGSI

SEQ ID NO: 1327085 - protein, 9 aa, Homo Sapiens
VPLVLEKAS

SEQ ID NO: 1327086 - protein, 9 aa, Homo Sapiens
PHIKAVTQK

SEQ ID NO: 1327087 - protein, 9 aa, Homo Sapiens
QDTQNVLKN

SEQ ID NO: 1327088 - protein, 9 aa, Homo Sapiens
MVHYTSKDM

SEQ ID NO: 1327089 - protein, 9 aa, Homo Sapiens
CPLLLVYIM

SEQ ID NO: 1327090 - protein, 9 aa, Homo Sapiens
VPKTSTSRT

SEQ ID NO: 1327091 - protein, 9 aa, Homo Sapiens
RIHQEIQEL

SEQ ID NO: 1327092 - protein, 9 aa, Homo Sapiens
FERLHRLLA

SEQ ID NO: 1327093 - protein, 9 aa, Homo Sapiens
LHRLIMMIK

SEQ ID NO: 1327094 - protein, 9 aa, Homo Sapiens
SNCKEPVIA

SEQ ID NO: 1327095 - protein, 9 aa, Homo Sapiens
KQKRKKKEM

SEQ ID NO: 1327096 - protein, 9 aa, Homo Sapiens
EADPFVNGC

SEQ ID NO: 1327097 - protein, 9 aa, Homo Sapiens
IAEKRQLQE

SEQ ID NO: 1327098 - protein, 9 aa, Homo Sapiens
TTTIPSCPE

SEQ ID NO: 1327099 - protein, 9 aa, Homo Sapiens
FVSMRVMIE

SEQ ID NO: 1327100 - protein, 9 aa, Homo Sapiens
SRECSPAPP

SEQ ID NO: 1327101 - protein, 9 aa, Homo Sapiens
PTAIKKTIL

SEQ ID NO: 1327102 - protein, 9 aa, Homo Sapiens
RLDLAGWEL

SEQ ID NO: 1327103 - protein, 9 aa, Homo Sapiens
PNALPSAIQ

SEQ ID NO: 1327104 - protein, 9 aa, Homo Sapiens
KGKSKWEAW

SEQ ID NO: 1327105 - protein, 9 aa, Homo Sapiens
RMERLTKQL

SEQ ID NO: 1327106 - protein, 9 aa, Homo Sapiens
GSKSFNFDH

SEQ ID NO: 1327107 - protein, 9 aa, Homo Sapiens
DVCYAPSCA

SEQ ID NO: 1327108 - protein, 9 aa, Homo Sapiens
CKPDVIAQL

SEQ ID NO: 1327109 - protein, 9 aa, Homo Sapiens
ALTHTKPSA

SEQ ID NO: 1327110 - protein, 9 aa, Homo Sapiens
HLGVFCFSQ

SEQ ID NO: 1327111 - protein, 9 aa, Homo Sapiens
SVWPGHQEV

SEQ ID NO: 1327112 - protein, 9 aa, Homo Sapiens
ELVNTGCDQ

SEQ ID NO: 1327113 - protein, 9 aa, Homo Sapiens
KIAVIAEKL

SEQ ID NO: 1327114 - protein, 9 aa, Homo Sapiens
HFYSCDRFG

SEQ ID NO: 1327115 - protein, 9 aa, Homo Sapiens
LVEVHRLYV

SEQ ID NO: 1327116 - protein, 9 aa, Homo Sapiens
FGMCVNTLF

SEQ ID NO: 1327117 - protein, 9 aa, Homo Sapiens
YTVLHHLGH

SEQ ID NO: 1327118 - protein, 9 aa, Homo Sapiens
PKKKPSVMP

SEQ ID NO: 1327119 - protein, 9 aa, Homo Sapiens
VLHHLGHPE

SEQ ID NO: 1327120 - protein, 9 aa, Homo Sapiens
GRTGENRNH

SEQ ID NO: 1327121 - protein, 9 aa, Homo Sapiens
EMPHTREKP

SEQ ID NO: 1327122 - protein, 9 aa, Homo Sapiens
DRAFKSSHN

SEQ ID NO: 1327123 - protein, 9 aa, Homo Sapiens
SLKTLEARE

SEQ ID NO: 1327124 - protein, 9 aa, Homo Sapiens
SPGEGANPQ

SEQ ID NO: 1327125 - protein, 9 aa, Homo Sapiens
KMGHFQVRG

SEQ ID NO: 1327126 - protein, 9 aa, Homo Sapiens
CWHPYTNTA

SEQ ID NO: 1327127 - protein, 9 aa, Homo Sapiens
CGCTPARSP

SEQ ID NO: 1327128 - protein, 9 aa, Homo Sapiens
HIPLHPKHW

SEQ ID NO: 1327129 - protein, 9 aa, Homo Sapiens
WNAAWHKHG

SEQ ID NO: 1327130 - protein, 9 aa, Homo Sapiens
SMSSAHKVS

SEQ ID NO: 1327131 - protein, 9 aa, Homo Sapiens
TVFNRHKML

SEQ ID NO: 1327132 - protein, 9 aa, Homo Sapiens
PFLLLNILN

SEQ ID NO: 1327133 - protein, 9 aa, Homo Sapiens
TPQSEPREG

SEQ ID NO: 1327134 - protein, 9 aa, Homo Sapiens
ISYDRYVAI

SEQ ID NO: 1327135 - protein, 9 aa, Homo Sapiens
RQDECDVSA

SEQ ID NO: 1327136 - protein, 9 aa, Homo Sapiens
QVYYDTIKY

SEQ ID NO: 1327137 - protein, 9 aa, Homo Sapiens
RKMVCSIPE

SEQ ID NO: 1327138 - protein, 9 aa, Homo Sapiens
IMNQRLCCT

SEQ ID NO: 1327139 - protein, 9 aa, Homo Sapiens
ALLLGGTAI

SEQ ID NO: 1327140 - protein, 9 aa, Homo Sapiens
IENAKCQCA

SEQ ID NO: 1327141 - protein, 9 aa, Homo Sapiens
PLLLCHGFI

SEQ ID NO: 1327142 - protein, 9 aa, Homo Sapiens
PHRCELAAA

SEQ ID NO: 1327143 - protein, 9 aa, Homo Sapiens
TQNEWASLY

SEQ ID NO: 1327144 - protein, 9 aa, Homo Sapiens
REPLHTIFL

SEQ ID NO: 1327145 - protein, 9 aa, Homo Sapiens
TTLKLLLVF

SEQ ID NO: 1327146 - protein, 9 aa, Homo Sapiens
SLADYITAV

SEQ ID NO: 1327147 - protein, 9 aa, Homo Sapiens
RLYHEGHVK

SEQ ID NO: 1327148 - protein, 9 aa, Homo Sapiens
VGRPSAATR

SEQ ID NO: 1327149 - protein, 9 aa, Homo Sapiens
RPWKTEPPD

SEQ ID NO: 1327150 - protein, 9 aa, Homo Sapiens
EAYETREYI

SEQ ID NO: 1327151 - protein, 9 aa, Homo Sapiens
MLQLCYRVL

SEQ ID NO: 1327152 - protein, 9 aa, Homo Sapiens
QVIEDLVCG

SEQ ID NO: 1327153 - protein, 9 aa, Homo Sapiens
VDFEWECGV

SEQ ID NO: 1327154 - protein, 9 aa, Homo Sapiens
NEIIDMVKE

SEQ ID NO: 1327155 - protein, 9 aa, Homo Sapiens
LDGLYGPIT

SEQ ID NO: 1327156 - protein, 9 aa, Homo Sapiens
GDMCISILH

SEQ ID NO: 1327157 - protein, 9 aa, Homo Sapiens
WDDLCCRSQ

SEQ ID NO: 1327158 - protein, 9 aa, Homo Sapiens
GQILLAVYH

SEQ ID NO: 1327159 - protein, 9 aa, Homo Sapiens
TCNDFLFER

SEQ ID NO: 1327160 - protein, 9 aa, Homo Sapiens
PHSSPDDLK

SEQ ID NO: 1327161 - protein, 9 aa, Homo Sapiens
CAKSKSRSS

SEQ ID NO: 1327162 - protein, 9 aa, Homo Sapiens
VMEGSNMTF

SEQ ID NO: 1327163 - protein, 9 aa, Homo Sapiens
LVTLVIVCA

SEQ ID NO: 1327164 - protein, 9 aa, Homo Sapiens
ITDEMKCMF

SEQ ID NO: 1327165 - protein, 9 aa, Homo Sapiens
MKTHNGEKP

SEQ ID NO: 1327166 - protein, 9 aa, Homo Sapiens
RSALMTAID

SEQ ID NO: 1327167 - protein, 9 aa, Homo Sapiens
TPHAEKRSL

SEQ ID NO: 1327168 - protein, 9 aa, Homo Sapiens
NPFVTSIDD

SEQ ID NO: 1327169 - protein, 9 aa, Homo Sapiens
LADKKDHDA

SEQ ID NO: 1327170 - protein, 9 aa, Homo Sapiens
RGENVAQTP

SEQ ID NO: 1327171 - protein, 9 aa, Homo Sapiens
KDEHILQFL

SEQ ID NO: 1327172 - protein, 9 aa, Homo Sapiens
INARELWIT

SEQ ID NO: 1327173 - protein, 9 aa, Homo Sapiens
KMSNANFAK

SEQ ID NO: 1327174 - protein, 9 aa, Homo Sapiens
MRTVEGGDQ

SEQ ID NO: 1327175 - protein, 9 aa, Homo Sapiens
RKGEKMGHF

SEQ ID NO: 1327176 - protein, 9 aa, Homo Sapiens
FVDLCPTGF

SEQ ID NO: 1327177 - protein, 9 aa, Homo Sapiens
RERKQLMIY

SEQ ID NO: 1327178 - protein, 9 aa, Homo Sapiens
WRVYTVLAV

SEQ ID NO: 1327179 - protein, 9 aa, Homo Sapiens
ELKIKTKKR

SEQ ID NO: 1327180 - protein, 9 aa, Homo Sapiens
DKNEEHEDE

SEQ ID NO: 1327181 - protein, 9 aa, Homo Sapiens
GIKFSTEAL

SEQ ID NO: 1327182 - protein, 9 aa, Homo Sapiens
PKQKGCVAS

SEQ ID NO: 1327183 - protein, 9 aa, Homo Sapiens
ANTMSTHLS

SEQ ID NO: 1327184 - protein, 9 aa, Homo Sapiens
EQERHSQNS

SEQ ID NO: 1327185 - protein, 9 aa, Homo Sapiens
QDILDDLYW

SEQ ID NO: 1327186 - protein, 9 aa, Homo Sapiens
RQSVTDCLM

SEQ ID NO: 1327187 - protein, 9 aa, Homo Sapiens
SVICSILPY

SEQ ID NO: 1327188 - protein, 9 aa, Homo Sapiens
IGGRSLYNW

SEQ ID NO: 1327189 - protein, 9 aa, Homo Sapiens
DSPSPKRQC

SEQ ID NO: 1327190 - protein, 9 aa, Homo Sapiens
RVSNRSLLT

SEQ ID NO: 1327191 - protein, 9 aa, Homo Sapiens
TGNSGAEAV

SEQ ID NO: 1327192 - protein, 9 aa, Homo Sapiens
MIVGINCYH

SEQ ID NO: 1327193 - protein, 9 aa, Homo Sapiens
NKEYVVNEV

SEQ ID NO: 1327194 - protein, 9 aa, Homo Sapiens
ILRDKVYLI

SEQ ID NO: 1327195 - protein, 9 aa, Homo Sapiens
PLPMEQAHY

SEQ ID NO: 1327196 - protein, 9 aa, Homo Sapiens
DGHWHQVDV

SEQ ID NO: 1327197 - protein, 9 aa, Homo Sapiens
EKAAIIEEL

SEQ ID NO: 1327198 - protein, 9 aa, Homo Sapiens
VKNKPPQHL

SEQ ID NO: 1327199 - protein, 9 aa, Homo Sapiens
EVWAAAAHK

SEQ ID NO: 1327200 - protein, 9 aa, Homo Sapiens
MAFINTQLY

SEQ ID NO: 1327201 - protein, 9 aa, Homo Sapiens
IGSDTFNCC

SEQ ID NO: 1327202 - protein, 9 aa, Homo Sapiens
CHNFIYEQS

SEQ ID NO: 1327203 - protein, 9 aa, Homo Sapiens
NDEDWLLLC

SEQ ID NO: 1327204 - protein, 9 aa, Homo Sapiens
YPEESEDIV

SEQ ID NO: 1327205 - protein, 9 aa, Homo Sapiens
TQTFNLEGS

SEQ ID NO: 1327206 - protein, 9 aa, Homo Sapiens
VAPPAFSGR

SEQ ID NO: 1327207 - protein, 9 aa, Homo Sapiens
VLLNQKDLR

SEQ ID NO: 1327208 - protein, 9 aa, Homo Sapiens
LAMSQARFE

SEQ ID NO: 1327209 - protein, 9 aa, Homo Sapiens
SKTGISLNV

SEQ ID NO: 1327210 - protein, 9 aa, Homo Sapiens
ARETEFEAE

SEQ ID NO: 1327211 - protein, 9 aa, Homo Sapiens
QGHPPGSPQ

SEQ ID NO: 1327212 - protein, 9 aa, Homo Sapiens
MEHTPPHLL

SEQ ID NO: 1327213 - protein, 9 aa, Homo Sapiens
ILNQSIKVP

SEQ ID NO: 1327214 - protein, 9 aa, Homo Sapiens
EAFKASHNL

SEQ ID NO: 1327215 - protein, 9 aa, Homo Sapiens
AVEWHVLPI

SEQ ID NO: 1327216 - protein, 9 aa, Homo Sapiens
KPGAEGCPD

SEQ ID NO: 1327217 - protein, 9 aa, Homo Sapiens
EFIECRPVI

SEQ ID NO: 1327218 - protein, 9 aa, Homo Sapiens
ILNQLTGHN

SEQ ID NO: 1327219 - protein, 9 aa, Homo Sapiens
DFPPHIVEH

SEQ ID NO: 1327220 - protein, 9 aa, Homo Sapiens
GSSPEALHH

SEQ ID NO: 1327221 - protein, 9 aa, Homo Sapiens
PQKLQMSPC

SEQ ID NO: 1327222 - protein, 9 aa, Homo Sapiens
SKRCSAKEV

SEQ ID NO: 1327223 - protein, 9 aa, Homo Sapiens
TQDGPFYVI

SEQ ID NO: 1327224 - protein, 9 aa, Homo Sapiens
QETRDMFHL

SEQ ID NO: 1327225 - protein, 9 aa, Homo Sapiens
NLRPVDIDG

SEQ ID NO: 1327226 - protein, 9 aa, Homo Sapiens
HIKALLVLL

SEQ ID NO: 1327227 - protein, 9 aa, Homo Sapiens
VGMHLLNIP

SEQ ID NO: 1327228 - protein, 9 aa, Homo Sapiens
RECFLKGEG

SEQ ID NO: 1327229 - protein, 9 aa, Homo Sapiens
HSQPQSRGR

SEQ ID NO: 1327230 - protein, 9 aa, Homo Sapiens
FTDEPEKEL

SEQ ID NO: 1327231 - protein, 9 aa, Homo Sapiens
VSPYGLNGM

SEQ ID NO: 1327232 - protein, 9 aa, Homo Sapiens
TIKYLRIPN

SEQ ID NO: 1327233 - protein, 9 aa, Homo Sapiens
SLKFSPHPL

SEQ ID NO: 1327234 - protein, 9 aa, Homo Sapiens
PQPPILGYG

SEQ ID NO: 1327235 - protein, 9 aa, Homo Sapiens
KWQIAQLKE

SEQ ID NO: 1327236 - protein, 9 aa, Homo Sapiens
VSHSQYQGG

SEQ ID NO: 1327237 - protein, 9 aa, Homo Sapiens
CHECGTKCP

SEQ ID NO: 1327238 - protein, 9 aa, Homo Sapiens
GLARRPPAH

SEQ ID NO: 1327239 - protein, 9 aa, Homo Sapiens
ACQNIKYLD

SEQ ID NO: 1327240 - protein, 9 aa, Homo Sapiens
LVPASSLTV

SEQ ID NO: 1327241 - protein, 9 aa, Homo Sapiens
VLYQNTHHK

SEQ ID NO: 1327242 - protein, 9 aa, Homo Sapiens
HSLRFTWSM

SEQ ID NO: 1327243 - protein, 9 aa, Homo Sapiens
DGRPWMMNI

SEQ ID NO: 1327244 - protein, 9 aa, Homo Sapiens
LNSTNSWWT

SEQ ID NO: 1327245 - protein, 9 aa, Homo Sapiens
CGGTYQIGT

SEQ ID NO: 1327246 - protein, 9 aa, Homo Sapiens
TYLQLKEIC

SEQ ID NO: 1327247 - protein, 9 aa, Homo Sapiens
NQGYLSEVG

SEQ ID NO: 1327248 - protein, 9 aa, Homo Sapiens
IFKRDDSDV

SEQ ID NO: 1327249 - protein, 9 aa, Homo Sapiens
GEDAACITY

SEQ ID NO: 1327250 - protein, 9 aa, Homo Sapiens
GTNSTHFLV

SEQ ID NO: 1327251 - protein, 9 aa, Homo Sapiens
QARLMGRIC

SEQ ID NO: 1327252 - protein, 9 aa, Homo Sapiens
HWQVHHHAT

SEQ ID NO: 1327253 - protein, 9 aa, Homo Sapiens
SMSDNGICV

SEQ ID NO: 1327254 - protein, 9 aa, Homo Sapiens
KEGECSPHK

SEQ ID NO: 1327255 - protein, 9 aa, Homo Sapiens
QASTSNMVS

SEQ ID NO: 1327256 - protein, 9 aa, Homo Sapiens
VSQLQGLWH

SEQ ID NO: 1327257 - protein, 9 aa, Homo Sapiens
DCFCIPRER

SEQ ID NO: 1327258 - protein, 9 aa, Homo Sapiens
RSPSSAPTA

SEQ ID NO: 1327259 - protein, 9 aa, Homo Sapiens
PLPGYKVHE

SEQ ID NO: 1327260 - protein, 9 aa, Homo Sapiens
SMNTYLQMS

SEQ ID NO: 1327261 - protein, 9 aa, Homo Sapiens
SYDPGEEDP

SEQ ID NO: 1327262 - protein, 9 aa, Homo Sapiens
PQQPTLSPV

SEQ ID NO: 1327263 - protein, 9 aa, Homo Sapiens
PSTLSIKKC

SEQ ID NO: 1327264 - protein, 9 aa, Homo Sapiens
EAKQTLHHF

SEQ ID NO: 1327265 - protein, 9 aa, Homo Sapiens
QKKPVCVFR

SEQ ID NO: 1327266 - protein, 9 aa, Homo Sapiens
PAVLPRLRR

SEQ ID NO: 1327267 - protein, 9 aa, Homo Sapiens
QVESGLHRT

SEQ ID NO: 1327268 - protein, 9 aa, Homo Sapiens
ENVQLRKYC

SEQ ID NO: 1327269 - protein, 9 aa, Homo Sapiens
LPGTISQQT

SEQ ID NO: 1327270 - protein, 9 aa, Homo Sapiens
FSRLHRVGR

SEQ ID NO: 1327271 - protein, 9 aa, Homo Sapiens
QQQDINYQE

SEQ ID NO: 1327272 - protein, 9 aa, Homo Sapiens
EPRPPRDCV

SEQ ID NO: 1327273 - protein, 9 aa, Homo Sapiens
LALLCHLCK

SEQ ID NO: 1327274 - protein, 9 aa, Homo Sapiens
MVEIGTERY

SEQ ID NO: 1327275 - protein, 9 aa, Homo Sapiens
RAVQTPRPQ

SEQ ID NO: 1327276 - protein, 9 aa, Homo Sapiens
VELQLRAAS

SEQ ID NO: 1327277 - protein, 9 aa, Homo Sapiens
LCNTQITML

SEQ ID NO: 1327278 - protein, 9 aa, Homo Sapiens
EMIDAGYYI

SEQ ID NO: 1327279 - protein, 9 aa, Homo Sapiens
SNGHIPSEQ

SEQ ID NO: 1327280 - protein, 9 aa, Homo Sapiens
VGALEGVPI

SEQ ID NO: 1327281 - protein, 9 aa, Homo Sapiens
VPPAPEDLH

SEQ ID NO: 1327282 - protein, 9 aa, Homo Sapiens
SFQTHEMIH

SEQ ID NO: 1327283 - protein, 9 aa, Homo Sapiens
LYKISLRNL

SEQ ID NO: 1327284 - protein, 9 aa, Homo Sapiens
AVVTYYLYM

SEQ ID NO: 1327285 - protein, 9 aa, Homo Sapiens
YKVQGPLPN

SEQ ID NO: 1327286 - protein, 9 aa, Homo Sapiens
QLKECLNRI

SEQ ID NO: 1327287 - protein, 9 aa, Homo Sapiens
QIVLTSQSL

SEQ ID NO: 1327288 - protein, 9 aa, Homo Sapiens
SQGSGRPRP

SEQ ID NO: 1327289 - protein, 9 aa, Homo Sapiens
GGGDTGSTG

SEQ ID NO: 1327290 - protein, 9 aa, Homo Sapiens
FAVLTIFYR

SEQ ID NO: 1327291 - protein, 9 aa, Homo Sapiens
EELIEHVTA

SEQ ID NO: 1327292 - protein, 9 aa, Homo Sapiens
VISEELDHA

SEQ ID NO: 1327293 - protein, 9 aa, Homo Sapiens
IRLHGWLQE

SEQ ID NO: 1327294 - protein, 9 aa, Homo Sapiens
RRLCTGEDV

SEQ ID NO: 1327295 - protein, 9 aa, Homo Sapiens
RLREEMECI

SEQ ID NO: 1327296 - protein, 9 aa, Homo Sapiens
PKRGERAWT

SEQ ID NO: 1327297 - protein, 9 aa, Homo Sapiens
SQASHSEPL

SEQ ID NO: 1327298 - protein, 9 aa, Homo Sapiens
NIQGGRPSP

SEQ ID NO: 1327299 - protein, 9 aa, Homo Sapiens
GPGGSQSDR

SEQ ID NO: 1327300 - protein, 9 aa, Homo Sapiens
TLLFVHYLA

SEQ ID NO: 1327301 - protein, 9 aa, Homo Sapiens
MQKLFQRFP

SEQ ID NO: 1327302 - protein, 9 aa, Homo Sapiens
SRQTGIPAR

SEQ ID NO: 1327303 - protein, 9 aa, Homo Sapiens
HKRPKRPRI

SEQ ID NO: 1327304 - protein, 9 aa, Homo Sapiens
GKGGKNRHR

SEQ ID NO: 1327305 - protein, 9 aa, Homo Sapiens
FHASVCRLT

SEQ ID NO: 1327306 - protein, 9 aa, Homo Sapiens
RSILYVLTG

SEQ ID NO: 1327307 - protein, 9 aa, Homo Sapiens
HLKIPKMKM

SEQ ID NO: 1327308 - protein, 9 aa, Homo Sapiens
RSGGREWGR

SEQ ID NO: 1327309 - protein, 9 aa, Homo Sapiens
FMRNAVDKK

SEQ ID NO: 1327310 - protein, 9 aa, Homo Sapiens
LLRQMKTTK

SEQ ID NO: 1327311 - protein, 9 aa, Homo Sapiens
ATSTVVSLL

SEQ ID NO: 1327312 - protein, 9 aa, Homo Sapiens
CRAAAMLPT

SEQ ID NO: 1327313 - protein, 9 aa, Homo Sapiens
SPDQERVLL

SEQ ID NO: 1327314 - protein, 9 aa, Homo Sapiens
LQRLKVHMK

SEQ ID NO: 1327315 - protein, 9 aa, Homo Sapiens
VGKKIGCDN

SEQ ID NO: 1327316 - protein, 9 aa, Homo Sapiens
GVCVLRAVV

SEQ ID NO: 1327317 - protein, 9 aa, Homo Sapiens
WYKMDDVEV

SEQ ID NO: 1327318 - protein, 9 aa, Homo Sapiens
MDSTGVPDL

SEQ ID NO: 1327319 - protein, 9 aa, Homo Sapiens
LDLCRFRIY

SEQ ID NO: 1327320 - protein, 9 aa, Homo Sapiens
GKHSVLAKE

SEQ ID NO: 1327321 - protein, 9 aa, Homo Sapiens
LHPLWPTPA

SEQ ID NO: 1327322 - protein, 9 aa, Homo Sapiens
DTAELLGHR

SEQ ID NO: 1327323 - protein, 9 aa, Homo Sapiens
ARKECEKED

SEQ ID NO: 1327324 - protein, 9 aa, Homo Sapiens
QKGQHFGLG

SEQ ID NO: 1327325 - protein, 9 aa, Homo Sapiens
NMRMGERGV

SEQ ID NO: 1327326 - protein, 9 aa, Homo Sapiens
VCGSTCNNE

SEQ ID NO: 1327327 - protein, 9 aa, Homo Sapiens
DDVCFEHQF

SEQ ID NO: 1327328 - protein, 9 aa, Homo Sapiens
MSLPCENQK

SEQ ID NO: 1327329 - protein, 9 aa, Homo Sapiens
MDSSQILTP

SEQ ID NO: 1327330 - protein, 9 aa, Homo Sapiens
DEDQTSLAT

SEQ ID NO: 1327331 - protein, 9 aa, Homo Sapiens
TLNKHQHFG

SEQ ID NO: 1327332 - protein, 9 aa, Homo Sapiens
TYKQAKCNA

SEQ ID NO: 1327333 - protein, 9 aa, Homo Sapiens
CGKAFRLCQ

SEQ ID NO: 1327334 - protein, 9 aa, Homo Sapiens
LLAEAWDFT

SEQ ID NO: 1327335 - protein, 9 aa, Homo Sapiens
KELQIINQK

SEQ ID NO: 1327336 - protein, 9 aa, Homo Sapiens
MPTIIGHQK

SEQ ID NO: 1327337 - protein, 9 aa, Homo Sapiens
WIRSLLDVV

SEQ ID NO: 1327338 - protein, 9 aa, Homo Sapiens
FVFLILCLP

SEQ ID NO: 1327339 - protein, 9 aa, Homo Sapiens
PSRPCRMRL

SEQ ID NO: 1327340 - protein, 9 aa, Homo Sapiens
FDRTCTEAE

SEQ ID NO: 1327341 - protein, 9 aa, Homo Sapiens
RLFYDICKL

SEQ ID NO: 1327342 - protein, 9 aa, Homo Sapiens
AHMMRRLLA

SEQ ID NO: 1327343 - protein, 9 aa, Homo Sapiens
TDPSTVDDK

SEQ ID NO: 1327344 - protein, 9 aa, Homo Sapiens
EWMRLDMMD

SEQ ID NO: 1327345 - protein, 9 aa, Homo Sapiens
ENVAQTPRI

SEQ ID NO: 1327346 - protein, 9 aa, Homo Sapiens
WGKHCVDKF

SEQ ID NO: 1327347 - protein, 9 aa, Homo Sapiens
STHNITQGI

SEQ ID NO: 1327348 - protein, 9 aa, Homo Sapiens
AHLGVSDDL

SEQ ID NO: 1327349 - protein, 9 aa, Homo Sapiens
YSRLANELH

SEQ ID NO: 1327350 - protein, 9 aa, Homo Sapiens
VVYVYVKEI

SEQ ID NO: 1327351 - protein, 9 aa, Homo Sapiens
TEDEISKLC

SEQ ID NO: 1327352 - protein, 9 aa, Homo Sapiens
QTTEHISIH

SEQ ID NO: 1327353 - protein, 9 aa, Homo Sapiens
GQPPAWYGN

SEQ ID NO: 1327354 - protein, 9 aa, Homo Sapiens
AACAPTPLS

SEQ ID NO: 1327355 - protein, 9 aa, Homo Sapiens
PALQEVQQI

SEQ ID NO: 1327356 - protein, 9 aa, Homo Sapiens
KTHLRTHTG

SEQ ID NO: 1327357 - protein, 9 aa, Homo Sapiens
APDELALWR

SEQ ID NO: 1327358 - protein, 9 aa, Homo Sapiens
GARMTVLQA

SEQ ID NO: 1327359 - protein, 9 aa, Homo Sapiens
ISDVVMFIT

SEQ ID NO: 1327360 - protein, 9 aa, Homo Sapiens
VFYLVVGNY

SEQ ID NO: 1327361 - protein, 9 aa, Homo Sapiens
LCGLHTVLS

SEQ ID NO: 1327362 - protein, 9 aa, Homo Sapiens
PSRCTGAGT

SEQ ID NO: 1327363 - protein, 9 aa, Homo Sapiens
LAHHQHHHF

SEQ ID NO: 1327364 - protein, 9 aa, Homo Sapiens
LTTENPERL

SEQ ID NO: 1327365 - protein, 9 aa, Homo Sapiens
KYHPLGSFE

SEQ ID NO: 1327366 - protein, 9 aa, Homo Sapiens
IPLHPKHWF

SEQ ID NO: 1327367 - protein, 9 aa, Homo Sapiens
CSDGITNSP

SEQ ID NO: 1327368 - protein, 9 aa, Homo Sapiens
NLVGIHGGD

SEQ ID NO: 1327369 - protein, 9 aa, Homo Sapiens
QHRQFMDHT

SEQ ID NO: 1327370 - protein, 9 aa, Homo Sapiens
LPALVLCVL

SEQ ID NO: 1327371 - protein, 9 aa, Homo Sapiens
NAICIGMYV

SEQ ID NO: 1327372 - protein, 9 aa, Homo Sapiens
HDPGASVQG

SEQ ID NO: 1327373 - protein, 9 aa, Homo Sapiens
CCITFFIFV

SEQ ID NO: 1327374 - protein, 9 aa, Homo Sapiens
GSTSRRTRP

SEQ ID NO: 1327375 - protein, 9 aa, Homo Sapiens
RGGRCAQTR

SEQ ID NO: 1327376 - protein, 9 aa, Homo Sapiens
LFRIPGQAN

SEQ ID NO: 1327377 - protein, 9 aa, Homo Sapiens
RVAKKGIRL

SEQ ID NO: 1327378 - protein, 9 aa, Homo Sapiens
RLLGRWKTL

SEQ ID NO: 1327379 - protein, 9 aa, Homo Sapiens
KTRKRCSAS

SEQ ID NO: 1327380 - protein, 9 aa, Homo Sapiens
RDIDAFLKV

SEQ ID NO: 1327381 - protein, 9 aa, Homo Sapiens
DLRRDMFNM

SEQ ID NO: 1327382 - protein, 9 aa, Homo Sapiens
DSHRNIIMW

SEQ ID NO: 1327383 - protein, 9 aa, Homo Sapiens
PTMEEGSGQ

SEQ ID NO: 1327384 - protein, 9 aa, Homo Sapiens
DSSEHGTPD

SEQ ID NO: 1327385 - protein, 9 aa, Homo Sapiens
LLGAVNMAG

SEQ ID NO: 1327386 - protein, 9 aa, Homo Sapiens
KGKGLRGST

SEQ ID NO: 1327387 - protein, 9 aa, Homo Sapiens
TLSSQVPDV

SEQ ID NO: 1327388 - protein, 9 aa, Homo Sapiens
EWMVSIIHR

SEQ ID NO: 1327389 - protein, 9 aa, Homo Sapiens
SAHQDAHRH

SEQ ID NO: 1327390 - protein, 9 aa, Homo Sapiens
LHVKEPHLR

SEQ ID NO: 1327391 - protein, 9 aa, Homo Sapiens
GPLDGQDSP

SEQ ID NO: 1327392 - protein, 9 aa, Homo Sapiens
LQTAQTEGI

SEQ ID NO: 1327393 - protein, 9 aa, Homo Sapiens
ATVLSFSLY

SEQ ID NO: 1327394 - protein, 9 aa, Homo Sapiens
NMTFLAETK

SEQ ID NO: 1327395 - protein, 9 aa, Homo Sapiens
YSSEFSKWL

SEQ ID NO: 1327396 - protein, 9 aa, Homo Sapiens
WEQSEQLEQ

SEQ ID NO: 1327397 - protein, 9 aa, Homo Sapiens
SLISSYNLQ

SEQ ID NO: 1327398 - protein, 9 aa, Homo Sapiens
RTRLASRSQ

SEQ ID NO: 1327399 - protein, 9 aa, Homo Sapiens
QEKAITTLK

SEQ ID NO: 1327400 - protein, 9 aa, Homo Sapiens
MFLATHKGY

SEQ ID NO: 1327401 - protein, 9 aa, Homo Sapiens
WDYMMPEQR

SEQ ID NO: 1327402 - protein, 9 aa, Homo Sapiens
VETVSEKKN

SEQ ID NO: 1327403 - protein, 9 aa, Homo Sapiens
VLLKPITGR

SEQ ID NO: 1327404 - protein, 9 aa, Homo Sapiens
HQQNTIQKY

SEQ ID NO: 1327405 - protein, 9 aa, Homo Sapiens
QSAAYNLLC

SEQ ID NO: 1327406 - protein, 9 aa, Homo Sapiens
IMALMDTYS

SEQ ID NO: 1327407 - protein, 9 aa, Homo Sapiens
QYLNRNYWE

SEQ ID NO: 1327408 - protein, 9 aa, Homo Sapiens
KAYPCGTCD

SEQ ID NO: 1327409 - protein, 9 aa, Homo Sapiens
TGDEHSSMN

SEQ ID NO: 1327410 - protein, 9 aa, Homo Sapiens
SWVEDCNNC

SEQ ID NO: 1327411 - protein, 9 aa, Homo Sapiens
SIKSEDEQK

SEQ ID NO: 1327412 - protein, 9 aa, Homo Sapiens
SYWLHTSPE

SEQ ID NO: 1327413 - protein, 9 aa, Homo Sapiens
GPRAIEAAG

SEQ ID NO: 1327414 - protein, 9 aa, Homo Sapiens
TKAAAIGID

SEQ ID NO: 1327415 - protein, 9 aa, Homo Sapiens
CQNTQTFNL

SEQ ID NO: 1327416 - protein, 9 aa, Homo Sapiens
QMAKRQKVH

SEQ ID NO: 1327417 - protein, 9 aa, Homo Sapiens
PPRKHLVEC

SEQ ID NO: 1327418 - protein, 9 aa, Homo Sapiens
KTERSPAST

SEQ ID NO: 1327419 - protein, 9 aa, Homo Sapiens
TYNQVQTCS

SEQ ID NO: 1327420 - protein, 9 aa, Homo Sapiens
PPHPPSSLS

SEQ ID NO: 1327421 - protein, 9 aa, Homo Sapiens
NVTNGGSHA

SEQ ID NO: 1327422 - protein, 9 aa, Homo Sapiens
ENEKERLKA

SEQ ID NO: 1327423 - protein, 9 aa, Homo Sapiens
LLLGGTAII

SEQ ID NO: 1327424 - protein, 9 aa, Homo Sapiens
PPQGDVEVM

SEQ ID NO: 1327425 - protein, 9 aa, Homo Sapiens
YEDTLIDEV

SEQ ID NO: 1327426 - protein, 9 aa, Homo Sapiens
EYRSHQARE

SEQ ID NO: 1327427 - protein, 9 aa, Homo Sapiens
GVQFLEAQI

SEQ ID NO: 1327428 - protein, 9 aa, Homo Sapiens
VKDSIAEGH

SEQ ID NO: 1327429 - protein, 9 aa, Homo Sapiens
HRPGPTRKH

SEQ ID NO: 1327430 - protein, 9 aa, Homo Sapiens
PSMTSVTSC

SEQ ID NO: 1327431 - protein, 9 aa, Homo Sapiens
NLYVDSDSE

SEQ ID NO: 1327432 - protein, 9 aa, Homo Sapiens
RELDVENTK

SEQ ID NO: 1327433 - protein, 9 aa, Homo Sapiens
DPPAMRRPS

SEQ ID NO: 1327434 - protein, 9 aa, Homo Sapiens
PLFTDVSHG

SEQ ID NO: 1327435 - protein, 9 aa, Homo Sapiens
FICLGSLSK

SEQ ID NO: 1327436 - protein, 9 aa, Homo Sapiens
GFWLSLLYW

SEQ ID NO: 1327437 - protein, 9 aa, Homo Sapiens
DSTYGDEEC

SEQ ID NO: 1327438 - protein, 9 aa, Homo Sapiens
TTEHISIHQ

SEQ ID NO: 1327439 - protein, 9 aa, Homo Sapiens
KKSPTTQNS

SEQ ID NO: 1327440 - protein, 9 aa, Homo Sapiens
GINTGVAKH

SEQ ID NO: 1327441 - protein, 9 aa, Homo Sapiens
CLSGYYRMD

SEQ ID NO: 1327442 - protein, 9 aa, Homo Sapiens
FLAVRQVVA

SEQ ID NO: 1327443 - protein, 9 aa, Homo Sapiens
NRHTFETAR

SEQ ID NO: 1327444 - protein, 9 aa, Homo Sapiens
LWVLLYVQG

SEQ ID NO: 1327445 - protein, 9 aa, Homo Sapiens
DYLGLNSQQ

SEQ ID NO: 1327446 - protein, 9 aa, Homo Sapiens
EISKLCKLE

SEQ ID NO: 1327447 - protein, 9 aa, Homo Sapiens
SERCMVKKS

SEQ ID NO: 1327448 - protein, 9 aa, Homo Sapiens
KNKTPKEKD

SEQ ID NO: 1327449 - protein, 9 aa, Homo Sapiens
VDTLLFVHY

SEQ ID NO: 1327450 - protein, 9 aa, Homo Sapiens
VIKDKQEGI

SEQ ID NO: 1327451 - protein, 9 aa, Homo Sapiens
IHTFSAGLG

SEQ ID NO: 1327452 - protein, 9 aa, Homo Sapiens
YHKHDLLLT

SEQ ID NO: 1327453 - protein, 9 aa, Homo Sapiens
SIEKAAEDS

SEQ ID NO: 1327454 - protein, 9 aa, Homo Sapiens
GLESIPSLS

SEQ ID NO: 1327455 - protein, 9 aa, Homo Sapiens
LDYLSPEMI

SEQ ID NO: 1327456 - protein, 9 aa, Homo Sapiens
EHDDSLRFN

SEQ ID NO: 1327457 - protein, 9 aa, Homo Sapiens
SHLKTHLRT

SEQ ID NO: 1327458 - protein, 9 aa, Homo Sapiens
VEFADLVTA

SEQ ID NO: 1327459 - protein, 9 aa, Homo Sapiens
YRGTRYPDV

SEQ ID NO: 1327460 - protein, 9 aa, Homo Sapiens
VRFTSLFDA

SEQ ID NO: 1327461 - protein, 9 aa, Homo Sapiens
LATMCGQES

SEQ ID NO: 1327462 - protein, 9 aa, Homo Sapiens
IWIDTSCVC

SEQ ID NO: 1327463 - protein, 9 aa, Homo Sapiens
PLSMVFAGA

SEQ ID NO: 1327464 - protein, 9 aa, Homo Sapiens
SPSDYPCLP

SEQ ID NO: 1327465 - protein, 9 aa, Homo Sapiens
RDRHITLRA

SEQ ID NO: 1327466 - protein, 9 aa, Homo Sapiens
LKMEIGPVS

SEQ ID NO: 1327467 - protein, 9 aa, Homo Sapiens
AYADSWSGS

SEQ ID NO: 1327468 - protein, 9 aa, Homo Sapiens
VRSRVSIAV

SEQ ID NO: 1327469 - protein, 9 aa, Homo Sapiens
HMVEARLAR

SEQ ID NO: 1327470 - protein, 9 aa, Homo Sapiens
TAPYIPELW

SEQ ID NO: 1327471 - protein, 9 aa, Homo Sapiens
LETFAHTDL

SEQ ID NO: 1327472 - protein, 9 aa, Homo Sapiens
VGQITLMDV

SEQ ID NO: 1327473 - protein, 9 aa, Homo Sapiens
LLQEPHLFL

SEQ ID NO: 1327474 - protein, 9 aa, Homo Sapiens
ASYPKRLGR

SEQ ID NO: 1327475 - protein, 9 aa, Homo Sapiens
TGVVGPGGL

SEQ ID NO: 1327476 - protein, 9 aa, Homo Sapiens
CSASSGSSS

SEQ ID NO: 1327477 - protein, 9 aa, Homo Sapiens
ARCSACTCG

SEQ ID NO: 1327478 - protein, 9 aa, Homo Sapiens
SAYIHKKTR

SEQ ID NO: 1327479 - protein, 9 aa, Homo Sapiens
ASMWSELQA

SEQ ID NO: 1327480 - protein, 9 aa, Homo Sapiens
DDQQMEWQR

SEQ ID NO: 1327481 - protein, 9 aa, Homo Sapiens
VLRKAIADW

SEQ ID NO: 1327482 - protein, 9 aa, Homo Sapiens
QPNNRMSPG

SEQ ID NO: 1327483 - protein, 9 aa, Homo Sapiens
TNSTHFLVF

SEQ ID NO: 1327484 - protein, 9 aa, Homo Sapiens
NRTIMTIGT

SEQ ID NO: 1327485 - protein, 9 aa, Homo Sapiens
KRQHSLYID

SEQ ID NO: 1327486 - protein, 9 aa, Homo Sapiens
RRTGHHIVA

SEQ ID NO: 1327487 - protein, 9 aa, Homo Sapiens
EQKEERCRV

SEQ ID NO: 1327488 - protein, 9 aa, Homo Sapiens
NRVGFVEAA

SEQ ID NO: 1327489 - protein, 9 aa, Homo Sapiens
TACTLGAYH

SEQ ID NO: 1327490 - protein, 9 aa, Homo Sapiens
RIPVFEGEH

SEQ ID NO: 1327491 - protein, 9 aa, Homo Sapiens
LAEHNPLGS

SEQ ID NO: 1327492 - protein, 9 aa, Homo Sapiens
RFIVRFIAM

SEQ ID NO: 1327493 - protein, 9 aa, Homo Sapiens
MPSSALSSG

SEQ ID NO: 1327494 - protein, 9 aa, Homo Sapiens
MTFSHFMSV

SEQ ID NO: 1327495 - protein, 9 aa, Homo Sapiens
RGVCYGADH

SEQ ID NO: 1327496 - protein, 9 aa, Homo Sapiens
DTIQLYLGT

SEQ ID NO: 1327497 - protein, 9 aa, Homo Sapiens
ATQYQDYSM

SEQ ID NO: 1327498 - protein, 9 aa, Homo Sapiens
NISTKEYTY

SEQ ID NO: 1327499 - protein, 9 aa, Homo Sapiens
AVSEMTWRA

SEQ ID NO: 1327500 - protein, 9 aa, Homo Sapiens
VNYLMSLPC

SEQ ID NO: 1327501 - protein, 9 aa, Homo Sapiens
MYHCLQFAY

SEQ ID NO: 1327502 - protein, 9 aa, Homo Sapiens
DKMCNDVSV

SEQ ID NO: 1327503 - protein, 9 aa, Homo Sapiens
GHVKPQGVG

SEQ ID NO: 1327504 - protein, 9 aa, Homo Sapiens
LCQKLTLHQ

SEQ ID NO: 1327505 - protein, 9 aa, Homo Sapiens
GLARTLSIL

SEQ ID NO: 1327506 - protein, 9 aa, Homo Sapiens
YLGTKLLDS

SEQ ID NO: 1327507 - protein, 9 aa, Homo Sapiens
HMDASGETV

SEQ ID NO: 1327508 - protein, 9 aa, Homo Sapiens
NTETKDHAP

SEQ ID NO: 1327509 - protein, 9 aa, Homo Sapiens
QPKLVSHSG

SEQ ID NO: 1327510 - protein, 9 aa, Homo Sapiens
LDPSKKVLL

SEQ ID NO: 1327511 - protein, 9 aa, Homo Sapiens
PVQAWLFSD

SEQ ID NO: 1327512 - protein, 9 aa, Homo Sapiens
VCQKKQDGA

SEQ ID NO: 1327513 - protein, 9 aa, Homo Sapiens
LQKDIEEVK

SEQ ID NO: 1327514 - protein, 9 aa, Homo Sapiens
DGSSTREDI

SEQ ID NO: 1327515 - protein, 9 aa, Homo Sapiens
EHLNTIVQI

SEQ ID NO: 1327516 - protein, 9 aa, Homo Sapiens
LERWHRLQV

SEQ ID NO: 1327517 - protein, 9 aa, Homo Sapiens
NSLYTISKG

SEQ ID NO: 1327518 - protein, 9 aa, Homo Sapiens
KVVSKSKVP

SEQ ID NO: 1327519 - protein, 9 aa, Homo Sapiens
QGTQLPSHI

SEQ ID NO: 1327520 - protein, 9 aa, Homo Sapiens
DPADIWPLD

SEQ ID NO: 1327521 - protein, 9 aa, Homo Sapiens
GMPSSALSS

SEQ ID NO: 1327522 - protein, 9 aa, Homo Sapiens
IHHLTLERP

SEQ ID NO: 1327523 - protein, 9 aa, Homo Sapiens
SDNSGTRSR

SEQ ID NO: 1327524 - protein, 9 aa, Homo Sapiens
YWHSLHPGY

SEQ ID NO: 1327525 - protein, 9 aa, Homo Sapiens
LAAELEDCR

SEQ ID NO: 1327526 - protein, 9 aa, Homo Sapiens
PRPTKARTP

SEQ ID NO: 1327527 - protein, 9 aa, Homo Sapiens
MLRNITFKN

SEQ ID NO: 1327528 - protein, 9 aa, Homo Sapiens
PPAFSGRIL

SEQ ID NO: 1327529 - protein, 9 aa, Homo Sapiens
EHVVCGSTC

SEQ ID NO: 1327530 - protein, 9 aa, Homo Sapiens
GDDIGLTSY

SEQ ID NO: 1327531 - protein, 9 aa, Homo Sapiens
LVSAWEVEA

SEQ ID NO: 1327532 - protein, 9 aa, Homo Sapiens
HLNSLADRS

SEQ ID NO: 1327533 - protein, 9 aa, Homo Sapiens
RVCGPATFE

SEQ ID NO: 1327534 - protein, 9 aa, Homo Sapiens
CSPTTPSPA

SEQ ID NO: 1327535 - protein, 9 aa, Homo Sapiens
KSVMNQVME

SEQ ID NO: 1327536 - protein, 9 aa, Homo Sapiens
LLGLENTHY

SEQ ID NO: 1327537 - protein, 9 aa, Homo Sapiens
VEPTVDLLG

SEQ ID NO: 1327538 - protein, 9 aa, Homo Sapiens
YMQKSSSLL

SEQ ID NO: 1327539 - protein, 9 aa, Homo Sapiens
EEHNFAEFN

SEQ ID NO: 1327540 - protein, 9 aa, Homo Sapiens
KQDELKCSA

SEQ ID NO: 1327541 - protein, 9 aa, Homo Sapiens
PGAVVPRGQ

SEQ ID NO: 1327542 - protein, 9 aa, Homo Sapiens
PVTRHRSRS

SEQ ID NO: 1327543 - protein, 9 aa, Homo Sapiens
PRGLMPLRV

SEQ ID NO: 1327544 - protein, 9 aa, Homo Sapiens
HTQFEYPIH

SEQ ID NO: 1327545 - protein, 9 aa, Homo Sapiens
ITVVEEDGR

SEQ ID NO: 1327546 - protein, 9 aa, Homo Sapiens
CRELDNNCS

SEQ ID NO: 1327547 - protein, 9 aa, Homo Sapiens
LCGTRANAK

SEQ ID NO: 1327548 - protein, 9 aa, Homo Sapiens
VLSCLLHIT

SEQ ID NO: 1327549 - protein, 9 aa, Homo Sapiens
NLTNGVSAG

SEQ ID NO: 1327550 - protein, 9 aa, Homo Sapiens
HITVLEALR

SEQ ID NO: 1327551 - protein, 9 aa, Homo Sapiens
EAQRQAKVW

SEQ ID NO: 1327552 - protein, 9 aa, Homo Sapiens
GARACRLHC

SEQ ID NO: 1327553 - protein, 9 aa, Homo Sapiens
KMTDTICIS

SEQ ID NO: 1327554 - protein, 9 aa, Homo Sapiens
QLSGQCFTA

SEQ ID NO: 1327555 - protein, 9 aa, Homo Sapiens
YMKRNSRRS

SEQ ID NO: 1327556 - protein, 9 aa, Homo Sapiens
EKSFLMEGY

SEQ ID NO: 1327557 - protein, 9 aa, Homo Sapiens
HKVYPLVCQ

SEQ ID NO: 1327558 - protein, 9 aa, Homo Sapiens
VADFKDALT

SEQ ID NO: 1327559 - protein, 9 aa, Homo Sapiens
IDSVIPHVL

SEQ ID NO: 1327560 - protein, 9 aa, Homo Sapiens
AVGWLTTWS

SEQ ID NO: 1327561 - protein, 9 aa, Homo Sapiens
YSSLAVCDH

SEQ ID NO: 1327562 - protein, 9 aa, Homo Sapiens
TSSSTMYSN

SEQ ID NO: 1327563 - protein, 9 aa, Homo Sapiens
PTHLHPCRR

SEQ ID NO: 1327564 - protein, 9 aa, Homo Sapiens
ETPKEMPTP

SEQ ID NO: 1327565 - protein, 9 aa, Homo Sapiens
NLVATATLT

SEQ ID NO: 1327566 - protein, 9 aa, Homo Sapiens
SLKKENHTC

SEQ ID NO: 1327567 - protein, 9 aa, Homo Sapiens
YDKMCNDVS

SEQ ID NO: 1327568 - protein, 9 aa, Homo Sapiens
DDRFCGTYI

SEQ ID NO: 1327569 - protein, 9 aa, Homo Sapiens
QSLLSSERM

SEQ ID NO: 1327570 - protein, 9 aa, Homo Sapiens
YETGDMCIS

SEQ ID NO: 1327571 - protein, 9 aa, Homo Sapiens
IGEGFKEVV

SEQ ID NO: 1327572 - protein, 9 aa, Homo Sapiens
CYPCSLFQP

SEQ ID NO: 1327573 - protein, 9 aa, Homo Sapiens
NVALTQATR

SEQ ID NO: 1327574 - protein, 9 aa, Homo Sapiens
FGGKQEDVY

SEQ ID NO: 1327575 - protein, 9 aa, Homo Sapiens
HFSNFTMIM

SEQ ID NO: 1327576 - protein, 9 aa, Homo Sapiens
SCWKQYLED

SEQ ID NO: 1327577 - protein, 9 aa, Homo Sapiens
ALIESTVCA

SEQ ID NO: 1327578 - protein, 9 aa, Homo Sapiens
SVQHQLYTE

SEQ ID NO: 1327579 - protein, 9 aa, Homo Sapiens
QSILREVAA

SEQ ID NO: 1327580 - protein, 9 aa, Homo Sapiens
DIRQSYANS

SEQ ID NO: 1327581 - protein, 9 aa, Homo Sapiens
FTIDNTCIL

SEQ ID NO: 1327582 - protein, 9 aa, Homo Sapiens
MPELHNFLC

SEQ ID NO: 1327583 - protein, 9 aa, Homo Sapiens
DEAGTPYDK

SEQ ID NO: 1327584 - protein, 9 aa, Homo Sapiens
DVRHQQQEL

SEQ ID NO: 1327585 - protein, 9 aa, Homo Sapiens
EQDCAHACP

SEQ ID NO: 1327586 - protein, 9 aa, Homo Sapiens
AFICGFQLT

SEQ ID NO: 1327587 - protein, 9 aa, Homo Sapiens
SWRGKYKCV

SEQ ID NO: 1327588 - protein, 9 aa, Homo Sapiens
VAFFGQAVQ

SEQ ID NO: 1327589 - protein, 9 aa, Homo Sapiens
RKIHTQERH

SEQ ID NO: 1327590 - protein, 9 aa, Homo Sapiens
HLRPRPRTY

SEQ ID NO: 1327591 - protein, 9 aa, Homo Sapiens
FGGSTHNIT

SEQ ID NO: 1327592 - protein, 9 aa, Homo Sapiens
TTQITEEVW

SEQ ID NO: 1327593 - protein, 9 aa, Homo Sapiens
PPYRDWTLC

SEQ ID NO: 1327594 - protein, 9 aa, Homo Sapiens
EGCPDAKGE

SEQ ID NO: 1327595 - protein, 9 aa, Homo Sapiens
VTPERIADN

SEQ ID NO: 1327596 - protein, 9 aa, Homo Sapiens
PVTATSHLA

SEQ ID NO: 1327597 - protein, 9 aa, Homo Sapiens
ESNMNNLVS

SEQ ID NO: 1327598 - protein, 9 aa, Homo Sapiens
PQMLLAHLA

SEQ ID NO: 1327599 - protein, 9 aa, Homo Sapiens
HISTISSPS

SEQ ID NO: 1327600 - protein, 9 aa, Homo Sapiens
AGPSALPSP

SEQ ID NO: 1327601 - protein, 9 aa, Homo Sapiens
QSLILRQFR

SEQ ID NO: 1327602 - protein, 9 aa, Homo Sapiens
EKSEPDISS

SEQ ID NO: 1327603 - protein, 9 aa, Homo Sapiens
AETLIQLPE

SEQ ID NO: 1327604 - protein, 9 aa, Homo Sapiens
WQVFKNDAT

SEQ ID NO: 1327605 - protein, 9 aa, Homo Sapiens
TTLPASQRS

SEQ ID NO: 1327606 - protein, 9 aa, Homo Sapiens
QIPELAKMI

SEQ ID NO: 1327607 - protein, 9 aa, Homo Sapiens
QKEDPKAML

SEQ ID NO: 1327608 - protein, 9 aa, Homo Sapiens
QPLVTSYLC

SEQ ID NO: 1327609 - protein, 9 aa, Homo Sapiens
MRSVSARSP

SEQ ID NO: 1327610 - protein, 9 aa, Homo Sapiens
SPEKTHHLH

SEQ ID NO: 1327611 - protein, 9 aa, Homo Sapiens
DVESGHIAH

SEQ ID NO: 1327612 - protein, 9 aa, Homo Sapiens
QQATGKEEK

SEQ ID NO: 1327613 - protein, 9 aa, Homo Sapiens
YMLPQSYHT

SEQ ID NO: 1327614 - protein, 9 aa, Homo Sapiens
LKYATEKKD

SEQ ID NO: 1327615 - protein, 9 aa, Homo Sapiens
VSWLRLRLE

SEQ ID NO: 1327616 - protein, 9 aa, Homo Sapiens
AEHIQVGYY

SEQ ID NO: 1327617 - protein, 9 aa, Homo Sapiens
PGTFDGLKL

SEQ ID NO: 1327618 - protein, 9 aa, Homo Sapiens
AHVHQHTGE

SEQ ID NO: 1327619 - protein, 9 aa, Homo Sapiens
IRHSLSLHD

SEQ ID NO: 1327620 - protein, 9 aa, Homo Sapiens
TGHLHTHSV

SEQ ID NO: 1327621 - protein, 9 aa, Homo Sapiens
SSGTTGTPK

SEQ ID NO: 1327622 - protein, 9 aa, Homo Sapiens
KEKEERMWA

SEQ ID NO: 1327623 - protein, 9 aa, Homo Sapiens
CSILEEHRK

SEQ ID NO: 1327624 - protein, 9 aa, Homo Sapiens
HAVLSGHRF

SEQ ID NO: 1327625 - protein, 9 aa, Homo Sapiens
MMKEFSSTV

SEQ ID NO: 1327626 - protein, 9 aa, Homo Sapiens
MGNLRVAKK

SEQ ID NO: 1327627 - protein, 9 aa, Homo Sapiens
KDTEGKKSG

SEQ ID NO: 1327628 - protein, 9 aa, Homo Sapiens
NPEVMCSDS

SEQ ID NO: 1327629 - protein, 9 aa, Homo Sapiens
RQCRVQKFT

SEQ ID NO: 1327630 - protein, 9 aa, Homo Sapiens
MLRFPTCFS

SEQ ID NO: 1327631 - protein, 9 aa, Homo Sapiens
IHCWLSPPL

SEQ ID NO: 1327632 - protein, 9 aa, Homo Sapiens
GFPCSRLLP

SEQ ID NO: 1327633 - protein, 9 aa, Homo Sapiens
CKQLTGQAP

SEQ ID NO: 1327634 - protein, 9 aa, Homo Sapiens
RWDDRRTPP

SEQ ID NO: 1327635 - protein, 9 aa, Homo Sapiens
FFVLVNLEV

SEQ ID NO: 1327636 - protein, 9 aa, Homo Sapiens
MPSFGMLNV

SEQ ID NO: 1327637 - protein, 9 aa, Homo Sapiens
HMYSERRIT

SEQ ID NO: 1327638 - protein, 9 aa, Homo Sapiens
KVCLRRLWK

SEQ ID NO: 1327639 - protein, 9 aa, Homo Sapiens
SVPIFDEII

SEQ ID NO: 1327640 - protein, 9 aa, Homo Sapiens
CPWPIMEAV

SEQ ID NO: 1327641 - protein, 9 aa, Homo Sapiens
LIDNKHILS

SEQ ID NO: 1327642 - protein, 9 aa, Homo Sapiens
MHRWWQDLC

SEQ ID NO: 1327643 - protein, 9 aa, Homo Sapiens
PPEDVLASP

SEQ ID NO: 1327644 - protein, 9 aa, Homo Sapiens
KLDFAGLVQ

SEQ ID NO: 1327645 - protein, 9 aa, Homo Sapiens
GESKHHPGQ

SEQ ID NO: 1327646 - protein, 9 aa, Homo Sapiens
LTTHFTKRV

SEQ ID NO: 1327647 - protein, 9 aa, Homo Sapiens
QSMLHRWFV

SEQ ID NO: 1327648 - protein, 9 aa, Homo Sapiens
RPVSKLVVT

SEQ ID NO: 1327649 - protein, 9 aa, Homo Sapiens
TQAMGQQPI

SEQ ID NO: 1327650 - protein, 9 aa, Homo Sapiens
DLEHTFTFR

SEQ ID NO: 1327651 - protein, 9 aa, Homo Sapiens
FLETGDEHS

SEQ ID NO: 1327652 - protein, 9 aa, Homo Sapiens
EFQKMWRDL

SEQ ID NO: 1327653 - protein, 9 aa, Homo Sapiens
TWKDDMNDK

SEQ ID NO: 1327654 - protein, 9 aa, Homo Sapiens
SPVMSGGIF

SEQ ID NO: 1327655 - protein, 9 aa, Homo Sapiens
QVAHIPVIR

SEQ ID NO: 1327656 - protein, 9 aa, Homo Sapiens
CWTKEWRVL

SEQ ID NO: 1327657 - protein, 9 aa, Homo Sapiens
ICVNMSVSR

SEQ ID NO: 1327658 - protein, 9 aa, Homo Sapiens
EERLQAITA

SEQ ID NO: 1327659 - protein, 9 aa, Homo Sapiens
IDITKEENS

SEQ ID NO: 1327660 - protein, 9 aa, Homo Sapiens
AGWTSKTWP

SEQ ID NO: 1327661 - protein, 9 aa, Homo Sapiens
RWGSDSEKR

SEQ ID NO: 1327662 - protein, 9 aa, Homo Sapiens
YSIGKQKMA

SEQ ID NO: 1327663 - protein, 9 aa, Homo Sapiens
CCRRCESMT

SEQ ID NO: 1327664 - protein, 9 aa, Homo Sapiens
KELGKVRCG

SEQ ID NO: 1327665 - protein, 9 aa, Homo Sapiens
TTTVTMTRA

SEQ ID NO: 1327666 - protein, 9 aa, Homo Sapiens
FPWVLQDYM

SEQ ID NO: 1327667 - protein, 9 aa, Homo Sapiens
ARLVALEPD

SEQ ID NO: 1327668 - protein, 9 aa, Homo Sapiens
LVTETRRIF

SEQ ID NO: 1327669 - protein, 9 aa, Homo Sapiens
GSIWLMFPT

SEQ ID NO: 1327670 - protein, 9 aa, Homo Sapiens
KTSTSRTQK

SEQ ID NO: 1327671 - protein, 9 aa, Homo Sapiens
MKATGKMYA

SEQ ID NO: 1327672 - protein, 9 aa, Homo Sapiens
FREGDMWIC

SEQ ID NO: 1327673 - protein, 9 aa, Homo Sapiens
RYVSNHVFN

SEQ ID NO: 1327674 - protein, 9 aa, Homo Sapiens
AKGELSLPE

SEQ ID NO: 1327675 - protein, 9 aa, Homo Sapiens
GLMSMPNVL

SEQ ID NO: 1327676 - protein, 9 aa, Homo Sapiens
SPSLQSSVQ

SEQ ID NO: 1327677 - protein, 9 aa, Homo Sapiens
TLEDEEELW

SEQ ID NO: 1327678 - protein, 9 aa, Homo Sapiens
TKIFPNYRH

SEQ ID NO: 1327679 - protein, 9 aa, Homo Sapiens
TAVAKTTSE

SEQ ID NO: 1327680 - protein, 9 aa, Homo Sapiens
EMPTPQRKG

SEQ ID NO: 1327681 - protein, 9 aa, Homo Sapiens
GTILEGKRS

SEQ ID NO: 1327682 - protein, 9 aa, Homo Sapiens
LQIQLDDIV

SEQ ID NO: 1327683 - protein, 9 aa, Homo Sapiens
DPTDHYHVQ

SEQ ID NO: 1327684 - protein, 9 aa, Homo Sapiens
QDAHINMLY

SEQ ID NO: 1327685 - protein, 9 aa, Homo Sapiens
EEEEEPPPS

SEQ ID NO: 1327686 - protein, 9 aa, Homo Sapiens
SDCYIEYVI

SEQ ID NO: 1327687 - protein, 9 aa, Homo Sapiens
TKTTDDETR

SEQ ID NO: 1327688 - protein, 9 aa, Homo Sapiens
CMMVRAAVL

SEQ ID NO: 1327689 - protein, 9 aa, Homo Sapiens
YHLLPTEQH

SEQ ID NO: 1327690 - protein, 9 aa, Homo Sapiens
QSVWTLFLE

SEQ ID NO: 1327691 - protein, 9 aa, Homo Sapiens
QLILPDSLT

SEQ ID NO: 1327692 - protein, 9 aa, Homo Sapiens
CRIIQWLEA

SEQ ID NO: 1327693 - protein, 9 aa, Homo Sapiens
SLNQFMTVY

SEQ ID NO: 1327694 - protein, 9 aa, Homo Sapiens
SCTGASTQA

SEQ ID NO: 1327695 - protein, 9 aa, Homo Sapiens
PRLPARDCT

SEQ ID NO: 1327696 - protein, 9 aa, Homo Sapiens
CIITSTYGW

SEQ ID NO: 1327697 - protein, 9 aa, Homo Sapiens
NKHQHFGYV

SEQ ID NO: 1327698 - protein, 9 aa, Homo Sapiens
KSGPGDDFF

SEQ ID NO: 1327699 - protein, 9 aa, Homo Sapiens
LNHYLKSHQ

SEQ ID NO: 1327700 - protein, 9 aa, Homo Sapiens
FAVSLVDTL

SEQ ID NO: 1327701 - protein, 9 aa, Homo Sapiens
KRWHPKLLA

SEQ ID NO: 1327702 - protein, 9 aa, Homo Sapiens
KRQSLNSSS

SEQ ID NO: 1327703 - protein, 9 aa, Homo Sapiens
YLKQVDFSC

SEQ ID NO: 1327704 - protein, 9 aa, Homo Sapiens
VGISPAATQ

SEQ ID NO: 1327705 - protein, 9 aa, Homo Sapiens
APPSRCTGA

SEQ ID NO: 1327706 - protein, 9 aa, Homo Sapiens
ASVQPNEMS

SEQ ID NO: 1327707 - protein, 9 aa, Homo Sapiens
AKLCESCRA

SEQ ID NO: 1327708 - protein, 9 aa, Homo Sapiens
IIYCNFNQL

SEQ ID NO: 1327709 - protein, 9 aa, Homo Sapiens
RAQEQHNVF

SEQ ID NO: 1327710 - protein, 9 aa, Homo Sapiens
SCKPWATPD

SEQ ID NO: 1327711 - protein, 9 aa, Homo Sapiens
SLVKTCDSS

SEQ ID NO: 1327712 - protein, 9 aa, Homo Sapiens
ESCEKNDFL

SEQ ID NO: 1327713 - protein, 9 aa, Homo Sapiens
LDPVWLMVD

SEQ ID NO: 1327714 - protein, 9 aa, Homo Sapiens
DWHLKIPKM

SEQ ID NO: 1327715 - protein, 9 aa, Homo Sapiens
FLVALLAHV

SEQ ID NO: 1327716 - protein, 9 aa, Homo Sapiens
NVMILMNPV

SEQ ID NO: 1327717 - protein, 9 aa, Homo Sapiens
CSCPTCTDS

SEQ ID NO: 1327718 - protein, 9 aa, Homo Sapiens
AASAGRRSA

SEQ ID NO: 1327719 - protein, 9 aa, Homo Sapiens
PGSLCSMEI

SEQ ID NO: 1327720 - protein, 9 aa, Homo Sapiens
TDQIWKFQH

SEQ ID NO: 1327721 - protein, 9 aa, Homo Sapiens
QNPVNQFAG

SEQ ID NO: 1327722 - protein, 9 aa, Homo Sapiens
KTRSRTNLM

SEQ ID NO: 1327723 - protein, 9 aa, Homo Sapiens
LLALTTHFT

SEQ ID NO: 1327724 - protein, 9 aa, Homo Sapiens
MNITDEMKC

SEQ ID NO: 1327725 - protein, 9 aa, Homo Sapiens
CPTTWPPSR

SEQ ID NO: 1327726 - protein, 9 aa, Homo Sapiens
PITMQTVYV

SEQ ID NO: 1327727 - protein, 9 aa, Homo Sapiens
ARMQVWFQN

SEQ ID NO: 1327728 - protein, 9 aa, Homo Sapiens
VKTHNGVKP

SEQ ID NO: 1327729 - protein, 9 aa, Homo Sapiens
QIILFFFLF

SEQ ID NO: 1327730 - protein, 9 aa, Homo Sapiens
YVSCCLQPN

SEQ ID NO: 1327731 - protein, 9 aa, Homo Sapiens
ASVSSKSDE

SEQ ID NO: 1327732 - protein, 9 aa, Homo Sapiens
QCTGKCSAC

SEQ ID NO: 1327733 - protein, 9 aa, Homo Sapiens
LYVDSDSEE

SEQ ID NO: 1327734 - protein, 9 aa, Homo Sapiens
ANDQEQASW

SEQ ID NO: 1327735 - protein, 9 aa, Homo Sapiens
VQQQLIREM

SEQ ID NO: 1327736 - protein, 9 aa, Homo Sapiens
TSVKSLLQI

SEQ ID NO: 1327737 - protein, 9 aa, Homo Sapiens
RPDEGYCQV

SEQ ID NO: 1327738 - protein, 9 aa, Homo Sapiens
GFNPFQHLE

SEQ ID NO: 1327739 - protein, 9 aa, Homo Sapiens
GAMTSECHP

SEQ ID NO: 1327740 - protein, 9 aa, Homo Sapiens
SVICEHIKQ

SEQ ID NO: 1327741 - protein, 9 aa, Homo Sapiens
PVEKLMRDV

SEQ ID NO: 1327742 - protein, 9 aa, Homo Sapiens
EKDEWLEAI

SEQ ID NO: 1327743 - protein, 9 aa, Homo Sapiens
VKRIQINFV

SEQ ID NO: 1327744 - protein, 9 aa, Homo Sapiens
KITPRTVYT

SEQ ID NO: 1327745 - protein, 9 aa, Homo Sapiens
QDVVVLDHV

SEQ ID NO: 1327746 - protein, 9 aa, Homo Sapiens
EYQPHIIVS

SEQ ID NO: 1327747 - protein, 9 aa, Homo Sapiens
WMWQLVSFQ

SEQ ID NO: 1327748 - protein, 9 aa, Homo Sapiens
LGYQLCKPD

SEQ ID NO: 1327749 - protein, 9 aa, Homo Sapiens
NDESPLGLC

SEQ ID NO: 1327750 - protein, 9 aa, Homo Sapiens
TVTQLKECL

SEQ ID NO: 1327751 - protein, 9 aa, Homo Sapiens
YTLNKHQHF

SEQ ID NO: 1327752 - protein, 9 aa, Homo Sapiens
HEYDSGTYR

SEQ ID NO: 1327753 - protein, 9 aa, Homo Sapiens
WRYQLLLKM

SEQ ID NO: 1327754 - protein, 9 aa, Homo Sapiens
RFFKYLCIT

SEQ ID NO: 1327755 - protein, 9 aa, Homo Sapiens
AYILTCNMS

SEQ ID NO: 1327756 - protein, 9 aa, Homo Sapiens
CSILGLGQA

SEQ ID NO: 1327757 - protein, 9 aa, Homo Sapiens
MYGVSKHCI

SEQ ID NO: 1327758 - protein, 9 aa, Homo Sapiens
MNRGGMSGC

SEQ ID NO: 1327759 - protein, 9 aa, Homo Sapiens
AACPTASRP

SEQ ID NO: 1327760 - protein, 9 aa, Homo Sapiens
EEPKITQLQ

SEQ ID NO: 1327761 - protein, 9 aa, Homo Sapiens
NSCGAFGYR

SEQ ID NO: 1327762 - protein, 9 aa, Homo Sapiens
GVIANSLTC

SEQ ID NO: 1327763 - protein, 9 aa, Homo Sapiens
TKIDCVECL

SEQ ID NO: 1327764 - protein, 9 aa, Homo Sapiens
QIINQKWVE

SEQ ID NO: 1327765 - protein, 9 aa, Homo Sapiens
SQHRPSYDV

SEQ ID NO: 1327766 - protein, 9 aa, Homo Sapiens
LKHMDKNEE

SEQ ID NO: 1327767 - protein, 9 aa, Homo Sapiens
HVPKSGVKL

SEQ ID NO: 1327768 - protein, 9 aa, Homo Sapiens
KHGKSLYYY

SEQ ID NO: 1327769 - protein, 9 aa, Homo Sapiens
HIKAHGDWR

SEQ ID NO: 1327770 - protein, 9 aa, Homo Sapiens
LCYKFCKQV

SEQ ID NO: 1327771 - protein, 9 aa, Homo Sapiens
WCVGFLFQK

SEQ ID NO: 1327772 - protein, 9 aa, Homo Sapiens
ITNCPKGFT

SEQ ID NO: 1327773 - protein, 9 aa, Homo Sapiens
ARDNTTNFL

SEQ ID NO: 1327774 - protein, 9 aa, Homo Sapiens
MVVPLMPDQ

SEQ ID NO: 1327775 - protein, 9 aa, Homo Sapiens
PREYQNRFL

SEQ ID NO: 1327776 - protein, 9 aa, Homo Sapiens
AMGPRVEAG

SEQ ID NO: 1327777 - protein, 9 aa, Homo Sapiens
EKQKSIILL

SEQ ID NO: 1327778 - protein, 9 aa, Homo Sapiens
DVFEVKATA

SEQ ID NO: 1327779 - protein, 9 aa, Homo Sapiens
SNYWMNVIT

SEQ ID NO: 1327780 - protein, 9 aa, Homo Sapiens
VRAIWIDGT

SEQ ID NO: 1327781 - protein, 9 aa, Homo Sapiens
TEGTELSRR

SEQ ID NO: 1327782 - protein, 9 aa, Homo Sapiens
PHARASWAF

SEQ ID NO: 1327783 - protein, 9 aa, Homo Sapiens
ILRLVQATP

SEQ ID NO: 1327784 - protein, 9 aa, Homo Sapiens
QTYECPIAF

SEQ ID NO: 1327785 - protein, 9 aa, Homo Sapiens
ARVLIVTFL

SEQ ID NO: 1327786 - protein, 9 aa, Homo Sapiens
APFDKISDA

SEQ ID NO: 1327787 - protein, 9 aa, Homo Sapiens
QPDDWYGHR

SEQ ID NO: 1327788 - protein, 9 aa, Homo Sapiens
MPHTREKPF

SEQ ID NO: 1327789 - protein, 9 aa, Homo Sapiens
DVVPSMQPV

SEQ ID NO: 1327790 - protein, 9 aa, Homo Sapiens
SPELSQKSP

SEQ ID NO: 1327791 - protein, 9 aa, Homo Sapiens
IVTLVNPFN

SEQ ID NO: 1327792 - protein, 9 aa, Homo Sapiens
FSNFTMIMQ

SEQ ID NO: 1327793 - protein, 9 aa, Homo Sapiens
MVERAAISS

SEQ ID NO: 1327794 - protein, 9 aa, Homo Sapiens
PSEVCDTET

SEQ ID NO: 1327795 - protein, 9 aa, Homo Sapiens
VAQVAQDEE

SEQ ID NO: 1327796 - protein, 9 aa, Homo Sapiens
DLVDKNEWK

SEQ ID NO: 1327797 - protein, 9 aa, Homo Sapiens
TYFDTQNNI

SEQ ID NO: 1327798 - protein, 9 aa, Homo Sapiens
KKDVYKVGE

SEQ ID NO: 1327799 - protein, 9 aa, Homo Sapiens
PWPEVWKEV

SEQ ID NO: 1327800 - protein, 9 aa, Homo Sapiens
QMISEGDIG

SEQ ID NO: 1327801 - protein, 9 aa, Homo Sapiens
DRVSHASVW

SEQ ID NO: 1327802 - protein, 9 aa, Homo Sapiens
LLVWYRHYF

SEQ ID NO: 1327803 - protein, 9 aa, Homo Sapiens
GGCSYMPST

SEQ ID NO: 1327804 - protein, 9 aa, Homo Sapiens
YPGKHFWYL

SEQ ID NO: 1327805 - protein, 9 aa, Homo Sapiens
KKKLKLAPL

SEQ ID NO: 1327806 - protein, 9 aa, Homo Sapiens
SMVAVIVYC

SEQ ID NO: 1327807 - protein, 9 aa, Homo Sapiens
PGSHFVAVD

SEQ ID NO: 1327808 - protein, 9 aa, Homo Sapiens
LWVVVSDAT

SEQ ID NO: 1327809 - protein, 9 aa, Homo Sapiens
HLIYPLLCR

SEQ ID NO: 1327810 - protein, 9 aa, Homo Sapiens
CAVEEIRNG

SEQ ID NO: 1327811 - protein, 9 aa, Homo Sapiens
FRRRLNLTQ

SEQ ID NO: 1327812 - protein, 9 aa, Homo Sapiens
EEIMKQIQD

SEQ ID NO: 1327813 - protein, 9 aa, Homo Sapiens
HREHILELS

SEQ ID NO: 1327814 - protein, 9 aa, Homo Sapiens
ILDHIKAHG

SEQ ID NO: 1327815 - protein, 9 aa, Homo Sapiens
GVLLLGDTY

SEQ ID NO: 1327816 - protein, 9 aa, Homo Sapiens
LVANMEPVQ

SEQ ID NO: 1327817 - protein, 9 aa, Homo Sapiens
QQQHHKEVK

SEQ ID NO: 1327818 - protein, 9 aa, Homo Sapiens
DLETTSCST

SEQ ID NO: 1327819 - protein, 9 aa, Homo Sapiens
ITGIKDQFL

SEQ ID NO: 1327820 - protein, 9 aa, Homo Sapiens
AARLTQGTD

SEQ ID NO: 1327821 - protein, 9 aa, Homo Sapiens
HTSGQKLAS

SEQ ID NO: 1327822 - protein, 9 aa, Homo Sapiens
HPAGRSCGH

SEQ ID NO: 1327823 - protein, 9 aa, Homo Sapiens
VTEFEQCHH

SEQ ID NO: 1327824 - protein, 9 aa, Homo Sapiens
PSIHSNIND

SEQ ID NO: 1327825 - protein, 9 aa, Homo Sapiens
AQEEYSRKG

SEQ ID NO: 1327826 - protein, 9 aa, Homo Sapiens
MGFSTPATS

SEQ ID NO: 1327827 - protein, 9 aa, Homo Sapiens
KEFKAQGVT

SEQ ID NO: 1327828 - protein, 9 aa, Homo Sapiens
SLGGNSHTI

SEQ ID NO: 1327829 - protein, 9 aa, Homo Sapiens
GISPAATQP

SEQ ID NO: 1327830 - protein, 9 aa, Homo Sapiens
MVLYLQQAK

SEQ ID NO: 1327831 - protein, 9 aa, Homo Sapiens
LSEYSPNSS

SEQ ID NO: 1327832 - protein, 9 aa, Homo Sapiens
HLRQAVELL

SEQ ID NO: 1327833 - protein, 9 aa, Homo Sapiens
KIPLNPSPS

SEQ ID NO: 1327834 - protein, 9 aa, Homo Sapiens
GLNKSQLVE

SEQ ID NO: 1327835 - protein, 9 aa, Homo Sapiens
RYEETMFHC

SEQ ID NO: 1327836 - protein, 9 aa, Homo Sapiens
SAETLIQLP

SEQ ID NO: 1327837 - protein, 9 aa, Homo Sapiens
EAYTSYSVS

SEQ ID NO: 1327838 - protein, 9 aa, Homo Sapiens
NITQFLPLP

SEQ ID NO: 1327839 - protein, 9 aa, Homo Sapiens
TKEEPLISA

SEQ ID NO: 1327840 - protein, 9 aa, Homo Sapiens
EKRVTSYQM

SEQ ID NO: 1327841 - protein, 9 aa, Homo Sapiens
WTRDASIIK

SEQ ID NO: 1327842 - protein, 9 aa, Homo Sapiens
IVCGKLTPE

SEQ ID NO: 1327843 - protein, 9 aa, Homo Sapiens
ETVKHREFQ

SEQ ID NO: 1327844 - protein, 9 aa, Homo Sapiens
WNFIESPMI

SEQ ID NO: 1327845 - protein, 9 aa, Homo Sapiens
DDFYYGWDG

SEQ ID NO: 1327846 - protein, 9 aa, Homo Sapiens
AREALVAEL

SEQ ID NO: 1327847 - protein, 9 aa, Homo Sapiens
AMSQARFEK

SEQ ID NO: 1327848 - protein, 9 aa, Homo Sapiens
LLIFFFITL

SEQ ID NO: 1327849 - protein, 9 aa, Homo Sapiens
QTVSERKNC

SEQ ID NO: 1327850 - protein, 9 aa, Homo Sapiens
FASMWSELQ

SEQ ID NO: 1327851 - protein, 9 aa, Homo Sapiens
SPLIFIFAY

SEQ ID NO: 1327852 - protein, 9 aa, Homo Sapiens
SGGITILGG

SEQ ID NO: 1327853 - protein, 9 aa, Homo Sapiens
NSLPQAFPA

SEQ ID NO: 1327854 - protein, 9 aa, Homo Sapiens
VISYSIQDR

SEQ ID NO: 1327855 - protein, 9 aa, Homo Sapiens
GCCNNHNVQ

SEQ ID NO: 1327856 - protein, 9 aa, Homo Sapiens
RSPVMSGGI

SEQ ID NO: 1327857 - protein, 9 aa, Homo Sapiens
LRSQLRVGH

SEQ ID NO: 1327858 - protein, 9 aa, Homo Sapiens
ENTDKSKAA

SEQ ID NO: 1327859 - protein, 9 aa, Homo Sapiens
GEENEKERL

SEQ ID NO: 1327860 - protein, 9 aa, Homo Sapiens
IVRQCDMYR

SEQ ID NO: 1327861 - protein, 9 aa, Homo Sapiens
TDTVPLPGS

SEQ ID NO: 1327862 - protein, 9 aa, Homo Sapiens
RIPLLRKCW

SEQ ID NO: 1327863 - protein, 9 aa, Homo Sapiens
CKQLTYYSK

SEQ ID NO: 1327864 - protein, 9 aa, Homo Sapiens
QEPDFHIAG

SEQ ID NO: 1327865 - protein, 9 aa, Homo Sapiens
QLLLWAKAM

SEQ ID NO: 1327866 - protein, 9 aa, Homo Sapiens
LSDTLNKLK

SEQ ID NO: 1327867 - protein, 9 aa, Homo Sapiens
IASAIVQAH

SEQ ID NO: 1327868 - protein, 9 aa, Homo Sapiens
EGHPKYALW

SEQ ID NO: 1327869 - protein, 9 aa, Homo Sapiens
VCLWLHEAQ

SEQ ID NO: 1327870 - protein, 9 aa, Homo Sapiens
AECEQALRL

SEQ ID NO: 1327871 - protein, 9 aa, Homo Sapiens
TAEAHRRMV

SEQ ID NO: 1327872 - protein, 9 aa, Homo Sapiens
NATCLHKLK

SEQ ID NO: 1327873 - protein, 9 aa, Homo Sapiens
ATKTRATES

SEQ ID NO: 1327874 - protein, 9 aa, Homo Sapiens
IYSFGIFLY

SEQ ID NO: 1327875 - protein, 9 aa, Homo Sapiens
DISLSLYPT

SEQ ID NO: 1327876 - protein, 9 aa, Homo Sapiens
PFASGGFLY

SEQ ID NO: 1327877 - protein, 9 aa, Homo Sapiens
PCDTGNRAL

SEQ ID NO: 1327878 - protein, 9 aa, Homo Sapiens
VETERIRAE

SEQ ID NO: 1327879 - protein, 9 aa, Homo Sapiens
REISKEGNH

SEQ ID NO: 1327880 - protein, 9 aa, Homo Sapiens
HGPPSSPTP

SEQ ID NO: 1327881 - protein, 9 aa, Homo Sapiens
PPGMRELLG

SEQ ID NO: 1327882 - protein, 9 aa, Homo Sapiens
PMNDNIFAS

SEQ ID NO: 1327883 - protein, 9 aa, Homo Sapiens
PRAPHPPQP

SEQ ID NO: 1327884 - protein, 9 aa, Homo Sapiens
SSRIVAPGH

SEQ ID NO: 1327885 - protein, 9 aa, Homo Sapiens
DMAATGEQH

SEQ ID NO: 1327886 - protein, 9 aa, Homo Sapiens
HNDLIAQSA

SEQ ID NO: 1327887 - protein, 9 aa, Homo Sapiens
ALQNTLKAK

SEQ ID NO: 1327888 - protein, 9 aa, Homo Sapiens
TFEGALNGM

SEQ ID NO: 1327889 - protein, 9 aa, Homo Sapiens
RDDSDVIYP

SEQ ID NO: 1327890 - protein, 9 aa, Homo Sapiens
VITRNRDDP

SEQ ID NO: 1327891 - protein, 9 aa, Homo Sapiens
NNDGVDEGI

SEQ ID NO: 1327892 - protein, 9 aa, Homo Sapiens
ISDRTRNMF

SEQ ID NO: 1327893 - protein, 9 aa, Homo Sapiens
SHSEPLVSF

SEQ ID NO: 1327894 - protein, 9 aa, Homo Sapiens
PKLKEKVWP

SEQ ID NO: 1327895 - protein, 9 aa, Homo Sapiens
WAITYLLGL

SEQ ID NO: 1327896 - protein, 9 aa, Homo Sapiens
YLDRSLRKC

SEQ ID NO: 1327897 - protein, 9 aa, Homo Sapiens
QLRFLKLKR

SEQ ID NO: 1327898 - protein, 9 aa, Homo Sapiens
SLWDCFNLF

SEQ ID NO: 1327899 - protein, 9 aa, Homo Sapiens
GALVTTARN

SEQ ID NO: 1327900 - protein, 9 aa, Homo Sapiens
RSMRYQQNC

SEQ ID NO: 1327901 - protein, 9 aa, Homo Sapiens
EVLAMIEST

SEQ ID NO: 1327902 - protein, 9 aa, Homo Sapiens
QARWPLSVA

SEQ ID NO: 1327903 - protein, 9 aa, Homo Sapiens
IMDLMLICT

SEQ ID NO: 1327904 - protein, 9 aa, Homo Sapiens
STPSMCYWR

SEQ ID NO: 1327905 - protein, 9 aa, Homo Sapiens
GLSGASGLD

SEQ ID NO: 1327906 - protein, 9 aa, Homo Sapiens
LQDITDVLG

SEQ ID NO: 1327907 - protein, 9 aa, Homo Sapiens
TIQLYLGTK

SEQ ID NO: 1327908 - protein, 9 aa, Homo Sapiens
NSYCSLHPH

SEQ ID NO: 1327909 - protein, 9 aa, Homo Sapiens
EDTQLGTVI

SEQ ID NO: 1327910 - protein, 9 aa, Homo Sapiens
REAKGNQAL

SEQ ID NO: 1327911 - protein, 9 aa, Homo Sapiens
QEDIRKKKD

SEQ ID NO: 1327912 - protein, 9 aa, Homo Sapiens
PHFSKILEN

SEQ ID NO: 1327913 - protein, 9 aa, Homo Sapiens
LERHYEELH

SEQ ID NO: 1327914 - protein, 9 aa, Homo Sapiens
CDECDMRFT

SEQ ID NO: 1327915 - protein, 9 aa, Homo Sapiens
SAVVHKYAL

SEQ ID NO: 1327916 - protein, 9 aa, Homo Sapiens
NLRWRKAHF

SEQ ID NO: 1327917 - protein, 9 aa, Homo Sapiens
PLCDHTSTL

SEQ ID NO: 1327918 - protein, 9 aa, Homo Sapiens
PIYSFGIFL

SEQ ID NO: 1327919 - protein, 9 aa, Homo Sapiens
MREQEQKMW

SEQ ID NO: 1327920 - protein, 9 aa, Homo Sapiens
VPSDPFSLK

SEQ ID NO: 1327921 - protein, 9 aa, Homo Sapiens
IIIVVNQEI

SEQ ID NO: 1327922 - protein, 9 aa, Homo Sapiens
RHHLKTHTT

SEQ ID NO: 1327923 - protein, 9 aa, Homo Sapiens
IKWTVLRVI

SEQ ID NO: 1327924 - protein, 9 aa, Homo Sapiens
SVSPMNDNI

SEQ ID NO: 1327925 - protein, 9 aa, Homo Sapiens
LCVDQWLKI

SEQ ID NO: 1327926 - protein, 9 aa, Homo Sapiens
VCSAVGLNI

SEQ ID NO: 1327927 - protein, 9 aa, Homo Sapiens
IRREQQSAH

SEQ ID NO: 1327928 - protein, 9 aa, Homo Sapiens
NNENADALA

SEQ ID NO: 1327929 - protein, 9 aa, Homo Sapiens
MPDMPFPSI

SEQ ID NO: 1327930 - protein, 9 aa, Homo Sapiens
FLLFFPSCT

SEQ ID NO: 1327931 - protein, 9 aa, Homo Sapiens
LQKATCHHP

SEQ ID NO: 1327932 - protein, 9 aa, Homo Sapiens
TPVVLPHSL

SEQ ID NO: 1327933 - protein, 9 aa, Homo Sapiens
AHLCPQQHV

SEQ ID NO: 1327934 - protein, 9 aa, Homo Sapiens
VGGQLNLVV

SEQ ID NO: 1327935 - protein, 9 aa, Homo Sapiens
TAEKLDFAG

SEQ ID NO: 1327936 - protein, 9 aa, Homo Sapiens
KSFNFDHVF

SEQ ID NO: 1327937 - protein, 9 aa, Homo Sapiens
PRQSVTDCL

SEQ ID NO: 1327938 - protein, 9 aa, Homo Sapiens
RGIMPSFGM

SEQ ID NO: 1327939 - protein, 9 aa, Homo Sapiens
SDLTTKNLD

SEQ ID NO: 1327940 - protein, 9 aa, Homo Sapiens
HREFMRNAV

SEQ ID NO: 1327941 - protein, 9 aa, Homo Sapiens
CGMTFSHFM

SEQ ID NO: 1327942 - protein, 9 aa, Homo Sapiens
KRNRHHIEK

SEQ ID NO: 1327943 - protein, 9 aa, Homo Sapiens
KPSIEVADP

SEQ ID NO: 1327944 - protein, 9 aa, Homo Sapiens
DTKVISVST

SEQ ID NO: 1327945 - protein, 9 aa, Homo Sapiens
TQILFPNRQ

SEQ ID NO: 1327946 - protein, 9 aa, Homo Sapiens
TAKTQFLQN

SEQ ID NO: 1327947 - protein, 9 aa, Homo Sapiens
IAVCVHQCL

SEQ ID NO: 1327948 - protein, 9 aa, Homo Sapiens
LLRKCWFQL

SEQ ID NO: 1327949 - protein, 9 aa, Homo Sapiens
MKEEPTKPV

SEQ ID NO: 1327950 - protein, 9 aa, Homo Sapiens
SRSWSRGWY

SEQ ID NO: 1327951 - protein, 9 aa, Homo Sapiens
TTEANNLAA

SEQ ID NO: 1327952 - protein, 9 aa, Homo Sapiens
RICVQAHCG

SEQ ID NO: 1327953 - protein, 9 aa, Homo Sapiens
FQVISPQCI

SEQ ID NO: 1327954 - protein, 9 aa, Homo Sapiens
EPSRGENVA

SEQ ID NO: 1327955 - protein, 9 aa, Homo Sapiens
SLLIEHQRV

SEQ ID NO: 1327956 - protein, 9 aa, Homo Sapiens
WDQLLEASA

SEQ ID NO: 1327957 - protein, 9 aa, Homo Sapiens
MKMKKIQIP

SEQ ID NO: 1327958 - protein, 9 aa, Homo Sapiens
AALFAAVIH

SEQ ID NO: 1327959 - protein, 9 aa, Homo Sapiens
VQWHSKVWQ

SEQ ID NO: 1327960 - protein, 9 aa, Homo Sapiens
PEGDDNWAN

SEQ ID NO: 1327961 - protein, 9 aa, Homo Sapiens
TIVRRRGRR

SEQ ID NO: 1327962 - protein, 9 aa, Homo Sapiens
QLNVSSVRQ

SEQ ID NO: 1327963 - protein, 9 aa, Homo Sapiens
MMALGETSM

SEQ ID NO: 1327964 - protein, 9 aa, Homo Sapiens
LFWLMIFSP

SEQ ID NO: 1327965 - protein, 9 aa, Homo Sapiens
KGSHARFNC

SEQ ID NO: 1327966 - protein, 9 aa, Homo Sapiens
EDIMEISVT

SEQ ID NO: 1327967 - protein, 9 aa, Homo Sapiens
DSLSEYSPN

SEQ ID NO: 1327968 - protein, 9 aa, Homo Sapiens
CVDAGRIPQ

SEQ ID NO: 1327969 - protein, 9 aa, Homo Sapiens
LVNMGGNRS

SEQ ID NO: 1327970 - protein, 9 aa, Homo Sapiens
QEIRKILKI

SEQ ID NO: 1327971 - protein, 9 aa, Homo Sapiens
LIFGLNVLL

SEQ ID NO: 1327972 - protein, 9 aa, Homo Sapiens
LGVAVDAQV

SEQ ID NO: 1327973 - protein, 9 aa, Homo Sapiens
GSGRPRPGT

SEQ ID NO: 1327974 - protein, 9 aa, Homo Sapiens
RSVHLKEGD

SEQ ID NO: 1327975 - protein, 9 aa, Homo Sapiens
QNGAEQYLV

SEQ ID NO: 1327976 - protein, 9 aa, Homo Sapiens
ACLKVSADG

SEQ ID NO: 1327977 - protein, 9 aa, Homo Sapiens
EGNANGGLV

SEQ ID NO: 1327978 - protein, 9 aa, Homo Sapiens
YDFVSALVF

SEQ ID NO: 1327979 - protein, 9 aa, Homo Sapiens
GLDLLMDLL

SEQ ID NO: 1327980 - protein, 9 aa, Homo Sapiens
LLLCHGFIF

SEQ ID NO: 1327981 - protein, 9 aa, Homo Sapiens
QLMEKCTAL

SEQ ID NO: 1327982 - protein, 9 aa, Homo Sapiens
YSGKMNLNW

SEQ ID NO: 1327983 - protein, 9 aa, Homo Sapiens
DIFAGAWIA

SEQ ID NO: 1327984 - protein, 9 aa, Homo Sapiens
IPKRSSLEK

SEQ ID NO: 1327985 - protein, 9 aa, Homo Sapiens
TGEKLYVCS

SEQ ID NO: 1327986 - protein, 9 aa, Homo Sapiens
RGGHLGVFC

SEQ ID NO: 1327987 - protein, 9 aa, Homo Sapiens
RKPKRANCV

SEQ ID NO: 1327988 - protein, 9 aa, Homo Sapiens
IIQQDTSET

SEQ ID NO: 1327989 - protein, 9 aa, Homo Sapiens
VLKHMDKNE

SEQ ID NO: 1327990 - protein, 9 aa, Homo Sapiens
CLVLIIYNF

SEQ ID NO: 1327991 - protein, 9 aa, Homo Sapiens
PPAHRAVDV

SEQ ID NO: 1327992 - protein, 9 aa, Homo Sapiens
CCFDVHISQ

SEQ ID NO: 1327993 - protein, 9 aa, Homo Sapiens
SRLETEMRR

SEQ ID NO: 1327994 - protein, 9 aa, Homo Sapiens
SHLVRESSG

SEQ ID NO: 1327995 - protein, 9 aa, Homo Sapiens
LWGPLKKSN

SEQ ID NO: 1327996 - protein, 9 aa, Homo Sapiens
VYFDEFVMM

SEQ ID NO: 1327997 - protein, 9 aa, Homo Sapiens
KNNPPYILD

SEQ ID NO: 1327998 - protein, 9 aa, Homo Sapiens
PQSKVMYIT

SEQ ID NO: 1327999 - protein, 9 aa, Homo Sapiens
MALGILGFF

SEQ ID NO: 1328000 - protein, 9 aa, Homo Sapiens
KEYQPHIIV

SEQ ID NO: 1328001 - protein, 9 aa, Homo Sapiens
EYPILSLSV

SEQ ID NO: 1328002 - protein, 9 aa, Homo Sapiens
KYALAVCLS

SEQ ID NO: 1328003 - protein, 9 aa, Homo Sapiens
RGEWRQGGS

SEQ ID NO: 1328004 - protein, 9 aa, Homo Sapiens
RKDISVKIK

SEQ ID NO: 1328005 - protein, 9 aa, Homo Sapiens
PSTKEHHVV

SEQ ID NO: 1328006 - protein, 9 aa, Homo Sapiens
LCGEESFDT

SEQ ID NO: 1328007 - protein, 9 aa, Homo Sapiens
PSYLITCCP

SEQ ID NO: 1328008 - protein, 9 aa, Homo Sapiens
SGLLDAGKM

SEQ ID NO: 1328009 - protein, 9 aa, Homo Sapiens
DGEADPFVN

SEQ ID NO: 1328010 - protein, 9 aa, Homo Sapiens
ENGKITGIK

SEQ ID NO: 1328011 - protein, 9 aa, Homo Sapiens
YVHETQELF

SEQ ID NO: 1328012 - protein, 9 aa, Homo Sapiens
QQRERERRE

SEQ ID NO: 1328013 - protein, 9 aa, Homo Sapiens
RQGKLWLQK

SEQ ID NO: 1328014 - protein, 9 aa, Homo Sapiens
TWLENGNMS

SEQ ID NO: 1328015 - protein, 9 aa, Homo Sapiens
NFDHVFHGN

SEQ ID NO: 1328016 - protein, 9 aa, Homo Sapiens
PSSISCAQI

SEQ ID NO: 1328017 - protein, 9 aa, Homo Sapiens
YCPNHPIIQ

SEQ ID NO: 1328018 - protein, 9 aa, Homo Sapiens
MMSRGREKC

SEQ ID NO: 1328019 - protein, 9 aa, Homo Sapiens
GHDPVHKLL

SEQ ID NO: 1328020 - protein, 9 aa, Homo Sapiens
QNRARKYFV

SEQ ID NO: 1328021 - protein, 9 aa, Homo Sapiens
RAEEAEPIM

SEQ ID NO: 1328022 - protein, 9 aa, Homo Sapiens
QGRPGHPDT

SEQ ID NO: 1328023 - protein, 9 aa, Homo Sapiens
TTMSIESPF

SEQ ID NO: 1328024 - protein, 9 aa, Homo Sapiens
TPEATYQMA

SEQ ID NO: 1328025 - protein, 9 aa, Homo Sapiens
QASHSEPLV

SEQ ID NO: 1328026 - protein, 9 aa, Homo Sapiens
LNKGFKDTN

SEQ ID NO: 1328027 - protein, 9 aa, Homo Sapiens
TSSPDYQHY

SEQ ID NO: 1328028 - protein, 9 aa, Homo Sapiens
NNRYLDFSI

SEQ ID NO: 1328029 - protein, 9 aa, Homo Sapiens
QIRQYHIKP

SEQ ID NO: 1328030 - protein, 9 aa, Homo Sapiens
VTCGWDNLL

SEQ ID NO: 1328031 - protein, 9 aa, Homo Sapiens
LNCRVRRGT

SEQ ID NO: 1328032 - protein, 9 aa, Homo Sapiens
NDLKKKRIV

SEQ ID NO: 1328033 - protein, 9 aa, Homo Sapiens
WNQKDALLF

SEQ ID NO: 1328034 - protein, 9 aa, Homo Sapiens
VEEDDDDDD

SEQ ID NO: 1328035 - protein, 9 aa, Homo Sapiens
GRMDQDIFD

SEQ ID NO: 1328036 - protein, 9 aa, Homo Sapiens
TSIAAPEKC

SEQ ID NO: 1328037 - protein, 9 aa, Homo Sapiens
LQSVPVFQV

SEQ ID NO: 1328038 - protein, 9 aa, Homo Sapiens
ESEMEYVIR

SEQ ID NO: 1328039 - protein, 9 aa, Homo Sapiens
TSLWTPPQG

SEQ ID NO: 1328040 - protein, 9 aa, Homo Sapiens
QFHYHLCGL

SEQ ID NO: 1328041 - protein, 9 aa, Homo Sapiens
TGTSTSSLE

SEQ ID NO: 1328042 - protein, 9 aa, Homo Sapiens
VWNLPLENP

SEQ ID NO: 1328043 - protein, 9 aa, Homo Sapiens
KQDCAHFVC

SEQ ID NO: 1328044 - protein, 9 aa, Homo Sapiens
EQTECGRRL

SEQ ID NO: 1328045 - protein, 9 aa, Homo Sapiens
ECIVTTHIR

SEQ ID NO: 1328046 - protein, 9 aa, Homo Sapiens
ERSNAQWQL

SEQ ID NO: 1328047 - protein, 9 aa, Homo Sapiens
TSAISSPAL

SEQ ID NO: 1328048 - protein, 9 aa, Homo Sapiens
VWVLHSIGH

SEQ ID NO: 1328049 - protein, 9 aa, Homo Sapiens
LTSSPEVEG

SEQ ID NO: 1328050 - protein, 9 aa, Homo Sapiens
SAAERYTNF

SEQ ID NO: 1328051 - protein, 9 aa, Homo Sapiens
LHLDTFAME

SEQ ID NO: 1328052 - protein, 9 aa, Homo Sapiens
KKENHTCSG

SEQ ID NO: 1328053 - protein, 9 aa, Homo Sapiens
TLESAKGAP

SEQ ID NO: 1328054 - protein, 9 aa, Homo Sapiens
IKAHGDWRD

SEQ ID NO: 1328055 - protein, 9 aa, Homo Sapiens
GSAVSIYVP

SEQ ID NO: 1328056 - protein, 9 aa, Homo Sapiens
AINFQRDVF

SEQ ID NO: 1328057 - protein, 9 aa, Homo Sapiens
PAALPPRPG

SEQ ID NO: 1328058 - protein, 9 aa, Homo Sapiens
GERDYGPSI

SEQ ID NO: 1328059 - protein, 9 aa, Homo Sapiens
GTGSDFDVH

SEQ ID NO: 1328060 - protein, 9 aa, Homo Sapiens
TQPNTKYIF

SEQ ID NO: 1328061 - protein, 9 aa, Homo Sapiens
RECDTMADM

SEQ ID NO: 1328062 - protein, 9 aa, Homo Sapiens
TMSHMHKNG

SEQ ID NO: 1328063 - protein, 9 aa, Homo Sapiens
YVGKFLRVH

SEQ ID NO: 1328064 - protein, 9 aa, Homo Sapiens
ADMSSLVEV

SEQ ID NO: 1328065 - protein, 9 aa, Homo Sapiens
PFLKRGKDG

SEQ ID NO: 1328066 - protein, 9 aa, Homo Sapiens
DLPKAHTTF

SEQ ID NO: 1328067 - protein, 9 aa, Homo Sapiens
VINATGSAH

SEQ ID NO: 1328068 - protein, 9 aa, Homo Sapiens
STKIWSKSN

SEQ ID NO: 1328069 - protein, 9 aa, Homo Sapiens
TLGKLNAVI

SEQ ID NO: 1328070 - protein, 9 aa, Homo Sapiens
VLDHRYYAD

SEQ ID NO: 1328071 - protein, 9 aa, Homo Sapiens
APCQQVLVH

SEQ ID NO: 1328072 - protein, 9 aa, Homo Sapiens
FTLFACEEL

SEQ ID NO: 1328073 - protein, 9 aa, Homo Sapiens
AMTHGCFLN

SEQ ID NO: 1328074 - protein, 9 aa, Homo Sapiens
ADLDWPNLV

SEQ ID NO: 1328075 - protein, 9 aa, Homo Sapiens
TKAVVAAHI

SEQ ID NO: 1328076 - protein, 9 aa, Homo Sapiens
EVMGAVRRL

SEQ ID NO: 1328077 - protein, 9 aa, Homo Sapiens
LEDYHPLIT

SEQ ID NO: 1328078 - protein, 9 aa, Homo Sapiens
AARASPSTR

SEQ ID NO: 1328079 - protein, 9 aa, Homo Sapiens
PVMMVLQGG

SEQ ID NO: 1328080 - protein, 9 aa, Homo Sapiens
LSRDATPLP

SEQ ID NO: 1328081 - protein, 9 aa, Homo Sapiens
VGIYLQQMS

SEQ ID NO: 1328082 - protein, 9 aa, Homo Sapiens
WPVFPIGLG

SEQ ID NO: 1328083 - protein, 9 aa, Homo Sapiens
LSSGFTGVY

SEQ ID NO: 1328084 - protein, 9 aa, Homo Sapiens
FGLVLIITP

SEQ ID NO: 1328085 - protein, 9 aa, Homo Sapiens
LQEPRGARP

SEQ ID NO: 1328086 - protein, 9 aa, Homo Sapiens
PGAPCVPGP

SEQ ID NO: 1328087 - protein, 9 aa, Homo Sapiens
QPQSRGRPS

SEQ ID NO: 1328088 - protein, 9 aa, Homo Sapiens
AFSFRANMG

SEQ ID NO: 1328089 - protein, 9 aa, Homo Sapiens
VNLDQGYLQ

SEQ ID NO: 1328090 - protein, 9 aa, Homo Sapiens
LSCSFAPKP

SEQ ID NO: 1328091 - protein, 9 aa, Homo Sapiens
AGYSDGSND

SEQ ID NO: 1328092 - protein, 9 aa, Homo Sapiens
NYIRSLIRT

SEQ ID NO: 1328093 - protein, 9 aa, Homo Sapiens
KMGLDEDNK

SEQ ID NO: 1328094 - protein, 9 aa, Homo Sapiens
APAKMSSLP

SEQ ID NO: 1328095 - protein, 9 aa, Homo Sapiens
EERCGIIEF

SEQ ID NO: 1328096 - protein, 9 aa, Homo Sapiens
VWIVRIWDT

SEQ ID NO: 1328097 - protein, 9 aa, Homo Sapiens
CTVCEKTFK

SEQ ID NO: 1328098 - protein, 9 aa, Homo Sapiens
EVRPNSWPW

SEQ ID NO: 1328099 - protein, 9 aa, Homo Sapiens
DGPDPGTPV

SEQ ID NO: 1328100 - protein, 9 aa, Homo Sapiens
ICVKDYCFV

SEQ ID NO: 1328101 - protein, 9 aa, Homo Sapiens
GQRGIIGLP

SEQ ID NO: 1328102 - protein, 9 aa, Homo Sapiens
KPKSFWICL

SEQ ID NO: 1328103 - protein, 9 aa, Homo Sapiens
VNWMRYVNC

SEQ ID NO: 1328104 - protein, 9 aa, Homo Sapiens
CTETPLIIA

SEQ ID NO: 1328105 - protein, 9 aa, Homo Sapiens
HSKLQSQLL

SEQ ID NO: 1328106 - protein, 9 aa, Homo Sapiens
NEDANGFME

SEQ ID NO: 1328107 - protein, 9 aa, Homo Sapiens
LPFDPEQPP

SEQ ID NO: 1328108 - protein, 9 aa, Homo Sapiens
RDNNRVGFV

SEQ ID NO: 1328109 - protein, 9 aa, Homo Sapiens
EGEKVFCVN

SEQ ID NO: 1328110 - protein, 9 aa, Homo Sapiens
QALDTDFRK

SEQ ID NO: 1328111 - protein, 9 aa, Homo Sapiens
ADFLDALTH

SEQ ID NO: 1328112 - protein, 9 aa, Homo Sapiens
EMEYVIRCT

SEQ ID NO: 1328113 - protein, 9 aa, Homo Sapiens
QLCYRVLRH

SEQ ID NO: 1328114 - protein, 9 aa, Homo Sapiens
VRKQCTLAA

SEQ ID NO: 1328115 - protein, 9 aa, Homo Sapiens
IPAHKAHQK

SEQ ID NO: 1328116 - protein, 9 aa, Homo Sapiens
ASQVRDLLS

SEQ ID NO: 1328117 - protein, 9 aa, Homo Sapiens
MNDNIFASS

SEQ ID NO: 1328118 - protein, 9 aa, Homo Sapiens
SETFNHVNG

SEQ ID NO: 1328119 - protein, 9 aa, Homo Sapiens
LSLIDLNHI

SEQ ID NO: 1328120 - protein, 9 aa, Homo Sapiens
CSPLRLSES

SEQ ID NO: 1328121 - protein, 9 aa, Homo Sapiens
LTALWKEKE

SEQ ID NO: 1328122 - protein, 9 aa, Homo Sapiens
PVFIDTASY

SEQ ID NO: 1328123 - protein, 9 aa, Homo Sapiens
KCILQAVNF

SEQ ID NO: 1328124 - protein, 9 aa, Homo Sapiens
LCCIPNHSN

SEQ ID NO: 1328125 - protein, 9 aa, Homo Sapiens
IRGKKQSPL

SEQ ID NO: 1328126 - protein, 9 aa, Homo Sapiens
SLENPDTSP

SEQ ID NO: 1328127 - protein, 9 aa, Homo Sapiens
CKTEEERQK

SEQ ID NO: 1328128 - protein, 9 aa, Homo Sapiens
DNTPAFAQP

SEQ ID NO: 1328129 - protein, 9 aa, Homo Sapiens
QRLSYSKVY

SEQ ID NO: 1328130 - protein, 9 aa, Homo Sapiens
LHHTHDEIV

SEQ ID NO: 1328131 - protein, 9 aa, Homo Sapiens
QPHFVCCIK

SEQ ID NO: 1328132 - protein, 9 aa, Homo Sapiens
FSSHNLITA

SEQ ID NO: 1328133 - protein, 9 aa, Homo Sapiens
SSSCKKQAA

SEQ ID NO: 1328134 - protein, 9 aa, Homo Sapiens
YAEAKVVCE

SEQ ID NO: 1328135 - protein, 9 aa, Homo Sapiens
EVHIPENVP

SEQ ID NO: 1328136 - protein, 9 aa, Homo Sapiens
YERPPLPRL

SEQ ID NO: 1328137 - protein, 9 aa, Homo Sapiens
GPVPQLPLA

SEQ ID NO: 1328138 - protein, 9 aa, Homo Sapiens
NEEELRRCE

SEQ ID NO: 1328139 - protein, 9 aa, Homo Sapiens
FSHSGYQFT

SEQ ID NO: 1328140 - protein, 9 aa, Homo Sapiens
KTFSQKTTL

SEQ ID NO: 1328141 - protein, 9 aa, Homo Sapiens
QEDVGEYQC

SEQ ID NO: 1328142 - protein, 9 aa, Homo Sapiens
PDVPYDSDS

SEQ ID NO: 1328143 - protein, 9 aa, Homo Sapiens
TVYKLNDNS

SEQ ID NO: 1328144 - protein, 9 aa, Homo Sapiens
DRCRVTQLA

SEQ ID NO: 1328145 - protein, 9 aa, Homo Sapiens
MWINAGTVH

SEQ ID NO: 1328146 - protein, 9 aa, Homo Sapiens
SRGGKATLK

SEQ ID NO: 1328147 - protein, 9 aa, Homo Sapiens
AASTHMVLI

SEQ ID NO: 1328148 - protein, 9 aa, Homo Sapiens
VKVVIDAEY

SEQ ID NO: 1328149 - protein, 9 aa, Homo Sapiens
REGEEGTYL

SEQ ID NO: 1328150 - protein, 9 aa, Homo Sapiens
WHLWKHYSD

SEQ ID NO: 1328151 - protein, 9 aa, Homo Sapiens
MGPPERRTA

SEQ ID NO: 1328152 - protein, 9 aa, Homo Sapiens
FDNFFYQER

SEQ ID NO: 1328153 - protein, 9 aa, Homo Sapiens
CGPNEIYNF

SEQ ID NO: 1328154 - protein, 9 aa, Homo Sapiens
EAHRRMVVE

SEQ ID NO: 1328155 - protein, 9 aa, Homo Sapiens
SPLDWQLRC

SEQ ID NO: 1328156 - protein, 9 aa, Homo Sapiens
SVFYTNVMP

SEQ ID NO: 1328157 - protein, 9 aa, Homo Sapiens
IVRNVEDIE

SEQ ID NO: 1328158 - protein, 9 aa, Homo Sapiens
GSKPTPMME

SEQ ID NO: 1328159 - protein, 9 aa, Homo Sapiens
FLIQAHTVT

SEQ ID NO: 1328160 - protein, 9 aa, Homo Sapiens
GCMPFYAEE

SEQ ID NO: 1328161 - protein, 9 aa, Homo Sapiens
VYAACERSY

SEQ ID NO: 1328162 - protein, 9 aa, Homo Sapiens
YYVKDIPST

SEQ ID NO: 1328163 - protein, 9 aa, Homo Sapiens
GRLLILRSP

SEQ ID NO: 1328164 - protein, 9 aa, Homo Sapiens
PETIHQGIK

SEQ ID NO: 1328165 - protein, 9 aa, Homo Sapiens
HVISVIPAS

SEQ ID NO: 1328166 - protein, 9 aa, Homo Sapiens
RHQQFQFYQ

SEQ ID NO: 1328167 - protein, 9 aa, Homo Sapiens
SILNQLTGH

SEQ ID NO: 1328168 - protein, 9 aa, Homo Sapiens
HFWYLPSHD

SEQ ID NO: 1328169 - protein, 9 aa, Homo Sapiens
CVEALLARD

SEQ ID NO: 1328170 - protein, 9 aa, Homo Sapiens
KKLAALAET

SEQ ID NO: 1328171 - protein, 9 aa, Homo Sapiens
KVVSSQDPH

SEQ ID NO: 1328172 - protein, 9 aa, Homo Sapiens
FLQCTISLV

SEQ ID NO: 1328173 - protein, 9 aa, Homo Sapiens
RVKLTGSIL

SEQ ID NO: 1328174 - protein, 9 aa, Homo Sapiens
VKPIQIINN

SEQ ID NO: 1328175 - protein, 9 aa, Homo Sapiens
RNPMCSERC

SEQ ID NO: 1328176 - protein, 9 aa, Homo Sapiens
TWGVWHVSE

SEQ ID NO: 1328177 - protein, 9 aa, Homo Sapiens
LSLEAAHHH

SEQ ID NO: 1328178 - protein, 9 aa, Homo Sapiens
SHLHRLNSP

SEQ ID NO: 1328179 - protein, 9 aa, Homo Sapiens
FDQAHLYSC

SEQ ID NO: 1328180 - protein, 9 aa, Homo Sapiens
SYLNSFQTH

SEQ ID NO: 1328181 - protein, 9 aa, Homo Sapiens
DHISSRLNL

SEQ ID NO: 1328182 - protein, 9 aa, Homo Sapiens
ELGVAVDAQ

SEQ ID NO: 1328183 - protein, 9 aa, Homo Sapiens
NQCNTTRDN

SEQ ID NO: 1328184 - protein, 9 aa, Homo Sapiens
ITFIEKSSL

SEQ ID NO: 1328185 - protein, 9 aa, Homo Sapiens
LKERELKLY

SEQ ID NO: 1328186 - protein, 9 aa, Homo Sapiens
EARDHNLQE

SEQ ID NO: 1328187 - protein, 9 aa, Homo Sapiens
RCVTAERCV

SEQ ID NO: 1328188 - protein, 9 aa, Homo Sapiens
TTVVDVEEI

SEQ ID NO: 1328189 - protein, 9 aa, Homo Sapiens
LSTGITLIG

SEQ ID NO: 1328190 - protein, 9 aa, Homo Sapiens
EEPWSAQLE

SEQ ID NO: 1328191 - protein, 9 aa, Homo Sapiens
PATGAHWMW

SEQ ID NO: 1328192 - protein, 9 aa, Homo Sapiens
LDVIFMKGN

SEQ ID NO: 1328193 - protein, 9 aa, Homo Sapiens
VVMWDYSSN

SEQ ID NO: 1328194 - protein, 9 aa, Homo Sapiens
GHYLKMNIM

SEQ ID NO: 1328195 - protein, 9 aa, Homo Sapiens
WGGHEVKQG

SEQ ID NO: 1328196 - protein, 9 aa, Homo Sapiens
MKEVLKGAI

SEQ ID NO: 1328197 - protein, 9 aa, Homo Sapiens
GSLHIGHTL

SEQ ID NO: 1328198 - protein, 9 aa, Homo Sapiens
SPKETSMQP

SEQ ID NO: 1328199 - protein, 9 aa, Homo Sapiens
DYMNMTPHR

SEQ ID NO: 1328200 - protein, 9 aa, Homo Sapiens
FTRVEMDRV

SEQ ID NO: 1328201 - protein, 9 aa, Homo Sapiens
DAPLHYAGE

SEQ ID NO: 1328202 - protein, 9 aa, Homo Sapiens
ETVYNMLRL

SEQ ID NO: 1328203 - protein, 9 aa, Homo Sapiens
QSFFSLIVG

SEQ ID NO: 1328204 - protein, 9 aa, Homo Sapiens
INNTIEMVK

SEQ ID NO: 1328205 - protein, 9 aa, Homo Sapiens
IITICREEG

SEQ ID NO: 1328206 - protein, 9 aa, Homo Sapiens
GSVPVPGTQ

SEQ ID NO: 1328207 - protein, 9 aa, Homo Sapiens
EVNMSLSGH

SEQ ID NO: 1328208 - protein, 9 aa, Homo Sapiens
TFSKGSDIW

SEQ ID NO: 1328209 - protein, 9 aa, Homo Sapiens
WWEKPCTLL

SEQ ID NO: 1328210 - protein, 9 aa, Homo Sapiens
SSFEQFKVT

SEQ ID NO: 1328211 - protein, 9 aa, Homo Sapiens
ENPDLKLTI

SEQ ID NO: 1328212 - protein, 9 aa, Homo Sapiens
VHFFDVEWA

SEQ ID NO: 1328213 - protein, 9 aa, Homo Sapiens
IDVKMPFVV

SEQ ID NO: 1328214 - protein, 9 aa, Homo Sapiens
TPHINKFTI

SEQ ID NO: 1328215 - protein, 9 aa, Homo Sapiens
SKPLHKKKS

SEQ ID NO: 1328216 - protein, 9 aa, Homo Sapiens
LNICVVDCR

SEQ ID NO: 1328217 - protein, 9 aa, Homo Sapiens
YILLTMCHN

SEQ ID NO: 1328218 - protein, 9 aa, Homo Sapiens
VTHVYASGN

SEQ ID NO: 1328219 - protein, 9 aa, Homo Sapiens
VRKCLANSS

SEQ ID NO: 1328220 - protein, 9 aa, Homo Sapiens
DTQVALTLR

SEQ ID NO: 1328221 - protein, 9 aa, Homo Sapiens
SLEGRGTPC

SEQ ID NO: 1328222 - protein, 9 aa, Homo Sapiens
NLQLSHQPH

SEQ ID NO: 1328223 - protein, 9 aa, Homo Sapiens
PLNICVVDC

SEQ ID NO: 1328224 - protein, 9 aa, Homo Sapiens
YFEHISTYD

SEQ ID NO: 1328225 - protein, 9 aa, Homo Sapiens
YHCVTEECS

SEQ ID NO: 1328226 - protein, 9 aa, Homo Sapiens
WFFKNQSLL

SEQ ID NO: 1328227 - protein, 9 aa, Homo Sapiens
LLLNLLDVI

SEQ ID NO: 1328228 - protein, 9 aa, Homo Sapiens
MVVAGSLSQ

SEQ ID NO: 1328229 - protein, 9 aa, Homo Sapiens
KLTLKTIMA

SEQ ID NO: 1328230 - protein, 9 aa, Homo Sapiens
PKCDPATLK

SEQ ID NO: 1328231 - protein, 9 aa, Homo Sapiens
TFFMCIEDI

SEQ ID NO: 1328232 - protein, 9 aa, Homo Sapiens
ELMIYISMA

SEQ ID NO: 1328233 - protein, 9 aa, Homo Sapiens
DPKKLKMKQ

SEQ ID NO: 1328234 - protein, 9 aa, Homo Sapiens
EEKRRRTRV

SEQ ID NO: 1328235 - protein, 9 aa, Homo Sapiens
NSLSGGITI

SEQ ID NO: 1328236 - protein, 9 aa, Homo Sapiens
CTKGGSCPF

SEQ ID NO: 1328237 - protein, 9 aa, Homo Sapiens
LQPLVTSYL

SEQ ID NO: 1328238 - protein, 9 aa, Homo Sapiens
WCTGAIIPE

SEQ ID NO: 1328239 - protein, 9 aa, Homo Sapiens
VAVIVTFQL

SEQ ID NO: 1328240 - protein, 9 aa, Homo Sapiens
DTETVIKPV

SEQ ID NO: 1328241 - protein, 9 aa, Homo Sapiens
TRCLRMRPP

SEQ ID NO: 1328242 - protein, 9 aa, Homo Sapiens
PSSDQQFSP

SEQ ID NO: 1328243 - protein, 9 aa, Homo Sapiens
TNVLKILTN

SEQ ID NO: 1328244 - protein, 9 aa, Homo Sapiens
DTSCMSQRR

SEQ ID NO: 1328245 - protein, 9 aa, Homo Sapiens
SKDVTLHWK

SEQ ID NO: 1328246 - protein, 9 aa, Homo Sapiens
AWGTFAQPL

SEQ ID NO: 1328247 - protein, 9 aa, Homo Sapiens
TVHNADVIA

SEQ ID NO: 1328248 - protein, 9 aa, Homo Sapiens
LQGLHLGTD

SEQ ID NO: 1328249 - protein, 9 aa, Homo Sapiens
LAQEPSMTS

SEQ ID NO: 1328250 - protein, 9 aa, Homo Sapiens
KGTLNLEDI

SEQ ID NO: 1328251 - protein, 9 aa, Homo Sapiens
KCPVEWAKF

SEQ ID NO: 1328252 - protein, 9 aa, Homo Sapiens
CSVPWTVFR

SEQ ID NO: 1328253 - protein, 9 aa, Homo Sapiens
WRSSERYMQ

SEQ ID NO: 1328254 - protein, 9 aa, Homo Sapiens
TIRGEIQDA

SEQ ID NO: 1328255 - protein, 9 aa, Homo Sapiens
FLEANIPHA

SEQ ID NO: 1328256 - protein, 9 aa, Homo Sapiens
TVGMHLLNI

SEQ ID NO: 1328257 - protein, 9 aa, Homo Sapiens
IIRDLQTTH

SEQ ID NO: 1328258 - protein, 9 aa, Homo Sapiens
YLSNTDLNK

SEQ ID NO: 1328259 - protein, 9 aa, Homo Sapiens
GMPLERKRH

SEQ ID NO: 1328260 - protein, 9 aa, Homo Sapiens
AGSPTLGRV

SEQ ID NO: 1328261 - protein, 9 aa, Homo Sapiens
VTALGDGPG

SEQ ID NO: 1328262 - protein, 9 aa, Homo Sapiens
KADTLQGAL

SEQ ID NO: 1328263 - protein, 9 aa, Homo Sapiens
GMSKQSLND

SEQ ID NO: 1328264 - protein, 9 aa, Homo Sapiens
CTMWGLPCG

SEQ ID NO: 1328265 - protein, 9 aa, Homo Sapiens
CETCGKMYG

SEQ ID NO: 1328266 - protein, 9 aa, Homo Sapiens
PLVVTLLVW

SEQ ID NO: 1328267 - protein, 9 aa, Homo Sapiens
VGLGVQVLP

SEQ ID NO: 1328268 - protein, 9 aa, Homo Sapiens
SACNVAAAS

SEQ ID NO: 1328269 - protein, 9 aa, Homo Sapiens
ADLADGAHV

SEQ ID NO: 1328270 - protein, 9 aa, Homo Sapiens
QRCLSQAEE

SEQ ID NO: 1328271 - protein, 9 aa, Homo Sapiens
PVIAGLMKI

SEQ ID NO: 1328272 - protein, 9 aa, Homo Sapiens
KAKLVRAGV

SEQ ID NO: 1328273 - protein, 9 aa, Homo Sapiens
NSLHKYIMT

SEQ ID NO: 1328274 - protein, 9 aa, Homo Sapiens
KQREHLLGI

SEQ ID NO: 1328275 - protein, 9 aa, Homo Sapiens
TPMMETQPV

SEQ ID NO: 1328276 - protein, 9 aa, Homo Sapiens
DKPSISAAT

SEQ ID NO: 1328277 - protein, 9 aa, Homo Sapiens
HRLNSPIGR

SEQ ID NO: 1328278 - protein, 9 aa, Homo Sapiens
DVGEYQCEV

SEQ ID NO: 1328279 - protein, 9 aa, Homo Sapiens
VLALVEVYR

SEQ ID NO: 1328280 - protein, 9 aa, Homo Sapiens
KFELLAKEH

SEQ ID NO: 1328281 - protein, 9 aa, Homo Sapiens
EQHKMRMVI

SEQ ID NO: 1328282 - protein, 9 aa, Homo Sapiens
PKWSELLKL

SEQ ID NO: 1328283 - protein, 9 aa, Homo Sapiens
FSSGTTGTP

SEQ ID NO: 1328284 - protein, 9 aa, Homo Sapiens
VFDIDEDER

SEQ ID NO: 1328285 - protein, 9 aa, Homo Sapiens
VTSPCCIIT

SEQ ID NO: 1328286 - protein, 9 aa, Homo Sapiens
TNLVTVSKP

SEQ ID NO: 1328287 - protein, 9 aa, Homo Sapiens
EHTLQLIWE

SEQ ID NO: 1328288 - protein, 9 aa, Homo Sapiens
ADPHHVQGK

SEQ ID NO: 1328289 - protein, 9 aa, Homo Sapiens
MTSISDLEF

SEQ ID NO: 1328290 - protein, 9 aa, Homo Sapiens
AKKKLEKKN

SEQ ID NO: 1328291 - protein, 9 aa, Homo Sapiens
QLCALETQP

SEQ ID NO: 1328292 - protein, 9 aa, Homo Sapiens
DTSPALEAY

SEQ ID NO: 1328293 - protein, 9 aa, Homo Sapiens
AGPEEQAGG

SEQ ID NO: 1328294 - protein, 9 aa, Homo Sapiens
MYLMHASLY

SEQ ID NO: 1328295 - protein, 9 aa, Homo Sapiens
GPSESLTVS

SEQ ID NO: 1328296 - protein, 9 aa, Homo Sapiens
SCKYHALCS

SEQ ID NO: 1328297 - protein, 9 aa, Homo Sapiens
ETVHTSAVS

SEQ ID NO: 1328298 - protein, 9 aa, Homo Sapiens
ADLGRKGQI

SEQ ID NO: 1328299 - protein, 9 aa, Homo Sapiens
LSELEQLWR

SEQ ID NO: 1328300 - protein, 9 aa, Homo Sapiens
DFTLLARNC

SEQ ID NO: 1328301 - protein, 9 aa, Homo Sapiens
FDKIFTNTK

SEQ ID NO: 1328302 - protein, 9 aa, Homo Sapiens
IAISLCGAS

SEQ ID NO: 1328303 - protein, 9 aa, Homo Sapiens
AFVEHRCLL

SEQ ID NO: 1328304 - protein, 9 aa, Homo Sapiens
ELRLDDNHI

SEQ ID NO: 1328305 - protein, 9 aa, Homo Sapiens
TVVTLDKVP

SEQ ID NO: 1328306 - protein, 9 aa, Homo Sapiens
SKLAFSSSF

SEQ ID NO: 1328307 - protein, 9 aa, Homo Sapiens
YYRMDGILF

SEQ ID NO: 1328308 - protein, 9 aa, Homo Sapiens
PEDAIIYCN

SEQ ID NO: 1328309 - protein, 9 aa, Homo Sapiens
IIAWPFITV

SEQ ID NO: 1328310 - protein, 9 aa, Homo Sapiens
GHNKTREFL

SEQ ID NO: 1328311 - protein, 9 aa, Homo Sapiens
SIRCQAIKE

SEQ ID NO: 1328312 - protein, 9 aa, Homo Sapiens
KRPRIILTT

SEQ ID NO: 1328313 - protein, 9 aa, Homo Sapiens
HFRKLHCTR

SEQ ID NO: 1328314 - protein, 9 aa, Homo Sapiens
RKCLYKVIR

SEQ ID NO: 1328315 - protein, 9 aa, Homo Sapiens
SSERYMQKS

SEQ ID NO: 1328316 - protein, 9 aa, Homo Sapiens
QEAWHPEAP

SEQ ID NO: 1328317 - protein, 9 aa, Homo Sapiens
GTVGALLVY

SEQ ID NO: 1328318 - protein, 9 aa, Homo Sapiens
SALVTLVPP

SEQ ID NO: 1328319 - protein, 9 aa, Homo Sapiens
IRSLGLDQK

SEQ ID NO: 1328320 - protein, 9 aa, Homo Sapiens
NGATGHISS

SEQ ID NO: 1328321 - protein, 9 aa, Homo Sapiens
RSLGHQGSW

SEQ ID NO: 1328322 - protein, 9 aa, Homo Sapiens
VVYFLSIMI

SEQ ID NO: 1328323 - protein, 9 aa, Homo Sapiens
AEPPHPPSS

SEQ ID NO: 1328324 - protein, 9 aa, Homo Sapiens
QGAGSPTLG

SEQ ID NO: 1328325 - protein, 9 aa, Homo Sapiens
CYLFGEIMY

SEQ ID NO: 1328326 - protein, 9 aa, Homo Sapiens
QSDRGGGRS

SEQ ID NO: 1328327 - protein, 9 aa, Homo Sapiens
LLTIKDDII

SEQ ID NO: 1328328 - protein, 9 aa, Homo Sapiens
QMLRQATKC

SEQ ID NO: 1328329 - protein, 9 aa, Homo Sapiens
CCGDLLAAS

SEQ ID NO: 1328330 - protein, 9 aa, Homo Sapiens
ICYHYFCGH

SEQ ID NO: 1328331 - protein, 9 aa, Homo Sapiens
ICLARQIEK

SEQ ID NO: 1328332 - protein, 9 aa, Homo Sapiens
DMPSSSMSS

SEQ ID NO: 1328333 - protein, 9 aa, Homo Sapiens
DDPSYGNST

SEQ ID NO: 1328334 - protein, 9 aa, Homo Sapiens
RASVDLTPT

SEQ ID NO: 1328335 - protein, 9 aa, Homo Sapiens
EALVAELAL

SEQ ID NO: 1328336 - protein, 9 aa, Homo Sapiens
SAATRTCSC

SEQ ID NO: 1328337 - protein, 9 aa, Homo Sapiens
KAFGRYTTL

SEQ ID NO: 1328338 - protein, 9 aa, Homo Sapiens
LQRETVKHR

SEQ ID NO: 1328339 - protein, 9 aa, Homo Sapiens
RKQLFQKFP

SEQ ID NO: 1328340 - protein, 9 aa, Homo Sapiens
PYTECVEHL

SEQ ID NO: 1328341 - protein, 9 aa, Homo Sapiens
SQLVTQQVA

SEQ ID NO: 1328342 - protein, 9 aa, Homo Sapiens
FSFELVVHF

SEQ ID NO: 1328343 - protein, 9 aa, Homo Sapiens
SFTRLAQHF

SEQ ID NO: 1328344 - protein, 9 aa, Homo Sapiens
QGGLLPLVK

SEQ ID NO: 1328345 - protein, 9 aa, Homo Sapiens
SRWMTSLIS

SEQ ID NO: 1328346 - protein, 9 aa, Homo Sapiens
HLCKKQGAA

SEQ ID NO: 1328347 - protein, 9 aa, Homo Sapiens
SSSSSEKQH

SEQ ID NO: 1328348 - protein, 9 aa, Homo Sapiens
AHTRLQEME

SEQ ID NO: 1328349 - protein, 9 aa, Homo Sapiens
IWIITQRNS

SEQ ID NO: 1328350 - protein, 9 aa, Homo Sapiens
YHLCGLHTV

SEQ ID NO: 1328351 - protein, 9 aa, Homo Sapiens
EAPESNGMH

SEQ ID NO: 1328352 - protein, 9 aa, Homo Sapiens
IIADRITLK

SEQ ID NO: 1328353 - protein, 9 aa, Homo Sapiens
IGDTQAMGQ

SEQ ID NO: 1328354 - protein, 9 aa, Homo Sapiens
VSVDDSGTF

SEQ ID NO: 1328355 - protein, 9 aa, Homo Sapiens
DGSMWSITT

SEQ ID NO: 1328356 - protein, 9 aa, Homo Sapiens
GRQEDVATA

SEQ ID NO: 1328357 - protein, 9 aa, Homo Sapiens
RGWNFTGTH

SEQ ID NO: 1328358 - protein, 9 aa, Homo Sapiens
NLTGCLTHK

SEQ ID NO: 1328359 - protein, 9 aa, Homo Sapiens
MAANMPNKE

SEQ ID NO: 1328360 - protein, 9 aa, Homo Sapiens
TVSQTYSGP

SEQ ID NO: 1328361 - protein, 9 aa, Homo Sapiens
LRVFRGANT

SEQ ID NO: 1328362 - protein, 9 aa, Homo Sapiens
DVRNPPVVS

SEQ ID NO: 1328363 - protein, 9 aa, Homo Sapiens
PAGECGAPG

SEQ ID NO: 1328364 - protein, 9 aa, Homo Sapiens
YSGKAADMW

SEQ ID NO: 1328365 - protein, 9 aa, Homo Sapiens
LEWLTSLYK

SEQ ID NO: 1328366 - protein, 9 aa, Homo Sapiens
ETSHITVLE

SEQ ID NO: 1328367 - protein, 9 aa, Homo Sapiens
TGDAFTLFA

SEQ ID NO: 1328368 - protein, 9 aa, Homo Sapiens
CWQAVWPVW

SEQ ID NO: 1328369 - protein, 9 aa, Homo Sapiens
PILDDQIQW

SEQ ID NO: 1328370 - protein, 9 aa, Homo Sapiens
RKDLIHHFS

SEQ ID NO: 1328371 - protein, 9 aa, Homo Sapiens
RGHASQRPD

SEQ ID NO: 1328372 - protein, 9 aa, Homo Sapiens
LRNKQIKVT

SEQ ID NO: 1328373 - protein, 9 aa, Homo Sapiens
VGGSVPIFD

SEQ ID NO: 1328374 - protein, 9 aa, Homo Sapiens
KHLPSTHQI

SEQ ID NO: 1328375 - protein, 9 aa, Homo Sapiens
IQEECDERH

SEQ ID NO: 1328376 - protein, 9 aa, Homo Sapiens
GINFKWKFL

SEQ ID NO: 1328377 - protein, 9 aa, Homo Sapiens
CSAYEYYVS

SEQ ID NO: 1328378 - protein, 9 aa, Homo Sapiens
WHVLPILWH

SEQ ID NO: 1328379 - protein, 9 aa, Homo Sapiens
LKNNPPYIL

SEQ ID NO: 1328380 - protein, 9 aa, Homo Sapiens
IMYNFFIVL

SEQ ID NO: 1328381 - protein, 9 aa, Homo Sapiens
SVRYILKDY

SEQ ID NO: 1328382 - protein, 9 aa, Homo Sapiens
LQQRLKKVV

SEQ ID NO: 1328383 - protein, 9 aa, Homo Sapiens
REKQCLIKS

SEQ ID NO: 1328384 - protein, 9 aa, Homo Sapiens
EEGCMPFYA

SEQ ID NO: 1328385 - protein, 9 aa, Homo Sapiens
VQVLLNQKD

SEQ ID NO: 1328386 - protein, 9 aa, Homo Sapiens
PHKMAFAKM

SEQ ID NO: 1328387 - protein, 9 aa, Homo Sapiens
NWTRLQQLL

SEQ ID NO: 1328388 - protein, 9 aa, Homo Sapiens
GVDNIFIKN

SEQ ID NO: 1328389 - protein, 9 aa, Homo Sapiens
QRFNPCLME

SEQ ID NO: 1328390 - protein, 9 aa, Homo Sapiens
FTLNHIEMT

SEQ ID NO: 1328391 - protein, 9 aa, Homo Sapiens
HRGKNENES

SEQ ID NO: 1328392 - protein, 9 aa, Homo Sapiens
VYLIRPKVQ

SEQ ID NO: 1328393 - protein, 9 aa, Homo Sapiens
KEYEHFSKY

SEQ ID NO: 1328394 - protein, 9 aa, Homo Sapiens
WKFMEGPLF

SEQ ID NO: 1328395 - protein, 9 aa, Homo Sapiens
GHPINLTCS

SEQ ID NO: 1328396 - protein, 9 aa, Homo Sapiens
SSATSAAKP

SEQ ID NO: 1328397 - protein, 9 aa, Homo Sapiens
TYKHDVLTR

SEQ ID NO: 1328398 - protein, 9 aa, Homo Sapiens
TDAQGTHIG

SEQ ID NO: 1328399 - protein, 9 aa, Homo Sapiens
YPSVGAQGV

SEQ ID NO: 1328400 - protein, 9 aa, Homo Sapiens
RAGFGTEAE

SEQ ID NO: 1328401 - protein, 9 aa, Homo Sapiens
QIIPIYSFG

SEQ ID NO: 1328402 - protein, 9 aa, Homo Sapiens
QKEMTDIVE

SEQ ID NO: 1328403 - protein, 9 aa, Homo Sapiens
TGGFGCFLL

SEQ ID NO: 1328404 - protein, 9 aa, Homo Sapiens
RQVNGINPN

SEQ ID NO: 1328405 - protein, 9 aa, Homo Sapiens
TPLVNKHHP

SEQ ID NO: 1328406 - protein, 9 aa, Homo Sapiens
VYRVWKWGE

SEQ ID NO: 1328407 - protein, 9 aa, Homo Sapiens
KNTQDMQVD

SEQ ID NO: 1328408 - protein, 9 aa, Homo Sapiens
ENGDSWKEY

SEQ ID NO: 1328409 - protein, 9 aa, Homo Sapiens
WSELQARGL

SEQ ID NO: 1328410 - protein, 9 aa, Homo Sapiens
NFFYQERAN

SEQ ID NO: 1328411 - protein, 9 aa, Homo Sapiens
DPDACTISN

SEQ ID NO: 1328412 - protein, 9 aa, Homo Sapiens
HFRDNTPNA

SEQ ID NO: 1328413 - protein, 9 aa, Homo Sapiens
IMEISVTDG

SEQ ID NO: 1328414 - protein, 9 aa, Homo Sapiens
YLLHHQRTH

SEQ ID NO: 1328415 - protein, 9 aa, Homo Sapiens
QLLVLEPPV

SEQ ID NO: 1328416 - protein, 9 aa, Homo Sapiens
STDQEIQEI

SEQ ID NO: 1328417 - protein, 9 aa, Homo Sapiens
VAVQVVRAR

SEQ ID NO: 1328418 - protein, 9 aa, Homo Sapiens
DRPDVWAVL

SEQ ID NO: 1328419 - protein, 9 aa, Homo Sapiens
FLEENLDPS

SEQ ID NO: 1328420 - protein, 9 aa, Homo Sapiens
CVTVFSTPN

SEQ ID NO: 1328421 - protein, 9 aa, Homo Sapiens
FYCMTCHET

SEQ ID NO: 1328422 - protein, 9 aa, Homo Sapiens
MAVWRPGCF

SEQ ID NO: 1328423 - protein, 9 aa, Homo Sapiens
ELRSGPHRQ

SEQ ID NO: 1328424 - protein, 9 aa, Homo Sapiens
RNYYRLKEA

SEQ ID NO: 1328425 - protein, 9 aa, Homo Sapiens
KKVVPYNRM

SEQ ID NO: 1328426 - protein, 9 aa, Homo Sapiens
IRHEQLTRA

SEQ ID NO: 1328427 - protein, 9 aa, Homo Sapiens
TVQSYAAGF

SEQ ID NO: 1328428 - protein, 9 aa, Homo Sapiens
ATLQVLYQA

SEQ ID NO: 1328429 - protein, 9 aa, Homo Sapiens
HSYHLTTFL

SEQ ID NO: 1328430 - protein, 9 aa, Homo Sapiens
PITDKPYVP

SEQ ID NO: 1328431 - protein, 9 aa, Homo Sapiens
DNTFSRLQN

SEQ ID NO: 1328432 - protein, 9 aa, Homo Sapiens
MAPQMISEG

SEQ ID NO: 1328433 - protein, 9 aa, Homo Sapiens
PAIVQLNKC

SEQ ID NO: 1328434 - protein, 9 aa, Homo Sapiens
VLSAESTPM

SEQ ID NO: 1328435 - protein, 9 aa, Homo Sapiens
LQSLSHRLD

SEQ ID NO: 1328436 - protein, 9 aa, Homo Sapiens
TRATESQTP

SEQ ID NO: 1328437 - protein, 9 aa, Homo Sapiens
GAQQQDINY

SEQ ID NO: 1328438 - protein, 9 aa, Homo Sapiens
KRHAKLITS

SEQ ID NO: 1328439 - protein, 9 aa, Homo Sapiens
GLPASRCLH

SEQ ID NO: 1328440 - protein, 9 aa, Homo Sapiens
CWLSPPLGL

SEQ ID NO: 1328441 - protein, 9 aa, Homo Sapiens
NGRFTGLVL

SEQ ID NO: 1328442 - protein, 9 aa, Homo Sapiens
DNNRVGFVE

SEQ ID NO: 1328443 - protein, 9 aa, Homo Sapiens
DDVLGITKH

SEQ ID NO: 1328444 - protein, 9 aa, Homo Sapiens
ECGKPFNHF

SEQ ID NO: 1328445 - protein, 9 aa, Homo Sapiens
TIQVWQRGS

SEQ ID NO: 1328446 - protein, 9 aa, Homo Sapiens
SQLQALNIP

SEQ ID NO: 1328447 - protein, 9 aa, Homo Sapiens
ELMGYIMDK

SEQ ID NO: 1328448 - protein, 9 aa, Homo Sapiens
YETCQTYEC

SEQ ID NO: 1328449 - protein, 9 aa, Homo Sapiens
IDLRQDRPV

SEQ ID NO: 1328450 - protein, 9 aa, Homo Sapiens
RAKGSSATT

SEQ ID NO: 1328451 - protein, 9 aa, Homo Sapiens
YMENEDLNQ

SEQ ID NO: 1328452 - protein, 9 aa, Homo Sapiens
LVDQWHWGV

SEQ ID NO: 1328453 - protein, 9 aa, Homo Sapiens
CGWAPFSVG

SEQ ID NO: 1328454 - protein, 9 aa, Homo Sapiens
LWRHPITGT

SEQ ID NO: 1328455 - protein, 9 aa, Homo Sapiens
EAAQMVHRE

SEQ ID NO: 1328456 - protein, 9 aa, Homo Sapiens
VYVYVKEIC

SEQ ID NO: 1328457 - protein, 9 aa, Homo Sapiens
SVGLHMGFS

SEQ ID NO: 1328458 - protein, 9 aa, Homo Sapiens
KVSAFVMGL

SEQ ID NO: 1328459 - protein, 9 aa, Homo Sapiens
TPLHNAVCT

SEQ ID NO: 1328460 - protein, 9 aa, Homo Sapiens
VRLTNILKE

SEQ ID NO: 1328461 - protein, 9 aa, Homo Sapiens
SRFASTSIK

SEQ ID NO: 1328462 - protein, 9 aa, Homo Sapiens
RRLEMMSRG

SEQ ID NO: 1328463 - protein, 9 aa, Homo Sapiens
GKVLHTIRM

SEQ ID NO: 1328464 - protein, 9 aa, Homo Sapiens
SHFLRGAPH

SEQ ID NO: 1328465 - protein, 9 aa, Homo Sapiens
SIYPAQVEL

SEQ ID NO: 1328466 - protein, 9 aa, Homo Sapiens
EEVELLSPA

SEQ ID NO: 1328467 - protein, 9 aa, Homo Sapiens
PIALPHCSE

SEQ ID NO: 1328468 - protein, 9 aa, Homo Sapiens
ASAEGFSKR

SEQ ID NO: 1328469 - protein, 9 aa, Homo Sapiens
TEELCTLCR

SEQ ID NO: 1328470 - protein, 9 aa, Homo Sapiens
SSVISDCTE

SEQ ID NO: 1328471 - protein, 9 aa, Homo Sapiens
ITLLGLVGT

SEQ ID NO: 1328472 - protein, 9 aa, Homo Sapiens
WHFIKRRTA

SEQ ID NO: 1328473 - protein, 9 aa, Homo Sapiens
MASGVKLTL

SEQ ID NO: 1328474 - protein, 9 aa, Homo Sapiens
ILGASVVCW

SEQ ID NO: 1328475 - protein, 9 aa, Homo Sapiens
TSSPEVEGV

SEQ ID NO: 1328476 - protein, 9 aa, Homo Sapiens
TTMNNDMTL

SEQ ID NO: 1328477 - protein, 9 aa, Homo Sapiens
IHMWKGYRD

SEQ ID NO: 1328478 - protein, 9 aa, Homo Sapiens
IKQFQTISE

SEQ ID NO: 1328479 - protein, 9 aa, Homo Sapiens
VPSFEGYRE

SEQ ID NO: 1328480 - protein, 9 aa, Homo Sapiens
YSQIVKEDR

SEQ ID NO: 1328481 - protein, 9 aa, Homo Sapiens
KNNQIEQLS

SEQ ID NO: 1328482 - protein, 9 aa, Homo Sapiens
HALHNNFQA

SEQ ID NO: 1328483 - protein, 9 aa, Homo Sapiens
RAERERAAR

SEQ ID NO: 1328484 - protein, 9 aa, Homo Sapiens
GHPKYALWR

SEQ ID NO: 1328485 - protein, 9 aa, Homo Sapiens
ENGNSDNKD

SEQ ID NO: 1328486 - protein, 9 aa, Homo Sapiens
TIVNNVKLV

SEQ ID NO: 1328487 - protein, 9 aa, Homo Sapiens
LPAADWHYL

SEQ ID NO: 1328488 - protein, 9 aa, Homo Sapiens
IQLEAAIRA

SEQ ID NO: 1328489 - protein, 9 aa, Homo Sapiens
FPVTFGFLG

SEQ ID NO: 1328490 - protein, 9 aa, Homo Sapiens
SQIKYKERF

SEQ ID NO: 1328491 - protein, 9 aa, Homo Sapiens
VMKQAPQAT

SEQ ID NO: 1328492 - protein, 9 aa, Homo Sapiens
PGESSHSIY

SEQ ID NO: 1328493 - protein, 9 aa, Homo Sapiens
PAGPASIMG

SEQ ID NO: 1328494 - protein, 9 aa, Homo Sapiens
KCHSIRRQY

SEQ ID NO: 1328495 - protein, 9 aa, Homo Sapiens
CDCCLRATH

SEQ ID NO: 1328496 - protein, 9 aa, Homo Sapiens
KAQLKTGKN

SEQ ID NO: 1328497 - protein, 9 aa, Homo Sapiens
NVSYICSHY

SEQ ID NO: 1328498 - protein, 9 aa, Homo Sapiens
SVQPNEMSE

SEQ ID NO: 1328499 - protein, 9 aa, Homo Sapiens
TLEQCHYRF

SEQ ID NO: 1328500 - protein, 9 aa, Homo Sapiens
CAASAGRRS

SEQ ID NO: 1328501 - protein, 9 aa, Homo Sapiens
MRQSLVHSV

SEQ ID NO: 1328502 - protein, 9 aa, Homo Sapiens
KMACVAQNA

SEQ ID NO: 1328503 - protein, 9 aa, Homo Sapiens
LQQMSYPCF

SEQ ID NO: 1328504 - protein, 9 aa, Homo Sapiens
HLTSGNWEL

SEQ ID NO: 1328505 - protein, 9 aa, Homo Sapiens
LHDPNSNRI

SEQ ID NO: 1328506 - protein, 9 aa, Homo Sapiens
LWSLQPLRQ

SEQ ID NO: 1328507 - protein, 9 aa, Homo Sapiens
AQSWQQMSL

SEQ ID NO: 1328508 - protein, 9 aa, Homo Sapiens
TLFNILHFP

SEQ ID NO: 1328509 - protein, 9 aa, Homo Sapiens
MPISPSRRV

SEQ ID NO: 1328510 - protein, 9 aa, Homo Sapiens
CREQPSSTM

SEQ ID NO: 1328511 - protein, 9 aa, Homo Sapiens
AHFPSVALP

SEQ ID NO: 1328512 - protein, 9 aa, Homo Sapiens
SIVCGKLTP

SEQ ID NO: 1328513 - protein, 9 aa, Homo Sapiens
KCPLLLVYI

SEQ ID NO: 1328514 - protein, 9 aa, Homo Sapiens
PAPATYHAE

SEQ ID NO: 1328515 - protein, 9 aa, Homo Sapiens
MNRRASQMI

SEQ ID NO: 1328516 - protein, 9 aa, Homo Sapiens
MFAATADPT

SEQ ID NO: 1328517 - protein, 9 aa, Homo Sapiens
TLALLLGGT

SEQ ID NO: 1328518 - protein, 9 aa, Homo Sapiens
FVESVMVRT

SEQ ID NO: 1328519 - protein, 9 aa, Homo Sapiens
LVHLFHFYR

SEQ ID NO: 1328520 - protein, 9 aa, Homo Sapiens
KLGMQLVLP

SEQ ID NO: 1328521 - protein, 9 aa, Homo Sapiens
ALIPHHSAG

SEQ ID NO: 1328522 - protein, 9 aa, Homo Sapiens
ARNPVINIT

SEQ ID NO: 1328523 - protein, 9 aa, Homo Sapiens
SAISEQIIS

SEQ ID NO: 1328524 - protein, 9 aa, Homo Sapiens
VAFSEASWK

SEQ ID NO: 1328525 - protein, 9 aa, Homo Sapiens
EERYLEEED

SEQ ID NO: 1328526 - protein, 9 aa, Homo Sapiens
TVVLGSLSG

SEQ ID NO: 1328527 - protein, 9 aa, Homo Sapiens
GPPGPVGPT

SEQ ID NO: 1328528 - protein, 9 aa, Homo Sapiens
DLSTIILTL

SEQ ID NO: 1328529 - protein, 9 aa, Homo Sapiens
EYCDRAFKS

SEQ ID NO: 1328530 - protein, 9 aa, Homo Sapiens
QFLWMVDAC

SEQ ID NO: 1328531 - protein, 9 aa, Homo Sapiens
TTEDEHKIL

SEQ ID NO: 1328532 - protein, 9 aa, Homo Sapiens
LTAPTQALM

SEQ ID NO: 1328533 - protein, 9 aa, Homo Sapiens
SETLPGHTK

SEQ ID NO: 1328534 - protein, 9 aa, Homo Sapiens
LYGNIHSWM

SEQ ID NO: 1328535 - protein, 9 aa, Homo Sapiens
RAVTHMGIY

SEQ ID NO: 1328536 - protein, 9 aa, Homo Sapiens
HSLEELADE

SEQ ID NO: 1328537 - protein, 9 aa, Homo Sapiens
PVSDDTCYR

SEQ ID NO: 1328538 - protein, 9 aa, Homo Sapiens
KSALVTLVP

SEQ ID NO: 1328539 - protein, 9 aa, Homo Sapiens
GVEEDDDDD

SEQ ID NO: 1328540 - protein, 9 aa, Homo Sapiens
GTRMKSVGI

SEQ ID NO: 1328541 - protein, 9 aa, Homo Sapiens
GLTTPAQPP

SEQ ID NO: 1328542 - protein, 9 aa, Homo Sapiens
KYCKGNLKS

SEQ ID NO: 1328543 - protein, 9 aa, Homo Sapiens
FWLSLLYWP

SEQ ID NO: 1328544 - protein, 9 aa, Homo Sapiens
GYATYYCEG

SEQ ID NO: 1328545 - protein, 9 aa, Homo Sapiens
IMTFANSPW

SEQ ID NO: 1328546 - protein, 9 aa, Homo Sapiens
ISRTVIQRG

SEQ ID NO: 1328547 - protein, 9 aa, Homo Sapiens
TLKACSPLW

SEQ ID NO: 1328548 - protein, 9 aa, Homo Sapiens
SSQEGSPSS

SEQ ID NO: 1328549 - protein, 9 aa, Homo Sapiens
FGMLNVTLL

SEQ ID NO: 1328550 - protein, 9 aa, Homo Sapiens
PERKYDLKE

SEQ ID NO: 1328551 - protein, 9 aa, Homo Sapiens
GSKFTGGLK

SEQ ID NO: 1328552 - protein, 9 aa, Homo Sapiens
CIMKNQIRK

SEQ ID NO: 1328553 - protein, 9 aa, Homo Sapiens
GSTHNITQG

SEQ ID NO: 1328554 - protein, 9 aa, Homo Sapiens
YTRGRDQIK

SEQ ID NO: 1328555 - protein, 9 aa, Homo Sapiens
EERRTIDIY

SEQ ID NO: 1328556 - protein, 9 aa, Homo Sapiens
AGTKWSSRS

SEQ ID NO: 1328557 - protein, 9 aa, Homo Sapiens
RLDNLSILD

SEQ ID NO: 1328558 - protein, 9 aa, Homo Sapiens
LRQHHLVHA

SEQ ID NO: 1328559 - protein, 9 aa, Homo Sapiens
NEGCLYMTC

SEQ ID NO: 1328560 - protein, 9 aa, Homo Sapiens
LVVWHRGSK

SEQ ID NO: 1328561 - protein, 9 aa, Homo Sapiens
RNAIMKKQF

SEQ ID NO: 1328562 - protein, 9 aa, Homo Sapiens
VSQYVQAVP

SEQ ID NO: 1328563 - protein, 9 aa, Homo Sapiens
LESEMVFND

SEQ ID NO: 1328564 - protein, 9 aa, Homo Sapiens
IGPQMLLAH

SEQ ID NO: 1328565 - protein, 9 aa, Homo Sapiens
PSWPWTRCL

SEQ ID NO: 1328566 - protein, 9 aa, Homo Sapiens
CEVLKRELG

SEQ ID NO: 1328567 - protein, 9 aa, Homo Sapiens
AVLGALINT

SEQ ID NO: 1328568 - protein, 9 aa, Homo Sapiens
VQTCSADEP

SEQ ID NO: 1328569 - protein, 9 aa, Homo Sapiens
PPWLHHPKA

SEQ ID NO: 1328570 - protein, 9 aa, Homo Sapiens
IKDCLKIIE

SEQ ID NO: 1328571 - protein, 9 aa, Homo Sapiens
RPGPPHPHP

SEQ ID NO: 1328572 - protein, 9 aa, Homo Sapiens
EVFILSSNF

SEQ ID NO: 1328573 - protein, 9 aa, Homo Sapiens
KCDEEIEAE

SEQ ID NO: 1328574 - protein, 9 aa, Homo Sapiens
TSWNMGTIL

SEQ ID NO: 1328575 - protein, 9 aa, Homo Sapiens
SLGLDQKMC

SEQ ID NO: 1328576 - protein, 9 aa, Homo Sapiens
LSLALTDMF

SEQ ID NO: 1328577 - protein, 9 aa, Homo Sapiens
LFQLKNGMG

SEQ ID NO: 1328578 - protein, 9 aa, Homo Sapiens
MNPSSNFCN

SEQ ID NO: 1328579 - protein, 9 aa, Homo Sapiens
DRFYLISLK

SEQ ID NO: 1328580 - protein, 9 aa, Homo Sapiens
LSITKGKKS

SEQ ID NO: 1328581 - protein, 9 aa, Homo Sapiens
NITDEMKCM

SEQ ID NO: 1328582 - protein, 9 aa, Homo Sapiens
QIDLLEPRE

SEQ ID NO: 1328583 - protein, 9 aa, Homo Sapiens
RDGFNMRVP

SEQ ID NO: 1328584 - protein, 9 aa, Homo Sapiens
ATCSSHVTV

SEQ ID NO: 1328585 - protein, 9 aa, Homo Sapiens
TVYFDEFVM

SEQ ID NO: 1328586 - protein, 9 aa, Homo Sapiens
GKPKSFWIC

SEQ ID NO: 1328587 - protein, 9 aa, Homo Sapiens
IFKILQEYQ

SEQ ID NO: 1328588 - protein, 9 aa, Homo Sapiens
ESSGINETT

SEQ ID NO: 1328589 - protein, 9 aa, Homo Sapiens
ITIRWKSEL

SEQ ID NO: 1328590 - protein, 9 aa, Homo Sapiens
FVDVLHTYM

SEQ ID NO: 1328591 - protein, 9 aa, Homo Sapiens
LTVMTDLVD

SEQ ID NO: 1328592 - protein, 9 aa, Homo Sapiens
LVTENPEKS

SEQ ID NO: 1328593 - protein, 9 aa, Homo Sapiens
RCCCIAVCV

SEQ ID NO: 1328594 - protein, 9 aa, Homo Sapiens
KLQNDVYSE

SEQ ID NO: 1328595 - protein, 9 aa, Homo Sapiens
EYMLEVKNS

SEQ ID NO: 1328596 - protein, 9 aa, Homo Sapiens
NLEDIFPST

SEQ ID NO: 1328597 - protein, 9 aa, Homo Sapiens
CDCKEADRA

SEQ ID NO: 1328598 - protein, 9 aa, Homo Sapiens
TKCKGTILS

SEQ ID NO: 1328599 - protein, 9 aa, Homo Sapiens
YEYYVSCCL

SEQ ID NO: 1328600 - protein, 9 aa, Homo Sapiens
RQGVPQAQR

SEQ ID NO: 1328601 - protein, 9 aa, Homo Sapiens
IFLQDINKP

SEQ ID NO: 1328602 - protein, 9 aa, Homo Sapiens
TGNRALELS

SEQ ID NO: 1328603 - protein, 9 aa, Homo Sapiens
GYSISHMKR

SEQ ID NO: 1328604 - protein, 9 aa, Homo Sapiens
DMCISILHP

SEQ ID NO: 1328605 - protein, 9 aa, Homo Sapiens
QSPCWQAVW

SEQ ID NO: 1328606 - protein, 9 aa, Homo Sapiens
FYGQITHNT

SEQ ID NO: 1328607 - protein, 9 aa, Homo Sapiens
NKVKRVAKE

SEQ ID NO: 1328608 - protein, 9 aa, Homo Sapiens
QVFKMHKKG

SEQ ID NO: 1328609 - protein, 9 aa, Homo Sapiens
RHMGKCKVY

SEQ ID NO: 1328610 - protein, 9 aa, Homo Sapiens
ITYCEFNAR

SEQ ID NO: 1328611 - protein, 9 aa, Homo Sapiens
FAIITTLLM

SEQ ID NO: 1328612 - protein, 9 aa, Homo Sapiens
YGPSSLGQP

SEQ ID NO: 1328613 - protein, 9 aa, Homo Sapiens
FHPENAVSV

SEQ ID NO: 1328614 - protein, 9 aa, Homo Sapiens
VNVSAMYKC

SEQ ID NO: 1328615 - protein, 9 aa, Homo Sapiens
DVIFDEWMK

SEQ ID NO: 1328616 - protein, 9 aa, Homo Sapiens
LQGFTVDKA

SEQ ID NO: 1328617 - protein, 9 aa, Homo Sapiens
CISRNFLPG

SEQ ID NO: 1328618 - protein, 9 aa, Homo Sapiens
QIKMLSTSE

SEQ ID NO: 1328619 - protein, 9 aa, Homo Sapiens
CMSHLEDIL

SEQ ID NO: 1328620 - protein, 9 aa, Homo Sapiens
TSCMSQRRP

SEQ ID NO: 1328621 - protein, 9 aa, Homo Sapiens
GRITQDLGL

SEQ ID NO: 1328622 - protein, 9 aa, Homo Sapiens
ESHKHRGNP

SEQ ID NO: 1328623 - protein, 9 aa, Homo Sapiens
RTCTEAEDV

SEQ ID NO: 1328624 - protein, 9 aa, Homo Sapiens
LGQSLLENG

SEQ ID NO: 1328625 - protein, 9 aa, Homo Sapiens
SGHDIHTIL

SEQ ID NO: 1328626 - protein, 9 aa, Homo Sapiens
LFPVTPEAI

SEQ ID NO: 1328627 - protein, 9 aa, Homo Sapiens
TEPSHLVRE

SEQ ID NO: 1328628 - protein, 9 aa, Homo Sapiens
EIGTERYQK

SEQ ID NO: 1328629 - protein, 9 aa, Homo Sapiens
EAWCRTTLP

SEQ ID NO: 1328630 - protein, 9 aa, Homo Sapiens
RNQDSTAVA

SEQ ID NO: 1328631 - protein, 9 aa, Homo Sapiens
LKVFVRDTV

SEQ ID NO: 1328632 - protein, 9 aa, Homo Sapiens
HYSDASKLR

SEQ ID NO: 1328633 - protein, 9 aa, Homo Sapiens
SFKHLIYPL

SEQ ID NO: 1328634 - protein, 9 aa, Homo Sapiens
NVFLATDRA

SEQ ID NO: 1328635 - protein, 9 aa, Homo Sapiens
KFPVKVRLG

SEQ ID NO: 1328636 - protein, 9 aa, Homo Sapiens
LILPDSLTS

SEQ ID NO: 1328637 - protein, 9 aa, Homo Sapiens
CLRSSTSSS

SEQ ID NO: 1328638 - protein, 9 aa, Homo Sapiens
PRVFLSPKA

SEQ ID NO: 1328639 - protein, 9 aa, Homo Sapiens
SEACTSTLT

SEQ ID NO: 1328640 - protein, 9 aa, Homo Sapiens
IAAPEKCSL

SEQ ID NO: 1328641 - protein, 9 aa, Homo Sapiens
VPLTQVMYR

SEQ ID NO: 1328642 - protein, 9 aa, Homo Sapiens
LKATDNIVE

SEQ ID NO: 1328643 - protein, 9 aa, Homo Sapiens
GRNMELEHF

SEQ ID NO: 1328644 - protein, 9 aa, Homo Sapiens
QCLGHRLQL

SEQ ID NO: 1328645 - protein, 9 aa, Homo Sapiens
GHVLYVYAA

SEQ ID NO: 1328646 - protein, 9 aa, Homo Sapiens
RQNDKPPYS

SEQ ID NO: 1328647 - protein, 9 aa, Homo Sapiens
GGHVLYVYA

SEQ ID NO: 1328648 - protein, 9 aa, Homo Sapiens
TSCHPATLD

SEQ ID NO: 1328649 - protein, 9 aa, Homo Sapiens
MGLGQIIKI

SEQ ID NO: 1328650 - protein, 9 aa, Homo Sapiens
VNYPLWEVW

SEQ ID NO: 1328651 - protein, 9 aa, Homo Sapiens
TEGPPALPA

SEQ ID NO: 1328652 - protein, 9 aa, Homo Sapiens
PGSPQAAGQ

SEQ ID NO: 1328653 - protein, 9 aa, Homo Sapiens
MNKKKCQRR

SEQ ID NO: 1328654 - protein, 9 aa, Homo Sapiens
LDLKGKSKW

SEQ ID NO: 1328655 - protein, 9 aa, Homo Sapiens
KRQKVHEEA

SEQ ID NO: 1328656 - protein, 9 aa, Homo Sapiens
DDKGPRAPH

SEQ ID NO: 1328657 - protein, 9 aa, Homo Sapiens
PSPGSVPVP

SEQ ID NO: 1328658 - protein, 9 aa, Homo Sapiens
AAATMAGAR

SEQ ID NO: 1328659 - protein, 9 aa, Homo Sapiens
RKKQIVPLI

SEQ ID NO: 1328660 - protein, 9 aa, Homo Sapiens
KNLTGLNQC

SEQ ID NO: 1328661 - protein, 9 aa, Homo Sapiens
SPQNRSRTN

SEQ ID NO: 1328662 - protein, 9 aa, Homo Sapiens
SEGNVSFLS

SEQ ID NO: 1328663 - protein, 9 aa, Homo Sapiens
VVPLLAEAG

SEQ ID NO: 1328664 - protein, 9 aa, Homo Sapiens
KEDDLVCGA

SEQ ID NO: 1328665 - protein, 9 aa, Homo Sapiens
IIIVFFFIF

SEQ ID NO: 1328666 - protein, 9 aa, Homo Sapiens
SFIIQPSNT

SEQ ID NO: 1328667 - protein, 9 aa, Homo Sapiens
QNRPSMDFN

SEQ ID NO: 1328668 - protein, 9 aa, Homo Sapiens
AIFAFATCS

SEQ ID NO: 1328669 - protein, 9 aa, Homo Sapiens
LVNCHVIAT

SEQ ID NO: 1328670 - protein, 9 aa, Homo Sapiens
IRKILKILL

SEQ ID NO: 1328671 - protein, 9 aa, Homo Sapiens
SAMSENDNM

SEQ ID NO: 1328672 - protein, 9 aa, Homo Sapiens
ADGALLRGL

SEQ ID NO: 1328673 - protein, 9 aa, Homo Sapiens
VQALRHGVC

SEQ ID NO: 1328674 - protein, 9 aa, Homo Sapiens
NGSLEVAVH

SEQ ID NO: 1328675 - protein, 9 aa, Homo Sapiens
RPYERPPLP

SEQ ID NO: 1328676 - protein, 9 aa, Homo Sapiens
VYSHTIYPV

SEQ ID NO: 1328677 - protein, 9 aa, Homo Sapiens
GGTIEERAQ

SEQ ID NO: 1328678 - protein, 9 aa, Homo Sapiens
DGSSTTYNT

SEQ ID NO: 1328679 - protein, 9 aa, Homo Sapiens
PNSLVIYRL

SEQ ID NO: 1328680 - protein, 9 aa, Homo Sapiens
EGPEENSTY

SEQ ID NO: 1328681 - protein, 9 aa, Homo Sapiens
SEGLQQVVD

SEQ ID NO: 1328682 - protein, 9 aa, Homo Sapiens
KCVFSVGTH

SEQ ID NO: 1328683 - protein, 9 aa, Homo Sapiens
KYACQAIND

SEQ ID NO: 1328684 - protein, 9 aa, Homo Sapiens
GVTHITDDI

SEQ ID NO: 1328685 - protein, 9 aa, Homo Sapiens
TEHMPTPVI

SEQ ID NO: 1328686 - protein, 9 aa, Homo Sapiens
PKDAALSNV

SEQ ID NO: 1328687 - protein, 9 aa, Homo Sapiens
TLKSDGTRV

SEQ ID NO: 1328688 - protein, 9 aa, Homo Sapiens
VSPMNDNIF

SEQ ID NO: 1328689 - protein, 9 aa, Homo Sapiens
SLIDASEDI

SEQ ID NO: 1328690 - protein, 9 aa, Homo Sapiens
KTQEEIEDP

SEQ ID NO: 1328691 - protein, 9 aa, Homo Sapiens
VDKNEWKNC

SEQ ID NO: 1328692 - protein, 9 aa, Homo Sapiens
KLKFFLKQH

SEQ ID NO: 1328693 - protein, 9 aa, Homo Sapiens
RIHMYSERR

SEQ ID NO: 1328694 - protein, 9 aa, Homo Sapiens
HYLFIISVS

SEQ ID NO: 1328695 - protein, 9 aa, Homo Sapiens
IYNFFCDVH

SEQ ID NO: 1328696 - protein, 9 aa, Homo Sapiens
CKTDLCKGK

SEQ ID NO: 1328697 - protein, 9 aa, Homo Sapiens
VQRVLCRSQ

SEQ ID NO: 1328698 - protein, 9 aa, Homo Sapiens
LENTKPQVK

SEQ ID NO: 1328699 - protein, 9 aa, Homo Sapiens
DGSKPTPMM

SEQ ID NO: 1328700 - protein, 9 aa, Homo Sapiens
GFTFISFHR

SEQ ID NO: 1328701 - protein, 9 aa, Homo Sapiens
VDVEEIVDI

SEQ ID NO: 1328702 - protein, 9 aa, Homo Sapiens
HVIATPSMV

SEQ ID NO: 1328703 - protein, 9 aa, Homo Sapiens
SSERPYKCT

SEQ ID NO: 1328704 - protein, 9 aa, Homo Sapiens
RSPRSTPWA

SEQ ID NO: 1328705 - protein, 9 aa, Homo Sapiens
GLSDISTQV

SEQ ID NO: 1328706 - protein, 9 aa, Homo Sapiens
GFTMPKKFV

SEQ ID NO: 1328707 - protein, 9 aa, Homo Sapiens
FVATMYHCL

SEQ ID NO: 1328708 - protein, 9 aa, Homo Sapiens
FGYLVDQWH

SEQ ID NO: 1328709 - protein, 9 aa, Homo Sapiens
THSAQTGAC

SEQ ID NO: 1328710 - protein, 9 aa, Homo Sapiens
ATYVSWAIT

SEQ ID NO: 1328711 - protein, 9 aa, Homo Sapiens
FSSTVQGNT

SEQ ID NO: 1328712 - protein, 9 aa, Homo Sapiens
QKDSGVLDR

SEQ ID NO: 1328713 - protein, 9 aa, Homo Sapiens
VPEPSRRVR

SEQ ID NO: 1328714 - protein, 9 aa, Homo Sapiens
HIKAVTQKG

SEQ ID NO: 1328715 - protein, 9 aa, Homo Sapiens
PAHRAVDVG

SEQ ID NO: 1328716 - protein, 9 aa, Homo Sapiens
NKPPQHLTW

SEQ ID NO: 1328717 - protein, 9 aa, Homo Sapiens
TQLLVLEPP

SEQ ID NO: 1328718 - protein, 9 aa, Homo Sapiens
GVPFCYFIN

SEQ ID NO: 1328719 - protein, 9 aa, Homo Sapiens
GEKMNVIGH

SEQ ID NO: 1328720 - protein, 9 aa, Homo Sapiens
KYGLLPSHV

SEQ ID NO: 1328721 - protein, 9 aa, Homo Sapiens
NDSCKGDSG

SEQ ID NO: 1328722 - protein, 9 aa, Homo Sapiens
FVRDTVNQL

SEQ ID NO: 1328723 - protein, 9 aa, Homo Sapiens
PKPCDKSRR

SEQ ID NO: 1328724 - protein, 9 aa, Homo Sapiens
HRPLPAAIH

SEQ ID NO: 1328725 - protein, 9 aa, Homo Sapiens
EYKWKKPSI

SEQ ID NO: 1328726 - protein, 9 aa, Homo Sapiens
VDMKKSGGG

SEQ ID NO: 1328727 - protein, 9 aa, Homo Sapiens
IAVIHGEVQ

SEQ ID NO: 1328728 - protein, 9 aa, Homo Sapiens
VVSSQDPHT

SEQ ID NO: 1328729 - protein, 9 aa, Homo Sapiens
SFDLVTNDG

SEQ ID NO: 1328730 - protein, 9 aa, Homo Sapiens
AFASIPGCI

SEQ ID NO: 1328731 - protein, 9 aa, Homo Sapiens
NMHIRADTG

SEQ ID NO: 1328732 - protein, 9 aa, Homo Sapiens
DVEVMYPAL

SEQ ID NO: 1328733 - protein, 9 aa, Homo Sapiens
GEYEELHTH

SEQ ID NO: 1328734 - protein, 9 aa, Homo Sapiens
TMVLRHQQF

SEQ ID NO: 1328735 - protein, 9 aa, Homo Sapiens
FKIFCPIPW

SEQ ID NO: 1328736 - protein, 9 aa, Homo Sapiens
RPSYDVYNP

SEQ ID NO: 1328737 - protein, 9 aa, Homo Sapiens
ETPLHVAVR

SEQ ID NO: 1328738 - protein, 9 aa, Homo Sapiens
LCPTGFKVG

SEQ ID NO: 1328739 - protein, 9 aa, Homo Sapiens
VGQVARNTG

SEQ ID NO: 1328740 - protein, 9 aa, Homo Sapiens
TTIPTRAIT

SEQ ID NO: 1328741 - protein, 9 aa, Homo Sapiens
PPLQGTRVP

SEQ ID NO: 1328742 - protein, 9 aa, Homo Sapiens
RAARACFRS

SEQ ID NO: 1328743 - protein, 9 aa, Homo Sapiens
GKDTNDSQF

SEQ ID NO: 1328744 - protein, 9 aa, Homo Sapiens
CLANSSWTD

SEQ ID NO: 1328745 - protein, 9 aa, Homo Sapiens
PFRDMRELT

SEQ ID NO: 1328746 - protein, 9 aa, Homo Sapiens
SKEHILEML

SEQ ID NO: 1328747 - protein, 9 aa, Homo Sapiens
QTIEENDQQ

SEQ ID NO: 1328748 - protein, 9 aa, Homo Sapiens
TGENRNHLT

SEQ ID NO: 1328749 - protein, 9 aa, Homo Sapiens
SYQLDSMVT

SEQ ID NO: 1328750 - protein, 9 aa, Homo Sapiens
PRSSLEYRV

SEQ ID NO: 1328751 - protein, 9 aa, Homo Sapiens
RGMRALQGG

SEQ ID NO: 1328752 - protein, 9 aa, Homo Sapiens
DSVRYWVKA

SEQ ID NO: 1328753 - protein, 9 aa, Homo Sapiens
NKYGKAHFL

SEQ ID NO: 1328754 - protein, 9 aa, Homo Sapiens
SKDIGYLDD

SEQ ID NO: 1328755 - protein, 9 aa, Homo Sapiens
ETLISLDDG

SEQ ID NO: 1328756 - protein, 9 aa, Homo Sapiens
IMHLDLAGR

SEQ ID NO: 1328757 - protein, 9 aa, Homo Sapiens
HFKIFCPIP

SEQ ID NO: 1328758 - protein, 9 aa, Homo Sapiens
KAWAKVTMN

SEQ ID NO: 1328759 - protein, 9 aa, Homo Sapiens
EKGEPVDPG

SEQ ID NO: 1328760 - protein, 9 aa, Homo Sapiens
GRAAAVMLF

SEQ ID NO: 1328761 - protein, 9 aa, Homo Sapiens
PLEPAVIAH

SEQ ID NO: 1328762 - protein, 9 aa, Homo Sapiens
SRNWPSHRS

SEQ ID NO: 1328763 - protein, 9 aa, Homo Sapiens
ERFLAKTYS

SEQ ID NO: 1328764 - protein, 9 aa, Homo Sapiens
MYKQCLPPR

SEQ ID NO: 1328765 - protein, 9 aa, Homo Sapiens
PEINLVTET

SEQ ID NO: 1328766 - protein, 9 aa, Homo Sapiens
HVTLLIYCR

SEQ ID NO: 1328767 - protein, 9 aa, Homo Sapiens
GLFPPSKLA

SEQ ID NO: 1328768 - protein, 9 aa, Homo Sapiens
ECLNRILCL

SEQ ID NO: 1328769 - protein, 9 aa, Homo Sapiens
PDGRRRRHN

SEQ ID NO: 1328770 - protein, 9 aa, Homo Sapiens
ETCGKMYGW

SEQ ID NO: 1328771 - protein, 9 aa, Homo Sapiens
VSKAWAKVT

SEQ ID NO: 1328772 - protein, 9 aa, Homo Sapiens
GRRRRSSKS

SEQ ID NO: 1328773 - protein, 9 aa, Homo Sapiens
FNIVGSYSC

SEQ ID NO: 1328774 - protein, 9 aa, Homo Sapiens
GASVVCWTP

SEQ ID NO: 1328775 - protein, 9 aa, Homo Sapiens
SATKMCILD

SEQ ID NO: 1328776 - protein, 9 aa, Homo Sapiens
VQVHPITKK

SEQ ID NO: 1328777 - protein, 9 aa, Homo Sapiens
PTLTVSRWM

SEQ ID NO: 1328778 - protein, 9 aa, Homo Sapiens
QQHVLGAQV

SEQ ID NO: 1328779 - protein, 9 aa, Homo Sapiens
PIKGQVSVK

SEQ ID NO: 1328780 - protein, 9 aa, Homo Sapiens
SREVYTWNL

SEQ ID NO: 1328781 - protein, 9 aa, Homo Sapiens
SALPRPSLV

SEQ ID NO: 1328782 - protein, 9 aa, Homo Sapiens
NPYLVTKLV

SEQ ID NO: 1328783 - protein, 9 aa, Homo Sapiens
WHLKIPKMK

SEQ ID NO: 1328784 - protein, 9 aa, Homo Sapiens
EQVSKPCAH

SEQ ID NO: 1328785 - protein, 9 aa, Homo Sapiens
VEKLMRDVK

SEQ ID NO: 1328786 - protein, 9 aa, Homo Sapiens
MLSREGRTR

SEQ ID NO: 1328787 - protein, 9 aa, Homo Sapiens
NSFFTLTVA

SEQ ID NO: 1328788 - protein, 9 aa, Homo Sapiens
RSMLCSYRQ

SEQ ID NO: 1328789 - protein, 9 aa, Homo Sapiens
SIQGEAVHM

SEQ ID NO: 1328790 - protein, 9 aa, Homo Sapiens
GLPSHQASG

SEQ ID NO: 1328791 - protein, 9 aa, Homo Sapiens
RHPSWPWTR

SEQ ID NO: 1328792 - protein, 9 aa, Homo Sapiens
ECGNTFYRS

SEQ ID NO: 1328793 - protein, 9 aa, Homo Sapiens
TLTVAIQDA

SEQ ID NO: 1328794 - protein, 9 aa, Homo Sapiens
KKNKTPKEK

SEQ ID NO: 1328795 - protein, 9 aa, Homo Sapiens
EECWAMRSY

SEQ ID NO: 1328796 - protein, 9 aa, Homo Sapiens
EEGKYYNVP

SEQ ID NO: 1328797 - protein, 9 aa, Homo Sapiens
NLKRVSALL

SEQ ID NO: 1328798 - protein, 9 aa, Homo Sapiens
SEEENGWLL

SEQ ID NO: 1328799 - protein, 9 aa, Homo Sapiens
HLFFSRSEP

SEQ ID NO: 1328800 - protein, 9 aa, Homo Sapiens
PYRRTVRAM

SEQ ID NO: 1328801 - protein, 9 aa, Homo Sapiens
TDRLPRCVC

SEQ ID NO: 1328802 - protein, 9 aa, Homo Sapiens
LKLILVMLE

SEQ ID NO: 1328803 - protein, 9 aa, Homo Sapiens
SETSPAFHI

SEQ ID NO: 1328804 - protein, 9 aa, Homo Sapiens
SGPTSAAPA

SEQ ID NO: 1328805 - protein, 9 aa, Homo Sapiens
PMELVQWGD

SEQ ID NO: 1328806 - protein, 9 aa, Homo Sapiens
EVAVSKAWA

SEQ ID NO: 1328807 - protein, 9 aa, Homo Sapiens
GQCKAWASF

SEQ ID NO: 1328808 - protein, 9 aa, Homo Sapiens
KKLQNDVYS

SEQ ID NO: 1328809 - protein, 9 aa, Homo Sapiens
LDVRCASAS

SEQ ID NO: 1328810 - protein, 9 aa, Homo Sapiens
RVPEPSRRV

SEQ ID NO: 1328811 - protein, 9 aa, Homo Sapiens
SLQGHRLDN

SEQ ID NO: 1328812 - protein, 9 aa, Homo Sapiens
LLPETKWVA

SEQ ID NO: 1328813 - protein, 9 aa, Homo Sapiens
DCHMTSISD

SEQ ID NO: 1328814 - protein, 9 aa, Homo Sapiens
RKEIMVQLE

SEQ ID NO: 1328815 - protein, 9 aa, Homo Sapiens
KRSRITYSD

SEQ ID NO: 1328816 - protein, 9 aa, Homo Sapiens
YECNECGNV

SEQ ID NO: 1328817 - protein, 9 aa, Homo Sapiens
HVTYEGIIE

SEQ ID NO: 1328818 - protein, 9 aa, Homo Sapiens
AGVLCHQLG

SEQ ID NO: 1328819 - protein, 9 aa, Homo Sapiens
PQPSLLCSP

SEQ ID NO: 1328820 - protein, 9 aa, Homo Sapiens
PLSKVVRHF

SEQ ID NO: 1328821 - protein, 9 aa, Homo Sapiens
ITCCPFVQE

SEQ ID NO: 1328822 - protein, 9 aa, Homo Sapiens
TKKSISLTK

SEQ ID NO: 1328823 - protein, 9 aa, Homo Sapiens
EVTMSYPMH

SEQ ID NO: 1328824 - protein, 9 aa, Homo Sapiens
ITAKVRRLV

SEQ ID NO: 1328825 - protein, 9 aa, Homo Sapiens
ELCPGVTIW

SEQ ID NO: 1328826 - protein, 9 aa, Homo Sapiens
LRSLHFLQI

SEQ ID NO: 1328827 - protein, 9 aa, Homo Sapiens
EICDEAEKP

SEQ ID NO: 1328828 - protein, 9 aa, Homo Sapiens
YYIPVLGPD

SEQ ID NO: 1328829 - protein, 9 aa, Homo Sapiens
DIASHYPTL

SEQ ID NO: 1328830 - protein, 9 aa, Homo Sapiens
QQEVIMLFC

SEQ ID NO: 1328831 - protein, 9 aa, Homo Sapiens
AEAHLISAQ

SEQ ID NO: 1328832 - protein, 9 aa, Homo Sapiens
MESDKGWTY

SEQ ID NO: 1328833 - protein, 9 aa, Homo Sapiens
YISENCEMS

SEQ ID NO: 1328834 - protein, 9 aa, Homo Sapiens
VLPHVDFQL

SEQ ID NO: 1328835 - protein, 9 aa, Homo Sapiens
NDGTMLSTH

SEQ ID NO: 1328836 - protein, 9 aa, Homo Sapiens
PPEWRTALG

SEQ ID NO: 1328837 - protein, 9 aa, Homo Sapiens
AVTHLVGFP

SEQ ID NO: 1328838 - protein, 9 aa, Homo Sapiens
LVDPNFGFE

SEQ ID NO: 1328839 - protein, 9 aa, Homo Sapiens
DIDECHLLR

SEQ ID NO: 1328840 - protein, 9 aa, Homo Sapiens
WACATCGAA

SEQ ID NO: 1328841 - protein, 9 aa, Homo Sapiens
LSGNDPSIH

SEQ ID NO: 1328842 - protein, 9 aa, Homo Sapiens
YQDYSMSSA

SEQ ID NO: 1328843 - protein, 9 aa, Homo Sapiens
DPGARMTVL

SEQ ID NO: 1328844 - protein, 9 aa, Homo Sapiens
NRQIYPPST

SEQ ID NO: 1328845 - protein, 9 aa, Homo Sapiens
DLVRMYRDD

SEQ ID NO: 1328846 - protein, 9 aa, Homo Sapiens
WLSSPSRLM

SEQ ID NO: 1328847 - protein, 9 aa, Homo Sapiens
NPTFPGEKL

SEQ ID NO: 1328848 - protein, 9 aa, Homo Sapiens
LSNVVERVT

SEQ ID NO: 1328849 - protein, 9 aa, Homo Sapiens
IIIVGDDCG

SEQ ID NO: 1328850 - protein, 9 aa, Homo Sapiens
MTDLVDKNE

SEQ ID NO: 1328851 - protein, 9 aa, Homo Sapiens
HPLQPLMNR

SEQ ID NO: 1328852 - protein, 9 aa, Homo Sapiens
VLLNQCRGF

SEQ ID NO: 1328853 - protein, 9 aa, Homo Sapiens
MCNDVSVKL

SEQ ID NO: 1328854 - protein, 9 aa, Homo Sapiens
GYLDQWAIR

SEQ ID NO: 1328855 - protein, 9 aa, Homo Sapiens
SSPHARALV

SEQ ID NO: 1328856 - protein, 9 aa, Homo Sapiens
PRCSLIILM

SEQ ID NO: 1328857 - protein, 9 aa, Homo Sapiens
WVLCTVITE

SEQ ID NO: 1328858 - protein, 9 aa, Homo Sapiens
KRLATDKHF

SEQ ID NO: 1328859 - protein, 9 aa, Homo Sapiens
VPPQYHKVL

SEQ ID NO: 1328860 - protein, 9 aa, Homo Sapiens
MWGLPCGSV

SEQ ID NO: 1328861 - protein, 9 aa, Homo Sapiens
RMDGILFGG

SEQ ID NO: 1328862 - protein, 9 aa, Homo Sapiens
FECYRIPKV

SEQ ID NO: 1328863 - protein, 9 aa, Homo Sapiens
MLRLGQMDT

SEQ ID NO: 1328864 - protein, 9 aa, Homo Sapiens
EFENYMCQQ

SEQ ID NO: 1328865 - protein, 9 aa, Homo Sapiens
SIPGCIVMT

SEQ ID NO: 1328866 - protein, 9 aa, Homo Sapiens
VSMDSWNRK

SEQ ID NO: 1328867 - protein, 9 aa, Homo Sapiens
EENLDFKVI

SEQ ID NO: 1328868 - protein, 9 aa, Homo Sapiens
IYYKILGLQ

SEQ ID NO: 1328869 - protein, 9 aa, Homo Sapiens
PPTSISCSY

SEQ ID NO: 1328870 - protein, 9 aa, Homo Sapiens
FPRSLSLQK

SEQ ID NO: 1328871 - protein, 9 aa, Homo Sapiens
LCLLPTGTY

SEQ ID NO: 1328872 - protein, 9 aa, Homo Sapiens
TPFLPFTST

SEQ ID NO: 1328873 - protein, 9 aa, Homo Sapiens
DNDHITVEL

SEQ ID NO: 1328874 - protein, 9 aa, Homo Sapiens
HINCPWKVP

SEQ ID NO: 1328875 - protein, 9 aa, Homo Sapiens
PKGISQLIT

SEQ ID NO: 1328876 - protein, 9 aa, Homo Sapiens
YFLFIAEHG

SEQ ID NO: 1328877 - protein, 9 aa, Homo Sapiens
NQCRGFLCN

SEQ ID NO: 1328878 - protein, 9 aa, Homo Sapiens
VFFNHPKGC

SEQ ID NO: 1328879 - protein, 9 aa, Homo Sapiens
TYQVTVCIE

SEQ ID NO: 1328880 - protein, 9 aa, Homo Sapiens
MRMGERGVF

SEQ ID NO: 1328881 - protein, 9 aa, Homo Sapiens
VNHPSAVLM

SEQ ID NO: 1328882 - protein, 9 aa, Homo Sapiens
ANGVVTLPA

SEQ ID NO: 1328883 - protein, 9 aa, Homo Sapiens
AGTGEDADW

SEQ ID NO: 1328884 - protein, 9 aa, Homo Sapiens
TQMVEKIIG

SEQ ID NO: 1328885 - protein, 9 aa, Homo Sapiens
IVHLTPSLD

SEQ ID NO: 1328886 - protein, 9 aa, Homo Sapiens
HYTMDNITR

SEQ ID NO: 1328887 - protein, 9 aa, Homo Sapiens
QLMAVTYTV

SEQ ID NO: 1328888 - protein, 9 aa, Homo Sapiens
DFYCMTCHE

SEQ ID NO: 1328889 - protein, 9 aa, Homo Sapiens
GSLILLGVS

SEQ ID NO: 1328890 - protein, 9 aa, Homo Sapiens
FAMAQLRFL

SEQ ID NO: 1328891 - protein, 9 aa, Homo Sapiens
MDRLSHRLH

SEQ ID NO: 1328892 - protein, 9 aa, Homo Sapiens
ISVVHIHCW

SEQ ID NO: 1328893 - protein, 9 aa, Homo Sapiens
CRVTQLALL

SEQ ID NO: 1328894 - protein, 9 aa, Homo Sapiens
VRPQAELGG

SEQ ID NO: 1328895 - protein, 9 aa, Homo Sapiens
RDNRPLSPI

SEQ ID NO: 1328896 - protein, 9 aa, Homo Sapiens
TSAHPSRPC

SEQ ID NO: 1328897 - protein, 9 aa, Homo Sapiens
STREDIMEI

SEQ ID NO: 1328898 - protein, 9 aa, Homo Sapiens
HKMLCLRLP

SEQ ID NO: 1328899 - protein, 9 aa, Homo Sapiens
TILCCITFF

SEQ ID NO: 1328900 - protein, 9 aa, Homo Sapiens
VYDFGDTQK

SEQ ID NO: 1328901 - protein, 9 aa, Homo Sapiens
IKALLVLLS

SEQ ID NO: 1328902 - protein, 9 aa, Homo Sapiens
SLIRTGGWF

SEQ ID NO: 1328903 - protein, 9 aa, Homo Sapiens
KKLEDAWAR

SEQ ID NO: 1328904 - protein, 9 aa, Homo Sapiens
VNGLTLVSR

SEQ ID NO: 1328905 - protein, 9 aa, Homo Sapiens
SGQRHPTIV

SEQ ID NO: 1328906 - protein, 9 aa, Homo Sapiens
SWQRRRLPS

SEQ ID NO: 1328907 - protein, 9 aa, Homo Sapiens
WLPFFLAHV

SEQ ID NO: 1328908 - protein, 9 aa, Homo Sapiens
QAKAHPENK

SEQ ID NO: 1328909 - protein, 9 aa, Homo Sapiens
ANLVESLCS

SEQ ID NO: 1328910 - protein, 9 aa, Homo Sapiens
AIWIDGTDK

SEQ ID NO: 1328911 - protein, 9 aa, Homo Sapiens
CVKEFLSFL

SEQ ID NO: 1328912 - protein, 9 aa, Homo Sapiens
CQTYECPIA

SEQ ID NO: 1328913 - protein, 9 aa, Homo Sapiens
RHPITGTHL

SEQ ID NO: 1328914 - protein, 9 aa, Homo Sapiens
VLARDIEHM

SEQ ID NO: 1328915 - protein, 9 aa, Homo Sapiens
LGRLLILRS

SEQ ID NO: 1328916 - protein, 9 aa, Homo Sapiens
VAVIVYCLS

SEQ ID NO: 1328917 - protein, 9 aa, Homo Sapiens
GAVVPRGQE

SEQ ID NO: 1328918 - protein, 9 aa, Homo Sapiens
RTNAKCKLS

SEQ ID NO: 1328919 - protein, 9 aa, Homo Sapiens
IIYDEDYEF

SEQ ID NO: 1328920 - protein, 9 aa, Homo Sapiens
ISELRQHKF

SEQ ID NO: 1328921 - protein, 9 aa, Homo Sapiens
KDEKNRFSL

SEQ ID NO: 1328922 - protein, 9 aa, Homo Sapiens
LADLYVLVP

SEQ ID NO: 1328923 - protein, 9 aa, Homo Sapiens
GPMSEEPWS

SEQ ID NO: 1328924 - protein, 9 aa, Homo Sapiens
LEKDQIKML

SEQ ID NO: 1328925 - protein, 9 aa, Homo Sapiens
VISTPTDFL

SEQ ID NO: 1328926 - protein, 9 aa, Homo Sapiens
LGLSEARMQ

SEQ ID NO: 1328927 - protein, 9 aa, Homo Sapiens
GLYTSLTTL

SEQ ID NO: 1328928 - protein, 9 aa, Homo Sapiens
KNLHKLVFS

SEQ ID NO: 1328929 - protein, 9 aa, Homo Sapiens
YDFGDTQKT

SEQ ID NO: 1328930 - protein, 9 aa, Homo Sapiens
FVFLLHMVD

SEQ ID NO: 1328931 - protein, 9 aa, Homo Sapiens
SFAYMEGES

SEQ ID NO: 1328932 - protein, 9 aa, Homo Sapiens
NKLDADYIK

SEQ ID NO: 1328933 - protein, 9 aa, Homo Sapiens
TPAEEMPEK

SEQ ID NO: 1328934 - protein, 9 aa, Homo Sapiens
YKRNVMILM

SEQ ID NO: 1328935 - protein, 9 aa, Homo Sapiens
FRVKVVNAV

SEQ ID NO: 1328936 - protein, 9 aa, Homo Sapiens
ICEDGNHFI

SEQ ID NO: 1328937 - protein, 9 aa, Homo Sapiens
KAMERADYV

SEQ ID NO: 1328938 - protein, 9 aa, Homo Sapiens
QRKRRKFMM

SEQ ID NO: 1328939 - protein, 9 aa, Homo Sapiens
QLAQLKESF

SEQ ID NO: 1328940 - protein, 9 aa, Homo Sapiens
KDDMNDKFT

SEQ ID NO: 1328941 - protein, 9 aa, Homo Sapiens
LLSGCHVNI

SEQ ID NO: 1328942 - protein, 9 aa, Homo Sapiens
HVVLEVVVV

SEQ ID NO: 1328943 - protein, 9 aa, Homo Sapiens
LQLAIEERY

SEQ ID NO: 1328944 - protein, 9 aa, Homo Sapiens
LNSRPTPDN

SEQ ID NO: 1328945 - protein, 9 aa, Homo Sapiens
SPDYQHYLR

SEQ ID NO: 1328946 - protein, 9 aa, Homo Sapiens
EDTGCYSCF

SEQ ID NO: 1328947 - protein, 9 aa, Homo Sapiens
EAGTPYDKE

SEQ ID NO: 1328948 - protein, 9 aa, Homo Sapiens
VPSSHLLTV

SEQ ID NO: 1328949 - protein, 9 aa, Homo Sapiens
DIEHMVEAR

SEQ ID NO: 1328950 - protein, 9 aa, Homo Sapiens
QKCIRYVVD

SEQ ID NO: 1328951 - protein, 9 aa, Homo Sapiens
HHHENSSRG

SEQ ID NO: 1328952 - protein, 9 aa, Homo Sapiens
IGKWKGTAN

SEQ ID NO: 1328953 - protein, 9 aa, Homo Sapiens
ITYIRLTQY

SEQ ID NO: 1328954 - protein, 9 aa, Homo Sapiens
DTGDADISI

SEQ ID NO: 1328955 - protein, 9 aa, Homo Sapiens
MENEPYHEN

SEQ ID NO: 1328956 - protein, 9 aa, Homo Sapiens
RPVSRCTPQ

SEQ ID NO: 1328957 - protein, 9 aa, Homo Sapiens
KSICLITLL

SEQ ID NO: 1328958 - protein, 9 aa, Homo Sapiens
MDSNDSHGS

SEQ ID NO: 1328959 - protein, 9 aa, Homo Sapiens
TLPPAPEAR

SEQ ID NO: 1328960 - protein, 9 aa, Homo Sapiens
WLLPGMGPH

SEQ ID NO: 1328961 - protein, 9 aa, Homo Sapiens
EGGITFVPH

SEQ ID NO: 1328962 - protein, 9 aa, Homo Sapiens
SNTLSTVLP

SEQ ID NO: 1328963 - protein, 9 aa, Homo Sapiens
QFQEGFASS

SEQ ID NO: 1328964 - protein, 9 aa, Homo Sapiens
KLQTPHINK

SEQ ID NO: 1328965 - protein, 9 aa, Homo Sapiens
KRLCYFDPL

SEQ ID NO: 1328966 - protein, 9 aa, Homo Sapiens
SACTCGCTP

SEQ ID NO: 1328967 - protein, 9 aa, Homo Sapiens
IDWVALAQA

SEQ ID NO: 1328968 - protein, 9 aa, Homo Sapiens
ILPVFINAN

SEQ ID NO: 1328969 - protein, 9 aa, Homo Sapiens
LRSLNLVDN

SEQ ID NO: 1328970 - protein, 9 aa, Homo Sapiens
PQGPLKDYI

SEQ ID NO: 1328971 - protein, 9 aa, Homo Sapiens
IKTSNLLLY

SEQ ID NO: 1328972 - protein, 9 aa, Homo Sapiens
VAAEKPVRA

SEQ ID NO: 1328973 - protein, 9 aa, Homo Sapiens
EEKRHRTWS

SEQ ID NO: 1328974 - protein, 9 aa, Homo Sapiens
DFVDDDDGD

SEQ ID NO: 1328975 - protein, 9 aa, Homo Sapiens
SNPRESHPS

SEQ ID NO: 1328976 - protein, 9 aa, Homo Sapiens
FNVTNGGSH

SEQ ID NO: 1328977 - protein, 9 aa, Homo Sapiens
SLHREFMRN

SEQ ID NO: 1328978 - protein, 9 aa, Homo Sapiens
KIFYNITGP

SEQ ID NO: 1328979 - protein, 9 aa, Homo Sapiens
PLVKDIRQS

SEQ ID NO: 1328980 - protein, 9 aa, Homo Sapiens
TGTYKVVPS

SEQ ID NO: 1328981 - protein, 9 aa, Homo Sapiens
LCSPRPEEL

SEQ ID NO: 1328982 - protein, 9 aa, Homo Sapiens
LGDWFPGSP

SEQ ID NO: 1328983 - protein, 9 aa, Homo Sapiens
EMLLMRLPH

SEQ ID NO: 1328984 - protein, 9 aa, Homo Sapiens
HNIPFPSPQ

SEQ ID NO: 1328985 - protein, 9 aa, Homo Sapiens
TCRFKHPVN

SEQ ID NO: 1328986 - protein, 9 aa, Homo Sapiens
KLQEPRGAR

SEQ ID NO: 1328987 - protein, 9 aa, Homo Sapiens
TSSGQYIVI

SEQ ID NO: 1328988 - protein, 9 aa, Homo Sapiens
AATAAGISQ

SEQ ID NO: 1328989 - protein, 9 aa, Homo Sapiens
DAPEAPPCY

SEQ ID NO: 1328990 - protein, 9 aa, Homo Sapiens
CAVHEASVP

SEQ ID NO: 1328991 - protein, 9 aa, Homo Sapiens
LHSALLHLL

SEQ ID NO: 1328992 - protein, 9 aa, Homo Sapiens
LKITHVPEN

SEQ ID NO: 1328993 - protein, 9 aa, Homo Sapiens
AKTYSTKDQ

SEQ ID NO: 1328994 - protein, 9 aa, Homo Sapiens
MKKIQIPVS

SEQ ID NO: 1328995 - protein, 9 aa, Homo Sapiens
TITSRLQLQ

SEQ ID NO: 1328996 - protein, 9 aa, Homo Sapiens
QMFSNLTKG

SEQ ID NO: 1328997 - protein, 9 aa, Homo Sapiens
CNWVVNTCL

SEQ ID NO: 1328998 - protein, 9 aa, Homo Sapiens
GPRKEHTRS

SEQ ID NO: 1328999 - protein, 9 aa, Homo Sapiens
MMFCVLLKM

SEQ ID NO: 1329000 - protein, 9 aa, Homo Sapiens
KAHGDWRDD

SEQ ID NO: 1329001 - protein, 9 aa, Homo Sapiens
IQAHTVTPS

SEQ ID NO: 1329002 - protein, 9 aa, Homo Sapiens
SPPLGLHSS

SEQ ID NO: 1329003 - protein, 9 aa, Homo Sapiens
KTETVGPQG

SEQ ID NO: 1329004 - protein, 9 aa, Homo Sapiens
CFDASDELA

SEQ ID NO: 1329005 - protein, 9 aa, Homo Sapiens
EAVRHPIFR

SEQ ID NO: 1329006 - protein, 9 aa, Homo Sapiens
DSADIESIM

SEQ ID NO: 1329007 - protein, 9 aa, Homo Sapiens
AIRLIHHCA

SEQ ID NO: 1329008 - protein, 9 aa, Homo Sapiens
LKSVHYIEE

SEQ ID NO: 1329009 - protein, 9 aa, Homo Sapiens
WLLHHTLPP

SEQ ID NO: 1329010 - protein, 9 aa, Homo Sapiens
PTSAAPARR

SEQ ID NO: 1329011 - protein, 9 aa, Homo Sapiens
ITLGGPLPP

SEQ ID NO: 1329012 - protein, 9 aa, Homo Sapiens
TAVEFITVI

SEQ ID NO: 1329013 - protein, 9 aa, Homo Sapiens
LQGPCDTGN

SEQ ID NO: 1329014 - protein, 9 aa, Homo Sapiens
VLNKAIKLQ

SEQ ID NO: 1329015 - protein, 9 aa, Homo Sapiens
SYVFYWWDY

SEQ ID NO: 1329016 - protein, 9 aa, Homo Sapiens
QVDYIFRGV

SEQ ID NO: 1329017 - protein, 9 aa, Homo Sapiens
GRPTSFTSL

SEQ ID NO: 1329018 - protein, 9 aa, Homo Sapiens
GAGPRKEHT

SEQ ID NO: 1329019 - protein, 9 aa, Homo Sapiens
IFRVKVVNA

SEQ ID NO: 1329020 - protein, 9 aa, Homo Sapiens
ELTISPHCV

SEQ ID NO: 1329021 - protein, 9 aa, Homo Sapiens
FIKRRTAPI

SEQ ID NO: 1329022 - protein, 9 aa, Homo Sapiens
KKKPLLLTF

SEQ ID NO: 1329023 - protein, 9 aa, Homo Sapiens
IPPGLYHTC

SEQ ID NO: 1329024 - protein, 9 aa, Homo Sapiens
FTPQHKMLC

SEQ ID NO: 1329025 - protein, 9 aa, Homo Sapiens
HYIIEQEVC

SEQ ID NO: 1329026 - protein, 9 aa, Homo Sapiens
HHGNGTQQV

SEQ ID NO: 1329027 - protein, 9 aa, Homo Sapiens
FIHYLANVL

SEQ ID NO: 1329028 - protein, 9 aa, Homo Sapiens
KDGAIMTFF

SEQ ID NO: 1329029 - protein, 9 aa, Homo Sapiens
SARTTVSLN

SEQ ID NO: 1329030 - protein, 9 aa, Homo Sapiens
VESGLHRTL

SEQ ID NO: 1329031 - protein, 9 aa, Homo Sapiens
PRSTPWACA

SEQ ID NO: 1329032 - protein, 9 aa, Homo Sapiens
DKDGIGDKC

SEQ ID NO: 1329033 - protein, 9 aa, Homo Sapiens
ISEFALEYH

SEQ ID NO: 1329034 - protein, 9 aa, Homo Sapiens
VKDGAIMTF

SEQ ID NO: 1329035 - protein, 9 aa, Homo Sapiens
IQGRVTHLT

SEQ ID NO: 1329036 - protein, 9 aa, Homo Sapiens
FVESTYSQL

SEQ ID NO: 1329037 - protein, 9 aa, Homo Sapiens
VNMAGMGTM

SEQ ID NO: 1329038 - protein, 9 aa, Homo Sapiens
YVQGVALAK

SEQ ID NO: 1329039 - protein, 9 aa, Homo Sapiens
CLENTPCYD

SEQ ID NO: 1329040 - protein, 9 aa, Homo Sapiens
DQGLFVQLI

SEQ ID NO: 1329041 - protein, 9 aa, Homo Sapiens
KSRKKPEFH

SEQ ID NO: 1329042 - protein, 9 aa, Homo Sapiens
IPSTLKFFH

SEQ ID NO: 1329043 - protein, 9 aa, Homo Sapiens
RLTKFMKTE

SEQ ID NO: 1329044 - protein, 9 aa, Homo Sapiens
HHRVACVCV

SEQ ID NO: 1329045 - protein, 9 aa, Homo Sapiens
ENTRQKTRE

SEQ ID NO: 1329046 - protein, 9 aa, Homo Sapiens
REVLWTVET

SEQ ID NO: 1329047 - protein, 9 aa, Homo Sapiens
TATCFDAVQ

SEQ ID NO: 1329048 - protein, 9 aa, Homo Sapiens
FQFQNLHQL

SEQ ID NO: 1329049 - protein, 9 aa, Homo Sapiens
SAAEPSART

SEQ ID NO: 1329050 - protein, 9 aa, Homo Sapiens
MRTAAISTP

SEQ ID NO: 1329051 - protein, 9 aa, Homo Sapiens
HAQAEARHP

SEQ ID NO: 1329052 - protein, 9 aa, Homo Sapiens
DAVKPVIYK

SEQ ID NO: 1329053 - protein, 9 aa, Homo Sapiens
LHEWYLLNI

SEQ ID NO: 1329054 - protein, 9 aa, Homo Sapiens
TEVSKYIMQ

SEQ ID NO: 1329055 - protein, 9 aa, Homo Sapiens
MTGRSPFDI

SEQ ID NO: 1329056 - protein, 9 aa, Homo Sapiens
NLEEVKMTA

SEQ ID NO: 1329057 - protein, 9 aa, Homo Sapiens
HISAAAALR

SEQ ID NO: 1329058 - protein, 9 aa, Homo Sapiens
EEASQVGGT

SEQ ID NO: 1329059 - protein, 9 aa, Homo Sapiens
GAFLYKGSF

SEQ ID NO: 1329060 - protein, 9 aa, Homo Sapiens
EAQRAGFGT

SEQ ID NO: 1329061 - protein, 9 aa, Homo Sapiens
QARSPSTAA

SEQ ID NO: 1329062 - protein, 9 aa, Homo Sapiens
HHYIEDERL

SEQ ID NO: 1329063 - protein, 9 aa, Homo Sapiens
NMTDGPHTL

SEQ ID NO: 1329064 - protein, 9 aa, Homo Sapiens
EYSRKGFCS

SEQ ID NO: 1329065 - protein, 9 aa, Homo Sapiens
DCWPVEPLF

SEQ ID NO: 1329066 - protein, 9 aa, Homo Sapiens
SQRRPSQNV

SEQ ID NO: 1329067 - protein, 9 aa, Homo Sapiens
TKMLAVYLY

SEQ ID NO: 1329068 - protein, 9 aa, Homo Sapiens
ASPLRESTL

SEQ ID NO: 1329069 - protein, 9 aa, Homo Sapiens
QSAHTRLQE

SEQ ID NO: 1329070 - protein, 9 aa, Homo Sapiens
SHEHREHIL

SEQ ID NO: 1329071 - protein, 9 aa, Homo Sapiens
EPEEVTTCV

SEQ ID NO: 1329072 - protein, 9 aa, Homo Sapiens
NTGQTVVTF

SEQ ID NO: 1329073 - protein, 9 aa, Homo Sapiens
SGMTGTSTS

SEQ ID NO: 1329074 - protein, 9 aa, Homo Sapiens
RLHRLLAEE

SEQ ID NO: 1329075 - protein, 9 aa, Homo Sapiens
FITLCLPPG

SEQ ID NO: 1329076 - protein, 9 aa, Homo Sapiens
IVGGVSTSW

SEQ ID NO: 1329077 - protein, 9 aa, Homo Sapiens
DNKDLEVET

SEQ ID NO: 1329078 - protein, 9 aa, Homo Sapiens
PRGISSYVL

SEQ ID NO: 1329079 - protein, 9 aa, Homo Sapiens
CFDAVQGKT

SEQ ID NO: 1329080 - protein, 9 aa, Homo Sapiens
MQNRFGKKE

SEQ ID NO: 1329081 - protein, 9 aa, Homo Sapiens
SALIMVVAG

SEQ ID NO: 1329082 - protein, 9 aa, Homo Sapiens
KGWRKAFGT

SEQ ID NO: 1329083 - protein, 9 aa, Homo Sapiens
NKSESNEDL

SEQ ID NO: 1329084 - protein, 9 aa, Homo Sapiens
VVAVLASLL

SEQ ID NO: 1329085 - protein, 9 aa, Homo Sapiens
NIHLRGEAV

SEQ ID NO: 1329086 - protein, 9 aa, Homo Sapiens
KQKTNIFVP

SEQ ID NO: 1329087 - protein, 9 aa, Homo Sapiens
REAFGNALI

SEQ ID NO: 1329088 - protein, 9 aa, Homo Sapiens
PVFMVTGRQ

SEQ ID NO: 1329089 - protein, 9 aa, Homo Sapiens
LLGDIVKRV

SEQ ID NO: 1329090 - protein, 9 aa, Homo Sapiens
FNRNSYMIL

SEQ ID NO: 1329091 - protein, 9 aa, Homo Sapiens
SYVCPCTLV

SEQ ID NO: 1329092 - protein, 9 aa, Homo Sapiens
QRKTVFNRH

SEQ ID NO: 1329093 - protein, 9 aa, Homo Sapiens
HRQVKHYHI

SEQ ID NO: 1329094 - protein, 9 aa, Homo Sapiens
KPDNEGCNL

SEQ ID NO: 1329095 - protein, 9 aa, Homo Sapiens
LWIAQRRKT

SEQ ID NO: 1329096 - protein, 9 aa, Homo Sapiens
KKQICIQYK

SEQ ID NO: 1329097 - protein, 9 aa, Homo Sapiens
PSSPEPPVQ

SEQ ID NO: 1329098 - protein, 9 aa, Homo Sapiens
SGGQKQRMS

SEQ ID NO: 1329099 - protein, 9 aa, Homo Sapiens
THPRMRHYI

SEQ ID NO: 1329100 - protein, 9 aa, Homo Sapiens
QESPHQEKL

SEQ ID NO: 1329101 - protein, 9 aa, Homo Sapiens
PSIDLWGAG

SEQ ID NO: 1329102 - protein, 9 aa, Homo Sapiens
WSLQPLRQQ

SEQ ID NO: 1329103 - protein, 9 aa, Homo Sapiens
ALSPEENII

SEQ ID NO: 1329104 - protein, 9 aa, Homo Sapiens
VLTNWLTDA

SEQ ID NO: 1329105 - protein, 9 aa, Homo Sapiens
IAAVPPQYH

SEQ ID NO: 1329106 - protein, 9 aa, Homo Sapiens
YVFYLVVGN

SEQ ID NO: 1329107 - protein, 9 aa, Homo Sapiens
LDDWTANPH

SEQ ID NO: 1329108 - protein, 9 aa, Homo Sapiens
PFHVVWLNC

SEQ ID NO: 1329109 - protein, 9 aa, Homo Sapiens
LSVSPMNDN

SEQ ID NO: 1329110 - protein, 9 aa, Homo Sapiens
YAQNVLRKH

SEQ ID NO: 1329111 - protein, 9 aa, Homo Sapiens
AHVQKRKGT

SEQ ID NO: 1329112 - protein, 9 aa, Homo Sapiens
ALAMSQARF

SEQ ID NO: 1329113 - protein, 9 aa, Homo Sapiens
GALATDAIT

SEQ ID NO: 1329114 - protein, 9 aa, Homo Sapiens
ISHILVTSF

SEQ ID NO: 1329115 - protein, 9 aa, Homo Sapiens
DPSIHLYKE

SEQ ID NO: 1329116 - protein, 9 aa, Homo Sapiens
TICREEGIL

SEQ ID NO: 1329117 - protein, 9 aa, Homo Sapiens
HMKITRRRL

SEQ ID NO: 1329118 - protein, 9 aa, Homo Sapiens
RKLSTGITL

SEQ ID NO: 1329119 - protein, 9 aa, Homo Sapiens
CSLIILMWT

SEQ ID NO: 1329120 - protein, 9 aa, Homo Sapiens
TLLKNYGLL

SEQ ID NO: 1329121 - protein, 9 aa, Homo Sapiens
MLQRWMPQT

SEQ ID NO: 1329122 - protein, 9 aa, Homo Sapiens
LEKDMAATG

SEQ ID NO: 1329123 - protein, 9 aa, Homo Sapiens
CLYDLETTS

SEQ ID NO: 1329124 - protein, 9 aa, Homo Sapiens
CDTVVGDDQ

SEQ ID NO: 1329125 - protein, 9 aa, Homo Sapiens
EELTIHNRG

SEQ ID NO: 1329126 - protein, 9 aa, Homo Sapiens
KGSKEHHSS

SEQ ID NO: 1329127 - protein, 9 aa, Homo Sapiens
DLKHQVQQH

SEQ ID NO: 1329128 - protein, 9 aa, Homo Sapiens
QFMGGIDRA

SEQ ID NO: 1329129 - protein, 9 aa, Homo Sapiens
FEGEHSNIV

SEQ ID NO: 1329130 - protein, 9 aa, Homo Sapiens
EDYKSYQVP

SEQ ID NO: 1329131 - protein, 9 aa, Homo Sapiens
SCDSSPSRD

SEQ ID NO: 1329132 - protein, 9 aa, Homo Sapiens
ALQMQHKHL

SEQ ID NO: 1329133 - protein, 9 aa, Homo Sapiens
MRRSTAGTS

SEQ ID NO: 1329134 - protein, 9 aa, Homo Sapiens
RQFAQHPAG

SEQ ID NO: 1329135 - protein, 9 aa, Homo Sapiens
DFHRNRKSF

SEQ ID NO: 1329136 - protein, 9 aa, Homo Sapiens
AVLVPFREH

SEQ ID NO: 1329137 - protein, 9 aa, Homo Sapiens
PQPGAASTP

SEQ ID NO: 1329138 - protein, 9 aa, Homo Sapiens
ISDKDGSIV

SEQ ID NO: 1329139 - protein, 9 aa, Homo Sapiens
SEECKAGAY

SEQ ID NO: 1329140 - protein, 9 aa, Homo Sapiens
NGHIPSEQP

SEQ ID NO: 1329141 - protein, 9 aa, Homo Sapiens
QPGEKKSQA

SEQ ID NO: 1329142 - protein, 9 aa, Homo Sapiens
SGNDEDWLL

SEQ ID NO: 1329143 - protein, 9 aa, Homo Sapiens
LVPARQQGL

SEQ ID NO: 1329144 - protein, 9 aa, Homo Sapiens
LANVLLELR

SEQ ID NO: 1329145 - protein, 9 aa, Homo Sapiens
MTWRAMGGA

SEQ ID NO: 1329146 - protein, 9 aa, Homo Sapiens
LPQLTSVLT

SEQ ID NO: 1329147 - protein, 9 aa, Homo Sapiens
SVPHCQIQG

SEQ ID NO: 1329148 - protein, 9 aa, Homo Sapiens
LAIQRFNPC

SEQ ID NO: 1329149 - protein, 9 aa, Homo Sapiens
VCNWVVNTC

SEQ ID NO: 1329150 - protein, 9 aa, Homo Sapiens
MELTGTCAE

SEQ ID NO: 1329151 - protein, 9 aa, Homo Sapiens
RSRLAAASG

SEQ ID NO: 1329152 - protein, 9 aa, Homo Sapiens
PFACDECDM

SEQ ID NO: 1329153 - protein, 9 aa, Homo Sapiens
PGTISQQTV

SEQ ID NO: 1329154 - protein, 9 aa, Homo Sapiens
RHSFQYFLK

SEQ ID NO: 1329155 - protein, 9 aa, Homo Sapiens
ENLQDVIGA

SEQ ID NO: 1329156 - protein, 9 aa, Homo Sapiens
NVMKDQHLV

SEQ ID NO: 1329157 - protein, 9 aa, Homo Sapiens
GVSAGNGDD

SEQ ID NO: 1329158 - protein, 9 aa, Homo Sapiens
HHTQDQVAG

SEQ ID NO: 1329159 - protein, 9 aa, Homo Sapiens
SATSTWLED

SEQ ID NO: 1329160 - protein, 9 aa, Homo Sapiens
ADQSAGHPS

SEQ ID NO: 1329161 - protein, 9 aa, Homo Sapiens
LGSPGSSPT

SEQ ID NO: 1329162 - protein, 9 aa, Homo Sapiens
HLDLEDRLT

SEQ ID NO: 1329163 - protein, 9 aa, Homo Sapiens
TLPKKPTSM

SEQ ID NO: 1329164 - protein, 9 aa, Homo Sapiens
WDDLSECLI

SEQ ID NO: 1329165 - protein, 9 aa, Homo Sapiens
ALRSLHFLQ

SEQ ID NO: 1329166 - protein, 9 aa, Homo Sapiens
LVDRYMSWF

SEQ ID NO: 1329167 - protein, 9 aa, Homo Sapiens
PSEVNQNTS

SEQ ID NO: 1329168 - protein, 9 aa, Homo Sapiens
FHKSLVKEG

SEQ ID NO: 1329169 - protein, 9 aa, Homo Sapiens
RCLREWEER

SEQ ID NO: 1329170 - protein, 9 aa, Homo Sapiens
RFTSLFDAK

SEQ ID NO: 1329171 - protein, 9 aa, Homo Sapiens
WEHQSVSLK

SEQ ID NO: 1329172 - protein, 9 aa, Homo Sapiens
ILIGVVSAT

SEQ ID NO: 1329173 - protein, 9 aa, Homo Sapiens
GKAPSGTQL

SEQ ID NO: 1329174 - protein, 9 aa, Homo Sapiens
CLLSCTGPS

SEQ ID NO: 1329175 - protein, 9 aa, Homo Sapiens
MVLRHQQFQ

SEQ ID NO: 1329176 - protein, 9 aa, Homo Sapiens
NKQIKVTIK

SEQ ID NO: 1329177 - protein, 9 aa, Homo Sapiens
RINSAKGWR

SEQ ID NO: 1329178 - protein, 9 aa, Homo Sapiens
ATLLSEHTT

SEQ ID NO: 1329179 - protein, 9 aa, Homo Sapiens
LPQTEISDI

SEQ ID NO: 1329180 - protein, 9 aa, Homo Sapiens
MVCEKPGKK

SEQ ID NO: 1329181 - protein, 9 aa, Homo Sapiens
SLVSAWEVE

SEQ ID NO: 1329182 - protein, 9 aa, Homo Sapiens
AATGECHDA

SEQ ID NO: 1329183 - protein, 9 aa, Homo Sapiens
MLLAHLARV

SEQ ID NO: 1329184 - protein, 9 aa, Homo Sapiens
CFLLCKPRC

SEQ ID NO: 1329185 - protein, 9 aa, Homo Sapiens
GKNPVNSKK

SEQ ID NO: 1329186 - protein, 9 aa, Homo Sapiens
KLALIDKLL

SEQ ID NO: 1329187 - protein, 9 aa, Homo Sapiens
HTIIFCETK

SEQ ID NO: 1329188 - protein, 9 aa, Homo Sapiens
LPTIVNNVK

SEQ ID NO: 1329189 - protein, 9 aa, Homo Sapiens
ELQPIDFGA

SEQ ID NO: 1329190 - protein, 9 aa, Homo Sapiens
RHNLRSFTE

SEQ ID NO: 1329191 - protein, 9 aa, Homo Sapiens
RTSKEAISQ

SEQ ID NO: 1329192 - protein, 9 aa, Homo Sapiens
LNCVVGSHG

SEQ ID NO: 1329193 - protein, 9 aa, Homo Sapiens
HWILSHTVA

SEQ ID NO: 1329194 - protein, 9 aa, Homo Sapiens
MHMWCHTSV

SEQ ID NO: 1329195 - protein, 9 aa, Homo Sapiens
GIMPSFGML

SEQ ID NO: 1329196 - protein, 9 aa, Homo Sapiens
YMLINVPMD

SEQ ID NO: 1329197 - protein, 9 aa, Homo Sapiens
SQGEFQVSK

SEQ ID NO: 1329198 - protein, 9 aa, Homo Sapiens
VEVMEGSNM

SEQ ID NO: 1329199 - protein, 9 aa, Homo Sapiens
SAKRWHPKL

SEQ ID NO: 1329200 - protein, 9 aa, Homo Sapiens
SMSQSSQDT

SEQ ID NO: 1329201 - protein, 9 aa, Homo Sapiens
SSEFSKWLL

SEQ ID NO: 1329202 - protein, 9 aa, Homo Sapiens
SQIKFMEKG

SEQ ID NO: 1329203 - protein, 9 aa, Homo Sapiens
SDKGWTYAS

SEQ ID NO: 1329204 - protein, 9 aa, Homo Sapiens
DQIWKFQHH

SEQ ID NO: 1329205 - protein, 9 aa, Homo Sapiens
GVLKRRAGD

SEQ ID NO: 1329206 - protein, 9 aa, Homo Sapiens
EPSASLGEY

SEQ ID NO: 1329207 - protein, 9 aa, Homo Sapiens
TFGSFNSLG

SEQ ID NO: 1329208 - protein, 9 aa, Homo Sapiens
SMRYQQNCL

SEQ ID NO: 1329209 - protein, 9 aa, Homo Sapiens
IIGGFWLSL

SEQ ID NO: 1329210 - protein, 9 aa, Homo Sapiens
SAMITDYMF

SEQ ID NO: 1329211 - protein, 9 aa, Homo Sapiens
LMIFSPVVV

SEQ ID NO: 1329212 - protein, 9 aa, Homo Sapiens
AGYHLPTWL

SEQ ID NO: 1329213 - protein, 9 aa, Homo Sapiens
PPHPHPHPR

SEQ ID NO: 1329214 - protein, 9 aa, Homo Sapiens
QNVQTRWKQ

SEQ ID NO: 1329215 - protein, 9 aa, Homo Sapiens
EVGDLCVSF

SEQ ID NO: 1329216 - protein, 9 aa, Homo Sapiens
WMPISPSRR

SEQ ID NO: 1329217 - protein, 9 aa, Homo Sapiens
TSKTWPALV

SEQ ID NO: 1329218 - protein, 9 aa, Homo Sapiens
GHWHSNVSA

SEQ ID NO: 1329219 - protein, 9 aa, Homo Sapiens
TIIGHQKNH

SEQ ID NO: 1329220 - protein, 9 aa, Homo Sapiens
YGYHCVTEE

SEQ ID NO: 1329221 - protein, 9 aa, Homo Sapiens
LEDDGFCLF

SEQ ID NO: 1329222 - protein, 9 aa, Homo Sapiens
PPVGPKSNH

SEQ ID NO: 1329223 - protein, 9 aa, Homo Sapiens
LQDFPCNCW

SEQ ID NO: 1329224 - protein, 9 aa, Homo Sapiens
MMDDYTYIS

SEQ ID NO: 1329225 - protein, 9 aa, Homo Sapiens
LSSSTMTPY

SEQ ID NO: 1329226 - protein, 9 aa, Homo Sapiens
ALTVGLVQQ

SEQ ID NO: 1329227 - protein, 9 aa, Homo Sapiens
VFQAESKVA

SEQ ID NO: 1329228 - protein, 9 aa, Homo Sapiens
FHYLMTFLR

SEQ ID NO: 1329229 - protein, 9 aa, Homo Sapiens
SDALLSSHD

SEQ ID NO: 1329230 - protein, 9 aa, Homo Sapiens
TCFNHLDLP

SEQ ID NO: 1329231 - protein, 9 aa, Homo Sapiens
HTIMIACVS

SEQ ID NO: 1329232 - protein, 9 aa, Homo Sapiens
TSSLIDTVQ

SEQ ID NO: 1329233 - protein, 9 aa, Homo Sapiens
QTSGGVLWD

SEQ ID NO: 1329234 - protein, 9 aa, Homo Sapiens
KKHFKLWRH

SEQ ID NO: 1329235 - protein, 9 aa, Homo Sapiens
EDNYGQEWT

SEQ ID NO: 1329236 - protein, 9 aa, Homo Sapiens
GIGEELTIH

SEQ ID NO: 1329237 - protein, 9 aa, Homo Sapiens
TSRRCWARC

SEQ ID NO: 1329238 - protein, 9 aa, Homo Sapiens
NLVTVSKPV

SEQ ID NO: 1329239 - protein, 9 aa, Homo Sapiens
EENDYFTEM

SEQ ID NO: 1329240 - protein, 9 aa, Homo Sapiens
GEGDCNVVK

SEQ ID NO: 1329241 - protein, 9 aa, Homo Sapiens
GAAPALDTT

SEQ ID NO: 1329242 - protein, 9 aa, Homo Sapiens
CEVSYCDCC

SEQ ID NO: 1329243 - protein, 9 aa, Homo Sapiens
VERMYSHIT

SEQ ID NO: 1329244 - protein, 9 aa, Homo Sapiens
TLWHVVDEG

SEQ ID NO: 1329245 - protein, 9 aa, Homo Sapiens
SRGALGSIT

SEQ ID NO: 1329246 - protein, 9 aa, Homo Sapiens
TTQNLTQKK

SEQ ID NO: 1329247 - protein, 9 aa, Homo Sapiens
ADVFEVKAT

SEQ ID NO: 1329248 - protein, 9 aa, Homo Sapiens
LPTFSEVIR

SEQ ID NO: 1329249 - protein, 9 aa, Homo Sapiens
CTGAGTAGR

SEQ ID NO: 1329250 - protein, 9 aa, Homo Sapiens
HPLCKCGRR

SEQ ID NO: 1329251 - protein, 9 aa, Homo Sapiens
PDITLPRRD

SEQ ID NO: 1329252 - protein, 9 aa, Homo Sapiens
ILLVSPSSA

SEQ ID NO: 1329253 - protein, 9 aa, Homo Sapiens
CRCAPVMSW

SEQ ID NO: 1329254 - protein, 9 aa, Homo Sapiens
KILQFLPEQ

SEQ ID NO: 1329255 - protein, 9 aa, Homo Sapiens
MTQVFTLHL

SEQ ID NO: 1329256 - protein, 9 aa, Homo Sapiens
WLSMEMEVL

SEQ ID NO: 1329257 - protein, 9 aa, Homo Sapiens
LAGQRGIIG

SEQ ID NO: 1329258 - protein, 9 aa, Homo Sapiens
EEAKIVMEK

SEQ ID NO: 1329259 - protein, 9 aa, Homo Sapiens
GDCVPNAYH

SEQ ID NO: 1329260 - protein, 9 aa, Homo Sapiens
LEYTIKCNY

SEQ ID NO: 1329261 - protein, 9 aa, Homo Sapiens
APVLDVRCA

SEQ ID NO: 1329262 - protein, 9 aa, Homo Sapiens
IFNQSPSMA

SEQ ID NO: 1329263 - protein, 9 aa, Homo Sapiens
KSNFEEYFE

SEQ ID NO: 1329264 - protein, 9 aa, Homo Sapiens
TNESSREEL

SEQ ID NO: 1329265 - protein, 9 aa, Homo Sapiens
SVTQTLDRE

SEQ ID NO: 1329266 - protein, 9 aa, Homo Sapiens
EVSQLGIVN

SEQ ID NO: 1329267 - protein, 9 aa, Homo Sapiens
DWLLLCDGC

SEQ ID NO: 1329268 - protein, 9 aa, Homo Sapiens
RKNCCALIT

SEQ ID NO: 1329269 - protein, 9 aa, Homo Sapiens
MEYVIRCTK

SEQ ID NO: 1329270 - protein, 9 aa, Homo Sapiens
DMSSLVEVR

SEQ ID NO: 1329271 - protein, 9 aa, Homo Sapiens
GPHQLIASL

SEQ ID NO: 1329272 - protein, 9 aa, Homo Sapiens
LKEKVWPEG

SEQ ID NO: 1329273 - protein, 9 aa, Homo Sapiens
SNQMRQSLV

SEQ ID NO: 1329274 - protein, 9 aa, Homo Sapiens
SSMSNKYTQ

SEQ ID NO: 1329275 - protein, 9 aa, Homo Sapiens
EKERLEVQT

SEQ ID NO: 1329276 - protein, 9 aa, Homo Sapiens
MELAARAVA

SEQ ID NO: 1329277 - protein, 9 aa, Homo Sapiens
ILSHLLSVL

SEQ ID NO: 1329278 - protein, 9 aa, Homo Sapiens
NICGTRYKK

SEQ ID NO: 1329279 - protein, 9 aa, Homo Sapiens
TRSSGRRQW

SEQ ID NO: 1329280 - protein, 9 aa, Homo Sapiens
KKSISLTKA

SEQ ID NO: 1329281 - protein, 9 aa, Homo Sapiens
VSQEHRCIP

SEQ ID NO: 1329282 - protein, 9 aa, Homo Sapiens
ASDTEEVDR

SEQ ID NO: 1329283 - protein, 9 aa, Homo Sapiens
KREQTKNPD

SEQ ID NO: 1329284 - protein, 9 aa, Homo Sapiens
FRGSGPGRR

SEQ ID NO: 1329285 - protein, 9 aa, Homo Sapiens
HPLTCDDPH

SEQ ID NO: 1329286 - protein, 9 aa, Homo Sapiens
IYLQFVPKS

SEQ ID NO: 1329287 - protein, 9 aa, Homo Sapiens
YKERFDNEM

SEQ ID NO: 1329288 - protein, 9 aa, Homo Sapiens
YHYFCGHNE

SEQ ID NO: 1329289 - protein, 9 aa, Homo Sapiens
ICGLIIVVF

SEQ ID NO: 1329290 - protein, 9 aa, Homo Sapiens
LRESTLMDI

SEQ ID NO: 1329291 - protein, 9 aa, Homo Sapiens
LIQDQNVQT

SEQ ID NO: 1329292 - protein, 9 aa, Homo Sapiens
LQFKAEHIK

SEQ ID NO: 1329293 - protein, 9 aa, Homo Sapiens
FLDKLDVVC

SEQ ID NO: 1329294 - protein, 9 aa, Homo Sapiens
EPGSEVNTA

SEQ ID NO: 1329295 - protein, 9 aa, Homo Sapiens
NDVGPADTG

SEQ ID NO: 1329296 - protein, 9 aa, Homo Sapiens
HVVQVLLNQ

SEQ ID NO: 1329297 - protein, 9 aa, Homo Sapiens
KLCKLEASG

SEQ ID NO: 1329298 - protein, 9 aa, Homo Sapiens
AILSIIQGE

SEQ ID NO: 1329299 - protein, 9 aa, Homo Sapiens
DDGIKLLYA

SEQ ID NO: 1329300 - protein, 9 aa, Homo Sapiens
QNPQPMMPP

SEQ ID NO: 1329301 - protein, 9 aa, Homo Sapiens
TTVRRRKCP

SEQ ID NO: 1329302 - protein, 9 aa, Homo Sapiens
LPVPAFNVT

SEQ ID NO: 1329303 - protein, 9 aa, Homo Sapiens
AVSFICFTP

SEQ ID NO: 1329304 - protein, 9 aa, Homo Sapiens
SIATCVYIT

SEQ ID NO: 1329305 - protein, 9 aa, Homo Sapiens
GEQQRLIRE

SEQ ID NO: 1329306 - protein, 9 aa, Homo Sapiens
SNYMSIDAL

SEQ ID NO: 1329307 - protein, 9 aa, Homo Sapiens
QYRLHHYLN

SEQ ID NO: 1329308 - protein, 9 aa, Homo Sapiens
YFNLSKSTQ

SEQ ID NO: 1329309 - protein, 9 aa, Homo Sapiens
DVPYDSDSG

SEQ ID NO: 1329310 - protein, 9 aa, Homo Sapiens
SGQCFTARD

SEQ ID NO: 1329311 - protein, 9 aa, Homo Sapiens
GDQILQANN

SEQ ID NO: 1329312 - protein, 9 aa, Homo Sapiens
GKAEFPDEE

SEQ ID NO: 1329313 - protein, 9 aa, Homo Sapiens
ENCRRRSEY

SEQ ID NO: 1329314 - protein, 9 aa, Homo Sapiens
YGKAFNQGS

SEQ ID NO: 1329315 - protein, 9 aa, Homo Sapiens
ILQFLCAWD

SEQ ID NO: 1329316 - protein, 9 aa, Homo Sapiens
LNIFLEKNK

SEQ ID NO: 1329317 - protein, 9 aa, Homo Sapiens
HLSLPSRWD

SEQ ID NO: 1329318 - protein, 9 aa, Homo Sapiens
IISTPQDIA

SEQ ID NO: 1329319 - protein, 9 aa, Homo Sapiens
GPLEGNANG

SEQ ID NO: 1329320 - protein, 9 aa, Homo Sapiens
TMDADSEEI

SEQ ID NO: 1329321 - protein, 9 aa, Homo Sapiens
IPHDVGSSE

SEQ ID NO: 1329322 - protein, 9 aa, Homo Sapiens
MLAPGGTCI

SEQ ID NO: 1329323 - protein, 9 aa, Homo Sapiens
QLGCGEVIN

SEQ ID NO: 1329324 - protein, 9 aa, Homo Sapiens
APSHHQSRS

SEQ ID NO: 1329325 - protein, 9 aa, Homo Sapiens
TKHCNSEEM

SEQ ID NO: 1329326 - protein, 9 aa, Homo Sapiens
YTYPRLPEP

SEQ ID NO: 1329327 - protein, 9 aa, Homo Sapiens
CPVEWAKFC

SEQ ID NO: 1329328 - protein, 9 aa, Homo Sapiens
CMNPAHAFG

SEQ ID NO: 1329329 - protein, 9 aa, Homo Sapiens
YLEQYHIDF

SEQ ID NO: 1329330 - protein, 9 aa, Homo Sapiens
VPFREHFEE

SEQ ID NO: 1329331 - protein, 9 aa, Homo Sapiens
GAHMMRRLL

SEQ ID NO: 1329332 - protein, 9 aa, Homo Sapiens
ASHNLQDVV

SEQ ID NO: 1329333 - protein, 9 aa, Homo Sapiens
PTAVQKEEV

SEQ ID NO: 1329334 - protein, 9 aa, Homo Sapiens
EPWPENVTL

SEQ ID NO: 1329335 - protein, 9 aa, Homo Sapiens
KSRLISGVS

SEQ ID NO: 1329336 - protein, 9 aa, Homo Sapiens
SHLLTEAEL

SEQ ID NO: 1329337 - protein, 9 aa, Homo Sapiens
GGGTADHCI

SEQ ID NO: 1329338 - protein, 9 aa, Homo Sapiens
HWMWQLVSF

SEQ ID NO: 1329339 - protein, 9 aa, Homo Sapiens
KLSATSTWL

SEQ ID NO: 1329340 - protein, 9 aa, Homo Sapiens
QKHISSPLA

SEQ ID NO: 1329341 - protein, 9 aa, Homo Sapiens
YLWGPLKKS

SEQ ID NO: 1329342 - protein, 9 aa, Homo Sapiens
QAESGEAVR

SEQ ID NO: 1329343 - protein, 9 aa, Homo Sapiens
MPKTSRRCW

SEQ ID NO: 1329344 - protein, 9 aa, Homo Sapiens
ILSHTVALT

SEQ ID NO: 1329345 - protein, 9 aa, Homo Sapiens
TDFRKLRQQ

SEQ ID NO: 1329346 - protein, 9 aa, Homo Sapiens
LSDLFQWVV

SEQ ID NO: 1329347 - protein, 9 aa, Homo Sapiens
ETRCKTEEE

SEQ ID NO: 1329348 - protein, 9 aa, Homo Sapiens
LKFFLKQHC

SEQ ID NO: 1329349 - protein, 9 aa, Homo Sapiens
PSPDYCVHN

SEQ ID NO: 1329350 - protein, 9 aa, Homo Sapiens
DLDHFWLET

SEQ ID NO: 1329351 - protein, 9 aa, Homo Sapiens
SNKLHLLRH

SEQ ID NO: 1329352 - protein, 9 aa, Homo Sapiens
YHENVEQSL

SEQ ID NO: 1329353 - protein, 9 aa, Homo Sapiens
MDTNGGGWT

SEQ ID NO: 1329354 - protein, 9 aa, Homo Sapiens
NFQAIIISL

SEQ ID NO: 1329355 - protein, 9 aa, Homo Sapiens
TSCLASLLT

SEQ ID NO: 1329356 - protein, 9 aa, Homo Sapiens
GVGVRKWSV

SEQ ID NO: 1329357 - protein, 9 aa, Homo Sapiens
SCKHSPSTP

SEQ ID NO: 1329358 - protein, 9 aa, Homo Sapiens
STDAATAKT

SEQ ID NO: 1329359 - protein, 9 aa, Homo Sapiens
WMLYECPNY

SEQ ID NO: 1329360 - protein, 9 aa, Homo Sapiens
GSTKHMKIT

SEQ ID NO: 1329361 - protein, 9 aa, Homo Sapiens
TRFGQVFDS

SEQ ID NO: 1329362 - protein, 9 aa, Homo Sapiens
LEDYYEEAL

SEQ ID NO: 1329363 - protein, 9 aa, Homo Sapiens
DYHSQNSYH

SEQ ID NO: 1329364 - protein, 9 aa, Homo Sapiens
HVGLTAVVL

SEQ ID NO: 1329365 - protein, 9 aa, Homo Sapiens
QWEPYCRDI

SEQ ID NO: 1329366 - protein, 9 aa, Homo Sapiens
LLENMDVAF

SEQ ID NO: 1329367 - protein, 9 aa, Homo Sapiens
HHSNLVGMG

SEQ ID NO: 1329368 - protein, 9 aa, Homo Sapiens
DTAADLDWP

SEQ ID NO: 1329369 - protein, 9 aa, Homo Sapiens
ITFANLLNK

SEQ ID NO: 1329370 - protein, 9 aa, Homo Sapiens
GQSPSPTPV

SEQ ID NO: 1329371 - protein, 9 aa, Homo Sapiens
LRSSSIPSV

SEQ ID NO: 1329372 - protein, 9 aa, Homo Sapiens
AWLRLRVLV

SEQ ID NO: 1329373 - protein, 9 aa, Homo Sapiens
LRNFNNCMK

SEQ ID NO: 1329374 - protein, 9 aa, Homo Sapiens
ISCSYSVPL

SEQ ID NO: 1329375 - protein, 9 aa, Homo Sapiens
WITYGQGSG

SEQ ID NO: 1329376 - protein, 9 aa, Homo Sapiens
SVPGAHPMP

SEQ ID NO: 1329377 - protein, 9 aa, Homo Sapiens
TLKEEGQCK

SEQ ID NO: 1329378 - protein, 9 aa, Homo Sapiens
RSPSPPHRR

SEQ ID NO: 1329379 - protein, 9 aa, Homo Sapiens
KCDASFLQS

SEQ ID NO: 1329380 - protein, 9 aa, Homo Sapiens
NDLYLMSGS

SEQ ID NO: 1329381 - protein, 9 aa, Homo Sapiens
RDFQGKSNF

SEQ ID NO: 1329382 - protein, 9 aa, Homo Sapiens
SMSTPFLSL

SEQ ID NO: 1329383 - protein, 9 aa, Homo Sapiens
KESLPELNT

SEQ ID NO: 1329384 - protein, 9 aa, Homo Sapiens
CEPEVSNYW

SEQ ID NO: 1329385 - protein, 9 aa, Homo Sapiens
SDLLQGPRP

SEQ ID NO: 1329386 - protein, 9 aa, Homo Sapiens
KPNNSNKCV

SEQ ID NO: 1329387 - protein, 9 aa, Homo Sapiens
ATRTCSCTG

SEQ ID NO: 1329388 - protein, 9 aa, Homo Sapiens
YEQGRYSFE

SEQ ID NO: 1329389 - protein, 9 aa, Homo Sapiens
IAPEGYATY

SEQ ID NO: 1329390 - protein, 9 aa, Homo Sapiens
EVELLSPAP

SEQ ID NO: 1329391 - protein, 9 aa, Homo Sapiens
SAPSRTWQG

SEQ ID NO: 1329392 - protein, 9 aa, Homo Sapiens
NECQCIPSK

SEQ ID NO: 1329393 - protein, 9 aa, Homo Sapiens
WGPTAGAAR

SEQ ID NO: 1329394 - protein, 9 aa, Homo Sapiens
LTGLCNRST

SEQ ID NO: 1329395 - protein, 9 aa, Homo Sapiens
HRNVSILYA

SEQ ID NO: 1329396 - protein, 9 aa, Homo Sapiens
SLYTGLVNG

SEQ ID NO: 1329397 - protein, 9 aa, Homo Sapiens
LTNAPELHV

SEQ ID NO: 1329398 - protein, 9 aa, Homo Sapiens
ISSPLASYF

SEQ ID NO: 1329399 - protein, 9 aa, Homo Sapiens
GGSLLTTEG

SEQ ID NO: 1329400 - protein, 9 aa, Homo Sapiens
VSRARSEQF

SEQ ID NO: 1329401 - protein, 9 aa, Homo Sapiens
LEIYEDILF

SEQ ID NO: 1329402 - protein, 9 aa, Homo Sapiens
CSVVLGPHA

SEQ ID NO: 1329403 - protein, 9 aa, Homo Sapiens
AGALATDAI

SEQ ID NO: 1329404 - protein, 9 aa, Homo Sapiens
DGSTIHIHY

SEQ ID NO: 1329405 - protein, 9 aa, Homo Sapiens
LHRLLAEEE

SEQ ID NO: 1329406 - protein, 9 aa, Homo Sapiens
CRAVGFEAH

SEQ ID NO: 1329407 - protein, 9 aa, Homo Sapiens
LLVLLSFAM

SEQ ID NO: 1329408 - protein, 9 aa, Homo Sapiens
LHVPLFIMF

SEQ ID NO: 1329409 - protein, 9 aa, Homo Sapiens
ASAEKGSLI

SEQ ID NO: 1329410 - protein, 9 aa, Homo Sapiens
VRHTPAEEM

SEQ ID NO: 1329411 - protein, 9 aa, Homo Sapiens
EDRLTKFMK

SEQ ID NO: 1329412 - protein, 9 aa, Homo Sapiens
MTFMERVKT

SEQ ID NO: 1329413 - protein, 9 aa, Homo Sapiens
YGAALYTYM

SEQ ID NO: 1329414 - protein, 9 aa, Homo Sapiens
FYVAEISIG

SEQ ID NO: 1329415 - protein, 9 aa, Homo Sapiens
DDNWANYNT

SEQ ID NO: 1329416 - protein, 9 aa, Homo Sapiens
LKIHLQSHT

SEQ ID NO: 1329417 - protein, 9 aa, Homo Sapiens
QEKNLLEEI

SEQ ID NO: 1329418 - protein, 9 aa, Homo Sapiens
CAGYSDGSN

SEQ ID NO: 1329419 - protein, 9 aa, Homo Sapiens
VEWRYRNVE

SEQ ID NO: 1329420 - protein, 9 aa, Homo Sapiens
NLKNKPGWF

SEQ ID NO: 1329421 - protein, 9 aa, Homo Sapiens
GRHDSVRYW

SEQ ID NO: 1329422 - protein, 9 aa, Homo Sapiens
GPGDQESCW

SEQ ID NO: 1329423 - protein, 9 aa, Homo Sapiens
CSVCRSNKN

SEQ ID NO: 1329424 - protein, 9 aa, Homo Sapiens
TETPLIIAG

SEQ ID NO: 1329425 - protein, 9 aa, Homo Sapiens
GWVGRFRPP

SEQ ID NO: 1329426 - protein, 9 aa, Homo Sapiens
HFAWQSPTI

SEQ ID NO: 1329427 - protein, 9 aa, Homo Sapiens
TLHCFFQPR

SEQ ID NO: 1329428 - protein, 9 aa, Homo Sapiens
EKENATVTH

SEQ ID NO: 1329429 - protein, 9 aa, Homo Sapiens
GRPYPMIDA

SEQ ID NO: 1329430 - protein, 9 aa, Homo Sapiens
HLFDFTACH

SEQ ID NO: 1329431 - protein, 9 aa, Homo Sapiens
FSYQVTNGM

SEQ ID NO: 1329432 - protein, 9 aa, Homo Sapiens
SGKIKKVYP

SEQ ID NO: 1329433 - protein, 9 aa, Homo Sapiens
RIFSLGGSQ

SEQ ID NO: 1329434 - protein, 9 aa, Homo Sapiens
PEKDRYPQA

SEQ ID NO: 1329435 - protein, 9 aa, Homo Sapiens
LALDVAVQV

SEQ ID NO: 1329436 - protein, 9 aa, Homo Sapiens
WAKQDCAHF

SEQ ID NO: 1329437 - protein, 9 aa, Homo Sapiens
FSDTEGLIQ

SEQ ID NO: 1329438 - protein, 9 aa, Homo Sapiens
GEESFDTGS

SEQ ID NO: 1329439 - protein, 9 aa, Homo Sapiens
PIHESLNIE

SEQ ID NO: 1329440 - protein, 9 aa, Homo Sapiens
HPGRPHTGN

SEQ ID NO: 1329441 - protein, 9 aa, Homo Sapiens
DKAFSRSKC

SEQ ID NO: 1329442 - protein, 9 aa, Homo Sapiens
RITLKLVGP

SEQ ID NO: 1329443 - protein, 9 aa, Homo Sapiens
IGKSHTEDG

SEQ ID NO: 1329444 - protein, 9 aa, Homo Sapiens
NNCELDVTC

SEQ ID NO: 1329445 - protein, 9 aa, Homo Sapiens
KLQMSPCSE

SEQ ID NO: 1329446 - protein, 9 aa, Homo Sapiens
RTRFYVYNK

SEQ ID NO: 1329447 - protein, 9 aa, Homo Sapiens
KYLAKDLSE

SEQ ID NO: 1329448 - protein, 9 aa, Homo Sapiens
VIAEKLDLK

SEQ ID NO: 1329449 - protein, 9 aa, Homo Sapiens
GFRQVKDPL

SEQ ID NO: 1329450 - protein, 9 aa, Homo Sapiens
NLKMMWRIN

SEQ ID NO: 1329451 - protein, 9 aa, Homo Sapiens
YHPLGSFEQ

SEQ ID NO: 1329452 - protein, 9 aa, Homo Sapiens
PHPQLREAY

SEQ ID NO: 1329453 - protein, 9 aa, Homo Sapiens
TAVRGLRHG

SEQ ID NO: 1329454 - protein, 9 aa, Homo Sapiens
NVGQWQARH

SEQ ID NO: 1329455 - protein, 9 aa, Homo Sapiens
SRCMPRGGA

SEQ ID NO: 1329456 - protein, 9 aa, Homo Sapiens
YYKILGLQF

SEQ ID NO: 1329457 - protein, 9 aa, Homo Sapiens
IHQGIKHAV

SEQ ID NO: 1329458 - protein, 9 aa, Homo Sapiens
YEIMGRALR

SEQ ID NO: 1329459 - protein, 9 aa, Homo Sapiens
KIRPLWCHY

SEQ ID NO: 1329460 - protein, 9 aa, Homo Sapiens
GYNSCGAFG

SEQ ID NO: 1329461 - protein, 9 aa, Homo Sapiens
LINAEVKSA

SEQ ID NO: 1329462 - protein, 9 aa, Homo Sapiens
LSRIVFCHL

SEQ ID NO: 1329463 - protein, 9 aa, Homo Sapiens
YIEYVIRGE

SEQ ID NO: 1329464 - protein, 9 aa, Homo Sapiens
CLLPTGTYK

SEQ ID NO: 1329465 - protein, 9 aa, Homo Sapiens
KTYSTKDQQ

SEQ ID NO: 1329466 - protein, 9 aa, Homo Sapiens
FLLVTLVIV

SEQ ID NO: 1329467 - protein, 9 aa, Homo Sapiens
WHRTQYEPL

SEQ ID NO: 1329468 - protein, 9 aa, Homo Sapiens
NPGDHIQSS

SEQ ID NO: 1329469 - protein, 9 aa, Homo Sapiens
QDLMRHQEE

SEQ ID NO: 1329470 - protein, 9 aa, Homo Sapiens
ALHSKLQSQ

SEQ ID NO: 1329471 - protein, 9 aa, Homo Sapiens
LSVLWDPTI

SEQ ID NO: 1329472 - protein, 9 aa, Homo Sapiens
YYVSCCLQP

SEQ ID NO: 1329473 - protein, 9 aa, Homo Sapiens
ARAYGRSRS

SEQ ID NO: 1329474 - protein, 9 aa, Homo Sapiens
YKHFKVTTM

SEQ ID NO: 1329475 - protein, 9 aa, Homo Sapiens
TEAGFPEQV

SEQ ID NO: 1329476 - protein, 9 aa, Homo Sapiens
LDLCFKNGI

SEQ ID NO: 1329477 - protein, 9 aa, Homo Sapiens
YWLNFYIQS

SEQ ID NO: 1329478 - protein, 9 aa, Homo Sapiens
YTLPSLCRL

SEQ ID NO: 1329479 - protein, 9 aa, Homo Sapiens
IPSKVTKKY

SEQ ID NO: 1329480 - protein, 9 aa, Homo Sapiens
GVDGAWGQW

SEQ ID NO: 1329481 - protein, 9 aa, Homo Sapiens
EAAEQKVTH

SEQ ID NO: 1329482 - protein, 9 aa, Homo Sapiens
GPFPACLKV

SEQ ID NO: 1329483 - protein, 9 aa, Homo Sapiens
CVLLLLHLS

SEQ ID NO: 1329484 - protein, 9 aa, Homo Sapiens
NPTTKTTDD

SEQ ID NO: 1329485 - protein, 9 aa, Homo Sapiens
FPTSAISSP

SEQ ID NO: 1329486 - protein, 9 aa, Homo Sapiens
MMIYLLPRC

SEQ ID NO: 1329487 - protein, 9 aa, Homo Sapiens
NVTALPLPD

SEQ ID NO: 1329488 - protein, 9 aa, Homo Sapiens
KQCTLAALR

SEQ ID NO: 1329489 - protein, 9 aa, Homo Sapiens
AAGSVTDLT

SEQ ID NO: 1329490 - protein, 9 aa, Homo Sapiens
KIDVKMPFV

SEQ ID NO: 1329491 - protein, 9 aa, Homo Sapiens
TVDKAFLTS

SEQ ID NO: 1329492 - protein, 9 aa, Homo Sapiens
DCCLGYTDH

SEQ ID NO: 1329493 - protein, 9 aa, Homo Sapiens
CFRSCKPWA

SEQ ID NO: 1329494 - protein, 9 aa, Homo Sapiens
WGENDTFME

SEQ ID NO: 1329495 - protein, 9 aa, Homo Sapiens
SISSLKAVT

SEQ ID NO: 1329496 - protein, 9 aa, Homo Sapiens
GKKWNLFPR

SEQ ID NO: 1329497 - protein, 9 aa, Homo Sapiens
CAFNLMFGA

SEQ ID NO: 1329498 - protein, 9 aa, Homo Sapiens
LANGTNVLS

SEQ ID NO: 1329499 - protein, 9 aa, Homo Sapiens
PPSITPSSE

SEQ ID NO: 1329500 - protein, 9 aa, Homo Sapiens
SGKKCRLTI

SEQ ID NO: 1329501 - protein, 9 aa, Homo Sapiens
AFSGRILHQ

SEQ ID NO: 1329502 - protein, 9 aa, Homo Sapiens
SDTLNKLKI

SEQ ID NO: 1329503 - protein, 9 aa, Homo Sapiens
DALLSSHDN

SEQ ID NO: 1329504 - protein, 9 aa, Homo Sapiens
HLPPTHHPI

SEQ ID NO: 1329505 - protein, 9 aa, Homo Sapiens
VAPKGISQL

SEQ ID NO: 1329506 - protein, 9 aa, Homo Sapiens
QIRKLKSIL

SEQ ID NO: 1329507 - protein, 9 aa, Homo Sapiens
CLLRRTLMR

SEQ ID NO: 1329508 - protein, 9 aa, Homo Sapiens
EKCTALSVR

SEQ ID NO: 1329509 - protein, 9 aa, Homo Sapiens
KKIPSNNIT

SEQ ID NO: 1329510 - protein, 9 aa, Homo Sapiens
PVQQPGHIL

SEQ ID NO: 1329511 - protein, 9 aa, Homo Sapiens
SPVEEHCGD

SEQ ID NO: 1329512 - protein, 9 aa, Homo Sapiens
SVDKAHGDA

SEQ ID NO: 1329513 - protein, 9 aa, Homo Sapiens
PEPHFTLDG

SEQ ID NO: 1329514 - protein, 9 aa, Homo Sapiens
GKSNNLVLS

SEQ ID NO: 1329515 - protein, 9 aa, Homo Sapiens
MVEYITHSC

SEQ ID NO: 1329516 - protein, 9 aa, Homo Sapiens
KADETTAKT

SEQ ID NO: 1329517 - protein, 9 aa, Homo Sapiens
SNGYHTLSQ

SEQ ID NO: 1329518 - protein, 9 aa, Homo Sapiens
HYLYIAPIF

SEQ ID NO: 1329519 - protein, 9 aa, Homo Sapiens
CIACSYGQI

SEQ ID NO: 1329520 - protein, 9 aa, Homo Sapiens
SEARASDLL

SEQ ID NO: 1329521 - protein, 9 aa, Homo Sapiens
RLESEMVFN

SEQ ID NO: 1329522 - protein, 9 aa, Homo Sapiens
LFFADISSI

SEQ ID NO: 1329523 - protein, 9 aa, Homo Sapiens
DVEKEKKVQ

SEQ ID NO: 1329524 - protein, 9 aa, Homo Sapiens
QELHSQLAE

SEQ ID NO: 1329525 - protein, 9 aa, Homo Sapiens
LGLGIGLCG

SEQ ID NO: 1329526 - protein, 9 aa, Homo Sapiens
LRVGAICFG

SEQ ID NO: 1329527 - protein, 9 aa, Homo Sapiens
YTGQMTPKN

SEQ ID NO: 1329528 - protein, 9 aa, Homo Sapiens
LGLEGSVMS

SEQ ID NO: 1329529 - protein, 9 aa, Homo Sapiens
ETTKDSLPM

SEQ ID NO: 1329530 - protein, 9 aa, Homo Sapiens
CDKYNTQPV

SEQ ID NO: 1329531 - protein, 9 aa, Homo Sapiens
CPEEVKKPP

SEQ ID NO: 1329532 - protein, 9 aa, Homo Sapiens
NRSFLVFIR

SEQ ID NO: 1329533 - protein, 9 aa, Homo Sapiens
ELNMMKFFF

SEQ ID NO: 1329534 - protein, 9 aa, Homo Sapiens
MVNLLLGKC

SEQ ID NO: 1329535 - protein, 9 aa, Homo Sapiens
NALIQRLEA

SEQ ID NO: 1329536 - protein, 9 aa, Homo Sapiens
VSIRCQAIK

SEQ ID NO: 1329537 - protein, 9 aa, Homo Sapiens
SSATKMCIL

SEQ ID NO: 1329538 - protein, 9 aa, Homo Sapiens
DDVVAKRTH

SEQ ID NO: 1329539 - protein, 9 aa, Homo Sapiens
QLRGNQLIY

SEQ ID NO: 1329540 - protein, 9 aa, Homo Sapiens
FYGGLDDQL

SEQ ID NO: 1329541 - protein, 9 aa, Homo Sapiens
PPQPKLVSH

SEQ ID NO: 1329542 - protein, 9 aa, Homo Sapiens
SSKSDEGRT

SEQ ID NO: 1329543 - protein, 9 aa, Homo Sapiens
PNFVTAMMS

SEQ ID NO: 1329544 - protein, 9 aa, Homo Sapiens
NNVPKFGSP

SEQ ID NO: 1329545 - protein, 9 aa, Homo Sapiens
GKIECLPLE

SEQ ID NO: 1329546 - protein, 9 aa, Homo Sapiens
RGKKQSPLI

SEQ ID NO: 1329547 - protein, 9 aa, Homo Sapiens
SQLRVGHPN

SEQ ID NO: 1329548 - protein, 9 aa, Homo Sapiens
DHAPQNSNP

SEQ ID NO: 1329549 - protein, 9 aa, Homo Sapiens
SNTTRGFIC

SEQ ID NO: 1329550 - protein, 9 aa, Homo Sapiens
NGRFNEKHN

SEQ ID NO: 1329551 - protein, 9 aa, Homo Sapiens
FNFFIHNLD

SEQ ID NO: 1329552 - protein, 9 aa, Homo Sapiens
HVLPGSAAT

SEQ ID NO: 1329553 - protein, 9 aa, Homo Sapiens
KKLVKISEI

SEQ ID NO: 1329554 - protein, 9 aa, Homo Sapiens
EMTLKDDRQ

SEQ ID NO: 1329555 - protein, 9 aa, Homo Sapiens
NATIPAYHL

SEQ ID NO: 1329556 - protein, 9 aa, Homo Sapiens
YLRVPCPAQ

SEQ ID NO: 1329557 - protein, 9 aa, Homo Sapiens
LPFSPLCDH

SEQ ID NO: 1329558 - protein, 9 aa, Homo Sapiens
SKGLPVRQD

SEQ ID NO: 1329559 - protein, 9 aa, Homo Sapiens
PKTNVTSPG

SEQ ID NO: 1329560 - protein, 9 aa, Homo Sapiens
TSVSLHFCT

SEQ ID NO: 1329561 - protein, 9 aa, Homo Sapiens
PTTTGSAHT

SEQ ID NO: 1329562 - protein, 9 aa, Homo Sapiens
GDDNWANYN

SEQ ID NO: 1329563 - protein, 9 aa, Homo Sapiens
ANPHPFTCS

SEQ ID NO: 1329564 - protein, 9 aa, Homo Sapiens
NNSPTLHIG

SEQ ID NO: 1329565 - protein, 9 aa, Homo Sapiens
ESGHIAHIP

SEQ ID NO: 1329566 - protein, 9 aa, Homo Sapiens
GRDRSPLCR

SEQ ID NO: 1329567 - protein, 9 aa, Homo Sapiens
KASILKDQW

SEQ ID NO: 1329568 - protein, 9 aa, Homo Sapiens
FNILQKSGK

SEQ ID NO: 1329569 - protein, 9 aa, Homo Sapiens
VNSLVEVHR

SEQ ID NO: 1329570 - protein, 9 aa, Homo Sapiens
EACSNGVLI

SEQ ID NO: 1329571 - protein, 9 aa, Homo Sapiens
CVAMSHKIG

SEQ ID NO: 1329572 - protein, 9 aa, Homo Sapiens
AGSLDEDEE

SEQ ID NO: 1329573 - protein, 9 aa, Homo Sapiens
PKHVGFVTI

SEQ ID NO: 1329574 - protein, 9 aa, Homo Sapiens
YGLMKVGAL

SEQ ID NO: 1329575 - protein, 9 aa, Homo Sapiens
NGTPACEVL

SEQ ID NO: 1329576 - protein, 9 aa, Homo Sapiens
DSLRYSSGY

SEQ ID NO: 1329577 - protein, 9 aa, Homo Sapiens
TFTPESQRR

SEQ ID NO: 1329578 - protein, 9 aa, Homo Sapiens
EKKNFCDKA

SEQ ID NO: 1329579 - protein, 9 aa, Homo Sapiens
TVKQSGEIL

SEQ ID NO: 1329580 - protein, 9 aa, Homo Sapiens
LIHHCAKYV

SEQ ID NO: 1329581 - protein, 9 aa, Homo Sapiens
QMCLVLIIY

SEQ ID NO: 1329582 - protein, 9 aa, Homo Sapiens
PCTVLRPSG

SEQ ID NO: 1329583 - protein, 9 aa, Homo Sapiens
LPHCSEMVP

SEQ ID NO: 1329584 - protein, 9 aa, Homo Sapiens
TLFFFVFTH

SEQ ID NO: 1329585 - protein, 9 aa, Homo Sapiens
PHYNYYVTL

SEQ ID NO: 1329586 - protein, 9 aa, Homo Sapiens
VTHLVGPVM

SEQ ID NO: 1329587 - protein, 9 aa, Homo Sapiens
RQKKIFFKA

SEQ ID NO: 1329588 - protein, 9 aa, Homo Sapiens
QRKGEKMGH

SEQ ID NO: 1329589 - protein, 9 aa, Homo Sapiens
SKAYGERYI

SEQ ID NO: 1329590 - protein, 9 aa, Homo Sapiens
KKQTLEGKA

SEQ ID NO: 1329591 - protein, 9 aa, Homo Sapiens
DFEEMKHEE

SEQ ID NO: 1329592 - protein, 9 aa, Homo Sapiens
WATLQVLYQ

SEQ ID NO: 1329593 - protein, 9 aa, Homo Sapiens
TSRFGGSTH

SEQ ID NO: 1329594 - protein, 9 aa, Homo Sapiens
HFRKILISL

SEQ ID NO: 1329595 - protein, 9 aa, Homo Sapiens
CCLVVPLLA

SEQ ID NO: 1329596 - protein, 9 aa, Homo Sapiens
HVDRFAWDT

SEQ ID NO: 1329597 - protein, 9 aa, Homo Sapiens
HCPGMPLER

SEQ ID NO: 1329598 - protein, 9 aa, Homo Sapiens
ERIKNNDSK

SEQ ID NO: 1329599 - protein, 9 aa, Homo Sapiens
QVIQPERVL

SEQ ID NO: 1329600 - protein, 9 aa, Homo Sapiens
LMFPTPFVH

SEQ ID NO: 1329601 - protein, 9 aa, Homo Sapiens
PRLESEMVF

SEQ ID NO: 1329602 - protein, 9 aa, Homo Sapiens
IAIFQIAAN

SEQ ID NO: 1329603 - protein, 9 aa, Homo Sapiens
EIILMKACV

SEQ ID NO: 1329604 - protein, 9 aa, Homo Sapiens
VDDDDGDDL

SEQ ID NO: 1329605 - protein, 9 aa, Homo Sapiens
RYLAHRKMH

SEQ ID NO: 1329606 - protein, 9 aa, Homo Sapiens
EDFPPHIVE

SEQ ID NO: 1329607 - protein, 9 aa, Homo Sapiens
ARSPSSATS

SEQ ID NO: 1329608 - protein, 9 aa, Homo Sapiens
DKRTLKQFE

SEQ ID NO: 1329609 - protein, 9 aa, Homo Sapiens
CCPFVQENQ

SEQ ID NO: 1329610 - protein, 9 aa, Homo Sapiens
LSGGQKQRM

SEQ ID NO: 1329611 - protein, 9 aa, Homo Sapiens
FLLLKWRFH

SEQ ID NO: 1329612 - protein, 9 aa, Homo Sapiens
RVIARLAVH

SEQ ID NO: 1329613 - protein, 9 aa, Homo Sapiens
TPLAEHCFS

SEQ ID NO: 1329614 - protein, 9 aa, Homo Sapiens
RDKTRWTHN

SEQ ID NO: 1329615 - protein, 9 aa, Homo Sapiens
GTPIITFPE

SEQ ID NO: 1329616 - protein, 9 aa, Homo Sapiens
SPRSHFEQW

SEQ ID NO: 1329617 - protein, 9 aa, Homo Sapiens
MGNSSAEDE

SEQ ID NO: 1329618 - protein, 9 aa, Homo Sapiens
WKADPGMTD

SEQ ID NO: 1329619 - protein, 9 aa, Homo Sapiens
RRWRMSTWP

SEQ ID NO: 1329620 - protein, 9 aa, Homo Sapiens
DASIIKGDF

SEQ ID NO: 1329621 - protein, 9 aa, Homo Sapiens
SLVKEGGDR

SEQ ID NO: 1329622 - protein, 9 aa, Homo Sapiens
PLEKAQLKT

SEQ ID NO: 1329623 - protein, 9 aa, Homo Sapiens
GPTFQAENS

SEQ ID NO: 1329624 - protein, 9 aa, Homo Sapiens
MSPTSSFIT

SEQ ID NO: 1329625 - protein, 9 aa, Homo Sapiens
LYEDTLIDE

SEQ ID NO: 1329626 - protein, 9 aa, Homo Sapiens
PTLMSLAKQ

SEQ ID NO: 1329627 - protein, 9 aa, Homo Sapiens
IEATKHCNS

SEQ ID NO: 1329628 - protein, 9 aa, Homo Sapiens
LMWLYQLSK

SEQ ID NO: 1329629 - protein, 9 aa, Homo Sapiens
QQDINYQEL

SEQ ID NO: 1329630 - protein, 9 aa, Homo Sapiens
TKWYISPRL

SEQ ID NO: 1329631 - protein, 9 aa, Homo Sapiens
EGFKEVVQY

SEQ ID NO: 1329632 - protein, 9 aa, Homo Sapiens
RGTNPNLRN

SEQ ID NO: 1329633 - protein, 9 aa, Homo Sapiens
GECSPHKNP

SEQ ID NO: 1329634 - protein, 9 aa, Homo Sapiens
KCWTSHQDA

SEQ ID NO: 1329635 - protein, 9 aa, Homo Sapiens
NGQDPIKGQ

SEQ ID NO: 1329636 - protein, 9 aa, Homo Sapiens
THTTPAVEQ

SEQ ID NO: 1329637 - protein, 9 aa, Homo Sapiens
ECLRQRAPH

SEQ ID NO: 1329638 - protein, 9 aa, Homo Sapiens
GLSRAWRPH

SEQ ID NO: 1329639 - protein, 9 aa, Homo Sapiens
EADLNHKFN

SEQ ID NO: 1329640 - protein, 9 aa, Homo Sapiens
EVGLPAEVY

SEQ ID NO: 1329641 - protein, 9 aa, Homo Sapiens
YKDGKVLHT

SEQ ID NO: 1329642 - protein, 9 aa, Homo Sapiens
SVLSKTKET

SEQ ID NO: 1329643 - protein, 9 aa, Homo Sapiens
IYIRSKASY

SEQ ID NO: 1329644 - protein, 9 aa, Homo Sapiens
LQNIHLRGE

SEQ ID NO: 1329645 - protein, 9 aa, Homo Sapiens
EKPVRALLG

SEQ ID NO: 1329646 - protein, 9 aa, Homo Sapiens
QFKSHIYFF

SEQ ID NO: 1329647 - protein, 9 aa, Homo Sapiens
IRDLVFMEG

SEQ ID NO: 1329648 - protein, 9 aa, Homo Sapiens
EEWRLHSVQ

SEQ ID NO: 1329649 - protein, 9 aa, Homo Sapiens
DWPNLVDAA

SEQ ID NO: 1329650 - protein, 9 aa, Homo Sapiens
GKAFRLCQK

SEQ ID NO: 1329651 - protein, 9 aa, Homo Sapiens
CMHILVRCI

SEQ ID NO: 1329652 - protein, 9 aa, Homo Sapiens
RPNTYFRPI

SEQ ID NO: 1329653 - protein, 9 aa, Homo Sapiens
RGKSVRLRL

SEQ ID NO: 1329654 - protein, 9 aa, Homo Sapiens
SEEPWSAQL

SEQ ID NO: 1329655 - protein, 9 aa, Homo Sapiens
ADGYQCCMM

SEQ ID NO: 1329656 - protein, 9 aa, Homo Sapiens
THSCDVVTE

SEQ ID NO: 1329657 - protein, 9 aa, Homo Sapiens
TFGSGSNLT

SEQ ID NO: 1329658 - protein, 9 aa, Homo Sapiens
TVAHELGHM

SEQ ID NO: 1329659 - protein, 9 aa, Homo Sapiens
DDCFSLRHC

SEQ ID NO: 1329660 - protein, 9 aa, Homo Sapiens
FGIIAWPFI

SEQ ID NO: 1329661 - protein, 9 aa, Homo Sapiens
TFLTLELSY

SEQ ID NO: 1329662 - protein, 9 aa, Homo Sapiens
FHPSIKTHD

SEQ ID NO: 1329663 - protein, 9 aa, Homo Sapiens
MDIQKQIHK

SEQ ID NO: 1329664 - protein, 9 aa, Homo Sapiens
EKHNQAKEK

SEQ ID NO: 1329665 - protein, 9 aa, Homo Sapiens
LKGLAPGTN

SEQ ID NO: 1329666 - protein, 9 aa, Homo Sapiens
ILSLSVPPR

SEQ ID NO: 1329667 - protein, 9 aa, Homo Sapiens
ARAQNSSGT

SEQ ID NO: 1329668 - protein, 9 aa, Homo Sapiens
TVSQYVQAV

SEQ ID NO: 1329669 - protein, 9 aa, Homo Sapiens
YDVSSLPLP

SEQ ID NO: 1329670 - protein, 9 aa, Homo Sapiens
RNVGRCSTG

SEQ ID NO: 1329671 - protein, 9 aa, Homo Sapiens
ENFDVDGRM

SEQ ID NO: 1329672 - protein, 9 aa, Homo Sapiens
QRRQNQCRF

SEQ ID NO: 1329673 - protein, 9 aa, Homo Sapiens
PFQFSAPGV

SEQ ID NO: 1329674 - protein, 9 aa, Homo Sapiens
EVSNYWMNV

SEQ ID NO: 1329675 - protein, 9 aa, Homo Sapiens
DMWPHSDPY

SEQ ID NO: 1329676 - protein, 9 aa, Homo Sapiens
YKCETCGKM

SEQ ID NO: 1329677 - protein, 9 aa, Homo Sapiens
NGQNLGHYW

SEQ ID NO: 1329678 - protein, 9 aa, Homo Sapiens
PTNSTGKFC

SEQ ID NO: 1329679 - protein, 9 aa, Homo Sapiens
RLPRCVCST

SEQ ID NO: 1329680 - protein, 9 aa, Homo Sapiens
EVLISDIND

SEQ ID NO: 1329681 - protein, 9 aa, Homo Sapiens
PVMVKRKWT

SEQ ID NO: 1329682 - protein, 9 aa, Homo Sapiens
RMGAVAHAC

SEQ ID NO: 1329683 - protein, 9 aa, Homo Sapiens
LLCQCDKKR

SEQ ID NO: 1329684 - protein, 9 aa, Homo Sapiens
PSRGENVAQ

SEQ ID NO: 1329685 - protein, 9 aa, Homo Sapiens
LSCLPEPPL

SEQ ID NO: 1329686 - protein, 9 aa, Homo Sapiens
KAKRVKVQD

SEQ ID NO: 1329687 - protein, 9 aa, Homo Sapiens
QVSSSRTVH

SEQ ID NO: 1329688 - protein, 9 aa, Homo Sapiens
LDVLMAATH

SEQ ID NO: 1329689 - protein, 9 aa, Homo Sapiens
IIITLLDPR

SEQ ID NO: 1329690 - protein, 9 aa, Homo Sapiens
PVLHEELLH

SEQ ID NO: 1329691 - protein, 9 aa, Homo Sapiens
ARTGRCVSA

SEQ ID NO: 1329692 - protein, 9 aa, Homo Sapiens
KELNTRPME

SEQ ID NO: 1329693 - protein, 9 aa, Homo Sapiens
SANNIVWLL

SEQ ID NO: 1329694 - protein, 9 aa, Homo Sapiens
TTLNRLDQH

SEQ ID NO: 1329695 - protein, 9 aa, Homo Sapiens
LGLGPQPMV

SEQ ID NO: 1329696 - protein, 9 aa, Homo Sapiens
GLWVVVSDA

SEQ ID NO: 1329697 - protein, 9 aa, Homo Sapiens
FVLVNLEVT

SEQ ID NO: 1329698 - protein, 9 aa, Homo Sapiens
DGVLAWGTF

SEQ ID NO: 1329699 - protein, 9 aa, Homo Sapiens
ALLRGLGLQ

SEQ ID NO: 1329700 - protein, 9 aa, Homo Sapiens
LHRLAASLS

SEQ ID NO: 1329701 - protein, 9 aa, Homo Sapiens
LLDGTFKLS

SEQ ID NO: 1329702 - protein, 9 aa, Homo Sapiens
CIPRGDCLN

SEQ ID NO: 1329703 - protein, 9 aa, Homo Sapiens
RSLALAMSQ

SEQ ID NO: 1329704 - protein, 9 aa, Homo Sapiens
PVTPEAIKS

SEQ ID NO: 1329705 - protein, 9 aa, Homo Sapiens
SVTESIQVC

SEQ ID NO: 1329706 - protein, 9 aa, Homo Sapiens
TQTEPRNHQ

SEQ ID NO: 1329707 - protein, 9 aa, Homo Sapiens
TGTCAEKLK

SEQ ID NO: 1329708 - protein, 9 aa, Homo Sapiens
AINFLICED

SEQ ID NO: 1329709 - protein, 9 aa, Homo Sapiens
GAHSPAHRS

SEQ ID NO: 1329710 - protein, 9 aa, Homo Sapiens
TERDASHLI

SEQ ID NO: 1329711 - protein, 9 aa, Homo Sapiens
APGHISTSP

SEQ ID NO: 1329712 - protein, 9 aa, Homo Sapiens
TCSVEDPTK

SEQ ID NO: 1329713 - protein, 9 aa, Homo Sapiens
PRQVREHVL

SEQ ID NO: 1329714 - protein, 9 aa, Homo Sapiens
LQSAFLHHI

SEQ ID NO: 1329715 - protein, 9 aa, Homo Sapiens
LCCALCIGG

SEQ ID NO: 1329716 - protein, 9 aa, Homo Sapiens
SPCCIITST

SEQ ID NO: 1329717 - protein, 9 aa, Homo Sapiens
MDGNWRWGS

SEQ ID NO: 1329718 - protein, 9 aa, Homo Sapiens
LEQLEGKHS

SEQ ID NO: 1329719 - protein, 9 aa, Homo Sapiens
RQEDVATAR

SEQ ID NO: 1329720 - protein, 9 aa, Homo Sapiens
HFDENLTGC

SEQ ID NO: 1329721 - protein, 9 aa, Homo Sapiens
MDYKYLHWQ

SEQ ID NO: 1329722 - protein, 9 aa, Homo Sapiens
PRIHVRSRG

SEQ ID NO: 1329723 - protein, 9 aa, Homo Sapiens
DEREYHADG

SEQ ID NO: 1329724 - protein, 9 aa, Homo Sapiens
LLYLQPYNS

SEQ ID NO: 1329725 - protein, 9 aa, Homo Sapiens
PKMMKKFLH

SEQ ID NO: 1329726 - protein, 9 aa, Homo Sapiens
LPAMKWPRL

SEQ ID NO: 1329727 - protein, 9 aa, Homo Sapiens
SYVGCVISA

SEQ ID NO: 1329728 - protein, 9 aa, Homo Sapiens
ITDKPYVPL

SEQ ID NO: 1329729 - protein, 9 aa, Homo Sapiens
QIWRGQQRP

SEQ ID NO: 1329730 - protein, 9 aa, Homo Sapiens
KDLGSQPCV

SEQ ID NO: 1329731 - protein, 9 aa, Homo Sapiens
DSCWQTSND

SEQ ID NO: 1329732 - protein, 9 aa, Homo Sapiens
VRVCGRPLM

SEQ ID NO: 1329733 - protein, 9 aa, Homo Sapiens
TCSVLGCAK

SEQ ID NO: 1329734 - protein, 9 aa, Homo Sapiens
KSKKTKLLL

SEQ ID NO: 1329735 - protein, 9 aa, Homo Sapiens
DNEAIYDIY

SEQ ID NO: 1329736 - protein, 9 aa, Homo Sapiens
LPVRQPTQL

SEQ ID NO: 1329737 - protein, 9 aa, Homo Sapiens
SLSREAIAA

SEQ ID NO: 1329738 - protein, 9 aa, Homo Sapiens
IRHGSRCYG

SEQ ID NO: 1329739 - protein, 9 aa, Homo Sapiens
LHAGGVGLC

SEQ ID NO: 1329740 - protein, 9 aa, Homo Sapiens
CTHCLCTVE

SEQ ID NO: 1329741 - protein, 9 aa, Homo Sapiens
GFTVLSAES

SEQ ID NO: 1329742 - protein, 9 aa, Homo Sapiens
RHPVYESDK

SEQ ID NO: 1329743 - protein, 9 aa, Homo Sapiens
SGKMNLNWP

SEQ ID NO: 1329744 - protein, 9 aa, Homo Sapiens
SHLVHHQRV

SEQ ID NO: 1329745 - protein, 9 aa, Homo Sapiens
RNICLLTIL

SEQ ID NO: 1329746 - protein, 9 aa, Homo Sapiens
QKSIILLKV

SEQ ID NO: 1329747 - protein, 9 aa, Homo Sapiens
VDGVASSCH

SEQ ID NO: 1329748 - protein, 9 aa, Homo Sapiens
LYTGLVNGA

SEQ ID NO: 1329749 - protein, 9 aa, Homo Sapiens
AVHGRTAKD

SEQ ID NO: 1329750 - protein, 9 aa, Homo Sapiens
LHRLHMHGP

SEQ ID NO: 1329751 - protein, 9 aa, Homo Sapiens
TGCLVTGLD

SEQ ID NO: 1329752 - protein, 9 aa, Homo Sapiens
RDLAFLRAK

SEQ ID NO: 1329753 - protein, 9 aa, Homo Sapiens
LGLKCGGTI

SEQ ID NO: 1329754 - protein, 9 aa, Homo Sapiens
VDLHRLHMH

SEQ ID NO: 1329755 - protein, 9 aa, Homo Sapiens
IALPHCSEM

SEQ ID NO: 1329756 - protein, 9 aa, Homo Sapiens
SDSDQPLNS

SEQ ID NO: 1329757 - protein, 9 aa, Homo Sapiens
VLPMNTGVD

SEQ ID NO: 1329758 - protein, 9 aa, Homo Sapiens
ANGEILPTP

SEQ ID NO: 1329759 - protein, 9 aa, Homo Sapiens
YVDSRSYYG

SEQ ID NO: 1329760 - protein, 9 aa, Homo Sapiens
RKDLEIMQI

SEQ ID NO: 1329761 - protein, 9 aa, Homo Sapiens
PTTQNSPLD

SEQ ID NO: 1329762 - protein, 9 aa, Homo Sapiens
SHRKPTSDE

SEQ ID NO: 1329763 - protein, 9 aa, Homo Sapiens
IMVSGFGPL

SEQ ID NO: 1329764 - protein, 9 aa, Homo Sapiens
QFMTVYKLN

SEQ ID NO: 1329765 - protein, 9 aa, Homo Sapiens
DTADAVHPF

SEQ ID NO: 1329766 - protein, 9 aa, Homo Sapiens
PTFRDRLIF

SEQ ID NO: 1329767 - protein, 9 aa, Homo Sapiens
QPPILGYGA

SEQ ID NO: 1329768 - protein, 9 aa, Homo Sapiens
QEMLLMYQL

SEQ ID NO: 1329769 - protein, 9 aa, Homo Sapiens
PASTPLMLW

SEQ ID NO: 1329770 - protein, 9 aa, Homo Sapiens
NYNDDLAET

SEQ ID NO: 1329771 - protein, 9 aa, Homo Sapiens
IQMEKYACQ

SEQ ID NO: 1329772 - protein, 9 aa, Homo Sapiens
ECGNIFKSS

SEQ ID NO: 1329773 - protein, 9 aa, Homo Sapiens
NDYFTEMQL

SEQ ID NO: 1329774 - protein, 9 aa, Homo Sapiens
CNSEEMWRR

SEQ ID NO: 1329775 - protein, 9 aa, Homo Sapiens
GKWKGTANA

SEQ ID NO: 1329776 - protein, 9 aa, Homo Sapiens
ASEPGLFVV

SEQ ID NO: 1329777 - protein, 9 aa, Homo Sapiens
SQGHLGPGR

SEQ ID NO: 1329778 - protein, 9 aa, Homo Sapiens
THEMPHTRE

SEQ ID NO: 1329779 - protein, 9 aa, Homo Sapiens
FSLKKFVYA

SEQ ID NO: 1329780 - protein, 9 aa, Homo Sapiens
TDEQTRITL

SEQ ID NO: 1329781 - protein, 9 aa, Homo Sapiens
IYKDRSNNQ

SEQ ID NO: 1329782 - protein, 9 aa, Homo Sapiens
SSVLQNIHL

SEQ ID NO: 1329783 - protein, 9 aa, Homo Sapiens
YPCSEEISD

SEQ ID NO: 1329784 - protein, 9 aa, Homo Sapiens
RTILVLVAL

SEQ ID NO: 1329785 - protein, 9 aa, Homo Sapiens
VRFTLRRME

SEQ ID NO: 1329786 - protein, 9 aa, Homo Sapiens
PYLYLRLTS

SEQ ID NO: 1329787 - protein, 9 aa, Homo Sapiens
WKLDKRTKV

SEQ ID NO: 1329788 - protein, 9 aa, Homo Sapiens
VTMVTRGHQ

SEQ ID NO: 1329789 - protein, 9 aa, Homo Sapiens
IHCKAGKGQ

SEQ ID NO: 1329790 - protein, 9 aa, Homo Sapiens
PVQPPHDSA

SEQ ID NO: 1329791 - protein, 9 aa, Homo Sapiens
QAQRPGPPH

SEQ ID NO: 1329792 - protein, 9 aa, Homo Sapiens
YLPMAQSAA

SEQ ID NO: 1329793 - protein, 9 aa, Homo Sapiens
LEECWAMRS

SEQ ID NO: 1329794 - protein, 9 aa, Homo Sapiens
NEAGRERRA

SEQ ID NO: 1329795 - protein, 9 aa, Homo Sapiens
TDCILFGLM

SEQ ID NO: 1329796 - protein, 9 aa, Homo Sapiens
IEHMVEARL

SEQ ID NO: 1329797 - protein, 9 aa, Homo Sapiens
SDFPYLGTF

SEQ ID NO: 1329798 - protein, 9 aa, Homo Sapiens
FASIPGCIV

SEQ ID NO: 1329799 - protein, 9 aa, Homo Sapiens
LIEAVTVSW

SEQ ID NO: 1329800 - protein, 9 aa, Homo Sapiens
SDYPCLPPP

SEQ ID NO: 1329801 - protein, 9 aa, Homo Sapiens
IKYYQHLYI

SEQ ID NO: 1329802 - protein, 9 aa, Homo Sapiens
KVQTDVTMK

SEQ ID NO: 1329803 - protein, 9 aa, Homo Sapiens
GTLNLEDIF

SEQ ID NO: 1329804 - protein, 9 aa, Homo Sapiens
EEAAKWNQV

SEQ ID NO: 1329805 - protein, 9 aa, Homo Sapiens
DKTTSVLEH

SEQ ID NO: 1329806 - protein, 9 aa, Homo Sapiens
RGCLRWMRQ

SEQ ID NO: 1329807 - protein, 9 aa, Homo Sapiens
SQSSVQHQL

SEQ ID NO: 1329808 - protein, 9 aa, Homo Sapiens
WAVAWVIPV

SEQ ID NO: 1329809 - protein, 9 aa, Homo Sapiens
SREPKSKSP

SEQ ID NO: 1329810 - protein, 9 aa, Homo Sapiens
ASNHNGASC

SEQ ID NO: 1329811 - protein, 9 aa, Homo Sapiens
ACSPLWSLQ

SEQ ID NO: 1329812 - protein, 9 aa, Homo Sapiens
PQHKMLCLR

SEQ ID NO: 1329813 - protein, 9 aa, Homo Sapiens
FSPTRTRLA

SEQ ID NO: 1329814 - protein, 9 aa, Homo Sapiens
LDRGAGLHR

SEQ ID NO: 1329815 - protein, 9 aa, Homo Sapiens
QMSKDVIIS

SEQ ID NO: 1329816 - protein, 9 aa, Homo Sapiens
PPTSLVVWH

SEQ ID NO: 1329817 - protein, 9 aa, Homo Sapiens
TVPAEAPVP

SEQ ID NO: 1329818 - protein, 9 aa, Homo Sapiens
CGCESPNLN

SEQ ID NO: 1329819 - protein, 9 aa, Homo Sapiens
EREQRLLLI

SEQ ID NO: 1329820 - protein, 9 aa, Homo Sapiens
MSCNRIAEN

SEQ ID NO: 1329821 - protein, 9 aa, Homo Sapiens
VSMTFITVL

SEQ ID NO: 1329822 - protein, 9 aa, Homo Sapiens
SEAPGGQVT

SEQ ID NO: 1329823 - protein, 9 aa, Homo Sapiens
QDFLDTYNK

SEQ ID NO: 1329824 - protein, 9 aa, Homo Sapiens
GCQAQRACC

SEQ ID NO: 1329825 - protein, 9 aa, Homo Sapiens
TTSDTSLWT

SEQ ID NO: 1329826 - protein, 9 aa, Homo Sapiens
DCSERASIC

SEQ ID NO: 1329827 - protein, 9 aa, Homo Sapiens
NEWLLCPIR

SEQ ID NO: 1329828 - protein, 9 aa, Homo Sapiens
RVKWLVVVI

SEQ ID NO: 1329829 - protein, 9 aa, Homo Sapiens
RRAGYAYRH

SEQ ID NO: 1329830 - protein, 9 aa, Homo Sapiens
DLKDYMCQA

SEQ ID NO: 1329831 - protein, 9 aa, Homo Sapiens
VPLGGLPSH

SEQ ID NO: 1329832 - protein, 9 aa, Homo Sapiens
AMAKELAIL

SEQ ID NO: 1329833 - protein, 9 aa, Homo Sapiens
ALAKEERRT

SEQ ID NO: 1329834 - protein, 9 aa, Homo Sapiens
KGEKMGHFQ

SEQ ID NO: 1329835 - protein, 9 aa, Homo Sapiens
TEYFRVPTF

SEQ ID NO: 1329836 - protein, 9 aa, Homo Sapiens
GEPVDPGPP

SEQ ID NO: 1329837 - protein, 9 aa, Homo Sapiens
RKHRRKITV

SEQ ID NO: 1329838 - protein, 9 aa, Homo Sapiens
PLVNVPSHQ

SEQ ID NO: 1329839 - protein, 9 aa, Homo Sapiens
DVYSFVIVI

SEQ ID NO: 1329840 - protein, 9 aa, Homo Sapiens
KQCTYTFGK

SEQ ID NO: 1329841 - protein, 9 aa, Homo Sapiens
ERVEYIKSF

SEQ ID NO: 1329842 - protein, 9 aa, Homo Sapiens
PEDTVTFIR

SEQ ID NO: 1329843 - protein, 9 aa, Homo Sapiens
MDHIQHHLV

SEQ ID NO: 1329844 - protein, 9 aa, Homo Sapiens
VQELRKWGS

SEQ ID NO: 1329845 - protein, 9 aa, Homo Sapiens
RAKVCLRRL

SEQ ID NO: 1329846 - protein, 9 aa, Homo Sapiens
GEEWNKVKR

SEQ ID NO: 1329847 - protein, 9 aa, Homo Sapiens
IFGKVTGET

SEQ ID NO: 1329848 - protein, 9 aa, Homo Sapiens
TFVSHVQPG

SEQ ID NO: 1329849 - protein, 9 aa, Homo Sapiens
EKQHFYSCD

SEQ ID NO: 1329850 - protein, 9 aa, Homo Sapiens
SLNDERIQA

SEQ ID NO: 1329851 - protein, 9 aa, Homo Sapiens
PACEVLPRS

SEQ ID NO: 1329852 - protein, 9 aa, Homo Sapiens
LLVTLVIVC

SEQ ID NO: 1329853 - protein, 9 aa, Homo Sapiens
SQYVQAVPL

SEQ ID NO: 1329854 - protein, 9 aa, Homo Sapiens
PCIYMVPMN

SEQ ID NO: 1329855 - protein, 9 aa, Homo Sapiens
LGLPEKDTM

SEQ ID NO: 1329856 - protein, 9 aa, Homo Sapiens
APVGHNAPK

SEQ ID NO: 1329857 - protein, 9 aa, Homo Sapiens
YEERTAKVA

SEQ ID NO: 1329858 - protein, 9 aa, Homo Sapiens
RIHHSNLVG

SEQ ID NO: 1329859 - protein, 9 aa, Homo Sapiens
EKRMVDNFH

SEQ ID NO: 1329860 - protein, 9 aa, Homo Sapiens
IWCCYVCCR

SEQ ID NO: 1329861 - protein, 9 aa, Homo Sapiens
DFIPAVRDI

SEQ ID NO: 1329862 - protein, 9 aa, Homo Sapiens
FVHRCLLAC

SEQ ID NO: 1329863 - protein, 9 aa, Homo Sapiens
APVMSWARG

SEQ ID NO: 1329864 - protein, 9 aa, Homo Sapiens
PFPYLYLRL

SEQ ID NO: 1329865 - protein, 9 aa, Homo Sapiens
NCRMFFIPL

SEQ ID NO: 1329866 - protein, 9 aa, Homo Sapiens
SNIVISVVR

SEQ ID NO: 1329867 - protein, 9 aa, Homo Sapiens
KNHQQNTIQ

SEQ ID NO: 1329868 - protein, 9 aa, Homo Sapiens
PGTPPPLIL

SEQ ID NO: 1329869 - protein, 9 aa, Homo Sapiens
TYLLGLICL

SEQ ID NO: 1329870 - protein, 9 aa, Homo Sapiens
QKLKYKVIS

SEQ ID NO: 1329871 - protein, 9 aa, Homo Sapiens
LRGYLQYLA

SEQ ID NO: 1329872 - protein, 9 aa, Homo Sapiens
IFTFDRTCT

SEQ ID NO: 1329873 - protein, 9 aa, Homo Sapiens
LNYMLLAKH

SEQ ID NO: 1329874 - protein, 9 aa, Homo Sapiens
EADAFITFA

SEQ ID NO: 1329875 - protein, 9 aa, Homo Sapiens
RVFSSFVTL

SEQ ID NO: 1329876 - protein, 9 aa, Homo Sapiens
EAAAVLMAW

SEQ ID NO: 1329877 - protein, 9 aa, Homo Sapiens
EKCTDPRGR

SEQ ID NO: 1329878 - protein, 9 aa, Homo Sapiens
GSVTDLTFK

SEQ ID NO: 1329879 - protein, 9 aa, Homo Sapiens
GWGPKQPER

SEQ ID NO: 1329880 - protein, 9 aa, Homo Sapiens
HHSSKIRMH

SEQ ID NO: 1329881 - protein, 9 aa, Homo Sapiens
CDSAQIWQH

SEQ ID NO: 1329882 - protein, 9 aa, Homo Sapiens
AVDRDTSSG

SEQ ID NO: 1329883 - protein, 9 aa, Homo Sapiens
GTVNIHTRD

SEQ ID NO: 1329884 - protein, 9 aa, Homo Sapiens
IHKKTRLLV

SEQ ID NO: 1329885 - protein, 9 aa, Homo Sapiens
CHFCYPCSL

SEQ ID NO: 1329886 - protein, 9 aa, Homo Sapiens
AVIITLVTC

SEQ ID NO: 1329887 - protein, 9 aa, Homo Sapiens
HSNINDNIY

SEQ ID NO: 1329888 - protein, 9 aa, Homo Sapiens
MSTPFLSLP

SEQ ID NO: 1329889 - protein, 9 aa, Homo Sapiens
RSSSRIRFS

SEQ ID NO: 1329890 - protein, 9 aa, Homo Sapiens
QHYKAEEGL

SEQ ID NO: 1329891 - protein, 9 aa, Homo Sapiens
LGAVNMAGM

SEQ ID NO: 1329892 - protein, 9 aa, Homo Sapiens
ECDTCGEAF

SEQ ID NO: 1329893 - protein, 9 aa, Homo Sapiens
NGVLIPGNL

SEQ ID NO: 1329894 - protein, 9 aa, Homo Sapiens
VLLSNEQKV

SEQ ID NO: 1329895 - protein, 9 aa, Homo Sapiens
AWNLLKPCC

SEQ ID NO: 1329896 - protein, 9 aa, Homo Sapiens
IIEIFYELC

SEQ ID NO: 1329897 - protein, 9 aa, Homo Sapiens
TFGLTIMVT

SEQ ID NO: 1329898 - protein, 9 aa, Homo Sapiens
RFSCSDELS

SEQ ID NO: 1329899 - protein, 9 aa, Homo Sapiens
HMLGMQHDE

SEQ ID NO: 1329900 - protein, 9 aa, Homo Sapiens
HLCLVCGDI

SEQ ID NO: 1329901 - protein, 9 aa, Homo Sapiens
GHPLPASGK

SEQ ID NO: 1329902 - protein, 9 aa, Homo Sapiens
GTLDYLSPE

SEQ ID NO: 1329903 - protein, 9 aa, Homo Sapiens
VTKLVEVMF

SEQ ID NO: 1329904 - protein, 9 aa, Homo Sapiens
PARSPSSAA

SEQ ID NO: 1329905 - protein, 9 aa, Homo Sapiens
SHRTFGHSL

SEQ ID NO: 1329906 - protein, 9 aa, Homo Sapiens
LLSSINQEE

SEQ ID NO: 1329907 - protein, 9 aa, Homo Sapiens
LDQNDPHFI

SEQ ID NO: 1329908 - protein, 9 aa, Homo Sapiens
SDEEWRSQW

SEQ ID NO: 1329909 - protein, 9 aa, Homo Sapiens
HRRSLDSLD

SEQ ID NO: 1329910 - protein, 9 aa, Homo Sapiens
SGHRDGRWA

SEQ ID NO: 1329911 - protein, 9 aa, Homo Sapiens
SQSEDGLTT

SEQ ID NO: 1329912 - protein, 9 aa, Homo Sapiens
VTLVNPFNN

SEQ ID NO: 1329913 - protein, 9 aa, Homo Sapiens
SADNLAVTD

SEQ ID NO: 1329914 - protein, 9 aa, Homo Sapiens
AQKSHFYLV

SEQ ID NO: 1329915 - protein, 9 aa, Homo Sapiens
RHTPAEEMP

SEQ ID NO: 1329916 - protein, 9 aa, Homo Sapiens
TRGFICKCP

SEQ ID NO: 1329917 - protein, 9 aa, Homo Sapiens
KPLSPVSSQ

SEQ ID NO: 1329918 - protein, 9 aa, Homo Sapiens
MQLVSDFRQ

SEQ ID NO: 1329919 - protein, 9 aa, Homo Sapiens
VSAVEPGTF

SEQ ID NO: 1329920 - protein, 9 aa, Homo Sapiens
VCKLAQSNG

SEQ ID NO: 1329921 - protein, 9 aa, Homo Sapiens
IEDTVEWRY

SEQ ID NO: 1329922 - protein, 9 aa, Homo Sapiens
TRTVSSSSE

SEQ ID NO: 1329923 - protein, 9 aa, Homo Sapiens
LYLFFCFGI

SEQ ID NO: 1329924 - protein, 9 aa, Homo Sapiens
EINLVTETR

SEQ ID NO: 1329925 - protein, 9 aa, Homo Sapiens
VSKRNSFGS

SEQ ID NO: 1329926 - protein, 9 aa, Homo Sapiens
NSLLQGYRI

SEQ ID NO: 1329927 - protein, 9 aa, Homo Sapiens
THGRWKYSS

SEQ ID NO: 1329928 - protein, 9 aa, Homo Sapiens
DGPDGSAVS

SEQ ID NO: 1329929 - protein, 9 aa, Homo Sapiens
TTELTEAGE

SEQ ID NO: 1329930 - protein, 9 aa, Homo Sapiens
CSDTDSDSP

SEQ ID NO: 1329931 - protein, 9 aa, Homo Sapiens
LLTVSVMSA

SEQ ID NO: 1329932 - protein, 9 aa, Homo Sapiens
PSQIDWVAL

SEQ ID NO: 1329933 - protein, 9 aa, Homo Sapiens
RWKPLWGVW

SEQ ID NO: 1329934 - protein, 9 aa, Homo Sapiens
AFLLALTTH

SEQ ID NO: 1329935 - protein, 9 aa, Homo Sapiens
GLFVQLIQA

SEQ ID NO: 1329936 - protein, 9 aa, Homo Sapiens
TKLLLFKEL

SEQ ID NO: 1329937 - protein, 9 aa, Homo Sapiens
VWHRGSKVL

SEQ ID NO: 1329938 - protein, 9 aa, Homo Sapiens
EEANGNTGT

SEQ ID NO: 1329939 - protein, 9 aa, Homo Sapiens
ECLKGQLCD

SEQ ID NO: 1329940 - protein, 9 aa, Homo Sapiens
AIRHSFIDG

SEQ ID NO: 1329941 - protein, 9 aa, Homo Sapiens
GCTFVKFQT

SEQ ID NO: 1329942 - protein, 9 aa, Homo Sapiens
FGYGYNSCG

SEQ ID NO: 1329943 - protein, 9 aa, Homo Sapiens
LAHVLNTHC

SEQ ID NO: 1329944 - protein, 9 aa, Homo Sapiens
MTFGLTIMV

SEQ ID NO: 1329945 - protein, 9 aa, Homo Sapiens
NPEKSISVF

SEQ ID NO: 1329946 - protein, 9 aa, Homo Sapiens
FYSMSTPFL

SEQ ID NO: 1329947 - protein, 9 aa, Homo Sapiens
HHDLIEEYH

SEQ ID NO: 1329948 - protein, 9 aa, Homo Sapiens
NTMILDLCH

SEQ ID NO: 1329949 - protein, 9 aa, Homo Sapiens
VHTGEKLYV

SEQ ID NO: 1329950 - protein, 9 aa, Homo Sapiens
DRMMRKGTT

SEQ ID NO: 1329951 - protein, 9 aa, Homo Sapiens
FSDLLVPKV

SEQ ID NO: 1329952 - protein, 9 aa, Homo Sapiens
QFQNLHQLG

SEQ ID NO: 1329953 - protein, 9 aa, Homo Sapiens
SDNGICVLA

SEQ ID NO: 1329954 - protein, 9 aa, Homo Sapiens
KPGFPKCGQ

SEQ ID NO: 1329955 - protein, 9 aa, Homo Sapiens
IFEVSQLGI

SEQ ID NO: 1329956 - protein, 9 aa, Homo Sapiens
RSSACTRST

SEQ ID NO: 1329957 - protein, 9 aa, Homo Sapiens
VSSEGKQIL

SEQ ID NO: 1329958 - protein, 9 aa, Homo Sapiens
PGCIRVVRG

SEQ ID NO: 1329959 - protein, 9 aa, Homo Sapiens
EENCVPRHD

SEQ ID NO: 1329960 - protein, 9 aa, Homo Sapiens
TTRSWATPR

SEQ ID NO: 1329961 - protein, 9 aa, Homo Sapiens
NSPQELCMP

SEQ ID NO: 1329962 - protein, 9 aa, Homo Sapiens
TCSHIDVMS

SEQ ID NO: 1329963 - protein, 9 aa, Homo Sapiens
GIKLLYAAL

SEQ ID NO: 1329964 - protein, 9 aa, Homo Sapiens
SELSSNPTA

SEQ ID NO: 1329965 - protein, 9 aa, Homo Sapiens
NEKERLKAT

SEQ ID NO: 1329966 - protein, 9 aa, Homo Sapiens
EKNLLEEIL

SEQ ID NO: 1329967 - protein, 9 aa, Homo Sapiens
TEECLAKLQ

SEQ ID NO: 1329968 - protein, 9 aa, Homo Sapiens
LGEQQRLIR

SEQ ID NO: 1329969 - protein, 9 aa, Homo Sapiens
GLNVLLRTA

SEQ ID NO: 1329970 - protein, 9 aa, Homo Sapiens
RLKDTGYQW

SEQ ID NO: 1329971 - protein, 9 aa, Homo Sapiens
EPHCLCIPH

SEQ ID NO: 1329972 - protein, 9 aa, Homo Sapiens
PTPFLPFTS

SEQ ID NO: 1329973 - protein, 9 aa, Homo Sapiens
HAAGEKCTK

SEQ ID NO: 1329974 - protein, 9 aa, Homo Sapiens
DGVPSPPRI

SEQ ID NO: 1329975 - protein, 9 aa, Homo Sapiens
RRCNTLQLH

SEQ ID NO: 1329976 - protein, 9 aa, Homo Sapiens
VCNSDHVLK

SEQ ID NO: 1329977 - protein, 9 aa, Homo Sapiens
GRYTTLNQH

SEQ ID NO: 1329978 - protein, 9 aa, Homo Sapiens
EECDERHKT

SEQ ID NO: 1329979 - protein, 9 aa, Homo Sapiens
YCTSKAYNN

SEQ ID NO: 1329980 - protein, 9 aa, Homo Sapiens
IEDEGFQAA

SEQ ID NO: 1329981 - protein, 9 aa, Homo Sapiens
SAATAAGIS

SEQ ID NO: 1329982 - protein, 9 aa, Homo Sapiens
STPQMSATF

SEQ ID NO: 1329983 - protein, 9 aa, Homo Sapiens
KLCHTLAAL

SEQ ID NO: 1329984 - protein, 9 aa, Homo Sapiens
GFRYQSLKQ

SEQ ID NO: 1329985 - protein, 9 aa, Homo Sapiens
MTWSMVGKY

SEQ ID NO: 1329986 - protein, 9 aa, Homo Sapiens
KKVETLENT

SEQ ID NO: 1329987 - protein, 9 aa, Homo Sapiens
HHQRTHSGQ

SEQ ID NO: 1329988 - protein, 9 aa, Homo Sapiens
SVIEDEGFQ

SEQ ID NO: 1329989 - protein, 9 aa, Homo Sapiens
HKGLAHCPG

SEQ ID NO: 1329990 - protein, 9 aa, Homo Sapiens
VDEFKKFRE

SEQ ID NO: 1329991 - protein, 9 aa, Homo Sapiens
DECRHADQY

SEQ ID NO: 1329992 - protein, 9 aa, Homo Sapiens
SFGMLNVTL

SEQ ID NO: 1329993 - protein, 9 aa, Homo Sapiens
FFPGSEEIC

SEQ ID NO: 1329994 - protein, 9 aa, Homo Sapiens
TLQRVKIIS

SEQ ID NO: 1329995 - protein, 9 aa, Homo Sapiens
MACVAQNAS

SEQ ID NO: 1329996 - protein, 9 aa, Homo Sapiens
DASEDIQLE

SEQ ID NO: 1329997 - protein, 9 aa, Homo Sapiens
SGMKMYGCE

SEQ ID NO: 1329998 - protein, 9 aa, Homo Sapiens
RAHAALFGS

SEQ ID NO: 1329999 - protein, 9 aa, Homo Sapiens
CHTLAALTS

SEQ ID NO: 1330000 - protein, 9 aa, Homo Sapiens
DCDSGYTCH

SEQ ID NO: 1330001 - protein, 9 aa, Homo Sapiens
EYQWIDRIH

SEQ ID NO: 1330002 - protein, 9 aa, Homo Sapiens
LYNLYGLLV

SEQ ID NO: 1330003 - protein, 9 aa, Homo Sapiens
SSFSLFSFS

SEQ ID NO: 1330004 - protein, 9 aa, Homo Sapiens
VNHFAYRTG

SEQ ID NO: 1330005 - protein, 9 aa, Homo Sapiens
QLMTTNIWL

SEQ ID NO: 1330006 - protein, 9 aa, Homo Sapiens
GQGKYSDMH

SEQ ID NO: 1330007 - protein, 9 aa, Homo Sapiens
TVHADYSGS

SEQ ID NO: 1330008 - protein, 9 aa, Homo Sapiens
TSQQSVASH

SEQ ID NO: 1330009 - protein, 9 aa, Homo Sapiens
WGARCQCCP

SEQ ID NO: 1330010 - protein, 9 aa, Homo Sapiens
SAATWARTS

SEQ ID NO: 1330011 - protein, 9 aa, Homo Sapiens
SHIPLHPKH

SEQ ID NO: 1330012 - protein, 9 aa, Homo Sapiens
TIKFGKFSV

SEQ ID NO: 1330013 - protein, 9 aa, Homo Sapiens
SGVKKLYLI

SEQ ID NO: 1330014 - protein, 9 aa, Homo Sapiens
ALSEPGNSS

SEQ ID NO: 1330015 - protein, 9 aa, Homo Sapiens
NKKSCFLYL

SEQ ID NO: 1330016 - protein, 9 aa, Homo Sapiens
IMRDPKRLR

SEQ ID NO: 1330017 - protein, 9 aa, Homo Sapiens
YPSTCSLEH

SEQ ID NO: 1330018 - protein, 9 aa, Homo Sapiens
PHVDFQLVL

SEQ ID NO: 1330019 - protein, 9 aa, Homo Sapiens
PTEQHILMK

SEQ ID NO: 1330020 - protein, 9 aa, Homo Sapiens
CNRIAENLG

SEQ ID NO: 1330021 - protein, 9 aa, Homo Sapiens
AHVWLLPGM

SEQ ID NO: 1330022 - protein, 9 aa, Homo Sapiens
KMTPANDTY

SEQ ID NO: 1330023 - protein, 9 aa, Homo Sapiens
YNPGDHIQS

SEQ ID NO: 1330024 - protein, 9 aa, Homo Sapiens
PCSPTTPSP

SEQ ID NO: 1330025 - protein, 9 aa, Homo Sapiens
QLVSIKSED

SEQ ID NO: 1330026 - protein, 9 aa, Homo Sapiens
THVLIWNIR

SEQ ID NO: 1330027 - protein, 9 aa, Homo Sapiens
TGMYILSPA

SEQ ID NO: 1330028 - protein, 9 aa, Homo Sapiens
HLQSHTGER

SEQ ID NO: 1330029 - protein, 9 aa, Homo Sapiens
IRYNDMPIV

SEQ ID NO: 1330030 - protein, 9 aa, Homo Sapiens
WFRGFNMRM

SEQ ID NO: 1330031 - protein, 9 aa, Homo Sapiens
ETCQTYECP

SEQ ID NO: 1330032 - protein, 9 aa, Homo Sapiens
KRKWTRPTK

SEQ ID NO: 1330033 - protein, 9 aa, Homo Sapiens
INFKWKFLT

SEQ ID NO: 1330034 - protein, 9 aa, Homo Sapiens
LHYTACRPS

SEQ ID NO: 1330035 - protein, 9 aa, Homo Sapiens
VEGDDIVST

SEQ ID NO: 1330036 - protein, 9 aa, Homo Sapiens
LQCCSEESP

SEQ ID NO: 1330037 - protein, 9 aa, Homo Sapiens
FPEVVVAEG

SEQ ID NO: 1330038 - protein, 9 aa, Homo Sapiens
FLQHMDMKP

SEQ ID NO: 1330039 - protein, 9 aa, Homo Sapiens
SLPCSGARA

SEQ ID NO: 1330040 - protein, 9 aa, Homo Sapiens
IYNTSTDRL

SEQ ID NO: 1330041 - protein, 9 aa, Homo Sapiens
MLGMQHDEE

SEQ ID NO: 1330042 - protein, 9 aa, Homo Sapiens
MENEDLNQF

SEQ ID NO: 1330043 - protein, 9 aa, Homo Sapiens
LSSPSRLMW

SEQ ID NO: 1330044 - protein, 9 aa, Homo Sapiens
MSFPPHLNH

SEQ ID NO: 1330045 - protein, 9 aa, Homo Sapiens
VRHCVCREV

SEQ ID NO: 1330046 - protein, 9 aa, Homo Sapiens
EEILKQLVI

SEQ ID NO: 1330047 - protein, 9 aa, Homo Sapiens
SAATRPSTC

SEQ ID NO: 1330048 - protein, 9 aa, Homo Sapiens
ELQSLMHQS

SEQ ID NO: 1330049 - protein, 9 aa, Homo Sapiens
RGRHISVIC

SEQ ID NO: 1330050 - protein, 9 aa, Homo Sapiens
EAMQDEFLL

SEQ ID NO: 1330051 - protein, 9 aa, Homo Sapiens
SHRLHQSPS

SEQ ID NO: 1330052 - protein, 9 aa, Homo Sapiens
PDPDAWLHA

SEQ ID NO: 1330053 - protein, 9 aa, Homo Sapiens
RSWSRGWYS

SEQ ID NO: 1330054 - protein, 9 aa, Homo Sapiens
MTQKYKHTL

SEQ ID NO: 1330055 - protein, 9 aa, Homo Sapiens
VDGDHLITE

SEQ ID NO: 1330056 - protein, 9 aa, Homo Sapiens
TAAENVCYM

SEQ ID NO: 1330057 - protein, 9 aa, Homo Sapiens
ERNRENVMG

SEQ ID NO: 1330058 - protein, 9 aa, Homo Sapiens
LPYFRTQIF

SEQ ID NO: 1330059 - protein, 9 aa, Homo Sapiens
CPPCYDVCY

SEQ ID NO: 1330060 - protein, 9 aa, Homo Sapiens
RTGVKCVPG

SEQ ID NO: 1330061 - protein, 9 aa, Homo Sapiens
GPNPATPMT

SEQ ID NO: 1330062 - protein, 9 aa, Homo Sapiens
PDSMLGTMF

SEQ ID NO: 1330063 - protein, 9 aa, Homo Sapiens
GEEGTYLAL

SEQ ID NO: 1330064 - protein, 9 aa, Homo Sapiens
NVGSKRHAK

SEQ ID NO: 1330065 - protein, 9 aa, Homo Sapiens
WEWEEDPTS

SEQ ID NO: 1330066 - protein, 9 aa, Homo Sapiens
SAMLPKITV

SEQ ID NO: 1330067 - protein, 9 aa, Homo Sapiens
IPCIPKEGA

SEQ ID NO: 1330068 - protein, 9 aa, Homo Sapiens
PFLPFTSTL

SEQ ID NO: 1330069 - protein, 9 aa, Homo Sapiens
SWVALGPHS

SEQ ID NO: 1330070 - protein, 9 aa, Homo Sapiens
ITGGSMMMS

SEQ ID NO: 1330071 - protein, 9 aa, Homo Sapiens
LWRGDVVKV

SEQ ID NO: 1330072 - protein, 9 aa, Homo Sapiens
STPRDEEPW

SEQ ID NO: 1330073 - protein, 9 aa, Homo Sapiens
VMGAVRRLL

SEQ ID NO: 1330074 - protein, 9 aa, Homo Sapiens
TASILKQLV

SEQ ID NO: 1330075 - protein, 9 aa, Homo Sapiens
ASSAATWAR

SEQ ID NO: 1330076 - protein, 9 aa, Homo Sapiens
VGTERGCTF

SEQ ID NO: 1330077 - protein, 9 aa, Homo Sapiens
KQRKEHKNR

SEQ ID NO: 1330078 - protein, 9 aa, Homo Sapiens
KHPVNVPRD

SEQ ID NO: 1330079 - protein, 9 aa, Homo Sapiens
ALLRGSCVV

SEQ ID NO: 1330080 - protein, 9 aa, Homo Sapiens
VDPTVLKHM

SEQ ID NO: 1330081 - protein, 9 aa, Homo Sapiens
PPLLRHHLK

SEQ ID NO: 1330082 - protein, 9 aa, Homo Sapiens
YAKNEWLLC

SEQ ID NO: 1330083 - protein, 9 aa, Homo Sapiens
HKMISTLQQ

SEQ ID NO: 1330084 - protein, 9 aa, Homo Sapiens
SGKTAVFVL

SEQ ID NO: 1330085 - protein, 9 aa, Homo Sapiens
NAAVRSAVC

SEQ ID NO: 1330086 - protein, 9 aa, Homo Sapiens
GLCRILSQS

SEQ ID NO: 1330087 - protein, 9 aa, Homo Sapiens
AYSPRNIWV

SEQ ID NO: 1330088 - protein, 9 aa, Homo Sapiens
ANHGEVKCA

SEQ ID NO: 1330089 - protein, 9 aa, Homo Sapiens
RTRARSPSS

SEQ ID NO: 1330090 - protein, 9 aa, Homo Sapiens
PDIMCGGVQ

SEQ ID NO: 1330091 - protein, 9 aa, Homo Sapiens
PTHPGRPHT

SEQ ID NO: 1330092 - protein, 9 aa, Homo Sapiens
STGVPDLIQ

SEQ ID NO: 1330093 - protein, 9 aa, Homo Sapiens
IEHIFELAK

SEQ ID NO: 1330094 - protein, 9 aa, Homo Sapiens
HGKSLYYYI

SEQ ID NO: 1330095 - protein, 9 aa, Homo Sapiens
RQESKKFRL

SEQ ID NO: 1330096 - protein, 9 aa, Homo Sapiens
ALVIEIATY

SEQ ID NO: 1330097 - protein, 9 aa, Homo Sapiens
GAKVLATMC

SEQ ID NO: 1330098 - protein, 9 aa, Homo Sapiens
FSVGLHMGF

SEQ ID NO: 1330099 - protein, 9 aa, Homo Sapiens
KQEEGVPDL

SEQ ID NO: 1330100 - protein, 9 aa, Homo Sapiens
RRPPAHRAV

SEQ ID NO: 1330101 - protein, 9 aa, Homo Sapiens
DDDQQMEWQ

SEQ ID NO: 1330102 - protein, 9 aa, Homo Sapiens
KEDVMMATV

SEQ ID NO: 1330103 - protein, 9 aa, Homo Sapiens
NQLTGHNLF

SEQ ID NO: 1330104 - protein, 9 aa, Homo Sapiens
PARSPTGAA

SEQ ID NO: 1330105 - protein, 9 aa, Homo Sapiens
SQFLHTYSA

SEQ ID NO: 1330106 - protein, 9 aa, Homo Sapiens
RTQQLIQTY

SEQ ID NO: 1330107 - protein, 9 aa, Homo Sapiens
KGDTAEMER

SEQ ID NO: 1330108 - protein, 9 aa, Homo Sapiens
IAEYANDSL

SEQ ID NO: 1330109 - protein, 9 aa, Homo Sapiens
LRSRLCTMK

SEQ ID NO: 1330110 - protein, 9 aa, Homo Sapiens
AQDQLSCSW

SEQ ID NO: 1330111 - protein, 9 aa, Homo Sapiens
PITIEIEHF

SEQ ID NO: 1330112 - protein, 9 aa, Homo Sapiens
RDLYHRIDV

SEQ ID NO: 1330113 - protein, 9 aa, Homo Sapiens
ESLMCEKWI

SEQ ID NO: 1330114 - protein, 9 aa, Homo Sapiens
LALLLGGTA

SEQ ID NO: 1330115 - protein, 9 aa, Homo Sapiens
HILPPSQLE

SEQ ID NO: 1330116 - protein, 9 aa, Homo Sapiens
WSLHNSKEE

SEQ ID NO: 1330117 - protein, 9 aa, Homo Sapiens
VVEMVPCGT

SEQ ID NO: 1330118 - protein, 9 aa, Homo Sapiens
KNYYFNTYE

SEQ ID NO: 1330119 - protein, 9 aa, Homo Sapiens
RLDQHEQIC

SEQ ID NO: 1330120 - protein, 9 aa, Homo Sapiens
NGDNAHPLW

SEQ ID NO: 1330121 - protein, 9 aa, Homo Sapiens
LCFFPRKGP

SEQ ID NO: 1330122 - protein, 9 aa, Homo Sapiens
KQEIEHLTR

SEQ ID NO: 1330123 - protein, 9 aa, Homo Sapiens
PFPESKPIL

SEQ ID NO: 1330124 - protein, 9 aa, Homo Sapiens
RSQLRVGHP

SEQ ID NO: 1330125 - protein, 9 aa, Homo Sapiens
VLLYVQGVA

SEQ ID NO: 1330126 - protein, 9 aa, Homo Sapiens
DSPFGYLDI

SEQ ID NO: 1330127 - protein, 9 aa, Homo Sapiens
CLHCCDPGT

SEQ ID NO: 1330128 - protein, 9 aa, Homo Sapiens
PPHLNHPPM

SEQ ID NO: 1330129 - protein, 9 aa, Homo Sapiens
ILEHLQKQD

SEQ ID NO: 1330130 - protein, 9 aa, Homo Sapiens
GVHLVSEFP

SEQ ID NO: 1330131 - protein, 9 aa, Homo Sapiens
KSVWQRRRR

SEQ ID NO: 1330132 - protein, 9 aa, Homo Sapiens
RLSVRNVGR

SEQ ID NO: 1330133 - protein, 9 aa, Homo Sapiens
FSLPHIVYA

SEQ ID NO: 1330134 - protein, 9 aa, Homo Sapiens
FCVNVEDEN

SEQ ID NO: 1330135 - protein, 9 aa, Homo Sapiens
AMLQKCIRY

SEQ ID NO: 1330136 - protein, 9 aa, Homo Sapiens
KRTHTGEKS

SEQ ID NO: 1330137 - protein, 9 aa, Homo Sapiens
WRAWSSFCT

SEQ ID NO: 1330138 - protein, 9 aa, Homo Sapiens
PTTLDPSST

SEQ ID NO: 1330139 - protein, 9 aa, Homo Sapiens
YYHYYSRCL

SEQ ID NO: 1330140 - protein, 9 aa, Homo Sapiens
EITSLSSEG

SEQ ID NO: 1330141 - protein, 9 aa, Homo Sapiens
GSCRGSISS

SEQ ID NO: 1330142 - protein, 9 aa, Homo Sapiens
GIIGGFWLS

SEQ ID NO: 1330143 - protein, 9 aa, Homo Sapiens
SVIPHVLKM

SEQ ID NO: 1330144 - protein, 9 aa, Homo Sapiens
STPLMLWPA

SEQ ID NO: 1330145 - protein, 9 aa, Homo Sapiens
ALYTYMLPQ

SEQ ID NO: 1330146 - protein, 9 aa, Homo Sapiens
VEDFEMIDA

SEQ ID NO: 1330147 - protein, 9 aa, Homo Sapiens
QGRGVEKSP

SEQ ID NO: 1330148 - protein, 9 aa, Homo Sapiens
SAYYLTSQA

SEQ ID NO: 1330149 - protein, 9 aa, Homo Sapiens
AVFVLPILQ

SEQ ID NO: 1330150 - protein, 9 aa, Homo Sapiens
RDCLAEEGH

SEQ ID NO: 1330151 - protein, 9 aa, Homo Sapiens
SFIAPKQCL

SEQ ID NO: 1330152 - protein, 9 aa, Homo Sapiens
EIFDEDTKI

SEQ ID NO: 1330153 - protein, 9 aa, Homo Sapiens
GRCSTGART

SEQ ID NO: 1330154 - protein, 9 aa, Homo Sapiens
HFLSKMSEA

SEQ ID NO: 1330155 - protein, 9 aa, Homo Sapiens
KATARKVLS

SEQ ID NO: 1330156 - protein, 9 aa, Homo Sapiens
VESDNPEFN

SEQ ID NO: 1330157 - protein, 9 aa, Homo Sapiens
QDTTRHSAL

SEQ ID NO: 1330158 - protein, 9 aa, Homo Sapiens
STAGTSRSS

SEQ ID NO: 1330159 - protein, 9 aa, Homo Sapiens
GGGGGDTGS

SEQ ID NO: 1330160 - protein, 9 aa, Homo Sapiens
SRELHLPIR

SEQ ID NO: 1330161 - protein, 9 aa, Homo Sapiens
SFASVHIGL

SEQ ID NO: 1330162 - protein, 9 aa, Homo Sapiens
RKYSDSDSD

SEQ ID NO: 1330163 - protein, 9 aa, Homo Sapiens
KTCSVCTKA

SEQ ID NO: 1330164 - protein, 9 aa, Homo Sapiens
TYTFGKEVE

SEQ ID NO: 1330165 - protein, 9 aa, Homo Sapiens
IKFMEKGEK

SEQ ID NO: 1330166 - protein, 9 aa, Homo Sapiens
QCLGRRITE

SEQ ID NO: 1330167 - protein, 9 aa, Homo Sapiens
YSAGEENEK

SEQ ID NO: 1330168 - protein, 9 aa, Homo Sapiens
EVIVKKQIV

SEQ ID NO: 1330169 - protein, 9 aa, Homo Sapiens
TSFYMKRNS

SEQ ID NO: 1330170 - protein, 9 aa, Homo Sapiens
SCFSGMTGT

SEQ ID NO: 1330171 - protein, 9 aa, Homo Sapiens
ISQHAPSIL

SEQ ID NO: 1330172 - protein, 9 aa, Homo Sapiens
CNECQCIPS

SEQ ID NO: 1330173 - protein, 9 aa, Homo Sapiens
GIGKWKGTA

SEQ ID NO: 1330174 - protein, 9 aa, Homo Sapiens
SPSSAPTAG

SEQ ID NO: 1330175 - protein, 9 aa, Homo Sapiens
LEGKHSVLA

SEQ ID NO: 1330176 - protein, 9 aa, Homo Sapiens
DDEGWPLDP

SEQ ID NO: 1330177 - protein, 9 aa, Homo Sapiens
KDEGTFDRL

SEQ ID NO: 1330178 - protein, 9 aa, Homo Sapiens
LHPEVWELF

SEQ ID NO: 1330179 - protein, 9 aa, Homo Sapiens
EQLGMLMEI

SEQ ID NO: 1330180 - protein, 9 aa, Homo Sapiens
PSDLLTDTV

SEQ ID NO: 1330181 - protein, 9 aa, Homo Sapiens
GSDIWSFGV

SEQ ID NO: 1330182 - protein, 9 aa, Homo Sapiens
HGGFPEPFH

SEQ ID NO: 1330183 - protein, 9 aa, Homo Sapiens
DRVDYVTVK

SEQ ID NO: 1330184 - protein, 9 aa, Homo Sapiens
WVLLPKLVL

SEQ ID NO: 1330185 - protein, 9 aa, Homo Sapiens
SEAEENKQI

SEQ ID NO: 1330186 - protein, 9 aa, Homo Sapiens
RGLGLQLAL

SEQ ID NO: 1330187 - protein, 9 aa, Homo Sapiens
VDVISVETP

SEQ ID NO: 1330188 - protein, 9 aa, Homo Sapiens
VYMADLGSR

SEQ ID NO: 1330189 - protein, 9 aa, Homo Sapiens
SNFEEYFEI

SEQ ID NO: 1330190 - protein, 9 aa, Homo Sapiens
TSLYMSPEL

SEQ ID NO: 1330191 - protein, 9 aa, Homo Sapiens
LWGPMDVQD

SEQ ID NO: 1330192 - protein, 9 aa, Homo Sapiens
TRLKYVHLH

SEQ ID NO: 1330193 - protein, 9 aa, Homo Sapiens
ILLLWKYGF

SEQ ID NO: 1330194 - protein, 9 aa, Homo Sapiens
MARETEFEA

SEQ ID NO: 1330195 - protein, 9 aa, Homo Sapiens
EWCAKVQGT

SEQ ID NO: 1330196 - protein, 9 aa, Homo Sapiens
SELTAEKLD

SEQ ID NO: 1330197 - protein, 9 aa, Homo Sapiens
LNPQKPGDI

SEQ ID NO: 1330198 - protein, 9 aa, Homo Sapiens
GIVNCAIIT

SEQ ID NO: 1330199 - protein, 9 aa, Homo Sapiens
LDNCFLLCK

SEQ ID NO: 1330200 - protein, 9 aa, Homo Sapiens
EQHYKDAME

SEQ ID NO: 1330201 - protein, 9 aa, Homo Sapiens
LATTSLENT

SEQ ID NO: 1330202 - protein, 9 aa, Homo Sapiens
HSSYLASEI

SEQ ID NO: 1330203 - protein, 9 aa, Homo Sapiens
RLKRRDDVR

SEQ ID NO: 1330204 - protein, 9 aa, Homo Sapiens
SLCGASATT

SEQ ID NO: 1330205 - protein, 9 aa, Homo Sapiens
VESLYFRLH

SEQ ID NO: 1330206 - protein, 9 aa, Homo Sapiens
LQLDIKTSN

SEQ ID NO: 1330207 - protein, 9 aa, Homo Sapiens
KGTSLYMSP

SEQ ID NO: 1330208 - protein, 9 aa, Homo Sapiens
DVPEAAAQS

SEQ ID NO: 1330209 - protein, 9 aa, Homo Sapiens
PSQDERMWS

SEQ ID NO: 1330210 - protein, 9 aa, Homo Sapiens
KVCDEAFTY

SEQ ID NO: 1330211 - protein, 9 aa, Homo Sapiens
NRVHEKQKL

SEQ ID NO: 1330212 - protein, 9 aa, Homo Sapiens
RDVFLRIDM

SEQ ID NO: 1330213 - protein, 9 aa, Homo Sapiens
IVMSACFLA

SEQ ID NO: 1330214 - protein, 9 aa, Homo Sapiens
AVLTIFYRT

SEQ ID NO: 1330215 - protein, 9 aa, Homo Sapiens
KKCSLYGKK

SEQ ID NO: 1330216 - protein, 9 aa, Homo Sapiens
CRNALREFL

SEQ ID NO: 1330217 - protein, 9 aa, Homo Sapiens
IVDTGAIDD

SEQ ID NO: 1330218 - protein, 9 aa, Homo Sapiens
QKAIEGYTK

SEQ ID NO: 1330219 - protein, 9 aa, Homo Sapiens
SSVEMLVDC

SEQ ID NO: 1330220 - protein, 9 aa, Homo Sapiens
IFRSWGCVG

SEQ ID NO: 1330221 - protein, 9 aa, Homo Sapiens
REATAAPHR

SEQ ID NO: 1330222 - protein, 9 aa, Homo Sapiens
SNPDGPVII

SEQ ID NO: 1330223 - protein, 9 aa, Homo Sapiens
TGHISSLDA

SEQ ID NO: 1330224 - protein, 9 aa, Homo Sapiens
PFNGQDPIK

SEQ ID NO: 1330225 - protein, 9 aa, Homo Sapiens
QRMSLARAV

SEQ ID NO: 1330226 - protein, 9 aa, Homo Sapiens
LDIDEEEDD

SEQ ID NO: 1330227 - protein, 9 aa, Homo Sapiens
RRLNLTQHI

SEQ ID NO: 1330228 - protein, 9 aa, Homo Sapiens
EVVPQQPTL

SEQ ID NO: 1330229 - protein, 9 aa, Homo Sapiens
NIIIKLNKA

SEQ ID NO: 1330230 - protein, 9 aa, Homo Sapiens
IALPPDKKV

SEQ ID NO: 1330231 - protein, 9 aa, Homo Sapiens
DPGTKGPGA

SEQ ID NO: 1330232 - protein, 9 aa, Homo Sapiens
TFIRSIGLM

SEQ ID NO: 1330233 - protein, 9 aa, Homo Sapiens
IAMGQHMFE

SEQ ID NO: 1330234 - protein, 9 aa, Homo Sapiens
QLNKHLPST

SEQ ID NO: 1330235 - protein, 9 aa, Homo Sapiens
EYPISKKRA

SEQ ID NO: 1330236 - protein, 9 aa, Homo Sapiens
GAICFGLSG

SEQ ID NO: 1330237 - protein, 9 aa, Homo Sapiens
HDSKIMVCE

SEQ ID NO: 1330238 - protein, 9 aa, Homo Sapiens
RHLWRPDVK

SEQ ID NO: 1330239 - protein, 9 aa, Homo Sapiens
FTAHTAPAY

SEQ ID NO: 1330240 - protein, 9 aa, Homo Sapiens
EAKQRGLTP

SEQ ID NO: 1330241 - protein, 9 aa, Homo Sapiens
VVKTTLKLL

SEQ ID NO: 1330242 - protein, 9 aa, Homo Sapiens
LSIQWKIQN

SEQ ID NO: 1330243 - protein, 9 aa, Homo Sapiens
SQNQIRKHI

SEQ ID NO: 1330244 - protein, 9 aa, Homo Sapiens
GPRPAHMVV

SEQ ID NO: 1330245 - protein, 9 aa, Homo Sapiens
AFNVTNGGS

SEQ ID NO: 1330246 - protein, 9 aa, Homo Sapiens
FPNPLVSIV

SEQ ID NO: 1330247 - protein, 9 aa, Homo Sapiens
RVSHLLTEA

SEQ ID NO: 1330248 - protein, 9 aa, Homo Sapiens
TDGESVMFH

SEQ ID NO: 1330249 - protein, 9 aa, Homo Sapiens
GKKKVLNKY

SEQ ID NO: 1330250 - protein, 9 aa, Homo Sapiens
NGKKWNLFP

SEQ ID NO: 1330251 - protein, 9 aa, Homo Sapiens
KCALFFRFV

SEQ ID NO: 1330252 - protein, 9 aa, Homo Sapiens
DSIRINVTT

SEQ ID NO: 1330253 - protein, 9 aa, Homo Sapiens
ETLQVMILQ

SEQ ID NO: 1330254 - protein, 9 aa, Homo Sapiens
QFKAEHIKI

SEQ ID NO: 1330255 - protein, 9 aa, Homo Sapiens
SERYMQKSS

SEQ ID NO: 1330256 - protein, 9 aa, Homo Sapiens
DGALKGEAD

SEQ ID NO: 1330257 - protein, 9 aa, Homo Sapiens
GDITYCEFN

SEQ ID NO: 1330258 - protein, 9 aa, Homo Sapiens
KRKNVTFLE

SEQ ID NO: 1330259 - protein, 9 aa, Homo Sapiens
DKRQSLNSS

SEQ ID NO: 1330260 - protein, 9 aa, Homo Sapiens
FKSHIYFFR

SEQ ID NO: 1330261 - protein, 9 aa, Homo Sapiens
PSFHSPEKL

SEQ ID NO: 1330262 - protein, 9 aa, Homo Sapiens
YMSADDLHI

SEQ ID NO: 1330263 - protein, 9 aa, Homo Sapiens
QGHPLPASG

SEQ ID NO: 1330264 - protein, 9 aa, Homo Sapiens
AASPAKGEL

SEQ ID NO: 1330265 - protein, 9 aa, Homo Sapiens
LANSSWTDM

SEQ ID NO: 1330266 - protein, 9 aa, Homo Sapiens
ASRSQGATC

SEQ ID NO: 1330267 - protein, 9 aa, Homo Sapiens
HLWMGLSKV

SEQ ID NO: 1330268 - protein, 9 aa, Homo Sapiens
QKDDLVANM

SEQ ID NO: 1330269 - protein, 9 aa, Homo Sapiens
GGGRGASPE

SEQ ID NO: 1330270 - protein, 9 aa, Homo Sapiens
IGVIVVGFP

SEQ ID NO: 1330271 - protein, 9 aa, Homo Sapiens
EIYKAETLM

SEQ ID NO: 1330272 - protein, 9 aa, Homo Sapiens
FNSLSGEGY

SEQ ID NO: 1330273 - protein, 9 aa, Homo Sapiens
LLQHNLWKF

SEQ ID NO: 1330274 - protein, 9 aa, Homo Sapiens
KDSHLKRRQ

SEQ ID NO: 1330275 - protein, 9 aa, Homo Sapiens
QVHHHATAY

SEQ ID NO: 1330276 - protein, 9 aa, Homo Sapiens
RALDWIFNH

SEQ ID NO: 1330277 - protein, 9 aa, Homo Sapiens
DSERDELYV

SEQ ID NO: 1330278 - protein, 9 aa, Homo Sapiens
LTPEKEGEL

SEQ ID NO: 1330279 - protein, 9 aa, Homo Sapiens
EVKPGHVLR

SEQ ID NO: 1330280 - protein, 9 aa, Homo Sapiens
HRYCDAIAE

SEQ ID NO: 1330281 - protein, 9 aa, Homo Sapiens
EVESFHSSL

SEQ ID NO: 1330282 - protein, 9 aa, Homo Sapiens
RLMGRICIS

SEQ ID NO: 1330283 - protein, 9 aa, Homo Sapiens
HLFHFYRVL

SEQ ID NO: 1330284 - protein, 9 aa, Homo Sapiens
STYSQLGQE

SEQ ID NO: 1330285 - protein, 9 aa, Homo Sapiens
RGFEISQGH

SEQ ID NO: 1330286 - protein, 9 aa, Homo Sapiens
ESKLVANQS

SEQ ID NO: 1330287 - protein, 9 aa, Homo Sapiens
GCDVGSDGC

SEQ ID NO: 1330288 - protein, 9 aa, Homo Sapiens
YNKSHNEKK

SEQ ID NO: 1330289 - protein, 9 aa, Homo Sapiens
VNYVPQQEI

SEQ ID NO: 1330290 - protein, 9 aa, Homo Sapiens
YLITCCPFV

SEQ ID NO: 1330291 - protein, 9 aa, Homo Sapiens
SEARMQVWF

SEQ ID NO: 1330292 - protein, 9 aa, Homo Sapiens
EKHITFTPE

SEQ ID NO: 1330293 - protein, 9 aa, Homo Sapiens
ARWKSHRRS

SEQ ID NO: 1330294 - protein, 9 aa, Homo Sapiens
PEQVSTLFG

SEQ ID NO: 1330295 - protein, 9 aa, Homo Sapiens
MDHTHYLLT

SEQ ID NO: 1330296 - protein, 9 aa, Homo Sapiens
PSIEVADPK

SEQ ID NO: 1330297 - protein, 9 aa, Homo Sapiens
GQCFTARDD

SEQ ID NO: 1330298 - protein, 9 aa, Homo Sapiens
FDVEWAAKA

SEQ ID NO: 1330299 - protein, 9 aa, Homo Sapiens
VTMTRATNS

SEQ ID NO: 1330300 - protein, 9 aa, Homo Sapiens
RTYYRNSVG

SEQ ID NO: 1330301 - protein, 9 aa, Homo Sapiens
QVFAFLKGL

SEQ ID NO: 1330302 - protein, 9 aa, Homo Sapiens
CDTGNRALE

SEQ ID NO: 1330303 - protein, 9 aa, Homo Sapiens
VAEQFLRVM

SEQ ID NO: 1330304 - protein, 9 aa, Homo Sapiens
KYGWKKEAI

SEQ ID NO: 1330305 - protein, 9 aa, Homo Sapiens
ILLIFFFIT

SEQ ID NO: 1330306 - protein, 9 aa, Homo Sapiens
SNANFAKLF

SEQ ID NO: 1330307 - protein, 9 aa, Homo Sapiens
GVSPGRAEP

SEQ ID NO: 1330308 - protein, 9 aa, Homo Sapiens
HMGKCKVYW

SEQ ID NO: 1330309 - protein, 9 aa, Homo Sapiens
SGVKLDAAG

SEQ ID NO: 1330310 - protein, 9 aa, Homo Sapiens
AVQTPRPQN

SEQ ID NO: 1330311 - protein, 9 aa, Homo Sapiens
PLWSLQPLR

SEQ ID NO: 1330312 - protein, 9 aa, Homo Sapiens
VAFVQPVCP

SEQ ID NO: 1330313 - protein, 9 aa, Homo Sapiens
RDFTRTYEP

SEQ ID NO: 1330314 - protein, 9 aa, Homo Sapiens
REENANLGL

SEQ ID NO: 1330315 - protein, 9 aa, Homo Sapiens
KSPASTFTL

SEQ ID NO: 1330316 - protein, 9 aa, Homo Sapiens
PFDPEQPPT

SEQ ID NO: 1330317 - protein, 9 aa, Homo Sapiens
QPKCWQQDM

SEQ ID NO: 1330318 - protein, 9 aa, Homo Sapiens
CLCIPHPEV

SEQ ID NO: 1330319 - protein, 9 aa, Homo Sapiens
VNMGGNRSI

SEQ ID NO: 1330320 - protein, 9 aa, Homo Sapiens
AFVNYMMSS

SEQ ID NO: 1330321 - protein, 9 aa, Homo Sapiens
LEKLCLRND

SEQ ID NO: 1330322 - protein, 9 aa, Homo Sapiens
SCTSASTPV

SEQ ID NO: 1330323 - protein, 9 aa, Homo Sapiens
KVPTGEKIY

SEQ ID NO: 1330324 - protein, 9 aa, Homo Sapiens
GAPLCNYLS

SEQ ID NO: 1330325 - protein, 9 aa, Homo Sapiens
GENRNHLTQ

SEQ ID NO: 1330326 - protein, 9 aa, Homo Sapiens
RVQSILREV

SEQ ID NO: 1330327 - protein, 9 aa, Homo Sapiens
VEPGTFNNL

SEQ ID NO: 1330328 - protein, 9 aa, Homo Sapiens
YKHTLPVGG

SEQ ID NO: 1330329 - protein, 9 aa, Homo Sapiens
MSLGSHGVS

SEQ ID NO: 1330330 - protein, 9 aa, Homo Sapiens
SGLVDPNFG

SEQ ID NO: 1330331 - protein, 9 aa, Homo Sapiens
GAMTEKWTH

SEQ ID NO: 1330332 - protein, 9 aa, Homo Sapiens
DENVTKDSN

SEQ ID NO: 1330333 - protein, 9 aa, Homo Sapiens
TMTRTMVPS

SEQ ID NO: 1330334 - protein, 9 aa, Homo Sapiens
QHHVSSDLE

SEQ ID NO: 1330335 - protein, 9 aa, Homo Sapiens
KFFQELREV

SEQ ID NO: 1330336 - protein, 9 aa, Homo Sapiens
HLDAVACST

SEQ ID NO: 1330337 - protein, 9 aa, Homo Sapiens
PASDTPPWT

SEQ ID NO: 1330338 - protein, 9 aa, Homo Sapiens
CHVRKKRKI

SEQ ID NO: 1330339 - protein, 9 aa, Homo Sapiens
RVLSRITLV

SEQ ID NO: 1330340 - protein, 9 aa, Homo Sapiens
GPDGSAVSI

SEQ ID NO: 1330341 - protein, 9 aa, Homo Sapiens
AVKVELRQY

SEQ ID NO: 1330342 - protein, 9 aa, Homo Sapiens
TGSLPPTRQ

SEQ ID NO: 1330343 - protein, 9 aa, Homo Sapiens
WPIVGVHLV

SEQ ID NO: 1330344 - protein, 9 aa, Homo Sapiens
RRDFQGKSN

SEQ ID NO: 1330345 - protein, 9 aa, Homo Sapiens
AEDSAEITW

SEQ ID NO: 1330346 - protein, 9 aa, Homo Sapiens
ARNIIQSTE

SEQ ID NO: 1330347 - protein, 9 aa, Homo Sapiens
TLPSPPTPP

SEQ ID NO: 1330348 - protein, 9 aa, Homo Sapiens
PERFDNQPC

SEQ ID NO: 1330349 - protein, 9 aa, Homo Sapiens
YPAQVELQS

SEQ ID NO: 1330350 - protein, 9 aa, Homo Sapiens
PTIIGHQKN

SEQ ID NO: 1330351 - protein, 9 aa, Homo Sapiens
PHAPVGHNA

SEQ ID NO: 1330352 - protein, 9 aa, Homo Sapiens
SADIESIMA

SEQ ID NO: 1330353 - protein, 9 aa, Homo Sapiens
VVNQEILNT

SEQ ID NO: 1330354 - protein, 9 aa, Homo Sapiens
CSSTPCYQP

SEQ ID NO: 1330355 - protein, 9 aa, Homo Sapiens
TSLRSGTKY

SEQ ID NO: 1330356 - protein, 9 aa, Homo Sapiens
NKPDCDDWE

SEQ ID NO: 1330357 - protein, 9 aa, Homo Sapiens
ASGVKLTLV

SEQ ID NO: 1330358 - protein, 9 aa, Homo Sapiens
QVRDLLSKM

SEQ ID NO: 1330359 - protein, 9 aa, Homo Sapiens
HQQSASTSV

SEQ ID NO: 1330360 - protein, 9 aa, Homo Sapiens
SILSGASWV

SEQ ID NO: 1330361 - protein, 9 aa, Homo Sapiens
SVHHPGFYA

SEQ ID NO: 1330362 - protein, 9 aa, Homo Sapiens
QVTVCIENM

SEQ ID NO: 1330363 - protein, 9 aa, Homo Sapiens
VIPHVLKME

SEQ ID NO: 1330364 - protein, 9 aa, Homo Sapiens
QPHGKCQSS

SEQ ID NO: 1330365 - protein, 9 aa, Homo Sapiens
EIHFQDYSS

SEQ ID NO: 1330366 - protein, 9 aa, Homo Sapiens
ERPRGGRCA

SEQ ID NO: 1330367 - protein, 9 aa, Homo Sapiens
IIDYSENCL

SEQ ID NO: 1330368 - protein, 9 aa, Homo Sapiens
PEEERWAEF

SEQ ID NO: 1330369 - protein, 9 aa, Homo Sapiens
IEVIPPNNQ

SEQ ID NO: 1330370 - protein, 9 aa, Homo Sapiens
SPRTQASRS

SEQ ID NO: 1330371 - protein, 9 aa, Homo Sapiens
TAQASKHIP

SEQ ID NO: 1330372 - protein, 9 aa, Homo Sapiens
HSLDFTELD

SEQ ID NO: 1330373 - protein, 9 aa, Homo Sapiens
VPTEEAYII

SEQ ID NO: 1330374 - protein, 9 aa, Homo Sapiens
FWCKAGGGL

SEQ ID NO: 1330375 - protein, 9 aa, Homo Sapiens
KLYLIDCVN

SEQ ID NO: 1330376 - protein, 9 aa, Homo Sapiens
KWNEIYGNK

SEQ ID NO: 1330377 - protein, 9 aa, Homo Sapiens
VDNKEYVVN

SEQ ID NO: 1330378 - protein, 9 aa, Homo Sapiens
CSDELSRHR

SEQ ID NO: 1330379 - protein, 9 aa, Homo Sapiens
PLDQTLQVL

SEQ ID NO: 1330380 - protein, 9 aa, Homo Sapiens
LSVAPKGIS

SEQ ID NO: 1330381 - protein, 9 aa, Homo Sapiens
DTWVLLNQC

SEQ ID NO: 1330382 - protein, 9 aa, Homo Sapiens
CSLHGVSCW

SEQ ID NO: 1330383 - protein, 9 aa, Homo Sapiens
KMHKKGWGL

SEQ ID NO: 1330384 - protein, 9 aa, Homo Sapiens
AEGDMSSER

SEQ ID NO: 1330385 - protein, 9 aa, Homo Sapiens
HHLDAVACS

SEQ ID NO: 1330386 - protein, 9 aa, Homo Sapiens
KLTPEKEGE

SEQ ID NO: 1330387 - protein, 9 aa, Homo Sapiens
ASCVSEDKH

SEQ ID NO: 1330388 - protein, 9 aa, Homo Sapiens
YIMSTTGWL

SEQ ID NO: 1330389 - protein, 9 aa, Homo Sapiens
LPGEADLAD

SEQ ID NO: 1330390 - protein, 9 aa, Homo Sapiens
INKIIPKPS

SEQ ID NO: 1330391 - protein, 9 aa, Homo Sapiens
SFNFDHVFH

SEQ ID NO: 1330392 - protein, 9 aa, Homo Sapiens
GSSDPSLQS

SEQ ID NO: 1330393 - protein, 9 aa, Homo Sapiens
IILLLWKYG

SEQ ID NO: 1330394 - protein, 9 aa, Homo Sapiens
DQISFMKGK

SEQ ID NO: 1330395 - protein, 9 aa, Homo Sapiens
PWVLLPKLV

SEQ ID NO: 1330396 - protein, 9 aa, Homo Sapiens
SALNEECLK

SEQ ID NO: 1330397 - protein, 9 aa, Homo Sapiens
KAAETRQES

SEQ ID NO: 1330398 - protein, 9 aa, Homo Sapiens
KIFVTTKSS

SEQ ID NO: 1330399 - protein, 9 aa, Homo Sapiens
EQTAAALKR

SEQ ID NO: 1330400 - protein, 9 aa, Homo Sapiens
CLYMTCAKC

SEQ ID NO: 1330401 - protein, 9 aa, Homo Sapiens
KKLWQSPAS

SEQ ID NO: 1330402 - protein, 9 aa, Homo Sapiens
QLDLCRFRI

SEQ ID NO: 1330403 - protein, 9 aa, Homo Sapiens
PKLMDGILE

SEQ ID NO: 1330404 - protein, 9 aa, Homo Sapiens
VPCTEVWTG

SEQ ID NO: 1330405 - protein, 9 aa, Homo Sapiens
CLASKDHTK

SEQ ID NO: 1330406 - protein, 9 aa, Homo Sapiens
VSAETLIQL

SEQ ID NO: 1330407 - protein, 9 aa, Homo Sapiens
GEGFQRLVL

SEQ ID NO: 1330408 - protein, 9 aa, Homo Sapiens
RILPKEQWT

SEQ ID NO: 1330409 - protein, 9 aa, Homo Sapiens
ENLTNGVSA

SEQ ID NO: 1330410 - protein, 9 aa, Homo Sapiens
DGTVCIWHS

SEQ ID NO: 1330411 - protein, 9 aa, Homo Sapiens
KSSEEDKKK

SEQ ID NO: 1330412 - protein, 9 aa, Homo Sapiens
QELRVPCLP

SEQ ID NO: 1330413 - protein, 9 aa, Homo Sapiens
YQVTVCIEN

SEQ ID NO: 1330414 - protein, 9 aa, Homo Sapiens
GSRCYGVCV

SEQ ID NO: 1330415 - protein, 9 aa, Homo Sapiens
FEVFFFTIG

SEQ ID NO: 1330416 - protein, 9 aa, Homo Sapiens
PKEKDTEGK

SEQ ID NO: 1330417 - protein, 9 aa, Homo Sapiens
RDELRCRII

SEQ ID NO: 1330418 - protein, 9 aa, Homo Sapiens
VAKSWTDVV

SEQ ID NO: 1330419 - protein, 9 aa, Homo Sapiens
LEQYHIDFE

SEQ ID NO: 1330420 - protein, 9 aa, Homo Sapiens
WPENVTLYQ

SEQ ID NO: 1330421 - protein, 9 aa, Homo Sapiens
DLATTSVTI

SEQ ID NO: 1330422 - protein, 9 aa, Homo Sapiens
KAGLPHPQL

SEQ ID NO: 1330423 - protein, 9 aa, Homo Sapiens
MSSFEKQCN

SEQ ID NO: 1330424 - protein, 9 aa, Homo Sapiens
KCVFDSANV

SEQ ID NO: 1330425 - protein, 9 aa, Homo Sapiens
DTWLKSVMN

SEQ ID NO: 1330426 - protein, 9 aa, Homo Sapiens
EFQEERQDE

SEQ ID NO: 1330427 - protein, 9 aa, Homo Sapiens
DRHITLRAS

SEQ ID NO: 1330428 - protein, 9 aa, Homo Sapiens
SSTPCYQPA

SEQ ID NO: 1330429 - protein, 9 aa, Homo Sapiens
SIGKQKMAI

SEQ ID NO: 1330430 - protein, 9 aa, Homo Sapiens
RSLQCSPPV

SEQ ID NO: 1330431 - protein, 9 aa, Homo Sapiens
GLLGEKTQV

SEQ ID NO: 1330432 - protein, 9 aa, Homo Sapiens
FQQMLMEKE

SEQ ID NO: 1330433 - protein, 9 aa, Homo Sapiens
RWTWWSAAA

SEQ ID NO: 1330434 - protein, 9 aa, Homo Sapiens
SCLSGYYRM

SEQ ID NO: 1330435 - protein, 9 aa, Homo Sapiens
WAVKTEAIS

SEQ ID NO: 1330436 - protein, 9 aa, Homo Sapiens
ATQLLVLEP

SEQ ID NO: 1330437 - protein, 9 aa, Homo Sapiens
TQKTASYYS

SEQ ID NO: 1330438 - protein, 9 aa, Homo Sapiens
PGDQESCWK

SEQ ID NO: 1330439 - protein, 9 aa, Homo Sapiens
LTMKHRILP

SEQ ID NO: 1330440 - protein, 9 aa, Homo Sapiens
SALFLHQNT

SEQ ID NO: 1330441 - protein, 9 aa, Homo Sapiens
MCCGDLLAA

SEQ ID NO: 1330442 - protein, 9 aa, Homo Sapiens
TQQVAQQYA

SEQ ID NO: 1330443 - protein, 9 aa, Homo Sapiens
LILVMLEIV

SEQ ID NO: 1330444 - protein, 9 aa, Homo Sapiens
SLRQDRMAF

SEQ ID NO: 1330445 - protein, 9 aa, Homo Sapiens
WSHWILSHT

SEQ ID NO: 1330446 - protein, 9 aa, Homo Sapiens
PALTVHMTQ

SEQ ID NO: 1330447 - protein, 9 aa, Homo Sapiens
KSKSKCNDL

SEQ ID NO: 1330448 - protein, 9 aa, Homo Sapiens
IFLLVTLVI

SEQ ID NO: 1330449 - protein, 9 aa, Homo Sapiens
NIFKSSSSL

SEQ ID NO: 1330450 - protein, 9 aa, Homo Sapiens
PRMRHYIKN

SEQ ID NO: 1330451 - protein, 9 aa, Homo Sapiens
GNLYLWGPL

SEQ ID NO: 1330452 - protein, 9 aa, Homo Sapiens
AKMIKMFFA

SEQ ID NO: 1330453 - protein, 9 aa, Homo Sapiens
EKWAFREIQ

SEQ ID NO: 1330454 - protein, 9 aa, Homo Sapiens
GTNPNLRNF

SEQ ID NO: 1330455 - protein, 9 aa, Homo Sapiens
LKCSAMRAV

SEQ ID NO: 1330456 - protein, 9 aa, Homo Sapiens
LCQVCRNKC

SEQ ID NO: 1330457 - protein, 9 aa, Homo Sapiens
RRWVRSHFD

SEQ ID NO: 1330458 - protein, 9 aa, Homo Sapiens
LYSDLSDTL

SEQ ID NO: 1330459 - protein, 9 aa, Homo Sapiens
QRWLLYNLE

SEQ ID NO: 1330460 - protein, 9 aa, Homo Sapiens
ITKMPAISD

SEQ ID NO: 1330461 - protein, 9 aa, Homo Sapiens
TYSVSDAVV

SEQ ID NO: 1330462 - protein, 9 aa, Homo Sapiens
ETTRIHQEI

SEQ ID NO: 1330463 - protein, 9 aa, Homo Sapiens
TFGWVMFVA

SEQ ID NO: 1330464 - protein, 9 aa, Homo Sapiens
PEVWELFPN

SEQ ID NO: 1330465 - protein, 9 aa, Homo Sapiens
CGKSFSWCS

SEQ ID NO: 1330466 - protein, 9 aa, Homo Sapiens
EAWDFTGVV

SEQ ID NO: 1330467 - protein, 9 aa, Homo Sapiens
LWTTPLLSM

SEQ ID NO: 1330468 - protein, 9 aa, Homo Sapiens
NGTNVLSLL

SEQ ID NO: 1330469 - protein, 9 aa, Homo Sapiens
MRVAQVAQD

SEQ ID NO: 1330470 - protein, 9 aa, Homo Sapiens
ILSKVPSEV

SEQ ID NO: 1330471 - protein, 9 aa, Homo Sapiens
QHASKQIAT

SEQ ID NO: 1330472 - protein, 9 aa, Homo Sapiens
KCRLTIIEC

SEQ ID NO: 1330473 - protein, 9 aa, Homo Sapiens
EWECGVGVI

SEQ ID NO: 1330474 - protein, 9 aa, Homo Sapiens
EGTFDRLLI

SEQ ID NO: 1330475 - protein, 9 aa, Homo Sapiens
STIILTLLA

SEQ ID NO: 1330476 - protein, 9 aa, Homo Sapiens
VKNTVGMHL

SEQ ID NO: 1330477 - protein, 9 aa, Homo Sapiens
KVTIKKIMK

SEQ ID NO: 1330478 - protein, 9 aa, Homo Sapiens
VSEKKNFCD

SEQ ID NO: 1330479 - protein, 9 aa, Homo Sapiens
EIFTMHQQD

SEQ ID NO: 1330480 - protein, 9 aa, Homo Sapiens
DHREGDVGF

SEQ ID NO: 1330481 - protein, 9 aa, Homo Sapiens
EQHDLHNRL

SEQ ID NO: 1330482 - protein, 9 aa, Homo Sapiens
VPQGWMGFP

SEQ ID NO: 1330483 - protein, 9 aa, Homo Sapiens
PIQIINNTI

SEQ ID NO: 1330484 - protein, 9 aa, Homo Sapiens
VVDGDHLIT

SEQ ID NO: 1330485 - protein, 9 aa, Homo Sapiens
RKETRFGQV

SEQ ID NO: 1330486 - protein, 9 aa, Homo Sapiens
PSITPSSET

SEQ ID NO: 1330487 - protein, 9 aa, Homo Sapiens
AVASNTTRG

SEQ ID NO: 1330488 - protein, 9 aa, Homo Sapiens
YLYRSVMLE

SEQ ID NO: 1330489 - protein, 9 aa, Homo Sapiens
HYHLCGLHT

SEQ ID NO: 1330490 - protein, 9 aa, Homo Sapiens
TPSLDVTPQ

SEQ ID NO: 1330491 - protein, 9 aa, Homo Sapiens
EVGYSMHMV

SEQ ID NO: 1330492 - protein, 9 aa, Homo Sapiens
LAFFPSYLS

SEQ ID NO: 1330493 - protein, 9 aa, Homo Sapiens
EKKIYDCQI

SEQ ID NO: 1330494 - protein, 9 aa, Homo Sapiens
RDTVNQLQQ

SEQ ID NO: 1330495 - protein, 9 aa, Homo Sapiens
AAKSLLFWL

SEQ ID NO: 1330496 - protein, 9 aa, Homo Sapiens
TKGKKSKIH

SEQ ID NO: 1330497 - protein, 9 aa, Homo Sapiens
KQLQIQLDD

SEQ ID NO: 1330498 - protein, 9 aa, Homo Sapiens
TPLEVSFPQ

SEQ ID NO: 1330499 - protein, 9 aa, Homo Sapiens
QMVEIGTER

SEQ ID NO: 1330500 - protein, 9 aa, Homo Sapiens
CSTPSTDVT

SEQ ID NO: 1330501 - protein, 9 aa, Homo Sapiens
VIVALISIF

SEQ ID NO: 1330502 - protein, 9 aa, Homo Sapiens
LYLQPYNSR

SEQ ID NO: 1330503 - protein, 9 aa, Homo Sapiens
WAEWRQFNR

SEQ ID NO: 1330504 - protein, 9 aa, Homo Sapiens
DISKITPRT

SEQ ID NO: 1330505 - protein, 9 aa, Homo Sapiens
VYCQHMQEE

SEQ ID NO: 1330506 - protein, 9 aa, Homo Sapiens
FLIILPLLG

SEQ ID NO: 1330507 - protein, 9 aa, Homo Sapiens
SRIPLLRKC

SEQ ID NO: 1330508 - protein, 9 aa, Homo Sapiens
NSKEPEEVT

SEQ ID NO: 1330509 - protein, 9 aa, Homo Sapiens
DKITTVQVP

SEQ ID NO: 1330510 - protein, 9 aa, Homo Sapiens
NCSWFMHCN

SEQ ID NO: 1330511 - protein, 9 aa, Homo Sapiens
IIEATKHCN

SEQ ID NO: 1330512 - protein, 9 aa, Homo Sapiens
KRRKIVVHS

SEQ ID NO: 1330513 - protein, 9 aa, Homo Sapiens
GKLLLVCKQ

SEQ ID NO: 1330514 - protein, 9 aa, Homo Sapiens
TAQDPFQFS

SEQ ID NO: 1330515 - protein, 9 aa, Homo Sapiens
VSQTQHTSG

SEQ ID NO: 1330516 - protein, 9 aa, Homo Sapiens
TADEEKCHS

SEQ ID NO: 1330517 - protein, 9 aa, Homo Sapiens
RYIAHKHNM

SEQ ID NO: 1330518 - protein, 9 aa, Homo Sapiens
CQCIPSKVT

SEQ ID NO: 1330519 - protein, 9 aa, Homo Sapiens
ICVLAFKCP

SEQ ID NO: 1330520 - protein, 9 aa, Homo Sapiens
LQEPHLFLG

SEQ ID NO: 1330521 - protein, 9 aa, Homo Sapiens
SVRHAMWKM

SEQ ID NO: 1330522 - protein, 9 aa, Homo Sapiens
SMVLAYSGG

SEQ ID NO: 1330523 - protein, 9 aa, Homo Sapiens
TQLWATVVL

SEQ ID NO: 1330524 - protein, 9 aa, Homo Sapiens
DGIFGGILA

SEQ ID NO: 1330525 - protein, 9 aa, Homo Sapiens
PLQSLVGQY

SEQ ID NO: 1330526 - protein, 9 aa, Homo Sapiens
LAAISYDRY

SEQ ID NO: 1330527 - protein, 9 aa, Homo Sapiens
STFEIEREA

SEQ ID NO: 1330528 - protein, 9 aa, Homo Sapiens
VPMSSSGHL

SEQ ID NO: 1330529 - protein, 9 aa, Homo Sapiens
EPFQMCLVL

SEQ ID NO: 1330530 - protein, 9 aa, Homo Sapiens
GSREHVYSH

SEQ ID NO: 1330531 - protein, 9 aa, Homo Sapiens
IPITGAVII

SEQ ID NO: 1330532 - protein, 9 aa, Homo Sapiens
VRHPIFRPA

SEQ ID NO: 1330533 - protein, 9 aa, Homo Sapiens
LIQANTPAS

SEQ ID NO: 1330534 - protein, 9 aa, Homo Sapiens
TAGSLDEDE

SEQ ID NO: 1330535 - protein, 9 aa, Homo Sapiens
IDECHLLRL

SEQ ID NO: 1330536 - protein, 9 aa, Homo Sapiens
IRLREFIEC

SEQ ID NO: 1330537 - protein, 9 aa, Homo Sapiens
WCLFRNIFM

SEQ ID NO: 1330538 - protein, 9 aa, Homo Sapiens
WHPEAPTGP

SEQ ID NO: 1330539 - protein, 9 aa, Homo Sapiens
YINTSHIKV

SEQ ID NO: 1330540 - protein, 9 aa, Homo Sapiens
EGTKMAVRL

SEQ ID NO: 1330541 - protein, 9 aa, Homo Sapiens
FKAIEKPRI

SEQ ID NO: 1330542 - protein, 9 aa, Homo Sapiens
DVGPADTGR

SEQ ID NO: 1330543 - protein, 9 aa, Homo Sapiens
LSHRLHQSP

SEQ ID NO: 1330544 - protein, 9 aa, Homo Sapiens
HYAAVCKPL

SEQ ID NO: 1330545 - protein, 9 aa, Homo Sapiens
WTFPRMTPW

SEQ ID NO: 1330546 - protein, 9 aa, Homo Sapiens
DKYNTQPVG

SEQ ID NO: 1330547 - protein, 9 aa, Homo Sapiens
GNTLRIRQD

SEQ ID NO: 1330548 - protein, 9 aa, Homo Sapiens
TVSRRSSTP

SEQ ID NO: 1330549 - protein, 9 aa, Homo Sapiens
HNGKSCGLC

SEQ ID NO: 1330550 - protein, 9 aa, Homo Sapiens
YYRGTVGAL

SEQ ID NO: 1330551 - protein, 9 aa, Homo Sapiens
HLITEPLPE

SEQ ID NO: 1330552 - protein, 9 aa, Homo Sapiens
CCPEIFTMH

SEQ ID NO: 1330553 - protein, 9 aa, Homo Sapiens
VGCTEPEIW

SEQ ID NO: 1330554 - protein, 9 aa, Homo Sapiens
EPGTFDGLK

SEQ ID NO: 1330555 - protein, 9 aa, Homo Sapiens
VVVCVLLWG

SEQ ID NO: 1330556 - protein, 9 aa, Homo Sapiens
TCTSKNSSL

SEQ ID NO: 1330557 - protein, 9 aa, Homo Sapiens
LADLEGVNM

SEQ ID NO: 1330558 - protein, 9 aa, Homo Sapiens
WVQCALHFA

SEQ ID NO: 1330559 - protein, 9 aa, Homo Sapiens
SRDEKVEAG

SEQ ID NO: 1330560 - protein, 9 aa, Homo Sapiens
SSDSENMLC

SEQ ID NO: 1330561 - protein, 9 aa, Homo Sapiens
HILQLRTVT

SEQ ID NO: 1330562 - protein, 9 aa, Homo Sapiens
QGAQSWQQM

SEQ ID NO: 1330563 - protein, 9 aa, Homo Sapiens
HPEAAQMVH

SEQ ID NO: 1330564 - protein, 9 aa, Homo Sapiens
VHGDPGVQL

SEQ ID NO: 1330565 - protein, 9 aa, Homo Sapiens
HPSWPWTRC

SEQ ID NO: 1330566 - protein, 9 aa, Homo Sapiens
GVTEHMPTP

SEQ ID NO: 1330567 - protein, 9 aa, Homo Sapiens
QCLIKSDQL

SEQ ID NO: 1330568 - protein, 9 aa, Homo Sapiens
ELLWMCLHA

SEQ ID NO: 1330569 - protein, 9 aa, Homo Sapiens
VNKGCVRGL

SEQ ID NO: 1330570 - protein, 9 aa, Homo Sapiens
FEREVKHLK

SEQ ID NO: 1330571 - protein, 9 aa, Homo Sapiens
LSPPLGLHS

SEQ ID NO: 1330572 - protein, 9 aa, Homo Sapiens
GKPENEFVF

SEQ ID NO: 1330573 - protein, 9 aa, Homo Sapiens
QQYKDEEGV

SEQ ID NO: 1330574 - protein, 9 aa, Homo Sapiens
LKNGMGLEC

SEQ ID NO: 1330575 - protein, 9 aa, Homo Sapiens
TCSATGGII

SEQ ID NO: 1330576 - protein, 9 aa, Homo Sapiens
GSTDGLVMT

SEQ ID NO: 1330577 - protein, 9 aa, Homo Sapiens
HCVDKFDII

SEQ ID NO: 1330578 - protein, 9 aa, Homo Sapiens
ILRYIAHKH

SEQ ID NO: 1330579 - protein, 9 aa, Homo Sapiens
NLFMLVLGV

SEQ ID NO: 1330580 - protein, 9 aa, Homo Sapiens
QDREPLHTI

SEQ ID NO: 1330581 - protein, 9 aa, Homo Sapiens
TPNYCDQMG

SEQ ID NO: 1330582 - protein, 9 aa, Homo Sapiens
IEVLISDIN

SEQ ID NO: 1330583 - protein, 9 aa, Homo Sapiens
EYEHFSKYM

SEQ ID NO: 1330584 - protein, 9 aa, Homo Sapiens
DGEAGTEDK

SEQ ID NO: 1330585 - protein, 9 aa, Homo Sapiens
KVLNKYGKA

SEQ ID NO: 1330586 - protein, 9 aa, Homo Sapiens
GDFLKRIEC

SEQ ID NO: 1330587 - protein, 9 aa, Homo Sapiens
TGVKCVPGE

SEQ ID NO: 1330588 - protein, 9 aa, Homo Sapiens
EFDKIHSTV

SEQ ID NO: 1330589 - protein, 9 aa, Homo Sapiens
YYSHADAEN

SEQ ID NO: 1330590 - protein, 9 aa, Homo Sapiens
SKLYFNSLM

SEQ ID NO: 1330591 - protein, 9 aa, Homo Sapiens
SGFNQEANI

SEQ ID NO: 1330592 - protein, 9 aa, Homo Sapiens
ELRALRGRL

SEQ ID NO: 1330593 - protein, 9 aa, Homo Sapiens
VMLLCQNTQ

SEQ ID NO: 1330594 - protein, 9 aa, Homo Sapiens
QMSYPCFVD

SEQ ID NO: 1330595 - protein, 9 aa, Homo Sapiens
RHLTGEVAK

SEQ ID NO: 1330596 - protein, 9 aa, Homo Sapiens
RSRCMPRGG

SEQ ID NO: 1330597 - protein, 9 aa, Homo Sapiens
RAPGRASSC

SEQ ID NO: 1330598 - protein, 9 aa, Homo Sapiens
TGACALILS

SEQ ID NO: 1330599 - protein, 9 aa, Homo Sapiens
IAQQGSYTS

SEQ ID NO: 1330600 - protein, 9 aa, Homo Sapiens
GVVGAAVAT

SEQ ID NO: 1330601 - protein, 9 aa, Homo Sapiens
ALLHLLATN

SEQ ID NO: 1330602 - protein, 9 aa, Homo Sapiens
IQSIRCHYR

SEQ ID NO: 1330603 - protein, 9 aa, Homo Sapiens
IVSHSSTLD

SEQ ID NO: 1330604 - protein, 9 aa, Homo Sapiens
NNVDLWYNL

SEQ ID NO: 1330605 - protein, 9 aa, Homo Sapiens
PTSDEAPPG

SEQ ID NO: 1330606 - protein, 9 aa, Homo Sapiens
FEEQERHSQ

SEQ ID NO: 1330607 - protein, 9 aa, Homo Sapiens
ATCHNFIYE

SEQ ID NO: 1330608 - protein, 9 aa, Homo Sapiens
TFDAESPPI

SEQ ID NO: 1330609 - protein, 9 aa, Homo Sapiens
IEITAYNRH

SEQ ID NO: 1330610 - protein, 9 aa, Homo Sapiens
LEFEADRHA

SEQ ID NO: 1330611 - protein, 9 aa, Homo Sapiens
KYTQAVFLE

SEQ ID NO: 1330612 - protein, 9 aa, Homo Sapiens
GKLKKADVV

SEQ ID NO: 1330613 - protein, 9 aa, Homo Sapiens
EKRYLRMTV

SEQ ID NO: 1330614 - protein, 9 aa, Homo Sapiens
DTIEANEDM

SEQ ID NO: 1330615 - protein, 9 aa, Homo Sapiens
SKVWQKSEV

SEQ ID NO: 1330616 - protein, 9 aa, Homo Sapiens
VKILENAVP

SEQ ID NO: 1330617 - protein, 9 aa, Homo Sapiens
DADLTTEAD

SEQ ID NO: 1330618 - protein, 9 aa, Homo Sapiens
IPQKLQMSP

SEQ ID NO: 1330619 - protein, 9 aa, Homo Sapiens
ATRNVYHII

SEQ ID NO: 1330620 - protein, 9 aa, Homo Sapiens
MNPAHAFGP

SEQ ID NO: 1330621 - protein, 9 aa, Homo Sapiens
TPYNSHTVM

SEQ ID NO: 1330622 - protein, 9 aa, Homo Sapiens
AGYEAFRTP

SEQ ID NO: 1330623 - protein, 9 aa, Homo Sapiens
RPGASRRWR

SEQ ID NO: 1330624 - protein, 9 aa, Homo Sapiens
QHCLGLGVR

SEQ ID NO: 1330625 - protein, 9 aa, Homo Sapiens
CKTVVNCSS

SEQ ID NO: 1330626 - protein, 9 aa, Homo Sapiens
FGYLDILTE

SEQ ID NO: 1330627 - protein, 9 aa, Homo Sapiens
VFIAMELTG

SEQ ID NO: 1330628 - protein, 9 aa, Homo Sapiens
YDELEQIRL

SEQ ID NO: 1330629 - protein, 9 aa, Homo Sapiens
DNLRPVDID

SEQ ID NO: 1330630 - protein, 9 aa, Homo Sapiens
TEGGVCALL

SEQ ID NO: 1330631 - protein, 9 aa, Homo Sapiens
KRTHQWRTS

SEQ ID NO: 1330632 - protein, 9 aa, Homo Sapiens
ARYRKPLEL

SEQ ID NO: 1330633 - protein, 9 aa, Homo Sapiens
GMCVNTLFL

SEQ ID NO: 1330634 - protein, 9 aa, Homo Sapiens
CLKGQLCDV

SEQ ID NO: 1330635 - protein, 9 aa, Homo Sapiens
EGQCKAWAS

SEQ ID NO: 1330636 - protein, 9 aa, Homo Sapiens
ELGHMLGMQ

SEQ ID NO: 1330637 - protein, 9 aa, Homo Sapiens
PAFNVTNGG

SEQ ID NO: 1330638 - protein, 9 aa, Homo Sapiens
YFINDLYSV

SEQ ID NO: 1330639 - protein, 9 aa, Homo Sapiens
VHNFTALNG

SEQ ID NO: 1330640 - protein, 9 aa, Homo Sapiens
NDLEDNYGQ

SEQ ID NO: 1330641 - protein, 9 aa, Homo Sapiens
LTWLGYVNF

SEQ ID NO: 1330642 - protein, 9 aa, Homo Sapiens
VPMNQSQVL

SEQ ID NO: 1330643 - protein, 9 aa, Homo Sapiens
AVYLYEVSQ

SEQ ID NO: 1330644 - protein, 9 aa, Homo Sapiens
YGGSDYALA

SEQ ID NO: 1330645 - protein, 9 aa, Homo Sapiens
ERFRVVIKD

SEQ ID NO: 1330646 - protein, 9 aa, Homo Sapiens
TLEDFKEMR

SEQ ID NO: 1330647 - protein, 9 aa, Homo Sapiens
MFPSGGGKS

SEQ ID NO: 1330648 - protein, 9 aa, Homo Sapiens
MLAYSGPGS

SEQ ID NO: 1330649 - protein, 9 aa, Homo Sapiens
SLGLFLQCT

SEQ ID NO: 1330650 - protein, 9 aa, Homo Sapiens
VIAHPGCVN

SEQ ID NO: 1330651 - protein, 9 aa, Homo Sapiens
HHMAVLHGA

SEQ ID NO: 1330652 - protein, 9 aa, Homo Sapiens
PIQTPCGRG

SEQ ID NO: 1330653 - protein, 9 aa, Homo Sapiens
TINLYVDSD

SEQ ID NO: 1330654 - protein, 9 aa, Homo Sapiens
VPGTLEEVS

SEQ ID NO: 1330655 - protein, 9 aa, Homo Sapiens
PKLSKDPHF

SEQ ID NO: 1330656 - protein, 9 aa, Homo Sapiens
LTLNSNTWM

SEQ ID NO: 1330657 - protein, 9 aa, Homo Sapiens
SLPAGPSAL

SEQ ID NO: 1330658 - protein, 9 aa, Homo Sapiens
KKCPLLLVY

SEQ ID NO: 1330659 - protein, 9 aa, Homo Sapiens
ECGAPGPAG

SEQ ID NO: 1330660 - protein, 9 aa, Homo Sapiens
VASDTEEVD

SEQ ID NO: 1330661 - protein, 9 aa, Homo Sapiens
SSEGESPNF

SEQ ID NO: 1330662 - protein, 9 aa, Homo Sapiens
RAPHLLQGA

SEQ ID NO: 1330663 - protein, 9 aa, Homo Sapiens
EEDISGLHA

SEQ ID NO: 1330664 - protein, 9 aa, Homo Sapiens
SSSFSLFSF

SEQ ID NO: 1330665 - protein, 9 aa, Homo Sapiens
ESKMACVAQ

SEQ ID NO: 1330666 - protein, 9 aa, Homo Sapiens
DVDLTSIAE

SEQ ID NO: 1330667 - protein, 9 aa, Homo Sapiens
VQGRGIGPL

SEQ ID NO: 1330668 - protein, 9 aa, Homo Sapiens
QKVTSLSLD

SEQ ID NO: 1330669 - protein, 9 aa, Homo Sapiens
SLCRLYLNG

SEQ ID NO: 1330670 - protein, 9 aa, Homo Sapiens
FMKGKMMFC

SEQ ID NO: 1330671 - protein, 9 aa, Homo Sapiens
SDSESDTNS

SEQ ID NO: 1330672 - protein, 9 aa, Homo Sapiens
FCWSCHHDK

SEQ ID NO: 1330673 - protein, 9 aa, Homo Sapiens
YNHRFHRIS

SEQ ID NO: 1330674 - protein, 9 aa, Homo Sapiens
AVIVTFQLT

SEQ ID NO: 1330675 - protein, 9 aa, Homo Sapiens
FSGCCFSFA

SEQ ID NO: 1330676 - protein, 9 aa, Homo Sapiens
RSPSSAASA

SEQ ID NO: 1330677 - protein, 9 aa, Homo Sapiens
PPRIHVRSR

SEQ ID NO: 1330678 - protein, 9 aa, Homo Sapiens
LLPLVKRRR

SEQ ID NO: 1330679 - protein, 9 aa, Homo Sapiens
HIPPAKKCS

SEQ ID NO: 1330680 - protein, 9 aa, Homo Sapiens
NHIPPHTFL

SEQ ID NO: 1330681 - protein, 9 aa, Homo Sapiens
VKVLNANLS

SEQ ID NO: 1330682 - protein, 9 aa, Homo Sapiens
PHLFISQVT

SEQ ID NO: 1330683 - protein, 9 aa, Homo Sapiens
VLMSVVPSA

SEQ ID NO: 1330684 - protein, 9 aa, Homo Sapiens
NRCDLIGFE

SEQ ID NO: 1330685 - protein, 9 aa, Homo Sapiens
LMVCEKPGK

SEQ ID NO: 1330686 - protein, 9 aa, Homo Sapiens
EPSPWQGSK

SEQ ID NO: 1330687 - protein, 9 aa, Homo Sapiens
IFLLICGFR

SEQ ID NO: 1330688 - protein, 9 aa, Homo Sapiens
QQGNIFIAD

SEQ ID NO: 1330689 - protein, 9 aa, Homo Sapiens
NAQWQLIVK

SEQ ID NO: 1330690 - protein, 9 aa, Homo Sapiens
PAWALADTQ

SEQ ID NO: 1330691 - protein, 9 aa, Homo Sapiens
LSRAIGRIT

SEQ ID NO: 1330692 - protein, 9 aa, Homo Sapiens
QQALQATRQ

SEQ ID NO: 1330693 - protein, 9 aa, Homo Sapiens
VLRQARHQA

SEQ ID NO: 1330694 - protein, 9 aa, Homo Sapiens
VLEKLQSIN

SEQ ID NO: 1330695 - protein, 9 aa, Homo Sapiens
RDMFNMFCY

SEQ ID NO: 1330696 - protein, 9 aa, Homo Sapiens
KWPVDRESC

SEQ ID NO: 1330697 - protein, 9 aa, Homo Sapiens
GSDYALARL

SEQ ID NO: 1330698 - protein, 9 aa, Homo Sapiens
LALWRGDVV

SEQ ID NO: 1330699 - protein, 9 aa, Homo Sapiens
FNTYEGLVE

SEQ ID NO: 1330700 - protein, 9 aa, Homo Sapiens
EKLYVCSEC

SEQ ID NO: 1330701 - protein, 9 aa, Homo Sapiens
PVNVCCLVR

SEQ ID NO: 1330702 - protein, 9 aa, Homo Sapiens
DTILFLYCV

SEQ ID NO: 1330703 - protein, 9 aa, Homo Sapiens
YDLKEPTEE

SEQ ID NO: 1330704 - protein, 9 aa, Homo Sapiens
NNRLASYLD

SEQ ID NO: 1330705 - protein, 9 aa, Homo Sapiens
FTRLAQHFG

SEQ ID NO: 1330706 - protein, 9 aa, Homo Sapiens
MAKRQKVHE

SEQ ID NO: 1330707 - protein, 9 aa, Homo Sapiens
YLRLRHIDD

SEQ ID NO: 1330708 - protein, 9 aa, Homo Sapiens
FLIIVTSIS

SEQ ID NO: 1330709 - protein, 9 aa, Homo Sapiens
PTRTRLASR

SEQ ID NO: 1330710 - protein, 9 aa, Homo Sapiens
SVMFHLFDH

SEQ ID NO: 1330711 - protein, 9 aa, Homo Sapiens
HTRSDSENW

SEQ ID NO: 1330712 - protein, 9 aa, Homo Sapiens
EMCDKVHIS

SEQ ID NO: 1330713 - protein, 9 aa, Homo Sapiens
DSDLLRCGG

SEQ ID NO: 1330714 - protein, 9 aa, Homo Sapiens
QPAVPSSSA

SEQ ID NO: 1330715 - protein, 9 aa, Homo Sapiens
VLCHQLGCG

SEQ ID NO: 1330716 - protein, 9 aa, Homo Sapiens
TKIKAMESK

SEQ ID NO: 1330717 - protein, 9 aa, Homo Sapiens
TEHRCLVTA

SEQ ID NO: 1330718 - protein, 9 aa, Homo Sapiens
VSYCDCCLR

SEQ ID NO: 1330719 - protein, 9 aa, Homo Sapiens
KPLELFGKV

SEQ ID NO: 1330720 - protein, 9 aa, Homo Sapiens
TVAEKPNNI

SEQ ID NO: 1330721 - protein, 9 aa, Homo Sapiens
GLIIVVFVA

SEQ ID NO: 1330722 - protein, 9 aa, Homo Sapiens
QEGAHNISN

SEQ ID NO: 1330723 - protein, 9 aa, Homo Sapiens
IYFSELSVT

SEQ ID NO: 1330724 - protein, 9 aa, Homo Sapiens
HTPPHLLKE

SEQ ID NO: 1330725 - protein, 9 aa, Homo Sapiens
PPHIVEHPS

SEQ ID NO: 1330726 - protein, 9 aa, Homo Sapiens
RVWCWPDLQ

SEQ ID NO: 1330727 - protein, 9 aa, Homo Sapiens
PQMSGQPPP

SEQ ID NO: 1330728 - protein, 9 aa, Homo Sapiens
QIRNMHFLP

SEQ ID NO: 1330729 - protein, 9 aa, Homo Sapiens
GTYQIGTTA

SEQ ID NO: 1330730 - protein, 9 aa, Homo Sapiens
PFDDQNLKE

SEQ ID NO: 1330731 - protein, 9 aa, Homo Sapiens
QQPQGQGES

SEQ ID NO: 1330732 - protein, 9 aa, Homo Sapiens
KKKSRTLGN

SEQ ID NO: 1330733 - protein, 9 aa, Homo Sapiens
ILCYKFCKQ

SEQ ID NO: 1330734 - protein, 9 aa, Homo Sapiens
LTTGSLCVS

SEQ ID NO: 1330735 - protein, 9 aa, Homo Sapiens
VDAQWKEAI

SEQ ID NO: 1330736 - protein, 9 aa, Homo Sapiens
NKEKEERMW

SEQ ID NO: 1330737 - protein, 9 aa, Homo Sapiens
LQPFPVPVG

SEQ ID NO: 1330738 - protein, 9 aa, Homo Sapiens
LFSRDKLKF

SEQ ID NO: 1330739 - protein, 9 aa, Homo Sapiens
IATAICAPA

SEQ ID NO: 1330740 - protein, 9 aa, Homo Sapiens
CRTTLPASQ

SEQ ID NO: 1330741 - protein, 9 aa, Homo Sapiens
WHRLQVLRQ

SEQ ID NO: 1330742 - protein, 9 aa, Homo Sapiens
TPVFTLPEY

SEQ ID NO: 1330743 - protein, 9 aa, Homo Sapiens
VCTKAPKDP

SEQ ID NO: 1330744 - protein, 9 aa, Homo Sapiens
QAFEISLYD

SEQ ID NO: 1330745 - protein, 9 aa, Homo Sapiens
TALLHAGLS

SEQ ID NO: 1330746 - protein, 9 aa, Homo Sapiens
PPAKKQRKP

SEQ ID NO: 1330747 - protein, 9 aa, Homo Sapiens
VRDTVNQLQ

SEQ ID NO: 1330748 - protein, 9 aa, Homo Sapiens
VQFLEAQII

SEQ ID NO: 1330749 - protein, 9 aa, Homo Sapiens
LIGEHHDVV

SEQ ID NO: 1330750 - protein, 9 aa, Homo Sapiens
GQIWRGQQR

SEQ ID NO: 1330751 - protein, 9 aa, Homo Sapiens
SESQNVPSI

SEQ ID NO: 1330752 - protein, 9 aa, Homo Sapiens
QHKFYLETQ

SEQ ID NO: 1330753 - protein, 9 aa, Homo Sapiens
TSSNTLSLW

SEQ ID NO: 1330754 - protein, 9 aa, Homo Sapiens
RLGLLVPRL

SEQ ID NO: 1330755 - protein, 9 aa, Homo Sapiens
SAAVGPLGS

SEQ ID NO: 1330756 - protein, 9 aa, Homo Sapiens
CRFPNCFRS

SEQ ID NO: 1330757 - protein, 9 aa, Homo Sapiens
DILDDLYWT

SEQ ID NO: 1330758 - protein, 9 aa, Homo Sapiens
PTHVPWLLA

SEQ ID NO: 1330759 - protein, 9 aa, Homo Sapiens
NIDRTPESA

SEQ ID NO: 1330760 - protein, 9 aa, Homo Sapiens
RPLPAAIHT

SEQ ID NO: 1330761 - protein, 9 aa, Homo Sapiens
PTVFPKTNV

SEQ ID NO: 1330762 - protein, 9 aa, Homo Sapiens
GIKHMKFWC

SEQ ID NO: 1330763 - protein, 9 aa, Homo Sapiens
AVTDPQYRA

SEQ ID NO: 1330764 - protein, 9 aa, Homo Sapiens
DYSGRLIVC

SEQ ID NO: 1330765 - protein, 9 aa, Homo Sapiens
RKTQSNIHD

SEQ ID NO: 1330766 - protein, 9 aa, Homo Sapiens
PQFLLPGPA

SEQ ID NO: 1330767 - protein, 9 aa, Homo Sapiens
PHMTSPFIS

SEQ ID NO: 1330768 - protein, 9 aa, Homo Sapiens
LMFSPTHPG

SEQ ID NO: 1330769 - protein, 9 aa, Homo Sapiens
NNDMTLLKL

SEQ ID NO: 1330770 - protein, 9 aa, Homo Sapiens
ISLSEDVRH

SEQ ID NO: 1330771 - protein, 9 aa, Homo Sapiens
KFRDSLKHF

SEQ ID NO: 1330772 - protein, 9 aa, Homo Sapiens
TVSEKKNFC

SEQ ID NO: 1330773 - protein, 9 aa, Homo Sapiens
SCLSSGFTG

SEQ ID NO: 1330774 - protein, 9 aa, Homo Sapiens
PREVVTRFL

SEQ ID NO: 1330775 - protein, 9 aa, Homo Sapiens
WVVLKNNVL

SEQ ID NO: 1330776 - protein, 9 aa, Homo Sapiens
QIFFRWHYQ

SEQ ID NO: 1330777 - protein, 9 aa, Homo Sapiens
TRYKKRDNY

SEQ ID NO: 1330778 - protein, 9 aa, Homo Sapiens
QRMFEYFQT

SEQ ID NO: 1330779 - protein, 9 aa, Homo Sapiens
TMDLSIRTP

SEQ ID NO: 1330780 - protein, 9 aa, Homo Sapiens
EEDDYDITL

SEQ ID NO: 1330781 - protein, 9 aa, Homo Sapiens
LDIYFSELS

SEQ ID NO: 1330782 - protein, 9 aa, Homo Sapiens
MTSGKIKKV

SEQ ID NO: 1330783 - protein, 9 aa, Homo Sapiens
HRKRPPRQK

SEQ ID NO: 1330784 - protein, 9 aa, Homo Sapiens
QQVLVHLAQ

SEQ ID NO: 1330785 - protein, 9 aa, Homo Sapiens
MLNAIPKHL

SEQ ID NO: 1330786 - protein, 9 aa, Homo Sapiens
WPSLLCMHE

SEQ ID NO: 1330787 - protein, 9 aa, Homo Sapiens
DGKVLHTIR

SEQ ID NO: 1330788 - protein, 9 aa, Homo Sapiens
SITTGKNGY

SEQ ID NO: 1330789 - protein, 9 aa, Homo Sapiens
LPHSLDFTE

SEQ ID NO: 1330790 - protein, 9 aa, Homo Sapiens
DLLRQMKTT

SEQ ID NO: 1330791 - protein, 9 aa, Homo Sapiens
TELSVCAKP

SEQ ID NO: 1330792 - protein, 9 aa, Homo Sapiens
DLLYLTPML

SEQ ID NO: 1330793 - protein, 9 aa, Homo Sapiens
ALLSSHDNA

SEQ ID NO: 1330794 - protein, 9 aa, Homo Sapiens
QANNYNISN

SEQ ID NO: 1330795 - protein, 9 aa, Homo Sapiens
CGKPFNHFS

SEQ ID NO: 1330796 - protein, 9 aa, Homo Sapiens
MDADEDMTK

SEQ ID NO: 1330797 - protein, 9 aa, Homo Sapiens
MKKIYYRSA

SEQ ID NO: 1330798 - protein, 9 aa, Homo Sapiens
LWPALDPSS

SEQ ID NO: 1330799 - protein, 9 aa, Homo Sapiens
ICWLPYHVT

SEQ ID NO: 1330800 - protein, 9 aa, Homo Sapiens
ICQYVVQVI

SEQ ID NO: 1330801 - protein, 9 aa, Homo Sapiens
QLTASDHKN

SEQ ID NO: 1330802 - protein, 9 aa, Homo Sapiens
LFLLFHSRQ

SEQ ID NO: 1330803 - protein, 9 aa, Homo Sapiens
RGYMPSGDV

SEQ ID NO: 1330804 - protein, 9 aa, Homo Sapiens
AKTTSRSGC

SEQ ID NO: 1330805 - protein, 9 aa, Homo Sapiens
SIRHSLSLH

SEQ ID NO: 1330806 - protein, 9 aa, Homo Sapiens
RPKSHPKAE

SEQ ID NO: 1330807 - protein, 9 aa, Homo Sapiens
EPGTFLIRP

SEQ ID NO: 1330808 - protein, 9 aa, Homo Sapiens
KITTESFDP

SEQ ID NO: 1330809 - protein, 9 aa, Homo Sapiens
IVQLSSALH

SEQ ID NO: 1330810 - protein, 9 aa, Homo Sapiens
NVPTFTQTS

SEQ ID NO: 1330811 - protein, 9 aa, Homo Sapiens
RQEPLPAWG

SEQ ID NO: 1330812 - protein, 9 aa, Homo Sapiens
TQAHSSYLA

SEQ ID NO: 1330813 - protein, 9 aa, Homo Sapiens
PQQLYHLDT

SEQ ID NO: 1330814 - protein, 9 aa, Homo Sapiens
IIIILMYRR

SEQ ID NO: 1330815 - protein, 9 aa, Homo Sapiens
TDLEVITNC

SEQ ID NO: 1330816 - protein, 9 aa, Homo Sapiens
NGAVIMAVW

SEQ ID NO: 1330817 - protein, 9 aa, Homo Sapiens
EENGWLLGQ

SEQ ID NO: 1330818 - protein, 9 aa, Homo Sapiens
APKDPAVCL

SEQ ID NO: 1330819 - protein, 9 aa, Homo Sapiens
DHFFITPRQ

SEQ ID NO: 1330820 - protein, 9 aa, Homo Sapiens
NQFLILNKH

SEQ ID NO: 1330821 - protein, 9 aa, Homo Sapiens
GNGKVYPTV

SEQ ID NO: 1330822 - protein, 9 aa, Homo Sapiens
RSKKILPLG

SEQ ID NO: 1330823 - protein, 9 aa, Homo Sapiens
PKCQKSSTK

SEQ ID NO: 1330824 - protein, 9 aa, Homo Sapiens
VDFLSERCM

SEQ ID NO: 1330825 - protein, 9 aa, Homo Sapiens
GRVLRKAIA

SEQ ID NO: 1330826 - protein, 9 aa, Homo Sapiens
VKAHDNSCP

SEQ ID NO: 1330827 - protein, 9 aa, Homo Sapiens
VPLMSPQSS

SEQ ID NO: 1330828 - protein, 9 aa, Homo Sapiens
TQDMQVDET

SEQ ID NO: 1330829 - protein, 9 aa, Homo Sapiens
RGIIGLPGQ

SEQ ID NO: 1330830 - protein, 9 aa, Homo Sapiens
TGHSSLNMH

SEQ ID NO: 1330831 - protein, 9 aa, Homo Sapiens
SKAGEYIRV

SEQ ID NO: 1330832 - protein, 9 aa, Homo Sapiens
RRKITVVEE

SEQ ID NO: 1330833 - protein, 9 aa, Homo Sapiens
IDKKCPDYA

SEQ ID NO: 1330834 - protein, 9 aa, Homo Sapiens
LRQMKTTKE

SEQ ID NO: 1330835 - protein, 9 aa, Homo Sapiens
EWRQGGSPV

SEQ ID NO: 1330836 - protein, 9 aa, Homo Sapiens
KKAEYEERT

SEQ ID NO: 1330837 - protein, 9 aa, Homo Sapiens
RIQEGAHNI

SEQ ID NO: 1330838 - protein, 9 aa, Homo Sapiens
VDLEYVNDN

SEQ ID NO: 1330839 - protein, 9 aa, Homo Sapiens
SLTKASILK

SEQ ID NO: 1330840 - protein, 9 aa, Homo Sapiens
LEMTLKDDR

SEQ ID NO: 1330841 - protein, 9 aa, Homo Sapiens
GPKEPLEND

SEQ ID NO: 1330842 - protein, 9 aa, Homo Sapiens
QLQINKIIP

SEQ ID NO: 1330843 - protein, 9 aa, Homo Sapiens
INCFESAEE

SEQ ID NO: 1330844 - protein, 9 aa, Homo Sapiens
VSHKNAKYL

SEQ ID NO: 1330845 - protein, 9 aa, Homo Sapiens
SQLMQSSGH

SEQ ID NO: 1330846 - protein, 9 aa, Homo Sapiens
STVCAINEK

SEQ ID NO: 1330847 - protein, 9 aa, Homo Sapiens
NLFSLWVMC

SEQ ID NO: 1330848 - protein, 9 aa, Homo Sapiens
PMVPQGWMG

SEQ ID NO: 1330849 - protein, 9 aa, Homo Sapiens
ALQEVQQIH

SEQ ID NO: 1330850 - protein, 9 aa, Homo Sapiens
RWPIVGVHL

SEQ ID NO: 1330851 - protein, 9 aa, Homo Sapiens
RTQASRSTV

SEQ ID NO: 1330852 - protein, 9 aa, Homo Sapiens
TFANLLNKP

SEQ ID NO: 1330853 - protein, 9 aa, Homo Sapiens
SCRELDNNC

SEQ ID NO: 1330854 - protein, 9 aa, Homo Sapiens
YVLRMGPPL

SEQ ID NO: 1330855 - protein, 9 aa, Homo Sapiens
PAFSGRILH

SEQ ID NO: 1330856 - protein, 9 aa, Homo Sapiens
KITLGVQLR

SEQ ID NO: 1330857 - protein, 9 aa, Homo Sapiens
YVKDIPSTL

SEQ ID NO: 1330858 - protein, 9 aa, Homo Sapiens
QCLEDHTWV

SEQ ID NO: 1330859 - protein, 9 aa, Homo Sapiens
PQALHRVTL

SEQ ID NO: 1330860 - protein, 9 aa, Homo Sapiens
VKLLGEQHY

SEQ ID NO: 1330861 - protein, 9 aa, Homo Sapiens
TIKKIMKRI

SEQ ID NO: 1330862 - protein, 9 aa, Homo Sapiens
RVFRGANTF

SEQ ID NO: 1330863 - protein, 9 aa, Homo Sapiens
ESPNFPEEL

SEQ ID NO: 1330864 - protein, 9 aa, Homo Sapiens
RTVVTLDKV

SEQ ID NO: 1330865 - protein, 9 aa, Homo Sapiens
LQRQKKIFF

SEQ ID NO: 1330866 - protein, 9 aa, Homo Sapiens
NAHPLWKWM

SEQ ID NO: 1330867 - protein, 9 aa, Homo Sapiens
AVKKKAALQ

SEQ ID NO: 1330868 - protein, 9 aa, Homo Sapiens
MQSSGHSGS

SEQ ID NO: 1330869 - protein, 9 aa, Homo Sapiens
TFFTAAFVC

SEQ ID NO: 1330870 - protein, 9 aa, Homo Sapiens
QVVPPEWRT

SEQ ID NO: 1330871 - protein, 9 aa, Homo Sapiens
LLLNVQPHH

SEQ ID NO: 1330872 - protein, 9 aa, Homo Sapiens
SIPENDRLA

SEQ ID NO: 1330873 - protein, 9 aa, Homo Sapiens
FMVTGRQED

SEQ ID NO: 1330874 - protein, 9 aa, Homo Sapiens
YTECVEHLS

SEQ ID NO: 1330875 - protein, 9 aa, Homo Sapiens
IRALLHLYQ

SEQ ID NO: 1330876 - protein, 9 aa, Homo Sapiens
QQVQFYEMI

SEQ ID NO: 1330877 - protein, 9 aa, Homo Sapiens
RLPGHRHST

SEQ ID NO: 1330878 - protein, 9 aa, Homo Sapiens
HSILSGASW

SEQ ID NO: 1330879 - protein, 9 aa, Homo Sapiens
VSKRKLGCH

SEQ ID NO: 1330880 - protein, 9 aa, Homo Sapiens
EIYEDILFF

SEQ ID NO: 1330881 - protein, 9 aa, Homo Sapiens
EPDLGDAVP

SEQ ID NO: 1330882 - protein, 9 aa, Homo Sapiens
IKGQVSVKG

SEQ ID NO: 1330883 - protein, 9 aa, Homo Sapiens
AGLQFWEGP

SEQ ID NO: 1330884 - protein, 9 aa, Homo Sapiens
TFFEDLKQC

SEQ ID NO: 1330885 - protein, 9 aa, Homo Sapiens
AWKHHYIAC

SEQ ID NO: 1330886 - protein, 9 aa, Homo Sapiens
LTAATGECH

SEQ ID NO: 1330887 - protein, 9 aa, Homo Sapiens
IFVQGPAWQ

SEQ ID NO: 1330888 - protein, 9 aa, Homo Sapiens
EPGTWMCYN

SEQ ID NO: 1330889 - protein, 9 aa, Homo Sapiens
AATRPSTCT

SEQ ID NO: 1330890 - protein, 9 aa, Homo Sapiens
RNIRLVSVL

SEQ ID NO: 1330891 - protein, 9 aa, Homo Sapiens
SFGQDILDD

SEQ ID NO: 1330892 - protein, 9 aa, Homo Sapiens
ECGKSFSWC

SEQ ID NO: 1330893 - protein, 9 aa, Homo Sapiens
SIFDLQKTS

SEQ ID NO: 1330894 - protein, 9 aa, Homo Sapiens
KQLVILLMS

SEQ ID NO: 1330895 - protein, 9 aa, Homo Sapiens
MNHTLFSLN

SEQ ID NO: 1330896 - protein, 9 aa, Homo Sapiens
IFGFTIDNT

SEQ ID NO: 1330897 - protein, 9 aa, Homo Sapiens
QSHQESTCG

SEQ ID NO: 1330898 - protein, 9 aa, Homo Sapiens
WALTWTFPR

SEQ ID NO: 1330899 - protein, 9 aa, Homo Sapiens
PQDLGSAYY

SEQ ID NO: 1330900 - protein, 9 aa, Homo Sapiens
HSPGVMVTQ

SEQ ID NO: 1330901 - protein, 9 aa, Homo Sapiens
GDTGSTGPG

SEQ ID NO: 1330902 - protein, 9 aa, Homo Sapiens
LDYEDKFSD

SEQ ID NO: 1330903 - protein, 9 aa, Homo Sapiens
NNKRCYSFR

SEQ ID NO: 1330904 - protein, 9 aa, Homo Sapiens
AAGEKCTKE

SEQ ID NO: 1330905 - protein, 9 aa, Homo Sapiens
DMKKSGGGD

SEQ ID NO: 1330906 - protein, 9 aa, Homo Sapiens
YIHQKSFSC

SEQ ID NO: 1330907 - protein, 9 aa, Homo Sapiens
MCAAVSFIC

SEQ ID NO: 1330908 - protein, 9 aa, Homo Sapiens
AMVILCHFR

SEQ ID NO: 1330909 - protein, 9 aa, Homo Sapiens
AQGLHKMFG

SEQ ID NO: 1330910 - protein, 9 aa, Homo Sapiens
YSCMQRLGT

SEQ ID NO: 1330911 - protein, 9 aa, Homo Sapiens
TIFGKVTGE

SEQ ID NO: 1330912 - protein, 9 aa, Homo Sapiens
TQPVGNWSD

SEQ ID NO: 1330913 - protein, 9 aa, Homo Sapiens
LTWMRPKKC

SEQ ID NO: 1330914 - protein, 9 aa, Homo Sapiens
LYQEGTKMA

SEQ ID NO: 1330915 - protein, 9 aa, Homo Sapiens
SPAADNHSL

SEQ ID NO: 1330916 - protein, 9 aa, Homo Sapiens
SIPAHKAHQ

SEQ ID NO: 1330917 - protein, 9 aa, Homo Sapiens
EREEIMKQI

SEQ ID NO: 1330918 - protein, 9 aa, Homo Sapiens
QLEKEDTVE

SEQ ID NO: 1330919 - protein, 9 aa, Homo Sapiens
WVLPFASGG

SEQ ID NO: 1330920 - protein, 9 aa, Homo Sapiens
HIWQYVYSK

SEQ ID NO: 1330921 - protein, 9 aa, Homo Sapiens
KKVFRASVD

SEQ ID NO: 1330922 - protein, 9 aa, Homo Sapiens
VEIAGRLGP

SEQ ID NO: 1330923 - protein, 9 aa, Homo Sapiens
IYCNFNQLY

SEQ ID NO: 1330924 - protein, 9 aa, Homo Sapiens
MHRPEKDRY

SEQ ID NO: 1330925 - protein, 9 aa, Homo Sapiens
QPDLTVSQT

SEQ ID NO: 1330926 - protein, 9 aa, Homo Sapiens
VRALLGPGA

SEQ ID NO: 1330927 - protein, 9 aa, Homo Sapiens
HGPNLILCS

SEQ ID NO: 1330928 - protein, 9 aa, Homo Sapiens
THREPVSDY

SEQ ID NO: 1330929 - protein, 9 aa, Homo Sapiens
VTSLPSSGF

SEQ ID NO: 1330930 - protein, 9 aa, Homo Sapiens
DLRQDRPVS

SEQ ID NO: 1330931 - protein, 9 aa, Homo Sapiens
GTKLLDSQG

SEQ ID NO: 1330932 - protein, 9 aa, Homo Sapiens
LHTYMRSFG

SEQ ID NO: 1330933 - protein, 9 aa, Homo Sapiens
SFIQGAEKF

SEQ ID NO: 1330934 - protein, 9 aa, Homo Sapiens
GPDSVVVYV

SEQ ID NO: 1330935 - protein, 9 aa, Homo Sapiens
LPLEARKDL

SEQ ID NO: 1330936 - protein, 9 aa, Homo Sapiens
GAYLKDKMC

SEQ ID NO: 1330937 - protein, 9 aa, Homo Sapiens
RGMTPFMSV

SEQ ID NO: 1330938 - protein, 9 aa, Homo Sapiens
AVACSTTIN

SEQ ID NO: 1330939 - protein, 9 aa, Homo Sapiens
GLGQVVCSI

SEQ ID NO: 1330940 - protein, 9 aa, Homo Sapiens
FDIEWRDRH

SEQ ID NO: 1330941 - protein, 9 aa, Homo Sapiens
CSKYIELPY

SEQ ID NO: 1330942 - protein, 9 aa, Homo Sapiens
GKITGIKDQ

SEQ ID NO: 1330943 - protein, 9 aa, Homo Sapiens
SEKGGKVLV

SEQ ID NO: 1330944 - protein, 9 aa, Homo Sapiens
EPFATGDLG

SEQ ID NO: 1330945 - protein, 9 aa, Homo Sapiens
HFSFAFSFP

SEQ ID NO: 1330946 - protein, 9 aa, Homo Sapiens
EKQRWLLYN

SEQ ID NO: 1330947 - protein, 9 aa, Homo Sapiens
ILISDVVMF

SEQ ID NO: 1330948 - protein, 9 aa, Homo Sapiens
SEVKVLNAN

SEQ ID NO: 1330949 - protein, 9 aa, Homo Sapiens
PSSFMLPIH

SEQ ID NO: 1330950 - protein, 9 aa, Homo Sapiens
TNLMDRQAR

SEQ ID NO: 1330951 - protein, 9 aa, Homo Sapiens
VCTYHTPAA

SEQ ID NO: 1330952 - protein, 9 aa, Homo Sapiens
YSAIKTISL

SEQ ID NO: 1330953 - protein, 9 aa, Homo Sapiens
NFIALEIVD

SEQ ID NO: 1330954 - protein, 9 aa, Homo Sapiens
ESLMSHVIE

SEQ ID NO: 1330955 - protein, 9 aa, Homo Sapiens
LTESEMEYV

SEQ ID NO: 1330956 - protein, 9 aa, Homo Sapiens
QLVTQQVAQ

SEQ ID NO: 1330957 - protein, 9 aa, Homo Sapiens
FSENHQDYF

SEQ ID NO: 1330958 - protein, 9 aa, Homo Sapiens
PLDESTIVV

SEQ ID NO: 1330959 - protein, 9 aa, Homo Sapiens
VIVERIPQG

SEQ ID NO: 1330960 - protein, 9 aa, Homo Sapiens
RMIHDLTKQ

SEQ ID NO: 1330961 - protein, 9 aa, Homo Sapiens
DEHGCLLRR

SEQ ID NO: 1330962 - protein, 9 aa, Homo Sapiens
LIPHHSAGC

SEQ ID NO: 1330963 - protein, 9 aa, Homo Sapiens
GRLEAKEGE

SEQ ID NO: 1330964 - protein, 9 aa, Homo Sapiens
LVIISDALE

SEQ ID NO: 1330965 - protein, 9 aa, Homo Sapiens
IICLASKDH

SEQ ID NO: 1330966 - protein, 9 aa, Homo Sapiens
RFRDNHMDR

SEQ ID NO: 1330967 - protein, 9 aa, Homo Sapiens
LILRQFRAA

SEQ ID NO: 1330968 - protein, 9 aa, Homo Sapiens
HQWRTSTTN

SEQ ID NO: 1330969 - protein, 9 aa, Homo Sapiens
HVKEPHLRF

SEQ ID NO: 1330970 - protein, 9 aa, Homo Sapiens
LLTDQRSPY

SEQ ID NO: 1330971 - protein, 9 aa, Homo Sapiens
QHDDISRLT

SEQ ID NO: 1330972 - protein, 9 aa, Homo Sapiens
MDLNHPESI

SEQ ID NO: 1330973 - protein, 9 aa, Homo Sapiens
LNGIHFDPE

SEQ ID NO: 1330974 - protein, 9 aa, Homo Sapiens
EIQGLPITS

SEQ ID NO: 1330975 - protein, 9 aa, Homo Sapiens
FPNMYPGER

SEQ ID NO: 1330976 - protein, 9 aa, Homo Sapiens
KSLHIVERE

SEQ ID NO: 1330977 - protein, 9 aa, Homo Sapiens
IALFFYFRA

SEQ ID NO: 1330978 - protein, 9 aa, Homo Sapiens
AWPFITVPL

SEQ ID NO: 1330979 - protein, 9 aa, Homo Sapiens
NECGNVFYV

SEQ ID NO: 1330980 - protein, 9 aa, Homo Sapiens
HLARASRDV

SEQ ID NO: 1330981 - protein, 9 aa, Homo Sapiens
YQLNKHLPS

SEQ ID NO: 1330982 - protein, 9 aa, Homo Sapiens
RFTLRRMEE

SEQ ID NO: 1330983 - protein, 9 aa, Homo Sapiens
TEFYLLAAI

SEQ ID NO: 1330984 - protein, 9 aa, Homo Sapiens
YIVESLIQL

SEQ ID NO: 1330985 - protein, 9 aa, Homo Sapiens
YTWKKIMWL

SEQ ID NO: 1330986 - protein, 9 aa, Homo Sapiens
VRILHGGMV

SEQ ID NO: 1330987 - protein, 9 aa, Homo Sapiens
LQPGEKKSQ

SEQ ID NO: 1330988 - protein, 9 aa, Homo Sapiens
HPLPASGKT

SEQ ID NO: 1330989 - protein, 9 aa, Homo Sapiens
NSQLMEQLW

SEQ ID NO: 1330990 - protein, 9 aa, Homo Sapiens
YSMSTPFLS

SEQ ID NO: 1330991 - protein, 9 aa, Homo Sapiens
PASQRSSAC

SEQ ID NO: 1330992 - protein, 9 aa, Homo Sapiens
VSRGDQVAH

SEQ ID NO: 1330993 - protein, 9 aa, Homo Sapiens
CRLYLNGNY

SEQ ID NO: 1330994 - protein, 9 aa, Homo Sapiens
VGVPKGGPR

SEQ ID NO: 1330995 - protein, 9 aa, Homo Sapiens
DKASAKVLG

SEQ ID NO: 1330996 - protein, 9 aa, Homo Sapiens
GLHPLWPTP

SEQ ID NO: 1330997 - protein, 9 aa, Homo Sapiens
NCVHKVAER

SEQ ID NO: 1330998 - protein, 9 aa, Homo Sapiens
RPSPCLSWS

SEQ ID NO: 1330999 - protein, 9 aa, Homo Sapiens
YRGPETNPQ

SEQ ID NO: 1331000 - protein, 9 aa, Homo Sapiens
VWKPPLVDN

SEQ ID NO: 1331001 - protein, 9 aa, Homo Sapiens
DRPNLELLS

SEQ ID NO: 1331002 - protein, 9 aa, Homo Sapiens
LICGFRQVK

SEQ ID NO: 1331003 - protein, 9 aa, Homo Sapiens
LTSPQVYNN

SEQ ID NO: 1331004 - protein, 9 aa, Homo Sapiens
MNGRYSVKV

SEQ ID NO: 1331005 - protein, 9 aa, Homo Sapiens
AVSVQSWFD

SEQ ID NO: 1331006 - protein, 9 aa, Homo Sapiens
EATEMQLPI

SEQ ID NO: 1331007 - protein, 9 aa, Homo Sapiens
RGSREHVYS

SEQ ID NO: 1331008 - protein, 9 aa, Homo Sapiens
GWRRRHRAV

SEQ ID NO: 1331009 - protein, 9 aa, Homo Sapiens
EHKIIHTGK

SEQ ID NO: 1331010 - protein, 9 aa, Homo Sapiens
LGGFQIHPT

SEQ ID NO: 1331011 - protein, 9 aa, Homo Sapiens
GRSLYNWGF

SEQ ID NO: 1331012 - protein, 9 aa, Homo Sapiens
FQCCDCGPG

SEQ ID NO: 1331013 - protein, 9 aa, Homo Sapiens
SMPGSHFVA

SEQ ID NO: 1331014 - protein, 9 aa, Homo Sapiens
MSHMHKNGD

SEQ ID NO: 1331015 - protein, 9 aa, Homo Sapiens
LGCQQYIQF

SEQ ID NO: 1331016 - protein, 9 aa, Homo Sapiens
IRNKDRPVM

SEQ ID NO: 1331017 - protein, 9 aa, Homo Sapiens
QVSTLFGNI

SEQ ID NO: 1331018 - protein, 9 aa, Homo Sapiens
HGCLLRRTL

SEQ ID NO: 1331019 - protein, 9 aa, Homo Sapiens
RTGRCVSAC

SEQ ID NO: 1331020 - protein, 9 aa, Homo Sapiens
NKPGWFFKK

SEQ ID NO: 1331021 - protein, 9 aa, Homo Sapiens
LGAQQKIPK

SEQ ID NO: 1331022 - protein, 9 aa, Homo Sapiens
YGHTAPGTD

SEQ ID NO: 1331023 - protein, 9 aa, Homo Sapiens
FYMKRNSRR

SEQ ID NO: 1331024 - protein, 9 aa, Homo Sapiens
AKTTSEMVL

SEQ ID NO: 1331025 - protein, 9 aa, Homo Sapiens
FTIPLEIMQ

SEQ ID NO: 1331026 - protein, 9 aa, Homo Sapiens
KPTSMDGPG

SEQ ID NO: 1331027 - protein, 9 aa, Homo Sapiens
QRQRQQQQR

SEQ ID NO: 1331028 - protein, 9 aa, Homo Sapiens
WKGNELQHC

SEQ ID NO: 1331029 - protein, 9 aa, Homo Sapiens
LRMTVLTLY

SEQ ID NO: 1331030 - protein, 9 aa, Homo Sapiens
PDSLHREFM

SEQ ID NO: 1331031 - protein, 9 aa, Homo Sapiens
RPLGEPSAS

SEQ ID NO: 1331032 - protein, 9 aa, Homo Sapiens
RSKERRWSR

SEQ ID NO: 1331033 - protein, 9 aa, Homo Sapiens
SVAPYPSTC

SEQ ID NO: 1331034 - protein, 9 aa, Homo Sapiens
NTKFTIPDF

SEQ ID NO: 1331035 - protein, 9 aa, Homo Sapiens
KDPPAMRRP

SEQ ID NO: 1331036 - protein, 9 aa, Homo Sapiens
IITLLDPRL

SEQ ID NO: 1331037 - protein, 9 aa, Homo Sapiens
YPLTGMSPI

SEQ ID NO: 1331038 - protein, 9 aa, Homo Sapiens
QGELLSRVF

SEQ ID NO: 1331039 - protein, 9 aa, Homo Sapiens
DLAHLHMEI

SEQ ID NO: 1331040 - protein, 9 aa, Homo Sapiens
HTHDEIVLL

SEQ ID NO: 1331041 - protein, 9 aa, Homo Sapiens
MSSGDVWIV

SEQ ID NO: 1331042 - protein, 9 aa, Homo Sapiens
TGECHDALY

SEQ ID NO: 1331043 - protein, 9 aa, Homo Sapiens
ILHINSKGC

SEQ ID NO: 1331044 - protein, 9 aa, Homo Sapiens
AEERAPSRQ

SEQ ID NO: 1331045 - protein, 9 aa, Homo Sapiens
TCHHPSYAQ

SEQ ID NO: 1331046 - protein, 9 aa, Homo Sapiens
TDTYQAFKA

SEQ ID NO: 1331047 - protein, 9 aa, Homo Sapiens
AYMEGESLL

SEQ ID NO: 1331048 - protein, 9 aa, Homo Sapiens
HIQRAISLS

SEQ ID NO: 1331049 - protein, 9 aa, Homo Sapiens
SVCLSGYLR

SEQ ID NO: 1331050 - protein, 9 aa, Homo Sapiens
SITQFVTSL

SEQ ID NO: 1331051 - protein, 9 aa, Homo Sapiens
SLMSVCGWS

SEQ ID NO: 1331052 - protein, 9 aa, Homo Sapiens
PDDIRHIRA

SEQ ID NO: 1331053 - protein, 9 aa, Homo Sapiens
GNLLCRYTF

SEQ ID NO: 1331054 - protein, 9 aa, Homo Sapiens
HHTLPPAPE

SEQ ID NO: 1331055 - protein, 9 aa, Homo Sapiens
PFYLRLSFN

SEQ ID NO: 1331056 - protein, 9 aa, Homo Sapiens
LLVYIMSTT

SEQ ID NO: 1331057 - protein, 9 aa, Homo Sapiens
ECVEPDRLL

SEQ ID NO: 1331058 - protein, 9 aa, Homo Sapiens
PIIIVGDDC

SEQ ID NO: 1331059 - protein, 9 aa, Homo Sapiens
IWTADMVPN

SEQ ID NO: 1331060 - protein, 9 aa, Homo Sapiens
ASTHMVLIS

SEQ ID NO: 1331061 - protein, 9 aa, Homo Sapiens
KGRQCEWCS

SEQ ID NO: 1331062 - protein, 9 aa, Homo Sapiens
RFFITSTGA

SEQ ID NO: 1331063 - protein, 9 aa, Homo Sapiens
IRSLQIDSS

SEQ ID NO: 1331064 - protein, 9 aa, Homo Sapiens
LVVIVALIS

SEQ ID NO: 1331065 - protein, 9 aa, Homo Sapiens
FIFFQCLYG

SEQ ID NO: 1331066 - protein, 9 aa, Homo Sapiens
QRRHTWASG

SEQ ID NO: 1331067 - protein, 9 aa, Homo Sapiens
STRFFAKKQ

SEQ ID NO: 1331068 - protein, 9 aa, Homo Sapiens
HAVDRDTSS

SEQ ID NO: 1331069 - protein, 9 aa, Homo Sapiens
HPFTCSVED

SEQ ID NO: 1331070 - protein, 9 aa, Homo Sapiens
GQGRGVEKS

SEQ ID NO: 1331071 - protein, 9 aa, Homo Sapiens
DVEAAMRYV

SEQ ID NO: 1331072 - protein, 9 aa, Homo Sapiens
LTLWHVVDE

SEQ ID NO: 1331073 - protein, 9 aa, Homo Sapiens
KQGPCMSVA

SEQ ID NO: 1331074 - protein, 9 aa, Homo Sapiens
PPRALAAGA

SEQ ID NO: 1331075 - protein, 9 aa, Homo Sapiens
VLSIDADVF

SEQ ID NO: 1331076 - protein, 9 aa, Homo Sapiens
PEVWVLHSI

SEQ ID NO: 1331077 - protein, 9 aa, Homo Sapiens
CTGEGNIIE

SEQ ID NO: 1331078 - protein, 9 aa, Homo Sapiens
IGTTSHKDV

SEQ ID NO: 1331079 - protein, 9 aa, Homo Sapiens
DSDGPDDKN

SEQ ID NO: 1331080 - protein, 9 aa, Homo Sapiens
GNDTLLFLI

SEQ ID NO: 1331081 - protein, 9 aa, Homo Sapiens
DEKIAYRDV

SEQ ID NO: 1331082 - protein, 9 aa, Homo Sapiens
EEELWFNTD

SEQ ID NO: 1331083 - protein, 9 aa, Homo Sapiens
TGIMGSAGG

SEQ ID NO: 1331084 - protein, 9 aa, Homo Sapiens
NFFKTIAEV

SEQ ID NO: 1331085 - protein, 9 aa, Homo Sapiens
DAWARCEGQ

SEQ ID NO: 1331086 - protein, 9 aa, Homo Sapiens
NVMPMLNPL

SEQ ID NO: 1331087 - protein, 9 aa, Homo Sapiens
EVDLEHTFT

SEQ ID NO: 1331088 - protein, 9 aa, Homo Sapiens
EELRRCEEN

SEQ ID NO: 1331089 - protein, 9 aa, Homo Sapiens
LFIHYLANV

SEQ ID NO: 1331090 - protein, 9 aa, Homo Sapiens
KYQESDHKV

SEQ ID NO: 1331091 - protein, 9 aa, Homo Sapiens
AHGDASKVT

SEQ ID NO: 1331092 - protein, 9 aa, Homo Sapiens
NRGKDTNDS

SEQ ID NO: 1331093 - protein, 9 aa, Homo Sapiens
ERMYSHITA

SEQ ID NO: 1331094 - protein, 9 aa, Homo Sapiens
CDVVTEAIY

SEQ ID NO: 1331095 - protein, 9 aa, Homo Sapiens
IPPAYTKVK

SEQ ID NO: 1331096 - protein, 9 aa, Homo Sapiens
PAKRLCYFD

SEQ ID NO: 1331097 - protein, 9 aa, Homo Sapiens
DTSCQATGQ

SEQ ID NO: 1331098 - protein, 9 aa, Homo Sapiens
LARDIEHMV

SEQ ID NO: 1331099 - protein, 9 aa, Homo Sapiens
RINQLICQL

SEQ ID NO: 1331100 - protein, 9 aa, Homo Sapiens
IRSIGLMFQ

SEQ ID NO: 1331101 - protein, 9 aa, Homo Sapiens
RPPRQVREH

SEQ ID NO: 1331102 - protein, 9 aa, Homo Sapiens
LSVCAKPSA

SEQ ID NO: 1331103 - protein, 9 aa, Homo Sapiens
LEVSFPQSS

SEQ ID NO: 1331104 - protein, 9 aa, Homo Sapiens
CGEESFDTG

SEQ ID NO: 1331105 - protein, 9 aa, Homo Sapiens
SSIASTMAA

SEQ ID NO: 1331106 - protein, 9 aa, Homo Sapiens
SFLMEGYKF

SEQ ID NO: 1331107 - protein, 9 aa, Homo Sapiens
GADLGRKGQ

SEQ ID NO: 1331108 - protein, 9 aa, Homo Sapiens
IPDGVCSKD

SEQ ID NO: 1331109 - protein, 9 aa, Homo Sapiens
QSWQQMSLQ

SEQ ID NO: 1331110 - protein, 9 aa, Homo Sapiens
DVGSDGCFL

SEQ ID NO: 1331111 - protein, 9 aa, Homo Sapiens
EVMCSDSET

SEQ ID NO: 1331112 - protein, 9 aa, Homo Sapiens
GASVASGSE

SEQ ID NO: 1331113 - protein, 9 aa, Homo Sapiens
YGLPVHGDP

SEQ ID NO: 1331114 - protein, 9 aa, Homo Sapiens
LQMSPTSSF

SEQ ID NO: 1331115 - protein, 9 aa, Homo Sapiens
DNTETKDHA

SEQ ID NO: 1331116 - protein, 9 aa, Homo Sapiens
KVSRLETEM

SEQ ID NO: 1331117 - protein, 9 aa, Homo Sapiens
PNAYHPQFC

SEQ ID NO: 1331118 - protein, 9 aa, Homo Sapiens
SIYLTSSPE

SEQ ID NO: 1331119 - protein, 9 aa, Homo Sapiens
MEKYACQAI

SEQ ID NO: 1331120 - protein, 9 aa, Homo Sapiens
CSLFHQCYA

SEQ ID NO: 1331121 - protein, 9 aa, Homo Sapiens
IQVWQRGSI

SEQ ID NO: 1331122 - protein, 9 aa, Homo Sapiens
SSQHRPSYD

SEQ ID NO: 1331123 - protein, 9 aa, Homo Sapiens
KREENLKMM

SEQ ID NO: 1331124 - protein, 9 aa, Homo Sapiens
QESPRSPLL

SEQ ID NO: 1331125 - protein, 9 aa, Homo Sapiens
GPYCVDENM

SEQ ID NO: 1331126 - protein, 9 aa, Homo Sapiens
TKEQHDLHN

SEQ ID NO: 1331127 - protein, 9 aa, Homo Sapiens
SSLGEAIIK

SEQ ID NO: 1331128 - protein, 9 aa, Homo Sapiens
KTHHPHGKT

SEQ ID NO: 1331129 - protein, 9 aa, Homo Sapiens
GNSDNKDLE

SEQ ID NO: 1331130 - protein, 9 aa, Homo Sapiens
VIKYLAKDL

SEQ ID NO: 1331131 - protein, 9 aa, Homo Sapiens
KHGKPKKQT

SEQ ID NO: 1331132 - protein, 9 aa, Homo Sapiens
FLVDIILNF

SEQ ID NO: 1331133 - protein, 9 aa, Homo Sapiens
KRNPMCSER

SEQ ID NO: 1331134 - protein, 9 aa, Homo Sapiens
MLAYLTELA

SEQ ID NO: 1331135 - protein, 9 aa, Homo Sapiens
TSKDMLRKR

SEQ ID NO: 1331136 - protein, 9 aa, Homo Sapiens
GLWHRFNRP

SEQ ID NO: 1331137 - protein, 9 aa, Homo Sapiens
TEKENATVT

SEQ ID NO: 1331138 - protein, 9 aa, Homo Sapiens
SLKGIPKQA

SEQ ID NO: 1331139 - protein, 9 aa, Homo Sapiens
IDREKLCNF

SEQ ID NO: 1331140 - protein, 9 aa, Homo Sapiens
RQNISRTVI

SEQ ID NO: 1331141 - protein, 9 aa, Homo Sapiens
QQQQQQQSE

SEQ ID NO: 1331142 - protein, 9 aa, Homo Sapiens
VSHLLTEAE

SEQ ID NO: 1331143 - protein, 9 aa, Homo Sapiens
LVLWTTLTI

SEQ ID NO: 1331144 - protein, 9 aa, Homo Sapiens
KAIHLIAVC

SEQ ID NO: 1331145 - protein, 9 aa, Homo Sapiens
FEGEKVFCV

SEQ ID NO: 1331146 - protein, 9 aa, Homo Sapiens
YADGCSPHY

SEQ ID NO: 1331147 - protein, 9 aa, Homo Sapiens
NGYHTLSQH

SEQ ID NO: 1331148 - protein, 9 aa, Homo Sapiens
AKNEWLLCP

SEQ ID NO: 1331149 - protein, 9 aa, Homo Sapiens
KDAQELLCK

SEQ ID NO: 1331150 - protein, 9 aa, Homo Sapiens
RGVSTWRSA

SEQ ID NO: 1331151 - protein, 9 aa, Homo Sapiens
VRQGQETPG

SEQ ID NO: 1331152 - protein, 9 aa, Homo Sapiens
HKYIMTRIL

SEQ ID NO: 1331153 - protein, 9 aa, Homo Sapiens
KMWDQEERM

SEQ ID NO: 1331154 - protein, 9 aa, Homo Sapiens
KWKNYELRI

SEQ ID NO: 1331155 - protein, 9 aa, Homo Sapiens
RQFRAAGVG

SEQ ID NO: 1331156 - protein, 9 aa, Homo Sapiens
EPVMLPVIH

SEQ ID NO: 1331157 - protein, 9 aa, Homo Sapiens
LETAEEVVT

SEQ ID NO: 1331158 - protein, 9 aa, Homo Sapiens
SETCHFDPT

SEQ ID NO: 1331159 - protein, 9 aa, Homo Sapiens
RHLVSLIFN

SEQ ID NO: 1331160 - protein, 9 aa, Homo Sapiens
GWCVGFLFQ

SEQ ID NO: 1331161 - protein, 9 aa, Homo Sapiens
NDIRNPVFD

SEQ ID NO: 1331162 - protein, 9 aa, Homo Sapiens
LPRPSLVIN

SEQ ID NO: 1331163 - protein, 9 aa, Homo Sapiens
FFLHKEFLL

SEQ ID NO: 1331164 - protein, 9 aa, Homo Sapiens
AGRPSAATR

SEQ ID NO: 1331165 - protein, 9 aa, Homo Sapiens
PTLGTMPEV

SEQ ID NO: 1331166 - protein, 9 aa, Homo Sapiens
FINDLYSVS

SEQ ID NO: 1331167 - protein, 9 aa, Homo Sapiens
DANDNTPVF

SEQ ID NO: 1331168 - protein, 9 aa, Homo Sapiens
GHKGLQIFC

SEQ ID NO: 1331169 - protein, 9 aa, Homo Sapiens
AGLHRDVLL

SEQ ID NO: 1331170 - protein, 9 aa, Homo Sapiens
PKHLCLVCG

SEQ ID NO: 1331171 - protein, 9 aa, Homo Sapiens
SLRSLNLVD

SEQ ID NO: 1331172 - protein, 9 aa, Homo Sapiens
YACQAINDG

SEQ ID NO: 1331173 - protein, 9 aa, Homo Sapiens
DEESGSGFN

SEQ ID NO: 1331174 - protein, 9 aa, Homo Sapiens
FGFEGNNCE

SEQ ID NO: 1331175 - protein, 9 aa, Homo Sapiens
LIEWDRTYL

SEQ ID NO: 1331176 - protein, 9 aa, Homo Sapiens
HTAAENDFV

SEQ ID NO: 1331177 - protein, 9 aa, Homo Sapiens
RLAASLSSR

SEQ ID NO: 1331178 - protein, 9 aa, Homo Sapiens
QHMGQYYLP

SEQ ID NO: 1331179 - protein, 9 aa, Homo Sapiens
SDKYDACDV

SEQ ID NO: 1331180 - protein, 9 aa, Homo Sapiens
YLQRITLYC

SEQ ID NO: 1331181 - protein, 9 aa, Homo Sapiens
AYCQALPQV

SEQ ID NO: 1331182 - protein, 9 aa, Homo Sapiens
VQLSSALHT

SEQ ID NO: 1331183 - protein, 9 aa, Homo Sapiens
VDVAQDTTL

SEQ ID NO: 1331184 - protein, 9 aa, Homo Sapiens
FVEFADLVT

SEQ ID NO: 1331185 - protein, 9 aa, Homo Sapiens
AHTTCLAAC

SEQ ID NO: 1331186 - protein, 9 aa, Homo Sapiens
HSKKILSLC

SEQ ID NO: 1331187 - protein, 9 aa, Homo Sapiens
VPPDSKLDQ

SEQ ID NO: 1331188 - protein, 9 aa, Homo Sapiens
TMYEMYFVS

SEQ ID NO: 1331189 - protein, 9 aa, Homo Sapiens
WQPQGAHSP

SEQ ID NO: 1331190 - protein, 9 aa, Homo Sapiens
FQNFSMASP

SEQ ID NO: 1331191 - protein, 9 aa, Homo Sapiens
QLSFVESRF

SEQ ID NO: 1331192 - protein, 9 aa, Homo Sapiens
TVSVMRYST

SEQ ID NO: 1331193 - protein, 9 aa, Homo Sapiens
AQRAGFGTE

SEQ ID NO: 1331194 - protein, 9 aa, Homo Sapiens
LQLIWERVK

SEQ ID NO: 1331195 - protein, 9 aa, Homo Sapiens
PHINKFTIL

SEQ ID NO: 1331196 - protein, 9 aa, Homo Sapiens
VIRFNADYG

SEQ ID NO: 1331197 - protein, 9 aa, Homo Sapiens
RPPKQKGCV

SEQ ID NO: 1331198 - protein, 9 aa, Homo Sapiens
SGGCMNPAH

SEQ ID NO: 1331199 - protein, 9 aa, Homo Sapiens
IRLIHHCAK

SEQ ID NO: 1331200 - protein, 9 aa, Homo Sapiens
NQPGILTSD

SEQ ID NO: 1331201 - protein, 9 aa, Homo Sapiens
EISVVHIHC

SEQ ID NO: 1331202 - protein, 9 aa, Homo Sapiens
VASGPHLFI

SEQ ID NO: 1331203 - protein, 9 aa, Homo Sapiens
GSRDEKVEA

SEQ ID NO: 1331204 - protein, 9 aa, Homo Sapiens
HLTREVEAT

SEQ ID NO: 1331205 - protein, 9 aa, Homo Sapiens
HFLRGAPHR

SEQ ID NO: 1331206 - protein, 9 aa, Homo Sapiens
GALINTLGI

SEQ ID NO: 1331207 - protein, 9 aa, Homo Sapiens
SASDKDQLM

SEQ ID NO: 1331208 - protein, 9 aa, Homo Sapiens
AQMQAELLY

SEQ ID NO: 1331209 - protein, 9 aa, Homo Sapiens
QEAQNITGG

SEQ ID NO: 1331210 - protein, 9 aa, Homo Sapiens
PHPVLEKLQ

SEQ ID NO: 1331211 - protein, 9 aa, Homo Sapiens
QIVPLIKSH

SEQ ID NO: 1331212 - protein, 9 aa, Homo Sapiens
LVAFSEASW

SEQ ID NO: 1331213 - protein, 9 aa, Homo Sapiens
SARAPPSRC

SEQ ID NO: 1331214 - protein, 9 aa, Homo Sapiens
GIKTFPVRS

SEQ ID NO: 1331215 - protein, 9 aa, Homo Sapiens
TNPDPSNTA

SEQ ID NO: 1331216 - protein, 9 aa, Homo Sapiens
TGYINTSHI

SEQ ID NO: 1331217 - protein, 9 aa, Homo Sapiens
VIISSMMML

SEQ ID NO: 1331218 - protein, 9 aa, Homo Sapiens
QPLPSNTLS

SEQ ID NO: 1331219 - protein, 9 aa, Homo Sapiens
HLQEEKEKV

SEQ ID NO: 1331220 - protein, 9 aa, Homo Sapiens
WLHALGELL

SEQ ID NO: 1331221 - protein, 9 aa, Homo Sapiens
KLHLLGTSN

SEQ ID NO: 1331222 - protein, 9 aa, Homo Sapiens
ERVAFFVAL

SEQ ID NO: 1331223 - protein, 9 aa, Homo Sapiens
DTVEWRYRN

SEQ ID NO: 1331224 - protein, 9 aa, Homo Sapiens
AAPSNLKRV

SEQ ID NO: 1331225 - protein, 9 aa, Homo Sapiens
TVMYLYKHP

SEQ ID NO: 1331226 - protein, 9 aa, Homo Sapiens
WTVETKATQ

SEQ ID NO: 1331227 - protein, 9 aa, Homo Sapiens
DQSPMAALI

SEQ ID NO: 1331228 - protein, 9 aa, Homo Sapiens
LPMNTGVDA

SEQ ID NO: 1331229 - protein, 9 aa, Homo Sapiens
SHMKRVLDA

SEQ ID NO: 1331230 - protein, 9 aa, Homo Sapiens
GTPKCMVHS

SEQ ID NO: 1331231 - protein, 9 aa, Homo Sapiens
SKLPQDDDM

SEQ ID NO: 1331232 - protein, 9 aa, Homo Sapiens
VSPESDFES

SEQ ID NO: 1331233 - protein, 9 aa, Homo Sapiens
KLYFNSLMT

SEQ ID NO: 1331234 - protein, 9 aa, Homo Sapiens
PTVFAASQG

SEQ ID NO: 1331235 - protein, 9 aa, Homo Sapiens
KGPDSVVVY

SEQ ID NO: 1331236 - protein, 9 aa, Homo Sapiens
LEHYTNLYD

SEQ ID NO: 1331237 - protein, 9 aa, Homo Sapiens
NLVYLIPHD

SEQ ID NO: 1331238 - protein, 9 aa, Homo Sapiens
LLQHGTEVN

SEQ ID NO: 1331239 - protein, 9 aa, Homo Sapiens
ALPGTISQQ

SEQ ID NO: 1331240 - protein, 9 aa, Homo Sapiens
GLPVRQPTQ

SEQ ID NO: 1331241 - protein, 9 aa, Homo Sapiens
KFAISENSL

SEQ ID NO: 1331242 - protein, 9 aa, Homo Sapiens
RSLQEQTEC

SEQ ID NO: 1331243 - protein, 9 aa, Homo Sapiens
VLSYVRHLK

SEQ ID NO: 1331244 - protein, 9 aa, Homo Sapiens
KSLVDPKNI

SEQ ID NO: 1331245 - protein, 9 aa, Homo Sapiens
EYYSHADAE

SEQ ID NO: 1331246 - protein, 9 aa, Homo Sapiens
NCVVGSHGM

SEQ ID NO: 1331247 - protein, 9 aa, Homo Sapiens
EAAEGKSLD

SEQ ID NO: 1331248 - protein, 9 aa, Homo Sapiens
EDVMMATVM

SEQ ID NO: 1331249 - protein, 9 aa, Homo Sapiens
KRPQCATSN

SEQ ID NO: 1331250 - protein, 9 aa, Homo Sapiens
YVSSLTRSM

SEQ ID NO: 1331251 - protein, 9 aa, Homo Sapiens
LKYFRFIVR

SEQ ID NO: 1331252 - protein, 9 aa, Homo Sapiens
HLLKPVKHI

SEQ ID NO: 1331253 - protein, 9 aa, Homo Sapiens
VGYRVTQIT

SEQ ID NO: 1331254 - protein, 9 aa, Homo Sapiens
NLWKFCRDI

SEQ ID NO: 1331255 - protein, 9 aa, Homo Sapiens
PYFLEEPKD

SEQ ID NO: 1331256 - protein, 9 aa, Homo Sapiens
GAVKDGAIM

SEQ ID NO: 1331257 - protein, 9 aa, Homo Sapiens
ARRPYLRVP

SEQ ID NO: 1331258 - protein, 9 aa, Homo Sapiens
RRSARAPPS

SEQ ID NO: 1331259 - protein, 9 aa, Homo Sapiens
TTRELKTPS

SEQ ID NO: 1331260 - protein, 9 aa, Homo Sapiens
EEPVVRAKI

SEQ ID NO: 1331261 - protein, 9 aa, Homo Sapiens
YQWLDLCKL

SEQ ID NO: 1331262 - protein, 9 aa, Homo Sapiens
MMWRINPAH

SEQ ID NO: 1331263 - protein, 9 aa, Homo Sapiens
LPWPSRKED

SEQ ID NO: 1331264 - protein, 9 aa, Homo Sapiens
QRLLLIFHS

SEQ ID NO: 1331265 - protein, 9 aa, Homo Sapiens
NLMDRQARK

SEQ ID NO: 1331266 - protein, 9 aa, Homo Sapiens
QIKVTIKKI

SEQ ID NO: 1331267 - protein, 9 aa, Homo Sapiens
SQEETQGLP

SEQ ID NO: 1331268 - protein, 9 aa, Homo Sapiens
KKSVVRPRR

SEQ ID NO: 1331269 - protein, 9 aa, Homo Sapiens
AHESIIWCW

SEQ ID NO: 1331270 - protein, 9 aa, Homo Sapiens
QVADTGFGG

SEQ ID NO: 1331271 - protein, 9 aa, Homo Sapiens
KAKHLCLSL

SEQ ID NO: 1331272 - protein, 9 aa, Homo Sapiens
KGGLEDECK

SEQ ID NO: 1331273 - protein, 9 aa, Homo Sapiens
IIPPTSISC

SEQ ID NO: 1331274 - protein, 9 aa, Homo Sapiens
QATRQLLLQ

SEQ ID NO: 1331275 - protein, 9 aa, Homo Sapiens
CGGDGTSMW

SEQ ID NO: 1331276 - protein, 9 aa, Homo Sapiens
LAESRVQRN

SEQ ID NO: 1331277 - protein, 9 aa, Homo Sapiens
TKCAPAACF

SEQ ID NO: 1331278 - protein, 9 aa, Homo Sapiens
TQMMVYVPK

SEQ ID NO: 1331279 - protein, 9 aa, Homo Sapiens
IMLLEQEKE

SEQ ID NO: 1331280 - protein, 9 aa, Homo Sapiens
AQGVSQHLL

SEQ ID NO: 1331281 - protein, 9 aa, Homo Sapiens
GPRPLCPHA

SEQ ID NO: 1331282 - protein, 9 aa, Homo Sapiens
SLLKVFVRD

SEQ ID NO: 1331283 - protein, 9 aa, Homo Sapiens
PQGLILNVT

SEQ ID NO: 1331284 - protein, 9 aa, Homo Sapiens
TITEFLYIA

SEQ ID NO: 1331285 - protein, 9 aa, Homo Sapiens
WRRCNTLQL

SEQ ID NO: 1331286 - protein, 9 aa, Homo Sapiens
VLVGLDIWN

SEQ ID NO: 1331287 - protein, 9 aa, Homo Sapiens
YVGSNIVQL

SEQ ID NO: 1331288 - protein, 9 aa, Homo Sapiens
QSLVGQYNQ

SEQ ID NO: 1331289 - protein, 9 aa, Homo Sapiens
KNVRHICYF

SEQ ID NO: 1331290 - protein, 9 aa, Homo Sapiens
ASRDYISMA

SEQ ID NO: 1331291 - protein, 9 aa, Homo Sapiens
ALHRVTLSM

SEQ ID NO: 1331292 - protein, 9 aa, Homo Sapiens
SRGENVAQT

SEQ ID NO: 1331293 - protein, 9 aa, Homo Sapiens
PTPRPERPE

SEQ ID NO: 1331294 - protein, 9 aa, Homo Sapiens
KMEMPIISN

SEQ ID NO: 1331295 - protein, 9 aa, Homo Sapiens
RIFNFTRSR

SEQ ID NO: 1331296 - protein, 9 aa, Homo Sapiens
MCHNLITFL

SEQ ID NO: 1331297 - protein, 9 aa, Homo Sapiens
VFLSENFRK

SEQ ID NO: 1331298 - protein, 9 aa, Homo Sapiens
LGCGEVINA

SEQ ID NO: 1331299 - protein, 9 aa, Homo Sapiens
AVAPPSAVG

SEQ ID NO: 1331300 - protein, 9 aa, Homo Sapiens
EDKDDDEGS

SEQ ID NO: 1331301 - protein, 9 aa, Homo Sapiens
TPKGISRKQ

SEQ ID NO: 1331302 - protein, 9 aa, Homo Sapiens
HLRGSGNTP

SEQ ID NO: 1331303 - protein, 9 aa, Homo Sapiens
KDESHAGKA

SEQ ID NO: 1331304 - protein, 9 aa, Homo Sapiens
DDREESFRI

SEQ ID NO: 1331305 - protein, 9 aa, Homo Sapiens
RSSSIPSVV

SEQ ID NO: 1331306 - protein, 9 aa, Homo Sapiens
ILEFEADRH

SEQ ID NO: 1331307 - protein, 9 aa, Homo Sapiens
PQQTQALGI

SEQ ID NO: 1331308 - protein, 9 aa, Homo Sapiens
LWRQFIKGS

SEQ ID NO: 1331309 - protein, 9 aa, Homo Sapiens
FNDTLIFLP

SEQ ID NO: 1331310 - protein, 9 aa, Homo Sapiens
NNENLQEIY

SEQ ID NO: 1331311 - protein, 9 aa, Homo Sapiens
NMSCCRCFC

SEQ ID NO: 1331312 - protein, 9 aa, Homo Sapiens
GECAHNATC

SEQ ID NO: 1331313 - protein, 9 aa, Homo Sapiens
ELAQAMRWD

SEQ ID NO: 1331314 - protein, 9 aa, Homo Sapiens
WKKIMWLGR

SEQ ID NO: 1331315 - protein, 9 aa, Homo Sapiens
TNQYVVGEL

SEQ ID NO: 1331316 - protein, 9 aa, Homo Sapiens
SGDVWIVRI

SEQ ID NO: 1331317 - protein, 9 aa, Homo Sapiens
VISPLLPSP

SEQ ID NO: 1331318 - protein, 9 aa, Homo Sapiens
AKEHIKEMH

SEQ ID NO: 1331319 - protein, 9 aa, Homo Sapiens
TFQLTAFTF

SEQ ID NO: 1331320 - protein, 9 aa, Homo Sapiens
PLWVCCFFF

SEQ ID NO: 1331321 - protein, 9 aa, Homo Sapiens
YLFFADISS

SEQ ID NO: 1331322 - protein, 9 aa, Homo Sapiens
LVIYRLPTL

SEQ ID NO: 1331323 - protein, 9 aa, Homo Sapiens
PHSLRFTWS

SEQ ID NO: 1331324 - protein, 9 aa, Homo Sapiens
NKPWVYSLL

SEQ ID NO: 1331325 - protein, 9 aa, Homo Sapiens
NLLAEHNPL

SEQ ID NO: 1331326 - protein, 9 aa, Homo Sapiens
IEQSKEAWG

SEQ ID NO: 1331327 - protein, 9 aa, Homo Sapiens
INLARAVYS

SEQ ID NO: 1331328 - protein, 9 aa, Homo Sapiens
RVYDNVREY

SEQ ID NO: 1331329 - protein, 9 aa, Homo Sapiens
SSNTFPIWF

SEQ ID NO: 1331330 - protein, 9 aa, Homo Sapiens
ICYYKNHYH

SEQ ID NO: 1331331 - protein, 9 aa, Homo Sapiens
LGPRGISSY

SEQ ID NO: 1331332 - protein, 9 aa, Homo Sapiens
AYGRSRSKL

SEQ ID NO: 1331333 - protein, 9 aa, Homo Sapiens
WGQWTPWGD

SEQ ID NO: 1331334 - protein, 9 aa, Homo Sapiens
YNNIFCVKE

SEQ ID NO: 1331335 - protein, 9 aa, Homo Sapiens
EWHVLPILW

SEQ ID NO: 1331336 - protein, 9 aa, Homo Sapiens
DISGLHATI

SEQ ID NO: 1331337 - protein, 9 aa, Homo Sapiens
LRKCWFQLG

SEQ ID NO: 1331338 - protein, 9 aa, Homo Sapiens
CDHTSTLVA

SEQ ID NO: 1331339 - protein, 9 aa, Homo Sapiens
KTRHLGAAV

SEQ ID NO: 1331340 - protein, 9 aa, Homo Sapiens
AGRDHFAFG

SEQ ID NO: 1331341 - protein, 9 aa, Homo Sapiens
WELPDYLMK

SEQ ID NO: 1331342 - protein, 9 aa, Homo Sapiens
IVALISIFV

SEQ ID NO: 1331343 - protein, 9 aa, Homo Sapiens
EAARLTQGT

SEQ ID NO: 1331344 - protein, 9 aa, Homo Sapiens
AVVNATIPA

SEQ ID NO: 1331345 - protein, 9 aa, Homo Sapiens
MLKGKLGVS

SEQ ID NO: 1331346 - protein, 9 aa, Homo Sapiens
AADQTTTEQ

SEQ ID NO: 1331347 - protein, 9 aa, Homo Sapiens
MLWPALDPS

SEQ ID NO: 1331348 - protein, 9 aa, Homo Sapiens
HNQCQEVLY

SEQ ID NO: 1331349 - protein, 9 aa, Homo Sapiens
ALDTTITSR

SEQ ID NO: 1331350 - protein, 9 aa, Homo Sapiens
ATPLPRPGA

SEQ ID NO: 1331351 - protein, 9 aa, Homo Sapiens
RSTRKKWCP

SEQ ID NO: 1331352 - protein, 9 aa, Homo Sapiens
KVTCHDGAS

SEQ ID NO: 1331353 - protein, 9 aa, Homo Sapiens
ADAAEALFY

SEQ ID NO: 1331354 - protein, 9 aa, Homo Sapiens
CVLLKMKTS

SEQ ID NO: 1331355 - protein, 9 aa, Homo Sapiens
RGSSIPEND

SEQ ID NO: 1331356 - protein, 9 aa, Homo Sapiens
GTQKVAISE

SEQ ID NO: 1331357 - protein, 9 aa, Homo Sapiens
YTIRDRENH

SEQ ID NO: 1331358 - protein, 9 aa, Homo Sapiens
VGAYLVDNK

SEQ ID NO: 1331359 - protein, 9 aa, Homo Sapiens
FPYLYLRLT

SEQ ID NO: 1331360 - protein, 9 aa, Homo Sapiens
ASHSEPLVS

SEQ ID NO: 1331361 - protein, 9 aa, Homo Sapiens
FIFAYLIFA

SEQ ID NO: 1331362 - protein, 9 aa, Homo Sapiens
WSAHLLTRA

SEQ ID NO: 1331363 - protein, 9 aa, Homo Sapiens
EHWEKLLKN

SEQ ID NO: 1331364 - protein, 9 aa, Homo Sapiens
GWPLDPEDR

SEQ ID NO: 1331365 - protein, 9 aa, Homo Sapiens
HQQLCPSAN

SEQ ID NO: 1331366 - protein, 9 aa, Homo Sapiens
YVLFIVLAL

SEQ ID NO: 1331367 - protein, 9 aa, Homo Sapiens
VHQEPGAVV

SEQ ID NO: 1331368 - protein, 9 aa, Homo Sapiens
FTPDMAFEV

SEQ ID NO: 1331369 - protein, 9 aa, Homo Sapiens
TAQEKQFPM

SEQ ID NO: 1331370 - protein, 9 aa, Homo Sapiens
AWGRAAAVM

SEQ ID NO: 1331371 - protein, 9 aa, Homo Sapiens
TLRLQRFFQ

SEQ ID NO: 1331372 - protein, 9 aa, Homo Sapiens
QDKHLWVLH

SEQ ID NO: 1331373 - protein, 9 aa, Homo Sapiens
LPKLHLDTF

SEQ ID NO: 1331374 - protein, 9 aa, Homo Sapiens
IQIINNTIE

SEQ ID NO: 1331375 - protein, 9 aa, Homo Sapiens
RALLGPGAE

SEQ ID NO: 1331376 - protein, 9 aa, Homo Sapiens
HHLVHAQHF

SEQ ID NO: 1331377 - protein, 9 aa, Homo Sapiens
QVVLLPQPP

SEQ ID NO: 1331378 - protein, 9 aa, Homo Sapiens
PLTPQQTQA

SEQ ID NO: 1331379 - protein, 9 aa, Homo Sapiens
HVYHGHLSS

SEQ ID NO: 1331380 - protein, 9 aa, Homo Sapiens
EKNRFSLAL

SEQ ID NO: 1331381 - protein, 9 aa, Homo Sapiens
VTNDTFDWD

SEQ ID NO: 1331382 - protein, 9 aa, Homo Sapiens
AVIFLNTRH

SEQ ID NO: 1331383 - protein, 9 aa, Homo Sapiens
TVDVISVET

SEQ ID NO: 1331384 - protein, 9 aa, Homo Sapiens
KMLSTSEQF

SEQ ID NO: 1331385 - protein, 9 aa, Homo Sapiens
LTSLVDEAK

SEQ ID NO: 1331386 - protein, 9 aa, Homo Sapiens
KKADSYIEE

SEQ ID NO: 1331387 - protein, 9 aa, Homo Sapiens
LDHRYYADG

SEQ ID NO: 1331388 - protein, 9 aa, Homo Sapiens
SSVNPIIYV

SEQ ID NO: 1331389 - protein, 9 aa, Homo Sapiens
SFRGSGPGR

SEQ ID NO: 1331390 - protein, 9 aa, Homo Sapiens
KGQTGVMIC

SEQ ID NO: 1331391 - protein, 9 aa, Homo Sapiens
HCVSQVAFD

SEQ ID NO: 1331392 - protein, 9 aa, Homo Sapiens
RQQAEHCQK

SEQ ID NO: 1331393 - protein, 9 aa, Homo Sapiens
QIHPTLLWE

SEQ ID NO: 1331394 - protein, 9 aa, Homo Sapiens
TSHEHREHI

SEQ ID NO: 1331395 - protein, 9 aa, Homo Sapiens
DFVESVMVR

SEQ ID NO: 1331396 - protein, 9 aa, Homo Sapiens
VPSGITARD

SEQ ID NO: 1331397 - protein, 9 aa, Homo Sapiens
AQAFESYQL

SEQ ID NO: 1331398 - protein, 9 aa, Homo Sapiens
LSQLSIMDL

SEQ ID NO: 1331399 - protein, 9 aa, Homo Sapiens
MTSLISSLR

SEQ ID NO: 1331400 - protein, 9 aa, Homo Sapiens
FNSPLKLLA

SEQ ID NO: 1331401 - protein, 9 aa, Homo Sapiens
QERANKKQW

SEQ ID NO: 1331402 - protein, 9 aa, Homo Sapiens
HPHGKTHHP

SEQ ID NO: 1331403 - protein, 9 aa, Homo Sapiens
SQEHNIILY

SEQ ID NO: 1331404 - protein, 9 aa, Homo Sapiens
HTLAALTSP

SEQ ID NO: 1331405 - protein, 9 aa, Homo Sapiens
AQGTHIGCR

SEQ ID NO: 1331406 - protein, 9 aa, Homo Sapiens
SSDLSCKVC

SEQ ID NO: 1331407 - protein, 9 aa, Homo Sapiens
DLCRFRIYS

SEQ ID NO: 1331408 - protein, 9 aa, Homo Sapiens
TGESPWESS

SEQ ID NO: 1331409 - protein, 9 aa, Homo Sapiens
INHKWVNGF

SEQ ID NO: 1331410 - protein, 9 aa, Homo Sapiens
CEECDKAFT

SEQ ID NO: 1331411 - protein, 9 aa, Homo Sapiens
IVVGFPATP

SEQ ID NO: 1331412 - protein, 9 aa, Homo Sapiens
HHPHGKTHH

SEQ ID NO: 1331413 - protein, 9 aa, Homo Sapiens
GYIMDKAEG

SEQ ID NO: 1331414 - protein, 9 aa, Homo Sapiens
SKFQECHMK

SEQ ID NO: 1331415 - protein, 9 aa, Homo Sapiens
ISESEYCKC

SEQ ID NO: 1331416 - protein, 9 aa, Homo Sapiens
HELYYDTAC

SEQ ID NO: 1331417 - protein, 9 aa, Homo Sapiens
IGTVPSDYR

SEQ ID NO: 1331418 - protein, 9 aa, Homo Sapiens
VGDYSGRLI

SEQ ID NO: 1331419 - protein, 9 aa, Homo Sapiens
CTFVNARTD

SEQ ID NO: 1331420 - protein, 9 aa, Homo Sapiens
YVLQSLHLM

SEQ ID NO: 1331421 - protein, 9 aa, Homo Sapiens
GGPTEEKLL

SEQ ID NO: 1331422 - protein, 9 aa, Homo Sapiens
YDRSILVDG

SEQ ID NO: 1331423 - protein, 9 aa, Homo Sapiens
EIIQSSTGE

SEQ ID NO: 1331424 - protein, 9 aa, Homo Sapiens
HAKCVTIMP

SEQ ID NO: 1331425 - protein, 9 aa, Homo Sapiens
QGRVQSILR

SEQ ID NO: 1331426 - protein, 9 aa, Homo Sapiens
LLFFSSVIS

SEQ ID NO: 1331427 - protein, 9 aa, Homo Sapiens
FLAFPSPQG

SEQ ID NO: 1331428 - protein, 9 aa, Homo Sapiens
EASRDPAKM

SEQ ID NO: 1331429 - protein, 9 aa, Homo Sapiens
KDYIFDLCL

SEQ ID NO: 1331430 - protein, 9 aa, Homo Sapiens
GCLQMADQI

SEQ ID NO: 1331431 - protein, 9 aa, Homo Sapiens
GPAPRRSLG

SEQ ID NO: 1331432 - protein, 9 aa, Homo Sapiens
SIPLSSPLK

SEQ ID NO: 1331433 - protein, 9 aa, Homo Sapiens
SHHIQNVVT

SEQ ID NO: 1331434 - protein, 9 aa, Homo Sapiens
LVPFREHFE

SEQ ID NO: 1331435 - protein, 9 aa, Homo Sapiens
ILEINQELH

SEQ ID NO: 1331436 - protein, 9 aa, Homo Sapiens
RSLSLQKIM

SEQ ID NO: 1331437 - protein, 9 aa, Homo Sapiens
PSSAASAGR

SEQ ID NO: 1331438 - protein, 9 aa, Homo Sapiens
RSFRGSGPG

SEQ ID NO: 1331439 - protein, 9 aa, Homo Sapiens
SDQQFSPKS

SEQ ID NO: 1331440 - protein, 9 aa, Homo Sapiens
TRGPFGGPN

SEQ ID NO: 1331441 - protein, 9 aa, Homo Sapiens
KGLELFRIE

SEQ ID NO: 1331442 - protein, 9 aa, Homo Sapiens
FFFLFPLGY

SEQ ID NO: 1331443 - protein, 9 aa, Homo Sapiens
YPDPLTYDS

SEQ ID NO: 1331444 - protein, 9 aa, Homo Sapiens
QRRRLPSVI

SEQ ID NO: 1331445 - protein, 9 aa, Homo Sapiens
RSSLEYRVS

SEQ ID NO: 1331446 - protein, 9 aa, Homo Sapiens
FEVIVKKQI

SEQ ID NO: 1331447 - protein, 9 aa, Homo Sapiens
VIGPQMLLA

SEQ ID NO: 1331448 - protein, 9 aa, Homo Sapiens
DVTVQGNYE

SEQ ID NO: 1331449 - protein, 9 aa, Homo Sapiens
SPKWKNYEL

SEQ ID NO: 1331450 - protein, 9 aa, Homo Sapiens
GRGHASQRP

SEQ ID NO: 1331451 - protein, 9 aa, Homo Sapiens
VRFHIAWSR

SEQ ID NO: 1331452 - protein, 9 aa, Homo Sapiens
QIYPPSTCS

SEQ ID NO: 1331453 - protein, 9 aa, Homo Sapiens
EEGIDTDTI

SEQ ID NO: 1331454 - protein, 9 aa, Homo Sapiens
EDHTWVPPF

SEQ ID NO: 1331455 - protein, 9 aa, Homo Sapiens
FLLSGNDPS

SEQ ID NO: 1331456 - protein, 9 aa, Homo Sapiens
TWLAGTIIP

SEQ ID NO: 1331457 - protein, 9 aa, Homo Sapiens
LVPDCSDFL

SEQ ID NO: 1331458 - protein, 9 aa, Homo Sapiens
GCVVLMQDK

SEQ ID NO: 1331459 - protein, 9 aa, Homo Sapiens
AQELRDVWG

SEQ ID NO: 1331460 - protein, 9 aa, Homo Sapiens
HRTLNKFGC

SEQ ID NO: 1331461 - protein, 9 aa, Homo Sapiens
EGSNMTFLA

SEQ ID NO: 1331462 - protein, 9 aa, Homo Sapiens
DTNLCDANK

SEQ ID NO: 1331463 - protein, 9 aa, Homo Sapiens
LPSSGFNQE

SEQ ID NO: 1331464 - protein, 9 aa, Homo Sapiens
QHYKDAMEQ

SEQ ID NO: 1331465 - protein, 9 aa, Homo Sapiens
GDLMWINAG

SEQ ID NO: 1331466 - protein, 9 aa, Homo Sapiens
SNHGHSVLV

SEQ ID NO: 1331467 - protein, 9 aa, Homo Sapiens
RQGLAEPGS

SEQ ID NO: 1331468 - protein, 9 aa, Homo Sapiens
WHYFDQISF

SEQ ID NO: 1331469 - protein, 9 aa, Homo Sapiens
IRQYHIKPL

SEQ ID NO: 1331470 - protein, 9 aa, Homo Sapiens
LSRAWRPHN

SEQ ID NO: 1331471 - protein, 9 aa, Homo Sapiens
VVTLGGSLD

SEQ ID NO: 1331472 - protein, 9 aa, Homo Sapiens
VTEHMPTPV

SEQ ID NO: 1331473 - protein, 9 aa, Homo Sapiens
TKFMSDRSS

SEQ ID NO: 1331474 - protein, 9 aa, Homo Sapiens
WEPAAHQRG

SEQ ID NO: 1331475 - protein, 9 aa, Homo Sapiens
SINQEERDL

SEQ ID NO: 1331476 - protein, 9 aa, Homo Sapiens
PAVIITLVT

SEQ ID NO: 1331477 - protein, 9 aa, Homo Sapiens
HDVGSSEDL

SEQ ID NO: 1331478 - protein, 9 aa, Homo Sapiens
PDPTKTFDY

SEQ ID NO: 1331479 - protein, 9 aa, Homo Sapiens
VANNVPPTA

SEQ ID NO: 1331480 - protein, 9 aa, Homo Sapiens
MSENDNMFC

SEQ ID NO: 1331481 - protein, 9 aa, Homo Sapiens
SETSSSSCK

SEQ ID NO: 1331482 - protein, 9 aa, Homo Sapiens
SSPTPRTCP

SEQ ID NO: 1331483 - protein, 9 aa, Homo Sapiens
SATTGRSRK

SEQ ID NO: 1331484 - protein, 9 aa, Homo Sapiens
TQPTKEGMM

SEQ ID NO: 1331485 - protein, 9 aa, Homo Sapiens
ITFIVRRLF

SEQ ID NO: 1331486 - protein, 9 aa, Homo Sapiens
GQPSSETRA

SEQ ID NO: 1331487 - protein, 9 aa, Homo Sapiens
RIFLQDINK

SEQ ID NO: 1331488 - protein, 9 aa, Homo Sapiens
QMGADSMYD

SEQ ID NO: 1331489 - protein, 9 aa, Homo Sapiens
VVLVFVEST

SEQ ID NO: 1331490 - protein, 9 aa, Homo Sapiens
PFKDLGNLC

SEQ ID NO: 1331491 - protein, 9 aa, Homo Sapiens
ADEKVDIYK

SEQ ID NO: 1331492 - protein, 9 aa, Homo Sapiens
ASVHIGLYD

SEQ ID NO: 1331493 - protein, 9 aa, Homo Sapiens
KWMVIIFTR

SEQ ID NO: 1331494 - protein, 9 aa, Homo Sapiens
TAAGISQLL

SEQ ID NO: 1331495 - protein, 9 aa, Homo Sapiens
GRPDAKDVL

SEQ ID NO: 1331496 - protein, 9 aa, Homo Sapiens
TRQNISQSS

SEQ ID NO: 1331497 - protein, 9 aa, Homo Sapiens
IGLPGQRGE

SEQ ID NO: 1331498 - protein, 9 aa, Homo Sapiens
LANQPSPHM

SEQ ID NO: 1331499 - protein, 9 aa, Homo Sapiens
GAFFTGDLP

SEQ ID NO: 1331500 - protein, 9 aa, Homo Sapiens
ALEELWASL

SEQ ID NO: 1331501 - protein, 9 aa, Homo Sapiens
DYEICQYVV

SEQ ID NO: 1331502 - protein, 9 aa, Homo Sapiens
PPQPGAAST

SEQ ID NO: 1331503 - protein, 9 aa, Homo Sapiens
ESTVCAINE

SEQ ID NO: 1331504 - protein, 9 aa, Homo Sapiens
ELDAELLGE

SEQ ID NO: 1331505 - protein, 9 aa, Homo Sapiens
CLAKLQDPF

SEQ ID NO: 1331506 - protein, 9 aa, Homo Sapiens
KWILAAVTS

SEQ ID NO: 1331507 - protein, 9 aa, Homo Sapiens
NNPEFWALI

SEQ ID NO: 1331508 - protein, 9 aa, Homo Sapiens
PSQLQMKPC

SEQ ID NO: 1331509 - protein, 9 aa, Homo Sapiens
HVQPPKPSS

SEQ ID NO: 1331510 - protein, 9 aa, Homo Sapiens
YLMRPKASG

SEQ ID NO: 1331511 - protein, 9 aa, Homo Sapiens
LCEPEVSNY

SEQ ID NO: 1331512 - protein, 9 aa, Homo Sapiens
QGRGIGPLT

SEQ ID NO: 1331513 - protein, 9 aa, Homo Sapiens
MAPAAPKIL

SEQ ID NO: 1331514 - protein, 9 aa, Homo Sapiens
CDVGSDGCF

SEQ ID NO: 1331515 - protein, 9 aa, Homo Sapiens
FLEEIIGSL

SEQ ID NO: 1331516 - protein, 9 aa, Homo Sapiens
LTLHNRSTE

SEQ ID NO: 1331517 - protein, 9 aa, Homo Sapiens
SVGRPSAAT

SEQ ID NO: 1331518 - protein, 9 aa, Homo Sapiens
EAPDELALW

SEQ ID NO: 1331519 - protein, 9 aa, Homo Sapiens
GVSIGSICL

SEQ ID NO: 1331520 - protein, 9 aa, Homo Sapiens
ARFLTSMWR

SEQ ID NO: 1331521 - protein, 9 aa, Homo Sapiens
ISYSIQDRT

SEQ ID NO: 1331522 - protein, 9 aa, Homo Sapiens
RCAGSAGRA

SEQ ID NO: 1331523 - protein, 9 aa, Homo Sapiens
SGPCHAAAL

SEQ ID NO: 1331524 - protein, 9 aa, Homo Sapiens
SEHPSQSVR

SEQ ID NO: 1331525 - protein, 9 aa, Homo Sapiens
HQLYTECLY

SEQ ID NO: 1331526 - protein, 9 aa, Homo Sapiens
SYSVPLMSP

SEQ ID NO: 1331527 - protein, 9 aa, Homo Sapiens
PYRDWTLCY

SEQ ID NO: 1331528 - protein, 9 aa, Homo Sapiens
AASSSDLSC

SEQ ID NO: 1331529 - protein, 9 aa, Homo Sapiens
HHDHVIFLT

SEQ ID NO: 1331530 - protein, 9 aa, Homo Sapiens
EDVSIRCQA

SEQ ID NO: 1331531 - protein, 9 aa, Homo Sapiens
VNNYHPLQP

SEQ ID NO: 1331532 - protein, 9 aa, Homo Sapiens
KTNKSRGFT

SEQ ID NO: 1331533 - protein, 9 aa, Homo Sapiens
QYHKVLMPK

SEQ ID NO: 1331534 - protein, 9 aa, Homo Sapiens
ALRGKDVAE

SEQ ID NO: 1331535 - protein, 9 aa, Homo Sapiens
IFTMHQQDI

SEQ ID NO: 1331536 - protein, 9 aa, Homo Sapiens
NYYTGGWHH

SEQ ID NO: 1331537 - protein, 9 aa, Homo Sapiens
LCKLEASGK

SEQ ID NO: 1331538 - protein, 9 aa, Homo Sapiens
ETVSEKKNF

SEQ ID NO: 1331539 - protein, 9 aa, Homo Sapiens
NTQTFNLEG

SEQ ID NO: 1331540 - protein, 9 aa, Homo Sapiens
PVVNTQLLP

SEQ ID NO: 1331541 - protein, 9 aa, Homo Sapiens
RRALACVSL

SEQ ID NO: 1331542 - protein, 9 aa, Homo Sapiens
QIEDVTEKL

SEQ ID NO: 1331543 - protein, 9 aa, Homo Sapiens
TETVGPQGP

SEQ ID NO: 1331544 - protein, 9 aa, Homo Sapiens
SNCMQTTIC

SEQ ID NO: 1331545 - protein, 9 aa, Homo Sapiens
PAIINPQTA

SEQ ID NO: 1331546 - protein, 9 aa, Homo Sapiens
VIISTPQDI

SEQ ID NO: 1331547 - protein, 9 aa, Homo Sapiens
GDPCWTHAR

SEQ ID NO: 1331548 - protein, 9 aa, Homo Sapiens
QNVLRKHKD

SEQ ID NO: 1331549 - protein, 9 aa, Homo Sapiens
IAKRVKLTG

SEQ ID NO: 1331550 - protein, 9 aa, Homo Sapiens
IFFFITLVF

SEQ ID NO: 1331551 - protein, 9 aa, Homo Sapiens
PVVPIPPQM

SEQ ID NO: 1331552 - protein, 9 aa, Homo Sapiens
STDHQTPQP

SEQ ID NO: 1331553 - protein, 9 aa, Homo Sapiens
YLKMNIMVP

SEQ ID NO: 1331554 - protein, 9 aa, Homo Sapiens
ECDKAFRVH

SEQ ID NO: 1331555 - protein, 9 aa, Homo Sapiens
AQELLCKVD

SEQ ID NO: 1331556 - protein, 9 aa, Homo Sapiens
SLRHCCLPQ

SEQ ID NO: 1331557 - protein, 9 aa, Homo Sapiens
QPEKLIFEF

SEQ ID NO: 1331558 - protein, 9 aa, Homo Sapiens
LTKFMKTEE

SEQ ID NO: 1331559 - protein, 9 aa, Homo Sapiens
DVFIAMELT

SEQ ID NO: 1331560 - protein, 9 aa, Homo Sapiens
EKVMTEAKM

SEQ ID NO: 1331561 - protein, 9 aa, Homo Sapiens
MSPILALSC

SEQ ID NO: 1331562 - protein, 9 aa, Homo Sapiens
EAGTEDKRS

SEQ ID NO: 1331563 - protein, 9 aa, Homo Sapiens
VCEKQTITR

SEQ ID NO: 1331564 - protein, 9 aa, Homo Sapiens
DHNLQEGNL

SEQ ID NO: 1331565 - protein, 9 aa, Homo Sapiens
TPSSPEGDN

SEQ ID NO: 1331566 - protein, 9 aa, Homo Sapiens
SPTYKQAKC

SEQ ID NO: 1331567 - protein, 9 aa, Homo Sapiens
IAEVRSSLK

SEQ ID NO: 1331568 - protein, 9 aa, Homo Sapiens
PQKPGDIDN

SEQ ID NO: 1331569 - protein, 9 aa, Homo Sapiens
LNEENDVNA

SEQ ID NO: 1331570 - protein, 9 aa, Homo Sapiens
KERVSSRRK

SEQ ID NO: 1331571 - protein, 9 aa, Homo Sapiens
RRFFPGSEE

SEQ ID NO: 1331572 - protein, 9 aa, Homo Sapiens
SSSRIRFSS

SEQ ID NO: 1331573 - protein, 9 aa, Homo Sapiens
HKGQIVISL

SEQ ID NO: 1331574 - protein, 9 aa, Homo Sapiens
LDWQLRCTI

SEQ ID NO: 1331575 - protein, 9 aa, Homo Sapiens
TISQQTVPG

SEQ ID NO: 1331576 - protein, 9 aa, Homo Sapiens
RLYVCPSTQ

SEQ ID NO: 1331577 - protein, 9 aa, Homo Sapiens
IIMISLTAR

SEQ ID NO: 1331578 - protein, 9 aa, Homo Sapiens
QNLGHYWNI

SEQ ID NO: 1331579 - protein, 9 aa, Homo Sapiens
VIVVLMCRG

SEQ ID NO: 1331580 - protein, 9 aa, Homo Sapiens
PIWFEYPVQ

SEQ ID NO: 1331581 - protein, 9 aa, Homo Sapiens
NMNITCVAV

SEQ ID NO: 1331582 - protein, 9 aa, Homo Sapiens
KLAFSSSFS

SEQ ID NO: 1331583 - protein, 9 aa, Homo Sapiens
GQVWRYLCA

SEQ ID NO: 1331584 - protein, 9 aa, Homo Sapiens
SVSLIAQYF

SEQ ID NO: 1331585 - protein, 9 aa, Homo Sapiens
TREASDNSG

SEQ ID NO: 1331586 - protein, 9 aa, Homo Sapiens
NLDEMTKLL

SEQ ID NO: 1331587 - protein, 9 aa, Homo Sapiens
QAWVQLGTQ

SEQ ID NO: 1331588 - protein, 9 aa, Homo Sapiens
RLSNVAPPA

SEQ ID NO: 1331589 - protein, 9 aa, Homo Sapiens
TQKVAISEF

SEQ ID NO: 1331590 - protein, 9 aa, Homo Sapiens
RNHLTQIML

SEQ ID NO: 1331591 - protein, 9 aa, Homo Sapiens
SNKNPWVCL

SEQ ID NO: 1331592 - protein, 9 aa, Homo Sapiens
YVNDNHPVF

SEQ ID NO: 1331593 - protein, 9 aa, Homo Sapiens
CVVDCRAFG

SEQ ID NO: 1331594 - protein, 9 aa, Homo Sapiens
SLHIGHTLT

SEQ ID NO: 1331595 - protein, 9 aa, Homo Sapiens
ARPSTSVHT

SEQ ID NO: 1331596 - protein, 9 aa, Homo Sapiens
GRKVLWLLI

SEQ ID NO: 1331597 - protein, 9 aa, Homo Sapiens
VVVAEGPFI

SEQ ID NO: 1331598 - protein, 9 aa, Homo Sapiens
TDGPHTLNP

SEQ ID NO: 1331599 - protein, 9 aa, Homo Sapiens
NDQSENGRY

SEQ ID NO: 1331600 - protein, 9 aa, Homo Sapiens
SGQNSSSGI

SEQ ID NO: 1331601 - protein, 9 aa, Homo Sapiens
ICKTFVQRN

SEQ ID NO: 1331602 - protein, 9 aa, Homo Sapiens
DTMDIEWLL

SEQ ID NO: 1331603 - protein, 9 aa, Homo Sapiens
HQESTCGRS

SEQ ID NO: 1331604 - protein, 9 aa, Homo Sapiens
HTNHPNTWG

SEQ ID NO: 1331605 - protein, 9 aa, Homo Sapiens
KDTNDSQFF

SEQ ID NO: 1331606 - protein, 9 aa, Homo Sapiens
TTRIHQEIQ

SEQ ID NO: 1331607 - protein, 9 aa, Homo Sapiens
DPPASHEDN

SEQ ID NO: 1331608 - protein, 9 aa, Homo Sapiens
ANRDRCRVT

SEQ ID NO: 1331609 - protein, 9 aa, Homo Sapiens
ACCKSVHYD

SEQ ID NO: 1331610 - protein, 9 aa, Homo Sapiens
FCFGISQSV

SEQ ID NO: 1331611 - protein, 9 aa, Homo Sapiens
DPGAQVFVV

SEQ ID NO: 1331612 - protein, 9 aa, Homo Sapiens
GPRAPHPPQ

SEQ ID NO: 1331613 - protein, 9 aa, Homo Sapiens
DFTRTYEPD

SEQ ID NO: 1331614 - protein, 9 aa, Homo Sapiens
SVSEKGTVI

SEQ ID NO: 1331615 - protein, 9 aa, Homo Sapiens
SLILLGVSK

SEQ ID NO: 1331616 - protein, 9 aa, Homo Sapiens
LRHIDDREE

SEQ ID NO: 1331617 - protein, 9 aa, Homo Sapiens
QCMLAREER

SEQ ID NO: 1331618 - protein, 9 aa, Homo Sapiens
MNTGVDAGE

SEQ ID NO: 1331619 - protein, 9 aa, Homo Sapiens
RFVQVHPIT

SEQ ID NO: 1331620 - protein, 9 aa, Homo Sapiens
PKGLMIFAG

SEQ ID NO: 1331621 - protein, 9 aa, Homo Sapiens
ASGHRTFET

SEQ ID NO: 1331622 - protein, 9 aa, Homo Sapiens
KHFSIFLSE

SEQ ID NO: 1331623 - protein, 9 aa, Homo Sapiens
LWAHQLFHR

SEQ ID NO: 1331624 - protein, 9 aa, Homo Sapiens
EDKGILNDF

SEQ ID NO: 1331625 - protein, 9 aa, Homo Sapiens
KQCLGHRLQ

SEQ ID NO: 1331626 - protein, 9 aa, Homo Sapiens
TSCSKDCTV

SEQ ID NO: 1331627 - protein, 9 aa, Homo Sapiens
YCLISAKMP

SEQ ID NO: 1331628 - protein, 9 aa, Homo Sapiens
QPLAKTTSR

SEQ ID NO: 1331629 - protein, 9 aa, Homo Sapiens
GWSLTLSPG

SEQ ID NO: 1331630 - protein, 9 aa, Homo Sapiens
NELFVTEVS

SEQ ID NO: 1331631 - protein, 9 aa, Homo Sapiens
IPVEPGCQA

SEQ ID NO: 1331632 - protein, 9 aa, Homo Sapiens
CFGISQSVV

SEQ ID NO: 1331633 - protein, 9 aa, Homo Sapiens
CKGPMTKHP

SEQ ID NO: 1331634 - protein, 9 aa, Homo Sapiens
WNCEVLKRE

SEQ ID NO: 1331635 - protein, 9 aa, Homo Sapiens
ENEEEVDII

SEQ ID NO: 1331636 - protein, 9 aa, Homo Sapiens
CWTELGALD

SEQ ID NO: 1331637 - protein, 9 aa, Homo Sapiens
SYTYPRLPE

SEQ ID NO: 1331638 - protein, 9 aa, Homo Sapiens
NTKEQHDLH

SEQ ID NO: 1331639 - protein, 9 aa, Homo Sapiens
TEKDEWLEA

SEQ ID NO: 1331640 - protein, 9 aa, Homo Sapiens
MLQMLEQYS

SEQ ID NO: 1331641 - protein, 9 aa, Homo Sapiens
IFGVRLDTV

SEQ ID NO: 1331642 - protein, 9 aa, Homo Sapiens
AEQKYVGKF

SEQ ID NO: 1331643 - protein, 9 aa, Homo Sapiens
PIFTTRVHV

SEQ ID NO: 1331644 - protein, 9 aa, Homo Sapiens
VQGKTRTLM

SEQ ID NO: 1331645 - protein, 9 aa, Homo Sapiens
EEFYNCRNI

SEQ ID NO: 1331646 - protein, 9 aa, Homo Sapiens
PVGVYHSPV

SEQ ID NO: 1331647 - protein, 9 aa, Homo Sapiens
KCVLDMEGK

SEQ ID NO: 1331648 - protein, 9 aa, Homo Sapiens
HKGYHPLAE

SEQ ID NO: 1331649 - protein, 9 aa, Homo Sapiens
YVLHNMMVT

SEQ ID NO: 1331650 - protein, 9 aa, Homo Sapiens
YHKIKATNK

SEQ ID NO: 1331651 - protein, 9 aa, Homo Sapiens
YAGDWHYQD

SEQ ID NO: 1331652 - protein, 9 aa, Homo Sapiens
NRFLEENLD

SEQ ID NO: 1331653 - protein, 9 aa, Homo Sapiens
AVLKEGLSG

SEQ ID NO: 1331654 - protein, 9 aa, Homo Sapiens
IRPETLVCH

SEQ ID NO: 1331655 - protein, 9 aa, Homo Sapiens
TIHIHYREP

SEQ ID NO: 1331656 - protein, 9 aa, Homo Sapiens
RRHKMISTL

SEQ ID NO: 1331657 - protein, 9 aa, Homo Sapiens
RSYTGQMTP

SEQ ID NO: 1331658 - protein, 9 aa, Homo Sapiens
CVPGPKGDP

SEQ ID NO: 1331659 - protein, 9 aa, Homo Sapiens
DMDLLHRIV

SEQ ID NO: 1331660 - protein, 9 aa, Homo Sapiens
HRSRSRTPP

SEQ ID NO: 1331661 - protein, 9 aa, Homo Sapiens
AKWEQLSLV

SEQ ID NO: 1331662 - protein, 9 aa, Homo Sapiens
ECEQVSKPC

SEQ ID NO: 1331663 - protein, 9 aa, Homo Sapiens
SFYSMSTPF

SEQ ID NO: 1331664 - protein, 9 aa, Homo Sapiens
PVCLHAGGV

SEQ ID NO: 1331665 - protein, 9 aa, Homo Sapiens
LLDVVMWDY

SEQ ID NO: 1331666 - protein, 9 aa, Homo Sapiens
PVLVSCGSS

SEQ ID NO: 1331667 - protein, 9 aa, Homo Sapiens
LTAECTIVT

SEQ ID NO: 1331668 - protein, 9 aa, Homo Sapiens
INEAILVPL

SEQ ID NO: 1331669 - protein, 9 aa, Homo Sapiens
EVSVDKAHG

SEQ ID NO: 1331670 - protein, 9 aa, Homo Sapiens
PFSGCCFSF

SEQ ID NO: 1331671 - protein, 9 aa, Homo Sapiens
PGIAGPVTM

SEQ ID NO: 1331672 - protein, 9 aa, Homo Sapiens
KPENEFVFN

SEQ ID NO: 1331673 - protein, 9 aa, Homo Sapiens
WWDYFEDQP

SEQ ID NO: 1331674 - protein, 9 aa, Homo Sapiens
AQTELCCLF

SEQ ID NO: 1331675 - protein, 9 aa, Homo Sapiens
DSQFFITTK

SEQ ID NO: 1331676 - protein, 9 aa, Homo Sapiens
RAPSRQGLA

SEQ ID NO: 1331677 - protein, 9 aa, Homo Sapiens
RDAHDYRDC

SEQ ID NO: 1331678 - protein, 9 aa, Homo Sapiens
CFSLCMKST

SEQ ID NO: 1331679 - protein, 9 aa, Homo Sapiens
IIYVFLSEN

SEQ ID NO: 1331680 - protein, 9 aa, Homo Sapiens
VLIGVSELI

SEQ ID NO: 1331681 - protein, 9 aa, Homo Sapiens
TLVMVEAEY

SEQ ID NO: 1331682 - protein, 9 aa, Homo Sapiens
EAVAFQSGS

SEQ ID NO: 1331683 - protein, 9 aa, Homo Sapiens
QLLWHRTQY

SEQ ID NO: 1331684 - protein, 9 aa, Homo Sapiens
LQLALFYQG

SEQ ID NO: 1331685 - protein, 9 aa, Homo Sapiens
GIKKAQNSQ

SEQ ID NO: 1331686 - protein, 9 aa, Homo Sapiens
GFTFVTFES

SEQ ID NO: 1331687 - protein, 9 aa, Homo Sapiens
EYPCSEEIS

SEQ ID NO: 1331688 - protein, 9 aa, Homo Sapiens
DSPDDLTTE

SEQ ID NO: 1331689 - protein, 9 aa, Homo Sapiens
HNETYSALS

SEQ ID NO: 1331690 - protein, 9 aa, Homo Sapiens
CLCIPACVI

SEQ ID NO: 1331691 - protein, 9 aa, Homo Sapiens
DSWKEYFCD

SEQ ID NO: 1331692 - protein, 9 aa, Homo Sapiens
ETLQRVKII

SEQ ID NO: 1331693 - protein, 9 aa, Homo Sapiens
NKLLARAVP

SEQ ID NO: 1331694 - protein, 9 aa, Homo Sapiens
QYQPHGKCQ

SEQ ID NO: 1331695 - protein, 9 aa, Homo Sapiens
FYSQETRDM

SEQ ID NO: 1331696 - protein, 9 aa, Homo Sapiens
GPGDPMWGG

SEQ ID NO: 1331697 - protein, 9 aa, Homo Sapiens
ATQAPGSWG

SEQ ID NO: 1331698 - protein, 9 aa, Homo Sapiens
PKVLDGTHC

SEQ ID NO: 1331699 - protein, 9 aa, Homo Sapiens
DLAPKCDAS

SEQ ID NO: 1331700 - protein, 9 aa, Homo Sapiens
TQAPGSWGS

SEQ ID NO: 1331701 - protein, 9 aa, Homo Sapiens
GFEISQGHL

SEQ ID NO: 1331702 - protein, 9 aa, Homo Sapiens
RFRSFDTLL

SEQ ID NO: 1331703 - protein, 9 aa, Homo Sapiens
LASDAGGRQ

SEQ ID NO: 1331704 - protein, 9 aa, Homo Sapiens
QGAEKFISL

SEQ ID NO: 1331705 - protein, 9 aa, Homo Sapiens
KEVQLHKTT

SEQ ID NO: 1331706 - protein, 9 aa, Homo Sapiens
TLVLMEDTG

SEQ ID NO: 1331707 - protein, 9 aa, Homo Sapiens
ISETFNHVN

SEQ ID NO: 1331708 - protein, 9 aa, Homo Sapiens
QLCSPICPP

SEQ ID NO: 1331709 - protein, 9 aa, Homo Sapiens
TAHTAPAYY

SEQ ID NO: 1331710 - protein, 9 aa, Homo Sapiens
TKKRPQCAT

SEQ ID NO: 1331711 - protein, 9 aa, Homo Sapiens
TTEQGMRQL

SEQ ID NO: 1331712 - protein, 9 aa, Homo Sapiens
FFVDYDNKS

SEQ ID NO: 1331713 - protein, 9 aa, Homo Sapiens
YALARLELQ

SEQ ID NO: 1331714 - protein, 9 aa, Homo Sapiens
NRAIMARRQ

SEQ ID NO: 1331715 - protein, 9 aa, Homo Sapiens
SRGTNPNLR

SEQ ID NO: 1331716 - protein, 9 aa, Homo Sapiens
KQTLHHFLE

SEQ ID NO: 1331717 - protein, 9 aa, Homo Sapiens
PAEETKPDT

SEQ ID NO: 1331718 - protein, 9 aa, Homo Sapiens
LNVTALPLP

SEQ ID NO: 1331719 - protein, 9 aa, Homo Sapiens
KDLHLLEKL

SEQ ID NO: 1331720 - protein, 9 aa, Homo Sapiens
RLLSVWPGH

SEQ ID NO: 1331721 - protein, 9 aa, Homo Sapiens
GTAGRRLTS

SEQ ID NO: 1331722 - protein, 9 aa, Homo Sapiens
GGGSLPPQD

SEQ ID NO: 1331723 - protein, 9 aa, Homo Sapiens
TYISVTGCI

SEQ ID NO: 1331724 - protein, 9 aa, Homo Sapiens
VGAICFGLS

SEQ ID NO: 1331725 - protein, 9 aa, Homo Sapiens
KCETCGKMY

SEQ ID NO: 1331726 - protein, 9 aa, Homo Sapiens
SNVEVFILS

SEQ ID NO: 1331727 - protein, 9 aa, Homo Sapiens
HWEKLLKNM

SEQ ID NO: 1331728 - protein, 9 aa, Homo Sapiens
TRQALASED

SEQ ID NO: 1331729 - protein, 9 aa, Homo Sapiens
SNTDLNKRR

SEQ ID NO: 1331730 - protein, 9 aa, Homo Sapiens
VQQHQQMMH

SEQ ID NO: 1331731 - protein, 9 aa, Homo Sapiens
NQQLWEQSE

SEQ ID NO: 1331732 - protein, 9 aa, Homo Sapiens
STAKRARNN

SEQ ID NO: 1331733 - protein, 9 aa, Homo Sapiens
VQMENLQDV

SEQ ID NO: 1331734 - protein, 9 aa, Homo Sapiens
IREKYMQKL

SEQ ID NO: 1331735 - protein, 9 aa, Homo Sapiens
HCSSLTKHR

SEQ ID NO: 1331736 - protein, 9 aa, Homo Sapiens
PAPSTKEHH

SEQ ID NO: 1331737 - protein, 9 aa, Homo Sapiens
CSMEIPGLR

SEQ ID NO: 1331738 - protein, 9 aa, Homo Sapiens
SLNMHIRAD

SEQ ID NO: 1331739 - protein, 9 aa, Homo Sapiens
HVAVRLGHV

SEQ ID NO: 1331740 - protein, 9 aa, Homo Sapiens
SGGKCVFDS

SEQ ID NO: 1331741 - protein, 9 aa, Homo Sapiens
VDANYEMSG

SEQ ID NO: 1331742 - protein, 9 aa, Homo Sapiens
GDAPAKLFG

SEQ ID NO: 1331743 - protein, 9 aa, Homo Sapiens
PVTYPSVGA

SEQ ID NO: 1331744 - protein, 9 aa, Homo Sapiens
VKIRPQFLL

SEQ ID NO: 1331745 - protein, 9 aa, Homo Sapiens
QRSLFLLFH

SEQ ID NO: 1331746 - protein, 9 aa, Homo Sapiens
PSTASSAPS

SEQ ID NO: 1331747 - protein, 9 aa, Homo Sapiens
DALDTLCKH

SEQ ID NO: 1331748 - protein, 9 aa, Homo Sapiens
IIIKDNMAQ

SEQ ID NO: 1331749 - protein, 9 aa, Homo Sapiens
NIRLIPEKA

SEQ ID NO: 1331750 - protein, 9 aa, Homo Sapiens
VTTYWKTLV

SEQ ID NO: 1331751 - protein, 9 aa, Homo Sapiens
CYPDNPVNR

SEQ ID NO: 1331752 - protein, 9 aa, Homo Sapiens
KNEWLLCPI

SEQ ID NO: 1331753 - protein, 9 aa, Homo Sapiens
FRVDLPIKL

SEQ ID NO: 1331754 - protein, 9 aa, Homo Sapiens
YAWHFETRK

SEQ ID NO: 1331755 - protein, 9 aa, Homo Sapiens
EVLYHISMI

SEQ ID NO: 1331756 - protein, 9 aa, Homo Sapiens
SEEVCPQDT

SEQ ID NO: 1331757 - protein, 9 aa, Homo Sapiens
QNRVHEKQK

SEQ ID NO: 1331758 - protein, 9 aa, Homo Sapiens
QLMVPARDS

SEQ ID NO: 1331759 - protein, 9 aa, Homo Sapiens
VSMRVMIEA

SEQ ID NO: 1331760 - protein, 9 aa, Homo Sapiens
TGRCVSACC

SEQ ID NO: 1331761 - protein, 9 aa, Homo Sapiens
LKQIQEECD

SEQ ID NO: 1331762 - protein, 9 aa, Homo Sapiens
LMDGILEII

SEQ ID NO: 1331763 - protein, 9 aa, Homo Sapiens
IEYHGAEKE

SEQ ID NO: 1331764 - protein, 9 aa, Homo Sapiens
TKPVIAKKE

SEQ ID NO: 1331765 - protein, 9 aa, Homo Sapiens
TSNHGLADL

SEQ ID NO: 1331766 - protein, 9 aa, Homo Sapiens
LHSFTDVIF

SEQ ID NO: 1331767 - protein, 9 aa, Homo Sapiens
PNGYLCFHY

SEQ ID NO: 1331768 - protein, 9 aa, Homo Sapiens
INKPDCDDW

SEQ ID NO: 1331769 - protein, 9 aa, Homo Sapiens
VLDHVYHGH

SEQ ID NO: 1331770 - protein, 9 aa, Homo Sapiens
MTEIFRRVY

SEQ ID NO: 1331771 - protein, 9 aa, Homo Sapiens
LVDANYEMS

SEQ ID NO: 1331772 - protein, 9 aa, Homo Sapiens
LFQFLWMVD

SEQ ID NO: 1331773 - protein, 9 aa, Homo Sapiens
PPYNKVCTY

SEQ ID NO: 1331774 - protein, 9 aa, Homo Sapiens
TGNIREEVN

SEQ ID NO: 1331775 - protein, 9 aa, Homo Sapiens
NLLKIKHGN

SEQ ID NO: 1331776 - protein, 9 aa, Homo Sapiens
DQQMEWQRY

SEQ ID NO: 1331777 - protein, 9 aa, Homo Sapiens
VLLPPKDDT

SEQ ID NO: 1331778 - protein, 9 aa, Homo Sapiens
GPPLPTRGH

SEQ ID NO: 1331779 - protein, 9 aa, Homo Sapiens
FHMYLVLVK

SEQ ID NO: 1331780 - protein, 9 aa, Homo Sapiens
SKGSDIWSF

SEQ ID NO: 1331781 - protein, 9 aa, Homo Sapiens
FAWTFHSVA

SEQ ID NO: 1331782 - protein, 9 aa, Homo Sapiens
PGRASSCAA

SEQ ID NO: 1331783 - protein, 9 aa, Homo Sapiens
YEIGSSKIN

SEQ ID NO: 1331784 - protein, 9 aa, Homo Sapiens
HIKKKCCYV

SEQ ID NO: 1331785 - protein, 9 aa, Homo Sapiens
ECLCIPACV

SEQ ID NO: 1331786 - protein, 9 aa, Homo Sapiens
VCSSVAYAV

SEQ ID NO: 1331787 - protein, 9 aa, Homo Sapiens
KSIYFHTAQ

SEQ ID NO: 1331788 - protein, 9 aa, Homo Sapiens
KSGIRIKEG

SEQ ID NO: 1331789 - protein, 9 aa, Homo Sapiens
EGVDGAWGQ

SEQ ID NO: 1331790 - protein, 9 aa, Homo Sapiens
TDMLMEGVK

SEQ ID NO: 1331791 - protein, 9 aa, Homo Sapiens
STPSLFLCI

SEQ ID NO: 1331792 - protein, 9 aa, Homo Sapiens
TPVNETATT

SEQ ID NO: 1331793 - protein, 9 aa, Homo Sapiens
AKVMRPLRS

SEQ ID NO: 1331794 - protein, 9 aa, Homo Sapiens
PRACPPDVY

SEQ ID NO: 1331795 - protein, 9 aa, Homo Sapiens
QCLSFVFFQ

SEQ ID NO: 1331796 - protein, 9 aa, Homo Sapiens
TEVNKADNE

SEQ ID NO: 1331797 - protein, 9 aa, Homo Sapiens
YGKKCWTSH

SEQ ID NO: 1331798 - protein, 9 aa, Homo Sapiens
WQLVSFQKL

SEQ ID NO: 1331799 - protein, 9 aa, Homo Sapiens
MATVAGAMT

SEQ ID NO: 1331800 - protein, 9 aa, Homo Sapiens
LSRGGKATL

SEQ ID NO: 1331801 - protein, 9 aa, Homo Sapiens
PHGKCQSSV

SEQ ID NO: 1331802 - protein, 9 aa, Homo Sapiens
TLLIYCRLR

SEQ ID NO: 1331803 - protein, 9 aa, Homo Sapiens
AASGPCHAA

SEQ ID NO: 1331804 - protein, 9 aa, Homo Sapiens
GCVNMCEQV

SEQ ID NO: 1331805 - protein, 9 aa, Homo Sapiens
LDGTHCYTE

SEQ ID NO: 1331806 - protein, 9 aa, Homo Sapiens
TYCVFKTVN

SEQ ID NO: 1331807 - protein, 9 aa, Homo Sapiens
KSGRRCWGQ

SEQ ID NO: 1331808 - protein, 9 aa, Homo Sapiens
QLYLGTKLL

SEQ ID NO: 1331809 - protein, 9 aa, Homo Sapiens
YLKEVDQLH

SEQ ID NO: 1331810 - protein, 9 aa, Homo Sapiens
PCIHCLRPI

SEQ ID NO: 1331811 - protein, 9 aa, Homo Sapiens
FTELQPIDF

SEQ ID NO: 1331812 - protein, 9 aa, Homo Sapiens
CYPHFTCTV

SEQ ID NO: 1331813 - protein, 9 aa, Homo Sapiens
KHSLDIDEE

SEQ ID NO: 1331814 - protein, 9 aa, Homo Sapiens
KETYFDTQN

SEQ ID NO: 1331815 - protein, 9 aa, Homo Sapiens
AHTSWNMGT

SEQ ID NO: 1331816 - protein, 9 aa, Homo Sapiens
TARKAPAPV

SEQ ID NO: 1331817 - protein, 9 aa, Homo Sapiens
SVRAIWIDG

SEQ ID NO: 1331818 - protein, 9 aa, Homo Sapiens
HLSLHRCRH

SEQ ID NO: 1331819 - protein, 9 aa, Homo Sapiens
GISRSQSSF

SEQ ID NO: 1331820 - protein, 9 aa, Homo Sapiens
GQQQASVTT

SEQ ID NO: 1331821 - protein, 9 aa, Homo Sapiens
VVEGQGWQV

SEQ ID NO: 1331822 - protein, 9 aa, Homo Sapiens
AHVLVKRKP

SEQ ID NO: 1331823 - protein, 9 aa, Homo Sapiens
YHMDASGET

SEQ ID NO: 1331824 - protein, 9 aa, Homo Sapiens
RNIDSEFSN

SEQ ID NO: 1331825 - protein, 9 aa, Homo Sapiens
YVRVLRFFS

SEQ ID NO: 1331826 - protein, 9 aa, Homo Sapiens
KVLLKVIES

SEQ ID NO: 1331827 - protein, 9 aa, Homo Sapiens
SKSKVPHLH

SEQ ID NO: 1331828 - protein, 9 aa, Homo Sapiens
DTRGSSIPE

SEQ ID NO: 1331829 - protein, 9 aa, Homo Sapiens
FVQPVCPTF

SEQ ID NO: 1331830 - protein, 9 aa, Homo Sapiens
GIHFDPENP

SEQ ID NO: 1331831 - protein, 9 aa, Homo Sapiens
ANVFENEEH

SEQ ID NO: 1331832 - protein, 9 aa, Homo Sapiens
QLEHDLQVF

SEQ ID NO: 1331833 - protein, 9 aa, Homo Sapiens
LYPYGDPHM

SEQ ID NO: 1331834 - protein, 9 aa, Homo Sapiens
CSPPYQLDS

SEQ ID NO: 1331835 - protein, 9 aa, Homo Sapiens
LWPLEAKRQ

SEQ ID NO: 1331836 - protein, 9 aa, Homo Sapiens
TISLDRYWA

SEQ ID NO: 1331837 - protein, 9 aa, Homo Sapiens
KPETDTYSS

SEQ ID NO: 1331838 - protein, 9 aa, Homo Sapiens
TSLLETFAH

SEQ ID NO: 1331839 - protein, 9 aa, Homo Sapiens
LLQQQKICQ

SEQ ID NO: 1331840 - protein, 9 aa, Homo Sapiens
AGEKCTKEP

SEQ ID NO: 1331841 - protein, 9 aa, Homo Sapiens
LFKELQPDK

SEQ ID NO: 1331842 - protein, 9 aa, Homo Sapiens
YKSHIQVRL

SEQ ID NO: 1331843 - protein, 9 aa, Homo Sapiens
ETLDDDQQM

SEQ ID NO: 1331844 - protein, 9 aa, Homo Sapiens
PHTRNNIKP

SEQ ID NO: 1331845 - protein, 9 aa, Homo Sapiens
GYVNFLINP

SEQ ID NO: 1331846 - protein, 9 aa, Homo Sapiens
RLFQLKNGM

SEQ ID NO: 1331847 - protein, 9 aa, Homo Sapiens
ALPYKTSVS

SEQ ID NO: 1331848 - protein, 9 aa, Homo Sapiens
TVTRFIEEK

SEQ ID NO: 1331849 - protein, 9 aa, Homo Sapiens
FLLDVMSYD

SEQ ID NO: 1331850 - protein, 9 aa, Homo Sapiens
STKEYTYLK

SEQ ID NO: 1331851 - protein, 9 aa, Homo Sapiens
VDSQEHNII

SEQ ID NO: 1331852 - protein, 9 aa, Homo Sapiens
TTRDNEVIS

SEQ ID NO: 1331853 - protein, 9 aa, Homo Sapiens
GGMEVWWCA

SEQ ID NO: 1331854 - protein, 9 aa, Homo Sapiens
GDHQQLCPS

SEQ ID NO: 1331855 - protein, 9 aa, Homo Sapiens
GQHMAEQLL

SEQ ID NO: 1331856 - protein, 9 aa, Homo Sapiens
NSEQASHHC

SEQ ID NO: 1331857 - protein, 9 aa, Homo Sapiens
MGTILEGKR

SEQ ID NO: 1331858 - protein, 9 aa, Homo Sapiens
HKWVNGFNL

SEQ ID NO: 1331859 - protein, 9 aa, Homo Sapiens
HTCLASLSI

SEQ ID NO: 1331860 - protein, 9 aa, Homo Sapiens
ILPDSLTSA

SEQ ID NO: 1331861 - protein, 9 aa, Homo Sapiens
QSQPSGAPM

SEQ ID NO: 1331862 - protein, 9 aa, Homo Sapiens
SSSRIFKLA

SEQ ID NO: 1331863 - protein, 9 aa, Homo Sapiens
PVCCPEKIC

SEQ ID NO: 1331864 - protein, 9 aa, Homo Sapiens
SGGREWGRS

SEQ ID NO: 1331865 - protein, 9 aa, Homo Sapiens
ALDKDAPLH

SEQ ID NO: 1331866 - protein, 9 aa, Homo Sapiens
AQLKESFQQ

SEQ ID NO: 1331867 - protein, 9 aa, Homo Sapiens
VRNVGRCST

SEQ ID NO: 1331868 - protein, 9 aa, Homo Sapiens
AELPEDKSR

SEQ ID NO: 1331869 - protein, 9 aa, Homo Sapiens
ALINTLGIG

SEQ ID NO: 1331870 - protein, 9 aa, Homo Sapiens
CEGRDTHRK

SEQ ID NO: 1331871 - protein, 9 aa, Homo Sapiens
EVRIHIRVG

SEQ ID NO: 1331872 - protein, 9 aa, Homo Sapiens
EHSSMNRLT

SEQ ID NO: 1331873 - protein, 9 aa, Homo Sapiens
EDRRFNIDL

SEQ ID NO: 1331874 - protein, 9 aa, Homo Sapiens
YVAFLPEEE

SEQ ID NO: 1331875 - protein, 9 aa, Homo Sapiens
FEEIKMAMG

SEQ ID NO: 1331876 - protein, 9 aa, Homo Sapiens
RGTRMKSVG

SEQ ID NO: 1331877 - protein, 9 aa, Homo Sapiens
NGALLSCNT

SEQ ID NO: 1331878 - protein, 9 aa, Homo Sapiens
AHQLFHRIQ

SEQ ID NO: 1331879 - protein, 9 aa, Homo Sapiens
GREWGRSKE

SEQ ID NO: 1331880 - protein, 9 aa, Homo Sapiens
NSVPLGHTH

SEQ ID NO: 1331881 - protein, 9 aa, Homo Sapiens
PVKSTLILV

SEQ ID NO: 1331882 - protein, 9 aa, Homo Sapiens
DDPHFQDSS

SEQ ID NO: 1331883 - protein, 9 aa, Homo Sapiens
APVNQIQEI

SEQ ID NO: 1331884 - protein, 9 aa, Homo Sapiens
DVGLGVQVL

SEQ ID NO: 1331885 - protein, 9 aa, Homo Sapiens
GDPAFRRGC

SEQ ID NO: 1331886 - protein, 9 aa, Homo Sapiens
VNTYVRVLR

SEQ ID NO: 1331887 - protein, 9 aa, Homo Sapiens
GCTSIVRNL

SEQ ID NO: 1331888 - protein, 9 aa, Homo Sapiens
DMDYIQIDA

SEQ ID NO: 1331889 - protein, 9 aa, Homo Sapiens
VIIFTRKED

SEQ ID NO: 1331890 - protein, 9 aa, Homo Sapiens
WQGLLLIAS

SEQ ID NO: 1331891 - protein, 9 aa, Homo Sapiens
HYLTVACIF

SEQ ID NO: 1331892 - protein, 9 aa, Homo Sapiens
FFIGAVNLP

SEQ ID NO: 1331893 - protein, 9 aa, Homo Sapiens
PLVNKHHPT

SEQ ID NO: 1331894 - protein, 9 aa, Homo Sapiens
GQHAVLSGH

SEQ ID NO: 1331895 - protein, 9 aa, Homo Sapiens
NNTIEMVKP

SEQ ID NO: 1331896 - protein, 9 aa, Homo Sapiens
QVVDMKKSG

SEQ ID NO: 1331897 - protein, 9 aa, Homo Sapiens
QKFWLRSKK

SEQ ID NO: 1331898 - protein, 9 aa, Homo Sapiens
MISELRQHK

SEQ ID NO: 1331899 - protein, 9 aa, Homo Sapiens
TLHWKKDGQ

SEQ ID NO: 1331900 - protein, 9 aa, Homo Sapiens
VIGVIVPGR

SEQ ID NO: 1331901 - protein, 9 aa, Homo Sapiens
DTCGEAFNC

SEQ ID NO: 1331902 - protein, 9 aa, Homo Sapiens
DIVDTGAID

SEQ ID NO: 1331903 - protein, 9 aa, Homo Sapiens
PHLFLGLEA

SEQ ID NO: 1331904 - protein, 9 aa, Homo Sapiens
IKSSVSHKN

SEQ ID NO: 1331905 - protein, 9 aa, Homo Sapiens
IHHTWPWVN

SEQ ID NO: 1331906 - protein, 9 aa, Homo Sapiens
YAALTHPKC

SEQ ID NO: 1331907 - protein, 9 aa, Homo Sapiens
LLLLDLPIL

SEQ ID NO: 1331908 - protein, 9 aa, Homo Sapiens
TYAAFAIIT

SEQ ID NO: 1331909 - protein, 9 aa, Homo Sapiens
AVKPVIYKV

SEQ ID NO: 1331910 - protein, 9 aa, Homo Sapiens
KQCHVRKKR

SEQ ID NO: 1331911 - protein, 9 aa, Homo Sapiens
ARRPPAHRA

SEQ ID NO: 1331912 - protein, 9 aa, Homo Sapiens
APVIISSMM

SEQ ID NO: 1331913 - protein, 9 aa, Homo Sapiens
KSPHLAALI

SEQ ID NO: 1331914 - protein, 9 aa, Homo Sapiens
YCRVWCWPD

SEQ ID NO: 1331915 - protein, 9 aa, Homo Sapiens
ECGTKCPVE

SEQ ID NO: 1331916 - protein, 9 aa, Homo Sapiens
RGVEKSPHL

SEQ ID NO: 1331917 - protein, 9 aa, Homo Sapiens
STGNKREQT

SEQ ID NO: 1331918 - protein, 9 aa, Homo Sapiens
RECSPAPPP

SEQ ID NO: 1331919 - protein, 9 aa, Homo Sapiens
KFFLKQHCE

SEQ ID NO: 1331920 - protein, 9 aa, Homo Sapiens
GGGEDSTTR

SEQ ID NO: 1331921 - protein, 9 aa, Homo Sapiens
SNFVLYNKS

SEQ ID NO: 1331922 - protein, 9 aa, Homo Sapiens
EHTRSDSEN

SEQ ID NO: 1331923 - protein, 9 aa, Homo Sapiens
HNCETRCGQ

SEQ ID NO: 1331924 - protein, 9 aa, Homo Sapiens
LLERVTVSH

SEQ ID NO: 1331925 - protein, 9 aa, Homo Sapiens
FLLDNVRIV

SEQ ID NO: 1331926 - protein, 9 aa, Homo Sapiens
GYLQYLAVL

SEQ ID NO: 1331927 - protein, 9 aa, Homo Sapiens
EGPAKVAHM

SEQ ID NO: 1331928 - protein, 9 aa, Homo Sapiens
TEQSGTHDY

SEQ ID NO: 1331929 - protein, 9 aa, Homo Sapiens
CVCREVGLE

SEQ ID NO: 1331930 - protein, 9 aa, Homo Sapiens
AISLCGASA

SEQ ID NO: 1331931 - protein, 9 aa, Homo Sapiens
ELKLYWGTA

SEQ ID NO: 1331932 - protein, 9 aa, Homo Sapiens
LYVDSRSYY

SEQ ID NO: 1331933 - protein, 9 aa, Homo Sapiens
SQVQVVLLP

SEQ ID NO: 1331934 - protein, 9 aa, Homo Sapiens
PNDILLVSP

SEQ ID NO: 1331935 - protein, 9 aa, Homo Sapiens
VSVKNYEGM

SEQ ID NO: 1331936 - protein, 9 aa, Homo Sapiens
QMTVPIQMT

SEQ ID NO: 1331937 - protein, 9 aa, Homo Sapiens
LQINKIIPK

SEQ ID NO: 1331938 - protein, 9 aa, Homo Sapiens
DVLHTYMRS

SEQ ID NO: 1331939 - protein, 9 aa, Homo Sapiens
PEDVLASPE

SEQ ID NO: 1331940 - protein, 9 aa, Homo Sapiens
LLRFILFFP

SEQ ID NO: 1331941 - protein, 9 aa, Homo Sapiens
YDTLMTINR

SEQ ID NO: 1331942 - protein, 9 aa, Homo Sapiens
EKQCLIKSD

SEQ ID NO: 1331943 - protein, 9 aa, Homo Sapiens
IHYARIQLC

SEQ ID NO: 1331944 - protein, 9 aa, Homo Sapiens
NLNANQNLT

SEQ ID NO: 1331945 - protein, 9 aa, Homo Sapiens
SPQSSKNLS

SEQ ID NO: 1331946 - protein, 9 aa, Homo Sapiens
YDMCWSCEH

SEQ ID NO: 1331947 - protein, 9 aa, Homo Sapiens
DRSSNTFPV

SEQ ID NO: 1331948 - protein, 9 aa, Homo Sapiens
GDTQKTASY

SEQ ID NO: 1331949 - protein, 9 aa, Homo Sapiens
PRNHQGARL

SEQ ID NO: 1331950 - protein, 9 aa, Homo Sapiens
SAHNRNNSG

SEQ ID NO: 1331951 - protein, 9 aa, Homo Sapiens
WQQLTASDH

SEQ ID NO: 1331952 - protein, 9 aa, Homo Sapiens
HHLTLERPA

SEQ ID NO: 1331953 - protein, 9 aa, Homo Sapiens
RKQQLTGAG

SEQ ID NO: 1331954 - protein, 9 aa, Homo Sapiens
QRVKIISIN

SEQ ID NO: 1331955 - protein, 9 aa, Homo Sapiens
GTSETILYA

SEQ ID NO: 1331956 - protein, 9 aa, Homo Sapiens
ILFFVPFPY

SEQ ID NO: 1331957 - protein, 9 aa, Homo Sapiens
TLPVPSFEG

SEQ ID NO: 1331958 - protein, 9 aa, Homo Sapiens
WERQAEDSD

SEQ ID NO: 1331959 - protein, 9 aa, Homo Sapiens
GRRQQPQGQ

SEQ ID NO: 1331960 - protein, 9 aa, Homo Sapiens
MDSAKRWHP

SEQ ID NO: 1331961 - protein, 9 aa, Homo Sapiens
VQLRKYCKS

SEQ ID NO: 1331962 - protein, 9 aa, Homo Sapiens
TVFSTPNYC

SEQ ID NO: 1331963 - protein, 9 aa, Homo Sapiens
LTLQEEELT

SEQ ID NO: 1331964 - protein, 9 aa, Homo Sapiens
LVEVCRKLN

SEQ ID NO: 1331965 - protein, 9 aa, Homo Sapiens
IRHRPSLYI

SEQ ID NO: 1331966 - protein, 9 aa, Homo Sapiens
ETTYVSSLT

SEQ ID NO: 1331967 - protein, 9 aa, Homo Sapiens
VPFKVKADQ

SEQ ID NO: 1331968 - protein, 9 aa, Homo Sapiens
TVSLNIRKS

SEQ ID NO: 1331969 - protein, 9 aa, Homo Sapiens
GNSFTHLPD

SEQ ID NO: 1331970 - protein, 9 aa, Homo Sapiens
PCGVGQRIR

SEQ ID NO: 1331971 - protein, 9 aa, Homo Sapiens
SIDDVLGIT

SEQ ID NO: 1331972 - protein, 9 aa, Homo Sapiens
ERRIPRGRH

SEQ ID NO: 1331973 - protein, 9 aa, Homo Sapiens
SEKQKSIIL

SEQ ID NO: 1331974 - protein, 9 aa, Homo Sapiens
YMACQYVLS

SEQ ID NO: 1331975 - protein, 9 aa, Homo Sapiens
SSSLLHSIQ

SEQ ID NO: 1331976 - protein, 9 aa, Homo Sapiens
AVTREHLEL

SEQ ID NO: 1331977 - protein, 9 aa, Homo Sapiens
NLVLSCPYF

SEQ ID NO: 1331978 - protein, 9 aa, Homo Sapiens
HMAEQLLAR

SEQ ID NO: 1331979 - protein, 9 aa, Homo Sapiens
TKKPNLSKI

SEQ ID NO: 1331980 - protein, 9 aa, Homo Sapiens
AHSDYAHYS

SEQ ID NO: 1331981 - protein, 9 aa, Homo Sapiens
HDKDGWPLC

SEQ ID NO: 1331982 - protein, 9 aa, Homo Sapiens
MMNIKEDTD

SEQ ID NO: 1331983 - protein, 9 aa, Homo Sapiens
PETKWVALP

SEQ ID NO: 1331984 - protein, 9 aa, Homo Sapiens
LPEAARLTQ

SEQ ID NO: 1331985 - protein, 9 aa, Homo Sapiens
VPRDDEGWP

SEQ ID NO: 1331986 - protein, 9 aa, Homo Sapiens
AQPTMEEGS

SEQ ID NO: 1331987 - protein, 9 aa, Homo Sapiens
NMLYQSWEL

SEQ ID NO: 1331988 - protein, 9 aa, Homo Sapiens
SILEEHRKD

SEQ ID NO: 1331989 - protein, 9 aa, Homo Sapiens
NLMVLVEQQ

SEQ ID NO: 1331990 - protein, 9 aa, Homo Sapiens
TSLKRHLTP

SEQ ID NO: 1331991 - protein, 9 aa, Homo Sapiens
VTRETEWSF

SEQ ID NO: 1331992 - protein, 9 aa, Homo Sapiens
ITPLLLLPL

SEQ ID NO: 1331993 - protein, 9 aa, Homo Sapiens
VALTESEME

SEQ ID NO: 1331994 - protein, 9 aa, Homo Sapiens
EMLGDMIWD

SEQ ID NO: 1331995 - protein, 9 aa, Homo Sapiens
QNRFGKKEF

SEQ ID NO: 1331996 - protein, 9 aa, Homo Sapiens
YMRSFGLSI

SEQ ID NO: 1331997 - protein, 9 aa, Homo Sapiens
GTMPEVETI

SEQ ID NO: 1331998 - protein, 9 aa, Homo Sapiens
MTCHETKFA

SEQ ID NO: 1331999 - protein, 9 aa, Homo Sapiens
PLVCQCLAP

SEQ ID NO: 1332000 - protein, 9 aa, Homo Sapiens
GQLLLWAKA

SEQ ID NO: 1332001 - protein, 9 aa, Homo Sapiens
AHIKALLVL

SEQ ID NO: 1332002 - protein, 9 aa, Homo Sapiens
TTMYFPSEA

SEQ ID NO: 1332003 - protein, 9 aa, Homo Sapiens
MPEVETIRA

SEQ ID NO: 1332004 - protein, 9 aa, Homo Sapiens
HKQWDRALA

SEQ ID NO: 1332005 - protein, 9 aa, Homo Sapiens
TDGNILRRV

SEQ ID NO: 1332006 - protein, 9 aa, Homo Sapiens
VFMYLTGNN

SEQ ID NO: 1332007 - protein, 9 aa, Homo Sapiens
FSSVEMLVD

SEQ ID NO: 1332008 - protein, 9 aa, Homo Sapiens
MNQTNKDKM

SEQ ID NO: 1332009 - protein, 9 aa, Homo Sapiens
LSHKSGRRC

SEQ ID NO: 1332010 - protein, 9 aa, Homo Sapiens
HIKGRLIDT

SEQ ID NO: 1332011 - protein, 9 aa, Homo Sapiens
NKFGCRPPQ

SEQ ID NO: 1332012 - protein, 9 aa, Homo Sapiens
VRHCTWFYK

SEQ ID NO: 1332013 - protein, 9 aa, Homo Sapiens
CIICNHCAV

SEQ ID NO: 1332014 - protein, 9 aa, Homo Sapiens
YRPGTVALH

SEQ ID NO: 1332015 - protein, 9 aa, Homo Sapiens
GKAFICGFQ

SEQ ID NO: 1332016 - protein, 9 aa, Homo Sapiens
HLPQEFGDV

SEQ ID NO: 1332017 - protein, 9 aa, Homo Sapiens
WDTSSNTLS

SEQ ID NO: 1332018 - protein, 9 aa, Homo Sapiens
AVSKAWAKV

SEQ ID NO: 1332019 - protein, 9 aa, Homo Sapiens
QERKPMGVS

SEQ ID NO: 1332020 - protein, 9 aa, Homo Sapiens
LVIVRILHG

SEQ ID NO: 1332021 - protein, 9 aa, Homo Sapiens
HLDDTCVSN

SEQ ID NO: 1332022 - protein, 9 aa, Homo Sapiens
HAGQGVHVV

SEQ ID NO: 1332023 - protein, 9 aa, Homo Sapiens
KDGLYTSLT

SEQ ID NO: 1332024 - protein, 9 aa, Homo Sapiens
KDKMCKAVA

SEQ ID NO: 1332025 - protein, 9 aa, Homo Sapiens
DTDEKMGKN

SEQ ID NO: 1332026 - protein, 9 aa, Homo Sapiens
ARDKRTLKQ

SEQ ID NO: 1332027 - protein, 9 aa, Homo Sapiens
LAEEGHKIY

SEQ ID NO: 1332028 - protein, 9 aa, Homo Sapiens
FALSEEVCP

SEQ ID NO: 1332029 - protein, 9 aa, Homo Sapiens
QTSSGQYIV

SEQ ID NO: 1332030 - protein, 9 aa, Homo Sapiens
CQRAIIQHH

SEQ ID NO: 1332031 - protein, 9 aa, Homo Sapiens
LAKMIKMFF

SEQ ID NO: 1332032 - protein, 9 aa, Homo Sapiens
RNIIMWLDH

SEQ ID NO: 1332033 - protein, 9 aa, Homo Sapiens
VHEIVEKIL

SEQ ID NO: 1332034 - protein, 9 aa, Homo Sapiens
NAHKSKEWY

SEQ ID NO: 1332035 - protein, 9 aa, Homo Sapiens
EIHSKEHIL

SEQ ID NO: 1332036 - protein, 9 aa, Homo Sapiens
PGDLMWINA

SEQ ID NO: 1332037 - protein, 9 aa, Homo Sapiens
SGVPPPGQS

SEQ ID NO: 1332038 - protein, 9 aa, Homo Sapiens
SYLGHDPVH

SEQ ID NO: 1332039 - protein, 9 aa, Homo Sapiens
TAECTIVTL

SEQ ID NO: 1332040 - protein, 9 aa, Homo Sapiens
QVTAFQEQE

SEQ ID NO: 1332041 - protein, 9 aa, Homo Sapiens
GHVLRVKHA

SEQ ID NO: 1332042 - protein, 9 aa, Homo Sapiens
SVTDCLMAV

SEQ ID NO: 1332043 - protein, 9 aa, Homo Sapiens
LTDEDWNEV

SEQ ID NO: 1332044 - protein, 9 aa, Homo Sapiens
ELSLQGWRR

SEQ ID NO: 1332045 - protein, 9 aa, Homo Sapiens
NSPSRELHL

SEQ ID NO: 1332046 - protein, 9 aa, Homo Sapiens
KIEGKYEKN

SEQ ID NO: 1332047 - protein, 9 aa, Homo Sapiens
PAVVVLHEW

SEQ ID NO: 1332048 - protein, 9 aa, Homo Sapiens
VESVMVRTI

SEQ ID NO: 1332049 - protein, 9 aa, Homo Sapiens
SNAFLWPCG

SEQ ID NO: 1332050 - protein, 9 aa, Homo Sapiens
ADVEWCWHP

SEQ ID NO: 1332051 - protein, 9 aa, Homo Sapiens
MLTDLSTII

SEQ ID NO: 1332052 - protein, 9 aa, Homo Sapiens
HSQNSYHNA

SEQ ID NO: 1332053 - protein, 9 aa, Homo Sapiens
GMWGRVLRK

SEQ ID NO: 1332054 - protein, 9 aa, Homo Sapiens
TDSDSPDEG

SEQ ID NO: 1332055 - protein, 9 aa, Homo Sapiens
EREVPEYLY

SEQ ID NO: 1332056 - protein, 9 aa, Homo Sapiens
DESHAGKAV

SEQ ID NO: 1332057 - protein, 9 aa, Homo Sapiens
NEWASLYPT

SEQ ID NO: 1332058 - protein, 9 aa, Homo Sapiens
SVCVQMEEL

SEQ ID NO: 1332059 - protein, 9 aa, Homo Sapiens
HLSIQTDSP

SEQ ID NO: 1332060 - protein, 9 aa, Homo Sapiens
LIFEFCGYE

SEQ ID NO: 1332061 - protein, 9 aa, Homo Sapiens
NARELWITY

SEQ ID NO: 1332062 - protein, 9 aa, Homo Sapiens
PCCIITSTY

SEQ ID NO: 1332063 - protein, 9 aa, Homo Sapiens
TKEYTYLKG

SEQ ID NO: 1332064 - protein, 9 aa, Homo Sapiens
YGEFVEYHK

SEQ ID NO: 1332065 - protein, 9 aa, Homo Sapiens
FTHVLNVAH

SEQ ID NO: 1332066 - protein, 9 aa, Homo Sapiens
TVQGRITVQ

SEQ ID NO: 1332067 - protein, 9 aa, Homo Sapiens
KKVRSLHTR

SEQ ID NO: 1332068 - protein, 9 aa, Homo Sapiens
ATRNVVCLW

SEQ ID NO: 1332069 - protein, 9 aa, Homo Sapiens
VTFQLTAFT

SEQ ID NO: 1332070 - protein, 9 aa, Homo Sapiens
IQDQNVQTR

SEQ ID NO: 1332071 - protein, 9 aa, Homo Sapiens
RKPQAVEWH

SEQ ID NO: 1332072 - protein, 9 aa, Homo Sapiens
SDAVVTYYL

SEQ ID NO: 1332073 - protein, 9 aa, Homo Sapiens
TNGLVRALG

SEQ ID NO: 1332074 - protein, 9 aa, Homo Sapiens
IRESLPALH

SEQ ID NO: 1332075 - protein, 9 aa, Homo Sapiens
VILEKMRTQ

SEQ ID NO: 1332076 - protein, 9 aa, Homo Sapiens
SSQNQIRKH

SEQ ID NO: 1332077 - protein, 9 aa, Homo Sapiens
ADLLLPGSQ

SEQ ID NO: 1332078 - protein, 9 aa, Homo Sapiens
DTGAIDDLE

SEQ ID NO: 1332079 - protein, 9 aa, Homo Sapiens
TTIPSCPEG

SEQ ID NO: 1332080 - protein, 9 aa, Homo Sapiens
LQRASKIGE

SEQ ID NO: 1332081 - protein, 9 aa, Homo Sapiens
VHGLLRQLG

SEQ ID NO: 1332082 - protein, 9 aa, Homo Sapiens
QMYHYNAGV

SEQ ID NO: 1332083 - protein, 9 aa, Homo Sapiens
ICIQYKPSL

SEQ ID NO: 1332084 - protein, 9 aa, Homo Sapiens
EYGECGKAF

SEQ ID NO: 1332085 - protein, 9 aa, Homo Sapiens
ERQQHIAQQ

SEQ ID NO: 1332086 - protein, 9 aa, Homo Sapiens
IQIAINNGT

SEQ ID NO: 1332087 - protein, 9 aa, Homo Sapiens
SMAVVIPDA

SEQ ID NO: 1332088 - protein, 9 aa, Homo Sapiens
TNTATVTEE

SEQ ID NO: 1332089 - protein, 9 aa, Homo Sapiens
EFKAQGVTI

SEQ ID NO: 1332090 - protein, 9 aa, Homo Sapiens
AKEKVTGIE

SEQ ID NO: 1332091 - protein, 9 aa, Homo Sapiens
WQTSNDCGG

SEQ ID NO: 1332092 - protein, 9 aa, Homo Sapiens
FDVDGIFGG

SEQ ID NO: 1332093 - protein, 9 aa, Homo Sapiens
GIVEVVSKW

SEQ ID NO: 1332094 - protein, 9 aa, Homo Sapiens
IIQPSNTCE

SEQ ID NO: 1332095 - protein, 9 aa, Homo Sapiens
AMERADYVA

SEQ ID NO: 1332096 - protein, 9 aa, Homo Sapiens
CMQRLGTKL

SEQ ID NO: 1332097 - protein, 9 aa, Homo Sapiens
LTYHCRCHT

SEQ ID NO: 1332098 - protein, 9 aa, Homo Sapiens
GRRCWGQTI

SEQ ID NO: 1332099 - protein, 9 aa, Homo Sapiens
GTGEDADWL

SEQ ID NO: 1332100 - protein, 9 aa, Homo Sapiens
KCPFAYHKL

SEQ ID NO: 1332101 - protein, 9 aa, Homo Sapiens
SDLNSQCLS

SEQ ID NO: 1332102 - protein, 9 aa, Homo Sapiens
GSKRKYCKG

SEQ ID NO: 1332103 - protein, 9 aa, Homo Sapiens
AVGLALFLY

SEQ ID NO: 1332104 - protein, 9 aa, Homo Sapiens
RSILVDGEE

SEQ ID NO: 1332105 - protein, 9 aa, Homo Sapiens
GHCSQASHS

SEQ ID NO: 1332106 - protein, 9 aa, Homo Sapiens
DSRPVSRHL

SEQ ID NO: 1332107 - protein, 9 aa, Homo Sapiens
MPAPPEGAT

SEQ ID NO: 1332108 - protein, 9 aa, Homo Sapiens
AVYDTLMTI

SEQ ID NO: 1332109 - protein, 9 aa, Homo Sapiens
PVDYDFVSA

SEQ ID NO: 1332110 - protein, 9 aa, Homo Sapiens
NKMRAILCI

SEQ ID NO: 1332111 - protein, 9 aa, Homo Sapiens
RSLNLVDNE

SEQ ID NO: 1332112 - protein, 9 aa, Homo Sapiens
PHACTQCGK

SEQ ID NO: 1332113 - protein, 9 aa, Homo Sapiens
TPAHKITGD

SEQ ID NO: 1332114 - protein, 9 aa, Homo Sapiens
ELHLAVAWN

SEQ ID NO: 1332115 - protein, 9 aa, Homo Sapiens
STLAHSAIF

SEQ ID NO: 1332116 - protein, 9 aa, Homo Sapiens
CIECQANQV

SEQ ID NO: 1332117 - protein, 9 aa, Homo Sapiens
GARTSLSTR

SEQ ID NO: 1332118 - protein, 9 aa, Homo Sapiens
TFVPLGAAQ

SEQ ID NO: 1332119 - protein, 9 aa, Homo Sapiens
DAGGRQFAQ

SEQ ID NO: 1332120 - protein, 9 aa, Homo Sapiens
ADDLHINLW

SEQ ID NO: 1332121 - protein, 9 aa, Homo Sapiens
SDRFRSFDT

SEQ ID NO: 1332122 - protein, 9 aa, Homo Sapiens
LPVYLDLCC

SEQ ID NO: 1332123 - protein, 9 aa, Homo Sapiens
LEEELHKQW

SEQ ID NO: 1332124 - protein, 9 aa, Homo Sapiens
CSPRPEELI

SEQ ID NO: 1332125 - protein, 9 aa, Homo Sapiens
LGRWKTLLI

SEQ ID NO: 1332126 - protein, 9 aa, Homo Sapiens
LYTISKGFF

SEQ ID NO: 1332127 - protein, 9 aa, Homo Sapiens
SITRTYYRN

SEQ ID NO: 1332128 - protein, 9 aa, Homo Sapiens
YLANVLLEL

SEQ ID NO: 1332129 - protein, 9 aa, Homo Sapiens
ADGAHVWLL

SEQ ID NO: 1332130 - protein, 9 aa, Homo Sapiens
PSRWDDRRT

SEQ ID NO: 1332131 - protein, 9 aa, Homo Sapiens
EMALRGKDV

SEQ ID NO: 1332132 - protein, 9 aa, Homo Sapiens
TNVLSLLID

SEQ ID NO: 1332133 - protein, 9 aa, Homo Sapiens
QPWCCPGRW

SEQ ID NO: 1332134 - protein, 9 aa, Homo Sapiens
ARARTCSPC

SEQ ID NO: 1332135 - protein, 9 aa, Homo Sapiens
HQFPALTQE

SEQ ID NO: 1332136 - protein, 9 aa, Homo Sapiens
KRPKCSLFF

SEQ ID NO: 1332137 - protein, 9 aa, Homo Sapiens
HSKLQRVFD

SEQ ID NO: 1332138 - protein, 9 aa, Homo Sapiens
MIFAGRKKI

SEQ ID NO: 1332139 - protein, 9 aa, Homo Sapiens
GASRSLDDV

SEQ ID NO: 1332140 - protein, 9 aa, Homo Sapiens
AMGPPERRT

SEQ ID NO: 1332141 - protein, 9 aa, Homo Sapiens
DARVCGRCC

SEQ ID NO: 1332142 - protein, 9 aa, Homo Sapiens
APMSVPHNR

SEQ ID NO: 1332143 - protein, 9 aa, Homo Sapiens
HSIRRQYRQ

SEQ ID NO: 1332144 - protein, 9 aa, Homo Sapiens
TLDDSVSSS

SEQ ID NO: 1332145 - protein, 9 aa, Homo Sapiens
PYKCTVCEK

SEQ ID NO: 1332146 - protein, 9 aa, Homo Sapiens
AGPTSHVVA

SEQ ID NO: 1332147 - protein, 9 aa, Homo Sapiens
QYVLSNQYR

SEQ ID NO: 1332148 - protein, 9 aa, Homo Sapiens
GRYKGHRPE

SEQ ID NO: 1332149 - protein, 9 aa, Homo Sapiens
AMNSLSTMY

SEQ ID NO: 1332150 - protein, 9 aa, Homo Sapiens
LLPHQRSLW

SEQ ID NO: 1332151 - protein, 9 aa, Homo Sapiens
HILQFLCAW

SEQ ID NO: 1332152 - protein, 9 aa, Homo Sapiens
LDLLPCHPF

SEQ ID NO: 1332153 - protein, 9 aa, Homo Sapiens
RMFEYFQTT

SEQ ID NO: 1332154 - protein, 9 aa, Homo Sapiens
LFREGDMWI

SEQ ID NO: 1332155 - protein, 9 aa, Homo Sapiens
TVTSNAFLW

SEQ ID NO: 1332156 - protein, 9 aa, Homo Sapiens
GLTQGLIEH

SEQ ID NO: 1332157 - protein, 9 aa, Homo Sapiens
YSSMVIDEV

SEQ ID NO: 1332158 - protein, 9 aa, Homo Sapiens
RPPNSAAQY

SEQ ID NO: 1332159 - protein, 9 aa, Homo Sapiens
PQPKLVSHS

SEQ ID NO: 1332160 - protein, 9 aa, Homo Sapiens
PEAATTMYF

SEQ ID NO: 1332161 - protein, 9 aa, Homo Sapiens
ITTVQVPMM

SEQ ID NO: 1332162 - protein, 9 aa, Homo Sapiens
WWEISVCGN

SEQ ID NO: 1332163 - protein, 9 aa, Homo Sapiens
QLPFDPEQP

SEQ ID NO: 1332164 - protein, 9 aa, Homo Sapiens
RYHQDFFQE

SEQ ID NO: 1332165 - protein, 9 aa, Homo Sapiens
QVKHYHIFR

SEQ ID NO: 1332166 - protein, 9 aa, Homo Sapiens
TVGECRSPP

SEQ ID NO: 1332167 - protein, 9 aa, Homo Sapiens
TMVDYFFQR

SEQ ID NO: 1332168 - protein, 9 aa, Homo Sapiens
PVKIRPQFL

SEQ ID NO: 1332169 - protein, 9 aa, Homo Sapiens
LCPSKRHRP

SEQ ID NO: 1332170 - protein, 9 aa, Homo Sapiens
FFWQCGCHV

SEQ ID NO: 1332171 - protein, 9 aa, Homo Sapiens
DYLSPEMIE

SEQ ID NO: 1332172 - protein, 9 aa, Homo Sapiens
TSPCCIITS

SEQ ID NO: 1332173 - protein, 9 aa, Homo Sapiens
EEIKMAMGI

SEQ ID NO: 1332174 - protein, 9 aa, Homo Sapiens
SQEAQNITG

SEQ ID NO: 1332175 - protein, 9 aa, Homo Sapiens
GAEGDMSSE

SEQ ID NO: 1332176 - protein, 9 aa, Homo Sapiens
LYRIGKKSH

SEQ ID NO: 1332177 - protein, 9 aa, Homo Sapiens
GRAVKKKAA

SEQ ID NO: 1332178 - protein, 9 aa, Homo Sapiens
NQMRQSLVH

SEQ ID NO: 1332179 - protein, 9 aa, Homo Sapiens
SVLWDPTIS

SEQ ID NO: 1332180 - protein, 9 aa, Homo Sapiens
WSCHHDKAI

SEQ ID NO: 1332181 - protein, 9 aa, Homo Sapiens
QSNSYCSLH

SEQ ID NO: 1332182 - protein, 9 aa, Homo Sapiens
EKEKKFFVK

SEQ ID NO: 1332183 - protein, 9 aa, Homo Sapiens
IDTTPVVNG

SEQ ID NO: 1332184 - protein, 9 aa, Homo Sapiens
FNLSNTIMG

SEQ ID NO: 1332185 - protein, 9 aa, Homo Sapiens
NIEKTRMHL

SEQ ID NO: 1332186 - protein, 9 aa, Homo Sapiens
ECVLSRMQH

SEQ ID NO: 1332187 - protein, 9 aa, Homo Sapiens
HQVQGRGIG

SEQ ID NO: 1332188 - protein, 9 aa, Homo Sapiens
TSHATTAST

SEQ ID NO: 1332189 - protein, 9 aa, Homo Sapiens
MGDCFCIPR

SEQ ID NO: 1332190 - protein, 9 aa, Homo Sapiens
KSKDARVCG

SEQ ID NO: 1332191 - protein, 9 aa, Homo Sapiens
GHTRAPQAC

SEQ ID NO: 1332192 - protein, 9 aa, Homo Sapiens
ISQLCALET

SEQ ID NO: 1332193 - protein, 9 aa, Homo Sapiens
KTGSGKTAV

SEQ ID NO: 1332194 - protein, 9 aa, Homo Sapiens
KKPNLSKIL

SEQ ID NO: 1332195 - protein, 9 aa, Homo Sapiens
QLSQKHISS

SEQ ID NO: 1332196 - protein, 9 aa, Homo Sapiens
LWVLVVLDT

SEQ ID NO: 1332197 - protein, 9 aa, Homo Sapiens
EYECHTSNS

SEQ ID NO: 1332198 - protein, 9 aa, Homo Sapiens
FSAVGHVLW

SEQ ID NO: 1332199 - protein, 9 aa, Homo Sapiens
LFTVVTWDP

SEQ ID NO: 1332200 - protein, 9 aa, Homo Sapiens
QQDNLITLE

SEQ ID NO: 1332201 - protein, 9 aa, Homo Sapiens
DKDEPPKDI

SEQ ID NO: 1332202 - protein, 9 aa, Homo Sapiens
LYKDRYEEA

SEQ ID NO: 1332203 - protein, 9 aa, Homo Sapiens
WPFITVPLM

SEQ ID NO: 1332204 - protein, 9 aa, Homo Sapiens
LEEHRKDLE

SEQ ID NO: 1332205 - protein, 9 aa, Homo Sapiens
PSCTYILHS

SEQ ID NO: 1332206 - protein, 9 aa, Homo Sapiens
LARYRGQYN

SEQ ID NO: 1332207 - protein, 9 aa, Homo Sapiens
IICNHCAVP

SEQ ID NO: 1332208 - protein, 9 aa, Homo Sapiens
TFIEKSSLS

SEQ ID NO: 1332209 - protein, 9 aa, Homo Sapiens
ELLSPAPKG

SEQ ID NO: 1332210 - protein, 9 aa, Homo Sapiens
ASSRHRGFG

SEQ ID NO: 1332211 - protein, 9 aa, Homo Sapiens
CCIAVCVHQ

SEQ ID NO: 1332212 - protein, 9 aa, Homo Sapiens
EAYSAATAA

SEQ ID NO: 1332213 - protein, 9 aa, Homo Sapiens
TLQEEADYF

SEQ ID NO: 1332214 - protein, 9 aa, Homo Sapiens
LNCSLLLCW

SEQ ID NO: 1332215 - protein, 9 aa, Homo Sapiens
VGLIFAVYV

SEQ ID NO: 1332216 - protein, 9 aa, Homo Sapiens
HVVGTEIIQ

SEQ ID NO: 1332217 - protein, 9 aa, Homo Sapiens
TEAYILNAG

SEQ ID NO: 1332218 - protein, 9 aa, Homo Sapiens
LMTTNIWLK

SEQ ID NO: 1332219 - protein, 9 aa, Homo Sapiens
LVFMEGPES

SEQ ID NO: 1332220 - protein, 9 aa, Homo Sapiens
SWKEYFCDY

SEQ ID NO: 1332221 - protein, 9 aa, Homo Sapiens
NNQPLPSNT

SEQ ID NO: 1332222 - protein, 9 aa, Homo Sapiens
FYGPAVIIT

SEQ ID NO: 1332223 - protein, 9 aa, Homo Sapiens
YGYGSGWSS

SEQ ID NO: 1332224 - protein, 9 aa, Homo Sapiens
PEALIVPVP

SEQ ID NO: 1332225 - protein, 9 aa, Homo Sapiens
HAIMHLDLA

SEQ ID NO: 1332226 - protein, 9 aa, Homo Sapiens
SSVPSLHVP

SEQ ID NO: 1332227 - protein, 9 aa, Homo Sapiens
NLVGGPLEQ

SEQ ID NO: 1332228 - protein, 9 aa, Homo Sapiens
TSPHKMAFA

SEQ ID NO: 1332229 - protein, 9 aa, Homo Sapiens
AYLKDKMCK

SEQ ID NO: 1332230 - protein, 9 aa, Homo Sapiens
CTDPSTVDD

SEQ ID NO: 1332231 - protein, 9 aa, Homo Sapiens
SSLGAFFTG

SEQ ID NO: 1332232 - protein, 9 aa, Homo Sapiens
NTAEGTSFR

SEQ ID NO: 1332233 - protein, 9 aa, Homo Sapiens
QGRTRQALA

SEQ ID NO: 1332234 - protein, 9 aa, Homo Sapiens
EQCLAQLFM

SEQ ID NO: 1332235 - protein, 9 aa, Homo Sapiens
KTKKRPQCA

SEQ ID NO: 1332236 - protein, 9 aa, Homo Sapiens
KDTGYQWLD

SEQ ID NO: 1332237 - protein, 9 aa, Homo Sapiens
TLNKLKITA

SEQ ID NO: 1332238 - protein, 9 aa, Homo Sapiens
TLISLDDGL

SEQ ID NO: 1332239 - protein, 9 aa, Homo Sapiens
TLPPCIYMV

SEQ ID NO: 1332240 - protein, 9 aa, Homo Sapiens
ECSECDKAF

SEQ ID NO: 1332241 - protein, 9 aa, Homo Sapiens
ILFFLSKKE

SEQ ID NO: 1332242 - protein, 9 aa, Homo Sapiens
ADFTLLARN

SEQ ID NO: 1332243 - protein, 9 aa, Homo Sapiens
LSEDFHVKD

SEQ ID NO: 1332244 - protein, 9 aa, Homo Sapiens
VWRVSPLPL

SEQ ID NO: 1332245 - protein, 9 aa, Homo Sapiens
KDMVCIPVG

SEQ ID NO: 1332246 - protein, 9 aa, Homo Sapiens
NICLLTILM

SEQ ID NO: 1332247 - protein, 9 aa, Homo Sapiens
VPQTNAHKS

SEQ ID NO: 1332248 - protein, 9 aa, Homo Sapiens
IIVTSISLL

SEQ ID NO: 1332249 - protein, 9 aa, Homo Sapiens
GDEECLYLN

SEQ ID NO: 1332250 - protein, 9 aa, Homo Sapiens
VPATKNSVR

SEQ ID NO: 1332251 - protein, 9 aa, Homo Sapiens
KYKGVWKPP

SEQ ID NO: 1332252 - protein, 9 aa, Homo Sapiens
SPGGWKVIT

SEQ ID NO: 1332253 - protein, 9 aa, Homo Sapiens
VVCSFLHAR

SEQ ID NO: 1332254 - protein, 9 aa, Homo Sapiens
VSRMRCLHN

SEQ ID NO: 1332255 - protein, 9 aa, Homo Sapiens
VIFLVDIIL

SEQ ID NO: 1332256 - protein, 9 aa, Homo Sapiens
FFNSLNEVT

SEQ ID NO: 1332257 - protein, 9 aa, Homo Sapiens
TVGLLLLLL

SEQ ID NO: 1332258 - protein, 9 aa, Homo Sapiens
PQGASPTSQ

SEQ ID NO: 1332259 - protein, 9 aa, Homo Sapiens
GTTIQCVRF

SEQ ID NO: 1332260 - protein, 9 aa, Homo Sapiens
GFSNKLHLL

SEQ ID NO: 1332261 - protein, 9 aa, Homo Sapiens
QPPAKKQRK

SEQ ID NO: 1332262 - protein, 9 aa, Homo Sapiens
ILDDQIQWP

SEQ ID NO: 1332263 - protein, 9 aa, Homo Sapiens
KLVEKWAFR

SEQ ID NO: 1332264 - protein, 9 aa, Homo Sapiens
ATPDGHLLF

SEQ ID NO: 1332265 - protein, 9 aa, Homo Sapiens
MLPVIHSCQ

SEQ ID NO: 1332266 - protein, 9 aa, Homo Sapiens
GLMHDLKDQ

SEQ ID NO: 1332267 - protein, 9 aa, Homo Sapiens
SPGSTTSSS

SEQ ID NO: 1332268 - protein, 9 aa, Homo Sapiens
PDRPEKRVT

SEQ ID NO: 1332269 - protein, 9 aa, Homo Sapiens
VVQGTNSTH

SEQ ID NO: 1332270 - protein, 9 aa, Homo Sapiens
IMSRLMLKQ

SEQ ID NO: 1332271 - protein, 9 aa, Homo Sapiens
PHAGQGVHV

SEQ ID NO: 1332272 - protein, 9 aa, Homo Sapiens
ENIVVIHCK

SEQ ID NO: 1332273 - protein, 9 aa, Homo Sapiens
KRGERAWTH

SEQ ID NO: 1332274 - protein, 9 aa, Homo Sapiens
IANREKQCL

SEQ ID NO: 1332275 - protein, 9 aa, Homo Sapiens
GPTSHVVAV

SEQ ID NO: 1332276 - protein, 9 aa, Homo Sapiens
IVTSISLLV

SEQ ID NO: 1332277 - protein, 9 aa, Homo Sapiens
SREGEEGTY

SEQ ID NO: 1332278 - protein, 9 aa, Homo Sapiens
LCQRFPTLT

SEQ ID NO: 1332279 - protein, 9 aa, Homo Sapiens
MDFNALVEK

SEQ ID NO: 1332280 - protein, 9 aa, Homo Sapiens
FRCSRWVRP

SEQ ID NO: 1332281 - protein, 9 aa, Homo Sapiens
HTIKHAKAY

SEQ ID NO: 1332282 - protein, 9 aa, Homo Sapiens
QPCGPLEGN

SEQ ID NO: 1332283 - protein, 9 aa, Homo Sapiens
KEPHLRFTR

SEQ ID NO: 1332284 - protein, 9 aa, Homo Sapiens
TTAKTQLYA

SEQ ID NO: 1332285 - protein, 9 aa, Homo Sapiens
IHTDSWTTV

SEQ ID NO: 1332286 - protein, 9 aa, Homo Sapiens
HPGDSDLLR

SEQ ID NO: 1332287 - protein, 9 aa, Homo Sapiens
HISTYDNQM

SEQ ID NO: 1332288 - protein, 9 aa, Homo Sapiens
FCIIAITFI

SEQ ID NO: 1332289 - protein, 9 aa, Homo Sapiens
EYFLPRMIH

SEQ ID NO: 1332290 - protein, 9 aa, Homo Sapiens
TGLGDSSMV

SEQ ID NO: 1332291 - protein, 9 aa, Homo Sapiens
HTSGLITTG

SEQ ID NO: 1332292 - protein, 9 aa, Homo Sapiens
MQTRVVRRL

SEQ ID NO: 1332293 - protein, 9 aa, Homo Sapiens
HMRESAMQK

SEQ ID NO: 1332294 - protein, 9 aa, Homo Sapiens
TFSQRAVYD

SEQ ID NO: 1332295 - protein, 9 aa, Homo Sapiens
HARAGERAR

SEQ ID NO: 1332296 - protein, 9 aa, Homo Sapiens
QMSNDFSNN

SEQ ID NO: 1332297 - protein, 9 aa, Homo Sapiens
NPSSNFCNY

SEQ ID NO: 1332298 - protein, 9 aa, Homo Sapiens
APDGTALTP

SEQ ID NO: 1332299 - protein, 9 aa, Homo Sapiens
KALEELWAS

SEQ ID NO: 1332300 - protein, 9 aa, Homo Sapiens
EEANATSTV

SEQ ID NO: 1332301 - protein, 9 aa, Homo Sapiens
VTSEPHEMS

SEQ ID NO: 1332302 - protein, 9 aa, Homo Sapiens
RRPSTAARA

SEQ ID NO: 1332303 - protein, 9 aa, Homo Sapiens
VDTAWIFLQ

SEQ ID NO: 1332304 - protein, 9 aa, Homo Sapiens
ITAALVELE

SEQ ID NO: 1332305 - protein, 9 aa, Homo Sapiens
GSLCVSEQT

SEQ ID NO: 1332306 - protein, 9 aa, Homo Sapiens
EAHVNLDQG

SEQ ID NO: 1332307 - protein, 9 aa, Homo Sapiens
TPEGAGWTS

SEQ ID NO: 1332308 - protein, 9 aa, Homo Sapiens
TEYGVQNYI

SEQ ID NO: 1332309 - protein, 9 aa, Homo Sapiens
DSPSRQSHR

SEQ ID NO: 1332310 - protein, 9 aa, Homo Sapiens
NDCMMDSSQ

SEQ ID NO: 1332311 - protein, 9 aa, Homo Sapiens
YCIKRMLAY

SEQ ID NO: 1332312 - protein, 9 aa, Homo Sapiens
ATDKQYKGI

SEQ ID NO: 1332313 - protein, 9 aa, Homo Sapiens
GPLKDYIFD

SEQ ID NO: 1332314 - protein, 9 aa, Homo Sapiens
LALGLALTL

SEQ ID NO: 1332315 - protein, 9 aa, Homo Sapiens
CSGHDIHTI

SEQ ID NO: 1332316 - protein, 9 aa, Homo Sapiens
EITDEIKVN

SEQ ID NO: 1332317 - protein, 9 aa, Homo Sapiens
RQAIKGVFY

SEQ ID NO: 1332318 - protein, 9 aa, Homo Sapiens
RHRGFGLFF

SEQ ID NO: 1332319 - protein, 9 aa, Homo Sapiens
EPSQHDDIS

SEQ ID NO: 1332320 - protein, 9 aa, Homo Sapiens
KAYGERYIA

SEQ ID NO: 1332321 - protein, 9 aa, Homo Sapiens
LSGEKQHIS

SEQ ID NO: 1332322 - protein, 9 aa, Homo Sapiens
HPDVTMKSL

SEQ ID NO: 1332323 - protein, 9 aa, Homo Sapiens
TEVPWPEVW

SEQ ID NO: 1332324 - protein, 9 aa, Homo Sapiens
GAAVATVLS

SEQ ID NO: 1332325 - protein, 9 aa, Homo Sapiens
TRHRSRSRT

SEQ ID NO: 1332326 - protein, 9 aa, Homo Sapiens
EVDFLSERC

SEQ ID NO: 1332327 - protein, 9 aa, Homo Sapiens
CQNIKYLDV

SEQ ID NO: 1332328 - protein, 9 aa, Homo Sapiens
SAKRTKVAA

SEQ ID NO: 1332329 - protein, 9 aa, Homo Sapiens
EPPVIVVPP

SEQ ID NO: 1332330 - protein, 9 aa, Homo Sapiens
PDEKIAYRD

SEQ ID NO: 1332331 - protein, 9 aa, Homo Sapiens
VCLSGYLRE

SEQ ID NO: 1332332 - protein, 9 aa, Homo Sapiens
EVPMSSSGH

SEQ ID NO: 1332333 - protein, 9 aa, Homo Sapiens
SVSPSGEDF

SEQ ID NO: 1332334 - protein, 9 aa, Homo Sapiens
DVKTPNTEM

SEQ ID NO: 1332335 - protein, 9 aa, Homo Sapiens
ALGVIIIIL

SEQ ID NO: 1332336 - protein, 9 aa, Homo Sapiens
CSFLHARLR

SEQ ID NO: 1332337 - protein, 9 aa, Homo Sapiens
KHIKRSLLV

SEQ ID NO: 1332338 - protein, 9 aa, Homo Sapiens
NSTLAMGPG

SEQ ID NO: 1332339 - protein, 9 aa, Homo Sapiens
NKKVQTCHV

SEQ ID NO: 1332340 - protein, 9 aa, Homo Sapiens
GDGTVTEVT

SEQ ID NO: 1332341 - protein, 9 aa, Homo Sapiens
AAQLTAECT

SEQ ID NO: 1332342 - protein, 9 aa, Homo Sapiens
LSPFTIVTS

SEQ ID NO: 1332343 - protein, 9 aa, Homo Sapiens
IMDKAEGSV

SEQ ID NO: 1332344 - protein, 9 aa, Homo Sapiens
DPNDLYLMS

SEQ ID NO: 1332345 - protein, 9 aa, Homo Sapiens
QLLFVFEYV

SEQ ID NO: 1332346 - protein, 9 aa, Homo Sapiens
DSRSFFTSA

SEQ ID NO: 1332347 - protein, 9 aa, Homo Sapiens
DIDEREYHA

SEQ ID NO: 1332348 - protein, 9 aa, Homo Sapiens
GFASSIQDE

SEQ ID NO: 1332349 - protein, 9 aa, Homo Sapiens
QSEVVATEA

SEQ ID NO: 1332350 - protein, 9 aa, Homo Sapiens
MVSILKGYR

SEQ ID NO: 1332351 - protein, 9 aa, Homo Sapiens
SAQTGACAL

SEQ ID NO: 1332352 - protein, 9 aa, Homo Sapiens
GHSGDPSLQ

SEQ ID NO: 1332353 - protein, 9 aa, Homo Sapiens
TSVTSCLAS

SEQ ID NO: 1332354 - protein, 9 aa, Homo Sapiens
YITIRWKSE

SEQ ID NO: 1332355 - protein, 9 aa, Homo Sapiens
TGGWHHHDK

SEQ ID NO: 1332356 - protein, 9 aa, Homo Sapiens
REVATRTVS

SEQ ID NO: 1332357 - protein, 9 aa, Homo Sapiens
EELRLDDNH

SEQ ID NO: 1332358 - protein, 9 aa, Homo Sapiens
FCVLLKMKT

SEQ ID NO: 1332359 - protein, 9 aa, Homo Sapiens
TSRKSQEPD

SEQ ID NO: 1332360 - protein, 9 aa, Homo Sapiens
LMEGFLAFP

SEQ ID NO: 1332361 - protein, 9 aa, Homo Sapiens
LYEYGECGK

SEQ ID NO: 1332362 - protein, 9 aa, Homo Sapiens
DSTTLDTID

SEQ ID NO: 1332363 - protein, 9 aa, Homo Sapiens
SHNKQPKRC

SEQ ID NO: 1332364 - protein, 9 aa, Homo Sapiens
HVKPQGVGG

SEQ ID NO: 1332365 - protein, 9 aa, Homo Sapiens
VIQPERVLY

SEQ ID NO: 1332366 - protein, 9 aa, Homo Sapiens
AILSTMDAD

SEQ ID NO: 1332367 - protein, 9 aa, Homo Sapiens
LYTLPSLCR

SEQ ID NO: 1332368 - protein, 9 aa, Homo Sapiens
PCDLKDIGL

SEQ ID NO: 1332369 - protein, 9 aa, Homo Sapiens
TPNDKTLSL

SEQ ID NO: 1332370 - protein, 9 aa, Homo Sapiens
KYLKKHQVL

SEQ ID NO: 1332371 - protein, 9 aa, Homo Sapiens
LKYVSITQF

SEQ ID NO: 1332372 - protein, 9 aa, Homo Sapiens
FFFDNLVYY

SEQ ID NO: 1332373 - protein, 9 aa, Homo Sapiens
ILIATAICA

SEQ ID NO: 1332374 - protein, 9 aa, Homo Sapiens
TMVMPGGCI

SEQ ID NO: 1332375 - protein, 9 aa, Homo Sapiens
VQQYRHKMR

SEQ ID NO: 1332376 - protein, 9 aa, Homo Sapiens
RRQWQSIEG

SEQ ID NO: 1332377 - protein, 9 aa, Homo Sapiens
TLTAVCNHI

SEQ ID NO: 1332378 - protein, 9 aa, Homo Sapiens
ASDHKNLGL

SEQ ID NO: 1332379 - protein, 9 aa, Homo Sapiens
STSVPKNPL

SEQ ID NO: 1332380 - protein, 9 aa, Homo Sapiens
EWLSEGFTT

SEQ ID NO: 1332381 - protein, 9 aa, Homo Sapiens
TTFSECPSL

SEQ ID NO: 1332382 - protein, 9 aa, Homo Sapiens
WLAGTIIPP

SEQ ID NO: 1332383 - protein, 9 aa, Homo Sapiens
ETATTSDSK

SEQ ID NO: 1332384 - protein, 9 aa, Homo Sapiens
FKYAHEYDS

SEQ ID NO: 1332385 - protein, 9 aa, Homo Sapiens
VKVNSAVTH

SEQ ID NO: 1332386 - protein, 9 aa, Homo Sapiens
DLYILIGTV

SEQ ID NO: 1332387 - protein, 9 aa, Homo Sapiens
LCPSANVYD

SEQ ID NO: 1332388 - protein, 9 aa, Homo Sapiens
LLSSERMKL

SEQ ID NO: 1332389 - protein, 9 aa, Homo Sapiens
LVGSHLSHS

SEQ ID NO: 1332390 - protein, 9 aa, Homo Sapiens
DVDGIFGGI

SEQ ID NO: 1332391 - protein, 9 aa, Homo Sapiens
YFLAYLCNT

SEQ ID NO: 1332392 - protein, 9 aa, Homo Sapiens
SLSSLHVRK

SEQ ID NO: 1332393 - protein, 9 aa, Homo Sapiens
NWCALCNSE

SEQ ID NO: 1332394 - protein, 9 aa, Homo Sapiens
EKDQIKMLS

SEQ ID NO: 1332395 - protein, 9 aa, Homo Sapiens
SQIFGQASM

SEQ ID NO: 1332396 - protein, 9 aa, Homo Sapiens
NEPGTFLIR

SEQ ID NO: 1332397 - protein, 9 aa, Homo Sapiens
PQIVLTSQS

SEQ ID NO: 1332398 - protein, 9 aa, Homo Sapiens
PLPTRGHAL

SEQ ID NO: 1332399 - protein, 9 aa, Homo Sapiens
SSGSRSHSL

SEQ ID NO: 1332400 - protein, 9 aa, Homo Sapiens
GEKKMPHGS

SEQ ID NO: 1332401 - protein, 9 aa, Homo Sapiens
RGKDTNDSQ

SEQ ID NO: 1332402 - protein, 9 aa, Homo Sapiens
AWARCEGQE

SEQ ID NO: 1332403 - protein, 9 aa, Homo Sapiens
SNLLAEHNP

SEQ ID NO: 1332404 - protein, 9 aa, Homo Sapiens
NTYDLQESS

SEQ ID NO: 1332405 - protein, 9 aa, Homo Sapiens
RYACNVIEE

SEQ ID NO: 1332406 - protein, 9 aa, Homo Sapiens
NGINPNGDS

SEQ ID NO: 1332407 - protein, 9 aa, Homo Sapiens
AHRGSPFLK

SEQ ID NO: 1332408 - protein, 9 aa, Homo Sapiens
YQACEAALG

SEQ ID NO: 1332409 - protein, 9 aa, Homo Sapiens
HCSNTPLGA

SEQ ID NO: 1332410 - protein, 9 aa, Homo Sapiens
NTRPMEVFM

SEQ ID NO: 1332411 - protein, 9 aa, Homo Sapiens
IIIKLNKAG

SEQ ID NO: 1332412 - protein, 9 aa, Homo Sapiens
LKIDLQRET

SEQ ID NO: 1332413 - protein, 9 aa, Homo Sapiens
FQCVGIIPP

SEQ ID NO: 1332414 - protein, 9 aa, Homo Sapiens
TSIEPISSI

SEQ ID NO: 1332415 - protein, 9 aa, Homo Sapiens
SAPTAGRAS

SEQ ID NO: 1332416 - protein, 9 aa, Homo Sapiens
SRYHPQIVL

SEQ ID NO: 1332417 - protein, 9 aa, Homo Sapiens
HYLEELSQR

SEQ ID NO: 1332418 - protein, 9 aa, Homo Sapiens
TTTELFLVM

SEQ ID NO: 1332419 - protein, 9 aa, Homo Sapiens
ASTSNMVSK

SEQ ID NO: 1332420 - protein, 9 aa, Homo Sapiens
LTPPGTVTT

SEQ ID NO: 1332421 - protein, 9 aa, Homo Sapiens
KIHLQSHTG

SEQ ID NO: 1332422 - protein, 9 aa, Homo Sapiens
EIENAKCQC

SEQ ID NO: 1332423 - protein, 9 aa, Homo Sapiens
GHQKNHTGT

SEQ ID NO: 1332424 - protein, 9 aa, Homo Sapiens
LAPFTLKSD

SEQ ID NO: 1332425 - protein, 9 aa, Homo Sapiens
VTMKSLPFY

SEQ ID NO: 1332426 - protein, 9 aa, Homo Sapiens
RPTAIRQTL

SEQ ID NO: 1332427 - protein, 9 aa, Homo Sapiens
ASSATEKDE

SEQ ID NO: 1332428 - protein, 9 aa, Homo Sapiens
NRLDQHEQI

SEQ ID NO: 1332429 - protein, 9 aa, Homo Sapiens
GLSTEQVYN

SEQ ID NO: 1332430 - protein, 9 aa, Homo Sapiens
AHKGQIVIS

SEQ ID NO: 1332431 - protein, 9 aa, Homo Sapiens
TIVQIDLNE

SEQ ID NO: 1332432 - protein, 9 aa, Homo Sapiens
WYKLQTYDV

SEQ ID NO: 1332433 - protein, 9 aa, Homo Sapiens
WPVDRESCS

SEQ ID NO: 1332434 - protein, 9 aa, Homo Sapiens
KEHTRSDSE

SEQ ID NO: 1332435 - protein, 9 aa, Homo Sapiens
WQIAQLKEE

SEQ ID NO: 1332436 - protein, 9 aa, Homo Sapiens
LQQDNNQPG

SEQ ID NO: 1332437 - protein, 9 aa, Homo Sapiens
SAHTIKHAK

SEQ ID NO: 1332438 - protein, 9 aa, Homo Sapiens
YVYAACERS

SEQ ID NO: 1332439 - protein, 9 aa, Homo Sapiens
VKLTGSILP

SEQ ID NO: 1332440 - protein, 9 aa, Homo Sapiens
EVQDAESDL

SEQ ID NO: 1332441 - protein, 9 aa, Homo Sapiens
QEIISDNCV

SEQ ID NO: 1332442 - protein, 9 aa, Homo Sapiens
PGARACRLH

SEQ ID NO: 1332443 - protein, 9 aa, Homo Sapiens
GARCDVSKW

SEQ ID NO: 1332444 - protein, 9 aa, Homo Sapiens
TLDQPSFVP

SEQ ID NO: 1332445 - protein, 9 aa, Homo Sapiens
KGLMIFAGR

SEQ ID NO: 1332446 - protein, 9 aa, Homo Sapiens
VHAEERELW

SEQ ID NO: 1332447 - protein, 9 aa, Homo Sapiens
PDVKNDFVF

SEQ ID NO: 1332448 - protein, 9 aa, Homo Sapiens
FAAVIHDVD

SEQ ID NO: 1332449 - protein, 9 aa, Homo Sapiens
RGGMSGCGS

SEQ ID NO: 1332450 - protein, 9 aa, Homo Sapiens
VPARDSTSC

SEQ ID NO: 1332451 - protein, 9 aa, Homo Sapiens
DQHVDDVSS

SEQ ID NO: 1332452 - protein, 9 aa, Homo Sapiens
KELKIISLI

SEQ ID NO: 1332453 - protein, 9 aa, Homo Sapiens
MAQAFESYQ

SEQ ID NO: 1332454 - protein, 9 aa, Homo Sapiens
RSVSARSPR

SEQ ID NO: 1332455 - protein, 9 aa, Homo Sapiens
ALKGEADQS

SEQ ID NO: 1332456 - protein, 9 aa, Homo Sapiens
SVSDAVVTY

SEQ ID NO: 1332457 - protein, 9 aa, Homo Sapiens
KKLHESGLF

SEQ ID NO: 1332458 - protein, 9 aa, Homo Sapiens
PVPSVCFRN

SEQ ID NO: 1332459 - protein, 9 aa, Homo Sapiens
NYMSIDALK

SEQ ID NO: 1332460 - protein, 9 aa, Homo Sapiens
LLGNVVTSL

SEQ ID NO: 1332461 - protein, 9 aa, Homo Sapiens
VIHKWCEEM

SEQ ID NO: 1332462 - protein, 9 aa, Homo Sapiens
KVKTTKVTQ

SEQ ID NO: 1332463 - protein, 9 aa, Homo Sapiens
YALWRTDRP

SEQ ID NO: 1332464 - protein, 9 aa, Homo Sapiens
SLRASLVEI

SEQ ID NO: 1332465 - protein, 9 aa, Homo Sapiens
VLFKYFEVQ

SEQ ID NO: 1332466 - protein, 9 aa, Homo Sapiens
LLTESEQYS

SEQ ID NO: 1332467 - protein, 9 aa, Homo Sapiens
YSKHFSIFL

SEQ ID NO: 1332468 - protein, 9 aa, Homo Sapiens
KFNESLVFD

SEQ ID NO: 1332469 - protein, 9 aa, Homo Sapiens
GYREGRRPP

SEQ ID NO: 1332470 - protein, 9 aa, Homo Sapiens
TEIGPKCDP

SEQ ID NO: 1332471 - protein, 9 aa, Homo Sapiens
SGLISGLCY

SEQ ID NO: 1332472 - protein, 9 aa, Homo Sapiens
LLLNILNAR

SEQ ID NO: 1332473 - protein, 9 aa, Homo Sapiens
IVCPKKIHI

SEQ ID NO: 1332474 - protein, 9 aa, Homo Sapiens
MTDGPHTLN

SEQ ID NO: 1332475 - protein, 9 aa, Homo Sapiens
RRKFMMQSR

SEQ ID NO: 1332476 - protein, 9 aa, Homo Sapiens
TAPDGTALT

SEQ ID NO: 1332477 - protein, 9 aa, Homo Sapiens
VAKTKDPPA

SEQ ID NO: 1332478 - protein, 9 aa, Homo Sapiens
DAKDVLIQL

SEQ ID NO: 1332479 - protein, 9 aa, Homo Sapiens
KIFTIPLEI

SEQ ID NO: 1332480 - protein, 9 aa, Homo Sapiens
TQADQNNPH

SEQ ID NO: 1332481 - protein, 9 aa, Homo Sapiens
FFMCIEDIS

SEQ ID NO: 1332482 - protein, 9 aa, Homo Sapiens
VTKRCSPSL

SEQ ID NO: 1332483 - protein, 9 aa, Homo Sapiens
AISRVIRLQ

SEQ ID NO: 1332484 - protein, 9 aa, Homo Sapiens
KETRFGQVF

SEQ ID NO: 1332485 - protein, 9 aa, Homo Sapiens
KERRWSRSR

SEQ ID NO: 1332486 - protein, 9 aa, Homo Sapiens
VSILCYKFC

SEQ ID NO: 1332487 - protein, 9 aa, Homo Sapiens
ALAFLYKDR

SEQ ID NO: 1332488 - protein, 9 aa, Homo Sapiens
NENDNRVQH

SEQ ID NO: 1332489 - protein, 9 aa, Homo Sapiens
EAVKMEMPI

SEQ ID NO: 1332490 - protein, 9 aa, Homo Sapiens
FKRSRITYS

SEQ ID NO: 1332491 - protein, 9 aa, Homo Sapiens
QDAHRHQGV

SEQ ID NO: 1332492 - protein, 9 aa, Homo Sapiens
CLQFAYYKL

SEQ ID NO: 1332493 - protein, 9 aa, Homo Sapiens
DTAIVGAVR

SEQ ID NO: 1332494 - protein, 9 aa, Homo Sapiens
VLVEDRMSL

SEQ ID NO: 1332495 - protein, 9 aa, Homo Sapiens
LMQKHNDLI

SEQ ID NO: 1332496 - protein, 9 aa, Homo Sapiens
FASVEAENT

SEQ ID NO: 1332497 - protein, 9 aa, Homo Sapiens
KKFRTWAEW

SEQ ID NO: 1332498 - protein, 9 aa, Homo Sapiens
SDVVKTGER

SEQ ID NO: 1332499 - protein, 9 aa, Homo Sapiens
GGMSGCGSF

SEQ ID NO: 1332500 - protein, 9 aa, Homo Sapiens
VSGKDDIFA

SEQ ID NO: 1332501 - protein, 9 aa, Homo Sapiens
QGASPTSQS

SEQ ID NO: 1332502 - protein, 9 aa, Homo Sapiens
LKQGKYQDV

SEQ ID NO: 1332503 - protein, 9 aa, Homo Sapiens
TRESNSSHM

SEQ ID NO: 1332504 - protein, 9 aa, Homo Sapiens
EVASVLATS

SEQ ID NO: 1332505 - protein, 9 aa, Homo Sapiens
NLLQHGTEV

SEQ ID NO: 1332506 - protein, 9 aa, Homo Sapiens
HAFGPAVVA

SEQ ID NO: 1332507 - protein, 9 aa, Homo Sapiens
GHPKHLEQQ

SEQ ID NO: 1332508 - protein, 9 aa, Homo Sapiens
YFDEFVMML

SEQ ID NO: 1332509 - protein, 9 aa, Homo Sapiens
SEIYGLMKV

SEQ ID NO: 1332510 - protein, 9 aa, Homo Sapiens
LPEDLVRMY

SEQ ID NO: 1332511 - protein, 9 aa, Homo Sapiens
VDGERSFRG

SEQ ID NO: 1332512 - protein, 9 aa, Homo Sapiens
LCRLNLSSN

SEQ ID NO: 1332513 - protein, 9 aa, Homo Sapiens
LDFDTKAVV

SEQ ID NO: 1332514 - protein, 9 aa, Homo Sapiens
VRAHLQDQH

SEQ ID NO: 1332515 - protein, 9 aa, Homo Sapiens
PFATGDLGN

SEQ ID NO: 1332516 - protein, 9 aa, Homo Sapiens
GTSVQNMLN

SEQ ID NO: 1332517 - protein, 9 aa, Homo Sapiens
LLCKVDSDL

SEQ ID NO: 1332518 - protein, 9 aa, Homo Sapiens
IGRWREESV

SEQ ID NO: 1332519 - protein, 9 aa, Homo Sapiens
SQAQVLSQE

SEQ ID NO: 1332520 - protein, 9 aa, Homo Sapiens
NCPYISNTN

SEQ ID NO: 1332521 - protein, 9 aa, Homo Sapiens
PHIIVSTTG

SEQ ID NO: 1332522 - protein, 9 aa, Homo Sapiens
NQDPGTKGP

SEQ ID NO: 1332523 - protein, 9 aa, Homo Sapiens
EHQPLSIQW

SEQ ID NO: 1332524 - protein, 9 aa, Homo Sapiens
DPTGLEGGP

SEQ ID NO: 1332525 - protein, 9 aa, Homo Sapiens
QGLLLIASL

SEQ ID NO: 1332526 - protein, 9 aa, Homo Sapiens
DLNSQCLSA

SEQ ID NO: 1332527 - protein, 9 aa, Homo Sapiens
FLYLPLRAD

SEQ ID NO: 1332528 - protein, 9 aa, Homo Sapiens
ICGVINQLA

SEQ ID NO: 1332529 - protein, 9 aa, Homo Sapiens
KCRACFGLD

SEQ ID NO: 1332530 - protein, 9 aa, Homo Sapiens
WTSKTWPAL

SEQ ID NO: 1332531 - protein, 9 aa, Homo Sapiens
LPGPPLPTR

SEQ ID NO: 1332532 - protein, 9 aa, Homo Sapiens
EDAVSEMTW

SEQ ID NO: 1332533 - protein, 9 aa, Homo Sapiens
IVKRVYEVI

SEQ ID NO: 1332534 - protein, 9 aa, Homo Sapiens
KLVRAGVSP

SEQ ID NO: 1332535 - protein, 9 aa, Homo Sapiens
TITIESEGC

SEQ ID NO: 1332536 - protein, 9 aa, Homo Sapiens
AVRLGHVEL

SEQ ID NO: 1332537 - protein, 9 aa, Homo Sapiens
QNKTKLFPS

SEQ ID NO: 1332538 - protein, 9 aa, Homo Sapiens
RLHCSVLEA

SEQ ID NO: 1332539 - protein, 9 aa, Homo Sapiens
KDEESGSGF

SEQ ID NO: 1332540 - protein, 9 aa, Homo Sapiens
KCREVRSRV

SEQ ID NO: 1332541 - protein, 9 aa, Homo Sapiens
VSHSGREDT

SEQ ID NO: 1332542 - protein, 9 aa, Homo Sapiens
LRKHKTIHT

SEQ ID NO: 1332543 - protein, 9 aa, Homo Sapiens
PEGKDTLWE

SEQ ID NO: 1332544 - protein, 9 aa, Homo Sapiens
AVNAEFGGG

SEQ ID NO: 1332545 - protein, 9 aa, Homo Sapiens
YLGTFPINP

SEQ ID NO: 1332546 - protein, 9 aa, Homo Sapiens
APGGQVTEV

SEQ ID NO: 1332547 - protein, 9 aa, Homo Sapiens
VCAQCRTYF

SEQ ID NO: 1332548 - protein, 9 aa, Homo Sapiens
LHRLNSPIG

SEQ ID NO: 1332549 - protein, 9 aa, Homo Sapiens
YHISMIPAK

SEQ ID NO: 1332550 - protein, 9 aa, Homo Sapiens
SNPTASAGA

SEQ ID NO: 1332551 - protein, 9 aa, Homo Sapiens
DIMEDTMHF

SEQ ID NO: 1332552 - protein, 9 aa, Homo Sapiens
PAHVVPASV

SEQ ID NO: 1332553 - protein, 9 aa, Homo Sapiens
EDAPSEVDF

SEQ ID NO: 1332554 - protein, 9 aa, Homo Sapiens
EMLLMYQLQ

SEQ ID NO: 1332555 - protein, 9 aa, Homo Sapiens
QHPAGRSCG

SEQ ID NO: 1332556 - protein, 9 aa, Homo Sapiens
YIAPIFSED

SEQ ID NO: 1332557 - protein, 9 aa, Homo Sapiens
LDQLRFSGL

SEQ ID NO: 1332558 - protein, 9 aa, Homo Sapiens
KPDVIMLLE

SEQ ID NO: 1332559 - protein, 9 aa, Homo Sapiens
SDIAPNDIT

SEQ ID NO: 1332560 - protein, 9 aa, Homo Sapiens
GTLISELAQ

SEQ ID NO: 1332561 - protein, 9 aa, Homo Sapiens
VSSWSVDDL

SEQ ID NO: 1332562 - protein, 9 aa, Homo Sapiens
HVVFLLQQV

SEQ ID NO: 1332563 - protein, 9 aa, Homo Sapiens
CEECGNTFY

SEQ ID NO: 1332564 - protein, 9 aa, Homo Sapiens
AMLIIICFI

SEQ ID NO: 1332565 - protein, 9 aa, Homo Sapiens
GTVVVLRLD

SEQ ID NO: 1332566 - protein, 9 aa, Homo Sapiens
VFVRDTVNQ

SEQ ID NO: 1332567 - protein, 9 aa, Homo Sapiens
IMFYVAIRH

SEQ ID NO: 1332568 - protein, 9 aa, Homo Sapiens
WGQRKNFTM

SEQ ID NO: 1332569 - protein, 9 aa, Homo Sapiens
PTPTSSCTG

SEQ ID NO: 1332570 - protein, 9 aa, Homo Sapiens
TCSADEPMT

SEQ ID NO: 1332571 - protein, 9 aa, Homo Sapiens
CQQSHYYGS

SEQ ID NO: 1332572 - protein, 9 aa, Homo Sapiens
FGKVFGNFN

SEQ ID NO: 1332573 - protein, 9 aa, Homo Sapiens
CSPICPPKY

SEQ ID NO: 1332574 - protein, 9 aa, Homo Sapiens
ENCEMSTMN

SEQ ID NO: 1332575 - protein, 9 aa, Homo Sapiens
DIRAGLPTA

SEQ ID NO: 1332576 - protein, 9 aa, Homo Sapiens
STFVPTRSY

SEQ ID NO: 1332577 - protein, 9 aa, Homo Sapiens
DLYWTATEP

SEQ ID NO: 1332578 - protein, 9 aa, Homo Sapiens
STVGIRQDG

SEQ ID NO: 1332579 - protein, 9 aa, Homo Sapiens
DTVTFIRSI

SEQ ID NO: 1332580 - protein, 9 aa, Homo Sapiens
TQACRKTQS

SEQ ID NO: 1332581 - protein, 9 aa, Homo Sapiens
APSHYSQDM

SEQ ID NO: 1332582 - protein, 9 aa, Homo Sapiens
GGVHFVNQL

SEQ ID NO: 1332583 - protein, 9 aa, Homo Sapiens
EELQKGMRT

SEQ ID NO: 1332584 - protein, 9 aa, Homo Sapiens
YYVRFTLFQ

SEQ ID NO: 1332585 - protein, 9 aa, Homo Sapiens
KVYPGKHFW

SEQ ID NO: 1332586 - protein, 9 aa, Homo Sapiens
RVTVDVISV

SEQ ID NO: 1332587 - protein, 9 aa, Homo Sapiens
YADSWSGSE

SEQ ID NO: 1332588 - protein, 9 aa, Homo Sapiens
FARDNTTNF

SEQ ID NO: 1332589 - protein, 9 aa, Homo Sapiens
NNKLIGSIV

SEQ ID NO: 1332590 - protein, 9 aa, Homo Sapiens
PLPVISPLL

SEQ ID NO: 1332591 - protein, 9 aa, Homo Sapiens
QYKCDCTQT

SEQ ID NO: 1332592 - protein, 9 aa, Homo Sapiens
CVQMEELSK

SEQ ID NO: 1332593 - protein, 9 aa, Homo Sapiens
ISLFVSSRS

SEQ ID NO: 1332594 - protein, 9 aa, Homo Sapiens
PESKPILAL

SEQ ID NO: 1332595 - protein, 9 aa, Homo Sapiens
QDDTMVDYF

SEQ ID NO: 1332596 - protein, 9 aa, Homo Sapiens
TAEDLSLPP

SEQ ID NO: 1332597 - protein, 9 aa, Homo Sapiens
PSPRIPMLS

SEQ ID NO: 1332598 - protein, 9 aa, Homo Sapiens
LRAYFPDAR

SEQ ID NO: 1332599 - protein, 9 aa, Homo Sapiens
SGQHSQTSS

SEQ ID NO: 1332600 - protein, 9 aa, Homo Sapiens
HTSWNMGTI

SEQ ID NO: 1332601 - protein, 9 aa, Homo Sapiens
TCTVDTENI

SEQ ID NO: 1332602 - protein, 9 aa, Homo Sapiens
KSWEHQSVS

SEQ ID NO: 1332603 - protein, 9 aa, Homo Sapiens
TYNTQEGAV

SEQ ID NO: 1332604 - protein, 9 aa, Homo Sapiens
IGEKDLHLL

SEQ ID NO: 1332605 - protein, 9 aa, Homo Sapiens
GMGLECGHK

SEQ ID NO: 1332606 - protein, 9 aa, Homo Sapiens
TKMPAISDQ

SEQ ID NO: 1332607 - protein, 9 aa, Homo Sapiens
PSLLCMHER

SEQ ID NO: 1332608 - protein, 9 aa, Homo Sapiens
NTEAYILNA

SEQ ID NO: 1332609 - protein, 9 aa, Homo Sapiens
SVPSPGIAG

SEQ ID NO: 1332610 - protein, 9 aa, Homo Sapiens
VSQKSSPRC

SEQ ID NO: 1332611 - protein, 9 aa, Homo Sapiens
GTEEECGAD

SEQ ID NO: 1332612 - protein, 9 aa, Homo Sapiens
KGLDRRARK

SEQ ID NO: 1332613 - protein, 9 aa, Homo Sapiens
AECTIVTLV

SEQ ID NO: 1332614 - protein, 9 aa, Homo Sapiens
AMGIEDSEL

SEQ ID NO: 1332615 - protein, 9 aa, Homo Sapiens
HQPGSEAPA

SEQ ID NO: 1332616 - protein, 9 aa, Homo Sapiens
DAWLHALGE

SEQ ID NO: 1332617 - protein, 9 aa, Homo Sapiens
RLEAEVESF

SEQ ID NO: 1332618 - protein, 9 aa, Homo Sapiens
EPVIYNRTR

SEQ ID NO: 1332619 - protein, 9 aa, Homo Sapiens
LWPQDSRGL

SEQ ID NO: 1332620 - protein, 9 aa, Homo Sapiens
HYVLFIVLA

SEQ ID NO: 1332621 - protein, 9 aa, Homo Sapiens
SRRRHKMIS

SEQ ID NO: 1332622 - protein, 9 aa, Homo Sapiens
MFYYYNKQR

SEQ ID NO: 1332623 - protein, 9 aa, Homo Sapiens
DRMQRQEEE

SEQ ID NO: 1332624 - protein, 9 aa, Homo Sapiens
WEENCVPRH

SEQ ID NO: 1332625 - protein, 9 aa, Homo Sapiens
LWFTHLKYV

SEQ ID NO: 1332626 - protein, 9 aa, Homo Sapiens
TIPDFKVGT

SEQ ID NO: 1332627 - protein, 9 aa, Homo Sapiens
GEHKNQDPG

SEQ ID NO: 1332628 - protein, 9 aa, Homo Sapiens
MEACSNGVL

SEQ ID NO: 1332629 - protein, 9 aa, Homo Sapiens
CLLFMKLAA

SEQ ID NO: 1332630 - protein, 9 aa, Homo Sapiens
REHVLEEVI

SEQ ID NO: 1332631 - protein, 9 aa, Homo Sapiens
ILATWAVPQ

SEQ ID NO: 1332632 - protein, 9 aa, Homo Sapiens
CTPARSPTG

SEQ ID NO: 1332633 - protein, 9 aa, Homo Sapiens
VDVSWNAIC

SEQ ID NO: 1332634 - protein, 9 aa, Homo Sapiens
DLAETVVKC

SEQ ID NO: 1332635 - protein, 9 aa, Homo Sapiens
KNVTFLEEV

SEQ ID NO: 1332636 - protein, 9 aa, Homo Sapiens
ACRPSVYTS

SEQ ID NO: 1332637 - protein, 9 aa, Homo Sapiens
CTFVKFQTH

SEQ ID NO: 1332638 - protein, 9 aa, Homo Sapiens
HINSLWTTP

SEQ ID NO: 1332639 - protein, 9 aa, Homo Sapiens
KWSVTCRGE

SEQ ID NO: 1332640 - protein, 9 aa, Homo Sapiens
LKKLHESGL

SEQ ID NO: 1332641 - protein, 9 aa, Homo Sapiens
PPGSQSSPR

SEQ ID NO: 1332642 - protein, 9 aa, Homo Sapiens
SENDNMFCA

SEQ ID NO: 1332643 - protein, 9 aa, Homo Sapiens
SATEKDEWL

SEQ ID NO: 1332644 - protein, 9 aa, Homo Sapiens
HILLILWRI

SEQ ID NO: 1332645 - protein, 9 aa, Homo Sapiens
MATHTCTPT

SEQ ID NO: 1332646 - protein, 9 aa, Homo Sapiens
RSLVDSKTY

SEQ ID NO: 1332647 - protein, 9 aa, Homo Sapiens
LRDFITLCL

SEQ ID NO: 1332648 - protein, 9 aa, Homo Sapiens
DNNQPGILT

SEQ ID NO: 1332649 - protein, 9 aa, Homo Sapiens
QCTFFFLHK

SEQ ID NO: 1332650 - protein, 9 aa, Homo Sapiens
QTSLTNSVF

SEQ ID NO: 1332651 - protein, 9 aa, Homo Sapiens
TTEGTGLRG

SEQ ID NO: 1332652 - protein, 9 aa, Homo Sapiens
VGINCYHDM

SEQ ID NO: 1332653 - protein, 9 aa, Homo Sapiens
GYHLPTWLC

SEQ ID NO: 1332654 - protein, 9 aa, Homo Sapiens
RPVNTYVRV

SEQ ID NO: 1332655 - protein, 9 aa, Homo Sapiens
GKESKLVAN

SEQ ID NO: 1332656 - protein, 9 aa, Homo Sapiens
RTVGQLMEF

SEQ ID NO: 1332657 - protein, 9 aa, Homo Sapiens
VIDLMEPTL

SEQ ID NO: 1332658 - protein, 9 aa, Homo Sapiens
GLDGTFVPL

SEQ ID NO: 1332659 - protein, 9 aa, Homo Sapiens
SVHYIEELQ

SEQ ID NO: 1332660 - protein, 9 aa, Homo Sapiens
WHVSELDTQ

SEQ ID NO: 1332661 - protein, 9 aa, Homo Sapiens
FGVRLDTVR

SEQ ID NO: 1332662 - protein, 9 aa, Homo Sapiens
AGSRDEKVE

SEQ ID NO: 1332663 - protein, 9 aa, Homo Sapiens
EGRRPPTSE

SEQ ID NO: 1332664 - protein, 9 aa, Homo Sapiens
VSLKSQLVA

SEQ ID NO: 1332665 - protein, 9 aa, Homo Sapiens
LWMCLHAED

SEQ ID NO: 1332666 - protein, 9 aa, Homo Sapiens
SGTKYKVTG

SEQ ID NO: 1332667 - protein, 9 aa, Homo Sapiens
FEEARRRTH

SEQ ID NO: 1332668 - protein, 9 aa, Homo Sapiens
DVDYKGGYK

SEQ ID NO: 1332669 - protein, 9 aa, Homo Sapiens
IIPKNMLVT

SEQ ID NO: 1332670 - protein, 9 aa, Homo Sapiens
GAFVYLYKL

SEQ ID NO: 1332671 - protein, 9 aa, Homo Sapiens
EHISTYDNQ

SEQ ID NO: 1332672 - protein, 9 aa, Homo Sapiens
KCMFNQLRE

SEQ ID NO: 1332673 - protein, 9 aa, Homo Sapiens
EPPKDIFDE

SEQ ID NO: 1332674 - protein, 9 aa, Homo Sapiens
LISELAQAM

SEQ ID NO: 1332675 - protein, 9 aa, Homo Sapiens
RWGSTAGGC

SEQ ID NO: 1332676 - protein, 9 aa, Homo Sapiens
LCLPFCGHN

SEQ ID NO: 1332677 - protein, 9 aa, Homo Sapiens
EAKPHSLRF

SEQ ID NO: 1332678 - protein, 9 aa, Homo Sapiens
GQVIHKWCE

SEQ ID NO: 1332679 - protein, 9 aa, Homo Sapiens
GRSVLGFMV

SEQ ID NO: 1332680 - protein, 9 aa, Homo Sapiens
KAWRKQSCR

SEQ ID NO: 1332681 - protein, 9 aa, Homo Sapiens
IEHTLNEKC

SEQ ID NO: 1332682 - protein, 9 aa, Homo Sapiens
ARNNIVIIW

SEQ ID NO: 1332683 - protein, 9 aa, Homo Sapiens
MRPKKCPLL

SEQ ID NO: 1332684 - protein, 9 aa, Homo Sapiens
HNRSTEDLH

SEQ ID NO: 1332685 - protein, 9 aa, Homo Sapiens
RDCVQGKTP

SEQ ID NO: 1332686 - protein, 9 aa, Homo Sapiens
YETREYIIR

SEQ ID NO: 1332687 - protein, 9 aa, Homo Sapiens
RVNMCHIQR

SEQ ID NO: 1332688 - protein, 9 aa, Homo Sapiens
GKMTHPLCK

SEQ ID NO: 1332689 - protein, 9 aa, Homo Sapiens
AGTRGGDHH

SEQ ID NO: 1332690 - protein, 9 aa, Homo Sapiens
RFFDVWCQQ

SEQ ID NO: 1332691 - protein, 9 aa, Homo Sapiens
RTMCTRKRR

SEQ ID NO: 1332692 - protein, 9 aa, Homo Sapiens
FALGVGTAL

SEQ ID NO: 1332693 - protein, 9 aa, Homo Sapiens
KLKLAPLQV

SEQ ID NO: 1332694 - protein, 9 aa, Homo Sapiens
DMRELTMLR

SEQ ID NO: 1332695 - protein, 9 aa, Homo Sapiens
DWDRVVAIF

SEQ ID NO: 1332696 - protein, 9 aa, Homo Sapiens
KQDTQNVLK

SEQ ID NO: 1332697 - protein, 9 aa, Homo Sapiens
MGVEEDDDD

SEQ ID NO: 1332698 - protein, 9 aa, Homo Sapiens
WKKTRSRTN

SEQ ID NO: 1332699 - protein, 9 aa, Homo Sapiens
CAHACPAVE

SEQ ID NO: 1332700 - protein, 9 aa, Homo Sapiens
DSDSDSESD

SEQ ID NO: 1332701 - protein, 9 aa, Homo Sapiens
GSETVHTSA

SEQ ID NO: 1332702 - protein, 9 aa, Homo Sapiens
HQTYIPVLC

SEQ ID NO: 1332703 - protein, 9 aa, Homo Sapiens
SKDPHFSKI

SEQ ID NO: 1332704 - protein, 9 aa, Homo Sapiens
ENIIIKLNK

SEQ ID NO: 1332705 - protein, 9 aa, Homo Sapiens
IFPKIMPEK

SEQ ID NO: 1332706 - protein, 9 aa, Homo Sapiens
GKNKLNTIT

SEQ ID NO: 1332707 - protein, 9 aa, Homo Sapiens
MYLFLAYLF

SEQ ID NO: 1332708 - protein, 9 aa, Homo Sapiens
GSGQRHPTI

SEQ ID NO: 1332709 - protein, 9 aa, Homo Sapiens
DQIQWPTVH

SEQ ID NO: 1332710 - protein, 9 aa, Homo Sapiens
FETTDESPR

SEQ ID NO: 1332711 - protein, 9 aa, Homo Sapiens
SKPYDAAKA

SEQ ID NO: 1332712 - protein, 9 aa, Homo Sapiens
ITCTALAVL

SEQ ID NO: 1332713 - protein, 9 aa, Homo Sapiens
HLVSEFPYI

SEQ ID NO: 1332714 - protein, 9 aa, Homo Sapiens
EELHKQWDR

SEQ ID NO: 1332715 - protein, 9 aa, Homo Sapiens
HRVGRFSEP

SEQ ID NO: 1332716 - protein, 9 aa, Homo Sapiens
PFSPLWVCC

SEQ ID NO: 1332717 - protein, 9 aa, Homo Sapiens
ALVVEANTK

SEQ ID NO: 1332718 - protein, 9 aa, Homo Sapiens
KEVDQLHLE

SEQ ID NO: 1332719 - protein, 9 aa, Homo Sapiens
LSMYQLELA

SEQ ID NO: 1332720 - protein, 9 aa, Homo Sapiens
YVSITQFVT

SEQ ID NO: 1332721 - protein, 9 aa, Homo Sapiens
SDVRNPPVV

SEQ ID NO: 1332722 - protein, 9 aa, Homo Sapiens
DRYMSWFLP

SEQ ID NO: 1332723 - protein, 9 aa, Homo Sapiens
PQEEVELLS

SEQ ID NO: 1332724 - protein, 9 aa, Homo Sapiens
TQKVTSLSL

SEQ ID NO: 1332725 - protein, 9 aa, Homo Sapiens
KPTSDEAPP

SEQ ID NO: 1332726 - protein, 9 aa, Homo Sapiens
VELGQYGFV

SEQ ID NO: 1332727 - protein, 9 aa, Homo Sapiens
RETSHITVL

SEQ ID NO: 1332728 - protein, 9 aa, Homo Sapiens
IKETYFDTQ

SEQ ID NO: 1332729 - protein, 9 aa, Homo Sapiens
EINQELHSQ

SEQ ID NO: 1332730 - protein, 9 aa, Homo Sapiens
FKVPGNLFR

SEQ ID NO: 1332731 - protein, 9 aa, Homo Sapiens
TGQTVVTFH

SEQ ID NO: 1332732 - protein, 9 aa, Homo Sapiens
IYKAETLMQ

SEQ ID NO: 1332733 - protein, 9 aa, Homo Sapiens
RPLPMEQAH

SEQ ID NO: 1332734 - protein, 9 aa, Homo Sapiens
ATHKGYHPL

SEQ ID NO: 1332735 - protein, 9 aa, Homo Sapiens
SLVGTMLTY

SEQ ID NO: 1332736 - protein, 9 aa, Homo Sapiens
FFHLSLPSR

SEQ ID NO: 1332737 - protein, 9 aa, Homo Sapiens
TRVYGVIPK

SEQ ID NO: 1332738 - protein, 9 aa, Homo Sapiens
KYKVISEEL

SEQ ID NO: 1332739 - protein, 9 aa, Homo Sapiens
IEWRDRHIT

SEQ ID NO: 1332740 - protein, 9 aa, Homo Sapiens
VQNGAEQYL

SEQ ID NO: 1332741 - protein, 9 aa, Homo Sapiens
DINKPDCDD

SEQ ID NO: 1332742 - protein, 9 aa, Homo Sapiens
PWKSGKMTH

SEQ ID NO: 1332743 - protein, 9 aa, Homo Sapiens
TASSKMTTF

SEQ ID NO: 1332744 - protein, 9 aa, Homo Sapiens
QSVKNVTQM

SEQ ID NO: 1332745 - protein, 9 aa, Homo Sapiens
MALQMGINV

SEQ ID NO: 1332746 - protein, 9 aa, Homo Sapiens
VFLSRSDLQ

SEQ ID NO: 1332747 - protein, 9 aa, Homo Sapiens
HISFSSHNL

SEQ ID NO: 1332748 - protein, 9 aa, Homo Sapiens
RDWNDMEHI

SEQ ID NO: 1332749 - protein, 9 aa, Homo Sapiens
GAQLWGPMD

SEQ ID NO: 1332750 - protein, 9 aa, Homo Sapiens
RQSLNSSSS

SEQ ID NO: 1332751 - protein, 9 aa, Homo Sapiens
HHCSNTPLG

SEQ ID NO: 1332752 - protein, 9 aa, Homo Sapiens
DLGSAYYLT

SEQ ID NO: 1332753 - protein, 9 aa, Homo Sapiens
NKNDFWWLV

SEQ ID NO: 1332754 - protein, 9 aa, Homo Sapiens
ADISITSEV

SEQ ID NO: 1332755 - protein, 9 aa, Homo Sapiens
QPLSIQWKI

SEQ ID NO: 1332756 - protein, 9 aa, Homo Sapiens
SHVVAVLAS

SEQ ID NO: 1332757 - protein, 9 aa, Homo Sapiens
NSLMSWRVY

SEQ ID NO: 1332758 - protein, 9 aa, Homo Sapiens
TPTHREPVS

SEQ ID NO: 1332759 - protein, 9 aa, Homo Sapiens
KKGTHVLIW

SEQ ID NO: 1332760 - protein, 9 aa, Homo Sapiens
EGHCSQASH

SEQ ID NO: 1332761 - protein, 9 aa, Homo Sapiens
LKMVILNLI

SEQ ID NO: 1332762 - protein, 9 aa, Homo Sapiens
NTMSTHLSN

SEQ ID NO: 1332763 - protein, 9 aa, Homo Sapiens
DDDPIGPDT

SEQ ID NO: 1332764 - protein, 9 aa, Homo Sapiens
TSGLITTGY

SEQ ID NO: 1332765 - protein, 9 aa, Homo Sapiens
KFLNSTNSW

SEQ ID NO: 1332766 - protein, 9 aa, Homo Sapiens
SKHLMSPRT

SEQ ID NO: 1332767 - protein, 9 aa, Homo Sapiens
FYFGIIAWP

SEQ ID NO: 1332768 - protein, 9 aa, Homo Sapiens
MPTPQRKGL

SEQ ID NO: 1332769 - protein, 9 aa, Homo Sapiens
DSSTVCFNI

SEQ ID NO: 1332770 - protein, 9 aa, Homo Sapiens
RHQGVQVPV

SEQ ID NO: 1332771 - protein, 9 aa, Homo Sapiens
VPHQVQGRG

SEQ ID NO: 1332772 - protein, 9 aa, Homo Sapiens
WSSRSSHRS

SEQ ID NO: 1332773 - protein, 9 aa, Homo Sapiens
ISMAVVDGQ

SEQ ID NO: 1332774 - protein, 9 aa, Homo Sapiens
VFGIQEPGS

SEQ ID NO: 1332775 - protein, 9 aa, Homo Sapiens
VWEETSQGR

SEQ ID NO: 1332776 - protein, 9 aa, Homo Sapiens
VGLALFLYC

SEQ ID NO: 1332777 - protein, 9 aa, Homo Sapiens
VFEGEHSNI

SEQ ID NO: 1332778 - protein, 9 aa, Homo Sapiens
EVQCCTADM

SEQ ID NO: 1332779 - protein, 9 aa, Homo Sapiens
PPAGPNNVP

SEQ ID NO: 1332780 - protein, 9 aa, Homo Sapiens
IKVNLTRDV

SEQ ID NO: 1332781 - protein, 9 aa, Homo Sapiens
TALEGSRVW

SEQ ID NO: 1332782 - protein, 9 aa, Homo Sapiens
RRESLILQS

SEQ ID NO: 1332783 - protein, 9 aa, Homo Sapiens
HMYNSELLD

SEQ ID NO: 1332784 - protein, 9 aa, Homo Sapiens
EEEQQIRLV

SEQ ID NO: 1332785 - protein, 9 aa, Homo Sapiens
KAFVNYMMS

SEQ ID NO: 1332786 - protein, 9 aa, Homo Sapiens
GWTSKTWPA

SEQ ID NO: 1332787 - protein, 9 aa, Homo Sapiens
HEIQPYEIT

SEQ ID NO: 1332788 - protein, 9 aa, Homo Sapiens
ENGSITQVV

SEQ ID NO: 1332789 - protein, 9 aa, Homo Sapiens
PPCAGFLFG

SEQ ID NO: 1332790 - protein, 9 aa, Homo Sapiens
GYLSEVGAY

SEQ ID NO: 1332791 - protein, 9 aa, Homo Sapiens
FHYIIEQEV

SEQ ID NO: 1332792 - protein, 9 aa, Homo Sapiens
HEVKQGIDP

SEQ ID NO: 1332793 - protein, 9 aa, Homo Sapiens
DHKNLGLVM

SEQ ID NO: 1332794 - protein, 9 aa, Homo Sapiens
TGDIHAITT

SEQ ID NO: 1332795 - protein, 9 aa, Homo Sapiens
KGMDAVPPW

SEQ ID NO: 1332796 - protein, 9 aa, Homo Sapiens
ERWAEFYHQ

SEQ ID NO: 1332797 - protein, 9 aa, Homo Sapiens
AEGCPDAKG

SEQ ID NO: 1332798 - protein, 9 aa, Homo Sapiens
CWLHIDAHL

SEQ ID NO: 1332799 - protein, 9 aa, Homo Sapiens
NCDRFYLIS

SEQ ID NO: 1332800 - protein, 9 aa, Homo Sapiens
HQSVRHAMW

SEQ ID NO: 1332801 - protein, 9 aa, Homo Sapiens
ICIMKNQIR

SEQ ID NO: 1332802 - protein, 9 aa, Homo Sapiens
HSSPDDLKA

SEQ ID NO: 1332803 - protein, 9 aa, Homo Sapiens
FTNCHTKIH

SEQ ID NO: 1332804 - protein, 9 aa, Homo Sapiens
EELRKCVLD

SEQ ID NO: 1332805 - protein, 9 aa, Homo Sapiens
RSQQRERER

SEQ ID NO: 1332806 - protein, 9 aa, Homo Sapiens
FHPLQPLMN

SEQ ID NO: 1332807 - protein, 9 aa, Homo Sapiens
NKCGAHMMR

SEQ ID NO: 1332808 - protein, 9 aa, Homo Sapiens
FRASVDLTP

SEQ ID NO: 1332809 - protein, 9 aa, Homo Sapiens
ASDHDYRIQ

SEQ ID NO: 1332810 - protein, 9 aa, Homo Sapiens
SDHLSLHRC

SEQ ID NO: 1332811 - protein, 9 aa, Homo Sapiens
LEVALQRGK

SEQ ID NO: 1332812 - protein, 9 aa, Homo Sapiens
SPRCAGSAG

SEQ ID NO: 1332813 - protein, 9 aa, Homo Sapiens
AIDMMELYN

SEQ ID NO: 1332814 - protein, 9 aa, Homo Sapiens
MLYQSWELR

SEQ ID NO: 1332815 - protein, 9 aa, Homo Sapiens
ATGPEEPSH

SEQ ID NO: 1332816 - protein, 9 aa, Homo Sapiens
YPMHSVQHR

SEQ ID NO: 1332817 - protein, 9 aa, Homo Sapiens
GHFSILHAF

SEQ ID NO: 1332818 - protein, 9 aa, Homo Sapiens
RPQRRHTWA

SEQ ID NO: 1332819 - protein, 9 aa, Homo Sapiens
KQFPMKKFR

SEQ ID NO: 1332820 - protein, 9 aa, Homo Sapiens
HAPAFPQAQ

SEQ ID NO: 1332821 - protein, 9 aa, Homo Sapiens
TPEEYVGQI

SEQ ID NO: 1332822 - protein, 9 aa, Homo Sapiens
MAFCVTSFI

SEQ ID NO: 1332823 - protein, 9 aa, Homo Sapiens
TPVMVVDTA

SEQ ID NO: 1332824 - protein, 9 aa, Homo Sapiens
PERARPSEG

SEQ ID NO: 1332825 - protein, 9 aa, Homo Sapiens
GLLPLVKRR

SEQ ID NO: 1332826 - protein, 9 aa, Homo Sapiens
GISRYIVSD

SEQ ID NO: 1332827 - protein, 9 aa, Homo Sapiens
RHPERKYDL

SEQ ID NO: 1332828 - protein, 9 aa, Homo Sapiens
HLEITIPND

SEQ ID NO: 1332829 - protein, 9 aa, Homo Sapiens
PLKLLADLD

SEQ ID NO: 1332830 - protein, 9 aa, Homo Sapiens
GFKEVVQYV

SEQ ID NO: 1332831 - protein, 9 aa, Homo Sapiens
LKEDVSYIE

SEQ ID NO: 1332832 - protein, 9 aa, Homo Sapiens
RRRRRHRSF

SEQ ID NO: 1332833 - protein, 9 aa, Homo Sapiens
VAKIMSDRN

SEQ ID NO: 1332834 - protein, 9 aa, Homo Sapiens
ARKSTLKTR

SEQ ID NO: 1332835 - protein, 9 aa, Homo Sapiens
KNVFHYLMT

SEQ ID NO: 1332836 - protein, 9 aa, Homo Sapiens
QDRRFMLRM

SEQ ID NO: 1332837 - protein, 9 aa, Homo Sapiens
DGCFLRGYR

SEQ ID NO: 1332838 - protein, 9 aa, Homo Sapiens
NIPICLASR

SEQ ID NO: 1332839 - protein, 9 aa, Homo Sapiens
GLTRMYFQP

SEQ ID NO: 1332840 - protein, 9 aa, Homo Sapiens
RRRLPSVIP

SEQ ID NO: 1332841 - protein, 9 aa, Homo Sapiens
GSGFNPFQH

SEQ ID NO: 1332842 - protein, 9 aa, Homo Sapiens
GPCMSVAWN

SEQ ID NO: 1332843 - protein, 9 aa, Homo Sapiens
ADRKCQLSP

SEQ ID NO: 1332844 - protein, 9 aa, Homo Sapiens
TSEPHEMSA

SEQ ID NO: 1332845 - protein, 9 aa, Homo Sapiens
SCGLGRRQQ

SEQ ID NO: 1332846 - protein, 9 aa, Homo Sapiens
FIVLFAIGA

SEQ ID NO: 1332847 - protein, 9 aa, Homo Sapiens
WVGYPFHLF

SEQ ID NO: 1332848 - protein, 9 aa, Homo Sapiens
HRDGRWAVR

SEQ ID NO: 1332849 - protein, 9 aa, Homo Sapiens
TTSLKGIPK

SEQ ID NO: 1332850 - protein, 9 aa, Homo Sapiens
TVLQALRHP

SEQ ID NO: 1332851 - protein, 9 aa, Homo Sapiens
DFTRELDPV

SEQ ID NO: 1332852 - protein, 9 aa, Homo Sapiens
LCDSIITIC

SEQ ID NO: 1332853 - protein, 9 aa, Homo Sapiens
SSPVFTFHH

SEQ ID NO: 1332854 - protein, 9 aa, Homo Sapiens
RLGQEIMHF

SEQ ID NO: 1332855 - protein, 9 aa, Homo Sapiens
PPSTRPPPG

SEQ ID NO: 1332856 - protein, 9 aa, Homo Sapiens
NLTVPGSLC

SEQ ID NO: 1332857 - protein, 9 aa, Homo Sapiens
TVSVHHPGF

SEQ ID NO: 1332858 - protein, 9 aa, Homo Sapiens
ICKDTLQVS

SEQ ID NO: 1332859 - protein, 9 aa, Homo Sapiens
SISCAQIPC

SEQ ID NO: 1332860 - protein, 9 aa, Homo Sapiens
PRTRCTKFT

SEQ ID NO: 1332861 - protein, 9 aa, Homo Sapiens
YVSRPHRCE

SEQ ID NO: 1332862 - protein, 9 aa, Homo Sapiens
VREQLSKST

SEQ ID NO: 1332863 - protein, 9 aa, Homo Sapiens
NMGTILEGK

SEQ ID NO: 1332864 - protein, 9 aa, Homo Sapiens
RKNLEKVHA

SEQ ID NO: 1332865 - protein, 9 aa, Homo Sapiens
DDYDITLMR

SEQ ID NO: 1332866 - protein, 9 aa, Homo Sapiens
VQSEIEHIF

SEQ ID NO: 1332867 - protein, 9 aa, Homo Sapiens
FLPEQIFFR

SEQ ID NO: 1332868 - protein, 9 aa, Homo Sapiens
WTSLGDSLT

SEQ ID NO: 1332869 - protein, 9 aa, Homo Sapiens
LTSGNWELI

SEQ ID NO: 1332870 - protein, 9 aa, Homo Sapiens
KRANCVIQR

SEQ ID NO: 1332871 - protein, 9 aa, Homo Sapiens
MSVVSGRAY

SEQ ID NO: 1332872 - protein, 9 aa, Homo Sapiens
LDAELLGEA

SEQ ID NO: 1332873 - protein, 9 aa, Homo Sapiens
QSLHLMIPE

SEQ ID NO: 1332874 - protein, 9 aa, Homo Sapiens
MGQIIPIYS

SEQ ID NO: 1332875 - protein, 9 aa, Homo Sapiens
PCTMESAPR

SEQ ID NO: 1332876 - protein, 9 aa, Homo Sapiens
DTQEWERGW

SEQ ID NO: 1332877 - protein, 9 aa, Homo Sapiens
VVRPRRSEK

SEQ ID NO: 1332878 - protein, 9 aa, Homo Sapiens
KTTSVLEHL

SEQ ID NO: 1332879 - protein, 9 aa, Homo Sapiens
RFRPPEPHF

SEQ ID NO: 1332880 - protein, 9 aa, Homo Sapiens
PGPGIKFST

SEQ ID NO: 1332881 - protein, 9 aa, Homo Sapiens
SYLSSKCIA

SEQ ID NO: 1332882 - protein, 9 aa, Homo Sapiens
DYPCLPPPP

SEQ ID NO: 1332883 - protein, 9 aa, Homo Sapiens
TSPKKAVEP

SEQ ID NO: 1332884 - protein, 9 aa, Homo Sapiens
GYHCVTEEC

SEQ ID NO: 1332885 - protein, 9 aa, Homo Sapiens
VPQLPLAVA

SEQ ID NO: 1332886 - protein, 9 aa, Homo Sapiens
GCNKRTARK

SEQ ID NO: 1332887 - protein, 9 aa, Homo Sapiens
PEPPVQPNG

SEQ ID NO: 1332888 - protein, 9 aa, Homo Sapiens
RRDDVRHQQ

SEQ ID NO: 1332889 - protein, 9 aa, Homo Sapiens
ACTRSTLMS

SEQ ID NO: 1332890 - protein, 9 aa, Homo Sapiens
LAGWELPDY

SEQ ID NO: 1332891 - protein, 9 aa, Homo Sapiens
GTVYFDEFV

SEQ ID NO: 1332892 - protein, 9 aa, Homo Sapiens
SPERARPSE

SEQ ID NO: 1332893 - protein, 9 aa, Homo Sapiens
GTKSTRFFA

SEQ ID NO: 1332894 - protein, 9 aa, Homo Sapiens
AGLPHPQLR

SEQ ID NO: 1332895 - protein, 9 aa, Homo Sapiens
MPCQQNQQQ

SEQ ID NO: 1332896 - protein, 9 aa, Homo Sapiens
LVVPLLAEA

SEQ ID NO: 1332897 - protein, 9 aa, Homo Sapiens
LIASLFTFW

SEQ ID NO: 1332898 - protein, 9 aa, Homo Sapiens
NWKRQHQHY

SEQ ID NO: 1332899 - protein, 9 aa, Homo Sapiens
SHQGLTCNR

SEQ ID NO: 1332900 - protein, 9 aa, Homo Sapiens
GFLAFPSPQ

SEQ ID NO: 1332901 - protein, 9 aa, Homo Sapiens
QVLLNQKDL

SEQ ID NO: 1332902 - protein, 9 aa, Homo Sapiens
LPPLRFLWF

SEQ ID NO: 1332903 - protein, 9 aa, Homo Sapiens
LLDPAQKYL

SEQ ID NO: 1332904 - protein, 9 aa, Homo Sapiens
IWPSSDINI

SEQ ID NO: 1332905 - protein, 9 aa, Homo Sapiens
GTYCGQSVC

SEQ ID NO: 1332906 - protein, 9 aa, Homo Sapiens
GANGTLGFF

SEQ ID NO: 1332907 - protein, 9 aa, Homo Sapiens
LGSQPCVLC

SEQ ID NO: 1332908 - protein, 9 aa, Homo Sapiens
FPEQVTAFQ

SEQ ID NO: 1332909 - protein, 9 aa, Homo Sapiens
EECRAEEEQ

SEQ ID NO: 1332910 - protein, 9 aa, Homo Sapiens
NIPLELMLL

SEQ ID NO: 1332911 - protein, 9 aa, Homo Sapiens
ENLNGVSSI

SEQ ID NO: 1332912 - protein, 9 aa, Homo Sapiens
KNCTEVTKF

SEQ ID NO: 1332913 - protein, 9 aa, Homo Sapiens
KYNTQPVGN

SEQ ID NO: 1332914 - protein, 9 aa, Homo Sapiens
ETLKNRKKS

SEQ ID NO: 1332915 - protein, 9 aa, Homo Sapiens
ASEKQRWLL

SEQ ID NO: 1332916 - protein, 9 aa, Homo Sapiens
KHNIYKRTC

SEQ ID NO: 1332917 - protein, 9 aa, Homo Sapiens
THHPISHHI

SEQ ID NO: 1332918 - protein, 9 aa, Homo Sapiens
LPPVYPVAL

SEQ ID NO: 1332919 - protein, 9 aa, Homo Sapiens
NRNKKTKII

SEQ ID NO: 1332920 - protein, 9 aa, Homo Sapiens
TRCKTEEER

SEQ ID NO: 1332921 - protein, 9 aa, Homo Sapiens
TCHFDPTVF

SEQ ID NO: 1332922 - protein, 9 aa, Homo Sapiens
VFINANRNW

SEQ ID NO: 1332923 - protein, 9 aa, Homo Sapiens
GQRHPTIVL

SEQ ID NO: 1332924 - protein, 9 aa, Homo Sapiens
IRGEIQDAF

SEQ ID NO: 1332925 - protein, 9 aa, Homo Sapiens
AGDQILQAN

SEQ ID NO: 1332926 - protein, 9 aa, Homo Sapiens
WETQALEND

SEQ ID NO: 1332927 - protein, 9 aa, Homo Sapiens
PTSGNFFMM

SEQ ID NO: 1332928 - protein, 9 aa, Homo Sapiens
VSGKKCRLT

SEQ ID NO: 1332929 - protein, 9 aa, Homo Sapiens
INYHFHSWR

SEQ ID NO: 1332930 - protein, 9 aa, Homo Sapiens
HVGFVTIPR

SEQ ID NO: 1332931 - protein, 9 aa, Homo Sapiens
QLSLIDLNH

SEQ ID NO: 1332932 - protein, 9 aa, Homo Sapiens
NGLSIPVDE

SEQ ID NO: 1332933 - protein, 9 aa, Homo Sapiens
SQTHSRSRS

SEQ ID NO: 1332934 - protein, 9 aa, Homo Sapiens
GCVGTVIGS

SEQ ID NO: 1332935 - protein, 9 aa, Homo Sapiens
RLPKKQQVS

SEQ ID NO: 1332936 - protein, 9 aa, Homo Sapiens
KYKERFDNE

SEQ ID NO: 1332937 - protein, 9 aa, Homo Sapiens
EPSARTTVS

SEQ ID NO: 1332938 - protein, 9 aa, Homo Sapiens
AAEMLGTKI

SEQ ID NO: 1332939 - protein, 9 aa, Homo Sapiens
VLHEELLHL

SEQ ID NO: 1332940 - protein, 9 aa, Homo Sapiens
GSKRHAKLI

SEQ ID NO: 1332941 - protein, 9 aa, Homo Sapiens
REDGLPVPS

SEQ ID NO: 1332942 - protein, 9 aa, Homo Sapiens
GEELTIHNR

SEQ ID NO: 1332943 - protein, 9 aa, Homo Sapiens
QKYLKKHQV

SEQ ID NO: 1332944 - protein, 9 aa, Homo Sapiens
PCLLRFILF

SEQ ID NO: 1332945 - protein, 9 aa, Homo Sapiens
LLDPPRKHL

SEQ ID NO: 1332946 - protein, 9 aa, Homo Sapiens
GILDECLTH

SEQ ID NO: 1332947 - protein, 9 aa, Homo Sapiens
LRQHSVNEG

SEQ ID NO: 1332948 - protein, 9 aa, Homo Sapiens
ESVDKSVGQ

SEQ ID NO: 1332949 - protein, 9 aa, Homo Sapiens
DALTGHLHT

SEQ ID NO: 1332950 - protein, 9 aa, Homo Sapiens
DVELIQTFL

SEQ ID NO: 1332951 - protein, 9 aa, Homo Sapiens
MSLSGHYLE

SEQ ID NO: 1332952 - protein, 9 aa, Homo Sapiens
MVILCHFRK

SEQ ID NO: 1332953 - protein, 9 aa, Homo Sapiens
LEENDYFTE

SEQ ID NO: 1332954 - protein, 9 aa, Homo Sapiens
SHITVLEAL

SEQ ID NO: 1332955 - protein, 9 aa, Homo Sapiens
PRDCVQGKT

SEQ ID NO: 1332956 - protein, 9 aa, Homo Sapiens
ERPPLPRLR

SEQ ID NO: 1332957 - protein, 9 aa, Homo Sapiens
INLTCSVPW

SEQ ID NO: 1332958 - protein, 9 aa, Homo Sapiens
TTDCILFGL

SEQ ID NO: 1332959 - protein, 9 aa, Homo Sapiens
KFFGGKQED

SEQ ID NO: 1332960 - protein, 9 aa, Homo Sapiens
IPDNKLDAD

SEQ ID NO: 1332961 - protein, 9 aa, Homo Sapiens
VCGALLRGY

SEQ ID NO: 1332962 - protein, 9 aa, Homo Sapiens
FGLSLEAAH

SEQ ID NO: 1332963 - protein, 9 aa, Homo Sapiens
DCFDASDEL

SEQ ID NO: 1332964 - protein, 9 aa, Homo Sapiens
SHKQLYMYG

SEQ ID NO: 1332965 - protein, 9 aa, Homo Sapiens
MRRPSSRHA

SEQ ID NO: 1332966 - protein, 9 aa, Homo Sapiens
HEVTLKACS

SEQ ID NO: 1332967 - protein, 9 aa, Homo Sapiens
LNILNARVQ

SEQ ID NO: 1332968 - protein, 9 aa, Homo Sapiens
KEKVTGIES

SEQ ID NO: 1332969 - protein, 9 aa, Homo Sapiens
TCQIRQYHI

SEQ ID NO: 1332970 - protein, 9 aa, Homo Sapiens
ILCTKSLPC

SEQ ID NO: 1332971 - protein, 9 aa, Homo Sapiens
VILFITPLL

SEQ ID NO: 1332972 - protein, 9 aa, Homo Sapiens
LLPEILQST

SEQ ID NO: 1332973 - protein, 9 aa, Homo Sapiens
GLGPVLPPP

SEQ ID NO: 1332974 - protein, 9 aa, Homo Sapiens
VLNVAHGRW

SEQ ID NO: 1332975 - protein, 9 aa, Homo Sapiens
TTQNSPLDW

SEQ ID NO: 1332976 - protein, 9 aa, Homo Sapiens
LKIISLIFE

SEQ ID NO: 1332977 - protein, 9 aa, Homo Sapiens
ASVGRPSAA

SEQ ID NO: 1332978 - protein, 9 aa, Homo Sapiens
EALQVPAVL

SEQ ID NO: 1332979 - protein, 9 aa, Homo Sapiens
EEEQVRATS

SEQ ID NO: 1332980 - protein, 9 aa, Homo Sapiens
TLLPALVLC

SEQ ID NO: 1332981 - protein, 9 aa, Homo Sapiens
YEMIAEKLR

SEQ ID NO: 1332982 - protein, 9 aa, Homo Sapiens
STHLSNGQM

SEQ ID NO: 1332983 - protein, 9 aa, Homo Sapiens
VLVVSVPAP

SEQ ID NO: 1332984 - protein, 9 aa, Homo Sapiens
NVAFQAETQ

SEQ ID NO: 1332985 - protein, 9 aa, Homo Sapiens
LELFGKVFG

SEQ ID NO: 1332986 - protein, 9 aa, Homo Sapiens
YEICQYVVQ

SEQ ID NO: 1332987 - protein, 9 aa, Homo Sapiens
SIPSDVVKT

SEQ ID NO: 1332988 - protein, 9 aa, Homo Sapiens
KIWPKLWVL

SEQ ID NO: 1332989 - protein, 9 aa, Homo Sapiens
ECYRIPKVA

SEQ ID NO: 1332990 - protein, 9 aa, Homo Sapiens
IIYLDREKQ

SEQ ID NO: 1332991 - protein, 9 aa, Homo Sapiens
QDAGIGAGM

SEQ ID NO: 1332992 - protein, 9 aa, Homo Sapiens
GLFVVGLYT

SEQ ID NO: 1332993 - protein, 9 aa, Homo Sapiens
LLLVCKQLT

SEQ ID NO: 1332994 - protein, 9 aa, Homo Sapiens
SDDTCYRET

SEQ ID NO: 1332995 - protein, 9 aa, Homo Sapiens
NGQLIESLQ

SEQ ID NO: 1332996 - protein, 9 aa, Homo Sapiens
AITWEMAFS

SEQ ID NO: 1332997 - protein, 9 aa, Homo Sapiens
IFQVYMADL

SEQ ID NO: 1332998 - protein, 9 aa, Homo Sapiens
NGWLLGQME

SEQ ID NO: 1332999 - protein, 9 aa, Homo Sapiens
ATPLYGNIH

SEQ ID NO: 1333000 - protein, 9 aa, Homo Sapiens
GSPFLKRGK

SEQ ID NO: 1333001 - protein, 9 aa, Homo Sapiens
SNTWMNDTV

SEQ ID NO: 1333002 - protein, 9 aa, Homo Sapiens
IMCGGVQCE

SEQ ID NO: 1333003 - protein, 9 aa, Homo Sapiens
TLNIAGNNH

SEQ ID NO: 1333004 - protein, 9 aa, Homo Sapiens
EAIIKRAGS

SEQ ID NO: 1333005 - protein, 9 aa, Homo Sapiens
IRKMKDRFS

SEQ ID NO: 1333006 - protein, 9 aa, Homo Sapiens
KVPYDDLCY

SEQ ID NO: 1333007 - protein, 9 aa, Homo Sapiens
AVILRYTDF

SEQ ID NO: 1333008 - protein, 9 aa, Homo Sapiens
IHGGDPEDN

SEQ ID NO: 1333009 - protein, 9 aa, Homo Sapiens
SFLLWTGAI

SEQ ID NO: 1333010 - protein, 9 aa, Homo Sapiens
KKEYLNEDA

SEQ ID NO: 1333011 - protein, 9 aa, Homo Sapiens
AIIRIHSLQ

SEQ ID NO: 1333012 - protein, 9 aa, Homo Sapiens
EELQSQAQV

SEQ ID NO: 1333013 - protein, 9 aa, Homo Sapiens
KKLFTVVTW

SEQ ID NO: 1333014 - protein, 9 aa, Homo Sapiens
DMLRKRHYW

SEQ ID NO: 1333015 - protein, 9 aa, Homo Sapiens
QVDYILATW

SEQ ID NO: 1333016 - protein, 9 aa, Homo Sapiens
CITAKVRRL

SEQ ID NO: 1333017 - protein, 9 aa, Homo Sapiens
EENSTYEQL

SEQ ID NO: 1333018 - protein, 9 aa, Homo Sapiens
GAEAVMNWV

SEQ ID NO: 1333019 - protein, 9 aa, Homo Sapiens
LAGSMVHVY

SEQ ID NO: 1333020 - protein, 9 aa, Homo Sapiens
NALNGIHFD

SEQ ID NO: 1333021 - protein, 9 aa, Homo Sapiens
PNNNPITMQ

SEQ ID NO: 1333022 - protein, 9 aa, Homo Sapiens
YGQDCQMCS

SEQ ID NO: 1333023 - protein, 9 aa, Homo Sapiens
YHAEGGWPQ

SEQ ID NO: 1333024 - protein, 9 aa, Homo Sapiens
KRCPILSAT

SEQ ID NO: 1333025 - protein, 9 aa, Homo Sapiens
RRKCPHAHL

SEQ ID NO: 1333026 - protein, 9 aa, Homo Sapiens
ELVVTGFYA

SEQ ID NO: 1333027 - protein, 9 aa, Homo Sapiens
PIHLQSSVP

SEQ ID NO: 1333028 - protein, 9 aa, Homo Sapiens
MGIGKWKGT

SEQ ID NO: 1333029 - protein, 9 aa, Homo Sapiens
DPTSIEPIS

SEQ ID NO: 1333030 - protein, 9 aa, Homo Sapiens
HFQVFKMHK

SEQ ID NO: 1333031 - protein, 9 aa, Homo Sapiens
QEQHNVFLA

SEQ ID NO: 1333032 - protein, 9 aa, Homo Sapiens
VTDPQYRAR

SEQ ID NO: 1333033 - protein, 9 aa, Homo Sapiens
NVTPRPQQT

SEQ ID NO: 1333034 - protein, 9 aa, Homo Sapiens
GVPQAQRPG

SEQ ID NO: 1333035 - protein, 9 aa, Homo Sapiens
CPCDKYNTQ

SEQ ID NO: 1333036 - protein, 9 aa, Homo Sapiens
ILRNTKEQH

SEQ ID NO: 1333037 - protein, 9 aa, Homo Sapiens
QLYQPKLAS

SEQ ID NO: 1333038 - protein, 9 aa, Homo Sapiens
VICFPLHYP

SEQ ID NO: 1333039 - protein, 9 aa, Homo Sapiens
ALYTVLHHL

SEQ ID NO: 1333040 - protein, 9 aa, Homo Sapiens
MTPHRPGPT

SEQ ID NO: 1333041 - protein, 9 aa, Homo Sapiens
KLIHTGEKH

SEQ ID NO: 1333042 - protein, 9 aa, Homo Sapiens
SFVSPESDF

SEQ ID NO: 1333043 - protein, 9 aa, Homo Sapiens
QLVPASSLT

SEQ ID NO: 1333044 - protein, 9 aa, Homo Sapiens
IPHVLKMEP

SEQ ID NO: 1333045 - protein, 9 aa, Homo Sapiens
DDSDVIYPA

SEQ ID NO: 1333046 - protein, 9 aa, Homo Sapiens
VDDFYYGWD

SEQ ID NO: 1333047 - protein, 9 aa, Homo Sapiens
SLKMDPTGL

SEQ ID NO: 1333048 - protein, 9 aa, Homo Sapiens
EDNKPDNEG

SEQ ID NO: 1333049 - protein, 9 aa, Homo Sapiens
AQNDQSPMA

SEQ ID NO: 1333050 - protein, 9 aa, Homo Sapiens
LTITARKIR

SEQ ID NO: 1333051 - protein, 9 aa, Homo Sapiens
KCPHAHLRV

SEQ ID NO: 1333052 - protein, 9 aa, Homo Sapiens
AGENSEKKQ

SEQ ID NO: 1333053 - protein, 9 aa, Homo Sapiens
ASQVGGTQE

SEQ ID NO: 1333054 - protein, 9 aa, Homo Sapiens
PTTKEDVMM

SEQ ID NO: 1333055 - protein, 9 aa, Homo Sapiens
FLHPINTLF

SEQ ID NO: 1333056 - protein, 9 aa, Homo Sapiens
PSFTELQPI

SEQ ID NO: 1333057 - protein, 9 aa, Homo Sapiens
YERAISMHN

SEQ ID NO: 1333058 - protein, 9 aa, Homo Sapiens
RHHCSNTPL

SEQ ID NO: 1333059 - protein, 9 aa, Homo Sapiens
LIILMWTYL

SEQ ID NO: 1333060 - protein, 9 aa, Homo Sapiens
RNLSKPYDA

SEQ ID NO: 1333061 - protein, 9 aa, Homo Sapiens
LCHGFIFKG

SEQ ID NO: 1333062 - protein, 9 aa, Homo Sapiens
SGLHRTLRL

SEQ ID NO: 1333063 - protein, 9 aa, Homo Sapiens
LPRRLWRSS

SEQ ID NO: 1333064 - protein, 9 aa, Homo Sapiens
YKISLRNLV

SEQ ID NO: 1333065 - protein, 9 aa, Homo Sapiens
CHIRFTWAL

SEQ ID NO: 1333066 - protein, 9 aa, Homo Sapiens
PQTIQGGLL

SEQ ID NO: 1333067 - protein, 9 aa, Homo Sapiens
MACLDLGFQ

SEQ ID NO: 1333068 - protein, 9 aa, Homo Sapiens
KEKIREQKE

SEQ ID NO: 1333069 - protein, 9 aa, Homo Sapiens
GFVLEDFKQ

SEQ ID NO: 1333070 - protein, 9 aa, Homo Sapiens
LGMAFITFQ

SEQ ID NO: 1333071 - protein, 9 aa, Homo Sapiens
PQRRHTWAS

SEQ ID NO: 1333072 - protein, 9 aa, Homo Sapiens
RSKCLMKRH

SEQ ID NO: 1333073 - protein, 9 aa, Homo Sapiens
FHHISGEKT

SEQ ID NO: 1333074 - protein, 9 aa, Homo Sapiens
HYIEELQKF

SEQ ID NO: 1333075 - protein, 9 aa, Homo Sapiens
KLQGSVTVI

SEQ ID NO: 1333076 - protein, 9 aa, Homo Sapiens
LLCTSFYMK

SEQ ID NO: 1333077 - protein, 9 aa, Homo Sapiens
REKYMQKLF

SEQ ID NO: 1333078 - protein, 9 aa, Homo Sapiens
SSQTHSLIL

SEQ ID NO: 1333079 - protein, 9 aa, Homo Sapiens
AGRSCGHTR

SEQ ID NO: 1333080 - protein, 9 aa, Homo Sapiens
QLRDPHHDL

SEQ ID NO: 1333081 - protein, 9 aa, Homo Sapiens
ELQPDKNGQ

SEQ ID NO: 1333082 - protein, 9 aa, Homo Sapiens
RPDVKVLRW

SEQ ID NO: 1333083 - protein, 9 aa, Homo Sapiens
MSVQEEDRR

SEQ ID NO: 1333084 - protein, 9 aa, Homo Sapiens
SPEDRDQDL

SEQ ID NO: 1333085 - protein, 9 aa, Homo Sapiens
IMSPGSSLS

SEQ ID NO: 1333086 - protein, 9 aa, Homo Sapiens
RMTPWRPLS

SEQ ID NO: 1333087 - protein, 9 aa, Homo Sapiens
VQPPHDSAG

SEQ ID NO: 1333088 - protein, 9 aa, Homo Sapiens
EVLKGAIQI

SEQ ID NO: 1333089 - protein, 9 aa, Homo Sapiens
RYYADGCSP

SEQ ID NO: 1333090 - protein, 9 aa, Homo Sapiens
YFPSEAFSL

SEQ ID NO: 1333091 - protein, 9 aa, Homo Sapiens
ARTSRPLRA

SEQ ID NO: 1333092 - protein, 9 aa, Homo Sapiens
GDYTPRVSI

SEQ ID NO: 1333093 - protein, 9 aa, Homo Sapiens
GAPQDSIRI

SEQ ID NO: 1333094 - protein, 9 aa, Homo Sapiens
AWESRWRAW

SEQ ID NO: 1333095 - protein, 9 aa, Homo Sapiens
SMLQSQLLK

SEQ ID NO: 1333096 - protein, 9 aa, Homo Sapiens
HMEDEGGFP

SEQ ID NO: 1333097 - protein, 9 aa, Homo Sapiens
MLVTLCHYA

SEQ ID NO: 1333098 - protein, 9 aa, Homo Sapiens
DPLTKDERI

SEQ ID NO: 1333099 - protein, 9 aa, Homo Sapiens
EDIASHYPT

SEQ ID NO: 1333100 - protein, 9 aa, Homo Sapiens
RKKPEFHSC

SEQ ID NO: 1333101 - protein, 9 aa, Homo Sapiens
SVSARSPRL

SEQ ID NO: 1333102 - protein, 9 aa, Homo Sapiens
NTWNFIESP

SEQ ID NO: 1333103 - protein, 9 aa, Homo Sapiens
EDTVEWRYR

SEQ ID NO: 1333104 - protein, 9 aa, Homo Sapiens
SRRSSTPSM

SEQ ID NO: 1333105 - protein, 9 aa, Homo Sapiens
QNVLKNYRT

SEQ ID NO: 1333106 - protein, 9 aa, Homo Sapiens
RAGPTSHVV

SEQ ID NO: 1333107 - protein, 9 aa, Homo Sapiens
EGLPVRLQW

SEQ ID NO: 1333108 - protein, 9 aa, Homo Sapiens
TKAPRVPDI

SEQ ID NO: 1333109 - protein, 9 aa, Homo Sapiens
LYEQSCESH

SEQ ID NO: 1333110 - protein, 9 aa, Homo Sapiens
GGVCALLCG

SEQ ID NO: 1333111 - protein, 9 aa, Homo Sapiens
GEGIAVSHR

SEQ ID NO: 1333112 - protein, 9 aa, Homo Sapiens
DSLHREFMR

SEQ ID NO: 1333113 - protein, 9 aa, Homo Sapiens
KPGNLDTKV

SEQ ID NO: 1333114 - protein, 9 aa, Homo Sapiens
HNSVGGFLV

SEQ ID NO: 1333115 - protein, 9 aa, Homo Sapiens
GSLLTTEGT

SEQ ID NO: 1333116 - protein, 9 aa, Homo Sapiens
DLENIVVIH

SEQ ID NO: 1333117 - protein, 9 aa, Homo Sapiens
WAHDNPVCT

SEQ ID NO: 1333118 - protein, 9 aa, Homo Sapiens
HISHFIHNI

SEQ ID NO: 1333119 - protein, 9 aa, Homo Sapiens
WDHCVVGGY

SEQ ID NO: 1333120 - protein, 9 aa, Homo Sapiens
ALTSLVDEA

SEQ ID NO: 1333121 - protein, 9 aa, Homo Sapiens
NNQIEQLSV

SEQ ID NO: 1333122 - protein, 9 aa, Homo Sapiens
RNTKEQHDL

SEQ ID NO: 1333123 - protein, 9 aa, Homo Sapiens
NQALYSWPY

SEQ ID NO: 1333124 - protein, 9 aa, Homo Sapiens
QQWVVFPNN

SEQ ID NO: 1333125 - protein, 9 aa, Homo Sapiens
PRVPQSKVM

SEQ ID NO: 1333126 - protein, 9 aa, Homo Sapiens
KPYDAAKAE

SEQ ID NO: 1333127 - protein, 9 aa, Homo Sapiens
SRMRCLHNE

SEQ ID NO: 1333128 - protein, 9 aa, Homo Sapiens
HSFQYFLKK

SEQ ID NO: 1333129 - protein, 9 aa, Homo Sapiens
TDCLMAVKE

SEQ ID NO: 1333130 - protein, 9 aa, Homo Sapiens
VVGTERGCT

SEQ ID NO: 1333131 - protein, 9 aa, Homo Sapiens
TTLLMLNLL

SEQ ID NO: 1333132 - protein, 9 aa, Homo Sapiens
VLKGSHARF

SEQ ID NO: 1333133 - protein, 9 aa, Homo Sapiens
PVSCTSFWP

SEQ ID NO: 1333134 - protein, 9 aa, Homo Sapiens
MCIEDISGK

SEQ ID NO: 1333135 - protein, 9 aa, Homo Sapiens
DAVSTLEED

SEQ ID NO: 1333136 - protein, 9 aa, Homo Sapiens
RKLHSGMKM

SEQ ID NO: 1333137 - protein, 9 aa, Homo Sapiens
AHINMLYQS

SEQ ID NO: 1333138 - protein, 9 aa, Homo Sapiens
ALRKHKTIH

SEQ ID NO: 1333139 - protein, 9 aa, Homo Sapiens
GPITFKDFI

SEQ ID NO: 1333140 - protein, 9 aa, Homo Sapiens
NKTREFLAH

SEQ ID NO: 1333141 - protein, 9 aa, Homo Sapiens
EHLKIFYCC

SEQ ID NO: 1333142 - protein, 9 aa, Homo Sapiens
LLPAADWHY

SEQ ID NO: 1333143 - protein, 9 aa, Homo Sapiens
RTVCMPHQL

SEQ ID NO: 1333144 - protein, 9 aa, Homo Sapiens
VTIILISDV

SEQ ID NO: 1333145 - protein, 9 aa, Homo Sapiens
ECGNVFYVK

SEQ ID NO: 1333146 - protein, 9 aa, Homo Sapiens
IQAASQAGV

SEQ ID NO: 1333147 - protein, 9 aa, Homo Sapiens
PPKDIFDEL

SEQ ID NO: 1333148 - protein, 9 aa, Homo Sapiens
EVDEATNYN

SEQ ID NO: 1333149 - protein, 9 aa, Homo Sapiens
RLSELEQLW

SEQ ID NO: 1333150 - protein, 9 aa, Homo Sapiens
VAQNASLLK

SEQ ID NO: 1333151 - protein, 9 aa, Homo Sapiens
REHVYSHTI

SEQ ID NO: 1333152 - protein, 9 aa, Homo Sapiens
RDNPHSHHI

SEQ ID NO: 1333153 - protein, 9 aa, Homo Sapiens
SSATSAALL

SEQ ID NO: 1333154 - protein, 9 aa, Homo Sapiens
QPTMEEGSG

SEQ ID NO: 1333155 - protein, 9 aa, Homo Sapiens
SHLNGLSIP

SEQ ID NO: 1333156 - protein, 9 aa, Homo Sapiens
EGDGKSNNL

SEQ ID NO: 1333157 - protein, 9 aa, Homo Sapiens
LEMSCNRIA

SEQ ID NO: 1333158 - protein, 9 aa, Homo Sapiens
DSAKRWHPK

SEQ ID NO: 1333159 - protein, 9 aa, Homo Sapiens
RAGYAYRHI

SEQ ID NO: 1333160 - protein, 9 aa, Homo Sapiens
FVRVDLEYV

SEQ ID NO: 1333161 - protein, 9 aa, Homo Sapiens
RLTLLERRR

SEQ ID NO: 1333162 - protein, 9 aa, Homo Sapiens
RSSSLWKAV

SEQ ID NO: 1333163 - protein, 9 aa, Homo Sapiens
HYECEECGK

SEQ ID NO: 1333164 - protein, 9 aa, Homo Sapiens
DGLTVKASE

SEQ ID NO: 1333165 - protein, 9 aa, Homo Sapiens
SNMVSKLLE

SEQ ID NO: 1333166 - protein, 9 aa, Homo Sapiens
HKVVGLLSR

SEQ ID NO: 1333167 - protein, 9 aa, Homo Sapiens
HLVFHSKVR

SEQ ID NO: 1333168 - protein, 9 aa, Homo Sapiens
ELQKGMRTV

SEQ ID NO: 1333169 - protein, 9 aa, Homo Sapiens
TKIHHVDAH

SEQ ID NO: 1333170 - protein, 9 aa, Homo Sapiens
AALPPRPGH

SEQ ID NO: 1333171 - protein, 9 aa, Homo Sapiens
LQSWCPVIK

SEQ ID NO: 1333172 - protein, 9 aa, Homo Sapiens
MSSAHKVSG

SEQ ID NO: 1333173 - protein, 9 aa, Homo Sapiens
KRCNKKQLC

SEQ ID NO: 1333174 - protein, 9 aa, Homo Sapiens
MMTKEDDKH

SEQ ID NO: 1333175 - protein, 9 aa, Homo Sapiens
PHVDGERSF

SEQ ID NO: 1333176 - protein, 9 aa, Homo Sapiens
HSLDIDEEE

SEQ ID NO: 1333177 - protein, 9 aa, Homo Sapiens
LEEFMNKFH

SEQ ID NO: 1333178 - protein, 9 aa, Homo Sapiens
FPESKPILA

SEQ ID NO: 1333179 - protein, 9 aa, Homo Sapiens
RDHFAFGEP

SEQ ID NO: 1333180 - protein, 9 aa, Homo Sapiens
VEVHRLYVG

SEQ ID NO: 1333181 - protein, 9 aa, Homo Sapiens
KCAVEEIRN

SEQ ID NO: 1333182 - protein, 9 aa, Homo Sapiens
RGCTARGSP

SEQ ID NO: 1333183 - protein, 9 aa, Homo Sapiens
LQSSNCVHK

SEQ ID NO: 1333184 - protein, 9 aa, Homo Sapiens
CRLTPSCEI

SEQ ID NO: 1333185 - protein, 9 aa, Homo Sapiens
NHLLGGSGD

SEQ ID NO: 1333186 - protein, 9 aa, Homo Sapiens
TMNNDMTLL

SEQ ID NO: 1333187 - protein, 9 aa, Homo Sapiens
SRKRIARTI

SEQ ID NO: 1333188 - protein, 9 aa, Homo Sapiens
KMKHMRESA

SEQ ID NO: 1333189 - protein, 9 aa, Homo Sapiens
HKMRWLKAE

SEQ ID NO: 1333190 - protein, 9 aa, Homo Sapiens
LLGLEGSVM

SEQ ID NO: 1333191 - protein, 9 aa, Homo Sapiens
NPFYNPGDH

SEQ ID NO: 1333192 - protein, 9 aa, Homo Sapiens
KCQCAKLEA

SEQ ID NO: 1333193 - protein, 9 aa, Homo Sapiens
RYCDAIAEI

SEQ ID NO: 1333194 - protein, 9 aa, Homo Sapiens
HRLQADYAS

SEQ ID NO: 1333195 - protein, 9 aa, Homo Sapiens
FSPEHPVEE

SEQ ID NO: 1333196 - protein, 9 aa, Homo Sapiens
RAHLQDQHM

SEQ ID NO: 1333197 - protein, 9 aa, Homo Sapiens
DKRRKIVVH

SEQ ID NO: 1333198 - protein, 9 aa, Homo Sapiens
VTSLNFFKT

SEQ ID NO: 1333199 - protein, 9 aa, Homo Sapiens
DKKFLEKEV

SEQ ID NO: 1333200 - protein, 9 aa, Homo Sapiens
CCEVSTRFD

SEQ ID NO: 1333201 - protein, 9 aa, Homo Sapiens
GQHDLDLRV

SEQ ID NO: 1333202 - protein, 9 aa, Homo Sapiens
SIRARLVFR

SEQ ID NO: 1333203 - protein, 9 aa, Homo Sapiens
SPQGASPTS

SEQ ID NO: 1333204 - protein, 9 aa, Homo Sapiens
GMGQLLLWA

SEQ ID NO: 1333205 - protein, 9 aa, Homo Sapiens
DEKMGKNSS

SEQ ID NO: 1333206 - protein, 9 aa, Homo Sapiens
RWAEFYHQP

SEQ ID NO: 1333207 - protein, 9 aa, Homo Sapiens
EDEDVSIRC

SEQ ID NO: 1333208 - protein, 9 aa, Homo Sapiens
LPLRSAVDS

SEQ ID NO: 1333209 - protein, 9 aa, Homo Sapiens
KSLVRRSYQ

SEQ ID NO: 1333210 - protein, 9 aa, Homo Sapiens
TSMRGGHLG

SEQ ID NO: 1333211 - protein, 9 aa, Homo Sapiens
IHYREPRRM

SEQ ID NO: 1333212 - protein, 9 aa, Homo Sapiens
LLLKICGVI

SEQ ID NO: 1333213 - protein, 9 aa, Homo Sapiens
IRNMHFLPD

SEQ ID NO: 1333214 - protein, 9 aa, Homo Sapiens
RAIMARRQH

SEQ ID NO: 1333215 - protein, 9 aa, Homo Sapiens
TTAKGDIYA

SEQ ID NO: 1333216 - protein, 9 aa, Homo Sapiens
LDYEEPDYG

SEQ ID NO: 1333217 - protein, 9 aa, Homo Sapiens
GSRTHGRWK

SEQ ID NO: 1333218 - protein, 9 aa, Homo Sapiens
VPPEWRTAL

SEQ ID NO: 1333219 - protein, 9 aa, Homo Sapiens
VQLEERKVI

SEQ ID NO: 1333220 - protein, 9 aa, Homo Sapiens
LHHLGHPEP

SEQ ID NO: 1333221 - protein, 9 aa, Homo Sapiens
ATTAACAPT

SEQ ID NO: 1333222 - protein, 9 aa, Homo Sapiens
YMLKPKYFP

SEQ ID NO: 1333223 - protein, 9 aa, Homo Sapiens
ISGQASGSP

SEQ ID NO: 1333224 - protein, 9 aa, Homo Sapiens
ELQHCIRKR

SEQ ID NO: 1333225 - protein, 9 aa, Homo Sapiens
RANCVIQRR

SEQ ID NO: 1333226 - protein, 9 aa, Homo Sapiens
QEGSPSSDQ

SEQ ID NO: 1333227 - protein, 9 aa, Homo Sapiens
LRDNRPLSP

SEQ ID NO: 1333228 - protein, 9 aa, Homo Sapiens
MKHVHQGVR

SEQ ID NO: 1333229 - protein, 9 aa, Homo Sapiens
SPSTAASVG

SEQ ID NO: 1333230 - protein, 9 aa, Homo Sapiens
SLVEVHRLY

SEQ ID NO: 1333231 - protein, 9 aa, Homo Sapiens
PLEQILPPR

SEQ ID NO: 1333232 - protein, 9 aa, Homo Sapiens
NMCVPHPRG

SEQ ID NO: 1333233 - protein, 9 aa, Homo Sapiens
RMQVFAMAQ

SEQ ID NO: 1333234 - protein, 9 aa, Homo Sapiens
QVQAPVAAV

SEQ ID NO: 1333235 - protein, 9 aa, Homo Sapiens
TLHSALFSR

SEQ ID NO: 1333236 - protein, 9 aa, Homo Sapiens
VYSFVIVIW

SEQ ID NO: 1333237 - protein, 9 aa, Homo Sapiens
PNMAILFHI

SEQ ID NO: 1333238 - protein, 9 aa, Homo Sapiens
PPPLILWPQ

SEQ ID NO: 1333239 - protein, 9 aa, Homo Sapiens
AMLPKITVR

SEQ ID NO: 1333240 - protein, 9 aa, Homo Sapiens
LYTYMLPQS

SEQ ID NO: 1333241 - protein, 9 aa, Homo Sapiens
PDLIQVTTD

SEQ ID NO: 1333242 - protein, 9 aa, Homo Sapiens
CTGPSRVAK

SEQ ID NO: 1333243 - protein, 9 aa, Homo Sapiens
LSGAVDWVM

SEQ ID NO: 1333244 - protein, 9 aa, Homo Sapiens
GCTARGSPW

SEQ ID NO: 1333245 - protein, 9 aa, Homo Sapiens
TAMMSKLRF

SEQ ID NO: 1333246 - protein, 9 aa, Homo Sapiens
LVTVGGHPG

SEQ ID NO: 1333247 - protein, 9 aa, Homo Sapiens
AIPLRKLKM

SEQ ID NO: 1333248 - protein, 9 aa, Homo Sapiens
DIGDHQAGL

SEQ ID NO: 1333249 - protein, 9 aa, Homo Sapiens
KSSVNWMRY

SEQ ID NO: 1333250 - protein, 9 aa, Homo Sapiens
SNIACDGDK

SEQ ID NO: 1333251 - protein, 9 aa, Homo Sapiens
SPSRRRAPP

SEQ ID NO: 1333252 - protein, 9 aa, Homo Sapiens
YTPVVLPHS

SEQ ID NO: 1333253 - protein, 9 aa, Homo Sapiens
LLPPVFIDT

SEQ ID NO: 1333254 - protein, 9 aa, Homo Sapiens
FCLSHPQVQ

SEQ ID NO: 1333255 - protein, 9 aa, Homo Sapiens
LPRLPARDC

SEQ ID NO: 1333256 - protein, 9 aa, Homo Sapiens
PASAKRTKV

SEQ ID NO: 1333257 - protein, 9 aa, Homo Sapiens
INTMILDLC

SEQ ID NO: 1333258 - protein, 9 aa, Homo Sapiens
AAAELDAEL

SEQ ID NO: 1333259 - protein, 9 aa, Homo Sapiens
TLQICCHPG

SEQ ID NO: 1333260 - protein, 9 aa, Homo Sapiens
VEAYNIHTD

SEQ ID NO: 1333261 - protein, 9 aa, Homo Sapiens
PVRHSSSVR

SEQ ID NO: 1333262 - protein, 9 aa, Homo Sapiens
GENDDMPKD

SEQ ID NO: 1333263 - protein, 9 aa, Homo Sapiens
FQVMIMVSG

SEQ ID NO: 1333264 - protein, 9 aa, Homo Sapiens
RGPLGLSGA

SEQ ID NO: 1333265 - protein, 9 aa, Homo Sapiens
EVAPEFLVL

SEQ ID NO: 1333266 - protein, 9 aa, Homo Sapiens
LFQYLMRPK

SEQ ID NO: 1333267 - protein, 9 aa, Homo Sapiens
RINSQLVTQ

SEQ ID NO: 1333268 - protein, 9 aa, Homo Sapiens
PVEPLFVPA

SEQ ID NO: 1333269 - protein, 9 aa, Homo Sapiens
VTVTVMGAR

SEQ ID NO: 1333270 - protein, 9 aa, Homo Sapiens
CMTLAQEPS

SEQ ID NO: 1333271 - protein, 9 aa, Homo Sapiens
IRGMMLYHH

SEQ ID NO: 1333272 - protein, 9 aa, Homo Sapiens
LLSALGELR

SEQ ID NO: 1333273 - protein, 9 aa, Homo Sapiens
SKGCTFVKF

SEQ ID NO: 1333274 - protein, 9 aa, Homo Sapiens
KHIVLEKLS

SEQ ID NO: 1333275 - protein, 9 aa, Homo Sapiens
PVNWCANDT

SEQ ID NO: 1333276 - protein, 9 aa, Homo Sapiens
RQISRSFFL

SEQ ID NO: 1333277 - protein, 9 aa, Homo Sapiens
NMEMKSVNR

SEQ ID NO: 1333278 - protein, 9 aa, Homo Sapiens
ACQAINDGV

SEQ ID NO: 1333279 - protein, 9 aa, Homo Sapiens
FILQWEPYC

SEQ ID NO: 1333280 - protein, 9 aa, Homo Sapiens
GGVNTGVIC

SEQ ID NO: 1333281 - protein, 9 aa, Homo Sapiens
TGYVHWKGQ

SEQ ID NO: 1333282 - protein, 9 aa, Homo Sapiens
ERAAGTGED

SEQ ID NO: 1333283 - protein, 9 aa, Homo Sapiens
PLTGMSPIL

SEQ ID NO: 1333284 - protein, 9 aa, Homo Sapiens
ERKYPEPLC

SEQ ID NO: 1333285 - protein, 9 aa, Homo Sapiens
KHLIYPLLC

SEQ ID NO: 1333286 - protein, 9 aa, Homo Sapiens
FLGCMDSIK

SEQ ID NO: 1333287 - protein, 9 aa, Homo Sapiens
FKLQFKSHI

SEQ ID NO: 1333288 - protein, 9 aa, Homo Sapiens
NRVIIPVKW

SEQ ID NO: 1333289 - protein, 9 aa, Homo Sapiens
FQGKAKHLC

SEQ ID NO: 1333290 - protein, 9 aa, Homo Sapiens
KAVEPTVDL

SEQ ID NO: 1333291 - protein, 9 aa, Homo Sapiens
NKKKCQRRI

SEQ ID NO: 1333292 - protein, 9 aa, Homo Sapiens
YPDSMLGTM

SEQ ID NO: 1333293 - protein, 9 aa, Homo Sapiens
YMCQQLLLA

SEQ ID NO: 1333294 - protein, 9 aa, Homo Sapiens
RYEAIARAK

SEQ ID NO: 1333295 - protein, 9 aa, Homo Sapiens
GSIRQLLHE

SEQ ID NO: 1333296 - protein, 9 aa, Homo Sapiens
DYAHYSGSY

SEQ ID NO: 1333297 - protein, 9 aa, Homo Sapiens
ERASQGEFQ

SEQ ID NO: 1333298 - protein, 9 aa, Homo Sapiens
QVSKRNSFG

SEQ ID NO: 1333299 - protein, 9 aa, Homo Sapiens
TQEEIEDPS

SEQ ID NO: 1333300 - protein, 9 aa, Homo Sapiens
NQEKAITTL

SEQ ID NO: 1333301 - protein, 9 aa, Homo Sapiens
LIRYAVMQI

SEQ ID NO: 1333302 - protein, 9 aa, Homo Sapiens
VVSKANFSI

SEQ ID NO: 1333303 - protein, 9 aa, Homo Sapiens
AALEAIERV

SEQ ID NO: 1333304 - protein, 9 aa, Homo Sapiens
AVWGGHEVK

SEQ ID NO: 1333305 - protein, 9 aa, Homo Sapiens
HHQKTHHLL

SEQ ID NO: 1333306 - protein, 9 aa, Homo Sapiens
SPKPCDKSR

SEQ ID NO: 1333307 - protein, 9 aa, Homo Sapiens
CHYRFKNLL

SEQ ID NO: 1333308 - protein, 9 aa, Homo Sapiens
DFFQEILHL

SEQ ID NO: 1333309 - protein, 9 aa, Homo Sapiens
ASRGTLWRL

SEQ ID NO: 1333310 - protein, 9 aa, Homo Sapiens
FLLLIREID

SEQ ID NO: 1333311 - protein, 9 aa, Homo Sapiens
VCSVVLGPH

SEQ ID NO: 1333312 - protein, 9 aa, Homo Sapiens
LVSPSSAFQ

SEQ ID NO: 1333313 - protein, 9 aa, Homo Sapiens
PHGSVQLSF

SEQ ID NO: 1333314 - protein, 9 aa, Homo Sapiens
CEHIKQFQT

SEQ ID NO: 1333315 - protein, 9 aa, Homo Sapiens
ARLMGRICI

SEQ ID NO: 1333316 - protein, 9 aa, Homo Sapiens
LSEEVCPQD

SEQ ID NO: 1333317 - protein, 9 aa, Homo Sapiens
KYSMVELHD

SEQ ID NO: 1333318 - protein, 9 aa, Homo Sapiens
CLTSPQVYN

SEQ ID NO: 1333319 - protein, 9 aa, Homo Sapiens
YVIYRLYHS

SEQ ID NO: 1333320 - protein, 9 aa, Homo Sapiens
EVNSMGSRS

SEQ ID NO: 1333321 - protein, 9 aa, Homo Sapiens
RGGEFGMST

SEQ ID NO: 1333322 - protein, 9 aa, Homo Sapiens
SLAKQQPII

SEQ ID NO: 1333323 - protein, 9 aa, Homo Sapiens
AARPSPATH

SEQ ID NO: 1333324 - protein, 9 aa, Homo Sapiens
YCRLGEVRI

SEQ ID NO: 1333325 - protein, 9 aa, Homo Sapiens
LASRSQGAT

SEQ ID NO: 1333326 - protein, 9 aa, Homo Sapiens
KISFKYNRP

SEQ ID NO: 1333327 - protein, 9 aa, Homo Sapiens
SSRIFKLAQ

SEQ ID NO: 1333328 - protein, 9 aa, Homo Sapiens
CKKQGAARA

SEQ ID NO: 1333329 - protein, 9 aa, Homo Sapiens
LGPHAGQGV

SEQ ID NO: 1333330 - protein, 9 aa, Homo Sapiens
HILHKTKGK

SEQ ID NO: 1333331 - protein, 9 aa, Homo Sapiens
ELEQLWRTA

SEQ ID NO: 1333332 - protein, 9 aa, Homo Sapiens
FQLVLPGEA

SEQ ID NO: 1333333 - protein, 9 aa, Homo Sapiens
QGPGWEEAS

SEQ ID NO: 1333334 - protein, 9 aa, Homo Sapiens
HWLAQLVKN

SEQ ID NO: 1333335 - protein, 9 aa, Homo Sapiens
YLDNGAKAV

SEQ ID NO: 1333336 - protein, 9 aa, Homo Sapiens
YDRYVVICF

SEQ ID NO: 1333337 - protein, 9 aa, Homo Sapiens
IKGMVTEFK

SEQ ID NO: 1333338 - protein, 9 aa, Homo Sapiens
IALPQTEIS

SEQ ID NO: 1333339 - protein, 9 aa, Homo Sapiens
EELHTHTKE

SEQ ID NO: 1333340 - protein, 9 aa, Homo Sapiens
RDDPADIWP

SEQ ID NO: 1333341 - protein, 9 aa, Homo Sapiens
PWKLDKRTK

SEQ ID NO: 1333342 - protein, 9 aa, Homo Sapiens
FLAKTYSTK

SEQ ID NO: 1333343 - protein, 9 aa, Homo Sapiens
LNNNNISHI

SEQ ID NO: 1333344 - protein, 9 aa, Homo Sapiens
PGPAPRRSL

SEQ ID NO: 1333345 - protein, 9 aa, Homo Sapiens
LTNESSREE

SEQ ID NO: 1333346 - protein, 9 aa, Homo Sapiens
DLPIKLARY

SEQ ID NO: 1333347 - protein, 9 aa, Homo Sapiens
TLVGDSVIL

SEQ ID NO: 1333348 - protein, 9 aa, Homo Sapiens
HLTPSLDVT

SEQ ID NO: 1333349 - protein, 9 aa, Homo Sapiens
KNEDNVKSV

SEQ ID NO: 1333350 - protein, 9 aa, Homo Sapiens
KKQDHTYCV

SEQ ID NO: 1333351 - protein, 9 aa, Homo Sapiens
EMDIEYIQS

SEQ ID NO: 1333352 - protein, 9 aa, Homo Sapiens
TPLLSMTPI

SEQ ID NO: 1333353 - protein, 9 aa, Homo Sapiens
ARAVPAFLK

SEQ ID NO: 1333354 - protein, 9 aa, Homo Sapiens
GKLALIDKL

SEQ ID NO: 1333355 - protein, 9 aa, Homo Sapiens
SPWQGSKPR

SEQ ID NO: 1333356 - protein, 9 aa, Homo Sapiens
ERSFRGSGP

SEQ ID NO: 1333357 - protein, 9 aa, Homo Sapiens
KPRCSLIIL

SEQ ID NO: 1333358 - protein, 9 aa, Homo Sapiens
HCIICNHCA

SEQ ID NO: 1333359 - protein, 9 aa, Homo Sapiens
KDRTVAANT

SEQ ID NO: 1333360 - protein, 9 aa, Homo Sapiens
FADSKFQEC

SEQ ID NO: 1333361 - protein, 9 aa, Homo Sapiens
SMLAPGGTC

SEQ ID NO: 1333362 - protein, 9 aa, Homo Sapiens
IDLQKNKLK

SEQ ID NO: 1333363 - protein, 9 aa, Homo Sapiens
IYGEWIPRL

SEQ ID NO: 1333364 - protein, 9 aa, Homo Sapiens
YLNSFQTHE

SEQ ID NO: 1333365 - protein, 9 aa, Homo Sapiens
LLPTGTYKV

SEQ ID NO: 1333366 - protein, 9 aa, Homo Sapiens
VSHAVGVLR

SEQ ID NO: 1333367 - protein, 9 aa, Homo Sapiens
TSIAENMEG

SEQ ID NO: 1333368 - protein, 9 aa, Homo Sapiens
AASAGRPSA

SEQ ID NO: 1333369 - protein, 9 aa, Homo Sapiens
AVLHGAVFA

SEQ ID NO: 1333370 - protein, 9 aa, Homo Sapiens
HIHYREPRR

SEQ ID NO: 1333371 - protein, 9 aa, Homo Sapiens
KYKCVFSVG

SEQ ID NO: 1333372 - protein, 9 aa, Homo Sapiens
TESCGDGTV

SEQ ID NO: 1333373 - protein, 9 aa, Homo Sapiens
MIYDDQGDM

SEQ ID NO: 1333374 - protein, 9 aa, Homo Sapiens
VVRAHLQDQ

SEQ ID NO: 1333375 - protein, 9 aa, Homo Sapiens
YRTASIIIA

SEQ ID NO: 1333376 - protein, 9 aa, Homo Sapiens
NPERFDNQP

SEQ ID NO: 1333377 - protein, 9 aa, Homo Sapiens
DAFITFANL

SEQ ID NO: 1333378 - protein, 9 aa, Homo Sapiens
LGHFTSDMS

SEQ ID NO: 1333379 - protein, 9 aa, Homo Sapiens
ISQQTVPGH

SEQ ID NO: 1333380 - protein, 9 aa, Homo Sapiens
GDDCGHIIS

SEQ ID NO: 1333381 - protein, 9 aa, Homo Sapiens
QQQQALQAT

SEQ ID NO: 1333382 - protein, 9 aa, Homo Sapiens
QAVADRMQR

SEQ ID NO: 1333383 - protein, 9 aa, Homo Sapiens
FSNHTGYVH

SEQ ID NO: 1333384 - protein, 9 aa, Homo Sapiens
KLDKKEKKN

SEQ ID NO: 1333385 - protein, 9 aa, Homo Sapiens
DLTLHNRST

SEQ ID NO: 1333386 - protein, 9 aa, Homo Sapiens
IQQPRVPLV

SEQ ID NO: 1333387 - protein, 9 aa, Homo Sapiens
VSCTNKNLF

SEQ ID NO: 1333388 - protein, 9 aa, Homo Sapiens
NCRCLDGRR

SEQ ID NO: 1333389 - protein, 9 aa, Homo Sapiens
SEAPHVDGE

SEQ ID NO: 1333390 - protein, 9 aa, Homo Sapiens
AIFQIAANL

SEQ ID NO: 1333391 - protein, 9 aa, Homo Sapiens
FKATRQNIS

SEQ ID NO: 1333392 - protein, 9 aa, Homo Sapiens
ENVTLYQQL

SEQ ID NO: 1333393 - protein, 9 aa, Homo Sapiens
SFPPHLNHP

SEQ ID NO: 1333394 - protein, 9 aa, Homo Sapiens
GIGLCGAIR

SEQ ID NO: 1333395 - protein, 9 aa, Homo Sapiens
SVPQIGVVN

SEQ ID NO: 1333396 - protein, 9 aa, Homo Sapiens
ISIKEERTL

SEQ ID NO: 1333397 - protein, 9 aa, Homo Sapiens
RDQEMLLMY

SEQ ID NO: 1333398 - protein, 9 aa, Homo Sapiens
RHLRDLLEE

SEQ ID NO: 1333399 - protein, 9 aa, Homo Sapiens
VSSITNPIK

SEQ ID NO: 1333400 - protein, 9 aa, Homo Sapiens
DSIKENKCL

SEQ ID NO: 1333401 - protein, 9 aa, Homo Sapiens
YQEGTKMAV

SEQ ID NO: 1333402 - protein, 9 aa, Homo Sapiens
LRTLEQCHY

SEQ ID NO: 1333403 - protein, 9 aa, Homo Sapiens
PGTFNNLFN

SEQ ID NO: 1333404 - protein, 9 aa, Homo Sapiens
LTGHNLFFK

SEQ ID NO: 1333405 - protein, 9 aa, Homo Sapiens
AFVYLYKLK

SEQ ID NO: 1333406 - protein, 9 aa, Homo Sapiens
VANTMSTHL

SEQ ID NO: 1333407 - protein, 9 aa, Homo Sapiens
ECTIVTLVY

SEQ ID NO: 1333408 - protein, 9 aa, Homo Sapiens
IESYDYTTD

SEQ ID NO: 1333409 - protein, 9 aa, Homo Sapiens
PFLLFFPSC

SEQ ID NO: 1333410 - protein, 9 aa, Homo Sapiens
VAIFVQGPA

SEQ ID NO: 1333411 - protein, 9 aa, Homo Sapiens
MVMPGGCIT

SEQ ID NO: 1333412 - protein, 9 aa, Homo Sapiens
EEYKNVGSK

SEQ ID NO: 1333413 - protein, 9 aa, Homo Sapiens
CSHCVLLLL

SEQ ID NO: 1333414 - protein, 9 aa, Homo Sapiens
MDSWNRKLL

SEQ ID NO: 1333415 - protein, 9 aa, Homo Sapiens
HCYKSHIQV

SEQ ID NO: 1333416 - protein, 9 aa, Homo Sapiens
IATPSMVAM

SEQ ID NO: 1333417 - protein, 9 aa, Homo Sapiens
PGGETKCAP

SEQ ID NO: 1333418 - protein, 9 aa, Homo Sapiens
NNNNISHIL

SEQ ID NO: 1333419 - protein, 9 aa, Homo Sapiens
SWEHQSVSL

SEQ ID NO: 1333420 - protein, 9 aa, Homo Sapiens
AHSSYLASE

SEQ ID NO: 1333421 - protein, 9 aa, Homo Sapiens
LSLQGWRRR

SEQ ID NO: 1333422 - protein, 9 aa, Homo Sapiens
RYHITFGPV

SEQ ID NO: 1333423 - protein, 9 aa, Homo Sapiens
TLSPGWSAV

SEQ ID NO: 1333424 - protein, 9 aa, Homo Sapiens
INEYRSHQA

SEQ ID NO: 1333425 - protein, 9 aa, Homo Sapiens
RKHLGTGLS

SEQ ID NO: 1333426 - protein, 9 aa, Homo Sapiens
ELGGFHKPN

SEQ ID NO: 1333427 - protein, 9 aa, Homo Sapiens
YISNTNQAD

SEQ ID NO: 1333428 - protein, 9 aa, Homo Sapiens
PRDDEGWPL

SEQ ID NO: 1333429 - protein, 9 aa, Homo Sapiens
PSLVKTCDS

SEQ ID NO: 1333430 - protein, 9 aa, Homo Sapiens
LCIPHPEVP

SEQ ID NO: 1333431 - protein, 9 aa, Homo Sapiens
DQTMDLSIR

SEQ ID NO: 1333432 - protein, 9 aa, Homo Sapiens
FNLMFGAST

SEQ ID NO: 1333433 - protein, 9 aa, Homo Sapiens
YLIGMLAYL

SEQ ID NO: 1333434 - protein, 9 aa, Homo Sapiens
LIPAEIMDH

SEQ ID NO: 1333435 - protein, 9 aa, Homo Sapiens
LPGIETLEE

SEQ ID NO: 1333436 - protein, 9 aa, Homo Sapiens
SLEAAHHHE

SEQ ID NO: 1333437 - protein, 9 aa, Homo Sapiens
DHIERYEFP

SEQ ID NO: 1333438 - protein, 9 aa, Homo Sapiens
KGLSEDFHV

SEQ ID NO: 1333439 - protein, 9 aa, Homo Sapiens
REEAKIVME

SEQ ID NO: 1333440 - protein, 9 aa, Homo Sapiens
RAVKMVTCF

SEQ ID NO: 1333441 - protein, 9 aa, Homo Sapiens
AAPADRKCQ

SEQ ID NO: 1333442 - protein, 9 aa, Homo Sapiens
TPCPLPCSP

SEQ ID NO: 1333443 - protein, 9 aa, Homo Sapiens
SGFIKKTFD

SEQ ID NO: 1333444 - protein, 9 aa, Homo Sapiens
ERHGESQYV

SEQ ID NO: 1333445 - protein, 9 aa, Homo Sapiens
VPRELPTCS

SEQ ID NO: 1333446 - protein, 9 aa, Homo Sapiens
LSNPEEVKR

SEQ ID NO: 1333447 - protein, 9 aa, Homo Sapiens
GCHVNIIPN

SEQ ID NO: 1333448 - protein, 9 aa, Homo Sapiens
MRHVKEMDA

SEQ ID NO: 1333449 - protein, 9 aa, Homo Sapiens
VLYLMFDTS

SEQ ID NO: 1333450 - protein, 9 aa, Homo Sapiens
SRGDQVAHI

SEQ ID NO: 1333451 - protein, 9 aa, Homo Sapiens
AALAETLKE

SEQ ID NO: 1333452 - protein, 9 aa, Homo Sapiens
KVRVVFAEL

SEQ ID NO: 1333453 - protein, 9 aa, Homo Sapiens
HRECQQSHY

SEQ ID NO: 1333454 - protein, 9 aa, Homo Sapiens
GPHLFISQV

SEQ ID NO: 1333455 - protein, 9 aa, Homo Sapiens
VDEAKQRGL

SEQ ID NO: 1333456 - protein, 9 aa, Homo Sapiens
AEQYLVQTL

SEQ ID NO: 1333457 - protein, 9 aa, Homo Sapiens
FPVRSEKQK

SEQ ID NO: 1333458 - protein, 9 aa, Homo Sapiens
NKGFKDTNQ

SEQ ID NO: 1333459 - protein, 9 aa, Homo Sapiens
ALPDDVETE

SEQ ID NO: 1333460 - protein, 9 aa, Homo Sapiens
LLTQLWATV

SEQ ID NO: 1333461 - protein, 9 aa, Homo Sapiens
IAFIMDGNC

SEQ ID NO: 1333462 - protein, 9 aa, Homo Sapiens
HRHQGVQVP

SEQ ID NO: 1333463 - protein, 9 aa, Homo Sapiens
NDTNLCDAN

SEQ ID NO: 1333464 - protein, 9 aa, Homo Sapiens
VLFGGCSYM

SEQ ID NO: 1333465 - protein, 9 aa, Homo Sapiens
GPRGLMPLR

SEQ ID NO: 1333466 - protein, 9 aa, Homo Sapiens
TYSTKDQQF

SEQ ID NO: 1333467 - protein, 9 aa, Homo Sapiens
RELERNYYR

SEQ ID NO: 1333468 - protein, 9 aa, Homo Sapiens
LMLWPALDP

SEQ ID NO: 1333469 - protein, 9 aa, Homo Sapiens
CATILDIIK

SEQ ID NO: 1333470 - protein, 9 aa, Homo Sapiens
MMVLQGGPR

SEQ ID NO: 1333471 - protein, 9 aa, Homo Sapiens
DISETFNHV

SEQ ID NO: 1333472 - protein, 9 aa, Homo Sapiens
ASLGRGRGR

SEQ ID NO: 1333473 - protein, 9 aa, Homo Sapiens
VGVSGALPP

SEQ ID NO: 1333474 - protein, 9 aa, Homo Sapiens
RPHRCELAA

SEQ ID NO: 1333475 - protein, 9 aa, Homo Sapiens
EKRHRTWSK

SEQ ID NO: 1333476 - protein, 9 aa, Homo Sapiens
FDVSVERVQ

SEQ ID NO: 1333477 - protein, 9 aa, Homo Sapiens
SPCWQAVWP

SEQ ID NO: 1333478 - protein, 9 aa, Homo Sapiens
QCCMQNTKT

SEQ ID NO: 1333479 - protein, 9 aa, Homo Sapiens
SVQEEDRRK

SEQ ID NO: 1333480 - protein, 9 aa, Homo Sapiens
NQFMTVYKL

SEQ ID NO: 1333481 - protein, 9 aa, Homo Sapiens
SGDNRKMVC

SEQ ID NO: 1333482 - protein, 9 aa, Homo Sapiens
EWCSIDGSI

SEQ ID NO: 1333483 - protein, 9 aa, Homo Sapiens
REEIMKQIQ

SEQ ID NO: 1333484 - protein, 9 aa, Homo Sapiens
KYRMRKKFP

SEQ ID NO: 1333485 - protein, 9 aa, Homo Sapiens
KSHFYLVTP

SEQ ID NO: 1333486 - protein, 9 aa, Homo Sapiens
KCGCENVQL

SEQ ID NO: 1333487 - protein, 9 aa, Homo Sapiens
ELVLPDEVI

SEQ ID NO: 1333488 - protein, 9 aa, Homo Sapiens
QYLCTPQEV

SEQ ID NO: 1333489 - protein, 9 aa, Homo Sapiens
GLDDQLCAN

SEQ ID NO: 1333490 - protein, 9 aa, Homo Sapiens
LGTKLGFVS

SEQ ID NO: 1333491 - protein, 9 aa, Homo Sapiens
EKTLRSFRE

SEQ ID NO: 1333492 - protein, 9 aa, Homo Sapiens
ARESKNTQD

SEQ ID NO: 1333493 - protein, 9 aa, Homo Sapiens
GDGNCLMYA

SEQ ID NO: 1333494 - protein, 9 aa, Homo Sapiens
HTSTLVAQS

SEQ ID NO: 1333495 - protein, 9 aa, Homo Sapiens
THLTGIHAV

SEQ ID NO: 1333496 - protein, 9 aa, Homo Sapiens
VLYNKFIIL

SEQ ID NO: 1333497 - protein, 9 aa, Homo Sapiens
ELHKRVQGM

SEQ ID NO: 1333498 - protein, 9 aa, Homo Sapiens
AVKTAVMSL

SEQ ID NO: 1333499 - protein, 9 aa, Homo Sapiens
NVFKRHSMW

SEQ ID NO: 1333500 - protein, 9 aa, Homo Sapiens
RRSSKSPKP

SEQ ID NO: 1333501 - protein, 9 aa, Homo Sapiens
PRSMPLEEN

SEQ ID NO: 1333502 - protein, 9 aa, Homo Sapiens
RGEIQDAFD

SEQ ID NO: 1333503 - protein, 9 aa, Homo Sapiens
GRVAFKLHI

SEQ ID NO: 1333504 - protein, 9 aa, Homo Sapiens
GGGGRDVPE

SEQ ID NO: 1333505 - protein, 9 aa, Homo Sapiens
AAKPSAPTP

SEQ ID NO: 1333506 - protein, 9 aa, Homo Sapiens
LVTSYLCSD

SEQ ID NO: 1333507 - protein, 9 aa, Homo Sapiens
KMCKAVAEE

SEQ ID NO: 1333508 - protein, 9 aa, Homo Sapiens
TTKTTDDET

SEQ ID NO: 1333509 - protein, 9 aa, Homo Sapiens
IECLPLEGN

SEQ ID NO: 1333510 - protein, 9 aa, Homo Sapiens
PLGIVRSRG

SEQ ID NO: 1333511 - protein, 9 aa, Homo Sapiens
SGAGKTEVS

SEQ ID NO: 1333512 - protein, 9 aa, Homo Sapiens
VLHKLTVNG

SEQ ID NO: 1333513 - protein, 9 aa, Homo Sapiens
TEALRCHLR

SEQ ID NO: 1333514 - protein, 9 aa, Homo Sapiens
GKSFSWCSR

SEQ ID NO: 1333515 - protein, 9 aa, Homo Sapiens
PDSTATERV

SEQ ID NO: 1333516 - protein, 9 aa, Homo Sapiens
DQWAIRAYS

SEQ ID NO: 1333517 - protein, 9 aa, Homo Sapiens
VQEAEAQSE

SEQ ID NO: 1333518 - protein, 9 aa, Homo Sapiens
QEILPVFIN

SEQ ID NO: 1333519 - protein, 9 aa, Homo Sapiens
IATLESAKG

SEQ ID NO: 1333520 - protein, 9 aa, Homo Sapiens
RGRLRAQGL

SEQ ID NO: 1333521 - protein, 9 aa, Homo Sapiens
FEILSHLLS

SEQ ID NO: 1333522 - protein, 9 aa, Homo Sapiens
PPLNICVVD

SEQ ID NO: 1333523 - protein, 9 aa, Homo Sapiens
EEGSRQLGE

SEQ ID NO: 1333524 - protein, 9 aa, Homo Sapiens
PEHFWMPIS

SEQ ID NO: 1333525 - protein, 9 aa, Homo Sapiens
DVLGTEAYT

SEQ ID NO: 1333526 - protein, 9 aa, Homo Sapiens
HTKIHHVDA

SEQ ID NO: 1333527 - protein, 9 aa, Homo Sapiens
QPYTECVEH

SEQ ID NO: 1333528 - protein, 9 aa, Homo Sapiens
HYRFKNLLR

SEQ ID NO: 1333529 - protein, 9 aa, Homo Sapiens
TRTREASDN

SEQ ID NO: 1333530 - protein, 9 aa, Homo Sapiens
ATNLQEDVE

SEQ ID NO: 1333531 - protein, 9 aa, Homo Sapiens
TPRTCPTTW

SEQ ID NO: 1333532 - protein, 9 aa, Homo Sapiens
PEFRAPKTD

SEQ ID NO: 1333533 - protein, 9 aa, Homo Sapiens
FCLENMAQK

SEQ ID NO: 1333534 - protein, 9 aa, Homo Sapiens
KARGKSVRL

SEQ ID NO: 1333535 - protein, 9 aa, Homo Sapiens
KHCVDKFDI

SEQ ID NO: 1333536 - protein, 9 aa, Homo Sapiens
RCCHIRFTW

SEQ ID NO: 1333537 - protein, 9 aa, Homo Sapiens
YTANLVAFM

SEQ ID NO: 1333538 - protein, 9 aa, Homo Sapiens
NLLLAAEHI

SEQ ID NO: 1333539 - protein, 9 aa, Homo Sapiens
SDMDYIQID

SEQ ID NO: 1333540 - protein, 9 aa, Homo Sapiens
SSVPGVDPV

SEQ ID NO: 1333541 - protein, 9 aa, Homo Sapiens
LVNTGCDQE

SEQ ID NO: 1333542 - protein, 9 aa, Homo Sapiens
RQLPGPHDD

SEQ ID NO: 1333543 - protein, 9 aa, Homo Sapiens
RSTAGTSRS

SEQ ID NO: 1333544 - protein, 9 aa, Homo Sapiens
YERLVLSYV

SEQ ID NO: 1333545 - protein, 9 aa, Homo Sapiens
KEPEEVTTC

SEQ ID NO: 1333546 - protein, 9 aa, Homo Sapiens
PQVQDLPLD

SEQ ID NO: 1333547 - protein, 9 aa, Homo Sapiens
AFPQAQAAL

SEQ ID NO: 1333548 - protein, 9 aa, Homo Sapiens
TTMAGHHRV

SEQ ID NO: 1333549 - protein, 9 aa, Homo Sapiens
PRQNQVPRL

SEQ ID NO: 1333550 - protein, 9 aa, Homo Sapiens
LASLLTWLA

SEQ ID NO: 1333551 - protein, 9 aa, Homo Sapiens
IPGCIVMTD

SEQ ID NO: 1333552 - protein, 9 aa, Homo Sapiens
SKPTPMMET

SEQ ID NO: 1333553 - protein, 9 aa, Homo Sapiens
QEGDSHRNI

SEQ ID NO: 1333554 - protein, 9 aa, Homo Sapiens
SNNDGVDEG

SEQ ID NO: 1333555 - protein, 9 aa, Homo Sapiens
QELVKHADV

SEQ ID NO: 1333556 - protein, 9 aa, Homo Sapiens
HTSVRKCVM

SEQ ID NO: 1333557 - protein, 9 aa, Homo Sapiens
VPENPILSE

SEQ ID NO: 1333558 - protein, 9 aa, Homo Sapiens
VSCRLEKQS

SEQ ID NO: 1333559 - protein, 9 aa, Homo Sapiens
CDKASAKVL

SEQ ID NO: 1333560 - protein, 9 aa, Homo Sapiens
SAYYRGTVG

SEQ ID NO: 1333561 - protein, 9 aa, Homo Sapiens
RSLPAGPSA

SEQ ID NO: 1333562 - protein, 9 aa, Homo Sapiens
EEAEPIMFP

SEQ ID NO: 1333563 - protein, 9 aa, Homo Sapiens
SLPGTIAPL

SEQ ID NO: 1333564 - protein, 9 aa, Homo Sapiens
FTFYIIMKL

SEQ ID NO: 1333565 - protein, 9 aa, Homo Sapiens
AQRACCKSV

SEQ ID NO: 1333566 - protein, 9 aa, Homo Sapiens
DTSVAKIMS

SEQ ID NO: 1333567 - protein, 9 aa, Homo Sapiens
PAAPADRKC

SEQ ID NO: 1333568 - protein, 9 aa, Homo Sapiens
RTFRRRLNL

SEQ ID NO: 1333569 - protein, 9 aa, Homo Sapiens
LYSGQNSSS

SEQ ID NO: 1333570 - protein, 9 aa, Homo Sapiens
YGMASPGLT

SEQ ID NO: 1333571 - protein, 9 aa, Homo Sapiens
DPNGPTHVP

SEQ ID NO: 1333572 - protein, 9 aa, Homo Sapiens
EETQGLPSS

SEQ ID NO: 1333573 - protein, 9 aa, Homo Sapiens
YSMSSAHKV

SEQ ID NO: 1333574 - protein, 9 aa, Homo Sapiens
VVILEKMRT

SEQ ID NO: 1333575 - protein, 9 aa, Homo Sapiens
LLSPKGERH

SEQ ID NO: 1333576 - protein, 9 aa, Homo Sapiens
KKCSKGNGF

SEQ ID NO: 1333577 - protein, 9 aa, Homo Sapiens
KQGCNKRTA

SEQ ID NO: 1333578 - protein, 9 aa, Homo Sapiens
CRFRIYSNH

SEQ ID NO: 1333579 - protein, 9 aa, Homo Sapiens
VCEKPGKKS

SEQ ID NO: 1333580 - protein, 9 aa, Homo Sapiens
TACRPSVYT

SEQ ID NO: 1333581 - protein, 9 aa, Homo Sapiens
QVVRAHLQD

SEQ ID NO: 1333582 - protein, 9 aa, Homo Sapiens
QQLTGAGIY

SEQ ID NO: 1333583 - protein, 9 aa, Homo Sapiens
SRDLAFLRA

SEQ ID NO: 1333584 - protein, 9 aa, Homo Sapiens
LCKRLYRIG

SEQ ID NO: 1333585 - protein, 9 aa, Homo Sapiens
MPLEENVVD

SEQ ID NO: 1333586 - protein, 9 aa, Homo Sapiens
ERKEENTRQ

SEQ ID NO: 1333587 - protein, 9 aa, Homo Sapiens
GLPSGTEIS

SEQ ID NO: 1333588 - protein, 9 aa, Homo Sapiens
AIAAPILHI

SEQ ID NO: 1333589 - protein, 9 aa, Homo Sapiens
YLQLKEICI

SEQ ID NO: 1333590 - protein, 9 aa, Homo Sapiens
MSLQGMPGR

SEQ ID NO: 1333591 - protein, 9 aa, Homo Sapiens
LLFLEEIIG

SEQ ID NO: 1333592 - protein, 9 aa, Homo Sapiens
TCCPFVQEN

SEQ ID NO: 1333593 - protein, 9 aa, Homo Sapiens
QLIQANTPA

SEQ ID NO: 1333594 - protein, 9 aa, Homo Sapiens
QPLRKPDIG

SEQ ID NO: 1333595 - protein, 9 aa, Homo Sapiens
SDPSTEFDK

SEQ ID NO: 1333596 - protein, 9 aa, Homo Sapiens
NPEEERWAE

SEQ ID NO: 1333597 - protein, 9 aa, Homo Sapiens
PPGTVTTLT

SEQ ID NO: 1333598 - protein, 9 aa, Homo Sapiens
KVAATAGGQ

SEQ ID NO: 1333599 - protein, 9 aa, Homo Sapiens
THCLCTVEN

SEQ ID NO: 1333600 - protein, 9 aa, Homo Sapiens
QNYITFNPT

SEQ ID NO: 1333601 - protein, 9 aa, Homo Sapiens
QCRTYFTPH

SEQ ID NO: 1333602 - protein, 9 aa, Homo Sapiens
LDHFWLETL

SEQ ID NO: 1333603 - protein, 9 aa, Homo Sapiens
IAGPVTMTS

SEQ ID NO: 1333604 - protein, 9 aa, Homo Sapiens
SIIRSCMVL

SEQ ID NO: 1333605 - protein, 9 aa, Homo Sapiens
DEGALVTTA

SEQ ID NO: 1333606 - protein, 9 aa, Homo Sapiens
YLKNKMSSE

SEQ ID NO: 1333607 - protein, 9 aa, Homo Sapiens
YKLKELWLR

SEQ ID NO: 1333608 - protein, 9 aa, Homo Sapiens
LGLDWQCRC

SEQ ID NO: 1333609 - protein, 9 aa, Homo Sapiens
ILTLQEEEL

SEQ ID NO: 1333610 - protein, 9 aa, Homo Sapiens
LHLSIQTDS

SEQ ID NO: 1333611 - protein, 9 aa, Homo Sapiens
TAAPHRKRK

SEQ ID NO: 1333612 - protein, 9 aa, Homo Sapiens
ELESVDKSV

SEQ ID NO: 1333613 - protein, 9 aa, Homo Sapiens
LTSLLPIIS

SEQ ID NO: 1333614 - protein, 9 aa, Homo Sapiens
RSWATPRRS

SEQ ID NO: 1333615 - protein, 9 aa, Homo Sapiens
WSEERCAVH

SEQ ID NO: 1333616 - protein, 9 aa, Homo Sapiens
KYVSITQFV

SEQ ID NO: 1333617 - protein, 9 aa, Homo Sapiens
ELDADSYDP

SEQ ID NO: 1333618 - protein, 9 aa, Homo Sapiens
GAINFQRDV

SEQ ID NO: 1333619 - protein, 9 aa, Homo Sapiens
TGLPWLLAS

SEQ ID NO: 1333620 - protein, 9 aa, Homo Sapiens
DMSGYTIYN

SEQ ID NO: 1333621 - protein, 9 aa, Homo Sapiens
SNDFSNNDG

SEQ ID NO: 1333622 - protein, 9 aa, Homo Sapiens
VASMRKFSL

SEQ ID NO: 1333623 - protein, 9 aa, Homo Sapiens
QEYIEKSFL

SEQ ID NO: 1333624 - protein, 9 aa, Homo Sapiens
SLGEYLKGR

SEQ ID NO: 1333625 - protein, 9 aa, Homo Sapiens
CSTAPFNGI

SEQ ID NO: 1333626 - protein, 9 aa, Homo Sapiens
QDSTYGDEE

SEQ ID NO: 1333627 - protein, 9 aa, Homo Sapiens
LQDSDSDQP

SEQ ID NO: 1333628 - protein, 9 aa, Homo Sapiens
NPMANYSLI

SEQ ID NO: 1333629 - protein, 9 aa, Homo Sapiens
IVGINCYHD

SEQ ID NO: 1333630 - protein, 9 aa, Homo Sapiens
GEEVRPNSW

SEQ ID NO: 1333631 - protein, 9 aa, Homo Sapiens
KAQVKTETV

SEQ ID NO: 1333632 - protein, 9 aa, Homo Sapiens
REDIMEISV

SEQ ID NO: 1333633 - protein, 9 aa, Homo Sapiens
FFKTIAEVR

SEQ ID NO: 1333634 - protein, 9 aa, Homo Sapiens
TPRPERPES

SEQ ID NO: 1333635 - protein, 9 aa, Homo Sapiens
EYMENEDLN

SEQ ID NO: 1333636 - protein, 9 aa, Homo Sapiens
IPGENGKIT

SEQ ID NO: 1333637 - protein, 9 aa, Homo Sapiens
ANQRIADNT

SEQ ID NO: 1333638 - protein, 9 aa, Homo Sapiens
SVFDIDEDE

SEQ ID NO: 1333639 - protein, 9 aa, Homo Sapiens
EREECRAEE

SEQ ID NO: 1333640 - protein, 9 aa, Homo Sapiens
DNCDLREDT

SEQ ID NO: 1333641 - protein, 9 aa, Homo Sapiens
SPNSVHGSC

SEQ ID NO: 1333642 - protein, 9 aa, Homo Sapiens
LQGSVTVIC

SEQ ID NO: 1333643 - protein, 9 aa, Homo Sapiens
VDVVEIKIP

SEQ ID NO: 1333644 - protein, 9 aa, Homo Sapiens
IIGVNVAFQ

SEQ ID NO: 1333645 - protein, 9 aa, Homo Sapiens
SSAEQLRLP

SEQ ID NO: 1333646 - protein, 9 aa, Homo Sapiens
SLSLYPTDN

SEQ ID NO: 1333647 - protein, 9 aa, Homo Sapiens
LGAVCAWES

SEQ ID NO: 1333648 - protein, 9 aa, Homo Sapiens
RAGSTFLNP

SEQ ID NO: 1333649 - protein, 9 aa, Homo Sapiens
NQFAGKAPS

SEQ ID NO: 1333650 - protein, 9 aa, Homo Sapiens
ICLLTILMV

SEQ ID NO: 1333651 - protein, 9 aa, Homo Sapiens
HRSIKKLRF

SEQ ID NO: 1333652 - protein, 9 aa, Homo Sapiens
DNPHSHHIQ

SEQ ID NO: 1333653 - protein, 9 aa, Homo Sapiens
ETMFHCQFS

SEQ ID NO: 1333654 - protein, 9 aa, Homo Sapiens
LDVDHISSR

SEQ ID NO: 1333655 - protein, 9 aa, Homo Sapiens
ASLVEYVVV

SEQ ID NO: 1333656 - protein, 9 aa, Homo Sapiens
MLHLYPGPM

SEQ ID NO: 1333657 - protein, 9 aa, Homo Sapiens
PSLVRETSH

SEQ ID NO: 1333658 - protein, 9 aa, Homo Sapiens
VMPMLNPLI

SEQ ID NO: 1333659 - protein, 9 aa, Homo Sapiens
SQLVEIVGC

SEQ ID NO: 1333660 - protein, 9 aa, Homo Sapiens
MSEEPWSAQ

SEQ ID NO: 1333661 - protein, 9 aa, Homo Sapiens
GSSGAMGPP

SEQ ID NO: 1333662 - protein, 9 aa, Homo Sapiens
IMSDRNLPF

SEQ ID NO: 1333663 - protein, 9 aa, Homo Sapiens
FFSYFRSWD

SEQ ID NO: 1333664 - protein, 9 aa, Homo Sapiens
QDGDAAMYG

SEQ ID NO: 1333665 - protein, 9 aa, Homo Sapiens
SHITPTTGV

SEQ ID NO: 1333666 - protein, 9 aa, Homo Sapiens
ASQLPHIFT

SEQ ID NO: 1333667 - protein, 9 aa, Homo Sapiens
RAKQEELEV

SEQ ID NO: 1333668 - protein, 9 aa, Homo Sapiens
CTYILHSSP

SEQ ID NO: 1333669 - protein, 9 aa, Homo Sapiens
TIHYPALDD

SEQ ID NO: 1333670 - protein, 9 aa, Homo Sapiens
GGEEVRPNS

SEQ ID NO: 1333671 - protein, 9 aa, Homo Sapiens
EENTRQKTR

SEQ ID NO: 1333672 - protein, 9 aa, Homo Sapiens
DVKMPFVVE

SEQ ID NO: 1333673 - protein, 9 aa, Homo Sapiens
QLTSTIMRD

SEQ ID NO: 1333674 - protein, 9 aa, Homo Sapiens
RQGQSTILP

SEQ ID NO: 1333675 - protein, 9 aa, Homo Sapiens
DPAKMRRRS

SEQ ID NO: 1333676 - protein, 9 aa, Homo Sapiens
VNADFFKHL

SEQ ID NO: 1333677 - protein, 9 aa, Homo Sapiens
ETPLIIAGN

SEQ ID NO: 1333678 - protein, 9 aa, Homo Sapiens
KSHIYFFRA

SEQ ID NO: 1333679 - protein, 9 aa, Homo Sapiens
NFVLYNKSH

SEQ ID NO: 1333680 - protein, 9 aa, Homo Sapiens
QSKNLYKIS

SEQ ID NO: 1333681 - protein, 9 aa, Homo Sapiens
EVEVTPPKA

SEQ ID NO: 1333682 - protein, 9 aa, Homo Sapiens
GKQDITLLA

SEQ ID NO: 1333683 - protein, 9 aa, Homo Sapiens
AKNGYRLMN

SEQ ID NO: 1333684 - protein, 9 aa, Homo Sapiens
LHSMLMEQD

SEQ ID NO: 1333685 - protein, 9 aa, Homo Sapiens
ISRKQFEEM

SEQ ID NO: 1333686 - protein, 9 aa, Homo Sapiens
GSGQHSQTS

SEQ ID NO: 1333687 - protein, 9 aa, Homo Sapiens
VVVVHELGV

SEQ ID NO: 1333688 - protein, 9 aa, Homo Sapiens
GVKTQKKEG

SEQ ID NO: 1333689 - protein, 9 aa, Homo Sapiens
DTKIFYNIT

SEQ ID NO: 1333690 - protein, 9 aa, Homo Sapiens
VLSQEGKST

SEQ ID NO: 1333691 - protein, 9 aa, Homo Sapiens
VFRQRQPGC

SEQ ID NO: 1333692 - protein, 9 aa, Homo Sapiens
ATAARAVVF

SEQ ID NO: 1333693 - protein, 9 aa, Homo Sapiens
EVDVTFRVT

SEQ ID NO: 1333694 - protein, 9 aa, Homo Sapiens
IHTRDNKVH

SEQ ID NO: 1333695 - protein, 9 aa, Homo Sapiens
QYYDMCWSC

SEQ ID NO: 1333696 - protein, 9 aa, Homo Sapiens
LTEHFLKFT

SEQ ID NO: 1333697 - protein, 9 aa, Homo Sapiens
RVPPDSKLD

SEQ ID NO: 1333698 - protein, 9 aa, Homo Sapiens
DITYCEFNA

SEQ ID NO: 1333699 - protein, 9 aa, Homo Sapiens
HCIRFWNTL

SEQ ID NO: 1333700 - protein, 9 aa, Homo Sapiens
PLLTPAFLP

SEQ ID NO: 1333701 - protein, 9 aa, Homo Sapiens
SSSGQQGCS

SEQ ID NO: 1333702 - protein, 9 aa, Homo Sapiens
HCLQFAYYK

SEQ ID NO: 1333703 - protein, 9 aa, Homo Sapiens
DDICLDIIR

SEQ ID NO: 1333704 - protein, 9 aa, Homo Sapiens
VYGWIVADN

SEQ ID NO: 1333705 - protein, 9 aa, Homo Sapiens
ITTESFDPL

SEQ ID NO: 1333706 - protein, 9 aa, Homo Sapiens
YVAIRHRPS

SEQ ID NO: 1333707 - protein, 9 aa, Homo Sapiens
SVRIHSSVE

SEQ ID NO: 1333708 - protein, 9 aa, Homo Sapiens
TEIAPQHRR

SEQ ID NO: 1333709 - protein, 9 aa, Homo Sapiens
CRLHCSVLE

SEQ ID NO: 1333710 - protein, 9 aa, Homo Sapiens
DRPVMQLYQ

SEQ ID NO: 1333711 - protein, 9 aa, Homo Sapiens
ERCFSLCMK

SEQ ID NO: 1333712 - protein, 9 aa, Homo Sapiens
CEGVMDIYN

SEQ ID NO: 1333713 - protein, 9 aa, Homo Sapiens
GKLWLQKWY

SEQ ID NO: 1333714 - protein, 9 aa, Homo Sapiens
KMKSMKLER

SEQ ID NO: 1333715 - protein, 9 aa, Homo Sapiens
HDHVIFLTR

SEQ ID NO: 1333716 - protein, 9 aa, Homo Sapiens
RILEHLQKQ

SEQ ID NO: 1333717 - protein, 9 aa, Homo Sapiens
TVATPPRAL

SEQ ID NO: 1333718 - protein, 9 aa, Homo Sapiens
GKEAYPMPT

SEQ ID NO: 1333719 - protein, 9 aa, Homo Sapiens
VLIDNKHIL

SEQ ID NO: 1333720 - protein, 9 aa, Homo Sapiens
DRQHMWRPK

SEQ ID NO: 1333721 - protein, 9 aa, Homo Sapiens
PVFINANRN

SEQ ID NO: 1333722 - protein, 9 aa, Homo Sapiens
NSLQAAKGG

SEQ ID NO: 1333723 - protein, 9 aa, Homo Sapiens
VCRELLRRT

SEQ ID NO: 1333724 - protein, 9 aa, Homo Sapiens
YLAHHQHHH

SEQ ID NO: 1333725 - protein, 9 aa, Homo Sapiens
YGNKLPPLA

SEQ ID NO: 1333726 - protein, 9 aa, Homo Sapiens
PSSLGEAII

SEQ ID NO: 1333727 - protein, 9 aa, Homo Sapiens
NSRPTPDNP

SEQ ID NO: 1333728 - protein, 9 aa, Homo Sapiens
GHQKCKPDI

SEQ ID NO: 1333729 - protein, 9 aa, Homo Sapiens
QLCPQNSLL

SEQ ID NO: 1333730 - protein, 9 aa, Homo Sapiens
SPPNEPGTF

SEQ ID NO: 1333731 - protein, 9 aa, Homo Sapiens
VKHIQEEEA

SEQ ID NO: 1333732 - protein, 9 aa, Homo Sapiens
VDPGARMTV

SEQ ID NO: 1333733 - protein, 9 aa, Homo Sapiens
MRNHKRVKE

SEQ ID NO: 1333734 - protein, 9 aa, Homo Sapiens
EAISQRLCE

SEQ ID NO: 1333735 - protein, 9 aa, Homo Sapiens
FILIFWIIC

SEQ ID NO: 1333736 - protein, 9 aa, Homo Sapiens
NWNRIMKDT

SEQ ID NO: 1333737 - protein, 9 aa, Homo Sapiens
LEKLQSINN

SEQ ID NO: 1333738 - protein, 9 aa, Homo Sapiens
PRIMRICLR

SEQ ID NO: 1333739 - protein, 9 aa, Homo Sapiens
EIQPYEITL

SEQ ID NO: 1333740 - protein, 9 aa, Homo Sapiens
HLRDLLEEE

SEQ ID NO: 1333741 - protein, 9 aa, Homo Sapiens
DCAHACPAV

SEQ ID NO: 1333742 - protein, 9 aa, Homo Sapiens
TNSHNDDTL

SEQ ID NO: 1333743 - protein, 9 aa, Homo Sapiens
ENSGFEPGT

SEQ ID NO: 1333744 - protein, 9 aa, Homo Sapiens
NTGYINTSH

SEQ ID NO: 1333745 - protein, 9 aa, Homo Sapiens
PLHTIFLKD

SEQ ID NO: 1333746 - protein, 9 aa, Homo Sapiens
AHPGCVNLS

SEQ ID NO: 1333747 - protein, 9 aa, Homo Sapiens
ILPTPGQET

SEQ ID NO: 1333748 - protein, 9 aa, Homo Sapiens
ANMFSIAGA

SEQ ID NO: 1333749 - protein, 9 aa, Homo Sapiens
KWFHGLGSR

SEQ ID NO: 1333750 - protein, 9 aa, Homo Sapiens
SELSLQGWR

SEQ ID NO: 1333751 - protein, 9 aa, Homo Sapiens
FVAAIICYG

SEQ ID NO: 1333752 - protein, 9 aa, Homo Sapiens
QFELPREYQ

SEQ ID NO: 1333753 - protein, 9 aa, Homo Sapiens
STYDNQMEI

SEQ ID NO: 1333754 - protein, 9 aa, Homo Sapiens
HNLITANVP

SEQ ID NO: 1333755 - protein, 9 aa, Homo Sapiens
PVISPLLPS

SEQ ID NO: 1333756 - protein, 9 aa, Homo Sapiens
STGLSDIST

SEQ ID NO: 1333757 - protein, 9 aa, Homo Sapiens
DDTAIVGAV

SEQ ID NO: 1333758 - protein, 9 aa, Homo Sapiens
DFIDCVSEK

SEQ ID NO: 1333759 - protein, 9 aa, Homo Sapiens
YTECRNALR

SEQ ID NO: 1333760 - protein, 9 aa, Homo Sapiens
FPVSCHDIR

SEQ ID NO: 1333761 - protein, 9 aa, Homo Sapiens
EQRLLLIFH

SEQ ID NO: 1333762 - protein, 9 aa, Homo Sapiens
ELIEHVTAC

SEQ ID NO: 1333763 - protein, 9 aa, Homo Sapiens
TMYNLHQQA

SEQ ID NO: 1333764 - protein, 9 aa, Homo Sapiens
YRGATCHNF

SEQ ID NO: 1333765 - protein, 9 aa, Homo Sapiens
KDINTSIKN

SEQ ID NO: 1333766 - protein, 9 aa, Homo Sapiens
TYPPGWSLT

SEQ ID NO: 1333767 - protein, 9 aa, Homo Sapiens
YHTPAASQG

SEQ ID NO: 1333768 - protein, 9 aa, Homo Sapiens
PHNRIGVGV

SEQ ID NO: 1333769 - protein, 9 aa, Homo Sapiens
HPERKYDLK

SEQ ID NO: 1333770 - protein, 9 aa, Homo Sapiens
ESDNPEFNI

SEQ ID NO: 1333771 - protein, 9 aa, Homo Sapiens
ETLIQLPEL

SEQ ID NO: 1333772 - protein, 9 aa, Homo Sapiens
IPPHTFLFF

SEQ ID NO: 1333773 - protein, 9 aa, Homo Sapiens
HELGHMLGM

SEQ ID NO: 1333774 - protein, 9 aa, Homo Sapiens
ATHPSPCMR

SEQ ID NO: 1333775 - protein, 9 aa, Homo Sapiens
YTGLSHVSD

SEQ ID NO: 1333776 - protein, 9 aa, Homo Sapiens
IECRPVIPP

SEQ ID NO: 1333777 - protein, 9 aa, Homo Sapiens
LDHVYHGHL

SEQ ID NO: 1333778 - protein, 9 aa, Homo Sapiens
YYGTCVLLG

SEQ ID NO: 1333779 - protein, 9 aa, Homo Sapiens
KSPANGVVT

SEQ ID NO: 1333780 - protein, 9 aa, Homo Sapiens
KTTTLVLMF

SEQ ID NO: 1333781 - protein, 9 aa, Homo Sapiens
EYLNEDANG

SEQ ID NO: 1333782 - protein, 9 aa, Homo Sapiens
IEYIQSHYN

SEQ ID NO: 1333783 - protein, 9 aa, Homo Sapiens
SLVGPRTSG

SEQ ID NO: 1333784 - protein, 9 aa, Homo Sapiens
RQNQCRFSM

SEQ ID NO: 1333785 - protein, 9 aa, Homo Sapiens
LEYRVSSRL

SEQ ID NO: 1333786 - protein, 9 aa, Homo Sapiens
YATSQYMWG

SEQ ID NO: 1333787 - protein, 9 aa, Homo Sapiens
THACPLKFG

SEQ ID NO: 1333788 - protein, 9 aa, Homo Sapiens
GDQESCWKQ

SEQ ID NO: 1333789 - protein, 9 aa, Homo Sapiens
NSHNDDTLL

SEQ ID NO: 1333790 - protein, 9 aa, Homo Sapiens
KHLCLVCGD

SEQ ID NO: 1333791 - protein, 9 aa, Homo Sapiens
FMEGPLFGR

SEQ ID NO: 1333792 - protein, 9 aa, Homo Sapiens
EDIWNAAWH

SEQ ID NO: 1333793 - protein, 9 aa, Homo Sapiens
LMGYIMDKA

SEQ ID NO: 1333794 - protein, 9 aa, Homo Sapiens
HPEVWELFP

SEQ ID NO: 1333795 - protein, 9 aa, Homo Sapiens
KGISQLITM

SEQ ID NO: 1333796 - protein, 9 aa, Homo Sapiens
SEYSPNSSP

SEQ ID NO: 1333797 - protein, 9 aa, Homo Sapiens
TMKSLPFYE

SEQ ID NO: 1333798 - protein, 9 aa, Homo Sapiens
LTADEEKCH

SEQ ID NO: 1333799 - protein, 9 aa, Homo Sapiens
RSPRAVGCT

SEQ ID NO: 1333800 - protein, 9 aa, Homo Sapiens
KLQRRDNMF

SEQ ID NO: 1333801 - protein, 9 aa, Homo Sapiens
DIVKRVYEV

SEQ ID NO: 1333802 - protein, 9 aa, Homo Sapiens
YLHAMCTLS

SEQ ID NO: 1333803 - protein, 9 aa, Homo Sapiens
RNMFKLQSG

SEQ ID NO: 1333804 - protein, 9 aa, Homo Sapiens
GYIIPELLT

SEQ ID NO: 1333805 - protein, 9 aa, Homo Sapiens
ITVRDNQAI

SEQ ID NO: 1333806 - protein, 9 aa, Homo Sapiens
NVIVRNVED

SEQ ID NO: 1333807 - protein, 9 aa, Homo Sapiens
VTGETVYNM

SEQ ID NO: 1333808 - protein, 9 aa, Homo Sapiens
MDADSEEIN

SEQ ID NO: 1333809 - protein, 9 aa, Homo Sapiens
IYCRVWCWP

SEQ ID NO: 1333810 - protein, 9 aa, Homo Sapiens
HRHSTFVPT

SEQ ID NO: 1333811 - protein, 9 aa, Homo Sapiens
LDLTMKHRI

SEQ ID NO: 1333812 - protein, 9 aa, Homo Sapiens
CAHWQVHHH

SEQ ID NO: 1333813 - protein, 9 aa, Homo Sapiens
GSLDNARRL

SEQ ID NO: 1333814 - protein, 9 aa, Homo Sapiens
HYSQDMPMR

SEQ ID NO: 1333815 - protein, 9 aa, Homo Sapiens
YASRFIVIT

SEQ ID NO: 1333816 - protein, 9 aa, Homo Sapiens
FMNVDLREC

SEQ ID NO: 1333817 - protein, 9 aa, Homo Sapiens
QANKLKKMC

SEQ ID NO: 1333818 - protein, 9 aa, Homo Sapiens
VQFYEMIAE

SEQ ID NO: 1333819 - protein, 9 aa, Homo Sapiens
IYLQQMSYP

SEQ ID NO: 1333820 - protein, 9 aa, Homo Sapiens
LDPPRKHLV

SEQ ID NO: 1333821 - protein, 9 aa, Homo Sapiens
SRPTTRSWA

SEQ ID NO: 1333822 - protein, 9 aa, Homo Sapiens
IRKVGGQLN

SEQ ID NO: 1333823 - protein, 9 aa, Homo Sapiens
YECNICGTR

SEQ ID NO: 1333824 - protein, 9 aa, Homo Sapiens
TELEMTIFL

SEQ ID NO: 1333825 - protein, 9 aa, Homo Sapiens
IILGASVVC

SEQ ID NO: 1333826 - protein, 9 aa, Homo Sapiens
SGDPPVNYV

SEQ ID NO: 1333827 - protein, 9 aa, Homo Sapiens
SKTYADARV

SEQ ID NO: 1333828 - protein, 9 aa, Homo Sapiens
LPQLIILIK

SEQ ID NO: 1333829 - protein, 9 aa, Homo Sapiens
IASLFTFWN

SEQ ID NO: 1333830 - protein, 9 aa, Homo Sapiens
DTITGADMS

SEQ ID NO: 1333831 - protein, 9 aa, Homo Sapiens
LHLYQECEK

SEQ ID NO: 1333832 - protein, 9 aa, Homo Sapiens
SKAVVNATI

SEQ ID NO: 1333833 - protein, 9 aa, Homo Sapiens
TNDNVSCRL

SEQ ID NO: 1333834 - protein, 9 aa, Homo Sapiens
KRLGLVNDI

SEQ ID NO: 1333835 - protein, 9 aa, Homo Sapiens
FVTMQIWDM

SEQ ID NO: 1333836 - protein, 9 aa, Homo Sapiens
SVRNVGRCS

SEQ ID NO: 1333837 - protein, 9 aa, Homo Sapiens
SSRHRGFGL

SEQ ID NO: 1333838 - protein, 9 aa, Homo Sapiens
LNLMVLVEQ

SEQ ID NO: 1333839 - protein, 9 aa, Homo Sapiens
AVTDDDNEM

SEQ ID NO: 1333840 - protein, 9 aa, Homo Sapiens
DPEDLQDFN

SEQ ID NO: 1333841 - protein, 9 aa, Homo Sapiens
KAPCQQVLV

SEQ ID NO: 1333842 - protein, 9 aa, Homo Sapiens
SRSSAATAR

SEQ ID NO: 1333843 - protein, 9 aa, Homo Sapiens
EERAPSRQG

SEQ ID NO: 1333844 - protein, 9 aa, Homo Sapiens
SDVYRVWKW

SEQ ID NO: 1333845 - protein, 9 aa, Homo Sapiens
PYQFANSQN

SEQ ID NO: 1333846 - protein, 9 aa, Homo Sapiens
ELCTLCRRL

SEQ ID NO: 1333847 - protein, 9 aa, Homo Sapiens
DNLSILDRV

SEQ ID NO: 1333848 - protein, 9 aa, Homo Sapiens
YPDNPVNRS

SEQ ID NO: 1333849 - protein, 9 aa, Homo Sapiens
VAFSSVEML

SEQ ID NO: 1333850 - protein, 9 aa, Homo Sapiens
GYGYNSCGA

SEQ ID NO: 1333851 - protein, 9 aa, Homo Sapiens
ICAQTEGIN

SEQ ID NO: 1333852 - protein, 9 aa, Homo Sapiens
GHPISELIY

SEQ ID NO: 1333853 - protein, 9 aa, Homo Sapiens
EVKHLKYVE

SEQ ID NO: 1333854 - protein, 9 aa, Homo Sapiens
RTPPKITSP

SEQ ID NO: 1333855 - protein, 9 aa, Homo Sapiens
RPTSFTSLA

SEQ ID NO: 1333856 - protein, 9 aa, Homo Sapiens
SYSIQDRTP

SEQ ID NO: 1333857 - protein, 9 aa, Homo Sapiens
EQEVCDLVL

SEQ ID NO: 1333858 - protein, 9 aa, Homo Sapiens
AVTHMGIYV

SEQ ID NO: 1333859 - protein, 9 aa, Homo Sapiens
GIFPKIMPE

SEQ ID NO: 1333860 - protein, 9 aa, Homo Sapiens
FKNGILDEC

SEQ ID NO: 1333861 - protein, 9 aa, Homo Sapiens
RGRTRARSP

SEQ ID NO: 1333862 - protein, 9 aa, Homo Sapiens
FVRPYPAEA

SEQ ID NO: 1333863 - protein, 9 aa, Homo Sapiens
DDIVSTQVA

SEQ ID NO: 1333864 - protein, 9 aa, Homo Sapiens
HDKFTDTYQ

SEQ ID NO: 1333865 - protein, 9 aa, Homo Sapiens
CIWHSSTYR

SEQ ID NO: 1333866 - protein, 9 aa, Homo Sapiens
VNSAVTHLV

SEQ ID NO: 1333867 - protein, 9 aa, Homo Sapiens
RFHRISAMD

SEQ ID NO: 1333868 - protein, 9 aa, Homo Sapiens
VWWCATSDP

SEQ ID NO: 1333869 - protein, 9 aa, Homo Sapiens
CAHRGSPFL

SEQ ID NO: 1333870 - protein, 9 aa, Homo Sapiens
FVMTHQEYV

SEQ ID NO: 1333871 - protein, 9 aa, Homo Sapiens
FEFETRGKL

SEQ ID NO: 1333872 - protein, 9 aa, Homo Sapiens
DFDNNIQLF

SEQ ID NO: 1333873 - protein, 9 aa, Homo Sapiens
QHILQLRTV

SEQ ID NO: 1333874 - protein, 9 aa, Homo Sapiens
RGVSIGSIC

SEQ ID NO: 1333875 - protein, 9 aa, Homo Sapiens
CKKQAASMA

SEQ ID NO: 1333876 - protein, 9 aa, Homo Sapiens
HLPPPVKST

SEQ ID NO: 1333877 - protein, 9 aa, Homo Sapiens
FIQLSFVES

SEQ ID NO: 1333878 - protein, 9 aa, Homo Sapiens
FLFVFLLII

SEQ ID NO: 1333879 - protein, 9 aa, Homo Sapiens
PAASQGLHY

SEQ ID NO: 1333880 - protein, 9 aa, Homo Sapiens
CKECRMTFT

SEQ ID NO: 1333881 - protein, 9 aa, Homo Sapiens
TKTHWYSGE

SEQ ID NO: 1333882 - protein, 9 aa, Homo Sapiens
EHGCLLRRT

SEQ ID NO: 1333883 - protein, 9 aa, Homo Sapiens
APAFPQAQA

SEQ ID NO: 1333884 - protein, 9 aa, Homo Sapiens
DQDLFLLRK

SEQ ID NO: 1333885 - protein, 9 aa, Homo Sapiens
PGGWKVITE

SEQ ID NO: 1333886 - protein, 9 aa, Homo Sapiens
LEGQEKNLL

SEQ ID NO: 1333887 - protein, 9 aa, Homo Sapiens
RVLELEKDM

SEQ ID NO: 1333888 - protein, 9 aa, Homo Sapiens
QEMGLSNPE

SEQ ID NO: 1333889 - protein, 9 aa, Homo Sapiens
QGRVTHLTG

SEQ ID NO: 1333890 - protein, 9 aa, Homo Sapiens
DPPRKHLVE

SEQ ID NO: 1333891 - protein, 9 aa, Homo Sapiens
HACTQCGKA

SEQ ID NO: 1333892 - protein, 9 aa, Homo Sapiens
LFLLFFSSV

SEQ ID NO: 1333893 - protein, 9 aa, Homo Sapiens
VILRYTDFD

SEQ ID NO: 1333894 - protein, 9 aa, Homo Sapiens
ETCHFDPTV

SEQ ID NO: 1333895 - protein, 9 aa, Homo Sapiens
DTTLICPKP

SEQ ID NO: 1333896 - protein, 9 aa, Homo Sapiens
DPTVLKHMD

SEQ ID NO: 1333897 - protein, 9 aa, Homo Sapiens
ERWHRLQVL

SEQ ID NO: 1333898 - protein, 9 aa, Homo Sapiens
RGSPWPSSS

SEQ ID NO: 1333899 - protein, 9 aa, Homo Sapiens
KSSVPGVDP

SEQ ID NO: 1333900 - protein, 9 aa, Homo Sapiens
KATRQNISQ

SEQ ID NO: 1333901 - protein, 9 aa, Homo Sapiens
IPKDEHILQ

SEQ ID NO: 1333902 - protein, 9 aa, Homo Sapiens
PGTFLIRPS

SEQ ID NO: 1333903 - protein, 9 aa, Homo Sapiens
QREEEETVG

SEQ ID NO: 1333904 - protein, 9 aa, Homo Sapiens
KKNKKQCMM

SEQ ID NO: 1333905 - protein, 9 aa, Homo Sapiens
SSTREDIME

SEQ ID NO: 1333906 - protein, 9 aa, Homo Sapiens
ACGHHGPCI

SEQ ID NO: 1333907 - protein, 9 aa, Homo Sapiens
SINEEELRR

SEQ ID NO: 1333908 - protein, 9 aa, Homo Sapiens
MLCSYRQMS

SEQ ID NO: 1333909 - protein, 9 aa, Homo Sapiens
FRQQPPRQN

SEQ ID NO: 1333910 - protein, 9 aa, Homo Sapiens
TMTPYGSPW

SEQ ID NO: 1333911 - protein, 9 aa, Homo Sapiens
LMKVTAFSP

SEQ ID NO: 1333912 - protein, 9 aa, Homo Sapiens
TEEVDRTSS

SEQ ID NO: 1333913 - protein, 9 aa, Homo Sapiens
ALSVEIDDN

SEQ ID NO: 1333914 - protein, 9 aa, Homo Sapiens
WTNAGDHQL

SEQ ID NO: 1333915 - protein, 9 aa, Homo Sapiens
CLAEEGHKI

SEQ ID NO: 1333916 - protein, 9 aa, Homo Sapiens
DDFTEECLA

SEQ ID NO: 1333917 - protein, 9 aa, Homo Sapiens
HEFEDRDRS

SEQ ID NO: 1333918 - protein, 9 aa, Homo Sapiens
ILKWEALHV

SEQ ID NO: 1333919 - protein, 9 aa, Homo Sapiens
MSWARGRDT

SEQ ID NO: 1333920 - protein, 9 aa, Homo Sapiens
LAFQYFREL

SEQ ID NO: 1333921 - protein, 9 aa, Homo Sapiens
HEAAHQNNV

SEQ ID NO: 1333922 - protein, 9 aa, Homo Sapiens
SVIPTRTAR

SEQ ID NO: 1333923 - protein, 9 aa, Homo Sapiens
GAWGQWTPW

SEQ ID NO: 1333924 - protein, 9 aa, Homo Sapiens
YSIVCGKLT

SEQ ID NO: 1333925 - protein, 9 aa, Homo Sapiens
PSHRSEATD

SEQ ID NO: 1333926 - protein, 9 aa, Homo Sapiens
SVLVCAGYE

SEQ ID NO: 1333927 - protein, 9 aa, Homo Sapiens
TSVIITNRS

SEQ ID NO: 1333928 - protein, 9 aa, Homo Sapiens
GHMSFQLPG

SEQ ID NO: 1333929 - protein, 9 aa, Homo Sapiens
ILLTIKDDI

SEQ ID NO: 1333930 - protein, 9 aa, Homo Sapiens
TAEEVVTLG

SEQ ID NO: 1333931 - protein, 9 aa, Homo Sapiens
NKAFVNYMM

SEQ ID NO: 1333932 - protein, 9 aa, Homo Sapiens
STPARSPSS

SEQ ID NO: 1333933 - protein, 9 aa, Homo Sapiens
SSFRVVGEK

SEQ ID NO: 1333934 - protein, 9 aa, Homo Sapiens
KSHTEDGII

SEQ ID NO: 1333935 - protein, 9 aa, Homo Sapiens
SANCSEFLT

SEQ ID NO: 1333936 - protein, 9 aa, Homo Sapiens
WTANPHIGD

SEQ ID NO: 1333937 - protein, 9 aa, Homo Sapiens
GHISSLDAR

SEQ ID NO: 1333938 - protein, 9 aa, Homo Sapiens
ADVNDNTPA

SEQ ID NO: 1333939 - protein, 9 aa, Homo Sapiens
RKYWSHYYQ

SEQ ID NO: 1333940 - protein, 9 aa, Homo Sapiens
LSLKVLHKL

SEQ ID NO: 1333941 - protein, 9 aa, Homo Sapiens
WKEAIKAKV

SEQ ID NO: 1333942 - protein, 9 aa, Homo Sapiens
NPMCSERCC

SEQ ID NO: 1333943 - protein, 9 aa, Homo Sapiens
KKTMEIKGM

SEQ ID NO: 1333944 - protein, 9 aa, Homo Sapiens
LCTPQEVRD

SEQ ID NO: 1333945 - protein, 9 aa, Homo Sapiens
VTFLTLELS

SEQ ID NO: 1333946 - protein, 9 aa, Homo Sapiens
ACPITFSSP

SEQ ID NO: 1333947 - protein, 9 aa, Homo Sapiens
TWKKIMWLG

SEQ ID NO: 1333948 - protein, 9 aa, Homo Sapiens
PWPENVTLY

SEQ ID NO: 1333949 - protein, 9 aa, Homo Sapiens
LNVIDLMEP

SEQ ID NO: 1333950 - protein, 9 aa, Homo Sapiens
MTPWRPLSI

SEQ ID NO: 1333951 - protein, 9 aa, Homo Sapiens
LLSVWPGHQ

SEQ ID NO: 1333952 - protein, 9 aa, Homo Sapiens
SISCSYSVP

SEQ ID NO: 1333953 - protein, 9 aa, Homo Sapiens
SSIPENDRL

SEQ ID NO: 1333954 - protein, 9 aa, Homo Sapiens
LEELWASLE

SEQ ID NO: 1333955 - protein, 9 aa, Homo Sapiens
PFPVSCHDI

SEQ ID NO: 1333956 - protein, 9 aa, Homo Sapiens
PIALDPSGW

SEQ ID NO: 1333957 - protein, 9 aa, Homo Sapiens
KQICIQYKP

SEQ ID NO: 1333958 - protein, 9 aa, Homo Sapiens
CSALSAASA

SEQ ID NO: 1333959 - protein, 9 aa, Homo Sapiens
IGPKCDPAT

SEQ ID NO: 1333960 - protein, 9 aa, Homo Sapiens
ESVMVRTIL

SEQ ID NO: 1333961 - protein, 9 aa, Homo Sapiens
QIQEIISDN

SEQ ID NO: 1333962 - protein, 9 aa, Homo Sapiens
KEVRLIRNL

SEQ ID NO: 1333963 - protein, 9 aa, Homo Sapiens
LEVWRVSPL

SEQ ID NO: 1333964 - protein, 9 aa, Homo Sapiens
TFSGEEAKA

SEQ ID NO: 1333965 - protein, 9 aa, Homo Sapiens
PNLILCSVS

SEQ ID NO: 1333966 - protein, 9 aa, Homo Sapiens
KLQLEKVMT

SEQ ID NO: 1333967 - protein, 9 aa, Homo Sapiens
TRPGLNKSQ

SEQ ID NO: 1333968 - protein, 9 aa, Homo Sapiens
EERKNLEKV

SEQ ID NO: 1333969 - protein, 9 aa, Homo Sapiens
RVWKWGESL

SEQ ID NO: 1333970 - protein, 9 aa, Homo Sapiens
AREEKIRIR

SEQ ID NO: 1333971 - protein, 9 aa, Homo Sapiens
SRHTQQIQE

SEQ ID NO: 1333972 - protein, 9 aa, Homo Sapiens
DLSHEVIRI

SEQ ID NO: 1333973 - protein, 9 aa, Homo Sapiens
VLHRLAASL

SEQ ID NO: 1333974 - protein, 9 aa, Homo Sapiens
IPPGVATGV

SEQ ID NO: 1333975 - protein, 9 aa, Homo Sapiens
AKTKDPPAM

SEQ ID NO: 1333976 - protein, 9 aa, Homo Sapiens
LLLSLALTD

SEQ ID NO: 1333977 - protein, 9 aa, Homo Sapiens
VSKAKQRWS

SEQ ID NO: 1333978 - protein, 9 aa, Homo Sapiens
PNTWGASPA

SEQ ID NO: 1333979 - protein, 9 aa, Homo Sapiens
TIISVVHRL

SEQ ID NO: 1333980 - protein, 9 aa, Homo Sapiens
IWDDLSECL

SEQ ID NO: 1333981 - protein, 9 aa, Homo Sapiens
VRQDVEALL

SEQ ID NO: 1333982 - protein, 9 aa, Homo Sapiens
LVKDVLNIL

SEQ ID NO: 1333983 - protein, 9 aa, Homo Sapiens
MLHFLAPRL

SEQ ID NO: 1333984 - protein, 9 aa, Homo Sapiens
QTGFYGENC

SEQ ID NO: 1333985 - protein, 9 aa, Homo Sapiens
PLDKLLDHM

SEQ ID NO: 1333986 - protein, 9 aa, Homo Sapiens
RSRSKERRW

SEQ ID NO: 1333987 - protein, 9 aa, Homo Sapiens
FLTIVRRRG

SEQ ID NO: 1333988 - protein, 9 aa, Homo Sapiens
QKVNHFAYR

SEQ ID NO: 1333989 - protein, 9 aa, Homo Sapiens
APAPVQPPH

SEQ ID NO: 1333990 - protein, 9 aa, Homo Sapiens
TEGTGLRGQ

SEQ ID NO: 1333991 - protein, 9 aa, Homo Sapiens
CTRSTLMSC

SEQ ID NO: 1333992 - protein, 9 aa, Homo Sapiens
TSIVRNLHY

SEQ ID NO: 1333993 - protein, 9 aa, Homo Sapiens
SKKAVDWCL

SEQ ID NO: 1333994 - protein, 9 aa, Homo Sapiens
ESPHQEKLE

SEQ ID NO: 1333995 - protein, 9 aa, Homo Sapiens
YVYCGCESP

SEQ ID NO: 1333996 - protein, 9 aa, Homo Sapiens
KHIPEARYR

SEQ ID NO: 1333997 - protein, 9 aa, Homo Sapiens
TVRRRKCPH

SEQ ID NO: 1333998 - protein, 9 aa, Homo Sapiens
FEQCHHCLE

SEQ ID NO: 1333999 - protein, 9 aa, Homo Sapiens
MARTKMKHM

SEQ ID NO: 1334000 - protein, 9 aa, Homo Sapiens
LLECLGSPG

SEQ ID NO: 1334001 - protein, 9 aa, Homo Sapiens
DYKGGYKHA

SEQ ID NO: 1334002 - protein, 9 aa, Homo Sapiens
KQPKLMDGI

SEQ ID NO: 1334003 - protein, 9 aa, Homo Sapiens
QITCGRWHT

SEQ ID NO: 1334004 - protein, 9 aa, Homo Sapiens
SVFRPMDLM

SEQ ID NO: 1334005 - protein, 9 aa, Homo Sapiens
EKQQMGADS

SEQ ID NO: 1334006 - protein, 9 aa, Homo Sapiens
PNEVDSFIV

SEQ ID NO: 1334007 - protein, 9 aa, Homo Sapiens
IMGFISKEW

SEQ ID NO: 1334008 - protein, 9 aa, Homo Sapiens
EFFTDLKLW

SEQ ID NO: 1334009 - protein, 9 aa, Homo Sapiens
ISSPALSLS

SEQ ID NO: 1334010 - protein, 9 aa, Homo Sapiens
TQNLTQKKC

SEQ ID NO: 1334011 - protein, 9 aa, Homo Sapiens
SKRKYCKGN

SEQ ID NO: 1334012 - protein, 9 aa, Homo Sapiens
RQISDWTGS

SEQ ID NO: 1334013 - protein, 9 aa, Homo Sapiens
WIICLASKD

SEQ ID NO: 1334014 - protein, 9 aa, Homo Sapiens
VSSATKMCI

SEQ ID NO: 1334015 - protein, 9 aa, Homo Sapiens
GVDMYVVRG

SEQ ID NO: 1334016 - protein, 9 aa, Homo Sapiens
IDTDTIEAN

SEQ ID NO: 1334017 - protein, 9 aa, Homo Sapiens
TSCSTFNLE

SEQ ID NO: 1334018 - protein, 9 aa, Homo Sapiens
GLVMAALYG

SEQ ID NO: 1334019 - protein, 9 aa, Homo Sapiens
KLQYQSSQT

SEQ ID NO: 1334020 - protein, 9 aa, Homo Sapiens
AREKCRKAR

SEQ ID NO: 1334021 - protein, 9 aa, Homo Sapiens
TPRGSIVTR

SEQ ID NO: 1334022 - protein, 9 aa, Homo Sapiens
TPDSKEKTP

SEQ ID NO: 1334023 - protein, 9 aa, Homo Sapiens
LRTIQVWQR

SEQ ID NO: 1334024 - protein, 9 aa, Homo Sapiens
TSNIKKGKK

SEQ ID NO: 1334025 - protein, 9 aa, Homo Sapiens
SNIKKGKKI

SEQ ID NO: 1334026 - protein, 9 aa, Homo Sapiens
HVAVWGLSK

SEQ ID NO: 1334027 - protein, 9 aa, Homo Sapiens
PQTNAHKSK

SEQ ID NO: 1334028 - protein, 9 aa, Homo Sapiens
DSTATERVI

SEQ ID NO: 1334029 - protein, 9 aa, Homo Sapiens
ESGHPINLT

SEQ ID NO: 1334030 - protein, 9 aa, Homo Sapiens
TVRTRLFSL

SEQ ID NO: 1334031 - protein, 9 aa, Homo Sapiens
NVYHIISIG

SEQ ID NO: 1334032 - protein, 9 aa, Homo Sapiens
ARSPSSAPT

SEQ ID NO: 1334033 - protein, 9 aa, Homo Sapiens
EVWWCATSD

SEQ ID NO: 1334034 - protein, 9 aa, Homo Sapiens
FVTIPRNYT

SEQ ID NO: 1334035 - protein, 9 aa, Homo Sapiens
DSYMALGIL

SEQ ID NO: 1334036 - protein, 9 aa, Homo Sapiens
SKAWAKVTM

SEQ ID NO: 1334037 - protein, 9 aa, Homo Sapiens
AVVAAHIQE

SEQ ID NO: 1334038 - protein, 9 aa, Homo Sapiens
HMRISEILL

SEQ ID NO: 1334039 - protein, 9 aa, Homo Sapiens
RNGTPACEV

SEQ ID NO: 1334040 - protein, 9 aa, Homo Sapiens
DAPAKLFGF

SEQ ID NO: 1334041 - protein, 9 aa, Homo Sapiens
KEEEQVRAT

SEQ ID NO: 1334042 - protein, 9 aa, Homo Sapiens
VRQVVAQTV

SEQ ID NO: 1334043 - protein, 9 aa, Homo Sapiens
VLWKKGLSL

SEQ ID NO: 1334044 - protein, 9 aa, Homo Sapiens
PRRTGHHIV

SEQ ID NO: 1334045 - protein, 9 aa, Homo Sapiens
RTTLPASQR

SEQ ID NO: 1334046 - protein, 9 aa, Homo Sapiens
EDLATTSVT

SEQ ID NO: 1334047 - protein, 9 aa, Homo Sapiens
HCLCIPHPE

SEQ ID NO: 1334048 - protein, 9 aa, Homo Sapiens
TLLLPETKW

SEQ ID NO: 1334049 - protein, 9 aa, Homo Sapiens
LGEEHCKVS

SEQ ID NO: 1334050 - protein, 9 aa, Homo Sapiens
KASMTKKSI

SEQ ID NO: 1334051 - protein, 9 aa, Homo Sapiens
YALMDGAHG

SEQ ID NO: 1334052 - protein, 9 aa, Homo Sapiens
GHASQRPDR

SEQ ID NO: 1334053 - protein, 9 aa, Homo Sapiens
SSVGGTSAV

SEQ ID NO: 1334054 - protein, 9 aa, Homo Sapiens
CPHARASWA

SEQ ID NO: 1334055 - protein, 9 aa, Homo Sapiens
ERCIMVDKE

SEQ ID NO: 1334056 - protein, 9 aa, Homo Sapiens
NLRHKCVHN

SEQ ID NO: 1334057 - protein, 9 aa, Homo Sapiens
HQLGCGQAL

SEQ ID NO: 1334058 - protein, 9 aa, Homo Sapiens
WVLARSSPT

SEQ ID NO: 1334059 - protein, 9 aa, Homo Sapiens
GNLIIIIIT

SEQ ID NO: 1334060 - protein, 9 aa, Homo Sapiens
LWHVVDEGA

SEQ ID NO: 1334061 - protein, 9 aa, Homo Sapiens
QYLMRPKAS

SEQ ID NO: 1334062 - protein, 9 aa, Homo Sapiens
QTCQDWLTG

SEQ ID NO: 1334063 - protein, 9 aa, Homo Sapiens
SLSGGITIL

SEQ ID NO: 1334064 - protein, 9 aa, Homo Sapiens
VWIYPEGTH

SEQ ID NO: 1334065 - protein, 9 aa, Homo Sapiens
EEQQIRLVV

SEQ ID NO: 1334066 - protein, 9 aa, Homo Sapiens
SLGGSQGGR

SEQ ID NO: 1334067 - protein, 9 aa, Homo Sapiens
LVANMFSIA

SEQ ID NO: 1334068 - protein, 9 aa, Homo Sapiens
STEVDTRLS

SEQ ID NO: 1334069 - protein, 9 aa, Homo Sapiens
TKFMKTEEA

SEQ ID NO: 1334070 - protein, 9 aa, Homo Sapiens
WQAGATPWN

SEQ ID NO: 1334071 - protein, 9 aa, Homo Sapiens
IQYHKFTAL

SEQ ID NO: 1334072 - protein, 9 aa, Homo Sapiens
TSAFGFAFD

SEQ ID NO: 1334073 - protein, 9 aa, Homo Sapiens
DFYYGWDGG

SEQ ID NO: 1334074 - protein, 9 aa, Homo Sapiens
ALGSIWLMF

SEQ ID NO: 1334075 - protein, 9 aa, Homo Sapiens
VGLGVFATG

SEQ ID NO: 1334076 - protein, 9 aa, Homo Sapiens
KVLDGTHCY

SEQ ID NO: 1334077 - protein, 9 aa, Homo Sapiens
RIWALKMLL

SEQ ID NO: 1334078 - protein, 9 aa, Homo Sapiens
NNIFCVKEF

SEQ ID NO: 1334079 - protein, 9 aa, Homo Sapiens
DENLNKNHF

SEQ ID NO: 1334080 - protein, 9 aa, Homo Sapiens
GSEMKSGAR

SEQ ID NO: 1334081 - protein, 9 aa, Homo Sapiens
KYLCITAKV

SEQ ID NO: 1334082 - protein, 9 aa, Homo Sapiens
VHFFACPSK

SEQ ID NO: 1334083 - protein, 9 aa, Homo Sapiens
QKLQLEKVM

SEQ ID NO: 1334084 - protein, 9 aa, Homo Sapiens
FLLSVMTYD

SEQ ID NO: 1334085 - protein, 9 aa, Homo Sapiens
LHFLQRASK

SEQ ID NO: 1334086 - protein, 9 aa, Homo Sapiens
NTHVLPGSA

SEQ ID NO: 1334087 - protein, 9 aa, Homo Sapiens
KEFRKNWCA

SEQ ID NO: 1334088 - protein, 9 aa, Homo Sapiens
HSKLSTAEC

SEQ ID NO: 1334089 - protein, 9 aa, Homo Sapiens
PELDSGTSV

SEQ ID NO: 1334090 - protein, 9 aa, Homo Sapiens
EATAAPHRK

SEQ ID NO: 1334091 - protein, 9 aa, Homo Sapiens
KQCMLAREE

SEQ ID NO: 1334092 - protein, 9 aa, Homo Sapiens
SEQIISSTL

SEQ ID NO: 1334093 - protein, 9 aa, Homo Sapiens
AEYEERTAK

SEQ ID NO: 1334094 - protein, 9 aa, Homo Sapiens
NIYEKLLCG

SEQ ID NO: 1334095 - protein, 9 aa, Homo Sapiens
EAFQKITSQ

SEQ ID NO: 1334096 - protein, 9 aa, Homo Sapiens
TATPDGHLL

SEQ ID NO: 1334097 - protein, 9 aa, Homo Sapiens
TTPAVEQVS

SEQ ID NO: 1334098 - protein, 9 aa, Homo Sapiens
WPAISAFAN

SEQ ID NO: 1334099 - protein, 9 aa, Homo Sapiens
DNKLDADYI

SEQ ID NO: 1334100 - protein, 9 aa, Homo Sapiens
IMSTTGWLE

SEQ ID NO: 1334101 - protein, 9 aa, Homo Sapiens
QTFNYMLYP

SEQ ID NO: 1334102 - protein, 9 aa, Homo Sapiens
VWQRGSITP

SEQ ID NO: 1334103 - protein, 9 aa, Homo Sapiens
EPRGARPSD

SEQ ID NO: 1334104 - protein, 9 aa, Homo Sapiens
PGLLSMVNS

SEQ ID NO: 1334105 - protein, 9 aa, Homo Sapiens
LSTMDADSE

SEQ ID NO: 1334106 - protein, 9 aa, Homo Sapiens
VSSNSIFDL

SEQ ID NO: 1334107 - protein, 9 aa, Homo Sapiens
VKFLLSRGT

SEQ ID NO: 1334108 - protein, 9 aa, Homo Sapiens
SHKDVLQEM

SEQ ID NO: 1334109 - protein, 9 aa, Homo Sapiens
IRQSYANSS

SEQ ID NO: 1334110 - protein, 9 aa, Homo Sapiens
ALQPFPVPV

SEQ ID NO: 1334111 - protein, 9 aa, Homo Sapiens
MMDLNHPES

SEQ ID NO: 1334112 - protein, 9 aa, Homo Sapiens
DLRHTLQGL

SEQ ID NO: 1334113 - protein, 9 aa, Homo Sapiens
LFCYSTHLF

SEQ ID NO: 1334114 - protein, 9 aa, Homo Sapiens
DLSMVFPHV

SEQ ID NO: 1334115 - protein, 9 aa, Homo Sapiens
ESGEAVRHP

SEQ ID NO: 1334116 - protein, 9 aa, Homo Sapiens
MVFPHVTSG

SEQ ID NO: 1334117 - protein, 9 aa, Homo Sapiens
VALLAHVLV

SEQ ID NO: 1334118 - protein, 9 aa, Homo Sapiens
DFNALVEKT

SEQ ID NO: 1334119 - protein, 9 aa, Homo Sapiens
QAFDYAYIV

SEQ ID NO: 1334120 - protein, 9 aa, Homo Sapiens
YANFFIGAV

SEQ ID NO: 1334121 - protein, 9 aa, Homo Sapiens
CLSHPQVQD

SEQ ID NO: 1334122 - protein, 9 aa, Homo Sapiens
MVAVKDSCG

SEQ ID NO: 1334123 - protein, 9 aa, Homo Sapiens
IGILQLTFF

SEQ ID NO: 1334124 - protein, 9 aa, Homo Sapiens
TIHTGKQPY

SEQ ID NO: 1334125 - protein, 9 aa, Homo Sapiens
DSFIVTFLG

SEQ ID NO: 1334126 - protein, 9 aa, Homo Sapiens
SMVERAAIS

SEQ ID NO: 1334127 - protein, 9 aa, Homo Sapiens
NWKITHVVL

SEQ ID NO: 1334128 - protein, 9 aa, Homo Sapiens
PDLTVSQTY

SEQ ID NO: 1334129 - protein, 9 aa, Homo Sapiens
DTVRFTLRR

SEQ ID NO: 1334130 - protein, 9 aa, Homo Sapiens
EALHLSIQT

SEQ ID NO: 1334131 - protein, 9 aa, Homo Sapiens
KADYPEGDD

SEQ ID NO: 1334132 - protein, 9 aa, Homo Sapiens
LRDVWGNQQ

SEQ ID NO: 1334133 - protein, 9 aa, Homo Sapiens
GSMQMAISR

SEQ ID NO: 1334134 - protein, 9 aa, Homo Sapiens
PTGAASAAR

SEQ ID NO: 1334135 - protein, 9 aa, Homo Sapiens
AHQNNVGRM

SEQ ID NO: 1334136 - protein, 9 aa, Homo Sapiens
VLKGAIQIP

SEQ ID NO: 1334137 - protein, 9 aa, Homo Sapiens
LSGCHVNII

SEQ ID NO: 1334138 - protein, 9 aa, Homo Sapiens
DGVCSKDSD

SEQ ID NO: 1334139 - protein, 9 aa, Homo Sapiens
VFMVTGRQE

SEQ ID NO: 1334140 - protein, 9 aa, Homo Sapiens
SMFWLKKLH

SEQ ID NO: 1334141 - protein, 9 aa, Homo Sapiens
KRRKFMMQS

SEQ ID NO: 1334142 - protein, 9 aa, Homo Sapiens
LLMIWFYAK

SEQ ID NO: 1334143 - protein, 9 aa, Homo Sapiens
QQPTLSPVT

SEQ ID NO: 1334144 - protein, 9 aa, Homo Sapiens
FFLLLCVVY

SEQ ID NO: 1334145 - protein, 9 aa, Homo Sapiens
KMTHPLCKC

SEQ ID NO: 1334146 - protein, 9 aa, Homo Sapiens
AEKLDFAGL

SEQ ID NO: 1334147 - protein, 9 aa, Homo Sapiens
HIGLYDSVK

SEQ ID NO: 1334148 - protein, 9 aa, Homo Sapiens
THITEHYST

SEQ ID NO: 1334149 - protein, 9 aa, Homo Sapiens
YQVTNGMEF

SEQ ID NO: 1334150 - protein, 9 aa, Homo Sapiens
QKLMAEVLA

SEQ ID NO: 1334151 - protein, 9 aa, Homo Sapiens
HITDDICLD

SEQ ID NO: 1334152 - protein, 9 aa, Homo Sapiens
MWADVSHLK

SEQ ID NO: 1334153 - protein, 9 aa, Homo Sapiens
LDDQIQWPT

SEQ ID NO: 1334154 - protein, 9 aa, Homo Sapiens
PVRQYVYRV

SEQ ID NO: 1334155 - protein, 9 aa, Homo Sapiens
PRGWDHTAS

SEQ ID NO: 1334156 - protein, 9 aa, Homo Sapiens
GHINCPWKV

SEQ ID NO: 1334157 - protein, 9 aa, Homo Sapiens
RVYYSPTPG

SEQ ID NO: 1334158 - protein, 9 aa, Homo Sapiens
HISRGYDFC

SEQ ID NO: 1334159 - protein, 9 aa, Homo Sapiens
KKCWTSHQD

SEQ ID NO: 1334160 - protein, 9 aa, Homo Sapiens
YLDVFARTQ

SEQ ID NO: 1334161 - protein, 9 aa, Homo Sapiens
FGSMQMAIS

SEQ ID NO: 1334162 - protein, 9 aa, Homo Sapiens
FEWECGVGV

SEQ ID NO: 1334163 - protein, 9 aa, Homo Sapiens
LYALTSQFI

SEQ ID NO: 1334164 - protein, 9 aa, Homo Sapiens
QCPAGPKGA

SEQ ID NO: 1334165 - protein, 9 aa, Homo Sapiens
GPQMLLAHL

SEQ ID NO: 1334166 - protein, 9 aa, Homo Sapiens
CITIPESDL

SEQ ID NO: 1334167 - protein, 9 aa, Homo Sapiens
NSQLVTQQV

SEQ ID NO: 1334168 - protein, 9 aa, Homo Sapiens
AIEKPRIGE

SEQ ID NO: 1334169 - protein, 9 aa, Homo Sapiens
LVHVDKCPR

SEQ ID NO: 1334170 - protein, 9 aa, Homo Sapiens
SEQESPRSP

SEQ ID NO: 1334171 - protein, 9 aa, Homo Sapiens
SPTLGRVPH

SEQ ID NO: 1334172 - protein, 9 aa, Homo Sapiens
TAAHGHLEW

SEQ ID NO: 1334173 - protein, 9 aa, Homo Sapiens
TVVTFHSPY

SEQ ID NO: 1334174 - protein, 9 aa, Homo Sapiens
VKLTLVSRG

SEQ ID NO: 1334175 - protein, 9 aa, Homo Sapiens
LSNVTPRPQ

SEQ ID NO: 1334176 - protein, 9 aa, Homo Sapiens
EAQMQAELL

SEQ ID NO: 1334177 - protein, 9 aa, Homo Sapiens
MPEFRAPKT

SEQ ID NO: 1334178 - protein, 9 aa, Homo Sapiens
TQVFTLHLF

SEQ ID NO: 1334179 - protein, 9 aa, Homo Sapiens
MRELREVLW

SEQ ID NO: 1334180 - protein, 9 aa, Homo Sapiens
DPNAGSQLP

SEQ ID NO: 1334181 - protein, 9 aa, Homo Sapiens
LMTYWQELI

SEQ ID NO: 1334182 - protein, 9 aa, Homo Sapiens
YLVTKLVEV

SEQ ID NO: 1334183 - protein, 9 aa, Homo Sapiens
KRHSMWEED

SEQ ID NO: 1334184 - protein, 9 aa, Homo Sapiens
LLPPLRFLW

SEQ ID NO: 1334185 - protein, 9 aa, Homo Sapiens
LITHIIFTI

SEQ ID NO: 1334186 - protein, 9 aa, Homo Sapiens
LVGTMLTYS

SEQ ID NO: 1334187 - protein, 9 aa, Homo Sapiens
LLSAYWHSL

SEQ ID NO: 1334188 - protein, 9 aa, Homo Sapiens
QWHSKVWQK

SEQ ID NO: 1334189 - protein, 9 aa, Homo Sapiens
KCVTIMPKD

SEQ ID NO: 1334190 - protein, 9 aa, Homo Sapiens
YYDVGHCPV

SEQ ID NO: 1334191 - protein, 9 aa, Homo Sapiens
LSDTLVIFQ

SEQ ID NO: 1334192 - protein, 9 aa, Homo Sapiens
TPQHKMLCL

SEQ ID NO: 1334193 - protein, 9 aa, Homo Sapiens
MGDFLKRIE

SEQ ID NO: 1334194 - protein, 9 aa, Homo Sapiens
TLPLGGFQI

SEQ ID NO: 1334195 - protein, 9 aa, Homo Sapiens
RDSDGKLQE

SEQ ID NO: 1334196 - protein, 9 aa, Homo Sapiens
KACSPLWSL

SEQ ID NO: 1334197 - protein, 9 aa, Homo Sapiens
TGCLTHKEF

SEQ ID NO: 1334198 - protein, 9 aa, Homo Sapiens
LMMNRLANI

SEQ ID NO: 1334199 - protein, 9 aa, Homo Sapiens
KLEVAQNVL

SEQ ID NO: 1334200 - protein, 9 aa, Homo Sapiens
DVWCQQRLA

SEQ ID NO: 1334201 - protein, 9 aa, Homo Sapiens
TEHSVLELV

SEQ ID NO: 1334202 - protein, 9 aa, Homo Sapiens
CLSSGFTGV

SEQ ID NO: 1334203 - protein, 9 aa, Homo Sapiens
EKIYVCIEC

SEQ ID NO: 1334204 - protein, 9 aa, Homo Sapiens
LGAFPTPCP

SEQ ID NO: 1334205 - protein, 9 aa, Homo Sapiens
GMLKEETRS

SEQ ID NO: 1334206 - protein, 9 aa, Homo Sapiens
STCPRFLSG

SEQ ID NO: 1334207 - protein, 9 aa, Homo Sapiens
ALATDAITA

SEQ ID NO: 1334208 - protein, 9 aa, Homo Sapiens
LLLVYIMST

SEQ ID NO: 1334209 - protein, 9 aa, Homo Sapiens
VSSRSASDS

SEQ ID NO: 1334210 - protein, 9 aa, Homo Sapiens
KDTADAVHP

SEQ ID NO: 1334211 - protein, 9 aa, Homo Sapiens
FENYMCQQL

SEQ ID NO: 1334212 - protein, 9 aa, Homo Sapiens
EFADLVTAE

SEQ ID NO: 1334213 - protein, 9 aa, Homo Sapiens
AASTPRDEE

SEQ ID NO: 1334214 - protein, 9 aa, Homo Sapiens
HEWYLLNIF

SEQ ID NO: 1334215 - protein, 9 aa, Homo Sapiens
GVTGWCVGF

SEQ ID NO: 1334216 - protein, 9 aa, Homo Sapiens
MDGPDPGTP

SEQ ID NO: 1334217 - protein, 9 aa, Homo Sapiens
IVPDTHKDH

SEQ ID NO: 1334218 - protein, 9 aa, Homo Sapiens
PQPMVPREL

SEQ ID NO: 1334219 - protein, 9 aa, Homo Sapiens
PQPPPGPLS

SEQ ID NO: 1334220 - protein, 9 aa, Homo Sapiens
TNSPIQKRN

SEQ ID NO: 1334221 - protein, 9 aa, Homo Sapiens
QRYVHETQE

SEQ ID NO: 1334222 - protein, 9 aa, Homo Sapiens
RQLGCGEVI

SEQ ID NO: 1334223 - protein, 9 aa, Homo Sapiens
VLYIQANNC

SEQ ID NO: 1334224 - protein, 9 aa, Homo Sapiens
SLQGWRRRQ

SEQ ID NO: 1334225 - protein, 9 aa, Homo Sapiens
VRHQQQELV

SEQ ID NO: 1334226 - protein, 9 aa, Homo Sapiens
ATDAITAAL

SEQ ID NO: 1334227 - protein, 9 aa, Homo Sapiens
YPAEAKSML

SEQ ID NO: 1334228 - protein, 9 aa, Homo Sapiens
RVMTINGIP

SEQ ID NO: 1334229 - protein, 9 aa, Homo Sapiens
DASGETVSE

SEQ ID NO: 1334230 - protein, 9 aa, Homo Sapiens
YVCCRRCES

SEQ ID NO: 1334231 - protein, 9 aa, Homo Sapiens
LNINECFSN

SEQ ID NO: 1334232 - protein, 9 aa, Homo Sapiens
AFYLVHLFH

SEQ ID NO: 1334233 - protein, 9 aa, Homo Sapiens
NIVIIWIVS

SEQ ID NO: 1334234 - protein, 9 aa, Homo Sapiens
TTPPGRSLP

SEQ ID NO: 1334235 - protein, 9 aa, Homo Sapiens
WCHLAAQPQ

SEQ ID NO: 1334236 - protein, 9 aa, Homo Sapiens
STSCKLTDL

SEQ ID NO: 1334237 - protein, 9 aa, Homo Sapiens
VPTPRIDSQ

SEQ ID NO: 1334238 - protein, 9 aa, Homo Sapiens
FMKGLYTDT

SEQ ID NO: 1334239 - protein, 9 aa, Homo Sapiens
WGRKEEPEG

SEQ ID NO: 1334240 - protein, 9 aa, Homo Sapiens
FPEPFHSKV

SEQ ID NO: 1334241 - protein, 9 aa, Homo Sapiens
QGNIFIADF

SEQ ID NO: 1334242 - protein, 9 aa, Homo Sapiens
TFSSTIFPN

SEQ ID NO: 1334243 - protein, 9 aa, Homo Sapiens
VSVLSIDAD

SEQ ID NO: 1334244 - protein, 9 aa, Homo Sapiens
LIRPETLVC

SEQ ID NO: 1334245 - protein, 9 aa, Homo Sapiens
VVHRLSTVR

SEQ ID NO: 1334246 - protein, 9 aa, Homo Sapiens
NTGVDAGET

SEQ ID NO: 1334247 - protein, 9 aa, Homo Sapiens
MRERKFHRI

SEQ ID NO: 1334248 - protein, 9 aa, Homo Sapiens
QHSSLEEHK

SEQ ID NO: 1334249 - protein, 9 aa, Homo Sapiens
RTGVTGYHE

SEQ ID NO: 1334250 - protein, 9 aa, Homo Sapiens
GQHWIWFNL

SEQ ID NO: 1334251 - protein, 9 aa, Homo Sapiens
PGAEGCPDA

SEQ ID NO: 1334252 - protein, 9 aa, Homo Sapiens
QTGKIECLP

SEQ ID NO: 1334253 - protein, 9 aa, Homo Sapiens
ITSLSSEGL

SEQ ID NO: 1334254 - protein, 9 aa, Homo Sapiens
MGNLIIIII

SEQ ID NO: 1334255 - protein, 9 aa, Homo Sapiens
ENMQPRTRC

SEQ ID NO: 1334256 - protein, 9 aa, Homo Sapiens
KAAETTVVD

SEQ ID NO: 1334257 - protein, 9 aa, Homo Sapiens
TQEEHDDSL

SEQ ID NO: 1334258 - protein, 9 aa, Homo Sapiens
RTRLIRKCF

SEQ ID NO: 1334259 - protein, 9 aa, Homo Sapiens
QWKHVFVLS

SEQ ID NO: 1334260 - protein, 9 aa, Homo Sapiens
SPYGLNGML

SEQ ID NO: 1334261 - protein, 9 aa, Homo Sapiens
REEHADSAH

SEQ ID NO: 1334262 - protein, 9 aa, Homo Sapiens
QLIILIKNA

SEQ ID NO: 1334263 - protein, 9 aa, Homo Sapiens
RHEQLTRAL

SEQ ID NO: 1334264 - protein, 9 aa, Homo Sapiens
RDFRDLQLA

SEQ ID NO: 1334265 - protein, 9 aa, Homo Sapiens
TWWEKPCTL

SEQ ID NO: 1334266 - protein, 9 aa, Homo Sapiens
MSLVRSACS

SEQ ID NO: 1334267 - protein, 9 aa, Homo Sapiens
QYTYTIIQE

SEQ ID NO: 1334268 - protein, 9 aa, Homo Sapiens
KSLPSECIL

SEQ ID NO: 1334269 - protein, 9 aa, Homo Sapiens
RPRIILTTQ

SEQ ID NO: 1334270 - protein, 9 aa, Homo Sapiens
HQLGSKYIL

SEQ ID NO: 1334271 - protein, 9 aa, Homo Sapiens
KVASDTEEV

SEQ ID NO: 1334272 - protein, 9 aa, Homo Sapiens
GFISKEWER

SEQ ID NO: 1334273 - protein, 9 aa, Homo Sapiens
KGKESKLVA

SEQ ID NO: 1334274 - protein, 9 aa, Homo Sapiens
TVYIEVIPP

SEQ ID NO: 1334275 - protein, 9 aa, Homo Sapiens
RLWRSSSLW

SEQ ID NO: 1334276 - protein, 9 aa, Homo Sapiens
ITDDICLDI

SEQ ID NO: 1334277 - protein, 9 aa, Homo Sapiens
ITLPRRDEW

SEQ ID NO: 1334278 - protein, 9 aa, Homo Sapiens
TEEKRHRTW

SEQ ID NO: 1334279 - protein, 9 aa, Homo Sapiens
VRYWDLHTS

SEQ ID NO: 1334280 - protein, 9 aa, Homo Sapiens
EEGHKIYLR

SEQ ID NO: 1334281 - protein, 9 aa, Homo Sapiens
SGFDQAHLY

SEQ ID NO: 1334282 - protein, 9 aa, Homo Sapiens
IPSIKYYLD

SEQ ID NO: 1334283 - protein, 9 aa, Homo Sapiens
TWARTSSRR

SEQ ID NO: 1334284 - protein, 9 aa, Homo Sapiens
YLRIPNEII

SEQ ID NO: 1334285 - protein, 9 aa, Homo Sapiens
SYDRSLQCS

SEQ ID NO: 1334286 - protein, 9 aa, Homo Sapiens
PHIIVLGLV

SEQ ID NO: 1334287 - protein, 9 aa, Homo Sapiens
RIRKCIRNP

SEQ ID NO: 1334288 - protein, 9 aa, Homo Sapiens
LSTVRGCYE

SEQ ID NO: 1334289 - protein, 9 aa, Homo Sapiens
TAVWGGHEV

SEQ ID NO: 1334290 - protein, 9 aa, Homo Sapiens
THSGHLWNP

SEQ ID NO: 1334291 - protein, 9 aa, Homo Sapiens
WATPRRSPR

SEQ ID NO: 1334292 - protein, 9 aa, Homo Sapiens
QAALQVPEH

SEQ ID NO: 1334293 - protein, 9 aa, Homo Sapiens
VAMFHQYSG

SEQ ID NO: 1334294 - protein, 9 aa, Homo Sapiens
QREVSVVDR

SEQ ID NO: 1334295 - protein, 9 aa, Homo Sapiens
TGHLEEPMS

SEQ ID NO: 1334296 - protein, 9 aa, Homo Sapiens
SKSTQKKLA

SEQ ID NO: 1334297 - protein, 9 aa, Homo Sapiens
SSPKRQQLS

SEQ ID NO: 1334298 - protein, 9 aa, Homo Sapiens
EDVTEKLKA

SEQ ID NO: 1334299 - protein, 9 aa, Homo Sapiens
QGSWGVSEA

SEQ ID NO: 1334300 - protein, 9 aa, Homo Sapiens
SLADTLIIG

SEQ ID NO: 1334301 - protein, 9 aa, Homo Sapiens
SRPTPDNPY

SEQ ID NO: 1334302 - protein, 9 aa, Homo Sapiens
DIAPNDITR

SEQ ID NO: 1334303 - protein, 9 aa, Homo Sapiens
IKYKERFDN

SEQ ID NO: 1334304 - protein, 9 aa, Homo Sapiens
RDIWKADPG

SEQ ID NO: 1334305 - protein, 9 aa, Homo Sapiens
EHRCLLFMK

SEQ ID NO: 1334306 - protein, 9 aa, Homo Sapiens
TRPILDVVD

SEQ ID NO: 1334307 - protein, 9 aa, Homo Sapiens
RRPSAAARC

SEQ ID NO: 1334308 - protein, 9 aa, Homo Sapiens
FGNFNLLHG

SEQ ID NO: 1334309 - protein, 9 aa, Homo Sapiens
KPDLNMALP

SEQ ID NO: 1334310 - protein, 9 aa, Homo Sapiens
MKTSKYWSK

SEQ ID NO: 1334311 - protein, 9 aa, Homo Sapiens
DNYGQEWTY

SEQ ID NO: 1334312 - protein, 9 aa, Homo Sapiens
CSAKEVERV

SEQ ID NO: 1334313 - protein, 9 aa, Homo Sapiens
PLLLTFILV

SEQ ID NO: 1334314 - protein, 9 aa, Homo Sapiens
QPYEITLVH

SEQ ID NO: 1334315 - protein, 9 aa, Homo Sapiens
IGVNVAFQA

SEQ ID NO: 1334316 - protein, 9 aa, Homo Sapiens
LHAIHSHHT

SEQ ID NO: 1334317 - protein, 9 aa, Homo Sapiens
HCMKREVDE

SEQ ID NO: 1334318 - protein, 9 aa, Homo Sapiens
CQNRARKYF

SEQ ID NO: 1334319 - protein, 9 aa, Homo Sapiens
LFFFLFPLG

SEQ ID NO: 1334320 - protein, 9 aa, Homo Sapiens
LTLPEDLVR

SEQ ID NO: 1334321 - protein, 9 aa, Homo Sapiens
TSASTPVRS

SEQ ID NO: 1334322 - protein, 9 aa, Homo Sapiens
EDIPEHYPG

SEQ ID NO: 1334323 - protein, 9 aa, Homo Sapiens
MSLCGTRAN

SEQ ID NO: 1334324 - protein, 9 aa, Homo Sapiens
SRPHRCELA

SEQ ID NO: 1334325 - protein, 9 aa, Homo Sapiens
GHVRCHMNK

SEQ ID NO: 1334326 - protein, 9 aa, Homo Sapiens
CSPLWSLQP

SEQ ID NO: 1334327 - protein, 9 aa, Homo Sapiens
HIFLLICGF

SEQ ID NO: 1334328 - protein, 9 aa, Homo Sapiens
KGVFYRRAQ

SEQ ID NO: 1334329 - protein, 9 aa, Homo Sapiens
LQEAKEKVT

SEQ ID NO: 1334330 - protein, 9 aa, Homo Sapiens
HQEELRRLE

SEQ ID NO: 1334331 - protein, 9 aa, Homo Sapiens
VCRLTPSCE

SEQ ID NO: 1334332 - protein, 9 aa, Homo Sapiens
DDDVYHSLE

SEQ ID NO: 1334333 - protein, 9 aa, Homo Sapiens
IPKLSKDPH

SEQ ID NO: 1334334 - protein, 9 aa, Homo Sapiens
RNFNYLKSG

SEQ ID NO: 1334335 - protein, 9 aa, Homo Sapiens
TDLRHTLQG

SEQ ID NO: 1334336 - protein, 9 aa, Homo Sapiens
CAWDFNIDK

SEQ ID NO: 1334337 - protein, 9 aa, Homo Sapiens
AQVKTETVG

SEQ ID NO: 1334338 - protein, 9 aa, Homo Sapiens
YLKDKMCKA

SEQ ID NO: 1334339 - protein, 9 aa, Homo Sapiens
LGLFIVANS

SEQ ID NO: 1334340 - protein, 9 aa, Homo Sapiens
LRKWRPGAS

SEQ ID NO: 1334341 - protein, 9 aa, Homo Sapiens
MECIVTTHI

SEQ ID NO: 1334342 - protein, 9 aa, Homo Sapiens
CGGTIEERA

SEQ ID NO: 1334343 - protein, 9 aa, Homo Sapiens
KYEKNDNGA

SEQ ID NO: 1334344 - protein, 9 aa, Homo Sapiens
VWGNQQALR

SEQ ID NO: 1334345 - protein, 9 aa, Homo Sapiens
THNGVKPYQ

SEQ ID NO: 1334346 - protein, 9 aa, Homo Sapiens
LGTWRTEVV

SEQ ID NO: 1334347 - protein, 9 aa, Homo Sapiens
KIRKTSQVL

SEQ ID NO: 1334348 - protein, 9 aa, Homo Sapiens
VLPSASVSR

SEQ ID NO: 1334349 - protein, 9 aa, Homo Sapiens
IQEIHDEQA

SEQ ID NO: 1334350 - protein, 9 aa, Homo Sapiens
HVSCMERKK

SEQ ID NO: 1334351 - protein, 9 aa, Homo Sapiens
DHGVRLNLS

SEQ ID NO: 1334352 - protein, 9 aa, Homo Sapiens
PSRQGLAEP

SEQ ID NO: 1334353 - protein, 9 aa, Homo Sapiens
QVGPLPCVL

SEQ ID NO: 1334354 - protein, 9 aa, Homo Sapiens
KQLFQKFPV

SEQ ID NO: 1334355 - protein, 9 aa, Homo Sapiens
GMEKCDDGW

SEQ ID NO: 1334356 - protein, 9 aa, Homo Sapiens
YWEMKQAFI

SEQ ID NO: 1334357 - protein, 9 aa, Homo Sapiens
LTAITIFHD

SEQ ID NO: 1334358 - protein, 9 aa, Homo Sapiens
TGSGKTAVF

SEQ ID NO: 1334359 - protein, 9 aa, Homo Sapiens
IINYGKKCW

SEQ ID NO: 1334360 - protein, 9 aa, Homo Sapiens
REPFLLFFP

SEQ ID NO: 1334361 - protein, 9 aa, Homo Sapiens
FAQTWTDSH

SEQ ID NO: 1334362 - protein, 9 aa, Homo Sapiens
KHLLELRKI

SEQ ID NO: 1334363 - protein, 9 aa, Homo Sapiens
LTKDERIYV

SEQ ID NO: 1334364 - protein, 9 aa, Homo Sapiens
VKVMQCWCC

SEQ ID NO: 1334365 - protein, 9 aa, Homo Sapiens
LTVASLHLV

SEQ ID NO: 1334366 - protein, 9 aa, Homo Sapiens
NQYVVGELA

SEQ ID NO: 1334367 - protein, 9 aa, Homo Sapiens
GGQFFSPKE

SEQ ID NO: 1334368 - protein, 9 aa, Homo Sapiens
VCGRPLMRH

SEQ ID NO: 1334369 - protein, 9 aa, Homo Sapiens
ELCLQVIDL

SEQ ID NO: 1334370 - protein, 9 aa, Homo Sapiens
PLHPKHWFQ

SEQ ID NO: 1334371 - protein, 9 aa, Homo Sapiens
TIYSILSLK

SEQ ID NO: 1334372 - protein, 9 aa, Homo Sapiens
NGASRSLDD

SEQ ID NO: 1334373 - protein, 9 aa, Homo Sapiens
LCTVITEGP

SEQ ID NO: 1334374 - protein, 9 aa, Homo Sapiens
KKKKKKERE

SEQ ID NO: 1334375 - protein, 9 aa, Homo Sapiens
ILHQGCLLG

SEQ ID NO: 1334376 - protein, 9 aa, Homo Sapiens
DQVIDVGSE

SEQ ID NO: 1334377 - protein, 9 aa, Homo Sapiens
MVTRGHQLY

SEQ ID NO: 1334378 - protein, 9 aa, Homo Sapiens
KRPTKIGCR

SEQ ID NO: 1334379 - protein, 9 aa, Homo Sapiens
EVADVNDNT

SEQ ID NO: 1334380 - protein, 9 aa, Homo Sapiens
YVAEISIGL

SEQ ID NO: 1334381 - protein, 9 aa, Homo Sapiens
GRCVSACCA

SEQ ID NO: 1334382 - protein, 9 aa, Homo Sapiens
AQHFGPVFT

SEQ ID NO: 1334383 - protein, 9 aa, Homo Sapiens
KDGDDFKEP

SEQ ID NO: 1334384 - protein, 9 aa, Homo Sapiens
ITKGKKSKI

SEQ ID NO: 1334385 - protein, 9 aa, Homo Sapiens
SWLLPAPWP

SEQ ID NO: 1334386 - protein, 9 aa, Homo Sapiens
PLRSNIACD

SEQ ID NO: 1334387 - protein, 9 aa, Homo Sapiens
THPSPCMRR

SEQ ID NO: 1334388 - protein, 9 aa, Homo Sapiens
DEVIIPLPT

SEQ ID NO: 1334389 - protein, 9 aa, Homo Sapiens
LVVTGFYAE

SEQ ID NO: 1334390 - protein, 9 aa, Homo Sapiens
LEANIPHAY

SEQ ID NO: 1334391 - protein, 9 aa, Homo Sapiens
FLLFFWQCG

SEQ ID NO: 1334392 - protein, 9 aa, Homo Sapiens
IHLQSHTGE

SEQ ID NO: 1334393 - protein, 9 aa, Homo Sapiens
AMQEMEEYP

SEQ ID NO: 1334394 - protein, 9 aa, Homo Sapiens
IEEQKEERC

SEQ ID NO: 1334395 - protein, 9 aa, Homo Sapiens
HQDFFQEIL

SEQ ID NO: 1334396 - protein, 9 aa, Homo Sapiens
NVPPTATSL

SEQ ID NO: 1334397 - protein, 9 aa, Homo Sapiens
AGRMGGRHP

SEQ ID NO: 1334398 - protein, 9 aa, Homo Sapiens
HFRHENVIG

SEQ ID NO: 1334399 - protein, 9 aa, Homo Sapiens
LNHHKKYQY

SEQ ID NO: 1334400 - protein, 9 aa, Homo Sapiens
MVHREFQLD

SEQ ID NO: 1334401 - protein, 9 aa, Homo Sapiens
KMLLTISTI

SEQ ID NO: 1334402 - protein, 9 aa, Homo Sapiens
KPEQVSTLF

SEQ ID NO: 1334403 - protein, 9 aa, Homo Sapiens
LLWAKAMRL

SEQ ID NO: 1334404 - protein, 9 aa, Homo Sapiens
NLITANVPY

SEQ ID NO: 1334405 - protein, 9 aa, Homo Sapiens
FEMCFAKMP

SEQ ID NO: 1334406 - protein, 9 aa, Homo Sapiens
MQVFAMAQL

SEQ ID NO: 1334407 - protein, 9 aa, Homo Sapiens
RKTFTTGMT

SEQ ID NO: 1334408 - protein, 9 aa, Homo Sapiens
IQHLSSLES

SEQ ID NO: 1334409 - protein, 9 aa, Homo Sapiens
PEYPCSEEI

SEQ ID NO: 1334410 - protein, 9 aa, Homo Sapiens
HPTFTRSNT

SEQ ID NO: 1334411 - protein, 9 aa, Homo Sapiens
ACAKSKSRS

SEQ ID NO: 1334412 - protein, 9 aa, Homo Sapiens
IMQRVSLSI

SEQ ID NO: 1334413 - protein, 9 aa, Homo Sapiens
TKTPIITTL

SEQ ID NO: 1334414 - protein, 9 aa, Homo Sapiens
VLRIVAKYL

SEQ ID NO: 1334415 - protein, 9 aa, Homo Sapiens
HTRAPQACS

SEQ ID NO: 1334416 - protein, 9 aa, Homo Sapiens
WTNQKICKT

SEQ ID NO: 1334417 - protein, 9 aa, Homo Sapiens
RTQVRGIKT

SEQ ID NO: 1334418 - protein, 9 aa, Homo Sapiens
VGISRKELV

SEQ ID NO: 1334419 - protein, 9 aa, Homo Sapiens
DQNNPHKNI

SEQ ID NO: 1334420 - protein, 9 aa, Homo Sapiens
RVLASNGHI

SEQ ID NO: 1334421 - protein, 9 aa, Homo Sapiens
TIVVKIQGY

SEQ ID NO: 1334422 - protein, 9 aa, Homo Sapiens
LSSNPSSCD

SEQ ID NO: 1334423 - protein, 9 aa, Homo Sapiens
NCDLREDTL

SEQ ID NO: 1334424 - protein, 9 aa, Homo Sapiens
NDVNASSKT

SEQ ID NO: 1334425 - protein, 9 aa, Homo Sapiens
ELVVFIYYA

SEQ ID NO: 1334426 - protein, 9 aa, Homo Sapiens
KITTVQVPM

SEQ ID NO: 1334427 - protein, 9 aa, Homo Sapiens
HSNVSANNN

SEQ ID NO: 1334428 - protein, 9 aa, Homo Sapiens
TAQTEGIFG

SEQ ID NO: 1334429 - protein, 9 aa, Homo Sapiens
FWSDFHRNR

SEQ ID NO: 1334430 - protein, 9 aa, Homo Sapiens
PCMRRSTAG

SEQ ID NO: 1334431 - protein, 9 aa, Homo Sapiens
FHVKDSKPS

SEQ ID NO: 1334432 - protein, 9 aa, Homo Sapiens
MPFVVEIAD

SEQ ID NO: 1334433 - protein, 9 aa, Homo Sapiens
YKTGNLYLW

SEQ ID NO: 1334434 - protein, 9 aa, Homo Sapiens
RDLVFMEGP

SEQ ID NO: 1334435 - protein, 9 aa, Homo Sapiens
DLVTNDGIS

SEQ ID NO: 1334436 - protein, 9 aa, Homo Sapiens
EREIQGLPI

SEQ ID NO: 1334437 - protein, 9 aa, Homo Sapiens
EIRKMKDRF

SEQ ID NO: 1334438 - protein, 9 aa, Homo Sapiens
RPVDYDFVS

SEQ ID NO: 1334439 - protein, 9 aa, Homo Sapiens
YDLETTSCS

SEQ ID NO: 1334440 - protein, 9 aa, Homo Sapiens
YFGIIAWPF

SEQ ID NO: 1334441 - protein, 9 aa, Homo Sapiens
RWRMSTWPS

SEQ ID NO: 1334442 - protein, 9 aa, Homo Sapiens
GHRPPIWVI

SEQ ID NO: 1334443 - protein, 9 aa, Homo Sapiens
RSRLRQHSV

SEQ ID NO: 1334444 - protein, 9 aa, Homo Sapiens
VLEHLKIFY

SEQ ID NO: 1334445 - protein, 9 aa, Homo Sapiens
YNMYASRLY

SEQ ID NO: 1334446 - protein, 9 aa, Homo Sapiens
VYKLNVGQW

SEQ ID NO: 1334447 - protein, 9 aa, Homo Sapiens
PLHFLQRAS

SEQ ID NO: 1334448 - protein, 9 aa, Homo Sapiens
AQTPLFTDV

SEQ ID NO: 1334449 - protein, 9 aa, Homo Sapiens
ELALVGPHA

SEQ ID NO: 1334450 - protein, 9 aa, Homo Sapiens
QTDVTMKGV

SEQ ID NO: 1334451 - protein, 9 aa, Homo Sapiens
STPVRSPTS

SEQ ID NO: 1334452 - protein, 9 aa, Homo Sapiens
LTLKMGSAI

SEQ ID NO: 1334453 - protein, 9 aa, Homo Sapiens
RTSLFANRW

SEQ ID NO: 1334454 - protein, 9 aa, Homo Sapiens
SDRELPSSV

SEQ ID NO: 1334455 - protein, 9 aa, Homo Sapiens
VTVKQSGEI

SEQ ID NO: 1334456 - protein, 9 aa, Homo Sapiens
YHVIRHTMN

SEQ ID NO: 1334457 - protein, 9 aa, Homo Sapiens
TIDEHDVII

SEQ ID NO: 1334458 - protein, 9 aa, Homo Sapiens
RNAVELVKK

SEQ ID NO: 1334459 - protein, 9 aa, Homo Sapiens
ARQAKAHPE

SEQ ID NO: 1334460 - protein, 9 aa, Homo Sapiens
NPVNRSLVL

SEQ ID NO: 1334461 - protein, 9 aa, Homo Sapiens
VTRGHQLYQ

SEQ ID NO: 1334462 - protein, 9 aa, Homo Sapiens
AEGKNIDDL

SEQ ID NO: 1334463 - protein, 9 aa, Homo Sapiens
KTGISLNVL

SEQ ID NO: 1334464 - protein, 9 aa, Homo Sapiens
LHFLQILRM

SEQ ID NO: 1334465 - protein, 9 aa, Homo Sapiens
LCLRNDWEI

SEQ ID NO: 1334466 - protein, 9 aa, Homo Sapiens
YERHGESQY

SEQ ID NO: 1334467 - protein, 9 aa, Homo Sapiens
NTGTTIQCV

SEQ ID NO: 1334468 - protein, 9 aa, Homo Sapiens
KDDKSPLHM

SEQ ID NO: 1334469 - protein, 9 aa, Homo Sapiens
KHIQEEEAE

SEQ ID NO: 1334470 - protein, 9 aa, Homo Sapiens
VSPTAIKKT

SEQ ID NO: 1334471 - protein, 9 aa, Homo Sapiens
RTWSKGVRV

SEQ ID NO: 1334472 - protein, 9 aa, Homo Sapiens
VASRPPVHI

SEQ ID NO: 1334473 - protein, 9 aa, Homo Sapiens
KQAFDYAYI

SEQ ID NO: 1334474 - protein, 9 aa, Homo Sapiens
KVVPYNRMK

SEQ ID NO: 1334475 - protein, 9 aa, Homo Sapiens
SCLIRLHGW

SEQ ID NO: 1334476 - protein, 9 aa, Homo Sapiens
IARTILVLV

SEQ ID NO: 1334477 - protein, 9 aa, Homo Sapiens
PIRPKSHPK

SEQ ID NO: 1334478 - protein, 9 aa, Homo Sapiens
LKRQHSLYI

SEQ ID NO: 1334479 - protein, 9 aa, Homo Sapiens
QQMEWQRYL

SEQ ID NO: 1334480 - protein, 9 aa, Homo Sapiens
MSYPCFVDD

SEQ ID NO: 1334481 - protein, 9 aa, Homo Sapiens
HFTCTVDTE

SEQ ID NO: 1334482 - protein, 9 aa, Homo Sapiens
SQTHSLILI

SEQ ID NO: 1334483 - protein, 9 aa, Homo Sapiens
GCITIPESD

SEQ ID NO: 1334484 - protein, 9 aa, Homo Sapiens
LHRPPNSAA

SEQ ID NO: 1334485 - protein, 9 aa, Homo Sapiens
MLMEIIQAK

SEQ ID NO: 1334486 - protein, 9 aa, Homo Sapiens
MNVIGHMSF

SEQ ID NO: 1334487 - protein, 9 aa, Homo Sapiens
VSEKGTVIR

SEQ ID NO: 1334488 - protein, 9 aa, Homo Sapiens
QGVTHITDD

SEQ ID NO: 1334489 - protein, 9 aa, Homo Sapiens
GMGAQLWGP

SEQ ID NO: 1334490 - protein, 9 aa, Homo Sapiens
RSYEAITKH

SEQ ID NO: 1334491 - protein, 9 aa, Homo Sapiens
FITVITSMN

SEQ ID NO: 1334492 - protein, 9 aa, Homo Sapiens
QALLSSINQ

SEQ ID NO: 1334493 - protein, 9 aa, Homo Sapiens
IVYANQEVS

SEQ ID NO: 1334494 - protein, 9 aa, Homo Sapiens
PLTYDSVRL

SEQ ID NO: 1334495 - protein, 9 aa, Homo Sapiens
MKREVDEAT

SEQ ID NO: 1334496 - protein, 9 aa, Homo Sapiens
KTEQSAALA

SEQ ID NO: 1334497 - protein, 9 aa, Homo Sapiens
VCMSHLEDI

SEQ ID NO: 1334498 - protein, 9 aa, Homo Sapiens
DIWSFGVLL

SEQ ID NO: 1334499 - protein, 9 aa, Homo Sapiens
TLYSAGEEN

SEQ ID NO: 1334500 - protein, 9 aa, Homo Sapiens
TPMTSATGG

SEQ ID NO: 1334501 - protein, 9 aa, Homo Sapiens
LGSKYFTLY

SEQ ID NO: 1334502 - protein, 9 aa, Homo Sapiens
KCDPATLKL

SEQ ID NO: 1334503 - protein, 9 aa, Homo Sapiens
ALCCLEEFS

SEQ ID NO: 1334504 - protein, 9 aa, Homo Sapiens
KVDIYKLTG

SEQ ID NO: 1334505 - protein, 9 aa, Homo Sapiens
QLQIQLDDI

SEQ ID NO: 1334506 - protein, 9 aa, Homo Sapiens
GEKLYVCSE

SEQ ID NO: 1334507 - protein, 9 aa, Homo Sapiens
AIKDCLKII

SEQ ID NO: 1334508 - protein, 9 aa, Homo Sapiens
NPVNSKKST

SEQ ID NO: 1334509 - protein, 9 aa, Homo Sapiens
IAVSHRNNS

SEQ ID NO: 1334510 - protein, 9 aa, Homo Sapiens
FDDTCHGNP

SEQ ID NO: 1334511 - protein, 9 aa, Homo Sapiens
VETLYKEIL

SEQ ID NO: 1334512 - protein, 9 aa, Homo Sapiens
ETSMQPPEI

SEQ ID NO: 1334513 - protein, 9 aa, Homo Sapiens
MAYDRYVVI

SEQ ID NO: 1334514 - protein, 9 aa, Homo Sapiens
HRTHGQKHQ

SEQ ID NO: 1334515 - protein, 9 aa, Homo Sapiens
ARRELHTTT

SEQ ID NO: 1334516 - protein, 9 aa, Homo Sapiens
HFCTPGPPA

SEQ ID NO: 1334517 - protein, 9 aa, Homo Sapiens
ATTSDSKGT

SEQ ID NO: 1334518 - protein, 9 aa, Homo Sapiens
QPNEMSENE

SEQ ID NO: 1334519 - protein, 9 aa, Homo Sapiens
RQSKHPMTN

SEQ ID NO: 1334520 - protein, 9 aa, Homo Sapiens
ELKQDTQNV

SEQ ID NO: 1334521 - protein, 9 aa, Homo Sapiens
HNEDTVRFT

SEQ ID NO: 1334522 - protein, 9 aa, Homo Sapiens
HYLEPGIPP

SEQ ID NO: 1334523 - protein, 9 aa, Homo Sapiens
HIQSMLHRW

SEQ ID NO: 1334524 - protein, 9 aa, Homo Sapiens
RNFLPGGRR

SEQ ID NO: 1334525 - protein, 9 aa, Homo Sapiens
LEAQKRKKE

SEQ ID NO: 1334526 - protein, 9 aa, Homo Sapiens
KLKEMCSDV

SEQ ID NO: 1334527 - protein, 9 aa, Homo Sapiens
TRTEHSVLE

SEQ ID NO: 1334528 - protein, 9 aa, Homo Sapiens
GRRRRHNLR

SEQ ID NO: 1334529 - protein, 9 aa, Homo Sapiens
LNPEFIQSA

SEQ ID NO: 1334530 - protein, 9 aa, Homo Sapiens
FTNTHITEH

SEQ ID NO: 1334531 - protein, 9 aa, Homo Sapiens
EVKAPVPSV

SEQ ID NO: 1334532 - protein, 9 aa, Homo Sapiens
LEEFYAGDW

SEQ ID NO: 1334533 - protein, 9 aa, Homo Sapiens
EKPHACTQC

SEQ ID NO: 1334534 - protein, 9 aa, Homo Sapiens
YEYGECGKA

SEQ ID NO: 1334535 - protein, 9 aa, Homo Sapiens
AEGEEEKSE

SEQ ID NO: 1334536 - protein, 9 aa, Homo Sapiens
QAKQAVHCM

SEQ ID NO: 1334537 - protein, 9 aa, Homo Sapiens
NTLKAKLQE

SEQ ID NO: 1334538 - protein, 9 aa, Homo Sapiens
RTKSDTSCM

SEQ ID NO: 1334539 - protein, 9 aa, Homo Sapiens
RLCWSLHNS

SEQ ID NO: 1334540 - protein, 9 aa, Homo Sapiens
FGPDSTGPN

SEQ ID NO: 1334541 - protein, 9 aa, Homo Sapiens
HLEGGITFV

SEQ ID NO: 1334542 - protein, 9 aa, Homo Sapiens
VYPDDIRHI

SEQ ID NO: 1334543 - protein, 9 aa, Homo Sapiens
KTCQIRQYH

SEQ ID NO: 1334544 - protein, 9 aa, Homo Sapiens
PSPSRRRAP

SEQ ID NO: 1334545 - protein, 9 aa, Homo Sapiens
TSEIGSAFN

SEQ ID NO: 1334546 - protein, 9 aa, Homo Sapiens
YGFGIMCIY

SEQ ID NO: 1334547 - protein, 9 aa, Homo Sapiens
KGQHFGLGS

SEQ ID NO: 1334548 - protein, 9 aa, Homo Sapiens
KSCFLYLPL

SEQ ID NO: 1334549 - protein, 9 aa, Homo Sapiens
REHQPLSIQ

SEQ ID NO: 1334550 - protein, 9 aa, Homo Sapiens
IRNTRRTAQ

SEQ ID NO: 1334551 - protein, 9 aa, Homo Sapiens
SVTDLTFKV

SEQ ID NO: 1334552 - protein, 9 aa, Homo Sapiens
VAYGFLITR

SEQ ID NO: 1334553 - protein, 9 aa, Homo Sapiens
CALPLEARK

SEQ ID NO: 1334554 - protein, 9 aa, Homo Sapiens
AGHQHNASD

SEQ ID NO: 1334555 - protein, 9 aa, Homo Sapiens
MSIESPFNH

SEQ ID NO: 1334556 - protein, 9 aa, Homo Sapiens
KRSSLEKPN

SEQ ID NO: 1334557 - protein, 9 aa, Homo Sapiens
DVAALLMEG

SEQ ID NO: 1334558 - protein, 9 aa, Homo Sapiens
VSCLQGLHL

SEQ ID NO: 1334559 - protein, 9 aa, Homo Sapiens
PIQLQTPHA

SEQ ID NO: 1334560 - protein, 9 aa, Homo Sapiens
CSWRQNDKP

SEQ ID NO: 1334561 - protein, 9 aa, Homo Sapiens
IIAGNPAYR

SEQ ID NO: 1334562 - protein, 9 aa, Homo Sapiens
SSWAVLSSS

SEQ ID NO: 1334563 - protein, 9 aa, Homo Sapiens
PLGYHQDDP

SEQ ID NO: 1334564 - protein, 9 aa, Homo Sapiens
QLALFYQGP

SEQ ID NO: 1334565 - protein, 9 aa, Homo Sapiens
EVSVVDRVS

SEQ ID NO: 1334566 - protein, 9 aa, Homo Sapiens
NRLADLIEW

SEQ ID NO: 1334567 - protein, 9 aa, Homo Sapiens
SLRWDVAHF

SEQ ID NO: 1334568 - protein, 9 aa, Homo Sapiens
HTASVRADT

SEQ ID NO: 1334569 - protein, 9 aa, Homo Sapiens
LRSPRVFPV

SEQ ID NO: 1334570 - protein, 9 aa, Homo Sapiens
AELQKYSVL

SEQ ID NO: 1334571 - protein, 9 aa, Homo Sapiens
KLMRERKFH

SEQ ID NO: 1334572 - protein, 9 aa, Homo Sapiens
ERTLVNDGK

SEQ ID NO: 1334573 - protein, 9 aa, Homo Sapiens
STCGRSGER

SEQ ID NO: 1334574 - protein, 9 aa, Homo Sapiens
DPKGLMIFA

SEQ ID NO: 1334575 - protein, 9 aa, Homo Sapiens
HKSNSIKWQ

SEQ ID NO: 1334576 - protein, 9 aa, Homo Sapiens
TFHYIIEQE

SEQ ID NO: 1334577 - protein, 9 aa, Homo Sapiens
DGVLALCCL

SEQ ID NO: 1334578 - protein, 9 aa, Homo Sapiens
MASFYSMST

SEQ ID NO: 1334579 - protein, 9 aa, Homo Sapiens
MLRQATKCA

SEQ ID NO: 1334580 - protein, 9 aa, Homo Sapiens
TIDGLVDLT

SEQ ID NO: 1334581 - protein, 9 aa, Homo Sapiens
QQVFYNDPS

SEQ ID NO: 1334582 - protein, 9 aa, Homo Sapiens
VGLDIWNSQ

SEQ ID NO: 1334583 - protein, 9 aa, Homo Sapiens
MGTSFKVYY

SEQ ID NO: 1334584 - protein, 9 aa, Homo Sapiens
LPLHFLQRA

SEQ ID NO: 1334585 - protein, 9 aa, Homo Sapiens
HDLLLTRTI

SEQ ID NO: 1334586 - protein, 9 aa, Homo Sapiens
QTAAALKRA

SEQ ID NO: 1334587 - protein, 9 aa, Homo Sapiens
NVRHICYFL

SEQ ID NO: 1334588 - protein, 9 aa, Homo Sapiens
GPKGAGLQF

SEQ ID NO: 1334589 - protein, 9 aa, Homo Sapiens
YTNLYDIKR

SEQ ID NO: 1334590 - protein, 9 aa, Homo Sapiens
KAPVPSVCF

SEQ ID NO: 1334591 - protein, 9 aa, Homo Sapiens
RALQNTLKA

SEQ ID NO: 1334592 - protein, 9 aa, Homo Sapiens
RTYEPDSVL

SEQ ID NO: 1334593 - protein, 9 aa, Homo Sapiens
GVNVAFQAE

SEQ ID NO: 1334594 - protein, 9 aa, Homo Sapiens
EMPLFKLYI

SEQ ID NO: 1334595 - protein, 9 aa, Homo Sapiens
CEQDREPLH

SEQ ID NO: 1334596 - protein, 9 aa, Homo Sapiens
PMDADEDMT

SEQ ID NO: 1334597 - protein, 9 aa, Homo Sapiens
TGEKHYECE

SEQ ID NO: 1334598 - protein, 9 aa, Homo Sapiens
SPGRHKSES

SEQ ID NO: 1334599 - protein, 9 aa, Homo Sapiens
VYVEMRREA

SEQ ID NO: 1334600 - protein, 9 aa, Homo Sapiens
FVNYMMSSH

SEQ ID NO: 1334601 - protein, 9 aa, Homo Sapiens
KADVVRVIT

SEQ ID NO: 1334602 - protein, 9 aa, Homo Sapiens
TQVGLRGFY

SEQ ID NO: 1334603 - protein, 9 aa, Homo Sapiens
HPSIKTHDP

SEQ ID NO: 1334604 - protein, 9 aa, Homo Sapiens
ICSILPYLA

SEQ ID NO: 1334605 - protein, 9 aa, Homo Sapiens
SCVVALHSL

SEQ ID NO: 1334606 - protein, 9 aa, Homo Sapiens
NLEAQTELC

SEQ ID NO: 1334607 - protein, 9 aa, Homo Sapiens
LVTSPCCII

SEQ ID NO: 1334608 - protein, 9 aa, Homo Sapiens
KMSEAEENK

SEQ ID NO: 1334609 - protein, 9 aa, Homo Sapiens
TEVTLWMQS

SEQ ID NO: 1334610 - protein, 9 aa, Homo Sapiens
GNQNPVNQF

SEQ ID NO: 1334611 - protein, 9 aa, Homo Sapiens
VLLRQGHDP

SEQ ID NO: 1334612 - protein, 9 aa, Homo Sapiens
ERINQLICQ

SEQ ID NO: 1334613 - protein, 9 aa, Homo Sapiens
RPGMLKEET

SEQ ID NO: 1334614 - protein, 9 aa, Homo Sapiens
RMSPGMAQK

SEQ ID NO: 1334615 - protein, 9 aa, Homo Sapiens
VSHLRTLRV

SEQ ID NO: 1334616 - protein, 9 aa, Homo Sapiens
RTVVSMLVS

SEQ ID NO: 1334617 - protein, 9 aa, Homo Sapiens
WFLYKMHDI

SEQ ID NO: 1334618 - protein, 9 aa, Homo Sapiens
SSHVSSEAG

SEQ ID NO: 1334619 - protein, 9 aa, Homo Sapiens
FTSVFQPPL

SEQ ID NO: 1334620 - protein, 9 aa, Homo Sapiens
MTTVLTGLA

SEQ ID NO: 1334621 - protein, 9 aa, Homo Sapiens
LTVSQTYSG

SEQ ID NO: 1334622 - protein, 9 aa, Homo Sapiens
MLYVPLVLK

SEQ ID NO: 1334623 - protein, 9 aa, Homo Sapiens
ERPRACPPD

SEQ ID NO: 1334624 - protein, 9 aa, Homo Sapiens
PAYTKVKSK

SEQ ID NO: 1334625 - protein, 9 aa, Homo Sapiens
STTFLSDLE

SEQ ID NO: 1334626 - protein, 9 aa, Homo Sapiens
HVHIQSMLH

SEQ ID NO: 1334627 - protein, 9 aa, Homo Sapiens
LIGDDIGLT

SEQ ID NO: 1334628 - protein, 9 aa, Homo Sapiens
DVVSKANFS

SEQ ID NO: 1334629 - protein, 9 aa, Homo Sapiens
QYGHMKIMA

SEQ ID NO: 1334630 - protein, 9 aa, Homo Sapiens
QIHLSAHTI

SEQ ID NO: 1334631 - protein, 9 aa, Homo Sapiens
KVHMKTHNG

SEQ ID NO: 1334632 - protein, 9 aa, Homo Sapiens
ISVMPKRGL

SEQ ID NO: 1334633 - protein, 9 aa, Homo Sapiens
PVSRHLVSL

SEQ ID NO: 1334634 - protein, 9 aa, Homo Sapiens
EAKQQKCPF

SEQ ID NO: 1334635 - protein, 9 aa, Homo Sapiens
QLWLLVCER

SEQ ID NO: 1334636 - protein, 9 aa, Homo Sapiens
LPGLYRLEH

SEQ ID NO: 1334637 - protein, 9 aa, Homo Sapiens
NVIKRTSPS

SEQ ID NO: 1334638 - protein, 9 aa, Homo Sapiens
LHPNTFSTF

SEQ ID NO: 1334639 - protein, 9 aa, Homo Sapiens
HCLRPIWGR

SEQ ID NO: 1334640 - protein, 9 aa, Homo Sapiens
KNDVESAKM

SEQ ID NO: 1334641 - protein, 9 aa, Homo Sapiens
HLPIFSSIF

SEQ ID NO: 1334642 - protein, 9 aa, Homo Sapiens
PGTEEECGA

SEQ ID NO: 1334643 - protein, 9 aa, Homo Sapiens
SDTHWCWVE

SEQ ID NO: 1334644 - protein, 9 aa, Homo Sapiens
GTEDKRSQE

SEQ ID NO: 1334645 - protein, 9 aa, Homo Sapiens
LHYEVDAQW

SEQ ID NO: 1334646 - protein, 9 aa, Homo Sapiens
DEDWLLLCD

SEQ ID NO: 1334647 - protein, 9 aa, Homo Sapiens
HEMKTRFLI

SEQ ID NO: 1334648 - protein, 9 aa, Homo Sapiens
TEFDKIHST

SEQ ID NO: 1334649 - protein, 9 aa, Homo Sapiens
NLARAVYSD

SEQ ID NO: 1334650 - protein, 9 aa, Homo Sapiens
EKFYVIDCH

SEQ ID NO: 1334651 - protein, 9 aa, Homo Sapiens
VEHIPKALE

SEQ ID NO: 1334652 - protein, 9 aa, Homo Sapiens
AVQYQFTDS

SEQ ID NO: 1334653 - protein, 9 aa, Homo Sapiens
DRSKKILPL

SEQ ID NO: 1334654 - protein, 9 aa, Homo Sapiens
MQNTKTCTK

SEQ ID NO: 1334655 - protein, 9 aa, Homo Sapiens
DITLMRLSK

SEQ ID NO: 1334656 - protein, 9 aa, Homo Sapiens
PLLLAYLNS

SEQ ID NO: 1334657 - protein, 9 aa, Homo Sapiens
DIVAMFHQY

SEQ ID NO: 1334658 - protein, 9 aa, Homo Sapiens
SRSARTGRC

SEQ ID NO: 1334659 - protein, 9 aa, Homo Sapiens
HEKQKLFQE

SEQ ID NO: 1334660 - protein, 9 aa, Homo Sapiens
DSLKARMRQ

SEQ ID NO: 1334661 - protein, 9 aa, Homo Sapiens
MKVEEPKIT

SEQ ID NO: 1334662 - protein, 9 aa, Homo Sapiens
KGDTPLHIV

SEQ ID NO: 1334663 - protein, 9 aa, Homo Sapiens
LKTDDILWQ

SEQ ID NO: 1334664 - protein, 9 aa, Homo Sapiens
LYCLDNPYP

SEQ ID NO: 1334665 - protein, 9 aa, Homo Sapiens
EIYGLMKVG

SEQ ID NO: 1334666 - protein, 9 aa, Homo Sapiens
SLHRLQADY

SEQ ID NO: 1334667 - protein, 9 aa, Homo Sapiens
PDEVISIRG

SEQ ID NO: 1334668 - protein, 9 aa, Homo Sapiens
RPGHPDTPP

SEQ ID NO: 1334669 - protein, 9 aa, Homo Sapiens
SKKKPLLLT

SEQ ID NO: 1334670 - protein, 9 aa, Homo Sapiens
IRVLASNGH

SEQ ID NO: 1334671 - protein, 9 aa, Homo Sapiens
PSWLLPAPW

SEQ ID NO: 1334672 - protein, 9 aa, Homo Sapiens
KKAGVKTQK

SEQ ID NO: 1334673 - protein, 9 aa, Homo Sapiens
YVHWKGQVL

SEQ ID NO: 1334674 - protein, 9 aa, Homo Sapiens
VHLAQLTIP

SEQ ID NO: 1334675 - protein, 9 aa, Homo Sapiens
RTDRILMKV

SEQ ID NO: 1334676 - protein, 9 aa, Homo Sapiens
LETIFTKSY

SEQ ID NO: 1334677 - protein, 9 aa, Homo Sapiens
QALATLSAP

SEQ ID NO: 1334678 - protein, 9 aa, Homo Sapiens
RKRIARTIL

SEQ ID NO: 1334679 - protein, 9 aa, Homo Sapiens
ILPVKIRPQ

SEQ ID NO: 1334680 - protein, 9 aa, Homo Sapiens
NRTFQEKAS

SEQ ID NO: 1334681 - protein, 9 aa, Homo Sapiens
LLFQKRQCR

SEQ ID NO: 1334682 - protein, 9 aa, Homo Sapiens
WELFPNQQS

SEQ ID NO: 1334683 - protein, 9 aa, Homo Sapiens
LGQALHLNR

SEQ ID NO: 1334684 - protein, 9 aa, Homo Sapiens
LGLVVKHDS

SEQ ID NO: 1334685 - protein, 9 aa, Homo Sapiens
MGEICWPGT

SEQ ID NO: 1334686 - protein, 9 aa, Homo Sapiens
IPDVKNDFV

SEQ ID NO: 1334687 - protein, 9 aa, Homo Sapiens
YDPKGLMIF

SEQ ID NO: 1334688 - protein, 9 aa, Homo Sapiens
AASFYAHFF

SEQ ID NO: 1334689 - protein, 9 aa, Homo Sapiens
SVMVRTILP

SEQ ID NO: 1334690 - protein, 9 aa, Homo Sapiens
CALYCGQGV

SEQ ID NO: 1334691 - protein, 9 aa, Homo Sapiens
HRFLYIVNL

SEQ ID NO: 1334692 - protein, 9 aa, Homo Sapiens
ARASPSTRG

SEQ ID NO: 1334693 - protein, 9 aa, Homo Sapiens
REGDMWICM

SEQ ID NO: 1334694 - protein, 9 aa, Homo Sapiens
QRKEHKNRM

SEQ ID NO: 1334695 - protein, 9 aa, Homo Sapiens
SKSYFEHIS

SEQ ID NO: 1334696 - protein, 9 aa, Homo Sapiens
ADSYDPGEE

SEQ ID NO: 1334697 - protein, 9 aa, Homo Sapiens
SSWTCLADL

SEQ ID NO: 1334698 - protein, 9 aa, Homo Sapiens
LISSYNLQA

SEQ ID NO: 1334699 - protein, 9 aa, Homo Sapiens
YFRSWDVDD

SEQ ID NO: 1334700 - protein, 9 aa, Homo Sapiens
KAVVAAHIQ

SEQ ID NO: 1334701 - protein, 9 aa, Homo Sapiens
WDHEERPTQ

SEQ ID NO: 1334702 - protein, 9 aa, Homo Sapiens
RCLGLAGEF

SEQ ID NO: 1334703 - protein, 9 aa, Homo Sapiens
PVFEGEHSN

SEQ ID NO: 1334704 - protein, 9 aa, Homo Sapiens
LTIVMLIVP

SEQ ID NO: 1334705 - protein, 9 aa, Homo Sapiens
GLSHKSSDA

SEQ ID NO: 1334706 - protein, 9 aa, Homo Sapiens
PDWEWTKLD

SEQ ID NO: 1334707 - protein, 9 aa, Homo Sapiens
EDIIVSKRK

SEQ ID NO: 1334708 - protein, 9 aa, Homo Sapiens
KFMEKGEKV

SEQ ID NO: 1334709 - protein, 9 aa, Homo Sapiens
EGANPQMFH

SEQ ID NO: 1334710 - protein, 9 aa, Homo Sapiens
DIFDCLEGR

SEQ ID NO: 1334711 - protein, 9 aa, Homo Sapiens
KCLHQEYGV

SEQ ID NO: 1334712 - protein, 9 aa, Homo Sapiens
LIKILAYDE

SEQ ID NO: 1334713 - protein, 9 aa, Homo Sapiens
LYACRQDDM

SEQ ID NO: 1334714 - protein, 9 aa, Homo Sapiens
IDAERVDQA

SEQ ID NO: 1334715 - protein, 9 aa, Homo Sapiens
AIQRFNPCL

SEQ ID NO: 1334716 - protein, 9 aa, Homo Sapiens
QYMGNRFVQ

SEQ ID NO: 1334717 - protein, 9 aa, Homo Sapiens
ATSAALLSS

SEQ ID NO: 1334718 - protein, 9 aa, Homo Sapiens
IFIADFELL

SEQ ID NO: 1334719 - protein, 9 aa, Homo Sapiens
QHLRLLDGT

SEQ ID NO: 1334720 - protein, 9 aa, Homo Sapiens
DFVFLLHMV

SEQ ID NO: 1334721 - protein, 9 aa, Homo Sapiens
VVTPTTFSE

SEQ ID NO: 1334722 - protein, 9 aa, Homo Sapiens
NPEFIQSAT

SEQ ID NO: 1334723 - protein, 9 aa, Homo Sapiens
LVVTLLVWY

SEQ ID NO: 1334724 - protein, 9 aa, Homo Sapiens
WIDRIHTPR

SEQ ID NO: 1334725 - protein, 9 aa, Homo Sapiens
VAFLGCMDS

SEQ ID NO: 1334726 - protein, 9 aa, Homo Sapiens
QQMGADSMY

SEQ ID NO: 1334727 - protein, 9 aa, Homo Sapiens
EPQMVLYLQ

SEQ ID NO: 1334728 - protein, 9 aa, Homo Sapiens
VAFDSFILC

SEQ ID NO: 1334729 - protein, 9 aa, Homo Sapiens
GWEKKLQND

SEQ ID NO: 1334730 - protein, 9 aa, Homo Sapiens
SSPSTLSIK

SEQ ID NO: 1334731 - protein, 9 aa, Homo Sapiens
QKVHEEANA

SEQ ID NO: 1334732 - protein, 9 aa, Homo Sapiens
KDISVKIKI

SEQ ID NO: 1334733 - protein, 9 aa, Homo Sapiens
LEGNANGGL

SEQ ID NO: 1334734 - protein, 9 aa, Homo Sapiens
PITSYVSIN

SEQ ID NO: 1334735 - protein, 9 aa, Homo Sapiens
RHPHQIADL

SEQ ID NO: 1334736 - protein, 9 aa, Homo Sapiens
GEVINATGS

SEQ ID NO: 1334737 - protein, 9 aa, Homo Sapiens
VKIYQIYEG

SEQ ID NO: 1334738 - protein, 9 aa, Homo Sapiens
LVIHYFRAL

SEQ ID NO: 1334739 - protein, 9 aa, Homo Sapiens
ALTSIANVE

SEQ ID NO: 1334740 - protein, 9 aa, Homo Sapiens
YEDILFFLS

SEQ ID NO: 1334741 - protein, 9 aa, Homo Sapiens
HFEELLVFV

SEQ ID NO: 1334742 - protein, 9 aa, Homo Sapiens
GRPSPCLSW

SEQ ID NO: 1334743 - protein, 9 aa, Homo Sapiens
DTIFDVSVE

SEQ ID NO: 1334744 - protein, 9 aa, Homo Sapiens
KSLPCRQPA

SEQ ID NO: 1334745 - protein, 9 aa, Homo Sapiens
EEESGVKVD

SEQ ID NO: 1334746 - protein, 9 aa, Homo Sapiens
RLHMHGPNL

SEQ ID NO: 1334747 - protein, 9 aa, Homo Sapiens
ALVTLVPPQ

SEQ ID NO: 1334748 - protein, 9 aa, Homo Sapiens
SGQYIVIAP

SEQ ID NO: 1334749 - protein, 9 aa, Homo Sapiens
KPKRGRSKS

SEQ ID NO: 1334750 - protein, 9 aa, Homo Sapiens
SEDLHVFTP

SEQ ID NO: 1334751 - protein, 9 aa, Homo Sapiens
EMTKLLQDL

SEQ ID NO: 1334752 - protein, 9 aa, Homo Sapiens
SLENCRRRS

SEQ ID NO: 1334753 - protein, 9 aa, Homo Sapiens
NDLVTSVDS

SEQ ID NO: 1334754 - protein, 9 aa, Homo Sapiens
VVDSKRCSA

SEQ ID NO: 1334755 - protein, 9 aa, Homo Sapiens
CICVNMSVS

SEQ ID NO: 1334756 - protein, 9 aa, Homo Sapiens
EPDFHIAGD

SEQ ID NO: 1334757 - protein, 9 aa, Homo Sapiens
VLLHHTHDE

SEQ ID NO: 1334758 - protein, 9 aa, Homo Sapiens
PIPWAYIKM

SEQ ID NO: 1334759 - protein, 9 aa, Homo Sapiens
KSIRARLVF

SEQ ID NO: 1334760 - protein, 9 aa, Homo Sapiens
DKDDDEGSP

SEQ ID NO: 1334761 - protein, 9 aa, Homo Sapiens
RFGNTDGAA

SEQ ID NO: 1334762 - protein, 9 aa, Homo Sapiens
SKCNDLVTS

SEQ ID NO: 1334763 - protein, 9 aa, Homo Sapiens
LAGTIIPPT

SEQ ID NO: 1334764 - protein, 9 aa, Homo Sapiens
RDGTVTTYW

SEQ ID NO: 1334765 - protein, 9 aa, Homo Sapiens
FTYTVLLDG

SEQ ID NO: 1334766 - protein, 9 aa, Homo Sapiens
CRMTFTQSS

SEQ ID NO: 1334767 - protein, 9 aa, Homo Sapiens
ISQGHLGPG

SEQ ID NO: 1334768 - protein, 9 aa, Homo Sapiens
EYGAWKHHY

SEQ ID NO: 1334769 - protein, 9 aa, Homo Sapiens
EIEDPSVIG

SEQ ID NO: 1334770 - protein, 9 aa, Homo Sapiens
IFHINPHLP

SEQ ID NO: 1334771 - protein, 9 aa, Homo Sapiens
AETVVKCDI

SEQ ID NO: 1334772 - protein, 9 aa, Homo Sapiens
RKCPHAHLR

SEQ ID NO: 1334773 - protein, 9 aa, Homo Sapiens
LNEDANGFM

SEQ ID NO: 1334774 - protein, 9 aa, Homo Sapiens
WERGWEPAA

SEQ ID NO: 1334775 - protein, 9 aa, Homo Sapiens
HQDIKPQNL

SEQ ID NO: 1334776 - protein, 9 aa, Homo Sapiens
QDVHKNSTK

SEQ ID NO: 1334777 - protein, 9 aa, Homo Sapiens
SVIYIINIH

SEQ ID NO: 1334778 - protein, 9 aa, Homo Sapiens
LPEQIFFRW

SEQ ID NO: 1334779 - protein, 9 aa, Homo Sapiens
RRRTHEFED

SEQ ID NO: 1334780 - protein, 9 aa, Homo Sapiens
GEQHYKDAM

SEQ ID NO: 1334781 - protein, 9 aa, Homo Sapiens
YLAHFLIKL

SEQ ID NO: 1334782 - protein, 9 aa, Homo Sapiens
LQKAIEGYT

SEQ ID NO: 1334783 - protein, 9 aa, Homo Sapiens
WLGYVNFLI

SEQ ID NO: 1334784 - protein, 9 aa, Homo Sapiens
KVSAFAFME

SEQ ID NO: 1334785 - protein, 9 aa, Homo Sapiens
SIDADVFEV

SEQ ID NO: 1334786 - protein, 9 aa, Homo Sapiens
CHVFEILSH

SEQ ID NO: 1334787 - protein, 9 aa, Homo Sapiens
HPISHHIPA

SEQ ID NO: 1334788 - protein, 9 aa, Homo Sapiens
AEVQSEIEH

SEQ ID NO: 1334789 - protein, 9 aa, Homo Sapiens
RGKDGLLDT

SEQ ID NO: 1334790 - protein, 9 aa, Homo Sapiens
HMDRREHGH

SEQ ID NO: 1334791 - protein, 9 aa, Homo Sapiens
LKDDFEVFF

SEQ ID NO: 1334792 - protein, 9 aa, Homo Sapiens
SGAPQDSIR

SEQ ID NO: 1334793 - protein, 9 aa, Homo Sapiens
TGRLMRICV

SEQ ID NO: 1334794 - protein, 9 aa, Homo Sapiens
GNMCKKFEG

SEQ ID NO: 1334795 - protein, 9 aa, Homo Sapiens
RPHYNYYVT

SEQ ID NO: 1334796 - protein, 9 aa, Homo Sapiens
EARASDLLQ

SEQ ID NO: 1334797 - protein, 9 aa, Homo Sapiens
PEQLPRDEV

SEQ ID NO: 1334798 - protein, 9 aa, Homo Sapiens
SNATPCTVL

SEQ ID NO: 1334799 - protein, 9 aa, Homo Sapiens
AGGRQFAQH

SEQ ID NO: 1334800 - protein, 9 aa, Homo Sapiens
EGTIACLQF

SEQ ID NO: 1334801 - protein, 9 aa, Homo Sapiens
IISDNCVVI

SEQ ID NO: 1334802 - protein, 9 aa, Homo Sapiens
IQVLKKRRN

SEQ ID NO: 1334803 - protein, 9 aa, Homo Sapiens
DSTTRGNRP

SEQ ID NO: 1334804 - protein, 9 aa, Homo Sapiens
KSMKLERHW

SEQ ID NO: 1334805 - protein, 9 aa, Homo Sapiens
TIRDLVFME

SEQ ID NO: 1334806 - protein, 9 aa, Homo Sapiens
KWVALPETM

SEQ ID NO: 1334807 - protein, 9 aa, Homo Sapiens
SVSLKSQLV

SEQ ID NO: 1334808 - protein, 9 aa, Homo Sapiens
VSATSEECT

SEQ ID NO: 1334809 - protein, 9 aa, Homo Sapiens
TAIKKTILD

SEQ ID NO: 1334810 - protein, 9 aa, Homo Sapiens
AESNMNNLV

SEQ ID NO: 1334811 - protein, 9 aa, Homo Sapiens
GPPRSRLAA

SEQ ID NO: 1334812 - protein, 9 aa, Homo Sapiens
CNRTIMTIG

SEQ ID NO: 1334813 - protein, 9 aa, Homo Sapiens
PDDDPIGPD

SEQ ID NO: 1334814 - protein, 9 aa, Homo Sapiens
KEDVSYIER

SEQ ID NO: 1334815 - protein, 9 aa, Homo Sapiens
EDEFDNGSM

SEQ ID NO: 1334816 - protein, 9 aa, Homo Sapiens
TSAAPARRP

SEQ ID NO: 1334817 - protein, 9 aa, Homo Sapiens
AYVISNILL

SEQ ID NO: 1334818 - protein, 9 aa, Homo Sapiens
VDKLNAKLA

SEQ ID NO: 1334819 - protein, 9 aa, Homo Sapiens
LLTILMVVM

SEQ ID NO: 1334820 - protein, 9 aa, Homo Sapiens
KGNQALYSW

SEQ ID NO: 1334821 - protein, 9 aa, Homo Sapiens
LGQEIMHFS

SEQ ID NO: 1334822 - protein, 9 aa, Homo Sapiens
MCWSCEHLI

SEQ ID NO: 1334823 - protein, 9 aa, Homo Sapiens
VSCHDIRKV

SEQ ID NO: 1334824 - protein, 9 aa, Homo Sapiens
VMLQRWMPQ

SEQ ID NO: 1334825 - protein, 9 aa, Homo Sapiens
CLRQRAPHL

SEQ ID NO: 1334826 - protein, 9 aa, Homo Sapiens
AVFKYCHFS

SEQ ID NO: 1334827 - protein, 9 aa, Homo Sapiens
FPNCFRSHN

SEQ ID NO: 1334828 - protein, 9 aa, Homo Sapiens
MRCLHNETY

SEQ ID NO: 1334829 - protein, 9 aa, Homo Sapiens
GPRLGVLPL

SEQ ID NO: 1334830 - protein, 9 aa, Homo Sapiens
NRIHMYSER

SEQ ID NO: 1334831 - protein, 9 aa, Homo Sapiens
EGIDTDTIE

SEQ ID NO: 1334832 - protein, 9 aa, Homo Sapiens
SRSLDDVRN

SEQ ID NO: 1334833 - protein, 9 aa, Homo Sapiens
FIHNIPFPS

SEQ ID NO: 1334834 - protein, 9 aa, Homo Sapiens
HTLLPVFLR

SEQ ID NO: 1334835 - protein, 9 aa, Homo Sapiens
NSEDDIYMM

SEQ ID NO: 1334836 - protein, 9 aa, Homo Sapiens
ALTLGPSVA

SEQ ID NO: 1334837 - protein, 9 aa, Homo Sapiens
EYIEKSFLM

SEQ ID NO: 1334838 - protein, 9 aa, Homo Sapiens
APQGQDSTQ

SEQ ID NO: 1334839 - protein, 9 aa, Homo Sapiens
MFSRLHRVG

SEQ ID NO: 1334840 - protein, 9 aa, Homo Sapiens
SANLLTQIL

SEQ ID NO: 1334841 - protein, 9 aa, Homo Sapiens
GWLQETHKG

SEQ ID NO: 1334842 - protein, 9 aa, Homo Sapiens
CVNGDNAHP

SEQ ID NO: 1334843 - protein, 9 aa, Homo Sapiens
AVHASVILT

SEQ ID NO: 1334844 - protein, 9 aa, Homo Sapiens
AHFFLSYLP

SEQ ID NO: 1334845 - protein, 9 aa, Homo Sapiens
WINKPWVYS

SEQ ID NO: 1334846 - protein, 9 aa, Homo Sapiens
DSYVCPCTL

SEQ ID NO: 1334847 - protein, 9 aa, Homo Sapiens
NMETDSSKS

SEQ ID NO: 1334848 - protein, 9 aa, Homo Sapiens
PVRPWVLLP

SEQ ID NO: 1334849 - protein, 9 aa, Homo Sapiens
QQQQLQINK

SEQ ID NO: 1334850 - protein, 9 aa, Homo Sapiens
LYILIGTVP

SEQ ID NO: 1334851 - protein, 9 aa, Homo Sapiens
LNDERIQAS

SEQ ID NO: 1334852 - protein, 9 aa, Homo Sapiens
QPHLCRELH

SEQ ID NO: 1334853 - protein, 9 aa, Homo Sapiens
EAAMRYVQF

SEQ ID NO: 1334854 - protein, 9 aa, Homo Sapiens
HFNSLPQAF

SEQ ID NO: 1334855 - protein, 9 aa, Homo Sapiens
EIYKKVKDD

SEQ ID NO: 1334856 - protein, 9 aa, Homo Sapiens
ADHSRMKHE

SEQ ID NO: 1334857 - protein, 9 aa, Homo Sapiens
LWNSREKGS

SEQ ID NO: 1334858 - protein, 9 aa, Homo Sapiens
PTSMDGPGQ

SEQ ID NO: 1334859 - protein, 9 aa, Homo Sapiens
VRFIAMALF

SEQ ID NO: 1334860 - protein, 9 aa, Homo Sapiens
LHDSKIMVC

SEQ ID NO: 1334861 - protein, 9 aa, Homo Sapiens
AAVRAVTHM

SEQ ID NO: 1334862 - protein, 9 aa, Homo Sapiens
DPSNTANRI

SEQ ID NO: 1334863 - protein, 9 aa, Homo Sapiens
TALGDGPGK

SEQ ID NO: 1334864 - protein, 9 aa, Homo Sapiens
ECHLLRLGH

SEQ ID NO: 1334865 - protein, 9 aa, Homo Sapiens
DSDGKLQEV

SEQ ID NO: 1334866 - protein, 9 aa, Homo Sapiens
REQQSAHTR

SEQ ID NO: 1334867 - protein, 9 aa, Homo Sapiens
MKGSNQFHA

SEQ ID NO: 1334868 - protein, 9 aa, Homo Sapiens
QLLGRNTVA

SEQ ID NO: 1334869 - protein, 9 aa, Homo Sapiens
AVTGPDPGS

SEQ ID NO: 1334870 - protein, 9 aa, Homo Sapiens
GTLESGHPI

SEQ ID NO: 1334871 - protein, 9 aa, Homo Sapiens
HVYEQVRAK

SEQ ID NO: 1334872 - protein, 9 aa, Homo Sapiens
HIDDREESF

SEQ ID NO: 1334873 - protein, 9 aa, Homo Sapiens
QSQLSMKSS

SEQ ID NO: 1334874 - protein, 9 aa, Homo Sapiens
AVLSSSTMT

SEQ ID NO: 1334875 - protein, 9 aa, Homo Sapiens
STGESCTMW

SEQ ID NO: 1334876 - protein, 9 aa, Homo Sapiens
VVNLNSKDL

SEQ ID NO: 1334877 - protein, 9 aa, Homo Sapiens
KESRGPCSD

SEQ ID NO: 1334878 - protein, 9 aa, Homo Sapiens
SGTLSSNVI

SEQ ID NO: 1334879 - protein, 9 aa, Homo Sapiens
SVEIDDNFL

SEQ ID NO: 1334880 - protein, 9 aa, Homo Sapiens
SKTKGKNKL

SEQ ID NO: 1334881 - protein, 9 aa, Homo Sapiens
INASYVVWK

SEQ ID NO: 1334882 - protein, 9 aa, Homo Sapiens
VAQDTTLIC

SEQ ID NO: 1334883 - protein, 9 aa, Homo Sapiens
ANEIYKKVK

SEQ ID NO: 1334884 - protein, 9 aa, Homo Sapiens
DSNSTIPVE

SEQ ID NO: 1334885 - protein, 9 aa, Homo Sapiens
LMELKVASQ

SEQ ID NO: 1334886 - protein, 9 aa, Homo Sapiens
SSDLNSQCL

SEQ ID NO: 1334887 - protein, 9 aa, Homo Sapiens
VMDKENHYL

SEQ ID NO: 1334888 - protein, 9 aa, Homo Sapiens
ISGGGRGAS

SEQ ID NO: 1334889 - protein, 9 aa, Homo Sapiens
WRDLEEATL

SEQ ID NO: 1334890 - protein, 9 aa, Homo Sapiens
FPTPFVHPT

SEQ ID NO: 1334891 - protein, 9 aa, Homo Sapiens
TNAGDHQLS

SEQ ID NO: 1334892 - protein, 9 aa, Homo Sapiens
ISVKIKIPP

SEQ ID NO: 1334893 - protein, 9 aa, Homo Sapiens
KYVEQRKKI

SEQ ID NO: 1334894 - protein, 9 aa, Homo Sapiens
IISDALEQL

SEQ ID NO: 1334895 - protein, 9 aa, Homo Sapiens
RQWQSIEGT

SEQ ID NO: 1334896 - protein, 9 aa, Homo Sapiens
VVSVPAPTN

SEQ ID NO: 1334897 - protein, 9 aa, Homo Sapiens
ASEELQKDI

SEQ ID NO: 1334898 - protein, 9 aa, Homo Sapiens
NLGAQQKIP

SEQ ID NO: 1334899 - protein, 9 aa, Homo Sapiens
DARMHLMKH

SEQ ID NO: 1334900 - protein, 9 aa, Homo Sapiens
DIYTPAYGD

SEQ ID NO: 1334901 - protein, 9 aa, Homo Sapiens
DAHLCPQQH

SEQ ID NO: 1334902 - protein, 9 aa, Homo Sapiens
KEERRTIDI

SEQ ID NO: 1334903 - protein, 9 aa, Homo Sapiens
THLNCAPKS

SEQ ID NO: 1334904 - protein, 9 aa, Homo Sapiens
PVRALLGPG

SEQ ID NO: 1334905 - protein, 9 aa, Homo Sapiens
PGMPLERKR

SEQ ID NO: 1334906 - protein, 9 aa, Homo Sapiens
GGGRDVPEA

SEQ ID NO: 1334907 - protein, 9 aa, Homo Sapiens
HRVRALQNT

SEQ ID NO: 1334908 - protein, 9 aa, Homo Sapiens
MWYVPHPKK

SEQ ID NO: 1334909 - protein, 9 aa, Homo Sapiens
LEVRMREVD

SEQ ID NO: 1334910 - protein, 9 aa, Homo Sapiens
AVFVICWLP

SEQ ID NO: 1334911 - protein, 9 aa, Homo Sapiens
SENSLITLR

SEQ ID NO: 1334912 - protein, 9 aa, Homo Sapiens
SQDPHTKAG

SEQ ID NO: 1334913 - protein, 9 aa, Homo Sapiens
KPCRRKKKV

SEQ ID NO: 1334914 - protein, 9 aa, Homo Sapiens
QIKVVKVFH

SEQ ID NO: 1334915 - protein, 9 aa, Homo Sapiens
KPEYPCSEE

SEQ ID NO: 1334916 - protein, 9 aa, Homo Sapiens
DASNLVGEE

SEQ ID NO: 1334917 - protein, 9 aa, Homo Sapiens
IMVQLEERK

SEQ ID NO: 1334918 - protein, 9 aa, Homo Sapiens
KLVANMFSI

SEQ ID NO: 1334919 - protein, 9 aa, Homo Sapiens
HNFIALEIV

SEQ ID NO: 1334920 - protein, 9 aa, Homo Sapiens
DDEAMLQKC

SEQ ID NO: 1334921 - protein, 9 aa, Homo Sapiens
FIITAVTVG

SEQ ID NO: 1334922 - protein, 9 aa, Homo Sapiens
SRLVGQIND

SEQ ID NO: 1334923 - protein, 9 aa, Homo Sapiens
GSCPEHITT

SEQ ID NO: 1334924 - protein, 9 aa, Homo Sapiens
VTGWCVGFL

SEQ ID NO: 1334925 - protein, 9 aa, Homo Sapiens
TRSPFHVVW

SEQ ID NO: 1334926 - protein, 9 aa, Homo Sapiens
NGYLCFHYG

SEQ ID NO: 1334927 - protein, 9 aa, Homo Sapiens
ALKMLLTIS

SEQ ID NO: 1334928 - protein, 9 aa, Homo Sapiens
THSTFFLVN

SEQ ID NO: 1334929 - protein, 9 aa, Homo Sapiens
ADMLQRDGL

SEQ ID NO: 1334930 - protein, 9 aa, Homo Sapiens
KNRKKSDYS

SEQ ID NO: 1334931 - protein, 9 aa, Homo Sapiens
SELSVTERW

SEQ ID NO: 1334932 - protein, 9 aa, Homo Sapiens
IAYRDVMLE

SEQ ID NO: 1334933 - protein, 9 aa, Homo Sapiens
GNELQHCIR

SEQ ID NO: 1334934 - protein, 9 aa, Homo Sapiens
ALLHLYQEC

SEQ ID NO: 1334935 - protein, 9 aa, Homo Sapiens
LRDKVYLIR

SEQ ID NO: 1334936 - protein, 9 aa, Homo Sapiens
PVVGIPDNK

SEQ ID NO: 1334937 - protein, 9 aa, Homo Sapiens
GLAPRAETS

SEQ ID NO: 1334938 - protein, 9 aa, Homo Sapiens
NFCAFNLMF

SEQ ID NO: 1334939 - protein, 9 aa, Homo Sapiens
SSWSVDDLM

SEQ ID NO: 1334940 - protein, 9 aa, Homo Sapiens
AGYSRHRVH

SEQ ID NO: 1334941 - protein, 9 aa, Homo Sapiens
IAIVPQELV

SEQ ID NO: 1334942 - protein, 9 aa, Homo Sapiens
KRKQHRSRT

SEQ ID NO: 1334943 - protein, 9 aa, Homo Sapiens
MYPGERTCR

SEQ ID NO: 1334944 - protein, 9 aa, Homo Sapiens
EVLGCVVLM

SEQ ID NO: 1334945 - protein, 9 aa, Homo Sapiens
SFRIAKQIL

SEQ ID NO: 1334946 - protein, 9 aa, Homo Sapiens
TFTAHTAPA

SEQ ID NO: 1334947 - protein, 9 aa, Homo Sapiens
IVNNVKLVF

SEQ ID NO: 1334948 - protein, 9 aa, Homo Sapiens
VVCEFEGGH

SEQ ID NO: 1334949 - protein, 9 aa, Homo Sapiens
QWPYRVFAD

SEQ ID NO: 1334950 - protein, 9 aa, Homo Sapiens
GSSSDLSMV

SEQ ID NO: 1334951 - protein, 9 aa, Homo Sapiens
LYLYGVILL

SEQ ID NO: 1334952 - protein, 9 aa, Homo Sapiens
CCTADMNIT

SEQ ID NO: 1334953 - protein, 9 aa, Homo Sapiens
LKEICIKDE

SEQ ID NO: 1334954 - protein, 9 aa, Homo Sapiens
NSDNLRPVD

SEQ ID NO: 1334955 - protein, 9 aa, Homo Sapiens
KNKKQCMMV

SEQ ID NO: 1334956 - protein, 9 aa, Homo Sapiens
HQVDVVLHL

SEQ ID NO: 1334957 - protein, 9 aa, Homo Sapiens
TGQSKGFTF

SEQ ID NO: 1334958 - protein, 9 aa, Homo Sapiens
GEYIRVKLQ

SEQ ID NO: 1334959 - protein, 9 aa, Homo Sapiens
RPVASQLPH

SEQ ID NO: 1334960 - protein, 9 aa, Homo Sapiens
PDMIQQPRV

SEQ ID NO: 1334961 - protein, 9 aa, Homo Sapiens
HISSLDARE

SEQ ID NO: 1334962 - protein, 9 aa, Homo Sapiens
FWWERADMW

SEQ ID NO: 1334963 - protein, 9 aa, Homo Sapiens
DLAMGTRAT

SEQ ID NO: 1334964 - protein, 9 aa, Homo Sapiens
RSQGATCTG

SEQ ID NO: 1334965 - protein, 9 aa, Homo Sapiens
GNNKHIKRS

SEQ ID NO: 1334966 - protein, 9 aa, Homo Sapiens
VIYIINIHS

SEQ ID NO: 1334967 - protein, 9 aa, Homo Sapiens
MTFTQSSHL

SEQ ID NO: 1334968 - protein, 9 aa, Homo Sapiens
LTVSRWMTS

SEQ ID NO: 1334969 - protein, 9 aa, Homo Sapiens
LMLLTQKVT

SEQ ID NO: 1334970 - protein, 9 aa, Homo Sapiens
AAPARRPSA

SEQ ID NO: 1334971 - protein, 9 aa, Homo Sapiens
INPRTPPKI

SEQ ID NO: 1334972 - protein, 9 aa, Homo Sapiens
PTVPAEAPV

SEQ ID NO: 1334973 - protein, 9 aa, Homo Sapiens
PPHCPSPYS

SEQ ID NO: 1334974 - protein, 9 aa, Homo Sapiens
WLENGNMSR

SEQ ID NO: 1334975 - protein, 9 aa, Homo Sapiens
DFLDTYNKL

SEQ ID NO: 1334976 - protein, 9 aa, Homo Sapiens
PKDDHHLRG

SEQ ID NO: 1334977 - protein, 9 aa, Homo Sapiens
PTQVTLIMA

SEQ ID NO: 1334978 - protein, 9 aa, Homo Sapiens
RYMQKSSSL

SEQ ID NO: 1334979 - protein, 9 aa, Homo Sapiens
DCKKAQVQV

SEQ ID NO: 1334980 - protein, 9 aa, Homo Sapiens
RKYCKGNLK

SEQ ID NO: 1334981 - protein, 9 aa, Homo Sapiens
PEEQAGGPP

SEQ ID NO: 1334982 - protein, 9 aa, Homo Sapiens
ADQPNNRMS

SEQ ID NO: 1334983 - protein, 9 aa, Homo Sapiens
AYPCGTCDL

SEQ ID NO: 1334984 - protein, 9 aa, Homo Sapiens
GVECDRSKK

SEQ ID NO: 1334985 - protein, 9 aa, Homo Sapiens
QLQMKPCRL

SEQ ID NO: 1334986 - protein, 9 aa, Homo Sapiens
LGFPTSAIS

SEQ ID NO: 1334987 - protein, 9 aa, Homo Sapiens
FLQNMEMKS

SEQ ID NO: 1334988 - protein, 9 aa, Homo Sapiens
SHSSTLDSC

SEQ ID NO: 1334989 - protein, 9 aa, Homo Sapiens
LVRHCVCRE

SEQ ID NO: 1334990 - protein, 9 aa, Homo Sapiens
RADMWPHSD

SEQ ID NO: 1334991 - protein, 9 aa, Homo Sapiens
LEIESYDYT

SEQ ID NO: 1334992 - protein, 9 aa, Homo Sapiens
MIQQPRVPL

SEQ ID NO: 1334993 - protein, 9 aa, Homo Sapiens
RNFYHMPFG

SEQ ID NO: 1334994 - protein, 9 aa, Homo Sapiens
TVQAQPEWL

SEQ ID NO: 1334995 - protein, 9 aa, Homo Sapiens
SLDLKGVHL

SEQ ID NO: 1334996 - protein, 9 aa, Homo Sapiens
SVITVVAAH

SEQ ID NO: 1334997 - protein, 9 aa, Homo Sapiens
PCGRGPQPR

SEQ ID NO: 1334998 - protein, 9 aa, Homo Sapiens
RRKERRRRR

SEQ ID NO: 1334999 - protein, 9 aa, Homo Sapiens
SLSVPPRRV

SEQ ID NO: 1335000 - protein, 9 aa, Homo Sapiens
TPGRSRLSV

SEQ ID NO: 1335001 - protein, 9 aa, Homo Sapiens
GMKRWILPD

SEQ ID NO: 1335002 - protein, 9 aa, Homo Sapiens
IPAVRDIDA

SEQ ID NO: 1335003 - protein, 9 aa, Homo Sapiens
HRTESEWEN

SEQ ID NO: 1335004 - protein, 9 aa, Homo Sapiens
WLMIFSPVV

SEQ ID NO: 1335005 - protein, 9 aa, Homo Sapiens
WDEKTLRSF

SEQ ID NO: 1335006 - protein, 9 aa, Homo Sapiens
RWISGGGRG

SEQ ID NO: 1335007 - protein, 9 aa, Homo Sapiens
APKCDASFL

SEQ ID NO: 1335008 - protein, 9 aa, Homo Sapiens
QSISHPHSC

SEQ ID NO: 1335009 - protein, 9 aa, Homo Sapiens
VQMFLGLTM

SEQ ID NO: 1335010 - protein, 9 aa, Homo Sapiens
SHPQVQDLP

SEQ ID NO: 1335011 - protein, 9 aa, Homo Sapiens
TIGDDDFTL

SEQ ID NO: 1335012 - protein, 9 aa, Homo Sapiens
SDALEQLSE

SEQ ID NO: 1335013 - protein, 9 aa, Homo Sapiens
ELKIISLIF

SEQ ID NO: 1335014 - protein, 9 aa, Homo Sapiens
EDDGFCLFF

SEQ ID NO: 1335015 - protein, 9 aa, Homo Sapiens
RITIQEALR

SEQ ID NO: 1335016 - protein, 9 aa, Homo Sapiens
VHHQRVHTQ

SEQ ID NO: 1335017 - protein, 9 aa, Homo Sapiens
DKRCNKKQL

SEQ ID NO: 1335018 - protein, 9 aa, Homo Sapiens
RMHDENVDL

SEQ ID NO: 1335019 - protein, 9 aa, Homo Sapiens
VPGREFICL

SEQ ID NO: 1335020 - protein, 9 aa, Homo Sapiens
HCKAGKGQT

SEQ ID NO: 1335021 - protein, 9 aa, Homo Sapiens
GMEASVEKQ

SEQ ID NO: 1335022 - protein, 9 aa, Homo Sapiens
VGPKSNHGH

SEQ ID NO: 1335023 - protein, 9 aa, Homo Sapiens
FFPVTFGFL

SEQ ID NO: 1335024 - protein, 9 aa, Homo Sapiens
LPASQRSSA

SEQ ID NO: 1335025 - protein, 9 aa, Homo Sapiens
MWSPQNLHS

SEQ ID NO: 1335026 - protein, 9 aa, Homo Sapiens
PHSLDFTEL

SEQ ID NO: 1335027 - protein, 9 aa, Homo Sapiens
GSGRNFYHM

SEQ ID NO: 1335028 - protein, 9 aa, Homo Sapiens
LLQKPRVYE

SEQ ID NO: 1335029 - protein, 9 aa, Homo Sapiens
SQGLHYITV

SEQ ID NO: 1335030 - protein, 9 aa, Homo Sapiens
LWFNTDEDD

SEQ ID NO: 1335031 - protein, 9 aa, Homo Sapiens
CPPDVYAIM

SEQ ID NO: 1335032 - protein, 9 aa, Homo Sapiens
QQMMHWLKG

SEQ ID NO: 1335033 - protein, 9 aa, Homo Sapiens
CGHIISLKL

SEQ ID NO: 1335034 - protein, 9 aa, Homo Sapiens
LAELMIYIS

SEQ ID NO: 1335035 - protein, 9 aa, Homo Sapiens
AATADPTAL

SEQ ID NO: 1335036 - protein, 9 aa, Homo Sapiens
YLAAPRGVC

SEQ ID NO: 1335037 - protein, 9 aa, Homo Sapiens
EAANGDKAA

SEQ ID NO: 1335038 - protein, 9 aa, Homo Sapiens
YLLTNLEYH

SEQ ID NO: 1335039 - protein, 9 aa, Homo Sapiens
VTTLRVSVF

SEQ ID NO: 1335040 - protein, 9 aa, Homo Sapiens
CSAHTTCLA

SEQ ID NO: 1335041 - protein, 9 aa, Homo Sapiens
DEFLLKSIL

SEQ ID NO: 1335042 - protein, 9 aa, Homo Sapiens
QDPNRMPVR

SEQ ID NO: 1335043 - protein, 9 aa, Homo Sapiens
RNMHFLPDG

SEQ ID NO: 1335044 - protein, 9 aa, Homo Sapiens
LRSGPHRQL

SEQ ID NO: 1335045 - protein, 9 aa, Homo Sapiens
SIYFHTAQK

SEQ ID NO: 1335046 - protein, 9 aa, Homo Sapiens
CGQSVCENG

SEQ ID NO: 1335047 - protein, 9 aa, Homo Sapiens
NQFENETIK

SEQ ID NO: 1335048 - protein, 9 aa, Homo Sapiens
SSSAASAEG

SEQ ID NO: 1335049 - protein, 9 aa, Homo Sapiens
MWATLQVLY

SEQ ID NO: 1335050 - protein, 9 aa, Homo Sapiens
QRPHLTGQL

SEQ ID NO: 1335051 - protein, 9 aa, Homo Sapiens
KGRKVLWLL

SEQ ID NO: 1335052 - protein, 9 aa, Homo Sapiens
FVKFKYAHE

SEQ ID NO: 1335053 - protein, 9 aa, Homo Sapiens
IPLELMLLC

SEQ ID NO: 1335054 - protein, 9 aa, Homo Sapiens
AATTMYFPS

SEQ ID NO: 1335055 - protein, 9 aa, Homo Sapiens
SPLVKDIRQ

SEQ ID NO: 1335056 - protein, 9 aa, Homo Sapiens
PTFPGEKLP

SEQ ID NO: 1335057 - protein, 9 aa, Homo Sapiens
QQHQQMMHW

SEQ ID NO: 1335058 - protein, 9 aa, Homo Sapiens
DKCDDDDDN

SEQ ID NO: 1335059 - protein, 9 aa, Homo Sapiens
KEDPEDLQD

SEQ ID NO: 1335060 - protein, 9 aa, Homo Sapiens
HTYCVFKTV

SEQ ID NO: 1335061 - protein, 9 aa, Homo Sapiens
LCLLFRFYD

SEQ ID NO: 1335062 - protein, 9 aa, Homo Sapiens
HHPGFYAEW

SEQ ID NO: 1335063 - protein, 9 aa, Homo Sapiens
VLKRRAGDL

SEQ ID NO: 1335064 - protein, 9 aa, Homo Sapiens
AIRVLASNG

SEQ ID NO: 1335065 - protein, 9 aa, Homo Sapiens
LDQTLQVLS

SEQ ID NO: 1335066 - protein, 9 aa, Homo Sapiens
YLCNTQITM

SEQ ID NO: 1335067 - protein, 9 aa, Homo Sapiens
VHADYSGSS

SEQ ID NO: 1335068 - protein, 9 aa, Homo Sapiens
CTSKAYNNQ

SEQ ID NO: 1335069 - protein, 9 aa, Homo Sapiens
LFKYFEVQS

SEQ ID NO: 1335070 - protein, 9 aa, Homo Sapiens
EPLVPSDPF

SEQ ID NO: 1335071 - protein, 9 aa, Homo Sapiens
VCVGIADGH

SEQ ID NO: 1335072 - protein, 9 aa, Homo Sapiens
DTQAMGQQP

SEQ ID NO: 1335073 - protein, 9 aa, Homo Sapiens
GTYIASEHS

SEQ ID NO: 1335074 - protein, 9 aa, Homo Sapiens
DWFPGSPQA

SEQ ID NO: 1335075 - protein, 9 aa, Homo Sapiens
DFGDTQKTA

SEQ ID NO: 1335076 - protein, 9 aa, Homo Sapiens
QYFDLESYL

SEQ ID NO: 1335077 - protein, 9 aa, Homo Sapiens
CKLMRERKF

SEQ ID NO: 1335078 - protein, 9 aa, Homo Sapiens
YERDIWKAD

SEQ ID NO: 1335079 - protein, 9 aa, Homo Sapiens
QGMPVASKL

SEQ ID NO: 1335080 - protein, 9 aa, Homo Sapiens
INPQTALYT

SEQ ID NO: 1335081 - protein, 9 aa, Homo Sapiens
VTEVTLWMQ

SEQ ID NO: 1335082 - protein, 9 aa, Homo Sapiens
LRSLEMDSS

SEQ ID NO: 1335083 - protein, 9 aa, Homo Sapiens
QGDVEVMYP

SEQ ID NO: 1335084 - protein, 9 aa, Homo Sapiens
SSVVKCSTA

SEQ ID NO: 1335085 - protein, 9 aa, Homo Sapiens
LFYQGPGWE

SEQ ID NO: 1335086 - protein, 9 aa, Homo Sapiens
SLSSRAEVV

SEQ ID NO: 1335087 - protein, 9 aa, Homo Sapiens
YKMHDILNM

SEQ ID NO: 1335088 - protein, 9 aa, Homo Sapiens
MHPITRKDT

SEQ ID NO: 1335089 - protein, 9 aa, Homo Sapiens
CLQVIDLLP

SEQ ID NO: 1335090 - protein, 9 aa, Homo Sapiens
AAARCSACT

SEQ ID NO: 1335091 - protein, 9 aa, Homo Sapiens
CLCPSKRHR

SEQ ID NO: 1335092 - protein, 9 aa, Homo Sapiens
DFQGKSNFE

SEQ ID NO: 1335093 - protein, 9 aa, Homo Sapiens
QIWLCCITQ

SEQ ID NO: 1335094 - protein, 9 aa, Homo Sapiens
SFVIVIWGV

SEQ ID NO: 1335095 - protein, 9 aa, Homo Sapiens
EEPSQHDDI

SEQ ID NO: 1335096 - protein, 9 aa, Homo Sapiens
PHLLQGARR

SEQ ID NO: 1335097 - protein, 9 aa, Homo Sapiens
GHTIIFCET

SEQ ID NO: 1335098 - protein, 9 aa, Homo Sapiens
FTLPVPSFE

SEQ ID NO: 1335099 - protein, 9 aa, Homo Sapiens
ECRALCACW

SEQ ID NO: 1335100 - protein, 9 aa, Homo Sapiens
YSGEKKMLE

SEQ ID NO: 1335101 - protein, 9 aa, Homo Sapiens
VVIDAEYRH

SEQ ID NO: 1335102 - protein, 9 aa, Homo Sapiens
RYLEEEDTE

SEQ ID NO: 1335103 - protein, 9 aa, Homo Sapiens
LHVAVRLGH

SEQ ID NO: 1335104 - protein, 9 aa, Homo Sapiens
EAENTYLCQ

SEQ ID NO: 1335105 - protein, 9 aa, Homo Sapiens
NIKPSSHNG

SEQ ID NO: 1335106 - protein, 9 aa, Homo Sapiens
LLHGKTIEI

SEQ ID NO: 1335107 - protein, 9 aa, Homo Sapiens
QLHKTTWLR

SEQ ID NO: 1335108 - protein, 9 aa, Homo Sapiens
KETLKDINT

SEQ ID NO: 1335109 - protein, 9 aa, Homo Sapiens
HQQDINDTV

SEQ ID NO: 1335110 - protein, 9 aa, Homo Sapiens
NHPNTWGAS

SEQ ID NO: 1335111 - protein, 9 aa, Homo Sapiens
MSGCGSFAP

SEQ ID NO: 1335112 - protein, 9 aa, Homo Sapiens
YKGGYKHAT

SEQ ID NO: 1335113 - protein, 9 aa, Homo Sapiens
VLWIWRYQE

SEQ ID NO: 1335114 - protein, 9 aa, Homo Sapiens
FLTSMWRLS

SEQ ID NO: 1335115 - protein, 9 aa, Homo Sapiens
LCSVPWTVF

SEQ ID NO: 1335116 - protein, 9 aa, Homo Sapiens
MTSVTSCLA

SEQ ID NO: 1335117 - protein, 9 aa, Homo Sapiens
VDNNCSWFM

SEQ ID NO: 1335118 - protein, 9 aa, Homo Sapiens
LSSPSFTEL

SEQ ID NO: 1335119 - protein, 9 aa, Homo Sapiens
GNQEKAITT

SEQ ID NO: 1335120 - protein, 9 aa, Homo Sapiens
DNNCSWFMH

SEQ ID NO: 1335121 - protein, 9 aa, Homo Sapiens
QCYADFTLL

SEQ ID NO: 1335122 - protein, 9 aa, Homo Sapiens
TYCGQSVCE

SEQ ID NO: 1335123 - protein, 9 aa, Homo Sapiens
TFDKIFTNT

SEQ ID NO: 1335124 - protein, 9 aa, Homo Sapiens
LVRRSYQRR

SEQ ID NO: 1335125 - protein, 9 aa, Homo Sapiens
PLMLWPALD

SEQ ID NO: 1335126 - protein, 9 aa, Homo Sapiens
MSLPHPCQM

SEQ ID NO: 1335127 - protein, 9 aa, Homo Sapiens
YHQSTAVAG

SEQ ID NO: 1335128 - protein, 9 aa, Homo Sapiens
GERSKPKCQ

SEQ ID NO: 1335129 - protein, 9 aa, Homo Sapiens
TFDRTCTEA

SEQ ID NO: 1335130 - protein, 9 aa, Homo Sapiens
AAPAARPSP

SEQ ID NO: 1335131 - protein, 9 aa, Homo Sapiens
DLQRETVKH

SEQ ID NO: 1335132 - protein, 9 aa, Homo Sapiens
QHNLWKFCR

SEQ ID NO: 1335133 - protein, 9 aa, Homo Sapiens
QPWDPQMSG

SEQ ID NO: 1335134 - protein, 9 aa, Homo Sapiens
SSIPSVVRG

SEQ ID NO: 1335135 - protein, 9 aa, Homo Sapiens
WSMREANMA

SEQ ID NO: 1335136 - protein, 9 aa, Homo Sapiens
IDRTPESAL

SEQ ID NO: 1335137 - protein, 9 aa, Homo Sapiens
QSLLENGII

SEQ ID NO: 1335138 - protein, 9 aa, Homo Sapiens
QEPRGARPS

SEQ ID NO: 1335139 - protein, 9 aa, Homo Sapiens
PPLPNKPPL

SEQ ID NO: 1335140 - protein, 9 aa, Homo Sapiens
NTTNFLHWC

SEQ ID NO: 1335141 - protein, 9 aa, Homo Sapiens
ATHPCDLKD

SEQ ID NO: 1335142 - protein, 9 aa, Homo Sapiens
NDLQARIAT

SEQ ID NO: 1335143 - protein, 9 aa, Homo Sapiens
DINTSIKNK

SEQ ID NO: 1335144 - protein, 9 aa, Homo Sapiens
FIHHWRDRH

SEQ ID NO: 1335145 - protein, 9 aa, Homo Sapiens
QKINTMILD

SEQ ID NO: 1335146 - protein, 9 aa, Homo Sapiens
LVVGDQVID

SEQ ID NO: 1335147 - protein, 9 aa, Homo Sapiens
TQVIEDLVC

SEQ ID NO: 1335148 - protein, 9 aa, Homo Sapiens
YLALEDEGE

SEQ ID NO: 1335149 - protein, 9 aa, Homo Sapiens
KIAYRDVML

SEQ ID NO: 1335150 - protein, 9 aa, Homo Sapiens
ENLQEIYKA

SEQ ID NO: 1335151 - protein, 9 aa, Homo Sapiens
LNVAQEEYS

SEQ ID NO: 1335152 - protein, 9 aa, Homo Sapiens
ARACRLHCS

SEQ ID NO: 1335153 - protein, 9 aa, Homo Sapiens
VTRGETVVL

SEQ ID NO: 1335154 - protein, 9 aa, Homo Sapiens
LMSPRTGLL

SEQ ID NO: 1335155 - protein, 9 aa, Homo Sapiens
LNVLLRTAD

SEQ ID NO: 1335156 - protein, 9 aa, Homo Sapiens
AGTIIPPTS

SEQ ID NO: 1335157 - protein, 9 aa, Homo Sapiens
ETLKEVSLT

SEQ ID NO: 1335158 - protein, 9 aa, Homo Sapiens
CRLLKMVIL

SEQ ID NO: 1335159 - protein, 9 aa, Homo Sapiens
GSLFCYSTH

SEQ ID NO: 1335160 - protein, 9 aa, Homo Sapiens
QMVDGSMWS

SEQ ID NO: 1335161 - protein, 9 aa, Homo Sapiens
KPRPKCTCI

SEQ ID NO: 1335162 - protein, 9 aa, Homo Sapiens
QQNQYIHIS

SEQ ID NO: 1335163 - protein, 9 aa, Homo Sapiens
KQWDRALAV

SEQ ID NO: 1335164 - protein, 9 aa, Homo Sapiens
PTKARTPLP

SEQ ID NO: 1335165 - protein, 9 aa, Homo Sapiens
GRPSAATRP

SEQ ID NO: 1335166 - protein, 9 aa, Homo Sapiens
YEFPPDLTL

SEQ ID NO: 1335167 - protein, 9 aa, Homo Sapiens
GHQGHTIIF

SEQ ID NO: 1335168 - protein, 9 aa, Homo Sapiens
QMEWQRYLR

SEQ ID NO: 1335169 - protein, 9 aa, Homo Sapiens
ALPPDKKVK

SEQ ID NO: 1335170 - protein, 9 aa, Homo Sapiens
DSRAQRMSL

SEQ ID NO: 1335171 - protein, 9 aa, Homo Sapiens
FKAQGVTIK

SEQ ID NO: 1335172 - protein, 9 aa, Homo Sapiens
WPAEHSARY

SEQ ID NO: 1335173 - protein, 9 aa, Homo Sapiens
VDVWSVGFI

SEQ ID NO: 1335174 - protein, 9 aa, Homo Sapiens
RIRFSSRES

SEQ ID NO: 1335175 - protein, 9 aa, Homo Sapiens
KRTVCMPHQ

SEQ ID NO: 1335176 - protein, 9 aa, Homo Sapiens
LFVFEYVGK

SEQ ID NO: 1335177 - protein, 9 aa, Homo Sapiens
TVLSAESTP

SEQ ID NO: 1335178 - protein, 9 aa, Homo Sapiens
LNAQQVSQF

SEQ ID NO: 1335179 - protein, 9 aa, Homo Sapiens
KVPVNTDLF

SEQ ID NO: 1335180 - protein, 9 aa, Homo Sapiens
RMRCLHNET

SEQ ID NO: 1335181 - protein, 9 aa, Homo Sapiens
AEGKSLDSA

SEQ ID NO: 1335182 - protein, 9 aa, Homo Sapiens
SFTELQPID
